United States Patent 7,618,814 (MICRORNA-RELATED NUCLEIC ACIDS AND USES THEREOF) - sequence listing, part 13

SEQ ID NO: 483129 - RNA, 32 nt, Human
uaaaaggaaaccugcaaaugucuacauauaug

SEQ ID NO: 483130 - RNA, 25 nt, Human
uaaaaggaacaaagggauguucacu

SEQ ID NO: 483131 - RNA, 32 nt, Human
uaaaaggaagaacuacuuucaguaagaugguu

SEQ ID NO: 483132 - RNA, 32 nt, Human
uaaaaggaaggugaagugcgggagagaaacag

SEQ ID NO: 483133 - RNA, 32 nt, Human
uaaaaggaaucaggguauuuugcuggaaggau

SEQ ID NO: 483134 - RNA, 32 nt, Human
uaaaaggacaugcccacugaauucagguccuu

SEQ ID NO: 483135 - RNA, 23 nt, Human
uaaaaggaccagggaggaucaga

SEQ ID NO: 483136 - RNA, 32 nt, Human
uaaaaggagagcagggaaaggagccagugaga

SEQ ID NO: 483137 - RNA, 32 nt, Human
uaaaaggaggccgaggugggaggaucaccuga

SEQ ID NO: 483138 - RNA, 32 nt, Human
uaaaaggagucacauagagaaaccccaugaaa

SEQ ID NO: 483139 - RNA, 32 nt, Human
uaaaaggcaaaguguuucugaaggcaauuucu

SEQ ID NO: 483140 - RNA, 32 nt, Human
uaaaaggcacgcaagggugcggcugcacgcgg

SEQ ID NO: 483141 - RNA, 32 nt, Human
uaaaaggcccagagagaagagccccacucuca

SEQ ID NO: 483142 - RNA, 22 nt, Human
uaaaagggacaauguggccacu

SEQ ID NO: 483143 - RNA, 24 nt, Human
uaaaagggacaggaauugcucacu

SEQ ID NO: 483144 - RNA, 32 nt, Human
uaaaagggagagagggagggaggaaggaagga

SEQ ID NO: 483145 - RNA, 32 nt, Human
uaaaagggauccggggcugagggcaggggucg

SEQ ID NO: 483146 - RNA, 32 nt, Human
uaaaagggcuaggaauuucuuuuuccgggagc

SEQ ID NO: 483147 - RNA, 32 nt, Human
uaaaagggcuccgaacacuacauuagccuaca

SEQ ID NO: 483148 - RNA, 32 nt, Human
uaaaagggcuucuuccucuuuuacugggugau

SEQ ID NO: 483149 - RNA, 32 nt, Human
uaaaaggggagcuuccugggaauuucaggcuc

SEQ ID NO: 483150 - RNA, 32 nt, Human
uaaaagggugggaguagcaggagggucuuaaa

SEQ ID NO: 483151 - RNA, 32 nt, Human
uaaaagguagccucuucauaggaaccaggagg

SEQ ID NO: 483152 - RNA, 32 nt, Human
uaaaagguaggugggguggggaguggggcccc

SEQ ID NO: 483153 - RNA, 32 nt, Human
uaaaagguagugugacccaaauuuguauaaag

SEQ ID NO: 483154 - RNA, 32 nt, Human
uaaaaggucauguagagguuguaguagaaugg

SEQ ID NO: 483155 - RNA, 32 nt, Human
uaaaagguggaggacugauagacaacuuagag

SEQ ID NO: 483156 - RNA, 32 nt, Human
uaaaaggugggaaaggagagcacuguucuuug

SEQ ID NO: 483157 - RNA, 32 nt, Human
uaaaaguaaagaaacauacacuaucuuagccc

SEQ ID NO: 483158 - RNA, 32 nt, Human
uaaaaguacaugaggcugggcacaguggcuca

SEQ ID NO: 483159 - RNA, 32 nt, Human
uaaaaguagagggagguaagagacgguagcac

SEQ ID NO: 483160 - RNA, 32 nt, Human
uaaaagucaguagaaucuucuaccucauaacu

SEQ ID NO: 483161 - RNA, 32 nt, Human
uaaaagucucugaaguauuccaugccuuuugg

SEQ ID NO: 483162 - RNA, 32 nt, Human
uaaaagugaaagucaucuagcauucuuauuca

SEQ ID NO: 483163 - RNA, 32 nt, Human
uaaaagugagccacuaucagauuugcacauca

SEQ ID NO: 483164 - RNA, 32 nt, Human
uaaaagugcaauagaccaugcugguaacuaca

SEQ ID NO: 483165 - RNA, 32 nt, Human
uaaaagugcaauuacugucaaaagaguucaaa

SEQ ID NO: 483166 - RNA, 32 nt, Human
uaaaagugggcacagauccagagagguagcaa

SEQ ID NO: 483167 - RNA, 32 nt, Human
uaaaaguggggagaaggaagauccucagugaa

SEQ ID NO: 483168 - RNA, 32 nt, Human
uaaaagugucacucuuccuccuuuucuacuuu

SEQ ID NO: 483169 - RNA, 32 nt, Human
uaaaaguuaagaaggaaagaaggaaagcagga

SEQ ID NO: 483170 - RNA, 32 nt, Human
uaaaaguuaggggaacacaacugguaguguua

SEQ ID NO: 483171 - RNA, 32 nt, Human
uaaaaguucagaaaacuugcagccugacaaug

SEQ ID NO: 483172 - RNA, 32 nt, Human
uaaaaguuccaaugcuaagcccaauuccagac

SEQ ID NO: 483173 - RNA, 32 nt, Human
uaaaaguuccucucccuucccuucccucaccc

SEQ ID NO: 483174 - RNA, 32 nt, Human
uaaaaguucugugacaguacagaaggaaaaca

SEQ ID NO: 483175 - RNA, 32 nt, Human
uaaaaguugaugugugacaaaauacuuaugug

SEQ ID NO: 483176 - RNA, 32 nt, Human
uaaaaguugcagagauuggaggcugccccgag

SEQ ID NO: 483177 - RNA, 32 nt, Human
uaaaaguugcagcccacagcccuucaugugga

SEQ ID NO: 483178 - RNA, 32 nt, Human
uaaaaguuggaaaggcuggagccgugugugug

SEQ ID NO: 483179 - RNA, 20 nt, Human
uaaaaguuuaaauugcucac

SEQ ID NO: 483180 - RNA, 32 nt, Human
uaaaaguuuaacauaugggcauaugugacaua

SEQ ID NO: 483181 - RNA, 32 nt, Human
uaaaaguuucaucagaaacuuuacauaucuuu

SEQ ID NO: 483182 - RNA, 32 nt, Human
uaaaauaaagaaaagaggaggaggaggaggaa

SEQ ID NO: 483183 - RNA, 32 nt, Human
uaaaauaaagguaaaaugcugccugaaaauaa

SEQ ID NO: 483184 - RNA, 32 nt, Human
uaaaauaaauguaauuuaucuuugccaaaacc

SEQ ID NO: 483185 - RNA, 32 nt, Human
uaaaauaagacauacaguuuucuggccauucu

SEQ ID NO: 483186 - RNA, 32 nt, Human
uaaaauaagcacccaugaaagccagccagccc

SEQ ID NO: 483187 - RNA, 32 nt, Human
uaaaauaagcuugcaaaugacagcagagacau

SEQ ID NO: 483188 - RNA, 32 nt, Human
uaaaauaauaagcauuuaaaauaguuuacaga

SEQ ID NO: 483189 - RNA, 32 nt, Human
uaaaauaauagggagguuggggaaguggguug

SEQ ID NO: 483190 - RNA, 32 nt, Human
uaaaauaaucuugacuuaaauugucagaaugu

SEQ ID NO: 483191 - RNA, 32 nt, Human
uaaaauacaauugagauuccauuuuucuccua

SEQ ID NO: 483192 - RNA, 32 nt, Human
uaaaauacacacacaacugaucuagacaucaa

SEQ ID NO: 483193 - RNA, 32 nt, Human
uaaaauacacagaaaugguauaacaaucaugu

SEQ ID NO: 483194 - RNA, 32 nt, Human
uaaaauacacccaucaauauaaggcaagaaaa

SEQ ID NO: 483195 - RNA, 32 nt, Human
uaaaauacgcucuuaaauuauuuucuagucuu

SEQ ID NO: 483196 - RNA, 32 nt, Human
uaaaauagcauuagagcaaguugcuugucaug

SEQ ID NO: 483197 - RNA, 32 nt, Human
uaaaauagccaagagguauaucgaugauggaa

SEQ ID NO: 483198 - RNA, 30 nt, Human
uaaaauagccucucucugaucauucugucu

SEQ ID NO: 483199 - RNA, 32 nt, Human
uaaaauagggggaggaaggaaggggaguaaug

SEQ ID NO: 483200 - RNA, 32 nt, Human
uaaaauauagagacaggacagaauguguucuu

SEQ ID NO: 483201 - RNA, 32 nt, Human
uaaaauauauacacuuguacaaaaagggaaaa

SEQ ID NO: 483202 - RNA, 23 nt, Human
uaaaauauauauuaauucauuua

SEQ ID NO: 483203 - RNA, 32 nt, Human
uaaaauauauuugcuuugagaguaauucccca

SEQ ID NO: 483204 - RNA, 24 nt, Human
uaaaauauauuuuaauuacauuua

SEQ ID NO: 483205 - RNA, 31 nt, Human
uaaaauauauuuuaauuacauuuaaaaagac

SEQ ID NO: 483206 - RNA, 32 nt, Human
uaaaauauccgucccuuccaugccuuaguuua

SEQ ID NO: 483207 - RNA, 32 nt, Human
uaaaauauguaaucucuuaaauggcaguaaga

SEQ ID NO: 483208 - RNA, 27 nt, Human
uaaaauaugugcauucacuuguauuug

SEQ ID NO: 483209 - RNA, 32 nt, Human
uaaaauauuauuaccagugaacaucaggcacu

SEQ ID NO: 483210 - RNA, 32 nt, Human
uaaaauauugauuuuaauugaucuuuucaauu

SEQ ID NO: 483211 - RNA, 32 nt, Human
uaaaauauuuuaaucaggcagaguuuuaugga

SEQ ID NO: 483212 - RNA, 32 nt, Human
uaaaauauuuuuauuuucuuccuugucucaua

SEQ ID NO: 483213 - RNA, 32 nt, Human
uaaaaucaaaccugaauaaaacuacaaguuua

SEQ ID NO: 483214 - RNA, 32 nt, Human
uaaaaucaagacaggguacaagcaggagcaca

SEQ ID NO: 483215 - RNA, 32 nt, Human
uaaaaucaauagaucugggauuauguggccuu

SEQ ID NO: 483216 - RNA, 32 nt, Human
uaaaaucacaauauuguuuuuguuccuauuuu

SEQ ID NO: 483217 - RNA, 24 nt, Human
uaaaaucacaaugaaauaucacua

SEQ ID NO: 483218 - RNA, 32 nt, Human
uaaaaucacacagcgugauuuuacaagguccc

SEQ ID NO: 483219 - RNA, 32 nt, Human
uaaaaucaggacuccuaaccugcuccagucag

SEQ ID NO: 483220 - RNA, 32 nt, Human
uaaaaucaguccagcacuuuuagaacccacug

SEQ ID NO: 483221 - RNA, 32 nt, Human
uaaaaucagugugaacacccaacccauuacca

SEQ ID NO: 483222 - RNA, 30 nt, Human
uaaaaucauaaauauaaucuaauacacuuu

SEQ ID NO: 483223 - RNA, 32 nt, Human
uaaaaucauagaauguuguacugacgacacaa

SEQ ID NO: 483224 - RNA, 32 nt, Human
uaaaaucccugccuucuugagcuaacauucuc

SEQ ID NO: 483225 - RNA, 32 nt, Human
uaaaauccgcuagagcagcccaaauuuuucuc

SEQ ID NO: 483226 - RNA, 32 nt, Human
uaaaauccggaggugaaggaagaaaagauuga

SEQ ID NO: 483227 - RNA, 32 nt, Human
uaaaauccuuagaaucuccaaagugaugucuu

SEQ ID NO: 483228 - RNA, 20 nt, Human
uaaaaucgucugccugugua

SEQ ID NO: 483229 - RNA, 32 nt, Human
uaaaaucuacaaaucagcccucgaguuauuca

SEQ ID NO: 483230 - RNA, 32 nt, Human
uaaaaucuccaucucucagucaauccaagugu

SEQ ID NO: 483231 - RNA, 32 nt, Human
uaaaaucucccaggccuuuaggaugcaauagg

SEQ ID NO: 483232 - RNA, 32 nt, Human
uaaaaucucccuccccucuuuuauuuuaauua

SEQ ID NO: 483233 - RNA, 32 nt, Human
uaaaaucugauccccucucuacccuaccacuu

SEQ ID NO: 483234 - RNA, 26 nt, Human
uaaaaucugaugaugaauauaaaaaa

SEQ ID NO: 483235 - RNA, 32 nt, Human
uaaaaucuuaaaacuuacucagcugguugcaa

SEQ ID NO: 483236 - RNA, 23 nt, Human
uaaaaucuuaaagcagacaaaaa

SEQ ID NO: 483237 - RNA, 24 nt, Human
uaaaaucuuaaauaaaacagaaaa

SEQ ID NO: 483238 - RNA, 32 nt, Human
uaaaaucuuggccagagcuccuugccaucugc

SEQ ID NO: 483239 - RNA, 32 nt, Human
uaaaaucuuggggcuuagccugggcuuuucug

SEQ ID NO: 483240 - RNA, 32 nt, Human
uaaaaugaaaaaggagaauuucaagucagcag

SEQ ID NO: 483241 - RNA, 32 nt, Human
uaaaaugaaaaccaaaccagacaccugacaua

SEQ ID NO: 483242 - RNA, 32 nt, Human
uaaaaugaaagauuggcaaaggcccuugaggg

SEQ ID NO: 483243 - RNA, 32 nt, Human
uaaaaugaacaagccuguguucuugaucaugu

SEQ ID NO: 483244 - RNA, 32 nt, Human
uaaaaugaaucuaaacauugaaugugaauggc

SEQ ID NO: 483245 - RNA, 32 nt, Human
uaaaaugagugaaaucacagugcacccuguuc

SEQ ID NO: 483246 - RNA, 32 nt, Human
uaaaaugaguuacaagacacuuuuccagagua

SEQ ID NO: 483247 - RNA, 32 nt, Human
uaaaaugauaaauagguaauuugaauaauuuu

SEQ ID NO: 483248 - RNA, 24 nt, Human
uaaaaugauaugcuuauacauuug

SEQ ID NO: 483249 - RNA, 32 nt, Human
uaaaaugauggauucaacuucugccucggaug

SEQ ID NO: 483250 - RNA, 29 nt, Human
uaaaaugcacuucuuccugaaaauggaga

SEQ ID NO: 483251 - RNA, 32 nt, Human
uaaaaugccaucaguucaccuuuaaagacaca

SEQ ID NO: 483252 - RNA, 32 nt, Human
uaaaaugcccaggaguccuggaagcuacgcgg

SEQ ID NO: 483253 - RNA, 32 nt, Human
uaaaaugcccuaggcagccaggcuucccuggg

SEQ ID NO: 483254 - RNA, 32 nt, Human
uaaaaugcguccuugaaagaaaaagaaucuga

SEQ ID NO: 483255 - RNA, 32 nt, Human
uaaaaugcuaauuugagagaaguaggagugua

SEQ ID NO: 483256 - RNA, 32 nt, Human
uaaaaugcuguuauugugaugagucuuugguu

SEQ ID NO: 483257 - RNA, 30 nt, Human
uaaaauggaaagguccugcuguggaaacuu

SEQ ID NO: 483258 - RNA, 32 nt, Human
uaaaauggaagggagagcugggcauggcgguu

SEQ ID NO: 483259 - RNA, 32 nt, Human
uaaaauggaauauuauucagcaaucaaagaaa

SEQ ID NO: 483260 - RNA, 32 nt, Human
uaaaauggacaacugagaauucucccagcugc

SEQ ID NO: 483261 - RNA, 32 nt, Human
uaaaauggagagaagaaugaacuagaacauuc

SEQ ID NO: 483262 - RNA, 32 nt, Human
uaaaauggauaggacauaauuucccaacuagu

SEQ ID NO: 483263 - RNA, 32 nt, Human
uaaaauggauuuaaaaauuccuacucacagcc

SEQ ID NO: 483264 - RNA, 32 nt, Human
uaaaauggcagcuucaguucuagagaagaaag

SEQ ID NO: 483265 - RNA, 32 nt, Human
uaaaauggcaguguuucucccacuuugauaug

SEQ ID NO: 483266 - RNA, 32 nt, Human
uaaaauggcuguaaaaaugacuuaaauguuua

SEQ ID NO: 483267 - RNA, 32 nt, Human
uaaaaugggacugggugcaguggcucaggccu

SEQ ID NO: 483268 - RNA, 32 nt, Human
uaaaaugggcuuuccucugucugccauccuca

SEQ ID NO: 483269 - RNA, 32 nt, Human
uaaaauggucuaagggcucuuuuuccaacauu

SEQ ID NO: 483270 - RNA, 32 nt, Human
uaaaaugguucucagggauuccugccaauacu

SEQ ID NO: 483271 - RNA, 29 nt, Human
uaaaauguaccaagaaauaucuguacuuc

SEQ ID NO: 483272 - RNA, 32 nt, Human
uaaaauguauacaucaaauucucuccaaggac

SEQ ID NO: 483273 - RNA, 32 nt, Human
uaaaaugucaggaacaacuuuccucuuauuaa

SEQ ID NO: 483274 - RNA, 32 nt, Human
uaaaaugucaucugcuaaacauucacugugac

SEQ ID NO: 483275 - RNA, 32 nt, Human
uaaaaugucaucuguuaggaagccauucuaaa

SEQ ID NO: 483276 - RNA, 32 nt, Human
uaaaauguccccagaguggagaaguucaguuc

SEQ ID NO: 483277 - RNA, 32 nt, Human
uaaaaugucucaucuucucaugccaucuaguu

SEQ ID NO: 483278 - RNA, 32 nt, Human
uaaaaugucuucaaggcuucagucucauauuu

SEQ ID NO: 483279 - RNA, 32 nt, Human
uaaaaugugcugcccuucacagaugacaccac

SEQ ID NO: 483280 - RNA, 32 nt, Human
uaaaauguguaauuuuguuuauauuuucccau

SEQ ID NO: 483281 - RNA, 32 nt, Human
uaaaaugugucccuggcuucugagcuugccca

SEQ ID NO: 483282 - RNA, 32 nt, Human
uaaaauguuaucuccuaguugccaugcauucc

SEQ ID NO: 483283 - RNA, 32 nt, Human
uaaaauguuccuggucggggcuuggaagagcu

SEQ ID NO: 483284 - RNA, 32 nt, Human
uaaaauguucuagucauuuugagaaaucauau

SEQ ID NO: 483285 - RNA, 26 nt, Human
uaaaauguugccuuccccacuucuca

SEQ ID NO: 483286 - RNA, 32 nt, Human
uaaaauguuucauuugaaaagucugguuucuu

SEQ ID NO: 483287 - RNA, 32 nt, Human
uaaaauguuuugaauuuaacuuguuuagaaaa

SEQ ID NO: 483288 - RNA, 32 nt, Human
uaaaauguuuuuaaaaccuguuaguuaaaaca

SEQ ID NO: 483289 - RNA, 32 nt, Human
uaaaauguuuuuaagaauuuuucuuuuuauua

SEQ ID NO: 483290 - RNA, 32 nt, Human
uaaaauuaccagggcucucugaacauggaccu

SEQ ID NO: 483291 - RNA, 32 nt, Human
uaaaauuacugacugaugacauugagacaaga

SEQ ID NO: 483292 - RNA, 32 nt, Human
uaaaauuacugcuuuccaucuacuggguaaaa

SEQ ID NO: 483293 - RNA, 32 nt, Human
uaaaauuagaaauguccccucacugcagauca

SEQ ID NO: 483294 - RNA, 32 nt, Human
uaaaauuagggagaagagaggagucaugaucu

SEQ ID NO: 483295 - RNA, 32 nt, Human
uaaaauuagggaggccacagcagagguacaga

SEQ ID NO: 483296 - RNA, 32 nt, Human
uaaaauuauaguaacagaaauaauagcucaua

SEQ ID NO: 483297 - RNA, 32 nt, Human
uaaaauucaaaaacaaaauuagccgggcauga

SEQ ID NO: 483298 - RNA, 32 nt, Human
uaaaauucaaugccucuccauauuaaaaacuc

SEQ ID NO: 483299 - RNA, 32 nt, Human
uaaaauuccuauaacauaguauuuuacaguuu

SEQ ID NO: 483300 - RNA, 32 nt, Human
uaaaauuccugccucucccuaacacaggaguu

SEQ ID NO: 483301 - RNA, 32 nt, Human
uaaaauuccugcucugccacagcuccacucag

SEQ ID NO: 483302 - RNA, 31 nt, Human
uaaaauucuaggagagaaauaaagagucugu

SEQ ID NO: 483303 - RNA, 32 nt, Human
uaaaauucucauaagaagcaucuccccagcca

SEQ ID NO: 483304 - RNA, 32 nt, Human
uaaaauucuguugguuuuagaggucagauucc

SEQ ID NO: 483305 - RNA, 32 nt, Human
uaaaauucuucucaucccauuggaguuuuuaa

SEQ ID NO: 483306 - RNA, 32 nt, Human
uaaaauugaagagauuucaacauaucauuuuu

SEQ ID NO: 483307 - RNA, 32 nt, Human
uaaaauugauuguggugaugguuguauaacug

SEQ ID NO: 483308 - RNA, 32 nt, Human
uaaaauugcaacuggugcccuaacccaaaacu

SEQ ID NO: 483309 - RNA, 32 nt, Human
uaaaauugcccagucuucagcggagcaguuuu

SEQ ID NO: 483310 - RNA, 32 nt, Human
uaaaauugccccaccugcucuagauggaucuu

SEQ ID NO: 483311 - RNA, 32 nt, Human
uaaaauugcgguauaaagucucauuuccaaau

SEQ ID NO: 483312 - RNA, 32 nt, Human
uaaaauugcugcggaaugugugcaguaucuag

SEQ ID NO: 483313 - RNA, 32 nt, Human
uaaaauugcugugagcucgacagugccugaag

SEQ ID NO: 483314 - RNA, 32 nt, Human
uaaaauugcuucagcucggcucccucuucccc

SEQ ID NO: 483315 - RNA, 32 nt, Human
uaaaauuggaaccuaauucgagaggaaguaag

SEQ ID NO: 483316 - RNA, 32 nt, Human
uaaaauugggacauccauccucccagacagug

SEQ ID NO: 483317 - RNA, 32 nt, Human
uaaaauuguaucauugcuuucuuucuauauug

SEQ ID NO: 483318 - RNA, 32 nt, Human
uaaaauugucucaggcaggaagucagucuaua

SEQ ID NO: 483319 - RNA, 32 nt, Human
uaaaauugugugugcacguucauguacacaug

SEQ ID NO: 483320 - RNA, 32 nt, Human
uaaaauuguuggugggaagcacuuauaaggca

SEQ ID NO: 483321 - RNA, 32 nt, Human
uaaaauuuaaucacaggaaacuacuuauaucu

SEQ ID NO: 483322 - RNA, 32 nt, Human
uaaaauuuaauuuucuagcuggcuccaauuca

SEQ ID NO: 483323 - RNA, 20 nt, Human
uaaaauuuacaacagucuga

SEQ ID NO: 483324 - RNA, 32 nt, Human
uaaaauuuauaugauguaugcauauguguaca

SEQ ID NO: 483325 - RNA, 32 nt, Human
uaaaauuugcacacaaaacaucuuaggcacuu

SEQ ID NO: 483326 - RNA, 32 nt, Human
uaaaauuugcaguuuaacaagaugacuagggg

SEQ ID NO: 483327 - RNA, 32 nt, Human
uaaaauuuuauaucaccuccacaaacaaaacu

SEQ ID NO: 483328 - RNA, 32 nt, Human
uaaaauuuucacaccaccugcuuuucuauuca

SEQ ID NO: 483329 - RNA, 32 nt, Human
uaaaauuuuggaccugagacacuguggcuguc

SEQ ID NO: 483330 - RNA, 32 nt, Human
uaaacaaaaacuaaaacuaagaauucucaaaa

SEQ ID NO: 483331 - RNA, 32 nt, Human
uaaacaaaaagauauuaaauauacagaaguua

SEQ ID NO: 483332 - RNA, 32 nt, Human
uaaacaaaauaugggcaugcaugcuaaaggga

SEQ ID NO: 483333 - RNA, 32 nt, Human
uaaacaaaauugcugcaccaaugcacugagug

SEQ ID NO: 483334 - RNA, 32 nt, Human
uaaacaaacauacacuucuccuggcaagguua

SEQ ID NO: 483335 - RNA, 32 nt, Human
uaaacaaagcaaaacaccaaacuacaguuuua

SEQ ID NO: 483336 - RNA, 32 nt, Human
uaaacaaaggccaagaaagagagaagaugaga

SEQ ID NO: 483337 - RNA, 32 nt, Human
uaaacaaagggcacagaaugucagccucaggg

SEQ ID NO: 483338 - RNA, 31 nt, Human
uaaacaaauaaacaagaacacugcagacaug

SEQ ID NO: 483339 - RNA, 19 nt, Human
uaaacaaaugcagcuggaa

SEQ ID NO: 483340 - RNA, 32 nt, Human
uaaacaacacugcaauuugucuccuugcaccg

SEQ ID NO: 483341 - RNA, 32 nt, Human
uaaacaacagccaagagagcaggggugacgau

SEQ ID NO: 483342 - RNA, 32 nt, Human
uaaacaacagguuugcauucaugaagcuuuca

SEQ ID NO: 483343 - RNA, 32 nt, Human
uaaacaacaguuggaggaauccauggaaaaua

SEQ ID NO: 483344 - RNA, 32 nt, Human
uaaacaaccagcuguccccgcaguaagaagcc

SEQ ID NO: 483345 - RNA, 32 nt, Human
uaaacaacccauauuggggacccccugugacu

SEQ ID NO: 483346 - RNA, 32 nt, Human
uaaacaagagcagagaggccauuuggucaaag

SEQ ID NO: 483347 - RNA, 32 nt, Human
uaaacaagccuggaucugacagugccacaaug

SEQ ID NO: 483348 - RNA, 32 nt, Human
uaaacaaguccuggcaggacucacaggaacaa

SEQ ID NO: 483349 - RNA, 32 nt, Human
uaaacaauaauacuaucuuuuauagggguuug

SEQ ID NO: 483350 - RNA, 32 nt, Human
uaaacaauccaucccacagauccucaggcauu

SEQ ID NO: 483351 - RNA, 32 nt, Human
uaaacaaucucgcauuaaaaauucaaauguaa

SEQ ID NO: 483352 - RNA, 32 nt, Human
uaaacaaucucuuccucagccagcacagggaa

SEQ ID NO: 483353 - RNA, 32 nt, Human
uaaacaaugaaagcgaugaggggaccauuuac

SEQ ID NO: 483354 - RNA, 31 nt, Human
uaaacacaauggcuaucaacagcugcuaaua

SEQ ID NO: 483355 - RNA, 32 nt, Human
uaaacacacgugcacacaucguacacauguga

SEQ ID NO: 483356 - RNA, 32 nt, Human
uaaacacagaauguaagcuauaguuuaaucug

SEQ ID NO: 483357 - RNA, 32 nt, Human
uaaacacaugguguacacccacuguaacauua

SEQ ID NO: 483358 - RNA, 32 nt, Human
uaaacaccacaguauagaucuugugacugugu

SEQ ID NO: 483359 - RNA, 32 nt, Human
uaaacacccaagagaaauucuggaccuaguaa

SEQ ID NO: 483360 - RNA, 32 nt, Human
uaaacacccaggagaccaucagccucuccugg

SEQ ID NO: 483361 - RNA, 32 nt, Human
uaaacacccucaggcacccuaacccuguguau

SEQ ID NO: 483362 - RNA, 32 nt, Human
uaaacacgcccccaucucacacacaaacugag

SEQ ID NO: 483363 - RNA, 32 nt, Human
uaaacacgugacacaaacacacacaaaaggga

SEQ ID NO: 483364 - RNA, 32 nt, Human
uaaacacuaagcucacuuaggucacuuucuag

SEQ ID NO: 483365 - RNA, 32 nt, Human
uaaacacuggccuuggcggcugagggaggagg

SEQ ID NO: 483366 - RNA, 32 nt, Human
uaaacagaaagaaagaaagaaaaaggaaggaa

SEQ ID NO: 483367 - RNA, 32 nt, Human
uaaacagacagaaagacagacacagacacaga

SEQ ID NO: 483368 - RNA, 32 nt, Human
uaaacagaggagaaagggaaagaguacaaagc

SEQ ID NO: 483369 - RNA, 32 nt, Human
uaaacagauggucaaauuaaaaaugcuuuacu

SEQ ID NO: 483370 - RNA, 32 nt, Human
uaaacagauuuuuaaaaaucuccacccauuaa

SEQ ID NO: 483371 - RNA, 32 nt, Human
uaaacagcaaaaguucuuucucguggguaaau

SEQ ID NO: 483372 - RNA, 32 nt, Human
uaaacagcacuccccaccccacccucauuuuu

SEQ ID NO: 483373 - RNA, 32 nt, Human
uaaacagccaaaaugaagcagaaaaauagcuc

SEQ ID NO: 483374 - RNA, 32 nt, Human
uaaacagcccucaccggugaauaaacauaaga

SEQ ID NO: 483375 - RNA, 32 nt, Human
uaaacagcuccgcucuuucagggaaggauggu

SEQ ID NO: 483376 - RNA, 32 nt, Human
uaaacagcucggcuuguccuugucccaugugu

SEQ ID NO: 483377 - RNA, 32 nt, Human
uaaacaggaccacccuuuauucuuaaauuugu

SEQ ID NO: 483378 - RNA, 32 nt, Human
uaaacaguauuuuuagaucaccuucaaaaggg

SEQ ID NO: 483379 - RNA, 32 nt, Human
uaaacagucuuaacugaaacacucugauauua

SEQ ID NO: 483380 - RNA, 32 nt, Human
uaaacaguggggguuaugaaacccaccucaca

SEQ ID NO: 483381 - RNA, 32 nt, Human
uaaacaguuuucguaaagauggggucuggcua

SEQ ID NO: 483382 - RNA, 32 nt, Human
uaaacaguuuuguuuuguuuuacuugaggggg

SEQ ID NO: 483383 - RNA, 32 nt, Human
uaaacauacauauauacacauaugcaugugug

SEQ ID NO: 483384 - RNA, 32 nt, Human
uaaacauacucuuacuguucugucuuuaugaa

SEQ ID NO: 483385 - RNA, 32 nt, Human
uaaacauagacacacacauauacagcucucuc

SEQ ID NO: 483386 - RNA, 32 nt, Human
uaaacauaggagagaaguuuauaaagggcauu

SEQ ID NO: 483387 - RNA, 19 nt, Human
uaaacaucaaauacuuuca

SEQ ID NO: 483388 - RNA, 32 nt, Human
uaaacaucacacacugagaaucucuucauaau

SEQ ID NO: 483389 - RNA, 32 nt, Human
uaaacaucacacgccagagaagccacaguuac

SEQ ID NO: 483390 - RNA, 32 nt, Human
uaaacaucacauaguagacagccauuaaauua

SEQ ID NO: 483391 - RNA, 32 nt, Human
uaaacaucccaggucucauccuucaggaauuu

SEQ ID NO: 483392 - RNA, 32 nt, Human
uaaacauccuauaaugcacagggcaguacccc

SEQ ID NO: 483393 - RNA, 32 nt, Human
uaaacaucucccagugugcuauaguagaaaau

SEQ ID NO: 483394 - RNA, 31 nt, Human
uaaacaucucugccuuugccuguguguguuc

SEQ ID NO: 483395 - RNA, 32 nt, Human
uaaacaugaccacgaagaaugcuguucugauu

SEQ ID NO: 483396 - RNA, 32 nt, Human
uaaacaugcagggggugggagcagggucacaa

SEQ ID NO: 483397 - RNA, 32 nt, Human
uaaacaugccauaaugcacaggacuguccccu

SEQ ID NO: 483398 - RNA, 32 nt, Human
uaaacaugcugugugccacaggccaguguugu

SEQ ID NO: 483399 - RNA, 30 nt, Human
uaaacauggagacugaaccaaaggcaaguu

SEQ ID NO: 483400 - RNA, 32 nt, Human
uaaacauggccucucccuccccuaggcuacca

SEQ ID NO: 483401 - RNA, 32 nt, Human
uaaacaugggagaaaccuggaagaauauuugc

SEQ ID NO: 483402 - RNA, 32 nt, Human
uaaacaugggaggcggagguugcagugagccg

SEQ ID NO: 483403 - RNA, 18 nt, Human
uaaacauguauguacucc

SEQ ID NO: 483404 - RNA, 32 nt, Human
uaaacauuaaacaauacagcugccucaaaucu

SEQ ID NO: 483405 - RNA, 32 nt, Human
uaaacauuacugggugagcaaauuccuuaaua

SEQ ID NO: 483406 - RNA, 32 nt, Human
uaaacauuccaaaaccuccagacuuauugcaa

SEQ ID NO: 483407 - RNA, 32 nt, Human
uaaacauucucaaauguuugagauucaaguga

SEQ ID NO: 483408 - RNA, 32 nt, Human
uaaacauucucccagucccuggccccaccucu

SEQ ID NO: 483409 - RNA, 32 nt, Human
uaaaccaaagaauauuuguauuucaagcaguu

SEQ ID NO: 483410 - RNA, 32 nt, Human
uaaaccaaagcacauuuugaaugaguauggaa

SEQ ID NO: 483411 - RNA, 31 nt, Human
uaaaccaacaacaccuaauuggggaaagcau

SEQ ID NO: 483412 - RNA, 32 nt, Human
uaaaccaagaugagcagaaggaagagagcagg

SEQ ID NO: 483413 - RNA, 32 nt, Human
uaaaccaaggcacuccagccugggugacagag

SEQ ID NO: 483414 - RNA, 32 nt, Human
uaaaccacgagcguucaggguuugucuguuug

SEQ ID NO: 483415 - RNA, 32 nt, Human
uaaaccacuguacagguggcacuggacuuaga

SEQ ID NO: 483416 - RNA, 32 nt, Human
uaaaccagaaauacuuuugggcccaacacuug

SEQ ID NO: 483417 - RNA, 32 nt, Human
uaaaccagagucuauuacuucuguucuccaac

SEQ ID NO: 483418 - RNA, 32 nt, Human
uaaaccagcccccacccccacccuccaccugc

SEQ ID NO: 483419 - RNA, 32 nt, Human
uaaaccagccucccuuaacccuaccuucuucu

SEQ ID NO: 483420 - RNA, 32 nt, Human
uaaaccagccugggcaccauggugagacccca

SEQ ID NO: 483421 - RNA, 32 nt, Human
uaaaccagcugaugcugucaguguucaaguuu

SEQ ID NO: 483422 - RNA, 32 nt, Human
uaaaccagcugcaucuagcucuaaaccaccug

SEQ ID NO: 483423 - RNA, 32 nt, Human
uaaaccaggaaauggacucucacuggacacua

SEQ ID NO: 483424 - RNA, 32 nt, Human
uaaaccaggaaggcagagauugcagugagcug

SEQ ID NO: 483425 - RNA, 32 nt, Human
uaaaccagugugaaggaggagagagguggagg

SEQ ID NO: 483426 - RNA, 32 nt, Human
uaaaccaucccugaaaccuaaauucacguuuc

SEQ ID NO: 483427 - RNA, 32 nt, Human
uaaaccauuaguaauacaugcuguaauauaga

SEQ ID NO: 483428 - RNA, 32 nt, Human
uaaaccauucaugcccuuaaauagcuagauuu

SEQ ID NO: 483429 - RNA, 32 nt, Human
uaaaccauucuuacugcucucuuccaaaacaa

SEQ ID NO: 483430 - RNA, 32 nt, Human
uaaacccaacacuuugggaggcugaggcaggc

SEQ ID NO: 483431 - RNA, 32 nt, Human
uaaacccaagaaaugauccuggaauacaguac

SEQ ID NO: 483432 - RNA, 32 nt, Human
uaaacccacaggcuucuauacugacauauuuc

SEQ ID NO: 483433 - RNA, 32 nt, Human
uaaacccacugcuccaggcuugaaaggcagca

SEQ ID NO: 483434 - RNA, 32 nt, Human
uaaacccagcacuuugggaggcugaagcgggu

SEQ ID NO: 483435 - RNA, 32 nt, Human
uaaacccagcuacugaggaggcugaggcauga

SEQ ID NO: 483436 - RNA, 32 nt, Human
uaaacccagcuacuugggaggcugaggcagga

SEQ ID NO: 483437 - RNA, 32 nt, Human
uaaacccagcuauucaggaggcugagguggga

SEQ ID NO: 483438 - RNA, 32 nt, Human
uaaacccaggaggcaaaggcugcagugagcca

SEQ ID NO: 483439 - RNA, 32 nt, Human
uaaacccaggaggcagagguugcagugaguga

SEQ ID NO: 483440 - RNA, 32 nt, Human
uaaacccaggaggccgagcugacaaagugagc

SEQ ID NO: 483441 - RNA, 32 nt, Human
uaaacccaggaggcggagguugcagugagcug

SEQ ID NO: 483442 - RNA, 32 nt, Human
uaaacccaggaggcggagguugcagugaguug

SEQ ID NO: 483443 - RNA, 32 nt, Human
uaaacccaggaggcggugguuguaggaagcug

SEQ ID NO: 483444 - RNA, 32 nt, Human
uaaacccaggagguggagguugaaaugagcug

SEQ ID NO: 483445 - RNA, 32 nt, Human
uaaacccaggagguggagguugcagugagccg

SEQ ID NO: 483446 - RNA, 32 nt, Human
uaaacccaggagguggagguugcagugagcug

SEQ ID NO: 483447 - RNA, 32 nt, Human
uaaacccaggaguucaagaccagccuggguaa

SEQ ID NO: 483448 - RNA, 32 nt, Human
uaaacccaggcggcagagguugcagugagcca

SEQ ID NO: 483449 - RNA, 32 nt, Human
uaaacccagguggcggagguugcagugagccg

SEQ ID NO: 483450 - RNA, 32 nt, Human
uaaacccagugagaggugagggggagugauga

SEQ ID NO: 483451 - RNA, 32 nt, Human
uaaaccccagcaauugcacuccugggccucug

SEQ ID NO: 483452 - RNA, 32 nt, Human
uaaaccccauuauacuuccacugguuaucucc

SEQ ID NO: 483453 - RNA, 32 nt, Human
uaaaccccggagccaccaugccugcucccccg

SEQ ID NO: 483454 - RNA, 32 nt, Human
uaaaccccuuuccuuuucuguggcuuuuaauu

SEQ ID NO: 483455 - RNA, 32 nt, Human
uaaacccgggaggcagaggcugcagagagcca

SEQ ID NO: 483456 - RNA, 32 nt, Human
uaaacccgggaggcggagcuugcagugagcca

SEQ ID NO: 483457 - RNA, 32 nt, Human
uaaacccgggaggcggagguugcagugagccg

SEQ ID NO: 483458 - RNA, 32 nt, Human
uaaacccgggaggugaaggaugcagugagcca

SEQ ID NO: 483459 - RNA, 32 nt, Human
uaaacccgggagguggagcuugcagugagccg

SEQ ID NO: 483460 - RNA, 32 nt, Human
uaaacccucacaugaucauguaagcuaugcag

SEQ ID NO: 483461 - RNA, 32 nt, Human
uaaacccucacugacuuuuuagcaauaaagcu

SEQ ID NO: 483462 - RNA, 32 nt, Human
uaaacccucauggguggugucugagaggcgug

SEQ ID NO: 483463 - RNA, 32 nt, Human
uaaacccuggaggcagagguugcagugagcca

SEQ ID NO: 483464 - RNA, 32 nt, Human
uaaacccugggugcaagugcgggaucccucca

SEQ ID NO: 483465 - RNA, 32 nt, Human
uaaacccuuugucagaaugcaguuuccuagag

SEQ ID NO: 483466 - RNA, 32 nt, Human
uaaaccgaggaguggucacaucccagugcaug

SEQ ID NO: 483467 - RNA, 32 nt, Human
uaaaccggggaggcggggguugcaaugagcua

SEQ ID NO: 483468 - RNA, 32 nt, Human
uaaaccucagcccucuggccuccacuuuccuc

SEQ ID NO: 483469 - RNA, 32 nt, Human
uaaaccucaguuauuacauguaauuugaugag

SEQ ID NO: 483470 - RNA, 32 nt, Human
uaaaccucauguuucggaugaagaggaagaag

SEQ ID NO: 483471 - RNA, 21 nt, Human
uaaaccucucugaccugugua

SEQ ID NO: 483472 - RNA, 32 nt, Human
uaaaccucuucccauacaccuuucccccauaa

SEQ ID NO: 483473 - RNA, 32 nt, Human
uaaaccucuucccuuucuguguguuuuuauuu

SEQ ID NO: 483474 - RNA, 32 nt, Human
uaaaccugagaggcagagguuacagugagcca

SEQ ID NO: 483475 - RNA, 32 nt, Human
uaaaccugagagguggagguuacagugaguug

SEQ ID NO: 483476 - RNA, 32 nt, Human
uaaaccugagagguggagguugcaguugagcc

SEQ ID NO: 483477 - RNA, 32 nt, Human
uaaaccugagucguacagaaagcugccuggua

SEQ ID NO: 483478 - RNA, 32 nt, Human
uaaaccugcacugaaaccugagauggagcugc

SEQ ID NO: 483479 - RNA, 32 nt, Human
uaaaccugcucuuacuguccaggcucuggggu

SEQ ID NO: 483480 - RNA, 32 nt, Human
uaaaccuggacagggagagggaggguguuaga

SEQ ID NO: 483481 - RNA, 32 nt, Human
uaaaccugggagacggagguugcagugagcca

SEQ ID NO: 483482 - RNA, 32 nt, Human
uaaaccugggaggcggagaguacagugagcca

SEQ ID NO: 483483 - RNA, 32 nt, Human
uaaaccugggaggcggagcuugcagugagccg

SEQ ID NO: 483484 - RNA, 32 nt, Human
uaaaccugggagguggagguugcagugacccg

SEQ ID NO: 483485 - RNA, 32 nt, Human
uaaaccugggauguggagguugcagugaacug

SEQ ID NO: 483486 - RNA, 32 nt, Human
uaaaccuucacaaccuucaugauuucauagga

SEQ ID NO: 483487 - RNA, 32 nt, Human
uaaaccuucucccaucucuuucaaaaucuuuu

SEQ ID NO: 483488 - RNA, 32 nt, Human
uaaaccuuucaaaagacuuucuaaggaugaua

SEQ ID NO: 483489 - RNA, 32 nt, Human
uaaaccuuugguggcugggauaugauggguua

SEQ ID NO: 483490 - RNA, 32 nt, Human
uaaacgaaauacugcucuguccagaggcuuua

SEQ ID NO: 483491 - RNA, 32 nt, Human
uaaacgaagauaagcaaacuacaaaccaggaa

SEQ ID NO: 483492 - RNA, 32 nt, Human
uaaacgacugaccuuccuuaaaaacagaauga

SEQ ID NO: 483493 - RNA, 32 nt, Human
uaaacgagcucccuucuuugcacacauagcca

SEQ ID NO: 483494 - RNA, 32 nt, Human
uaaacgauccagagacaagacagcaccuagua

SEQ ID NO: 483495 - RNA, 32 nt, Human
uaaacgcacacaguaucuagucaggggaaaag

SEQ ID NO: 483496 - RNA, 32 nt, Human
uaaacgcaccaaucagcacccugucaaaacag

SEQ ID NO: 483497 - RNA, 32 nt, Human
uaaacgccagucuccacuccagccucaaaaga

SEQ ID NO: 483498 - RNA, 32 nt, Human
uaaacgccucagucucacccugcugcugcucc

SEQ ID NO: 483499 - RNA, 32 nt, Human
uaaacgcuaaaacauucgucccuugaagcgga

SEQ ID NO: 483500 - RNA, 32 nt, Human
uaaacggaaacugagaugaggaaccagccguc

SEQ ID NO: 483501 - RNA, 32 nt, Human
uaaacggggguucugaugcucucaccugaauu

SEQ ID NO: 483502 - RNA, 32 nt, Human
uaaacgguauuuaaaaugcaaucuaauuguga

SEQ ID NO: 483503 - RNA, 32 nt, Human
uaaacggugaaaugacaugcaaaggccauagu

SEQ ID NO: 483504 - RNA, 32 nt, Human
uaaacguccugggaagugggcccuucccuggg

SEQ ID NO: 483505 - RNA, 32 nt, Human
uaaacguugggucucacguuuguugccauuau

SEQ ID NO: 483506 - RNA, 32 nt, Human
uaaacguuguauuaaaaagaccccguguaaac

SEQ ID NO: 483507 - RNA, 32 nt, Human
uaaacuaaauuuagguuugcagaaaguauuaa

SEQ ID NO: 483508 - RNA, 32 nt, Human
uaaacuaaccacugcuuuccaggauggccugc

SEQ ID NO: 483509 - RNA, 32 nt, Human
uaaacuacaguagguaacuuuaaggauuucuu

SEQ ID NO: 483510 - RNA, 32 nt, Human
uaaacuacuaguuuuaaaaaccuguguuaaau

SEQ ID NO: 483511 - RNA, 32 nt, Human
uaaacuacugcaacccucacauccucaaaggg

SEQ ID NO: 483512 - RNA, 32 nt, Human
uaaacuagaaccaaugucuccaggcagauuag

SEQ ID NO: 483513 - RNA, 32 nt, Human
uaaacuagaagaggaagaagaagaggaaguag

SEQ ID NO: 483514 - RNA, 32 nt, Human
uaaacuagacuggcacaucguuacccuuaugc

SEQ ID NO: 483515 - RNA, 32 nt, Human
uaaacuagccuucucaaaaucccagcaauaua

SEQ ID NO: 483516 - RNA, 32 nt, Human
uaaacuaucugugguguguguggggaaugaag

SEQ ID NO: 483517 - RNA, 32 nt, Human
uaaacuauuagccuggcgugguagcgcacgcc

SEQ ID NO: 483518 - RNA, 32 nt, Human
uaaacuauuucuaucaauugggccacacucaa

SEQ ID NO: 483519 - RNA, 24 nt, Human
uaaacucaaaagucccugccccag

SEQ ID NO: 483520 - RNA, 32 nt, Human
uaaacucaggaagugucaggugauuuccuagg

SEQ ID NO: 483521 - RNA, 32 nt, Human
uaaacucaggcucccagaacugaagauggugg

SEQ ID NO: 483522 - RNA, 32 nt, Human
uaaacucagugguuugguuuuuauuauuaaua

SEQ ID NO: 483523 - RNA, 32 nt, Human
uaaacucaucucuuuucccuuuauucaagcug

SEQ ID NO: 483524 - RNA, 22 nt, Human
uaaacuccacaauucacaccaa

SEQ ID NO: 483525 - RNA, 32 nt, Human
uaaacuccacagguaucagagaggguguaacu

SEQ ID NO: 483526 - RNA, 32 nt, Human
uaaacuccccuucauauauacaucuauccuau

SEQ ID NO: 483527 - RNA, 22 nt, Human
uaaacuccuggccucaagugau

SEQ ID NO: 483528 - RNA, 22 nt, Human
uaaacuccugggcucaagugau

SEQ ID NO: 483529 - RNA, 32 nt, Human
uaaacucgggagguagagguugcagugagcca

SEQ ID NO: 483530 - RNA, 32 nt, Human
uaaacucucccagaguaagagcuguaucguga

SEQ ID NO: 483531 - RNA, 32 nt, Human
uaaacucuuccccucaucacccuuugguagga

SEQ ID NO: 483532 - RNA, 32 nt, Human
uaaacucuuucaugacccuugaucaucagauc

SEQ ID NO: 483533 - RNA, 32 nt, Human
uaaacucuuuccugccaccagaauugcagugg

SEQ ID NO: 483534 - RNA, 32 nt, Human
uaaacugaaaaaugugauuggcuuccucucgc

SEQ ID NO: 483535 - RNA, 32 nt, Human
uaaacugaaaccaggggaagcuugcuuaguuu

SEQ ID NO: 483536 - RNA, 32 nt, Human
uaaacugaacuuaugcuaggaaaccuuaagua

SEQ ID NO: 483537 - RNA, 32 nt, Human
uaaacugaagauuuccucuggaagcuaccaca

SEQ ID NO: 483538 - RNA, 32 nt, Human
uaaacugaccaacauggagaaaccccgucucu

SEQ ID NO: 483539 - RNA, 32 nt, Human
uaaacugagaaggauauuaaaauaaguggcuu

SEQ ID NO: 483540 - RNA, 31 nt, Human
uaaacugagcagagagaaagcugacaaagag

SEQ ID NO: 483541 - RNA, 32 nt, Human
uaaacugauuucacuccagacugguguggcca

SEQ ID NO: 483542 - RNA, 32 nt, Human
uaaacugccuauuugcuuaucgggguguauug

SEQ ID NO: 483543 - RNA, 32 nt, Human
uaaacugccugggaagaggacaccuccuuggg

SEQ ID NO: 483544 - RNA, 32 nt, Human
uaaacugcgucucggaugucugucuuuugucu

SEQ ID NO: 483545 - RNA, 32 nt, Human
uaaacugcucuucccuccccacagggaacaca

SEQ ID NO: 483546 - RNA, 32 nt, Human
uaaacugcugcuauuuggaaaccccuucuuua

SEQ ID NO: 483547 - RNA, 32 nt, Human
uaaacugcuuauaauaauccaggaguugcauu

SEQ ID NO: 483548 - RNA, 32 nt, Human
uaaacugcuuuagauauuacugcucaguguuu

SEQ ID NO: 483549 - RNA, 32 nt, Human
uaaacuggaaacacucugaacccugccaucuu

SEQ ID NO: 483550 - RNA, 32 nt, Human
uaaacuggagccaauagaaaagacaaaaauga

SEQ ID NO: 483551 - RNA, 32 nt, Human
uaaacuggcaaaaggaacuuggauugcaggaa

SEQ ID NO: 483552 - RNA, 32 nt, Human
uaaacugggaaacugcuguggucucuguugcu

SEQ ID NO: 483553 - RNA, 32 nt, Human
uaaacugggaaggcuuucaggcuaccuuuuuc

SEQ ID NO: 483554 - RNA, 32 nt, Human
uaaacugggggaggcagggcacagggagaugc

SEQ ID NO: 483555 - RNA, 32 nt, Human
uaaacuguccuggagugacaucaugucauguu

SEQ ID NO: 483556 - RNA, 32 nt, Human
uaaacuguggaagagugacugcuagucccuuu

SEQ ID NO: 483557 - RNA, 32 nt, Human
uaaacugugucacagacuucugaauguuuagg

SEQ ID NO: 483558 - RNA, 32 nt, Human
uaaacuguucucuucagcuacugaaguucugu

SEQ ID NO: 483559 - RNA, 29 nt, Human
uaaacuguucugugugggucuggggaggg

SEQ ID NO: 483560 - RNA, 32 nt, Human
uaaacuguugcagaacuaaaaggcucuguggc

SEQ ID NO: 483561 - RNA, 32 nt, Human
uaaacuguuucuuagcugcacuguuuauggaa

SEQ ID NO: 483562 - RNA, 32 nt, Human
uaaacuucagaagaaaauaacagcaaccuauu

SEQ ID NO: 483563 - RNA, 32 nt, Human
uaaacuucagccacaugauucuuucacucaaa

SEQ ID NO: 483564 - RNA, 32 nt, Human
uaaacuuccucugcauuuccagccugaacaga

SEQ ID NO: 483565 - RNA, 32 nt, Human
uaaacuuccuguuauuuaaucucccccacggu

SEQ ID NO: 483566 - RNA, 32 nt, Human
uaaacuucuaggauuuucuucuacuuucugag

SEQ ID NO: 483567 - RNA, 32 nt, Human
uaaacuucucucucccugcucuugcccaggga

SEQ ID NO: 483568 - RNA, 32 nt, Human
uaaacuucuuagcacuuagcacugccuaccuc

SEQ ID NO: 483569 - RNA, 32 nt, Human
uaaacuugaccaaacaaaaauuaacuguuuuu

SEQ ID NO: 483570 - RNA, 32 nt, Human
uaaacuugaggagagcuaucagguuugcauag

SEQ ID NO: 483571 - RNA, 32 nt, Human
uaaacuugcaaaaucacuaggaucuccauuuc

SEQ ID NO: 483572 - RNA, 32 nt, Human
uaaacuuggccaaagugugugccugaauuauu

SEQ ID NO: 483573 - RNA, 32 nt, Human
uaaacuugggacgcggagauugcaguaagcca

SEQ ID NO: 483574 - RNA, 32 nt, Human
uaaacuuguaaauccacacacaacucugagaa

SEQ ID NO: 483575 - RNA, 32 nt, Human
uaaacuugugguuccguggguugauauccaga

SEQ ID NO: 483576 - RNA, 32 nt, Human
uaaacuuuagccuuuuggcugguguugaaugu

SEQ ID NO: 483577 - RNA, 32 nt, Human
uaaacuuucacaccccagacgaugucuucaua

SEQ ID NO: 483578 - RNA, 32 nt, Human
uaaacuuugccaugaacuccugggcuuugggg

SEQ ID NO: 483579 - RNA, 22 nt, Human
uaaacuuuggaauguguuuaaa

SEQ ID NO: 483580 - RNA, 20 nt, Human
uaaacuuugugcaggcccuu

SEQ ID NO: 483581 - RNA, 32 nt, Human
uaaacuuuuugcugggaacacugcagagacaa

SEQ ID NO: 483582 - RNA, 32 nt, Human
uaaagaaaaagcuccugaauugcccaaaccaa

SEQ ID NO: 483583 - RNA, 32 nt, Human
uaaagaaaaaggauuuuucuucgaguuagcug

SEQ ID NO: 483584 - RNA, 32 nt, Human
uaaagaaaaaucaccauuuaggagacuccauu

SEQ ID NO: 483585 - RNA, 23 nt, Human
uaaagaaaacaaaacuggacaga

SEQ ID NO: 483586 - RNA, 32 nt, Human
uaaagaaaagaggaggaggaggaggaagaaag

SEQ ID NO: 483587 - RNA, 32 nt, Human
uaaagaaaagauaacuacuggccaggugcagu

SEQ ID NO: 483588 - RNA, 32 nt, Human
uaaagaaaaguugccgaagaugagacugccca

SEQ ID NO: 483589 - RNA, 32 nt, Human
uaaagaaacaaggaccaacagcuggagcagag

SEQ ID NO: 483590 - RNA, 32 nt, Human
uaaagaaacucaggcagauacaagagaacaca

SEQ ID NO: 483591 - RNA, 32 nt, Human
uaaagaaagauaauucuaaagcuaaccaaaga

SEQ ID NO: 483592 - RNA, 32 nt, Human
uaaagaaagauuagcugggacauggugacacg

SEQ ID NO: 483593 - RNA, 32 nt, Human
uaaagaaauccauucaccccaaaacuuguuuu

SEQ ID NO: 483594 - RNA, 22 nt, Human
uaaagaaaucuuccuggacaga

SEQ ID NO: 483595 - RNA, 26 nt, Human
uaaagaaaucuuuggaaauuaggaga

SEQ ID NO: 483596 - RNA, 32 nt, Human
uaaagaacaggauuccagaaugaucauuaaau

SEQ ID NO: 483597 - RNA, 32 nt, Human
uaaagaacccuuuaauaaugcaucaccccauc

SEQ ID NO: 483598 - RNA, 22 nt, Human
uaaagaacugaaaaggguucug

SEQ ID NO: 483599 - RNA, 32 nt, Human
uaaagaacuuaaacaaauuuacaggaaaacaa

SEQ ID NO: 483600 - RNA, 32 nt, Human
uaaagaacuugacucaacuacaggggccuggg

SEQ ID NO: 483601 - RNA, 32 nt, Human
uaaagaagaaaauugucuauuucagugucuuu

SEQ ID NO: 483602 - RNA, 32 nt, Human
uaaagaagacacacagccaacguucaugcauu

SEQ ID NO: 483603 - RNA, 32 nt, Human
uaaagaagacugacuagaugcaucuuucuuug

SEQ ID NO: 483604 - RNA, 32 nt, Human
uaaagaagagcguccaggugggacugggauaa

SEQ ID NO: 483605 - RNA, 32 nt, Human
uaaagaagaggagaaaaagaagaaaagauucu

SEQ ID NO: 483606 - RNA, 32 nt, Human
uaaagaagaggugagagcaaaaggaauaaggg

SEQ ID NO: 483607 - RNA, 32 nt, Human
uaaagaagaguuucuaggggcuacuguuuaug

SEQ ID NO: 483608 - RNA, 32 nt, Human
uaaagaagauuugcauucagcaguucauuaag

SEQ ID NO: 483609 - RNA, 32 nt, Human
uaaagaaggagaaggaagaggaagaaggaaaa

SEQ ID NO: 483610 - RNA, 32 nt, Human
uaaagaaggaugaguuuaugcccuuuguaggg

SEQ ID NO: 483611 - RNA, 32 nt, Human
uaaagaagguagcucagcgccacugagauugu

SEQ ID NO: 483612 - RNA, 32 nt, Human
uaaagaaguuguguuuucagaggugauuuuau

SEQ ID NO: 483613 - RNA, 32 nt, Human
uaaagaauccuuagauccuaaaaaucccuucc

SEQ ID NO: 483614 - RNA, 32 nt, Human
uaaagaaugccauggccgggugcaguggcuca

SEQ ID NO: 483615 - RNA, 32 nt, Human
uaaagaaugcccuuuaugaugcacugauucca

SEQ ID NO: 483616 - RNA, 22 nt, Human
uaaagaauggaagagugcccug

SEQ ID NO: 483617 - RNA, 22 nt, Human
uaaagaaugugagaaaguucug

SEQ ID NO: 483618 - RNA, 30 nt, Human
uaaagaauucucuccauguuuuuguaucgg

SEQ ID NO: 483619 - RNA, 21 nt, Human
uaaagaauuuuaacaguccug

SEQ ID NO: 483620 - RNA, 32 nt, Human
uaaagacaaaaauacaucaaggaguuaugcug

SEQ ID NO: 483621 - RNA, 32 nt, Human
uaaagacaaagacaaauucuguuucuugagaa

SEQ ID NO: 483622 - RNA, 32 nt, Human
uaaagacaaagucaaugguccuaggagagcug

SEQ ID NO: 483623 - RNA, 32 nt, Human
uaaagacaaauacuucacucuuuuucauacua

SEQ ID NO: 483624 - RNA, 32 nt, Human
uaaagacaauccuugcacaaggcuuccaacuc

SEQ ID NO: 483625 - RNA, 32 nt, Human
uaaagacacaugcacacauauguuuauuacgg

SEQ ID NO: 483626 - RNA, 32 nt, Human
uaaagacacaugcacacguauguuuauugcag

SEQ ID NO: 483627 - RNA, 32 nt, Human
uaaagacacaugcacauguauguuuauugcag

SEQ ID NO: 483628 - RNA, 32 nt, Human
uaaagacacaugcacgcguauguucguugcag

SEQ ID NO: 483629 - RNA, 32 nt, Human
uaaagacacaugcauacauauguuuauugcag

SEQ ID NO: 483630 - RNA, 32 nt, Human
uaaagacacaugcaugcaaauguccacugcag

SEQ ID NO: 483631 - RNA, 32 nt, Human
uaaagacacaugccacauauauguuccuugca

SEQ ID NO: 483632 - RNA, 32 nt, Human
uaaagacaggagacaaaagagcagugguaaga

SEQ ID NO: 483633 - RNA, 32 nt, Human
uaaagacagugaggcccaggccuaggggcacg

SEQ ID NO: 483634 - RNA, 32 nt, Human
uaaagacaugguuaaagacacuucggagauau

SEQ ID NO: 483635 - RNA, 32 nt, Human
uaaagaccaccaggagcacacuuguaauuaca

SEQ ID NO: 483636 - RNA, 32 nt, Human
uaaagaccacccuggccaacauggugaaaccc

SEQ ID NO: 483637 - RNA, 32 nt, Human
uaaagaccagccugauuauuuguauagccaca

SEQ ID NO: 483638 - RNA, 32 nt, Human
uaaagaccagccuggccaacaaggugaaaccc

SEQ ID NO: 483639 - RNA, 32 nt, Human
uaaagaccagccuggccaacauggcaaaaccc

SEQ ID NO: 483640 - RNA, 32 nt, Human
uaaagaccagccuggucaauauagcaagacca

SEQ ID NO: 483641 - RNA, 32 nt, Human
uaaagaccaguucuuuaagcuaagacauguaa

SEQ ID NO: 483642 - RNA, 32 nt, Human
uaaagacccacauucugcuuucuuacucaugg

SEQ ID NO: 483643 - RNA, 32 nt, Human
uaaagacccaggagaaauagguaucccaaaga

SEQ ID NO: 483644 - RNA, 32 nt, Human
uaaagaccuagaggugaggucucugagcaagg

SEQ ID NO: 483645 - RNA, 32 nt, Human
uaaagaccucauugacacaggccucauuuggg

SEQ ID NO: 483646 - RNA, 32 nt, Human
uaaagaccugcacuauuuuguagaaaaauagg

SEQ ID NO: 483647 - RNA, 32 nt, Human
uaaagacgcacugccaagggcuccgugugccc

SEQ ID NO: 483648 - RNA, 32 nt, Human
uaaagacggguuucaccauguuggccaggcug

SEQ ID NO: 483649 - RNA, 32 nt, Human
uaaagacgugagccacggcaccuggccugaau

SEQ ID NO: 483650 - RNA, 32 nt, Human
uaaagacuagagcuuuccuccuccaggauguu

SEQ ID NO: 483651 - RNA, 32 nt, Human
uaaagacucacagguccgccucccaggcucaa

SEQ ID NO: 483652 - RNA, 20 nt, Human
uaaagacuuugagaauggau

SEQ ID NO: 483653 - RNA, 32 nt, Human
uaaagagaaaaauacaaauuaccuguaauuca

SEQ ID NO: 483654 - RNA, 32 nt, Human
uaaagagaaaguauaugucauauguuugcaaa

SEQ ID NO: 483655 - RNA, 31 nt, Human
uaaagagaacaaugccaggcuugacuugcaa

SEQ ID NO: 483656 - RNA, 32 nt, Human
uaaagagacaguguuagggaucuuggaagcac

SEQ ID NO: 483657 - RNA, 32 nt, Human
uaaagagagaaggcucuugauuccuuaugcaa

SEQ ID NO: 483658 - RNA, 32 nt, Human
uaaagagagacaggaaauggcuguguuagugc

SEQ ID NO: 483659 - RNA, 32 nt, Human
uaaagagagaucaauuacccacccuuaaauag

SEQ ID NO: 483660 - RNA, 32 nt, Human
uaaagagaguggcugcuauugacauugccaag

SEQ ID NO: 483661 - RNA, 32 nt, Human
uaaagagaucagagaccuaaagugccagacca

SEQ ID NO: 483662 - RNA, 22 nt, Human
uaaagagauuucccuucauuua

SEQ ID NO: 483663 - RNA, 32 nt, Human
uaaagagcaaaacuagacuucuaugugagaag

SEQ ID NO: 483664 - RNA, 32 nt, Human
uaaagagcagaguagaaauggaagaggcuuug

SEQ ID NO: 483665 - RNA, 32 nt, Human
uaaagagcagaugcauggccauuuuucuuuga

SEQ ID NO: 483666 - RNA, 32 nt, Human
uaaagagcagccuggcuaacauggugaaaccc

SEQ ID NO: 483667 - RNA, 32 nt, Human
uaaagagcaguuucaugcugcugaacuugcaa

SEQ ID NO: 483668 - RNA, 32 nt, Human
uaaagagcauucucuaccauugcccagcugaa

SEQ ID NO: 483669 - RNA, 32 nt, Human
uaaagaggaaacagccugucucagcuguacuc

SEQ ID NO: 483670 - RNA, 32 nt, Human
uaaagaggcagaggcgcagcuguggugggcag

SEQ ID NO: 483671 - RNA, 32 nt, Human
uaaagagggacaggcugaagagagggacaggc

SEQ ID NO: 483672 - RNA, 32 nt, Human
uaaagagggcuggagucaggggacuucucuuc

SEQ ID NO: 483673 - RNA, 32 nt, Human
uaaagagggugguuccaacuucaucaauaccu

SEQ ID NO: 483674 - RNA, 32 nt, Human
uaaagagucuguucuggcuucugauuuucagu

SEQ ID NO: 483675 - RNA, 32 nt, Human
uaaagauacuauauacguuuuguauaucauua

SEQ ID NO: 483676 - RNA, 32 nt, Human
uaaagaucacuugguaguuagccacauugaga

SEQ ID NO: 483677 - RNA, 32 nt, Human
uaaagaucauaauuagcuguguuaacacagaa

SEQ ID NO: 483678 - RNA, 32 nt, Human
uaaagaucaucucuucagagcugcaugguaaa

SEQ ID NO: 483679 - RNA, 32 nt, Human
uaaagaucauuuaucagaggagguucagcauu

SEQ ID NO: 483680 - RNA, 32 nt, Human
uaaagauccaacaacaucuggauuuucucaga

SEQ ID NO: 483681 - RNA, 32 nt, Human
uaaagaucugagggacuccucaguccuggggc

SEQ ID NO: 483682 - RNA, 32 nt, Human
uaaagaugacgaagaaaagcccaagaucaaag

SEQ ID NO: 483683 - RNA, 32 nt, Human
uaaagaugcauugaaugcuuggaagaaugcuu

SEQ ID NO: 483684 - RNA, 32 nt, Human
uaaagaugcucaccuuguucagaagagaauaa

SEQ ID NO: 483685 - RNA, 32 nt, Human
uaaagaugcuccuggcuuaucuucugcauguc

SEQ ID NO: 483686 - RNA, 32 nt, Human
uaaagauggaaaggagaaagaagcaaccucug

SEQ ID NO: 483687 - RNA, 32 nt, Human
uaaagauggguaaacugaggcacagggagccg

SEQ ID NO: 483688 - RNA, 30 nt, Human
uaaagaugguggugaugaacagccugaggg

SEQ ID NO: 483689 - RNA, 32 nt, Human
uaaagaugucucauguacuuggaaaagugagc

SEQ ID NO: 483690 - RNA, 32 nt, Human
uaaagaugugggggaggaagcuuggguaaggu

SEQ ID NO: 483691 - RNA, 32 nt, Human
uaaagauguguuuagaaccucuuguuuaaaaa

SEQ ID NO: 483692 - RNA, 32 nt, Human
uaaagauguuaacaauccaucuguauuuaaaa

SEQ ID NO: 483693 - RNA, 32 nt, Human
uaaagauuacaguacacauacaacccauucac

SEQ ID NO: 483694 - RNA, 32 nt, Human
uaaagauuauuuguaguuuacuuuccaucuau

SEQ ID NO: 483695 - RNA, 22 nt, Human
uaaagauucaacuuguuuuuca

SEQ ID NO: 483696 - RNA, 32 nt, Human
uaaagauucauauuguauucccugcagcaacc

SEQ ID NO: 483697 - RNA, 32 nt, Human
uaaagauucauuucucucccacccucaacucc

SEQ ID NO: 483698 - RNA, 32 nt, Human
uaaagauugaauaauugaaggcacuaugcuug

SEQ ID NO: 483699 - RNA, 32 nt, Human
uaaagauugugccagugauagauguugugaga

SEQ ID NO: 483700 - RNA, 18 nt, Human
uaaagauuugucugugua

SEQ ID NO: 483701 - RNA, 32 nt, Human
uaaagauuuuuaucuuugccugucuacuguaa

SEQ ID NO: 483702 - RNA, 31 nt, Human
uaaagcaaauaguaagaauuuuuaaaacuau

SEQ ID NO: 483703 - RNA, 32 nt, Human
uaaagcaacagucacugucauaagaauaaacg

SEQ ID NO: 483704 - RNA, 32 nt, Human
uaaagcaauucauuuucucccacccucggccc

SEQ ID NO: 483705 - RNA, 32 nt, Human
uaaagcacaaauauacuugaauauugcuuaaa

SEQ ID NO: 483706 - RNA, 32 nt, Human
uaaagcacccuguaucacagacuggcaacaag

SEQ ID NO: 483707 - RNA, 32 nt, Human
uaaagcaccgucuuuugcuagaagaacaagag

SEQ ID NO: 483708 - RNA, 20 nt, Human
uaaagcacugggauuauuuc

SEQ ID NO: 483709 - RNA, 24 nt, Human
uaaagcacuguuugucacuuuuca

SEQ ID NO: 483710 - RNA, 24 nt, Human
uaaagcacuuuguacuguuauuca

SEQ ID NO: 483711 - RNA, 32 nt, Human
uaaagcagagcucuguaacaaaauaauacaca

SEQ ID NO: 483712 - RNA, 32 nt, Human
uaaagcagauggggaguuacggaguuguuccu

SEQ ID NO: 483713 - RNA, 32 nt, Human
uaaagcagauuggagcucugcaguaccacaga

SEQ ID NO: 483714 - RNA, 32 nt, Human
uaaagcagauuggagcucugcaguaccacagg

SEQ ID NO: 483715 - RNA, 32 nt, Human
uaaagcagcuuccaucaggaacauggagcagg

SEQ ID NO: 483716 - RNA, 32 nt, Human
uaaagcaggaccugccuuaacugcuccuggcc

SEQ ID NO: 483717 - RNA, 32 nt, Human
uaaagcagucacuuuuccugugcuguuucaaa

SEQ ID NO: 483718 - RNA, 32 nt, Human
uaaagcagucauggucccuaccaucuaggaac

SEQ ID NO: 483719 - RNA, 32 nt, Human
uaaagcagugaaggaagagaacagagacaaac

SEQ ID NO: 483720 - RNA, 32 nt, Human
uaaagcaucuggaaauaggaagacagagaagg

SEQ ID NO: 483721 - RNA, 32 nt, Human
uaaagcaugaauuuuaauaucuagucauuaaa

SEQ ID NO: 483722 - RNA, 32 nt, Human
uaaagcaugacuuucaaggaugguucuuaggg

SEQ ID NO: 483723 - RNA, 32 nt, Human
uaaagcauucugaguggaugugcacugcaugg

SEQ ID NO: 483724 - RNA, 32 nt, Human
uaaagcauuggugaaaucacauauuuuauauu

SEQ ID NO: 483725 - RNA, 32 nt, Human
uaaagcauuugaaugguacaguagauguaaaa

SEQ ID NO: 483726 - RNA, 18 nt, Human
uaaagccaauggcugugu

SEQ ID NO: 483727 - RNA, 20 nt, Human
uaaagccacaugugccugug

SEQ ID NO: 483728 - RNA, 22 nt, Human
uaaagccacauuucauugucuu

SEQ ID NO: 483729 - RNA, 32 nt, Human
uaaagccacccacaaacaaacuacccauuuuc

SEQ ID NO: 483730 - RNA, 16 nt, Human
uaaagccacuagugua

SEQ ID NO: 483731 - RNA, 32 nt, Human
uaaagccacugcacucaaacguggggaacaag

SEQ ID NO: 483732 - RNA, 32 nt, Human
uaaagccacuuuccucuucagauccuggucug

SEQ ID NO: 483733 - RNA, 32 nt, Human
uaaagccagcgaggcccugccugccagccggg

SEQ ID NO: 483734 - RNA, 32 nt, Human
uaaagccaggguggagcugggagaggcccuug

SEQ ID NO: 483735 - RNA, 32 nt, Human
uaaagccagguggcagggccuuggggagcccc

SEQ ID NO: 483736 - RNA, 22 nt, Human
uaaagccagucaucaucucuug

SEQ ID NO: 483737 - RNA, 32 nt, Human
uaaagccaguggaguacaggcugcaauauaaa

SEQ ID NO: 483738 - RNA, 19 nt, Human
uaaagccaguggcagugua

SEQ ID NO: 483739 - RNA, 18 nt, Human
uaaagccaguggguggua

SEQ ID NO: 483740 - RNA, 20 nt, Human
uaaagccauacuuuugugug

SEQ ID NO: 483741 - RNA, 18 nt, Human
uaaagccauagcuuuugu

SEQ ID NO: 483742 - RNA, 32 nt, Human
uaaagccauccagaacaccagcaccucacugc

SEQ ID NO: 483743 - RNA, 18 nt, Human
uaaagccaugacuuuugu

SEQ ID NO: 483744 - RNA, 17 nt, Human
uaaagccaugagccgug

SEQ ID NO: 483745 - RNA, 17 nt, Human
uaaagccaugguagugu

SEQ ID NO: 483746 - RNA, 32 nt, Human
uaaagccauuugaagaauaaagucauccagag

SEQ ID NO: 483747 - RNA, 32 nt, Human
uaaagccauuuggucuuaauucugaccaauaa

SEQ ID NO: 483748 - RNA, 19 nt, Human
uaaagccauuugucugugu

SEQ ID NO: 483749 - RNA, 32 nt, Human
uaaagcccaagaaauucagcugacaagacaga

SEQ ID NO: 483750 - RNA, 32 nt, Human
uaaagcccaaguguucuuuagcuuuuuauaau

SEQ ID NO: 483751 - RNA, 32 nt, Human
uaaagcccacacccucuacccuguuccucagc

SEQ ID NO: 483752 - RNA, 32 nt, Human
uaaagcccaggacugaauuggccaccugaggc

SEQ ID NO: 483753 - RNA, 32 nt, Human
uaaagcccauaagcugggucucaggcugggcu

SEQ ID NO: 483754 - RNA, 32 nt, Human
uaaagccccagagacgugcucagccccaggac

SEQ ID NO: 483755 - RNA, 32 nt, Human
uaaagccccaggcuggguuagguggucuagga

SEQ ID NO: 483756 - RNA, 32 nt, Human
uaaagccccucagagucaccucucauucauag

SEQ ID NO: 483757 - RNA, 32 nt, Human
uaaagccccuuccuccccagccccugcuuuca

SEQ ID NO: 483758 - RNA, 32 nt, Human
uaaagccgagacuugggaacgagcccugacgu

SEQ ID NO: 483759 - RNA, 32 nt, Human
uaaagccgcgugccucaaggggaggcuggacc

SEQ ID NO: 483760 - RNA, 17 nt, Human
uaaagccuagucugugu

SEQ ID NO: 483761 - RNA, 32 nt, Human
uaaagccucacaccuauggccaucugaucuuc

SEQ ID NO: 483762 - RNA, 32 nt, Human
uaaagccugaacccguucuucucugguucaag

SEQ ID NO: 483763 - RNA, 19 nt, Human
uaaagccugcagaacugug

SEQ ID NO: 483764 - RNA, 32 nt, Human
uaaagccugcagagguggaaauuggagcucau

SEQ ID NO: 483765 - RNA, 32 nt, Human
uaaagccuguaaucccagcacuuugggaggcc

SEQ ID NO: 483766 - RNA, 32 nt, Human
uaaagccuuugacccaggccuacugagucaaa

SEQ ID NO: 483767 - RNA, 32 nt, Human
uaaagcgacacuuuacucacagccuggcuuga

SEQ ID NO: 483768 - RNA, 32 nt, Human
uaaagcggaaauguaugugcucuuccugcaaa

SEQ ID NO: 483769 - RNA, 32 nt, Human
uaaagcgggggaggggaagaggggcugagaaa

SEQ ID NO: 483770 - RNA, 32 nt, Human
uaaagcguggccgccucccgcggcgcucggga

SEQ ID NO: 483771 - RNA, 32 nt, Human
uaaagcguuccaaauauccacuugcagacacu

SEQ ID NO: 483772 - RNA, 32 nt, Human
uaaagcuacaccucaauccauucuucugaagu

SEQ ID NO: 483773 - RNA, 32 nt, Human
uaaagcuagagacgggggaggcuuaccacuuu

SEQ ID NO: 483774 - RNA, 32 nt, Human
uaaagcucaaauacuguuuucuuucauucuuc

SEQ ID NO: 483775 - RNA, 19 nt, Human
uaaagcucagcucugugua

SEQ ID NO: 483776 - RNA, 32 nt, Human
uaaagcuccuucuaucuugugaugccaccauc

SEQ ID NO: 483777 - RNA, 32 nt, Human
uaaagcucuugcuauguugcuauaagacagua

SEQ ID NO: 483778 - RNA, 20 nt, Human
uaaagcugaaugaccugugu

SEQ ID NO: 483779 - RNA, 32 nt, Human
uaaagcugaccagccugcucuguacagugaca

SEQ ID NO: 483780 - RNA, 32 nt, Human
uaaagcugagauuacaggcaugcgccaccaca

SEQ ID NO: 483781 - RNA, 32 nt, Human
uaaagcugaggcaaugcucccuccucuaucuc

SEQ ID NO: 483782 - RNA, 32 nt, Human
uaaagcugaguauuuccuaauuguauagaauc

SEQ ID NO: 483783 - RNA, 32 nt, Human
uaaagcugaucuguaaacccuuaccccuugcu

SEQ ID NO: 483784 - RNA, 32 nt, Human
uaaagcugcugaccgaucucccuccuccucac

SEQ ID NO: 483785 - RNA, 32 nt, Human
uaaagcuggcaguggagucucugccucaccca

SEQ ID NO: 483786 - RNA, 32 nt, Human
uaaagcugggcaauguaaugaucagaucuuug

SEQ ID NO: 483787 - RNA, 32 nt, Human
uaaagcugguggcggggugcuuggggagggug

SEQ ID NO: 483788 - RNA, 32 nt, Human
uaaagcugguuuuucuugauuacuugagaagc

SEQ ID NO: 483789 - RNA, 32 nt, Human
uaaagcugugagccacugugccaaggcuuuuu

SEQ ID NO: 483790 - RNA, 32 nt, Human
uaaagcuguuucuguauguaacaacugcaacc

SEQ ID NO: 483791 - RNA, 32 nt, Human
uaaagcuguuugcuuuuucaggcuuuggauua

SEQ ID NO: 483792 - RNA, 32 nt, Human
uaaagcuucauuuugaucgccacagccccaga

SEQ ID NO: 483793 - RNA, 32 nt, Human
uaaagcuucuuguccauggcuuuuguuugaug

SEQ ID NO: 483794 - RNA, 22 nt, Human
uaaagcuugaaggcaccguggg

SEQ ID NO: 483795 - RNA, 29 nt, Human
uaaagcuuuacagccuucugcaaagaaaa

SEQ ID NO: 483796 - RNA, 32 nt, Human
uaaagcuuuacuauucuguccugggcuuauau

SEQ ID NO: 483797 - RNA, 32 nt, Human
uaaagcuuucugguuagauuguuuucacuugg

SEQ ID NO: 483798 - RNA, 32 nt, Human
uaaagcuuuguccucugugaagaauuauaaaa

SEQ ID NO: 483799 - RNA, 32 nt, Human
uaaaggaaaaauagcagagauguucaccuuuu

SEQ ID NO: 483800 - RNA, 32 nt, Human
uaaaggaaacacugcaacuuuccuuaacagcc

SEQ ID NO: 483801 - RNA, 32 nt, Human
uaaaggaaagagauguggcuuuugugauauuc

SEQ ID NO: 483802 - RNA, 32 nt, Human
uaaaggaaggucuucaaucagaaacaaaagga

SEQ ID NO: 483803 - RNA, 31 nt, Human
uaaaggacaggccacaccacagcagagacca

SEQ ID NO: 483804 - RNA, 32 nt, Human
uaaaggacauuuuccaggaucucagugugagu

SEQ ID NO: 483805 - RNA, 32 nt, Human
uaaaggacccagaccccggcacccucaacauc

SEQ ID NO: 483806 - RNA, 32 nt, Human
uaaaggacuggcugggaugagaagaguguugc

SEQ ID NO: 483807 - RNA, 32 nt, Human
uaaaggagcaggaaagggcgugaggcaggagg

SEQ ID NO: 483808 - RNA, 32 nt, Human
uaaaggagcccggcggaggcagcgguggguuu

SEQ ID NO: 483809 - RNA, 32 nt, Human
uaaaggagccuucucaucucuggccgagaaca

SEQ ID NO: 483810 - RNA, 32 nt, Human
uaaaggaggaagauggcggggugcaggggguc

SEQ ID NO: 483811 - RNA, 32 nt, Human
uaaaggaggaaggcugccagaacugaacuagc

SEQ ID NO: 483812 - RNA, 32 nt, Human
uaaaggaggagcacgaauauucccuggauuuc

SEQ ID NO: 483813 - RNA, 32 nt, Human
uaaaggaggcugagguugcagugagcugagau

SEQ ID NO: 483814 - RNA, 32 nt, Human
uaaaggaguucaaauacuauagcugucaguug

SEQ ID NO: 483815 - RNA, 32 nt, Human
uaaaggaguuggaggagagggagggggaggac

SEQ ID NO: 483816 - RNA, 32 nt, Human
uaaaggaucgaaccagcaaauccagaggcuuu

SEQ ID NO: 483817 - RNA, 32 nt, Human
uaaaggaugauaugaugaaccuagccuguuaa

SEQ ID NO: 483818 - RNA, 32 nt, Human
uaaaggauucugggagaugguccaaggguguu

SEQ ID NO: 483819 - RNA, 32 nt, Human
uaaaggcaaggaaauuaagaacugaauccaua

SEQ ID NO: 483820 - RNA, 32 nt, Human
uaaaggcacagaugaguaugugguguguguug

SEQ ID NO: 483821 - RNA, 32 nt, Human
uaaaggcacgugccaccaugacuggccaauuu

SEQ ID NO: 483822 - RNA, 32 nt, Human
uaaaggcacugaggucuucucaguuaccccaa

SEQ ID NO: 483823 - RNA, 32 nt, Human
uaaaggcacuggccagcagugugugacuuugg

SEQ ID NO: 483824 - RNA, 32 nt, Human
uaaaggcaggccucucucuucuugccuuuaaa

SEQ ID NO: 483825 - RNA, 32 nt, Human
uaaaggcauaccuuaaacaagcuccaccuucc

SEQ ID NO: 483826 - RNA, 32 nt, Human
uaaaggcaugagccaccgcacucagccacuua

SEQ ID NO: 483827 - RNA, 32 nt, Human
uaaaggccagcuuuggccaggcugccacaggg

SEQ ID NO: 483828 - RNA, 32 nt, Human
uaaaggcccaugcacacuauaggcacucaaua

SEQ ID NO: 483829 - RNA, 32 nt, Human
uaaaggccguggcugugcuguauuugauauaa

SEQ ID NO: 483830 - RNA, 32 nt, Human
uaaaggccuaaccaccucccugcagucucuua

SEQ ID NO: 483831 - RNA, 32 nt, Human
uaaaggccuaucucugggucauaaauccugca

SEQ ID NO: 483832 - RNA, 32 nt, Human
uaaaggccucuggauacugggcuccccagaac

SEQ ID NO: 483833 - RNA, 32 nt, Human
uaaaggccugggagcuagacccuccccaagcc

SEQ ID NO: 483834 - RNA, 32 nt, Human
uaaaggcgugagccaccaugcccagccuccua

SEQ ID NO: 483835 - RNA, 32 nt, Human
uaaaggcgugagccaccguaccuugcccuugg

SEQ ID NO: 483836 - RNA, 32 nt, Human
uaaaggcgugagccaccgugcccagccuaauu

SEQ ID NO: 483837 - RNA, 32 nt, Human
uaaaggcguuuuccccacccugccucaguguu

SEQ ID NO: 483838 - RNA, 32 nt, Human
uaaaggcugccucuucucccugugguuugauu

SEQ ID NO: 483839 - RNA, 32 nt, Human
uaaaggcugccucuucucccugugguuugguu

SEQ ID NO: 483840 - RNA, 32 nt, Human
uaaaggcuuccucugggugccugcugaacaac

SEQ ID NO: 483841 - RNA, 32 nt, Human
uaaagggaaaggagaauuaaggaaauaauagg

SEQ ID NO: 483842 - RNA, 32 nt, Human
uaaagggaaagggaagucguggagaggcaggg

SEQ ID NO: 483843 - RNA, 32 nt, Human
uaaagggaagcuggaagagaagaaaccugcug

SEQ ID NO: 483844 - RNA, 32 nt, Human
uaaagggaggaaacuccucacagccuuuuuau

SEQ ID NO: 483845 - RNA, 32 nt, Human
uaaagggagucucucaccagcccaggcccuca

SEQ ID NO: 483846 - RNA, 32 nt, Human
uaaagggauacuuggaacaacuuuaugccaau

SEQ ID NO: 483847 - RNA, 32 nt, Human
uaaagggauucaggaagacgacguauggcucu

SEQ ID NO: 483848 - RNA, 32 nt, Human
uaaagggcaaggaggugggggccgcaggguug

SEQ ID NO: 483849 - RNA, 32 nt, Human
uaaagggcaguggcaugaucucggcucacugc

SEQ ID NO: 483850 - RNA, 32 nt, Human
uaaagggcccuccacugccaccucucauggga

SEQ ID NO: 483851 - RNA, 32 nt, Human
uaaaggggacaugccgggaguugcaguacccu

SEQ ID NO: 483852 - RNA, 32 nt, Human
uaaagggggaaugagggaguauggagggguau

SEQ ID NO: 483853 - RNA, 32 nt, Human
uaaaggggugagccaccgcacccaguccugag

SEQ ID NO: 483854 - RNA, 32 nt, Human
uaaaggguauuagggggcuugggggcuggggg

SEQ ID NO: 483855 - RNA, 32 nt, Human
uaaagggucgaaucucucugaagaacugccac

SEQ ID NO: 483856 - RNA, 32 nt, Human
uaaagggugcagugcagccacugagggacagc

SEQ ID NO: 483857 - RNA, 32 nt, Human
uaaaggguuaauagccagauaguagaaccagu

SEQ ID NO: 483858 - RNA, 32 nt, Human
uaaagguagccuugaggccagagcagguagca

SEQ ID NO: 483859 - RNA, 32 nt, Human
uaaaggucaaguggucaaguucuguuuucuuu

SEQ ID NO: 483860 - RNA, 32 nt, Human
uaaaggucacugggagcguuucugauucccgg

SEQ ID NO: 483861 - RNA, 32 nt, Human
uaaagguccaacaaugaaacagaacagauaua

SEQ ID NO: 483862 - RNA, 32 nt, Human
uaaaggucucuuuacaccagagcuaagaucac

SEQ ID NO: 483863 - RNA, 32 nt, Human
uaaaggucuuaauaacaagaacagugacuucg

SEQ ID NO: 483864 - RNA, 32 nt, Human
uaaaggugauucuuggguuugaagacauuugu

SEQ ID NO: 483865 - RNA, 32 nt, Human
uaaaggugcaauuacugucaaaagaguucaga

SEQ ID NO: 483866 - RNA, 32 nt, Human
uaaaggugcacgccgccaugcccagcuaauuu

SEQ ID NO: 483867 - RNA, 32 nt, Human
uaaaggugcgugccaccaugcccggcuaauuu

SEQ ID NO: 483868 - RNA, 32 nt, Human
uaaagguggagugagucaaaccucagcccagg

SEQ ID NO: 483869 - RNA, 32 nt, Human
uaaagguguagaagggagagaaguugggacac

SEQ ID NO: 483870 - RNA, 32 nt, Human
uaaaggugugagccaccaugccuggcccuaug

SEQ ID NO: 483871 - RNA, 32 nt, Human
uaaagguguucuauggcaacagugaugacauu

SEQ ID NO: 483872 - RNA, 32 nt, Human
uaaagguguucuguggcaacagugaugacauu

SEQ ID NO: 483873 - RNA, 32 nt, Human
uaaagguuggaaagaugacuguugcuggcagu

SEQ ID NO: 483874 - RNA, 32 nt, Human
uaaagguuucaacgucuugcucuaauaaauca

SEQ ID NO: 483875 - RNA, 32 nt, Human
uaaaguaaaauauuaacuuuuccucuuugaaa

SEQ ID NO: 483876 - RNA, 24 nt, Human
uaaaguaacuauacauguuuuuua

SEQ ID NO: 483877 - RNA, 32 nt, Human
uaaaguaauuuuccuuuugcaggauggcauag

SEQ ID NO: 483878 - RNA, 30 nt, Human
uaaaguagccucugcaucugccugccucgg

SEQ ID NO: 483879 - RNA, 32 nt, Human
uaaaguaggaacuguugugugagcgagacaug

SEQ ID NO: 483880 - RNA, 32 nt, Human
uaaaguaggagagauugguuggaaggcuuuua

SEQ ID NO: 483881 - RNA, 32 nt, Human
uaaaguaguacuuugaaucauaguaugaaaug

SEQ ID NO: 483882 - RNA, 32 nt, Human
uaaaguaugagugaaaaagagacugaaggucu

SEQ ID NO: 483883 - RNA, 24 nt, Human
uaaaguauguauuauuuacauuua

SEQ ID NO: 483884 - RNA, 32 nt, Human
uaaaguauuaaaugcacuaucugcuguaaacg

SEQ ID NO: 483885 - RNA, 32 nt, Human
uaaagucaaagaaugauggcagguaggaugaa

SEQ ID NO: 483886 - RNA, 32 nt, Human
uaaagucacagcaaacggcagaacuaacaaua

SEQ ID NO: 483887 - RNA, 31 nt, Human
uaaagucacagcuggccuguaggcucccagu

SEQ ID NO: 483888 - RNA, 32 nt, Human
uaaagucacccagcaggucaacaaugggccca

SEQ ID NO: 483889 - RNA, 32 nt, Human
uaaagucagcacagcuuuucuuguguccugua

SEQ ID NO: 483890 - RNA, 32 nt, Human
uaaagucagcauaagccaucaugugggcuuuc

SEQ ID NO: 483891 - RNA, 32 nt, Human
uaaagucagcuauuagauaugagaaaaccauu

SEQ ID NO: 483892 - RNA, 32 nt, Human
uaaagucaggcagggcuggagugagcagccag

SEQ ID NO: 483893 - RNA, 32 nt, Human
uaaaguccaguauuugaggauauaaagaggau

SEQ ID NO: 483894 - RNA, 32 nt, Human
uaaagucccaggauuggcuccaggcagcaauu

SEQ ID NO: 483895 - RNA, 32 nt, Human
uaaagucccuguaccccgucucccagggcaca

SEQ ID NO: 483896 - RNA, 32 nt, Human
uaaagucccuuuccuugcuccaacuccuuguc

SEQ ID NO: 483897 - RNA, 32 nt, Human
uaaaguccuccaccaccacucuggaccuaaga

SEQ ID NO: 483898 - RNA, 32 nt, Human
uaaaguccuccagggccucugaggaugggggc

SEQ ID NO: 483899 - RNA, 32 nt, Human
uaaaguccucuaagaugucauaacuuucuguu

SEQ ID NO: 483900 - RNA, 32 nt, Human
uaaagucuagggaaaagggaagacugguuaau

SEQ ID NO: 483901 - RNA, 31 nt, Human
uaaagucuagugaccuuaaacugaaugauuu

SEQ ID NO: 483902 - RNA, 32 nt, Human
uaaagucucuccugaaaauguuggcauaguaa

SEQ ID NO: 483903 - RNA, 32 nt, Human
uaaagucuggguggguggagggcaggcaggug

SEQ ID NO: 483904 - RNA, 32 nt, Human
uaaagucuuauaucccccucugugccuuuucu

SEQ ID NO: 483905 - RNA, 32 nt, Human
uaaagucuuuaagaugcauccauguuuccagu

SEQ ID NO: 483906 - RNA, 32 nt, Human
uaaagugaagaaaggggguggggaaccauauu

SEQ ID NO: 483907 - RNA, 32 nt, Human
uaaagugaagaacaaggcuggccacacaccac

SEQ ID NO: 483908 - RNA, 32 nt, Human
uaaagugaagugaggaggugcugaggcugcca

SEQ ID NO: 483909 - RNA, 32 nt, Human
uaaagugaccgcauauuucccuagccaggaga

SEQ ID NO: 483910 - RNA, 32 nt, Human
uaaagugacucuggggugcuuacuuuagucaa

SEQ ID NO: 483911 - RNA, 32 nt, Human
uaaagugacuucauuuguauacauuuggaauc

SEQ ID NO: 483912 - RNA, 32 nt, Human
uaaagugagcccagaggccacugagaaugcag

SEQ ID NO: 483913 - RNA, 32 nt, Human
uaaagugaggaguucaagaccagccugagcag

SEQ ID NO: 483914 - RNA, 32 nt, Human
uaaagugaugggcuuugcaaauccaggguaga

SEQ ID NO: 483915 - RNA, 32 nt, Human
uaaagugauuccuucuugcucagucccucugg

SEQ ID NO: 483916 - RNA, 32 nt, Human
uaaagugcaaacauuucgucccaaagucuaag

SEQ ID NO: 483917 - RNA, 32 nt, Human
uaaagugcaagcacuuuuccauuuuacaguau

SEQ ID NO: 483918 - RNA, 31 nt, Human
uaaagugcacuuugcagacguuucacuccuu

SEQ ID NO: 483919 - RNA, 32 nt, Human
uaaagugcagagccugggacccagugagacgg

SEQ ID NO: 483920 - RNA, 32 nt, Human
uaaagugcuucugcuuuuccaugaacuccucc

SEQ ID NO: 483921 - RNA, 32 nt, Human
uaaagugcuugaggcuaccucuaccuucaaau

SEQ ID NO: 483922 - RNA, 32 nt, Human
uaaagugcuuuagguaugaaaauaaaucaucu

SEQ ID NO: 483923 - RNA, 32 nt, Human
uaaaguggaccacacaccacaucugcugccgu

SEQ ID NO: 483924 - RNA, 32 nt, Human
uaaaguggaccaugcaggcugcagaggguggg

SEQ ID NO: 483925 - RNA, 32 nt, Human
uaaaguggcucuuggggaaaagcaauuuaaug

SEQ ID NO: 483926 - RNA, 32 nt, Human
uaaaguggcugaagaggcaggauggcuugggg

SEQ ID NO: 483927 - RNA, 32 nt, Human
uaaaguggcugguaacaacagcacuuuacagu

SEQ ID NO: 483928 - RNA, 32 nt, Human
uaaagugggaggcuucacuaaaugagggggua

SEQ ID NO: 483929 - RNA, 32 nt, Human
uaaaguggggacaacacgaugagagaccccag

SEQ ID NO: 483930 - RNA, 32 nt, Human
uaaagugggguuucuuccauauugacaaauga

SEQ ID NO: 483931 - RNA, 22 nt, Human
uaaaguggguuuucccuggagg

SEQ ID NO: 483932 - RNA, 32 nt, Human
uaaaguguagaccauaugaaaugaacugcaaa

SEQ ID NO: 483933 - RNA, 32 nt, Human
uaaagugucacccacagccauuaaguaugcag

SEQ ID NO: 483934 - RNA, 32 nt, Human
uaaaguguccaaagccuauggaagaaaaccau

SEQ ID NO: 483935 - RNA, 24 nt, Human
uaaaguguguauucuugauguuua

SEQ ID NO: 483936 - RNA, 21 nt, Human
uaaaguguguguaccugugug

SEQ ID NO: 483937 - RNA, 32 nt, Human
uaaaguguuaccuccccuccuaacccuucccc

SEQ ID NO: 483938 - RNA, 32 nt, Human
uaaaguguucuccuuuuaaggguggguuuaau

SEQ ID NO: 483939 - RNA, 32 nt, Human
uaaaguguugccaaagauaccugcugaauucu

SEQ ID NO: 483940 - RNA, 32 nt, Human
uaaaguguuuauguuaagaggauuaggccagg

SEQ ID NO: 483941 - RNA, 31 nt, Human
uaaaguuaagugucccucaggcagggagagg

SEQ ID NO: 483942 - RNA, 32 nt, Human
uaaaguuauaaauacaauauuuauaucuauaa

SEQ ID NO: 483943 - RNA, 32 nt, Human
uaaaguuaugauauuguaaaacaggugccacg

SEQ ID NO: 483944 - RNA, 31 nt, Human
uaaaguucaauaaauacuuuguugaauuuau

SEQ ID NO: 483945 - RNA, 32 nt, Human
uaaaguucuagacugggugaauucuuucauga

SEQ ID NO: 483946 - RNA, 32 nt, Human
uaaaguucugcucucuuggggacuucauagag

SEQ ID NO: 483947 - RNA, 32 nt, Human
uaaaguuuagaacuuccauguuaguaugugca

SEQ ID NO: 483948 - RNA, 32 nt, Human
uaaaguuuaggagauaggaagaaggacugugu

SEQ ID NO: 483949 - RNA, 32 nt, Human
uaaaguuucaguggagguggaggcagagauua

SEQ ID NO: 483950 - RNA, 32 nt, Human
uaaaguuucuuucuuacagaaguucugauauu

SEQ ID NO: 483951 - RNA, 32 nt, Human
uaaaguuuucugcuuuccuucuguccugaugg

SEQ ID NO: 483952 - RNA, 32 nt, Human
uaaauaaaaaccaauaguacuaauuuugcuuu

SEQ ID NO: 483953 - RNA, 32 nt, Human
uaaauaaaaauacuauuaacuggacuuccuaa

SEQ ID NO: 483954 - RNA, 32 nt, Human
uaaauaaaaauguagacauggcuggcgcagug

SEQ ID NO: 483955 - RNA, 32 nt, Human
uaaauaaaacacaggaaguauucugguggaaa

SEQ ID NO: 483956 - RNA, 32 nt, Human
uaaauaaaagauuaaaauauauacaaaucaaa

SEQ ID NO: 483957 - RNA, 32 nt, Human
uaaauaaaccuucagaccagagaucuauucuc

SEQ ID NO: 483958 - RNA, 29 nt, Human
uaaauaaacuuuuucacuaugcaccuggu

SEQ ID NO: 483959 - RNA, 32 nt, Human
uaaauaaagacaggguuuugcuauguuaccua

SEQ ID NO: 483960 - RNA, 32 nt, Human
uaaauaaagaccuuccucugcauggagaccgc

SEQ ID NO: 483961 - RNA, 32 nt, Human
uaaauaaagaugaacuugguuucaagccaaau

SEQ ID NO: 483962 - RNA, 32 nt, Human
uaaauaaagccucugggugguggagacgguac

SEQ ID NO: 483963 - RNA, 32 nt, Human
uaaauaaauaucaaacuacauucuuccgaaaa

SEQ ID NO: 483964 - RNA, 32 nt, Human
uaaauaaaugcaccuucucuguaugcagugcu

SEQ ID NO: 483965 - RNA, 24 nt, Human
uaaauaaauguuuuccuguaguca

SEQ ID NO: 483966 - RNA, 29 nt, Human
uaaauaaauuacccccuccuccagaucaa

SEQ ID NO: 483967 - RNA, 32 nt, Human
uaaauaacaacucccugaaccucaguuuccuc

SEQ ID NO: 483968 - RNA, 32 nt, Human
uaaauaaccaaaauaaagugcuuugaauggaa

SEQ ID NO: 483969 - RNA, 32 nt, Human
uaaauaacuuaucuuuuggacauauuuuuaua

SEQ ID NO: 483970 - RNA, 32 nt, Human
uaaauaagggaaauaacuguucuugggccacu

SEQ ID NO: 483971 - RNA, 32 nt, Human
uaaauaagguaaugccuguaagaaugccauaa

SEQ ID NO: 483972 - RNA, 32 nt, Human
uaaauaagguuaguacauucacuaggggcaaa

SEQ ID NO: 483973 - RNA, 32 nt, Human
uaaauaaguagaucagcaagacuuguuucaga

SEQ ID NO: 483974 - RNA, 32 nt, Human
uaaauaagucauauguuuguauccuguuuuau

SEQ ID NO: 483975 - RNA, 32 nt, Human
uaaauaauacuggccuuuaggguuggggaggu

SEQ ID NO: 483976 - RNA, 32 nt, Human
uaaauaauauagucuacaacauagagacugua

SEQ ID NO: 483977 - RNA, 32 nt, Human
uaaauaaucucaauaaauuuugugcuguggcc

SEQ ID NO: 483978 - RNA, 32 nt, Human
uaaauaauggauugcuuuuuagcaauagagcu

SEQ ID NO: 483979 - RNA, 32 nt, Human
uaaauaauucaguaggucuggggugaggccug

SEQ ID NO: 483980 - RNA, 32 nt, Human
uaaauacaauagcugaguuuuccccaguguau

SEQ ID NO: 483981 - RNA, 32 nt, Human
uaaauacaccugcuuuggguaaaacucuuugc

SEQ ID NO: 483982 - RNA, 32 nt, Human
uaaauacaggaagaaagagcuugaggugggag

SEQ ID NO: 483983 - RNA, 32 nt, Human
uaaauacauaaauaaaagaaaaauaugcauuu

SEQ ID NO: 483984 - RNA, 32 nt, Human
uaaauacauaaauauguauauuauuuagauua

SEQ ID NO: 483985 - RNA, 32 nt, Human
uaaauacauaguauuccucaguaucuauucca

SEQ ID NO: 483986 - RNA, 32 nt, Human
uaaauacauauguacauagauauaugggccuc

SEQ ID NO: 483987 - RNA, 32 nt, Human
uaaauacaucacagacagaaaccuuuauaaaa

SEQ ID NO: 483988 - RNA, 32 nt, Human
uaaauaccccacacccuccccucugcaaaggu

SEQ ID NO: 483989 - RNA, 32 nt, Human
uaaauacccucuguucucacacaaaugcuguu

SEQ ID NO: 483990 - RNA, 32 nt, Human
uaaauaccuccaggguucccagcaaguggcca

SEQ ID NO: 483991 - RNA, 32 nt, Human
uaaauacuauaccuuggcugggcauagugacu

SEQ ID NO: 483992 - RNA, 32 nt, Human
uaaauacuuauauuuuauuuuugaggcaugua

SEQ ID NO: 483993 - RNA, 31 nt, Human
uaaauacuucugacacuacauuuaaauguuu

SEQ ID NO: 483994 - RNA, 32 nt, Human
uaaauacuugcugaaugaaugcagaaaucagc

SEQ ID NO: 483995 - RNA, 32 nt, Human
uaaauacuugcugggugguugacacaggauua

SEQ ID NO: 483996 - RNA, 32 nt, Human
uaaauacuuggacagagguugcugaacuuuaa

SEQ ID NO: 483997 - RNA, 32 nt, Human
uaaauacuuucuguguuuaacagcccuuggcc

SEQ ID NO: 483998 - RNA, 22 nt, Human
uaaauagacuagucauguccuu

SEQ ID NO: 483999 - RNA, 32 nt, Human
uaaauagagacagggucucacucugucaccca

SEQ ID NO: 484000 - RNA, 23 nt, Human
uaaauagagcauuuucuuaauca

SEQ ID NO: 484001 - RNA, 32 nt, Human
uaaauagaggcugcuuuuccacccucacccuu

SEQ ID NO: 484002 - RNA, 32 nt, Human
uaaauagcaacuccuagugagacagcaggcgg

SEQ ID NO: 484003 - RNA, 32 nt, Human
uaaauagccagccaauucaucaacauucuggu

SEQ ID NO: 484004 - RNA, 32 nt, Human
uaaauagccaugagcuucacugcuuagaggga

SEQ ID NO: 484005 - RNA, 22 nt, Human
uaaauagccuagucuggggagu

SEQ ID NO: 484006 - RNA, 32 nt, Human
uaaauagccucucuccccauuuaggagcagcc

SEQ ID NO: 484007 - RNA, 23 nt, Human
uaaauagccuggugugguggcuc

SEQ ID NO: 484008 - RNA, 32 nt, Human
uaaauagcuuggaacacccugaagagcaacau

SEQ ID NO: 484009 - RNA, 31 nt, Human
uaaauaggaccaauaaauccuuuggaagagc

SEQ ID NO: 484010 - RNA, 31 nt, Human
uaaauaggcagcuagaaugcugccuauauuu

SEQ ID NO: 484011 - RNA, 32 nt, Human
uaaauagggaagcaacaaaaccuacagggaac

SEQ ID NO: 484012 - RNA, 32 nt, Human
uaaauaggguacugcauuguagucuccauauc

SEQ ID NO: 484013 - RNA, 32 nt, Human
uaaauagugcugcagugaacauacacaugcau

SEQ ID NO: 484014 - RNA, 32 nt, Human
uaaauaguguggagaccagagcucggcaccuu

SEQ ID NO: 484015 - RNA, 32 nt, Human
uaaauaguuaaaggauuauggaaaagauggug

SEQ ID NO: 484016 - RNA, 32 nt, Human
uaaauauacaucugaguuuaaauguucuguuu

SEQ ID NO: 484017 - RNA, 32 nt, Human
uaaauauagcacaaaaauacuaaacuucauaa

SEQ ID NO: 484018 - RNA, 32 nt, Human
uaaauauauaaauacaaauguauauuuuucag

SEQ ID NO: 484019 - RNA, 32 nt, Human
uaaauauauaaauacauguauguaugucaaaa

SEQ ID NO: 484020 - RNA, 32 nt, Human
uaaauauauaaauauacauagacauaaaaaua

SEQ ID NO: 484021 - RNA, 32 nt, Human
uaaauaucacaucacaauaaaaaucaaauugg

SEQ ID NO: 484022 - RNA, 32 nt, Human
uaaauaucaggaaagacgcugugggaaaauag

SEQ ID NO: 484023 - RNA, 31 nt, Human
uaaauaucaguauucugacauguaagaaaau

SEQ ID NO: 484024 - RNA, 32 nt, Human
uaaauaucauaucacuguaucuucucagucau

SEQ ID NO: 484025 - RNA, 32 nt, Human
uaaauauccaaucacauuuguaagcguggaag

SEQ ID NO: 484026 - RNA, 32 nt, Human
uaaauauccaauuuguugugauuuucagcacc

SEQ ID NO: 484027 - RNA, 32 nt, Human
uaaauauccuuuuucaggaggaacugauaucu

SEQ ID NO: 484028 - RNA, 32 nt, Human
uaaauaucugaccuuuugggaagcaggacaga

SEQ ID NO: 484029 - RNA, 32 nt, Human
uaaauaucuggaaucuuagcagucacuacauu

SEQ ID NO: 484030 - RNA, 32 nt, Human
uaaauaucuuucucagugguuaccuuuauauu

SEQ ID NO: 484031 - RNA, 32 nt, Human
uaaauaugaguauuugcaauaaacuaugauau

SEQ ID NO: 484032 - RNA, 32 nt, Human
uaaauaugaguauuuugaccuggcagcagaug

SEQ ID NO: 484033 - RNA, 32 nt, Human
uaaauaugcucuguuaguuuguauggaaugau

SEQ ID NO: 484034 - RNA, 32 nt, Human
uaaauaugcuucucaaaccucuaccuuuuuca

SEQ ID NO: 484035 - RNA, 32 nt, Human
uaaauaugcuucugucuucauaauauauuaua

SEQ ID NO: 484036 - RNA, 32 nt, Human
uaaauauggagcuuucaaaaagcacaaauagg

SEQ ID NO: 484037 - RNA, 32 nt, Human
uaaauauggcucacugcagccucgacaccugg

SEQ ID NO: 484038 - RNA, 25 nt, Human
uaaauaugucuguguguugacuggu

SEQ ID NO: 484039 - RNA, 32 nt, Human
uaaauauguguccuccccacugagcuuuguuu

SEQ ID NO: 484040 - RNA, 32 nt, Human
uaaauauuaguaucuuucaaugguugacugcu

SEQ ID NO: 484041 - RNA, 32 nt, Human
uaaauauucaaaauuuuauuaggauaaauuug

SEQ ID NO: 484042 - RNA, 32 nt, Human
uaaauauuccuucgagcuuuguuuucauaaaa

SEQ ID NO: 484043 - RNA, 32 nt, Human
uaaauauugauuucugccuuccuugcuaaugc

SEQ ID NO: 484044 - RNA, 32 nt, Human
uaaauauugauuucugucuuccuugcuaaugc

SEQ ID NO: 484045 - RNA, 32 nt, Human
uaaauauugcuuaucuugaggccagugcuugu

SEQ ID NO: 484046 - RNA, 32 nt, Human
uaaauauuuaacauagguuuugauuuauaugu

SEQ ID NO: 484047 - RNA, 32 nt, Human
uaaauauuucucugaguaauucacugguuuau

SEQ ID NO: 484048 - RNA, 32 nt, Human
uaaauauuuuaggccuucugggcuacaaagag

SEQ ID NO: 484049 - RNA, 32 nt, Human
uaaauauuuuuccuccucugaacuggauuuua

SEQ ID NO: 484050 - RNA, 32 nt, Human
uaaaucaaaagcuucuugaguaaaacuucuua

SEQ ID NO: 484051 - RNA, 32 nt, Human
uaaaucaaauaacaaaauagagaauucaggua

SEQ ID NO: 484052 - RNA, 32 nt, Human
uaaaucaacuaaucaaaaaugauauagacgac

SEQ ID NO: 484053 - RNA, 32 nt, Human
uaaaucaagcaaaccccuaaacauuguguagg

SEQ ID NO: 484054 - RNA, 32 nt, Human
uaaaucaagcuuuggaaguccaaaaagaauaa

SEQ ID NO: 484055 - RNA, 32 nt, Human
uaaaucaaugaaauguuucaaugauauaugca

SEQ ID NO: 484056 - RNA, 32 nt, Human
uaaaucaauuccucaaagugugcacaaaacua

SEQ ID NO: 484057 - RNA, 32 nt, Human
uaaaucacauuggguuauuauauaaucauuuc

SEQ ID NO: 484058 - RNA, 28 nt, Human
uaaaucaccucuuccgcuguuuuagcug

SEQ ID NO: 484059 - RNA, 30 nt, Human
uaaaucaccucuuccgcuguuuuagcugaa

SEQ ID NO: 484060 - RNA, 32 nt, Human
uaaaucaccucuuccgcuguuuuagcugaaga

SEQ ID NO: 484061 - RNA, 32 nt, Human
uaaaucacuauuuaauugccucuaauacuuua

SEQ ID NO: 484062 - RNA, 32 nt, Human
uaaaucacuguguugacccucuucugaaccaa

SEQ ID NO: 484063 - RNA, 32 nt, Human
uaaaucagaagaugaaugaauggauggaaucu

SEQ ID NO: 484064 - RNA, 32 nt, Human
uaaaucagacuggaucucugccacuuuucccu

SEQ ID NO: 484065 - RNA, 32 nt, Human
uaaaucagauuguaaucccaguacuuugggag

SEQ ID NO: 484066 - RNA, 32 nt, Human
uaaaucagcaagaagaauaaugguggggucuu

SEQ ID NO: 484067 - RNA, 32 nt, Human
uaaaucagcaaggauggcagaaaaugagcuga

SEQ ID NO: 484068 - RNA, 32 nt, Human
uaaaucagccuccaguuuuugaagcguucauu

SEQ ID NO: 484069 - RNA, 32 nt, Human
uaaaucagccuuccgcaauucauguaguuucu

SEQ ID NO: 484070 - RNA, 32 nt, Human
uaaaucagggguccgugcucccagcccgcuuc

SEQ ID NO: 484071 - RNA, 32 nt, Human
uaaaucauaggcaccacauuuuucaugucaga

SEQ ID NO: 484072 - RNA, 32 nt, Human
uaaaucaucagcccuguuuggugcagucucau

SEQ ID NO: 484073 - RNA, 32 nt, Human
uaaaucaugaaucccgccagguacgguggcuc

SEQ ID NO: 484074 - RNA, 32 nt, Human
uaaaucauuucaaagagaacagguagucagga

SEQ ID NO: 484075 - RNA, 32 nt, Human
uaaauccaaaaauuagcugguuguggugaugc

SEQ ID NO: 484076 - RNA, 31 nt, Human
uaaauccaaagcuagaaaugacgaagcucag

SEQ ID NO: 484077 - RNA, 32 nt, Human
uaaauccaaauuugaaucauuugucauguaug

SEQ ID NO: 484078 - RNA, 32 nt, Human
uaaauccaagguugaaaagaaaaagaaggaga

SEQ ID NO: 484079 - RNA, 32 nt, Human
uaaauccaaguuggccguuuuauuaguauguu

SEQ ID NO: 484080 - RNA, 21 nt, Human
uaaauccaauaucaugucuug

SEQ ID NO: 484081 - RNA, 32 nt, Human
uaaauccacaauauuuuauuacauuuuuaacu

SEQ ID NO: 484082 - RNA, 32 nt, Human
uaaauccacaguuuaauucacaagcuaguacu

SEQ ID NO: 484083 - RNA, 32 nt, Human
uaaauccaggaggcaaagguugcagugagcca

SEQ ID NO: 484084 - RNA, 32 nt, Human
uaaauccaggaggcggagguugcagugagcca

SEQ ID NO: 484085 - RNA, 32 nt, Human
uaaauccaguuuccaagaaccuaaacugauug

SEQ ID NO: 484086 - RNA, 32 nt, Human
uaaauccaucguaagauugagccucaaguuug

SEQ ID NO: 484087 - RNA, 32 nt, Human
uaaaucccaagugucucuugacuggcucaaga

SEQ ID NO: 484088 - RNA, 32 nt, Human
uaaaucccagcacuuugggaaggccgaguugg

SEQ ID NO: 484089 - RNA, 32 nt, Human
uaaaucccagugcagucaacagccuggccuau

SEQ ID NO: 484090 - RNA, 32 nt, Human
uaaauccccagccugugagucucagccucuuu

SEQ ID NO: 484091 - RNA, 32 nt, Human
uaaauccccaggacucagaccuaggcagcacc

SEQ ID NO: 484092 - RNA, 32 nt, Human
uaaaucccuacccacguuccagccucuaggug

SEQ ID NO: 484093 - RNA, 32 nt, Human
uaaauccguucccugcucccguccuguugacu

SEQ ID NO: 484094 - RNA, 32 nt, Human
uaaauccucacguuaacguacacacacaaaca

SEQ ID NO: 484095 - RNA, 32 nt, Human
uaaauccucccuccucuccucacauccugguc

SEQ ID NO: 484096 - RNA, 32 nt, Human
uaaauccuggccacauucaccaaccaaagggg

SEQ ID NO: 484097 - RNA, 32 nt, Human
uaaauccuucagcugauucucagucuaguaaa

SEQ ID NO: 484098 - RNA, 32 nt, Human
uaaauccuuguucacugaagucuuucaauuga

SEQ ID NO: 484099 - RNA, 32 nt, Human
uaaaucgaggcucucagacuccugcugccugg

SEQ ID NO: 484100 - RNA, 32 nt, Human
uaaaucgauaaauaaacucaaccuaaacaggu

SEQ ID NO: 484101 - RNA, 32 nt, Human
uaaaucguugggacucucagaugaaacaggau

SEQ ID NO: 484102 - RNA, 32 nt, Human
uaaaucuaagguugaaaagaaaaagaaggaga

SEQ ID NO: 484103 - RNA, 32 nt, Human
uaaaucuacuccuguauuaugcuuuacagugc

SEQ ID NO: 484104 - RNA, 32 nt, Human
uaaaucucccagaagaggaaaguggccugcuc

SEQ ID NO: 484105 - RNA, 32 nt, Human
uaaaucucccagaagaggaaaguggccugcuu

SEQ ID NO: 484106 - RNA, 32 nt, Human
uaaaucucuaccacagccucacaagcaaaugc

SEQ ID NO: 484107 - RNA, 32 nt, Human
uaaaucucucuaugccuccagccgagaagaua

SEQ ID NO: 484108 - RNA, 32 nt, Human
uaaaucucucucugucacccaggcuggagugc

SEQ ID NO: 484109 - RNA, 22 nt, Human
uaaaucugauaggcaacaguag

SEQ ID NO: 484110 - RNA, 32 nt, Human
uaaaucugccuggcguccccucccucugucuu

SEQ ID NO: 484111 - RNA, 32 nt, Human
uaaaucuggaaauguuuuguugcacuaaaaua

SEQ ID NO: 484112 - RNA, 32 nt, Human
uaaaucuggcagccuuaauuauuacacaacua

SEQ ID NO: 484113 - RNA, 32 nt, Human
uaaaucuggcuguauucaguagcaauacaaaa

SEQ ID NO: 484114 - RNA, 32 nt, Human
uaaaucuggcuguauucaguagcaauacaaga

SEQ ID NO: 484115 - RNA, 32 nt, Human
uaaaucuguaccaccuaacauugaacaucauu

SEQ ID NO: 484116 - RNA, 32 nt, Human
uaaaucugucuucugcucaguuucuggucccc

SEQ ID NO: 484117 - RNA, 32 nt, Human
uaaaucuguuccauuaucuucucuguaggaug

SEQ ID NO: 484118 - RNA, 32 nt, Human
uaaaucuucuguuccuccuuuuuccaagggaa

SEQ ID NO: 484119 - RNA, 32 nt, Human
uaaaucuugcaagaauauuuugugcuuucuuu

SEQ ID NO: 484120 - RNA, 32 nt, Human
uaaaucuugcugcugcucacucguuggguccg

SEQ ID NO: 484121 - RNA, 32 nt, Human
uaaaucuugcugcugcucacucuuugggucca

SEQ ID NO: 484122 - RNA, 32 nt, Human
uaaaucuugcugcuguucauuguuugggucca

SEQ ID NO: 484123 - RNA, 32 nt, Human
uaaaucuugcuugaugugugugcaauguacau

SEQ ID NO: 484124 - RNA, 32 nt, Human
uaaaucuuguuuuaaaaauacauauuucuacc

SEQ ID NO: 484125 - RNA, 32 nt, Human
uaaaucuuuuauuuucuuucagguuuacuuga

SEQ ID NO: 484126 - RNA, 32 nt, Human
uaaaugaaaacacacaaauugaaaaugcacag

SEQ ID NO: 484127 - RNA, 32 nt, Human
uaaaugaaaauggauauaagguauguauaacu

SEQ ID NO: 484128 - RNA, 32 nt, Human
uaaaugaacugcuuagcccugcucugaagaac

SEQ ID NO: 484129 - RNA, 30 nt, Human
uaaaugaagaaagugaaguaggccgggcac

SEQ ID NO: 484130 - RNA, 32 nt, Human
uaaaugaagaaagugaaguaggccgggcacgg

SEQ ID NO: 484131 - RNA, 23 nt, Human
uaaaugaagauugagugugcaca

SEQ ID NO: 484132 - RNA, 32 nt, Human
uaaaugaagcguggaaggcaucaaagaugugc

SEQ ID NO: 484133 - RNA, 32 nt, Human
uaaaugaagcucacuaaaugaaguucucauuu

SEQ ID NO: 484134 - RNA, 32 nt, Human
uaaaugaaggggauauucgacuguauaaccau

SEQ ID NO: 484135 - RNA, 32 nt, Human
uaaaugaaguaguggcccgugaccugucugau

SEQ ID NO: 484136 - RNA, 32 nt, Human
uaaaugaauggccacagaaagguggcccggcc

SEQ ID NO: 484137 - RNA, 32 nt, Human
uaaaugacacaguggcaccuggcacauaguag

SEQ ID NO: 484138 - RNA, 32 nt, Human
uaaaugaccugacaaaaacugacucaugucuu

SEQ ID NO: 484139 - RNA, 32 nt, Human
uaaaugacuucuugcaccaucuugccuaaugg

SEQ ID NO: 484140 - RNA, 32 nt, Human
uaaaugacuuuguuuuucaaggugcugucauu

SEQ ID NO: 484141 - RNA, 32 nt, Human
uaaaugagaguggauggauggguccuuuggaa

SEQ ID NO: 484142 - RNA, 32 nt, Human
uaaaugagauuacagcauaaugaagaagacaa

SEQ ID NO: 484143 - RNA, 32 nt, Human
uaaaugagcucagaguuuaccuagcuaaggcc

SEQ ID NO: 484144 - RNA, 32 nt, Human
uaaaugaggaagagcagcaggcauugucaugg

SEQ ID NO: 484145 - RNA, 32 nt, Human
uaaaugaggacuuggcuuaugaccagucugau

SEQ ID NO: 484146 - RNA, 32 nt, Human
uaaaugaggugagagugaagagacuagagcca

SEQ ID NO: 484147 - RNA, 32 nt, Human
uaaaugagguggcuucagaaauggcagaauaa

SEQ ID NO: 484148 - RNA, 32 nt, Human
uaaaugagguuggcagaguggcagugggggcu

SEQ ID NO: 484149 - RNA, 32 nt, Human
uaaaugaguucugcuuucuuuuuggaacugcu

SEQ ID NO: 484150 - RNA, 32 nt, Human
uaaaugaguuuaaacuuguagauggcuuagaa

SEQ ID NO: 484151 - RNA, 32 nt, Human
uaaaugauagccacaguauugcucccuaaaau

SEQ ID NO: 484152 - RNA, 32 nt, Human
uaaaugaucacuucgaucauguuuccaugcaa

SEQ ID NO: 484153 - RNA, 32 nt, Human
uaaaugaugagugaaugugaggcccuuggaca

SEQ ID NO: 484154 - RNA, 32 nt, Human
uaaaugauguaacagaggcuugauuuguguua

SEQ ID NO: 484155 - RNA, 32 nt, Human
uaaaugauguugcuuaacucucccucugaugu

SEQ ID NO: 484156 - RNA, 32 nt, Human
uaaaugcaaacaucauuuuuaaauuuucagug

SEQ ID NO: 484157 - RNA, 32 nt, Human
uaaaugcaacagauaucauuucaggugacuua

SEQ ID NO: 484158 - RNA, 32 nt, Human
uaaaugcaacucuuucuguucuuucuggcagc

SEQ ID NO: 484159 - RNA, 32 nt, Human
uaaaugcaaucagguaguguugcuuuuuacag

SEQ ID NO: 484160 - RNA, 32 nt, Human
uaaaugcacaucuucucgccaccugcuuuuuc

SEQ ID NO: 484161 - RNA, 32 nt, Human
uaaaugcagagcuuggcauuugcccauguuaa

SEQ ID NO: 484162 - RNA, 32 nt, Human
uaaaugcagucaaagaggcagucccuucccau

SEQ ID NO: 484163 - RNA, 32 nt, Human
uaaaugcagugucaugccuauaagcauuucuc

SEQ ID NO: 484164 - RNA, 32 nt, Human
uaaaugcagugucugugagaaagccuucagua

SEQ ID NO: 484165 - RNA, 32 nt, Human
uaaaugcaugcuagaaaaauagggcuggaucu

SEQ ID NO: 484166 - RNA, 32 nt, Human
uaaaugcaugugaauagcuggcaaaaagaugu

SEQ ID NO: 484167 - RNA, 32 nt, Human
uaaaugccacgacuaggggaaaaagaaacuau

SEQ ID NO: 484168 - RNA, 32 nt, Human
uaaaugccauugucacagccucauuuguaagc

SEQ ID NO: 484169 - RNA, 32 nt, Human
uaaaugccuuucuguguuucugaaucagaagc

SEQ ID NO: 484170 - RNA, 32 nt, Human
uaaaugcgugagccaccaugcccggccgcuau

SEQ ID NO: 484171 - RNA, 32 nt, Human
uaaaugcuaccaaccauagacaauaaauaaua

SEQ ID NO: 484172 - RNA, 21 nt, Human
uaaaugcuaucucagcauguu

SEQ ID NO: 484173 - RNA, 32 nt, Human
uaaaugcucacugugagugcccccaacuuucc

SEQ ID NO: 484174 - RNA, 32 nt, Human
uaaaugcugcuaggguggaggaguaugcagag

SEQ ID NO: 484175 - RNA, 32 nt, Human
uaaaugcuuaagaguuuuaaucaguccgccau

SEQ ID NO: 484176 - RNA, 29 nt, Human
uaaaugcuucaguuuccugaaauggaaug

SEQ ID NO: 484177 - RNA, 32 nt, Human
uaaaugcuuuacaacaugaaguauaacucaac

SEQ ID NO: 484178 - RNA, 32 nt, Human
uaaaugcuuuagugaagcagaauagcccuuuu

SEQ ID NO: 484179 - RNA, 32 nt, Human
uaaauggacaggagggagaaguuggggaaaau

SEQ ID NO: 484180 - RNA, 32 nt, Human
uaaauggaugaaacuucaaauuaucuuauuug

SEQ ID NO: 484181 - RNA, 32 nt, Human
uaaauggcaaaaacucuuucucagacuuacag

SEQ ID NO: 484182 - RNA, 32 nt, Human
uaaauggcauuguuugaaggggccggcuaauu

SEQ ID NO: 484183 - RNA, 32 nt, Human
uaaauggccaaaaacuuuaacuaugaaauguu

SEQ ID NO: 484184 - RNA, 32 nt, Human
uaaauggccguuuuuggaauuacuugauaaga

SEQ ID NO: 484185 - RNA, 32 nt, Human
uaaauggccugaccaaggagaaugacuacaag

SEQ ID NO: 484186 - RNA, 32 nt, Human
uaaauggcuguucaguucauguuguacgugau

SEQ ID NO: 484187 - RNA, 32 nt, Human
uaaaugggagagagaaggggagaaccaaucuc

SEQ ID NO: 484188 - RNA, 32 nt, Human
uaaaugggcaaggacgcccugcccucacuggg

SEQ ID NO: 484189 - RNA, 32 nt, Human
uaaaugggccucucuuccuuugcugugcacuu

SEQ ID NO: 484190 - RNA, 32 nt, Human
uaaaugggcugaguugggggaggcaugggguc

SEQ ID NO: 484191 - RNA, 32 nt, Human
uaaaugggggcagaagcugagccaagcagagg

SEQ ID NO: 484192 - RNA, 32 nt, Human
uaaauggugcuaugacugccuuccgccaaaaa

SEQ ID NO: 484193 - RNA, 32 nt, Human
uaaauggugucuuucuauguugcccagggugg

SEQ ID NO: 484194 - RNA, 32 nt, Human
uaaauggugugaccaggaucuaguuucuuucu

SEQ ID NO: 484195 - RNA, 32 nt, Human
uaaaugguuaacuuucaaaugaugcugcugcc

SEQ ID NO: 484196 - RNA, 32 nt, Human
uaaaugguuccucuugaagcucaaauuggcag

SEQ ID NO: 484197 - RNA, 32 nt, Human
uaaauguaaagaaauaguacuuuuagcauaag

SEQ ID NO: 484198 - RNA, 32 nt, Human
uaaaugucaacuugucauugaauguaaagaau

SEQ ID NO: 484199 - RNA, 32 nt, Human
uaaaugucaguaaaccaaauaaaaguucauuu

SEQ ID NO: 484200 - RNA, 32 nt, Human
uaaaugucauaacuacaccugcuccaggacca

SEQ ID NO: 484201 - RNA, 32 nt, Human
uaaaugucauagucaagauuugguagauaaau

SEQ ID NO: 484202 - RNA, 32 nt, Human
uaaaugucauuaaauuuauuuguacucagaac

SEQ ID NO: 484203 - RNA, 32 nt, Human
uaaauguccauucuuuaucaagggccuacuuu

SEQ ID NO: 484204 - RNA, 32 nt, Human
uaaaugucccucuccagagacagccccuccug

SEQ ID NO: 484205 - RNA, 32 nt, Human
uaaauguccguguuaagaauuggcccacuggu

SEQ ID NO: 484206 - RNA, 32 nt, Human
uaaaugugaaagcucaguggccgcuccuucuu

SEQ ID NO: 484207 - RNA, 32 nt, Human
uaaaugugcagggcagacagagccagaagggc

SEQ ID NO: 484208 - RNA, 32 nt, Human
uaaaugugccuuuguuccuccuucaccuucug

SEQ ID NO: 484209 - RNA, 32 nt, Human
uaaauguggagacaggaggaggugagauggcu

SEQ ID NO: 484210 - RNA, 32 nt, Human
uaaauguggcagagugaaaggagaaguuuuaa

SEQ ID NO: 484211 - RNA, 32 nt, Human
uaaaugugggaauaucaaugcaguucaccuca

SEQ ID NO: 484212 - RNA, 32 nt, Human
uaaauguguaacucauggucacuguguaaaca

SEQ ID NO: 484213 - RNA, 32 nt, Human
uaaauguguauuugugaauaacaaacugcaca

SEQ ID NO: 484214 - RNA, 32 nt, Human
uaaaugugucccaucaugcuuuccacugaccc

SEQ ID NO: 484215 - RNA, 32 nt, Human
uaaauguguugagugauauagcuaucagaugu

SEQ ID NO: 484216 - RNA, 32 nt, Human
uaaauguguuuuguuccuagggccagaggagc

SEQ ID NO: 484217 - RNA, 32 nt, Human
uaaauguuacugguagaaaggcaguucaggua

SEQ ID NO: 484218 - RNA, 32 nt, Human
uaaauguuagguuggugcaaaacuaaucgugg

SEQ ID NO: 484219 - RNA, 32 nt, Human
uaaauguugcugcuggguagcuccacaguguu

SEQ ID NO: 484220 - RNA, 32 nt, Human
uaaauguugugcuguuaacacugcaaauaaac

SEQ ID NO: 484221 - RNA, 32 nt, Human
uaaauguuuauuuaaauauucuaaauuggauu

SEQ ID NO: 484222 - RNA, 32 nt, Human
uaaauguuugccagacugggugcagaauuuau

SEQ ID NO: 484223 - RNA, 32 nt, Human
uaaauguuuuugacaauaaacuucuugugcag

SEQ ID NO: 484224 - RNA, 32 nt, Human
uaaauuaaaauggcauucuuaaagauuuucuu

SEQ ID NO: 484225 - RNA, 32 nt, Human
uaaauuaauauaauugcuuuccuccacaccca

SEQ ID NO: 484226 - RNA, 32 nt, Human
uaaauuacaucugaauaaagcuguaauuaaaa

SEQ ID NO: 484227 - RNA, 32 nt, Human
uaaauuaccacauuuggcuucccuucaucagc

SEQ ID NO: 484228 - RNA, 32 nt, Human
uaaauuacccagccucagauauuucuaugcag

SEQ ID NO: 484229 - RNA, 32 nt, Human
uaaauuacguuuauaacacugcagagaccuua

SEQ ID NO: 484230 - RNA, 32 nt, Human
uaaauuacucaggacuuaauguagcauugcac

SEQ ID NO: 484231 - RNA, 32 nt, Human
uaaauuacucaucucugucuuuaccagcaggc

SEQ ID NO: 484232 - RNA, 32 nt, Human
uaaauuacuccguucucuaucaguuaaagcua

SEQ ID NO: 484233 - RNA, 32 nt, Human
uaaauuacugaugaaauucuguuucuugucug

SEQ ID NO: 484234 - RNA, 32 nt, Human
uaaauuagucacggcacugcagccugggcaac

SEQ ID NO: 484235 - RNA, 32 nt, Human
uaaauuagugauauuuuaaucagguuuuacua

SEQ ID NO: 484236 - RNA, 32 nt, Human
uaaauuauggacuacaaccaagucaacuguuu

SEQ ID NO: 484237 - RNA, 32 nt, Human
uaaauuauggcaauauuugcacuuugggaaug

SEQ ID NO: 484238 - RNA, 32 nt, Human
uaaauuauugcuguauguaaacuguuacugaa

SEQ ID NO: 484239 - RNA, 32 nt, Human
uaaauucaaaaguaaugcuucaaucagauagu

SEQ ID NO: 484240 - RNA, 32 nt, Human
uaaauucaaaccauauccacacacaacaacua

SEQ ID NO: 484241 - RNA, 32 nt, Human
uaaauucacaucucaaggagggagaacccggg

SEQ ID NO: 484242 - RNA, 32 nt, Human
uaaauucacaugcaugauaggcauguuggaaa

SEQ ID NO: 484243 - RNA, 32 nt, Human
uaaauucaccugacgagggcacucugagauag

SEQ ID NO: 484244 - RNA, 32 nt, Human
uaaauucagagcagauuagagccugcgcaaug

SEQ ID NO: 484245 - RNA, 32 nt, Human
uaaauucagcuuuuauaaggcagcaguaccug

SEQ ID NO: 484246 - RNA, 32 nt, Human
uaaauucaggcugcaggcuccuuccauccaga

SEQ ID NO: 484247 - RNA, 32 nt, Human
uaaauucagggauauguauauguauguuugug

SEQ ID NO: 484248 - RNA, 32 nt, Human
uaaauucaguauguuggcauuacuuggaccug

SEQ ID NO: 484249 - RNA, 25 nt, Human
uaaauucagugauggcaagaaccaa

SEQ ID NO: 484250 - RNA, 32 nt, Human
uaaauucaguugaucugggccgagcauggugg

SEQ ID NO: 484251 - RNA, 32 nt, Human
uaaauucauuagugugaaagaggugggaguga

SEQ ID NO: 484252 - RNA, 32 nt, Human
uaaauuccaccuuuagaucugugaaagguaaa

SEQ ID NO: 484253 - RNA, 32 nt, Human
uaaauuccagggucucagaugguuaggacaaa

SEQ ID NO: 484254 - RNA, 32 nt, Human
uaaauucccaccaaggcaaccagacacaucca

SEQ ID NO: 484255 - RNA, 32 nt, Human
uaaauuccugucacuaaauggaaauguguuug

SEQ ID NO: 484256 - RNA, 32 nt, Human
uaaauuccuguccccucugucccuccccucca

SEQ ID NO: 484257 - RNA, 25 nt, Human
uaaauucuauuauauaaagccccaa

SEQ ID NO: 484258 - RNA, 32 nt, Human
uaaauucucucccucccuacugaggccuuggu

SEQ ID NO: 484259 - RNA, 32 nt, Human
uaaauucucuuucucccucucuucuccaauca

SEQ ID NO: 484260 - RNA, 32 nt, Human
uaaauucugucaccuccugucauuuuauuuuu

SEQ ID NO: 484261 - RNA, 32 nt, Human
uaaauucugucugccuacuaguuuuaaguaua

SEQ ID NO: 484262 - RNA, 32 nt, Human
uaaauucuuuuacugcaucuauugagaugauc

SEQ ID NO: 484263 - RNA, 32 nt, Human
uaaauugaaaggcuguuggcuguuguaucuug

SEQ ID NO: 484264 - RNA, 32 nt, Human
uaaauugaaauguuugcauugcaccaaaggag

SEQ ID NO: 484265 - RNA, 32 nt, Human
uaaauugaacaagccaggcuguccaggguggc

SEQ ID NO: 484266 - RNA, 32 nt, Human
uaaauugaagugccaugcaaguagcuagcaug

SEQ ID NO: 484267 - RNA, 32 nt, Human
uaaauugagacagggucucacucugucacuca

SEQ ID NO: 484268 - RNA, 32 nt, Human
uaaauugaucacuguaacuaaccccuucuguc

SEQ ID NO: 484269 - RNA, 22 nt, Human
uaaauugcaguaguccuuccca

SEQ ID NO: 484270 - RNA, 32 nt, Human
uaaauugcaguuguagacaccgaggaugguug

SEQ ID NO: 484271 - RNA, 32 nt, Human
uaaauugcauuucaaguggaaggaaaggggug

SEQ ID NO: 484272 - RNA, 32 nt, Human
uaaauuggaaacaaaagguugcaacgugacaa

SEQ ID NO: 484273 - RNA, 32 nt, Human
uaaauuggaguuggaguagaauguaguuugag

SEQ ID NO: 484274 - RNA, 32 nt, Human
uaaauuggcccaggguuggcuggugggucacc

SEQ ID NO: 484275 - RNA, 32 nt, Human
uaaauuggccugguauggcugcaguccuccgg

SEQ ID NO: 484276 - RNA, 32 nt, Human
uaaauugggaaugggagaagggaggauauaag

SEQ ID NO: 484277 - RNA, 32 nt, Human
uaaauugggccagggugggagcagggaaagaa

SEQ ID NO: 484278 - RNA, 32 nt, Human
uaaauugggggaacuccuucaucucucauggc

SEQ ID NO: 484279 - RNA, 32 nt, Human
uaaauuggugugagcucaaagcccagucaugu

SEQ ID NO: 484280 - RNA, 32 nt, Human
uaaauugucaccaauugaaaaucuugucacuc

SEQ ID NO: 484281 - RNA, 32 nt, Human
uaaauugucagucacuucuucaaaaccuuaca

SEQ ID NO: 484282 - RNA, 32 nt, Human
uaaauuguccccauuaccuuaagguaaucacu

SEQ ID NO: 484283 - RNA, 32 nt, Human
uaaauugugauuguuuauucuauuacuauugu

SEQ ID NO: 484284 - RNA, 32 nt, Human
uaaauugugggcaaaagagaaaaagaaggauu

SEQ ID NO: 484285 - RNA, 32 nt, Human
uaaauuguuagcaagaguguugagcuaguucc

SEQ ID NO: 484286 - RNA, 32 nt, Human
uaaauuguugggaggaaacuguuaacauugug

SEQ ID NO: 484287 - RNA, 32 nt, Human
uaaauuguugugugugcacauaugcauauauu

SEQ ID NO: 484288 - RNA, 32 nt, Human
uaaauuguuuucugcucugaguaaacaguaau

SEQ ID NO: 484289 - RNA, 32 nt, Human
uaaauuuaagggacuugaacucagggaacacu

SEQ ID NO: 484290 - RNA, 32 nt, Human
uaaauuuaauuuaaaaguagagguccaaauga

SEQ ID NO: 484291 - RNA, 32 nt, Human
uaaauuuaccauuuuguuuuucuugaauaguc

SEQ ID NO: 484292 - RNA, 32 nt, Human
uaaauuuagagucaaauuuagagcagaaaaua

SEQ ID NO: 484293 - RNA, 32 nt, Human
uaaauuuaggggaauuggaugcauuauucaac

SEQ ID NO: 484294 - RNA, 32 nt, Human
uaaauuucaagcaucugaucacaucacauggu

SEQ ID NO: 484295 - RNA, 32 nt, Human
uaaauuucacaauauaaaguucuacaguuaau

SEQ ID NO: 484296 - RNA, 32 nt, Human
uaaauuuccagacagagaccagaaggaagguu

SEQ ID NO: 484297 - RNA, 32 nt, Human
uaaauuucucuccugauggguacuuuaauuug

SEQ ID NO: 484298 - RNA, 32 nt, Human
uaaauuucucucuccaaaauaaaguucaagca

SEQ ID NO: 484299 - RNA, 32 nt, Human
uaaauuucuuccuauuucuggaauggaaaagg

SEQ ID NO: 484300 - RNA, 32 nt, Human
uaaauuugaagugaaugguuaaacauccagcu

SEQ ID NO: 484301 - RNA, 32 nt, Human
uaaauuugacaaaaauucagcugaacuuguaa

SEQ ID NO: 484302 - RNA, 31 nt, Human
uaaauuugacccucugggccgagucacauua

SEQ ID NO: 484303 - RNA, 32 nt, Human
uaaauuugcaguuccacuaaugacauuuugau

SEQ ID NO: 484304 - RNA, 32 nt, Human
uaaauuugcauccuuuucauaaugccacugag

SEQ ID NO: 484305 - RNA, 32 nt, Human
uaaauuugcuuuucacaccuuucuuuaaauaa

SEQ ID NO: 484306 - RNA, 32 nt, Human
uaaauuuggaaaacagucagugucuggguuga

SEQ ID NO: 484307 - RNA, 32 nt, Human
uaaauuuguaaauacugcuucuguuuuguuuc

SEQ ID NO: 484308 - RNA, 32 nt, Human
uaaauuuguucucaccaagcacugccugugca

SEQ ID NO: 484309 - RNA, 20 nt, Human
uaaauuuguuuguacauuga

SEQ ID NO: 484310 - RNA, 32 nt, Human
uaaauuuucauucuguuuugcaugucaguuag

SEQ ID NO: 484311 - RNA, 32 nt, Human
uaaauuuuccaacucaggagaugaacuugcug

SEQ ID NO: 484312 - RNA, 32 nt, Human
uaaauuuucuuuguaguuggugguguuugagg

SEQ ID NO: 484313 - RNA, 32 nt, Human
uaaauuuugcaaaggccuuuuagcugacacuc

SEQ ID NO: 484314 - RNA, 32 nt, Human
uaaauuuuucagacugacagacuucaaggaug

SEQ ID NO: 484315 - RNA, 32 nt, Human
uaaauuuuugcuggaaguggagucaugagacu

SEQ ID NO: 484316 - RNA, 32 nt, Human
uaacaaaaauuagccaggcaugguggcggaca

SEQ ID NO: 484317 - RNA, 32 nt, Human
uaacaaaaauuagcugggcgugguggugggug

SEQ ID NO: 484318 - RNA, 32 nt, Human
uaacaaaagauuaaucuuuaaaccacuaaaau

SEQ ID NO: 484319 - RNA, 32 nt, Human
uaacaaaaggccauagaagucuguuuuucugg

SEQ ID NO: 484320 - RNA, 32 nt, Human
uaacaaacacagugaaaccccgucucuacuaa

SEQ ID NO: 484321 - RNA, 32 nt, Human
uaacaaacauggcucccugaagccgcucaggc

SEQ ID NO: 484322 - RNA, 32 nt, Human
uaacaaacauuuauuaauccagccucugccuu

SEQ ID NO: 484323 - RNA, 32 nt, Human
uaacaaaccaauuucaaaaauagacuaacugc

SEQ ID NO: 484324 - RNA, 32 nt, Human
uaacaaacuggugagcaaauguuaaacaaaau

SEQ ID NO: 484325 - RNA, 32 nt, Human
uaacaaagaccaccaggacauccugggaacuc

SEQ ID NO: 484326 - RNA, 32 nt, Human
uaacaaagaggaaugagccaggagaacaaacu

SEQ ID NO: 484327 - RNA, 32 nt, Human
uaacaaagaugaugaacuuaggguaaaccaac

SEQ ID NO: 484328 - RNA, 32 nt, Human
uaacaaagauuaguggagaagcuguauaaucg

SEQ ID NO: 484329 - RNA, 32 nt, Human
uaacaaagcuguuccuugaaccagaacaacca

SEQ ID NO: 484330 - RNA, 32 nt, Human
uaacaaagggccugacccuugaaggcuuacug

SEQ ID NO: 484331 - RNA, 32 nt, Human
uaacaaaguaaucacuuugucuaucacuaagu

SEQ ID NO: 484332 - RNA, 32 nt, Human
uaacaaaguauuaguaugacuuuuugaauaag

SEQ ID NO: 484333 - RNA, 32 nt, Human
uaacaaaucauccuccccaguuaagacuuccc

SEQ ID NO: 484334 - RNA, 32 nt, Human
uaacaaauccauuucccuccucccucccuccc

SEQ ID NO: 484335 - RNA, 32 nt, Human
uaacaaaugaaaaagcgaucugaacagacauu

SEQ ID NO: 484336 - RNA, 18 nt, Human
uaacaaaugagccauccc

SEQ ID NO: 484337 - RNA, 32 nt, Human
uaacaaaugcucaugugauacucccuuaugug

SEQ ID NO: 484338 - RNA, 32 nt, Human
uaacaaauguacaaaccuuaauuuaaaaauau

SEQ ID NO: 484339 - RNA, 32 nt, Human
uaacaaauguuccuccucccucugggauacca

SEQ ID NO: 484340 - RNA, 32 nt, Human
uaacaaauuaacuaaggaaauauuucaaucuc

SEQ ID NO: 484341 - RNA, 32 nt, Human
uaacaaauuuggagaaauaaaaauaucuaaaa

SEQ ID NO: 484342 - RNA, 32 nt, Human
uaacaacacaauaucaauccagcaaucuuuag

SEQ ID NO: 484343 - RNA, 32 nt, Human
uaacaacagcacugugggaggcugaggugggu

SEQ ID NO: 484344 - RNA, 32 nt, Human
uaacaacagcacuuuacaguuuguagauguaa

SEQ ID NO: 484345 - RNA, 32 nt, Human
uaacaacagccaggagcuuccugucaguaacc

SEQ ID NO: 484346 - RNA, 32 nt, Human
uaacaacaguuaaugcaucuauccugaucccu

SEQ ID NO: 484347 - RNA, 32 nt, Human
uaacaacaugaucuucuuugaguuaaaccuac

SEQ ID NO: 484348 - RNA, 32 nt, Human
uaacaaccaaccaaccaaccaaccaaccacaa

SEQ ID NO: 484349 - RNA, 32 nt, Human
uaacaaccacccuuacugauaguugggaaaag

SEQ ID NO: 484350 - RNA, 32 nt, Human
uaacaaccagagaugacugaaaccacucugaa

SEQ ID NO: 484351 - RNA, 32 nt, Human
uaacaacccuguaagccacauucucuggcaca

SEQ ID NO: 484352 - RNA, 32 nt, Human
uaacaacgugucuccuggauuuuacuuugaag

SEQ ID NO: 484353 - RNA, 32 nt, Human
uaacaacucugagcacaugcugggugaaguca

SEQ ID NO: 484354 - RNA, 32 nt, Human
uaacaacugaaagcuuuacaguguucaugcua

SEQ ID NO: 484355 - RNA, 32 nt, Human
uaacaacugcacuccagccuggaugacagaac

SEQ ID NO: 484356 - RNA, 32 nt, Human
uaacaagaaagcuuccaucucaaaccuuuucu

SEQ ID NO: 484357 - RNA, 32 nt, Human
uaacaagaaaggagagucuugcagugauuaag

SEQ ID NO: 484358 - RNA, 32 nt, Human
uaacaagacagcacuccagauaggcagccacg

SEQ ID NO: 484359 - RNA, 32 nt, Human
uaacaagaccaucuugucuuucugggguagcc

SEQ ID NO: 484360 - RNA, 32 nt, Human
uaacaagacuccuaccuugagaucuuagucua

SEQ ID NO: 484361 - RNA, 32 nt, Human
uaacaagaggcauuugugcacacacacagggc

SEQ ID NO: 484362 - RNA, 32 nt, Human
uaacaagaucuguagaucugcuauugaaucag

SEQ ID NO: 484363 - RNA, 32 nt, Human
uaacaagauuuucuuaccucucaguuguugaa

SEQ ID NO: 484364 - RNA, 32 nt, Human
uaacaagcaccaacuugccagccauguaaggg

SEQ ID NO: 484365 - RNA, 32 nt, Human
uaacaagcccagcauccccuggggcugugauc

SEQ ID NO: 484366 - RNA, 32 nt, Human
uaacaagccuugcucagucuuacuaacggauc

SEQ ID NO: 484367 - RNA, 23 nt, Human
uaacaaggaaagccccuggagcu

SEQ ID NO: 484368 - RNA, 32 nt, Human
uaacaaggcuguaaagucacacaaaucagcag

SEQ ID NO: 484369 - RNA, 32 nt, Human
uaacaagggacacacagaguuggcagcacaaa

SEQ ID NO: 484370 - RNA, 32 nt, Human
uaacaagggcugagccccagguacagguugcc

SEQ ID NO: 484371 - RNA, 32 nt, Human
uaacaagguucuguguuuuucucaccucauuc

SEQ ID NO: 484372 - RNA, 32 nt, Human
uaacaauacuuacaacuuccauuuuuguaacc

SEQ ID NO: 484373 - RNA, 32 nt, Human
uaacaauccaagaauaaaugauuguaaaagau

SEQ ID NO: 484374 - RNA, 32 nt, Human
uaacaaucuaacacuuucauagaaucauuugg

SEQ ID NO: 484375 - RNA, 32 nt, Human
uaacaaugagcuccucccucccugccuccuug

SEQ ID NO: 484376 - RNA, 32 nt, Human
uaacaaugcagcccucuccacccuccggccag

SEQ ID NO: 484377 - RNA, 32 nt, Human
uaacaaugcauuucaucuagcacuccaguggu

SEQ ID NO: 484378 - RNA, 32 nt, Human
uaacaaugccuuguuguauuccugccuuugau

SEQ ID NO: 484379 - RNA, 32 nt, Human
uaacaauggaagcagaggucagagugaugcaa

SEQ ID NO: 484380 - RNA, 32 nt, Human
uaacaauuauuuuuaaaaggaggaauuuaaau

SEQ ID NO: 484381 - RNA, 32 nt, Human
uaacaauucauccugaaguuucuccaugaauu

SEQ ID NO: 484382 - RNA, 32 nt, Human
uaacaauuuucagaccuguugguauaggaaug

SEQ ID NO: 484383 - RNA, 32 nt, Human
uaacacaaagggcaagagguugcuaugguauu

SEQ ID NO: 484384 - RNA, 32 nt, Human
uaacacaacaaagugggaccaucucuauuccc

SEQ ID NO: 484385 - RNA, 32 nt, Human
uaacacaagcugacucuucccuucccuucucc

SEQ ID NO: 484386 - RNA, 32 nt, Human
uaacacacccagcuaauuuuguauuuuuagua

SEQ ID NO: 484387 - RNA, 32 nt, Human
uaacacacuugagccaucaccaaucagcauag

SEQ ID NO: 484388 - RNA, 32 nt, Human
uaacacagaaacagcuguggauuucuaucaac

SEQ ID NO: 484389 - RNA, 32 nt, Human
uaacacagaaacgcaauaaacacacacaaaau

SEQ ID NO: 484390 - RNA, 32 nt, Human
uaacacagaaagaaaaugggaacuuuacguuu

SEQ ID NO: 484391 - RNA, 32 nt, Human
uaacacagaaaggaaaugggaacuuuacauuu

SEQ ID NO: 484392 - RNA, 32 nt, Human
uaacacagauuugcuggauggaagcugcgugu

SEQ ID NO: 484393 - RNA, 32 nt, Human
uaacacagcagaaccacguggguauuuuagua

SEQ ID NO: 484394 - RNA, 32 nt, Human
uaacacagccugacauaggagagccccuggcu

SEQ ID NO: 484395 - RNA, 32 nt, Human
uaacacagcugcaucuugagcagugaccugcc

SEQ ID NO: 484396 - RNA, 32 nt, Human
uaacacaggagcagaaaaccaaacaccacaug

SEQ ID NO: 484397 - RNA, 32 nt, Human
uaacacaggaugaaacagguucagagagggga

SEQ ID NO: 484398 - RNA, 32 nt, Human
uaacacaguaaauauguacuuguagccuggau

SEQ ID NO: 484399 - RNA, 32 nt, Human
uaacacaguuuucccuuccauauuccucucuu

SEQ ID NO: 484400 - RNA, 32 nt, Human
uaacacaucugaacaggguuagucagcaaaau

SEQ ID NO: 484401 - RNA, 32 nt, Human
uaacacaucugggugucaucggacaccucacc

SEQ ID NO: 484402 - RNA, 32 nt, Human
uaacacaugccuaugauccagcuuuggucaua

SEQ ID NO: 484403 - RNA, 32 nt, Human
uaacacaugccugugguccuagcuacuuggga

SEQ ID NO: 484404 - RNA, 24 nt, Human
uaacaccaaacuaccucucugaua

SEQ ID NO: 484405 - RNA, 32 nt, Human
uaacaccaccagaaagugaacagggaaaauaa

SEQ ID NO: 484406 - RNA, 32 nt, Human
uaacaccacggcacuucagccugggugacaga

SEQ ID NO: 484407 - RNA, 32 nt, Human
uaacaccacugcacuccaaccugggcaacaga

SEQ ID NO: 484408 - RNA, 32 nt, Human
uaacaccauggaccagccccgaagagacaucu

SEQ ID NO: 484409 - RNA, 32 nt, Human
uaacaccauuagcuuuugugaucugguuaaga

SEQ ID NO: 484410 - RNA, 32 nt, Human
uaacacccagcccagugguucuuucauagaug

SEQ ID NO: 484411 - RNA, 32 nt, Human
uaacaccccacacccaacccacgccaugcccc

SEQ ID NO: 484412 - RNA, 32 nt, Human
uaacacccccuucccagccucugggaaaaucg

SEQ ID NO: 484413 - RNA, 32 nt, Human
uaacaccccuuccugagguucccuucaccccu

SEQ ID NO: 484414 - RNA, 32 nt, Human
uaacaccuccagguucucuaaguucuggggag

SEQ ID NO: 484415 - RNA, 32 nt, Human
uaacaccucccugcugccccucccucucucuc

SEQ ID NO: 484416 - RNA, 32 nt, Human
uaacaccugccugccggcccaccugcagcccg

SEQ ID NO: 484417 - RNA, 32 nt, Human
uaacaccuguaaucccaacaguucgggaggca

SEQ ID NO: 484418 - RNA, 32 nt, Human
uaacaccuguaaucccagcacuuugggaggcu

SEQ ID NO: 484419 - RNA, 32 nt, Human
uaacaccugugucucauuccucccucucugcc

SEQ ID NO: 484420 - RNA, 32 nt, Human
uaacaccuucaugaugacaacacugccucgcg

SEQ ID NO: 484421 - RNA, 32 nt, Human
uaacaccuugguguccugggccccagaguucc

SEQ ID NO: 484422 - RNA, 32 nt, Human
uaacacgggggaggggcaggagagggauaugg

SEQ ID NO: 484423 - RNA, 32 nt, Human
uaacacgucauuuccuuuuuguauuuuuaaac

SEQ ID NO: 484424 - RNA, 32 nt, Human
uaacacuacugcauuccagccugggugacaga

SEQ ID NO: 484425 - RNA, 32 nt, Human
uaacacuaguauuuguuaaaugggguauuuuu

SEQ ID NO: 484426 - RNA, 32 nt, Human
uaacacucaaauauuaacauuuuagguuucuc

SEQ ID NO: 484427 - RNA, 32 nt, Human
uaacacucacugcaaaggucugcaacuucacu

SEQ ID NO: 484428 - RNA, 32 nt, Human
uaacacugaacaaaggcuucacuuguccucau

SEQ ID NO: 484429 - RNA, 32 nt, Human
uaacacugaccuuggacuggauuugcagggca

SEQ ID NO: 484430 - RNA, 32 nt, Human
uaacacugaccuuuuauaauuugaugucucaa

SEQ ID NO: 484431 - RNA, 32 nt, Human
uaacacugagguagcucucuucaucuuauuug

SEQ ID NO: 484432 - RNA, 32 nt, Human
uaacacugcacuccaggcuggacaacacagca

SEQ ID NO: 484433 - RNA, 32 nt, Human
uaacacuucaaaaugcauuuuaucauaauuua

SEQ ID NO: 484434 - RNA, 32 nt, Human
uaacacuugccuguaaucagugaagggcugug

SEQ ID NO: 484435 - RNA, 32 nt, Human
uaacacuuuaagggccccaggucuccacugcc

SEQ ID NO: 484436 - RNA, 32 nt, Human
uaacacuuugggaggccaaggugggaagauug

SEQ ID NO: 484437 - RNA, 32 nt, Human
uaacacuuugggaggccuagacaggaggauug

SEQ ID NO: 484438 - RNA, 32 nt, Human
uaacacuuugggaggccuaggugggaggauug

SEQ ID NO: 484439 - RNA, 32 nt, Human
uaacacuuugggaggcugaggugggcggauca

SEQ ID NO: 484440 - RNA, 32 nt, Human
uaacagaaaaacacaaaauuucaaccauucuu

SEQ ID NO: 484441 - RNA, 32 nt, Human
uaacagaaaaauuguuccucuaagagucccaa

SEQ ID NO: 484442 - RNA, 32 nt, Human
uaacagaaacaucuuuaggauauuuuugucug

SEQ ID NO: 484443 - RNA, 32 nt, Human
uaacagaaacuauccugggauuaggugaaaaa

SEQ ID NO: 484444 - RNA, 32 nt, Human
uaacagaaagauaguccaggugcagugucuuu

SEQ ID NO: 484445 - RNA, 32 nt, Human
uaacagaagagaagacuguggagccagcuacc

SEQ ID NO: 484446 - RNA, 32 nt, Human
uaacagaauuaguuuggggaauacucauuuuu

SEQ ID NO: 484447 - RNA, 32 nt, Human
uaacagacaagucccauauuuugucaguagau

SEQ ID NO: 484448 - RNA, 32 nt, Human
uaacagacuuucaacagaggacugucuuauuc

SEQ ID NO: 484449 - RNA, 32 nt, Human
uaacagagacgggguuucaccauguuggccag

SEQ ID NO: 484450 - RNA, 32 nt, Human
uaacagaucaaauuggaugaaauauauaauua

SEQ ID NO: 484451 - RNA, 32 nt, Human
uaacagauccaaagagguccagaaggaaugac

SEQ ID NO: 484452 - RNA, 32 nt, Human
uaacagauggccagggugggaggcaggcagcu

SEQ ID NO: 484453 - RNA, 32 nt, Human
uaacagauugacugcagaaacaggucaagcuu

SEQ ID NO: 484454 - RNA, 32 nt, Human
uaacagcaaacaguagcagcagcaugcaccaa

SEQ ID NO: 484455 - RNA, 32 nt, Human
uaacagcacagcuucugagaaggcagagagaa

SEQ ID NO: 484456 - RNA, 32 nt, Human
uaacagcaccaaaucaaaaucucuccacuuuc

SEQ ID NO: 484457 - RNA, 32 nt, Human
uaacagcagaguaacauaaaauaaaaguacau

SEQ ID NO: 484458 - RNA, 32 nt, Human
uaacagcagcagagggaggugggggagaggga

SEQ ID NO: 484459 - RNA, 32 nt, Human
uaacagcagcagcggcaacggcagcagcagca

SEQ ID NO: 484460 - RNA, 32 nt, Human
uaacagcaguaggagagugaguuuuggggcca

SEQ ID NO: 484461 - RNA, 32 nt, Human
uaacagccacuccaacucuccaccuccagcuu

SEQ ID NO: 484462 - RNA, 32 nt, Human
uaacagccccaaggagcagcaggcaugggucc

SEQ ID NO: 484463 - RNA, 31 nt, Human
uaacagcgucagagagaaagaacugacugaa

SEQ ID NO: 484464 - RNA, 32 nt, Human
uaacagcuauguuugcaauagagacauuugga

SEQ ID NO: 484465 - RNA, 32 nt, Human
uaacagcucacugcagucuugaacuccugggc

SEQ ID NO: 484466 - RNA, 32 nt, Human
uaacagcucuccaagcccuuggggugacucgg

SEQ ID NO: 484467 - RNA, 32 nt, Human
uaacagcugugguuuccagugggaguccuggu

SEQ ID NO: 484468 - RNA, 32 nt, Human
uaacagcuucccacucaaccagucuccccaaa

SEQ ID NO: 484469 - RNA, 32 nt, Human
uaacagcuucucuauuugauauuugaaauucu

SEQ ID NO: 484470 - RNA, 32 nt, Human
uaacagcuugaacauuaugaaaugcuaaguuu

SEQ ID NO: 484471 - RNA, 21 nt, Human
uaacagcuuuggcucuacuca

SEQ ID NO: 484472 - RNA, 32 nt, Human
uaacaggaacuuccagccuccagccuacuuag

SEQ ID NO: 484473 - RNA, 32 nt, Human
uaacaggaccaacagggcuuaagcccagacuu

SEQ ID NO: 484474 - RNA, 32 nt, Human
uaacaggagggaggggaagaaggaaguuucca

SEQ ID NO: 484475 - RNA, 32 nt, Human
uaacaggaucuaagaugaccaucaggagaagg

SEQ ID NO: 484476 - RNA, 32 nt, Human
uaacaggcagaacaugggagaauccuuauucc

SEQ ID NO: 484477 - RNA, 32 nt, Human
uaacaggccaccccaaaccucagagggcgaaa

SEQ ID NO: 484478 - RNA, 32 nt, Human
uaacaggccgugguuaggaaggacggagaagg

SEQ ID NO: 484479 - RNA, 32 nt, Human
uaacagggaaauagaguuacaguucuugccua

SEQ ID NO: 484480 - RNA, 32 nt, Human
uaacagggagaggaugggggaggggacaaauu

SEQ ID NO: 484481 - RNA, 32 nt, Human
uaacaggggcugggcugccuuuuucuaccuug

SEQ ID NO: 484482 - RNA, 32 nt, Human
uaacagggugcugauagaugggccacauaaca

SEQ ID NO: 484483 - RNA, 32 nt, Human
uaacaggugccuucacuuuugagacuuagugc

SEQ ID NO: 484484 - RNA, 32 nt, Human
uaacaguaaaccccauacgcaggugggaggga

SEQ ID NO: 484485 - RNA, 31 nt, Human
uaacaguacagcuagaaaccaagagcugucg

SEQ ID NO: 484486 - RNA, 32 nt, Human
uaacaguaccaaaucaaaaucucuccacuucc

SEQ ID NO: 484487 - RNA, 32 nt, Human
uaacaguaccuagagagagagugugugugagu

SEQ ID NO: 484488 - RNA, 32 nt, Human
uaacaguauuauaaaaucaaaauauggguaaa

SEQ ID NO: 484489 - RNA, 32 nt, Human
uaacagucucugcuuugccuucugccugguag

SEQ ID NO: 484490 - RNA, 32 nt, Human
uaacagugcacaaggugggaaaagccagcuca

SEQ ID NO: 484491 - RNA, 32 nt, Human
uaacaguggggaggggacaucuggcagcaucu

SEQ ID NO: 484492 - RNA, 31 nt, Human
uaacagugggugggaaagguagaggccugug

SEQ ID NO: 484493 - RNA, 32 nt, Human
uaacaguuaucuuugacucucuugccuguuau

SEQ ID NO: 484494 - RNA, 32 nt, Human
uaacaguucccuguuaaaaugaaaaucuuagg

SEQ ID NO: 484495 - RNA, 32 nt, Human
uaacauaaaauuaugauaguuuguuuuaauag

SEQ ID NO: 484496 - RNA, 32 nt, Human
uaacauacuguagcuuuuucucccuugggggc

SEQ ID NO: 484497 - RNA, 32 nt, Human
uaacauacuguugauaucaagaaccuguuuag

SEQ ID NO: 484498 - RNA, 32 nt, Human
uaacauagaugugugggaauauuacuucuugu

SEQ ID NO: 484499 - RNA, 32 nt, Human
uaacauagugucugcugcugccucccugggga

SEQ ID NO: 484500 - RNA, 32 nt, Human
uaacauagugugaaugaaagucuggccaacag

SEQ ID NO: 484501 - RNA, 32 nt, Human
uaacauaucaaggagcucuucuagcuaaauga

SEQ ID NO: 484502 - RNA, 32 nt, Human
uaacauaugccuggacauccugaaggagaagu

SEQ ID NO: 484503 - RNA, 32 nt, Human
uaacauauuagcugcccuaaaugaucuuggag

SEQ ID NO: 484504 - RNA, 32 nt, Human
uaacaucagagccaccacuucucagugucagu

SEQ ID NO: 484505 - RNA, 32 nt, Human
uaacaucaggcgaucugccugccuuggcaucc

SEQ ID NO: 484506 - RNA, 32 nt, Human
uaacaucaucaguauugaagcauuuuauaaau

SEQ ID NO: 484507 - RNA, 32 nt, Human
uaacaucauuuuucuuuucuucuugcauuuug

SEQ ID NO: 484508 - RNA, 32 nt, Human
uaacaucccacugugaacauuaggcagaucaa

SEQ ID NO: 484509 - RNA, 32 nt, Human
uaacaucccaugugccucaccuaauaaaaugg

SEQ ID NO: 484510 - RNA, 32 nt, Human
uaacauccucaccuuuccuucucaccuguccu

SEQ ID NO: 484511 - RNA, 32 nt, Human
uaacauccuccugccugaaaacaaauaggucc

SEQ ID NO: 484512 - RNA, 32 nt, Human
uaacaucucaagcuacuaauuuugccaaccuu

SEQ ID NO: 484513 - RNA, 32 nt, Human
uaacaucucagguuuuuaucuugucuuaaauu

SEQ ID NO: 484514 - RNA, 32 nt, Human
uaacaucuccaucccuuugaugccucauccau

SEQ ID NO: 484515 - RNA, 32 nt, Human
uaacaucugaggugaccaagaggcagaagagc

SEQ ID NO: 484516 - RNA, 32 nt, Human
uaacaucugugcaagccccuuuccaggauucu

SEQ ID NO: 484517 - RNA, 32 nt, Human
uaacaucuucuuuccuaugcccucucugugga

SEQ ID NO: 484518 - RNA, 32 nt, Human
uaacaucuuuggagaaagugauacaagagcuu

SEQ ID NO: 484519 - RNA, 32 nt, Human
uaacaugaagcacaauggauuuacagcucuag

SEQ ID NO: 484520 - RNA, 32 nt, Human
uaacaugagaccaaaacuauguucuuugauua

SEQ ID NO: 484521 - RNA, 32 nt, Human
uaacaugaguaagaugaacuggaacacaaaau

SEQ ID NO: 484522 - RNA, 32 nt, Human
uaacaugcacagcuccauauccuggaagccuc

SEQ ID NO: 484523 - RNA, 32 nt, Human
uaacaugcuaacuuuccacacauggcugcauu

SEQ ID NO: 484524 - RNA, 31 nt, Human
uaacaugcuaucauaguacauuuagaaugau

SEQ ID NO: 484525 - RNA, 32 nt, Human
uaacaugcugcaauucaggagcugguuagaac

SEQ ID NO: 484526 - RNA, 32 nt, Human
uaacaugcuuucaaaguacuguguauuucaca

SEQ ID NO: 484527 - RNA, 32 nt, Human
uaacauggacugcuucaucugcuguauccucu

SEQ ID NO: 484528 - RNA, 32 nt, Human
uaacauggagugauuuccaagauagaugguua

SEQ ID NO: 484529 - RNA, 32 nt, Human
uaacauggauauuuucuugugugucuuuaaag

SEQ ID NO: 484530 - RNA, 29 nt, Human
uaacauggauuucaucuuucaugagaaac

SEQ ID NO: 484531 - RNA, 32 nt, Human
uaacaugggacaugccuuucuuuuccgaucag

SEQ ID NO: 484532 - RNA, 19 nt, Human
uaacauggugaaaccccgu

SEQ ID NO: 484533 - RNA, 20 nt, Human
uaacauggugaaacccgcgu

SEQ ID NO: 484534 - RNA, 32 nt, Human
uaacauggugaaacccuguuucugcuagaagu

SEQ ID NO: 484535 - RNA, 32 nt, Human
uaacauggugacuugcucacagccucacugga

SEQ ID NO: 484536 - RNA, 32 nt, Human
uaacauguauacaaaguaaauucuuagccagg

SEQ ID NO: 484537 - RNA, 32 nt, Human
uaacauguauacuagaaaacaaaaagauguua

SEQ ID NO: 484538 - RNA, 32 nt, Human
uaacauguauauguguacacaugccuauucug

SEQ ID NO: 484539 - RNA, 32 nt, Human
uaacaugucaagaagacuuuauaguaagcaca

SEQ ID NO: 484540 - RNA, 32 nt, Human
uaacaugugccagccaggcagagucuugugcu

SEQ ID NO: 484541 - RNA, 32 nt, Human
uaacauguugagucucugagagugcaaaacuu

SEQ ID NO: 484542 - RNA, 32 nt, Human
uaacauguugcaggaaaacacucuccccuuau

SEQ ID NO: 484543 - RNA, 32 nt, Human
uaacauguugggaggccaaggcuggcagauca

SEQ ID NO: 484544 - RNA, 32 nt, Human
uaacauuaaagagaaaaugcugcuauccguga

SEQ ID NO: 484545 - RNA, 32 nt, Human
uaacauuaagaaaauauuuaacucccuguaac

SEQ ID NO: 484546 - RNA, 32 nt, Human
uaacauuacccuccaagguugcaccugucuaa

SEQ ID NO: 484547 - RNA, 32 nt, Human
uaacauuagauccaaagugcauugguucagug

SEQ ID NO: 484548 - RNA, 32 nt, Human
uaacauuaucaucugcaguuacuguuuacaag

SEQ ID NO: 484549 - RNA, 32 nt, Human
uaacauuauuuaccaucuugcauauguauagu

SEQ ID NO: 484550 - RNA, 31 nt, Human
uaacauucaauaaauagcuauaugaaaucaa

SEQ ID NO: 484551 - RNA, 32 nt, Human
uaacauucaauaaauagcuauaugaaaucaaa

SEQ ID NO: 484552 - RNA, 32 nt, Human
uaacauucacuuauggauucaugauggcugua

SEQ ID NO: 484553 - RNA, 32 nt, Human
uaacauucagaauauagcauugguugccuauu

SEQ ID NO: 484554 - RNA, 32 nt, Human
uaacauuccuucuguaccuguaguucaugcgg

SEQ ID NO: 484555 - RNA, 32 nt, Human
uaacauugaugaaccuugaaaauaugcuaagu

SEQ ID NO: 484556 - RNA, 32 nt, Human
uaacauuggucagcagaugacacuggugacuu

SEQ ID NO: 484557 - RNA, 32 nt, Human
uaacauuguaaugcaaguucuacaaugauaau

SEQ ID NO: 484558 - RNA, 32 nt, Human
uaacauuguguuagcuuuuauuuccuggauag

SEQ ID NO: 484559 - RNA, 32 nt, Human
uaacauuuacuuuugcucccuaccugacugcc

SEQ ID NO: 484560 - RNA, 32 nt, Human
uaacauuuauuucucacaguccuggagacugg

SEQ ID NO: 484561 - RNA, 32 nt, Human
uaacauuucacacaaaaggaaaaugaggcuga

SEQ ID NO: 484562 - RNA, 32 nt, Human
uaacauuucucuccaccuuaguacuuuagacu

SEQ ID NO: 484563 - RNA, 32 nt, Human
uaacauuugcaaaauggaaauguaauaauaau

SEQ ID NO: 484564 - RNA, 32 nt, Human
uaaccaaacuacucccuaauccuugaaaaucc

SEQ ID NO: 484565 - RNA, 32 nt, Human
uaaccaaacuggaggcuggcaugggagaagug

SEQ ID NO: 484566 - RNA, 32 nt, Human
uaaccaaaggaaacugguuugagaaaauugug

SEQ ID NO: 484567 - RNA, 32 nt, Human
uaaccaaaugucaaaaugcuaauagucuguuc

SEQ ID NO: 484568 - RNA, 32 nt, Human
uaaccaacauggugaaaccccgucucuacaaa

SEQ ID NO: 484569 - RNA, 32 nt, Human
uaaccaacggcaagcugccacugugggcaaag

SEQ ID NO: 484570 - RNA, 32 nt, Human
uaaccaagagcucaggucacacagaccuugga

SEQ ID NO: 484571 - RNA, 32 nt, Human
uaaccaagcuaaauuauuuccauuuagccaug

SEQ ID NO: 484572 - RNA, 32 nt, Human
uaaccaagcuauucaaguauuccuaugccaga

SEQ ID NO: 484573 - RNA, 32 nt, Human
uaaccaaguaaagaagugagaacaaagugaga

SEQ ID NO: 484574 - RNA, 32 nt, Human
uaaccaaucugugcaacaacauagacugaccu

SEQ ID NO: 484575 - RNA, 32 nt, Human
uaaccaauuccagucugguccaugaagaggaa

SEQ ID NO: 484576 - RNA, 32 nt, Human
uaaccacaaaggacaagcagcucagagauuag

SEQ ID NO: 484577 - RNA, 32 nt, Human
uaaccacaagcuccagaugggcuguuuacccc

SEQ ID NO: 484578 - RNA, 32 nt, Human
uaaccacaagggauuguccugacaacuugugg

SEQ ID NO: 484579 - RNA, 21 nt, Human
uaaccacacacacucagagga

SEQ ID NO: 484580 - RNA, 32 nt, Human
uaaccacacagccugagccuggcccagccucg

SEQ ID NO: 484581 - RNA, 32 nt, Human
uaaccacaguuaauuucagcuuuuggcaggaa

SEQ ID NO: 484582 - RNA, 32 nt, Human
uaaccaccaacugcccuuauuccggcugggac

SEQ ID NO: 484583 - RNA, 32 nt, Human
uaaccaccagccaugaauucagugaacucuuu

SEQ ID NO: 484584 - RNA, 32 nt, Human
uaaccaccaggcacaaauucaccaggaacaac

SEQ ID NO: 484585 - RNA, 32 nt, Human
uaaccaccugcuucccacucagccugcaauag

SEQ ID NO: 484586 - RNA, 32 nt, Human
uaaccaccugcuuuguaggcaccagaaacuca

SEQ ID NO: 484587 - RNA, 32 nt, Human
uaaccacuacccuuuaaaguucauggggcaau

SEQ ID NO: 484588 - RNA, 32 nt, Human
uaaccacuccucccgccugauggccaagagag

SEQ ID NO: 484589 - RNA, 32 nt, Human
uaaccacugcacuccaaccugggcaacauggc

SEQ ID NO: 484590 - RNA, 32 nt, Human
uaaccacuuaaccucucagaacugaacaaaga

SEQ ID NO: 484591 - RNA, 32 nt, Human
uaaccacuucaggugcagcuugugcgagggua

SEQ ID NO: 484592 - RNA, 32 nt, Human
uaaccagaacuaaggguaugaaggaccuguau

SEQ ID NO: 484593 - RNA, 32 nt, Human
uaaccagaccuccagccacucacagcucuuuu

SEQ ID NO: 484594 - RNA, 32 nt, Human
uaaccagagagggacugugagcugccagccua

SEQ ID NO: 484595 - RNA, 32 nt, Human
uaaccagauagggcuguguccaggaacuccag

SEQ ID NO: 484596 - RNA, 32 nt, Human
uaaccagcauuacugcaccucuuguuagacuc

SEQ ID NO: 484597 - RNA, 32 nt, Human
uaaccagccacucaaacugaugcagugccuag

SEQ ID NO: 484598 - RNA, 32 nt, Human
uaaccagccacugcagcccuccagcucuggcc

SEQ ID NO: 484599 - RNA, 24 nt, Human
uaaccagccucaaagcuuggcaaa

SEQ ID NO: 484600 - RNA, 32 nt, Human
uaaccagcucuucccagcuggcugggacuguc

SEQ ID NO: 484601 - RNA, 32 nt, Human
uaaccaggaucaggcaggagggcagggauggu

SEQ ID NO: 484602 - RNA, 32 nt, Human
uaaccagggaggaugcccaugacugcugaccc

SEQ ID NO: 484603 - RNA, 32 nt, Human
uaaccagggaugggcuuuugcauggcacugac

SEQ ID NO: 484604 - RNA, 32 nt, Human
uaaccagggcucccagaagcuuugcuuaugua

SEQ ID NO: 484605 - RNA, 31 nt, Human
uaaccaggggcaccuguuugagcuggaggug

SEQ ID NO: 484606 - RNA, 32 nt, Human
uaaccaggguggugagggcacuaaucuuguag

SEQ ID NO: 484607 - RNA, 21 nt, Human
uaaccagguaauauuggcaaa

SEQ ID NO: 484608 - RNA, 32 nt, Human
uaaccagguaccacauucauuguuaaggaaug

SEQ ID NO: 484609 - RNA, 32 nt, Human
uaaccagguauaggccagaaaggagguggccc

SEQ ID NO: 484610 - RNA, 32 nt, Human
uaaccaggucaucagggacccauuguucucuu

SEQ ID NO: 484611 - RNA, 32 nt, Human
uaaccaguccagcauucuuagaacagaugggu

SEQ ID NO: 484612 - RNA, 32 nt, Human
uaaccaguuguucaacagcggguuaagcucag

SEQ ID NO: 484613 - RNA, 32 nt, Human
uaaccauagcuaucauguguuucccaaaucuu

SEQ ID NO: 484614 - RNA, 32 nt, Human
uaaccauaguacaggaugauuucuguccacac

SEQ ID NO: 484615 - RNA, 32 nt, Human
uaaccauauuugcuaaucuaagccauauugcg

SEQ ID NO: 484616 - RNA, 32 nt, Human
uaaccaucacagcaacaugccugcuaaauuuu

SEQ ID NO: 484617 - RNA, 32 nt, Human
uaaccaucucauuccuacuuuuauaacuauua

SEQ ID NO: 484618 - RNA, 32 nt, Human
uaaccaucugcucccaggcugugugcagaaaa

SEQ ID NO: 484619 - RNA, 32 nt, Human
uaaccaugggaagugaccaagcaaagacacuc

SEQ ID NO: 484620 - RNA, 31 nt, Human
uaaccauggucaaaagaccauucuguccuau

SEQ ID NO: 484621 - RNA, 22 nt, Human
uaaccaugugugguggugugca

SEQ ID NO: 484622 - RNA, 32 nt, Human
uaaccauguuggccaggauggucucgaucucu

SEQ ID NO: 484623 - RNA, 32 nt, Human
uaaccauuaaccauuucuuccuggugauuccu

SEQ ID NO: 484624 - RNA, 32 nt, Human
uaaccauugggaagguagaggcuggcagggaa

SEQ ID NO: 484625 - RNA, 32 nt, Human
uaacccaaaaggcggagguugcagugagccaa

SEQ ID NO: 484626 - RNA, 32 nt, Human
uaacccaaggaauugaggaaguugcugagaag

SEQ ID NO: 484627 - RNA, 32 nt, Human
uaacccaaggaccacaccagugccugauuucu

SEQ ID NO: 484628 - RNA, 32 nt, Human
uaacccacagaauccaaggagcauggcuggcc

SEQ ID NO: 484629 - RNA, 32 nt, Human
uaacccacaguucugucaccuaaagguaacug

SEQ ID NO: 484630 - RNA, 32 nt, Human
uaacccacgguguugcucauucucucacguua

SEQ ID NO: 484631 - RNA, 32 nt, Human
uaacccagagcugaugggugauaggaaaaugg

SEQ ID NO: 484632 - RNA, 32 nt, Human
uaacccagcuacucaggaggcugaggcacaag

SEQ ID NO: 484633 - RNA, 32 nt, Human
uaacccagcuacucgggaggcugaagcaggag

SEQ ID NO: 484634 - RNA, 32 nt, Human
uaacccagcuacucgugaggccaaggcaggag

SEQ ID NO: 484635 - RNA, 32 nt, Human
uaacccaggaccuuggaaauucuacucauccc

SEQ ID NO: 484636 - RNA, 32 nt, Human
uaacccaggaggcagagguugcagugagcuga

SEQ ID NO: 484637 - RNA, 32 nt, Human
uaacccaggcagugggaggucugcagccuggu

SEQ ID NO: 484638 - RNA, 32 nt, Human
uaacccaggccugucugacuacuuugccuucu

SEQ ID NO: 484639 - RNA, 32 nt, Human
uaacccaggccuuucaucagagcccaggaggg

SEQ ID NO: 484640 - RNA, 32 nt, Human
uaacccaggcgaggaggaggaggagaaaauuc

SEQ ID NO: 484641 - RNA, 32 nt, Human
uaacccaguucugcaccacugguuuuuguagc

SEQ ID NO: 484642 - RNA, 32 nt, Human
uaacccauugugcuuccaggacagcucacaau

SEQ ID NO: 484643 - RNA, 32 nt, Human
uaaccccaacgcacaggaaaagguagcuuacc

SEQ ID NO: 484644 - RNA, 32 nt, Human
uaaccccaacuacuuggguggcugaggcagga

SEQ ID NO: 484645 - RNA, 32 nt, Human
uaaccccaccuugccaagcuuucuucuacaac

SEQ ID NO: 484646 - RNA, 32 nt, Human
uaaccccacucccucugcugcagcacccccau

SEQ ID NO: 484647 - RNA, 32 nt, Human
uaaccccacugugcuuccacaugccuggccua

SEQ ID NO: 484648 - RNA, 32 nt, Human
uaaccccagcacuucgggaggcugaggugggc

SEQ ID NO: 484649 - RNA, 32 nt, Human
uaaccccagcacuuugggaggccgaggcgggc

SEQ ID NO: 484650 - RNA, 32 nt, Human
uaaccccagcacuuugggaggccgaggcgggu

SEQ ID NO: 484651 - RNA, 32 nt, Human
uaaccccagcacuuugggaggccgaggugggc

SEQ ID NO: 484652 - RNA, 32 nt, Human
uaaccccagcacuuugggaggcugagacaggc

SEQ ID NO: 484653 - RNA, 32 nt, Human
uaaccccagcacuuugggaggcugagaugggc

SEQ ID NO: 484654 - RNA, 32 nt, Human
uaaccccagcacuuugggaggcugaggcgggc

SEQ ID NO: 484655 - RNA, 32 nt, Human
uaaccccagcacuuugggaggcugaggugggu

SEQ ID NO: 484656 - RNA, 32 nt, Human
uaaccccagcuacuagggaggcugaggcagga

SEQ ID NO: 484657 - RNA, 32 nt, Human
uaaccccagcuacucgggaggcugaggcagga

SEQ ID NO: 484658 - RNA, 32 nt, Human
uaaccccagcuacuugggaggcugaggaggga

SEQ ID NO: 484659 - RNA, 32 nt, Human
uaaccccagcuauucgggaggcugaggcagga

SEQ ID NO: 484660 - RNA, 32 nt, Human
uaaccccagcuauuugggaggcugaggcagua

SEQ ID NO: 484661 - RNA, 32 nt, Human
uaaccccaggacucagaagugaaggaaaaaug

SEQ ID NO: 484662 - RNA, 32 nt, Human
uaaccccaggagguggggguuguugugagcca

SEQ ID NO: 484663 - RNA, 32 nt, Human
uaaccccaggcagaccgauaaaaagaccucca

SEQ ID NO: 484664 - RNA, 32 nt, Human
uaaccccagguaaauguuuuauauagaggauc

SEQ ID NO: 484665 - RNA, 32 nt, Human
uaaccccaguaggaagugauugaggcaugagu

SEQ ID NO: 484666 - RNA, 32 nt, Human
uaacccccacccaacccagcuccugcugcugu

SEQ ID NO: 484667 - RNA, 32 nt, Human
uaacccccaggaucagagauggagucucgcuc

SEQ ID NO: 484668 - RNA, 32 nt, Human
uaacccccggcucuccccugccccaccucacc

SEQ ID NO: 484669 - RNA, 32 nt, Human
uaacccccucauucucccucgcucccacuccg

SEQ ID NO: 484670 - RNA, 32 nt, Human
uaacccccucccccuucauuacuucacucagg

SEQ ID NO: 484671 - RNA, 32 nt, Human
uaacccccuccccucgcugcugggccccaucu

SEQ ID NO: 484672 - RNA, 32 nt, Human
uaacccccucugcuucuggugugugacgaggc

SEQ ID NO: 484673 - RNA, 32 nt, Human
uaaccccggcacuccggacagagcugggccug

SEQ ID NO: 484674 - RNA, 32 nt, Human
uaaccccgggacuccccaagcccagccucugu

SEQ ID NO: 484675 - RNA, 32 nt, Human
uaaccccuaaaccaucccccacccuaacccaa

SEQ ID NO: 484676 - RNA, 32 nt, Human
uaaccccuccauccucucuaacuuuucaagcc

SEQ ID NO: 484677 - RNA, 32 nt, Human
uaaccccuccuacccucuaccucuucccgaag

SEQ ID NO: 484678 - RNA, 32 nt, Human
uaaccccugucuucuuccccaggccucugacu

SEQ ID NO: 484679 - RNA, 32 nt, Human
uaaccccuguuggaguccaggggcuggagaaa

SEQ ID NO: 484680 - RNA, 32 nt, Human
uaacccgccagccuccuccucucgggcuggau

SEQ ID NO: 484681 - RNA, 32 nt, Human
uaacccgccgguuuuaccgugcuuuauuccug

SEQ ID NO: 484682 - RNA, 32 nt, Human
uaacccggaagguggaguuugcagugagccga

SEQ ID NO: 484683 - RNA, 32 nt, Human
uaacccgggagguggagguugcagugagcuga

SEQ ID NO: 484684 - RNA, 32 nt, Human
uaacccgggcuggcgcugcuaaccucacccaa

SEQ ID NO: 484685 - RNA, 32 nt, Human
uaacccuaaacacaucauguauuuuaaaugcc

SEQ ID NO: 484686 - RNA, 32 nt, Human
uaacccuacacccagaccccaggcuggacaug

SEQ ID NO: 484687 - RNA, 32 nt, Human
uaacccuagugaguuuucaguugugauuauuc

SEQ ID NO: 484688 - RNA, 32 nt, Human
uaacccucgcacuuucuccacuguggagaugg

SEQ ID NO: 484689 - RNA, 32 nt, Human
uaacccucugcuugcauuuacucucaucaaac

SEQ ID NO: 484690 - RNA, 32 nt, Human
uaacccucuugccaccaaauaccacacacacu

SEQ ID NO: 484691 - RNA, 32 nt, Human
uaacccugacccuccccauuuccccagcuugg

SEQ ID NO: 484692 - RNA, 32 nt, Human
uaacccugagaagcucugcugucuggggcaag

SEQ ID NO: 484693 - RNA, 32 nt, Human
uaacccugcauccaaauuccaggaagcucuua

SEQ ID NO: 484694 - RNA, 32 nt, Human
uaacccugccaguuucuccauccagcucacgc

SEQ ID NO: 484695 - RNA, 31 nt, Human
uaacccugccucucagaggguuuucucuccc

SEQ ID NO: 484696 - RNA, 32 nt, Human
uaacccugcgugucugugucacccuguuuguc

SEQ ID NO: 484697 - RNA, 32 nt, Human
uaacccugggggcggccauguuguccaggccc

SEQ ID NO: 484698 - RNA, 32 nt, Human
uaacccugguggacugcagccuucaucuuuau

SEQ ID NO: 484699 - RNA, 32 nt, Human
uaacccuguacaaagaggaauggagauugccu

SEQ ID NO: 484700 - RNA, 31 nt, Human
uaacccugucuaaugaaaccugugucucuga

SEQ ID NO: 484701 - RNA, 32 nt, Human
uaacccuuccuuguaucugucuucccaggaga

SEQ ID NO: 484702 - RNA, 32 nt, Human
uaacccuugaagcagcaugucuuugccauagc

SEQ ID NO: 484703 - RNA, 32 nt, Human
uaacccuugccuuccugucacaggguuugcuu

SEQ ID NO: 484704 - RNA, 32 nt, Human
uaacccuuguguuguguguuucugucugagga

SEQ ID NO: 484705 - RNA, 32 nt, Human
uaacccuuuccauuuccucucauuccauucau

SEQ ID NO: 484706 - RNA, 18 nt, Human
uaaccgcauuccauugaa

SEQ ID NO: 484707 - RNA, 32 nt, Human
uaaccgcccagagggcuccagguccgcaagcu

SEQ ID NO: 484708 - RNA, 32 nt, Human
uaaccgcucuaaaaauuaccagaguaagaaaa

SEQ ID NO: 484709 - RNA, 32 nt, Human
uaaccggaggcaggcugggugcaguggcucau

SEQ ID NO: 484710 - RNA, 32 nt, Human
uaaccgggcuccagccccagacccucuagcuc

SEQ ID NO: 484711 - RNA, 32 nt, Human
uaaccgucacucagcacaacacucccucuggg

SEQ ID NO: 484712 - RNA, 31 nt, Human
uaaccgugacuucccagccuccagagcugua

SEQ ID NO: 484713 - RNA, 32 nt, Human
uaaccuaacagcuuuggagauggcgguggaga

SEQ ID NO: 484714 - RNA, 32 nt, Human
uaaccuagacuaaaauugggaacuuauuugca

SEQ ID NO: 484715 - RNA, 32 nt, Human
uaaccuagcuucuuuuuacucuugccucugcu

SEQ ID NO: 484716 - RNA, 32 nt, Human
uaaccuaggcagugggaggcaaaugggauggu

SEQ ID NO: 484717 - RNA, 32 nt, Human
uaaccuaggugcugccuggcccccaggcccuc

SEQ ID NO: 484718 - RNA, 32 nt, Human
uaaccuauaacccccaacaguaugacagaaaa

SEQ ID NO: 484719 - RNA, 32 nt, Human
uaaccuauaagcugcccguggcagacguuuac

SEQ ID NO: 484720 - RNA, 32 nt, Human
uaaccuaugcaguaagauucugucuuuguaaa

SEQ ID NO: 484721 - RNA, 32 nt, Human
uaaccucagagccaggagccuggggcuggggc

SEQ ID NO: 484722 - RNA, 32 nt, Human
uaaccucagcacuuugggaggcugaggugggc

SEQ ID NO: 484723 - RNA, 32 nt, Human
uaaccucagccuauaucugucuaucuaaccua

SEQ ID NO: 484724 - RNA, 32 nt, Human
uaaccucagcuacuugggaggcugaggcagga

SEQ ID NO: 484725 - RNA, 32 nt, Human
uaaccucaucuucuucaccauuuggcaaugcc

SEQ ID NO: 484726 - RNA, 32 nt, Human
uaaccuccaaagccacacaggaggcugccagc

SEQ ID NO: 484727 - RNA, 32 nt, Human
uaaccuccaaguuuaaaacuacagucaggcau

SEQ ID NO: 484728 - RNA, 32 nt, Human
uaaccuccacuuccuucucugccccauugccu

SEQ ID NO: 484729 - RNA, 32 nt, Human
uaaccuccagccuccugcccagcacaggaauc

SEQ ID NO: 484730 - RNA, 25 nt, Human
uaaccucccccuaccuaggacccuu

SEQ ID NO: 484731 - RNA, 32 nt, Human
uaaccucuacagacacaauccucaaaccaaca

SEQ ID NO: 484732 - RNA, 32 nt, Human
uaaccucucaacuuuuauugcuguauucuagu

SEQ ID NO: 484733 - RNA, 32 nt, Human
uaaccucuccccuguaccugugccaagccuag

SEQ ID NO: 484734 - RNA, 31 nt, Human
uaaccucugcacuacugacauguggggccag

SEQ ID NO: 484735 - RNA, 32 nt, Human
uaaccucugccucccccaccccuuaacuuuaa

SEQ ID NO: 484736 - RNA, 32 nt, Human
uaaccucugggcaucagacaucagcaggucug

SEQ ID NO: 484737 - RNA, 32 nt, Human
uaaccucuggucagccgagaaaccccacuauc

SEQ ID NO: 484738 - RNA, 32 nt, Human
uaaccucuuugaggaaccacagagcccaaggc

SEQ ID NO: 484739 - RNA, 32 nt, Human
uaaccugaacagcucacaauguagcuguaaau

SEQ ID NO: 484740 - RNA, 32 nt, Human
uaaccugaagagggaggaaguggauuuggggu

SEQ ID NO: 484741 - RNA, 32 nt, Human
uaaccugacuucucugugccucaaugucuuca

SEQ ID NO: 484742 - RNA, 32 nt, Human
uaaccugagucccucucagaaaacagagcuaa

SEQ ID NO: 484743 - RNA, 32 nt, Human
uaaccugcagaaagagaugcagauguuggcua

SEQ ID NO: 484744 - RNA, 32 nt, Human
uaaccugcaugaaucaguuuugggggaaugga

SEQ ID NO: 484745 - RNA, 32 nt, Human
uaaccugccaaaauaaguauuccucuuccuuu

SEQ ID NO: 484746 - RNA, 32 nt, Human
uaaccugccaccaguguccacccuccggcccc

SEQ ID NO: 484747 - RNA, 32 nt, Human
uaaccugccauccaaaugauaaauugcuaauu

SEQ ID NO: 484748 - RNA, 32 nt, Human
uaaccugcgagaagcugguugugcgcugaggc

SEQ ID NO: 484749 - RNA, 32 nt, Human
uaaccugcuggcugugagucccuuguggaaua

SEQ ID NO: 484750 - RNA, 32 nt, Human
uaaccuggagugaagagguagaacugugguau

SEQ ID NO: 484751 - RNA, 32 nt, Human
uaaccugggagaucaucuuagaacaaagggcu

SEQ ID NO: 484752 - RNA, 32 nt, Human
uaaccugggaggucaggggcugugguauauca

SEQ ID NO: 484753 - RNA, 32 nt, Human
uaaccugggauuacuaacuguugagccaucuu

SEQ ID NO: 484754 - RNA, 32 nt, Human
uaaccuggucucacugugguugcccucaucca

SEQ ID NO: 484755 - RNA, 23 nt, Human
uaaccuggugauccgcccgccuc

SEQ ID NO: 484756 - RNA, 32 nt, Human
uaaccuguacacacaaacgcacagggaugcac

SEQ ID NO: 484757 - RNA, 32 nt, Human
uaaccuguauuuaaucuguacuuccuaugcca

SEQ ID NO: 484758 - RNA, 32 nt, Human
uaaccugucagcccuuuuacucagccacagcc

SEQ ID NO: 484759 - RNA, 32 nt, Human
uaaccugucgcugaagccccagaagcgggccc

SEQ ID NO: 484760 - RNA, 32 nt, Human
uaaccugucuuccaggugguacaguuagcugu

SEQ ID NO: 484761 - RNA, 32 nt, Human
uaaccugugcuugcauccuccuuuccuccucc

SEQ ID NO: 484762 - RNA, 32 nt, Human
uaaccuguuuccagccuggccugagguggaac

SEQ ID NO: 484763 - RNA, 32 nt, Human
uaaccuuagacaccuaugcagucauguuggga

SEQ ID NO: 484764 - RNA, 32 nt, Human
uaaccuuagaucuuugaugugaagcuagcacu

SEQ ID NO: 484765 - RNA, 32 nt, Human
uaaccuuagcccugccuuguguuccaaaagcu

SEQ ID NO: 484766 - RNA, 32 nt, Human
uaaccuuauggagagaaaggacuuugagacau

SEQ ID NO: 484767 - RNA, 28 nt, Human
uaaccuucaagugcuccucuucauuuga

SEQ ID NO: 484768 - RNA, 32 nt, Human
uaaccuuccaacugcuucccacaaacacauug

SEQ ID NO: 484769 - RNA, 32 nt, Human
uaaccuuccaauaucauuacaucauauuuaaa

SEQ ID NO: 484770 - RNA, 32 nt, Human
uaaccuuccaucauccucagcuagauguaugc

SEQ ID NO: 484771 - RNA, 32 nt, Human
uaaccuucgcaucccaagagcugcaguuucag

SEQ ID NO: 484772 - RNA, 32 nt, Human
uaaccuucucccuugucaucucagccugagcc

SEQ ID NO: 484773 - RNA, 32 nt, Human
uaaccuucuggcuuccuucucucaauaugcuu

SEQ ID NO: 484774 - RNA, 32 nt, Human
uaaccuugaaucugcccagacucuucccuuag

SEQ ID NO: 484775 - RNA, 32 nt, Human
uaaccuugaucucuugguucagguggugccug

SEQ ID NO: 484776 - RNA, 32 nt, Human
uaaccuugccaguuuguucccucuuuuauuuu

SEQ ID NO: 484777 - RNA, 32 nt, Human
uaaccuugcucaccaagcuguuccacuucucu

SEQ ID NO: 484778 - RNA, 32 nt, Human
uaaccuuggaggcggagguugcauugagcuga

SEQ ID NO: 484779 - RNA, 32 nt, Human
uaaccuuggaggucagcuugagaugacugcgc

SEQ ID NO: 484780 - RNA, 31 nt, Human
uaaccuuguccuuucucuccugugucucagu

SEQ ID NO: 484781 - RNA, 32 nt, Human
uaaccuugugagccaccgugcccaacccuaac

SEQ ID NO: 484782 - RNA, 32 nt, Human
uaaccuugugugucugugaucuccucugucuu

SEQ ID NO: 484783 - RNA, 32 nt, Human
uaaccuuguuuagggaaagaccugugucuuac

SEQ ID NO: 484784 - RNA, 32 nt, Human
uaaccuuuauggcucuuucaggaaaagugaaa

SEQ ID NO: 484785 - RNA, 32 nt, Human
uaaccuuucagccugugagccucugcacaaag

SEQ ID NO: 484786 - RNA, 32 nt, Human
uaaccuuuccacccuauccuguuaacccuuua

SEQ ID NO: 484787 - RNA, 32 nt, Human
uaaccuuuguguaacccugacuuaaugagaaa

SEQ ID NO: 484788 - RNA, 32 nt, Human
uaaccuuuuagaaauccacauauaucucaaau

SEQ ID NO: 484789 - RNA, 32 nt, Human
uaacgaaauagggaguagagagaaauggagau

SEQ ID NO: 484790 - RNA, 32 nt, Human
uaacgacugcacuccagccuggaugacagaac

SEQ ID NO: 484791 - RNA, 32 nt, Human
uaacgagacgccagggacaaucugccaguggc

SEQ ID NO: 484792 - RNA, 32 nt, Human
uaacgagacgguuccccucccuuucccugcca

SEQ ID NO: 484793 - RNA, 32 nt, Human
uaacgaggaacuuuucgccggcgccgggccgc

SEQ ID NO: 484794 - RNA, 32 nt, Human
uaacgaggcugccuccagcauuuccugauuuc

SEQ ID NO: 484795 - RNA, 32 nt, Human
uaacgagggggcuucuggagggaggcggcagc

SEQ ID NO: 484796 - RNA, 32 nt, Human
uaacgagucacagccucagcugugcugggacg

SEQ ID NO: 484797 - RNA, 32 nt, Human
uaacgauaagccucuuggaauauggaggccgc

SEQ ID NO: 484798 - RNA, 32 nt, Human
uaacgauacagagagaugaugacacuggaguu

SEQ ID NO: 484799 - RNA, 32 nt, Human
uaacgauugcaggagaaauaaugaggauguaa

SEQ ID NO: 484800 - RNA, 32 nt, Human
uaacgcagacaucagcuuuacacuucacagga

SEQ ID NO: 484801 - RNA, 32 nt, Human
uaacgcagccaagaucucgccaaucguuaacu

SEQ ID NO: 484802 - RNA, 32 nt, Human
uaacgccacugcacuccaguguaggcaacaga

SEQ ID NO: 484803 - RNA, 32 nt, Human
uaacgcccaaguuggaagguuguggauuuaca

SEQ ID NO: 484804 - RNA, 32 nt, Human
uaacgccuguaaucccagaacuuugggaagcc

SEQ ID NO: 484805 - RNA, 32 nt, Human
uaacgccuguaaucccagcacuugggaggccc

SEQ ID NO: 484806 - RNA, 32 nt, Human
uaacgccuguaaucccagcacuuugagaugcu

SEQ ID NO: 484807 - RNA, 31 nt, Human
uaacgcuacagcuagaccacggugggcuugg

SEQ ID NO: 484808 - RNA, 32 nt, Human
uaacgcucacugcgaaggucugcagcuucacu

SEQ ID NO: 484809 - RNA, 32 nt, Human
uaacgcuuguaaucccagcgcuuugggaggcc

SEQ ID NO: 484810 - RNA, 32 nt, Human
uaacggagccgagaccauagaugaggaggcug

SEQ ID NO: 484811 - RNA, 32 nt, Human
uaacggauagugagcuugugccccugccuagg

SEQ ID NO: 484812 - RNA, 32 nt, Human
uaacggauguuguguggaguccuggcuggagg

SEQ ID NO: 484813 - RNA, 32 nt, Human
uaacgggaggcugggcacagaggucaggaagc

SEQ ID NO: 484814 - RNA, 32 nt, Human
uaacgggcugccagaagagagagaggcagaga

SEQ ID NO: 484815 - RNA, 32 nt, Human
uaacggguucaagugauuccccugccucaguc

SEQ ID NO: 484816 - RNA, 24 nt, Human
uaacgguggaguccaugugugaaa

SEQ ID NO: 484817 - RNA, 32 nt, Human
uaacguacauuugugcuguuuucaauuuugug

SEQ ID NO: 484818 - RNA, 32 nt, Human
uaacgucugccacccccacucucacccccaag

SEQ ID NO: 484819 - RNA, 32 nt, Human
uaacgucuucauuauuuuccucauugaugucu

SEQ ID NO: 484820 - RNA, 32 nt, Human
uaacgucuugccugugcaucuagaaagguacc

SEQ ID NO: 484821 - RNA, 32 nt, Human
uaacgucuuugcaaaugaaaaauccacuguac

SEQ ID NO: 484822 - RNA, 32 nt, Human
uaacgugacugucaucugugacagcauuugug

SEQ ID NO: 484823 - RNA, 32 nt, Human
uaacguggagagaacacggagcaccagucacc

SEQ ID NO: 484824 - RNA, 32 nt, Human
uaacguucauaucuaacucugaauauuucuau

SEQ ID NO: 484825 - RNA, 32 nt, Human
uaacguucuggugugguuuccuguagugaucu

SEQ ID NO: 484826 - RNA, 32 nt, Human
uaacuaaaacccacagcccaaccaaaccuuga

SEQ ID NO: 484827 - RNA, 32 nt, Human
uaacuaaacucauuggagucuaguuccaaauu

SEQ ID NO: 484828 - RNA, 32 nt, Human
uaacuaacaauguuaguauaauaguccuaaua

SEQ ID NO: 484829 - RNA, 32 nt, Human
uaacuaacacaugagcagucacuuuggagaga

SEQ ID NO: 484830 - RNA, 32 nt, Human
uaacuaacauggcuaaacccuucucuacugaa

SEQ ID NO: 484831 - RNA, 32 nt, Human
uaacuaagaaaauuuauuugccucuuaaugcu

SEQ ID NO: 484832 - RNA, 30 nt, Human
uaacuaagcuugcauuuugaaaaagagacu

SEQ ID NO: 484833 - RNA, 32 nt, Human
uaacuaaucauauuuaaauauauuucacuuuc

SEQ ID NO: 484834 - RNA, 32 nt, Human
uaacuaaucauauuuaaauauauuucacuuug

SEQ ID NO: 484835 - RNA, 32 nt, Human
uaacuaauccauccucugaugucaccugcuaa

SEQ ID NO: 484836 - RNA, 24 nt, Human
uaacuacacagaggacccagggga

SEQ ID NO: 484837 - RNA, 32 nt, Human
uaacuacaccucagggcgggugagguuccgac

SEQ ID NO: 484838 - RNA, 32 nt, Human
uaacuacuuccaggaauuuagccuaggaaauc

SEQ ID NO: 484839 - RNA, 32 nt, Human
uaacuacuuggaaaauacagaauuggcuagug

SEQ ID NO: 484840 - RNA, 32 nt, Human
uaacuagaaaauucauacaacaucagugguua

SEQ ID NO: 484841 - RNA, 32 nt, Human
uaacuagaaagaauuauacauugcauagcacu

SEQ ID NO: 484842 - RNA, 32 nt, Human
uaacuagaaaucuaguauugccauaaaggaaa

SEQ ID NO: 484843 - RNA, 32 nt, Human
uaauggggcugauguguaaagcuguucaaguu

SEQ ID NO: 484844 - RNA, 32 nt, Human
uaauggggguauaaaucaagaaagcagucaaa

SEQ ID NO: 484845 - RNA, 23 nt, Human
uaaugggucacauuggcuggaug

SEQ ID NO: 484846 - RNA, 32 nt, Human
uaaugguaaaacaacauacaucugccaauaua

SEQ ID NO: 484847 - RNA, 32 nt, Human
uaaugguaucacgucgcaggguugucaggcgg

SEQ ID NO: 484848 - RNA, 21 nt, Human
uaauggucacuuucugacucc

SEQ ID NO: 484849 - RNA, 32 nt, Human
uaauggucagaggcgcaugaauuugugaaggu

SEQ ID NO: 484850 - RNA, 32 nt, Human
uaauggucagccuaaucauucugucagccuaa

SEQ ID NO: 484851 - RNA, 20 nt, Human
uaauggucucuccaacccug

SEQ ID NO: 484852 - RNA, 32 nt, Human
uaauggugcagaauaaaacacacacaucugau

SEQ ID NO: 484853 - RNA, 18 nt, Human
uaauggugccacuggacu

SEQ ID NO: 484854 - RNA, 32 nt, Human
uaauggugccacuggacuccagccugggagac

SEQ ID NO: 484855 - RNA, 32 nt, Human
uaauggugcccacuuucucgacuuuggccagg

SEQ ID NO: 484856 - RNA, 32 nt, Human
uaaugguggccuggggcuucugaggcuucugg

SEQ ID NO: 484857 - RNA, 32 nt, Human
uaauggugucacugcuggcaauggugauaaug

SEQ ID NO: 484858 - RNA, 32 nt, Human
uaaugguguuaauaauacaaaugaauuggccu

SEQ ID NO: 484859 - RNA, 32 nt, Human
uaaugguucauccucuauaaggccaacaaaga

SEQ ID NO: 484860 - RNA, 32 nt, Human
uaaugguuggcccugguguuguuggguggcag

SEQ ID NO: 484861 - RNA, 32 nt, Human
uaaugguuuggcucaaagaaggcacaugcauc

SEQ ID NO: 484862 - RNA, 32 nt, Human
uaaugguuuuaaauauaugcuauagggacguu

SEQ ID NO: 484863 - RNA, 32 nt, Human
uaaugguuuuguuggggcucuuaacuugcaag

SEQ ID NO: 484864 - RNA, 32 nt, Human
uaauguaaaaacaauucccuaggcuuucccug

SEQ ID NO: 484865 - RNA, 32 nt, Human
uaauguaaacagaacuggcacacacacauuaa

SEQ ID NO: 484866 - RNA, 32 nt, Human
uaauguaccuuuaucuucccccggcugacugu

SEQ ID NO: 484867 - RNA, 32 nt, Human
uaauguacuggcuccucacacaauacuguggu

SEQ ID NO: 484868 - RNA, 32 nt, Human
uaauguagacuauagaaugacuuucagguguu

SEQ ID NO: 484869 - RNA, 32 nt, Human
uaauguaggcaagccacuucauuuuucagaac

SEQ ID NO: 484870 - RNA, 32 nt, Human
uaauguaguacaacagugacaguuaugacagg

SEQ ID NO: 484871 - RNA, 32 nt, Human
uaauguaguaugguauaugcacaaaacuacuu

SEQ ID NO: 484872 - RNA, 32 nt, Human
uaauguauacacauuaaugauaaguugauaac

SEQ ID NO: 484873 - RNA, 32 nt, Human
uaaugucaaaggacgaaaucauggggacaauu

SEQ ID NO: 484874 - RNA, 31 nt, Human
uaaugucaagugucauaagagaggaugcgag

SEQ ID NO: 484875 - RNA, 32 nt, Human
uaaugucacagggguuguacacccuguuauau

SEQ ID NO: 484876 - RNA, 32 nt, Human
uaaugucacaucugccuucggagauuacaaau

SEQ ID NO: 484877 - RNA, 32 nt, Human
uaaugucacaucugccuuuggagauuacaaau

SEQ ID NO: 484878 - RNA, 32 nt, Human
uaaugucagcacuuuaaaaggcugaggcaggc

SEQ ID NO: 484879 - RNA, 32 nt, Human
uaaugucagcuacuugggaggcugaggcagga

SEQ ID NO: 484880 - RNA, 32 nt, Human
uaauguccaaagugcuuugucauuuagagucc

SEQ ID NO: 484881 - RNA, 32 nt, Human
uaauguccaucaguauaaauugagacugugaa

SEQ ID NO: 484882 - RNA, 32 nt, Human
uaaugucccugccucuucucccaaucaagguu

SEQ ID NO: 484883 - RNA, 32 nt, Human
uaauguccucaagguucauccauguuguguca

SEQ ID NO: 484884 - RNA, 32 nt, Human
uaaugucuccuccugguuuuuaguuguuuuuc

SEQ ID NO: 484885 - RNA, 32 nt, Human
uaaugucuggaauaucaaagagaugcucagua

SEQ ID NO: 484886 - RNA, 32 nt, Human
uaaugucuucaguuucuugaggagacuccuag

SEQ ID NO: 484887 - RNA, 32 nt, Human
uaaugugaaaaagaaaggaauuuagagguagg

SEQ ID NO: 484888 - RNA, 31 nt, Human
uaaugugaacaaugaccucuaacuuguauuu

SEQ ID NO: 484889 - RNA, 32 nt, Human
uaaugugaauaguuuguuaauauugcuguaaa

SEQ ID NO: 484890 - RNA, 32 nt, Human
uaaugugacaccugcagaaacuauagagcguc

SEQ ID NO: 484891 - RNA, 32 nt, Human
uaaugugacuuaggugcugucaacauuagcaa

SEQ ID NO: 484892 - RNA, 32 nt, Human
uaaugugagacaggaucucauucuguugccua

SEQ ID NO: 484893 - RNA, 32 nt, Human
uaaugugagauauguaccuucauauucagaaa

SEQ ID NO: 484894 - RNA, 32 nt, Human
uaaugugagcucauccacugcugcugcagcgu

SEQ ID NO: 484895 - RNA, 32 nt, Human
uaaugugaggagguggagagacagcccacccc

SEQ ID NO: 484896 - RNA, 32 nt, Human
uaaugugaggagguggagagacagcccacccu

SEQ ID NO: 484897 - RNA, 32 nt, Human
uaaugugaggguagggaaaauguggauaacau

SEQ ID NO: 484898 - RNA, 31 nt, Human
uaaugugcacuuuugugauguggaaggcaaa

SEQ ID NO: 484899 - RNA, 32 nt, Human
uaauguggcaaaguccacccucaggccuuaua

SEQ ID NO: 484900 - RNA, 32 nt, Human
uaauguggcugcugccucgugucacaucugaa

SEQ ID NO: 484901 - RNA, 32 nt, Human
uaaugugggaaaugguucuccuuucccucuca

SEQ ID NO: 484902 - RNA, 32 nt, Human
uaauguggggagcgggcaggggugggguggga

SEQ ID NO: 484903 - RNA, 32 nt, Human
uaaugugguacaauaaauagcccuuccugaca

SEQ ID NO: 484904 - RNA, 32 nt, Human
uaauguggugucugaagcagggccaggggagg

SEQ ID NO: 484905 - RNA, 32 nt, Human
uaauguguaaaaaccacgucugagcuugcuuu

SEQ ID NO: 484906 - RNA, 32 nt, Human
uaauguguacagucuuugcaguuccaccaaga

SEQ ID NO: 484907 - RNA, 32 nt, Human
uaauguguauuuuucuugguccaccauguuua

SEQ ID NO: 484908 - RNA, 32 nt, Human
uaauguguuccaggcauucuucuaagugguuu

SEQ ID NO: 484909 - RNA, 32 nt, Human
uaauguuaacugaucaggaagugcaguuuggg

SEQ ID NO: 484910 - RNA, 32 nt, Human
uaauguuacuguugauucauuucccaaauucc

SEQ ID NO: 484911 - RNA, 32 nt, Human
uaauguuagauaugugggaaaggccuuuauuc

SEQ ID NO: 484912 - RNA, 32 nt, Human
uaauguucaagaaacuaggcagucauaugauc

SEQ ID NO: 484913 - RNA, 32 nt, Human
uaauguucaagcuuuagaaagaucagagcaau

SEQ ID NO: 484914 - RNA, 32 nt, Human
uaauguucaguuauuaauauguauacugccau

SEQ ID NO: 484915 - RNA, 32 nt, Human
uaauguucauuucccaccccugcuccagccuc

SEQ ID NO: 484916 - RNA, 32 nt, Human
uaauguucccucaaauagcacagggaagcaac

SEQ ID NO: 484917 - RNA, 32 nt, Human
uaauguucgguuaaaaaugugacagaugagua

SEQ ID NO: 484918 - RNA, 32 nt, Human
uaauguucuguccuagccaaauucucaggaca

SEQ ID NO: 484919 - RNA, 32 nt, Human
uaauguucuuuagccuaaauguuaacaacuuu

SEQ ID NO: 484920 - RNA, 32 nt, Human
uaauguugaucuggcauccucaggcugcagcu

SEQ ID NO: 484921 - RNA, 32 nt, Human
uaauguuugguaacuuuuaugccuucacuuua

SEQ ID NO: 484922 - RNA, 32 nt, Human
uaauguuuuagucugcugcacacaucuaaaaa

SEQ ID NO: 484923 - RNA, 32 nt, Human
uaauguuuuauacacuuuuuaacugguugcac

SEQ ID NO: 484924 - RNA, 32 nt, Human
uaauguuuucagucauuguguguccuuuguug

SEQ ID NO: 484925 - RNA, 32 nt, Human
uaauguuuuuaauacccagaacacagggcuuc

SEQ ID NO: 484926 - RNA, 32 nt, Human
uaauuaaaagcauaguguauaagugaguacac

SEQ ID NO: 484927 - RNA, 32 nt, Human
uaauuaaaagugugaaaaucuaaaaauacuuc

SEQ ID NO: 484928 - RNA, 32 nt, Human
uaauuaaacaugcucagccugagccaccaaaa

SEQ ID NO: 484929 - RNA, 32 nt, Human
uaauuaaacgugccuuugaguagaugugaaua

SEQ ID NO: 484930 - RNA, 32 nt, Human
uaauuaaaguagaagagaaggguucuguucca

SEQ ID NO: 484931 - RNA, 32 nt, Human
uaauuaaauguguucaguauguacuuaucagu

SEQ ID NO: 484932 - RNA, 32 nt, Human
uaauuaacaaaugauaauagacaggagaaaua

SEQ ID NO: 484933 - RNA, 32 nt, Human
uaauuaaccccauaauuagauccauuaauuua

SEQ ID NO: 484934 - RNA, 32 nt, Human
uaauuaacuugcaggugugcaccaccacaaaa

SEQ ID NO: 484935 - RNA, 32 nt, Human
uaauuaaggcaucuuucugcuccugaucagaa

SEQ ID NO: 484936 - RNA, 32 nt, Human
uaauuaaggccuuucuucccaccccaagucca

SEQ ID NO: 484937 - RNA, 32 nt, Human
uaauuaagucacaggcaggacccaguuuccag

SEQ ID NO: 484938 - RNA, 32 nt, Human
uaauuaaguguaauauggauuacuuugaaacu

SEQ ID NO: 484939 - RNA, 32 nt, Human
uaauuaaucucucuggaaaaaggaaagcuaaa

SEQ ID NO: 484940 - RNA, 32 nt, Human
uaauuaauggacaacuguagugcagugauccu

SEQ ID NO: 484941 - RNA, 32 nt, Human
uaauuaauuucaugggacuaaaugaacuaaug

SEQ ID NO: 484942 - RNA, 32 nt, Human
uaauuacacacgugaaauaauuacagcuuaaa

SEQ ID NO: 484943 - RNA, 32 nt, Human
uaauuacagaacuuaccacacauauacauaga

SEQ ID NO: 484944 - RNA, 32 nt, Human
uaauuacaucugcaaggcccccuucuccaaau

SEQ ID NO: 484945 - RNA, 32 nt, Human
uaauuaccaguggauugguagaacugcuuuuu

SEQ ID NO: 484946 - RNA, 32 nt, Human
uaauuacccuuuugcaggcaccaccuuuaauc

SEQ ID NO: 484947 - RNA, 32 nt, Human
uaauuaccgacguugcaugcugugaggaggcu

SEQ ID NO: 484948 - RNA, 32 nt, Human
uaauuacugcaacuugcugcuggacaauugua

SEQ ID NO: 484949 - RNA, 32 nt, Human
uaauuacugugccuuuuccuuucuuuuuacac

SEQ ID NO: 484950 - RNA, 29 nt, Human
uaauuacuguuucuguugccuggacaguu

SEQ ID NO: 484951 - RNA, 32 nt, Human
uaauuacuugacuugccuugauuuauaggacu

SEQ ID NO: 484952 - RNA, 32 nt, Human
uaauuagaaacacacuuuugcacauauauuuu

SEQ ID NO: 484953 - RNA, 32 nt, Human
uaauuagaaagcccagagaaaaagccagaaaa

SEQ ID NO: 484954 - RNA, 32 nt, Human
uaauuagaaguagacaaagauuaaugaaaggg

SEQ ID NO: 484955 - RNA, 32 nt, Human
uaauuagagcauccuucccuuuuauucuacuu

SEQ ID NO: 484956 - RNA, 32 nt, Human
uaauuagauuauaccacuagagucuucagauu

SEQ ID NO: 484957 - RNA, 32 nt, Human
uaauuagcauggucaaugcgggagcgaugagu

SEQ ID NO: 484958 - RNA, 32 nt, Human
uaauuagccagccucagauacuucugugggcc

SEQ ID NO: 484959 - RNA, 32 nt, Human
uaauuagcccggcuaauuuuguauuuuuagua

SEQ ID NO: 484960 - RNA, 32 nt, Human
uaauuaggaacucuugagaauauuggcugcug

SEQ ID NO: 484961 - RNA, 32 nt, Human
uaauuaggacagaucaauguacacuuaccucu

SEQ ID NO: 484962 - RNA, 32 nt, Human
uaauuagucaucuggauuuuuauagauaaaau

SEQ ID NO: 484963 - RNA, 32 nt, Human
uaauuauaaacaaaggaacaaauaaguggaag

SEQ ID NO: 484964 - RNA, 32 nt, Human
uaauuauacagcccggaugaaucucacucaga

SEQ ID NO: 484965 - RNA, 32 nt, Human
uaauuauagagaucugucauuugguacuggau

SEQ ID NO: 484966 - RNA, 32 nt, Human
uaauuaucauuuccuuggcuucaugcucuccc

SEQ ID NO: 484967 - RNA, 32 nt, Human
uaauuaucuucagcccaggcuuuugcuagaug

SEQ ID NO: 484968 - RNA, 32 nt, Human
uaauuaugcauccuagcuaaggcacagaagac

SEQ ID NO: 484969 - RNA, 32 nt, Human
uaauuauguaucugaaagucacccccacauac

SEQ ID NO: 484970 - RNA, 32 nt, Human
uaauuauguccuauuuauuugagauuuguguu

SEQ ID NO: 484971 - RNA, 32 nt, Human
uaauuauucccuaugcagagacaggagagagg

SEQ ID NO: 484972 - RNA, 32 nt, Human
uaauuauugauggcucugccugcuuaggacuc

SEQ ID NO: 484973 - RNA, 32 nt, Human
uaauuauugcuuccuuucuuauuacuuuccua

SEQ ID NO: 484974 - RNA, 32 nt, Human
uaauuauugugcccuuuaaguguuguaaaauc

SEQ ID NO: 484975 - RNA, 32 nt, Human
uaauuauuugagauggaaucuugcuuugucag

SEQ ID NO: 484976 - RNA, 32 nt, Human
uaauuauuuuaaaguuagaaacuuuuucuuuu

SEQ ID NO: 484977 - RNA, 32 nt, Human
uaauucaaauccaugugugugccugcauuaca

SEQ ID NO: 484978 - RNA, 32 nt, Human
uaauucaaugcaacacauauuuauggggcaua

SEQ ID NO: 484979 - RNA, 32 nt, Human
uaauucacacagagcgucagaagccaugaugc

SEQ ID NO: 484980 - RNA, 32 nt, Human
uaauucacaguccucagaagccuauuuuuaaa

SEQ ID NO: 484981 - RNA, 32 nt, Human
uaauucagaaagagaagagacagugaccaacc

SEQ ID NO: 484982 - RNA, 32 nt, Human
uaauucagagaaugccuccugaguuguucuac

SEQ ID NO: 484983 - RNA, 32 nt, Human
uaauucagcugaugcucaaguccaagggguag

SEQ ID NO: 484984 - RNA, 32 nt, Human
uaauucaggagguagaaugcagcuugagaucu

SEQ ID NO: 484985 - RNA, 32 nt, Human
uaauucaggagguagaauggagcuugagauca

SEQ ID NO: 484986 - RNA, 32 nt, Human
uaauucaggccuuccuuuugaccacugccccc

SEQ ID NO: 484987 - RNA, 32 nt, Human
uaauucaggugacuugcuaucuagacaccugg

SEQ ID NO: 484988 - RNA, 32 nt, Human
uaauucauacuggggagaaacccuaaagugug

SEQ ID NO: 484989 - RNA, 32 nt, Human
uaauucaucuaaucccuccuguuugucucaaa

SEQ ID NO: 484990 - RNA, 32 nt, Human
uaauucaucuugguuugcuauguuaaaacugu

SEQ ID NO: 484991 - RNA, 32 nt, Human
uaauucaugauaaaauugaaccaaugguccua

SEQ ID NO: 484992 - RNA, 32 nt, Human
uaauuccaacacuuugggaggcugaggcagga

SEQ ID NO: 484993 - RNA, 32 nt, Human
uaauuccacaauaugccaaauacucauaaaga

SEQ ID NO: 484994 - RNA, 24 nt, Human
uaauuccacuuuaacauuuuacug

SEQ ID NO: 484995 - RNA, 32 nt, Human
uaauuccagauggagcugaaauuagcaguuau

SEQ ID NO: 484996 - RNA, 32 nt, Human
uaauuccagcacuguggaaggccgaggugggu

SEQ ID NO: 484997 - RNA, 32 nt, Human
uaauuccagcacuuugggaggccgaggaggga

SEQ ID NO: 484998 - RNA, 32 nt, Human
uaauuccagcacuuugggaggccgaggcagga

SEQ ID NO: 484999 - RNA, 32 nt, Human
uaauuccagcacuuugggaggccgaggcgggc

SEQ ID NO: 485000 - RNA, 32 nt, Human
uaauuccagcacuuugggaggccgaggcgggu

SEQ ID NO: 485001 - RNA, 32 nt, Human
uaauuccagcacuuugggaggccgaggugggc

SEQ ID NO: 485002 - RNA, 32 nt, Human
uaauuccagcacuuugggaggccgagucggaa

SEQ ID NO: 485003 - RNA, 32 nt, Human
uaauuccagcacuuugggaggcugacgugggc

SEQ ID NO: 485004 - RNA, 32 nt, Human
uaauuccagcacuuugggaggcugaggagggc

SEQ ID NO: 485005 - RNA, 32 nt, Human
uaauuccagcacuuugggaggcugaggcgggu

SEQ ID NO: 485006 - RNA, 32 nt, Human
uaauuccagcacuuugggaggcugagguagga

SEQ ID NO: 485007 - RNA, 32 nt, Human
uaauuccagcacuuugggaggcugaggugggu

SEQ ID NO: 485008 - RNA, 32 nt, Human
uaauuccagcacuuugggaggucgagguaggc

SEQ ID NO: 485009 - RNA, 32 nt, Human
uaauuccagcacuuugugaggcugaggcgagu

SEQ ID NO: 485010 - RNA, 32 nt, Human
uaauuccagcaguuugggaggcugaggcagga

SEQ ID NO: 485011 - RNA, 32 nt, Human
uaauuccagccacucgagaggcugaggcagga

SEQ ID NO: 485012 - RNA, 32 nt, Human
uaauuccagcggcuuggaaggcugaggcagga

SEQ ID NO: 485013 - RNA, 32 nt, Human
uaauuccagcuacucaggaggcugagacaggg

SEQ ID NO: 485014 - RNA, 32 nt, Human
uaauuccagcuacucaggaggcugaggcagga

SEQ ID NO: 485015 - RNA, 32 nt, Human
uaauuccagcuacucaggaggcugaggcaggu

SEQ ID NO: 485016 - RNA, 32 nt, Human
uaauuccagcuacucgggaggcugaggcagga

SEQ ID NO: 485017 - RNA, 32 nt, Human
uaauuccagcuacuugagaggcugagauagga

SEQ ID NO: 485018 - RNA, 32 nt, Human
uaauuccagcuacuugggaggcugaggcagga

SEQ ID NO: 485019 - RNA, 32 nt, Human
uaauuccagcuacuugggaggcugaggcaugg

SEQ ID NO: 485020 - RNA, 32 nt, Human
uaauuccaucuacucgggaggcugaggcagga

SEQ ID NO: 485021 - RNA, 32 nt, Human
uaauuccccguauucaugugaggggccagcuu

SEQ ID NO: 485022 - RNA, 32 nt, Human
uaauuccccuuccggacgcugccaucauguug

SEQ ID NO: 485023 - RNA, 32 nt, Human
uaauucccuaacuguggaguuuuaggaaguca

SEQ ID NO: 485024 - RNA, 32 nt, Human
uaauucccuucccaacacuugccugauggaaa

SEQ ID NO: 485025 - RNA, 32 nt, Human
uaauuccggcacuuugggaggcugaggcagaa

SEQ ID NO: 485026 - RNA, 32 nt, Human
uaauuccuagcaucugcuaucaaacugugccu

SEQ ID NO: 485027 - RNA, 32 nt, Human
uaauuccucaguuauaccagauuuuauaaaau

SEQ ID NO: 485028 - RNA, 32 nt, Human
uaauuccugccuuccucccuuuucccagucca

SEQ ID NO: 485029 - RNA, 32 nt, Human
uaauuccuguaaucccagcauuuugagaggcu

SEQ ID NO: 485030 - RNA, 32 nt, Human
uaauuccuuagagauacaguauaccuggcaau

SEQ ID NO: 485031 - RNA, 32 nt, Human
uaauuccuucacuagguuggguuuggggaggg

SEQ ID NO: 485032 - RNA, 32 nt, Human
uaauuccuuccucucccuuguucccaaguagg

SEQ ID NO: 485033 - RNA, 32 nt, Human
uaauuccuucucagauaccauggauguggaug

SEQ ID NO: 485034 - RNA, 32 nt, Human
uaauucgugagacugaaguugcuuagaguacu

SEQ ID NO: 485035 - RNA, 32 nt, Human
uaauucuaaagcugcuucagacugcuucauga

SEQ ID NO: 485036 - RNA, 32 nt, Human
uaauucuaaggaguuuuguuguauuuuagaau

SEQ ID NO: 485037 - RNA, 32 nt, Human
uaauucuagcacuuugggaggcugaggcgggu

SEQ ID NO: 485038 - RNA, 32 nt, Human
uaauucuauuaaaugguugagaaauuagucac

SEQ ID NO: 485039 - RNA, 32 nt, Human
uaauucuauuugaagcaugcucuguaaguugc

SEQ ID NO: 485040 - RNA, 32 nt, Human
uaauucucaaaauauuuaaaacuuuuucauga

SEQ ID NO: 485041 - RNA, 31 nt, Human
uaauucucaaauaaauauuuuggugaagcau

SEQ ID NO: 485042 - RNA, 32 nt, Human
uaauucucaacguaucaaagcuuuucacuggc

SEQ ID NO: 485043 - RNA, 32 nt, Human
uaauucucaauauguuaacaccuagguguucc

SEQ ID NO: 485044 - RNA, 23 nt, Human
uaauucucacuugcauuuuccua

SEQ ID NO: 485045 - RNA, 32 nt, Human
uaauucucccuccagcucccccaaaccccaga

SEQ ID NO: 485046 - RNA, 32 nt, Human
uaauucuccugccucagccucccgaguagcug

SEQ ID NO: 485047 - RNA, 32 nt, Human
uaauucuccugccucagccucccgaguggcug

SEQ ID NO: 485048 - RNA, 32 nt, Human
uaauucuccugccucaggcuucugaguagcug

SEQ ID NO: 485049 - RNA, 32 nt, Human
uaauucuggaaagagcaaauaaaugaagauug

SEQ ID NO: 485050 - RNA, 32 nt, Human
uaauucuggagcaaguggagugguugcaggca

SEQ ID NO: 485051 - RNA, 32 nt, Human
uaauucugggucacuuccagggccaggucugu

SEQ ID NO: 485052 - RNA, 32 nt, Human
uaauucuguccaacaaacacacacggguagau

SEQ ID NO: 485053 - RNA, 32 nt, Human
uaauucuuauuucuguguuacucauguacauu

SEQ ID NO: 485054 - RNA, 32 nt, Human
uaauucuucuuccaauguggcccagggaagcc

SEQ ID NO: 485055 - RNA, 32 nt, Human
uaauucuuggauuccacuguuuucuuugggga

SEQ ID NO: 485056 - RNA, 32 nt, Human
uaauucuuuuuccaggaauagcaguaagguca

SEQ ID NO: 485057 - RNA, 32 nt, Human
uaauugaauaugcacacaggcaugacacaggu

SEQ ID NO: 485058 - RNA, 32 nt, Human
uaauugacauuacaguuaaaugagcacugacc

SEQ ID NO: 485059 - RNA, 32 nt, Human
uaauugagaugggguuucaccaugguagccag

SEQ ID NO: 485060 - RNA, 32 nt, Human
uaauugagccaaagaugauggaagaagaaacu

SEQ ID NO: 485061 - RNA, 32 nt, Human
uaauugagcuguaacccagggacaggaaaaua

SEQ ID NO: 485062 - RNA, 32 nt, Human
uaauugaggccuggccucugcugugggugaau

SEQ ID NO: 485063 - RNA, 32 nt, Human
uaauugaggcugaaugaaugaucccgaaucug

SEQ ID NO: 485064 - RNA, 32 nt, Human
uaauugagggugcuaauuuucuuaagauagug

SEQ ID NO: 485065 - RNA, 32 nt, Human
uaauugagguauaaauuaaugagacaaaguga

SEQ ID NO: 485066 - RNA, 32 nt, Human
uaauugauuccuugugaccuaauucuagagaa

SEQ ID NO: 485067 - RNA, 32 nt, Human
uaauugcaacaugguucuuuguacauuuucau

SEQ ID NO: 485068 - RNA, 32 nt, Human
uaauugcaccacugcacuccagccugggugac

SEQ ID NO: 485069 - RNA, 32 nt, Human
uaauugcagaagcaguuggggugaagaaaacu

SEQ ID NO: 485070 - RNA, 32 nt, Human
uaauugcagaucuucccuuguaaaugugacug

SEQ ID NO: 485071 - RNA, 32 nt, Human
uaauugcagcacuuugggaggcugaggcaggu

SEQ ID NO: 485072 - RNA, 32 nt, Human
uaauugcagcacuuuuagaggcugaggcagga

SEQ ID NO: 485073 - RNA, 32 nt, Human
uaauugcaucacugcacuccaaccugggcaac

SEQ ID NO: 485074 - RNA, 32 nt, Human
uaauugcaucauugcacuccagccugggcaac

SEQ ID NO: 485075 - RNA, 32 nt, Human
uaauugcauggcuuuuccaaucagacgaaauu

SEQ ID NO: 485076 - RNA, 32 nt, Human
uaauugcccuaccuaccucacaggguuguugu

SEQ ID NO: 485077 - RNA, 32 nt, Human
uaauugccucuccccucucccauuuucucucu

SEQ ID NO: 485078 - RNA, 32 nt, Human
uaauugccuuucuuuuccccuccuccuuugua

SEQ ID NO: 485079 - RNA, 32 nt, Human
uaauugcgagggagaaucaugguucugcaguc

SEQ ID NO: 485080 - RNA, 32 nt, Human
uaauugcgccacugcacuccagccugagcgac

SEQ ID NO: 485081 - RNA, 32 nt, Human
uaauugcuucauuuucuugagcaauacugaag

SEQ ID NO: 485082 - RNA, 32 nt, Human
uaauugcuuguuuucuagccuggcaagauauu

SEQ ID NO: 485083 - RNA, 32 nt, Human
uaauuggaacuggaagagggaucauguuuugu

SEQ ID NO: 485084 - RNA, 32 nt, Human
uaauuggcauuucucaagacugucuuuaccag

SEQ ID NO: 485085 - RNA, 32 nt, Human
uaauuggccugggcugcaugggcugcuuuuau

SEQ ID NO: 485086 - RNA, 32 nt, Human
uaauuggcucaccucguuccacagcuccaccu

SEQ ID NO: 485087 - RNA, 32 nt, Human
uaauugggagagaagagaccugccagauuauc

SEQ ID NO: 485088 - RNA, 32 nt, Human
uaauugggaggaagauuagaagcagugggggu

SEQ ID NO: 485089 - RNA, 32 nt, Human
uaauugggaggcugaagcaggagaauugcuca

SEQ ID NO: 485090 - RNA, 32 nt, Human
uaauuggggagaagaagggaagagagcagcag

SEQ ID NO: 485091 - RNA, 32 nt, Human
uaauuggggagagggagugugccccucggggc

SEQ ID NO: 485092 - RNA, 32 nt, Human
uaauuggggguuucucuuucuguccggugucc

SEQ ID NO: 485093 - RNA, 32 nt, Human
uaauuggguauugggaggagggguguggggag

SEQ ID NO: 485094 - RNA, 32 nt, Human
uaauugguguugggaguguugcagugacugaa

SEQ ID NO: 485095 - RNA, 32 nt, Human
uaauugguuuucuuguaaauacaguuuuguac

SEQ ID NO: 485096 - RNA, 31 nt, Human
uaauuguacagcuagagccugcaaguucaac

SEQ ID NO: 485097 - RNA, 32 nt, Human
uaauuguagaacuuugugugaggacuuugguu

SEQ ID NO: 485098 - RNA, 32 nt, Human
uaauuguauguaccacacaucuccagacguua

SEQ ID NO: 485099 - RNA, 32 nt, Human
uaauuguauuuagaucuuguuauugcuccagu

SEQ ID NO: 485100 - RNA, 32 nt, Human
uaauugucacaugugucuuccaccuccuugac

SEQ ID NO: 485101 - RNA, 32 nt, Human
uaauugucacgggggucucacauaucagggcg

SEQ ID NO: 485102 - RNA, 32 nt, Human
uaauugucagccucuggcugugcauuggugca

SEQ ID NO: 485103 - RNA, 32 nt, Human
uaauugucaguuauaugaauaaauuacauguc

SEQ ID NO: 485104 - RNA, 32 nt, Human
uaauuguccuggaaggugggagaaauggagug

SEQ ID NO: 485105 - RNA, 32 nt, Human
uaauugucuaugcuuaaucaucuuuaaacacu

SEQ ID NO: 485106 - RNA, 32 nt, Human
uaauugucuggcuucucucuggacugggagcu

SEQ ID NO: 485107 - RNA, 32 nt, Human
uaauugugcaacuuuuaaccccuguuggcugg

SEQ ID NO: 485108 - RNA, 32 nt, Human
uaauugugccacugcacugcagccugggcgac

SEQ ID NO: 485109 - RNA, 32 nt, Human
uaauugugggaaguaugugauugccuggugug

SEQ ID NO: 485110 - RNA, 32 nt, Human
uaauugugggagaagagaggagaggagggcuc

SEQ ID NO: 485111 - RNA, 32 nt, Human
uaauuguguucuuuaaaaugcauacacacaua

SEQ ID NO: 485112 - RNA, 32 nt, Human
uaauuguuaauuagauguugcuuuuguuuaua

SEQ ID NO: 485113 - RNA, 31 nt, Human
uaauuguuacaaaaauaccugucagaaaccc

SEQ ID NO: 485114 - RNA, 32 nt, Human
uaauuguuagacugguugaugagggaaaugug

SEQ ID NO: 485115 - RNA, 32 nt, Human
uaauuguucacucuuuacuuuugaggcagcca

SEQ ID NO: 485116 - RNA, 32 nt, Human
uaauuguugcuguuuccagucuaaaggaccuc

SEQ ID NO: 485117 - RNA, 20 nt, Human
uaauuguuguaccuauugaa

SEQ ID NO: 485118 - RNA, 32 nt, Human
uaauuguuguccccauuuuauagaugaaaagg

SEQ ID NO: 485119 - RNA, 32 nt, Human
uaauuguuugcuguaucucccuucccucugag

SEQ ID NO: 485120 - RNA, 32 nt, Human
uaauuguuugugucaccccaugauauccguua

SEQ ID NO: 485121 - RNA, 32 nt, Human
uaauuuaaaauggcuguaaaaaugacuuaaau

SEQ ID NO: 485122 - RNA, 32 nt, Human
uaauuuaaauacccaaccucuccaucacagcu

SEQ ID NO: 485123 - RNA, 32 nt, Human
uaauuuaacaaaucugaaaauaugucaaauua

SEQ ID NO: 485124 - RNA, 32 nt, Human
uaauuuaacccaggcaugcaaugcuagauaau

SEQ ID NO: 485125 - RNA, 32 nt, Human
uaauuuaauccuucuguagcaaacaggcauuc

SEQ ID NO: 485126 - RNA, 32 nt, Human
uaauuuaauuggugaggcccauucuugcaacu

SEQ ID NO: 485127 - RNA, 28 nt, Human
uaauuuacaagugcugguacaucuuuuu

SEQ ID NO: 485128 - RNA, 32 nt, Human
uaauuuacacucccaccaacaguguauaagug

SEQ ID NO: 485129 - RNA, 32 nt, Human
uaauuuacacucccaccaacaguguauaauaa

SEQ ID NO: 485130 - RNA, 32 nt, Human
uaauuuacacucccaccaacaguguauguguu

SEQ ID NO: 485131 - RNA, 32 nt, Human
uaauuuaccauccugaaaguccagaauuaaaa

SEQ ID NO: 485132 - RNA, 32 nt, Human
uaauuuacuaaauuauguagcuaucugacugu

SEQ ID NO: 485133 - RNA, 32 nt, Human
uaauuuacuaugaaauggacauccuuuuaacu

SEQ ID NO: 485134 - RNA, 32 nt, Human
uaauuuacuucacuaacugcuauauucuauag

SEQ ID NO: 485135 - RNA, 32 nt, Human
uaauuuagguauaaauucugugacaugcucuu

SEQ ID NO: 485136 - RNA, 32 nt, Human
uaauuuagucaacuugaaaauuucgguagucu

SEQ ID NO: 485137 - RNA, 23 nt, Human
uaauuuaguuuggcauuuuccua

SEQ ID NO: 485138 - RNA, 32 nt, Human
uaauuuaucauuuuuccaaccuugguauuuua

SEQ ID NO: 485139 - RNA, 32 nt, Human
uaauuuauccaccaauuucugccugacauuca

SEQ ID NO: 485140 - RNA, 32 nt, Human
uaauuuaugaauuuuacuugcaccuuauaguu

SEQ ID NO: 485141 - RNA, 32 nt, Human
uaauuuaugggguggaaacagcauuaagaaua

SEQ ID NO: 485142 - RNA, 32 nt, Human
uaauuuauuaaagacuggcucuccaguuuuaa

SEQ ID NO: 485143 - RNA, 32 nt, Human
uaauuuauuuuccuccuccuccuucuucuucu

SEQ ID NO: 485144 - RNA, 32 nt, Human
uaauuuauuuugcuuuggagcagguaccuuuc

SEQ ID NO: 485145 - RNA, 32 nt, Human
uaauuucaaagcuuccucuggccagguagacu

SEQ ID NO: 485146 - RNA, 32 nt, Human
uaauuucaacagaagagugagagauggaaccc

SEQ ID NO: 485147 - RNA, 32 nt, Human
uaauuucacacauuauuccucguuuugacugg

SEQ ID NO: 485148 - RNA, 32 nt, Human
uaauuucacagcaacaggugacugacccuuug

SEQ ID NO: 485149 - RNA, 30 nt, Human
uaauuucacauguaguauaggagcuucuga

SEQ ID NO: 485150 - RNA, 32 nt, Human
uaauuucacugagcuggaggugaguguaagaa

SEQ ID NO: 485151 - RNA, 32 nt, Human
uaauuucagacaggcaauaguggggaggucau

SEQ ID NO: 485152 - RNA, 32 nt, Human
uaauuucagugcagugauuguugugagaaaua

SEQ ID NO: 485153 - RNA, 32 nt, Human
uaauuucaguuaucagaagccauuccaucauu

SEQ ID NO: 485154 - RNA, 32 nt, Human
uaauuucauucauuucuauacaggguuaacaa

SEQ ID NO: 485155 - RNA, 32 nt, Human
uaauuuccaacacacauacaugcacacaaaca

SEQ ID NO: 485156 - RNA, 32 nt, Human
uaauuuccacacacagcacuuccagagccuca

SEQ ID NO: 485157 - RNA, 32 nt, Human
uaauuuccauggccgguggcuuuuccuuccau

SEQ ID NO: 485158 - RNA, 32 nt, Human
uaauuuccccaaggucacacagcuggcugggg

SEQ ID NO: 485159 - RNA, 32 nt, Human
uaauuucccuugugaguuccccauuaaucugc

SEQ ID NO: 485160 - RNA, 32 nt, Human
uaauuuccgagcgaagcugcccccaggaugac

SEQ ID NO: 485161 - RNA, 32 nt, Human
uaauuuccuagagguucuggguuuucugaaag

SEQ ID NO: 485162 - RNA, 32 nt, Human
uaauuucuaagcugugaagcuuauagcauuuu

SEQ ID NO: 485163 - RNA, 32 nt, Human
uaauuucucauggcaguguuuaagaccacucu

SEQ ID NO: 485164 - RNA, 32 nt, Human
uaauuucuccacaacaaaaaccacaacuugaa

SEQ ID NO: 485165 - RNA, 32 nt, Human
uaauuucucugguucuuggcagcuccauuugg

SEQ ID NO: 485166 - RNA, 32 nt, Human
uaauuucugaaaaccaaaaacucuccaagugu

SEQ ID NO: 485167 - RNA, 32 nt, Human
uaauuucugaauccuuugccuguggguaggaa

SEQ ID NO: 485168 - RNA, 32 nt, Human
uaauuucugagagcuaguaccuauaugcuacc

SEQ ID NO: 485169 - RNA, 32 nt, Human
uaauuucugcaaggagcuuucuauccugaacu

SEQ ID NO: 485170 - RNA, 32 nt, Human
uaauuucugcuuccccagccuaagcagggauc

SEQ ID NO: 485171 - RNA, 32 nt, Human
uaauuucuguuacuggcuuugcuagaauucau

SEQ ID NO: 485172 - RNA, 32 nt, Human
uaauuucuucuuucauucacucaggaacaaau

SEQ ID NO: 485173 - RNA, 32 nt, Human
uaauuugaaauggcauuuaaaauaaacauauc

SEQ ID NO: 485174 - RNA, 32 nt, Human
uaauuugaacagcucuaagauauugucacuua

SEQ ID NO: 485175 - RNA, 32 nt, Human
uaauuugaauccauuuggaugaaauuguagag

SEQ ID NO: 485176 - RNA, 32 nt, Human
uaauuugaggcugggugcaguggcucacaccu

SEQ ID NO: 485177 - RNA, 32 nt, Human
uaauuugauuuaaugguuacugcccagauauu

SEQ ID NO: 485178 - RNA, 32 nt, Human
uaauuugcacuccuguuggaaagucuaaaaug

SEQ ID NO: 485179 - RNA, 32 nt, Human
uaauuugccugaggccacacagcuuguaagug

SEQ ID NO: 485180 - RNA, 32 nt, Human
uaauuugccugaugucugugagauuugauaaa

SEQ ID NO: 485181 - RNA, 32 nt, Human
uaauuugccuuuucucuuuugauuuaauguuu

SEQ ID NO: 485182 - RNA, 32 nt, Human
uaauuugcucugguguaaaacugcuaauuucu

SEQ ID NO: 485183 - RNA, 32 nt, Human
uaauuugcuuuuccuuaaggaugcugaacaua

SEQ ID NO: 485184 - RNA, 32 nt, Human
uaauuugcuuuuucugaccaagccuuguggca

SEQ ID NO: 485185 - RNA, 32 nt, Human
uaauuuggagacuacuuugaaaaguauggcaa

SEQ ID NO: 485186 - RNA, 32 nt, Human
uaauuuggcaggauaauauagugcaaauuauu

SEQ ID NO: 485187 - RNA, 32 nt, Human
uaauuuggccaaaaauaagaaauuggaaagaa

SEQ ID NO: 485188 - RNA, 32 nt, Human
uaauuuggcuuggcaugccagucuuauaauua

SEQ ID NO: 485189 - RNA, 32 nt, Human
uaauuuggggucucuuuguuuuccccaacaua

SEQ ID NO: 485190 - RNA, 32 nt, Human
uaauuugggguuccugguccugcuccaggagu

SEQ ID NO: 485191 - RNA, 32 nt, Human
uaauuugguaguuuauaaaaaugcuggaaaug

SEQ ID NO: 485192 - RNA, 32 nt, Human
uaauuuggugacauuuuaacaguaauuagcua

SEQ ID NO: 485193 - RNA, 32 nt, Human
uaauuuguaaaauccugcuaacuagcaaauuc

SEQ ID NO: 485194 - RNA, 32 nt, Human
uaauuugucugucagaucuaaugucaaacaac

SEQ ID NO: 485195 - RNA, 32 nt, Human
uaauuuguuuugcuggagaaacaucagguuug

SEQ ID NO: 485196 - RNA, 32 nt, Human
uaauuuguuuuuaaauacuuuccuggcugggc

SEQ ID NO: 485197 - RNA, 32 nt, Human
uaauuuuaaagccuuucggauuacuuuuaaaa

SEQ ID NO: 485198 - RNA, 32 nt, Human
uaauuuuaagcauguucaguggcagcuccccu

SEQ ID NO: 485199 - RNA, 32 nt, Human
uaauuuuaagcuccuucugucuuguagagucu

SEQ ID NO: 485200 - RNA, 32 nt, Human
uaauuuuaaugccaacaaaauugguuguaauc

SEQ ID NO: 485201 - RNA, 32 nt, Human
uaauuuuacacaauacacauggcuuaauuauu

SEQ ID NO: 485202 - RNA, 32 nt, Human
uaauuuuacaucuuaaauauuucuuucuacua

SEQ ID NO: 485203 - RNA, 32 nt, Human
uaauuuuagaccuuucugagaagauuauuaua

SEQ ID NO: 485204 - RNA, 32 nt, Human
uaauuuuauaaauauauaaauacauguaugua

SEQ ID NO: 485205 - RNA, 32 nt, Human
uaauuuuauagcacguuuacucuagugcuagc

SEQ ID NO: 485206 - RNA, 32 nt, Human
uaauuuuauaugucaacuugaauaggccacag

SEQ ID NO: 485207 - RNA, 32 nt, Human
uaauuuuaugccugaaacagaguuugcgcaca

SEQ ID NO: 485208 - RNA, 32 nt, Human
uaauuuuauucuccucuuccuuuuacccuagu

SEQ ID NO: 485209 - RNA, 32 nt, Human
uaauuuuauuuuccaaacugugcuggaccaaa

SEQ ID NO: 485210 - RNA, 32 nt, Human
uaauuuucccaaggcugcccagcugguggugu

SEQ ID NO: 485211 - RNA, 32 nt, Human
uaauuuuccuuucugaaaacucucauuuuaaa

SEQ ID NO: 485212 - RNA, 32 nt, Human
uaauuuucuuaagauagugccuaaaacacuaa

SEQ ID NO: 485213 - RNA, 32 nt, Human
uaauuuucuucucacuauuaaauuuauuuaaa

SEQ ID NO: 485214 - RNA, 32 nt, Human
uaauuuucuugcaaauaaguuauuuacugcua

SEQ ID NO: 485215 - RNA, 32 nt, Human
uaauuuucuuuuccuuuucaacaaucuccuaa

SEQ ID NO: 485216 - RNA, 32 nt, Human
uaauuuugaguuugaaaucucucccagaagac

SEQ ID NO: 485217 - RNA, 32 nt, Human
uaauuuugcccuaaaagcagauuuuaucacca

SEQ ID NO: 485218 - RNA, 32 nt, Human
uaauuuugcugguuuucauucuucugauuaac

SEQ ID NO: 485219 - RNA, 32 nt, Human
uaauuuugcuuacuuuuucaugcagcugcauu

SEQ ID NO: 485220 - RNA, 32 nt, Human
uaauuuuggccacuuguagguaucagugugau

SEQ ID NO: 485221 - RNA, 32 nt, Human
uaauuuugggcugagugcaguggcuuaugccu

SEQ ID NO: 485222 - RNA, 32 nt, Human
uaauuuuggguggggagaagaggcagauucaa

SEQ ID NO: 485223 - RNA, 32 nt, Human
uaauuuugucccaucuguuuucucuguucucu

SEQ ID NO: 485224 - RNA, 32 nt, Human
uaauuuuuaagaauugaguaaugguguagaac

SEQ ID NO: 485225 - RNA, 32 nt, Human
uaauuuuucacagccgagaaacagugcagcag

SEQ ID NO: 485226 - RNA, 32 nt, Human
uaauuuuugagacugaguaguauucuuggaua

SEQ ID NO: 485227 - RNA, 32 nt, Human
uaauuuuugauuugcuuccaccaggggaaaau

SEQ ID NO: 485228 - RNA, 32 nt, Human
uaauuuuugcuuuuaauuuugauaccucuuua

SEQ ID NO: 485229 - RNA, 32 nt, Human
uaauuuuuguguuuuaguagagacaggguuuc

SEQ ID NO: 485230 - RNA, 32 nt, Human
uaauuuuuguucauaauguagcuccccuuuag

SEQ ID NO: 485231 - RNA, 32 nt, Human
uacaaaaacucaucuuguaauauuuucauuuu

SEQ ID NO: 485232 - RNA, 32 nt, Human
uacaaaaacuuagccgggcaugguggcaugug

SEQ ID NO: 485233 - RNA, 32 nt, Human
uacaaaaacuuagccgggcaugguggugggca

SEQ ID NO: 485234 - RNA, 32 nt, Human
uacaaaaagacacaaaaauuagacaggugugg

SEQ ID NO: 485235 - RNA, 32 nt, Human
uacaaaaagcaggggcccagccccagcuguug

SEQ ID NO: 485236 - RNA, 32 nt, Human
uacaaaaaguagaaaaauuagcugaguguggu

SEQ ID NO: 485237 - RNA, 32 nt, Human
uacaaaaaguuagcugggcaugguggccugua

SEQ ID NO: 485238 - RNA, 32 nt, Human
uacaaaaaguuagcugggcaugguggugcgcg

SEQ ID NO: 485239 - RNA, 32 nt, Human
uacaaaaaguuagcugggugugguggcgugug

SEQ ID NO: 485240 - RNA, 32 nt, Human
uacaaaaauuccaagucucuuuugaacuguau

SEQ ID NO: 485241 - RNA, 32 nt, Human
uacaaaaauucucaguucucuucacucaagga

SEQ ID NO: 485242 - RNA, 32 nt, Human
uacaaaaauuuagccaggcaugguggcauaca

SEQ ID NO: 485243 - RNA, 32 nt, Human
uacaaaacagaauugaaguguguuagagcugg

SEQ ID NO: 485244 - RNA, 32 nt, Human
uacaaaacagcaugcacucaacuugggacuuu

SEQ ID NO: 485245 - RNA, 32 nt, Human
uacaaaacauuccucugaaaaucuaauauuug

SEQ ID NO: 485246 - RNA, 32 nt, Human
uacaaaaccagcucugacuuccuuauccugaa

SEQ ID NO: 485247 - RNA, 32 nt, Human
uacaaaacguuagaaaaauuagccaggugugg

SEQ ID NO: 485248 - RNA, 32 nt, Human
uacaaaacuguacagccuauuuuaguguggac

SEQ ID NO: 485249 - RNA, 32 nt, Human
uacaaaagagaaaagaaaagauuuuuaauaaa

SEQ ID NO: 485250 - RNA, 32 nt, Human
uacaaaagaguuucgcuuuaccccucugguaa

SEQ ID NO: 485251 - RNA, 32 nt, Human
uacaaaagauagaaaaacuuagccaggcaugg

SEQ ID NO: 485252 - RNA, 32 nt, Human
uacaaaagauuuuuaaaaauuagccagguggu

SEQ ID NO: 485253 - RNA, 25 nt, Human
uacaaaagcagccauagacaauaca

SEQ ID NO: 485254 - RNA, 32 nt, Human
uacaaaagguaaagcaguugagauucucuaca

SEQ ID NO: 485255 - RNA, 32 nt, Human
uacaaaagguuuaggaaaagaaaacaauggug

SEQ ID NO: 485256 - RNA, 32 nt, Human
uacaaaagucuuucugacauacacacugcagg

SEQ ID NO: 485257 - RNA, 32 nt, Human
uacaaaauauacaaaauauuagccagccaucg

SEQ ID NO: 485258 - RNA, 19 nt, Human
uacaaaauauauuuuacca

SEQ ID NO: 485259 - RNA, 32 nt, Human
uacaaaauauuagcugggcgugguggcaggcg

SEQ ID NO: 485260 - RNA, 32 nt, Human
uacaaaauauuuuaaaaauuagccaggugugg

SEQ ID NO: 485261 - RNA, 31 nt, Human
uacaaaaucacacuguguaccaaagcaucuu

SEQ ID NO: 485262 - RNA, 32 nt, Human
uacaaaaucucuugggucaagaaaguucuaga

SEQ ID NO: 485263 - RNA, 32 nt, Human
uacaaaaucugugucaguuguacauucacagg

SEQ ID NO: 485264 - RNA, 32 nt, Human
uacaaaaugcaaaaauuagcugggcauggugg

SEQ ID NO: 485265 - RNA, 32 nt, Human
uacaaaaugugcugcacuguugggagaaagaa

SEQ ID NO: 485266 - RNA, 32 nt, Human
uacaaaauuagccaggugugguggcgcauguc

SEQ ID NO: 485267 - RNA, 32 nt, Human
uacaaaauuagccgggugugguggcgcgugcu

SEQ ID NO: 485268 - RNA, 32 nt, Human
uacaaaauuagcugggugugguggcgcaugcc

SEQ ID NO: 485269 - RNA, 32 nt, Human
uacaaacaaaccucgucaccacggucaggagg

SEQ ID NO: 485270 - RNA, 32 nt, Human
uacaaacaaggaagcacauuguguacaaaaua

SEQ ID NO: 485271 - RNA, 32 nt, Human
uacaaacaaggcagaaacauuuaaacuaguau

SEQ ID NO: 485272 - RNA, 32 nt, Human
uacaaacacaugcaaacauaccuacacacaca

SEQ ID NO: 485273 - RNA, 32 nt, Human
uacaaaccaagcucagggccccaacccuagaa

SEQ ID NO: 485274 - RNA, 32 nt, Human
uacaaaccagugccacaaggagcuauuaugag

SEQ ID NO: 485275 - RNA, 32 nt, Human
uacaaacccauguugaucuuucucaaucuuga

SEQ ID NO: 485276 - RNA, 32 nt, Human
uacaaaccucaaaaacgugagcguaucuucca

SEQ ID NO: 485277 - RNA, 32 nt, Human
uacaaaccuccccuccaaacaccuucucacau

SEQ ID NO: 485278 - RNA, 32 nt, Human
uacaaaccuuaaauccaaaggcucuucucaga

SEQ ID NO: 485279 - RNA, 32 nt, Human
uacaaacgugagccacugugcuuggccacaca

SEQ ID NO: 485280 - RNA, 32 nt, Human
uacaaacgugagccaucgcaccuagccucuuu

SEQ ID NO: 485281 - RNA, 32 nt, Human
uacaaacuccugcaauucuuccugcaagccuc

SEQ ID NO: 485282 - RNA, 32 nt, Human
uacaaacucggugaacaacugagggaaccaaa

SEQ ID NO: 485283 - RNA, 32 nt, Human
uacaaacuggauauuuuauacauugcugacag

SEQ ID NO: 485284 - RNA, 32 nt, Human
uacaaacuuaccucuaaacucugaggauaaag

SEQ ID NO: 485285 - RNA, 32 nt, Human
uacaaagaacugcuucuugcucuugggguauc

SEQ ID NO: 485286 - RNA, 32 nt, Human
uacaaagaagcagaaguguaauuuuccuuuuc

SEQ ID NO: 485287 - RNA, 32 nt, Human
uacaaagaaggcuaaugucauucuuccaguag

SEQ ID NO: 485288 - RNA, 32 nt, Human
uacaaagaaucuagugugcucagggcuuggua

SEQ ID NO: 485289 - RNA, 32 nt, Human
uacaaagacuuuguuaaacuuuauccaguggu

SEQ ID NO: 485290 - RNA, 32 nt, Human
uacaaagagccccaggccccgggggcuucucu

SEQ ID NO: 485291 - RNA, 22 nt, Human
uacaaagagcuuuugugucuuu

SEQ ID NO: 485292 - RNA, 32 nt, Human
uacaaagauauaaucuauuuuauuaugguuuc

SEQ ID NO: 485293 - RNA, 32 nt, Human
uacaaagcaauucauaccuuuugcuacauuug

SEQ ID NO: 485294 - RNA, 32 nt, Human
uacaaagcacaauggggcugggcucauacagu

SEQ ID NO: 485295 - RNA, 32 nt, Human
uacaaagcagcaagagguuaggguggcaaggc

SEQ ID NO: 485296 - RNA, 32 nt, Human
uacaaagcagcuaaaaaugacacagcuuauuu

SEQ ID NO: 485297 - RNA, 31 nt, Human
uacaaagcaguuuucugaauggggauuaguu

SEQ ID NO: 485298 - RNA, 32 nt, Human
uacaaagccaacaacauuugcugcaaauaaac

SEQ ID NO: 485299 - RNA, 32 nt, Human
uacaaagcugaagaaaaugaagcccuauuacu

SEQ ID NO: 485300 - RNA, 32 nt, Human
uacaaagcugucacucacaaaaggcuggaugu

SEQ ID NO: 485301 - RNA, 32 nt, Human
uacaaaggcugcauaccauagggcagggcacc

SEQ ID NO: 485302 - RNA, 32 nt, Human
uacaaaggcuggaauagaacaaaagcccacca

SEQ ID NO: 485303 - RNA, 32 nt, Human
uacaaaggucuucuucccucgccccuucucca

SEQ ID NO: 485304 - RNA, 32 nt, Human
uacaaagguuuaaaggaauugauuccucugaa

SEQ ID NO: 485305 - RNA, 32 nt, Human
uacaaaguagacaugacaagugaacagcagag

SEQ ID NO: 485306 - RNA, 32 nt, Human
uacaaagucugcuuuugcuauucuuuuugcuu

SEQ ID NO: 485307 - RNA, 32 nt, Human
uacaaaguggaagugccagcuggcuuaaguac

SEQ ID NO: 485308 - RNA, 32 nt, Human
uacaaaguguggaagccagggcccagggaagg

SEQ ID NO: 485309 - RNA, 24 nt, Human
uacaaauaaaaacaauacagcaua

SEQ ID NO: 485310 - RNA, 32 nt, Human
uacaaauaaauguguucugaaucuuuucaucu

SEQ ID NO: 485311 - RNA, 32 nt, Human
uacaaauaaggcaugaggacuaugugaaaaau

SEQ ID NO: 485312 - RNA, 32 nt, Human
uacaaauaccccugggugucaccaacaauauu

SEQ ID NO: 485313 - RNA, 32 nt, Human
uacaaauagauggagaccugcugggaucagug

SEQ ID NO: 485314 - RNA, 32 nt, Human
uacaaauaggcaugccucacacacacagucca

SEQ ID NO: 485315 - RNA, 32 nt, Human
uacaaauauauguacaacagauuuugcuuuuu

SEQ ID NO: 485316 - RNA, 32 nt, Human
uacaaauauuagcguuuggcucuaauaagggu

SEQ ID NO: 485317 - RNA, 32 nt, Human
uacaaaucagaagaaaaagcaagcauuauaaa

SEQ ID NO: 485318 - RNA, 32 nt, Human
uacaaaucauuugcucauuuuuaauuuggguu

SEQ ID NO: 485319 - RNA, 30 nt, Human
uacaaaucuaaacucaugauacacuugaua

SEQ ID NO: 485320 - RNA, 24 nt, Human
uacaaaucugugcuacacuggaua

SEQ ID NO: 485321 - RNA, 32 nt, Human
uacaaaugagauuauauuuggagucauguucc

SEQ ID NO: 485322 - RNA, 32 nt, Human
uacaaauggauccauaguuugcagugauuuaa

SEQ ID NO: 485323 - RNA, 32 nt, Human
uacaaaugugaagucuguggcaaagcuuuuaa

SEQ ID NO: 485324 - RNA, 24 nt, Human
uacaaauuaacauuuuugaugcca

SEQ ID NO: 485325 - RNA, 32 nt, Human
uacaaauuaaguuugugacaagaaaugcccaa

SEQ ID NO: 485326 - RNA, 21 nt, Human
uacaaauuccucauucuguca

SEQ ID NO: 485327 - RNA, 19 nt, Human
uacaaauucugguaaacug

SEQ ID NO: 485328 - RNA, 32 nt, Human
uacaaauuguucuuguuaaaaaugacuaauac

SEQ ID NO: 485329 - RNA, 27 nt, Human
uacaaauuuaaaaaccaauacaguaua

SEQ ID NO: 485330 - RNA, 32 nt, Human
uacaaauuugagauagaucucgccugucuuaa

SEQ ID NO: 485331 - RNA, 32 nt, Human
uacaacaaucagaaagggcacugauuuauuug

SEQ ID NO: 485332 - RNA, 32 nt, Human
uacaacacaaaucaugcuucugacuggcacca

SEQ ID NO: 485333 - RNA, 18 nt, Human
uacaacaccugacuuuaa

SEQ ID NO: 485334 - RNA, 32 nt, Human
uacaacacuggcagagaugauucuagauuaac

SEQ ID NO: 485335 - RNA, 32 nt, Human
uacaacacuguaguggaacauucuucugcauu

SEQ ID NO: 485336 - RNA, 21 nt, Human
uacaacagaagauacaggaag

SEQ ID NO: 485337 - RNA, 24 nt, Human
uacaacagagaggcagucaggaga

SEQ ID NO: 485338 - RNA, 32 nt, Human
uacaacagccugaaucaaaugguuagcuuaau

SEQ ID NO: 485339 - RNA, 32 nt, Human
uacaacagugccugacacauauuaggcacugg

SEQ ID NO: 485340 - RNA, 32 nt, Human
uacaacauaccuaucagaaaugguuuucauua

SEQ ID NO: 485341 - RNA, 32 nt, Human
uacaacauagccccaaauauaguaagaucuau

SEQ ID NO: 485342 - RNA, 32 nt, Human
uacaacaucacugcgcuagggugcuucauggu

SEQ ID NO: 485343 - RNA, 24 nt, Human
uacaacaugaaauauaguugcaua

SEQ ID NO: 485344 - RNA, 32 nt, Human
uacaacauggcugagacuaaguguccagggag

SEQ ID NO: 485345 - RNA, 32 nt, Human
uacaacaugugaggcauucggggaagcugcac

SEQ ID NO: 485346 - RNA, 32 nt, Human
uacaacauucaaaucacaacaguauccugauu

SEQ ID NO: 485347 - RNA, 26 nt, Human
uacaaccaaagagcuaucucaggaga

SEQ ID NO: 485348 - RNA, 32 nt, Human
uacaaccacaaacaccacaacggccgccacuc

SEQ ID NO: 485349 - RNA, 32 nt, Human
uacaaccacugcacuaccugacucaggaaucg

SEQ ID NO: 485350 - RNA, 32 nt, Human
uacaaccagccaaaugcacuuuugugaaaaug

SEQ ID NO: 485351 - RNA, 32 nt, Human
uacaaccaggacacaggaagcccugcugggcu

SEQ ID NO: 485352 - RNA, 32 nt, Human
uacaaccauacauacuugcacauguguguuca

SEQ ID NO: 485353 - RNA, 32 nt, Human
uacaaccauaggcucacagaaaaagaaaaaga

SEQ ID NO: 485354 - RNA, 32 nt, Human
uacaacccgcagucccacaucaucucaggcgg

SEQ ID NO: 485355 - RNA, 32 nt, Human
uacaaccgaugguaauuaagcuuguauucaca

SEQ ID NO: 485356 - RNA, 32 nt, Human
uacaaccgguacucaaggggcagccccaccuc

SEQ ID NO: 485357 - RNA, 32 nt, Human
uacaaccuaccaccgcagcccaggcucgacuc

SEQ ID NO: 485358 - RNA, 32 nt, Human
uacaaccuauggauuucauguguuacaauauc

SEQ ID NO: 485359 - RNA, 32 nt, Human
uacaaccucugccuccugggcucaagugaucc

SEQ ID NO: 485360 - RNA, 32 nt, Human
uacaaccugagccuuuucuuauauaagacaag

SEQ ID NO: 485361 - RNA, 32 nt, Human
uacaaccugcauaauguggacucuugaccagu

SEQ ID NO: 485362 - RNA, 32 nt, Human
uacaaccugggugauagagcaagucucugucu

SEQ ID NO: 485363 - RNA, 32 nt, Human
uacaaccuguaaccacaaucccucaccucuca

SEQ ID NO: 485364 - RNA, 32 nt, Human
uacaaccuuccacagcagcccaggcuccacuc

SEQ ID NO: 485365 - RNA, 32 nt, Human
uacaacgacgaggagauucguuuccaaaccag

SEQ ID NO: 485366 - RNA, 32 nt, Human
uacaacgcaccgucuagccacaggagaacuaa

SEQ ID NO: 485367 - RNA, 32 nt, Human
uacaacgcuggagccgcuuccccagcucagag

SEQ ID NO: 485368 - RNA, 32 nt, Human
uacaacguccaggagaaggccauccagcgcuu

SEQ ID NO: 485369 - RNA, 32 nt, Human
uacaacguggagaagaaaagauauacuuacua

SEQ ID NO: 485370 - RNA, 32 nt, Human
uacaacuacauacauuuuugaagaccaaaugg

SEQ ID NO: 485371 - RNA, 32 nt, Human
uacaacucaaaauacaccagcucauuuggcug

SEQ ID NO: 485372 - RNA, 32 nt, Human
uacaacucaagcauuccucccaccuuggucuc

SEQ ID NO: 485373 - RNA, 32 nt, Human
uacaacucgaggagaacccagaccaggacagg

SEQ ID NO: 485374 - RNA, 32 nt, Human
uacaacugaccauuuaaaauugaacaaguuua

SEQ ID NO: 485375 - RNA, 32 nt, Human
uacaacugaguucugucuggcccagaaccagc

SEQ ID NO: 485376 - RNA, 32 nt, Human
uacaacugaugugcccuuagagcgcacuaguu

SEQ ID NO: 485377 - RNA, 32 nt, Human
uacaacugauugcaacagacuguugaguuaug

SEQ ID NO: 485378 - RNA, 32 nt, Human
uacaacuuccagauuugagcugccuggaggga

SEQ ID NO: 485379 - RNA, 32 nt, Human
uacaacuucuaucacccaacagugccaauggc

SEQ ID NO: 485380 - RNA, 32 nt, Human
uacaacuugcauuuacagaugguaauuccuag

SEQ ID NO: 485381 - RNA, 32 nt, Human
uacaacuugugggugaguuccaaagagcuugg

SEQ ID NO: 485382 - RNA, 32 nt, Human
uacaacuuugagcaaauagcagugauguuuua

SEQ ID NO: 485383 - RNA, 32 nt, Human
uacaagaaaggcaccugcaaggacugcaggac

SEQ ID NO: 485384 - RNA, 32 nt, Human
uacaagaaaggcaccugcaaggacugcucugu

SEQ ID NO: 485385 - RNA, 32 nt, Human
uacaagaaaggccugaauggaggacuuuucug

SEQ ID NO: 485386 - RNA, 32 nt, Human
uacaagaacaaugacaccacacucugccugaa

SEQ ID NO: 485387 - RNA, 32 nt, Human
uacaagaacuguauugccacacaugucagcua

SEQ ID NO: 485388 - RNA, 32 nt, Human
uacaagaagaagaaagaaagaaaucccacaga

SEQ ID NO: 485389 - RNA, 32 nt, Human
uacaagaagagcuuccuuuaaaguuccuauuu

SEQ ID NO: 485390 - RNA, 32 nt, Human
uacaagaagcagcugaggaaagggagacaagg

SEQ ID NO: 485391 - RNA, 32 nt, Human
uacaagaaguccccagcagcacacacacauuu

SEQ ID NO: 485392 - RNA, 32 nt, Human
uacaagaauaccacauuuugaaacccagaaag

SEQ ID NO: 485393 - RNA, 32 nt, Human
uacaagaaugagccaccgugccuggccuauuu

SEQ ID NO: 485394 - RNA, 21 nt, Human
uacaagacagcccagugucau

SEQ ID NO: 485395 - RNA, 32 nt, Human
uacaagacagcucuagagaagcucccucugcu

SEQ ID NO: 485396 - RNA, 32 nt, Human
uacaagaccagaaaugccacggccgcguccug

SEQ ID NO: 485397 - RNA, 32 nt, Human
uacaagacuauguaacacaaccugcacuucuc

SEQ ID NO: 485398 - RNA, 32 nt, Human
uacaagacuccuucagccaacaugaugguacu

SEQ ID NO: 485399 - RNA, 32 nt, Human
uacaagacuuggauacauuacagcagacaugg

SEQ ID NO: 485400 - RNA, 32 nt, Human
uacaagagaacagcugguugugauggcaggag

SEQ ID NO: 485401 - RNA, 32 nt, Human
uacaagagaagaggaagggagcagagagcacu

SEQ ID NO: 485402 - RNA, 32 nt, Human
uacaagagcccagcuagcugauauuuuuaauc

SEQ ID NO: 485403 - RNA, 32 nt, Human
uacaagaggaaucaccugguuucccaaccaau

SEQ ID NO: 485404 - RNA, 32 nt, Human
uacaagagggccuggggcacgauguggucagc

SEQ ID NO: 485405 - RNA, 32 nt, Human
uacaagaguaguuucuuacacaguuuaacaca

SEQ ID NO: 485406 - RNA, 20 nt, Human
uacaagagugcgccaccacg

SEQ ID NO: 485407 - RNA, 32 nt, Human
uacaagaguuaaaacuuccugucccauuuagu

SEQ ID NO: 485408 - RNA, 32 nt, Human
uacaagaguuugcagugcaggcacugaugaac

SEQ ID NO: 485409 - RNA, 32 nt, Human
uacaagauaaagaagucugugccugaaugaau

SEQ ID NO: 485410 - RNA, 32 nt, Human
uacaagaucccugaacuuaugccuccuaacug

SEQ ID NO: 485411 - RNA, 32 nt, Human
uacaagaucuacaaugcagcugaaaagcaacc

SEQ ID NO: 485412 - RNA, 32 nt, Human
uacaagaugauaccuuaauuacacucccgcaa

SEQ ID NO: 485413 - RNA, 32 nt, Human
uacaagaugcugcggccauuugcacauucuua

SEQ ID NO: 485414 - RNA, 32 nt, Human
uacaagcaagcaggccaggcagcugugggcaa

SEQ ID NO: 485415 - RNA, 32 nt, Human
uacaagcacaauucucccaguuaaggggcugg

SEQ ID NO: 485416 - RNA, 23 nt, Human
uacaagcacaugccaccaugccc

SEQ ID NO: 485417 - RNA, 32 nt, Human
uacaagcacaugccaccaugcccagcuaauuu

SEQ ID NO: 485418 - RNA, 32 nt, Human
uacaagcaccagccaccaugccuggcuaauuu

SEQ ID NO: 485419 - RNA, 19 nt, Human
uacaagcacccaccaccac

SEQ ID NO: 485420 - RNA, 32 nt, Human
uacaagcaccucaggugucugaaauaucucaa

SEQ ID NO: 485421 - RNA, 32 nt, Human
uacaagcacgacugaggcaacggcacgaagac

SEQ ID NO: 485422 - RNA, 32 nt, Human
uacaagcagagcucuuagcucagucccguggg

SEQ ID NO: 485423 - RNA, 20 nt, Human
uacaagcauaugccaccacg

SEQ ID NO: 485424 - RNA, 32 nt, Human
uacaagcaucuucucuggcguggauccgcugc

SEQ ID NO: 485425 - RNA, 32 nt, Human
uacaagcaugagccaccacaccuggccuaugu

SEQ ID NO: 485426 - RNA, 32 nt, Human
uacaagcaugagccaccacaccuggccuguua

SEQ ID NO: 485427 - RNA, 32 nt, Human
uacaagcaugagccaccacgccugagcuuucu

SEQ ID NO: 485428 - RNA, 20 nt, Human
uacaagcaugagccaccaug

SEQ ID NO: 485429 - RNA, 32 nt, Human
uacaagcaugagccaccgcaccugaccaaauu

SEQ ID NO: 485430 - RNA, 32 nt, Human
uacaagcaugagccacggcagccagcccuucu

SEQ ID NO: 485431 - RNA, 32 nt, Human
uacaagcaugagccacugugcccagccuguuc

SEQ ID NO: 485432 - RNA, 32 nt, Human
uacaagcaugagccacugugcccagccuucuu

SEQ ID NO: 485433 - RNA, 32 nt, Human
uacaagcaugagccacugugccugacccucaa

SEQ ID NO: 485434 - RNA, 20 nt, Human
uacaagcaugcaccaccaug

SEQ ID NO: 485435 - RNA, 32 nt, Human
uacaagcaugcaccaccaugcccagcuaauuu

SEQ ID NO: 485436 - RNA, 20 nt, Human
uacaagcaugcgccaccaug

SEQ ID NO: 485437 - RNA, 32 nt, Human
uacaagcaugcgccaccaugcccagcuuauuu

SEQ ID NO: 485438 - RNA, 32 nt, Human
uacaagcaugggccaccgcacccggccuauuu

SEQ ID NO: 485439 - RNA, 32 nt, Human
uacaagcaugugccaccauggccagcuaagug

SEQ ID NO: 485440 - RNA, 32 nt, Human
uacaagccacaggccccuuccccagccucagu

SEQ ID NO: 485441 - RNA, 32 nt, Human
uacaagccaccauaugcacagacuauacagcg

SEQ ID NO: 485442 - RNA, 32 nt, Human
uacaagccaccauaugcacagacuauacagug

SEQ ID NO: 485443 - RNA, 32 nt, Human
uacaagccagcugccauguugugagcacauac

SEQ ID NO: 485444 - RNA, 32 nt, Human
uacaagcccugggguuugaagcugacuuuaua

SEQ ID NO: 485445 - RNA, 32 nt, Human
uacaagccugagccaccgugcccggcccugaa

SEQ ID NO: 485446 - RNA, 19 nt, Human
uacaagcggcugccaccac

SEQ ID NO: 485447 - RNA, 20 nt, Human
uacaagcgugaaccaccaug

SEQ ID NO: 485448 - RNA, 32 nt, Human
uacaagcgugaaccacccugcccagccagaaa

SEQ ID NO: 485449 - RNA, 32 nt, Human
uacaagcgugagccaccacacuaggccuuuag

SEQ ID NO: 485450 - RNA, 32 nt, Human
uacaagcgugagccaccauuccuggacccucg

SEQ ID NO: 485451 - RNA, 32 nt, Human
uacaagcgugagccaccgaccccugccgagga

SEQ ID NO: 485452 - RNA, 19 nt, Human
uacaagcgugagccaccgc

SEQ ID NO: 485453 - RNA, 32 nt, Human
uacaagcgugagccaccgcacccugccugaau

SEQ ID NO: 485454 - RNA, 20 nt, Human
uacaagcgugagccaccgcg

SEQ ID NO: 485455 - RNA, 32 nt, Human
uacaagcgugagccaccgggccuggccugcau

SEQ ID NO: 485456 - RNA, 32 nt, Human
uacaagcgugagccaccgugccuggccugcca

SEQ ID NO: 485457 - RNA, 32 nt, Human
uacaagcgugagccacugcacccagccuguaa

SEQ ID NO: 485458 - RNA, 32 nt, Human
uacaagcgugagccacugcaccgggccacaga

SEQ ID NO: 485459 - RNA, 32 nt, Human
uacaagcgugagccacugugccuggcccuuuu

SEQ ID NO: 485460 - RNA, 32 nt, Human
uacaagcgugagccacugugcugggcccgagg

SEQ ID NO: 485461 - RNA, 32 nt, Human
uacaagcgugagcuaaccuugcccagccucug

SEQ ID NO: 485462 - RNA, 20 nt, Human
uacaagcgugcgccaccaug

SEQ ID NO: 485463 - RNA, 32 nt, Human
uacaagcgugcgccaccaugccuggcuaauuu

SEQ ID NO: 485464 - RNA, 19 nt, Human
uacaagcgugugcccccac

SEQ ID NO: 485465 - RNA, 32 nt, Human
uacaagcuacagaauauauacaugcaucuaug

SEQ ID NO: 485466 - RNA, 32 nt, Human
uacaagcucucaucauaugcaaauucucagaa

SEQ ID NO: 485467 - RNA, 32 nt, Human
uacaagcucucucucuuugccugcugccaucc

SEQ ID NO: 485468 - RNA, 32 nt, Human
uacaagcucugccucccgaguucaagugauuc

SEQ ID NO: 485469 - RNA, 32 nt, Human
uacaagcugcauguccugacccucuuugaauu

SEQ ID NO: 485470 - RNA, 32 nt, Human
uacaagcugggaacuucuaaacacuucauucu

SEQ ID NO: 485471 - RNA, 32 nt, Human
uacaagcuugagcuaccgcgcccagccaacac

SEQ ID NO: 485472 - RNA, 32 nt, Human
uacaagcuugccaaagauagaauauggaucgc

SEQ ID NO: 485473 - RNA, 32 nt, Human
uacaagcuugugcuguaggcacaugccuucug

SEQ ID NO: 485474 - RNA, 32 nt, Human
uacaaggaaaguuaaguaaaugucuuuacauu

SEQ ID NO: 485475 - RNA, 32 nt, Human
uacaaggaaaugcaguaaagccagggaauuua

SEQ ID NO: 485476 - RNA, 32 nt, Human
uacaaggaagcauacauagugggucaaggaga

SEQ ID NO: 485477 - RNA, 32 nt, Human
uacaaggaagggacacagggcuuaaaaugucc

SEQ ID NO: 485478 - RNA, 32 nt, Human
uacaaggacauggugagucuauuuuuaaugca

SEQ ID NO: 485479 - RNA, 32 nt, Human
uacaaggagggugguuaaucugcuauaucaaa

SEQ ID NO: 485480 - RNA, 32 nt, Human
uacaaggaguucaagcugacuguggagaacau

SEQ ID NO: 485481 - RNA, 32 nt, Human
uacaaggaucagagcugcuguaaugaaccuca

SEQ ID NO: 485482 - RNA, 19 nt, Human
uacaaggcacaccaccaug

SEQ ID NO: 485483 - RNA, 32 nt, Human
uacaaggcggagaaccuggagcagggaugaag

SEQ ID NO: 485484 - RNA, 32 nt, Human
uacaaggcugugguagaaucauaccccaugga

SEQ ID NO: 485485 - RNA, 32 nt, Human
uacaagggaggaacaccugaucuuccagaaaa

SEQ ID NO: 485486 - RNA, 32 nt, Human
uacaagggcaacagguaugguccuccgauauu

SEQ ID NO: 485487 - RNA, 32 nt, Human
uacaagggccagccuggccaacauggugaaac

SEQ ID NO: 485488 - RNA, 32 nt, Human
uacaagggugagccaccaugcccggccguaaa

SEQ ID NO: 485489 - RNA, 32 nt, Human
uacaagguacuaggaaggaaguuucucuucua

SEQ ID NO: 485490 - RNA, 32 nt, Human
uacaagguucuugaaugaaaauaaucuguuga

SEQ ID NO: 485491 - RNA, 20 nt, Human
uacaaguacacacuaccacg

SEQ ID NO: 485492 - RNA, 32 nt, Human
uacaaguaggaacuuccuuuccuucacuuccc

SEQ ID NO: 485493 - RNA, 32 nt, Human
uacaaguagggagcagggaaagaagagugagc

SEQ ID NO: 485494 - RNA, 23 nt, Human
uacaaguauaaggauuuuggcca

SEQ ID NO: 485495 - RNA, 32 nt, Human
uacaaguaugagccacugcauccggcccaucu

SEQ ID NO: 485496 - RNA, 32 nt, Human
uacaagucacccagccagaaggaaugcacagu

SEQ ID NO: 485497 - RNA, 32 nt, Human
uacaagucgugcuggcuaauuuuuaguuugua

SEQ ID NO: 485498 - RNA, 32 nt, Human
uacaagugaagaaacaaggaggcacuuccugu

SEQ ID NO: 485499 - RNA, 32 nt, Human
uacaagugaaugaagaaugaaagggaaagaau

SEQ ID NO: 485500 - RNA, 32 nt, Human
uacaagugacugccacuaugcccagcuaauuu

SEQ ID NO: 485501 - RNA, 32 nt, Human
uacaagugcacgccaccaugccuggcuaauuu

SEQ ID NO: 485502 - RNA, 20 nt, Human
uacaagugcccaccaccaug

SEQ ID NO: 485503 - RNA, 32 nt, Human
uacaagugcccaccaccaugcccagcuaauuu

SEQ ID NO: 485504 - RNA, 29 nt, Human
uacaagugccugcuaucccucucccacuc

SEQ ID NO: 485505 - RNA, 19 nt, Human
uacaagugcgcacuaccac

SEQ ID NO: 485506 - RNA, 32 nt, Human
uacaagugcuucuugaccccuuccucaauguu

SEQ ID NO: 485507 - RNA, 32 nt, Human
uacaaguggcuaagccaacaacagaauaaaua

SEQ ID NO: 485508 - RNA, 19 nt, Human
uacaagugugagccaccac

SEQ ID NO: 485509 - RNA, 32 nt, Human
uacaagugugagccaccacacccagccuaaug

SEQ ID NO: 485510 - RNA, 32 nt, Human
uacaagugugagccaccacaccuggccuggaa

SEQ ID NO: 485511 - RNA, 32 nt, Human
uacaagugugagccaccacaccuggcuccaga

SEQ ID NO: 485512 - RNA, 20 nt, Human
uacaagugugagccaccacg

SEQ ID NO: 485513 - RNA, 32 nt, Human
uacaagugugagccaccacgccaagccugacu

SEQ ID NO: 485514 - RNA, 32 nt, Human
uacaagugugagccaccgcgcccggcccaguu

SEQ ID NO: 485515 - RNA, 32 nt, Human
uacaagugugagccaccgcgccuggcccaagc

SEQ ID NO: 485516 - RNA, 32 nt, Human
uacaagugugagccacugcgacaggccucuuu

SEQ ID NO: 485517 - RNA, 32 nt, Human
uacaagugugagccacugugcccagcuuuuga

SEQ ID NO: 485518 - RNA, 20 nt, Human
uacaagugugcaccaccaug

SEQ ID NO: 485519 - RNA, 32 nt, Human
uacaagugugcaccaccaugccuggcuaauuu

SEQ ID NO: 485520 - RNA, 32 nt, Human
uacaaguguguaccaccaugccuggcugaaca

SEQ ID NO: 485521 - RNA, 32 nt, Human
uacaagugugugccaccaugccucacuaauuu

SEQ ID NO: 485522 - RNA, 21 nt, Human
uacaaguuccugaauguccca

SEQ ID NO: 485523 - RNA, 21 nt, Human
uacaaguucucugacuguguu

SEQ ID NO: 485524 - RNA, 32 nt, Human
uacaaguucuuuccucuucauuugaugccgug

SEQ ID NO: 485525 - RNA, 32 nt, Human
uacaaguugauccaaaggauaaggcugugacu

SEQ ID NO: 485526 - RNA, 32 nt, Human
uacaauaaauacugcuuuccucuaaaaagauc

SEQ ID NO: 485527 - RNA, 32 nt, Human
uacaauaaauuagcugggcaugguggugggug

SEQ ID NO: 485528 - RNA, 32 nt, Human
uacaauaauggaagggaaagaaagaagacaaa

SEQ ID NO: 485529 - RNA, 32 nt, Human
uacaauagaaaccaaaccaaaugggcacccuc

SEQ ID NO: 485530 - RNA, 32 nt, Human
uacaauagaguggaagucuguaguaguuaaua

SEQ ID NO: 485531 - RNA, 32 nt, Human
uacaauauacuuuuuauugagcacuuugcugc

SEQ ID NO: 485532 - RNA, 23 nt, Human
uacaauauguuguaaaauguaga

SEQ ID NO: 485533 - RNA, 32 nt, Human
uacaauauucaggaagcacauuuauucagauu

SEQ ID NO: 485534 - RNA, 22 nt, Human
uacaauauuuuaaagguguaga

SEQ ID NO: 485535 - RNA, 20 nt, Human
uacaaucaaagaagaggaaa

SEQ ID NO: 485536 - RNA, 24 nt, Human
uacaaucaaaggaacuucaggaaa

SEQ ID NO: 485537 - RNA, 32 nt, Human
uacaaucaccucacuccagcauggugucuguu

SEQ ID NO: 485538 - RNA, 32 nt, Human
uacaaucagaacuuggagauuuuaagaaaagg

SEQ ID NO: 485539 - RNA, 32 nt, Human
uacaaucaggaugacaaucaccaggaauuggg

SEQ ID NO: 485540 - RNA, 32 nt, Human
uacaaucaugcuauucuuacacuugcuauuuu

SEQ ID NO: 485541 - RNA, 32 nt, Human
uacaauccaagugcauucaacaagugauaugg

SEQ ID NO: 485542 - RNA, 32 nt, Human
uacaaucuaaaaagcacccaauggaguauaaa

SEQ ID NO: 485543 - RNA, 21 nt, Human
uacaaucugaaacucaggaaa

SEQ ID NO: 485544 - RNA, 19 nt, Human
uacaaucugugaccaccac

SEQ ID NO: 485545 - RNA, 32 nt, Human
uacaaugaaaaugcagugcucagucccaaaaa

SEQ ID NO: 485546 - RNA, 32 nt, Human
uacaaugaaaggcuucucagcaugauacccca

SEQ ID NO: 485547 - RNA, 32 nt, Human
uacaaugaaauggcaggaugccaauaugagau

SEQ ID NO: 485548 - RNA, 32 nt, Human
uacaaugagacaccaucucacaccagucaaaa

SEQ ID NO: 485549 - RNA, 32 nt, Human
uacaaugagcggugccugggggcuggaggaga

SEQ ID NO: 485550 - RNA, 32 nt, Human
uacaaugaucugcuuuagugagaggacaauuu

SEQ ID NO: 485551 - RNA, 32 nt, Human
uacaaugauuuucucccuucuuuuacaguagc

SEQ ID NO: 485552 - RNA, 32 nt, Human
uacaaugcagucaggcuggaccagagaauucc

SEQ ID NO: 485553 - RNA, 32 nt, Human
uacaaugccaggaagaugaaugugcguuaaug

SEQ ID NO: 485554 - RNA, 32 nt, Human
uacaaugcgugguuuccagaccugcagcuugu

SEQ ID NO: 485555 - RNA, 31 nt, Human
uacaauggcaggaucucagcucaccacaacc

SEQ ID NO: 485556 - RNA, 31 nt, Human
uacaauggcaugaucucagcucacugcaacc

SEQ ID NO: 485557 - RNA, 31 nt, Human
uacaauggcgagaucucagcucacggcaacc

SEQ ID NO: 485558 - RNA, 31 nt, Human
uacaauggcgcgaucucagcucaccgcaacc

SEQ ID NO: 485559 - RNA, 31 nt, Human
uacaauggcgugaucucagcucacucugcaa

SEQ ID NO: 485560 - RNA, 32 nt, Human
uacaauggcucacgccuguaauccuaacacuu

SEQ ID NO: 485561 - RNA, 32 nt, Human
uacaauggguguccacaugcacguguauaugu

SEQ ID NO: 485562 - RNA, 31 nt, Human
uacaauggugcgaucucagcucagugcaacc

SEQ ID NO: 485563 - RNA, 32 nt, Human
uacaauguaaaugacaaaacauaauuccugag

SEQ ID NO: 485564 - RNA, 32 nt, Human
uacaauguaagugcuuuuaauggcuguuuucc

SEQ ID NO: 485565 - RNA, 32 nt, Human
uacaaugucccauuuucuggauuugucugauc

SEQ ID NO: 485566 - RNA, 32 nt, Human
uacaauuacugcccuaaaaugucucuggcaau

SEQ ID NO: 485567 - RNA, 32 nt, Human
uacaauuacuuaaauguaucacagacugucac

SEQ ID NO: 485568 - RNA, 32 nt, Human
uacaauuaggcagaggucaaaaagugacaaug

SEQ ID NO: 485569 - RNA, 32 nt, Human
uacaauuaucaagcagagaccaccucagauua

SEQ ID NO: 485570 - RNA, 32 nt, Human
uacaauucagacaaacugcuuucuccugucca

SEQ ID NO: 485571 - RNA, 32 nt, Human
uacaauucaguuauuucuguaguuuguaaacu

SEQ ID NO: 485572 - RNA, 32 nt, Human
uacaauucaguuucagcucuggauuacuucag

SEQ ID NO: 485573 - RNA, 32 nt, Human
uacaauugaugugguuuucauuucucauguuu

SEQ ID NO: 485574 - RNA, 20 nt, Human
uacaauugugagccaccacg

SEQ ID NO: 485575 - RNA, 32 nt, Human
uacaauugugagccaccacguggagcuggaag

SEQ ID NO: 485576 - RNA, 32 nt, Human
uacaauugugagccaccaugccaggcucauug

SEQ ID NO: 485577 - RNA, 32 nt, Human
uacaauuguuaaaaauacagacaugcacauuc

SEQ ID NO: 485578 - RNA, 23 nt, Human
uacaauuguugacuuuucuuuua

SEQ ID NO: 485579 - RNA, 30 nt, Human
uacaauuuagcuuaaucagaaagccucucc

SEQ ID NO: 485580 - RNA, 31 nt, Human
uacaauuucaauaaauuuggggaaaacaaau

SEQ ID NO: 485581 - RNA, 32 nt, Human
uacaauuuuaagaggggagggaagggaaaguu

SEQ ID NO: 485582 - RNA, 32 nt, Human
uacacaaaaagcuuaugaagauguuccuuggg

SEQ ID NO: 485583 - RNA, 32 nt, Human
uacacaaaauuagcugggcgugguggugggca

SEQ ID NO: 485584 - RNA, 32 nt, Human
uacacaaaauuuuauuuaaagagaacacuuag

SEQ ID NO: 485585 - RNA, 32 nt, Human
uacacaaagaacacucuauauaacuguguuaa

SEQ ID NO: 485586 - RNA, 32 nt, Human
uacacaaagaaggaggaggaaaaggugagaaa

SEQ ID NO: 485587 - RNA, 32 nt, Human
uacacaaagaggaaguggggaaaaaggcaaaa

SEQ ID NO: 485588 - RNA, 32 nt, Human
uacacaaaggccagggagccuuuggcuuggac

SEQ ID NO: 485589 - RNA, 32 nt, Human
uacacaaccaacaaaaccgcaaaauauuccca

SEQ ID NO: 485590 - RNA, 32 nt, Human
uacacaagucagaggaaggaaggguccugaaa

SEQ ID NO: 485591 - RNA, 32 nt, Human
uacacaauaaagagaugagacacugcccccaa

SEQ ID NO: 485592 - RNA, 32 nt, Human
uacacaauacacuugaacuguggaauaaagca

SEQ ID NO: 485593 - RNA, 32 nt, Human
uacacaauauaaaauaugaaacucaauaauaa

SEQ ID NO: 485594 - RNA, 32 nt, Human
uacacaaucaacuucaaccccaauagaagaga

SEQ ID NO: 485595 - RNA, 32 nt, Human
uacacaaucccccauccucaaguccccaccgc

SEQ ID NO: 485596 - RNA, 32 nt, Human
uacacaaugaaaacacaucuguuggggugauc

SEQ ID NO: 485597 - RNA, 32 nt, Human
uacacaaugcugcaggugcuucccaggggcca

SEQ ID NO: 485598 - RNA, 32 nt, Human
uacacacaagggccaggcuccauucucccucc

SEQ ID NO: 485599 - RNA, 32 nt, Human
uacacacacauccauacacucugacaaucucc

SEQ ID NO: 485600 - RNA, 32 nt, Human
uacacacacaugcaugcaugcacacacgagca

SEQ ID NO: 485601 - RNA, 32 nt, Human
uacacacacuucaggugguuugugcuucaaag

SEQ ID NO: 485602 - RNA, 20 nt, Human
uacacacagauguacacaca

SEQ ID NO: 485603 - RNA, 32 nt, Human
uacacacagcacauauaugcacaaaauagccu

SEQ ID NO: 485604 - RNA, 32 nt, Human
uacacacaggaucccugcugggcaccaacagc

SEQ ID NO: 485605 - RNA, 32 nt, Human
uacacacagucuggaaaagcagccugggcuuc

SEQ ID NO: 485606 - RNA, 16 nt, Human
uacacacauauacaca

SEQ ID NO: 485607 - RNA, 18 nt, Human
uacacacauauacacaca

SEQ ID NO: 485608 - RNA, 32 nt, Human
uacacacauauguaggauguaugcauguguga

SEQ ID NO: 485609 - RNA, 32 nt, Human
uacacacaucuccaugcagaagcacaacuggg

SEQ ID NO: 485610 - RNA, 32 nt, Human
uacacacaugcacacacauauacacacaugug

SEQ ID NO: 485611 - RNA, 32 nt, Human
uacacacaugcacacacauaugcacacacaug

SEQ ID NO: 485612 - RNA, 32 nt, Human
uacacacaugguguacacccacugugacauua

SEQ ID NO: 485613 - RNA, 32 nt, Human
uacacacaugguguacacccacuuugauauua

SEQ ID NO: 485614 - RNA, 23 nt, Human
uacacacauguauaauauauaca

SEQ ID NO: 485615 - RNA, 32 nt, Human
uacacacaugugcacacacccucaugcauggg

SEQ ID NO: 485616 - RNA, 32 nt, Human
uacacaccaacacacauaugcacacucacacu

SEQ ID NO: 485617 - RNA, 32 nt, Human
uacacacccacauucccuuuuuaucaugacau

SEQ ID NO: 485618 - RNA, 32 nt, Human
uacacaccuaguucauaauccucauaauuuau

SEQ ID NO: 485619 - RNA, 32 nt, Human
uacacacgugugugugcgcguguguauaaaac

SEQ ID NO: 485620 - RNA, 32 nt, Human
uacacacguuaacagaaaucaucugauccccu

SEQ ID NO: 485621 - RNA, 32 nt, Human
uacacacucagccccuucuguacagcaccucu

SEQ ID NO: 485622 - RNA, 32 nt, Human
uacacacucugagucucugaaugaagcugaag

SEQ ID NO: 485623 - RNA, 32 nt, Human
uacacacugaguaguauguauuucauggauga

SEQ ID NO: 485624 - RNA, 32 nt, Human
uacacacugcaagcuucuccuuggcuuguagc

SEQ ID NO: 485625 - RNA, 32 nt, Human
uacacacugcagcagagcuuguagcuggacag

SEQ ID NO: 485626 - RNA, 32 nt, Human
uacacacuugcauacacauacacaacaugugu

SEQ ID NO: 485627 - RNA, 32 nt, Human
uacacagaaauccuaacauuauauucccaaau

SEQ ID NO: 485628 - RNA, 32 nt, Human
uacacagaauggaguccucuagccuaaagaua

SEQ ID NO: 485629 - RNA, 32 nt, Human
uacacagagcgcugagagaguggggcagugug

SEQ ID NO: 485630 - RNA, 32 nt, Human
uacacagaggcgggucuauaacaggcaaucaa

SEQ ID NO: 485631 - RNA, 32 nt, Human
uacacagaugcacacacacaagcacacaugca

SEQ ID NO: 485632 - RNA, 32 nt, Human
uacacagauguucacccaaccacaucccacuc

SEQ ID NO: 485633 - RNA, 32 nt, Human
uacacagcacaucugcagucauucaggagguc

SEQ ID NO: 485634 - RNA, 32 nt, Human
uacacagcagucuucagcccccuggaaggagg

SEQ ID NO: 485635 - RNA, 32 nt, Human
uacacagccugcaggccccggggcagccucca

SEQ ID NO: 485636 - RNA, 32 nt, Human
uacacaggacuucacuccagaguuaccauuau

SEQ ID NO: 485637 - RNA, 32 nt, Human
uacacaggcaccaggccagccugccugaggac

SEQ ID NO: 485638 - RNA, 32 nt, Human
uacacaggcagcucugcagggaagucugugac

SEQ ID NO: 485639 - RNA, 32 nt, Human
uacacagggaacacuucuugggcagccaggug

SEQ ID NO: 485640 - RNA, 32 nt, Human
uacacagggcugcugucacuucccagggccca

SEQ ID NO: 485641 - RNA, 32 nt, Human
uacacaggugcuggucgauguccacuuucugc

SEQ ID NO: 485642 - RNA, 32 nt, Human
uacacaggugggguagagagugggucagcagc

SEQ ID NO: 485643 - RNA, 32 nt, Human
uacacaguauucacuugucucccuuuaguagu

SEQ ID NO: 485644 - RNA, 32 nt, Human
uacacaguccucucccuauuaauaugggcaca

SEQ ID NO: 485645 - RNA, 32 nt, Human
uacacaguucacucuagcuucuuccaaaauau

SEQ ID NO: 485646 - RNA, 32 nt, Human
uacacaguucauccauucuccaugcagucuuu

SEQ ID NO: 485647 - RNA, 32 nt, Human
uacacaguugcuggcuuugcuccugggcaagg

SEQ ID NO: 485648 - RNA, 32 nt, Human
uacacauacagaauacuuacuauguuccaagc

SEQ ID NO: 485649 - RNA, 32 nt, Human
uacacauacauacacacacaaauacacaaucu

SEQ ID NO: 485650 - RNA, 32 nt, Human
uacacauacauacacacauacaaaaccuuuaa

SEQ ID NO: 485651 - RNA, 32 nt, Human
uacacauagccaugcagcaaacuacaguuuuu

SEQ ID NO: 485652 - RNA, 32 nt, Human
uacacauccagaugccagcccagcuaccacag

SEQ ID NO: 485653 - RNA, 32 nt, Human
uacacaucucagacccuuuagccaaacccuug

SEQ ID NO: 485654 - RNA, 32 nt, Human
uacacaugaguuucccaaauguguaccuggac

SEQ ID NO: 485655 - RNA, 22 nt, Human
uacacaugcacacccucucuga

SEQ ID NO: 485656 - RNA, 24 nt, Human
uacacaugcacauaugugccuugg

SEQ ID NO: 485657 - RNA, 32 nt, Human
uacacaugcacgcuugcacacaugcacacaga

SEQ ID NO: 485658 - RNA, 32 nt, Human
uacacaugcaugcacacauacacaggcauaca

SEQ ID NO: 485659 - RNA, 32 nt, Human
uacacaugcccaggcagcaccucaggcccuuu

SEQ ID NO: 485660 - RNA, 32 nt, Human
uacacaugcuugcacacaugcacacacaguga

SEQ ID NO: 485661 - RNA, 32 nt, Human
uacacauggaaagaggguuuaacagacccucu

SEQ ID NO: 485662 - RNA, 32 nt, Human
uacacaugggagcugccugccugcugcugcug

SEQ ID NO: 485663 - RNA, 32 nt, Human
uacacaugguauagcuugcuuggcguuugacu

SEQ ID NO: 485664 - RNA, 30 nt, Human
uacacaugucccugcaacuuuacccuguac

SEQ ID NO: 485665 - RNA, 31 nt, Human
uacacauguggcuugucuugccaauagacuc

SEQ ID NO: 485666 - RNA, 18 nt, Human
uacacauuccaucuuaca

SEQ ID NO: 485667 - RNA, 32 nt, Human
uacacauuugacuuccuauuggcccuuugaaa

SEQ ID NO: 485668 - RNA, 32 nt, Human
uacacauuuugcacuugggaggagggaggcua

SEQ ID NO: 485669 - RNA, 32 nt, Human
uacaccaacauagcuacaaucaaacaggccug

SEQ ID NO: 485670 - RNA, 32 nt, Human
uacaccaaccugugccccaggggcuucaagag

SEQ ID NO: 485671 - RNA, 32 nt, Human
uacaccacaaauauauccuguggcccuuucag

SEQ ID NO: 485672 - RNA, 32 nt, Human
uacaccacacacaccgucaucacauuuucaca

SEQ ID NO: 485673 - RNA, 32 nt, Human
uacaccacacccaggguggaaaccacaguugc

SEQ ID NO: 485674 - RNA, 32 nt, Human
uacaccacuacacuccagccugggcaacagag

SEQ ID NO: 485675 - RNA, 32 nt, Human
uacaccacugagggaaucccugugcugaucgu

SEQ ID NO: 485676 - RNA, 32 nt, Human
uacaccacugcacuccagucuggaugacaaag

SEQ ID NO: 485677 - RNA, 32 nt, Human
uacaccacugcacuucagucugugugacugag

SEQ ID NO: 485678 - RNA, 32 nt, Human
uacaccacugcacuugagccugggcagcagag

SEQ ID NO: 485679 - RNA, 32 nt, Human
uacaccagccaugcccgcggcaccacaugugu

SEQ ID NO: 485680 - RNA, 32 nt, Human
uacaccagccugggugacagagcaagacucuu

SEQ ID NO: 485681 - RNA, 32 nt, Human
uacaccagcuccaaguaacuugucccugcaac

SEQ ID NO: 485682 - RNA, 32 nt, Human
uacaccaggcugggugcgguggcucacgccug

SEQ ID NO: 485683 - RNA, 32 nt, Human
uacaccauccaucaccaacagaaacaugguua

SEQ ID NO: 485684 - RNA, 32 nt, Human
uacaccauggaauacuaugcagccauaaaaag

SEQ ID NO: 485685 - RNA, 32 nt, Human
uacaccauggaauacuaugcagccauaaagaa

SEQ ID NO: 485686 - RNA, 32 nt, Human
uacaccauggaauacuaugcagccauagaaaa

SEQ ID NO: 485687 - RNA, 32 nt, Human
uacaccauggaauacuaugcagccauuaagaa

SEQ ID NO: 485688 - RNA, 32 nt, Human
uacaccauugcauuccagccuaggcaacagag

SEQ ID NO: 485689 - RNA, 32 nt, Human
uacaccauugcauuccagccugggcaacagag

SEQ ID NO: 485690 - RNA, 32 nt, Human
uacacccaagccuugaugggauucugcugcga

SEQ ID NO: 485691 - RNA, 32 nt, Human
uacacccaagcuguuuuagcagcuccaaccac

SEQ ID NO: 485692 - RNA, 32 nt, Human
uacacccaagugccuaaaagaucucauuguaa

SEQ ID NO: 485693 - RNA, 32 nt, Human
uacacccaccgaggcauggggcucccugggcu

SEQ ID NO: 485694 - RNA, 32 nt, Human
uacacccagcacuuuggaaggcugaggaagga

SEQ ID NO: 485695 - RNA, 32 nt, Human
uacacccagcagaggacuccagccuucucggg

SEQ ID NO: 485696 - RNA, 32 nt, Human
uacacccagccuggcccagggccggcuuugcc

SEQ ID NO: 485697 - RNA, 32 nt, Human
uacacccaguaacagugguuacccacagugca

SEQ ID NO: 485698 - RNA, 32 nt, Human
uacaccccagcaaccauguccaagggaccugc

SEQ ID NO: 485699 - RNA, 32 nt, Human
uacaccccaucuuuaacuccacagaccaagac

SEQ ID NO: 485700 - RNA, 32 nt, Human
uacaccccaucuuugacucaguuccccacacc

SEQ ID NO: 485701 - RNA, 32 nt, Human
uacacccccacgcaccagaagggaggugccag

SEQ ID NO: 485702 - RNA, 32 nt, Human
uacacccccugccccgccaaacacacaauugg

SEQ ID NO: 485703 - RNA, 32 nt, Human
uacaccccucccccagcuccuuccccagauuc

SEQ ID NO: 485704 - RNA, 32 nt, Human
uacaccccugcacuccagccugggcggcagag

SEQ ID NO: 485705 - RNA, 32 nt, Human
uacaccccuggacuccagcuugggugacacag

SEQ ID NO: 485706 - RNA, 32 nt, Human
uacacccuccaccuccccauccccuguucucc

SEQ ID NO: 485707 - RNA, 32 nt, Human
uacacccugggggaaauaauuucugugguuuu

SEQ ID NO: 485708 - RNA, 32 nt, Human
uacaccgacccucguguccucccuucauccug

SEQ ID NO: 485709 - RNA, 32 nt, Human
uacaccuaaauacuccuccuuuuguaucauuc

SEQ ID NO: 485710 - RNA, 32 nt, Human
uacaccuacaggcuggaguguaaaauggacac

SEQ ID NO: 485711 - RNA, 32 nt, Human
uacaccuaguuucuaauaagcauuuuauaauu

SEQ ID NO: 485712 - RNA, 32 nt, Human
uacaccucagcaggaacagccuugaguugcuu

SEQ ID NO: 485713 - RNA, 32 nt, Human
uacaccuccaucggauuuuaguuuacaugucu

SEQ ID NO: 485714 - RNA, 32 nt, Human
uacaccucccacccucuccaucaccugcucug

SEQ ID NO: 485715 - RNA, 32 nt, Human
uacaccucuggauucauugucucucacagaug

SEQ ID NO: 485716 - RNA, 32 nt, Human
uacaccugagccacuguggugggucacagugu

SEQ ID NO: 485717 - RNA, 32 nt, Human
uacaccugccaaggcugaaucccugggcccag

SEQ ID NO: 485718 - RNA, 32 nt, Human
uacaccugcccuucucacccauggcccaccca

SEQ ID NO: 485719 - RNA, 32 nt, Human
uacaccugcuccaggaccaaucagugaaaccu

SEQ ID NO: 485720 - RNA, 32 nt, Human
uacaccugcuucugguccuguccacauuuuga

SEQ ID NO: 485721 - RNA, 32 nt, Human
uacaccuguagucccagcuacucaggaggcug

SEQ ID NO: 485722 - RNA, 32 nt, Human
uacaccuguagucccagcuacucaggaggcuu

SEQ ID NO: 485723 - RNA, 32 nt, Human
uacaccuguagucccagcuacucgggaggcug

SEQ ID NO: 485724 - RNA, 32 nt, Human
uacaccuguagucccaggcacuuugggaggcc

SEQ ID NO: 485725 - RNA, 32 nt, Human
uacaccuguggucccagcuacucuggaggcua

SEQ ID NO: 485726 - RNA, 32 nt, Human
uacaccuguggucccagcuauuugggaggcug

SEQ ID NO: 485727 - RNA, 32 nt, Human
uacacgaggaagaagaugcggucagcagucuc

SEQ ID NO: 485728 - RNA, 31 nt, Human
uacacgauggcgcugcugauucaucaguggu

SEQ ID NO: 485729 - RNA, 32 nt, Human
uacacgauguccuggaccggagcugcucccgg

SEQ ID NO: 485730 - RNA, 32 nt, Human
uacacgcacaugcacacauacacaugcaugca

SEQ ID NO: 485731 - RNA, 32 nt, Human
uacacgcgugagccacugugcccagccgaucu

SEQ ID NO: 485732 - RNA, 31 nt, Human
uacacgcuauuuuucugauuguuaagacuuu

SEQ ID NO: 485733 - RNA, 32 nt, Human
uacacgcucauauugugcauauggcagacccu

SEQ ID NO: 485734 - RNA, 32 nt, Human
uacacggccacagcaggcacgcucagagacac

SEQ ID NO: 485735 - RNA, 32 nt, Human
uacacgggaggcagaggugggagaaucgcuug

SEQ ID NO: 485736 - RNA, 32 nt, Human
uacacgugcccaccaccaugcccagcuaauuu

SEQ ID NO: 485737 - RNA, 32 nt, Human
uacacgugccuguagucccagcuacucuauag

SEQ ID NO: 485738 - RNA, 32 nt, Human
uacacguuguaucacugcauugugguaauagc

SEQ ID NO: 485739 - RNA, 32 nt, Human
uacacuaaaacccaacagggcaacuggaaccc

SEQ ID NO: 485740 - RNA, 32 nt, Human
uacacuacacuacacuauacuacacuacagcc

SEQ ID NO: 485741 - RNA, 32 nt, Human
uacacuagagggcugcaggacucuauccaccg

SEQ ID NO: 485742 - RNA, 32 nt, Human
uacacuagcaaguucuacccuccuggucugac

SEQ ID NO: 485743 - RNA, 32 nt, Human
uacacucacaugcacacaugcaugcacacuca

SEQ ID NO: 485744 - RNA, 32 nt, Human
uacacucaggaguucaagaccagucugggcaa

SEQ ID NO: 485745 - RNA, 31 nt, Human
uacacuccaaugucucuuuugcaagaguuuu

SEQ ID NO: 485746 - RNA, 32 nt, Human
uacacuccagccaaagcaacaagagcaaaaac

SEQ ID NO: 485747 - RNA, 32 nt, Human
uacacuccagccugagcaacagagugagaccc

SEQ ID NO: 485748 - RNA, 32 nt, Human
uacacuccagccuggaugacagagugagacuu

SEQ ID NO: 485749 - RNA, 32 nt, Human
uacacuccagccuggccgacagagcaagauuc

SEQ ID NO: 485750 - RNA, 32 nt, Human
uacacuccagccugggcaaaagagugagacuc

SEQ ID NO: 485751 - RNA, 32 nt, Human
uacacuccagccugggcaacacagcaagacuc

SEQ ID NO: 485752 - RNA, 32 nt, Human
uacacuccagccugggcaacagagugagacuc

SEQ ID NO: 485753 - RNA, 32 nt, Human
uacacuccagccugggcaacagcguaagaccc

SEQ ID NO: 485754 - RNA, 32 nt, Human
uacacuccagccugggcaacagugacacucuu

SEQ ID NO: 485755 - RNA, 32 nt, Human
uacacuccagccugggcgaaagggugagacuc

SEQ ID NO: 485756 - RNA, 32 nt, Human
uacacuccagccugggcgacagagugacccug

SEQ ID NO: 485757 - RNA, 32 nt, Human
uacacuccagccugggcgagacggcaagacuc

SEQ ID NO: 485758 - RNA, 32 nt, Human
uacacuccagccugggugacagagugagacuc

SEQ ID NO: 485759 - RNA, 32 nt, Human
uacacuccagccugggugacagagugagaucc

SEQ ID NO: 485760 - RNA, 32 nt, Human
uacacuccagccugggugacagagugagaucu

SEQ ID NO: 485761 - RNA, 32 nt, Human
uacacuccagccuggucaacagagugagacuc

SEQ ID NO: 485762 - RNA, 32 nt, Human
uacacuccagccuggucgacagagugaacucu

SEQ ID NO: 485763 - RNA, 32 nt, Human
uacacuccagccuggugacagagugagacucc

SEQ ID NO: 485764 - RNA, 32 nt, Human
uacacuccuccagggaccccggagcuuccacc

SEQ ID NO: 485765 - RNA, 32 nt, Human
uacacuccuccccagaugaccccacacccuac

SEQ ID NO: 485766 - RNA, 32 nt, Human
uacacuccuuauccuccccaaauuuuaagcuc

SEQ ID NO: 485767 - RNA, 32 nt, Human
uacacucguggacaccuacacacuccauagga

SEQ ID NO: 485768 - RNA, 32 nt, Human
uacacucuagcugaaagagcaagaguacacau

SEQ ID NO: 485769 - RNA, 32 nt, Human
uacacucucuccugccuuuuccaaguuugaug

SEQ ID NO: 485770 - RNA, 32 nt, Human
uacacucugaagggauaucauccuuucaaacg

SEQ ID NO: 485771 - RNA, 32 nt, Human
uacacucuucuccauucccuccacccacuugc

SEQ ID NO: 485772 - RNA, 32 nt, Human
uacacucuugcugucugucuuucuugccuucu

SEQ ID NO: 485773 - RNA, 32 nt, Human
uacacucuuucaggccucuuucugccuuuugu

SEQ ID NO: 485774 - RNA, 32 nt, Human
uacacugagccagcagguucaccagaaagcua

SEQ ID NO: 485775 - RNA, 32 nt, Human
uacacugaggguuucaaaauucgacuagaagu

SEQ ID NO: 485776 - RNA, 32 nt, Human
uacacugagguucugcccacuccugggcagcu

SEQ ID NO: 485777 - RNA, 32 nt, Human
uacacugauuccuuuaugaugacugcuuaacu

SEQ ID NO: 485778 - RNA, 32 nt, Human
uacacugcaucuuuaacacagagucaccugug

SEQ ID NO: 485779 - RNA, 32 nt, Human
uacacugccugcagcagucucuggguguguug

SEQ ID NO: 485780 - RNA, 32 nt, Human
uacacugcuacaccauuacuuucuugagacau

SEQ ID NO: 485781 - RNA, 32 nt, Human
uacacuggaaggcagauauacugugauaugcu

SEQ ID NO: 485782 - RNA, 32 nt, Human
uacacuggagugagcagaacugggggauaggg

SEQ ID NO: 485783 - RNA, 32 nt, Human
uacacuggcuacaccuggccuuguggcugcau

SEQ ID NO: 485784 - RNA, 32 nt, Human
uacacuggcucacgaaaaucugcccugcuaga

SEQ ID NO: 485785 - RNA, 32 nt, Human
uacacugggacuguaacagcauuuuuacuuuc

SEQ ID NO: 485786 - RNA, 32 nt, Human
uacacuggggacccaagccugcucugaggagu

SEQ ID NO: 485787 - RNA, 32 nt, Human
uacacugguaccccagugugaaaaggauggaa

SEQ ID NO: 485788 - RNA, 32 nt, Human
uacacuggucucaaacucuuggccucaaggga

SEQ ID NO: 485789 - RNA, 32 nt, Human
uacacugguuuucaaacuuuuaaaguugagga

SEQ ID NO: 485790 - RNA, 32 nt, Human
uacacuucucccacugugugauggcgacaaga

SEQ ID NO: 485791 - RNA, 32 nt, Human
uacacuucucuagcucagccucacaggccaaa

SEQ ID NO: 485792 - RNA, 31 nt, Human
uacacuuggagcuaggaaaccaaagcaagcu

SEQ ID NO: 485793 - RNA, 32 nt, Human
uacacuuucaagacacuguaaccacaagaugu

SEQ ID NO: 485794 - RNA, 32 nt, Human
uacacuuucuuggaugagaggggagagugugg

SEQ ID NO: 485795 - RNA, 32 nt, Human
uacacuuugacuccccuucccuucccuauuuu

SEQ ID NO: 485796 - RNA, 32 nt, Human
uacagaaaagagacauuucagcugugauuaug

SEQ ID NO: 485797 - RNA, 32 nt, Human
uacagaaaaguggaagcagauuggcugggcuu

SEQ ID NO: 485798 - RNA, 32 nt, Human
uacagaaaaucagcuccugacccugccuaaaa

SEQ ID NO: 485799 - RNA, 32 nt, Human
uacagaaaaucuggagcuaauacugguuuagc

SEQ ID NO: 485800 - RNA, 32 nt, Human
uacagaaaauuagacagguaugguggcacgca

SEQ ID NO: 485801 - RNA, 32 nt, Human
uacagaaaauuagccaggcaugguggcgcaug

SEQ ID NO: 485802 - RNA, 32 nt, Human
uacagaaaauuagccuggcaugguggcaugca

SEQ ID NO: 485803 - RNA, 32 nt, Human
uacagaaaauuagcugggcgcaguggcgggcg

SEQ ID NO: 485804 - RNA, 32 nt, Human
uacagaaaauuagcugggcgugguggcgggcg

SEQ ID NO: 485805 - RNA, 32 nt, Human
uacagaaacugauuauucugaggaugauauau

SEQ ID NO: 485806 - RNA, 32 nt, Human
uacagaaacugucauuagaaaugaguaguguu

SEQ ID NO: 485807 - RNA, 32 nt, Human
uacagaaagcccuucagucaccagagauggcc

SEQ ID NO: 485808 - RNA, 32 nt, Human
uacagaaauagaagaaagcaagccagacuuaa

SEQ ID NO: 485809 - RNA, 32 nt, Human
uacagaaauagucaacagauguuuccaagaac

SEQ ID NO: 485810 - RNA, 27 nt, Human
uacagaaauuucuuggauucuguauca

SEQ ID NO: 485811 - RNA, 32 nt, Human
uacagaacaagaaaaauacuauuugccaugcu

SEQ ID NO: 485812 - RNA, 32 nt, Human
uacagaacaccuguccugccugugccagccug

SEQ ID NO: 485813 - RNA, 32 nt, Human
uacagaacagaaguuaaugaaaaaggcuauuu

SEQ ID NO: 485814 - RNA, 32 nt, Human
uacagaacagguguuaagccuuuuccaauauu

SEQ ID NO: 485815 - RNA, 32 nt, Human
uacagaaccucauaguuugagaacaaagcuga

SEQ ID NO: 485816 - RNA, 32 nt, Human
uacagaacuauucaaagaagcucacagauggu

SEQ ID NO: 485817 - RNA, 32 nt, Human
uacagaacugauuuccuuccuggcuguacaug

SEQ ID NO: 485818 - RNA, 32 nt, Human
uacagaagacacacacaucacauagacccuca

SEQ ID NO: 485819 - RNA, 32 nt, Human
uacagaagagccaccacugggauggggaauaa

SEQ ID NO: 485820 - RNA, 32 nt, Human
uacagaagcuugacaagcauguccucacccuc

SEQ ID NO: 485821 - RNA, 32 nt, Human
uacagaagguccugugugacccucucugcauc

SEQ ID NO: 485822 - RNA, 32 nt, Human
uacagaagugagccacuguaccuggccuuuug

SEQ ID NO: 485823 - RNA, 32 nt, Human
uacagaagugagccacuguguccugccuaaaa

SEQ ID NO: 485824 - RNA, 32 nt, Human
uacagaaguucuaccuuagggaaaagaaaggg

SEQ ID NO: 485825 - RNA, 26 nt, Human
uacagaauaagucagaggaaaagcaa

SEQ ID NO: 485826 - RNA, 32 nt, Human
uacagaauaauccaguauugcugauuuuaaag

SEQ ID NO: 485827 - RNA, 32 nt, Human
uacagaaucaacaacagauaucacaacaggga

SEQ ID NO: 485828 - RNA, 32 nt, Human
uacagaaucuggauggcuaugcucugauccug

SEQ ID NO: 485829 - RNA, 32 nt, Human
uacagaaugcagaauggcuacugugugucuug

SEQ ID NO: 485830 - RNA, 32 nt, Human
uacagaauguucuggaaagaaaaagaaccggc

SEQ ID NO: 485831 - RNA, 32 nt, Human
uacagaauuagcugagugugguggcgcaugcc

SEQ ID NO: 485832 - RNA, 32 nt, Human
uacagaauugaauaccuguuaaagaaaaauua

SEQ ID NO: 485833 - RNA, 32 nt, Human
uacagacaaggccaaggcaaucccagggcauu

SEQ ID NO: 485834 - RNA, 32 nt, Human
uacagacaaguauuuccaggagccuuucugua

SEQ ID NO: 485835 - RNA, 32 nt, Human
uacagacacaagaacaaucuuugcuauaauug

SEQ ID NO: 485836 - RNA, 32 nt, Human
uacagacaccauauuuguucugcauucccugc

SEQ ID NO: 485837 - RNA, 20 nt, Human
uacagacacccgccaccacg

SEQ ID NO: 485838 - RNA, 32 nt, Human
uacagacacuucacuuagccuagggggccuuc

SEQ ID NO: 485839 - RNA, 32 nt, Human
uacagacagcuuuccugaucauuugauuuauu

SEQ ID NO: 485840 - RNA, 32 nt, Human
uacagacaggacagaaugaaacuccugcggcu

SEQ ID NO: 485841 - RNA, 19 nt, Human
uacagacaggcaccaccac

SEQ ID NO: 485842 - RNA, 32 nt, Human
uacagacaucuuccuccucccucaucccuucc

SEQ ID NO: 485843 - RNA, 20 nt, Human
uacagacaugaaccaccacg

SEQ ID NO: 485844 - RNA, 32 nt, Human
uacagacaugagcagccaugcccagccuguuu

SEQ ID NO: 485845 - RNA, 20 nt, Human
uacagacaugagccaccacg

SEQ ID NO: 485846 - RNA, 32 nt, Human
uacagacaugagccaccaugcccggccaagaa

SEQ ID NO: 485847 - RNA, 32 nt, Human
uacagacaugagccaccucgcccagccuuuuc

SEQ ID NO: 485848 - RNA, 32 nt, Human
uacagacaugagccacugcaccugcccagcuc

SEQ ID NO: 485849 - RNA, 32 nt, Human
uacagacaugagccacugugcccggcccccau

SEQ ID NO: 485850 - RNA, 32 nt, Human
uacagacaugagccacugugccggccuguuuu

SEQ ID NO: 485851 - RNA, 32 nt, Human
uacagacaugagccacugugccugucuagacu

SEQ ID NO: 485852 - RNA, 20 nt, Human
uacagacaugcaccacaacg

SEQ ID NO: 485853 - RNA, 19 nt, Human
uacagacaugcaccaccac

SEQ ID NO: 485854 - RNA, 20 nt, Human
uacagacaugugccaccacg

SEQ ID NO: 485855 - RNA, 32 nt, Human
uacagaccaaguuugcucgccuccuggcugag

SEQ ID NO: 485856 - RNA, 32 nt, Human
uacagaccaggugagagcccuuuugccuuagu

SEQ ID NO: 485857 - RNA, 32 nt, Human
uacagaccguggccgcccugccugugugugug

SEQ ID NO: 485858 - RNA, 32 nt, Human
uacagaccugccagggcccaggagagcucgac

SEQ ID NO: 485859 - RNA, 32 nt, Human
uacagaccuguuuugucauccugcugccaaga

SEQ ID NO: 485860 - RNA, 32 nt, Human
uacagaccuuuguaacaaguguacagaaaacu

SEQ ID NO: 485861 - RNA, 32 nt, Human
uacagacgcacgccaccaugcccggcuaauuu

SEQ ID NO: 485862 - RNA, 21 nt, Human
uacagacgguguuucaccaug

SEQ ID NO: 485863 - RNA, 32 nt, Human
uacagacgugaaccacugggcccagcccaaac

SEQ ID NO: 485864 - RNA, 19 nt, Human
uacagacgugagccaccac

SEQ ID NO: 485865 - RNA, 32 nt, Human
uacagacgugagccaccacccccggccacuug

SEQ ID NO: 485866 - RNA, 32 nt, Human
uacagacgugagccaccacgcccugccaauaa

SEQ ID NO: 485867 - RNA, 32 nt, Human
uacagacgugagccaccacucccggcccauag

SEQ ID NO: 485868 - RNA, 32 nt, Human
uacagacgugagccaccgugcccggccaaucc

SEQ ID NO: 485869 - RNA, 32 nt, Human
uacagacgugagccaccgugcccggccaguuc

SEQ ID NO: 485870 - RNA, 32 nt, Human
uacagacgugagccaccgugccuggccuggaa

SEQ ID NO: 485871 - RNA, 32 nt, Human
uacagacgugagccacugcagccaccgugccu

SEQ ID NO: 485872 - RNA, 32 nt, Human
uacagacgugagccacugcguccugccuaaaa

SEQ ID NO: 485873 - RNA, 32 nt, Human
uacagacgugagccacugugccuggccaagau

SEQ ID NO: 485874 - RNA, 32 nt, Human
uacagacgugagccacuguguccugccuaaaa

SEQ ID NO: 485875 - RNA, 19 nt, Human
uacagacgugagcuaccac

SEQ ID NO: 485876 - RNA, 32 nt, Human
uacagacgugagcuaucaugcccagcaacaua

SEQ ID NO: 485877 - RNA, 20 nt, Human
uacagacgugugccaccaug

SEQ ID NO: 485878 - RNA, 32 nt, Human
uacagacgugugccaccaugcuuggcuaauuu

SEQ ID NO: 485879 - RNA, 32 nt, Human
uacagacucuacugcugccugggggcgagcag

SEQ ID NO: 485880 - RNA, 32 nt, Human
uacagacugcauuuuaaaauuguaauuaugaa

SEQ ID NO: 485881 - RNA, 32 nt, Human
uacagacuggggacccuggacaugcgggccuu

SEQ ID NO: 485882 - RNA, 32 nt, Human
uacagacuugcugugugaccucaggccagugu

SEQ ID NO: 485883 - RNA, 32 nt, Human
uacagagaaaucacagacuuuugcuacaaauc

SEQ ID NO: 485884 - RNA, 32 nt, Human
uacagagaaauuauaggccaagagaaaaugcu

SEQ ID NO: 485885 - RNA, 32 nt, Human
uacagagaacaagggaugcugaggcuucugau

SEQ ID NO: 485886 - RNA, 32 nt, Human
uacagagaagagaagagggagucagcccaucg

SEQ ID NO: 485887 - RNA, 32 nt, Human
uacagagaagcuggcugguaggacccgcaggg

SEQ ID NO: 485888 - RNA, 19 nt, Human
uacagagaccaccaccacg

SEQ ID NO: 485889 - RNA, 32 nt, Human
uacagagagacaacuugcuccuuuccaucagc

SEQ ID NO: 485890 - RNA, 32 nt, Human
uacagagagagaaacacuacagcaacccaggg

SEQ ID NO: 485891 - RNA, 27 nt, Human
uacagagagagccagguuuuggugcca

SEQ ID NO: 485892 - RNA, 32 nt, Human
uacagagaggucaaguaacuugcccaaaguca

SEQ ID NO: 485893 - RNA, 19 nt, Human
uacagagauacccucucca

SEQ ID NO: 485894 - RNA, 32 nt, Human
uacagagaugugaugcaggaaaccuucacgaa

SEQ ID NO: 485895 - RNA, 32 nt, Human
uacagagaugugaugcaggaaaccuucaggaa

SEQ ID NO: 485896 - RNA, 32 nt, Human
uacagagauucuaugaagcccacccagaaaaa

SEQ ID NO: 485897 - RNA, 32 nt, Human
uacagagauucuuucugcugucacucaauuuc

SEQ ID NO: 485898 - RNA, 24 nt, Human
uacagagcaagaaauuucaggaaa

SEQ ID NO: 485899 - RNA, 32 nt, Human
uacagagcacagaacagaacuucuuacagaag

SEQ ID NO: 485900 - RNA, 32 nt, Human
uacagagcacuaguugucacugccuggcuuua

SEQ ID NO: 485901 - RNA, 32 nt, Human
uacagagcgagauggacuagccccagaaaaga

SEQ ID NO: 485902 - RNA, 32 nt, Human
uacagaggacauguaaauacacagcgguggug

SEQ ID NO: 485903 - RNA, 32 nt, Human
uacagaggagaaagcaccaggaggguguagca

SEQ ID NO: 485904 - RNA, 32 nt, Human
uacagaggcccuucaggagggccuccugugcc

SEQ ID NO: 485905 - RNA, 32 nt, Human
uacagagggaaagaccuacagagggaaagacc

SEQ ID NO: 485906 - RNA, 32 nt, Human
uacagagguucugcagaacuguggccaucugc

SEQ ID NO: 485907 - RNA, 32 nt, Human
uacagagugugagccaccacacccagccagca

SEQ ID NO: 485908 - RNA, 32 nt, Human
uacagaguguuauaacaccaucuggagucuuc

SEQ ID NO: 485909 - RNA, 32 nt, Human
uacagaguuccuuuugcuauguuugguaacau

SEQ ID NO: 485910 - RNA, 32 nt, Human
uacagaguugcuuggaauaaauccuaauagau

SEQ ID NO: 485911 - RNA, 32 nt, Human
uacagauaaagugucugaaauaacgcaugaug

SEQ ID NO: 485912 - RNA, 23 nt, Human
uacagauaacgucaggaagaguc

SEQ ID NO: 485913 - RNA, 32 nt, Human
uacagauacgugccaccauacccggcuaauuu

SEQ ID NO: 485914 - RNA, 32 nt, Human
uacagauacugauucagugggucuguguagag

SEQ ID NO: 485915 - RNA, 32 nt, Human
uacagauagaauauuugauauuucuugggauu

SEQ ID NO: 485916 - RNA, 32 nt, Human
uacagauauaagaaauacaaaaguuuaaaaag

SEQ ID NO: 485917 - RNA, 32 nt, Human
uacagaucaauaaaagcaccuguucuccaucu

SEQ ID NO: 485918 - RNA, 32 nt, Human
uacagaucagcaccuucucuguaccugcugga

SEQ ID NO: 485919 - RNA, 32 nt, Human
uacagaucucuguagagcuccuguguguaaua

SEQ ID NO: 485920 - RNA, 32 nt, Human
uacagaugacuugccauuucauuuacaaagau

SEQ ID NO: 485921 - RNA, 32 nt, Human
uacagaugaggugaggggaugguuagcagcga

SEQ ID NO: 485922 - RNA, 21 nt, Human
uacagaugcaaucaccaccac

SEQ ID NO: 485923 - RNA, 19 nt, Human
uacagaugcacaccaccac

SEQ ID NO: 485924 - RNA, 20 nt, Human
uacagaugcccaccaccaug

SEQ ID NO: 485925 - RNA, 23 nt, Human
uacagaugcccaccaccaugccc

SEQ ID NO: 485926 - RNA, 32 nt, Human
uacagaugcucuccaaccuauuuucuauaaga

SEQ ID NO: 485927 - RNA, 32 nt, Human
uacagauggaccucuugagaagaauuaucgua

SEQ ID NO: 485928 - RNA, 20 nt, Human
uacagaugggagccaccacg

SEQ ID NO: 485929 - RNA, 32 nt, Human
uacagaugggagccaccacgcccagcccaguc

SEQ ID NO: 485930 - RNA, 30 nt, Human
uacagaugggcauaggugcagugagugcag

SEQ ID NO: 485931 - RNA, 32 nt, Human
uacagaugggguccucuagggauggcagauug

SEQ ID NO: 485932 - RNA, 32 nt, Human
uacagauguagcccugggaauggcacagugga

SEQ ID NO: 485933 - RNA, 32 nt, Human
uacagaugugagccaacgcacccggcuacacc

SEQ ID NO: 485934 - RNA, 19 nt, Human
uacagaugugagccaccac

SEQ ID NO: 485935 - RNA, 32 nt, Human
uacagaugugagccaccacacacaccaucuga

SEQ ID NO: 485936 - RNA, 32 nt, Human
uacagaugugagccaccacaccaggccgguga

SEQ ID NO: 485937 - RNA, 32 nt, Human
uacagaugugagccaccacaccuggccccaag

SEQ ID NO: 485938 - RNA, 20 nt, Human
uacagaugugagccaccacg

SEQ ID NO: 485939 - RNA, 32 nt, Human
uacagaugugagccaccacgcccagccagaaa

SEQ ID NO: 485940 - RNA, 32 nt, Human
uacagaugugagccaccacgcccggccuuuuu

SEQ ID NO: 485941 - RNA, 32 nt, Human
uacagaugugagccaccaugcccagcuuucuu

SEQ ID NO: 485942 - RNA, 32 nt, Human
uacagaugugagccaccgcacccagccugagu

SEQ ID NO: 485943 - RNA, 32 nt, Human
uacagaugugagccaccgcauccagccccaca

SEQ ID NO: 485944 - RNA, 32 nt, Human
uacagaugugagccaccgcgcccacccugaac

SEQ ID NO: 485945 - RNA, 32 nt, Human
uacagaugugagccaccguacccagcuaauuu

SEQ ID NO: 485946 - RNA, 32 nt, Human
uacagaugugagccaccgugccuagccaagga

SEQ ID NO: 485947 - RNA, 32 nt, Human
uacagaugugagccacugcaccuggccccaga

SEQ ID NO: 485948 - RNA, 32 nt, Human
uacagaugugagccacugcguccugccuaaaa

SEQ ID NO: 485949 - RNA, 32 nt, Human
uacagaugugagccacugcguccuuccuaaaa

SEQ ID NO: 485950 - RNA, 32 nt, Human
uacagaugugagccacuucgcccagcugaggc

SEQ ID NO: 485951 - RNA, 32 nt, Human
uacagaugugagccauggugcccggcuacucu

SEQ ID NO: 485952 - RNA, 32 nt, Human
uacagaugugagccauuguggccuaagaugcu

SEQ ID NO: 485953 - RNA, 19 nt, Human
uacagaugugcaccaccac

SEQ ID NO: 485954 - RNA, 20 nt, Human
uacagaugugcaccaccacg

SEQ ID NO: 485955 - RNA, 19 nt, Human
uacagaugugcaccagcac

SEQ ID NO: 485956 - RNA, 32 nt, Human
uacagaugugcaucaccaugccuggcuaauuu

SEQ ID NO: 485957 - RNA, 32 nt, Human
uacagaugugggccaccaugucuggcuaauuu

SEQ ID NO: 485958 - RNA, 32 nt, Human
uacagaugugugcuaccaugcccagcuaauuu

SEQ ID NO: 485959 - RNA, 32 nt, Human
uacagauguguuguuugucacacugagauugc

SEQ ID NO: 485960 - RNA, 32 nt, Human
uacagauguuugccaccaugcccgccucauuu

SEQ ID NO: 485961 - RNA, 32 nt, Human
uacagauucaaugcuauucccauuaacugccg

SEQ ID NO: 485962 - RNA, 32 nt, Human
uacagauucagguacuucugggugacaggugu

SEQ ID NO: 485963 - RNA, 21 nt, Human
uacagauucucacuucugcua

SEQ ID NO: 485964 - RNA, 22 nt, Human
uacagauucuuuguuuuggcca

SEQ ID NO: 485965 - RNA, 32 nt, Human
uacagauuguagggcaucacuucaauucacca

SEQ ID NO: 485966 - RNA, 32 nt, Human
uacagauuuagagaaggaaccaguaaguagga

SEQ ID NO: 485967 - RNA, 32 nt, Human
uacagauuuuugaauaguuguuugcuugccag

SEQ ID NO: 485968 - RNA, 32 nt, Human
uacagcaaaccaacauggcacauguauaccua

SEQ ID NO: 485969 - RNA, 32 nt, Human
uacagcaaauaagaugugucccaggugacaag

SEQ ID NO: 485970 - RNA, 32 nt, Human
uacagcaaauuagcugggcgugguggcgcaug

SEQ ID NO: 485971 - RNA, 32 nt, Human
uacagcaacagaaaacuaaacacacacauaaa

SEQ ID NO: 485972 - RNA, 32 nt, Human
uacagcaacagacccagaaacuaaaguagaaa

SEQ ID NO: 485973 - RNA, 32 nt, Human
uacagcaacaggaaucucagagacagguggcc

SEQ ID NO: 485974 - RNA, 32 nt, Human
uacagcaagggagccauguuauauucaaguua

SEQ ID NO: 485975 - RNA, 32 nt, Human
uacagcaaguuugcacaaaaucgcacaacgau

SEQ ID NO: 485976 - RNA, 32 nt, Human
uacagcacaagcacguguucucaccuuuuucc

SEQ ID NO: 485977 - RNA, 32 nt, Human
uacagcacauuuuuccucaaagaaccaaacau

SEQ ID NO: 485978 - RNA, 18 nt, Human
uacagcacccaccaccac

SEQ ID NO: 485979 - RNA, 32 nt, Human
uacagcagaaaugcuauuuuguaugcuguuaa

SEQ ID NO: 485980 - RNA, 32 nt, Human
uacagcagagaagccucccugccuuggacccc

SEQ ID NO: 485981 - RNA, 32 nt, Human
uacagcagagacacucaguuguguggggugcu

SEQ ID NO: 485982 - RNA, 21 nt, Human
uacagcagagcuagguggaaa

SEQ ID NO: 485983 - RNA, 32 nt, Human
uacagcagaggcauugaacacacaccaccagg

SEQ ID NO: 485984 - RNA, 32 nt, Human
uacagcagccucggcggugccacccacugcac

SEQ ID NO: 485985 - RNA, 21 nt, Human
uacagcagcuggugcuaguca

SEQ ID NO: 485986 - RNA, 24 nt, Human
uacagcagcuucaguuuugugcca

SEQ ID NO: 485987 - RNA, 32 nt, Human
uacagcaggaagagacagcuuuuagaggggca

SEQ ID NO: 485988 - RNA, 32 nt, Human
uacagcaggacacucuggacaguagauugcag

SEQ ID NO: 485989 - RNA, 32 nt, Human
uacagcaggacagaauaugaccaccuucguuu

SEQ ID NO: 485990 - RNA, 32 nt, Human
uacagcaggacuccugaacauucuuccuuaaa

SEQ ID NO: 485991 - RNA, 32 nt, Human
uacagcaggagaaaguugagguucuucaccua

SEQ ID NO: 485992 - RNA, 32 nt, Human
uacagcaggagagcuuagggaggcugagagcu

SEQ ID NO: 485993 - RNA, 32 nt, Human
uacagcaggccucugggguccagccugggagc

SEQ ID NO: 485994 - RNA, 32 nt, Human
uacagcaggcugggcccaggaggucagguuca

SEQ ID NO: 485995 - RNA, 32 nt, Human
uacagcagggucuugcuguaacucagacauuc

SEQ ID NO: 485996 - RNA, 32 nt, Human
uacagcaguaccgaagauguuaguuaauagau

SEQ ID NO: 485997 - RNA, 32 nt, Human
uacagcaguauuuuuaauaaagaauuacagag

SEQ ID NO: 485998 - RNA, 32 nt, Human
uacagcaguggaaugaguggucccggagaugu

SEQ ID NO: 485999 - RNA, 32 nt, Human
uacagcaguguguggaggugauggccaguuaa

SEQ ID NO: 486000 - RNA, 16 nt, Human
uacagcaguuauucua

SEQ ID NO: 486001 - RNA, 32 nt, Human
uacagcauaugguaaccaagguuagaugccag

SEQ ID NO: 486002 - RNA, 32 nt, Human
uacagcauccaccucucuuggcucuuguaagg

SEQ ID NO: 486003 - RNA, 32 nt, Human
uacagcauccacugcagcucugggcuccauuu

SEQ ID NO: 486004 - RNA, 32 nt, Human
uacagcauccagggaagugcccagggaccagg

SEQ ID NO: 486005 - RNA, 32 nt, Human
uacagcaugacaauagagacuguggaugucgg

SEQ ID NO: 486006 - RNA, 15 nt, Human
uacagcauuauucua

SEQ ID NO: 486007 - RNA, 32 nt, Human
uacagcauuggagacagcuggggaagagguga

SEQ ID NO: 486008 - RNA, 32 nt, Human
uacagccaagggcacugcucacuguggcccgu

SEQ ID NO: 486009 - RNA, 32 nt, Human
uacagccaaugccuccauaggccacuuuuuaa

SEQ ID NO: 486010 - RNA, 32 nt, Human
uacagccagaagcccauggagcagggauguca

SEQ ID NO: 486011 - RNA, 32 nt, Human
uacagccaggaaccacaccugagccauuucca

SEQ ID NO: 486012 - RNA, 32 nt, Human
uacagccaugagccaccaugcccggccaaacu

SEQ ID NO: 486013 - RNA, 32 nt, Human
uacagcccacccuaccccuccuccaugggccc

SEQ ID NO: 486014 - RNA, 32 nt, Human
uacagccccuccaccgcccccugcugccccuc

SEQ ID NO: 486015 - RNA, 32 nt, Human
uacagcccgaggaguagaggcagcagcagcug

SEQ ID NO: 486016 - RNA, 32 nt, Human
uacagcccuagggugagaagaggcugagagag

SEQ ID NO: 486017 - RNA, 32 nt, Human
uacagcccugagcgaccgcgcccagccgucac

SEQ ID NO: 486018 - RNA, 32 nt, Human
uacagcccugcaggucuucaagucugugguug

SEQ ID NO: 486019 - RNA, 32 nt, Human
uacagcccugcucccaggugugcaucuuacug

SEQ ID NO: 486020 - RNA, 32 nt, Human
uacagccgcaccgccuauuccagccuuuggag

SEQ ID NO: 486021 - RNA, 32 nt, Human
uacagccgugagccaccacgcccagccugcuu

SEQ ID NO: 486022 - RNA, 32 nt, Human
uacagccgugagccacugcacccagccccaau

SEQ ID NO: 486023 - RNA, 19 nt, Human
uacagccgugcaccacuac

SEQ ID NO: 486024 - RNA, 32 nt, Human
uacagccucauagccccugugcagccuucguc

SEQ ID NO: 486025 - RNA, 32 nt, Human
uacagccugauggggaauucccagggaggccc

SEQ ID NO: 486026 - RNA, 32 nt, Human
uacagccugcacacaccugccugcagagcagg

SEQ ID NO: 486027 - RNA, 32 nt, Human
uacagccugcagaaccgugagccagcuaaacc

SEQ ID NO: 486028 - RNA, 32 nt, Human
uacagccugcagcugugagcugagccagugac

SEQ ID NO: 486029 - RNA, 32 nt, Human
uacagccugccuggauauggaugaugccaaua

SEQ ID NO: 486030 - RNA, 32 nt, Human
uacagccuggacgacagagcaagacucugucu

SEQ ID NO: 486031 - RNA, 32 nt, Human
uacagccugggcaauaaagugagacccuguca

SEQ ID NO: 486032 - RNA, 32 nt, Human
uacagccuggggaccaugggguggcagggaag

SEQ ID NO: 486033 - RNA, 32 nt, Human
uacagccugggugacagagcaagacuccgucu

SEQ ID NO: 486034 - RNA, 32 nt, Human
uacagccugggugacagagugagaucuugucu

SEQ ID NO: 486035 - RNA, 32 nt, Human
uacagccuggucaacagagcaagacucugucu

SEQ ID NO: 486036 - RNA, 32 nt, Human
uacagcgcggaggaggagggaggccaggcggg

SEQ ID NO: 486037 - RNA, 32 nt, Human
uacagcggcuguucccgccaguuccacagauc

SEQ ID NO: 486038 - RNA, 32 nt, Human
uacagcguaacagugcuuuaaaauguaugucc

SEQ ID NO: 486039 - RNA, 32 nt, Human
uacagcguccuguccaccaugcccucagacuc

SEQ ID NO: 486040 - RNA, 32 nt, Human
uacagcgucugucaggucgaugucucagaaca

SEQ ID NO: 486041 - RNA, 32 nt, Human
uacagcgugaucuaccacaccuggccaauccc

SEQ ID NO: 486042 - RNA, 32 nt, Human
uacagcguuuacaaaccagugccacaaggagc

SEQ ID NO: 486043 - RNA, 32 nt, Human
uacagcuaugcacuguaaaugcagccuucuuu

SEQ ID NO: 486044 - RNA, 32 nt, Human
uacagcuaugcgccaccaugcccagcuaauuu

SEQ ID NO: 486045 - RNA, 16 nt, Human
uacagcucacuaccac

SEQ ID NO: 486046 - RNA, 32 nt, Human
uacagcucacuaccacacaggcccugcagucc

SEQ ID NO: 486047 - RNA, 32 nt, Human
uacagcucagcccugauggacguguuugagcu

SEQ ID NO: 486048 - RNA, 32 nt, Human
uacagcucauguuccuuagaccugauuuguuu

SEQ ID NO: 486049 - RNA, 32 nt, Human
uacagcucauuuccccguccuccaaccaaugg

SEQ ID NO: 486050 - RNA, 32 nt, Human
uacagcuccagccccuccugggccucccagcg

SEQ ID NO: 486051 - RNA, 32 nt, Human
uacagcugagcuuuuuguuuucuucucuuuuu

SEQ ID NO: 486052 - RNA, 32 nt, Human
uacagcugccugccaaauuuuuguauuuuuag

SEQ ID NO: 486053 - RNA, 32 nt, Human
uacagcugccugccaccgugcccagcuaauuu

SEQ ID NO: 486054 - RNA, 32 nt, Human
uacagcugcggaggauggcagguggcaucucg

SEQ ID NO: 486055 - RNA, 32 nt, Human
uacagcuguaaaccaaaguggagcuggugcuu

SEQ ID NO: 486056 - RNA, 32 nt, Human
uacagcugugagccaccgugccuggccuuuua

SEQ ID NO: 486057 - RNA, 32 nt, Human
uacagcugugagccacugcacccggccgggaa

SEQ ID NO: 486058 - RNA, 32 nt, Human
uacagcugugagccauggcaccuggccacaca

SEQ ID NO: 486059 - RNA, 32 nt, Human
uacagcugugugaucuugggcaagucacuuaa

SEQ ID NO: 486060 - RNA, 32 nt, Human
uacagcuguuuccucagagggaaaaaucuuga

SEQ ID NO: 486061 - RNA, 32 nt, Human
uacagcuucccaagccccaucaauaaagcccc

SEQ ID NO: 486062 - RNA, 32 nt, Human
uacagcuucugccuccucaccuggccgucggu

SEQ ID NO: 486063 - RNA, 32 nt, Human
uacagcuugggugacagcgcgagacaccgucu

SEQ ID NO: 486064 - RNA, 32 nt, Human
uacagcuugugugguuugucuuuggaaauaaa

SEQ ID NO: 486065 - RNA, 32 nt, Human
uacagcuuugccuuguguccucuuguuccgug

SEQ ID NO: 486066 - RNA, 32 nt, Human
uacagcuuuucaggaagcuuagaucugaauuu

SEQ ID NO: 486067 - RNA, 18 nt, Human
uacaggaaaacuguccaa

SEQ ID NO: 486068 - RNA, 32 nt, Human
uacaggaaaagccauaucuugcaccagcagca

SEQ ID NO: 486069 - RNA, 32 nt, Human
uacaggaaaccaccccucacccuguccacuug

SEQ ID NO: 486070 - RNA, 27 nt, Human
uacaggaaaggagggaggaugcugugu

SEQ ID NO: 486071 - RNA, 32 nt, Human
uacaggaaauuaucugggcaugguggugugug

SEQ ID NO: 486072 - RNA, 32 nt, Human
uacaggaacacaagcagcagcacuccuuugag

SEQ ID NO: 486073 - RNA, 20 nt, Human
uacaggaacgcgccaccacg

SEQ ID NO: 486074 - RNA, 32 nt, Human
uacaggaagaaagagcuugaggugggagcggg

SEQ ID NO: 486075 - RNA, 32 nt, Human
uacaggaagccuccuaggguucugagcagaag

SEQ ID NO: 486076 - RNA, 19 nt, Human
uacaggaaggagucccuuu

SEQ ID NO: 486077 - RNA, 32 nt, Human
uacaggaaggcaggaggggugaguccccuacu

SEQ ID NO: 486078 - RNA, 32 nt, Human
uacaggaaugagccacugugccagcugacacg

SEQ ID NO: 486079 - RNA, 20 nt, Human
uacaggaaugcaccaccacg

SEQ ID NO: 486080 - RNA, 20 nt, Human
uacaggaaugcaccaccaug

SEQ ID NO: 486081 - RNA, 23 nt, Human
uacaggaaugcaccaccaugccc

SEQ ID NO: 486082 - RNA, 32 nt, Human
uacaggaauuaaauaguuuggaagaggguugg

SEQ ID NO: 486083 - RNA, 32 nt, Human
uacaggaauucauauauccaggcaacacaaaa

SEQ ID NO: 486084 - RNA, 32 nt, Human
uacaggacacuggccccucucaggucagaaga

SEQ ID NO: 486085 - RNA, 32 nt, Human
uacaggacaggcugcacaucucaguauaugua

SEQ ID NO: 486086 - RNA, 32 nt, Human
uacaggacauguacugagacaaaaaggaaaca

SEQ ID NO: 486087 - RNA, 32 nt, Human
uacaggacuacaaucccaacaugugccagucu

SEQ ID NO: 486088 - RNA, 32 nt, Human
uacaggacucagcuacagagcucugcuauaca

SEQ ID NO: 486089 - RNA, 32 nt, Human
uacaggagacgggguuucaccauguuggucag

SEQ ID NO: 486090 - RNA, 32 nt, Human
uacaggagagcaaaauugcaccagagauucuu

SEQ ID NO: 486091 - RNA, 32 nt, Human
uacaggagauacguaaaguaggccccacaaau

SEQ ID NO: 486092 - RNA, 20 nt, Human
uacaggagcauaccaccaug

SEQ ID NO: 486093 - RNA, 32 nt, Human
uacaggagcugaaggauaaaguagcugguaua

SEQ ID NO: 486094 - RNA, 32 nt, Human
uacaggaggauucuggagccgagaaggagaac

SEQ ID NO: 486095 - RNA, 32 nt, Human
uacaggaguaugccaccaugcccagcuaauuu

SEQ ID NO: 486096 - RNA, 29 nt, Human
uacaggaguauuuucgaagacauugggga

SEQ ID NO: 486097 - RNA, 32 nt, Human
uacaggagugaaccaccaugcccagccuaaag

SEQ ID NO: 486098 - RNA, 32 nt, Human
uacaggagugagccaccaugcccggcuggcag

SEQ ID NO: 486099 - RNA, 32 nt, Human
uacaggagugagccaccaugucugguccucug

SEQ ID NO: 486100 - RNA, 32 nt, Human
uacaggagugagccaccgcgccugguccccgc

SEQ ID NO: 486101 - RNA, 32 nt, Human
uacaggagugagccaccgugcccggccuaagu

SEQ ID NO: 486102 - RNA, 32 nt, Human
uacaggagugagccacugcgcccugccuggaa

SEQ ID NO: 486103 - RNA, 32 nt, Human
uacaggagugagccacugcgccuggcccacuu

SEQ ID NO: 486104 - RNA, 32 nt, Human
uacaggagugcaccaucaugcccagcuaauuu

SEQ ID NO: 486105 - RNA, 32 nt, Human
uacaggauaagauagauacaggguaaaauguu

SEQ ID NO: 486106 - RNA, 31 nt, Human
uacaggauguauaccauugacaugcacagcc

SEQ ID NO: 486107 - RNA, 32 nt, Human
uacaggauucuaaggaaccauggagauuugag

SEQ ID NO: 486108 - RNA, 32 nt, Human
uacaggauuucaugggcuggcucugcucgccu

SEQ ID NO: 486109 - RNA, 32 nt, Human
uacaggcaaaacaccaggcugcagagcuauga

SEQ ID NO: 486110 - RNA, 19 nt, Human
uacaggcaaacgccaccac

SEQ ID NO: 486111 - RNA, 19 nt, Human
uacaggcaaccaccaccac

SEQ ID NO: 486112 - RNA, 20 nt, Human
uacaggcaacugccaccaug

SEQ ID NO: 486113 - RNA, 32 nt, Human
uacaggcaagagccaccauaccaguuccuguc

SEQ ID NO: 486114 - RNA, 32 nt, Human
uacaggcaagcaagaugcccacacaacaggcu

SEQ ID NO: 486115 - RNA, 20 nt, Human
uacaggcaagcaccaccaug

SEQ ID NO: 486116 - RNA, 20 nt, Human
uacaggcacaaaccaccaug

SEQ ID NO: 486117 - RNA, 32 nt, Human
uacaggcacaagccaccgugcccagccaagaa

SEQ ID NO: 486118 - RNA, 20 nt, Human
uacaggcacaagucaccaug

SEQ ID NO: 486119 - RNA, 23 nt, Human
uacaggcacaagucaccaugccu

SEQ ID NO: 486120 - RNA, 18 nt, Human
uacaggcacacaccacca

SEQ ID NO: 486121 - RNA, 19 nt, Human
uacaggcacacaccaccac

SEQ ID NO: 486122 - RNA, 20 nt, Human
uacaggcacacaccaccacg

SEQ ID NO: 486123 - RNA, 23 nt, Human
uacaggcacacaccaccacgccc

SEQ ID NO: 486124 - RNA, 19 nt, Human
uacaggcacacaccaccau

SEQ ID NO: 486125 - RNA, 20 nt, Human
uacaggcacacaccaccaug

SEQ ID NO: 486126 - RNA, 19 nt, Human
uacaggcacacaccaucac

SEQ ID NO: 486127 - RNA, 21 nt, Human
uacaggcacacaccaucaccc

SEQ ID NO: 486128 - RNA, 20 nt, Human
uacaggcacacacuaccacg

SEQ ID NO: 486129 - RNA, 20 nt, Human
uacaggcacacccacgccac

SEQ ID NO: 486130 - RNA, 19 nt, Human
uacaggcacacgccaccac

SEQ ID NO: 486131 - RNA, 20 nt, Human
uacaggcacacgccaccaug

SEQ ID NO: 486132 - RNA, 20 nt, Human
uacaggcacacgcuaucaug

SEQ ID NO: 486133 - RNA, 20 nt, Human
uacaggcacacgcugccacg

SEQ ID NO: 486134 - RNA, 19 nt, Human
uacaggcacaggccaccac

SEQ ID NO: 486135 - RNA, 20 nt, Human
uacaggcacaggccgccacg

SEQ ID NO: 486136 - RNA, 19 nt, Human
uacaggcacaugccaccac

SEQ ID NO: 486137 - RNA, 21 nt, Human
uacaggcacaugccaccacca

SEQ ID NO: 486138 - RNA, 20 nt, Human
uacaggcacaugccaccacg

SEQ ID NO: 486139 - RNA, 23 nt, Human
uacaggcacaugccaccacgccc

SEQ ID NO: 486140 - RNA, 19 nt, Human
uacaggcacaugccaccau

SEQ ID NO: 486141 - RNA, 20 nt, Human
uacaggcacaugccaccaug

SEQ ID NO: 486142 - RNA, 23 nt, Human
uacaggcacaugccaccaugccc

SEQ ID NO: 486143 - RNA, 32 nt, Human
uacaggcacaugccaccaugcccagcuaaauu

SEQ ID NO: 486144 - RNA, 32 nt, Human
uacaggcacaugccaccaugcccagcugauuu

SEQ ID NO: 486145 - RNA, 32 nt, Human
uacaggcacaugccaccaugcccggcuaauuu

SEQ ID NO: 486146 - RNA, 32 nt, Human
uacaggcacaugccaccaugccuggcuaauuu

SEQ ID NO: 486147 - RNA, 32 nt, Human
uacaggcacaugccaccaugcucagcuaauuu

SEQ ID NO: 486148 - RNA, 19 nt, Human
uacaggcacaugccacuac

SEQ ID NO: 486149 - RNA, 23 nt, Human
uacaggcacauguuaccaugccc

SEQ ID NO: 486150 - RNA, 32 nt, Human
uacaggcacauguuaccaugcccagcuaauuu

SEQ ID NO: 486151 - RNA, 20 nt, Human
uacaggcaccagccaccaug

SEQ ID NO: 486152 - RNA, 32 nt, Human
uacaggcaccagccaccaugccuggcuaauuu

SEQ ID NO: 486153 - RNA, 19 nt, Human
uacaggcacccaccaccac

SEQ ID NO: 486154 - RNA, 20 nt, Human
uacaggcacccaccaccacg

SEQ ID NO: 486155 - RNA, 23 nt, Human
uacaggcacccaccaccacgccc

SEQ ID NO: 486156 - RNA, 19 nt, Human
uacaggcacccaccaccau

SEQ ID NO: 486157 - RNA, 20 nt, Human
uacaggcacccaccaccaug

SEQ ID NO: 486158 - RNA, 18 nt, Human
uacaggcacccaccauca

SEQ ID NO: 486159 - RNA, 19 nt, Human
uacaggcacccaccauccc

SEQ ID NO: 486160 - RNA, 20 nt, Human
uacaggcacccacuaccacg

SEQ ID NO: 486161 - RNA, 19 nt, Human
uacaggcacccaucaccac

SEQ ID NO: 486162 - RNA, 20 nt, Human
uacaggcaccccccaccaug

SEQ ID NO: 486163 - RNA, 19 nt, Human
uacaggcacccgccaccac

SEQ ID NO: 486164 - RNA, 20 nt, Human
uacaggcacccgccaccacg

SEQ ID NO: 486165 - RNA, 23 nt, Human
uacaggcacccgccaccacgccc

SEQ ID NO: 486166 - RNA, 20 nt, Human
uacaggcacccgccaccaug

SEQ ID NO: 486167 - RNA, 23 nt, Human
uacaggcacccgccaccaugccc

SEQ ID NO: 486168 - RNA, 20 nt, Human
uacaggcaccuaccaccagg

SEQ ID NO: 486169 - RNA, 19 nt, Human
uacaggcaccugccaccac

SEQ ID NO: 486170 - RNA, 22 nt, Human
uacaggcaccugccaccaccac

SEQ ID NO: 486171 - RNA, 20 nt, Human
uacaggcaccugccaccacg

SEQ ID NO: 486172 - RNA, 23 nt, Human
uacaggcaccugccaccacgccc

SEQ ID NO: 486173 - RNA, 19 nt, Human
uacaggcaccugccaccau

SEQ ID NO: 486174 - RNA, 23 nt, Human
uacaggcaccugccaccauaccc

SEQ ID NO: 486175 - RNA, 32 nt, Human
uacaggcaccugccaccauacccagcuaaguu

SEQ ID NO: 486176 - RNA, 20 nt, Human
uacaggcaccugccaccaug

SEQ ID NO: 486177 - RNA, 23 nt, Human
uacaggcaccugccaccaugccc

SEQ ID NO: 486178 - RNA, 32 nt, Human
uacaggcaccugccaccaugcccagcuaauuu

SEQ ID NO: 486179 - RNA, 32 nt, Human
uacaggcaccugccaccaugcccggcuaauuu

SEQ ID NO: 486180 - RNA, 32 nt, Human
uacaggcaccugccaccaugccuggcuaauuu

SEQ ID NO: 486181 - RNA, 32 nt, Human
uacaggcaccugccaccaugcgcagcuaauuu

SEQ ID NO: 486182 - RNA, 20 nt, Human
uacaggcacgagccaccaug

SEQ ID NO: 486183 - RNA, 23 nt, Human
uacaggcacgagccaccaugccc

SEQ ID NO: 486184 - RNA, 32 nt, Human
uacaggcacgagccaccaugcccagcuaauuu

SEQ ID NO: 486185 - RNA, 19 nt, Human
uacaggcacgagccaccgc

SEQ ID NO: 486186 - RNA, 19 nt, Human
uacaggcacgcaccaccac

SEQ ID NO: 486187 - RNA, 20 nt, Human
uacaggcacgcaccaccaug

SEQ ID NO: 486188 - RNA, 22 nt, Human
uacaggcacgcaccaccaugcc

SEQ ID NO: 486189 - RNA, 23 nt, Human
uacaggcacgcaccaccaugccu

SEQ ID NO: 486190 - RNA, 19 nt, Human
uacaggcacgcaccaccgc

SEQ ID NO: 486191 - RNA, 20 nt, Human
uacaggcacgcaucaccaug

SEQ ID NO: 486192 - RNA, 23 nt, Human
uacaggcacgcaucaccaugccu

SEQ ID NO: 486193 - RNA, 18 nt, Human
uacaggcacgccaccaug

SEQ ID NO: 486194 - RNA, 19 nt, Human
uacaggcacgcgccaccac

SEQ ID NO: 486195 - RNA, 20 nt, Human
uacaggcacgcgccaccaug

SEQ ID NO: 486196 - RNA, 23 nt, Human
uacaggcacgcgccaccaugccc

SEQ ID NO: 486197 - RNA, 19 nt, Human
uacaggcacgcgccacuac

SEQ ID NO: 486198 - RNA, 19 nt, Human
uacaggcacgcgcugccac

SEQ ID NO: 486199 - RNA, 20 nt, Human
uacaggcacgcgcugccacg

SEQ ID NO: 486200 - RNA, 32 nt, Human
uacaggcacgcuccaccacacccggcuaauuu

SEQ ID NO: 486201 - RNA, 20 nt, Human
uacaggcacguaccaccacg

SEQ ID NO: 486202 - RNA, 20 nt, Human
uacaggcacgugccaccacg

SEQ ID NO: 486203 - RNA, 23 nt, Human
uacaggcacgugccaccacgccc

SEQ ID NO: 486204 - RNA, 19 nt, Human
uacaggcacgugccaccau

SEQ ID NO: 486205 - RNA, 20 nt, Human
uacaggcacgugccaccaug

SEQ ID NO: 486206 - RNA, 23 nt, Human
uacaggcacgugccaccaugccc

SEQ ID NO: 486207 - RNA, 32 nt, Human
uacaggcacgugccaccaugccuggcuaauuu

SEQ ID NO: 486208 - RNA, 32 nt, Human
uacaggcacgugccaccaugucuggcuaauuu

SEQ ID NO: 486209 - RNA, 32 nt, Human
uacaggcacgugugaccaugccaggcuaauuu

SEQ ID NO: 486210 - RNA, 32 nt, Human
uacaggcacucauugcuacugaaggggacacc

SEQ ID NO: 486211 - RNA, 32 nt, Human
uacaggcacuugccaccauucccagcuaauuu

SEQ ID NO: 486212 - RNA, 20 nt, Human
uacaggcagacaccaucacg

SEQ ID NO: 486213 - RNA, 32 nt, Human
uacaggcagagugggacugagaugguacagug

SEQ ID NO: 486214 - RNA, 20 nt, Human
uacaggcaggagccaccgcg

SEQ ID NO: 486215 - RNA, 32 nt, Human
uacaggcaggagccaccgcgccugggccuuuu

SEQ ID NO: 486216 - RNA, 32 nt, Human
uacaggcaggagccacugagcccagccaagac

SEQ ID NO: 486217 - RNA, 18 nt, Human
uacaggcaggcaccacua

SEQ ID NO: 486218 - RNA, 32 nt, Human
uacaggcaggugccaccaugccuggcuaauuu

SEQ ID NO: 486219 - RNA, 32 nt, Human
uacaggcaggugccaccaugccuggcucauuu

SEQ ID NO: 486220 - RNA, 32 nt, Human
uacaggcauaagccacagcacccggcccugug

SEQ ID NO: 486221 - RNA, 20 nt, Human
uacaggcauaagccaccgcg

SEQ ID NO: 486222 - RNA, 19 nt, Human
uacaggcauacgccaccac

SEQ ID NO: 486223 - RNA, 20 nt, Human
uacaggcauauaccaccaug

SEQ ID NO: 486224 - RNA, 23 nt, Human
uacaggcauauaccaccaugccc

SEQ ID NO: 486225 - RNA, 19 nt, Human
uacaggcauaugccaccac

SEQ ID NO: 486226 - RNA, 19 nt, Human
uacaggcauaugccaucac

SEQ ID NO: 486227 - RNA, 19 nt, Human
uacaggcaucagccaccac

SEQ ID NO: 486228 - RNA, 26 nt, Human
uacaggcaucagccaccacacccagc

SEQ ID NO: 486229 - RNA, 32 nt, Human
uacaggcaucagccaccacacccagccaacuu

SEQ ID NO: 486230 - RNA, 32 nt, Human
uacaggcaucagccaccacacccagccccucc

SEQ ID NO: 486231 - RNA, 32 nt, Human
uacaggcaucagccaccacacccagccgucau

SEQ ID NO: 486232 - RNA, 32 nt, Human
uacaggcaucagccaccacgccuggcccucuc

SEQ ID NO: 486233 - RNA, 32 nt, Human
uacaggcaucagccaccacgccuggccugaua

SEQ ID NO: 486234 - RNA, 20 nt, Human
uacaggcauccgccaccaug

SEQ ID NO: 486235 - RNA, 19 nt, Human
uacaggcaucugccaccgc

SEQ ID NO: 486236 - RNA, 20 nt, Human
uacaggcaucugcuaccacg

SEQ ID NO: 486237 - RNA, 32 nt, Human
uacaggcaugaaccaccaugccuggaggagcc

SEQ ID NO: 486238 - RNA, 32 nt, Human
uacaggcaugaaccacugugcccagccgaaaa

SEQ ID NO: 486239 - RNA, 32 nt, Human
uacaggcaugaaccacugugcccagcugacaa

SEQ ID NO: 486240 - RNA, 18 nt, Human
uacaggcaugaaccauca

SEQ ID NO: 486241 - RNA, 32 nt, Human
uacaggcaugaaccauggugcccagccucauu

SEQ ID NO: 486242 - RNA, 19 nt, Human
uacaggcaugaaucaccac

SEQ ID NO: 486243 - RNA, 20 nt, Human
uacaggcaugaaucaccaug

SEQ ID NO: 486244 - RNA, 32 nt, Human
uacaggcaugaaucaccaugccuagccacuua

SEQ ID NO: 486245 - RNA, 32 nt, Human
uacaggcaugaaugaccgcgcccagccgcagg

SEQ ID NO: 486246 - RNA, 20 nt, Human
uacaggcaugacccaccgcg

SEQ ID NO: 486247 - RNA, 32 nt, Human
uacaggcaugagcacugcucccagcucuguuu

SEQ ID NO: 486248 - RNA, 32 nt, Human
uacaggcaugagccacagcacccggcccagaa

SEQ ID NO: 486249 - RNA, 32 nt, Human
uacaggcaugagccacagugcccggccaagua

SEQ ID NO: 486250 - RNA, 32 nt, Human
uacaggcaugagccaccaaacccagcccagaa

SEQ ID NO: 486251 - RNA, 19 nt, Human
uacaggcaugagccaccac

SEQ ID NO: 486252 - RNA, 32 nt, Human
uacaggcaugagccaccacaaccgucccacua

SEQ ID NO: 486253 - RNA, 32 nt, Human
uacaggcaugagccaccacaacuggccugaaa

SEQ ID NO: 486254 - RNA, 23 nt, Human
uacaggcaugagccaccacaccc

SEQ ID NO: 486255 - RNA, 32 nt, Human
uacaggcaugagccaccacacccacacaagac

SEQ ID NO: 486256 - RNA, 32 nt, Human
uacaggcaugagccaccacacccagccccuuu

SEQ ID NO: 486257 - RNA, 32 nt, Human
uacaggcaugagccaccacacccagcccggac

SEQ ID NO: 486258 - RNA, 32 nt, Human
uacaggcaugagccaccacacccagccuucag

SEQ ID NO: 486259 - RNA, 32 nt, Human
uacaggcaugagccaccacacccagccuuuau

SEQ ID NO: 486260 - RNA, 32 nt, Human
uacaggcaugagccaccacacccagcgagacg

SEQ ID NO: 486261 - RNA, 32 nt, Human
uacaggcaugagccaccacacccagcuccucc

SEQ ID NO: 486262 - RNA, 32 nt, Human
uacaggcaugagccaccacacccggcacuaua

SEQ ID NO: 486263 - RNA, 32 nt, Human
uacaggcaugagccaccacacccggccaauca

SEQ ID NO: 486264 - RNA, 32 nt, Human
uacaggcaugagccaccacacccugcccaugu

SEQ ID NO: 486265 - RNA, 32 nt, Human
uacaggcaugagccaccacaccuggauugcca

SEQ ID NO: 486266 - RNA, 32 nt, Human
uacaggcaugagccaccacaccuggccccauu

SEQ ID NO: 486267 - RNA, 32 nt, Human
uacaggcaugagccaccacaccuugccacaaa

SEQ ID NO: 486268 - RNA, 32 nt, Human
uacaggcaugagccaccacagcuggcccccuu

SEQ ID NO: 486269 - RNA, 32 nt, Human
uacaggcaugagccaccacauccggccuaauu

SEQ ID NO: 486270 - RNA, 32 nt, Human
uacaggcaugagccaccacaucuggccuagga

SEQ ID NO: 486271 - RNA, 20 nt, Human
uacaggcaugagccaccacg

SEQ ID NO: 486272 - RNA, 32 nt, Human
uacaggcaugagccaccacgcccagccaaaau

SEQ ID NO: 486273 - RNA, 32 nt, Human
uacaggcaugagccaccacgcccagccauuga

SEQ ID NO: 486274 - RNA, 32 nt, Human
uacaggcaugagccaccacgcccagcccauaa

SEQ ID NO: 486275 - RNA, 32 nt, Human
uacaggcaugagccaccacgcccagccuaaag

SEQ ID NO: 486276 - RNA, 32 nt, Human
uacaggcaugagccaccacgcccagccuauuu

SEQ ID NO: 486277 - RNA, 32 nt, Human
uacaggcaugagccaccacgcccagccuguuu

SEQ ID NO: 486278 - RNA, 32 nt, Human
uacaggcaugagccaccacgcccagccuuccc

SEQ ID NO: 486279 - RNA, 32 nt, Human
uacaggcaugagccaccacgcccggaccauga

SEQ ID NO: 486280 - RNA, 32 nt, Human
uacaggcaugagccaccacgcccggccaaauu

SEQ ID NO: 486281 - RNA, 32 nt, Human
uacaggcaugagccaccacgcccggcccacuc

SEQ ID NO: 486282 - RNA, 32 nt, Human
uacaggcaugagccaccacgcccggcuagacu

SEQ ID NO: 486283 - RNA, 32 nt, Human
uacaggcaugagccaccacgccuggccaaaaa

SEQ ID NO: 486284 - RNA, 32 nt, Human
uacaggcaugagccaccacgccuggccaagcu

SEQ ID NO: 486285 - RNA, 32 nt, Human
uacaggcaugagccaccacgccuggccaaggc

SEQ ID NO: 486286 - RNA, 32 nt, Human
uacaggcaugagccaccacgccuggccaguuu

SEQ ID NO: 486287 - RNA, 32 nt, Human
uacaggcaugagccaccacgccuggccgagag

SEQ ID NO: 486288 - RNA, 32 nt, Human
uacaggcaugagccaccacgccuggccuccuc

SEQ ID NO: 486289 - RNA, 32 nt, Human
uacaggcaugagccaccacgccuggcuggaau

SEQ ID NO: 486290 - RNA, 32 nt, Human
uacaggcaugagccaccacgccuguccgguua

SEQ ID NO: 486291 - RNA, 32 nt, Human
uacaggcaugagccaccacggccagcccacaa

SEQ ID NO: 486292 - RNA, 32 nt, Human
uacaggcaugagccaccacggcccgccaaaag

SEQ ID NO: 486293 - RNA, 32 nt, Human
uacaggcaugagccaccacuccuggccaggag

SEQ ID NO: 486294 - RNA, 32 nt, Human
uacaggcaugagccaccacuccuggccccaga

SEQ ID NO: 486295 - RNA, 32 nt, Human
uacaggcaugagccaccaggcccggccuuauu

SEQ ID NO: 486296 - RNA, 32 nt, Human
uacaggcaugagccaccaucuucagccagaug

SEQ ID NO: 486297 - RNA, 20 nt, Human
uacaggcaugagccaccaug

SEQ ID NO: 486298 - RNA, 32 nt, Human
uacaggcaugagccaccaugccagacuuccca

SEQ ID NO: 486299 - RNA, 32 nt, Human
uacaggcaugagccaccaugcccaacccaaga

SEQ ID NO: 486300 - RNA, 32 nt, Human
uacaggcaugagccaccaugcccagccaaaga

SEQ ID NO: 486301 - RNA, 32 nt, Human
uacaggcaugagccaccaugcccagccaaugu

SEQ ID NO: 486302 - RNA, 32 nt, Human
uacaggcaugagccaccaugcccagcccacug

SEQ ID NO: 486303 - RNA, 32 nt, Human
uacaggcaugagccaccaugcccagcccucaa

SEQ ID NO: 486304 - RNA, 32 nt, Human
uacaggcaugagccaccaugcccagccuccuu

SEQ ID NO: 486305 - RNA, 32 nt, Human
uacaggcaugagccaccaugcccagccuuuuu

SEQ ID NO: 486306 - RNA, 32 nt, Human
uacaggcaugagccaccaugcccagcugacaa

SEQ ID NO: 486307 - RNA, 32 nt, Human
uacaggcaugagccaccaugcccagcugcucc

SEQ ID NO: 486308 - RNA, 32 nt, Human
uacaggcaugagccaccaugcccagucgauau

SEQ ID NO: 486309 - RNA, 32 nt, Human
uacaggcaugagccaccaugcccggcccagug

SEQ ID NO: 486310 - RNA, 32 nt, Human
uacaggcaugagccaccaugcccggccccuua

SEQ ID NO: 486311 - RNA, 32 nt, Human
uacaggcaugagccaccaugcccggccuaaac

SEQ ID NO: 486312 - RNA, 32 nt, Human
uacaggcaugagccaccaugcccggccuucuu

SEQ ID NO: 486313 - RNA, 32 nt, Human
uacaggcaugagccaccaugcccggcuguuuu

SEQ ID NO: 486314 - RNA, 23 nt, Human
uacaggcaugagccaccaugccu

SEQ ID NO: 486315 - RNA, 32 nt, Human
uacaggcaugagccaccaugccuagccagcaa

SEQ ID NO: 486316 - RNA, 32 nt, Human
uacaggcaugagccaccaugccuagcccagaa

SEQ ID NO: 486317 - RNA, 32 nt, Human
uacaggcaugagccaccaugccuggcaacaua

SEQ ID NO: 486318 - RNA, 32 nt, Human
uacaggcaugagccaccaugccuggccaacuc

SEQ ID NO: 486319 - RNA, 32 nt, Human
uacaggcaugagccaccaugccuggccagaau

SEQ ID NO: 486320 - RNA, 32 nt, Human
uacaggcaugagccaccaugccuggccaggac

SEQ ID NO: 486321 - RNA, 32 nt, Human
uacaggcaugagccaccaugccuggccaugau

SEQ ID NO: 486322 - RNA, 32 nt, Human
uacaggcaugagccaccaugccuggcccagug

SEQ ID NO: 486323 - RNA, 32 nt, Human
uacaggcaugagccaccaugccuggccucugu

SEQ ID NO: 486324 - RNA, 32 nt, Human
uacaggcaugagccaccaugccuggcucaaau

SEQ ID NO: 486325 - RNA, 32 nt, Human
uacaggcaugagccaccaugucuugccaguuu

SEQ ID NO: 486326 - RNA, 32 nt, Human
uacaggcaugagccaccccgcccagcugaguc

SEQ ID NO: 486327 - RNA, 32 nt, Human
uacaggcaugagccaccccgccuggccaguua

SEQ ID NO: 486328 - RNA, 32 nt, Human
uacaggcaugagccaccgagcucagccuccac

SEQ ID NO: 486329 - RNA, 19 nt, Human
uacaggcaugagccaccgc

SEQ ID NO: 486330 - RNA, 32 nt, Human
uacaggcaugagccaccgcacccagcaagagu

SEQ ID NO: 486331 - RNA, 32 nt, Human
uacaggcaugagccaccgcacccagcccaugu

SEQ ID NO: 486332 - RNA, 32 nt, Human
uacaggcaugagccaccgcacccagccuacaa

SEQ ID NO: 486333 - RNA, 32 nt, Human
uacaggcaugagccaccgcacccagccuauuu

SEQ ID NO: 486334 - RNA, 32 nt, Human
uacaggcaugagccaccgcacccagccugcau

SEQ ID NO: 486335 - RNA, 32 nt, Human
uacaggcaugagccaccgcacccagccugguu

SEQ ID NO: 486336 - RNA, 32 nt, Human
uacaggcaugagccaccgcacccggccugcca

SEQ ID NO: 486337 - RNA, 32 nt, Human
uacaggcaugagccaccgcacccggccuuuuu

SEQ ID NO: 486338 - RNA, 32 nt, Human
uacaggcaugagccaccgcaccgggcccuccu

SEQ ID NO: 486339 - RNA, 32 nt, Human
uacaggcaugagccaccgcaccugacccaggc

SEQ ID NO: 486340 - RNA, 32 nt, Human
uacaggcaugagccaccgcaccuggcccuucu

SEQ ID NO: 486341 - RNA, 32 nt, Human
uacaggcaugagccaccgcaccuggccuuccc

SEQ ID NO: 486342 - RNA, 32 nt, Human
uacaggcaugagccaccgcaccuggucugauc

SEQ ID NO: 486343 - RNA, 32 nt, Human
uacaggcaugagccaccgcacucggccaggag

SEQ ID NO: 486344 - RNA, 32 nt, Human
uacaggcaugagccaccgcagccggccccauu

SEQ ID NO: 486345 - RNA, 20 nt, Human
uacaggcaugagccaccgcg

SEQ ID NO: 486346 - RNA, 32 nt, Human
uacaggcaugagccaccgcgccaggccaaggc

SEQ ID NO: 486347 - RNA, 32 nt, Human
uacaggcaugagccaccgcgcccagccaagga

SEQ ID NO: 486348 - RNA, 32 nt, Human
uacaggcaugagccaccgcgcccagccuaauu

SEQ ID NO: 486349 - RNA, 32 nt, Human
uacaggcaugagccaccgcgcccagcugccuu

SEQ ID NO: 486350 - RNA, 32 nt, Human
uacaggcaugagccaccgcgcccggccacgug

SEQ ID NO: 486351 - RNA, 32 nt, Human
uacaggcaugagccaccgcgcccggccagauu

SEQ ID NO: 486352 - RNA, 32 nt, Human
uacaggcaugagccaccgcgcccggcccaauc

SEQ ID NO: 486353 - RNA, 32 nt, Human
uacaggcaugagccaccgcgcccggccccaau

SEQ ID NO: 486354 - RNA, 32 nt, Human
uacaggcaugagccaccgcgcccggccucaau

SEQ ID NO: 486355 - RNA, 32 nt, Human
uacaggcaugagccaccgcgcccggccuguua

SEQ ID NO: 486356 - RNA, 32 nt, Human
uacaggcaugagccaccgcgcccggccuguuu

SEQ ID NO: 486357 - RNA, 32 nt, Human
uacaggcaugagccaccgcgcccugccccuac

SEQ ID NO: 486358 - RNA, 32 nt, Human
uacaggcaugagccaccgcgccugaccacauu

SEQ ID NO: 486359 - RNA, 32 nt, Human
uacaggcaugagccaccgcgccuggccaaugc

SEQ ID NO: 486360 - RNA, 32 nt, Human
uacaggcaugagccaccgcgccuggccgcuuu

SEQ ID NO: 486361 - RNA, 32 nt, Human
uacaggcaugagccaccgcgccuggccuaguu

SEQ ID NO: 486362 - RNA, 32 nt, Human
uacaggcaugagccaccgcgccuggccucugc

SEQ ID NO: 486363 - RNA, 32 nt, Human
uacaggcaugagccaccgcgcuuggccagacu

SEQ ID NO: 486364 - RNA, 32 nt, Human
uacaggcaugagccaccgcucccagccuuuga

SEQ ID NO: 486365 - RNA, 32 nt, Human
uacaggcaugagccaccgcuccuggccggguu

SEQ ID NO: 486366 - RNA, 32 nt, Human
uacaggcaugagccaccgcucucggcccccuu

SEQ ID NO: 486367 - RNA, 32 nt, Human
uacaggcaugagccaccgugccaggccaacag

SEQ ID NO: 486368 - RNA, 23 nt, Human
uacaggcaugagccaccgugccc

SEQ ID NO: 486369 - RNA, 32 nt, Human
uacaggcaugagccaccgugcccagccaaaug

SEQ ID NO: 486370 - RNA, 32 nt, Human
uacaggcaugagccaccgugcccagccaagaa

SEQ ID NO: 486371 - RNA, 32 nt, Human
uacaggcaugagccaccgugcccagccaggca

SEQ ID NO: 486372 - RNA, 32 nt, Human
uacaggcaugagccaccgugcccagcccaaaa

SEQ ID NO: 486373 - RNA, 32 nt, Human
uacaggcaugagccaccgugcccagccuacug

SEQ ID NO: 486374 - RNA, 32 nt, Human
uacaggcaugagccaccgugcccagccuauca

SEQ ID NO: 486375 - RNA, 32 nt, Human
uacaggcaugagccaccgugcccggcccuuua

SEQ ID NO: 486376 - RNA, 32 nt, Human
uacaggcaugagccaccgugcccggccucauc

SEQ ID NO: 486377 - RNA, 32 nt, Human
uacaggcaugagccaccgugcccggccucuua

SEQ ID NO: 486378 - RNA, 32 nt, Human
uacaggcaugagccaccgugcccggcuguauu

SEQ ID NO: 486379 - RNA, 32 nt, Human
uacaggcaugagccaccgugcccggcuucaca

SEQ ID NO: 486380 - RNA, 32 nt, Human
uacaggcaugagccaccgugccuggccaacau

SEQ ID NO: 486381 - RNA, 32 nt, Human
uacaggcaugagccaccgugccuggccucauu

SEQ ID NO: 486382 - RNA, 32 nt, Human
uacaggcaugagccaccgugccuggcuuugcu

SEQ ID NO: 486383 - RNA, 32 nt, Human
uacaggcaugagccaccgugccuguccuagaa

SEQ ID NO: 486384 - RNA, 32 nt, Human
uacaggcaugagccaccgugcgggccucuacu

SEQ ID NO: 486385 - RNA, 32 nt, Human
uacaggcaugagccaccguggccggccaagau

SEQ ID NO: 486386 - RNA, 32 nt, Human
uacaggcaugagccaccucacccagcauuuuu

SEQ ID NO: 486387 - RNA, 32 nt, Human
uacaggcaugagccaccucacccagcuccggu

SEQ ID NO: 486388 - RNA, 32 nt, Human
uacaggcaugagccaccucacuuggcccaauu

SEQ ID NO: 486389 - RNA, 32 nt, Human
uacaggcaugagccaccucgccuagcccaccg

SEQ ID NO: 486390 - RNA, 32 nt, Human
uacaggcaugagccaccucgccuggccagaug

SEQ ID NO: 486391 - RNA, 32 nt, Human
uacaggcaugagccaccugcccagccauguuu

SEQ ID NO: 486392 - RNA, 32 nt, Human
uacaggcaugagccacggcacccagccucauu

SEQ ID NO: 486393 - RNA, 32 nt, Human
uacaggcaugagccacggcgccuggcccccaa

SEQ ID NO: 486394 - RNA, 19 nt, Human
uacaggcaugagccacuac

SEQ ID NO: 486395 - RNA, 32 nt, Human
uacaggcaugagccacuacacccagccgauuu

SEQ ID NO: 486396 - RNA, 32 nt, Human
uacaggcaugagccacuacgccuggccaagua

SEQ ID NO: 486397 - RNA, 32 nt, Human
uacaggcaugagccacugcacccaacuccucu

SEQ ID NO: 486398 - RNA, 32 nt, Human
uacaggcaugagccacugcacccagacuagaa

SEQ ID NO: 486399 - RNA, 32 nt, Human
uacaggcaugagccacugcacccagccaagug

SEQ ID NO: 486400 - RNA, 32 nt, Human
uacaggcaugagccacugcacccagcccaguu

SEQ ID NO: 486401 - RNA, 32 nt, Human
uacaggcaugagccacugcacccagccgauag

SEQ ID NO: 486402 - RNA, 32 nt, Human
uacaggcaugagccacugcacccagccucuua

SEQ ID NO: 486403 - RNA, 32 nt, Human
uacaggcaugagccacugcacccagccuuggc

SEQ ID NO: 486404 - RNA, 32 nt, Human
uacaggcaugagccacugcacccggccaaguc

SEQ ID NO: 486405 - RNA, 32 nt, Human
uacaggcaugagccacugcacccggccuuucu

SEQ ID NO: 486406 - RNA, 32 nt, Human
uacaggcaugagccacugcacccggcuugaau

SEQ ID NO: 486407 - RNA, 32 nt, Human
uacaggcaugagccacugcaccuggcccacuu

SEQ ID NO: 486408 - RNA, 32 nt, Human
uacaggcaugagccacugcaccuggcccuuuu

SEQ ID NO: 486409 - RNA, 32 nt, Human
uacaggcaugagccacugcaccuggccgguua

SEQ ID NO: 486410 - RNA, 32 nt, Human
uacaggcaugagccacugcaccuggccuacgu

SEQ ID NO: 486411 - RNA, 32 nt, Human
uacaggcaugagccacugcaccuggccuagga

SEQ ID NO: 486412 - RNA, 32 nt, Human
uacaggcaugagccacugcauccggccuguua

SEQ ID NO: 486413 - RNA, 32 nt, Human
uacaggcaugagccacugcgccagccuaaagu

SEQ ID NO: 486414 - RNA, 32 nt, Human
uacaggcaugagccacugcgcccggccaagaa

SEQ ID NO: 486415 - RNA, 32 nt, Human
uacaggcaugagccacugcgcccggccaauuu

SEQ ID NO: 486416 - RNA, 32 nt, Human
uacaggcaugagccacugcgcccggccaugga

SEQ ID NO: 486417 - RNA, 32 nt, Human
uacaggcaugagccacugcgcccggcccaaau

SEQ ID NO: 486418 - RNA, 32 nt, Human
uacaggcaugagccacugcgcccggccuccaa

SEQ ID NO: 486419 - RNA, 32 nt, Human
uacaggcaugagccacugcgcccggccucuuu

SEQ ID NO: 486420 - RNA, 32 nt, Human
uacaggcaugagccacugcgcccggccugggu

SEQ ID NO: 486421 - RNA, 32 nt, Human
uacaggcaugagccacugcgcccggcugagug

SEQ ID NO: 486422 - RNA, 32 nt, Human
uacaggcaugagccacugcgccuggccagcaa

SEQ ID NO: 486423 - RNA, 32 nt, Human
uacaggcaugagccacugcgccuggccggaca

SEQ ID NO: 486424 - RNA, 32 nt, Human
uacaggcaugagccacugcgccuggccucaga

SEQ ID NO: 486425 - RNA, 32 nt, Human
uacaggcaugagccacugggcgcggccagaua

SEQ ID NO: 486426 - RNA, 32 nt, Human
uacaggcaugagccacuguacccagccaaaau

SEQ ID NO: 486427 - RNA, 32 nt, Human
uacaggcaugagccacugugcccagcccaggc

SEQ ID NO: 486428 - RNA, 32 nt, Human
uacaggcaugagccacugugcccagcccuuuu

SEQ ID NO: 486429 - RNA, 32 nt, Human
uacaggcaugagccacugugcccagccuguuc

SEQ ID NO: 486430 - RNA, 32 nt, Human
uacaggcaugagccacugugcccagcugggau

SEQ ID NO: 486431 - RNA, 32 nt, Human
uacaggcaugagccacugugcccagucaggau

SEQ ID NO: 486432 - RNA, 32 nt, Human
uacaggcaugagccacugugcccggcaagcag

SEQ ID NO: 486433 - RNA, 32 nt, Human
uacaggcaugagccacugugcccggccacuuu

SEQ ID NO: 486434 - RNA, 32 nt, Human
uacaggcaugagccacugugcccggccaguug

SEQ ID NO: 486435 - RNA, 32 nt, Human
uacaggcaugagccacugugcccggccuauga

SEQ ID NO: 486436 - RNA, 32 nt, Human
uacaggcaugagccacugugcccggccuggga

SEQ ID NO: 486437 - RNA, 32 nt, Human
uacaggcaugagccacugugcccggccuuuug

SEQ ID NO: 486438 - RNA, 32 nt, Human
uacaggcaugagccacugugccugaccuuaca

SEQ ID NO: 486439 - RNA, 32 nt, Human
uacaggcaugagccacugugccuggccaacau

SEQ ID NO: 486440 - RNA, 32 nt, Human
uacaggcaugagccacugugccuggccagaaa

SEQ ID NO: 486441 - RNA, 32 nt, Human
uacaggcaugagccacugugccuggccccuuc

SEQ ID NO: 486442 - RNA, 32 nt, Human
uacaggcaugagccacugugccuggccugagg

SEQ ID NO: 486443 - RNA, 32 nt, Human
uacaggcaugagccacugugccuggcuauucu

SEQ ID NO: 486444 - RNA, 32 nt, Human
uacaggcaugagccacugugccuguccuaccc

SEQ ID NO: 486445 - RNA, 32 nt, Human
uacaggcaugagccacugugcucagccuucau

SEQ ID NO: 486446 - RNA, 32 nt, Human
uacaggcaugagccacugugcuuggccuguua

SEQ ID NO: 486447 - RNA, 32 nt, Human
uacaggcaugagccacuguguccggucuugag

SEQ ID NO: 486448 - RNA, 32 nt, Human
uacaggcaugagccacuguguccuucccugcc

SEQ ID NO: 486449 - RNA, 32 nt, Human
uacaggcaugagccacugugucuggcccuauu

SEQ ID NO: 486450 - RNA, 32 nt, Human
uacaggcaugagccacuguguucaguuggcca

SEQ ID NO: 486451 - RNA, 19 nt, Human
uacaggcaugagccaucac

SEQ ID NO: 486452 - RNA, 32 nt, Human
uacaggcaugagccauugugcccagccuauau

SEQ ID NO: 486453 - RNA, 32 nt, Human
uacaggcaugagcccuugugcccagcccauag

SEQ ID NO: 486454 - RNA, 20 nt, Human
uacaggcaugagcuaccacg

SEQ ID NO: 486455 - RNA, 19 nt, Human
uacaggcaugagcuacuac

SEQ ID NO: 486456 - RNA, 32 nt, Human
uacaggcaugagcuacugugcccagccucuau

SEQ ID NO: 486457 - RNA, 19 nt, Human
uacaggcaugagucaccac

SEQ ID NO: 486458 - RNA, 23 nt, Human
uacaggcaugagucaccacaccu

SEQ ID NO: 486459 - RNA, 19 nt, Human
uacaggcaugagucaccau

SEQ ID NO: 486460 - RNA, 20 nt, Human
uacaggcaugagucacuacg

SEQ ID NO: 486461 - RNA, 32 nt, Human
uacaggcaugcaccaauuuuuguauuuuuagu

SEQ ID NO: 486462 - RNA, 19 nt, Human
uacaggcaugcaccaccac

SEQ ID NO: 486463 - RNA, 23 nt, Human
uacaggcaugcaccaccacaccc

SEQ ID NO: 486464 - RNA, 32 nt, Human
uacaggcaugcaccaccacacccggcuaauuu

SEQ ID NO: 486465 - RNA, 20 nt, Human
uacaggcaugcaccaccacg

SEQ ID NO: 486466 - RNA, 23 nt, Human
uacaggcaugcaccaccacgccc

SEQ ID NO: 486467 - RNA, 20 nt, Human
uacaggcaugcaccaccaug

SEQ ID NO: 486468 - RNA, 23 nt, Human
uacaggcaugcaccaccaugccc

SEQ ID NO: 486469 - RNA, 32 nt, Human
uacaggcaugcaccaccaugcccagcuaauuu

SEQ ID NO: 486470 - RNA, 32 nt, Human
uacaggcaugcaccaccaugcccaguuaauaa

SEQ ID NO: 486471 - RNA, 32 nt, Human
uacaggcaugcaccaccaugcccggcuaauuu

SEQ ID NO: 486472 - RNA, 23 nt, Human
uacaggcaugcaccaccaugccu

SEQ ID NO: 486473 - RNA, 32 nt, Human
uacaggcaugcaccaccaugccuagcuaauuu

SEQ ID NO: 486474 - RNA, 32 nt, Human
uacaggcaugcaccaccaugccuggcuaauuu

SEQ ID NO: 486475 - RNA, 32 nt, Human
uacaggcaugcaccaccaugccuggcuacuuu

SEQ ID NO: 486476 - RNA, 18 nt, Human
uacaggcaugcacuacca

SEQ ID NO: 486477 - RNA, 19 nt, Human
uacaggcaugcacuaccac

SEQ ID NO: 486478 - RNA, 20 nt, Human
uacaggcaugcacuaccacg

SEQ ID NO: 486479 - RNA, 20 nt, Human
uacaggcaugcaucaccaug

SEQ ID NO: 486480 - RNA, 23 nt, Human
uacaggcaugcaucaccaugucc

SEQ ID NO: 486481 - RNA, 20 nt, Human
uacaggcaugcaucacuaug

SEQ ID NO: 486482 - RNA, 32 nt, Human
uacaggcaugcauccccaugcccagcuaauuu

SEQ ID NO: 486483 - RNA, 19 nt, Human
uacaggcaugcgcagccac

SEQ ID NO: 486484 - RNA, 19 nt, Human
uacaggcaugcgccaccac

SEQ ID NO: 486485 - RNA, 23 nt, Human
uacaggcaugcgccaccacaccc

SEQ ID NO: 486486 - RNA, 20 nt, Human
uacaggcaugcgccaccacg

SEQ ID NO: 486487 - RNA, 23 nt, Human
uacaggcaugcgccaccacgccc

SEQ ID NO: 486488 - RNA, 19 nt, Human
uacaggcaugcgccaccau

SEQ ID NO: 486489 - RNA, 32 nt, Human
uacaggcaugcgccaccauacccaccagauuu

SEQ ID NO: 486490 - RNA, 20 nt, Human
uacaggcaugcgccaccaug

SEQ ID NO: 486491 - RNA, 32 nt, Human
uacaggcaugcgccaccaugaccggcuaauuu

SEQ ID NO: 486492 - RNA, 32 nt, Human
uacaggcaugcgccaccaugccaggcuaacuu

SEQ ID NO: 486493 - RNA, 32 nt, Human
uacaggcaugcgccaccaugcccagcuaauug

SEQ ID NO: 486494 - RNA, 32 nt, Human
uacaggcaugcgccaccaugcccagcuaauuu

SEQ ID NO: 486495 - RNA, 32 nt, Human
uacaggcaugcgccaccaugcccagcugauuu

SEQ ID NO: 486496 - RNA, 32 nt, Human
uacaggcaugcgccaccaugccccacuaauuc

SEQ ID NO: 486497 - RNA, 32 nt, Human
uacaggcaugcgccaccaugcccggcuaauuu

SEQ ID NO: 486498 - RNA, 32 nt, Human
uacaggcaugcgccaccaugccuggcuaauuu

SEQ ID NO: 486499 - RNA, 18 nt, Human
uacaggcaugcgccacua

SEQ ID NO: 486500 - RNA, 20 nt, Human
uacaggcaugcgcuaccacg

SEQ ID NO: 486501 - RNA, 19 nt, Human
uacaggcaugcgucaccac

SEQ ID NO: 486502 - RNA, 20 nt, Human
uacaggcaugcgucaccacg

SEQ ID NO: 486503 - RNA, 20 nt, Human
uacaggcaugcuccaccaug

SEQ ID NO: 486504 - RNA, 32 nt, Human
uacaggcaugcuccaccaugcccagcuaauuu

SEQ ID NO: 486505 - RNA, 19 nt, Human
uacaggcaugggccaccac

SEQ ID NO: 486506 - RNA, 23 nt, Human
uacaggcaugggccaccacaccc

SEQ ID NO: 486507 - RNA, 23 nt, Human
uacaggcaugggccaccacagcc

SEQ ID NO: 486508 - RNA, 20 nt, Human
uacaggcaugggccaccacg

SEQ ID NO: 486509 - RNA, 32 nt, Human
uacaggcaugggccaccaugcccggcuaauuu

SEQ ID NO: 486510 - RNA, 19 nt, Human
uacaggcaugggucaccgc

SEQ ID NO: 486511 - RNA, 32 nt, Human
uacaggcaugggucacugugcccagccuuuuc

SEQ ID NO: 486512 - RNA, 19 nt, Human
uacaggcauguaccaccac

SEQ ID NO: 486513 - RNA, 32 nt, Human
uacaggcauguaccaucacacccggcuaauuu

SEQ ID NO: 486514 - RNA, 20 nt, Human
uacaggcauguaccaucacg

SEQ ID NO: 486515 - RNA, 23 nt, Human
uacaggcauguaccaucacgccc

SEQ ID NO: 486516 - RNA, 20 nt, Human
uacaggcauguacuaccaug

SEQ ID NO: 486517 - RNA, 20 nt, Human
uacaggcaugugccacaacg

SEQ ID NO: 486518 - RNA, 19 nt, Human
uacaggcaugugccaccac

SEQ ID NO: 486519 - RNA, 20 nt, Human
uacaggcaugugccaccacg

SEQ ID NO: 486520 - RNA, 23 nt, Human
uacaggcaugugccaccacgccc

SEQ ID NO: 486521 - RNA, 23 nt, Human
uacaggcaugugccaccacgccu

SEQ ID NO: 486522 - RNA, 20 nt, Human
uacaggcaugugccaccaug

SEQ ID NO: 486523 - RNA, 23 nt, Human
uacaggcaugugccaccaugccc

SEQ ID NO: 486524 - RNA, 32 nt, Human
uacaggcaugugccaccaugcccagcuaauuu

SEQ ID NO: 486525 - RNA, 32 nt, Human
uacaggcaugugccaccaugcccggcuaauuu

SEQ ID NO: 486526 - RNA, 23 nt, Human
uacaggcaugugccaccaugccu

SEQ ID NO: 486527 - RNA, 32 nt, Human
uacaggcaugugccaccaugccugaccaauuu

SEQ ID NO: 486528 - RNA, 32 nt, Human
uacaggcaugugccaccaugccuggcuaauuu

SEQ ID NO: 486529 - RNA, 32 nt, Human
uacaggcaugugccaccauguaauuagcccgg

SEQ ID NO: 486530 - RNA, 32 nt, Human
uacaggcaugugccaccauguccagcuaauuu

SEQ ID NO: 486531 - RNA, 24 nt, Human
uacaggcaugugccacccaccacg

SEQ ID NO: 486532 - RNA, 20 nt, Human
uacaggcaugugccaccgcg

SEQ ID NO: 486533 - RNA, 32 nt, Human
uacaggcaugugccacgacacccggccaauuu

SEQ ID NO: 486534 - RNA, 23 nt, Human
uacaggcauguggcaccaugccc

SEQ ID NO: 486535 - RNA, 32 nt, Human
uacaggcauguggcaccaugcccgcuaaguuu

SEQ ID NO: 486536 - RNA, 32 nt, Human
uacaggcauguggcaccaugccuggcuaauuu

SEQ ID NO: 486537 - RNA, 19 nt, Human
uacaggcaugugucaccac

SEQ ID NO: 486538 - RNA, 20 nt, Human
uacaggcaugugucaccacg

SEQ ID NO: 486539 - RNA, 20 nt, Human
uacaggcaugugucaccaug

SEQ ID NO: 486540 - RNA, 32 nt, Human
uacaggcaugugucaccaugcccagcuaauuu

SEQ ID NO: 486541 - RNA, 32 nt, Human
uacaggcaugugucaccaugcccggcuaauuu

SEQ ID NO: 486542 - RNA, 32 nt, Human
uacaggcauguuucaccauguuggucaggcug

SEQ ID NO: 486543 - RNA, 32 nt, Human
uacaggcauuagccaccaugccuggccuauuc

SEQ ID NO: 486544 - RNA, 32 nt, Human
uacaggcauuagccaccaugccuggccuggag

SEQ ID NO: 486545 - RNA, 32 nt, Human
uacaggccaacaggaacaccuggcuccagcca

SEQ ID NO: 486546 - RNA, 20 nt, Human
uacaggccacggccaccaug

SEQ ID NO: 486547 - RNA, 32 nt, Human
uacaggccacggccaccaugccuggcuaaucu

SEQ ID NO: 486548 - RNA, 32 nt, Human
uacaggccaggccuagaaaugaugcauaucau

SEQ ID NO: 486549 - RNA, 19 nt, Human
uacaggcccacacuaccac

SEQ ID NO: 486550 - RNA, 32 nt, Human
uacaggcccacacuaccacacccggcuaauuu

SEQ ID NO: 486551 - RNA, 32 nt, Human
uacaggccccuguacagagaagugucucacgu

SEQ ID NO: 486552 - RNA, 32 nt, Human
uacaggcccucccuccccuuggccucuaggag

SEQ ID NO: 486553 - RNA, 19 nt, Human
uacaggcccugccaccacg

SEQ ID NO: 486554 - RNA, 32 nt, Human
uacaggcccugccaccacgcccggcuaauuug

SEQ ID NO: 486555 - RNA, 20 nt, Human
uacaggccucagccaccaug

SEQ ID NO: 486556 - RNA, 32 nt, Human
uacaggccucagccaccaugcccagcccugcg

SEQ ID NO: 486557 - RNA, 32 nt, Human
uacaggccuccacccaaccaccauccccuugg

SEQ ID NO: 486558 - RNA, 32 nt, Human
uacaggccucugccaccaugcucagcuauuuu

SEQ ID NO: 486559 - RNA, 20 nt, Human
uacaggccugagccaccacg

SEQ ID NO: 486560 - RNA, 32 nt, Human
uacaggccugagccaccauacccagcaaguua

SEQ ID NO: 486561 - RNA, 20 nt, Human
uacaggccugagccaccaug

SEQ ID NO: 486562 - RNA, 32 nt, Human
uacaggccugagccaccaugcccagcugaauu

SEQ ID NO: 486563 - RNA, 32 nt, Human
uacaggccugagccaccccacccggccuauuu

SEQ ID NO: 486564 - RNA, 20 nt, Human
uacaggccugagccaccgcg

SEQ ID NO: 486565 - RNA, 32 nt, Human
uacaggccugagccaccgcgcccagucucucc

SEQ ID NO: 486566 - RNA, 32 nt, Human
uacaggccugagccaccgcgcccggccuauuu

SEQ ID NO: 486567 - RNA, 32 nt, Human
uacaggccugagccaccgcguccggccuccau

SEQ ID NO: 486568 - RNA, 32 nt, Human
uacaggccugagccaccguaucuggcccaaaa

SEQ ID NO: 486569 - RNA, 32 nt, Human
uacaggccugagccaccgugcccagccaaaau

SEQ ID NO: 486570 - RNA, 32 nt, Human
uacaggccugagccaccgugccuggccccuaa

SEQ ID NO: 486571 - RNA, 32 nt, Human
uacaggccugagccaccgugccuggccuuuua

SEQ ID NO: 486572 - RNA, 32 nt, Human
uacaggccugagccacugcgcccagccaauac

SEQ ID NO: 486573 - RNA, 32 nt, Human
uacaggccugagccacugcgcccagccaggau

SEQ ID NO: 486574 - RNA, 20 nt, Human
uacaggccugcgccaccacg

SEQ ID NO: 486575 - RNA, 19 nt, Human
uacaggcgaucaccaccac

SEQ ID NO: 486576 - RNA, 20 nt, Human
uacaggcgcaaaccaccaug

SEQ ID NO: 486577 - RNA, 19 nt, Human
uacaggcgcaagccacuac

SEQ ID NO: 486578 - RNA, 18 nt, Human
uacaggcgcacaccacca

SEQ ID NO: 486579 - RNA, 19 nt, Human
uacaggcgcacaccaccac

SEQ ID NO: 486580 - RNA, 32 nt, Human
uacaggcgcacaccaccacacuggcuaauuuu

SEQ ID NO: 486581 - RNA, 20 nt, Human
uacaggcgcacaccaccacg

SEQ ID NO: 486582 - RNA, 32 nt, Human
uacaggcgcacaccaccaugcccagcuaacuu

SEQ ID NO: 486583 - RNA, 32 nt, Human
uacaggcgcacaucaccaugcccaaccuccaa

SEQ ID NO: 486584 - RNA, 19 nt, Human
uacaggcgcacgccaccac

SEQ ID NO: 486585 - RNA, 20 nt, Human
uacaggcgcacgccaccacg

SEQ ID NO: 486586 - RNA, 20 nt, Human
uacaggcgcacgccaccaug

SEQ ID NO: 486587 - RNA, 32 nt, Human
uacaggcgcacgccaccaugcccagcuaauuu

SEQ ID NO: 486588 - RNA, 19 nt, Human
uacaggcgcacgucaccac

SEQ ID NO: 486589 - RNA, 19 nt, Human
uacaggcgcaugccaccac

SEQ ID NO: 486590 - RNA, 20 nt, Human
uacaggcgcaugccaccaug

SEQ ID NO: 486591 - RNA, 32 nt, Human
uacaggcgcaugccaccaugccaggcuaauuu

SEQ ID NO: 486592 - RNA, 32 nt, Human
uacaggcgcaugccaccaugcccagcuaauuu

SEQ ID NO: 486593 - RNA, 20 nt, Human
uacaggcgcaugccaucacg

SEQ ID NO: 486594 - RNA, 20 nt, Human
uacaggcgcaugcuacgacg

SEQ ID NO: 486595 - RNA, 20 nt, Human
uacaggcgccagccaccaug

SEQ ID NO: 486596 - RNA, 32 nt, Human
uacaggcgccagccaccaugccuggcuaauuu

SEQ ID NO: 486597 - RNA, 18 nt, Human
uacaggcgcccaccacca

SEQ ID NO: 486598 - RNA, 19 nt, Human
uacaggcgcccaccaccac

SEQ ID NO: 486599 - RNA, 20 nt, Human
uacaggcgcccaccaccacg

SEQ ID NO: 486600 - RNA, 19 nt, Human
uacaggcgcccaccaccau

SEQ ID NO: 486601 - RNA, 20 nt, Human
uacaggcgcccaccaccaug

SEQ ID NO: 486602 - RNA, 23 nt, Human
uacaggcgcccaccaccaugccc

SEQ ID NO: 486603 - RNA, 32 nt, Human
uacaggcgcccaccaccaugcccagcuaauuu

SEQ ID NO: 486604 - RNA, 32 nt, Human
uacaggcgcccaccaccaugcccggcuaauuu

SEQ ID NO: 486605 - RNA, 20 nt, Human
uacaggcgcccaccaccgcg

SEQ ID NO: 486606 - RNA, 20 nt, Human
uacaggcgcccaccaccucg

SEQ ID NO: 486607 - RNA, 20 nt, Human
uacaggcgcccaccacgacg

SEQ ID NO: 486608 - RNA, 32 nt, Human
uacaggcgcccaccacuaugcccagcuaauuu

SEQ ID NO: 486609 - RNA, 20 nt, Human
uacaggcgcccaccaucacg

SEQ ID NO: 486610 - RNA, 32 nt, Human
uacaggcgcccaccgccaugcccggcuaauuu

SEQ ID NO: 486611 - RNA, 19 nt, Human
uacaggcgcccaccuccac

SEQ ID NO: 486612 - RNA, 20 nt, Human
uacaggcgcccacgaccacg

SEQ ID NO: 486613 - RNA, 20 nt, Human
uacaggcgcccgcaaccacg

SEQ ID NO: 486614 - RNA, 20 nt, Human
uacaggcgcccgccaacacg

SEQ ID NO: 486615 - RNA, 19 nt, Human
uacaggcgcccgccaccac

SEQ ID NO: 486616 - RNA, 20 nt, Human
uacaggcgcccgccaccacg

SEQ ID NO: 486617 - RNA, 20 nt, Human
uacaggcgcccgccaccaug

SEQ ID NO: 486618 - RNA, 23 nt, Human
uacaggcgcccgccaccaugccc

SEQ ID NO: 486619 - RNA, 32 nt, Human
uacaggcgcccgccaccaugcccagcuaauuu

SEQ ID NO: 486620 - RNA, 32 nt, Human
uacaggcgcccgccaccaugccccggcuauuu

SEQ ID NO: 486621 - RNA, 32 nt, Human
uacaggcgcccgccaccaugcccggcuaauuu

SEQ ID NO: 486622 - RNA, 32 nt, Human
uacaggcgcccgccaccaugccuggcuaauuu

SEQ ID NO: 486623 - RNA, 20 nt, Human
uacaggcgcccgccaccucg

SEQ ID NO: 486624 - RNA, 20 nt, Human
uacaggcgcccgccacuacg

SEQ ID NO: 486625 - RNA, 20 nt, Human
uacaggcgcccgccaucacg

SEQ ID NO: 486626 - RNA, 32 nt, Human
uacaggcgcccgccaucgugcccagcuaauuu

SEQ ID NO: 486627 - RNA, 20 nt, Human
uacaggcgcccgccgccacg

SEQ ID NO: 486628 - RNA, 20 nt, Human
uacaggcgcccggccaccac

SEQ ID NO: 486629 - RNA, 19 nt, Human
uacaggcgcccgucaccac

SEQ ID NO: 486630 - RNA, 20 nt, Human
uacaggcgccuaccaccaug

SEQ ID NO: 486631 - RNA, 23 nt, Human
uacaggcgccuaccaccaugccc

SEQ ID NO: 486632 - RNA, 32 nt, Human
uacaggcgccuaccaccaugcccagcuaauuu

SEQ ID NO: 486633 - RNA, 20 nt, Human
uacaggcgccuaucaccaug

SEQ ID NO: 486634 - RNA, 18 nt, Human
uacaggcgccucaccaug

SEQ ID NO: 486635 - RNA, 20 nt, Human
uacaggcgccugccacaacg

SEQ ID NO: 486636 - RNA, 19 nt, Human
uacaggcgccugccaccac

SEQ ID NO: 486637 - RNA, 20 nt, Human
uacaggcgccugccaccacg

SEQ ID NO: 486638 - RNA, 20 nt, Human
uacaggcgccugccaccaug

SEQ ID NO: 486639 - RNA, 23 nt, Human
uacaggcgccugccaccaugccc

SEQ ID NO: 486640 - RNA, 32 nt, Human
uacaggcgccugccaccaugcccgccuaauuu

SEQ ID NO: 486641 - RNA, 32 nt, Human
uacaggcgccugccaccaugccuagcaaauuu

SEQ ID NO: 486642 - RNA, 32 nt, Human
uacaggcgccugccaccaugccuggcuaauuu

SEQ ID NO: 486643 - RNA, 32 nt, Human
uacaggcgccugccaccaugccuggcugauau

SEQ ID NO: 486644 - RNA, 32 nt, Human
uacaggcgccugccaccaugcugggcuaauuu

SEQ ID NO: 486645 - RNA, 20 nt, Human
uacaggcgccugccagcacg

SEQ ID NO: 486646 - RNA, 19 nt, Human
uacaggcgccugcuaccac

SEQ ID NO: 486647 - RNA, 20 nt, Human
uacaggcgccugcuaccaug

SEQ ID NO: 486648 - RNA, 32 nt, Human
uacaggcgccugcuaccaugccuggcuaauuu

SEQ ID NO: 486649 - RNA, 19 nt, Human
uacaggcgcgagccaccac

SEQ ID NO: 486650 - RNA, 32 nt, Human
uacaggcgcgagccaccaugcccggccagugu

SEQ ID NO: 486651 - RNA, 20 nt, Human
uacaggcgcgagccaccgcg

SEQ ID NO: 486652 - RNA, 32 nt, Human
uacaggcgcgagccaccgcgcccagccuacac

SEQ ID NO: 486653 - RNA, 32 nt, Human
uacaggcgcgagccaccgcgcccgacagcagu

SEQ ID NO: 486654 - RNA, 17 nt, Human
uacaggcgcgagccacg

SEQ ID NO: 486655 - RNA, 32 nt, Human
uacaggcgcgagccacggcgcccagccuugaa

SEQ ID NO: 486656 - RNA, 20 nt, Human
uacaggcgcgcaccaccacg

SEQ ID NO: 486657 - RNA, 32 nt, Human
uacaggcgcgcaucaccaugcccagcuaauuu

SEQ ID NO: 486658 - RNA, 20 nt, Human
uacaggcgcgcgccaccacg

SEQ ID NO: 486659 - RNA, 20 nt, Human
uacaggcgcgcgccaccagg

SEQ ID NO: 486660 - RNA, 20 nt, Human
uacaggcgcgcgccaccaug

SEQ ID NO: 486661 - RNA, 19 nt, Human
uacaggcgcgcgccgccac

SEQ ID NO: 486662 - RNA, 20 nt, Human
uacaggcgcgcgccgccacg

SEQ ID NO: 486663 - RNA, 19 nt, Human
uacaggcgcguaucaccau

SEQ ID NO: 486664 - RNA, 19 nt, Human
uacaggcgcgugccaccac

SEQ ID NO: 486665 - RNA, 20 nt, Human
uacaggcgcgugccaccacg

SEQ ID NO: 486666 - RNA, 19 nt, Human
uacaggcgcgugccaccau

SEQ ID NO: 486667 - RNA, 32 nt, Human
uacaggcgcgugccaccauaccgagcuaguuu

SEQ ID NO: 486668 - RNA, 32 nt, Human
uacaggcgcgugccaccaugccuggcuuuugu

SEQ ID NO: 486669 - RNA, 19 nt, Human
uacaggcgcuggccaccac

SEQ ID NO: 486670 - RNA, 17 nt, Human
uacaggcgcuguuacca

SEQ ID NO: 486671 - RNA, 20 nt, Human
uacaggcgggagccaccaug

SEQ ID NO: 486672 - RNA, 32 nt, Human
uacaggcgggagccaccaugauggccaacuuu

SEQ ID NO: 486673 - RNA, 32 nt, Human
uacaggcgggagccaccaugccuggccagaac

SEQ ID NO: 486674 - RNA, 20 nt, Human
uacaggcgggcaacacuacg

SEQ ID NO: 486675 - RNA, 19 nt, Human
uacaggcguaagccaccac

SEQ ID NO: 486676 - RNA, 32 nt, Human
uacaggcguaagccaccacaccagcugaugca

SEQ ID NO: 486677 - RNA, 32 nt, Human
uacaggcguaagccaccacacccagcccaaaa

SEQ ID NO: 486678 - RNA, 32 nt, Human
uacaggcguaagccaccaugccuggcaacaua

SEQ ID NO: 486679 - RNA, 18 nt, Human
uacaggcguaagccacua

SEQ ID NO: 486680 - RNA, 32 nt, Human
uacaggcguaagccacugcgcccagccacugc

SEQ ID NO: 486681 - RNA, 32 nt, Human
uacaggcguaagggcccacgcccagccuacca

SEQ ID NO: 486682 - RNA, 20 nt, Human
uacaggcguacaccaccaug

SEQ ID NO: 486683 - RNA, 32 nt, Human
uacaggcguacaccaccaugccuggcuaauuu

SEQ ID NO: 486684 - RNA, 32 nt, Human
uacaggcguacgccaccaugcccaguuaacuu

SEQ ID NO: 486685 - RNA, 20 nt, Human
uacaggcgucaaagaccccg

SEQ ID NO: 486686 - RNA, 20 nt, Human
uacaggcgucagccaccaug

SEQ ID NO: 486687 - RNA, 32 nt, Human
uacaggcgucagccaccaugcccagccuuaaa

SEQ ID NO: 486688 - RNA, 20 nt, Human
uacaggcgucagccaccgcg

SEQ ID NO: 486689 - RNA, 20 nt, Human
uacaggcguccacuaccacg

SEQ ID NO: 486690 - RNA, 32 nt, Human
uacaggcguccgccaccaugcccagccaauuu

SEQ ID NO: 486691 - RNA, 32 nt, Human
uacaggcguccuccaccaugccuggcuaauau

SEQ ID NO: 486692 - RNA, 19 nt, Human
uacaggcgugaaccaccac

SEQ ID NO: 486693 - RNA, 20 nt, Human
uacaggcgugaagcaccacg

SEQ ID NO: 486694 - RNA, 32 nt, Human
uacaggcgugaagcaccacgcccagccugaaa

SEQ ID NO: 486695 - RNA, 18 nt, Human
uacaggcgugacgaccac

SEQ ID NO: 486696 - RNA, 19 nt, Human
uacaggcgugacgaccgcg

SEQ ID NO: 486697 - RNA, 20 nt, Human
uacaggcgugagacaccgcg

SEQ ID NO: 486698 - RNA, 32 nt, Human
uacaggcgugagacacugcgcccagccucauc

SEQ ID NO: 486699 - RNA, 19 nt, Human
uacaggcgugagcaaccgc

SEQ ID NO: 486700 - RNA, 32 nt, Human
uacaggcgugagcaaccgcacccggccaggac

SEQ ID NO: 486701 - RNA, 20 nt, Human
uacaggcgugagcaaccgcg

SEQ ID NO: 486702 - RNA, 32 nt, Human
uacaggcgugagcaaccgcgccuggcugacaa

SEQ ID NO: 486703 - RNA, 32 nt, Human
uacaggcgugagcaacugcacccagccuaguu

SEQ ID NO: 486704 - RNA, 32 nt, Human
uacaggcgugagcaaucgugcccagccuuguu

SEQ ID NO: 486705 - RNA, 32 nt, Human
uacaggcgugagcaccccacccagcucauuac

SEQ ID NO: 486706 - RNA, 32 nt, Human
uacaggcgugagccaacacaccggaccuucau

SEQ ID NO: 486707 - RNA, 32 nt, Human
uacaggcgugagccaaugugcccggccuaaac

SEQ ID NO: 486708 - RNA, 32 nt, Human
uacaggcgugagccacaaugcccggcccacgu

SEQ ID NO: 486709 - RNA, 32 nt, Human
uacaggcgugagccacagcgcccggcccucuu

SEQ ID NO: 486710 - RNA, 32 nt, Human
uacaggcgugagccacagugccuggccucuuc

SEQ ID NO: 486711 - RNA, 32 nt, Human
uacaggcgugagccacagugccuggccugauu

SEQ ID NO: 486712 - RNA, 18 nt, Human
uacaggcgugagccacca

SEQ ID NO: 486713 - RNA, 32 nt, Human
uacaggcgugagccaccaacacccugccugag

SEQ ID NO: 486714 - RNA, 19 nt, Human
uacaggcgugagccaccac

SEQ ID NO: 486715 - RNA, 32 nt, Human
uacaggcgugagccaccacaccaggcccgaga

SEQ ID NO: 486716 - RNA, 32 nt, Human
uacaggcgugagccaccacacccagccaaauu

SEQ ID NO: 486717 - RNA, 32 nt, Human
uacaggcgugagccaccacacccagccaguga

SEQ ID NO: 486718 - RNA, 32 nt, Human
uacaggcgugagccaccacacccagccaguuu

SEQ ID NO: 486719 - RNA, 32 nt, Human
uacaggcgugagccaccacacccagcccuuuc

SEQ ID NO: 486720 - RNA, 32 nt, Human
uacaggcgugagccaccacacccagcucaggg

SEQ ID NO: 486721 - RNA, 32 nt, Human
uacaggcgugagccaccacacccggcccacuu

SEQ ID NO: 486722 - RNA, 32 nt, Human
uacaggcgugagccaccacacccggcccccag

SEQ ID NO: 486723 - RNA, 32 nt, Human
uacaggcgugagccaccacacccggccgugga

SEQ ID NO: 486724 - RNA, 32 nt, Human
uacaggcgugagccaccacacccggcuccguu

SEQ ID NO: 486725 - RNA, 32 nt, Human
uacaggcgugagccaccacacccucccgagau

SEQ ID NO: 486726 - RNA, 32 nt, Human
uacaggcgugagccaccacaccuagcuggaag

SEQ ID NO: 486727 - RNA, 32 nt, Human
uacaggcgugagccaccacaccuggccagcuc

SEQ ID NO: 486728 - RNA, 32 nt, Human
uacaggcgugagccaccacaccuggcccuaaa

SEQ ID NO: 486729 - RNA, 32 nt, Human
uacaggcgugagccaccacaccuggccuguuu

SEQ ID NO: 486730 - RNA, 32 nt, Human
uacaggcgugagccaccacaccuggcuacccu

SEQ ID NO: 486731 - RNA, 32 nt, Human
uacaggcgugagccaccacacuuggccagacu

SEQ ID NO: 486732 - RNA, 32 nt, Human
uacaggcgugagccaccacauccagccaguga

SEQ ID NO: 486733 - RNA, 32 nt, Human
uacaggcgugagccaccacauccggccagugc

SEQ ID NO: 486734 - RNA, 32 nt, Human
uacaggcgugagccaccaccacacccagcccu

SEQ ID NO: 486735 - RNA, 32 nt, Human
uacaggcgugagccaccacccccggccuguau

SEQ ID NO: 486736 - RNA, 20 nt, Human
uacaggcgugagccaccacg

SEQ ID NO: 486737 - RNA, 32 nt, Human
uacaggcgugagccaccacgccagggcuuuau

SEQ ID NO: 486738 - RNA, 32 nt, Human
uacaggcgugagccaccacgcccaacugggac

SEQ ID NO: 486739 - RNA, 32 nt, Human
uacaggcgugagccaccacgcccagccguaca

SEQ ID NO: 486740 - RNA, 32 nt, Human
uacaggcgugagccaccacgcccagccuauac

SEQ ID NO: 486741 - RNA, 32 nt, Human
uacaggcgugagccaccacgcccgaccugaug

SEQ ID NO: 486742 - RNA, 32 nt, Human
uacaggcgugagccaccacgcccggccacuag

SEQ ID NO: 486743 - RNA, 32 nt, Human
uacaggcgugagccaccacgcccggccagcaa

SEQ ID NO: 486744 - RNA, 32 nt, Human
uacaggcgugagccaccacgcccggccccaaa

SEQ ID NO: 486745 - RNA, 32 nt, Human
uacaggcgugagccaccacgcccggcccccag

SEQ ID NO: 486746 - RNA, 32 nt, Human
uacaggcgugagccaccacgcccggcccguau

SEQ ID NO: 486747 - RNA, 32 nt, Human
uacaggcgugagccaccacgcccggccucuuu

SEQ ID NO: 486748 - RNA, 32 nt, Human
uacaggcgugagccaccacgcccggccuggcc

SEQ ID NO: 486749 - RNA, 32 nt, Human
uacaggcgugagccaccacgcccggucaccuu

SEQ ID NO: 486750 - RNA, 32 nt, Human
uacaggcgugagccaccacgccuggccaauua

SEQ ID NO: 486751 - RNA, 32 nt, Human
uacaggcgugagccaccacgccuggccgaaaa

SEQ ID NO: 486752 - RNA, 32 nt, Human
uacaggcgugagccaccacgccuggccucacu

SEQ ID NO: 486753 - RNA, 32 nt, Human
uacaggcgugagccaccacgccuggcuggauc

SEQ ID NO: 486754 - RNA, 32 nt, Human
uacaggcgugagccaccacgcucagccuuuaa

SEQ ID NO: 486755 - RNA, 32 nt, Human
uacaggcgugagccaccacguccaacugccuu

SEQ ID NO: 486756 - RNA, 32 nt, Human
uacaggcgugagccaccacgucuggccuucuu

SEQ ID NO: 486757 - RNA, 32 nt, Human
uacaggcgugagccaccacucccggccgugaa

SEQ ID NO: 486758 - RNA, 32 nt, Human
uacaggcgugagccaccacucccggcuaaguu

SEQ ID NO: 486759 - RNA, 32 nt, Human
uacaggcgugagccaccacuccuggccuaugc

SEQ ID NO: 486760 - RNA, 32 nt, Human
uacaggcgugagccaccagccaggccaagcua

SEQ ID NO: 486761 - RNA, 32 nt, Human
uacaggcgugagccaccaggcccagccucgag

SEQ ID NO: 486762 - RNA, 32 nt, Human
uacaggcgugagccaccaggccuggcuccuuu

SEQ ID NO: 486763 - RNA, 19 nt, Human
uacaggcgugagccaccau

SEQ ID NO: 486764 - RNA, 32 nt, Human
uacaggcgugagccaccauacccggcccacuc

SEQ ID NO: 486765 - RNA, 32 nt, Human
uacaggcgugagccaccauaccuggcgcaugc

SEQ ID NO: 486766 - RNA, 20 nt, Human
uacaggcgugagccaccaug

SEQ ID NO: 486767 - RNA, 32 nt, Human
uacaggcgugagccaccaugaccagcccucca

SEQ ID NO: 486768 - RNA, 23 nt, Human
uacaggcgugagccaccaugccc

SEQ ID NO: 486769 - RNA, 32 nt, Human
uacaggcgugagccaccaugcccagaugcuuu

SEQ ID NO: 486770 - RNA, 32 nt, Human
uacaggcgugagccaccaugcccagccuaaua

SEQ ID NO: 486771 - RNA, 32 nt, Human
uacaggcgugagccaccaugcccagccuacuc

SEQ ID NO: 486772 - RNA, 32 nt, Human
uacaggcgugagccaccaugccccgccccaga

SEQ ID NO: 486773 - RNA, 32 nt, Human
uacaggcgugagccaccaugcccggccagcuu

SEQ ID NO: 486774 - RNA, 32 nt, Human
uacaggcgugagccaccaugcccggccauggu

SEQ ID NO: 486775 - RNA, 32 nt, Human
uacaggcgugagccaccaugcccggcccaaau

SEQ ID NO: 486776 - RNA, 32 nt, Human
uacaggcgugagccaccaugcccggccucuuu

SEQ ID NO: 486777 - RNA, 32 nt, Human
uacaggcgugagccaccaugcccggcuaauuu

SEQ ID NO: 486778 - RNA, 32 nt, Human
uacaggcgugagccaccaugccuagcaacaua

SEQ ID NO: 486779 - RNA, 32 nt, Human
uacaggcgugagccaccaugccugcccagcaa

SEQ ID NO: 486780 - RNA, 32 nt, Human
uacaggcgugagccaccaugccuggcaacaua

SEQ ID NO: 486781 - RNA, 32 nt, Human
uacaggcgugagccaccaugccuggccaaaac

SEQ ID NO: 486782 - RNA, 32 nt, Human
uacaggcgugagccaccaugccuggccacauc

SEQ ID NO: 486783 - RNA, 32 nt, Human
uacaggcgugagccaccaugccuggccagaaa

SEQ ID NO: 486784 - RNA, 32 nt, Human
uacaggcgugagccaccaugccuggccaucag

SEQ ID NO: 486785 - RNA, 32 nt, Human
uacaggcgugagccaccaugccuggccuucau

SEQ ID NO: 486786 - RNA, 32 nt, Human
uacaggcgugagccaccaugcucggccuaaaa

SEQ ID NO: 486787 - RNA, 32 nt, Human
uacaggcgugagccaccauguccagccaaagu

SEQ ID NO: 486788 - RNA, 32 nt, Human
uacaggcgugagccaccauguccggcuugugu

SEQ ID NO: 486789 - RNA, 32 nt, Human
uacaggcgugagccaccauucccgggcgcugu

SEQ ID NO: 486790 - RNA, 32 nt, Human
uacaggcgugagccacccggccuggccuagaa

SEQ ID NO: 486791 - RNA, 32 nt, Human
uacaggcgugagccacccugacuggccguuca

SEQ ID NO: 486792 - RNA, 32 nt, Human
uacaggcgugagccaccgagccuggccgguua

SEQ ID NO: 486793 - RNA, 19 nt, Human
uacaggcgugagccaccgc

SEQ ID NO: 486794 - RNA, 32 nt, Human
uacaggcgugagccaccgcacccagccagggg

SEQ ID NO: 486795 - RNA, 32 nt, Human
uacaggcgugagccaccgcacccagcccaucu

SEQ ID NO: 486796 - RNA, 32 nt, Human
uacaggcgugagccaccgcacccagcccguau

SEQ ID NO: 486797 - RNA, 32 nt, Human
uacaggcgugagccaccgcacccggcagaguu

SEQ ID NO: 486798 - RNA, 32 nt, Human
uacaggcgugagccaccgcacccggcccuugu

SEQ ID NO: 486799 - RNA, 32 nt, Human
uacaggcgugagccaccgcacccggccuauug

SEQ ID NO: 486800 - RNA, 32 nt, Human
uacaggcgugagccaccgcacccggccucugu

SEQ ID NO: 486801 - RNA, 32 nt, Human
uacaggcgugagccaccgcacccggcuugcaa

SEQ ID NO: 486802 - RNA, 32 nt, Human
uacaggcgugagccaccgcacccggucagcua

SEQ ID NO: 486803 - RNA, 32 nt, Human
uacaggcgugagccaccgcaccuggccauuau

SEQ ID NO: 486804 - RNA, 32 nt, Human
uacaggcgugagccaccgcaccuggcccccuu

SEQ ID NO: 486805 - RNA, 32 nt, Human
uacaggcgugagccaccgcaccuggccuaccu

SEQ ID NO: 486806 - RNA, 32 nt, Human
uacaggcgugagccaccgcacuggccuaauuu

SEQ ID NO: 486807 - RNA, 32 nt, Human
uacaggcgugagccaccgcaucuggccacaau

SEQ ID NO: 486808 - RNA, 32 nt, Human
uacaggcgugagccaccgcccccggccgccuc

SEQ ID NO: 486809 - RNA, 20 nt, Human
uacaggcgugagccaccgcg

SEQ ID NO: 486810 - RNA, 32 nt, Human
uacaggcgugagccaccgcgacuggccuacac

SEQ ID NO: 486811 - RNA, 32 nt, Human
uacaggcgugagccaccgcgccaagccaaggu

SEQ ID NO: 486812 - RNA, 32 nt, Human
uacaggcgugagccaccgcgccaggcugagau

SEQ ID NO: 486813 - RNA, 32 nt, Human
uacaggcgugagccaccgcgcccagccaaaaa

SEQ ID NO: 486814 - RNA, 32 nt, Human
uacaggcgugagccaccgcgcccagccaaacc

SEQ ID NO: 486815 - RNA, 32 nt, Human
uacaggcgugagccaccgcgcccagccagaac

SEQ ID NO: 486816 - RNA, 32 nt, Human
uacaggcgugagccaccgcgcccagccccaua

SEQ ID NO: 486817 - RNA, 32 nt, Human
uacaggcgugagccaccgcgcccagccccauu

SEQ ID NO: 486818 - RNA, 32 nt, Human
uacaggcgugagccaccgcgcccagcccugaa

SEQ ID NO: 486819 - RNA, 32 nt, Human
uacaggcgugagccaccgcgcccagccggaau

SEQ ID NO: 486820 - RNA, 32 nt, Human
uacaggcgugagccaccgcgcccagccuacau

SEQ ID NO: 486821 - RNA, 32 nt, Human
uacaggcgugagccaccgcgcccagccuauaa

SEQ ID NO: 486822 - RNA, 32 nt, Human
uacaggcgugagccaccgcgcccagccucaac

SEQ ID NO: 486823 - RNA, 32 nt, Human
uacaggcgugagccaccgcgcccagccuuaau

SEQ ID NO: 486824 - RNA, 32 nt, Human
uacaggcgugagccaccgcgcccagcugaaau

SEQ ID NO: 486825 - RNA, 32 nt, Human
uacaggcgugagccaccgcgcccaucuccccu

SEQ ID NO: 486826 - RNA, 32 nt, Human
uacaggcgugagccaccgcgccccaccuaacc

SEQ ID NO: 486827 - RNA, 32 nt, Human
uacaggcgugagccaccgcgcccgaucagcag

SEQ ID NO: 486828 - RNA, 32 nt, Human
uacaggcgugagccaccgcgcccggccaagca

SEQ ID NO: 486829 - RNA, 32 nt, Human
uacaggcgugagccaccgcgcccggccaauuu

SEQ ID NO: 486830 - RNA, 32 nt, Human
uacaggcgugagccaccgcgcccggccagguu

SEQ ID NO: 486831 - RNA, 32 nt, Human
uacaggcgugagccaccgcgcccggccaguau

SEQ ID NO: 486832 - RNA, 32 nt, Human
uacaggcgugagccaccgcgcccggccaguuc

SEQ ID NO: 486833 - RNA, 32 nt, Human
uacaggcgugagccaccgcgcccggccauagg

SEQ ID NO: 486834 - RNA, 32 nt, Human
uacaggcgugagccaccgcgcccggccaugau

SEQ ID NO: 486835 - RNA, 32 nt, Human
uacaggcgugagccaccgcgcccggcccacua

SEQ ID NO: 486836 - RNA, 32 nt, Human
uacaggcgugagccaccgcgcccggcccaggu

SEQ ID NO: 486837 - RNA, 32 nt, Human
uacaggcgugagccaccgcgcccggcccauac

SEQ ID NO: 486838 - RNA, 32 nt, Human
uacaggcgugagccaccgcgcccggcccucuu

SEQ ID NO: 486839 - RNA, 32 nt, Human
uacaggcgugagccaccgcgcccggccgaauc

SEQ ID NO: 486840 - RNA, 32 nt, Human
uacaggcgugagccaccgcgcccggccggcuu

SEQ ID NO: 486841 - RNA, 32 nt, Human
uacaggcgugagccaccgcgcccggccguagu

SEQ ID NO: 486842 - RNA, 32 nt, Human
uacaggcgugagccaccgcgcccggccuagag

SEQ ID NO: 486843 - RNA, 32 nt, Human
uacaggcgugagccaccgcgcccggccuaggu

SEQ ID NO: 486844 - RNA, 32 nt, Human
uacaggcgugagccaccgcgcccggccucagc

SEQ ID NO: 486845 - RNA, 32 nt, Human
uacaggcgugagccaccgcgcccggccucagu

SEQ ID NO: 486846 - RNA, 32 nt, Human
uacaggcgugagccaccgcgcccggccuccau

SEQ ID NO: 486847 - RNA, 32 nt, Human
uacaggcgugagccaccgcgcccggccugaag

SEQ ID NO: 486848 - RNA, 32 nt, Human
uacaggcgugagccaccgcgcccggccugagg

SEQ ID NO: 486849 - RNA, 32 nt, Human
uacaggcgugagccaccgcgcccggccugagu

SEQ ID NO: 486850 - RNA, 32 nt, Human
uacaggcgugagccaccgcgcccggccuguau

SEQ ID NO: 486851 - RNA, 32 nt, Human
uacaggcgugagccaccgcgcccggccuguuc

SEQ ID NO: 486852 - RNA, 32 nt, Human
uacaggcgugagccaccgcgcccggccuguuu

SEQ ID NO: 486853 - RNA, 32 nt, Human
uacaggcgugagccaccgcgcccggcggcgaa

SEQ ID NO: 486854 - RNA, 32 nt, Human
uacaggcgugagccaccgcgcccggcugccuu

SEQ ID NO: 486855 - RNA, 32 nt, Human
uacaggcgugagccaccgcgcccugccuagaa

SEQ ID NO: 486856 - RNA, 32 nt, Human
uacaggcgugagccaccgcgccgggcaccuuc

SEQ ID NO: 486857 - RNA, 32 nt, Human
uacaggcgugagccaccgcgccugacugggac

SEQ ID NO: 486858 - RNA, 32 nt, Human
uacaggcgugagccaccgcgccuggccaaaac

SEQ ID NO: 486859 - RNA, 32 nt, Human
uacaggcgugagccaccgcgccuggccaaaau

SEQ ID NO: 486860 - RNA, 32 nt, Human
uacaggcgugagccaccgcgccuggccaagau

SEQ ID NO: 486861 - RNA, 32 nt, Human
uacaggcgugagccaccgcgccuggccacauc

SEQ ID NO: 486862 - RNA, 32 nt, Human
uacaggcgugagccaccgcgccuggccaggcu

SEQ ID NO: 486863 - RNA, 32 nt, Human
uacaggcgugagccaccgcgccuggccaggga

SEQ ID NO: 486864 - RNA, 32 nt, Human
uacaggcgugagccaccgcgccuggccgaugg

SEQ ID NO: 486865 - RNA, 32 nt, Human
uacaggcgugagccaccgcgccuggccgaugu

SEQ ID NO: 486866 - RNA, 32 nt, Human
uacaggcgugagccaccgcgccuggccuaaaa

SEQ ID NO: 486867 - RNA, 32 nt, Human
uacaggcgugagccaccgcgccuggccucagc

SEQ ID NO: 486868 - RNA, 32 nt, Human
uacaggcgugagccaccgcgccuggccuucag

SEQ ID NO: 486869 - RNA, 32 nt, Human
uacaggcgugagccaccgcgccuggucuauau

SEQ ID NO: 486870 - RNA, 32 nt, Human
uacaggcgugagccaccgcggcccaacagcgg

SEQ ID NO: 486871 - RNA, 32 nt, Human
uacaggcgugagccaccgcguccagccacauu

SEQ ID NO: 486872 - RNA, 32 nt, Human
uacaggcgugagccaccgcguccggccucuuu

SEQ ID NO: 486873 - RNA, 32 nt, Human
uacaggcgugagccaccgcguccggcucagga

SEQ ID NO: 486874 - RNA, 32 nt, Human
uacaggcgugagccaccgcgucuggccucagc

SEQ ID NO: 486875 - RNA, 32 nt, Human
uacaggcgugagccaccgcuccuggccuauuc

SEQ ID NO: 486876 - RNA, 32 nt, Human
uacaggcgugagccaccgcuccuggccugaca

SEQ ID NO: 486877 - RNA, 32 nt, Human
uacaggcgugagccaccguacccagccugguc

SEQ ID NO: 486878 - RNA, 32 nt, Human
uacaggcgugagccaccgugcccaaccaugaa

SEQ ID NO: 486879 - RNA, 32 nt, Human
uacaggcgugagccaccgugcccagccuccuu

SEQ ID NO: 486880 - RNA, 32 nt, Human
uacaggcgugagccaccgugcccagccuucug

SEQ ID NO: 486881 - RNA, 32 nt, Human
uacaggcgugagccaccgugcccagccuuucu

SEQ ID NO: 486882 - RNA, 32 nt, Human
uacaggcgugagccaccgugcccauccaacuu

SEQ ID NO: 486883 - RNA, 32 nt, Human
uacaggcgugagccaccgugcccggcccaaac

SEQ ID NO: 486884 - RNA, 32 nt, Human
uacaggcgugagccaccgugcccggcccaaag

SEQ ID NO: 486885 - RNA, 32 nt, Human
uacaggcgugagccaccgugcccggcccaacu

SEQ ID NO: 486886 - RNA, 32 nt, Human
uacaggcgugagccaccgugcccggcccagga

SEQ ID NO: 486887 - RNA, 32 nt, Human
uacaggcgugagccaccgugcccggcccuaaa

SEQ ID NO: 486888 - RNA, 32 nt, Human
uacaggcgugagccaccgugcccggcccuuuu

SEQ ID NO: 486889 - RNA, 32 nt, Human
uacaggcgugagccaccgugcccggccuaaau

SEQ ID NO: 486890 - RNA, 32 nt, Human
uacaggcgugagccaccgugcccggccuacaa

SEQ ID NO: 486891 - RNA, 32 nt, Human
uacaggcgugagccaccgugcccggccucucc

SEQ ID NO: 486892 - RNA, 32 nt, Human
uacaggcgugagccaccgugcccggccugaug

SEQ ID NO: 486893 - RNA, 32 nt, Human
uacaggcgugagccaccgugcccggccugauu

SEQ ID NO: 486894 - RNA, 32 nt, Human
uacaggcgugagccaccgugcccggccugugc

SEQ ID NO: 486895 - RNA, 32 nt, Human
uacaggcgugagccaccgugccugccccagaa

SEQ ID NO: 486896 - RNA, 32 nt, Human
uacaggcgugagccaccgugccuggccaagag

SEQ ID NO: 486897 - RNA, 32 nt, Human
uacaggcgugagccaccgugccuggccacgcc

SEQ ID NO: 486898 - RNA, 32 nt, Human
uacaggcgugagccaccgugccuggccagaaa

SEQ ID NO: 486899 - RNA, 32 nt, Human
uacaggcgugagccaccgugccuggccaggcc

SEQ ID NO: 486900 - RNA, 32 nt, Human
uacaggcgugagccaccgugccuggcccuggu

SEQ ID NO: 486901 - RNA, 32 nt, Human
uacaggcgugagccaccgugccuggccgaugu

SEQ ID NO: 486902 - RNA, 32 nt, Human
uacaggcgugagccaccgugccuggccgugau

SEQ ID NO: 486903 - RNA, 32 nt, Human
uacaggcgugagccaccgugccuggccuaaau

SEQ ID NO: 486904 - RNA, 32 nt, Human
uacaggcgugagccaccgugccuggcugagaa

SEQ ID NO: 486905 - RNA, 32 nt, Human
uacaggcgugagccaccgugccuggcuguagu

SEQ ID NO: 486906 - RNA, 32 nt, Human
uacaggcgugagccaccgugcucagccuaaau

SEQ ID NO: 486907 - RNA, 32 nt, Human
uacaggcgugagccaccgugcugggccaaaaa

SEQ ID NO: 486908 - RNA, 32 nt, Human
uacaggcgugagccaccguguccggccguagu

SEQ ID NO: 486909 - RNA, 32 nt, Human
uacaggcgugagccaccucaccaggccccguu

SEQ ID NO: 486910 - RNA, 32 nt, Human
uacaggcgugagccaccucacccagccggcua

SEQ ID NO: 486911 - RNA, 32 nt, Human
uacaggcgugagccaccucaccuggccuuuuc

SEQ ID NO: 486912 - RNA, 20 nt, Human
uacaggcgugagccaccucg

SEQ ID NO: 486913 - RNA, 32 nt, Human
uacaggcgugagccaccucgcccagcggcauc

SEQ ID NO: 486914 - RNA, 32 nt, Human
uacaggcgugagccaccucgcccggccaaucc

SEQ ID NO: 486915 - RNA, 32 nt, Human
uacaggcgugagccaccuugcccagcccacau

SEQ ID NO: 486916 - RNA, 32 nt, Human
uacaggcgugagccaccuugccuagcccacau

SEQ ID NO: 486917 - RNA, 32 nt, Human
uacaggcgugagccacggcaccaggcccucuu

SEQ ID NO: 486918 - RNA, 32 nt, Human
uacaggcgugagccacggcacgcagccagcaa

SEQ ID NO: 486919 - RNA, 32 nt, Human
uacaggcgugagccacggcgcccagccugugc

SEQ ID NO: 486920 - RNA, 18 nt, Human
uacaggcgugagccacua

SEQ ID NO: 486921 - RNA, 19 nt, Human
uacaggcgugagccacuac

SEQ ID NO: 486922 - RNA, 32 nt, Human
uacaggcgugagccacuacacccagccaauca

SEQ ID NO: 486923 - RNA, 32 nt, Human
uacaggcgugagccacuaggccugaccucccc

SEQ ID NO: 486924 - RNA, 32 nt, Human
uacaggcgugagccacuccacccagcccagau

SEQ ID NO: 486925 - RNA, 32 nt, Human
uacaggcgugagccacucugcccggccugugc

SEQ ID NO: 486926 - RNA, 32 nt, Human
uacaggcgugagccacugagccagccagcauu

SEQ ID NO: 486927 - RNA, 32 nt, Human
uacaggcgugagccacugagcccagccuacuu

SEQ ID NO: 486928 - RNA, 32 nt, Human
uacaggcgugagccacugagcccggccaaaaa

SEQ ID NO: 486929 - RNA, 32 nt, Human
uacaggcgugagccacugcacccacccacgcc

SEQ ID NO: 486930 - RNA, 32 nt, Human
uacaggcgugagccacugcacccagccaaaaa

SEQ ID NO: 486931 - RNA, 32 nt, Human
uacaggcgugagccacugcacccagcccucuu

SEQ ID NO: 486932 - RNA, 32 nt, Human
uacaggcgugagccacugcacccagccgagug

SEQ ID NO: 486933 - RNA, 32 nt, Human
uacaggcgugagccacugcacccagccuagaa

SEQ ID NO: 486934 - RNA, 32 nt, Human
uacaggcgugagccacugcacccagccuauuc

SEQ ID NO: 486935 - RNA, 32 nt, Human
uacaggcgugagccacugcacccagccucaug

SEQ ID NO: 486936 - RNA, 32 nt, Human
uacaggcgugagccacugcacccagccuggga

SEQ ID NO: 486937 - RNA, 32 nt, Human
uacaggcgugagccacugcacccggccgugac

SEQ ID NO: 486938 - RNA, 32 nt, Human
uacaggcgugagccacugcacccggccuaauu

SEQ ID NO: 486939 - RNA, 32 nt, Human
uacaggcgugagccacugcacccggcucacca

SEQ ID NO: 486940 - RNA, 32 nt, Human
uacaggcgugagccacugcaccuggcccucga

SEQ ID NO: 486941 - RNA, 32 nt, Human
uacaggcgugagccacugcaccuggccucugu

SEQ ID NO: 486942 - RNA, 32 nt, Human
uacaggcgugagccacugcaccuggccugaca

SEQ ID NO: 486943 - RNA, 32 nt, Human
uacaggcgugagccacugcaccuggccuuaua

SEQ ID NO: 486944 - RNA, 32 nt, Human
uacaggcgugagccacugcagugggccaauuu

SEQ ID NO: 486945 - RNA, 32 nt, Human
uacaggcgugagccacugcaucuggccuuuuu

SEQ ID NO: 486946 - RNA, 32 nt, Human
uacaggcgugagccacugcccagcuauacugu

SEQ ID NO: 486947 - RNA, 32 nt, Human
uacaggcgugagccacugcccccagccccagc

SEQ ID NO: 486948 - RNA, 32 nt, Human
uacaggcgugagccacugcgcccagccaacac

SEQ ID NO: 486949 - RNA, 32 nt, Human
uacaggcgugagccacugcgcccagccugaau

SEQ ID NO: 486950 - RNA, 32 nt, Human
uacaggcgugagccacugcgcccagccuguuc

SEQ ID NO: 486951 - RNA, 32 nt, Human
uacaggcgugagccacugcgcccagccuugua

SEQ ID NO: 486952 - RNA, 32 nt, Human
uacaggcgugagccacugcgcccagcuaccug

SEQ ID NO: 486953 - RNA, 32 nt, Human
uacaggcgugagccacugcgcccggccaauaa

SEQ ID NO: 486954 - RNA, 32 nt, Human
uacaggcgugagccacugcgcccggccaauuu

SEQ ID NO: 486955 - RNA, 32 nt, Human
uacaggcgugagccacugcgcccggccacauu

SEQ ID NO: 486956 - RNA, 32 nt, Human
uacaggcgugagccacugcgcccggcccuaau

SEQ ID NO: 486957 - RNA, 32 nt, Human
uacaggcgugagccacugcgcccggccuaauu

SEQ ID NO: 486958 - RNA, 32 nt, Human
uacaggcgugagccacugcgcccggccuauuu

SEQ ID NO: 486959 - RNA, 32 nt, Human
uacaggcgugagccacugcgcccggccucccc

SEQ ID NO: 486960 - RNA, 32 nt, Human
uacaggcgugagccacugcgcccggccuguug

SEQ ID NO: 486961 - RNA, 32 nt, Human
uacaggcgugagccacugcgcccggccuugaa

SEQ ID NO: 486962 - RNA, 32 nt, Human
uacaggcgugagccacugcgcccgggcaagac

SEQ ID NO: 486963 - RNA, 32 nt, Human
uacaggcgugagccacugcgcccugccuguuu

SEQ ID NO: 486964 - RNA, 32 nt, Human
uacaggcgugagccacugcgccuggccaagaa

SEQ ID NO: 486965 - RNA, 32 nt, Human
uacaggcgugagccacugcgccuggccagacc

SEQ ID NO: 486966 - RNA, 32 nt, Human
uacaggcgugagccacugcgccuggccaucag

SEQ ID NO: 486967 - RNA, 32 nt, Human
uacaggcgugagccacugcgccuggccgugac

SEQ ID NO: 486968 - RNA, 32 nt, Human
uacaggcgugagccacugcgccuggccuaguu

SEQ ID NO: 486969 - RNA, 32 nt, Human
uacaggcgugagccacugcgccuggccuuuuu

SEQ ID NO: 486970 - RNA, 32 nt, Human
uacaggcgugagccacugcguccagccagaau

SEQ ID NO: 486971 - RNA, 32 nt, Human
uacaggcgugagccacugcucccagccucuuu

SEQ ID NO: 486972 - RNA, 32 nt, Human
uacaggcgugagccacugcuccuggcccaaga

SEQ ID NO: 486973 - RNA, 32 nt, Human
uacaggcgugagccacugcucguggccaaaag

SEQ ID NO: 486974 - RNA, 32 nt, Human
uacaggcgugagccacuggcccggcggcacaa

SEQ ID NO: 486975 - RNA, 32 nt, Human
uacaggcgugagccacuggcggccucaacuca

SEQ ID NO: 486976 - RNA, 32 nt, Human
uacaggcgugagccacugggcccagccuaauu

SEQ ID NO: 486977 - RNA, 32 nt, Human
uacaggcgugagccacugugcacguugggacu

SEQ ID NO: 486978 - RNA, 32 nt, Human
uacaggcgugagccacugugcauggccccagc

SEQ ID NO: 486979 - RNA, 32 nt, Human
uacaggcgugagccacugugcccagccaaaag

SEQ ID NO: 486980 - RNA, 32 nt, Human
uacaggcgugagccacugugcccagccaccaa

SEQ ID NO: 486981 - RNA, 32 nt, Human
uacaggcgugagccacugugcccagccgauga

SEQ ID NO: 486982 - RNA, 32 nt, Human
uacaggcgugagccacugugcccagccggaac

SEQ ID NO: 486983 - RNA, 32 nt, Human
uacaggcgugagccacugugcccagccuaagc

SEQ ID NO: 486984 - RNA, 32 nt, Human
uacaggcgugagccacugugcccagcugagau

SEQ ID NO: 486985 - RNA, 32 nt, Human
uacaggcgugagccacugugcccggccaagaa

SEQ ID NO: 486986 - RNA, 32 nt, Human
uacaggcgugagccacugugcccggccucagu

SEQ ID NO: 486987 - RNA, 32 nt, Human
uacaggcgugagccacugugcccggccuuggc

SEQ ID NO: 486988 - RNA, 32 nt, Human
uacaggcgugagccacugugcccggcuguuca

SEQ ID NO: 486989 - RNA, 32 nt, Human
uacaggcgugagccacugugccuagccauucc

SEQ ID NO: 486990 - RNA, 32 nt, Human
uacaggcgugagccacugugccucgccuaauu

SEQ ID NO: 486991 - RNA, 32 nt, Human
uacaggcgugagccacugugccugacccacuc

SEQ ID NO: 486992 - RNA, 32 nt, Human
uacaggcgugagccacugugccugaccuguca

SEQ ID NO: 486993 - RNA, 32 nt, Human
uacaggcgugagccacugugccugccccaauc

SEQ ID NO: 486994 - RNA, 32 nt, Human
uacaggcgugagccacugugccuggccgacaa

SEQ ID NO: 486995 - RNA, 32 nt, Human
uacaggcgugagccacugugccuggccuaucu

SEQ ID NO: 486996 - RNA, 32 nt, Human
uacaggcgugagccacugugccuggccuguag

SEQ ID NO: 486997 - RNA, 32 nt, Human
uacaggcgugagccacugugccuggccuuaug

SEQ ID NO: 486998 - RNA, 32 nt, Human
uacaggcgugagccacugugccuggcugaguu

SEQ ID NO: 486999 - RNA, 32 nt, Human
uacaggcgugagccacugugccuggcugguua

SEQ ID NO: 487000 - RNA, 32 nt, Human
uacaggcgugagccacugugccuggcuuccau

SEQ ID NO: 487001 - RNA, 32 nt, Human
uacaggcgugagccacuguggccaaccuaauu

SEQ ID NO: 487002 - RNA, 32 nt, Human
uacaggcgugagccacuuacccggccucugcc

SEQ ID NO: 487003 - RNA, 20 nt, Human
uacaggcgugagccagcacg

SEQ ID NO: 487004 - RNA, 32 nt, Human
uacaggcgugagccagcacgcccagcuaauuu

SEQ ID NO: 487005 - RNA, 32 nt, Human
uacaggcgugagccagcgcgugccuggccaaa

SEQ ID NO: 487006 - RNA, 32 nt, Human
uacaggcgugagccagugugcccggccuccgu

SEQ ID NO: 487007 - RNA, 32 nt, Human
uacaggcgugagccauggcgcccagccugggc

SEQ ID NO: 487008 - RNA, 32 nt, Human
uacaggcgugagccauggcgcccagccuucca

SEQ ID NO: 487009 - RNA, 32 nt, Human
uacaggcgugagccauggugccagacuggagu

SEQ ID NO: 487010 - RNA, 32 nt, Human
uacaggcgugagccauggugcccagccuggcu

SEQ ID NO: 487011 - RNA, 32 nt, Human
uacaggcgugagccauugcgccugggcaggua

SEQ ID NO: 487012 - RNA, 20 nt, Human
uacaggcgugagcccccacg

SEQ ID NO: 487013 - RNA, 32 nt, Human
uacaggcgugagcccccacgcuggccugcuuu

SEQ ID NO: 487014 - RNA, 18 nt, Human
uacaggcgugagcccccg

SEQ ID NO: 487015 - RNA, 32 nt, Human
uacaggcgugagcccccgcgccgggcuaagaa

SEQ ID NO: 487016 - RNA, 32 nt, Human
uacaggcgugagccgccgugcccggcccccuu

SEQ ID NO: 487017 - RNA, 32 nt, Human
uacaggcgugagccgccgugccuggcguuaca

SEQ ID NO: 487018 - RNA, 32 nt, Human
uacaggcgugagccgcugcacccagcccagaa

SEQ ID NO: 487019 - RNA, 32 nt, Human
uacaggcgugagccuccgcgcccggcccccuu

SEQ ID NO: 487020 - RNA, 32 nt, Human
uacaggcgugagccugcgccuggcuguaauua

SEQ ID NO: 487021 - RNA, 32 nt, Human
uacaggcgugagccuuggugcuggcccagugu

SEQ ID NO: 487022 - RNA, 19 nt, Human
uacaggcgugagcuaccac

SEQ ID NO: 487023 - RNA, 32 nt, Human
uacaggcgugagcuaccaccaugccuggcuuc

SEQ ID NO: 487024 - RNA, 32 nt, Human
uacaggcgugagcuaccacgcccggccuuauu

SEQ ID NO: 487025 - RNA, 20 nt, Human
uacaggcgugagcuaccaug

SEQ ID NO: 487026 - RNA, 32 nt, Human
uacaggcgugagcuaccaugcccggcuaauuu

SEQ ID NO: 487027 - RNA, 19 nt, Human
uacaggcgugagcuaccgc

SEQ ID NO: 487028 - RNA, 32 nt, Human
uacaggcgugagcuaccgcacuggaccuagcc

SEQ ID NO: 487029 - RNA, 32 nt, Human
uacaggcgugagcuaccgcgcccagccugaaa

SEQ ID NO: 487030 - RNA, 32 nt, Human
uacaggcgugagcuacugugcccagccuuacg

SEQ ID NO: 487031 - RNA, 19 nt, Human
uacaggcgugagcuaucac

SEQ ID NO: 487032 - RNA, 32 nt, Human
uacaggcgugagcuaucacacccagccucccc

SEQ ID NO: 487033 - RNA, 32 nt, Human
uacaggcgugagcugccaugccaggcagauuu

SEQ ID NO: 487034 - RNA, 19 nt, Human
uacaggcgugagcugcuac

SEQ ID NO: 487035 - RNA, 32 nt, Human
uacaggcgugagcugcuacaccuagccugcau

SEQ ID NO: 487036 - RNA, 32 nt, Human
uacaggcgugagcugugccuggcccaccccag

SEQ ID NO: 487037 - RNA, 20 nt, Human
uacaggcgugaggcaccgcg

SEQ ID NO: 487038 - RNA, 19 nt, Human
uacaggcgugaggcaucac

SEQ ID NO: 487039 - RNA, 19 nt, Human
uacaggcgugagucaccac

SEQ ID NO: 487040 - RNA, 20 nt, Human
uacaggcgugagucaccgcg

SEQ ID NO: 487041 - RNA, 32 nt, Human
uacaggcgugagucaccgcgcccagccgggaa

SEQ ID NO: 487042 - RNA, 32 nt, Human
uacaggcgugagucaccgugcccagccaugua

SEQ ID NO: 487043 - RNA, 32 nt, Human
uacaggcgugagucaccgugcccagccuggau

SEQ ID NO: 487044 - RNA, 32 nt, Human
uacaggcgugagucacugugcccagccaaggu

SEQ ID NO: 487045 - RNA, 32 nt, Human
uacaggcgugagugaccaugccuagcucacuu

SEQ ID NO: 487046 - RNA, 19 nt, Human
uacaggcgugauccaccac

SEQ ID NO: 487047 - RNA, 17 nt, Human
uacaggcgugaugcccg

SEQ ID NO: 487048 - RNA, 20 nt, Human
uacaggcgugcaccaccacg

SEQ ID NO: 487049 - RNA, 23 nt, Human
uacaggcgugcaccaccacgccc

SEQ ID NO: 487050 - RNA, 20 nt, Human
uacaggcgugcaccaccaug

SEQ ID NO: 487051 - RNA, 32 nt, Human
uacaggcgugcaccaccaugcccguuaguuuu

SEQ ID NO: 487052 - RNA, 32 nt, Human
uacaggcgugcaccaccaugccuggcuaaguu

SEQ ID NO: 487053 - RNA, 20 nt, Human
uacaggcgugcaccacugug

SEQ ID NO: 487054 - RNA, 20 nt, Human
uacaggcgugcaccagcuca

SEQ ID NO: 487055 - RNA, 32 nt, Human
uacaggcgugcaccagcucaaacaugcaggcu

SEQ ID NO: 487056 - RNA, 19 nt, Human
uacaggcgugcaccaucac

SEQ ID NO: 487057 - RNA, 19 nt, Human
uacaggcgugcacuaccac

SEQ ID NO: 487058 - RNA, 20 nt, Human
uacaggcgugcaucaccaug

SEQ ID NO: 487059 - RNA, 20 nt, Human
uacaggcgugcgaggggcac

SEQ ID NO: 487060 - RNA, 18 nt, Human
uacaggcgugcgccaaca

SEQ ID NO: 487061 - RNA, 20 nt, Human
uacaggcgugcgccaccacg

SEQ ID NO: 487062 - RNA, 20 nt, Human
uacaggcgugcgccaccaug

SEQ ID NO: 487063 - RNA, 23 nt, Human
uacaggcgugcgccaccaugccc

SEQ ID NO: 487064 - RNA, 32 nt, Human
uacaggcgugcgccaccaugcccggcuaauuu

SEQ ID NO: 487065 - RNA, 32 nt, Human
uacaggcgugcgccaccaugcccggcuacuuc

SEQ ID NO: 487066 - RNA, 32 nt, Human
uacaggcgugcgccaccaugccuggcuaauuu

SEQ ID NO: 487067 - RNA, 32 nt, Human
uacaggcgugcgccaccauguccagcuaauuu

SEQ ID NO: 487068 - RNA, 18 nt, Human
uacaggcgugcgccacua

SEQ ID NO: 487069 - RNA, 18 nt, Human
uacaggcgugcgugacca

SEQ ID NO: 487070 - RNA, 19 nt, Human
uacaggcguggcccaucac

SEQ ID NO: 487071 - RNA, 18 nt, Human
uacaggcgugggccccca

SEQ ID NO: 487072 - RNA, 20 nt, Human
uacaggcguggguacaccac

SEQ ID NO: 487073 - RNA, 22 nt, Human
uacaggcgugugagccaccacg

SEQ ID NO: 487074 - RNA, 32 nt, Human
uacaggcgugugagccaccacgcccggccaug

SEQ ID NO: 487075 - RNA, 18 nt, Human
uacaggcgugugccacca

SEQ ID NO: 487076 - RNA, 19 nt, Human
uacaggcgugugccaccac

SEQ ID NO: 487077 - RNA, 20 nt, Human
uacaggcgugugccaccacg

SEQ ID NO: 487078 - RNA, 23 nt, Human
uacaggcgugugccaccacgccc

SEQ ID NO: 487079 - RNA, 20 nt, Human
uacaggcgugugccaccaug

SEQ ID NO: 487080 - RNA, 32 nt, Human
uacaggcgugugccaccaugcccaaccuauuu

SEQ ID NO: 487081 - RNA, 32 nt, Human
uacaggcgugugccaccaugcccagcuaauuu

SEQ ID NO: 487082 - RNA, 32 nt, Human
uacaggcgugugccaccaugccuggcuaauuu

SEQ ID NO: 487083 - RNA, 32 nt, Human
uacaggcgugugccaccaugucugacuaaugu

SEQ ID NO: 487084 - RNA, 20 nt, Human
uacaggcgugugccaccgcg

SEQ ID NO: 487085 - RNA, 32 nt, Human
uacaggcgugugccacugcgcccagccauuau

SEQ ID NO: 487086 - RNA, 18 nt, Human
uacaggcgugugccauca

SEQ ID NO: 487087 - RNA, 20 nt, Human
uacaggcgugugucaccacg

SEQ ID NO: 487088 - RNA, 18 nt, Human
uacaggcguguuagcaug

SEQ ID NO: 487089 - RNA, 31 nt, Human
uacaggcucaauaacuauuuacugaauguga

SEQ ID NO: 487090 - RNA, 18 nt, Human
uacaggcucacaccacca

SEQ ID NO: 487091 - RNA, 20 nt, Human
uacaggcucaugccaccaug

SEQ ID NO: 487092 - RNA, 32 nt, Human
uacaggcucaugccaccaugcccagcuaauuu

SEQ ID NO: 487093 - RNA, 32 nt, Human
uacaggcucaugccaucaugcccagcuaauau

SEQ ID NO: 487094 - RNA, 20 nt, Human
uacaggcuccugccaccacg

SEQ ID NO: 487095 - RNA, 20 nt, Human
uacaggcuccugccaccgcg

SEQ ID NO: 487096 - RNA, 19 nt, Human
uacaggcugagccaccgcg

SEQ ID NO: 487097 - RNA, 32 nt, Human
uacaggcugcagcuccuucccacaguuccagu

SEQ ID NO: 487098 - RNA, 32 nt, Human
uacaggcuggaaacagcuccuuguacaacacg

SEQ ID NO: 487099 - RNA, 32 nt, Human
uacaggcuggagcuacagagcccagccuguca

SEQ ID NO: 487100 - RNA, 32 nt, Human
uacaggcugugaaguaucugaccuguguuauc

SEQ ID NO: 487101 - RNA, 20 nt, Human
uacaggcuuaagccaccacg

SEQ ID NO: 487102 - RNA, 32 nt, Human
uacaggcuucagccaccacacccagccucauu

SEQ ID NO: 487103 - RNA, 32 nt, Human
uacaggcuuccaggcaccucaucagucaugcu

SEQ ID NO: 487104 - RNA, 32 nt, Human
uacaggcuugacccacugcgcccagccugcau

SEQ ID NO: 487105 - RNA, 19 nt, Human
uacaggcuugagccaccac

SEQ ID NO: 487106 - RNA, 32 nt, Human
uacaggcuugagccaccacaccugaccuauuc

SEQ ID NO: 487107 - RNA, 32 nt, Human
uacaggcuugagccaccacgcccagacuugug

SEQ ID NO: 487108 - RNA, 32 nt, Human
uacaggcuugagccaccacgcccagccuguag

SEQ ID NO: 487109 - RNA, 32 nt, Human
uacaggcuugagccaccacgcccaguccaaca

SEQ ID NO: 487110 - RNA, 19 nt, Human
uacaggcuugagccaccgc

SEQ ID NO: 487111 - RNA, 32 nt, Human
uacaggcuugagccaccgcacccggccgagaa

SEQ ID NO: 487112 - RNA, 32 nt, Human
uacaggcuugagccaccgcaccuggccuuccc

SEQ ID NO: 487113 - RNA, 20 nt, Human
uacaggcuugagccaccgcg

SEQ ID NO: 487114 - RNA, 32 nt, Human
uacaggcuugagccaccgcgcccggcuauauu

SEQ ID NO: 487115 - RNA, 32 nt, Human
uacaggcuugagccaccgggugaccggcuuac

SEQ ID NO: 487116 - RNA, 32 nt, Human
uacaggcuugagccaccgugccaggccuguuu

SEQ ID NO: 487117 - RNA, 32 nt, Human
uacaggcuugagccaccgugccuggccucaaa

SEQ ID NO: 487118 - RNA, 32 nt, Human
uacaggcuugagccaccgugccuggccucaag

SEQ ID NO: 487119 - RNA, 32 nt, Human
uacaggcuugagccaccgugccuggucuguuu

SEQ ID NO: 487120 - RNA, 32 nt, Human
uacaggcuugagccacgcguccggccugaagu

SEQ ID NO: 487121 - RNA, 32 nt, Human
uacaggcuugagccacugcaccuagccucuau

SEQ ID NO: 487122 - RNA, 32 nt, Human
uacaggcuugagccacugcgcccggccuagaa

SEQ ID NO: 487123 - RNA, 32 nt, Human
uacaggcuugagccacugcgccuggccugguc

SEQ ID NO: 487124 - RNA, 32 nt, Human
uacaggcuugagccacugcucccggcugauuu

SEQ ID NO: 487125 - RNA, 32 nt, Human
uacaggcuugagccacugcuccuggccaacau

SEQ ID NO: 487126 - RNA, 32 nt, Human
uacaggcuugagccacugugccuggcuucagg

SEQ ID NO: 487127 - RNA, 32 nt, Human
uacaggcuugagcccccgcgcccagccaucaa

SEQ ID NO: 487128 - RNA, 32 nt, Human
uacaggcuugauugguguaaaucuuuuuauaa

SEQ ID NO: 487129 - RNA, 19 nt, Human
uacaggcuugcaccaccac

SEQ ID NO: 487130 - RNA, 19 nt, Human
uacaggcuugcacuaccac

SEQ ID NO: 487131 - RNA, 20 nt, Human
uacaggcuugcacuaccaca

SEQ ID NO: 487132 - RNA, 19 nt, Human
uacaggcuugcgccaccac

SEQ ID NO: 487133 - RNA, 32 nt, Human
uacaggcuuggagcuugcaggucccuuucuac

SEQ ID NO: 487134 - RNA, 20 nt, Human
uacaggcuugggccaccgcg

SEQ ID NO: 487135 - RNA, 32 nt, Human
uacaggcuugggccaccgcgcccagccaaugu

SEQ ID NO: 487136 - RNA, 19 nt, Human
uacaggcuugugccaccac

SEQ ID NO: 487137 - RNA, 19 nt, Human
uacaggcuuugucacuacg

SEQ ID NO: 487138 - RNA, 32 nt, Human
uacagggaaugauuggucauggggaagucucu

SEQ ID NO: 487139 - RNA, 20 nt, Human
uacagggacccgccaccacg

SEQ ID NO: 487140 - RNA, 32 nt, Human
uacagggagcaguuuuggguggcgugggcucc

SEQ ID NO: 487141 - RNA, 32 nt, Human
uacagggaggaacaaggagaaaccagccaggc

SEQ ID NO: 487142 - RNA, 32 nt, Human
uacagggaggggccaugugcgaaccagggaga

SEQ ID NO: 487143 - RNA, 32 nt, Human
uacagggaugagccaccaugccuggcugggua

SEQ ID NO: 487144 - RNA, 32 nt, Human
uacagggaugagccaccgcgcccagccucauc

SEQ ID NO: 487145 - RNA, 19 nt, Human
uacagggauguaccaccac

SEQ ID NO: 487146 - RNA, 32 nt, Human
uacagggauguagcaccaugccuggcuaauuu

SEQ ID NO: 487147 - RNA, 32 nt, Human
uacagggcaggcagaggaggcaccuguagggg

SEQ ID NO: 487148 - RNA, 32 nt, Human
uacagggcagggauaaauacagugcaugucug

SEQ ID NO: 487149 - RNA, 32 nt, Human
uacagggccaaagacuugagacgugguguuuu

SEQ ID NO: 487150 - RNA, 20 nt, Human
uacagggccaccaccaccac

SEQ ID NO: 487151 - RNA, 21 nt, Human
uacagggccccgccccagcca

SEQ ID NO: 487152 - RNA, 32 nt, Human
uacagggccguuuuauucugcaaaccgaaacu

SEQ ID NO: 487153 - RNA, 32 nt, Human
uacagggcugcacagcccugaggggucagugc

SEQ ID NO: 487154 - RNA, 32 nt, Human
uacaggggagccacugcacuggccuucauugu

SEQ ID NO: 487155 - RNA, 32 nt, Human
uacaggggaggcugaggcaggagaaucgcuug

SEQ ID NO: 487156 - RNA, 32 nt, Human
uacaggggagggagagccugaggcucugcuca

SEQ ID NO: 487157 - RNA, 32 nt, Human
uacaggggcauauaccuguaauccuagcuauu

SEQ ID NO: 487158 - RNA, 19 nt, Human
uacaggggcccgccaccac

SEQ ID NO: 487159 - RNA, 20 nt, Human
uacaggggcccgccaccacg

SEQ ID NO: 487160 - RNA, 32 nt, Human
uacagggggaagggccugagaggaauguaagg

SEQ ID NO: 487161 - RNA, 32 nt, Human
uacagggggccgggacagggagguugggaggg

SEQ ID NO: 487162 - RNA, 23 nt, Human
uacagggguaugccaccaugccc

SEQ ID NO: 487163 - RNA, 32 nt, Human
uacagggguaugccaccaugcccagcuggcau

SEQ ID NO: 487164 - RNA, 32 nt, Human
uacagggguccucggucuccaucuacuucccu

SEQ ID NO: 487165 - RNA, 20 nt, Human
uacaggggugagccaccacg

SEQ ID NO: 487166 - RNA, 32 nt, Human
uacaggggugagccaccacgcccagccccagc

SEQ ID NO: 487167 - RNA, 32 nt, Human
uacaggggugagccaccgugcccaaccucacu

SEQ ID NO: 487168 - RNA, 32 nt, Human
uacaggggugagccaccgugccuugcuauuaa

SEQ ID NO: 487169 - RNA, 32 nt, Human
uacaggggugagccacugcgcccagccuaaaa

SEQ ID NO: 487170 - RNA, 32 nt, Human
uacaggggugagccacugugcccggccauaau

SEQ ID NO: 487171 - RNA, 32 nt, Human
uacaggggugcaccaccaugcccagcuaaguu

SEQ ID NO: 487172 - RNA, 32 nt, Human
uacagggguucagccaagcaagacugagcagc

SEQ ID NO: 487173 - RNA, 32 nt, Human
uacaggguaggcaccugucaggacagaacagc

SEQ ID NO: 487174 - RNA, 32 nt, Human
uacaggguuagcaaaaagagccugggcuguau

SEQ ID NO: 487175 - RNA, 32 nt, Human
uacagguaauccagaggcauaagaguccuggu

SEQ ID NO: 487176 - RNA, 20 nt, Human
uacagguacccaccaccacg

SEQ ID NO: 487177 - RNA, 20 nt, Human
uacagguacgcaccaccacg

SEQ ID NO: 487178 - RNA, 20 nt, Human
uacagguagacaccaucacg

SEQ ID NO: 487179 - RNA, 18 nt, Human
uacagguaggaccaccac

SEQ ID NO: 487180 - RNA, 20 nt, Human
uacagguaugacccaccacg

SEQ ID NO: 487181 - RNA, 32 nt, Human
uacagguaugagccacaacacccagccuuuaa

SEQ ID NO: 487182 - RNA, 32 nt, Human
uacagguaugagccacaacgcccagccaucau

SEQ ID NO: 487183 - RNA, 19 nt, Human
uacagguaugagccaccac

SEQ ID NO: 487184 - RNA, 32 nt, Human
uacagguaugagccaccacacccagcccaacu

SEQ ID NO: 487185 - RNA, 20 nt, Human
uacagguaugagccaccacg

SEQ ID NO: 487186 - RNA, 32 nt, Human
uacagguaugagccaccacgcccggucagaag

SEQ ID NO: 487187 - RNA, 32 nt, Human
uacagguaugagccaccaugcccggcuggcag

SEQ ID NO: 487188 - RNA, 32 nt, Human
uacagguaugagccaccaugccuggccccagc

SEQ ID NO: 487189 - RNA, 32 nt, Human
uacagguaugagccaccgcaccgggccuguuc

SEQ ID NO: 487190 - RNA, 32 nt, Human
uacagguaugagccaccgcgcccagcccaucu

SEQ ID NO: 487191 - RNA, 32 nt, Human
uacagguaugagccacugcgcccggccaguua

SEQ ID NO: 487192 - RNA, 32 nt, Human
uacagguaugcaccacagcuccaggccaaccu

SEQ ID NO: 487193 - RNA, 20 nt, Human
uacagguaugcaccaccacg

SEQ ID NO: 487194 - RNA, 32 nt, Human
uacagguaugcgccaccaugccccacuaauuu

SEQ ID NO: 487195 - RNA, 32 nt, Human
uacagguaugugccaccaugccuggcuaauuu

SEQ ID NO: 487196 - RNA, 32 nt, Human
uacagguauuggguaaauacagcuguuccaaa

SEQ ID NO: 487197 - RNA, 32 nt, Human
uacagguccccgcuaaagauggacucucuggc

SEQ ID NO: 487198 - RNA, 19 nt, Human
uacaggucuacaccaccac

SEQ ID NO: 487199 - RNA, 32 nt, Human
uacaggucuacaccaccacucccggcuaauuu

SEQ ID NO: 487200 - RNA, 20 nt, Human
uacaggugaccgccaccacg

SEQ ID NO: 487201 - RNA, 32 nt, Human
uacaggugagauuacuaaguugcucaccauua

SEQ ID NO: 487202 - RNA, 20 nt, Human
uacaggugagcacuaccacg

SEQ ID NO: 487203 - RNA, 32 nt, Human
uacaggugagccccagcaugcccagcuaauuu

SEQ ID NO: 487204 - RNA, 19 nt, Human
uacaggugcacaccaccac

SEQ ID NO: 487205 - RNA, 20 nt, Human
uacaggugcacaccaccacg

SEQ ID NO: 487206 - RNA, 20 nt, Human
uacaggugcacaccaccaug

SEQ ID NO: 487207 - RNA, 17 nt, Human
uacaggugcaccaccac

SEQ ID NO: 487208 - RNA, 32 nt, Human
uacaggugcaccaccacaccuggcuaauuuuu

SEQ ID NO: 487209 - RNA, 19 nt, Human
uacaggugcacgccaccac

SEQ ID NO: 487210 - RNA, 20 nt, Human
uacaggugcacgccaccacg

SEQ ID NO: 487211 - RNA, 32 nt, Human
uacaggugcacgcuaccaugcccggcuaauuu

SEQ ID NO: 487212 - RNA, 32 nt, Human
uacaggugcaggccaccaugcccggcuaauuu

SEQ ID NO: 487213 - RNA, 19 nt, Human
uacaggugcauaccaccac

SEQ ID NO: 487214 - RNA, 20 nt, Human
uacaggugcauaccaccaug

SEQ ID NO: 487215 - RNA, 32 nt, Human
uacaggugcauauuaauuuucuugguucuuuc

SEQ ID NO: 487216 - RNA, 32 nt, Human
uacaggugcaugccaccaugccaggcuaauuu

SEQ ID NO: 487217 - RNA, 32 nt, Human
uacaggugcaugccaccaugccuggcuaauuu

SEQ ID NO: 487218 - RNA, 32 nt, Human
uacaggugcaugccauuaugccaggcuaauuu

SEQ ID NO: 487219 - RNA, 32 nt, Human
uacaggugcaugcuacaaugcccagcuaauuu

SEQ ID NO: 487220 - RNA, 32 nt, Human
uacaggugcaugcuaccaugcccaguccauuu

SEQ ID NO: 487221 - RNA, 20 nt, Human
uacaggugcccaccaacacg

SEQ ID NO: 487222 - RNA, 19 nt, Human
uacaggugcccaccaccac

SEQ ID NO: 487223 - RNA, 20 nt, Human
uacaggugcccaccaccacg

SEQ ID NO: 487224 - RNA, 20 nt, Human
uacaggugcccaccaccaug

SEQ ID NO: 487225 - RNA, 23 nt, Human
uacaggugcccaccaccaugccc

SEQ ID NO: 487226 - RNA, 32 nt, Human
uacaggugcccaccaccaugcccagcuaauuu

SEQ ID NO: 487227 - RNA, 32 nt, Human
uacaggugcccaccaccaugcccggcuaauuu

SEQ ID NO: 487228 - RNA, 20 nt, Human
uacaggugcccaccaccgcg

SEQ ID NO: 487229 - RNA, 20 nt, Human
uacaggugcccaccagcacg

SEQ ID NO: 487230 - RNA, 18 nt, Human
uacaggugcccaccauca

SEQ ID NO: 487231 - RNA, 19 nt, Human
uacaggugcccgccaccac

SEQ ID NO: 487232 - RNA, 20 nt, Human
uacaggugcccgccaccacg

SEQ ID NO: 487233 - RNA, 32 nt, Human
uacaggugcccgccaccaugcccggcuaauuu

SEQ ID NO: 487234 - RNA, 32 nt, Human
uacaggugcccgccaccaugcccggcugauuu

SEQ ID NO: 487235 - RNA, 32 nt, Human
uacaggugcccgccaccaugcucagcuaauuu

SEQ ID NO: 487236 - RNA, 32 nt, Human
uacaggugcccgccacuaugcccagcuaauuu

SEQ ID NO: 487237 - RNA, 20 nt, Human
uacaggugcccuccaccacg

SEQ ID NO: 487238 - RNA, 32 nt, Human
uacaggugccugccaccaugcccagcuaauuu

SEQ ID NO: 487239 - RNA, 32 nt, Human
uacaggugccugccaccaugcccggcuaauac

SEQ ID NO: 487240 - RNA, 32 nt, Human
uacaggugccugccaccaugccuggcuaauuu

SEQ ID NO: 487241 - RNA, 32 nt, Human
uacaggugcgagccaccgugcccggccucugg

SEQ ID NO: 487242 - RNA, 20 nt, Human
uacaggugcgcaccaccaug

SEQ ID NO: 487243 - RNA, 23 nt, Human
uacaggugcgcaccaccaugccc

SEQ ID NO: 487244 - RNA, 32 nt, Human
uacaggugcgcaccaccaugcccagcuaauuu

SEQ ID NO: 487245 - RNA, 32 nt, Human
uacaggugcgcaccaccaugcccggcuaacuu

SEQ ID NO: 487246 - RNA, 20 nt, Human
uacaggugcgcaccacuacg

SEQ ID NO: 487247 - RNA, 19 nt, Human
uacaggugcgcacuaccac

SEQ ID NO: 487248 - RNA, 32 nt, Human
uacaggugcgccccaccaugcccagcuaauuu

SEQ ID NO: 487249 - RNA, 19 nt, Human
uacaggugcgcgccaccac

SEQ ID NO: 487250 - RNA, 32 nt, Human
uacaggugcgugccaccaugcccggguaauuu

SEQ ID NO: 487251 - RNA, 32 nt, Human
uacaggugcgugccaccaugccuggcuaauuu

SEQ ID NO: 487252 - RNA, 32 nt, Human
uacaggugcgugccaccaugcuuggcuaauuu

SEQ ID NO: 487253 - RNA, 32 nt, Human
uacaggugcucaauaaacacuuguagagcaga

SEQ ID NO: 487254 - RNA, 19 nt, Human
uacaggugcucaccaccac

SEQ ID NO: 487255 - RNA, 20 nt, Human
uacaggugcucaccaccacg

SEQ ID NO: 487256 - RNA, 23 nt, Human
uacaggugcuugccaccaugccc

SEQ ID NO: 487257 - RNA, 31 nt, Human
uacagguggcaauggaaaugggugaguggau

SEQ ID NO: 487258 - RNA, 20 nt, Human
uacagguggcuggagcagcu

SEQ ID NO: 487259 - RNA, 32 nt, Human
uacaggugggagccaccgcacccagccugcag

SEQ ID NO: 487260 - RNA, 32 nt, Human
uacaggugggcauaggugcagugagugcaggu

SEQ ID NO: 487261 - RNA, 32 nt, Human
uacagguggguuaggagaaaacugacaugagc

SEQ ID NO: 487262 - RNA, 32 nt, Human
uacagguggugccaccauaccuagcuaauuuu

SEQ ID NO: 487263 - RNA, 19 nt, Human
uacagguguaaaucaccac

SEQ ID NO: 487264 - RNA, 32 nt, Human
uacagguguaagccaccauaccgcaaccucaa

SEQ ID NO: 487265 - RNA, 32 nt, Human
uacagguguaagccaccaugcccagccuguuu

SEQ ID NO: 487266 - RNA, 32 nt, Human
uacagguguaagccaccgugcccagcccuaaa

SEQ ID NO: 487267 - RNA, 32 nt, Human
uacagguguacaccaccaugccuagcuaauuu

SEQ ID NO: 487268 - RNA, 32 nt, Human
uacagguguacgccaccauacccugucucuac

SEQ ID NO: 487269 - RNA, 32 nt, Human
uacaggugucagccaccacgcccggcccuaaa

SEQ ID NO: 487270 - RNA, 20 nt, Human
uacagguguccaccaccacg

SEQ ID NO: 487271 - RNA, 32 nt, Human
uacaggugucugccaccauacccaguuucauu

SEQ ID NO: 487272 - RNA, 19 nt, Human
uacaggugugaaccaccac

SEQ ID NO: 487273 - RNA, 20 nt, Human
uacaggugugaaccaccacg

SEQ ID NO: 487274 - RNA, 20 nt, Human
uacaggugugaaccaccaug

SEQ ID NO: 487275 - RNA, 32 nt, Human
uacaggugugaaccaccaugcccagccagaga

SEQ ID NO: 487276 - RNA, 32 nt, Human
uacaggugugaaccacugcgcccagccccaag

SEQ ID NO: 487277 - RNA, 32 nt, Human
uacaggugugagccacagcacccaaccuuuuu

SEQ ID NO: 487278 - RNA, 32 nt, Human
uacaggugugagccacagcaccuggccaacca

SEQ ID NO: 487279 - RNA, 32 nt, Human
uacaggugugagccacagcacucggccuaaau

SEQ ID NO: 487280 - RNA, 32 nt, Human
uacaggugugagccacagcgccuggcccagug

SEQ ID NO: 487281 - RNA, 32 nt, Human
uacaggugugagccacagugcccagcacuuga

SEQ ID NO: 487282 - RNA, 32 nt, Human
uacaggugugagccacagugccuggcccauuc

SEQ ID NO: 487283 - RNA, 19 nt, Human
uacaggugugagccaccac

SEQ ID NO: 487284 - RNA, 32 nt, Human
uacaggugugagccaccacaccaggccagagc

SEQ ID NO: 487285 - RNA, 32 nt, Human
uacaggugugagccaccacacccagccaacau

SEQ ID NO: 487286 - RNA, 32 nt, Human
uacaggugugagccaccacacccagccaauua

SEQ ID NO: 487287 - RNA, 32 nt, Human
uacaggugugagccaccacacccagcccaggc

SEQ ID NO: 487288 - RNA, 32 nt, Human
uacaggugugagccaccacacccagccucugu

SEQ ID NO: 487289 - RNA, 32 nt, Human
uacaggugugagccaccacacccggccaacca

SEQ ID NO: 487290 - RNA, 32 nt, Human
uacaggugugagccaccacacccggcccaacu

SEQ ID NO: 487291 - RNA, 32 nt, Human
uacaggugugagccaccacacccggcccccau

SEQ ID NO: 487292 - RNA, 32 nt, Human
uacaggugugagccaccacacccggccuauau

SEQ ID NO: 487293 - RNA, 32 nt, Human
uacaggugugagccaccacacccggccuuauc

SEQ ID NO: 487294 - RNA, 32 nt, Human
uacaggugugagccaccacaccugacccauag

SEQ ID NO: 487295 - RNA, 32 nt, Human
uacaggugugagccaccacaccugcccccgcc

SEQ ID NO: 487296 - RNA, 32 nt, Human
uacaggugugagccaccacaccuggccaagaa

SEQ ID NO: 487297 - RNA, 32 nt, Human
uacaggugugagccaccacaccuggcccauag

SEQ ID NO: 487298 - RNA, 32 nt, Human
uacaggugugagccaccacaccuggccccaaa

SEQ ID NO: 487299 - RNA, 32 nt, Human
uacaggugugagccaccacacugggccaaugc

SEQ ID NO: 487300 - RNA, 32 nt, Human
uacaggugugagccaccacacuuggccaguau

SEQ ID NO: 487301 - RNA, 32 nt, Human
uacaggugugagccaccacagccagccaguau

SEQ ID NO: 487302 - RNA, 32 nt, Human
uacaggugugagccaccacagccagccuaaaa

SEQ ID NO: 487303 - RNA, 32 nt, Human
uacaggugugagccaccacauccagccuaacu

SEQ ID NO: 487304 - RNA, 20 nt, Human
uacaggugugagccaccacg

SEQ ID NO: 487305 - RNA, 32 nt, Human
uacaggugugagccaccacgaucagccucuag

SEQ ID NO: 487306 - RNA, 32 nt, Human
uacaggugugagccaccacgcauggcccugaa

SEQ ID NO: 487307 - RNA, 32 nt, Human
uacaggugugagccaccacgccagccugacga

SEQ ID NO: 487308 - RNA, 32 nt, Human
uacaggugugagccaccacgcccagccaugaa

SEQ ID NO: 487309 - RNA, 32 nt, Human
uacaggugugagccaccacgcccagccugugg

SEQ ID NO: 487310 - RNA, 32 nt, Human
uacaggugugagccaccacgcccagccuuuuu

SEQ ID NO: 487311 - RNA, 32 nt, Human
uacaggugugagccaccacgcccggccaaggc

SEQ ID NO: 487312 - RNA, 32 nt, Human
uacaggugugagccaccacgcccggccgauuu

SEQ ID NO: 487313 - RNA, 32 nt, Human
uacaggugugagccaccacgcccgguacauau

SEQ ID NO: 487314 - RNA, 32 nt, Human
uacaggugugagccaccacgcccugccuacuc

SEQ ID NO: 487315 - RNA, 32 nt, Human
uacaggugugagccaccacgccuggacuauaa

SEQ ID NO: 487316 - RNA, 32 nt, Human
uacaggugugagccaccacgccuggcuaauuu

SEQ ID NO: 487317 - RNA, 32 nt, Human
uacaggugugagccaccacgccugggcccaug

SEQ ID NO: 487318 - RNA, 32 nt, Human
uacaggugugagccaccacguccggccaauuu

SEQ ID NO: 487319 - RNA, 32 nt, Human
uacaggugugagccaccacucccagccugauu

SEQ ID NO: 487320 - RNA, 32 nt, Human
uacaggugugagccaccaggcccagccuauau

SEQ ID NO: 487321 - RNA, 32 nt, Human
uacaggugugagccaccaggcucagcccccua

SEQ ID NO: 487322 - RNA, 32 nt, Human
uacaggugugagccaccaugccaggcccucuu

SEQ ID NO: 487323 - RNA, 23 nt, Human
uacaggugugagccaccaugccc

SEQ ID NO: 487324 - RNA, 32 nt, Human
uacaggugugagccaccaugcccaacacccac

SEQ ID NO: 487325 - RNA, 32 nt, Human
uacaggugugagccaccaugcccagcccaaaa

SEQ ID NO: 487326 - RNA, 32 nt, Human
uacaggugugagccaccaugcccagccucuuc

SEQ ID NO: 487327 - RNA, 32 nt, Human
uacaggugugagccaccaugcccagccugaau

SEQ ID NO: 487328 - RNA, 32 nt, Human
uacaggugugagccaccaugcccagccuguuc

SEQ ID NO: 487329 - RNA, 32 nt, Human
uacaggugugagccaccaugcccggccuucuc

SEQ ID NO: 487330 - RNA, 32 nt, Human
uacaggugugagccaccaugcccggccuuguu

SEQ ID NO: 487331 - RNA, 32 nt, Human
uacaggugugagccaccaugcccggcuaauuu

SEQ ID NO: 487332 - RNA, 32 nt, Human
uacaggugugagccaccaugccuggccccaug

SEQ ID NO: 487333 - RNA, 32 nt, Human
uacaggugugagccaccaugccuggccguggu

SEQ ID NO: 487334 - RNA, 32 nt, Human
uacaggugugagccaccaugccuggccuaaac

SEQ ID NO: 487335 - RNA, 32 nt, Human
uacaggugugagccaccaugccuggccugcuu

SEQ ID NO: 487336 - RNA, 32 nt, Human
uacaggugugagccaccaugccuggcucugga

SEQ ID NO: 487337 - RNA, 32 nt, Human
uacaggugugagccaccaugccugggcuaaac

SEQ ID NO: 487338 - RNA, 32 nt, Human
uacaggugugagccaccaugccuggucacccu

SEQ ID NO: 487339 - RNA, 32 nt, Human
uacaggugugagccaccaugcucugccaauua

SEQ ID NO: 487340 - RNA, 32 nt, Human
uacaggugugagccaccaugucuggccuugau

SEQ ID NO: 487341 - RNA, 32 nt, Human
uacaggugugagccacccugcccagccgucaa

SEQ ID NO: 487342 - RNA, 32 nt, Human
uacaggugugagccaccgcacccaauccuauu

SEQ ID NO: 487343 - RNA, 32 nt, Human
uacaggugugagccaccgcacccagccuaugu

SEQ ID NO: 487344 - RNA, 32 nt, Human
uacaggugugagccaccgcacccggccaaaaa

SEQ ID NO: 487345 - RNA, 32 nt, Human
uacaggugugagccaccgcacccggccaacuu

SEQ ID NO: 487346 - RNA, 32 nt, Human
uacaggugugagccaccgcacccggcuggcca

SEQ ID NO: 487347 - RNA, 32 nt, Human
uacaggugugagccaccgcaccuggccagaag

SEQ ID NO: 487348 - RNA, 32 nt, Human
uacaggugugagccaccgcaccuggccagacc

SEQ ID NO: 487349 - RNA, 32 nt, Human
uacaggugugagccaccgcaccuggccugcuu

SEQ ID NO: 487350 - RNA, 32 nt, Human
uacaggugugagccaccgcacucagcugauuu

SEQ ID NO: 487351 - RNA, 32 nt, Human
uacaggugugagccaccgcgccaggccucagc

SEQ ID NO: 487352 - RNA, 32 nt, Human
uacaggugugagccaccgcgcccagccaagaa

SEQ ID NO: 487353 - RNA, 32 nt, Human
uacaggugugagccaccgcgcccagccaccuu

SEQ ID NO: 487354 - RNA, 32 nt, Human
uacaggugugagccaccgcgcccagcccguuu

SEQ ID NO: 487355 - RNA, 32 nt, Human
uacaggugugagccaccgcgcccggcccgagc

SEQ ID NO: 487356 - RNA, 32 nt, Human
uacaggugugagccaccgcgcccggcccuuuu

SEQ ID NO: 487357 - RNA, 32 nt, Human
uacaggugugagccaccgcgcccggccgagaa

SEQ ID NO: 487358 - RNA, 32 nt, Human
uacaggugugagccaccgcgcccggccucucg

SEQ ID NO: 487359 - RNA, 32 nt, Human
uacaggugugagccaccgcgcccggcuguuuu

SEQ ID NO: 487360 - RNA, 32 nt, Human
uacaggugugagccaccgcgccgggcccuuuu

SEQ ID NO: 487361 - RNA, 32 nt, Human
uacaggugugagccaccgcgccugaccaacuu

SEQ ID NO: 487362 - RNA, 32 nt, Human
uacaggugugagccaccgcgccuggcccucaa

SEQ ID NO: 487363 - RNA, 32 nt, Human
uacaggugugagccaccgcgccuggcccugua

SEQ ID NO: 487364 - RNA, 32 nt, Human
uacaggugugagccaccgcgccuggccuauua

SEQ ID NO: 487365 - RNA, 32 nt, Human
uacaggugugagccaccgcgccuggccugggc

SEQ ID NO: 487366 - RNA, 32 nt, Human
uacaggugugagccaccgcgcucggccagagc

SEQ ID NO: 487367 - RNA, 32 nt, Human
uacaggugugagccaccgcguccagccagcuu

SEQ ID NO: 487368 - RNA, 32 nt, Human
uacaggugugagccaccgugaccagccaaugu

SEQ ID NO: 487369 - RNA, 32 nt, Human
uacaggugugagccaccgugcacggccggccu

SEQ ID NO: 487370 - RNA, 32 nt, Human
uacaggugugagccaccgugcccagccuauac

SEQ ID NO: 487371 - RNA, 32 nt, Human
uacaggugugagccaccgugcccaggcccuca

SEQ ID NO: 487372 - RNA, 32 nt, Human
uacaggugugagccaccgugcccggccaagua

SEQ ID NO: 487373 - RNA, 32 nt, Human
uacaggugugagccaccgugcccggccaccag

SEQ ID NO: 487374 - RNA, 32 nt, Human
uacaggugugagccaccgugcccggcccagau

SEQ ID NO: 487375 - RNA, 32 nt, Human
uacaggugugagccaccgugcccggcccauuc

SEQ ID NO: 487376 - RNA, 32 nt, Human
uacugguuuguaagcuuuaauuuuagaaaaga

SEQ ID NO: 487377 - RNA, 32 nt, Human
uacugguuuguaagcuuuaauuuuagagaaga

SEQ ID NO: 487378 - RNA, 32 nt, Human
uacuguaaaagauuuuugcuucccucuugugg

SEQ ID NO: 487379 - RNA, 31 nt, Human
uacuguaaaguuaauaaagcaauuuaaaagc

SEQ ID NO: 487380 - RNA, 19 nt, Human
uacuguaacacuuuacaau

SEQ ID NO: 487381 - RNA, 32 nt, Human
uacuguaagcuggcugacugcuggugaagaaa

SEQ ID NO: 487382 - RNA, 31 nt, Human
uacuguaaggccuucuuuaggccuuuagcuc

SEQ ID NO: 487383 - RNA, 32 nt, Human
uacuguacagcaggcaggagggugggcaggca

SEQ ID NO: 487384 - RNA, 32 nt, Human
uacuguacaggggaauaaaagagaucuuauuu

SEQ ID NO: 487385 - RNA, 32 nt, Human
uacuguacuacuguacuccagccugggggaaa

SEQ ID NO: 487386 - RNA, 32 nt, Human
uacuguacuccccucauggcccagggagccag

SEQ ID NO: 487387 - RNA, 32 nt, Human
uacuguagaacugcaauuuccauucuuuuaaa

SEQ ID NO: 487388 - RNA, 32 nt, Human
uacuguagcugagacccuagccugugccaggc

SEQ ID NO: 487389 - RNA, 32 nt, Human
uacuguaggcagugccauuugaccacaccgau

SEQ ID NO: 487390 - RNA, 32 nt, Human
uacuguaguagaauucauucugggcaaacacu

SEQ ID NO: 487391 - RNA, 32 nt, Human
uacuguagucagcugggaauggggaaggugca

SEQ ID NO: 487392 - RNA, 32 nt, Human
uacuguaguuccuagaaugcugugagggcggg

SEQ ID NO: 487393 - RNA, 32 nt, Human
uacuguauccagcaccacagaaaccucagugu

SEQ ID NO: 487394 - RNA, 32 nt, Human
uacuguauguaauguauuuauguauguauuug

SEQ ID NO: 487395 - RNA, 32 nt, Human
uacuguaugugcaugcauucacacacacauau

SEQ ID NO: 487396 - RNA, 32 nt, Human
uacuguauucuacauuauuauaugacauagua

SEQ ID NO: 487397 - RNA, 32 nt, Human
uacuguauuuuacaucuuuauuucuuggugaa

SEQ ID NO: 487398 - RNA, 32 nt, Human
uacuguauuuuuaaaaacccuaccuccauuaa

SEQ ID NO: 487399 - RNA, 32 nt, Human
uacuguauuuuuaccuuuuuccuuccuuauca

SEQ ID NO: 487400 - RNA, 25 nt, Human
uacugucaaguguuacaacuggaua

SEQ ID NO: 487401 - RNA, 32 nt, Human
uacugucauacaggcuggcgugcaguaguggg

SEQ ID NO: 487402 - RNA, 32 nt, Human
uacugucauggaggugcugaacacagggaagg

SEQ ID NO: 487403 - RNA, 32 nt, Human
uacugucauuguccuaaaaccuuauuuuagaa

SEQ ID NO: 487404 - RNA, 32 nt, Human
uacuguccagucuuaaagcugcagagaaucgg

SEQ ID NO: 487405 - RNA, 32 nt, Human
uacuguccccagagaaagugcagcucuggaag

SEQ ID NO: 487406 - RNA, 32 nt, Human
uacuguccccuccagaggccacaccaaggucu

SEQ ID NO: 487407 - RNA, 32 nt, Human
uacugucccuuccuagcugugugaucuugaca

SEQ ID NO: 487408 - RNA, 32 nt, Human
uacuguccuccagaauaccaaguauuagguga

SEQ ID NO: 487409 - RNA, 32 nt, Human
uacuguccuuugccuauugcucccucuaucau

SEQ ID NO: 487410 - RNA, 28 nt, Human
uacugucucagugcugcuauauuuaaga

SEQ ID NO: 487411 - RNA, 32 nt, Human
uacugucucagugcugcuauauuuaagacggu

SEQ ID NO: 487412 - RNA, 32 nt, Human
uacugucucucauugagcacugauagaauuua

SEQ ID NO: 487413 - RNA, 32 nt, Human
uacugucucugaaucaauaugaccucacuuaa

SEQ ID NO: 487414 - RNA, 32 nt, Human
uacugucugccuauauuaaggguccacacggc

SEQ ID NO: 487415 - RNA, 32 nt, Human
uacugucugccuugcuggaaugcuggcuuuca

SEQ ID NO: 487416 - RNA, 32 nt, Human
uacugucugggcuaaaaagcuuacagugagug

SEQ ID NO: 487417 - RNA, 32 nt, Human
uacugugaagacacaaagauacuuuuagaaua

SEQ ID NO: 487418 - RNA, 32 nt, Human
uacugugaaugagugagauccuggaggacccu

SEQ ID NO: 487419 - RNA, 32 nt, Human
uacugugaauuguuuuuguacaguuaucauga

SEQ ID NO: 487420 - RNA, 32 nt, Human
uacugugacuucuuccuguguaaucucagugg

SEQ ID NO: 487421 - RNA, 32 nt, Human
uacugugaggaacuugggaaaagcuuuagauc

SEQ ID NO: 487422 - RNA, 32 nt, Human
uacugugaguggucuguuauuaagcccaauga

SEQ ID NO: 487423 - RNA, 32 nt, Human
uacugugaguucugcuacaaagcacaaaugaa

SEQ ID NO: 487424 - RNA, 32 nt, Human
uacugugauaccuggcacagugcuuugaucuu

SEQ ID NO: 487425 - RNA, 32 nt, Human
uacugugccacuccaauauuuaucaaauccaa

SEQ ID NO: 487426 - RNA, 32 nt, Human
uacugugccacuggccaugccaaacagcaccc

SEQ ID NO: 487427 - RNA, 32 nt, Human
uacugugccauugcacuccaagccugggcaac

SEQ ID NO: 487428 - RNA, 31 nt, Human
uacugugcccaggaaggcugggugaaguccc

SEQ ID NO: 487429 - RNA, 32 nt, Human
uacugugccuucauccccauccugggcccuga

SEQ ID NO: 487430 - RNA, 32 nt, Human
uacugugcugccugagcccguggcaccguggg

SEQ ID NO: 487431 - RNA, 32 nt, Human
uacugugcuucaaauaaauagaaaaauaguua

SEQ ID NO: 487432 - RNA, 32 nt, Human
uacugugcuuccuuucuuguucaugugagcau

SEQ ID NO: 487433 - RNA, 32 nt, Human
uacuguggagcagcccaguccacaccagagcc

SEQ ID NO: 487434 - RNA, 32 nt, Human
uacuguggagggaacccaggauccugaaauuc

SEQ ID NO: 487435 - RNA, 32 nt, Human
uacugugggaauaggggucucuccauccaggg

SEQ ID NO: 487436 - RNA, 32 nt, Human
uacugugggagcaggggucucuccauccaggg

SEQ ID NO: 487437 - RNA, 32 nt, Human
uacugugggaggccgaggcaggaggaucacga

SEQ ID NO: 487438 - RNA, 32 nt, Human
uacugugggaugguaucucaggguaaguaaca

SEQ ID NO: 487439 - RNA, 32 nt, Human
uacuguggggcuggggacccucacaggugaca

SEQ ID NO: 487440 - RNA, 32 nt, Human
uacuguguaacuuucaaaaguagcuacucaau

SEQ ID NO: 487441 - RNA, 32 nt, Human
uacuguguaauucuauuuauaugaaauaucca

SEQ ID NO: 487442 - RNA, 32 nt, Human
uacuguguauuucacauucaucaugccccgac

SEQ ID NO: 487443 - RNA, 32 nt, Human
uacugugucucccaggccacugggugcucucu

SEQ ID NO: 487444 - RNA, 32 nt, Human
uacugugugacuuugggcaaguuccuucccca

SEQ ID NO: 487445 - RNA, 32 nt, Human
uacugugugcagggaccagaggguguggaggu

SEQ ID NO: 487446 - RNA, 32 nt, Human
uacugugugccaacuugcaaaaggaauagaaa

SEQ ID NO: 487447 - RNA, 32 nt, Human
uacuguguuguaugaaacccuuuuguccuuug

SEQ ID NO: 487448 - RNA, 32 nt, Human
uacuguuacaguggcaaucgcauuucaacgug

SEQ ID NO: 487449 - RNA, 32 nt, Human
uacuguuacauuggggaucaaguuuccaauau

SEQ ID NO: 487450 - RNA, 32 nt, Human
uacuguucacacacacaguuugagacuccaag

SEQ ID NO: 487451 - RNA, 32 nt, Human
uacuguucauuucugauuccucagcaccuggu

SEQ ID NO: 487452 - RNA, 32 nt, Human
uacuguucuauagccccagaacugggagaugg

SEQ ID NO: 487453 - RNA, 32 nt, Human
uacuguucugaccaggcguccucugcccccag

SEQ ID NO: 487454 - RNA, 32 nt, Human
uacuguucugcugcugaucacgagggcaccag

SEQ ID NO: 487455 - RNA, 32 nt, Human
uacuguugaauucuguaaauaguuauaucucg

SEQ ID NO: 487456 - RNA, 32 nt, Human
uacuguugaugauuuuugcuguuguuucauga

SEQ ID NO: 487457 - RNA, 32 nt, Human
uacuguugcugauuuuugcaucuucuugaaga

SEQ ID NO: 487458 - RNA, 32 nt, Human
uacuguuguccaggcuggagcgcaguugauug

SEQ ID NO: 487459 - RNA, 32 nt, Human
uacuguuuaaguacaucucagcagaauuuuau

SEQ ID NO: 487460 - RNA, 32 nt, Human
uacuguuucuaaagcaugcaacuuuuucacaa

SEQ ID NO: 487461 - RNA, 32 nt, Human
uacuguuugggucugugucccuagccaaaugu

SEQ ID NO: 487462 - RNA, 32 nt, Human
uacuguuuguuucuaaaaauccuacugugccc

SEQ ID NO: 487463 - RNA, 32 nt, Human
uacuguuuucuuucuggccuuuucuccugguu

SEQ ID NO: 487464 - RNA, 32 nt, Human
uacuguuuugggccuccaugccccagcucugg

SEQ ID NO: 487465 - RNA, 32 nt, Human
uacuuaaaaaugcaaaaauuagccggacgugg

SEQ ID NO: 487466 - RNA, 32 nt, Human
uacuuaaaagaaagauuucccauugcauacag

SEQ ID NO: 487467 - RNA, 32 nt, Human
uacuuaaacucagucucagcuuccucaucugu

SEQ ID NO: 487468 - RNA, 32 nt, Human
uacuuaaagaacagacaguuuacuuggccuaa

SEQ ID NO: 487469 - RNA, 32 nt, Human
uacuuaaauguucauauuauuagcacacuaca

SEQ ID NO: 487470 - RNA, 32 nt, Human
uacuuaacauacaaugcaaaugcuuuccgcau

SEQ ID NO: 487471 - RNA, 32 nt, Human
uacuuaaccaacaaacaaauguaagacuacaa

SEQ ID NO: 487472 - RNA, 32 nt, Human
uacuuaaccugagacucauuauuuagcuauuu

SEQ ID NO: 487473 - RNA, 32 nt, Human
uacuuaacgugucacuucuccucccagaggca

SEQ ID NO: 487474 - RNA, 32 nt, Human
uacuuaacucacugcaucuguacagucauucu

SEQ ID NO: 487475 - RNA, 32 nt, Human
uacuuaaggauuuaccguggcuuugaguaaug

SEQ ID NO: 487476 - RNA, 32 nt, Human
uacuuaagguauagagauucuuuuccaccugu

SEQ ID NO: 487477 - RNA, 32 nt, Human
uacuuaauuccuguaaucccagcauuuugaga

SEQ ID NO: 487478 - RNA, 32 nt, Human
uacuuaauuuugaauuucuccuugccacguua

SEQ ID NO: 487479 - RNA, 32 nt, Human
uacuuaccagcccaauucuacucuccucaaac

SEQ ID NO: 487480 - RNA, 32 nt, Human
uacuuaccauuccuauuuuauagaugaggaaa

SEQ ID NO: 487481 - RNA, 32 nt, Human
uacuuacgaugauucagguacuguuguaagug

SEQ ID NO: 487482 - RNA, 32 nt, Human
uacuuacggaguuucgcucuuauugcccagac

SEQ ID NO: 487483 - RNA, 32 nt, Human
uacuuacuaagcauuuacuaugucaucaauaa

SEQ ID NO: 487484 - RNA, 32 nt, Human
uacuuacuacugcacuccugcuuuugugggaa

SEQ ID NO: 487485 - RNA, 32 nt, Human
uacuuacugaugacugaccacacugucuugug

SEQ ID NO: 487486 - RNA, 32 nt, Human
uacuuacuuacacauuuuuaacuuuaugacca

SEQ ID NO: 487487 - RNA, 21 nt, Human
uacuuagaaucuccuucuguu

SEQ ID NO: 487488 - RNA, 32 nt, Human
uacuuagagacagggucuugcucuguugccca

SEQ ID NO: 487489 - RNA, 32 nt, Human
uacuuagaugaucuucaugggcccacagguac

SEQ ID NO: 487490 - RNA, 32 nt, Human
uacuuagcagaaauaaaagggaaaaguauguc

SEQ ID NO: 487491 - RNA, 32 nt, Human
uacuuaggagccucuuuguagggacugugccu

SEQ ID NO: 487492 - RNA, 32 nt, Human
uacuuagggaggcuaagauaggaggaucacuu

SEQ ID NO: 487493 - RNA, 32 nt, Human
uacuuaggggucagagagucucgaccagagga

SEQ ID NO: 487494 - RNA, 32 nt, Human
uacuuaggugggccaggauuucuugaaaccaa

SEQ ID NO: 487495 - RNA, 32 nt, Human
uacuuagucuucucccccuucccuggggcuuc

SEQ ID NO: 487496 - RNA, 32 nt, Human
uacuuagugaaagagagcugcaguugaaauug

SEQ ID NO: 487497 - RNA, 32 nt, Human
uacuuauaaaaaggauuuugaagcuggaaaca

SEQ ID NO: 487498 - RNA, 32 nt, Human
uacuuauaaacauacuaauccucuuucaggac

SEQ ID NO: 487499 - RNA, 32 nt, Human
uacuuauagaaauccauuaaaaagcaaucucu

SEQ ID NO: 487500 - RNA, 32 nt, Human
uacuuaucaaaaaggcaggaaaguagguauga

SEQ ID NO: 487501 - RNA, 32 nt, Human
uacuuaucagggccauacugguaagcuugcgu

SEQ ID NO: 487502 - RNA, 32 nt, Human
uacuuauccuuaagaacauggaaggggugcug

SEQ ID NO: 487503 - RNA, 32 nt, Human
uacuuaucucucugugcuguggaagcaacagg

SEQ ID NO: 487504 - RNA, 32 nt, Human
uacuuaucuugcuccauugucaugaguccaug

SEQ ID NO: 487505 - RNA, 32 nt, Human
uacuuaugaagucuucuuccugcuccacaacg

SEQ ID NO: 487506 - RNA, 32 nt, Human
uacuuaugcaaauuucugcagcuggcuugaau

SEQ ID NO: 487507 - RNA, 32 nt, Human
uacuuauuacugcuaaguauuucccagcacau

SEQ ID NO: 487508 - RNA, 32 nt, Human
uacuuauucaacuccauuucuuguccuuacaa

SEQ ID NO: 487509 - RNA, 32 nt, Human
uacuuauuuauucaucugccucauguuuuauu

SEQ ID NO: 487510 - RNA, 32 nt, Human
uacuuauuucugcuuuagccuccuauguuugc

SEQ ID NO: 487511 - RNA, 32 nt, Human
uacuucaaccugggagguugaggcugcaguga

SEQ ID NO: 487512 - RNA, 32 nt, Human
uacuucaagaaagaggcaguagaguugcuggu

SEQ ID NO: 487513 - RNA, 32 nt, Human
uacuucaagaagaagaagcuguggaagcccag

SEQ ID NO: 487514 - RNA, 32 nt, Human
uacuucacagcucaaaucugaucuaguaugaa

SEQ ID NO: 487515 - RNA, 32 nt, Human
uacuucacugccuuugucuguguuacuagugg

SEQ ID NO: 487516 - RNA, 32 nt, Human
uacuucagaggaagaauuaaggggcauguugg

SEQ ID NO: 487517 - RNA, 32 nt, Human
uacuucaggcugggcacaguggcucaugccug

SEQ ID NO: 487518 - RNA, 32 nt, Human
uacuucaguuaacuuggcuuuuauagaauccu

SEQ ID NO: 487519 - RNA, 31 nt, Human
uacuucaucagcuagauugcaagcuccaugu

SEQ ID NO: 487520 - RNA, 32 nt, Human
uacuucaucucuaggucacgggucaggaaaca

SEQ ID NO: 487521 - RNA, 32 nt, Human
uacuuccaaaacugugcugugugaaggcuuug

SEQ ID NO: 487522 - RNA, 32 nt, Human
uacuuccacagcaacaggugcuagagaccacu

SEQ ID NO: 487523 - RNA, 32 nt, Human
uacuuccagaagaacaaccagaugggaaggac

SEQ ID NO: 487524 - RNA, 32 nt, Human
uacuuccagaggaggaauuaaugagcgaccug

SEQ ID NO: 487525 - RNA, 31 nt, Human
uacuucccagcugcagccaaguucuuagggu

SEQ ID NO: 487526 - RNA, 32 nt, Human
uacuucccucugcauuuguggcugccauuuca

SEQ ID NO: 487527 - RNA, 32 nt, Human
uacuuccucaaaauguauccuuagucaccuca

SEQ ID NO: 487528 - RNA, 32 nt, Human
uacuuccuccaccccucccuaucucaccugcc

SEQ ID NO: 487529 - RNA, 32 nt, Human
uacuuccucuccccaggucucucgguuuccuc

SEQ ID NO: 487530 - RNA, 32 nt, Human
uacuuccugcauuuuaacaagauccccaaggg

SEQ ID NO: 487531 - RNA, 32 nt, Human
uacuuccugccugugucaccugguuccugcuu

SEQ ID NO: 487532 - RNA, 32 nt, Human
uacuuccugguugcaaccucucuuccucuggg

SEQ ID NO: 487533 - RNA, 32 nt, Human
uacuuccuguguacaaaguuuuauuguaaaug

SEQ ID NO: 487534 - RNA, 32 nt, Human
uacuuccuuuaaaugucccauggauguaggac

SEQ ID NO: 487535 - RNA, 32 nt, Human
uacuucggcaagacaucuuaagaaugugacac

SEQ ID NO: 487536 - RNA, 32 nt, Human
uacuucggcaggcguguguuacaguggaguca

SEQ ID NO: 487537 - RNA, 32 nt, Human
uacuucgggcuucuguuaaagcuguucuaugg

SEQ ID NO: 487538 - RNA, 24 nt, Human
uacuucuaccauuaaggugaaauc

SEQ ID NO: 487539 - RNA, 32 nt, Human
uacuucuacggaauaguuuuugcucauggaac

SEQ ID NO: 487540 - RNA, 24 nt, Human
uacuucuauaaacuuuacacaaua

SEQ ID NO: 487541 - RNA, 32 nt, Human
uacuucuauuaaguuauugaugcaauuugaua

SEQ ID NO: 487542 - RNA, 32 nt, Human
uacuucucaacaacaucaacuauguaaaauga

SEQ ID NO: 487543 - RNA, 32 nt, Human
uacuucuccaacacccggcagcacuuggcccu

SEQ ID NO: 487544 - RNA, 32 nt, Human
uacuucuccacugucccguucagucugaaugc

SEQ ID NO: 487545 - RNA, 32 nt, Human
uacuucucccagagaaaggaaaaucuuggaaa

SEQ ID NO: 487546 - RNA, 32 nt, Human
uacuucuccuucugucucuuggaaagauacag

SEQ ID NO: 487547 - RNA, 32 nt, Human
uacuucucuguaaaaugucuguucuacuucac

SEQ ID NO: 487548 - RNA, 32 nt, Human
uacuucucuguucggagacaugagaaguauga

SEQ ID NO: 487549 - RNA, 32 nt, Human
uacuucucuuagagucuuucuucuuuggcuug

SEQ ID NO: 487550 - RNA, 32 nt, Human
uacuucugaaagaugggguaauaccaacagcu

SEQ ID NO: 487551 - RNA, 32 nt, Human
uacuucugaccuugaaauagccugcuggugac

SEQ ID NO: 487552 - RNA, 32 nt, Human
uacuucugcccuuucuauccaucgucuucauu

SEQ ID NO: 487553 - RNA, 32 nt, Human
uacuucugcuuugcagaaauuaucugcuugca

SEQ ID NO: 487554 - RNA, 32 nt, Human
uacuucugcuuuuuauucuuccucaaguaguu

SEQ ID NO: 487555 - RNA, 32 nt, Human
uacuucuggguauuacagaaacagucuguaaa

SEQ ID NO: 487556 - RNA, 22 nt, Human
uacuucuggguuuuagacaaua

SEQ ID NO: 487557 - RNA, 32 nt, Human
uacuucuguacuucaaugaugaucucacggag

SEQ ID NO: 487558 - RNA, 19 nt, Human
uacuucuucaagauuggac

SEQ ID NO: 487559 - RNA, 19 nt, Human
uacuucuucauccauagac

SEQ ID NO: 487560 - RNA, 32 nt, Human
uacuucuuggauaaugcacaaauaguaagaca

SEQ ID NO: 487561 - RNA, 32 nt, Human
uacuucuugggcuucucagucuuggauuugaa

SEQ ID NO: 487562 - RNA, 32 nt, Human
uacuucuugucauccccacucccagccccuau

SEQ ID NO: 487563 - RNA, 32 nt, Human
uacuucuuuccuguuuugccuggaccacuuaa

SEQ ID NO: 487564 - RNA, 32 nt, Human
uacuucuuuuauuccuccuuuugguaaacaac

SEQ ID NO: 487565 - RNA, 32 nt, Human
uacuucuuuucuuccuuccucuuccucucuua

SEQ ID NO: 487566 - RNA, 32 nt, Human
uacuugaaaaacugagcacauaguggaaagag

SEQ ID NO: 487567 - RNA, 32 nt, Human
uacuugaaaggccagauuacucagcagaucuc

SEQ ID NO: 487568 - RNA, 32 nt, Human
uacuugaaaggcugaggcaggagaaucgcuug

SEQ ID NO: 487569 - RNA, 32 nt, Human
uacuugaagugggcagggaagcagcacugagu

SEQ ID NO: 487570 - RNA, 32 nt, Human
uacuugaaguuuguuaaaugguuuguggaaga

SEQ ID NO: 487571 - RNA, 32 nt, Human
uacuugaaucugagagauggaggcugcaguga

SEQ ID NO: 487572 - RNA, 32 nt, Human
uacuugaaugugccuaauggaaccauuugaug

SEQ ID NO: 487573 - RNA, 32 nt, Human
uacuugacaacaaaacccauucuuucaguuac

SEQ ID NO: 487574 - RNA, 32 nt, Human
uacuugacaccagcuaccuagcaggcucauug

SEQ ID NO: 487575 - RNA, 32 nt, Human
uacuugacauacugccacaaaguaguuuuuga

SEQ ID NO: 487576 - RNA, 32 nt, Human
uacuugagagcaucaaauuuugucauuaaaau

SEQ ID NO: 487577 - RNA, 32 nt, Human
uacuugagaggcuggggcaggagaaucacuag

SEQ ID NO: 487578 - RNA, 32 nt, Human
uacuugagcaccucaucuuuugcucaaauuga

SEQ ID NO: 487579 - RNA, 32 nt, Human
uacuugaggaauagagaagacuggguuuucuc

SEQ ID NO: 487580 - RNA, 32 nt, Human
uacuugaggcagaugggauaguagcugggaac

SEQ ID NO: 487581 - RNA, 32 nt, Human
uacuugagggccugagguagggggaucacuug

SEQ ID NO: 487582 - RNA, 32 nt, Human
uacuugaguagacgaugaacuaguaaacaaau

SEQ ID NO: 487583 - RNA, 30 nt, Human
uacuugaguuuggagucagaaagcaagacc

SEQ ID NO: 487584 - RNA, 32 nt, Human
uacuugauguaaccacgggcuccuggacuugc

SEQ ID NO: 487585 - RNA, 32 nt, Human
uacuugauuacaaaugaaaacucagaaaccaa

SEQ ID NO: 487586 - RNA, 32 nt, Human
uacuugcaacagucuuucaugauaugaggaug

SEQ ID NO: 487587 - RNA, 32 nt, Human
uacuugcaaucaaggguucaggugcaagcaga

SEQ ID NO: 487588 - RNA, 32 nt, Human
uacuugcagcggcaacagaugagggaacagca

SEQ ID NO: 487589 - RNA, 32 nt, Human
uacuugcaucuuagguauuucuucccagucac

SEQ ID NO: 487590 - RNA, 32 nt, Human
uacuugcaugaucuuacacgaagaaauagaau

SEQ ID NO: 487591 - RNA, 32 nt, Human
uacuugcauguguauacauacauguaacuuca

SEQ ID NO: 487592 - RNA, 21 nt, Human
uacuugccacugccaucacug

SEQ ID NO: 487593 - RNA, 32 nt, Human
uacuugccaggaccucuccuugcuacucuucc

SEQ ID NO: 487594 - RNA, 23 nt, Human
uacuugccauuugagccucacug

SEQ ID NO: 487595 - RNA, 32 nt, Human
uacuugccuaucugacuucauacaucccucag

SEQ ID NO: 487596 - RNA, 32 nt, Human
uacuugccucuggaacaccuucugcuaacauc

SEQ ID NO: 487597 - RNA, 32 nt, Human
uacuugccugcacuucuugagaaaaagacugc

SEQ ID NO: 487598 - RNA, 32 nt, Human
uacuugcuauauugaggaugaaguuuucuaug

SEQ ID NO: 487599 - RNA, 32 nt, Human
uacuugcuggaaaauuaguuggcuggacauug

SEQ ID NO: 487600 - RNA, 32 nt, Human
uacuugcugugggaagagagaugagggucaga

SEQ ID NO: 487601 - RNA, 32 nt, Human
uacuugcuguuuuuauugaucuuaugguuuau

SEQ ID NO: 487602 - RNA, 32 nt, Human
uacuuggaaacugccuuuuccauucacuuaca

SEQ ID NO: 487603 - RNA, 32 nt, Human
uacuuggaagcugaggugggaggaucacuuga

SEQ ID NO: 487604 - RNA, 32 nt, Human
uacuuggaaguaacuuuggaaaagaauuccuu

SEQ ID NO: 487605 - RNA, 32 nt, Human
uacuuggaggcugaggcgugagaaucgcuuga

SEQ ID NO: 487606 - RNA, 32 nt, Human
uacuuggagggcagaggugggaggauggcuug

SEQ ID NO: 487607 - RNA, 20 nt, Human
uacuuggagggcucagggca

SEQ ID NO: 487608 - RNA, 32 nt, Human
uacuuggaggggcagggagcccuuuccucggu

SEQ ID NO: 487609 - RNA, 32 nt, Human
uacuuggcacacacaggaugguguuuuaaaga

SEQ ID NO: 487610 - RNA, 32 nt, Human
uacuuggcacuucaguuucaaacacguagucc

SEQ ID NO: 487611 - RNA, 32 nt, Human
uacuuggcaggcugaggcagaagaaucaccug

SEQ ID NO: 487612 - RNA, 24 nt, Human
uacuuggcccucgccgguggccca

SEQ ID NO: 487613 - RNA, 32 nt, Human
uacuuggccugagacugaccucucccuagguc

SEQ ID NO: 487614 - RNA, 32 nt, Human
uacuuggcggugaggagggcagcuggagaucu

SEQ ID NO: 487615 - RNA, 32 nt, Human
uacuugggaaaaggucaguaggaugugcaucc

SEQ ID NO: 487616 - RNA, 32 nt, Human
uacuugggagagggagaccaugacagaagcca

SEQ ID NO: 487617 - RNA, 32 nt, Human
uacuugggagccuggggcaggagaaucacuug

SEQ ID NO: 487618 - RNA, 32 nt, Human
uacuugggaggaugaggcaggagaaucgcuug

SEQ ID NO: 487619 - RNA, 32 nt, Human
uacuugggaggcaccaucccagagagcuccaa

SEQ ID NO: 487620 - RNA, 32 nt, Human
uacuugggaggcagaggcaggagaaucauuug

SEQ ID NO: 487621 - RNA, 32 nt, Human
uacuugggaggcagaggcaggagaaucgcuug

SEQ ID NO: 487622 - RNA, 32 nt, Human
uacuugggaggcagaggcaggagaaucguuug

SEQ ID NO: 487623 - RNA, 32 nt, Human
uacuugggaggcagaggcaggagaauggcaug

SEQ ID NO: 487624 - RNA, 32 nt, Human
uacuugggaggcagaggcaggagaauugcuug

SEQ ID NO: 487625 - RNA, 32 nt, Human
uacuugggaggcagaggugggaagaugguuug

SEQ ID NO: 487626 - RNA, 32 nt, Human
uacuugggaggcagcggcuggagaauugcuug

SEQ ID NO: 487627 - RNA, 32 nt, Human
uacuugggaggccaaggcaggagaaucgcucg

SEQ ID NO: 487628 - RNA, 32 nt, Human
uacuugggaggccaaggcaggagaaucgcuug

SEQ ID NO: 487629 - RNA, 32 nt, Human
uacuugggaggccgaggcaggagaaucgcuug

SEQ ID NO: 487630 - RNA, 32 nt, Human
uacuugggaggccgaggcaggagaauugcuug

SEQ ID NO: 487631 - RNA, 32 nt, Human
uacuugggaggcggaagcaggaguaucccuug

SEQ ID NO: 487632 - RNA, 32 nt, Human
uacuugggaggcuaaggcaggagaaucgcuug

SEQ ID NO: 487633 - RNA, 32 nt, Human
uacuugggaggcuaaggcaggagaauugcuug

SEQ ID NO: 487634 - RNA, 32 nt, Human
uacuugggaggcuaaggcaggagcaucguuug

SEQ ID NO: 487635 - RNA, 32 nt, Human
uacuugggaggcugaagcaggagaacugccug

SEQ ID NO: 487636 - RNA, 32 nt, Human
uacuugggaggcugaagcaggagaaucgcuug

SEQ ID NO: 487637 - RNA, 32 nt, Human
uacuugggaggcugaagcaggagaauugccug

SEQ ID NO: 487638 - RNA, 32 nt, Human
uacuugggaggcugaagcaggagaauugcucg

SEQ ID NO: 487639 - RNA, 32 nt, Human
uacuugggaggcugaagcaggagagucacuug

SEQ ID NO: 487640 - RNA, 32 nt, Human
uacuugggaggcugaagcaggagcauggcgug

SEQ ID NO: 487641 - RNA, 32 nt, Human
uacuugggaggcugaagcaggaggauagcuag

SEQ ID NO: 487642 - RNA, 32 nt, Human
uacuugggaggcugagacaggagaaucgcuug

SEQ ID NO: 487643 - RNA, 32 nt, Human
uacuugggaggcugagacaggagaauugcuug

SEQ ID NO: 487644 - RNA, 32 nt, Human
uacuugggaggcugaggcagagcugcuugaac

SEQ ID NO: 487645 - RNA, 32 nt, Human
uacuugggaggcugaggcaggagaaccgcuua

SEQ ID NO: 487646 - RNA, 32 nt, Human
uacuugggaggcugaggcaggagaacugcuug

SEQ ID NO: 487647 - RNA, 32 nt, Human
uacuugggaggcugaggcaggagaauagcuug

SEQ ID NO: 487648 - RNA, 32 nt, Human
uacuugggaggcugaggcaggagaaucgccug

SEQ ID NO: 487649 - RNA, 32 nt, Human
uacuugggaggcugaggcaggagaaucgcugg

SEQ ID NO: 487650 - RNA, 32 nt, Human
uacuugggaggcugaggcaggagaaucgcuua

SEQ ID NO: 487651 - RNA, 32 nt, Human
uacuugggaggcugaggcaggagaaucgcuug

SEQ ID NO: 487652 - RNA, 32 nt, Human
uacuugggaggcugaggcaggagaauugcuua

SEQ ID NO: 487653 - RNA, 32 nt, Human
uacuugggaggcugaggcaggagaauugcuug

SEQ ID NO: 487654 - RNA, 32 nt, Human
uacuugggaggcuggggcaggagaauugccug

SEQ ID NO: 487655 - RNA, 32 nt, Human
uacuugggaggcuguggcaggagaaucgcuag

SEQ ID NO: 487656 - RNA, 32 nt, Human
uacuugggagguugaggcaggagaaucgcuug

SEQ ID NO: 487657 - RNA, 32 nt, Human
uacuugggggacugaggcgggaggaucacuug

SEQ ID NO: 487658 - RNA, 32 nt, Human
uacuugggggccugaggcacgagaaucgcuug

SEQ ID NO: 487659 - RNA, 32 nt, Human
uacuuggggugagcggaaagcauggcggggac

SEQ ID NO: 487660 - RNA, 32 nt, Human
uacuugguaggcugaggcaggagaaucgcuug

SEQ ID NO: 487661 - RNA, 32 nt, Human
uacuugguaggcugaggcaggagaauggcggg

SEQ ID NO: 487662 - RNA, 32 nt, Human
uacuugguaggcuguggcaggagaauggcgug

SEQ ID NO: 487663 - RNA, 32 nt, Human
uacuuggugguggaauguuacagugagaccug

SEQ ID NO: 487664 - RNA, 32 nt, Human
uacuugguuacaucacggcucugguucagaua

SEQ ID NO: 487665 - RNA, 32 nt, Human
uacuuguaauaauacaaauaagucagcugaug

SEQ ID NO: 487666 - RNA, 32 nt, Human
uacuuguacaauuuuugaucuacagcaucacg

SEQ ID NO: 487667 - RNA, 32 nt, Human
uacuugucaagaaagaagcaauguuggucagu

SEQ ID NO: 487668 - RNA, 32 nt, Human
uacuugucaccagcuccaagccccagacagca

SEQ ID NO: 487669 - RNA, 32 nt, Human
uacuugucauuucuuuaggucuugccuuccca

SEQ ID NO: 487670 - RNA, 31 nt, Human
uacuugucucuuuucugauauuaggacugau

SEQ ID NO: 487671 - RNA, 32 nt, Human
uacuugucuuauuccuccuuuccuuucuuuaa

SEQ ID NO: 487672 - RNA, 32 nt, Human
uacuugucuuggauagguugcugguaaaccau

SEQ ID NO: 487673 - RNA, 32 nt, Human
uacuuguguguguuugggggagugggaauugg

SEQ ID NO: 487674 - RNA, 32 nt, Human
uacuuguuccuccaaagcauucuccccagcau

SEQ ID NO: 487675 - RNA, 32 nt, Human
uacuuguugggaggaggaggaaagggaaggcu

SEQ ID NO: 487676 - RNA, 32 nt, Human
uacuuguuuagaagaaggaaagugauugauuc

SEQ ID NO: 487677 - RNA, 32 nt, Human
uacuuguuucaacuuagagaacaguuaugaug

SEQ ID NO: 487678 - RNA, 32 nt, Human
uacuuguuuuucccaucucuuccuuuccaauu

SEQ ID NO: 487679 - RNA, 32 nt, Human
uacuuuaagacauacuccuuccaucaaauaga

SEQ ID NO: 487680 - RNA, 22 nt, Human
uacuuuacaaaccauuaccugu

SEQ ID NO: 487681 - RNA, 32 nt, Human
uacuuuaccagacuuuacuuuguacucagaga

SEQ ID NO: 487682 - RNA, 32 nt, Human
uacuuuagaagaggauaauggauaaaaucaau

SEQ ID NO: 487683 - RNA, 32 nt, Human
uacuuuagccacaaagcuaaaacagcauuacc

SEQ ID NO: 487684 - RNA, 32 nt, Human
uacuuuagggacuguuguaauuucucauaugg

SEQ ID NO: 487685 - RNA, 31 nt, Human
uacuuuauacuuuucugugcuugacagauuu

SEQ ID NO: 487686 - RNA, 32 nt, Human
uacuuuauaucacauggugaaggauuuugcuu

SEQ ID NO: 487687 - RNA, 32 nt, Human
uacuuuaucaaggggaaccaagccugcugugc

SEQ ID NO: 487688 - RNA, 32 nt, Human
uacuuuaugagggcuggagugcacuggagcaa

SEQ ID NO: 487689 - RNA, 32 nt, Human
uacuuuauugacaaaaaggcagugaacauaac

SEQ ID NO: 487690 - RNA, 32 nt, Human
uacuuucaaaaauguuacugugaugaaaaauc

SEQ ID NO: 487691 - RNA, 32 nt, Human
uacuuucaaagucauauccaagaaagacaaua

SEQ ID NO: 487692 - RNA, 32 nt, Human
uacuuucaagccuucguucuuccuugagcauc

SEQ ID NO: 487693 - RNA, 32 nt, Human
uacuuucagaggaagcagagaaguugcuguua

SEQ ID NO: 487694 - RNA, 32 nt, Human
uacuuucagcagggcuuugaggcugggaaacu

SEQ ID NO: 487695 - RNA, 32 nt, Human
uacuuucaguagcaucuuuccacagcaagggc

SEQ ID NO: 487696 - RNA, 32 nt, Human
uacuuucaguauacuccauagaccaaagagca

SEQ ID NO: 487697 - RNA, 32 nt, Human
uacuuucagucuaacacagcacugccugcuuu

SEQ ID NO: 487698 - RNA, 32 nt, Human
uacuuucauucaggcuggagugcaguggcaug

SEQ ID NO: 487699 - RNA, 32 nt, Human
uacuuuccacagaaguacuuguaggagcucuc

SEQ ID NO: 487700 - RNA, 32 nt, Human
uacuuuccacauuuugacuauuacaagcuucu

SEQ ID NO: 487701 - RNA, 32 nt, Human
uacuuuccauaucuccugaguuggagauacuu

SEQ ID NO: 487702 - RNA, 32 nt, Human
uacuuucccaacaggaagucugaucuguugcc

SEQ ID NO: 487703 - RNA, 32 nt, Human
uacuuucccugccugccucccucccccugcua

SEQ ID NO: 487704 - RNA, 32 nt, Human
uacuuuccuugugcaauggagggagacgaucu

SEQ ID NO: 487705 - RNA, 32 nt, Human
uacuuucuauccuuuaaugccuaaaacuccau

SEQ ID NO: 487706 - RNA, 32 nt, Human
uacuuucucagcgcuguguggagggggaaugc

SEQ ID NO: 487707 - RNA, 32 nt, Human
uacuuucucaggguguucuuguccucaucuac

SEQ ID NO: 487708 - RNA, 32 nt, Human
uacuuucucuuccugguaauccucuggcccag

SEQ ID NO: 487709 - RNA, 32 nt, Human
uacuuucuggggccucuccuguugaauggcua

SEQ ID NO: 487710 - RNA, 32 nt, Human
uacuuucuuauaugaguuuacacaagucugug

SEQ ID NO: 487711 - RNA, 32 nt, Human
uacuuucuuugcuguaguuaugaaccuugggg

SEQ ID NO: 487712 - RNA, 32 nt, Human
uacuuugaaaugcaugagaaucaugcugcaau

SEQ ID NO: 487713 - RNA, 32 nt, Human
uacuuugaaauuccuugauuuguaauucaaug

SEQ ID NO: 487714 - RNA, 32 nt, Human
uacuuugacauuuaaagagaaauuuagagaau

SEQ ID NO: 487715 - RNA, 32 nt, Human
uacuuugacccccaggcuggagugcaguggca

SEQ ID NO: 487716 - RNA, 32 nt, Human
uacuuugaccugccaggagcucuucugugugc

SEQ ID NO: 487717 - RNA, 32 nt, Human
uacuuugacugcuguuaagcaauguuuagaaa

SEQ ID NO: 487718 - RNA, 32 nt, Human
uacuuugagaagaguccaaggaucuggccguc

SEQ ID NO: 487719 - RNA, 32 nt, Human
uacuuugagucuccauccccagaauuuccagc

SEQ ID NO: 487720 - RNA, 32 nt, Human
uacuuugauuauuuuuauuucuuauacucugu

SEQ ID NO: 487721 - RNA, 22 nt, Human
uacuuugauuuacagugccugu

SEQ ID NO: 487722 - RNA, 32 nt, Human
uacuuugccucaagcaaccucuagcucccaca

SEQ ID NO: 487723 - RNA, 32 nt, Human
uacuuugccuuagagaaggaaguacuuaccuu

SEQ ID NO: 487724 - RNA, 32 nt, Human
uacuuuggacacaaaccaaaacacacaccaaa

SEQ ID NO: 487725 - RNA, 32 nt, Human
uacuuuggcagggggugcuggggaaggggcug

SEQ ID NO: 487726 - RNA, 32 nt, Human
uacuuuggcuuccuuuuguaugauaggucccc

SEQ ID NO: 487727 - RNA, 32 nt, Human
uacuuugggagaccaaggugggcagaucacuu

SEQ ID NO: 487728 - RNA, 32 nt, Human
uacuuugggagaccgaggugggcagaucacuu

SEQ ID NO: 487729 - RNA, 32 nt, Human
uacuuugggaggccaaggcaagcagaucaccu

SEQ ID NO: 487730 - RNA, 32 nt, Human
uacuuugggaggccaaggcgggcagaucacaa

SEQ ID NO: 487731 - RNA, 32 nt, Human
uacuuugggaggcccaggugggaggaucgcuu

SEQ ID NO: 487732 - RNA, 32 nt, Human
uacuuugggaggccgaggcagguggaucaccu

SEQ ID NO: 487733 - RNA, 32 nt, Human
uacuuugggaggccgaggcggguggaucacga

SEQ ID NO: 487734 - RNA, 32 nt, Human
uacuuugggaggccgaggugggcagaucacaa

SEQ ID NO: 487735 - RNA, 32 nt, Human
uacuuugggaggcugagcugggcagaucaccu

SEQ ID NO: 487736 - RNA, 32 nt, Human
uacuuugggaggcugaggcaagugaagcacuu

SEQ ID NO: 487737 - RNA, 32 nt, Human
uacuuugggaggcugaggcgggaggauugcuu

SEQ ID NO: 487738 - RNA, 32 nt, Human
uacuuugggggaacaaaauagucagggauauu

SEQ ID NO: 487739 - RNA, 32 nt, Human
uacuuugggugcuccauagaugcucauuuguc

SEQ ID NO: 487740 - RNA, 32 nt, Human
uacuuuggugaguuuggggaggugaauuucuc

SEQ ID NO: 487741 - RNA, 32 nt, Human
uacuuuggugucuccaccacugucccuucucc

SEQ ID NO: 487742 - RNA, 32 nt, Human
uacuuugguugaggccuucgaaucacucuuca

SEQ ID NO: 487743 - RNA, 32 nt, Human
uacuuuguccuccaaaaagcuaacauacgguu

SEQ ID NO: 487744 - RNA, 32 nt, Human
uacuuuguccuuucugacuuuuguuguaaaga

SEQ ID NO: 487745 - RNA, 18 nt, Human
uacuuugucugguaccug

SEQ ID NO: 487746 - RNA, 32 nt, Human
uacuuuguucacaaacgugugauuuagauaug

SEQ ID NO: 487747 - RNA, 32 nt, Human
uacuuuguuccaggaacuaugcuggaaacuga

SEQ ID NO: 487748 - RNA, 32 nt, Human
uacuuuguugaaacaucaaccugggcagaaaa

SEQ ID NO: 487749 - RNA, 32 nt, Human
uacuuuguugcccaggcuggucucaaacuccu

SEQ ID NO: 487750 - RNA, 32 nt, Human
uacuuuguugggggacuuuggaggcgggcagg

SEQ ID NO: 487751 - RNA, 32 nt, Human
uacuuuguuuccugaagugauagccuacuaau

SEQ ID NO: 487752 - RNA, 32 nt, Human
uacuuuguuuuuaaauuaugcuuucuauuuug

SEQ ID NO: 487753 - RNA, 32 nt, Human
uacuuuuaaauggauuuuuaaagauucuuccc

SEQ ID NO: 487754 - RNA, 25 nt, Human
uacuuuuacucuuguacauauguug

SEQ ID NO: 487755 - RNA, 32 nt, Human
uacuuuuagccugaaaccucuuccacgccaug

SEQ ID NO: 487756 - RNA, 24 nt, Human
uacuuuuaguuuuaaaaugaaauc

SEQ ID NO: 487757 - RNA, 32 nt, Human
uacuuuucaagcaaauucaacaaaucagugua

SEQ ID NO: 487758 - RNA, 32 nt, Human
uacuuuucagcuuuuuaaaaggccaauuuuug

SEQ ID NO: 487759 - RNA, 32 nt, Human
uacuuuucaguuagauauacuucugcauaaag

SEQ ID NO: 487760 - RNA, 32 nt, Human
uacuuuuccacucuaggccacgaugccgcagu

SEQ ID NO: 487761 - RNA, 32 nt, Human
uacuuuuccaggcuggauuguaucuaugcccc

SEQ ID NO: 487762 - RNA, 32 nt, Human
uacuuuucuccaauaccugccaauacagaaaa

SEQ ID NO: 487763 - RNA, 32 nt, Human
uacuuuucucuaguuguuaaauagcuggaguu

SEQ ID NO: 487764 - RNA, 32 nt, Human
uacuuuucugagauuuggcuuauuuuuauuau

SEQ ID NO: 487765 - RNA, 32 nt, Human
uacuuuugaggugaaaagcuaagcuagggccu

SEQ ID NO: 487766 - RNA, 32 nt, Human
uacuuuugccauguuuucauuuccuugacuua

SEQ ID NO: 487767 - RNA, 32 nt, Human
uacuuuugccuaaaagcauuuauccuucauac

SEQ ID NO: 487768 - RNA, 32 nt, Human
uacuuuuggaaagagggacugaugggagcuga

SEQ ID NO: 487769 - RNA, 32 nt, Human
uacuuuugggcccaacacuugcaguugccuuc

SEQ ID NO: 487770 - RNA, 32 nt, Human
uacuuuuggggacuugcccacaucucugggau

SEQ ID NO: 487771 - RNA, 32 nt, Human
uacuuuugggucgggcccuccgggaagauggc

SEQ ID NO: 487772 - RNA, 32 nt, Human
uacuuuuucucuucccuuuaaugcuugcagaa

SEQ ID NO: 487773 - RNA, 32 nt, Human
uacuuuuucuucuucuugcuggugauggucuu

SEQ ID NO: 487774 - RNA, 32 nt, Human
uagaaaaacugagauuuucuucccucugugcu

SEQ ID NO: 487775 - RNA, 32 nt, Human
uagaaaaacuuagccaggcaugguggcaggug

SEQ ID NO: 487776 - RNA, 32 nt, Human
uagaaaaagcaguugaggauugguuuggauug

SEQ ID NO: 487777 - RNA, 32 nt, Human
uagaaaaaguggagcaggcagggccuugcacc

SEQ ID NO: 487778 - RNA, 32 nt, Human
uagaaaaauguucuuuaaaggcaucuacacaa

SEQ ID NO: 487779 - RNA, 28 nt, Human
uagaaaacaagugcuuuuuaucuugaaa

SEQ ID NO: 487780 - RNA, 32 nt, Human
uagaaaacaauguuuuaaaucacccaaauuua

SEQ ID NO: 487781 - RNA, 32 nt, Human
uagaaaacacaaaccacaacugacacaggaaa

SEQ ID NO: 487782 - RNA, 32 nt, Human
uagaaaacacaagcauuugaccaaaugagauc

SEQ ID NO: 487783 - RNA, 32 nt, Human
uagaaaacauauguuuacauuugauuaacugu

SEQ ID NO: 487784 - RNA, 32 nt, Human
uagaaaaccacagccucagauacuggggacuu

SEQ ID NO: 487785 - RNA, 32 nt, Human
uagaaaaccacccuucaaccugggugaugcuc

SEQ ID NO: 487786 - RNA, 32 nt, Human
uagaaaaccagcucagcacugccugcucccau

SEQ ID NO: 487787 - RNA, 32 nt, Human
uagaaaaccuaaaagaaaugauacauuccugg

SEQ ID NO: 487788 - RNA, 32 nt, Human
uagaaaacugauuuuagaguucugaucguuca

SEQ ID NO: 487789 - RNA, 23 nt, Human
uagaaaacuggucaaggaagcua

SEQ ID NO: 487790 - RNA, 32 nt, Human
uagaaaagaaagcauuuaccugccugucugua

SEQ ID NO: 487791 - RNA, 32 nt, Human
uagaaaagagcaagaaugcacauguauaaagu

SEQ ID NO: 487792 - RNA, 32 nt, Human
uagaaaagagcagagaaugacguggacauugg

SEQ ID NO: 487793 - RNA, 22 nt, Human
uagaaaagaggacuggucuugg

SEQ ID NO: 487794 - RNA, 32 nt, Human
uagaaaagccaucuucauucguggagacugug

SEQ ID NO: 487795 - RNA, 32 nt, Human
uagaaaaggaauaugcuacuguugccagccaa

SEQ ID NO: 487796 - RNA, 32 nt, Human
uagaaaaggagaggguccgaggguggugggag

SEQ ID NO: 487797 - RNA, 20 nt, Human
uagaaaaggaugaguucaua

SEQ ID NO: 487798 - RNA, 32 nt, Human
uagaaaaggcugcagacagucacagggaagug

SEQ ID NO: 487799 - RNA, 32 nt, Human
uagaaaaggggagacucacuucccugggagaa

SEQ ID NO: 487800 - RNA, 32 nt, Human
uagaaaagucauaucuccucacauuuuacuaa

SEQ ID NO: 487801 - RNA, 32 nt, Human
uagaaaagugaucucaguuggcccaagaugac

SEQ ID NO: 487802 - RNA, 32 nt, Human
uagaaaaguggcccagaaacagcagcuuaaag

SEQ ID NO: 487803 - RNA, 32 nt, Human
uagaaaaguugccagaaugcuguggaguuuua

SEQ ID NO: 487804 - RNA, 32 nt, Human
uagaaaauaaauagaagagacagugaagcaag

SEQ ID NO: 487805 - RNA, 32 nt, Human
uagaaaauacccuuuuuagaaauccaguuuua

SEQ ID NO: 487806 - RNA, 32 nt, Human
uagaaaauaguuguguguaucuuucugaggaa

SEQ ID NO: 487807 - RNA, 19 nt, Human
uagaaaauguguuuaguua

SEQ ID NO: 487808 - RNA, 32 nt, Human
uagaaaauugaauaugagguucaggagauagg

SEQ ID NO: 487809 - RNA, 32 nt, Human
uagaaaauugagaaggacuaggaagcugauag

SEQ ID NO: 487810 - RNA, 32 nt, Human
uagaaaauuuguacugaggggaauucuauuca

SEQ ID NO: 487811 - RNA, 31 nt, Human
uagaaacaaguguccaucacuaggacacuag

SEQ ID NO: 487812 - RNA, 32 nt, Human
uagaaacaccugccagugucaaggauuccagu

SEQ ID NO: 487813 - RNA, 32 nt, Human
uagaaacacuggcugcagcaaucaaccuccug

SEQ ID NO: 487814 - RNA, 32 nt, Human
uagaaacagaacauauggacugcucugaccuu

SEQ ID NO: 487815 - RNA, 32 nt, Human
uagaaacagauccgccagcccaaacagaaccu

SEQ ID NO: 487816 - RNA, 31 nt, Human
uagaaacaggaaucaaugacagcagaacucc

SEQ ID NO: 487817 - RNA, 32 nt, Human
uagaaacagugaucguugcagaaaaauaauua

SEQ ID NO: 487818 - RNA, 32 nt, Human
uagaaaccaaaaugcuauuuuaaaguaguuuc

SEQ ID NO: 487819 - RNA, 32 nt, Human
uagaaaccaaaccaaaugggcacccucgguug

SEQ ID NO: 487820 - RNA, 32 nt, Human
uagaaaccaaaccgcacacaaucuugcacacu

SEQ ID NO: 487821 - RNA, 32 nt, Human
uagaaaccagagccuucuccccaggccugccc

SEQ ID NO: 487822 - RNA, 32 nt, Human
uagaaaccagccuggccaacauggcaaaaccc

SEQ ID NO: 487823 - RNA, 32 nt, Human
uagaaaccagccuggccaacguggugaaaccc

SEQ ID NO: 487824 - RNA, 20 nt, Human
uagaaacccaggcucaugga

SEQ ID NO: 487825 - RNA, 32 nt, Human
uagaaacccauuguugaaacuccuguagcuau

SEQ ID NO: 487826 - RNA, 21 nt, Human
uagaaaccgacguuucaggga

SEQ ID NO: 487827 - RNA, 32 nt, Human
uagaaaccguaaauuuaacuuaaggauuuucu

SEQ ID NO: 487828 - RNA, 32 nt, Human
uagaaaccucccaaauucuuaaagcuaaauua

SEQ ID NO: 487829 - RNA, 32 nt, Human
uagaaaccugagauggagacagaaggagggga

SEQ ID NO: 487830 - RNA, 32 nt, Human
uagaaacguggcuuugggcuguggaaacgcug

SEQ ID NO: 487831 - RNA, 32 nt, Human
uagaaacuacgucugucauacugggagcuuua

SEQ ID NO: 487832 - RNA, 26 nt, Human
uagaaacucaguucccuucucagggg

SEQ ID NO: 487833 - RNA, 32 nt, Human
uagaaacuccauuaaucaucugauuuuccgaa

SEQ ID NO: 487834 - RNA, 32 nt, Human
uagaaacucuucuagcugauaucaugaaacga

SEQ ID NO: 487835 - RNA, 32 nt, Human
uagaaacugaguaguuuggauuuuuauggcuc

SEQ ID NO: 487836 - RNA, 32 nt, Human
uagaaacuguaacugccccugauugggcaggc

SEQ ID NO: 487837 - RNA, 32 nt, Human
uagaaagaaaagaacacuugcccagggcagcu

SEQ ID NO: 487838 - RNA, 32 nt, Human
uagaaagaaagaggagggacaagcaagcccau

SEQ ID NO: 487839 - RNA, 32 nt, Human
uagaaagaauuggccaggcaugguggcucaug

SEQ ID NO: 487840 - RNA, 32 nt, Human
uagaaagacaguccuggugaaugggcuucaag

SEQ ID NO: 487841 - RNA, 32 nt, Human
uagaaagagccaggguucaaagcuggcgaaug

SEQ ID NO: 487842 - RNA, 32 nt, Human
uagaaagagggaaggagcaggagacgacaggg

SEQ ID NO: 487843 - RNA, 32 nt, Human
uagaaagagugggacccuuucuggccugugau

SEQ ID NO: 487844 - RNA, 32 nt, Human
uagaaagaucccuagaaagagcaaagaaggaa

SEQ ID NO: 487845 - RNA, 32 nt, Human
uagaaagaugcuagaaaaauguucuuuaaagg

SEQ ID NO: 487846 - RNA, 32 nt, Human
uagaaagcaaacaugugcagauauccaaacaa

SEQ ID NO: 487847 - RNA, 32 nt, Human
uagaaagcaacuuggaaguguaaagagucacc

SEQ ID NO: 487848 - RNA, 32 nt, Human
uagaaagcaagaaugucaacaguguuagaugg

SEQ ID NO: 487849 - RNA, 32 nt, Human
uagaaagcaaguguuaccaaaguuguguuauc

SEQ ID NO: 487850 - RNA, 19 nt, Human
uagaaagccaaucaucuca

SEQ ID NO: 487851 - RNA, 32 nt, Human
uagaaagccaugugcagccaccaguccauugg

SEQ ID NO: 487852 - RNA, 32 nt, Human
uagaaagcucacaacuuuaaaaccuacaaaaa

SEQ ID NO: 487853 - RNA, 32 nt, Human
uagaaaggacauuucugccauuguucaggcug

SEQ ID NO: 487854 - RNA, 32 nt, Human
uagaaaggagagaaaaagcaccucuuuuggcu

SEQ ID NO: 487855 - RNA, 32 nt, Human
uagaaaggagagaacgggcgucaggggugcac

SEQ ID NO: 487856 - RNA, 32 nt, Human
uagaaaggagccucuuucuuaaaaccaaccaa

SEQ ID NO: 487857 - RNA, 32 nt, Human
uagaaaggaucuuggggcuuguuuucucuagg

SEQ ID NO: 487858 - RNA, 32 nt, Human
uagaaaggcacugcaggcugggcgcaggggcu

SEQ ID NO: 487859 - RNA, 32 nt, Human
uagaaaggcauccaggaauuguuuuccuacgc

SEQ ID NO: 487860 - RNA, 32 nt, Human
uagaaagggagguggcggauggagugggaagu

SEQ ID NO: 487861 - RNA, 32 nt, Human
uagaaaggguguggagggaggaagggggucua

SEQ ID NO: 487862 - RNA, 32 nt, Human
uagaaagguaacuccauagcugggagccaagu

SEQ ID NO: 487863 - RNA, 32 nt, Human
uagaaagguaugugaauaaauauguucaugcu

SEQ ID NO: 487864 - RNA, 32 nt, Human
uagaaagguuaggaagaaagaggagacaagga

SEQ ID NO: 487865 - RNA, 32 nt, Human
uagaaaguauaaaauauugccuccaacaugcu

SEQ ID NO: 487866 - RNA, 32 nt, Human
uagaaaguauuggcagaccaggcgugguggcg

SEQ ID NO: 487867 - RNA, 32 nt, Human
uagaaagucaguuucccggcacuggcaccccg

SEQ ID NO: 487868 - RNA, 32 nt, Human
uagaaagugaaaaaugagcaguauuugggcag

SEQ ID NO: 487869 - RNA, 32 nt, Human
uagaaagugaagaugcucaaauggugcuaugu

SEQ ID NO: 487870 - RNA, 32 nt, Human
uagaaaguggaaaugagguugcuauggaaacu

SEQ ID NO: 487871 - RNA, 32 nt, Human
uagaaaguguaaaauucuuggaaaagauuuuc

SEQ ID NO: 487872 - RNA, 32 nt, Human
uagaaaguugcuggagugagaaaugagccugu

SEQ ID NO: 487873 - RNA, 32 nt, Human
uagaaauaaccuaaaacugcagaaggaucuga

SEQ ID NO: 487874 - RNA, 26 nt, Human
uagaaauacagaaaugugcccagggg

SEQ ID NO: 487875 - RNA, 32 nt, Human
uagaaauacagaauaucacaaauguauaaagg

SEQ ID NO: 487876 - RNA, 32 nt, Human
uagaaauacauuacccucccacuccccaaguu

SEQ ID NO: 487877 - RNA, 32 nt, Human
uagaaauagacuuagcugggugcaguggcuca

SEQ ID NO: 487878 - RNA, 32 nt, Human
uagaaauaguaggaaguauugcagaagucaau

SEQ ID NO: 487879 - RNA, 32 nt, Human
uagaaauauauuagggaaagaaaguagccuuc

SEQ ID NO: 487880 - RNA, 32 nt, Human
uagaaaucagccagcagguggcagguucuggg

SEQ ID NO: 487881 - RNA, 32 nt, Human
uagaaaucagcuuuuaagcucccaugugauga

SEQ ID NO: 487882 - RNA, 32 nt, Human
uagaaaucgugugacuuuaaggauuuagauuu

SEQ ID NO: 487883 - RNA, 32 nt, Human
uagaaaucucugaaggcagcagccaucauccu

SEQ ID NO: 487884 - RNA, 32 nt, Human
uagaaaucugaucucggcuccaaccaacagcc

SEQ ID NO: 487885 - RNA, 32 nt, Human
uagaaaucuggugaccuaaggcucaguguggu

SEQ ID NO: 487886 - RNA, 32 nt, Human
uagaaaucuugaucucugcguuuuucuaugga

SEQ ID NO: 487887 - RNA, 32 nt, Human
uagaaaucuuguaggagcucuguuagcucuaa

SEQ ID NO: 487888 - RNA, 32 nt, Human
uagaaaugaaagcucaggaucucugaauuggg

SEQ ID NO: 487889 - RNA, 32 nt, Human
uagaaaugacucuaucagccucagccaaaccu

SEQ ID NO: 487890 - RNA, 32 nt, Human
uagaaaugaggaugucaucuuccuucacuuuu

SEQ ID NO: 487891 - RNA, 32 nt, Human
uagaaaugcaauauuuaguuucauccagcucu

SEQ ID NO: 487892 - RNA, 32 nt, Human
uagaaauggaaauuuugcuaucaacaauaaaa

SEQ ID NO: 487893 - RNA, 32 nt, Human
uagaaauguagaagaagcaaguggccagaugg

SEQ ID NO: 487894 - RNA, 22 nt, Human
uagaaauguggaaaucuguauu

SEQ ID NO: 487895 - RNA, 19 nt, Human
uagaaauuagguccuuggg

SEQ ID NO: 487896 - RNA, 32 nt, Human
uagaaauucuacugcacugccuggcucagcug

SEQ ID NO: 487897 - RNA, 32 nt, Human
uagaaauucucagcagacagugggauggagaa

SEQ ID NO: 487898 - RNA, 24 nt, Human
uagaaauugaaagggccuugggua

SEQ ID NO: 487899 - RNA, 32 nt, Human
uagaaauugagguugagaggaacucaggagau

SEQ ID NO: 487900 - RNA, 24 nt, Human
uagaaauugauuuuucuuggugua

SEQ ID NO: 487901 - RNA, 26 nt, Human
uagaaauuuauuuccuaguucuguag

SEQ ID NO: 487902 - RNA, 32 nt, Human
uagaaauuugaguaaagaaacaauaaggaccu

SEQ ID NO: 487903 - RNA, 32 nt, Human
uagaacaacuccaucagaacagcuccaccggg

SEQ ID NO: 487904 - RNA, 32 nt, Human
uagaacaauuugagccugagugaguucugugg

SEQ ID NO: 487905 - RNA, 32 nt, Human
uagaacagaaaugcuuauuuuauauuuggcug

SEQ ID NO: 487906 - RNA, 32 nt, Human
uagaacagagccgccugcccaggacccucagg

SEQ ID NO: 487907 - RNA, 32 nt, Human
uagaacagauggagccccucuccucuguagcg

SEQ ID NO: 487908 - RNA, 32 nt, Human
uagaacagccuccuuacuccagccuggcaggg

SEQ ID NO: 487909 - RNA, 32 nt, Human
uagaacagcugggaaaaagaaaauaauccauu

SEQ ID NO: 487910 - RNA, 32 nt, Human
uagaacaggagaaucacuugauggcugccagg

SEQ ID NO: 487911 - RNA, 32 nt, Human
uagaacaggugugguuucaccauauugcccag

SEQ ID NO: 487912 - RNA, 32 nt, Human
uagaacagucugcugggagucagaccuggaau

SEQ ID NO: 487913 - RNA, 32 nt, Human
uagaacagugccuggcacauaguaggcacuca

SEQ ID NO: 487914 - RNA, 32 nt, Human
uagaacagugccuggcacauaguaggcgcuca

SEQ ID NO: 487915 - RNA, 32 nt, Human
uagaacaugccguuucaugucaccugcuacag

SEQ ID NO: 487916 - RNA, 32 nt, Human
uagaacauuuuauuuuccuuguucaccauaca

SEQ ID NO: 487917 - RNA, 32 nt, Human
uagaaccaaaaacgccagucaugggaggcaga

SEQ ID NO: 487918 - RNA, 32 nt, Human
uagaaccacccgcucucucuuccuuuagccag

SEQ ID NO: 487919 - RNA, 32 nt, Human
uagaaccaccucagguacugaugaaccccacu

SEQ ID NO: 487920 - RNA, 32 nt, Human
uagaaccagcagaagccagagggugggagggg

SEQ ID NO: 487921 - RNA, 21 nt, Human
uagaaccaggcugcccucuac

SEQ ID NO: 487922 - RNA, 32 nt, Human
uagaaccaggucucacuauguugcccaggcua

SEQ ID NO: 487923 - RNA, 32 nt, Human
uagaacccaggagacggagguugcagugagcc

SEQ ID NO: 487924 - RNA, 32 nt, Human
uagaacccaggagguggagacugcagugagcc

SEQ ID NO: 487925 - RNA, 24 nt, Human
uagaaccccaggugaaggcacuua

SEQ ID NO: 487926 - RNA, 32 nt, Human
uagaacccggcucuggggcacuggccuaguuc

SEQ ID NO: 487927 - RNA, 32 nt, Human
uagaacccugagcacuggaggaagagcgccug

SEQ ID NO: 487928 - RNA, 32 nt, Human
uagaacccuuccugcaguauucauacaguguu

SEQ ID NO: 487929 - RNA, 32 nt, Human
uagaaccgggaggcggaaguugcagugagcca

SEQ ID NO: 487930 - RNA, 32 nt, Human
uagaaccuaccucccugcccagucagcaggcu

SEQ ID NO: 487931 - RNA, 32 nt, Human
uagaaccucuacuggcugaugccaacaucauc

SEQ ID NO: 487932 - RNA, 32 nt, Human
uagaaccugcugcacaggggcugggaauggga

SEQ ID NO: 487933 - RNA, 32 nt, Human
uagaaccugcuucucugaucuguguguuuccu

SEQ ID NO: 487934 - RNA, 32 nt, Human
uagaaccugucuuccucccuggcauugugggg

SEQ ID NO: 487935 - RNA, 32 nt, Human
uagaaccuguucucugccgucuuuggcucagc

SEQ ID NO: 487936 - RNA, 32 nt, Human
uagaaccuucuuuccuaauccccuuaucuuca

SEQ ID NO: 487937 - RNA, 32 nt, Human
uagaacgggaggcugcugaagugaguagcuga

SEQ ID NO: 487938 - RNA, 32 nt, Human
uagaacgugugcuucaugacccguuguacaga

SEQ ID NO: 487939 - RNA, 32 nt, Human
uagaacuaaggcuucugcuuccuugcugcugu

SEQ ID NO: 487940 - RNA, 32 nt, Human
uagaacuaauugaccuuucuaaaacagcauuu

SEQ ID NO: 487941 - RNA, 32 nt, Human
uagaacuacuaaaguuccaguaguuaggccau

SEQ ID NO: 487942 - RNA, 32 nt, Human
uagaacucacauuuuaaucagggauugcauuu

SEQ ID NO: 487943 - RNA, 32 nt, Human
uagaacucaccucucacacucuguucuuuagu

SEQ ID NO: 487944 - RNA, 32 nt, Human
uagaacucagaggaagaggcaggggcagcagc

SEQ ID NO: 487945 - RNA, 32 nt, Human
uagaacucccccaggcccugccauuggguugu

SEQ ID NO: 487946 - RNA, 32 nt, Human
uagaacugcaccauuggcucucuuggguuucc

SEQ ID NO: 487947 - RNA, 32 nt, Human
uagaacugguuccccucaccacccaaccuacc

SEQ ID NO: 487948 - RNA, 32 nt, Human
uagaacugucguaaagguguagaagggagaga

SEQ ID NO: 487949 - RNA, 32 nt, Human
uagaacuucaagcucuuucuucacucaggagg

SEQ ID NO: 487950 - RNA, 32 nt, Human
uagaacuucucucccuuuuucucccucauucc

SEQ ID NO: 487951 - RNA, 32 nt, Human
uagaacuugauuguugagacgccuugcuagag

SEQ ID NO: 487952 - RNA, 32 nt, Human
uagaacuuggcuggaugcaguggcucacaccu

SEQ ID NO: 487953 - RNA, 32 nt, Human
uagaacuuuuucugcugaccuacccggucagu

SEQ ID NO: 487954 - RNA, 32 nt, Human
uagaagaaagagaaaccuucacuuuggcauuu

SEQ ID NO: 487955 - RNA, 32 nt, Human
uagaagaaaugcugaagcaagcauaugaguuu

SEQ ID NO: 487956 - RNA, 32 nt, Human
uagaagaacagacaucuuccagcagcugucag

SEQ ID NO: 487957 - RNA, 32 nt, Human
uagaagaacaucacuuuuaaccuugcuuuggc

SEQ ID NO: 487958 - RNA, 19 nt, Human
uagaagaagccaagaauuu

SEQ ID NO: 487959 - RNA, 32 nt, Human
uagaagaagugggaagaagaaggagcucuaca

SEQ ID NO: 487960 - RNA, 32 nt, Human
uagaagaauugugacuguaaagccacuucuau

SEQ ID NO: 487961 - RNA, 32 nt, Human
uagaagacuguucugcaauuugcugccaaaug

SEQ ID NO: 487962 - RNA, 32 nt, Human
uagaagacuugacagcuugagaauagaggaaa

SEQ ID NO: 487963 - RNA, 32 nt, Human
uagaagagaaaggcuuccccuacaccccagcc

SEQ ID NO: 487964 - RNA, 32 nt, Human
uagaagagacaggagacaggaagccuucccau

SEQ ID NO: 487965 - RNA, 20 nt, Human
uagaagagauagggggucuu

SEQ ID NO: 487966 - RNA, 32 nt, Human
uagaagagaugggauuucaucauguuggccag

SEQ ID NO: 487967 - RNA, 32 nt, Human
uagaagagaugggguuucuccauguuggccag

SEQ ID NO: 487968 - RNA, 32 nt, Human
uagaagagccacaagaccacacacacagcccu

SEQ ID NO: 487969 - RNA, 32 nt, Human
uagaagagcuucccccugacacccugugacug

SEQ ID NO: 487970 - RNA, 32 nt, Human
uagaagagcuuugagagaggugggcccacggg

SEQ ID NO: 487971 - RNA, 32 nt, Human
uagaagaggaaggcuuugugcagcaguagcgu

SEQ ID NO: 487972 - RNA, 32 nt, Human
uagaagaggcgggguuucaccauguuggccag

SEQ ID NO: 487973 - RNA, 32 nt, Human
uagaagaggcggguacugucacuguguaaaau

SEQ ID NO: 487974 - RNA, 32 nt, Human
uagaagauaagaaacaugucaucauauuuaaa

SEQ ID NO: 487975 - RNA, 32 nt, Human
uagaagauagcuuaaccuguagguacauguua

SEQ ID NO: 487976 - RNA, 32 nt, Human
uagaagauaugggcuuuuggaagcacugauug

SEQ ID NO: 487977 - RNA, 21 nt, Human
uagaagaucugacugauguua

SEQ ID NO: 487978 - RNA, 32 nt, Human
uagaagauggugaaauagacgaugcaggauuu

SEQ ID NO: 487979 - RNA, 32 nt, Human
uagaagauucuauucugcuggccaguggaaca

SEQ ID NO: 487980 - RNA, 32 nt, Human
uagaagcaaaacugagugauaacucaugagaa

SEQ ID NO: 487981 - RNA, 32 nt, Human
uagaagcaaaggaggcugggcacaguggcuca

SEQ ID NO: 487982 - RNA, 32 nt, Human
uagaagcaacaaggcccuagcuggagacucug

SEQ ID NO: 487983 - RNA, 32 nt, Human
uagaagcaaccauucuaauaauugcugaaugu

SEQ ID NO: 487984 - RNA, 32 nt, Human
uagaagcaagcuggaugcaguggcucaugccu

SEQ ID NO: 487985 - RNA, 32 nt, Human
uagaagcaaguaaaucauccucuuuucaagag

SEQ ID NO: 487986 - RNA, 32 nt, Human
uagaagcacauguacauacauggaccucauuc

SEQ ID NO: 487987 - RNA, 32 nt, Human
uagaagcacugagcucccugucucuggaagua

SEQ ID NO: 487988 - RNA, 32 nt, Human
uagaagcagagcuggaguaaggacuugggugu

SEQ ID NO: 487989 - RNA, 32 nt, Human
uagaagcaggaacaccagugcuaagguagagc

SEQ ID NO: 487990 - RNA, 32 nt, Human
uagaagcaggcaaguuggguaacggcucucgg

SEQ ID NO: 487991 - RNA, 32 nt, Human
uagaagcagggugucagcuacugggaauauuu

SEQ ID NO: 487992 - RNA, 32 nt, Human
uagaagcaugauacaagacaucuacuggauuc

SEQ ID NO: 487993 - RNA, 32 nt, Human
uagaagcaugcaccaccaugcccaucuaauau

SEQ ID NO: 487994 - RNA, 32 nt, Human
uagaagccaagguuguggauuugaucuuagaa

SEQ ID NO: 487995 - RNA, 32 nt, Human
uagaagccaccacuggcuuucaggcuuggggg

SEQ ID NO: 487996 - RNA, 32 nt, Human
uagaagccacuugcacgguguggccagagccu

SEQ ID NO: 487997 - RNA, 32 nt, Human
uagaagccaggaccuggguucugggugaagcc

SEQ ID NO: 487998 - RNA, 32 nt, Human
uagaagccaggaguucgagaccagccugggua

SEQ ID NO: 487999 - RNA, 32 nt, Human
uagaagccauuuugauccaagaagcuacuuaa

SEQ ID NO: 488000 - RNA, 32 nt, Human
uagaagccccugguuugggguggguggaggag

SEQ ID NO: 488001 - RNA, 23 nt, Human
uagaagccucugggcucagagga

SEQ ID NO: 488002 - RNA, 32 nt, Human
uagaagcgguggaagguguggauguccgugcg

SEQ ID NO: 488003 - RNA, 32 nt, Human
uagaagcgugagccaccacgcccagccuuuuu

SEQ ID NO: 488004 - RNA, 32 nt, Human
uagaagcuaagcuguggcucaacucauccgga

SEQ ID NO: 488005 - RNA, 32 nt, Human
uagaagcucaugugguuguugcagcauucagu

SEQ ID NO: 488006 - RNA, 32 nt, Human
uagaagcuccaucccccuugucuuugugcuug

SEQ ID NO: 488007 - RNA, 22 nt, Human
uagaagcugcaaagaugugcca

SEQ ID NO: 488008 - RNA, 32 nt, Human
uagaagcugcuugcagggucgccgggcuaacc

SEQ ID NO: 488009 - RNA, 32 nt, Human
uagaaggaaaaaugauuugggccugcuuucca

SEQ ID NO: 488010 - RNA, 32 nt, Human
uagaaggaacauccugaauucuagaguugacu

SEQ ID NO: 488011 - RNA, 19 nt, Human
uagaaggaaucuuugguua

SEQ ID NO: 488012 - RNA, 32 nt, Human
uagaaggauguggcuuuuagagaaguccagua

SEQ ID NO: 488013 - RNA, 31 nt, Human
uagaaggcaguggugacuggcauucagaagu

SEQ ID NO: 488014 - RNA, 32 nt, Human
uagaaggcaguuuccucuacuugcccaagagc

SEQ ID NO: 488015 - RNA, 32 nt, Human
uagaaggccauggagcuuaaaccuccagcagu

SEQ ID NO: 488016 - RNA, 32 nt, Human
uagaaggcgauaaagcaauaauucagcuaauu

SEQ ID NO: 488017 - RNA, 32 nt, Human
uagaaggcugcugccauucagauagcacagac

SEQ ID NO: 488018 - RNA, 32 nt, Human
uagaagggaagagaauuggugcugcagaagug

SEQ ID NO: 488019 - RNA, 32 nt, Human
uagaagggaagagauaggaugggaaagcuaac

SEQ ID NO: 488020 - RNA, 32 nt, Human
uagaagggaagagggaaauggagagcauccuu

SEQ ID NO: 488021 - RNA, 32 nt, Human
uagaagggaccugacuggagugcugauggacu

SEQ ID NO: 488022 - RNA, 32 nt, Human
uagaagggagaguguauauguguaugaaugaa

SEQ ID NO: 488023 - RNA, 32 nt, Human
uagaagggaggcacaccagcuugggcaggugg

SEQ ID NO: 488024 - RNA, 32 nt, Human
uagaagggauuccaaauaaacacuugcacaca

SEQ ID NO: 488025 - RNA, 18 nt, Human
uagaaggggaaaauucaa

SEQ ID NO: 488026 - RNA, 32 nt, Human
uagaaggggaagccucugggcugagcauguag

SEQ ID NO: 488027 - RNA, 32 nt, Human
uagaaggggacuguucuucacacaucauauua

SEQ ID NO: 488028 - RNA, 32 nt, Human
uagaaggucucgagccuccuguaccuucccag

SEQ ID NO: 488029 - RNA, 32 nt, Human
uagaaguaccugcuggguucucaguuccaguu

SEQ ID NO: 488030 - RNA, 32 nt, Human
uagaagucaaugcaaaugcauuaauuuacaag

SEQ ID NO: 488031 - RNA, 32 nt, Human
uagaagucacacuaguauauaccauuuaauac

SEQ ID NO: 488032 - RNA, 32 nt, Human
uagaagucagcuuucacaucugauuucuguau

SEQ ID NO: 488033 - RNA, 32 nt, Human
uagaaguccuuuccucacccaccccacaccau

SEQ ID NO: 488034 - RNA, 32 nt, Human
uagaagucguccugucguccugccucacagua

SEQ ID NO: 488035 - RNA, 20 nt, Human
uagaagugaauuguuuagug

SEQ ID NO: 488036 - RNA, 32 nt, Human
uagaagugacauuguaagaggugguggggacc

SEQ ID NO: 488037 - RNA, 17 nt, Human
uagaagugaccaguuca

SEQ ID NO: 488038 - RNA, 32 nt, Human
uagaagugcggguccccagagccaggguagac

SEQ ID NO: 488039 - RNA, 32 nt, Human
uagaaguggcaaaauuccaagcagguucaaaa

SEQ ID NO: 488040 - RNA, 32 nt, Human
uagaaguggcugggaauuuugccuucuagacu

SEQ ID NO: 488041 - RNA, 32 nt, Human
uagaaguuaccugaguaucucugggaggccuc

SEQ ID NO: 488042 - RNA, 32 nt, Human
uagaaguuaggguuuaggcaucauuuugagaa

SEQ ID NO: 488043 - RNA, 32 nt, Human
uagaaguugagguagucugggguggggaacuu

SEQ ID NO: 488044 - RNA, 19 nt, Human
uagaaguuggccuuuaguu

SEQ ID NO: 488045 - RNA, 32 nt, Human
uagaaguuuccagauauggagggguauuuuca

SEQ ID NO: 488046 - RNA, 21 nt, Human
uagaaguuuguugacucguaa

SEQ ID NO: 488047 - RNA, 30 nt, Human
uagaauaaggaaauaaaaugauacacucac

SEQ ID NO: 488048 - RNA, 32 nt, Human
uagaauacaaacuccuuaaggccaggcacucu

SEQ ID NO: 488049 - RNA, 32 nt, Human
uagaauacauggaaacgcaaaugaguauuucg

SEQ ID NO: 488050 - RNA, 32 nt, Human
uagaauacuguaggaagucagugcaaggugca

SEQ ID NO: 488051 - RNA, 32 nt, Human
uagaauagacuggccugaaauccccuugccca

SEQ ID NO: 488052 - RNA, 32 nt, Human
uagaauagagguuauucuguaauggaaaagug

SEQ ID NO: 488053 - RNA, 32 nt, Human
uagaauagauacuguauuaaauauugccaugu

SEQ ID NO: 488054 - RNA, 31 nt, Human
uagaauaggaaacuguggcucagaggucauc

SEQ ID NO: 488055 - RNA, 31 nt, Human
uagaauaggcacuuuaaaacacucuuucccc

SEQ ID NO: 488056 - RNA, 32 nt, Human
uagaauaggcaggaaccaauuugcauuuaagu

SEQ ID NO: 488057 - RNA, 32 nt, Human
uagaauagucauaccuggaaugugucaaauua

SEQ ID NO: 488058 - RNA, 32 nt, Human
uagaauauagagaguuuuuaaaugucucccau

SEQ ID NO: 488059 - RNA, 32 nt, Human
uagaauaugacaugcugaaccaggcauggugg

SEQ ID NO: 488060 - RNA, 32 nt, Human
uagaauauguggaagagccagaggaggagcag

SEQ ID NO: 488061 - RNA, 32 nt, Human
uagaaucacagaacgacacccgguaauccaca

SEQ ID NO: 488062 - RNA, 32 nt, Human
uagaaucaggaaaauguccgcaaaagcauguu

SEQ ID NO: 488063 - RNA, 32 nt, Human
uagaaucauaacccacacaggcccacugcagg

SEQ ID NO: 488064 - RNA, 32 nt, Human
uagaaucaugguacauuauuguuucaguauuc

SEQ ID NO: 488065 - RNA, 25 nt, Human
uagaauccaaugcaacaggaagcua

SEQ ID NO: 488066 - RNA, 32 nt, Human
uagaauccagcccagaucugaggccaagcuau

SEQ ID NO: 488067 - RNA, 32 nt, Human
uagaauccagccuucaguuucuuaaaugaaau

SEQ ID NO: 488068 - RNA, 32 nt, Human
uagaauccaguacuuuuaauggugggaauuua

SEQ ID NO: 488069 - RNA, 32 nt, Human
uagaaucccacuuuuggugauuucaagucaag

SEQ ID NO: 488070 - RNA, 32 nt, Human
uagaaucccagaggccuccucauuagugaucc

SEQ ID NO: 488071 - RNA, 32 nt, Human
uagaaucccagcagcagagaaccaucaaggcg

SEQ ID NO: 488072 - RNA, 32 nt, Human
uagaaucgcuuuccuuccuccccuuuugcccc

SEQ ID NO: 488073 - RNA, 31 nt, Human
uagaaucucaauaaauuuaugugaagagaau

SEQ ID NO: 488074 - RNA, 32 nt, Human
uagaaucucagggcuuauccuagaagguguug

SEQ ID NO: 488075 - RNA, 32 nt, Human
uagaaucucauccuuagggcucagagaguccc

SEQ ID NO: 488076 - RNA, 32 nt, Human
uagaaucucccauccuauugucaagguuaaca

SEQ ID NO: 488077 - RNA, 32 nt, Human
uagaaugaagucaccaguaggucagucccuuc

SEQ ID NO: 488078 - RNA, 32 nt, Human
uagaaugacaguguuggaauuuggaggcagua

SEQ ID NO: 488079 - RNA, 32 nt, Human
uagaaugacuaaaacuaucuaccuauagaacu

SEQ ID NO: 488080 - RNA, 32 nt, Human
uagaaugagagggagggcagccuucugccacc

SEQ ID NO: 488081 - RNA, 32 nt, Human
uagaaugagccccaaaccuuagccucauuuau

SEQ ID NO: 488082 - RNA, 20 nt, Human
uagaaugagggccuuuaguu

SEQ ID NO: 488083 - RNA, 32 nt, Human
uagaaugaguuccucuggccaugggaggaucg

SEQ ID NO: 488084 - RNA, 32 nt, Human
uagaaugaucuauugcucaucagcuuuauuuu

SEQ ID NO: 488085 - RNA, 32 nt, Human
uagaaugauguaauauuccaggaugcugcugc

SEQ ID NO: 488086 - RNA, 32 nt, Human
uagaaugcaauggguauuuucucagauuucca

SEQ ID NO: 488087 - RNA, 32 nt, Human
uagaaugccacaucugcguccucaagaccugu

SEQ ID NO: 488088 - RNA, 32 nt, Human
uagaaugcuguugccacuuacgggggcuggag

SEQ ID NO: 488089 - RNA, 32 nt, Human
uagaauggaacaaacugaaggcccgaugagag

SEQ ID NO: 488090 - RNA, 32 nt, Human
uagaauggacccuuccuccaccucaguucaga

SEQ ID NO: 488091 - RNA, 32 nt, Human
uagaaugggaggugguaugggaaguggcaugu

SEQ ID NO: 488092 - RNA, 32 nt, Human
uagaaugggcuucaauauucauaacugaguua

SEQ ID NO: 488093 - RNA, 32 nt, Human
uagaauggguuugagcuuggggugggguggau

SEQ ID NO: 488094 - RNA, 32 nt, Human
uagaauguaaaaggaauauuacaguguuaacu

SEQ ID NO: 488095 - RNA, 32 nt, Human
uagaauguaagcuuggugaaagaagggacuuu

SEQ ID NO: 488096 - RNA, 23 nt, Human
uagaauguauacuccacacauuu

SEQ ID NO: 488097 - RNA, 32 nt, Human
uagaaugucauuuugcccucaaccuugguauu

SEQ ID NO: 488098 - RNA, 22 nt, Human
uagaaugugaugucugaagaua

SEQ ID NO: 488099 - RNA, 32 nt, Human
uagaaugugccuuucgugaaggucugacaaau

SEQ ID NO: 488100 - RNA, 32 nt, Human
uagaauguucauaagcauggucuuccaguugc

SEQ ID NO: 488101 - RNA, 21 nt, Human
uagaauguuucaguucuagga

SEQ ID NO: 488102 - RNA, 32 nt, Human
uagaauuaaaaaguggggacuuugggaggagg

SEQ ID NO: 488103 - RNA, 32 nt, Human
uagaauuaacaccauuauguauuuuguuauuu

SEQ ID NO: 488104 - RNA, 32 nt, Human
uagaauuaccucuauucuuuguuuugccauau

SEQ ID NO: 488105 - RNA, 32 nt, Human
uagaauuaugcuguuaaaacuacuuuagguga

SEQ ID NO: 488106 - RNA, 32 nt, Human
uagaauuauugcuuaugucauuucuuaagcag

SEQ ID NO: 488107 - RNA, 32 nt, Human
uagaauucacaaugcauuuuucaagagaaaug

SEQ ID NO: 488108 - RNA, 32 nt, Human
uagaauucauacuggggagaaaccuuagaaau

SEQ ID NO: 488109 - RNA, 32 nt, Human
uagaauucauuucucuuacguugaauccccaa

SEQ ID NO: 488110 - RNA, 32 nt, Human
uagaauuccuacucacacagcucagcaacaac

SEQ ID NO: 488111 - RNA, 32 nt, Human
uagaauucuaaguuucuagacccacugcccau

SEQ ID NO: 488112 - RNA, 32 nt, Human
uagaauugaauccaaggucugccauucacuag

SEQ ID NO: 488113 - RNA, 32 nt, Human
uagaauugcccagugcugccagagugagugag

SEQ ID NO: 488114 - RNA, 32 nt, Human
uagaauuguagacugauguuuuagcauuuuuc

SEQ ID NO: 488115 - RNA, 32 nt, Human
uagaauuguaugaaauuaagaguuucagaguu

SEQ ID NO: 488116 - RNA, 32 nt, Human
uagaauuguugggaucucauagauggaauggg

SEQ ID NO: 488117 - RNA, 32 nt, Human
uagaauuucucucccucucucuuuuaauacuu

SEQ ID NO: 488118 - RNA, 32 nt, Human
uagacaaaacucacaacuaccugcucaaguuc

SEQ ID NO: 488119 - RNA, 20 nt, Human
uagacaaacaguugccucca

SEQ ID NO: 488120 - RNA, 32 nt, Human
uagacaaacuucacaaacugucuuaauuuaga

SEQ ID NO: 488121 - RNA, 19 nt, Human
uagacaaagcuauuucuac

SEQ ID NO: 488122 - RNA, 32 nt, Human
uagacaaauugcugcugaccuuacgccuguau

SEQ ID NO: 488123 - RNA, 32 nt, Human
uagacaacacccuuacaaggauccgccagggc

SEQ ID NO: 488124 - RNA, 32 nt, Human
uagacaacaguuuguucuugccuguguugcuu

SEQ ID NO: 488125 - RNA, 32 nt, Human
uagacaaccagcuaaacugccuuuuuggugug

SEQ ID NO: 488126 - RNA, 32 nt, Human
uagacaagccugggaaacauagcaagaucuca

SEQ ID NO: 488127 - RNA, 32 nt, Human
uagacaaggagaagaggaagggaggaagggaa

SEQ ID NO: 488128 - RNA, 32 nt, Human
uagacacacagcaagcagacaaccacacaaag

SEQ ID NO: 488129 - RNA, 32 nt, Human
uagacacacagcagcagcagcgucucucagaa

SEQ ID NO: 488130 - RNA, 32 nt, Human
uagacacacauuuucuuuucacccuaaucuau

SEQ ID NO: 488131 - RNA, 32 nt, Human
uagacacagcuaacuugagucuuggagcuccu

SEQ ID NO: 488132 - RNA, 32 nt, Human
uagacaccuucaccuccaucgugcccucucuc

SEQ ID NO: 488133 - RNA, 32 nt, Human
uagacacggcuggggcgugcucuggccucacu

SEQ ID NO: 488134 - RNA, 32 nt, Human
uagacacuacuuauuuguuacauuuuguacua

SEQ ID NO: 488135 - RNA, 30 nt, Human
uagacacucaauaaauaauuguugaauuca

SEQ ID NO: 488136 - RNA, 31 nt, Human
uagacacucaauaaauacuuguugaauucaa

SEQ ID NO: 488137 - RNA, 32 nt, Human
uagacacucuaggcucggaggcugccacugua

SEQ ID NO: 488138 - RNA, 32 nt, Human
uagacacucuguaucuagcuacucuggugggg

SEQ ID NO: 488139 - RNA, 32 nt, Human
uagacacucuucuuagucccauggagcugacu

SEQ ID NO: 488140 - RNA, 32 nt, Human
uagacacugaugccauugugugcugccucaag

SEQ ID NO: 488141 - RNA, 32 nt, Human
uagacacugcaaccucuugcucguaucccagg

SEQ ID NO: 488142 - RNA, 32 nt, Human
uagacagaagaggaagaaagaacagauguuca

SEQ ID NO: 488143 - RNA, 32 nt, Human
uagacagcaguuucccuauauuauuuggaguc

SEQ ID NO: 488144 - RNA, 32 nt, Human
uagacagcauaaaugaaaaagacagaaauucc

SEQ ID NO: 488145 - RNA, 31 nt, Human
uagacagccccugcugggccuguuugcuguc

SEQ ID NO: 488146 - RNA, 32 nt, Human
uagacagcgcucagccccagccccaggugugg

SEQ ID NO: 488147 - RNA, 32 nt, Human
uagacagcugagaggaccugaucauguaggga

SEQ ID NO: 488148 - RNA, 32 nt, Human
uagacaggaauagaaguugugguggaggugau

SEQ ID NO: 488149 - RNA, 32 nt, Human
uagacagggaaaaucgauggugucaaggcaaa

SEQ ID NO: 488150 - RNA, 32 nt, Human
uagacagggcaggcuggcugcggggaggggcu

SEQ ID NO: 488151 - RNA, 31 nt, Human
uagacaggggagccaugcacagcaggaaaug

SEQ ID NO: 488152 - RNA, 22 nt, Human
uagacaggguuucaccauguug

SEQ ID NO: 488153 - RNA, 32 nt, Human
uagacaguaaggagccaggggaacagagagaa

SEQ ID NO: 488154 - RNA, 32 nt, Human
uagacaguaucagccaaaauuugaguuagcaa

SEQ ID NO: 488155 - RNA, 32 nt, Human
uagacaguauuauuacauucaguauuacaaug

SEQ ID NO: 488156 - RNA, 32 nt, Human
uagacagucagaccuccaggacuagaugaagu

SEQ ID NO: 488157 - RNA, 32 nt, Human
uagacagucaggcaaaacuaaugaacguggag

SEQ ID NO: 488158 - RNA, 32 nt, Human
uagacaguuccuucugguuagauggguccuac

SEQ ID NO: 488159 - RNA, 32 nt, Human
uagacaguuugccguauuugugguguucuccu

SEQ ID NO: 488160 - RNA, 32 nt, Human
uagacauauacacacacauauauguauguaua

SEQ ID NO: 488161 - RNA, 32 nt, Human
uagacauaucuauuaaguggaaagaaggcuuu

SEQ ID NO: 488162 - RNA, 32 nt, Human
uagacaucaaagaauucauacuggagagaagc

SEQ ID NO: 488163 - RNA, 32 nt, Human
uagacauccucaccaucuccauccgcucucac

SEQ ID NO: 488164 - RNA, 32 nt, Human
uagacaucucuucauuuuagagagaagaugga

SEQ ID NO: 488165 - RNA, 32 nt, Human
uagacaugcccaaaacuuauccuugggccaua

SEQ ID NO: 488166 - RNA, 32 nt, Human
uagacaugcucuuccucucguuucaugcaggc

SEQ ID NO: 488167 - RNA, 32 nt, Human
uagacaugcuggugucuacacagcagaagaag

SEQ ID NO: 488168 - RNA, 32 nt, Human
uagacaugggcugggugcaguggcucacuccu

SEQ ID NO: 488169 - RNA, 32 nt, Human
uagacaugugggagaaaaagugaggauggauc

SEQ ID NO: 488170 - RNA, 32 nt, Human
uagacauuagccaccaugccuggccaaauauu

SEQ ID NO: 488171 - RNA, 32 nt, Human
uagacauuaugcuuuuauaugcuauucagauu

SEQ ID NO: 488172 - RNA, 32 nt, Human
uagacauucauuuuaaacacuaccucaguuaa

SEQ ID NO: 488173 - RNA, 32 nt, Human
uagacauucugauccccacucccagguaugag

SEQ ID NO: 488174 - RNA, 32 nt, Human
uagacauuuucucaugucuaccaggaauugaa

SEQ ID NO: 488175 - RNA, 32 nt, Human
uagaccaaacuaacucauggagauauuuugaa

SEQ ID NO: 488176 - RNA, 32 nt, Human
uagaccaagaacuuccucugggguggcugugc

SEQ ID NO: 488177 - RNA, 32 nt, Human
uagaccaaggguguccaaucuuuggcuucccu

SEQ ID NO: 488178 - RNA, 32 nt, Human
uagaccaccagcugcacccaucuccacaaagc

SEQ ID NO: 488179 - RNA, 32 nt, Human
uagaccacccuccaugucagguacugagcaag

SEQ ID NO: 488180 - RNA, 32 nt, Human
uagaccaccugucccaggcuguggugccaccc

SEQ ID NO: 488181 - RNA, 32 nt, Human
uagaccagaagaggaugacaauggcaacaagu

SEQ ID NO: 488182 - RNA, 32 nt, Human
uagaccagccuggacaacauagcaagaccuca

SEQ ID NO: 488183 - RNA, 32 nt, Human
uagaccagccuggccaacaugacccaucuuua

SEQ ID NO: 488184 - RNA, 32 nt, Human
uagaccagccugggcaacacaguaagacccug

SEQ ID NO: 488185 - RNA, 32 nt, Human
uagaccagccugggcaacauagcaagacccug

SEQ ID NO: 488186 - RNA, 32 nt, Human
uagaccagccugggcaacauagugagacccaa

SEQ ID NO: 488187 - RNA, 32 nt, Human
uagaccagcuaguuugggagguggcggcagaa

SEQ ID NO: 488188 - RNA, 32 nt, Human
uagaccagcuuggaguuaaugcagaagaggac

SEQ ID NO: 488189 - RNA, 32 nt, Human
uagaccaggcuacuccugcuguggaccagcua

SEQ ID NO: 488190 - RNA, 32 nt, Human
uagaccaggcuggucucgaauuccugaccuca

SEQ ID NO: 488191 - RNA, 32 nt, Human
uagaccagggcugaugguaaaugaggugguca

SEQ ID NO: 488192 - RNA, 32 nt, Human
uagaccauaacuccucuaguaucaaaauuggg

SEQ ID NO: 488193 - RNA, 32 nt, Human
uagaccaucucuagcccuguggugaaagaggu

SEQ ID NO: 488194 - RNA, 32 nt, Human
uagaccaugaucuccuuggaagcagggacagu

SEQ ID NO: 488195 - RNA, 32 nt, Human
uagacccaaacuuguggaaguaucauguguua

SEQ ID NO: 488196 - RNA, 32 nt, Human
uagacccaaccuggccccagauucugccucug

SEQ ID NO: 488197 - RNA, 32 nt, Human
uagacccaggagaggaagguuaagagaugucg

SEQ ID NO: 488198 - RNA, 32 nt, Human
uagaccccaaaaacuuuugugacaacagugaa

SEQ ID NO: 488199 - RNA, 32 nt, Human
uagaccccaaagauuccuguugguggucuggg

SEQ ID NO: 488200 - RNA, 32 nt, Human
uagaccccacagaacugacagcagggacugaa

SEQ ID NO: 488201 - RNA, 32 nt, Human
uagaccccagcaccugugagucacgcagaccc

SEQ ID NO: 488202 - RNA, 32 nt, Human
uagaccccaggcagcuccgaauuugugaaccu

SEQ ID NO: 488203 - RNA, 32 nt, Human
uagaccccaguucuguuuuccaggaggaacuc

SEQ ID NO: 488204 - RNA, 32 nt, Human
uagaccccauaaccccagaccaaagagguucu

SEQ ID NO: 488205 - RNA, 25 nt, Human
uagaccccauguugaaaacuccaua

SEQ ID NO: 488206 - RNA, 32 nt, Human
uagaccccgccagcagcaguggggcuuggccu

SEQ ID NO: 488207 - RNA, 32 nt, Human
uagacccgggaggcagagguugcagugagccg

SEQ ID NO: 488208 - RNA, 32 nt, Human
uagacccuuacgcccagagaacugcugggagg

SEQ ID NO: 488209 - RNA, 32 nt, Human
uagaccgaagugggcagaucaccugaggucag

SEQ ID NO: 488210 - RNA, 32 nt, Human
uagaccgaaguguacggcagugccaucuggug

SEQ ID NO: 488211 - RNA, 32 nt, Human
uagaccgcuaacaccugucacuggccacuggu

SEQ ID NO: 488212 - RNA, 32 nt, Human
uagaccgggaaggggaggcgggcgggcggaga

SEQ ID NO: 488213 - RNA, 32 nt, Human
uagaccucccaaaaugcuggaauuacaggcgu

SEQ ID NO: 488214 - RNA, 32 nt, Human
uagaccuccuccacucuccauccccuuucccu

SEQ ID NO: 488215 - RNA, 32 nt, Human
uagaccuggaggaucugcaaugcuggaacuug

SEQ ID NO: 488216 - RNA, 32 nt, Human
uagaccugggggacccaaagggucuggccucu

SEQ ID NO: 488217 - RNA, 31 nt, Human
uagaccuggguggaggugagacuggugggug

SEQ ID NO: 488218 - RNA, 19 nt, Human
uagaccugugaaauuucuu

SEQ ID NO: 488219 - RNA, 32 nt, Human
uagaccuuaccucucaacucccucaagaguac

SEQ ID NO: 488220 - RNA, 32 nt, Human
uagaccuuagccagcaggagacucacuggggg

SEQ ID NO: 488221 - RNA, 32 nt, Human
uagaccuuuccucugaggagggcuggcaucuc

SEQ ID NO: 488222 - RNA, 32 nt, Human
uagacgacaaagcaucuauauagcuaagcuaa

SEQ ID NO: 488223 - RNA, 32 nt, Human
uagacgcaggaaauaaggucacauugguguug

SEQ ID NO: 488224 - RNA, 32 nt, Human
uagacgcauguugguaggucacuggaccagag

SEQ ID NO: 488225 - RNA, 32 nt, Human
uagacgcccagcugcacaacuugauugccuua

SEQ ID NO: 488226 - RNA, 32 nt, Human
uagacgcgccggacaggacugauggcgggacc

SEQ ID NO: 488227 - RNA, 30 nt, Human
uagacgcuugucgaaggcagguccuaguca

SEQ ID NO: 488228 - RNA, 32 nt, Human
uagacggagccacacuacaggcaggguaugag

SEQ ID NO: 488229 - RNA, 32 nt, Human
uagacggaguuucacucuuguugcccaggcug

SEQ ID NO: 488230 - RNA, 32 nt, Human
uagacggaguuuugcucuuguugcccaggcug

SEQ ID NO: 488231 - RNA, 32 nt, Human
uagacggccaccugcaggaccccacacucacu

SEQ ID NO: 488232 - RNA, 32 nt, Human
uagacggccuuuccuuuugcacuuucugaacu

SEQ ID NO: 488233 - RNA, 32 nt, Human
uagacguauuagaagauauauucugucguuuu

SEQ ID NO: 488234 - RNA, 32 nt, Human
uagacguggcagagaagagguugcgagcaugg

SEQ ID NO: 488235 - RNA, 32 nt, Human
uagacguggcagcucugugcaguguuugagcc

SEQ ID NO: 488236 - RNA, 32 nt, Human
uagacuaacaacuuuucaagugcucaagaguc

SEQ ID NO: 488237 - RNA, 32 nt, Human
uagacuacuugaacccauaaacuuggaagaau

SEQ ID NO: 488238 - RNA, 32 nt, Human
uagacuagaucccuuacccucucuccaguucc

SEQ ID NO: 488239 - RNA, 32 nt, Human
uagacuagcuguaaaggaccuccuaaauaaau

SEQ ID NO: 488240 - RNA, 32 nt, Human
uagacucaccccacagcacacagacuuucucu

SEQ ID NO: 488241 - RNA, 32 nt, Human
uagacucacugcaaccuccaccuccuguguuc

SEQ ID NO: 488242 - RNA, 32 nt, Human
uagacuccaggauacaaaccauaguaggcaau

SEQ ID NO: 488243 - RNA, 32 nt, Human
uagacuccaucccucaacuucucccauccucu

SEQ ID NO: 488244 - RNA, 32 nt, Human
uagacuccauggucuaacaagggagacauaua

SEQ ID NO: 488245 - RNA, 32 nt, Human
uagacucccagcugcacaauuugauugccuug

SEQ ID NO: 488246 - RNA, 32 nt, Human
uagacucccagucuucuccacauugcugucau

SEQ ID NO: 488247 - RNA, 32 nt, Human
uagacucccauuuugcaaaaggcuuacuuucc

SEQ ID NO: 488248 - RNA, 32 nt, Human
uagacuccucaccauccuuaaguucagugacu

SEQ ID NO: 488249 - RNA, 32 nt, Human
uagacucguccuagagcacagggacucuugcc

SEQ ID NO: 488250 - RNA, 32 nt, Human
uagacucucagauuccgaaggguccuccagcc

SEQ ID NO: 488251 - RNA, 32 nt, Human
uagacucuccacuguuaccuaaguucucaagc

SEQ ID NO: 488252 - RNA, 32 nt, Human
uagacucugguggacaggcaggccccaaggcc

SEQ ID NO: 488253 - RNA, 24 nt, Human
uagacugaaaaugccuaauugaua

SEQ ID NO: 488254 - RNA, 21 nt, Human
uagacugacagacauagcuga

SEQ ID NO: 488255 - RNA, 32 nt, Human
uagacugcaaaucuaaccauauuuaaugaaau

SEQ ID NO: 488256 - RNA, 31 nt, Human
uagacugcaagcuagaaagccaccaaggcca

SEQ ID NO: 488257 - RNA, 32 nt, Human
uagacugcagggcuuaaacaacagacauuuau

SEQ ID NO: 488258 - RNA, 32 nt, Human
uagacugccuuccuuggacccuuccaaagugu

SEQ ID NO: 488259 - RNA, 32 nt, Human
uagacuggaaaauguuuguguccagcugagga

SEQ ID NO: 488260 - RNA, 32 nt, Human
uagacuggaauguguggcauaaucuuggcuaa

SEQ ID NO: 488261 - RNA, 32 nt, Human
uagacuggacagcuuguggcaagugaauuucc

SEQ ID NO: 488262 - RNA, 32 nt, Human
uagacuggagcccagcagcagcgcggcggcgc

SEQ ID NO: 488263 - RNA, 32 nt, Human
uagacuggagugaggcuuccaggcucuuccug

SEQ ID NO: 488264 - RNA, 32 nt, Human
uagacuggccacacuggcucugaaacucacca

SEQ ID NO: 488265 - RNA, 32 nt, Human
uagacuggggccuucugccaccuuugccuccc

SEQ ID NO: 488266 - RNA, 32 nt, Human
uagacugggucucauucugucacccaggcuag

SEQ ID NO: 488267 - RNA, 32 nt, Human
uagacugguaaccagauaaaauaaccuuguaa

SEQ ID NO: 488268 - RNA, 32 nt, Human
uagacuggugcuguaacucaagcaucaauuca

SEQ ID NO: 488269 - RNA, 32 nt, Human
uagacuguauccaggagguggaagugaauugc

SEQ ID NO: 488270 - RNA, 30 nt, Human
uagacugucagagcauggcuagcucagggg

SEQ ID NO: 488271 - RNA, 32 nt, Human
uagacuguccuugagccagggucuguaaaccu

SEQ ID NO: 488272 - RNA, 32 nt, Human
uagacugugaagauucaguucaaauguuaucc

SEQ ID NO: 488273 - RNA, 32 nt, Human
uagacugugagcuccucgagggcagggaccgu

SEQ ID NO: 488274 - RNA, 32 nt, Human
uagacuuacaauauuuuucuuguuucuguacu

SEQ ID NO: 488275 - RNA, 32 nt, Human
uagacuucaagugaucuuucaucccaggaaua

SEQ ID NO: 488276 - RNA, 32 nt, Human
uagacuugccacccaucuccccagucuuuugu

SEQ ID NO: 488277 - RNA, 32 nt, Human
uagacuugcuuugccaaacuuuugccuuaagc

SEQ ID NO: 488278 - RNA, 32 nt, Human
uagacuuggggcacuuguggguacucauucuc

SEQ ID NO: 488279 - RNA, 32 nt, Human
uagacuuggggcacuuguggguacucauuuuc

SEQ ID NO: 488280 - RNA, 32 nt, Human
uagacuuugcauauauacaaauuuguaguauu

SEQ ID NO: 488281 - RNA, 32 nt, Human
uagacuuugccuggagaccccuuuggaaaucu

SEQ ID NO: 488282 - RNA, 32 nt, Human
uagacuuuuuaaugcuaaaauguccuuauuaa

SEQ ID NO: 488283 - RNA, 32 nt, Human
uagagaaaaagacugcuuugucacucaaacau

SEQ ID NO: 488284 - RNA, 32 nt, Human
uagagaaaaaugaagacaggaaaggggcagag

SEQ ID NO: 488285 - RNA, 32 nt, Human
uagagaaaagagaccauguuuauuuggguagg

SEQ ID NO: 488286 - RNA, 32 nt, Human
uagagaaacaggaggaaaauuaugccagagau

SEQ ID NO: 488287 - RNA, 32 nt, Human
uagagaaagagaagaagagaaagaggaagagu

SEQ ID NO: 488288 - RNA, 32 nt, Human
uagagaaagauaaacaggucaugaaggcugag

SEQ ID NO: 488289 - RNA, 18 nt, Human
uagagaaaggaguucaug

SEQ ID NO: 488290 - RNA, 32 nt, Human
uagagaaaucugagcccgaaccugccagaaua

SEQ ID NO: 488291 - RNA, 32 nt, Human
uagagaaaugagucucaugccuguaaucccag

SEQ ID NO: 488292 - RNA, 32 nt, Human
uagagaacaagucccccgaacgcugaguugga

SEQ ID NO: 488293 - RNA, 32 nt, Human
uagagaacaccguccugcugggcauggccggg

SEQ ID NO: 488294 - RNA, 32 nt, Human
uagagaacagcagcagcuucagccuggaccag

SEQ ID NO: 488295 - RNA, 32 nt, Human
uagagaacagccugguuaacauggugaaacac

SEQ ID NO: 488296 - RNA, 32 nt, Human
uagagaacccucagcuucucucugccucugga

SEQ ID NO: 488297 - RNA, 32 nt, Human
uagagaacuauacaacuuuuauuguuucuuaa

SEQ ID NO: 488298 - RNA, 32 nt, Human
uagagaacucacugcacccacccacaacacau

SEQ ID NO: 488299 - RNA, 32 nt, Human
uagagaagaaccagaggagcucagcugagaua

SEQ ID NO: 488300 - RNA, 32 nt, Human
uagagaagaagaggacaaaacaagggaaaagc

SEQ ID NO: 488301 - RNA, 32 nt, Human
uagagaagaaggagggaagaauagaugauuua

SEQ ID NO: 488302 - RNA, 32 nt, Human
uagagaagacuuugggggcuucaggcuccaau

SEQ ID NO: 488303 - RNA, 32 nt, Human
uagagaagauacaugagggcuuaaacaagaaa

SEQ ID NO: 488304 - RNA, 32 nt, Human
uagagaagcaguacauuugcuuuugauagaaa

SEQ ID NO: 488305 - RNA, 32 nt, Human
uagagaaggauugcugaucaccugccacccag

SEQ ID NO: 488306 - RNA, 32 nt, Human
uagagaaggccaagcaaccuccacuucuucag

SEQ ID NO: 488307 - RNA, 32 nt, Human
uagagaagggguuuugccgccauguugcacag

SEQ ID NO: 488308 - RNA, 32 nt, Human
uagagaagucagagagacuagaugcuuucacu

SEQ ID NO: 488309 - RNA, 32 nt, Human
uagagaagugagaugaguguguuuucuuuggg

SEQ ID NO: 488310 - RNA, 32 nt, Human
uagagaagugcagaggaagcaaugucuagugc

SEQ ID NO: 488311 - RNA, 32 nt, Human
uagagaauaagaauugcagaaaauaacaguga

SEQ ID NO: 488312 - RNA, 23 nt, Human
uagagaaucguauuuuucuuuca

SEQ ID NO: 488313 - RNA, 32 nt, Human
uagagaauguggcuucaacugggcuuauuaaa

SEQ ID NO: 488314 - RNA, 32 nt, Human
uagagaauuauacaacuuuuauuguuucuuaa

SEQ ID NO: 488315 - RNA, 32 nt, Human
uagagaauucuuuggcaugaucugacuuucca

SEQ ID NO: 488316 - RNA, 32 nt, Human
uagagacaagaaaccuguuucaacuugaagac

SEQ ID NO: 488317 - RNA, 32 nt, Human
uagagacacagaacaauguauuagaauuucca

SEQ ID NO: 488318 - RNA, 32 nt, Human
uagagacacaggcuggguuggucugccccuca

SEQ ID NO: 488319 - RNA, 32 nt, Human
uagagacagagagagaaaaaggcugaaauggg

SEQ ID NO: 488320 - RNA, 32 nt, Human
uagagacagaguuucgucauguugcccaggcu

SEQ ID NO: 488321 - RNA, 32 nt, Human
uagagacaggguuucgcuauguuggccaggcu

SEQ ID NO: 488322 - RNA, 32 nt, Human
uagagacagguuucaccauauuggccaggcug

SEQ ID NO: 488323 - RNA, 32 nt, Human
uagagacaguauucagauuagcuguaucccug

SEQ ID NO: 488324 - RNA, 31 nt, Human
uagagacauacuuguuaacuuuggagcacag

SEQ ID NO: 488325 - RNA, 32 nt, Human
uagagaccagccugggcaacaugaugugaaaa

SEQ ID NO: 488326 - RNA, 32 nt, Human
uagagaccagccugggcaacauggugaaaucc

SEQ ID NO: 488327 - RNA, 32 nt, Human
uagagaccagccugggccaacguggugaaacc

SEQ ID NO: 488328 - RNA, 32 nt, Human
uagagaccagccuggucaacauggugaaaccc

SEQ ID NO: 488329 - RNA, 32 nt, Human
uagagaccagccuguccaacguggugaaaccc

SEQ ID NO: 488330 - RNA, 32 nt, Human
uagagaccaucauugcuaacauggugaaaccc

SEQ ID NO: 488331 - RNA, 32 nt, Human
uagagaccauccuggccaacacggugaaaccc

SEQ ID NO: 488332 - RNA, 32 nt, Human
uagagaccauccuggccaacauggugaaaccc

SEQ ID NO: 488333 - RNA, 32 nt, Human
uagagaccauccuggcuaacacggugaaaccc

SEQ ID NO: 488334 - RNA, 32 nt, Human
uagagaccauccugguuaacacggugaaaccc

SEQ ID NO: 488335 - RNA, 32 nt, Human
uagagaccaucucauuggcccuaaggagccgc

SEQ ID NO: 488336 - RNA, 32 nt, Human
uagagaccaucuuugccaacauggugaaacuc

SEQ ID NO: 488337 - RNA, 32 nt, Human
uagagaccccacccucccaucgguccuacaug

SEQ ID NO: 488338 - RNA, 32 nt, Human
uagagacccuugccuguguccgggacccuggc

SEQ ID NO: 488339 - RNA, 32 nt, Human
uagagaccgguuuugccauguuggccaggcug

SEQ ID NO: 488340 - RNA, 23 nt, Human
uagagaccuaugauccucaugga

SEQ ID NO: 488341 - RNA, 32 nt, Human
uagagaccuguuucuucuguuauuacagaaca

SEQ ID NO: 488342 - RNA, 32 nt, Human
uagagacgacaggguuucaccauguuggccag

SEQ ID NO: 488343 - RNA, 32 nt, Human
uagagacgagguuuugccaucccuguggauuu

SEQ ID NO: 488344 - RNA, 32 nt, Human
uagagacgcaccuugcugcaguguccagaagc

SEQ ID NO: 488345 - RNA, 32 nt, Human
uagagacggaggaguuucaccauguuggccag

SEQ ID NO: 488346 - RNA, 32 nt, Human
uagagacggggucuccccauauuggccaggcu

SEQ ID NO: 488347 - RNA, 32 nt, Human
uagagacgggguucaccauguuggccaggcuu

SEQ ID NO: 488348 - RNA, 32 nt, Human
uagagacgggguuucaccuguuagccaggaug

SEQ ID NO: 488349 - RNA, 32 nt, Human
uagagacggguuucaccacguuggccaggcug

SEQ ID NO: 488350 - RNA, 32 nt, Human
uagagacggguuucaccauauugaccaggcug

SEQ ID NO: 488351 - RNA, 32 nt, Human
uagagacggguuucaccauguuggucagacua

SEQ ID NO: 488352 - RNA, 32 nt, Human
uagagacggguuucaucaugguggccaggaug

SEQ ID NO: 488353 - RNA, 32 nt, Human
uagagacuauguccaugcuuagcaggaaguag

SEQ ID NO: 488354 - RNA, 32 nt, Human
uagagacucagaaaaugucuuuucuuuaaaag

SEQ ID NO: 488355 - RNA, 21 nt, Human
uagagacucggccaccaggaa

SEQ ID NO: 488356 - RNA, 20 nt, Human
uagagacucgguggcccagg

SEQ ID NO: 488357 - RNA, 32 nt, Human
uagagacucuuccaccauucugacaugauccg

SEQ ID NO: 488358 - RNA, 32 nt, Human
uagagacugacagccucugccccaggccugag

SEQ ID NO: 488359 - RNA, 32 nt, Human
uagagacugccugguucucucugauguucaag

SEQ ID NO: 488360 - RNA, 32 nt, Human
uagagacuggguuucgcuguguuagccuggau

SEQ ID NO: 488361 - RNA, 19 nt, Human
uagagacuucacccggggg

SEQ ID NO: 488362 - RNA, 32 nt, Human
uagagagaaagccaggagguaagagccagcug

SEQ ID NO: 488363 - RNA, 32 nt, Human
uagagagacugcuccuauuuuaaaagugaugc

SEQ ID NO: 488364 - RNA, 32 nt, Human
uagagagagaaaggaagggaaggaagcugaag

SEQ ID NO: 488365 - RNA, 32 nt, Human
uagagagagacaggcucuugcuauguugccca

SEQ ID NO: 488366 - RNA, 32 nt, Human
uagagagagagcaggagcaucuugaccgcauu

SEQ ID NO: 488367 - RNA, 32 nt, Human
uagagagagaguucaaaacuaguugguaauuu

SEQ ID NO: 488368 - RNA, 32 nt, Human
uagagagagcaagacagcacuugagugcacug

SEQ ID NO: 488369 - RNA, 32 nt, Human
uagagagagggcuucucagcaggaugaugaag

SEQ ID NO: 488370 - RNA, 32 nt, Human
uagagagaguaagauuugagaacucaguuugc

SEQ ID NO: 488371 - RNA, 20 nt, Human
uagagagauaauaaauucaa

SEQ ID NO: 488372 - RNA, 32 nt, Human
uagagagcagagcuccuugcauggacaaauaa

SEQ ID NO: 488373 - RNA, 32 nt, Human
uagagagcagagggcccauuucagcucuguug

SEQ ID NO: 488374 - RNA, 32 nt, Human
uagagagcagcguggcugugugcaguggguac

SEQ ID NO: 488375 - RNA, 32 nt, Human
uagagagcccuccccagugucuucccaggaua

SEQ ID NO: 488376 - RNA, 32 nt, Human
uagagagccuccuguucuuucuaugcuugguc

SEQ ID NO: 488377 - RNA, 19 nt, Human
uagagagcuauuaguucau

SEQ ID NO: 488378 - RNA, 32 nt, Human
uagagagcugccugugggacagcccagggcag

SEQ ID NO: 488379 - RNA, 32 nt, Human
uagagagcuguaggaagcucaacauuucuuug

SEQ ID NO: 488380 - RNA, 32 nt, Human
uagagagcuugucuuucaaggccagguucccu

SEQ ID NO: 488381 - RNA, 19 nt, Human
uagagagcuuucaguucau

SEQ ID NO: 488382 - RNA, 19 nt, Human
uagagaggaaggcaguuca

SEQ ID NO: 488383 - RNA, 16 nt, Human
uagagaggaauucaug

SEQ ID NO: 488384 - RNA, 18 nt, Human
uagagaggacuuuacaug

SEQ ID NO: 488385 - RNA, 32 nt, Human
uagagaggagaaagagagcagcccgggagcaa

SEQ ID NO: 488386 - RNA, 18 nt, Human
uagagaggagccaaguuc

SEQ ID NO: 488387 - RNA, 32 nt, Human
uagagaggcccagcagagcagcucagacuccu

SEQ ID NO: 488388 - RNA, 16 nt, Human
uagagaggccuccaua

SEQ ID NO: 488389 - RNA, 32 nt, Human
uagagaggccuuuucuuccagaagagucccgc

SEQ ID NO: 488390 - RNA, 32 nt, Human
uagagaggcugaggcaggagaaucacuugaau

SEQ ID NO: 488391 - RNA, 32 nt, Human
uagagaggcugaggcaggagaaucgcuugaac

SEQ ID NO: 488392 - RNA, 32 nt, Human
uagagagggaaagagaagaccagaugugcaua

SEQ ID NO: 488393 - RNA, 32 nt, Human
uagagagggaggugacugguucccugggggau

SEQ ID NO: 488394 - RNA, 32 nt, Human
uagagagggaguuucgccauguuggccaggcu

SEQ ID NO: 488395 - RNA, 21 nt, Human
uagagaggggccucugggaug

SEQ ID NO: 488396 - RNA, 17 nt, Human
uagagaggggguuucau

SEQ ID NO: 488397 - RNA, 32 nt, Human
uagagagggguuucacaguguugggcagggug

SEQ ID NO: 488398 - RNA, 32 nt, Human
uagagagguacacauuuauuuacuguuuaggu

SEQ ID NO: 488399 - RNA, 32 nt, Human
uagagagguuccccuuucaaaucccagugccg

SEQ ID NO: 488400 - RNA, 32 nt, Human
uagagaguacgcgugugagccugggugcaagg

SEQ ID NO: 488401 - RNA, 20 nt, Human
uagagagucucaaguucaua

SEQ ID NO: 488402 - RNA, 32 nt, Human
uagagaguuucgaaguuaggaggacucaagac

SEQ ID NO: 488403 - RNA, 32 nt, Human
uagagauaauccaaaaucaggguuugguuugg

SEQ ID NO: 488404 - RNA, 32 nt, Human
uagagauacagaaaauugcaaccuccaccaga

SEQ ID NO: 488405 - RNA, 32 nt, Human
uagagauacauacuauuucuccauaugaauuu

SEQ ID NO: 488406 - RNA, 32 nt, Human
uagagauacuaucaucauauacaccugaaaaa

SEQ ID NO: 488407 - RNA, 32 nt, Human
uagagauagagaaauaggggugguuauuuuuc

SEQ ID NO: 488408 - RNA, 32 nt, Human
uagagauaugaacaggguaugguaggauuggg

SEQ ID NO: 488409 - RNA, 32 nt, Human
uagagauaugacugucaguugcagugaguucu

SEQ ID NO: 488410 - RNA, 32 nt, Human
uagagaucaagccagucuuuugcaucccaccu

SEQ ID NO: 488411 - RNA, 32 nt, Human
uagagaucccugucgagcaugacuguguagaa

SEQ ID NO: 488412 - RNA, 32 nt, Human
uagagaugaaaaggggccacugaaaagugaau

SEQ ID NO: 488413 - RNA, 32 nt, Human
uagagaugaaguuucaccguguuggccaggau

SEQ ID NO: 488414 - RNA, 32 nt, Human
uagagaugagauccacauccuaaaaauaccau

SEQ ID NO: 488415 - RNA, 32 nt, Human
uagagaugaggcuuuaccucagacaagaagag

SEQ ID NO: 488416 - RNA, 32 nt, Human
uagagaugcagcauuuguaauauuucaucccc

SEQ ID NO: 488417 - RNA, 32 nt, Human
uagagauggagagaaaugguguggaaacauuu

SEQ ID NO: 488418 - RNA, 32 nt, Human
uagagauggaguuucaccauguuacccaggau

SEQ ID NO: 488419 - RNA, 32 nt, Human
uagagauggaguuucaccauguugcccaggcu

SEQ ID NO: 488420 - RNA, 32 nt, Human
uagagauggaguuucaccauguuggccaggau

SEQ ID NO: 488421 - RNA, 32 nt, Human
uagagauggaguuucaccauguuggccaggcu

SEQ ID NO: 488422 - RNA, 32 nt, Human
uagagauggaguuucacuauguuggccaggcu

SEQ ID NO: 488423 - RNA, 32 nt, Human
uagagauggaguuucacucuguuucccaggcu

SEQ ID NO: 488424 - RNA, 32 nt, Human
uagagauggaguuuuacuauguuggccaggcu

SEQ ID NO: 488425 - RNA, 32 nt, Human
uagagauggaguuuugccauguggucccaggc

SEQ ID NO: 488426 - RNA, 32 nt, Human
uagagauggauuucaccauguuggucaagcug

SEQ ID NO: 488427 - RNA, 32 nt, Human
uagagaugggggaggucucccuauguggccca

SEQ ID NO: 488428 - RNA, 32 nt, Human
uagagauggggucucacuaugucgcccagggu

SEQ ID NO: 488429 - RNA, 32 nt, Human
uagagaugggguuucaccauacuggcuaggcu

SEQ ID NO: 488430 - RNA, 30 nt, Human
uagagaugggguuucgcuauguuggccaag

SEQ ID NO: 488431 - RNA, 32 nt, Human
uagagaugggguuucgcuauguuggccaggcu

SEQ ID NO: 488432 - RNA, 32 nt, Human
uagagauggguuucaccauguuggccaauaug

SEQ ID NO: 488433 - RNA, 32 nt, Human
uagagauggguuucaccauguuggccaggcug

SEQ ID NO: 488434 - RNA, 32 nt, Human
uagagauggguuucaccauguuggccaugcuc

SEQ ID NO: 488435 - RNA, 32 nt, Human
uagagauggguuucuccauguuggucgggcug

SEQ ID NO: 488436 - RNA, 32 nt, Human
uagagaugugccagauuuagauuuucuuaccc

SEQ ID NO: 488437 - RNA, 23 nt, Human
uagagaugugugccaccaugccc

SEQ ID NO: 488438 - RNA, 32 nt, Human
uagagaugugugccaccaugcccggccaauua

SEQ ID NO: 488439 - RNA, 32 nt, Human
uagagauguguuuuuccauguugcccaagcug

SEQ ID NO: 488440 - RNA, 32 nt, Human
uagagauuaaugaagaggagggagguuucuuu

SEQ ID NO: 488441 - RNA, 32 nt, Human
uagagauuaccccugcagcuguggggcuggcc

SEQ ID NO: 488442 - RNA, 32 nt, Human
uagagauuauaaggcucucugagccaucuucu

SEQ ID NO: 488443 - RNA, 32 nt, Human
uagagcaaaggagggaccucaggccuuccguu

SEQ ID NO: 488444 - RNA, 32 nt, Human
uagagcaagagcuguguuccaggaaccagauc

SEQ ID NO: 488445 - RNA, 32 nt, Human
uagagcaagggacuuucccacuagcuuaguau

SEQ ID NO: 488446 - RNA, 32 nt, Human
uagagcacaguaccccuucacacggaggacgc

SEQ ID NO: 488447 - RNA, 32 nt, Human
uagagcacccaagcuucugccuucuggaauau

SEQ ID NO: 488448 - RNA, 32 nt, Human
uagagcacgaggagcagaaacuggagcucaag

SEQ ID NO: 488449 - RNA, 18 nt, Human
uagagcagcaucuuuggc

SEQ ID NO: 488450 - RNA, 32 nt, Human
uagagcaggccugagggccauaggcgaugaga

SEQ ID NO: 488451 - RNA, 32 nt, Human
uagagcaggcugccccauaaauggguaacaua

SEQ ID NO: 488452 - RNA, 32 nt, Human
uagagcagguaucuucacccccuuuucacucu

SEQ ID NO: 488453 - RNA, 32 nt, Human
uagagcagugccugacauagcagaagcucaca

SEQ ID NO: 488454 - RNA, 32 nt, Human
uagagcaguuccucugccucccuaagcuccac

SEQ ID NO: 488455 - RNA, 32 nt, Human
uagagcauccccaaucaauaguuucagaaguu

SEQ ID NO: 488456 - RNA, 32 nt, Human
uagagcauucugggguggggcuuggaagggcg

SEQ ID NO: 488457 - RNA, 32 nt, Human
uagagccagaggaggagggcaaaggggcagau

SEQ ID NO: 488458 - RNA, 32 nt, Human
uagagccagcaggccccacuguauuauguaua

SEQ ID NO: 488459 - RNA, 32 nt, Human
uagagccagccuggccuugcccagagcauaca

SEQ ID NO: 488460 - RNA, 32 nt, Human
uagagccagcugcuugcucacagccacauuuc

SEQ ID NO: 488461 - RNA, 23 nt, Human
uagagccaggggugcaagugcca

SEQ ID NO: 488462 - RNA, 32 nt, Human
uagagccaguccaggcuggagaucccuuucaa

SEQ ID NO: 488463 - RNA, 32 nt, Human
uagagccagugagagaacuaggaaugacacuc

SEQ ID NO: 488464 - RNA, 32 nt, Human
uagagccaucccucagucagcuggcagggaca

SEQ ID NO: 488465 - RNA, 32 nt, Human
uagagccaugaucucaaccacgaaaugggaac

SEQ ID NO: 488466 - RNA, 32 nt, Human
uagagcccaggaguucaaagcugcaacgaccu

SEQ ID NO: 488467 - RNA, 32 nt, Human
uagagccccaaggcguggaagccagacuugac

SEQ ID NO: 488468 - RNA, 32 nt, Human
uagagcccgggcgacagagcaagacuuggucu

SEQ ID NO: 488469 - RNA, 32 nt, Human
uagagccgacugucuccucugccuuuuguuuu

SEQ ID NO: 488470 - RNA, 32 nt, Human
uagagccgagacuggaggaucgauuggcaccu

SEQ ID NO: 488471 - RNA, 32 nt, Human
uagagccucuggaaggagcauggccccaucaa

SEQ ID NO: 488472 - RNA, 32 nt, Human
uagagccugcaaggagcucccgagucugagga

SEQ ID NO: 488473 - RNA, 32 nt, Human
uagagccugccuggagcguuucuagcaaguga

SEQ ID NO: 488474 - RNA, 32 nt, Human
uagagccuuuuaucugcagaacaucgauaugu

SEQ ID NO: 488475 - RNA, 32 nt, Human
uagagcgaaaccaagcagaaaucaaugccauc

SEQ ID NO: 488476 - RNA, 32 nt, Human
uagagcggacacaggcaccuggcaagcuuucc

SEQ ID NO: 488477 - RNA, 32 nt, Human
uagagcgucucagcaucgccagucuagacugu

SEQ ID NO: 488478 - RNA, 32 nt, Human
uagagcuaacagcaaaacaguauccugacauu

SEQ ID NO: 488479 - RNA, 32 nt, Human
uagagcuacacgcugcuucacaagcacacggc

SEQ ID NO: 488480 - RNA, 32 nt, Human
uagagcuacagauccagauacacacacuugug

SEQ ID NO: 488481 - RNA, 32 nt, Human
uagagcuagcuggugugguugcagugaccuug

SEQ ID NO: 488482 - RNA, 32 nt, Human
uagagcuaggguggggucuggucacacacagg

SEQ ID NO: 488483 - RNA, 32 nt, Human
uagagcucagcccacaggacugcuucaggccg

SEQ ID NO: 488484 - RNA, 32 nt, Human
uagagcucccgggagaaaaaggcgaagauccc

SEQ ID NO: 488485 - RNA, 32 nt, Human
uagagcucccuaaucccaugcaccacauuggc

SEQ ID NO: 488486 - RNA, 32 nt, Human
uagagcucgcuucauuuauuuauguaacucag

SEQ ID NO: 488487 - RNA, 32 nt, Human
uagagcucucagaagcaguccuuugagcuggu

SEQ ID NO: 488488 - RNA, 32 nt, Human
uagagcugaaucuaaccacucuccuuggccca

SEQ ID NO: 488489 - RNA, 32 nt, Human
uagagcugcuccacaucucccugcugcucauc

SEQ ID NO: 488490 - RNA, 32 nt, Human
uagagcugcucugcugcaaggauuuccugccu

SEQ ID NO: 488491 - RNA, 32 nt, Human
uagagcugggauugguggagggagcaggugcc

SEQ ID NO: 488492 - RNA, 32 nt, Human
uagagcugggcuggggcagggggcagcuccuc

SEQ ID NO: 488493 - RNA, 32 nt, Human
uagagcuggguuucaccauguuggccaggcug

SEQ ID NO: 488494 - RNA, 32 nt, Human
uagagcuguaugaggccgggugcaguggcuca

SEQ ID NO: 488495 - RNA, 29 nt, Human
uagagcugucugugccucucugggagaaa

SEQ ID NO: 488496 - RNA, 32 nt, Human
uagagcuugccucacccgcuguagccgccgag

SEQ ID NO: 488497 - RNA, 32 nt, Human
uagagcuuuucagugcaucccaccucccuguc

SEQ ID NO: 488498 - RNA, 32 nt, Human
uagaggaaagagaacccuuguacacuguuggu

SEQ ID NO: 488499 - RNA, 32 nt, Human
uagaggaaaggcuccaaacaccugcagguugg

SEQ ID NO: 488500 - RNA, 32 nt, Human
uagaggaacccccuacucuccaccuuugccua

SEQ ID NO: 488501 - RNA, 32 nt, Human
uagaggaacgugccaccaugacuggcuaauuu

SEQ ID NO: 488502 - RNA, 32 nt, Human
uagaggaacuucugaacuuggaaaggggaagu

SEQ ID NO: 488503 - RNA, 32 nt, Human
uagaggaacuuuauuuacaguacuuugauuug

SEQ ID NO: 488504 - RNA, 32 nt, Human
uagaggaagacgagacaggacgaggcagaaaa

SEQ ID NO: 488505 - RNA, 32 nt, Human
uagaggaagggagggcgcagguuggagucagg

SEQ ID NO: 488506 - RNA, 32 nt, Human
uagaggaaguguaccacagcagccuggcuuca

SEQ ID NO: 488507 - RNA, 32 nt, Human
uagaggaaguuucugccaccuccccuccugag

SEQ ID NO: 488508 - RNA, 32 nt, Human
uagaggaaucuuauucucaucucccauauguu

SEQ ID NO: 488509 - RNA, 32 nt, Human
uagaggaauuaagacaaagacacagaaauaga

SEQ ID NO: 488510 - RNA, 32 nt, Human
uagaggaauuaagacaaagacacagaaauaua

SEQ ID NO: 488511 - RNA, 32 nt, Human
uagaggacacagcaagugaguccuccccacuc

SEQ ID NO: 488512 - RNA, 32 nt, Human
uagaggacaggcaagccagcucugggggaguc

SEQ ID NO: 488513 - RNA, 32 nt, Human
uagaggacauggcugucuucuaaaaagccacg

SEQ ID NO: 488514 - RNA, 32 nt, Human
uagaggacccacaaaucaugauauugaacaca

SEQ ID NO: 488515 - RNA, 32 nt, Human
uagaggacuauacacuuucuuuugaacuuuua

SEQ ID NO: 488516 - RNA, 32 nt, Human
uagaggacuauaguggaagugaaagcauucug

SEQ ID NO: 488517 - RNA, 32 nt, Human
uagaggacucacugguuucuuuucauaagcaa

SEQ ID NO: 488518 - RNA, 32 nt, Human
uagaggacuucuuaugcucaagcacaaagaac

SEQ ID NO: 488519 - RNA, 32 nt, Human
uagaggagaaacuggaacucucgagcguugcu

SEQ ID NO: 488520 - RNA, 32 nt, Human
uagaggagacggauucagaagggcuacagacc

SEQ ID NO: 488521 - RNA, 32 nt, Human
uagaggagagaggaggaggaggaggcugagag

SEQ ID NO: 488522 - RNA, 32 nt, Human
uagaggagagaggucuugaggggugggagcag

SEQ ID NO: 488523 - RNA, 32 nt, Human
uagaggagaggcgacagucgcgagccacacuu

SEQ ID NO: 488524 - RNA, 32 nt, Human
uagaggagcccaagccccagcuccauccucca

SEQ ID NO: 488525 - RNA, 32 nt, Human
uagaggagcugccggugccuccucagaacauc

SEQ ID NO: 488526 - RNA, 32 nt, Human
uagaggaggaagagggagucuggcaugaguug

SEQ ID NO: 488527 - RNA, 32 nt, Human
uagaggaggaggaggaggaggaagagguggag

SEQ ID NO: 488528 - RNA, 32 nt, Human
uagaggaucauaggucuggacacuccauccuu

SEQ ID NO: 488529 - RNA, 32 nt, Human
uagaggaugacgucugaccucuaccaucgcca

SEQ ID NO: 488530 - RNA, 32 nt, Human
uagaggaugcaacacccccgcuuguggagcug

SEQ ID NO: 488531 - RNA, 31 nt, Human
uagaggaugcuuuucguuucacugggauccg

SEQ ID NO: 488532 - RNA, 32 nt, Human
uagaggauguacugggacuuggcauuuaggau

SEQ ID NO: 488533 - RNA, 32 nt, Human
uagaggcaaacagggucucacucuguugccua

SEQ ID NO: 488534 - RNA, 32 nt, Human
uagaggcaagccaggccagggagcugggagcg

SEQ ID NO: 488535 - RNA, 20 nt, Human
uagaggcacgcaccaccgcg

SEQ ID NO: 488536 - RNA, 32 nt, Human
uagaggcagaaaaaggaggauaaagauaacag

SEQ ID NO: 488537 - RNA, 32 nt, Human
uagaggcagaaaguaggaaccagauagagaug

SEQ ID NO: 488538 - RNA, 32 nt, Human
uagaggcagcagcguguguaaagagcuugggg

SEQ ID NO: 488539 - RNA, 32 nt, Human
uagaggcagcugaacauauagggcacauuuuc

SEQ ID NO: 488540 - RNA, 32 nt, Human
uagaggcaggauuccuucccacccucaaagca

SEQ ID NO: 488541 - RNA, 32 nt, Human
uagaggcaggcagaucacgaggucaagagaua

SEQ ID NO: 488542 - RNA, 32 nt, Human
uagaggcagguuuucaccauguuggcuaggcu

SEQ ID NO: 488543 - RNA, 32 nt, Human
uagaggcaugagccaccgugcccagccucaaa

SEQ ID NO: 488544 - RNA, 32 nt, Human
uagaggcaugagccacugcgcccggccccugg

SEQ ID NO: 488545 - RNA, 32 nt, Human
uagaggcaugagccacuguccccggccuccug

SEQ ID NO: 488546 - RNA, 32 nt, Human
uagaggcauguaucaccaugcccagcuaauuu

SEQ ID NO: 488547 - RNA, 32 nt, Human
uagaggcauuaaguauugccucagucuuaaua

SEQ ID NO: 488548 - RNA, 32 nt, Human
uagaggccacacucaguuaauaauggggcaca

SEQ ID NO: 488549 - RNA, 21 nt, Human
uagaggccacggucccgggga

SEQ ID NO: 488550 - RNA, 32 nt, Human
uagaggccaggauuuugagaccagcuucggca

SEQ ID NO: 488551 - RNA, 21 nt, Human
uagaggccaucgcucaggaga

SEQ ID NO: 488552 - RNA, 32 nt, Human
uagaggcccagccucuguggcccugugaccug

SEQ ID NO: 488553 - RNA, 32 nt, Human
uagaggcccagccucuguggcgcugugaucug

SEQ ID NO: 488554 - RNA, 32 nt, Human
uagaggcccagccucuguggcgcuguuaccag

SEQ ID NO: 488555 - RNA, 32 nt, Human
uagaggcccauggaggaaaaggaagauaagca

SEQ ID NO: 488556 - RNA, 32 nt, Human
uagaggcccgagcgccuggugcugagugcacc

SEQ ID NO: 488557 - RNA, 32 nt, Human
uagaggcggaguuucgccauguuggucaggcu

SEQ ID NO: 488558 - RNA, 32 nt, Human
uagaggcgugagccacugcaccugaccuaaga

SEQ ID NO: 488559 - RNA, 32 nt, Human
uagaggcgugagcccccaugcuuggccuuacc

SEQ ID NO: 488560 - RNA, 32 nt, Human
uagaggcgugugccaccaugccuggcuaauuu

SEQ ID NO: 488561 - RNA, 32 nt, Human
uagaggcucacaugggaguuguccucacccuu

SEQ ID NO: 488562 - RNA, 32 nt, Human
uagaggcugacggcgcaagaccagcuuuagcc

SEQ ID NO: 488563 - RNA, 32 nt, Human
uagaggcugacuuggaaaccggugggugcaau

SEQ ID NO: 488564 - RNA, 32 nt, Human
uagaggcugagagaagaaggaagaaucagccc

SEQ ID NO: 488565 - RNA, 32 nt, Human
uagaggcugccucugugugugguuuaaguaaa

SEQ ID NO: 488566 - RNA, 32 nt, Human
uagaggcugggaggagccccuggacaugccug

SEQ ID NO: 488567 - RNA, 24 nt, Human
uagaggcuuacucagccuguggga

SEQ ID NO: 488568 - RNA, 32 nt, Human
uagaggcuucugacuccugggacuuuggagcu

SEQ ID NO: 488569 - RNA, 32 nt, Human
uagaggcuugacuugcagugaaacccguccua

SEQ ID NO: 488570 - RNA, 32 nt, Human
uagaggcuugagccaccaggcccggcuggaau

SEQ ID NO: 488571 - RNA, 32 nt, Human
uagaggcuugagccacugcaccuggccucaug

SEQ ID NO: 488572 - RNA, 32 nt, Human
uagagggaguggagcgagagccuacgacuaga

SEQ ID NO: 488573 - RNA, 32 nt, Human
uagagggcagggacuguggcgaggccgccgcc

SEQ ID NO: 488574 - RNA, 32 nt, Human
uagagggcaguggcaugaucucggcucacuac

SEQ ID NO: 488575 - RNA, 32 nt, Human
uagagggcauuucugucgcuguggaaguuguu

SEQ ID NO: 488576 - RNA, 32 nt, Human
uagagggcuacccaagcagaaaccccacauuu

SEQ ID NO: 488577 - RNA, 32 nt, Human
uagagggcuccugggagcgcucgcuucuccgu

SEQ ID NO: 488578 - RNA, 32 nt, Human
uagagggcugggcccuaugacuguggucuggg

SEQ ID NO: 488579 - RNA, 32 nt, Human
uagagggcuuggacacagccccggaugugagu

SEQ ID NO: 488580 - RNA, 32 nt, Human
uagaggggaggcaccuaaaggaaaagaggaaa

SEQ ID NO: 488581 - RNA, 32 nt, Human
uagaggggagguugggguuggagcagcggcga

SEQ ID NO: 488582 - RNA, 32 nt, Human
uagagggggauagaauuuuuauuucauauccu

SEQ ID NO: 488583 - RNA, 32 nt, Human
uagagggucaugcagacaaggaagaaaacuua

SEQ ID NO: 488584 - RNA, 32 nt, Human
uagaggguggcaaaaugccuuugcccaguguc

SEQ ID NO: 488585 - RNA, 32 nt, Human
uagagggugugaggagggagaggaucaagaaa

SEQ ID NO: 488586 - RNA, 32 nt, Human
uagaggguguugguaccacugccccuggccug

SEQ ID NO: 488587 - RNA, 32 nt, Human
uagaggguuauccuuuuguugugaaaggaagg

SEQ ID NO: 488588 - RNA, 32 nt, Human
uagagguagaggagcuacauuggccgcguccc

SEQ ID NO: 488589 - RNA, 32 nt, Human
uagagguagcuugccaucucucaggagcccuc

SEQ ID NO: 488590 - RNA, 32 nt, Human
uagaggucagaagaaaggagcaaguuuugcga

SEQ ID NO: 488591 - RNA, 32 nt, Human
uagaggucguuagcugggugugugggucccaa

SEQ ID NO: 488592 - RNA, 32 nt, Human
uagaggugaaaccagauguuaugagaguacuu

SEQ ID NO: 488593 - RNA, 32 nt, Human
uagaggugaugaagacacagaacaggcucagu

SEQ ID NO: 488594 - RNA, 31 nt, Human
uagagguggagacaggaaaaagacuaagcca

SEQ ID NO: 488595 - RNA, 32 nt, Human
uagagguggaggaggcaguccugggaauggga

SEQ ID NO: 488596 - RNA, 32 nt, Human
uagagguggcuuuucugcuuaacagucagccc

SEQ ID NO: 488597 - RNA, 32 nt, Human
uagaggugguagugaguaaugugccccugaaa

SEQ ID NO: 488598 - RNA, 32 nt, Human
uagaggugugagccaccacgcccggccuauuu

SEQ ID NO: 488599 - RNA, 32 nt, Human
uagaggugugagccacugugcccagcccauca

SEQ ID NO: 488600 - RNA, 32 nt, Human
uagagguuauuccaggagaguugaugaccuuc

SEQ ID NO: 488601 - RNA, 32 nt, Human
uagaguagcaagaguuuaugaugacagcccac

SEQ ID NO: 488602 - RNA, 32 nt, Human
uagaguaggguuuggccauguuggccaggcug

SEQ ID NO: 488603 - RNA, 31 nt, Human
uagaguagugagagaaggaaacaucugugga

SEQ ID NO: 488604 - RNA, 32 nt, Human
uagaguauggaggcugagccaggccuuggguu

SEQ ID NO: 488605 - RNA, 32 nt, Human
uagaguauucgguacuggacaaaaagacugga

SEQ ID NO: 488606 - RNA, 32 nt, Human
uagagucaaagucaggcucaaaagaagaauua

SEQ ID NO: 488607 - RNA, 32 nt, Human
uagagucacauguccaguagcauuucuaauuu

SEQ ID NO: 488608 - RNA, 32 nt, Human
uagagucacugggagucacacagcuccugugu

SEQ ID NO: 488609 - RNA, 32 nt, Human
uagagucagacuccuagacucacuuguucuca

SEQ ID NO: 488610 - RNA, 32 nt, Human
uagagucagccuucccccucccagggccaggg

SEQ ID NO: 488611 - RNA, 32 nt, Human
uagagucaggacagaaaagcuuccauaauuga

SEQ ID NO: 488612 - RNA, 32 nt, Human
uagagucaggcagagguuaaguguguugcacc

SEQ ID NO: 488613 - RNA, 32 nt, Human
uagagucaggcugcaguggaaucucccuagga

SEQ ID NO: 488614 - RNA, 32 nt, Human
uagagucaugguaguggguaaaagccaaagag

SEQ ID NO: 488615 - RNA, 32 nt, Human
uagaguccagccuggccaacauggugaaaccc

SEQ ID NO: 488616 - RNA, 32 nt, Human
uagagucccuccaaccuuauagauuuuuggcu

SEQ ID NO: 488617 - RNA, 32 nt, Human
uagaguccuggauacgugcaccaggagaguug

SEQ ID NO: 488618 - RNA, 32 nt, Human
uagagucgagcggggcaagggagccaguggcc

SEQ ID NO: 488619 - RNA, 32 nt, Human
uagagucgccugaaccugggaggcagagguug

SEQ ID NO: 488620 - RNA, 32 nt, Human
uagagucgguuucuggagcugccuuccuggga

SEQ ID NO: 488621 - RNA, 32 nt, Human
uagagucuaacuuugguucauuucugcacagg

SEQ ID NO: 488622 - RNA, 32 nt, Human
uagagucucaacucacucuagccugggugaca

SEQ ID NO: 488623 - RNA, 31 nt, Human
uagagucucaauaaaugucacuugguugguu

SEQ ID NO: 488624 - RNA, 32 nt, Human
uagagucucucccccuccccuuucucuuucuu

SEQ ID NO: 488625 - RNA, 32 nt, Human
uagagucucucuuccuccucagcgaaccacua

SEQ ID NO: 488626 - RNA, 32 nt, Human
uagagucucuggaagguuuuaagcccauuuuc

SEQ ID NO: 488627 - RNA, 32 nt, Human
uagagucugagccucaggcucuccugcccugg

SEQ ID NO: 488628 - RNA, 32 nt, Human
uagagucugaguuugugagauuauuuggggga

SEQ ID NO: 488629 - RNA, 32 nt, Human
uagagucuggagguugcaagggagacagccaa

SEQ ID NO: 488630 - RNA, 32 nt, Human
uagagugaaagaaaaagaaagagagcacgaac

SEQ ID NO: 488631 - RNA, 32 nt, Human
uagagugaagaaugcuaauguaaagcaaauag

SEQ ID NO: 488632 - RNA, 32 nt, Human
uagagugaagacagcugcuguuuuaauauauu

SEQ ID NO: 488633 - RNA, 32 nt, Human
uagagugaaucacaccuguaaucccagcacuu

SEQ ID NO: 488634 - RNA, 32 nt, Human
uagagugaauggaacaaagauuuguuagggga

SEQ ID NO: 488635 - RNA, 32 nt, Human
uagagugaccuuuuaaucagagcccagggaag

SEQ ID NO: 488636 - RNA, 32 nt, Human
uagagugacucacaccuguaaucccagcacuu

SEQ ID NO: 488637 - RNA, 32 nt, Human
uagagugacucgcaccuguaaucccagcacuu

SEQ ID NO: 488638 - RNA, 32 nt, Human
uagagugacuuguacaugagcuugcuugcaga

SEQ ID NO: 488639 - RNA, 20 nt, Human
uagagugagacccugucuca

SEQ ID NO: 488640 - RNA, 20 nt, Human
uagagugagacuacgucuca

SEQ ID NO: 488641 - RNA, 32 nt, Human
uagagugaggucuauaggaccaaugucucggg

SEQ ID NO: 488642 - RNA, 32 nt, Human
uagagugagugugcucuguugcugugaugcug

SEQ ID NO: 488643 - RNA, 32 nt, Human
uagagugaguucccaccugcccuaccuaaacu

SEQ ID NO: 488644 - RNA, 32 nt, Human
uagagugcaauggcaugaucuuggcucacugc

SEQ ID NO: 488645 - RNA, 32 nt, Human
uagagugcaguagcgugaucauagcuuacugc

SEQ ID NO: 488646 - RNA, 32 nt, Human
uagagugcaguggcacgaucucagcucacugc

SEQ ID NO: 488647 - RNA, 32 nt, Human
uagagugcaguggcacgaucuuggcucacugc

SEQ ID NO: 488648 - RNA, 32 nt, Human
uagagugcaguggcacgaucuuggcuuacugc

SEQ ID NO: 488649 - RNA, 32 nt, Human
uagagugcaguggcaugaucauagguuauugc

SEQ ID NO: 488650 - RNA, 32 nt, Human
uagagugcaguggcaugaucuaugcucacugu

SEQ ID NO: 488651 - RNA, 32 nt, Human
uagagugcaguggcaugaucucagcucacugc

SEQ ID NO: 488652 - RNA, 32 nt, Human
uagagugcaguggcaugaucucagcucauugc

SEQ ID NO: 488653 - RNA, 32 nt, Human
uagagugcaguggcaugaucucggcucacugc

SEQ ID NO: 488654 - RNA, 32 nt, Human
uagagugcaguggcaugaucucggcuuacugc

SEQ ID NO: 488655 - RNA, 32 nt, Human
uagagugcaguggcaugaucuuggcucacugc

SEQ ID NO: 488656 - RNA, 32 nt, Human
uagagugcaguggcgugaucucggcucacugc

SEQ ID NO: 488657 - RNA, 32 nt, Human
uagagugcaguggcgugaucucugcucauugc

SEQ ID NO: 488658 - RNA, 32 nt, Human
uagagugcaguggcuugaucauagcucacugc

SEQ ID NO: 488659 - RNA, 32 nt, Human
uagagugcagugguaugaucucagcuuacugc

SEQ ID NO: 488660 - RNA, 32 nt, Human
uagagugcaguggugugaucacagcucacugc

SEQ ID NO: 488661 - RNA, 32 nt, Human
uagagugcccagcagagguuugcugacaggug

SEQ ID NO: 488662 - RNA, 32 nt, Human
uagagugccuuggcucccuccugucguccugg

SEQ ID NO: 488663 - RNA, 32 nt, Human
uagagugcuggcuccugggccucccagcccuc

SEQ ID NO: 488664 - RNA, 32 nt, Human
uagagugcuguugggccagggugggaggaugg

SEQ ID NO: 488665 - RNA, 32 nt, Human
uagaguggcucaaaguacuucaggauuaggaa

SEQ ID NO: 488666 - RNA, 20 nt, Human
uagagugggaagaagaggcu

SEQ ID NO: 488667 - RNA, 22 nt, Human
uagagugggaagagggggcugg

SEQ ID NO: 488668 - RNA, 24 nt, Human
uagagugggaaggacuaaagacug

SEQ ID NO: 488669 - RNA, 21 nt, Human
uagagugggacccagcccuca

SEQ ID NO: 488670 - RNA, 32 nt, Human
uagagugggacccagcccucaccucccccaga

SEQ ID NO: 488671 - RNA, 32 nt, Human
uagaguggucucagaagugccuucaggacaau

SEQ ID NO: 488672 - RNA, 32 nt, Human
uagaguggucucaucuccuuccuuaaucuucc

SEQ ID NO: 488673 - RNA, 32 nt, Human
uagaguguacagcuucuucccacagcaaacag

SEQ ID NO: 488674 - RNA, 32 nt, Human
uagaguguaguggcaugaucucagcucacugc

SEQ ID NO: 488675 - RNA, 31 nt, Human
uagaguguauuuuucccuugcuuuugggggu

SEQ ID NO: 488676 - RNA, 32 nt, Human
uagagugugagccagccuguguuccugaaugc

SEQ ID NO: 488677 - RNA, 32 nt, Human
uagaguguggaaagucugagaauauuagcuuu

SEQ ID NO: 488678 - RNA, 32 nt, Human
uagagugugguguuuugaauuugcucuuuguc

SEQ ID NO: 488679 - RNA, 32 nt, Human
uagaguuaagagaaccuuaaaagauuaccgcu

SEQ ID NO: 488680 - RNA, 32 nt, Human
uagaguuaagugaagaguuaacacugugacuu

SEQ ID NO: 488681 - RNA, 32 nt, Human
uagaguucaucccagccccaauuuucuggggc

SEQ ID NO: 488682 - RNA, 32 nt, Human
uagaguucuccagagccccaaggagcgggagg

SEQ ID NO: 488683 - RNA, 32 nt, Human
uagaguucugggacuguggucugcccaccccc

SEQ ID NO: 488684 - RNA, 32 nt, Human
uagaguugcacccuagcaaccuagccagaaaa

SEQ ID NO: 488685 - RNA, 32 nt, Human
uagaguuggaaggucccagaccuggaacaaca

SEQ ID NO: 488686 - RNA, 32 nt, Human
uagaguugucuaccaagcaaaauguucgcuca

SEQ ID NO: 488687 - RNA, 32 nt, Human
uagaguugugagccaccgcugccagcccagag

SEQ ID NO: 488688 - RNA, 32 nt, Human
uagaguugugguccaaagaagcuccuaaagcu

SEQ ID NO: 488689 - RNA, 32 nt, Human
uagaguuugaaggaggugagggaugugaauug

SEQ ID NO: 488690 - RNA, 32 nt, Human
uagauaaagaagaguccuauggcuuauuuaau

SEQ ID NO: 488691 - RNA, 32 nt, Human
uagauaaaguaagccuagguguugucagcagg

SEQ ID NO: 488692 - RNA, 32 nt, Human
uagauaaauauguauaucaauauuuuaaauuc

SEQ ID NO: 488693 - RNA, 32 nt, Human
uagauaaaugaauucaaccaguugaucaaaug

SEQ ID NO: 488694 - RNA, 32 nt, Human
uagauaacagauuaguaguuacaugguaauua

SEQ ID NO: 488695 - RNA, 32 nt, Human
uagauaacuccaacuucuggcuguagagcacc

SEQ ID NO: 488696 - RNA, 32 nt, Human
uagauaagaguuucagguuaaauacuggaaca

SEQ ID NO: 488697 - RNA, 32 nt, Human
uagauaagcccagcagccccagaagauggucu

SEQ ID NO: 488698 - RNA, 32 nt, Human
uagauaaucacauaauagugggagauuucagu

SEQ ID NO: 488699 - RNA, 32 nt, Human
uagauaaucacauuuucugggcccuguaaaau

SEQ ID NO: 488700 - RNA, 32 nt, Human
uagauaauccugaauugaggucaugaggaggc

SEQ ID NO: 488701 - RNA, 32 nt, Human
uagauaaugcucgggcuuguuuugccauuuuu

SEQ ID NO: 488702 - RNA, 32 nt, Human
uagauaauuucuaacagagaggccccagcaau

SEQ ID NO: 488703 - RNA, 32 nt, Human
uagauacaacagcaagcccaagauuccgaaga

SEQ ID NO: 488704 - RNA, 32 nt, Human
uagauacaacagccacagcuccccaucaccua

SEQ ID NO: 488705 - RNA, 32 nt, Human
uagauacagaagccacacagaacugcauaaag

SEQ ID NO: 488706 - RNA, 32 nt, Human
uagauacauacgaauuguuaaaauggaaugca

SEQ ID NO: 488707 - RNA, 32 nt, Human
uagauacauagauagacgauucagagauagau

SEQ ID NO: 488708 - RNA, 32 nt, Human
uagauacaucacauuaaagcuuuucagaaucu

SEQ ID NO: 488709 - RNA, 32 nt, Human
uagauaccaaauauuuguuuguguuaccuuga

SEQ ID NO: 488710 - RNA, 32 nt, Human
uagauacuaaaucgucccuucuccaguccuga

SEQ ID NO: 488711 - RNA, 32 nt, Human
uagauacuaguugucugaauugaguuacuuug

SEQ ID NO: 488712 - RNA, 32 nt, Human
uagauacuugcaugaucuacuguagucaacgu

SEQ ID NO: 488713 - RNA, 31 nt, Human
uagauagaacaaucuuucuauauuuaauuuu

SEQ ID NO: 488714 - RNA, 32 nt, Human
uagauagccagucaaccagcaguauuagugcu

SEQ ID NO: 488715 - RNA, 32 nt, Human
uagauagcgccacugcacugcacgccagccua

SEQ ID NO: 488716 - RNA, 32 nt, Human
uagauagggaaacugaggcuuugggaggacuc

SEQ ID NO: 488717 - RNA, 32 nt, Human
uagauagggcugggcaaggaaaaagaaaauaa

SEQ ID NO: 488718 - RNA, 32 nt, Human
uagauaguagccacugccugaagcuuugcauc

SEQ ID NO: 488719 - RNA, 32 nt, Human
uagauaguggaugaagaaagaaggacgaggaa

SEQ ID NO: 488720 - RNA, 32 nt, Human
uagauauagaaucaugucaucuguaaacagag

SEQ ID NO: 488721 - RNA, 32 nt, Human
uagauaucaucugagagguaguuaauuuggca

SEQ ID NO: 488722 - RNA, 32 nt, Human
uagauaucuagaggugaaauuacugagucaag

SEQ ID NO: 488723 - RNA, 32 nt, Human
uagauaucugggaccuuucucaggaucugugu

SEQ ID NO: 488724 - RNA, 32 nt, Human
uagauaucuuuuuauugaugugcaaaaauuuu

SEQ ID NO: 488725 - RNA, 32 nt, Human
uagauaugauguuggguccacccuccacgggc

SEQ ID NO: 488726 - RNA, 30 nt, Human
uagauaugcugaaaaacaaagcaaagagau

SEQ ID NO: 488727 - RNA, 32 nt, Human
uagauauggaaaauagugaugaaccagaguuu

SEQ ID NO: 488728 - RNA, 32 nt, Human
uagauauggaauugcauuuucaagccaagcug

SEQ ID NO: 488729 - RNA, 32 nt, Human
uagauauggaguuucaccacguuggccaagac

SEQ ID NO: 488730 - RNA, 32 nt, Human
uagauauggcuuuuagaguuacauuaugcuug

SEQ ID NO: 488731 - RNA, 32 nt, Human
uagauaugucugucuuuuuggguccucagaga

SEQ ID NO: 488732 - RNA, 32 nt, Human
uagauauuaaaauguucagcaggcacaguucu

SEQ ID NO: 488733 - RNA, 32 nt, Human
uagauauucuuucuuauccuggacugguucuc

SEQ ID NO: 488734 - RNA, 32 nt, Human
uagauauuggguuccuggauuaagaugacuuc

SEQ ID NO: 488735 - RNA, 23 nt, Human
uagaucaagaucagcuucacuca

SEQ ID NO: 488736 - RNA, 32 nt, Human
uagaucacaggcugagggacagagcaaagacc

SEQ ID NO: 488737 - RNA, 32 nt, Human
uagaucacccuuguaauguguuacggguccau

SEQ ID NO: 488738 - RNA, 19 nt, Human
uagaucacuugaggucagg

SEQ ID NO: 488739 - RNA, 32 nt, Human
uagaucacuuuggugaaugcuaguuucaaauu

SEQ ID NO: 488740 - RNA, 32 nt, Human
uagaucagaugaauuaucaucggcauuaacgu

SEQ ID NO: 488741 - RNA, 22 nt, Human
uagaucagccaucagccuguca

SEQ ID NO: 488742 - RNA, 32 nt, Human
uagaucagcuaacaucugcuacuccaguaaca

SEQ ID NO: 488743 - RNA, 32 nt, Human
uagaucagcugguuaagaguccagccuggguu

SEQ ID NO: 488744 - RNA, 32 nt, Human
uagaucaggagaaacucgggcacucccuaagu

SEQ ID NO: 488745 - RNA, 32 nt, Human
uagaucaguacuugauuucauuuucauuuucc

SEQ ID NO: 488746 - RNA, 31 nt, Human
uagaucagugagaggagauugcaguucuaau

SEQ ID NO: 488747 - RNA, 32 nt, Human
uagaucauaugacugccuuucuguaaaauugg

SEQ ID NO: 488748 - RNA, 32 nt, Human
uagaucaucucuuucauaaugauaugauguua

SEQ ID NO: 488749 - RNA, 32 nt, Human
uagaucaugccaccaugccacugcacuccagc

SEQ ID NO: 488750 - RNA, 32 nt, Human
uagaucaugccacugcacuccagccuauguga

SEQ ID NO: 488751 - RNA, 32 nt, Human
uagaucaugccuguaaucccaguacuuuggga

SEQ ID NO: 488752 - RNA, 32 nt, Human
uagaucauggcaaggccugacaacagcugagc

SEQ ID NO: 488753 - RNA, 32 nt, Human
uagaucauggcuguucuucccaccucaucccu

SEQ ID NO: 488754 - RNA, 19 nt, Human
uagaucauuccaguucaua

SEQ ID NO: 488755 - RNA, 32 nt, Human
uagauccaaaugacauggcacaugugugccca

SEQ ID NO: 488756 - RNA, 32 nt, Human
uagauccacuggcagcuugcacucucagccug

SEQ ID NO: 488757 - RNA, 32 nt, Human
uagauccagcuacucgggaggcugaggcaggg

SEQ ID NO: 488758 - RNA, 32 nt, Human
uagaucccaaagauucuuggugaauuuugaag

SEQ ID NO: 488759 - RNA, 32 nt, Human
uagaucccacugagcccagcugacugaaaaca

SEQ ID NO: 488760 - RNA, 32 nt, Human
uagauccuaucauuccuuaaacauaauacccu

SEQ ID NO: 488761 - RNA, 32 nt, Human
uagauccuccaauguaaauauaaacaugccau

SEQ ID NO: 488762 - RNA, 32 nt, Human
uagauccugaaccuguccuugcuucucaguuu

SEQ ID NO: 488763 - RNA, 32 nt, Human
uagauccugggucuccccuuaaugucacccuu

SEQ ID NO: 488764 - RNA, 20 nt, Human
uagauccuguccaccuccac

SEQ ID NO: 488765 - RNA, 32 nt, Human
uagauccuguuuugggguuugcacauggaucg

SEQ ID NO: 488766 - RNA, 32 nt, Human
uagaucgcgccacugcacuccagccugggcga

SEQ ID NO: 488767 - RNA, 32 nt, Human
uagaucgcgucacugcacuccagccugggaga

SEQ ID NO: 488768 - RNA, 32 nt, Human
uagaucgcgucacugcacuccagccugggcga

SEQ ID NO: 488769 - RNA, 32 nt, Human
uagaucgguggcaggggagcagcguuugaucc

SEQ ID NO: 488770 - RNA, 32 nt, Human
uagaucgugccacugcauuccagccugagcga

SEQ ID NO: 488771 - RNA, 32 nt, Human
uagaucgugccauugcacuccagucugggaga

SEQ ID NO: 488772 - RNA, 32 nt, Human
uagaucguggggacagagaugggugauggaac

SEQ ID NO: 488773 - RNA, 32 nt, Human
uagaucuauaaggucacaugcuuuuaaaauag

SEQ ID NO: 488774 - RNA, 32 nt, Human
uagaucucugcacuuggcauggaaaauuuuga

SEQ ID NO: 488775 - RNA, 32 nt, Human
uagaucucuguuuuagaccaguagaccuaacu

SEQ ID NO: 488776 - RNA, 32 nt, Human
uagaucugaagcauaauuuaagaaaaacauca

SEQ ID NO: 488777 - RNA, 32 nt, Human
uagaucugggaggccaggcuggcaugauuccu

SEQ ID NO: 488778 - RNA, 32 nt, Human
uagaucugggcagcauuugacauggcugauca

SEQ ID NO: 488779 - RNA, 32 nt, Human
uagaucuggugcuucuucugugcugugguuua

SEQ ID NO: 488780 - RNA, 32 nt, Human
uagaucuguuccaacaguucuguguaaaccaa

SEQ ID NO: 488781 - RNA, 19 nt, Human
uagaucuugaucauucgca

SEQ ID NO: 488782 - RNA, 32 nt, Human
uagaucuugccacugcucuccagccugagcga

SEQ ID NO: 488783 - RNA, 32 nt, Human
uagaucuuucauuccaccucaggaaugagguu

SEQ ID NO: 488784 - RNA, 32 nt, Human
uagaucuuuccacaugcucugccauuaauuag

SEQ ID NO: 488785 - RNA, 32 nt, Human
uagaugaacugcugcccagugaacacuaugua

SEQ ID NO: 488786 - RNA, 32 nt, Human
uagaugacguuuccuauguaaguagguagccc

SEQ ID NO: 488787 - RNA, 32 nt, Human
uagaugacucucaguccccauggcacccugcu

SEQ ID NO: 488788 - RNA, 32 nt, Human
uagaugagcccagcccuguucugggugcagcu

SEQ ID NO: 488789 - RNA, 31 nt, Human
uagaugaggaaacugagucucagaagggcuu

SEQ ID NO: 488790 - RNA, 32 nt, Human
uagaugaggccuucccauggcuacagugugac

SEQ ID NO: 488791 - RNA, 32 nt, Human
uagaugagugaaaaggaggaaaggcgaaguag

SEQ ID NO: 488792 - RNA, 32 nt, Human
uagaugaucucucagacaggcugggacucaga

SEQ ID NO: 488793 - RNA, 32 nt, Human
uagaugaucugugugcuucuagcacaucagaa

SEQ ID NO: 488794 - RNA, 32 nt, Human
uagaugaugagacuggaggaagacuuccauug

SEQ ID NO: 488795 - RNA, 32 nt, Human
uagaugauugcugcuuuccuuugccaaacuug

SEQ ID NO: 488796 - RNA, 24 nt, Human
uagaugcaaagcauuauaaugacu

SEQ ID NO: 488797 - RNA, 32 nt, Human
uagaugcacagcacuuccuuguccucaugaaa

SEQ ID NO: 488798 - RNA, 32 nt, Human
uagaugcacuaagaauucacugcagcagcagg

SEQ ID NO: 488799 - RNA, 32 nt, Human
uagaugcacuuucuuuuuccaccagcacaucc

SEQ ID NO: 488800 - RNA, 32 nt, Human
uagaugcauuauacuccauaccugcuuuuccc

SEQ ID NO: 488801 - RNA, 32 nt, Human
uagaugcccagcugcacaacuugauugccuua

SEQ ID NO: 488802 - RNA, 32 nt, Human
uagaugcccagcuguggcuggguacaguguuc

SEQ ID NO: 488803 - RNA, 32 nt, Human
uagaugcccugguuugucccucuugucuccug

SEQ ID NO: 488804 - RNA, 32 nt, Human
uagaugccucucccccuccagcccuagccgag

SEQ ID NO: 488805 - RNA, 32 nt, Human
uagaugccucucccccuccaguccuagcccag

SEQ ID NO: 488806 - RNA, 32 nt, Human
uagaugccuuccaggcugcagucagugcagau

SEQ ID NO: 488807 - RNA, 32 nt, Human
uagaugccuucccacccaccaggcauugcccc

SEQ ID NO: 488808 - RNA, 28 nt, Human
uagaugcucaauaaacacuuguugaaug

SEQ ID NO: 488809 - RNA, 32 nt, Human
uagaugcugggaaguccaagaucagggugccg

SEQ ID NO: 488810 - RNA, 32 nt, Human
uagauggaauuucacucuuguugcccaggcua

SEQ ID NO: 488811 - RNA, 32 nt, Human
uagauggaguuucacucuuguugcccaggcca

SEQ ID NO: 488812 - RNA, 23 nt, Human
uagauggaguuucacuuuuguug

SEQ ID NO: 488813 - RNA, 32 nt, Human
uagauggaguuucacuuuuguugcccaggcug

SEQ ID NO: 488814 - RNA, 32 nt, Human
uagauggaguuuuacucuuguugcccaggcug

SEQ ID NO: 488815 - RNA, 32 nt, Human
uagauggccuaaaagaaucauggggaaauguu

SEQ ID NO: 488816 - RNA, 28 nt, Human
uagauggcggcugcagaggcugugcauc

SEQ ID NO: 488817 - RNA, 32 nt, Human
uagaugggaauuugagggagaauacagagaua

SEQ ID NO: 488818 - RNA, 32 nt, Human
uagaugggaccuuccacaaauaugucuucacu

SEQ ID NO: 488819 - RNA, 32 nt, Human
uagaugggacgugauggauggaauugaaguua

SEQ ID NO: 488820 - RNA, 27 nt, Human
uagaugggauuucaauucaccauguug

SEQ ID NO: 488821 - RNA, 32 nt, Human
uagaugggccugauuagagcagucaucuccug

SEQ ID NO: 488822 - RNA, 32 nt, Human
uagaugggccuguggucccaaaguaggucagu

SEQ ID NO: 488823 - RNA, 27 nt, Human
uagauggggccagcuuccacuauguug

SEQ ID NO: 488824 - RNA, 22 nt, Human
uagaugggguuucaccauguug

SEQ ID NO: 488825 - RNA, 32 nt, Human
uagaugguacuucuccagccuuccguuucuug

SEQ ID NO: 488826 - RNA, 32 nt, Human
uagauggugcaggugaguuugcaaugagggaa

SEQ ID NO: 488827 - RNA, 32 nt, Human
uagauguacauuccugagguucuuuuaucugu

SEQ ID NO: 488828 - RNA, 32 nt, Human
uagauguaccuguuuugcuuucacacuuaaua

SEQ ID NO: 488829 - RNA, 32 nt, Human
uagauguaguuuugcucuuguugcccaggcug

SEQ ID NO: 488830 - RNA, 32 nt, Human
uagaugucacacuggggagaaaccuuacaggu

SEQ ID NO: 488831 - RNA, 32 nt, Human
uagaugucaccuaagugauaguuaacccauuu

SEQ ID NO: 488832 - RNA, 32 nt, Human
uagaugucagaggcauggcugggccuccaucu

SEQ ID NO: 488833 - RNA, 32 nt, Human
uagauguccucaccccuccucacugccucucc

SEQ ID NO: 488834 - RNA, 32 nt, Human
uagaugucuuacaagucuuauauuuuugucuu

SEQ ID NO: 488835 - RNA, 32 nt, Human
uagaugugagccagcacaccgggccaagugaa

SEQ ID NO: 488836 - RNA, 32 nt, Human
uagaugugcaauagaaauagcuaauuuauuuc

SEQ ID NO: 488837 - RNA, 32 nt, Human
uagaugugugugugcacacacacagaaaccac

SEQ ID NO: 488838 - RNA, 31 nt, Human
uagauguucaauaaauauuuguugaaugagu

SEQ ID NO: 488839 - RNA, 32 nt, Human
uagauguucuugcuguguuaggaggugauaaa

SEQ ID NO: 488840 - RNA, 32 nt, Human
uagauguugcuuuccagccaggaaucuaaagc

SEQ ID NO: 488841 - RNA, 32 nt, Human
uagauguuggguuccuggauuaagaugacuuc

SEQ ID NO: 488842 - RNA, 32 nt, Human
uagauguuguuuuguucugugauggcuuuuuc

SEQ ID NO: 488843 - RNA, 32 nt, Human
uagauguuucuguuaugcucucucguuggcag

SEQ ID NO: 488844 - RNA, 32 nt, Human
uagauguuuuuagaaaaacuugugaaugaaaa

SEQ ID NO: 488845 - RNA, 32 nt, Human
uagauuacccuccaugauguggaugggccuga

SEQ ID NO: 488846 - RNA, 32 nt, Human
uagauuauuccaguaucccauggaagcugagg

SEQ ID NO: 488847 - RNA, 32 nt, Human
uagauucaaugccauccccaucaagcuaccaa

SEQ ID NO: 488848 - RNA, 32 nt, Human
uagauucacagaaauccaaagcuguauguagu

SEQ ID NO: 488849 - RNA, 32 nt, Human
uagauucacuccugccaugccuugccaauagu

SEQ ID NO: 488850 - RNA, 32 nt, Human
uagauucacuuaacaaacaaauuuuucugcuu

SEQ ID NO: 488851 - RNA, 32 nt, Human
uagauucauggcagaaaaugaccaaauccugu

SEQ ID NO: 488852 - RNA, 32 nt, Human
uagauucauugagcucacccuagaugaguccu

SEQ ID NO: 488853 - RNA, 32 nt, Human
uagauuccauuuuucuuaucucuuauuucuca

SEQ ID NO: 488854 - RNA, 32 nt, Human
uagauucccaggaacugggaaaugcagucagu

SEQ ID NO: 488855 - RNA, 32 nt, Human
uagauuccccgguggguuagacaggaaguaac

SEQ ID NO: 488856 - RNA, 32 nt, Human
uagauuccccucccagacacccucauuccugu

SEQ ID NO: 488857 - RNA, 32 nt, Human
uagauuccucaccaacuacuaccagucauuug

SEQ ID NO: 488858 - RNA, 32 nt, Human
uagauuccuuucuccugcuucauauaggccaa

SEQ ID NO: 488859 - RNA, 32 nt, Human
uagauugaagugugugugaugggggugcagcu

SEQ ID NO: 488860 - RNA, 32 nt, Human
uagauugcaaaugaccugcuuucuuucggauc

SEQ ID NO: 488861 - RNA, 32 nt, Human
uagauugcaaaugaccugcuuucuuucuguuc

SEQ ID NO: 488862 - RNA, 32 nt, Human
uagauugcaccacugcacucuagccuggguaa

SEQ ID NO: 488863 - RNA, 32 nt, Human
uagauugcaucaaauaaaaaugagcuacuuua

SEQ ID NO: 488864 - RNA, 32 nt, Human
uagauugcaugucauacuccauuugguucaac

SEQ ID NO: 488865 - RNA, 32 nt, Human
uagauugcgcuacugcacuccagccuaggcaa

SEQ ID NO: 488866 - RNA, 32 nt, Human
uagauugcuccuggagugugggaacaacaguc

SEQ ID NO: 488867 - RNA, 21 nt, Human
uagauuggagccaccaugccc

SEQ ID NO: 488868 - RNA, 32 nt, Human
uagauuggagccaccaugcccagcucagaggg

SEQ ID NO: 488869 - RNA, 32 nt, Human
uagauuggagccauggcuuuggaacagaacca

SEQ ID NO: 488870 - RNA, 32 nt, Human
uagauugggacccccuucaaaccuaaaaauca

SEQ ID NO: 488871 - RNA, 32 nt, Human
uagauugggaggugguuuguuuggugaauggg

SEQ ID NO: 488872 - RNA, 32 nt, Human
uagauugggcagggagaugggaggagucguga

SEQ ID NO: 488873 - RNA, 32 nt, Human
uagauuggguaucaccuuuaggauaacccaaa

SEQ ID NO: 488874 - RNA, 32 nt, Human
uagauugggugagggggacggggaugucaggg

SEQ ID NO: 488875 - RNA, 32 nt, Human
uagauugucauccugguuguccaacucugaau

SEQ ID NO: 488876 - RNA, 32 nt, Human
uagauugucccuuauuuccuucauacaugauu

SEQ ID NO: 488877 - RNA, 32 nt, Human
uagauugugcuacugcacucuagauuggguga

SEQ ID NO: 488878 - RNA, 32 nt, Human
uagauuguguuaucacucugccuguguauagu

SEQ ID NO: 488879 - RNA, 32 nt, Human
uagauuguuccuaucccccucuccuugaugug

SEQ ID NO: 488880 - RNA, 32 nt, Human
uagauuguuggggguggggagggagggaucua

SEQ ID NO: 488881 - RNA, 32 nt, Human
uagauuguuucagcuucucuuguuucauuuuc

SEQ ID NO: 488882 - RNA, 23 nt, Human
uagauuuaacaguguugauucuc

SEQ ID NO: 488883 - RNA, 32 nt, Human
uagauuuacaucuuuguccuugcucccaacga

SEQ ID NO: 488884 - RNA, 32 nt, Human
uagauuuagauccuucaccuuccuuuugcuuu

SEQ ID NO: 488885 - RNA, 32 nt, Human
uagauuucaauccaguccuagcacuugaucuc

SEQ ID NO: 488886 - RNA, 32 nt, Human
uagauuucaccuuuguuucauuauuacagcag

SEQ ID NO: 488887 - RNA, 32 nt, Human
uagauuuccucuuucauuacuuuuaguaacca

SEQ ID NO: 488888 - RNA, 32 nt, Human
uagauuugagauuaaaguggucauuugcagau

SEQ ID NO: 488889 - RNA, 32 nt, Human
uagauuugaugacucuuuuucugccuccaaag

SEQ ID NO: 488890 - RNA, 32 nt, Human
uagauuugcaagcugcucauuuuugacagcuu

SEQ ID NO: 488891 - RNA, 32 nt, Human
uagauuugcucuauugaaaauguuucauuuuu

SEQ ID NO: 488892 - RNA, 32 nt, Human
uagauuuggaaaugagcuuugcaaagacuuuu

SEQ ID NO: 488893 - RNA, 32 nt, Human
uagauuuggagaggaaggauggagguggacuc

SEQ ID NO: 488894 - RNA, 32 nt, Human
uagauuugggcaauggaggugaugacagcauu

SEQ ID NO: 488895 - RNA, 32 nt, Human
uagauuugguuuuccuuucuuuacuuacccug

SEQ ID NO: 488896 - RNA, 31 nt, Human
uagauuuuaagugccuuuucacugggagaau

SEQ ID NO: 488897 - RNA, 32 nt, Human
uagauuuucucagcuaaacggaagggaaaugc

SEQ ID NO: 488898 - RNA, 32 nt, Human
uagauuuucucagcuaaacggaagggaaaugu

SEQ ID NO: 488899 - RNA, 32 nt, Human
uagauuuucucagcuaaacuguagggaaaugc

SEQ ID NO: 488900 - RNA, 32 nt, Human
uagauuuugaauccugccucugccauuuccug

SEQ ID NO: 488901 - RNA, 32 nt, Human
uagauuuugguauucaaggagggaggauccug

SEQ ID NO: 488902 - RNA, 32 nt, Human
uagauuuuuacccaggccagugcagagaggug

SEQ ID NO: 488903 - RNA, 32 nt, Human
uagauuuuugcaccaucugccgacgaaccccu

SEQ ID NO: 488904 - RNA, 32 nt, Human
uagauuuuuggucacuugcuuuuauagacuau

SEQ ID NO: 488905 - RNA, 32 nt, Human
uagcaaaaagagacuugaauguuguggacaaa

SEQ ID NO: 488906 - RNA, 32 nt, Human
uagcaaaaaguuaaggaacuagggaaaagaga

SEQ ID NO: 488907 - RNA, 32 nt, Human
uagcaaaagcagacaccuuugccuuguuccug

SEQ ID NO: 488908 - RNA, 32 nt, Human
uagcaaaauacugauucaauguaaagcaaacu

SEQ ID NO: 488909 - RNA, 32 nt, Human
uagcaaacauuuaccaaguaucugccauguuc

SEQ ID NO: 488910 - RNA, 32 nt, Human
uagcaaaccaaccacacacuguucuguaucuu

SEQ ID NO: 488911 - RNA, 32 nt, Human
uagcaaaccccugauauuauucauggacuuga

SEQ ID NO: 488912 - RNA, 32 nt, Human
uagcaaaccucuuccuccucauugaagccaug

SEQ ID NO: 488913 - RNA, 23 nt, Human
uagcaaacuuggaauuuguaacc

SEQ ID NO: 488914 - RNA, 32 nt, Human
uagcaaaucugcaagagaaaacaggggauccu

SEQ ID NO: 488915 - RNA, 32 nt, Human
uagcaaaucugcuguggcaggcuguggauuuu

SEQ ID NO: 488916 - RNA, 32 nt, Human
uagcaaauggaucucagccacuguuggagugg

SEQ ID NO: 488917 - RNA, 32 nt, Human
uagcaaauggcagaaccaaagcucaaauaaaa

SEQ ID NO: 488918 - RNA, 32 nt, Human
uagcaaauguagaagcaguggcuguggcagua

SEQ ID NO: 488919 - RNA, 32 nt, Human
uagcaaauuguuuuugcuuugaaaaucuagcc

SEQ ID NO: 488920 - RNA, 31 nt, Human
uagcaacagagcuagaauggggcaaugcacu

SEQ ID NO: 488921 - RNA, 32 nt, Human
uagcaacagaugggaauuuggagucacucuga

SEQ ID NO: 488922 - RNA, 32 nt, Human
uagcaacagcagagcaggagcagcugguauuc

SEQ ID NO: 488923 - RNA, 32 nt, Human
uagcaacaucuucuccgaguccugcagccagc

SEQ ID NO: 488924 - RNA, 32 nt, Human
uagcaaccaggacgaaguugagaaggaaaacg

SEQ ID NO: 488925 - RNA, 32 nt, Human
uagcaaccaucuccuaucaaaggagcaauuuc

SEQ ID NO: 488926 - RNA, 32 nt, Human
uagcaacccugagaugauuuucuuccauuuac

SEQ ID NO: 488927 - RNA, 32 nt, Human
uagcaaccuucauuccaucugccuccuucauu

SEQ ID NO: 488928 - RNA, 32 nt, Human
uagcaacgaauagggcuccccuauguuccagc

SEQ ID NO: 488929 - RNA, 32 nt, Human
uagcaagaacuccaaaucauggaagugaaauu

SEQ ID NO: 488930 - RNA, 32 nt, Human
uagcaagaagcagaggaaagaaaccaauugcc

SEQ ID NO: 488931 - RNA, 23 nt, Human
uagcaagaccccaucacuacaaa

SEQ ID NO: 488932 - RNA, 24 nt, Human
uagcaagacccccaucucugcaaa

SEQ ID NO: 488933 - RNA, 22 nt, Human
uagcaagaccccucacuacaaa

SEQ ID NO: 488934 - RNA, 23 nt, Human
uagcaagacuccgaugcuacaaa

SEQ ID NO: 488935 - RNA, 32 nt, Human
uagcaagagaaacaggcagcagaggaacccaa

SEQ ID NO: 488936 - RNA, 32 nt, Human
uagcaagauauugaucaaauauagaaaguuga

SEQ ID NO: 488937 - RNA, 21 nt, Human
uagcaagaucuuuacauaauu

SEQ ID NO: 488938 - RNA, 32 nt, Human
uagcaagcaagaaaggcuccagugucaaggua

SEQ ID NO: 488939 - RNA, 32 nt, Human
uagcaaggacucgagcaggggugucuggagag

SEQ ID NO: 488940 - RNA, 32 nt, Human
uagcaaggagccaacauaacagaugggcugga

SEQ ID NO: 488941 - RNA, 32 nt, Human
uagcaaggagugacuuucuuucugcuacgugu

SEQ ID NO: 488942 - RNA, 24 nt, Human
uagcaaggccuggucugcaagauu

SEQ ID NO: 488943 - RNA, 32 nt, Human
uagcaaggcugcagagaggccagaacuaauca

SEQ ID NO: 488944 - RNA, 32 nt, Human
uagcaaggucugaaaguuucaaagggagaccu

SEQ ID NO: 488945 - RNA, 32 nt, Human
uagcaaggugagucggugcuugccaagaggca

SEQ ID NO: 488946 - RNA, 32 nt, Human
uagcaaguccaggaaaaacucuucucauucaa

SEQ ID NO: 488947 - RNA, 32 nt, Human
uagcaagucucagguguuugcaguaagaagcu

SEQ ID NO: 488948 - RNA, 32 nt, Human
uagcaagugaagaucuguugagaaacugagaa

SEQ ID NO: 488949 - RNA, 24 nt, Human
uagcaagugcuaggguuacaaagu

SEQ ID NO: 488950 - RNA, 32 nt, Human
uagcaaguggacuuguugaaacaggaagcaag

SEQ ID NO: 488951 - RNA, 32 nt, Human
uagcaaguggaucaaugcugaagauaaaucag

SEQ ID NO: 488952 - RNA, 32 nt, Human
uagcaagugugcacuccagcuucggaggcccu

SEQ ID NO: 488953 - RNA, 32 nt, Human
uagcaaucagucagggcugcagugagccauga

SEQ ID NO: 488954 - RNA, 32 nt, Human
uagcaauccauguuaguuuuuacuuucuguug

SEQ ID NO: 488955 - RNA, 32 nt, Human
uagcaaucugcccgccuccacccuuuaagcua

SEQ ID NO: 488956 - RNA, 32 nt, Human
uagcaaugaaacugaggcaggauagguacuua

SEQ ID NO: 488957 - RNA, 31 nt, Human
uagcaauggacaauuccaauaccuccacaca

SEQ ID NO: 488958 - RNA, 29 nt, Human
uagcaauggcugcuguuaucucgcagagc

SEQ ID NO: 488959 - RNA, 32 nt, Human
uagcaauguuagccucaagcaagaggaugaac

SEQ ID NO: 488960 - RNA, 32 nt, Human
uagcaauugcacuccggccugggcaacaagag

SEQ ID NO: 488961 - RNA, 32 nt, Human
uagcaauugggagcuugguggaccaucucuug

SEQ ID NO: 488962 - RNA, 32 nt, Human
uagcaauuuuaugcugggcaugguggcucacg

SEQ ID NO: 488963 - RNA, 32 nt, Human
uagcacaaaaguuaucaaagaggcucagccau

SEQ ID NO: 488964 - RNA, 32 nt, Human
uagcacaagcccgguugcuccuugucaggaga

SEQ ID NO: 488965 - RNA, 32 nt, Human
uagcacaaggagugcccgccuugagugacaug

SEQ ID NO: 488966 - RNA, 32 nt, Human
uagcacacaccuguagucccagauacuuggga

SEQ ID NO: 488967 - RNA, 32 nt, Human
uagcacacauuuucaaggcagcuuccugauaa

SEQ ID NO: 488968 - RNA, 32 nt, Human
uagcacaccuagacuugcuguaacuguacuca

SEQ ID NO: 488969 - RNA, 32 nt, Human
uagcacacgccuguaaucccagcuacuuggga

SEQ ID NO: 488970 - RNA, 32 nt, Human
uagcacacuugcccggccaccugcugccguga

SEQ ID NO: 488971 - RNA, 32 nt, Human
uagcacagagcagggacggcagcucugggaga

SEQ ID NO: 488972 - RNA, 32 nt, Human
uagcacagagguggggcuucgggcagggagcg

SEQ ID NO: 488973 - RNA, 32 nt, Human
uagcacagcagucugagaucaaacugcaaggc

SEQ ID NO: 488974 - RNA, 32 nt, Human
uagcacagccugugacagagccugggcagguc

SEQ ID NO: 488975 - RNA, 32 nt, Human
uagcacagcucccuucuguugaugcuguauuc

SEQ ID NO: 488976 - RNA, 32 nt, Human
uagcacagugauaucaccaugacuucacagac

SEQ ID NO: 488977 - RNA, 32 nt, Human
uagcacagugccuggcacacaguagaguaggu

SEQ ID NO: 488978 - RNA, 32 nt, Human
uagcacagugccuugcacuugauaggugcuua

SEQ ID NO: 488979 - RNA, 32 nt, Human
uagcacauaccuguaaucccagcuacucagga

SEQ ID NO: 488980 - RNA, 32 nt, Human
uagcacauauuucaggaggagaaugguauguu

SEQ ID NO: 488981 - RNA, 32 nt, Human
uagcacaucuuucucuauuauccuucuauugg

SEQ ID NO: 488982 - RNA, 32 nt, Human
uagcacaugccuguggucccagcuacucagag

SEQ ID NO: 488983 - RNA, 23 nt, Human
uagcaccaacuuauucaaugacu

SEQ ID NO: 488984 - RNA, 32 nt, Human
uagcaccacugcacuccagccugggagacaga

SEQ ID NO: 488985 - RNA, 32 nt, Human
uagcaccacugcacuccagccugggcaacaga

SEQ ID NO: 488986 - RNA, 32 nt, Human
uagcaccacugcacuccagccugggugacaga

SEQ ID NO: 488987 - RNA, 32 nt, Human
uagcaccacugcacuccaggcugggugacaga

SEQ ID NO: 488988 - RNA, 32 nt, Human
uagcaccacugcacuucagccuggacaacaga

SEQ ID NO: 488989 - RNA, 32 nt, Human
uagcaccacugcacuucuaguugacagaguga

SEQ ID NO: 488990 - RNA, 32 nt, Human
uagcaccacugcacuuuagccugggcgacaag

SEQ ID NO: 488991 - RNA, 32 nt, Human
uagcaccacugcaguccagccugggcgacaga

SEQ ID NO: 488992 - RNA, 32 nt, Human
uagcaccacugcaugcaagccugggcaauaga

SEQ ID NO: 488993 - RNA, 32 nt, Human
uagcaccacugcgcuccagccugggugaggag

SEQ ID NO: 488994 - RNA, 32 nt, Human
uagcaccagggcagacacucacccucaggaau

SEQ ID NO: 488995 - RNA, 32 nt, Human
uagcaccauucuugauguccagggaagaagcc

SEQ ID NO: 488996 - RNA, 32 nt, Human
uagcaccauugcacuccagccugggcgacucc

SEQ ID NO: 488997 - RNA, 32 nt, Human
uagcacccagccugcaucucccaggaggaagu

SEQ ID NO: 488998 - RNA, 32 nt, Human
uagcaccccuugcccugugucuguggaacaga

SEQ ID NO: 488999 - RNA, 32 nt, Human
uagcacccuauauuucugcuucccucuauuuu

SEQ ID NO: 489000 - RNA, 32 nt, Human
uagcacccuuaucaccccucacugccuugugg

SEQ ID NO: 489001 - RNA, 32 nt, Human
uagcaccucugccagugcacagauaggacugu

SEQ ID NO: 489002 - RNA, 32 nt, Human
uagcaccucuguguuuuaagggucuuucaaug

SEQ ID NO: 489003 - RNA, 32 nt, Human
uagcaccugcccgcccuccaccuucuccacca

SEQ ID NO: 489004 - RNA, 32 nt, Human
uagcaccuguaacccuguguacuaagugcuuu

SEQ ID NO: 489005 - RNA, 32 nt, Human
uagcaccuuccugauccccuuaucucuaaggc

SEQ ID NO: 489006 - RNA, 32 nt, Human
uagcaccuugggaggccgaggcgggcggauca

SEQ ID NO: 489007 - RNA, 32 nt, Human
uagcaccuugggaggcugaggcagguggauca

SEQ ID NO: 489008 - RNA, 32 nt, Human
uagcacgaaucacugcacccagccuauggaac

SEQ ID NO: 489009 - RNA, 32 nt, Human
uagcacgggagguaagggugguaugggauggg

SEQ ID NO: 489010 - RNA, 32 nt, Human
uagcacggggagcaaugauggagggagccccu

SEQ ID NO: 489011 - RNA, 32 nt, Human
uagcacgugccuguagucccagcuacucggga

SEQ ID NO: 489012 - RNA, 32 nt, Human
uagcacuaucacugcaaccuccgccuccuggg

SEQ ID NO: 489013 - RNA, 32 nt, Human
uagcacucaaagcuuaucagcgcagagcccau

SEQ ID NO: 489014 - RNA, 32 nt, Human
uagcacucagauuacccugccugcucugugcu

SEQ ID NO: 489015 - RNA, 32 nt, Human
uagcacuccagccuuagccugggcgacagagc

SEQ ID NO: 489016 - RNA, 31 nt, Human
uagcacuccggcucugggcuuucggccagaa

SEQ ID NO: 489017 - RNA, 32 nt, Human
uagcacugagcuuucaacauugaagugacuug

SEQ ID NO: 489018 - RNA, 32 nt, Human
uagcacugcacugucaccugaugauuggcccu

SEQ ID NO: 489019 - RNA, 32 nt, Human
uagcacugcaguccagccugggcgacagagug

SEQ ID NO: 489020 - RNA, 32 nt, Human
uagcacugccgagacugugcucuggccucccu

SEQ ID NO: 489021 - RNA, 32 nt, Human
uagcacuggccucugugccacagcuacuguuu

SEQ ID NO: 489022 - RNA, 32 nt, Human
uagcacugggcguggugcaugccuguaauccc

SEQ ID NO: 489023 - RNA, 32 nt, Human
uagcacuguggacaauaaaguccauaggcuga

SEQ ID NO: 489024 - RNA, 20 nt, Human
uagcacuuccauuuuccaua

SEQ ID NO: 489025 - RNA, 32 nt, Human
uagcacuugcaucguuauuaagcccuuauuug

SEQ ID NO: 489026 - RNA, 32 nt, Human
uagcacuuggaaaggcugagacaggaggauca

SEQ ID NO: 489027 - RNA, 22 nt, Human
uagcacuuuaucauucuccaca

SEQ ID NO: 489028 - RNA, 32 nt, Human
uagcacuuugggaggcagaggcgggcagauca

SEQ ID NO: 489029 - RNA, 32 nt, Human
uagcacuuugggaggccaaggcaggcagauca

SEQ ID NO: 489030 - RNA, 32 nt, Human
uagcacuuugggaggccaaggugggaggauug

SEQ ID NO: 489031 - RNA, 32 nt, Human
uagcacuuugggaggccgaggcaggcagauca

SEQ ID NO: 489032 - RNA, 32 nt, Human
uagcacuuugggaggccgaggcaggcggauca

SEQ ID NO: 489033 - RNA, 32 nt, Human
uagcacuuugggaggccgaggcaggcggaucc

SEQ ID NO: 489034 - RNA, 32 nt, Human
uagcacuuugggaggccgaggcgggcagauca

SEQ ID NO: 489035 - RNA, 32 nt, Human
uagcacuuugggaggccgaggcgggcggauca

SEQ ID NO: 489036 - RNA, 32 nt, Human
uagcacuuugggaggccgaggugggcagauca

SEQ ID NO: 489037 - RNA, 32 nt, Human
uagcacuuugggaggccgaggugggcggauca

SEQ ID NO: 489038 - RNA, 32 nt, Human
uagcacuuugggaggccgagguggguagaucg

SEQ ID NO: 489039 - RNA, 32 nt, Human
uagcacuuugggaggcugaggauggaaaauca

SEQ ID NO: 489040 - RNA, 32 nt, Human
uagcacuuugggaggcugaggcgggcggauag

SEQ ID NO: 489041 - RNA, 32 nt, Human
uagcacuuugggaggcugaggcggguagauca

SEQ ID NO: 489042 - RNA, 32 nt, Human
uagcacuuugggaggcugaggcgggugaauca

SEQ ID NO: 489043 - RNA, 32 nt, Human
uagcacuuugggaggcugagguaggcagauca

SEQ ID NO: 489044 - RNA, 32 nt, Human
uagcacuuugggaggcugaggugagcagguug

SEQ ID NO: 489045 - RNA, 32 nt, Human
uagcacuuugggaggcugaggugggcagauca

SEQ ID NO: 489046 - RNA, 30 nt, Human
uagcagaaaaggggagugcuaacuggggga

SEQ ID NO: 489047 - RNA, 32 nt, Human
uagcagaaauuuugaagccagaaggacaacau

SEQ ID NO: 489048 - RNA, 32 nt, Human
uagcagaacccagcucagaagauggggcuuau

SEQ ID NO: 489049 - RNA, 21 nt, Human
uagcagaacuuaucucaggaa

SEQ ID NO: 489050 - RNA, 23 nt, Human
uagcagaacuuguccccauggaa

SEQ ID NO: 489051 - RNA, 32 nt, Human
uagcagaagaauuggaguuggaagguugcaua

SEQ ID NO: 489052 - RNA, 32 nt, Human
uagcagaagcagcuugguaggauggaaggcac

SEQ ID NO: 489053 - RNA, 32 nt, Human
uagcagacacugcaacagaugccuccuagaaa

SEQ ID NO: 489054 - RNA, 32 nt, Human
uagcagacuuguauggcccacauguauuaguc

SEQ ID NO: 489055 - RNA, 32 nt, Human
uagcagagacaggguuucaccauguuggccag

SEQ ID NO: 489056 - RNA, 32 nt, Human
uagcagagacaggguuucaccguguuggccag

SEQ ID NO: 489057 - RNA, 32 nt, Human
uagcagagacgggguuucaccauguuggccag

SEQ ID NO: 489058 - RNA, 32 nt, Human
uagcagagacgggguuucaccguguuagccag

SEQ ID NO: 489059 - RNA, 32 nt, Human
uagcagagauggggguuucaccauguuggcca

SEQ ID NO: 489060 - RNA, 32 nt, Human
uagcagagaugggguuucaccacauuggccag

SEQ ID NO: 489061 - RNA, 32 nt, Human
uagcagagaugggguuucaccauauuggccag

SEQ ID NO: 489062 - RNA, 32 nt, Human
uagcagagaugggguuucaccguguuggccag

SEQ ID NO: 489063 - RNA, 32 nt, Human
uagcagagaugggguuucacuguguuggccag

SEQ ID NO: 489064 - RNA, 32 nt, Human
uagcagagaugggguuuuaccauguuggccag

SEQ ID NO: 489065 - RNA, 32 nt, Human
uagcagagaugggguuuuaccauguuggucag

SEQ ID NO: 489066 - RNA, 32 nt, Human
uagcagagccuuucuugcacuuuaaagugaga

SEQ ID NO: 489067 - RNA, 32 nt, Human
uagcagagcuccaggccucccuuccagucaga

SEQ ID NO: 489068 - RNA, 32 nt, Human
uagcagaggagaaaucggagauccccagacag

SEQ ID NO: 489069 - RNA, 32 nt, Human
uagcagaggugaguagaggggccugggggcuu

SEQ ID NO: 489070 - RNA, 32 nt, Human
uagcagagguuucacccggcaggaugacacag

SEQ ID NO: 489071 - RNA, 32 nt, Human
uagcagaugccauugaagauaaagcuacugua

SEQ ID NO: 489072 - RNA, 32 nt, Human
uagcagauuuggcagagguacagugagaaucu

SEQ ID NO: 489073 - RNA, 32 nt, Human
uagcagcaaaaauauaaaauaguuguccauau

SEQ ID NO: 489074 - RNA, 32 nt, Human
uagcagcaagggugggguggccagcagaugga

SEQ ID NO: 489075 - RNA, 31 nt, Human
uagcagcacauccucuuuccugugucaagaa

SEQ ID NO: 489076 - RNA, 32 nt, Human
uagcagcacugugcccagcacagguaagcacu

SEQ ID NO: 489077 - RNA, 32 nt, Human
uagcagcagcgugcagcucaguacguuguaac

SEQ ID NO: 489078 - RNA, 32 nt, Human
uagcagcagcguucccugccuccugcaggaug

SEQ ID NO: 489079 - RNA, 32 nt, Human
uagcagcaguacgagggcuacacuccucugcu

SEQ ID NO: 489080 - RNA, 32 nt, Human
uagcagcauguccuacggaaacccagcacgug

SEQ ID NO: 489081 - RNA, 32 nt, Human
uagcagcauucagaaaguuaaugagugguuuu

SEQ ID NO: 489082 - RNA, 32 nt, Human
uagcagcauuuugccccugggcauuuugcccc

SEQ ID NO: 489083 - RNA, 32 nt, Human
uagcagccaaaacuucagcccauagguuaguc

SEQ ID NO: 489084 - RNA, 32 nt, Human
uagcagccacugccaccugggcccggagccuc

SEQ ID NO: 489085 - RNA, 32 nt, Human
uagcagccauguggugggcaugugugacuacu

SEQ ID NO: 489086 - RNA, 32 nt, Human
uagcagcccccagcaucucccacccacccagc

SEQ ID NO: 489087 - RNA, 32 nt, Human
uagcagccuaguuuucuacauccuucaugcca

SEQ ID NO: 489088 - RNA, 32 nt, Human
uagcagccuccaagccacaaacacauccaagg

SEQ ID NO: 489089 - RNA, 32 nt, Human
uagcagccuuugacaaugacuuccucaaacug

SEQ ID NO: 489090 - RNA, 32 nt, Human
uagcagcgcacugcaaccuggaccuccugggc

SEQ ID NO: 489091 - RNA, 32 nt, Human
uagcagcgcauacaggagcuggggaagggggc

SEQ ID NO: 489092 - RNA, 32 nt, Human
uagcagcgccuucggguagcaggaugauuccu

SEQ ID NO: 489093 - RNA, 32 nt, Human
uagcagcuaucucucagugaacugugagggua

SEQ ID NO: 489094 - RNA, 32 nt, Human
uagcagcucugacuaacaggcugcaaagugca

SEQ ID NO: 489095 - RNA, 32 nt, Human
uagcagcuggauguuccugaaaccucugcagg

SEQ ID NO: 489096 - RNA, 32 nt, Human
uagcagcuuagaaucccagcugcuggcucggg

SEQ ID NO: 489097 - RNA, 32 nt, Human
uagcagcuuauucacaagacccaaaaggcaga

SEQ ID NO: 489098 - RNA, 32 nt, Human
uagcagcuuccucccuucauggcagccaaaag

SEQ ID NO: 489099 - RNA, 32 nt, Human
uagcagcuuguauaccucaggccaggugagcu

SEQ ID NO: 489100 - RNA, 32 nt, Human
uagcaggacagaugcauugaagccacaugguu

SEQ ID NO: 489101 - RNA, 32 nt, Human
uagcaggagcacaggcguggcagugagaaagc

SEQ ID NO: 489102 - RNA, 32 nt, Human
uagcaggagcaguuucuggccagaagcaccag

SEQ ID NO: 489103 - RNA, 32 nt, Human
uagcaggagcccuuugcugugugcucugucca

SEQ ID NO: 489104 - RNA, 32 nt, Human
uagcaggauagaagcaaaugaaacugaaagcu

SEQ ID NO: 489105 - RNA, 22 nt, Human
uagcaggaucuccuucagaauu

SEQ ID NO: 489106 - RNA, 32 nt, Human
uagcaggcaaaacuaugaugguuugugauauc

SEQ ID NO: 489107 - RNA, 32 nt, Human
uagcaggccuccaggugggguuagaauuguca

SEQ ID NO: 489108 - RNA, 32 nt, Human
uagcagggacggccuuucucuuagagcagcug

SEQ ID NO: 489109 - RNA, 32 nt, Human
uagcagggagcaugcccguaaucccagcuacu

SEQ ID NO: 489110 - RNA, 32 nt, Human
uagcagggaugcuguguucacccuucuuggua

SEQ ID NO: 489111 - RNA, 32 nt, Human
uagcagggggcacagagagagcagggucagcu

SEQ ID NO: 489112 - RNA, 26 nt, Human
uagcaggguagcugguugcuagaguu

SEQ ID NO: 489113 - RNA, 26 nt, Human
uagcagggucagguguuagcaggguu

SEQ ID NO: 489114 - RNA, 32 nt, Human
uagcaggguccuuccuugcaaaguacuauaca

SEQ ID NO: 489115 - RNA, 32 nt, Human
uagcagggucugcagugugaguaccagguuuc

SEQ ID NO: 489116 - RNA, 32 nt, Human
uagcaggguggaggaggccuggugugggcccu

SEQ ID NO: 489117 - RNA, 32 nt, Human
uagcagguccuuuuuccuccugcugagcugag

SEQ ID NO: 489118 - RNA, 32 nt, Human
uagcaggugccuguaaucacagcuacucggga

SEQ ID NO: 489119 - RNA, 32 nt, Human
uagcaggugccuguaaucccagcuacugggga

SEQ ID NO: 489120 - RNA, 32 nt, Human
uagcaggugugggcuuacagacacauggacug

SEQ ID NO: 489121 - RNA, 32 nt, Human
uagcagguuggugagagaagcuccccugagcu

SEQ ID NO: 489122 - RNA, 32 nt, Human
uagcaguacacccuuuuaucuccauugcuacu

SEQ ID NO: 489123 - RNA, 32 nt, Human
uagcagucaacuccugauucagacaugaucca

SEQ ID NO: 489124 - RNA, 32 nt, Human
uagcagucacacccuagccacugcugggaccu

SEQ ID NO: 489125 - RNA, 32 nt, Human
uagcagucauucuccuaaucugaccacuuuca

SEQ ID NO: 489126 - RNA, 28 nt, Human
uagcagucccagcugcuggcuuugaaga

SEQ ID NO: 489127 - RNA, 32 nt, Human
uagcaguccgugcgcagaggggccaguucuga

SEQ ID NO: 489128 - RNA, 32 nt, Human
uagcaguccuggaaguugaagguggagauggc

SEQ ID NO: 489129 - RNA, 32 nt, Human
uagcagucugggacucaagggugggucuuugg

SEQ ID NO: 489130 - RNA, 32 nt, Human
uagcagugagaaugccgccucugugaucagcu

SEQ ID NO: 489131 - RNA, 32 nt, Human
uagcagugagccaagaccgugccacuguacuc

SEQ ID NO: 489132 - RNA, 32 nt, Human
uagcagugaugauaugcauaagugcuguaagg

SEQ ID NO: 489133 - RNA, 32 nt, Human
uagcagugccuguguguuggagcucaguuagg

SEQ ID NO: 489134 - RNA, 32 nt, Human
uagcaguggccuggcacaaaacaaaugcucag

SEQ ID NO: 489135 - RNA, 32 nt, Human
uagcaguugcucccgcacuccaggccugugcu

SEQ ID NO: 489136 - RNA, 32 nt, Human
uagcaguugucauucaguaauuuccuacaagc

SEQ ID NO: 489137 - RNA, 32 nt, Human
uagcaguuugagcccagccuaggcaacauagc

SEQ ID NO: 489138 - RNA, 32 nt, Human
uagcauaacauacagacuuuugcacauucagc

SEQ ID NO: 489139 - RNA, 32 nt, Human
uagcauaauaccaaauuccucuauucacuaaa

SEQ ID NO: 489140 - RNA, 32 nt, Human
uagcauagccugggccaagcaggguggggaau

SEQ ID NO: 489141 - RNA, 32 nt, Human
uagcauaggaaaaaguuguuuaaugcucaggg

SEQ ID NO: 489142 - RNA, 32 nt, Human
uagcauauccuaaauaccaggcaaugugcugu

SEQ ID NO: 489143 - RNA, 32 nt, Human
uagcauaugccuguggucccagcuacugagga

SEQ ID NO: 489144 - RNA, 32 nt, Human
uagcaucacagcuucaggaagccuucucaagu

SEQ ID NO: 489145 - RNA, 32 nt, Human
uagcaucagcacuuaaucuuuaucugcugaau

SEQ ID NO: 489146 - RNA, 32 nt, Human
uagcaucaugugugaucucgucuuccagcgug

SEQ ID NO: 489147 - RNA, 32 nt, Human
uagcauccuuuuggcucccugguugguuguga

SEQ ID NO: 489148 - RNA, 32 nt, Human
uagcaucguggcaccguaagguggugaaguac

SEQ ID NO: 489149 - RNA, 32 nt, Human
uagcaucuacagccacaacucugcccaccacc

SEQ ID NO: 489150 - RNA, 32 nt, Human
uagcaucucaaggaaaagagcaugggaaagcc

SEQ ID NO: 489151 - RNA, 32 nt, Human
uagcaucucaggacaguuacucucaucauaua

SEQ ID NO: 489152 - RNA, 32 nt, Human
uagcaucucccaggaacaacgacuuuuugccu

SEQ ID NO: 489153 - RNA, 32 nt, Human
uagcaucugcuaucaaacugugccuuauuaaa

SEQ ID NO: 489154 - RNA, 32 nt, Human
uagcaucuucuuuggaauuacucaggaaccag

SEQ ID NO: 489155 - RNA, 32 nt, Human
uagcaucuuguucaaagauaagaaaguuacag

SEQ ID NO: 489156 - RNA, 32 nt, Human
uagcaucuuuacagauggagaggacagaguca

SEQ ID NO: 489157 - RNA, 32 nt, Human
uagcaugaaaccagagguucucagaaugaccg

SEQ ID NO: 489158 - RNA, 32 nt, Human
uagcaugaagacagagccccacccucagaugc

SEQ ID NO: 489159 - RNA, 29 nt, Human
uagcaugaccucacaucacugcguaggac

SEQ ID NO: 489160 - RNA, 32 nt, Human
uagcaugaucacgacuuacugcagccuugauc

SEQ ID NO: 489161 - RNA, 32 nt, Human
uagcaugccugccccaucuugccuguagcauu

SEQ ID NO: 489162 - RNA, 32 nt, Human
uagcaugcgcccgggguugacaacagcuggac

SEQ ID NO: 489163 - RNA, 32 nt, Human
uagcaugcuguaaacaauugucaaaguuguuu

SEQ ID NO: 489164 - RNA, 32 nt, Human
uagcauggccuucuugagcuaggguggaaugg

SEQ ID NO: 489165 - RNA, 32 nt, Human
uagcaugggaggcucuggaagcuguggcauug

SEQ ID NO: 489166 - RNA, 32 nt, Human
uagcauggucccucugucucaggcucuacacu

SEQ ID NO: 489167 - RNA, 32 nt, Human
uagcaugguggcccccacacacccagccugug

SEQ ID NO: 489168 - RNA, 32 nt, Human
uagcaugugcccgguccagucagugcagucau

SEQ ID NO: 489169 - RNA, 32 nt, Human
uagcaugugccuguaaucccagcuucuuggga

SEQ ID NO: 489170 - RNA, 32 nt, Human
uagcauguuccucauuccccaaugacaccuca

SEQ ID NO: 489171 - RNA, 32 nt, Human
uagcauguucuuucuuucuccauccacuggcu

SEQ ID NO: 489172 - RNA, 32 nt, Human
uagcauguugacuauguuguguaaaaccaagc

SEQ ID NO: 489173 - RNA, 32 nt, Human
uagcauguuuacugcucuaugccuccugaucc

SEQ ID NO: 489174 - RNA, 32 nt, Human
uagcauuagaauuauuuguuuguuaaaaguua

SEQ ID NO: 489175 - RNA, 32 nt, Human
uagcauuaggguucuuugcaaugugguaucua

SEQ ID NO: 489176 - RNA, 32 nt, Human
uagcauuaguuucagauucuuuugccauugca

SEQ ID NO: 489177 - RNA, 32 nt, Human
uagcauuaugggaggcugaggcgggcagauca

SEQ ID NO: 489178 - RNA, 32 nt, Human
uagcauucauuucccuuuauauuucccugaaa

SEQ ID NO: 489179 - RNA, 32 nt, Human
uagcauucccuggugaaguguugcagguugug

SEQ ID NO: 489180 - RNA, 32 nt, Human
uagcauuccugacucuaggaagaaggagcagu

SEQ ID NO: 489181 - RNA, 32 nt, Human
uagcauucuuguucaagaagcugcugguucac

SEQ ID NO: 489182 - RNA, 32 nt, Human
uagcauugacacauuuaaagcuuuucauuuaa

SEQ ID NO: 489183 - RNA, 31 nt, Human
uagcauugggccaggccuggcauucaaggga

SEQ ID NO: 489184 - RNA, 32 nt, Human
uagcauugucugucuguccggucuuguuugua

SEQ ID NO: 489185 - RNA, 32 nt, Human
uagcauugugugugaguggccccacagguaga

SEQ ID NO: 489186 - RNA, 32 nt, Human
uagcauuuaguauuuugcacaaagucuaaggg

SEQ ID NO: 489187 - RNA, 32 nt, Human
uagcauuuccuuguccccucuuccccaaaacc

SEQ ID NO: 489188 - RNA, 32 nt, Human
uagcauuucucuagccuuccuuuucugcugcu

SEQ ID NO: 489189 - RNA, 32 nt, Human
uagcauuucuguaguuuagaacagauguuaca

SEQ ID NO: 489190 - RNA, 32 nt, Human
uagcauuuuaauccauucuugacauucaguua

SEQ ID NO: 489191 - RNA, 32 nt, Human
uagcauuuuauauuugaacaugggcuuguuau

SEQ ID NO: 489192 - RNA, 32 nt, Human
uagccaaagcaaauucuccuauuaacacuuag

SEQ ID NO: 489193 - RNA, 32 nt, Human
uagccaaagcuagcuugagcaaaaagaacaaa

SEQ ID NO: 489194 - RNA, 32 nt, Human
uagccaaagggcccugcccagaugccuuccuu

SEQ ID NO: 489195 - RNA, 32 nt, Human
uagccaaagguuuuguucuggccuucuguacu

SEQ ID NO: 489196 - RNA, 32 nt, Human
uagccaaauacaguaacugugacuggcccagg

SEQ ID NO: 489197 - RNA, 32 nt, Human
uagccaacaucgugaaaccccaucucuacuaa

SEQ ID NO: 489198 - RNA, 32 nt, Human
uagccaacaugcugaaacuccaucucuacuaa

SEQ ID NO: 489199 - RNA, 32 nt, Human
uagccaacauggugaaaacccaucuguacuaa

SEQ ID NO: 489200 - RNA, 32 nt, Human
uagccaacauggugaaaccccgucucuauuaa

SEQ ID NO: 489201 - RNA, 32 nt, Human
uagccaacauggugaaaccccgucucuucuaa

SEQ ID NO: 489202 - RNA, 29 nt, Human
uagccaacauggugaaaucccaucucuac

SEQ ID NO: 489203 - RNA, 32 nt, Human
uagccaacauggugaacuaccaucucuacuaa

SEQ ID NO: 489204 - RNA, 32 nt, Human
uagccaagaggcccagaaaucuaaagaucuuu

SEQ ID NO: 489205 - RNA, 32 nt, Human
uagccaagaugccugaggaaacccagacccaa

SEQ ID NO: 489206 - RNA, 32 nt, Human
uagccaagauggugaaaccccaucucuacuaa

SEQ ID NO: 489207 - RNA, 32 nt, Human
uagccaaggaguucuagccugcagugaacuau

SEQ ID NO: 489208 - RNA, 19 nt, Human
uagccaaggugccucuaua

SEQ ID NO: 489209 - RNA, 32 nt, Human
uagccaagguggccgcagucugccuuugcauc

SEQ ID NO: 489210 - RNA, 32 nt, Human
uagccaauauggugaaaccccgucucuacuaa

SEQ ID NO: 489211 - RNA, 32 nt, Human
uagccaaugagcugugaguacacgugacacag

SEQ ID NO: 489212 - RNA, 32 nt, Human
uagccaauggcagaggggguuggggcugggac

SEQ ID NO: 489213 - RNA, 32 nt, Human
uagccacaauaagauuuucauuuuucagugcu

SEQ ID NO: 489214 - RNA, 32 nt, Human
uagccacacaugcgccaugaaguacccuuuga

SEQ ID NO: 489215 - RNA, 32 nt, Human
uagccacacguggcaugucauaccuaccaggu

SEQ ID NO: 489216 - RNA, 32 nt, Human
uagccacacugcacuguggccccuugggaaga

SEQ ID NO: 489217 - RNA, 32 nt, Human
uagccacacuucucccuucaggggcuucggag

SEQ ID NO: 489218 - RNA, 32 nt, Human
uagccacagcccaaaucuuccaggcaaaugua

SEQ ID NO: 489219 - RNA, 32 nt, Human
uagccacagcuguuuuaagacuucugaucucc

SEQ ID NO: 489220 - RNA, 32 nt, Human
uagccacaggcagggcugucaauaacccccuu

SEQ ID NO: 489221 - RNA, 32 nt, Human
uagccacaguccuuaagccacacacauuguug

SEQ ID NO: 489222 - RNA, 32 nt, Human
uagccacauuuaacuccagccuuggguuugac

SEQ ID NO: 489223 - RNA, 32 nt, Human
uagccaccaugcaguucugccuggguuggagu

SEQ ID NO: 489224 - RNA, 32 nt, Human
uagccacccagccugugggaccucaggagggu

SEQ ID NO: 489225 - RNA, 32 nt, Human
uagccaccccuccaccagaggggauggaggaa

SEQ ID NO: 489226 - RNA, 32 nt, Human
uagccaccuuagcaugaacauaggguuaaccc

SEQ ID NO: 489227 - RNA, 32 nt, Human
uagccaccuugauuuucuucuuuguggucuuu

SEQ ID NO: 489228 - RNA, 32 nt, Human
uagccacgagcugccuuccucccaggcuagug

SEQ ID NO: 489229 - RNA, 32 nt, Human
uagccacuaaccuuugccugguacaguauggg

SEQ ID NO: 489230 - RNA, 32 nt, Human
uagccacuccuguugacagugcaccugaaggg

SEQ ID NO: 489231 - RNA, 32 nt, Human
uagccacugcacuccagccugggcaacauagc

SEQ ID NO: 489232 - RNA, 32 nt, Human
uagccacugcacuccagccugggcaacguggu

SEQ ID NO: 489233 - RNA, 32 nt, Human
uagccacugcacuccagccugggcaauauagc

SEQ ID NO: 489234 - RNA, 32 nt, Human
uagccacugcacuccaucuugggcaacacagu

SEQ ID NO: 489235 - RNA, 32 nt, Human
uagccacugcacucuagucuggggaacauaug

SEQ ID NO: 489236 - RNA, 32 nt, Human
uagccacugcacuucagccugggcaacauagc

SEQ ID NO: 489237 - RNA, 32 nt, Human
uagccacugcacuugagccucuugggaaacau

SEQ ID NO: 489238 - RNA, 32 nt, Human
uagccacuggccccucccuguuucauguauuu

SEQ ID NO: 489239 - RNA, 32 nt, Human
uagccacugugcuccagccugggcaacaccau

SEQ ID NO: 489240 - RNA, 32 nt, Human
uagccacuuagcaaucucuauauucuuucaag

SEQ ID NO: 489241 - RNA, 32 nt, Human
uagccacuugcagcacauuaucagcagugacc

SEQ ID NO: 489242 - RNA, 32 nt, Human
uagccagaaacagguguucuggcuuuaggucc

SEQ ID NO: 489243 - RNA, 32 nt, Human
uagccagaagagaagcacuggauuccucaguc

SEQ ID NO: 489244 - RNA, 32 nt, Human
uagccagacuuguuuugcuaucuuauaagcag

SEQ ID NO: 489245 - RNA, 32 nt, Human
uagccagagaaacacugucuuccuucagaaau

SEQ ID NO: 489246 - RNA, 32 nt, Human
uagccagagccacugggagacuggggagacug

SEQ ID NO: 489247 - RNA, 32 nt, Human
uagccagaucuacgaguggauguaauaacugc

SEQ ID NO: 489248 - RNA, 32 nt, Human
uagccagcacacagggcagugagggagggcug

SEQ ID NO: 489249 - RNA, 32 nt, Human
uagccagcaguuucaguuauacucaaccaugc

SEQ ID NO: 489250 - RNA, 32 nt, Human
uagccagcccuccgccgccucuccuuagucgc

SEQ ID NO: 489251 - RNA, 32 nt, Human
uagccagcucagaauacccauguagcagcaac

SEQ ID NO: 489252 - RNA, 22 nt, Human
uagccaggacucuaaucugccu

SEQ ID NO: 489253 - RNA, 32 nt, Human
uagccaggcagaaagagugcucagggaaaauu

SEQ ID NO: 489254 - RNA, 32 nt, Human
uagccaggcuuaguggcgggcaucuguagucc

SEQ ID NO: 489255 - RNA, 32 nt, Human
uagccagggaugguccuggcugugcugcugca

SEQ ID NO: 489256 - RNA, 18 nt, Human
uagccagggcuggugcuu

SEQ ID NO: 489257 - RNA, 32 nt, Human
uagccagggucuguaggcaucacauugugagg

SEQ ID NO: 489258 - RNA, 32 nt, Human
uagccaggguucccucgaacuugggggaucuu

SEQ ID NO: 489259 - RNA, 32 nt, Human
uagccagguacugcauucucucccauccuggg

SEQ ID NO: 489260 - RNA, 32 nt, Human
uagccagguagccaccacugugcccaggcgcc

SEQ ID NO: 489261 - RNA, 32 nt, Human
uagccaggugcugaagaggauccucggagccg

SEQ ID NO: 489262 - RNA, 32 nt, Human
uagccagguguggcacacgccuguaaucccag

SEQ ID NO: 489263 - RNA, 25 nt, Human
uagccaggugugguggcacgugccu

SEQ ID NO: 489264 - RNA, 32 nt, Human
uagccagucagacuugaucacugacaccccgu

SEQ ID NO: 489265 - RNA, 32 nt, Human
uagccagucagaggaggaggagaaggagcccc

SEQ ID NO: 489266 - RNA, 32 nt, Human
uagccagucaguuuuagucacugugaaauauu

SEQ ID NO: 489267 - RNA, 32 nt, Human
uagccagugccgcauuuauccaucuguaagaa

SEQ ID NO: 489268 - RNA, 32 nt, Human
uagccagugggucccuuccuuucuccuuuccu

SEQ ID NO: 489269 - RNA, 32 nt, Human
uagccaguguccacagcaccuucucaaacuac

SEQ ID NO: 489270 - RNA, 32 nt, Human
uagccaguuacuggucaugccugcugugggca

SEQ ID NO: 489271 - RNA, 32 nt, Human
uagccaguucugacaguguuuuaggugccugg

SEQ ID NO: 489272 - RNA, 32 nt, Human
uagccauagagcuuccuuuccagaacccuucc

SEQ ID NO: 489273 - RNA, 22 nt, Human
uagccauaggcccucccagagu

SEQ ID NO: 489274 - RNA, 32 nt, Human
uagccaucacuucugggaaguaaagaacuuga

SEQ ID NO: 489275 - RNA, 32 nt, Human
uagccaucccccaggagaaugacagaagcaaa

SEQ ID NO: 489276 - RNA, 32 nt, Human
uagccaucccgucguuaaauguuuucauggau

SEQ ID NO: 489277 - RNA, 32 nt, Human
uagccaucccuuggggaaggguggggagaaau

SEQ ID NO: 489278 - RNA, 32 nt, Human
uagccaucuagccuucuucccaaacaagcagc

SEQ ID NO: 489279 - RNA, 32 nt, Human
uagccaucuccugucagguaggaaugaacuug

SEQ ID NO: 489280 - RNA, 32 nt, Human
uagccaucucuccagcucugcaguuuucacug

SEQ ID NO: 489281 - RNA, 32 nt, Human
uagccaucuucccuccacaccugauugcucaa

SEQ ID NO: 489282 - RNA, 32 nt, Human
uagccaugaaaugguuauuuugccaguuacau

SEQ ID NO: 489283 - RNA, 32 nt, Human
uagccaugaaggagucggagcccuggguccga

SEQ ID NO: 489284 - RNA, 32 nt, Human
uagccaugacuaggguccucaggcaguggccc

SEQ ID NO: 489285 - RNA, 32 nt, Human
uagccaugaucuuccacacuauguggcauugu

SEQ ID NO: 489286 - RNA, 30 nt, Human
uagccauggaagagaauauggaagagggac

SEQ ID NO: 489287 - RNA, 32 nt, Human
uagccauggcuggcagagguuucuaggguggg

SEQ ID NO: 489288 - RNA, 32 nt, Human
uagccaugguggacccagcgggcagguucugc

SEQ ID NO: 489289 - RNA, 32 nt, Human
uagcccaaaggacaagaaaacacuucucacua

SEQ ID NO: 489290 - RNA, 32 nt, Human
uagcccaaaggagaggccaaaagggaaaccaa

SEQ ID NO: 489291 - RNA, 32 nt, Human
uagcccaacagcuguucuguucuaucuacccc

SEQ ID NO: 489292 - RNA, 32 nt, Human
uagcccacauucccaugaccucccucugcuug

SEQ ID NO: 489293 - RNA, 32 nt, Human
uagcccacccgacuaacaucucagucucugaa

SEQ ID NO: 489294 - RNA, 32 nt, Human
uagcccacgccucuaaucccagcacuuuggga

SEQ ID NO: 489295 - RNA, 32 nt, Human
uagcccacugcagccuccaccucccaggcuca

SEQ ID NO: 489296 - RNA, 32 nt, Human
uagcccacuuaaguaaauacuaugaugauaag

SEQ ID NO: 489297 - RNA, 32 nt, Human
uagcccagagacauggagaguugcuacaaccc

SEQ ID NO: 489298 - RNA, 32 nt, Human
uagcccagcaaauagugauaacaaauaaaacc

SEQ ID NO: 489299 - RNA, 32 nt, Human
uagcccagccuauccuaaugaacuaccugauu

SEQ ID NO: 489300 - RNA, 32 nt, Human
uagcccaggaaugcagcugggggccaggccgu

SEQ ID NO: 489301 - RNA, 32 nt, Human
uagcccaggaauucgagaccagccugggcaag

SEQ ID NO: 489302 - RNA, 30 nt, Human
uagcccaggaggucaggucaaggcugcagu

SEQ ID NO: 489303 - RNA, 32 nt, Human
uagcccaggaguuaaagaccagccugggcaac

SEQ ID NO: 489304 - RNA, 32 nt, Human
uagcccaggaguuugagaacagccugggcaac

SEQ ID NO: 489305 - RNA, 32 nt, Human
uagcccaggccagagugcaguggcgcgaucuc

SEQ ID NO: 489306 - RNA, 32 nt, Human
uagcccaggcuggagugcaguggcacagucac

SEQ ID NO: 489307 - RNA, 32 nt, Human
uagcccaggcuggagugcaguguggcacaauc

SEQ ID NO: 489308 - RNA, 32 nt, Human
uagcccagggcucccccaaaagaauugguuca

SEQ ID NO: 489309 - RNA, 32 nt, Human
uagcccagucuggagugcagugguacaauaau

SEQ ID NO: 489310 - RNA, 32 nt, Human
uagcccagucuggagugcaguggugugaucau

SEQ ID NO: 489311 - RNA, 32 nt, Human
uagcccagugaaacugaucguugacuucugga

SEQ ID NO: 489312 - RNA, 32 nt, Human
uagcccagugccuggugcaaagcaggcuuuca

SEQ ID NO: 489313 - RNA, 32 nt, Human
uagcccaguuaauccucacaccuacuguagga

SEQ ID NO: 489314 - RNA, 32 nt, Human
uagcccaucaugacuaucaaaauucaccugua

SEQ ID NO: 489315 - RNA, 32 nt, Human
uagcccaugaacacgugugggccucggucacg

SEQ ID NO: 489316 - RNA, 32 nt, Human
uagcccaugaggaggaugugaccgggacugag

SEQ ID NO: 489317 - RNA, 32 nt, Human
uagcccaugccuuuugagggcugaacaaauaa

SEQ ID NO: 489318 - RNA, 32 nt, Human
uagcccaugcuguuuucccuuugccacacugu

SEQ ID NO: 489319 - RNA, 32 nt, Human
uagcccauguuuagauccaggucuccaauuca

SEQ ID NO: 489320 - RNA, 32 nt, Human
uagccccacugcacuccagccugggugacaga

SEQ ID NO: 489321 - RNA, 32 nt, Human
uagccccagagccuggcaacagccuggccugc

SEQ ID NO: 489322 - RNA, 32 nt, Human
uagccccagcuacuagggaggcugaggaggga

SEQ ID NO: 489323 - RNA, 32 nt, Human
uagccccagcuacucaagaggcugaggcagga

SEQ ID NO: 489324 - RNA, 32 nt, Human
uagccccagcuacucgggaggcugaggcagga

SEQ ID NO: 489325 - RNA, 32 nt, Human
uagccccagcuacucgggaggcugagguggaa

SEQ ID NO: 489326 - RNA, 32 nt, Human
uagccccagcuacuugggaggcugaggcggga

SEQ ID NO: 489327 - RNA, 32 nt, Human
uagccccagcuacuugggaggcugagguggga

SEQ ID NO: 489328 - RNA, 32 nt, Human
uagccccagcuauucaggagacugaggcagga

SEQ ID NO: 489329 - RNA, 32 nt, Human
uagccccaggcccgcccugcccgcgcccgccg

SEQ ID NO: 489330 - RNA, 32 nt, Human
uagcccccaacacacagaaaccacaccagaua

SEQ ID NO: 489331 - RNA, 19 nt, Human
uagcccccaagucaggcca

SEQ ID NO: 489332 - RNA, 32 nt, Human
uagcccccagccagggcguuggggagggcggu

SEQ ID NO: 489333 - RNA, 32 nt, Human
uagcccccgaguccaagaacuuaggcaggggc

SEQ ID NO: 489334 - RNA, 32 nt, Human
uagcccccuccaccuuuccacucaacaaccuc

SEQ ID NO: 489335 - RNA, 32 nt, Human
uagcccccugcacuguccuucccauaggagaa

SEQ ID NO: 489336 - RNA, 32 nt, Human
uagcccccuuuuaagagaaucucccuuucaau

SEQ ID NO: 489337 - RNA, 32 nt, Human
uagccccgccugcugcuucuccaccuccccuc

SEQ ID NO: 489338 - RNA, 32 nt, Human
uagccccgccugcugcuucucuaccuccccuc

SEQ ID NO: 489339 - RNA, 32 nt, Human
uagccccggacugaguccccuccagucgagga

SEQ ID NO: 489340 - RNA, 32 nt, Human
uagccccggcucccagugugcgcccggccggc

SEQ ID NO: 489341 - RNA, 32 nt, Human
uagccccggggcccugagcagaggccguagcu

SEQ ID NO: 489342 - RNA, 32 nt, Human
uagccccgugauggcucccuguuggcuacgca

SEQ ID NO: 489343 - RNA, 32 nt, Human
uagccccucaugcugggcucuggaccaugagc

SEQ ID NO: 489344 - RNA, 25 nt, Human
uagccccucccagccuaccccuccu

SEQ ID NO: 489345 - RNA, 32 nt, Human
uagccccucucaaaaggagucuuuauucugag

SEQ ID NO: 489346 - RNA, 32 nt, Human
uagccccugcacccucuucccugccucugcuc

SEQ ID NO: 489347 - RNA, 32 nt, Human
uagccccugccugcacccacgaugcugcacgg

SEQ ID NO: 489348 - RNA, 32 nt, Human
uagccccuucaucaugucaucucccuuaugcu

SEQ ID NO: 489349 - RNA, 31 nt, Human
uagccccuucccgucugcccuguguccucac

SEQ ID NO: 489350 - RNA, 32 nt, Human
uagcccgcagugcaggggcagcgcggcgcggg

SEQ ID NO: 489351 - RNA, 32 nt, Human
uagcccgccugggaggagcgccuggacucgcg

SEQ ID NO: 489352 - RNA, 32 nt, Human
uagcccggaaggaggagcaagagccagggggc

SEQ ID NO: 489353 - RNA, 32 nt, Human
uagcccggccagggccuggugugaggcugggc

SEQ ID NO: 489354 - RNA, 32 nt, Human
uagcccgggggaggcagaaucuggguaaugga

SEQ ID NO: 489355 - RNA, 32 nt, Human
uagcccuaaggagaugaucagagauguguaaa

SEQ ID NO: 489356 - RNA, 32 nt, Human
uagcccuagcuacucuggaggcugaggcagga

SEQ ID NO: 489357 - RNA, 32 nt, Human
uagcccucaaauaaacuguuauugcauuauag

SEQ ID NO: 489358 - RNA, 32 nt, Human
uagcccucauggcugaaggcccaguccuggcu

SEQ ID NO: 489359 - RNA, 19 nt, Human
uagcccuccauccucuaca

SEQ ID NO: 489360 - RNA, 32 nt, Human
uagcccucccaaaauguagauuauuuuauuuc

SEQ ID NO: 489361 - RNA, 32 nt, Human
uagcccucccucucuugggacagaccccucgg

SEQ ID NO: 489362 - RNA, 32 nt, Human
uagcccucccugcuuugccuggcccguugaag

SEQ ID NO: 489363 - RNA, 32 nt, Human
uagcccuggcuccaagggcugccuccugacag

SEQ ID NO: 489364 - RNA, 32 nt, Human
uagcccuggcuggaaaaccaccucucaauagc

SEQ ID NO: 489365 - RNA, 32 nt, Human
uagcccugggcaagagccuggaagccucuaua

SEQ ID NO: 489366 - RNA, 32 nt, Human
uagcccugguacaugguacacacacccccacc

SEQ ID NO: 489367 - RNA, 32 nt, Human
uagcccuguccauccagcaccuggacaccccg

SEQ ID NO: 489368 - RNA, 32 nt, Human
uagcccugucccccagccuggcaccuggacac

SEQ ID NO: 489369 - RNA, 32 nt, Human
uagcccugucccuucccugccugcagcccagg

SEQ ID NO: 489370 - RNA, 32 nt, Human
uagcccugugaccaacucuggcugccagaaaa

SEQ ID NO: 489371 - RNA, 32 nt, Human
uagcccuguuucucaauucccaucauguagag

SEQ ID NO: 489372 - RNA, 32 nt, Human
uagcccuuggccaggccauccuguugcagauc

SEQ ID NO: 489373 - RNA, 32 nt, Human
uagcccuuguaauccuagcacuuugggaggcc

SEQ ID NO: 489374 - RNA, 32 nt, Human
uagcccuuuguaguuugcaaagcacuuuucca

SEQ ID NO: 489375 - RNA, 32 nt, Human
uagcccuuuguuuugcaguggaaaacacugaa

SEQ ID NO: 489376 - RNA, 32 nt, Human
uagcccuuuuagauuuuggcacugugaaaccc

SEQ ID NO: 489377 - RNA, 32 nt, Human
uagccgaagagauuccucugaaaaucuuggcc

SEQ ID NO: 489378 - RNA, 32 nt, Human
uagccgaagcgcuuccagcauccucuguucau

SEQ ID NO: 489379 - RNA, 32 nt, Human
uagccgacucacuugcaacuccaccucagcag

SEQ ID NO: 489380 - RNA, 32 nt, Human
uagccgagggagagucuuggggccaagaaggg

SEQ ID NO: 489381 - RNA, 32 nt, Human
uagccgaucucuaggcccuucuugcacugcca

SEQ ID NO: 489382 - RNA, 32 nt, Human
uagccgccgcugggccgagccugcacuggggc

SEQ ID NO: 489383 - RNA, 32 nt, Human
uagccgccuuucugucugagagaaacugaggc

SEQ ID NO: 489384 - RNA, 32 nt, Human
uagccgcggcgcugcugcugggcugcugggcu

SEQ ID NO: 489385 - RNA, 32 nt, Human
uagccgcggcugcuucgguugccgcggucggu

SEQ ID NO: 489386 - RNA, 32 nt, Human
uagccgcucgccguccuugcaggcucugccgu

SEQ ID NO: 489387 - RNA, 32 nt, Human
uagccgcugcuugugagaccuuccucaagcuc

SEQ ID NO: 489388 - RNA, 32 nt, Human
uagccggagacagcucuucaguucccauaaac

SEQ ID NO: 489389 - RNA, 32 nt, Human
uagccggagccgcgggugagcgcggcgagcgg

SEQ ID NO: 489390 - RNA, 32 nt, Human
uagccggccccagggagugcagagccagggag

SEQ ID NO: 489391 - RNA, 32 nt, Human
uagccgggcauggugcaugccuguaaucccag

SEQ ID NO: 489392 - RNA, 32 nt, Human
uagccgggcucacgccugaaaucccagcacuu

SEQ ID NO: 489393 - RNA, 32 nt, Human
uagccggggccaggggaccgugguggagaccu

SEQ ID NO: 489394 - RNA, 32 nt, Human
uagccguaacuugccugcaccugcugccuuaa

SEQ ID NO: 489395 - RNA, 32 nt, Human
uagccgucauccucacagcugcagggccaggu

SEQ ID NO: 489396 - RNA, 32 nt, Human
uagccgucuccucuuuaucaugcuuuuucccc

SEQ ID NO: 489397 - RNA, 32 nt, Human
uagccgugcacagccccauacacuucagggga

SEQ ID NO: 489398 - RNA, 23 nt, Human
uagccguguuagggaucauguua

SEQ ID NO: 489399 - RNA, 32 nt, Human
uagccuaacaaggugcugucacagacccuugu

SEQ ID NO: 489400 - RNA, 32 nt, Human
uagccuaaguaggaagugaaaagauaauucac

SEQ ID NO: 489401 - RNA, 23 nt, Human
uagccuaauaaagcuuuuuugaa

SEQ ID NO: 489402 - RNA, 32 nt, Human
uagccuacaguguuuccacacgcccugacacc

SEQ ID NO: 489403 - RNA, 22 nt, Human
uagccuaggcaacauagugaga

SEQ ID NO: 489404 - RNA, 32 nt, Human
uagccuagggaacauggcaaaaccccagcucu

SEQ ID NO: 489405 - RNA, 22 nt, Human
uagccuaggugacagagugaga

SEQ ID NO: 489406 - RNA, 32 nt, Human
uagccuaguuuuccuuuucuuuauucuggcuc

SEQ ID NO: 489407 - RNA, 32 nt, Human
uagccuaucccuccugacaguccuuauaaaua

SEQ ID NO: 489408 - RNA, 32 nt, Human
uagccuaucuccugugccccugacugagcaga

SEQ ID NO: 489409 - RNA, 32 nt, Human
uagccuauucccucuaggaaccuuggagggca

SEQ ID NO: 489410 - RNA, 23 nt, Human
uagccucaaacucccaggcucaa

SEQ ID NO: 489411 - RNA, 23 nt, Human
uagccucaaacuccuggucucaa

SEQ ID NO: 489412 - RNA, 23 nt, Human
uagccucaaacuucugggcuuaa

SEQ ID NO: 489413 - RNA, 32 nt, Human
uagccucacgugcaaucugggugucuucgggg

SEQ ID NO: 489414 - RNA, 17 nt, Human
uagccucagaucuuccc

SEQ ID NO: 489415 - RNA, 32 nt, Human
uagccucaucucagugccuaugaggggccugc

SEQ ID NO: 489416 - RNA, 32 nt, Human
uagccucauggaccagcccacguuuuccaugg

SEQ ID NO: 489417 - RNA, 22 nt, Human
uagccuccaaccccugggcuca

SEQ ID NO: 489418 - RNA, 32 nt, Human
uagccuccauaacugugugagccaauucccua

SEQ ID NO: 489419 - RNA, 32 nt, Human
uagccucccaagugcuaggauuacaggcauca

SEQ ID NO: 489420 - RNA, 32 nt, Human
uagccuccuccacuccuccccacagcgcagag

SEQ ID NO: 489421 - RNA, 32 nt, Human
uagccucucaggaaccugcuuaccucagagcc

SEQ ID NO: 489422 - RNA, 32 nt, Human
uagccucugagauguguggugugagcccgugu

SEQ ID NO: 489423 - RNA, 32 nt, Human
uagccucugcugcaaaugcucagcccugcugu

SEQ ID NO: 489424 - RNA, 32 nt, Human
uagccucuuucaucuucucucacccacauaac

SEQ ID NO: 489425 - RNA, 20 nt, Human
uagccugaaaccucuuccac

SEQ ID NO: 489426 - RNA, 32 nt, Human
uagccugacagcucuagauacagcauuucuau

SEQ ID NO: 489427 - RNA, 32 nt, Human
uagccugaccaacauggagaaacccugucucu

SEQ ID NO: 489428 - RNA, 32 nt, Human
uagccugaccaacauggagaaaucccgucucu

SEQ ID NO: 489429 - RNA, 32 nt, Human
uagccugaccaacauggugaaacucuguucua

SEQ ID NO: 489430 - RNA, 32 nt, Human
uagccugacccuugcugaucuguccagccucu

SEQ ID NO: 489431 - RNA, 32 nt, Human
uagccugaccgacauggagaaacccugugucc

SEQ ID NO: 489432 - RNA, 32 nt, Human
uagccugagcuccuaaagaccucuuguacuug

SEQ ID NO: 489433 - RNA, 32 nt, Human
uagccugaguauacaaucaagcuucagugugc

SEQ ID NO: 489434 - RNA, 32 nt, Human
uagccugaugucaaccuggaagcugguguuca

SEQ ID NO: 489435 - RNA, 32 nt, Human
uagccugaugucaaccugggagcuggugauca

SEQ ID NO: 489436 - RNA, 32 nt, Human
uagccugcagugaacuaugauaguaccacugc

SEQ ID NO: 489437 - RNA, 32 nt, Human
uagccugcggucaggggcaaggcuuuuggaug

SEQ ID NO: 489438 - RNA, 32 nt, Human
uagccugcuacagccuugaacucaugggcuca

SEQ ID NO: 489439 - RNA, 32 nt, Human
uagccugcuguugaccaguaguaugcuauuag

SEQ ID NO: 489440 - RNA, 32 nt, Human
uagccugcuuucuuaccaaauucauguuaccc

SEQ ID NO: 489441 - RNA, 20 nt, Human
uagccugcuuuuguccuguu

SEQ ID NO: 489442 - RNA, 32 nt, Human
uagccuggacaacauggugaaaccccaucucu

SEQ ID NO: 489443 - RNA, 22 nt, Human
uagccuggacaacuaagugaga

SEQ ID NO: 489444 - RNA, 32 nt, Human
uagccuggagaugggaaaauaugcuuggcaga

SEQ ID NO: 489445 - RNA, 32 nt, Human
uagccuggaggucaaggcugcagugagccaug

SEQ ID NO: 489446 - RNA, 32 nt, Human
uagccuggaugagcugaguggagccaggcugg

SEQ ID NO: 489447 - RNA, 32 nt, Human
uagccuggcagccuggcuuugcggacucaccu

SEQ ID NO: 489448 - RNA, 32 nt, Human
uagccuggccaacaucaugaaaccccgucucu

SEQ ID NO: 489449 - RNA, 32 nt, Human
uagccuggccaacaugaugaaacccugucucu

SEQ ID NO: 489450 - RNA, 32 nt, Human
uagccuggccaacauggcaaaacccccucuuu

SEQ ID NO: 489451 - RNA, 32 nt, Human
uagccuggccaacaugguaaaacccuaucuuu

SEQ ID NO: 489452 - RNA, 32 nt, Human
uagccuggccaacauggugaaaccccaucucu

SEQ ID NO: 489453 - RNA, 30 nt, Human
uagccuggccaacauggugaaaccccguca

SEQ ID NO: 489454 - RNA, 32 nt, Human
uagccuggccaacauggugaaaccccgucucu

SEQ ID NO: 489455 - RNA, 32 nt, Human
uagccuggccaacauggugaaacccugucucu

SEQ ID NO: 489456 - RNA, 32 nt, Human
uagccuggccaacauggugagacacccgucuc

SEQ ID NO: 489457 - RNA, 32 nt, Human
uagccuggccaacauguuguaaaccccgucuc

SEQ ID NO: 489458 - RNA, 32 nt, Human
uagccuggccaagauggugaaaccccaucucu

SEQ ID NO: 489459 - RNA, 29 nt, Human
uagccuggcuaacauggcaaaaccccauc

SEQ ID NO: 489460 - RNA, 32 nt, Human
uagccuggcuaauacagugaaaccccaucucu

SEQ ID NO: 489461 - RNA, 32 nt, Human
uagccuggcuuucuugcucucccucaucucau

SEQ ID NO: 489462 - RNA, 32 nt, Human
uagccugggaggaucagucuguccaggucagc

SEQ ID NO: 489463 - RNA, 22 nt, Human
uagccugggcaacagagcgaga

SEQ ID NO: 489464 - RNA, 22 nt, Human
uagccugggcaacagaguaaga

SEQ ID NO: 489465 - RNA, 22 nt, Human
uagccugggcaacagagugaga

SEQ ID NO: 489466 - RNA, 32 nt, Human
uagccugggcaacaugaugaaaccccaucucc

SEQ ID NO: 489467 - RNA, 32 nt, Human
uagccugggcaacauggugaaaccccaucucu

SEQ ID NO: 489468 - RNA, 32 nt, Human
uagccugggcaacauggugagaccccaucucu

SEQ ID NO: 489469 - RNA, 32 nt, Human
uagccugggcaacuugguaaaaccccaucucu

SEQ ID NO: 489470 - RNA, 22 nt, Human
uagccugggcgacagagcaaga

SEQ ID NO: 489471 - RNA, 22 nt, Human
uagccugggcgacagagcgaga

SEQ ID NO: 489472 - RNA, 22 nt, Human
uagccugggcgacagagugaga

SEQ ID NO: 489473 - RNA, 22 nt, Human
uagccugggugacaaagugaga

SEQ ID NO: 489474 - RNA, 22 nt, Human
uagccugggugacagaacgaga

SEQ ID NO: 489475 - RNA, 22 nt, Human
uagccugggugacagaaugaga

SEQ ID NO: 489476 - RNA, 22 nt, Human
uagccugggugacagagcaaga

SEQ ID NO: 489477 - RNA, 22 nt, Human
uagccugggugacagagcgaga

SEQ ID NO: 489478 - RNA, 22 nt, Human
uagccugggugacagagugaga

SEQ ID NO: 489479 - RNA, 32 nt, Human
uagccugggugacugacuggccugggccuggg

SEQ ID NO: 489480 - RNA, 32 nt, Human
uagccuggucuuaaacuccuaaccucagguga

SEQ ID NO: 489481 - RNA, 32 nt, Human
uagccugguggcagagugagacuccaucucaa

SEQ ID NO: 489482 - RNA, 32 nt, Human
uagccugguggcaguggugagggagugaggag

SEQ ID NO: 489483 - RNA, 32 nt, Human
uagccuggugggaaaaugcacacauuucugag

SEQ ID NO: 489484 - RNA, 32 nt, Human
uagccuggugggcguggcaugugcuuuuuaaa

SEQ ID NO: 489485 - RNA, 32 nt, Human
uagccugucacucauuugccaugagguaugug

SEQ ID NO: 489486 - RNA, 32 nt, Human
uagccugucucaaagaaagaaagaaagaaaag

SEQ ID NO: 489487 - RNA, 18 nt, Human
uagccuguggucuccaca

SEQ ID NO: 489488 - RNA, 32 nt, Human
uagccuuaaagagccuacaguguccuuuugga

SEQ ID NO: 489489 - RNA, 23 nt, Human
uagccuuaaauuccuggguucaa

SEQ ID NO: 489490 - RNA, 32 nt, Human
uagccuuacugggaaccuucugucccccaaga

SEQ ID NO: 489491 - RNA, 32 nt, Human
uagccuuauuucucaucacaucaugcuguuuu

SEQ ID NO: 489492 - RNA, 32 nt, Human
uagccuuccucacagcacccaggauugugacu

SEQ ID NO: 489493 - RNA, 20 nt, Human
uagccuuccugaccuccaua

SEQ ID NO: 489494 - RNA, 32 nt, Human
uagccuuccugaccuucacuuaccucagcuau

SEQ ID NO: 489495 - RNA, 17 nt, Human
uagccuugaaguuuaca

SEQ ID NO: 489496 - RNA, 18 nt, Human
uagccuugaauccugcau

SEQ ID NO: 489497 - RNA, 23 nt, Human
uagccuugaccucucaggcucaa

SEQ ID NO: 489498 - RNA, 21 nt, Human
uagccuugagcaccuuccaca

SEQ ID NO: 489499 - RNA, 18 nt, Human
uagccuugauauucucca

SEQ ID NO: 489500 - RNA, 32 nt, Human
uagccuugaugaaaaguacaagauauguucaa

SEQ ID NO: 489501 - RNA, 32 nt, Human
uagccuugauuucaguagauguaauggaagcc

SEQ ID NO: 489502 - RNA, 20 nt, Human
uagccuugcaguggucuaca

SEQ ID NO: 489503 - RNA, 32 nt, Human
uagccuugccaacauggugaaaccccaucucu

SEQ ID NO: 489504 - RNA, 17 nt, Human
uagccuugcuuucuaua

SEQ ID NO: 489505 - RNA, 32 nt, Human
uagccuugguaucauuuucuagcaauaacuga

SEQ ID NO: 489506 - RNA, 32 nt, Human
uagccuuggucuuuuggccucuuuacccugug

SEQ ID NO: 489507 - RNA, 18 nt, Human
uagccuugugguuucaca

SEQ ID NO: 489508 - RNA, 19 nt, Human
uagccuuuacuucuucaca

SEQ ID NO: 489509 - RNA, 20 nt, Human
uagccuuugcauucucuaua

SEQ ID NO: 489510 - RNA, 32 nt, Human
uagccuuuggaggugggcucuauuccuguccc

SEQ ID NO: 489511 - RNA, 32 nt, Human
uagccuuuucccucugcccauccuagaggaga

SEQ ID NO: 489512 - RNA, 32 nt, Human
uagccuuuuugguaugguaaagagaugucaaa

SEQ ID NO: 489513 - RNA, 32 nt, Human
uagcgaacuucccucauuucucucugcaaucu

SEQ ID NO: 489514 - RNA, 32 nt, Human
uagcgaaggcagcagcagcgguggcgacauga

SEQ ID NO: 489515 - RNA, 23 nt, Human
uagcgagaccccaucucuacaaa

SEQ ID NO: 489516 - RNA, 24 nt, Human
uagcgagacccccauugcuacaaa

SEQ ID NO: 489517 - RNA, 23 nt, Human
uagcgagacccugucucuacaaa

SEQ ID NO: 489518 - RNA, 23 nt, Human
uagcgagacccugucucuacaag

SEQ ID NO: 489519 - RNA, 18 nt, Human
uagcgagaucugauuccg

SEQ ID NO: 489520 - RNA, 32 nt, Human
uagcgaggaggcaccccaagcacggagaagac

SEQ ID NO: 489521 - RNA, 32 nt, Human
uagcgagggcccuggccucaccuccugguggc

SEQ ID NO: 489522 - RNA, 32 nt, Human
uagcgauacugaggcagcgcccaggacaagug

SEQ ID NO: 489523 - RNA, 32 nt, Human
uagcgauagcuuuuaguagacagcgguaggug

SEQ ID NO: 489524 - RNA, 32 nt, Human
uagcgaugcugcaccucccaugauguccuggc

SEQ ID NO: 489525 - RNA, 30 nt, Human
uagcgaugucauucuucccugcucagacuc

SEQ ID NO: 489526 - RNA, 32 nt, Human
uagcgauuaucucuacuucuccaccucucauc

SEQ ID NO: 489527 - RNA, 32 nt, Human
uagcgcaaggcgggccgggcaccccgcgcucc

SEQ ID NO: 489528 - RNA, 24 nt, Human
uagcgcagggagccaggcgggcug

SEQ ID NO: 489529 - RNA, 32 nt, Human
uagcgccacccgcuucgcuugcaucagcugcg

SEQ ID NO: 489530 - RNA, 32 nt, Human
uagcgccacugcacugcacgccagccuaggcg

SEQ ID NO: 489531 - RNA, 32 nt, Human
uagcgccacugcaguccggccugggugaaaga

SEQ ID NO: 489532 - RNA, 32 nt, Human
uagcgccagggcuucccgcaccccaggcuggg

SEQ ID NO: 489533 - RNA, 32 nt, Human
uagcgccauugcacuccagccugagcgacaga

SEQ ID NO: 489534 - RNA, 32 nt, Human
uagcgccauugcacuccagccugggcaacaag

SEQ ID NO: 489535 - RNA, 32 nt, Human
uagcgccauugcacuccagccugggcgacuga

SEQ ID NO: 489536 - RNA, 32 nt, Human
uagcgccccauuugggaacagagcaagagugu

SEQ ID NO: 489537 - RNA, 32 nt, Human
uagcgcccugcagggacggugcaggcugguug

SEQ ID NO: 489538 - RNA, 32 nt, Human
uagcgcccuuuggaaagaagcuacuauaggac

SEQ ID NO: 489539 - RNA, 32 nt, Human
uagcgccucccaucugcuccccaauucuugau

SEQ ID NO: 489540 - RNA, 32 nt, Human
uagcgccugccugcccgccacugcccgcugag

SEQ ID NO: 489541 - RNA, 32 nt, Human
uagcgccugcucauauaaagcucuccuaacuc

SEQ ID NO: 489542 - RNA, 32 nt, Human
uagcgcgggagcugagaaguugcaggguugag

SEQ ID NO: 489543 - RNA, 32 nt, Human
uagcgcucaagcagagcccagcgcggugcuau

SEQ ID NO: 489544 - RNA, 32 nt, Human
uagcgcugaaacugaacaucuccuggguucuu

SEQ ID NO: 489545 - RNA, 32 nt, Human
uagcgcugggcaaagugaaggcuuccugaucu

SEQ ID NO: 489546 - RNA, 32 nt, Human
uagcgcuguccccagggccuugagugccugga

SEQ ID NO: 489547 - RNA, 32 nt, Human
uagcggagaagcucccccucccugcuucccuu

SEQ ID NO: 489548 - RNA, 19 nt, Human
uagcggagagcacgggaag

SEQ ID NO: 489549 - RNA, 32 nt, Human
uagcggaggaaaggagcaauccaugcacacuc

SEQ ID NO: 489550 - RNA, 32 nt, Human
uagcggcaaagauucagagaggcgugagcagc

SEQ ID NO: 489551 - RNA, 32 nt, Human
uagcggcaacucccucccucccugcaauccuu

SEQ ID NO: 489552 - RNA, 32 nt, Human
uagcggcacugcacuccagccugggugacaaa

SEQ ID NO: 489553 - RNA, 32 nt, Human
uagcggcagcagccccagccucaaggccaguu

SEQ ID NO: 489554 - RNA, 32 nt, Human
uagcggcauugcacuccagccugggcaacaag

SEQ ID NO: 489555 - RNA, 32 nt, Human
uagcggccaaggaggcuucaguucuuugccgc

SEQ ID NO: 489556 - RNA, 32 nt, Human
uagcggcccgggcgcugccuucacuccuggag

SEQ ID NO: 489557 - RNA, 32 nt, Human
uagcggcccuggagggcugcuaggugguucug

SEQ ID NO: 489558 - RNA, 32 nt, Human
uagcggccucugcaccacggagcugcuuggug

SEQ ID NO: 489559 - RNA, 32 nt, Human
uagcggcucuuccaagcucaaagaagcagagg

SEQ ID NO: 489560 - RNA, 32 nt, Human
uagcgggagagacaggauaaccuguccgagag

SEQ ID NO: 489561 - RNA, 32 nt, Human
uagcgggagagggagcgggaucaccggcccgg

SEQ ID NO: 489562 - RNA, 32 nt, Human
uagcgggagggguguguucauggggaacaacc

SEQ ID NO: 489563 - RNA, 32 nt, Human
uagcggggcaaccucagggcuaccagcgaucc

SEQ ID NO: 489564 - RNA, 32 nt, Human
uagcggggcccaggcugcccgcgggugcaccc

SEQ ID NO: 489565 - RNA, 32 nt, Human
uagcgggugccuguaaucccaguuacucagga

SEQ ID NO: 489566 - RNA, 32 nt, Human
uagcggguggaaagcuggacuggaguucucac

SEQ ID NO: 489567 - RNA, 32 nt, Human
uagcggucaaaggagcaaaacagacuuugucu

SEQ ID NO: 489568 - RNA, 32 nt, Human
uagcgucaccucaggucuggggaagucugugc

SEQ ID NO: 489569 - RNA, 26 nt, Human
uagcgucauaguuuccucacccaaau

SEQ ID NO: 489570 - RNA, 32 nt, Human
uagcguccucaccggcugccagcagggaaaug

SEQ ID NO: 489571 - RNA, 32 nt, Human
uagcguccucaccuuccccaagccacacaucc

SEQ ID NO: 489572 - RNA, 32 nt, Human
uagcgugaacccagaagguggagguagcagug

SEQ ID NO: 489573 - RNA, 32 nt, Human
uagcgugaaggggaaucaaagaggagguugug

SEQ ID NO: 489574 - RNA, 32 nt, Human
uagcgugaucauagcuuacugcagccucgaac

SEQ ID NO: 489575 - RNA, 32 nt, Human
uagcgugaucucuacucacugcagccucaauc

SEQ ID NO: 489576 - RNA, 32 nt, Human
uagcguggauccugggaugagaagacucaggg

SEQ ID NO: 489577 - RNA, 32 nt, Human
uagcgugggaagggggacagagagggcccucc

SEQ ID NO: 489578 - RNA, 32 nt, Human
uagcguuccauuugugaacaaauguucccuug

SEQ ID NO: 489579 - RNA, 32 nt, Human
uagcguuccucuuccccucuaguuuccuggag

SEQ ID NO: 489580 - RNA, 32 nt, Human
uagcguugaugaacucauguuugggaagaaau

SEQ ID NO: 489581 - RNA, 32 nt, Human
uagcguuggagacauacacaaaugggcauaca

SEQ ID NO: 489582 - RNA, 32 nt, Human
uagcguuguaggggcccugccugcacugcggu

SEQ ID NO: 489583 - RNA, 32 nt, Human
uagcguuuccuccucgaaauucuaccaagacu

SEQ ID NO: 489584 - RNA, 32 nt, Human
uagcuaaaaguuaagaaggaaagaaggaaagc

SEQ ID NO: 489585 - RNA, 32 nt, Human
uagcuaaaugacugagaagucuaaagagcuga

SEQ ID NO: 489586 - RNA, 32 nt, Human
uagcuaacuaugacagucacccucuguacgug

SEQ ID NO: 489587 - RNA, 32 nt, Human
uagcuaacuguaccaucacugccacaucaggg

SEQ ID NO: 489588 - RNA, 32 nt, Human
uagcuaaggccuggcuguagcaguuauaaacu

SEQ ID NO: 489589 - RNA, 32 nt, Human
uagcuaaguccaccccaccugcugccucacau

SEQ ID NO: 489590 - RNA, 31 nt, Human
uagcuaaucaauaaauauuuauugagcugaa

SEQ ID NO: 489591 - RNA, 32 nt, Human
uagcuacacccacucuaaaauuaacuggacau

SEQ ID NO: 489592 - RNA, 32 nt, Human
uagcuacacuucagauuaaaguaggagaaaga

SEQ ID NO: 489593 - RNA, 32 nt, Human
uagcuaccacuguugaguuuuccugcuuggaa

SEQ ID NO: 489594 - RNA, 32 nt, Human
uagcuaccaucuuugcagcagcccugguaacu

SEQ ID NO: 489595 - RNA, 32 nt, Human
uagcuacccuccccgucuccagccugggcucc

SEQ ID NO: 489596 - RNA, 32 nt, Human
uagcuacccuugcccaccgccguggaguucgc

SEQ ID NO: 489597 - RNA, 32 nt, Human
uagcuaccuggacuuuacagagcugucagaag

SEQ ID NO: 489598 - RNA, 32 nt, Human
uagcuaccugggagguuaaggugggaggauug

SEQ ID NO: 489599 - RNA, 32 nt, Human
uagcuaccuucucuacccaucucccccauccc

SEQ ID NO: 489600 - RNA, 32 nt, Human
uagcuacucuuauguuccacaugcacauauga

SEQ ID NO: 489601 - RNA, 32 nt, Human
uagcuacugcacuccaaccugggcaacauagu

SEQ ID NO: 489602 - RNA, 32 nt, Human
uagcuacuuauucagauacugaagaccaacgg

SEQ ID NO: 489603 - RNA, 32 nt, Human
uagcuacuucuuuaagcuccuccagugugcug

SEQ ID NO: 489604 - RNA, 32 nt, Human
uagcuacuugggaggcugagaugggaggauca

SEQ ID NO: 489605 - RNA, 32 nt, Human
uagcuacuugggaggcugaggcaggugaaucg

SEQ ID NO: 489606 - RNA, 32 nt, Human
uagcuacuugggaggcugaggugggagaauug

SEQ ID NO: 489607 - RNA, 32 nt, Human
uagcuacuugggaggcugaggugugaggauca

SEQ ID NO: 489608 - RNA, 32 nt, Human
uagcuagagauuggugaauugaaugcuccuga

SEQ ID NO: 489609 - RNA, 32 nt, Human
uagcuagaguuucaggaaugccuccagcuguc

SEQ ID NO: 489610 - RNA, 32 nt, Human
uagcuagauaaauauuguuagucuuagacaau

SEQ ID NO: 489611 - RNA, 32 nt, Human
uagcuagcagugagccaagaccgugccacugu

SEQ ID NO: 489612 - RNA, 32 nt, Human
uagcuagcauucaacagagaacucugucuuaa

SEQ ID NO: 489613 - RNA, 32 nt, Human
uagcuagcccacccugugcuaguuuucauguu

SEQ ID NO: 489614 - RNA, 32 nt, Human
uagcuagccugacuaagucccagauccccuac

SEQ ID NO: 489615 - RNA, 32 nt, Human
uagcuaggaaggguuuguagaaaacaagauaa

SEQ ID NO: 489616 - RNA, 32 nt, Human
uagcuaggacuacaaggcacaccaccaugccu

SEQ ID NO: 489617 - RNA, 32 nt, Human
uagcuaggagaugucaaaagcccauaugagga

SEQ ID NO: 489618 - RNA, 32 nt, Human
uagcuagggcuggggucagccacugccaaucc

SEQ ID NO: 489619 - RNA, 32 nt, Human
uagcuaguggagaggcaggaaaaaggaaauga

SEQ ID NO: 489620 - RNA, 32 nt, Human
uagcuauacauacucacuuuugguaacacuuu

SEQ ID NO: 489621 - RNA, 32 nt, Human
uagcuaugccaacugguugacccuccauucuc

SEQ ID NO: 489622 - RNA, 32 nt, Human
uagcuaugcuucuuccuccucagaccuggcau

SEQ ID NO: 489623 - RNA, 23 nt, Human
uagcuauguggaaugauauguca

SEQ ID NO: 489624 - RNA, 32 nt, Human
uagcuauguuuggagaaggaauuuguggcugc

SEQ ID NO: 489625 - RNA, 32 nt, Human
uagcuauuaagguggccuguugcagugcagag

SEQ ID NO: 489626 - RNA, 32 nt, Human
uagcuauuccacccucugccugccugccugcc

SEQ ID NO: 489627 - RNA, 32 nt, Human
uagcuauucgggaggcugagacaggagaauca

SEQ ID NO: 489628 - RNA, 32 nt, Human
uagcuauugcacuccagccuuggcaacauaau

SEQ ID NO: 489629 - RNA, 32 nt, Human
uagcuauuuaauuuuucccuuuccuauuguaa

SEQ ID NO: 489630 - RNA, 32 nt, Human
uagcuauuucgcauauauguaaaauguucuca

SEQ ID NO: 489631 - RNA, 32 nt, Human
uagcuauuugggaggcugaggcuggaggauug

SEQ ID NO: 489632 - RNA, 32 nt, Human
uagcucaacacaguuauauucuuuuugugaau

SEQ ID NO: 489633 - RNA, 32 nt, Human
uagcucaagccuguaaucccagcacuuuggga

SEQ ID NO: 489634 - RNA, 32 nt, Human
uagcucaaguugugcaugaauuacugaauauu

SEQ ID NO: 489635 - RNA, 32 nt, Human
uagcucacaccuguaaucccagaacuuuggga

SEQ ID NO: 489636 - RNA, 32 nt, Human
uagcucacaccuguaaucccagcacuucggga

SEQ ID NO: 489637 - RNA, 32 nt, Human
uagcucacaccuguaaucccagcacuuuagga

SEQ ID NO: 489638 - RNA, 32 nt, Human
uagcucacaccuguaaucccagcacuuuggga

SEQ ID NO: 489639 - RNA, 32 nt, Human
uagcucacaccuguaaucccagccuggaaugc

SEQ ID NO: 489640 - RNA, 32 nt, Human
uagcucacaccuguaauucccagcgcuuuggg

SEQ ID NO: 489641 - RNA, 32 nt, Human
uagcucacauccuccuuccuccaccuugacaa

SEQ ID NO: 489642 - RNA, 32 nt, Human
uagcucaccgcaaccuccaccucccggguuca

SEQ ID NO: 489643 - RNA, 32 nt, Human
uagcucacgccuguaaucccaacacuuuggga

SEQ ID NO: 489644 - RNA, 32 nt, Human
uagcucacgccuguaaucccagcacuuuggga

SEQ ID NO: 489645 - RNA, 32 nt, Human
uagcucacgccuguaauuccagcacuuuggga

SEQ ID NO: 489646 - RNA, 32 nt, Human
uagcucacgccugugauuccagcacuuuggga

SEQ ID NO: 489647 - RNA, 32 nt, Human
uagcucacuacaaccuccacuuuccagguuca

SEQ ID NO: 489648 - RNA, 32 nt, Human
uagcucacuacaaccucugccucccagguuca

SEQ ID NO: 489649 - RNA, 32 nt, Human
uagcucacuacaacuucugccucccaggcuca

SEQ ID NO: 489650 - RNA, 32 nt, Human
uagcucacuacagccuugaacuccugggcuca

SEQ ID NO: 489651 - RNA, 32 nt, Human
uagcucacugaagccucaaccucccuggguuu

SEQ ID NO: 489652 - RNA, 32 nt, Human
uagcucacugcaacccccgccucccggguuca

SEQ ID NO: 489653 - RNA, 32 nt, Human
uagcucacugcaaccucaaacuccugggcuca

SEQ ID NO: 489654 - RNA, 32 nt, Human
uagcucacugcaaccuccaacugcugggcuua

SEQ ID NO: 489655 - RNA, 32 nt, Human
uagcucacugcaaccuccaccucccagguuca

SEQ ID NO: 489656 - RNA, 32 nt, Human
uagcucacugcaaccuccaccucccggguuca

SEQ ID NO: 489657 - RNA, 32 nt, Human
uagcucacugcaaccuccgccuccuggguuca

SEQ ID NO: 489658 - RNA, 32 nt, Human
uagcucacugcaaccucugcuuccuggguuca

SEQ ID NO: 489659 - RNA, 32 nt, Human
uagcucacugcaagcuccgccucccagguuca

SEQ ID NO: 489660 - RNA, 32 nt, Human
uagcucacugcacccucaaccuccuggguuca

SEQ ID NO: 489661 - RNA, 32 nt, Human
uagcucacugcagccuccaccucccaggcuca

SEQ ID NO: 489662 - RNA, 32 nt, Human
uagcucacugcagcuucaaacucuugggcuca

SEQ ID NO: 489663 - RNA, 32 nt, Human
uagcucacugcagcuuugaccucccagaccca

SEQ ID NO: 489664 - RNA, 32 nt, Human
uagcucacugcugccucaaccucccaggcuca

SEQ ID NO: 489665 - RNA, 32 nt, Human
uagcucacuguagccucgaccuuccgggauca

SEQ ID NO: 489666 - RNA, 32 nt, Human
uagcucagaaguugcagagcagccugggcaac

SEQ ID NO: 489667 - RNA, 32 nt, Human
uagcucagccucccaccgucuuccuccuacac

SEQ ID NO: 489668 - RNA, 32 nt, Human
uagcucaggaagguagaagagaucugugccca

SEQ ID NO: 489669 - RNA, 32 nt, Human
uagcucaggagacaauuccagcacagacacua

SEQ ID NO: 489670 - RNA, 32 nt, Human
uagcucaggccuguaaccccagcacuucggga

SEQ ID NO: 489671 - RNA, 32 nt, Human
uagcucagggaggaggcaugagagggaucguu

SEQ ID NO: 489672 - RNA, 32 nt, Human
uagcucaggguuugugagugcaccaaucaaca

SEQ ID NO: 489673 - RNA, 32 nt, Human
uagcucaggucugggugccauucuuuacacuc

SEQ ID NO: 489674 - RNA, 32 nt, Human
uagcucaguaucucugccuucucuccauuguu

SEQ ID NO: 489675 - RNA, 32 nt, Human
uagcucauaccuguaaucccaggacuuuggga

SEQ ID NO: 489676 - RNA, 32 nt, Human
uagcucauacuuguaacccagcacuuugggaa

SEQ ID NO: 489677 - RNA, 32 nt, Human
uagcucaucucagccuccucugggagcaucaa

SEQ ID NO: 489678 - RNA, 32 nt, Human
uagcucaugccuguaacccuggcacuuaaggg

SEQ ID NO: 489679 - RNA, 32 nt, Human
uagcucaugccuguaaucccaauacuuuggga

SEQ ID NO: 489680 - RNA, 32 nt, Human
uagcucaugccuguaaucccagcacuucggga

SEQ ID NO: 489681 - RNA, 32 nt, Human
uagcucaugccuguaaucccagcacuuuggga

SEQ ID NO: 489682 - RNA, 32 nt, Human
uagcucaugccuguagucccagcuacuccaga

SEQ ID NO: 489683 - RNA, 32 nt, Human
uagcucaugccuguaucccagcccuuugggag

SEQ ID NO: 489684 - RNA, 31 nt, Human
uagcucaugucuguaaucccagcacuuuggg

SEQ ID NO: 489685 - RNA, 32 nt, Human
uagcuccaacuugucucagcaucacaucuucu

SEQ ID NO: 489686 - RNA, 31 nt, Human
uagcuccaagugucacacaccagaacauuaa

SEQ ID NO: 489687 - RNA, 32 nt, Human
uagcuccagcuacucaggaggcugaggcggga

SEQ ID NO: 489688 - RNA, 32 nt, Human
uagcuccagguggcaggcagagcaggaugcag

SEQ ID NO: 489689 - RNA, 32 nt, Human
uagcuccauauuggacauccccagaaaagaug

SEQ ID NO: 489690 - RNA, 32 nt, Human
uagcuccccugccccugcagccuggagggcuc

SEQ ID NO: 489691 - RNA, 32 nt, Human
uagcucccugcaggagagcugaaucuggagcu

SEQ ID NO: 489692 - RNA, 32 nt, Human
uagcucccuggacccgguugaccuguuggcuc

SEQ ID NO: 489693 - RNA, 32 nt, Human
uagcucccuggacccgguugaccuguuggucu

SEQ ID NO: 489694 - RNA, 32 nt, Human
uagcucccuguggggcaggagugccaggacca

SEQ ID NO: 489695 - RNA, 32 nt, Human
uagcucccuuuccuaggaguuguucuguccac

SEQ ID NO: 489696 - RNA, 32 nt, Human
uagcuccgcaaagcucugggcuugugugagag

SEQ ID NO: 489697 - RNA, 32 nt, Human
uagcuccggcgccccuagcuggugacugcugc

SEQ ID NO: 489698 - RNA, 32 nt, Human
uagcuccuaagaccugaaaacucuucucaaga

SEQ ID NO: 489699 - RNA, 32 nt, Human
uagcuccuauaccaccaccaccaccaccauua

SEQ ID NO: 489700 - RNA, 32 nt, Human
uagcuccucacugcuacagccuagaaggugag

SEQ ID NO: 489701 - RNA, 32 nt, Human
uagcuccuccugcuguggcuucagcugcugca

SEQ ID NO: 489702 - RNA, 32 nt, Human
uagcuccuccugguuuggugugguguuugcca

SEQ ID NO: 489703 - RNA, 32 nt, Human
uagcuccucuuuucuuccuuuuuauuucauaa

SEQ ID NO: 489704 - RNA, 32 nt, Human
uagcuccugcagcagcucugcuacgucaucgu

SEQ ID NO: 489705 - RNA, 32 nt, Human
uagcuccugcccccaggccuaggcaugcugcu

SEQ ID NO: 489706 - RNA, 32 nt, Human
uagcuccugccugcucucccugcguugccuag

SEQ ID NO: 489707 - RNA, 32 nt, Human
uagcuccuggcagagggugaguggggaccuac

SEQ ID NO: 489708 - RNA, 32 nt, Human
uagcucgauugccaaaaagcaccaagaaacau

SEQ ID NO: 489709 - RNA, 32 nt, Human
uagcucgguaaucucauguaccacagguaaug

SEQ ID NO: 489710 - RNA, 32 nt, Human
uagcucgucucaaacuccuggccucaagugau

SEQ ID NO: 489711 - RNA, 32 nt, Human
uagcucgugccuguaauaccaacauuuuggga

SEQ ID NO: 489712 - RNA, 32 nt, Human
uagcucuaaaaauagauucagagaaagggugg

SEQ ID NO: 489713 - RNA, 32 nt, Human
uagcucuacuacuugaaugauuuuggaauuuu

SEQ ID NO: 489714 - RNA, 32 nt, Human
uagcucuagcacuuacagcugugugaucuugg

SEQ ID NO: 489715 - RNA, 32 nt, Human
uagcucuauaaauauaugaauauggacaaaau

SEQ ID NO: 489716 - RNA, 32 nt, Human
uagcucucccucucacacacgcucacacccgg

SEQ ID NO: 489717 - RNA, 32 nt, Human
uagcucucgccuguaaucccagcacuuuggga

SEQ ID NO: 489718 - RNA, 32 nt, Human
uagcucucugcaaccucugccucccagguuca

SEQ ID NO: 489719 - RNA, 32 nt, Human
uagcucugagcagggucacauuuggccaaacc

SEQ ID NO: 489720 - RNA, 32 nt, Human
uagcucugcacucucuggaauaagggcccgau

SEQ ID NO: 489721 - RNA, 32 nt, Human
uagcucugccaguauuggguuuugccauuuuu

SEQ ID NO: 489722 - RNA, 32 nt, Human
uagcucugccucccucuccauaucuccuuccc

SEQ ID NO: 489723 - RNA, 32 nt, Human
uagcucugccugccugucaaccccucacugca

SEQ ID NO: 489724 - RNA, 32 nt, Human
uagcucuggaaccaggcuuguaauccauagca

SEQ ID NO: 489725 - RNA, 32 nt, Human
uagcucuggaccagccuguuggacccgcucug

SEQ ID NO: 489726 - RNA, 22 nt, Human
uagcucuggcauccucaggggu

SEQ ID NO: 489727 - RNA, 32 nt, Human
uagcucuggcauccucagggguugugauccag

SEQ ID NO: 489728 - RNA, 29 nt, Human
uagcucuggcugccugucagcucccuugg

SEQ ID NO: 489729 - RNA, 32 nt, Human
uagcucuggguugggcuuggggccaagucuca

SEQ ID NO: 489730 - RNA, 32 nt, Human
uagcucugucaccaggcuggagugcaguggug

SEQ ID NO: 489731 - RNA, 19 nt, Human
uagcucugugauucuucca

SEQ ID NO: 489732 - RNA, 32 nt, Human
uagcucuguggccucagaccucugggccugug

SEQ ID NO: 489733 - RNA, 24 nt, Human
uagcucuuaucacccuuccuagaa

SEQ ID NO: 489734 - RNA, 32 nt, Human
uagcucuuaucacccuuccuagaaagguuauu

SEQ ID NO: 489735 - RNA, 32 nt, Human
uagcucuugggaugcaggcucagcccgcugga

SEQ ID NO: 489736 - RNA, 32 nt, Human
uagcucuugucacguuccuuccuuccucacuc

SEQ ID NO: 489737 - RNA, 32 nt, Human
uagcucuuuaccuuuugaggaggaugagcggg

SEQ ID NO: 489738 - RNA, 32 nt, Human
uagcucuuuaguaauuugggcccagugccuug

SEQ ID NO: 489739 - RNA, 32 nt, Human
uagcucuuucccuccucccauuuccuuuagua

SEQ ID NO: 489740 - RNA, 22 nt, Human
uagcucuuucuugcuguuuuaa

SEQ ID NO: 489741 - RNA, 32 nt, Human
uagcucuuugaagagcuggucuauggaaguuu

SEQ ID NO: 489742 - RNA, 32 nt, Human
uagcugaaaacaaaugacaacuuucaaaacau

SEQ ID NO: 489743 - RNA, 32 nt, Human
uagcugaaacccaauucagauccaccauagga

SEQ ID NO: 489744 - RNA, 32 nt, Human
uagcugaccaaaggggucagcagggauggcgu

SEQ ID NO: 489745 - RNA, 32 nt, Human
uagcugaccauccuguuuuccaucccagagcc

SEQ ID NO: 489746 - RNA, 32 nt, Human
uagcugacucgguacucucugaagauggcaga

SEQ ID NO: 489747 - RNA, 32 nt, Human
uagcugagagguuccagcaaaagcuugaaguc

SEQ ID NO: 489748 - RNA, 32 nt, Human
uagcugagcaaugcuugugaaucuuuucuuaa

SEQ ID NO: 489749 - RNA, 32 nt, Human
uagcugaggaagaagggaggcuucacagcauc

SEQ ID NO: 489750 - RNA, 32 nt, Human
uagcugaggcccagaggaacgggaggaaaggg

SEQ ID NO: 489751 - RNA, 32 nt, Human
uagcugagguccagaaauacaaaccuggaacu

SEQ ID NO: 489752 - RNA, 32 nt, Human
uagcugagucaccauuuggcuucggccuggaa

SEQ ID NO: 489753 - RNA, 32 nt, Human
uagcugagugcacgccuguaaucccagcuucu

SEQ ID NO: 489754 - RNA, 16 nt, Human
uagcugauacuacaga

SEQ ID NO: 489755 - RNA, 32 nt, Human
uagcugaucacaccaacagauccucaucagca

SEQ ID NO: 489756 - RNA, 32 nt, Human
uagcugauggugcuggagcuguuaucauagcu

SEQ ID NO: 489757 - RNA, 32 nt, Human
uagcugcaaaggacagauccagggacugaagc

SEQ ID NO: 489758 - RNA, 32 nt, Human
uagcugcacgguggcugcuggccacaccacgg

SEQ ID NO: 489759 - RNA, 32 nt, Human
uagcugcagcaugccauuuggcuuucccaccu

SEQ ID NO: 489760 - RNA, 32 nt, Human
uagcugcagccacccgcaccuucacagacaua

SEQ ID NO: 489761 - RNA, 30 nt, Human
uagcugcaggaggugauggcacaaugcugc

SEQ ID NO: 489762 - RNA, 32 nt, Human
uagcugcagguucucucucacugccaucaaac

SEQ ID NO: 489763 - RNA, 32 nt, Human
uagcugcaguggaagauucuguuuuccugugg

SEQ ID NO: 489764 - RNA, 32 nt, Human
uagcugcagugucacaaagccauggcagaggg

SEQ ID NO: 489765 - RNA, 32 nt, Human
uagcugcauagacaggauuuuugcugaaaagg

SEQ ID NO: 489766 - RNA, 32 nt, Human
uagcugcauugcagguuucaggauuugcaggg

SEQ ID NO: 489767 - RNA, 32 nt, Human
uagcugccagaccugcucuugcugcugcucag

SEQ ID NO: 489768 - RNA, 32 nt, Human
uagcugccaucuuuuccuauguuucuucacau

SEQ ID NO: 489769 - RNA, 32 nt, Human
uagcugccccaccccucaggcccagccuggcc

SEQ ID NO: 489770 - RNA, 32 nt, Human
uagcugcccuaaaaggaaugaggaagcgagag

SEQ ID NO: 489771 - RNA, 32 nt, Human
uagcugccgcccuggguguccucaccccuucc

SEQ ID NO: 489772 - RNA, 32 nt, Human
uagcugccgccgcugcucaccccggccguccg

SEQ ID NO: 489773 - RNA, 32 nt, Human
uagcugccucuggcauucuuuuacuuaguuua

SEQ ID NO: 489774 - RNA, 32 nt, Human
uagcugccugcaccugcccuucagggagaugg

SEQ ID NO: 489775 - RNA, 32 nt, Human
uagcugccugcucuuccuuaagauggccuccc

SEQ ID NO: 489776 - RNA, 32 nt, Human
uagcugcuaaugaagagacaaaagagagagga

SEQ ID NO: 489777 - RNA, 32 nt, Human
uagcugcuacagucuccaggcagcuugacuug

SEQ ID NO: 489778 - RNA, 32 nt, Human
uagcugcuagaugcugaaaagacugaaaggag

SEQ ID NO: 489779 - RNA, 31 nt, Human
uagcugcucaauaaaggcuguguguguggaa

SEQ ID NO: 489780 - RNA, 32 nt, Human
uagcugcuccagucucagccugggcagcuucc

SEQ ID NO: 489781 - RNA, 32 nt, Human
uagcugcucuagcccuggguucuuggagaccu

SEQ ID NO: 489782 - RNA, 32 nt, Human
uagcugcucuccccaugauucccucccaguuu

SEQ ID NO: 489783 - RNA, 32 nt, Human
uagcugcugaaacccucuaucucuccggcauc

SEQ ID NO: 489784 - RNA, 32 nt, Human
uagcugcugcagcugcuggcucagccacgagc

SEQ ID NO: 489785 - RNA, 32 nt, Human
uagcugcugccuugccuuccgggaccucguuu

SEQ ID NO: 489786 - RNA, 32 nt, Human
uagcugcugcugcugcugcugcugcaaacugu

SEQ ID NO: 489787 - RNA, 32 nt, Human
uagcugcugcugcuggcuccacuccugcgguc

SEQ ID NO: 489788 - RNA, 32 nt, Human
uagcugcuggggaaauugguuuugaaaaucau

SEQ ID NO: 489789 - RNA, 32 nt, Human
uagcugcuggggaagcggggagaggggucagg

SEQ ID NO: 489790 - RNA, 32 nt, Human
uagcugcugugagaauuugucuuccucaccag

SEQ ID NO: 489791 - RNA, 32 nt, Human
uagcugcuugggaggcugaggcaggcggauag

SEQ ID NO: 489792 - RNA, 32 nt, Human
uagcuggaacagacauuuaucauuugacaaca

SEQ ID NO: 489793 - RNA, 32 nt, Human
uagcuggaacuacagguggugccaccauaccu

SEQ ID NO: 489794 - RNA, 32 nt, Human
uagcuggaagaugcggaaggggagcgacuagg

SEQ ID NO: 489795 - RNA, 23 nt, Human
uagcuggaccucgucucccaggg

SEQ ID NO: 489796 - RNA, 32 nt, Human
uagcuggaccucgucucccagggauuagagaa

SEQ ID NO: 489797 - RNA, 32 nt, Human
uagcuggauuacaggcacgugccaucacgccc

SEQ ID NO: 489798 - RNA, 32 nt, Human
uagcuggauuacaggcaugugccacccaccca

SEQ ID NO: 489799 - RNA, 32 nt, Human
uagcuggauuacaggugcaugccacgacaccc

SEQ ID NO: 489800 - RNA, 32 nt, Human
uagcuggcaaagguuuggugaaauagcuuugg

SEQ ID NO: 489801 - RNA, 32 nt, Human
uagcuggcaagcaguaguaucaagauggcggc

SEQ ID NO: 489802 - RNA, 32 nt, Human
uagcuggcauacaggugcaagccacuaugucc

SEQ ID NO: 489803 - RNA, 32 nt, Human
uagcuggcucccuagccuaccucucuggugau

SEQ ID NO: 489804 - RNA, 32 nt, Human
uagcuggcugacauggcacaagccacuuaccc

SEQ ID NO: 489805 - RNA, 32 nt, Human
uagcuggcugugccuuccuccuuucucucauc

SEQ ID NO: 489806 - RNA, 32 nt, Human
uagcuggcuuaacaaugacagaacagcuuaaa

SEQ ID NO: 489807 - RNA, 19 nt, Human
uagcuggcuuuuauccugu

SEQ ID NO: 489808 - RNA, 32 nt, Human
uagcugggaagccacaugcuggauggcuacaa

SEQ ID NO: 489809 - RNA, 32 nt, Human
uagcugggaagugggaccugggggugguugga

SEQ ID NO: 489810 - RNA, 32 nt, Human
uagcugggacauaccaacacacccagcuaauu

SEQ ID NO: 489811 - RNA, 32 nt, Human
uagcugggacuacagcacccaccaccacaccc

SEQ ID NO: 489812 - RNA, 32 nt, Human
uagcugggacuacaggcaccacuguggacccc

SEQ ID NO: 489813 - RNA, 18 nt, Human
uagcugggagccugggca

SEQ ID NO: 489814 - RNA, 32 nt, Human
uagcugggaguacagcgucugccaccaugccu

SEQ ID NO: 489815 - RNA, 18 nt, Human
uagcugggaucacuggca

SEQ ID NO: 489816 - RNA, 32 nt, Human
uagcugggauuaaggcgccugccaccaugccc

SEQ ID NO: 489817 - RNA, 18 nt, Human
uagcugggauuacaggug

SEQ ID NO: 489818 - RNA, 32 nt, Human
uagcugggauuacagugccugccaccaugccc

SEQ ID NO: 489819 - RNA, 18 nt, Human
uagcugggauuauaggug

SEQ ID NO: 489820 - RNA, 32 nt, Human
uagcugggauugcagccugcaccaccacaccu

SEQ ID NO: 489821 - RNA, 32 nt, Human
uagcugggccacaggcgugugccaccacaccu

SEQ ID NO: 489822 - RNA, 21 nt, Human
uagcugggccaccuccccggg

SEQ ID NO: 489823 - RNA, 31 nt, Human
uagcugggcguacuggcaugcaccuguaguc

SEQ ID NO: 489824 - RNA, 32 nt, Human
uagcuggggagagagggaucuuagaugagucu

SEQ ID NO: 489825 - RNA, 32 nt, Human
uagcuggggauugggcccucuuucucccagug

SEQ ID NO: 489826 - RNA, 22 nt, Human
uagcuggggcccuucacuggug

SEQ ID NO: 489827 - RNA, 18 nt, Human
uagcugggguuacaggug

SEQ ID NO: 489828 - RNA, 32 nt, Human
uagcuggguccccuggugaugaguuucagcau

SEQ ID NO: 489829 - RNA, 25 nt, Human
uagcugggugguaucuuuuacugug

SEQ ID NO: 489830 - RNA, 32 nt, Human
uagcuggguguggugguaggcaccuguaaucc

SEQ ID NO: 489831 - RNA, 32 nt, Human
uagcugguaccacaucuauucccauccagaga

SEQ ID NO: 489832 - RNA, 32 nt, Human
uagcuggucauugucucguggccagagggccc

SEQ ID NO: 489833 - RNA, 32 nt, Human
uagcuggucucaaacuccugaccuuaguugau

SEQ ID NO: 489834 - RNA, 32 nt, Human
uagcuggucuugaacuccugacccucaugauc

SEQ ID NO: 489835 - RNA, 32 nt, Human
uagcugguggcaauaaauaccagacacguaca

SEQ ID NO: 489836 - RNA, 32 nt, Human
uagcugguguuacugaguaaauuugaguguua

SEQ ID NO: 489837 - RNA, 32 nt, Human
uagcuguacuacaggaaugcaccaccaugccc

SEQ ID NO: 489838 - RNA, 32 nt, Human
uagcuguagcuggaggcagacuagccuugcac

SEQ ID NO: 489839 - RNA, 32 nt, Human
uaguuacauauguauacaugugccaugcuggu

SEQ ID NO: 489840 - RNA, 32 nt, Human
uaguuacauauguauacaugugccauguuggu

SEQ ID NO: 489841 - RNA, 32 nt, Human
uaguuacugauucuagggaacaauuggguaga

SEQ ID NO: 489842 - RNA, 32 nt, Human
uaguuacuggggguguugggggagacaggaga

SEQ ID NO: 489843 - RNA, 32 nt, Human
uaguuacugugagccuggcagagcagaaaagg

SEQ ID NO: 489844 - RNA, 32 nt, Human
uaguuagaaccugaaccacuaacuuccagggg

SEQ ID NO: 489845 - RNA, 32 nt, Human
uaguuagaauccaaauuugucuucuuauccau

SEQ ID NO: 489846 - RNA, 32 nt, Human
uaguuagagcaugggcccuggagccaggcugc

SEQ ID NO: 489847 - RNA, 32 nt, Human
uaguuagauuucaccugcauauacauuuuucc

SEQ ID NO: 489848 - RNA, 32 nt, Human
uaguuaggaagaaaggaggugggauaaggguc

SEQ ID NO: 489849 - RNA, 32 nt, Human
uaguuaggagcuauggcuaaacaucauccuga

SEQ ID NO: 489850 - RNA, 21 nt, Human
uaguuaggcaagggacaauga

SEQ ID NO: 489851 - RNA, 32 nt, Human
uaguuaggcaggaagcagagguguuuccuuuc

SEQ ID NO: 489852 - RNA, 32 nt, Human
uaguuagucucuaaaaauacaauguuucaggc

SEQ ID NO: 489853 - RNA, 32 nt, Human
uaguuagugaagaucaacugugugcugagcuc

SEQ ID NO: 489854 - RNA, 32 nt, Human
uaguuagugcagcuuuucauuguguugugugg

SEQ ID NO: 489855 - RNA, 32 nt, Human
uaguuaguggagggcaggauucucaggucccc

SEQ ID NO: 489856 - RNA, 32 nt, Human
uaguuauaacaugauaggugcugaauugugau

SEQ ID NO: 489857 - RNA, 32 nt, Human
uaguuaucuuucuccuuuuucuccuggaacug

SEQ ID NO: 489858 - RNA, 32 nt, Human
uaguuaugagggcaaccuagguuguucauguc

SEQ ID NO: 489859 - RNA, 32 nt, Human
uaguuauuaagcaauugacuuucacaccaacu

SEQ ID NO: 489860 - RNA, 32 nt, Human
uaguuauugaacuucuauaaugugccaggcuc

SEQ ID NO: 489861 - RNA, 32 nt, Human
uaguuauugagcaccuacuauguguuaggccc

SEQ ID NO: 489862 - RNA, 32 nt, Human
uaguuauuguaaggauuaaguaaguuauuaua

SEQ ID NO: 489863 - RNA, 32 nt, Human
uaguuauuguucaaggagggugcaauauuaag

SEQ ID NO: 489864 - RNA, 32 nt, Human
uaguuauuucuuggaccuugacaguaucuaau

SEQ ID NO: 489865 - RNA, 32 nt, Human
uaguuauuugcaaccucccuuuggguuuggcc

SEQ ID NO: 489866 - RNA, 32 nt, Human
uaguucaaccaccaaucccccuguccugaacu

SEQ ID NO: 489867 - RNA, 20 nt, Human
uaguucaaccauuguggaag

SEQ ID NO: 489868 - RNA, 32 nt, Human
uaguucacaccuguaaucccagcacuuuggga

SEQ ID NO: 489869 - RNA, 32 nt, Human
uaguucacagcaaauucacugccuccucccau

SEQ ID NO: 489870 - RNA, 32 nt, Human
uaguucacagccgucuccacagcucuuaccca

SEQ ID NO: 489871 - RNA, 32 nt, Human
uaguucacagcuguaccccaaggcuggagagg

SEQ ID NO: 489872 - RNA, 32 nt, Human
uaguucacagcuguucagggugacagugagca

SEQ ID NO: 489873 - RNA, 32 nt, Human
uaguucacaggcagaagcgagcugugacauug

SEQ ID NO: 489874 - RNA, 32 nt, Human
uaguucacugcaacuuccgcuucccagguuca

SEQ ID NO: 489875 - RNA, 32 nt, Human
uaguucagaguuaaagcuaaaacaccaaauau

SEQ ID NO: 489876 - RNA, 32 nt, Human
uaguucagauggugauucugaagcuuacaucu

SEQ ID NO: 489877 - RNA, 32 nt, Human
uaguucagccaagugauugggagaccacacag

SEQ ID NO: 489878 - RNA, 32 nt, Human
uaguucagcuacucagggggcugaggugggag

SEQ ID NO: 489879 - RNA, 32 nt, Human
uaguucagcugaggaagagaaucagcugaucc

SEQ ID NO: 489880 - RNA, 32 nt, Human
uaguucaggagguagaaugcagcuugagauca

SEQ ID NO: 489881 - RNA, 32 nt, Human
uaguucaggaguuugaaaccagccugggcaac

SEQ ID NO: 489882 - RNA, 32 nt, Human
uaguucaguacugauggaaucugagaaaauuu

SEQ ID NO: 489883 - RNA, 32 nt, Human
uaguucaguucugcagggcugcucaguucaca

SEQ ID NO: 489884 - RNA, 32 nt, Human
uaguucauaauccagucucagauuuugcucuu

SEQ ID NO: 489885 - RNA, 32 nt, Human
uaguucaugagucuagguaaaauaucaauuac

SEQ ID NO: 489886 - RNA, 32 nt, Human
uaguucaugccauucagagcucauccccaaga

SEQ ID NO: 489887 - RNA, 32 nt, Human
uaguucaugccuguuucauugacacgugcugg

SEQ ID NO: 489888 - RNA, 32 nt, Human
uaguuccaaugcauuuggcuccagaaagaccc

SEQ ID NO: 489889 - RNA, 32 nt, Human
uaguuccacccccuccuaccugggugagcuug

SEQ ID NO: 489890 - RNA, 32 nt, Human
uaguuccagacaccuccacgcccaccuggucc

SEQ ID NO: 489891 - RNA, 32 nt, Human
uaguuccagcgcuuugggaggcugagguggac

SEQ ID NO: 489892 - RNA, 32 nt, Human
uaguuccagcuaacugggcggcugaggcagga

SEQ ID NO: 489893 - RNA, 32 nt, Human
uaguuccagcuacauaggaggcugagguggga

SEQ ID NO: 489894 - RNA, 32 nt, Human
uaguuccagcuaccugggaggcugaggcagga

SEQ ID NO: 489895 - RNA, 32 nt, Human
uaguuccagcuacucaggaggcugaaguggga

SEQ ID NO: 489896 - RNA, 32 nt, Human
uaguuccagcuacucaggaggcugaggcaaga

SEQ ID NO: 489897 - RNA, 32 nt, Human
uaguuccagcuacucaggaggcugaggcagga

SEQ ID NO: 489898 - RNA, 32 nt, Human
uaguuccagcuacucaggaggcugaggcuaga

SEQ ID NO: 489899 - RNA, 32 nt, Human
uaguuccagcuacucaggaggcugagguggga

SEQ ID NO: 489900 - RNA, 32 nt, Human
uaguuccagcuacucaguaggcugaggcagaa

SEQ ID NO: 489901 - RNA, 32 nt, Human
uaguuccagcuacucggagacugaggcaggag

SEQ ID NO: 489902 - RNA, 32 nt, Human
uaguuccagcuacucgggaggcugaggcaaga

SEQ ID NO: 489903 - RNA, 32 nt, Human
uaguuccagcuacucgggaggcugaggcagga

SEQ ID NO: 489904 - RNA, 32 nt, Human
uaguuccagcuacucgggaggcugaggugaaa

SEQ ID NO: 489905 - RNA, 32 nt, Human
uaguuccagcuacuugagaggcugaggcagga

SEQ ID NO: 489906 - RNA, 32 nt, Human
uaguuccagcuacuugggaggcugagacaggc

SEQ ID NO: 489907 - RNA, 32 nt, Human
uaguuccagcuacuugggaggcugaggcagca

SEQ ID NO: 489908 - RNA, 32 nt, Human
uaguuccagcuacuugggaggcugaggcagga

SEQ ID NO: 489909 - RNA, 32 nt, Human
uaguuccagcuacuugggaggcugagguggga

SEQ ID NO: 489910 - RNA, 32 nt, Human
uaguuccagcuacuugugaggcugagguggga

SEQ ID NO: 489911 - RNA, 32 nt, Human
uaguuccagcuauacaggaaggugaggcagaa

SEQ ID NO: 489912 - RNA, 32 nt, Human
uaguuccagcuauuugggaggcugaggaagga

SEQ ID NO: 489913 - RNA, 32 nt, Human
uaguuccagcugcuugggaggcugaggcacga

SEQ ID NO: 489914 - RNA, 32 nt, Human
uaguuccaguuacucaggaggcugaggugaga

SEQ ID NO: 489915 - RNA, 32 nt, Human
uaguuccaguuacuccagaggcugagguagga

SEQ ID NO: 489916 - RNA, 32 nt, Human
uaguucccaccacacaugaggugguggaaugg

SEQ ID NO: 489917 - RNA, 32 nt, Human
uaguucccauguuaaaucccauucauaacuuu

SEQ ID NO: 489918 - RNA, 31 nt, Human
uaguucccucguguggagcacuuguguuagg

SEQ ID NO: 489919 - RNA, 32 nt, Human
uaguucccugcaccccuucugggaaagaauua

SEQ ID NO: 489920 - RNA, 32 nt, Human
uaguucccuguauucaaaucccagugucuaac

SEQ ID NO: 489921 - RNA, 32 nt, Human
uaguucccuucauuccagagcuaugcuuguga

SEQ ID NO: 489922 - RNA, 32 nt, Human
uaguuccuagcuccucuuaggaaaacaguucu

SEQ ID NO: 489923 - RNA, 32 nt, Human
uaguuccugagugaugucuguguguuccuugc

SEQ ID NO: 489924 - RNA, 32 nt, Human
uaguuccuugacuuuccucgaauuucauuacc

SEQ ID NO: 489925 - RNA, 32 nt, Human
uaguucuacaucuagugcuucuugccaaaaag

SEQ ID NO: 489926 - RNA, 32 nt, Human
uaguucuaccacccuucacugcuaguguacag

SEQ ID NO: 489927 - RNA, 32 nt, Human
uaguucuaccugcugcaguugcacugaaguga

SEQ ID NO: 489928 - RNA, 32 nt, Human
uaguucuacuucagaaccacagagacaugagc

SEQ ID NO: 489929 - RNA, 32 nt, Human
uaguucuagaggcuggaaguccacagugccgg

SEQ ID NO: 489930 - RNA, 32 nt, Human
uaguucuagcacuuugagaggcugagcggggu

SEQ ID NO: 489931 - RNA, 32 nt, Human
uaguucuagcacuuugagaggcugaggagggu

SEQ ID NO: 489932 - RNA, 32 nt, Human
uaguucuagcuacuagggaggcugaggaggaa

SEQ ID NO: 489933 - RNA, 32 nt, Human
uaguucuagcuacucuggaggcugaggcagga

SEQ ID NO: 489934 - RNA, 32 nt, Human
uaguucuccagguaguuacuuuugccaugucc

SEQ ID NO: 489935 - RNA, 32 nt, Human
uaguucucccuccccuccuacuucucucacac

SEQ ID NO: 489936 - RNA, 32 nt, Human
uaguucucucagguaaauacagggaucaauaa

SEQ ID NO: 489937 - RNA, 32 nt, Human
uaguucugcacuuuuccacauuauacuccaua

SEQ ID NO: 489938 - RNA, 32 nt, Human
uaguucugcuuaccuucucuuccucauccaga

SEQ ID NO: 489939 - RNA, 32 nt, Human
uaguucugcuucacucuauuuaucucuugaug

SEQ ID NO: 489940 - RNA, 32 nt, Human
uaguucugcuucugaaacuggaguaucauucu

SEQ ID NO: 489941 - RNA, 32 nt, Human
uaguucuggacuuuccuuucuguuccuugggu

SEQ ID NO: 489942 - RNA, 32 nt, Human
uaguucuguugucuuguugucucagucuuuua

SEQ ID NO: 489943 - RNA, 32 nt, Human
uaguucuuauuccggagccucaaacaagcauu

SEQ ID NO: 489944 - RNA, 32 nt, Human
uaguucuugaucugcugaccaugacacaaaac

SEQ ID NO: 489945 - RNA, 32 nt, Human
uaguucuuuuguauuuugagggagaggguggg

SEQ ID NO: 489946 - RNA, 32 nt, Human
uaguugaaagcaaccugcaugcuaaucguggu

SEQ ID NO: 489947 - RNA, 32 nt, Human
uaguugaaccguccuggaauagaaacucgccc

SEQ ID NO: 489948 - RNA, 32 nt, Human
uaguugaauguauacuucuguaccaaaacuug

SEQ ID NO: 489949 - RNA, 32 nt, Human
uaguugacagccuugcuccucucccaaguucu

SEQ ID NO: 489950 - RNA, 32 nt, Human
uaguugagacgggguuucaccauguuggucag

SEQ ID NO: 489951 - RNA, 32 nt, Human
uaguugagaugggguuuuuccacguuggucag

SEQ ID NO: 489952 - RNA, 32 nt, Human
uaguugaggugagguuucaccauguuggccag

SEQ ID NO: 489953 - RNA, 32 nt, Human
uaguugauaggugaggugggugaagaaggcug

SEQ ID NO: 489954 - RNA, 32 nt, Human
uaguugaugcagaugagaaaguuugacacagc

SEQ ID NO: 489955 - RNA, 32 nt, Human
uaguugauggccuucagaagaauugaggaucu

SEQ ID NO: 489956 - RNA, 32 nt, Human
uaguugauuuuucugccugaaggauccugaac

SEQ ID NO: 489957 - RNA, 32 nt, Human
uaguugcagaacuuaguuuauaaaaacaaaga

SEQ ID NO: 489958 - RNA, 32 nt, Human
uaguugcaggagacggguguuacacgcaguca

SEQ ID NO: 489959 - RNA, 32 nt, Human
uaguugcaggcaguguaccucagguugacucu

SEQ ID NO: 489960 - RNA, 32 nt, Human
uaguugcagucagggagccagcgaaaagacaa

SEQ ID NO: 489961 - RNA, 32 nt, Human
uaguugcaugaccacauagaacaugugucuau

SEQ ID NO: 489962 - RNA, 32 nt, Human
uaguugccaccuguauauccucuuuggaagaa

SEQ ID NO: 489963 - RNA, 32 nt, Human
uaguugccauuuuaacaaagcagguaaaucgg

SEQ ID NO: 489964 - RNA, 32 nt, Human
uaguugcccacacuagagugcaauggcgcaac

SEQ ID NO: 489965 - RNA, 32 nt, Human
uaguugcgcgcaccuuuugaaaagcuuggcgu

SEQ ID NO: 489966 - RNA, 32 nt, Human
uaguugcuaacauacuaacaacugauuuuaag

SEQ ID NO: 489967 - RNA, 32 nt, Human
uaguugcuaaugcagaacaaguucugucuugg

SEQ ID NO: 489968 - RNA, 32 nt, Human
uaguugcuccgccucugcuggcacauuucccc

SEQ ID NO: 489969 - RNA, 32 nt, Human
uaguugcugcacuccagccuaggcaacauagu

SEQ ID NO: 489970 - RNA, 32 nt, Human
uaguugcugcucaugguucugucuguccgugc

SEQ ID NO: 489971 - RNA, 32 nt, Human
uaguugcuggccuucagaagaauugaggaucu

SEQ ID NO: 489972 - RNA, 32 nt, Human
uaguugcugguaaagcccugagggucccgcca

SEQ ID NO: 489973 - RNA, 32 nt, Human
uaguugcugucugguguuugcuggugaaaaca

SEQ ID NO: 489974 - RNA, 32 nt, Human
uaguugcuguguaaauguuaggaagcaaagua

SEQ ID NO: 489975 - RNA, 32 nt, Human
uaguuggaaauguaaucaucccaaagaucauu

SEQ ID NO: 489976 - RNA, 32 nt, Human
uaguuggagagggauuggaguaccacuuucuu

SEQ ID NO: 489977 - RNA, 32 nt, Human
uaguuggaggcugcaguaagcuaugaucaugc

SEQ ID NO: 489978 - RNA, 32 nt, Human
uaguuggaucaagugacuucugcccaccugga

SEQ ID NO: 489979 - RNA, 31 nt, Human
uaguuggcaaugucuuacauuuauguuaagu

SEQ ID NO: 489980 - RNA, 32 nt, Human
uaguuggcacuggcaaugcacauacuuacuag

SEQ ID NO: 489981 - RNA, 32 nt, Human
uaguuggcaucuccgcgcguccggacacccga

SEQ ID NO: 489982 - RNA, 32 nt, Human
uaguuggcuuccugccucucuccucuaaaaua

SEQ ID NO: 489983 - RNA, 32 nt, Human
uaguuggcuuugucugucaggugcagucuggc

SEQ ID NO: 489984 - RNA, 32 nt, Human
uaguugggaauuggaaccccuccagggggaac

SEQ ID NO: 489985 - RNA, 32 nt, Human
uaguugggaggcuggcacaggagaaucgcuug

SEQ ID NO: 489986 - RNA, 32 nt, Human
uaguuggucaucuguguguuccaccugcaucc

SEQ ID NO: 489987 - RNA, 32 nt, Human
uaguuggugcuggauggauguuuguugaauga

SEQ ID NO: 489988 - RNA, 32 nt, Human
uaguuguaacaaauucaccacacuaaugucag

SEQ ID NO: 489989 - RNA, 32 nt, Human
uaguuguauaccugauuguaacaaucaucuuu

SEQ ID NO: 489990 - RNA, 32 nt, Human
uaguuguauuuuuaguagagaugggguuucac

SEQ ID NO: 489991 - RNA, 32 nt, Human
uaguugucagaauaugccuucgucaaggcuca

SEQ ID NO: 489992 - RNA, 32 nt, Human
uaguugucccuuuguggacaaguuucccaaau

SEQ ID NO: 489993 - RNA, 32 nt, Human
uaguugucugguuucagggauagcuguuugaa

SEQ ID NO: 489994 - RNA, 31 nt, Human
uaguuguggguggagagaggagugaguuugu

SEQ ID NO: 489995 - RNA, 32 nt, Human
uaguuguggucugccugauacuaccauagcac

SEQ ID NO: 489996 - RNA, 32 nt, Human
uaguugugucaccauucuuguugcuuuuuaaa

SEQ ID NO: 489997 - RNA, 32 nt, Human
uaguuguugaaugaguacaguaaugaaugaca

SEQ ID NO: 489998 - RNA, 32 nt, Human
uaguuguugggagggggaggacaagaagucua

SEQ ID NO: 489999 - RNA, 32 nt, Human
uaguuguuugacaggaggagaauaaggcugaa

SEQ ID NO: 490000 - RNA, 32 nt, Human
uaguuuaaaaguacaggaaggaugauuaaggc

SEQ ID NO: 490001 - RNA, 32 nt, Human
uaguuuaaagauacuagucaccugccauaagu

SEQ ID NO: 490002 - RNA, 32 nt, Human
uaguuuacaguuuagcauaaacaaauaguagu

SEQ ID NO: 490003 - RNA, 32 nt, Human
uaguuuaccagccugugacaacugagugcuuc

SEQ ID NO: 490004 - RNA, 32 nt, Human
uaguuuaccaguacuuuaauauuaguuuucuu

SEQ ID NO: 490005 - RNA, 32 nt, Human
uaguuuacucugccuggauagaaaguugacca

SEQ ID NO: 490006 - RNA, 32 nt, Human
uaguuuagaaauuaugcugucacugccaaaca

SEQ ID NO: 490007 - RNA, 32 nt, Human
uaguuuagggaucucuggaaaugucaguuucc

SEQ ID NO: 490008 - RNA, 32 nt, Human
uaguuuauaagacaggagaaaagggagaaagc

SEQ ID NO: 490009 - RNA, 32 nt, Human
uaguuuaugguuaucaggaagcucuguaagaa

SEQ ID NO: 490010 - RNA, 32 nt, Human
uaguuucaccacccucaaaauccugugcuuca

SEQ ID NO: 490011 - RNA, 32 nt, Human
uaguuucagcuauucgggaggcugaggcagac

SEQ ID NO: 490012 - RNA, 32 nt, Human
uaguuucaucugagaacuucugauuagcucuc

SEQ ID NO: 490013 - RNA, 32 nt, Human
uaguuuccagauagggcuaauuacaaaauguu

SEQ ID NO: 490014 - RNA, 32 nt, Human
uaguuuccauuuucuuccacugauucucuuga

SEQ ID NO: 490015 - RNA, 32 nt, Human
uaguuuccucuccuccagcccagacccagugg

SEQ ID NO: 490016 - RNA, 32 nt, Human
uaguuuccucugaaauguaacuuuaaauaaac

SEQ ID NO: 490017 - RNA, 32 nt, Human
uaguuuccugcaggagccuacccugaaaucuc

SEQ ID NO: 490018 - RNA, 32 nt, Human
uaguuucuaaauucucagcagcaguugccucc

SEQ ID NO: 490019 - RNA, 32 nt, Human
uaguuucugggaauuggauuuauuucucuugu

SEQ ID NO: 490020 - RNA, 32 nt, Human
uaguuucuguacuuauuagaacuggguaaauu

SEQ ID NO: 490021 - RNA, 32 nt, Human
uaguuucugucucucaggcacucguaacuaag

SEQ ID NO: 490022 - RNA, 32 nt, Human
uaguuucuuccucugacauggggaccauaaca

SEQ ID NO: 490023 - RNA, 32 nt, Human
uaguuucuuccucuguaaaauagggagaagaa

SEQ ID NO: 490024 - RNA, 32 nt, Human
uaguuugaagugagggaagaaugaguagucag

SEQ ID NO: 490025 - RNA, 32 nt, Human
uaguuugacagcucauuuugaagauuacauua

SEQ ID NO: 490026 - RNA, 32 nt, Human
uaguuugaccucacagugccccuucccaauca

SEQ ID NO: 490027 - RNA, 32 nt, Human
uaguuugcuaagaguuuucuguuucuuuuucu

SEQ ID NO: 490028 - RNA, 32 nt, Human
uaguuugcucuccugccccucuccuuaaaacu

SEQ ID NO: 490029 - RNA, 32 nt, Human
uaguuugcugauuuccuaaaugcuacccuuug

SEQ ID NO: 490030 - RNA, 32 nt, Human
uaguuugcuguggccuucccgguugugagagc

SEQ ID NO: 490031 - RNA, 32 nt, Human
uaguuugcuguugcauguuaaccugacuuuug

SEQ ID NO: 490032 - RNA, 32 nt, Human
uaguuuggaaacaucacucuguuguaagcuga

SEQ ID NO: 490033 - RNA, 32 nt, Human
uaguuugggaggccaaggcgggcagaucaccu

SEQ ID NO: 490034 - RNA, 32 nt, Human
uaguuuguacauaaacauugugaaaaucugau

SEQ ID NO: 490035 - RNA, 32 nt, Human
uaguuugucauccugugaaaaccaccucguuu

SEQ ID NO: 490036 - RNA, 32 nt, Human
uaguuugucuuguuuugcuuuccagagaucuu

SEQ ID NO: 490037 - RNA, 32 nt, Human
uaguuugugcuaggaaguauguaggauccaaa

SEQ ID NO: 490038 - RNA, 32 nt, Human
uaguuuguguacaaauguaauuauguucauug

SEQ ID NO: 490039 - RNA, 32 nt, Human
uaguuuguuuaguuaaggugugcaguguuuuu

SEQ ID NO: 490040 - RNA, 32 nt, Human
uaguuuguuuuuaaaaaguuuucucuguagaa

SEQ ID NO: 490041 - RNA, 32 nt, Human
uaguuuuaaaagucuaugaucugaucuggacu

SEQ ID NO: 490042 - RNA, 32 nt, Human
uaguuuuacugauuaggacuuuuauugugaau

SEQ ID NO: 490043 - RNA, 32 nt, Human
uaguuuuagggaaaaagaaugucugccuagac

SEQ ID NO: 490044 - RNA, 32 nt, Human
uaguuuuauucuuuuucccuugcccccaaagc

SEQ ID NO: 490045 - RNA, 32 nt, Human
uaguuuuauuuuuguaaagguauguaaguuau

SEQ ID NO: 490046 - RNA, 32 nt, Human
uaguuuucacauuuuaauuccuccuccugaga

SEQ ID NO: 490047 - RNA, 32 nt, Human
uaguuuucagcucauuuaaaagaggcaaaaau

SEQ ID NO: 490048 - RNA, 32 nt, Human
uaguuuucauagguacaaaaguggugaaaugg

SEQ ID NO: 490049 - RNA, 32 nt, Human
uaguuuuccaacucaugucuggcuccggcguu

SEQ ID NO: 490050 - RNA, 21 nt, Human
uaguuuucuagaucuuuuaca

SEQ ID NO: 490051 - RNA, 32 nt, Human
uaguuuucugaagugggugagggagacgcuuc

SEQ ID NO: 490052 - RNA, 32 nt, Human
uaguuuucugcagcucuaccuggccugcuuac

SEQ ID NO: 490053 - RNA, 32 nt, Human
uaguuuucuuuuaaggugacccaucugugaua

SEQ ID NO: 490054 - RNA, 18 nt, Human
uaguuuugauguuuuaua

SEQ ID NO: 490055 - RNA, 32 nt, Human
uaguuuugccaaagccucuccacucaccagca

SEQ ID NO: 490056 - RNA, 17 nt, Human
uaguuuugccuuucaca

SEQ ID NO: 490057 - RNA, 32 nt, Human
uaguuuugggaggggauggcagacagucaagg

SEQ ID NO: 490058 - RNA, 32 nt, Human
uaguuuugggucauuuaaagggacuugaggaa

SEQ ID NO: 490059 - RNA, 18 nt, Human
uaguuuuggugucccaca

SEQ ID NO: 490060 - RNA, 19 nt, Human
uaguuuuguauuuucuaua

SEQ ID NO: 490061 - RNA, 18 nt, Human
uaguuuuguuucugcaca

SEQ ID NO: 490062 - RNA, 32 nt, Human
uaguuuuuauguuugacagugguacaaaugac

SEQ ID NO: 490063 - RNA, 32 nt, Human
uaguuuuucaauccucacccuccuucuaaccc

SEQ ID NO: 490064 - RNA, 32 nt, Human
uaguuuuucuugugauacauuuuguuaaccug

SEQ ID NO: 490065 - RNA, 32 nt, Human
uaguuuuugguacaggucuuucaaguccuugg

SEQ ID NO: 490066 - RNA, 32 nt, Human
uauaaaaacauguugcuuuuaaaauguggagu

SEQ ID NO: 490067 - RNA, 32 nt, Human
uauaaaaaccaauuuccugauggacuauuaaa

SEQ ID NO: 490068 - RNA, 32 nt, Human
uauaaaaaccacacucagucuuuguucaaugg

SEQ ID NO: 490069 - RNA, 32 nt, Human
uauaaaaaccaccacccuccagccugggcaac

SEQ ID NO: 490070 - RNA, 32 nt, Human
uauaaaaacuccagaggauaaguuuacacuua

SEQ ID NO: 490071 - RNA, 32 nt, Human
uauaaaaacuuagcugggugugguggcaugug

SEQ ID NO: 490072 - RNA, 32 nt, Human
uauaaaaacuuuagguucuaaaaaccuguaca

SEQ ID NO: 490073 - RNA, 32 nt, Human
uauaaaaagagugucauauuccagcauuugaa

SEQ ID NO: 490074 - RNA, 32 nt, Human
uauaaaaagcagccaaagcucaggggaaauuu

SEQ ID NO: 490075 - RNA, 32 nt, Human
uauaaaaagcagcgaaagcucaggggaaauuu

SEQ ID NO: 490076 - RNA, 32 nt, Human
uauaaaaauacugggaaaaauugauaaauaac

SEQ ID NO: 490077 - RNA, 32 nt, Human
uauaaaaauagaauagagaguuaggaucagaa

SEQ ID NO: 490078 - RNA, 32 nt, Human
uauaaaaaucagcucuuggaauauauguugca

SEQ ID NO: 490079 - RNA, 32 nt, Human
uauaaaaauguccuugaguuuggagccugagc

SEQ ID NO: 490080 - RNA, 32 nt, Human
uauaaaaauuaaaguuaugcacuacuaacauu

SEQ ID NO: 490081 - RNA, 32 nt, Human
uauaaaaauuguaaaacuacuacuuuguuuua

SEQ ID NO: 490082 - RNA, 32 nt, Human
uauaaaacauccuucucuuauucuccauacug

SEQ ID NO: 490083 - RNA, 32 nt, Human
uauaaaagaauauacaucacaauauaauauuu

SEQ ID NO: 490084 - RNA, 32 nt, Human
uauaaaagagaccccagaguucucccaagccc

SEQ ID NO: 490085 - RNA, 32 nt, Human
uauaaaagagccuauucaauagcucagagguu

SEQ ID NO: 490086 - RNA, 32 nt, Human
uauaaaaggagagcagggaaaggagccaguga

SEQ ID NO: 490087 - RNA, 32 nt, Human
uauaaaaggaugacgccugccaauugcauugc

SEQ ID NO: 490088 - RNA, 32 nt, Human
uauaaaagggaucauccaguggaguuguaaac

SEQ ID NO: 490089 - RNA, 32 nt, Human
uauaaaaguaaauaugggagcaguugucccag

SEQ ID NO: 490090 - RNA, 32 nt, Human
uauaaaauaaggguguguaacauaucaagaua

SEQ ID NO: 490091 - RNA, 23 nt, Human
uauaaaauagauuuucaugggaa

SEQ ID NO: 490092 - RNA, 32 nt, Human
uauaaaauauauuggcuuuuguuuucaaugug

SEQ ID NO: 490093 - RNA, 32 nt, Human
uauaaaaucaacacuaaugauaaaugaaguau

SEQ ID NO: 490094 - RNA, 32 nt, Human
uauaaaaucugaauuuuagggguuugucccca

SEQ ID NO: 490095 - RNA, 32 nt, Human
uauaaaaugaugguauucuaagguccauccuu

SEQ ID NO: 490096 - RNA, 32 nt, Human
uauaaaauguacuaauuagcuuuaaacacuaa

SEQ ID NO: 490097 - RNA, 31 nt, Human
uauaaaaugucucacuucaugguuuuauuac

SEQ ID NO: 490098 - RNA, 32 nt, Human
uauaaaauuauuccgauauccauguuuaagaa

SEQ ID NO: 490099 - RNA, 32 nt, Human
uauaaaauuugaaaauggagaaaggauggaaa

SEQ ID NO: 490100 - RNA, 32 nt, Human
uauaaacaaggcaauuagaaaaauaauuaaag

SEQ ID NO: 490101 - RNA, 32 nt, Human
uauaaacacgaggcugcacacugugugggaaa

SEQ ID NO: 490102 - RNA, 32 nt, Human
uauaaacaucucccugucauccuuuuucaccc

SEQ ID NO: 490103 - RNA, 32 nt, Human
uauaaacaucuucaguaacuugccaggcucua

SEQ ID NO: 490104 - RNA, 32 nt, Human
uauaaaccaaagcagagggcacuggagccccg

SEQ ID NO: 490105 - RNA, 32 nt, Human
uauaaaccagauguagcaguuucuugacaugg

SEQ ID NO: 490106 - RNA, 32 nt, Human
uauaaaccggggaacagugguuacucacaagg

SEQ ID NO: 490107 - RNA, 32 nt, Human
uauaaaccugcagggucacucaucuaaagucu

SEQ ID NO: 490108 - RNA, 22 nt, Human
uauaaacgcauauacauacaua

SEQ ID NO: 490109 - RNA, 32 nt, Human
uauaaacugccucuucauguugccugcucaag

SEQ ID NO: 490110 - RNA, 32 nt, Human
uauaaacugcucuugcaguccaaagggauacc

SEQ ID NO: 490111 - RNA, 32 nt, Human
uauaaagaaagccagagggacagagggaguga

SEQ ID NO: 490112 - RNA, 32 nt, Human
uauaaagaaauucuguuuuuagucaagugacu

SEQ ID NO: 490113 - RNA, 32 nt, Human
uauaaagaaccugccuuccuuccuucaugguc

SEQ ID NO: 490114 - RNA, 32 nt, Human
uauaaagaauagacuugcuugggugguaguac

SEQ ID NO: 490115 - RNA, 32 nt, Human
uauaaagacacaugcacacauauguuuauuac

SEQ ID NO: 490116 - RNA, 32 nt, Human
uauaaagcaaacauaucuguaaacuucaagga

SEQ ID NO: 490117 - RNA, 32 nt, Human
uauaaagcaaagcacucacaauaugccugaca

SEQ ID NO: 490118 - RNA, 32 nt, Human
uauaaagcaguuagaccaguaccugacaauau

SEQ ID NO: 490119 - RNA, 32 nt, Human
uauaaagcaguuuccagguagucucaaugaca

SEQ ID NO: 490120 - RNA, 32 nt, Human
uauaaagcaguuuugcacauaaaauaccauca

SEQ ID NO: 490121 - RNA, 32 nt, Human
uauaaagccauauagaauaaaaauguuaauuu

SEQ ID NO: 490122 - RNA, 32 nt, Human
uauaaagccuuucaaacuuccaucaauccuaa

SEQ ID NO: 490123 - RNA, 32 nt, Human
uauaaagcuuaccucauggagcuguuaacaua

SEQ ID NO: 490124 - RNA, 32 nt, Human
uauaaaggagagaagcgggcggaccggacggc

SEQ ID NO: 490125 - RNA, 32 nt, Human
uauaaaggagcacacugucgcacuacauuguc

SEQ ID NO: 490126 - RNA, 32 nt, Human
uauaaaggccagcauuuuucugaaaaguuggg

SEQ ID NO: 490127 - RNA, 32 nt, Human
uauaaagggugaggacuggcugugcauccugc

SEQ ID NO: 490128 - RNA, 32 nt, Human
uauaaaggguuauuuucucaugaguggaaacc

SEQ ID NO: 490129 - RNA, 32 nt, Human
uauaaaguagccucgcaucuguuucucaaccu

SEQ ID NO: 490130 - RNA, 32 nt, Human
uauaaaguauuuuuauaaugacuggucuuccu

SEQ ID NO: 490131 - RNA, 32 nt, Human
uauaaagugcucugaauaaagcagaaauauau

SEQ ID NO: 490132 - RNA, 32 nt, Human
uauaaaguugaauauaagugguaaaagagcug

SEQ ID NO: 490133 - RNA, 32 nt, Human
uauaaauacaugcacacacuugcauacauaua

SEQ ID NO: 490134 - RNA, 32 nt, Human
uauaaauaccugcacugucucugaggacuuac

SEQ ID NO: 490135 - RNA, 32 nt, Human
uauaaauagccaacacucagugaacaaaaucc

SEQ ID NO: 490136 - RNA, 32 nt, Human
uauaaauaggagaggaugagagcccagaggua

SEQ ID NO: 490137 - RNA, 32 nt, Human
uauaaauauaaauauauucuuuacuuuuugua

SEQ ID NO: 490138 - RNA, 32 nt, Human
uauaaauauauguauauguaugguuguaaaua

SEQ ID NO: 490139 - RNA, 32 nt, Human
uauaaauaucagcuuguucauccaagccacug

SEQ ID NO: 490140 - RNA, 32 nt, Human
uauaaauaucggcugcagccaucccccucauu

SEQ ID NO: 490141 - RNA, 31 nt, Human
uauaaaucaauaaagguuggaaacagagaag

SEQ ID NO: 490142 - RNA, 32 nt, Human
uauaaaucaaugaugggucagaggaaaacaga

SEQ ID NO: 490143 - RNA, 32 nt, Human
uauaaaucaguuauuucuaucuagugaaaugg

SEQ ID NO: 490144 - RNA, 32 nt, Human
uauaaauccauucaguggguuguauaacauuu

SEQ ID NO: 490145 - RNA, 32 nt, Human
uauaaauccuacuagaguaaaaauuaggugug

SEQ ID NO: 490146 - RNA, 32 nt, Human
uauaaaugaaaccauaugguguguacuuuuua

SEQ ID NO: 490147 - RNA, 32 nt, Human
uauaaaugcuacagcugugagagcuuguuucu

SEQ ID NO: 490148 - RNA, 31 nt, Human
uauaaaugcugaguaugucuguugaagacga

SEQ ID NO: 490149 - RNA, 32 nt, Human
uauaaauggugcuucucauuuucugauaauuu

SEQ ID NO: 490150 - RNA, 32 nt, Human
uauaaaugucugacagugcagugcaaacagaa

SEQ ID NO: 490151 - RNA, 32 nt, Human
uauaaaugugcagaaagauuccaaaggagaau

SEQ ID NO: 490152 - RNA, 32 nt, Human
uauaaaugugcuaauuauuugagacuuccuca

SEQ ID NO: 490153 - RNA, 32 nt, Human
uauaaauguguauguguccuuguaaauguuuc

SEQ ID NO: 490154 - RNA, 32 nt, Human
uauaaauguuuggaaagguucuaaggggaccu

SEQ ID NO: 490155 - RNA, 21 nt, Human
uauaaauuacccagguucugu

SEQ ID NO: 490156 - RNA, 32 nt, Human
uauaaauucuccuggcucuccugggcuuccau

SEQ ID NO: 490157 - RNA, 32 nt, Human
uauaaauugugggaaaugagugagggcaaggu

SEQ ID NO: 490158 - RNA, 32 nt, Human
uauaaauuuugugaaugcauuuuccugguguu

SEQ ID NO: 490159 - RNA, 32 nt, Human
uauaacaaaugucacugucuuaagggacagug

SEQ ID NO: 490160 - RNA, 32 nt, Human
uauaacaagcagaugauguuguccuaagaauu

SEQ ID NO: 490161 - RNA, 32 nt, Human
uauaacacuaugcauuaaaagcacuuuuugua

SEQ ID NO: 490162 - RNA, 32 nt, Human
uauaacacucacugcgaaggucuguggcuuca

SEQ ID NO: 490163 - RNA, 32 nt, Human
uauaacacuguaauuguggugugcaaacagcu

SEQ ID NO: 490164 - RNA, 32 nt, Human
uauaacacuugcagacagagaaacugaggucu

SEQ ID NO: 490165 - RNA, 24 nt, Human
uauaacagaaaguuuauguggaaa

SEQ ID NO: 490166 - RNA, 22 nt, Human
uauaacagagcacuaauggaaa

SEQ ID NO: 490167 - RNA, 32 nt, Human
uauaacaugaacauaagugcuuagcugccaug

SEQ ID NO: 490168 - RNA, 32 nt, Human
uauaacaugcccacccuuccuccuuuagaaac

SEQ ID NO: 490169 - RNA, 32 nt, Human
uauaaccaaagaggaagagcaaaaggcagacc

SEQ ID NO: 490170 - RNA, 32 nt, Human
uauaaccaaaguuugagaacugggaacuucau

SEQ ID NO: 490171 - RNA, 32 nt, Human
uauaaccaagaauuuuaauuuauucaucuugc

SEQ ID NO: 490172 - RNA, 27 nt, Human
uauaaccagauuuuuaaagcacuaggu

SEQ ID NO: 490173 - RNA, 32 nt, Human
uauaaccaguuccuuuaagcagucuuuuuacc

SEQ ID NO: 490174 - RNA, 32 nt, Human
uauaacccagaaacaaaucucaaaguguacaa

SEQ ID NO: 490175 - RNA, 32 nt, Human
uauaaccuauaaauuuguuucuuccaagcuua

SEQ ID NO: 490176 - RNA, 32 nt, Human
uauaaccuguuuccagccuggccugaggugga

SEQ ID NO: 490177 - RNA, 32 nt, Human
uauaaccuuuauuauugcuauaucuuugugga

SEQ ID NO: 490178 - RNA, 32 nt, Human
uauaacgaaauuuugaauaaacuugaauuccu

SEQ ID NO: 490179 - RNA, 32 nt, Human
uauaacgugagggcugaaugcagcccauucuc

SEQ ID NO: 490180 - RNA, 32 nt, Human
uauaacuacuaaaaauaucauagggaggauaa

SEQ ID NO: 490181 - RNA, 32 nt, Human
uauaacuaguacucaagguuuaaccuuaaaau

SEQ ID NO: 490182 - RNA, 32 nt, Human
uauaacucagggacuguggcucguggcggugc

SEQ ID NO: 490183 - RNA, 32 nt, Human
uauaacucauaagauuuaggcauaaucugguu

SEQ ID NO: 490184 - RNA, 32 nt, Human
uauaacuccauggcucugcagcaagacucgaa

SEQ ID NO: 490185 - RNA, 32 nt, Human
uauaacuccuaaagcuucucugcuccaguuau

SEQ ID NO: 490186 - RNA, 32 nt, Human
uauaacugcaguuauuuuugcaugguaagagu

SEQ ID NO: 490187 - RNA, 32 nt, Human
uauaacuguccagcucugugcaucagaggagg

SEQ ID NO: 490188 - RNA, 32 nt, Human
uauaacuguguacuuuugaugacuguacagcu

SEQ ID NO: 490189 - RNA, 32 nt, Human
uauaacuuccaggacaaugcagauugauguug

SEQ ID NO: 490190 - RNA, 32 nt, Human
uauaacuuccccuuaauuuaaauuuaauaaac

SEQ ID NO: 490191 - RNA, 32 nt, Human
uauaacuugcauuacauguuguaagcaugguc

SEQ ID NO: 490192 - RNA, 32 nt, Human
uauaagaaaugcaagaggauauugauaggugu

SEQ ID NO: 490193 - RNA, 32 nt, Human
uauaagaaauuagcagggcaugguggcacaug

SEQ ID NO: 490194 - RNA, 32 nt, Human
uauaagaaauuagccggacaugguggcgaaug

SEQ ID NO: 490195 - RNA, 32 nt, Human
uauaagaacucaugugauuaaguucacaguuu

SEQ ID NO: 490196 - RNA, 32 nt, Human
uauaagaagcuuucauauuagugaugucaucu

SEQ ID NO: 490197 - RNA, 32 nt, Human
uauaagaaggcaagagacaaggugcuucaaau

SEQ ID NO: 490198 - RNA, 32 nt, Human
uauaagaauacugagaaaccaccacaaaaauu

SEQ ID NO: 490199 - RNA, 32 nt, Human
uauaagaccuuaaggcugggugcaguggcuca

SEQ ID NO: 490200 - RNA, 32 nt, Human
uauaagacucacugaagaacuuuccuccuuag

SEQ ID NO: 490201 - RNA, 22 nt, Human
uauaagacugaagugcugguua

SEQ ID NO: 490202 - RNA, 32 nt, Human
uauaagacugaggagggugccugugggaacag

SEQ ID NO: 490203 - RNA, 32 nt, Human
uauaagagcaagaaaucuacagcugguguaaa

SEQ ID NO: 490204 - RNA, 32 nt, Human
uauaagagcagccugggcaaaauagugagaca

SEQ ID NO: 490205 - RNA, 32 nt, Human
uauaagagcauuuauguucugaaggaauuuuu

SEQ ID NO: 490206 - RNA, 32 nt, Human
uauaagaggcagcgugaaagcagaugagcugu

SEQ ID NO: 490207 - RNA, 32 nt, Human
uauaagagucagcauggagagccccugcuaau

SEQ ID NO: 490208 - RNA, 32 nt, Human
uauaagagugccucuuucauaaaaccaaaugc

SEQ ID NO: 490209 - RNA, 32 nt, Human
uauaagaucuuucugugacagguaacaaauuu

SEQ ID NO: 490210 - RNA, 32 nt, Human
uauaagauguccuucuuagugugaaagaaggg

SEQ ID NO: 490211 - RNA, 32 nt, Human
uauaagauucauucucuuucauugcucugcua

SEQ ID NO: 490212 - RNA, 32 nt, Human
uauaagcaaugccauccauauaccauauuuua

SEQ ID NO: 490213 - RNA, 32 nt, Human
uauaagcacugcaaucaauaccucacaaagcg

SEQ ID NO: 490214 - RNA, 32 nt, Human
uauaagcauaugugauaaggcaaugcaaccuc

SEQ ID NO: 490215 - RNA, 32 nt, Human
uauaagcauuuaaagugcugaagaggauuuau

SEQ ID NO: 490216 - RNA, 32 nt, Human
uauaagccagcaacaggaacuuuugugaagac

SEQ ID NO: 490217 - RNA, 32 nt, Human
uauaagccuuaaauccauuagauugcauggua

SEQ ID NO: 490218 - RNA, 32 nt, Human
uauaagcgugagccaccaugccuggccccaau

SEQ ID NO: 490219 - RNA, 32 nt, Human
uauaagcucacacuucauggagcacugacagc

SEQ ID NO: 490220 - RNA, 32 nt, Human
uauaagcucuccucaaagcucaggaaaccugg

SEQ ID NO: 490221 - RNA, 32 nt, Human
uauaaggaugaucagagacuuuugccagcuac

SEQ ID NO: 490222 - RNA, 32 nt, Human
uauaaggcaaaaagaucuguauuuacacuccu

SEQ ID NO: 490223 - RNA, 32 nt, Human
uauaaggcucaaauagucuauaccugaacugc

SEQ ID NO: 490224 - RNA, 32 nt, Human
uauaaggugcucucuuucugucuucuacagau

SEQ ID NO: 490225 - RNA, 32 nt, Human
uauaaguaccuacaaaugcaaagaaaaauacu

SEQ ID NO: 490226 - RNA, 32 nt, Human
uauaaguacugccugugagaauuugcacuuua

SEQ ID NO: 490227 - RNA, 32 nt, Human
uauaagucacauaggaaacuugaaaggucuga

SEQ ID NO: 490228 - RNA, 32 nt, Human
uauaagucucuuccuuucucaaauaaaguuuu

SEQ ID NO: 490229 - RNA, 32 nt, Human
uauaagucugugugucagguacagcugggccc

SEQ ID NO: 490230 - RNA, 32 nt, Human
uauaagugcuuaauaaauauuugcugaauguu

SEQ ID NO: 490231 - RNA, 32 nt, Human
uauaaguggagagagugcuacaucagagagug

SEQ ID NO: 490232 - RNA, 32 nt, Human
uauaagugugagccacugcaucuggcccucua

SEQ ID NO: 490233 - RNA, 32 nt, Human
uauaagugugauuuuaaaaauguggauuaaac

SEQ ID NO: 490234 - RNA, 32 nt, Human
uauaaguguuuauauuaaugaucuugcauuug

SEQ ID NO: 490235 - RNA, 32 nt, Human
uauaaguuacuuuuaacaaccccucuuacuuu

SEQ ID NO: 490236 - RNA, 32 nt, Human
uauaaguuccucacacccuaucucuaugacuu

SEQ ID NO: 490237 - RNA, 32 nt, Human
uauaauaaacccucagcacuugcucaguaguu

SEQ ID NO: 490238 - RNA, 32 nt, Human
uauaauaauuuccaagcgguagauuauguggc

SEQ ID NO: 490239 - RNA, 32 nt, Human
uauaauacaagaaauagugaugcucuguuuuc

SEQ ID NO: 490240 - RNA, 32 nt, Human
uauaauacguacaauccuucccucaucccauc

SEQ ID NO: 490241 - RNA, 20 nt, Human
uauaauacuauuuccuauaa

SEQ ID NO: 490242 - RNA, 32 nt, Human
uauaauagaguuuccagucauuguuagacaac

SEQ ID NO: 490243 - RNA, 32 nt, Human
uauaauagcacuggaggagacugugguagcca

SEQ ID NO: 490244 - RNA, 32 nt, Human
uauaauaggcagggugugcucuagccuagcgg

SEQ ID NO: 490245 - RNA, 32 nt, Human
uauaauagucuccacucuccccaaaauauugu

SEQ ID NO: 490246 - RNA, 32 nt, Human
uauaauaugcagcugcaaaaugccagcaagaa

SEQ ID NO: 490247 - RNA, 20 nt, Human
uauaauauguuacacucuua

SEQ ID NO: 490248 - RNA, 19 nt, Human
uauaauauguuuaucuaua

SEQ ID NO: 490249 - RNA, 32 nt, Human
uauaaucaaauuugacuuccuagccuguggau

SEQ ID NO: 490250 - RNA, 32 nt, Human
uauaaucacagacccuccaccccacauagugg

SEQ ID NO: 490251 - RNA, 32 nt, Human
uauaaucacgccacugcacuccagccugggcu

SEQ ID NO: 490252 - RNA, 32 nt, Human
uauaaucauucuauuugcuuuauuaucggugc

SEQ ID NO: 490253 - RNA, 32 nt, Human
uauaauccuuagugaagacaguguccucuaac

SEQ ID NO: 490254 - RNA, 32 nt, Human
uauaaucgaauauucaacaccaugaagauaaa

SEQ ID NO: 490255 - RNA, 32 nt, Human
uauaaucgacuuuuguuuguguucugugacuu

SEQ ID NO: 490256 - RNA, 32 nt, Human
uauaaucgccacccuccacccuucuccccagc

SEQ ID NO: 490257 - RNA, 32 nt, Human
uauaaucgcgccacucacuacacuucagcuug

SEQ ID NO: 490258 - RNA, 32 nt, Human
uauaaucggauauuuauuucugugucuacagu

SEQ ID NO: 490259 - RNA, 32 nt, Human
uauaaucgucagccucuucaauggcguaggaa

SEQ ID NO: 490260 - RNA, 32 nt, Human
uauaaucuccacccucacggaguugucaucac

SEQ ID NO: 490261 - RNA, 32 nt, Human
uauaaucuguaauuggacagcucucucgaaga

SEQ ID NO: 490262 - RNA, 32 nt, Human
uauaaucuuaaauuauucagcauaugugcaac

SEQ ID NO: 490263 - RNA, 32 nt, Human
uauaaugcaaauguaacuuauguuuucauuuu

SEQ ID NO: 490264 - RNA, 32 nt, Human
uauaaugcagagcaugugaagggagaccggcu

SEQ ID NO: 490265 - RNA, 32 nt, Human
uauaaugcuucccagaauugucugacugaaca

SEQ ID NO: 490266 - RNA, 32 nt, Human
uauaauggaagaggcuuucucucuccaauaaa

SEQ ID NO: 490267 - RNA, 32 nt, Human
uauaauggcaccacuguacuccacuugggcga

SEQ ID NO: 490268 - RNA, 32 nt, Human
uauaaugggacuuuucuuucugcauccaccuu

SEQ ID NO: 490269 - RNA, 32 nt, Human
uauaaugggggagauguaugacugggaacugc

SEQ ID NO: 490270 - RNA, 21 nt, Human
uauaaugguaccccccaguaa

SEQ ID NO: 490271 - RNA, 31 nt, Human
uauaauggugcgaucucagcucaccgcaauc

SEQ ID NO: 490272 - RNA, 32 nt, Human
uauaauggugcuuuuaugguuauuaaaaauug

SEQ ID NO: 490273 - RNA, 32 nt, Human
uauaauguaaaaagaucuacauacaaacaaug

SEQ ID NO: 490274 - RNA, 32 nt, Human
uauaaugucccucaaguuuauggcaguguacc

SEQ ID NO: 490275 - RNA, 32 nt, Human
uauaauguguuaggaaauuacagucauuucua

SEQ ID NO: 490276 - RNA, 32 nt, Human
uauaauuaaaugaucuguucuucuacuucacu

SEQ ID NO: 490277 - RNA, 32 nt, Human
uauaauuaauauaacauuucuggacuugaacu

SEQ ID NO: 490278 - RNA, 32 nt, Human
uauaauuauucggccgggcaugguggcucaca

SEQ ID NO: 490279 - RNA, 32 nt, Human
uauaauucagugcuuggcagguuaguauauuu

SEQ ID NO: 490280 - RNA, 32 nt, Human
uauaauuccaguuagaaggcagaaucuagcaa

SEQ ID NO: 490281 - RNA, 32 nt, Human
uauaauucuguguccccucugcaugcccuuaa

SEQ ID NO: 490282 - RNA, 32 nt, Human
uauaauugcaucauugcacuccagccugggca

SEQ ID NO: 490283 - RNA, 32 nt, Human
uauaauugcuggggugauuaugugguuaaggg

SEQ ID NO: 490284 - RNA, 25 nt, Human
uauaauuggagauuuuaccuggaga

SEQ ID NO: 490285 - RNA, 32 nt, Human
uauaauugucucugaguaacccuuuggaaugg

SEQ ID NO: 490286 - RNA, 32 nt, Human
uauaauuuccuggaagaccucgaugaaccaga

SEQ ID NO: 490287 - RNA, 32 nt, Human
uauaauuugaauuuuaugccucccgugguugg

SEQ ID NO: 490288 - RNA, 32 nt, Human
uauaauuuggaaaugugacugcauaccaauaa

SEQ ID NO: 490289 - RNA, 32 nt, Human
uauaauuugggugacuagaacaacuugaagau

SEQ ID NO: 490290 - RNA, 32 nt, Human
uauaauuuuccagaacuuaccucuguuuuaaa

SEQ ID NO: 490291 - RNA, 32 nt, Human
uauaauuuugauuuuaaauggucacccaugua

SEQ ID NO: 490292 - RNA, 32 nt, Human
uauacaaaagaauugugccucucccaagucca

SEQ ID NO: 490293 - RNA, 32 nt, Human
uauacaaaaucaggaauaacuuuguuuuuaua

SEQ ID NO: 490294 - RNA, 32 nt, Human
uauacaaaguauaucacaauuuuaagugagua

SEQ ID NO: 490295 - RNA, 32 nt, Human
uauacaaagugaagccacauugccaaacuugc

SEQ ID NO: 490296 - RNA, 32 nt, Human
uauacaagacuggauuaaaaagacuggauucu

SEQ ID NO: 490297 - RNA, 32 nt, Human
uauacaagcauuaaacuggagugcaguaaacc

SEQ ID NO: 490298 - RNA, 32 nt, Human
uauacaauaagaaaauugccccaaaguggaug

SEQ ID NO: 490299 - RNA, 24 nt, Human
uauacaauagaauguuuucuagca

SEQ ID NO: 490300 - RNA, 32 nt, Human
uauacaauaggcuggugacaccagaguucauu

SEQ ID NO: 490301 - RNA, 32 nt, Human
uauacaauggaauacuaugcagccauaaaaag

SEQ ID NO: 490302 - RNA, 32 nt, Human
uauacaauguuuguuaacuuuguauuuguauu

SEQ ID NO: 490303 - RNA, 26 nt, Human
uauacacaaacauguauaugugcaca

SEQ ID NO: 490304 - RNA, 32 nt, Human
uauacacaaagaaggaggaggaaaaggugaga

SEQ ID NO: 490305 - RNA, 32 nt, Human
uauacacaaauuaucaauccacugcaggacug

SEQ ID NO: 490306 - RNA, 24 nt, Human
uauacacacaaacacauauacaua

SEQ ID NO: 490307 - RNA, 20 nt, Human
uauacacacaauuauacaca

SEQ ID NO: 490308 - RNA, 24 nt, Human
uauacacacacagagauauauaca

SEQ ID NO: 490309 - RNA, 26 nt, Human
uauacacacacauacacucauacaua

SEQ ID NO: 490310 - RNA, 27 nt, Human
uauacacacacauacauauuuaauaca

SEQ ID NO: 490311 - RNA, 32 nt, Human
uauacacacacauacguauacacacacauaca

SEQ ID NO: 490312 - RNA, 22 nt, Human
uauacacacacauacucacaca

SEQ ID NO: 490313 - RNA, 24 nt, Human
uauacacacacauauguacauaua

SEQ ID NO: 490314 - RNA, 32 nt, Human
uauacacacacgcacacauauauguugcugca

SEQ ID NO: 490315 - RNA, 16 nt, Human
uauacacacagacaca

SEQ ID NO: 490316 - RNA, 26 nt, Human
uauacacacagacacaugcauauaca

SEQ ID NO: 490317 - RNA, 32 nt, Human
uauacacacagacaucuacacugacauacccc

SEQ ID NO: 490318 - RNA, 26 nt, Human
uauacacacagauacaaguguacaca

SEQ ID NO: 490319 - RNA, 21 nt, Human
uauacacacauacauggacau

SEQ ID NO: 490320 - RNA, 26 nt, Human
uauacacacauauauacguguguaua

SEQ ID NO: 490321 - RNA, 32 nt, Human
uauacacacaugcauacaugagccuccacaca

SEQ ID NO: 490322 - RNA, 32 nt, Human
uauacacacaugguguacacccacuuugauau

SEQ ID NO: 490323 - RNA, 24 nt, Human
uauacacacuaaguccaucuuaca

SEQ ID NO: 490324 - RNA, 16 nt, Human
uauacacagauacaca

SEQ ID NO: 490325 - RNA, 21 nt, Human
uauacacagauguguauacac

SEQ ID NO: 490326 - RNA, 32 nt, Human
uauacacaggcaggacaggaaguaggaccuaa

SEQ ID NO: 490327 - RNA, 24 nt, Human
uauacacauacauacacauacaua

SEQ ID NO: 490328 - RNA, 22 nt, Human
uauacacauacauauauacaca

SEQ ID NO: 490329 - RNA, 24 nt, Human
uauacacauacauauauauacaca

SEQ ID NO: 490330 - RNA, 24 nt, Human
uauacacauauauacacauacaca

SEQ ID NO: 490331 - RNA, 32 nt, Human
uauacacauauauacacauacacacauguaua

SEQ ID NO: 490332 - RNA, 24 nt, Human
uauacacauauauacauauauaua

SEQ ID NO: 490333 - RNA, 20 nt, Human
uauacacauauauauacaca

SEQ ID NO: 490334 - RNA, 22 nt, Human
uauacacauauauguauacaua

SEQ ID NO: 490335 - RNA, 32 nt, Human
uauacacauauguacaugaaaaugauguucau

SEQ ID NO: 490336 - RNA, 32 nt, Human
uauacacauauguguguaugcaguuugucagg

SEQ ID NO: 490337 - RNA, 32 nt, Human
uauacaccccugagugaggauuacaugcccau

SEQ ID NO: 490338 - RNA, 32 nt, Human
uauacaccuaguucuguaugaucauaucauag

SEQ ID NO: 490339 - RNA, 32 nt, Human
uauacaccuuguagaacucauuuugcuggcug

SEQ ID NO: 490340 - RNA, 20 nt, Human
uauacacguauauaugcaca

SEQ ID NO: 490341 - RNA, 32 nt, Human
uauacacuaagcuauuacaaugguacuuaaaa

SEQ ID NO: 490342 - RNA, 32 nt, Human
uauacacuguccuccuccaccuugauggaccc

SEQ ID NO: 490343 - RNA, 32 nt, Human
uauacacugucuucauauguauaauucucacu

SEQ ID NO: 490344 - RNA, 32 nt, Human
uauacagaaaauacaaaaauuagccagguaug

SEQ ID NO: 490345 - RNA, 23 nt, Human
uauacagacacauauguauacac

SEQ ID NO: 490346 - RNA, 32 nt, Human
uauacagacagaaaguagauuauacauugccu

SEQ ID NO: 490347 - RNA, 32 nt, Human
uauacagacagugcauccagaggaaggcaccu

SEQ ID NO: 490348 - RNA, 24 nt, Human
uauacagacauauacacauacaua

SEQ ID NO: 490349 - RNA, 32 nt, Human
uauacagaccuccagauuauuuucuauauuug

SEQ ID NO: 490350 - RNA, 32 nt, Human
uauacagauggguuuucauuuuccugaugcug

SEQ ID NO: 490351 - RNA, 32 nt, Human
uauacagcacauggaagaaguaccaagaggcg

SEQ ID NO: 490352 - RNA, 32 nt, Human
uauacagccagaacagccaagccucaauucuu

SEQ ID NO: 490353 - RNA, 32 nt, Human
uauacagccugcagagagugcguggcaauccu

SEQ ID NO: 490354 - RNA, 24 nt, Human
uauacagcucagcuuuuugucuuu

SEQ ID NO: 490355 - RNA, 32 nt, Human
uauacagcugcuucugcuauugcugguuuggg

SEQ ID NO: 490356 - RNA, 32 nt, Human
uauacagcuucugucucaauagggucagauau

SEQ ID NO: 490357 - RNA, 32 nt, Human
uauacaggagccaagcagcccagggugggucg

SEQ ID NO: 490358 - RNA, 32 nt, Human
uauacagggaaaggaauaugaagccuugacaa

SEQ ID NO: 490359 - RNA, 32 nt, Human
uauacagggaccaaagacugaaugcucagccu

SEQ ID NO: 490360 - RNA, 32 nt, Human
uauacaguguggugaagguugacugagaaguc

SEQ ID NO: 490361 - RNA, 32 nt, Human
uauacaguucuaugcagaacagugagccaaau

SEQ ID NO: 490362 - RNA, 21 nt, Human
uauacaguuuuggguguucuu

SEQ ID NO: 490363 - RNA, 32 nt, Human
uauacauaaaaauuaaguucugagugaguucu

SEQ ID NO: 490364 - RNA, 32 nt, Human
uauacauaaagugacuggaauuuuaacaggug

SEQ ID NO: 490365 - RNA, 24 nt, Human
uauacauacauacacacauacaua

SEQ ID NO: 490366 - RNA, 32 nt, Human
uauacauacauacacacauacauacauaugca

SEQ ID NO: 490367 - RNA, 22 nt, Human
uauacauacauacacauacaca

SEQ ID NO: 490368 - RNA, 32 nt, Human
uauacauacauauauguguauguauguguucc

SEQ ID NO: 490369 - RNA, 18 nt, Human
uauacauacaugcauaca

SEQ ID NO: 490370 - RNA, 32 nt, Human
uauacauacgugcacacacacauacauauuca

SEQ ID NO: 490371 - RNA, 32 nt, Human
uauacauaggagcuggggauucuacaguaucu

SEQ ID NO: 490372 - RNA, 32 nt, Human
uauacauauacacauacacauauauguauaca

SEQ ID NO: 490373 - RNA, 21 nt, Human
uauacauauaguguauauaca

SEQ ID NO: 490374 - RNA, 19 nt, Human
uauacauauauaauacaca

SEQ ID NO: 490375 - RNA, 23 nt, Human
uauacauauauaauauauacaca

SEQ ID NO: 490376 - RNA, 24 nt, Human
uauacauauauacacauauauaca

SEQ ID NO: 490377 - RNA, 20 nt, Human
uauacauauauacauacaca

SEQ ID NO: 490378 - RNA, 24 nt, Human
uauacauauauacauauauccaca

SEQ ID NO: 490379 - RNA, 22 nt, Human
uauacauauauauuuauacaca

SEQ ID NO: 490380 - RNA, 20 nt, Human
uauacauauauguauauaca

SEQ ID NO: 490381 - RNA, 32 nt, Human
uauacauauccacacacauacauuacauauau

SEQ ID NO: 490382 - RNA, 24 nt, Human
uauacauaugccauauguauaaca

SEQ ID NO: 490383 - RNA, 32 nt, Human
uauacaucugcuucuaacauaucgcauguuua

SEQ ID NO: 490384 - RNA, 32 nt, Human
uauacaucuuagagucuagggcagcaguccau

SEQ ID NO: 490385 - RNA, 22 nt, Human
uauacaugcacauacauacaca

SEQ ID NO: 490386 - RNA, 32 nt, Human
uauacaugcaugcacaugugcucguacaaugg

SEQ ID NO: 490387 - RNA, 24 nt, Human
uauacauguauauacauauauaca

SEQ ID NO: 490388 - RNA, 32 nt, Human
uauacauguauguauauacagaugugugugua

SEQ ID NO: 490389 - RNA, 32 nt, Human
uauacaugugagccaccgugccuggccuugag

SEQ ID NO: 490390 - RNA, 32 nt, Human
uauacauguguauaauuaggguauguauuaug

SEQ ID NO: 490391 - RNA, 23 nt, Human
uauacauguguauauaagacagu

SEQ ID NO: 490392 - RNA, 32 nt, Human
uauacauugaaggaagaaaagaaggaagcagu

SEQ ID NO: 490393 - RNA, 32 nt, Human
uauacauuggaaucauccaguguuagagcauu

SEQ ID NO: 490394 - RNA, 32 nt, Human
uauacauuuaaauucauauauguaauguuugu

SEQ ID NO: 490395 - RNA, 32 nt, Human
uauacauuucacacauucuuuugcaaguuuua

SEQ ID NO: 490396 - RNA, 32 nt, Human
uauacauuuuuguaugagaaaggugauuggua

SEQ ID NO: 490397 - RNA, 32 nt, Human
uauaccaaaaggaauucugucaagaugacugc

SEQ ID NO: 490398 - RNA, 21 nt, Human
uauaccaaaggugcuugccaa

SEQ ID NO: 490399 - RNA, 19 nt, Human
uauaccaacacaucuucaa

SEQ ID NO: 490400 - RNA, 32 nt, Human
uauaccaacauggaagacauuugucucuauua

SEQ ID NO: 490401 - RNA, 32 nt, Human
uauaccaacuauucagaggaacucauacuuca

SEQ ID NO: 490402 - RNA, 32 nt, Human
uauaccaagagauucuucuagaucucauugau

SEQ ID NO: 490403 - RNA, 32 nt, Human
uauaccaaguguuccaugauaccauuugugag

SEQ ID NO: 490404 - RNA, 32 nt, Human
uauaccacaaaugauucaugcaaaugaauuuu

SEQ ID NO: 490405 - RNA, 32 nt, Human
uauaccacaggccuuccugggucuccagcuua

SEQ ID NO: 490406 - RNA, 32 nt, Human
uauaccacugcacuccagccugggugacagag

SEQ ID NO: 490407 - RNA, 32 nt, Human
uauaccacuguacccacccagaaucaaagcca

SEQ ID NO: 490408 - RNA, 32 nt, Human
uauaccacuuuauuuggugugcuguguuaguc

SEQ ID NO: 490409 - RNA, 32 nt, Human
uauaccagaaaaggaaggaaggauggagacgg

SEQ ID NO: 490410 - RNA, 32 nt, Human
uauaccagaguuuaccacaaguguuuugacga

SEQ ID NO: 490411 - RNA, 32 nt, Human
uauaccagcauucaugauagcauuucagcauu

SEQ ID NO: 490412 - RNA, 32 nt, Human
uauaccagcauuucagcaaaucaucaucaaua

SEQ ID NO: 490413 - RNA, 19 nt, Human
uauaccagucacaugggga

SEQ ID NO: 490414 - RNA, 32 nt, Human
uauaccauauuugucaucuauuuucugguuuc

SEQ ID NO: 490415 - RNA, 32 nt, Human
uauaccauccacccucauggugucuucuacga

SEQ ID NO: 490416 - RNA, 32 nt, Human
uauaccaucuucuauuuccagcuccugauucc

SEQ ID NO: 490417 - RNA, 32 nt, Human
uauaccaucuuucuacaguauuuccuacagcu

SEQ ID NO: 490418 - RNA, 32 nt, Human
uauaccaugaacauguggguacaccugagccc

SEQ ID NO: 490419 - RNA, 32 nt, Human
uauaccauuuaaagcuggcaccagagacccga

SEQ ID NO: 490420 - RNA, 32 nt, Human
uauacccaauacagguucaccaucauuaacag

SEQ ID NO: 490421 - RNA, 32 nt, Human
uauacccacauauucuggauuuuguagugcac

SEQ ID NO: 490422 - RNA, 32 nt, Human
uauacccacugcauccuacuccuaccugguca

SEQ ID NO: 490423 - RNA, 32 nt, Human
uauacccagaggaaaauacacaccuggggagu

SEQ ID NO: 490424 - RNA, 32 nt, Human
uauacccagaguucuucgcuccacucacucaa

SEQ ID NO: 490425 - RNA, 32 nt, Human
uauacccagcuacucgggaggcugaggcagaa

SEQ ID NO: 490426 - RNA, 32 nt, Human
uauaccccggcuucccccuugcccucagcccu

SEQ ID NO: 490427 - RNA, 32 nt, Human
uauaccccucuccucugucuccagaagcuucu

SEQ ID NO: 490428 - RNA, 32 nt, Human
uauacccuccuauuuuccuauguuuacauuau

SEQ ID NO: 490429 - RNA, 32 nt, Human
uauacccuggggacagaaagucagguugaaac

SEQ ID NO: 490430 - RNA, 32 nt, Human
uauaccuccugagcugaugagaugucucugag

SEQ ID NO: 490431 - RNA, 32 nt, Human
uauaccuccuugguacuacccuucccagacuu

SEQ ID NO: 490432 - RNA, 32 nt, Human
uauaccucgggaaccaccuccaucuccagcag

SEQ ID NO: 490433 - RNA, 32 nt, Human
uauaccucuguggauuugcuaccucuccuauu

SEQ ID NO: 490434 - RNA, 32 nt, Human
uauaccugaaaccaaaauggauauuuuuaguc

SEQ ID NO: 490435 - RNA, 32 nt, Human
uauaccugcuaccuucaugggccgagcuugcc

SEQ ID NO: 490436 - RNA, 32 nt, Human
uauaccuguagucccagcuacucaggaagcug

SEQ ID NO: 490437 - RNA, 32 nt, Human
uauaccuuccucacuggcccccuccaccugcc

SEQ ID NO: 490438 - RNA, 32 nt, Human
uauaccuucuaggagcuccuauugggagacau

SEQ ID NO: 490439 - RNA, 32 nt, Human
uauaccuucucccuuccauuucugagaucuca

SEQ ID NO: 490440 - RNA, 32 nt, Human
uauaccuucugcuggcggguguucugugccug

SEQ ID NO: 490441 - RNA, 32 nt, Human
uauaccuugcaggcucauuucagcagacacuc

SEQ ID NO: 490442 - RNA, 32 nt, Human
uauacgacauuuuacacaacaauaauggaccu

SEQ ID NO: 490443 - RNA, 32 nt, Human
uauacgaggcucggaaggacaccccgcggaag

SEQ ID NO: 490444 - RNA, 32 nt, Human
uauacgaguugaguaucccuuagaugagaugc

SEQ ID NO: 490445 - RNA, 32 nt, Human
uauacgauaucacuuacacugcgccugaaggc

SEQ ID NO: 490446 - RNA, 32 nt, Human
uauacguacauacacacauacauacauacaua

SEQ ID NO: 490447 - RNA, 32 nt, Human
uauacguggccaacugccucaccucuagcacu

SEQ ID NO: 490448 - RNA, 32 nt, Human
uauacguggccaacugccucagcucuagcacu

SEQ ID NO: 490449 - RNA, 32 nt, Human
uauacguggccaacugccucgccucuagcacu

SEQ ID NO: 490450 - RNA, 32 nt, Human
uauacuaaguccagagacaugcaggugagccc

SEQ ID NO: 490451 - RNA, 32 nt, Human
uauacuaaguucccagaauccccagcugaaga

SEQ ID NO: 490452 - RNA, 32 nt, Human
uauacuacucacaaguucuggcucauggcucc

SEQ ID NO: 490453 - RNA, 32 nt, Human
uauacuaucuguguuuucaccauucaaagugc

SEQ ID NO: 490454 - RNA, 32 nt, Human
uauacuauuaugcagcuuauuuuaccugaaac

SEQ ID NO: 490455 - RNA, 32 nt, Human
uauacucaacuugcacuguauaucucccuguc

SEQ ID NO: 490456 - RNA, 32 nt, Human
uauacucacaccaaggucugcugucuuauagc

SEQ ID NO: 490457 - RNA, 32 nt, Human
uauacucaggaaaaugucaccaagcacccucc

SEQ ID NO: 490458 - RNA, 32 nt, Human
uauacucagugcaacagaaaaacccauaugga

SEQ ID NO: 490459 - RNA, 32 nt, Human
uauacucauacuuaugaguguaaagaauuuac

SEQ ID NO: 490460 - RNA, 32 nt, Human
uauacucauagaauggaagugagcaaaggaaa

SEQ ID NO: 490461 - RNA, 32 nt, Human
uauacuccucaaggaugcugcauuuggaccua

SEQ ID NO: 490462 - RNA, 32 nt, Human
uauacucgcaauaggaauaagcuaaugcccau

SEQ ID NO: 490463 - RNA, 32 nt, Human
uauacucguacauguaugcacacauacccaua

SEQ ID NO: 490464 - RNA, 32 nt, Human
uauacucucaaagcuagucugaaagugaccuu

SEQ ID NO: 490465 - RNA, 32 nt, Human
uauacucucaguggcuuagaccccagaagaaa

SEQ ID NO: 490466 - RNA, 32 nt, Human
uauacucuuuguccaaaacucaguuucaaaau

SEQ ID NO: 490467 - RNA, 32 nt, Human
uauacugaagaaaaagaagaagaaaagaaaaa

SEQ ID NO: 490468 - RNA, 32 nt, Human
uauacugagccucaacagauugccugcuccuc

SEQ ID NO: 490469 - RNA, 32 nt, Human
uauacugcagguaacaaaagucaaaguauuuu

SEQ ID NO: 490470 - RNA, 32 nt, Human
uauacugcuaaggccacugaugcucaacucug

SEQ ID NO: 490471 - RNA, 32 nt, Human
uauacuggagagaaacuacuaaccugaaagau

SEQ ID NO: 490472 - RNA, 32 nt, Human
uauacuggccauaaaagagggagcugccuuca

SEQ ID NO: 490473 - RNA, 32 nt, Human
uauacuggcccucccuucucuucucuuugcug

SEQ ID NO: 490474 - RNA, 32 nt, Human
uauacugggaaaugcuuuguaccaaguagcag

SEQ ID NO: 490475 - RNA, 32 nt, Human
uauacugggcagggaguuuggagaacugguuu

SEQ ID NO: 490476 - RNA, 32 nt, Human
uauacugguguguguccaaguuauacaugaau

SEQ ID NO: 490477 - RNA, 32 nt, Human
uauacuguauaugauuauggccuacaauguug

SEQ ID NO: 490478 - RNA, 32 nt, Human
uauacuguggccugcaggaggguuggagugcu

SEQ ID NO: 490479 - RNA, 32 nt, Human
uauacugugguguuuggccuccauaaacugca

SEQ ID NO: 490480 - RNA, 32 nt, Human
uauacuguuguggguuggagaaaaguggaaag

SEQ ID NO: 490481 - RNA, 32 nt, Human
uauacuuaaccugaaucucuacucacagcccc

SEQ ID NO: 490482 - RNA, 32 nt, Human
uauacuuaagggaaaaguugcaagaaugcuga

SEQ ID NO: 490483 - RNA, 32 nt, Human
uauacuuaauugcaguagggacucauucccag

SEQ ID NO: 490484 - RNA, 32 nt, Human
uauacuuaccauuugaauaaagggaccacaac

SEQ ID NO: 490485 - RNA, 32 nt, Human
uauacuucagggacucugugaaccccucacaa

SEQ ID NO: 490486 - RNA, 32 nt, Human
uauacuucucagagaaauaucugacaucuauu

SEQ ID NO: 490487 - RNA, 32 nt, Human
uauacuugaaugaaaauguccauuuacacgua

SEQ ID NO: 490488 - RNA, 32 nt, Human
uauacuugcucuccgugucuucccagggcugc

SEQ ID NO: 490489 - RNA, 32 nt, Human
uauacuuguccuuccucccauuuccucccuuu

SEQ ID NO: 490490 - RNA, 32 nt, Human
uauacuugugcuucaaccaaucuaaauuggau

SEQ ID NO: 490491 - RNA, 32 nt, Human
uauacuuguucuucuauaacaucagaaauagg

SEQ ID NO: 490492 - RNA, 32 nt, Human
uauacuuuaccaguaaguuuucagaggaaaua

SEQ ID NO: 490493 - RNA, 32 nt, Human
uauacuuucuuccaaugcagacgggagaaagu

SEQ ID NO: 490494 - RNA, 32 nt, Human
uauacuuuggagcacagcacagccagaaaggg

SEQ ID NO: 490495 - RNA, 32 nt, Human
uauacuuugggggaucaagggaagagauggaa

SEQ ID NO: 490496 - RNA, 32 nt, Human
uauacuuuucauuuucaagaugauugcucuau

SEQ ID NO: 490497 - RNA, 32 nt, Human
uauagaaaagugguuuggaggggauuggggga

SEQ ID NO: 490498 - RNA, 32 nt, Human
uauagaaaauugacugaaggagggccaagaug

SEQ ID NO: 490499 - RNA, 32 nt, Human
uauagaaacaucuagaaauagacugaaagaaa

SEQ ID NO: 490500 - RNA, 32 nt, Human
uauagaaacuauucacuaagaacuuaaaacca

SEQ ID NO: 490501 - RNA, 32 nt, Human
uauagaaaugauccugaacacucugaacuuga

SEQ ID NO: 490502 - RNA, 32 nt, Human
uauagaaaugcagaaguuugggcucugcucca

SEQ ID NO: 490503 - RNA, 32 nt, Human
uauagaaccaaauaaaccuaccauuacaugaa

SEQ ID NO: 490504 - RNA, 32 nt, Human
uauagaacucacuggaucgcccuucaucucuc

SEQ ID NO: 490505 - RNA, 32 nt, Human
uauagaagaacauuugugaaacucccugccgu

SEQ ID NO: 490506 - RNA, 32 nt, Human
uauagaagagaaaugcugcuagaaggaauuaa

SEQ ID NO: 490507 - RNA, 32 nt, Human
uauagaagagccuucuguagaccauauagaaa

SEQ ID NO: 490508 - RNA, 32 nt, Human
uauagaaggggagggggcaaagggcuucuucc

SEQ ID NO: 490509 - RNA, 32 nt, Human
uauagaaguuccccucguuccuugggagauga

SEQ ID NO: 490510 - RNA, 32 nt, Human
uauagaaucugucuguucuuuguuuaacaggu

SEQ ID NO: 490511 - RNA, 32 nt, Human
uauagaaugccaggaggaaaggaagugacaag

SEQ ID NO: 490512 - RNA, 32 nt, Human
uauagaauuuguggaaggagagaggauacaca

SEQ ID NO: 490513 - RNA, 32 nt, Human
uauagacaacccagaaacaaauucauacaucu

SEQ ID NO: 490514 - RNA, 32 nt, Human
uauagacaaugaaguccagccugagguggcuu

SEQ ID NO: 490515 - RNA, 32 nt, Human
uauagacacuuccugaaugcuagaacaaugaa

SEQ ID NO: 490516 - RNA, 32 nt, Human
uauagacaggaaagagguggaggcucuuccuu

SEQ ID NO: 490517 - RNA, 32 nt, Human
uauagacaguguccugaagggauuccagcuca

SEQ ID NO: 490518 - RNA, 32 nt, Human
uauagacauaugcuauaacauggaugcaccuu

SEQ ID NO: 490519 - RNA, 32 nt, Human
uauagacauauguagauacauaccauguuuuc

SEQ ID NO: 490520 - RNA, 32 nt, Human
uauagacccaggagaggaagguuaagagaugu

SEQ ID NO: 490521 - RNA, 32 nt, Human
uauagaccuguaugcauucaucuugcuggaac

SEQ ID NO: 490522 - RNA, 32 nt, Human
uauagacgacagcacuggcucugugaaggugg

SEQ ID NO: 490523 - RNA, 32 nt, Human
uauagacggguuucaccauguuggccagacug

SEQ ID NO: 490524 - RNA, 32 nt, Human
uauagacucuacuguaguacauuucaggaucu

SEQ ID NO: 490525 - RNA, 32 nt, Human
uauagacuggacuuuaaaggcauagcugccuu

SEQ ID NO: 490526 - RNA, 32 nt, Human
uauagacuuaaacugugaacuugcucuagugu

SEQ ID NO: 490527 - RNA, 32 nt, Human
uauagacuuggaggugggggaucuucucaucg

SEQ ID NO: 490528 - RNA, 32 nt, Human
uauagagaaaguaaucauauuuguuuaugguu

SEQ ID NO: 490529 - RNA, 32 nt, Human
uauagagaagauggaugcauccuuguccaugc

SEQ ID NO: 490530 - RNA, 32 nt, Human
uauagagacauccagucccugacuccaccugc

SEQ ID NO: 490531 - RNA, 32 nt, Human
uauagagacucagaaaaugucuuuucuuuaaa

SEQ ID NO: 490532 - RNA, 32 nt, Human
uauagagagagggaggagagcgagagagagug

SEQ ID NO: 490533 - RNA, 32 nt, Human
uauagagagccuuccugucauaacugccaguc

SEQ ID NO: 490534 - RNA, 32 nt, Human
uauagagaggagaggagugaagaaaaggcugu

SEQ ID NO: 490535 - RNA, 32 nt, Human
uauagagaggguucauguggcauuuuagagaa

SEQ ID NO: 490536 - RNA, 32 nt, Human
uauagagagugagagucagguggcagcuguau

SEQ ID NO: 490537 - RNA, 32 nt, Human
uauagagauaugcagaaggaagggcauccuuc

SEQ ID NO: 490538 - RNA, 32 nt, Human
uauagagauggggguuuugccauguugcccaa

SEQ ID NO: 490539 - RNA, 32 nt, Human
uauagagauugauuucaagggaguuacauuau

SEQ ID NO: 490540 - RNA, 32 nt, Human
uauagagcccuggucaaguucucuccaccucu

SEQ ID NO: 490541 - RNA, 32 nt, Human
uauagagcuacucauccuuauuuggaaaaacc

SEQ ID NO: 490542 - RNA, 32 nt, Human
uauagagcuucugcuucccuuucccuucccag

SEQ ID NO: 490543 - RNA, 32 nt, Human
uauagaggaacagaaggugggccaggccuccc

SEQ ID NO: 490544 - RNA, 32 nt, Human
uauagagggccaagacuuggcaacagaagcag

SEQ ID NO: 490545 - RNA, 32 nt, Human
uauagagguagcccuaaaggcaacuagaagag

SEQ ID NO: 490546 - RNA, 32 nt, Human
uauagauaggcacagcuacucccguucgggaa

SEQ ID NO: 490547 - RNA, 32 nt, Human
uauagauauagcuauccuuggagcuuauguuu

SEQ ID NO: 490548 - RNA, 32 nt, Human
uauagauauauccuccuuuaacuccgaccaga

SEQ ID NO: 490549 - RNA, 32 nt, Human
uauagaugauauaggaaugaaccaauacgcuu

SEQ ID NO: 490550 - RNA, 32 nt, Human
uauagauggccuuggaauuugcucuugggggu

SEQ ID NO: 490551 - RNA, 32 nt, Human
uauagaugguuugcucugggcuugccugcccu

SEQ ID NO: 490552 - RNA, 32 nt, Human
uauagaugugagccaccgcgcccggccuacug

SEQ ID NO: 490553 - RNA, 32 nt, Human
uauagaugugagccagcacaccgggccaagug

SEQ ID NO: 490554 - RNA, 32 nt, Human
uauagauuacauaggaagaacaaucacaucag

SEQ ID NO: 490555 - RNA, 20 nt, Human
uauagauuccaccccugccc

SEQ ID NO: 490556 - RNA, 32 nt, Human
uauagauuggagccaccaugcccagcucagag

SEQ ID NO: 490557 - RNA, 32 nt, Human
uauagcaaaauggagaaaauuagaccggccau

SEQ ID NO: 490558 - RNA, 32 nt, Human
uauagcaaaugaacccagaauggaacaguggg

SEQ ID NO: 490559 - RNA, 32 nt, Human
uauagcacccuaaucugcuguagacucuuuga

SEQ ID NO: 490560 - RNA, 32 nt, Human
uauagcacuugacuuuaugaaaggaucugggc

SEQ ID NO: 490561 - RNA, 32 nt, Human
uauagcacuuuaaaguuucugcaguccuuuga

SEQ ID NO: 490562 - RNA, 32 nt, Human
uauagcagaagcagcucaauuguuugguugga

SEQ ID NO: 490563 - RNA, 32 nt, Human
uauagcagccaucuuggauugugagugugucu

SEQ ID NO: 490564 - RNA, 32 nt, Human
uauagcagcucgguacugaaggcgguguuuaa

SEQ ID NO: 490565 - RNA, 32 nt, Human
uauagcagcugaagcaggacuucauuccagau

SEQ ID NO: 490566 - RNA, 32 nt, Human
uauagcagugcaggaacaaacagcacuugcca

SEQ ID NO: 490567 - RNA, 32 nt, Human
uauagcaucucucuauuucaaagacauuccua

SEQ ID NO: 490568 - RNA, 32 nt, Human
uauagcaugaaauauauucaaauacauaccuu

SEQ ID NO: 490569 - RNA, 32 nt, Human
uauagcauuuccuagaucuaccagcuuauaag

SEQ ID NO: 490570 - RNA, 32 nt, Human
uauagccagcggcucccagccucgguggcuuu

SEQ ID NO: 490571 - RNA, 32 nt, Human
uauagcccaguucuuacaagcagagaagccua

SEQ ID NO: 490572 - RNA, 32 nt, Human
uauagcccugaaacguuugaaguggccucauu

SEQ ID NO: 490573 - RNA, 32 nt, Human
uauagcccuuuauuuaaaagagagaaguuccu

SEQ ID NO: 490574 - RNA, 32 nt, Human
uauagccgugugggguuugucucccuucugaa

SEQ ID NO: 490575 - RNA, 32 nt, Human
uauagccuaggugacagagugagacucugucu

SEQ ID NO: 490576 - RNA, 32 nt, Human
uauagccugggcaagagcgugagacccugucu

SEQ ID NO: 490577 - RNA, 32 nt, Human
uauagccuguaugguuucuacuuuauggaauu

SEQ ID NO: 490578 - RNA, 32 nt, Human
uauagccuuugugcuguucugccuugccugug

SEQ ID NO: 490579 - RNA, 32 nt, Human
uauagcggauauagagcuagcuaaucucuaca

SEQ ID NO: 490580 - RNA, 32 nt, Human
uauagcucacugcagccuggaacuccugggau

SEQ ID NO: 490581 - RNA, 32 nt, Human
uauagcucagccaaaucucuguuuuauguccu

SEQ ID NO: 490582 - RNA, 32 nt, Human
uauagcuccagaagugacaagacacuucacau

SEQ ID NO: 490583 - RNA, 32 nt, Human
uauagcuccuccagauucuagguauuaauuua

SEQ ID NO: 490584 - RNA, 32 nt, Human
uauagcucucauguauugaaggugcuacuuua

SEQ ID NO: 490585 - RNA, 32 nt, Human
uauagcugaauaguccuuaaaugaugaacagg

SEQ ID NO: 490586 - RNA, 32 nt, Human
uauagcugauccuucucugaggcucagguccu

SEQ ID NO: 490587 - RNA, 32 nt, Human
uauagcugcaagaaaugugguauguggagaag

SEQ ID NO: 490588 - RNA, 32 nt, Human
uauagcugcuguggccacaccuuccgccagcc

SEQ ID NO: 490589 - RNA, 32 nt, Human
uauagcugugaaccaccaugcccggccaggaa

SEQ ID NO: 490590 - RNA, 32 nt, Human
uauagcuuccauuuacaaguaaggauuauauc

SEQ ID NO: 490591 - RNA, 32 nt, Human
uauagcuugcugcugcucaccuuuugguccac

SEQ ID NO: 490592 - RNA, 32 nt, Human
uauagcuuucauuuuaguuugacauuuagugu

SEQ ID NO: 490593 - RNA, 32 nt, Human
uauaggaaauaagcauacuauauguuagcugu

SEQ ID NO: 490594 - RNA, 32 nt, Human
uauaggaaccccucagcucugaggucugugau

SEQ ID NO: 490595 - RNA, 32 nt, Human
uauaggaaggaagguuuaaucugucuuaagcc

SEQ ID NO: 490596 - RNA, 32 nt, Human
uauaggaccacaggccagccugggagauuuua

SEQ ID NO: 490597 - RNA, 32 nt, Human
uauaggagccucccacuuucaccagagcagcc

SEQ ID NO: 490598 - RNA, 32 nt, Human
uauaggaggcagagguugcagugagccgaggu

SEQ ID NO: 490599 - RNA, 32 nt, Human
uauaggagugagccaccgcgccgggccagacu

SEQ ID NO: 490600 - RNA, 32 nt, Human
uauaggcacaagucaccaugcccagccggaau

SEQ ID NO: 490601 - RNA, 32 nt, Human
uauaggcaccugccaucaugcccagcuaauuu

SEQ ID NO: 490602 - RNA, 32 nt, Human
uauaggcacgagccaccaugccaagccuguug

SEQ ID NO: 490603 - RNA, 32 nt, Human
uauaggcacuggguccagccuugaucagugac

SEQ ID NO: 490604 - RNA, 32 nt, Human
uauaggcagaggagaaugucagaugcucagcu

SEQ ID NO: 490605 - RNA, 32 nt, Human
uauaggcaggugugagggacaguggcuaagaa

SEQ ID NO: 490606 - RNA, 32 nt, Human
uauaggcaugagccaccacacccagccuccuc

SEQ ID NO: 490607 - RNA, 32 nt, Human
uauaggcaugagccaccacacccggccugagu

SEQ ID NO: 490608 - RNA, 32 nt, Human
uauaggcaugagccaccacaccuggcuacuuu

SEQ ID NO: 490609 - RNA, 32 nt, Human
uauaggcaugagccaccacgacuggccagagg

SEQ ID NO: 490610 - RNA, 32 nt, Human
uauaggcaugagccaccacgcccagccuguua

SEQ ID NO: 490611 - RNA, 32 nt, Human
uauaggcaugagccaccacgccuggccagaug

SEQ ID NO: 490612 - RNA, 32 nt, Human
uauaggcaugagccaccaugcccagccaggaa

SEQ ID NO: 490613 - RNA, 32 nt, Human
uauaggcaugagccaccgcacccagccucucu

SEQ ID NO: 490614 - RNA, 32 nt, Human
uauaggcaugagccaccgugcccagccuacuu

SEQ ID NO: 490615 - RNA, 32 nt, Human
uauaggcaugagccaccgugcccggcuauuuu

SEQ ID NO: 490616 - RNA, 32 nt, Human
uauaggcaugagccaccgugccuggcugaugc

SEQ ID NO: 490617 - RNA, 32 nt, Human
uauaggcaugagccacugagccuggcccugaa

SEQ ID NO: 490618 - RNA, 32 nt, Human
uauaggcaugagccacugcacccggccggugg

SEQ ID NO: 490619 - RNA, 32 nt, Human
uauaggcaugagccacugcaccuggccugugu

SEQ ID NO: 490620 - RNA, 32 nt, Human
uauaggcaugagccacugcgccuggccaacaa

SEQ ID NO: 490621 - RNA, 32 nt, Human
uauaggcaugagccacugggccccgccaggcu

SEQ ID NO: 490622 - RNA, 32 nt, Human
uauaggcaugagccacugugccaggcccaaac

SEQ ID NO: 490623 - RNA, 32 nt, Human
uauaggcaugagccacugugcccagcugaaug

SEQ ID NO: 490624 - RNA, 32 nt, Human
uauaggcaugagccacugugccuggcccucuc

SEQ ID NO: 490625 - RNA, 32 nt, Human
uauaggcaugcaccaccaugcccagcuaauuu

SEQ ID NO: 490626 - RNA, 32 nt, Human
uauaggcaugcgccaccaugcccggccggcuu

SEQ ID NO: 490627 - RNA, 32 nt, Human
uauaggcauguaccaccaugcccagcuaauuu

SEQ ID NO: 490628 - RNA, 32 nt, Human
uauaggcaugugccaccaugcccagcuaauuu

SEQ ID NO: 490629 - RNA, 32 nt, Human
uauaggcaugugccacggugccugacuugagu

SEQ ID NO: 490630 - RNA, 32 nt, Human
uauaggcauuaaccacacacuuuaauggguau

SEQ ID NO: 490631 - RNA, 32 nt, Human
uauaggcccagcuuccccuuguucuguggccc

SEQ ID NO: 490632 - RNA, 32 nt, Human
uauaggcccaggaagagggcagaggggccaga

SEQ ID NO: 490633 - RNA, 32 nt, Human
uauaggccugagccacugcguacagcuuguuu

SEQ ID NO: 490634 - RNA, 32 nt, Human
uauaggcgcaugccaccaugccuggcuaauuu

SEQ ID NO: 490635 - RNA, 32 nt, Human
uauaggcgccugccaccaugcccagcuaauuu

SEQ ID NO: 490636 - RNA, 32 nt, Human
uauaggcguaagccaccacacccagccagaaa

SEQ ID NO: 490637 - RNA, 32 nt, Human
uauaggcguaagccaccacaccuggccaaaaa

SEQ ID NO: 490638 - RNA, 32 nt, Human
uauaggcguaagccaccaugccuggccaaaaa

SEQ ID NO: 490639 - RNA, 32 nt, Human
uauaggcguccgccaccaugccuggcuaauuu

SEQ ID NO: 490640 - RNA, 32 nt, Human
uauaggcgugagccaccacaccccgccgcggc

SEQ ID NO: 490641 - RNA, 32 nt, Human
uauaggcgugagccaccacgcccagcugggaa

SEQ ID NO: 490642 - RNA, 32 nt, Human
uauaggcgugagccaccacgccccgccuaaaa

SEQ ID NO: 490643 - RNA, 32 nt, Human
uauaggcgugagccaccacgcccggcgagguu

SEQ ID NO: 490644 - RNA, 32 nt, Human
uauaggcgugagccaccaugcccagccuaauu

SEQ ID NO: 490645 - RNA, 32 nt, Human
uauaggcgugagccaccaugcucagccauuaa

SEQ ID NO: 490646 - RNA, 32 nt, Human
uauaggcgugagccaccgcacccgacccccuc

SEQ ID NO: 490647 - RNA, 32 nt, Human
uauaggcgugagccaccgcaccgugagccacu

SEQ ID NO: 490648 - RNA, 32 nt, Human
uauaggcgugagccaccgcaccuggccuauga

SEQ ID NO: 490649 - RNA, 32 nt, Human
uauaggcgugagccaccgcccccggccuugac

SEQ ID NO: 490650 - RNA, 32 nt, Human
uauaggcgugagccaccgcgcccagcccugga

SEQ ID NO: 490651 - RNA, 32 nt, Human
uauaggcgugagccaccgcgcccggccuccag

SEQ ID NO: 490652 - RNA, 32 nt, Human
uauaggcgugagccaccgcgccuggccccggg

SEQ ID NO: 490653 - RNA, 32 nt, Human
uauaggcgugagccaccgcgccuggcuuauac

SEQ ID NO: 490654 - RNA, 32 nt, Human
uauaggcgugagccaccgcuccuggccaggca

SEQ ID NO: 490655 - RNA, 32 nt, Human
uauaggcgugagccaccgcuccuggccagggu

SEQ ID NO: 490656 - RNA, 32 nt, Human
uauaggcgugagccaccguacccggccuaccc

SEQ ID NO: 490657 - RNA, 32 nt, Human
uauaggcgugagccaccgugccuggccuaaag

SEQ ID NO: 490658 - RNA, 32 nt, Human
uauaggcgugagccacggcauccagccucauc

SEQ ID NO: 490659 - RNA, 32 nt, Human
uauaggcgugagccacugcacccggccccuau

SEQ ID NO: 490660 - RNA, 32 nt, Human
uauaggcgugagccacugcaccugguccccca

SEQ ID NO: 490661 - RNA, 32 nt, Human
uauaggcgugagccacugcgccuggccaaaug

SEQ ID NO: 490662 - RNA, 32 nt, Human
uauaggcgugagccacugugcccagccucaca

SEQ ID NO: 490663 - RNA, 32 nt, Human
uauaggcgugagccacuguguccagccuuuuc

SEQ ID NO: 490664 - RNA, 32 nt, Human
uauaggcgugagccucuggcccggccuuuccu

SEQ ID NO: 490665 - RNA, 32 nt, Human
uauaggcgugagucaccaugcccugcuaaaau

SEQ ID NO: 490666 - RNA, 32 nt, Human
uauaggcgugcaccaccaugcccagcuaauuu

SEQ ID NO: 490667 - RNA, 32 nt, Human
uauaggcgugugccaccaugcccagcaaauuu

SEQ ID NO: 490668 - RNA, 32 nt, Human
uauaggcgugugccaccaugcccagcuaauuu

SEQ ID NO: 490669 - RNA, 31 nt, Human
uauaggcuaauguaaaagaugccaagcaaac

SEQ ID NO: 490670 - RNA, 32 nt, Human
uauaggcugcugucucaugucuuggucacauc

SEQ ID NO: 490671 - RNA, 32 nt, Human
uauaggcuugaaaucauccaucacauaagaaa

SEQ ID NO: 490672 - RNA, 32 nt, Human
uauaggcuugagccaccacgcccggcugguuc

SEQ ID NO: 490673 - RNA, 32 nt, Human
uauaggcuugagccaccacggcuggaugaauc

SEQ ID NO: 490674 - RNA, 32 nt, Human
uauaggcuuggaaagugaggcagcaaugcugu

SEQ ID NO: 490675 - RNA, 32 nt, Human
uauaggcuuucccacauucuuuacauuuguag

SEQ ID NO: 490676 - RNA, 32 nt, Human
uauagggaggggaaugcuaucgauaagaguga

SEQ ID NO: 490677 - RNA, 32 nt, Human
uauagggccacuuggagaugcagaggauucca

SEQ ID NO: 490678 - RNA, 32 nt, Human
uauagggcuucaauacccagguggugacagag

SEQ ID NO: 490679 - RNA, 32 nt, Human
uauaggggagaaagugauuguaguugggaucu

SEQ ID NO: 490680 - RNA, 32 nt, Human
uauaggggcccguucauggagcuggucauuuc

SEQ ID NO: 490681 - RNA, 32 nt, Human
uauagggguaacuggaagccaugaaggaagga

SEQ ID NO: 490682 - RNA, 32 nt, Human
uauagggguuucuuagaggagcuucagaauac

SEQ ID NO: 490683 - RNA, 32 nt, Human
uauagggucgagccuaggggagcuugagggag

SEQ ID NO: 490684 - RNA, 32 nt, Human
uauagggugaggaugcccagcucugcaagaca

SEQ ID NO: 490685 - RNA, 32 nt, Human
uauagguaaauacccuccacucaaggagguag

SEQ ID NO: 490686 - RNA, 32 nt, Human
uauagguaacccacaggcccagugccacccuc

SEQ ID NO: 490687 - RNA, 32 nt, Human
uauagguauuuuauucccauguuuccaucuau

SEQ ID NO: 490688 - RNA, 32 nt, Human
uauaggucagucuugcaaguaccauuuuauaa

SEQ ID NO: 490689 - RNA, 32 nt, Human
uauagguccuuucuauuaaaaacuuaagugca

SEQ ID NO: 490690 - RNA, 32 nt, Human
uauaggucucaauauuuauuaugagaccagug

SEQ ID NO: 490691 - RNA, 32 nt, Human
uauaggugcaugccaccaugcccagcuaauuu

SEQ ID NO: 490692 - RNA, 32 nt, Human
uauaggugcaugccaccaugccuggcuaaucu

SEQ ID NO: 490693 - RNA, 32 nt, Human
uauaggugccugccaccaugcccggcuaauuu

SEQ ID NO: 490694 - RNA, 32 nt, Human
uauaggugcgagccacugcgcccagccucagu

SEQ ID NO: 490695 - RNA, 32 nt, Human
uauaggugcgugccaccaugcccagcuaauau

SEQ ID NO: 490696 - RNA, 32 nt, Human
uauaggugugagccacagcacccagccaaaaa

SEQ ID NO: 490697 - RNA, 32 nt, Human
uauaggugugagccaccacacccagccucuau

SEQ ID NO: 490698 - RNA, 32 nt, Human
uauaggugugagccaccacgccuggcuaauuu

SEQ ID NO: 490699 - RNA, 32 nt, Human
uauaggugugagccaccaugcccagccccuuc

SEQ ID NO: 490700 - RNA, 32 nt, Human
uauaggugugagccacccugcucaaccagguu

SEQ ID NO: 490701 - RNA, 32 nt, Human
uauaggugugagccaccgcacccagccaaacc

SEQ ID NO: 490702 - RNA, 32 nt, Human
uauaggugugagccaccgcacccaguugggaa

SEQ ID NO: 490703 - RNA, 32 nt, Human
uauaggugugagccaccgcgcccggccugccu

SEQ ID NO: 490704 - RNA, 32 nt, Human
uauaggugugagccaccgcgccgggccgguug

SEQ ID NO: 490705 - RNA, 32 nt, Human
uauaggugugagccaccgugccgggccuggac

SEQ ID NO: 490706 - RNA, 32 nt, Human
uauaggugugagccacugcacccggccuccaa

SEQ ID NO: 490707 - RNA, 32 nt, Human
uauaggugugagccacugcaccuggccuggag

SEQ ID NO: 490708 - RNA, 32 nt, Human
uauaggugugagccacugcgccuggcuaaguu

SEQ ID NO: 490709 - RNA, 32 nt, Human
uauaggugugagccacugcucccgggcccuaa

SEQ ID NO: 490710 - RNA, 32 nt, Human
uauaggugugagccacugucccuggccuauac

SEQ ID NO: 490711 - RNA, 32 nt, Human
uauaggugugagccagcagccauaccccucuu

SEQ ID NO: 490712 - RNA, 32 nt, Human
uauaggugugagccagcaugccuggccccugg

SEQ ID NO: 490713 - RNA, 32 nt, Human
uauaggugugagccaucacgccaggucaagag

SEQ ID NO: 490714 - RNA, 32 nt, Human
uauaggugugcgccaccaugcccagcuaauuu

SEQ ID NO: 490715 - RNA, 32 nt, Human
uauaggugugugccaccaugcacagcuaauuu

SEQ ID NO: 490716 - RNA, 32 nt, Human
uauaggugugugccacuaugcccagcuaauuu

SEQ ID NO: 490717 - RNA, 23 nt, Human
uauaguaaaacuagccuuucaca

SEQ ID NO: 490718 - RNA, 32 nt, Human
uauaguaaaauaauguuuccacauuauauuau

SEQ ID NO: 490719 - RNA, 32 nt, Human
uauaguaacaugcagucugaaguccuaguuac

SEQ ID NO: 490720 - RNA, 32 nt, Human
uauaguaagacauacguguaccucuauaauaa

SEQ ID NO: 490721 - RNA, 32 nt, Human
uauaguacaucuggaccuucccuaccugggcu

SEQ ID NO: 490722 - RNA, 32 nt, Human
uauaguacugcugcuacugcuucuacaaugua

SEQ ID NO: 490723 - RNA, 31 nt, Human
uauaguaggaaacugccacauuuuugcuauc

SEQ ID NO: 490724 - RNA, 32 nt, Human
uauaguauaauccagucucucuucucacuucu

SEQ ID NO: 490725 - RNA, 32 nt, Human
uauaguaucacuucuauucuuuuuguuaaagg

SEQ ID NO: 490726 - RNA, 32 nt, Human
uauagucauuaaaucauuacuuuuacauauau

SEQ ID NO: 490727 - RNA, 32 nt, Human
uauagucgcuacacggcauucagucugcagga

SEQ ID NO: 490728 - RNA, 32 nt, Human
uauagucuauguagauaaaaaguaccacuugu

SEQ ID NO: 490729 - RNA, 32 nt, Human
uauagucuguacuucaguucucaucuuguaaa

SEQ ID NO: 490730 - RNA, 32 nt, Human
uauagucuuuucacacugcagcuuugggaaaa

SEQ ID NO: 490731 - RNA, 32 nt, Human
uauagugacaucaucccagacugccuucugua

SEQ ID NO: 490732 - RNA, 32 nt, Human
uauagugauccagggaugaacacccccugugc

SEQ ID NO: 490733 - RNA, 32 nt, Human
uauagugcuucacuguuuuugcacugauuuuu

SEQ ID NO: 490734 - RNA, 32 nt, Human
uauaguggaaagugccucagcuggaaagaucu

SEQ ID NO: 490735 - RNA, 32 nt, Human
uauaguggcaggaaccuguaaucccagcuaca

SEQ ID NO: 490736 - RNA, 32 nt, Human
uauaguggcauuucugauaaacuugaaaagac

SEQ ID NO: 490737 - RNA, 32 nt, Human
uauaguggcccaggauguagugaaagaacaaa

SEQ ID NO: 490738 - RNA, 32 nt, Human
uauaguggcguguaaucuccuuuucgggaggc

SEQ ID NO: 490739 - RNA, 32 nt, Human
uauaguggcucacaccuguaaucacagcacuu

SEQ ID NO: 490740 - RNA, 32 nt, Human
uauagugguggacaaggcucugguuuuuauga

SEQ ID NO: 490741 - RNA, 32 nt, Human
uauagugucuguguuauaacagcagcuucaaa

SEQ ID NO: 490742 - RNA, 32 nt, Human
uauaguguucaucauugaguaauggauuaagu

SEQ ID NO: 490743 - RNA, 32 nt, Human
uauaguguugccugucuguucuaaagcgaacc

SEQ ID NO: 490744 - RNA, 32 nt, Human
uauaguuauggacuacuugaaaccacuacuga

SEQ ID NO: 490745 - RNA, 32 nt, Human
uauaguuauggccuuaauuugcauuuagcuaa

SEQ ID NO: 490746 - RNA, 32 nt, Human
uauaguucagcaauggccugaauagaagcaac

SEQ ID NO: 490747 - RNA, 32 nt, Human
uauaguuccuugagucuccacacacacuccuc

SEQ ID NO: 490748 - RNA, 32 nt, Human
uauaguugcccagcuuuccuggcaauugacuu

SEQ ID NO: 490749 - RNA, 31 nt, Human
uauaguuuaaguuuuuguacagcagaaggua

SEQ ID NO: 490750 - RNA, 32 nt, Human
uauaguuuagguaguauguuacauuugaauuu

SEQ ID NO: 490751 - RNA, 32 nt, Human
uauaguuuauugaacagccacacccauuccuu

SEQ ID NO: 490752 - RNA, 32 nt, Human
uauaguuucaccacuccucucccuugagggau

SEQ ID NO: 490753 - RNA, 32 nt, Human
uauaguuugaaggaaugcaaggagaaggauuu

SEQ ID NO: 490754 - RNA, 32 nt, Human
uauaguuuuccucagcaguuuccucuucuggg

SEQ ID NO: 490755 - RNA, 32 nt, Human
uauaguuuuuggaucuuuagcauaagcacaug

SEQ ID NO: 490756 - RNA, 32 nt, Human
uauauaaaaacaaugauaaagaugugaacugu

SEQ ID NO: 490757 - RNA, 32 nt, Human
uauauaaaagaaagauuucucacugcguagga

SEQ ID NO: 490758 - RNA, 23 nt, Human
uauauaaaaguaauaaaguacaa

SEQ ID NO: 490759 - RNA, 32 nt, Human
uauauaaaauauucagcagcaccaaguuuuau

SEQ ID NO: 490760 - RNA, 32 nt, Human
uauauaaacgcauauacauacauauacccgug

SEQ ID NO: 490761 - RNA, 32 nt, Human
uauauaaagacaggguuuugcuauguuaccua

SEQ ID NO: 490762 - RNA, 32 nt, Human
uauauaaauaaguacaaaucccaggggaagug

SEQ ID NO: 490763 - RNA, 32 nt, Human
uauauaaaucuuuguuaugaucaugucauaua

SEQ ID NO: 490764 - RNA, 32 nt, Human
uauauaacacugugaacuucuaaagcaagagg

SEQ ID NO: 490765 - RNA, 32 nt, Human
uauauaacuauacaguaagcauuuguauuuuc

SEQ ID NO: 490766 - RNA, 32 nt, Human
uauauaacucaggagauuccaugucuuucuca

SEQ ID NO: 490767 - RNA, 32 nt, Human
uauauaacucauuccuaucuguacuacauaac

SEQ ID NO: 490768 - RNA, 32 nt, Human
uauauaacugaccuuauuuauaauuagggaua

SEQ ID NO: 490769 - RNA, 32 nt, Human
uauauaagacugcugcagucacaucacaauau

SEQ ID NO: 490770 - RNA, 32 nt, Human
uauauaagagcagcagccgccuuuguaaagug

SEQ ID NO: 490771 - RNA, 32 nt, Human
uauauaagcaccgcaacugagaacagagcaau

SEQ ID NO: 490772 - RNA, 32 nt, Human
uauauaaggauggucccagcugugucaaaagg

SEQ ID NO: 490773 - RNA, 24 nt, Human
uauauaaguauauauguguguaua

SEQ ID NO: 490774 - RNA, 32 nt, Human
uauauaagucaagaacuagagcucaagauuaa

SEQ ID NO: 490775 - RNA, 32 nt, Human
uauauaauagguccuuccacuuuuuggagagu

SEQ ID NO: 490776 - RNA, 32 nt, Human
uauauaaucauaagcauuuuagggugggaggg

SEQ ID NO: 490777 - RNA, 32 nt, Human
uauauaauuaugcaaaugaaugcgacuauguu

SEQ ID NO: 490778 - RNA, 32 nt, Human
uauauaauuucgaguacuuucaaagauagauu

SEQ ID NO: 490779 - RNA, 32 nt, Human
uauauacacacacauacacauauauuaugcau

SEQ ID NO: 490780 - RNA, 22 nt, Human
uauauacacacacauauaugua

SEQ ID NO: 490781 - RNA, 26 nt, Human
uauauacacacauauacauauauaua

SEQ ID NO: 490782 - RNA, 32 nt, Human
uauauacacauacauauaauuuuguuuuccuu

SEQ ID NO: 490783 - RNA, 24 nt, Human
uauauacacauauguguguaugca

SEQ ID NO: 490784 - RNA, 22 nt, Human
uauauacagauguguguguaua

SEQ ID NO: 490785 - RNA, 31 nt, Human
uauauacauacuuacuguaacacaucuaaaa

SEQ ID NO: 490786 - RNA, 18 nt, Human
uauauacauauauacaca

SEQ ID NO: 490787 - RNA, 32 nt, Human
uauauacauauauacacaaccaaggugugauc

SEQ ID NO: 490788 - RNA, 27 nt, Human
uauauacauauauauguguguauauaa

SEQ ID NO: 490789 - RNA, 25 nt, Human
uauauacauauauguguguguauaa

SEQ ID NO: 490790 - RNA, 32 nt, Human
uauauacauauccacacacauacauuacauau

SEQ ID NO: 490791 - RNA, 32 nt, Human
uauauacauauguaaugugugcguaucauguc

SEQ ID NO: 490792 - RNA, 32 nt, Human
uauauacauauguacauauucucauauguaaa

SEQ ID NO: 490793 - RNA, 32 nt, Human
uauauacauauguagacuauauacaugugugu

SEQ ID NO: 490794 - RNA, 32 nt, Human
uauauacauauguauguauauacguauguaua

SEQ ID NO: 490795 - RNA, 32 nt, Human
uauauacauauguauguuuauauacacacaug

SEQ ID NO: 490796 - RNA, 32 nt, Human
uauauacauauguguauauuauaucugugugu

SEQ ID NO: 490797 - RNA, 25 nt, Human
uauauacauuguauguguguauaua

SEQ ID NO: 490798 - RNA, 32 nt, Human
uauauacccaugucuacuguuuugcuucagcu

SEQ ID NO: 490799 - RNA, 32 nt, Human
uauauacccugaccaauaaaugauaguagaau

SEQ ID NO: 490800 - RNA, 32 nt, Human
uauauacuauguaugcagugcaucugcauaga

SEQ ID NO: 490801 - RNA, 22 nt, Human
uauauacuccuuuuaagaagca

SEQ ID NO: 490802 - RNA, 32 nt, Human
uauauacugaggcugucauacccagauuccca

SEQ ID NO: 490803 - RNA, 32 nt, Human
uauauacugugaaaacuuugagaagauaauac

SEQ ID NO: 490804 - RNA, 32 nt, Human
uauauacuugcauacacuaucacugcauuaaa

SEQ ID NO: 490805 - RNA, 32 nt, Human
uauauagaaaaugcuaaagaauccauaaaaag

SEQ ID NO: 490806 - RNA, 32 nt, Human
uauauagaauccagauaucauugucaacuucc

SEQ ID NO: 490807 - RNA, 32 nt, Human
uauauagagccuucagaaacugugaguggaaa

SEQ ID NO: 490808 - RNA, 32 nt, Human
uauauagaguaucucugcugcuuuuguuuacc

SEQ ID NO: 490809 - RNA, 32 nt, Human
uauauagcuacaaaugaaaacaauccagcacu

SEQ ID NO: 490810 - RNA, 32 nt, Human
uauauaggaauugccuuucuuuagucuucagg

SEQ ID NO: 490811 - RNA, 32 nt, Human
uauauaggaugugaggggaggggugagaacaa

SEQ ID NO: 490812 - RNA, 32 nt, Human
uauauaggcaugagccacugagccuggcccug

SEQ ID NO: 490813 - RNA, 32 nt, Human
uauauaggcgugagccaccacgcccagcuggg

SEQ ID NO: 490814 - RNA, 21 nt, Human
uauauagguaauguguguaua

SEQ ID NO: 490815 - RNA, 25 nt, Human
uauauaguguauauauauguauaca

SEQ ID NO: 490816 - RNA, 32 nt, Human
uauauaguuuucacauuuuaauuccuccuccu

SEQ ID NO: 490817 - RNA, 22 nt, Human
uauauauaaaagguuguguaca

SEQ ID NO: 490818 - RNA, 24 nt, Human
uauauauacauguguguauguaua

SEQ ID NO: 490819 - RNA, 28 nt, Human
uauauauauguauauguguauauauaua

SEQ ID NO: 490820 - RNA, 24 nt, Human
uauauauauguauguguguguaua

SEQ ID NO: 490821 - RNA, 26 nt, Human
uauauaugcacauauauguguguaua

SEQ ID NO: 490822 - RNA, 22 nt, Human
uauauauguacacaggugugca

SEQ ID NO: 490823 - RNA, 28 nt, Human
uauauauguacauguguauauaaguaua

SEQ ID NO: 490824 - RNA, 22 nt, Human
uauauauguauaaccaaguaca

SEQ ID NO: 490825 - RNA, 28 nt, Human
uauauauguauacauauauguaugugua

SEQ ID NO: 490826 - RNA, 23 nt, Human
uauauauguauacauucuguaca

SEQ ID NO: 490827 - RNA, 24 nt, Human
uauauauguauauaugcauauaca

SEQ ID NO: 490828 - RNA, 21 nt, Human
uauauauguauauaugggaca

SEQ ID NO: 490829 - RNA, 26 nt, Human
uauauauguauauguauguuuguaca

SEQ ID NO: 490830 - RNA, 21 nt, Human
uauauauguauaugucuguac

SEQ ID NO: 490831 - RNA, 24 nt, Human
uauauauguauguauauauguaua

SEQ ID NO: 490832 - RNA, 24 nt, Human
uauauaugugaauauguguauaua

SEQ ID NO: 490833 - RNA, 28 nt, Human
uauauauguguauguauauauauguaua

SEQ ID NO: 490834 - RNA, 26 nt, Human
uauauauguguauguauauauguaca

SEQ ID NO: 490835 - RNA, 24 nt, Human
uauauauguguguauguguguaua

SEQ ID NO: 490836 - RNA, 24 nt, Human
uauauauguguguguauguuugca

SEQ ID NO: 490837 - RNA, 23 nt, Human
uauauauuuauguguauguguca

SEQ ID NO: 490838 - RNA, 22 nt, Human
uauauauuucuuguguguucuu

SEQ ID NO: 490839 - RNA, 32 nt, Human
uauaucaaacuaauuacaaccaagaaauaaua

SEQ ID NO: 490840 - RNA, 32 nt, Human
uauaucaaccacaaccuucugcaucacaguau

SEQ ID NO: 490841 - RNA, 32 nt, Human
uauaucaagcaauaaucucccacccaaggcuu

SEQ ID NO: 490842 - RNA, 32 nt, Human
uauaucacccagagugcgugggauauguugaa

SEQ ID NO: 490843 - RNA, 32 nt, Human
uauaucacccuuuagaucuugauuuccugguc

SEQ ID NO: 490844 - RNA, 32 nt, Human
uauaucaccuugaaaugucucucuucucaucu

SEQ ID NO: 490845 - RNA, 32 nt, Human
uauaucacuauacaggguaauugcuuuuauaa

SEQ ID NO: 490846 - RNA, 32 nt, Human
uauaucacugauuuuguagagcugcugggaga

SEQ ID NO: 490847 - RNA, 32 nt, Human
uauaucacuggcagagccuguaguuggaaagg

SEQ ID NO: 490848 - RNA, 32 nt, Human
uauaucacuggcauuuguaucuucaguauuuc

SEQ ID NO: 490849 - RNA, 32 nt, Human
uauaucagcuaaguguuccuggaacauaaaaa

SEQ ID NO: 490850 - RNA, 32 nt, Human
uauaucaggaauacaaggaugugaaauaaaac

SEQ ID NO: 490851 - RNA, 32 nt, Human
uauaucagggauuugagcaucuguagauuuug

SEQ ID NO: 490852 - RNA, 32 nt, Human
uauaucagugauauuucgaacugugaaaaugg

SEQ ID NO: 490853 - RNA, 32 nt, Human
uauaucauaaucaaggcuuugaacuugaugug

SEQ ID NO: 490854 - RNA, 32 nt, Human
uauaucauauugcuuuuuguccaucuuugugg

SEQ ID NO: 490855 - RNA, 32 nt, Human
uauaucaucuuacugccuguguguguggacuu

SEQ ID NO: 490856 - RNA, 32 nt, Human
uauaucauuccaccagcaccaccaagaccuga

SEQ ID NO: 490857 - RNA, 32 nt, Human
uauaucauuuccucuucauuaaagaacagcuu

SEQ ID NO: 490858 - RNA, 32 nt, Human
uauauccacacaaugaauaacagccacaaaaa

SEQ ID NO: 490859 - RNA, 32 nt, Human
uauauccacuucacuccucauuugcccaaugg

SEQ ID NO: 490860 - RNA, 32 nt, Human
uauauccauagaucuaaggggcaaacagauac

SEQ ID NO: 490861 - RNA, 32 nt, Human
uauauccauuuugcuucccagcacuuuuuagg

SEQ ID NO: 490862 - RNA, 32 nt, Human
uauaucccagcuacugggagguugaagcagaa

SEQ ID NO: 490863 - RNA, 32 nt, Human
uauauccccagcaccuaaaacagggucacaca

SEQ ID NO: 490864 - RNA, 32 nt, Human
uauaucccucaccucuggccucucaucccuuc

SEQ ID NO: 490865 - RNA, 32 nt, Human
uauaucccuccugugcugagcuaguuuucuau

SEQ ID NO: 490866 - RNA, 32 nt, Human
uauaucccuccuuuaccauaguacucccaccc

SEQ ID NO: 490867 - RNA, 22 nt, Human
uauaucccuucccaacccccau

SEQ ID NO: 490868 - RNA, 32 nt, Human
uauauccuauacuuuccaccuccauagggggu

SEQ ID NO: 490869 - RNA, 32 nt, Human
uauauccugaugcuggaugguauuaaucuugu

SEQ ID NO: 490870 - RNA, 32 nt, Human
uauauccugccugggcucuggccucugcucug

SEQ ID NO: 490871 - RNA, 32 nt, Human
uauauccuggcuuugugaccucagccaaguug

SEQ ID NO: 490872 - RNA, 32 nt, Human
uauauccuggguccuuucucccuccgucugcu

SEQ ID NO: 490873 - RNA, 32 nt, Human
uauauccuguguacuaauucuuugucauuuau

SEQ ID NO: 490874 - RNA, 32 nt, Human
uauauccuguguugugaccucaugguuuaagu

SEQ ID NO: 490875 - RNA, 23 nt, Human
uauaucgagauugccugcuuccu

SEQ ID NO: 490876 - RNA, 32 nt, Human
uauaucgaugauggaaauuagccacauguaca

SEQ ID NO: 490877 - RNA, 32 nt, Human
uauaucggucccggaagacauagaugcucccg

SEQ ID NO: 490878 - RNA, 32 nt, Human
uauaucuaaacauacaaguaugaacuauucua

SEQ ID NO: 490879 - RNA, 32 nt, Human
uauaucuaaauuuagaaaucauuuggguuaau

SEQ ID NO: 490880 - RNA, 32 nt, Human
uauaucuacauacaucaauuaaacuuaugucc

SEQ ID NO: 490881 - RNA, 32 nt, Human
uauaucuacuauuaaguagaaguggaucacca

SEQ ID NO: 490882 - RNA, 32 nt, Human
uauaucuagcuuuaggaaguugcccuuacagg

SEQ ID NO: 490883 - RNA, 32 nt, Human
uauaucuauaaauauauuaaaaagcaagucaa

SEQ ID NO: 490884 - RNA, 22 nt, Human
uauaucuauauguguguauaca

SEQ ID NO: 490885 - RNA, 32 nt, Human
uauaucucauuuccuucaaccuugccuccuca

SEQ ID NO: 490886 - RNA, 32 nt, Human
uauaucucugcucuuugaccucaaggucuaga

SEQ ID NO: 490887 - RNA, 32 nt, Human
uauaucucugugucucuccaucauuccaaagc

SEQ ID NO: 490888 - RNA, 32 nt, Human
uauaucugagucucccaucaaaggaccugcac

SEQ ID NO: 490889 - RNA, 32 nt, Human
uauaucugaguuugaaggauguuuauauaggg

SEQ ID NO: 490890 - RNA, 32 nt, Human
uauaucugcagugucuucuuccugggccuaca

SEQ ID NO: 490891 - RNA, 32 nt, Human
uauaucuggaaccucuuauaaauggagcacuu

SEQ ID NO: 490892 - RNA, 32 nt, Human
uauaucuggcagauugacauuuauacacuuuu

SEQ ID NO: 490893 - RNA, 32 nt, Human
uauaucuggcagcagacuuucaguggaaaccu

SEQ ID NO: 490894 - RNA, 29 nt, Human
uauaucuggcugcaaucacugcugcugcu

SEQ ID NO: 490895 - RNA, 29 nt, Human
uauaucuggcugccauuuuucugaugcau

SEQ ID NO: 490896 - RNA, 32 nt, Human
uauaucugggagagcuaggucccuuggagcuc

SEQ ID NO: 490897 - RNA, 32 nt, Human
uauaucugugaguguauauacaugcaugcaau

SEQ ID NO: 490898 - RNA, 21 nt, Human
uauaucuguggauucaaguua

SEQ ID NO: 490899 - RNA, 24 nt, Human
uauaucuguguauguguguauaca

SEQ ID NO: 490900 - RNA, 32 nt, Human
uauaucugugugaccuuaggcaagucaccgaa

SEQ ID NO: 490901 - RNA, 32 nt, Human
uauaucuuacuuuacacauacguguauguaca

SEQ ID NO: 490902 - RNA, 21 nt, Human
uauaucuuaugauucaaguca

SEQ ID NO: 490903 - RNA, 32 nt, Human
uauaucuucugugguuuugaaggaggugaguu

SEQ ID NO: 490904 - RNA, 32 nt, Human
uauaucuugguuguuguauuguaccagugaaa

SEQ ID NO: 490905 - RNA, 32 nt, Human
uauaucuuugggaacaucucucacccccuggg

SEQ ID NO: 490906 - RNA, 32 nt, Human
uauaucuuuuuauacacugccuaaaucaguac

SEQ ID NO: 490907 - RNA, 32 nt, Human
uauaugaaaagagguuuaacuggcucaugguu

SEQ ID NO: 490908 - RNA, 32 nt, Human
uauaugaaaagagguuuaauuggcucacaguu

SEQ ID NO: 490909 - RNA, 32 nt, Human
uauaugaacuccucagaccuuaaaccuuuucc

SEQ ID NO: 490910 - RNA, 32 nt, Human
uauaugaauauguauauguauauguauguaag

SEQ ID NO: 490911 - RNA, 32 nt, Human
uauaugacaaaugaaaagaauaacaaguuguc

SEQ ID NO: 490912 - RNA, 32 nt, Human
uauaugacaaauucucacuuaccaagaauggu

SEQ ID NO: 490913 - RNA, 32 nt, Human
uauaugacuaaaggagggcugaacucuguauu

SEQ ID NO: 490914 - RNA, 32 nt, Human
uauaugagauuaaagcauauaaacuggagugc

SEQ ID NO: 490915 - RNA, 32 nt, Human
uauaugaugccuguaaacacaacaguauuuau

SEQ ID NO: 490916 - RNA, 32 nt, Human
uauaugaugggggaguagaucuuucuaggagg

SEQ ID NO: 490917 - RNA, 32 nt, Human
uauaugauuccugccauuugcugcuaaaucug

SEQ ID NO: 490918 - RNA, 32 nt, Human
uauaugcaaagcacacuucugagaucuuucag

SEQ ID NO: 490919 - RNA, 32 nt, Human
uauaugcaacacaagccugucugccacccugg

SEQ ID NO: 490920 - RNA, 32 nt, Human
uauaugcacaaacacacacagaaauauauuca

SEQ ID NO: 490921 - RNA, 32 nt, Human
uauaugcacaggagucaaagagaugucuuuau

SEQ ID NO: 490922 - RNA, 32 nt, Human
uauaugcacaggcacacacauguaugcacaca

SEQ ID NO: 490923 - RNA, 32 nt, Human
uauaugcacaugcuccaagguccauacucagu

SEQ ID NO: 490924 - RNA, 32 nt, Human
uauaugcagacuauccauucucaggaagaaaa

SEQ ID NO: 490925 - RNA, 32 nt, Human
uauaugcaguuuuauccugugcccuaaagccu

SEQ ID NO: 490926 - RNA, 32 nt, Human
uauaugcauacagccuacauaacaaacgaagu

SEQ ID NO: 490927 - RNA, 32 nt, Human
uauaugcauaugcagacauauguauauggucu

SEQ ID NO: 490928 - RNA, 32 nt, Human
uauaugccaugcugggaggccacugagaaugc

SEQ ID NO: 490929 - RNA, 19 nt, Human
uauaugcuaaaagaaugca

SEQ ID NO: 490930 - RNA, 21 nt, Human
uauaugcuauagauguguaca

SEQ ID NO: 490931 - RNA, 32 nt, Human
uauaugcucucacucugaaauuccaagguugg

SEQ ID NO: 490932 - RNA, 32 nt, Human
uauauggaacauggcagaaagacugaaaaaua

SEQ ID NO: 490933 - RNA, 32 nt, Human
uauauggacuccguccuugaggaggaucucau

SEQ ID NO: 490934 - RNA, 32 nt, Human
uauauggacuuuaaugacacaauguuuagaga

SEQ ID NO: 490935 - RNA, 32 nt, Human
uauauggaugauauacuuugugcugcccccac

SEQ ID NO: 490936 - RNA, 32 nt, Human
uauauggcagacuauauuaacagcugcugaac

SEQ ID NO: 490937 - RNA, 32 nt, Human
uauauggcaguggcacuucuagauaucuguug

SEQ ID NO: 490938 - RNA, 32 nt, Human
uauauggccuccagaacugugggaaaauaaau

SEQ ID NO: 490939 - RNA, 32 nt, Human
uauauggcgcgaucucagcucacugcaaccuc

SEQ ID NO: 490940 - RNA, 32 nt, Human
uauauggcuucugcuucucuugugugugccuc

SEQ ID NO: 490941 - RNA, 28 nt, Human
uauaugggcauggcacuggagcuguacu

SEQ ID NO: 490942 - RNA, 32 nt, Human
uauaugggccagccuggauauacaacagagua

SEQ ID NO: 490943 - RNA, 32 nt, Human
uauaugguugccacacuugauuguagauggag

SEQ ID NO: 490944 - RNA, 30 nt, Human
uauauguaacauccugauuuacagcuucgg

SEQ ID NO: 490945 - RNA, 31 nt, Human
uauauguaacauccugauuuacagcuucggg

SEQ ID NO: 490946 - RNA, 32 nt, Human
uauauguaaccagcaaauauauuuuuccuuag

SEQ ID NO: 490947 - RNA, 20 nt, Human
uauauguacauauauacaca

SEQ ID NO: 490948 - RNA, 32 nt, Human
uauauguacucagaguauuuuuauuaaagaag

SEQ ID NO: 490949 - RNA, 32 nt, Human
uauauguagccacaaacacugaccucauguag

SEQ ID NO: 490950 - RNA, 32 nt, Human
uauauguauaaaugcuggugguggugaaagua

SEQ ID NO: 490951 - RNA, 24 nt, Human
uauauguauacacauauauauaca

SEQ ID NO: 490952 - RNA, 32 nt, Human
uauauguauacauauacacauauacacacaug

SEQ ID NO: 490953 - RNA, 24 nt, Human
uauauguauauacauauauacaua

SEQ ID NO: 490954 - RNA, 20 nt, Human
uauauguauauacauaucac

SEQ ID NO: 490955 - RNA, 32 nt, Human
uauauguauauguaugguuguaaauaucuaua

SEQ ID NO: 490956 - RNA, 32 nt, Human
uauauguauauguauguuuguacaaaucucca

SEQ ID NO: 490957 - RNA, 22 nt, Human
uauauguauauguguauguaua

SEQ ID NO: 490958 - RNA, 23 nt, Human
uauauguauauuauacauacaca

SEQ ID NO: 490959 - RNA, 32 nt, Human
uauauguauauuuauuuuuauguauguuacua

SEQ ID NO: 490960 - RNA, 32 nt, Human
uauaugucaaaucagaagagaagaacuauaaa

SEQ ID NO: 490961 - RNA, 32 nt, Human
uauaugucauuuucuccuuucuuuucacguua

SEQ ID NO: 490962 - RNA, 32 nt, Human
uauauguccaccaguauaauggcauugcugug

SEQ ID NO: 490963 - RNA, 32 nt, Human
uauaugucccuuggaagagaucaaagugagaa

SEQ ID NO: 490964 - RNA, 32 nt, Human
uauaugucugcaaucauggauaggaauaaaau

SEQ ID NO: 490965 - RNA, 32 nt, Human
uauaugucuuauguaugcuuucauucuuuaua

SEQ ID NO: 490966 - RNA, 32 nt, Human
uauaugugaaaguucuuaguagguacagaaau

SEQ ID NO: 490967 - RNA, 32 nt, Human
uauaugugauuaucacuguaagccacaaaggc

SEQ ID NO: 490968 - RNA, 22 nt, Human
uauaugugcauauauauacaua

SEQ ID NO: 490969 - RNA, 19 nt, Human
uauaugugccgacaugugg

SEQ ID NO: 490970 - RNA, 31 nt, Human
uauauguggguggcaaaugggaaugggagag

SEQ ID NO: 490971 - RNA, 32 nt, Human
uauauguguauauaaauauauguguguguaua

SEQ ID NO: 490972 - RNA, 22 nt, Human
uauauguguauauguauacaca

SEQ ID NO: 490973 - RNA, 22 nt, Human
uauauguguaugcaugugugca

SEQ ID NO: 490974 - RNA, 21 nt, Human
uauauguguaugugugugaca

SEQ ID NO: 490975 - RNA, 29 nt, Human
uauauguguaugugugugacaggaaaauc

SEQ ID NO: 490976 - RNA, 21 nt, Human
uauauguguaugugugugcac

SEQ ID NO: 490977 - RNA, 23 nt, Human
uauaugugucauauguauguaca

SEQ ID NO: 490978 - RNA, 24 nt, Human
uauauguguguauauauauacaca

SEQ ID NO: 490979 - RNA, 24 nt, Human
uauauguguguauauguauguaua

SEQ ID NO: 490980 - RNA, 22 nt, Human
uauauguguguguauguguaca

SEQ ID NO: 490981 - RNA, 32 nt, Human
uauauguguuuauagagauacacacacauaua

SEQ ID NO: 490982 - RNA, 32 nt, Human
uauauguugaaaaacugcuguggccuuuuaug

SEQ ID NO: 490983 - RNA, 32 nt, Human
uauauguuuccccuguuaauaucugguuaaau

SEQ ID NO: 490984 - RNA, 32 nt, Human
uauauguuuucagacacccucuauauuaucag

SEQ ID NO: 490985 - RNA, 21 nt, Human
uauauuaagcagcccagccuu

SEQ ID NO: 490986 - RNA, 32 nt, Human
uauauuacacauacacuguuauuugaaacacu

SEQ ID NO: 490987 - RNA, 32 nt, Human
uauauuacagaaguucuagucccacuugucaa

SEQ ID NO: 490988 - RNA, 32 nt, Human
uauauuaccacgacauuuaacaucaauauugu

SEQ ID NO: 490989 - RNA, 32 nt, Human
uauauuaccuguucugcuucaccaggagauca

SEQ ID NO: 490990 - RNA, 32 nt, Human
uauauuacuacuuauaauacuguggcuagucu

SEQ ID NO: 490991 - RNA, 32 nt, Human
uauauuacuuagauccuucuagucagaagcga

SEQ ID NO: 490992 - RNA, 32 nt, Human
uauauuagaaauuuccauuuuguuaaauaaau

SEQ ID NO: 490993 - RNA, 32 nt, Human
uauauuagaccagaccaccaugugucauugug

SEQ ID NO: 490994 - RNA, 32 nt, Human
uauauuagagaugccugcaucuuugacuauaa

SEQ ID NO: 490995 - RNA, 32 nt, Human
uauauuaucaccggcucucagccuaagagacu

SEQ ID NO: 490996 - RNA, 32 nt, Human
uauauuaucuguccauucugaggaaccaguga

SEQ ID NO: 490997 - RNA, 32 nt, Human
uauauuaugcagaaacagucuguucccccuca

SEQ ID NO: 490998 - RNA, 32 nt, Human
uauauuauuggcugugucuggaauucuugcuu

SEQ ID NO: 490999 - RNA, 32 nt, Human
uauauucacaucugcauucugugagugcgggu

SEQ ID NO: 491000 - RNA, 32 nt, Human
uauauucacaugugaaagcaagugaucuguug

SEQ ID NO: 491001 - RNA, 32 nt, Human
uauauucaguucauaaguguaauugaccauac

SEQ ID NO: 491002 - RNA, 32 nt, Human
uauauucaucuagauucaacacuuguuaguau

SEQ ID NO: 491003 - RNA, 32 nt, Human
uauauucauucaaagcuuuagaugugucccau

SEQ ID NO: 491004 - RNA, 32 nt, Human
uauauucauugaucaaacugauaugcuacagg

SEQ ID NO: 491005 - RNA, 32 nt, Human
uauauucauugugcaguggacacacaccuaau

SEQ ID NO: 491006 - RNA, 32 nt, Human
uauauuccauagagaagaaagaugggauagcu

SEQ ID NO: 491007 - RNA, 22 nt, Human
uauauuccaugaagacaaaaua

SEQ ID NO: 491008 - RNA, 32 nt, Human
uauauucuaaagaagaaagaaggcaggauagu

SEQ ID NO: 491009 - RNA, 32 nt, Human
uauauucuaguuuggaguacuugcuguaggau

SEQ ID NO: 491010 - RNA, 32 nt, Human
uauauucuauauguguaucuuccuaggcaaaa

SEQ ID NO: 491011 - RNA, 32 nt, Human
uauauucucccuuuuauauugcaucugcuguu

SEQ ID NO: 491012 - RNA, 24 nt, Human
uauauucugagagacaggacaguu

SEQ ID NO: 491013 - RNA, 32 nt, Human
uauauucuucuuuguaguccuucuucccaccc

SEQ ID NO: 491014 - RNA, 18 nt, Human
uauauucuuuagauaguu

SEQ ID NO: 491015 - RNA, 32 nt, Human
uauauucuuucaaguaaccaagcuguugacuu

SEQ ID NO: 491016 - RNA, 32 nt, Human
uauauucuuuccccucuuuuaaaacaaauggu

SEQ ID NO: 491017 - RNA, 32 nt, Human
uauauugacuaaaucaagaucugugauugaac

SEQ ID NO: 491018 - RNA, 32 nt, Human
uauauugacuaaauccagaucugugauugaac

SEQ ID NO: 491019 - RNA, 32 nt, Human
uauauugacuuucuuugguuuuccuugugcau

SEQ ID NO: 491020 - RNA, 32 nt, Human
uauauugagaccaguaacuuuacuguaaauuu

SEQ ID NO: 491021 - RNA, 32 nt, Human
uauauugcaugucuauuucuguuacacaauuu

SEQ ID NO: 491022 - RNA, 32 nt, Human
uauauugccaccaagacuuuccaggcucuucg

SEQ ID NO: 491023 - RNA, 32 nt, Human
uauauugcccaggcuggucuugaaguccuggc

SEQ ID NO: 491024 - RNA, 32 nt, Human
uauauugcugaauuccaaccucccuggggcgg

SEQ ID NO: 491025 - RNA, 32 nt, Human
uauauugcuggaaacucagcugugcuccagac

SEQ ID NO: 491026 - RNA, 32 nt, Human
uauauugucaugaagucuaaaaggaaauucuc

SEQ ID NO: 491027 - RNA, 32 nt, Human
uauauugucccauuaagcaaaaagcagguuau

SEQ ID NO: 491028 - RNA, 32 nt, Human
uauauuguccuccaccuccaucauuuucaaua

SEQ ID NO: 491029 - RNA, 32 nt, Human
uauauuguguucugcuugagguuuggggagga

SEQ ID NO: 491030 - RNA, 32 nt, Human
uauauuuaagaaugaguuaaaagggaacaaaa

SEQ ID NO: 491031 - RNA, 32 nt, Human
uauauuuaaugccuuuacaauaccuuuaauuu

SEQ ID NO: 491032 - RNA, 32 nt, Human
uauauuuacuaaaaaccuuagacauuaugaaa

SEQ ID NO: 491033 - RNA, 24 nt, Human
uauauuuagauauacguauauaca

SEQ ID NO: 491034 - RNA, 32 nt, Human
uauauuuagucuaaguaacacauacauguuua

SEQ ID NO: 491035 - RNA, 32 nt, Human
uauauuuauaaaguuauuuuaagaacucuaaa

SEQ ID NO: 491036 - RNA, 32 nt, Human
uauauuuauaaauaugugauuaucauuuauuu

SEQ ID NO: 491037 - RNA, 32 nt, Human
uauauuucacuuucucuuugacuugagaccuu

SEQ ID NO: 491038 - RNA, 32 nt, Human
uauauuucacuuucucuuugacuuuagaccuu

SEQ ID NO: 491039 - RNA, 32 nt, Human
uauauuucagcugggaaaagcuuacauuuaac

SEQ ID NO: 491040 - RNA, 32 nt, Human
uauauuucagugugguuagguuuuaguugaug

SEQ ID NO: 491041 - RNA, 32 nt, Human
uauauuucauucuuuugaaaauauccaugaaa

SEQ ID NO: 491042 - RNA, 32 nt, Human
uauauuucccuuuaggcugugauaguuuuuga

SEQ ID NO: 491043 - RNA, 32 nt, Human
uauauuuccuguuuuucccuuugcccacccug

SEQ ID NO: 491044 - RNA, 32 nt, Human
uauauuuccuucugacacuuggaagguauuga

SEQ ID NO: 491045 - RNA, 32 nt, Human
uauauuucugcauuuauuuacuucuguuuugu

SEQ ID NO: 491046 - RNA, 32 nt, Human
uauauuugaaauaagauccuggaaacgaauuu

SEQ ID NO: 491047 - RNA, 32 nt, Human
uauauuugaagugaauggugauuggaaauuuu

SEQ ID NO: 491048 - RNA, 32 nt, Human
uauauuugagagcaaucaaaucacacagcaug

SEQ ID NO: 491049 - RNA, 32 nt, Human
uauauuugagcccaacugcuuggacgccuucc

SEQ ID NO: 491050 - RNA, 32 nt, Human
uauauuugauaaguauuguuacauuugacaau

SEQ ID NO: 491051 - RNA, 32 nt, Human
uauauuugcuaaguaaaaauguugacagaaau

SEQ ID NO: 491052 - RNA, 32 nt, Human
uauauuugcuucaacaacuuugugcuuuccug

SEQ ID NO: 491053 - RNA, 32 nt, Human
uauauuuggagacagggucuauaaggagguaa

SEQ ID NO: 491054 - RNA, 32 nt, Human
uauauuuguaaaagaaccacagcagcuauuuu

SEQ ID NO: 491055 - RNA, 32 nt, Human
uauauuuguaaaccaagagaccggcugggugu

SEQ ID NO: 491056 - RNA, 22 nt, Human
uauauuuguauauauauguaca

SEQ ID NO: 491057 - RNA, 32 nt, Human
uauauuugugugugcagauguacauaaagaug

SEQ ID NO: 491058 - RNA, 32 nt, Human
uauauuuuaagccacaucaacugguuuaauau

SEQ ID NO: 491059 - RNA, 32 nt, Human
uauauuuuacagucuuaucugccuuuuuaucu

SEQ ID NO: 491060 - RNA, 31 nt, Human
uauauuuucacaugaaauaccaaaugucaca

SEQ ID NO: 491061 - RNA, 32 nt, Human
uauauuuucacuucugcauuauguacauaaag

SEQ ID NO: 491062 - RNA, 32 nt, Human
uauauuuucuuucucuuccuccuuccucuucc

SEQ ID NO: 491063 - RNA, 32 nt, Human
uauauuuugagacucuguuauugagugcauau

SEQ ID NO: 491064 - RNA, 32 nt, Human
uauauuuugaguuugauuucaccagaaauaau

SEQ ID NO: 491065 - RNA, 32 nt, Human
uauauuuugcaucucagcagaagguugagugc

SEQ ID NO: 491066 - RNA, 32 nt, Human
uauauuuuuaaucguucuuugcccuaaagacu

SEQ ID NO: 491067 - RNA, 32 nt, Human
uauauuuuugugcauccuucucccagaugacu

SEQ ID NO: 491068 - RNA, 32 nt, Human
uaucaaaauguagccuuuggggagggagggga

SEQ ID NO: 491069 - RNA, 32 nt, Human
uaucaaaauugcuuguuuaauucucuaaugca

SEQ ID NO: 491070 - RNA, 32 nt, Human
uaucaaacccccaagaugcugaugauaggccu

SEQ ID NO: 491071 - RNA, 32 nt, Human
uaucaaacuaauuacaaccaagaaauaauagu

SEQ ID NO: 491072 - RNA, 32 nt, Human
uaucaaacuuccggaacugccaccccaccagu

SEQ ID NO: 491073 - RNA, 32 nt, Human
uaucaaagcccaagaaauggaacuuugggcag

SEQ ID NO: 491074 - RNA, 32 nt, Human
uaucaaaguaaccacuucauuauauuuuagug

SEQ ID NO: 491075 - RNA, 32 nt, Human
uaucaaagugagaaaaugccucaauucacaua

SEQ ID NO: 491076 - RNA, 32 nt, Human
uaucaaaguguucuuccuccugucaguucagu

SEQ ID NO: 491077 - RNA, 22 nt, Human
uaucaacaagcauucaagguua

SEQ ID NO: 491078 - RNA, 32 nt, Human
uaucaacacagcauucauucucagggaauuga

SEQ ID NO: 491079 - RNA, 32 nt, Human
uaucaacacuguuacuuucguacauuggcugg

SEQ ID NO: 491080 - RNA, 32 nt, Human
uaucaacagcaaacuucagccguuucacuuuu

SEQ ID NO: 491081 - RNA, 32 nt, Human
uaucaacauauuuuggcaugaaucuguuuuug

SEQ ID NO: 491082 - RNA, 32 nt, Human
uaucaaccugucuaaagaguauuugaagcagu

SEQ ID NO: 491083 - RNA, 32 nt, Human
uaucaaccuuuccaucaugucuguuuuccugg

SEQ ID NO: 491084 - RNA, 32 nt, Human
uaucaacuaggggaggagagagggucuccagu

SEQ ID NO: 491085 - RNA, 32 nt, Human
uaucaacucacagccaaugggugaaagcagau

SEQ ID NO: 491086 - RNA, 32 nt, Human
uaucaacuccacccaucaucauuuggucauga

SEQ ID NO: 491087 - RNA, 32 nt, Human
uaucaacucccaguaccccucucugccguggc

SEQ ID NO: 491088 - RNA, 32 nt, Human
uaucaagaaaauaggcugggugcaguggcuca

SEQ ID NO: 491089 - RNA, 32 nt, Human
uaucaagaaagcagauuuggcaguucaaaaga

SEQ ID NO: 491090 - RNA, 32 nt, Human
uaucaagaagucagagaaaacacuuuccugga

SEQ ID NO: 491091 - RNA, 32 nt, Human
uaucaagacaugggggauagugaacagcauca

SEQ ID NO: 491092 - RNA, 32 nt, Human
uaucaagauaugguucaaauaggacuacuaga

SEQ ID NO: 491093 - RNA, 32 nt, Human
uaucaagccaguguaucagucuggagccuagg

SEQ ID NO: 491094 - RNA, 32 nt, Human
uaucaagccccugucuaaccuacgaccccaga

SEQ ID NO: 491095 - RNA, 32 nt, Human
uaucaaggcugacuuguguucauguggaguca

SEQ ID NO: 491096 - RNA, 32 nt, Human
uaucaagguuccugauucagcacuuugcucuu

SEQ ID NO: 491097 - RNA, 32 nt, Human
uaucaauaaagcuugauuuaacaaacaagaaa

SEQ ID NO: 491098 - RNA, 32 nt, Human
uaucaauaccuaaagaaagugcaucagugaag

SEQ ID NO: 491099 - RNA, 32 nt, Human
uaucaauaggugacuacuuacuacacaugaac

SEQ ID NO: 491100 - RNA, 32 nt, Human
uaucaaucuucauuuuaaaguuguuuuuguuc

SEQ ID NO: 491101 - RNA, 32 nt, Human
uaucacaaaaugcucucauaagaauuauugca

SEQ ID NO: 491102 - RNA, 32 nt, Human
uaucacacaaaacaccagagcugaggauaggg

SEQ ID NO: 491103 - RNA, 32 nt, Human
uaucacacaaugacugcauacagacuucaaau

SEQ ID NO: 491104 - RNA, 32 nt, Human
uaucacacaggcuuucaggacagacuuguaac

SEQ ID NO: 491105 - RNA, 32 nt, Human
uaucacaccacugcacuccagccugggugaca

SEQ ID NO: 491106 - RNA, 32 nt, Human
uaucacaccacugcacuucagccuggaugaca

SEQ ID NO: 491107 - RNA, 32 nt, Human
uaucacaccacugugcucuagccugggugaca

SEQ ID NO: 491108 - RNA, 32 nt, Human
uaucacagaccagcucugcagcaggggauugg

SEQ ID NO: 491109 - RNA, 32 nt, Human
uaucacagaucaagaauggaguacgagugauu

SEQ ID NO: 491110 - RNA, 32 nt, Human
uaucacagccaucucugggauuugaaauaucc

SEQ ID NO: 491111 - RNA, 32 nt, Human
uaucacagccgccuacgcccaccuauggccag

SEQ ID NO: 491112 - RNA, 32 nt, Human
uaucacagccuauaugguagauuccuuuccuu

SEQ ID NO: 491113 - RNA, 32 nt, Human
uaucacagccuucuuucaugauuuugcaguuu

SEQ ID NO: 491114 - RNA, 32 nt, Human
uaucacagcuacuugggaggcagcggcuggag

SEQ ID NO: 491115 - RNA, 32 nt, Human
uaucacaggccuggguggguggguugggggaa

SEQ ID NO: 491116 - RNA, 32 nt, Human
uaucacauagauuucaguuuuuagaaggguuu

SEQ ID NO: 491117 - RNA, 32 nt, Human
uaucacauugacuuccuuugaugucuuuuagu

SEQ ID NO: 491118 - RNA, 32 nt, Human
uaucacauuuuaauaccacagcacuuauaaug

SEQ ID NO: 491119 - RNA, 22 nt, Human
uaucaccaaaugcaaauuugau

SEQ ID NO: 491120 - RNA, 32 nt, Human
uaucaccaggugggagugcaguggcacaaucu

SEQ ID NO: 491121 - RNA, 32 nt, Human
uaucaccauucguucaugaaucaugccuagcu

SEQ ID NO: 491122 - RNA, 32 nt, Human
uaucacccaauugccucugacacugacuaaga

SEQ ID NO: 491123 - RNA, 32 nt, Human
uaucacccacacacaccucgcuggggcagggg

SEQ ID NO: 491124 - RNA, 23 nt, Human
uaucacccaggcuggagugcagu

SEQ ID NO: 491125 - RNA, 32 nt, Human
uaucacccccuaccccuccagcuccgcaaccc

SEQ ID NO: 491126 - RNA, 32 nt, Human
uaucacccccugcacugggauaccaaauuccc

SEQ ID NO: 491127 - RNA, 32 nt, Human
uaucacccugauuccucuaucucccccagccc

SEQ ID NO: 491128 - RNA, 32 nt, Human
uaucacccuggagcacuugguauuccagaccc

SEQ ID NO: 491129 - RNA, 32 nt, Human
uaucaccuccaggacuuucucguuuuccaccu

SEQ ID NO: 491130 - RNA, 32 nt, Human
uaucaccugugguuuuuccuuugagaugaaac

SEQ ID NO: 491131 - RNA, 32 nt, Human
uaucacgccgcugcacuccagcuugaaugaca

SEQ ID NO: 491132 - RNA, 32 nt, Human
uaucacggccacugcccaugucuuggacacug

SEQ ID NO: 491133 - RNA, 31 nt, Human
uaucacgggauugcuuuacauuuaaacuuuu

SEQ ID NO: 491134 - RNA, 32 nt, Human
uaucacgguacagcacgaagccaggcuccuuu

SEQ ID NO: 491135 - RNA, 32 nt, Human
uaucacuaaaauguuaucuucaagagauguua

SEQ ID NO: 491136 - RNA, 32 nt, Human
uaucacuaggaguaggcugagcucuggaaaca

SEQ ID NO: 491137 - RNA, 32 nt, Human
uaucacucaagggggaugcuguggaaaccugg

SEQ ID NO: 491138 - RNA, 32 nt, Human
uaucacugaacaaacuaaaggugcacugcuuu

SEQ ID NO: 491139 - RNA, 32 nt, Human
uaucacugcaaccuccgccuccuggguucaaa

SEQ ID NO: 491140 - RNA, 32 nt, Human
uaucacugcacuccagccuggcugacagagug

SEQ ID NO: 491141 - RNA, 32 nt, Human
uaucacugggguuucccauguugcagcacuuc

SEQ ID NO: 491142 - RNA, 32 nt, Human
uaucacuguagagggaaggaacagaggcccug

SEQ ID NO: 491143 - RNA, 32 nt, Human
uaucacugugaucuuauucugaggggagaaaa

SEQ ID NO: 491144 - RNA, 32 nt, Human
uaucacuguuuaauguuacccaacaagaguua

SEQ ID NO: 491145 - RNA, 32 nt, Human
uaucacuguuugcucaccuaauuuauauacag

SEQ ID NO: 491146 - RNA, 31 nt, Human
uaucacuuacugaagaauaccugaagugauc

SEQ ID NO: 491147 - RNA, 32 nt, Human
uaucacuuccagcacaagcugcagccugcauc

SEQ ID NO: 491148 - RNA, 32 nt, Human
uaucacuucucaggaaguugugagggugagga

SEQ ID NO: 491149 - RNA, 31 nt, Human
uaucacuugaaccuaggaguuggagaccaac

SEQ ID NO: 491150 - RNA, 32 nt, Human
uaucacuuucugagaucaucuuccucauuuau

SEQ ID NO: 491151 - RNA, 32 nt, Human
uaucacuuugggaggccuaggcaggcagauca

SEQ ID NO: 491152 - RNA, 32 nt, Human
uaucagaaaaauaccaaguuauuuuauaaaag

SEQ ID NO: 491153 - RNA, 32 nt, Human
uaucagaaucaucagagaugagcccagaagcu

SEQ ID NO: 491154 - RNA, 32 nt, Human
uaucagacagcugcuggaaaagaaugaaccuc

SEQ ID NO: 491155 - RNA, 32 nt, Human
uaucagacaguacagguauagaacauuuccag

SEQ ID NO: 491156 - RNA, 32 nt, Human
uaucagacauucucaaccuuguuuccaagguu

SEQ ID NO: 491157 - RNA, 32 nt, Human
uaucagacgugcucccucccauccuccagccc

SEQ ID NO: 491158 - RNA, 32 nt, Human
uaucagagacaaggguucaccauguugcccag

SEQ ID NO: 491159 - RNA, 32 nt, Human
uaucagagccgagccuggaaucaaacugccuc

SEQ ID NO: 491160 - RNA, 32 nt, Human
uaucagagcugucagcacuaccucuccccgcu

SEQ ID NO: 491161 - RNA, 32 nt, Human
uaucagaguaagccucuccccuccagagcccu

SEQ ID NO: 491162 - RNA, 32 nt, Human
uaucagagucaagugaacugugguguaugugc

SEQ ID NO: 491163 - RNA, 32 nt, Human
uaucagaucaaauaaaagcuacaaugacaagu

SEQ ID NO: 491164 - RNA, 32 nt, Human
uaucagaucacaaacuccuagagucuacaugc

SEQ ID NO: 491165 - RNA, 32 nt, Human
uaucagcacacgugugaucaccguaggguaac

SEQ ID NO: 491166 - RNA, 31 nt, Human
uaucagcacuuucagcaucggcucuucagca

SEQ ID NO: 491167 - RNA, 32 nt, Human
uaucagcagaguaguaggcacaguuguaaaaa

SEQ ID NO: 491168 - RNA, 32 nt, Human
uaucagcagccuguguaaccccuuuccuguaa

SEQ ID NO: 491169 - RNA, 32 nt, Human
uaucagccacccaggaagcacaugcacaacug

SEQ ID NO: 491170 - RNA, 32 nt, Human
uaucagccagaggcuucauuuuaucaucugug

SEQ ID NO: 491171 - RNA, 32 nt, Human
uaucagccagagggggaagaaggguggcucua

SEQ ID NO: 491172 - RNA, 32 nt, Human
uaucagcuauuuccugucuuacuugaaaaguc

SEQ ID NO: 491173 - RNA, 32 nt, Human
uaucagcucacuauaagcuccaccucccaggu

SEQ ID NO: 491174 - RNA, 32 nt, Human
uaucagcuguguccaaagacugugcuucaucc

SEQ ID NO: 491175 - RNA, 32 nt, Human
uaucaggaacagcuaugggagccccagggucu

SEQ ID NO: 491176 - RNA, 32 nt, Human
uaucaggaacuagggagagaaauaaaugcagg

SEQ ID NO: 491177 - RNA, 32 nt, Human
uaucaggagacagggucugagagcagacaacc

SEQ ID NO: 491178 - RNA, 32 nt, Human
uaucaggagcccaggucuccagcuggagggaa

SEQ ID NO: 491179 - RNA, 32 nt, Human
uaucaggaggcugaggcagagaaucacuugaa

SEQ ID NO: 491180 - RNA, 32 nt, Human
uaucaggaggugaugcuggagaccugcggacu

SEQ ID NO: 491181 - RNA, 32 nt, Human
uaucaggaguugucaaggcagagaagagagug

SEQ ID NO: 491182 - RNA, 32 nt, Human
uaucaggauacugugagcaacauggugucccu

SEQ ID NO: 491183 - RNA, 32 nt, Human
uaucaggcacugagccacugcgcccagucaac

SEQ ID NO: 491184 - RNA, 21 nt, Human
uaucaggcacuuuucaugcug

SEQ ID NO: 491185 - RNA, 27 nt, Human
uaucaggcauaagguuuucucaugcug

SEQ ID NO: 491186 - RNA, 32 nt, Human
uaucaggccagcugcagccucuugccuugacc

SEQ ID NO: 491187 - RNA, 32 nt, Human
uaucaggcucaaaugaaugaaaggaggauguu

SEQ ID NO: 491188 - RNA, 32 nt, Human
uaucaggcuggccgagagucacccauguucuc

SEQ ID NO: 491189 - RNA, 32 nt, Human
uaucaggcugggauaaagacuucugcagaaga

SEQ ID NO: 491190 - RNA, 32 nt, Human
uaucagggaaaucauagccaaggggaaaucua

SEQ ID NO: 491191 - RNA, 32 nt, Human
uaucaggggaauagaagggagaaagagaauau

SEQ ID NO: 491192 - RNA, 32 nt, Human
uaucagguacauuccagccuguuggcaacucc

SEQ ID NO: 491193 - RNA, 32 nt, Human
uaucaggugaagcaacacugggcaggauagag

SEQ ID NO: 491194 - RNA, 32 nt, Human
uaucaggugagcuguggaggugggguccuugg

SEQ ID NO: 491195 - RNA, 32 nt, Human
uaucagguuccagagggucugaugucuggcac

SEQ ID NO: 491196 - RNA, 32 nt, Human
uaucagguugacuauauagccauacuugaaaa

SEQ ID NO: 491197 - RNA, 32 nt, Human
uaucaguaaaacaaaggacuugccaugguuca

SEQ ID NO: 491198 - RNA, 32 nt, Human
uaucaguaauccagaauuuaguaguccaugcc

SEQ ID NO: 491199 - RNA, 32 nt, Human
uaucaguagacagcugcugcuuccaugaaacg

SEQ ID NO: 491200 - RNA, 32 nt, Human
uaucagucaaagaagacuuuugaugaggaaua

SEQ ID NO: 491201 - RNA, 21 nt, Human
uaucagucgugucaccagcug

SEQ ID NO: 491202 - RNA, 32 nt, Human
uaucagucuaaacuuagacugccuuuaauguu

SEQ ID NO: 491203 - RNA, 32 nt, Human
uaucagugcagugcguuuaccaugugaaccca

SEQ ID NO: 491204 - RNA, 32 nt, Human
uaucagugcuucccgagugagcauggaacacu

SEQ ID NO: 491205 - RNA, 32 nt, Human
uaucaguguuugcuucaggacuccaccuccuc

SEQ ID NO: 491206 - RNA, 32 nt, Human
uaucaguuacccacucggucccaguuuuguug

SEQ ID NO: 491207 - RNA, 32 nt, Human
uaucaguuaggggacccaagguuuguuuggga

SEQ ID NO: 491208 - RNA, 32 nt, Human
uaucaguuccuuccucccuucaagagucagcu

SEQ ID NO: 491209 - RNA, 32 nt, Human
uaucaguugaaauuaaaucgucuuccaacuug

SEQ ID NO: 491210 - RNA, 32 nt, Human
uaucaguugaguaucuacuaugugcuaggcac

SEQ ID NO: 491211 - RNA, 32 nt, Human
uaucauaaaagccauauauaaaagauccuuuc

SEQ ID NO: 491212 - RNA, 32 nt, Human
uaucauaaccaccagaaaucauacucuccuuu

SEQ ID NO: 491213 - RNA, 32 nt, Human
uaucauaaugugcccuguaucuauuggcagug

SEQ ID NO: 491214 - RNA, 32 nt, Human
uaucauacaugcacauaaaacacuucuugaga

SEQ ID NO: 491215 - RNA, 32 nt, Human
uaucauacuaccucuucuuucuguagggauga

SEQ ID NO: 491216 - RNA, 32 nt, Human
uaucauacuacuguugcuaguacuucauuaua

SEQ ID NO: 491217 - RNA, 32 nt, Human
uaucauacuuccugccucuccccucccccagu

SEQ ID NO: 491218 - RNA, 32 nt, Human
uaucauagacuugcuuucuggcacugguuucc

SEQ ID NO: 491219 - RNA, 32 nt, Human
uaucauagcuccaggauuacuguucagggggu

SEQ ID NO: 491220 - RNA, 32 nt, Human
uaucauauguguauuuaacaguuuuauaucuu

SEQ ID NO: 491221 - RNA, 32 nt, Human
uaucauauuaucuguguuagcauguaguauuu

SEQ ID NO: 491222 - RNA, 32 nt, Human
uaucaucaagagaauuuggaauucugagccag

SEQ ID NO: 491223 - RNA, 32 nt, Human
uaucaucacacaacucagccuggcugauuauc

SEQ ID NO: 491224 - RNA, 32 nt, Human
uaucaucagggaaaacgugggggaagaugaac

SEQ ID NO: 491225 - RNA, 32 nt, Human
uaucaucauaauuucugauguaaagagcauga

SEQ ID NO: 491226 - RNA, 23 nt, Human
uaucaucaucaucgucaucauca

SEQ ID NO: 491227 - RNA, 21 nt, Human
uaucauccaaggguagaugua

SEQ ID NO: 491228 - RNA, 32 nt, Human
uaucauccucaaggacauuacuagugacucag

SEQ ID NO: 491229 - RNA, 32 nt, Human
uaucauccuguaccgugccaucauggccaucg

SEQ ID NO: 491230 - RNA, 32 nt, Human
uaucauccuuacccuucucuuugucucaccca

SEQ ID NO: 491231 - RNA, 32 nt, Human
uaucaucucaggcgucaaccacaugcacacac

SEQ ID NO: 491232 - RNA, 32 nt, Human
uaucaucuccauuugaucaucuccuccaauga

SEQ ID NO: 491233 - RNA, 32 nt, Human
uaucaucucccaggauccaugagguccagugc

SEQ ID NO: 491234 - RNA, 32 nt, Human
uaucaucucccaggauccaugagguccagugu

SEQ ID NO: 491235 - RNA, 32 nt, Human
uaucaucuggcuauuugggaaggaaggacaca

SEQ ID NO: 491236 - RNA, 32 nt, Human
uaucaucuuggccauuuccuuuugagaacuug

SEQ ID NO: 491237 - RNA, 32 nt, Human
uaucaugaaagaaccaagaaucuaguaauuua

SEQ ID NO: 491238 - RNA, 32 nt, Human
uaucaugaauccauuuacugaaaguguccauu

SEQ ID NO: 491239 - RNA, 32 nt, Human
uaucaugagaacagcaaggagggagucugccc

SEQ ID NO: 491240 - RNA, 32 nt, Human
uaucaugagauggagacccucuaucucgugag

SEQ ID NO: 491241 - RNA, 32 nt, Human
uaucaugagcuguucaauaaugacggacgcau

SEQ ID NO: 491242 - RNA, 32 nt, Human
uaucaugaggcuguggaggggagggcugcuuc

SEQ ID NO: 491243 - RNA, 32 nt, Human
uaucaugauauucccccguugcucugaaugag

SEQ ID NO: 491244 - RNA, 18 nt, Human
uaucaugauggcauucca

SEQ ID NO: 491245 - RNA, 32 nt, Human
uaucaugcaaaugcuguauucuucuuuggugg

SEQ ID NO: 491246 - RNA, 32 nt, Human
uaucaugcaacuuggaaaacuguuaguaauaa

SEQ ID NO: 491247 - RNA, 32 nt, Human
uaucaugcagcuuuugaggagucuuuuacacu

SEQ ID NO: 491248 - RNA, 32 nt, Human
uaucaugccacugcacuccagccugggugaca

SEQ ID NO: 491249 - RNA, 32 nt, Human
uaucaugccccuguacuccagccugggugaca

SEQ ID NO: 491250 - RNA, 32 nt, Human
uaucaugcccugugcaaccucuuggccugauc

SEQ ID NO: 491251 - RNA, 32 nt, Human
uaucauggaguagagaaagaaagagcaagagc

SEQ ID NO: 491252 - RNA, 32 nt, Human
uaucauggcaguguucugacagauguauagug

SEQ ID NO: 491253 - RNA, 32 nt, Human
uaucauggcccaggagugaggcauucagggcu

SEQ ID NO: 491254 - RNA, 32 nt, Human
uaucauggcugcaaguaacuucaaaaggaugg

SEQ ID NO: 491255 - RNA, 32 nt, Human
uaucauggcuuccacugcaugaagauaaagag

SEQ ID NO: 491256 - RNA, 29 nt, Human
uaucauggggacaauucaucucuuucgaa

SEQ ID NO: 491257 - RNA, 32 nt, Human
uaucaugggugucaccauugccaucacucaag

SEQ ID NO: 491258 - RNA, 32 nt, Human
uaucauguaucucucuguggugguucauucca

SEQ ID NO: 491259 - RNA, 32 nt, Human
uaucauguccauauuacuugaggagacagcau

SEQ ID NO: 491260 - RNA, 32 nt, Human
uaucaugugcuagauuggaguggggaagugug

SEQ ID NO: 491261 - RNA, 32 nt, Human
uaucauguuaucuucauaacaugcauuuugca

SEQ ID NO: 491262 - RNA, 32 nt, Human
uaucauguuggccaggcuggucucgaacuccu

SEQ ID NO: 491263 - RNA, 32 nt, Human
uaucauucauucuguagccaauggcuuacagu

SEQ ID NO: 491264 - RNA, 32 nt, Human
uaucauucauucuucaguuguugauuuaggag

SEQ ID NO: 491265 - RNA, 32 nt, Human
uaucauucccguuugcaucgcuaaguaagcaa

SEQ ID NO: 491266 - RNA, 32 nt, Human
uaucauuccucuuacuuuauccuuuuuccuua

SEQ ID NO: 491267 - RNA, 32 nt, Human
uaucauugaacccaaaguaggaaaugauagcu

SEQ ID NO: 491268 - RNA, 32 nt, Human
uaucauugcaaauccauuaaagaaggagaagc

SEQ ID NO: 491269 - RNA, 32 nt, Human
uaucauuugagccaggagguugagguugcagu

SEQ ID NO: 491270 - RNA, 32 nt, Human
uaucauuugcuagcauuuaaaauauauaaaga

SEQ ID NO: 491271 - RNA, 32 nt, Human
uaucauuuuagcaccuucucucagggaugacc

SEQ ID NO: 491272 - RNA, 32 nt, Human
uaucauuuucauauccacuuccccaccacuga

SEQ ID NO: 491273 - RNA, 32 nt, Human
uaucauuuuucucccauaauguuuccauaauu

SEQ ID NO: 491274 - RNA, 32 nt, Human
uauccaaaaaccuugagauuugcucauaggaa

SEQ ID NO: 491275 - RNA, 32 nt, Human
uauccaaaaugaaauaaacagaaggaccaaaa

SEQ ID NO: 491276 - RNA, 20 nt, Human
uauccaaacgaggcauucca

SEQ ID NO: 491277 - RNA, 32 nt, Human
uauccaaacucugucuuaauguaaauguaacu

SEQ ID NO: 491278 - RNA, 32 nt, Human
uauccaaacuucuuuuaauuguucacagauuu

SEQ ID NO: 491279 - RNA, 32 nt, Human
uauccaaagaauaaggaggaggaugaacacuu

SEQ ID NO: 491280 - RNA, 32 nt, Human
uauccaaaggagcuugguaagugccuuacugc

SEQ ID NO: 491281 - RNA, 32 nt, Human
uauccaagagauugccaagaguagaagacaga

SEQ ID NO: 491282 - RNA, 32 nt, Human
uauccaaggagguggcugugcagguggccacc

SEQ ID NO: 491283 - RNA, 32 nt, Human
uauccaaggggauggacccaggcucgugggga

SEQ ID NO: 491284 - RNA, 32 nt, Human
uauccaauagcuaucagccacaugugacuacu

SEQ ID NO: 491285 - RNA, 32 nt, Human
uauccaaucugccugugacaugcauuuuacuc

SEQ ID NO: 491286 - RNA, 31 nt, Human
uauccacaaucauagacaaccaaagcaacaa

SEQ ID NO: 491287 - RNA, 32 nt, Human
uauccacagcaacugcugagccccacuacaua

SEQ ID NO: 491288 - RNA, 32 nt, Human
uauccaccaaagacuucauuuguguaucauca

SEQ ID NO: 491289 - RNA, 32 nt, Human
uauccaccagguggcagcaucuugucauacgu

SEQ ID NO: 491290 - RNA, 32 nt, Human
uauccacguucugggagugucauagaaucuca

SEQ ID NO: 491291 - RNA, 32 nt, Human
uauccacuaauggggcagagacaggaagagca

SEQ ID NO: 491292 - RNA, 32 nt, Human
uauccacucucaucuucuuccaauaucaagag

SEQ ID NO: 491293 - RNA, 32 nt, Human
uauccacugcccccucccuccuggugucucug

SEQ ID NO: 491294 - RNA, 32 nt, Human
uauccacuggguaacagugacuacccaugagg

SEQ ID NO: 491295 - RNA, 32 nt, Human
uauccacuguaaaaccauacuacuuucauuuu

SEQ ID NO: 491296 - RNA, 32 nt, Human
uauccacuucuuuugguuccccaguccaaaac

SEQ ID NO: 491297 - RNA, 32 nt, Human
uauccacuugcaaauacuacaaaaagauuguu

SEQ ID NO: 491298 - RNA, 32 nt, Human
uauccacuugcagacacuacaaaaagaguauu

SEQ ID NO: 491299 - RNA, 32 nt, Human
uauccagaaauguccaccugaacaugagccug

SEQ ID NO: 491300 - RNA, 32 nt, Human
uauccagaacucacagcccaaccugcaaccug

SEQ ID NO: 491301 - RNA, 32 nt, Human
uauccagagcauaauuuuccauggccauaguu

SEQ ID NO: 491302 - RNA, 32 nt, Human
uauccagaggcaaacuuuaugaggcuuugaaa

SEQ ID NO: 491303 - RNA, 32 nt, Human
uauccagccacgauggaugacauggcugugga

SEQ ID NO: 491304 - RNA, 32 nt, Human
uauccagccagaaauaaaaaucugccaguggu

SEQ ID NO: 491305 - RNA, 32 nt, Human
uauccagcccaagauuuggugccugcagccuc

SEQ ID NO: 491306 - RNA, 32 nt, Human
uauccagccuuuccuugcaucaucuuccucuu

SEQ ID NO: 491307 - RNA, 32 nt, Human
uauccagcggggaacagugguuacccacgagg

SEQ ID NO: 491308 - RNA, 32 nt, Human
uauccaggaaacacuugcuggagccacucgca

SEQ ID NO: 491309 - RNA, 32 nt, Human
uauccaggagguggaagugaauugcaagugga

SEQ ID NO: 491310 - RNA, 32 nt, Human
uauccaggaguaccacaaccaccaccagugcu

SEQ ID NO: 491311 - RNA, 32 nt, Human
uauccaggauccuuccuuuuccuucuuccucc

SEQ ID NO: 491312 - RNA, 32 nt, Human
uauccaggcugcaguggagccuggugaacuau

SEQ ID NO: 491313 - RNA, 21 nt, Human
uauccaggcuggaaugcggug

SEQ ID NO: 491314 - RNA, 32 nt, Human
uauccaggcuggccucaaacuccugggcucaa

SEQ ID NO: 491315 - RNA, 21 nt, Human
uauccaggcuggugugcagug

SEQ ID NO: 491316 - RNA, 32 nt, Human
uauccaggcuuacacucuagaaacccacaggc

SEQ ID NO: 491317 - RNA, 32 nt, Human
uauccaggguguuccaggugagcuggggaagg

SEQ ID NO: 491318 - RNA, 32 nt, Human
uauccagguguggcaugauggggcaggaggag

SEQ ID NO: 491319 - RNA, 32 nt, Human
uauccagguuccaagccuagaggcuccuuccg

SEQ ID NO: 491320 - RNA, 32 nt, Human
uauccagguuccggcuacacauuuucuaaguc

SEQ ID NO: 491321 - RNA, 32 nt, Human
uauccaguauagcagugacuuugacugcuguu

SEQ ID NO: 491322 - RNA, 32 nt, Human
uauccagucccaaccaacccuuccguuagaug

SEQ ID NO: 491323 - RNA, 32 nt, Human
uauccaguggagaauuuugggcucacccugua

SEQ ID NO: 491324 - RNA, 32 nt, Human
uauccauaaagugcauaugcucagaccaccua

SEQ ID NO: 491325 - RNA, 32 nt, Human
uauccauacacacuaaacacacagguauaugc

SEQ ID NO: 491326 - RNA, 32 nt, Human
uauccauacuauauacacuugaagcaauuggu

SEQ ID NO: 491327 - RNA, 32 nt, Human
uauccauaugugaagaacuggagaagaaggag

SEQ ID NO: 491328 - RNA, 32 nt, Human
uauccaucuguuuauuucuauaccuuucaaua

SEQ ID NO: 491329 - RNA, 32 nt, Human
uauccaugaggcugcugcgccauguugcacua

SEQ ID NO: 491330 - RNA, 31 nt, Human
uauccaugauuucucccuguauugaggcuag

SEQ ID NO: 491331 - RNA, 31 nt, Human
uauccauggacaaugucaacucuuaaugacu

SEQ ID NO: 491332 - RNA, 32 nt, Human
uauccauuaaaaauauuuaaaaauuagccaga

SEQ ID NO: 491333 - RNA, 32 nt, Human
uauccauuagcugggacuuaaaugacucacuu

SEQ ID NO: 491334 - RNA, 32 nt, Human
uauccauuccccugauugagggugggugggug

SEQ ID NO: 491335 - RNA, 32 nt, Human
uauccauuuaucuucucucucgugcuuaauua

SEQ ID NO: 491336 - RNA, 32 nt, Human
uauccauuucuuagcuaucaugcuccucaucu

SEQ ID NO: 491337 - RNA, 32 nt, Human
uaucccaaacuaagcuaugugaaauaagagaa

SEQ ID NO: 491338 - RNA, 32 nt, Human
uaucccaaagggguggccagagccaaagccag

SEQ ID NO: 491339 - RNA, 32 nt, Human
uaucccaaccuugccagcauguauccaggauu

SEQ ID NO: 491340 - RNA, 32 nt, Human
uaucccaccaacacucucccagcucccauguc

SEQ ID NO: 491341 - RNA, 32 nt, Human
uaucccacugcacucugcuuaaggguuccugc

SEQ ID NO: 491342 - RNA, 32 nt, Human
uaucccacuguauagauccacagggagcaaac

SEQ ID NO: 491343 - RNA, 32 nt, Human
uaucccagaaacaagaggguccuggccacagc

SEQ ID NO: 491344 - RNA, 32 nt, Human
uaucccagaggucgaggcugcagugagcugug

SEQ ID NO: 491345 - RNA, 32 nt, Human
uaucccagaguuucgaacaggucgugcugacc

SEQ ID NO: 491346 - RNA, 32 nt, Human
uaucccagcgugccccgcggcgggcccuaccg

SEQ ID NO: 491347 - RNA, 32 nt, Human
uaucccagcuacucgggaggccaaggcaggaa

SEQ ID NO: 491348 - RNA, 32 nt, Human
uaucccagcuacucgggaggcugaggcaggag

SEQ ID NO: 491349 - RNA, 32 nt, Human
uaucccagcuacugggagguugaagcagaauu

SEQ ID NO: 491350 - RNA, 32 nt, Human
uaucccagcuacuugggaggcagaggcaggag

SEQ ID NO: 491351 - RNA, 32 nt, Human
uaucccagcuacuugggaggcuaaggcaggga

SEQ ID NO: 491352 - RNA, 32 nt, Human
uaucccagcuacuugggaggcugaagcaugag

SEQ ID NO: 491353 - RNA, 32 nt, Human
uaucccaggaguuuuaguuugaagaauugcaa

SEQ ID NO: 491354 - RNA, 32 nt, Human
uaucccaggaucuggugcuuacucagcauauu

SEQ ID NO: 491355 - RNA, 32 nt, Human
uaucccaugagccucagcauccuggcacccgg

SEQ ID NO: 491356 - RNA, 31 nt, Human
uaucccaugccccagcccccacccucucgug

SEQ ID NO: 491357 - RNA, 32 nt, Human
uaucccauuuucugaugauuugaaggggagaa

SEQ ID NO: 491358 - RNA, 32 nt, Human
uauccccaacuucuagaccugcuccaaacuag

SEQ ID NO: 491359 - RNA, 32 nt, Human
uauccccaccuuggcuaucaucacccgaugag

SEQ ID NO: 491360 - RNA, 32 nt, Human
uauccccagcagaggcuacagaacagcaaaga

SEQ ID NO: 491361 - RNA, 32 nt, Human
uauccccaguaacagugaucccuuuucuuauu

SEQ ID NO: 491362 - RNA, 32 nt, Human
uauccccagugcugggauggcacacagguguc

SEQ ID NO: 491363 - RNA, 32 nt, Human
uauccccaguucucgggagaaagaguccgcga

SEQ ID NO: 491364 - RNA, 32 nt, Human
uauccccaucauuccaaaaugcuugcuugucu

SEQ ID NO: 491365 - RNA, 28 nt, Human
uaucccccaagugccuucccucaugccu

SEQ ID NO: 491366 - RNA, 32 nt, Human
uaucccccuaacaacagggaaguuuuaucagu

SEQ ID NO: 491367 - RNA, 32 nt, Human
uaucccccugcucuagccaagguggccgcagu

SEQ ID NO: 491368 - RNA, 32 nt, Human
uauccccuacaucuggcagcauguggagcagg

SEQ ID NO: 491369 - RNA, 32 nt, Human
uauccccuccccucugcuugagccuugagccu

SEQ ID NO: 491370 - RNA, 32 nt, Human
uauccccucuacucuuacuucccccaaauuua

SEQ ID NO: 491371 - RNA, 32 nt, Human
uauccccuugcaaauucuugucuuccaaucau

SEQ ID NO: 491372 - RNA, 32 nt, Human
uauccccuuuuaacagaugagaaaaauacaac

SEQ ID NO: 491373 - RNA, 32 nt, Human
uaucccgaaaaguuacaugucaccuccacgag

SEQ ID NO: 491374 - RNA, 32 nt, Human
uaucccgagggugcggcgugaagaggagccug

SEQ ID NO: 491375 - RNA, 32 nt, Human
uaucccgggaauucaagguugcagugagcuau

SEQ ID NO: 491376 - RNA, 32 nt, Human
uaucccggggagccaggaagcagugagcccag

SEQ ID NO: 491377 - RNA, 32 nt, Human
uaucccgguuccaagccuagaggauccuucca

SEQ ID NO: 491378 - RNA, 32 nt, Human
uaucccuacaauauuugcauuucauguuuuua

SEQ ID NO: 491379 - RNA, 32 nt, Human
uaucccuagaagcagagcuggaguaaggacuu

SEQ ID NO: 491380 - RNA, 32 nt, Human
uaucccuagcacaaagcaagugccuggcacau

SEQ ID NO: 491381 - RNA, 32 nt, Human
uaucccuaggagagaugaaauuugagagguga

SEQ ID NO: 491382 - RNA, 32 nt, Human
uaucccuauuccuaaagauucccaucaaugaa

SEQ ID NO: 491383 - RNA, 32 nt, Human
uaucccucacccuuccgcggaaagagcccccu

SEQ ID NO: 491384 - RNA, 32 nt, Human
uaucccuccagugguaccugucacugcaaaug

SEQ ID NO: 491385 - RNA, 32 nt, Human
uaucccuccucccauccacacacacaggcacc

SEQ ID NO: 491386 - RNA, 32 nt, Human
uaucccuccugagacaucuuugcugcaagauc

SEQ ID NO: 491387 - RNA, 32 nt, Human
uaucccugacagcugcugcacuagccuuccug

SEQ ID NO: 491388 - RNA, 32 nt, Human
uaucccugcccagccuguggugcuugaaacgu

SEQ ID NO: 491389 - RNA, 32 nt, Human
uaucccugcccagggcuguuuucaaauacaau

SEQ ID NO: 491390 - RNA, 31 nt, Human
uaucccugccucuucuucgcccuguucugug

SEQ ID NO: 491391 - RNA, 32 nt, Human
uaucccugcucccuuuuuccuccccuucccuc

SEQ ID NO: 491392 - RNA, 32 nt, Human
uaucccuggccacaccuggggaguagccaaga

SEQ ID NO: 491393 - RNA, 32 nt, Human
uaucccuguaacugccaagagcucaggagcca

SEQ ID NO: 491394 - RNA, 32 nt, Human
uaucccuuccagaauaccaagauaauguaagc

SEQ ID NO: 491395 - RNA, 32 nt, Human
uaucccuugguuuauuggcuucaacaucuucu

SEQ ID NO: 491396 - RNA, 32 nt, Human
uauccgaagccuuggcuggcgcaggcugaugg

SEQ ID NO: 491397 - RNA, 32 nt, Human
uauccgaagggcccucaauguccacaaagcca

SEQ ID NO: 491398 - RNA, 32 nt, Human
uauccgagaagaggaggguagaaaugaaggaa

SEQ ID NO: 491399 - RNA, 32 nt, Human
uauccgcaggcuuaaccagcagccuucucagg

SEQ ID NO: 491400 - RNA, 32 nt, Human
uauccgcccacaggaagccugcaguccuggaa

SEQ ID NO: 491401 - RNA, 18 nt, Human
uauccgccuggcauuuca

SEQ ID NO: 491402 - RNA, 32 nt, Human
uauccgcuuccuguggaagcaagaccaaaagg

SEQ ID NO: 491403 - RNA, 32 nt, Human
uauccgggacucgggucccaaccucucuaaac

SEQ ID NO: 491404 - RNA, 17 nt, Human
uauccgggguucauucc

SEQ ID NO: 491405 - RNA, 32 nt, Human
uauccgucuuacaacuuugauuuuggaaagua

SEQ ID NO: 491406 - RNA, 32 nt, Human
uauccgugcugccccggaccccugugacuggc

SEQ ID NO: 491407 - RNA, 32 nt, Human
uauccuaaacccuuaaccuaaauuuaacuuga

SEQ ID NO: 491408 - RNA, 32 nt, Human
uauccuagcuacucaggaggcugaggcaggag

SEQ ID NO: 491409 - RNA, 32 nt, Human
uauccuagguaucaucauuuauccaaguacuu

SEQ ID NO: 491410 - RNA, 32 nt, Human
uauccucaauaugcaugucugcccaucacauc

SEQ ID NO: 491411 - RNA, 32 nt, Human
uauccucagcuuauaggaaucucuccagguca

SEQ ID NO: 491412 - RNA, 32 nt, Human
uauccucaucuaaauacugagaggcuaguugg

SEQ ID NO: 491413 - RNA, 32 nt, Human
uauccuccacaucuagccugugcccagcacac

SEQ ID NO: 491414 - RNA, 32 nt, Human
uauccuccccuccacuccagcccaccggugac

SEQ ID NO: 491415 - RNA, 32 nt, Human
uauccucggcgaacaugucucuccugagucca

SEQ ID NO: 491416 - RNA, 32 nt, Human
uauccucucccacuuucucuucccucuacuca

SEQ ID NO: 491417 - RNA, 32 nt, Human
uauccucugagagacuuagagguggggaauaa

SEQ ID NO: 491418 - RNA, 32 nt, Human
uauccucuguaagaaugucagaaaagguugac

SEQ ID NO: 491419 - RNA, 32 nt, Human
uauccucuuccuccucuuccuccuccuggugg

SEQ ID NO: 491420 - RNA, 32 nt, Human
uauccucuuggacuucccagccuucagaacug

SEQ ID NO: 491421 - RNA, 32 nt, Human
uauccucuuuuuauugcuuugucuauguuuca

SEQ ID NO: 491422 - RNA, 32 nt, Human
uauccugaggagcaauugggggagguuuagaa

SEQ ID NO: 491423 - RNA, 32 nt, Human
uauccugaguacugggauuacaggcgcccacc

SEQ ID NO: 491424 - RNA, 32 nt, Human
uauccugcucuuuuggaaacguauuccggaag

SEQ ID NO: 491425 - RNA, 32 nt, Human
uauccuggaaacauaugucacaugcgggaacu

SEQ ID NO: 491426 - RNA, 32 nt, Human
uauccuggccaacauggugaaaccccgucucu

SEQ ID NO: 491427 - RNA, 32 nt, Human
uauccugggacuuggaagcuggcaggauuugc

SEQ ID NO: 491428 - RNA, 32 nt, Human
uauccugggccagaggggacagcuggacagug

SEQ ID NO: 491429 - RNA, 32 nt, Human
uauccuggggccacccucccugccuccaaaac

SEQ ID NO: 491430 - RNA, 32 nt, Human
uauccugggucuuggcuuuucccccauuuguu

SEQ ID NO: 491431 - RNA, 32 nt, Human
uauccugucccuccaccccacccuccaccuca

SEQ ID NO: 491432 - RNA, 32 nt, Human
uauccuguuuggagacuccaacagucagguga

SEQ ID NO: 491433 - RNA, 32 nt, Human
uauccuguuuuaugaagaaagcagaaauaauu

SEQ ID NO: 491434 - RNA, 32 nt, Human
uauccuuacuucugucuccacucugauaccag

SEQ ID NO: 491435 - RNA, 32 nt, Human
uauccuuaucuaguguuugauugucaaugcug

SEQ ID NO: 491436 - RNA, 32 nt, Human
uauccuuauucacggcauugggucaccaacuc

SEQ ID NO: 491437 - RNA, 32 nt, Human
uauccuuccaggcugcuuaagaauggacugcu

SEQ ID NO: 491438 - RNA, 32 nt, Human
uauccuucgugcgcuaugggagcugcuguggc

SEQ ID NO: 491439 - RNA, 32 nt, Human
uauccuucuugcaaagugcuucccuugauucc

SEQ ID NO: 491440 - RNA, 32 nt, Human
uauccuugaccuauaucuccccauuuccucuc

SEQ ID NO: 491441 - RNA, 32 nt, Human
uauccuugauuuuucauuguguaucuguuugg

SEQ ID NO: 491442 - RNA, 32 nt, Human
uauccuugcaccugacacuguccccacacaaa

SEQ ID NO: 491443 - RNA, 32 nt, Human
uauccuugggggcucccagggcaaggguuaag

SEQ ID NO: 491444 - RNA, 32 nt, Human
uauccuuuauaaggaaugugcuccuagccacu

SEQ ID NO: 491445 - RNA, 32 nt, Human
uauccuuuccccuuuguuuuccuuccuuucuu

SEQ ID NO: 491446 - RNA, 32 nt, Human
uauccuuuccucaaccuccuccuuucccaauu

SEQ ID NO: 491447 - RNA, 32 nt, Human
uauccuuucucuuuccucaucuccuaucacuc

SEQ ID NO: 491448 - RNA, 32 nt, Human
uauccuuuguccuguucagagagaccagggcc

SEQ ID NO: 491449 - RNA, 32 nt, Human
uauccuuuucccaacaaaagcucacagucuaa

SEQ ID NO: 491450 - RNA, 32 nt, Human
uaucgaaucuaucagcuuuuucucaauggaaa

SEQ ID NO: 491451 - RNA, 32 nt, Human
uaucgacuacuaaaugagagauuuucagaccc

SEQ ID NO: 491452 - RNA, 32 nt, Human
uaucgagccugaccaccgcaagccaggaagca

SEQ ID NO: 491453 - RNA, 32 nt, Human
uaucgauaaacaguaaaguaauucuaaauacc

SEQ ID NO: 491454 - RNA, 32 nt, Human
uaucgauagcccaggcaggaguacaguggcac

SEQ ID NO: 491455 - RNA, 32 nt, Human
uaucgaugacuugguggcuuuuccuugaaucc

SEQ ID NO: 491456 - RNA, 32 nt, Human
uaucgcaccacagcgcuccagccuggucgaca

SEQ ID NO: 491457 - RNA, 32 nt, Human
uaucgcaccacugcacuccagccugggcaaca

SEQ ID NO: 491458 - RNA, 32 nt, Human
uaucgcaccauuguacuccagccugugugaca

SEQ ID NO: 491459 - RNA, 32 nt, Human
uaucgcaugaugagcuaugaccacuggagcag

SEQ ID NO: 491460 - RNA, 32 nt, Human
uaucgccacugcacuccagccugggugacaga

SEQ ID NO: 491461 - RNA, 23 nt, Human
uaucgcccaggauggagugcagu

SEQ ID NO: 491462 - RNA, 23 nt, Human
uaucgcccaggcuggaguacagu

SEQ ID NO: 491463 - RNA, 23 nt, Human
uaucgcccaggcuggagugcaau

SEQ ID NO: 491464 - RNA, 23 nt, Human
uaucgcccaggcuggagugcagu

SEQ ID NO: 491465 - RNA, 32 nt, Human
uaucgccucugccucccaaaucuucaccugcu

SEQ ID NO: 491466 - RNA, 19 nt, Human
uaucgcgccaucacggaag

SEQ ID NO: 491467 - RNA, 32 nt, Human
uaucgcucuuccccucuccucggccacucccc

SEQ ID NO: 491468 - RNA, 32 nt, Human
uaucgcugccuugccaugucuuguucagaaga

SEQ ID NO: 491469 - RNA, 32 nt, Human
uaucgcuggaauuaaggugugagccacugugc

SEQ ID NO: 491470 - RNA, 32 nt, Human
uaucgcuuucccuuuuuccucucccuccgccc

SEQ ID NO: 491471 - RNA, 32 nt, Human
uaucggcagugugggaaaugcgaagcauuucu

SEQ ID NO: 491472 - RNA, 32 nt, Human
uaucggccuugugucagcaggucauggucccu

SEQ ID NO: 491473 - RNA, 32 nt, Human
uaucggggacugugccguguuccucucugccg

SEQ ID NO: 491474 - RNA, 32 nt, Human
uaucgggguacgggacagggaggaggccucau

SEQ ID NO: 491475 - RNA, 32 nt, Human
uaucggucuccuuuccccuccuccccguucuc

SEQ ID NO: 491476 - RNA, 32 nt, Human
uaucggugcaggaaaggcaaagaagggaacau

SEQ ID NO: 491477 - RNA, 32 nt, Human
uaucguaaaauuaagaaaggauaaaguuggua

SEQ ID NO: 491478 - RNA, 32 nt, Human
uaucguaucccuugccaucugaacuuguuugc

SEQ ID NO: 491479 - RNA, 32 nt, Human
uaucguaugauagaaagacauucuuccccagg

SEQ ID NO: 491480 - RNA, 32 nt, Human
uaucguauugaaucuagauuacauuggguuau

SEQ ID NO: 491481 - RNA, 32 nt, Human
uaucguccugcugaagcaggccacagcugugc

SEQ ID NO: 491482 - RNA, 32 nt, Human
uaucgucuggugugguggcucacaccuguaau

SEQ ID NO: 491483 - RNA, 32 nt, Human
uaucgugagaucugguaguuuaaaagugugua

SEQ ID NO: 491484 - RNA, 32 nt, Human
uaucgugccacugcacuccagccuggaggaca

SEQ ID NO: 491485 - RNA, 32 nt, Human
uaucgugccacugcauuccagccugggugaca

SEQ ID NO: 491486 - RNA, 32 nt, Human
uaucguggacuuuauaaaagcaaaggaaauug

SEQ ID NO: 491487 - RNA, 32 nt, Human
uaucgugugugcauguacaugcaugggcacug

SEQ ID NO: 491488 - RNA, 32 nt, Human
uaucguuuuugaaggagaucuuuuuaaaaccu

SEQ ID NO: 491489 - RNA, 32 nt, Human
uaucuaaaaaucaagucucggcaguggcucau

SEQ ID NO: 491490 - RNA, 32 nt, Human
uaucuaaaugccacucauuugguccugcgcau

SEQ ID NO: 491491 - RNA, 32 nt, Human
uaucuaaaugggauuuugaguucuccagcuau

SEQ ID NO: 491492 - RNA, 32 nt, Human
uaucuaaauuauaacauacaauuauuuuauaa

SEQ ID NO: 491493 - RNA, 32 nt, Human
uaucuaacuuuccuucccuccauugaguacgu

SEQ ID NO: 491494 - RNA, 32 nt, Human
uaucuaaggaaaaaggugaauauguuuuugua

SEQ ID NO: 491495 - RNA, 32 nt, Human
uaucuaauucuuuaaugauuccuauaaaucua

SEQ ID NO: 491496 - RNA, 32 nt, Human
uaucuacaaaggaaagagaaaggugagaaaua

SEQ ID NO: 491497 - RNA, 32 nt, Human
uaucuacaagccgcuggggcuugggggcucca

SEQ ID NO: 491498 - RNA, 32 nt, Human
uaucuacagaaggaaagaauccccuacgccac

SEQ ID NO: 491499 - RNA, 32 nt, Human
uaucuacaucuucacggucucugagauccuga

SEQ ID NO: 491500 - RNA, 32 nt, Human
uaucuaccccagaugccugccucugcccccac

SEQ ID NO: 491501 - RNA, 32 nt, Human
uaucuacccugacuaaagcuugaaaugcuaca

SEQ ID NO: 491502 - RNA, 32 nt, Human
uaucuacccugacuaaagcuugaaaugcugca

SEQ ID NO: 491503 - RNA, 32 nt, Human
uaucuacugagugccuguuaugugccaaacac

SEQ ID NO: 491504 - RNA, 31 nt, Human
uaucuacugcuacagauccuguugaagaaag

SEQ ID NO: 491505 - RNA, 32 nt, Human
uaucuacugcucaugaaaucucuggauuuaac

SEQ ID NO: 491506 - RNA, 32 nt, Human
uaucuacugcuccuuuuuacugccuucagagg

SEQ ID NO: 491507 - RNA, 32 nt, Human
uaucuacuuauccagguuugcaaauguacaug

SEQ ID NO: 491508 - RNA, 32 nt, Human
uaucuagaccuuagccagcaggagacucacug

SEQ ID NO: 491509 - RNA, 32 nt, Human
uaucuagccuccugccaaaauugaugcucaga

SEQ ID NO: 491510 - RNA, 32 nt, Human
uaucuaggaagaaugacugagggauaguauug

SEQ ID NO: 491511 - RNA, 32 nt, Human
uaucuaggaagugucuugccaggucaccaaau

SEQ ID NO: 491512 - RNA, 32 nt, Human
uaucuaggcuuagggagcccugggacccugcc

SEQ ID NO: 491513 - RNA, 32 nt, Human
uaucuaguauugaggcuugcucuuucaugugg

SEQ ID NO: 491514 - RNA, 32 nt, Human
uaucuagugaugcagaauaucaaggaggccac

SEQ ID NO: 491515 - RNA, 32 nt, Human
uaucuaguuccagcuacuugagaggcugaggc

SEQ ID NO: 491516 - RNA, 32 nt, Human
uaucuauaaagugaauguucaacaacaaugau

SEQ ID NO: 491517 - RNA, 32 nt, Human
uaucuauacauuuuacagucucuaauacuuag

SEQ ID NO: 491518 - RNA, 32 nt, Human
uaucuauaugcacauacauacauauauacaca

SEQ ID NO: 491519 - RNA, 32 nt, Human
uaucuaucucccagaacagaacaugugccaau

SEQ ID NO: 491520 - RNA, 32 nt, Human
uaucuaucuuuguucuccuuggcaacugagag

SEQ ID NO: 491521 - RNA, 32 nt, Human
uaucuaugcauacauauauacacacauaugua

SEQ ID NO: 491522 - RNA, 32 nt, Human
uaucuaugccuuucuggcugauuuuuguagag

SEQ ID NO: 491523 - RNA, 32 nt, Human
uaucuaugcuuugcaaagacuaaggcguauua

SEQ ID NO: 491524 - RNA, 32 nt, Human
uaucuauguaacaaaucgcagcacaggagucc

SEQ ID NO: 491525 - RNA, 32 nt, Human
uaucuaugugcagcaugacucucuccagguga

SEQ ID NO: 491526 - RNA, 32 nt, Human
uaucuauuaaaagacaaaaauuagcugggcgu

SEQ ID NO: 491527 - RNA, 32 nt, Human
uaucuauuuacacuauuagccuaguuuucuca

SEQ ID NO: 491528 - RNA, 32 nt, Human
uaucuauuucacuugaccccugcccaccucuc

SEQ ID NO: 491529 - RNA, 32 nt, Human
uaucuauuugcaccuuaaaagacagcuagauu

SEQ ID NO: 491530 - RNA, 32 nt, Human
uaucucaaguaauuuggugucauuuacaaaag

SEQ ID NO: 491531 - RNA, 32 nt, Human
uaucucaccuucccaaaagacacuguguaagu

SEQ ID NO: 491532 - RNA, 32 nt, Human
uaucucacgccuguagucccagcacuuuggga

SEQ ID NO: 491533 - RNA, 32 nt, Human
uaucucagaguccucaacguggguguggccga

SEQ ID NO: 491534 - RNA, 32 nt, Human
uaucucagccuccugaguagcugggauuacag

SEQ ID NO: 491535 - RNA, 25 nt, Human
uaucucagcucacugcaaacucugc

SEQ ID NO: 491536 - RNA, 32 nt, Human
uaucucagcucacugcaaccacugccucccag

SEQ ID NO: 491537 - RNA, 23 nt, Human
uaucucagcucacugcaaccucc

SEQ ID NO: 491538 - RNA, 32 nt, Human
uaucucagcucacugcaaccuccgccucccag

SEQ ID NO: 491539 - RNA, 32 nt, Human
uaucucagcuguacaugcucugccuguggaga

SEQ ID NO: 491540 - RNA, 32 nt, Human
uaucucaggcugggaagaacacaucuugggcc

SEQ ID NO: 491541 - RNA, 32 nt, Human
uaucucaguaaccuuaaauaggaaaaguacuc

SEQ ID NO: 491542 - RNA, 32 nt, Human
uaucucagugccuuuacagugccagggauggg

SEQ ID NO: 491543 - RNA, 32 nt, Human
uaucucaguucuguagcagaucccugguucag

SEQ ID NO: 491544 - RNA, 32 nt, Human
uaucucauaguuccggacuaaauacuggcuuu

SEQ ID NO: 491545 - RNA, 32 nt, Human
uaucucauccaccucuucucuuuguuggguau

SEQ ID NO: 491546 - RNA, 32 nt, Human
uaucucaucuguccccucuccuggggcuuaag

SEQ ID NO: 491547 - RNA, 32 nt, Human
uaucucaugccuauaaucccagcacuuuggga

SEQ ID NO: 491548 - RNA, 32 nt, Human
uaucucauuuuaaaaagaaguucuuuaugaaa

SEQ ID NO: 491549 - RNA, 32 nt, Human
uaucuccaaagagggauuacaaggucaaagag

SEQ ID NO: 491550 - RNA, 32 nt, Human
uaucuccacccacacuaucauagauuccuuag

SEQ ID NO: 491551 - RNA, 32 nt, Human
uaucuccacuaaaaauacaaaauuagcugggu

SEQ ID NO: 491552 - RNA, 32 nt, Human
uaucucccagacccuucucuugaaguccaaua

SEQ ID NO: 491553 - RNA, 32 nt, Human
uaucucccaggcucuguaucuacugguuccug

SEQ ID NO: 491554 - RNA, 32 nt, Human
uaucuccccaaaaauguauagugccuuguuuu

SEQ ID NO: 491555 - RNA, 32 nt, Human
uaucuccccaggagcagcaucucugagcaccc

SEQ ID NO: 491556 - RNA, 32 nt, Human
uaucucccugcccucugcucucacaggcuggg

SEQ ID NO: 491557 - RNA, 32 nt, Human
uaucucccuggcucacuggcaggugugggauc

SEQ ID NO: 491558 - RNA, 32 nt, Human
uaucuccgcaggcuauuuguucagagaggccu

SEQ ID NO: 491559 - RNA, 32 nt, Human
uaucuccggaaagaguccuggugacccagcga

SEQ ID NO: 491560 - RNA, 19 nt, Human
uaucuccuaguguuuaaau

SEQ ID NO: 491561 - RNA, 32 nt, Human
uaucuccucaucucccccucccuuuugggaaa

SEQ ID NO: 491562 - RNA, 32 nt, Human
uaucuccugcaaccucagugccucagccugag

SEQ ID NO: 491563 - RNA, 32 nt, Human
uaucuccugccugucugccucuguccugcuuu

SEQ ID NO: 491564 - RNA, 32 nt, Human
uaucuccuguucucugagaguaccaugguguu

SEQ ID NO: 491565 - RNA, 32 nt, Human
uaucuccuuuaucaaaacaacaguaauaacaa

SEQ ID NO: 491566 - RNA, 32 nt, Human
uaucucggcucacugcaaccacugccucccag

SEQ ID NO: 491567 - RNA, 25 nt, Human
uaucucggcucacugcaagcuccgc

SEQ ID NO: 491568 - RNA, 32 nt, Human
uaucucggugcugccgggggaggcgggaggag

SEQ ID NO: 491569 - RNA, 32 nt, Human
uaucucgucuuuccuccuuagaagaacagacc

SEQ ID NO: 491570 - RNA, 32 nt, Human
uaucucuaaaacacagaaggcggugcagggug

SEQ ID NO: 491571 - RNA, 32 nt, Human
uaucucuaauaaaaauacaaaaauuagcuggg

SEQ ID NO: 491572 - RNA, 32 nt, Human
uaucucuacagggguccucggucuccaucuac

SEQ ID NO: 491573 - RNA, 32 nt, Human
uaucucuacaucauuuuaacagcugguauggc

SEQ ID NO: 491574 - RNA, 32 nt, Human
uaucucuaccaaaaauacaaaaauuagccagg

SEQ ID NO: 491575 - RNA, 32 nt, Human
uaucucuacuaaaaacgcacagaaaaauuagc

SEQ ID NO: 491576 - RNA, 32 nt, Human
uaucucuacuaaaaauacaaaaagauuagcca

SEQ ID NO: 491577 - RNA, 32 nt, Human
uaucucuacuaaaaauacaaaaauuaaccagg

SEQ ID NO: 491578 - RNA, 32 nt, Human
uaucucuacuaaaaauacaaaaauuagccggg

SEQ ID NO: 491579 - RNA, 32 nt, Human
uaucucuacuaaaaauacaaaaauuagcuagg

SEQ ID NO: 491580 - RNA, 32 nt, Human
uaucucuacuaaaaauacaaaaauuagcuggg

SEQ ID NO: 491581 - RNA, 32 nt, Human
uaucucuacuaaaaauacaaaaauuaucgggg

SEQ ID NO: 491582 - RNA, 32 nt, Human
uaucucuacuaaaaauacaaaaauuaucuggg

SEQ ID NO: 491583 - RNA, 32 nt, Human
uaucucuacuaaaaauacaaaauuagccaggc

SEQ ID NO: 491584 - RNA, 32 nt, Human
uaucucuacuaaaaauaccaaaauuagcuggg

SEQ ID NO: 491585 - RNA, 32 nt, Human
uaucucuacuaaaaauagaaaaauuagcuagg

SEQ ID NO: 491586 - RNA, 32 nt, Human
uaucucuacuaaaauacaaaaauuagcugggc

SEQ ID NO: 491587 - RNA, 32 nt, Human
uaucucucauucucaccucaacccacuuuacc

SEQ ID NO: 491588 - RNA, 32 nt, Human
uaucucucauuucuuugccuucagcagaauca

SEQ ID NO: 491589 - RNA, 32 nt, Human
uaucucucccugggcugccaccagagaaggug

SEQ ID NO: 491590 - RNA, 32 nt, Human
uaucucuccuaaaaauacaaaaauuagccggg

SEQ ID NO: 491591 - RNA, 32 nt, Human
uaucucucugcaggcucgccucugggcuuugu

SEQ ID NO: 491592 - RNA, 32 nt, Human
uaucucucuguggacagugguggccgccgugc

SEQ ID NO: 491593 - RNA, 32 nt, Human
uaucucugaccuggaggucugccuguaucuuu

SEQ ID NO: 491594 - RNA, 32 nt, Human
uaucucugauaauucaaaaaugcuaauaaacu

SEQ ID NO: 491595 - RNA, 32 nt, Human
uaucucugcccuccuccacucccuuuuuguaa

SEQ ID NO: 491596 - RNA, 32 nt, Human
uaucucuggccuuacccugccuuccugccucc

SEQ ID NO: 491597 - RNA, 32 nt, Human
uaucucugggaaaaaggagcagcauuuggcca

SEQ ID NO: 491598 - RNA, 32 nt, Human
uaucucuggugcuggccucugccccuccaucc

SEQ ID NO: 491599 - RNA, 32 nt, Human
uaucucuguacuccuauaugaagagaacagua

SEQ ID NO: 491600 - RNA, 32 nt, Human
uaucucuguguugguguaucugugccauuggc

SEQ ID NO: 491601 - RNA, 32 nt, Human
uaucucuguuuugguaccaguaccaugauguu

SEQ ID NO: 491602 - RNA, 32 nt, Human
uaucucuucacacauccccaggcccagugcuu

SEQ ID NO: 491603 - RNA, 32 nt, Human
uaucucuucuuucucuuccucucccuccuccu

SEQ ID NO: 491604 - RNA, 32 nt, Human
uaucucuucuuucuguaucuauagguaaaucu

SEQ ID NO: 491605 - RNA, 32 nt, Human
uaucucuuuaugcaauaccucaauuuuucaua

SEQ ID NO: 491606 - RNA, 32 nt, Human
uaucucuuucccuggaaucaacuuguaugaaa

SEQ ID NO: 491607 - RNA, 32 nt, Human
uaucucuuucuuucucuuucuguuuccuggcc

SEQ ID NO: 491608 - RNA, 32 nt, Human
uaucucuuugucuugugucuuauuuauuacaa

SEQ ID NO: 491609 - RNA, 32 nt, Human
uaucucuuugugauaguuuaagccccugcacc

SEQ ID NO: 491610 - RNA, 32 nt, Human
uaucucuuuuugacauuguaauaaacuuguua

SEQ ID NO: 491611 - RNA, 32 nt, Human
uaucugaaagaaauaaccaucuucucaacaug

SEQ ID NO: 491612 - RNA, 32 nt, Human
uaucugaagcccucccagguguuaacauucca

SEQ ID NO: 491613 - RNA, 32 nt, Human
uaucugacaagaaacuuacuuaaccauugugu

SEQ ID NO: 491614 - RNA, 32 nt, Human
uaucugacuuaaaauuaugaauauuuugaaua

SEQ ID NO: 491615 - RNA, 32 nt, Human
uaucugagagugaaggaggggugggaaggugc

SEQ ID NO: 491616 - RNA, 32 nt, Human
uaucugagccacaaccuucuguaauucacuuc

SEQ ID NO: 491617 - RNA, 32 nt, Human
uaucugagucuuuccaagagcaauugccaagg

SEQ ID NO: 491618 - RNA, 32 nt, Human
uaucugaguuccacugggguaaggggaugaau

SEQ ID NO: 491619 - RNA, 32 nt, Human
uaucugaucuacucggggccucaggcuucuca

SEQ ID NO: 491620 - RNA, 32 nt, Human
uaucugcaaauacaagaaaugagaggcuucuc

SEQ ID NO: 491621 - RNA, 32 nt, Human
uaucugcaauacccaagccacagggaagaacu

SEQ ID NO: 491622 - RNA, 32 nt, Human
uaucugcacagcaacccagccuuuccgugcug

SEQ ID NO: 491623 - RNA, 32 nt, Human
uaucugcacccacccauaggugcucuugucua

SEQ ID NO: 491624 - RNA, 32 nt, Human
uaucugcacucccauguucauuucagcauuau

SEQ ID NO: 491625 - RNA, 32 nt, Human
uaucugcaggaguucaagaccagccuggggaa

SEQ ID NO: 491626 - RNA, 32 nt, Human
uaucugcaguguccuugcuguguagcucuuca

SEQ ID NO: 491627 - RNA, 32 nt, Human
uaucugcauaaauauaugucauauauacacau

SEQ ID NO: 491628 - RNA, 32 nt, Human
uaucugcauauucuuuuucccauguggcucua

SEQ ID NO: 491629 - RNA, 32 nt, Human
uaucugcaucgcuucccaccuccgggccuuug

SEQ ID NO: 491630 - RNA, 32 nt, Human
uaucugccaucaucugccauaggaaagauacc

SEQ ID NO: 491631 - RNA, 32 nt, Human
uaucugcccccaugcaggccaggcuggcuacc

SEQ ID NO: 491632 - RNA, 32 nt, Human
uaucugcccuggagccuguacagccaugccac

SEQ ID NO: 491633 - RNA, 32 nt, Human
uaucugccugcuccucucccuccuaaggaaaa

SEQ ID NO: 491634 - RNA, 32 nt, Human
uaucugccuguguggcuuugcauuucaaaugu

SEQ ID NO: 491635 - RNA, 32 nt, Human
uaucugccuucuaagaaggcagaccaggucuu

SEQ ID NO: 491636 - RNA, 32 nt, Human
uaucugcgcacccggagguggggugaggacgg

SEQ ID NO: 491637 - RNA, 32 nt, Human
uaucugcgccgugaggacuugucuccuaaucu

SEQ ID NO: 491638 - RNA, 32 nt, Human
uaucugcuacgguaacuucaucagcccgccaa

SEQ ID NO: 491639 - RNA, 32 nt, Human
uaucugcuaucaggcagcaccaaagguuuuug

SEQ ID NO: 491640 - RNA, 32 nt, Human
uaucugcucaggccuggcaugaccucaauuau

SEQ ID NO: 491641 - RNA, 32 nt, Human
uaucugcucauuuugacaaagugccucaugca

SEQ ID NO: 491642 - RNA, 32 nt, Human
uaucugcugcaccuucacucuccaggguacau

SEQ ID NO: 491643 - RNA, 32 nt, Human
uaucuggagaagguguacaacuuucaaacaca

SEQ ID NO: 491644 - RNA, 32 nt, Human
uaucuggagcagucggggcgggcaggcccagc

SEQ ID NO: 491645 - RNA, 32 nt, Human
uaucuggaggcuggaagucugagaucagagug

SEQ ID NO: 491646 - RNA, 32 nt, Human
uaucuggaucaguaauaaaauauuucaaaggc

SEQ ID NO: 491647 - RNA, 32 nt, Human
uaucuggcagaagaaauuucuaagcagcaaag

SEQ ID NO: 491648 - RNA, 32 nt, Human
uaucuggccagauuuaaguagauucuauuucc

SEQ ID NO: 491649 - RNA, 32 nt, Human
uaucuggccccugaacacaguauacgaagcau

SEQ ID NO: 491650 - RNA, 32 nt, Human
uaucuggcucaagccacucuuacuuuauggac

SEQ ID NO: 491651 - RNA, 32 nt, Human
uaucuggcuggacugaucugucucacaagaag

SEQ ID NO: 491652 - RNA, 32 nt, Human
uaucugggaggcagaguuugccgugagcugag

SEQ ID NO: 491653 - RNA, 32 nt, Human
uaucugggauccacauaauggagacauucuga

SEQ ID NO: 491654 - RNA, 32 nt, Human
uaucugggcuauauacaguccucaaauaaaua

SEQ ID NO: 491655 - RNA, 32 nt, Human
uaucugggucccuagaaggcccuagauguggg

SEQ ID NO: 491656 - RNA, 32 nt, Human
uaucuggucgugaacuccuggccucaagggau

SEQ ID NO: 491657 - RNA, 32 nt, Human
uaucuggugcugaucucacugcauaaugacuu

SEQ ID NO: 491658 - RNA, 32 nt, Human
uaucuguaaaaagagagaaaacauguuuuguu

SEQ ID NO: 491659 - RNA, 32 nt, Human
uaucuguaaaacaagggggugggccaggcgau

SEQ ID NO: 491660 - RNA, 32 nt, Human
uaucuguacuaaaaacacaaaauuagcugggu

SEQ ID NO: 491661 - RNA, 32 nt, Human
uaucuguagaaauugaauuuugcugcaacuaa

SEQ ID NO: 491662 - RNA, 32 nt, Human
uaucugucaaaccauuucuguuagaacgaugu

SEQ ID NO: 491663 - RNA, 32 nt, Human
uaucugucuugcaaaucaguaaacugaagcaa

SEQ ID NO: 491664 - RNA, 32 nt, Human
uaucugucuuuuugcuuuuagcauccuaauga

SEQ ID NO: 491665 - RNA, 32 nt, Human
uaucugugauaauuccagcaggguaaagcggg

SEQ ID NO: 491666 - RNA, 32 nt, Human
uaucugugcaauggaauauaaauaucacaaag

SEQ ID NO: 491667 - RNA, 32 nt, Human
uaucuguggaaaccaacagauauugcucuaua

SEQ ID NO: 491668 - RNA, 32 nt, Human
uaucuguggaaagcuaggcuucccaggcuggg

SEQ ID NO: 491669 - RNA, 32 nt, Human
uaucuguggaguuccugcuccguggacugcag

SEQ ID NO: 491670 - RNA, 32 nt, Human
uaucugugggggagggagggagacgugaagcc

SEQ ID NO: 491671 - RNA, 32 nt, Human
uaucuguguaggucauaucuucucuaguaaac

SEQ ID NO: 491672 - RNA, 32 nt, Human
uaucuguguauauaaauccacaugcacaugaa

SEQ ID NO: 491673 - RNA, 32 nt, Human
uaucuguguccagcggccccagcuccagccca

SEQ ID NO: 491674 - RNA, 32 nt, Human
uaucuguguccggcggccccagcuccagccca

SEQ ID NO: 491675 - RNA, 32 nt, Human
uaucuguguuagauucuagucuugccuaauuu

SEQ ID NO: 491676 - RNA, 32 nt, Human
uaucuguuacggccuccuuuuaucucucuucu

SEQ ID NO: 491677 - RNA, 32 nt, Human
uaucuguuuucaucuugagguggccaauaugg

SEQ ID NO: 491678 - RNA, 32 nt, Human
uaucuuaaaaagagcacugagcagggacuuaa

SEQ ID NO: 491679 - RNA, 32 nt, Human
uaucuuaaaaauggaaguccuaaaaauuaguu

SEQ ID NO: 491680 - RNA, 32 nt, Human
uaucuuaaaaugguucuaaaaauugcauucaa

SEQ ID NO: 491681 - RNA, 32 nt, Human
uaucuuaaagcacuuacagauaggccuucuug

SEQ ID NO: 491682 - RNA, 32 nt, Human
uaucuuaaaggcauuauucuccagccuuaaga

SEQ ID NO: 491683 - RNA, 32 nt, Human
uaucuuacauaccuccaccagacuggacuugc

SEQ ID NO: 491684 - RNA, 32 nt, Human
uaucuuagcugcacuccaacauugcauccuuu

SEQ ID NO: 491685 - RNA, 32 nt, Human
uaucuuauuaugaggcaaguauguuaagauuu

SEQ ID NO: 491686 - RNA, 29 nt, Human
uaucuucaccccacaaacaauaaagcaaa

SEQ ID NO: 491687 - RNA, 32 nt, Human
uaucuucacuuucuuuguccagucuuuuguuu

SEQ ID NO: 491688 - RNA, 32 nt, Human
uaucuucagcuuuggguaggaggaaucuuggu

SEQ ID NO: 491689 - RNA, 32 nt, Human
uaucuucaucauuuuguacauuuccuuuuuga

SEQ ID NO: 491690 - RNA, 32 nt, Human
uaucuucaugccauuacagcuuucuagaugcu

SEQ ID NO: 491691 - RNA, 32 nt, Human
uaucuucauguccagugagcaguguugcguuu

SEQ ID NO: 491692 - RNA, 32 nt, Human
uaucuuccaaaccccacuuucucccuccuccu

SEQ ID NO: 491693 - RNA, 32 nt, Human
uaucuuccaagagggugcuggggaggagaaag

SEQ ID NO: 491694 - RNA, 32 nt, Human
uaucuuccagaggaagaggaggaggcggcgaa

SEQ ID NO: 491695 - RNA, 32 nt, Human
uaucuuccagcuucugucagaacuuuagguca

SEQ ID NO: 491696 - RNA, 32 nt, Human
uaucuuccauuuuacagagagaaaaucccacc

SEQ ID NO: 491697 - RNA, 32 nt, Human
uaucuucccgagagaucagcuacagaggaacc

SEQ ID NO: 491698 - RNA, 32 nt, Human
uaucuucccgucucaaaauggacaugauggau

SEQ ID NO: 491699 - RNA, 32 nt, Human
uaucuucccucccucacuucccuuuucuccca

SEQ ID NO: 491700 - RNA, 32 nt, Human
uaucuuccucaccucucggccuucccacuugc

SEQ ID NO: 491701 - RNA, 32 nt, Human
uaucuucuacaaagaucacuucccaguccauc

SEQ ID NO: 491702 - RNA, 32 nt, Human
uaucuucuauuuuuaucaugaauucccuuuua

SEQ ID NO: 491703 - RNA, 32 nt, Human
uaucuucucacuucucacugguguuggaaaua

SEQ ID NO: 491704 - RNA, 32 nt, Human
uaucuucuccccuucugagccuguccauucau

SEQ ID NO: 491705 - RNA, 32 nt, Human
uaucuucucuggccucuccaguccugcuuacu

SEQ ID NO: 491706 - RNA, 32 nt, Human
uaucuucugaucaggaaguuugagugcuaugc

SEQ ID NO: 491707 - RNA, 32 nt, Human
uaucuucugcugcugcuuggaguuacauuuuc

SEQ ID NO: 491708 - RNA, 32 nt, Human
uaucuucugcuuccugacagcuucuuuuucaa

SEQ ID NO: 491709 - RNA, 32 nt, Human
uaucuucuggcugucuuccugcugugguggaa

SEQ ID NO: 491710 - RNA, 32 nt, Human
uaucuucugggagcuugggcacgaucucaggc

SEQ ID NO: 491711 - RNA, 20 nt, Human
uaucuucuguucuaacaaug

SEQ ID NO: 491712 - RNA, 32 nt, Human
uaucuucuucauuuuuaaccuguuuucauuug

SEQ ID NO: 491713 - RNA, 32 nt, Human
uaucuugagguauuuugccacuggcuucaugc

SEQ ID NO: 491714 - RNA, 32 nt, Human
uaucuugcaaagugaauguguccccuucccca

SEQ ID NO: 491715 - RNA, 32 nt, Human
uaucuugcacacaggugcucuaaccauguuua

SEQ ID NO: 491716 - RNA, 32 nt, Human
uaucuugccuccauaucaauccauucucauga

SEQ ID NO: 491717 - RNA, 32 nt, Human
uaucuugccuccuccuuuauuacccucugagu

SEQ ID NO: 491718 - RNA, 32 nt, Human
uaucuugcuuugacaaauaccaccgugcucag

SEQ ID NO: 491719 - RNA, 32 nt, Human
uaucuuggaauagggcccauguuuagacagag

SEQ ID NO: 491720 - RNA, 32 nt, Human
uaucuuggagugaggucacagaaggauagagc

SEQ ID NO: 491721 - RNA, 30 nt, Human
uaucuuggccucucccaugucucaguguug

SEQ ID NO: 491722 - RNA, 32 nt, Human
uaucuuggcugggaucucacacaugucuagga

SEQ ID NO: 491723 - RNA, 32 nt, Human
uaucuugggagggagaagggauggagcaggag

SEQ ID NO: 491724 - RNA, 32 nt, Human
uaucuugggaguugaguugucaagagaauuau

SEQ ID NO: 491725 - RNA, 32 nt, Human
uaucuugggcugccuuucucuaaguugguugu

SEQ ID NO: 491726 - RNA, 32 nt, Human
uaucuuggucaauuuaccugaccucagcuuuc

SEQ ID NO: 491727 - RNA, 32 nt, Human
uaucuugguuuggaaucgaaacuucugcuaca

SEQ ID NO: 491728 - RNA, 32 nt, Human
uaucuuguagaauugugagcaugugaaugagu

SEQ ID NO: 491729 - RNA, 32 nt, Human
uaucuuguaugccuauguaauucaaagugacu

SEQ ID NO: 491730 - RNA, 32 nt, Human
uaucuuguccgugugggcacacacugaguguu

SEQ ID NO: 491731 - RNA, 32 nt, Human
uaucuuguccuagcccaggccuccaugaagga

SEQ ID NO: 491732 - RNA, 32 nt, Human
uaucuugugcaucccuccucugcucuccauca

SEQ ID NO: 491733 - RNA, 32 nt, Human
uaucuuguuagagagcuuuucacugugaggaa

SEQ ID NO: 491734 - RNA, 32 nt, Human
uaucuuguucucuuccuccaaagacuuggaag

SEQ ID NO: 491735 - RNA, 32 nt, Human
uaucuuuaaauacuuuguacuaacuuuaucac

SEQ ID NO: 491736 - RNA, 32 nt, Human
uaucuuuaagcuauaaauguguuaacauguau

SEQ ID NO: 491737 - RNA, 32 nt, Human
uaucuuuaaucuccucuuuuaucuuggacuga

SEQ ID NO: 491738 - RNA, 32 nt, Human
uaucuuuacagauuuuucauuugagcauggag

SEQ ID NO: 491739 - RNA, 32 nt, Human
uaucuuuacaggagcagggaagagcaguagag

SEQ ID NO: 491740 - RNA, 32 nt, Human
uaucuuuauuuguacuuuuuccuuccucccug

SEQ ID NO: 491741 - RNA, 32 nt, Human
uaucuuucaucuuaccuguaauccuagcacuu

SEQ ID NO: 491742 - RNA, 32 nt, Human
uaucuuuccaggucauacuuguuuuuaaucau

SEQ ID NO: 491743 - RNA, 32 nt, Human
uaucuuucccuuccuucucuacccucaccucc

SEQ ID NO: 491744 - RNA, 32 nt, Human
uaucuuucucucuccaaaugucacugagcccu

SEQ ID NO: 491745 - RNA, 32 nt, Human
uaucuuucuguggcauuugagaacagaaacca

SEQ ID NO: 491746 - RNA, 26 nt, Human
uaucuuugcaauucugaauugugcug

SEQ ID NO: 491747 - RNA, 23 nt, Human
uaucuuugcacugaaguugucug

SEQ ID NO: 491748 - RNA, 32 nt, Human
uaucuuugcccaggaucugaaaggcaauacuu

SEQ ID NO: 491749 - RNA, 31 nt, Human
uaucuuugccucucuuugucucugcauuucc

SEQ ID NO: 491750 - RNA, 21 nt, Human
uaucuuuguucuuguuugcug

SEQ ID NO: 491751 - RNA, 32 nt, Human
uaucuuuuagggacugcagccaauguucccca

SEQ ID NO: 491752 - RNA, 32 nt, Human
uaucuuuucuaaaaauacaaaaauuagccaac

SEQ ID NO: 491753 - RNA, 32 nt, Human
uaucuuuucuaaaaauacaaaaauuagccagg

SEQ ID NO: 491754 - RNA, 32 nt, Human
uaucuuuugcuguccuguccagucccaucaac

SEQ ID NO: 491755 - RNA, 32 nt, Human
uaucuuuuggaggacuaauuuaccuuacugcu

SEQ ID NO: 491756 - RNA, 32 nt, Human
uaucuuuugggggagucuggaagccuguuggu

SEQ ID NO: 491757 - RNA, 32 nt, Human
uaucuuuuucacuuucuugccuguuuugcuuc

SEQ ID NO: 491758 - RNA, 32 nt, Human
uaucuuuuugagacagagucuugcucugucgc

SEQ ID NO: 491759 - RNA, 32 nt, Human
uaugaaaaaccugaaaucacaugccuuuguaa

SEQ ID NO: 491760 - RNA, 32 nt, Human
uaugaaaaaccugaaaucgcaugccuauucac

SEQ ID NO: 491761 - RNA, 32 nt, Human
uaugaaaaagauuauuugugcauuuuauugac

SEQ ID NO: 491762 - RNA, 18 nt, Human
uaugaaaacagugcagua

SEQ ID NO: 491763 - RNA, 32 nt, Human
uaugaaaaggagaggacacagagacagaggag

SEQ ID NO: 491764 - RNA, 32 nt, Human
uaugaaaauuccaguggauagacuuauauggc

SEQ ID NO: 491765 - RNA, 32 nt, Human
uaugaaacauaucaugguaaugacagaugcaa

SEQ ID NO: 491766 - RNA, 32 nt, Human
uaugaaacgucaucuucagugccugcagagug

SEQ ID NO: 491767 - RNA, 32 nt, Human
uaugaaacuuuacaacacuugugaaagcaacu

SEQ ID NO: 491768 - RNA, 32 nt, Human
uaugaaagcccccauucccaucacccccucca

SEQ ID NO: 491769 - RNA, 32 nt, Human
uaugaaaggagagagcaaagggugucugcguc

SEQ ID NO: 491770 - RNA, 32 nt, Human
uaugaaagugccuuuuacucagccugcacaga

SEQ ID NO: 491771 - RNA, 32 nt, Human
uaugaaauacuuuuguacuuaauccauuucuu

SEQ ID NO: 491772 - RNA, 32 nt, Human
uaugaaaugacuaaauuccuccuugcaguguu

SEQ ID NO: 491773 - RNA, 32 nt, Human
uaugaacaaugccacaacggugcucaacaugc

SEQ ID NO: 491774 - RNA, 32 nt, Human
uaugaacaccacugcacuccaccuguccacuu

SEQ ID NO: 491775 - RNA, 32 nt, Human
uaugaacacugaucaaguaguuguggagagau

SEQ ID NO: 491776 - RNA, 32 nt, Human
uaugaacagagaauauacucuguucauauaag

SEQ ID NO: 491777 - RNA, 32 nt, Human
uaugaacauaaggcaaauuaauguucuaggau

SEQ ID NO: 491778 - RNA, 32 nt, Human
uaugaaccacugcaccuggcccuggauugcau

SEQ ID NO: 491779 - RNA, 32 nt, Human
uaugaacccaaucucugccacaugucaauacc

SEQ ID NO: 491780 - RNA, 32 nt, Human
uaugaacccauugguuagagugcaguggcuuc

SEQ ID NO: 491781 - RNA, 32 nt, Human
uaugaacuauugccucuggacguugugagaau

SEQ ID NO: 491782 - RNA, 32 nt, Human
uaugaacucaucauuccagccugggcaacaag

SEQ ID NO: 491783 - RNA, 32 nt, Human
uaugaacucccucugugucacuguaugugaaa

SEQ ID NO: 491784 - RNA, 32 nt, Human
uaugaacucucaccggcuccccaagcccuccc

SEQ ID NO: 491785 - RNA, 32 nt, Human
uaugaacugcccaacuuccugucccuuucagg

SEQ ID NO: 491786 - RNA, 32 nt, Human
uaugaacuuuugcuuaacaaaauaacauacaa

SEQ ID NO: 491787 - RNA, 32 nt, Human
uaugaagaaaacaguuuuauuugagugcuuua

SEQ ID NO: 491788 - RNA, 32 nt, Human
uaugaagaacauuucccaugcaucuacaagcu

SEQ ID NO: 491789 - RNA, 32 nt, Human
uaugaagacaggacaucacauaugaaugcacg

SEQ ID NO: 491790 - RNA, 32 nt, Human
uaugaagagggaaaggaggagcacaaaggagu

SEQ ID NO: 491791 - RNA, 32 nt, Human
uaugaagcaccacugcccuguagaccugggau

SEQ ID NO: 491792 - RNA, 32 nt, Human
uaugaagccccuaaugcaaagcucuuuaccuc

SEQ ID NO: 491793 - RNA, 32 nt, Human
uaugaagcgcauugcauuuccauagcacugaa

SEQ ID NO: 491794 - RNA, 32 nt, Human
uaugaagcuaccucaaacuuccagucagguag

SEQ ID NO: 491795 - RNA, 32 nt, Human
uaugaagcuuucuccacccuggcucccaaggc

SEQ ID NO: 491796 - RNA, 32 nt, Human
uaugaaggagccugagccaugaagugggaagc

SEQ ID NO: 491797 - RNA, 32 nt, Human
uaugaaggauuucagaaauuuguaauaaaugu

SEQ ID NO: 491798 - RNA, 32 nt, Human
uaugaaggcaaucguagagugugcaggaggaa

SEQ ID NO: 491799 - RNA, 32 nt, Human
uaugaaggcaggggcucaguggccgggucccu

SEQ ID NO: 491800 - RNA, 32 nt, Human
uaugaaguaauguuaauuuuacuaagaauaaa

SEQ ID NO: 491801 - RNA, 32 nt, Human
uaugaaguagcuuugugucuguuaccugucca

SEQ ID NO: 491802 - RNA, 32 nt, Human
uaugaaguaugguaacagggagggagacaccu

SEQ ID NO: 491803 - RNA, 32 nt, Human
uaugaagucagcaaguccugugcucaggaugc

SEQ ID NO: 491804 - RNA, 32 nt, Human
uaugaagucuauuucuaguugacuguaacaug

SEQ ID NO: 491805 - RNA, 32 nt, Human
uaugaagucuuuuaacagucucucuuuauaua

SEQ ID NO: 491806 - RNA, 32 nt, Human
uaugaaguuacuuucuuaaugugaccuagcaa

SEQ ID NO: 491807 - RNA, 32 nt, Human
uaugaaguuguuuugcggugucagccuuuucu

SEQ ID NO: 491808 - RNA, 32 nt, Human
uaugaauaauaauaacaaacacugccuucugu

SEQ ID NO: 491809 - RNA, 32 nt, Human
uaugaauagggagggagagcacaauucagucc

SEQ ID NO: 491810 - RNA, 32 nt, Human
uaugaauauguauauguauauguauguaagau

SEQ ID NO: 491811 - RNA, 32 nt, Human
uaugaaucaaagcuuauauguaaacuucaagg

SEQ ID NO: 491812 - RNA, 32 nt, Human
uaugaauccaggagguggagcuugcagugagc

SEQ ID NO: 491813 - RNA, 32 nt, Human
uaugaaugaaaaugcaucuauuucagagccga

SEQ ID NO: 491814 - RNA, 32 nt, Human
uaugaaugcaccauugcacacuaaccugggug

SEQ ID NO: 491815 - RNA, 32 nt, Human
uaugaaugggauuauguucuucauuugacucu

SEQ ID NO: 491816 - RNA, 31 nt, Human
uaugaauggguggaaaggugugagacuggga

SEQ ID NO: 491817 - RNA, 32 nt, Human
uaugaauguggaaucuuggaaagugauauauu

SEQ ID NO: 491818 - RNA, 31 nt, Human
uaugaauuaacuucuuuacauuuagaaugcc

SEQ ID NO: 491819 - RNA, 32 nt, Human
uaugaauuacuauacauauacaugcauagaaa

SEQ ID NO: 491820 - RNA, 32 nt, Human
uaugaauugcugucuagccuuagucaauaaac

SEQ ID NO: 491821 - RNA, 32 nt, Human
uaugaauuuguguugggccacauucaaagcca

SEQ ID NO: 491822 - RNA, 32 nt, Human
uaugaauuuguguugggccacauucaaagcua

SEQ ID NO: 491823 - RNA, 32 nt, Human
uaugacaaccugaggcacugugcucggaaguu

SEQ ID NO: 491824 - RNA, 32 nt, Human
uaugacaagauguugagcucacugaaaagcaa

SEQ ID NO: 491825 - RNA, 32 nt, Human
uaugacaagcuguaucacugccuucguuuaua

SEQ ID NO: 491826 - RNA, 32 nt, Human
uaugacaccagaaaacucuucaugcuauugaa

SEQ ID NO: 491827 - RNA, 32 nt, Human
uaugacaccauggaaagaaaacauuagagaaa

SEQ ID NO: 491828 - RNA, 32 nt, Human
uaugacaccauguccacaaugguguacauaaa

SEQ ID NO: 491829 - RNA, 17 nt, Human
uaugacagcacagggga

SEQ ID NO: 491830 - RNA, 32 nt, Human
uaugacagcgucaagacugcccuuggcaccgu

SEQ ID NO: 491831 - RNA, 32 nt, Human
uaugacaguuuuugacuuaagauguggcuuuu

SEQ ID NO: 491832 - RNA, 32 nt, Human
uaugacaucaaaagcacaggaaacagaagcaa

SEQ ID NO: 491833 - RNA, 32 nt, Human
uaugacaucauccugaagaacuucgagaagcu

SEQ ID NO: 491834 - RNA, 32 nt, Human
uaugacaucuuuccuacuccagucccucucgu

SEQ ID NO: 491835 - RNA, 32 nt, Human
uaugacaugccacccucuccaugcccaaccua

SEQ ID NO: 491836 - RNA, 22 nt, Human
uaugacaugcuuaugcuuacca

SEQ ID NO: 491837 - RNA, 32 nt, Human
uaugacauguugauguuauaagcacaauagau

SEQ ID NO: 491838 - RNA, 32 nt, Human
uaugaccaaucaggaccaagucuuggagguga

SEQ ID NO: 491839 - RNA, 32 nt, Human
uaugaccacacaguuggauggaggcuucucca

SEQ ID NO: 491840 - RNA, 32 nt, Human
uaugacccaagaguagaugugaccucacuggg

SEQ ID NO: 491841 - RNA, 32 nt, Human
uaugacccagcaauuucacucucagguauaua

SEQ ID NO: 491842 - RNA, 32 nt, Human
uaugaccccugcacucccucuguaucaucuca

SEQ ID NO: 491843 - RNA, 32 nt, Human
uaugaccgugcaaaugagcucugcucuaaaau

SEQ ID NO: 491844 - RNA, 32 nt, Human
uaugaccucaacaaagagauaagguggagaaa

SEQ ID NO: 491845 - RNA, 32 nt, Human
uaugaccugccucuggcccugguccugggcgg

SEQ ID NO: 491846 - RNA, 32 nt, Human
uaugaccuguguuuuaccuggugaucaguucu

SEQ ID NO: 491847 - RNA, 32 nt, Human
uaugacgaguuaacaaguuggugaccugcaca

SEQ ID NO: 491848 - RNA, 32 nt, Human
uaugacgaugccacucgcugcauucaagucua

SEQ ID NO: 491849 - RNA, 32 nt, Human
uaugacggcguggaugccagaggugcugccca

SEQ ID NO: 491850 - RNA, 32 nt, Human
uaugacuaggacgggaagaggaagcacugccu

SEQ ID NO: 491851 - RNA, 32 nt, Human
uaugacuaugccacuguacuccagccugggua

SEQ ID NO: 491852 - RNA, 32 nt, Human
uaugacuccagaauuucccaaagcagugcaug

SEQ ID NO: 491853 - RNA, 32 nt, Human
uaugacucuccucuccugcaggugucuaucca

SEQ ID NO: 491854 - RNA, 23 nt, Human
uaugacucuugucuccuccucca

SEQ ID NO: 491855 - RNA, 32 nt, Human
uaugacugcacuccagccugggugacagaccc

SEQ ID NO: 491856 - RNA, 32 nt, Human
uaugacugcacuccagccugggugacagagca

SEQ ID NO: 491857 - RNA, 32 nt, Human
uaugacugcagacuggcucuccugccuuaaac

SEQ ID NO: 491858 - RNA, 32 nt, Human
uaugacugcaucacugcacuccagccugggca

SEQ ID NO: 491859 - RNA, 32 nt, Human
uaugacugccuaguacuuugugguguauaugc

SEQ ID NO: 491860 - RNA, 32 nt, Human
uaugacugcuugaaauagucucucucccaugg

SEQ ID NO: 491861 - RNA, 32 nt, Human
uaugacugggugcgguggcucacaccuguaau

SEQ ID NO: 491862 - RNA, 32 nt, Human
uaugacugugccacugcacuccagccugguca

SEQ ID NO: 491863 - RNA, 32 nt, Human
uaugacugugggagcuccuccuucccucccca

SEQ ID NO: 491864 - RNA, 32 nt, Human
uaugacuucuaaucuuagauucccaggaacug

SEQ ID NO: 491865 - RNA, 32 nt, Human
uaugacuugcuuuuuccauuccagucaucaua

SEQ ID NO: 491866 - RNA, 26 nt, Human
uaugacuugugucuccccuuguucca

SEQ ID NO: 491867 - RNA, 32 nt, Human
uaugacuuuuuauaaaauggcuguaaucauuu

SEQ ID NO: 491868 - RNA, 32 nt, Human
uaugagaaaacucuuaguucucaucagauacu

SEQ ID NO: 491869 - RNA, 32 nt, Human
uaugagaaaagaaugaaaguaguaagaauagc

SEQ ID NO: 491870 - RNA, 32 nt, Human
uaugagaaaggcacuagaugacuuuaggauuu

SEQ ID NO: 491871 - RNA, 32 nt, Human
uaugagaacagcuugaccauuuagaauuucag

SEQ ID NO: 491872 - RNA, 32 nt, Human
uaugagaacauaauuguuccagaucuggaggc

SEQ ID NO: 491873 - RNA, 32 nt, Human
uaugagaaugucuguuuccucuccuuguuaac

SEQ ID NO: 491874 - RNA, 32 nt, Human
uaugagaauuccccaucucccccaaucuccuc

SEQ ID NO: 491875 - RNA, 32 nt, Human
uaugagacacccacuguacaguucucagggcu

SEQ ID NO: 491876 - RNA, 32 nt, Human
uaugagagaacaguguuccuccgguguguugc

SEQ ID NO: 491877 - RNA, 32 nt, Human
uaugagagagccucaaaagagagggcaagaau

SEQ ID NO: 491878 - RNA, 32 nt, Human
uaugagaggcccccaccugcugccuuuggacg

SEQ ID NO: 491879 - RNA, 32 nt, Human
uaugagagggagccgcuccugguucuggaguc

SEQ ID NO: 491880 - RNA, 32 nt, Human
uaugagaguggauaucaaugccucacagaaac

SEQ ID NO: 491881 - RNA, 32 nt, Human
uaugagaucauccucauguuaaaccuuggauu

SEQ ID NO: 491882 - RNA, 31 nt, Human
uaugagaucauuuucccuugccugaguuuug

SEQ ID NO: 491883 - RNA, 32 nt, Human
uaugagauggguuucuaaguaucuuauugugu

SEQ ID NO: 491884 - RNA, 32 nt, Human
uaugagauguacaaguaagugucuuaucugua

SEQ ID NO: 491885 - RNA, 32 nt, Human
uaugagauucugauucagccagggggaggaca

SEQ ID NO: 491886 - RNA, 32 nt, Human
uaugagcaacucuauucauuccuugccaugug

SEQ ID NO: 491887 - RNA, 32 nt, Human
uaugagcagagggaggagaagaaggggugcuc

SEQ ID NO: 491888 - RNA, 32 nt, Human
uaugagcagccugcccugcaaucucuuucuca

SEQ ID NO: 491889 - RNA, 32 nt, Human
uaugagcagccugccuugaacccucucucuca

SEQ ID NO: 491890 - RNA, 32 nt, Human
uaugagcagcugcuguaacauacucaucaacu

SEQ ID NO: 491891 - RNA, 32 nt, Human
uaugagcagggacgcugagcuggggcagcagu

SEQ ID NO: 491892 - RNA, 32 nt, Human
uaugagccacugcaccuggaaaggagccagaa

SEQ ID NO: 491893 - RNA, 32 nt, Human
uaugagccaggagauggggacugugacauagg

SEQ ID NO: 491894 - RNA, 32 nt, Human
uaugagccugcccucacucccucuguggaauc

SEQ ID NO: 491895 - RNA, 32 nt, Human
uaugagcgucugucucugugggcuugggaugu

SEQ ID NO: 491896 - RNA, 32 nt, Human
uaugagcuaaaugucugucucuaaaggguuaa

SEQ ID NO: 491897 - RNA, 32 nt, Human
uaugagcugcccccgcccgcuccugagaauaa

SEQ ID NO: 491898 - RNA, 32 nt, Human
uaugagcugugagcaagacaucugcugcauag

SEQ ID NO: 491899 - RNA, 32 nt, Human
uaugagcuuccuauggaauuguccuuauguga

SEQ ID NO: 491900 - RNA, 32 nt, Human
uaugaggaacacacccuuguucccgucauuca

SEQ ID NO: 491901 - RNA, 32 nt, Human
uaugaggaaguugaccuuaagaacaaagaaca

SEQ ID NO: 491902 - RNA, 32 nt, Human
uaugaggacacaaaggcauaagagugauauaa

SEQ ID NO: 491903 - RNA, 32 nt, Human
uaugaggaggaggaggaggaggaugugaagau

SEQ ID NO: 491904 - RNA, 32 nt, Human
uaugaggauaaauaaucugcuuuugauagcaa

SEQ ID NO: 491905 - RNA, 32 nt, Human
uaugaggccagagacguggaaguggcucgcug

SEQ ID NO: 491906 - RNA, 32 nt, Human
uaugaggcccaucucagguuuggggauccccc

SEQ ID NO: 491907 - RNA, 32 nt, Human
uaugaggcccuccccauggcuuuagcugacuu

SEQ ID NO: 491908 - RNA, 32 nt, Human
uaugaggcgcucugguaaggugcucaggccag

SEQ ID NO: 491909 - RNA, 32 nt, Human
uaugagggagauugaggcugcagugagcugug

SEQ ID NO: 491910 - RNA, 32 nt, Human
uaugagggaggcagcaaggaguugggacuuca

SEQ ID NO: 491911 - RNA, 32 nt, Human
uaugagggcugccauucucuuccuucagcccu

SEQ ID NO: 491912 - RNA, 32 nt, Human
uaugaggugggugacccaggacagagaacgcu

SEQ ID NO: 491913 - RNA, 32 nt, Human
uaugaguacagacaaaacuacagacuuagucu

SEQ ID NO: 491914 - RNA, 32 nt, Human
uaugaguagccacugcacuccagccugggcaa

SEQ ID NO: 491915 - RNA, 32 nt, Human
uaugaguauucaagcuuuuucucucuauauuu

SEQ ID NO: 491916 - RNA, 32 nt, Human
uaugagucaacuuuccuguaaagcagaacaag

SEQ ID NO: 491917 - RNA, 26 nt, Human
uaugauaacaccacugcacuccugcu

SEQ ID NO: 491918 - RNA, 32 nt, Human
uaugauacacgugguuuuuaugugcucugugg

SEQ ID NO: 491919 - RNA, 32 nt, Human
uaugauacagaauuucauaagagccaugcugu

SEQ ID NO: 491920 - RNA, 32 nt, Human
uaugauacaggaaguucaggaggcagagucuc

SEQ ID NO: 491921 - RNA, 32 nt, Human
uaugauaccaacaaacaggaagugucaggaag

SEQ ID NO: 491922 - RNA, 32 nt, Human
uaugauagcaccacugcacuccagccugggca

SEQ ID NO: 491923 - RNA, 32 nt, Human
uaugauaguaccacugcacuccagccugggca

SEQ ID NO: 491924 - RNA, 32 nt, Human
uaugauauuguuuuaguacaagacgaaucauu

SEQ ID NO: 491925 - RNA, 32 nt, Human
uaugauauuuggaguccuggaaaaggaaaauu

SEQ ID NO: 491926 - RNA, 32 nt, Human
uaugaucacaccaccacacuccagccugagca

SEQ ID NO: 491927 - RNA, 32 nt, Human
uaugaucacaccacuacacuccagccuggaca

SEQ ID NO: 491928 - RNA, 32 nt, Human
uaugaucacaccacugcaauccagccucggua

SEQ ID NO: 491929 - RNA, 32 nt, Human
uaugaucacaccacugcacuccagccugggug

SEQ ID NO: 491930 - RNA, 32 nt, Human
uaugaucacaccacuguacuccagccugggca

SEQ ID NO: 491931 - RNA, 32 nt, Human
uaugaucacaccauugcacuucagccugggcg

SEQ ID NO: 491932 - RNA, 32 nt, Human
uaugaucacagcucacugcagcuuugaucuga

SEQ ID NO: 491933 - RNA, 32 nt, Human
uaugaucacgccacugcacuccagccugggcg

SEQ ID NO: 491934 - RNA, 32 nt, Human
uaugaucacgccacugcacuccagccugggua

SEQ ID NO: 491935 - RNA, 31 nt, Human
uaugaucacugguagccuaccaaagcuguag

SEQ ID NO: 491936 - RNA, 32 nt, Human
uaugaucagaagauuugggaaagauggaaucu

SEQ ID NO: 491937 - RNA, 32 nt, Human
uaugaucaugccacugcacuccaaccugggca

SEQ ID NO: 491938 - RNA, 32 nt, Human
uaugaucaugccacugcacuccagcaugggug

SEQ ID NO: 491939 - RNA, 32 nt, Human
uaugaucaugccacugcacuccagccugggca

SEQ ID NO: 491940 - RNA, 32 nt, Human
uaugaucaugccacugcacuccagccugggug

SEQ ID NO: 491941 - RNA, 32 nt, Human
uaugaucaugccacugcacuccagucugggug

SEQ ID NO: 491942 - RNA, 32 nt, Human
uaugaucaugccacuguacucuggccugagug

SEQ ID NO: 491943 - RNA, 32 nt, Human
uaugaucaugccagauuggagaagauccaagc

SEQ ID NO: 491944 - RNA, 32 nt, Human
uaugaucaugccauugcacuccagccugggug

SEQ ID NO: 491945 - RNA, 32 nt, Human
uaugaucaugccauugucuuccagccugagug

SEQ ID NO: 491946 - RNA, 32 nt, Human
uaugaucaugcuggacaccuggugaggaaaaa

SEQ ID NO: 491947 - RNA, 32 nt, Human
uaugaucaugcuguacaacaggguagaaaaug

SEQ ID NO: 491948 - RNA, 32 nt, Human
uaugaucauguguggugauaaagaccauccac

SEQ ID NO: 491949 - RNA, 32 nt, Human
uaugauccaucuuacugggcucaggccacaua

SEQ ID NO: 491950 - RNA, 32 nt, Human
uaugauccccuggggagguagcagggaccucu

SEQ ID NO: 491951 - RNA, 32 nt, Human
uaugauccugaagacagcucugcagccaacug

SEQ ID NO: 491952 - RNA, 32 nt, Human
uaugauccugccacugcacuccagccugggcg

SEQ ID NO: 491953 - RNA, 32 nt, Human
uaugaucgcaccacugcacuccagccugggug

SEQ ID NO: 491954 - RNA, 32 nt, Human
uaugaucgcgccacuacacuccagccugagca

SEQ ID NO: 491955 - RNA, 32 nt, Human
uaugaucgcgccacugcacuccaggcugggca

SEQ ID NO: 491956 - RNA, 32 nt, Human
uaugaucgcgccacugcacuccugccugggca

SEQ ID NO: 491957 - RNA, 32 nt, Human
uaugaucgugccacugcacuccagccugggca

SEQ ID NO: 491958 - RNA, 32 nt, Human
uaugaucucaccacuacacuccagccugggug

SEQ ID NO: 491959 - RNA, 32 nt, Human
uaugaucucaccacuguacuccagccugggug

SEQ ID NO: 491960 - RNA, 32 nt, Human
uaugaucuccucauugcgucccccucugccca

SEQ ID NO: 491961 - RNA, 32 nt, Human
uaugaucuugccauugcacuccagcugagagu

SEQ ID NO: 491962 - RNA, 32 nt, Human
uaugaugacuccaaguccaagcccacccuucc

SEQ ID NO: 491963 - RNA, 32 nt, Human
uaugaugagauggaugcccuguugagucuugg

SEQ ID NO: 491964 - RNA, 32 nt, Human
uaugaugaggcuuuugcuauggcuaaugaucc

SEQ ID NO: 491965 - RNA, 32 nt, Human
uaugaugaugccacuguacugcagcuugggua

SEQ ID NO: 491966 - RNA, 32 nt, Human
uaugaugccaaaagcugccacugugugguauu

SEQ ID NO: 491967 - RNA, 19 nt, Human
uaugauggaaaacagcaag

SEQ ID NO: 491968 - RNA, 32 nt, Human
uaugauggaagaggagaguuggauaggcugug

SEQ ID NO: 491969 - RNA, 32 nt, Human
uaugauggauuuuguaaauagauuuguuacag

SEQ ID NO: 491970 - RNA, 32 nt, Human
uaugauggcaccacugcacuccagccugggag

SEQ ID NO: 491971 - RNA, 32 nt, Human
uaugauggcaccacugcacuucagccugggug

SEQ ID NO: 491972 - RNA, 32 nt, Human
uaugauggcaccacuguacuccagccugggug

SEQ ID NO: 491973 - RNA, 32 nt, Human
uaugauggcacugcugcacuccagccugcggg

SEQ ID NO: 491974 - RNA, 32 nt, Human
uaugauggcaggcgccuguaaucccagcuacu

SEQ ID NO: 491975 - RNA, 32 nt, Human
uaugauggcugggagcucuggcagccauacgg

SEQ ID NO: 491976 - RNA, 32 nt, Human
uaugauggggcaugugccauagugcaggcuug

SEQ ID NO: 491977 - RNA, 32 nt, Human
uaugauggugccacuacacuccagccugggua

SEQ ID NO: 491978 - RNA, 32 nt, Human
uaugauggugccacugcauuccagccugggug

SEQ ID NO: 491979 - RNA, 32 nt, Human
uaugaugucauguacacaggugcugccucucc

SEQ ID NO: 491980 - RNA, 32 nt, Human
uaugauguuaucuggacugggcuguaaaaauc

SEQ ID NO: 491981 - RNA, 32 nt, Human
uaugauuacaccacugcacuucagucugugug

SEQ ID NO: 491982 - RNA, 32 nt, Human
uaugauuaugccacugcuuuccagccugggca

SEQ ID NO: 491983 - RNA, 32 nt, Human
uaugauucauccccaggauggaaaugugaagg

SEQ ID NO: 491984 - RNA, 32 nt, Human
uaugauuccaccauugcacuccagucugggca

SEQ ID NO: 491985 - RNA, 32 nt, Human
uaugauuccccaggcccugcaggauuuugggg

SEQ ID NO: 491986 - RNA, 32 nt, Human
uaugauuccuguacagugcacacauugguauu

SEQ ID NO: 491987 - RNA, 32 nt, Human
uaugauucuuaaaauacugaauuaguuucuaa

SEQ ID NO: 491988 - RNA, 32 nt, Human
uaugauugaaaaaucguaguagauggaaauau

SEQ ID NO: 491989 - RNA, 32 nt, Human
uaugauugcacagcugcacuccagccugugcu

SEQ ID NO: 491990 - RNA, 32 nt, Human
uaugauugcaccacugcacuccaaccugggca

SEQ ID NO: 491991 - RNA, 32 nt, Human
uaugauugcaccacugcacuccaaccugggug

SEQ ID NO: 491992 - RNA, 32 nt, Human
uaugauugcaccacugcacuccagccugggca

SEQ ID NO: 491993 - RNA, 32 nt, Human
uaugauugcaccacugcacuccagccugggug

SEQ ID NO: 491994 - RNA, 32 nt, Human
uaugauugcaccacugcacucuacucugggug

SEQ ID NO: 491995 - RNA, 32 nt, Human
uaugauugcaccauugcaccuccagccugggc

SEQ ID NO: 491996 - RNA, 32 nt, Human
uaugauugcagcccucagccugggcugccuga

SEQ ID NO: 491997 - RNA, 32 nt, Human
uaugauugcaucacugcacugcagccugggca

SEQ ID NO: 491998 - RNA, 32 nt, Human
uaugauugcgccgcugcacuccagccugggca

SEQ ID NO: 491999 - RNA, 32 nt, Human
uaugauuggaguuuaguuuauguuggccagcu

SEQ ID NO: 492000 - RNA, 32 nt, Human
uaugauuguaccacugcacuccagccugggca

SEQ ID NO: 492001 - RNA, 32 nt, Human
uaugauuguaccacugcacuccagccugggug

SEQ ID NO: 492002 - RNA, 32 nt, Human
uaugauuguccucaucaaucucuuuacaucuu

SEQ ID NO: 492003 - RNA, 31 nt, Human
uaugauugucucuguccuugccacaguuuuu

SEQ ID NO: 492004 - RNA, 32 nt, Human
uaugauugugccacacacuccagccugggugg

SEQ ID NO: 492005 - RNA, 32 nt, Human
uaugauugugccacugcacuccagccugggca

SEQ ID NO: 492006 - RNA, 32 nt, Human
uaugauugugccacugcacuccagccugggua

SEQ ID NO: 492007 - RNA, 32 nt, Human
uaugauugugccacugcacuccagccugggug

SEQ ID NO: 492008 - RNA, 32 nt, Human
uaugauugugccacugcgcuccaggcugggug

SEQ ID NO: 492009 - RNA, 32 nt, Human
uaugauuguggcauugcacuccagccugggug

SEQ ID NO: 492010 - RNA, 32 nt, Human
uaugauuuauccugagugcuguaucuauuacu

SEQ ID NO: 492011 - RNA, 32 nt, Human
uaugauuucaccacugcauucuagccugggca

SEQ ID NO: 492012 - RNA, 32 nt, Human
uaugauuuccaaaguccaaaucugucauuuaa

SEQ ID NO: 492013 - RNA, 32 nt, Human
uaugauuugcaaaugaggagagagaagaugag

SEQ ID NO: 492014 - RNA, 32 nt, Human
uaugauuuguagcucuagguuucuugaugauc

SEQ ID NO: 492015 - RNA, 32 nt, Human
uaugcaaaaagaauuuucccagauaggcuagc

SEQ ID NO: 492016 - RNA, 32 nt, Human
uaugcaaaaauucggggucccaacaaggagag

SEQ ID NO: 492017 - RNA, 32 nt, Human
uaugcaaaacggaugcgugauauuucuugcuu

SEQ ID NO: 492018 - RNA, 19 nt, Human
uaugcaaaauugcuuugua

SEQ ID NO: 492019 - RNA, 32 nt, Human
uaugcaaagagaagagaaagaaggaugcaaug

SEQ ID NO: 492020 - RNA, 32 nt, Human
uaugcaaaucagcacaaaaugugacauucuga

SEQ ID NO: 492021 - RNA, 24 nt, Human
uaugcaaauguauguauacaugua

SEQ ID NO: 492022 - RNA, 32 nt, Human
uaugcaacacaaacacuguccuuuuggguccc

SEQ ID NO: 492023 - RNA, 32 nt, Human
uaugcaaccccagucuacucagugaguuuucu

SEQ ID NO: 492024 - RNA, 32 nt, Human
uaugcaaccugacaaaccacugaggucauggu

SEQ ID NO: 492025 - RNA, 32 nt, Human
uaugcaaccugacaaaccauugaggucauggu

SEQ ID NO: 492026 - RNA, 32 nt, Human
uaugcaacuucaaauagucugaugccugcuuc

SEQ ID NO: 492027 - RNA, 32 nt, Human
uaugcaagccucaucaacaccacuuugcagca

SEQ ID NO: 492028 - RNA, 30 nt, Human
uaugcaagccugguguugcuccuguccuca

SEQ ID NO: 492029 - RNA, 24 nt, Human
uaugcaaguauguauauaugugua

SEQ ID NO: 492030 - RNA, 32 nt, Human
uaugcaaguccuccucccucaucucaaagggu

SEQ ID NO: 492031 - RNA, 23 nt, Human
uaugcaauauauaaauaaacagu

SEQ ID NO: 492032 - RNA, 32 nt, Human
uaugcaauauggugacaccccgucucuacuaa

SEQ ID NO: 492033 - RNA, 32 nt, Human
uaugcaaucauaagugauuugguuacugcaau

SEQ ID NO: 492034 - RNA, 32 nt, Human
uaugcacaaaucaccacgcacacuucacagua

SEQ ID NO: 492035 - RNA, 26 nt, Human
uaugcacaaggcaagagcagaaacca

SEQ ID NO: 492036 - RNA, 22 nt, Human
uaugcacacacacguacacgca

SEQ ID NO: 492037 - RNA, 32 nt, Human
uaugcacaccucagguugaagaugcuacauag

SEQ ID NO: 492038 - RNA, 32 nt, Human
uaugcacacucccauuccucuuggguuucauc

SEQ ID NO: 492039 - RNA, 32 nt, Human
uaugcacagaucuugcagcccagaaccaaguc

SEQ ID NO: 492040 - RNA, 32 nt, Human
uaugcacagcaacauggauaaauuucacagac

SEQ ID NO: 492041 - RNA, 32 nt, Human
uaugcacaggaacuaaaggaaaaagagaucga

SEQ ID NO: 492042 - RNA, 32 nt, Human
uaugcacaugcacacacauaccacuugagaac

SEQ ID NO: 492043 - RNA, 32 nt, Human
uaugcacauguguauauguacauguaugccug

SEQ ID NO: 492044 - RNA, 32 nt, Human
uaugcacgagagagacagaggaggaaagagac

SEQ ID NO: 492045 - RNA, 32 nt, Human
uaugcacgugauacauuuuauggagugccuca

SEQ ID NO: 492046 - RNA, 32 nt, Human
uaugcacgugugcacacaccacacacauacac

SEQ ID NO: 492047 - RNA, 23 nt, Human
uaugcacuauguauauacauaua

SEQ ID NO: 492048 - RNA, 32 nt, Human
uaugcacucuggccugcuucuccaguuacuug

SEQ ID NO: 492049 - RNA, 32 nt, Human
uaugcacuggguggaagaaggguaggagggcu

SEQ ID NO: 492050 - RNA, 32 nt, Human
uaugcacuugcugcugccuccugggcucugau

SEQ ID NO: 492051 - RNA, 32 nt, Human
uaugcagaagcauauuuugcugguuugaaaga

SEQ ID NO: 492052 - RNA, 20 nt, Human
uaugcagaccugacugccaa

SEQ ID NO: 492053 - RNA, 32 nt, Human
uaugcagacuauaccacuguacccacccagaa

SEQ ID NO: 492054 - RNA, 32 nt, Human
uaugcagagaaaaguuuuugacuggaaauaca

SEQ ID NO: 492055 - RNA, 32 nt, Human
uaugcagagcaucugucucuccacuacccgcu

SEQ ID NO: 492056 - RNA, 32 nt, Human
uaugcagagcccagaguggugggagaacagcu

SEQ ID NO: 492057 - RNA, 32 nt, Human
uaugcagagccuuggaaagaugggcaaaugcu

SEQ ID NO: 492058 - RNA, 32 nt, Human
uaugcagaggugcagaaccagggacuccuggg

SEQ ID NO: 492059 - RNA, 32 nt, Human
uaugcagcaagcaagggugaccuccaguggcc

SEQ ID NO: 492060 - RNA, 32 nt, Human
uaugcagcaugggguuuuuauuauguuuuacc

SEQ ID NO: 492061 - RNA, 32 nt, Human
uaugcagcugagcuccccacaggccggcccgg

SEQ ID NO: 492062 - RNA, 32 nt, Human
uaugcagcuggguccagacauaugagagggac

SEQ ID NO: 492063 - RNA, 32 nt, Human
uaugcaggaggaagaugacaaucauuguggaa

SEQ ID NO: 492064 - RNA, 32 nt, Human
uaugcaggcaacacuccuugcagauccagaaa

SEQ ID NO: 492065 - RNA, 32 nt, Human
uaugcagggacaaggagguugcugacuguacu

SEQ ID NO: 492066 - RNA, 32 nt, Human
uaugcagggagccagggugagggcagagugug

SEQ ID NO: 492067 - RNA, 32 nt, Human
uaugcagguaggccuaaugggggaagauggua

SEQ ID NO: 492068 - RNA, 32 nt, Human
uaugcagguauuccugucauuccugacugagg

SEQ ID NO: 492069 - RNA, 32 nt, Human
uaugcaggugauagacuagagaacaagaccuc

SEQ ID NO: 492070 - RNA, 32 nt, Human
uaugcaguauagaaaaguuaacacaaguacua

SEQ ID NO: 492071 - RNA, 32 nt, Human
uaugcagugcaucgaaaccuuuugcuugggga

SEQ ID NO: 492072 - RNA, 20 nt, Human
uaugcaguuaccugugccuu

SEQ ID NO: 492073 - RNA, 32 nt, Human
uaugcauacaugcacagagaugcauacacagg

SEQ ID NO: 492074 - RNA, 32 nt, Human
uaugcauagcgcugcacucagucggacugaac

SEQ ID NO: 492075 - RNA, 32 nt, Human
uaugcauaucuaaaagcacagcacuuaauccu

SEQ ID NO: 492076 - RNA, 32 nt, Human
uaugcauauguauguagauauguuuauaucua

SEQ ID NO: 492077 - RNA, 32 nt, Human
uaugcauauuuuaugggggcaguauuauuaca

SEQ ID NO: 492078 - RNA, 32 nt, Human
uaugcaucccuuagaacccugcucagacacca

SEQ ID NO: 492079 - RNA, 20 nt, Human
uaugcaucgcaauaaaacag

SEQ ID NO: 492080 - RNA, 32 nt, Human
uaugcaucugaacaagugggucucucccuuga

SEQ ID NO: 492081 - RNA, 32 nt, Human
uaugcaucugcaggaaacauagccuggcucug

SEQ ID NO: 492082 - RNA, 29 nt, Human
uaugcaugagauacuaauuaaugaugaaa

SEQ ID NO: 492083 - RNA, 32 nt, Human
uaugcaugugccuguucagagucuccagauac

SEQ ID NO: 492084 - RNA, 32 nt, Human
uaugcauguuaauuagcaauguaagcaauauu

SEQ ID NO: 492085 - RNA, 32 nt, Human
uaugcauguucugacugacaccaucuugaugc

SEQ ID NO: 492086 - RNA, 32 nt, Human
uaugcauguugcugggggaagccacuccggac

SEQ ID NO: 492087 - RNA, 32 nt, Human
uaugcauuaccuuaaugucucugugugguuag

SEQ ID NO: 492088 - RNA, 32 nt, Human
uaugcauuacuccacauccacccuuuaagaau

SEQ ID NO: 492089 - RNA, 32 nt, Human
uaugcauugggaacugcaggggcacagugaug

SEQ ID NO: 492090 - RNA, 32 nt, Human
uaugcauuucaugaugggguccaacaagaaca

SEQ ID NO: 492091 - RNA, 32 nt, Human
uaugcauuuguaacuguguucuuccucuucug

SEQ ID NO: 492092 - RNA, 32 nt, Human
uaugcauuuucucuuuuuacauauaggauuug

SEQ ID NO: 492093 - RNA, 32 nt, Human
uaugccaaaaggaaaacuaugacuguaugauu

SEQ ID NO: 492094 - RNA, 32 nt, Human
uaugccaaaauuaguuguuuaagugaaguuuu

SEQ ID NO: 492095 - RNA, 32 nt, Human
uaugccaaagcccaaggcaccggguggcauau

SEQ ID NO: 492096 - RNA, 19 nt, Human
uaugccaaaggcccggggg

SEQ ID NO: 492097 - RNA, 18 nt, Human
uaugccaacccaaggaga

SEQ ID NO: 492098 - RNA, 19 nt, Human
uaugccaaccggcuggggg

SEQ ID NO: 492099 - RNA, 32 nt, Human
uaugccaagcauuaagauaaacaaauaugaug

SEQ ID NO: 492100 - RNA, 32 nt, Human
uaugccaagccuugggaaucucagccuccccu

SEQ ID NO: 492101 - RNA, 32 nt, Human
uaugccaauguucacacugaaauacuguauug

SEQ ID NO: 492102 - RNA, 32 nt, Human
uaugccacauggucuucauuuaugccagguaa

SEQ ID NO: 492103 - RNA, 32 nt, Human
uaugccacugcaauuagaguauccaauaaagg

SEQ ID NO: 492104 - RNA, 32 nt, Human
uaugccacugcacuccagccuaggugacaaag

SEQ ID NO: 492105 - RNA, 32 nt, Human
uaugccacugcacuccagccugggcaacagag

SEQ ID NO: 492106 - RNA, 32 nt, Human
uaugccacugcacuccagccugggugacagag

SEQ ID NO: 492107 - RNA, 32 nt, Human
uaugccacugcacuccagccuggugacagagc

SEQ ID NO: 492108 - RNA, 32 nt, Human
uaugccacugcacucccgccugggugacaaag

SEQ ID NO: 492109 - RNA, 32 nt, Human
uaugccacugcacuucagccugggugacagag

SEQ ID NO: 492110 - RNA, 32 nt, Human
uaugccacugcuuuccagccugggcaacauag

SEQ ID NO: 492111 - RNA, 32 nt, Human
uaugccacuguacuccagccuggguaacagga

SEQ ID NO: 492112 - RNA, 32 nt, Human
uaugccacuguacuccagccugggugacagag

SEQ ID NO: 492113 - RNA, 32 nt, Human
uaugccacuguacuccagcgugggugacagag

SEQ ID NO: 492114 - RNA, 32 nt, Human
uaugccagauggccacacccccagccacagau

SEQ ID NO: 492115 - RNA, 17 nt, Human
uaugccagcgcccaggg

SEQ ID NO: 492116 - RNA, 32 nt, Human
uaugccagcugggccauuucucagacauucaa

SEQ ID NO: 492117 - RNA, 32 nt, Human
uaugccaggauuuugugaaggcugaggcagaa

SEQ ID NO: 492118 - RNA, 32 nt, Human
uaugccaggcgcugauguaagcacuuuaggua

SEQ ID NO: 492119 - RNA, 32 nt, Human
uaugccaggugcuucaccuguuauuucacuua

SEQ ID NO: 492120 - RNA, 32 nt, Human
uaugccagucacacccugcuccagaccucggu

SEQ ID NO: 492121 - RNA, 32 nt, Human
uaugccagugagcacaacacaggccgcauaug

SEQ ID NO: 492122 - RNA, 32 nt, Human
uaugccaucaugucacugcagagguaugaaaa

SEQ ID NO: 492123 - RNA, 19 nt, Human
uaugccaucuggcugccaa

SEQ ID NO: 492124 - RNA, 32 nt, Human
uaugccauuacacuccagccugggcaacagcg

SEQ ID NO: 492125 - RNA, 32 nt, Human
uaugccauugcacuccagccugggugacaaag

SEQ ID NO: 492126 - RNA, 32 nt, Human
uaugccauugcacuccagccugggugacagag

SEQ ID NO: 492127 - RNA, 32 nt, Human
uaugcccaaagcuuuucagggucuccaacucu

SEQ ID NO: 492128 - RNA, 32 nt, Human
uaugcccacaugcucaagcccagaaggcagaa

SEQ ID NO: 492129 - RNA, 32 nt, Human
uaugcccacggagcuaagagacaggaacacag

SEQ ID NO: 492130 - RNA, 32 nt, Human
uaugcccauaauaaucccagcacuuugggagg

SEQ ID NO: 492131 - RNA, 32 nt, Human
uaugcccaugucuucugagcagagccaccauu

SEQ ID NO: 492132 - RNA, 32 nt, Human
uaugccccaaaccaaaggguuuccugggcuuc

SEQ ID NO: 492133 - RNA, 32 nt, Human
uaugcccccacgaccauccucacugcagaacu

SEQ ID NO: 492134 - RNA, 32 nt, Human
uaugccccugcacaucagccugggugauagau

SEQ ID NO: 492135 - RNA, 32 nt, Human
uaugcccuagagcugcuccagcacccuugguu

SEQ ID NO: 492136 - RNA, 32 nt, Human
uaugcccuccaaacccucccaggauucaaagc

SEQ ID NO: 492137 - RNA, 32 nt, Human
uaugcccucccuuccuccugagccagcccaga

SEQ ID NO: 492138 - RNA, 32 nt, Human
uaugcccugaguagcgaguccaugucacucag

SEQ ID NO: 492139 - RNA, 32 nt, Human
uaugcccugcgcuccuccacagccugggccgg

SEQ ID NO: 492140 - RNA, 32 nt, Human
uaugcccuuugccucugcucugcacagugaaa

SEQ ID NO: 492141 - RNA, 32 nt, Human
uaugcccuuugcuccuggugggagagggagga

SEQ ID NO: 492142 - RNA, 32 nt, Human
uaugccgcagagccaggcacgccgugggcacu

SEQ ID NO: 492143 - RNA, 32 nt, Human
uaugccgcugcacuccagccugggggacagag

SEQ ID NO: 492144 - RNA, 32 nt, Human
uaugccuaccaaacauccaaagguagacgugg

SEQ ID NO: 492145 - RNA, 32 nt, Human
uaugccuagaaggugaugugaaugcgauucag

SEQ ID NO: 492146 - RNA, 32 nt, Human
uaugccuauagucccagcuacuugggaggcug

SEQ ID NO: 492147 - RNA, 32 nt, Human
uaugccuaugagucaguaaagacugaaguaau

SEQ ID NO: 492148 - RNA, 32 nt, Human
uaugccucacugguuguuauucuuagguuauu

SEQ ID NO: 492149 - RNA, 32 nt, Human
uaugccucagccccaucucugcuccuguuuga

SEQ ID NO: 492150 - RNA, 32 nt, Human
uaugccucuccaccucccaugucacccaugaa

SEQ ID NO: 492151 - RNA, 19 nt, Human
uaugccucuggcaugggga

SEQ ID NO: 492152 - RNA, 32 nt, Human
uaugccucuggcauggggaaauuaagggaaca

SEQ ID NO: 492153 - RNA, 32 nt, Human
uaugccucuguguaucucagcauuuuuauucc

SEQ ID NO: 492154 - RNA, 32 nt, Human
uaugccugacaggcaucugagcaaagguuuuu

SEQ ID NO: 492155 - RNA, 32 nt, Human
uaugccugaguguuuaugcuugcaaaaaguau

SEQ ID NO: 492156 - RNA, 32 nt, Human
uaugccugcacugcagcccagccccggacagc

SEQ ID NO: 492157 - RNA, 32 nt, Human
uaugccugccguuucccugccuccugcuucag

SEQ ID NO: 492158 - RNA, 32 nt, Human
uaugccugccugguaaggaaauccauuuuggc

SEQ ID NO: 492159 - RNA, 32 nt, Human
uaugccuggcacggaucucagcuggaucccug

SEQ ID NO: 492160 - RNA, 32 nt, Human
uaugccugguacaagcuggcagaggagguuuc

SEQ ID NO: 492161 - RNA, 32 nt, Human
uaugccuguaaaucccagcuauuugggaggcu

SEQ ID NO: 492162 - RNA, 23 nt, Human
uaugccuguaaccccagcacuuu

SEQ ID NO: 492163 - RNA, 21 nt, Human
uaugccuguaaucccagcacu

SEQ ID NO: 492164 - RNA, 23 nt, Human
uaugccuguaaucccagcacuuu

SEQ ID NO: 492165 - RNA, 32 nt, Human
uaugccuguaaucccagcuacucgggaggcug

SEQ ID NO: 492166 - RNA, 32 nt, Human
uaugccuguaaucccagcuacuuaggaggcug

SEQ ID NO: 492167 - RNA, 23 nt, Human
uaugccuguaaucccugcacuuu

SEQ ID NO: 492168 - RNA, 32 nt, Human
uaugccuguaccgauggcauggugcuauaucc

SEQ ID NO: 492169 - RNA, 32 nt, Human
uaugccuguagucccaacuacuuggaaggcug

SEQ ID NO: 492170 - RNA, 32 nt, Human
uaugccuguagucccagcuacucaggagguug

SEQ ID NO: 492171 - RNA, 32 nt, Human
uaugccuguagucccaguuacuugggaggcug

SEQ ID NO: 492172 - RNA, 32 nt, Human
uaugccuguaguuuucuaucaucccaguaggu

SEQ ID NO: 492173 - RNA, 32 nt, Human
uaugccugugaguuauccaagaccauguauga

SEQ ID NO: 492174 - RNA, 32 nt, Human
uaugccuguggucccagcuacugaggaggcug

SEQ ID NO: 492175 - RNA, 32 nt, Human
uaugccuguucugguuccuuguugacuugggg

SEQ ID NO: 492176 - RNA, 32 nt, Human
uaugccuuccaagaggaacuucagacacaaaa

SEQ ID NO: 492177 - RNA, 32 nt, Human
uaugccuucuucugcugccugguuuugggggc

SEQ ID NO: 492178 - RNA, 32 nt, Human
uaugccuuuucccaacuccagaaagugacaag

SEQ ID NO: 492179 - RNA, 32 nt, Human
uaugccuuuugagcugucuugacguucacaga

SEQ ID NO: 492180 - RNA, 32 nt, Human
uaugccuuuuucuagaucuugaugcaaacagu

SEQ ID NO: 492181 - RNA, 32 nt, Human
uaugcggaaagccacacagagccauuguuuuc

SEQ ID NO: 492182 - RNA, 32 nt, Human
uaugcggcguuauuucugagggcucuguucug

SEQ ID NO: 492183 - RNA, 32 nt, Human
uaugcggcuccucugcuuuugaguccaaugcu

SEQ ID NO: 492184 - RNA, 32 nt, Human
uaugcggugacggcggggugugguggccugug

SEQ ID NO: 492185 - RNA, 32 nt, Human
uaugcguauguauguauguauguaugcccuca

SEQ ID NO: 492186 - RNA, 32 nt, Human
uaugcgucagaaaagaaaugacagguuugaaa

SEQ ID NO: 492187 - RNA, 32 nt, Human
uaugcguggcgcuguguucacuuuccagaguc

SEQ ID NO: 492188 - RNA, 32 nt, Human
uaugcgugugugaaagcagguggaccauucca

SEQ ID NO: 492189 - RNA, 32 nt, Human
uaugcuaagcaggguuccaaguagcuaaauga

SEQ ID NO: 492190 - RNA, 32 nt, Human
uaugcuacuauacauugauuuacugccuguuu

SEQ ID NO: 492191 - RNA, 32 nt, Human
uaugcuacuuaaaaauauuaaaauagaguggu

SEQ ID NO: 492192 - RNA, 32 nt, Human
uaugcuacuugugaggcagaagaguuuucugu

SEQ ID NO: 492193 - RNA, 32 nt, Human
uaugcuagaacucugggcagggccuaaucuag

SEQ ID NO: 492194 - RNA, 32 nt, Human
uaugcuagaugcugggguugcagccacgagca

SEQ ID NO: 492195 - RNA, 32 nt, Human
uaugcuaugauggaguucuuuugugauuucuu

SEQ ID NO: 492196 - RNA, 32 nt, Human
uaugcucacaccacugcacuccauccugggca

SEQ ID NO: 492197 - RNA, 32 nt, Human
uaugcucacauuuguguuuuauuugaaaagug

SEQ ID NO: 492198 - RNA, 32 nt, Human
uaugcucagaugcccugguugccugaagaugg

SEQ ID NO: 492199 - RNA, 32 nt, Human
uaugcucagcacugcccccucucugauugcuu

SEQ ID NO: 492200 - RNA, 32 nt, Human
uaugcuccaaacacuccucuaagcacuuuaca

SEQ ID NO: 492201 - RNA, 32 nt, Human
uaugcuccaggguuguguucagugcaucauuc

SEQ ID NO: 492202 - RNA, 32 nt, Human
uaugcuccccuuccucugcuccuuaaggucac

SEQ ID NO: 492203 - RNA, 32 nt, Human
uaugcucgcaaucucagcuauuuggaagcuac

SEQ ID NO: 492204 - RNA, 32 nt, Human
uaugcucugggugacagcgggaaggugcuuuc

SEQ ID NO: 492205 - RNA, 32 nt, Human
uaugcugacaccagaaacucagagccagcuug

SEQ ID NO: 492206 - RNA, 32 nt, Human
uaugcugagccccugccacaugcaucaucauc

SEQ ID NO: 492207 - RNA, 32 nt, Human
uaugcugaggaccucagccauguggccgcugg

SEQ ID NO: 492208 - RNA, 32 nt, Human
uaugcugaggaccucagccauguggccucugg

SEQ ID NO: 492209 - RNA, 32 nt, Human
uaugcugauggaccaggaagcccugaauccau

SEQ ID NO: 492210 - RNA, 32 nt, Human
uaugcugauguagggcaggugagcccaaaaau

SEQ ID NO: 492211 - RNA, 32 nt, Human
uaugcugcagauucaucugaugaagaggagga

SEQ ID NO: 492212 - RNA, 32 nt, Human
uaugcugcaggcaaggguuuccauccccgcug

SEQ ID NO: 492213 - RNA, 25 nt, Human
uaugcugcaguccugcagucaccua

SEQ ID NO: 492214 - RNA, 32 nt, Human
uaugcugcauuuggcuggagcccgguguucag

SEQ ID NO: 492215 - RNA, 32 nt, Human
uaugcugcuaccucucuccuugaagggagcau

SEQ ID NO: 492216 - RNA, 32 nt, Human
uaugcugcucuaagucugcucucugcauguuu

SEQ ID NO: 492217 - RNA, 32 nt, Human
uaugcugcugcacuccagccuggacaacagag

SEQ ID NO: 492218 - RNA, 32 nt, Human
uaugcugcugcugugcuaagacugccuaugaa

SEQ ID NO: 492219 - RNA, 32 nt, Human
uaugcuggagauuacuuaggugggccaggauu

SEQ ID NO: 492220 - RNA, 32 nt, Human
uaugcuggaggcagagggcaagggaggggugg

SEQ ID NO: 492221 - RNA, 32 nt, Human
uaugcugggccauuuuucaucuugagauugcu

SEQ ID NO: 492222 - RNA, 32 nt, Human
uaugcuggguuauuggcaaagaagcaaacagg

SEQ ID NO: 492223 - RNA, 32 nt, Human
uaugcuggucucaaacucccaaccucagguga

SEQ ID NO: 492224 - RNA, 32 nt, Human
uaugcugguuauuucacugcuucaccuuccag

SEQ ID NO: 492225 - RNA, 32 nt, Human
uaugcuguagugacaacaacaaagauguauuu

SEQ ID NO: 492226 - RNA, 32 nt, Human
uaugcuguauauguuauguaauuuauuuuagg

SEQ ID NO: 492227 - RNA, 32 nt, Human
uaugcugucuggacaggcacacacaugcagau

SEQ ID NO: 492228 - RNA, 32 nt, Human
uaugcugucuuuccucuuccuccuagcuggcu

SEQ ID NO: 492229 - RNA, 32 nt, Human
uaugcuuaaagauccaccuccauuaacugcac

SEQ ID NO: 492230 - RNA, 32 nt, Human
uaugcuuaccaagaucaagugcauugaggggc

SEQ ID NO: 492231 - RNA, 32 nt, Human
uaugcuuagucuuccauauaaccuucuaugca

SEQ ID NO: 492232 - RNA, 32 nt, Human
uaugcuucagaauacaguuguuugcccugugc

SEQ ID NO: 492233 - RNA, 32 nt, Human
uaugcuucccacaaccucuccugggcccaggu

SEQ ID NO: 492234 - RNA, 32 nt, Human
uaugcuuccuuguuuccaugccaacaugcuga

SEQ ID NO: 492235 - RNA, 32 nt, Human
uaugcuucucaaaccucuaccuuuuucaaauu

SEQ ID NO: 492236 - RNA, 32 nt, Human
uaugcuucuccucucugagaauccugacuuac

SEQ ID NO: 492237 - RNA, 32 nt, Human
uaugcuucucuagcuccccaucuuccaggucc

SEQ ID NO: 492238 - RNA, 32 nt, Human
uaugcuugcaauacaagaauaucuucagaugg

SEQ ID NO: 492239 - RNA, 32 nt, Human
uaugcuugcggaccgcagcccagcaugccggu

SEQ ID NO: 492240 - RNA, 32 nt, Human
uaugcuugcuguggaccucauuuaagauugca

SEQ ID NO: 492241 - RNA, 32 nt, Human
uaugcuugugagugaccuucuagaaaggaacu

SEQ ID NO: 492242 - RNA, 32 nt, Human
uaugcuuuccgcaguccuaacuaugcugcguu

SEQ ID NO: 492243 - RNA, 32 nt, Human
uaugcuuuggcuuucaugccuccuggauauga

SEQ ID NO: 492244 - RNA, 32 nt, Human
uaugcuuuuuaauuucuagaacauggaaaccu

SEQ ID NO: 492245 - RNA, 32 nt, Human
uauggaaaacugucaggugaccaguccauuua

SEQ ID NO: 492246 - RNA, 32 nt, Human
uauggaaaaguuaaccauuauagaaaagcaaa

SEQ ID NO: 492247 - RNA, 32 nt, Human
uauggaaaccucuaaggugagaaaguuuugaa

SEQ ID NO: 492248 - RNA, 32 nt, Human
uauggaaagggagacuguuucagaggacuuga

SEQ ID NO: 492249 - RNA, 32 nt, Human
uauggaacucaggaggcggaggcugcagucaa

SEQ ID NO: 492250 - RNA, 32 nt, Human
uauggaacuucaaaggcccacauggcaagcca

SEQ ID NO: 492251 - RNA, 32 nt, Human
uauggaagccaagagcucccggcucaugauac

SEQ ID NO: 492252 - RNA, 32 nt, Human
uauggaagccaagagcucucggcucaugauac

SEQ ID NO: 492253 - RNA, 32 nt, Human
uauggaaggcggggcucauggcugauuggcaa

SEQ ID NO: 492254 - RNA, 32 nt, Human
uauggaauugcacauccaucucauaggaauug

SEQ ID NO: 492255 - RNA, 32 nt, Human
uauggacaacuuuuugccacuaacugaauucu

SEQ ID NO: 492256 - RNA, 32 nt, Human
uauggacacagcccgagagaugggcgcaaggg

SEQ ID NO: 492257 - RNA, 32 nt, Human
uauggacaggagcuaauggaagugacagucau

SEQ ID NO: 492258 - RNA, 32 nt, Human
uauggacaguuagcauuuaccaauauguaucu

SEQ ID NO: 492259 - RNA, 32 nt, Human
uauggacauccagcagaaaagaggaugcuuuu

SEQ ID NO: 492260 - RNA, 32 nt, Human
uauggacauggacuugugggcccugcagugca

SEQ ID NO: 492261 - RNA, 32 nt, Human
uauggaccagaagagagcuuugggacauuuuu

SEQ ID NO: 492262 - RNA, 32 nt, Human
uauggaccagugcccuccgcagacagcucaca

SEQ ID NO: 492263 - RNA, 32 nt, Human
uauggaccauucuagaauaccuugccauauuu

SEQ ID NO: 492264 - RNA, 32 nt, Human
uauggacgugagccaccacacccgcccuugaa

SEQ ID NO: 492265 - RNA, 32 nt, Human
uauggacucagaggaaugauguuuuaguuuug

SEQ ID NO: 492266 - RNA, 32 nt, Human
uauggacucucuucagcuucuggagaccucac

SEQ ID NO: 492267 - RNA, 32 nt, Human
uauggacuugacuuuucuuggacugacaacug

SEQ ID NO: 492268 - RNA, 32 nt, Human
uauggagaaagaaaccugaggagauugaaguu

SEQ ID NO: 492269 - RNA, 32 nt, Human
uauggagaaagagacgccucuggccuuggggg

SEQ ID NO: 492270 - RNA, 32 nt, Human
uauggagaacuccacguggaucucugauugcg

SEQ ID NO: 492271 - RNA, 32 nt, Human
uauggagacuccgucucuacagaagguuuuga

SEQ ID NO: 492272 - RNA, 32 nt, Human
uauggagacugucuggaaggcuuggaaugguu

SEQ ID NO: 492273 - RNA, 32 nt, Human
uauggagagaaaaagaggcacaccuggacgca

SEQ ID NO: 492274 - RNA, 32 nt, Human
uauggagagccagcagggucugggaguucucc

SEQ ID NO: 492275 - RNA, 32 nt, Human
uauggagagggcugcuuuuggggauuauuuau

SEQ ID NO: 492276 - RNA, 32 nt, Human
uauggagcacgagcagagggaaaaugacugcg

SEQ ID NO: 492277 - RNA, 32 nt, Human
uauggagcagggccacugaauuugcuguaauc

SEQ ID NO: 492278 - RNA, 32 nt, Human
uauggagcagggccgcugaacuugcuguaauc

SEQ ID NO: 492279 - RNA, 32 nt, Human
uauggagcccugcccacagccccuggucaucu

SEQ ID NO: 492280 - RNA, 32 nt, Human
uauggagccuccaucaucaugcucuuuuguga

SEQ ID NO: 492281 - RNA, 32 nt, Human
uauggagcuaagugccuuuuggaggauuucuu

SEQ ID NO: 492282 - RNA, 32 nt, Human
uauggagcuagauuuuuaaaaacacuguaaaa

SEQ ID NO: 492283 - RNA, 32 nt, Human
uauggagcugauuuucuagucuguggaucagc

SEQ ID NO: 492284 - RNA, 32 nt, Human
uauggaggcaaaucagcugggcccugcccuca

SEQ ID NO: 492285 - RNA, 32 nt, Human
uauggagggagaaacaugaguauagaggaggc

SEQ ID NO: 492286 - RNA, 32 nt, Human
uauggagguacccaaggcucagccagucucua

SEQ ID NO: 492287 - RNA, 32 nt, Human
uauggaguaaccaagugauggaagagguugga

SEQ ID NO: 492288 - RNA, 32 nt, Human
uauggaguagcucgcagagaucacagaaaugc

SEQ ID NO: 492289 - RNA, 32 nt, Human
uauggaguccugaagauacacagccaccacuc

SEQ ID NO: 492290 - RNA, 32 nt, Human
uauggagugggaaugaagauggggaacuuacg

SEQ ID NO: 492291 - RNA, 32 nt, Human
uauggaguucagggagcuucaggguuggcaaa

SEQ ID NO: 492292 - RNA, 19 nt, Human
uauggauaaagaugcagua

SEQ ID NO: 492293 - RNA, 32 nt, Human
uauggauauacugaugaagacuucaaaauuca

SEQ ID NO: 492294 - RNA, 32 nt, Human
uauggauccugccuccugccacgugcugggug

SEQ ID NO: 492295 - RNA, 32 nt, Human
uauggaucggccacugcacuccgggcugggcg

SEQ ID NO: 492296 - RNA, 32 nt, Human
uauggaugaagugaacccaugcagugacugga

SEQ ID NO: 492297 - RNA, 32 nt, Human
uauggaugcuuagugcccucacuucucucugu

SEQ ID NO: 492298 - RNA, 32 nt, Human
ucaaccucggaggcggagguugcagugagcca

SEQ ID NO: 492299 - RNA, 32 nt, Human
ucaaccucgguauuuucccuuggauauuaacu

SEQ ID NO: 492300 - RNA, 32 nt, Human
ucaaccucuagacagggaacagcuucaggaua

SEQ ID NO: 492301 - RNA, 32 nt, Human
ucaaccucucagagugcugggauuauaggugu

SEQ ID NO: 492302 - RNA, 32 nt, Human
ucaaccucuccaggaggcccugaagguggccu

SEQ ID NO: 492303 - RNA, 32 nt, Human
ucaaccucuccuccgcugucaugccugcuucc

SEQ ID NO: 492304 - RNA, 32 nt, Human
ucaaccucucuccagcccacucuuccaaaaua

SEQ ID NO: 492305 - RNA, 32 nt, Human
ucaaccucugcccacccgugcaugucaucaca

SEQ ID NO: 492306 - RNA, 32 nt, Human
ucaaccucuuacugcuguucucccuuucuccg

SEQ ID NO: 492307 - RNA, 32 nt, Human
ucaaccucuucuggcccugcguccugcagcga

SEQ ID NO: 492308 - RNA, 23 nt, Human
ucaaccucuugagcucaagcgau

SEQ ID NO: 492309 - RNA, 32 nt, Human
ucaaccucuuucugauagauuuccucuuucau

SEQ ID NO: 492310 - RNA, 32 nt, Human
ucaaccugaggcauuacugagccccggcgcca

SEQ ID NO: 492311 - RNA, 32 nt, Human
ucaaccugccuacuccccacacugccucaccu

SEQ ID NO: 492312 - RNA, 32 nt, Human
ucaaccugcucacuguucuaucuccaaaugag

SEQ ID NO: 492313 - RNA, 32 nt, Human
ucaaccuggagcucuacgccuccugcguuuac

SEQ ID NO: 492314 - RNA, 29 nt, Human
ucaaccuggcugcauucagcugccaugcc

SEQ ID NO: 492315 - RNA, 32 nt, Human
ucaaccugggagauggagguugcagugagccg

SEQ ID NO: 492316 - RNA, 32 nt, Human
ucaaccugggaggcagagguugcagugagcca

SEQ ID NO: 492317 - RNA, 32 nt, Human
ucaaccugggaggcagagguugcagugagccg

SEQ ID NO: 492318 - RNA, 32 nt, Human
ucaaccugggaggcggagguugcagugagcuu

SEQ ID NO: 492319 - RNA, 32 nt, Human
ucaaccugggagguagagguugcagugagccg

SEQ ID NO: 492320 - RNA, 32 nt, Human
ucaaccugggagguugaggcugcagugagcug

SEQ ID NO: 492321 - RNA, 32 nt, Human
ucaaccugggcaaagccuagugaaggcuucuc

SEQ ID NO: 492322 - RNA, 32 nt, Human
ucaaccugggcaacauagagagacccuaucuc

SEQ ID NO: 492323 - RNA, 32 nt, Human
ucaaccugggcaacauggugaccucccgucuc

SEQ ID NO: 492324 - RNA, 18 nt, Human
ucaaccuggucaagucuu

SEQ ID NO: 492325 - RNA, 32 nt, Human
ucaaccuguaucaagaacaaaaaugggaggag

SEQ ID NO: 492326 - RNA, 21 nt, Human
ucaaccugugugauggugcuu

SEQ ID NO: 492327 - RNA, 24 nt, Human
ucaaccuuccaggcugaagugauu

SEQ ID NO: 492328 - RNA, 23 nt, Human
ucaaccuucuggguucaagcgau

SEQ ID NO: 492329 - RNA, 32 nt, Human
ucaaccuuugaucucuugagaggaugguucac

SEQ ID NO: 492330 - RNA, 32 nt, Human
ucaaccuuugccuuauccaaccccucuucaga

SEQ ID NO: 492331 - RNA, 32 nt, Human
ucaacgacucagcuuugcacuccagggcugcg

SEQ ID NO: 492332 - RNA, 32 nt, Human
ucaacgcaguaauucccaucugccuuuauugc

SEQ ID NO: 492333 - RNA, 32 nt, Human
ucaacgccaaggagaugacccaucuuuugcag

SEQ ID NO: 492334 - RNA, 32 nt, Human
ucaacgccaagucauccucccaccucagccuc

SEQ ID NO: 492335 - RNA, 32 nt, Human
ucaacgccagccuggccaacauggugaaaccc

SEQ ID NO: 492336 - RNA, 32 nt, Human
ucaacgccagcuuucugugcuucugccuguca

SEQ ID NO: 492337 - RNA, 32 nt, Human
ucaacgccccgccucauuggaaaacugaaauc

SEQ ID NO: 492338 - RNA, 32 nt, Human
ucaacgccucuccucaaugcugggcccucuua

SEQ ID NO: 492339 - RNA, 32 nt, Human
ucaacgccugccuccccucgagcguccucagc

SEQ ID NO: 492340 - RNA, 32 nt, Human
ucaacggcaaguuucccucccuuuucugacug

SEQ ID NO: 492341 - RNA, 32 nt, Human
ucaacggcuaagcucaaacguuagucuugaca

SEQ ID NO: 492342 - RNA, 32 nt, Human
ucaacgggagucaccagcagccaagaaggaac

SEQ ID NO: 492343 - RNA, 32 nt, Human
ucaacgguccugcccucggucucccucuuccc

SEQ ID NO: 492344 - RNA, 32 nt, Human
ucaacggugacuugugggcagugccuucugcu

SEQ ID NO: 492345 - RNA, 32 nt, Human
ucaacguagcuacucaggaggcugagguggga

SEQ ID NO: 492346 - RNA, 32 nt, Human
ucaacguccuguacuccaguuuugacuacgag

SEQ ID NO: 492347 - RNA, 32 nt, Human
ucaacgugaccaaccuuccuugcuuacacaua

SEQ ID NO: 492348 - RNA, 32 nt, Human
ucaacgugagccaggagcagcgucccggcucc

SEQ ID NO: 492349 - RNA, 32 nt, Human
ucaacgugaggcucugcugccaugaaggugaa

SEQ ID NO: 492350 - RNA, 32 nt, Human
ucaacguggcauuaacugcaagcacagggguc

SEQ ID NO: 492351 - RNA, 32 nt, Human
ucaacgugggguccuuggacagcaagugaugg

SEQ ID NO: 492352 - RNA, 32 nt, Human
ucaacguguguggucuccucagucucugucag

SEQ ID NO: 492353 - RNA, 32 nt, Human
ucaacguguuagccaggauggucucagucucc

SEQ ID NO: 492354 - RNA, 22 nt, Human
ucaacguugacaagagguugcu

SEQ ID NO: 492355 - RNA, 32 nt, Human
ucaacguugcugcuaauacaagagucuuagag

SEQ ID NO: 492356 - RNA, 32 nt, Human
ucaacuaaaaauacaaaaauuagccaggugug

SEQ ID NO: 492357 - RNA, 32 nt, Human
ucaacuaaagaaauuaacccuaacccagccau

SEQ ID NO: 492358 - RNA, 32 nt, Human
ucaacuaauaauacaaaauuagccaggcgugg

SEQ ID NO: 492359 - RNA, 32 nt, Human
ucaacuacaaauaggcugggauucaaugugga

SEQ ID NO: 492360 - RNA, 32 nt, Human
ucaacuacauuuuagaaaggaggaaaucuaaa

SEQ ID NO: 492361 - RNA, 32 nt, Human
ucaacuagaccccacaccagggcacccuaaga

SEQ ID NO: 492362 - RNA, 32 nt, Human
ucaacuagacucccccucuccccugucuaaac

SEQ ID NO: 492363 - RNA, 32 nt, Human
ucaacuagccccggcaccagacucaaaggaug

SEQ ID NO: 492364 - RNA, 21 nt, Human
ucaacuaucagaaggcugcuu

SEQ ID NO: 492365 - RNA, 32 nt, Human
ucaacucaacgcaugcagccacuguagaaaag

SEQ ID NO: 492366 - RNA, 32 nt, Human
ucaacucaagcaauccucccaccucagccacc

SEQ ID NO: 492367 - RNA, 32 nt, Human
ucaacucaccgcaaccuccgccucccggguuc

SEQ ID NO: 492368 - RNA, 32 nt, Human
ucaacucaccgcaaccuccuccucuuggguuc

SEQ ID NO: 492369 - RNA, 32 nt, Human
ucaacucacugcaaccccugcucucagguuca

SEQ ID NO: 492370 - RNA, 32 nt, Human
ucaacucacugcaaccuccgcucccgguuuga

SEQ ID NO: 492371 - RNA, 32 nt, Human
ucaacucacugcaaccucugcccuucagguuc

SEQ ID NO: 492372 - RNA, 32 nt, Human
ucaacucaggcagacuggcuaaggaccagccc

SEQ ID NO: 492373 - RNA, 32 nt, Human
ucaacucaugccagcagccucagcgucugccu

SEQ ID NO: 492374 - RNA, 32 nt, Human
ucaacuccguucucaacaccuuccuuaagucu

SEQ ID NO: 492375 - RNA, 24 nt, Human
ucaacuccuaugaguggcaacuga

SEQ ID NO: 492376 - RNA, 18 nt, Human
ucaacuccugggcucaag

SEQ ID NO: 492377 - RNA, 22 nt, Human
ucaacuccugggcucaagcgau

SEQ ID NO: 492378 - RNA, 32 nt, Human
ucaacucgaagccaggagggggcuuccagguc

SEQ ID NO: 492379 - RNA, 32 nt, Human
ucaacucucaccucugcagcucagggaccucg

SEQ ID NO: 492380 - RNA, 32 nt, Human
ucaacucugagcugucugcaaggcuuaguaag

SEQ ID NO: 492381 - RNA, 32 nt, Human
ucaacucugcagcuccucucgcacccagagga

SEQ ID NO: 492382 - RNA, 19 nt, Human
ucaacucugccccacccca

SEQ ID NO: 492383 - RNA, 18 nt, Human
ucaacucugggcuuuugg

SEQ ID NO: 492384 - RNA, 32 nt, Human
ucaacucuguuacccaggcuggagugcagugg

SEQ ID NO: 492385 - RNA, 32 nt, Human
ucaacucuucuagcuugcuguuucuggaccaa

SEQ ID NO: 492386 - RNA, 32 nt, Human
ucaacucuucucaaaaucccaggcuggaaauu

SEQ ID NO: 492387 - RNA, 22 nt, Human
ucaacucuuggccucaagugau

SEQ ID NO: 492388 - RNA, 32 nt, Human
ucaacucuuuuuccgaugcucugcaccagauc

SEQ ID NO: 492389 - RNA, 32 nt, Human
ucaacugaagucagaguucaagacagccuggg

SEQ ID NO: 492390 - RNA, 32 nt, Human
ucaacugacuguacuugcuacuuuaaaaucua

SEQ ID NO: 492391 - RNA, 32 nt, Human
ucaacugaucaaaccaaaggaaaaguguugcu

SEQ ID NO: 492392 - RNA, 21 nt, Human
ucaacugauccuuccccacca

SEQ ID NO: 492393 - RNA, 32 nt, Human
ucaacugcaacauuuucuuuucugccuaucuu

SEQ ID NO: 492394 - RNA, 32 nt, Human
ucaacugcacuuccagucacccaggccuugca

SEQ ID NO: 492395 - RNA, 32 nt, Human
ucaacugccccaaaucucuuaauagcuucuag

SEQ ID NO: 492396 - RNA, 32 nt, Human
ucaacugccccagguuuaagcaauccucccac

SEQ ID NO: 492397 - RNA, 32 nt, Human
ucaacuggccuguagauuugugguguuccuag

SEQ ID NO: 492398 - RNA, 32 nt, Human
ucaacugggaaaaugaagaccugcuggaaaau

SEQ ID NO: 492399 - RNA, 32 nt, Human
ucaacugggagguuagaugggggccagggucc

SEQ ID NO: 492400 - RNA, 23 nt, Human
ucaacugggccaggagguaguuu

SEQ ID NO: 492401 - RNA, 32 nt, Human
ucaacugguguuuucagaccucaguuggauga

SEQ ID NO: 492402 - RNA, 32 nt, Human
ucaacuguaguuggcuuuugaaugaggaugac

SEQ ID NO: 492403 - RNA, 23 nt, Human
ucaacuguuacucuuuucuuuca

SEQ ID NO: 492404 - RNA, 29 nt, Human
ucaacuguugugugugugcaugccuuggg

SEQ ID NO: 492405 - RNA, 32 nt, Human
ucaacuguuucuuuaaaaugcauuuacugauu

SEQ ID NO: 492406 - RNA, 32 nt, Human
ucaacuuaugcagaacuggcaacuuacuacug

SEQ ID NO: 492407 - RNA, 32 nt, Human
ucaacuucagccaggcucucagacuggaggug

SEQ ID NO: 492408 - RNA, 32 nt, Human
ucaacuuccacucaccuaugaaugggguauuu

SEQ ID NO: 492409 - RNA, 20 nt, Human
ucaacuuccugggcucaagu

SEQ ID NO: 492410 - RNA, 22 nt, Human
ucaacuuccugggcucaaguga

SEQ ID NO: 492411 - RNA, 32 nt, Human
ucaacuuccuuuucuuucuuccuuccuuucuu

SEQ ID NO: 492412 - RNA, 32 nt, Human
ucaacuucugggcucccagugcccauuggcug

SEQ ID NO: 492413 - RNA, 32 nt, Human
ucaacuucuucaguugaguuaucugaaagugu

SEQ ID NO: 492414 - RNA, 32 nt, Human
ucaacuucuugggccuuggcucugaguuggaa

SEQ ID NO: 492415 - RNA, 32 nt, Human
ucaacuugaagcaagcuuucucucauaacgua

SEQ ID NO: 492416 - RNA, 23 nt, Human
ucaacuugcuaauuuaugccaga

SEQ ID NO: 492417 - RNA, 32 nt, Human
ucaacuugcugcaucaaagauaugagauuuuu

SEQ ID NO: 492418 - RNA, 32 nt, Human
ucaacuugguugcucugauaccccagagccug

SEQ ID NO: 492419 - RNA, 32 nt, Human
ucaacuuucucauuuggccugugcagaagaca

SEQ ID NO: 492420 - RNA, 32 nt, Human
ucaacuuugcaaccuccgaugagaagaaaaug

SEQ ID NO: 492421 - RNA, 32 nt, Human
ucaacuuugcagcugcugugucucuucgucgu

SEQ ID NO: 492422 - RNA, 32 nt, Human
ucaagaaaaagcaugagcuggccacacaugua

SEQ ID NO: 492423 - RNA, 32 nt, Human
ucaagaaaaccagcaacccagacuuccacugg

SEQ ID NO: 492424 - RNA, 23 nt, Human
ucaagaaaaugcccuccccucca

SEQ ID NO: 492425 - RNA, 32 nt, Human
ucaagaaacaaaggaaucuggggucuucugac

SEQ ID NO: 492426 - RNA, 21 nt, Human
ucaagaaacaaauacauuuua

SEQ ID NO: 492427 - RNA, 32 nt, Human
ucaagaaaccucuuuucacugcaccugaggcu

SEQ ID NO: 492428 - RNA, 32 nt, Human
ucaagaaacugauccuggagaucgagaccauc

SEQ ID NO: 492429 - RNA, 32 nt, Human
ucaagaaauccuuacagguaaguauugcuucc

SEQ ID NO: 492430 - RNA, 21 nt, Human
ucaagaaauuaaaaucaucua

SEQ ID NO: 492431 - RNA, 32 nt, Human
ucaagaacaauccugaagcacagugaacuuga

SEQ ID NO: 492432 - RNA, 32 nt, Human
ucaagaacagccuagccaacauggugaaaccc

SEQ ID NO: 492433 - RNA, 32 nt, Human
ucaagaacagccugaccaacauggugaaacuc

SEQ ID NO: 492434 - RNA, 32 nt, Human
ucaagaacagccuuaccaacaugaugaaacca

SEQ ID NO: 492435 - RNA, 32 nt, Human
ucaagaacauccuggcuaacacggugaaacuc

SEQ ID NO: 492436 - RNA, 32 nt, Human
ucaagaacaugcugggcagagcuuaagccacu

SEQ ID NO: 492437 - RNA, 32 nt, Human
ucaagaaccucaggagcgcugccagcuugaca

SEQ ID NO: 492438 - RNA, 32 nt, Human
ucaagaaccuguugagaggagcaccuagcaua

SEQ ID NO: 492439 - RNA, 32 nt, Human
ucaagaacucaagcuccaugaggagauguuuc

SEQ ID NO: 492440 - RNA, 32 nt, Human
ucaagaacugcaaaugagacaggaagcuguuc

SEQ ID NO: 492441 - RNA, 32 nt, Human
ucaagaagaguaucugacuuucuuggaagugu

SEQ ID NO: 492442 - RNA, 32 nt, Human
ucaagaaggaaaaggugacaucaguugugacc

SEQ ID NO: 492443 - RNA, 32 nt, Human
ucaagaaggccaggaaauaccuccauagcugg

SEQ ID NO: 492444 - RNA, 32 nt, Human
ucaagaagucaggcaggaggauuucccuuuua

SEQ ID NO: 492445 - RNA, 32 nt, Human
ucaagaauacagaaaaaugaaaauaacauuuu

SEQ ID NO: 492446 - RNA, 32 nt, Human
ucaagaaucuucuguuccacauccacacagcc

SEQ ID NO: 492447 - RNA, 32 nt, Human
ucaagaaucuuuccuuaauuacaugcaaauac

SEQ ID NO: 492448 - RNA, 31 nt, Human
ucaagaaugcucucugggcgcuguucuugca

SEQ ID NO: 492449 - RNA, 32 nt, Human
ucaagaauggcagcauccugugccucagcacg

SEQ ID NO: 492450 - RNA, 32 nt, Human
ucaagaauucacccaguguucuuuggaugucc

SEQ ID NO: 492451 - RNA, 32 nt, Human
ucaagacaaaccuggccaacauggugaaaccc

SEQ ID NO: 492452 - RNA, 32 nt, Human
ucaagacaagagcuguuaugcuguuuccuagc

SEQ ID NO: 492453 - RNA, 32 nt, Human
ucaagacaagccuggccaacauggugaaaccc

SEQ ID NO: 492454 - RNA, 31 nt, Human
ucaagacaagugugggcaacacagcaagacc

SEQ ID NO: 492455 - RNA, 32 nt, Human
ucaagacagacacccgggggccugugucugug

SEQ ID NO: 492456 - RNA, 32 nt, Human
ucaagacagauuccuuuuuaaaggaauucuga

SEQ ID NO: 492457 - RNA, 25 nt, Human
ucaagacaggugacaccagcacuuu

SEQ ID NO: 492458 - RNA, 32 nt, Human
ucaagacagugcuggcaaagcugcaguauuga

SEQ ID NO: 492459 - RNA, 32 nt, Human
ucaagaccaaacuggccaauauagugagaucc

SEQ ID NO: 492460 - RNA, 32 nt, Human
ucaagaccaaccugacuaacauggugaaaccc

SEQ ID NO: 492461 - RNA, 32 nt, Human
ucaagaccaaccuggccaacauugugaaaccc

SEQ ID NO: 492462 - RNA, 32 nt, Human
ucaagaccaaucugacuaacacggugaaaccc

SEQ ID NO: 492463 - RNA, 32 nt, Human
ucaagaccaaucuggccaacauggugaaaccc

SEQ ID NO: 492464 - RNA, 32 nt, Human
ucaagaccacccuggccaacauggugaaaccc

SEQ ID NO: 492465 - RNA, 32 nt, Human
ucaagaccacccuggccaacauggugacaccc

SEQ ID NO: 492466 - RNA, 32 nt, Human
ucaagaccacccuggccaacaugguuaaaccc

SEQ ID NO: 492467 - RNA, 32 nt, Human
ucaagaccacccuggccaaccuggugaaaccc

SEQ ID NO: 492468 - RNA, 32 nt, Human
ucaagaccacccuggcuaacacggugaaaccc

SEQ ID NO: 492469 - RNA, 23 nt, Human
ucaagaccagccagggcaacaug

SEQ ID NO: 492470 - RNA, 32 nt, Human
ucaagaccagccagggcaacaugaugagaccc

SEQ ID NO: 492471 - RNA, 32 nt, Human
ucaagaccagccagggcaacauggugagaccu

SEQ ID NO: 492472 - RNA, 32 nt, Human
ucaagaccagcccagccaacauggugaaaacc

SEQ ID NO: 492473 - RNA, 32 nt, Human
ucaagaccagcccaggcaacauggugacccca

SEQ ID NO: 492474 - RNA, 32 nt, Human
ucaagaccagccuagccaacauggugaaaccc

SEQ ID NO: 492475 - RNA, 32 nt, Human
ucaagaccagccuagccaagauggugaaaccc

SEQ ID NO: 492476 - RNA, 32 nt, Human
ucaagaccagccuaggcaacauagugagaugc

SEQ ID NO: 492477 - RNA, 32 nt, Human
ucaagaccagccuaggcaacauggugaaaccc

SEQ ID NO: 492478 - RNA, 32 nt, Human
ucaagaccagccuaggcaacuaagugaaaccc

SEQ ID NO: 492479 - RNA, 32 nt, Human
ucaagaccagccuaggcaauguagugacaccu

SEQ ID NO: 492480 - RNA, 32 nt, Human
ucaagaccagccuaggccagauggugaaaccc

SEQ ID NO: 492481 - RNA, 32 nt, Human
ucaagaccagccuagguaacauagugggaccc

SEQ ID NO: 492482 - RNA, 32 nt, Human
ucaagaccagccucaucaacauagugagaccc

SEQ ID NO: 492483 - RNA, 32 nt, Human
ucaagaccagccugaccaacaucgugaaaugc

SEQ ID NO: 492484 - RNA, 32 nt, Human
ucaagaccagccugaccaacauggagaaaccc

SEQ ID NO: 492485 - RNA, 32 nt, Human
ucaagaccagccugaccaacauggagaaacgc

SEQ ID NO: 492486 - RNA, 32 nt, Human
ucaagaccagccugaccaacauggauaaaucc

SEQ ID NO: 492487 - RNA, 32 nt, Human
ucaagaccagccugaccaacauggauuaaccc

SEQ ID NO: 492488 - RNA, 32 nt, Human
ucaagaccagccugaccaacauggcaaaacau

SEQ ID NO: 492489 - RNA, 32 nt, Human
ucaagaccagccugaccaacauggccaaaaac

SEQ ID NO: 492490 - RNA, 32 nt, Human
ucaagaccagccugaccaacauggcgaaaccc

SEQ ID NO: 492491 - RNA, 32 nt, Human
ucaagaccagccugaccaacauggugaaaccc

SEQ ID NO: 492492 - RNA, 32 nt, Human
ucaagaccagccugaccaacauggugaaaccu

SEQ ID NO: 492493 - RNA, 32 nt, Human
ucaagaccagccugaccaacauggugaaaucc

SEQ ID NO: 492494 - RNA, 32 nt, Human
ucaagaccagccugaccaacguggcgaaaccu

SEQ ID NO: 492495 - RNA, 32 nt, Human
ucaagaccagccugaccaauauagugaaacac

SEQ ID NO: 492496 - RNA, 32 nt, Human
ucaagaccagccugacgaacauggugaaaccc

SEQ ID NO: 492497 - RNA, 32 nt, Human
ucaagaccagccugagaaacauagugagcccu

SEQ ID NO: 492498 - RNA, 32 nt, Human
ucaagaccagccugagcaacauagugagaccc

SEQ ID NO: 492499 - RNA, 32 nt, Human
ucaagaccagccugagcaacaugaugaaacuc

SEQ ID NO: 492500 - RNA, 32 nt, Human
ucaagaccagccugaguaacaugaugagaccc

SEQ ID NO: 492501 - RNA, 32 nt, Human
ucaagaccagccugaucaacauggugaaaccc

SEQ ID NO: 492502 - RNA, 32 nt, Human
ucaagaccagccugcccaacauagugaaacuc

SEQ ID NO: 492503 - RNA, 32 nt, Human
ucaagaccagccugcccaacauggcaaaaccu

SEQ ID NO: 492504 - RNA, 32 nt, Human
ucaagaccagccugcccaacauggugaaaccc

SEQ ID NO: 492505 - RNA, 32 nt, Human
ucaagaccagccuggacaacauagugagaccu

SEQ ID NO: 492506 - RNA, 23 nt, Human
ucaagaccagccuggacaacaug

SEQ ID NO: 492507 - RNA, 32 nt, Human
ucaagaccagccuggacaacauggcaaaaccc

SEQ ID NO: 492508 - RNA, 32 nt, Human
ucaagaccagccuggacaacauggcaagaccc

SEQ ID NO: 492509 - RNA, 32 nt, Human
ucaagaccagccuggacaacauggugaaaccc

SEQ ID NO: 492510 - RNA, 32 nt, Human
ucaagaccagccuggacaauauagugaaaccc

SEQ ID NO: 492511 - RNA, 32 nt, Human
ucaagaccagccuggacagcuuagugagaucc

SEQ ID NO: 492512 - RNA, 32 nt, Human
ucaagaccagccuggcaaacauggugaaacgc

SEQ ID NO: 492513 - RNA, 32 nt, Human
ucaagaccagccuggccaaacauggugaaacc

SEQ ID NO: 492514 - RNA, 32 nt, Human
ucaagaccagccuggccaacaaggcgaaaccc

SEQ ID NO: 492515 - RNA, 32 nt, Human
ucaagaccagccuggccaacaaggugaaaccc

SEQ ID NO: 492516 - RNA, 32 nt, Human
ucaagaccagccuggccaacacagugaaaccc

SEQ ID NO: 492517 - RNA, 32 nt, Human
ucaagaccagccuggccaacacggugaaaccc

SEQ ID NO: 492518 - RNA, 32 nt, Human
ucaagaccagccuggccaacagggugaaaccc

SEQ ID NO: 492519 - RNA, 32 nt, Human
ucaagaccagccuggccaacauagugaaaacu

SEQ ID NO: 492520 - RNA, 32 nt, Human
ucaagaccagccuggccaacauagugaaaccc

SEQ ID NO: 492521 - RNA, 23 nt, Human
ucaagaccagccuggccaacaug

SEQ ID NO: 492522 - RNA, 32 nt, Human
ucaagaccagccuggccaacaugauaaaacac

SEQ ID NO: 492523 - RNA, 32 nt, Human
ucaagaccagccuggccaacaugauaaaaucu

SEQ ID NO: 492524 - RNA, 32 nt, Human
ucaagaccagccuggccaacaugaugaaaccc

SEQ ID NO: 492525 - RNA, 32 nt, Human
ucaagaccagccuggccaacaugaugaaaccu

SEQ ID NO: 492526 - RNA, 32 nt, Human
ucaagaccagccuggccaacaugaugagaccu

SEQ ID NO: 492527 - RNA, 32 nt, Human
ucaagaccagccuggccaacauggagaaaccc

SEQ ID NO: 492528 - RNA, 32 nt, Human
ucaagaccagccuggccaacauggcaaaaccc

SEQ ID NO: 492529 - RNA, 32 nt, Human
ucaagaccagccuggccaacauggcaaaaucc

SEQ ID NO: 492530 - RNA, 32 nt, Human
ucaagaccagccuggccaacauggcagaaacc

SEQ ID NO: 492531 - RNA, 32 nt, Human
ucaagaccagccuggccaacauggcgaaaacc

SEQ ID NO: 492532 - RNA, 32 nt, Human
ucaagaccagccuggccaacauggcgaaaccc

SEQ ID NO: 492533 - RNA, 32 nt, Human
ucaagaccagccuggccaacauggcgaaaccu

SEQ ID NO: 492534 - RNA, 32 nt, Human
ucaagaccagccuggccaacauggcgaaauuc

SEQ ID NO: 492535 - RNA, 32 nt, Human
ucaagaccagccuggccaacauggcgaauucc

SEQ ID NO: 492536 - RNA, 32 nt, Human
ucaagaccagccuggccaacaugguaaaaccc

SEQ ID NO: 492537 - RNA, 32 nt, Human
ucaagaccagccuggccaacauggucccagcu

SEQ ID NO: 492538 - RNA, 32 nt, Human
ucaagaccagccuggccaacauggugaaaacc

SEQ ID NO: 492539 - RNA, 32 nt, Human
ucaagaccagccuggccaacauggugaaacac

SEQ ID NO: 492540 - RNA, 32 nt, Human
ucaagaccagccuggccaacauggugaaaccc

SEQ ID NO: 492541 - RNA, 32 nt, Human
ucaagaccagccuggccaacauggugaaaccu

SEQ ID NO: 492542 - RNA, 32 nt, Human
ucaagaccagccuggccaacauggugaaacgu

SEQ ID NO: 492543 - RNA, 32 nt, Human
ucaagaccagccuggccaacauggugaaaucc

SEQ ID NO: 492544 - RNA, 32 nt, Human
ucaagaccagccuggccaacauggugaauccc

SEQ ID NO: 492545 - RNA, 32 nt, Human
ucaagaccagccuggccaacauggugaauuau

SEQ ID NO: 492546 - RNA, 32 nt, Human
ucaagaccagccuggccaacauggugagacac

SEQ ID NO: 492547 - RNA, 32 nt, Human
ucaagaccagccuggccaacaugguggaaccc

SEQ ID NO: 492548 - RNA, 32 nt, Human
ucaagaccagccuggccaacaugguguaaccu

SEQ ID NO: 492549 - RNA, 32 nt, Human
ucaagaccagccuggccaacaugguguaacgc

SEQ ID NO: 492550 - RNA, 32 nt, Human
ucaagaccagccuggccaacaugugaaacccc

SEQ ID NO: 492551 - RNA, 32 nt, Human
ucaagaccagccuggccaaccuggugaaaccc

SEQ ID NO: 492552 - RNA, 32 nt, Human
ucaagaccagccuggccaaccuggugaaaugc

SEQ ID NO: 492553 - RNA, 23 nt, Human
ucaagaccagccuggccaacgug

SEQ ID NO: 492554 - RNA, 32 nt, Human
ucaagaccagccuggccaacguggcaaauacc

SEQ ID NO: 492555 - RNA, 32 nt, Human
ucaagaccagccuggccaacguggugaaacac

SEQ ID NO: 492556 - RNA, 32 nt, Human
ucaagaccagccuggccaacguggugaaaccc

SEQ ID NO: 492557 - RNA, 32 nt, Human
ucaagaccagccuggccaacguggugaaaccu

SEQ ID NO: 492558 - RNA, 32 nt, Human
ucaagaccagccuggccaacguggugaaagcc

SEQ ID NO: 492559 - RNA, 32 nt, Human
ucaagaccagccuggccaacuuggugaaaccc

SEQ ID NO: 492560 - RNA, 32 nt, Human
ucaagaccagccuggccaagauggugaaaucc

SEQ ID NO: 492561 - RNA, 32 nt, Human
ucaagaccagccuggccaagaugguggaaccc

SEQ ID NO: 492562 - RNA, 32 nt, Human
ucaagaccagccuggccaauauggcaaaaccc

SEQ ID NO: 492563 - RNA, 32 nt, Human
ucaagaccagccuggccaauauggugaaaccc

SEQ ID NO: 492564 - RNA, 32 nt, Human
ucaagaccagccuggccaauguagugaaaccc

SEQ ID NO: 492565 - RNA, 32 nt, Human
ucaagaccagccuggccaaugugaugaaaccc

SEQ ID NO: 492566 - RNA, 32 nt, Human
ucaagaccagccuggccaauguggugaaaccc

SEQ ID NO: 492567 - RNA, 32 nt, Human
ucaagaccagccuggccacauggugcaacccc

SEQ ID NO: 492568 - RNA, 32 nt, Human
ucaagaccagccuggccagcauagugaaaccc

SEQ ID NO: 492569 - RNA, 32 nt, Human
ucaagaccagccuggccaucauggugaaaccc

SEQ ID NO: 492570 - RNA, 32 nt, Human
ucaagaccagccuggcccaaauggugaaaccc

SEQ ID NO: 492571 - RNA, 32 nt, Human
ucaagaccagccuggccgacauggcgaaaccc

SEQ ID NO: 492572 - RNA, 32 nt, Human
ucaagaccagccuggccgggguggugaaaccc

SEQ ID NO: 492573 - RNA, 23 nt, Human
ucaagaccagccuggcuaacaug

SEQ ID NO: 492574 - RNA, 32 nt, Human
ucaagaccagccuggcuaacauggcaaaaccc

SEQ ID NO: 492575 - RNA, 32 nt, Human
ucaagaccagccuggcuaacauggugaaaccu

SEQ ID NO: 492576 - RNA, 32 nt, Human
ucaagaccagccuggcuaacauggugaaaucc

SEQ ID NO: 492577 - RNA, 32 nt, Human
ucaagaccagccuggcuaacaugugaaacuaa

SEQ ID NO: 492578 - RNA, 32 nt, Human
ucaagaccagccuggcuaauauggugaaaccc

SEQ ID NO: 492579 - RNA, 32 nt, Human
ucaagaccagccuggcugacaccgugaaaccu

SEQ ID NO: 492580 - RNA, 21 nt, Human
ucaagaccagccugggcaaca

SEQ ID NO: 492581 - RNA, 32 nt, Human
ucaagaccagccugggcaacacagugacaccu

SEQ ID NO: 492582 - RNA, 32 nt, Human
ucaagaccagccugggcaacacagugaggccc

SEQ ID NO: 492583 - RNA, 32 nt, Human
ucaagaccagccugggcaacacagugagugag

SEQ ID NO: 492584 - RNA, 32 nt, Human
ucaagaccagccugggcaacacggugaaaccc

SEQ ID NO: 492585 - RNA, 32 nt, Human
ucaagaccagccugggcaacauaguaagaccc

SEQ ID NO: 492586 - RNA, 32 nt, Human
ucaagaccagccugggcaacauagugaaaccg

SEQ ID NO: 492587 - RNA, 32 nt, Human
ucaagaccagccugggcaacauagugagaacc

SEQ ID NO: 492588 - RNA, 32 nt, Human
ucaagaccagccugggcaacauagugagaaug

SEQ ID NO: 492589 - RNA, 32 nt, Human
ucaagaccagccugggcaacauagugagaccc

SEQ ID NO: 492590 - RNA, 32 nt, Human
ucaagaccagccugggcaacauagugagaccu

SEQ ID NO: 492591 - RNA, 32 nt, Human
ucaagaccagccugggcaacauagugagacgc

SEQ ID NO: 492592 - RNA, 32 nt, Human
ucaagaccagccugggcaacauagugagacuc

SEQ ID NO: 492593 - RNA, 32 nt, Human
ucaagaccagccugggcaacauggcaagaccc

SEQ ID NO: 492594 - RNA, 32 nt, Human
ucaagaccagccugggcaacauggcgaaaacc

SEQ ID NO: 492595 - RNA, 32 nt, Human
ucaagaccagccugggcaacauggcgaaaccc

SEQ ID NO: 492596 - RNA, 32 nt, Human
ucaagaccagccugggcaacauggcgagaccc

SEQ ID NO: 492597 - RNA, 32 nt, Human
ucaagaccagccugggcaacauggcuauaugg

SEQ ID NO: 492598 - RNA, 32 nt, Human
ucaagaccagccugggcaacaugguaaaacuc

SEQ ID NO: 492599 - RNA, 32 nt, Human
ucaagaccagccugggcaacauggugaaaccc

SEQ ID NO: 492600 - RNA, 32 nt, Human
ucaagaccagccugggcaacauggugaaaucc

SEQ ID NO: 492601 - RNA, 32 nt, Human
ucaagaccagccugggcaacauggugagaccc

SEQ ID NO: 492602 - RNA, 32 nt, Human
ucaagaccagccugggcaacauggugagauuu

SEQ ID NO: 492603 - RNA, 32 nt, Human
ucaagaccagccugggcaacgugguggugugc

SEQ ID NO: 492604 - RNA, 32 nt, Human
ucaagaccagccugggcaacuuagugaggccc

SEQ ID NO: 492605 - RNA, 32 nt, Human
ucaagaccagccugggcaauauagugagaccc

SEQ ID NO: 492606 - RNA, 32 nt, Human
ucaagaccagccugggcaauguaguaagaccc

SEQ ID NO: 492607 - RNA, 32 nt, Human
ucaagaccagccugggcaaugugaugaaacuc

SEQ ID NO: 492608 - RNA, 32 nt, Human
ucaagaccagccugggcagcauggugaaaccc

SEQ ID NO: 492609 - RNA, 21 nt, Human
ucaagaccagccuggguaaca

SEQ ID NO: 492610 - RNA, 32 nt, Human
ucaagaccagccuggguaacaaagugagaccc

SEQ ID NO: 492611 - RNA, 32 nt, Human
ucaagaccagccuggguaacauggugaaaucc

SEQ ID NO: 492612 - RNA, 32 nt, Human
ucaagaccagccuggucaacauagugagacac

SEQ ID NO: 492613 - RNA, 23 nt, Human
ucaagaccagccuggucaacaug

SEQ ID NO: 492614 - RNA, 32 nt, Human
ucaagaccagccuggucaacauggcaaaagcc

SEQ ID NO: 492615 - RNA, 32 nt, Human
ucaagaccagccuggucaacauggugaaaccc

SEQ ID NO: 492616 - RNA, 32 nt, Human
ucaagaccagccuggucaacauggugaaacug

SEQ ID NO: 492617 - RNA, 32 nt, Human
ucaagaccagccuggucaacauggugaaaucu

SEQ ID NO: 492618 - RNA, 32 nt, Human
ucaagaccagccuguccaacauggugaaaccc

SEQ ID NO: 492619 - RNA, 32 nt, Human
ucaagaccagccuugccaacauggugaaaccc

SEQ ID NO: 492620 - RNA, 32 nt, Human
ucaagaccagccuugccaagauggugacaccc

SEQ ID NO: 492621 - RNA, 32 nt, Human
ucaagaccagccuuggcaacauggugaaaccc

SEQ ID NO: 492622 - RNA, 32 nt, Human
ucaagaccagcguggccaacguggcgaaaccc

SEQ ID NO: 492623 - RNA, 32 nt, Human
ucaagaccagcugggccaacaugguuaaaccc

SEQ ID NO: 492624 - RNA, 32 nt, Human
ucaagaccagcuuggccaacauagugaaaucc

SEQ ID NO: 492625 - RNA, 32 nt, Human
ucaagaccagcuuggccaacauggagaaaccc

SEQ ID NO: 492626 - RNA, 32 nt, Human
ucaagaccagcuuggccaacauggcgaaaccc

SEQ ID NO: 492627 - RNA, 32 nt, Human
ucaagaccagcuuggccaacauggugaaaccc

SEQ ID NO: 492628 - RNA, 32 nt, Human
ucaagaccagcuuggccaacauggugaaaccu

SEQ ID NO: 492629 - RNA, 32 nt, Human
ucaagaccaggauaugaaaagagaagauaaga

SEQ ID NO: 492630 - RNA, 32 nt, Human
ucaagaccaggcuggccaacaugguaaaaccc

SEQ ID NO: 492631 - RNA, 32 nt, Human
ucaagaccaggcuggccaacauggugaaaccc

SEQ ID NO: 492632 - RNA, 32 nt, Human
ucaagaccaggcuggucaacauggcgaaaccc

SEQ ID NO: 492633 - RNA, 32 nt, Human
ucaagaccagggcagaggucauugaggucacu

SEQ ID NO: 492634 - RNA, 32 nt, Human
ucaagaccaguauggccaacaugguaagaccc

SEQ ID NO: 492635 - RNA, 32 nt, Human
ucaagaccagucugagcaacauggugagagcu

SEQ ID NO: 492636 - RNA, 32 nt, Human
ucaagaccagucugagcaauagagugaggccu

SEQ ID NO: 492637 - RNA, 32 nt, Human
ucaagaccagucuggccaacauggugaaaugc

SEQ ID NO: 492638 - RNA, 32 nt, Human
ucaagaccagucuggccaauauggagaaaccu

SEQ ID NO: 492639 - RNA, 32 nt, Human
ucaagaccagucugggcaacaugguaaaaccc

SEQ ID NO: 492640 - RNA, 32 nt, Human
ucaagaccagucugggcaacauggugagaccc

SEQ ID NO: 492641 - RNA, 32 nt, Human
ucaagaccauacuggcuaacacggugaaaccc

SEQ ID NO: 492642 - RNA, 32 nt, Human
ucaagaccaucccggcuaaaacggugaaaccc

SEQ ID NO: 492643 - RNA, 32 nt, Human
ucaagaccauccuggccaacacagugaaaccc

SEQ ID NO: 492644 - RNA, 32 nt, Human
ucaagaccauccuggccaacauagugaaaccc

SEQ ID NO: 492645 - RNA, 32 nt, Human
ucaagaccauccuggccaacaugaugaaaccc

SEQ ID NO: 492646 - RNA, 32 nt, Human
ucaagaccauccuggccaacauggugaaacca

SEQ ID NO: 492647 - RNA, 32 nt, Human
ucaagaccauccuggccaacauggugaaaccc

SEQ ID NO: 492648 - RNA, 32 nt, Human
ucaagaccauccuggccaacauggugaaaccu

SEQ ID NO: 492649 - RNA, 32 nt, Human
ucaagaccauccuggccaacauggugaaacgc

SEQ ID NO: 492650 - RNA, 32 nt, Human
ucaagaccauccuggcuaacaaggugaaaccu

SEQ ID NO: 492651 - RNA, 32 nt, Human
ucaagaccauccuggcuaacacagugaaaccc

SEQ ID NO: 492652 - RNA, 32 nt, Human
ucaagaccauccuggcuaacacggcgaaacgc

SEQ ID NO: 492653 - RNA, 32 nt, Human
ucaagaccauccuggcuaacacgguaaaaccc

SEQ ID NO: 492654 - RNA, 32 nt, Human
ucaagaccauccuggcuaacacggugaaaccc

SEQ ID NO: 492655 - RNA, 32 nt, Human
ucaagaccauccuggcuaacacggugaaacuc

SEQ ID NO: 492656 - RNA, 32 nt, Human
ucaagaccauccuggcuaacacggugauaccc

SEQ ID NO: 492657 - RNA, 32 nt, Human
ucaagaccauccuggcuaacacguugaaaccc

SEQ ID NO: 492658 - RNA, 32 nt, Human
ucaagaccauccuggcuaacauagugaaaccc

SEQ ID NO: 492659 - RNA, 32 nt, Human
ucaagaccauccuggcuaacauggugaaaccc

SEQ ID NO: 492660 - RNA, 32 nt, Human
ucaagaccaucguggcuuacacggugaaaccc

SEQ ID NO: 492661 - RNA, 32 nt, Human
ucaagaccaucuuggcuaacacagugaaaccc

SEQ ID NO: 492662 - RNA, 32 nt, Human
ucaagaccauucuggccaacauggugaaaccc

SEQ ID NO: 492663 - RNA, 32 nt, Human
ucaagacccuggggcuccgggucuucuuagca

SEQ ID NO: 492664 - RNA, 32 nt, Human
ucaagaccggccuggccaacauggugaaaccc

SEQ ID NO: 492665 - RNA, 32 nt, Human
ucaagaccuauguaauggacaagcagcaggcc

SEQ ID NO: 492666 - RNA, 32 nt, Human
ucaagaccugccuggccaacauggugaaaccc

SEQ ID NO: 492667 - RNA, 32 nt, Human
ucaagacggugaaaauugugugcugcuuaggc

SEQ ID NO: 492668 - RNA, 32 nt, Human
ucaagacuagccugaccaacauggugaaacuc

SEQ ID NO: 492669 - RNA, 32 nt, Human
ucaagacuagccuggccaacaucaugaaaccc

SEQ ID NO: 492670 - RNA, 32 nt, Human
ucaagacuagccuggccaacaugaugaaaccc

SEQ ID NO: 492671 - RNA, 32 nt, Human
ucaagacuagccuggccaacauggcaaaaccc

SEQ ID NO: 492672 - RNA, 32 nt, Human
ucaagacuagccuggccaacauggugaaaccc

SEQ ID NO: 492673 - RNA, 32 nt, Human
ucaagacuagccuggccaacauggugagacac

SEQ ID NO: 492674 - RNA, 32 nt, Human
ucaagacuagccuggccaacauguuguaaacc

SEQ ID NO: 492675 - RNA, 32 nt, Human
ucaagacuagccuggcugacauggugaaacuc

SEQ ID NO: 492676 - RNA, 32 nt, Human
ucaagacuagccuggucaacauggugaaaccc

SEQ ID NO: 492677 - RNA, 32 nt, Human
ucaagacuauccuggccaacauggugaaaccc

SEQ ID NO: 492678 - RNA, 32 nt, Human
ucaagacuauccuggcuaacacgguaaaaccc

SEQ ID NO: 492679 - RNA, 32 nt, Human
ucaagacucagggugucccgaagcugagcccc

SEQ ID NO: 492680 - RNA, 32 nt, Human
ucaagacuggacuugaacuccugggcucaagc

SEQ ID NO: 492681 - RNA, 32 nt, Human
ucaagacuguccuggacaacauggugaaaccc

SEQ ID NO: 492682 - RNA, 32 nt, Human
ucaagacuucugugucucacacaagcuuucaa

SEQ ID NO: 492683 - RNA, 32 nt, Human
ucaagagaaaacuacuuagugcaucagaagaa

SEQ ID NO: 492684 - RNA, 32 nt, Human
ucaagagaacaacagagugggucucuugggga

SEQ ID NO: 492685 - RNA, 32 nt, Human
ucaagagaauuccuguucuccuugugcuauga

SEQ ID NO: 492686 - RNA, 32 nt, Human
ucaagagagaagguagcacgucuuuguucaaa

SEQ ID NO: 492687 - RNA, 32 nt, Human
ucaagagagacacggcuccugccuucauggag

SEQ ID NO: 492688 - RNA, 32 nt, Human
ucaagagagggugugggauugggacccaggcc

SEQ ID NO: 492689 - RNA, 22 nt, Human
ucaagagauggagaccauccug

SEQ ID NO: 492690 - RNA, 32 nt, Human
ucaagagauucugccucagccuccagaguagc

SEQ ID NO: 492691 - RNA, 32 nt, Human
ucaagagcagccuggccaacauggugaaaccc

SEQ ID NO: 492692 - RNA, 32 nt, Human
ucaagagcagccuggccaacauugugaaaccc

SEQ ID NO: 492693 - RNA, 32 nt, Human
ucaagagcagccuggccaaccuggugaaaccc

SEQ ID NO: 492694 - RNA, 32 nt, Human
ucaagagcagccuggccaagauggugaaaccc

SEQ ID NO: 492695 - RNA, 32 nt, Human
ucaagagcagccuggucaacauggugaaacuc

SEQ ID NO: 492696 - RNA, 32 nt, Human
ucaagagcaggucccaggugugccugcagcag

SEQ ID NO: 492697 - RNA, 32 nt, Human
ucaagagcagucugggcaacauggugagaccc

SEQ ID NO: 492698 - RNA, 32 nt, Human
ucaagagcagugagguuuguucuuuccaguga

SEQ ID NO: 492699 - RNA, 32 nt, Human
ucaagagcaguugguugggagucugagaaguc

SEQ ID NO: 492700 - RNA, 32 nt, Human
ucaagagccaucuucgaucuuugcggccugag

SEQ ID NO: 492701 - RNA, 32 nt, Human
ucaagagccgacugucagccucggcgggccgg

SEQ ID NO: 492702 - RNA, 32 nt, Human
ucaagagccuccguaccuccccugggcggcgg

SEQ ID NO: 492703 - RNA, 32 nt, Human
ucaagagccuugauuauaguaggaagcugaaa

SEQ ID NO: 492704 - RNA, 32 nt, Human
ucaagagcuaccugggcagaagcuccaggccc

SEQ ID NO: 492705 - RNA, 32 nt, Human
ucaagagcuagaaccugcugcaagucacugcc

SEQ ID NO: 492706 - RNA, 32 nt, Human
ucaagagcuagaguuugaauggguuuuauaua

SEQ ID NO: 492707 - RNA, 32 nt, Human
ucaagagcuccaauggggucuccagcugaaag

SEQ ID NO: 492708 - RNA, 32 nt, Human
ucaagagcuuuuggauaaggaggcaggaagaa

SEQ ID NO: 492709 - RNA, 32 nt, Human
ucaagaggaagaagaagagggaggacucagga

SEQ ID NO: 492710 - RNA, 32 nt, Human
ucaagaggaagauagacaggaggaggagguca

SEQ ID NO: 492711 - RNA, 32 nt, Human
ucaagaggcugagacaggagaaacacuugaac

SEQ ID NO: 492712 - RNA, 32 nt, Human
ucaagaggcugaggcaagagaaucacuugaac

SEQ ID NO: 492713 - RNA, 32 nt, Human
ucaagaggcugaggcacgagaaucacuugaac

SEQ ID NO: 492714 - RNA, 32 nt, Human
ucaagaggcugaggcaggagaaucacuugcac

SEQ ID NO: 492715 - RNA, 32 nt, Human
ucaagaggcugaggcaggagaaucacuuguac

SEQ ID NO: 492716 - RNA, 32 nt, Human
ucaagaggcugaggcaggagaaucgccugaac

SEQ ID NO: 492717 - RNA, 32 nt, Human
ucaagaggcugaggcaggagaaucgcuugaac

SEQ ID NO: 492718 - RNA, 32 nt, Human
ucaagaggcugaggcaggagaauuccuugaac

SEQ ID NO: 492719 - RNA, 32 nt, Human
ucaagaggcugaggcaggagaauugcuugaac

SEQ ID NO: 492720 - RNA, 32 nt, Human
ucaagaggcugaggcaggagaauuguuugaac

SEQ ID NO: 492721 - RNA, 32 nt, Human
ucaagaggcugagguaggagaaucacuugaac

SEQ ID NO: 492722 - RNA, 32 nt, Human
ucaagaggcugaggugggagaaucgcuugaac

SEQ ID NO: 492723 - RNA, 32 nt, Human
ucaagaggcugcagcggcugcugcaggcccuc

SEQ ID NO: 492724 - RNA, 32 nt, Human
ucaagagggagguggaggcaggcacugaauaa

SEQ ID NO: 492725 - RNA, 32 nt, Human
ucaagagggagguuuccuccugagugaagaga

SEQ ID NO: 492726 - RNA, 32 nt, Human
ucaagagggugaggcaggagaaucgcuugaac

SEQ ID NO: 492727 - RNA, 32 nt, Human
ucaagagguaaauuguccugaaacccccauug

SEQ ID NO: 492728 - RNA, 32 nt, Human
ucaagaguaguugaaaguaucuugccacuguu

SEQ ID NO: 492729 - RNA, 32 nt, Human
ucaagagugcucuuuuuaucaccuucuggaaa

SEQ ID NO: 492730 - RNA, 32 nt, Human
ucaagaguggggucagcaagagaaacucuacg

SEQ ID NO: 492731 - RNA, 32 nt, Human
ucaagaguucaucucaggagacaaggacugug

SEQ ID NO: 492732 - RNA, 32 nt, Human
ucaagaguuucagaagcaacaggacagaccag

SEQ ID NO: 492733 - RNA, 32 nt, Human
ucaagauacuauacauuuaaagcaccccaaug

SEQ ID NO: 492734 - RNA, 32 nt, Human
ucaagaucagccugaccaacaugaugaaaccc

SEQ ID NO: 492735 - RNA, 32 nt, Human
ucaagaucagccugcgcaacauggcgaaaccc

SEQ ID NO: 492736 - RNA, 32 nt, Human
ucaagaucagccuggccaacauaaggagaccu

SEQ ID NO: 492737 - RNA, 32 nt, Human
ucaagaucagccuggccaacauggcaaaaccc

SEQ ID NO: 492738 - RNA, 32 nt, Human
ucaagaucagccuggccaacauggugaaaccc

SEQ ID NO: 492739 - RNA, 32 nt, Human
ucaagaucagccuggcuaacauggcgaaaccc

SEQ ID NO: 492740 - RNA, 32 nt, Human
ucaagaucagccugggaaacauagugagaccc

SEQ ID NO: 492741 - RNA, 32 nt, Human
ucaagaucagccugggcaacauagugaaaccu

SEQ ID NO: 492742 - RNA, 32 nt, Human
ucaagaucagccugggcaacauagugagaccu

SEQ ID NO: 492743 - RNA, 32 nt, Human
ucaagaucagccugggcaacauggugaaaccu

SEQ ID NO: 492744 - RNA, 32 nt, Human
ucaagaucagccugggcaauauagugaaaccc

SEQ ID NO: 492745 - RNA, 32 nt, Human
ucaagaucaggccacauaaggaacaggggaau

SEQ ID NO: 492746 - RNA, 23 nt, Human
ucaagaucagguugcuccacaca

SEQ ID NO: 492747 - RNA, 32 nt, Human
ucaagaucauccuggccaacauggugaaaccc

SEQ ID NO: 492748 - RNA, 32 nt, Human
ucaagaucccagguuacggaauggcaccaagu

SEQ ID NO: 492749 - RNA, 32 nt, Human
ucaagaucuucauuuauacagcuguuaaaucc

SEQ ID NO: 492750 - RNA, 22 nt, Human
ucaagaugagaauuaaaggcau

SEQ ID NO: 492751 - RNA, 32 nt, Human
ucaagaugcagguggaguacaugucauucagc

SEQ ID NO: 492752 - RNA, 32 nt, Human
ucaagaugcccuggcagcagauuucugcagga

SEQ ID NO: 492753 - RNA, 32 nt, Human
ucaagaugccucugcagccacaauucugaccu

SEQ ID NO: 492754 - RNA, 32 nt, Human
ucaagauggagacaaucuccacagccaccaug

SEQ ID NO: 492755 - RNA, 32 nt, Human
ucaagauggugacuugguuucuggaaacugcu

SEQ ID NO: 492756 - RNA, 32 nt, Human
ucaagauuacaacaucuguuacauucuaagug

SEQ ID NO: 492757 - RNA, 32 nt, Human
ucaagauuagccuggacaacauggugaaaccc

SEQ ID NO: 492758 - RNA, 32 nt, Human
ucaagauuagccuggccaacuuagugaaacuc

SEQ ID NO: 492759 - RNA, 32 nt, Human
ucaagauuccauuucuuaacagucuccaaucc

SEQ ID NO: 492760 - RNA, 32 nt, Human
ucaagauucuguaaaccaagcaaaugggggaa

SEQ ID NO: 492761 - RNA, 32 nt, Human
ucaagauuuugaucugagacaugcugaugcuu

SEQ ID NO: 492762 - RNA, 32 nt, Human
ucaagcaaaaugucucuuguggcccaucuuac

SEQ ID NO: 492763 - RNA, 32 nt, Human
ucaagcaaaccaccucaccacacuauccaggg

SEQ ID NO: 492764 - RNA, 32 nt, Human
ucaagcaauaauuguuuccaacuugucuggga

SEQ ID NO: 492765 - RNA, 32 nt, Human
ucaagcaauauggaagcaaccagcaaauuaac

SEQ ID NO: 492766 - RNA, 32 nt, Human
ucaagcaauccucccaucucagccucuuaaag

SEQ ID NO: 492767 - RNA, 32 nt, Human
ucaagcaauccuccugccucagccucucaagu

SEQ ID NO: 492768 - RNA, 32 nt, Human
ucaagcaauccucucaucuccaccuccagagu

SEQ ID NO: 492769 - RNA, 32 nt, Human
ucaagcaaucugccagccucagccucucaaag

SEQ ID NO: 492770 - RNA, 32 nt, Human
ucaagcaauucucccaccucagccucucgagu

SEQ ID NO: 492771 - RNA, 32 nt, Human
ucaagcaauucucccaccucagccucuugagu

SEQ ID NO: 492772 - RNA, 19 nt, Human
ucaagcaauucuccugccu

SEQ ID NO: 492773 - RNA, 32 nt, Human
ucaagcacaagcuccugaaggagugggccugg

SEQ ID NO: 492774 - RNA, 32 nt, Human
ucaagcacaggccagaauccacacuccugucc

SEQ ID NO: 492775 - RNA, 32 nt, Human
ucaagcaccaccacccggccguguggugcccg

SEQ ID NO: 492776 - RNA, 32 nt, Human
ucaagcaccugccccuugccuccuugaccaca

SEQ ID NO: 492777 - RNA, 32 nt, Human
ucaagcaccugucaugugccauugagcccacg

SEQ ID NO: 492778 - RNA, 32 nt, Human
ucaagcacuccuggagggaucugggugccggc

SEQ ID NO: 492779 - RNA, 32 nt, Human
ucaagcagaaccagaagagaacuuuacaccug

SEQ ID NO: 492780 - RNA, 20 nt, Human
ucaagcagcaucuucugguu

SEQ ID NO: 492781 - RNA, 32 nt, Human
ucaagcaggccccgcuggugcacugagagcca

SEQ ID NO: 492782 - RNA, 32 nt, Human
ucaagcaggucaggaaccugcuuuuuaacaag

SEQ ID NO: 492783 - RNA, 32 nt, Human
ucaagcagguuagagaaaauagagaugaauua

SEQ ID NO: 492784 - RNA, 32 nt, Human
ucaagcaguccucccaccccagccucugagua

SEQ ID NO: 492785 - RNA, 32 nt, Human
ucaagcaguccuccccacucagccucucuagu

SEQ ID NO: 492786 - RNA, 32 nt, Human
ucaagcaguucucccaccucagccucucgacu

SEQ ID NO: 492787 - RNA, 32 nt, Human
ucaagcaucucuacuuuuuacuggagugaaaa

SEQ ID NO: 492788 - RNA, 32 nt, Human
ucaagcauggccaaccuccaccuuccccucuc

SEQ ID NO: 492789 - RNA, 32 nt, Human
ucaagccaaacaguaaaaacuaccaagagaac

SEQ ID NO: 492790 - RNA, 32 nt, Human
ucaagccaagcccagaggcaguggcugggguc

SEQ ID NO: 492791 - RNA, 32 nt, Human
ucaagccacacaugcauguucgugcauccccc

SEQ ID NO: 492792 - RNA, 32 nt, Human
ucaagccacagaaacccagcaugucccuguca

SEQ ID NO: 492793 - RNA, 32 nt, Human
ucaagccacagacauuguggugucaccaucca

SEQ ID NO: 492794 - RNA, 32 nt, Human
ucaagccacaguuaucaaaggcuacauuuuca

SEQ ID NO: 492795 - RNA, 32 nt, Human
ucaagccacguaugucagaugacuugaauguu

SEQ ID NO: 492796 - RNA, 32 nt, Human
ucaagccacugaggcagggcagagggaccuuu

SEQ ID NO: 492797 - RNA, 32 nt, Human
ucaagccacugcacuccagccugggcgacaga

SEQ ID NO: 492798 - RNA, 32 nt, Human
ucaagccacuggcagccucaugccaccacauu

SEQ ID NO: 492799 - RNA, 32 nt, Human
ucaagccagacucugcaauuucucccaaggcu

SEQ ID NO: 492800 - RNA, 32 nt, Human
  misc_feature (28)..(30): n is a, c, g or u
ucaagccaggagacccugucuggggugnnnau

SEQ ID NO: 492801 - RNA, 32 nt, Human
ucaagccagggccguuggcuuaugccuguaau

SEQ ID NO: 492802 - RNA, 32 nt, Human
ucaagccaucaugcggugggugcugccaugac

SEQ ID NO: 492803 - RNA, 21 nt, Human
ucaagccauccucccaccuca

SEQ ID NO: 492804 - RNA, 21 nt, Human
ucaagccauccucccuccuca

SEQ ID NO: 492805 - RNA, 32 nt, Human
ucaagccaucugccugccuccaccucccaaaa

SEQ ID NO: 492806 - RNA, 17 nt, Human
ucaagccaugugacuuu

SEQ ID NO: 492807 - RNA, 32 nt, Human
ucaagccauugcacuccagccugggcaacaag

SEQ ID NO: 492808 - RNA, 32 nt, Human
ucaagccauuguacuccagccuggacaacaag

SEQ ID NO: 492809 - RNA, 32 nt, Human
ucaagccauuuugccacucgcuucccugccau

SEQ ID NO: 492810 - RNA, 32 nt, Human
ucaagcccacagacuucaaauaacuucaagaa

SEQ ID NO: 492811 - RNA, 32 nt, Human
ucaagcccagagaagacugaggcuacggggaa

SEQ ID NO: 492812 - RNA, 32 nt, Human
ucaagcccaggaguuugaaguugcaaugagcu

SEQ ID NO: 492813 - RNA, 24 nt, Human
ucaagcccauaaucccagcacuuu

SEQ ID NO: 492814 - RNA, 32 nt, Human
ucaagcccauaaucccagcacuuugggaggcu

SEQ ID NO: 492815 - RNA, 18 nt, Human
ucaagccccacaguucuu

SEQ ID NO: 492816 - RNA, 32 nt, Human
ucaagccccagaggaggcggcaagaggaacag

SEQ ID NO: 492817 - RNA, 32 nt, Human
ucaagcccccuccaaaggcuccccuacccggu

SEQ ID NO: 492818 - RNA, 32 nt, Human
ucaagcccccuuccuugcucuggaccccuuag

SEQ ID NO: 492819 - RNA, 23 nt, Human
ucaagcccugaagcauggggcca

SEQ ID NO: 492820 - RNA, 32 nt, Human
ucaagcccugcugggaccuuguggcuuggcug

SEQ ID NO: 492821 - RNA, 32 nt, Human
ucaagcccugggaggucaaggcugcagugagc

SEQ ID NO: 492822 - RNA, 32 nt, Human
ucaagccgaagagucauccucucaccucaccc

SEQ ID NO: 492823 - RNA, 32 nt, Human
ucaagccgagggcagaggccuuuguacgcagc

SEQ ID NO: 492824 - RNA, 32 nt, Human
ucaagccgcccaggaacucgagauucugguua

SEQ ID NO: 492825 - RNA, 32 nt, Human
ucaagccuagccuggccaacauggugaaaccc

SEQ ID NO: 492826 - RNA, 23 nt, Human
ucaagccuauaaucccagcacuu

SEQ ID NO: 492827 - RNA, 24 nt, Human
ucaagccuauaaucccagcacuuu

SEQ ID NO: 492828 - RNA, 32 nt, Human
ucaagccuauaaucccagcacuuugggaggca

SEQ ID NO: 492829 - RNA, 32 nt, Human
ucaagccuauaaucccagcauguugagaggcu

SEQ ID NO: 492830 - RNA, 32 nt, Human
ucaagccucggacugcagagugugugacggcu

SEQ ID NO: 492831 - RNA, 32 nt, Human
ucaagccugaagauaguggcucugcuguuuuc

SEQ ID NO: 492832 - RNA, 18 nt, Human
ucaagccugauuauuuuu

SEQ ID NO: 492833 - RNA, 32 nt, Human
ucaagccugccuggcgucucugugccccugug

SEQ ID NO: 492834 - RNA, 24 nt, Human
ucaagccuggacaacagggcaaga

SEQ ID NO: 492835 - RNA, 23 nt, Human
ucaagccugggcaacagagcaag

SEQ ID NO: 492836 - RNA, 24 nt, Human
ucaagccugggcaacagagcaaga

SEQ ID NO: 492837 - RNA, 24 nt, Human
ucaagccugggcaacagagugaga

SEQ ID NO: 492838 - RNA, 32 nt, Human
ucaagccugggcaacagagugagaccccaacu

SEQ ID NO: 492839 - RNA, 32 nt, Human
ucaagccugggcgacagagcaaggcuucaucu

SEQ ID NO: 492840 - RNA, 24 nt, Human
ucaagccugggcgacagagcgaga

SEQ ID NO: 492841 - RNA, 32 nt, Human
ucaagccugggcgacagagcgagacuccgucu

SEQ ID NO: 492842 - RNA, 32 nt, Human
ucaagccuggggcagguggaagguggucugac

SEQ ID NO: 492843 - RNA, 32 nt, Human
ucaagccugggugacagagcaagacuccaucu

SEQ ID NO: 492844 - RNA, 32 nt, Human
ucaagccugggugacagagcgaaacuccgucu

SEQ ID NO: 492845 - RNA, 24 nt, Human
ucaagccuguaaucccaacacuuu

SEQ ID NO: 492846 - RNA, 32 nt, Human
ucaagccuguaaucccagcacguugggaggcc

SEQ ID NO: 492847 - RNA, 24 nt, Human
ucaagccuguaaucccagcacuuu

SEQ ID NO: 492848 - RNA, 32 nt, Human
ucaagccuguaaucccagcacuuuagguggcu

SEQ ID NO: 492849 - RNA, 32 nt, Human
ucaagccuguaaucccagcacuuugggaggcc

SEQ ID NO: 492850 - RNA, 32 nt, Human
ucaagccuguaaucccagcacuuugggaggcu

SEQ ID NO: 492851 - RNA, 32 nt, Human
ucaagccuguaaucccagcacuuuggguggcc

SEQ ID NO: 492852 - RNA, 24 nt, Human
ucaagccuguaaucccagcaguuu

SEQ ID NO: 492853 - RNA, 32 nt, Human
ucaagccuguaaucccagcauuuugggaggcc

SEQ ID NO: 492854 - RNA, 24 nt, Human
ucaagccuguaaucccaguacuuu

SEQ ID NO: 492855 - RNA, 32 nt, Human
ucaagccuguaauccuagcacuuugggaggca

SEQ ID NO: 492856 - RNA, 32 nt, Human
ucaagccuguaaugucagcacuuuaaaaggcu

SEQ ID NO: 492857 - RNA, 32 nt, Human
ucaagccuguaguuccagcuacucgggaggcu

SEQ ID NO: 492858 - RNA, 32 nt, Human
ucaagccugucaucccagcacugugggaggcc

SEQ ID NO: 492859 - RNA, 32 nt, Human
ucaagccugugggcagcaugcccagauuccca

SEQ ID NO: 492860 - RNA, 16 nt, Human
ucaagccuguugucuu

SEQ ID NO: 492861 - RNA, 16 nt, Human
ucaagccuguuuucuu

SEQ ID NO: 492862 - RNA, 32 nt, Human
ucaagccuuaaaggaggcugccguggagcacg

SEQ ID NO: 492863 - RNA, 16 nt, Human
ucaagccuucguucuu

SEQ ID NO: 492864 - RNA, 32 nt, Human
ucaagccuucugcuccccaauucucucuguug

SEQ ID NO: 492865 - RNA, 32 nt, Human
ucaagccuugacuguucuugcccggcaagaga

SEQ ID NO: 492866 - RNA, 18 nt, Human
ucaagccuugggauucuu

SEQ ID NO: 492867 - RNA, 18 nt, Human
ucaagccuuuuuauucuu

SEQ ID NO: 492868 - RNA, 19 nt, Human
ucaagcgauccuccugccu

SEQ ID NO: 492869 - RNA, 32 nt, Human
ucaagcgauccuucugccucagccucucuggu

SEQ ID NO: 492870 - RNA, 32 nt, Human
ucaagcgaugcucccaccuccaccucccaaag

SEQ ID NO: 492871 - RNA, 32 nt, Human
ucaagcgauucuccugacucagccucucaagu

SEQ ID NO: 492872 - RNA, 32 nt, Human
ucaagcgauucuccugccucagccucucaagu

SEQ ID NO: 492873 - RNA, 32 nt, Human
ucaagcgauucuccugccucagccucucgagu

SEQ ID NO: 492874 - RNA, 32 nt, Human
ucaagcgauucuccugccucagccucucuagu

SEQ ID NO: 492875 - RNA, 32 nt, Human
ucaagcgauucuccugccucagccucuggagu

SEQ ID NO: 492876 - RNA, 32 nt, Human
ucaagcgauucucuuaacucagccucuugagu

SEQ ID NO: 492877 - RNA, 32 nt, Human
ucaagcgauucuugugccucagccucucgagu

SEQ ID NO: 492878 - RNA, 32 nt, Human
ucaagcgcugacugggugccugccuggggcuu

SEQ ID NO: 492879 - RNA, 32 nt, Human
ucaagcggagccaagagaggagcagacaagga

SEQ ID NO: 492880 - RNA, 32 nt, Human
ucaagcgggccugggcuccaggaagcuggcca

SEQ ID NO: 492881 - RNA, 32 nt, Human
ucaagcgguccuucuaccucagccucuggagc

SEQ ID NO: 492882 - RNA, 32 nt, Human
ucaagcgugguggcucacgccuguaauccagc

SEQ ID NO: 492883 - RNA, 32 nt, Human
ucaagcuaaguggcaagcgggaagcugaaacu

SEQ ID NO: 492884 - RNA, 32 nt, Human
ucaagcuagggcagcagguagcucuucccagc

SEQ ID NO: 492885 - RNA, 32 nt, Human
ucaagcuaguaaaaccuuguacuucucuauug

SEQ ID NO: 492886 - RNA, 32 nt, Human
ucaagcuauaaaagcaggagguuaucugugca

SEQ ID NO: 492887 - RNA, 32 nt, Human
ucaagcuauccucccaccucagccucucaaau

SEQ ID NO: 492888 - RNA, 32 nt, Human
ucaagcuauucucaugccucagccucucaagu

SEQ ID NO: 492889 - RNA, 32 nt, Human
ucaagcucaaacaccaccucccuuauucagga

SEQ ID NO: 492890 - RNA, 32 nt, Human
ucaagcucaggaguucgagaccagcccggcca

SEQ ID NO: 492891 - RNA, 24 nt, Human
ucaagcuccugaacucaagcaauu

SEQ ID NO: 492892 - RNA, 32 nt, Human
ucaagcucugauuaaagugaaaaugcauuuuu

SEQ ID NO: 492893 - RNA, 32 nt, Human
ucaagcucugcaguuuccugucuggcacccug

SEQ ID NO: 492894 - RNA, 22 nt, Human
ucaagcugaagucagucuucuu

SEQ ID NO: 492895 - RNA, 32 nt, Human
ucaagcugauuuuauuggucaugagaacaaau

SEQ ID NO: 492896 - RNA, 32 nt, Human
ucaagcugcuguacuccuggccucagagcccc

SEQ ID NO: 492897 - RNA, 32 nt, Human
ucaagcuggccuacugccuccaacacacuacg

SEQ ID NO: 492898 - RNA, 31 nt, Human
ucaagcugggagagagaaaugacugagauga

SEQ ID NO: 492899 - RNA, 17 nt, Human
ucaagcugucaauuuuu

SEQ ID NO: 492900 - RNA, 29 nt, Human
ucaagcugucugugucuuugugugucugc

SEQ ID NO: 492901 - RNA, 18 nt, Human
ucaagcuguguaauuuuu

SEQ ID NO: 492902 - RNA, 32 nt, Human
ucaagcuuggaugacagagcaagacuccguuu

SEQ ID NO: 492903 - RNA, 18 nt, Human
ucaagcuugggaacuuuu

SEQ ID NO: 492904 - RNA, 24 nt, Human
ucaagcuugggugacagagcaaga

SEQ ID NO: 492905 - RNA, 32 nt, Human
ucaagcuugggugacagagcaagaccccgucc

SEQ ID NO: 492906 - RNA, 17 nt, Human
ucaagcuuucaagccuu

SEQ ID NO: 492907 - RNA, 24 nt, Human
ucaagcuuuccgagucaagugauu

SEQ ID NO: 492908 - RNA, 32 nt, Human
ucaagcuuuccuugccuuccagccacugcaaa

SEQ ID NO: 492909 - RNA, 32 nt, Human
ucaaggaaaaacacccacuacuuagcagacug

SEQ ID NO: 492910 - RNA, 32 nt, Human
ucaaggaaaccagaauuugacacacuccaaca

SEQ ID NO: 492911 - RNA, 32 nt, Human
ucaaggaagaaaggaaggaaggaaggcgagag

SEQ ID NO: 492912 - RNA, 22 nt, Human
ucaaggaagccuaugagaugcc

SEQ ID NO: 492913 - RNA, 32 nt, Human
ucaaggaaggaagugggaacaagguuggaugc

SEQ ID NO: 492914 - RNA, 32 nt, Human
ucaaggaaggguggggcaggcaguacccccaa

SEQ ID NO: 492915 - RNA, 32 nt, Human
ucaaggaagguagccgggcauggugccaggca

SEQ ID NO: 492916 - RNA, 32 nt, Human
ucaaggaauaggguggggcaaugugucauucu

SEQ ID NO: 492917 - RNA, 32 nt, Human
ucaaggaauauucaauauucugccuuucagaa

SEQ ID NO: 492918 - RNA, 32 nt, Human
ucaaggaauccuccugccccagccucucagau

SEQ ID NO: 492919 - RNA, 32 nt, Human
ucaaggaaugggaggccuuucacuggguccag

SEQ ID NO: 492920 - RNA, 32 nt, Human
ucaaggacaacagcagggugucacccagagcc

SEQ ID NO: 492921 - RNA, 32 nt, Human
ucaaggacaagcuucucauuauggcaggcaua

SEQ ID NO: 492922 - RNA, 32 nt, Human
ucaaggacacuggccuugcaggcccgagggag

SEQ ID NO: 492923 - RNA, 32 nt, Human
ucaaggaccauggccugagccugguggacgcc

SEQ ID NO: 492924 - RNA, 32 nt, Human
ucaaggaccgggagguaagagguuugggacug

SEQ ID NO: 492925 - RNA, 23 nt, Human
ucaaggaccuaguucuuuaggga

SEQ ID NO: 492926 - RNA, 32 nt, Human
ucaaggacuccucucuuucuucaccaagaagc

SEQ ID NO: 492927 - RNA, 32 nt, Human
ucaaggacugucccuccagcagucgccuccuc

SEQ ID NO: 492928 - RNA, 32 nt, Human
ucaaggacuuuaaucauacuuguuccaaagag

SEQ ID NO: 492929 - RNA, 32 nt, Human
ucaaggagacgcuggcccuggagcugcacgga

SEQ ID NO: 492930 - RNA, 32 nt, Human
ucaaggaggaaagagagggagauggaggaugu

SEQ ID NO: 492931 - RNA, 32 nt, Human
ucaaggaggagaagagugaggagaaaggaaac

SEQ ID NO: 492932 - RNA, 21 nt, Human
ucaaggaggaggcucccuuca

SEQ ID NO: 492933 - RNA, 32 nt, Human
ucaaggaggcacugggcucagccugggcauua

SEQ ID NO: 492934 - RNA, 32 nt, Human
ucaaggagggaccugugcccugcuccacaucc

SEQ ID NO: 492935 - RNA, 32 nt, Human
ucaaggaggugggggcagggaggaucacugga

SEQ ID NO: 492936 - RNA, 32 nt, Human
ucaaggaguacaaccuggucuggcgccccagg

SEQ ID NO: 492937 - RNA, 32 nt, Human
ucaaggagucaugggugccccugggaaauucc

SEQ ID NO: 492938 - RNA, 32 nt, Human
ucaaggaguuccauuccaggaggaagagaucu

SEQ ID NO: 492939 - RNA, 31 nt, Human
ucaaggauagaguacaguuguaggggaagua

SEQ ID NO: 492940 - RNA, 32 nt, Human
ucaaggauuuuuauugcucugugaguuauuuu

SEQ ID NO: 492941 - RNA, 32 nt, Human
ucaaggcaagccccagucucaagcuagaguuu

SEQ ID NO: 492942 - RNA, 32 nt, Human
ucaaggcaaugaccagaaugauaugcuuccug

SEQ ID NO: 492943 - RNA, 32 nt, Human
ucaaggcaauggucagcuacggcaugaucccg

SEQ ID NO: 492944 - RNA, 32 nt, Human
ucaaggcacaaacuggcaggugcuuaauuagg

SEQ ID NO: 492945 - RNA, 32 nt, Human
ucaaggcacccaggauugauugcaggaauauc

SEQ ID NO: 492946 - RNA, 32 nt, Human
ucaaggcaccuugaccgucgcccacccacacc

SEQ ID NO: 492947 - RNA, 32 nt, Human
ucaaggcagaccuacaagaugggguacuaaca

SEQ ID NO: 492948 - RNA, 32 nt, Human
ucaaggcagaggaggagaggaggaaaggaugg

SEQ ID NO: 492949 - RNA, 32 nt, Human
ucaaggcaguuuucuucuuugagaaacuaucc

SEQ ID NO: 492950 - RNA, 32 nt, Human
ucaaggccacaggcacacaggucucauugcuu

SEQ ID NO: 492951 - RNA, 32 nt, Human
ucaaggccagccuggacaacauaguaagaccc

SEQ ID NO: 492952 - RNA, 32 nt, Human
ucaaggccagccuggccaacauggugaacccc

SEQ ID NO: 492953 - RNA, 32 nt, Human
ucaaggccagccuggccaacgugaugaaacuc

SEQ ID NO: 492954 - RNA, 22 nt, Human
ucaaggccagccugggaacaug

SEQ ID NO: 492955 - RNA, 32 nt, Human
ucaaggccagccugggcaacauaguaagacuc

SEQ ID NO: 492956 - RNA, 32 nt, Human
ucaaggccagccugggcaacauagugaagccc

SEQ ID NO: 492957 - RNA, 32 nt, Human
ucaaggccagccugggcaacauggugaaaccc

SEQ ID NO: 492958 - RNA, 31 nt, Human
ucaaggccagccugggcaacauggugucucu

SEQ ID NO: 492959 - RNA, 32 nt, Human
ucaaggccagguguggugauucaugccugaaa

SEQ ID NO: 492960 - RNA, 32 nt, Human
ucaaggccaguucugcagugacaggcccaggg

SEQ ID NO: 492961 - RNA, 32 nt, Human
ucaaggccauccuggccaacauggugaaaccc

SEQ ID NO: 492962 - RNA, 32 nt, Human
ucaaggccauccuggcuaacacggugaaaccc

SEQ ID NO: 492963 - RNA, 32 nt, Human
ucaaggcccacauucuuaaauacugugcauaa

SEQ ID NO: 492964 - RNA, 32 nt, Human
ucaaggcccaggcugggguucagaccugcaga

SEQ ID NO: 492965 - RNA, 32 nt, Human
ucaaggccccauccaccucccucccuugacuc

SEQ ID NO: 492966 - RNA, 32 nt, Human
ucaaggccuaggagaauggggucacaugguca

SEQ ID NO: 492967 - RNA, 32 nt, Human
ucaaggccugggaguaaucuucagcucacugc

SEQ ID NO: 492968 - RNA, 32 nt, Human
ucaaggcgacacagcagagcccacagguggca

SEQ ID NO: 492969 - RNA, 32 nt, Human
ucaaggcggaucugggcuuccacccucaugaa

SEQ ID NO: 492970 - RNA, 32 nt, Human
ucaaggcgggagggccugcagugauucagcag

SEQ ID NO: 492971 - RNA, 32 nt, Human
ucaaggcgugaucucugucacuuuauuuuaau

SEQ ID NO: 492972 - RNA, 32 nt, Human
ucaaggcucacugcaaccucaaccuucugguu

SEQ ID NO: 492973 - RNA, 32 nt, Human
ucaaggcucacugcagccucaaccuucugggu

SEQ ID NO: 492974 - RNA, 32 nt, Human
ucaaggcucacugcagccuggaccuccugguu

SEQ ID NO: 492975 - RNA, 32 nt, Human
ucaaggcucacugcagccuugaacaccuggac

SEQ ID NO: 492976 - RNA, 32 nt, Human
ucaaggcucuuccguuccacauccacacagcc

SEQ ID NO: 492977 - RNA, 32 nt, Human
ucaaggcugcagugagcucaugaucauaccac

SEQ ID NO: 492978 - RNA, 32 nt, Human
ucaaggcugcugguuacauagacaugguagaa

SEQ ID NO: 492979 - RNA, 32 nt, Human
ucaagggaaacaaucacauuguuugauuccaa

SEQ ID NO: 492980 - RNA, 32 nt, Human
ucaagggaacaaagucugaagauggaacggag

SEQ ID NO: 492981 - RNA, 32 nt, Human
ucaagggaaguuuacuguugaagaacugucua

SEQ ID NO: 492982 - RNA, 32 nt, Human
ucaagggagcugauaaagaacuucuucccaaa

SEQ ID NO: 492983 - RNA, 32 nt, Human
ucaagggaggcagggccccugugggcacuagg

SEQ ID NO: 492984 - RNA, 31 nt, Human
ucaagggagggccuaaagcacuuguaacuuu

SEQ ID NO: 492985 - RNA, 32 nt, Human
ucaagggaggggccuugggcccacccucacag

SEQ ID NO: 492986 - RNA, 32 nt, Human
ucaagggaguaaguagagguggcuucagaaau

SEQ ID NO: 492987 - RNA, 32 nt, Human
ucaagggagucaggccacccaggagcagagga

SEQ ID NO: 492988 - RNA, 32 nt, Human
ucaagggauccucccaccucagccucuggagu

SEQ ID NO: 492989 - RNA, 32 nt, Human
ucaagggaucgucuugccucagucucccaagu

SEQ ID NO: 492990 - RNA, 32 nt, Human
ucaagggauguauuggaacaugucggaguaga

SEQ ID NO: 492991 - RNA, 32 nt, Human
ucaagggauucuccugccucagccucuugagu

SEQ ID NO: 492992 - RNA, 32 nt, Human
ucaagggcaaaaagucuacauacuuucauccu

SEQ ID NO: 492993 - RNA, 23 nt, Human
ucaagggcacacaaguucacaca

SEQ ID NO: 492994 - RNA, 32 nt, Human
ucaagggcaucgacaucugccucccagcacca

SEQ ID NO: 492995 - RNA, 32 nt, Human
ucaagggccagccuccagcgcugcucuuucug

SEQ ID NO: 492996 - RNA, 32 nt, Human
ucaagggccugaggcagauccagaggacaagc

SEQ ID NO: 492997 - RNA, 32 nt, Human
ucaagggcgagccugggcuacaggaggaucug

SEQ ID NO: 492998 - RNA, 32 nt, Human
ucaagggcuacaauucaagcacuuuuauucgu

SEQ ID NO: 492999 - RNA, 32 nt, Human
ucaagggcugcacugugcugaccaucgcccac

SEQ ID NO: 493000 - RNA, 32 nt, Human
ucaaggggaaaacaguuagacugugaaccugc

SEQ ID NO: 493001 - RNA, 32 nt, Human
ucaaggggaaggcaagacugggaugucuaguc

SEQ ID NO: 493002 - RNA, 32 nt, Human
ucaaggggaagggaguugucugccauucaaug

SEQ ID NO: 493003 - RNA, 32 nt, Human
ucaaggggcaggccuggggcccuucccuccug

SEQ ID NO: 493004 - RNA, 32 nt, Human
ucaaggggccccucaaaggcccucucuggggg

SEQ ID NO: 493005 - RNA, 32 nt, Human
ucaaggggccuuggcaucaggcccagacagag

SEQ ID NO: 493006 - RNA, 32 nt, Human
ucaagggguagggagagggaggagguugcaaa

SEQ ID NO: 493007 - RNA, 32 nt, Human
ucaaggguaaaauguuaggugucagcuuucag

SEQ ID NO: 493008 - RNA, 32 nt, Human
ucaaggguauacauauaugaaaagccaagaag

SEQ ID NO: 493009 - RNA, 32 nt, Human
ucaagggucaugguccucaucacacacauguc

SEQ ID NO: 493010 - RNA, 20 nt, Human
ucaagggugaaccaggccuu

SEQ ID NO: 493011 - RNA, 32 nt, Human
ucaagggugcagcucugcagcacaggcagccu

SEQ ID NO: 493012 - RNA, 32 nt, Human
ucaaggguggauccagcucgagacacccucgc

SEQ ID NO: 493013 - RNA, 32 nt, Human
ucaaggguguccugccugccuggguccagggc

SEQ ID NO: 493014 - RNA, 32 nt, Human
ucaaggguuggcaaacuacagcccacaggcca

SEQ ID NO: 493015 - RNA, 32 nt, Human
ucaaggguuuuccagguguagcuaacaguugc

SEQ ID NO: 493016 - RNA, 32 nt, Human
ucaagguaccgccuugcugaaguauuuauuua

SEQ ID NO: 493017 - RNA, 32 nt, Human
ucaaggucaaagcugagcuagccgggcaugag

SEQ ID NO: 493018 - RNA, 32 nt, Human
ucaaggucacugcaucagagcuguaacagauc

SEQ ID NO: 493019 - RNA, 32 nt, Human
ucaaggucaggagaucaagaccauccuggcua

SEQ ID NO: 493020 - RNA, 32 nt, Human
ucaaggucaggcaagugagcaccggggacuga

SEQ ID NO: 493021 - RNA, 32 nt, Human
ucaagguccacucaggcacaagagccacagua

SEQ ID NO: 493022 - RNA, 32 nt, Human
ucaagguccagccuugguccagggccguuugc

SEQ ID NO: 493023 - RNA, 32 nt, Human
ucaagguccuuucuauagacucaacaugcggu

SEQ ID NO: 493024 - RNA, 32 nt, Human
ucaaggucgcaccgcuacacuccagccugggu

SEQ ID NO: 493025 - RNA, 32 nt, Human
ucaaggucucuuuucauccuucaucugauucc

SEQ ID NO: 493026 - RNA, 24 nt, Human
ucaaggugacaucuguuuuacugg

SEQ ID NO: 493027 - RNA, 32 nt, Human
ucaaggugagagugagcuacaagaugaggcuu

SEQ ID NO: 493028 - RNA, 32 nt, Human
ucaaggugaugacggcacaaaauacuuagacu

SEQ ID NO: 493029 - RNA, 24 nt, Human
ucaaggugaugcucugucugcugg

SEQ ID NO: 493030 - RNA, 21 nt, Human
ucaaggugccuacuuugcugg

SEQ ID NO: 493031 - RNA, 32 nt, Human
ucaaggugccugaauccccugguaagugagug

SEQ ID NO: 493032 - RNA, 32 nt, Human
ucaagguggaacauacuguaaucuccagaugc

SEQ ID NO: 493033 - RNA, 32 nt, Human
ucaagguggccaccccagaugaagcuccugcc

SEQ ID NO: 493034 - RNA, 32 nt, Human
ucaaggugggagcagggcaagugccuucggag

SEQ ID NO: 493035 - RNA, 32 nt, Human
ucaagguggguggaucacuugaggucaggagu

SEQ ID NO: 493036 - RNA, 32 nt, Human
ucaagguggugguugaggagacagaggaccca

SEQ ID NO: 493037 - RNA, 32 nt, Human
ucaagguguagauuguacugaagagagagauu

SEQ ID NO: 493038 - RNA, 19 nt, Human
ucaagguguagcaagugua

SEQ ID NO: 493039 - RNA, 32 nt, Human
ucaaggugugggcuccugguggcugcucagug

SEQ ID NO: 493040 - RNA, 18 nt, Human
ucaagguuaaaauucuga

SEQ ID NO: 493041 - RNA, 32 nt, Human
ucaagguucacuguuguuuuguccucagaacc

SEQ ID NO: 493042 - RNA, 22 nt, Human
ucaagguucagcugcaggacca

SEQ ID NO: 493043 - RNA, 32 nt, Human
ucaagguugaacagauuucuagagccuuguuu

SEQ ID NO: 493044 - RNA, 32 nt, Human
ucaagguugcacagcaccuucaagauggggcu

SEQ ID NO: 493045 - RNA, 22 nt, Human
ucaagguugcgaguacaggcca

SEQ ID NO: 493046 - RNA, 21 nt, Human
ucaagguugguagugaaguca

SEQ ID NO: 493047 - RNA, 32 nt, Human
ucaagguuuaaccuuaaaauuaagauuuccuu

SEQ ID NO: 493048 - RNA, 32 nt, Human
ucaagguuuggaaagaaagaaaguugaguuuu

SEQ ID NO: 493049 - RNA, 19 nt, Human
ucaaguaaagcaaguugug

SEQ ID NO: 493050 - RNA, 24 nt, Human
ucaaguaacugggauuacaggcau

SEQ ID NO: 493051 - RNA, 32 nt, Human
ucaaguaagaauuggguuaagggaaaaauaga

SEQ ID NO: 493052 - RNA, 19 nt, Human
ucaaguaauaaauauuuaa

SEQ ID NO: 493053 - RNA, 19 nt, Human
ucaaguaauguggguugug

SEQ ID NO: 493054 - RNA, 32 nt, Human
ucaaguacacacuguuggcaaaaggcuaacac

SEQ ID NO: 493055 - RNA, 32 nt, Human
ucaaguaccagagaugucuccaagagcaccag

SEQ ID NO: 493056 - RNA, 32 nt, Human
ucaaguagacuccagugucuguuauucccuuc

SEQ ID NO: 493057 - RNA, 32 nt, Human
ucaaguagagcuggagaccaggauccguggcu

SEQ ID NO: 493058 - RNA, 32 nt, Human
ucaaguagccagaaacagguguucuggcuuua

SEQ ID NO: 493059 - RNA, 23 nt, Human
ucaaguagcugggacuacaggcg

SEQ ID NO: 493060 - RNA, 23 nt, Human
ucaaguagcugggauuacaagca

SEQ ID NO: 493061 - RNA, 24 nt, Human
ucaaguagcugggauuacaagcau

SEQ ID NO: 493062 - RNA, 30 nt, Human
ucaaguagcuugcauucuggaagcgaagaa

SEQ ID NO: 493063 - RNA, 32 nt, Human
ucaaguaguuucguaauuuccacacacagcac

SEQ ID NO: 493064 - RNA, 21 nt, Human
ucaaguauauaaaguuuugcc

SEQ ID NO: 493065 - RNA, 32 nt, Human
ucaaguauguauucagcaccuguugcaguaug

SEQ ID NO: 493066 - RNA, 32 nt, Human
ucaaguauuucccuacagaacuccucaagaaa

SEQ ID NO: 493067 - RNA, 32 nt, Human
ucaagucaauguuaauaaagcauuucaaaacc

SEQ ID NO: 493068 - RNA, 32 nt, Human
ucaagucaccacacuccagccugggugacaga

SEQ ID NO: 493069 - RNA, 32 nt, Human
ucaagucaccugcagauuuagcauuagacauc

SEQ ID NO: 493070 - RNA, 32 nt, Human
ucaagucacuaccaccaccacaauuaacagcu

SEQ ID NO: 493071 - RNA, 32 nt, Human
ucaagucacuccucagcugaggaccuguccau

SEQ ID NO: 493072 - RNA, 32 nt, Human
ucaagucagaggaggaagcugagggccccgag

SEQ ID NO: 493073 - RNA, 18 nt, Human
ucaagucagucaauuucc

SEQ ID NO: 493074 - RNA, 32 nt, Human
ucaagucaucuuugauuccuggaccuaauaaa

SEQ ID NO: 493075 - RNA, 32 nt, Human
ucaaguccacaucccugaagcugucagacagc

SEQ ID NO: 493076 - RNA, 32 nt, Human
ucaaguccagccugggcuacauagugagaccg

SEQ ID NO: 493077 - RNA, 32 nt, Human
ucaaguccaggaguucgagaccagccugggca

SEQ ID NO: 493078 - RNA, 32 nt, Human
ucaaguccauaaccacacuugcucucacauuu

SEQ ID NO: 493079 - RNA, 32 nt, Human
ucaaguccaugugucccauggcuggucagagc

SEQ ID NO: 493080 - RNA, 32 nt, Human
ucaagucccaggaguccugaccagagagcagg

SEQ ID NO: 493081 - RNA, 32 nt, Human
ucaagucccuccuggaagggagccagaggccc

SEQ ID NO: 493082 - RNA, 32 nt, Human
ucaagucgagccgcuucuaccugcugcugcug

SEQ ID NO: 493083 - RNA, 32 nt, Human
ucaagucgggcaagcggguggggaagcccuca

SEQ ID NO: 493084 - RNA, 32 nt, Human
ucaagucggguggaucaccugaggucaagagu

SEQ ID NO: 493085 - RNA, 32 nt, Human
ucaagucuccuguccuccuccuggagcagcag

SEQ ID NO: 493086 - RNA, 32 nt, Human
ucaagucugagccucaaggagccucugcgacu

SEQ ID NO: 493087 - RNA, 32 nt, Human
ucaagucugcaaccuaaaagugggagaucuug

SEQ ID NO: 493088 - RNA, 32 nt, Human
ucaagucugggagcugccggucccacucuguc

SEQ ID NO: 493089 - RNA, 24 nt, Human
ucaagucugggcgacagggugaga

SEQ ID NO: 493090 - RNA, 32 nt, Human
ucaagucuguaaucccagcgcuuugggaggcc

SEQ ID NO: 493091 - RNA, 19 nt, Human
ucaagucuucucaagucuu

SEQ ID NO: 493092 - RNA, 20 nt, Human
ucaagucuuuuuauuuuucc

SEQ ID NO: 493093 - RNA, 32 nt, Human
ucaagugaaaaggaggaccaagaggcaacagg

SEQ ID NO: 493094 - RNA, 21 nt, Human
ucaagugacccucccaccuca

SEQ ID NO: 493095 - RNA, 32 nt, Human
ucaagugacccucccaccucagccucucaagu

SEQ ID NO: 493096 - RNA, 32 nt, Human
ucaagugacccuuccacaucagccucuguaga

SEQ ID NO: 493097 - RNA, 32 nt, Human
ucaagugagcgcaagagguugaggcuccagug

SEQ ID NO: 493098 - RNA, 32 nt, Human
ucaagugauccaccagccuccaccucccgacg

SEQ ID NO: 493099 - RNA, 32 nt, Human
ucaagugauccgcccuccccagccucccaaag

SEQ ID NO: 493100 - RNA, 32 nt, Human
ucaagugauccucccaccucagccucucaagu

SEQ ID NO: 493101 - RNA, 32 nt, Human
ucaagugauccucccgccucagccucuugagu

SEQ ID NO: 493102 - RNA, 32 nt, Human
ucaagugauccucccgcuucagccucucaagc

SEQ ID NO: 493103 - RNA, 32 nt, Human
ucaagugauccuuccaccucagccucuggagu

SEQ ID NO: 493104 - RNA, 31 nt, Human
ucaagugaucugcccgccacagcaggcuggg

SEQ ID NO: 493105 - RNA, 19 nt, Human
ucaagugauuaagugugua

SEQ ID NO: 493106 - RNA, 21 nt, Human
ucaagugauucucccaucuca

SEQ ID NO: 493107 - RNA, 32 nt, Human
ucaagugauucucgugccucagccucuggagu

SEQ ID NO: 493108 - RNA, 32 nt, Human
ucaagugauucugccuguaaucccagaauuuu

SEQ ID NO: 493109 - RNA, 32 nt, Human
ucaagugauucuucugccucagccucucaagu

SEQ ID NO: 493110 - RNA, 32 nt, Human
ucaagugauucuugugccucagccucuccagu

SEQ ID NO: 493111 - RNA, 32 nt, Human
ucaagugcacacauaaccauaacaauucuuac

SEQ ID NO: 493112 - RNA, 32 nt, Human
ucaagugcagcucaauacuagcuucaguauaa

SEQ ID NO: 493113 - RNA, 32 nt, Human
ucaagugccugauccugcccugggcucagagc

SEQ ID NO: 493114 - RNA, 32 nt, Human
ucaagugccugauuaauugagguggcaacaua

SEQ ID NO: 493115 - RNA, 32 nt, Human
ucaagugccugccucugccccuuggugggcug

SEQ ID NO: 493116 - RNA, 32 nt, Human
ucaagugccuggaacagaacagccauucaaua

SEQ ID NO: 493117 - RNA, 32 nt, Human
ucaagugcucacugcaugaagacuggcuuguc

SEQ ID NO: 493118 - RNA, 32 nt, Human
ucaagugcuccucuucauuugaggacaccuac

SEQ ID NO: 493119 - RNA, 32 nt, Human
ucaagugcucuugccacagaacccaggugcuc

SEQ ID NO: 493120 - RNA, 32 nt, Human
ucaagugcugggacugggugggggcaggaugg

SEQ ID NO: 493121 - RNA, 32 nt, Human
ucaaguggagaaaagaggaauauuauuagaga

SEQ ID NO: 493122 - RNA, 32 nt, Human
ucaaguggagcauggcccucccuggcucccug

SEQ ID NO: 493123 - RNA, 32 nt, Human
ucaaguggaggcggaggaggaggcggaggagg

SEQ ID NO: 493124 - RNA, 32 nt, Human
ucaaguggcugggaugacuacaggcaugggcc

SEQ ID NO: 493125 - RNA, 32 nt, Human
ucaaguggcuuccaccucaaguggaagauuca

SEQ ID NO: 493126 - RNA, 32 nt, Human
ucaagugggccuuccugcucagccucuaugcc

SEQ ID NO: 493127 - RNA, 32 nt, Human
ucaaguggguuauuuagaguugaauagcaauu

SEQ ID NO: 493128 - RNA, 32 nt, Human
ucaagugguguuuuucacagucagaacuugaa

SEQ ID NO: 493129 - RNA, 21 nt, Human
ucaagugucaaccuugagguc

SEQ ID NO: 493130 - RNA, 18 nt, Human
ucaagugucaaucaucca

SEQ ID NO: 493131 - RNA, 32 nt, Human
ucaaguguccccagacccuucuugccugcugg

SEQ ID NO: 493132 - RNA, 32 nt, Human
ucaagugucugaucaagccucaguguaugggc

SEQ ID NO: 493133 - RNA, 32 nt, Human
ucaagugugagcugcggcugagcccagcgcuc

SEQ ID NO: 493134 - RNA, 32 nt, Human
ucaagugugcaucacuucuccuguucugccaa

SEQ ID NO: 493135 - RNA, 32 nt, Human
ucaagugugcccacccugcagucuucauccuc

SEQ ID NO: 493136 - RNA, 32 nt, Human
ucaaguguggguggacaguccuaauggggauc

SEQ ID NO: 493137 - RNA, 32 nt, Human
ucaaguguugcaggacagaugagcucaaggua

SEQ ID NO: 493138 - RNA, 32 nt, Human
ucaaguguuucuguuuauugggagacugccuu

SEQ ID NO: 493139 - RNA, 21 nt, Human
ucaaguuaagacaagguugua

SEQ ID NO: 493140 - RNA, 20 nt, Human
ucaaguuaccuaggcugcau

SEQ ID NO: 493141 - RNA, 32 nt, Human
ucaaguuauuuuuauaugaguuaaugugaaau

SEQ ID NO: 493142 - RNA, 32 nt, Human
ucaaguucacccucagaugcuuuccugggccc

SEQ ID NO: 493143 - RNA, 32 nt, Human
ucaaguuccagaggaacgggaugagcuccuga

SEQ ID NO: 493144 - RNA, 32 nt, Human
ucaaguucccagccagccaauggaugccagca

SEQ ID NO: 493145 - RNA, 32 nt, Human
ucaaguuccugggcucaaagaugggagucucc

SEQ ID NO: 493146 - RNA, 32 nt, Human
ucaaguucucauuccauuucuuugaugccacu

SEQ ID NO: 493147 - RNA, 32 nt, Human
ucaaguucuccuccuugaucaccguggccaga

SEQ ID NO: 493148 - RNA, 19 nt, Human
ucaaguucugucaauacuu

SEQ ID NO: 493149 - RNA, 32 nt, Human
ucaaguugccauagcagccucucucccaacaa

SEQ ID NO: 493150 - RNA, 32 nt, Human
ucaaguuggaaagaacaaaagaagaacaaaaa

SEQ ID NO: 493151 - RNA, 32 nt, Human
ucaaguuggauuugaacccagcugcucuguac

SEQ ID NO: 493152 - RNA, 24 nt, Human
ucaaguugggaggcccuccucuca

SEQ ID NO: 493153 - RNA, 32 nt, Human
ucaaguuguggucucagccaaaaugagugaua

SEQ ID NO: 493154 - RNA, 32 nt, Human
ucaaguuuaggucauuuagaagauuugacacu

SEQ ID NO: 493155 - RNA, 32 nt, Human
ucaaguuucauaaagaguucugauucccagag

SEQ ID NO: 493156 - RNA, 17 nt, Human
ucaaguuuccaauucuu

SEQ ID NO: 493157 - RNA, 24 nt, Human
ucaaguuuggcauagacucuuucc

SEQ ID NO: 493158 - RNA, 32 nt, Human
ucaaguuugggugacuggugcagaguuacuuc

SEQ ID NO: 493159 - RNA, 32 nt, Human
ucaaguuuucugcuuaguggcacugacauuaa

SEQ ID NO: 493160 - RNA, 32 nt, Human
ucaauaaaacauuuccuauagagccauaucau

SEQ ID NO: 493161 - RNA, 32 nt, Human
ucaauaaaacuguuucgaaaagaaggaaaagg

SEQ ID NO: 493162 - RNA, 32 nt, Human
ucaauaaaccagggacacaaugcacuguggaa

SEQ ID NO: 493163 - RNA, 32 nt, Human
ucaauaaaccaggggcacaaugcacuguggaa

SEQ ID NO: 493164 - RNA, 32 nt, Human
ucaauaaagaaagauggaaggaagggagaaau

SEQ ID NO: 493165 - RNA, 32 nt, Human
ucaauaaagccaagccgguccagcugcauuaa

SEQ ID NO: 493166 - RNA, 32 nt, Human
ucaauaaagguuccugaaucuuccugccaaaa

SEQ ID NO: 493167 - RNA, 32 nt, Human
ucaauaaauacugagggaacucagagaccagu

SEQ ID NO: 493168 - RNA, 32 nt, Human
ucaauaaauuccauguuuagcagaaauaggca

SEQ ID NO: 493169 - RNA, 32 nt, Human
ucaauaaucccagcuacucgggaggcugagac

SEQ ID NO: 493170 - RNA, 32 nt, Human
ucaauaaucuuaauuuugauauuugaauaaau

SEQ ID NO: 493171 - RNA, 32 nt, Human
ucaauaccagccuggccaacauggugaaaccc

SEQ ID NO: 493172 - RNA, 32 nt, Human
ucaauaccagccuggccaacguggugaaaccc

SEQ ID NO: 493173 - RNA, 32 nt, Human
ucaauaccagccugggcaacauaguaagaccc

SEQ ID NO: 493174 - RNA, 32 nt, Human
ucaauaccagcucagaccauguggaccgcgga

SEQ ID NO: 493175 - RNA, 32 nt, Human
ucaauaccuaguuaaacucauuucacuucucc

SEQ ID NO: 493176 - RNA, 32 nt, Human
ucaauacuacaaaaucaacaugauuucauaag

SEQ ID NO: 493177 - RNA, 32 nt, Human
ucaauacugaaagauuaaaauggggagguugc

SEQ ID NO: 493178 - RNA, 32 nt, Human
ucaauacugauggggaagcuggacacuuggag

SEQ ID NO: 493179 - RNA, 32 nt, Human
ucaauacugcuccaaaaggccuggcaugaaag

SEQ ID NO: 493180 - RNA, 32 nt, Human
ucaauagaacccaggagguggagacugcagug

SEQ ID NO: 493181 - RNA, 32 nt, Human
ucaauagaacuugccuccugaaccugacuagg

SEQ ID NO: 493182 - RNA, 32 nt, Human
ucaauagaugacguuuccuauguaaguaggua

SEQ ID NO: 493183 - RNA, 32 nt, Human
ucaauagauggcuauggaucaagcaugguugc

SEQ ID NO: 493184 - RNA, 32 nt, Human
ucaauagcuaagcaucuccuuacagucacuaa

SEQ ID NO: 493185 - RNA, 32 nt, Human
ucaauaggcuggaaagcuaaaaggauuuugca

SEQ ID NO: 493186 - RNA, 32 nt, Human
ucaauauaaagaaaaagacugcagagguagug

SEQ ID NO: 493187 - RNA, 32 nt, Human
ucaauauaaauaaaagagcagaaaaauauguc

SEQ ID NO: 493188 - RNA, 18 nt, Human
ucaauauccaacaugcca

SEQ ID NO: 493189 - RNA, 32 nt, Human
ucaauauccacuucuuucagccuacuguagac

SEQ ID NO: 493190 - RNA, 32 nt, Human
ucaauauccauuccucccuucuuucuuaaagu

SEQ ID NO: 493191 - RNA, 30 nt, Human
ucaauaugacggcugaagaaacagugaaug

SEQ ID NO: 493192 - RNA, 32 nt, Human
ucaauaugcccuuucacaugccuuagaccagu

SEQ ID NO: 493193 - RNA, 32 nt, Human
ucaauaugucauaacagcauucugaagucaga

SEQ ID NO: 493194 - RNA, 32 nt, Human
ucaauauuauggucaacuuuaagucuuaguuu

SEQ ID NO: 493195 - RNA, 31 nt, Human
ucaauauucaauaaagcugcugagaaucuag

SEQ ID NO: 493196 - RNA, 32 nt, Human
ucaauauucacacccauaaacauuacuaagcc

SEQ ID NO: 493197 - RNA, 32 nt, Human
ucaauauucccaauaucucccccaccaccucc

SEQ ID NO: 493198 - RNA, 32 nt, Human
ucaauauuggagagcuuucuguuuuucuacau

SEQ ID NO: 493199 - RNA, 32 nt, Human
ucaaucaaaggaugggaacuggaacugagaac

SEQ ID NO: 493200 - RNA, 32 nt, Human
ucaaucaaauuggccacuuaagaaauaaagag

SEQ ID NO: 493201 - RNA, 32 nt, Human
ucaaucaacccccagucuaccccgccucccuc

SEQ ID NO: 493202 - RNA, 32 nt, Human
ucaaucaagacacccaguaagccacauaauau

SEQ ID NO: 493203 - RNA, 20 nt, Human
ucaaucaaucaaucaucuua

SEQ ID NO: 493204 - RNA, 32 nt, Human
ucaaucaccauccuuuauaccaggauuugcau

SEQ ID NO: 493205 - RNA, 32 nt, Human
ucaaucacggaagaggcagucaaggaggaagg

SEQ ID NO: 493206 - RNA, 26 nt, Human
ucaaucagcaaauaaagccaugucua

SEQ ID NO: 493207 - RNA, 25 nt, Human
ucaaucagccuaguugaucagcuua

SEQ ID NO: 493208 - RNA, 32 nt, Human
ucaaucagguggagcaaggcccucuccugucc

SEQ ID NO: 493209 - RNA, 32 nt, Human
ucaaucauauuccucugggauuucuaaacagc

SEQ ID NO: 493210 - RNA, 26 nt, Human
ucaaucaucacagugggaaccucuug

SEQ ID NO: 493211 - RNA, 21 nt, Human
ucaaucaucucaaagauuuua

SEQ ID NO: 493212 - RNA, 32 nt, Human
ucaaucauuauagagaggaaaacaguacuuuu

SEQ ID NO: 493213 - RNA, 32 nt, Human
ucaauccaaaacugaugcagcuuguggaccac

SEQ ID NO: 493214 - RNA, 31 nt, Human
ucaauccaaguguccaucaaugguagacugg

SEQ ID NO: 493215 - RNA, 32 nt, Human
ucaauccacuccagauuugauuuacaauuguc

SEQ ID NO: 493216 - RNA, 32 nt, Human
ucaauccaguccuagcacuugaucucauuggg

SEQ ID NO: 493217 - RNA, 32 nt, Human
ucaauccaguuuucaaaacauaaguguaagca

SEQ ID NO: 493218 - RNA, 32 nt, Human
ucaauccaugaccauccucgcugugcuuggcu

SEQ ID NO: 493219 - RNA, 32 nt, Human
ucaaucccagguacuaaugaccuugcuuuggc

SEQ ID NO: 493220 - RNA, 32 nt, Human
ucaauccucaaauuagcaucacuugacccuau

SEQ ID NO: 493221 - RNA, 32 nt, Human
ucaauccuccacucuaagugauuccuccaggg

SEQ ID NO: 493222 - RNA, 32 nt, Human
ucaauccucuuucccaguccuaucuccugcuu

SEQ ID NO: 493223 - RNA, 32 nt, Human
ucaauccucuuucuuuauccuuagccacccug

SEQ ID NO: 493224 - RNA, 32 nt, Human
ucaauccugcaaccccagcugucccaccggug

SEQ ID NO: 493225 - RNA, 32 nt, Human
ucaauccuucuggccaagagugucuugcuugu

SEQ ID NO: 493226 - RNA, 32 nt, Human
ucaauccuuuaccaacugucccaugaagagua

SEQ ID NO: 493227 - RNA, 23 nt, Human
ucaaucggccuugugauauccug

SEQ ID NO: 493228 - RNA, 32 nt, Human
ucaaucgggcagcucccuuuuccacaagccuc

SEQ ID NO: 493229 - RNA, 32 nt, Human
ucaaucggggacuaaaauuucccacugaaaau

SEQ ID NO: 493230 - RNA, 21 nt, Human
ucaaucgucagcgacagccug

SEQ ID NO: 493231 - RNA, 32 nt, Human
ucaaucgucucucccuuuggaucucuggcauu

SEQ ID NO: 493232 - RNA, 32 nt, Human
ucaaucguggucucccucucccucucuuguug

SEQ ID NO: 493233 - RNA, 27 nt, Human
ucaaucuaaucuucgauggaaauucua

SEQ ID NO: 493234 - RNA, 32 nt, Human
ucaaucuacucaaagcaugggauuacuagaau

SEQ ID NO: 493235 - RNA, 23 nt, Human
ucaaucuacuguaaguacccagg

SEQ ID NO: 493236 - RNA, 32 nt, Human
ucaaucuagguggugccagcugauccaucaag

SEQ ID NO: 493237 - RNA, 32 nt, Human
ucaaucuagugccuccuugaggccaggaguuc

SEQ ID NO: 493238 - RNA, 32 nt, Human
ucaaucuauguuucucuuucugcuucucuacu

SEQ ID NO: 493239 - RNA, 32 nt, Human
ucaaucucccaagcccacaccacugcccugcu

SEQ ID NO: 493240 - RNA, 32 nt, Human
ucaaucuccugagaccagccucuaccuccaga

SEQ ID NO: 493241 - RNA, 23 nt, Human
ucaaucuccugggcucaaaugau

SEQ ID NO: 493242 - RNA, 32 nt, Human
ucaaucucuauccugaugucaugggaguccua

SEQ ID NO: 493243 - RNA, 32 nt, Human
ucaaucugcaaaauggggauggggaagguuca

SEQ ID NO: 493244 - RNA, 32 nt, Human
ucaaucugcacaauugacauuuuuggccggag

SEQ ID NO: 493245 - RNA, 23 nt, Human
ucaaucugcuuuugagguuguuu

SEQ ID NO: 493246 - RNA, 32 nt, Human
ucaaucuggaaggcagagguugcagugagauu

SEQ ID NO: 493247 - RNA, 31 nt, Human
ucaaucuggcuuuguugcugccaaaggagau

SEQ ID NO: 493248 - RNA, 32 nt, Human
ucaaucugugaagccuuuaucuaugggagauu

SEQ ID NO: 493249 - RNA, 21 nt, Human
ucaaucugugugagucuguuu

SEQ ID NO: 493250 - RNA, 32 nt, Human
ucaaucuucuccccagccccucccucccucag

SEQ ID NO: 493251 - RNA, 32 nt, Human
ucaaucuugaagaugggacuaggcuggugggg

SEQ ID NO: 493252 - RNA, 32 nt, Human
ucaaucuuuaguugcuucauaggcauucauga

SEQ ID NO: 493253 - RNA, 28 nt, Human
ucaaugaaacuugaugugaacuuccaaa

SEQ ID NO: 493254 - RNA, 32 nt, Human
ucaaugaaaggcagaugucccuuuaagguuug

SEQ ID NO: 493255 - RNA, 32 nt, Human
ucaaugaaaugauguggugaugcaugccuaua

SEQ ID NO: 493256 - RNA, 32 nt, Human
ucaaugaagaagcaaagaggugacugacugaa

SEQ ID NO: 493257 - RNA, 32 nt, Human
ucaaugacaaagaugaaagggaaagggggugu

SEQ ID NO: 493258 - RNA, 32 nt, Human
ucaaugacuguuuaucaugcaggugaaagggg

SEQ ID NO: 493259 - RNA, 32 nt, Human
ucaaugagcacuaaaggaaucauaggaauaug

SEQ ID NO: 493260 - RNA, 32 nt, Human
ucaaugagcagugcaauaagccagcaacuggg

SEQ ID NO: 493261 - RNA, 32 nt, Human
ucaaugagcugcagaaauucagcccaggacug

SEQ ID NO: 493262 - RNA, 17 nt, Human
ucaaugaggaaauucaa

SEQ ID NO: 493263 - RNA, 32 nt, Human
ucaaugagguuaugagaaaaacagcaggggca

SEQ ID NO: 493264 - RNA, 32 nt, Human
ucaaugauggccagcaggacucaucuccugcc

SEQ ID NO: 493265 - RNA, 28 nt, Human
ucaaugauguauaugaccucagcuuauu

SEQ ID NO: 493266 - RNA, 22 nt, Human
ucaaugauuaggaaucauucug

SEQ ID NO: 493267 - RNA, 32 nt, Human
ucaaugauuauuuccugccaagaaggugaacg

SEQ ID NO: 493268 - RNA, 32 nt, Human
ucaaugcaacagcaaauaagaaucucuagaac

SEQ ID NO: 493269 - RNA, 32 nt, Human
ucaaugcacacaccugcuguugcuuuugauuu

SEQ ID NO: 493270 - RNA, 32 nt, Human
ucaaugcagcugguaucucugagcucugagga

SEQ ID NO: 493271 - RNA, 32 nt, Human
ucaaugcauacuuaagaacaccuacuaugugc

SEQ ID NO: 493272 - RNA, 32 nt, Human
ucaaugccaagaaacgugucccuggcccauau

SEQ ID NO: 493273 - RNA, 32 nt, Human
ucaaugcccacuuagaucucccagaaauagca

SEQ ID NO: 493274 - RNA, 32 nt, Human
ucaaugcccagcccugacaccugcccuuuguc

SEQ ID NO: 493275 - RNA, 32 nt, Human
ucaaugccuuagccaaggaguccagcaccugu

SEQ ID NO: 493276 - RNA, 32 nt, Human
ucaaugcuaucuacucucuggccuacggagcc

SEQ ID NO: 493277 - RNA, 32 nt, Human
ucaaugcuggguggaggagggcagaaacgcag

SEQ ID NO: 493278 - RNA, 32 nt, Human
ucaaugcuguaauauaauuugcaccuggaaug

SEQ ID NO: 493279 - RNA, 32 nt, Human
ucaaugcuuuacuaauguuccaacacaaaaug

SEQ ID NO: 493280 - RNA, 32 nt, Human
ucaauggacaaacugacagggacugcuuugaa

SEQ ID NO: 493281 - RNA, 32 nt, Human
ucaauggagaacuuauagcugugcaaagaucu

SEQ ID NO: 493282 - RNA, 32 nt, Human
ucaauggagacaccaccuggcugcccauccug

SEQ ID NO: 493283 - RNA, 28 nt, Human
ucaauggauaaagugggaaaaaugugga

SEQ ID NO: 493284 - RNA, 32 nt, Human
ucaauggcccucaaggaacaaaguggguugug

SEQ ID NO: 493285 - RNA, 32 nt, Human
ucaauggcugucuugcucaauuggccagacau

SEQ ID NO: 493286 - RNA, 32 nt, Human
ucaauggcuuuuugccgcucuaccucuugugu

SEQ ID NO: 493287 - RNA, 31 nt, Human
ucaaugggaagaccuguuugcagagaggagc

SEQ ID NO: 493288 - RNA, 32 nt, Human
ucaaugggagagaaagggccugaguuucagcc

SEQ ID NO: 493289 - RNA, 32 nt, Human
ucaauggggaaaggacacagaaacaggaacug

SEQ ID NO: 493290 - RNA, 26 nt, Human
ucaauggguguccuaggaaccuuuua

SEQ ID NO: 493291 - RNA, 32 nt, Human
ucaaugggugucugaauaaacaaauugugauc

SEQ ID NO: 493292 - RNA, 32 nt, Human
ucaauggucaccaagguccugaagccuuccug

SEQ ID NO: 493293 - RNA, 32 nt, Human
ucaauggugcaggacagaaagccagucagacu

SEQ ID NO: 493294 - RNA, 32 nt, Human
ucaauggugcccaggcuggagugcaguggcgu

SEQ ID NO: 493295 - RNA, 32 nt, Human
ucaaugguguccaggcuggagugcaguggcgu

SEQ ID NO: 493296 - RNA, 32 nt, Human
ucaaugguugacugcaaagaagugagaagcca

SEQ ID NO: 493297 - RNA, 32 nt, Human
ucaaugguuguuaguauauucacaaaguugug

SEQ ID NO: 493298 - RNA, 32 nt, Human
ucaaugucaggcccgagaacagccugcggaau

SEQ ID NO: 493299 - RNA, 32 nt, Human
ucaaugucauucucuucucugccauccuuauu

SEQ ID NO: 493300 - RNA, 32 nt, Human
ucaaugucauucuuuucacagguccagugucu

SEQ ID NO: 493301 - RNA, 32 nt, Human
ucaaugucccacugaauccuguuggccaguau

SEQ ID NO: 493302 - RNA, 32 nt, Human
ucaaugugaguuuccgugcauggcuggugacu

SEQ ID NO: 493303 - RNA, 32 nt, Human
ucaaugugcacuccuagcuuggugucucagac

SEQ ID NO: 493304 - RNA, 32 nt, Human
ucaauguggcgaggaagaugcuggggccggua

SEQ ID NO: 493305 - RNA, 32 nt, Human
ucaauguggcucaaacuaaccgcccacacaug

SEQ ID NO: 493306 - RNA, 21 nt, Human
ucaauguggggcaucaggcca

SEQ ID NO: 493307 - RNA, 32 nt, Human
ucaauguucauaacuuaaaccuggguaccugg

SEQ ID NO: 493308 - RNA, 32 nt, Human
ucaauguugcccaggcuggagugcaguggcgu

SEQ ID NO: 493309 - RNA, 21 nt, Human
ucaauguuugggaccaucuua

SEQ ID NO: 493310 - RNA, 32 nt, Human
ucaauuagauauguuacauaggaugugccaac

SEQ ID NO: 493311 - RNA, 22 nt, Human
ucaauuauuuuucuuccuugca

SEQ ID NO: 493312 - RNA, 21 nt, Human
ucaauucaaaacaaagacagu

SEQ ID NO: 493313 - RNA, 32 nt, Human
ucaauucaaccaacauccaguccuggaagccc

SEQ ID NO: 493314 - RNA, 32 nt, Human
ucaauucacccagcucucuugccugcaggcug

SEQ ID NO: 493315 - RNA, 32 nt, Human
ucaauucagaagcauuuuaccagugaagcccu

SEQ ID NO: 493316 - RNA, 32 nt, Human
ucaauucaggagaaacuguacuggucagucac

SEQ ID NO: 493317 - RNA, 32 nt, Human
ucaauucaggccaagugugguggugcacaccu

SEQ ID NO: 493318 - RNA, 31 nt, Human
ucaauuccaugacuuaagguuggagagcuaa

SEQ ID NO: 493319 - RNA, 32 nt, Human
ucaauuccauuuuggggcauggggaaggcugu

SEQ ID NO: 493320 - RNA, 32 nt, Human
ucaauucccccuucccccuccaacacauacac

SEQ ID NO: 493321 - RNA, 32 nt, Human
ucaauucccuacucccucuuauguuuuuauau

SEQ ID NO: 493322 - RNA, 32 nt, Human
ucaauucccuugguccccagugcaguguuugg

SEQ ID NO: 493323 - RNA, 32 nt, Human
ucaauuccuaggauagcagagagauggacaac

SEQ ID NO: 493324 - RNA, 18 nt, Human
ucaauuccucccauuuca

SEQ ID NO: 493325 - RNA, 32 nt, Human
ucaauuccuugcaagaugcauucucucaaagc

SEQ ID NO: 493326 - RNA, 32 nt, Human
ucaauucucaauauauucaguaaugaagaaug

SEQ ID NO: 493327 - RNA, 32 nt, Human
ucaauucucauuuuguaguaucucaaacacaa

SEQ ID NO: 493328 - RNA, 32 nt, Human
ucaauucuguagagucaggggugaggaggagc

SEQ ID NO: 493329 - RNA, 32 nt, Human
ucaauucuugccuuauaccucagucuauucug

SEQ ID NO: 493330 - RNA, 32 nt, Human
ucaauucuuucauucccugaccagugagaggg

SEQ ID NO: 493331 - RNA, 32 nt, Human
ucaauugacugcaaccucugcuucccaggcuc

SEQ ID NO: 493332 - RNA, 32 nt, Human
ucaauugagcccaggaguucaagaccagccug

SEQ ID NO: 493333 - RNA, 32 nt, Human
ucaauugaggcaggauguucaaaugauugcag

SEQ ID NO: 493334 - RNA, 32 nt, Human
ucaauugcuucucaagucuaaccagccucagc

SEQ ID NO: 493335 - RNA, 32 nt, Human
ucaauugcuuugauuucucugccuguaagaua

SEQ ID NO: 493336 - RNA, 32 nt, Human
ucaauuggcccaguguuucuccaggcugggga

SEQ ID NO: 493337 - RNA, 32 nt, Human
ucaauugggcuuaaaaauugacaugcaaucuc

SEQ ID NO: 493338 - RNA, 32 nt, Human
ucaauugggggaaaauauuaacuuugcugaau

SEQ ID NO: 493339 - RNA, 32 nt, Human
ucaauuguaucugacccuucuuuaaguuaugu

SEQ ID NO: 493340 - RNA, 32 nt, Human
ucaauuguauuuuucuguucagaaaacuccaa

SEQ ID NO: 493341 - RNA, 32 nt, Human
ucaauuguccucuguguccugccugacauggc

SEQ ID NO: 493342 - RNA, 32 nt, Human
ucaauuguccuggcugauuaugcaucacucug

SEQ ID NO: 493343 - RNA, 32 nt, Human
ucaauugugugaacaguggcccgaaagguuau

SEQ ID NO: 493344 - RNA, 32 nt, Human
ucaauuguucaucaguggguaaaacaaauucu

SEQ ID NO: 493345 - RNA, 32 nt, Human
ucaauuguugcugcaucagauaugagagauuc

SEQ ID NO: 493346 - RNA, 23 nt, Human
ucaauuguuuuaagaaaacucua

SEQ ID NO: 493347 - RNA, 32 nt, Human
ucaauuuaaaucuugaggccacucaugguggc

SEQ ID NO: 493348 - RNA, 32 nt, Human
ucaauuuacagaccugacucuccucaccuucc

SEQ ID NO: 493349 - RNA, 22 nt, Human
ucaauuuagucuauccuggaua

SEQ ID NO: 493350 - RNA, 32 nt, Human
ucaauuuaucuucucccuggaauugggaccac

SEQ ID NO: 493351 - RNA, 32 nt, Human
ucaauuucaguauuuuguugagcuuugacaaa

SEQ ID NO: 493352 - RNA, 32 nt, Human
ucaauuuccauucauaaguccucacaaaccca

SEQ ID NO: 493353 - RNA, 32 nt, Human
ucaauuuccucccucacucccucuuaccuucc

SEQ ID NO: 493354 - RNA, 32 nt, Human
ucaauuuccucuucuuuuuccucugaccucug

SEQ ID NO: 493355 - RNA, 32 nt, Human
ucaauuucuuaggcuggagugcaguggcacga

SEQ ID NO: 493356 - RNA, 32 nt, Human
ucaauuucuucagcagacccuacagaggcaag

SEQ ID NO: 493357 - RNA, 32 nt, Human
ucaauuugcuggauuuaagcacugcugcacuu

SEQ ID NO: 493358 - RNA, 32 nt, Human
ucaauuuggucuuauuggcuccauuauacaua

SEQ ID NO: 493359 - RNA, 32 nt, Human
ucaauuuuaaggcauauuuaacaaaauuugaa

SEQ ID NO: 493360 - RNA, 32 nt, Human
ucaauuuuacuuggaaagccugggacacagaa

SEQ ID NO: 493361 - RNA, 32 nt, Human
ucaauuuuaguugaaauucucucuccauggcc

SEQ ID NO: 493362 - RNA, 32 nt, Human
ucaauuuucucauucucuagugauuaccuuca

SEQ ID NO: 493363 - RNA, 32 nt, Human
ucaauuuuggcuuuuguuuccauugcuuuugg

SEQ ID NO: 493364 - RNA, 32 nt, Human
ucacaaaaacagucugcaggcugugucuggcc

SEQ ID NO: 493365 - RNA, 32 nt, Human
ucacaaaaagauaagaaagauucaaagaauuc

SEQ ID NO: 493366 - RNA, 22 nt, Human
ucacaaaaauaaaaugaucaua

SEQ ID NO: 493367 - RNA, 24 nt, Human
ucacaaaaaucaguaagcacaaua

SEQ ID NO: 493368 - RNA, 22 nt, Human
ucacaaaacuguaauuuacuua

SEQ ID NO: 493369 - RNA, 19 nt, Human
ucacaaaaucuguuuagca

SEQ ID NO: 493370 - RNA, 31 nt, Human
ucacaaaauggaaucuuuugccaaagaaacc

SEQ ID NO: 493371 - RNA, 25 nt, Human
ucacaaaauugagugaaacacaaua

SEQ ID NO: 493372 - RNA, 32 nt, Human
ucacaaaauuuucaacaucacagucuaaaaua

SEQ ID NO: 493373 - RNA, 32 nt, Human
ucacaaaccagugacauuuccugaaaucaagc

SEQ ID NO: 493374 - RNA, 32 nt, Human
ucacaaaccuuccuugcuauuuguucuuaagu

SEQ ID NO: 493375 - RNA, 16 nt, Human
ucacaaacuccuccaa

SEQ ID NO: 493376 - RNA, 32 nt, Human
ucacaaacuccuccaaaccccaaaccccaaac

SEQ ID NO: 493377 - RNA, 19 nt, Human
ucacaaagaacugaaucuc

SEQ ID NO: 493378 - RNA, 32 nt, Human
ucacaaagaggauaccuggugacacgcccagg

SEQ ID NO: 493379 - RNA, 32 nt, Human
ucacaaagaguauaugcuaguuucuuguagau

SEQ ID NO: 493380 - RNA, 32 nt, Human
ucacaaagcuaaauaaauucucuuccauaccu

SEQ ID NO: 493381 - RNA, 32 nt, Human
ucacaaagcuaccaccugucaccagagccuac

SEQ ID NO: 493382 - RNA, 32 nt, Human
ucacaaagcuacuggucagcugggcagcucag

SEQ ID NO: 493383 - RNA, 32 nt, Human
ucacaaagcuguuuucacuguggccccuacau

SEQ ID NO: 493384 - RNA, 32 nt, Human
ucacaaagguggggguccuggugcaggcagug

SEQ ID NO: 493385 - RNA, 32 nt, Human
ucacaaagugaagaagucagagggcagucacc

SEQ ID NO: 493386 - RNA, 32 nt, Human
ucacaaaguuuuucacauuccauucagaauuc

SEQ ID NO: 493387 - RNA, 32 nt, Human
ucacaaauagccacauucugcucuacucucca

SEQ ID NO: 493388 - RNA, 32 nt, Human
ucacaaauggcagaacaguauguaaagcuggu

SEQ ID NO: 493389 - RNA, 32 nt, Human
ucacaacaauagguggaaguugcuagugcagu

SEQ ID NO: 493390 - RNA, 32 nt, Human
ucacaacacagcccaggugugggaacaguagg

SEQ ID NO: 493391 - RNA, 32 nt, Human
ucacaacaccacuucucacgcuuggguaauuu

SEQ ID NO: 493392 - RNA, 32 nt, Human
ucacaacagccaugucuuccucugccucuaac

SEQ ID NO: 493393 - RNA, 32 nt, Human
ucacaacagccauuuguuuucaaggucaaggc

SEQ ID NO: 493394 - RNA, 32 nt, Human
ucacaacagcccaaucugcaguugaggaaacc

SEQ ID NO: 493395 - RNA, 32 nt, Human
ucacaacaggaaaugcagacgugggagucacu

SEQ ID NO: 493396 - RNA, 32 nt, Human
ucacaacaguaagucccugacuccaccucuuc

SEQ ID NO: 493397 - RNA, 32 nt, Human
ucacaacaguaagucccuggccccaccucuuc

SEQ ID NO: 493398 - RNA, 32 nt, Human
ucacaacauugcacuucagccuggugacauga

SEQ ID NO: 493399 - RNA, 32 nt, Human
ucacaaccagccugaccaacauggagaaaccc

SEQ ID NO: 493400 - RNA, 32 nt, Human
ucacaaccagccuggucaacuugguaaaaccc

SEQ ID NO: 493401 - RNA, 22 nt, Human
ucacaaccccugacugcuccuc

SEQ ID NO: 493402 - RNA, 32 nt, Human
ucacaacccucagagucaaacuuugugaccgg

SEQ ID NO: 493403 - RNA, 32 nt, Human
ucacaacggacacuuugcuccacacacauaau

SEQ ID NO: 493404 - RNA, 32 nt, Human
ucacaacucacugcagccuggaccuccuagcc

SEQ ID NO: 493405 - RNA, 32 nt, Human
ucacaacuccaggugcucagacugccuguggc

SEQ ID NO: 493406 - RNA, 32 nt, Human
ucacaacugaaccaguucucuacuccuucccu

SEQ ID NO: 493407 - RNA, 32 nt, Human
ucacaacugaauagucuuguucuuuuaguagc

SEQ ID NO: 493408 - RNA, 32 nt, Human
ucacaacugcaaccuccgucucccggguucaa

SEQ ID NO: 493409 - RNA, 32 nt, Human
ucacaacuguaaccucaagcacuuugggaggc

SEQ ID NO: 493410 - RNA, 32 nt, Human
ucacaacuguaauccucgcacuuugggaggcu

SEQ ID NO: 493411 - RNA, 32 nt, Human
ucacaagaauagcaugggaaagacuggccccc

SEQ ID NO: 493412 - RNA, 32 nt, Human
ucacaagagcccaggagguugagaaugcagug

SEQ ID NO: 493413 - RNA, 32 nt, Human
ucacaagaguugcucccaagccuggaugaguu

SEQ ID NO: 493414 - RNA, 32 nt, Human
ucacaagaugacggcugggcuccugggcugcc

SEQ ID NO: 493415 - RNA, 32 nt, Human
ucacaaggcaauucauacuggagagaaaccuu

SEQ ID NO: 493416 - RNA, 32 nt, Human
ucacaaggcagugaggcugagguggggcggcc

SEQ ID NO: 493417 - RNA, 32 nt, Human
ucacaaggccgccucccaccucuggggcauug

SEQ ID NO: 493418 - RNA, 32 nt, Human
ucacaaggcgggaguuccagagagaggacaua

SEQ ID NO: 493419 - RNA, 32 nt, Human
ucacaaggcuuuggagaauugucuuccuaaau

SEQ ID NO: 493420 - RNA, 32 nt, Human
ucacaaggucaguaaugcugcaggaaaagcaa

SEQ ID NO: 493421 - RNA, 32 nt, Human
ucacaagguccuuaaaaguggaggaggggcca

SEQ ID NO: 493422 - RNA, 22 nt, Human
ucacaaggucuuuacuuaugca

SEQ ID NO: 493423 - RNA, 21 nt, Human
ucacaaguaaaagcuacagua

SEQ ID NO: 493424 - RNA, 32 nt, Human
ucacaaguaacuuggaaaauagaagcagaaua

SEQ ID NO: 493425 - RNA, 32 nt, Human
ucacaaguaagaugggacaggugaaugcuucu

SEQ ID NO: 493426 - RNA, 19 nt, Human
ucacaaguaaugucacaau

SEQ ID NO: 493427 - RNA, 18 nt, Human
ucacaaguaggagacaca

SEQ ID NO: 493428 - RNA, 21 nt, Human
ucacaaguaguagaagaacga

SEQ ID NO: 493429 - RNA, 32 nt, Human
ucacaagucucccacaggccauguaaagggua

SEQ ID NO: 493430 - RNA, 32 nt, Human
ucacaagucuguaaucccagcacuuugggagg

SEQ ID NO: 493431 - RNA, 31 nt, Human
ucacaagugggucucccuuguccgggacuau

SEQ ID NO: 493432 - RNA, 32 nt, Human
ucacaauaaucugggacccaggcuugugcccu

SEQ ID NO: 493433 - RNA, 32 nt, Human
ucacaauacccugcagccuugaccucaugggc

SEQ ID NO: 493434 - RNA, 32 nt, Human
ucacaauauaaauuaaacuaauucauuuuugu

SEQ ID NO: 493435 - RNA, 32 nt, Human
ucacaaucaugccacacacuucugcaaggacu

SEQ ID NO: 493436 - RNA, 32 nt, Human
ucacaaucuuccaaugacuucucccuccggug

SEQ ID NO: 493437 - RNA, 32 nt, Human
ucacaaugacacacacaucacacacacaucac

SEQ ID NO: 493438 - RNA, 32 nt, Human
ucacaaugggucucucccaguaagagugcacu

SEQ ID NO: 493439 - RNA, 32 nt, Human
ucacaaugugaagcugugggugcaguggcgcc

SEQ ID NO: 493440 - RNA, 18 nt, Human
ucacaauuaaaauucuga

SEQ ID NO: 493441 - RNA, 20 nt, Human
ucacaauuaauaaacacaau

SEQ ID NO: 493442 - RNA, 32 nt, Human
ucacaauuagcucuugccccuaccccacgcca

SEQ ID NO: 493443 - RNA, 32 nt, Human
ucacaauucagcuucuaugaccaaaaugaguu

SEQ ID NO: 493444 - RNA, 32 nt, Human
ucacaauucuguagguuaggaguccagguuaa

SEQ ID NO: 493445 - RNA, 32 nt, Human
ucacacaaagcccagacgcggagaaaauggcg

SEQ ID NO: 493446 - RNA, 21 nt, Human
ucacacaaauuccaauugaga

SEQ ID NO: 493447 - RNA, 32 nt, Human
ucacacaacaaccuucugcucaacugacuuau

SEQ ID NO: 493448 - RNA, 32 nt, Human
ucacacaacacuguucacugaggacagcacca

SEQ ID NO: 493449 - RNA, 32 nt, Human
ucacacaacaggcuuaucagaaaccuaccaga

SEQ ID NO: 493450 - RNA, 24 nt, Human
ucacacaaccaugacgcacugcuc

SEQ ID NO: 493451 - RNA, 32 nt, Human
ucacacaacugcacuccagccugggcaacaga

SEQ ID NO: 493452 - RNA, 32 nt, Human
ucacacaauugcaguccagccugggcagcaag

SEQ ID NO: 493453 - RNA, 20 nt, Human
ucacacacaacuggcaccca

SEQ ID NO: 493454 - RNA, 32 nt, Human
ucacacacaguauacacauacacaagugcaca

SEQ ID NO: 493455 - RNA, 32 nt, Human
ucacacacccuagccucacacguuaggaggac

SEQ ID NO: 493456 - RNA, 32 nt, Human
ucacacacccugacaucugggccccgcgccac

SEQ ID NO: 493457 - RNA, 32 nt, Human
ucacacacgacaguugacaggucuucacgcag

SEQ ID NO: 493458 - RNA, 32 nt, Human
ucacacacgcagcagagguuucccuugaagug

SEQ ID NO: 493459 - RNA, 32 nt, Human
ucacacacucagccucugccucagguggcagg

SEQ ID NO: 493460 - RNA, 32 nt, Human
ucacacacuguugcagcgcagguuggaaucaa

SEQ ID NO: 493461 - RNA, 32 nt, Human
ucacacagaaaagaauguuucaggccauguuc

SEQ ID NO: 493462 - RNA, 32 nt, Human
ucacacagaacaacuuucuaaccuaguagugg

SEQ ID NO: 493463 - RNA, 32 nt, Human
ucacacagaucuuccccgaggaagaggggcug

SEQ ID NO: 493464 - RNA, 31 nt, Human
ucacacagcagagucagaaguagaagccaga

SEQ ID NO: 493465 - RNA, 32 nt, Human
ucacacagcaggcaguggcaggcaguagugaa

SEQ ID NO: 493466 - RNA, 32 nt, Human
ucacacagcccuucccucuggggcccaacaau

SEQ ID NO: 493467 - RNA, 32 nt, Human
ucacacagccuggccuguaccugcaccccacu

SEQ ID NO: 493468 - RNA, 23 nt, Human
ucacacagcuaauaaaagucaga

SEQ ID NO: 493469 - RNA, 32 nt, Human
ucacacagcuuuuuagcuuacauaacuggugc

SEQ ID NO: 493470 - RNA, 32 nt, Human
ucacacaggaagcaaguuacagaaccaagggc

SEQ ID NO: 493471 - RNA, 31 nt, Human
ucacacaggcacuuuguacacauccugguuu

SEQ ID NO: 493472 - RNA, 32 nt, Human
ucacacaggccuggggcaaucucuugaccuca

SEQ ID NO: 493473 - RNA, 22 nt, Human
ucacacaggcuggagugcagug

SEQ ID NO: 493474 - RNA, 32 nt, Human
ucacacaggcuggagugcaguggcgugagcuc

SEQ ID NO: 493475 - RNA, 32 nt, Human
ucacacaggcuggagugcaguggugugaucuu

SEQ ID NO: 493476 - RNA, 32 nt, Human
ucacacaggcugggugcaguggcucaugccug

SEQ ID NO: 493477 - RNA, 32 nt, Human
ucacacagucagcuaaaagcacuguggggaag

SEQ ID NO: 493478 - RNA, 21 nt, Human
ucacacagucucugcagguca

SEQ ID NO: 493479 - RNA, 32 nt, Human
ucacacagucuggagugcuguggugcaauuau

SEQ ID NO: 493480 - RNA, 32 nt, Human
ucacacagugccugcccucaccuguggaauuu

SEQ ID NO: 493481 - RNA, 32 nt, Human
ucacacaguuugccacacacacuggcaaaggc

SEQ ID NO: 493482 - RNA, 32 nt, Human
ucacacauagaaacacccacauggacacaagg

SEQ ID NO: 493483 - RNA, 17 nt, Human
ucacacauccccagcca

SEQ ID NO: 493484 - RNA, 32 nt, Human
ucacacaucuguauuccagccugggcaauaga

SEQ ID NO: 493485 - RNA, 32 nt, Human
ucacacaucuguccuggaaaaggcugaaccag

SEQ ID NO: 493486 - RNA, 32 nt, Human
ucacacaucuuccuccaggucagggagugaag

SEQ ID NO: 493487 - RNA, 32 nt, Human
ucacacaugcacuuccacuaccuggggagaau

SEQ ID NO: 493488 - RNA, 32 nt, Human
ucacacaugccacauccauugcagagaugcuc

SEQ ID NO: 493489 - RNA, 32 nt, Human
ucacacauguuaauuccagcacuuugggagac

SEQ ID NO: 493490 - RNA, 32 nt, Human
ucacaccaaacagagccccacaccaagaaaag

SEQ ID NO: 493491 - RNA, 32 nt, Human
ucacaccaacagcacacaccccuuuuucccau

SEQ ID NO: 493492 - RNA, 32 nt, Human
ucacaccacaguacuccagccuaggugacaga

SEQ ID NO: 493493 - RNA, 32 nt, Human
ucacaccaccacacuccaaccuguguaacaga

SEQ ID NO: 493494 - RNA, 32 nt, Human
ucacaccaccacacuccagccugagcagcaga

SEQ ID NO: 493495 - RNA, 32 nt, Human
ucacaccaccgcacuccacccugggaagcaaa

SEQ ID NO: 493496 - RNA, 32 nt, Human
ucacaccaccucacuccagccugggcaacaua

SEQ ID NO: 493497 - RNA, 32 nt, Human
ucacaccacuaauaagcaacagagccaggauu

SEQ ID NO: 493498 - RNA, 32 nt, Human
ucacaccacuacacuccagccaaagcaacaag

SEQ ID NO: 493499 - RNA, 32 nt, Human
ucacaccacuacacuccagccuaggcaacaga

SEQ ID NO: 493500 - RNA, 32 nt, Human
ucacaccacuacacuccagccuggacaacaga

SEQ ID NO: 493501 - RNA, 32 nt, Human
ucacaccacuacacuccagccugggcgacaga

SEQ ID NO: 493502 - RNA, 32 nt, Human
ucacaccacuacacuccagccugggcgagacg

SEQ ID NO: 493503 - RNA, 32 nt, Human
ucacaccacuacucuccaaccugggugacaga

SEQ ID NO: 493504 - RNA, 32 nt, Human
ucacaccacuccacuccagucuggacaacaga

SEQ ID NO: 493505 - RNA, 32 nt, Human
ucacaccacugaccucuagccugguggcagag

SEQ ID NO: 493506 - RNA, 32 nt, Human
ucacaccacugcaauccagccucgguaacaca

SEQ ID NO: 493507 - RNA, 32 nt, Human
ucacaccacugcaauccagccugggcgacaaa

SEQ ID NO: 493508 - RNA, 32 nt, Human
ucacaccacugcaccccagccugggugacagc

SEQ ID NO: 493509 - RNA, 32 nt, Human
ucacaccacugcacuacagccucggcaauaga

SEQ ID NO: 493510 - RNA, 32 nt, Human
ucacaccacugcacucagccugggugacagag

SEQ ID NO: 493511 - RNA, 32 nt, Human
ucacaccacugcacuccaaccuggacaacaga

SEQ ID NO: 493512 - RNA, 32 nt, Human
ucacaccacugcacuccaaccugggaaacgca

SEQ ID NO: 493513 - RNA, 32 nt, Human
ucacaccacugcacuccagccagggcaacagu

SEQ ID NO: 493514 - RNA, 32 nt, Human
ucacaccacugcacuccagcccaggugacaga

SEQ ID NO: 493515 - RNA, 32 nt, Human
ucacaccacugcacuccagccuaggcaacaga

SEQ ID NO: 493516 - RNA, 32 nt, Human
ucacaccacugcacuccagccuggacaacaga

SEQ ID NO: 493517 - RNA, 32 nt, Human
ucacaccacugcacuccagccuggacgacaga

SEQ ID NO: 493518 - RNA, 32 nt, Human
ucacaccacugcacuccagccuggcaacagag

SEQ ID NO: 493519 - RNA, 32 nt, Human
ucacaccacugcacuccagccuggcgacagag

SEQ ID NO: 493520 - RNA, 32 nt, Human
ucacaccacugcacuccagccugggagagaga

SEQ ID NO: 493521 - RNA, 32 nt, Human
ucacaccacugcacuccagccugggcaacaag

SEQ ID NO: 493522 - RNA, 32 nt, Human
ucacaccacugcacuccagccugggcaacaga

SEQ ID NO: 493523 - RNA, 32 nt, Human
ucacaccacugcacuccagccugggcaacuga

SEQ ID NO: 493524 - RNA, 32 nt, Human
ucacaccacugcacuccagccugggcaauaga

SEQ ID NO: 493525 - RNA, 32 nt, Human
ucacaccacugcacuccagccugggcgacaga

SEQ ID NO: 493526 - RNA, 32 nt, Human
ucacaccacugcacuccagccugggcgacagu

SEQ ID NO: 493527 - RNA, 32 nt, Human
ucacaccacugcacuccagccugggcggcaga

SEQ ID NO: 493528 - RNA, 32 nt, Human
ucacaccacugcacuccagccugggcuacaga

SEQ ID NO: 493529 - RNA, 32 nt, Human
ucacaccacugcacuccagccugggggacaga

SEQ ID NO: 493530 - RNA, 32 nt, Human
ucacaccacugcacuccagccuggggugauag

SEQ ID NO: 493531 - RNA, 32 nt, Human
ucacaccacugcacuccagccugggugacaga

SEQ ID NO: 493532 - RNA, 32 nt, Human
ucacaccacugcacuccagccugggugacagc

SEQ ID NO: 493533 - RNA, 32 nt, Human
ucacaccacugcacuccagccugggugauaga

SEQ ID NO: 493534 - RNA, 32 nt, Human
ucacaccacugcacuccagccuggguggcaga

SEQ ID NO: 493535 - RNA, 32 nt, Human
ucacaccacugcacuccagccugggugucaga

SEQ ID NO: 493536 - RNA, 32 nt, Human
ucacaccacugcacuccagccuggucaacaga

SEQ ID NO: 493537 - RNA, 32 nt, Human
ucacaccacugcacuccagccuggugacagag

SEQ ID NO: 493538 - RNA, 32 nt, Human
ucacaccacugcacuccagccugugcgacaga

SEQ ID NO: 493539 - RNA, 32 nt, Human
ucacaccacugcacuccagccuuggcgacaaa

SEQ ID NO: 493540 - RNA, 32 nt, Human
ucacaccacugcacuccagccuuggcgacaga

SEQ ID NO: 493541 - RNA, 32 nt, Human
ucacaccacugcacuccagccuuggugacaga

SEQ ID NO: 493542 - RNA, 32 nt, Human
ucacaccacugcacuccagcuugggggauaga

SEQ ID NO: 493543 - RNA, 32 nt, Human
ucacaccacugcacuccagucugggcaacagu

SEQ ID NO: 493544 - RNA, 32 nt, Human
ucacaccacugcacuccagucugggcaccaga

SEQ ID NO: 493545 - RNA, 32 nt, Human
ucacaccacugcacuccagugugagcaacaga

SEQ ID NO: 493546 - RNA, 32 nt, Human
ucacaccacugcacuccauccagccuggguga

SEQ ID NO: 493547 - RNA, 32 nt, Human
ucacaccacugcacuccauccugggcaacaga

SEQ ID NO: 493548 - RNA, 32 nt, Human
ucacaccacugcacuccggccugggcgacaga

SEQ ID NO: 493549 - RNA, 32 nt, Human
ucacaccacugcacucuagccugggcaacaga

SEQ ID NO: 493550 - RNA, 32 nt, Human
ucacaccacugcacucuagccugggugacaga

SEQ ID NO: 493551 - RNA, 32 nt, Human
ucacaccacugcacucuggccugcaugcacuc

SEQ ID NO: 493552 - RNA, 32 nt, Human
ucacaccacugcacuucagccuggaugacaga

SEQ ID NO: 493553 - RNA, 32 nt, Human
ucacaccacugcacuucagccugggcaacaga

SEQ ID NO: 493554 - RNA, 32 nt, Human
ucacaccacugcacuucauccuaggcaacaga

SEQ ID NO: 493555 - RNA, 32 nt, Human
ucacaccacugcauuccagccugggcacuaga

SEQ ID NO: 493556 - RNA, 32 nt, Human
ucacaccacugcauuccagccugggugacaga

SEQ ID NO: 493557 - RNA, 32 nt, Human
ucacaccacugcauucccgccugggcagcaga

SEQ ID NO: 493558 - RNA, 32 nt, Human
ucacaccacugcauucuggccugggugacaga

SEQ ID NO: 493559 - RNA, 32 nt, Human
ucacaccacugcgcucuagccugggcaacaag

SEQ ID NO: 493560 - RNA, 32 nt, Human
ucacaccacuggcacuccagccugggcaacag

SEQ ID NO: 493561 - RNA, 32 nt, Human
ucacaccacuggcugccagucagggccugcca

SEQ ID NO: 493562 - RNA, 32 nt, Human
ucacaccacuguacuccagcccggcacuccag

SEQ ID NO: 493563 - RNA, 32 nt, Human
ucacaccacuguacuccagccugagugacaaa

SEQ ID NO: 493564 - RNA, 32 nt, Human
ucacaccacuguacuccagccuggaugacaga

SEQ ID NO: 493565 - RNA, 32 nt, Human
ucacaccacuguacuccagccugggcaacaga

SEQ ID NO: 493566 - RNA, 32 nt, Human
ucacaccacuguacuccagccugggugacaaa

SEQ ID NO: 493567 - RNA, 32 nt, Human
ucacaccacuguacuccagccuggugacagag

SEQ ID NO: 493568 - RNA, 32 nt, Human
ucacaccacuguauuccagccugggugacaga

SEQ ID NO: 493569 - RNA, 32 nt, Human
ucacaccacuguauuccagccugggugacuga

SEQ ID NO: 493570 - RNA, 32 nt, Human
ucacaccacugugcucuagccugggugacaaa

SEQ ID NO: 493571 - RNA, 32 nt, Human
ucacaccagugcacuccagccugggcgacaga

SEQ ID NO: 493572 - RNA, 32 nt, Human
ucacaccauaaggagauuucuguuuuucuuuu

SEQ ID NO: 493573 - RNA, 32 nt, Human
ucacaccaucgcacuccagccuaggcaacaag

SEQ ID NO: 493574 - RNA, 32 nt, Human
ucacaccauucuccggccucagucucccgagu

SEQ ID NO: 493575 - RNA, 32 nt, Human
ucacaccauugcacuccaaccugggcaacaag

SEQ ID NO: 493576 - RNA, 32 nt, Human
ucacaccauugcacuccaaccugggcgacagg

SEQ ID NO: 493577 - RNA, 32 nt, Human
ucacaccauugcacuccagccuagauaacaag

SEQ ID NO: 493578 - RNA, 32 nt, Human
ucacaccauugcacuccagccuaggcaacaag

SEQ ID NO: 493579 - RNA, 32 nt, Human
ucacaccauugcacuccagccuaggcauggug

SEQ ID NO: 493580 - RNA, 32 nt, Human
ucacaccauugcacuccagccugagcaacaga

SEQ ID NO: 493581 - RNA, 32 nt, Human
ucacaccauugcacuccagccugggaaacaag

SEQ ID NO: 493582 - RNA, 32 nt, Human
ucacaccauugcacuccagccugggcaaaaag

SEQ ID NO: 493583 - RNA, 32 nt, Human
ucacaccauugcacuccagccugggcaacaag

SEQ ID NO: 493584 - RNA, 32 nt, Human
ucacaccauugcacuccagccugggcaacaga

SEQ ID NO: 493585 - RNA, 32 nt, Human
ucacaccauugcacuccagccugggcgacaag

SEQ ID NO: 493586 - RNA, 32 nt, Human
ucacaccauugcacuccagccugggcgacaga

SEQ ID NO: 493587 - RNA, 32 nt, Human
ucacaccauugcacuccagccugggcgacagg

SEQ ID NO: 493588 - RNA, 32 nt, Human
ucacaccauugcacuccagcuugggcaacaau

SEQ ID NO: 493589 - RNA, 32 nt, Human
ucacaccauugcacugcagccugggugaagaa

SEQ ID NO: 493590 - RNA, 32 nt, Human
ucacaccauugcacuucaaccuggucaacaga

SEQ ID NO: 493591 - RNA, 32 nt, Human
ucacaccauugcacuucagccugggcgacaca

SEQ ID NO: 493592 - RNA, 32 nt, Human
ucacaccauugcccuccagccugggugacaga

SEQ ID NO: 493593 - RNA, 32 nt, Human
ucacaccauugcgcuucagccugggcaacaag

SEQ ID NO: 493594 - RNA, 32 nt, Human
ucacaccauugcuguccagccugggugacaga

SEQ ID NO: 493595 - RNA, 21 nt, Human
ucacacccacuccagcccucu

SEQ ID NO: 493596 - RNA, 24 nt, Human
ucacacccauaaucccaacacuuu

SEQ ID NO: 493597 - RNA, 24 nt, Human
ucacacccauaaucccagcacuuu

SEQ ID NO: 493598 - RNA, 32 nt, Human
ucacacccauaaucccagcacuuugggaggcu

SEQ ID NO: 493599 - RNA, 32 nt, Human
ucacacccauagcgggagagaccucaugcaga

SEQ ID NO: 493600 - RNA, 32 nt, Human
ucacaccccaagccucagaggauugucuuacc

SEQ ID NO: 493601 - RNA, 32 nt, Human
ucacacccccaccugcauuuugaagucauauu

SEQ ID NO: 493602 - RNA, 32 nt, Human
ucacacccccuccucaagcugggccugcccuc

SEQ ID NO: 493603 - RNA, 32 nt, Human
ucacaccccugcacuccagccugggugacagc

SEQ ID NO: 493604 - RNA, 32 nt, Human
ucacaccccugcccugggccggcaggauccgg

SEQ ID NO: 493605 - RNA, 24 nt, Human
ucacacccguaaucccagcacuuu

SEQ ID NO: 493606 - RNA, 32 nt, Human
ucacacccguaaucccagcacuuugcggggcc

SEQ ID NO: 493607 - RNA, 29 nt, Human
ucacacccguaaucccagcacuuugggag

SEQ ID NO: 493608 - RNA, 32 nt, Human
ucacacccuaccuuccccagacuugcacuggg

SEQ ID NO: 493609 - RNA, 32 nt, Human
ucacacccuccccauuaguauccuguuagggg

SEQ ID NO: 493610 - RNA, 32 nt, Human
ucacacccugacuucagggaaggugaaacagg

SEQ ID NO: 493611 - RNA, 25 nt, Human
ucacacccuguaaucccagcacuuu

SEQ ID NO: 493612 - RNA, 32 nt, Human
ucacacccuguaaucccagcacuuugggaggc

SEQ ID NO: 493613 - RNA, 32 nt, Human
ucacacccuucuucugaccagcuccugucccc

SEQ ID NO: 493614 - RNA, 32 nt, Human
ucacacccuuucccucucccugugugccugcc

SEQ ID NO: 493615 - RNA, 32 nt, Human
ucacaccgcugcacucaagccugggugacagu

SEQ ID NO: 493616 - RNA, 32 nt, Human
ucacaccgcugcacucaagcuugggugacaga

SEQ ID NO: 493617 - RNA, 32 nt, Human
ucacaccgcugcacuccagccugggcaacaag

SEQ ID NO: 493618 - RNA, 23 nt, Human
ucacaccgguaaucccaacacuu

SEQ ID NO: 493619 - RNA, 24 nt, Human
ucacaccgguaaucccagcacuuu

SEQ ID NO: 493620 - RNA, 32 nt, Human
ucacaccgguaaucccagcacuuugggaggcc

SEQ ID NO: 493621 - RNA, 32 nt, Human
ucacaccgguaaucccagcacuuugggaggcu

SEQ ID NO: 493622 - RNA, 22 nt, Human
ucacaccuaaucccagcacuuu

SEQ ID NO: 493623 - RNA, 32 nt, Human
ucacaccuaccccuaccguccagccuggccuc

SEQ ID NO: 493624 - RNA, 23 nt, Human
ucacaccuauaaucccaacacuu

SEQ ID NO: 493625 - RNA, 24 nt, Human
ucacaccuauaaucccaacacuuu

SEQ ID NO: 493626 - RNA, 32 nt, Human
ucacaccuauaaucccaacacuuucggaggcc

SEQ ID NO: 493627 - RNA, 24 nt, Human
ucacaccuauaaucccaauacuuu

SEQ ID NO: 493628 - RNA, 32 nt, Human
ucacaccuauaaucccaauacuuugggaggcc

SEQ ID NO: 493629 - RNA, 32 nt, Human
ucacaccuauaaucccagcaccuuggguggcc

SEQ ID NO: 493630 - RNA, 22 nt, Human
ucacaccuauaaucccagcacu

SEQ ID NO: 493631 - RNA, 32 nt, Human
ucacaccuauaaucccagcacuaugggaggcu

SEQ ID NO: 493632 - RNA, 32 nt, Human
ucacaccuauaaucccagcacucugggaggcc

SEQ ID NO: 493633 - RNA, 24 nt, Human
ucacaccuauaaucccagcacuuu

SEQ ID NO: 493634 - RNA, 32 nt, Human
ucacaccuauaaucccagcacuuuaggaggcc

SEQ ID NO: 493635 - RNA, 32 nt, Human
ucacaccuauaaucccagcacuuugggaagcc

SEQ ID NO: 493636 - RNA, 32 nt, Human
ucacaccuauaaucccagcacuuugggaggca

SEQ ID NO: 493637 - RNA, 32 nt, Human
ucacaccuauaaucccagcacuuugggaggcc

SEQ ID NO: 493638 - RNA, 32 nt, Human
ucacaccuauaaucccagcacuuugggaggcu

SEQ ID NO: 493639 - RNA, 32 nt, Human
ucacaccuauaaucccagcacuuugggagggu

SEQ ID NO: 493640 - RNA, 32 nt, Human
ucacaccuauaaucccagcacuuugggagguu

SEQ ID NO: 493641 - RNA, 24 nt, Human
ucacaccuauaaucccagcccuuu

SEQ ID NO: 493642 - RNA, 32 nt, Human
ucacaccuauaaucccagcccuuugggagacu

SEQ ID NO: 493643 - RNA, 24 nt, Human
ucacaccuauaaucccagcgcuuu

SEQ ID NO: 493644 - RNA, 32 nt, Human
ucacaccuauaaucccagcgcuuuggaggcug

SEQ ID NO: 493645 - RNA, 24 nt, Human
ucacaccuauaauccuagcgcuuu

SEQ ID NO: 493646 - RNA, 24 nt, Human
ucacaccuauaauccuaggacuuu

SEQ ID NO: 493647 - RNA, 24 nt, Human
ucacaccuauaauccuggcacuuu

SEQ ID NO: 493648 - RNA, 23 nt, Human
ucacaccuauaaucgagcacuuu

SEQ ID NO: 493649 - RNA, 24 nt, Human
ucacaccuauaauuccagcacuuu

SEQ ID NO: 493650 - RNA, 22 nt, Human
ucacaccuauagucccagcacu

SEQ ID NO: 493651 - RNA, 32 nt, Human
ucacaccucacugcagccucaaucuuagcugg

SEQ ID NO: 493652 - RNA, 32 nt, Human
ucacaccucacugcagccuuggccucucaggc

SEQ ID NO: 493653 - RNA, 32 nt, Human
ucacaccucagggcagcgagaguggaccuggu

SEQ ID NO: 493654 - RNA, 24 nt, Human
ucacaccucuaaucccagcacuuu

SEQ ID NO: 493655 - RNA, 32 nt, Human
ucacaccucuaaucccagcacuuugggaggcu

SEQ ID NO: 493656 - RNA, 32 nt, Human
ucacaccucucaucguggaguuccaccaugug

SEQ ID NO: 493657 - RNA, 32 nt, Human
ucacaccucuuucugccucuacauauggccua

SEQ ID NO: 493658 - RNA, 24 nt, Human
ucacaccugaaaucccagcacuuu

SEQ ID NO: 493659 - RNA, 32 nt, Human
ucacaccugaaaucccagcacuuugggaggcc

SEQ ID NO: 493660 - RNA, 32 nt, Human
ucacaccugaagacaugcucucacauauagag

SEQ ID NO: 493661 - RNA, 32 nt, Human
ucacaccugacugcacuccagccuggguggca

SEQ ID NO: 493662 - RNA, 24 nt, Human
ucacaccugcaaucccagcacuuu

SEQ ID NO: 493663 - RNA, 32 nt, Human
ucacaccugcaaucccagcacuuuggaaggcc

SEQ ID NO: 493664 - RNA, 32 nt, Human
ucacaccugcaaucccagcacuuugggaggcc

SEQ ID NO: 493665 - RNA, 32 nt, Human
ucacaccugcaaucccaguacuuugagaggcc

SEQ ID NO: 493666 - RNA, 24 nt, Human
ucacaccuggaaucccagcauuuu

SEQ ID NO: 493667 - RNA, 18 nt, Human
ucacaccugggcaaacuu

SEQ ID NO: 493668 - RNA, 24 nt, Human
ucacaccuguaaacccagcacuuu

SEQ ID NO: 493669 - RNA, 24 nt, Human
ucacaccuguaaccccaacacuuu

SEQ ID NO: 493670 - RNA, 22 nt, Human
ucacaccuguaaccccagcacu

SEQ ID NO: 493671 - RNA, 24 nt, Human
ucacaccuguaaccccagcacuuu

SEQ ID NO: 493672 - RNA, 32 nt, Human
ucacaccuguaaccccagcacuuugggacgcc

SEQ ID NO: 493673 - RNA, 32 nt, Human
ucacaccuguaaccccagcacuuugggaggcu

SEQ ID NO: 493674 - RNA, 32 nt, Human
ucacaccuguaacccccagcacuuugggaggc

SEQ ID NO: 493675 - RNA, 24 nt, Human
ucacaccuguaacccuagcacuuu

SEQ ID NO: 493676 - RNA, 32 nt, Human
ucacaccuguaacccuagcacuuugggaggcc

SEQ ID NO: 493677 - RNA, 32 nt, Human
ucacaccuguaauaaucccagcacuuugggag

SEQ ID NO: 493678 - RNA, 32 nt, Human
ucacaccuguaauaccagcacuuugggaagug

SEQ ID NO: 493679 - RNA, 24 nt, Human
ucacaccuguaauaccagcaguuu

SEQ ID NO: 493680 - RNA, 32 nt, Human
ucacaccuguaauaccagcaguuugagaagcu

SEQ ID NO: 493681 - RNA, 32 nt, Human
ucacaccuguaaucacagcacuuugggaggcc

SEQ ID NO: 493682 - RNA, 32 nt, Human
ucacaccuguaaucacagcacuuugggaggcu

SEQ ID NO: 493683 - RNA, 24 nt, Human
ucacaccuguaauccaagcacuuu

SEQ ID NO: 493684 - RNA, 32 nt, Human
ucacaccuguaauccaagcacuuugggaggcc

SEQ ID NO: 493685 - RNA, 32 nt, Human
ucacaccuguaaucccaacacucugggaagcc

SEQ ID NO: 493686 - RNA, 24 nt, Human
ucacaccuguaaucccaacacuuu

SEQ ID NO: 493687 - RNA, 32 nt, Human
ucacaccuguaaucccaacacuuugagaggcu

SEQ ID NO: 493688 - RNA, 32 nt, Human
ucacaccuguaaucccaacacuuugagcggcu

SEQ ID NO: 493689 - RNA, 32 nt, Human
ucacaccuguaaucccaacacuuuggaaggcc

SEQ ID NO: 493690 - RNA, 32 nt, Human
ucacaccuguaaucccaacacuuugggaagcc

SEQ ID NO: 493691 - RNA, 32 nt, Human
ucacaccuguaaucccaacacuuugggaaucu

SEQ ID NO: 493692 - RNA, 32 nt, Human
ucacaccuguaaucccaacacuuugggacguu

SEQ ID NO: 493693 - RNA, 32 nt, Human
ucacaccuguaaucccaacacuuugggagccc

SEQ ID NO: 493694 - RNA, 32 nt, Human
ucacaccuguaaucccaacacuuugggaggcc

SEQ ID NO: 493695 - RNA, 32 nt, Human
ucacaccuguaaucccaacacuuugggaggcu

SEQ ID NO: 493696 - RNA, 32 nt, Human
ucacaccuguaaucccaacacuuugggaugcu

SEQ ID NO: 493697 - RNA, 24 nt, Human
ucacaccuguaaucccaacaguuu

SEQ ID NO: 493698 - RNA, 24 nt, Human
ucacaccuguaaucccaacauuuu

SEQ ID NO: 493699 - RNA, 32 nt, Human
ucacaccuguaaucccaacauuuugggaaccc

SEQ ID NO: 493700 - RNA, 32 nt, Human
ucacaccuguaaucccaacauuuugggaggcc

SEQ ID NO: 493701 - RNA, 32 nt, Human
ucacaccuguaaucccaacccuuugggaggcc

SEQ ID NO: 493702 - RNA, 22 nt, Human
ucacaccuguaaucccaauacu

SEQ ID NO: 493703 - RNA, 32 nt, Human
ucacaccuguaaucccaauacugggaagccaa

SEQ ID NO: 493704 - RNA, 32 nt, Human
ucacaccuguaaucccaauacuuuggguggcu

SEQ ID NO: 493705 - RNA, 24 nt, Human
ucacaccuguaaucccagaacuuu

SEQ ID NO: 493706 - RNA, 32 nt, Human
ucacaccuguaaucccagaacuuugggaggcc

SEQ ID NO: 493707 - RNA, 32 nt, Human
ucacaccuguaaucccagagcuucgggaggcc

SEQ ID NO: 493708 - RNA, 20 nt, Human
ucacaccuguaaucccagca

SEQ ID NO: 493709 - RNA, 32 nt, Human
ucacaccuguaaucccagcaauuugggagacc

SEQ ID NO: 493710 - RNA, 21 nt, Human
ucacaccuguaaucccagcac

SEQ ID NO: 493711 - RNA, 32 nt, Human
ucacaccuguaaucccagcacacugggaggcc

SEQ ID NO: 493712 - RNA, 32 nt, Human
ucacaccuguaaucccagcaccuugggaggcu

SEQ ID NO: 493713 - RNA, 32 nt, Human
ucacaccuguaaucccagcacguugggaggcu

SEQ ID NO: 493714 - RNA, 22 nt, Human
ucacaccuguaaucccagcacu

SEQ ID NO: 493715 - RNA, 32 nt, Human
ucacaccuguaaucccagcacuaugggaggcc

SEQ ID NO: 493716 - RNA, 32 nt, Human
ucacaccuguaaucccagcacucugggaggcc

SEQ ID NO: 493717 - RNA, 32 nt, Human
ucacaccuguaaucccagcacucugggagggc

SEQ ID NO: 493718 - RNA, 32 nt, Human
ucacaccuguaaucccagcacuguggaaagac

SEQ ID NO: 493719 - RNA, 23 nt, Human
ucacaccuguaaucccagcacuu

SEQ ID NO: 493720 - RNA, 32 nt, Human
ucacaccuguaaucccagcacuuagagaggcc

SEQ ID NO: 493721 - RNA, 32 nt, Human
ucacaccuguaaucccagcacuuagggaagac

SEQ ID NO: 493722 - RNA, 32 nt, Human
ucacaccuguaaucccagcacuuagggaggcu

SEQ ID NO: 493723 - RNA, 32 nt, Human
ucacaccuguaaucccagcacuuagguaggcc

SEQ ID NO: 493724 - RNA, 32 nt, Human
ucacaccuguaaucccagcacuucgggaagcc

SEQ ID NO: 493725 - RNA, 32 nt, Human
ucacaccuguaaucccagcacuucgggaggcc

SEQ ID NO: 493726 - RNA, 32 nt, Human
ucacaccuguaaucccagcacuucgggagguc

SEQ ID NO: 493727 - RNA, 32 nt, Human
ucacaccuguaaucccagcacuugggaagccc

SEQ ID NO: 493728 - RNA, 32 nt, Human
ucacaccuguaaucccagcacuuggggaagcu

SEQ ID NO: 493729 - RNA, 32 nt, Human
ucacaccuguaaucccagcacuuggggaggcu

SEQ ID NO: 493730 - RNA, 24 nt, Human
ucacaccuguaaucccagcacuuu

SEQ ID NO: 493731 - RNA, 32 nt, Human
ucacaccuguaaucccagcacuuuaggagguc

SEQ ID NO: 493732 - RNA, 32 nt, Human
ucacaccuguaaucccagcacuuucggaggcc

SEQ ID NO: 493733 - RNA, 32 nt, Human
ucacaccuguaaucccagcacuuugagaggau

SEQ ID NO: 493734 - RNA, 32 nt, Human
ucacaccuguaaucccagcacuuugagaggcc

SEQ ID NO: 493735 - RNA, 32 nt, Human
ucacaccuguaaucccagcacuuugcggggcu

SEQ ID NO: 493736 - RNA, 32 nt, Human
ucacaccuguaaucccagcacuuuggcaggcc

SEQ ID NO: 493737 - RNA, 32 nt, Human
ucacaccuguaaucccagcacuuugggaaccc

SEQ ID NO: 493738 - RNA, 32 nt, Human
ucacaccuguaaucccagcacuuugggaagcu

SEQ ID NO: 493739 - RNA, 32 nt, Human
ucacaccuguaaucccagcacuuugggaaguc

SEQ ID NO: 493740 - RNA, 32 nt, Human
ucacaccuguaaucccagcacuuugggacacc

SEQ ID NO: 493741 - RNA, 32 nt, Human
ucacaccuguaaucccagcacuuugggagacu

SEQ ID NO: 493742 - RNA, 32 nt, Human
ucacaccuguaaucccagcacuuugggagccc

SEQ ID NO: 493743 - RNA, 32 nt, Human
ucacaccuguaaucccagcacuuugggagccu

SEQ ID NO: 493744 - RNA, 32 nt, Human
ucacaccuguaaucccagcacuuugggaggac

SEQ ID NO: 493745 - RNA, 32 nt, Human
ucacaccuguaaucccagcacuuugggaggcc

SEQ ID NO: 493746 - RNA, 32 nt, Human
ucacaccuguaaucccagcacuuugggaggcg

SEQ ID NO: 493747 - RNA, 32 nt, Human
ucacaccuguaaucccagcacuuugggaggcu

SEQ ID NO: 493748 - RNA, 32 nt, Human
ucacaccuguaaucccagcacuuugggagggc

SEQ ID NO: 493749 - RNA, 32 nt, Human
ucacaccuguaaucccagcacuuugggagguc

SEQ ID NO: 493750 - RNA, 32 nt, Human
ucacaccuguaaucccagcacuuugggaggug

SEQ ID NO: 493751 - RNA, 32 nt, Human
ucacaccuguaaucccagcacuuugggagucc

SEQ ID NO: 493752 - RNA, 32 nt, Human
ucacaccuguaaucccagcacuuugggagucu

SEQ ID NO: 493753 - RNA, 32 nt, Human
ucacaccuguaaucccagcacuuugggauuac

SEQ ID NO: 493754 - RNA, 32 nt, Human
ucacaccuguaaucccagcacuuugggauucc

SEQ ID NO: 493755 - RNA, 32 nt, Human
ucacaccuguaaucccagcacuuuggggagcu

SEQ ID NO: 493756 - RNA, 32 nt, Human
ucacaccuguaaucccagcacuuuggguggcu

SEQ ID NO: 493757 - RNA, 32 nt, Human
ucacaccuguaaucccagcacuuugguaggcc

SEQ ID NO: 493758 - RNA, 32 nt, Human
ucacaccuguaaucccagcacuuuuggaggcc

SEQ ID NO: 493759 - RNA, 24 nt, Human
ucacaccuguaaucccagcaguuu

SEQ ID NO: 493760 - RNA, 32 nt, Human
ucacaccuguaaucccagcaguuuggaaggcc

SEQ ID NO: 493761 - RNA, 32 nt, Human
ucacaccuguaaucccagcaguuugggaggcc

SEQ ID NO: 493762 - RNA, 24 nt, Human
ucacaccuguaaucccagcauuuu

SEQ ID NO: 493763 - RNA, 32 nt, Human
ucacaccuguaaucccagcauuuugggaagcu

SEQ ID NO: 493764 - RNA, 32 nt, Human
ucacaccuguaaucccagcauuuugggaggca

SEQ ID NO: 493765 - RNA, 32 nt, Human
ucacaccuguaaucccagcauuuugggaggcc

SEQ ID NO: 493766 - RNA, 32 nt, Human
ucacaccuguaaucccagcauuuugggaggcu

SEQ ID NO: 493767 - RNA, 32 nt, Human
ucacaccuguaaucccagcccuuugggaggcu

SEQ ID NO: 493768 - RNA, 21 nt, Human
ucacaccuguaaucccagccu

SEQ ID NO: 493769 - RNA, 24 nt, Human
ucacaccuguaaucccagcgcuuu

SEQ ID NO: 493770 - RNA, 32 nt, Human
ucacaccuguaaucccagcgcuuugggaggcu

SEQ ID NO: 493771 - RNA, 23 nt, Human
ucacaccuguaaucccagcuacu

SEQ ID NO: 493772 - RNA, 32 nt, Human
ucacaccuguaaucccagcuacucagcagggu

SEQ ID NO: 493773 - RNA, 32 nt, Human
ucacaccuguaaucccagcuacucaggaagcu

SEQ ID NO: 493774 - RNA, 32 nt, Human
ucacaccuguaaucccagcuacuugggaggcu

SEQ ID NO: 493775 - RNA, 32 nt, Human
ucacaccuguaaucccagcuauucacgaggcu

SEQ ID NO: 493776 - RNA, 24 nt, Human
ucacaccuguaaucccagcucuuu

SEQ ID NO: 493777 - RNA, 32 nt, Human
ucacaccuguaaucccagcucuuuggaggccg

SEQ ID NO: 493778 - RNA, 32 nt, Human
ucacaccuguaaucccagcucuuugggaggcc

SEQ ID NO: 493779 - RNA, 32 nt, Human
ucacaccuguaaucccagcuguuugggaggcu

SEQ ID NO: 493780 - RNA, 24 nt, Human
ucacaccuguaaucccaggacuuu

SEQ ID NO: 493781 - RNA, 32 nt, Human
ucacaccuguaaucccaggacuuugggaggcu

SEQ ID NO: 493782 - RNA, 21 nt, Human
ucacaccuguaaucccaguac

SEQ ID NO: 493783 - RNA, 32 nt, Human
ucacaccuguaaucccaguaccuugggaggcc

SEQ ID NO: 493784 - RNA, 24 nt, Human
ucacaccuguaaucccaguacuuu

SEQ ID NO: 493785 - RNA, 32 nt, Human
ucacaccuguaaucccaguacuuugagacgcu

SEQ ID NO: 493786 - RNA, 32 nt, Human
ucacaccuguaaucccaguacuuugggaggcc

SEQ ID NO: 493787 - RNA, 32 nt, Human
ucacaccuguaaucccagugcuuugggaggcc

SEQ ID NO: 493788 - RNA, 25 nt, Human
ucacaccuguaauccccagcacuuu

SEQ ID NO: 493789 - RNA, 32 nt, Human
ucacaccuguaauccccagcacuuugggaggc

SEQ ID NO: 493790 - RNA, 24 nt, Human
ucacaccuguaauccccgcacuuu

SEQ ID NO: 493791 - RNA, 32 nt, Human
ucacaccuguaauccccgcacuuuggaaggcc

SEQ ID NO: 493792 - RNA, 23 nt, Human
ucacaccuguaaucccgcacuuu

SEQ ID NO: 493793 - RNA, 24 nt, Human
ucacaccuguaaucccggcacuuu

SEQ ID NO: 493794 - RNA, 32 nt, Human
ucacaccuguaaucccggcacuuugggaggcu

SEQ ID NO: 493795 - RNA, 32 nt, Human
ucacaccuguaaucccggcauuuugggaggcc

SEQ ID NO: 493796 - RNA, 24 nt, Human
ucacaccuguaaucccugcacuuu

SEQ ID NO: 493797 - RNA, 32 nt, Human
ucacaccuguaaucccugcacuuugggaggcc

SEQ ID NO: 493798 - RNA, 24 nt, Human
ucacaccuguaaucccugcauuuu

SEQ ID NO: 493799 - RNA, 24 nt, Human
ucacaccuguaauccgaguacuuu

SEQ ID NO: 493800 - RNA, 32 nt, Human
ucacaccuguaauccgaguacuuugcggggcu

SEQ ID NO: 493801 - RNA, 23 nt, Human
ucacaccuguaauccuaacacuu

SEQ ID NO: 493802 - RNA, 32 nt, Human
ucacaccuguaauccuaacacuuggggaggcu

SEQ ID NO: 493803 - RNA, 24 nt, Human
ucacaccuguaauccuaacacuuu

SEQ ID NO: 493804 - RNA, 32 nt, Human
ucacaccuguaauccuaacacuuugggaggcu

SEQ ID NO: 493805 - RNA, 32 nt, Human
ucacaccuguaauccuaaguaacacuuuggga

SEQ ID NO: 493806 - RNA, 32 nt, Human
ucacaccuguaauccuagaacuuugggaggcc

SEQ ID NO: 493807 - RNA, 21 nt, Human
ucacaccuguaauccuagcac

SEQ ID NO: 493808 - RNA, 32 nt, Human
ucacaccuguaauccuagcacauugggaggcc

SEQ ID NO: 493809 - RNA, 32 nt, Human
ucacaccuguaauccuagcacguggggaggcu

SEQ ID NO: 493810 - RNA, 24 nt, Human
ucacaccuguaauccuagcacuuu

SEQ ID NO: 493811 - RNA, 32 nt, Human
ucacaccuguaauccuagcacuuugggaggcc

SEQ ID NO: 493812 - RNA, 32 nt, Human
ucacaccuguaauccuagcacuuugggaggcu

SEQ ID NO: 493813 - RNA, 32 nt, Human
ucacaccuguaauccuagcacuuugggagguc

SEQ ID NO: 493814 - RNA, 32 nt, Human
ucacaccuguaauccuagcaguuugggaggcc

SEQ ID NO: 493815 - RNA, 21 nt, Human
ucacaccuguaauccuagcau

SEQ ID NO: 493816 - RNA, 32 nt, Human
ucacaccuguaauccuagcaucuugggaggcc

SEQ ID NO: 493817 - RNA, 24 nt, Human
ucacaccuguaauccuagcgcuuu

SEQ ID NO: 493818 - RNA, 32 nt, Human
ucacaccuguaauccuagcgcuuugggaggcc

SEQ ID NO: 493819 - RNA, 32 nt, Human
ucacaccuguaauccugcacuuugggagucug

SEQ ID NO: 493820 - RNA, 32 nt, Human
ucacaccuguaaucucaacacuuugggaggcc

SEQ ID NO: 493821 - RNA, 24 nt, Human
ucacaccuguaaucucaacgcuuu

SEQ ID NO: 493822 - RNA, 32 nt, Human
ucacaccuguaaucucaacgcuuugggagggg

SEQ ID NO: 493823 - RNA, 32 nt, Human
ucacaccuguaaucucagcaaccugggagucc

SEQ ID NO: 493824 - RNA, 21 nt, Human
ucacaccuguaaucucagcac

SEQ ID NO: 493825 - RNA, 32 nt, Human
ucacaccuguaaucucagcacguugggaaguu

SEQ ID NO: 493826 - RNA, 32 nt, Human
ucacaccuguaaucucagcacucugggaggcc

SEQ ID NO: 493827 - RNA, 24 nt, Human
ucacaccuguaaucucagcacuuu

SEQ ID NO: 493828 - RNA, 32 nt, Human
ucacaccuguaaucucagcacuuugggaaguu

SEQ ID NO: 493829 - RNA, 32 nt, Human
ucacaccuguaaucucagcacuuugggaggcc

SEQ ID NO: 493830 - RNA, 32 nt, Human
ucacaccuguaaucucagcacuuugggaggcg

SEQ ID NO: 493831 - RNA, 32 nt, Human
ucacaccuguaaucucagcacuuugggaggcu

SEQ ID NO: 493832 - RNA, 32 nt, Human
ucacaccuguaaucucagcacuuugggugguc

SEQ ID NO: 493833 - RNA, 24 nt, Human
ucacaccuguaaucucagcauuuu

SEQ ID NO: 493834 - RNA, 32 nt, Human
ucacaccuguaaucucagcauuuugggaggcc

SEQ ID NO: 493835 - RNA, 23 nt, Human
ucacaccuguaaucucagccucc

SEQ ID NO: 493836 - RNA, 32 nt, Human
ucacaccuguaaucucagccucccagacggcu

SEQ ID NO: 493837 - RNA, 24 nt, Human
ucacaccuguaaucugaacacuuu

SEQ ID NO: 493838 - RNA, 32 nt, Human
ucacaccuguaaucugagcacauugggaggcc

SEQ ID NO: 493839 - RNA, 32 nt, Human
ucacaccuguaaucugagcauucugggaggcc

SEQ ID NO: 493840 - RNA, 32 nt, Human
ucacaccuguaaucuuaacacugugggaggcc

SEQ ID NO: 493841 - RNA, 32 nt, Human
ucacaccuguaaugcagcucguuggguggcug

SEQ ID NO: 493842 - RNA, 32 nt, Human
ucacaccuguaaugccagcacuuugggcagcu

SEQ ID NO: 493843 - RNA, 24 nt, Human
ucacaccuguaaugccagcccuuu

SEQ ID NO: 493844 - RNA, 32 nt, Human
ucacaccuguaaugccagcccuuugggaggcc

SEQ ID NO: 493845 - RNA, 24 nt, Human
ucacaccuguaauuccaacacuuu

SEQ ID NO: 493846 - RNA, 32 nt, Human
ucacaccuguaauuccaacacuuugggaggca

SEQ ID NO: 493847 - RNA, 32 nt, Human
ucacaccuguaauuccagcacuucaggaggcc

SEQ ID NO: 493848 - RNA, 32 nt, Human
ucacaccuguaauuccagcacuuggggaggcc

SEQ ID NO: 493849 - RNA, 24 nt, Human
ucacaccuguaauuccagcacuuu

SEQ ID NO: 493850 - RNA, 32 nt, Human
ucacaccuguaauuccagcacuuugggaggcc

SEQ ID NO: 493851 - RNA, 32 nt, Human
ucacaccuguaauuccagcacuuugggaggcu

SEQ ID NO: 493852 - RNA, 32 nt, Human
ucacaccuguaauuccagcacuuugggagguc

SEQ ID NO: 493853 - RNA, 32 nt, Human
ucacaccuguaauuccagcacuuugugaggcu

SEQ ID NO: 493854 - RNA, 32 nt, Human
ucacaccuguaauucccagcgcuuugggaauu

SEQ ID NO: 493855 - RNA, 32 nt, Human
ucacaccuguaauucuagcacuuugggaggcu

SEQ ID NO: 493856 - RNA, 32 nt, Human
ucacaccuguaauugcagcacucugggaggcc

SEQ ID NO: 493857 - RNA, 24 nt, Human
ucacaccuguaauugcagcacuuu

SEQ ID NO: 493858 - RNA, 32 nt, Human
ucacaccuguaauugcagcacuuugggaggcu

SEQ ID NO: 493859 - RNA, 32 nt, Human
ucacaccuguaauuucagcaccuugggaggcc

SEQ ID NO: 493860 - RNA, 32 nt, Human
ucacaccuguaauuucagcacucuggggaggu

SEQ ID NO: 493861 - RNA, 23 nt, Human
ucacaccuguacucccagcacuu

SEQ ID NO: 493862 - RNA, 24 nt, Human
ucacaccuguacucccagcauuuu

SEQ ID NO: 493863 - RNA, 24 nt, Human
ucacaccuguagucccagcacuuu

SEQ ID NO: 493864 - RNA, 32 nt, Human
ucacaccuguagucccagcuacuugggaggcu

SEQ ID NO: 493865 - RNA, 24 nt, Human
ucacaccuguauucccagcacuuu

SEQ ID NO: 493866 - RNA, 24 nt, Human
ucacaccugucaucccagcacuuu

SEQ ID NO: 493867 - RNA, 32 nt, Human
ucacaccugucaucccagcacuuugggaggcc

SEQ ID NO: 493868 - RNA, 32 nt, Human
ucacaccugucaucccagcaguuugggaggcc

SEQ ID NO: 493869 - RNA, 19 nt, Human
ucacaccugucauuccggc

SEQ ID NO: 493870 - RNA, 23 nt, Human
ucacaccugugacggaagcacuu

SEQ ID NO: 493871 - RNA, 24 nt, Human
ucacaccugugaucccaacauuuu

SEQ ID NO: 493872 - RNA, 22 nt, Human
ucacaccugugaucccagcacu

SEQ ID NO: 493873 - RNA, 23 nt, Human
ucacaccugugaucccagcacuu

SEQ ID NO: 493874 - RNA, 32 nt, Human
ucacaccugugaucccagcacuugggaagguc

SEQ ID NO: 493875 - RNA, 32 nt, Human
ucacaccugugaucccagcacuuggggagaac

SEQ ID NO: 493876 - RNA, 24 nt, Human
ucacaccugugaucccagcacuuu

SEQ ID NO: 493877 - RNA, 32 nt, Human
ucacaccugugaucccagcacuuugggaggcc

SEQ ID NO: 493878 - RNA, 32 nt, Human
ucacaccugugaucccagcacuuugggaggcu

SEQ ID NO: 493879 - RNA, 24 nt, Human
ucacaccugugaucccagcauuuu

SEQ ID NO: 493880 - RNA, 27 nt, Human
ucacaccugugauccccccagcacuuu

SEQ ID NO: 493881 - RNA, 21 nt, Human
ucacaccugugaucucagcac

SEQ ID NO: 493882 - RNA, 25 nt, Human
ucacaccuguggaaucccagcacuu

SEQ ID NO: 493883 - RNA, 32 nt, Human
ucacaccuguggucccagcucuuuggaaggcc

SEQ ID NO: 493884 - RNA, 32 nt, Human
ucacaccuguggugucagcuacucgggaggcu

SEQ ID NO: 493885 - RNA, 24 nt, Human
ucacaccuguuaaucccagcacuu

SEQ ID NO: 493886 - RNA, 24 nt, Human
ucacaccuguuaucccagcacuuu

SEQ ID NO: 493887 - RNA, 23 nt, Human
ucacaccuuaaucccagcacuuu

SEQ ID NO: 493888 - RNA, 32 nt, Human
ucacaccuucuguuccccuccuggccugugca

SEQ ID NO: 493889 - RNA, 25 nt, Human
ucacaccuuguaaucccagcacuuu

SEQ ID NO: 493890 - RNA, 24 nt, Human
ucacaccuuuaaucccagcacuuu

SEQ ID NO: 493891 - RNA, 32 nt, Human
ucacaccuuuaaucccagcacuuugggaagcc

SEQ ID NO: 493892 - RNA, 32 nt, Human
ucacaccuuuaaucccagcacuuugggagacu

SEQ ID NO: 493893 - RNA, 24 nt, Human
ucacaccuuuaauccuagcacuuu

SEQ ID NO: 493894 - RNA, 32 nt, Human
ucacacgaauaccugccuucucuggcuuuccu

SEQ ID NO: 493895 - RNA, 32 nt, Human
ucacacgacugcauucuagccugggugacaga

SEQ ID NO: 493896 - RNA, 32 nt, Human
ucacacgcaccguguccccacccaggacagca

SEQ ID NO: 493897 - RNA, 32 nt, Human
ucacacgccacugcacuccagccugggugaca

SEQ ID NO: 493898 - RNA, 32 nt, Human
ucacacgccuguaaucccagcacuuugggagg

SEQ ID NO: 493899 - RNA, 32 nt, Human
ucacacgcuggaagaagugggaaagguuugua

SEQ ID NO: 493900 - RNA, 32 nt, Human
ucacacggaaauggguacuugguggcauagag

SEQ ID NO: 493901 - RNA, 32 nt, Human
ucacacggaggcagagguggggaugagguaug

SEQ ID NO: 493902 - RNA, 32 nt, Human
ucacacuacagcccuggugggggagaaggggg

SEQ ID NO: 493903 - RNA, 32 nt, Human
ucacacuacugcacuccagccugggcaacaga

SEQ ID NO: 493904 - RNA, 32 nt, Human
ucacacuacugcacuccagccugggcgacaaa

SEQ ID NO: 493905 - RNA, 32 nt, Human
ucacacuacugcacuccugcaugggcgacuga

SEQ ID NO: 493906 - RNA, 32 nt, Human
ucacacuacugcauuccagccugagcaacaga

SEQ ID NO: 493907 - RNA, 32 nt, Human
ucacacuaucacugccccaaauugucuuucua

SEQ ID NO: 493908 - RNA, 32 nt, Human
ucacacuauugcacuccagccugggcgacagg

SEQ ID NO: 493909 - RNA, 32 nt, Human
ucacacucaguccuggccuugcucugagggua

SEQ ID NO: 493910 - RNA, 32 nt, Human
ucacacucauucucaacccccugacaaaacac

SEQ ID NO: 493911 - RNA, 32 nt, Human
ucacacuccacucaccuccaccucccaaagug

SEQ ID NO: 493912 - RNA, 32 nt, Human
ucacacuccagccuggguaacagagugagacu

SEQ ID NO: 493913 - RNA, 32 nt, Human
ucacacuccagugcuuuuaagcagguuuuccc

SEQ ID NO: 493914 - RNA, 32 nt, Human
ucacacuccugcucacuagcccccaggcgcag

SEQ ID NO: 493915 - RNA, 22 nt, Human
ucacacuccuggccucaaguga

SEQ ID NO: 493916 - RNA, 32 nt, Human
ucacacuccugggcucugaacacacacgccag

SEQ ID NO: 493917 - RNA, 23 nt, Human
ucacacucguccccagcuuagca

SEQ ID NO: 493918 - RNA, 32 nt, Human
ucacacucuccaggcuggagugcaguggcaca

SEQ ID NO: 493919 - RNA, 32 nt, Human
ucacacucuccucagcucucucaucuccugga

SEQ ID NO: 493920 - RNA, 32 nt, Human
ucacacucuuucaagagaagcuuccuuggaca

SEQ ID NO: 493921 - RNA, 32 nt, Human
ucacacucuuucaagagaagcuuccuuggguu

SEQ ID NO: 493922 - RNA, 32 nt, Human
ucacacugaggccuuggggacugaggcccugg

SEQ ID NO: 493923 - RNA, 32 nt, Human
ucacacugauaauacagacauaccugaaacug

SEQ ID NO: 493924 - RNA, 32 nt, Human
ucacacugcaggcaggcuuuagagugcuuuga

SEQ ID NO: 493925 - RNA, 32 nt, Human
ucacacugcccaggcuggagcauaguggcaag

SEQ ID NO: 493926 - RNA, 32 nt, Human
ucacacugcugcacuccagccugugcaacaga

SEQ ID NO: 493927 - RNA, 18 nt, Human
ucacacuggcccagagaa

SEQ ID NO: 493928 - RNA, 32 nt, Human
ucacacuggggaaacucauuuuccccugcagc

SEQ ID NO: 493929 - RNA, 32 nt, Human
ucacacugggguccccaaagaagucaagaucu

SEQ ID NO: 493930 - RNA, 23 nt, Human
ucacacuguaaugccagcacuuu

SEQ ID NO: 493931 - RNA, 32 nt, Human
ucacacuguaaugccagcacuuugggaggcua

SEQ ID NO: 493932 - RNA, 32 nt, Human
ucacacugucgccaggcuggagugcaguggug

SEQ ID NO: 493933 - RNA, 32 nt, Human
ucacacuuaaagucuucagcccagcuacuucc

SEQ ID NO: 493934 - RNA, 24 nt, Human
ucacacuuauaaucccagcacuuu

SEQ ID NO: 493935 - RNA, 32 nt, Human
ucacacuuauaaucccagcacuuugggaggcc

SEQ ID NO: 493936 - RNA, 24 nt, Human
ucacacuuaucaucucagcacuuu

SEQ ID NO: 493937 - RNA, 32 nt, Human
ucacacuucugccucuugcaaaauugcuggaa

SEQ ID NO: 493938 - RNA, 32 nt, Human
ucacacuugccucccauccugccugcagaaaa

SEQ ID NO: 493939 - RNA, 32 nt, Human
ucacacuugcuggcuugcgcaucaggacuggc

SEQ ID NO: 493940 - RNA, 24 nt, Human
ucacacuuguaaucccaacacuuu

SEQ ID NO: 493941 - RNA, 32 nt, Human
ucacacuuguaaucccaacacuuuggaaggcu

SEQ ID NO: 493942 - RNA, 32 nt, Human
ucacacuuguaaucccagcaauuugggaggcu

SEQ ID NO: 493943 - RNA, 24 nt, Human
ucacacuuguaaucccagcacuuu

SEQ ID NO: 493944 - RNA, 32 nt, Human
ucacacuuguaaucccagcacuuugagguggg

SEQ ID NO: 493945 - RNA, 32 nt, Human
ucacacuuguaaucccagcacuuugggaagcc

SEQ ID NO: 493946 - RNA, 32 nt, Human
ucacacuuguaaucccagcacuuugggaggcc

SEQ ID NO: 493947 - RNA, 32 nt, Human
ucacacuuguaaucccagcacuuugggaugcu

SEQ ID NO: 493948 - RNA, 32 nt, Human
ucacacuuguaaucccagcauuuugggaggcc

SEQ ID NO: 493949 - RNA, 32 nt, Human
ucacacuuguaauccuaguacuuugggaggcc

SEQ ID NO: 493950 - RNA, 32 nt, Human
ucacagaaaaaucugcccagagccuacccuca

SEQ ID NO: 493951 - RNA, 32 nt, Human
ucacagaaaacauuguuccucccuccacaccu

SEQ ID NO: 493952 - RNA, 32 nt, Human
ucacagaaacuggggaagggaaaacaaaccuu

SEQ ID NO: 493953 - RNA, 32 nt, Human
ucacagaaaggcagguuucauuucuuaucaca

SEQ ID NO: 493954 - RNA, 32 nt, Human
ucacagaacaaagaguaaagaggcugagugug

SEQ ID NO: 493955 - RNA, 32 nt, Human
ucacagaacaaagccagguacucuccaucacc

SEQ ID NO: 493956 - RNA, 32 nt, Human
ucacagaacccuuuuccugacucucauggaag

SEQ ID NO: 493957 - RNA, 32 nt, Human
ucacagaacuccaccauugugggcuuugagag

SEQ ID NO: 493958 - RNA, 32 nt, Human
ucacagaacuuguagucuucugccccaaacaa

SEQ ID NO: 493959 - RNA, 32 nt, Human
ucacagaagggccuggaugcaagguuacccuu

SEQ ID NO: 493960 - RNA, 32 nt, Human
ucacagaaguagugguuugcuuugauggaaau

SEQ ID NO: 493961 - RNA, 32 nt, Human
ucacagacacuacauaucuaaagcuuugacaa

SEQ ID NO: 493962 - RNA, 32 nt, Human
ucacagacacugcacagaccuuagggaauggc

SEQ ID NO: 493963 - RNA, 32 nt, Human
ucacagacagagagggugagggguugagccca

SEQ ID NO: 493964 - RNA, 32 nt, Human
ucacagacaugaggaagcaggcuguagauuua

SEQ ID NO: 493965 - RNA, 32 nt, Human
ucacagaccacagcuucuaugugagggagagc

SEQ ID NO: 493966 - RNA, 32 nt, Human
ucacagaccagaaaaaguuccaucuaaaauau

SEQ ID NO: 493967 - RNA, 32 nt, Human
ucacagacccucccccuaccaguggguguggc

SEQ ID NO: 493968 - RNA, 32 nt, Human
ucacagacccucucaggccucugacgagugag

SEQ ID NO: 493969 - RNA, 23 nt, Human
ucacagacugcagacccccggcu

SEQ ID NO: 493970 - RNA, 32 nt, Human
ucacagacuuaacagcccagcacuucauacga

SEQ ID NO: 493971 - RNA, 32 nt, Human
ucacagacuucccuaguguuuguacuacacgu

SEQ ID NO: 493972 - RNA, 32 nt, Human
ucacagagaaugucuuauacagcaacugcuca

SEQ ID NO: 493973 - RNA, 32 nt, Human
ucacagagauccagagaacagaaacaagagcc

SEQ ID NO: 493974 - RNA, 32 nt, Human
ucacagagcaccccaguuccucaccagcuacu

SEQ ID NO: 493975 - RNA, 19 nt, Human
ucacagagcagcaaguuca

SEQ ID NO: 493976 - RNA, 32 nt, Human
ucacagagcagugauaacuaccugccaguguc

SEQ ID NO: 493977 - RNA, 32 nt, Human
ucacagagcuaaaaacucaguucccaaauccc

SEQ ID NO: 493978 - RNA, 32 nt, Human
ucacagagcucucugguugggcugcucuauaa

SEQ ID NO: 493979 - RNA, 21 nt, Human
ucacagaggcccccucuguca

SEQ ID NO: 493980 - RNA, 32 nt, Human
ucacagaggcgguuguaagaggaugugguuau

SEQ ID NO: 493981 - RNA, 32 nt, Human
ucacagaggcucacccuuugccacuuuccuga

SEQ ID NO: 493982 - RNA, 32 nt, Human
ucacagaggcugccuuucuccugagcucgggg

SEQ ID NO: 493983 - RNA, 32 nt, Human
ucacagagggcacuguggucacacacagugcc

SEQ ID NO: 493984 - RNA, 32 nt, Human
ucacagagggcagggccaggguccagcagggg

SEQ ID NO: 493985 - RNA, 32 nt, Human
ucacagaggggcucgguggcccaggugguggu

SEQ ID NO: 493986 - RNA, 32 nt, Human
ucacagagucccaacucagaggaaaagggcca

SEQ ID NO: 493987 - RNA, 32 nt, Human
ucacagaguguggacaucagcccagggccgcg

SEQ ID NO: 493988 - RNA, 32 nt, Human
ucacagaucaucaagacuucucucuucuguca

SEQ ID NO: 493989 - RNA, 32 nt, Human
ucacagaugaacaaacuucuacacugauuuuu

SEQ ID NO: 493990 - RNA, 32 nt, Human
ucacagaugaaccugcagacccugccagagug

SEQ ID NO: 493991 - RNA, 32 nt, Human
ucacagaugagcgcaggcagagcucugugugc

SEQ ID NO: 493992 - RNA, 32 nt, Human
ucacagaugaggcugccccugcccccuccccg

SEQ ID NO: 493993 - RNA, 32 nt, Human
ucacagaugccaucaagcugauccucgcuugg

SEQ ID NO: 493994 - RNA, 32 nt, Human
ucacagauggauaaaugaggcugauguuugga

SEQ ID NO: 493995 - RNA, 32 nt, Human
ucacagauucacauacgacugaucuugauuuu

SEQ ID NO: 493996 - RNA, 32 nt, Human
ucacagauugcauaaauucacccaugaaucua

SEQ ID NO: 493997 - RNA, 32 nt, Human
ucacagauuuggugagaggagcacggagugcu

SEQ ID NO: 493998 - RNA, 32 nt, Human
ucacagcaaacuuggaaagaaggcuaugacuc

SEQ ID NO: 493999 - RNA, 24 nt, Human
ucacagcaaccucugccucccagg

SEQ ID NO: 494000 - RNA, 32 nt, Human
ucacagcaacuccugaggaaagugcuauucuu

SEQ ID NO: 494001 - RNA, 32 nt, Human
ucacagcaacuggcuggaaaagaaagggaaaa

SEQ ID NO: 494002 - RNA, 22 nt, Human
ucacagcaaggaccacagagcg

SEQ ID NO: 494003 - RNA, 19 nt, Human
ucacagcaaggaccggacg

SEQ ID NO: 494004 - RNA, 32 nt, Human
ucacagcacagagugaccgcugccuggcguuc

SEQ ID NO: 494005 - RNA, 32 nt, Human
ucacagcacagggagaaaaacugagguacaca

SEQ ID NO: 494006 - RNA, 21 nt, Human
ucacagcacccucagcaccuu

SEQ ID NO: 494007 - RNA, 32 nt, Human
ucacagcacuccuuugccccagagcagagaau

SEQ ID NO: 494008 - RNA, 32 nt, Human
ucacagcacugcacugcagccugggugacaaa

SEQ ID NO: 494009 - RNA, 32 nt, Human
ucacagcacugcacugcugccugggcgacagc

SEQ ID NO: 494010 - RNA, 32 nt, Human
ucacagcagcuggcuggcuugacuuugccaac

SEQ ID NO: 494011 - RNA, 32 nt, Human
ucacagcagucacaggcccaggaaggcggcag

SEQ ID NO: 494012 - RNA, 20 nt, Human
ucacagcauaauuucccggc

SEQ ID NO: 494013 - RNA, 32 nt, Human
ucacagcauauaggucaggaaagaauggagac

SEQ ID NO: 494014 - RNA, 32 nt, Human
ucacagcauauuguaugagacugugugagugc

SEQ ID NO: 494015 - RNA, 32 nt, Human
ucacagcauuuagugcuuccugccugguguga

SEQ ID NO: 494016 - RNA, 32 nt, Human
ucacagccaaaagccugggacucuuugugaag

SEQ ID NO: 494017 - RNA, 32 nt, Human
ucacagccaaggccccuuccacccucuccaga

SEQ ID NO: 494018 - RNA, 32 nt, Human
ucacagccaaggcuggacuggguuggcugcag

SEQ ID NO: 494019 - RNA, 32 nt, Human
ucacagccaauuucacacaguacuacgaagag

SEQ ID NO: 494020 - RNA, 18 nt, Human
ucacagccacccccacca

SEQ ID NO: 494021 - RNA, 32 nt, Human
ucacagccaccuggaacccaagccagcugagc

SEQ ID NO: 494022 - RNA, 32 nt, Human
ucacagccacuagaaacccaucagccuuuccc

SEQ ID NO: 494023 - RNA, 19 nt, Human
ucacagccacugcuuggca

SEQ ID NO: 494024 - RNA, 19 nt, Human
ucacagccagccaaaggca

SEQ ID NO: 494025 - RNA, 32 nt, Human
ucacagcccagagcauguuccagaucccagag

SEQ ID NO: 494026 - RNA, 32 nt, Human
ucacagcccaggagggaggguagcuuggcacu

SEQ ID NO: 494027 - RNA, 32 nt, Human
ucacagcccaucccaucuccccgacgccgccc

SEQ ID NO: 494028 - RNA, 32 nt, Human
ucacagccccucagcaccaagcagaagguggc

SEQ ID NO: 494029 - RNA, 32 nt, Human
ucacagccccuccauguuaccucccgcaccuc

SEQ ID NO: 494030 - RNA, 31 nt, Human
ucacagcccuucucugggucuugaagucccu

SEQ ID NO: 494031 - RNA, 32 nt, Human
ucacagccguaaucccagcuacucgggaggcu

SEQ ID NO: 494032 - RNA, 32 nt, Human
ucacagccucauuccugccuuuucucagccau

SEQ ID NO: 494033 - RNA, 32 nt, Human
ucacagccuccuuacucuccccaggcuuugcu

SEQ ID NO: 494034 - RNA, 32 nt, Human
ucacagccucuguaucucugcaggccauacug

SEQ ID NO: 494035 - RNA, 32 nt, Human
ucacagcggaggugacacacaccgcauggagu

SEQ ID NO: 494036 - RNA, 32 nt, Human
ucacagcguagcuguucccaggaaaggggugc

SEQ ID NO: 494037 - RNA, 32 nt, Human
ucacagcuaaguagcuguggccaccggcaguu

SEQ ID NO: 494038 - RNA, 31 nt, Human
ucacagcuacucagggagguugaggcagcag

SEQ ID NO: 494039 - RNA, 32 nt, Human
ucacagcuacucgggagguugaggcaggagaa

SEQ ID NO: 494040 - RNA, 24 nt, Human
ucacagcuauaaucucagcacuuu

SEQ ID NO: 494041 - RNA, 32 nt, Human
ucacagcuaugaauaagcuuucagguuuuauu

SEQ ID NO: 494042 - RNA, 32 nt, Human
ucacagcucacagcaggcuccaccucucaggc

SEQ ID NO: 494043 - RNA, 32 nt, Human
ucacagcucacugaagucucgaccucccaggc

SEQ ID NO: 494044 - RNA, 32 nt, Human
ucacagcucacugcaaccucaaacuccugggc

SEQ ID NO: 494045 - RNA, 32 nt, Human
ucacagcucacugcaaccucaauccugggcuc

SEQ ID NO: 494046 - RNA, 32 nt, Human
ucacagcucacugcaaccucuacucccaggcu

SEQ ID NO: 494047 - RNA, 32 nt, Human
ucacagcucacugcaaccuuacuccuaggcuc

SEQ ID NO: 494048 - RNA, 32 nt, Human
ucacagcucacugcagcccugaacuccugggc

SEQ ID NO: 494049 - RNA, 32 nt, Human
ucacagcucacugcagccucaaacuccugggc

SEQ ID NO: 494050 - RNA, 32 nt, Human
ucacagcucacugcagccucaaccucugaagg

SEQ ID NO: 494051 - RNA, 32 nt, Human
ucacagcucacugcagccucaaccuggguuca

SEQ ID NO: 494052 - RNA, 32 nt, Human
ucacagcucacugcagccuccaccuccugggc

SEQ ID NO: 494053 - RNA, 32 nt, Human
ucacagcucacugcagccuccaucuccuaggc

SEQ ID NO: 494054 - RNA, 32 nt, Human
ucacagcucacugcagccucgaccucccgggc

SEQ ID NO: 494055 - RNA, 32 nt, Human
ucacagcucacugcagccucgaccuccugcgc

SEQ ID NO: 494056 - RNA, 32 nt, Human
ucacagcucacugcagccucgaccuccuggac

SEQ ID NO: 494057 - RNA, 32 nt, Human
ucacagcucacugcagccucgaccuccugggc

SEQ ID NO: 494058 - RNA, 32 nt, Human
ucacagcucacugcagccucgacuucccaggc

SEQ ID NO: 494059 - RNA, 32 nt, Human
ucacagcucacugcagccuggaccuccuggcc

SEQ ID NO: 494060 - RNA, 32 nt, Human
ucacagcucacugcagccuugaccucccgggc

SEQ ID NO: 494061 - RNA, 32 nt, Human
ucacagcucacugcagccuugaccuccugggu

SEQ ID NO: 494062 - RNA, 32 nt, Human
ucacagcucacugcagccuugagcuccugggc

SEQ ID NO: 494063 - RNA, 32 nt, Human
ucacagcucacugcagccuuguccucccaggc

SEQ ID NO: 494064 - RNA, 32 nt, Human
ucacagcucacugcagcuuugaucugaccgcu

SEQ ID NO: 494065 - RNA, 32 nt, Human
ucacagcucacugcagguucagccuucugagu

SEQ ID NO: 494066 - RNA, 32 nt, Human
ucacagcucacugcagucucgaacuccuggac

SEQ ID NO: 494067 - RNA, 32 nt, Human
ucacagcucacugcugccucgaccuccgucag

SEQ ID NO: 494068 - RNA, 32 nt, Human
ucacagcucacuguagccucgaccuuccaggc

SEQ ID NO: 494069 - RNA, 32 nt, Human
ucacagcucacuguagccucuaacucccaggc

SEQ ID NO: 494070 - RNA, 32 nt, Human
ucacagcucacuguagccuugaucuccugggc

SEQ ID NO: 494071 - RNA, 32 nt, Human
ucacagcuccuggccuuguugugcauaugagg

SEQ ID NO: 494072 - RNA, 32 nt, Human
ucacagcucugccucacagcacccuggccaag

SEQ ID NO: 494073 - RNA, 32 nt, Human
ucacagcugcuuggauggcugaggcaggagaa

SEQ ID NO: 494074 - RNA, 32 nt, Human
ucacagcuggacccugcuucacccucaccccc

SEQ ID NO: 494075 - RNA, 32 nt, Human
ucacagcuguaaucccagcacuuagggagguc

SEQ ID NO: 494076 - RNA, 24 nt, Human
ucacagcuguaaucccagcacuuu

SEQ ID NO: 494077 - RNA, 32 nt, Human
ucacagcuguaaucccagcacuuugagguugg

SEQ ID NO: 494078 - RNA, 32 nt, Human
ucacagcuguguaugugugcucaaauuuaucc

SEQ ID NO: 494079 - RNA, 32 nt, Human
ucacagcuucuccaagugccuagugaaacggg

SEQ ID NO: 494080 - RNA, 32 nt, Human
ucacagcuuggcugagcucugucucugcaggu

SEQ ID NO: 494081 - RNA, 32 nt, Human
ucacaggaaauguugauuuucuaagguccuca

SEQ ID NO: 494082 - RNA, 16 nt, Human
ucacaggaaggcuguc

SEQ ID NO: 494083 - RNA, 22 nt, Human
ucacaggaauucugauugcuga

SEQ ID NO: 494084 - RNA, 32 nt, Human
ucacaggacggcuccugggcagcugggcccuc

SEQ ID NO: 494085 - RNA, 32 nt, Human
ucacaggacucugcagauagugccucugcaaa

SEQ ID NO: 494086 - RNA, 32 nt, Human
ucacaggacuugugauuguguuaaauucucac

SEQ ID NO: 494087 - RNA, 32 nt, Human
ucacaggagccacugcacuccagccuggguga

SEQ ID NO: 494088 - RNA, 32 nt, Human
ucacaggaugaauuaagaauugccaagguguu

SEQ ID NO: 494089 - RNA, 32 nt, Human
ucacaggaugacacccucccauaccccauagc

SEQ ID NO: 494090 - RNA, 32 nt, Human
ucacaggaugccuuauuugucuucuacacccc

SEQ ID NO: 494091 - RNA, 32 nt, Human
ucacaggcagcucugagccgcgcuuuccccuc

SEQ ID NO: 494092 - RNA, 32 nt, Human
ucacaggcaggaaccucaugcucugaggaagu

SEQ ID NO: 494093 - RNA, 32 nt, Human
ucacaggcauauucccugcacacacaugcaua

SEQ ID NO: 494094 - RNA, 32 nt, Human
ucacaggcaugccacguggccugagaugauuc

SEQ ID NO: 494095 - RNA, 21 nt, Human
ucacaggccagcuggccgggg

SEQ ID NO: 494096 - RNA, 22 nt, Human
ucacaggccauccuugcugcuc

SEQ ID NO: 494097 - RNA, 32 nt, Human
ucacaggcccuuacugggaugcagagaggaga

SEQ ID NO: 494098 - RNA, 32 nt, Human
ucacaggccuagcucaugucauggaucaggug

SEQ ID NO: 494099 - RNA, 32 nt, Human
ucacaggccugcgggagccagggugggcagcc

SEQ ID NO: 494100 - RNA, 20 nt, Human
ucacaggccugguucuggca

SEQ ID NO: 494101 - RNA, 32 nt, Human
ucacaggccugguucuggcaguucuuugcgga

SEQ ID NO: 494102 - RNA, 32 nt, Human
ucacaggcucaagcaauucuccugccucagcc

SEQ ID NO: 494103 - RNA, 32 nt, Human
ucacaggcucagggcaaagaaguggccuccug

SEQ ID NO: 494104 - RNA, 32 nt, Human
ucacaggcuggggacagagguggcccugguuc

SEQ ID NO: 494105 - RNA, 32 nt, Human
ucacaggcuugugagggccccgucgcugccug

SEQ ID NO: 494106 - RNA, 32 nt, Human
ucacaggcuuugcucaccagggcacaggaagg

SEQ ID NO: 494107 - RNA, 24 nt, Human
ucacagggaggcauucauggagcu

SEQ ID NO: 494108 - RNA, 32 nt, Human
ucacagggccacaaagaacaaguuuccccaug

SEQ ID NO: 494109 - RNA, 32 nt, Human
ucacagggccaguauucuuuuuaccauguucc

SEQ ID NO: 494110 - RNA, 31 nt, Human
ucacagggcuaucuucugcauuuaaagaaua

SEQ ID NO: 494111 - RNA, 32 nt, Human
ucacagggcuguaacacuguuacuguacagag

SEQ ID NO: 494112 - RNA, 32 nt, Human
ucacaggucaccauggggaauucuagccccca

SEQ ID NO: 494113 - RNA, 18 nt, Human
ucacaggucacgcuggca

SEQ ID NO: 494114 - RNA, 32 nt, Human
ucacaggucacugcagcccugaccuccugggc

SEQ ID NO: 494115 - RNA, 19 nt, Human
ucacaggucagaagcuuag

SEQ ID NO: 494116 - RNA, 32 nt, Human
ucacaggucucaaagcaggaacaguggguuug

SEQ ID NO: 494117 - RNA, 32 nt, Human
ucacaggugaagccucgguaggucccagggag

SEQ ID NO: 494118 - RNA, 32 nt, Human
ucacaggugccuuuagaaguaccauuucaugu

SEQ ID NO: 494119 - RNA, 26 nt, Human
ucacaggugcucugcucguggcccca

SEQ ID NO: 494120 - RNA, 21 nt, Human
ucacagguuccuucauuaaca

SEQ ID NO: 494121 - RNA, 32 nt, Human
ucacagguugacugaagcacaaguugccccug

SEQ ID NO: 494122 - RNA, 32 nt, Human
ucacaguaauccucagaguggcccaggugggu

SEQ ID NO: 494123 - RNA, 32 nt, Human
ucacaguacagcucuugucuuuaccaacugcc

SEQ ID NO: 494124 - RNA, 32 nt, Human
ucacaguagacagaauaaacaagucauaucua

SEQ ID NO: 494125 - RNA, 32 nt, Human
ucacagucauuuccacagccucaaccacuguc

SEQ ID NO: 494126 - RNA, 32 nt, Human
ucacaguccaggaagagggguggccaguccua

SEQ ID NO: 494127 - RNA, 32 nt, Human
ucacagucggcaggcagcauggggaagggagg

SEQ ID NO: 494128 - RNA, 32 nt, Human
ucacagucuaauucucccagacuaggauuuuu

SEQ ID NO: 494129 - RNA, 32 nt, Human
ucacagucucauuccccuccgucacuagcacg

SEQ ID NO: 494130 - RNA, 32 nt, Human
ucacagucucccugaaggagcugcagaguaac

SEQ ID NO: 494131 - RNA, 32 nt, Human
ucacagucucucuugggaggaaacaaugaauu

SEQ ID NO: 494132 - RNA, 32 nt, Human
ucacagugaacugccugucucucucgaguuga

SEQ ID NO: 494133 - RNA, 32 nt, Human
ucacagugacagugucauggggagcugggcgg

SEQ ID NO: 494134 - RNA, 21 nt, Human
ucacagugcauauacacaaua

SEQ ID NO: 494135 - RNA, 32 nt, Human
ucacagugccccugcaaguugcagccucaguu

SEQ ID NO: 494136 - RNA, 32 nt, Human
ucacagugcuucuguucagguugcacacuggg

SEQ ID NO: 494137 - RNA, 32 nt, Human
ucacaguggcuuaggccagggugggagcagug

SEQ ID NO: 494138 - RNA, 32 nt, Human
ucacagugugucucccuuuuugguuuucuuuu

SEQ ID NO: 494139 - RNA, 32 nt, Human
ucacaguucacugcagccucaaccucuccaga

SEQ ID NO: 494140 - RNA, 32 nt, Human
ucacaguucacugcagccugggugacacucca

SEQ ID NO: 494141 - RNA, 32 nt, Human
ucacaguucuggaggcugcaaaguccaauauu

SEQ ID NO: 494142 - RNA, 22 nt, Human
ucacaguuggucccccuugccu

SEQ ID NO: 494143 - RNA, 32 nt, Human
ucacaguuucaggcuuuuaugaggaaagcguu

SEQ ID NO: 494144 - RNA, 32 nt, Human
ucacaguuugccuguugaucucuaauuuucua

SEQ ID NO: 494145 - RNA, 31 nt, Human
ucacauacaauuuguauccauuuaaagugua

SEQ ID NO: 494146 - RNA, 32 nt, Human
ucacauacacacacauagacgccuuucccuau

SEQ ID NO: 494147 - RNA, 32 nt, Human
ucacauacacagauugucuucagagccaaacg

SEQ ID NO: 494148 - RNA, 32 nt, Human
ucacauacauuugaacauuuuauaauuauuga

SEQ ID NO: 494149 - RNA, 32 nt, Human
ucacauacauuugaccauuuuauaauuauuga

SEQ ID NO: 494150 - RNA, 32 nt, Human
ucacauaccagcuguuuuucagucuccugcuc

SEQ ID NO: 494151 - RNA, 32 nt, Human
ucacauacccacuuagcaaaaccaaagcaccu

SEQ ID NO: 494152 - RNA, 32 nt, Human
ucacauaggaacagaugcaaguucacucuguu

SEQ ID NO: 494153 - RNA, 32 nt, Human
ucacauaucugccugugagacuggauugagac

SEQ ID NO: 494154 - RNA, 32 nt, Human
ucacauaugaaucaucacaggucgauccaggc

SEQ ID NO: 494155 - RNA, 32 nt, Human
ucacauaugcagccucaaauguuacacagaua

SEQ ID NO: 494156 - RNA, 32 nt, Human
ucacaucaccagcucaccucugguagccauag

SEQ ID NO: 494157 - RNA, 32 nt, Human
ucacaucacugcacuccagccuggguaacaga

SEQ ID NO: 494158 - RNA, 32 nt, Human
ucacaucacugcacuccauccugggugacaga

SEQ ID NO: 494159 - RNA, 32 nt, Human
ucacaucacugcaguccagccugggugacaga

SEQ ID NO: 494160 - RNA, 32 nt, Human
ucacaucaugcuguuuuauccuugaacuucua

SEQ ID NO: 494161 - RNA, 32 nt, Human
ucacauccaaagugaugcuuugcuuuggguuu

SEQ ID NO: 494162 - RNA, 32 nt, Human
ucacauccagggcugugucuuccuugggggag

SEQ ID NO: 494163 - RNA, 32 nt, Human
ucacaucccaggagaauuccacggagaggaau

SEQ ID NO: 494164 - RNA, 32 nt, Human
ucacaucccugggugaagauggggagacagug

SEQ ID NO: 494165 - RNA, 32 nt, Human
ucacaucccuucaagaguccugaagaucaagc

SEQ ID NO: 494166 - RNA, 32 nt, Human
ucacauccgauuucuccuccugccccagccuc

SEQ ID NO: 494167 - RNA, 20 nt, Human
ucacauccugagcugcuccu

SEQ ID NO: 494168 - RNA, 32 nt, Human
ucacauccugagcugcuccuggcugauaacca

SEQ ID NO: 494169 - RNA, 32 nt, Human
ucacauccugggugggacagagcaggacaaug

SEQ ID NO: 494170 - RNA, 32 nt, Human
ucacauccuucauggaaggagaugucugggau

SEQ ID NO: 494171 - RNA, 32 nt, Human
ucacauccuucuuggaaucucagucugugagu

SEQ ID NO: 494172 - RNA, 32 nt, Human
ucacauccuuugcccaugugucuaugagguua

SEQ ID NO: 494173 - RNA, 32 nt, Human
ucacaucgggcagaggugacgcuguggaccug

SEQ ID NO: 494174 - RNA, 32 nt, Human
ucacaucuaaccucaucuucuucaccauuugg

SEQ ID NO: 494175 - RNA, 32 nt, Human
ucacaucuccaaugaaucugcccaugccuaug

SEQ ID NO: 494176 - RNA, 24 nt, Human
ucacaucuguaaccccagcacuuu

SEQ ID NO: 494177 - RNA, 32 nt, Human
ucacaucuguaaccccagcacuuugggaggcu

SEQ ID NO: 494178 - RNA, 24 nt, Human
ucacaucuguaauccaagcacuuu

SEQ ID NO: 494179 - RNA, 32 nt, Human
ucacaucuguaauccaagcacuuugggagguc

SEQ ID NO: 494180 - RNA, 24 nt, Human
ucacaucuguaaucccaacacuuu

SEQ ID NO: 494181 - RNA, 32 nt, Human
ucacaucuguaaucccaacacuuugggaggcu

SEQ ID NO: 494182 - RNA, 24 nt, Human
ucacaucuguaaucccagcacuuu

SEQ ID NO: 494183 - RNA, 32 nt, Human
ucacaucuguaaucccagcacuuuggaaggcu

SEQ ID NO: 494184 - RNA, 32 nt, Human
ucacaucuguaaucccagcacuuugggagacu

SEQ ID NO: 494185 - RNA, 32 nt, Human
ucacaucuguaaucccagcacuuugggaggca

SEQ ID NO: 494186 - RNA, 32 nt, Human
ucacaucuguaaucccagcacuuugggaggcc

SEQ ID NO: 494187 - RNA, 32 nt, Human
ucacaucuguaaucccagcacuuugggaggcu

SEQ ID NO: 494188 - RNA, 32 nt, Human
ucacaucuguaaucccagcacuuugggagucc

SEQ ID NO: 494189 - RNA, 32 nt, Human
ucacaucuguaaucccagcacuuuuggaggcu

SEQ ID NO: 494190 - RNA, 24 nt, Human
ucacaucuguaaucucaacacuuu

SEQ ID NO: 494191 - RNA, 32 nt, Human
ucacaucuguaaucucagcauuuugggaggcc

SEQ ID NO: 494192 - RNA, 32 nt, Human
ucacaucuguaaucucagcucuuuggaaggca

SEQ ID NO: 494193 - RNA, 24 nt, Human
ucacaucuguaaugccagcacuuu

SEQ ID NO: 494194 - RNA, 32 nt, Human
ucacaucuuagcagugauuuuuauccaauuuu

SEQ ID NO: 494195 - RNA, 31 nt, Human
ucacaucuuaugucugccaugccaggggugu

SEQ ID NO: 494196 - RNA, 32 nt, Human
ucacaucuuuaaucccagcaauuugggaggcu

SEQ ID NO: 494197 - RNA, 32 nt, Human
ucacaucuuuaaucccagcaguuugggaggcu

SEQ ID NO: 494198 - RNA, 32 nt, Human
ucacaugaacccaggagguugaagcugcggug

SEQ ID NO: 494199 - RNA, 32 nt, Human
ucacaugaauccaggagguggagguugcagug

SEQ ID NO: 494200 - RNA, 32 nt, Human
ucacaugacccuuccauguuaaagcugacuuu

SEQ ID NO: 494201 - RNA, 21 nt, Human
ucacaugacuguccccuccca

SEQ ID NO: 494202 - RNA, 32 nt, Human
ucacaugagcccaggagguugaggcugcagug

SEQ ID NO: 494203 - RNA, 32 nt, Human
ucacaugaugauaccugcuuuucucaggccug

SEQ ID NO: 494204 - RNA, 32 nt, Human
ucacaugcaagggacaggguuacauccccaag

SEQ ID NO: 494205 - RNA, 32 nt, Human
ucacaugccaaggaaaauggcacggaagaccc

SEQ ID NO: 494206 - RNA, 32 nt, Human
ucacaugcccacugcagcccuccagccucugg

SEQ ID NO: 494207 - RNA, 32 nt, Human
ucacaugcccugcuucagcugguaaugggacu

SEQ ID NO: 494208 - RNA, 32 nt, Human
ucacaugcggugaaccugugaggcagauccau

SEQ ID NO: 494209 - RNA, 32 nt, Human
ucacaugcuauucccaugucaugggcccaggg

SEQ ID NO: 494210 - RNA, 32 nt, Human
ucacaugcucccugacuuaguucuguuuagaa

SEQ ID NO: 494211 - RNA, 32 nt, Human
ucacaugcugguuuguuugcuugcuuguuuac

SEQ ID NO: 494212 - RNA, 32 nt, Human
ucacaugcuuaugcuacucaggaggcugaggu

SEQ ID NO: 494213 - RNA, 32 nt, Human
ucacaugcuucucaccuaaguccccagggucc

SEQ ID NO: 494214 - RNA, 32 nt, Human
ucacauggacccugagcaaggaaggagggagg

SEQ ID NO: 494215 - RNA, 32 nt, Human
ucacauggcaaaagcuuugaaaaucauaaaga

SEQ ID NO: 494216 - RNA, 32 nt, Human
ucacauggcagagagaaagagagagaaagagu

SEQ ID NO: 494217 - RNA, 32 nt, Human
ucacauggcuccuaccuccagcacagaagcgg

SEQ ID NO: 494218 - RNA, 32 nt, Human
ucacauggcucucaaaauuccugaaaauucaa

SEQ ID NO: 494219 - RNA, 32 nt, Human
ucacaugggcccaggcugagugugagugagca

SEQ ID NO: 494220 - RNA, 32 nt, Human
ucacauggguguccuugggaccacugacccug

SEQ ID NO: 494221 - RNA, 18 nt, Human
ucacauggucugcuuagc

SEQ ID NO: 494222 - RNA, 32 nt, Human
ucacauggugagaaggaggaugaagggaggag

SEQ ID NO: 494223 - RNA, 32 nt, Human
ucacaugugaaaagcuuaauaaauuccaucua

SEQ ID NO: 494224 - RNA, 32 nt, Human
ucacaugugcauccacuucuuuucauccauug

SEQ ID NO: 494225 - RNA, 32 nt, Human
ucacaugugugccugugucuucuguccuggag

SEQ ID NO: 494226 - RNA, 32 nt, Human
ucacauguucacuugcuuuuccuuccaucugu

SEQ ID NO: 494227 - RNA, 32 nt, Human
ucacauguucucuuggacuuuauauaaaucug

SEQ ID NO: 494228 - RNA, 32 nt, Human
ucacauguucucuuuagcacaccauuccugca

SEQ ID NO: 494229 - RNA, 32 nt, Human
ucacauguucuuuguucaaucauagaauauau

SEQ ID NO: 494230 - RNA, 32 nt, Human
ucacauuacauggcuucaucuaccuccaggcu

SEQ ID NO: 494231 - RNA, 21 nt, Human
ucacauuaucuugcuaucacu

SEQ ID NO: 494232 - RNA, 32 nt, Human
ucacauuauucuauguaagugaucacuuguca

SEQ ID NO: 494233 - RNA, 32 nt, Human
ucacauuauucuauguaagugaugacuuguca

SEQ ID NO: 494234 - RNA, 32 nt, Human
ucacauuauuuauuuuucauugugagauacua

SEQ ID NO: 494235 - RNA, 32 nt, Human
ucacauucaguuauaaucauuuagcaauauua

SEQ ID NO: 494236 - RNA, 32 nt, Human
ucacauucauuucuuagguccauucucagagc

SEQ ID NO: 494237 - RNA, 32 nt, Human
ucacauuccagauggcagaacagggaaaggau

SEQ ID NO: 494238 - RNA, 32 nt, Human
ucacauuccugcucucuaccuacuucuuggua

SEQ ID NO: 494239 - RNA, 24 nt, Human
ucacauucguaaucccagcacuuu

SEQ ID NO: 494240 - RNA, 32 nt, Human
ucacauucuaggguaugugggaguguauauga

SEQ ID NO: 494241 - RNA, 32 nt, Human
ucacauucucaccuagcaacaacuggcuggag

SEQ ID NO: 494242 - RNA, 32 nt, Human
ucacauucugaaguccuuggagucaagacuuc

SEQ ID NO: 494243 - RNA, 32 nt, Human
ucacauucuuugucgucuccccagagaaagca

SEQ ID NO: 494244 - RNA, 32 nt, Human
ucacauugaaaugaggauuuugcuuaaaacag

SEQ ID NO: 494245 - RNA, 32 nt, Human
ucacauugaugaaguugcucuagcuagaaagc

SEQ ID NO: 494246 - RNA, 32 nt, Human
ucacauugccuucugaagaggagggaguauua

SEQ ID NO: 494247 - RNA, 17 nt, Human
ucacauuggaacucuga

SEQ ID NO: 494248 - RNA, 32 nt, Human
ucacauuggagcugguguugucugaaguuuuc

SEQ ID NO: 494249 - RNA, 19 nt, Human
ucacauugggucucugguc

SEQ ID NO: 494250 - RNA, 31 nt, Human
ucacauugggucucugguccugugucuucac

SEQ ID NO: 494251 - RNA, 32 nt, Human
ucacauuguggaggcacgagggcuggagucca

SEQ ID NO: 494252 - RNA, 32 nt, Human
ucacauuguuaagaaaaauacuuuuuaaaguu

SEQ ID NO: 494253 - RNA, 32 nt, Human
ucacauuucugcccuccaccuuggcggucagc

SEQ ID NO: 494254 - RNA, 24 nt, Human
ucacauuuguaaucccagcacuuu

SEQ ID NO: 494255 - RNA, 32 nt, Human
ucacauuuguaaucccagcacuuuggaaggcc

SEQ ID NO: 494256 - RNA, 32 nt, Human
ucacauuuucuuuccugguuuucugguucugc

SEQ ID NO: 494257 - RNA, 32 nt, Human
ucaccaaaaagacacugcagaaacccugagca

SEQ ID NO: 494258 - RNA, 23 nt, Human
ucaccaaaaccaaacagagacag

SEQ ID NO: 494259 - RNA, 32 nt, Human
ucaccaaaagauuaaaugaaaccacccugugu

SEQ ID NO: 494260 - RNA, 32 nt, Human
ucaccaaaagccccaggcauuucagaaggugg

SEQ ID NO: 494261 - RNA, 32 nt, Human
ucaccaaacaacuucagaaagacagugacugu

SEQ ID NO: 494262 - RNA, 32 nt, Human
ucaccaaacacaugcuaggauauaacccccaa

SEQ ID NO: 494263 - RNA, 21 nt, Human
ucaccaaagagauuauuuuga

SEQ ID NO: 494264 - RNA, 31 nt, Human
ucaccaaagggaccuguuaccuggaccaggu

SEQ ID NO: 494265 - RNA, 32 nt, Human
ucaccaaagggcagaaaacaacagcucaagcc

SEQ ID NO: 494266 - RNA, 32 nt, Human
ucaccaaaguguugggauuacuggugugagcc

SEQ ID NO: 494267 - RNA, 32 nt, Human
ucaccaacacugccuuccuccagccugucccu

SEQ ID NO: 494268 - RNA, 32 nt, Human
ucaccaacauggagaaaucccaucucuacuaa

SEQ ID NO: 494269 - RNA, 32 nt, Human
ucaccaaccaggagaaauucaccuaggacugg

SEQ ID NO: 494270 - RNA, 32 nt, Human
ucaccaacccagaaccuccuugaucaucacag

SEQ ID NO: 494271 - RNA, 32 nt, Human
ucaccaacucagacuucacauguggucacuga

SEQ ID NO: 494272 - RNA, 32 nt, Human
ucaccaacucagugcuauuaauucuccuucuc

SEQ ID NO: 494273 - RNA, 32 nt, Human
ucaccaacuuuuucuuccucauagaagcaaca

SEQ ID NO: 494274 - RNA, 19 nt, Human
ucaccaagaacaaagucug

SEQ ID NO: 494275 - RNA, 22 nt, Human
ucaccaagaagcaaguuucuga

SEQ ID NO: 494276 - RNA, 21 nt, Human
ucaccaagacgcccauccugg

SEQ ID NO: 494277 - RNA, 32 nt, Human
ucaccaagagaggcacgcucacccucacccuc

SEQ ID NO: 494278 - RNA, 32 nt, Human
ucaccaagcucugaacugggauuucauuuugu

SEQ ID NO: 494279 - RNA, 32 nt, Human
ucaccaaggaaaugcgaucaacucagaggaga

SEQ ID NO: 494280 - RNA, 32 nt, Human
ucaccaaggcuggagggcaauagcaugaucac

SEQ ID NO: 494281 - RNA, 32 nt, Human
ucaccaaggcuggagugcagcggugugaucuc

SEQ ID NO: 494282 - RNA, 32 nt, Human
ucaccaaggcuggagugcaggggcacaaucuc

SEQ ID NO: 494283 - RNA, 32 nt, Human
ucaccaaggcuggagugcauuggugcaaucuu

SEQ ID NO: 494284 - RNA, 32 nt, Human
ucaccaagggccuggcaccaggugcccagucu

SEQ ID NO: 494285 - RNA, 32 nt, Human
ucaccaaggucugcuuggacaaugggcuggcu

SEQ ID NO: 494286 - RNA, 22 nt, Human
ucaccaagucaccucccucuga

SEQ ID NO: 494287 - RNA, 32 nt, Human
ucaccaauuuggcuggucucgacuccuggcug

SEQ ID NO: 494288 - RNA, 32 nt, Human
ucaccacacaauacaaauacuugcuccagccg

SEQ ID NO: 494289 - RNA, 32 nt, Human
ucaccacaccuggcugauuuuguauuuuuagu

SEQ ID NO: 494290 - RNA, 32 nt, Human
ucaccacacuccuuaggaagugccaguggugg

SEQ ID NO: 494291 - RNA, 32 nt, Human
ucaccacagacuauaaggaaauggaauuauuu

SEQ ID NO: 494292 - RNA, 32 nt, Human
ucaccacagaggggucccuaagccacagacau

SEQ ID NO: 494293 - RNA, 32 nt, Human
ucaccacauacccucacuucccccuucccuac

SEQ ID NO: 494294 - RNA, 32 nt, Human
ucaccacaucugcuucccaccaugcuucuaag

SEQ ID NO: 494295 - RNA, 32 nt, Human
ucaccaccagaaccaacuccucuuucaaacac

SEQ ID NO: 494296 - RNA, 18 nt, Human
ucaccaccaugcccggcu

SEQ ID NO: 494297 - RNA, 32 nt, Human
ucaccacccaggaaaggggaaaugcggcccgc

SEQ ID NO: 494298 - RNA, 32 nt, Human
ucaccacccaguuuuucccucuggacccagga

SEQ ID NO: 494299 - RNA, 32 nt, Human
ucaccacccgcaccccugacccuccuggucca

SEQ ID NO: 494300 - RNA, 32 nt, Human
ucaccaccgcucauggugcgcgcgucucgggc

SEQ ID NO: 494301 - RNA, 32 nt, Human
ucaccaccggacauggugcuuggggcuuugug

SEQ ID NO: 494302 - RNA, 32 nt, Human
ucaccaccuccugcuguggguggagagccuug

SEQ ID NO: 494303 - RNA, 32 nt, Human
ucaccaccucuaauuucagcuucagcaguugc

SEQ ID NO: 494304 - RNA, 32 nt, Human
ucaccaccucugcaccugcugucuugagacuc

SEQ ID NO: 494305 - RNA, 32 nt, Human
ucaccaccuucccagcucucccucuggcccug

SEQ ID NO: 494306 - RNA, 32 nt, Human
ucaccaccuugaugcugugugccuccuuccug

SEQ ID NO: 494307 - RNA, 32 nt, Human
ucaccacgagaagccagucauaaagauaaagg

SEQ ID NO: 494308 - RNA, 32 nt, Human
ucaccacggacaggaagagcagcucuggcuau

SEQ ID NO: 494309 - RNA, 32 nt, Human
ucaccacgguaaacugggauguuuucaaaagu

SEQ ID NO: 494310 - RNA, 32 nt, Human
ucaccacguuagccaggauggucuccaucucc

SEQ ID NO: 494311 - RNA, 32 nt, Human
ucaccacguugcccaggcuggucuccagcucc

SEQ ID NO: 494312 - RNA, 32 nt, Human
ucaccacuacacuccagccugggugacagcaa

SEQ ID NO: 494313 - RNA, 32 nt, Human
ucaccacuagcguaaaagcaaaaagcuuuuac

SEQ ID NO: 494314 - RNA, 32 nt, Human
ucaccacucacugcggccucaaccuucagggc

SEQ ID NO: 494315 - RNA, 32 nt, Human
ucaccacuccugcaacaacaacaaauacggcu

SEQ ID NO: 494316 - RNA, 19 nt, Human
ucaccacucucuacuuuga

SEQ ID NO: 494317 - RNA, 32 nt, Human
ucaccacugaacuccagccugggcgacagagg

SEQ ID NO: 494318 - RNA, 32 nt, Human
ucaccacugcaacccagggucccagcuggcug

SEQ ID NO: 494319 - RNA, 32 nt, Human
ucaccacugcacuccagccugggcagcagagc

SEQ ID NO: 494320 - RNA, 32 nt, Human
ucaccacugcccuccagccugggugacagagc

SEQ ID NO: 494321 - RNA, 32 nt, Human
ucaccacuggccgccucuccuugccaggccug

SEQ ID NO: 494322 - RNA, 31 nt, Human
ucaccacuggccucugggcacuugugcugag

SEQ ID NO: 494323 - RNA, 32 nt, Human
ucaccacuguacuccagccugggugacagagc

SEQ ID NO: 494324 - RNA, 32 nt, Human
ucaccacugucccguggaugccuguguaccuc

SEQ ID NO: 494325 - RNA, 32 nt, Human
ucaccacuuaagauagaagcagcagcugcaua

SEQ ID NO: 494326 - RNA, 32 nt, Human
ucaccacuuggcugcuugagauugguucugcu

SEQ ID NO: 494327 - RNA, 32 nt, Human
ucaccagacaccucuugccucuguaccugguc

SEQ ID NO: 494328 - RNA, 32 nt, Human
ucaccagagacaccugccggcugacaaggaca

SEQ ID NO: 494329 - RNA, 32 nt, Human
ucaccagagauggaccagggaggacaggaugc

SEQ ID NO: 494330 - RNA, 32 nt, Human
ucaccagagccaaguccucucccuucagauca

SEQ ID NO: 494331 - RNA, 32 nt, Human
ucaccagaguccaaacaaaaagcuaagcuagg

SEQ ID NO: 494332 - RNA, 32 nt, Human
ucaccagauggaacuuaccuugcuguuggaug

SEQ ID NO: 494333 - RNA, 32 nt, Human
ucaccagcaaagugcacugaugugugagcucu

SEQ ID NO: 494334 - RNA, 32 nt, Human
ucaccagcaacaaaagagguuaucuuaccaua

SEQ ID NO: 494335 - RNA, 20 nt, Human
ucaccagcagacacacuggg

SEQ ID NO: 494336 - RNA, 21 nt, Human
ucaccagcagcuccccugagc

SEQ ID NO: 494337 - RNA, 32 nt, Human
ucaccagcagcugggccagcugugacacuguu

SEQ ID NO: 494338 - RNA, 32 nt, Human
ucaccagcccuccccuccccagggucauagag

SEQ ID NO: 494339 - RNA, 32 nt, Human
ucaccagcccugcacugaugucacuuuaugua

SEQ ID NO: 494340 - RNA, 32 nt, Human
ucaccagccgcuuacgggacccugccaugccu

SEQ ID NO: 494341 - RNA, 32 nt, Human
ucaccagccugggcuaagcuccugggcugugc

SEQ ID NO: 494342 - RNA, 32 nt, Human
ucaccagcuacugcagaggcauuuugcauuug

SEQ ID NO: 494343 - RNA, 32 nt, Human
ucaccagcuccaagccccagacagcaguucag

SEQ ID NO: 494344 - RNA, 21 nt, Human
ucaccagcucuccagccagga

SEQ ID NO: 494345 - RNA, 23 nt, Human
ucaccagcucugugaccuugggc

SEQ ID NO: 494346 - RNA, 32 nt, Human
ucaccagcucuucacaucccugggugaagaug

SEQ ID NO: 494347 - RNA, 32 nt, Human
ucaccaggaaugcgaggccacccuggaccaga

SEQ ID NO: 494348 - RNA, 32 nt, Human
ucaccaggacagucacccccaaacuugacccc

SEQ ID NO: 494349 - RNA, 18 nt, Human
ucaccaggacuccauucu

SEQ ID NO: 494350 - RNA, 31 nt, Human
ucaccaggacugccugggccuguguucauuc

SEQ ID NO: 494351 - RNA, 32 nt, Human
ucaccaggagcaaacccaagucuuaguugcua

SEQ ID NO: 494352 - RNA, 21 nt, Human
ucaccaggauggagugcagug

SEQ ID NO: 494353 - RNA, 32 nt, Human
ucaccaggcccaggagcuggcgccucagcaac

SEQ ID NO: 494354 - RNA, 32 nt, Human
ucaccaggccugguagaugagauggcuugucu

SEQ ID NO: 494355 - RNA, 32 nt, Human
ucaccaggcuccuccccacagcuguuggcauc

SEQ ID NO: 494356 - RNA, 32 nt, Human
ucaccaggcuucuucugccucccuugguaacc

SEQ ID NO: 494357 - RNA, 32 nt, Human
ucaccagggacguggcuuacaguuccagcagg

SEQ ID NO: 494358 - RNA, 32 nt, Human
ucaccagggccaagccacgaaggguuuuauaa

SEQ ID NO: 494359 - RNA, 32 nt, Human
ucaccagggcccuguccuggcugcccucaccc

SEQ ID NO: 494360 - RNA, 32 nt, Human
ucaccagggucugaggggcagcucuggccagu

SEQ ID NO: 494361 - RNA, 32 nt, Human
ucaccagguagaaaugcgauuugcucacugag

SEQ ID NO: 494362 - RNA, 32 nt, Human
ucaccaggugagcaaggcuggggaacaaugga

SEQ ID NO: 494363 - RNA, 32 nt, Human
ucaccagucggacugugcuguggcuaaccagg

SEQ ID NO: 494364 - RNA, 32 nt, Human
ucaccagugcacuccagccugggugacagagc

SEQ ID NO: 494365 - RNA, 31 nt, Human
ucaccaguguggagagaaaggugcuggcaua

SEQ ID NO: 494366 - RNA, 32 nt, Human
ucaccaguuagccuguggggcuguucacucuu

SEQ ID NO: 494367 - RNA, 32 nt, Human
ucaccauacugccugggcagguuuccaacucc

SEQ ID NO: 494368 - RNA, 32 nt, Human
ucaccauauuagccaggauggucuccaucucc

SEQ ID NO: 494369 - RNA, 32 nt, Human
ucaccaucaaagauuuuauugaguuuuucaua

SEQ ID NO: 494370 - RNA, 32 nt, Human
ucaccaucaagcaauccaugucauagggaaac

SEQ ID NO: 494371 - RNA, 32 nt, Human
ucaccaucacagugacugcaacaccauaaggc

SEQ ID NO: 494372 - RNA, 32 nt, Human
ucaccaucauuagcuuccuccugggucauuua

SEQ ID NO: 494373 - RNA, 32 nt, Human
ucaccauccagccugaugcauccugggaggga

SEQ ID NO: 494374 - RNA, 32 nt, Human
ucaccauccaucugccccacgcuccaagccug

SEQ ID NO: 494375 - RNA, 32 nt, Human
ucaccauccuccugggggagcagggggugggu

SEQ ID NO: 494376 - RNA, 32 nt, Human
ucaccauccuuuauaccaggauuugcauaucc

SEQ ID NO: 494377 - RNA, 32 nt, Human
ucaccaucuccaagccugucaacaucacugca

SEQ ID NO: 494378 - RNA, 32 nt, Human
ucaccaucugaugccauguacccacuucagaa

SEQ ID NO: 494379 - RNA, 32 nt, Human
ucaccaugaaagucaccuaggccaggcauggu

SEQ ID NO: 494380 - RNA, 32 nt, Human
ucaccaugaagcgaaacacagagaagcggauu

SEQ ID NO: 494381 - RNA, 32 nt, Human
ucaccaugaagcuuccucucgggccgacagcu

SEQ ID NO: 494382 - RNA, 32 nt, Human
ucaccaugaggacacuuaucucuuucaguggu

SEQ ID NO: 494383 - RNA, 32 nt, Human
ucaccaugagguuugccuuuguggaaaacucg

SEQ ID NO: 494384 - RNA, 32 nt, Human
ucaccaugauagccaggauggucuugaucucc

SEQ ID NO: 494385 - RNA, 30 nt, Human
ucaccaugccaaucaaaccuguugggugga

SEQ ID NO: 494386 - RNA, 32 nt, Human
ucaccaugcccuuccugcauccuucccccaac

SEQ ID NO: 494387 - RNA, 32 nt, Human
ucaccaugccuggcuaauuuuguauuuuuagu

SEQ ID NO: 494388 - RNA, 32 nt, Human
ucaccaugcuucccuaccccagccuguuucuu

SEQ ID NO: 494389 - RNA, 30 nt, Human
ucaccauggacuuccagcaucgccccgggg

SEQ ID NO: 494390 - RNA, 30 nt, Human
ucaccauggccaagggcuucuauauuucca

SEQ ID NO: 494391 - RNA, 20 nt, Human
ucaccauguaacacacaaua

SEQ ID NO: 494392 - RNA, 32 nt, Human
ucaccauguaacacacaauacaugcaugcacu

SEQ ID NO: 494393 - RNA, 32 nt, Human
ucaccauguaacacacaauacaugcaugcauu

SEQ ID NO: 494394 - RNA, 32 nt, Human
ucaccauguaggccaggauggucucgaacucu

SEQ ID NO: 494395 - RNA, 32 nt, Human
ucaccaugucagccaggauggucuugaucucc

SEQ ID NO: 494396 - RNA, 32 nt, Human
ucaccaugucggccaggcuggucuccaacuac

SEQ ID NO: 494397 - RNA, 32 nt, Human
ucaccaugucucaaacuccugaccucaggcga

SEQ ID NO: 494398 - RNA, 32 nt, Human
ucaccaugucucccccacccugccucaguucu

SEQ ID NO: 494399 - RNA, 32 nt, Human
ucaccaugugagccaggauggucucaaucucc

SEQ ID NO: 494400 - RNA, 32 nt, Human
ucaccauguggggcuguacuacgugguggucu

SEQ ID NO: 494401 - RNA, 32 nt, Human
ucaccaugugggguucagcugagguuguagcc

SEQ ID NO: 494402 - RNA, 32 nt, Human
ucaccauguuaaccaggauggucucgaucucu

SEQ ID NO: 494403 - RNA, 32 nt, Human
ucaccauguuagccaggauggucucaaacucc

SEQ ID NO: 494404 - RNA, 32 nt, Human
ucaccauguuagccaggauggucucaaucucc

SEQ ID NO: 494405 - RNA, 32 nt, Human
ucaccauguuagccaggauggucuccaucucc

SEQ ID NO: 494406 - RNA, 32 nt, Human
ucaccauguuagccaggauggucucgaucucc

SEQ ID NO: 494407 - RNA, 32 nt, Human
ucaccauguuagccaggauggucucgaugauc

SEQ ID NO: 494408 - RNA, 32 nt, Human
ucaccauguuagccaggauggucucgcucucc

SEQ ID NO: 494409 - RNA, 32 nt, Human
ucaccauguuagccaggauggucuggaucucc

SEQ ID NO: 494410 - RNA, 32 nt, Human
ucaccauguuagccaggauggucuugaucuga

SEQ ID NO: 494411 - RNA, 32 nt, Human
ucaccauguuagccaggaugguuucgaucucc

SEQ ID NO: 494412 - RNA, 32 nt, Human
ucaccauguuauauuuucuuuuaagacauuaa

SEQ ID NO: 494413 - RNA, 32 nt, Human
ucaccauguugaccaggauggucucaaucucc

SEQ ID NO: 494414 - RNA, 32 nt, Human
ucaccauguugaccaggauggucucaaucucu

SEQ ID NO: 494415 - RNA, 32 nt, Human
ucaccauguuggccaggauggucucaaacuug

SEQ ID NO: 494416 - RNA, 32 nt, Human
ucaccauguuggccaggauggucucaaucucc

SEQ ID NO: 494417 - RNA, 32 nt, Human
ucaccauguuggccaggauggucucaaucucu

SEQ ID NO: 494418 - RNA, 32 nt, Human
ucaccauguuggccaggauggucuccgucucc

SEQ ID NO: 494419 - RNA, 32 nt, Human
ucaccauguuggccaggauggucucgaacucc

SEQ ID NO: 494420 - RNA, 32 nt, Human
ucaccauguuggccaggauggucucgagucuc

SEQ ID NO: 494421 - RNA, 32 nt, Human
ucaccauguuggccaggauggucucgaucucc

SEQ ID NO: 494422 - RNA, 32 nt, Human
ucaccauguuggccaggauggucucgaucucu

SEQ ID NO: 494423 - RNA, 32 nt, Human
ucaccauguuggccaggauggucucgcccucc

SEQ ID NO: 494424 - RNA, 32 nt, Human
ucaccauguuggccaggauggucucggucucc

SEQ ID NO: 494425 - RNA, 32 nt, Human
ucaccauguuggccaggauggucuggaucucu

SEQ ID NO: 494426 - RNA, 32 nt, Human
ucaccauguuggccaggauggucuugaucucc

SEQ ID NO: 494427 - RNA, 32 nt, Human
ucaccauguuggccaggcuggucuccaacucc

SEQ ID NO: 494428 - RNA, 32 nt, Human
ucaccauguuggccaggcuggucuccaucacc

SEQ ID NO: 494429 - RNA, 32 nt, Human
ucaccauguuggccaggcuggucuccaucucc

SEQ ID NO: 494430 - RNA, 32 nt, Human
ucaccauguuguccaggauggucuugaucucc

SEQ ID NO: 494431 - RNA, 32 nt, Human
ucaccauuacacuccagccugggcgacaagaa

SEQ ID NO: 494432 - RNA, 32 nt, Human
ucaccauuacacuccagccugggcgacaagag

SEQ ID NO: 494433 - RNA, 32 nt, Human
ucaccauucccaagccccuggccacucuaagc

SEQ ID NO: 494434 - RNA, 32 nt, Human
ucaccauugcacuccagccuggaugacagaga

SEQ ID NO: 494435 - RNA, 32 nt, Human
ucaccauugcacuccagccuggaugacagagu

SEQ ID NO: 494436 - RNA, 32 nt, Human
ucaccauugcacuccagccugggcgacugagc

SEQ ID NO: 494437 - RNA, 32 nt, Human
ucaccauugucaacauuuugaccaacagcagg

SEQ ID NO: 494438 - RNA, 32 nt, Human
ucaccauugucugcacaaauccuugaaaauaa

SEQ ID NO: 494439 - RNA, 32 nt, Human
ucaccauuuugguagaugagguugucugguga

SEQ ID NO: 494440 - RNA, 32 nt, Human
ucaccauuuuuccugcugcacugaccaaucag

SEQ ID NO: 494441 - RNA, 32 nt, Human
ucaccauuuuuguccuguaucuguaaacacuu

SEQ ID NO: 494442 - RNA, 32 nt, Human
ucacccaaagcaguggccaacaucgcggaccc

SEQ ID NO: 494443 - RNA, 32 nt, Human
ucacccaacaccacucagguugucuucucaac

SEQ ID NO: 494444 - RNA, 21 nt, Human
ucacccaagccagagugcagu

SEQ ID NO: 494445 - RNA, 22 nt, Human
ucacccaagccagagugcagug

SEQ ID NO: 494446 - RNA, 23 nt, Human
ucacccaagccagagugcagugg

SEQ ID NO: 494447 - RNA, 32 nt, Human
ucacccaagcuggaaugcaauggcacaauuuc

SEQ ID NO: 494448 - RNA, 32 nt, Human
ucacccaagcuggaguacaguggcacaaacau

SEQ ID NO: 494449 - RNA, 22 nt, Human
ucacccaagcuggagugcagug

SEQ ID NO: 494450 - RNA, 32 nt, Human
ucacccaagcuggagugcaguggugcaaacac

SEQ ID NO: 494451 - RNA, 32 nt, Human
ucacccaagcuggagugcaguggugcaaucuu

SEQ ID NO: 494452 - RNA, 32 nt, Human
ucacccaagcuggugugcaguggugugaucuu

SEQ ID NO: 494453 - RNA, 32 nt, Human
ucacccaaguuggagugcaguggccccgcaau

SEQ ID NO: 494454 - RNA, 32 nt, Human
ucacccaauguucacaucugcacucaaggucg

SEQ ID NO: 494455 - RNA, 32 nt, Human
ucacccacaaaacaauguaaucccagcgaugg

SEQ ID NO: 494456 - RNA, 32 nt, Human
ucacccacaacccucuggaaguggccuugccc

SEQ ID NO: 494457 - RNA, 32 nt, Human
ucacccacagccagggcagguucccgaggcug

SEQ ID NO: 494458 - RNA, 32 nt, Human
ucacccaccagcuguaacucaguuugugugag

SEQ ID NO: 494459 - RNA, 32 nt, Human
ucacccacccaccuccuucauuaucagcaaua

SEQ ID NO: 494460 - RNA, 32 nt, Human
ucacccaccugugccgcccugccuuguuaccu

SEQ ID NO: 494461 - RNA, 32 nt, Human
ucacccacgaggcuggguggccagcagucugg

SEQ ID NO: 494462 - RNA, 32 nt, Human
ucacccacgcuggagugcaaugguguggucuu

SEQ ID NO: 494463 - RNA, 32 nt, Human
ucacccacgcuggagugcugugaugcgaucuc

SEQ ID NO: 494464 - RNA, 20 nt, Human
ucacccacucauucauuaca

SEQ ID NO: 494465 - RNA, 32 nt, Human
ucacccagacacacaccccagcaccuggcacu

SEQ ID NO: 494466 - RNA, 22 nt, Human
ucacccagacuagagugcagug

SEQ ID NO: 494467 - RNA, 22 nt, Human
ucacccagacuggaaugcagug

SEQ ID NO: 494468 - RNA, 22 nt, Human
ucacccagacuggaguacaaug

SEQ ID NO: 494469 - RNA, 32 nt, Human
ucacccagacuggagugcaauggcuugaucuu

SEQ ID NO: 494470 - RNA, 22 nt, Human
ucacccagacuggagugcagug

SEQ ID NO: 494471 - RNA, 32 nt, Human
ucacccagacuggagugcaguggcacaaucuc

SEQ ID NO: 494472 - RNA, 32 nt, Human
ucacccagacuggagugcaguggcgcgaucuc

SEQ ID NO: 494473 - RNA, 32 nt, Human
ucacccagacuggagugcaguggugcgaucuc

SEQ ID NO: 494474 - RNA, 32 nt, Human
ucacccagacuggagugcaguggugugaucau

SEQ ID NO: 494475 - RNA, 21 nt, Human
ucacccagacuggcgugcagu

SEQ ID NO: 494476 - RNA, 22 nt, Human
ucacccagacuggcgugcagug

SEQ ID NO: 494477 - RNA, 23 nt, Human
ucacccagacuggcgugcagugg

SEQ ID NO: 494478 - RNA, 32 nt, Human
ucacccagagucagggagagaugaaaauaaua

SEQ ID NO: 494479 - RNA, 21 nt, Human
ucacccagccauggugugguc

SEQ ID NO: 494480 - RNA, 32 nt, Human
ucacccagccccggaagauaggggcaagcagc

SEQ ID NO: 494481 - RNA, 32 nt, Human
ucacccagcuacucaggaggcugaggcaggag

SEQ ID NO: 494482 - RNA, 32 nt, Human
ucacccagcucuggaacugccugcuucacauu

SEQ ID NO: 494483 - RNA, 32 nt, Human
ucacccaggacagccuguggccuuugugagcc

SEQ ID NO: 494484 - RNA, 32 nt, Human
ucacccaggagcaggcucccaagugaagaaac

SEQ ID NO: 494485 - RNA, 32 nt, Human
ucacccaggauggagugcaguguugugaucau

SEQ ID NO: 494486 - RNA, 32 nt, Human
ucacccaggcaggagugcaguggcacagucau

SEQ ID NO: 494487 - RNA, 32 nt, Human
ucacccaggcaggagugcaguggcguuaucuu

SEQ ID NO: 494488 - RNA, 21 nt, Human
ucacccaggccagaguguagu

SEQ ID NO: 494489 - RNA, 22 nt, Human
ucacccaggccagaguguagug

SEQ ID NO: 494490 - RNA, 23 nt, Human
ucacccaggccagaguguagugg

SEQ ID NO: 494491 - RNA, 22 nt, Human
ucacccaggccggagugcagug

SEQ ID NO: 494492 - RNA, 32 nt, Human
ucacccaggccggagugcaguggcacaaucaa

SEQ ID NO: 494493 - RNA, 32 nt, Human
ucacccaggccggagugcaguggugcgauccc

SEQ ID NO: 494494 - RNA, 32 nt, Human
ucacccaggccggagugcagugguguaaucuc

SEQ ID NO: 494495 - RNA, 32 nt, Human
ucacccaggcgggaguggugcaauggcuugau

SEQ ID NO: 494496 - RNA, 32 nt, Human
ucacccaggcgggaguuagguggcaugauuuc

SEQ ID NO: 494497 - RNA, 22 nt, Human
ucacccaggcuagaaugcagug

SEQ ID NO: 494498 - RNA, 22 nt, Human
ucacccaggcuagaguacagug

SEQ ID NO: 494499 - RNA, 22 nt, Human
ucacccaggcuagagugcaaug

SEQ ID NO: 494500 - RNA, 21 nt, Human
ucacccaggcuagagugcagu

SEQ ID NO: 494501 - RNA, 32 nt, Human
ucacccaggcuagagugcaguagcacgaucuu

SEQ ID NO: 494502 - RNA, 22 nt, Human
ucacccaggcuagagugcagug

SEQ ID NO: 494503 - RNA, 32 nt, Human
ucacccaggcuagagugcaguggagcgaucuc

SEQ ID NO: 494504 - RNA, 32 nt, Human
ucacccaggcuagagugcaguggcacaaaaau

SEQ ID NO: 494505 - RNA, 32 nt, Human
ucacccaggcuagagugcaguggcgcgaucuc

SEQ ID NO: 494506 - RNA, 32 nt, Human
ucacccaggcuagagugcaguggcgugaucuu

SEQ ID NO: 494507 - RNA, 32 nt, Human
ucacccaggcuagagugcaguggugcaaucuc

SEQ ID NO: 494508 - RNA, 32 nt, Human
ucacccaggcugaacugcaguggugugaucua

SEQ ID NO: 494509 - RNA, 32 nt, Human
ucacccaggcugaagugcaguagugcaaucuc

SEQ ID NO: 494510 - RNA, 22 nt, Human
ucacccaggcugaagugcagug

SEQ ID NO: 494511 - RNA, 32 nt, Human
ucacccaggcugaagugcaguggagcaaucuc

SEQ ID NO: 494512 - RNA, 32 nt, Human
ucacccaggcugaagugcagugguacaaucuu

SEQ ID NO: 494513 - RNA, 32 nt, Human
ucacccaggcugaagugcagugguacgaucau

SEQ ID NO: 494514 - RNA, 32 nt, Human
ucacccaggcugcagugcaauggcgcgaucuc

SEQ ID NO: 494515 - RNA, 22 nt, Human
ucacccaggcugcagugccaug

SEQ ID NO: 494516 - RNA, 32 nt, Human
ucacccaggcugcagugccaugcagacaccuc

SEQ ID NO: 494517 - RNA, 32 nt, Human
ucacccaggcugcaguguaguggugcaaacau

SEQ ID NO: 494518 - RNA, 32 nt, Human
ucacccaggcugcuggaguacaguggcacaau

SEQ ID NO: 494519 - RNA, 32 nt, Human
ucacccaggcuggaaugacgaagugaaguagu

SEQ ID NO: 494520 - RNA, 21 nt, Human
ucacccaggcuggaaugcagu

SEQ ID NO: 494521 - RNA, 22 nt, Human
ucacccaggcuggaaugcagug

SEQ ID NO: 494522 - RNA, 32 nt, Human
ucacccaggcuggaaugcagugcaguggcaca

SEQ ID NO: 494523 - RNA, 23 nt, Human
ucacccaggcuggaaugcagugg

SEQ ID NO: 494524 - RNA, 32 nt, Human
ucacccaggcuggaaugcaguggcacaauguc

SEQ ID NO: 494525 - RNA, 32 nt, Human
ucacccaggcuggaaugcaguggcacaauuuu

SEQ ID NO: 494526 - RNA, 32 nt, Human
ucacccaggcuggaaugcaguggcgugaucuc

SEQ ID NO: 494527 - RNA, 32 nt, Human
ucacccaggcuggaaugcaguggugugaacug

SEQ ID NO: 494528 - RNA, 32 nt, Human
ucacccaggcuggaaugcaguggugugaucuu

SEQ ID NO: 494529 - RNA, 32 nt, Human
ucacccaggcuggacugcaaugacgcgaucuu

SEQ ID NO: 494530 - RNA, 32 nt, Human
ucacccaggcuggagagcaauugcacaaacac

SEQ ID NO: 494531 - RNA, 22 nt, Human
ucacccaggcuggagcacacug

SEQ ID NO: 494532 - RNA, 32 nt, Human
ucacccaggcuggagcacacuggugcgaucau

SEQ ID NO: 494533 - RNA, 22 nt, Human
ucacccaggcuggagcgcagug

SEQ ID NO: 494534 - RNA, 32 nt, Human
ucacccaggcuggagcgcaguggugugaucuc

SEQ ID NO: 494535 - RNA, 32 nt, Human
ucacccaggcuggagcguaauggcacaaucuu

SEQ ID NO: 494536 - RNA, 21 nt, Human
ucacccaggcuggaguacaau

SEQ ID NO: 494537 - RNA, 22 nt, Human
ucacccaggcuggaguacaaug

SEQ ID NO: 494538 - RNA, 32 nt, Human
ucacccaggcuggaguacaaugaugcgaucuc

SEQ ID NO: 494539 - RNA, 32 nt, Human
ucacccaggcuggaguacaauggcgugaucuc

SEQ ID NO: 494540 - RNA, 22 nt, Human
ucacccaggcuggaguacacug

SEQ ID NO: 494541 - RNA, 21 nt, Human
ucacccaggcuggaguacagu

SEQ ID NO: 494542 - RNA, 22 nt, Human
ucacccaggcuggaguacagug

SEQ ID NO: 494543 - RNA, 23 nt, Human
ucacccaggcuggaguacagugg

SEQ ID NO: 494544 - RNA, 32 nt, Human
ucacccaggcuggaguacaguggcgugaucac

SEQ ID NO: 494545 - RNA, 32 nt, Human
ucacccaggcuggaguacaguggcgugauuuu

SEQ ID NO: 494546 - RNA, 32 nt, Human
ucacccaggcuggaguaccgguggugggaucu

SEQ ID NO: 494547 - RNA, 22 nt, Human
ucacccaggcuggaguagagug

SEQ ID NO: 494548 - RNA, 22 nt, Human
ucacccaggcuggaguauagug

SEQ ID NO: 494549 - RNA, 32 nt, Human
ucacccaggcuggaguauaguggcacaaacau

SEQ ID NO: 494550 - RNA, 32 nt, Human
ucacccaggcuggaguauaguggugugaucuu

SEQ ID NO: 494551 - RNA, 32 nt, Human
ucacccaggcuggaguccaauggggcggucau

SEQ ID NO: 494552 - RNA, 21 nt, Human
ucacccaggcuggaguccagu

SEQ ID NO: 494553 - RNA, 22 nt, Human
ucacccaggcuggaguccagug

SEQ ID NO: 494554 - RNA, 23 nt, Human
ucacccaggcuggaguccagugg

SEQ ID NO: 494555 - RNA, 32 nt, Human
ucacccaggcuggaguccaguggcacaaucuu

SEQ ID NO: 494556 - RNA, 32 nt, Human
ucacccaggcuggaguccaguggugugaucau

SEQ ID NO: 494557 - RNA, 32 nt, Human
ucacccaggcuggagucuagugucgugaucuu

SEQ ID NO: 494558 - RNA, 32 nt, Human
ucacccaggcuggagugaggugguacaaucuc

SEQ ID NO: 494559 - RNA, 19 nt, Human
ucacccaggcuggagugca

SEQ ID NO: 494560 - RNA, 32 nt, Human
ucacccaggcuggagugcaaaggugcaaucau

SEQ ID NO: 494561 - RNA, 21 nt, Human
ucacccaggcuggagugcaau

SEQ ID NO: 494562 - RNA, 22 nt, Human
ucacccaggcuggagugcaaug

SEQ ID NO: 494563 - RNA, 32 nt, Human
ucacccaggcuggagugcaaugacgcaaucuc

SEQ ID NO: 494564 - RNA, 32 nt, Human
ucacccaggcuggagugcaaugcugcgaucuc

SEQ ID NO: 494565 - RNA, 32 nt, Human
ucacccaggcuggagugcaauggcacaaucuc

SEQ ID NO: 494566 - RNA, 32 nt, Human
ucacccaggcuggagugcaauggcacgaucuc

SEQ ID NO: 494567 - RNA, 32 nt, Human
ucacccaggcuggagugcaauggcacgaucuu

SEQ ID NO: 494568 - RNA, 32 nt, Human
ucacccaggcuggagugcaauggcauguucau

SEQ ID NO: 494569 - RNA, 32 nt, Human
ucacccaggcuggagugcaauggcgcaaucau

SEQ ID NO: 494570 - RNA, 32 nt, Human
ucacccaggcuggagugcaauggcgcgaucuc

SEQ ID NO: 494571 - RNA, 32 nt, Human
ucacccaggcuggagugcaauggcgcgaucuu

SEQ ID NO: 494572 - RNA, 32 nt, Human
ucacccaggcuggagugcaauggcgugaccuc

SEQ ID NO: 494573 - RNA, 32 nt, Human
ucacccaggcuggagugcaauggcgugaucuc

SEQ ID NO: 494574 - RNA, 32 nt, Human
ucacccaggcuggagugcaaugggcacaauua

SEQ ID NO: 494575 - RNA, 32 nt, Human
ucacccaggcuggagugcaauggugagaucuc

SEQ ID NO: 494576 - RNA, 32 nt, Human
ucacccaggcuggagugcaauggugcaaucuc

SEQ ID NO: 494577 - RNA, 32 nt, Human
ucacccaggcuggagugcaauggugcaauuuc

SEQ ID NO: 494578 - RNA, 32 nt, Human
ucacccaggcuggagugcaauggugccaucuu

SEQ ID NO: 494579 - RNA, 32 nt, Human
ucacccaggcuggagugcaauggugcgaucuc

SEQ ID NO: 494580 - RNA, 32 nt, Human
ucacccaggcuggagugcaaugguguguuguc

SEQ ID NO: 494581 - RNA, 32 nt, Human
ucacccaggcuggagugcaauugugcaaucuc

SEQ ID NO: 494582 - RNA, 22 nt, Human
ucacccaggcuggagugcacug

SEQ ID NO: 494583 - RNA, 20 nt, Human
ucacccaggcuggagugcag

SEQ ID NO: 494584 - RNA, 32 nt, Human
ucacccaggcuggagugcagcaguugaucaga

SEQ ID NO: 494585 - RNA, 32 nt, Human
ucacccaggcuggagugcagcaguugcucaga

SEQ ID NO: 494586 - RNA, 21 nt, Human
ucacccaggcuggagugcagu

SEQ ID NO: 494587 - RNA, 32 nt, Human
ucacccaggcuggagugcaguagcacgauagc

SEQ ID NO: 494588 - RNA, 32 nt, Human
ucacccaggcuggagugcaguagcaugaucag

SEQ ID NO: 494589 - RNA, 32 nt, Human
ucacccaggcuggagugcaguagcaugaucga

SEQ ID NO: 494590 - RNA, 32 nt, Human
ucacccaggcuggagugcaguagcgcgaucuc

SEQ ID NO: 494591 - RNA, 32 nt, Human
ucacccaggcuggagugcaguagugcaaucag

SEQ ID NO: 494592 - RNA, 32 nt, Human
ucacccaggcuggagugcaguagugcgaucuc

SEQ ID NO: 494593 - RNA, 22 nt, Human
ucacccaggcuggagugcagug

SEQ ID NO: 494594 - RNA, 32 nt, Human
ucacccaggcuggagugcagugcacaaucucg

SEQ ID NO: 494595 - RNA, 32 nt, Human
ucacccaggcuggagugcagugcugcgaucac

SEQ ID NO: 494596 - RNA, 32 nt, Human
ucacccaggcuggagugcagugcugugauauu

SEQ ID NO: 494597 - RNA, 32 nt, Human
ucacccaggcuggagugcagugcugugaucuu

SEQ ID NO: 494598 - RNA, 23 nt, Human
ucacccaggcuggagugcagugg

SEQ ID NO: 494599 - RNA, 32 nt, Human
ucacccaggcuggagugcaguggagcaaucuc

SEQ ID NO: 494600 - RNA, 32 nt, Human
ucacccaggcuggagugcaguggcacaaccuu

SEQ ID NO: 494601 - RNA, 32 nt, Human
ucacccaggcuggagugcaguggcacaaucac

SEQ ID NO: 494602 - RNA, 32 nt, Human
ucacccaggcuggagugcaguggcacaaucau

SEQ ID NO: 494603 - RNA, 32 nt, Human
ucacccaggcuggagugcaguggcacaaucuc

SEQ ID NO: 494604 - RNA, 32 nt, Human
ucacccaggcuggagugcaguggcacaaucuu

SEQ ID NO: 494605 - RNA, 32 nt, Human
ucacccaggcuggagugcaguggcccaaucuc

SEQ ID NO: 494606 - RNA, 32 nt, Human
ucacccaggcuggagugcaguggcgcaaucac

SEQ ID NO: 494607 - RNA, 32 nt, Human
ucacccaggcuggagugcaguggcgcaaucuc

SEQ ID NO: 494608 - RNA, 32 nt, Human
ucacccaggcuggagugcaguggcgcaaucuu

SEQ ID NO: 494609 - RNA, 32 nt, Human
ucacccaggcuggagugcaguggcgccaucuc

SEQ ID NO: 494610 - RNA, 32 nt, Human
ucacccaggcuggagugcaguggcgccaucuu

SEQ ID NO: 494611 - RNA, 32 nt, Human
ucacccaggcuggagugcaguggcgcgaucuc

SEQ ID NO: 494612 - RNA, 32 nt, Human
ucacccaggcuggagugcaguggcgcgaucuu

SEQ ID NO: 494613 - RNA, 32 nt, Human
ucacccaggcuggagugcaguggcgcgauguc

SEQ ID NO: 494614 - RNA, 32 nt, Human
ucacccaggcuggagugcaguggcgugauccc

SEQ ID NO: 494615 - RNA, 32 nt, Human
ucacccaggcuggagugcaguggcgugaucuc

SEQ ID NO: 494616 - RNA, 32 nt, Human
ucacccaggcuggagugcaguggcgugaucug

SEQ ID NO: 494617 - RNA, 32 nt, Human
ucacccaggcuggagugcaguggcgugaucuu

SEQ ID NO: 494618 - RNA, 32 nt, Human
ucacccaggcuggagugcaguggcgugauuuu

SEQ ID NO: 494619 - RNA, 32 nt, Human
ucacccaggcuggagugcaguggcucaauuuu

SEQ ID NO: 494620 - RNA, 32 nt, Human
ucacccaggcuggagugcaguggggcaaucuu

SEQ ID NO: 494621 - RNA, 32 nt, Human
ucacccaggcuggagugcagugguacaaucau

SEQ ID NO: 494622 - RNA, 32 nt, Human
ucacccaggcuggagugcagugguacagucuc

SEQ ID NO: 494623 - RNA, 32 nt, Human
ucacccaggcuggagugcagugguaugaccau

SEQ ID NO: 494624 - RNA, 32 nt, Human
ucacccaggcuggagugcagugguaugaucuu

SEQ ID NO: 494625 - RNA, 32 nt, Human
ucacccaggcuggagugcaguggugacagauc

SEQ ID NO: 494626 - RNA, 32 nt, Human
ucacccaggcuggagugcaguggugagauuuu

SEQ ID NO: 494627 - RNA, 32 nt, Human
ucacccaggcuggagugcaguggugcaaucac

SEQ ID NO: 494628 - RNA, 32 nt, Human
ucacccaggcuggagugcaguggugcaaucau

SEQ ID NO: 494629 - RNA, 32 nt, Human
ucacccaggcuggagugcaguggugcaaucgc

SEQ ID NO: 494630 - RNA, 32 nt, Human
ucacccaggcuggagugcaguggugcaaucuc

SEQ ID NO: 494631 - RNA, 32 nt, Human
ucacccaggcuggagugcaguggugcaaucuu

SEQ ID NO: 494632 - RNA, 32 nt, Human
ucacccaggcuggagugcaguggugcagucau

SEQ ID NO: 494633 - RNA, 32 nt, Human
ucacccaggcuggagugcaguggugcgaccuc

SEQ ID NO: 494634 - RNA, 32 nt, Human
ucacccaggcuggagugcaguggugcgagcuc

SEQ ID NO: 494635 - RNA, 32 nt, Human
ucacccaggcuggagugcaguggugcgaucuc

SEQ ID NO: 494636 - RNA, 32 nt, Human
ucacccaggcuggagugcaguggugcgaucug

SEQ ID NO: 494637 - RNA, 32 nt, Human
ucacccaggcuggagugcaguggugcgaucuu

SEQ ID NO: 494638 - RNA, 32 nt, Human
ucacccaggcuggagugcaguggugugaacag

SEQ ID NO: 494639 - RNA, 32 nt, Human
ucacccaggcuggagugcaguggugugacggc

SEQ ID NO: 494640 - RNA, 32 nt, Human
ucacccaggcuggagugcaguggugugagcuc

SEQ ID NO: 494641 - RNA, 32 nt, Human
ucacccaggcuggagugcaguggugugaucac

SEQ ID NO: 494642 - RNA, 32 nt, Human
ucacccaggcuggagugcaguggugugaucau

SEQ ID NO: 494643 - RNA, 32 nt, Human
ucacccaggcuggagugcaguggugugaucuc

SEQ ID NO: 494644 - RNA, 32 nt, Human
ucacccaggcuggagugcaguggugugaucuu

SEQ ID NO: 494645 - RNA, 32 nt, Human
ucacccaggcuggagugcaguggugugauuuc

SEQ ID NO: 494646 - RNA, 32 nt, Human
ucacccaggcuggagugcagugucgugaucaa

SEQ ID NO: 494647 - RNA, 32 nt, Human
ucacccaggcuggagugcaguguggcuggagg

SEQ ID NO: 494648 - RNA, 32 nt, Human
ucacccaggcuggagugcaguguugcaguccg

SEQ ID NO: 494649 - RNA, 32 nt, Human
ucacccaggcuggagugccauagugugaucuc

SEQ ID NO: 494650 - RNA, 32 nt, Human
ucacccaggcuggagugcgauggcgcgaucuu

SEQ ID NO: 494651 - RNA, 32 nt, Human
ucacccaggcuggagugcgguggcgcaaucuc

SEQ ID NO: 494652 - RNA, 32 nt, Human
ucacccaggcuggagugcgguggcgcaaucuu

SEQ ID NO: 494653 - RNA, 32 nt, Human
ucacccaggcuggagugcgguggugcaaucuu

SEQ ID NO: 494654 - RNA, 21 nt, Human
ucacccaggcuggagugcugu

SEQ ID NO: 494655 - RNA, 32 nt, Human
ucacccaggcuggagugcuguggugcaaucuc

SEQ ID NO: 494656 - RNA, 32 nt, Human
ucacccaggcuggagugcuguggugugauuuu

SEQ ID NO: 494657 - RNA, 32 nt, Human
ucacccaggcuggagugcugugguguuaccuc

SEQ ID NO: 494658 - RNA, 21 nt, Human
ucacccaggcuggaguggagu

SEQ ID NO: 494659 - RNA, 22 nt, Human
ucacccaggcuggaguggagug

SEQ ID NO: 494660 - RNA, 23 nt, Human
ucacccaggcuggaguggagugg

SEQ ID NO: 494661 - RNA, 32 nt, Human
ucacccaggcuggaguggaguggcgcuauccc

SEQ ID NO: 494662 - RNA, 32 nt, Human
ucacccaggcuggaguggagugguaugaucuu

SEQ ID NO: 494663 - RNA, 20 nt, Human
ucacccaggcuggaguguaa

SEQ ID NO: 494664 - RNA, 32 nt, Human
ucacccaggcuggaguguaagugacaugauca

SEQ ID NO: 494665 - RNA, 22 nt, Human
ucacccaggcuggaguguagug

SEQ ID NO: 494666 - RNA, 32 nt, Human
ucacccaggcuggaguguaguggcgcaaucuc

SEQ ID NO: 494667 - RNA, 32 nt, Human
ucacccaggcuggaguguaguggugcaauccu

SEQ ID NO: 494668 - RNA, 32 nt, Human
ucacccaggcuggaguguaguggugcagucuu

SEQ ID NO: 494669 - RNA, 32 nt, Human
ucacccaggcuggaguguagugguguaaucuc

SEQ ID NO: 494670 - RNA, 32 nt, Human
ucacccaggcuggaguguaguggugugauccu

SEQ ID NO: 494671 - RNA, 32 nt, Human
ucacccaggcuggagugugcaguggcgcggug

SEQ ID NO: 494672 - RNA, 32 nt, Human
ucacccaggcuggaguuauagugacgugaucc

SEQ ID NO: 494673 - RNA, 32 nt, Human
ucacccaggcuggaguucaguggugcgaccuc

SEQ ID NO: 494674 - RNA, 16 nt, Human
ucacccaggcuggcag

SEQ ID NO: 494675 - RNA, 23 nt, Human
ucacccaggcuggcagaucaugg

SEQ ID NO: 494676 - RNA, 32 nt, Human
ucacccaggcuggcgugcaauaguucaaucuc

SEQ ID NO: 494677 - RNA, 22 nt, Human
ucacccaggcuggcgugcaaug

SEQ ID NO: 494678 - RNA, 32 nt, Human
ucacccaggcuggcgugcaauggcgcaguuga

SEQ ID NO: 494679 - RNA, 32 nt, Human
ucacccaggcugggaauugcaguggcacaauc

SEQ ID NO: 494680 - RNA, 20 nt, Human
ucacccaggcuggggugcag

SEQ ID NO: 494681 - RNA, 32 nt, Human
ucacccaggcuggggugcaguggcgcgaucuu

SEQ ID NO: 494682 - RNA, 32 nt, Human
ucacccaggcuggggugcaguggcgugaucuu

SEQ ID NO: 494683 - RNA, 32 nt, Human
ucacccaggcuggugugcaggggugcggucau

SEQ ID NO: 494684 - RNA, 32 nt, Human
ucacccaggcuguaguacaguggugccaucuc

SEQ ID NO: 494685 - RNA, 32 nt, Human
ucacccaggcuugagugcaguggugcgaucac

SEQ ID NO: 494686 - RNA, 32 nt, Human
ucacccagggccugaccccagaguggucccaa

SEQ ID NO: 494687 - RNA, 18 nt, Human
ucacccaggugcucaguc

SEQ ID NO: 494688 - RNA, 32 nt, Human
ucacccagguggcuggaguacaguggccugau

SEQ ID NO: 494689 - RNA, 32 nt, Human
ucacccagguucgaguucaguggugccaucuc

SEQ ID NO: 494690 - RNA, 32 nt, Human
ucacccagguuggagcacaguggugcaaucau

SEQ ID NO: 494691 - RNA, 32 nt, Human
ucacccagguuggagugcagcaggggcaugau

SEQ ID NO: 494692 - RNA, 32 nt, Human
ucacccagguuggagugcaguggcgugaucuc

SEQ ID NO: 494693 - RNA, 32 nt, Human
ucacccagguuggagugcaguggugugaucuc

SEQ ID NO: 494694 - RNA, 32 nt, Human
ucacccagguuggagugcaguggugugaucuu

SEQ ID NO: 494695 - RNA, 32 nt, Human
ucacccagguuggagugcauugguguggucuu

SEQ ID NO: 494696 - RNA, 32 nt, Human
ucacccaguauacuccauaccagccugaggug

SEQ ID NO: 494697 - RNA, 32 nt, Human
ucacccagucuggagugcaguggugugaucac

SEQ ID NO: 494698 - RNA, 32 nt, Human
ucacccagucuggaguggaguggcauaaucuu

SEQ ID NO: 494699 - RNA, 18 nt, Human
ucacccagugaucagucg

SEQ ID NO: 494700 - RNA, 32 nt, Human
ucacccaguugacccaucucucagccucucug

SEQ ID NO: 494701 - RNA, 32 nt, Human
ucacccaguuuggagugcaguggugcagucuc

SEQ ID NO: 494702 - RNA, 32 nt, Human
ucacccaucaaaccagugaauuucucaaucuu

SEQ ID NO: 494703 - RNA, 32 nt, Human
ucacccauccccagcauugggaaagggucaca

SEQ ID NO: 494704 - RNA, 32 nt, Human
ucacccauccuagaggccaggcaggagcccuu

SEQ ID NO: 494705 - RNA, 22 nt, Human
ucacccaucucagcaagcccag

SEQ ID NO: 494706 - RNA, 32 nt, Human
ucacccaucugugugcuuccauccugcauuaa

SEQ ID NO: 494707 - RNA, 32 nt, Human
ucacccaucuuucuguuugucauucuuaucuc

SEQ ID NO: 494708 - RNA, 32 nt, Human
ucacccaucuuuguucccaucugaggacucag

SEQ ID NO: 494709 - RNA, 23 nt, Human
ucacccaugcuaggcaagcccag

SEQ ID NO: 494710 - RNA, 32 nt, Human
ucacccaugcuaggguccccaaagcacugggg

SEQ ID NO: 494711 - RNA, 32 nt, Human
ucacccaugcuggaguacaauggcacaaacac

SEQ ID NO: 494712 - RNA, 32 nt, Human
ucaccccaagcaccugcuggcugcuggaagca

SEQ ID NO: 494713 - RNA, 32 nt, Human
ucaccccacaaccaccaccaccacaauaaaca

SEQ ID NO: 494714 - RNA, 32 nt, Human
ucaccccacaugcucccuguuucucaugcuuu

SEQ ID NO: 494715 - RNA, 32 nt, Human
ucaccccacccccuccagccagaggcgagaau

SEQ ID NO: 494716 - RNA, 26 nt, Human
ucaccccaccgcccucuuaaguuucu

SEQ ID NO: 494717 - RNA, 32 nt, Human
ucaccccaccucucgcugcucagcucgguuuc

SEQ ID NO: 494718 - RNA, 32 nt, Human
ucaccccaccuugcaugcaccuugcuaccugc

SEQ ID NO: 494719 - RNA, 32 nt, Human
ucaccccacucagcucaccucucccuccaccu

SEQ ID NO: 494720 - RNA, 32 nt, Human
ucaccccacugcauuccagccugggugacaga

SEQ ID NO: 494721 - RNA, 32 nt, Human
ucaccccacuguccuccagccugggcaacaga

SEQ ID NO: 494722 - RNA, 32 nt, Human
ucaccccacugugcuguagccugggugacagu

SEQ ID NO: 494723 - RNA, 32 nt, Human
ucaccccagaaacuccccuuguacccccuucc

SEQ ID NO: 494724 - RNA, 32 nt, Human
ucaccccagacuccugacugucucccgggacu

SEQ ID NO: 494725 - RNA, 32 nt, Human
ucaccccagcaugagugcugagauauggacuc

SEQ ID NO: 494726 - RNA, 32 nt, Human
ucaccccagcuccaucagggcuggcagucccg

SEQ ID NO: 494727 - RNA, 32 nt, Human
ucaccccagcuggagugcaguagcacgaucuu

SEQ ID NO: 494728 - RNA, 32 nt, Human
ucaccccagcuggagugcaguggugcgaucuc

SEQ ID NO: 494729 - RNA, 32 nt, Human
ucaccccaggaggcugcugcuaugauucccac

SEQ ID NO: 494730 - RNA, 32 nt, Human
ucaccccaggccacugccacacugggccugaa

SEQ ID NO: 494731 - RNA, 32 nt, Human
ucaccccaggcuugagaacaggugaccauccc

SEQ ID NO: 494732 - RNA, 25 nt, Human
ucaccccagguucucaccucagggg

SEQ ID NO: 494733 - RNA, 32 nt, Human
ucaccccauaggcugaguggaagcucauguuc

SEQ ID NO: 494734 - RNA, 32 nt, Human
ucaccccauugcacuccagccuggacaacaag

SEQ ID NO: 494735 - RNA, 32 nt, Human
ucaccccauuucacuccagccugggcgacaag

SEQ ID NO: 494736 - RNA, 32 nt, Human
ucacccccaagugucucccacgacugcccucc

SEQ ID NO: 494737 - RNA, 32 nt, Human
ucacccccaccaccaggcuucuauuugggauu

SEQ ID NO: 494738 - RNA, 18 nt, Human
ucacccccaccaccccca

SEQ ID NO: 494739 - RNA, 32 nt, Human
ucacccccagaacccgcagcugugggaagagc

SEQ ID NO: 494740 - RNA, 32 nt, Human
ucacccccagcacagggggauucugagcagug

SEQ ID NO: 494741 - RNA, 15 nt, Human
ucacccccagcggcu

SEQ ID NO: 494742 - RNA, 32 nt, Human
ucacccccauaacaccagcaggguggggguua

SEQ ID NO: 494743 - RNA, 32 nt, Human
ucacccccgcgacuaucuccccaaaacggagc

SEQ ID NO: 494744 - RNA, 32 nt, Human
ucacccccucauuuccccagugaccauagcca

SEQ ID NO: 494745 - RNA, 32 nt, Human
ucacccccucggcuugguccuggcaggcaucc

SEQ ID NO: 494746 - RNA, 32 nt, Human
ucacccccuggcugagaagcccugaaguaaag

SEQ ID NO: 494747 - RNA, 25 nt, Human
ucacccccuguaaucccagcacuuu

SEQ ID NO: 494748 - RNA, 32 nt, Human
ucacccccuguaaucccagcacuuugggaagc

SEQ ID NO: 494749 - RNA, 32 nt, Human
ucacccccuuccauuacccauucuccacagaa

SEQ ID NO: 494750 - RNA, 32 nt, Human
ucacccccuucccaucuacacgucccucccca

SEQ ID NO: 494751 - RNA, 19 nt, Human
ucaccccggccucuugcaa

SEQ ID NO: 494752 - RNA, 32 nt, Human
ucaccccggcuggagugcaguggugugaucuu

SEQ ID NO: 494753 - RNA, 32 nt, Human
ucaccccuccccuccccuccucagagcccacc

SEQ ID NO: 494754 - RNA, 32 nt, Human
ucaccccugcacuccagccugggcaacagagu

SEQ ID NO: 494755 - RNA, 32 nt, Human
ucaccccugcugcuggagugcaauugcacaau

SEQ ID NO: 494756 - RNA, 32 nt, Human
ucaccccuggaaucccagcacuuugggaggcg

SEQ ID NO: 494757 - RNA, 32 nt, Human
ucaccccuggggacagaggucagccuaaggug

SEQ ID NO: 494758 - RNA, 24 nt, Human
ucaccccuguaaucccagcacuuu

SEQ ID NO: 494759 - RNA, 32 nt, Human
ucaccccuguaaucccagcacuuugggaggcc

SEQ ID NO: 494760 - RNA, 32 nt, Human
ucaccccuguaaucccagcacuuugggaggcu

SEQ ID NO: 494761 - RNA, 32 nt, Human
ucaccccuguaaucccagcacuuugggugggu

SEQ ID NO: 494762 - RNA, 32 nt, Human
ucaccccuguaaucccagcacuuugugaggcc

SEQ ID NO: 494763 - RNA, 24 nt, Human
ucaccccuguaaucccaguacuuu

SEQ ID NO: 494764 - RNA, 32 nt, Human
ucaccccuguaaucccaguacuuugggaggcc

SEQ ID NO: 494765 - RNA, 32 nt, Human
ucaccccuguaauccuagcacuuugggaggcu

SEQ ID NO: 494766 - RNA, 32 nt, Human
ucaccccuguaaucgcagcacuuugggaggcu

SEQ ID NO: 494767 - RNA, 24 nt, Human
ucaccccuguaaucucagcacuuu

SEQ ID NO: 494768 - RNA, 32 nt, Human
ucaccccuguaaucucagcacuuuggguggcc

SEQ ID NO: 494769 - RNA, 32 nt, Human
ucaccccuguaaucucagcauuuugggaggcu

SEQ ID NO: 494770 - RNA, 32 nt, Human
ucaccccugucugaccuuauuguugcucacac

SEQ ID NO: 494771 - RNA, 22 nt, Human
ucaccccuucagccgagcccag

SEQ ID NO: 494772 - RNA, 32 nt, Human
ucaccccuugcaauaacgucacugccugugac

SEQ ID NO: 494773 - RNA, 32 nt, Human
ucaccccuuguccuuuuccacccuuuuaagag

SEQ ID NO: 494774 - RNA, 32 nt, Human
ucaccccuuuaaucccagcacuuuggaaggcc

SEQ ID NO: 494775 - RNA, 32 nt, Human
ucaccccuuugccuugcugucugucuccaccc

SEQ ID NO: 494776 - RNA, 32 nt, Human
ucaccccuuugucuccaaccuccauuucuguu

SEQ ID NO: 494777 - RNA, 32 nt, Human
ucacccgagcuggagugcaguggugcagucuu

SEQ ID NO: 494778 - RNA, 32 nt, Human
ucacccgcacacugggagggcagccagguggg

SEQ ID NO: 494779 - RNA, 32 nt, Human
ucacccgcgcgacuauguuugcugauuuuucg

SEQ ID NO: 494780 - RNA, 32 nt, Human
ucacccggcagccucuuguccagcgcugaccc

SEQ ID NO: 494781 - RNA, 32 nt, Human
ucacccgggaaagaggugagaggaugggaagg

SEQ ID NO: 494782 - RNA, 32 nt, Human
ucacccgggaagggaaagcagccagcagcccu

SEQ ID NO: 494783 - RNA, 32 nt, Human
ucacccgggcuggagugcaauggcucgaucuc

SEQ ID NO: 494784 - RNA, 32 nt, Human
ucacccgggcuggagugcaguggcgccaucuc

SEQ ID NO: 494785 - RNA, 32 nt, Human
ucacccgggcuggagugcaguggcgcgaucuc

SEQ ID NO: 494786 - RNA, 32 nt, Human
ucacccgggcuggagugcaguggcgugaucuu

SEQ ID NO: 494787 - RNA, 32 nt, Human
ucacccgggcuggagugcaguggugcgaucuc

SEQ ID NO: 494788 - RNA, 32 nt, Human
ucacccgggcuggaguguaacguggcaugauc

SEQ ID NO: 494789 - RNA, 32 nt, Human
ucacccgggcugggcucuacuaccuguacugu

SEQ ID NO: 494790 - RNA, 32 nt, Human
ucacccggggcuccccucucugcuccacgcca

SEQ ID NO: 494791 - RNA, 32 nt, Human
ucacccgggguucguguuaaaugcagauucug

SEQ ID NO: 494792 - RNA, 32 nt, Human
ucacccguucaucauguguacugagcagcuac

SEQ ID NO: 494793 - RNA, 32 nt, Human
ucacccuacaaaccaccauggcucuaaacccu

SEQ ID NO: 494794 - RNA, 32 nt, Human
ucacccuagccugacuggaagcagaaaaugac

SEQ ID NO: 494795 - RNA, 32 nt, Human
ucagccccuccgaccuucucacugaccaguug

SEQ ID NO: 494796 - RNA, 21 nt, Human
ucagccccuccuggggugcuu

SEQ ID NO: 494797 - RNA, 25 nt, Human
ucagccccuccuggggugcuugugg

SEQ ID NO: 494798 - RNA, 22 nt, Human
ucagccccucgagcgugggcuc

SEQ ID NO: 494799 - RNA, 24 nt, Human
ucagccccucuuuucccacauuca

SEQ ID NO: 494800 - RNA, 32 nt, Human
ucagccccugaacaauaauggccucucaugcu

SEQ ID NO: 494801 - RNA, 21 nt, Human
ucagccccugaugcccaggcu

SEQ ID NO: 494802 - RNA, 21 nt, Human
ucagccccugcaaggcgcuca

SEQ ID NO: 494803 - RNA, 32 nt, Human
ucagccccugcaccuggggugugugauucacg

SEQ ID NO: 494804 - RNA, 24 nt, Human
ucagccccugccgaccuuagcuua

SEQ ID NO: 494805 - RNA, 22 nt, Human
ucagccccugccucccaggcca

SEQ ID NO: 494806 - RNA, 32 nt, Human
ucagccccugcucccauccaguggccagucgg

SEQ ID NO: 494807 - RNA, 32 nt, Human
ucagccccugggaacaggccccacgcccucuc

SEQ ID NO: 494808 - RNA, 32 nt, Human
ucagccccuucccuguguccaccuuucucucc

SEQ ID NO: 494809 - RNA, 21 nt, Human
ucagccccuuccuccccacuc

SEQ ID NO: 494810 - RNA, 21 nt, Human
ucagccccuuccuccucacca

SEQ ID NO: 494811 - RNA, 26 nt, Human
ucagccccuucuucuuuccugccuca

SEQ ID NO: 494812 - RNA, 32 nt, Human
ucagcccgaaugccugucaguuucauggaggg

SEQ ID NO: 494813 - RNA, 23 nt, Human
ucagcccgacugcccuccuccca

SEQ ID NO: 494814 - RNA, 32 nt, Human
ucagcccgaggguucugcucuuccugcauguu

SEQ ID NO: 494815 - RNA, 32 nt, Human
ucagcccgauccugcccuuuccuugaacggga

SEQ ID NO: 494816 - RNA, 32 nt, Human
ucagcccgccucugccccacugcuuccugccu

SEQ ID NO: 494817 - RNA, 32 nt, Human
ucagcccggaggaggaggaggaggaggaggag

SEQ ID NO: 494818 - RNA, 20 nt, Human
ucagcccggcugugaacguc

SEQ ID NO: 494819 - RNA, 32 nt, Human
ucagcccgggagguggagguugcagugagcca

SEQ ID NO: 494820 - RNA, 32 nt, Human
ucagcccgggcaacauggugaaaccccgucuc

SEQ ID NO: 494821 - RNA, 32 nt, Human
ucagcccuaccugcaaccaccgcuugccaugg

SEQ ID NO: 494822 - RNA, 32 nt, Human
ucagcccuagaggaauagacucagggauuuca

SEQ ID NO: 494823 - RNA, 32 nt, Human
ucagcccucgcucuccccuuuccacagccucc

SEQ ID NO: 494824 - RNA, 23 nt, Human
ucagcccucgugucccgggcuca

SEQ ID NO: 494825 - RNA, 32 nt, Human
ucagcccucuacugagucccuuagccaagcag

SEQ ID NO: 494826 - RNA, 32 nt, Human
ucagcccucuacugcaggaccaguccaugagc

SEQ ID NO: 494827 - RNA, 32 nt, Human
ucagcccucuuccugccagcaggaagccucug

SEQ ID NO: 494828 - RNA, 32 nt, Human
ucagcccucuucucccugcuccaguagucucc

SEQ ID NO: 494829 - RNA, 32 nt, Human
ucagcccugagauccugcacaagguggagugu

SEQ ID NO: 494830 - RNA, 32 nt, Human
ucagcccugagcgugcugaguucuguguuucu

SEQ ID NO: 494831 - RNA, 32 nt, Human
ucagcccugauuggccaguuugaugagaccaa

SEQ ID NO: 494832 - RNA, 32 nt, Human
ucagcccugcagcuguaguacagugcugugcc

SEQ ID NO: 494833 - RNA, 32 nt, Human
ucagcccugccugcccuggccugggcucuccc

SEQ ID NO: 494834 - RNA, 32 nt, Human
ucagcccugcucaugaggcagcaaacccugca

SEQ ID NO: 494835 - RNA, 32 nt, Human
ucagcccugcuccuccugccuccuggggucca

SEQ ID NO: 494836 - RNA, 32 nt, Human
ucagcccugcugucaccaccuugucaugcacc

SEQ ID NO: 494837 - RNA, 32 nt, Human
ucagcccugggcaacauagugagaccccuguc

SEQ ID NO: 494838 - RNA, 32 nt, Human
ucagcccuggggaucagaaaggugggcuugcu

SEQ ID NO: 494839 - RNA, 32 nt, Human
ucagcccugucagcuccugguggcugaguuga

SEQ ID NO: 494840 - RNA, 32 nt, Human
ucagcccugugucugucacaggcugggucaaa

SEQ ID NO: 494841 - RNA, 23 nt, Human
ucagcccuucccaccaggcacuu

SEQ ID NO: 494842 - RNA, 20 nt, Human
ucagcccuucccuguaacuu

SEQ ID NO: 494843 - RNA, 19 nt, Human
ucagcccuucugcuucugg

SEQ ID NO: 494844 - RNA, 32 nt, Human
ucagcccuuucaaacaugcuuaccucgaguga

SEQ ID NO: 494845 - RNA, 32 nt, Human
ucagcccuuuccaaagucgccaaaaacccaca

SEQ ID NO: 494846 - RNA, 20 nt, Human
ucagcccuuuccuguggccu

SEQ ID NO: 494847 - RNA, 32 nt, Human
ucagcccuuugucaaucauaaugguuuuuaaa

SEQ ID NO: 494848 - RNA, 22 nt, Human
ucagccgaaagccccccgccca

SEQ ID NO: 494849 - RNA, 32 nt, Human
ucagccgaaucccagccccuucccuugggccu

SEQ ID NO: 494850 - RNA, 32 nt, Human
ucagccgacaagaggcaccaugaaauuggaau

SEQ ID NO: 494851 - RNA, 32 nt, Human
ucagccgagcccaggggaggcacaaagggcag

SEQ ID NO: 494852 - RNA, 32 nt, Human
ucagccgagggugaauucucaggacuggucgg

SEQ ID NO: 494853 - RNA, 25 nt, Human
ucagccgauccucugcucagguuca

SEQ ID NO: 494854 - RNA, 32 nt, Human
ucagccgcaacucgucgugcaugugggcaugg

SEQ ID NO: 494855 - RNA, 32 nt, Human
ucagccgcauggcuccccugugccccagcccc

SEQ ID NO: 494856 - RNA, 32 nt, Human
ucagccgcgggccgcugggaacuccacucggg

SEQ ID NO: 494857 - RNA, 32 nt, Human
ucagccgcuccugguggggaauggcuggggcu

SEQ ID NO: 494858 - RNA, 32 nt, Human
ucagccgcugcuuugucuccuuagcucggguc

SEQ ID NO: 494859 - RNA, 32 nt, Human
ucagccgcuucucaaguggguaggaaagcaga

SEQ ID NO: 494860 - RNA, 32 nt, Human
ucagccggacuggccgggccuggacccaugcc

SEQ ID NO: 494861 - RNA, 32 nt, Human
ucagccggccaagaaaaggaagcuccgucccu

SEQ ID NO: 494862 - RNA, 32 nt, Human
ucagccggcugguggagagggaggccggccuc

SEQ ID NO: 494863 - RNA, 32 nt, Human
ucagccggcuucccugagggaggagaacacug

SEQ ID NO: 494864 - RNA, 32 nt, Human
ucagccgggaggcccagaguguucugcagagg

SEQ ID NO: 494865 - RNA, 31 nt, Human
ucagccgggcaggaaagaugggaugaagccc

SEQ ID NO: 494866 - RNA, 32 nt, Human
ucagccgggcuggggcugcuggggaagcccug

SEQ ID NO: 494867 - RNA, 32 nt, Human
ucagccgggguccacucucagggcacaggugg

SEQ ID NO: 494868 - RNA, 32 nt, Human
ucagccggugaacccucucucccaucaccguc

SEQ ID NO: 494869 - RNA, 32 nt, Human
ucagccgucacugucugugucacugcaguggu

SEQ ID NO: 494870 - RNA, 32 nt, Human
ucagccgugcccugcuccaucucccucgccag

SEQ ID NO: 494871 - RNA, 19 nt, Human
ucagccuaagggaguggga

SEQ ID NO: 494872 - RNA, 31 nt, Human
ucagccuaaguguccauccacgaaugaauga

SEQ ID NO: 494873 - RNA, 32 nt, Human
ucagccuacccacccuccccaucuuugcugag

SEQ ID NO: 494874 - RNA, 32 nt, Human
ucagccuacugccucggaucucuccagccgaa

SEQ ID NO: 494875 - RNA, 32 nt, Human
ucagccuagaucuagcagugagagagcccucu

SEQ ID NO: 494876 - RNA, 23 nt, Human
ucagccuaggcaacauaguaaga

SEQ ID NO: 494877 - RNA, 32 nt, Human
ucagccuaggcaacauaguaagaccucaucuc

SEQ ID NO: 494878 - RNA, 32 nt, Human
ucagccuaggcaacauggugaaauccugucuu

SEQ ID NO: 494879 - RNA, 32 nt, Human
ucagccucacaaguagcugggauuacaggugc

SEQ ID NO: 494880 - RNA, 32 nt, Human
ucagccucacacaccacguauuaagucaguca

SEQ ID NO: 494881 - RNA, 32 nt, Human
ucagccucacccacagcagccccaucgccaaa

SEQ ID NO: 494882 - RNA, 32 nt, Human
ucagccucacgggcccucagcacuuuguguuu

SEQ ID NO: 494883 - RNA, 32 nt, Human
ucagccucacugccugcuuauugccucuuucu

SEQ ID NO: 494884 - RNA, 32 nt, Human
ucagccucagacccuccucuggccccggccuu

SEQ ID NO: 494885 - RNA, 32 nt, Human
ucagccucagugggguuccugauguuuaucua

SEQ ID NO: 494886 - RNA, 32 nt, Human
ucagccuccaaaagugcugggauuauaggugu

SEQ ID NO: 494887 - RNA, 32 nt, Human
ucagccuccaaaguagcugggauuacaggcac

SEQ ID NO: 494888 - RNA, 32 nt, Human
ucagccuccaaaguagcugggauuacaggcau

SEQ ID NO: 494889 - RNA, 32 nt, Human
ucagccuccaaaguagcugggauuacagguuu

SEQ ID NO: 494890 - RNA, 32 nt, Human
ucagccuccaaggcuuuaaagccacauuucag

SEQ ID NO: 494891 - RNA, 32 nt, Human
ucagccuccagaauagcugggauuacaggcgu

SEQ ID NO: 494892 - RNA, 32 nt, Human
ucagccuccaguuuccugagcagguacuuagc

SEQ ID NO: 494893 - RNA, 32 nt, Human
ucagccuccauuuugaaggcugucuacacuua

SEQ ID NO: 494894 - RNA, 32 nt, Human
ucagccucccaaaaagcugggauuacuagcau

SEQ ID NO: 494895 - RNA, 32 nt, Human
ucagccucccaaaagcugggauuacaggcgug

SEQ ID NO: 494896 - RNA, 32 nt, Human
ucagccucccaaaaugcugggacuaugggcau

SEQ ID NO: 494897 - RNA, 32 nt, Human
ucagccucccaaaaugcugggauuacaggcau

SEQ ID NO: 494898 - RNA, 32 nt, Human
ucagccucccaaaaugcugggauuacaggcgu

SEQ ID NO: 494899 - RNA, 32 nt, Human
ucagccucccaaaaugcugggauuacaggcuu

SEQ ID NO: 494900 - RNA, 32 nt, Human
ucagccucccaaaaugcuuggauuacaggcau

SEQ ID NO: 494901 - RNA, 32 nt, Human
ucagccucccaaaauggugggauuacaggugu

SEQ ID NO: 494902 - RNA, 32 nt, Human
ucagccucccaaaauucugggauuacaggcau

SEQ ID NO: 494903 - RNA, 32 nt, Human
ucagccucccaaacuacugggauuacagguug

SEQ ID NO: 494904 - RNA, 32 nt, Human
ucagccucccaaacugcugggauuacaggcgu

SEQ ID NO: 494905 - RNA, 32 nt, Human
ucagccucccaaacugcugggauuacaggugu

SEQ ID NO: 494906 - RNA, 32 nt, Human
ucagccucccaaagagcugggauuacaggugu

SEQ ID NO: 494907 - RNA, 32 nt, Human
ucagccucccaaaggguugggauuaccggcau

SEQ ID NO: 494908 - RNA, 32 nt, Human
ucagccucccaaaguacugggauuacaaacau

SEQ ID NO: 494909 - RNA, 32 nt, Human
ucagccucccaaaguacugggauuacaggcau

SEQ ID NO: 494910 - RNA, 32 nt, Human
ucagccucccaaaguacugggauuacaggcgu

SEQ ID NO: 494911 - RNA, 32 nt, Human
ucagccucccaaaguacugggauuauaggcau

SEQ ID NO: 494912 - RNA, 32 nt, Human
ucagccucccaaaguacugggauuauaggugu

SEQ ID NO: 494913 - RNA, 32 nt, Human
ucagccucccaaaguccugggauuacaggcgu

SEQ ID NO: 494914 - RNA, 32 nt, Human
ucagccucccaaaguccugggauuacaggcug

SEQ ID NO: 494915 - RNA, 32 nt, Human
ucagccucccaaagugcagggauuacaggcac

SEQ ID NO: 494916 - RNA, 32 nt, Human
ucagccucccaaagugcagggauuacaggcau

SEQ ID NO: 494917 - RNA, 32 nt, Human
ucagccucccaaagugccgccgggauuacagg

SEQ ID NO: 494918 - RNA, 32 nt, Human
ucagccucccaaagugccgggauuacaggcgu

SEQ ID NO: 494919 - RNA, 32 nt, Human
ucagccucccaaagugcuaggauuacacagcc

SEQ ID NO: 494920 - RNA, 32 nt, Human
ucagccucccaaagugcuaggauuacaggaua

SEQ ID NO: 494921 - RNA, 32 nt, Human
ucagccucccaaagugcuaggauuacaggcau

SEQ ID NO: 494922 - RNA, 32 nt, Human
ucagccucccaaagugcuaggauuacaggccu

SEQ ID NO: 494923 - RNA, 32 nt, Human
ucagccucccaaagugcuaggauuacaggcgu

SEQ ID NO: 494924 - RNA, 32 nt, Human
ucagccucccaaagugcuaggauuacaggugu

SEQ ID NO: 494925 - RNA, 32 nt, Human
ucagccucccaaagugcuaggauuacgggugu

SEQ ID NO: 494926 - RNA, 32 nt, Human
ucagccucccaaagugcuaggauuauaggcgu

SEQ ID NO: 494927 - RNA, 32 nt, Human
ucagccucccaaagugcuaggguuacagacau

SEQ ID NO: 494928 - RNA, 32 nt, Human
ucagccucccaaagugcuaugauuacagacgu

SEQ ID NO: 494929 - RNA, 32 nt, Human
ucagccucccaaagugcucggauuacagacau

SEQ ID NO: 494930 - RNA, 32 nt, Human
ucagccucccaaagugcugagauuacaagcgu

SEQ ID NO: 494931 - RNA, 32 nt, Human
ucagccucccaaagugcugagauuacagacau

SEQ ID NO: 494932 - RNA, 32 nt, Human
ucagccucccaaagugcugagauuacaggcau

SEQ ID NO: 494933 - RNA, 32 nt, Human
ucagccucccaaagugcugagauuacaggcgu

SEQ ID NO: 494934 - RNA, 32 nt, Human
ucagccucccaaagugcugagauuacaggggu

SEQ ID NO: 494935 - RNA, 32 nt, Human
ucagccucccaaagugcugagauuacaggugu

SEQ ID NO: 494936 - RNA, 32 nt, Human
ucagccucccaaagugcugagauuacuggcuu

SEQ ID NO: 494937 - RNA, 32 nt, Human
ucagccucccaaagugcugagauuauaggcac

SEQ ID NO: 494938 - RNA, 32 nt, Human
ucagccucccaaagugcugauauuacaggcgu

SEQ ID NO: 494939 - RNA, 32 nt, Human
ucagccucccaaagugcugcugggauuacagg

SEQ ID NO: 494940 - RNA, 32 nt, Human
ucagccucccaaagugcuggaauuacaggcgu

SEQ ID NO: 494941 - RNA, 32 nt, Human
ucagccucccaaagugcuggaauuauaggcgu

SEQ ID NO: 494942 - RNA, 32 nt, Human
ucagccucccaaagugcuggauuacaggcgug

SEQ ID NO: 494943 - RNA, 32 nt, Human
ucagccucccaaagugcuggcauuacaggcgu

SEQ ID NO: 494944 - RNA, 32 nt, Human
ucagccucccaaagugcugggacuacagacau

SEQ ID NO: 494945 - RNA, 32 nt, Human
ucagccucccaaagugcugggacuacaggcau

SEQ ID NO: 494946 - RNA, 32 nt, Human
ucagccucccaaagugcugggacuacaggcgu

SEQ ID NO: 494947 - RNA, 32 nt, Human
ucagccucccaaagugcugggaucacaggcau

SEQ ID NO: 494948 - RNA, 32 nt, Human
ucagccucccaaagugcugggaugacaggcgu

SEQ ID NO: 494949 - RNA, 32 nt, Human
ucagccucccaaagugcugggaugacaggugu

SEQ ID NO: 494950 - RNA, 32 nt, Human
ucagccucccaaagugcugggaugacaguugu

SEQ ID NO: 494951 - RNA, 32 nt, Human
ucagccucccaaagugcugggauuaacaggua

SEQ ID NO: 494952 - RNA, 32 nt, Human
ucagccucccaaagugcugggauuacaagcgu

SEQ ID NO: 494953 - RNA, 32 nt, Human
ucagccucccaaagugcugggauuacaaguau

SEQ ID NO: 494954 - RNA, 32 nt, Human
ucagccucccaaagugcugggauuacaagugu

SEQ ID NO: 494955 - RNA, 32 nt, Human
ucagccucccaaagugcugggauuacagaccu

SEQ ID NO: 494956 - RNA, 32 nt, Human
ucagccucccaaagugcugggauuacagacgu

SEQ ID NO: 494957 - RNA, 32 nt, Human
ucagccucccaaagugcugggauuacagauga

SEQ ID NO: 494958 - RNA, 32 nt, Human
ucagccucccaaagugcugggauuacagaugu

SEQ ID NO: 494959 - RNA, 32 nt, Human
ucagccucccaaagugcugggauuacagcccu

SEQ ID NO: 494960 - RNA, 32 nt, Human
ucagccucccaaagugcugggauuacagcgaa

SEQ ID NO: 494961 - RNA, 32 nt, Human
ucagccucccaaagugcugggauuacagcgug

SEQ ID NO: 494962 - RNA, 32 nt, Human
ucagccucccaaagugcugggauuacaggaau

SEQ ID NO: 494963 - RNA, 32 nt, Human
ucagccucccaaagugcugggauuacaggagu

SEQ ID NO: 494964 - RNA, 32 nt, Human
ucagccucccaaagugcugggauuacaggcaa

SEQ ID NO: 494965 - RNA, 32 nt, Human
ucagccucccaaagugcugggauuacaggcau

SEQ ID NO: 494966 - RNA, 32 nt, Human
ucagccucccaaagugcugggauuacaggcca

SEQ ID NO: 494967 - RNA, 32 nt, Human
ucagccucccaaagugcugggauuacaggccc

SEQ ID NO: 494968 - RNA, 32 nt, Human
ucagccucccaaagugcugggauuacaggccu

SEQ ID NO: 494969 - RNA, 32 nt, Human
ucagccucccaaagugcugggauuacaggcgc

SEQ ID NO: 494970 - RNA, 32 nt, Human
ucagccucccaaagugcugggauuacaggcgg

SEQ ID NO: 494971 - RNA, 32 nt, Human
ucagccucccaaagugcugggauuacaggcgu

SEQ ID NO: 494972 - RNA, 32 nt, Human
ucagccucccaaagugcugggauuacaggcuu

SEQ ID NO: 494973 - RNA, 32 nt, Human
ucagccucccaaagugcugggauuacaggggu

SEQ ID NO: 494974 - RNA, 32 nt, Human
ucagccucccaaagugcugggauuacagguau

SEQ ID NO: 494975 - RNA, 32 nt, Human
ucagccucccaaagugcugggauuacaggugg

SEQ ID NO: 494976 - RNA, 32 nt, Human
ucagccucccaaagugcugggauuacaggugu

SEQ ID NO: 494977 - RNA, 32 nt, Human
ucagccucccaaagugcugggauuacagucau

SEQ ID NO: 494978 - RNA, 32 nt, Human
ucagccucccaaagugcugggauuacaguugc

SEQ ID NO: 494979 - RNA, 32 nt, Human
ucagccucccaaagugcugggauuaccggcuu

SEQ ID NO: 494980 - RNA, 32 nt, Human
ucagccucccaaagugcugggauuaccgguau

SEQ ID NO: 494981 - RNA, 32 nt, Human
ucagccucccaaagugcugggauuacuggugu

SEQ ID NO: 494982 - RNA, 32 nt, Human
ucagccucccaaagugcugggauuauacguau

SEQ ID NO: 494983 - RNA, 32 nt, Human
ucagccucccaaagugcugggauuauaggcau

SEQ ID NO: 494984 - RNA, 32 nt, Human
ucagccucccaaagugcugggauuauaggcgu

SEQ ID NO: 494985 - RNA, 32 nt, Human
ucagccucccaaagugcugggauuauaggcug

SEQ ID NO: 494986 - RNA, 32 nt, Human
ucagccucccaaagugcugggauuauaggugu

SEQ ID NO: 494987 - RNA, 32 nt, Human
ucagccucccaaagugcugggauuccagacca

SEQ ID NO: 494988 - RNA, 32 nt, Human
ucagccucccaaagugcugggauugcaggcau

SEQ ID NO: 494989 - RNA, 32 nt, Human
ucagccucccaaagugcugggauugcaggugc

SEQ ID NO: 494990 - RNA, 32 nt, Human
ucagccucccaaagugcugggauugcaggugu

SEQ ID NO: 494991 - RNA, 32 nt, Human
ucagccucccaaagugcugggcuuacgggccu

SEQ ID NO: 494992 - RNA, 32 nt, Human
ucagccucccaaagugcugggguuacaggcau

SEQ ID NO: 494993 - RNA, 32 nt, Human
ucagccucccaaagugcugggguuacaggcgu

SEQ ID NO: 494994 - RNA, 32 nt, Human
ucagccucccaaagugcugggguuacaggugu

SEQ ID NO: 494995 - RNA, 32 nt, Human
ucagccucccaaagugcugguauuacagaugu

SEQ ID NO: 494996 - RNA, 32 nt, Human
ucagccucccaaagugcuuggauuacaggcau

SEQ ID NO: 494997 - RNA, 32 nt, Human
ucagccucccaaaguggugggauuacaggugu

SEQ ID NO: 494998 - RNA, 32 nt, Human
ucagccucccaaaguggugggauuauaggcau

SEQ ID NO: 494999 - RNA, 32 nt, Human
ucagccucccaaaguguggggauuacaggugc

SEQ ID NO: 495000 - RNA, 32 nt, Human
ucagccucccaaaguguugagauuacaggcau

SEQ ID NO: 495001 - RNA, 32 nt, Human
ucagccucccaaaguguugcacuacugaauac

SEQ ID NO: 495002 - RNA, 32 nt, Human
ucagccucccaaaguguugggauuacagacau

SEQ ID NO: 495003 - RNA, 32 nt, Human
ucagccucccaaaguguugggauuacaggcau

SEQ ID NO: 495004 - RNA, 32 nt, Human
ucagccucccaaaguguugggauuacaggcgu

SEQ ID NO: 495005 - RNA, 32 nt, Human
ucagccucccaaaguguugggauuacaggugu

SEQ ID NO: 495006 - RNA, 32 nt, Human
ucagccucccaaaguguugggauugcagauau

SEQ ID NO: 495007 - RNA, 32 nt, Human
ucagccucccaaaguucugggauuacaagugu

SEQ ID NO: 495008 - RNA, 32 nt, Human
ucagccucccaaaguucugggauuacaggcau

SEQ ID NO: 495009 - RNA, 32 nt, Human
ucagccucccaaaguucugggauuacaggugu

SEQ ID NO: 495010 - RNA, 32 nt, Human
ucagccucccaaaguuuugggauuacagaccu

SEQ ID NO: 495011 - RNA, 32 nt, Human
ucagccucccaaauagcggggauuacuggugc

SEQ ID NO: 495012 - RNA, 32 nt, Human
ucagccucccaaauagcugggacuacaaggug

SEQ ID NO: 495013 - RNA, 32 nt, Human
ucagccucccaaauagcugggacuacaggcac

SEQ ID NO: 495014 - RNA, 32 nt, Human
ucagccucccaaauagcugggacuacaggucu

SEQ ID NO: 495015 - RNA, 32 nt, Human
ucagccucccaaauagcugggaucacuggcac

SEQ ID NO: 495016 - RNA, 32 nt, Human
ucagccucccaaauagcugggauuacaggcac

SEQ ID NO: 495017 - RNA, 32 nt, Human
ucagccucccaaauagcugggauuacaggugc

SEQ ID NO: 495018 - RNA, 32 nt, Human
ucagccucccaaauagcugggauuacaguugc

SEQ ID NO: 495019 - RNA, 32 nt, Human
ucagccucccaaauagcuggggcuaccauggu

SEQ ID NO: 495020 - RNA, 32 nt, Human
ucagccucccaaauagcugugauuacaggcgu

SEQ ID NO: 495021 - RNA, 32 nt, Human
ucagccucccaaauuacugggauuacaggcau

SEQ ID NO: 495022 - RNA, 32 nt, Human
ucagccucccaaauugcugggauuacaggcau

SEQ ID NO: 495023 - RNA, 32 nt, Human
ucagccucccaaauugcugggauuacaggcgu

SEQ ID NO: 495024 - RNA, 32 nt, Human
ucagccucccaaauugcugggauuuacaggca

SEQ ID NO: 495025 - RNA, 32 nt, Human
ucagccucccaaauuugcugggauuccagggu

SEQ ID NO: 495026 - RNA, 32 nt, Human
ucagccucccaacaugcugggauuauagacau

SEQ ID NO: 495027 - RNA, 32 nt, Human
ucagccucccaacguacugggauuacaggcgu

SEQ ID NO: 495028 - RNA, 32 nt, Human
ucagccucccaacgugcugggauuacagccgg

SEQ ID NO: 495029 - RNA, 32 nt, Human
ucagccucccaacuagcugggauuacaggcgu

SEQ ID NO: 495030 - RNA, 32 nt, Human
ucagccucccaacuugcugggauuacaggugu

SEQ ID NO: 495031 - RNA, 32 nt, Human
ucagccucccaagcaccugggauuacaagcau

SEQ ID NO: 495032 - RNA, 32 nt, Human
ucagccucccaagcagcugggauuacaggcgc

SEQ ID NO: 495033 - RNA, 32 nt, Human
ucagccucccaagcagcugggauuauagacac

SEQ ID NO: 495034 - RNA, 32 nt, Human
ucagccucccaagcauauaacccccuaaggaa

SEQ ID NO: 495035 - RNA, 32 nt, Human
ucagccucccaaggagcugggauuacaggcac

SEQ ID NO: 495036 - RNA, 32 nt, Human
ucagccucccaaggcugggauuacagguaugc

SEQ ID NO: 495037 - RNA, 32 nt, Human
ucagccucccaaggugcugggauuacaggcac

SEQ ID NO: 495038 - RNA, 32 nt, Human
ucagccucccaaggugcugggauuacaggcau

SEQ ID NO: 495039 - RNA, 32 nt, Human
ucagccucccaaggugcugggauuacaggugu

SEQ ID NO: 495040 - RNA, 32 nt, Human
ucagccucccaaggugcugggauugcaggccg

SEQ ID NO: 495041 - RNA, 32 nt, Human
ucagccucccaagguguugggauuacagaugu

SEQ ID NO: 495042 - RNA, 32 nt, Human
ucagccucccaaguaacugggauuacaggcau

SEQ ID NO: 495043 - RNA, 32 nt, Human
ucagccucccaaguaccugggauuacaggcau

SEQ ID NO: 495044 - RNA, 32 nt, Human
ucagccucccaaguagcugggauaacaggcgc

SEQ ID NO: 495045 - RNA, 32 nt, Human
ucagccucccaaguagcugggaugacaggcgc

SEQ ID NO: 495046 - RNA, 32 nt, Human
ucagccucccaaguagcugggauuaaaggcac

SEQ ID NO: 495047 - RNA, 32 nt, Human
ucagccucccaaguagcugggauuacaccacc

SEQ ID NO: 495048 - RNA, 32 nt, Human
ucagccucccaaguagcugggauuacagacuc

SEQ ID NO: 495049 - RNA, 32 nt, Human
ucagccucccaaguagcugggauuacagauca

SEQ ID NO: 495050 - RNA, 32 nt, Human
ucagccucccaaguagcugggauuacagaugu

SEQ ID NO: 495051 - RNA, 32 nt, Human
ucagccucccaaguagcugggauuacagauug

SEQ ID NO: 495052 - RNA, 32 nt, Human
ucagccucccaaguagcugggauuacagcgau

SEQ ID NO: 495053 - RNA, 32 nt, Human
ucagccucccaaguagcugggauuacaggcac

SEQ ID NO: 495054 - RNA, 32 nt, Human
ucagccucccaaguagcugggauuacaggcag

SEQ ID NO: 495055 - RNA, 32 nt, Human
ucagccucccaaguagcugggauuacaggcau

SEQ ID NO: 495056 - RNA, 32 nt, Human
ucagccucccaaguagcugggauuacaggcgc

SEQ ID NO: 495057 - RNA, 32 nt, Human
ucagccucccaaguagcugggauuacaggcgu

SEQ ID NO: 495058 - RNA, 32 nt, Human
ucagccucccaaguagcugggauuacaggugc

SEQ ID NO: 495059 - RNA, 32 nt, Human
ucagccucccaaguagcugggauuacaggugu

SEQ ID NO: 495060 - RNA, 32 nt, Human
ucagccucccaaguagcugggauuacagucag

SEQ ID NO: 495061 - RNA, 32 nt, Human
ucagccucccaaguagcugggauuacagugcc

SEQ ID NO: 495062 - RNA, 32 nt, Human
ucagccucccaaguagcugggauuacaguucc

SEQ ID NO: 495063 - RNA, 32 nt, Human
ucagccucccaaguagcugggauuacaguuuc

SEQ ID NO: 495064 - RNA, 32 nt, Human
ucagccucccaaguagcugggauuacaugugu

SEQ ID NO: 495065 - RNA, 32 nt, Human
ucagccucccaaguagcugggauuacgggcau

SEQ ID NO: 495066 - RNA, 32 nt, Human
ucagccucccaaguagcugggauuacuggugc

SEQ ID NO: 495067 - RNA, 32 nt, Human
ucagccucccaaguagcugggauuauaggcac

SEQ ID NO: 495068 - RNA, 32 nt, Human
ucagccucccaaguagcugggauuauaggugu

SEQ ID NO: 495069 - RNA, 32 nt, Human
ucagccucccaaguagcugggauugcaggcgc

SEQ ID NO: 495070 - RNA, 32 nt, Human
ucagccucccaaguagcugggauuguaagagu

SEQ ID NO: 495071 - RNA, 32 nt, Human
ucagccucccaaguaggugggauuacaggcau

SEQ ID NO: 495072 - RNA, 32 nt, Human
ucagccucccaaguaggugggauuacaggcgc

SEQ ID NO: 495073 - RNA, 32 nt, Human
ucagccucccaaguaguugggauuacaggcac

SEQ ID NO: 495074 - RNA, 32 nt, Human
ucagccucccaaguaguugggauuacaggcau

SEQ ID NO: 495075 - RNA, 32 nt, Human
ucagccucccaaguaguugggauuacgggcau

SEQ ID NO: 495076 - RNA, 32 nt, Human
ucagccucccaagucacugggauuauagacau

SEQ ID NO: 495077 - RNA, 32 nt, Human
ucagccucccaaguggcugggauuacaggcgc

SEQ ID NO: 495078 - RNA, 32 nt, Human
ucagccucccaaguggcugggauuauaggugc

SEQ ID NO: 495079 - RNA, 32 nt, Human
ucagccucccaaguggcugggauugcaggcau

SEQ ID NO: 495080 - RNA, 32 nt, Human
ucagccucccaaguugcugggacuacaggugc

SEQ ID NO: 495081 - RNA, 32 nt, Human
ucagccucccaaugugcugggauuacaggcau

SEQ ID NO: 495082 - RNA, 32 nt, Human
ucagccucccacagugcugggauuacaggcau

SEQ ID NO: 495083 - RNA, 32 nt, Human
ucagccucccacagugcugggauuacaggcgu

SEQ ID NO: 495084 - RNA, 32 nt, Human
ucagccucccagacggcugggauuccaggcgu

SEQ ID NO: 495085 - RNA, 32 nt, Human
ucagccucccagacuguugggauuacaggcau

SEQ ID NO: 495086 - RNA, 32 nt, Human
ucagccucccagagugcugggauuacaauugu

SEQ ID NO: 495087 - RNA, 32 nt, Human
ucagccucccagagugcugggauuacaggugu

SEQ ID NO: 495088 - RNA, 32 nt, Human
ucagccucccagguagcugggauuacaggcac

SEQ ID NO: 495089 - RNA, 32 nt, Human
ucagccucccagguagcugggauuacaggcau

SEQ ID NO: 495090 - RNA, 32 nt, Human
ucagccucccagguagcugggauuacaggcuc

SEQ ID NO: 495091 - RNA, 32 nt, Human
ucagccucccagguggcugggauuacaggcau

SEQ ID NO: 495092 - RNA, 32 nt, Human
ucagccucccagguugcugggguuacaggugu

SEQ ID NO: 495093 - RNA, 32 nt, Human
ucagccucccagugcugggauuauagguguga

SEQ ID NO: 495094 - RNA, 32 nt, Human
ucagccucccagugugcugggauuacaggcau

SEQ ID NO: 495095 - RNA, 32 nt, Human
ucagccucccauagcugggacuacaggcgccc

SEQ ID NO: 495096 - RNA, 32 nt, Human
ucagccuccccaagugcugggauuacaggcgu

SEQ ID NO: 495097 - RNA, 32 nt, Human
ucagccuccccaguagcugggauuacaggcac

SEQ ID NO: 495098 - RNA, 32 nt, Human
ucagccuccccaguagcugggauuacaggcgc

SEQ ID NO: 495099 - RNA, 32 nt, Human
ucagccuccccaguagcugggauuacaggcgu

SEQ ID NO: 495100 - RNA, 32 nt, Human
ucagccuccccaguagcugggauuacaggcuc

SEQ ID NO: 495101 - RNA, 32 nt, Human
ucagccuccccaguagcugggauuacaguguu

SEQ ID NO: 495102 - RNA, 32 nt, Human
ucagccucccgaagagcugggauuacacgcau

SEQ ID NO: 495103 - RNA, 32 nt, Human
ucagccucccgaagugcugggauuacaggcgu

SEQ ID NO: 495104 - RNA, 32 nt, Human
ucagccucccgaaguguugggauuacaggcac

SEQ ID NO: 495105 - RNA, 32 nt, Human
ucagccucccgaauagcugggauuacacgugc

SEQ ID NO: 495106 - RNA, 32 nt, Human
ucagccucccgaauagcugggauuacaggcgc

SEQ ID NO: 495107 - RNA, 32 nt, Human
ucagccucccgaauaucugggauuacaggugc

SEQ ID NO: 495108 - RNA, 32 nt, Human
ucagccucccgagcagcugggauuacaggcgc

SEQ ID NO: 495109 - RNA, 32 nt, Human
ucagccucccgaguaacugggauuacaggcgg

SEQ ID NO: 495110 - RNA, 32 nt, Human
ucagccucccgaguaacugggauuacaggcuu

SEQ ID NO: 495111 - RNA, 32 nt, Human
ucagccucccgaguaccugggauuacaggcau

SEQ ID NO: 495112 - RNA, 32 nt, Human
ucagccucccgaguagcagggauuaccggugu

SEQ ID NO: 495113 - RNA, 32 nt, Human
ucagccucccgaguagcggggauuacaggcac

SEQ ID NO: 495114 - RNA, 32 nt, Human
ucagccucccgaguagcggggauuacaggcgc

SEQ ID NO: 495115 - RNA, 32 nt, Human
ucagccucccgaguagcugggaucacaggugu

SEQ ID NO: 495116 - RNA, 32 nt, Human
ucagccucccgaguagcugggauuacaagcac

SEQ ID NO: 495117 - RNA, 32 nt, Human
ucagccucccgaguagcugggauuacaagugc

SEQ ID NO: 495118 - RNA, 32 nt, Human
ucagccucccgaguagcugggauuacagacau

SEQ ID NO: 495119 - RNA, 32 nt, Human
ucagccucccgaguagcugggauuacaggaag

SEQ ID NO: 495120 - RNA, 32 nt, Human
ucagccucccgaguagcugggauuacaggaau

SEQ ID NO: 495121 - RNA, 32 nt, Human
ucagccucccgaguagcugggauuacaggagc

SEQ ID NO: 495122 - RNA, 32 nt, Human
ucagccucccgaguagcugggauuacaggagg

SEQ ID NO: 495123 - RNA, 32 nt, Human
ucagccucccgaguagcugggauuacaggaug

SEQ ID NO: 495124 - RNA, 32 nt, Human
ucagccucccgaguagcugggauuacaggcac

SEQ ID NO: 495125 - RNA, 32 nt, Human
ucagccucccgaguagcugggauuacaggcau

SEQ ID NO: 495126 - RNA, 32 nt, Human
ucagccucccgaguagcugggauuacaggcgc

SEQ ID NO: 495127 - RNA, 32 nt, Human
ucagccucccgaguagcugggauuacaggcgu

SEQ ID NO: 495128 - RNA, 32 nt, Human
ucagccucccgaguagcugggauuacagggug

SEQ ID NO: 495129 - RNA, 32 nt, Human
ucagccucccgaguagcugggauuacagguga

SEQ ID NO: 495130 - RNA, 32 nt, Human
ucagccucccgaguagcugggauuacaggugc

SEQ ID NO: 495131 - RNA, 32 nt, Human
ucagccucccgaguagcugggauuacaggugg

SEQ ID NO: 495132 - RNA, 32 nt, Human
ucagccucccgaguagcugggauuacaggugu

SEQ ID NO: 495133 - RNA, 32 nt, Human
ucagccucccgaguagcugggauuacgggcau

SEQ ID NO: 495134 - RNA, 32 nt, Human
ucagccucccgaguagcugggauuacgggcgc

SEQ ID NO: 495135 - RNA, 32 nt, Human
ucagccucccgaguagcugggauuacuggugc

SEQ ID NO: 495136 - RNA, 32 nt, Human
ucagccucccgaguagcugggauuagaggcgc

SEQ ID NO: 495137 - RNA, 32 nt, Human
ucagccucccgaguagcugggauuagaggcgu

SEQ ID NO: 495138 - RNA, 32 nt, Human
ucagccucccgaguagcugggauuauagacac

SEQ ID NO: 495139 - RNA, 32 nt, Human
ucagccucccgaguagcugggauuauaggcac

SEQ ID NO: 495140 - RNA, 32 nt, Human
ucagccucccgaguagcugggauuauaggcga

SEQ ID NO: 495141 - RNA, 32 nt, Human
ucagccucccgaguagcugggauuaugggcgc

SEQ ID NO: 495142 - RNA, 32 nt, Human
ucagccucccgaguagcugggauuccaggcgc

SEQ ID NO: 495143 - RNA, 32 nt, Human
ucagccucccgaguagcugggauugcaggagc

SEQ ID NO: 495144 - RNA, 32 nt, Human
ucagccucccgaguagcugggauugcaggcgc

SEQ ID NO: 495145 - RNA, 32 nt, Human
ucagccucccgaguagcugggauugcagguac

SEQ ID NO: 495146 - RNA, 32 nt, Human
ucagccucccgaguagcugggauugcaggugc

SEQ ID NO: 495147 - RNA, 32 nt, Human
ucagccucccgaguaguugggauuacaggcgc

SEQ ID NO: 495148 - RNA, 32 nt, Human
ucagccucccgaguaguugggauuacagguga

SEQ ID NO: 495149 - RNA, 32 nt, Human
ucagccucccgaguggcugggauuagcggcau

SEQ ID NO: 495150 - RNA, 32 nt, Human
ucagccucccgaguugcugggacuacagguga

SEQ ID NO: 495151 - RNA, 32 nt, Human
ucagccucccgaguugcugggacuauaggugu

SEQ ID NO: 495152 - RNA, 32 nt, Human
ucagccucccgaguugcugggauugcgggcau

SEQ ID NO: 495153 - RNA, 19 nt, Human
ucagccucccgcuccaggc

SEQ ID NO: 495154 - RNA, 32 nt, Human
ucagccucccggguagcugggauuacaggcau

SEQ ID NO: 495155 - RNA, 32 nt, Human
ucagccucccggguagcugggauugcagacgu

SEQ ID NO: 495156 - RNA, 32 nt, Human
ucagccucccguguagcugggauuacaggcgc

SEQ ID NO: 495157 - RNA, 32 nt, Human
ucagccucccuaauagcugggacuacaggcaa

SEQ ID NO: 495158 - RNA, 32 nt, Human
ucagccucccuaauaguugggauuacaggcac

SEQ ID NO: 495159 - RNA, 32 nt, Human
ucagccucccuaguagcugggauuacagccau

SEQ ID NO: 495160 - RNA, 32 nt, Human
ucagccucccuaguagcugggauuacaggcac

SEQ ID NO: 495161 - RNA, 32 nt, Human
ucagccucccuaguagcugggauuacaggcau

SEQ ID NO: 495162 - RNA, 32 nt, Human
ucagccucccuaguagcugggauuacaggcgc

SEQ ID NO: 495163 - RNA, 32 nt, Human
ucagccucccuaguagcugggauuacaggugc

SEQ ID NO: 495164 - RNA, 32 nt, Human
ucagccucccuaguggcugggauuacaggcgc

SEQ ID NO: 495165 - RNA, 32 nt, Human
ucagccuccgaaagugcugggauuacaggcgu

SEQ ID NO: 495166 - RNA, 32 nt, Human
ucagccuccgaaagugcugggauuacaguugu

SEQ ID NO: 495167 - RNA, 32 nt, Human
ucagccuccgaaguagcugggauuacaggcgc

SEQ ID NO: 495168 - RNA, 32 nt, Human
ucagccuccggaguagcugggauuacaggcac

SEQ ID NO: 495169 - RNA, 32 nt, Human
ucagccuccggaguagcugggauuacaggcau

SEQ ID NO: 495170 - RNA, 32 nt, Human
ucagccuccggaguagcugggauuacaggcgu

SEQ ID NO: 495171 - RNA, 32 nt, Human
ucagccuccggcccuggaacccucuccaggga

SEQ ID NO: 495172 - RNA, 32 nt, Human
ucagccuccguuuuguucucucuccuuuuccu

SEQ ID NO: 495173 - RNA, 32 nt, Human
ucagccuccuaaagcacugggauuacaggcuu

SEQ ID NO: 495174 - RNA, 32 nt, Human
ucagccuccuaaagcacugggauuacaggugu

SEQ ID NO: 495175 - RNA, 32 nt, Human
ucagccuccuaaagugcugggauuacaggccu

SEQ ID NO: 495176 - RNA, 32 nt, Human
ucagccuccuaaagugcugggauuauagcugu

SEQ ID NO: 495177 - RNA, 32 nt, Human
ucagccuccuaaguaccugggauuacaggcau

SEQ ID NO: 495178 - RNA, 32 nt, Human
ucagccuccuaaguagcugggauuacaggaaa

SEQ ID NO: 495179 - RNA, 32 nt, Human
ucagccuccuaaguagcugggauuacaggcac

SEQ ID NO: 495180 - RNA, 32 nt, Human
ucagccuccuaaguagcugggauuacaggcau

SEQ ID NO: 495181 - RNA, 32 nt, Human
ucagccuccuaaguagcugggauuacaggcgc

SEQ ID NO: 495182 - RNA, 32 nt, Human
ucagccuccuaaguaucugggauuacaggcau

SEQ ID NO: 495183 - RNA, 32 nt, Human
ucagccuccuagagugcugggauuacagacau

SEQ ID NO: 495184 - RNA, 32 nt, Human
ucagccuccuagauaacugggauuacaggugc

SEQ ID NO: 495185 - RNA, 32 nt, Human
ucagccuccugaauagcugggauuacaggcac

SEQ ID NO: 495186 - RNA, 32 nt, Human
ucagccuccugaauagcugggauuacaggugc

SEQ ID NO: 495187 - RNA, 32 nt, Human
ucagccuccugagucgcugggauuacugagau

SEQ ID NO: 495188 - RNA, 24 nt, Human
ucagccuccugggcucaagcaauu

SEQ ID NO: 495189 - RNA, 32 nt, Human
ucagccuccuuccuagagacagacucaugcag

SEQ ID NO: 495190 - RNA, 24 nt, Human
ucagccuccuuguuuguccgguuc

SEQ ID NO: 495191 - RNA, 32 nt, Human
ucagccucgaguagcugggacuacaggcgcau

SEQ ID NO: 495192 - RNA, 32 nt, Human
ucagccucguaaagugcugggauuacaggggu

SEQ ID NO: 495193 - RNA, 32 nt, Human
ucagccucguaaauugcugggauuacaggcau

SEQ ID NO: 495194 - RNA, 23 nt, Human
ucagccucuacccucagaguuca

SEQ ID NO: 495195 - RNA, 32 nt, Human
ucagccucuagccuucacuccugggcuccaaa

SEQ ID NO: 495196 - RNA, 32 nt, Human
ucagccucucaaacugcugggauuauaggcau

SEQ ID NO: 495197 - RNA, 32 nt, Human
ucagccucucaaagagcugggauuacaggcau

SEQ ID NO: 495198 - RNA, 32 nt, Human
ucagccucucaaagcgcugggauuacaggcau

SEQ ID NO: 495199 - RNA, 32 nt, Human
ucagccucucaaagugcugggauuacaagcau

SEQ ID NO: 495200 - RNA, 32 nt, Human
ucagccucucaaagugcugggauuacaggccu

SEQ ID NO: 495201 - RNA, 32 nt, Human
ucagccucucaaagugcugggauuacaggcgu

SEQ ID NO: 495202 - RNA, 32 nt, Human
ucagccucucaaagugcugggauuacaggugu

SEQ ID NO: 495203 - RNA, 32 nt, Human
ucagccucucaaagugcugggauuacaguagg

SEQ ID NO: 495204 - RNA, 32 nt, Human
ucagccucucaaagugcugggauuacgggcau

SEQ ID NO: 495205 - RNA, 32 nt, Human
ucagccucucaaagugcugggauuauaggcgu

SEQ ID NO: 495206 - RNA, 32 nt, Human
ucagccucucaaagugcugggauuauaggcuu

SEQ ID NO: 495207 - RNA, 32 nt, Human
ucagccucucaaguaacugggauuacaggcau

SEQ ID NO: 495208 - RNA, 32 nt, Human
ucagccucucaaguagcggauuacaggcgccc

SEQ ID NO: 495209 - RNA, 32 nt, Human
ucagccucucaaguagcugggauuacaagcau

SEQ ID NO: 495210 - RNA, 32 nt, Human
ucagccucucaaguagcugggauuacagggca

SEQ ID NO: 495211 - RNA, 32 nt, Human
ucagccucucaaguagcugggauuacagggcu

SEQ ID NO: 495212 - RNA, 24 nt, Human
ucagccucuccaaccuggcaccca

SEQ ID NO: 495213 - RNA, 32 nt, Human
ucagccucuccaagugcugggauuacaggcau

SEQ ID NO: 495214 - RNA, 32 nt, Human
ucagccucuccaggcaccaucucccuuccugu

SEQ ID NO: 495215 - RNA, 32 nt, Human
ucagccucuccccucuccuuucucucccugcc

SEQ ID NO: 495216 - RNA, 20 nt, Human
ucagccucuccucugggcuc

SEQ ID NO: 495217 - RNA, 17 nt, Human
ucagccucuccugccuc

SEQ ID NO: 495218 - RNA, 32 nt, Human
ucagccucucgagcagcugggauuacagguau

SEQ ID NO: 495219 - RNA, 32 nt, Human
ucagccucucgaguagcugggauuacaggcac

SEQ ID NO: 495220 - RNA, 32 nt, Human
ucagccucucgaguagcugggauuacaggcau

SEQ ID NO: 495221 - RNA, 32 nt, Human
ucagccucucgaguagcugggauuacaggcgc

SEQ ID NO: 495222 - RNA, 32 nt, Human
ucagccucucgaguagcugggauuauaggcgu

SEQ ID NO: 495223 - RNA, 32 nt, Human
ucagccucucgaguggcugggauuacaggcau

SEQ ID NO: 495224 - RNA, 32 nt, Human
ucagccucucgguggugggauuaugaaugauu

SEQ ID NO: 495225 - RNA, 24 nt, Human
ucagccucucuaaggggcaguuca

SEQ ID NO: 495226 - RNA, 23 nt, Human
ucagccucucuuuggugacguca

SEQ ID NO: 495227 - RNA, 32 nt, Human
ucagccucugaaauugcugggauuacaggcau

SEQ ID NO: 495228 - RNA, 24 nt, Human
ucagccucugaggauccaggcuca

SEQ ID NO: 495229 - RNA, 22 nt, Human
ucagccucugaguuccagguuc

SEQ ID NO: 495230 - RNA, 21 nt, Human
ucagccucugcaaggcacuca

SEQ ID NO: 495231 - RNA, 25 nt, Human
ucagccucugccagacagaguuaga

SEQ ID NO: 495232 - RNA, 24 nt, Human
ucagccucuggcccucuuggcuca

SEQ ID NO: 495233 - RNA, 32 nt, Human
ucagccucugguucuccucgaguccuugggga

SEQ ID NO: 495234 - RNA, 32 nt, Human
ucagccucuguggggcacucagagacgggguu

SEQ ID NO: 495235 - RNA, 32 nt, Human
ucagccucuucaugaucuaucucccucucuuu

SEQ ID NO: 495236 - RNA, 32 nt, Human
ucagccugaaagugcuaggauuacaggcguga

SEQ ID NO: 495237 - RNA, 32 nt, Human
ucagccugaccaacaugaugaaaccccguugc

SEQ ID NO: 495238 - RNA, 32 nt, Human
ucagccugagagaaggagcuggcgagaaccuu

SEQ ID NO: 495239 - RNA, 22 nt, Human
ucagccugagcaacauagcaag

SEQ ID NO: 495240 - RNA, 32 nt, Human
ucagccugagcccugucccugcccuucucugc

SEQ ID NO: 495241 - RNA, 32 nt, Human
ucagccugagccugaguaccgcuaaggcuuua

SEQ ID NO: 495242 - RNA, 32 nt, Human
ucagccugcaccccucccuugucucauagaug

SEQ ID NO: 495243 - RNA, 32 nt, Human
ucagccugcaccugaugccguaucuuuccccu

SEQ ID NO: 495244 - RNA, 32 nt, Human
ucagccugcagaagcagagcaagcauaugaaa

SEQ ID NO: 495245 - RNA, 32 nt, Human
ucagccugcaguaccucuaccuccaggagaac

SEQ ID NO: 495246 - RNA, 32 nt, Human
ucagccugccaaagugcugggauuacuggcgu

SEQ ID NO: 495247 - RNA, 32 nt, Human
ucagccugccaaguagcugggauuacaggcau

SEQ ID NO: 495248 - RNA, 32 nt, Human
ucagccugcccaacauggugaaaccucgucuc

SEQ ID NO: 495249 - RNA, 32 nt, Human
ucagccugccuacuccuucuccaucuuuucuu

SEQ ID NO: 495250 - RNA, 32 nt, Human
ucagccugcucacuucacuucugcauuauauc

SEQ ID NO: 495251 - RNA, 18 nt, Human
ucagccugcucccuggga

SEQ ID NO: 495252 - RNA, 32 nt, Human
ucagccugcucuucucucugguggcuccaccc

SEQ ID NO: 495253 - RNA, 18 nt, Human
ucagccugcugcucagca

SEQ ID NO: 495254 - RNA, 18 nt, Human
ucagccuggaaggcgagg

SEQ ID NO: 495255 - RNA, 32 nt, Human
ucagccuggagaccgaagcgcuucacugagcg

SEQ ID NO: 495256 - RNA, 32 nt, Human
ucagccuggagugagcacagccuggacccugg

SEQ ID NO: 495257 - RNA, 32 nt, Human
ucagccuggauccccagccucugccaacggcc

SEQ ID NO: 495258 - RNA, 32 nt, Human
ucagccuggcacugcccagcccuccagccgua

SEQ ID NO: 495259 - RNA, 32 nt, Human
ucagccuggcagcugcccaucccauaaccaaa

SEQ ID NO: 495260 - RNA, 32 nt, Human
ucagccuggccaacauaaggagaccuaagugc

SEQ ID NO: 495261 - RNA, 32 nt, Human
ucagccuggccaacauaaggagaccuaagugu

SEQ ID NO: 495262 - RNA, 32 nt, Human
ucagccuggccaacaugaugaaaccuugucuu

SEQ ID NO: 495263 - RNA, 23 nt, Human
ucagccuggccaauauggugaaa

SEQ ID NO: 495264 - RNA, 32 nt, Human
ucagccuggccugcucucaccaccuccuccaa

SEQ ID NO: 495265 - RNA, 32 nt, Human
ucagccuggcugucagagcuugcaguguaauc

SEQ ID NO: 495266 - RNA, 18 nt, Human
ucagccugggaagugagg

SEQ ID NO: 495267 - RNA, 32 nt, Human
ucagccugggaggucaaggcugcagugagcug

SEQ ID NO: 495268 - RNA, 32 nt, Human
ucagccugggcaacaagagugaaacuccaucu

SEQ ID NO: 495269 - RNA, 32 nt, Human
ucagccugggcaacacagggagacucaucucu

SEQ ID NO: 495270 - RNA, 32 nt, Human
ucagccugggcaacacagugagacuccaucuc

SEQ ID NO: 495271 - RNA, 23 nt, Human
ucagccugggcaacagagcaaga

SEQ ID NO: 495272 - RNA, 32 nt, Human
ucagccugggcaacagagcgagacuccaucuc

SEQ ID NO: 495273 - RNA, 32 nt, Human
ucagccugggcaacagagugagacuccaucuc

SEQ ID NO: 495274 - RNA, 32 nt, Human
ucagccugggcaacauagcaagauuuugucuc

SEQ ID NO: 495275 - RNA, 32 nt, Human
ucagccugggcaacauagcaauacuccgucuc

SEQ ID NO: 495276 - RNA, 32 nt, Human
ucagccugggcaacauagcaggaccccaucuc

SEQ ID NO: 495277 - RNA, 32 nt, Human
ucagccugggcaacauagugaaaccuggucuc

SEQ ID NO: 495278 - RNA, 32 nt, Human
ucagccugggcaacauagugagaccuccauuu

SEQ ID NO: 495279 - RNA, 32 nt, Human
ucagccugggcaacauggccagaccuccucuc

SEQ ID NO: 495280 - RNA, 32 nt, Human
ucagccugggcaacauggugaaaccucgucuc

SEQ ID NO: 495281 - RNA, 32 nt, Human
ucagccugggcaacauggugaaaccuugucuc

SEQ ID NO: 495282 - RNA, 32 nt, Human
ucagccugggcaacaugguggaacccugucuc

SEQ ID NO: 495283 - RNA, 32 nt, Human
ucagccugggcaauauagugaaaccccaucuc

SEQ ID NO: 495284 - RNA, 32 nt, Human
ucagccugggcaaugugauaaaaccccaucuc

SEQ ID NO: 495285 - RNA, 32 nt, Human
ucagccugggcagcuucccccugccuuuugca

SEQ ID NO: 495286 - RNA, 19 nt, Human
ucagccugggcgaccgaga

SEQ ID NO: 495287 - RNA, 32 nt, Human
ucagccuggggagcugaaggggagacgcgucu

SEQ ID NO: 495288 - RNA, 18 nt, Human
ucagccuggggggcucca

SEQ ID NO: 495289 - RNA, 22 nt, Human
ucagccugggugacagagcaag

SEQ ID NO: 495290 - RNA, 23 nt, Human
ucagccugggugacagagcaaga

SEQ ID NO: 495291 - RNA, 23 nt, Human
ucagccugguauggaaagcaagg

SEQ ID NO: 495292 - RNA, 20 nt, Human
ucagccuggucccaccccca

SEQ ID NO: 495293 - RNA, 32 nt, Human
ucagccuguccgauuccuccucccucuggccg

SEQ ID NO: 495294 - RNA, 22 nt, Human
ucagccugucuccagggcugcu

SEQ ID NO: 495295 - RNA, 18 nt, Human
ucagccugucugcucucu

SEQ ID NO: 495296 - RNA, 20 nt, Human
ucagccugugaccagcucuu

SEQ ID NO: 495297 - RNA, 32 nt, Human
ucagccuguggagucugaguuuugaaggaugu

SEQ ID NO: 495298 - RNA, 32 nt, Human
ucagccuguggcccagcacuggucaagaaaac

SEQ ID NO: 495299 - RNA, 32 nt, Human
ucagccuucaaacccagcaaacagucagcuau

SEQ ID NO: 495300 - RNA, 18 nt, Human
ucagccuucagguggaga

SEQ ID NO: 495301 - RNA, 32 nt, Human
ucagccuuccaaaauguugggauuacaggcgu

SEQ ID NO: 495302 - RNA, 32 nt, Human
ucagccuuccaaagugcugggaugacagcgug

SEQ ID NO: 495303 - RNA, 32 nt, Human
ucagccuuccaaagugcugggauuacaggcau

SEQ ID NO: 495304 - RNA, 32 nt, Human
ucagccuuccaaagugcugggauuacaggcgu

SEQ ID NO: 495305 - RNA, 32 nt, Human
ucagccuuccaaagugcugggauuacaggugu

SEQ ID NO: 495306 - RNA, 32 nt, Human
ucagccuuccaaagugcugggauucugggugu

SEQ ID NO: 495307 - RNA, 32 nt, Human
ucagccuuccaaaguguugggauuauaggcgu

SEQ ID NO: 495308 - RNA, 32 nt, Human
ucagccuuccaagaagcugggauuacaagcgc

SEQ ID NO: 495309 - RNA, 32 nt, Human
ucagccuuccaaguagcugggauuacaagugc

SEQ ID NO: 495310 - RNA, 32 nt, Human
ucagccuuccaaguagcugggauuacaggagu

SEQ ID NO: 495311 - RNA, 32 nt, Human
ucagccuuccaaguagcugggauuacaggugu

SEQ ID NO: 495312 - RNA, 32 nt, Human
ucagccuucccaagguucuauccuguuccgag

SEQ ID NO: 495313 - RNA, 32 nt, Human
ucagccuucccaagugcugggauuacaggugu

SEQ ID NO: 495314 - RNA, 32 nt, Human
ucagccuucccaccagcccuggagaggaggaa

SEQ ID NO: 495315 - RNA, 32 nt, Human
ucagccuucccuguucuccagccuaggugguu

SEQ ID NO: 495316 - RNA, 32 nt, Human
ucagccuuccgaguagcugggauuacaggcac

SEQ ID NO: 495317 - RNA, 32 nt, Human
ucagccuuccgaguagcugggauuacaggcgc

SEQ ID NO: 495318 - RNA, 32 nt, Human
ucagccuuccgaguagcugggauuacaggcuc

SEQ ID NO: 495319 - RNA, 32 nt, Human
ucagccuuccgaguagcugggauuacaggugc

SEQ ID NO: 495320 - RNA, 32 nt, Human
ucagccuuccgaguagcugggauuacaggugu

SEQ ID NO: 495321 - RNA, 32 nt, Human
ucagccuucggccucagaauggggccugcacu

SEQ ID NO: 495322 - RNA, 32 nt, Human
ucagccuucuaaagugcugggauuacaggcgu

SEQ ID NO: 495323 - RNA, 32 nt, Human
ucagccuucucccuccccagggccacuuguug

SEQ ID NO: 495324 - RNA, 32 nt, Human
ucagccuucuuuucccuucccugagggccggc

SEQ ID NO: 495325 - RNA, 32 nt, Human
ucagccuugaacugcagcgucaccucuucccu

SEQ ID NO: 495326 - RNA, 32 nt, Human
ucagccuugcagauauguguggcauuuacuag

SEQ ID NO: 495327 - RNA, 32 nt, Human
ucagccuugcagccccgcgcccggagcaucuc

SEQ ID NO: 495328 - RNA, 18 nt, Human
ucagccuugccugcuuuc

SEQ ID NO: 495329 - RNA, 32 nt, Human
ucagccuugccugcuuucaucucucccagcuu

SEQ ID NO: 495330 - RNA, 32 nt, Human
ucagccuugccuggcucuccuuguagcagauu

SEQ ID NO: 495331 - RNA, 32 nt, Human
ucagccuugugagucaccuggcaggccccagc

SEQ ID NO: 495332 - RNA, 32 nt, Human
ucagccuuucaaguggcugggaugacuacagg

SEQ ID NO: 495333 - RNA, 32 nt, Human
ucagccuuucaucuauccauccuuccucuuua

SEQ ID NO: 495334 - RNA, 21 nt, Human
ucagccuuuccccuccccucc

SEQ ID NO: 495335 - RNA, 32 nt, Human
ucagccuuuguaucuccuuggccaaagcaagu

SEQ ID NO: 495336 - RNA, 32 nt, Human
ucagccuuuugcccaacuugugucuacugucg

SEQ ID NO: 495337 - RNA, 32 nt, Human
ucagcgacccaaagugcugggauuacaggugu

SEQ ID NO: 495338 - RNA, 32 nt, Human
ucagcgacuugggaggcugagguggagaauug

SEQ ID NO: 495339 - RNA, 32 nt, Human
ucagcgagaaacugugcggagcuccagcagcu

SEQ ID NO: 495340 - RNA, 32 nt, Human
ucagcgagagugagcuggauguggccgggcug

SEQ ID NO: 495341 - RNA, 32 nt, Human
ucagcgagcagguguguguggguccuccacca

SEQ ID NO: 495342 - RNA, 32 nt, Human
ucagcgaggagccauaaugugcauaugugcac

SEQ ID NO: 495343 - RNA, 32 nt, Human
ucagcgagugaguggaggggaagucaaggugc

SEQ ID NO: 495344 - RNA, 32 nt, Human
ucagcgcacaagucaguguaaaccacuuagau

SEQ ID NO: 495345 - RNA, 32 nt, Human
ucagcgcaguggagaaggcucacaguuaccua

SEQ ID NO: 495346 - RNA, 20 nt, Human
ucagcgcaucugcuacagca

SEQ ID NO: 495347 - RNA, 32 nt, Human
ucagcgccacugcuccugccacagugaggggc

SEQ ID NO: 495348 - RNA, 32 nt, Human
ucagcgcccagccuggggaauuuaaacacucc

SEQ ID NO: 495349 - RNA, 32 nt, Human
ucagcgcggagcugggccgguucuccacagcc

SEQ ID NO: 495350 - RNA, 32 nt, Human
ucagcgcgugagccacacugucuccaccacca

SEQ ID NO: 495351 - RNA, 32 nt, Human
ucagcgcuagggaacugagaccagagaaagaa

SEQ ID NO: 495352 - RNA, 32 nt, Human
ucagcgcucugccuuccagcuagauguuguca

SEQ ID NO: 495353 - RNA, 32 nt, Human
ucagcgcugccccugcccccacccucaccccc

SEQ ID NO: 495354 - RNA, 32 nt, Human
ucagcgcugccucugcuggugccuucuccccc

SEQ ID NO: 495355 - RNA, 32 nt, Human
ucagcgcugggugggaaggcauugagaaugga

SEQ ID NO: 495356 - RNA, 19 nt, Human
ucagcggaacagggugaga

SEQ ID NO: 495357 - RNA, 32 nt, Human
ucagcggacagaacugggauggauacacacau

SEQ ID NO: 495358 - RNA, 32 nt, Human
ucagcggagccccaggccccggggccggagau

SEQ ID NO: 495359 - RNA, 32 nt, Human
ucagcggagggguuugggagucaggccugggc

SEQ ID NO: 495360 - RNA, 32 nt, Human
ucagcggaggugagaggagaggaggagaaaac

SEQ ID NO: 495361 - RNA, 32 nt, Human
ucagcggcaggcgaagggggcugaggaaagga

SEQ ID NO: 495362 - RNA, 32 nt, Human
ucagcggccaaggggagugacaacagccagac

SEQ ID NO: 495363 - RNA, 21 nt, Human
ucagcggccaucacucugcca

SEQ ID NO: 495364 - RNA, 32 nt, Human
ucagcggccgugacggggccagcuggacacac

SEQ ID NO: 495365 - RNA, 32 nt, Human
ucagcggccuggcagagguuucagcgcugagg

SEQ ID NO: 495366 - RNA, 32 nt, Human
ucagcggcugccccaccauggcuaccugggcc

SEQ ID NO: 495367 - RNA, 32 nt, Human
ucagcgggcaucuccuggagacaggcagacau

SEQ ID NO: 495368 - RNA, 32 nt, Human
ucagcggggccacccagggcucgcgggguccc

SEQ ID NO: 495369 - RNA, 32 nt, Human
ucagcggggugagccuacggccaggaugggug

SEQ ID NO: 495370 - RNA, 32 nt, Human
ucagcguaggugagcuguggccuuuugcgagg

SEQ ID NO: 495371 - RNA, 19 nt, Human
ucagcgucaccuccuccca

SEQ ID NO: 495372 - RNA, 32 nt, Human
ucagcguccaaaugccucagucaugaaauugu

SEQ ID NO: 495373 - RNA, 32 nt, Human
ucagcgucccaaagugcugggauuauaggcgu

SEQ ID NO: 495374 - RNA, 32 nt, Human
ucagcgucccagagugcugggauuacaguugu

SEQ ID NO: 495375 - RNA, 32 nt, Human
ucagcgucccgaagugcugggauuacaggugu

SEQ ID NO: 495376 - RNA, 32 nt, Human
ucagcgucccgaguaacugggauuacaggcac

SEQ ID NO: 495377 - RNA, 32 nt, Human
ucagcgucugcagucaagucucuuguauucgg

SEQ ID NO: 495378 - RNA, 32 nt, Human
ucagcgugaccuggaccugcugggcaggaucc

SEQ ID NO: 495379 - RNA, 32 nt, Human
ucagcguggaaccugaggacgcagggagggag

SEQ ID NO: 495380 - RNA, 32 nt, Human
ucagcguggcuuggacggggccugugucagag

SEQ ID NO: 495381 - RNA, 32 nt, Human
ucagcgugggguggaggagaaguggaguuugg

SEQ ID NO: 495382 - RNA, 32 nt, Human
ucagcguuugcucaguuaagggagagguagag

SEQ ID NO: 495383 - RNA, 20 nt, Human
ucagcuaaaaauggagucua

SEQ ID NO: 495384 - RNA, 32 nt, Human
ucagcuaaaauccuaacuuucuccuuauuucu

SEQ ID NO: 495385 - RNA, 20 nt, Human
ucagcuaaaggaguacagca

SEQ ID NO: 495386 - RNA, 32 nt, Human
ucagcuaagagaagugggagggccagagcuuu

SEQ ID NO: 495387 - RNA, 32 nt, Human
ucagcuaagcuucaguggccugcuccaucccc

SEQ ID NO: 495388 - RNA, 32 nt, Human
ucagcuacaguuuaauuccacacuguuacaga

SEQ ID NO: 495389 - RNA, 32 nt, Human
ucagcuaccccuagcuccuuguggguuggccc

SEQ ID NO: 495390 - RNA, 32 nt, Human
ucagcuaccucacgggaaccagccugcuguuc

SEQ ID NO: 495391 - RNA, 32 nt, Human
ucagcuaccuuuuaaagaggcuaaguuaucuu

SEQ ID NO: 495392 - RNA, 20 nt, Human
ucagcuagaaagaggcuguu

SEQ ID NO: 495393 - RNA, 32 nt, Human
ucagcuagacacacccagcccagauucaacag

SEQ ID NO: 495394 - RNA, 32 nt, Human
ucagcuagacacacucaggaggacuacugagg

SEQ ID NO: 495395 - RNA, 32 nt, Human
ucagcuagccagauuaguaaccucuuugucca

SEQ ID NO: 495396 - RNA, 32 nt, Human
ucagcuaggaagggggaguggcgcuggcaggc

SEQ ID NO: 495397 - RNA, 32 nt, Human
ucagcuaggaggcugaggcaggagaaucacug

SEQ ID NO: 495398 - RNA, 32 nt, Human
ucagcuagucucuccaccuuggccauuuccag

SEQ ID NO: 495399 - RNA, 20 nt, Human
ucagcuauagcugcaguuua

SEQ ID NO: 495400 - RNA, 32 nt, Human
ucagcuaucuugucugguuuucuugagaccuc

SEQ ID NO: 495401 - RNA, 32 nt, Human
ucagcuauggccugggcuccagcuuuggcucu

SEQ ID NO: 495402 - RNA, 32 nt, Human
ucagcuaugucaggaaauauggcuggacauaa

SEQ ID NO: 495403 - RNA, 32 nt, Human
ucagcuauucucggaagagagaagggagaggg

SEQ ID NO: 495404 - RNA, 32 nt, Human
ucagcuauugaggaggcugaggcaggagaauu

SEQ ID NO: 495405 - RNA, 32 nt, Human
ucagcuauuuuuaaaguuugugaauggagugu

SEQ ID NO: 495406 - RNA, 32 nt, Human
ucagcucaaaaacaagaagugaagccagacag

SEQ ID NO: 495407 - RNA, 31 nt, Human
ucagcucaaagcuagaaacaccaaggucuuu

SEQ ID NO: 495408 - RNA, 32 nt, Human
ucagcucaacaucuucuguuaguuauagcugc

SEQ ID NO: 495409 - RNA, 18 nt, Human
ucagcucaaugcuacaca

SEQ ID NO: 495410 - RNA, 32 nt, Human
ucagcucacagcaaccuccgccucccagguuc

SEQ ID NO: 495411 - RNA, 32 nt, Human
ucagcucacagcaaccuccgccucccggguuc

SEQ ID NO: 495412 - RNA, 32 nt, Human
ucagcucaccaaaucucugccucccaggcuua

SEQ ID NO: 495413 - RNA, 32 nt, Human
ucagcucaccacaaccuccgccucccagguuc

SEQ ID NO: 495414 - RNA, 32 nt, Human
ucagcucaccgcaaccuccaccuccaggguug

SEQ ID NO: 495415 - RNA, 32 nt, Human
ucagcucaccgcaaccuccacucgcagguuca

SEQ ID NO: 495416 - RNA, 32 nt, Human
ucagcucaccgcaaccuccgccucccggguuc

SEQ ID NO: 495417 - RNA, 32 nt, Human
ucagcucaccgcaaccucugccucccagauuc

SEQ ID NO: 495418 - RNA, 32 nt, Human
ucagcucaccgcauccuccaccucccagguuc

SEQ ID NO: 495419 - RNA, 32 nt, Human
ucagcucaccucaaccuccgccucccggguuc

SEQ ID NO: 495420 - RNA, 32 nt, Human
ucagcucaccucucccuccaccuccucuccac

SEQ ID NO: 495421 - RNA, 32 nt, Human
ucagcucaccucucuguauccuugcccugugg

SEQ ID NO: 495422 - RNA, 32 nt, Human
ucagcucacggcaaccuccgccucccggguuc

SEQ ID NO: 495423 - RNA, 32 nt, Human
ucagcucacuacaaccuccgccucccauguuc

SEQ ID NO: 495424 - RNA, 32 nt, Human
ucagcucacuacaaccuccugcuccuggguuc

SEQ ID NO: 495425 - RNA, 32 nt, Human
ucagcucacuauaagcuccaccucccagguuc

SEQ ID NO: 495426 - RNA, 32 nt, Human
ucagcucacucugcaaccuccacuucccaggu

SEQ ID NO: 495427 - RNA, 32 nt, Human
ucagcucacugaaccucugccucccaggucaa

SEQ ID NO: 495428 - RNA, 32 nt, Human
ucagcucacugcaaacuccaccucccagguuc

SEQ ID NO: 495429 - RNA, 32 nt, Human
ucagcucacugcaaacucugccucccgaauuc

SEQ ID NO: 495430 - RNA, 32 nt, Human
ucagcucacugcaacaccgccucccggguuca

SEQ ID NO: 495431 - RNA, 32 nt, Human
ucagcucacugcaacauccaccuccuggguuc

SEQ ID NO: 495432 - RNA, 32 nt, Human
ucagcucacugcaacauccgccucugggguuc

SEQ ID NO: 495433 - RNA, 32 nt, Human
ucagcucacugcaaccacugccucccaggcuc

SEQ ID NO: 495434 - RNA, 32 nt, Human
ucagcucacugcaaccuacgccuucuggguuc

SEQ ID NO: 495435 - RNA, 32 nt, Human
ucagcucacugcaaccuccaccucccagacuc

SEQ ID NO: 495436 - RNA, 32 nt, Human
ucagcucacugcaaccuccaccucccaggauc

SEQ ID NO: 495437 - RNA, 32 nt, Human
ucagcucacugcaaccuccaccucccaggcuc

SEQ ID NO: 495438 - RNA, 32 nt, Human
ucagcucacugcaaccuccaccucccaggugc

SEQ ID NO: 495439 - RNA, 32 nt, Human
ucagcucacugcaaccuccaccucccagguuc

SEQ ID NO: 495440 - RNA, 32 nt, Human
ucagcucacugcaaccuccaccucccggguca

SEQ ID NO: 495441 - RNA, 32 nt, Human
ucagcucacugcaaccuccaccucccggguuc

SEQ ID NO: 495442 - RNA, 32 nt, Human
ucagcucacugcaaccuccaccucccggguuu

SEQ ID NO: 495443 - RNA, 32 nt, Human
ucagcucacugcaaccuccaccucccugguuc

SEQ ID NO: 495444 - RNA, 32 nt, Human
ucagcucacugcaaccuccaccuccggguuca

SEQ ID NO: 495445 - RNA, 32 nt, Human
ucagcucacugcaaccuccaccuccuggauuc

SEQ ID NO: 495446 - RNA, 32 nt, Human
ucagcucacugcaaccuccaccuccuggguuc

SEQ ID NO: 495447 - RNA, 32 nt, Human
ucagcucacugcaaccuccaccuccuggguug

SEQ ID NO: 495448 - RNA, 32 nt, Human
ucagcucacugcaaccuccaccucgcagguuc

SEQ ID NO: 495449 - RNA, 32 nt, Human
ucagcucacugcaaccuccaccucucagguuc

SEQ ID NO: 495450 - RNA, 32 nt, Human
ucagcucacugcaaccuccaccucuuauguuc

SEQ ID NO: 495451 - RNA, 32 nt, Human
ucagcucacugcaaccuccaccuugcgugucu

SEQ ID NO: 495452 - RNA, 32 nt, Human
ucagcucacugcaaccuccaucuccagguuuc

SEQ ID NO: 495453 - RNA, 32 nt, Human
ucagcucacugcaaccuccaucucccggauuc

SEQ ID NO: 495454 - RNA, 32 nt, Human
ucagcucacugcaaccuccaucuccuggauuc

SEQ ID NO: 495455 - RNA, 32 nt, Human
ucagcucacugcaaccucccccuccuggguuc

SEQ ID NO: 495456 - RNA, 32 nt, Human
ucagcucacugcaaccuccgcaucccggguuc

SEQ ID NO: 495457 - RNA, 32 nt, Human
ucagcucacugcaaccuccgcccccuggguuc

SEQ ID NO: 495458 - RNA, 32 nt, Human
ucagcucacugcaaccuccgccucccaaguuc

SEQ ID NO: 495459 - RNA, 32 nt, Human
ucagcucacugcaaccuccgccucccagguuc

SEQ ID NO: 495460 - RNA, 32 nt, Human
ucagcucacugcaaccuccgccucccggguuc

SEQ ID NO: 495461 - RNA, 32 nt, Human
ucagcucacugcaaccuccgccuccugagguu

SEQ ID NO: 495462 - RNA, 32 nt, Human
ucagcucacugcaaccuccgccuccugggauc

SEQ ID NO: 495463 - RNA, 32 nt, Human
ucagcucacugcaaccuccgccuccuggguuc

SEQ ID NO: 495464 - RNA, 32 nt, Human
ucagcucacugcaaccuccgccucuuggguuc

SEQ ID NO: 495465 - RNA, 32 nt, Human
ucagcucacugcaaccuccgccugcuggguuc

SEQ ID NO: 495466 - RNA, 32 nt, Human
ucagcucacugcaaccuccgccuucuggguuc

SEQ ID NO: 495467 - RNA, 32 nt, Human
ucagcucacugcaaccuccgguucccgggcuc

SEQ ID NO: 495468 - RNA, 32 nt, Human
ucagcucacugcaaccuccgucuccaggguuc

SEQ ID NO: 495469 - RNA, 32 nt, Human
ucagcucacugcaaccuccgucucuacuaaaa

SEQ ID NO: 495470 - RNA, 32 nt, Human
ucagcucacugcaaccuccuccucccggguuc

SEQ ID NO: 495471 - RNA, 32 nt, Human
ucagcucacugcaaccuccuccuucuggguuc

SEQ ID NO: 495472 - RNA, 32 nt, Human
ucagcucacugcaaccucgaccucuuggguuc

SEQ ID NO: 495473 - RNA, 32 nt, Human
ucagcucacugcaaccucuaccuccuggguuc

SEQ ID NO: 495474 - RNA, 32 nt, Human
ucagcucacugcaaccucucucucccggguuc

SEQ ID NO: 495475 - RNA, 32 nt, Human
ucagcucacugcaaccucugccuccagaguuc

SEQ ID NO: 495476 - RNA, 32 nt, Human
ucagcucacugcaaccucugccucccagguuc

SEQ ID NO: 495477 - RNA, 32 nt, Human
ucagcucacugcaaccucugccucccaguuca

SEQ ID NO: 495478 - RNA, 32 nt, Human
ucagcucacugcaaccucugccucccggauuc

SEQ ID NO: 495479 - RNA, 32 nt, Human
ucagcucacugcaaccucugccucccggauuu

SEQ ID NO: 495480 - RNA, 32 nt, Human
ucagcucacugcaaccucugccucccggguuc

SEQ ID NO: 495481 - RNA, 32 nt, Human
ucagcucacugcaaccucugccuucuggauuc

SEQ ID NO: 495482 - RNA, 32 nt, Human
ucagcucacugcaaccucugcuucccggguuc

SEQ ID NO: 495483 - RNA, 32 nt, Human
ucagcucacugcaaccucugucucccggguuc

SEQ ID NO: 495484 - RNA, 32 nt, Human
ucagcucacugcaaccugugccucccggcuuc

SEQ ID NO: 495485 - RNA, 32 nt, Human
ucagcucacugcaaccuucaccucccagguuc

SEQ ID NO: 495486 - RNA, 32 nt, Human
ucagcucacugcaaccuucgccucccagcuuc

SEQ ID NO: 495487 - RNA, 32 nt, Human
ucagcucacugcaaccuuggccucccguguuc

SEQ ID NO: 495488 - RNA, 32 nt, Human
ucagcucacugcaaccuuugucucccgggcuc

SEQ ID NO: 495489 - RNA, 32 nt, Human
ucagcucacugcaacguccaccuccuggguuc

SEQ ID NO: 495490 - RNA, 32 nt, Human
ucagcucacugcaacguccaccucuugaguuc

SEQ ID NO: 495491 - RNA, 32 nt, Human
ucagcucacugcaacgucugccucccggguuc

SEQ ID NO: 495492 - RNA, 32 nt, Human
ucagcucacugcaacuuccaccucccagguuc

SEQ ID NO: 495493 - RNA, 32 nt, Human
ucagcucacugcaacuuccgcaucccagguuc

SEQ ID NO: 495494 - RNA, 32 nt, Human
ucagcucacugcaacuucugccucccagguuc

SEQ ID NO: 495495 - RNA, 32 nt, Human
ucagcucacugcaagcuccaacucccggguuc

SEQ ID NO: 495496 - RNA, 32 nt, Human
ucagcucacugcaagcuccaccucccggguuc

SEQ ID NO: 495497 - RNA, 32 nt, Human
ucagcucacugcaagcuccaccucccggguuu

SEQ ID NO: 495498 - RNA, 32 nt, Human
ucagcucacugcaagcuccaccuuccggguuc

SEQ ID NO: 495499 - RNA, 32 nt, Human
ucagcucacugcaagcuccgccucccagguuc

SEQ ID NO: 495500 - RNA, 32 nt, Human
ucagcucacugcaagcuccgccucccggguac

SEQ ID NO: 495501 - RNA, 32 nt, Human
ucagcucacugcaagcuccgccuccucccggg

SEQ ID NO: 495502 - RNA, 32 nt, Human
ucagcucacugcaagcucuaccucuugguuca

SEQ ID NO: 495503 - RNA, 32 nt, Human
ucagcucacugcaagcucugccucccggguuc

SEQ ID NO: 495504 - RNA, 32 nt, Human
ucagcucacugcaagcucugccucucagguuc

SEQ ID NO: 495505 - RNA, 32 nt, Human
ucagcucacugcaaucuccaccuccuggguuc

SEQ ID NO: 495506 - RNA, 32 nt, Human
ucagcucacugcaaucuccgccucccggguuc

SEQ ID NO: 495507 - RNA, 32 nt, Human
ucagcucacugcaaucuucaccuccuaggcuc

SEQ ID NO: 495508 - RNA, 32 nt, Human
ucagcucacugcacccuccgccucucggguuc

SEQ ID NO: 495509 - RNA, 32 nt, Human
ucagcucacugcacccuugaccucccauacuc

SEQ ID NO: 495510 - RNA, 32 nt, Human
ucagcucacugcagccacugccucccagguuc

SEQ ID NO: 495511 - RNA, 32 nt, Human
ucagcucacugcagcccccgccucccagguuc

SEQ ID NO: 495512 - RNA, 32 nt, Human
ucagcucacugcagccuccaacucucugguuc

SEQ ID NO: 495513 - RNA, 32 nt, Human
ucagcucacugcagccuccaccucccagguuc

SEQ ID NO: 495514 - RNA, 32 nt, Human
ucagcucacugcagccuccaccuccuggguuc

SEQ ID NO: 495515 - RNA, 32 nt, Human
ucagcucacugcagccuccacuuccuggguuc

SEQ ID NO: 495516 - RNA, 32 nt, Human
ucagcucacugcagccuccgucucccagguuc

SEQ ID NO: 495517 - RNA, 32 nt, Human
ucagcucacugcagccucugccucccggguuc

SEQ ID NO: 495518 - RNA, 32 nt, Human
ucagcucacugcagccucugucucccgggcuc

SEQ ID NO: 495519 - RNA, 32 nt, Human
ucagcucacugcagcuuugaccuugccgggcu

SEQ ID NO: 495520 - RNA, 32 nt, Human
ucagcucacugcagucucugccucccggguuc

SEQ ID NO: 495521 - RNA, 32 nt, Human
ucagcucacugcauccucugccucccggguuc

SEQ ID NO: 495522 - RNA, 32 nt, Human
ucagcucacugcgaccuccaccucccauguuc

SEQ ID NO: 495523 - RNA, 32 nt, Human
ucagcucacugcgaccuccaccuccuggguuc

SEQ ID NO: 495524 - RNA, 32 nt, Human
ucagcucacuggcaacaucugccucccggguu

SEQ ID NO: 495525 - RNA, 32 nt, Human
ucagcucacuguaaccuccaccucccggauuc

SEQ ID NO: 495526 - RNA, 32 nt, Human
ucagcucacuguacuccagcccggguucaagc

SEQ ID NO: 495527 - RNA, 32 nt, Human
ucagcucagcacucagucagugguaacuugug

SEQ ID NO: 495528 - RNA, 32 nt, Human
ucagcucagcagagcaagaccccagagaugcu

SEQ ID NO: 495529 - RNA, 32 nt, Human
ucagcucagcucccugccuugucacauuuguc

SEQ ID NO: 495530 - RNA, 32 nt, Human
ucagcucagcuggccuggaaugggccaggcug

SEQ ID NO: 495531 - RNA, 32 nt, Human
ucagcucaggacugcuauuuagcuccucuuaa

SEQ ID NO: 495532 - RNA, 32 nt, Human
ucagcucagggguguccugggccagguagugg

SEQ ID NO: 495533 - RNA, 32 nt, Human
ucagcucagugcaaccuccgcccccugggauc

SEQ ID NO: 495534 - RNA, 32 nt, Human
ucagcucagugcaaccuccgccucccgaguuc

SEQ ID NO: 495535 - RNA, 32 nt, Human
ucagcucauccaggcuggacaaaccaguuccu

SEQ ID NO: 495536 - RNA, 32 nt, Human
ucagcucauccuggggaugucugcucauggga

SEQ ID NO: 495537 - RNA, 22 nt, Human
ucagcucauggagcggcaauag

SEQ ID NO: 495538 - RNA, 32 nt, Human
ucagcucauugcaaccucugccuaacggguuc

SEQ ID NO: 495539 - RNA, 32 nt, Human
ucagcucauugcaaccucugucucccagguuc

SEQ ID NO: 495540 - RNA, 32 nt, Human
ucagcucauugcaacuuccaccuccuggguug

SEQ ID NO: 495541 - RNA, 18 nt, Human
ucagcuccaaaagcaucu

SEQ ID NO: 495542 - RNA, 17 nt, Human
ucagcuccaaacgccuc

SEQ ID NO: 495543 - RNA, 21 nt, Human
ucagcuccaaacuuagcuuuu

SEQ ID NO: 495544 - RNA, 20 nt, Human
ucagcuccaaagcgaaucuu

SEQ ID NO: 495545 - RNA, 32 nt, Human
ucagcuccaagcggaagauuuccccagcuuuc

SEQ ID NO: 495546 - RNA, 21 nt, Human
ucagcuccaaggagcgcgcuc

SEQ ID NO: 495547 - RNA, 32 nt, Human
ucagcuccaauaaacugugcucugccuacccu

SEQ ID NO: 495548 - RNA, 32 nt, Human
ucagcuccacacaaagcugcagaaggacgaaa

SEQ ID NO: 495549 - RNA, 19 nt, Human
ucagcuccaccaaacgcuc

SEQ ID NO: 495550 - RNA, 19 nt, Human
ucagcuccagcuccaggcu

SEQ ID NO: 495551 - RNA, 22 nt, Human
ucagcuccauuucuggagucug

SEQ ID NO: 495552 - RNA, 32 nt, Human
ucagcucccagcccagcuuccaugcagcuuua

SEQ ID NO: 495553 - RNA, 32 nt, Human
ucagcucccaggcuaggcuguggccgccggug

SEQ ID NO: 495554 - RNA, 32 nt, Human
ucagcuccccucggagaagagcuguucacagc

SEQ ID NO: 495555 - RNA, 32 nt, Human
ucagcucccgggacguuuggagcugcugcuaa

SEQ ID NO: 495556 - RNA, 32 nt, Human
ucagcucccugcaaccuccgccucccggguuc

SEQ ID NO: 495557 - RNA, 32 nt, Human
ucagcucccugccuguuucccguaaggcugua

SEQ ID NO: 495558 - RNA, 32 nt, Human
ucagcucccugugcgacccuccagggaugcag

SEQ ID NO: 495559 - RNA, 28 nt, Human
ucagcucccugugcugccugauuucuca

SEQ ID NO: 495560 - RNA, 32 nt, Human
ucagcucccuuuaaccuccagcuccuggguuc

SEQ ID NO: 495561 - RNA, 32 nt, Human
ucagcuccgaccauguugcugugugauuaucu

SEQ ID NO: 495562 - RNA, 32 nt, Human
ucagcuccgcuggucugucugugcauccacug

SEQ ID NO: 495563 - RNA, 20 nt, Human
ucagcuccggguacacuucc

SEQ ID NO: 495564 - RNA, 32 nt, Human
ucagcuccuaaauuuggcuggcuuuguuuuuc

SEQ ID NO: 495565 - RNA, 32 nt, Human
ucagcuccuagagggagauuguuagaucauga

SEQ ID NO: 495566 - RNA, 32 nt, Human
ucagcuccuauccucuggacggggagcaucau

SEQ ID NO: 495567 - RNA, 32 nt, Human
ucagcuccuaucucuguauggccuggucuuuc

SEQ ID NO: 495568 - RNA, 32 nt, Human
ucagcuccuaucucuguauggccugguuuuuc

SEQ ID NO: 495569 - RNA, 32 nt, Human
ucagcuccuccagccccaccucccagcauggu

SEQ ID NO: 495570 - RNA, 32 nt, Human
ucagcuccucccccugccguugguuaauaaac

SEQ ID NO: 495571 - RNA, 24 nt, Human
ucagcuccuccucuuaggagcuca

SEQ ID NO: 495572 - RNA, 32 nt, Human
ucagcuccugcugcucuuagggaaaggaggcc

SEQ ID NO: 495573 - RNA, 28 nt, Human
ucagcuccuggagcugccucucugcacu

SEQ ID NO: 495574 - RNA, 32 nt, Human
ucagcuccuuccaccacaaccccacgcgccca

SEQ ID NO: 495575 - RNA, 24 nt, Human
ucagcuccuuccugugguuugcca

SEQ ID NO: 495576 - RNA, 32 nt, Human
ucagcuccuugcagauguagcccuugcccauc

SEQ ID NO: 495577 - RNA, 19 nt, Human
ucagcuccuuuacagccuu

SEQ ID NO: 495578 - RNA, 32 nt, Human
ucagcucgaugcagaaccaccaugcuccagac

SEQ ID NO: 495579 - RNA, 32 nt, Human
ucagcucgccgcaaccuccgccucccagguuc

SEQ ID NO: 495580 - RNA, 19 nt, Human
ucagcucgccgugcucugg

SEQ ID NO: 495581 - RNA, 32 nt, Human
ucagcucgcugcaacccccaccucccagguuc

SEQ ID NO: 495582 - RNA, 32 nt, Human
ucagcucgcugcaaccuccaccuccugggcuc

SEQ ID NO: 495583 - RNA, 32 nt, Human
ucagcucgcugcaaccuccaccuccuggguuc

SEQ ID NO: 495584 - RNA, 32 nt, Human
ucagcucgcugcaaccuccaccuuccggguuc

SEQ ID NO: 495585 - RNA, 32 nt, Human
ucagcucuccaucugucucugccuggcaggcg

SEQ ID NO: 495586 - RNA, 22 nt, Human
ucagcucuccuccucuagcuca

SEQ ID NO: 495587 - RNA, 20 nt, Human
ucagcucuccugcugcagca

SEQ ID NO: 495588 - RNA, 32 nt, Human
ucagcucucucaucuccuggaaccauggccag

SEQ ID NO: 495589 - RNA, 32 nt, Human
ucagcucucuggaagguggcccugcccggacc

SEQ ID NO: 495590 - RNA, 32 nt, Human
ucagcucugacagccccuccuccaggaaggcc

SEQ ID NO: 495591 - RNA, 32 nt, Human
ucagcucugacucccaccuccacaccccaaug

SEQ ID NO: 495592 - RNA, 31 nt, Human
ucagcucugacucucccuugccuuaagggga

SEQ ID NO: 495593 - RNA, 32 nt, Human
ucagcucugaguagcugggauuauaggcaugc

SEQ ID NO: 495594 - RNA, 32 nt, Human
ucagcucugccagugcaggcugggcagccugg

SEQ ID NO: 495595 - RNA, 20 nt, Human
ucagcucuggacccccuccc

SEQ ID NO: 495596 - RNA, 23 nt, Human
ucagcucuggaugcuaccccugg

SEQ ID NO: 495597 - RNA, 29 nt, Human
ucagcucuggcgccuucaucccccugccu

SEQ ID NO: 495598 - RNA, 32 nt, Human
ucagcucugucugucugggugcucacgggagg

SEQ ID NO: 495599 - RNA, 32 nt, Human
ucagcucugucugugugggugcucacaggagg

SEQ ID NO: 495600 - RNA, 32 nt, Human
ucagcucugucugugugggugcucacgggagg

SEQ ID NO: 495601 - RNA, 32 nt, Human
ucagcucuuaccucaccucccuccauuuacau

SEQ ID NO: 495602 - RNA, 32 nt, Human
ucagcucuucucucagaaguucagcuguugaa

SEQ ID NO: 495603 - RNA, 32 nt, Human
ucagcucuucugacuuaagugugcaaaauauu

SEQ ID NO: 495604 - RNA, 32 nt, Human
ucagcucuugauacggaaacgagugucuucac

SEQ ID NO: 495605 - RNA, 25 nt, Human
ucagcucuugguuaauuuagguuca

SEQ ID NO: 495606 - RNA, 22 nt, Human
ucagcucuuguuuugcugcugg

SEQ ID NO: 495607 - RNA, 32 nt, Human
ucagcucuuuaagcaucucucuccaaggaaca

SEQ ID NO: 495608 - RNA, 32 nt, Human
ucagcucuuuucuccagcuuuugcaguguccu

SEQ ID NO: 495609 - RNA, 24 nt, Human
ucagcugaaaagugguuggggaug

SEQ ID NO: 495610 - RNA, 32 nt, Human
ucagcugaaacaguccuggacuuucaaaaacc

SEQ ID NO: 495611 - RNA, 32 nt, Human
ucagcugaauuguccaagguugcccagaaggu

SEQ ID NO: 495612 - RNA, 23 nt, Human
ucagcugacgccaggucaggcac

SEQ ID NO: 495613 - RNA, 32 nt, Human
ucagcugagauggugccacugcacuccagccu

SEQ ID NO: 495614 - RNA, 32 nt, Human
ucagcugagcaguggcccuggccacaaaacca

SEQ ID NO: 495615 - RNA, 32 nt, Human
ucagcugaggacacauccccacccugccuccc

SEQ ID NO: 495616 - RNA, 32 nt, Human
ucagcugauucugaccucagcgucuccauggc

SEQ ID NO: 495617 - RNA, 32 nt, Human
ucagcugcaagaacaucaaaccagagugccca

SEQ ID NO: 495618 - RNA, 32 nt, Human
ucagcugcaagucagcaauuucccagguacca

SEQ ID NO: 495619 - RNA, 22 nt, Human
ucagcugcaauucugagggggg

SEQ ID NO: 495620 - RNA, 32 nt, Human
ucagcugccacaacagcuaugccaccacccua

SEQ ID NO: 495621 - RNA, 32 nt, Human
ucagcugccauccugcccuccagggacaacgc

SEQ ID NO: 495622 - RNA, 32 nt, Human
ucagcugccauccuggacuucccugaaugagg

SEQ ID NO: 495623 - RNA, 32 nt, Human
ucagcugcccaggcuggagugugguggcgcca

SEQ ID NO: 495624 - RNA, 19 nt, Human
ucagcugcccugggguccc

SEQ ID NO: 495625 - RNA, 32 nt, Human
ucagcugcccugguggggguugugugagagag

SEQ ID NO: 495626 - RNA, 32 nt, Human
ucagcugcccuuccaaggagcuucugcugcug

SEQ ID NO: 495627 - RNA, 32 nt, Human
ucagcugccgcgcuguugcuaggcaacagcgu

SEQ ID NO: 495628 - RNA, 32 nt, Human
ucagcugccuggggagugagccucccuggucc

SEQ ID NO: 495629 - RNA, 20 nt, Human
ucagcugcgccccccuccca

SEQ ID NO: 495630 - RNA, 32 nt, Human
ucagcugcucagaucccacuuuugccagacgc

SEQ ID NO: 495631 - RNA, 32 nt, Human
ucagcugcuccuccucuccuaggagaccagag

SEQ ID NO: 495632 - RNA, 32 nt, Human
ucagcugcugacacgcagccugcucuggagcc

SEQ ID NO: 495633 - RNA, 32 nt, Human
ucagcugcugcaaccuccaccucccggguuca

SEQ ID NO: 495634 - RNA, 32 nt, Human
ucagcugcuggccugcacucaucaccucuucc

SEQ ID NO: 495635 - RNA, 32 nt, Human
ucagcugcuuugacaaaaugacuggcuccuga

SEQ ID NO: 495636 - RNA, 32 nt, Human
ucagcuggacacugcccaaccgcaccucaggc

SEQ ID NO: 495637 - RNA, 32 nt, Human
ucagcuggagccaagcaaggaaaggguaccag

SEQ ID NO: 495638 - RNA, 32 nt, Human
ucagcuggagggagcauggcagugagccaagg

SEQ ID NO: 495639 - RNA, 32 nt, Human
ucagcuggagggcugcagagccccucccaaua

SEQ ID NO: 495640 - RNA, 32 nt, Human
ucagcuggauguguuuacguggagaggcgugg

SEQ ID NO: 495641 - RNA, 18 nt, Human
ucagcuggccacagccca

SEQ ID NO: 495642 - RNA, 32 nt, Human
ucagcuggcccugcccagccacccuggacaug

SEQ ID NO: 495643 - RNA, 32 nt, Human
ucagcuggcccugcccagccacccuggacgug

SEQ ID NO: 495644 - RNA, 32 nt, Human
ucagcuggcucucaucaggcugcagcccccuc

SEQ ID NO: 495645 - RNA, 32 nt, Human
ucagcugggaccccaaaccuccucagcucacc

SEQ ID NO: 495646 - RNA, 32 nt, Human
ucagcugggacggcuugccucggcuccauggg

SEQ ID NO: 495647 - RNA, 32 nt, Human
ucagcugggaguguccaucaucaggggaagau

SEQ ID NO: 495648 - RNA, 32 nt, Human
ucagcugggccgaaauaagaucacacacauca

SEQ ID NO: 495649 - RNA, 32 nt, Human
ucagcuggggccugggcuguggacagaaggau

SEQ ID NO: 495650 - RNA, 32 nt, Human
ucagcuggggguggaggggcaauuggaaggcu

SEQ ID NO: 495651 - RNA, 32 nt, Human
ucagcugguagaaacagcccuuggggacuaca

SEQ ID NO: 495652 - RNA, 32 nt, Human
ucagcuggucucaaaacuggccacugccucag

SEQ ID NO: 495653 - RNA, 32 nt, Human
ucagcugguggcuguggagcugaguccccucc

SEQ ID NO: 495654 - RNA, 32 nt, Human
ucagcuguaacccucacccacagccugcuggg

SEQ ID NO: 495655 - RNA, 32 nt, Human
ucagcuguaggaaggggccccuuuguaaacaa

SEQ ID NO: 495656 - RNA, 32 nt, Human
ucagcuguaucauuagacuuguauuuagagcg

SEQ ID NO: 495657 - RNA, 32 nt, Human
ucagcugucacuggcgauguccuaggggugcu

SEQ ID NO: 495658 - RNA, 32 nt, Human
ucagcugucaucugcagccucugccuccagcc

SEQ ID NO: 495659 - RNA, 32 nt, Human
ucagcuguccccaucagaggcccuucucccag

SEQ ID NO: 495660 - RNA, 32 nt, Human
ucagcugucugcccucugggcuuggguagggg

SEQ ID NO: 495661 - RNA, 32 nt, Human
ucagcugucuugcccaggcuggaguucagggg

SEQ ID NO: 495662 - RNA, 32 nt, Human
ucagcugucuuguuccaccaguauuuaccagg

SEQ ID NO: 495663 - RNA, 32 nt, Human
ucagcugugauggauauagagaaucagaggca

SEQ ID NO: 495664 - RNA, 32 nt, Human
ucagcugugcaggagccaugaggcaccaaccu

SEQ ID NO: 495665 - RNA, 32 nt, Human
ucagcuguggagugugguuggagaugaagugg

SEQ ID NO: 495666 - RNA, 32 nt, Human
ucagcuguuacccacucugggaccagcagucu

SEQ ID NO: 495667 - RNA, 32 nt, Human
ucagcuguuucauuauugugugccucgagcau

SEQ ID NO: 495668 - RNA, 32 nt, Human
ucagcuguuuguuaguuuuugcuuuauuuaaa

SEQ ID NO: 495669 - RNA, 32 nt, Human
ucagcuuaaaggacacuccuugcagggacuga

SEQ ID NO: 495670 - RNA, 32 nt, Human
ucagcuuaaugcaaccucuaccucccagguuc

SEQ ID NO: 495671 - RNA, 32 nt, Human
ucagcuuacuacagccaggucuccucucugcg

SEQ ID NO: 495672 - RNA, 32 nt, Human
ucagcuuacucaaccucugccucuuggguuuc

SEQ ID NO: 495673 - RNA, 32 nt, Human
ucagcuuacugcaaccucugccucccggguuc

SEQ ID NO: 495674 - RNA, 32 nt, Human
ucagcuuacugcaaccucugucucccggguuc

SEQ ID NO: 495675 - RNA, 32 nt, Human
ucagcuuagacugaggaaaacucuccauuaug

SEQ ID NO: 495676 - RNA, 32 nt, Human
ucagcuuagcagucuuucaugguggaagugac

SEQ ID NO: 495677 - RNA, 32 nt, Human
ucagcuuagcccagagguagcuugguggcaaa

SEQ ID NO: 495678 - RNA, 32 nt, Human
ucagcuuagcuugucuguggaacuccugacgu

SEQ ID NO: 495679 - RNA, 32 nt, Human
ucagcuuauaggaaucucuccaggucaacagg

SEQ ID NO: 495680 - RNA, 31 nt, Human
ucagcuucaauaaaccuguccacaaugaaaa

SEQ ID NO: 495681 - RNA, 32 nt, Human
ucagcuucauucucucucagcugugcagugga

SEQ ID NO: 495682 - RNA, 32 nt, Human
ucagcuuccaacuacaaagacagacuuggucc

SEQ ID NO: 495683 - RNA, 32 nt, Human
ucagcuucccaaaaugcugggauuacaagcau

SEQ ID NO: 495684 - RNA, 32 nt, Human
ucagcuucccaaagugcagggauuacaagugu

SEQ ID NO: 495685 - RNA, 32 nt, Human
ucagcuucccaaagugccgggauuacaagcuu

SEQ ID NO: 495686 - RNA, 32 nt, Human
ucagcuucccaaagugcugggauuacagacau

SEQ ID NO: 495687 - RNA, 32 nt, Human
ucagcuucccaaagugcugggauuacaggcau

SEQ ID NO: 495688 - RNA, 32 nt, Human
ucagcuucccaaagugcugggauuacaggugu

SEQ ID NO: 495689 - RNA, 32 nt, Human
ucagcuucccaaaguguugggauuacccaugu

SEQ ID NO: 495690 - RNA, 32 nt, Human
ucagcuucccaagcagcugggauuacaggugc

SEQ ID NO: 495691 - RNA, 32 nt, Human
ucagcuucccaaggagcugggacugcaggcau

SEQ ID NO: 495692 - RNA, 32 nt, Human
ucagcuucccaaguagcugggauuacaggcac

SEQ ID NO: 495693 - RNA, 32 nt, Human
ucagcuucccaaguagcugggauuacaggcgu

SEQ ID NO: 495694 - RNA, 32 nt, Human
ucagcuucccaaguaguugggauuacaggcgc

SEQ ID NO: 495695 - RNA, 32 nt, Human
ucagcuucccaaguggcugggauuacaggcau

SEQ ID NO: 495696 - RNA, 32 nt, Human
ucagcuucccaaguggcugggauuacaggcgc

SEQ ID NO: 495697 - RNA, 32 nt, Human
ucagcuucccagaguguugugggaaucuuggu

SEQ ID NO: 495698 - RNA, 32 nt, Human
ucagcuucccagcugcccuggcuuagccuucc

SEQ ID NO: 495699 - RNA, 32 nt, Human
ucagcuucccgaguagcugggauuacagaugu

SEQ ID NO: 495700 - RNA, 32 nt, Human
ucagcuucccgaguagcugggauuacaggcac

SEQ ID NO: 495701 - RNA, 32 nt, Human
ucagcuucccgaguagcugggauuacaggcgu

SEQ ID NO: 495702 - RNA, 32 nt, Human
ucagcuucccgaguagcugggauuacagguau

SEQ ID NO: 495703 - RNA, 32 nt, Human
ucagcuucccgaguagcugggauuauaggcac

SEQ ID NO: 495704 - RNA, 32 nt, Human
ucagcuucccuaguaauggauuacaggcgccc

SEQ ID NO: 495705 - RNA, 21 nt, Human
ucagcuucccucccaggauca

SEQ ID NO: 495706 - RNA, 32 nt, Human
ucagcuuccuaaagugcugggauuacaggcgu

SEQ ID NO: 495707 - RNA, 32 nt, Human
ucagcuuccuaaagugcugggauuacuggcau

SEQ ID NO: 495708 - RNA, 32 nt, Human
ucagcuuccuaaguagcugggauuacaggcgu

SEQ ID NO: 495709 - RNA, 32 nt, Human
ucagcuuccucuagcccggcccucucuaaggg

SEQ ID NO: 495710 - RNA, 32 nt, Human
ucagcuucgagccgaggugcagugagcuggug

SEQ ID NO: 495711 - RNA, 23 nt, Human
ucagcuucuaaucccagcacuuu

SEQ ID NO: 495712 - RNA, 32 nt, Human
ucagcuucucaaagugcugggauuacaggcgu

SEQ ID NO: 495713 - RNA, 32 nt, Human
ucagcuucucacuagacuaucucccuuauucu

SEQ ID NO: 495714 - RNA, 21 nt, Human
ucagcuucuccacucaggcuc

SEQ ID NO: 495715 - RNA, 20 nt, Human
ucagcuucucccugccacuu

SEQ ID NO: 495716 - RNA, 32 nt, Human
ucagcuucuccucuggcaucuguuagccgacu

SEQ ID NO: 495717 - RNA, 32 nt, Human
ucagcuucuccuggugggggugcuuugccugu

SEQ ID NO: 495718 - RNA, 32 nt, Human
ucagcuucucucugacugaaggacauucagag

SEQ ID NO: 495719 - RNA, 32 nt, Human
ucagcuucucuggcuccugggccaggugugcg

SEQ ID NO: 495720 - RNA, 32 nt, Human
ucagcuucugccucauaacacacacaagaacu

SEQ ID NO: 495721 - RNA, 32 nt, Human
ucagcuucuggguggugggugggguggggugg

SEQ ID NO: 495722 - RNA, 25 nt, Human
ucagcuucuuuugaagggggcauuu

SEQ ID NO: 495723 - RNA, 17 nt, Human
ucagcuugagcugaaaa

SEQ ID NO: 495724 - RNA, 32 nt, Human
ucagcuugagucugcagaaugccuugcaaauc

SEQ ID NO: 495725 - RNA, 32 nt, Human
ucagcuugccaugauagucugaccucauuaau

SEQ ID NO: 495726 - RNA, 32 nt, Human
ucagcuugcucucuauugaugaugcuuucuuu

SEQ ID NO: 495727 - RNA, 32 nt, Human
ucagcuuggaccaagacaaaauaauuuaguuc

SEQ ID NO: 495728 - RNA, 23 nt, Human
ucagcuugggcaacagagcaaga

SEQ ID NO: 495729 - RNA, 32 nt, Human
ucagcuugggcaacagagugauacuccaucuc

SEQ ID NO: 495730 - RNA, 22 nt, Human
ucagcuuggggagugaacacuu

SEQ ID NO: 495731 - RNA, 23 nt, Human
ucagcuugggugacagagccaga

SEQ ID NO: 495732 - RNA, 30 nt, Human
ucagcuugguucuagugagaaagacagaua

SEQ ID NO: 495733 - RNA, 32 nt, Human
ucagcuuuccaaguagcugggauuacaggcac

SEQ ID NO: 495734 - RNA, 32 nt, Human
ucagcuuuccccaaacuggaaugugucuuugc

SEQ ID NO: 495735 - RNA, 23 nt, Human
ucagcuuugaccuuccaggcuca

SEQ ID NO: 495736 - RNA, 32 nt, Human
ucagcuuugcuccccuauccucugcuuugcca

SEQ ID NO: 495737 - RNA, 32 nt, Human
ucagcuuuuaguaaccugcuguggucagcaua

SEQ ID NO: 495738 - RNA, 32 nt, Human
ucagcuuuuagucccagcuauggaagggagcu

SEQ ID NO: 495739 - RNA, 32 nt, Human
ucagcuuuuauaaggcagcaguaccuguccaa

SEQ ID NO: 495740 - RNA, 32 nt, Human
ucagcuuuuggggguccaucaaaggagguugc

SEQ ID NO: 495741 - RNA, 32 nt, Human
ucaggaaaaagcuucuuuugagauaucuuuag

SEQ ID NO: 495742 - RNA, 32 nt, Human
ucaggaaaaucaggcuguggagucuagaaacu

SEQ ID NO: 495743 - RNA, 32 nt, Human
ucaggaaaauugccuuucucuauuuguuaaga

SEQ ID NO: 495744 - RNA, 32 nt, Human
ucaggaaaauuuaagaaaaagaauaguuaguu

SEQ ID NO: 495745 - RNA, 32 nt, Human
ucaggaaacucauauugugaauauagguauca

SEQ ID NO: 495746 - RNA, 32 nt, Human
ucaggaaacugaggugggagaaucgcuugagc

SEQ ID NO: 495747 - RNA, 32 nt, Human
ucaggaaagccuuuaugguguggcuaaaggag

SEQ ID NO: 495748 - RNA, 32 nt, Human
ucaggaaagguggucaggaaaacucuggcugg

SEQ ID NO: 495749 - RNA, 32 nt, Human
ucaggaaauacugauagacucacuuaguaaaa

SEQ ID NO: 495750 - RNA, 25 nt, Human
ucaggaaauauaauuugagaauacu

SEQ ID NO: 495751 - RNA, 32 nt, Human
ucaggaaaugcacucggcaucugcacaguccu

SEQ ID NO: 495752 - RNA, 32 nt, Human
ucaggaaccaacacaagcacaaccacgggcau

SEQ ID NO: 495753 - RNA, 32 nt, Human
ucaggaaccaguugcuguuucuucccaugucg

SEQ ID NO: 495754 - RNA, 32 nt, Human
ucaggaaccaucaguccccuuguaauaaaggu

SEQ ID NO: 495755 - RNA, 32 nt, Human
ucaggaacccaccaggaucucccuucucccua

SEQ ID NO: 495756 - RNA, 32 nt, Human
ucaggaacccuucucugaucaucaggauucuc

SEQ ID NO: 495757 - RNA, 32 nt, Human
ucaggaaccucagaggagggggcucuggggac

SEQ ID NO: 495758 - RNA, 32 nt, Human
ucaggaacucacaaagcuaugugaccuuacac

SEQ ID NO: 495759 - RNA, 32 nt, Human
ucaggaagacuuggccaggccguguuccgugu

SEQ ID NO: 495760 - RNA, 32 nt, Human
ucaggaagagaaaguagagaagaaaagaauga

SEQ ID NO: 495761 - RNA, 32 nt, Human
ucaggaagagcuauggcccagaaacaacaggg

SEQ ID NO: 495762 - RNA, 32 nt, Human
ucaggaagaggccaggauggugguguggggag

SEQ ID NO: 495763 - RNA, 19 nt, Human
ucaggaagagguguaggga

SEQ ID NO: 495764 - RNA, 32 nt, Human
ucaggaagauacaauuggaauuagcuuuugua

SEQ ID NO: 495765 - RNA, 32 nt, Human
ucaggaagcaccgggaagaugcaggccugcau

SEQ ID NO: 495766 - RNA, 32 nt, Human
ucaggaagccaaggugggcagaugacuugagg

SEQ ID NO: 495767 - RNA, 32 nt, Human
ucaggaagccucucuuucuucacuuaccauua

SEQ ID NO: 495768 - RNA, 32 nt, Human
ucaggaagcgccagagcgccugggacagcuug

SEQ ID NO: 495769 - RNA, 32 nt, Human
ucaggaagcugagacacgagaaucacuugaac

SEQ ID NO: 495770 - RNA, 32 nt, Human
ucaggaagcugaggcaggagaaucacuugaac

SEQ ID NO: 495771 - RNA, 32 nt, Human
ucaggaagcugaggcaggagaaucgcuugaac

SEQ ID NO: 495772 - RNA, 32 nt, Human
ucaggaagcuguagaaggaguguuugucaauu

SEQ ID NO: 495773 - RNA, 32 nt, Human
ucaggaagcugugcagccucugccauugccau

SEQ ID NO: 495774 - RNA, 32 nt, Human
ucaggaaggaagagaccugggcacccaagacc

SEQ ID NO: 495775 - RNA, 32 nt, Human
ucaggaaggagagaucugacugagcgacacca

SEQ ID NO: 495776 - RNA, 32 nt, Human
ucaggaaggcaggagacaggagacgggaccuc

SEQ ID NO: 495777 - RNA, 32 nt, Human
ucaggaaggccuuuucuaucggcagcaauucc

SEQ ID NO: 495778 - RNA, 32 nt, Human
ucaggaagggagcaccggagaagacuugcaca

SEQ ID NO: 495779 - RNA, 32 nt, Human
ucaggaagggagcccagcuggugacaagagag

SEQ ID NO: 495780 - RNA, 32 nt, Human
ucaggaaggggugaaauagcuggcagauacaa

SEQ ID NO: 495781 - RNA, 32 nt, Human
ucaggaagugugagcacgggccuggcuggcac

SEQ ID NO: 495782 - RNA, 32 nt, Human
ucaggaaucuucuccccagagacuccuaagug

SEQ ID NO: 495783 - RNA, 32 nt, Human
ucaggaauggugcuagccucugcaacacgaca

SEQ ID NO: 495784 - RNA, 32 nt, Human
ucaggaauuaugccaccaugcccggcuaguug

SEQ ID NO: 495785 - RNA, 32 nt, Human
ucaggaauucaaaaccagccuggccaacaugc

SEQ ID NO: 495786 - RNA, 32 nt, Human
ucaggaauucaagaccagccuggccaacaugu

SEQ ID NO: 495787 - RNA, 32 nt, Human
ucaggaauucacccaggcagccuggagucagc

SEQ ID NO: 495788 - RNA, 32 nt, Human
ucaggaauucuuugcuuuggcuucugucuguu

SEQ ID NO: 495789 - RNA, 32 nt, Human
ucaggaauugcuuggauugauacauggacccc

SEQ ID NO: 495790 - RNA, 21 nt, Human
ucaggaauuuaggguaugauc

SEQ ID NO: 495791 - RNA, 32 nt, Human
ucaggaauuucagccaauaggagccagccagg

SEQ ID NO: 495792 - RNA, 32 nt, Human
ucaggacaaauagcuaaugcauuuuugccuua

SEQ ID NO: 495793 - RNA, 32 nt, Human
ucaggacacaugcacacgcauguacacagagg

SEQ ID NO: 495794 - RNA, 21 nt, Human
ucaggacagaaagguguccaa

SEQ ID NO: 495795 - RNA, 32 nt, Human
ucaggacagauggggaacagcagaagccgugu

SEQ ID NO: 495796 - RNA, 32 nt, Human
ucaggacaggcagagguggucagggagaaggu

SEQ ID NO: 495797 - RNA, 32 nt, Human
ucaggacagugcagcugcauuuaucagagcac

SEQ ID NO: 495798 - RNA, 32 nt, Human
ucaggacauuuuauagagccuuuuccaguuuu

SEQ ID NO: 495799 - RNA, 32 nt, Human
ucaggaccaagcuucugauccucccaaauauu

SEQ ID NO: 495800 - RNA, 23 nt, Human
ucaggaccacagguucuuaugau

SEQ ID NO: 495801 - RNA, 24 nt, Human
ucaggaccacaguggaguaugauc

SEQ ID NO: 495802 - RNA, 23 nt, Human
ucaggaccacaguuugaaauguc

SEQ ID NO: 495803 - RNA, 32 nt, Human
ucaggaccaccagggcauggaacuggagacca

SEQ ID NO: 495804 - RNA, 32 nt, Human
ucaggaccacccugccaaggcagaauaaaccg

SEQ ID NO: 495805 - RNA, 32 nt, Human
ucaggaccagccucgcaagcauuuuaauagac

SEQ ID NO: 495806 - RNA, 32 nt, Human
ucaggaccagccugaccaacauggugaaaccc

SEQ ID NO: 495807 - RNA, 32 nt, Human
ucaggaccagccuggccaacaugaugaaaccc

SEQ ID NO: 495808 - RNA, 32 nt, Human
ucaggaccagccuggccaauauggugaaaccc

SEQ ID NO: 495809 - RNA, 32 nt, Human
ucaggaccagccuggccagcauggugaaaccc

SEQ ID NO: 495810 - RNA, 32 nt, Human
ucaggaccagccuggucaagauggugaaacuc

SEQ ID NO: 495811 - RNA, 32 nt, Human
ucaggaccauccuggcuaacaccgugaaacuc

SEQ ID NO: 495812 - RNA, 32 nt, Human
ucaggaccauccuggcuaacauggugaaaccc

SEQ ID NO: 495813 - RNA, 32 nt, Human
ucaggacccacugcuguaugagucacaauuau

SEQ ID NO: 495814 - RNA, 32 nt, Human
ucaggacccaggaguccaggccccagccccuc

SEQ ID NO: 495815 - RNA, 32 nt, Human
ucaggacccuccugccuccucuccaggcccuu

SEQ ID NO: 495816 - RNA, 32 nt, Human
ucaggacccuucuacuuuuuccuuccugcccu

SEQ ID NO: 495817 - RNA, 32 nt, Human
ucaggaccucaaggggcucggcuaugagaagg

SEQ ID NO: 495818 - RNA, 24 nt, Human
ucaggaccucacucagaaagacua

SEQ ID NO: 495819 - RNA, 32 nt, Human
ucaggaccuccuugcagcaccagaagaacccu

SEQ ID NO: 495820 - RNA, 32 nt, Human
ucaggaccugcagacaguacaggcuagauaac

SEQ ID NO: 495821 - RNA, 32 nt, Human
ucaggaccuggacaccaugcagcggcugaaca

SEQ ID NO: 495822 - RNA, 32 nt, Human
ucaggaccugggcagugagggagcccgggcag

SEQ ID NO: 495823 - RNA, 32 nt, Human
ucaggacucacaucuucacuccugggccuuug

SEQ ID NO: 495824 - RNA, 20 nt, Human
ucaggacucacucugcugcu

SEQ ID NO: 495825 - RNA, 32 nt, Human
ucaggacucaggcuucuccaucauucucuguu

SEQ ID NO: 495826 - RNA, 32 nt, Human
ucaggacucagugacaucgccucccagccgac

SEQ ID NO: 495827 - RNA, 32 nt, Human
ucaggacuccagcccacugccacugggugaca

SEQ ID NO: 495828 - RNA, 32 nt, Human
ucaggacuccugggucccaggggucggaauug

SEQ ID NO: 495829 - RNA, 32 nt, Human
ucaggacucugagucugaucaugaauuuuaug

SEQ ID NO: 495830 - RNA, 32 nt, Human
ucaggacucugccuccaccacccccgugggca

SEQ ID NO: 495831 - RNA, 32 nt, Human
ucaggacucugccuccaccaccccugugggca

SEQ ID NO: 495832 - RNA, 32 nt, Human
ucaggacugaaauacauuaaugugggugauuu

SEQ ID NO: 495833 - RNA, 32 nt, Human
ucaggacugcacucucuucucggcugcacuaa

SEQ ID NO: 495834 - RNA, 32 nt, Human
ucaggacugcagcuccagccucuucaggccca

SEQ ID NO: 495835 - RNA, 32 nt, Human
ucaggacugcgaagauggugacccugcggaag

SEQ ID NO: 495836 - RNA, 32 nt, Human
ucaggacuggcucccccaucugcuccaaggga

SEQ ID NO: 495837 - RNA, 32 nt, Human
ucaggacugggcccugauugauaacaccucag

SEQ ID NO: 495838 - RNA, 32 nt, Human
ucaggacugggcucucuggccugcuggggcuc

SEQ ID NO: 495839 - RNA, 32 nt, Human
ucaggacugucugagccccacccugcgagggu

SEQ ID NO: 495840 - RNA, 32 nt, Human
ucaggacuuccagaccagccuggucaacaugg

SEQ ID NO: 495841 - RNA, 32 nt, Human
ucaggagaacuccaguagaggguuugggugcu

SEQ ID NO: 495842 - RNA, 32 nt, Human
ucaggagaaucacuugagcucaggaguucuag

SEQ ID NO: 495843 - RNA, 32 nt, Human
ucaggagaccaggaaaauggccacagggcucc

SEQ ID NO: 495844 - RNA, 22 nt, Human
ucaggagaccucuggaauacua

SEQ ID NO: 495845 - RNA, 32 nt, Human
ucaggagaccuggugauuugaccugcaccugu

SEQ ID NO: 495846 - RNA, 32 nt, Human
ucaggagacgguuuugagaucaacuggucuga

SEQ ID NO: 495847 - RNA, 32 nt, Human
ucaggagacucgcuugaaccugggagguggag

SEQ ID NO: 495848 - RNA, 32 nt, Human
ucaggagacugaagcaggagaaucgcucgagc

SEQ ID NO: 495849 - RNA, 32 nt, Human
ucaggagacugagacaggagaaucgcuugagc

SEQ ID NO: 495850 - RNA, 32 nt, Human
ucaggagacugaggcaggagaaucacuugaac

SEQ ID NO: 495851 - RNA, 32 nt, Human
ucaggagacugaggcaggagaaucgcuugaac

SEQ ID NO: 495852 - RNA, 32 nt, Human
ucaggagacugaguuaggagaaucccuugagc

SEQ ID NO: 495853 - RNA, 32 nt, Human
ucaggagagacgcagcccugggggccagcugg

SEQ ID NO: 495854 - RNA, 32 nt, Human
ucaggagagagcuuccuguuucuaaguggccu

SEQ ID NO: 495855 - RNA, 32 nt, Human
ucaggagagagggugaagcggagcagcccgag

SEQ ID NO: 495856 - RNA, 32 nt, Human
ucaggagagcagcagacaagcuggacugggga

SEQ ID NO: 495857 - RNA, 32 nt, Human
ucaggagagccacaggugccacugccuccuca

SEQ ID NO: 495858 - RNA, 32 nt, Human
ucaggagaguuaaggagguugugggugggauu

SEQ ID NO: 495859 - RNA, 22 nt, Human
ucaggagaucaggaccauccug

SEQ ID NO: 495860 - RNA, 32 nt, Human
ucaggagcaaauggaauccaggccuucccaga

SEQ ID NO: 495861 - RNA, 16 nt, Human
ucaggagcagagccag

SEQ ID NO: 495862 - RNA, 32 nt, Human
ucaggagcagaggccggagcuguccaucagca

SEQ ID NO: 495863 - RNA, 32 nt, Human
ucaggagcagggagcuugcggggcgcaggaag

SEQ ID NO: 495864 - RNA, 32 nt, Human
ucaggagcaggggccuggccuccuggguucuu

SEQ ID NO: 495865 - RNA, 20 nt, Human
ucaggagcaggugcugcaca

SEQ ID NO: 495866 - RNA, 32 nt, Human
ucaggagcaguggagcagugagcugccuccuc

SEQ ID NO: 495867 - RNA, 32 nt, Human
ucaggagcaguggcaagaugggagcugguugg

SEQ ID NO: 495868 - RNA, 32 nt, Human
ucaggagcauuuuccugccagucagcacaauu

SEQ ID NO: 495869 - RNA, 32 nt, Human
ucaggagccaagucugcuucugugauauuauc

SEQ ID NO: 495870 - RNA, 32 nt, Human
ucaggagccauuuuucccacauaguauauuag

SEQ ID NO: 495871 - RNA, 32 nt, Human
ucaggagcccagcuggcugggcccagcugccu

SEQ ID NO: 495872 - RNA, 32 nt, Human
ucaggagcccagcugucugcaguggcugacag

SEQ ID NO: 495873 - RNA, 32 nt, Human
ucaggagcccaggaguuugagguuggccugga

SEQ ID NO: 495874 - RNA, 32 nt, Human
ucaggagccgguggugggcgucugaggagaag

SEQ ID NO: 495875 - RNA, 32 nt, Human
ucaggagccugaggcaggagaauugcuugaac

SEQ ID NO: 495876 - RNA, 32 nt, Human
ucaggagccugcaccaguccugccuguccuuc

SEQ ID NO: 495877 - RNA, 18 nt, Human
ucaggagcgcccccuccc

SEQ ID NO: 495878 - RNA, 32 nt, Human
ucaggagcucaagaccagccuggcuaacaugg

SEQ ID NO: 495879 - RNA, 32 nt, Human
ucaggagcucaagaccagccuggguaacaaag

SEQ ID NO: 495880 - RNA, 32 nt, Human
ucaggagcucaagaccagccuggucaacaugg

SEQ ID NO: 495881 - RNA, 32 nt, Human
ucaggagcucaagaucagccugggcaacaugg

SEQ ID NO: 495882 - RNA, 32 nt, Human
ucaggagcucaaggcuggagugucuugacagu

SEQ ID NO: 495883 - RNA, 32 nt, Human
ucaggagcuccgcguagcaccugcccaaccaa

SEQ ID NO: 495884 - RNA, 32 nt, Human
ucaggagcucgagaccagccuggccgacaugg

SEQ ID NO: 495885 - RNA, 32 nt, Human
ucaggagcucgagaccauccugggcaacauaa

SEQ ID NO: 495886 - RNA, 32 nt, Human
ucaggagcucggcuucuugcuccagccgggca

SEQ ID NO: 495887 - RNA, 22 nt, Human
ucaggagcugggauuacaggcg

SEQ ID NO: 495888 - RNA, 32 nt, Human
ucaggagcuggggcuuggggagcugcuggagg

SEQ ID NO: 495889 - RNA, 32 nt, Human
ucaggagcuguguagaaaauguuagucaauca

SEQ ID NO: 495890 - RNA, 32 nt, Human
ucaggagcuugagaccagccugggcaacaugg

SEQ ID NO: 495891 - RNA, 32 nt, Human
ucaggaggaaaaagcuugcauuucuguguguu

SEQ ID NO: 495892 - RNA, 32 nt, Human
ucaggaggaaguggguggggccagauaagaga

SEQ ID NO: 495893 - RNA, 32 nt, Human
ucaggaggagagaaggaaggagaggugaucuc

SEQ ID NO: 495894 - RNA, 32 nt, Human
ucaggaggaucucuugagccugggaggucaag

SEQ ID NO: 495895 - RNA, 32 nt, Human
ucaggaggaugaggcaggagaaucacuugaac

SEQ ID NO: 495896 - RNA, 32 nt, Human
ucaggaggaugaggcaggagaccugcuugaac

SEQ ID NO: 495897 - RNA, 32 nt, Human
ucaggaggaugcugugcacacugugugugaug

SEQ ID NO: 495898 - RNA, 32 nt, Human
ucaggaggcaaaggcaggagaguugcuugaac

SEQ ID NO: 495899 - RNA, 32 nt, Human
ucaggaggccaaagcaggagaauugcuugaac

SEQ ID NO: 495900 - RNA, 32 nt, Human
ucaggaggccaguguggccggggaagaggugg

SEQ ID NO: 495901 - RNA, 32 nt, Human
ucaggaggccgaggcaggagaauugcuggaac

SEQ ID NO: 495902 - RNA, 32 nt, Human
ucaggaggccgaggcaggagaauugcuugaac

SEQ ID NO: 495903 - RNA, 32 nt, Human
ucaggaggccucaggaggccagccugccauga

SEQ ID NO: 495904 - RNA, 32 nt, Human
ucaggaggcuaaggcaggagaaucacuugaac

SEQ ID NO: 495905 - RNA, 32 nt, Human
ucaggaggcuaaggcaggagaaucgcuugaac

SEQ ID NO: 495906 - RNA, 32 nt, Human
ucaggaggcuaaggcgggagaaucacuugaac

SEQ ID NO: 495907 - RNA, 32 nt, Human
ucaggaggcuaaggcgggagaaucgcuugaau

SEQ ID NO: 495908 - RNA, 32 nt, Human
ucaggaggcuacagcaggagaauugcuugaac

SEQ ID NO: 495909 - RNA, 32 nt, Human
ucaggaggcugaaacaggagaaucacuugaac

SEQ ID NO: 495910 - RNA, 32 nt, Human
ucaggaggcugaagcaagagaaucacuugaac

SEQ ID NO: 495911 - RNA, 32 nt, Human
ucaggaggcugaagcaagagaaucgcuugaac

SEQ ID NO: 495912 - RNA, 32 nt, Human
ucaggaggcugaagcaccagaaucucuugaac

SEQ ID NO: 495913 - RNA, 32 nt, Human
ucaggaggcugaagcagaagaacugcuugaac

SEQ ID NO: 495914 - RNA, 32 nt, Human
ucaggaggcugaagcagaagaaucacuugaac

SEQ ID NO: 495915 - RNA, 32 nt, Human
ucaggaggcugaagcaggagaaucacuugaac

SEQ ID NO: 495916 - RNA, 32 nt, Human
ucaggaggcugaagcaggagaaucgcuggaac

SEQ ID NO: 495917 - RNA, 32 nt, Human
ucaggaggcugaagcaggagaaucgcuugaac

SEQ ID NO: 495918 - RNA, 32 nt, Human
ucaggaggcugaagcaggaggauagcuugagc

SEQ ID NO: 495919 - RNA, 32 nt, Human
ucaggaggcugaagcaggaggaucacuugagc

SEQ ID NO: 495920 - RNA, 32 nt, Human
ucaggaggcugaagcaggaugauagcuugauu

SEQ ID NO: 495921 - RNA, 32 nt, Human
ucaggaggcugaagugggaggaucccuugagc

SEQ ID NO: 495922 - RNA, 32 nt, Human
ucaggaggcugacauaggagaauugcuugaau

SEQ ID NO: 495923 - RNA, 32 nt, Human
ucaggaggcugagacaggagaaucaccugaac

SEQ ID NO: 495924 - RNA, 32 nt, Human
ucaggaggcugagacaggagaaucacuugaac

SEQ ID NO: 495925 - RNA, 32 nt, Human
ucaggaggcugagacaggagaaucgcuugaac

SEQ ID NO: 495926 - RNA, 32 nt, Human
ucaggaggcugaggaagaucacuugaacccgg

SEQ ID NO: 495927 - RNA, 32 nt, Human
ucaggaggcugaggaaggagaaucacuugaac

SEQ ID NO: 495928 - RNA, 32 nt, Human
ucaggaggcugaggcaagagaaucacuggaac

SEQ ID NO: 495929 - RNA, 32 nt, Human
ucaggaggcugaggcaagagaaucacuugaac

SEQ ID NO: 495930 - RNA, 32 nt, Human
ucaggaggcugaggcacaagaaucacuugaac

SEQ ID NO: 495931 - RNA, 32 nt, Human
ucaggaggcugaggcagaagaaucacuugaac

SEQ ID NO: 495932 - RNA, 32 nt, Human
ucaggaggcugaggcagaauugcuugaaccca

SEQ ID NO: 495933 - RNA, 32 nt, Human
ucaggaggcugaggcagaauugcuugaaccug

SEQ ID NO: 495934 - RNA, 32 nt, Human
ucaggaggcugaggcaggagaacugcuugaac

SEQ ID NO: 495935 - RNA, 32 nt, Human
ucaggaggcugaggcaggagaagggcgugaac

SEQ ID NO: 495936 - RNA, 32 nt, Human
ucaggaggcugaggcaggagaaucaauugaac

SEQ ID NO: 495937 - RNA, 32 nt, Human
ucaggaggcugaggcaggagaaucacucggac

SEQ ID NO: 495938 - RNA, 32 nt, Human
ucaggaggcugaggcaggagaaucacuugaac

SEQ ID NO: 495939 - RNA, 32 nt, Human
ucaggaggcugaggcaggagaaucacuugaag

SEQ ID NO: 495940 - RNA, 32 nt, Human
ucaggaggcugaggcaggagaaucacuugaau

SEQ ID NO: 495941 - RNA, 32 nt, Human
ucaggaggcugaggcaggagaaucacuugacc

SEQ ID NO: 495942 - RNA, 32 nt, Human
ucaggaggcugaggcaggagaaucacuugaga

SEQ ID NO: 495943 - RNA, 32 nt, Human
ucaggaggcugaggcaggagaaucacuugagc

SEQ ID NO: 495944 - RNA, 32 nt, Human
ucaggaggcugaggcaggagaaucacuuggac

SEQ ID NO: 495945 - RNA, 32 nt, Human
ucaggaggcugaggcaggagaaucacuuguac

SEQ ID NO: 495946 - RNA, 32 nt, Human
ucaggaggcugaggcaggagaaucacuuucac

SEQ ID NO: 495947 - RNA, 32 nt, Human
ucaggaggcugaggcaggagaaucagagguug

SEQ ID NO: 495948 - RNA, 32 nt, Human
ucaggaggcugaggcaggagaaucauuucaac

SEQ ID NO: 495949 - RNA, 32 nt, Human
ucaggaggcugaggcaggagaaucccuugaac

SEQ ID NO: 495950 - RNA, 32 nt, Human
ucaggaggcugaggcaggagaaucgccugaac

SEQ ID NO: 495951 - RNA, 32 nt, Human
ucaggaggcugaggcaggagaaucgcgugaac

SEQ ID NO: 495952 - RNA, 32 nt, Human
ucaggaggcugaggcaggagaaucgcuagaac

SEQ ID NO: 495953 - RNA, 32 nt, Human
ucaggaggcugaggcaggagaaucgcuggaac

SEQ ID NO: 495954 - RNA, 32 nt, Human
ucaggaggcugaggcaggagaaucgcuuaaac

SEQ ID NO: 495955 - RNA, 32 nt, Human
ucaggaggcugaggcaggagaaucgcuugaaa

SEQ ID NO: 495956 - RNA, 32 nt, Human
ucaggaggcugaggcaggagaaucgcuugaac

SEQ ID NO: 495957 - RNA, 32 nt, Human
ucaggaggcugaggcaggagaaucgcuugaau

SEQ ID NO: 495958 - RNA, 32 nt, Human
ucaggaggcugaggcaggagaaucgcuugagc

SEQ ID NO: 495959 - RNA, 32 nt, Human
ucaggaggcugaggcaggagaaucgcuuggac

SEQ ID NO: 495960 - RNA, 32 nt, Human
ucaggaggcugaggcaggagaaucgcuuguac

SEQ ID NO: 495961 - RNA, 32 nt, Human
ucaggaggcugaggcaggagaaucguuugaac

SEQ ID NO: 495962 - RNA, 32 nt, Human
ucaggaggcugaggcaggagaaucucuugaac

SEQ ID NO: 495963 - RNA, 32 nt, Human
ucaggaggcugaggcaggagaauggcaugaac

SEQ ID NO: 495964 - RNA, 32 nt, Human
ucaggaggcugaggcaggagaauggcgagaac

SEQ ID NO: 495965 - RNA, 32 nt, Human
ucaggaggcugaggcaggagaauggcguaaac

SEQ ID NO: 495966 - RNA, 32 nt, Human
ucaggaggcugaggcaggagaauggcgugaac

SEQ ID NO: 495967 - RNA, 32 nt, Human
ucaggaggcugaggcaggagaauggcuucaac

SEQ ID NO: 495968 - RNA, 32 nt, Human
ucaggaggcugaggcaggagaauggcuugaac

SEQ ID NO: 495969 - RNA, 32 nt, Human
ucaggaggcugaggcaggagaauuacuugaac

SEQ ID NO: 495970 - RNA, 32 nt, Human
ucaggaggcugaggcaggagaauuacuuuaac

SEQ ID NO: 495971 - RNA, 32 nt, Human
ucaggaggcugaggcaggagaauucuuuuaac

SEQ ID NO: 495972 - RNA, 32 nt, Human
ucaggaggcugaggcaggagaauugauugaac

SEQ ID NO: 495973 - RNA, 32 nt, Human
ucaggaggcugaggcaggagaauugcuuaaac

SEQ ID NO: 495974 - RNA, 32 nt, Human
ucaggaggcugaggcaggagaauugcuugaaa

SEQ ID NO: 495975 - RNA, 32 nt, Human
ucaggaggcugaggcaggagaauugcuugaac

SEQ ID NO: 495976 - RNA, 32 nt, Human
ucaggaggcugaggcaggagaauugcuugaau

SEQ ID NO: 495977 - RNA, 32 nt, Human
ucaggaggcugaggcaggagaauugcuuggac

SEQ ID NO: 495978 - RNA, 32 nt, Human
ucaggaggcugaggcaggagaauuguuugaac

SEQ ID NO: 495979 - RNA, 32 nt, Human
ucaggaggcugaggcaggagaauuugcuugau

SEQ ID NO: 495980 - RNA, 32 nt, Human
ucaggaggcugaggcaggagacuggcuugaac

SEQ ID NO: 495981 - RNA, 32 nt, Human
ucaggaggcugaggcaggagagucacuugaac

SEQ ID NO: 495982 - RNA, 32 nt, Human
ucaggaggcugaggcaggagaguggacugagc

SEQ ID NO: 495983 - RNA, 32 nt, Human
ucaggaggcugaggcaggagauucgcuugaac

SEQ ID NO: 495984 - RNA, 32 nt, Human
ucaggaggcugaggcaggaggaucacagugac

SEQ ID NO: 495985 - RNA, 32 nt, Human
ucaggaggcugaggcaggaggaucacuugaac

SEQ ID NO: 495986 - RNA, 32 nt, Human
ucaggaggcugaggcaggaggaucacuugagc

SEQ ID NO: 495987 - RNA, 32 nt, Human
ucaggaggcugaggcaggggaaucgcuugaac

SEQ ID NO: 495988 - RNA, 32 nt, Human
ucaggaggcugaggcaggugaaucacuugaac

SEQ ID NO: 495989 - RNA, 32 nt, Human
ucaggaggcugaggcaugagaaucacuugaac

SEQ ID NO: 495990 - RNA, 32 nt, Human
ucaggaggcugaggccggagaaucgcuugagc

SEQ ID NO: 495991 - RNA, 32 nt, Human
ucaggaggcugaggcgggagaaucacuugaac

SEQ ID NO: 495992 - RNA, 32 nt, Human
ucaggaggcugaggcgggagaaucccuugaac

SEQ ID NO: 495993 - RNA, 32 nt, Human
ucaggaggcugaggcuagagaaucacuugaac

SEQ ID NO: 495994 - RNA, 32 nt, Human
ucaggaggcugaggcuggagaaucauuugaac

SEQ ID NO: 495995 - RNA, 32 nt, Human
ucaggaggcugagggaggagaaucccuugaac

SEQ ID NO: 495996 - RNA, 32 nt, Human
ucaggaggcugagguaggagaaucaccugagc

SEQ ID NO: 495997 - RNA, 32 nt, Human
ucaggaggcugagguaggagaaucacuugaac

SEQ ID NO: 495998 - RNA, 32 nt, Human
ucaggaggcugagguaggagaaucauugaacc

SEQ ID NO: 495999 - RNA, 32 nt, Human
ucaggaggcugagguaggagaaucgcuugaac

SEQ ID NO: 496000 - RNA, 32 nt, Human
ucaggaggcugaggugggagaaucgcuugaac

SEQ ID NO: 496001 - RNA, 32 nt, Human
ucaggaggcugaggugggaggaucauuugagc

SEQ ID NO: 496002 - RNA, 32 nt, Human
ucaggaggcugagucaggagaaucacuugaac

SEQ ID NO: 496003 - RNA, 32 nt, Human
ucaggaggcugggacaggagaaucgcuugaac

SEQ ID NO: 496004 - RNA, 32 nt, Human
ucaggaggcuggggcaggagaaucgcuugaac

SEQ ID NO: 496005 - RNA, 32 nt, Human
ucaggaggcuggggcaggagaauggcaugaac

SEQ ID NO: 496006 - RNA, 32 nt, Human
ucaggaggcuuaggcaggagaauugcuugaac

SEQ ID NO: 496007 - RNA, 32 nt, Human
ucaggaggcuuagguaggagaauagcuugagc

SEQ ID NO: 496008 - RNA, 32 nt, Human
ucaggaggcuugaacccuggaggcagagguug

SEQ ID NO: 496009 - RNA, 32 nt, Human
ucaggagggcaggcugagguggggaaggaggg

SEQ ID NO: 496010 - RNA, 32 nt, Human
ucaggagggugaggcaggagauuugcuugaac

SEQ ID NO: 496011 - RNA, 25 nt, Human
ucaggaggucagccuggccaauaug

SEQ ID NO: 496012 - RNA, 32 nt, Human
ucaggaggugcugguguccaccuccagggccc

SEQ ID NO: 496013 - RNA, 20 nt, Human
ucaggagguggagguugcag

SEQ ID NO: 496014 - RNA, 23 nt, Human
ucaggagguggagguugcaguga

SEQ ID NO: 496015 - RNA, 32 nt, Human
ucaggagguugagacaggagaaucgcuuaaac

SEQ ID NO: 496016 - RNA, 32 nt, Human
ucaggagguugaggcaggagaaucacuugaac

SEQ ID NO: 496017 - RNA, 32 nt, Human
ucaggagguugaggcaggagaaucgcuugaac

SEQ ID NO: 496018 - RNA, 32 nt, Human
ucaggagguugagguaggagaauugcuugaac

SEQ ID NO: 496019 - RNA, 32 nt, Human
ucaggagguuggggcagaauugcuugaaccca

SEQ ID NO: 496020 - RNA, 32 nt, Human
ucaggagguugggggaaaagauguuuaugagu

SEQ ID NO: 496021 - RNA, 32 nt, Human
ucaggaguccaggacccaggagagggaagaau

SEQ ID NO: 496022 - RNA, 32 nt, Human
ucaggagucugaggcacgagaaucaccugaac

SEQ ID NO: 496023 - RNA, 32 nt, Human
ucaggagucugaggcaggagaaucgcuugaac

SEQ ID NO: 496024 - RNA, 32 nt, Human
ucaggagucugaggcaggagaauggcaugaac

SEQ ID NO: 496025 - RNA, 32 nt, Human
ucaggagucugaggcaggagaauugcuugaac

SEQ ID NO: 496026 - RNA, 32 nt, Human
ucaggagucugccacuugucaaagaaggagcu

SEQ ID NO: 496027 - RNA, 32 nt, Human
ucaggagucugugcugugcacccuggguuaua

SEQ ID NO: 496028 - RNA, 32 nt, Human
ucaggagugaagaugccacagagccgggcucc

SEQ ID NO: 496029 - RNA, 32 nt, Human
ucaggagugacagaucacagggugagggccac

SEQ ID NO: 496030 - RNA, 32 nt, Human
ucaggagugccucccuggccuggguagcuacc

SEQ ID NO: 496031 - RNA, 32 nt, Human
ucaggagugguggcaugugccuguaaucccag

SEQ ID NO: 496032 - RNA, 32 nt, Human
ucaggaguucaagacaagaccagccuggccaa

SEQ ID NO: 496033 - RNA, 18 nt, Human
ucaggaguucaagacgag

SEQ ID NO: 496034 - RNA, 32 nt, Human
ucaggaguucaaggccagccugggcaacaugg

SEQ ID NO: 496035 - RNA, 22 nt, Human
ucaggaguucgggaccauccug

SEQ ID NO: 496036 - RNA, 32 nt, Human
ucaggaguugaggaguucaggaguucaagacc

SEQ ID NO: 496037 - RNA, 32 nt, Human
ucaggaguuuaacaucagccugggcaacauag

SEQ ID NO: 496038 - RNA, 32 nt, Human
ucaggaguuucagaucagucuggccaacaaac

SEQ ID NO: 496039 - RNA, 32 nt, Human
ucaggaguuugaaaccagccugggcaacauag

SEQ ID NO: 496040 - RNA, 32 nt, Human
ucaggaguuugagaccagccugggcaacacgg

SEQ ID NO: 496041 - RNA, 32 nt, Human
ucaggaguuugagaccagccugggcaacauag

SEQ ID NO: 496042 - RNA, 32 nt, Human
ucaggaguuugagaccagccugggcaacauga

SEQ ID NO: 496043 - RNA, 32 nt, Human
ucaggaguuugagaccagccugggcaacaugg

SEQ ID NO: 496044 - RNA, 32 nt, Human
ucaggaguuugagaccagccugggcaauauag

SEQ ID NO: 496045 - RNA, 32 nt, Human
ucaggaguuugagaccagccugggcaauaucg

SEQ ID NO: 496046 - RNA, 32 nt, Human
ucaggaguuugagaccagccuggguaauaugg

SEQ ID NO: 496047 - RNA, 32 nt, Human
ucaggauauccccacccccacccugggaaaga

SEQ ID NO: 496048 - RNA, 32 nt, Human
ucaggauaugcuguuuugcugugugcagaugg

SEQ ID NO: 496049 - RNA, 32 nt, Human
ucaggaucaaugcuuugcauccuucaauccaa

SEQ ID NO: 496050 - RNA, 32 nt, Human
ucaggaucaccacgcaucucaggauuggucua

SEQ ID NO: 496051 - RNA, 32 nt, Human
ucaggauccacuccagaccuauugaaucucaa

SEQ ID NO: 496052 - RNA, 32 nt, Human
ucaggaucccacccuccaucccgucugcccug

SEQ ID NO: 496053 - RNA, 32 nt, Human
ucaggaucugacacccucuugucccaacacca

SEQ ID NO: 496054 - RNA, 32 nt, Human
ucaggaucugcugccucuuguuccaaggauua

SEQ ID NO: 496055 - RNA, 32 nt, Human
ucaggaucugggcuucuguccucugcuguucu

SEQ ID NO: 496056 - RNA, 32 nt, Human
ucaggaucuugggaacagcuagucuuccucug

SEQ ID NO: 496057 - RNA, 32 nt, Human
ucaggaugaaaaggacacagaaggccagauga

SEQ ID NO: 496058 - RNA, 32 nt, Human
ucaggaugaauuucuucuuucugccaucuuuu

SEQ ID NO: 496059 - RNA, 31 nt, Human
ucaggaugacuucugcucuucuauggcaaua

SEQ ID NO: 496060 - RNA, 32 nt, Human
ucaggaugaucacauuuuucugccuguguacu

SEQ ID NO: 496061 - RNA, 32 nt, Human
ucaggaugcucacaaaccugcagcuggaagcu

SEQ ID NO: 496062 - RNA, 30 nt, Human
ucaggaugcuguugcugggagcuguucuac

SEQ ID NO: 496063 - RNA, 32 nt, Human
ucaggauggaaaggaaaauacugaguuuagca

SEQ ID NO: 496064 - RNA, 32 nt, Human
ucaggauggagugaagaccuggagaggagggg

SEQ ID NO: 496065 - RNA, 32 nt, Human
ucaggauggcugcagugccagccuggggcagc

SEQ ID NO: 496066 - RNA, 30 nt, Human
ucaggaugucugcccguggcccggcuaucg

SEQ ID NO: 496067 - RNA, 32 nt, Human
ucaggauguugccagggauuacuccaauccca

SEQ ID NO: 496068 - RNA, 32 nt, Human
ucaggauuacaaaggauuuagccucaaguagu

SEQ ID NO: 496069 - RNA, 32 nt, Human
ucaggauucauuuggaaaguggguaaaagggg

SEQ ID NO: 496070 - RNA, 32 nt, Human
ucaggauuccacugacguccugggcagccagu

SEQ ID NO: 496071 - RNA, 32 nt, Human
ucaggauucggucuguuuccaucccagcauuc

SEQ ID NO: 496072 - RNA, 32 nt, Human
ucaggauucugaggcaggagaauggcaugaac

SEQ ID NO: 496073 - RNA, 32 nt, Human
ucaggauucuguggcuguagacugaucacaga

SEQ ID NO: 496074 - RNA, 32 nt, Human
ucaggcaaaaacaaaaaccuaaaacucaucag

SEQ ID NO: 496075 - RNA, 32 nt, Human
ucaggcaacugauuucaaaugccuaugaaacc

SEQ ID NO: 496076 - RNA, 32 nt, Human
ucaggcaagcuugccagacaucaauccagcaa

SEQ ID NO: 496077 - RNA, 32 nt, Human
ucaggcacagucaggggcugagguuggaggag

SEQ ID NO: 496078 - RNA, 18 nt, Human
ucaggcaccacccccucc

SEQ ID NO: 496079 - RNA, 32 nt, Human
ucaggcaccacuguuaaucacugagacugauu

SEQ ID NO: 496080 - RNA, 32 nt, Human
ucaggcaccagcacagggcucugggugacuca

SEQ ID NO: 496081 - RNA, 32 nt, Human
ucaggcacccggggccagagacauaugggcca

SEQ ID NO: 496082 - RNA, 32 nt, Human
ucaggcacugagccacugcgcccagucaacaa

SEQ ID NO: 496083 - RNA, 32 nt, Human
ucaggcacugaggaggccgagagaugaggccg

SEQ ID NO: 496084 - RNA, 32 nt, Human
ucaggcacugcugccuuccugccucccaaggc

SEQ ID NO: 496085 - RNA, 32 nt, Human
ucaggcagacagcaggcuggagcccagcauuc

SEQ ID NO: 496086 - RNA, 32 nt, Human
ucaggcagagaggcccucccaugcccacaaca

SEQ ID NO: 496087 - RNA, 23 nt, Human
ucaggcagaggaaagaacccugu

SEQ ID NO: 496088 - RNA, 32 nt, Human
ucaggcagaggccaguacagaggaggagccau

SEQ ID NO: 496089 - RNA, 32 nt, Human
ucaggcagagggaacagcgugugcaaaagccc

SEQ ID NO: 496090 - RNA, 32 nt, Human
ucaggcagagggacucagggauggggacugcc

SEQ ID NO: 496091 - RNA, 32 nt, Human
ucaggcagaucuccugcccucucugagccuug

SEQ ID NO: 496092 - RNA, 32 nt, Human
ucaggcagcaguggcgccuggugucaggucug

SEQ ID NO: 496093 - RNA, 32 nt, Human
ucaggcagccacggccagggagcuaugagggu

SEQ ID NO: 496094 - RNA, 22 nt, Human
ucaggcagccccaaacuggugc

SEQ ID NO: 496095 - RNA, 22 nt, Human
ucaggcagccgcaaaaccuggc

SEQ ID NO: 496096 - RNA, 32 nt, Human
ucaggcagccucucccccuccuuccuggaccc

SEQ ID NO: 496097 - RNA, 32 nt, Human
ucaggcagcuagugauagagguggggccaagc

SEQ ID NO: 496098 - RNA, 32 nt, Human
ucaggcaggaagcagaaggaagggcaaugggc

SEQ ID NO: 496099 - RNA, 32 nt, Human
ucaggcaggagagaugguuuaaagaggaagau

SEQ ID NO: 496100 - RNA, 32 nt, Human
ucaggcaggaggaucacuugaacccaggaauu

SEQ ID NO: 496101 - RNA, 32 nt, Human
ucaggcaggaggaucacuugagcuuaggaguu

SEQ ID NO: 496102 - RNA, 32 nt, Human
ucaggcaggaggugggcagugaaggggaauac

SEQ ID NO: 496103 - RNA, 32 nt, Human
ucaggcaggcccuggcccuggaggcugagcug

SEQ ID NO: 496104 - RNA, 32 nt, Human
ucaggcaggcggggcccaugguuggucccugc

SEQ ID NO: 496105 - RNA, 32 nt, Human
ucaggcagggaguccagggugccuggaagagg

SEQ ID NO: 496106 - RNA, 24 nt, Human
ucaggcagguaaucccagaacuuu

SEQ ID NO: 496107 - RNA, 32 nt, Human
ucaggcagucccuaugauggugguuauggauc

SEQ ID NO: 496108 - RNA, 21 nt, Human
ucaggcaguccugggauccuc

SEQ ID NO: 496109 - RNA, 21 nt, Human
ucaggcagucugccugccuca

SEQ ID NO: 496110 - RNA, 32 nt, Human
ucaggcagugcacuccuggagccaagagggaa

SEQ ID NO: 496111 - RNA, 32 nt, Human
ucaggcaguggccaagagcccaaagggcuaag

SEQ ID NO: 496112 - RNA, 23 nt, Human
ucaggcaguugucacacugcauc

SEQ ID NO: 496113 - RNA, 32 nt, Human
ucaggcaucccugccccgcucuccuugagggc

SEQ ID NO: 496114 - RNA, 32 nt, Human
ucaggcaucccugcccugcucuccuugagggc

SEQ ID NO: 496115 - RNA, 32 nt, Human
ucaggcaucucuaggaccuugcuggacggugg

SEQ ID NO: 496116 - RNA, 32 nt, Human
ucaggcaucugcacuccuccgagcccggugga

SEQ ID NO: 496117 - RNA, 32 nt, Human
ucaggcaugcagauaccccagacugccacucu

SEQ ID NO: 496118 - RNA, 24 nt, Human
ucaggcauggcugacagcuugugc

SEQ ID NO: 496119 - RNA, 32 nt, Human
ucaggcaugguggcacaugccuguaaucccag

SEQ ID NO: 496120 - RNA, 32 nt, Human
ucaggcaugguggcucacaccuguaaucccag

SEQ ID NO: 496121 - RNA, 32 nt, Human
ucaggcaugguggcucaggccuguaaucccag

SEQ ID NO: 496122 - RNA, 32 nt, Human
ucaggcaugguggguugugccuguaaucccag

SEQ ID NO: 496123 - RNA, 32 nt, Human
ucaggcaugguggugggcgccuguaaucccag

SEQ ID NO: 496124 - RNA, 32 nt, Human
ucaggcaugguggugggcgccuguaauuccag

SEQ ID NO: 496125 - RNA, 32 nt, Human
ucaggcaugucagagaagggaggacucacuag

SEQ ID NO: 496126 - RNA, 21 nt, Human
ucaggcaugugacuggccuaa

SEQ ID NO: 496127 - RNA, 32 nt, Human
ucaggcauuccagaggugaacuguccauugcu

SEQ ID NO: 496128 - RNA, 20 nt, Human
ucaggcauuucauuaggacc

SEQ ID NO: 496129 - RNA, 32 nt, Human
ucaggccaacagggcuuccugggauacaagag

SEQ ID NO: 496130 - RNA, 32 nt, Human
ucaggccaagcccaauacagccauuaaagaug

SEQ ID NO: 496131 - RNA, 32 nt, Human
ucaggccaagugcaccacacacccucaugggu

SEQ ID NO: 496132 - RNA, 32 nt, Human
ucaggccacagcuccggccacagcucuggcuc

SEQ ID NO: 496133 - RNA, 25 nt, Human
ucaggccaccugcccccuucuccca

SEQ ID NO: 496134 - RNA, 32 nt, Human
ucaggccacugcacuccagccugaacaacaaa

SEQ ID NO: 496135 - RNA, 32 nt, Human
ucaggccacugcacuccagccugggcaacaga

SEQ ID NO: 496136 - RNA, 32 nt, Human
ucaggccacugcacuccagccuggguaacaga

SEQ ID NO: 496137 - RNA, 32 nt, Human
ucaggccacugcauuuagccugggcgacagag

SEQ ID NO: 496138 - RNA, 32 nt, Human
ucaggccagcaacuauccuugccaggguuuuu

SEQ ID NO: 496139 - RNA, 32 nt, Human
ucaggccagcaaggaagagaguuugaguuguu

SEQ ID NO: 496140 - RNA, 32 nt, Human
ucaggccagcacuuugggaggcugagucgggc

SEQ ID NO: 496141 - RNA, 32 nt, Human
ucaggccagcugcuugggcuucauccuccuca

SEQ ID NO: 496142 - RNA, 32 nt, Human
ucaggccaggaaggaggggaaaagagugagag

SEQ ID NO: 496143 - RNA, 32 nt, Human
ucaggccaggagaagucugaugacucacucac

SEQ ID NO: 496144 - RNA, 32 nt, Human
ucaggccaggagagacggaagaacuggcaagc

SEQ ID NO: 496145 - RNA, 32 nt, Human
ucaggccaggaguucaagaucaaccaaccugg

SEQ ID NO: 496146 - RNA, 32 nt, Human
ucaggccaggugugaauccugagguccaugga

SEQ ID NO: 496147 - RNA, 32 nt, Human
ucaggccaucacagaacaccccagcuuccuca

SEQ ID NO: 496148 - RNA, 32 nt, Human
ucaggccaucucuggcugucuuccugucucuc

SEQ ID NO: 496149 - RNA, 32 nt, Human
ucaggccaugagaaugaagagaggaugggaag

SEQ ID NO: 496150 - RNA, 32 nt, Human
ucaggccauggacucaggaccugcccggugau

SEQ ID NO: 496151 - RNA, 32 nt, Human
ucaggccauucaccugccuccugucaguagug

SEQ ID NO: 496152 - RNA, 32 nt, Human
ucaggccauugcacuccagccugggcaauagg

SEQ ID NO: 496153 - RNA, 32 nt, Human
ucaggccauugcacuucagccugggugacaga

SEQ ID NO: 496154 - RNA, 32 nt, Human
ucaggcccaagugccauccauaguccaucucc

SEQ ID NO: 496155 - RNA, 32 nt, Human
ucaggcccagaaccagaugcagagggaacagc

SEQ ID NO: 496156 - RNA, 32 nt, Human
ucaggcccagaacuugcccuccaguggaccuu

SEQ ID NO: 496157 - RNA, 32 nt, Human
ucaggcccagaacuugccuccagucggccuuu

SEQ ID NO: 496158 - RNA, 32 nt, Human
ucaggcccagcacauccagccuggcaucccac

SEQ ID NO: 496159 - RNA, 32 nt, Human
ucaggcccagccgccagaccucagagaucuca

SEQ ID NO: 496160 - RNA, 32 nt, Human
ucaggcccaguucucgugcccuuagaggggaa

SEQ ID NO: 496161 - RNA, 32 nt, Human
ucaggcccauucuuucugaucugcgcccccag

SEQ ID NO: 496162 - RNA, 32 nt, Human
ucaggcccccagugggaccacaugccacugcc

SEQ ID NO: 496163 - RNA, 22 nt, Human
ucaggcccccgcucgggcccga

SEQ ID NO: 496164 - RNA, 25 nt, Human
ucaggccccgggcuucccuucuccc

SEQ ID NO: 496165 - RNA, 21 nt, Human
ucaggccccuccuucagccug

SEQ ID NO: 496166 - RNA, 32 nt, Human
ucaggcccgaaggucucucuggcucuaggacc

SEQ ID NO: 496167 - RNA, 32 nt, Human
ucaggcccuaggcuggccuaggaagcucagca

SEQ ID NO: 496168 - RNA, 32 nt, Human
ucaggcccucacugacccucaggggagccccc

SEQ ID NO: 496169 - RNA, 32 nt, Human
ucaggcccucagggugcugagguuuuccuuug

SEQ ID NO: 496170 - RNA, 32 nt, Human
ucaggcccuccccuccccuccccuccccuccc

SEQ ID NO: 496171 - RNA, 32 nt, Human
ucaggcccugcucacucccggggccaccaaac

SEQ ID NO: 496172 - RNA, 32 nt, Human
ucaggcccuggcuuucugcagcaacaguggag

SEQ ID NO: 496173 - RNA, 32 nt, Human
ucaggccgcauccugaacugcuucuccaagga

SEQ ID NO: 496174 - RNA, 32 nt, Human
ucaggccggacagaaaacaugacccaucaaug

SEQ ID NO: 496175 - RNA, 32 nt, Human
ucaggccggcagcagcagcagagagcagagag

SEQ ID NO: 496176 - RNA, 32 nt, Human
ucaggccggggccaagagugagcugcuaacac

SEQ ID NO: 496177 - RNA, 32 nt, Human
ucaggccuacagccacauccccaagcccacca

SEQ ID NO: 496178 - RNA, 32 nt, Human
ucaggccuauaaccccagcucccuaggagacc

SEQ ID NO: 496179 - RNA, 32 nt, Human
ucaggccuauaaucccaguacuuugggaggcc

SEQ ID NO: 496180 - RNA, 32 nt, Human
ucaggccucaaacccuuucauaccuuuauucu

SEQ ID NO: 496181 - RNA, 32 nt, Human
ucaggccuccagacuguacuuccagaugucuc

SEQ ID NO: 496182 - RNA, 18 nt, Human
ucaggccucccaaaggca

SEQ ID NO: 496183 - RNA, 32 nt, Human
ucaggccucccucucucuucugcuccacccuu

SEQ ID NO: 496184 - RNA, 32 nt, Human
ucaggccucuccaagcccggagcauccccagc

SEQ ID NO: 496185 - RNA, 20 nt, Human
ucaggccucucuccagcagg

SEQ ID NO: 496186 - RNA, 32 nt, Human
ucaggccucugcucuccgaccucucuccucug

SEQ ID NO: 496187 - RNA, 21 nt, Human
ucaggccucugugccgcacca

SEQ ID NO: 496188 - RNA, 32 nt, Human
ucaggccucuugagaaauggaugcugucucag

SEQ ID NO: 496189 - RNA, 32 nt, Human
ucaggccugcagcccccucccaugucugucug

SEQ ID NO: 496190 - RNA, 32 nt, Human
ucaggccugcugcaggagcucugagaacaaga

SEQ ID NO: 496191 - RNA, 32 nt, Human
ucaggccugcuggccuccugcugugaacauuu

SEQ ID NO: 496192 - RNA, 32 nt, Human
ucaggccuggcuuagagguagcggguggcugg

SEQ ID NO: 496193 - RNA, 32 nt, Human
ucaggccugggcaacauagaugugagcaccua

SEQ ID NO: 496194 - RNA, 32 nt, Human
ucaggccuggugugguggcucacaccuguaau

SEQ ID NO: 496195 - RNA, 23 nt, Human
ucaggccuguaaccccagcacuu

SEQ ID NO: 496196 - RNA, 32 nt, Human
ucaggccuguaaccccagcacuucgggaggcu

SEQ ID NO: 496197 - RNA, 32 nt, Human
ucaggccuguaaccccaguacuuugggaggcc

SEQ ID NO: 496198 - RNA, 24 nt, Human
ucaggccuguaaucccaacacuuu

SEQ ID NO: 496199 - RNA, 32 nt, Human
ucaggccuguaaucccaacacuuugggaggcc

SEQ ID NO: 496200 - RNA, 32 nt, Human
ucaggccuguaaucccaacccuuuggaaggua

SEQ ID NO: 496201 - RNA, 22 nt, Human
ucaggccuguaaucccagcacu

SEQ ID NO: 496202 - RNA, 32 nt, Human
ucaggccuguaaucccagcacucugggaggcc

SEQ ID NO: 496203 - RNA, 32 nt, Human
ucaggccuguaaucccagcacugugggaggcc

SEQ ID NO: 496204 - RNA, 23 nt, Human
ucaggccuguaaucccagcacuu

SEQ ID NO: 496205 - RNA, 32 nt, Human
ucaggccuguaaucccagcacuucaggaagcc

SEQ ID NO: 496206 - RNA, 24 nt, Human
ucaggccuguaaucccagcacuuu

SEQ ID NO: 496207 - RNA, 32 nt, Human
ucaggccuguaaucccagcacuuugggaagcc

SEQ ID NO: 496208 - RNA, 32 nt, Human
ucaggccuguaaucccagcacuuugggaggcc

SEQ ID NO: 496209 - RNA, 32 nt, Human
ucaggccuguaaucccagcacuuugggaggcu

SEQ ID NO: 496210 - RNA, 24 nt, Human
ucaggccuguaaucccagcauuuu

SEQ ID NO: 496211 - RNA, 32 nt, Human
ucaggccuguaaucccagcauuuucagaggcu

SEQ ID NO: 496212 - RNA, 32 nt, Human
ucaggccuguaaucccagcauuuugggaggcu

SEQ ID NO: 496213 - RNA, 32 nt, Human
ucaggccuguaaucccagcuacuagggaggcg

SEQ ID NO: 496214 - RNA, 32 nt, Human
ucaggccuguaaucccagcucuggaagcugaa

SEQ ID NO: 496215 - RNA, 32 nt, Human
ucaggccuguaauccuaacacuuugggaggcc

SEQ ID NO: 496216 - RNA, 32 nt, Human
ucaggccuguaauccuggcacuuugggaggcc

SEQ ID NO: 496217 - RNA, 24 nt, Human
ucaggccuguaaucucagcacuuu

SEQ ID NO: 496218 - RNA, 32 nt, Human
ucaggccuguaaucucagcacuuugggaggcc

SEQ ID NO: 496219 - RNA, 32 nt, Human
ucaggccuguaauuccagcacuuugggaggcc

SEQ ID NO: 496220 - RNA, 22 nt, Human
ucaggccugugacccggccaga

SEQ ID NO: 496221 - RNA, 32 nt, Human
ucaggccugugaucccagcacuuugggaggcu

SEQ ID NO: 496222 - RNA, 32 nt, Human
ucaggccuguggagucagaacccgcucuucag

SEQ ID NO: 496223 - RNA, 32 nt, Human
ucaggccuguucuagcaucuggccggggcggc

SEQ ID NO: 496224 - RNA, 32 nt, Human
ucaggccuuaugcuaagggugaguaauuccau

SEQ ID NO: 496225 - RNA, 32 nt, Human
ucaggccuuccugacuucucccccucuuggcu

SEQ ID NO: 496226 - RNA, 32 nt, Human
ucaggccuuugaaggggcagcuucuggaaguu

SEQ ID NO: 496227 - RNA, 32 nt, Human
ucaggcgagcagggugggcaagugggaggagg

SEQ ID NO: 496228 - RNA, 32 nt, Human
ucaggcgauccaucugccucagccugaaagug

SEQ ID NO: 496229 - RNA, 32 nt, Human
ucaggcgcagccggccacgauccugcccaucc

SEQ ID NO: 496230 - RNA, 32 nt, Human
ucaggcgcaguggcucacaccuguaaucccag

SEQ ID NO: 496231 - RNA, 32 nt, Human
ucaggcgcaguggcucaugccuguaaucccag

SEQ ID NO: 496232 - RNA, 32 nt, Human
ucaggcgcaugugccaguuggggccccgcggg

SEQ ID NO: 496233 - RNA, 32 nt, Human
ucaggcgcgguggcucacgccuguaaucccag

SEQ ID NO: 496234 - RNA, 32 nt, Human
ucaggcggcugcaggcuucagccugcgcuggu

SEQ ID NO: 496235 - RNA, 32 nt, Human
ucaggcgugguggcgggcgccuguaaucccag

SEQ ID NO: 496236 - RNA, 32 nt, Human
ucaggcguuuucuccccaccaagcccccaccc

SEQ ID NO: 496237 - RNA, 32 nt, Human
ucaggcuacagcacuccagccugggcaacaag

SEQ ID NO: 496238 - RNA, 20 nt, Human
ucaggcuagagugcaguggc

SEQ ID NO: 496239 - RNA, 20 nt, Human
ucaggcuagucucgaacucc

SEQ ID NO: 496240 - RNA, 32 nt, Human
ucaggcuauauguauaagguggaugugaaaca

SEQ ID NO: 496241 - RNA, 32 nt, Human
ucaggcuauccccauucccccucuugggccuc

SEQ ID NO: 496242 - RNA, 32 nt, Human
ucaggcucaaaaaugcagacccugccgaaaca

SEQ ID NO: 496243 - RNA, 32 nt, Human
ucaggcucaagaaguggaggagagggaaaacc

SEQ ID NO: 496244 - RNA, 32 nt, Human
ucaggcucaagcaaaccucucaccucagccug

SEQ ID NO: 496245 - RNA, 32 nt, Human
ucaggcucaagcaauccucccgccucagccuc

SEQ ID NO: 496246 - RNA, 32 nt, Human
ucaggcucaagcaauccucccgccucagccuu

SEQ ID NO: 496247 - RNA, 32 nt, Human
ucaggcucaagcgauccucccaucucagccuc

SEQ ID NO: 496248 - RNA, 32 nt, Human
ucaggcucaagcgauucucccaccucagccau

SEQ ID NO: 496249 - RNA, 32 nt, Human
ucaggcucagccccagcccucagcccagucaa

SEQ ID NO: 496250 - RNA, 32 nt, Human
ucaggcucaggugauccucccaucucagccug

SEQ ID NO: 496251 - RNA, 32 nt, Human
ucaggcucaguggcucaugccuguaaucccag

SEQ ID NO: 496252 - RNA, 32 nt, Human
ucaggcucauuuucuucucaacucuggcucuc

SEQ ID NO: 496253 - RNA, 32 nt, Human
ucaggcucccaaagugcugagauuacaggcau

SEQ ID NO: 496254 - RNA, 32 nt, Human
ucaggcucccaaguagcugggauuacaggugc

SEQ ID NO: 496255 - RNA, 32 nt, Human
ucaggcucccgaguagcugggauuacaggcau

SEQ ID NO: 496256 - RNA, 32 nt, Human
ucaggcuccucaugccaagagaucaccaagca

SEQ ID NO: 496257 - RNA, 32 nt, Human
ucaggcuccucccagguuauguuuucauagug

SEQ ID NO: 496258 - RNA, 32 nt, Human
ucaggcuccugagcacggcuucccuuuuugaa

SEQ ID NO: 496259 - RNA, 32 nt, Human
ucaggcuccugcaggccagcugcaugcucucc

SEQ ID NO: 496260 - RNA, 32 nt, Human
ucaggcucuaauggcugaagaaucaagaaagc

SEQ ID NO: 496261 - RNA, 20 nt, Human
ucaggcucugccuuggccug

SEQ ID NO: 496262 - RNA, 32 nt, Human
ucaggcucugcuucacuguccagccuuggaac

SEQ ID NO: 496263 - RNA, 32 nt, Human
ucaggcucuggccuccauccuccagggccacc

SEQ ID NO: 496264 - RNA, 32 nt, Human
ucaggcucuguggagggcauuugcugccccag

SEQ ID NO: 496265 - RNA, 32 nt, Human
ucaggcugaaaucuggcaucaucucagguucc

SEQ ID NO: 496266 - RNA, 32 nt, Human
ucaggcugacuucuucucaaucccagaaauau

SEQ ID NO: 496267 - RNA, 32 nt, Human
ucaggcugagccugacucugaagcuguuccca

SEQ ID NO: 496268 - RNA, 32 nt, Human
ucaggcugaggaaaguuucaacaggcacuugg

SEQ ID NO: 496269 - RNA, 32 nt, Human
ucaggcugaggcaggagaaucgcuugaacuga

SEQ ID NO: 496270 - RNA, 32 nt, Human
ucaggcugaggcaggagaauugcuugaaccug

SEQ ID NO: 496271 - RNA, 32 nt, Human
ucaggcugaggcaggagggucacuugacccag

SEQ ID NO: 496272 - RNA, 32 nt, Human
ucaggcugaucuggaacuucugaccucaggug

SEQ ID NO: 496273 - RNA, 32 nt, Human
ucaggcugccaggggaggaggagaagccagca

SEQ ID NO: 496274 - RNA, 32 nt, Human
ucaggcugcgugccuccgucugccugugugcu

SEQ ID NO: 496275 - RNA, 32 nt, Human
ucaggcugcuucugacaggcccaagucacagc

SEQ ID NO: 496276 - RNA, 32 nt, Human
ucaggcugcuucuguuuaaaauauaaaagaaa

SEQ ID NO: 496277 - RNA, 32 nt, Human
ucaggcuggaauagaguggacugaggaagaug

SEQ ID NO: 496278 - RNA, 32 nt, Human
ucaggcuggacaccccuccaccuggcggucca

SEQ ID NO: 496279 - RNA, 18 nt, Human
ucaggcuggagugcagug

SEQ ID NO: 496280 - RNA, 19 nt, Human
ucaggcuggagugcagugg

SEQ ID NO: 496281 - RNA, 32 nt, Human
ucaggcuggagugcaguggcacaaucacggcu

SEQ ID NO: 496282 - RNA, 32 nt, Human
ucaggcuggagugcaguggcacaaucuuagcu

SEQ ID NO: 496283 - RNA, 32 nt, Human
ucaggcuggagugcaguggcaugaucucggcu

SEQ ID NO: 496284 - RNA, 32 nt, Human
ucaggcuggagugcaguggcaugaucuuagcu

SEQ ID NO: 496285 - RNA, 32 nt, Human
ucaggcuggagugcaguggcgcgaucaugguu

SEQ ID NO: 496286 - RNA, 32 nt, Human
ucaggcuggagugcaguggcgcgaucuugguu

SEQ ID NO: 496287 - RNA, 32 nt, Human
ucaggcuggagugcaguggcucacugcaaccu

SEQ ID NO: 496288 - RNA, 32 nt, Human
ucaggcuggagugcagugguacgaucuuggcu

SEQ ID NO: 496289 - RNA, 32 nt, Human
ucaggcuggagugcagugguauaaucaugccu

SEQ ID NO: 496290 - RNA, 32 nt, Human
ucaggcuggagugcagugguauaaucucagcu

SEQ ID NO: 496291 - RNA, 32 nt, Human
ucaggcuggagugcaguggugugaucucaguu

SEQ ID NO: 496292 - RNA, 32 nt, Human
ucaggcuggagugcaguggugugaucucggcu

SEQ ID NO: 496293 - RNA, 19 nt, Human
ucaggcuggagugcggugg

SEQ ID NO: 496294 - RNA, 32 nt, Human
ucaggcuggagugcggugguauaaucucagcc

SEQ ID NO: 496295 - RNA, 32 nt, Human
ucaggcuggagugcgguggugugaucuuggcu

SEQ ID NO: 496296 - RNA, 32 nt, Human
ucaggcugggaaccugaacacacacuuguguu

SEQ ID NO: 496297 - RNA, 32 nt, Human
ucaggcugggaggauagcacaggcuaggggcu

SEQ ID NO: 496298 - RNA, 32 nt, Human
ucaggcugggcacgguggcucacagcuauaau

SEQ ID NO: 496299 - RNA, 32 nt, Human
ucaggcugggcagaggucacacagugaguaaa

SEQ ID NO: 496300 - RNA, 32 nt, Human
ucaggcugggcuguggugccagcauagauagg

SEQ ID NO: 496301 - RNA, 32 nt, Human
ucaggcuggggucugcagugcagcauuaaugg

SEQ ID NO: 496302 - RNA, 32 nt, Human
ucaggcuggguagauggagcucugcugacuuc

SEQ ID NO: 496303 - RNA, 18 nt, Human
ucaggcugggugcagugg

SEQ ID NO: 496304 - RNA, 32 nt, Human
ucaggcuggucuugaacuccugacguggugau

SEQ ID NO: 496305 - RNA, 32 nt, Human
ucaggcuggugaaggcggcaggaagcuggagc

SEQ ID NO: 496306 - RNA, 32 nt, Human
ucaggcuguauccuucuaccuccuggcccagg

SEQ ID NO: 496307 - RNA, 32 nt, Human
ucaggcugucaccgaggaaacuccuuugaugg

SEQ ID NO: 496308 - RNA, 31 nt, Human
ucaggcugucccugagggccuguguuuugag

SEQ ID NO: 496309 - RNA, 32 nt, Human
ucaggcuguuaccugcccccucaggcccuaag

SEQ ID NO: 496310 - RNA, 20 nt, Human
ucaggcuuaucauccuugca

SEQ ID NO: 496311 - RNA, 32 nt, Human
ucaggcuuaugaagguaagcaugccaugacca

SEQ ID NO: 496312 - RNA, 32 nt, Human
ucaggcuucagcuugguuuguuaaauugagag

SEQ ID NO: 496313 - RNA, 32 nt, Human
ucaggcuucccaacaccuccuucccaacaccu

SEQ ID NO: 496314 - RNA, 32 nt, Human
ucaggcuucccagacaccuccuucccaaacac

SEQ ID NO: 496315 - RNA, 32 nt, Human
ucaggcuugcagagaaauacucacaucugugc

SEQ ID NO: 496316 - RNA, 32 nt, Human
ucaggcuugccaagagguuggaagggaaaugg

SEQ ID NO: 496317 - RNA, 32 nt, Human
ucaggcuugcccaggaaaggggcugugcuguc

SEQ ID NO: 496318 - RNA, 32 nt, Human
ucaggcuugguggcucaugccuauaauccugg

SEQ ID NO: 496319 - RNA, 32 nt, Human
ucagggaacagaacagaucugcagggccagug

SEQ ID NO: 496320 - RNA, 32 nt, Human
ucagggaagagggagaguaagagggaagccuc

SEQ ID NO: 496321 - RNA, 32 nt, Human
ucagggaagcuggaccaccuggaguugauccu

SEQ ID NO: 496322 - RNA, 32 nt, Human
ucagggaaggcagaagggcaggcaagccggau

SEQ ID NO: 496323 - RNA, 32 nt, Human
ucagggaaucugcaaucuaugaaaauuacaug

SEQ ID NO: 496324 - RNA, 32 nt, Human
ucagggacacacaagcacuuucacaucgaggc

SEQ ID NO: 496325 - RNA, 32 nt, Human
ucagggacacacaaggacuuucacaucgaggc

SEQ ID NO: 496326 - RNA, 32 nt, Human
ucagggacacacacuugugcacaugugugcac

SEQ ID NO: 496327 - RNA, 32 nt, Human
ucagggacagaagggaagggacccacaggaag

SEQ ID NO: 496328 - RNA, 32 nt, Human
ucagggacagagccaugcugggaagacgccug

SEQ ID NO: 496329 - RNA, 32 nt, Human
ucagggacagggccaugggguagggugagaag

SEQ ID NO: 496330 - RNA, 32 nt, Human
ucagggacauggcacgggcaccugcucugucu

SEQ ID NO: 496331 - RNA, 32 nt, Human
ucagggaccccaaacggagggacuggcugaag

SEQ ID NO: 496332 - RNA, 32 nt, Human
ucagggaccucccugccccaacgucucccaag

SEQ ID NO: 496333 - RNA, 21 nt, Human
ucagggaccucgcccccuccc

SEQ ID NO: 496334 - RNA, 32 nt, Human
ucagggacucuccagccuacuccuuuucugaa

SEQ ID NO: 496335 - RNA, 32 nt, Human
ucagggagaagaaaggaggcagcgaagcagau

SEQ ID NO: 496336 - RNA, 32 nt, Human
ucagggagaauguggcauuugaggacucucuu

SEQ ID NO: 496337 - RNA, 18 nt, Human
ucagggagacaaguugua

SEQ ID NO: 496338 - RNA, 32 nt, Human
ucagggagagaagggcagacccauucucaaag

SEQ ID NO: 496339 - RNA, 32 nt, Human
ucagggagaggaagaaagagggaugggguggg

SEQ ID NO: 496340 - RNA, 32 nt, Human
ucagggagagggcuagagcucacacccagcuc

SEQ ID NO: 496341 - RNA, 32 nt, Human
ucagggagaggggacgccagacacacggccug

SEQ ID NO: 496342 - RNA, 32 nt, Human
ucagggagcacagggugcaggagcggcggcga

SEQ ID NO: 496343 - RNA, 32 nt, Human
ucagggagccaguagugagaaaccccacgaau

SEQ ID NO: 496344 - RNA, 32 nt, Human
ucagggagccgugcccuugaaagcgguguauu

SEQ ID NO: 496345 - RNA, 32 nt, Human
ucagggagccuuuucuggaggaggugagaccu

SEQ ID NO: 496346 - RNA, 32 nt, Human
ucagggagcugcagagagaacaagaccugaga

SEQ ID NO: 496347 - RNA, 32 nt, Human
ucagggagcuggcucccccagcaaaggcccuu

SEQ ID NO: 496348 - RNA, 32 nt, Human
ucagggaggauucugugugggguuggaaguaa

SEQ ID NO: 496349 - RNA, 32 nt, Human
ucagggaggcggagguuguggugagccgagau

SEQ ID NO: 496350 - RNA, 32 nt, Human
ucagggagggcaccacucccagaggaacagga

SEQ ID NO: 496351 - RNA, 32 nt, Human
ucagggagggcagaggguggcagcgagggcag

SEQ ID NO: 496352 - RNA, 32 nt, Human
ucagggagggccuggggugggggccaggggcc

SEQ ID NO: 496353 - RNA, 32 nt, Human
ucagggaggugauuucccaaaguaauugccca

SEQ ID NO: 496354 - RNA, 32 nt, Human
ucagggaguaaauaagcuaaagcaaaucacac

SEQ ID NO: 496355 - RNA, 32 nt, Human
ucagggagucugcucugccucccaggcgggau

SEQ ID NO: 496356 - RNA, 32 nt, Human
ucagggagugcuuccuggaggagcugauaccu

SEQ ID NO: 496357 - RNA, 32 nt, Human
ucagggaucacugcaaccucugccuccugggu

SEQ ID NO: 496358 - RNA, 32 nt, Human
ucagggaucaugagggagagugcguuggagcc

SEQ ID NO: 496359 - RNA, 21 nt, Human
ucagggaucuagaacuagaaa

SEQ ID NO: 496360 - RNA, 32 nt, Human
ucagggaucuauggcccuuggcccagccccac

SEQ ID NO: 496361 - RNA, 32 nt, Human
ucagggaucuuucuucccagcccuggagccug

SEQ ID NO: 496362 - RNA, 32 nt, Human
ucagggaugagguggcguugagcugggcggga

SEQ ID NO: 496363 - RNA, 32 nt, Human
ucagggaugcagauguaugagacuggauaacu

SEQ ID NO: 496364 - RNA, 32 nt, Human
ucagggauggagcugcugcugaagggacuugu

SEQ ID NO: 496365 - RNA, 32 nt, Human
ucagggauggcaugcaagaccaccgccaccac

SEQ ID NO: 496366 - RNA, 32 nt, Human
ucagggauggggagccucaugggugaaagagg

SEQ ID NO: 496367 - RNA, 32 nt, Human
ucagggaugguagcuauuuuucugccaugaga

SEQ ID NO: 496368 - RNA, 32 nt, Human
ucagggauguauaaaguacuuguguucugcug

SEQ ID NO: 496369 - RNA, 32 nt, Human
ucagggauuccugguccuuccuucccacacua

SEQ ID NO: 496370 - RNA, 32 nt, Human
ucagggauuggcagaggggaccaaggggacau

SEQ ID NO: 496371 - RNA, 32 nt, Human
ucagggcaaaaauaacagcccauguugaacuc

SEQ ID NO: 496372 - RNA, 32 nt, Human
ucagggcaaaggacagggaccugggagccgag

SEQ ID NO: 496373 - RNA, 32 nt, Human
ucagggcaacagcauuaagcacaucugugaau

SEQ ID NO: 496374 - RNA, 32 nt, Human
ucagggcacacuccagccugacuuuggcacuc

SEQ ID NO: 496375 - RNA, 32 nt, Human
ucagggcacaugcacacagacauuuaucucug

SEQ ID NO: 496376 - RNA, 32 nt, Human
ucagggcacgcaggaccaguuugauugaggag

SEQ ID NO: 496377 - RNA, 32 nt, Human
ucagggcacugcacuggaacacuggguguucc

SEQ ID NO: 496378 - RNA, 32 nt, Human
ucagggcagagcagguguuuaucugccccggc

SEQ ID NO: 496379 - RNA, 32 nt, Human
ucagggcagagggaggaaggacagcagaccag

SEQ ID NO: 496380 - RNA, 32 nt, Human
ucagggcaggcccugcucccccuaccuccuug

SEQ ID NO: 496381 - RNA, 32 nt, Human
ucagggcaggggucugugucuccaccccaagg

SEQ ID NO: 496382 - RNA, 32 nt, Human
ucagggcauggucucaucuccgcaucaggaau

SEQ ID NO: 496383 - RNA, 32 nt, Human
ucagggcauuagagagaaugagccuggugggu

SEQ ID NO: 496384 - RNA, 32 nt, Human
ucagggcauuucucccuccagccagggcccaa

SEQ ID NO: 496385 - RNA, 32 nt, Human
ucagggccaaccacagcuucccgagucauuca

SEQ ID NO: 496386 - RNA, 32 nt, Human
ucagggccacugcuccauugcucugggggcug

SEQ ID NO: 496387 - RNA, 32 nt, Human
ucagggccaguucuggugggcagcagagaccu

SEQ ID NO: 496388 - RNA, 32 nt, Human
ucagggcccagaauguccaggucuccaggguc

SEQ ID NO: 496389 - RNA, 32 nt, Human
ucagggcccagcaguguuccuccaucagcaug

SEQ ID NO: 496390 - RNA, 32 nt, Human
ucagggcccagggagcccccagaggacuuuau

SEQ ID NO: 496391 - RNA, 32 nt, Human
ucagggcccauuucaucucuggcagugccuug

SEQ ID NO: 496392 - RNA, 32 nt, Human
ucagggccugaguccccaugcccugcucuaug

SEQ ID NO: 496393 - RNA, 32 nt, Human
ucagggccugcucucugucaugugaugcuaua

SEQ ID NO: 496394 - RNA, 32 nt, Human
ucagggccuggaacaggcagaguggcccugag

SEQ ID NO: 496395 - RNA, 32 nt, Human
ucagggccuggaugcaggugccaagcucucca

SEQ ID NO: 496396 - RNA, 32 nt, Human
ucagggccuggcaggccagugucuggguuuuu

SEQ ID NO: 496397 - RNA, 32 nt, Human
ucagggccugggaaaagaagaugaggaaauug

SEQ ID NO: 496398 - RNA, 32 nt, Human
ucagggccugggcagccccaauuucuggccca

SEQ ID NO: 496399 - RNA, 32 nt, Human
ucagggccuucccucccugccugggugucggg

SEQ ID NO: 496400 - RNA, 32 nt, Human
ucagggccuugacaccacagagccaagcaaca

SEQ ID NO: 496401 - RNA, 32 nt, Human
ucagggccuuucuccuccccaccuguagcuga

SEQ ID NO: 496402 - RNA, 32 nt, Human
ucagggcgcaauggcggcgcugggcggggaug

SEQ ID NO: 496403 - RNA, 32 nt, Human
ucagggcgcacguguuuguucacauguccagc

SEQ ID NO: 496404 - RNA, 32 nt, Human
ucagggcgcaggagggaaugagcuguggauuu

SEQ ID NO: 496405 - RNA, 32 nt, Human
ucagggcgccucuccaguccacggucaugacc

SEQ ID NO: 496406 - RNA, 32 nt, Human
ucagggcgugcuucugccccagaagaccaaga

SEQ ID NO: 496407 - RNA, 32 nt, Human
ucagggcuagcacaucuuucucuauuauccuu

SEQ ID NO: 496408 - RNA, 31 nt, Human
ucagggcucaauaaggauuugcugaaugaau

SEQ ID NO: 496409 - RNA, 32 nt, Human
ucagggcucacugcagccucgaccuccugggc

SEQ ID NO: 496410 - RNA, 32 nt, Human
ucagggcucacugcagcuuugacuucccaggc

SEQ ID NO: 496411 - RNA, 32 nt, Human
ucagggcucacuguaaccuccgacuccugggu

SEQ ID NO: 496412 - RNA, 32 nt, Human
ucagggcuccacccuuugggccuguagcucuu

SEQ ID NO: 496413 - RNA, 32 nt, Human
ucagggcucccaggacccuggggaggaggcgg

SEQ ID NO: 496414 - RNA, 22 nt, Human
ucagggcuccucaucuuggccu

SEQ ID NO: 496415 - RNA, 32 nt, Human
ucagggcucuagacccgagcccuccaaaccug

SEQ ID NO: 496416 - RNA, 32 nt, Human
ucagggcugaggaggagaagcaggggcaggag

SEQ ID NO: 496417 - RNA, 32 nt, Human
ucagggcugagugcaugagucugcaccuccag

SEQ ID NO: 496418 - RNA, 24 nt, Human
ucagggcugcagugagguacgauc

SEQ ID NO: 496419 - RNA, 32 nt, Human
ucagggcugcauuuccagccagccuggaagua

SEQ ID NO: 496420 - RNA, 32 nt, Human
ucagggcugcugggggcaacuggccauuugcc

SEQ ID NO: 496421 - RNA, 32 nt, Human
ucagggcugggcagguccuggggaggcugaga

SEQ ID NO: 496422 - RNA, 32 nt, Human
ucagggcuguagccugacaaaggguuuccuaa

SEQ ID NO: 496423 - RNA, 22 nt, Human
ucagggcugucacaucuacauc

SEQ ID NO: 496424 - RNA, 32 nt, Human
ucaggggacagaaagagagcacuuucgacaca

SEQ ID NO: 496425 - RNA, 21 nt, Human
ucaggggacucagcccugagg

SEQ ID NO: 496426 - RNA, 22 nt, Human
ucaggggacuggauagauucuu

SEQ ID NO: 496427 - RNA, 31 nt, Human
ucaggggagagcuggaagaaagacugucaac

SEQ ID NO: 496428 - RNA, 22 nt, Human
ucaggggaggauucggucuucu

SEQ ID NO: 496429 - RNA, 32 nt, Human
ucaggggaggucagaggaucccacuuccugag

SEQ ID NO: 496430 - RNA, 22 nt, Human
ucaggggauuuccucuggcuca

SEQ ID NO: 496431 - RNA, 32 nt, Human
ucaggggcacuggccucucugcagggccuucc

SEQ ID NO: 496432 - RNA, 32 nt, Human
ucaggggcacuucaggcuccacaggcgucaug

SEQ ID NO: 496433 - RNA, 32 nt, Human
ucaggggcagcugggcgcaggagcuggugggc

SEQ ID NO: 496434 - RNA, 21 nt, Human
ucaggggcaucucucuggcuc

SEQ ID NO: 496435 - RNA, 32 nt, Human
ucaggggcccccagugaaaugcaggugagggu

SEQ ID NO: 496436 - RNA, 32 nt, Human
ucaggggccuggggcuccugggauuucugugu

SEQ ID NO: 496437 - RNA, 32 nt, Human
ucaggggccuuccucugcccacagagggaguu

SEQ ID NO: 496438 - RNA, 32 nt, Human
ucaggggcucagagcagaguuggaaacacagu

SEQ ID NO: 496439 - RNA, 32 nt, Human
ucaggggcugcacucagacucccuggccaagc

SEQ ID NO: 496440 - RNA, 20 nt, Human
ucaggggcugcccgcuccca

SEQ ID NO: 496441 - RNA, 32 nt, Human
ucaggggcugggaagugucccucuccagcccu

SEQ ID NO: 496442 - RNA, 32 nt, Human
ucaggggcuucacauggaggagcugcagauag

SEQ ID NO: 496443 - RNA, 32 nt, Human
ucaggggcuucugcagggugagcugcuucugu

SEQ ID NO: 496444 - RNA, 32 nt, Human
ucaggggcuucugcuuuugcauccuucucauu

SEQ ID NO: 496445 - RNA, 32 nt, Human
ucagggggauagcggguggugagggaaggggc

SEQ ID NO: 496446 - RNA, 32 nt, Human
ucagggggcaagagccuuucucuccagcuaca

SEQ ID NO: 496447 - RNA, 32 nt, Human
ucagggggccagaagcagcaacuguuuuucau

SEQ ID NO: 496448 - RNA, 32 nt, Human
ucagggggcugagcuggagacugagcuggggc

SEQ ID NO: 496449 - RNA, 32 nt, Human
ucagggggcugaggcaggagaauugcuugaac

SEQ ID NO: 496450 - RNA, 32 nt, Human
ucagggggcugagucaugggaaucacuugaac

SEQ ID NO: 496451 - RNA, 32 nt, Human
ucagggggucaguuaucaugucccugaaaggg

SEQ ID NO: 496452 - RNA, 32 nt, Human
ucaggggguguugccagguguggcuggggaag

SEQ ID NO: 496453 - RNA, 32 nt, Human
ucaggggguugaggcaggagaaucgcuucaac

SEQ ID NO: 496454 - RNA, 32 nt, Human
ucaggggucacugaggccugagacccaggacu

SEQ ID NO: 496455 - RNA, 25 nt, Human
ucagggguccaccuucucuggcuca

SEQ ID NO: 496456 - RNA, 32 nt, Human
ucagggguccagcucugcagggugggggcuag

SEQ ID NO: 496457 - RNA, 32 nt, Human
ucaggggucccagaaagggacagggaaauaaa

SEQ ID NO: 496458 - RNA, 21 nt, Human
ucaggggugagcucuggucca

SEQ ID NO: 496459 - RNA, 32 nt, Human
ucagggguuugagaccagccugggcaacaugg

SEQ ID NO: 496460 - RNA, 32 nt, Human
ucaggguaaccuucucccuugucaucucagcc

SEQ ID NO: 496461 - RNA, 32 nt, Human
ucaggguaaugugcuugguuugcacauguugu

SEQ ID NO: 496462 - RNA, 32 nt, Human
ucaggguagccaccgaacaugaugcucgggca

SEQ ID NO: 496463 - RNA, 32 nt, Human
ucaggguaguagaccugucagauuggagguca

SEQ ID NO: 496464 - RNA, 32 nt, Human
ucaggguauggggagggagggagccagugcuc

SEQ ID NO: 496465 - RNA, 32 nt, Human
ucagggucacccaagcaacaaagucccgagca

SEQ ID NO: 496466 - RNA, 31 nt, Human
ucagggucacucagcagguccuggaggauuu

SEQ ID NO: 496467 - RNA, 32 nt, Human
ucagggucagcccucagggugcuggggcccuu

SEQ ID NO: 496468 - RNA, 32 nt, Human
ucagggucaguguggcuaugccugggaauucc

SEQ ID NO: 496469 - RNA, 21 nt, Human
ucaggguccaggggccucuga

SEQ ID NO: 496470 - RNA, 32 nt, Human
ucaggguccugcaagcaguggggaagggggcc

SEQ ID NO: 496471 - RNA, 32 nt, Human
ucaggguccuucaccgucucuccagucucgga

SEQ ID NO: 496472 - RNA, 32 nt, Human
ucagggucuagaguggagagaaaucgguaaga

SEQ ID NO: 496473 - RNA, 32 nt, Human
ucagggucucagaaaguaggcaggggaggaga

SEQ ID NO: 496474 - RNA, 32 nt, Human
ucagggucucagggagccaguucaaggucugg

SEQ ID NO: 496475 - RNA, 32 nt, Human
ucagggucuccuccucaccccaccccaggccc

SEQ ID NO: 496476 - RNA, 32 nt, Human
ucagggucugcucuccucugaugguccaggcg

SEQ ID NO: 496477 - RNA, 32 nt, Human
ucagggucuucccauggugauucagaauagau

SEQ ID NO: 496478 - RNA, 32 nt, Human
ucagggugaaggacagaguccuggguggggca

SEQ ID NO: 496479 - RNA, 32 nt, Human
ucagggugaggcuggaggggacaggauggggu

SEQ ID NO: 496480 - RNA, 32 nt, Human
ucagggugccaaggaggcagggcugaacacca

SEQ ID NO: 496481 - RNA, 32 nt, Human
ucagggugggaggcacaagaucauuccuguug

SEQ ID NO: 496482 - RNA, 32 nt, Human
ucagggugggauuagggugaggcaagugaggc

SEQ ID NO: 496483 - RNA, 19 nt, Human
ucagggugggccugugcug

SEQ ID NO: 496484 - RNA, 32 nt, Human
ucaggguggggugggcaugggguggggguaug

SEQ ID NO: 496485 - RNA, 32 nt, Human
ucaggguggguacauuuaaaacugacaaguau

SEQ ID NO: 496486 - RNA, 31 nt, Human
ucaggguggguggcagggggauauagugagg

SEQ ID NO: 496487 - RNA, 32 nt, Human
ucaggguggguggcagggggauauagugaggg

SEQ ID NO: 496488 - RNA, 32 nt, Human
ucaggguggguugucugucugcauuugggagg

SEQ ID NO: 496489 - RNA, 32 nt, Human
ucaggguuagaaacagucuugcgagguaggcc

SEQ ID NO: 496490 - RNA, 32 nt, Human
ucaggguuauucaguccucugccucauggcug

SEQ ID NO: 496491 - RNA, 32 nt, Human
ucaggguucucagagccccuggcagauggagg

SEQ ID NO: 496492 - RNA, 32 nt, Human
ucaggguucucugaugccaaagggccuagacu

SEQ ID NO: 496493 - RNA, 32 nt, Human
ucaggguucucugguccaagacccugcuuuaa

SEQ ID NO: 496494 - RNA, 32 nt, Human
ucaggguucugucuugccuucauguggaccuu

SEQ ID NO: 496495 - RNA, 20 nt, Human
ucaggguuggcaaacauuuu

SEQ ID NO: 496496 - RNA, 32 nt, Human
ucaggguuucaggaguccagccccaggaggca

SEQ ID NO: 496497 - RNA, 32 nt, Human
ucaggguuugcaccuugagacauaaucuaccu

SEQ ID NO: 496498 - RNA, 23 nt, Human
ucaggguuuggauuagcagugga

SEQ ID NO: 496499 - RNA, 32 nt, Human
ucaggguuuguucccaccauugcccugagcug

SEQ ID NO: 496500 - RNA, 32 nt, Human
ucaggguuuucugugagccucucaccuuacag

SEQ ID NO: 496501 - RNA, 32 nt, Human
ucaggguuuuucuauucuggacaaugaauuug

SEQ ID NO: 496502 - RNA, 32 nt, Human
ucagguaacaggcagauacaggaaaagcugcu

SEQ ID NO: 496503 - RNA, 32 nt, Human
ucagguacagaaguauugauacaacuaagauc

SEQ ID NO: 496504 - RNA, 32 nt, Human
ucagguacagcagcugaggcugcccugaggaa

SEQ ID NO: 496505 - RNA, 32 nt, Human
ucagguaccagccuggccgggacccggcugug

SEQ ID NO: 496506 - RNA, 18 nt, Human
ucagguaccuggaguuua

SEQ ID NO: 496507 - RNA, 21 nt, Human
ucagguacggagaggauucuc

SEQ ID NO: 496508 - RNA, 32 nt, Human
ucagguacuagggggucuagaccugaggcugc

SEQ ID NO: 496509 - RNA, 32 nt, Human
ucagguacugcucuccccuuccaaccccauuu

SEQ ID NO: 496510 - RNA, 32 nt, Human
ucagguagaagaagaaaggugccacuccggca

SEQ ID NO: 496511 - RNA, 32 nt, Human
ucagguagauuucuuccacugauaacuugagu

SEQ ID NO: 496512 - RNA, 32 nt, Human
ucagguagccucucggcucucucugcuccgcu

SEQ ID NO: 496513 - RNA, 24 nt, Human
ucagguagcugagacuacaggcgu

SEQ ID NO: 496514 - RNA, 32 nt, Human
ucagguaggaggucagcacaagauaacggguc

SEQ ID NO: 496515 - RNA, 32 nt, Human
ucagguagggcugagacucucaggugaggaug

SEQ ID NO: 496516 - RNA, 20 nt, Human
ucagguauccuuaggaccuc

SEQ ID NO: 496517 - RNA, 32 nt, Human
ucagguaugccucaccaauuugcccgucuuua

SEQ ID NO: 496518 - RNA, 32 nt, Human
ucagguaugguggcucaugccuguaaucccag

SEQ ID NO: 496519 - RNA, 32 nt, Human
ucagguauucuuugagacacacaguaucauua

SEQ ID NO: 496520 - RNA, 21 nt, Human
ucagguauugguuagauucuc

SEQ ID NO: 496521 - RNA, 32 nt, Human
ucagguauuguacucgggaggcugagguggga

SEQ ID NO: 496522 - RNA, 32 nt, Human
ucaggucaacacugcacuccagccugggcgac

SEQ ID NO: 496523 - RNA, 32 nt, Human
ucaggucaaucagcaaggacccaucucugccc

SEQ ID NO: 496524 - RNA, 32 nt, Human
ucaggucacagcaugcagaagaacaguccaac

SEQ ID NO: 496525 - RNA, 32 nt, Human
ucaggucacauugcucacagggcacaguucuc

SEQ ID NO: 496526 - RNA, 32 nt, Human
ucaggucacugcaaccucugccucccagguuc

SEQ ID NO: 496527 - RNA, 32 nt, Human
ucaggucacugcacaaauauaucugcaauuau

SEQ ID NO: 496528 - RNA, 32 nt, Human
ucaggucacugugcggcccugcuccaaacucc

SEQ ID NO: 496529 - RNA, 32 nt, Human
ucaggucagaagacaugccuggagggaugucu

SEQ ID NO: 496530 - RNA, 32 nt, Human
ucaggucagcagcagaggcuccuggccuucuu

SEQ ID NO: 496531 - RNA, 32 nt, Human
ucaggucagcucaggcuggagcaggcauauga

SEQ ID NO: 496532 - RNA, 32 nt, Human
ucaggucagcucaggcuggagcagguauauga

SEQ ID NO: 496533 - RNA, 32 nt, Human
ucaggucaggagaggcagaguugagguucugc

SEQ ID NO: 496534 - RNA, 32 nt, Human
ucaggucaggagcuggaaguucaccugcaggu

SEQ ID NO: 496535 - RNA, 32 nt, Human
ucaggucaggaggcuggaguggagggaaggca

SEQ ID NO: 496536 - RNA, 32 nt, Human
ucaggucaggccagggcagugcugcugcagag

SEQ ID NO: 496537 - RNA, 32 nt, Human
ucaggucagggacuuggacaggagucaguguc

SEQ ID NO: 496538 - RNA, 32 nt, Human
ucaggucagggugggcuggaaaguggugccac

SEQ ID NO: 496539 - RNA, 32 nt, Human
ucagguccagccuucccuguagccagacaguu

SEQ ID NO: 496540 - RNA, 32 nt, Human
ucaggucccaacggggcugaguucuagcccag

SEQ ID NO: 496541 - RNA, 32 nt, Human
ucaggucccagagggccaccguguccauuaca

SEQ ID NO: 496542 - RNA, 32 nt, Human
ucaggucccauguugucccugcugccucccuc

SEQ ID NO: 496543 - RNA, 32 nt, Human
ucaggucccugcugccaagagucagauaggcc

SEQ ID NO: 496544 - RNA, 32 nt, Human
ucagguccugggacuaaggcggggacaugacu

SEQ ID NO: 496545 - RNA, 32 nt, Human
ucagguccugguggcaucucaggguccugccc

SEQ ID NO: 496546 - RNA, 32 nt, Human
ucagguccuguccuuaugggccugugucuggu

SEQ ID NO: 496547 - RNA, 32 nt, Human
ucagguccuuuuuggagggcaaaggaaguucc

SEQ ID NO: 496548 - RNA, 32 nt, Human
ucaggucgggaguucaagaccagccuggccaa

SEQ ID NO: 496549 - RNA, 32 nt, Human
ucaggucucagugucccuaucuguaagaucaa

SEQ ID NO: 496550 - RNA, 32 nt, Human
ucaggucucccaucucccucagugaccuggau

SEQ ID NO: 496551 - RNA, 32 nt, Human
ucaggucugaaacccacccacccgcaagccua

SEQ ID NO: 496552 - RNA, 32 nt, Human
ucaggucugaaaucuuuagcacuuaaggaaaa

SEQ ID NO: 496553 - RNA, 32 nt, Human
ucaggucugaagcagguuuggggccugcugac

SEQ ID NO: 496554 - RNA, 32 nt, Human
ucaggucugauaguccucugcuaaaacaacac

SEQ ID NO: 496555 - RNA, 32 nt, Human
ucaggucugggcugagaugugugcagagggcc

SEQ ID NO: 496556 - RNA, 32 nt, Human
ucaggucugguggcaggagggcagcagugugc

SEQ ID NO: 496557 - RNA, 23 nt, Human
ucaggucuuauucaagaauagua

SEQ ID NO: 496558 - RNA, 32 nt, Human
ucaggucuuauucaagaauaguaagucauauu

SEQ ID NO: 496559 - RNA, 32 nt, Human
ucaggucuuugaggccagcccuagccaacaug

SEQ ID NO: 496560 - RNA, 32 nt, Human
ucaggugaaagagaugcccuaaagaggacuga

SEQ ID NO: 496561 - RNA, 32 nt, Human
ucaggugaacagcucggagaagcugcagcugc

SEQ ID NO: 496562 - RNA, 32 nt, Human
ucaggugaaugggaccagucucucuucuucca

SEQ ID NO: 496563 - RNA, 23 nt, Human
ucaggugacaaccauuaugauca

SEQ ID NO: 496564 - RNA, 22 nt, Human
ucaggugaccagcuugugucuc

SEQ ID NO: 496565 - RNA, 32 nt, Human
ucaggugacggacucagacuccuggcuucaug

SEQ ID NO: 496566 - RNA, 32 nt, Human
ucaggugagaagcagaggaaggagaggagagg

SEQ ID NO: 496567 - RNA, 32 nt, Human
ucaggugagugcaggccaaggcgggggugaga

SEQ ID NO: 496568 - RNA, 32 nt, Human
ucaggugauauugcaauucuguauuuaaagcu

SEQ ID NO: 496569 - RNA, 32 nt, Human
ucaggugauccacccaccccagccucccaaag

SEQ ID NO: 496570 - RNA, 32 nt, Human
ucaggugauccacccaccucagccucucaaag

SEQ ID NO: 496571 - RNA, 32 nt, Human
ucaggugauccgcccgccucagccucugaaau

SEQ ID NO: 496572 - RNA, 32 nt, Human
ucaggugauccgccugccucagccucucaaag

SEQ ID NO: 496573 - RNA, 32 nt, Human
ucaggugauccgccugucucagccucuccaag

SEQ ID NO: 496574 - RNA, 32 nt, Human
ucaggugauccucccaucucagccucucgagu

SEQ ID NO: 496575 - RNA, 32 nt, Human
ucaggugauccuccugccucagccucuuaagu

SEQ ID NO: 496576 - RNA, 32 nt, Human
ucaggugaugaacaggcugaaaucaguacuuc

SEQ ID NO: 496577 - RNA, 32 nt, Human
ucaggugauucacccaccucagcuucccaaag

SEQ ID NO: 496578 - RNA, 32 nt, Human
ucaggugauucucuugccucagccucugaagu

SEQ ID NO: 496579 - RNA, 20 nt, Human
ucaggugauuuguaugcuca

SEQ ID NO: 496580 - RNA, 32 nt, Human
ucaggugcaacccagucugccuagcagccccc

SEQ ID NO: 496581 - RNA, 32 nt, Human
ucaggugcaagcauguguguucccggggcgcg

SEQ ID NO: 496582 - RNA, 21 nt, Human
ucaggugcacacaucaccagg

SEQ ID NO: 496583 - RNA, 32 nt, Human
ucaggugcacacaucaccaggugcaucugcag

SEQ ID NO: 496584 - RNA, 32 nt, Human
ucaggugcagcaggguccuccuugucugguuc

SEQ ID NO: 496585 - RNA, 32 nt, Human
ucaggugcagggaggaaauggaagcacguucu

SEQ ID NO: 496586 - RNA, 32 nt, Human
ucaggugcccccauugccucaggcuggcccug

SEQ ID NO: 496587 - RNA, 32 nt, Human
ucaggugccguggcucacaccuguaaucccag

SEQ ID NO: 496588 - RNA, 32 nt, Human
ucaggugccucugccauagcuucugucgccug

SEQ ID NO: 496589 - RNA, 32 nt, Human
ucaggugcugcagcuccaccucagagggcacu

SEQ ID NO: 496590 - RNA, 32 nt, Human
ucaggugcuucugugcuugcuguccuaccucu

SEQ ID NO: 496591 - RNA, 32 nt, Human
ucaggugcuuguucuguccucuugccuuuuac

SEQ ID NO: 496592 - RNA, 32 nt, Human
ucagguggcagaggugaaagaaaauaauguau

SEQ ID NO: 496593 - RNA, 18 nt, Human
ucagguggccaugccuca

SEQ ID NO: 496594 - RNA, 32 nt, Human
ucagguggcccaugccugggaucuucucuaug

SEQ ID NO: 496595 - RNA, 32 nt, Human
ucagguggccucagccuggcccaggggaccag

SEQ ID NO: 496596 - RNA, 32 nt, Human
ucagguggcuaaggcaggagaaucacuucagc

SEQ ID NO: 496597 - RNA, 32 nt, Human
ucagguggcugaggcaggagaaucacuugaac

SEQ ID NO: 496598 - RNA, 32 nt, Human
ucaggugggaggaagagagaccucagggaaaa

SEQ ID NO: 496599 - RNA, 32 nt, Human
ucaggugggaggauugcuugaggccagccugg

SEQ ID NO: 496600 - RNA, 32 nt, Human
ucaggugggaggauugcuugaggccaggaguu

SEQ ID NO: 496601 - RNA, 32 nt, Human
ucaggugggcugggaccuaggaagcuccaucu

SEQ ID NO: 496602 - RNA, 32 nt, Human
ucagguggggucucgcucugucaccuagacua

SEQ ID NO: 496603 - RNA, 32 nt, Human
ucagguggggucuuccucgguugcguaccugg

SEQ ID NO: 496604 - RNA, 32 nt, Human
ucaggugucuauaauuguagcacauggagaaa

SEQ ID NO: 496605 - RNA, 32 nt, Human
ucagguguggcggugcgugccuguaaucccag

SEQ ID NO: 496606 - RNA, 32 nt, Human
ucagguguggcugcugugggggcaggugccag

SEQ ID NO: 496607 - RNA, 29 nt, Human
ucagguguggcuucucucacaccuggcgc

SEQ ID NO: 496608 - RNA, 32 nt, Human
ucaggugugguggugcaugccuguaaucccag

SEQ ID NO: 496609 - RNA, 32 nt, Human
ucagguguucaaggaaacggucuacccuucuu

SEQ ID NO: 496610 - RNA, 32 nt, Human
ucagguguugggggaugggguguggaggcagc

SEQ ID NO: 496611 - RNA, 32 nt, Human
ucagguuaucaaaggcaaguagaguaauaaau

SEQ ID NO: 496612 - RNA, 32 nt, Human
ucagguucaagcaauucucaugcuucagccuc

SEQ ID NO: 496613 - RNA, 32 nt, Human
ucagguucaagcaauucuccugccucagccuc

SEQ ID NO: 496614 - RNA, 32 nt, Human
ucagguucaagcaauucuccugccuccgccuc

SEQ ID NO: 496615 - RNA, 32 nt, Human
ucagguucaagugauucuccugccucugccuc

SEQ ID NO: 496616 - RNA, 32 nt, Human
ucagguucauuuccauaguucccugcggccuc

SEQ ID NO: 496617 - RNA, 32 nt, Human
ucagguuccagagcuuggagguuccaggucca

SEQ ID NO: 496618 - RNA, 32 nt, Human
ucagguucccaagacuucaguccuggucugcu

SEQ ID NO: 496619 - RNA, 32 nt, Human
ucagguuccuagaccaccccagaugcaggggc

SEQ ID NO: 496620 - RNA, 31 nt, Human
ucagguucgcccucugggccagguccuucac

SEQ ID NO: 496621 - RNA, 32 nt, Human
ucagguucuagaacagugucauccaacauaaa

SEQ ID NO: 496622 - RNA, 32 nt, Human
ucagguucugccucugggaggcugugugcacc

SEQ ID NO: 496623 - RNA, 32 nt, Human
ucagguugaagacccugguucuuccaguuccu

SEQ ID NO: 496624 - RNA, 32 nt, Human
ucagguugacucuguacaucugaauagugagu

SEQ ID NO: 496625 - RNA, 32 nt, Human
ucagguuggaagggguguaggaagagggguga

SEQ ID NO: 496626 - RNA, 32 nt, Human
ucagguuggaguccuguccuuacucugcugca

SEQ ID NO: 496627 - RNA, 32 nt, Human
ucagguuggcaccucuggaggugcccaggcuu

SEQ ID NO: 496628 - RNA, 32 nt, Human
ucagguugucaugggggaaacugaggcacagg

SEQ ID NO: 496629 - RNA, 32 nt, Human
ucagguuuagagcccauguccacccaugucca

SEQ ID NO: 496630 - RNA, 32 nt, Human
ucagguuuccagagcugaggaguggugccuau

SEQ ID NO: 496631 - RNA, 32 nt, Human
ucagguuuccggcuacugacagugguagaguc

SEQ ID NO: 496632 - RNA, 32 nt, Human
ucagguuugcucccccucuacccuuuccccca

SEQ ID NO: 496633 - RNA, 32 nt, Human
ucagguuuuccuucuaggugcuguuccggugg

SEQ ID NO: 496634 - RNA, 32 nt, Human
ucagguuuuggaaaauggaagaagcacaaagg

SEQ ID NO: 496635 - RNA, 32 nt, Human
ucagguuuuuccuauugcaccaugaaguccuu

SEQ ID NO: 496636 - RNA, 32 nt, Human
ucaguaaacacauuaccaaauuuuaaauaagg

SEQ ID NO: 496637 - RNA, 32 nt, Human
ucaguaaaguacaaaguguuuauuuuacaaaa

SEQ ID NO: 496638 - RNA, 32 nt, Human
ucaguaaauuguuuguucuaagccacuuuuaa

SEQ ID NO: 496639 - RNA, 32 nt, Human
ucaguaacaccagcuuccugucagcugcaacc

SEQ ID NO: 496640 - RNA, 32 nt, Human
ucaguaacuauaccugguacauuuccugugug

SEQ ID NO: 496641 - RNA, 32 nt, Human
ucaguaacucacuguuucuaagccuccuggac

SEQ ID NO: 496642 - RNA, 32 nt, Human
ucaguaacugauuuaccuugaucacuuuucaa

SEQ ID NO: 496643 - RNA, 32 nt, Human
ucaguaacugcucccccuucuccauauaagca

SEQ ID NO: 496644 - RNA, 32 nt, Human
ucaguaagcucugcucaaagaagaggaucuau

SEQ ID NO: 496645 - RNA, 32 nt, Human
ucaguaaggagguagaguagauuugugaacag

SEQ ID NO: 496646 - RNA, 32 nt, Human
ucaguaauacgguuuccccugggguugaccag

SEQ ID NO: 496647 - RNA, 32 nt, Human
ucaguaauacugggugacucacuugagugacc

SEQ ID NO: 496648 - RNA, 32 nt, Human
ucaguaaucacuuuucagaagacuucuaugga

SEQ ID NO: 496649 - RNA, 32 nt, Human
ucaguaaucugaguuuuugauggccuuuuaaa

SEQ ID NO: 496650 - RNA, 32 nt, Human
ucaguaauguacugaaaucuuauaagugaaua

SEQ ID NO: 496651 - RNA, 18 nt, Human
ucaguaauguuaauucuu

SEQ ID NO: 496652 - RNA, 32 nt, Human
ucaguaauuccugcccagaagacuuuuauuua

SEQ ID NO: 496653 - RNA, 32 nt, Human
ucaguaauuucugcuuuuuagccagggccagu

SEQ ID NO: 496654 - RNA, 32 nt, Human
ucaguacaaagccacaauaggagcugacuuuc

SEQ ID NO: 496655 - RNA, 32 nt, Human
ucaguacacagaagagacggaugugagacacc

SEQ ID NO: 496656 - RNA, 32 nt, Human
ucaguacaucuauuuugugaacaucaguugga

SEQ ID NO: 496657 - RNA, 32 nt, Human
ucaguaccaaguagcuggagguggugaucaga

SEQ ID NO: 496658 - RNA, 32 nt, Human
ucaguaccaguucugccagccacagugagccc

SEQ ID NO: 496659 - RNA, 32 nt, Human
ucaguacccagggccucuucagcucuuuguag

SEQ ID NO: 496660 - RNA, 32 nt, Human
ucaguacccugccuucuugacugguuuccguu

SEQ ID NO: 496661 - RNA, 20 nt, Human
ucaguaccugaggggcugcu

SEQ ID NO: 496662 - RNA, 32 nt, Human
ucaguaccuucaccugucucagucucuagagc

SEQ ID NO: 496663 - RNA, 32 nt, Human
ucaguacuauacuguaaggagaagcugagaaa

SEQ ID NO: 496664 - RNA, 31 nt, Human
ucaguacucaauaaauauuugugggauguug

SEQ ID NO: 496665 - RNA, 32 nt, Human
ucaguacuggaggacacagucaaguguuuggu

SEQ ID NO: 496666 - RNA, 32 nt, Human
ucaguacugggaaagggugaggcugaggcugc

SEQ ID NO: 496667 - RNA, 32 nt, Human
ucaguacuucuggagccaaggugggaggauug

SEQ ID NO: 496668 - RNA, 32 nt, Human
ucaguacuugaccacaucccaggauuuauggu

SEQ ID NO: 496669 - RNA, 32 nt, Human
ucaguacuugacuccuuuuuauggccuuagga

SEQ ID NO: 496670 - RNA, 32 nt, Human
ucaguacuugccuccuugcuggcauugaauua

SEQ ID NO: 496671 - RNA, 32 nt, Human
ucaguacuugcuggaaaagaauauggauucug

SEQ ID NO: 496672 - RNA, 32 nt, Human
ucaguacuuggcugcuuuucugugaaaauuau

SEQ ID NO: 496673 - RNA, 32 nt, Human
ucaguacuuuguuuccccagguagaguggggg

SEQ ID NO: 496674 - RNA, 21 nt, Human
ucaguagaaacagcaguugua

SEQ ID NO: 496675 - RNA, 32 nt, Human
ucaguagaagagagaggaaaguagacuccauc

SEQ ID NO: 496676 - RNA, 32 nt, Human
ucaguagagacagggucucaccauguuagcca

SEQ ID NO: 496677 - RNA, 32 nt, Human
ucaguagagacaggguuucaccauguuggcca

SEQ ID NO: 496678 - RNA, 32 nt, Human
ucaguagagacaggguuucgccauguugccca

SEQ ID NO: 496679 - RNA, 32 nt, Human
ucaguagagacagguuucaccacauuggucag

SEQ ID NO: 496680 - RNA, 32 nt, Human
ucaguagagacggguuucaucaugguggccag

SEQ ID NO: 496681 - RNA, 32 nt, Human
ucaguagagauggguuucaccauguuggccag

SEQ ID NO: 496682 - RNA, 21 nt, Human
ucaguagagggaaccgacuug

SEQ ID NO: 496683 - RNA, 32 nt, Human
ucaguagauuucugggcuccuauauucacuag

SEQ ID NO: 496684 - RNA, 32 nt, Human
ucaguagcagaggacgauccuccgaugaaagc

SEQ ID NO: 496685 - RNA, 32 nt, Human
ucaguagcauuuuuagccaucucgaucacagc

SEQ ID NO: 496686 - RNA, 32 nt, Human
ucaguagccagccuggguccugccagggcuuc

SEQ ID NO: 496687 - RNA, 32 nt, Human
ucaguagccagcuuguccucacccucaggaag

SEQ ID NO: 496688 - RNA, 32 nt, Human
ucaguagcccuccuccuaccacugaaccccau

SEQ ID NO: 496689 - RNA, 32 nt, Human
ucaguagccuccaaccaugcaaugauucaaua

SEQ ID NO: 496690 - RNA, 32 nt, Human
ucaguagccugaguguuauacuagagaucuaa

SEQ ID NO: 496691 - RNA, 32 nt, Human
ucaguagcuuucuuacagcgucuuugaaagug

SEQ ID NO: 496692 - RNA, 32 nt, Human
ucaguaggaagagcugaggcugccugggaggc

SEQ ID NO: 496693 - RNA, 32 nt, Human
ucaguaggaaggggugaggcagcuguccugag

SEQ ID NO: 496694 - RNA, 32 nt, Human
ucaguaggagcagaaaaguuacuggggaguac

SEQ ID NO: 496695 - RNA, 32 nt, Human
ucaguaggagcuugucuucccugggcccccag

SEQ ID NO: 496696 - RNA, 32 nt, Human
ucaguaggcccaggagcaucaaaacgggaaca

SEQ ID NO: 496697 - RNA, 18 nt, Human
ucaguagggcaaaauguu

SEQ ID NO: 496698 - RNA, 32 nt, Human
ucaguagucacacccucacagcuggccugccc

SEQ ID NO: 496699 - RNA, 32 nt, Human
ucaguagucaucucuguaaaucugcaauuucu

SEQ ID NO: 496700 - RNA, 19 nt, Human
ucaguaguucuccuugcug

SEQ ID NO: 496701 - RNA, 30 nt, Human
ucaguaguuugcauuucagaaagccuuuca

SEQ ID NO: 496702 - RNA, 32 nt, Human
ucaguauagcugugcaccucugggcaaauagu

SEQ ID NO: 496703 - RNA, 32 nt, Human
ucaguaucaaaccaaagauuucuaucucuucc

SEQ ID NO: 496704 - RNA, 32 nt, Human
ucaguaucacucaacuucacuuuaugaaccaa

SEQ ID NO: 496705 - RNA, 32 nt, Human
ucaguaucccacaugggaguguucccuagguu

SEQ ID NO: 496706 - RNA, 32 nt, Human
ucaguaucccagauuguaauuuugccaagugu

SEQ ID NO: 496707 - RNA, 32 nt, Human
ucaguauccuccugucacaggagggaguuggg

SEQ ID NO: 496708 - RNA, 32 nt, Human
ucaguaucugcugcuuuugauguugcaagaca

SEQ ID NO: 496709 - RNA, 32 nt, Human
ucaguauuaaaaccagcuuaacuucuaugaca

SEQ ID NO: 496710 - RNA, 32 nt, Human
ucaguauucucaucugucauggcggccaagac

SEQ ID NO: 496711 - RNA, 32 nt, Human
ucaguauucuucccuuuguuucaucaaaggga

SEQ ID NO: 496712 - RNA, 31 nt, Human
ucaguauuuauguucuaucauuuaaaaagag

SEQ ID NO: 496713 - RNA, 32 nt, Human
ucaguauuuauuucugucucuggauuugacuu

SEQ ID NO: 496714 - RNA, 32 nt, Human
ucaguauuucaagcucuauuucuguggcacau

SEQ ID NO: 496715 - RNA, 32 nt, Human
ucaguauuucugcacucuuagcuggauucuaa

SEQ ID NO: 496716 - RNA, 32 nt, Human
ucaguauuuuucauuuaccauaugaaguuuag

SEQ ID NO: 496717 - RNA, 32 nt, Human
ucagucaaccagcaguggacuacagcucacua

SEQ ID NO: 496718 - RNA, 32 nt, Human
ucagucaacucaugccagcagccucagcgucu

SEQ ID NO: 496719 - RNA, 32 nt, Human
ucagucaacuuaaaucugaacuuuuucuuaaa

SEQ ID NO: 496720 - RNA, 32 nt, Human
ucagucaaggacaaaccucccaccucacagac

SEQ ID NO: 496721 - RNA, 32 nt, Human
ucagucacagagaggcaggagagagguucugu

SEQ ID NO: 496722 - RNA, 32 nt, Human
ucagucacaggcaaaggcuggguuuggcuggg

SEQ ID NO: 496723 - RNA, 32 nt, Human
ucagucacaggccugggcuuccuggccugagu

SEQ ID NO: 496724 - RNA, 20 nt, Human
ucagucacccaggcugaaaa

SEQ ID NO: 496725 - RNA, 32 nt, Human
ucagucacccuccagugugcauugacgaccag

SEQ ID NO: 496726 - RNA, 27 nt, Human
ucagucacccugacccagagggcugcc

SEQ ID NO: 496727 - RNA, 32 nt, Human
ucagucaccugucaggguuugugcggguuggg

SEQ ID NO: 496728 - RNA, 22 nt, Human
ucagucaccuuugggguugcca

SEQ ID NO: 496729 - RNA, 32 nt, Human
ucagucacucccuugaauggugcaaugaauua

SEQ ID NO: 496730 - RNA, 32 nt, Human
ucagucacugcacuggugcaaaggcaagcaga

SEQ ID NO: 496731 - RNA, 32 nt, Human
ucagucacugccugggcugugugguucugggc

SEQ ID NO: 496732 - RNA, 32 nt, Human
ucagucacuggggcggaggcagcggcuguagc

SEQ ID NO: 496733 - RNA, 32 nt, Human
ucagucagacagggagcugggcuaagauggcc

SEQ ID NO: 496734 - RNA, 22 nt, Human
ucagucagauucaacuauuuua

SEQ ID NO: 496735 - RNA, 21 nt, Human
ucagucagccacaccuuccug

SEQ ID NO: 496736 - RNA, 22 nt, Human
ucagucagccaguggcuucuug

SEQ ID NO: 496737 - RNA, 22 nt, Human
ucagucagcccaccuuguccug

SEQ ID NO: 496738 - RNA, 23 nt, Human
ucagucagcccagugggaucuua

SEQ ID NO: 496739 - RNA, 19 nt, Human
ucagucagcuauccuugca

SEQ ID NO: 496740 - RNA, 32 nt, Human
ucagucaguagaaccuacccacccucacggcc

SEQ ID NO: 496741 - RNA, 21 nt, Human
ucagucaguaugaacuuccug

SEQ ID NO: 496742 - RNA, 32 nt, Human
ucagucaucauuaaacuucucuggaccaaaaa

SEQ ID NO: 496743 - RNA, 32 nt, Human
ucagucaucucugcaagggacccugacgccug

SEQ ID NO: 496744 - RNA, 25 nt, Human
ucagucaucuucagggaccagucug

SEQ ID NO: 496745 - RNA, 31 nt, Human
ucagucaugaccaucuguaucuuguuaccug

SEQ ID NO: 496746 - RNA, 32 nt, Human
ucagucaugcugcaacaacugagacacugaga

SEQ ID NO: 496747 - RNA, 32 nt, Human
ucagucauggcggaagguaaagagguagcagc

SEQ ID NO: 496748 - RNA, 32 nt, Human
ucagucauguaaccccgggagggaccuucccu

SEQ ID NO: 496749 - RNA, 32 nt, Human
ucaguccaacauccuuuucuccaucagcaacu

SEQ ID NO: 496750 - RNA, 32 nt, Human
ucaguccaacuugcacgaagcucgcauugaaa

SEQ ID NO: 496751 - RNA, 32 nt, Human
ucaguccaagcuguggaaaagcuccccuuauc

SEQ ID NO: 496752 - RNA, 32 nt, Human
ucaguccacagcuguaugccccagucacacaa

SEQ ID NO: 496753 - RNA, 32 nt, Human
ucaguccacggaccugcugagcugcagccacu

SEQ ID NO: 496754 - RNA, 32 nt, Human
ucaguccacugcaaccucugcccucccggguu

SEQ ID NO: 496755 - RNA, 20 nt, Human
ucaguccaggcaggaagcag

SEQ ID NO: 496756 - RNA, 32 nt, Human
ucaguccaggcuggagagguuggggccggggu

SEQ ID NO: 496757 - RNA, 32 nt, Human
ucaguccagguggagguugguuuuguaguucu

SEQ ID NO: 496758 - RNA, 32 nt, Human
ucaguccauagagacgaacagaaugagaccuu

SEQ ID NO: 496759 - RNA, 32 nt, Human
ucaguccaugacaguuacuaaaggacauuuua

SEQ ID NO: 496760 - RNA, 32 nt, Human
ucagucccaaagagucaguauugggugguaac

SEQ ID NO: 496761 - RNA, 32 nt, Human
ucagucccaagugcccuuuuacagagaaugcc

SEQ ID NO: 496762 - RNA, 32 nt, Human
ucagucccagagggguggucaccccacccuuc

SEQ ID NO: 496763 - RNA, 32 nt, Human
ucagucccagaucuugcucugccuugggguuc

SEQ ID NO: 496764 - RNA, 32 nt, Human
ucagucccagcccuguagcugugugucuuggg

SEQ ID NO: 496765 - RNA, 32 nt, Human
ucaguccccaccuguacaacaacggaaaggug

SEQ ID NO: 496766 - RNA, 20 nt, Human
ucagucccccgcccccuccc

SEQ ID NO: 496767 - RNA, 32 nt, Human
ucagucccccuuccucccacucuccacccuac

SEQ ID NO: 496768 - RNA, 20 nt, Human
ucaguccccgugcugugcuu

SEQ ID NO: 496769 - RNA, 32 nt, Human
ucaguccccucagaccacggugaugccuugac

SEQ ID NO: 496770 - RNA, 22 nt, Human
ucaguccccucauauagguuua

SEQ ID NO: 496771 - RNA, 22 nt, Human
ucaguccccucucucuggguca

SEQ ID NO: 496772 - RNA, 32 nt, Human
ucagucccgcucuccuaccacacccaccuuuc

SEQ ID NO: 496773 - RNA, 22 nt, Human
ucagucccucccuccuggcuca

SEQ ID NO: 496774 - RNA, 32 nt, Human
ucagucccugccugcccugccuaggucuagcc

SEQ ID NO: 496775 - RNA, 22 nt, Human
ucagucccugcugggugacuca

SEQ ID NO: 496776 - RNA, 32 nt, Human
ucagucccuuccaagcugcacuggucauuggg

SEQ ID NO: 496777 - RNA, 32 nt, Human
ucagucccuuccucugcuguguuuuucuugag

SEQ ID NO: 496778 - RNA, 32 nt, Human
ucaguccgucugucuucucuuuccucugcccu

SEQ ID NO: 496779 - RNA, 32 nt, Human
ucaguccuagaaggucucugaagaucuggacu

SEQ ID NO: 496780 - RNA, 23 nt, Human
ucaguccucaggcccaaggcuca

SEQ ID NO: 496781 - RNA, 32 nt, Human
ucaguccuccccacccuccuuccucugucucc

SEQ ID NO: 496782 - RNA, 32 nt, Human
ucaguccucugguuaugaccucaaguccuacu

SEQ ID NO: 496783 - RNA, 19 nt, Human
ucaguccucuuggagucua

SEQ ID NO: 496784 - RNA, 32 nt, Human
ucaguccucuuucaaagguagccaucauggau

SEQ ID NO: 496785 - RNA, 32 nt, Human
ucaguccucuuucugugccuggcauaucuggu

SEQ ID NO: 496786 - RNA, 32 nt, Human
ucaguccugaaccacauuacuuuccugucuac

SEQ ID NO: 496787 - RNA, 32 nt, Human
ucaguccugaggaaaaauauuggggacuccaa

SEQ ID NO: 496788 - RNA, 32 nt, Human
ucaguccugccuggguccuggugccuuggacc

SEQ ID NO: 496789 - RNA, 32 nt, Human
ucaguccugggcaaagguauuaguacaauaag

SEQ ID NO: 496790 - RNA, 32 nt, Human
ucaguccugucugacugaccucagggccucac

SEQ ID NO: 496791 - RNA, 32 nt, Human
ucaguccugucugaucgaggccucgccucucu

SEQ ID NO: 496792 - RNA, 32 nt, Human
ucaguccugugcauccaggcuguuaggugacu

SEQ ID NO: 496793 - RNA, 32 nt, Human
ucaguccuuacggguaaacagauugagcaugg

SEQ ID NO: 496794 - RNA, 18 nt, Human
ucaguccuucguguaaca

SEQ ID NO: 496795 - RNA, 21 nt, Human
ucagucgaaaggggcuggggc

SEQ ID NO: 496796 - RNA, 32 nt, Human
ucagucgauuucaguucugauaauguuaagaa

SEQ ID NO: 496797 - RNA, 32 nt, Human
ucagucgcccaggcuggagugcaguggcauga

SEQ ID NO: 496798 - RNA, 32 nt, Human
ucagucgcucaggcuggagugcaguggcgcga

SEQ ID NO: 496799 - RNA, 32 nt, Human
ucagucgcuucuguuuagaggaaggcccccua

SEQ ID NO: 496800 - RNA, 32 nt, Human
ucagucggccugcgcuccucagccuggcgguu

SEQ ID NO: 496801 - RNA, 32 nt, Human
ucagucggggagaugagaggaggcaugaagcu

SEQ ID NO: 496802 - RNA, 32 nt, Human
ucagucgguaugcucuggcaucccauuucuuc

SEQ ID NO: 496803 - RNA, 32 nt, Human
ucagucgucauuuuuaaguccagugagcauug

SEQ ID NO: 496804 - RNA, 32 nt, Human
ucagucuaagcuguggaaaagcuccccuuauc

SEQ ID NO: 496805 - RNA, 32 nt, Human
ucagucuaggaagaaagagaaaguagcaggaa

SEQ ID NO: 496806 - RNA, 32 nt, Human
ucagucuaugcagcaaaagcacagagacuuaa

SEQ ID NO: 496807 - RNA, 32 nt, Human
ucagucuauguucuuuagguagcuagacacaa

SEQ ID NO: 496808 - RNA, 32 nt, Human
ucagucucaaaacaaaaacaaaaacaaacaaa

SEQ ID NO: 496809 - RNA, 32 nt, Human
ucagucucaaagcacaaggagguucagcccag

SEQ ID NO: 496810 - RNA, 32 nt, Human
ucagucucacgaccuacccccaccccggacug

SEQ ID NO: 496811 - RNA, 32 nt, Human
ucagucucaguuacuuagaauggaacccagag

SEQ ID NO: 496812 - RNA, 32 nt, Human
ucagucucaugcuccuggaauaccuucaauag

SEQ ID NO: 496813 - RNA, 32 nt, Human
ucagucuccacaacaggacgaagcuggcugag

SEQ ID NO: 496814 - RNA, 32 nt, Human
ucagucucccaaagcgcugggauuacaggcag

SEQ ID NO: 496815 - RNA, 32 nt, Human
ucagucucccaaagggcugggauuaaaggcau

SEQ ID NO: 496816 - RNA, 32 nt, Human
ucagucucccaaagugcugagauuacaggcau

SEQ ID NO: 496817 - RNA, 32 nt, Human
ucagucucccaaagugcugggauuacaggcau

SEQ ID NO: 496818 - RNA, 32 nt, Human
ucagucucccaaagugcugggauuacaggcgu

SEQ ID NO: 496819 - RNA, 32 nt, Human
ucagucucccaaagugcugggauuauaggcgu

SEQ ID NO: 496820 - RNA, 32 nt, Human
ucagucucccaaagugcugguauuacaggcgu

SEQ ID NO: 496821 - RNA, 32 nt, Human
ucagucucccaaauugccgggauuacaggcau

SEQ ID NO: 496822 - RNA, 32 nt, Human
ucagucucccaaguagcagggauuacaggcau

SEQ ID NO: 496823 - RNA, 32 nt, Human
ucagucucccaaguagcugggauuacaggugu

SEQ ID NO: 496824 - RNA, 32 nt, Human
ucagucucccaaguagcugggauuauaggcau

SEQ ID NO: 496825 - RNA, 32 nt, Human
ucagucucccaggacucugcugccucagccag

SEQ ID NO: 496826 - RNA, 32 nt, Human
ucagucucccagguagcugggauuacaggcau

SEQ ID NO: 496827 - RNA, 32 nt, Human
ucagucucccgaagugcugggauuacagaugu

SEQ ID NO: 496828 - RNA, 32 nt, Human
ucagucucccgaguagcugggauuacaggcac

SEQ ID NO: 496829 - RNA, 32 nt, Human
ucagucucccgaguagcugggauuacaggcgu

SEQ ID NO: 496830 - RNA, 32 nt, Human
ucagucucccgaguagcugggauuauaggcgc

SEQ ID NO: 496831 - RNA, 32 nt, Human
ucagucucccuaagugcugggauuacagacgu

SEQ ID NO: 496832 - RNA, 32 nt, Human
ucagucuccgaugccaucaugcagccugguua

SEQ ID NO: 496833 - RNA, 32 nt, Human
ucagucuccgguucagcuuccgacaccagagu

SEQ ID NO: 496834 - RNA, 32 nt, Human
ucagucuccugcucaaaacaggagcgcagcag

SEQ ID NO: 496835 - RNA, 22 nt, Human
ucagucuccugucccagcuuca

SEQ ID NO: 496836 - RNA, 32 nt, Human
ucagucucgagccucagucucccgucugggac

SEQ ID NO: 496837 - RNA, 32 nt, Human
ucagucucucaaagugcugggauuacaggcau

SEQ ID NO: 496838 - RNA, 32 nt, Human
ucagucucucaaagugcugggauuacaggugu

SEQ ID NO: 496839 - RNA, 20 nt, Human
ucagucucucccuggcucuc

SEQ ID NO: 496840 - RNA, 32 nt, Human
ucagucucucugccucugccugccuccugguc

SEQ ID NO: 496841 - RNA, 32 nt, Human
ucagucucucuuccgccuuccuucccuccuuu

SEQ ID NO: 496842 - RNA, 32 nt, Human
ucagucucugcaguuucucuaccugcccccag

SEQ ID NO: 496843 - RNA, 32 nt, Human
ucagucucuucuccuuccccugccugcaacag

SEQ ID NO: 496844 - RNA, 32 nt, Human
ucagucugccgaguagcugggauuacaggcau

SEQ ID NO: 496845 - RNA, 31 nt, Human
ucagucugccucuuuuucuuuguucccugag

SEQ ID NO: 496846 - RNA, 32 nt, Human
ucagucugccugcugcugugcgguagcuccag

SEQ ID NO: 496847 - RNA, 32 nt, Human
ucagucugggcaacacgaugaaaccccaucuc

SEQ ID NO: 496848 - RNA, 32 nt, Human
ucagucugggcaacacgaugaaacuccgucuc

SEQ ID NO: 496849 - RNA, 32 nt, Human
ucagucugggcaauauggugacaccccaucuc

SEQ ID NO: 496850 - RNA, 32 nt, Human
ucagucuggucuguuacuuuucugccuagagg

SEQ ID NO: 496851 - RNA, 32 nt, Human
ucagucugucaccaggcuggagugcaguggca

SEQ ID NO: 496852 - RNA, 32 nt, Human
ucagucuguggaaccuguugggaguuucuuca

SEQ ID NO: 496853 - RNA, 32 nt, Human
ucagucuguugagucuguugugacugucuuau

SEQ ID NO: 496854 - RNA, 32 nt, Human
ucagucuguuggacucuucaaaccagguucuu

SEQ ID NO: 496855 - RNA, 32 nt, Human
ucagucuguuggcagacuggagugcaaucaug

SEQ ID NO: 496856 - RNA, 32 nt, Human
ucagucuuaaaacccaaaggcucuuuucagag

SEQ ID NO: 496857 - RNA, 32 nt, Human
ucagucuuacacugcccuucugaccccuacaa

SEQ ID NO: 496858 - RNA, 32 nt, Human
ucagucuucccaacuucuuacaccauugcuuu

SEQ ID NO: 496859 - RNA, 32 nt, Human
ucagucuuccgaguagcugggauuacaggcgu

SEQ ID NO: 496860 - RNA, 32 nt, Human
ucagucuucggggaagagaggugggguggggc

SEQ ID NO: 496861 - RNA, 32 nt, Human
ucagucuucuagaaacagagacaagaaaggca

SEQ ID NO: 496862 - RNA, 32 nt, Human
ucagucuucuaggagggcagagugaaucccag

SEQ ID NO: 496863 - RNA, 32 nt, Human
ucagucuuguguccguuccugagaaggagcuc

SEQ ID NO: 496864 - RNA, 32 nt, Human
ucagucuuguugcccaggcuggagugcaaugg

SEQ ID NO: 496865 - RNA, 32 nt, Human
ucagucuuguuugaaggagguggugauggugg

SEQ ID NO: 496866 - RNA, 32 nt, Human
ucagucuuuucagauugcauugacuguccucu

SEQ ID NO: 496867 - RNA, 32 nt, Human
ucagucuuuuccaugaacuucuccccugguag

SEQ ID NO: 496868 - RNA, 32 nt, Human
ucagucuuuugcagguaucuaaccuugccaug

SEQ ID NO: 496869 - RNA, 32 nt, Human
ucagugaaaccucauaugacgcuuuuauagug

SEQ ID NO: 496870 - RNA, 32 nt, Human
ucagugaacuacucugagauuuacugucuuca

SEQ ID NO: 496871 - RNA, 32 nt, Human
ucagugaacuuggccugccuguucuguccuau

SEQ ID NO: 496872 - RNA, 32 nt, Human
ucagugaagauaugcgugcacgcacagacaga

SEQ ID NO: 496873 - RNA, 23 nt, Human
ucagugaaggugguggggcugcc

SEQ ID NO: 496874 - RNA, 32 nt, Human
ucagugaaugcacaggaucaacaggguuuguu

SEQ ID NO: 496875 - RNA, 32 nt, Human
ucagugacacccagagcagcgagagucauguu

SEQ ID NO: 496876 - RNA, 21 nt, Human
ucagugacccagcugucccca

SEQ ID NO: 496877 - RNA, 32 nt, Human
ucagugagaccagcuuaaaugaauaguuguua

SEQ ID NO: 496878 - RNA, 32 nt, Human
ucagugagagcaaaagcaucuucuguuagucu

SEQ ID NO: 496879 - RNA, 32 nt, Human
ucagugagagugcaaccccacccuccacagga

SEQ ID NO: 496880 - RNA, 32 nt, Human
ucagugagauacaauccagucuucucaugcac

SEQ ID NO: 496881 - RNA, 32 nt, Human
ucagugaggaagagagaagccgcaagaagaaa

SEQ ID NO: 496882 - RNA, 32 nt, Human
ucagugaggacagccuauguccagcuuugcug

SEQ ID NO: 496883 - RNA, 32 nt, Human
ucagugaggacuugucaguaaggacuuggucc

SEQ ID NO: 496884 - RNA, 32 nt, Human
ucagugaggcccauccuggcuauccucuuuca

SEQ ID NO: 496885 - RNA, 32 nt, Human
ucagugaggcugguugaagaccagagguaaac

SEQ ID NO: 496886 - RNA, 32 nt, Human
ucagugagguaggccagcuuuuaugacgcacc

SEQ ID NO: 496887 - RNA, 32 nt, Human
ucagugagguggggaaaggaagucuuccuguc

SEQ ID NO: 496888 - RNA, 32 nt, Human
ucagugaguagaaagguauccaaggugaagcc

SEQ ID NO: 496889 - RNA, 16 nt, Human
ucagugaguuguucga

SEQ ID NO: 496890 - RNA, 32 nt, Human
ucagugaugaggaggacaacacugccuuucaa

SEQ ID NO: 496891 - RNA, 32 nt, Human
ucagugauuccagguuuuaaauaauuuguaag

SEQ ID NO: 496892 - RNA, 32 nt, Human
ucagugauuuuucugccucggccuccugagua

SEQ ID NO: 496893 - RNA, 32 nt, Human
ucagugcaaguuccccagccaaaagagcaccu

SEQ ID NO: 496894 - RNA, 32 nt, Human
ucagugcacaugcacacaccccacacgcauac

SEQ ID NO: 496895 - RNA, 32 nt, Human
ucagugcaccaucaagagaugcagccccgugg

SEQ ID NO: 496896 - RNA, 32 nt, Human
ucagugcaguguccagacugcguauuucaguu

SEQ ID NO: 496897 - RNA, 32 nt, Human
ucagugccaccuggacacuacccuuggagcau

SEQ ID NO: 496898 - RNA, 32 nt, Human
ucagugccagacuugaacauuuuaucccuaau

SEQ ID NO: 496899 - RNA, 32 nt, Human
ucagugccagugccugugccagagguggcgag

SEQ ID NO: 496900 - RNA, 32 nt, Human
ucagugccauguccacaguaucugccauacuc

SEQ ID NO: 496901 - RNA, 22 nt, Human
ucagugcccagcagccaucuua

SEQ ID NO: 496902 - RNA, 32 nt, Human
ucagugcccaggaagaaggcagcugggacagg

SEQ ID NO: 496903 - RNA, 32 nt, Human
ucagugcccaggccccacacagucuucaaagg

SEQ ID NO: 496904 - RNA, 32 nt, Human
ucagugcccauguuugcuagcugccuccaugu

SEQ ID NO: 496905 - RNA, 32 nt, Human
ucagugccccaggaagaggaaguggcaggguc

SEQ ID NO: 496906 - RNA, 32 nt, Human
ucagugccgaggaggaggaagaaaaacaggcc

SEQ ID NO: 496907 - RNA, 25 nt, Human
ucagugccucugaguaggugccaug

SEQ ID NO: 496908 - RNA, 32 nt, Human
ucagugccugcacuucacauccagcaaauuaa

SEQ ID NO: 496909 - RNA, 32 nt, Human
ucagugccugggaaugcucaaggcccagcuug

SEQ ID NO: 496910 - RNA, 32 nt, Human
ucagugccuuucugcaccccuucucuccuggg

SEQ ID NO: 496911 - RNA, 32 nt, Human
ucagugcgcugcucuccagcccgcuugaacgc

SEQ ID NO: 496912 - RNA, 32 nt, Human
ucagugcgggguuucgguggccgcccugcugg

SEQ ID NO: 496913 - RNA, 32 nt, Human
ucagugcucccuuccucuccucuccuucuagu

SEQ ID NO: 496914 - RNA, 32 nt, Human
ucagugcuccucaaacauuaaaguguacaucc

SEQ ID NO: 496915 - RNA, 32 nt, Human
ucagugcucucagcuggcagugcaaugcuugu

SEQ ID NO: 496916 - RNA, 32 nt, Human
ucagugcugaugugccucaaggcacaugagug

SEQ ID NO: 496917 - RNA, 32 nt, Human
ucagugcuguaguucaaccaccaaucccccug

SEQ ID NO: 496918 - RNA, 32 nt, Human
ucagugcuguccugggaguccucugacucaga

SEQ ID NO: 496919 - RNA, 32 nt, Human
ucagugcuguuugcuugcauguuaacaacaaa

SEQ ID NO: 496920 - RNA, 32 nt, Human
ucagugcuucccuggaaagguggacccccaga

SEQ ID NO: 496921 - RNA, 32 nt, Human
ucagugcuuuccagucucagcaugguuuggag

SEQ ID NO: 496922 - RNA, 32 nt, Human
ucaguggaaguuaagaggggugagaaaacaaa

SEQ ID NO: 496923 - RNA, 32 nt, Human
ucaguggacacauugcugccaggaagagcugc

SEQ ID NO: 496924 - RNA, 32 nt, Human
ucaguggacagaaauacgccuguuccacuugu

SEQ ID NO: 496925 - RNA, 32 nt, Human
ucaguggaccaaaucucuacccuuccccaacc

SEQ ID NO: 496926 - RNA, 32 nt, Human
ucaguggacugaauuguauggaaggaaauuga

SEQ ID NO: 496927 - RNA, 32 nt, Human
ucaguggagagggagaaccgcugcuagucgac

SEQ ID NO: 496928 - RNA, 32 nt, Human
ucaguggagcuuggugggggaggugggcgcag

SEQ ID NO: 496929 - RNA, 32 nt, Human
ucaguggagugaaguucaggaggcauggagcu

SEQ ID NO: 496930 - RNA, 32 nt, Human
ucaguggagugagcugaccgaggcagagcgac

SEQ ID NO: 496931 - RNA, 32 nt, Human
ucaguggaucuggucugaguuucaaucugcca

SEQ ID NO: 496932 - RNA, 32 nt, Human
ucaguggcaaaguuucuugcccuugaaaucca

SEQ ID NO: 496933 - RNA, 32 nt, Human
ucaguggcagacaguugugugauugacaucac

SEQ ID NO: 496934 - RNA, 32 nt, Human
ucaguggcagagccaccagggacaagugaggc

SEQ ID NO: 496935 - RNA, 32 nt, Human
ucaguggcaggaucucagcucacugcaaccuc

SEQ ID NO: 496936 - RNA, 32 nt, Human
ucaguggccacugagcaucugggcagcucugu

SEQ ID NO: 496937 - RNA, 32 nt, Human
ucaguggccagaggaucaccagugcauccuuc

SEQ ID NO: 496938 - RNA, 32 nt, Human
ucaguggccuagucaugcuuucuacucauguc

SEQ ID NO: 496939 - RNA, 32 nt, Human
ucaguggcgauggcaugacagagcuagagcuc

SEQ ID NO: 496940 - RNA, 32 nt, Human
ucaguggcgcgaucucagcucacuacaagcuc

SEQ ID NO: 496941 - RNA, 32 nt, Human
ucaguggcucaugccuguaaucccagcauuuu

SEQ ID NO: 496942 - RNA, 32 nt, Human
ucaguggcugugucuacacaaggcucaccacu

SEQ ID NO: 496943 - RNA, 32 nt, Human
ucagugggaacugggaauguuuuuagcuggug

SEQ ID NO: 496944 - RNA, 32 nt, Human
ucagugggaagguguaaggaggggcuugcuaa

SEQ ID NO: 496945 - RNA, 32 nt, Human
ucagugggacccauucagaguuuacagaugcu

SEQ ID NO: 496946 - RNA, 19 nt, Human
ucagugggacuggagccua

SEQ ID NO: 496947 - RNA, 32 nt, Human
ucagugggagcgggacagggacacagggcacc

SEQ ID NO: 496948 - RNA, 32 nt, Human
ucagugggcagcagggacagggggcugugaag

SEQ ID NO: 496949 - RNA, 32 nt, Human
ucagugggcccaaacccuugaaauccgugaaa

SEQ ID NO: 496950 - RNA, 32 nt, Human
ucagugggccgcagccccagacccccugcgca

SEQ ID NO: 496951 - RNA, 32 nt, Human
ucagugggccugggacaguggcugcucuugac

SEQ ID NO: 496952 - RNA, 32 nt, Human
ucaguggggaaaguuggggagguggagaacca

SEQ ID NO: 496953 - RNA, 32 nt, Human
ucaguggggaccccucgcaacccugccuguca

SEQ ID NO: 496954 - RNA, 32 nt, Human
ucaguggggagcuguagcggggugggggcuag

SEQ ID NO: 496955 - RNA, 32 nt, Human
ucagugggggagggcaccucagcaaccucuga

SEQ ID NO: 496956 - RNA, 22 nt, Human
ucagugggggcaaggggcucuu

SEQ ID NO: 496957 - RNA, 32 nt, Human
ucagugggggcagucaggccaaacuucucauu

SEQ ID NO: 496958 - RNA, 32 nt, Human
ucagugggucugucacccucucuccuugaagc

SEQ ID NO: 496959 - RNA, 32 nt, Human
ucaguggguggagugccagggaggaggaggca

SEQ ID NO: 496960 - RNA, 32 nt, Human
ucagugggugggcagagguuuagaaagguggu

SEQ ID NO: 496961 - RNA, 32 nt, Human
ucagugguauucuauuauagcagcaugaaaug

SEQ ID NO: 496962 - RNA, 32 nt, Human
ucaguggucauggcuguugucuugccaccccc

SEQ ID NO: 496963 - RNA, 32 nt, Human
ucaguggucuucauccugacacagugguuuga

SEQ ID NO: 496964 - RNA, 32 nt, Human
ucaguggugacgguggcugagagcuccuggau

SEQ ID NO: 496965 - RNA, 32 nt, Human
ucaguggugcaaacacagcucucuccacaacc

SEQ ID NO: 496966 - RNA, 32 nt, Human
ucaguggugcuucuagacgagcuguucaccgg

SEQ ID NO: 496967 - RNA, 32 nt, Human
ucagugguuaccauuuguuugcaggaaaaaga

SEQ ID NO: 496968 - RNA, 32 nt, Human
ucagugguuuguuccuucuuauuucugaagag

SEQ ID NO: 496969 - RNA, 32 nt, Human
ucaguguaaagcagucauuagaauugauuaua

SEQ ID NO: 496970 - RNA, 23 nt, Human
ucaguguaagguacugagccaag

SEQ ID NO: 496971 - RNA, 32 nt, Human
ucaguguacgaggcagacggcggcagugcggc

SEQ ID NO: 496972 - RNA, 19 nt, Human
ucaguguaucacuggaguc

SEQ ID NO: 496973 - RNA, 32 nt, Human
ucaguguauuagauguauuaccuccaugcucu

SEQ ID NO: 496974 - RNA, 32 nt, Human
ucagugucaagaaucaacaguuccauggagcc

SEQ ID NO: 496975 - RNA, 32 nt, Human
ucagugucacccggaagcagaguuuaauguga

SEQ ID NO: 496976 - RNA, 32 nt, Human
ucaguguccuaacuggagcccagagugccuug

SEQ ID NO: 496977 - RNA, 32 nt, Human
ucaguguccucuucaacuugcucucuuuccca

SEQ ID NO: 496978 - RNA, 22 nt, Human
ucaguguccugaggaacaggac

SEQ ID NO: 496979 - RNA, 32 nt, Human
ucaguguccuuacccccuccuaccucuuuucu

SEQ ID NO: 496980 - RNA, 32 nt, Human
ucagugucuacaaauaaagugcauuagcacac

SEQ ID NO: 496981 - RNA, 32 nt, Human
ucagugucuggaguccuuggugcagaaaguac

SEQ ID NO: 496982 - RNA, 32 nt, Human
ucagugucuguggccacaauccuguacuguuc

SEQ ID NO: 496983 - RNA, 32 nt, Human
ucagugucuuccucuuaaaccucaaucaucga

SEQ ID NO: 496984 - RNA, 32 nt, Human
ucagugucuucuuuuucuacugcaagcacaug

SEQ ID NO: 496985 - RNA, 32 nt, Human
ucagugugaacuguucuauuuuuguguuauaa

SEQ ID NO: 496986 - RNA, 32 nt, Human
ucagugugaccaggaugggcgggaggggaucu

SEQ ID NO: 496987 - RNA, 32 nt, Human
ucagugugagccagauggagcaggaacaugua

SEQ ID NO: 496988 - RNA, 32 nt, Human
ucagugugagccuuaaauuagggagggccaaa

SEQ ID NO: 496989 - RNA, 32 nt, Human
ucagugugaggagagccaggaggcaggugcug

SEQ ID NO: 496990 - RNA, 32 nt, Human
ucagugugauuuuugucuucugcuccuucuac

SEQ ID NO: 496991 - RNA, 32 nt, Human
ucagugugcagcaaauuuguucuuuugguuuc

SEQ ID NO: 496992 - RNA, 32 nt, Human
ucagugugccccuaccuguucuccccuccagg

SEQ ID NO: 496993 - RNA, 32 nt, Human
ucagugugcccuucucuuaucugccaugucca

SEQ ID NO: 496994 - RNA, 32 nt, Human
ucagugugcgaaauggcuugcaggggacagga

SEQ ID NO: 496995 - RNA, 32 nt, Human
ucagugugcuuugggaauucagugaaaucaug

SEQ ID NO: 496996 - RNA, 32 nt, Human
ucaguguggcugcuuuggcuuggugaagcccu

SEQ ID NO: 496997 - RNA, 32 nt, Human
ucaguguggcuucuggaagugucuccuauccu

SEQ ID NO: 496998 - RNA, 32 nt, Human
ucagugugggagaacugaagacuuccgguugg

SEQ ID NO: 496999 - RNA, 32 nt, Human
ucaguguggggugggagcaggaaggcuguugg

SEQ ID NO: 497000 - RNA, 32 nt, Human
ucaguguguaaauaaagcucuuuugccacccc

SEQ ID NO: 497001 - RNA, 19 nt, Human
ucaguguguaggugccaug

SEQ ID NO: 497002 - RNA, 32 nt, Human
ucaguguguuguuccccucuauguauccauau

SEQ ID NO: 497003 - RNA, 32 nt, Human
ucaguguuacuuugcuuaauacuuagguagcc

SEQ ID NO: 497004 - RNA, 32 nt, Human
ucaguguuccaggacuggguguucugcugguc

SEQ ID NO: 497005 - RNA, 32 nt, Human
ucaguguucccaggaccuuagugcauggucgg

SEQ ID NO: 497006 - RNA, 32 nt, Human
ucaguguuccugucccaaaccccacacagaau

SEQ ID NO: 497007 - RNA, 32 nt, Human
ucaguguucucuuaacagauaaccggagugau

SEQ ID NO: 497008 - RNA, 32 nt, Human
ucaguguucugccucuggcagcugugcuaaca

SEQ ID NO: 497009 - RNA, 32 nt, Human
ucaguguuguguccauggaguuuuaggagggg

SEQ ID NO: 497010 - RNA, 32 nt, Human
ucaguguuuaugguuuuauacucugaauucua

SEQ ID NO: 497011 - RNA, 32 nt, Human
ucaguguuucacguaagacuuuuugguuugau

SEQ ID NO: 497012 - RNA, 32 nt, Human
ucaguguuugugaagaggcaggacuggccaga

SEQ ID NO: 497013 - RNA, 32 nt, Human
ucaguguuuucugcaaggguugugaccugaaa

SEQ ID NO: 497014 - RNA, 21 nt, Human
ucaguuaaaguuagguugcca

SEQ ID NO: 497015 - RNA, 32 nt, Human
ucaguuaagaucaaaccucacaaagagaaaua

SEQ ID NO: 497016 - RNA, 32 nt, Human
ucaguuaagugugcacuaagccuggaccacau

SEQ ID NO: 497017 - RNA, 32 nt, Human
ucaguuaaucuaggauuguauauugccaaggu

SEQ ID NO: 497018 - RNA, 32 nt, Human
ucaguuaaugcaacuucaaccuuccagaugcu

SEQ ID NO: 497019 - RNA, 32 nt, Human
ucaguuaaugucuuaaucauguauuuaggguu

SEQ ID NO: 497020 - RNA, 32 nt, Human
ucaguuaauuuaaagugguuauucuuggaagu

SEQ ID NO: 497021 - RNA, 19 nt, Human
ucaguuacaaaaaguugua

SEQ ID NO: 497022 - RNA, 32 nt, Human
ucaguuacagcaaucauucaaucugaacaggg

SEQ ID NO: 497023 - RNA, 23 nt, Human
ucaguuagcucagaagccaccug

SEQ ID NO: 497024 - RNA, 32 nt, Human
ucaguuaggaucauagacuuucccugacucgu

SEQ ID NO: 497025 - RNA, 20 nt, Human
ucaguuaguccaggaccacu

SEQ ID NO: 497026 - RNA, 17 nt, Human
ucaguuauaaaggaguu

SEQ ID NO: 497027 - RNA, 18 nt, Human
ucaguuauaaggagucug

SEQ ID NO: 497028 - RNA, 17 nt, Human
ucaguuauauauuccuu

SEQ ID NO: 497029 - RNA, 24 nt, Human
ucaguuauauuuugguggagucug

SEQ ID NO: 497030 - RNA, 17 nt, Human
ucaguuaucugcagucu

SEQ ID NO: 497031 - RNA, 17 nt, Human
ucaguuauggccaucua

SEQ ID NO: 497032 - RNA, 32 nt, Human
ucaguuauguauauuuguuuuccuuguuuuuc

SEQ ID NO: 497033 - RNA, 32 nt, Human
ucaguuauugcuguuuucuuccuuccuuggau

SEQ ID NO: 497034 - RNA, 19 nt, Human
ucaguuauuggugagucua

SEQ ID NO: 497035 - RNA, 19 nt, Human
ucaguuauugugaagucug

SEQ ID NO: 497036 - RNA, 32 nt, Human
ucaguuauuuugaagguccagcauccugauua

SEQ ID NO: 497037 - RNA, 19 nt, Human
ucaguuauuuugagagucu

SEQ ID NO: 497038 - RNA, 21 nt, Human
ucaguuauuuuuaaugugcca

SEQ ID NO: 497039 - RNA, 19 nt, Human
ucaguuauuuuugaagcua

SEQ ID NO: 497040 - RNA, 32 nt, Human
ucaguucaacacagcaagugcuucacuuccaa

SEQ ID NO: 497041 - RNA, 32 nt, Human
ucaguucaauccaacauccuuauauugcaaug

SEQ ID NO: 497042 - RNA, 32 nt, Human
ucaguucacgcauuccucccaccuccaccucc

SEQ ID NO: 497043 - RNA, 32 nt, Human
ucaguucacugcaaccuccacccugcagguuc

SEQ ID NO: 497044 - RNA, 32 nt, Human
ucaguucacugcaaccuccaccucccagguuc

SEQ ID NO: 497045 - RNA, 32 nt, Human
ucaguucacugcaaccuccacuuccuagguuc

SEQ ID NO: 497046 - RNA, 32 nt, Human
ucaguucacugcaaccucugccucccacguuc

SEQ ID NO: 497047 - RNA, 32 nt, Human
ucaguucacugcaaccucugccucccggguuc

SEQ ID NO: 497048 - RNA, 32 nt, Human
ucaguucacugcaaccucugccuccuggguuc

SEQ ID NO: 497049 - RNA, 32 nt, Human
ucaguucacugcaacuucugccucccgaguuc

SEQ ID NO: 497050 - RNA, 32 nt, Human
ucaguucacugcaagcuccgccuccucguuuc

SEQ ID NO: 497051 - RNA, 32 nt, Human
ucaguucacugcagccuccgcccuccagguuc

SEQ ID NO: 497052 - RNA, 32 nt, Human
ucaguucacugcagccucgaccucccaggcuc

SEQ ID NO: 497053 - RNA, 32 nt, Human
ucaguucagaacacuuugggccacauagugau

SEQ ID NO: 497054 - RNA, 32 nt, Human
ucaguucagaguuguacacuguguacauuugg

SEQ ID NO: 497055 - RNA, 32 nt, Human
ucaguucagcuuuggagaauggggugugagug

SEQ ID NO: 497056 - RNA, 32 nt, Human
ucaguucaggcagcucugcuggagggcggugc

SEQ ID NO: 497057 - RNA, 31 nt, Human
ucaguucaguuucagcggugccaaccucuuu

SEQ ID NO: 497058 - RNA, 32 nt, Human
ucaguucauaugcagaacguauuuagccauua

SEQ ID NO: 497059 - RNA, 32 nt, Human
ucaguucaugcaaccuccgccuccuggguuca

SEQ ID NO: 497060 - RNA, 32 nt, Human
ucaguuccagaacuuaccucagugcacuuggg

SEQ ID NO: 497061 - RNA, 32 nt, Human
ucaguuccagccuucucucaaggagaggcaaa

SEQ ID NO: 497062 - RNA, 21 nt, Human
ucaguucccuaaucugugaaa

SEQ ID NO: 497063 - RNA, 32 nt, Human
ucaguucccugggaguuuuuguggcagccuuu

SEQ ID NO: 497064 - RNA, 32 nt, Human
ucaguuccuagccuggaucccaaaaagguaca

SEQ ID NO: 497065 - RNA, 32 nt, Human
ucaguuccucaccccucucccugcuuucuuug

SEQ ID NO: 497066 - RNA, 32 nt, Human
ucaguuccugcuucuggucuucuccugggcuc

SEQ ID NO: 497067 - RNA, 32 nt, Human
ucaguuccuggagcuuacggagcuccaaagcu

SEQ ID NO: 497068 - RNA, 32 nt, Human
ucaguuccuguuucuucccauuuccuggcaca

SEQ ID NO: 497069 - RNA, 32 nt, Human
ucaguuccuuggagagggcagggacuccgccc

SEQ ID NO: 497070 - RNA, 32 nt, Human
ucaguucgcucugugaugucaagugcagaaug

SEQ ID NO: 497071 - RNA, 24 nt, Human
ucaguucucucagccccagguuca

SEQ ID NO: 497072 - RNA, 32 nt, Human
ucaguucucucccugccacuuccagggaucug

SEQ ID NO: 497073 - RNA, 32 nt, Human
ucaguucucucccuuccucucuccuuauagac

SEQ ID NO: 497074 - RNA, 32 nt, Human
ucaguucugcugcugucuuuacugcucucaac

SEQ ID NO: 497075 - RNA, 32 nt, Human
ucaguucuggcacaucccaacccuucacauuu

SEQ ID NO: 497076 - RNA, 25 nt, Human
ucaguucugugucguguucggguuu

SEQ ID NO: 497077 - RNA, 32 nt, Human
ucaguugaaacgagguuucaccauauuggcca

SEQ ID NO: 497078 - RNA, 32 nt, Human
ucaguugaacccaggagguggagguugcagug

SEQ ID NO: 497079 - RNA, 32 nt, Human
ucaguugagcccaggaguucaagaccagccug

SEQ ID NO: 497080 - RNA, 32 nt, Human
ucaguugagccccagaguucaagaccagccug

SEQ ID NO: 497081 - RNA, 32 nt, Human
ucaguugagggcugagggagagacugaggugc

SEQ ID NO: 497082 - RNA, 32 nt, Human
ucaguugauccaccugccucagccucugcauu

SEQ ID NO: 497083 - RNA, 32 nt, Human
ucaguugaucuuuugaccaagaccucaagaga

SEQ ID NO: 497084 - RNA, 32 nt, Human
ucaguugcagagcaggaagccuggaucccagc

SEQ ID NO: 497085 - RNA, 32 nt, Human
ucaguugcuauuucucuucguaaugaauuuuc

SEQ ID NO: 497086 - RNA, 32 nt, Human
ucaguugggcaugagccuggagagaugugacu

SEQ ID NO: 497087 - RNA, 32 nt, Human
ucaguugggcuggggguugcuccacacccuaa

SEQ ID NO: 497088 - RNA, 23 nt, Human
ucaguugggggccaccugaccca

SEQ ID NO: 497089 - RNA, 32 nt, Human
ucaguugguggcagugguugguuuaaaguaga

SEQ ID NO: 497090 - RNA, 32 nt, Human
ucaguugguuccaaguauguuagaucagcuaa

SEQ ID NO: 497091 - RNA, 32 nt, Human
ucaguuguauagcaaguauuuacugaguagcu

SEQ ID NO: 497092 - RNA, 32 nt, Human
ucaguuguccccaucaucauggagacccaaaa

SEQ ID NO: 497093 - RNA, 32 nt, Human
ucaguuguccugagagagaugaagcagccuug

SEQ ID NO: 497094 - RNA, 32 nt, Human
ucaguugucuaaacuucgggcucucuuccacc

SEQ ID NO: 497095 - RNA, 32 nt, Human
ucaguugugaccagcuuugcaaagggagcggu

SEQ ID NO: 497096 - RNA, 32 nt, Human
ucaguugugaggaccucugcucugugcucagc

SEQ ID NO: 497097 - RNA, 32 nt, Human
ucaguugugcacugaggccggcugguccuuga

SEQ ID NO: 497098 - RNA, 32 nt, Human
ucaguugugcucccuggucccuucccuguugc

SEQ ID NO: 497099 - RNA, 32 nt, Human
ucaguuguguuuugggccugucggguccuuca

SEQ ID NO: 497100 - RNA, 32 nt, Human
ucaguuguucagagaagagggggaggauucgc

SEQ ID NO: 497101 - RNA, 32 nt, Human
ucaguuuacagauguuaaggaacuuauaauca

SEQ ID NO: 497102 - RNA, 32 nt, Human
ucaguuuaccugcacaugcuuucuuucauuuc

SEQ ID NO: 497103 - RNA, 32 nt, Human
ucaguuuagcauuacauugucuugagcaccag

SEQ ID NO: 497104 - RNA, 32 nt, Human
ucaguuuaugcaacuucugccuccccagguuc

SEQ ID NO: 497105 - RNA, 32 nt, Human
ucaguuuauuuggcaaacaugacaacauuuuu

SEQ ID NO: 497106 - RNA, 32 nt, Human
ucaguuucaccaccucccucuuccagacugca

SEQ ID NO: 497107 - RNA, 26 nt, Human
ucaguuucagucagggacauauuuug

SEQ ID NO: 497108 - RNA, 32 nt, Human
ucaguuucauuuccacggacccuccugccugg

SEQ ID NO: 497109 - RNA, 32 nt, Human
ucaguuuccagaaauacaaguuagauaauugg

SEQ ID NO: 497110 - RNA, 32 nt, Human
ucaguuuccagccuacagacuuucggggguuc

SEQ ID NO: 497111 - RNA, 21 nt, Human
ucaguuuccccagcugugaaa

SEQ ID NO: 497112 - RNA, 32 nt, Human
ucaguuucccccaaaugagcaaaggggauaaa

SEQ ID NO: 497113 - RNA, 32 nt, Human
ucaguuucccccaucuccucugccagaggcuc

SEQ ID NO: 497114 - RNA, 32 nt, Human
ucaguuucccucccuucucccuccauccgcag

SEQ ID NO: 497115 - RNA, 32 nt, Human
ucaguuuccgaaucucuuucccuuccccugug

SEQ ID NO: 497116 - RNA, 21 nt, Human
ucaguuuccucaucugcagaa

SEQ ID NO: 497117 - RNA, 21 nt, Human
ucaguuuccucaucugucaaa

SEQ ID NO: 497118 - RNA, 32 nt, Human
ucaguuuccuuguaagcagguaaugaaaauua

SEQ ID NO: 497119 - RNA, 21 nt, Human
ucaguuuccuugucugugaaa

SEQ ID NO: 497120 - RNA, 32 nt, Human
ucaguuucuaguguaagcuugcagugacuuuu

SEQ ID NO: 497121 - RNA, 32 nt, Human
ucaguuucucagacuguagccauugaaaauua

SEQ ID NO: 497122 - RNA, 32 nt, Human
ucaguuucucuccaggccaccaugucugcagg

SEQ ID NO: 497123 - RNA, 32 nt, Human
ucaguuucucucccucuccucaccccucuauc

SEQ ID NO: 497124 - RNA, 32 nt, Human
ucaguuugaacaaaccacuuugcccaaccuga

SEQ ID NO: 497125 - RNA, 32 nt, Human
ucaguuugacagacacagccugaaugcccaag

SEQ ID NO: 497126 - RNA, 32 nt, Human
ucaguuugagauacuagguuuuaucaccugcu

SEQ ID NO: 497127 - RNA, 32 nt, Human
ucaguuugcaacaugucuguaccaagauggua

SEQ ID NO: 497128 - RNA, 32 nt, Human
ucaguuugccaaggcugaugguauugggucac

SEQ ID NO: 497129 - RNA, 32 nt, Human
ucaguuugcccaucugucccagugcuaacaca

SEQ ID NO: 497130 - RNA, 19 nt, Human
ucaguuugggaagaggaga

SEQ ID NO: 497131 - RNA, 32 nt, Human
ucaguuuguggugaaauuccaguuuauuauca

SEQ ID NO: 497132 - RNA, 32 nt, Human
ucaguuuguggugaaauuccgguuuauuauca

SEQ ID NO: 497133 - RNA, 32 nt, Human
ucaguuuuccuuaaaacgcgcacacaacucua

SEQ ID NO: 497134 - RNA, 32 nt, Human
ucaguuuucucccacauucaccccugcccaga

SEQ ID NO: 497135 - RNA, 32 nt, Human
ucaguuuugaggccgagaguccucuggcgccc

SEQ ID NO: 497136 - RNA, 32 nt, Human
ucaguuuuggagaggaauauguucuuuauauc

SEQ ID NO: 497137 - RNA, 21 nt, Human
ucaguuuugggguaugggggg

SEQ ID NO: 497138 - RNA, 32 nt, Human
ucaguuuugguguggagaaagaggccaguuua

SEQ ID NO: 497139 - RNA, 32 nt, Human
ucaguuuuugacugaccuggauauccaugagc

SEQ ID NO: 497140 - RNA, 24 nt, Human
ucauaaaaauauuuuuaaaaucag

SEQ ID NO: 497141 - RNA, 32 nt, Human
ucauaaaaauuacaauuuaugaugcaaauaau

SEQ ID NO: 497142 - RNA, 32 nt, Human
ucauaaaacuaaccugaaaaacaaauaaaugc

SEQ ID NO: 497143 - RNA, 32 nt, Human
ucauaaaacucauaauguugauauaaucaaga

SEQ ID NO: 497144 - RNA, 32 nt, Human
ucauaaaagaaagguuuaauugacucacaguu

SEQ ID NO: 497145 - RNA, 32 nt, Human
ucauaaaagcccucauauccacuggcaguccc

SEQ ID NO: 497146 - RNA, 32 nt, Human
ucauaaaaggauucacacuggagagaaacccu

SEQ ID NO: 497147 - RNA, 32 nt, Human
ucauaaaccaaguuaugagagcagagcugaga

SEQ ID NO: 497148 - RNA, 32 nt, Human
ucauaaaccacuuuggaaaauaauuccaacaa

SEQ ID NO: 497149 - RNA, 32 nt, Human
ucauaaaccagcugcgguaacagacaagccuu

SEQ ID NO: 497150 - RNA, 32 nt, Human
ucauaaaccuggcucaugcccaacacauuucu

SEQ ID NO: 497151 - RNA, 32 nt, Human
ucauaaacugaucacuaucuauuaugcagcua

SEQ ID NO: 497152 - RNA, 32 nt, Human
ucauaaagaggaggagaaacagggugagucaa

SEQ ID NO: 497153 - RNA, 23 nt, Human
ucauaaagaugaguaaagucuca

SEQ ID NO: 497154 - RNA, 32 nt, Human
ucauaaaggcacaagugcacacacaucuaugc

SEQ ID NO: 497155 - RNA, 21 nt, Human
ucauaaaggguuaaaaaucca

SEQ ID NO: 497156 - RNA, 32 nt, Human
ucauaacaacaauuaauuuccucuggggccug

SEQ ID NO: 497157 - RNA, 32 nt, Human
ucauaacacugcacuccaggcuggacaacaca

SEQ ID NO: 497158 - RNA, 32 nt, Human
ucauaacaugccacuguauacaguuugaagcu

SEQ ID NO: 497159 - RNA, 21 nt, Human
ucauaacccacacaggcccac

SEQ ID NO: 497160 - RNA, 32 nt, Human
ucauaacucacugcagccucaaacuucuggcc

SEQ ID NO: 497161 - RNA, 32 nt, Human
ucauaacucuagagaaaaacuucaucuucauc

SEQ ID NO: 497162 - RNA, 32 nt, Human
ucauaagaaaaaucagcugaaguguuaccaac

SEQ ID NO: 497163 - RNA, 32 nt, Human
ucauaagaaagaggccagaaggucaaagaggu

SEQ ID NO: 497164 - RNA, 32 nt, Human
ucauaagaaguccauauacugaagagcguuug

SEQ ID NO: 497165 - RNA, 32 nt, Human
ucauaagacaugcacacuaauacacauacaca

SEQ ID NO: 497166 - RNA, 32 nt, Human
ucauaagauggaaaugcuauaccuuaccuacc

SEQ ID NO: 497167 - RNA, 32 nt, Human
ucauaagcaagcucagaccugcccccaguuca

SEQ ID NO: 497168 - RNA, 32 nt, Human
ucauaagcccccaaauuaacaggaugaggagg

SEQ ID NO: 497169 - RNA, 32 nt, Human
ucauaagcuccccagaugauuccuguguacau

SEQ ID NO: 497170 - RNA, 32 nt, Human
ucauaagcuuugaauuuucuguuaucucugau

SEQ ID NO: 497171 - RNA, 32 nt, Human
ucauaaggcaauucauacuggagagaaaccuu

SEQ ID NO: 497172 - RNA, 32 nt, Human
ucauaaggcaauucauacuggagagaauccuu

SEQ ID NO: 497173 - RNA, 32 nt, Human
ucauaaggcaauucauaguggagagaaaccuu

SEQ ID NO: 497174 - RNA, 32 nt, Human
ucauaaggcuaagcuaggggugaacagaaggc

SEQ ID NO: 497175 - RNA, 32 nt, Human
ucauaaggcuauucauauuggagagaaacguu

SEQ ID NO: 497176 - RNA, 31 nt, Human
ucauaagggcacuucuuuaggcauuucauua

SEQ ID NO: 497177 - RNA, 32 nt, Human
ucauaagggcuggagugcuguggugccaucau

SEQ ID NO: 497178 - RNA, 32 nt, Human
ucauaaggguuauuuuaauaacuggcauucuc

SEQ ID NO: 497179 - RNA, 32 nt, Human
ucauaagguaguccacugaagugcagucauca

SEQ ID NO: 497180 - RNA, 32 nt, Human
ucauaagguccuuccuagcaaggcaaagggau

SEQ ID NO: 497181 - RNA, 32 nt, Human
ucauaaguagacuccacugggguagagguauu

SEQ ID NO: 497182 - RNA, 32 nt, Human
ucauaagugggguggcggggccagucuaggga

SEQ ID NO: 497183 - RNA, 32 nt, Human
ucauaaguuauccccaagggguucagggacua

SEQ ID NO: 497184 - RNA, 18 nt, Human
ucauaauaaaucaucuca

SEQ ID NO: 497185 - RNA, 28 nt, Human
ucauaaucaagugcuggcuaaugucagc

SEQ ID NO: 497186 - RNA, 32 nt, Human
ucauaaucccuccuggcuuugugugaauagcu

SEQ ID NO: 497187 - RNA, 32 nt, Human
ucauaaucugucuuuuuccuugauagaacuua

SEQ ID NO: 497188 - RNA, 32 nt, Human
ucauaaugggggcggaggcgggagugagagga

SEQ ID NO: 497189 - RNA, 32 nt, Human
ucauaauguggcagagguggugggaagaagaa

SEQ ID NO: 497190 - RNA, 32 nt, Human
ucauaauucaugaaagcccaguucugaagauu

SEQ ID NO: 497191 - RNA, 32 nt, Human
ucauacaagcacauguguaauauuucuauuau

SEQ ID NO: 497192 - RNA, 27 nt, Human
ucauacacacauacauacauaugcaca

SEQ ID NO: 497193 - RNA, 32 nt, Human
ucauacagaauaguuucaccacccucaaaauc

SEQ ID NO: 497194 - RNA, 32 nt, Human
ucauacagagagaagauucaguucagccuaaa

SEQ ID NO: 497195 - RNA, 32 nt, Human
ucauacagcaagacacaugagacauagauuag

SEQ ID NO: 497196 - RNA, 32 nt, Human
ucauacagcugcaggauucgagacuacagcug

SEQ ID NO: 497197 - RNA, 32 nt, Human
ucauacaggagaaaggcccuauccaugucaag

SEQ ID NO: 497198 - RNA, 32 nt, Human
ucauacaggagagaaaccucacaagugugaug

SEQ ID NO: 497199 - RNA, 32 nt, Human
ucauacaggagagaaacucacaagugugauga

SEQ ID NO: 497200 - RNA, 32 nt, Human
ucauacagggucuccaaugcagccaaggagag

SEQ ID NO: 497201 - RNA, 32 nt, Human
ucauacagucccagagaugugaaguuaucaag

SEQ ID NO: 497202 - RNA, 25 nt, Human
ucauacaguuaguguugccagugaa

SEQ ID NO: 497203 - RNA, 32 nt, Human
ucauacaucaccccuggcuggccggcaacagg

SEQ ID NO: 497204 - RNA, 32 nt, Human
ucauacaugaagucaggaaaagaaaagaaacu

SEQ ID NO: 497205 - RNA, 32 nt, Human
ucauacauuuccaacuuggucugcaucucuuu

SEQ ID NO: 497206 - RNA, 32 nt, Human
ucauaccaacaugcuccagccugagugagaga

SEQ ID NO: 497207 - RNA, 32 nt, Human
ucauaccacaugcugccuaugggacuucaguu

SEQ ID NO: 497208 - RNA, 32 nt, Human
ucauaccaccgcacuccagccugagcaacaga

SEQ ID NO: 497209 - RNA, 32 nt, Human
ucauaccacggcacuccagccugggugacagu

SEQ ID NO: 497210 - RNA, 32 nt, Human
ucauaccacugcacuccagccuggcgacagag

SEQ ID NO: 497211 - RNA, 32 nt, Human
ucauaccacugcacuccagccugggcgacaga

SEQ ID NO: 497212 - RNA, 32 nt, Human
ucauaccacugcacuccagccugggugacaga

SEQ ID NO: 497213 - RNA, 32 nt, Human
ucauaccacugcacuccagucugggcaacaga

SEQ ID NO: 497214 - RNA, 32 nt, Human
ucauaccacugcacugcagccugagugacaca

SEQ ID NO: 497215 - RNA, 32 nt, Human
ucauaccacugcacuuaacuuggcaacagagc

SEQ ID NO: 497216 - RNA, 32 nt, Human
ucauaccacuguacugcagucugggccacaca

SEQ ID NO: 497217 - RNA, 32 nt, Human
ucauaccacuucauuccagccugggugacaga

SEQ ID NO: 497218 - RNA, 32 nt, Human
ucauaccacuugauaagcaucuugaaacacca

SEQ ID NO: 497219 - RNA, 32 nt, Human
ucauaccaguaacuacugaaguagaagauucu

SEQ ID NO: 497220 - RNA, 32 nt, Human
ucauaccagugcacuccaggcgggugacagag

SEQ ID NO: 497221 - RNA, 32 nt, Human
ucauaccauggagucaugagcugucugggaag

SEQ ID NO: 497222 - RNA, 32 nt, Human
ucauaccauugcacuccagccuaggcaacaag

SEQ ID NO: 497223 - RNA, 32 nt, Human
ucauaccauugcacuccagccugggcaacaag

SEQ ID NO: 497224 - RNA, 32 nt, Human
ucauacccaguaagaugcaagaaaggaauauc

SEQ ID NO: 497225 - RNA, 32 nt, Human
ucauacccucacauuaguucacuugagcugcc

SEQ ID NO: 497226 - RNA, 32 nt, Human
ucauacccugaccucugaccucaccuacagcu

SEQ ID NO: 497227 - RNA, 32 nt, Human
ucauacccuugccucuugugccccagcaccuu

SEQ ID NO: 497228 - RNA, 32 nt, Human
ucauaccuauaaucccagcccuuugagaggcc

SEQ ID NO: 497229 - RNA, 24 nt, Human
ucauaccuauagucccagcacuuu

SEQ ID NO: 497230 - RNA, 32 nt, Human
ucauaccuauaguuggucuuagauaagaaaug

SEQ ID NO: 497231 - RNA, 32 nt, Human
ucauaccucacugcagcuucaacuuccugggc

SEQ ID NO: 497232 - RNA, 32 nt, Human
ucauaccucacugcggccucaaacuccugggc

SEQ ID NO: 497233 - RNA, 32 nt, Human
ucauaccucauggucucucuuuaauugaccaa

SEQ ID NO: 497234 - RNA, 32 nt, Human
ucauaccugcuuguauuccugcuucugguguu

SEQ ID NO: 497235 - RNA, 25 nt, Human
ucauaccuguaaaucccagcacuuu

SEQ ID NO: 497236 - RNA, 32 nt, Human
ucauaccuguaaaucccagcacuuugggaggc

SEQ ID NO: 497237 - RNA, 32 nt, Human
ucauaccuguaaauccuaggacuuagggaggc

SEQ ID NO: 497238 - RNA, 32 nt, Human
ucauaccuguaaucccaacaauuugggaggcc

SEQ ID NO: 497239 - RNA, 32 nt, Human
ucauaccuguaaucccaagcagcugggauuac

SEQ ID NO: 497240 - RNA, 20 nt, Human
ucauaccuguaaucccagca

SEQ ID NO: 497241 - RNA, 32 nt, Human
ucauaccuguaaucccagcaauuugggaggcu

SEQ ID NO: 497242 - RNA, 24 nt, Human
ucauaccuguaaucccagcacuuu

SEQ ID NO: 497243 - RNA, 32 nt, Human
ucauaccuguaaucccagcacuuugggaagcc

SEQ ID NO: 497244 - RNA, 32 nt, Human
ucauaccuguaaucccagcacuuugggaggcc

SEQ ID NO: 497245 - RNA, 32 nt, Human
ucauaccuguaaucccagcacuuugggaggcu

SEQ ID NO: 497246 - RNA, 24 nt, Human
ucauaccuguaaucccagcaguuu

SEQ ID NO: 497247 - RNA, 32 nt, Human
ucauaccuguaaucccagcaguuugggaggcc

SEQ ID NO: 497248 - RNA, 23 nt, Human
ucauaccuguaaucccagcauuu

SEQ ID NO: 497249 - RNA, 32 nt, Human
ucauaccuguaaucccagcauuuggggaggcc

SEQ ID NO: 497250 - RNA, 32 nt, Human
ucauaccuguaaucccaggacuuugggaggcc

SEQ ID NO: 497251 - RNA, 32 nt, Human
ucauaccuguaaucccggcacuuugggaggcc

SEQ ID NO: 497252 - RNA, 22 nt, Human
ucauaccuguaauccuagcacu

SEQ ID NO: 497253 - RNA, 32 nt, Human
ucauaccuguaauccuagcacucugggaggcc

SEQ ID NO: 497254 - RNA, 32 nt, Human
ucauaccuguaaucucagcacugugggaggcc

SEQ ID NO: 497255 - RNA, 24 nt, Human
ucauaccuguaaugccagcacuuu

SEQ ID NO: 497256 - RNA, 32 nt, Human
ucauaccuguaaugccagcacuuugggaggcc

SEQ ID NO: 497257 - RNA, 25 nt, Human
ucauaccuguuaauuccagcacuuu

SEQ ID NO: 497258 - RNA, 32 nt, Human
ucauaccuguuaauuccagcacuuugggaggc

SEQ ID NO: 497259 - RNA, 24 nt, Human
ucauaccuguuauaccagcacuuu

SEQ ID NO: 497260 - RNA, 32 nt, Human
ucauaccuguucuaguucaucuccacguuuau

SEQ ID NO: 497261 - RNA, 24 nt, Human
ucauaccuuuaaucccagcacuuu

SEQ ID NO: 497262 - RNA, 32 nt, Human
ucauacggaguaagcugcucugccugugugag

SEQ ID NO: 497263 - RNA, 32 nt, Human
ucauacguccaccaugggguccuaccaauaga

SEQ ID NO: 497264 - RNA, 24 nt, Human
ucauacguguaaucccaguacuuu

SEQ ID NO: 497265 - RNA, 32 nt, Human
ucauacguguaaucccaguacuuuggaaggug

SEQ ID NO: 497266 - RNA, 32 nt, Human
ucauacuacuauacuucuggguugaacagaau

SEQ ID NO: 497267 - RNA, 32 nt, Human
ucauacuacugcacuccagccugggcgacaag

SEQ ID NO: 497268 - RNA, 32 nt, Human
ucauacuaggguaauaaauguggcagauuuuu

SEQ ID NO: 497269 - RNA, 32 nt, Human
ucauacucacugcagccuugaccgccugggcu

SEQ ID NO: 497270 - RNA, 19 nt, Human
ucauacuccugggcucaag

SEQ ID NO: 497271 - RNA, 32 nt, Human
ucauacucuauacucagggcuuaaugaacugg

SEQ ID NO: 497272 - RNA, 32 nt, Human
uccacagccugagagguguccccaaagaaagg

SEQ ID NO: 497273 - RNA, 32 nt, Human
uccacagcgccgaguacuccagccgggacgca

SEQ ID NO: 497274 - RNA, 32 nt, Human
uccacagcgcgacugcuccagcauuuuuccuu

SEQ ID NO: 497275 - RNA, 19 nt, Human
uccacagcucagagaagaa

SEQ ID NO: 497276 - RNA, 32 nt, Human
uccacagcuccugccguucuccuugccaggaa

SEQ ID NO: 497277 - RNA, 20 nt, Human
uccacagcucuuccuugagc

SEQ ID NO: 497278 - RNA, 32 nt, Human
uccacagcuggacaggagagacaccgccugcg

SEQ ID NO: 497279 - RNA, 21 nt, Human
uccacagcuguccuggccgca

SEQ ID NO: 497280 - RNA, 32 nt, Human
uccacagcuguuagcagcaucugccccaauuu

SEQ ID NO: 497281 - RNA, 21 nt, Human
uccacaggaaaccugaccuga

SEQ ID NO: 497282 - RNA, 20 nt, Human
uccacaggaacccagcauuc

SEQ ID NO: 497283 - RNA, 32 nt, Human
uccacaggcacuuucaccuaaguuucugccac

SEQ ID NO: 497284 - RNA, 32 nt, Human
uccacaggccccuccaccuuccagcuaaccag

SEQ ID NO: 497285 - RNA, 31 nt, Human
uccacaggcgcccccaccacagcagaacagc

SEQ ID NO: 497286 - RNA, 22 nt, Human
uccacagggaauacagcauccu

SEQ ID NO: 497287 - RNA, 32 nt, Human
uccacagggaggcagguggccacggcgagguc

SEQ ID NO: 497288 - RNA, 32 nt, Human
uccacagggcugggcccaugcacagccauccu

SEQ ID NO: 497289 - RNA, 32 nt, Human
uccacagggcuggguuuucuugcaccuugggu

SEQ ID NO: 497290 - RNA, 32 nt, Human
uccacagggucccacagccacguguuuagacc

SEQ ID NO: 497291 - RNA, 32 nt, Human
uccacagggucugagcuccucagaggugggag

SEQ ID NO: 497292 - RNA, 32 nt, Human
uccacagguacuuugcagucauaccacaccca

SEQ ID NO: 497293 - RNA, 32 nt, Human
uccacagguuucccuccgccuccugagggccu

SEQ ID NO: 497294 - RNA, 32 nt, Human
uccacaguacugggugacugguauagucugau

SEQ ID NO: 497295 - RNA, 32 nt, Human
uccacaguauaugauccauccagacauuugca

SEQ ID NO: 497296 - RNA, 32 nt, Human
uccacagucaaccacuucaccucacugggcaa

SEQ ID NO: 497297 - RNA, 32 nt, Human
uccacagucagggaaggacucucacuuauuug

SEQ ID NO: 497298 - RNA, 32 nt, Human
uccacagucccaaugccucugcuuuuuguuuu

SEQ ID NO: 497299 - RNA, 22 nt, Human
uccacaguccggagcccggcgg

SEQ ID NO: 497300 - RNA, 24 nt, Human
uccacagucugcccucaucccucu

SEQ ID NO: 497301 - RNA, 32 nt, Human
uccacagucuguuccuguucugauauucugag

SEQ ID NO: 497302 - RNA, 25 nt, Human
uccacagucuucuggguggcagcga

SEQ ID NO: 497303 - RNA, 32 nt, Human
uccacagugaccuggaucaggguggggacaag

SEQ ID NO: 497304 - RNA, 19 nt, Human
uccacagugagaacuggac

SEQ ID NO: 497305 - RNA, 32 nt, Human
uccacagugcccagguuucucauguuguaaau

SEQ ID NO: 497306 - RNA, 32 nt, Human
uccacagugcugcuaauaucccagcuccagcc

SEQ ID NO: 497307 - RNA, 23 nt, Human
uccacaguuauguaaggcaguga

SEQ ID NO: 497308 - RNA, 18 nt, Human
uccacaguucccaaagcu

SEQ ID NO: 497309 - RNA, 32 nt, Human
uccacauaaaagugcucuccugccugggcagc

SEQ ID NO: 497310 - RNA, 32 nt, Human
uccacauaaccugaggaccauggaugcugaug

SEQ ID NO: 497311 - RNA, 24 nt, Human
uccacauagcuaccuaccuauuca

SEQ ID NO: 497312 - RNA, 26 nt, Human
uccacauagcugggggugacuguuca

SEQ ID NO: 497313 - RNA, 32 nt, Human
uccacauauacaaccauacauacuugcacaug

SEQ ID NO: 497314 - RNA, 18 nt, Human
uccacaucaaaagaagaa

SEQ ID NO: 497315 - RNA, 32 nt, Human
uccacaucaagaaaauaguuucccaucugaaa

SEQ ID NO: 497316 - RNA, 32 nt, Human
uccacaucaagauagcugggcccaguguggaa

SEQ ID NO: 497317 - RNA, 32 nt, Human
uccacaucagccagggcaucagaaguugggcc

SEQ ID NO: 497318 - RNA, 32 nt, Human
uccacauccccgccucccagacauauaccagg

SEQ ID NO: 497319 - RNA, 32 nt, Human
uccacaucgccaaggugccacagggggagcaa

SEQ ID NO: 497320 - RNA, 20 nt, Human
uccacaucucccugcugcuc

SEQ ID NO: 497321 - RNA, 25 nt, Human
uccacaugaaaccuacacacuguca

SEQ ID NO: 497322 - RNA, 32 nt, Human
uccacaugacucugccucccaaagugcugcca

SEQ ID NO: 497323 - RNA, 32 nt, Human
uccacaugccaagaggaugcaggauuucuaca

SEQ ID NO: 497324 - RNA, 32 nt, Human
uccacaugcuccaagccacagguccccaaaua

SEQ ID NO: 497325 - RNA, 22 nt, Human
uccacauggauaagcaccuacu

SEQ ID NO: 497326 - RNA, 32 nt, Human
uccacauggcaaaaccccaucuguaccaaaaa

SEQ ID NO: 497327 - RNA, 32 nt, Human
uccacauguauuaacagaaagaucccagaauu

SEQ ID NO: 497328 - RNA, 32 nt, Human
uccacauguuggccaggaugguuucggucucu

SEQ ID NO: 497329 - RNA, 32 nt, Human
uccacauuagcagggaagaauuuggaagauuu

SEQ ID NO: 497330 - RNA, 32 nt, Human
uccacauucuugcugucaucucagccauccac

SEQ ID NO: 497331 - RNA, 32 nt, Human
uccacauugaccccucccuagccuggcaggug

SEQ ID NO: 497332 - RNA, 21 nt, Human
uccacauugagaugggcccag

SEQ ID NO: 497333 - RNA, 32 nt, Human
uccacauugagaugggcccagauggaagagug

SEQ ID NO: 497334 - RNA, 32 nt, Human
uccacauugcaacuuugcaucucuauuaggaa

SEQ ID NO: 497335 - RNA, 32 nt, Human
uccacauuggccucugcagcugggugaccaga

SEQ ID NO: 497336 - RNA, 32 nt, Human
uccacauugguggugaugaugggugaguuucc

SEQ ID NO: 497337 - RNA, 19 nt, Human
uccacauuuauaacuuuca

SEQ ID NO: 497338 - RNA, 32 nt, Human
uccacauuuguuguguuccuagggcuucucua

SEQ ID NO: 497339 - RNA, 32 nt, Human
uccacauuuuaaaaugacuugcacuugugcau

SEQ ID NO: 497340 - RNA, 32 nt, Human
uccaccaaaccagcuccaggugaccagacucu

SEQ ID NO: 497341 - RNA, 32 nt, Human
uccaccaaaggaguuugggauugaguuuugcu

SEQ ID NO: 497342 - RNA, 32 nt, Human
uccaccaaauuagugccucuuagaugauguga

SEQ ID NO: 497343 - RNA, 32 nt, Human
uccaccaaccugcgcaggcagcacuuuuggcc

SEQ ID NO: 497344 - RNA, 32 nt, Human
uccaccaagcacugcauguaggacagggcaca

SEQ ID NO: 497345 - RNA, 32 nt, Human
uccaccaaggccagaagggaaaaaggaagaac

SEQ ID NO: 497346 - RNA, 32 nt, Human
uccaccaagugggggaaggggaagggagagaa

SEQ ID NO: 497347 - RNA, 32 nt, Human
uccaccaaugaccccucgcgcugcuuccagaa

SEQ ID NO: 497348 - RNA, 32 nt, Human
uccaccacacauacccucuaagccagcaagau

SEQ ID NO: 497349 - RNA, 32 nt, Human
uccaccacagccgcuugcacguauagauacug

SEQ ID NO: 497350 - RNA, 32 nt, Human
uccaccacaggcacugcuguguggaacgaguu

SEQ ID NO: 497351 - RNA, 32 nt, Human
uccaccacaugagaacacagccagcaggugcc

SEQ ID NO: 497352 - RNA, 32 nt, Human
uccaccaccaacuucucagcauguuucucucc

SEQ ID NO: 497353 - RNA, 22 nt, Human
uccaccaccaccaccgccgccg

SEQ ID NO: 497354 - RNA, 32 nt, Human
uccaccaccaccgccuccuacccuucuuaaca

SEQ ID NO: 497355 - RNA, 23 nt, Human
uccaccacccuuucccccuucuc

SEQ ID NO: 497356 - RNA, 32 nt, Human
uccaccaccucuccaucccagggagccacgac

SEQ ID NO: 497357 - RNA, 32 nt, Human
uccaccaccucuguagcaaccagcucagagaa

SEQ ID NO: 497358 - RNA, 32 nt, Human
uccaccacugaggcccaggcucccaggaccca

SEQ ID NO: 497359 - RNA, 32 nt, Human
uccaccacugcacccaggacccgcugaacccu

SEQ ID NO: 497360 - RNA, 32 nt, Human
uccaccacugucccuucuccccgcuucaaaau

SEQ ID NO: 497361 - RNA, 32 nt, Human
uccaccacuucuuccuccacccaggaccuaau

SEQ ID NO: 497362 - RNA, 32 nt, Human
uccaccagacacagcucgggccuguguaauug

SEQ ID NO: 497363 - RNA, 32 nt, Human
uccaccagaggagagcacaggagagcuaggca

SEQ ID NO: 497364 - RNA, 32 nt, Human
uccaccagagggcagaccugcacucuccauuc

SEQ ID NO: 497365 - RNA, 32 nt, Human
uccaccagauaaccagcuaaucccaggaauuu

SEQ ID NO: 497366 - RNA, 32 nt, Human
uccaccagauagcagagggguaagagaggaug

SEQ ID NO: 497367 - RNA, 32 nt, Human
uccaccagcacaagaagaggaggcaggggcag

SEQ ID NO: 497368 - RNA, 32 nt, Human
uccaccaggaaucagaggcagcuguuaccagg

SEQ ID NO: 497369 - RNA, 32 nt, Human
uccaccaggagucuggagugcaauggcacgau

SEQ ID NO: 497370 - RNA, 32 nt, Human
uccaccagguaccggugcgcccagggcagcca

SEQ ID NO: 497371 - RNA, 32 nt, Human
uccaccauaagcaacagaacaccuauacuugc

SEQ ID NO: 497372 - RNA, 32 nt, Human
uccaccauauuucuccccacucuguaccuucu

SEQ ID NO: 497373 - RNA, 32 nt, Human
uccaccaucagggcuggaaggaagagaaaggg

SEQ ID NO: 497374 - RNA, 32 nt, Human
uccaccaucauuaaggagaggaguguggaggc

SEQ ID NO: 497375 - RNA, 32 nt, Human
uccaccaugucacccucauggagcuuucguua

SEQ ID NO: 497376 - RNA, 32 nt, Human
uccaccauugauaucucccagagguacagaaa

SEQ ID NO: 497377 - RNA, 32 nt, Human
uccaccauugcacuccagucugggcaacagag

SEQ ID NO: 497378 - RNA, 32 nt, Human
uccacccaauaugccacguacgccaacaggga

SEQ ID NO: 497379 - RNA, 32 nt, Human
uccacccaaugccccgccccugcuccaaauca

SEQ ID NO: 497380 - RNA, 32 nt, Human
uccacccacccacacacauacauacauacacc

SEQ ID NO: 497381 - RNA, 32 nt, Human
uccacccacccagugacagagcacaggcagcc

SEQ ID NO: 497382 - RNA, 21 nt, Human
uccacccaccugccccauguc

SEQ ID NO: 497383 - RNA, 19 nt, Human
uccacccaccuuggccucc

SEQ ID NO: 497384 - RNA, 18 nt, Human
uccacccaccuuggccuu

SEQ ID NO: 497385 - RNA, 32 nt, Human
uccacccacugaggcucaguuuccccaugugc

SEQ ID NO: 497386 - RNA, 32 nt, Human
uccacccagcaggcagaguggcguggccuccc

SEQ ID NO: 497387 - RNA, 32 nt, Human
uccacccagcaugucuccugcccaugcagcug

SEQ ID NO: 497388 - RNA, 32 nt, Human
uccacccagccggccacugugugucauggcuc

SEQ ID NO: 497389 - RNA, 24 nt, Human
uccacccaggaggaggcacuggca

SEQ ID NO: 497390 - RNA, 32 nt, Human
uccacccaguugagacacaccaugcuuguuca

SEQ ID NO: 497391 - RNA, 32 nt, Human
uccaccccaagaaagccaaauacaacauaaac

SEQ ID NO: 497392 - RNA, 32 nt, Human
uccaccccaccaccccucuaaguccgacccac

SEQ ID NO: 497393 - RNA, 20 nt, Human
uccaccccagagucucaggc

SEQ ID NO: 497394 - RNA, 21 nt, Human
uccaccccagccccgcccagg

SEQ ID NO: 497395 - RNA, 32 nt, Human
uccaccccaggcucugggaggcucccugagau

SEQ ID NO: 497396 - RNA, 18 nt, Human
uccaccccaguccccggg

SEQ ID NO: 497397 - RNA, 32 nt, Human
uccaccccaucccagacucccaccccagggau

SEQ ID NO: 497398 - RNA, 32 nt, Human
uccaccccaucuuaagcucugucuuccguggc

SEQ ID NO: 497399 - RNA, 20 nt, Human
uccaccccaugugccucagg

SEQ ID NO: 497400 - RNA, 32 nt, Human
uccacccccaccccuuaacuuggguaccccuc

SEQ ID NO: 497401 - RNA, 32 nt, Human
uccacccccacuguuguggucagccccagaga

SEQ ID NO: 497402 - RNA, 32 nt, Human
uccacccccauccugcgcccagucuccucgau

SEQ ID NO: 497403 - RNA, 32 nt, Human
uccacccccucagaucaggcauagccauaguc

SEQ ID NO: 497404 - RNA, 22 nt, Human
uccacccccuggugccugcagg

SEQ ID NO: 497405 - RNA, 32 nt, Human
uccacccccuuuccuuccuuuccucucuguac

SEQ ID NO: 497406 - RNA, 32 nt, Human
uccaccccgacccgcacacacacccacacugc

SEQ ID NO: 497407 - RNA, 32 nt, Human
uccaccccgcauuccacucaucagcuucacaa

SEQ ID NO: 497408 - RNA, 32 nt, Human
uccaccccgccuggccuggcguccaccucugc

SEQ ID NO: 497409 - RNA, 32 nt, Human
uccaccccucaccaacaccucugcaguccucu

SEQ ID NO: 497410 - RNA, 32 nt, Human
uccaccccucauuuccuuuuugcacacauuac

SEQ ID NO: 497411 - RNA, 32 nt, Human
uccaccccuccugcuuccccaggcauuaugaa

SEQ ID NO: 497412 - RNA, 21 nt, Human
uccaccccugacaacccgaga

SEQ ID NO: 497413 - RNA, 32 nt, Human
uccaccccugcuccccagagacuuccugcuuu

SEQ ID NO: 497414 - RNA, 32 nt, Human
uccaccccugggaggcagaagccaggcauagc

SEQ ID NO: 497415 - RNA, 32 nt, Human
uccaccccuucuguucgccacacccugcgucu

SEQ ID NO: 497416 - RNA, 32 nt, Human
uccaccccuuggugcuggcaguguuuggggac

SEQ ID NO: 497417 - RNA, 31 nt, Human
uccacccgcaggccucccaugcuccaagcag

SEQ ID NO: 497418 - RNA, 32 nt, Human
uccacccgccagggagaggggagccagagccg

SEQ ID NO: 497419 - RNA, 32 nt, Human
uccacccgccggccucccgcagccuggccagg

SEQ ID NO: 497420 - RNA, 32 nt, Human
uccacccgccuucucacuaucucuuuugccua

SEQ ID NO: 497421 - RNA, 32 nt, Human
uccacccgcucccaggguuucccaccacaggg

SEQ ID NO: 497422 - RNA, 31 nt, Human
uccacccguccuggggugguuggaggccugg

SEQ ID NO: 497423 - RNA, 32 nt, Human
uccacccgugucccucaugggugagcccucca

SEQ ID NO: 497424 - RNA, 32 nt, Human
uccacccguucccacugcccugggcagccauc

SEQ ID NO: 497425 - RNA, 32 nt, Human
uccacccuacaccccucugucucccuccauuc

SEQ ID NO: 497426 - RNA, 32 nt, Human
uccacccuagcacaucugggcucuacccucgc

SEQ ID NO: 497427 - RNA, 32 nt, Human
uccacccuaggcuucucuccucccucuucccu

SEQ ID NO: 497428 - RNA, 32 nt, Human
uccacccucacccuuuuccuuucccaugaacc

SEQ ID NO: 497429 - RNA, 32 nt, Human
uccacccucagcucccugcacaauucauggga

SEQ ID NO: 497430 - RNA, 32 nt, Human
uccacccuccaggagaccccagugucuguggu

SEQ ID NO: 497431 - RNA, 32 nt, Human
uccacccuccauuccuccuccccugggccucu

SEQ ID NO: 497432 - RNA, 32 nt, Human
uccacccuccccgugcugcuguguucugcucc

SEQ ID NO: 497433 - RNA, 32 nt, Human
uccacccucugccugccugccugccugcuguc

SEQ ID NO: 497434 - RNA, 22 nt, Human
uccacccucugugccgccgccg

SEQ ID NO: 497435 - RNA, 32 nt, Human
uccacccucuuugguuccuugugguccugcuc

SEQ ID NO: 497436 - RNA, 32 nt, Human
uccacccugcaacccccaucccccaccgggcc

SEQ ID NO: 497437 - RNA, 32 nt, Human
uccacccugcagccgcugccuccugggccccg

SEQ ID NO: 497438 - RNA, 32 nt, Human
uccacccugcaggggcccagacugccugcagg

SEQ ID NO: 497439 - RNA, 24 nt, Human
uccacccugcccgugcugcugcuc

SEQ ID NO: 497440 - RNA, 32 nt, Human
uccacccugccuccucuguucugaaauuccau

SEQ ID NO: 497441 - RNA, 32 nt, Human
uccacccugccugccgucugugcuuccuccug

SEQ ID NO: 497442 - RNA, 32 nt, Human
uccacccugccugccugggccgccucuguggc

SEQ ID NO: 497443 - RNA, 32 nt, Human
uccacccugccugugucuggggccugggggcu

SEQ ID NO: 497444 - RNA, 32 nt, Human
uccacccuggaccaccucugggggucugucag

SEQ ID NO: 497445 - RNA, 32 nt, Human
uccacccugggaacuguggaaaaaguaggaga

SEQ ID NO: 497446 - RNA, 24 nt, Human
uccacccugggcaacagagcaaga

SEQ ID NO: 497447 - RNA, 32 nt, Human
uccacccugggcaacagagcaagaccccaucu

SEQ ID NO: 497448 - RNA, 32 nt, Human
uccacccugggcaacagagcaagacuccaugu

SEQ ID NO: 497449 - RNA, 24 nt, Human
uccacccugggcgacagagcaaga

SEQ ID NO: 497450 - RNA, 32 nt, Human
uccacccugggcgacagagcaagauucuauca

SEQ ID NO: 497451 - RNA, 24 nt, Human
uccacccugggcgacagagugaga

SEQ ID NO: 497452 - RNA, 32 nt, Human
uccacccugggugacagagugaagacucccuc

SEQ ID NO: 497453 - RNA, 32 nt, Human
uccacccugugggcacaauaacauaacuguug

SEQ ID NO: 497454 - RNA, 22 nt, Human
uccacccuuaacccugugcuca

SEQ ID NO: 497455 - RNA, 32 nt, Human
uccacccuuaugucacagugcuucauguguac

SEQ ID NO: 497456 - RNA, 32 nt, Human
uccacccuucaaccaguggcuccugggagacu

SEQ ID NO: 497457 - RNA, 22 nt, Human
uccacccuuccugccucauguc

SEQ ID NO: 497458 - RNA, 21 nt, Human
uccacccuuuaaaagcauuga

SEQ ID NO: 497459 - RNA, 32 nt, Human
uccacccuuuccugcggcaccaccucccuuuu

SEQ ID NO: 497460 - RNA, 32 nt, Human
uccacccuuugcugcugaccucggcugcuccu

SEQ ID NO: 497461 - RNA, 22 nt, Human
uccacccuuuuuucuaaguguu

SEQ ID NO: 497462 - RNA, 32 nt, Human
uccaccgaggccagguuggggaaguucagccu

SEQ ID NO: 497463 - RNA, 32 nt, Human
uccaccgccauccuucaccucucccucagccu

SEQ ID NO: 497464 - RNA, 22 nt, Human
uccaccgccgccgccgccgccg

SEQ ID NO: 497465 - RNA, 32 nt, Human
uccaccgcucgaguucucuacucuccauaucc

SEQ ID NO: 497466 - RNA, 32 nt, Human
uccaccgcuuuggagaccucaggacuuggaua

SEQ ID NO: 497467 - RNA, 32 nt, Human
uccaccggaaggacgaggggcaggacgugugg

SEQ ID NO: 497468 - RNA, 32 nt, Human
uccaccggcacgagggcggaaaagaaagccuc

SEQ ID NO: 497469 - RNA, 32 nt, Human
uccaccggcugcagacccauggccgagcgcgg

SEQ ID NO: 497470 - RNA, 32 nt, Human
uccaccgggccuuccuggugggcauguacggc

SEQ ID NO: 497471 - RNA, 26 nt, Human
uccaccguacucugugaaucuaauua

SEQ ID NO: 497472 - RNA, 32 nt, Human
uccaccguuccaggcagcagcacucccaccug

SEQ ID NO: 497473 - RNA, 32 nt, Human
uccaccuaaacaucaucucccaaauuuuaauc

SEQ ID NO: 497474 - RNA, 32 nt, Human
uccaccuacugaacuagaaccugcucaggauu

SEQ ID NO: 497475 - RNA, 32 nt, Human
uccaccuagaccaagucggcagucucccuaca

SEQ ID NO: 497476 - RNA, 25 nt, Human
uccaccuauucacccauacaaccuu

SEQ ID NO: 497477 - RNA, 32 nt, Human
uccaccucaacacacauccaucucaagaggaa

SEQ ID NO: 497478 - RNA, 32 nt, Human
uccaccucacuguccccagccugccugccucc

SEQ ID NO: 497479 - RNA, 32 nt, Human
uccaccucaucuuccuccuguuggcuccucag

SEQ ID NO: 497480 - RNA, 32 nt, Human
uccaccucaugcagugagccagccuggccgcu

SEQ ID NO: 497481 - RNA, 32 nt, Human
uccaccuccacaugcuccgccuccaggucccg

SEQ ID NO: 497482 - RNA, 32 nt, Human
uccaccuccaccgccaccuccaccuccggcac

SEQ ID NO: 497483 - RNA, 23 nt, Human
uccaccuccagccaccccagguc

SEQ ID NO: 497484 - RNA, 32 nt, Human
uccaccucccaaaaugcugagauuacaggugu

SEQ ID NO: 497485 - RNA, 32 nt, Human
uccaccucccaaacugcugggauuacaggugu

SEQ ID NO: 497486 - RNA, 32 nt, Human
uccaccucccaaaguacugggauuacaggcau

SEQ ID NO: 497487 - RNA, 32 nt, Human
uccaccucccaaagugcuaggauuacaggcgu

SEQ ID NO: 497488 - RNA, 32 nt, Human
uccaccucccaaagugcugggauuacaggcgu

SEQ ID NO: 497489 - RNA, 32 nt, Human
uccaccucccaaaguguucggauuacaaacgu

SEQ ID NO: 497490 - RNA, 32 nt, Human
uccaccucccaaaguguugugauuacaggcgu

SEQ ID NO: 497491 - RNA, 32 nt, Human
uccaccucccaaggugcugggauuacaggcau

SEQ ID NO: 497492 - RNA, 32 nt, Human
uccaccucccaagguguugggauuacaggcgu

SEQ ID NO: 497493 - RNA, 32 nt, Human
uccaccucccagggugcugggauuacaggugu

SEQ ID NO: 497494 - RNA, 32 nt, Human
uccaccuccccgucuuccucugggugccaaau

SEQ ID NO: 497495 - RNA, 32 nt, Human
uccaccucccgcagugcugggauuacaggcau

SEQ ID NO: 497496 - RNA, 32 nt, Human
uccaccucccuccaccaggauggcagccagga

SEQ ID NO: 497497 - RNA, 32 nt, Human
uccaccuccuuucagcugcuccugggccucag

SEQ ID NO: 497498 - RNA, 32 nt, Human
uccaccucggagaccacccucccccagccaga

SEQ ID NO: 497499 - RNA, 32 nt, Human
uccaccucuccucuguccuugcugccucagag

SEQ ID NO: 497500 - RNA, 32 nt, Human
uccaccucuccuuuuugccauuucacuuauug

SEQ ID NO: 497501 - RNA, 32 nt, Human
uccaccucugcggcuccuaccugggugcaauc

SEQ ID NO: 497502 - RNA, 32 nt, Human
uccaccucugggagcuggaguccacuggggug

SEQ ID NO: 497503 - RNA, 32 nt, Human
uccaccugcaggaaggccagagguucuggugg

SEQ ID NO: 497504 - RNA, 21 nt, Human
uccaccugccaggcucaagca

SEQ ID NO: 497505 - RNA, 32 nt, Human
uccaccugccuuggccuuccagagugcuggga

SEQ ID NO: 497506 - RNA, 32 nt, Human
uccaccuggacucugcccaggccagcguguuc

SEQ ID NO: 497507 - RNA, 32 nt, Human
uccaccugggcaacaagaacgaaacuccguau

SEQ ID NO: 497508 - RNA, 32 nt, Human
uccaccugggugcugggcugggcucuaaagcc

SEQ ID NO: 497509 - RNA, 32 nt, Human
uccaccuguauguacagugauaacguguguga

SEQ ID NO: 497510 - RNA, 32 nt, Human
uccaccuguccggauccagcugucuggucaug

SEQ ID NO: 497511 - RNA, 32 nt, Human
uccaccugucucaaacucuaaggucggcacuu

SEQ ID NO: 497512 - RNA, 32 nt, Human
uccaccugucuucauccuccccugcacuccag

SEQ ID NO: 497513 - RNA, 32 nt, Human
uccaccugugcuacccgguccagaccucccag

SEQ ID NO: 497514 - RNA, 32 nt, Human
uccaccuguuguuccuggacucugacacauga

SEQ ID NO: 497515 - RNA, 32 nt, Human
uccaccuuaaggcuuuaaaagacagugaagcu

SEQ ID NO: 497516 - RNA, 32 nt, Human
uccaccuuagcagagggcaaguucuuucaucg

SEQ ID NO: 497517 - RNA, 32 nt, Human
uccaccuucacaaguauccuucaaaggcaucc

SEQ ID NO: 497518 - RNA, 21 nt, Human
uccaccuucagcauuuacugu

SEQ ID NO: 497519 - RNA, 21 nt, Human
uccaccuuccaggcuuacuca

SEQ ID NO: 497520 - RNA, 23 nt, Human
uccaccuucccuagucaccagcu

SEQ ID NO: 497521 - RNA, 24 nt, Human
uccaccuuccugcacucauucuca

SEQ ID NO: 497522 - RNA, 19 nt, Human
uccaccuuccuuugugcuc

SEQ ID NO: 497523 - RNA, 32 nt, Human
uccaccuucucccaaggccagcccacauagcc

SEQ ID NO: 497524 - RNA, 22 nt, Human
uccaccuucucugccuccaguc

SEQ ID NO: 497525 - RNA, 21 nt, Human
uccaccuucucuucacucuca

SEQ ID NO: 497526 - RNA, 32 nt, Human
uccaccuugauauugcacuuccaggcuccaga

SEQ ID NO: 497527 - RNA, 32 nt, Human
uccaccuuggcugggaagacuauggugcugcc

SEQ ID NO: 497528 - RNA, 32 nt, Human
uccaccuugucacuccagguucuggugacccc

SEQ ID NO: 497529 - RNA, 22 nt, Human
uccaccuuuaccuaacuaccuu

SEQ ID NO: 497530 - RNA, 23 nt, Human
uccaccuuuccacucaacaaccu

SEQ ID NO: 497531 - RNA, 21 nt, Human
uccaccuuucccuuggauuca

SEQ ID NO: 497532 - RNA, 32 nt, Human
uccaccuuucucucugaaucucucuccugucu

SEQ ID NO: 497533 - RNA, 24 nt, Human
uccaccuuugggucgcuuugcugu

SEQ ID NO: 497534 - RNA, 32 nt, Human
uccaccuuugugcaaaugcgaaccacaucuca

SEQ ID NO: 497535 - RNA, 32 nt, Human
uccaccuuuuucucccccacacuucgcggcuu

SEQ ID NO: 497536 - RNA, 32 nt, Human
uccacgaacuuuugucauucagccugggagac

SEQ ID NO: 497537 - RNA, 32 nt, Human
uccacgacggugacacgcuucccuggauuggc

SEQ ID NO: 497538 - RNA, 32 nt, Human
uccacgacucauugucuugcugcccagagcug

SEQ ID NO: 497539 - RNA, 32 nt, Human
uccacgagaccaugcuccucagaagcuaccca

SEQ ID NO: 497540 - RNA, 32 nt, Human
uccacgagccugacccccguaaagggucugug

SEQ ID NO: 497541 - RNA, 32 nt, Human
uccacgaggcugucaccacccugguagcacug

SEQ ID NO: 497542 - RNA, 32 nt, Human
uccacgagggucccaggcagagcugcagagcu

SEQ ID NO: 497543 - RNA, 32 nt, Human
uccacgauccuucccugaacacuguaguuuuc

SEQ ID NO: 497544 - RNA, 32 nt, Human
uccacgauguacaaagucauuucggccaguag

SEQ ID NO: 497545 - RNA, 32 nt, Human
uccacgcaaagaggaggaaauuuggaaauaca

SEQ ID NO: 497546 - RNA, 32 nt, Human
uccacgcagccuggugauggcaggccuggguu

SEQ ID NO: 497547 - RNA, 32 nt, Human
uccacgcagcuggcagagagcacagugaucac

SEQ ID NO: 497548 - RNA, 32 nt, Human
uccacgcauggagaacugcagcugugaggccc

SEQ ID NO: 497549 - RNA, 32 nt, Human
uccacgccaggccacgacggagggcgacuacc

SEQ ID NO: 497550 - RNA, 32 nt, Human
uccacgccgcucacuccagccgaggcccccgc

SEQ ID NO: 497551 - RNA, 32 nt, Human
uccacgccgcuuuugcccccucccuccccucc

SEQ ID NO: 497552 - RNA, 23 nt, Human
uccacgcggacaggcaguuccag

SEQ ID NO: 497553 - RNA, 20 nt, Human
uccacgcguacccuaaggcc

SEQ ID NO: 497554 - RNA, 32 nt, Human
uccacgcucuuugguuccuugugguccugcuc

SEQ ID NO: 497555 - RNA, 23 nt, Human
uccacgcugcaggacccgcgccg

SEQ ID NO: 497556 - RNA, 32 nt, Human
uccacgcugccuccuccucgaguuuuccucgg

SEQ ID NO: 497557 - RNA, 32 nt, Human
uccacgcugccuggagcagguuguuagagagc

SEQ ID NO: 497558 - RNA, 32 nt, Human
uccacgcugugaagcuuuguucuuuuggucuu

SEQ ID NO: 497559 - RNA, 22 nt, Human
uccacggacuucggagcauaga

SEQ ID NO: 497560 - RNA, 32 nt, Human
uccacggaggguggaagaggagaggguggaag

SEQ ID NO: 497561 - RNA, 32 nt, Human
uccacggcagcaucuucagcucuuggguuuag

SEQ ID NO: 497562 - RNA, 32 nt, Human
uccacggcagcuugagccccuuagcaccaugu

SEQ ID NO: 497563 - RNA, 32 nt, Human
uccacggccguacaauccccagcccuuccagc

SEQ ID NO: 497564 - RNA, 32 nt, Human
uccacggcuccugcuucugcccccaggguucg

SEQ ID NO: 497565 - RNA, 18 nt, Human
uccacggcugcccagggc

SEQ ID NO: 497566 - RNA, 32 nt, Human
uccacgggagagaagacgagccucccggcugu

SEQ ID NO: 497567 - RNA, 22 nt, Human
uccacggggucugccuuugcag

SEQ ID NO: 497568 - RNA, 32 nt, Human
uccacgggugccccuagcuggcccagagccgg

SEQ ID NO: 497569 - RNA, 32 nt, Human
uccacggguggaccaggauggagucuccugcc

SEQ ID NO: 497570 - RNA, 32 nt, Human
uccacgguagcagccacacuuccuucagaagg

SEQ ID NO: 497571 - RNA, 32 nt, Human
uccacggugacggguggcucuguggcugguag

SEQ ID NO: 497572 - RNA, 32 nt, Human
uccacggugccccguagcagcagguccugcgg

SEQ ID NO: 497573 - RNA, 24 nt, Human
uccacgguguucuggcagcaggga

SEQ ID NO: 497574 - RNA, 32 nt, Human
uccacgguuugcuuucugcaggauuuaaaaua

SEQ ID NO: 497575 - RNA, 21 nt, Human
uccacguaauucaauuucuca

SEQ ID NO: 497576 - RNA, 19 nt, Human
uccacgucaguucaugagg

SEQ ID NO: 497577 - RNA, 32 nt, Human
uccacguccagccugggaccuggcaucucugg

SEQ ID NO: 497578 - RNA, 32 nt, Human
uccacgucccgcccccuuccucuuccugccuc

SEQ ID NO: 497579 - RNA, 32 nt, Human
uccacgucccuggccuuccuccccuuccaggc

SEQ ID NO: 497580 - RNA, 32 nt, Human
uccacguccuuaucuucuugaugcaagacaau

SEQ ID NO: 497581 - RNA, 22 nt, Human
uccacgugaaaagaccaccaaa

SEQ ID NO: 497582 - RNA, 32 nt, Human
uccacgugcaggccaagagcacugagacaccc

SEQ ID NO: 497583 - RNA, 32 nt, Human
uccacgugcucgccucugcccagccugcccca

SEQ ID NO: 497584 - RNA, 32 nt, Human
uccacguguccacccuccugcucaugcagagg

SEQ ID NO: 497585 - RNA, 22 nt, Human
uccacguguucugguggaauga

SEQ ID NO: 497586 - RNA, 32 nt, Human
uccacguugggggacugaggccaacucuccuu

SEQ ID NO: 497587 - RNA, 32 nt, Human
uccacguuugacauuccaucagauuucgucca

SEQ ID NO: 497588 - RNA, 32 nt, Human
uccacuaaaaacaaaaacaauuagcugggcau

SEQ ID NO: 497589 - RNA, 32 nt, Human
uccacuaaaaauacaaaaauuagccaggcaug

SEQ ID NO: 497590 - RNA, 32 nt, Human
uccacuaaaaauacaaaaauuagccaggcgug

SEQ ID NO: 497591 - RNA, 32 nt, Human
uccacuaaaaauacaaaaauuagccaggugug

SEQ ID NO: 497592 - RNA, 32 nt, Human
uccacuaaaaauacaaaaauuagccgggcgug

SEQ ID NO: 497593 - RNA, 32 nt, Human
uccacuaaaaauacaaaaauuagccgggugug

SEQ ID NO: 497594 - RNA, 32 nt, Human
uccacuaaaaauacaaaauuagccgggcaugg

SEQ ID NO: 497595 - RNA, 32 nt, Human
uccacuaaaaauacaaaauuagccgggugugg

SEQ ID NO: 497596 - RNA, 32 nt, Human
uccacuaaaaauacaaaauuagcugggcgugg

SEQ ID NO: 497597 - RNA, 32 nt, Human
uccacuaaaaauacaaaauuagcugggugugg

SEQ ID NO: 497598 - RNA, 32 nt, Human
uccacuaaaauacaaaauuagcuggguguggu

SEQ ID NO: 497599 - RNA, 32 nt, Human
uccacuaaccaccaccaccaccaccgccgcca

SEQ ID NO: 497600 - RNA, 32 nt, Human
uccacuaacugcacuuccuucccacuggaaaa

SEQ ID NO: 497601 - RNA, 32 nt, Human
uccacuaagaacaccugcauucuucccuuauc

SEQ ID NO: 497602 - RNA, 32 nt, Human
uccacuacccuguuaagagcagccugggaacg

SEQ ID NO: 497603 - RNA, 32 nt, Human
uccacuacucaucucuggaauuagccgcuuaa

SEQ ID NO: 497604 - RNA, 19 nt, Human
uccacuacuccaccucaga

SEQ ID NO: 497605 - RNA, 32 nt, Human
uccacuagacccccuuccccagccucucuagu

SEQ ID NO: 497606 - RNA, 20 nt, Human
uccacuagagcugccugcca

SEQ ID NO: 497607 - RNA, 32 nt, Human
uccacuauucuggccuucuacaaguuccaaaa

SEQ ID NO: 497608 - RNA, 32 nt, Human
uccacucaacaucaagauaagcugcucuauau

SEQ ID NO: 497609 - RNA, 32 nt, Human
uccacucaaccaggccuccaccugccauggag

SEQ ID NO: 497610 - RNA, 31 nt, Human
uccacucaaguguccuuuucuguaggcagga

SEQ ID NO: 497611 - RNA, 32 nt, Human
uccacucacugcaacuuccgccuccugggguc

SEQ ID NO: 497612 - RNA, 32 nt, Human
uccacucacugcagccuccgccucugggguuc

SEQ ID NO: 497613 - RNA, 32 nt, Human
uccacucacugcaggcuccgccucccggguuc

SEQ ID NO: 497614 - RNA, 32 nt, Human
uccacucaggugcacacaucaccaggugcauc

SEQ ID NO: 497615 - RNA, 32 nt, Human
uccacucauccccuucuucucuccuuggccuc

SEQ ID NO: 497616 - RNA, 32 nt, Human
uccacuccaaggcugccugccugcuguaaaca

SEQ ID NO: 497617 - RNA, 26 nt, Human
uccacuccaaucagucuaucuucaca

SEQ ID NO: 497618 - RNA, 32 nt, Human
uccacuccagccugagcaacacagugagaccc

SEQ ID NO: 497619 - RNA, 32 nt, Human
uccacuccagccugggcaacagugugagaccu

SEQ ID NO: 497620 - RNA, 32 nt, Human
uccacuccagcuguuucccaaauccuuccuuc

SEQ ID NO: 497621 - RNA, 32 nt, Human
uccacucccugaggccacuuagccugagacau

SEQ ID NO: 497622 - RNA, 32 nt, Human
uccacucccugccugugcugguugcagccuca

SEQ ID NO: 497623 - RNA, 32 nt, Human
uccacuccuccccucacuccccugcucccccg

SEQ ID NO: 497624 - RNA, 32 nt, Human
uccacuccucuccaggagcuagccugugcccu

SEQ ID NO: 497625 - RNA, 32 nt, Human
uccacuccugcucucccuccugcaggugaccc

SEQ ID NO: 497626 - RNA, 32 nt, Human
uccacuccuuacugccaagucucaagcauacc

SEQ ID NO: 497627 - RNA, 32 nt, Human
uccacuccuuggcuggaggcagugcugaggcc

SEQ ID NO: 497628 - RNA, 32 nt, Human
uccacucggccugggagguucuggauuuuggc

SEQ ID NO: 497629 - RNA, 32 nt, Human
uccacucggggaacuccuuuccaagcugaccu

SEQ ID NO: 497630 - RNA, 22 nt, Human
uccacucggggguggagugaga

SEQ ID NO: 497631 - RNA, 24 nt, Human
uccacucguccgcacgguacgucu

SEQ ID NO: 497632 - RNA, 32 nt, Human
uccacucgugguugugauuuucaccuucucaa

SEQ ID NO: 497633 - RNA, 27 nt, Human
uccacucuagaggccaggccaccagca

SEQ ID NO: 497634 - RNA, 32 nt, Human
uccacucuaguugaguucugcagcaugcagcg

SEQ ID NO: 497635 - RNA, 32 nt, Human
uccacucucccagcucagggcuccagcuguug

SEQ ID NO: 497636 - RNA, 32 nt, Human
uccacucuccccucucucugggaucauagagu

SEQ ID NO: 497637 - RNA, 32 nt, Human
uccacucucccucaagccugugcucagguugc

SEQ ID NO: 497638 - RNA, 32 nt, Human
uccacucugauagaauuauuucacaaauaaua

SEQ ID NO: 497639 - RNA, 32 nt, Human
uccacucugauccugcaucccacucccuggga

SEQ ID NO: 497640 - RNA, 32 nt, Human
uccacucugcagccucaaacuccugggcucca

SEQ ID NO: 497641 - RNA, 32 nt, Human
uccacucugcagucuaggugggugauauucug

SEQ ID NO: 497642 - RNA, 32 nt, Human
uccacucugccucuugcaagcugugugacccc

SEQ ID NO: 497643 - RNA, 32 nt, Human
uccacucugccucuugcaagcugugugacccu

SEQ ID NO: 497644 - RNA, 32 nt, Human
uccacucugcucugagcagccugggaugcuga

SEQ ID NO: 497645 - RNA, 32 nt, Human
uccacucugcuucucugacuucugccuggaga

SEQ ID NO: 497646 - RNA, 32 nt, Human
uccacucugggcaggugacuggaauagcugau

SEQ ID NO: 497647 - RNA, 32 nt, Human
uccacucuguccguggaguggagcugcugguu

SEQ ID NO: 497648 - RNA, 32 nt, Human
uccacucuuucugcccucaccugggcaacguu

SEQ ID NO: 497649 - RNA, 21 nt, Human
uccacucuuuucuucuucaca

SEQ ID NO: 497650 - RNA, 20 nt, Human
uccacugaagcugacuuagc

SEQ ID NO: 497651 - RNA, 32 nt, Human
uccacugaauauuuaaauuuuccucuuaaaug

SEQ ID NO: 497652 - RNA, 20 nt, Human
uccacugaccaggcugugaa

SEQ ID NO: 497653 - RNA, 32 nt, Human
uccacugacuccagagagggagauccccagua

SEQ ID NO: 497654 - RNA, 18 nt, Human
uccacugacugccuguca

SEQ ID NO: 497655 - RNA, 32 nt, Human
uccacugagaagccacuucaagaggcuggugc

SEQ ID NO: 497656 - RNA, 32 nt, Human
uccacugagagcuguucuuuugcucaauaaaa

SEQ ID NO: 497657 - RNA, 32 nt, Human
uccacugagauguuugcauggagagaaacaua

SEQ ID NO: 497658 - RNA, 32 nt, Human
uccacugagauucucuaugaggauguacagaa

SEQ ID NO: 497659 - RNA, 32 nt, Human
uccacugagccaagaucgcucccacugcacuc

SEQ ID NO: 497660 - RNA, 32 nt, Human
uccacugagcugacaguaaagcugcagugauu

SEQ ID NO: 497661 - RNA, 32 nt, Human
uccacugagggccgagacuuugucuuugcggc

SEQ ID NO: 497662 - RNA, 32 nt, Human
uccacugagguugggguguacuaguuacacau

SEQ ID NO: 497663 - RNA, 32 nt, Human
uccacugaugcaggagcugccaccccaagggg

SEQ ID NO: 497664 - RNA, 32 nt, Human
uccacugauuccuucuuagccauggagagcau

SEQ ID NO: 497665 - RNA, 32 nt, Human
uccacugauuuccugauguccaugucuauaug

SEQ ID NO: 497666 - RNA, 32 nt, Human
uccacugcaccacuacucccaagccuagggau

SEQ ID NO: 497667 - RNA, 32 nt, Human
uccacugcacuccagcccaggugacaguguga

SEQ ID NO: 497668 - RNA, 32 nt, Human
uccacugcacuccagccugggugacagaccga

SEQ ID NO: 497669 - RNA, 32 nt, Human
uccacugcacuccagccugggugacagaucca

SEQ ID NO: 497670 - RNA, 32 nt, Human
uccacugcagcucugggcuccauuucccuuug

SEQ ID NO: 497671 - RNA, 32 nt, Human
uccacugccaagcaggacuuggcacaugagca

SEQ ID NO: 497672 - RNA, 32 nt, Human
uccacugcccuggcagcagcagguguggccaa

SEQ ID NO: 497673 - RNA, 32 nt, Human
uccacugccucccagguucaugccauucuccu

SEQ ID NO: 497674 - RNA, 32 nt, Human
uccacugccugggagcagcucacucagcuugc

SEQ ID NO: 497675 - RNA, 32 nt, Human
uccacugcguugucccauccagccuccacucg

SEQ ID NO: 497676 - RNA, 32 nt, Human
uccacugcuaacaacaggacugccuuucccug

SEQ ID NO: 497677 - RNA, 32 nt, Human
uccacugcuaucuucuucuguccugaguuugg

SEQ ID NO: 497678 - RNA, 32 nt, Human
uccacugcugcucccggguccugcugcccgag

SEQ ID NO: 497679 - RNA, 32 nt, Human
uccacugcuucuaccuccccucccaggacccc

SEQ ID NO: 497680 - RNA, 32 nt, Human
uccacuggaucaccgccgucacugccuguucc

SEQ ID NO: 497681 - RNA, 32 nt, Human
uccacuggcacuucccugcuuugcuaccaucg

SEQ ID NO: 497682 - RNA, 32 nt, Human
uccacuggcagcuugcacucucagccugaaaa

SEQ ID NO: 497683 - RNA, 32 nt, Human
uccacuggcuggcugcgggcuccagcggccgu

SEQ ID NO: 497684 - RNA, 32 nt, Human
uccacugggaaaaggggaaaaagggaauucuu

SEQ ID NO: 497685 - RNA, 32 nt, Human
uccacugggaagagacaggaauucuaccuaca

SEQ ID NO: 497686 - RNA, 32 nt, Human
uccacugggaucaugagucacucugaagccac

SEQ ID NO: 497687 - RNA, 32 nt, Human
uccacugggcugcccaagcugcaugucaccug

SEQ ID NO: 497688 - RNA, 32 nt, Human
uccacugggguuucuuucaguuucccaaauac

SEQ ID NO: 497689 - RNA, 32 nt, Human
uccacuggucucaaaagucaccugccuacaaa

SEQ ID NO: 497690 - RNA, 19 nt, Human
uccacugguucccauggcc

SEQ ID NO: 497691 - RNA, 24 nt, Human
uccacuguacacgcuguauauagg

SEQ ID NO: 497692 - RNA, 32 nt, Human
uccacugucaccaagcuggauggcaagcugcg

SEQ ID NO: 497693 - RNA, 32 nt, Human
uccacugucacuguuucucugcuguugcaaau

SEQ ID NO: 497694 - RNA, 32 nt, Human
uccacugucauaaucucuuuccaucuuacuug

SEQ ID NO: 497695 - RNA, 32 nt, Human
uccacugucaucaaacuggccauguccuggcc

SEQ ID NO: 497696 - RNA, 18 nt, Human
uccacugucuccacucuc

SEQ ID NO: 497697 - RNA, 32 nt, Human
uccacugucuguuccuuuugcugucugaacuu

SEQ ID NO: 497698 - RNA, 32 nt, Human
uccacugugaacugaggaggggaggggugugc

SEQ ID NO: 497699 - RNA, 32 nt, Human
uccacugugcacgguuaaaaggccaacuccac

SEQ ID NO: 497700 - RNA, 32 nt, Human
uccacugugcaggaguggccggggaagcuggc

SEQ ID NO: 497701 - RNA, 32 nt, Human
uccacugugcccaccacugcccucccccuugc

SEQ ID NO: 497702 - RNA, 32 nt, Human
uccacuguggacccccaaaaccuguccugucc

SEQ ID NO: 497703 - RNA, 23 nt, Human
uccacuguggagauggcuggggc

SEQ ID NO: 497704 - RNA, 19 nt, Human
uccacugugggacccuuga

SEQ ID NO: 497705 - RNA, 32 nt, Human
uccacuguggugugcucuccagcucuucaccu

SEQ ID NO: 497706 - RNA, 32 nt, Human
uccacuguuccaucuguggccuaggcauggcg

SEQ ID NO: 497707 - RNA, 32 nt, Human
uccacuguuguguuuggcaugaacacagucuu

SEQ ID NO: 497708 - RNA, 21 nt, Human
uccacuuaacucgcgccgccg

SEQ ID NO: 497709 - RNA, 32 nt, Human
uccacuuaaggaugaggcagacuuggugacaa

SEQ ID NO: 497710 - RNA, 32 nt, Human
uccacuuauaauaccaacugucuugucagacu

SEQ ID NO: 497711 - RNA, 20 nt, Human
uccacuuauccccuccguga

SEQ ID NO: 497712 - RNA, 32 nt, Human
uccacuucacaauauuugauauucaggagcau

SEQ ID NO: 497713 - RNA, 32 nt, Human
uccacuucaugaguguuuuacaacagcacuug

SEQ ID NO: 497714 - RNA, 32 nt, Human
uccacuuccaugccuggaggaagccugcaacc

SEQ ID NO: 497715 - RNA, 32 nt, Human
uccacuucccccaggucuugguuuugagaaac

SEQ ID NO: 497716 - RNA, 32 nt, Human
uccacuuccuuucuucuucuucuaaaauauug

SEQ ID NO: 497717 - RNA, 32 nt, Human
uccacuucgccuucugccaugacuguccguuu

SEQ ID NO: 497718 - RNA, 32 nt, Human
uccacuucuaacuccacuggcuccaugauucu

SEQ ID NO: 497719 - RNA, 32 nt, Human
uccacuucucacaggccuccucuuucaaauaa

SEQ ID NO: 497720 - RNA, 32 nt, Human
uccacuucucacucuuauggucucaaagcuug

SEQ ID NO: 497721 - RNA, 32 nt, Human
uccacuucuccaagaauggaagccugaacuga

SEQ ID NO: 497722 - RNA, 32 nt, Human
uccacuucuccccucacuuuccccucacccau

SEQ ID NO: 497723 - RNA, 32 nt, Human
uccacuucucugcuuccuccacguccuaacga

SEQ ID NO: 497724 - RNA, 32 nt, Human
uccacuucugcagcaagcuucuuccuggacau

SEQ ID NO: 497725 - RNA, 32 nt, Human
uccacuucuuaaugcuuuccucccuggcauga

SEQ ID NO: 497726 - RNA, 32 nt, Human
uccacuugagguucaugagaauguaucuuuuu

SEQ ID NO: 497727 - RNA, 32 nt, Human
uccacuugcacacacgcacacacucaugcuca

SEQ ID NO: 497728 - RNA, 31 nt, Human
uccacuugcauaauucaugccaacacugguu

SEQ ID NO: 497729 - RNA, 32 nt, Human
uccacuugcuuccaaggugcuagggaaguuuc

SEQ ID NO: 497730 - RNA, 32 nt, Human
uccacuuggccaaacuuuagccaagcuccuca

SEQ ID NO: 497731 - RNA, 32 nt, Human
uccacuuggcuccucucacuucccaggggguc

SEQ ID NO: 497732 - RNA, 32 nt, Human
uccacuugucccagguuagggggcuugccuug

SEQ ID NO: 497733 - RNA, 32 nt, Human
uccacuuguucagucugaaaugcagcucccug

SEQ ID NO: 497734 - RNA, 32 nt, Human
uccacuuuaaaauucuuuagugcucaaaacca

SEQ ID NO: 497735 - RNA, 32 nt, Human
uccacuuuaaggcuuuaaaagacagugaagcu

SEQ ID NO: 497736 - RNA, 32 nt, Human
uccacuuuccauccugucugggucugaaaaca

SEQ ID NO: 497737 - RNA, 32 nt, Human
uccacuuuccauuuucucuuucaccucauuuu

SEQ ID NO: 497738 - RNA, 32 nt, Human
uccacuuuccuucaggcucugugaauacuuca

SEQ ID NO: 497739 - RNA, 32 nt, Human
uccacuuugccucccccaaucacugcggcggc

SEQ ID NO: 497740 - RNA, 32 nt, Human
uccacuuugccucugcugcucugccagucugc

SEQ ID NO: 497741 - RNA, 19 nt, Human
uccacuuuuccacuucuca

SEQ ID NO: 497742 - RNA, 19 nt, Human
uccacuuuuuccacucuua

SEQ ID NO: 497743 - RNA, 23 nt, Human
uccagaaaaaauaucuuucagga

SEQ ID NO: 497744 - RNA, 32 nt, Human
uccagaaaaaggagguuggggcaccaaaacca

SEQ ID NO: 497745 - RNA, 22 nt, Human
uccagaaaacagggcuaacuua

SEQ ID NO: 497746 - RNA, 24 nt, Human
uccagaaaacuccuggaagacccg

SEQ ID NO: 497747 - RNA, 25 nt, Human
uccagaaaagaggcuaggagaggcc

SEQ ID NO: 497748 - RNA, 21 nt, Human
uccagaaaaggggcugggaug

SEQ ID NO: 497749 - RNA, 32 nt, Human
uccagaaaaggguggcugcagauggagcagcu

SEQ ID NO: 497750 - RNA, 32 nt, Human
uccagaaacagcuuggccagcuuugugaaccu

SEQ ID NO: 497751 - RNA, 22 nt, Human
uccagaaacauggcagagcaga

SEQ ID NO: 497752 - RNA, 25 nt, Human
uccagaaagagugaccugguguccc

SEQ ID NO: 497753 - RNA, 23 nt, Human
uccagaaagaucugcucugcugc

SEQ ID NO: 497754 - RNA, 18 nt, Human
uccagaaagcaccaagga

SEQ ID NO: 497755 - RNA, 32 nt, Human
uccagaaagcagagaagauaccagaggaggga

SEQ ID NO: 497756 - RNA, 25 nt, Human
uccagaaagccagcucucuucugaa

SEQ ID NO: 497757 - RNA, 32 nt, Human
uccagaaagcugagguuucuccaggucugacc

SEQ ID NO: 497758 - RNA, 32 nt, Human
uccagaaaggguugcuagccuuaacuucagcu

SEQ ID NO: 497759 - RNA, 20 nt, Human
uccagaaagucacacucuca

SEQ ID NO: 497760 - RNA, 32 nt, Human
uccagaaaucauacugcauacaugcuacaaaa

SEQ ID NO: 497761 - RNA, 32 nt, Human
uccagaaaugagcacaucagaggcucuggggu

SEQ ID NO: 497762 - RNA, 32 nt, Human
uccagaacacaaaucagagggaaagggggugu

SEQ ID NO: 497763 - RNA, 32 nt, Human
uccagaacagaagaaagaugaaagccagaaga

SEQ ID NO: 497764 - RNA, 32 nt, Human
uccagaaccaacugcauugguuuuccaugacc

SEQ ID NO: 497765 - RNA, 32 nt, Human
uccagaaccauccccuuuuuccauuuuuauau

SEQ ID NO: 497766 - RNA, 32 nt, Human
uccagaacccagccuccuggguuuccccaguc

SEQ ID NO: 497767 - RNA, 32 nt, Human
uccagaaccucagcagaucugagccaccgccu

SEQ ID NO: 497768 - RNA, 18 nt, Human
uccagaacuccacuguca

SEQ ID NO: 497769 - RNA, 24 nt, Human
uccagaagaaugaaggucuagaga

SEQ ID NO: 497770 - RNA, 32 nt, Human
uccagaagagaagaaagacauggcugacagug

SEQ ID NO: 497771 - RNA, 32 nt, Human
uccagaagagaugggaaaaggucaucaaaggg

SEQ ID NO: 497772 - RNA, 18 nt, Human
uccagaagagccccugcc

SEQ ID NO: 497773 - RNA, 20 nt, Human
uccagaagaguggaaaugcc

SEQ ID NO: 497774 - RNA, 32 nt, Human
uccagaagaugccagcuucucucuccagggug

SEQ ID NO: 497775 - RNA, 20 nt, Human
uccagaagaugugagaagcc

SEQ ID NO: 497776 - RNA, 32 nt, Human
uccagaagccccgcggaacagagagcccugcu

SEQ ID NO: 497777 - RNA, 32 nt, Human
uccagaagccccgucuaaccaaccuauucaga

SEQ ID NO: 497778 - RNA, 18 nt, Human
uccagaagccuaauccau

SEQ ID NO: 497779 - RNA, 32 nt, Human
uccagaagccuccuguuggccuuggaauaugg

SEQ ID NO: 497780 - RNA, 32 nt, Human
uccagaagcucccagaugugugcaccugugga

SEQ ID NO: 497781 - RNA, 32 nt, Human
uccagaagcugaacuccagcccuaagagcccc

SEQ ID NO: 497782 - RNA, 32 nt, Human
uccagaagcugaggcuggagaaucacuugaac

SEQ ID NO: 497783 - RNA, 19 nt, Human
uccagaaggaccauucuca

SEQ ID NO: 497784 - RNA, 32 nt, Human
uccagaaggcaaauacuuuuguaucagaggaa

SEQ ID NO: 497785 - RNA, 21 nt, Human
uccagaaggcggagguugcag

SEQ ID NO: 497786 - RNA, 32 nt, Human
uccagaaggcggagguugcagugagcugagau

SEQ ID NO: 497787 - RNA, 21 nt, Human
uccagaagggacagugaugcc

SEQ ID NO: 497788 - RNA, 19 nt, Human
uccagaagggagaauccgu

SEQ ID NO: 497789 - RNA, 21 nt, Human
uccagaagucagagccaacuc

SEQ ID NO: 497790 - RNA, 32 nt, Human
uccagaagugcgggguaggggaagaagagcua

SEQ ID NO: 497791 - RNA, 23 nt, Human
uccagaaguggccuagaaaugcc

SEQ ID NO: 497792 - RNA, 32 nt, Human
uccagaaucacugcuaaguucuugucaacaag

SEQ ID NO: 497793 - RNA, 32 nt, Human
uccagaauccugcuuaagguuuuaggguaccu

SEQ ID NO: 497794 - RNA, 32 nt, Human
uccagaaucgcaaucccuucuccccacagcca

SEQ ID NO: 497795 - RNA, 32 nt, Human
uccagaauggcaguagcuuuagcaagcagaug

SEQ ID NO: 497796 - RNA, 32 nt, Human
uccagaauggccaccaggcuucccagaguucu

SEQ ID NO: 497797 - RNA, 32 nt, Human
uccagaaugguauggaaucugagggaagauuu

SEQ ID NO: 497798 - RNA, 24 nt, Human
uccagaauguaccguucaucgccg

SEQ ID NO: 497799 - RNA, 32 nt, Human
uccagaauuaacaagaaagccaucucuuccuc

SEQ ID NO: 497800 - RNA, 20 nt, Human
uccagaauuuucaccuggua

SEQ ID NO: 497801 - RNA, 32 nt, Human
uccagacaagggcaagaguuagccagaugcuc

SEQ ID NO: 497802 - RNA, 32 nt, Human
uccagacaaugccagcauaaauccauccaucc

SEQ ID NO: 497803 - RNA, 32 nt, Human
uccagacacaaguugucauuuagaugaagcuu

SEQ ID NO: 497804 - RNA, 32 nt, Human
uccagacacacgugcacaggcgcagauaugcu

SEQ ID NO: 497805 - RNA, 32 nt, Human
uccagacacuauacuuccaacugcccuuucuu

SEQ ID NO: 497806 - RNA, 32 nt, Human
uccagacacugcgcccuccacccucacucugc

SEQ ID NO: 497807 - RNA, 32 nt, Human
uccagacaggguggggcuuagaauggggcuuc

SEQ ID NO: 497808 - RNA, 32 nt, Human
uccagacauuuacucuuaaucacugcauuaau

SEQ ID NO: 497809 - RNA, 32 nt, Human
uccagaccaaccuggccaacaugguaaaaccc

SEQ ID NO: 497810 - RNA, 32 nt, Human
uccagaccacccuggccaacauggugaaaccc

SEQ ID NO: 497811 - RNA, 32 nt, Human
uccagaccagccugaccaaaauggugaaaccu

SEQ ID NO: 497812 - RNA, 32 nt, Human
uccagaccagccugaccaacguggugaaacuc

SEQ ID NO: 497813 - RNA, 32 nt, Human
uccagaccagccuggccaacauagugaaaccc

SEQ ID NO: 497814 - RNA, 32 nt, Human
uccagaccagccuggccaacaugaugaaaccc

SEQ ID NO: 497815 - RNA, 32 nt, Human
uccagaccagccuggccaacauggcaaaaccc

SEQ ID NO: 497816 - RNA, 32 nt, Human
uccagaccagccuggccaacauggcgaaaccc

SEQ ID NO: 497817 - RNA, 32 nt, Human
uccagaccagccuggccaacauggcuuucuuc

SEQ ID NO: 497818 - RNA, 32 nt, Human
uccagaccagccuggccaacauggugaaaccc

SEQ ID NO: 497819 - RNA, 32 nt, Human
uccagaccagccuggccaacauggugaaaccu

SEQ ID NO: 497820 - RNA, 32 nt, Human
uccagaccagccuggccaacauggugaaacuc

SEQ ID NO: 497821 - RNA, 32 nt, Human
uccagaccagccuggccaccuuagugagaucc

SEQ ID NO: 497822 - RNA, 32 nt, Human
uccagaccagccuggccaucauggugaaaucc

SEQ ID NO: 497823 - RNA, 32 nt, Human
uccagaccagccuggcuaauauggugaaaccu

SEQ ID NO: 497824 - RNA, 32 nt, Human
uccagaccagccugggcaacauagugagacuc

SEQ ID NO: 497825 - RNA, 32 nt, Human
uccagaccagccugggcaacauagugagaucc

SEQ ID NO: 497826 - RNA, 32 nt, Human
uccagaccagccugggcagcaucgugagaccc

SEQ ID NO: 497827 - RNA, 32 nt, Human
uccagaccagccuggucaacauggugaaaccc

SEQ ID NO: 497828 - RNA, 32 nt, Human
uccagaccagccuguucaacauggcgaaaccc

SEQ ID NO: 497829 - RNA, 32 nt, Human
uccagaccaggcauugcccagccugggaaucu

SEQ ID NO: 497830 - RNA, 32 nt, Human
uccagaccaggcugggucacaugacaaagccc

SEQ ID NO: 497831 - RNA, 32 nt, Human
uccagaccauccuggccaacauggugaaaucg

SEQ ID NO: 497832 - RNA, 32 nt, Human
uccagaccauccuggcuaacacggugaaaccc

SEQ ID NO: 497833 - RNA, 32 nt, Human
uccagaccaucuuggcuaacagggugaaaccc

SEQ ID NO: 497834 - RNA, 32 nt, Human
uccagacccaggaagccugaggggaaggaagg

SEQ ID NO: 497835 - RNA, 32 nt, Human
uccagaccccaagagaggguucuuggaucucg

SEQ ID NO: 497836 - RNA, 16 nt, Human
uccagacccgccgcug

SEQ ID NO: 497837 - RNA, 18 nt, Human
uccagacccgcugcuguc

SEQ ID NO: 497838 - RNA, 23 nt, Human
uccagacccugcugaacgagcua

SEQ ID NO: 497839 - RNA, 19 nt, Human
uccagacccugugcucuua

SEQ ID NO: 497840 - RNA, 24 nt, Human
uccagaccgagggcucugcugcuu

SEQ ID NO: 497841 - RNA, 32 nt, Human
uccagaccgcagcugcaaaugcagcuucaacu

SEQ ID NO: 497842 - RNA, 32 nt, Human
uccagaccguccuggcuaacauggugaaaccc

SEQ ID NO: 497843 - RNA, 32 nt, Human
uccagaccuaccucggaccaaauguucucuac

SEQ ID NO: 497844 - RNA, 32 nt, Human
uccagaccucaagugaucugcccgccucggcc

SEQ ID NO: 497845 - RNA, 24 nt, Human
uccagaccucaggugauccacccg

SEQ ID NO: 497846 - RNA, 24 nt, Human
uccagaccucaggugauccgccca

SEQ ID NO: 497847 - RNA, 24 nt, Human
uccagaccucaggugaucuaccca

SEQ ID NO: 497848 - RNA, 32 nt, Human
uccagaccucaugauuuacccaccucggccuc

SEQ ID NO: 497849 - RNA, 21 nt, Human
uccagaccucgcguccucucg

SEQ ID NO: 497850 - RNA, 18 nt, Human
uccagaccucgguucuua

SEQ ID NO: 497851 - RNA, 32 nt, Human
uccagaccuuggcaaauguuaucuguggggga

SEQ ID NO: 497852 - RNA, 19 nt, Human
uccagacgcucccagggcc

SEQ ID NO: 497853 - RNA, 32 nt, Human
uccagacuaaggcuucuaaccaggcuggagcc

SEQ ID NO: 497854 - RNA, 32 nt, Human
uccagacuagaagaaagugaggcagcucaccu

SEQ ID NO: 497855 - RNA, 32 nt, Human
uccagacucuccccucucccacccuucuaccc

SEQ ID NO: 497856 - RNA, 22 nt, Human
uccagacuggacaacagagcaa

SEQ ID NO: 497857 - RNA, 18 nt, Human
uccagacuggcacuuuca

SEQ ID NO: 497858 - RNA, 32 nt, Human
uccagacugggcgacagagcaagacucugucu

SEQ ID NO: 497859 - RNA, 32 nt, Human
uccagacugggcgcgaccacuaacccgguuaa

SEQ ID NO: 497860 - RNA, 32 nt, Human
uccagacugggggagagagcaagacucugucu

SEQ ID NO: 497861 - RNA, 24 nt, Human
uccagacugggugacacagcgaga

SEQ ID NO: 497862 - RNA, 32 nt, Human
uccagacugggugacacagcgagacuucaucu

SEQ ID NO: 497863 - RNA, 32 nt, Human
uccagacugggugacagagugagacuccaucu

SEQ ID NO: 497864 - RNA, 32 nt, Human
uccagacuggucucaaacuccugggcucaagc

SEQ ID NO: 497865 - RNA, 24 nt, Human
uccagacugugcgacagagcgaga

SEQ ID NO: 497866 - RNA, 32 nt, Human
uccagacuucacacaguauucucccccacgcc

SEQ ID NO: 497867 - RNA, 32 nt, Human
uccagacuuccucugcuggucuggccugguga

SEQ ID NO: 497868 - RNA, 32 nt, Human
uccagacuugcaaauccaguguggaccugaug

SEQ ID NO: 497869 - RNA, 32 nt, Human
uccagacuugccugugagugccccuugaugga

SEQ ID NO: 497870 - RNA, 32 nt, Human
uccagacuuggugacagagcaagacuccaucu

SEQ ID NO: 497871 - RNA, 32 nt, Human
uccagacuuuguccaacauuuauuccuauggc

SEQ ID NO: 497872 - RNA, 32 nt, Human
uccagagaaaagccacuuuaaaaacagcugaa

SEQ ID NO: 497873 - RNA, 32 nt, Human
uccagagaaggugggagcggagaguuugaagu

SEQ ID NO: 497874 - RNA, 32 nt, Human
uccagagacacuccugaaauuguccuaaguca

SEQ ID NO: 497875 - RNA, 32 nt, Human
uccagagacaguggccuugcucugguugucca

SEQ ID NO: 497876 - RNA, 32 nt, Human
uccagagaccccagcaccuggcccaggaugca

SEQ ID NO: 497877 - RNA, 32 nt, Human
uccagagagaagcagcagagagaggcgcugga

SEQ ID NO: 497878 - RNA, 32 nt, Human
uccagagagaguuggcugccacagccucugcc

SEQ ID NO: 497879 - RNA, 32 nt, Human
uccagagagcagcucccuuucucaggagcuug

SEQ ID NO: 497880 - RNA, 32 nt, Human
uccagagagcagugggagacgcuggcagcagg

SEQ ID NO: 497881 - RNA, 18 nt, Human
uccagagagcccagggcc

SEQ ID NO: 497882 - RNA, 32 nt, Human
uccagagagcugccuuccacaagaccagcaga

SEQ ID NO: 497883 - RNA, 22 nt, Human
uccagagaggcccuucuuugga

SEQ ID NO: 497884 - RNA, 32 nt, Human
uccagagaggcuggaugacuugcucaaguuca

SEQ ID NO: 497885 - RNA, 32 nt, Human
uccagagagggcauggaggcuccauacaaccu

SEQ ID NO: 497886 - RNA, 27 nt, Human
uccagagaguggaccuugacucuucca

SEQ ID NO: 497887 - RNA, 32 nt, Human
uccagagaugaagauuuaugaagucagugaag

SEQ ID NO: 497888 - RNA, 32 nt, Human
uccagagauggaaacucacuccccuacaaaag

SEQ ID NO: 497889 - RNA, 22 nt, Human
uccagagauuuuaccagagguu

SEQ ID NO: 497890 - RNA, 32 nt, Human
uccagagcaaaccgcccagaguagaagaugga

SEQ ID NO: 497891 - RNA, 32 nt, Human
uccagagcaaggcccagcugggcagaggguga

SEQ ID NO: 497892 - RNA, 32 nt, Human
uccagagcacugagcagagaggcuggugauga

SEQ ID NO: 497893 - RNA, 32 nt, Human
uccagagcagccuguggccuguaaagcauaua

SEQ ID NO: 497894 - RNA, 31 nt, Human
uccagagcaggacuggagcuuugugcucagc

SEQ ID NO: 497895 - RNA, 32 nt, Human
uccagagcauuaauuguaucacuguguauggu

SEQ ID NO: 497896 - RNA, 32 nt, Human
uccagagcauugacuuccucuuccuagacuug

SEQ ID NO: 497897 - RNA, 32 nt, Human
uccagagcauuuugcauacaucuuuaggguua

SEQ ID NO: 497898 - RNA, 32 nt, Human
uccagagccaggagaguuggaccauugagggc

SEQ ID NO: 497899 - RNA, 32 nt, Human
uccagagccaugggagcggaaaggaggcugcu

SEQ ID NO: 497900 - RNA, 22 nt, Human
uccagagcccagcguucaguua

SEQ ID NO: 497901 - RNA, 32 nt, Human
uccagagccugcucugaauuugacuuuggcau

SEQ ID NO: 497902 - RNA, 32 nt, Human
uccagagccugggaugggcuuuucccuguggg

SEQ ID NO: 497903 - RNA, 26 nt, Human
uccagagccugggcgacagagcgaga

SEQ ID NO: 497904 - RNA, 26 nt, Human
uccagagccugggugacagagcaaga

SEQ ID NO: 497905 - RNA, 19 nt, Human
uccagagccuucgcuccca

SEQ ID NO: 497906 - RNA, 32 nt, Human
uccagagcucacugcccuucuagaugugccuu

SEQ ID NO: 497907 - RNA, 26 nt, Human
uccagagcugcaaguuuuaaaguguu

SEQ ID NO: 497908 - RNA, 21 nt, Human
uccagagcuggagugcagcgg

SEQ ID NO: 497909 - RNA, 32 nt, Human
uccagagcuguggguagaggacaucgccucac

SEQ ID NO: 497910 - RNA, 32 nt, Human
uccagagcuucaaaggcaacacaagcucgcaa

SEQ ID NO: 497911 - RNA, 32 nt, Human
uccagagcuuggagguuccagguccagaucca

SEQ ID NO: 497912 - RNA, 32 nt, Human
uccagaggaaaaacagaggaugcugaaguaca

SEQ ID NO: 497913 - RNA, 32 nt, Human
uccagaggaagaggaggaggcggcgaagcguu

SEQ ID NO: 497914 - RNA, 32 nt, Human
uccagaggaagcaaggaggagggagguggggu

SEQ ID NO: 497915 - RNA, 32 nt, Human
uccagaggaauguuuugcuauguagggaaauu

SEQ ID NO: 497916 - RNA, 32 nt, Human
uccagaggaccaagaaauaccugugugacaca

SEQ ID NO: 497917 - RNA, 32 nt, Human
uccagaggagccccucuuggacugccuggguu

SEQ ID NO: 497918 - RNA, 32 nt, Human
uccagaggagcguuucccaagacacuggcugc

SEQ ID NO: 497919 - RNA, 32 nt, Human
uccagaggcaacaggugucuuccggucccagg

SEQ ID NO: 497920 - RNA, 32 nt, Human
uccagaggcaagcacaauauuacagaggaacu

SEQ ID NO: 497921 - RNA, 32 nt, Human
uccagaggcaggcagaggaaauauugucagag

SEQ ID NO: 497922 - RNA, 25 nt, Human
uccagaggcccugagcagcuuucag

SEQ ID NO: 497923 - RNA, 32 nt, Human
uccagaggccuggaagggagguggagguccag

SEQ ID NO: 497924 - RNA, 20 nt, Human
uccagaggcggagguugcag

SEQ ID NO: 497925 - RNA, 32 nt, Human
uccagaggcuaagaaauuucuguuaguaaaag

SEQ ID NO: 497926 - RNA, 32 nt, Human
uccagaggcuaaggcaggagaauugcuugaac

SEQ ID NO: 497927 - RNA, 21 nt, Human
uccagaggcuauguucaguug

SEQ ID NO: 497928 - RNA, 32 nt, Human
uccagaggcucuagaggagaaucuuuccuugc

SEQ ID NO: 497929 - RNA, 32 nt, Human
uccagaggcugaaaugggaggaucucuugagc

SEQ ID NO: 497930 - RNA, 32 nt, Human
uccagaggcugaggcaggagaaucacuugaac

SEQ ID NO: 497931 - RNA, 32 nt, Human
uccagaggcugaggcaggagaaucgcuugaac

SEQ ID NO: 497932 - RNA, 32 nt, Human
uccagaggcugaggcaggagaauggcuugaac

SEQ ID NO: 497933 - RNA, 32 nt, Human
uccagaggcugcacccagaacagugggacaug

SEQ ID NO: 497934 - RNA, 32 nt, Human
uccagagggcaccugccugcaggaugggccgg

SEQ ID NO: 497935 - RNA, 21 nt, Human
uccagaggggccgauuaggga

SEQ ID NO: 497936 - RNA, 32 nt, Human
uccagaggggugcuggugggcucugcagggcc

SEQ ID NO: 497937 - RNA, 23 nt, Human
uccagaggguggacggagcgggg

SEQ ID NO: 497938 - RNA, 32 nt, Human
uccagaggucgcccagcuccggcgcugacggg

SEQ ID NO: 497939 - RNA, 32 nt, Human
uccagaggugucgaaauguccuggggaccuga

SEQ ID NO: 497940 - RNA, 32 nt, Human
uccagagucaucucagcccugccuuucucugg

SEQ ID NO: 497941 - RNA, 32 nt, Human
uccagagucucuuuuuacacuucaccuccuuc

SEQ ID NO: 497942 - RNA, 32 nt, Human
uccagagugaagauaguccaaguccuaagaga

SEQ ID NO: 497943 - RNA, 32 nt, Human
uccagagugcaggagccaagugcucggggacc

SEQ ID NO: 497944 - RNA, 24 nt, Human
uccagagugggaaacagagcaaga

SEQ ID NO: 497945 - RNA, 32 nt, Human
uccagaguuguaucucugaugccugugcccau

SEQ ID NO: 497946 - RNA, 17 nt, Human
uccagaguuuccucuca

SEQ ID NO: 497947 - RNA, 32 nt, Human
uccagauaaacccaccuaagugaaauggccau

SEQ ID NO: 497948 - RNA, 32 nt, Human
uccagauaaccaguuuucacaucugagacauu

SEQ ID NO: 497949 - RNA, 24 nt, Human
uccagauaacuccauccugucgag

SEQ ID NO: 497950 - RNA, 19 nt, Human
uccagauaagagagcugaa

SEQ ID NO: 497951 - RNA, 32 nt, Human
uccagaucaacaaaagugucuuucaaagaaaa

SEQ ID NO: 497952 - RNA, 32 nt, Human
uccagaucaaugaggaccagacugccuauucg

SEQ ID NO: 497953 - RNA, 32 nt, Human
uccagaucacacacaugcacacacacauaugc

SEQ ID NO: 497954 - RNA, 23 nt, Human
uccagaucagaaaccugcugcuc

SEQ ID NO: 497955 - RNA, 32 nt, Human
uccagaucagcaugggcaacaugguaagaccu

SEQ ID NO: 497956 - RNA, 32 nt, Human
uccagaucagccuggccaacauggugaaaccc

SEQ ID NO: 497957 - RNA, 32 nt, Human
uccagaucagcuguuuugccuguugcucaguu

SEQ ID NO: 497958 - RNA, 18 nt, Human
uccagaucauaucccucu

SEQ ID NO: 497959 - RNA, 32 nt, Human
uccagaucauuagcuucuuaaaaaucccagcu

SEQ ID NO: 497960 - RNA, 32 nt, Human
uccagaucccacacuccuuccucggcacuucc

SEQ ID NO: 497961 - RNA, 18 nt, Human
uccagaucccaguauuca

SEQ ID NO: 497962 - RNA, 18 nt, Human
uccagaucccuaccccuc

SEQ ID NO: 497963 - RNA, 18 nt, Human
uccagaucccucacauca

SEQ ID NO: 497964 - RNA, 20 nt, Human
uccagaucccuccuccuccc

SEQ ID NO: 497965 - RNA, 32 nt, Human
uccagaucccugcagccugccacuaccccgag

SEQ ID NO: 497966 - RNA, 32 nt, Human
uccagauccuuuacuacugaacucacagggcu

SEQ ID NO: 497967 - RNA, 18 nt, Human
uccagauccuuuauuuca

SEQ ID NO: 497968 - RNA, 18 nt, Human
uccagaucgcucacauca

SEQ ID NO: 497969 - RNA, 18 nt, Human
uccagaucgcuuccucuc

SEQ ID NO: 497970 - RNA, 32 nt, Human
uccagaucgguuugaugaugaauuaguaauga

SEQ ID NO: 497971 - RNA, 18 nt, Human
uccagaucuccagggcuc

SEQ ID NO: 497972 - RNA, 16 nt, Human
uccagaucuccaucca

SEQ ID NO: 497973 - RNA, 20 nt, Human
uccagaucuggggucucuua

SEQ ID NO: 497974 - RNA, 20 nt, Human
uccagaucuguuugcucuua

SEQ ID NO: 497975 - RNA, 18 nt, Human
uccagaucuucauugcca

SEQ ID NO: 497976 - RNA, 32 nt, Human
uccagaugacucuccugcuccuucggggaaag

SEQ ID NO: 497977 - RNA, 23 nt, Human
uccagaugauagaggcuaacuca

SEQ ID NO: 497978 - RNA, 30 nt, Human
uccagaugccuggacccagaguguggggga

SEQ ID NO: 497979 - RNA, 32 nt, Human
uccagaugcgagccaccgcaccagucccccaa

SEQ ID NO: 497980 - RNA, 32 nt, Human
uccagaugcugaggcaggagaauggcaugaac

SEQ ID NO: 497981 - RNA, 19 nt, Human
uccagaugcuguuaccuca

SEQ ID NO: 497982 - RNA, 32 nt, Human
uccagauggagguggaggguugauuugggaag

SEQ ID NO: 497983 - RNA, 32 nt, Human
uccagauggaguuucgcucuugucccccaggc

SEQ ID NO: 497984 - RNA, 18 nt, Human
uccagauggcccacucuc

SEQ ID NO: 497985 - RNA, 21 nt, Human
uccagauggcugggagaugcc

SEQ ID NO: 497986 - RNA, 32 nt, Human
uccagauggguuuuguuaggggugggggagaa

SEQ ID NO: 497987 - RNA, 32 nt, Human
uccagauggucuucagaguugucuuuauaugu

SEQ ID NO: 497988 - RNA, 32 nt, Human
uccagaugucccagccuccaucaggccagacc

SEQ ID NO: 497989 - RNA, 32 nt, Human
uccagauguggucaacuucuggaacacucgcu

SEQ ID NO: 497990 - RNA, 32 nt, Human
uccagauguuccgugacaagcauuucaugucu

SEQ ID NO: 497991 - RNA, 18 nt, Human
uccagauuaaccauccca

SEQ ID NO: 497992 - RNA, 18 nt, Human
uccagauucaccacccuc

SEQ ID NO: 497993 - RNA, 32 nt, Human
uccagauucacgacauuccugucccauguaga

SEQ ID NO: 497994 - RNA, 32 nt, Human
uccagauucccuucaagcaucucccucauccu

SEQ ID NO: 497995 - RNA, 32 nt, Human
uccagauuccugugguucaucccaaggaaauu

SEQ ID NO: 497996 - RNA, 32 nt, Human
uccagauucuguguuccucccuucccugcccc

SEQ ID NO: 497997 - RNA, 32 nt, Human
uccagauucuuaagccaacaaaagugccuuca

SEQ ID NO: 497998 - RNA, 18 nt, Human
uccagauucuuagucuca

SEQ ID NO: 497999 - RNA, 32 nt, Human
uccagauugcaaccuggccugcaucccagcuc

SEQ ID NO: 498000 - RNA, 18 nt, Human
uccagauuguagcucuua

SEQ ID NO: 498001 - RNA, 20 nt, Human
uccagauuucaaaaaucuca

SEQ ID NO: 498002 - RNA, 32 nt, Human
uccagauuucauuugauguuguucacauugca

SEQ ID NO: 498003 - RNA, 18 nt, Human
uccagauuugcacuucca

SEQ ID NO: 498004 - RNA, 32 nt, Human
uccagauuugcccccgccuuguuuugaaagcc

SEQ ID NO: 498005 - RNA, 32 nt, Human
uccagauuugggcuauuucuguaugauccaau

SEQ ID NO: 498006 - RNA, 32 nt, Human
uccagauuuggguggagccucugugggaacca

SEQ ID NO: 498007 - RNA, 19 nt, Human
uccagauuuuagauucuca

SEQ ID NO: 498008 - RNA, 32 nt, Human
uccagcaaaaggaaucucauguugacuccugg

SEQ ID NO: 498009 - RNA, 32 nt, Human
uccagcaaacggaggacugaacuggggagagu

SEQ ID NO: 498010 - RNA, 32 nt, Human
uccagcaaaggacacagucaacagggugaaaa

SEQ ID NO: 498011 - RNA, 32 nt, Human
uccagcaaaggacaccugcagagaugucccca

SEQ ID NO: 498012 - RNA, 32 nt, Human
uccagcaaauucccgugucuguggucaccauu

SEQ ID NO: 498013 - RNA, 32 nt, Human
uccagcaaccaggaugaucuuguuaaaacauu

SEQ ID NO: 498014 - RNA, 32 nt, Human
uccagcaaccugcacuccagccugggugacag

SEQ ID NO: 498015 - RNA, 19 nt, Human
uccagcaagucucaggcca

SEQ ID NO: 498016 - RNA, 21 nt, Human
uccagcaauagcauccaaggg

SEQ ID NO: 498017 - RNA, 32 nt, Human
uccagcaaugguaaccugcucacuccagaacu

SEQ ID NO: 498018 - RNA, 32 nt, Human
uccagcaauuuccaaaagcuggagcuguguaa

SEQ ID NO: 498019 - RNA, 32 nt, Human
uccagcacaauuaugacaauucagagaagcaa

SEQ ID NO: 498020 - RNA, 32 nt, Human
uccagcacacacacauaagcacugaaaucacu

SEQ ID NO: 498021 - RNA, 32 nt, Human
uccagcacacugacucaaagaugugggcagcu

SEQ ID NO: 498022 - RNA, 32 nt, Human
uccagcacagaaggaaucugugcagaugagca

SEQ ID NO: 498023 - RNA, 24 nt, Human
uccagcacaugggcucuggaccac

SEQ ID NO: 498024 - RNA, 22 nt, Human
uccagcaccaccacacccagug

SEQ ID NO: 498025 - RNA, 32 nt, Human
uccagcaccagaaaauuaccucucuuagcccc

SEQ ID NO: 498026 - RNA, 32 nt, Human
uccagcacccaccucccuacucucccucaugg

SEQ ID NO: 498027 - RNA, 27 nt, Human
uccagcacccugggcgacagagugaga

SEQ ID NO: 498028 - RNA, 21 nt, Human
uccagcaccuugcugugcugc

SEQ ID NO: 498029 - RNA, 18 nt, Human
uccagcacuaccauugua

SEQ ID NO: 498030 - RNA, 32 nt, Human
uccagcacugccaucaauaaccugcagccaug

SEQ ID NO: 498031 - RNA, 32 nt, Human
uccagcacugccucucccugugcauuagaccc

SEQ ID NO: 498032 - RNA, 32 nt, Human
uccagcacugggcaggcacagagcaggggcug

SEQ ID NO: 498033 - RNA, 32 nt, Human
uccagcacuugggagcugacugugcuggaggu

SEQ ID NO: 498034 - RNA, 32 nt, Human
uccagcagaacugcuuggauuuuucuaccagg

SEQ ID NO: 498035 - RNA, 22 nt, Human
uccagcagaaggcucuggccca

SEQ ID NO: 498036 - RNA, 32 nt, Human
uccagcagacagcucuucaagggugucuuguu

SEQ ID NO: 498037 - RNA, 23 nt, Human
uccagcagacuacucuggcccca

SEQ ID NO: 498038 - RNA, 30 nt, Human
uccagcagacugugcaugcuccugucccca

SEQ ID NO: 498039 - RNA, 32 nt, Human
uccagcagagcaccucacuccuuugaagagca

SEQ ID NO: 498040 - RNA, 32 nt, Human
uccagcagagcugaucugccucucacacaggu

SEQ ID NO: 498041 - RNA, 26 nt, Human
uccagcagaggaccucccacccaaug

SEQ ID NO: 498042 - RNA, 32 nt, Human
uccagcagaguugguucuuucugaggucugca

SEQ ID NO: 498043 - RNA, 22 nt, Human
uccagcagcaguagccagggcu

SEQ ID NO: 498044 - RNA, 32 nt, Human
uccagcagccaagaggguagugguguaccgga

SEQ ID NO: 498045 - RNA, 32 nt, Human
uccagcagccaagauggugaagcagaucgaga

SEQ ID NO: 498046 - RNA, 32 nt, Human
uccagcagccuagcauccccuaccuccaugcc

SEQ ID NO: 498047 - RNA, 30 nt, Human
uccagcagccucuccuguuccuccugccac

SEQ ID NO: 498048 - RNA, 20 nt, Human
uccagcagccuugggguccc

SEQ ID NO: 498049 - RNA, 32 nt, Human
uccagcagcgaugaugaggacaaggaagaaga

SEQ ID NO: 498050 - RNA, 32 nt, Human
uccagcagcugcuuccuguaaugcaggacucc

SEQ ID NO: 498051 - RNA, 32 nt, Human
uccagcaggagcacagcucagcagggucccug

SEQ ID NO: 498052 - RNA, 23 nt, Human
uccagcaggagccgucuccacca

SEQ ID NO: 498053 - RNA, 32 nt, Human
uccagcaggcagcuggggcugagugaaaacau

SEQ ID NO: 498054 - RNA, 20 nt, Human
uccagcaggcgcgcggccag

SEQ ID NO: 498055 - RNA, 32 nt, Human
uccagcagggcucaugguggucucagagggcg

SEQ ID NO: 498056 - RNA, 21 nt, Human
uccagcaggggagggguggga

SEQ ID NO: 498057 - RNA, 32 nt, Human
uccagcaggggcccugcccaccagaacacagu

SEQ ID NO: 498058 - RNA, 32 nt, Human
uccagcagguaacaguggauacccacaaugca

SEQ ID NO: 498059 - RNA, 32 nt, Human
uccagcagguccuccugcucccagaggugacc

SEQ ID NO: 498060 - RNA, 21 nt, Human
uccagcagguggagguugcag

SEQ ID NO: 498061 - RNA, 24 nt, Human
uccagcagguggagguugcaguga

SEQ ID NO: 498062 - RNA, 32 nt, Human
uccagcagguggagguugcagugagccaagau

SEQ ID NO: 498063 - RNA, 32 nt, Human
uccagcagguuucugcccugacauucucuugu

SEQ ID NO: 498064 - RNA, 32 nt, Human
uccagcagucgccuccucccacccugagcccc

SEQ ID NO: 498065 - RNA, 27 nt, Human
uccagcagucugggcgacagagugaga

SEQ ID NO: 498066 - RNA, 32 nt, Human
uccagcagugauguggagaauucuuuuaaugg

SEQ ID NO: 498067 - RNA, 21 nt, Human
uccagcaucagucacauguaa

SEQ ID NO: 498068 - RNA, 25 nt, Human
uccagcauccgagcuggcgaggaaa

SEQ ID NO: 498069 - RNA, 30 nt, Human
uccagcauccucuccagcucccguagaguc

SEQ ID NO: 498070 - RNA, 31 nt, Human
uccagcauccucucugugggcuguucaccaa

SEQ ID NO: 498071 - RNA, 32 nt, Human
uccagcaucucuccguagccugggugaagucc

SEQ ID NO: 498072 - RNA, 32 nt, Human
uccagcaugaacagacugguccuugcugcuuu

SEQ ID NO: 498073 - RNA, 32 nt, Human
uccagcaugccuggcugauuuuuguauuuuua

SEQ ID NO: 498074 - RNA, 32 nt, Human
uccagcaugcuuguauguauauuucagaaccu

SEQ ID NO: 498075 - RNA, 32 nt, Human
uccagcaugggcaacauaacaagaccccaucc

SEQ ID NO: 498076 - RNA, 32 nt, Human
uccagcaugggugacagagugagauccugucu

SEQ ID NO: 498077 - RNA, 24 nt, Human
uccagcaugggugauggagagaga

SEQ ID NO: 498078 - RNA, 31 nt, Human
uccagcauggguuucagcacagcagacggcg

SEQ ID NO: 498079 - RNA, 31 nt, Human
uccagcauggugcucgcggccccgcugcugc

SEQ ID NO: 498080 - RNA, 32 nt, Human
uccagcauucucgugugaacugcagaggagcc

SEQ ID NO: 498081 - RNA, 32 nt, Human
uccagcauuggaacuucugaucuucaagcagg

SEQ ID NO: 498082 - RNA, 32 nt, Human
uccagcauuuuuccuucaagguucauccaugu

SEQ ID NO: 498083 - RNA, 32 nt, Human
uccagccaaaaccaaagauuucuuaaugauug

SEQ ID NO: 498084 - RNA, 32 nt, Human
uccagccaacugucucuccacccuuccagaau

SEQ ID NO: 498085 - RNA, 32 nt, Human
uccagccaagcccaggcaucaggaggcuguua

SEQ ID NO: 498086 - RNA, 32 nt, Human
uccagccaagccccagcauccaaggaccggca

SEQ ID NO: 498087 - RNA, 32 nt, Human
uccagccacaccaccucugccuuccaucugac

SEQ ID NO: 498088 - RNA, 32 nt, Human
uccagccacagcacuccagccugggugacaga

SEQ ID NO: 498089 - RNA, 25 nt, Human
uccagccaccccugucccaacccca

SEQ ID NO: 498090 - RNA, 32 nt, Human
uccagccaccuucuccauauccaucuuuuauu

SEQ ID NO: 498091 - RNA, 22 nt, Human
uccagccacugcccuggccuca

SEQ ID NO: 498092 - RNA, 32 nt, Human
uccagccacuggcugcuaacaagucaccaaaa

SEQ ID NO: 498093 - RNA, 32 nt, Human
uccagccagaacugacagcccagaccccauac

SEQ ID NO: 498094 - RNA, 24 nt, Human
uccagccagagugacagagcaaga

SEQ ID NO: 498095 - RNA, 32 nt, Human
uccagccagagugacagagcaagacuccaucu

SEQ ID NO: 498096 - RNA, 32 nt, Human
uccagccagccaaauccauccugcucuuccau

SEQ ID NO: 498097 - RNA, 32 nt, Human
uccagccagcccccaaacaagauuccucucca

SEQ ID NO: 498098 - RNA, 21 nt, Human
uccagccagcguccgccgccg

SEQ ID NO: 498099 - RNA, 20 nt, Human
uccagccaggagucugcacu

SEQ ID NO: 498100 - RNA, 21 nt, Human
uccagccaggauccacaugga

SEQ ID NO: 498101 - RNA, 24 nt, Human
uccagccaggaugacagagcaaga

SEQ ID NO: 498102 - RNA, 32 nt, Human
uccagccaggaugacagagcaagacugcaucu

SEQ ID NO: 498103 - RNA, 32 nt, Human
uccagccaggcugcagggagugaggcacacgg

SEQ ID NO: 498104 - RNA, 24 nt, Human
uccagccagggcaacagagugaga

SEQ ID NO: 498105 - RNA, 23 nt, Human
uccagccaggggauagagcgaga

SEQ ID NO: 498106 - RNA, 22 nt, Human
uccagccagggggauggguccc

SEQ ID NO: 498107 - RNA, 23 nt, Human
uccagccagggguggggaugggg

SEQ ID NO: 498108 - RNA, 24 nt, Human
uccagccagggugacagagugaga

SEQ ID NO: 498109 - RNA, 32 nt, Human
uccagccagguugacagaaugagacccugucu

SEQ ID NO: 498110 - RNA, 25 nt, Human
uccagccaguggaguccuggcucca

SEQ ID NO: 498111 - RNA, 21 nt, Human
uccagccauccucucaccuca

SEQ ID NO: 498112 - RNA, 23 nt, Human
uccagccaugacuccuguacagc

SEQ ID NO: 498113 - RNA, 32 nt, Human
uccagccaugacugcaaacccgggcaucuuug

SEQ ID NO: 498114 - RNA, 32 nt, Human
uccagccauugcuccccucucccugccacccu

SEQ ID NO: 498115 - RNA, 32 nt, Human
uccagccauugcugcuuugugcucugagcagg

SEQ ID NO: 498116 - RNA, 32 nt, Human
uccagcccaaagauaaauuuuguuuguccagu

SEQ ID NO: 498117 - RNA, 32 nt, Human
uccagcccaacagaaggaaggaggagggcgcc

SEQ ID NO: 498118 - RNA, 32 nt, Human
uccagcccacagccugggucucagggaucuug

SEQ ID NO: 498119 - RNA, 32 nt, Human
uccagcccacugccacugggugacacagacug

SEQ ID NO: 498120 - RNA, 32 nt, Human
uccagcccagcacucuucaugcucauucauuu

SEQ ID NO: 498121 - RNA, 32 nt, Human
uccagcccaggacuucgaggcugcaaugagcu

SEQ ID NO: 498122 - RNA, 32 nt, Human
uccagcccaggaguucaagaccagccugggca

SEQ ID NO: 498123 - RNA, 24 nt, Human
uccagcccaggcaacagagcguga

SEQ ID NO: 498124 - RNA, 32 nt, Human
uccagcccaggcaacagagcgugacuccgucu

SEQ ID NO: 498125 - RNA, 32 nt, Human
uccagcccaggcaacagaguaagacucagucu

SEQ ID NO: 498126 - RNA, 24 nt, Human
uccagcccaggcaacagagugaga

SEQ ID NO: 498127 - RNA, 32 nt, Human
uccagcccaggcaacagagugagacuccgucu

SEQ ID NO: 498128 - RNA, 24 nt, Human
uccagcccaggcaauagaguaaga

SEQ ID NO: 498129 - RNA, 24 nt, Human
uccagcccagguaacagagugaga

SEQ ID NO: 498130 - RNA, 32 nt, Human
uccagcccaggugacagagcaagacuccaucu

SEQ ID NO: 498131 - RNA, 24 nt, Human
uccagcccaggugacagagcgaga

SEQ ID NO: 498132 - RNA, 32 nt, Human
uccagcccaggugacagagcgagacuccaucu

SEQ ID NO: 498133 - RNA, 24 nt, Human
uccagcccaggugacagagggaga

SEQ ID NO: 498134 - RNA, 24 nt, Human
uccagcccaggugacagagugaga

SEQ ID NO: 498135 - RNA, 32 nt, Human
uccagcccauccuggccaacauggugaaaccc

SEQ ID NO: 498136 - RNA, 32 nt, Human
uccagccccaacaaaggguucucuuuguaucu

SEQ ID NO: 498137 - RNA, 32 nt, Human
uccagccccacucauccucucggauguucugc

SEQ ID NO: 498138 - RNA, 32 nt, Human
uccagccccagacaacagcccaggcaucuccu

SEQ ID NO: 498139 - RNA, 27 nt, Human
uccagccccagacccgccggggucccu

SEQ ID NO: 498140 - RNA, 32 nt, Human
uccagccccaggacaggaaacagaacugccug

SEQ ID NO: 498141 - RNA, 32 nt, Human
uccagccccaggcuguggugaggggccucaca

SEQ ID NO: 498142 - RNA, 32 nt, Human
uccagcccccaccccaccuccugggacccuca

SEQ ID NO: 498143 - RNA, 32 nt, Human
uccagcccccagcaaccaccaaucugcuuucu

SEQ ID NO: 498144 - RNA, 22 nt, Human
uccagcccccaggaagccugcu

SEQ ID NO: 498145 - RNA, 24 nt, Human
uccagccccccaagccuggccuca

SEQ ID NO: 498146 - RNA, 21 nt, Human
uccagccccccucucuggccc

SEQ ID NO: 498147 - RNA, 32 nt, Human
uccagcccccuugagcugggaacucaggcucc

SEQ ID NO: 498148 - RNA, 20 nt, Human
uccagcccccuugucuugga

SEQ ID NO: 498149 - RNA, 24 nt, Human
uccagccccucacgccuccucuca

SEQ ID NO: 498150 - RNA, 32 nt, Human
uccagccccuccaaccucccucuguccacagg

SEQ ID NO: 498151 - RNA, 32 nt, Human
uccagccccuccaacuucaucgacugcccagc

SEQ ID NO: 498152 - RNA, 32 nt, Human
uccagccccuccaccccuccccuacccccaca

SEQ ID NO: 498153 - RNA, 32 nt, Human
uccagccccucccucuggguucccaaguugaa

SEQ ID NO: 498154 - RNA, 24 nt, Human
uccagccccucucacugcccuuca

SEQ ID NO: 498155 - RNA, 21 nt, Human
uccagccccucucuuccuuca

SEQ ID NO: 498156 - RNA, 22 nt, Human
uccagccccucucuugucucca

SEQ ID NO: 498157 - RNA, 32 nt, Human
uccagccccugagaguugcugucucccagugg

SEQ ID NO: 498158 - RNA, 21 nt, Human
uccagccccugauggggcaga

SEQ ID NO: 498159 - RNA, 32 nt, Human
uccagccccugccagaccuccugcuaccgucc

SEQ ID NO: 498160 - RNA, 32 nt, Human
uccagccccugugacauccgccuggauuggga

SEQ ID NO: 498161 - RNA, 24 nt, Human
uccagcccgagugacagaaugagg

SEQ ID NO: 498162 - RNA, 32 nt, Human
uccagcccggaugacagagcaagacucuguau

SEQ ID NO: 498163 - RNA, 32 nt, Human
uccagcccggcacuccagccuggcgacaagag

SEQ ID NO: 498164 - RNA, 21 nt, Human
uccagcccggccuggccgcca

SEQ ID NO: 498165 - RNA, 32 nt, Human
uccagcccggcuucccuucucucugaaauccu

SEQ ID NO: 498166 - RNA, 24 nt, Human
uccagcccgggcgacagagcaaga

SEQ ID NO: 498167 - RNA, 32 nt, Human
uccagcccgggcgacagagcaagacucugugu

SEQ ID NO: 498168 - RNA, 24 nt, Human
uccagcccgggcgacagagcgaga

SEQ ID NO: 498169 - RNA, 32 nt, Human
uccagcccgggcgacagagcgagacuccaucu

SEQ ID NO: 498170 - RNA, 32 nt, Human
uccagcccgggcgacagagcgagacucugucu

SEQ ID NO: 498171 - RNA, 24 nt, Human
uccagcccgggcgacagagugaga

SEQ ID NO: 498172 - RNA, 24 nt, Human
uccagcccgggugacaauacaaga

SEQ ID NO: 498173 - RNA, 24 nt, Human
uccagcccgggugacagagcaaga

SEQ ID NO: 498174 - RNA, 32 nt, Human
uccagcccgggugacagagcaagacuccgucu

SEQ ID NO: 498175 - RNA, 32 nt, Human
uccagcccgggugacagagcaagacugugucu

SEQ ID NO: 498176 - RNA, 24 nt, Human
uccagcccgggugacagagcgaga

SEQ ID NO: 498177 - RNA, 32 nt, Human
uccagcccgggugacagagcgagacucuaucu

SEQ ID NO: 498178 - RNA, 32 nt, Human
uccagcccgggugacagagcgagacucuggcu

SEQ ID NO: 498179 - RNA, 22 nt, Human
uccagcccgggugacagaguga

SEQ ID NO: 498180 - RNA, 32 nt, Human
uccagcccuaaaggaaggguagacccgugucu

SEQ ID NO: 498181 - RNA, 32 nt, Human
uccagcccuagggguacgggagagggaaagac

SEQ ID NO: 498182 - RNA, 32 nt, Human
uccagcccucucacugugucccucucucugga

SEQ ID NO: 498183 - RNA, 32 nt, Human
uccagcccugcagcuauucaccaauaucaguc

SEQ ID NO: 498184 - RNA, 32 nt, Human
uccagcccugcagggagccgcucaagucuggg

SEQ ID NO: 498185 - RNA, 32 nt, Human
uccagcccugcucucccuggucuccaggcagg

SEQ ID NO: 498186 - RNA, 24 nt, Human
uccagcccuggcgacagagugaga

SEQ ID NO: 498187 - RNA, 32 nt, Human
uccagcccugggaaauuuccuuucuccagacu

SEQ ID NO: 498188 - RNA, 23 nt, Human
uccagcccuggugacagaggaga

SEQ ID NO: 498189 - RNA, 32 nt, Human
uccagcccugucucaaccauacuccaaauuag

SEQ ID NO: 498190 - RNA, 32 nt, Human
uccagcccuuaaaucccccagcuuccaaacuu

SEQ ID NO: 498191 - RNA, 32 nt, Human
uccagccgcacucucuacauuaauaguaggca

SEQ ID NO: 498192 - RNA, 20 nt, Human
uccagccgccgccgccgccg

SEQ ID NO: 498193 - RNA, 32 nt, Human
uccagccggggcaacagagcaagacucugccu

SEQ ID NO: 498194 - RNA, 24 nt, Human
uccagccggggugacagagugaga

SEQ ID NO: 498195 - RNA, 32 nt, Human
uccagccggggugacagagugagacuccgacu

SEQ ID NO: 498196 - RNA, 25 nt, Human
uccagccgugguuaggugguccuag

SEQ ID NO: 498197 - RNA, 23 nt, Human
uccagccuaagcaaauagcaaga

SEQ ID NO: 498198 - RNA, 24 nt, Human
uccagccuaagcaacagagcaaga

SEQ ID NO: 498199 - RNA, 24 nt, Human
uccagccuaagcaauagagcgaga

SEQ ID NO: 498200 - RNA, 22 nt, Human
uccagccuacuagcgggcgggg

SEQ ID NO: 498201 - RNA, 24 nt, Human
uccagccuagacaacagggcaagg

SEQ ID NO: 498202 - RNA, 23 nt, Human
uccagccuaggcaacaagagcaa

SEQ ID NO: 498203 - RNA, 23 nt, Human
uccagccuaggcaacaagagcga

SEQ ID NO: 498204 - RNA, 23 nt, Human
uccagccuaggcaacaagaguga

SEQ ID NO: 498205 - RNA, 23 nt, Human
uccagccuaggcaacacgagcaa

SEQ ID NO: 498206 - RNA, 32 nt, Human
uccagccuaggcaacagagacucugucucaaa

SEQ ID NO: 498207 - RNA, 24 nt, Human
uccagccuaggcaacagagcaaga

SEQ ID NO: 498208 - RNA, 24 nt, Human
uccagccuaggcaacagagcgaga

SEQ ID NO: 498209 - RNA, 24 nt, Human
uccagccuaggcaacagagggaga

SEQ ID NO: 498210 - RNA, 20 nt, Human
uccagccuaggcaacagagu

SEQ ID NO: 498211 - RNA, 24 nt, Human
uccagccuaggcaacagagugaga

SEQ ID NO: 498212 - RNA, 21 nt, Human
uccagccuaggcauggugaga

SEQ ID NO: 498213 - RNA, 24 nt, Human
uccagccuaggcgacagagcgaga

SEQ ID NO: 498214 - RNA, 32 nt, Human
uccagccuaggcgacagagcgagacucugucu

SEQ ID NO: 498215 - RNA, 24 nt, Human
uccagccuaggcgacagagugaga

SEQ ID NO: 498216 - RNA, 32 nt, Human
uccagccuaggcgacagagugagacccugucu

SEQ ID NO: 498217 - RNA, 24 nt, Human
uccagccuaggcgacggggcaaga

SEQ ID NO: 498218 - RNA, 25 nt, Human
uccagccuaggguggggaagugagg

SEQ ID NO: 498219 - RNA, 32 nt, Human
uccagccuaggucagagguggggacagagaac

SEQ ID NO: 498220 - RNA, 24 nt, Human
uccagccuaggugacagaaugaga

SEQ ID NO: 498221 - RNA, 32 nt, Human
uccagccuaggugacagaaugagacucuaucu

SEQ ID NO: 498222 - RNA, 24 nt, Human
uccagccuaggugacagagcaaga

SEQ ID NO: 498223 - RNA, 32 nt, Human
uccagccuaggugacagagcaagacuccaucu

SEQ ID NO: 498224 - RNA, 32 nt, Human
uccagccuaggugacagagcaagacucugucu

SEQ ID NO: 498225 - RNA, 24 nt, Human
uccagccuaggugacagagcgaga

SEQ ID NO: 498226 - RNA, 32 nt, Human
uccagccuaggugacagagcgagacuccgucu

SEQ ID NO: 498227 - RNA, 32 nt, Human
uccagccuaggugacagagggagacucugccu

SEQ ID NO: 498228 - RNA, 24 nt, Human
uccagccuaggugacagagugaga

SEQ ID NO: 498229 - RNA, 32 nt, Human
uccagccuaggugacagagugagacccugucu

SEQ ID NO: 498230 - RNA, 32 nt, Human
uccagccuaggugacagagugagacuccaccu

SEQ ID NO: 498231 - RNA, 32 nt, Human
uccagccuaggugacagagugagacuccgucu

SEQ ID NO: 498232 - RNA, 24 nt, Human
uccagccuaggugacagggcaaga

SEQ ID NO: 498233 - RNA, 24 nt, Human
uccagccuaggugauagagcaaga

SEQ ID NO: 498234 - RNA, 32 nt, Human
uccagccuaggugauagagcaagacucugucc

SEQ ID NO: 498235 - RNA, 23 nt, Human
uccagccuaguaauggagcaaga

SEQ ID NO: 498236 - RNA, 32 nt, Human
uccagccuagucucaaacuccuggguucaagc

SEQ ID NO: 498237 - RNA, 32 nt, Human
uccagccucacaaaaggauucuuucaacuucu

SEQ ID NO: 498238 - RNA, 32 nt, Human
uccagccucacgcccgugggcugcaguuggaa

SEQ ID NO: 498239 - RNA, 19 nt, Human
uccagccucagagggccca

SEQ ID NO: 498240 - RNA, 24 nt, Human
uccagccucagcaauagagugaga

SEQ ID NO: 498241 - RNA, 23 nt, Human
uccagccucagccagggcaggga

SEQ ID NO: 498242 - RNA, 32 nt, Human
uccagccucaggacacacagggaacggcugca

SEQ ID NO: 498243 - RNA, 32 nt, Human
uccagccuccacagcugaccuccaagucggac

SEQ ID NO: 498244 - RNA, 32 nt, Human
uccagccuccaguggaggcuucagaggacagc

SEQ ID NO: 498245 - RNA, 26 nt, Human
uccagccuccccuacccagggucucu

SEQ ID NO: 498246 - RNA, 32 nt, Human
uccagccuccccucaggcuuuccagucaccag

SEQ ID NO: 498247 - RNA, 32 nt, Human
uccagccuccuggccuucggacucugaaucug

SEQ ID NO: 498248 - RNA, 24 nt, Human
uccagccucgccgacaaagcgaga

SEQ ID NO: 498249 - RNA, 32 nt, Human
uccagccucggcaacagagcaagacuccgucu

SEQ ID NO: 498250 - RNA, 24 nt, Human
uccagccucggugacagagcaaga

SEQ ID NO: 498251 - RNA, 32 nt, Human
uccagccucggugacagagcaagacuccaucu

SEQ ID NO: 498252 - RNA, 32 nt, Human
uccagccucggugacagagcaagacuguuuug

SEQ ID NO: 498253 - RNA, 32 nt, Human
uccagccucuacuggcaaccugaaccuuuccc

SEQ ID NO: 498254 - RNA, 32 nt, Human
uccagccucuaucaugggaguuccugccaugu

SEQ ID NO: 498255 - RNA, 20 nt, Human
uccagccucucccuccagca

SEQ ID NO: 498256 - RNA, 32 nt, Human
uccagccucugccucacacuccuguccucuga

SEQ ID NO: 498257 - RNA, 32 nt, Human
uccagccucugccucccgaagugcuguauuac

SEQ ID NO: 498258 - RNA, 24 nt, Human
uccagccugaacaacauaacaaga

SEQ ID NO: 498259 - RNA, 32 nt, Human
uccagccugaacaacauaacaagacccugucu

SEQ ID NO: 498260 - RNA, 32 nt, Human
uccagccugaagaucugggggcacaguauagc

SEQ ID NO: 498261 - RNA, 32 nt, Human
uccagccugaccagcccuggccuagucguggg

SEQ ID NO: 498262 - RNA, 22 nt, Human
uccagccugaccccagagcaga

SEQ ID NO: 498263 - RNA, 32 nt, Human
uccagccugaccuucacaucuggaaggauuuu

SEQ ID NO: 498264 - RNA, 23 nt, Human
uccagccugacgacaaagcgaga

SEQ ID NO: 498265 - RNA, 24 nt, Human
uccagccugagacaucaggggaga

SEQ ID NO: 498266 - RNA, 24 nt, Human
uccagccugagagacagaaugaga

SEQ ID NO: 498267 - RNA, 24 nt, Human
uccagccugagcaacacagugaga

SEQ ID NO: 498268 - RNA, 32 nt, Human
uccagccugagcaacacagugagacccuaucu

SEQ ID NO: 498269 - RNA, 22 nt, Human
uccagccugagcaacagagcaa

SEQ ID NO: 498270 - RNA, 24 nt, Human
uccagccugagcaacagagcaaga

SEQ ID NO: 498271 - RNA, 32 nt, Human
uccagccugagcaacagagcaagacucuaucu

SEQ ID NO: 498272 - RNA, 24 nt, Human
uccagccugagcaacagagccgga

SEQ ID NO: 498273 - RNA, 24 nt, Human
uccagccugagcaacagagcgaga

SEQ ID NO: 498274 - RNA, 20 nt, Human
uccagccugagcaacagagu

SEQ ID NO: 498275 - RNA, 24 nt, Human
uccagccugagcaacagagugaga

SEQ ID NO: 498276 - RNA, 32 nt, Human
uccagccugagcaacagagugagacccugucu

SEQ ID NO: 498277 - RNA, 24 nt, Human
uccagccugagcagcagagcggga

SEQ ID NO: 498278 - RNA, 24 nt, Human
uccagccugagcgacagagcaaga

SEQ ID NO: 498279 - RNA, 32 nt, Human
uccagccugagcgacagagcaagacuccgucu

SEQ ID NO: 498280 - RNA, 32 nt, Human
uccagccugagcgacagagcgagacuccgucu

SEQ ID NO: 498281 - RNA, 32 nt, Human
uccagccugagcgacagagcgagacucugccu

SEQ ID NO: 498282 - RNA, 24 nt, Human
uccagccugagcgacagaguaaga

SEQ ID NO: 498283 - RNA, 24 nt, Human
uccagccugagcgacagagugaga

SEQ ID NO: 498284 - RNA, 24 nt, Human
uccagccugagcuacagagcaaga

SEQ ID NO: 498285 - RNA, 32 nt, Human
uccagccugagguggcuucagauggagaugag

SEQ ID NO: 498286 - RNA, 32 nt, Human
uccagccugagguggugaaggcaggaugcucu

SEQ ID NO: 498287 - RNA, 24 nt, Human
uccagccugagugacagaacaagg

SEQ ID NO: 498288 - RNA, 24 nt, Human
uccagccugagugacagaaugaga

SEQ ID NO: 498289 - RNA, 32 nt, Human
uccagccugagugacagaaugagaccuugucu

SEQ ID NO: 498290 - RNA, 24 nt, Human
uccagccugagugacagagcgaga

SEQ ID NO: 498291 - RNA, 32 nt, Human
uccagccugagugacagagcgagacccugucu

SEQ ID NO: 498292 - RNA, 32 nt, Human
uccagccugagugacagagcgagacuccaucu

SEQ ID NO: 498293 - RNA, 32 nt, Human
uccagccugagugacagagcgagacucuaucu

SEQ ID NO: 498294 - RNA, 32 nt, Human
uccagccugagugacagagcgagacucugucu

SEQ ID NO: 498295 - RNA, 24 nt, Human
uccagccugagugacagagugaga

SEQ ID NO: 498296 - RNA, 32 nt, Human
uccagccugagugacagagugagacccugccu

SEQ ID NO: 498297 - RNA, 32 nt, Human
uccagccugagugacagagugagacccugucu

SEQ ID NO: 498298 - RNA, 22 nt, Human
uccagccugagugaggaagcaa

SEQ ID NO: 498299 - RNA, 24 nt, Human
uccagccugagugauagagugaga

SEQ ID NO: 498300 - RNA, 23 nt, Human
uccagccugaugacagagcaaga

SEQ ID NO: 498301 - RNA, 24 nt, Human
uccagccugcacaguagagugagg

SEQ ID NO: 498302 - RNA, 22 nt, Human
uccagccugccccggagcugga

SEQ ID NO: 498303 - RNA, 32 nt, Human
uccagccugccuggaaaugcugugggcucagg

SEQ ID NO: 498304 - RNA, 21 nt, Human
uccagccugcgagggucccag

SEQ ID NO: 498305 - RNA, 24 nt, Human
uccagccugcgcaacagagcgaga

SEQ ID NO: 498306 - RNA, 24 nt, Human
uccagccugcgcgacagaucgaga

SEQ ID NO: 498307 - RNA, 23 nt, Human
uccagccugcggacagaccaaga

SEQ ID NO: 498308 - RNA, 24 nt, Human
uccagccugcgggacagagugaga

SEQ ID NO: 498309 - RNA, 32 nt, Human
uccagccugcgggacagagugagacccugucu

SEQ ID NO: 498310 - RNA, 24 nt, Human
uccagccugcgugacaaagugaga

SEQ ID NO: 498311 - RNA, 32 nt, Human
uccagccugcgugacaaagugagacccucucu

SEQ ID NO: 498312 - RNA, 23 nt, Human
uccagccugcuucaggagggagg

SEQ ID NO: 498313 - RNA, 23 nt, Human
uccagccuggaaaacaaguguga

SEQ ID NO: 498314 - RNA, 24 nt, Human
uccagccuggaaaacggagugaga

SEQ ID NO: 498315 - RNA, 24 nt, Human
uccagccuggaagaccaaacgaga

SEQ ID NO: 498316 - RNA, 22 nt, Human
uccagccuggaaggcagagaga

SEQ ID NO: 498317 - RNA, 24 nt, Human
uccagccuggaaggcagagagaga

SEQ ID NO: 498318 - RNA, 25 nt, Human
uccagccuggacaacaagagcaaga

SEQ ID NO: 498319 - RNA, 32 nt, Human
uccagccuggacaacaagagcaagacuccauc

SEQ ID NO: 498320 - RNA, 23 nt, Human
uccagccuggacaacaagagcga

SEQ ID NO: 498321 - RNA, 32 nt, Human
uccagccuggacaacaagagcgaaacuccguc

SEQ ID NO: 498322 - RNA, 32 nt, Human
uccagccuggacaacaagagcgaaacucuguc

SEQ ID NO: 498323 - RNA, 32 nt, Human
uccagccuggacaacaagagcgaaauucuguc

SEQ ID NO: 498324 - RNA, 32 nt, Human
uccagccuggacaacaagagugaaacgcuauc

SEQ ID NO: 498325 - RNA, 24 nt, Human
uccagccuggacaacacagugaga

SEQ ID NO: 498326 - RNA, 32 nt, Human
uccagccuggacaacacagugagacucugucu

SEQ ID NO: 498327 - RNA, 24 nt, Human
uccagccuggacaacagaaagaga

SEQ ID NO: 498328 - RNA, 32 nt, Human
uccagccuggacaacagaaagagaccuugucu

SEQ ID NO: 498329 - RNA, 21 nt, Human
uccagccuggacaacagacaa

SEQ ID NO: 498330 - RNA, 24 nt, Human
uccagccuggacaacagagcaaga

SEQ ID NO: 498331 - RNA, 32 nt, Human
uccagccuggacaacagagcaagaccuucucu

SEQ ID NO: 498332 - RNA, 32 nt, Human
uccagccuggacaacagagcaagacuccgacg

SEQ ID NO: 498333 - RNA, 32 nt, Human
uccagccuggacaacagagcaagacuccuucu

SEQ ID NO: 498334 - RNA, 24 nt, Human
uccagccuggacaacagagcgaga

SEQ ID NO: 498335 - RNA, 32 nt, Human
uccagccuggacaacagagcgagacuccaucu

SEQ ID NO: 498336 - RNA, 24 nt, Human
uccagccuggacaacagagcuaga

SEQ ID NO: 498337 - RNA, 32 nt, Human
uccagccuggacaacagagcuagacuccaucu

SEQ ID NO: 498338 - RNA, 24 nt, Human
uccagccuggacaacagagggaga

SEQ ID NO: 498339 - RNA, 32 nt, Human
uccagccuggacaacagagggagacucugucu

SEQ ID NO: 498340 - RNA, 22 nt, Human
uccagccuggacaacagaguaa

SEQ ID NO: 498341 - RNA, 32 nt, Human
uccagccuggacaacagaguaaaacccugucu

SEQ ID NO: 498342 - RNA, 24 nt, Human
uccagccuggacaacagagugaga

SEQ ID NO: 498343 - RNA, 32 nt, Human
uccagccuggacaacagagugagaaccugucu

SEQ ID NO: 498344 - RNA, 32 nt, Human
uccagccuggacaacagagugagacucguaau

SEQ ID NO: 498345 - RNA, 24 nt, Human
uccagccuggacaacagaguggga

SEQ ID NO: 498346 - RNA, 32 nt, Human
uccagccuggacaacagagugggacucugucu

SEQ ID NO: 498347 - RNA, 24 nt, Human
uccagccuggacaacagauugaga

SEQ ID NO: 498348 - RNA, 32 nt, Human
uccagccuggacaacagauugagacccugucu

SEQ ID NO: 498349 - RNA, 32 nt, Human
uccagccuggacaacagcgagagcuccaucuc

SEQ ID NO: 498350 - RNA, 24 nt, Human
uccagccuggacaacauagugaga

SEQ ID NO: 498351 - RNA, 24 nt, Human
uccagccuggacaacggagugaga

SEQ ID NO: 498352 - RNA, 32 nt, Human
uccagccuggacaacggagugagacucugggg

SEQ ID NO: 498353 - RNA, 32 nt, Human
uccagccuggacagagaaaccucuccagccac

SEQ ID NO: 498354 - RNA, 24 nt, Human
uccagccuggacagcagaacaaga

SEQ ID NO: 498355 - RNA, 20 nt, Human
uccagccuggacagcaggag

SEQ ID NO: 498356 - RNA, 23 nt, Human
uccagccuggacagcaggagcga

SEQ ID NO: 498357 - RNA, 32 nt, Human
uccagccuggacagcaggagcgaaacuccguc

SEQ ID NO: 498358 - RNA, 24 nt, Human
uccagccuggacgacagagcaaga

SEQ ID NO: 498359 - RNA, 32 nt, Human
uccagccuggacgacagagcaagacucagucu

SEQ ID NO: 498360 - RNA, 32 nt, Human
uccagccuggacgacagagcgagacuccaucu

SEQ ID NO: 498361 - RNA, 32 nt, Human
uccagccuggacgacagagcgagacuccgucu

SEQ ID NO: 498362 - RNA, 24 nt, Human
uccagccuggacgacagagugaga

SEQ ID NO: 498363 - RNA, 24 nt, Human
uccagccuggacgacugagugaga

SEQ ID NO: 498364 - RNA, 32 nt, Human
uccagccuggacgacugagugagacccugucu

SEQ ID NO: 498365 - RNA, 24 nt, Human
uccagccuggacgauauagccaga

SEQ ID NO: 498366 - RNA, 32 nt, Human
uccagccuggaggacagagcgagacucuaucu

SEQ ID NO: 498367 - RNA, 24 nt, Human
uccagccuggaggccagagugaga

SEQ ID NO: 498368 - RNA, 24 nt, Human
uccagccuggagugcaggaggggg

SEQ ID NO: 498369 - RNA, 24 nt, Human
uccagccuggauaaaagagcaaga

SEQ ID NO: 498370 - RNA, 24 nt, Human
uccagccuggauaacagagcgaga

SEQ ID NO: 498371 - RNA, 24 nt, Human
uccagccuggauaauagagugaga

SEQ ID NO: 498372 - RNA, 32 nt, Human
uccagccuggauaauagagugagacccuaugu

SEQ ID NO: 498373 - RNA, 32 nt, Human
uccagccuggauccccucacacugaacccuuc

SEQ ID NO: 498374 - RNA, 23 nt, Human
uccagccuggaugacaagaguga

SEQ ID NO: 498375 - RNA, 32 nt, Human
uccagccuggaugacagagcaagacucugucu

SEQ ID NO: 498376 - RNA, 32 nt, Human
uccagccuggaugacagagcgagacuccgccu

SEQ ID NO: 498377 - RNA, 22 nt, Human
uccagccuggaugacagaguga

SEQ ID NO: 498378 - RNA, 24 nt, Human
uccagccuggaugacagagugaga

SEQ ID NO: 498379 - RNA, 32 nt, Human
uccagccuggaugacagagugagacuccaucu

SEQ ID NO: 498380 - RNA, 32 nt, Human
uccagccuggaugacagagugagacuccgucu

SEQ ID NO: 498381 - RNA, 32 nt, Human
uccagccuggaugacagagugagacuucaucu

SEQ ID NO: 498382 - RNA, 22 nt, Human
uccagccuggaugacagagugg

SEQ ID NO: 498383 - RNA, 23 nt, Human
uccagccuggaugacagagugga

SEQ ID NO: 498384 - RNA, 22 nt, Human
uccagccuggaugacagcgaga

SEQ ID NO: 498385 - RNA, 25 nt, Human
uccagccuggaugaccugggacccc

SEQ ID NO: 498386 - RNA, 24 nt, Human
uccagccuggaugacggagccaga

SEQ ID NO: 498387 - RNA, 32 nt, Human
uccagccuggaugacggagccagauccuguuu

SEQ ID NO: 498388 - RNA, 24 nt, Human
uccagccuggaugacgggaugaga

SEQ ID NO: 498389 - RNA, 24 nt, Human
uccagccuggaugauagagcaaga

SEQ ID NO: 498390 - RNA, 32 nt, Human
uccagccuggaugauagagcaagacccugucu

SEQ ID NO: 498391 - RNA, 23 nt, Human
uccagccuggcaacagagcaaga

SEQ ID NO: 498392 - RNA, 23 nt, Human
uccagccuggcaacagagcaagg

SEQ ID NO: 498393 - RNA, 23 nt, Human
uccagccuggcaacagagcgaga

SEQ ID NO: 498394 - RNA, 23 nt, Human
uccagccuggcaacagagugaga

SEQ ID NO: 498395 - RNA, 17 nt, Human
uccagccuggcacuucc

SEQ ID NO: 498396 - RNA, 23 nt, Human
uccagccuggccacagagcgaga

SEQ ID NO: 498397 - RNA, 24 nt, Human
uccagccuggcccacagagugaga

SEQ ID NO: 498398 - RNA, 32 nt, Human
uccagccuggccgacagagcaagauucugucu

SEQ ID NO: 498399 - RNA, 23 nt, Human
uccagccuggcgacaaagcgaga

SEQ ID NO: 498400 - RNA, 24 nt, Human
uccagccuggcgacaagagcgaga

SEQ ID NO: 498401 - RNA, 24 nt, Human
uccagccuggcgacaagagugaga

SEQ ID NO: 498402 - RNA, 23 nt, Human
uccagccuggcgacacagugaga

SEQ ID NO: 498403 - RNA, 23 nt, Human
uccagccuggcgacagagagaga

SEQ ID NO: 498404 - RNA, 22 nt, Human
uccagccuggcgacagagcaag

SEQ ID NO: 498405 - RNA, 23 nt, Human
uccagccuggcgacagagcaaga

SEQ ID NO: 498406 - RNA, 23 nt, Human
uccagccuggcgacagagcgaga

SEQ ID NO: 498407 - RNA, 23 nt, Human
uccagccuggcgacagagcuaga

SEQ ID NO: 498408 - RNA, 23 nt, Human
uccagccuggcgacagagggaga

SEQ ID NO: 498409 - RNA, 23 nt, Human
uccagccuggcgacagagugaga

SEQ ID NO: 498410 - RNA, 23 nt, Human
uccagccuggcgacugagcgaga

SEQ ID NO: 498411 - RNA, 23 nt, Human
uccagccuggcuacagagugaga

SEQ ID NO: 498412 - RNA, 24 nt, Human
uccagccuggcugacagagcaaga

SEQ ID NO: 498413 - RNA, 24 nt, Human
uccagccuggcugacagagcgaga

SEQ ID NO: 498414 - RNA, 32 nt, Human
uccagccuggcugacagagcgagacugucucu

SEQ ID NO: 498415 - RNA, 22 nt, Human
uccagccuggcugacagugaga

SEQ ID NO: 498416 - RNA, 32 nt, Human
uccagccuggcugacagugcaagacucugucu

SEQ ID NO: 498417 - RNA, 23 nt, Human
uccagccuggcugugagccaaga

SEQ ID NO: 498418 - RNA, 23 nt, Human
uccagccugggaaacaagaguga

SEQ ID NO: 498419 - RNA, 22 nt, Human
uccagccugggaaacagagcga

SEQ ID NO: 498420 - RNA, 23 nt, Human
uccagccugggaaauagagugag

SEQ ID NO: 498421 - RNA, 24 nt, Human
uccagccugggaagcagagugaga

SEQ ID NO: 498422 - RNA, 32 nt, Human
uccagccugggaagcagagugagacccugucu

SEQ ID NO: 498423 - RNA, 24 nt, Human
uccagccugggagacacagcgaga

SEQ ID NO: 498424 - RNA, 32 nt, Human
uccagccugggagacacagugagacccugucu

SEQ ID NO: 498425 - RNA, 24 nt, Human
uccagccugggagacagagcaaga

SEQ ID NO: 498426 - RNA, 32 nt, Human
uccagccugggagacagagcaagacucagucu

SEQ ID NO: 498427 - RNA, 32 nt, Human
uccagccugggagacagagcaagacuccaucu

SEQ ID NO: 498428 - RNA, 32 nt, Human
uccagccugggagacagagcaagacuccgucu

SEQ ID NO: 498429 - RNA, 32 nt, Human
uccagccugggagacagagcaagacucugucu

SEQ ID NO: 498430 - RNA, 32 nt, Human
uccagccugggagacagagccagacuccaucu

SEQ ID NO: 498431 - RNA, 22 nt, Human
uccagccugggagacagagcga

SEQ ID NO: 498432 - RNA, 24 nt, Human
uccagccugggagacagagcgaga

SEQ ID NO: 498433 - RNA, 32 nt, Human
uccagccugggagacagagcgagacgcugucu

SEQ ID NO: 498434 - RNA, 32 nt, Human
uccagccugggagacagagcgagacuccaucu

SEQ ID NO: 498435 - RNA, 32 nt, Human
uccagccugggagacagagcgagacuccgucu

SEQ ID NO: 498436 - RNA, 32 nt, Human
uccagccugggagacagagcgagacucugucu

SEQ ID NO: 498437 - RNA, 32 nt, Human
uccagccugggagacagagcgagacucuuguc

SEQ ID NO: 498438 - RNA, 24 nt, Human
uccagccugggagacagagugaga

SEQ ID NO: 498439 - RNA, 24 nt, Human
uccagccugggagacagaguuaga

SEQ ID NO: 498440 - RNA, 22 nt, Human
uccagccugggagacagcaaga

SEQ ID NO: 498441 - RNA, 32 nt, Human
uccagccugggagacggagcaagacuccaucu

SEQ ID NO: 498442 - RNA, 24 nt, Human
uccagccugggagauacagcgaga

SEQ ID NO: 498443 - RNA, 24 nt, Human
uccagccugggagauagagcaaga

SEQ ID NO: 498444 - RNA, 32 nt, Human
uccagccugggagauagagcaagacuccaucu

SEQ ID NO: 498445 - RNA, 22 nt, Human
uccagccugggagauggugaga

SEQ ID NO: 498446 - RNA, 22 nt, Human
uccagccugggcaaaaaagcaa

SEQ ID NO: 498447 - RNA, 20 nt, Human
uccagccugggcaaaaagag

SEQ ID NO: 498448 - RNA, 23 nt, Human
uccagccugggcaaaaagagcaa

SEQ ID NO: 498449 - RNA, 22 nt, Human
uccagccugggcaaaagagcaa

SEQ ID NO: 498450 - RNA, 24 nt, Human
uccagccugggcaaaauagcgaga

SEQ ID NO: 498451 - RNA, 24 nt, Human
uccagccugggcaacaaaacgaga

SEQ ID NO: 498452 - RNA, 24 nt, Human
uccagccugggcaacaaagcaaga

SEQ ID NO: 498453 - RNA, 24 nt, Human
uccagccugggcaacaaagcuaga

SEQ ID NO: 498454 - RNA, 24 nt, Human
uccagccugggcaacaaagugaga

SEQ ID NO: 498455 - RNA, 23 nt, Human
uccagccugggcaacaacaguga

SEQ ID NO: 498456 - RNA, 19 nt, Human
uccagccugggcaacaaga

SEQ ID NO: 498457 - RNA, 23 nt, Human
uccagccugggcaacaagaacaa

SEQ ID NO: 498458 - RNA, 23 nt, Human
uccagccugggcaacaagaauga

SEQ ID NO: 498459 - RNA, 21 nt, Human
uccagccugggcaacaagaga

SEQ ID NO: 498460 - RNA, 24 nt, Human
uccagccugggcaacaagagaaga

SEQ ID NO: 498461 - RNA, 23 nt, Human
uccagccugggcaacaagagaga

SEQ ID NO: 498462 - RNA, 23 nt, Human
uccagccugggcaacaagagcaa

SEQ ID NO: 498463 - RNA, 25 nt, Human
uccagccugggcaacaagagcaaga

SEQ ID NO: 498464 - RNA, 23 nt, Human
uccagccugggcaacaagagcga

SEQ ID NO: 498465 - RNA, 24 nt, Human
uccagccugggcaacaagagcgag

SEQ ID NO: 498466 - RNA, 25 nt, Human
uccagccugggcaacaagagcgagg

SEQ ID NO: 498467 - RNA, 21 nt, Human
uccagccugggcaacaagagg

SEQ ID NO: 498468 - RNA, 23 nt, Human
uccagccugggcaacaagaggaa

SEQ ID NO: 498469 - RNA, 23 nt, Human
uccagccugggcaacaagaggga

SEQ ID NO: 498470 - RNA, 21 nt, Human
uccagccugggcaacaagagu

SEQ ID NO: 498471 - RNA, 23 nt, Human
uccagccugggcaacaagaguaa

SEQ ID NO: 498472 - RNA, 24 nt, Human
uccagccugggcaacaagaguaag

SEQ ID NO: 498473 - RNA, 25 nt, Human
uccagccugggcaacaagaguaaga

SEQ ID NO: 498474 - RNA, 23 nt, Human
uccagccugggcaacaagaguga

SEQ ID NO: 498475 - RNA, 25 nt, Human
uccagccugggcaacaagagugaga

SEQ ID NO: 498476 - RNA, 23 nt, Human
uccagccugggcaacaagagugg

SEQ ID NO: 498477 - RNA, 21 nt, Human
uccagccugggcaacaagcga

SEQ ID NO: 498478 - RNA, 23 nt, Human
uccagccugggcaacaagggcaa

SEQ ID NO: 498479 - RNA, 23 nt, Human
uccagccugggcaacaagugcga

SEQ ID NO: 498480 - RNA, 20 nt, Human
uccagccugggcaacacaga

SEQ ID NO: 498481 - RNA, 24 nt, Human
uccagccugggcaacacagagaga

SEQ ID NO: 498482 - RNA, 24 nt, Human
uccagccugggcaacacagcaaga

SEQ ID NO: 498483 - RNA, 32 nt, Human
uccagccugggcaacacagcaagacucugucg

SEQ ID NO: 498484 - RNA, 32 nt, Human
uccagccugggcaacacagcaagacucugucu

SEQ ID NO: 498485 - RNA, 24 nt, Human
uccagccugggcaacacagcgaga

SEQ ID NO: 498486 - RNA, 24 nt, Human
uccagccugggcaacacagugaga

SEQ ID NO: 498487 - RNA, 23 nt, Human
uccagccugggcaacacgagcga

SEQ ID NO: 498488 - RNA, 22 nt, Human
uccagccugggcaacagaacaa

SEQ ID NO: 498489 - RNA, 24 nt, Human
uccagccugggcaacagaacaaga

SEQ ID NO: 498490 - RNA, 24 nt, Human
uccagccugggcaacagaacgaga

SEQ ID NO: 498491 - RNA, 24 nt, Human
uccagccugggcaacagaagaaga

SEQ ID NO: 498492 - RNA, 24 nt, Human
uccagccugggcaacagaaugaga

SEQ ID NO: 498493 - RNA, 32 nt, Human
uccagccugggcaacagaaugagacccuuccg

SEQ ID NO: 498494 - RNA, 20 nt, Human
uccagccugggcaacagaca

SEQ ID NO: 498495 - RNA, 27 nt, Human
uccagccugggcaacagacagagugag

SEQ ID NO: 498496 - RNA, 28 nt, Human
uccagccugggcaacagacagagugaga

SEQ ID NO: 498497 - RNA, 20 nt, Human
uccagccugggcaacagaga

SEQ ID NO: 498498 - RNA, 32 nt, Human
uccagccugggcaacagagaacccugucucua

SEQ ID NO: 498499 - RNA, 32 nt, Human
uccagccugggcaacagagacccugucucaac

SEQ ID NO: 498500 - RNA, 32 nt, Human
uccagccugggcaacagagacucugucucaaa

SEQ ID NO: 498501 - RNA, 22 nt, Human
uccagccugggcaacagagaga

SEQ ID NO: 498502 - RNA, 32 nt, Human
uccagccugggcaacagagagacugucuccaa

SEQ ID NO: 498503 - RNA, 24 nt, Human
uccagccugggcaacagagagaga

SEQ ID NO: 498504 - RNA, 32 nt, Human
uccagccugggcaacagagagcgacucucuca

SEQ ID NO: 498505 - RNA, 22 nt, Human
uccagccugggcaacagagcaa

SEQ ID NO: 498506 - RNA, 32 nt, Human
uccagccugggcaacagagcaaaacccugucu

SEQ ID NO: 498507 - RNA, 32 nt, Human
uccagccugggcaacagagcaaaacuccgucu

SEQ ID NO: 498508 - RNA, 32 nt, Human
uccagccugggcaacagagcaaaacuuucagg

SEQ ID NO: 498509 - RNA, 24 nt, Human
uccagccugggcaacagagcaaga

SEQ ID NO: 498510 - RNA, 32 nt, Human
uccagccugggcaacagagcaagacccaucuc

SEQ ID NO: 498511 - RNA, 32 nt, Human
uccagccugggcaacagagcaagaccccaucc

SEQ ID NO: 498512 - RNA, 32 nt, Human
uccagccugggcaacagagcaagaccccaucu

SEQ ID NO: 498513 - RNA, 32 nt, Human
uccagccugggcaacagagcaagacccugucu

SEQ ID NO: 498514 - RNA, 32 nt, Human
uccagccugggcaacagagcaagaccucgucu

SEQ ID NO: 498515 - RNA, 32 nt, Human
uccagccugggcaacagagcaagaccuugucu

SEQ ID NO: 498516 - RNA, 32 nt, Human
uccagccugggcaacagagcaagacuccaucu

SEQ ID NO: 498517 - RNA, 32 nt, Human
uccagccugggcaacagagcaagacuccgucu

SEQ ID NO: 498518 - RNA, 32 nt, Human
uccagccugggcaacagagcaagacucggucu

SEQ ID NO: 498519 - RNA, 32 nt, Human
uccagccugggcaacagagcaagacucugccu

SEQ ID NO: 498520 - RNA, 32 nt, Human
uccagccugggcaacagagcaagacucugucu

SEQ ID NO: 498521 - RNA, 32 nt, Human
uccagccugggcaacagagcaagacugccuca

SEQ ID NO: 498522 - RNA, 32 nt, Human
uccagccugggcaacagagcaagacugucuca

SEQ ID NO: 498523 - RNA, 32 nt, Human
uccagccugggcaacagagcaagauccugucu

SEQ ID NO: 498524 - RNA, 24 nt, Human
uccagccugggcaacagagcaagg

SEQ ID NO: 498525 - RNA, 32 nt, Human
uccagccugggcaacagagcaaggcucugucu

SEQ ID NO: 498526 - RNA, 32 nt, Human
uccagccugggcaacagagcaaggcucuguuu

SEQ ID NO: 498527 - RNA, 32 nt, Human
uccagccugggcaacagagcaaggcugucucu

SEQ ID NO: 498528 - RNA, 32 nt, Human
uccagccugggcaacagagcauaacuccaucu

SEQ ID NO: 498529 - RNA, 24 nt, Human
uccagccugggcaacagagccaga

SEQ ID NO: 498530 - RNA, 24 nt, Human
uccagccugggcaacagagccagg

SEQ ID NO: 498531 - RNA, 24 nt, Human
uccagccugggcaacagagcgaga

SEQ ID NO: 498532 - RNA, 32 nt, Human
uccagccugggcaacagagcgagacuacaucu

SEQ ID NO: 498533 - RNA, 32 nt, Human
uccagccugggcaacagagcgagacuccaucu

SEQ ID NO: 498534 - RNA, 32 nt, Human
uccagccugggcaacagagcgagacuucaucu

SEQ ID NO: 498535 - RNA, 24 nt, Human
uccagccugggcaacagagcgagg

SEQ ID NO: 498536 - RNA, 24 nt, Human
uccagccugggcaacagagcuaga

SEQ ID NO: 498537 - RNA, 22 nt, Human
uccagccugggcaacagaggga

SEQ ID NO: 498538 - RNA, 23 nt, Human
uccagccugggcaacagagggag

SEQ ID NO: 498539 - RNA, 24 nt, Human
uccagccugggcaacagagggaga

SEQ ID NO: 498540 - RNA, 32 nt, Human
uccagccugggcaacagagggagacuccaucu

SEQ ID NO: 498541 - RNA, 32 nt, Human
uccagccugggcaacagagggagacuucaucu

SEQ ID NO: 498542 - RNA, 20 nt, Human
uccagccugggcaacagagu

SEQ ID NO: 498543 - RNA, 22 nt, Human
uccagccugggcaacagaguaa

SEQ ID NO: 498544 - RNA, 24 nt, Human
uccagccugggcaacagaguaaga

SEQ ID NO: 498545 - RNA, 32 nt, Human
uccagccugggcaacagaguaagaacugucuc

SEQ ID NO: 498546 - RNA, 32 nt, Human
uccagccugggcaacagaguaagacuccaucu

SEQ ID NO: 498547 - RNA, 22 nt, Human
uccagccugggcaacagaguga

SEQ ID NO: 498548 - RNA, 23 nt, Human
uccagccugggcaacagagugag

SEQ ID NO: 498549 - RNA, 24 nt, Human
uccagccugggcaacagagugaga

SEQ ID NO: 498550 - RNA, 32 nt, Human
uccagccugggcaacagagugagacccuaucu

SEQ ID NO: 498551 - RNA, 32 nt, Human
uccagccugggcaacagagugagacccugccu

SEQ ID NO: 498552 - RNA, 32 nt, Human
uccagccugggcaacagagugagacccugucu

SEQ ID NO: 498553 - RNA, 32 nt, Human
uccagccugggcaacagagugagacccuguuu

SEQ ID NO: 498554 - RNA, 32 nt, Human
uccagccugggcaacagagugagacuaucuca

SEQ ID NO: 498555 - RNA, 32 nt, Human
uccagccugggcaacagagugagacuccaucu

SEQ ID NO: 498556 - RNA, 32 nt, Human
uccagccugggcaacagagugagacugucuca

SEQ ID NO: 498557 - RNA, 24 nt, Human
uccagccugggcaacagagugagg

SEQ ID NO: 498558 - RNA, 22 nt, Human
uccagccugggcaacagagugg

SEQ ID NO: 498559 - RNA, 24 nt, Human
uccagccugggcaacagaguggga

SEQ ID NO: 498560 - RNA, 32 nt, Human
uccagccugggcaacagagugggacuccaucu

SEQ ID NO: 498561 - RNA, 24 nt, Human
uccagccugggcaacagaugaaga

SEQ ID NO: 498562 - RNA, 22 nt, Human
uccagccugggcaacagcgaga

SEQ ID NO: 498563 - RNA, 24 nt, Human
uccagccugggcaacagcgugaga

SEQ ID NO: 498564 - RNA, 23 nt, Human
uccagccugggcaacaggaguaa

SEQ ID NO: 498565 - RNA, 24 nt, Human
uccagccugggcaacagggcaaga

SEQ ID NO: 498566 - RNA, 23 nt, Human
uccagccugggcaacagguaaga

SEQ ID NO: 498567 - RNA, 23 nt, Human
uccagccugggcaacaggugaga

SEQ ID NO: 498568 - RNA, 19 nt, Human
uccagccugggcaacagug

SEQ ID NO: 498569 - RNA, 22 nt, Human
uccagccugggcaacagugaga

SEQ ID NO: 498570 - RNA, 24 nt, Human
uccagccugggcaacagugugaga

SEQ ID NO: 498571 - RNA, 24 nt, Human
uccagccugggcaacaguguuaag

SEQ ID NO: 498572 - RNA, 22 nt, Human
uccagccugggcaacauagcaa

SEQ ID NO: 498573 - RNA, 23 nt, Human
uccagccugggcaacauagcaag

SEQ ID NO: 498574 - RNA, 24 nt, Human
uccagccugggcaacauagcaaga

SEQ ID NO: 498575 - RNA, 32 nt, Human
uccagccugggcaacauagcaagacuccaucu

SEQ ID NO: 498576 - RNA, 24 nt, Human
uccagccugggcaacauaguaaga

SEQ ID NO: 498577 - RNA, 24 nt, Human
uccagccugggcaacauagugaga

SEQ ID NO: 498578 - RNA, 32 nt, Human
uccagccugggcaacauagugagaccccaucu

SEQ ID NO: 498579 - RNA, 23 nt, Human
uccagccugggcaacaugaguga

SEQ ID NO: 498580 - RNA, 32 nt, Human
uccagccugggcaaccaggugagacccugccu

SEQ ID NO: 498581 - RNA, 21 nt, Human
uccagccugggcaacgaaaag

SEQ ID NO: 498582 - RNA, 21 nt, Human
uccagccugggcaacgagagg

SEQ ID NO: 498583 - RNA, 23 nt, Human
uccagccugggcaacgagaggga

SEQ ID NO: 498584 - RNA, 24 nt, Human
uccagccugggcaacgagagggga

SEQ ID NO: 498585 - RNA, 23 nt, Human
uccagccugggcaacgagaguga

SEQ ID NO: 498586 - RNA, 21 nt, Human
uccagccugggcaacgagcaa

SEQ ID NO: 498587 - RNA, 23 nt, Human
uccagccugggcaacgagcaaga

SEQ ID NO: 498588 - RNA, 21 nt, Human
uccagccugggcaacgagcga

SEQ ID NO: 498589 - RNA, 21 nt, Human
uccagccugggcaacgaguga

SEQ ID NO: 498590 - RNA, 24 nt, Human
uccagccugggcaacggagcaaga

SEQ ID NO: 498591 - RNA, 24 nt, Human
uccagccugggcaacggagugaga

SEQ ID NO: 498592 - RNA, 24 nt, Human
uccagccugggcaacggauugaga

SEQ ID NO: 498593 - RNA, 23 nt, Human
uccagccugggcaacgggcgaga

SEQ ID NO: 498594 - RNA, 22 nt, Human
uccagccugggcaacguaguaa

SEQ ID NO: 498595 - RNA, 32 nt, Human
uccagccugggcaacguggugagacccugucu

SEQ ID NO: 498596 - RNA, 19 nt, Human
uccagccugggcaacugag

SEQ ID NO: 498597 - RNA, 22 nt, Human
uccagccugggcaacugagcaa

SEQ ID NO: 498598 - RNA, 24 nt, Human
uccagccugggcaacugagcaaga

SEQ ID NO: 498599 - RNA, 32 nt, Human
uccagccugggcaacugagcaagacugucuca

SEQ ID NO: 498600 - RNA, 23 nt, Human
uccagccugggcaauaagagcaa

SEQ ID NO: 498601 - RNA, 23 nt, Human
uccagccugggcaauaagagcga

SEQ ID NO: 498602 - RNA, 23 nt, Human
uccagccugggcaauaagaguga

SEQ ID NO: 498603 - RNA, 32 nt, Human
uccagccugggcaauacagugagacccugucu

SEQ ID NO: 498604 - RNA, 24 nt, Human
uccagccugggcaauagagcaaga

SEQ ID NO: 498605 - RNA, 32 nt, Human
uccagccugggcaauagagcaagacuccaucu

SEQ ID NO: 498606 - RNA, 32 nt, Human
uccagccugggcaauagagcaagacugcaaga

SEQ ID NO: 498607 - RNA, 24 nt, Human
uccagccugggcaauagaguaaga

SEQ ID NO: 498608 - RNA, 24 nt, Human
uccagccugggcaauagagugaga

SEQ ID NO: 498609 - RNA, 24 nt, Human
uccagccugggcaauagggcaaga

SEQ ID NO: 498610 - RNA, 24 nt, Human
uccagccugggcaauaggguaaga

SEQ ID NO: 498611 - RNA, 24 nt, Human
uccagccugggcaauauagcaaga

SEQ ID NO: 498612 - RNA, 22 nt, Human
uccagccugggcaauggagaga

SEQ ID NO: 498613 - RNA, 23 nt, Human
uccagccugggcaauggagagag

SEQ ID NO: 498614 - RNA, 24 nt, Human
uccagccugggcaauggagagagg

SEQ ID NO: 498615 - RNA, 24 nt, Human
uccagccugggcaauggagugaga

SEQ ID NO: 498616 - RNA, 24 nt, Human
uccagccugggcaccaaugugaga

SEQ ID NO: 498617 - RNA, 24 nt, Human
uccagccugggcaccacagcaaga

SEQ ID NO: 498618 - RNA, 24 nt, Human
uccagccugggcaccagagcgaga

SEQ ID NO: 498619 - RNA, 24 nt, Human
uccagccugggcacuagagugaga

SEQ ID NO: 498620 - RNA, 23 nt, Human
uccagccugggcagcaagagcaa

SEQ ID NO: 498621 - RNA, 23 nt, Human
uccagccugggcagcaagaguga

SEQ ID NO: 498622 - RNA, 22 nt, Human
uccagccugggcagcagagcaa

SEQ ID NO: 498623 - RNA, 24 nt, Human
uccagccugggcagcagagcaaga

SEQ ID NO: 498624 - RNA, 32 nt, Human
uccagccugggcagcagagcaagacucugucu

SEQ ID NO: 498625 - RNA, 24 nt, Human
uccagccugggcagcagagcgaga

SEQ ID NO: 498626 - RNA, 24 nt, Human
uccagccugggcagcagaggaaga

SEQ ID NO: 498627 - RNA, 24 nt, Human
uccagccugggcagcagagugaga

SEQ ID NO: 498628 - RNA, 24 nt, Human
uccagccugggcagcauaguguga

SEQ ID NO: 498629 - RNA, 24 nt, Human
uccagccugggcagcugaacaaga

SEQ ID NO: 498630 - RNA, 24 nt, Human
uccagccugggcaguauagcaaga

SEQ ID NO: 498631 - RNA, 24 nt, Human
uccagccugggccacaaggcaaga

SEQ ID NO: 498632 - RNA, 24 nt, Human
uccagccugggccacacagugaga

SEQ ID NO: 498633 - RNA, 24 nt, Human
uccagccugggccacagaacgaga

SEQ ID NO: 498634 - RNA, 24 nt, Human
uccagccugggccacagaaugaga

SEQ ID NO: 498635 - RNA, 32 nt, Human
uccagccugggccacagaaugagacuccaucu

SEQ ID NO: 498636 - RNA, 32 nt, Human
uccagccugggccacagagcaagacuccgucu

SEQ ID NO: 498637 - RNA, 24 nt, Human
uccagccugggccacagagugaga

SEQ ID NO: 498638 - RNA, 24 nt, Human
uccagccugggccacauagcaaga

SEQ ID NO: 498639 - RNA, 24 nt, Human
uccagccugggcgaaagagaaaga

SEQ ID NO: 498640 - RNA, 24 nt, Human
uccagccugggcgaaagggcaaga

SEQ ID NO: 498641 - RNA, 32 nt, Human
uccagccugggcgaaagggcaagacuccaucu

SEQ ID NO: 498642 - RNA, 24 nt, Human
uccagccugggcgaaagggugaga

SEQ ID NO: 498643 - RNA, 24 nt, Human
uccagccugggcgacaaagcaaga

SEQ ID NO: 498644 - RNA, 32 nt, Human
uccagccugggcgacaaagcaagacuccgucu

SEQ ID NO: 498645 - RNA, 32 nt, Human
uccagccugggcgacaaagcaagacucugucu

SEQ ID NO: 498646 - RNA, 22 nt, Human
uccagccugggcgacaaagcga

SEQ ID NO: 498647 - RNA, 24 nt, Human
uccagccugggcgacaaagcgaga

SEQ ID NO: 498648 - RNA, 24 nt, Human
uccagccugggcgacaaagugaga

SEQ ID NO: 498649 - RNA, 23 nt, Human
uccagccugggcgacaagagcaa

SEQ ID NO: 498650 - RNA, 25 nt, Human
uccagccugggcgacaagagcaaga

SEQ ID NO: 498651 - RNA, 23 nt, Human
uccagccugggcgacaagagcga

SEQ ID NO: 498652 - RNA, 24 nt, Human
uccagccugggcgacaagagcgag

SEQ ID NO: 498653 - RNA, 25 nt, Human
uccagccugggcgacaagagcgaga

SEQ ID NO: 498654 - RNA, 23 nt, Human
uccagccugggcgacaagaggga

SEQ ID NO: 498655 - RNA, 24 nt, Human
uccagccugggcgacaagagggag

SEQ ID NO: 498656 - RNA, 23 nt, Human
uccagccugggcgacaagaguga

SEQ ID NO: 498657 - RNA, 24 nt, Human
uccagccugggcgacacagcaaga

SEQ ID NO: 498658 - RNA, 32 nt, Human
uccagccugggcgacacagcaagacuccgucu

SEQ ID NO: 498659 - RNA, 24 nt, Human
uccagccugggcgacacagcgaga

SEQ ID NO: 498660 - RNA, 24 nt, Human
uccagccugggcgacagaacaaga

SEQ ID NO: 498661 - RNA, 24 nt, Human
uccagccugggcgacagaacgaga

SEQ ID NO: 498662 - RNA, 21 nt, Human
uccagccugggcgacagaagu

SEQ ID NO: 498663 - RNA, 24 nt, Human
uccagccugggcgacagaaugaga

SEQ ID NO: 498664 - RNA, 32 nt, Human
uccagccugggcgacagaaugagacccugucu

SEQ ID NO: 498665 - RNA, 32 nt, Human
uccagccugggcgacagaaugagacuccaucu

SEQ ID NO: 498666 - RNA, 32 nt, Human
uccagccugggcgacagaaugagacucugucu

SEQ ID NO: 498667 - RNA, 24 nt, Human
uccagccugggcgacagaccgaga

SEQ ID NO: 498668 - RNA, 19 nt, Human
uccagccugggcgacagag

SEQ ID NO: 498669 - RNA, 32 nt, Human
uccagccugggcgacagagaaccucucuaaaa

SEQ ID NO: 498670 - RNA, 24 nt, Human
uccagccugggcgacagagagaga

SEQ ID NO: 498671 - RNA, 22 nt, Human
uccagccugggcgacagagcaa

SEQ ID NO: 498672 - RNA, 24 nt, Human
uccagccugggcgacagagcaaga

SEQ ID NO: 498673 - RNA, 32 nt, Human
uccagccugggcgacagagcaagacacugucu

SEQ ID NO: 498674 - RNA, 32 nt, Human
uccagccugggcgacagagcaagacccugcuu

SEQ ID NO: 498675 - RNA, 32 nt, Human
uccagccugggcgacagagcaagacccugucu

SEQ ID NO: 498676 - RNA, 32 nt, Human
uccagccugggcgacagagcaagacgccaucu

SEQ ID NO: 498677 - RNA, 32 nt, Human
uccagccugggcgacagagcaagacucagucu

SEQ ID NO: 498678 - RNA, 32 nt, Human
uccagccugggcgacagagcaagacuccaccu

SEQ ID NO: 498679 - RNA, 32 nt, Human
uccagccugggcgacagagcaagacuccaucu

SEQ ID NO: 498680 - RNA, 32 nt, Human
uccagccugggcgacagagcaagacuccauuu

SEQ ID NO: 498681 - RNA, 32 nt, Human
uccagccugggcgacagagcaagacucccucu

SEQ ID NO: 498682 - RNA, 32 nt, Human
uccagccugggcgacagagcaagacuccgucu

SEQ ID NO: 498683 - RNA, 32 nt, Human
uccagccugggcgacagagcaagacuccuucu

SEQ ID NO: 498684 - RNA, 32 nt, Human
uccagccugggcgacagagcaagacucggucu

SEQ ID NO: 498685 - RNA, 31 nt, Human
uccagccugggcgacagagcaagacucucuc

SEQ ID NO: 498686 - RNA, 32 nt, Human
uccagccugggcgacagagcaagacucucuca

SEQ ID NO: 498687 - RNA, 32 nt, Human
uccagccugggcgacagagcaagacucugucu

SEQ ID NO: 498688 - RNA, 32 nt, Human
uccagccugggcgacagagcaagaucguuucu

SEQ ID NO: 498689 - RNA, 32 nt, Human
uccagccugggcgacagagcaagauuccguuc

SEQ ID NO: 498690 - RNA, 24 nt, Human
uccagccugggcgacagagcaagg

SEQ ID NO: 498691 - RNA, 32 nt, Human
uccagccugggcgacagagcaaggcucugucu

SEQ ID NO: 498692 - RNA, 32 nt, Human
uccagccugggcgacagagcaagucucaaaaa

SEQ ID NO: 498693 - RNA, 32 nt, Human
uccagccugggcgacagagcaauacucccguc

SEQ ID NO: 498694 - RNA, 32 nt, Human
uccagccugggcgacagagcaauacucuuuau

SEQ ID NO: 498695 - RNA, 32 nt, Human
uccagccugggcgacagagcacgacuucaucu

SEQ ID NO: 498696 - RNA, 24 nt, Human
uccagccugggcgacagagcagga

SEQ ID NO: 498697 - RNA, 32 nt, Human
uccagccugggcgacagagcaggacuccaucu

SEQ ID NO: 498698 - RNA, 32 nt, Human
uccagccugggcgacagagcaggacucucucu

SEQ ID NO: 498699 - RNA, 32 nt, Human
uccagccugggcgacagagcaggacucuuucu

SEQ ID NO: 498700 - RNA, 24 nt, Human
uccagccugggcgacagagccaga

SEQ ID NO: 498701 - RNA, 32 nt, Human
uccagccugggcgacagagccagacucaaucu

SEQ ID NO: 498702 - RNA, 32 nt, Human
uccagccugggcgacagagccagacuccaucu

SEQ ID NO: 498703 - RNA, 32 nt, Human
uccagccugggcgacagagccagacuccgacu

SEQ ID NO: 498704 - RNA, 32 nt, Human
uccagccugggcgacagagccagacuccgucu

SEQ ID NO: 498705 - RNA, 32 nt, Human
uccagccugggcgacagagccagacucuuguc

SEQ ID NO: 498706 - RNA, 32 nt, Human
uccagccugggcgacagagccagacugucuca

SEQ ID NO: 498707 - RNA, 22 nt, Human
uccagccugggcgacagagcga

SEQ ID NO: 498708 - RNA, 32 nt, Human
uccagccugggcgacagagcgaaacuccgucu

SEQ ID NO: 498709 - RNA, 24 nt, Human
uccagccugggcgacagagcgaga

SEQ ID NO: 498710 - RNA, 32 nt, Human
uccagccugggcgacagagcgagaccccaucu

SEQ ID NO: 498711 - RNA, 32 nt, Human
uccagccugggcgacagagcgagacuccaucu

SEQ ID NO: 498712 - RNA, 32 nt, Human
uccagccugggcgacagagcgagacuccgccu

SEQ ID NO: 498713 - RNA, 32 nt, Human
uccagccugggcgacagagcgagacuccgucu

SEQ ID NO: 498714 - RNA, 32 nt, Human
uccagccugggcgacagagcgagacuccgugg

SEQ ID NO: 498715 - RNA, 32 nt, Human
uccagccugggcgacagagcgagacucugucu

SEQ ID NO: 498716 - RNA, 32 nt, Human
uccagccugggcgacagagcgagacucugugu

SEQ ID NO: 498717 - RNA, 32 nt, Human
uccagccugggcgacagagcgagacugucuca

SEQ ID NO: 498718 - RNA, 32 nt, Human
uccagccugggcgacagagcgagacuucgucu

SEQ ID NO: 498719 - RNA, 32 nt, Human
uccagccugggcgacagagcgagacuuuggcu

SEQ ID NO: 498720 - RNA, 32 nt, Human
uccagccugggcgacagagcgagaguuugucu

SEQ ID NO: 498721 - RNA, 32 nt, Human
uccagccugggcgacagagcgagauuccgucu

SEQ ID NO: 498722 - RNA, 32 nt, Human
uccagccugggcgacagagcgagauucugucu

SEQ ID NO: 498723 - RNA, 24 nt, Human
uccagccugggcgacagagcuaga

SEQ ID NO: 498724 - RNA, 32 nt, Human
uccagccugggcgacagagcuagacuccgucu

SEQ ID NO: 498725 - RNA, 24 nt, Human
uccagccugggcgacagagggaga

SEQ ID NO: 498726 - RNA, 24 nt, Human
uccagccugggcgacagaggguga

SEQ ID NO: 498727 - RNA, 20 nt, Human
uccagccugggcgacagagu

SEQ ID NO: 498728 - RNA, 24 nt, Human
uccagccugggcgacagaguaaga

SEQ ID NO: 498729 - RNA, 22 nt, Human
uccagccugggcgacagaguga

SEQ ID NO: 498730 - RNA, 24 nt, Human
uccagccugggcgacagagugaga

SEQ ID NO: 498731 - RNA, 32 nt, Human
uccagccugggcgacagagugagacccagacu

SEQ ID NO: 498732 - RNA, 32 nt, Human
uccagccugggcgacagagugagaccccaucu

SEQ ID NO: 498733 - RNA, 32 nt, Human
uccagccugggcgacagagugagacccugccu

SEQ ID NO: 498734 - RNA, 24 nt, Human
uccagccugggcgacagagugagg

SEQ ID NO: 498735 - RNA, 22 nt, Human
uccagccugggcgacagagugg

SEQ ID NO: 498736 - RNA, 22 nt, Human
uccagccugggcgacagcaaga

SEQ ID NO: 498737 - RNA, 24 nt, Human
uccagccugggcgacagggcaaga

SEQ ID NO: 498738 - RNA, 32 nt, Human
uccagccugggcgacagggcaagacucugucu

SEQ ID NO: 498739 - RNA, 24 nt, Human
uccagccugggcgacagggugaga

SEQ ID NO: 498740 - RNA, 24 nt, Human
uccagccugggcgacaguaccaga

SEQ ID NO: 498741 - RNA, 20 nt, Human
uccagccugggcgacaguga

SEQ ID NO: 498742 - RNA, 24 nt, Human
uccagccugggcgacagugcaaga

SEQ ID NO: 498743 - RNA, 32 nt, Human
uccagccugggcgacagugcaagacucugucu

SEQ ID NO: 498744 - RNA, 22 nt, Human
uccagccugggcgacaucuaga

SEQ ID NO: 498745 - RNA, 21 nt, Human
uccagccugggcgacgagcaa

SEQ ID NO: 498746 - RNA, 21 nt, Human
uccagccugggcgacgaguga

SEQ ID NO: 498747 - RNA, 24 nt, Human
uccagccugggcgacggagcgaga

SEQ ID NO: 498748 - RNA, 24 nt, Human
uccagccugggcgacggagugaga

SEQ ID NO: 498749 - RNA, 22 nt, Human
uccagccugggcgacugugaga

SEQ ID NO: 498750 - RNA, 24 nt, Human
uccagccugggcgagacggcaaga

SEQ ID NO: 498751 - RNA, 32 nt, Human
uccagccugggcgagagaaugagacucuaucu

SEQ ID NO: 498752 - RNA, 32 nt, Human
uccagccugggcgagagagcaagacuccaucu

SEQ ID NO: 498753 - RNA, 24 nt, Human
uccagccugggcgauagagcaaga

SEQ ID NO: 498754 - RNA, 32 nt, Human
uccagccugggcgauagagcaagacucugucu

SEQ ID NO: 498755 - RNA, 24 nt, Human
uccagccugggcgauagagcuaga

SEQ ID NO: 498756 - RNA, 24 nt, Human
uccagccugggcgauagagggaga

SEQ ID NO: 498757 - RNA, 24 nt, Human
uccagccugggcgauagagugaga

SEQ ID NO: 498758 - RNA, 21 nt, Human
uccagccugggcgaugagcaa

SEQ ID NO: 498759 - RNA, 32 nt, Human
uccagccugggcgauggagcaagacucagucu

SEQ ID NO: 498760 - RNA, 32 nt, Human
uccagccugggcgauggagcaagacuccaucu

SEQ ID NO: 498761 - RNA, 24 nt, Human
uccagccugggcgauggagcgaga

SEQ ID NO: 498762 - RNA, 24 nt, Human
uccagccugggcgauggagugaga

SEQ ID NO: 498763 - RNA, 21 nt, Human
uccagccugggcggagccgga

SEQ ID NO: 498764 - RNA, 22 nt, Human
uccagccugggcggcagagcaa

SEQ ID NO: 498765 - RNA, 32 nt, Human
uccagccugggcggcagagcaaaacugaaaaa

SEQ ID NO: 498766 - RNA, 24 nt, Human
uccagccugggcggcagagcaaga

SEQ ID NO: 498767 - RNA, 32 nt, Human
uccagccugggcggcagagcaagacucccucu

SEQ ID NO: 498768 - RNA, 32 nt, Human
uccagccugggcggcagagcaagacuccgucu

SEQ ID NO: 498769 - RNA, 32 nt, Human
uccagccugggcggcagagcaagacucuguau

SEQ ID NO: 498770 - RNA, 32 nt, Human
uccagccugggcggcagagcaagauucugucu

SEQ ID NO: 498771 - RNA, 24 nt, Human
uccagccugggcggcagagugaga

SEQ ID NO: 498772 - RNA, 24 nt, Human
uccagccugggcgucagagugaga

SEQ ID NO: 498773 - RNA, 24 nt, Human
uccagccugggcuacaaagcagga

SEQ ID NO: 498774 - RNA, 24 nt, Human
uccagccugggcuacagagcaaga

SEQ ID NO: 498775 - RNA, 32 nt, Human
uccagccugggcuacagagcaagacuccaccu

SEQ ID NO: 498776 - RNA, 24 nt, Human
uccagccugggcuacagagcgaga

SEQ ID NO: 498777 - RNA, 20 nt, Human
uccagccugggcuacagagu

SEQ ID NO: 498778 - RNA, 24 nt, Human
uccagccugggcuacagagugaga

SEQ ID NO: 498779 - RNA, 24 nt, Human
uccagccugggcuacauagugaga

SEQ ID NO: 498780 - RNA, 22 nt, Human
uccagccugggcucaaaaaaga

SEQ ID NO: 498781 - RNA, 21 nt, Human
uccagccugggcuccgcagga

SEQ ID NO: 498782 - RNA, 29 nt, Human
uccagccugggcuucagagcaagacucgg

SEQ ID NO: 498783 - RNA, 24 nt, Human
uccagccuggggaacagagcaaga

SEQ ID NO: 498784 - RNA, 32 nt, Human
uccagccuggggaacagagcaagacugucuca

SEQ ID NO: 498785 - RNA, 32 nt, Human
uccagccuggggaacagagcaagauucugucu

SEQ ID NO: 498786 - RNA, 23 nt, Human
uccagccuggggacagagcaaga

SEQ ID NO: 498787 - RNA, 25 nt, Human
uccagccuggggagacagagcgaga

SEQ ID NO: 498788 - RNA, 26 nt, Human
uccagccuggggcugacagagcaaga

SEQ ID NO: 498789 - RNA, 24 nt, Human
uccagccuggggcugaggcugagg

SEQ ID NO: 498790 - RNA, 22 nt, Human
uccagccugggggaaagaguga

SEQ ID NO: 498791 - RNA, 25 nt, Human
uccagccugggggacaagagugaga

SEQ ID NO: 498792 - RNA, 22 nt, Human
uccagccugggggacagaaaga

SEQ ID NO: 498793 - RNA, 24 nt, Human
uccagccugggggacagagcaaga

SEQ ID NO: 498794 - RNA, 32 nt, Human
uccagccugggggacagagcaagacccugccu

SEQ ID NO: 498795 - RNA, 32 nt, Human
uccagccugggggacagagcaagaccgugucu

SEQ ID NO: 498796 - RNA, 32 nt, Human
uccagccugggggacagagcaagacucuaucu

SEQ ID NO: 498797 - RNA, 32 nt, Human
uccagccugggggacagagcaagacuguuguc

SEQ ID NO: 498798 - RNA, 24 nt, Human
uccagccugggggacagagcaagg

SEQ ID NO: 498799 - RNA, 32 nt, Human
uccagccugggggacagagcaaggcuccgucu

SEQ ID NO: 498800 - RNA, 24 nt, Human
uccagccugggggacagagcacga

SEQ ID NO: 498801 - RNA, 24 nt, Human
uccagccugggggacagagcgaga

SEQ ID NO: 498802 - RNA, 32 nt, Human
uccagccugggggacagagcgagacuccgucu

SEQ ID NO: 498803 - RNA, 32 nt, Human
uccagccugggggacagagcgagacucugccu

SEQ ID NO: 498804 - RNA, 24 nt, Human
uccagccugggggacagagugaga

SEQ ID NO: 498805 - RNA, 32 nt, Human
uccagccugggggacagagugagacccugucu

SEQ ID NO: 498806 - RNA, 24 nt, Human
uccagccuggggugacagagcaag

SEQ ID NO: 498807 - RNA, 25 nt, Human
uccagccuggggugauagaacaaga

SEQ ID NO: 498808 - RNA, 24 nt, Human
uccagccuggguaaaagagugaga

SEQ ID NO: 498809 - RNA, 23 nt, Human
uccagccuggguaacaagagcaa

SEQ ID NO: 498810 - RNA, 21 nt, Human
uccagccuggguaacagacgc

SEQ ID NO: 498811 - RNA, 24 nt, Human
uccagccuggguaacagagcaaga

SEQ ID NO: 498812 - RNA, 32 nt, Human
uccagccuggguaacagagcaagaccaugucu

SEQ ID NO: 498813 - RNA, 32 nt, Human
uccagccuggguaacagagcaagacuccaucu

SEQ ID NO: 498814 - RNA, 32 nt, Human
uccagccuggguaacagagcaagacucugucu

SEQ ID NO: 498815 - RNA, 31 nt, Human
uccagccuggguaacagagcaagagucuguc

SEQ ID NO: 498816 - RNA, 24 nt, Human
uccagccuggguaacagagcgaga

SEQ ID NO: 498817 - RNA, 24 nt, Human
uccagccuggguaacagagcuaga

SEQ ID NO: 498818 - RNA, 24 nt, Human
uccagccuggguaacagagugaga

SEQ ID NO: 498819 - RNA, 25 nt, Human
uccagccugggucagaagggguggg

SEQ ID NO: 498820 - RNA, 32 nt, Human
uccagccugggugaaagagcgagacuccaucu

SEQ ID NO: 498821 - RNA, 24 nt, Human
uccagccugggugaaagagcuaga

SEQ ID NO: 498822 - RNA, 32 nt, Human
uccagccugggugaaagagcuagauucucucu

SEQ ID NO: 498823 - RNA, 24 nt, Human
uccagccugggugaaggagugaga

SEQ ID NO: 498824 - RNA, 32 nt, Human
uccagccugggugaaggagugagacccugucu

SEQ ID NO: 498825 - RNA, 24 nt, Human
uccagccugggugacaaagcaaga

SEQ ID NO: 498826 - RNA, 32 nt, Human
uccagccugggugacaaagcaagacuccaucu

SEQ ID NO: 498827 - RNA, 32 nt, Human
uccagccugggugacaaagcaagacugugucu

SEQ ID NO: 498828 - RNA, 32 nt, Human
uccagccugggugacaaagcaagauucugucu

SEQ ID NO: 498829 - RNA, 32 nt, Human
uccagccugggugacaaagcaaggcccugucu

SEQ ID NO: 498830 - RNA, 32 nt, Human
uccagccugggugacaaagcgagacuccaucu

SEQ ID NO: 498831 - RNA, 23 nt, Human
uccagccugggugacaaaggaga

SEQ ID NO: 498832 - RNA, 24 nt, Human
uccagccugggugacaaaguaaga

SEQ ID NO: 498833 - RNA, 32 nt, Human
uccagccugggugacaaaguaagacccugccu

SEQ ID NO: 498834 - RNA, 24 nt, Human
uccagccugggugacaaagucaga

SEQ ID NO: 498835 - RNA, 32 nt, Human
uccagccugggugacaaagucagacuccaucu

SEQ ID NO: 498836 - RNA, 24 nt, Human
uccagccugggugacaaagugaga

SEQ ID NO: 498837 - RNA, 32 nt, Human
uccagccugggugacaaagugagacuccaucu

SEQ ID NO: 498838 - RNA, 32 nt, Human
uccagccugggugacaaagugagacuccguca

SEQ ID NO: 498839 - RNA, 32 nt, Human
uccagccugggugacaaagugagacucuaucu

SEQ ID NO: 498840 - RNA, 21 nt, Human
uccagccugggugacaagagc

SEQ ID NO: 498841 - RNA, 23 nt, Human
uccagccugggugacaagagcaa

SEQ ID NO: 498842 - RNA, 32 nt, Human
uccagccugggugacaagagcaaaacuccauc

SEQ ID NO: 498843 - RNA, 32 nt, Human
uccagccugggugacaagagcaaaacucuguc

SEQ ID NO: 498844 - RNA, 25 nt, Human
uccagccugggugacaagagcaaga

SEQ ID NO: 498845 - RNA, 32 nt, Human
uccagccugggugacaagagcaagacuccgug

SEQ ID NO: 498846 - RNA, 23 nt, Human
uccagccugggugacaagagcga

SEQ ID NO: 498847 - RNA, 32 nt, Human
uccagccugggugacaagagcgaaacuccauc

SEQ ID NO: 498848 - RNA, 23 nt, Human
uccagccugggugacaagaguga

SEQ ID NO: 498849 - RNA, 32 nt, Human
uccagccugggugacaagagugaaacuccauc

SEQ ID NO: 498850 - RNA, 25 nt, Human
uccagccugggugacaagagugaga

SEQ ID NO: 498851 - RNA, 32 nt, Human
uccagccugggugacaagagugagacuccguc

SEQ ID NO: 498852 - RNA, 32 nt, Human
uccagccugggugacaagagugagacucuguc

SEQ ID NO: 498853 - RNA, 24 nt, Human
uccagccugggugacaagggaaga

SEQ ID NO: 498854 - RNA, 32 nt, Human
uccagccugggugacaagggaagacucucucu

SEQ ID NO: 498855 - RNA, 32 nt, Human
uccagccugggugacacagcaagacucugucu

SEQ ID NO: 498856 - RNA, 32 nt, Human
uccagccugggugacacagcgacacucugucu

SEQ ID NO: 498857 - RNA, 24 nt, Human
uccagccugggugacacagcgaga

SEQ ID NO: 498858 - RNA, 32 nt, Human
uccagccugggugacacagcgagacuccgucu

SEQ ID NO: 498859 - RNA, 32 nt, Human
uccagccugggugacacagcgagacucugucu

SEQ ID NO: 498860 - RNA, 24 nt, Human
uccagccugggugacacagugaga

SEQ ID NO: 498861 - RNA, 32 nt, Human
uccagccugggugacacagugagacccugucc

SEQ ID NO: 498862 - RNA, 32 nt, Human
uccagccugggugacacagugagacuccaucu

SEQ ID NO: 498863 - RNA, 24 nt, Human
uccagccugggugacagaacaaga

SEQ ID NO: 498864 - RNA, 32 nt, Human
uccagccugggugacagaacaagacucugucu

SEQ ID NO: 498865 - RNA, 32 nt, Human
uccagccugggugacagaacaagacugucuca

SEQ ID NO: 498866 - RNA, 24 nt, Human
uccagccugggugacagaacgaga

SEQ ID NO: 498867 - RNA, 32 nt, Human
uccagccugggugacagaacgagacccugucu

SEQ ID NO: 498868 - RNA, 32 nt, Human
uccagccugggugacagaacgagacuccaccu

SEQ ID NO: 498869 - RNA, 32 nt, Human
uccagccugggugacagaacgagacuccgucu

SEQ ID NO: 498870 - RNA, 24 nt, Human
uccagccugggugacagaauaaga

SEQ ID NO: 498871 - RNA, 22 nt, Human
uccagccugggugacagaauga

SEQ ID NO: 498872 - RNA, 24 nt, Human
uccagccugggugacagaaugaga

SEQ ID NO: 498873 - RNA, 32 nt, Human
uccagccugggugacagaaugagacccuguca

SEQ ID NO: 498874 - RNA, 32 nt, Human
uccagccugggugacagaaugagacuccaucc

SEQ ID NO: 498875 - RNA, 32 nt, Human
uccagccugggugacagaaugaggcucccguc

SEQ ID NO: 498876 - RNA, 24 nt, Human
uccagccugggugacagaccgaga

SEQ ID NO: 498877 - RNA, 32 nt, Human
uccagccugggugacagaccgagacucugucu

SEQ ID NO: 498878 - RNA, 24 nt, Human
uccagccugggugacagacuaaga

SEQ ID NO: 498879 - RNA, 32 nt, Human
uccagccugggugacagacuaagacuccgucu

SEQ ID NO: 498880 - RNA, 19 nt, Human
uccagccugggugacagag

SEQ ID NO: 498881 - RNA, 23 nt, Human
uccagccugggugacagagacag

SEQ ID NO: 498882 - RNA, 32 nt, Human
uccagccugggugacagagacagugagacucu

SEQ ID NO: 498883 - RNA, 22 nt, Human
uccagccugggugacagagaga

SEQ ID NO: 498884 - RNA, 32 nt, Human
uccagccugggugacagagagacucugucuca

SEQ ID NO: 498885 - RNA, 24 nt, Human
uccagccugggugacagagagaga

SEQ ID NO: 498886 - RNA, 32 nt, Human
uccagccugggugacagagagagacccugucu

SEQ ID NO: 498887 - RNA, 32 nt, Human
uccagccugggugacagagagagacuccaucu

SEQ ID NO: 498888 - RNA, 32 nt, Human
uccagccugggugacagagagagacuccgucu

SEQ ID NO: 498889 - RNA, 32 nt, Human
uccagccugggugacagagagagacuccgugu

SEQ ID NO: 498890 - RNA, 32 nt, Human
uccagccugggugacagagagauacccugucu

SEQ ID NO: 498891 - RNA, 20 nt, Human
uccagccugggugacagagc

SEQ ID NO: 498892 - RNA, 22 nt, Human
uccagccugggugacagagcaa

SEQ ID NO: 498893 - RNA, 32 nt, Human
uccagccugggugacagagcaaacucucucuu

SEQ ID NO: 498894 - RNA, 32 nt, Human
uccagccugggugacagagcaacacugugucu

SEQ ID NO: 498895 - RNA, 24 nt, Human
uccagccugggugacagagcaaga

SEQ ID NO: 498896 - RNA, 32 nt, Human
uccagccugggugacagagcaagaaaauaaua

SEQ ID NO: 498897 - RNA, 32 nt, Human
uccagccugggugacagagcaagaaucauucu

SEQ ID NO: 498898 - RNA, 32 nt, Human
uccagccugggugacagagcaagacauaaaag

SEQ ID NO: 498899 - RNA, 32 nt, Human
uccagccugggugacagagcaagacccugucu

SEQ ID NO: 498900 - RNA, 32 nt, Human
uccagccugggugacagagcaagacccuguuu

SEQ ID NO: 498901 - RNA, 32 nt, Human
uccagccugggugacagagcaagaccugucac

SEQ ID NO: 498902 - RNA, 32 nt, Human
uccagccugggugacagagcaagacuccaucu

SEQ ID NO: 498903 - RNA, 32 nt, Human
uccagccugggugacagagcaagacuccauuu

SEQ ID NO: 498904 - RNA, 32 nt, Human
uccagccugggugacagagcaagacucccucu

SEQ ID NO: 498905 - RNA, 32 nt, Human
uccagccugggugacagagcaagacuccgucu

SEQ ID NO: 498906 - RNA, 32 nt, Human
uccagccugggugacagagcaagacucucucu

SEQ ID NO: 498907 - RNA, 32 nt, Human
uccagccugggugacagagcaagacucucuuu

SEQ ID NO: 498908 - RNA, 32 nt, Human
uccagccugggugacagagcaagacucugccu

SEQ ID NO: 498909 - RNA, 32 nt, Human
uccagccugggugacagagcaagacucuguau

SEQ ID NO: 498910 - RNA, 32 nt, Human
uccagccugggugacagagcaagacucugucu

SEQ ID NO: 498911 - RNA, 32 nt, Human
uccagccugggugacagagcaagacugcguuu

SEQ ID NO: 498912 - RNA, 32 nt, Human
uccagccugggugacagagcaagacuucauaa

SEQ ID NO: 498913 - RNA, 32 nt, Human
uccagccugggugacagagcaagacuuggucu

SEQ ID NO: 498914 - RNA, 32 nt, Human
uccagccugggugacagagcaagagacccugu

SEQ ID NO: 498915 - RNA, 32 nt, Human
uccagccugggugacagagcaagagucugucu

SEQ ID NO: 498916 - RNA, 32 nt, Human
uccagccugggugacagagcaagaucuugucu

SEQ ID NO: 498917 - RNA, 32 nt, Human
uccagccugggugacagagcaagauuccgugg

SEQ ID NO: 498918 - RNA, 24 nt, Human
uccagccugggugacagagcaagg

SEQ ID NO: 498919 - RNA, 32 nt, Human
uccagccugggugacagagcaaggcucccauc

SEQ ID NO: 498920 - RNA, 32 nt, Human
uccagccugggugacagagcaaggcucugucu

SEQ ID NO: 498921 - RNA, 32 nt, Human
uccagccugggugacagagcaauacccugucu

SEQ ID NO: 498922 - RNA, 28 nt, Human
uccagccugggugacagagcagacucca

SEQ ID NO: 498923 - RNA, 24 nt, Human
uccagccugggugacagagcagga

SEQ ID NO: 498924 - RNA, 32 nt, Human
uccagccugggugacagagcaggacccugucu

SEQ ID NO: 498925 - RNA, 32 nt, Human
uccagccugggugacagagccacuccgucuca

SEQ ID NO: 498926 - RNA, 24 nt, Human
uccagccugggugacagagccaga

SEQ ID NO: 498927 - RNA, 32 nt, Human
uccagccugggugacagagccagacacugucu

SEQ ID NO: 498928 - RNA, 32 nt, Human
uccagccugggugacagagccagaccccgucc

SEQ ID NO: 498929 - RNA, 32 nt, Human
uccagccugggugacagagccagacuccaucu

SEQ ID NO: 498930 - RNA, 32 nt, Human
uccagccugggugacagagccagacuccgucu

SEQ ID NO: 498931 - RNA, 32 nt, Human
uccagccugggugacagagccagacucugucc

SEQ ID NO: 498932 - RNA, 32 nt, Human
uccagccugggugacagagccagacucugucu

SEQ ID NO: 498933 - RNA, 32 nt, Human
uccagccugggugacagagcgacccucugucu

SEQ ID NO: 498934 - RNA, 24 nt, Human
uccagccugggugacagagcgaga

SEQ ID NO: 498935 - RNA, 32 nt, Human
uccagccugggugacagagcgagaaucagucu

SEQ ID NO: 498936 - RNA, 32 nt, Human
uccagccugggugacagagcgagaccaugucu

SEQ ID NO: 498937 - RNA, 32 nt, Human
uccagccugggugacagagcgagacccagacu

SEQ ID NO: 498938 - RNA, 32 nt, Human
uccagccugggugacagagcgagaccccaucu

SEQ ID NO: 498939 - RNA, 32 nt, Human
uccagccugggugacagagcgagacccuauuc

SEQ ID NO: 498940 - RNA, 32 nt, Human
uccagccugggugacagagcgagacccugucu

SEQ ID NO: 498941 - RNA, 32 nt, Human
uccagccugggugacagagcgagaccgucuca

SEQ ID NO: 498942 - RNA, 32 nt, Human
uccagccugggugacagagcgagacuaucuca

SEQ ID NO: 498943 - RNA, 32 nt, Human
uccagccugggugacagagcgagacucagucu

SEQ ID NO: 498944 - RNA, 32 nt, Human
uccagccugggugacagagcgagacuccaucu

SEQ ID NO: 498945 - RNA, 32 nt, Human
uccagccugggugacagagcgagacuccauuu

SEQ ID NO: 498946 - RNA, 32 nt, Human
uccagccugggugacagagcgagacuccguau

SEQ ID NO: 498947 - RNA, 32 nt, Human
uccagccugggugacagagcgagacuccgucu

SEQ ID NO: 498948 - RNA, 32 nt, Human
uccagccugggugacagagcgagacucuggcu

SEQ ID NO: 498949 - RNA, 32 nt, Human
uccagccugggugacagagcgagacucugucu

SEQ ID NO: 498950 - RNA, 32 nt, Human
uccagccugggugacagagcgagacucuguuu

SEQ ID NO: 498951 - RNA, 31 nt, Human
uccagccugggugacagagcgagacugucuc

SEQ ID NO: 498952 - RNA, 32 nt, Human
uccagccugggugacagagcgagacugucuca

SEQ ID NO: 498953 - RNA, 32 nt, Human
uccagccugggugacagagcgagacuguguuu

SEQ ID NO: 498954 - RNA, 32 nt, Human
uccagccugggugacagagcgagacuuauaga

SEQ ID NO: 498955 - RNA, 32 nt, Human
uccagccugggugacagagcgagacuuaucuc

SEQ ID NO: 498956 - RNA, 32 nt, Human
uccagccugggugacagagcgagacuuugucc

SEQ ID NO: 498957 - RNA, 24 nt, Human
uccagccugggugacagagcgagg

SEQ ID NO: 498958 - RNA, 25 nt, Human
uccagccugggugacagagcgaggc

SEQ ID NO: 498959 - RNA, 24 nt, Human
uccagccugggugacagagcguga

SEQ ID NO: 498960 - RNA, 32 nt, Human
uccagccugggugacagagcgugagacuccgu

SEQ ID NO: 498961 - RNA, 24 nt, Human
uccagccugggugacagagcuaga

SEQ ID NO: 498962 - RNA, 32 nt, Human
uccagccugggugacagagcuagacucugucu

SEQ ID NO: 498963 - RNA, 32 nt, Human
uccagccugggugacagaggaagacucagaau

SEQ ID NO: 498964 - RNA, 22 nt, Human
uccagccugggugacagaggga

SEQ ID NO: 498965 - RNA, 32 nt, Human
uccagccugggugacagagggaaacuccaucu

SEQ ID NO: 498966 - RNA, 24 nt, Human
uccagccugggugacagagggaga

SEQ ID NO: 498967 - RNA, 32 nt, Human
uccagccugggugacagagggagacuccaucu

SEQ ID NO: 498968 - RNA, 32 nt, Human
uccagccugggugacagagggagacuccgucc

SEQ ID NO: 498969 - RNA, 32 nt, Human
uccagccugggugacagagggagacuccgucu

SEQ ID NO: 498970 - RNA, 32 nt, Human
uccagccugggugacagagggagacucugucu

SEQ ID NO: 498971 - RNA, 20 nt, Human
uccagccugggugacagagu

SEQ ID NO: 498972 - RNA, 22 nt, Human
uccagccugggugacagaguaa

SEQ ID NO: 498973 - RNA, 32 nt, Human
uccagccugggugacagaguaacacucugucu

SEQ ID NO: 498974 - RNA, 24 nt, Human
uccagccugggugacagaguaaga

SEQ ID NO: 498975 - RNA, 32 nt, Human
uccagccugggugacagaguaagacccugucu

SEQ ID NO: 498976 - RNA, 32 nt, Human
uccagccugggugacagaguaagacuccaugu

SEQ ID NO: 498977 - RNA, 32 nt, Human
uccagccugggugacagaguaagacuccgucu

SEQ ID NO: 498978 - RNA, 32 nt, Human
uccagccugggugacagaguaagacucugucu

SEQ ID NO: 498979 - RNA, 32 nt, Human
uccagccugggugacagaguaauacucgguuu

SEQ ID NO: 498980 - RNA, 32 nt, Human
uccagccugggugacagaguaggacccugucu

SEQ ID NO: 498981 - RNA, 24 nt, Human
uccagccugggugacagagucaga

SEQ ID NO: 498982 - RNA, 32 nt, Human
uccagccugggugacagagucagacccuaucu

SEQ ID NO: 498983 - RNA, 32 nt, Human
uccagccugggugacagagucagacccugucu

SEQ ID NO: 498984 - RNA, 22 nt, Human
uccagccugggugacagaguga

SEQ ID NO: 498985 - RNA, 23 nt, Human
uccagccugggugacagagugag

SEQ ID NO: 498986 - RNA, 24 nt, Human
uccagccugggugacagagugaga

SEQ ID NO: 498987 - RNA, 32 nt, Human
uccagccugggugacagagugagacaccaucu

SEQ ID NO: 498988 - RNA, 32 nt, Human
uccagccugggugacagagugagaccccaucu

SEQ ID NO: 498989 - RNA, 32 nt, Human
uccagccugggugacagagugagacccccacu

SEQ ID NO: 498990 - RNA, 32 nt, Human
uccagccugggugacagagugagacccuauuu

SEQ ID NO: 498991 - RNA, 32 nt, Human
uccagccugggugacagagugagacccugccu

SEQ ID NO: 498992 - RNA, 32 nt, Human
uccagccugggugacagagugagacccuggcu

SEQ ID NO: 498993 - RNA, 32 nt, Human
uccagccugggugacagagugagacccugucc

SEQ ID NO: 498994 - RNA, 32 nt, Human
uccagccugggugacagagugagacccugucu

SEQ ID NO: 498995 - RNA, 32 nt, Human
uccagccugggugacagagugagacccuguuc

SEQ ID NO: 498996 - RNA, 32 nt, Human
uccagccugggugacagagugagaccucauuu

SEQ ID NO: 498997 - RNA, 32 nt, Human
uccagccugggugacagagugagacucagucu

SEQ ID NO: 498998 - RNA, 32 nt, Human
uccagccugggugacagagugagacuccaacu

SEQ ID NO: 498999 - RNA, 32 nt, Human
uccagccugggugacagagugagacuccaccu

SEQ ID NO: 499000 - RNA, 32 nt, Human
uccagccugggugacagagugagacuccauca

SEQ ID NO: 499001 - RNA, 32 nt, Human
uccagccugggugacagagugagacuccaucu

SEQ ID NO: 499002 - RNA, 32 nt, Human
uccagccugggugacagagugagacuccgucu

SEQ ID NO: 499003 - RNA, 32 nt, Human
uccagccugggugacagagugagacuccgugu

SEQ ID NO: 499004 - RNA, 32 nt, Human
uccagccugggugacagagugagacucugucu

SEQ ID NO: 499005 - RNA, 32 nt, Human
uccagccugggugacagagugagacucuguuu

SEQ ID NO: 499006 - RNA, 32 nt, Human
uccagccugggugacagagugagacucuuguc

SEQ ID NO: 499007 - RNA, 32 nt, Human
uccagccugggugacagagugagacugucuca

SEQ ID NO: 499008 - RNA, 32 nt, Human
uccagccugggugacagagugagacuuugucu

SEQ ID NO: 499009 - RNA, 32 nt, Human
uccagccugggugacagagugagaucccgucu

SEQ ID NO: 499010 - RNA, 32 nt, Human
uccagccugggugacagagugagauccugucu

SEQ ID NO: 499011 - RNA, 32 nt, Human
uccagccugggugacagagugagauuccgccu

SEQ ID NO: 499012 - RNA, 32 nt, Human
uccagccugggugacagagugagauuccgucu

SEQ ID NO: 499013 - RNA, 32 nt, Human
uccagccugggugacagagugagauucugucu

SEQ ID NO: 499014 - RNA, 24 nt, Human
uccagccugggugacagagugagg

SEQ ID NO: 499015 - RNA, 32 nt, Human
uccagccugggugacagagugagugagacucu

SEQ ID NO: 499016 - RNA, 32 nt, Human
uccagccugggugacagagugauacuccaucu

SEQ ID NO: 499017 - RNA, 24 nt, Human
uccagccugggugacagaguggga

SEQ ID NO: 499018 - RNA, 24 nt, Human
uccagccugggugacagauccaga

SEQ ID NO: 499019 - RNA, 32 nt, Human
uccagccugggugacagauccagacucugucu

SEQ ID NO: 499020 - RNA, 24 nt, Human
uccagccugggugacagauugaga

SEQ ID NO: 499021 - RNA, 32 nt, Human
uccagccugggugacagauugagacucccucu

SEQ ID NO: 499022 - RNA, 22 nt, Human
uccagccugggugacagcaaga

SEQ ID NO: 499023 - RNA, 32 nt, Human
uccagccugggugacagcaagacccugucucg

SEQ ID NO: 499024 - RNA, 24 nt, Human
uccagccugggugacagcaagaga

SEQ ID NO: 499025 - RNA, 24 nt, Human
uccagccugggugacagcacgaga

SEQ ID NO: 499026 - RNA, 22 nt, Human
uccagccugggugacagcgaga

SEQ ID NO: 499027 - RNA, 32 nt, Human
uccagccugggugacagcgagacccugucuca

SEQ ID NO: 499028 - RNA, 32 nt, Human
uccagccugggugacagcgagacccugucucc

SEQ ID NO: 499029 - RNA, 24 nt, Human
uccagccugggugacagcgcgaga

SEQ ID NO: 499030 - RNA, 32 nt, Human
uccagccugggugacagcgcgagacuccaucu

SEQ ID NO: 499031 - RNA, 24 nt, Human
uccagccugggugacagcguaaga

SEQ ID NO: 499032 - RNA, 32 nt, Human
uccagccugggugacagcguaagacucucuca

SEQ ID NO: 499033 - RNA, 22 nt, Human
uccagccugggugacagcuaga

SEQ ID NO: 499034 - RNA, 24 nt, Human
uccagccugggugacagggcaaga

SEQ ID NO: 499035 - RNA, 32 nt, Human
uccagccugggugacagggcaagacccugucu

SEQ ID NO: 499036 - RNA, 32 nt, Human
uccagccugggugacagggcaagacucugucu

SEQ ID NO: 499037 - RNA, 24 nt, Human
uccagccugggugacagggcgaga

SEQ ID NO: 499038 - RNA, 32 nt, Human
uccagccugggugacagggcgagacucugucu

SEQ ID NO: 499039 - RNA, 22 nt, Human
uccagccugggugacaggguga

SEQ ID NO: 499040 - RNA, 24 nt, Human
uccagccugggugacagggugaga

SEQ ID NO: 499041 - RNA, 32 nt, Human
uccagccugggugacagggugagacucugucu

SEQ ID NO: 499042 - RNA, 20 nt, Human
uccagccugggugacaguga

SEQ ID NO: 499043 - RNA, 21 nt, Human
uccagccugggugacagugag

SEQ ID NO: 499044 - RNA, 22 nt, Human
uccagccugggugacagugaga

SEQ ID NO: 499045 - RNA, 32 nt, Human
uccagccugggugacagugagacuguggcuca

SEQ ID NO: 499046 - RNA, 32 nt, Human
uccagccugggugacagugagacuuugucaca

SEQ ID NO: 499047 - RNA, 22 nt, Human
uccagccugggugacaguguga

SEQ ID NO: 499048 - RNA, 32 nt, Human
uccagccugggugacagugugaaacuuugucu

SEQ ID NO: 499049 - RNA, 24 nt, Human
uccagccugggugacauagcaaga

SEQ ID NO: 499050 - RNA, 32 nt, Human
uccagccugggugacauagcaagacccugucu

SEQ ID NO: 499051 - RNA, 24 nt, Human
uccagccugggugacauaucaaga

SEQ ID NO: 499052 - RNA, 32 nt, Human
uccagccugggugacauaucaagaccuguuug

SEQ ID NO: 499053 - RNA, 24 nt, Human
uccagccugggugaccgagugaga

SEQ ID NO: 499054 - RNA, 32 nt, Human
uccagccugggugaccgagugagacuguuucu

SEQ ID NO: 499055 - RNA, 32 nt, Human
uccagccugggugacgagcgaaacuccaucuc

SEQ ID NO: 499056 - RNA, 21 nt, Human
uccagccugggugacgaguga

SEQ ID NO: 499057 - RNA, 24 nt, Human
uccagccugggugacggaacggga

SEQ ID NO: 499058 - RNA, 24 nt, Human
uccagccugggugacggagaaaga

SEQ ID NO: 499059 - RNA, 32 nt, Human
uccagccugggugacggagcgagacuccaucu

SEQ ID NO: 499060 - RNA, 24 nt, Human
uccagccugggugacggagugaga

SEQ ID NO: 499061 - RNA, 32 nt, Human
uccagccugggugacggagugagacuccaucu

SEQ ID NO: 499062 - RNA, 22 nt, Human
uccagccugggugacggugaga

SEQ ID NO: 499063 - RNA, 31 nt, Human
uccagccugggugacggugagacuuugucuc

SEQ ID NO: 499064 - RNA, 19 nt, Human
uccagccugggugacuagc

SEQ ID NO: 499065 - RNA, 21 nt, Human
uccagccugggugacuagcaa

SEQ ID NO: 499066 - RNA, 32 nt, Human
uccagccugggugacuagcaaaacuccaucuc

SEQ ID NO: 499067 - RNA, 19 nt, Human
uccagccugggugacugag

SEQ ID NO: 499068 - RNA, 24 nt, Human
uccagccugggugacugagcaaga

SEQ ID NO: 499069 - RNA, 32 nt, Human
uccagccugggugacugagcaagacucugccu

SEQ ID NO: 499070 - RNA, 24 nt, Human
uccagccugggugacugagcgaga

SEQ ID NO: 499071 - RNA, 32 nt, Human
uccagccugggugacugagcgagacuccaucu

SEQ ID NO: 499072 - RNA, 32 nt, Human
uccagccugggugacugagcgagacucugucu

SEQ ID NO: 499073 - RNA, 32 nt, Human
uccagccugggugacugagcgagauucugucu

SEQ ID NO: 499074 - RNA, 24 nt, Human
uccagccugggugacugagggaga

SEQ ID NO: 499075 - RNA, 32 nt, Human
uccagccugggugacugagggagacucugucu

SEQ ID NO: 499076 - RNA, 32 nt, Human
uccagccugggugacugagugagacccuguuu

SEQ ID NO: 499077 - RNA, 24 nt, Human
uccagccugggugagaaagcaaga

SEQ ID NO: 499078 - RNA, 32 nt, Human
uccagccugggugagaaagcaagacccuauau

SEQ ID NO: 499079 - RNA, 23 nt, Human
uccagccugggugagaagagcga

SEQ ID NO: 499080 - RNA, 32 nt, Human
uccagccugggugagaagagcgaaacuccguc

SEQ ID NO: 499081 - RNA, 32 nt, Human
uccagccugggugagagagcaagacccugccu

SEQ ID NO: 499082 - RNA, 24 nt, Human
uccagccugggugagagagugaga

SEQ ID NO: 499083 - RNA, 32 nt, Human
uccagccugggugaggagagcgagacucuuuc

SEQ ID NO: 499084 - RNA, 21 nt, Human
uccagccugggugauaagagc

SEQ ID NO: 499085 - RNA, 25 nt, Human
uccagccugggugauaagagcaaga

SEQ ID NO: 499086 - RNA, 32 nt, Human
uccagccugggugauaagagcaagacucuugc

SEQ ID NO: 499087 - RNA, 23 nt, Human
uccagccugggugauaagaguga

SEQ ID NO: 499088 - RNA, 24 nt, Human
uccagccugggugauagagcaaga

SEQ ID NO: 499089 - RNA, 32 nt, Human
uccagccugggugauagagcaagaccccaacu

SEQ ID NO: 499090 - RNA, 32 nt, Human
uccagccugggugauagagcaagacccuaucu

SEQ ID NO: 499091 - RNA, 32 nt, Human
uccagccugggugauagagcaagacugucuca

SEQ ID NO: 499092 - RNA, 24 nt, Human
uccagccugggugauagagcugga

SEQ ID NO: 499093 - RNA, 24 nt, Human
uccagccugggugauagagugaga

SEQ ID NO: 499094 - RNA, 32 nt, Human
uccagccugggugauagagugagaacuugucu

SEQ ID NO: 499095 - RNA, 32 nt, Human
uccagccugggugauagagugagacccucguc

SEQ ID NO: 499096 - RNA, 32 nt, Human
uccagccugggugauagagugagauucagucu

SEQ ID NO: 499097 - RNA, 32 nt, Human
uccagccugggugauaggaugagacuccaucu

SEQ ID NO: 499098 - RNA, 32 nt, Human
uccagccugggugaugaagacgagacucuguc

SEQ ID NO: 499099 - RNA, 19 nt, Human
uccagccugggugauggag

SEQ ID NO: 499100 - RNA, 24 nt, Human
uccagccugggugauggagcaaga

SEQ ID NO: 499101 - RNA, 32 nt, Human
uccagccugggugauggagcaagacuccaucu

SEQ ID NO: 499102 - RNA, 25 nt, Human
uccagccugggugaugggagugaga

SEQ ID NO: 499103 - RNA, 32 nt, Human
uccagccuggguggacagaacaaggcccuguc

SEQ ID NO: 499104 - RNA, 32 nt, Human
uccagccuggguggacagagcaagacuccguc

SEQ ID NO: 499105 - RNA, 32 nt, Human
uccagccuggguggcaaagcaagaccccuguc

SEQ ID NO: 499106 - RNA, 32 nt, Human
uccagccuggguggcaaagugagacucuggcu

SEQ ID NO: 499107 - RNA, 19 nt, Human
uccagccuggguggcagag

SEQ ID NO: 499108 - RNA, 24 nt, Human
uccagccuggguggcagagagaga

SEQ ID NO: 499109 - RNA, 32 nt, Human
uccagccuggguggcagagagagacucugucu

SEQ ID NO: 499110 - RNA, 20 nt, Human
uccagccuggguggcagagc

SEQ ID NO: 499111 - RNA, 22 nt, Human
uccagccuggguggcagagcaa

SEQ ID NO: 499112 - RNA, 32 nt, Human
uccagccuggguggcagagcaacacuucgucu

SEQ ID NO: 499113 - RNA, 31 nt, Human
uccagccuggguggcagagcaagacugucuc

SEQ ID NO: 499114 - RNA, 24 nt, Human
uccagccuggguggcagagccaga

SEQ ID NO: 499115 - RNA, 32 nt, Human
uccagccuggguggcagagccagacccugacu

SEQ ID NO: 499116 - RNA, 24 nt, Human
uccagccuggguggcagagcgaga

SEQ ID NO: 499117 - RNA, 32 nt, Human
uccagccuggguggcagagcgagacccugucu

SEQ ID NO: 499118 - RNA, 24 nt, Human
uccagccuggguggcagagugaga

SEQ ID NO: 499119 - RNA, 32 nt, Human
uccagccuggguggcagagugagacccugucu

SEQ ID NO: 499120 - RNA, 32 nt, Human
uccagccuggguggcagagugagacucgucuc

SEQ ID NO: 499121 - RNA, 32 nt, Human
uccagccugggugguagaucaaggcuuuguuu

SEQ ID NO: 499122 - RNA, 32 nt, Human
uccagccugggugucagagcaagacucugguu

SEQ ID NO: 499123 - RNA, 24 nt, Human
uccagccugggugucagagcgaga

SEQ ID NO: 499124 - RNA, 24 nt, Human
uccagccuggguuacagagcgaga

SEQ ID NO: 499125 - RNA, 32 nt, Human
uccagccuggguuacagagugagacccugucu

SEQ ID NO: 499126 - RNA, 32 nt, Human
uccagccugguauaaccucuggcuccaugggc

SEQ ID NO: 499127 - RNA, 24 nt, Human
uccagccuggucaacaaagcaaga

SEQ ID NO: 499128 - RNA, 24 nt, Human
uccagccuggucaacagagcaaga

SEQ ID NO: 499129 - RNA, 32 nt, Human
uccagccuggucaacagagcaagacuccaucu

SEQ ID NO: 499130 - RNA, 24 nt, Human
uccagccuggucaacagagugaga

SEQ ID NO: 499131 - RNA, 24 nt, Human
uccagccuggucaauggagugcga

SEQ ID NO: 499132 - RNA, 24 nt, Human
uccagccugguccagagagaaaga

SEQ ID NO: 499133 - RNA, 23 nt, Human
uccagccuggucgacaagagaga

SEQ ID NO: 499134 - RNA, 22 nt, Human
uccagccuggucgacagaguga

SEQ ID NO: 499135 - RNA, 24 nt, Human
uccagccuggucgacagagugaga

SEQ ID NO: 499136 - RNA, 23 nt, Human
uccagccuggugacagagcaaga

SEQ ID NO: 499137 - RNA, 23 nt, Human
uccagccuggugacagagcgaga

SEQ ID NO: 499138 - RNA, 23 nt, Human
uccagccuggugacagagugaga

SEQ ID NO: 499139 - RNA, 23 nt, Human
uccagccuggugauagaacgaga

SEQ ID NO: 499140 - RNA, 23 nt, Human
uccagccugguuacagagcgaga

SEQ ID NO: 499141 - RNA, 24 nt, Human
uccagccugguugacagagcaaga

SEQ ID NO: 499142 - RNA, 32 nt, Human
uccagccugguugacagagcaagacuccgucu

SEQ ID NO: 499143 - RNA, 32 nt, Human
uccagccugguugacagagcaagacucugucu

SEQ ID NO: 499144 - RNA, 24 nt, Human
uccagccugguugacagagugaga

SEQ ID NO: 499145 - RNA, 32 nt, Human
uccagccugguugacagagugagacuccgucu

SEQ ID NO: 499146 - RNA, 20 nt, Human
uccagccuguaggggaguga

SEQ ID NO: 499147 - RNA, 32 nt, Human
uccagccuguaugcacagacccccagguuauu

SEQ ID NO: 499148 - RNA, 32 nt, Human
uccagccugugaugggcaggccuaggcugcca

SEQ ID NO: 499149 - RNA, 24 nt, Human
uccagccugugcaacagagccaga

SEQ ID NO: 499150 - RNA, 24 nt, Human
uccagccugugcaacagagcgagg

SEQ ID NO: 499151 - RNA, 24 nt, Human
uccagccugugcgacagaaugaga

SEQ ID NO: 499152 - RNA, 32 nt, Human
uccagccugugcgacagaaugagacacugucu

SEQ ID NO: 499153 - RNA, 24 nt, Human
uccagccugugugacagaaugaga

SEQ ID NO: 499154 - RNA, 22 nt, Human
uccagccugugugacagagcaa

SEQ ID NO: 499155 - RNA, 24 nt, Human
uccagccugugugacagagcaaga

SEQ ID NO: 499156 - RNA, 32 nt, Human
uccagccugugugacagagcaauacucuuguc

SEQ ID NO: 499157 - RNA, 24 nt, Human
uccagccugugugauggagagaga

SEQ ID NO: 499158 - RNA, 32 nt, Human
uccagccuguguuucaggagaggacugugcug

SEQ ID NO: 499159 - RNA, 23 nt, Human
uccagccuguugacaaagcaaga

SEQ ID NO: 499160 - RNA, 21 nt, Human
uccagccuguuggagggggga

SEQ ID NO: 499161 - RNA, 24 nt, Human
uccagccuuccagguggcgugaga

SEQ ID NO: 499162 - RNA, 20 nt, Human
uccagccuuccccuggcccc

SEQ ID NO: 499163 - RNA, 32 nt, Human
uccagccuugagccccuccacccccaaauccu

SEQ ID NO: 499164 - RNA, 32 nt, Human
uccagccuuggaaaguaggaaaguaggcugcu

SEQ ID NO: 499165 - RNA, 24 nt, Human
uccagccuuggcaacaaagcaaga

SEQ ID NO: 499166 - RNA, 24 nt, Human
uccagccuuggcaacagagugaga

SEQ ID NO: 499167 - RNA, 32 nt, Human
uccagccuuggcaacagagugagacccugucu

SEQ ID NO: 499168 - RNA, 32 nt, Human
uccagccuuggcaacauaaugagacacuguca

SEQ ID NO: 499169 - RNA, 24 nt, Human
uccagccuuggcgacagagcgaga

SEQ ID NO: 499170 - RNA, 32 nt, Human
uccagccuuggcgacagagcgagacuccaucu

SEQ ID NO: 499171 - RNA, 24 nt, Human
uccagccuuggcgacagagggaga

SEQ ID NO: 499172 - RNA, 32 nt, Human
uccagccuuggugacagagcaagacccugucu

SEQ ID NO: 499173 - RNA, 32 nt, Human
uccagccuuggugacagagcaagacucugucu

SEQ ID NO: 499174 - RNA, 24 nt, Human
uccagccuuggugacagagugaga

SEQ ID NO: 499175 - RNA, 32 nt, Human
uccagccuuggugacagagugagacucugucu

SEQ ID NO: 499176 - RNA, 22 nt, Human
uccagccuuguauggaguuaga

SEQ ID NO: 499177 - RNA, 32 nt, Human
uccagcgaggagugccccugcccaccacccag

SEQ ID NO: 499178 - RNA, 22 nt, Human
uccagcgagugcccacccaaug

SEQ ID NO: 499179 - RNA, 32 nt, Human
uccagcgauccucccgcuucagccucuagagu

SEQ ID NO: 499180 - RNA, 32 nt, Human
uccagcgauucuccugccucagccucuugaau

SEQ ID NO: 499181 - RNA, 32 nt, Human
uccagcgccagccuggcccugagugcgaacuc

SEQ ID NO: 499182 - RNA, 32 nt, Human
uccagcgcccaucuccccuuccgugccccaga

SEQ ID NO: 499183 - RNA, 32 nt, Human
uccagcgccugacagccaggaccccaggcagc

SEQ ID NO: 499184 - RNA, 32 nt, Human
uccagcgccugaggcaggagaaucgcuugaac

SEQ ID NO: 499185 - RNA, 32 nt, Human
uccagcgccuggugcagcuccucuucggggau

SEQ ID NO: 499186 - RNA, 32 nt, Human
uccagcgccuucuguccugccugcccaguccc

SEQ ID NO: 499187 - RNA, 32 nt, Human
uccagcgcgacagccuuggaccugggacugga

SEQ ID NO: 499188 - RNA, 18 nt, Human
uccagcgcucgccucucg

SEQ ID NO: 499189 - RNA, 32 nt, Human
uccagcgcugagauuuuccuugcagaucuauc

SEQ ID NO: 499190 - RNA, 32 nt, Human
uccagcgcugccucugcugccgggccuggacc

SEQ ID NO: 499191 - RNA, 32 nt, Human
uccagcggcccaggcgggggacagugccguuc

SEQ ID NO: 499192 - RNA, 32 nt, Human
uccagcggccucugcaggaucugcagcugugg

SEQ ID NO: 499193 - RNA, 21 nt, Human
uccagcggcgacagagcaaga

SEQ ID NO: 499194 - RNA, 32 nt, Human
uccagcggcugccccagcuacgcugggaggag

SEQ ID NO: 499195 - RNA, 32 nt, Human
uccagcgggucugaguccagccucgggagccc

SEQ ID NO: 499196 - RNA, 32 nt, Human
uccagcggucugcuuccuuggagccagugugg

SEQ ID NO: 499197 - RNA, 18 nt, Human
uccagcgugaccagggcc

SEQ ID NO: 499198 - RNA, 24 nt, Human
uccagcgugggcaacagagugaga

SEQ ID NO: 499199 - RNA, 24 nt, Human
uccagcgugggcgacagagcaaga

SEQ ID NO: 499200 - RNA, 24 nt, Human
uccagcgugggcgacagagcgaga

SEQ ID NO: 499201 - RNA, 24 nt, Human
uccagcgugggugacagagugaga

SEQ ID NO: 499202 - RNA, 32 nt, Human
uccagcgugucuccagccguguugguaccauu

SEQ ID NO: 499203 - RNA, 32 nt, Human
uccagcguuacccuuuuuacggcuucacaacc

SEQ ID NO: 499204 - RNA, 19 nt, Human
uccagcuaaaucccaccuc

SEQ ID NO: 499205 - RNA, 32 nt, Human
uccagcuaaccaggccaggccggggcggugga

SEQ ID NO: 499206 - RNA, 19 nt, Human
uccagcuaagagggcccau

SEQ ID NO: 499207 - RNA, 20 nt, Human
uccagcuaagucugcaagcc

SEQ ID NO: 499208 - RNA, 21 nt, Human
uccagcuacucaggaggcuga

SEQ ID NO: 499209 - RNA, 21 nt, Human
uccagcuacucgggaggcuga

SEQ ID NO: 499210 - RNA, 32 nt, Human
uccagcuacucgggaggcugagguagagaauc

SEQ ID NO: 499211 - RNA, 32 nt, Human
uccagcuacuucuguuguuuacgacguugccu

SEQ ID NO: 499212 - RNA, 32 nt, Human
uccagcuaggcacuggcccaguucacuguacc

SEQ ID NO: 499213 - RNA, 32 nt, Human
uccagcuaucuaagauacacacacaaccacac

SEQ ID NO: 499214 - RNA, 32 nt, Human
uccagcuaucuucuccuuuccacuggugccag

SEQ ID NO: 499215 - RNA, 28 nt, Human
uccagcuauguggcugccucuucugcug

SEQ ID NO: 499216 - RNA, 32 nt, Human
uccagcucaaaggccaccuccuccuagaagcc

SEQ ID NO: 499217 - RNA, 32 nt, Human
uccagcucagagcuccucccaccccaacauac

SEQ ID NO: 499218 - RNA, 32 nt, Human
uccagcucagccgccagaccccagggagacac

SEQ ID NO: 499219 - RNA, 32 nt, Human
uccagcucagucuccagcuccaccuccggcuc

SEQ ID NO: 499220 - RNA, 32 nt, Human
uccagcucagugcccagagacagcccccacau

SEQ ID NO: 499221 - RNA, 32 nt, Human
uccagcucaguucuguguacaaaccauggagg

SEQ ID NO: 499222 - RNA, 32 nt, Human
uccagcuccacgacaaacuuucugccuucccc

SEQ ID NO: 499223 - RNA, 32 nt, Human
uccagcuccagccccacagcccgcggcgcccg

SEQ ID NO: 499224 - RNA, 32 nt, Human
uccagcuccagccgcagcuuaggcagcggagg

SEQ ID NO: 499225 - RNA, 32 nt, Human
uccagcuccagccugcuggggccugugcugac

SEQ ID NO: 499226 - RNA, 23 nt, Human
uccagcuccauccccacccaaug

SEQ ID NO: 499227 - RNA, 32 nt, Human
uccagcucccagagaagacucuaucacagugc

SEQ ID NO: 499228 - RNA, 32 nt, Human
uccagcucccauggaggguggggaagaagaag

SEQ ID NO: 499229 - RNA, 32 nt, Human
uccagcuccccauuuccuuucucaccuccucc

SEQ ID NO: 499230 - RNA, 22 nt, Human
uccagcuccccuguccucuuca

SEQ ID NO: 499231 - RNA, 22 nt, Human
uccagcuccggggcaggcugga

SEQ ID NO: 499232 - RNA, 32 nt, Human
uccagcuccuaagucgugggccugguuucagc

SEQ ID NO: 499233 - RNA, 32 nt, Human
uccagcuccucccacgggguccccguagcccc

SEQ ID NO: 499234 - RNA, 32 nt, Human
uccagcuccucggggagaggggaugcacacgu

SEQ ID NO: 499235 - RNA, 19 nt, Human
uccagcuccugcuccuucg

SEQ ID NO: 499236 - RNA, 19 nt, Human
uccagcuccuuccuccucu

SEQ ID NO: 499237 - RNA, 22 nt, Human
uccagcuccuuccuuccuuccc

SEQ ID NO: 499238 - RNA, 32 nt, Human
uccagcuccuuucuggagaaucuaaggugaac

SEQ ID NO: 499239 - RNA, 21 nt, Human
uccagcucggacugggcggga

SEQ ID NO: 499240 - RNA, 24 nt, Human
uccagcucgggcaacaaagugaga

SEQ ID NO: 499241 - RNA, 25 nt, Human
uccagcucgggugacaagagugaga

SEQ ID NO: 499242 - RNA, 25 nt, Human
uccagcucggguggcgguggcggga

SEQ ID NO: 499243 - RNA, 32 nt, Human
uccagcucguccagggugugcaggaguggcag

SEQ ID NO: 499244 - RNA, 32 nt, Human
uccagcucuaggauucaaugaucaggggacuu

SEQ ID NO: 499245 - RNA, 32 nt, Human
uccagcucuauguguugaguuaccuugggcaa

SEQ ID NO: 499246 - RNA, 32 nt, Human
uccagcucugcagcaguugucuccuaauguga

SEQ ID NO: 499247 - RNA, 32 nt, Human
uccagcucugcaguguggcugcuucuugauuc

SEQ ID NO: 499248 - RNA, 32 nt, Human
uccagcucuggcccucagcugcuugacaggac

SEQ ID NO: 499249 - RNA, 32 nt, Human
uccagcucuuauauguagcacagggaaaggac

SEQ ID NO: 499250 - RNA, 32 nt, Human
uccagcucuuccaggcugcaugucccccucaa

SEQ ID NO: 499251 - RNA, 31 nt, Human
uccagcugaacaucaccuaggagggccaugc

SEQ ID NO: 499252 - RNA, 32 nt, Human
uccagcugaacccaaacuacaaguggguuuaa

SEQ ID NO: 499253 - RNA, 32 nt, Human
uccagcugaaucucaaacagaaggcaguaaug

SEQ ID NO: 499254 - RNA, 22 nt, Human
uccagcugaccucuggcuccug

SEQ ID NO: 499255 - RNA, 32 nt, Human
uccagcugagccacgccugccgggccaccugc

SEQ ID NO: 499256 - RNA, 32 nt, Human
uccagcugagccugaaucugacucuugagggu

SEQ ID NO: 499257 - RNA, 26 nt, Human
uccagcugagggggacagauccaggg

SEQ ID NO: 499258 - RNA, 32 nt, Human
uccagcugagguaccuggcucaucucauuggg

SEQ ID NO: 499259 - RNA, 32 nt, Human
uccagcugagugaagcuaggcaaauggagugg

SEQ ID NO: 499260 - RNA, 32 nt, Human
uccagcugcacucuccucuccugggacccagc

SEQ ID NO: 499261 - RNA, 32 nt, Human
uccagcugcagggccagggggugcaggugaua

SEQ ID NO: 499262 - RNA, 25 nt, Human
uccagcugccaggcucugaugcacu

SEQ ID NO: 499263 - RNA, 32 nt, Human
uccagcugcccuuccuuagaccaucacaugcc

SEQ ID NO: 499264 - RNA, 22 nt, Human
uccagcugccgagaccugcagg

SEQ ID NO: 499265 - RNA, 32 nt, Human
uccagcugccuacuuucugcccggaucucugg

SEQ ID NO: 499266 - RNA, 31 nt, Human
uccagcugccucucauguacuugucuguugg

SEQ ID NO: 499267 - RNA, 24 nt, Human
uccagcugcucggccggggcgaga

SEQ ID NO: 499268 - RNA, 32 nt, Human
uccagcugcugccucccaacccaugcccgcua

SEQ ID NO: 499269 - RNA, 20 nt, Human
uccagcugcugcucauacua

SEQ ID NO: 499270 - RNA, 18 nt, Human
uccagcugcuucaggcua

SEQ ID NO: 499271 - RNA, 32 nt, Human
uccagcugcuuuugcacaugugagaauggcca

SEQ ID NO: 499272 - RNA, 20 nt, Human
uccagcuggagugacagagc

SEQ ID NO: 499273 - RNA, 32 nt, Human
uccagcugggagagacagugggcgucguccau

SEQ ID NO: 499274 - RNA, 32 nt, Human
uccagcugggagguggucucugugugccacuc

SEQ ID NO: 499275 - RNA, 23 nt, Human
uccagcugggcgacagagcgaga

SEQ ID NO: 499276 - RNA, 32 nt, Human
uccagcuggggagggggaaaaggugggaaagc

SEQ ID NO: 499277 - RNA, 32 nt, Human
uccagcugucucuccccuguccccacaugucu

SEQ ID NO: 499278 - RNA, 32 nt, Human
uccagcugugcuguguuucuggaguccuuugg

SEQ ID NO: 499279 - RNA, 32 nt, Human
uccagcuguucuuccugcacaggccaucgagc

SEQ ID NO: 499280 - RNA, 24 nt, Human
uccagcuuaggugacagagugaga

SEQ ID NO: 499281 - RNA, 24 nt, Human
uccagcuuagguggcaaagugaga

SEQ ID NO: 499282 - RNA, 32 nt, Human
uccagcuuauagucuuccaguuuaaugaacua

SEQ ID NO: 499283 - RNA, 32 nt, Human
uccagcuuaucugccgaggauucccccuggaa

SEQ ID NO: 499284 - RNA, 32 nt, Human
uccagcuucaccgaccuccaugccgcugccug

SEQ ID NO: 499285 - RNA, 32 nt, Human
uccagcuucaccuccuuuucuggacccgaggg

SEQ ID NO: 499286 - RNA, 22 nt, Human
uccagcuucagcuccagcucca

SEQ ID NO: 499287 - RNA, 32 nt, Human
uccagcuucauagacuccucuguaucacugcc

SEQ ID NO: 499288 - RNA, 27 nt, Human
uccagcuucaugugacccugggucccu

SEQ ID NO: 499289 - RNA, 22 nt, Human
uccagcuucccugccaaacuca

SEQ ID NO: 499290 - RNA, 22 nt, Human
uccagcuucccugucucuuccu

SEQ ID NO: 499291 - RNA, 32 nt, Human
uccagcuuccuccucaaccucguccucugccc

SEQ ID NO: 499292 - RNA, 32 nt, Human
uccagcuucuagccucaagcagucuucccauc

SEQ ID NO: 499293 - RNA, 24 nt, Human
uccagcuucugcucagagcgcgga

SEQ ID NO: 499294 - RNA, 21 nt, Human
uccagcuucugcucugcccca

SEQ ID NO: 499295 - RNA, 32 nt, Human
uccagcuucuugcugaugagcuuguuguugag

SEQ ID NO: 499296 - RNA, 26 nt, Human
uccagcuugaaugagugggguugggg

SEQ ID NO: 499297 - RNA, 32 nt, Human
uccagcuugcagugguccccagccuggagcag

SEQ ID NO: 499298 - RNA, 32 nt, Human
uccagcuugcccugccuccagcaggaaaucuu

SEQ ID NO: 499299 - RNA, 32 nt, Human
uccagcuugccugcccuuccucaucucucccu

SEQ ID NO: 499300 - RNA, 23 nt, Human
uccagcuuggcaacagagcgaga

SEQ ID NO: 499301 - RNA, 23 nt, Human
uccagcuugggagacaagagcga

SEQ ID NO: 499302 - RNA, 24 nt, Human
uccagcuugggcaacaaagugaga

SEQ ID NO: 499303 - RNA, 24 nt, Human
uccagcuugggcaacagagcaaga

SEQ ID NO: 499304 - RNA, 32 nt, Human
uccagcuugggcaacagagcaagacuccaucu

SEQ ID NO: 499305 - RNA, 24 nt, Human
uccagcuugggcaacagaguaaga

SEQ ID NO: 499306 - RNA, 24 nt, Human
uccagcuugggcaacagagugaga

SEQ ID NO: 499307 - RNA, 32 nt, Human
uccagcuugggcaacagagugagacccugucu

SEQ ID NO: 499308 - RNA, 24 nt, Human
uccagcuugggcaacagggcgaga

SEQ ID NO: 499309 - RNA, 21 nt, Human
uccagcuugggcaacgagcaa

SEQ ID NO: 499310 - RNA, 22 nt, Human
uccagcuugggcaacgagcaaa

SEQ ID NO: 499311 - RNA, 24 nt, Human
uccagcuugggcaccagagcaaga

SEQ ID NO: 499312 - RNA, 24 nt, Human
uccagcuugggcgacagagcaaga

SEQ ID NO: 499313 - RNA, 32 nt, Human
uccagcuugggcgacagagcaagacugucuca

SEQ ID NO: 499314 - RNA, 24 nt, Human
uccagcuugggcgacagagcgaga

SEQ ID NO: 499315 - RNA, 32 nt, Human
uccagcuugggcgacagagcgagacucugucu

SEQ ID NO: 499316 - RNA, 24 nt, Human
uccagcuugggcgacggagugaga

SEQ ID NO: 499317 - RNA, 32 nt, Human
uccagcuugggcgacggagugagacccugucu

SEQ ID NO: 499318 - RNA, 32 nt, Human
uccagcuugggggauagagugagacccugucu

SEQ ID NO: 499319 - RNA, 21 nt, Human
uccagcuuggggucagguggg

SEQ ID NO: 499320 - RNA, 24 nt, Human
uccagcuugggugacaaaguaaga

SEQ ID NO: 499321 - RNA, 32 nt, Human
uccagcuugggugacaaaguaagacccugucu

SEQ ID NO: 499322 - RNA, 24 nt, Human
uccagcuugggugacacagugaga

SEQ ID NO: 499323 - RNA, 32 nt, Human
uccagcuugggugacacagugagacugugucu

SEQ ID NO: 499324 - RNA, 19 nt, Human
uccagcuugggugacagag

SEQ ID NO: 499325 - RNA, 24 nt, Human
uccagcuugggugacagagcaaga

SEQ ID NO: 499326 - RNA, 32 nt, Human
uccagcuugggugacagagcaagacuccaucu

SEQ ID NO: 499327 - RNA, 32 nt, Human
uccagcuugggugacagagcaagagucuguca

SEQ ID NO: 499328 - RNA, 24 nt, Human
uccagcuugggugacagagcgaga

SEQ ID NO: 499329 - RNA, 32 nt, Human
uccagcuugggugacagagcgagacuccguau

SEQ ID NO: 499330 - RNA, 23 nt, Human
uccagcuugggugacagagugag

SEQ ID NO: 499331 - RNA, 24 nt, Human
uccagcuugggugacagagugaga

SEQ ID NO: 499332 - RNA, 32 nt, Human
uccagcuugggugacagagugagacuccaucu

SEQ ID NO: 499333 - RNA, 32 nt, Human
uccagcuugggugacagagugagacucugucu

SEQ ID NO: 499334 - RNA, 32 nt, Human
uccagcuugguggugaaugcugaggagaguca

SEQ ID NO: 499335 - RNA, 32 nt, Human
uccagcuuucaggcuuacuggggaggguggaa

SEQ ID NO: 499336 - RNA, 32 nt, Human
uccagcuuuccuguauuucuucccaagagcau

SEQ ID NO: 499337 - RNA, 32 nt, Human
uccagcuuuguguaauucucuuugccagcugc

SEQ ID NO: 499338 - RNA, 32 nt, Human
uccagcuuuucucaaguuaguuauaggaugua

SEQ ID NO: 499339 - RNA, 32 nt, Human
uccagcuuuugugacuauaacugcuaugaaca

SEQ ID NO: 499340 - RNA, 32 nt, Human
uccaggaaaagaaaggaacacccauccaugug

SEQ ID NO: 499341 - RNA, 32 nt, Human
uccaggaaaagaggaagaagaaguagaggagc

SEQ ID NO: 499342 - RNA, 24 nt, Human
uccaggaaaauggacccugagaug

SEQ ID NO: 499343 - RNA, 32 nt, Human
uccaggaaagagagcuaauucacucucucuuu

SEQ ID NO: 499344 - RNA, 21 nt, Human
uccaggaaaguguuucuggga

SEQ ID NO: 499345 - RNA, 25 nt, Human
uccaggaaauugaucaacucuucca

SEQ ID NO: 499346 - RNA, 32 nt, Human
uccaggaaccaaaaagagcaucccuaugggcu

SEQ ID NO: 499347 - RNA, 19 nt, Human
uccaggaacuccacuccca

SEQ ID NO: 499348 - RNA, 32 nt, Human
uccaggaacuucccaggagagccagcugggaa

SEQ ID NO: 499349 - RNA, 32 nt, Human
uccaggaagaaaagagggcaaagggaacaaug

SEQ ID NO: 499350 - RNA, 21 nt, Human
uccaggaagaacuguggggug

SEQ ID NO: 499351 - RNA, 32 nt, Human
uccaggaagaccagacucccacccuuccacac

SEQ ID NO: 499352 - RNA, 32 nt, Human
uccaggaagcaagcggagguugcagugaguug

SEQ ID NO: 499353 - RNA, 22 nt, Human
uccaggaagccuccuccuugga

SEQ ID NO: 499354 - RNA, 32 nt, Human
uccaggaagccuuccuuuauccauccaggaag

SEQ ID NO: 499355 - RNA, 32 nt, Human
uccaggaagcugagaauuaaaagcugaagaug

SEQ ID NO: 499356 - RNA, 32 nt, Human
uccaggaaggcagggacaccacugaguguuac

SEQ ID NO: 499357 - RNA, 21 nt, Human
uccaggaaggccagcccuggg

SEQ ID NO: 499358 - RNA, 21 nt, Human
uccaggaaggggaguucuggg

SEQ ID NO: 499359 - RNA, 32 nt, Human
uccaggaaguccaaaucaggaucaugaagagg

SEQ ID NO: 499360 - RNA, 25 nt, Human
uccaggaaguccauacccuggggug

SEQ ID NO: 499361 - RNA, 21 nt, Human
uccaggaagucuuuccugaua

SEQ ID NO: 499362 - RNA, 21 nt, Human
uccaggaauaauguuuuggga

SEQ ID NO: 499363 - RNA, 32 nt, Human
uccaggaauacuggccagagggccgugcugaa

SEQ ID NO: 499364 - RNA, 32 nt, Human
uccaggaauacuggccagagggcugugcugaa

SEQ ID NO: 499365 - RNA, 24 nt, Human
uccaggaauggagccuuuguggua

SEQ ID NO: 499366 - RNA, 32 nt, Human
uccaggaauuugagaccagcaugggaaacaga

SEQ ID NO: 499367 - RNA, 19 nt, Human
uccaggacaacaaugugga

SEQ ID NO: 499368 - RNA, 32 nt, Human
uccaggacaauccagccucugcccuggaacug

SEQ ID NO: 499369 - RNA, 32 nt, Human
uccaggacagcccucuggagccguggggccug

SEQ ID NO: 499370 - RNA, 32 nt, Human
uccaggaccagcccugcuggggcccaggccca

SEQ ID NO: 499371 - RNA, 22 nt, Human
uccaggaccagggguccugcuc

SEQ ID NO: 499372 - RNA, 20 nt, Human
uccaggacccagagcuguuc

SEQ ID NO: 499373 - RNA, 18 nt, Human
uccaggaccccuguggcu

SEQ ID NO: 499374 - RNA, 32 nt, Human
uccaggacccucgaaaccccagccccuaggga

SEQ ID NO: 499375 - RNA, 21 nt, Human
uccaggacccucgggcagcuc

SEQ ID NO: 499376 - RNA, 21 nt, Human
uccaggacccugacuugucuc

SEQ ID NO: 499377 - RNA, 20 nt, Human
uccaggaccggaugccccuc

SEQ ID NO: 499378 - RNA, 32 nt, Human
uccaggaccucaccagguccucgucagacucc

SEQ ID NO: 499379 - RNA, 17 nt, Human
uccaggaccucagcugc

SEQ ID NO: 499380 - RNA, 32 nt, Human
uccaggaccuccauuccacucaucucuggccu

SEQ ID NO: 499381 - RNA, 20 nt, Human
uccaggaccuucccuaccuc

SEQ ID NO: 499382 - RNA, 22 nt, Human
uccaggaccuugcuuccuucuc

SEQ ID NO: 499383 - RNA, 21 nt, Human
uccaggaccuuguucucugcu

SEQ ID NO: 499384 - RNA, 32 nt, Human
uccaggacggaaaauucggagagcaugagaau

SEQ ID NO: 499385 - RNA, 32 nt, Human
uccaggacucaucugcaacauuugcaaucuuu

SEQ ID NO: 499386 - RNA, 25 nt, Human
uccaggacucugucagcucugcugc

SEQ ID NO: 499387 - RNA, 32 nt, Human
uccaggacugagaaaggggaaagggaagggug

SEQ ID NO: 499388 - RNA, 32 nt, Human
uccaggacugagagcccagcugccucugccca

SEQ ID NO: 499389 - RNA, 23 nt, Human
uccaggacugccacagagcaaga

SEQ ID NO: 499390 - RNA, 32 nt, Human
uccaggacugggucugaccuggugggagcacc

SEQ ID NO: 499391 - RNA, 32 nt, Human
uccaggacugucccuccuugagacaccaguug

SEQ ID NO: 499392 - RNA, 32 nt, Human
uccaggacuuccagacagaguaccagguuuua

SEQ ID NO: 499393 - RNA, 21 nt, Human
uccaggagaaacugcagagca

SEQ ID NO: 499394 - RNA, 32 nt, Human
uccaggagagaaagggaccgcuuggagcaguu

SEQ ID NO: 499395 - RNA, 23 nt, Human
uccaggagagcaacccuggggug

SEQ ID NO: 499396 - RNA, 32 nt, Human
uccaggagaggugcacgcagccucccauccca

SEQ ID NO: 499397 - RNA, 32 nt, Human
uccaggagauuucaauccaggcuaucuguguu

SEQ ID NO: 499398 - RNA, 32 nt, Human
uccaggagcacacggcccugccccauccuggg

SEQ ID NO: 499399 - RNA, 32 nt, Human
uccaggagcagcaggagcauggccgaggaucu

SEQ ID NO: 499400 - RNA, 32 nt, Human
uccaggagcauggaccgaggugcagugguggg

SEQ ID NO: 499401 - RNA, 32 nt, Human
uccaggagccacgggcucccaccccgagcaua

SEQ ID NO: 499402 - RNA, 32 nt, Human
uccaggagccccgggauugaaggaugguggcg

SEQ ID NO: 499403 - RNA, 32 nt, Human
uccaggagcugcaagaaguccauauuguuccu

SEQ ID NO: 499404 - RNA, 32 nt, Human
uccaggaggaaccagcccugccaacaccugga

SEQ ID NO: 499405 - RNA, 32 nt, Human
uccaggaggaagagaucuauacccuaagcaga

SEQ ID NO: 499406 - RNA, 32 nt, Human
uccaggaggaggagguugcagugagccgagau

SEQ ID NO: 499407 - RNA, 32 nt, Human
uccaggaggcaaagguugcagugagccaaaau

SEQ ID NO: 499408 - RNA, 32 nt, Human
uccaggaggcagagcuugcagugagcugagau

SEQ ID NO: 499409 - RNA, 21 nt, Human
uccaggaggcagagguugcag

SEQ ID NO: 499410 - RNA, 32 nt, Human
uccaggaggcagagguugcagugaguggaggu

SEQ ID NO: 499411 - RNA, 32 nt, Human
uccaggaggcagcauucuaugggcuuaugagc

SEQ ID NO: 499412 - RNA, 32 nt, Human
uccaggaggcgaagguugcagugagcugagau

SEQ ID NO: 499413 - RNA, 32 nt, Human
uccaggaggcgcaggcugcagugagcucugau

SEQ ID NO: 499414 - RNA, 32 nt, Human
uccaggaggcggaggcugcagugagcugugau

SEQ ID NO: 499415 - RNA, 21 nt, Human
uccaggaggcggagguugcag

SEQ ID NO: 499416 - RNA, 32 nt, Human
uccaggaggcggagguugcagugaaccaagau

SEQ ID NO: 499417 - RNA, 32 nt, Human
uccaggaggcggagguugcagugagccaagau

SEQ ID NO: 499418 - RNA, 32 nt, Human
uccaggaggcggagguugcagugagccgagau

SEQ ID NO: 499419 - RNA, 32 nt, Human
uccaggaggcggaguuuguggugaguugagau

SEQ ID NO: 499420 - RNA, 32 nt, Human
uccaggaggcguuuggggguggggaaggcacc

SEQ ID NO: 499421 - RNA, 19 nt, Human
uccaggagggaggcuggga

SEQ ID NO: 499422 - RNA, 32 nt, Human
uccaggaggggccugucgagcugcaguuuaug

SEQ ID NO: 499423 - RNA, 32 nt, Human
uccaggaggguguaaguucugaaugguuccuu

SEQ ID NO: 499424 - RNA, 32 nt, Human
uccaggaggucgaggcugcagugagccaagau

SEQ ID NO: 499425 - RNA, 32 nt, Human
uccaggagguggagccugcagugagccaagau

SEQ ID NO: 499426 - RNA, 24 nt, Human
uccaggagguggagcuugcaguga

SEQ ID NO: 499427 - RNA, 32 nt, Human
uccaggagguggagcuugcagugagccgagac

SEQ ID NO: 499428 - RNA, 21 nt, Human
uccaggagguggaggcugcag

SEQ ID NO: 499429 - RNA, 32 nt, Human
uccaggagguggaggcugcagugagcuaugau

SEQ ID NO: 499430 - RNA, 21 nt, Human
uccaggagguggagguugcag

SEQ ID NO: 499431 - RNA, 24 nt, Human
uccaggagguggagguugcaguga

SEQ ID NO: 499432 - RNA, 32 nt, Human
uccaggagguggagguugcagugagcugagau

SEQ ID NO: 499433 - RNA, 32 nt, Human
uccaggagguugaggcugcagugagcugugau

SEQ ID NO: 499434 - RNA, 32 nt, Human
uccaggaguacccugaagaccacccagguggg

SEQ ID NO: 499435 - RNA, 32 nt, Human
uccaggagucaacaaaccccggcugaggcuga

SEQ ID NO: 499436 - RNA, 32 nt, Human
uccaggaguucaaggcugcagugaguugugau

SEQ ID NO: 499437 - RNA, 32 nt, Human
uccaggauagcuuugaggauaagcugcggaug

SEQ ID NO: 499438 - RNA, 32 nt, Human
uccaggauaugugucauuucccaugaggggcc

SEQ ID NO: 499439 - RNA, 21 nt, Human
uccaggaucgcuguaccgcuc

SEQ ID NO: 499440 - RNA, 21 nt, Human
uccaggaugcacagagugaga

SEQ ID NO: 499441 - RNA, 20 nt, Human
uccaggaugccuccugcugc

SEQ ID NO: 499442 - RNA, 32 nt, Human
uccaggauggacucagugcagagcaggacaug

SEQ ID NO: 499443 - RNA, 20 nt, Human
uccaggauggagugcagugg

SEQ ID NO: 499444 - RNA, 31 nt, Human
uccaggauggccagccuguuccgguccuauc

SEQ ID NO: 499445 - RNA, 32 nt, Human
uccaggaugggcugcagguugcagucagggcu

SEQ ID NO: 499446 - RNA, 32 nt, Human
uccaggauguacaaagaacucucaaaccggau

SEQ ID NO: 499447 - RNA, 32 nt, Human
uccaggauguggaggaaggaagaugagaaaua

SEQ ID NO: 499448 - RNA, 32 nt, Human
uccaggauucgcccucucccaugccuucaagu

SEQ ID NO: 499449 - RNA, 32 nt, Human
uccaggcaacagugccugcaaggccugaauua

SEQ ID NO: 499450 - RNA, 32 nt, Human
uccaggcaagaaaaaugugcagaugcugcggc

SEQ ID NO: 499451 - RNA, 32 nt, Human
uccaggcaagagaaagaagaaaaagaagaaga

SEQ ID NO: 499452 - RNA, 32 nt, Human
uccaggcaaggaguaaauggccccagcagaug

SEQ ID NO: 499453 - RNA, 32 nt, Human
uccaggcaauuuccauagaucugcaguccugc

SEQ ID NO: 499454 - RNA, 32 nt, Human
uccaggcacagaccaggugaggggauauuuag

SEQ ID NO: 499455 - RNA, 32 nt, Human
uccaggcacaggcugguggugcuggagaagga

SEQ ID NO: 499456 - RNA, 22 nt, Human
uccaggcacauagccccaacca

SEQ ID NO: 499457 - RNA, 32 nt, Human
uccaggcaccacucagcucuggcucuuccugg

SEQ ID NO: 499458 - RNA, 32 nt, Human
uccaggcacuucuucccuugaguggguggacu

SEQ ID NO: 499459 - RNA, 32 nt, Human
uccaggcagagaaggagcagaggcucucccgg

SEQ ID NO: 499460 - RNA, 20 nt, Human
uccaggcagaguggggcgga

SEQ ID NO: 499461 - RNA, 32 nt, Human
uccaggcagcaggcuggcauggggacuucauc

SEQ ID NO: 499462 - RNA, 32 nt, Human
uccaggcagccccacuguaagacaucucauug

SEQ ID NO: 499463 - RNA, 32 nt, Human
uccaggcagccuguccugacccucagcagccu

SEQ ID NO: 499464 - RNA, 25 nt, Human
uccaggcagcggggacagggcgagg

SEQ ID NO: 499465 - RNA, 16 nt, Human
uccaggcaggaagcag

SEQ ID NO: 499466 - RNA, 32 nt, Human
uccaggcaggagccuugccucucagguggcgg

SEQ ID NO: 499467 - RNA, 32 nt, Human
uccaggcaggagcugagcauggggugggcagu

SEQ ID NO: 499468 - RNA, 20 nt, Human
uccaggcaggagugcagugg

SEQ ID NO: 499469 - RNA, 31 nt, Human
uccaggcaggcgaggagaagcugugcuguga

SEQ ID NO: 499470 - RNA, 32 nt, Human
uccaggcagggggcaaacacaugugaaggccc

SEQ ID NO: 499471 - RNA, 32 nt, Human
uccaggcaggguguaggggaauguauuagucc

SEQ ID NO: 499472 - RNA, 32 nt, Human
uccaggcaguguuuuuaagugauaugaguuag

SEQ ID NO: 499473 - RNA, 24 nt, Human
uccaggcaucacguccacaugcaa

SEQ ID NO: 499474 - RNA, 31 nt, Human
uccaggcaucucuucugacaaacacugcagg

SEQ ID NO: 499475 - RNA, 32 nt, Human
uccaggcaugagccacugcgcccagucuacac

SEQ ID NO: 499476 - RNA, 32 nt, Human
uccaggcaugaggugguuccugcccuggacgc

SEQ ID NO: 499477 - RNA, 32 nt, Human
uccaggcaugcaccaccaugccuggcuaauuu

SEQ ID NO: 499478 - RNA, 32 nt, Human
uccaggcauucgggggccugaggucccuccag

SEQ ID NO: 499479 - RNA, 24 nt, Human
uccaggccacacaaccccaaacca

SEQ ID NO: 499480 - RNA, 22 nt, Human
uccaggccaccugucucuguaa

SEQ ID NO: 499481 - RNA, 32 nt, Human
uccaggccaccuucuccaucugcucacugagg

SEQ ID NO: 499482 - RNA, 19 nt, Human
uccaggccacucacccagc

SEQ ID NO: 499483 - RNA, 32 nt, Human
uccaggccagcuuugaggauaagcugcugaug

SEQ ID NO: 499484 - RNA, 32 nt, Human
uccaggccaggcaaggggcugguccaugaugu

SEQ ID NO: 499485 - RNA, 32 nt, Human
uccaggccaggugugagggacaucccaugugg

SEQ ID NO: 499486 - RNA, 23 nt, Human
uccaggccaguuugaagacuaca

SEQ ID NO: 499487 - RNA, 32 nt, Human
uccaggccaucuuuugucccaguccuagguaa

SEQ ID NO: 499488 - RNA, 32 nt, Human
uccaggccaugcuggagguacccccgaggcac

SEQ ID NO: 499489 - RNA, 21 nt, Human
uccaggcccagccuggcccca

SEQ ID NO: 499490 - RNA, 32 nt, Human
uccaggcccagcuccugcaucuuggcggccuc

SEQ ID NO: 499491 - RNA, 32 nt, Human
uccaggcccagcuccugcaucuugguggcccc

SEQ ID NO: 499492 - RNA, 32 nt, Human
uccaggcccagcugcagcaacaacagucauua

SEQ ID NO: 499493 - RNA, 32 nt, Human
uccaggcccagggcaugguccugcugcuucac

SEQ ID NO: 499494 - RNA, 32 nt, Human
uccaggcccaugucacuggucagcgugguuuu

SEQ ID NO: 499495 - RNA, 32 nt, Human
uccaggccccaggccucuuuguggacccaucu

SEQ ID NO: 499496 - RNA, 21 nt, Human
uccaggcccgagagaccagca

SEQ ID NO: 499497 - RNA, 32 nt, Human
uccaggcccggggaaggagccucugccucaag

SEQ ID NO: 499498 - RNA, 32 nt, Human
uccaggcccuccucucugggccccuggugugu

SEQ ID NO: 499499 - RNA, 21 nt, Human
uccaggcccugcaugccguca

SEQ ID NO: 499500 - RNA, 24 nt, Human
uccaggcccugcccgaccccauca

SEQ ID NO: 499501 - RNA, 32 nt, Human
uccaggcccugccuugucccugcuccugugcu

SEQ ID NO: 499502 - RNA, 21 nt, Human
uccaggcccuggcaggugggg

SEQ ID NO: 499503 - RNA, 32 nt, Human
uccaggcccuggccacgggaugacuguggaga

SEQ ID NO: 499504 - RNA, 32 nt, Human
uccaggcccugugcaccuuaccccagagacag

SEQ ID NO: 499505 - RNA, 32 nt, Human
uccaggcccuuagggaaguugucuccuuccau

SEQ ID NO: 499506 - RNA, 18 nt, Human
uccaggccgcagagccag

SEQ ID NO: 499507 - RNA, 22 nt, Human
uccaggccggaguccaguggug

SEQ ID NO: 499508 - RNA, 19 nt, Human
uccaggccuaccaggggca

SEQ ID NO: 499509 - RNA, 32 nt, Human
uccaggccuccccuaccucauguccucucauu

SEQ ID NO: 499510 - RNA, 32 nt, Human
uccaggccucgcugccggucagcugcucggca

SEQ ID NO: 499511 - RNA, 19 nt, Human
uccaggccucggccuuccu

SEQ ID NO: 499512 - RNA, 32 nt, Human
uccaggccucuaguuccagaaggauccaagac

SEQ ID NO: 499513 - RNA, 32 nt, Human
uccaggccucucucugcuccaucccccugccu

SEQ ID NO: 499514 - RNA, 18 nt, Human
uccaggccucuuugccca

SEQ ID NO: 499515 - RNA, 18 nt, Human
uccaggccugcaggggca

SEQ ID NO: 499516 - RNA, 25 nt, Human
uccaggccugggugacagugcgaga

SEQ ID NO: 499517 - RNA, 24 nt, Human
uccaggccugucugaaccccacca

SEQ ID NO: 499518 - RNA, 32 nt, Human
uccaggccuugccucccccgaccgccauggag

SEQ ID NO: 499519 - RNA, 32 nt, Human
uccaggccuuucaccugcucugccuugaaaug

SEQ ID NO: 499520 - RNA, 32 nt, Human
uccaggcgcacagacaccaacugugugacacc

SEQ ID NO: 499521 - RNA, 22 nt, Human
uccaggcggugcuccuggggug

SEQ ID NO: 499522 - RNA, 32 nt, Human
uccaggcgugagccacugcgcccggccagccc

SEQ ID NO: 499523 - RNA, 32 nt, Human
uccaggcgugagccacugcggccagcacauuu

SEQ ID NO: 499524 - RNA, 32 nt, Human
uccaggcgugagccaucgugcccagcuagacg

SEQ ID NO: 499525 - RNA, 32 nt, Human
uccaggcuagaggguggggcuuuugcugggga

SEQ ID NO: 499526 - RNA, 20 nt, Human
uccaggcuagagugcagugg

SEQ ID NO: 499527 - RNA, 32 nt, Human
uccaggcuagucucgaauuccugggcucaagu

SEQ ID NO: 499528 - RNA, 32 nt, Human
uccaggcucaagcgguccuucuaccucagccu

SEQ ID NO: 499529 - RNA, 32 nt, Human
uccaggcucaggcuggagccgugauggcaccg

SEQ ID NO: 499530 - RNA, 32 nt, Human
uccaggcucauuugcuuccaccuagcuucggu

SEQ ID NO: 499531 - RNA, 32 nt, Human
uccaggcuccaguaggagagaaagaacuccuc

SEQ ID NO: 499532 - RNA, 32 nt, Human
uccaggcuccauccuuccucugugcagauaau

SEQ ID NO: 499533 - RNA, 32 nt, Human
uccaggcuccugcugcagcuccugggccgcac

SEQ ID NO: 499534 - RNA, 32 nt, Human
uccaggcuccuuuccuacauccuucccgcgcc

SEQ ID NO: 499535 - RNA, 32 nt, Human
uccaggcucugccuggccugacccuguccugu

SEQ ID NO: 499536 - RNA, 32 nt, Human
uccaggcugaucuugaaccucugaccucaggu

SEQ ID NO: 499537 - RNA, 23 nt, Human
uccaggcugauguuucuggugug

SEQ ID NO: 499538 - RNA, 32 nt, Human
uccaggcugcacuaagccaagauccuaccacu

SEQ ID NO: 499539 - RNA, 32 nt, Human
uccaggcugcuuccuguuggcuggguuugguu

SEQ ID NO: 499540 - RNA, 20 nt, Human
uccaggcuggaaugcgguga

SEQ ID NO: 499541 - RNA, 32 nt, Human
uccaggcuggacaacacagcaagacuccaucu

SEQ ID NO: 499542 - RNA, 24 nt, Human
uccaggcuggacgacagagcaaga

SEQ ID NO: 499543 - RNA, 32 nt, Human
uccaggcuggacgacagagcaagacccuguau

SEQ ID NO: 499544 - RNA, 32 nt, Human
uccaggcuggaggagugcagucguacagucau

SEQ ID NO: 499545 - RNA, 20 nt, Human
uccaggcuggagggcaguga

SEQ ID NO: 499546 - RNA, 19 nt, Human
uccaggcuggagugcaaug

SEQ ID NO: 499547 - RNA, 20 nt, Human
uccaggcuggagugcaaugg

SEQ ID NO: 499548 - RNA, 20 nt, Human
uccaggcuggagugcagcga

SEQ ID NO: 499549 - RNA, 18 nt, Human
uccaggcuggagugcagu

SEQ ID NO: 499550 - RNA, 19 nt, Human
uccaggcuggagugcagug

SEQ ID NO: 499551 - RNA, 20 nt, Human
uccaggcuggagugcaguga

SEQ ID NO: 499552 - RNA, 22 nt, Human
uccaggcuggagugcagugaug

SEQ ID NO: 499553 - RNA, 20 nt, Human
uccaggcuggagugcagugg

SEQ ID NO: 499554 - RNA, 23 nt, Human
uccaggcuggagugcaguggcgu

SEQ ID NO: 499555 - RNA, 23 nt, Human
uccaggcuggagugcaguggugu

SEQ ID NO: 499556 - RNA, 19 nt, Human
uccaggcuggagugcggug

SEQ ID NO: 499557 - RNA, 20 nt, Human
uccaggcuggagugcggugg

SEQ ID NO: 499558 - RNA, 20 nt, Human
uccaggcuggaguucagugg

SEQ ID NO: 499559 - RNA, 24 nt, Human
uccaggcuggaugauagagcaaga

SEQ ID NO: 499560 - RNA, 32 nt, Human
uccaggcuggaugauagagcaagaucuugucu

SEQ ID NO: 499561 - RNA, 32 nt, Human
uccaggcuggccuugagcuccugggcucaagc

SEQ ID NO: 499562 - RNA, 32 nt, Human
uccaggcugggacacagaacuuaugacuuuug

SEQ ID NO: 499563 - RNA, 24 nt, Human
uccaggcugggcaacagagugaga

SEQ ID NO: 499564 - RNA, 32 nt, Human
uccaggcugggcaacggagugagacccugucu

SEQ ID NO: 499565 - RNA, 24 nt, Human
uccaggcugggcgacagagcgaga

SEQ ID NO: 499566 - RNA, 32 nt, Human
uccaggcugggcgacagagcgagacuccgucu

SEQ ID NO: 499567 - RNA, 24 nt, Human
uccaggcugggcgacagagugaga

SEQ ID NO: 499568 - RNA, 32 nt, Human
uccaggcuggggccucacagguggggcuguua

SEQ ID NO: 499569 - RNA, 32 nt, Human
uccaggcuggguaacagaaugagaccuuaucu

SEQ ID NO: 499570 - RNA, 32 nt, Human
uccaggcugggugacagagcgagacuccaucu

SEQ ID NO: 499571 - RNA, 32 nt, Human
uccaggcugggugacagagcgagacuccaugu

SEQ ID NO: 499572 - RNA, 32 nt, Human
uccaggcugggugacagauuaagcaagacucu

SEQ ID NO: 499573 - RNA, 32 nt, Human
uccaggcuggucuugaacuccugggcucaagc

SEQ ID NO: 499574 - RNA, 32 nt, Human
uccaggcuggucuugaacuccugggcucaagu

SEQ ID NO: 499575 - RNA, 20 nt, Human
uccaggcuggugugcaguga

SEQ ID NO: 499576 - RNA, 32 nt, Human
uccaggcugugccuacacagcagugcugguga

SEQ ID NO: 499577 - RNA, 32 nt, Human
uccaggcuucacucaacucauggacuccucug

SEQ ID NO: 499578 - RNA, 26 nt, Human
uccaggcuucauccuagagacuguca

SEQ ID NO: 499579 - RNA, 32 nt, Human
uccaggcuuccacccagcuguggggacugcug

SEQ ID NO: 499580 - RNA, 22 nt, Human
uccaggcuugaaaggcagcaaa

SEQ ID NO: 499581 - RNA, 25 nt, Human
uccaggcuugagugacagagcaaga

SEQ ID NO: 499582 - RNA, 32 nt, Human
uccaggcuuucuaaccacaccuacccagggug

SEQ ID NO: 499583 - RNA, 32 nt, Human
uccagggaacgagugugucucaaggggcauuu

SEQ ID NO: 499584 - RNA, 32 nt, Human
uccagggaagaugauagccugccccuuccucu

SEQ ID NO: 499585 - RNA, 21 nt, Human
uccagggaaggcguugggaug

SEQ ID NO: 499586 - RNA, 32 nt, Human
uccagggaaguuaguccucuggccucaauucu

SEQ ID NO: 499587 - RNA, 32 nt, Human
uccagggaauuuaaguaacuugcucaauauca

SEQ ID NO: 499588 - RNA, 32 nt, Human
uccagggacaacaagugggugguccagaagua

SEQ ID NO: 499589 - RNA, 32 nt, Human
uccagggacagaggggguggccucccaacuca

SEQ ID NO: 499590 - RNA, 21 nt, Human
uccagggacccgcacccagug

SEQ ID NO: 499591 - RNA, 18 nt, Human
uccagggaccucugcugc

SEQ ID NO: 499592 - RNA, 23 nt, Human
uccagggagacccuccugggaug

SEQ ID NO: 499593 - RNA, 18 nt, Human
uccagggagcagaguguc

SEQ ID NO: 499594 - RNA, 32 nt, Human
uccagggagcaucucugcucuaccccugcccc

SEQ ID NO: 499595 - RNA, 32 nt, Human
uccagggagcauucaccugcccugucuccaaa

SEQ ID NO: 499596 - RNA, 19 nt, Human
uccagggagccccgaggcc

SEQ ID NO: 499597 - RNA, 32 nt, Human
uccagggaggagaagagggacuccagaauggc

SEQ ID NO: 499598 - RNA, 32 nt, Human
uccagggagggcccugcgccccgcggcgcucc

SEQ ID NO: 499599 - RNA, 32 nt, Human
uccagggaucaccauggagaucaccagggauc

SEQ ID NO: 499600 - RNA, 32 nt, Human
uccagggaugcucggcccuggcucugugccag

SEQ ID NO: 499601 - RNA, 32 nt, Human
uccagggauggacacagguccgcugaacgcgg

SEQ ID NO: 499602 - RNA, 32 nt, Human
uccagggauucaaggccaaccugggcaauaga

SEQ ID NO: 499603 - RNA, 24 nt, Human
uccagggcagaaacagcccaucca

SEQ ID NO: 499604 - RNA, 32 nt, Human
uccagggccaacuccuagcuaccaguggcuuc

SEQ ID NO: 499605 - RNA, 32 nt, Human
uccagggccaacuccuagcuaccgguggcuuc

SEQ ID NO: 499606 - RNA, 32 nt, Human
uccagggccagccugcaguacagaggcuggag

SEQ ID NO: 499607 - RNA, 24 nt, Human
uccagggccaggcagcccacccag

SEQ ID NO: 499608 - RNA, 32 nt, Human
uccagggccaugggagauacaauuccaaguuc

SEQ ID NO: 499609 - RNA, 25 nt, Human
uccagggcccaagcagcccgcccag

SEQ ID NO: 499610 - RNA, 20 nt, Human
uccagggcccccgcugucuc

SEQ ID NO: 499611 - RNA, 22 nt, Human
uccagggcccugagcucggugg

SEQ ID NO: 499612 - RNA, 32 nt, Human
uccagggcccugcuucagacguacugaccgag

SEQ ID NO: 499613 - RNA, 32 nt, Human
uccagggccuccugccccuccccuuccuccag

SEQ ID NO: 499614 - RNA, 23 nt, Human
uccagggccucugcuccaaagga

SEQ ID NO: 499615 - RNA, 32 nt, Human
uccagggccuggcaaggcuggcucucugcagg

SEQ ID NO: 499616 - RNA, 32 nt, Human
uccagggccugggacugcuccuuccccagcca

SEQ ID NO: 499617 - RNA, 22 nt, Human
uccagggcggaccuggggcccc

SEQ ID NO: 499618 - RNA, 32 nt, Human
uccagggcuagguagagagggcccaggcaggc

SEQ ID NO: 499619 - RNA, 32 nt, Human
uccagggcucaaaugauccucccaucucggcc

SEQ ID NO: 499620 - RNA, 32 nt, Human
uccagggcucaagcaguccucccaccucagcc

SEQ ID NO: 499621 - RNA, 32 nt, Human
uccagggcucaaggauccuccugccucagucu

SEQ ID NO: 499622 - RNA, 32 nt, Human
uccagggcucaagggauccucccaccucagcc

SEQ ID NO: 499623 - RNA, 32 nt, Human
uccagggcuccuggugcuccccaugugggaau

SEQ ID NO: 499624 - RNA, 32 nt, Human
uccagggcugaaugccuucuuccugcaggcuc

SEQ ID NO: 499625 - RNA, 23 nt, Human
uccagggcuggaauccugugcuc

SEQ ID NO: 499626 - RNA, 32 nt, Human
uccagggcuuccgggaugcuguuuuccuuuuu

SEQ ID NO: 499627 - RNA, 32 nt, Human
uccagggcuuuggguuuugugcauggguagac

SEQ ID NO: 499628 - RNA, 21 nt, Human
uccaggggacagaauaaccca

SEQ ID NO: 499629 - RNA, 32 nt, Human
uccaggggacauuucagccaugcugaaaggga

SEQ ID NO: 499630 - RNA, 32 nt, Human
uccaggggagaaaccugagucucagagcaggg

SEQ ID NO: 499631 - RNA, 32 nt, Human
uccaggggagggagauggaggcacccaaacug

SEQ ID NO: 499632 - RNA, 32 nt, Human
uccaggggccuuuggucugcccuaccuuaacc

SEQ ID NO: 499633 - RNA, 32 nt, Human
uccagggggacucugugcuaugguacaaaccu

SEQ ID NO: 499634 - RNA, 32 nt, Human
uccagggggucacuccucccaccccaccuacc

SEQ ID NO: 499635 - RNA, 32 nt, Human
uccagggguccagggccagccugagaugcccg

SEQ ID NO: 499636 - RNA, 32 nt, Human
uccaggggugugaccugggacgggugggccug

SEQ ID NO: 499637 - RNA, 32 nt, Human
uccagggguguucacaggcuuucacagcaagg

SEQ ID NO: 499638 - RNA, 19 nt, Human
uccaggguaccccgaggcc

SEQ ID NO: 499639 - RNA, 32 nt, Human
uccaggguagaagacugagggagcacaggaga

SEQ ID NO: 499640 - RNA, 32 nt, Human
uccagggucaccaagcagcagagcucugggga

SEQ ID NO: 499641 - RNA, 24 nt, Human
uccagggucauuacacacagcaug

SEQ ID NO: 499642 - RNA, 32 nt, Human
uccagggucugcaggcuggggcucgggcuuug

SEQ ID NO: 499643 - RNA, 32 nt, Human
uccagggucuggcagagccucugagaugaugc

SEQ ID NO: 499644 - RNA, 32 nt, Human
uccagggugggacccagaguuacuggccccuc

SEQ ID NO: 499645 - RNA, 32 nt, Human
uccagggugggcacccacagugacucagagga

SEQ ID NO: 499646 - RNA, 32 nt, Human
uccagggugggcuacaugcaaugugguugcug

SEQ ID NO: 499647 - RNA, 32 nt, Human
uccagggugggugggagugggcugagggcucg

SEQ ID NO: 499648 - RNA, 32 nt, Human
uccaggguuagggggagcaggaagcccagaua

SEQ ID NO: 499649 - RNA, 32 nt, Human
uccaggguucaagcgauucucuugccucagcc

SEQ ID NO: 499650 - RNA, 32 nt, Human
uccaggguucaagugauucucccaccucagcc

SEQ ID NO: 499651 - RNA, 32 nt, Human
uccaggguucaagugauucuccugccucagcc

SEQ ID NO: 499652 - RNA, 32 nt, Human
uccaggguuccaaggucugcucucuaccaauc

SEQ ID NO: 499653 - RNA, 32 nt, Human
uccaggguuccaguggggagcuuguagugugg

SEQ ID NO: 499654 - RNA, 32 nt, Human
uccaggguugacgccauucuccugccucagcc

SEQ ID NO: 499655 - RNA, 22 nt, Human
uccaggguuugggucgcuuugc

SEQ ID NO: 499656 - RNA, 32 nt, Human
uccagguaaccagcuaacucuugggcucaggc

SEQ ID NO: 499657 - RNA, 21 nt, Human
uccagguacacuuggcacuca

SEQ ID NO: 499658 - RNA, 32 nt, Human
uccagguacuggggacuaguagaaagaucuga

SEQ ID NO: 499659 - RNA, 32 nt, Human
uccagguagcugccugugaaugcacugcucuc

SEQ ID NO: 499660 - RNA, 32 nt, Human
uccagguaguuuucuuccucuaccuccacauc

SEQ ID NO: 499661 - RNA, 32 nt, Human
uccaggucauucucucugacucucaucugcac

SEQ ID NO: 499662 - RNA, 32 nt, Human
uccagguccaucuugcccuccaccucugcaug

SEQ ID NO: 499663 - RNA, 32 nt, Human
uccaggucccagaggguggaaggagccaggac

SEQ ID NO: 499664 - RNA, 32 nt, Human
uccaggucccauccucuccucacucaagggau

SEQ ID NO: 499665 - RNA, 32 nt, Human
uccagguccuggcaaauguagccuacaucauc

SEQ ID NO: 499666 - RNA, 32 nt, Human
uccagguccuuuccuucucgucuuccucucuc

SEQ ID NO: 499667 - RNA, 23 nt, Human
uccaggucguccugaggaugccg

SEQ ID NO: 499668 - RNA, 32 nt, Human
uccaggucuagaaggccaggccucuacuaggu

SEQ ID NO: 499669 - RNA, 32 nt, Human
uccaggucucccugaccugccugcucuaugcc

SEQ ID NO: 499670 - RNA, 32 nt, Human
uccaggucuccucugaggaagcauucugacuu

SEQ ID NO: 499671 - RNA, 32 nt, Human
uccaggucuugugcuaaagaaacaugucaguc

SEQ ID NO: 499672 - RNA, 32 nt, Human
uccaggugaggguagggcacauucuaaaggaa

SEQ ID NO: 499673 - RNA, 32 nt, Human
uccaggugagucucccaucugcagagacgcgg

SEQ ID NO: 499674 - RNA, 32 nt, Human
uccaggugcagcuguggauggaagacagggau

SEQ ID NO: 499675 - RNA, 32 nt, Human
uccaggugcccccaacauuugagaaccccaag

SEQ ID NO: 499676 - RNA, 32 nt, Human
uccaggugcccuggcuggagucaguccucauc

SEQ ID NO: 499677 - RNA, 32 nt, Human
uccaggugccguggagcagcaggcuggcuuug

SEQ ID NO: 499678 - RNA, 32 nt, Human
uccaggugcuagcucuggacagcagcugauuu

SEQ ID NO: 499679 - RNA, 32 nt, Human
uccaggugcucccaccacacacccagcccugc

SEQ ID NO: 499680 - RNA, 32 nt, Human
uccaggugcuggaucauagcacuuggacuguu

SEQ ID NO: 499681 - RNA, 32 nt, Human
uccaggugcuguuaguggaggaaaugcuaaau

SEQ ID NO: 499682 - RNA, 32 nt, Human
uccagguggagcuggagcaggaggacagcaag

SEQ ID NO: 499683 - RNA, 32 nt, Human
uccagguggcggagguugcagugagccgagau

SEQ ID NO: 499684 - RNA, 32 nt, Human
uccaggugggagagacacucccagggacaagg

SEQ ID NO: 499685 - RNA, 32 nt, Human
uccaggugggcagccacuugggccaagacugc

SEQ ID NO: 499686 - RNA, 21 nt, Human
uccaggugggcucccccgggc

SEQ ID NO: 499687 - RNA, 19 nt, Human
uccagguguccaccuggua

SEQ ID NO: 499688 - RNA, 21 nt, Human
uccagguguccuucgcaccca

SEQ ID NO: 499689 - RNA, 32 nt, Human
uccagguguccuugccuuucuucccaaaguca

SEQ ID NO: 499690 - RNA, 32 nt, Human
uccaggugucugcaccucacacuggacccacc

SEQ ID NO: 499691 - RNA, 29 nt, Human
uccaggugucuguguucccaggaaccaaa

SEQ ID NO: 499692 - RNA, 32 nt, Human
uccaggugugaccauugcugaaaacuugugcc

SEQ ID NO: 499693 - RNA, 32 nt, Human
uccaggugugagccacuucacccagccacauu

SEQ ID NO: 499694 - RNA, 32 nt, Human
uccaggugugagcuacugugcccagcuaaaau

SEQ ID NO: 499695 - RNA, 32 nt, Human
uccaggugugcggccgccugagcccgagccag

SEQ ID NO: 499696 - RNA, 32 nt, Human
uccagguuccaacucuugauucuaucacaaaa

SEQ ID NO: 499697 - RNA, 32 nt, Human
uccagguucccaggaacccaagaggagcugga

SEQ ID NO: 499698 - RNA, 32 nt, Human
uccagguucugggcaugagaggccguggccuc

SEQ ID NO: 499699 - RNA, 32 nt, Human
uccagguucuugggaggaagggagaaaagaag

SEQ ID NO: 499700 - RNA, 32 nt, Human
uccagguugaagcaaagcugaaugccaggcac

SEQ ID NO: 499701 - RNA, 24 nt, Human
uccagguugggcaacagagcaaga

SEQ ID NO: 499702 - RNA, 22 nt, Human
uccagguuggguugggggcacu

SEQ ID NO: 499703 - RNA, 32 nt, Human
uccagguugguagaucagcuuagguagaacag

SEQ ID NO: 499704 - RNA, 32 nt, Human
uccagguuucaagugauucuccugccucagcc

SEQ ID NO: 499705 - RNA, 32 nt, Human
uccaguaaaggguuuuggcugcauuuggggaa

SEQ ID NO: 499706 - RNA, 22 nt, Human
uccaguaaaugucccaccagug

SEQ ID NO: 499707 - RNA, 32 nt, Human
uccaguaacacauagacugugcgcauaggccu

SEQ ID NO: 499708 - RNA, 32 nt, Human
uccaguaagcagggcacugcccagggagacug

SEQ ID NO: 499709 - RNA, 32 nt, Human
uccaguaaugaagugguaacuaaccuggaagu

SEQ ID NO: 499710 - RNA, 32 nt, Human
uccaguacaucuuuaaacaaggccccagagac

SEQ ID NO: 499711 - RNA, 23 nt, Human
uccaguaccggcgggacacagca

SEQ ID NO: 499712 - RNA, 32 nt, Human
uccaguaccugcugcugaucuguuucagccga

SEQ ID NO: 499713 - RNA, 32 nt, Human
uccaguacuagucccagaauuuagaauaugcu

SEQ ID NO: 499714 - RNA, 23 nt, Human
uccaguaggcauccacuguggaa

SEQ ID NO: 499715 - RNA, 32 nt, Human
uccaguaggugaccucacagugacucaagcua

SEQ ID NO: 499716 - RNA, 32 nt, Human
uccaguagugggaaaacugggguggggguggg

SEQ ID NO: 499717 - RNA, 21 nt, Human
uccaguaguugaacacuguca

SEQ ID NO: 499718 - RNA, 32 nt, Human
uccaguauaccucuucuggaugccauucucca

SEQ ID NO: 499719 - RNA, 32 nt, Human
uccaguaucuuccuucaccuccuccucuuagg

SEQ ID NO: 499720 - RNA, 32 nt, Human
uccaguaucuuccuucagcuccuccucuuagg

SEQ ID NO: 499721 - RNA, 24 nt, Human
uccaguaugggugacagagugaga

SEQ ID NO: 499722 - RNA, 32 nt, Human
uccagucaaaccugccucccacuucucacuaa

SEQ ID NO: 499723 - RNA, 32 nt, Human
uccagucaacccacagaccccagaaagaguac

SEQ ID NO: 499724 - RNA, 32 nt, Human
uccagucaauagagacauugacugguuggcug

SEQ ID NO: 499725 - RNA, 31 nt, Human
uccagucacagcucagacuucauagagcugu

SEQ ID NO: 499726 - RNA, 32 nt, Human
uccagucacagcuggacugggucugcccaccu

SEQ ID NO: 499727 - RNA, 32 nt, Human
uccagucacaugcccccacuuccccacaggug

SEQ ID NO: 499728 - RNA, 32 nt, Human
uccagucagaagcagcccuuggcugggugagg

SEQ ID NO: 499729 - RNA, 32 nt, Human
uccagucagccuguccuggcugagcuccugcg

SEQ ID NO: 499730 - RNA, 32 nt, Human
uccagucagccuuggaggccucugccuagaca

SEQ ID NO: 499731 - RNA, 32 nt, Human
uccagucaggaggcauaguuuuuagugaacaa

SEQ ID NO: 499732 - RNA, 32 nt, Human
uccagucagugcagucauguaugaggagaauu

SEQ ID NO: 499733 - RNA, 22 nt, Human
uccagucauaaaaauguguucu

SEQ ID NO: 499734 - RNA, 32 nt, Human
uccagucaugguacuaccccagccuggggucc

SEQ ID NO: 499735 - RNA, 32 nt, Human
uccagucauugacaggcauuuccucuuugcua

SEQ ID NO: 499736 - RNA, 32 nt, Human
uccagucauuuugcagaaauguuuccauuugg

SEQ ID NO: 499737 - RNA, 19 nt, Human
uccaguccaaccugaucca

SEQ ID NO: 499738 - RNA, 32 nt, Human
uccaguccaugguccaugcaggcuccuuucau

SEQ ID NO: 499739 - RNA, 21 nt, Human
uccagucccacgcuggcccca

SEQ ID NO: 499740 - RNA, 32 nt, Human
uccagucccaggacacagcagcggccaccaug

SEQ ID NO: 499741 - RNA, 32 nt, Human
uccagucccaggaguccuucagccucuggggg

SEQ ID NO: 499742 - RNA, 22 nt, Human
uccaguccccagccuggcccca

SEQ ID NO: 499743 - RNA, 32 nt, Human
uccaguccuaggagaacagucccugggucagc

SEQ ID NO: 499744 - RNA, 32 nt, Human
uccaguccucaagggaauacugaagaugcuga

SEQ ID NO: 499745 - RNA, 32 nt, Human
uccaguccucagagaaauaaucacuuucuuaa

SEQ ID NO: 499746 - RNA, 32 nt, Human
uccaguccuccaagaaccagcacugccggagc

SEQ ID NO: 499747 - RNA, 32 nt, Human
uccaguccuccccuuggaucugccuuuguccu

SEQ ID NO: 499748 - RNA, 32 nt, Human
uccaguccucgcacugcuguguguucugguca

SEQ ID NO: 499749 - RNA, 32 nt, Human
uccaguccucuccuggaaauggaggaccagga

SEQ ID NO: 499750 - RNA, 32 nt, Human
uccaguccucugcuucuucugcaauaaaugau

SEQ ID NO: 499751 - RNA, 32 nt, Human
uccaguccuggagcagcuggaagaugcuguca

SEQ ID NO: 499752 - RNA, 19 nt, Human
uccaguccuuguaaucuua

SEQ ID NO: 499753 - RNA, 32 nt, Human
uccaguccuuuuaaaaucugagcagaaaaauu

SEQ ID NO: 499754 - RNA, 32 nt, Human
uccagucgaauccugcuucuuggugcccugau

SEQ ID NO: 499755 - RNA, 32 nt, Human
uccagucgagguaccggguucaucucacuagg

SEQ ID NO: 499756 - RNA, 24 nt, Human
uccagucggguuaacagagcaaga

SEQ ID NO: 499757 - RNA, 32 nt, Human
uccagucuaagaagucccauugccaaagcuuu

SEQ ID NO: 499758 - RNA, 32 nt, Human
uccagucuacacacccagcccaggcuuaacuc

SEQ ID NO: 499759 - RNA, 21 nt, Human
uccagucuacuuugggguucu

SEQ ID NO: 499760 - RNA, 32 nt, Human
uccagucuaggugacagagcaagacuccaucu

SEQ ID NO: 499761 - RNA, 32 nt, Human
uccagucuaggugacagagcgagacuccaucu

SEQ ID NO: 499762 - RNA, 32 nt, Human
uccagucucaagugauccucugccucagccuc

SEQ ID NO: 499763 - RNA, 23 nt, Human
uccagucucacagcagagugauc

SEQ ID NO: 499764 - RNA, 21 nt, Human
uccagucuccaccaggaaccu

SEQ ID NO: 499765 - RNA, 32 nt, Human
uccagucuccaccuucccgccuauucccccag

SEQ ID NO: 499766 - RNA, 32 nt, Human
uccagucuccacuguuggcucuccagcaacca

SEQ ID NO: 499767 - RNA, 21 nt, Human
uccagucuccagaacugugaa

SEQ ID NO: 499768 - RNA, 32 nt, Human
uccagucucccuccccugacucccucugcugu

SEQ ID NO: 499769 - RNA, 32 nt, Human
uccagucuccuccucaguucugugccugagaa

SEQ ID NO: 499770 - RNA, 23 nt, Human
uccagucucgaccccgagccccu

SEQ ID NO: 499771 - RNA, 32 nt, Human
uccagucucggcucuuaaaacuaugagcauuu

SEQ ID NO: 499772 - RNA, 32 nt, Human
uccagucucugaguucuaccugauguaacucu

SEQ ID NO: 499773 - RNA, 32 nt, Human
uccagucucugccuaauuuuuaguguuuaaua

SEQ ID NO: 499774 - RNA, 32 nt, Human
uccagucucugccucuguguucacacggccuu

SEQ ID NO: 499775 - RNA, 22 nt, Human
uccagucugagagcaggggagg

SEQ ID NO: 499776 - RNA, 24 nt, Human
uccagucugagcaacagaacgaga

SEQ ID NO: 499777 - RNA, 32 nt, Human
uccagucugcucucagcuugugccuuguaaau

SEQ ID NO: 499778 - RNA, 32 nt, Human
uccagucuggacaacagagcaagacucugucu

SEQ ID NO: 499779 - RNA, 32 nt, Human
uccagucuggacaacagagugagacccugugu

SEQ ID NO: 499780 - RNA, 24 nt, Human
uccagucuggaccacagagugaga

SEQ ID NO: 499781 - RNA, 32 nt, Human
uccagucuggaccacagagugagacccuguuu

SEQ ID NO: 499782 - RNA, 24 nt, Human
uccagucuggacgacagagugaga

SEQ ID NO: 499783 - RNA, 23 nt, Human
uccagucuggaguuggagcaagg

SEQ ID NO: 499784 - RNA, 24 nt, Human
uccagucuggaugacagagagaga

SEQ ID NO: 499785 - RNA, 23 nt, Human
uccagucuggcaacagagcaaga

SEQ ID NO: 499786 - RNA, 32 nt, Human
uccagucuggccccagcaaacccggaggccgc

SEQ ID NO: 499787 - RNA, 20 nt, Human
uccagucuggccgggcgggg

SEQ ID NO: 499788 - RNA, 25 nt, Human
uccagucugggacaacagagcaaga

SEQ ID NO: 499789 - RNA, 32 nt, Human
uccagucugggcaacagacggagacugugucu

SEQ ID NO: 499790 - RNA, 24 nt, Human
uccagucugggcaacagagcaaga

SEQ ID NO: 499791 - RNA, 32 nt, Human
uccagucugggcaacagagcaagacccugccu

SEQ ID NO: 499792 - RNA, 32 nt, Human
uccagucugggcaacagagcaagacucugugu

SEQ ID NO: 499793 - RNA, 24 nt, Human
uccagucugggcaacagagcgaga

SEQ ID NO: 499794 - RNA, 24 nt, Human
uccagucugggcaacagagugaga

SEQ ID NO: 499795 - RNA, 32 nt, Human
uccagucugggcaacagagugagacccugucu

SEQ ID NO: 499796 - RNA, 24 nt, Human
uccagucugggcaacagugcaaga

SEQ ID NO: 499797 - RNA, 24 nt, Human
uccagucugggcgacagagcaaga

SEQ ID NO: 499798 - RNA, 32 nt, Human
uccagucugggcgacagagcaagacucugacu

SEQ ID NO: 499799 - RNA, 24 nt, Human
uccagucugggcgacagagcgaga

SEQ ID NO: 499800 - RNA, 32 nt, Human
uccagucugggcgacagagcgagacucugucu

SEQ ID NO: 499801 - RNA, 25 nt, Human
uccagucugggcgacaggagcaaga

SEQ ID NO: 499802 - RNA, 21 nt, Human
uccagucugggcugagugggg

SEQ ID NO: 499803 - RNA, 22 nt, Human
uccagucuggggaggagagaga

SEQ ID NO: 499804 - RNA, 24 nt, Human
uccagucuggguaacagagcgaga

SEQ ID NO: 499805 - RNA, 22 nt, Human
uccagucuggguaacagggaga

SEQ ID NO: 499806 - RNA, 23 nt, Human
uccagucuggguaagaagaguga

SEQ ID NO: 499807 - RNA, 24 nt, Human
uccagucugggugaaagagcgaga

SEQ ID NO: 499808 - RNA, 24 nt, Human
uccagucugggugacagagagaga

SEQ ID NO: 499809 - RNA, 32 nt, Human
uccagucugggugacagagcaagacucaguca

SEQ ID NO: 499810 - RNA, 32 nt, Human
uccagucugggugacagagcaagacucggucu

SEQ ID NO: 499811 - RNA, 24 nt, Human
uccagucugggugacagagugaga

SEQ ID NO: 499812 - RNA, 32 nt, Human
uccagucugggugacagagugagacuccgccu

SEQ ID NO: 499813 - RNA, 32 nt, Human
uccagucugggugacagagugagacucugucu

SEQ ID NO: 499814 - RNA, 22 nt, Human
uccagucugggugacagcaaga

SEQ ID NO: 499815 - RNA, 24 nt, Human
uccagucugggugacagcgugaga

SEQ ID NO: 499816 - RNA, 23 nt, Human
uccagucugggugagaccugagg

SEQ ID NO: 499817 - RNA, 24 nt, Human
uccagucugggugucagaaugaga

SEQ ID NO: 499818 - RNA, 32 nt, Human
uccagucugggugucagaaugagaccccaucu

SEQ ID NO: 499819 - RNA, 23 nt, Human
uccagucugggugucccagcgag

SEQ ID NO: 499820 - RNA, 25 nt, Human
uccagucuggucggcaagagugaga

SEQ ID NO: 499821 - RNA, 24 nt, Human
uccagucugguugacagagugaga

SEQ ID NO: 499822 - RNA, 25 nt, Human
uccagucugguuuugagagcagggg

SEQ ID NO: 499823 - RNA, 32 nt, Human
uccagucugugcaucaugaaugauaagcuguu

SEQ ID NO: 499824 - RNA, 32 nt, Human
uccagucuguggugaugcugucugucugucug

SEQ ID NO: 499825 - RNA, 23 nt, Human
uccagucuguguguagggagaga

SEQ ID NO: 499826 - RNA, 32 nt, Human
uccagucuucauuuuacauacacacacauauu

SEQ ID NO: 499827 - RNA, 24 nt, Human
uccagucuuccaccuggaagcccu

SEQ ID NO: 499828 - RNA, 32 nt, Human
uccagucuuggcacuuuuuccaauuugacuga

SEQ ID NO: 499829 - RNA, 32 nt, Human
uccagucuuuaagcccagcugugcucgggugu

SEQ ID NO: 499830 - RNA, 32 nt, Human
uccagugaaaacaagacugaaauaugaugacc

SEQ ID NO: 499831 - RNA, 32 nt, Human
uccagugaaaacagcugccuuccggauuaugu

SEQ ID NO: 499832 - RNA, 32 nt, Human
uccagugaaacuuuagucacaaaaacagucug

SEQ ID NO: 499833 - RNA, 32 nt, Human
uccagugacagcugagacaacaaggaccacgg

SEQ ID NO: 499834 - RNA, 22 nt, Human
uccagugaccgacagagcaaga

SEQ ID NO: 499835 - RNA, 18 nt, Human
uccagugaccuggaccug

SEQ ID NO: 499836 - RNA, 32 nt, Human
uccagugagauggagucgcgagucgcggacgc

SEQ ID NO: 499837 - RNA, 32 nt, Human
uccagugagaugggugcuguucuugagcagcu

SEQ ID NO: 499838 - RNA, 32 nt, Human
uccagugaguccauguggagagagcacugugu

SEQ ID NO: 499839 - RNA, 32 nt, Human
uccagugaguuacccagggcuccagggagccc

SEQ ID NO: 499840 - RNA, 27 nt, Human
uccagugcaaaaguggccaguaccaaa

SEQ ID NO: 499841 - RNA, 32 nt, Human
uccagugcacucgagccugggugacagggcaa

SEQ ID NO: 499842 - RNA, 32 nt, Human
uccagugcaguggugugaucauggcucacugc

SEQ ID NO: 499843 - RNA, 32 nt, Human
uccagugccaugaacucagccgcuguccuggg

SEQ ID NO: 499844 - RNA, 32 nt, Human
uccagugccaugagccugacacaugaaggucu

SEQ ID NO: 499845 - RNA, 32 nt, Human
uccagugccguuuuggaaagauguugccuuug

SEQ ID NO: 499846 - RNA, 32 nt, Human
uccagugcuacgugucccuggcauuuuaggug

SEQ ID NO: 499847 - RNA, 32 nt, Human
uccagugcuagaaaauuuagcccuuuaaaacg

SEQ ID NO: 499848 - RNA, 32 nt, Human
uccagugcuagugcuagcuuugcacugccuuu

SEQ ID NO: 499849 - RNA, 32 nt, Human
uccagugcuccaggcugggggccguggauccu

SEQ ID NO: 499850 - RNA, 32 nt, Human
uccaguggaaacaagugcauagaugugaauug

SEQ ID NO: 499851 - RNA, 32 nt, Human
uccaguggaagccacauaugguagcaagagcc

SEQ ID NO: 499852 - RNA, 32 nt, Human
uccaguggaaggcauauaggagugaugguucc

SEQ ID NO: 499853 - RNA, 19 nt, Human
uccaguggaccagcauuca

SEQ ID NO: 499854 - RNA, 21 nt, Human
uccaguggaccugggaacccu

SEQ ID NO: 499855 - RNA, 32 nt, Human
uccaguggagccagaugccgagaccgaguguc

SEQ ID NO: 499856 - RNA, 32 nt, Human
uccaguggaggaagaaggaaggagaggcuugg

SEQ ID NO: 499857 - RNA, 32 nt, Human
uccaguggauccuuaguuuucucuucacugcc

SEQ ID NO: 499858 - RNA, 31 nt, Human
uccaguggcacaaucucggcucacugcaucc

SEQ ID NO: 499859 - RNA, 31 nt, Human
uccaguggcacuaucucagcucacugcaacc

SEQ ID NO: 499860 - RNA, 32 nt, Human
uccaguggcagggagggagggagcuccuuucc

SEQ ID NO: 499861 - RNA, 32 nt, Human
uccaguggccacucucaggcagaguucagauu

SEQ ID NO: 499862 - RNA, 32 nt, Human
uccaguggccccugggguuccagccuguagca

SEQ ID NO: 499863 - RNA, 32 nt, Human
uccaguggccuuuccucacucuguaguguuug

SEQ ID NO: 499864 - RNA, 32 nt, Human
uccaguggcgccccgugcgcaccagcugccug

SEQ ID NO: 499865 - RNA, 32 nt, Human
uccaguggcucacaccuguaaucccaguacuu

SEQ ID NO: 499866 - RNA, 32 nt, Human
uccagugggaacugaagagggcccaagucgga

SEQ ID NO: 499867 - RNA, 24 nt, Human
uccagugggaagguagccuggcca

SEQ ID NO: 499868 - RNA, 32 nt, Human
uccagugggaccccaaaccccacacugcgcug

SEQ ID NO: 499869 - RNA, 23 nt, Human
uccagugggacgucuggcccuca

SEQ ID NO: 499870 - RNA, 32 nt, Human
uccagugggacuagcaguugucacucuguucu

SEQ ID NO: 499871 - RNA, 32 nt, Human
uccagugggaggcggaggccgugagcgcccag

SEQ ID NO: 499872 - RNA, 32 nt, Human
uccagugggaugaacagacaaaccccacaagc

SEQ ID NO: 499873 - RNA, 32 nt, Human
uccagugggcaggacccuuggcaggcaagccc

SEQ ID NO: 499874 - RNA, 21 nt, Human
ucccgaccucaggugauccac

SEQ ID NO: 499875 - RNA, 24 nt, Human
ucccgaccucaggugauccaccca

SEQ ID NO: 499876 - RNA, 24 nt, Human
ucccgaccucaggugauccacccg

SEQ ID NO: 499877 - RNA, 24 nt, Human
ucccgaccucaggugauccgccca

SEQ ID NO: 499878 - RNA, 24 nt, Human
ucccgaccucaggugauccgcccg

SEQ ID NO: 499879 - RNA, 24 nt, Human
ucccgaccucaggugaucuacccg

SEQ ID NO: 499880 - RNA, 24 nt, Human
ucccgaccucaggugaucugccca

SEQ ID NO: 499881 - RNA, 23 nt, Human
ucccgaccucaggugaucuguuc

SEQ ID NO: 499882 - RNA, 32 nt, Human
ucccgaccucauuccauuucuaucuucugacc

SEQ ID NO: 499883 - RNA, 32 nt, Human
ucccgaccucgugaucugcccaccucagccuc

SEQ ID NO: 499884 - RNA, 32 nt, Human
ucccgaccucuagccuggcggcaccuucccag

SEQ ID NO: 499885 - RNA, 32 nt, Human
ucccgacgcugugguugcuguaagggguccuc

SEQ ID NO: 499886 - RNA, 32 nt, Human
ucccgacuccucaguggaggaggagcugcggu

SEQ ID NO: 499887 - RNA, 19 nt, Human
ucccgacucugggccagcg

SEQ ID NO: 499888 - RNA, 32 nt, Human
ucccgacugcccaccuccuccuccucccccuc

SEQ ID NO: 499889 - RNA, 32 nt, Human
ucccgagacguguaaugacaccacacuuguuu

SEQ ID NO: 499890 - RNA, 32 nt, Human
ucccgagagaggaggaagcccggagagagacg

SEQ ID NO: 499891 - RNA, 32 nt, Human
ucccgagcaucaugaguaacgugucugcucag

SEQ ID NO: 499892 - RNA, 32 nt, Human
ucccgagccauggggguguugauguccaagcg

SEQ ID NO: 499893 - RNA, 17 nt, Human
ucccgagcccuggccgc

SEQ ID NO: 499894 - RNA, 17 nt, Human
ucccgagccgcggccgc

SEQ ID NO: 499895 - RNA, 32 nt, Human
ucccgagcgccuucccggugaccccgcagugg

SEQ ID NO: 499896 - RNA, 24 nt, Human
ucccgagcugugagcgcagucuga

SEQ ID NO: 499897 - RNA, 21 nt, Human
ucccgaggacacaaacaggca

SEQ ID NO: 499898 - RNA, 32 nt, Human
ucccgaggagauggaggagcuggagaaggagc

SEQ ID NO: 499899 - RNA, 32 nt, Human
ucccgaggcaugagccaccacgccaagcccag

SEQ ID NO: 499900 - RNA, 25 nt, Human
ucccgaggccaauucccugcuccuu

SEQ ID NO: 499901 - RNA, 32 nt, Human
ucccgaggccccuggguccuucuagcuuuucu

SEQ ID NO: 499902 - RNA, 21 nt, Human
ucccgaggcgcccaagcugga

SEQ ID NO: 499903 - RNA, 32 nt, Human
ucccgagguauuucaccucuuaagagggaauc

SEQ ID NO: 499904 - RNA, 19 nt, Human
ucccgaguauggaccgugu

SEQ ID NO: 499905 - RNA, 32 nt, Human
ucccgaguggcuggacaaaaugagcuacgucu

SEQ ID NO: 499906 - RNA, 32 nt, Human
ucccgaguucaagcgauucuccugccucagcc

SEQ ID NO: 499907 - RNA, 32 nt, Human
ucccgaguucaagugaugcuccugcuucggcc

SEQ ID NO: 499908 - RNA, 32 nt, Human
ucccgaguucaagugauucuccugccucagcc

SEQ ID NO: 499909 - RNA, 32 nt, Human
ucccgaguucaagugauucuccuggcucaccc

SEQ ID NO: 499910 - RNA, 32 nt, Human
ucccgaguucaagugauuuuccugccucagcu

SEQ ID NO: 499911 - RNA, 32 nt, Human
ucccgaguugaguaacugggaccacagcuaug

SEQ ID NO: 499912 - RNA, 24 nt, Human
ucccgaucucaggugauccgcccg

SEQ ID NO: 499913 - RNA, 32 nt, Human
ucccgcaaggcaggcuggaggugccggugggc

SEQ ID NO: 499914 - RNA, 32 nt, Human
ucccgcacaugccucccacccuaggagggagg

SEQ ID NO: 499915 - RNA, 32 nt, Human
ucccgcaccccaggcuggggcagcgagggcgu

SEQ ID NO: 499916 - RNA, 32 nt, Human
ucccgcacuccuuaggcaagauuucccaguaa

SEQ ID NO: 499917 - RNA, 20 nt, Human
ucccgcacugauccccucca

SEQ ID NO: 499918 - RNA, 32 nt, Human
ucccgcagaaagucauguccagcuggaaccca

SEQ ID NO: 499919 - RNA, 32 nt, Human
ucccgcagaccauguuccauguuucuuuuagg

SEQ ID NO: 499920 - RNA, 32 nt, Human
ucccgcagagccggugccaucugugggggcuu

SEQ ID NO: 499921 - RNA, 32 nt, Human
ucccgcagcacccuccagccuugcagaagcag

SEQ ID NO: 499922 - RNA, 32 nt, Human
ucccgcaggaaggagggguccggccugaggcc

SEQ ID NO: 499923 - RNA, 32 nt, Human
ucccgcaggcaggcagaggcugcccuguaacc

SEQ ID NO: 499924 - RNA, 32 nt, Human
ucccgcaguccugggagccagcggccaccugc

SEQ ID NO: 499925 - RNA, 32 nt, Human
ucccgcaguggaaucagccuucccagggaccu

SEQ ID NO: 499926 - RNA, 32 nt, Human
ucccgcaguuagaauuuuguuuggagcccucu

SEQ ID NO: 499927 - RNA, 32 nt, Human
ucccgcauucaagugauucuccagccucagcc

SEQ ID NO: 499928 - RNA, 32 nt, Human
ucccgcauucagauuucauuugcuguugcuuu

SEQ ID NO: 499929 - RNA, 32 nt, Human
ucccgccaccggccgcuucuguccucggaccc

SEQ ID NO: 499930 - RNA, 32 nt, Human
ucccgccaccuccccucuccucuucuccccuc

SEQ ID NO: 499931 - RNA, 32 nt, Human
ucccgccacucacuccagccuggauaaaagag

SEQ ID NO: 499932 - RNA, 32 nt, Human
ucccgccacugcacgccagccugggcgacaga

SEQ ID NO: 499933 - RNA, 32 nt, Human
ucccgccacugcacuccagacugggcgacaga

SEQ ID NO: 499934 - RNA, 31 nt, Human
ucccgccacugcacuccagcacuccgcucuc

SEQ ID NO: 499935 - RNA, 32 nt, Human
ucccgccacugcacuccagcccaggugacaga

SEQ ID NO: 499936 - RNA, 32 nt, Human
ucccgccacugcacuccagccugggcaacaga

SEQ ID NO: 499937 - RNA, 32 nt, Human
ucccgccacugcacuccagccugggcgacaga

SEQ ID NO: 499938 - RNA, 32 nt, Human
ucccgccacugcacuccagccugggugacaga

SEQ ID NO: 499939 - RNA, 32 nt, Human
ucccgccacugcacucuagccugggugacaga

SEQ ID NO: 499940 - RNA, 23 nt, Human
ucccgccagccugcccgccugcu

SEQ ID NO: 499941 - RNA, 18 nt, Human
ucccgccagcguggccag

SEQ ID NO: 499942 - RNA, 32 nt, Human
ucccgccccacacccacccuccuggcucuucc

SEQ ID NO: 499943 - RNA, 32 nt, Human
ucccgccccagccuccugaguagcugggacua

SEQ ID NO: 499944 - RNA, 32 nt, Human
ucccgccccagccuggcccagggugaaggaag

SEQ ID NO: 499945 - RNA, 32 nt, Human
ucccgcccccagaggcucagcacuuuggacau

SEQ ID NO: 499946 - RNA, 32 nt, Human
ucccgccccggccaaccaugccaagccugccu

SEQ ID NO: 499947 - RNA, 24 nt, Human
ucccgccccugcccccacccccgg

SEQ ID NO: 499948 - RNA, 32 nt, Human
ucccgccccuugccugacccucagggagucag

SEQ ID NO: 499949 - RNA, 32 nt, Human
ucccgcccuccagcaugcagcagacugcuggc

SEQ ID NO: 499950 - RNA, 32 nt, Human
ucccgcccucggcccggccucccagcucucua

SEQ ID NO: 499951 - RNA, 32 nt, Human
ucccgcccugcagaggggcuccagcuguucag

SEQ ID NO: 499952 - RNA, 32 nt, Human
ucccgcccuuucuccucaugcacccggccucg

SEQ ID NO: 499953 - RNA, 24 nt, Human
ucccgcccuuuuggacccccgggc

SEQ ID NO: 499954 - RNA, 32 nt, Human
ucccgccgcaccucugcaucuccugggcguca

SEQ ID NO: 499955 - RNA, 32 nt, Human
ucccgccgccuccagccucuccccucuggcag

SEQ ID NO: 499956 - RNA, 20 nt, Human
ucccgccggcccgcgccgcu

SEQ ID NO: 499957 - RNA, 32 nt, Human
ucccgccggcgccaccaccgcggucacucacc

SEQ ID NO: 499958 - RNA, 32 nt, Human
ucccgccggguccucccuccccagaccccaga

SEQ ID NO: 499959 - RNA, 32 nt, Human
ucccgccgguaaucccaaagcuuugggaagcc

SEQ ID NO: 499960 - RNA, 32 nt, Human
ucccgccguguggcccucaucgaagccccgug

SEQ ID NO: 499961 - RNA, 32 nt, Human
ucccgccucaccccgcuccaucacaccagcug

SEQ ID NO: 499962 - RNA, 18 nt, Human
ucccgccucagccaccca

SEQ ID NO: 499963 - RNA, 32 nt, Human
ucccgccucaguagcugggauuacaggugccc

SEQ ID NO: 499964 - RNA, 32 nt, Human
ucccgccuccaauggcuguuucuguuuuccuu

SEQ ID NO: 499965 - RNA, 32 nt, Human
ucccgccuccacugcaacaucaucuacgacua

SEQ ID NO: 499966 - RNA, 32 nt, Human
ucccgccuccacugcaacaucuucuccuacga

SEQ ID NO: 499967 - RNA, 32 nt, Human
ucccgccuccaggaucuccucucaccugcccc

SEQ ID NO: 499968 - RNA, 22 nt, Human
ucccgccuccaggccucggggc

SEQ ID NO: 499969 - RNA, 21 nt, Human
ucccgccucccacuccccagc

SEQ ID NO: 499970 - RNA, 22 nt, Human
ucccgccucccagccccggcgc

SEQ ID NO: 499971 - RNA, 32 nt, Human
ucccgccuccccucggucuuccgaggcgcccg

SEQ ID NO: 499972 - RNA, 32 nt, Human
ucccgccucccgccucccuccagcugcgagug

SEQ ID NO: 499973 - RNA, 32 nt, Human
ucccgccuccuccucuugcuccuccucggcgu

SEQ ID NO: 499974 - RNA, 32 nt, Human
ucccgccucggcagcgucacugcccaguagcu

SEQ ID NO: 499975 - RNA, 32 nt, Human
ucccgccucgggagcugggacaacaggugccc

SEQ ID NO: 499976 - RNA, 20 nt, Human
ucccgccucucucccgccca

SEQ ID NO: 499977 - RNA, 26 nt, Human
ucccgccucuuccuccgcccccgggc

SEQ ID NO: 499978 - RNA, 32 nt, Human
ucccgccuggaaucccagcacuuugggaggcc

SEQ ID NO: 499979 - RNA, 24 nt, Human
ucccgccuggcuguuauucuucca

SEQ ID NO: 499980 - RNA, 24 nt, Human
ucccgccugggcgacagagcgaga

SEQ ID NO: 499981 - RNA, 32 nt, Human
ucccgccugggcgacagagcgagacucugucu

SEQ ID NO: 499982 - RNA, 32 nt, Human
ucccgccugggugacaaagcaauauucugugu

SEQ ID NO: 499983 - RNA, 32 nt, Human
ucccgccugggugacagagugagacucuaucu

SEQ ID NO: 499984 - RNA, 32 nt, Human
ucccgccuguaaucccagaacuuugggaggcu

SEQ ID NO: 499985 - RNA, 32 nt, Human
ucccgccuguaaucccagcacuuugggaagcc

SEQ ID NO: 499986 - RNA, 32 nt, Human
ucccgccuguaaucccagcacuuugggaggcc

SEQ ID NO: 499987 - RNA, 32 nt, Human
ucccgccuguaaucccaguacuuugggaagcc

SEQ ID NO: 499988 - RNA, 32 nt, Human
ucccgccuguaaucccauuacuuugggaggcc

SEQ ID NO: 499989 - RNA, 32 nt, Human
ucccgccuguaauccuagcacuuugggaggcc

SEQ ID NO: 499990 - RNA, 32 nt, Human
ucccgccuguccaucgcucuagcugcuaauac

SEQ ID NO: 499991 - RNA, 32 nt, Human
ucccgccuguucccgcccucucaccagugcac

SEQ ID NO: 499992 - RNA, 32 nt, Human
ucccgccuuggucucccagaguguuaggauua

SEQ ID NO: 499993 - RNA, 32 nt, Human
ucccgccuuuguccagcucuggguuuucaaac

SEQ ID NO: 499994 - RNA, 17 nt, Human
ucccgcgccgggucgcg

SEQ ID NO: 499995 - RNA, 32 nt, Human
ucccgcgggcccuggugcccuggcaugaaggc

SEQ ID NO: 499996 - RNA, 32 nt, Human
ucccgcggggccugggcugcgggcccacgggu

SEQ ID NO: 499997 - RNA, 32 nt, Human
ucccgcgugaaacagagguucaagagggaauc

SEQ ID NO: 499998 - RNA, 32 nt, Human
ucccgcguggagcaggcuugcccagcugggaa

SEQ ID NO: 499999 - RNA, 32 nt, Human
ucccgcucaaccagggcaccaggacgaggugg

SEQ ID NO: 500000 - RNA, 32 nt, Human
ucccgcucaaggcugccccagccuggggucuc

SEQ ID NO: 500001 - RNA, 22 nt, Human
ucccgcucaccuucccgcugcu

SEQ ID NO: 500002 - RNA, 21 nt, Human
ucccgcuccaccagcuuccag

SEQ ID NO: 500003 - RNA, 32 nt, Human
ucccgcucccuguggccccacagcccccgugg

SEQ ID NO: 500004 - RNA, 21 nt, Human
ucccgcuccgcagccccgggc

SEQ ID NO: 500005 - RNA, 32 nt, Human
ucccgcuccuucagcuccuccagcucccguuc

SEQ ID NO: 500006 - RNA, 32 nt, Human
ucccgcucgcgcccucaggucucccucccuuu

SEQ ID NO: 500007 - RNA, 22 nt, Human
ucccgcucgcucugcagcugcu

SEQ ID NO: 500008 - RNA, 32 nt, Human
ucccgcugaaguauuuggcuaccagccagauc

SEQ ID NO: 500009 - RNA, 31 nt, Human
ucccgcugccucuaccugccugguccagcug

SEQ ID NO: 500010 - RNA, 32 nt, Human
ucccgcugcguguccagguccaaaguggagag

SEQ ID NO: 500011 - RNA, 32 nt, Human
ucccgcuggaagccuccaucucuuuggaaaaa

SEQ ID NO: 500012 - RNA, 32 nt, Human
ucccgcuggccggggccguuuccccagagcgg

SEQ ID NO: 500013 - RNA, 32 nt, Human
ucccgcugggcagaggaugggcgcugggucga

SEQ ID NO: 500014 - RNA, 32 nt, Human
ucccgcuggucucccugaggacugagggugaa

SEQ ID NO: 500015 - RNA, 32 nt, Human
ucccgcuguccagcaaggccccgagacuuuuc

SEQ ID NO: 500016 - RNA, 32 nt, Human
ucccgcugugaucuugggcaagugacuuucuc

SEQ ID NO: 500017 - RNA, 19 nt, Human
ucccgcuucagccucucaa

SEQ ID NO: 500018 - RNA, 20 nt, Human
ucccgcuucccccuccccca

SEQ ID NO: 500019 - RNA, 19 nt, Human
ucccgcuucgccccgaguc

SEQ ID NO: 500020 - RNA, 32 nt, Human
ucccgcuuuccucaccacauacagcucuucuc

SEQ ID NO: 500021 - RNA, 32 nt, Human
ucccgcuuugcugccaaugcaacagcccugga

SEQ ID NO: 500022 - RNA, 32 nt, Human
ucccggaaccucugcucagccuggugaaccac

SEQ ID NO: 500023 - RNA, 32 nt, Human
ucccggaaggcaaauggcuggcguggaagcac

SEQ ID NO: 500024 - RNA, 23 nt, Human
ucccggaaggccacucauggcca

SEQ ID NO: 500025 - RNA, 32 nt, Human
ucccggaaucauguugucccacugccuauuaa

SEQ ID NO: 500026 - RNA, 32 nt, Human
ucccggacaagauaugagaaaugaguguugga

SEQ ID NO: 500027 - RNA, 20 nt, Human
ucccggacagcuggacccag

SEQ ID NO: 500028 - RNA, 32 nt, Human
ucccggacaggccgcuugcugcagaggaucca

SEQ ID NO: 500029 - RNA, 32 nt, Human
ucccggacuccagugauccucccgccucagcc

SEQ ID NO: 500030 - RNA, 24 nt, Human
ucccggacucgggugauccacccg

SEQ ID NO: 500031 - RNA, 32 nt, Human
ucccggacuuaucuacucuucacuuuccugau

SEQ ID NO: 500032 - RNA, 32 nt, Human
ucccggagagcacggaaccgcacgcacgucag

SEQ ID NO: 500033 - RNA, 32 nt, Human
ucccggagccagguggagucucgcucugucgc

SEQ ID NO: 500034 - RNA, 32 nt, Human
ucccggagcccggccguagaggcugcaaucgc

SEQ ID NO: 500035 - RNA, 32 nt, Human
ucccggagccggaagccaggaggaaacuacac

SEQ ID NO: 500036 - RNA, 32 nt, Human
ucccggaggcuggccgggcaggcguggugcgc

SEQ ID NO: 500037 - RNA, 32 nt, Human
ucccggagggcccugagcugagggcauugcuu

SEQ ID NO: 500038 - RNA, 32 nt, Human
ucccggauucaagccauucuccugccucagcc

SEQ ID NO: 500039 - RNA, 32 nt, Human
ucccggauucaagcgauucuccugccucagcc

SEQ ID NO: 500040 - RNA, 32 nt, Human
ucccggauucaagugauuccccugccuuagcc

SEQ ID NO: 500041 - RNA, 32 nt, Human
ucccggauucaagugauuccccugucucagcc

SEQ ID NO: 500042 - RNA, 32 nt, Human
ucccggauucaagugauucuccagccucagcc

SEQ ID NO: 500043 - RNA, 32 nt, Human
ucccggauucaagugauucuccugccucagcc

SEQ ID NO: 500044 - RNA, 21 nt, Human
ucccggcaacaucucugggaa

SEQ ID NO: 500045 - RNA, 32 nt, Human
ucccggcaaccaggggugccccaggcuagcuc

SEQ ID NO: 500046 - RNA, 32 nt, Human
ucccggcaccaucccuuccuucaucugacuua

SEQ ID NO: 500047 - RNA, 32 nt, Human
ucccggcacccaucuguaucaucagugccucu

SEQ ID NO: 500048 - RNA, 32 nt, Human
ucccggcagcagcgggggaccggaaguggcuc

SEQ ID NO: 500049 - RNA, 32 nt, Human
ucccggcagcugaccagaaucucuuggagggu

SEQ ID NO: 500050 - RNA, 32 nt, Human
ucccggcaguugguucccggaggcagaaucug

SEQ ID NO: 500051 - RNA, 22 nt, Human
ucccggccaucuagggucagca

SEQ ID NO: 500052 - RNA, 32 nt, Human
ucccggccauucucccucuuguuuucacuuca

SEQ ID NO: 500053 - RNA, 32 nt, Human
ucccggcccagucugaccaucucccuccaguu

SEQ ID NO: 500054 - RNA, 32 nt, Human
ucccggccccucugccccuccucauagcccag

SEQ ID NO: 500055 - RNA, 32 nt, Human
ucccggcccgggaggcggcgguggaugcggcg

SEQ ID NO: 500056 - RNA, 32 nt, Human
ucccggcccugagcgugugucgcugccauauu

SEQ ID NO: 500057 - RNA, 22 nt, Human
ucccggcccuggcggggugcug

SEQ ID NO: 500058 - RNA, 23 nt, Human
ucccggccgcccggcgcccuggg

SEQ ID NO: 500059 - RNA, 32 nt, Human
ucccggccuccccucgcucugaggcucggggu

SEQ ID NO: 500060 - RNA, 32 nt, Human
ucccggccuccuucaccuuucucaucuccaga

SEQ ID NO: 500061 - RNA, 32 nt, Human
ucccggccugcaagguggaguucuagccccau

SEQ ID NO: 500062 - RNA, 31 nt, Human
ucccggcgaggugaucccaugcgcgagggcg

SEQ ID NO: 500063 - RNA, 32 nt, Human
ucccggcgucuccugccagcuuccugcaaagc

SEQ ID NO: 500064 - RNA, 32 nt, Human
ucccggcgugagccaccgcgcccagcccucaa

SEQ ID NO: 500065 - RNA, 32 nt, Human
ucccggcucaaguccuuccucucucuuuccuu

SEQ ID NO: 500066 - RNA, 32 nt, Human
ucccggcucacucccugguccugcacuggggg

SEQ ID NO: 500067 - RNA, 32 nt, Human
ucccggcucacugcaaccuccaccucccaggu

SEQ ID NO: 500068 - RNA, 32 nt, Human
ucccggcucacugcaaccuccgccucccuggu

SEQ ID NO: 500069 - RNA, 32 nt, Human
ucccggcucacugcagccuugacuccgugagc

SEQ ID NO: 500070 - RNA, 20 nt, Human
ucccggcuccacccccucca

SEQ ID NO: 500071 - RNA, 32 nt, Human
ucccggcuccacccccuccaagcucaguggac

SEQ ID NO: 500072 - RNA, 20 nt, Human
ucccggcugaagugcagugg

SEQ ID NO: 500073 - RNA, 20 nt, Human
ucccggcugcgggugcuuug

SEQ ID NO: 500074 - RNA, 23 nt, Human
ucccggcuggccagggcccuggg

SEQ ID NO: 500075 - RNA, 32 nt, Human
ucccggcuggcuggcuccgaguguggggcgcu

SEQ ID NO: 500076 - RNA, 32 nt, Human
ucccggcugggaagaggcacagaggaagucac

SEQ ID NO: 500077 - RNA, 32 nt, Human
ucccggcuucaagugauucuccugccucagcc

SEQ ID NO: 500078 - RNA, 32 nt, Human
ucccgggaagaaauucuuaucacugcauuacc

SEQ ID NO: 500079 - RNA, 32 nt, Human
ucccgggaagcagcggcacuuuucucccugga

SEQ ID NO: 500080 - RNA, 32 nt, Human
ucccgggaagccacccucccagcucugaggac

SEQ ID NO: 500081 - RNA, 32 nt, Human
ucccgggaauucaagguugcagugagcuauga

SEQ ID NO: 500082 - RNA, 32 nt, Human
ucccgggaccaggcguucucuccucucgccuc

SEQ ID NO: 500083 - RNA, 32 nt, Human
ucccgggagagggcgggcuccguggcagcccc

SEQ ID NO: 500084 - RNA, 32 nt, Human
ucccgggagccaggacuucaguuucucuuguc

SEQ ID NO: 500085 - RNA, 32 nt, Human
ucccgggaugugcccugacaugguuaauuuau

SEQ ID NO: 500086 - RNA, 32 nt, Human
ucccgggauuacaggugugugccaccacaccu

SEQ ID NO: 500087 - RNA, 32 nt, Human
ucccgggauuucggggaugacacgggggccag

SEQ ID NO: 500088 - RNA, 32 nt, Human
ucccgggcacuucuccccaccucggccccgcg

SEQ ID NO: 500089 - RNA, 32 nt, Human
ucccgggccagcugccccaccccugcccaugc

SEQ ID NO: 500090 - RNA, 32 nt, Human
ucccgggccagcugccugcggaccgcuuccuu

SEQ ID NO: 500091 - RNA, 32 nt, Human
ucccgggcccgccggcccugagcucccggcgg

SEQ ID NO: 500092 - RNA, 32 nt, Human
ucccgggcccggagcagcccaccggccacccc

SEQ ID NO: 500093 - RNA, 32 nt, Human
ucccgggcgccuucccugcugggccccuggca

SEQ ID NO: 500094 - RNA, 20 nt, Human
ucccgggcgcggacacggaa

SEQ ID NO: 500095 - RNA, 32 nt, Human
ucccgggcgcgggcgggggucgugugcuugga

SEQ ID NO: 500096 - RNA, 32 nt, Human
ucccgggcucaagacauccuccugccucggcc

SEQ ID NO: 500097 - RNA, 32 nt, Human
ucccgggcucaagcaauccucccaccucagcc

SEQ ID NO: 500098 - RNA, 32 nt, Human
ucccgggcucaagcaauccuccugccucagcu

SEQ ID NO: 500099 - RNA, 32 nt, Human
ucccgggcucaagcaguucucuuuccucagcc

SEQ ID NO: 500100 - RNA, 32 nt, Human
ucccgggcucaagcgauccuccugccucagcc

SEQ ID NO: 500101 - RNA, 32 nt, Human
ucccgggcucaagcgauucuccugccucagcc

SEQ ID NO: 500102 - RNA, 32 nt, Human
ucccgggcucaagcgauucucucaccucagcc

SEQ ID NO: 500103 - RNA, 32 nt, Human
ucccgggcucaagcgauucucuugccucagcc

SEQ ID NO: 500104 - RNA, 32 nt, Human
ucccgggcucaagugacccucccaccucagcc

SEQ ID NO: 500105 - RNA, 32 nt, Human
ucccgggcucaagugauucucccgccucaguc

SEQ ID NO: 500106 - RNA, 32 nt, Human
ucccgggcucaagugauucuccucccucagcc

SEQ ID NO: 500107 - RNA, 32 nt, Human
ucccgggcucaagugguccuccugccucagcc

SEQ ID NO: 500108 - RNA, 32 nt, Human
ucccgggcucaccccauucuccugccucagcc

SEQ ID NO: 500109 - RNA, 32 nt, Human
ucccgggcucacgccauucuccugccucagcc

SEQ ID NO: 500110 - RNA, 24 nt, Human
ucccgggcucacgccauucuucca

SEQ ID NO: 500111 - RNA, 32 nt, Human
ucccgggcuccagugauccucccgccucagcc

SEQ ID NO: 500112 - RNA, 32 nt, Human
ucccgggcuccuggcuuugccucugggauccc

SEQ ID NO: 500113 - RNA, 32 nt, Human
ucccgggcugcacuuuggguccagcuguggaa

SEQ ID NO: 500114 - RNA, 32 nt, Human
ucccgggcuggugggucaagugcauugcucag

SEQ ID NO: 500115 - RNA, 32 nt, Human
ucccgggcuguaacuugcucuuuuguuuccca

SEQ ID NO: 500116 - RNA, 32 nt, Human
ucccggggaggagagagcagcuucugccacuu

SEQ ID NO: 500117 - RNA, 28 nt, Human
ucccggggcaccagcagcagagccaggg

SEQ ID NO: 500118 - RNA, 32 nt, Human
ucccggggcucccuccggggccgcggucgggg

SEQ ID NO: 500119 - RNA, 17 nt, Human
ucccgggggaagucguc

SEQ ID NO: 500120 - RNA, 32 nt, Human
ucccggggguggccuuggaggcuguggccacg

SEQ ID NO: 500121 - RNA, 32 nt, Human
ucccggguacaagugauucuccugccucaacc

SEQ ID NO: 500122 - RNA, 32 nt, Human
ucccggguccaagugauucuccugccucagcc

SEQ ID NO: 500123 - RNA, 32 nt, Human
ucccgggucucagcuagaacacgguggaagag

SEQ ID NO: 500124 - RNA, 19 nt, Human
ucccgggugaccccucaca

SEQ ID NO: 500125 - RNA, 32 nt, Human
ucccgggugaguguccaggcaugccagcggaa

SEQ ID NO: 500126 - RNA, 32 nt, Human
ucccggguucaaacgauucuccugccucagcc

SEQ ID NO: 500127 - RNA, 32 nt, Human
ucccggguucaaaugauucuccugccucaguc

SEQ ID NO: 500128 - RNA, 32 nt, Human
ucccggguucaagccauucuccugccucaguc

SEQ ID NO: 500129 - RNA, 32 nt, Human
ucccggguucaagcgauucuccugccucagcc

SEQ ID NO: 500130 - RNA, 32 nt, Human
ucccggguucaagcgauucuccugccucagcu

SEQ ID NO: 500131 - RNA, 32 nt, Human
ucccggguucaagcgauucuccugccucaguc

SEQ ID NO: 500132 - RNA, 32 nt, Human
ucccggguucaagcgauucuccugccucggcc

SEQ ID NO: 500133 - RNA, 32 nt, Human
ucccggguucaagcgauucuccugccugagcc

SEQ ID NO: 500134 - RNA, 32 nt, Human
ucccggguucaagcuauucuccugccucagcc

SEQ ID NO: 500135 - RNA, 32 nt, Human
ucccggguucaagugaucguccugccuuaggc

SEQ ID NO: 500136 - RNA, 32 nt, Human
ucccggguucaagugauucaugugccucagcc

SEQ ID NO: 500137 - RNA, 32 nt, Human
ucccggguucaagugauuccccuaccucagcc

SEQ ID NO: 500138 - RNA, 32 nt, Human
ucccggguucaagugauuccccugugugagcc

SEQ ID NO: 500139 - RNA, 32 nt, Human
ucccggguucaagugauucucaucucagccuc

SEQ ID NO: 500140 - RNA, 32 nt, Human
ucccggguucaagugauucucaugccucagcc

SEQ ID NO: 500141 - RNA, 32 nt, Human
ucccggguucaagugauucuccagccucagcc

SEQ ID NO: 500142 - RNA, 32 nt, Human
ucccggguucaagugauucuccugccucagcc

SEQ ID NO: 500143 - RNA, 32 nt, Human
ucccggguucaagugauucuccugccucggcc

SEQ ID NO: 500144 - RNA, 32 nt, Human
ucccggguucaagugauucuccugccuuagcc

SEQ ID NO: 500145 - RNA, 32 nt, Human
ucccggguucaagugauucuccugcuucagcu

SEQ ID NO: 500146 - RNA, 32 nt, Human
ucccggguucaagugauucuccugucucagcc

SEQ ID NO: 500147 - RNA, 32 nt, Human
ucccggguucaagugauucucgugccucagcu

SEQ ID NO: 500148 - RNA, 32 nt, Human
ucccggguucaagugauucucuggccucagcc

SEQ ID NO: 500149 - RNA, 32 nt, Human
ucccggguucaagugauucucuugccucagcc

SEQ ID NO: 500150 - RNA, 32 nt, Human
ucccggguucaagugauucuucugccucagcc

SEQ ID NO: 500151 - RNA, 32 nt, Human
ucccggguucaagugauucuucugccucagcu

SEQ ID NO: 500152 - RNA, 32 nt, Human
ucccggguucaagugauucuucugucucagcc

SEQ ID NO: 500153 - RNA, 32 nt, Human
ucccggguucacaccauucuccugccucagcc

SEQ ID NO: 500154 - RNA, 32 nt, Human
ucccggguucacgccauccuccugccucagcc

SEQ ID NO: 500155 - RNA, 32 nt, Human
ucccggguucacgccauucuccugccucagac

SEQ ID NO: 500156 - RNA, 32 nt, Human
ucccggguucacgccauucuccugccucagcc

SEQ ID NO: 500157 - RNA, 32 nt, Human
ucccggguucacgccauucuccugccucagcg

SEQ ID NO: 500158 - RNA, 32 nt, Human
ucccggguucacgccauucuccugccucagcu

SEQ ID NO: 500159 - RNA, 32 nt, Human
ucccggguucacgccauucucuugccucagcc

SEQ ID NO: 500160 - RNA, 32 nt, Human
ucccggguucacgcccuucuccugccucagcc

SEQ ID NO: 500161 - RNA, 32 nt, Human
ucccggguucacgccguucuccugccucagcc

SEQ ID NO: 500162 - RNA, 32 nt, Human
ucccggguucacgucauucuccugccucagcc

SEQ ID NO: 500163 - RNA, 32 nt, Human
ucccggguucaggccauucuccugccucagcc

SEQ ID NO: 500164 - RNA, 32 nt, Human
ucccggguucaggcuauucuccugccucagcc

SEQ ID NO: 500165 - RNA, 32 nt, Human
ucccggguucaugccauucuccugccucagcc

SEQ ID NO: 500166 - RNA, 32 nt, Human
ucccggguucaugccauucuccugccucagcg

SEQ ID NO: 500167 - RNA, 32 nt, Human
ucccggguucauggcauucuccugccucagcc

SEQ ID NO: 500168 - RNA, 32 nt, Human
ucccggguucaugugauucuccugccucagcc

SEQ ID NO: 500169 - RNA, 23 nt, Human
ucccggguuccagccucucagug

SEQ ID NO: 500170 - RNA, 32 nt, Human
ucccggguucucaccauucuccugccucagcc

SEQ ID NO: 500171 - RNA, 32 nt, Human
ucccggguucugacaguacgaugagcugcccc

SEQ ID NO: 500172 - RNA, 32 nt, Human
ucccggguugacaccauuuuccugccucagcc

SEQ ID NO: 500173 - RNA, 32 nt, Human
ucccgguauaggggccucucuccucucaucgg

SEQ ID NO: 500174 - RNA, 32 nt, Human
ucccggucaccagcaaccaugacggaccagca

SEQ ID NO: 500175 - RNA, 32 nt, Human
ucccggucauggcacacaccugugcccagacg

SEQ ID NO: 500176 - RNA, 32 nt, Human
ucccgguccacugcaaccuccacuucccgggu

SEQ ID NO: 500177 - RNA, 32 nt, Human
ucccggucgggaguucucuccaggcggcacga

SEQ ID NO: 500178 - RNA, 32 nt, Human
ucccggucuagagguuuuucuucuugguccuu

SEQ ID NO: 500179 - RNA, 32 nt, Human
ucccggucucacuccagcaucuccccaggcaa

SEQ ID NO: 500180 - RNA, 32 nt, Human
ucccggugacucuggaccugagguugcgugag

SEQ ID NO: 500181 - RNA, 32 nt, Human
ucccggugccagguucuuggagcugugaggag

SEQ ID NO: 500182 - RNA, 32 nt, Human
ucccggugccccugccaagauguggaaggggc

SEQ ID NO: 500183 - RNA, 31 nt, Human
ucccggugccucucuagggcccuggugacca

SEQ ID NO: 500184 - RNA, 32 nt, Human
ucccgguggaagcaagggagcccagccggagc

SEQ ID NO: 500185 - RNA, 32 nt, Human
ucccgguggaagccucgcaacgaagggccgga

SEQ ID NO: 500186 - RNA, 32 nt, Human
ucccggugugccgcugccguagggaagcagga

SEQ ID NO: 500187 - RNA, 32 nt, Human
ucccgguucccuccccagcuccucgucuuuga

SEQ ID NO: 500188 - RNA, 32 nt, Human
ucccgguuucaagugauucuccugccuccgcc

SEQ ID NO: 500189 - RNA, 32 nt, Human
ucccgguuucacuccuucucagccugggcucc

SEQ ID NO: 500190 - RNA, 32 nt, Human
ucccguacucuccagaguacugaagauucucc

SEQ ID NO: 500191 - RNA, 32 nt, Human
ucccguagcccuuccuggaucuggagagagca

SEQ ID NO: 500192 - RNA, 32 nt, Human
ucccguaggaaacugugggaccagagauaucc

SEQ ID NO: 500193 - RNA, 32 nt, Human
ucccguauccacgcaggaaggccgggggacug

SEQ ID NO: 500194 - RNA, 24 nt, Human
ucccgucacacacugcagcaggga

SEQ ID NO: 500195 - RNA, 32 nt, Human
ucccguccaacaggcuggaguacaauggcgag

SEQ ID NO: 500196 - RNA, 32 nt, Human
ucccguccaaggaagcagaguuguuaaagagu

SEQ ID NO: 500197 - RNA, 32 nt, Human
ucccgucccgggagcugggagcagcgcgggca

SEQ ID NO: 500198 - RNA, 32 nt, Human
ucccguccuccccuccccuucccuugcuucuc

SEQ ID NO: 500199 - RNA, 32 nt, Human
ucccguccucggggccccugcagccacccaac

SEQ ID NO: 500200 - RNA, 32 nt, Human
ucccgucucugaagcaccugcccagggccugg

SEQ ID NO: 500201 - RNA, 32 nt, Human
ucccgucugugagcucccugcccagcaccacc

SEQ ID NO: 500202 - RNA, 32 nt, Human
ucccgugacagaggaggggagggguggugccu

SEQ ID NO: 500203 - RNA, 32 nt, Human
ucccgugacugcugccucaucgauaccccauu

SEQ ID NO: 500204 - RNA, 32 nt, Human
ucccgugagucuccagccugcccagcaccagc

SEQ ID NO: 500205 - RNA, 22 nt, Human
ucccgugccagauucucucaca

SEQ ID NO: 500206 - RNA, 19 nt, Human
ucccgugccccuuccucac

SEQ ID NO: 500207 - RNA, 32 nt, Human
ucccgugccuguacaaagacaugcaugugcau

SEQ ID NO: 500208 - RNA, 32 nt, Human
ucccgugcuccuggcugcagcugggaagcuuc

SEQ ID NO: 500209 - RNA, 32 nt, Human
ucccgugcuccuugagguuauccacaggaaca

SEQ ID NO: 500210 - RNA, 32 nt, Human
ucccgugcuguuucccuggcagacacacaggc

SEQ ID NO: 500211 - RNA, 19 nt, Human
ucccguggcggcccucaca

SEQ ID NO: 500212 - RNA, 32 nt, Human
ucccguggcugguucuaggccccauucaagcc

SEQ ID NO: 500213 - RNA, 32 nt, Human
ucccguggcuuugugcuuaugucauuucuucu

SEQ ID NO: 500214 - RNA, 31 nt, Human
ucccgugggcacuuccacauccucugggccu

SEQ ID NO: 500215 - RNA, 32 nt, Human
ucccgugguggaggcggggagagggaaggacc

SEQ ID NO: 500216 - RNA, 32 nt, Human
ucccguguccugggcagcuucuguuucccucu

SEQ ID NO: 500217 - RNA, 32 nt, Human
ucccgugugaguugcugucugccccuugucag

SEQ ID NO: 500218 - RNA, 32 nt, Human
ucccguguucaagcgauucuccugccucagcc

SEQ ID NO: 500219 - RNA, 32 nt, Human
ucccguguucaagcgauucuccugccuuggcc

SEQ ID NO: 500220 - RNA, 32 nt, Human
ucccguguucacaccauucuccugccucagcc

SEQ ID NO: 500221 - RNA, 32 nt, Human
ucccguguucacgccauucuccugccucagcc

SEQ ID NO: 500222 - RNA, 32 nt, Human
ucccguguuuuugcacaaagccauuaugcagg

SEQ ID NO: 500223 - RNA, 32 nt, Human
ucccguucacauuuggaaaauguucuccuaag

SEQ ID NO: 500224 - RNA, 32 nt, Human
ucccguuggaugaauugcuccugcugaaacuc

SEQ ID NO: 500225 - RNA, 25 nt, Human
ucccguuguucaggugaccuggcua

SEQ ID NO: 500226 - RNA, 32 nt, Human
ucccguuucauuccuuucucuuccucaacaaa

SEQ ID NO: 500227 - RNA, 32 nt, Human
ucccguuucccucuugcuuccucucucgucau

SEQ ID NO: 500228 - RNA, 21 nt, Human
ucccguuuccuccugcgccca

SEQ ID NO: 500229 - RNA, 32 nt, Human
ucccguuucuccuggcugaggaagggaaggga

SEQ ID NO: 500230 - RNA, 32 nt, Human
ucccguuuucucuuugcuuucucuccaacugc

SEQ ID NO: 500231 - RNA, 32 nt, Human
ucccguuuuucauaaacagaaguaagaugucc

SEQ ID NO: 500232 - RNA, 32 nt, Human
ucccuaaaauacugcaugugugugcauacaug

SEQ ID NO: 500233 - RNA, 32 nt, Human
ucccuaaaaugagagaggacugggauugaaag

SEQ ID NO: 500234 - RNA, 20 nt, Human
ucccuaaacagccccucaca

SEQ ID NO: 500235 - RNA, 32 nt, Human
ucccuaaagcaaccggauaaucccagaagcau

SEQ ID NO: 500236 - RNA, 32 nt, Human
ucccuaaaggggagucaaguucccuggguugu

SEQ ID NO: 500237 - RNA, 22 nt, Human
ucccuaaaucugccucuucugc

SEQ ID NO: 500238 - RNA, 32 nt, Human
ucccuaaauguucacuccacuuacccagcuug

SEQ ID NO: 500239 - RNA, 32 nt, Human
ucccuaacacacuugcuacaucucauguccuu

SEQ ID NO: 500240 - RNA, 32 nt, Human
ucccuaaccacuuccuccuccacccgaccauc

SEQ ID NO: 500241 - RNA, 32 nt, Human
ucccuaagacagauuggcuuucuaaugaguuu

SEQ ID NO: 500242 - RNA, 32 nt, Human
ucccuaagcagccugaggguugacuggauugg

SEQ ID NO: 500243 - RNA, 32 nt, Human
ucccuaagccagcugcccccagagccacaguu

SEQ ID NO: 500244 - RNA, 32 nt, Human
ucccuaagcccauggguuacagaaugcuaggg

SEQ ID NO: 500245 - RNA, 32 nt, Human
ucccuaaggcauacuuuucuagcuaccuucug

SEQ ID NO: 500246 - RNA, 32 nt, Human
ucccuaaguccuucccugcaggcacgcaccau

SEQ ID NO: 500247 - RNA, 32 nt, Human
ucccuaaguugcugggauuacaggugugagcc

SEQ ID NO: 500248 - RNA, 32 nt, Human
ucccuaaucccuggcccucccagcugucuggg

SEQ ID NO: 500249 - RNA, 21 nt, Human
ucccuaaucuuuggguggcuu

SEQ ID NO: 500250 - RNA, 32 nt, Human
ucccuaaugaacacgcaugggcugaaaugaag

SEQ ID NO: 500251 - RNA, 32 nt, Human
ucccuaauuucccaguccuugucuugaacaau

SEQ ID NO: 500252 - RNA, 23 nt, Human
ucccuaauuugagaaguaaccuu

SEQ ID NO: 500253 - RNA, 32 nt, Human
ucccuaauuugccagugggaacuccuaaauca

SEQ ID NO: 500254 - RNA, 32 nt, Human
ucccuacaaaugaagacuuaucagggcccuag

SEQ ID NO: 500255 - RNA, 32 nt, Human
ucccuacaacaggcugcugugcagccuggggc

SEQ ID NO: 500256 - RNA, 32 nt, Human
ucccuacaggauaaaagcuucucuccauuaca

SEQ ID NO: 500257 - RNA, 32 nt, Human
ucccuacaucuucucuucugacuuuggcuaca

SEQ ID NO: 500258 - RNA, 32 nt, Human
ucccuaccacaaaucagggcucagggagaggc

SEQ ID NO: 500259 - RNA, 32 nt, Human
ucccuaccagccagggguuuccaagggaccuu

SEQ ID NO: 500260 - RNA, 32 nt, Human
ucccuacccacguuccagccucuaggugaguc

SEQ ID NO: 500261 - RNA, 32 nt, Human
ucccuacccacuguaacuggcauucccauagu

SEQ ID NO: 500262 - RNA, 32 nt, Human
ucccuaccccucucccccaaauacagcugaag

SEQ ID NO: 500263 - RNA, 32 nt, Human
ucccuaccccucucccccaaaugcagcugaag

SEQ ID NO: 500264 - RNA, 32 nt, Human
ucccuacccgcuguagccagagcugcuucaca

SEQ ID NO: 500265 - RNA, 32 nt, Human
ucccuacccuagccuugcucucagccaccuug

SEQ ID NO: 500266 - RNA, 32 nt, Human
ucccuacccugacuccuuccccaaacccaggg

SEQ ID NO: 500267 - RNA, 32 nt, Human
ucccuacccuggggcaccucugacccuggacc

SEQ ID NO: 500268 - RNA, 32 nt, Human
ucccuacccuuaauccccacaugggaagaagc

SEQ ID NO: 500269 - RNA, 32 nt, Human
ucccuaccucaccaggcuacuggcagcagcau

SEQ ID NO: 500270 - RNA, 32 nt, Human
ucccuaccuggagccucaccuccaaggaaauu

SEQ ID NO: 500271 - RNA, 32 nt, Human
ucccuaccuuaggcuccugaguagcugggacu

SEQ ID NO: 500272 - RNA, 32 nt, Human
ucccuaccuucucuuuuguuagggaggccuca

SEQ ID NO: 500273 - RNA, 32 nt, Human
ucccuaccuugccagcuucuucauaggaccag

SEQ ID NO: 500274 - RNA, 32 nt, Human
ucccuacgugcccacuggcacacacacgugcu

SEQ ID NO: 500275 - RNA, 32 nt, Human
ucccuacuccauccuucccuggugauucuuga

SEQ ID NO: 500276 - RNA, 32 nt, Human
ucccuacucuuuccucaucucuucccaaacuc

SEQ ID NO: 500277 - RNA, 32 nt, Human
ucccuacugcugguuucugccuucuccaugcu

SEQ ID NO: 500278 - RNA, 32 nt, Human
ucccuacuuucucugcagccagacuggaugcu

SEQ ID NO: 500279 - RNA, 32 nt, Human
ucccuagaaauggcagccugcauguggagaag

SEQ ID NO: 500280 - RNA, 32 nt, Human
ucccuagaaauugcucucaucugaugaguucu

SEQ ID NO: 500281 - RNA, 32 nt, Human
ucccuagaccaagcuggucacccggcugggaa

SEQ ID NO: 500282 - RNA, 32 nt, Human
ucccuagaccuccuucccucccuccucacguc

SEQ ID NO: 500283 - RNA, 32 nt, Human
ucccuagacuguaagcucuucaaggagcaaga

SEQ ID NO: 500284 - RNA, 32 nt, Human
ucccuagagcucaagaaagcugguccaggagg

SEQ ID NO: 500285 - RNA, 32 nt, Human
ucccuagaugagcuucacaucucagguaacug

SEQ ID NO: 500286 - RNA, 19 nt, Human
ucccuagcaaagccuacag

SEQ ID NO: 500287 - RNA, 32 nt, Human
ucccuagcacugagagguguggguagguaaaa

SEQ ID NO: 500288 - RNA, 32 nt, Human
ucccuagcccgcagucuuuuucucugucccuu

SEQ ID NO: 500289 - RNA, 32 nt, Human
ucccuagccuauggagcacgcagccaccacag

SEQ ID NO: 500290 - RNA, 32 nt, Human
ucccuagccucuuccuuuuucauuagcccaaa

SEQ ID NO: 500291 - RNA, 32 nt, Human
ucccuagcuccagccucuuccugggccagcca

SEQ ID NO: 500292 - RNA, 32 nt, Human
ucccuagcuccuggccccugccaggggcuuac

SEQ ID NO: 500293 - RNA, 32 nt, Human
ucccuagcugagccacgcugcccaugcagcag

SEQ ID NO: 500294 - RNA, 32 nt, Human
ucccuagcuggcggcucuauucugagcaguuc

SEQ ID NO: 500295 - RNA, 32 nt, Human
ucccuagcuguggcugagccaagauugcacuu

SEQ ID NO: 500296 - RNA, 32 nt, Human
ucccuagcuuggugccuucuccugcaggaguc

SEQ ID NO: 500297 - RNA, 21 nt, Human
ucccuaggcaggcccugcagg

SEQ ID NO: 500298 - RNA, 32 nt, Human
ucccuaggcccagggaggaagcaggucugaag

SEQ ID NO: 500299 - RNA, 32 nt, Human
ucccuaggcugaaggcagaaauuacuuaaauc

SEQ ID NO: 500300 - RNA, 32 nt, Human
ucccuaggcuggucccgaacgcuuggacccga

SEQ ID NO: 500301 - RNA, 32 nt, Human
ucccuagucuuguugccccaguuccuucugga

SEQ ID NO: 500302 - RNA, 32 nt, Human
ucccuaguggagcgcaggggaggcagaaguca

SEQ ID NO: 500303 - RNA, 32 nt, Human
ucccuagugucccuucagccugggcugaccag

SEQ ID NO: 500304 - RNA, 32 nt, Human
ucccuaguucaaaugauucuccugccucagcc

SEQ ID NO: 500305 - RNA, 32 nt, Human
ucccuaguucugaaagagacuugcugugugau

SEQ ID NO: 500306 - RNA, 32 nt, Human
ucccuaguuuccucuccuccagcccagaccca

SEQ ID NO: 500307 - RNA, 32 nt, Human
ucccuauaccauccacccucauggugucuucu

SEQ ID NO: 500308 - RNA, 32 nt, Human
ucccuauagagaaaccauugccaucauuguag

SEQ ID NO: 500309 - RNA, 32 nt, Human
ucccuauaggagcuggugagauugcagccugc

SEQ ID NO: 500310 - RNA, 32 nt, Human
ucccuaucacacaaaugauguuauuuuggacu

SEQ ID NO: 500311 - RNA, 32 nt, Human
ucccuaucaccuuuuguauuuuaaugcaauua

SEQ ID NO: 500312 - RNA, 32 nt, Human
ucccuaucagccccuccagcugccucaguuau

SEQ ID NO: 500313 - RNA, 32 nt, Human
ucccuaugaaagauuccacagagauguuuaug

SEQ ID NO: 500314 - RNA, 32 nt, Human
ucccuaugaggaggaagaucaacgaagucaca

SEQ ID NO: 500315 - RNA, 32 nt, Human
ucccuaugccacgguucccacccucccucacc

SEQ ID NO: 500316 - RNA, 32 nt, Human
ucccuauggaaagagacagaggguguuagaug

SEQ ID NO: 500317 - RNA, 32 nt, Human
ucccuaugggugccugaccugagggcagagac

SEQ ID NO: 500318 - RNA, 32 nt, Human
ucccuauggguucugugaccacugcuggacca

SEQ ID NO: 500319 - RNA, 32 nt, Human
ucccuauuugugaauucugggauuacugacuu

SEQ ID NO: 500320 - RNA, 32 nt, Human
ucccucaaacuaacaccccacacugcuuuggg

SEQ ID NO: 500321 - RNA, 32 nt, Human
ucccucaaagagagaucuuacuagaaccugua

SEQ ID NO: 500322 - RNA, 32 nt, Human
ucccucaagcccucaaguagguguuggagaga

SEQ ID NO: 500323 - RNA, 32 nt, Human
ucccucaaguuuauguucucaugcccucaauc

SEQ ID NO: 500324 - RNA, 32 nt, Human
ucccucaauaaauacauuacuguacucuggaa

SEQ ID NO: 500325 - RNA, 32 nt, Human
ucccucaaugagggaggaaggcagggacaccc

SEQ ID NO: 500326 - RNA, 32 nt, Human
ucccucacaaugcggaaagacagacuucuuca

SEQ ID NO: 500327 - RNA, 32 nt, Human
ucccucacagcccuuggcuggggcuccuccag

SEQ ID NO: 500328 - RNA, 32 nt, Human
ucccucacaggagccaccaccagccaccucuc

SEQ ID NO: 500329 - RNA, 32 nt, Human
ucccucaccagccucaccccuguggugggcuu

SEQ ID NO: 500330 - RNA, 32 nt, Human
ucccucacccacacacugggcgugaggagucu

SEQ ID NO: 500331 - RNA, 32 nt, Human
ucccucacccaccuucugucuagguucacuug

SEQ ID NO: 500332 - RNA, 32 nt, Human
ucccucacccccagcacagggggauucugagc

SEQ ID NO: 500333 - RNA, 32 nt, Human
ucccucaccccuguaagccagacaguuuguuc

SEQ ID NO: 500334 - RNA, 31 nt, Human
ucccucacccucucugggccucaguuucccc

SEQ ID NO: 500335 - RNA, 32 nt, Human
ucccucacccuugagucaaucuuuccauguca

SEQ ID NO: 500336 - RNA, 32 nt, Human
ucccucaccuccaaaagagcaaaaguacuuuc

SEQ ID NO: 500337 - RNA, 32 nt, Human
ucccucaccugccugccugucucccuccucug

SEQ ID NO: 500338 - RNA, 32 nt, Human
ucccucacgagguggggcucaggcuggaggag

SEQ ID NO: 500339 - RNA, 32 nt, Human
ucccucacgccucccuugauuuauguacuacc

SEQ ID NO: 500340 - RNA, 32 nt, Human
ucccucacuacagcuccagucauuaccagcgc

SEQ ID NO: 500341 - RNA, 32 nt, Human
ucccucacucaacacuuugaauacuuauuguu

SEQ ID NO: 500342 - RNA, 32 nt, Human
ucccucacucauucaaaccacucuguguagcc

SEQ ID NO: 500343 - RNA, 19 nt, Human
ucccucacucauuuagcca

SEQ ID NO: 500344 - RNA, 32 nt, Human
ucccucacugcuggacuggagcugggcuccug

SEQ ID NO: 500345 - RNA, 32 nt, Human
ucccucacuuaacccagacuugcucagcugag

SEQ ID NO: 500346 - RNA, 32 nt, Human
ucccucacuuccacgcaugggcucagaacaca

SEQ ID NO: 500347 - RNA, 32 nt, Human
ucccucacuucugcccuuucccuuccuccucc

SEQ ID NO: 500348 - RNA, 32 nt, Human
ucccucagacaggggcuggguggggaggcucu

SEQ ID NO: 500349 - RNA, 32 nt, Human
ucccucagacgcagccccaccaugguccuucg

SEQ ID NO: 500350 - RNA, 32 nt, Human
ucccucagagagaggugacaacagagggggua

SEQ ID NO: 500351 - RNA, 32 nt, Human
ucccucagagguggaggugaggggaaagugaa

SEQ ID NO: 500352 - RNA, 32 nt, Human
ucccucagaguguggguccuucaaacaaugua

SEQ ID NO: 500353 - RNA, 32 nt, Human
ucccucagccaaaucacuuuuccaucucuaaa

SEQ ID NO: 500354 - RNA, 32 nt, Human
ucccucagccacucugccccaagaugggccgu

SEQ ID NO: 500355 - RNA, 32 nt, Human
ucccucagccaggcaggguugcagcugagggc

SEQ ID NO: 500356 - RNA, 32 nt, Human
ucccucagcccauuugcaacucugccucuguu

SEQ ID NO: 500357 - RNA, 32 nt, Human
ucccucagccuccaggcuucagucuucccaac

SEQ ID NO: 500358 - RNA, 32 nt, Human
ucccucagccuccugaguagcuaggaccauag

SEQ ID NO: 500359 - RNA, 30 nt, Human
ucccucagccucucagugccuguccugacc

SEQ ID NO: 500360 - RNA, 27 nt, Human
ucccucagccugugcacccagcauaga

SEQ ID NO: 500361 - RNA, 32 nt, Human
ucccucagcucccagcccagcuuccaugcagc

SEQ ID NO: 500362 - RNA, 19 nt, Human
ucccucagcugagccugcu

SEQ ID NO: 500363 - RNA, 32 nt, Human
ucccucaggaacagcuccagcaccaauaaaga

SEQ ID NO: 500364 - RNA, 32 nt, Human
ucccucaggccugggcggugcagcuuccagag

SEQ ID NO: 500365 - RNA, 32 nt, Human
ucccucaggcuggagugcaguagcgugaucuc

SEQ ID NO: 500366 - RNA, 31 nt, Human
ucccucagggagacaaguuguagaggcaaca

SEQ ID NO: 500367 - RNA, 32 nt, Human
ucccucaggugccauucucccagggcuuaggc

SEQ ID NO: 500368 - RNA, 32 nt, Human
ucccucaguaaagccagaguccuaaaggccuc

SEQ ID NO: 500369 - RNA, 18 nt, Human
ucccucaucagacuguga

SEQ ID NO: 500370 - RNA, 32 nt, Human
ucccucauccuccccaauccccaaacuccuuc

SEQ ID NO: 500371 - RNA, 32 nt, Human
ucccucauccuggugggcacagagauaggcau

SEQ ID NO: 500372 - RNA, 32 nt, Human
ucccucaucuccauagaauaccagcuucugaa

SEQ ID NO: 500373 - RNA, 32 nt, Human
ucccucaucucuggcaggaaagauccacagcu

SEQ ID NO: 500374 - RNA, 32 nt, Human
ucccucaucuggacuccagcgguggcuucuug

SEQ ID NO: 500375 - RNA, 32 nt, Human
ucccucaucuuccuuuaccccucuucucuguc

SEQ ID NO: 500376 - RNA, 18 nt, Human
ucccucaugaaaaaugac

SEQ ID NO: 500377 - RNA, 32 nt, Human
ucccucauuaccccucugggcuuaguccaucc

SEQ ID NO: 500378 - RNA, 21 nt, Human
ucccuccaaaccucccagcca

SEQ ID NO: 500379 - RNA, 32 nt, Human
ucccuccaaggcagcaaagcagaaucgggagc

SEQ ID NO: 500380 - RNA, 32 nt, Human
ucccuccaaguggguccagauagggggcgccc

SEQ ID NO: 500381 - RNA, 32 nt, Human
ucccuccacaagggcuucugauauugucuuag

SEQ ID NO: 500382 - RNA, 32 nt, Human
ucccuccacaauaacagaaacacucccaggga

SEQ ID NO: 500383 - RNA, 21 nt, Human
ucccuccacacugcagccggg

SEQ ID NO: 500384 - RNA, 32 nt, Human
ucccuccacagccccugcuaucugccaucucc

SEQ ID NO: 500385 - RNA, 24 nt, Human
ucccuccaccccagaagcccugac

SEQ ID NO: 500386 - RNA, 32 nt, Human
ucccuccacccccauucugagucucuguccuu

SEQ ID NO: 500387 - RNA, 18 nt, Human
ucccuccacccccuccca

SEQ ID NO: 500388 - RNA, 32 nt, Human
ucccuccacuaguuggggccacugcacugagg

SEQ ID NO: 500389 - RNA, 32 nt, Human
ucccuccacuccucucaacugccucagcgauu

SEQ ID NO: 500390 - RNA, 20 nt, Human
ucccuccagacaguaccaca

SEQ ID NO: 500391 - RNA, 32 nt, Human
ucccuccagagcaacagcuucucaacaggcaa

SEQ ID NO: 500392 - RNA, 32 nt, Human
ucccuccagaggcugagaauugcuugaaccug

SEQ ID NO: 500393 - RNA, 32 nt, Human
ucccuccagcacaaccuguccccacacguggg

SEQ ID NO: 500394 - RNA, 32 nt, Human
ucccuccagcacguccccugcaccacggcaua

SEQ ID NO: 500395 - RNA, 32 nt, Human
ucccuccagcacugccgagguucucugccgag

SEQ ID NO: 500396 - RNA, 32 nt, Human
ucccuccagcugucaggccacgcccagggccc

SEQ ID NO: 500397 - RNA, 32 nt, Human
ucccuccaggauuguggaguuucuuuuacagc

SEQ ID NO: 500398 - RNA, 32 nt, Human
ucccuccagggaucaaaagcauccaaggaauu

SEQ ID NO: 500399 - RNA, 32 nt, Human
ucccuccagguggggcuggagccugcuggcgc

SEQ ID NO: 500400 - RNA, 32 nt, Human
ucccuccagucccuucuccaucccucccuuuu

SEQ ID NO: 500401 - RNA, 32 nt, Human
ucccuccaguggcaccuccuggaaacagucca

SEQ ID NO: 500402 - RNA, 32 nt, Human
ucccuccaguuccuccccagccccuucacuuc

SEQ ID NO: 500403 - RNA, 32 nt, Human
ucccuccaugccucucuggucagugugccuua

SEQ ID NO: 500404 - RNA, 32 nt, Human
ucccuccaugccuucagaguuaggagugagaa

SEQ ID NO: 500405 - RNA, 32 nt, Human
ucccuccaugggcugcuaacccuugccguagc

SEQ ID NO: 500406 - RNA, 32 nt, Human
ucccucccacacccagccuacuggguggacuc

SEQ ID NO: 500407 - RNA, 17 nt, Human
ucccucccaccccuccc

SEQ ID NO: 500408 - RNA, 19 nt, Human
ucccucccaccuccccaca

SEQ ID NO: 500409 - RNA, 32 nt, Human
ucccucccaccucugugaccucaggccuacgc

SEQ ID NO: 500410 - RNA, 32 nt, Human
ucccucccagaggugggaguaacugcugguag

SEQ ID NO: 500411 - RNA, 32 nt, Human
ucccucccagaugggcugggccuuugggcccu

SEQ ID NO: 500412 - RNA, 23 nt, Human
ucccucccagccagcagauuaca

SEQ ID NO: 500413 - RNA, 32 nt, Human
ucccucccauucugccccagcuuccuccagug

SEQ ID NO: 500414 - RNA, 32 nt, Human
ucccuccccagaggaggcgggagggugggcuc

SEQ ID NO: 500415 - RNA, 32 nt, Human
ucccuccccaggguguuccucccugugaccca

SEQ ID NO: 500416 - RNA, 32 nt, Human
ucccucccccuucacccacucccuccagaaca

SEQ ID NO: 500417 - RNA, 32 nt, Human
ucccucccccuucauaaaggccucccuuguca

SEQ ID NO: 500418 - RNA, 32 nt, Human
ucccucccccuuccucucuuccuuccuucccu

SEQ ID NO: 500419 - RNA, 32 nt, Human
ucccucccccuucuccuucacccccaaguguc

SEQ ID NO: 500420 - RNA, 32 nt, Human
ucccucccccuucucugucccccgccucucgc

SEQ ID NO: 500421 - RNA, 32 nt, Human
ucccuccccucccucucgcuccuuccuuuccg

SEQ ID NO: 500422 - RNA, 32 nt, Human
ucccuccccucuccacccaccccacagcaggc

SEQ ID NO: 500423 - RNA, 32 nt, Human
ucccuccccugccugguucccagggcaggcug

SEQ ID NO: 500424 - RNA, 32 nt, Human
ucccuccccuugccugugccaggugaggucag

SEQ ID NO: 500425 - RNA, 21 nt, Human
ucccuccccuuuaugcuuaau

SEQ ID NO: 500426 - RNA, 21 nt, Human
ucccucccgccgcagcgcggg

SEQ ID NO: 500427 - RNA, 32 nt, Human
ucccucccuccagaugcagaggcuggggaguc

SEQ ID NO: 500428 - RNA, 32 nt, Human
ucccucccuccccucaauacccucaguacuga

SEQ ID NO: 500429 - RNA, 20 nt, Human
ucccucccucccucuucugc

SEQ ID NO: 500430 - RNA, 32 nt, Human
ucccucccuccugugcugcugcuuuuugaucu

SEQ ID NO: 500431 - RNA, 32 nt, Human
ucccucccucgcgcaucuccagccuaaggguu

SEQ ID NO: 500432 - RNA, 32 nt, Human
ucccucccucguuuccagcuccugggcgaauc

SEQ ID NO: 500433 - RNA, 32 nt, Human
ucccucccugcccugcugaauccuaaagcugu

SEQ ID NO: 500434 - RNA, 32 nt, Human
ucccucccugucuuccugcucagcuuucuccc

SEQ ID NO: 500435 - RNA, 32 nt, Human
ucccucccuuccccuccccuucuaccuccucc

SEQ ID NO: 500436 - RNA, 32 nt, Human
ucccucccuuucuccuaaagccugguccccag

SEQ ID NO: 500437 - RNA, 32 nt, Human
ucccuccgaagaggaguccgaagaggacagcg

SEQ ID NO: 500438 - RNA, 32 nt, Human
ucccuccgcggcgggcccugcccacaccuccu

SEQ ID NO: 500439 - RNA, 32 nt, Human
ucccuccggcccccucccuggaguccacagcg

SEQ ID NO: 500440 - RNA, 32 nt, Human
ucccuccggccggcaggcugggcgcagggggc

SEQ ID NO: 500441 - RNA, 32 nt, Human
ucccuccggccgguccccagcugcaguggcug

SEQ ID NO: 500442 - RNA, 32 nt, Human
ucccuccgucccacuccacuccaggcugccgg

SEQ ID NO: 500443 - RNA, 32 nt, Human
ucccuccucacagauaaaugaaaaguaaguau

SEQ ID NO: 500444 - RNA, 32 nt, Human
ucccuccucacaucccucccacccucggucau

SEQ ID NO: 500445 - RNA, 32 nt, Human
ucccuccucaccagcucuccagccaggacgau

SEQ ID NO: 500446 - RNA, 32 nt, Human
ucccuccucaucaucaggcagauacagagcac

SEQ ID NO: 500447 - RNA, 32 nt, Human
ucccuccuccacccuccacucauuuuguucuu

SEQ ID NO: 500448 - RNA, 32 nt, Human
ucccuccuccacugcagaacuccaguaaaauc

SEQ ID NO: 500449 - RNA, 32 nt, Human
ucccuccuccaggcauccuggugccugcauac

SEQ ID NO: 500450 - RNA, 32 nt, Human
ucccuccucccaggcuggugugagugugcgug

SEQ ID NO: 500451 - RNA, 32 nt, Human
ucccuccucccagggguucagauguggugggg

SEQ ID NO: 500452 - RNA, 32 nt, Human
ucccuccuccccgccugcagcucucuuuaauu

SEQ ID NO: 500453 - RNA, 32 nt, Human
ucccuccuccuaugucuccauccuccaaaucu

SEQ ID NO: 500454 - RNA, 32 nt, Human
ucccuccuccuccccucucccucccccucucc

SEQ ID NO: 500455 - RNA, 32 nt, Human
ucccuccuccucuuucaccuucauacaagcag

SEQ ID NO: 500456 - RNA, 32 nt, Human
ucccuccuccugcccccaccucaggccucacu

SEQ ID NO: 500457 - RNA, 32 nt, Human
ucccuccucuaaaccacuuugaugaggaccaa

SEQ ID NO: 500458 - RNA, 32 nt, Human
ucccuccucuacucugaccuggggccccagca

SEQ ID NO: 500459 - RNA, 32 nt, Human
ucccuccucucccucacucauguccccuccca

SEQ ID NO: 500460 - RNA, 32 nt, Human
ucccuccucugccucuguucgcauaguaagaa

SEQ ID NO: 500461 - RNA, 32 nt, Human
ucccuccucugucaccaccagccucuccaagc

SEQ ID NO: 500462 - RNA, 32 nt, Human
ucccuccucuucucagagaccucccuuuccaa

SEQ ID NO: 500463 - RNA, 32 nt, Human
ucccuccugacccagggauggaggcuuugagu

SEQ ID NO: 500464 - RNA, 32 nt, Human
ucccuccugcacaccuggccuccugggccucc

SEQ ID NO: 500465 - RNA, 32 nt, Human
ucccuccugcagccucugcucagaacgcccuu

SEQ ID NO: 500466 - RNA, 32 nt, Human
ucccuccugcagccugcccccuaggcagcucg

SEQ ID NO: 500467 - RNA, 32 nt, Human
ucccuccugcaucuccccuggaguguucacuu

SEQ ID NO: 500468 - RNA, 32 nt, Human
ucccuccugccgacuccuggguugagcuguug

SEQ ID NO: 500469 - RNA, 32 nt, Human
ucccuccugccugcccgccagccugaccugug

SEQ ID NO: 500470 - RNA, 32 nt, Human
ucccuccugccugugggagcugcaccguggag

SEQ ID NO: 500471 - RNA, 32 nt, Human
ucccuccugcgcccgggcgcccccagcggguu

SEQ ID NO: 500472 - RNA, 32 nt, Human
ucccuccuggggauucuggggaaugggaugca

SEQ ID NO: 500473 - RNA, 32 nt, Human
ucccuccuguagggcacaaggccaggcugccu

SEQ ID NO: 500474 - RNA, 32 nt, Human
ucccuccuguagucccagcuacuugggaggcu

SEQ ID NO: 500475 - RNA, 32 nt, Human
ucccuccuguggccuccacugcaggcaggaca

SEQ ID NO: 500476 - RNA, 32 nt, Human
ucccuccuuacaaccaccgccaccuccuagug

SEQ ID NO: 500477 - RNA, 32 nt, Human
ucccuccuucccuuccccuuccuuccuuccuu

SEQ ID NO: 500478 - RNA, 32 nt, Human
ucccuccuuccuuccacucuccuuccuuuugc

SEQ ID NO: 500479 - RNA, 32 nt, Human
ucccuccuucucccucuccuucacacuacagu

SEQ ID NO: 500480 - RNA, 28 nt, Human
ucccuccuucuugcugccuccuccuccu

SEQ ID NO: 500481 - RNA, 32 nt, Human
ucccuccuugccucccccuccagccucccacu

SEQ ID NO: 500482 - RNA, 32 nt, Human
ucccucgaccucucucuucucacuuucuuccc

SEQ ID NO: 500483 - RNA, 32 nt, Human
ucccucgaguuguggugugaagagauaaauca

SEQ ID NO: 500484 - RNA, 32 nt, Human
ucccucgcaaguagcugggauuacaggcgccu

SEQ ID NO: 500485 - RNA, 32 nt, Human
ucccucgcaccacgugcccuccuggccgcgcc

SEQ ID NO: 500486 - RNA, 32 nt, Human
ucccucgcucaccccauccucucucccgcccc

SEQ ID NO: 500487 - RNA, 32 nt, Human
ucccucgcucucucccccuucucuccccuucu

SEQ ID NO: 500488 - RNA, 32 nt, Human
ucccucgcuguucaacugcuagcaugauuugu

SEQ ID NO: 500489 - RNA, 32 nt, Human
ucccucgcuguugaggccaccaugccuuacug

SEQ ID NO: 500490 - RNA, 32 nt, Human
ucccucggagacgcagguugcaguggacauug

SEQ ID NO: 500491 - RNA, 31 nt, Human
ucccucggcuucucugggucuagugcgggug

SEQ ID NO: 500492 - RNA, 32 nt, Human
ucccucgggcugcggacucugccuccuggguc

SEQ ID NO: 500493 - RNA, 32 nt, Human
ucccucggggccugagaagaucugguccucaa

SEQ ID NO: 500494 - RNA, 32 nt, Human
ucccucggucgggggucgaggcugcuuccguu

SEQ ID NO: 500495 - RNA, 18 nt, Human
ucccucgucgccgccucg

SEQ ID NO: 500496 - RNA, 32 nt, Human
ucccucgugcugucucuugccugucccaccug

SEQ ID NO: 500497 - RNA, 32 nt, Human
ucccucuaagaacaugacacugagaugaucaa

SEQ ID NO: 500498 - RNA, 32 nt, Human
ucccucuacacgcaaaucccaggcugggggau

SEQ ID NO: 500499 - RNA, 21 nt, Human
ucccucuacccagauugugaa

SEQ ID NO: 500500 - RNA, 32 nt, Human
ucccucucaaaaccagaacaucaacagugcug

SEQ ID NO: 500501 - RNA, 32 nt, Human
ucccucucaaauaccaugauguaucaugggcu

SEQ ID NO: 500502 - RNA, 32 nt, Human
ucccucucaagcucugcccuucccagcccagc

SEQ ID NO: 500503 - RNA, 19 nt, Human
ucccucucaaguguuccac

SEQ ID NO: 500504 - RNA, 32 nt, Human
ucccucucacacugccucagugcucacaaccu

SEQ ID NO: 500505 - RNA, 32 nt, Human
ucccucucagaccacuggaaugcaaguccuuc

SEQ ID NO: 500506 - RNA, 32 nt, Human
ucccucucaggcagagagguugccgagugauu

SEQ ID NO: 500507 - RNA, 32 nt, Human
ucccucuccagaaguccauuggaauauuaagc

SEQ ID NO: 500508 - RNA, 32 nt, Human
ucccucuccaucccaucuuugcagccucuugg

SEQ ID NO: 500509 - RNA, 32 nt, Human
ucccucucccagccuccaccccagggucugca

SEQ ID NO: 500510 - RNA, 32 nt, Human
ucccucucccagcugucagugcuuuuggacuu

SEQ ID NO: 500511 - RNA, 32 nt, Human
ucccucucccuccuccauuccucucucccugc

SEQ ID NO: 500512 - RNA, 32 nt, Human
ucccucucccucucccacucucccucucuuuc

SEQ ID NO: 500513 - RNA, 18 nt, Human
ucccucuccggggcuccu

SEQ ID NO: 500514 - RNA, 32 nt, Human
ucccucuccuaggagcacaggaaauggugcag

SEQ ID NO: 500515 - RNA, 32 nt, Human
ucccucuccucccagcccaugguaaccagcau

SEQ ID NO: 500516 - RNA, 32 nt, Human
ucccucuccucccugagcaccugcugcugcga

SEQ ID NO: 500517 - RNA, 32 nt, Human
ucccucuccuccucagcuacuuauuccccacc

SEQ ID NO: 500518 - RNA, 32 nt, Human
ucccucuccuccuucccccucaucuccccuuc

SEQ ID NO: 500519 - RNA, 22 nt, Human
ucccucuccugccaccucucca

SEQ ID NO: 500520 - RNA, 32 nt, Human
ucccucuccuuuccuucuucuucccucagauu

SEQ ID NO: 500521 - RNA, 17 nt, Human
ucccucucuaccugcca

SEQ ID NO: 500522 - RNA, 32 nt, Human
ucccucucucaucccuuccccuucccuuccuu

SEQ ID NO: 500523 - RNA, 32 nt, Human
ucccucucuccccucccccuccaguccacgac

SEQ ID NO: 500524 - RNA, 32 nt, Human
ucccucucuccccuggcccgcaaaguuuuggc

SEQ ID NO: 500525 - RNA, 32 nt, Human
ucccucucuccuccucucccuggcuuuguguu

SEQ ID NO: 500526 - RNA, 32 nt, Human
ucccucucuccuccucuuccucucucuggacg

SEQ ID NO: 500527 - RNA, 32 nt, Human
ucccucucucucccucucucucccucucucuu

SEQ ID NO: 500528 - RNA, 18 nt, Human
ucccucucucucuucugc

SEQ ID NO: 500529 - RNA, 32 nt, Human
ucccucucucucuucugcuucucccucuggcu

SEQ ID NO: 500530 - RNA, 32 nt, Human
ucccucucucuuccuuuuccugccgucuuucu

SEQ ID NO: 500531 - RNA, 32 nt, Human
ucccucucucuuucuucuuucuccugccaucc

SEQ ID NO: 500532 - RNA, 32 nt, Human
ucccucucugcuccuucucucuuccacagguc

SEQ ID NO: 500533 - RNA, 32 nt, Human
ucccucucugcucuccugucccuugagcccuu

SEQ ID NO: 500534 - RNA, 32 nt, Human
ucccucucuggaccucaguuucccucuguaua

SEQ ID NO: 500535 - RNA, 32 nt, Human
ucccucucuggcccccuggccuggggaaagcc

SEQ ID NO: 500536 - RNA, 32 nt, Human
ucccucucuggcggccucugcagcagcacagc

SEQ ID NO: 500537 - RNA, 32 nt, Human
ucccucucugucuaggugucaugguucugugu

SEQ ID NO: 500538 - RNA, 32 nt, Human
ucccucucuuccaaggagaugucagcugagcu

SEQ ID NO: 500539 - RNA, 32 nt, Human
ucccucucuuccaccuccccaggcugggcucc

SEQ ID NO: 500540 - RNA, 32 nt, Human
ucccucucuucccauucuccuuuuaaaucucu

SEQ ID NO: 500541 - RNA, 32 nt, Human
ucccucugaagaucucuuaggagugcaccagu

SEQ ID NO: 500542 - RNA, 19 nt, Human
ucccucugaagugcagugg

SEQ ID NO: 500543 - RNA, 32 nt, Human
ucccucugagcaguuuccccacugugucuguc

SEQ ID NO: 500544 - RNA, 20 nt, Human
ucccucugaguggggccagg

SEQ ID NO: 500545 - RNA, 32 nt, Human
ucccucugcacccucuggaacccuggcccaau

SEQ ID NO: 500546 - RNA, 32 nt, Human
ucccucugcaggagacucuugcagugacggaa

SEQ ID NO: 500547 - RNA, 32 nt, Human
ucccucugcaggcugggggcagaggccugagg

SEQ ID NO: 500548 - RNA, 32 nt, Human
ucccucugcaggucacagacacacagagccca

SEQ ID NO: 500549 - RNA, 32 nt, Human
ucccucugcaugggaugugacccccuccucua

SEQ ID NO: 500550 - RNA, 19 nt, Human
ucccucugccaagccugcu

SEQ ID NO: 500551 - RNA, 32 nt, Human
ucccucugccaaggccugugccagagggguug

SEQ ID NO: 500552 - RNA, 32 nt, Human
ucccucugcccaggugggggccguggcuggaa

SEQ ID NO: 500553 - RNA, 32 nt, Human
ucccucugccuagaacacucucucccaaguau

SEQ ID NO: 500554 - RNA, 15 nt, Human
ucccucugccugcca

SEQ ID NO: 500555 - RNA, 32 nt, Human
ucccucugcgggcuucucuugcucugagccuc

SEQ ID NO: 500556 - RNA, 32 nt, Human
ucccucugcugacccccugcagccuggagcca

SEQ ID NO: 500557 - RNA, 32 nt, Human
ucccucugcugcugccuuggcuuccuccuaau

SEQ ID NO: 500558 - RNA, 32 nt, Human
ucccucugcuggucugugcuggucucagaagg

SEQ ID NO: 500559 - RNA, 32 nt, Human
ucccucugcuguguucccacagacagaaacgc

SEQ ID NO: 500560 - RNA, 32 nt, Human
ucccucugcuucuuuucucuucugcccuccuu

SEQ ID NO: 500561 - RNA, 32 nt, Human
ucccucuggagcuuccaccuggccagggagga

SEQ ID NO: 500562 - RNA, 32 nt, Human
ucccucuggaguuuccuucaucugccccacac

SEQ ID NO: 500563 - RNA, 32 nt, Human
ucccucuggauccuuuucuugacaagcaguca

SEQ ID NO: 500564 - RNA, 32 nt, Human
ucccucuggcucccgggucacucuuguggccc

SEQ ID NO: 500565 - RNA, 32 nt, Human
ucccucugguaacaucuucccaccacacauau

SEQ ID NO: 500566 - RNA, 29 nt, Human
ucccucuggugucugccaucccccucccu

SEQ ID NO: 500567 - RNA, 32 nt, Human
ucccucuguaaaguuggagugcaggggacaag

SEQ ID NO: 500568 - RNA, 32 nt, Human
ucccucuguaauuucaaaaugaaugaaauuca

SEQ ID NO: 500569 - RNA, 32 nt, Human
ucccucuguaccaucugcuguggaaugcagga

SEQ ID NO: 500570 - RNA, 32 nt, Human
ucccucuguauacuuuaaagcucucuacaguc

SEQ ID NO: 500571 - RNA, 32 nt, Human
ucccucuguauaugugugugggaugggaagug

SEQ ID NO: 500572 - RNA, 32 nt, Human
ucccucugucaccaggcuggagugcaguggug

SEQ ID NO: 500573 - RNA, 32 nt, Human
ucccucuguccucugucagccuggccugaccc

SEQ ID NO: 500574 - RNA, 32 nt, Human
ucccucuguccugggaauuccucuuuguggca

SEQ ID NO: 500575 - RNA, 32 nt, Human
ucccucugucugucugucuaucuacuugucug

SEQ ID NO: 500576 - RNA, 32 nt, Human
ucccucugugccaggccagagugcaguggugc

SEQ ID NO: 500577 - RNA, 20 nt, Human
ucccucugugguugcugcau

SEQ ID NO: 500578 - RNA, 32 nt, Human
ucccucuguugacuggucaucuggaccaucgu

SEQ ID NO: 500579 - RNA, 32 nt, Human
ucccucuuaacguuccccuccugguuuugccu

SEQ ID NO: 500580 - RNA, 32 nt, Human
ucccucuuccauuccucgagcuacuccagggc

SEQ ID NO: 500581 - RNA, 32 nt, Human
ucccucuucccuccucccuccauccuuguuuu

SEQ ID NO: 500582 - RNA, 32 nt, Human
ucccucuuccuugguucccucuucccuggucc

SEQ ID NO: 500583 - RNA, 32 nt, Human
ucccucuucgguguucuucuucucuucucugc

SEQ ID NO: 500584 - RNA, 32 nt, Human
ucccucuucuccccagccuccuccagggcugc

SEQ ID NO: 500585 - RNA, 32 nt, Human
ucccucuucucccccaguucccugggcaauca

SEQ ID NO: 500586 - RNA, 32 nt, Human
ucccucuucuccccucccccuccucaccgucu

SEQ ID NO: 500587 - RNA, 32 nt, Human
ucccucuucucuugccugaucaucuaguuuuu

SEQ ID NO: 500588 - RNA, 32 nt, Human
ucccucuucuucuuuuucauccuucugucucu

SEQ ID NO: 500589 - RNA, 32 nt, Human
ucccucuucuuucuuacuuccauaaguaugua

SEQ ID NO: 500590 - RNA, 32 nt, Human
ucccucuugcugucucuguuucucauucucuu

SEQ ID NO: 500591 - RNA, 32 nt, Human
ucccucuuguagagccacaggguuaaaaggga

SEQ ID NO: 500592 - RNA, 32 nt, Human
ucccucuuguuacccaggcuggagugcagugg

SEQ ID NO: 500593 - RNA, 32 nt, Human
ucccucuuguugcccaggcuggagugcaacgg

SEQ ID NO: 500594 - RNA, 32 nt, Human
ucccucuuguugcccaggcuggagugcaaugg

SEQ ID NO: 500595 - RNA, 32 nt, Human
ucccucuuucccacccuccaccucucacgggc

SEQ ID NO: 500596 - RNA, 32 nt, Human
ucccucuuuccuuacaccuuguggaucaugug

SEQ ID NO: 500597 - RNA, 32 nt, Human
ucccucuuuccuuccuuccuccuggucuguuc

SEQ ID NO: 500598 - RNA, 32 nt, Human
ucccucuuucuuucccucccucccucccuccc

SEQ ID NO: 500599 - RNA, 32 nt, Human
ucccucuuugccugugugagcaucucugugua

SEQ ID NO: 500600 - RNA, 32 nt, Human
ucccucuuuuucucccuucucuggggcgcagg

SEQ ID NO: 500601 - RNA, 24 nt, Human
ucccugaaauaugguagccuggcc

SEQ ID NO: 500602 - RNA, 32 nt, Human
ucccugaacauacagugcccuuuacacuugau

SEQ ID NO: 500603 - RNA, 32 nt, Human
ucccugaacucuuggggcugagcugcaaccac

SEQ ID NO: 500604 - RNA, 32 nt, Human
ucccugaagagugcccuggucacagcacccuu

SEQ ID NO: 500605 - RNA, 32 nt, Human
ucccugaagccaggccacccagccaucagcag

SEQ ID NO: 500606 - RNA, 32 nt, Human
ucccugaagcgaguacacauugccagagccca

SEQ ID NO: 500607 - RNA, 32 nt, Human
ucccugaaggggcugcugacugccccagaauc

SEQ ID NO: 500608 - RNA, 32 nt, Human
ucccugaaucaccgacuggaggagaguuaccu

SEQ ID NO: 500609 - RNA, 32 nt, Human
ucccugaauccauggagguguucuguuugggg

SEQ ID NO: 500610 - RNA, 32 nt, Human
ucccugaaugagagcacagaggcauugaauuc

SEQ ID NO: 500611 - RNA, 32 nt, Human
ucccugacaaaacuaaagaacucuccuauuca

SEQ ID NO: 500612 - RNA, 31 nt, Human
ucccugacaaugucuccuacucaagcagggc

SEQ ID NO: 500613 - RNA, 23 nt, Human
ucccugacaauguggccuggcca

SEQ ID NO: 500614 - RNA, 32 nt, Human
ucccugacaccucugcacucccuugggcagag

SEQ ID NO: 500615 - RNA, 21 nt, Human
ucccugacacugcggggcuug

SEQ ID NO: 500616 - RNA, 18 nt, Human
ucccugaccagacuggaa

SEQ ID NO: 500617 - RNA, 32 nt, Human
ucccugacccagcaucagaaaacacauauugg

SEQ ID NO: 500618 - RNA, 32 nt, Human
ucccugacccagggcuggugaggaguggggcc

SEQ ID NO: 500619 - RNA, 24 nt, Human
ucccugaccuagccauggcacaga

SEQ ID NO: 500620 - RNA, 27 nt, Human
ucccugaccugagaacccuggggccug

SEQ ID NO: 500621 - RNA, 32 nt, Human
ucccugaccugcaccagguggcaccaaggguc

SEQ ID NO: 500622 - RNA, 32 nt, Human
ucccugaccuggagaggguuagaaagaaccaa

SEQ ID NO: 500623 - RNA, 32 nt, Human
ucccugacggcccuugcugccugcauggcuga

SEQ ID NO: 500624 - RNA, 32 nt, Human
ucccugacuccuggugcccucucccuuugucc

SEQ ID NO: 500625 - RNA, 21 nt, Human
ucccugacucucugugaccug

SEQ ID NO: 500626 - RNA, 32 nt, Human
ucccugacuguaaaugcuccauuuuuaaaguu

SEQ ID NO: 500627 - RNA, 32 nt, Human
ucccugacuucagaagugaagccacauaccuu

SEQ ID NO: 500628 - RNA, 32 nt, Human
ucccugagaaaggagaaaaagaugggauugcc

SEQ ID NO: 500629 - RNA, 32 nt, Human
ucccugagacccauaagguucaucuuauggga

SEQ ID NO: 500630 - RNA, 32 nt, Human
ucccugagacgggagucaaaaucagcaucccu

SEQ ID NO: 500631 - RNA, 32 nt, Human
ucccugagagacaugguuuccaugagcacagu

SEQ ID NO: 500632 - RNA, 31 nt, Human
ucccugagagucucuguuucaucaggacauu

SEQ ID NO: 500633 - RNA, 32 nt, Human
ucccugagauggauaccucuaccugcauggcc

SEQ ID NO: 500634 - RNA, 32 nt, Human
ucccugagcaggcaaggagcucuugcauuugc

SEQ ID NO: 500635 - RNA, 32 nt, Human
ucccugagccagccccagcagagacuggagag

SEQ ID NO: 500636 - RNA, 32 nt, Human
ucccugagccaguggcauccugccugggcccc

SEQ ID NO: 500637 - RNA, 22 nt, Human
ucccugagccccuuggcacuua

SEQ ID NO: 500638 - RNA, 32 nt, Human
ucccugagccgccugccaccucccacuccuga

SEQ ID NO: 500639 - RNA, 32 nt, Human
ucccugagccucuaguuccucacucuuccuuu

SEQ ID NO: 500640 - RNA, 32 nt, Human
ucccugagccucugaaagugaacuccccgacc

SEQ ID NO: 500641 - RNA, 32 nt, Human
ucccugagcuguucuucugccccauacugaag

SEQ ID NO: 500642 - RNA, 32 nt, Human
ucccugagcuuucuggcuucaggcugggaggc

SEQ ID NO: 500643 - RNA, 32 nt, Human
ucccugaggcagagguugcagugagcugagau

SEQ ID NO: 500644 - RNA, 32 nt, Human
ucccugaggcagcaggagcugguguguacugg

SEQ ID NO: 500645 - RNA, 32 nt, Human
ucccugaggcgaggguagcgggugcauggcgc

SEQ ID NO: 500646 - RNA, 32 nt, Human
ucccugaggcugccucugggccuguggaucca

SEQ ID NO: 500647 - RNA, 32 nt, Human
ucccugaggcuggacuccagaucugcaccgcc

SEQ ID NO: 500648 - RNA, 32 nt, Human
ucccugaguagcugggacuacaggcacacacc

SEQ ID NO: 500649 - RNA, 32 nt, Human
ucccugagucuuguccuccugagaggaagccc

SEQ ID NO: 500650 - RNA, 32 nt, Human
ucccugagugccuguguagcuggggaugggga

SEQ ID NO: 500651 - RNA, 32 nt, Human
ucccugagugcugggaggaggcugcaguacuc

SEQ ID NO: 500652 - RNA, 32 nt, Human
ucccugauagccacuuacuuuccuauccuaaa

SEQ ID NO: 500653 - RNA, 32 nt, Human
ucccugaucaguccucccagacugcacuggag

SEQ ID NO: 500654 - RNA, 32 nt, Human
ucccugauccccaggcuuggggcaauugguaa

SEQ ID NO: 500655 - RNA, 21 nt, Human
ucccugaucucaugggacuua

SEQ ID NO: 500656 - RNA, 31 nt, Human
ucccugaugaaggcuccugaggcccucgacc

SEQ ID NO: 500657 - RNA, 32 nt, Human
ucccugaugccugcuuucaguugaggguuggg

SEQ ID NO: 500658 - RNA, 32 nt, Human
ucccugaugucaggaugccuuuguuaggaucu

SEQ ID NO: 500659 - RNA, 32 nt, Human
ucccugauuacauaaugcucuucugagcacuu

SEQ ID NO: 500660 - RNA, 32 nt, Human
ucccugauugucaagaccuacucugaagaucu

SEQ ID NO: 500661 - RNA, 32 nt, Human
ucccugauuuucaaacugguugccugcaucuu

SEQ ID NO: 500662 - RNA, 27 nt, Human
ucccugauuuuucuuucaugggacuug

SEQ ID NO: 500663 - RNA, 32 nt, Human
ucccugcacaugcaggcaugcaugcacauacg

SEQ ID NO: 500664 - RNA, 32 nt, Human
ucccugcacaugcccuuuugccugugucaugu

SEQ ID NO: 500665 - RNA, 32 nt, Human
ucccugcaccacucucuucauccugggggcuc

SEQ ID NO: 500666 - RNA, 32 nt, Human
ucccugcaccucugccccaaggcugcccggcg

SEQ ID NO: 500667 - RNA, 32 nt, Human
ucccugcacuguucccugcacuguuccccaug

SEQ ID NO: 500668 - RNA, 32 nt, Human
ucccugcagauucaugaagaugagcauccgga

SEQ ID NO: 500669 - RNA, 32 nt, Human
ucccugcagcagaggcagaggcggcggcggca

SEQ ID NO: 500670 - RNA, 32 nt, Human
ucccugcagccaccguucagagcccgggcgag

SEQ ID NO: 500671 - RNA, 32 nt, Human
ucccugcagccccuccuuagcccaugucaugc

SEQ ID NO: 500672 - RNA, 32 nt, Human
ucccugcagccucaacaccacccugcugucca

SEQ ID NO: 500673 - RNA, 32 nt, Human
ucccugcagccuggcuggcuuuucuucuucuu

SEQ ID NO: 500674 - RNA, 32 nt, Human
ucccugcagcucagcacccccagccuggugcu

SEQ ID NO: 500675 - RNA, 32 nt, Human
ucccugcagcugagccugucucucacgggacc

SEQ ID NO: 500676 - RNA, 21 nt, Human
ucccugcaggccacacuccaa

SEQ ID NO: 500677 - RNA, 22 nt, Human
ucccugcaggccgcacugccaa

SEQ ID NO: 500678 - RNA, 32 nt, Human
ucccugcaggucucggggcuccuggguugcuu

SEQ ID NO: 500679 - RNA, 32 nt, Human
ucccugcagguuaagaauccacacaaccaagu

SEQ ID NO: 500680 - RNA, 32 nt, Human
ucccugcagucaucucuuugcacuuuguuacu

SEQ ID NO: 500681 - RNA, 22 nt, Human
ucccugcaguccugggggccua

SEQ ID NO: 500682 - RNA, 32 nt, Human
ucccugcagugucacuguuaaagcaacaguca

SEQ ID NO: 500683 - RNA, 32 nt, Human
ucccugcaucauacccaggaacugccagcucc

SEQ ID NO: 500684 - RNA, 32 nt, Human
ucccugcaucuugguccuuguccccuuggcca

SEQ ID NO: 500685 - RNA, 18 nt, Human
ucccugcaugacugugaa

SEQ ID NO: 500686 - RNA, 32 nt, Human
ucccugcauggcccgaugaccugcacuccugu

SEQ ID NO: 500687 - RNA, 32 nt, Human
ucccugcauggggaucuguaaagagaaaguuu

SEQ ID NO: 500688 - RNA, 32 nt, Human
ucccugcauuagugccugguuacuggguaccu

SEQ ID NO: 500689 - RNA, 32 nt, Human
ucccugccaaccuccuccucccugcccagccu

SEQ ID NO: 500690 - RNA, 32 nt, Human
ucccugccaccaggaugcccaagaggaagguc

SEQ ID NO: 500691 - RNA, 32 nt, Human
ucccugccaccaguuuucaccuagccagucuu

SEQ ID NO: 500692 - RNA, 32 nt, Human
ucccugccaccauccuccuuccugggcuccag

SEQ ID NO: 500693 - RNA, 32 nt, Human
ucccugccacgcccuggcaggacacaggcacu

SEQ ID NO: 500694 - RNA, 32 nt, Human
ucccugccacuguggguggaagggcccucuuc

SEQ ID NO: 500695 - RNA, 32 nt, Human
ucccugccagucucccccucuucugccagccu

SEQ ID NO: 500696 - RNA, 32 nt, Human
ucccugccaucagguugcugggaguggagaug

SEQ ID NO: 500697 - RNA, 32 nt, Human
ucccugccaucuggcccuucccuuugucucag

SEQ ID NO: 500698 - RNA, 32 nt, Human
ucccugccauuuuucacaccucucuuaauuuu

SEQ ID NO: 500699 - RNA, 32 nt, Human
ucccugcccacucugggccuugcugacaccug

SEQ ID NO: 500700 - RNA, 32 nt, Human
ucccugcccagccagggacuucuacucugcaa

SEQ ID NO: 500701 - RNA, 32 nt, Human
ucccugcccagccuguggugcuugaaacguuu

SEQ ID NO: 500702 - RNA, 32 nt, Human
ucccugcccaggcuggagcuggccaauucucc

SEQ ID NO: 500703 - RNA, 21 nt, Human
ucccugccccaaccggagagg

SEQ ID NO: 500704 - RNA, 32 nt, Human
ucccugcccccaggugucuacacaccugugua

SEQ ID NO: 500705 - RNA, 32 nt, Human
ucccugcccccgaccuggaguggauaagacaa

SEQ ID NO: 500706 - RNA, 32 nt, Human
ucccugcccccgggggcuucacaugccacugg

SEQ ID NO: 500707 - RNA, 32 nt, Human
ucccugccccuccagauugccuggugaucuau

SEQ ID NO: 500708 - RNA, 32 nt, Human
ucccugccccucccccugucuuuccacucugu

SEQ ID NO: 500709 - RNA, 32 nt, Human
ucccugccccucuccccuucacaccugcugga

SEQ ID NO: 500710 - RNA, 31 nt, Human
ucccugccccucucugccuguucuggacugu

SEQ ID NO: 500711 - RNA, 32 nt, Human
ucccugcccgcuggucaagaccacgccuggga

SEQ ID NO: 500712 - RNA, 32 nt, Human
ucccugcccuccagucccuccugcuuuuuagc

SEQ ID NO: 500713 - RNA, 32 nt, Human
ucccugcccucugcucucacaggcuggggaug

SEQ ID NO: 500714 - RNA, 32 nt, Human
ucccugcccugagacuguucugaggcccuggg

SEQ ID NO: 500715 - RNA, 32 nt, Human
ucccugcccugccuccagccuugguggcuccu

SEQ ID NO: 500716 - RNA, 32 nt, Human
ucccugcccugcucugcuagggagagaacgcc

SEQ ID NO: 500717 - RNA, 32 nt, Human
ucccugccuaucuccuccgcccgccuucuccu

SEQ ID NO: 500718 - RNA, 32 nt, Human
ucccugccuaugcugacauuccauuguagaaa

SEQ ID NO: 500719 - RNA, 32 nt, Human
ucccugccucagccucaugaauagcugggauu

SEQ ID NO: 500720 - RNA, 32 nt, Human
ucccugccuccccauuccccuggcugcacuuc

SEQ ID NO: 500721 - RNA, 24 nt, Human
ucccugccuccuccucucuucugc

SEQ ID NO: 500722 - RNA, 21 nt, Human
ucccugccucucaauucgcug

SEQ ID NO: 500723 - RNA, 32 nt, Human
ucccugccucuccugccucccuucccacuucc

SEQ ID NO: 500724 - RNA, 32 nt, Human
ucccugccugagggucacaguaccuugaaugg

SEQ ID NO: 500725 - RNA, 32 nt, Human
ucccugccugccugcugacccguggccccagc

SEQ ID NO: 500726 - RNA, 32 nt, Human
ucccugccugcucuuuaggccuuuggcaccca

SEQ ID NO: 500727 - RNA, 32 nt, Human
ucccugccuggaccauucccagcucccugcuc

SEQ ID NO: 500728 - RNA, 32 nt, Human
ucccugccuggaucucaccagcacuuucccuc

SEQ ID NO: 500729 - RNA, 32 nt, Human
ucccugccuggaucucacgagcacuuucccuc

SEQ ID NO: 500730 - RNA, 32 nt, Human
ucccugccuguggccccuccccugcagacgga

SEQ ID NO: 500731 - RNA, 32 nt, Human
ucccugccuucuugcccugcccucucuguagc

SEQ ID NO: 500732 - RNA, 32 nt, Human
ucccugccuugcacaagugcaggaugggggaa

SEQ ID NO: 500733 - RNA, 32 nt, Human
ucccugccuuucuucccuuugccuuucucucu

SEQ ID NO: 500734 - RNA, 32 nt, Human
ucccugccuuuucuagcuucugggggcuccag

SEQ ID NO: 500735 - RNA, 32 nt, Human
ucccugcgcgccgccucucacucacagccucc

SEQ ID NO: 500736 - RNA, 32 nt, Human
ucccugcggcagaaccuccugcccugcaccug

SEQ ID NO: 500737 - RNA, 32 nt, Human
ucccugcggccuccagcagugaagaguuccac

SEQ ID NO: 500738 - RNA, 24 nt, Human
ucccugcuaggccagcccugcagg

SEQ ID NO: 500739 - RNA, 32 nt, Human
ucccugcucacacccacacuggcugcugauug

SEQ ID NO: 500740 - RNA, 32 nt, Human
ucccugcucacucagccaccucccucucccuc

SEQ ID NO: 500741 - RNA, 32 nt, Human
ucccugcucacugcagccuccgcuucccuggu

SEQ ID NO: 500742 - RNA, 22 nt, Human
ucccugcucaguccagcacagg

SEQ ID NO: 500743 - RNA, 32 nt, Human
ucccugcucccaccuggaaccuugccagcgug

SEQ ID NO: 500744 - RNA, 32 nt, Human
ucccugcucccagcucucucuccuggagucug

SEQ ID NO: 500745 - RNA, 32 nt, Human
ucccugcuccuccaaagcccacgucgccugcg

SEQ ID NO: 500746 - RNA, 32 nt, Human
ucccugcuccuuccugucccuuuaccgguccc

SEQ ID NO: 500747 - RNA, 32 nt, Human
ucccugcucucaucucagcucccuccaggccu

SEQ ID NO: 500748 - RNA, 32 nt, Human
ucccugcucucccaggccccugccacagccuc

SEQ ID NO: 500749 - RNA, 32 nt, Human
ucccugcucugcccccaacuggcuguauaacc

SEQ ID NO: 500750 - RNA, 32 nt, Human
ucccugcucugccucccacccaguugccugaa

SEQ ID NO: 500751 - RNA, 32 nt, Human
ucccugcucugggagcauugcuagccuucuac

SEQ ID NO: 500752 - RNA, 32 nt, Human
ucccugcucuuuccuuuuucccggcuuccuuc

SEQ ID NO: 500753 - RNA, 21 nt, Human
ucccugcugcagcgcuagaaa

SEQ ID NO: 500754 - RNA, 22 nt, Human
ucccugcugcaguccacaggga

SEQ ID NO: 500755 - RNA, 32 nt, Human
ucccugcugccacuuaucccagcuccaaguuu

SEQ ID NO: 500756 - RNA, 32 nt, Human
ucccugcugccaugaaacuuugccuuaagaag

SEQ ID NO: 500757 - RNA, 32 nt, Human
ucccugcuggaaggcauucucagagcuuuaug

SEQ ID NO: 500758 - RNA, 32 nt, Human
ucccugcuggccuccagccagugccacuugga

SEQ ID NO: 500759 - RNA, 19 nt, Human
ucccugcugggcugccuca

SEQ ID NO: 500760 - RNA, 32 nt, Human
ucccugcugggugggacagaggacaaaggaga

SEQ ID NO: 500761 - RNA, 31 nt, Human
ucccugcuucuuuucugaccgggaaauaaau

SEQ ID NO: 500762 - RNA, 32 nt, Human
ucccugcuugcagcugugaagggggcaggaau

SEQ ID NO: 500763 - RNA, 32 nt, Human
ucccugcuuuacugcugagcuccugcuggagg

SEQ ID NO: 500764 - RNA, 25 nt, Human
ucccuggaaacaacucuggcacaga

SEQ ID NO: 500765 - RNA, 32 nt, Human
ucccuggaaacagugcccaccccacaucacua

SEQ ID NO: 500766 - RNA, 32 nt, Human
ucccuggaagccucuuuggaaaccacauagag

SEQ ID NO: 500767 - RNA, 32 nt, Human
ucccuggaaguggcagcagcagugagcaguca

SEQ ID NO: 500768 - RNA, 22 nt, Human
ucccuggaaguuugcggcagga

SEQ ID NO: 500769 - RNA, 22 nt, Human
ucccuggacacacuaugcagca

SEQ ID NO: 500770 - RNA, 32 nt, Human
ucccuggacacauucguggggcaggaaaaaga

SEQ ID NO: 500771 - RNA, 20 nt, Human
ucccuggacacgaagccagg

SEQ ID NO: 500772 - RNA, 24 nt, Human
ucccuggacagggcacagcaagga

SEQ ID NO: 500773 - RNA, 22 nt, Human
ucccuggacauacguuagcaca

SEQ ID NO: 500774 - RNA, 32 nt, Human
ucccuggaccaccaccccacguagcugcucac

SEQ ID NO: 500775 - RNA, 32 nt, Human
ucccuggaccaggguggcacagcuccaggcuc

SEQ ID NO: 500776 - RNA, 29 nt, Human
ucccuggacccaaaguguagccucuguaa

SEQ ID NO: 500777 - RNA, 29 nt, Human
ucccuggacccauugcaucaccucuguaa

SEQ ID NO: 500778 - RNA, 23 nt, Human
ucccuggaccccugcagggcagg

SEQ ID NO: 500779 - RNA, 32 nt, Human
ucccuggacccuaguacacucuaccuccuugg

SEQ ID NO: 500780 - RNA, 24 nt, Human
ucccuggacccuggcuggcaugga

SEQ ID NO: 500781 - RNA, 32 nt, Human
ucccuggaccugccugacaggccacaggagca

SEQ ID NO: 500782 - RNA, 22 nt, Human
ucccuggacgugcggccgcgga

SEQ ID NO: 500783 - RNA, 32 nt, Human
ucccuggacuaccuucaggaggcacgagagcu

SEQ ID NO: 500784 - RNA, 32 nt, Human
ucccuggacuccucugaccugacugcuuccga

SEQ ID NO: 500785 - RNA, 24 nt, Human
ucccuggacugagcucagcgcagg

SEQ ID NO: 500786 - RNA, 32 nt, Human
ucccuggagaggcggagcugaauggcccggac

SEQ ID NO: 500787 - RNA, 22 nt, Human
ucccuggagcaggcagugugga

SEQ ID NO: 500788 - RNA, 32 nt, Human
ucccuggagcccgggaaggaggcugccuggcu

SEQ ID NO: 500789 - RNA, 23 nt, Human
ucccuggagcccgugcccaggga

SEQ ID NO: 500790 - RNA, 22 nt, Human
ucccuggagcggcagcugcgga

SEQ ID NO: 500791 - RNA, 32 nt, Human
ucccuggaggcacgcaccacugcuucccacug

SEQ ID NO: 500792 - RNA, 32 nt, Human
ucccuggaggccuggucaguggggccucaucu

SEQ ID NO: 500793 - RNA, 32 nt, Human
ucccuggagggcaagcccugcccacagaaagc

SEQ ID NO: 500794 - RNA, 21 nt, Human
ucccuggagggcagcaaugga

SEQ ID NO: 500795 - RNA, 32 nt, Human
ucccuggaguuucuggaagaugccgugggaug

SEQ ID NO: 500796 - RNA, 26 nt, Human
ucccuggauaguccacugugugcaga

SEQ ID NO: 500797 - RNA, 22 nt, Human
ucccuggaugcagagacacggg

SEQ ID NO: 500798 - RNA, 32 nt, Human
ucccuggauggcaggaaggaagcaggugggag

SEQ ID NO: 500799 - RNA, 32 nt, Human
ucccuggaugugagacauggaaucaaaggaga

SEQ ID NO: 500800 - RNA, 32 nt, Human
ucccuggauucuggcaaaucuccgucuaguaa

SEQ ID NO: 500801 - RNA, 32 nt, Human
ucccuggauugcugggaauggaagccaggguu

SEQ ID NO: 500802 - RNA, 20 nt, Human
ucccuggcaccugccuggcc

SEQ ID NO: 500803 - RNA, 32 nt, Human
ucccuggcagggccuggagaagucuggaggcu

SEQ ID NO: 500804 - RNA, 32 nt, Human
ucccuggcaguggauugugggaggcucuugcu

SEQ ID NO: 500805 - RNA, 32 nt, Human
ucccuggccaagaagccaggagagggacggcu

SEQ ID NO: 500806 - RNA, 32 nt, Human
ucccuggccacagccucagcuugggagccucu

SEQ ID NO: 500807 - RNA, 32 nt, Human
ucccuggccacugccccugccgcggaggcagc

SEQ ID NO: 500808 - RNA, 32 nt, Human
ucccuggccauccugaauauccagaauggugu

SEQ ID NO: 500809 - RNA, 22 nt, Human
ucccuggccaucuucagagggg

SEQ ID NO: 500810 - RNA, 24 nt, Human
ucccuggcccagcaaaccaagagg

SEQ ID NO: 500811 - RNA, 32 nt, Human
ucccuggcccaggaguuuuccaguguguugcu

SEQ ID NO: 500812 - RNA, 19 nt, Human
ucccuggccccuucggaga

SEQ ID NO: 500813 - RNA, 32 nt, Human
ucccuggcccucaggcccuccuuccagggaug

SEQ ID NO: 500814 - RNA, 20 nt, Human
ucccuggcccuccccagaga

SEQ ID NO: 500815 - RNA, 21 nt, Human
ucccuggcccuguagcacaga

SEQ ID NO: 500816 - RNA, 21 nt, Human
ucccuggcccuuccugagagg

SEQ ID NO: 500817 - RNA, 21 nt, Human
ucccuggccggcugggaucug

SEQ ID NO: 500818 - RNA, 32 nt, Human
ucccuggccuccagugcccaccaggaggaucu

SEQ ID NO: 500819 - RNA, 32 nt, Human
ucccuggccuggggccacaccugcugcccucc

SEQ ID NO: 500820 - RNA, 21 nt, Human
ucccuggccugguggggccug

SEQ ID NO: 500821 - RNA, 32 nt, Human
ucccuggcgaggcagacgcugcggguggagac

SEQ ID NO: 500822 - RNA, 32 nt, Human
ucccuggcgauccucaccugcccagccauggc

SEQ ID NO: 500823 - RNA, 32 nt, Human
ucccuggcgccuggagugcacacagcccaguc

SEQ ID NO: 500824 - RNA, 32 nt, Human
ucccuggcguccucucccuccuggccagaugu

SEQ ID NO: 500825 - RNA, 22 nt, Human
ucccuggcgugccgcagacaga

SEQ ID NO: 500826 - RNA, 24 nt, Human
ucccuggcguguguaggccuggcc

SEQ ID NO: 500827 - RNA, 32 nt, Human
ucccuggcuacagcaaaggacgaugucugccu

SEQ ID NO: 500828 - RNA, 32 nt, Human
ucccuggcucaagcaauucuccuaugucagcc

SEQ ID NO: 500829 - RNA, 32 nt, Human
ucccuggcucaagcagucuucaucucagccuc

SEQ ID NO: 500830 - RNA, 32 nt, Human
ucccuggcucaagcgaucccuccccucagccu

SEQ ID NO: 500831 - RNA, 32 nt, Human
ucccuggcucaagugaucuuccagccucagcc

SEQ ID NO: 500832 - RNA, 32 nt, Human
ucccuggcucaagugauucuccugccucagcc

SEQ ID NO: 500833 - RNA, 32 nt, Human
ucccuggcucaagugggcacuguaccuuuugc

SEQ ID NO: 500834 - RNA, 21 nt, Human
ucccuggcuccccugaaucug

SEQ ID NO: 500835 - RNA, 32 nt, Human
ucccuggcucgcugucccgcagccugggcggg

SEQ ID NO: 500836 - RNA, 32 nt, Human
ucccuggcucggcucccugccuccgcgucgca

SEQ ID NO: 500837 - RNA, 26 nt, Human
ucccuggcucuaugcagaggggccug

SEQ ID NO: 500838 - RNA, 32 nt, Human
ucccuggcucugcccuucuuacugcaaaccau

SEQ ID NO: 500839 - RNA, 22 nt, Human
ucccuggcugcacguugggacc

SEQ ID NO: 500840 - RNA, 32 nt, Human
ucccuggcuggucucggacuccugggcucaag

SEQ ID NO: 500841 - RNA, 32 nt, Human
ucccuggcuguuccuuucaggcuuccgugcag

SEQ ID NO: 500842 - RNA, 21 nt, Human
ucccuggcuuaacucagaaag

SEQ ID NO: 500843 - RNA, 32 nt, Human
ucccuggcuucucugcugcaauuuuugucuuu

SEQ ID NO: 500844 - RNA, 24 nt, Human
ucccuggcuucucuggggcacuug

SEQ ID NO: 500845 - RNA, 32 nt, Human
ucccuggcuucuuucuuucccucucucuuucu

SEQ ID NO: 500846 - RNA, 31 nt, Human
ucccuggcuugcucugggccucaguuucccu

SEQ ID NO: 500847 - RNA, 18 nt, Human
ucccugggaaagggguug

SEQ ID NO: 500848 - RNA, 21 nt, Human
ucccugggaacgcagagcagg

SEQ ID NO: 500849 - RNA, 32 nt, Human
ucccugggacagauccaggucugcagaucgac

SEQ ID NO: 500850 - RNA, 21 nt, Human
ucccugggagagcagcacaga

SEQ ID NO: 500851 - RNA, 32 nt, Human
ucccugggaggaaggcuccaaauucucacuac

SEQ ID NO: 500852 - RNA, 22 nt, Human
ucccugggcaacacuggucagg

SEQ ID NO: 500853 - RNA, 21 nt, Human
ucccugggcacaugugcacac

SEQ ID NO: 500854 - RNA, 21 nt, Human
ucccugggcacccaagccggg

SEQ ID NO: 500855 - RNA, 23 nt, Human
ucccugggcacccugcaggcagg

SEQ ID NO: 500856 - RNA, 23 nt, Human
ucccugggcagagccagcucggg

SEQ ID NO: 500857 - RNA, 32 nt, Human
ucccugggcaggaagacugaggaggaagggau

SEQ ID NO: 500858 - RNA, 22 nt, Human
ucccugggcagggccagagggg

SEQ ID NO: 500859 - RNA, 32 nt, Human
ucccugggcaguuaccaaacaguuauucuagu

SEQ ID NO: 500860 - RNA, 22 nt, Human
ucccugggcaucuuuggccagg

SEQ ID NO: 500861 - RNA, 25 nt, Human
ucccugggccaccgggcagccuggg

SEQ ID NO: 500862 - RNA, 32 nt, Human
ucccugggccccuucucuccugggcagccaca

SEQ ID NO: 500863 - RNA, 22 nt, Human
ucccugggccgcgguggccagg

SEQ ID NO: 500864 - RNA, 32 nt, Human
ucccugggccucauggucugucuccucuagcc

SEQ ID NO: 500865 - RNA, 32 nt, Human
ucccugggccuccagcccggccuuccagccau

SEQ ID NO: 500866 - RNA, 21 nt, Human
ucccugggccugaggcacgga

SEQ ID NO: 500867 - RNA, 26 nt, Human
ucccugggcgccaacuagaguaugga

SEQ ID NO: 500868 - RNA, 32 nt, Human
ucccugggcggggagcgggggaagggaugggg

SEQ ID NO: 500869 - RNA, 32 nt, Human
ucccugggcuauggaucgaggagcugcuacuc

SEQ ID NO: 500870 - RNA, 32 nt, Human
ucccugggcucagcaacccaggaggccaugac

SEQ ID NO: 500871 - RNA, 32 nt, Human
ucccugggcuccuugccagcucccucuucccu

SEQ ID NO: 500872 - RNA, 32 nt, Human
ucccugggcucuggggcugaaggauuccagcc

SEQ ID NO: 500873 - RNA, 32 nt, Human
ucccugggcugccugcacucaguucucagccu

SEQ ID NO: 500874 - RNA, 18 nt, Human
ucccugggcuggcauggg

SEQ ID NO: 500875 - RNA, 26 nt, Human
ucccugggcugugcugcaggcacagg

SEQ ID NO: 500876 - RNA, 32 nt, Human
ucccugggcuuacugugcagcaggugcuuuuu

SEQ ID NO: 500877 - RNA, 32 nt, Human
ucccugggcuuccccacugccugcugaaggga

SEQ ID NO: 500878 - RNA, 16 nt, Human
ucccuggggagcuguc

SEQ ID NO: 500879 - RNA, 32 nt, Human
ucccuggggaucugcauuucuaacaggcuccu

SEQ ID NO: 500880 - RNA, 32 nt, Human
ucccuggggcagcugcucccugggccucugag

SEQ ID NO: 500881 - RNA, 32 nt, Human
ucccuggggcccuggccuaccacucacuggcc

SEQ ID NO: 500882 - RNA, 21 nt, Human
ucccuggggcggcagcgcgga

SEQ ID NO: 500883 - RNA, 32 nt, Human
ucccuggggcuccucuggccguguggggcuag

SEQ ID NO: 500884 - RNA, 20 nt, Human
ucccugggggagaccuauga

SEQ ID NO: 500885 - RNA, 21 nt, Human
ucccuggggggcaggggccag

SEQ ID NO: 500886 - RNA, 32 nt, Human
ucccugggguaguaggauaauggggaacagug

SEQ ID NO: 500887 - RNA, 24 nt, Human
ucccuggggucacgcgcagccgga

SEQ ID NO: 500888 - RNA, 32 nt, Human
ucccugggguccccaaauccaggcuagagcau

SEQ ID NO: 500889 - RNA, 32 nt, Human
ucccugggguccugccuuccaaccacggcauu

SEQ ID NO: 500890 - RNA, 32 nt, Human
ucccuggggucuggcucacugccuuaucagga

SEQ ID NO: 500891 - RNA, 32 nt, Human
ucccugggguucuccuccucucccagggccuc

SEQ ID NO: 500892 - RNA, 32 nt, Human
ucccugggucaaaggagaaugguggagcucuu

SEQ ID NO: 500893 - RNA, 32 nt, Human
ucccugggucacccaccccucgcugcuugccc

SEQ ID NO: 500894 - RNA, 21 nt, Human
ucccugggucauccagugaga

SEQ ID NO: 500895 - RNA, 32 nt, Human
ucccugggugccgcacguccagccugugucca

SEQ ID NO: 500896 - RNA, 32 nt, Human
ucccuggguuugagcaauccucccaccucagc

SEQ ID NO: 500897 - RNA, 32 nt, Human
ucccuggguuuucugccccagccuccuccuuc

SEQ ID NO: 500898 - RNA, 32 nt, Human
ucccugguacuccagcuuugagguccuaggaa

SEQ ID NO: 500899 - RNA, 32 nt, Human
ucccugguacuuccagcuuccaacucuaggga

SEQ ID NO: 500900 - RNA, 32 nt, Human
ucccugguccugauggcagaacccacccgauc

SEQ ID NO: 500901 - RNA, 32 nt, Human
ucccuggugaaggcuuaaagaugaggaagaug

SEQ ID NO: 500902 - RNA, 32 nt, Human
ucccuggugaaguguugcagguugugaacucu

SEQ ID NO: 500903 - RNA, 23 nt, Human
ucccuggugcaaguguucaucca

SEQ ID NO: 500904 - RNA, 24 nt, Human
ucccuggugcagguggccuggcca

SEQ ID NO: 500905 - RNA, 32 nt, Human
ucccuggugcagguggccuggccagcccacug

SEQ ID NO: 500906 - RNA, 22 nt, Human
ucccuggugcauaggaccuggc

SEQ ID NO: 500907 - RNA, 20 nt, Human
ucccuggugcccuccuggcc

SEQ ID NO: 500908 - RNA, 32 nt, Human
ucccuggugcccuccuggcccugcugcccagu

SEQ ID NO: 500909 - RNA, 24 nt, Human
ucccuggugcuccccgcgcagcca

SEQ ID NO: 500910 - RNA, 32 nt, Human
ucccuggugcugccucacacuccugagaucca

SEQ ID NO: 500911 - RNA, 22 nt, Human
ucccuggugcuggcaccaacca

SEQ ID NO: 500912 - RNA, 32 nt, Human
ucccugguggcucuccccuuuggagagagcua

SEQ ID NO: 500913 - RNA, 32 nt, Human
ucccuggugugucuguucucuccucuguccca

SEQ ID NO: 500914 - RNA, 32 nt, Human
ucccugguucaaacgauucuccugccucagcc

SEQ ID NO: 500915 - RNA, 32 nt, Human
ucccugguucaagcgauucuccugccucagcc

SEQ ID NO: 500916 - RNA, 32 nt, Human
ucccugguucaagcgauucuccugccuccucc

SEQ ID NO: 500917 - RNA, 32 nt, Human
ucccugguucaagcgauucuccugccuuagcc

SEQ ID NO: 500918 - RNA, 32 nt, Human
ucccugguucaagcgauucucuugccucagcu

SEQ ID NO: 500919 - RNA, 32 nt, Human
ucccugguucaagcgauuguccugccucagcc

SEQ ID NO: 500920 - RNA, 32 nt, Human
ucccugguucaagugauucuccugccucagcc

SEQ ID NO: 500921 - RNA, 32 nt, Human
ucccugguucaagugauucuccugccucaucc

SEQ ID NO: 500922 - RNA, 20 nt, Human
ucccugguucaggcccagcc

SEQ ID NO: 500923 - RNA, 32 nt, Human
ucccugguugccucucuugccccuuguccuga

SEQ ID NO: 500924 - RNA, 25 nt, Human
ucccugguuugggcuggccuggcca

SEQ ID NO: 500925 - RNA, 32 nt, Human
ucccuguaaaaugcagauuacagguauuaaag

SEQ ID NO: 500926 - RNA, 32 nt, Human
ucccuguaaucccagugcuuugggaggccgaa

SEQ ID NO: 500927 - RNA, 32 nt, Human
ucccuguagcagcagaugguacagugaguguu

SEQ ID NO: 500928 - RNA, 20 nt, Human
ucccuguagcccagccugca

SEQ ID NO: 500929 - RNA, 32 nt, Human
ucccuguagugaaguccaggagggugggacag

SEQ ID NO: 500930 - RNA, 26 nt, Human
ucccuguauuccaaaaccugcugcau

SEQ ID NO: 500931 - RNA, 32 nt, Human
ucccugucacccagccauggugugguccaggc

SEQ ID NO: 500932 - RNA, 32 nt, Human
ucccugucacuggagcacgcuggcagauuugg

SEQ ID NO: 500933 - RNA, 32 nt, Human
ucccugucagccacacccuuugucucccccua

SEQ ID NO: 500934 - RNA, 32 nt, Human
ucccuguccauguccacagaaggagauucacu

SEQ ID NO: 500935 - RNA, 32 nt, Human
ucccugucccagcugcuccuggggaguagaag

SEQ ID NO: 500936 - RNA, 32 nt, Human
ucccugucccccaaccugcagggaagaugacc

SEQ ID NO: 500937 - RNA, 20 nt, Human
ucccugucccccuccucugu

SEQ ID NO: 500938 - RNA, 32 nt, Human
ucccuguccccucggagaguucagggagagcu

SEQ ID NO: 500939 - RNA, 18 nt, Human
ucccuguccccucuucug

SEQ ID NO: 500940 - RNA, 31 nt, Human
ucccuguccccucuugggccugagguccucc

SEQ ID NO: 500941 - RNA, 32 nt, Human
ucccuguccuagucuugaucuguucugggcca

SEQ ID NO: 500942 - RNA, 32 nt, Human
ucccuguccucagacagugccaccauggccau

SEQ ID NO: 500943 - RNA, 32 nt, Human
ucccuguccuccuccuggauuguugaggaaaa

SEQ ID NO: 500944 - RNA, 32 nt, Human
ucccuguccuugccaaccaugccagugccugg

SEQ ID NO: 500945 - RNA, 32 nt, Human
ucccugucucacacuucuuuucucccaucccg

SEQ ID NO: 500946 - RNA, 32 nt, Human
ucccugucuccuccauccuggcugugcaguag

SEQ ID NO: 500947 - RNA, 32 nt, Human
ucccugucugauagagggaaccccuguacuga

SEQ ID NO: 500948 - RNA, 22 nt, Human
ucccugucuggaggcucaccuu

SEQ ID NO: 500949 - RNA, 32 nt, Human
ucccugucugucuguguuaguagaaaaauaaa

SEQ ID NO: 500950 - RNA, 32 nt, Human
ucccugucuucucuccccauuuuguccuuugc

SEQ ID NO: 500951 - RNA, 32 nt, Human
ucccugucuucuguccccaucuuccugccgau

SEQ ID NO: 500952 - RNA, 32 nt, Human
ucccugucuuucucugagccugucuccuuccu

SEQ ID NO: 500953 - RNA, 32 nt, Human
ucccugugaggcugggcugaggcacggauccc

SEQ ID NO: 500954 - RNA, 32 nt, Human
ucccugugauaccucucagaugacaacaaagu

SEQ ID NO: 500955 - RNA, 32 nt, Human
ucccugugauaggacaacuaguacauuuaaua

SEQ ID NO: 500956 - RNA, 24 nt, Human
ucccugugcagcauucaaaaauca

SEQ ID NO: 500957 - RNA, 32 nt, Human
ucccugugcccgugugccccagggcaggaaag

SEQ ID NO: 500958 - RNA, 32 nt, Human
ucccugugcccucucagcucugaggcuggccg

SEQ ID NO: 500959 - RNA, 32 nt, Human
ucccugugcccucuugcugccugccugucugc

SEQ ID NO: 500960 - RNA, 32 nt, Human
ucccugugcccugccuugcuuccuccaggacu

SEQ ID NO: 500961 - RNA, 32 nt, Human
ucccugugccggacuccagccggggcgacgag

SEQ ID NO: 500962 - RNA, 32 nt, Human
ucccugugcuccaccugccuccgcagaaggaa

SEQ ID NO: 500963 - RNA, 32 nt, Human
ucccugugcugggggagccucagucugcccuu

SEQ ID NO: 500964 - RNA, 23 nt, Human
ucccuguggaaaggggccuauga

SEQ ID NO: 500965 - RNA, 21 nt, Human
ucccuguggaauguaccuaug

SEQ ID NO: 500966 - RNA, 32 nt, Human
ucccuguggagccagggcugagccuugucacg

SEQ ID NO: 500967 - RNA, 32 nt, Human
ucccuguggagugggcucugcccacggggcag

SEQ ID NO: 500968 - RNA, 32 nt, Human
ucccuguggcaugaaccccacaggguauuaaa

SEQ ID NO: 500969 - RNA, 32 nt, Human
ucccuguggccagcgugaacagagccaugccc

SEQ ID NO: 500970 - RNA, 24 nt, Human
ucccuguggcuacaguagcgcaga

SEQ ID NO: 500971 - RNA, 32 nt, Human
ucccugugggaugucaucacccugggaaccgg

SEQ ID NO: 500972 - RNA, 32 nt, Human
ucccugugggcaagggcuuggcggcaguccug

SEQ ID NO: 500973 - RNA, 32 nt, Human
ucccuguguccacagguguucuccagugccaa

SEQ ID NO: 500974 - RNA, 32 nt, Human
ucccugugucccagacccuccugcugccacca

SEQ ID NO: 500975 - RNA, 32 nt, Human
ucccuguguggggcucaagccuggugcacuua

SEQ ID NO: 500976 - RNA, 32 nt, Human
ucccugugugggggaagggcaccccacagucu

SEQ ID NO: 500977 - RNA, 32 nt, Human
ucccuguguugcucugagccugguuggcaucc

SEQ ID NO: 500978 - RNA, 32 nt, Human
ucccuguguuuccuugcccuuuagaaaaugaa

SEQ ID NO: 500979 - RNA, 32 nt, Human
ucccuguuagcaauggcagagaccagccugga

SEQ ID NO: 500980 - RNA, 32 nt, Human
ucccuguucauaccaucucugcacccacaauc

SEQ ID NO: 500981 - RNA, 32 nt, Human
ucccuguuccagcugcucccucacuggccucc

SEQ ID NO: 500982 - RNA, 32 nt, Human
ucccuguuccagguuuauuuaauuccaaaggu

SEQ ID NO: 500983 - RNA, 32 nt, Human
ucccuguucccugagaccuggccucaaagggc

SEQ ID NO: 500984 - RNA, 23 nt, Human
ucccuguuccucacucagagagg

SEQ ID NO: 500985 - RNA, 32 nt, Human
ucccuguucugccucuuuaacucaguuaaguu

SEQ ID NO: 500986 - RNA, 22 nt, Human
ucccuguugccaguuagagagg

SEQ ID NO: 500987 - RNA, 32 nt, Human
ucccuguugcccaaguuggagugcaaucuugg

SEQ ID NO: 500988 - RNA, 32 nt, Human
ucccuguuguaacaucaagugaucagaacuaa

SEQ ID NO: 500989 - RNA, 32 nt, Human
ucccuuaaagauuuucugcuugaagucucccu

SEQ ID NO: 500990 - RNA, 32 nt, Human
ucccuuaacaguguugaauucaacugaaggcg

SEQ ID NO: 500991 - RNA, 32 nt, Human
ucccuuaaguuccccuguucaaggcauaccuu

SEQ ID NO: 500992 - RNA, 32 nt, Human
ucccuuaccaggaguguggcaagccucccugg

SEQ ID NO: 500993 - RNA, 22 nt, Human
ucccuuacccaucuugcuucca

SEQ ID NO: 500994 - RNA, 32 nt, Human
ucccuuacccccacuuccccagcacuuugaag

SEQ ID NO: 500995 - RNA, 32 nt, Human
ucccuuaccccucccuuagucuuggguuaagu

SEQ ID NO: 500996 - RNA, 32 nt, Human
ucccuuacgcccuuccuccucucccuccuccu

SEQ ID NO: 500997 - RNA, 32 nt, Human
ucccuuacgguuugugcugcuguuucuggggc

SEQ ID NO: 500998 - RNA, 32 nt, Human
ucccuuacuccccucucgcucccucuacccuc

SEQ ID NO: 500999 - RNA, 21 nt, Human
ucccuuacucuucggggguuu

SEQ ID NO: 501000 - RNA, 32 nt, Human
ucccuuacugacuguuucguggcccuauuaau

SEQ ID NO: 501001 - RNA, 32 nt, Human
ucccuuacugagcuugcugagcuccggggccc

SEQ ID NO: 501002 - RNA, 32 nt, Human
ucccuuacuuagucugccuucucuccacuuuu

SEQ ID NO: 501003 - RNA, 32 nt, Human
ucccuuagagcaaaggagagacagcccccauu

SEQ ID NO: 501004 - RNA, 32 nt, Human
ucccuuagcccugacuuuacuugcugugggaa

SEQ ID NO: 501005 - RNA, 32 nt, Human
ucccuuagcuacucaggaggccgaggcacaac

SEQ ID NO: 501006 - RNA, 32 nt, Human
ucccuuagcuacucaggaggccgaggcagaaa

SEQ ID NO: 501007 - RNA, 32 nt, Human
ucccuuagcuacucaggaggcugaggcaggag

SEQ ID NO: 501008 - RNA, 32 nt, Human
ucccuuaguaaucauuugugccuaaugcaucc

SEQ ID NO: 501009 - RNA, 32 nt, Human
ucccuuaguacagugugcugaccucaugagcc

SEQ ID NO: 501010 - RNA, 32 nt, Human
ucccuucaaccauaguaguuccucuguaccga

SEQ ID NO: 501011 - RNA, 20 nt, Human
ucccuucaagccucccaggc

SEQ ID NO: 501012 - RNA, 32 nt, Human
ucccuucaauaugccucuggcuguuccgcuua

SEQ ID NO: 501013 - RNA, 32 nt, Human
ucccuucacaagcccucucucucccucucuuu

SEQ ID NO: 501014 - RNA, 32 nt, Human
ucccuucaccacagugccugacccgcggcccc

SEQ ID NO: 501015 - RNA, 32 nt, Human
ucccuucaccuugcuugccuccugccucggaa

SEQ ID NO: 501016 - RNA, 32 nt, Human
ucccuucacugcacuuucuuccugccuuaggu

SEQ ID NO: 501017 - RNA, 32 nt, Human
ucccuucagaacuugaaguuucucccacugcc

SEQ ID NO: 501018 - RNA, 32 nt, Human
ucccuucagacucaggggcuccaccaaugcca

SEQ ID NO: 501019 - RNA, 32 nt, Human
ucccuucagcaacuuauuuugcuuuaauugcu

SEQ ID NO: 501020 - RNA, 32 nt, Human
ucccuucagccggcagagcgagcccagcgugg

SEQ ID NO: 501021 - RNA, 32 nt, Human
ucccuucaggacagugcuccccucuagcccag

SEQ ID NO: 501022 - RNA, 32 nt, Human
ucccuucaggcggagguugcagugagccgaga

SEQ ID NO: 501023 - RNA, 32 nt, Human
ucccuucaguacugcagcgccacccaguggaa

SEQ ID NO: 501024 - RNA, 32 nt, Human
ucccuucagucaguguccccaggguccagccu

SEQ ID NO: 501025 - RNA, 32 nt, Human
ucccuucauacuccucacccuacgcaccgcau

SEQ ID NO: 501026 - RNA, 32 nt, Human
ucccuucauucugcagugagauugccgagacc

SEQ ID NO: 501027 - RNA, 22 nt, Human
ucccuuccaagacccaagugca

SEQ ID NO: 501028 - RNA, 32 nt, Human
ucccuuccaagucucacaccucccuuaguccc

SEQ ID NO: 501029 - RNA, 32 nt, Human
ucccuuccaauguaaucucugccaacaccaug

SEQ ID NO: 501030 - RNA, 17 nt, Human
ucccuuccaccaccaaa

SEQ ID NO: 501031 - RNA, 32 nt, Human
ucccuuccagcuguuccauucucuccaccacc

SEQ ID NO: 501032 - RNA, 28 nt, Human
ucccuuccaggguucgccucaucugagg

SEQ ID NO: 501033 - RNA, 24 nt, Human
ucccuucccacagaccauaaacca

SEQ ID NO: 501034 - RNA, 21 nt, Human
ucccuucccaccccaacugca

SEQ ID NO: 501035 - RNA, 21 nt, Human
ucccuucccaccccucacuca

SEQ ID NO: 501036 - RNA, 32 nt, Human
ucccuucccagagggucuuacuguuccagggu

SEQ ID NO: 501037 - RNA, 22 nt, Human
ucccuucccagccuuguaacca

SEQ ID NO: 501038 - RNA, 32 nt, Human
ucccuucccccacuucacguccuuccugggac

SEQ ID NO: 501039 - RNA, 32 nt, Human
ucccuuccccuccacuaaaucuacucucuauu

SEQ ID NO: 501040 - RNA, 32 nt, Human
ucccuuccccuuccuuccuuccuuccuuccuu

SEQ ID NO: 501041 - RNA, 23 nt, Human
ucccuucccuccccccucagggg

SEQ ID NO: 501042 - RNA, 32 nt, Human
ucccuucccucccucccuccccucucugcugg

SEQ ID NO: 501043 - RNA, 32 nt, Human
ucccuucccuccuccuuccucauccuucuguc

SEQ ID NO: 501044 - RNA, 31 nt, Human
ucccuucccugccucuugccugugucccagc

SEQ ID NO: 501045 - RNA, 32 nt, Human
ucccuucccugccucuugccugugucccagcc

SEQ ID NO: 501046 - RNA, 32 nt, Human
ucccuucccuuccaucucuuccuuuccuuucc

SEQ ID NO: 501047 - RNA, 32 nt, Human
ucccuucccuuucaagguugucuugggaaccu

SEQ ID NO: 501048 - RNA, 32 nt, Human
ucccuucccuuucacucuuuccuucuuuccuu

SEQ ID NO: 501049 - RNA, 32 nt, Human
ucccuucccuuucccagggccuucucacagcc

SEQ ID NO: 501050 - RNA, 32 nt, Human
ucccuucccuuuccuuuucccuuucccuuucc

SEQ ID NO: 501051 - RNA, 24 nt, Human
ucccuucccuuuucucugcucaau

SEQ ID NO: 501052 - RNA, 32 nt, Human
ucccuuccggaaagcuugcuuugaaaaacuua

SEQ ID NO: 501053 - RNA, 32 nt, Human
ucccuuccuccaccacccugcucucaaaggcc

SEQ ID NO: 501054 - RNA, 32 nt, Human
ucccuuccuccacgugaggacauggcauuuac

SEQ ID NO: 501055 - RNA, 32 nt, Human
ucccuuccucccauuggccucuccuugccaaa

SEQ ID NO: 501056 - RNA, 32 nt, Human
ucccuuccucccucccuuccucccggcggccg

SEQ ID NO: 501057 - RNA, 32 nt, Human
ucccuuccuccuccuccagaugccuuuucucu

SEQ ID NO: 501058 - RNA, 32 nt, Human
ucccuuccuccucuccccuuuacccccuuccu

SEQ ID NO: 501059 - RNA, 32 nt, Human
ucccuuccucuccuuguauguaauaccuuuuu

SEQ ID NO: 501060 - RNA, 32 nt, Human
ucccuuccuuccucuccugucucccuccucug

SEQ ID NO: 501061 - RNA, 32 nt, Human
ucccuuccuugcagaauccuugcuccugaaua

SEQ ID NO: 501062 - RNA, 32 nt, Human
ucccuuccuuucccccuuccucccucccccuu

SEQ ID NO: 501063 - RNA, 32 nt, Human
ucccuucgccacccuccacccacccaccucgc

SEQ ID NO: 501064 - RNA, 32 nt, Human
ucccuucggaggaaaauuucaggcugaagguu

SEQ ID NO: 501065 - RNA, 21 nt, Human
ucccuucuaaguugucuucuu

SEQ ID NO: 501066 - RNA, 32 nt, Human
ucccuucuacagccucagaaaccagacucguu

SEQ ID NO: 501067 - RNA, 32 nt, Human
ucccuucuacuucacuccucaggggagugaag

SEQ ID NO: 501068 - RNA, 32 nt, Human
ucccuucuacuuugaagagaaggggauaggaa

SEQ ID NO: 501069 - RNA, 32 nt, Human
ucccuucuaggaagaaaaacuaugaugauguu

SEQ ID NO: 501070 - RNA, 22 nt, Human
ucccuucuaggccucugccuca

SEQ ID NO: 501071 - RNA, 23 nt, Human
ucccuucuauccaacauucaaca

SEQ ID NO: 501072 - RNA, 32 nt, Human
ucccuucucacugccacugcucuugccucuug

SEQ ID NO: 501073 - RNA, 32 nt, Human
ucccuucucagcguuccagucacuucaggagg

SEQ ID NO: 501074 - RNA, 32 nt, Human
ucccuucucaguaugccagcugucucaauggc

SEQ ID NO: 501075 - RNA, 31 nt, Human
ucccuucucaucuagaauaaaccaggccucu

SEQ ID NO: 501076 - RNA, 32 nt, Human
ucccuucuccacuggccagcuugggccucauc

SEQ ID NO: 501077 - RNA, 32 nt, Human
ucccuucuccagucuuuuccuuuuacucuggu

SEQ ID NO: 501078 - RNA, 32 nt, Human
ucccuucuccauccugccauguccauccucca

SEQ ID NO: 501079 - RNA, 19 nt, Human
ucccuucucccaccuuagu

SEQ ID NO: 501080 - RNA, 32 nt, Human
ucccuucucccagggucaugcagggaucugcu

SEQ ID NO: 501081 - RNA, 32 nt, Human
ucccuucucccaucccuggccuggggccucug

SEQ ID NO: 501082 - RNA, 32 nt, Human
ucccuucuccuccccucuccccacucccggug

SEQ ID NO: 501083 - RNA, 21 nt, Human
ucccuucucguguuugcuuaa

SEQ ID NO: 501084 - RNA, 32 nt, Human
ucccuucucucccacucacauuucaaccccug

SEQ ID NO: 501085 - RNA, 32 nt, Human
ucccuucucugccuugcuucaacccuuagugu

SEQ ID NO: 501086 - RNA, 32 nt, Human
ucccuucugagaucugaggacauggacaccaa

SEQ ID NO: 501087 - RNA, 32 nt, Human
ucccuucugagggucccuuugcagucccagua

SEQ ID NO: 501088 - RNA, 32 nt, Human
ucccuucugccaccccuaccucaccccuaguc

SEQ ID NO: 501089 - RNA, 32 nt, Human
ucccuucugccaucacuggcucuuguccucuc

SEQ ID NO: 501090 - RNA, 32 nt, Human
ucccuucugccccucucuaccucuuccacuca

SEQ ID NO: 501091 - RNA, 32 nt, Human
ucccuucugccuuccggcuuaaagcuguggau

SEQ ID NO: 501092 - RNA, 32 nt, Human
ucccuucugcuccaccuucucucucugcccuc

SEQ ID NO: 501093 - RNA, 32 nt, Human
ucccuucugcucccagaagcuuuuguugcuca

SEQ ID NO: 501094 - RNA, 32 nt, Human
ucccuucugggacccaggcuucagugucacac

SEQ ID NO: 501095 - RNA, 32 nt, Human
ucccuucugggggcuggagggagccggggcag

SEQ ID NO: 501096 - RNA, 32 nt, Human
ucccuucugucuuugcccucuguuccuuccag

SEQ ID NO: 501097 - RNA, 32 nt, Human
ucccuucuguucuguucauguagcacagauaa

SEQ ID NO: 501098 - RNA, 32 nt, Human
ucccuucuguuuuaaaggagguauuuuggaaa

SEQ ID NO: 501099 - RNA, 32 nt, Human
ucccuucuuccucuuggaguccccagugucua

SEQ ID NO: 501100 - RNA, 32 nt, Human
ucccuucuuggggcgcagaggcucagccagcu

SEQ ID NO: 501101 - RNA, 32 nt, Human
ucccuucuuuccucacugcuccucuccaccca

SEQ ID NO: 501102 - RNA, 32 nt, Human
ucccuugaacccaggaggcagaaguugcagug

SEQ ID NO: 501103 - RNA, 32 nt, Human
ucccuugaacccaggaggcagagguugcaaug

SEQ ID NO: 501104 - RNA, 32 nt, Human
ucccuugacgcagcugccccagaagagcugaa

SEQ ID NO: 501105 - RNA, 32 nt, Human
ucccuugacuucuuacauuuugcucacuccug

SEQ ID NO: 501106 - RNA, 32 nt, Human
ucccuugagcccaggaggucgaggcugcagug

SEQ ID NO: 501107 - RNA, 32 nt, Human
ucccuugagcccaggaguuccagaccagccug

SEQ ID NO: 501108 - RNA, 32 nt, Human
ucccuugagcccaggaguuggagagcaacauc

SEQ ID NO: 501109 - RNA, 32 nt, Human
ucccuugagccccagaggcagagguuguggug

SEQ ID NO: 501110 - RNA, 32 nt, Human
ucccuugagccuaggagguugaggcugcagug

SEQ ID NO: 501111 - RNA, 20 nt, Human
ucccuugagcuguaaacacu

SEQ ID NO: 501112 - RNA, 32 nt, Human
ucccuugaggugccuccucuccucugcccagg

SEQ ID NO: 501113 - RNA, 32 nt, Human
ucccuugaguccaggagguugaggcugcagug

SEQ ID NO: 501114 - RNA, 32 nt, Human
ucccuugaucauacagugaggcuacagugacu

SEQ ID NO: 501115 - RNA, 32 nt, Human
ucccuugcaggcaaucucuuugaacagagguu

SEQ ID NO: 501116 - RNA, 32 nt, Human
ucccuugcccauucccuccacccccaagcccc

SEQ ID NO: 501117 - RNA, 32 nt, Human
ucccuugccccauuaucuuuucaccucccagg

SEQ ID NO: 501118 - RNA, 32 nt, Human
ucccuugcccucuccagcuccaccucacccag

SEQ ID NO: 501119 - RNA, 32 nt, Human
ucccuugccuccaugcaauucugaacuucaga

SEQ ID NO: 501120 - RNA, 32 nt, Human
ucccuugcuggagcuagaaugagggggaggcc

SEQ ID NO: 501121 - RNA, 18 nt, Human
ucccuugcuggugucaua

SEQ ID NO: 501122 - RNA, 32 nt, Human
ucccuugcuguaugcugaucaucgccagaggu

SEQ ID NO: 501123 - RNA, 32 nt, Human
ucccuugcuuucuuucucuuccagucauggca

SEQ ID NO: 501124 - RNA, 32 nt, Human
ucccuuggccccucucuguuuacccucccugu

SEQ ID NO: 501125 - RNA, 32 nt, Human
ucccuugggcuggagcugcaguaccguaccug

SEQ ID NO: 501126 - RNA, 32 nt, Human
ucccuuggggcugagggacuugggaaucaggc

SEQ ID NO: 501127 - RNA, 32 nt, Human
ucccuugguuggauucuucaacacagccaaug

SEQ ID NO: 501128 - RNA, 32 nt, Human
ucccuugucuauguucuugucuuucagaauaa

SEQ ID NO: 501129 - RNA, 32 nt, Human
ucccuugugcagccuggggcucugcccaggcc

SEQ ID NO: 501130 - RNA, 32 nt, Human
ucccuuguggccaaauuucccucccagggagc

SEQ ID NO: 501131 - RNA, 32 nt, Human
ucccuugugguuucagcacagaaccugaaugc

SEQ ID NO: 501132 - RNA, 32 nt, Human
ucccuugugugugugacauucucucaugggac

SEQ ID NO: 501133 - RNA, 32 nt, Human
ucccuuguugucuuugaaaauacuucauuuuc

SEQ ID NO: 501134 - RNA, 32 nt, Human
ucccuuuacagcucuccuccagcccugggcac

SEQ ID NO: 501135 - RNA, 32 nt, Human
ucccuuuagccugucuucgggccugccacaau

SEQ ID NO: 501136 - RNA, 32 nt, Human
ucccuuuagugcagggcucugcauuuacugug

SEQ ID NO: 501137 - RNA, 32 nt, Human
ucccuuuaugacgucuuuucucaaaucaaagu

SEQ ID NO: 501138 - RNA, 28 nt, Human
ucccuuuaugggucugccucauuggauu

SEQ ID NO: 501139 - RNA, 32 nt, Human
ucccuuuauugagcuccuccacuggggagaua

SEQ ID NO: 501140 - RNA, 32 nt, Human
ucccuuucacucuucgcccagcauccugcccc

SEQ ID NO: 501141 - RNA, 32 nt, Human
ucccuuucacuguggcuaauguuugcuaggcc

SEQ ID NO: 501142 - RNA, 32 nt, Human
ucccuuucagaagaaaagaccacaggcaucag

SEQ ID NO: 501143 - RNA, 32 nt, Human
ucccuuucagagccagggaaggguccagacag

SEQ ID NO: 501144 - RNA, 19 nt, Human
ucccuuuccaagccugccu

SEQ ID NO: 501145 - RNA, 19 nt, Human
ucccuuuccaccccccaca

SEQ ID NO: 501146 - RNA, 19 nt, Human
ucccuuuccagaaguccac

SEQ ID NO: 501147 - RNA, 21 nt, Human
ucccuuuccagauccaugagg

SEQ ID NO: 501148 - RNA, 32 nt, Human
ucccuuucccacuugaggacccuggggagaga

SEQ ID NO: 501149 - RNA, 32 nt, Human
ucccuuucccccacuuucucacuuauucuagg

SEQ ID NO: 501150 - RNA, 32 nt, Human
ucccuuucccucucugcugagcauuuaaccau

SEQ ID NO: 501151 - RNA, 32 nt, Human
ucccuuucccuggccaggaagggccaccagca

SEQ ID NO: 501152 - RNA, 32 nt, Human
ucccuuucccuuugguaggugcaccugagcac

SEQ ID NO: 501153 - RNA, 24 nt, Human
ucccuuuccuccccaccacuaccu

SEQ ID NO: 501154 - RNA, 32 nt, Human
ucccuuuccuccucucccuccuguggauucuc

SEQ ID NO: 501155 - RNA, 32 nt, Human
ucccuuuccucuugcuguuuccuuccuguguu

SEQ ID NO: 501156 - RNA, 32 nt, Human
ucccuuuccugcucuggccuccuugaaaguuc

SEQ ID NO: 501157 - RNA, 32 nt, Human
ucccuuuccuucuguuccgguuucuggucgua

SEQ ID NO: 501158 - RNA, 32 nt, Human
ucccuuuccuuuccuuucauuuucuuuccuuu

SEQ ID NO: 501159 - RNA, 32 nt, Human
ucccuuuccuuuccuuuccucuugaccuucuu

SEQ ID NO: 501160 - RNA, 32 nt, Human
ucccuuucucacugcuucaccuucccaaugug

SEQ ID NO: 501161 - RNA, 32 nt, Human
ucccuuucucacuuuuggaaggugacuuuuca

SEQ ID NO: 501162 - RNA, 32 nt, Human
ucccuuucucccucucuuccucccucuuuugc

SEQ ID NO: 501163 - RNA, 32 nt, Human
ucccuuucuccuccugcucuuucuccccgcug

SEQ ID NO: 501164 - RNA, 32 nt, Human
ucccuuucucggcuaugggaaggaaggauugc

SEQ ID NO: 501165 - RNA, 32 nt, Human
ucccuuucucucuacuuccucuucuuaauugg

SEQ ID NO: 501166 - RNA, 32 nt, Human
ucccuuucuuucucccagcuuugccucccuua

SEQ ID NO: 501167 - RNA, 32 nt, Human
ucccuuugcaaaaaucacggguguagagaugg

SEQ ID NO: 501168 - RNA, 23 nt, Human
ucccuuugcaaaaugugaaaaga

SEQ ID NO: 501169 - RNA, 32 nt, Human
ucccuuugcaccugagaggggaaguucucagc

SEQ ID NO: 501170 - RNA, 32 nt, Human
ucccuuugccuccccaucuggugcuuucuugc

SEQ ID NO: 501171 - RNA, 32 nt, Human
ucccuuuggcagcugcaauacacaguguuauu

SEQ ID NO: 501172 - RNA, 32 nt, Human
ucccuuuggccugcaguuuguaccaaauccuu

SEQ ID NO: 501173 - RNA, 32 nt, Human
ucccuuugggccaggucggggagccagaccug

SEQ ID NO: 501174 - RNA, 32 nt, Human
ucccuuuggggaaggugaagaggucaaaugag

SEQ ID NO: 501175 - RNA, 32 nt, Human
ucccuuuggucaaggagagggagagagaggua

SEQ ID NO: 501176 - RNA, 32 nt, Human
ucccuuuggucuuuagggaaaauaaacaggaa

SEQ ID NO: 501177 - RNA, 32 nt, Human
ucccuuuguccucaccaaagccaguagguaaa

SEQ ID NO: 501178 - RNA, 32 nt, Human
ucccuuugugugcauacgccucuuguucaugu

SEQ ID NO: 501179 - RNA, 32 nt, Human
ucccuuuguucuguuuuauuugacuacagucu

SEQ ID NO: 501180 - RNA, 32 nt, Human
ucccuuuuacucagccuuucuguucuaccuag

SEQ ID NO: 501181 - RNA, 32 nt, Human
ucccuuuuauucaccacuugacuucuaacauu

SEQ ID NO: 501182 - RNA, 32 nt, Human
ucccuuuucagaaaguccuuagugcaaaccac

SEQ ID NO: 501183 - RNA, 32 nt, Human
ucccuuuuccuaagccucuggguccccuccag

SEQ ID NO: 501184 - RNA, 32 nt, Human
ucccuuuuccuuccugugcccucugaaagcua

SEQ ID NO: 501185 - RNA, 32 nt, Human
ucccuuuucucacucucauccccaccacagau

SEQ ID NO: 501186 - RNA, 32 nt, Human
ucccuuuucucaguccaugaggcugggggugc

SEQ ID NO: 501187 - RNA, 32 nt, Human
ucccuuuucucaucauugggguuagcgggugc

SEQ ID NO: 501188 - RNA, 32 nt, Human
ucccuuuucuccccacuccuccagaaggcaua

SEQ ID NO: 501189 - RNA, 32 nt, Human
ucccuuuucucuucucucuccuccugggaaaa

SEQ ID NO: 501190 - RNA, 32 nt, Human
ucccuuuucugcuucucugcuccucuuaaggc

SEQ ID NO: 501191 - RNA, 32 nt, Human
ucccuuuucuuuucuuuucuuucuacugugac

SEQ ID NO: 501192 - RNA, 32 nt, Human
ucccuuuugccacccuucccagucccaggacg

SEQ ID NO: 501193 - RNA, 19 nt, Human
ucccuuuuggaguuuaugc

SEQ ID NO: 501194 - RNA, 32 nt, Human
ucccuuuuguuccuugaaguugcccuugcucu

SEQ ID NO: 501195 - RNA, 32 nt, Human
ucccuuuuguuuuacuccucacuccucuauuu

SEQ ID NO: 501196 - RNA, 31 nt, Human
ucccuuuuguuuuggaggccuguguccuugu

SEQ ID NO: 501197 - RNA, 32 nt, Human
ucccuuuuuccgcccgucccaggcuggauaga

SEQ ID NO: 501198 - RNA, 20 nt, Human
ucccuuuuuccuucuccugc

SEQ ID NO: 501199 - RNA, 22 nt, Human
uccgaaaaacacagcccugaca

SEQ ID NO: 501200 - RNA, 32 nt, Human
uccgaaagugaacuuuugcugaagcgaaguag

SEQ ID NO: 501201 - RNA, 32 nt, Human
uccgaacaccaagaagaaagcacacaguucac

SEQ ID NO: 501202 - RNA, 32 nt, Human
uccgaacaccuccagauuccggcuucuacaug

SEQ ID NO: 501203 - RNA, 32 nt, Human
uccgaacacgauggcagaucugggcagugcug

SEQ ID NO: 501204 - RNA, 23 nt, Human
uccgaacccuuucuccccuuccc

SEQ ID NO: 501205 - RNA, 32 nt, Human
uccgaaccuccucugugaagcauucgagacag

SEQ ID NO: 501206 - RNA, 32 nt, Human
uccgaagaaagugacucucugagaaccagccc

SEQ ID NO: 501207 - RNA, 32 nt, Human
uccgaagagacagggucuucuauguugcccag

SEQ ID NO: 501208 - RNA, 32 nt, Human
uccgaagaugcuccaucugaucaaagugacac

SEQ ID NO: 501209 - RNA, 32 nt, Human
uccgaagccccuugucccuuucuuggggauug

SEQ ID NO: 501210 - RNA, 32 nt, Human
uccgaagcgccauccacgucuccugggccgug

SEQ ID NO: 501211 - RNA, 32 nt, Human
uccgaaggaaccuggggcagagcuggaagagg

SEQ ID NO: 501212 - RNA, 32 nt, Human
uccgaaggccguggggaugguggagagcgccg

SEQ ID NO: 501213 - RNA, 32 nt, Human
uccgaaguagcugggaauuacaggcacccacc

SEQ ID NO: 501214 - RNA, 24 nt, Human
uccgaaguccuuugucagggcuga

SEQ ID NO: 501215 - RNA, 32 nt, Human
uccgaauccuacuccauccuucauggagaccc

SEQ ID NO: 501216 - RNA, 32 nt, Human
uccgaauccugauccaggcgggggccaggggc

SEQ ID NO: 501217 - RNA, 32 nt, Human
uccgaauuagaaaagaggaagucuauugcccc

SEQ ID NO: 501218 - RNA, 32 nt, Human
uccgacaaagacacaucaccuugcaaaugaca

SEQ ID NO: 501219 - RNA, 32 nt, Human
uccgacaccagaguggaacccaguaagcacca

SEQ ID NO: 501220 - RNA, 32 nt, Human
uccgacacccacccccucuuuguguacuucag

SEQ ID NO: 501221 - RNA, 32 nt, Human
uccgacagcugggcagccugaguaaauaugca

SEQ ID NO: 501222 - RNA, 21 nt, Human
uccgacaggugcucuggggug

SEQ ID NO: 501223 - RNA, 32 nt, Human
uccgacauuagaaacaaaacaaaaagaacugu

SEQ ID NO: 501224 - RNA, 32 nt, Human
uccgaccaugccaccugcccugggggcucccc

SEQ ID NO: 501225 - RNA, 32 nt, Human
uccgacccagaacgcuucaguucugcucugca

SEQ ID NO: 501226 - RNA, 32 nt, Human
uccgaccccucggaccccggccgcgcauucca

SEQ ID NO: 501227 - RNA, 32 nt, Human
uccgacccgcccuccucaccacccucauccgg

SEQ ID NO: 501228 - RNA, 32 nt, Human
uccgacccggaggcggaaccggcagugcagcc

SEQ ID NO: 501229 - RNA, 32 nt, Human
uccgaccgcccaacguuugccucccagccuga

SEQ ID NO: 501230 - RNA, 32 nt, Human
uccgaccuguaaucccagcacgucgggaggcc

SEQ ID NO: 501231 - RNA, 32 nt, Human
uccgacgcgccgcuggccucagccuggacgcg

SEQ ID NO: 501232 - RNA, 21 nt, Human
uccgacgcuuuguccccaccu

SEQ ID NO: 501233 - RNA, 32 nt, Human
uccgacguaaacaaucuccuucacgagauguc

SEQ ID NO: 501234 - RNA, 32 nt, Human
uccgacgugcagccuggcagugcagugagcug

SEQ ID NO: 501235 - RNA, 32 nt, Human
uccgacuccagcucugggcaagauccauaaac

SEQ ID NO: 501236 - RNA, 31 nt, Human
uccgacugccucucgccucaguuuaaccauc

SEQ ID NO: 501237 - RNA, 32 nt, Human
uccgacugcugaccaagcuaggagagacccgg

SEQ ID NO: 501238 - RNA, 24 nt, Human
uccgacuggcugcagcggacacug

SEQ ID NO: 501239 - RNA, 32 nt, Human
uccgacugguccacuccucauccuggugucuu

SEQ ID NO: 501240 - RNA, 32 nt, Human
uccgacuguacccagaggugccugagguccua

SEQ ID NO: 501241 - RNA, 32 nt, Human
uccgagaagaggaggguagaaaugaaggaaaa

SEQ ID NO: 501242 - RNA, 32 nt, Human
uccgagaagggguggagaaacaggaugggaac

SEQ ID NO: 501243 - RNA, 32 nt, Human
uccgagacaagcuugucggacgcccagccggg

SEQ ID NO: 501244 - RNA, 32 nt, Human
uccgagaccagccugggcaacauagugagacc

SEQ ID NO: 501245 - RNA, 32 nt, Human
uccgagacucuucaguucagguaucaacccug

SEQ ID NO: 501246 - RNA, 32 nt, Human
uccgagagaaucaggauggaggccguggcgac

SEQ ID NO: 501247 - RNA, 32 nt, Human
uccgagcaguucugguuccuccuggccauccg

SEQ ID NO: 501248 - RNA, 23 nt, Human
uccgagccacuccgcggggaccg

SEQ ID NO: 501249 - RNA, 32 nt, Human
uccgagcccaggagcuggcuguggcuucuccc

SEQ ID NO: 501250 - RNA, 20 nt, Human
uccgagcccaggccugcagc

SEQ ID NO: 501251 - RNA, 32 nt, Human
uccgagcccggugggaggcucccggagcgcag

SEQ ID NO: 501252 - RNA, 32 nt, Human
uccgagcugcaaggagggugcgcuggaggagg

SEQ ID NO: 501253 - RNA, 24 nt, Human
uccgagcugcagcacuccaaggcu

SEQ ID NO: 501254 - RNA, 32 nt, Human
uccgaggaccugcugguggccauggcucuguc

SEQ ID NO: 501255 - RNA, 32 nt, Human
uccgaggagaaaggacuuccacacggcagcca

SEQ ID NO: 501256 - RNA, 32 nt, Human
uccgaggaggaggaggaggagggaggagggga

SEQ ID NO: 501257 - RNA, 32 nt, Human
uccgaggaggggguggguaaaagggagaggga

SEQ ID NO: 501258 - RNA, 32 nt, Human
uccgaggcaccacuguuucuugccuggaguug

SEQ ID NO: 501259 - RNA, 32 nt, Human
uccgaggcuuccuggucuagaguugcuggcaa

SEQ ID NO: 501260 - RNA, 32 nt, Human
uccgaggcuucugcacucgccugggaagaggc

SEQ ID NO: 501261 - RNA, 21 nt, Human
uccgagggcaccugugaccug

SEQ ID NO: 501262 - RNA, 32 nt, Human
uccgagggcuuccugaugugacggacugugaa

SEQ ID NO: 501263 - RNA, 31 nt, Human
uccgaggggguggaagggggugggcacacuc

SEQ ID NO: 501264 - RNA, 32 nt, Human
uccgaggugcaaagccuggugccccgagcccu

SEQ ID NO: 501265 - RNA, 32 nt, Human
uccgagguggccuggguggaggcuaugguggg

SEQ ID NO: 501266 - RNA, 32 nt, Human
uccgaguaacuuuagaacaugucgcuucaaau

SEQ ID NO: 501267 - RNA, 32 nt, Human
uccgagucagaucugcacuagcaaccagaacu

SEQ ID NO: 501268 - RNA, 32 nt, Human
uccgaguccccugcuccgccagccugcgcgcc

SEQ ID NO: 501269 - RNA, 32 nt, Human
uccgaguccugcagccagccuccugggacacc

SEQ ID NO: 501270 - RNA, 32 nt, Human
uccgagucuacccagcccuuguuagauucaga

SEQ ID NO: 501271 - RNA, 32 nt, Human
uccgagucuuugucucuuuugggucccugucu

SEQ ID NO: 501272 - RNA, 32 nt, Human
uccgagugccuggcccagucucucccgccucg

SEQ ID NO: 501273 - RNA, 19 nt, Human
uccgagugugugccaucca

SEQ ID NO: 501274 - RNA, 32 nt, Human
uccgauagccccaggaaacgaauccacagagg

SEQ ID NO: 501275 - RNA, 32 nt, Human
uccgauccuccccuuccccuguccuuccuucg

SEQ ID NO: 501276 - RNA, 32 nt, Human
uccgaucuccauggggaggagggacuuaagcc

SEQ ID NO: 501277 - RNA, 32 nt, Human
uccgaugacaugaguccucccaggugaccuca

SEQ ID NO: 501278 - RNA, 32 nt, Human
uccgaugauucuguggcuuuccaauccaguaa

SEQ ID NO: 501279 - RNA, 32 nt, Human
uccgaugcugacccguccuccugggcucccca

SEQ ID NO: 501280 - RNA, 32 nt, Human
uccgauguccugcacucggccuggauccucau

SEQ ID NO: 501281 - RNA, 32 nt, Human
uccgaugucuuugcccuccugcagaagcaauc

SEQ ID NO: 501282 - RNA, 32 nt, Human
uccgauguggguggggugaggagagaggcagc

SEQ ID NO: 501283 - RNA, 32 nt, Human
uccgaugugguuuuugcugauuuccuuugaug

SEQ ID NO: 501284 - RNA, 32 nt, Human
uccgauguuugugccaucugauccugaugucu

SEQ ID NO: 501285 - RNA, 32 nt, Human
uccgauuccccaggcugaauugggagugagau

SEQ ID NO: 501286 - RNA, 32 nt, Human
uccgauucucugcuguagcuuccaguggagaa

SEQ ID NO: 501287 - RNA, 32 nt, Human
uccgauucuuugucccugccucuugggcagca

SEQ ID NO: 501288 - RNA, 32 nt, Human
uccgauugauccugugaggaugaauuugcauu

SEQ ID NO: 501289 - RNA, 23 nt, Human
uccgauugcuccugcccccaccu

SEQ ID NO: 501290 - RNA, 32 nt, Human
uccgauuggcugagucccacacuuuggagcca

SEQ ID NO: 501291 - RNA, 32 nt, Human
uccgauuucucaaucuuuuccccaccuuuccc

SEQ ID NO: 501292 - RNA, 23 nt, Human
uccgcaaauuuucuuccauuuca

SEQ ID NO: 501293 - RNA, 20 nt, Human
uccgcaacagaaccaucuca

SEQ ID NO: 501294 - RNA, 32 nt, Human
uccgcaaccucaggggccugggauuccugugg

SEQ ID NO: 501295 - RNA, 32 nt, Human
uccgcaaccucugcuguccuccgcggcgcccc

SEQ ID NO: 501296 - RNA, 21 nt, Human
uccgcaaggcugcgacuggcc

SEQ ID NO: 501297 - RNA, 31 nt, Human
uccgcaauguggcugaggaagggagccaaaa

SEQ ID NO: 501298 - RNA, 21 nt, Human
uccgcacaccucuggcugucu

SEQ ID NO: 501299 - RNA, 23 nt, Human
uccgcacagccugucucugcuca

SEQ ID NO: 501300 - RNA, 32 nt, Human
uccgcacagccugucucugcucaguugcaaua

SEQ ID NO: 501301 - RNA, 32 nt, Human
uccgcacaguguccagcagcaauuuauucuuu

SEQ ID NO: 501302 - RNA, 28 nt, Human
uccgcacccagugcugccgcucgugcuc

SEQ ID NO: 501303 - RNA, 32 nt, Human
uccgcaccccauuccuccccucccauggccaa

SEQ ID NO: 501304 - RNA, 21 nt, Human
uccgcaccccgccccaugccc

SEQ ID NO: 501305 - RNA, 32 nt, Human
uccgcacccuuuccuucauaccucacuauaug

SEQ ID NO: 501306 - RNA, 32 nt, Human
uccgcacgacuguuacagaggucuccagagcc

SEQ ID NO: 501307 - RNA, 32 nt, Human
uccgcacgggauuugcagauuuacagaauggc

SEQ ID NO: 501308 - RNA, 32 nt, Human
uccgcacgugcccacacacacgcaguucagcc

SEQ ID NO: 501309 - RNA, 32 nt, Human
uccgcacuaccugaacauuguaauacagacaa

SEQ ID NO: 501310 - RNA, 32 nt, Human
uccgcacuauugucccuucuuccucacugcac

SEQ ID NO: 501311 - RNA, 32 nt, Human
uccgcacucucucuuccuucugucuacacccc

SEQ ID NO: 501312 - RNA, 32 nt, Human
uccgcacugacgcugcucagccgguccaucac

SEQ ID NO: 501313 - RNA, 32 nt, Human
uccgcagagcuaugacgucauggcaggcacgc

SEQ ID NO: 501314 - RNA, 32 nt, Human
uccgcagaugcagagguugagguggcugcggg

SEQ ID NO: 501315 - RNA, 24 nt, Human
uccgcagcaagguugacugcccca

SEQ ID NO: 501316 - RNA, 20 nt, Human
uccgcagcaggcuuggccag

SEQ ID NO: 501317 - RNA, 32 nt, Human
uccgcagccugggaaccuucucccucguacag

SEQ ID NO: 501318 - RNA, 32 nt, Human
uccgcagcucgcagccaccccaaagggaggaa

SEQ ID NO: 501319 - RNA, 22 nt, Human
uccgcagcuucagccuccgccg

SEQ ID NO: 501320 - RNA, 32 nt, Human
uccgcaggaagaggcgcggggugcaggcuugu

SEQ ID NO: 501321 - RNA, 32 nt, Human
uccgcagggaggcggcggcagcugcggcgggg

SEQ ID NO: 501322 - RNA, 32 nt, Human
uccgcagucacaguccagccacugaccgcagc

SEQ ID NO: 501323 - RNA, 32 nt, Human
uccgcagugaagcccgcggcgccuagggcgca

SEQ ID NO: 501324 - RNA, 32 nt, Human
uccgcaguggcugcuuuccuggaagacguuuc

SEQ ID NO: 501325 - RNA, 23 nt, Human
uccgcauccaggagaugcugcuu

SEQ ID NO: 501326 - RNA, 32 nt, Human
uccgcaucccccaaggcaguguggagauggac

SEQ ID NO: 501327 - RNA, 23 nt, Human
uccgcaucccucgccccccuccc

SEQ ID NO: 501328 - RNA, 32 nt, Human
uccgcaucgacgcacacauuccagaguacagu

SEQ ID NO: 501329 - RNA, 32 nt, Human
uccgcaucucagcccucucaggagcagucuuc

SEQ ID NO: 501330 - RNA, 23 nt, Human
uccgcaucucaggugaucugcuc

SEQ ID NO: 501331 - RNA, 32 nt, Human
uccgcaugagcuguugcccuccaggggccugg

SEQ ID NO: 501332 - RNA, 32 nt, Human
uccgcaugcaccuggccggccaccugccacug

SEQ ID NO: 501333 - RNA, 32 nt, Human
uccgcaugcacggcugccucuccagccaccuc

SEQ ID NO: 501334 - RNA, 32 nt, Human
uccgcauuauuggaggagagagagccucccuc

SEQ ID NO: 501335 - RNA, 32 nt, Human
uccgcauuugguaucuuuuacacuucaaccaa

SEQ ID NO: 501336 - RNA, 32 nt, Human
uccgccaaccuccucagucucccaggccuggg

SEQ ID NO: 501337 - RNA, 32 nt, Human
uccgccaaucagaaacuuccugccuggggccc

SEQ ID NO: 501338 - RNA, 32 nt, Human
uccgccacagccgccgccuccacccccggccc

SEQ ID NO: 501339 - RNA, 32 nt, Human
uccgccaccaccgcugccgcagccuggcuggg

SEQ ID NO: 501340 - RNA, 32 nt, Human
uccgccaccggcuucugaacagccuggcggga

SEQ ID NO: 501341 - RNA, 32 nt, Human
uccgccacucacugaaguuuugcauucuggcu

SEQ ID NO: 501342 - RNA, 32 nt, Human
uccgccacugcacuccagccugggugacagag

SEQ ID NO: 501343 - RNA, 32 nt, Human
uccgccagacuccugcccaggccaggacugag

SEQ ID NO: 501344 - RNA, 32 nt, Human
uccgccagcaccggaggaagaaagaggagggg

SEQ ID NO: 501345 - RNA, 32 nt, Human
uccgccagcuccugccuggcugccagauauac

SEQ ID NO: 501346 - RNA, 32 nt, Human
uccgccaggcuggagugcaguggcgcgaucuu

SEQ ID NO: 501347 - RNA, 32 nt, Human
uccgccagggugacacagcgguguacgccgag

SEQ ID NO: 501348 - RNA, 32 nt, Human
uccgccagugaaacugcccagcccuucucugc

SEQ ID NO: 501349 - RNA, 32 nt, Human
uccgccagugcaggaacccggugcucgcuggg

SEQ ID NO: 501350 - RNA, 16 nt, Human
uccgccagugcuuuca

SEQ ID NO: 501351 - RNA, 32 nt, Human
uccgccaguucaugccccagaccuucucgggu

SEQ ID NO: 501352 - RNA, 32 nt, Human
uccgccaucuacccuccgcuccugggcgcgcu

SEQ ID NO: 501353 - RNA, 31 nt, Human
uccgccaugaggagaagugaggugcuggcgg

SEQ ID NO: 501354 - RNA, 31 nt, Human
uccgccauggccucucuacucgccaaggacg

SEQ ID NO: 501355 - RNA, 32 nt, Human
uccgccauuacacuccagccugggugacagag

SEQ ID NO: 501356 - RNA, 32 nt, Human
uccgccauugcaaacacgaagcucuuccagaa

SEQ ID NO: 501357 - RNA, 32 nt, Human
uccgcccacccccauucuccaagcuucagccc

SEQ ID NO: 501358 - RNA, 32 nt, Human
uccgcccagccucuccccgcucuggauccugc

SEQ ID NO: 501359 - RNA, 32 nt, Human
uccgcccagcggcccugcgucuucccagguga

SEQ ID NO: 501360 - RNA, 28 nt, Human
uccgcccccagugcugcguucucccccu

SEQ ID NO: 501361 - RNA, 32 nt, Human
uccgcccccagugcugcguucucccccucuug

SEQ ID NO: 501362 - RNA, 32 nt, Human
uccgcccccuagugagagauaaggaccucagg

SEQ ID NO: 501363 - RNA, 27 nt, Human
uccgcccccugccgccacauuuccuua

SEQ ID NO: 501364 - RNA, 32 nt, Human
uccgccccgcacuccguuucccgguuuccccc

SEQ ID NO: 501365 - RNA, 32 nt, Human
uccgccccgcaucaccuggccaggggcggacc

SEQ ID NO: 501366 - RNA, 32 nt, Human
uccgccccucccccucccccucgaacaaaugg

SEQ ID NO: 501367 - RNA, 18 nt, Human
uccgccccuccugcucca

SEQ ID NO: 501368 - RNA, 32 nt, Human
uccgccccucgcgcuccagccacucggccgca

SEQ ID NO: 501369 - RNA, 32 nt, Human
uccgcccgcuggcugcagagcaucccugggag

SEQ ID NO: 501370 - RNA, 32 nt, Human
uccgcccgucccaggcuggauagagucccuuc

SEQ ID NO: 501371 - RNA, 32 nt, Human
uccgcccuacuuccuccuccuguuggcggcgg

SEQ ID NO: 501372 - RNA, 32 nt, Human
uccgcccucaccagcacagcaccaagccuugc

SEQ ID NO: 501373 - RNA, 18 nt, Human
uccgcccucacccagcca

SEQ ID NO: 501374 - RNA, 32 nt, Human
uccgcccucgcucucccuccgcgccaccagac

SEQ ID NO: 501375 - RNA, 32 nt, Human
uccgcccucucccacucucucuuuccggugug

SEQ ID NO: 501376 - RNA, 32 nt, Human
uccgcccugccggguccccaccagggaggcgc

SEQ ID NO: 501377 - RNA, 32 nt, Human
uccgcccugccugccugccuguguggucugcc

SEQ ID NO: 501378 - RNA, 32 nt, Human
uccgcccuggaaggccaggucacaaaggccau

SEQ ID NO: 501379 - RNA, 32 nt, Human
uccgcccuggauacccagaagcuaagaaggug

SEQ ID NO: 501380 - RNA, 32 nt, Human
uccgccgaagaaaaggugagaaaggaauucug

SEQ ID NO: 501381 - RNA, 32 nt, Human
uccgccgaagggaggggguggaagaggaggac

SEQ ID NO: 501382 - RNA, 32 nt, Human
uccgccgagcacaagcuccagcaucccgucag

SEQ ID NO: 501383 - RNA, 32 nt, Human
uccgccgcacacucccccuggguccucaggcc

SEQ ID NO: 501384 - RNA, 19 nt, Human
uccgccgcagccuugcugg

SEQ ID NO: 501385 - RNA, 32 nt, Human
uccgccgcagucucagcugcagcugcaggacu

SEQ ID NO: 501386 - RNA, 19 nt, Human
uccgccgccccuaugcugg

SEQ ID NO: 501387 - RNA, 19 nt, Human
uccgccgccgccgccgccg

SEQ ID NO: 501388 - RNA, 32 nt, Human
uccgccgccgcucccguuuccggcgggggaga

SEQ ID NO: 501389 - RNA, 32 nt, Human
uccgccgcuccaggacucggcgcggagggaau

SEQ ID NO: 501390 - RNA, 32 nt, Human
uccgccgcuccucugcugucagcgccggcagc

SEQ ID NO: 501391 - RNA, 19 nt, Human
uccgccgcugccgccgccg

SEQ ID NO: 501392 - RNA, 32 nt, Human
uccgccggagccuggccauaggguagucucgg

SEQ ID NO: 501393 - RNA, 32 nt, Human
uccgccggcauuuucccaucugccuuuucucu

SEQ ID NO: 501394 - RNA, 32 nt, Human
uccgccggggcagcaagagcgaaacuccaucu

SEQ ID NO: 501395 - RNA, 32 nt, Human
uccgccguccagggccucuccgucucggcccc

SEQ ID NO: 501396 - RNA, 32 nt, Human
uccgccgugucucucgggggcggcucgcgggg

SEQ ID NO: 501397 - RNA, 32 nt, Human
uccgccuaucgcuccccucggcuacgcugcca

SEQ ID NO: 501398 - RNA, 32 nt, Human
uccgccucacccaguacaucgacgggcagggu

SEQ ID NO: 501399 - RNA, 32 nt, Human
uccgccucacuggguguggccuggcuucuggg

SEQ ID NO: 501400 - RNA, 32 nt, Human
uccgccucccaaagcgcuggcauuacaggcga

SEQ ID NO: 501401 - RNA, 32 nt, Human
uccgccucccaaagugcuaggauuacagguau

SEQ ID NO: 501402 - RNA, 32 nt, Human
uccgccucccaaagugcuggaauuacaggcau

SEQ ID NO: 501403 - RNA, 32 nt, Human
uccgccucccaaagugcuggaauuacuggcau

SEQ ID NO: 501404 - RNA, 32 nt, Human
uccgccucccaaagugcugggaugacaggcgu

SEQ ID NO: 501405 - RNA, 32 nt, Human
uccgccucccaaagugcugggauuacaggcgu

SEQ ID NO: 501406 - RNA, 32 nt, Human
uccgccucccaaagugcugggauuacagguau

SEQ ID NO: 501407 - RNA, 32 nt, Human
uccgccucccaaagugcugggauuacaggugu

SEQ ID NO: 501408 - RNA, 32 nt, Human
uccgccucccaaagugcugggauugcaggcau

SEQ ID NO: 501409 - RNA, 32 nt, Human
uccgccucccaaaguguugggauuacaagcgu

SEQ ID NO: 501410 - RNA, 32 nt, Human
uccgccucccaaguagcugggauuacaggcau

SEQ ID NO: 501411 - RNA, 32 nt, Human
uccgccucccaaguagcugggauuacagguac

SEQ ID NO: 501412 - RNA, 32 nt, Human
uccgccucccacccucuccccaucugcucugg

SEQ ID NO: 501413 - RNA, 32 nt, Human
uccgccucccgaguagcugggauuacaggcau

SEQ ID NO: 501414 - RNA, 32 nt, Human
uccgccuccucccuccccuugaggcuggagcg

SEQ ID NO: 501415 - RNA, 32 nt, Human
uccgccucguaauccuccuccgaccggugccc

SEQ ID NO: 501416 - RNA, 32 nt, Human
uccgccucuccccuccccacuggcucugucug

SEQ ID NO: 501417 - RNA, 32 nt, Human
uccgccucucucccugccucccucucucucuu

SEQ ID NO: 501418 - RNA, 32 nt, Human
uccgccucugcacuccagccugggugacaaga

SEQ ID NO: 501419 - RNA, 32 nt, Human
uccgccucugcuggcacauuuccccagaccug

SEQ ID NO: 501420 - RNA, 32 nt, Human
uccgccucuucaccuacuguucugccugccug

SEQ ID NO: 501421 - RNA, 32 nt, Human
uccgccucuucuuccuccugcguccucccccg

SEQ ID NO: 501422 - RNA, 32 nt, Human
uccgccugcagccgugaaaggaagcuggguca

SEQ ID NO: 501423 - RNA, 32 nt, Human
uccgccugcaggaccuccucuuggccacuugg

SEQ ID NO: 501424 - RNA, 32 nt, Human
uccgccugcagggcauuccagaaagaugagga

SEQ ID NO: 501425 - RNA, 32 nt, Human
uccgccugccagcccaccccagccuggggaga

SEQ ID NO: 501426 - RNA, 24 nt, Human
uccgccugccgcccgcuggccugc

SEQ ID NO: 501427 - RNA, 31 nt, Human
uccgccuggaaccugccgagggaacgugugg

SEQ ID NO: 501428 - RNA, 32 nt, Human
uccgccuggccuggccauacugugucccaucg

SEQ ID NO: 501429 - RNA, 32 nt, Human
uccgccuggguuggggacagagagcagagagg

SEQ ID NO: 501430 - RNA, 32 nt, Human
uccgccuguagucccagcuacucaggaggcug

SEQ ID NO: 501431 - RNA, 32 nt, Human
uccgccuuccacgugcacccacugccucuucc

SEQ ID NO: 501432 - RNA, 32 nt, Human
uccgccuucuccccucccgcuguccaugcuug

SEQ ID NO: 501433 - RNA, 24 nt, Human
uccgccuugcucagccccuccaug

SEQ ID NO: 501434 - RNA, 32 nt, Human
uccgccuuuaaugcuacugaacauccaggacc

SEQ ID NO: 501435 - RNA, 32 nt, Human
uccgcgaccagccucaagcaggcugcucucug

SEQ ID NO: 501436 - RNA, 19 nt, Human
uccgcgagucucugggagg

SEQ ID NO: 501437 - RNA, 32 nt, Human
uccgcgauacaguuaggauggcuguaguaccu

SEQ ID NO: 501438 - RNA, 32 nt, Human
uccgcgcagcccccugaccugcagccuccgga

SEQ ID NO: 501439 - RNA, 23 nt, Human
uccgcgccaagccguccccgccg

SEQ ID NO: 501440 - RNA, 22 nt, Human
uccgcgccacccacccucgccg

SEQ ID NO: 501441 - RNA, 24 nt, Human
uccgcgccaggcccggccccgccg

SEQ ID NO: 501442 - RNA, 23 nt, Human
uccgcgcccggagcgccccgccg

SEQ ID NO: 501443 - RNA, 24 nt, Human
uccgcgccgccgccagccccgcug

SEQ ID NO: 501444 - RNA, 18 nt, Human
uccgcgccgccgccgccg

SEQ ID NO: 501445 - RNA, 32 nt, Human
uccgcgccucccucccccucgagccgccacga

SEQ ID NO: 501446 - RNA, 22 nt, Human
uccgcgcgccugggagacgcug

SEQ ID NO: 501447 - RNA, 32 nt, Human
uccgcgcggccgaguccaucuccugggaaaug

SEQ ID NO: 501448 - RNA, 32 nt, Human
uccgcgcuccccucagcuccugcagugcuaau

SEQ ID NO: 501449 - RNA, 32 nt, Human
uccgcgcucgcaacuucggccucccccggcuc

SEQ ID NO: 501450 - RNA, 24 nt, Human
uccgcgcugcgccacaucccaccg

SEQ ID NO: 501451 - RNA, 23 nt, Human
uccgcgcugcuucccccgcgccg

SEQ ID NO: 501452 - RNA, 32 nt, Human
uccgcggagacacccauccgugaaccccaggu

SEQ ID NO: 501453 - RNA, 32 nt, Human
uccgcggaggagguggaggaggcggcggcggc

SEQ ID NO: 501454 - RNA, 32 nt, Human
uccgcggccaugaaguuucgggccaagaucgu

SEQ ID NO: 501455 - RNA, 20 nt, Human
uccgcggcccuuuccaccuc

SEQ ID NO: 501456 - RNA, 32 nt, Human
uccgcggccuuccuccucccugcuccagaauu

SEQ ID NO: 501457 - RNA, 19 nt, Human
uccgcgggccccggccggg

SEQ ID NO: 501458 - RNA, 32 nt, Human
uccgcgggcgcaggcccagcucaggcccccag

SEQ ID NO: 501459 - RNA, 32 nt, Human
uccgcggucugcggcccauggaagaggaggag

SEQ ID NO: 501460 - RNA, 32 nt, Human
uccgcggugaagcacugccucagcuaccagca

SEQ ID NO: 501461 - RNA, 32 nt, Human
uccgcggugcccagcucuccagccuggggauu

SEQ ID NO: 501462 - RNA, 32 nt, Human
uccgcggugggauguugagcugaggccggagg

SEQ ID NO: 501463 - RNA, 32 nt, Human
uccgcgucucccaggacgcaugaagguggcac

SEQ ID NO: 501464 - RNA, 32 nt, Human
uccgcguggaacacaggagccgcaaccaccug

SEQ ID NO: 501465 - RNA, 32 nt, Human
uccgcguggcucacuccagccucggauguuuc

SEQ ID NO: 501466 - RNA, 32 nt, Human
uccgcguuccuugagcaaauggcucaccccug

SEQ ID NO: 501467 - RNA, 32 nt, Human
uccgcguugccuggcucuccgggcacgcgggc

SEQ ID NO: 501468 - RNA, 32 nt, Human
uccgcuaaaaaugcaaaaauuagccaggcgug

SEQ ID NO: 501469 - RNA, 32 nt, Human
uccgcuaagggaucagggagaggaagaaagag

SEQ ID NO: 501470 - RNA, 32 nt, Human
uccgcucaccuugccaggcuuuucagaggccu

SEQ ID NO: 501471 - RNA, 32 nt, Human
uccgcucacugcaacauccgccucccggacuc

SEQ ID NO: 501472 - RNA, 32 nt, Human
uccgcucacugcaaccuccaccuccuggcuuc

SEQ ID NO: 501473 - RNA, 32 nt, Human
uccgcucacugcaaccuccgccucccagguuc

SEQ ID NO: 501474 - RNA, 32 nt, Human
uccgcucacugcaaccucugccucccgguuca

SEQ ID NO: 501475 - RNA, 32 nt, Human
uccgcucacugcaaccucugcuucccggguuc

SEQ ID NO: 501476 - RNA, 32 nt, Human
uccgcucacugcaagcuccgccucccggguuc

SEQ ID NO: 501477 - RNA, 32 nt, Human
uccgcucacugcagccuccgccuccuggguuc

SEQ ID NO: 501478 - RNA, 32 nt, Human
uccgcucaugccacuguaagcagcccuagcuc

SEQ ID NO: 501479 - RNA, 19 nt, Human
uccgcucccaggccugcca

SEQ ID NO: 501480 - RNA, 32 nt, Human
uccgcucccuccugucaccuaccagggcagac

SEQ ID NO: 501481 - RNA, 32 nt, Human
uccgcuccguggacuggaaagcuguuccgcag

SEQ ID NO: 501482 - RNA, 32 nt, Human
uccgcuccuccacccaguucaggaacccgcga

SEQ ID NO: 501483 - RNA, 32 nt, Human
uccgcuccuccggcucucauggcauugugcca

SEQ ID NO: 501484 - RNA, 32 nt, Human
uccgcuccugcucgcaaccucgcgguuccugg

SEQ ID NO: 501485 - RNA, 32 nt, Human
uccgcuccuggcugccacaggguccuccgaug

SEQ ID NO: 501486 - RNA, 32 nt, Human
uccgcucgcagcaaccucugccucccagguuc

SEQ ID NO: 501487 - RNA, 32 nt, Human
uccgcucgcccuggggccgcucagggagccgg

SEQ ID NO: 501488 - RNA, 32 nt, Human
uccgcucgcuacaaccuccaccucccagcugc

SEQ ID NO: 501489 - RNA, 32 nt, Human
uccgcucucuuuuuccccaacagaccugucuu

SEQ ID NO: 501490 - RNA, 32 nt, Human
uccgcucugaaggcacugugugggugcugcgu

SEQ ID NO: 501491 - RNA, 32 nt, Human
uccgcucugcaugcccugucugugccaugagu

SEQ ID NO: 501492 - RNA, 32 nt, Human
uccgcucuggggaggcagcgcuggcggcgggg

SEQ ID NO: 501493 - RNA, 32 nt, Human
uccgcucuuccaggacggccucugugcugcug

SEQ ID NO: 501494 - RNA, 32 nt, Human
uccgcucuuggcuuccagaaaaguuuggagaa

SEQ ID NO: 501495 - RNA, 32 nt, Human
uccgcugagaaagcuucacguuaugcuuagug

SEQ ID NO: 501496 - RNA, 32 nt, Human
uccgcugagauauuuguguggagagaaacaua

SEQ ID NO: 501497 - RNA, 19 nt, Human
uccgcugcagcuggccaca

SEQ ID NO: 501498 - RNA, 32 nt, Human
uccgcugccuugcccuccauccuuccucuguu

SEQ ID NO: 501499 - RNA, 32 nt, Human
uccgcugcugcaggaacccagcuagcuggcca

SEQ ID NO: 501500 - RNA, 32 nt, Human
uccgcugcuucuguggaagugagcaugguugg

SEQ ID NO: 501501 - RNA, 21 nt, Human
uccgcugcuugcaaccucuag

SEQ ID NO: 501502 - RNA, 32 nt, Human
uccgcugcuuuaccaggaaggauggaaggggc

SEQ ID NO: 501503 - RNA, 32 nt, Human
uccgcuggcacccagaggcaauggguaagguu

SEQ ID NO: 501504 - RNA, 32 nt, Human
uccgcuggcgcaggcaggaggagcaggaggau

SEQ ID NO: 501505 - RNA, 32 nt, Human
uccgcuggggcagagggucgcggcggcuggga

SEQ ID NO: 501506 - RNA, 32 nt, Human
uccgcuggugcagcuuuccuuuuugccucuuu

SEQ ID NO: 501507 - RNA, 32 nt, Human
uccgcugguggaggugagggcgcccggcaggc

SEQ ID NO: 501508 - RNA, 32 nt, Human
uccgcuggugucacuauggccugggugagagg

SEQ ID NO: 501509 - RNA, 32 nt, Human
uccgcugucccagggugccauggagauggaga

SEQ ID NO: 501510 - RNA, 32 nt, Human
uccgcugugaugacauuuagaccucauuugug

SEQ ID NO: 501511 - RNA, 32 nt, Human
uccgcugugcuuccucugcaguaugaagacuu

SEQ ID NO: 501512 - RNA, 32 nt, Human
uccgcugugggugguccccagcacuccucugu

SEQ ID NO: 501513 - RNA, 32 nt, Human
uccgcuguuuccucugccaccaugaggaacau

SEQ ID NO: 501514 - RNA, 32 nt, Human
uccgcuuaauuucaaagauaaaaugcaguuac

SEQ ID NO: 501515 - RNA, 32 nt, Human
uccgcuucccaggcuggggugcaguggugcga

SEQ ID NO: 501516 - RNA, 32 nt, Human
uccgcuucccagguaauauuauuuaaauaaaa

SEQ ID NO: 501517 - RNA, 25 nt, Human
uccgcuuccuggagguuugcaguga

SEQ ID NO: 501518 - RNA, 32 nt, Human
uccgcuucucccugcagcccugccuuugcuga

SEQ ID NO: 501519 - RNA, 32 nt, Human
uccgcuucuccuccucuuccucccaggacgug

SEQ ID NO: 501520 - RNA, 32 nt, Human
uccgcuuggcccugccuucugccgcauccccg

SEQ ID NO: 501521 - RNA, 32 nt, Human
uccgcuuugcacuccaccccgguagcagcucc

SEQ ID NO: 501522 - RNA, 32 nt, Human
uccgcuuuguccugcugacccacuuagaccuc

SEQ ID NO: 501523 - RNA, 32 nt, Human
uccggaagcugaggcaggagaauggcuugaac

SEQ ID NO: 501524 - RNA, 31 nt, Human
uccggaaggcacuuuaaucaugccuaagagc

SEQ ID NO: 501525 - RNA, 32 nt, Human
uccggaagggagcaccggagaagacuugcaca

SEQ ID NO: 501526 - RNA, 32 nt, Human
uccggaaguggaggcgggagcggcacggcagc

SEQ ID NO: 501527 - RNA, 32 nt, Human
uccggaaugccacccacaucuuccauuuccau

SEQ ID NO: 501528 - RNA, 32 nt, Human
uccggacaaaggacggaggaggggcuggacgg

SEQ ID NO: 501529 - RNA, 32 nt, Human
uccggacaaauauccacccaagagaaccaauc

SEQ ID NO: 501530 - RNA, 32 nt, Human
uccggacaccaugucugugcgcuuuucuucua

SEQ ID NO: 501531 - RNA, 32 nt, Human
uccggacagcggucaaggcaaggaugucaugc

SEQ ID NO: 501532 - RNA, 32 nt, Human
uccggaccagcccucgggagucgccgacccgg

SEQ ID NO: 501533 - RNA, 32 nt, Human
uccggaccccacucugcccuccaaaaagacaa

SEQ ID NO: 501534 - RNA, 32 nt, Human
uccggaccugccucgagccucaggcugcugaa

SEQ ID NO: 501535 - RNA, 32 nt, Human
uccggacggggcgcucucccacccucaggcuc

SEQ ID NO: 501536 - RNA, 32 nt, Human
uccggacgugccacuucugccucguagaagac

SEQ ID NO: 501537 - RNA, 32 nt, Human
uccggacuuucauuuugggaggauggaugaac

SEQ ID NO: 501538 - RNA, 32 nt, Human
uccggagaccagccuggccaacauggugaaac

SEQ ID NO: 501539 - RNA, 32 nt, Human
uccggagagaggaucagguguuuucagguuaa

SEQ ID NO: 501540 - RNA, 32 nt, Human
uccggagagaugguggguugccauucugguag

SEQ ID NO: 501541 - RNA, 32 nt, Human
uccggagaggagaaggaggaagaagaggagga

SEQ ID NO: 501542 - RNA, 32 nt, Human
uccggagaugagccggcgaggccaggugcggg

SEQ ID NO: 501543 - RNA, 32 nt, Human
uccggagcagccgccgcccgaccgcgccgagc

SEQ ID NO: 501544 - RNA, 32 nt, Human
uccggagccgcccaccagguugccaggaggag

SEQ ID NO: 501545 - RNA, 32 nt, Human
uccggagccuugaggccaggagggcagugagc

SEQ ID NO: 501546 - RNA, 32 nt, Human
uccggaggcugagccaggagaaucgcuugaac

SEQ ID NO: 501547 - RNA, 32 nt, Human
uccggaggcugaggcaggagaaucacuugaag

SEQ ID NO: 501548 - RNA, 32 nt, Human
uccggaggcugaggcaggagaaucgcuugaac

SEQ ID NO: 501549 - RNA, 32 nt, Human
uccggaggcugaggcaggagaaucucuugaac

SEQ ID NO: 501550 - RNA, 32 nt, Human
uccggaggcugaggcaggagaauggcgugaac

SEQ ID NO: 501551 - RNA, 32 nt, Human
uccggagggauaauuggcagggcaguucgguc

SEQ ID NO: 501552 - RNA, 32 nt, Human
uccggaggggacccagcuccucugagccauac

SEQ ID NO: 501553 - RNA, 32 nt, Human
uccggaguaaugggguucagcucuugcaacgu

SEQ ID NO: 501554 - RNA, 23 nt, Human
uccggaguagcgccgggcucccu

SEQ ID NO: 501555 - RNA, 32 nt, Human
uccggaguccaaaacuccugccucucggccgc

SEQ ID NO: 501556 - RNA, 32 nt, Human
uccggaucagugaccaccaccacguucagguu

SEQ ID NO: 501557 - RNA, 32 nt, Human
uccggauccucuucauucuuuucggcuacuca

SEQ ID NO: 501558 - RNA, 21 nt, Human
uccggaugaaguaccagagug

SEQ ID NO: 501559 - RNA, 32 nt, Human
uccggaugacugcgggcaggccuggauaauau

SEQ ID NO: 501560 - RNA, 32 nt, Human
uccggaugccccugcuauagggagaggcagca

SEQ ID NO: 501561 - RNA, 32 nt, Human
uccggaugcucacuccaaagucucagcaggcc

SEQ ID NO: 501562 - RNA, 32 nt, Human
uccggaugcugagacaggagaaucucuugaac

SEQ ID NO: 501563 - RNA, 32 nt, Human
uccggauggagggagagguugugcugaccacc

SEQ ID NO: 501564 - RNA, 32 nt, Human
uccggauggaguuuccccucugcggcugccuc

SEQ ID NO: 501565 - RNA, 32 nt, Human
uccggcaccuccaaaccuaccccacagucagu

SEQ ID NO: 501566 - RNA, 32 nt, Human
uccggcacuugggcuccagucgcgcccuccaa

SEQ ID NO: 501567 - RNA, 32 nt, Human
uccggcagccacagaaggcugcagcccagccc

SEQ ID NO: 501568 - RNA, 32 nt, Human
uccggcagccuggcuccagucugacccaaacc

SEQ ID NO: 501569 - RNA, 24 nt, Human
uccggcagguggagcuugcaguga

SEQ ID NO: 501570 - RNA, 32 nt, Human
uccggcauaugcaaagauaggcagugcuguuc

SEQ ID NO: 501571 - RNA, 21 nt, Human
uccggccacugggaggcgcug

SEQ ID NO: 501572 - RNA, 32 nt, Human
uccggccagccgcgguccagagcgcgcgaggu

SEQ ID NO: 501573 - RNA, 32 nt, Human
uccggccagcugccugcccucuugucugugcu

SEQ ID NO: 501574 - RNA, 32 nt, Human
uccggccagcuuccuggguaccaaaauagcaa

SEQ ID NO: 501575 - RNA, 32 nt, Human
uccggccaggccuuguaggaaaaggccccgcc

SEQ ID NO: 501576 - RNA, 32 nt, Human
uccggccaggguggagugggugaggcagacau

SEQ ID NO: 501577 - RNA, 32 nt, Human
uccggcccacugucuguggcccauugucauug

SEQ ID NO: 501578 - RNA, 24 nt, Human
uccggcccaucuaucgggcaccgg

SEQ ID NO: 501579 - RNA, 32 nt, Human
uccggccccaggcuggccugagcugccgggca

SEQ ID NO: 501580 - RNA, 32 nt, Human
uccggccccgucagcgugugcugguccagcca

SEQ ID NO: 501581 - RNA, 32 nt, Human
uccggccccugccugcugggccgcccggguug

SEQ ID NO: 501582 - RNA, 21 nt, Human
uccggccccuucccccuuccc

SEQ ID NO: 501583 - RNA, 32 nt, Human
uccggcccuagccuggccgggcgggugccggg

SEQ ID NO: 501584 - RNA, 32 nt, Human
uccggcccuccuccuccuccugguccuugcua

SEQ ID NO: 501585 - RNA, 32 nt, Human
uccggccgccucgcccuuccccggcuccgcuc

SEQ ID NO: 501586 - RNA, 23 nt, Human
uccggccgcucugcacaaacugg

SEQ ID NO: 501587 - RNA, 23 nt, Human
uccggccgcuucauugucaccgg

SEQ ID NO: 501588 - RNA, 22 nt, Human
uccggccggucugcggcguugg

SEQ ID NO: 501589 - RNA, 19 nt, Human
uccggccugagcugucgca

SEQ ID NO: 501590 - RNA, 22 nt, Human
uccggccugaggcggcuggggc

SEQ ID NO: 501591 - RNA, 23 nt, Human
uccggccugaugacagagcgaga

SEQ ID NO: 501592 - RNA, 32 nt, Human
uccggccugccugccugccugccugccucucc

SEQ ID NO: 501593 - RNA, 32 nt, Human
uccggccugccugugcuguccccgcgcccugu

SEQ ID NO: 501594 - RNA, 32 nt, Human
uccggccugcucacggcgcuccaggccugccc

SEQ ID NO: 501595 - RNA, 32 nt, Human
uccggccuggagcucccagggccgaggucacu

SEQ ID NO: 501596 - RNA, 23 nt, Human
uccggccugggaugcgggccagg

SEQ ID NO: 501597 - RNA, 32 nt, Human
uccggccugggcaacagagacccugucucuau

SEQ ID NO: 501598 - RNA, 24 nt, Human
uccggccugggcaacagaggaaga

SEQ ID NO: 501599 - RNA, 24 nt, Human
uccggccugggcaacguagugaga

SEQ ID NO: 501600 - RNA, 32 nt, Human
uccggccugggcagcgccccagaagccucaua

SEQ ID NO: 501601 - RNA, 24 nt, Human
uccggccugggcgacagagcgaga

SEQ ID NO: 501602 - RNA, 32 nt, Human
uccggccugggcgacagagcgagacuccgucu

SEQ ID NO: 501603 - RNA, 32 nt, Human
uccggccugggcgacagagcgagacucugucu

SEQ ID NO: 501604 - RNA, 32 nt, Human
uccggccugggcgacagagcgagacugucuca

SEQ ID NO: 501605 - RNA, 22 nt, Human
uccggccugggcgagagugaga

SEQ ID NO: 501606 - RNA, 32 nt, Human
uccggccugggcugcuggaugcagcagcggcu

SEQ ID NO: 501607 - RNA, 24 nt, Human
uccggccuggggacaagagcaaga

SEQ ID NO: 501608 - RNA, 32 nt, Human
uccggccuggggacaagagcaagacuucgccu

SEQ ID NO: 501609 - RNA, 24 nt, Human
uccggccugggugaaagagcgaga

SEQ ID NO: 501610 - RNA, 32 nt, Human
uccggccugggugaaagagcgagacuccgucu

SEQ ID NO: 501611 - RNA, 32 nt, Human
uccggccugggugacaaagcaagacucugucu

SEQ ID NO: 501612 - RNA, 24 nt, Human
uccggccugggugacagaaggagg

SEQ ID NO: 501613 - RNA, 32 nt, Human
uccggccugggugacagaaggaggcucugccu

SEQ ID NO: 501614 - RNA, 24 nt, Human
uccggccugggugacagagccaga

SEQ ID NO: 501615 - RNA, 32 nt, Human
uccggccugggugacagagccagacuccaucu

SEQ ID NO: 501616 - RNA, 32 nt, Human
uccggccugggugacagagugagacccgugcu

SEQ ID NO: 501617 - RNA, 32 nt, Human
uccggccugggugauggagcaagaccucgucu

SEQ ID NO: 501618 - RNA, 22 nt, Human
uccggccuggugaccgauggga

SEQ ID NO: 501619 - RNA, 23 nt, Human
uccggccuguguguggcgcgagg

SEQ ID NO: 501620 - RNA, 32 nt, Human
uccggccuucuaagagguaugugucaaccuca

SEQ ID NO: 501621 - RNA, 32 nt, Human
uccggcgcgugguacaagcacguggcgagucc

SEQ ID NO: 501622 - RNA, 32 nt, Human
uccggcggcagcgcuuccucuggcagggccga

SEQ ID NO: 501623 - RNA, 22 nt, Human
uccggcggccccucugcugcuc

SEQ ID NO: 501624 - RNA, 32 nt, Human
uccggcggccgggagagcgagugagcgagcgg

SEQ ID NO: 501625 - RNA, 32 nt, Human
uccggcggccucucuccucucccucagugacu

SEQ ID NO: 501626 - RNA, 32 nt, Human
uccggcggccucugcugccgccuccggagacg

SEQ ID NO: 501627 - RNA, 32 nt, Human
uccggcgggcugggcugggaccccucugccuc

SEQ ID NO: 501628 - RNA, 32 nt, Human
uccggcggggacccagggagugguuugggguc

SEQ ID NO: 501629 - RNA, 32 nt, Human
uccggcgugccgcucuucuccuccaggccggc

SEQ ID NO: 501630 - RNA, 32 nt, Human
uccggcgugguggcacacuccuguaaucccag

SEQ ID NO: 501631 - RNA, 32 nt, Human
uccggcuaccugcccucccugccuuccccagg

SEQ ID NO: 501632 - RNA, 21 nt, Human
uccggcuacuugggaggcuga

SEQ ID NO: 501633 - RNA, 22 nt, Human
uccggcuagugcuucugugaua

SEQ ID NO: 501634 - RNA, 23 nt, Human
uccggcuaugcuucuucauacca

SEQ ID NO: 501635 - RNA, 32 nt, Human
uccggcucacugcaguuuugaccucccaggcu

SEQ ID NO: 501636 - RNA, 32 nt, Human
uccggcuccgagcgugguucccuucccguguc

SEQ ID NO: 501637 - RNA, 32 nt, Human
uccggcuccuccaucuuggccucggcaguggc

SEQ ID NO: 501638 - RNA, 32 nt, Human
uccggcucgccucgggcugggcucgggcuccg

SEQ ID NO: 501639 - RNA, 32 nt, Human
uccggcucucugggugagagaccgagaggggc

SEQ ID NO: 501640 - RNA, 32 nt, Human
uccggcucugggcgugguucccuucccguguc

SEQ ID NO: 501641 - RNA, 32 nt, Human
uccggcugaggucucccagagacaggcuuucc

SEQ ID NO: 501642 - RNA, 32 nt, Human
uccggcuuccaccagcccaucgcuccacgcuc

SEQ ID NO: 501643 - RNA, 32 nt, Human
uccggcuucccaagggguacugugcagacuga

SEQ ID NO: 501644 - RNA, 32 nt, Human
uccggcuucucuuccuaaggagggucugcggc

SEQ ID NO: 501645 - RNA, 22 nt, Human
uccggcuugggcgagagugaga

SEQ ID NO: 501646 - RNA, 32 nt, Human
uccggcuuugggccuggcaggcuggcacaucc

SEQ ID NO: 501647 - RNA, 21 nt, Human
uccgggaaagcagaggaugca

SEQ ID NO: 501648 - RNA, 25 nt, Human
uccgggaaagcagagguugcaguga

SEQ ID NO: 501649 - RNA, 32 nt, Human
uccgggaacuguggugcugcuuucugugcaca

SEQ ID NO: 501650 - RNA, 24 nt, Human
uccgggaagcagagguuguaguga

SEQ ID NO: 501651 - RNA, 32 nt, Human
uccgggaagccgcggcgagcgcgcaccgccuu

SEQ ID NO: 501652 - RNA, 32 nt, Human
uccgggaagucccgcgccagcccaggagaacc

SEQ ID NO: 501653 - RNA, 27 nt, Human
uccgggaagucuuccugguggcaguga

SEQ ID NO: 501654 - RNA, 32 nt, Human
uccgggacaagccuggccacccucgcugugau

SEQ ID NO: 501655 - RNA, 21 nt, Human
uccgggacccguucccugcuc

SEQ ID NO: 501656 - RNA, 25 nt, Human
uccgggaccggugacaggcgcgggg

SEQ ID NO: 501657 - RNA, 32 nt, Human
uccgggacucuagcagcggucuccgcgacccc

SEQ ID NO: 501658 - RNA, 32 nt, Human
uccgggagaaggcagagggcagaggcaggaaa

SEQ ID NO: 501659 - RNA, 24 nt, Human
uccgggagaugcauguugcaguga

SEQ ID NO: 501660 - RNA, 23 nt, Human
uccgggagcagugguggcggugg

SEQ ID NO: 501661 - RNA, 32 nt, Human
uccgggaggaaggcgcccggcugcgucugcag

SEQ ID NO: 501662 - RNA, 32 nt, Human
uccgggaggcagagauugcagugggccuagau

SEQ ID NO: 501663 - RNA, 23 nt, Human
uccgggaggcagagguugcagga

SEQ ID NO: 501664 - RNA, 24 nt, Human
uccgggaggcagagguugcaguga

SEQ ID NO: 501665 - RNA, 24 nt, Human
uccgggaggcagagguugcuguga

SEQ ID NO: 501666 - RNA, 32 nt, Human
uccgggaggcccagggaaggugcaauggauga

SEQ ID NO: 501667 - RNA, 24 nt, Human
uccgggaggcggagcuugcagcga

SEQ ID NO: 501668 - RNA, 32 nt, Human
uccgggaggcggagcuugcagcgagccgggau

SEQ ID NO: 501669 - RNA, 32 nt, Human
uccgggaggcggagguugcagugaaccgaacc

SEQ ID NO: 501670 - RNA, 32 nt, Human
uccgggaggcggagguugcggugagccaaggu

SEQ ID NO: 501671 - RNA, 24 nt, Human
uccgggaggcgggucuugcaguga

SEQ ID NO: 501672 - RNA, 32 nt, Human
uccgggaggcgggucuugcagugagcagagau

SEQ ID NO: 501673 - RNA, 20 nt, Human
uccgggagggaugcuucugg

SEQ ID NO: 501674 - RNA, 32 nt, Human
uccgggagggugcaggcaggagagggaaaggc

SEQ ID NO: 501675 - RNA, 32 nt, Human
uccgggagguggagguugcagugagccaagau

SEQ ID NO: 501676 - RNA, 21 nt, Human
uccgggaggugguucgggaua

SEQ ID NO: 501677 - RNA, 18 nt, Human
uccgggauccccacucuc

SEQ ID NO: 501678 - RNA, 25 nt, Human
uccgggcaagcggagguugcaguga

SEQ ID NO: 501679 - RNA, 32 nt, Human
uccgggcaagggaagacaggcggcgagacgga

SEQ ID NO: 501680 - RNA, 25 nt, Human
uccgggcaaguggagguugcuauga

SEQ ID NO: 501681 - RNA, 32 nt, Human
uccgggcacagaagaaaaagaauuauuccauc

SEQ ID NO: 501682 - RNA, 32 nt, Human
uccgggcaggagccuugccucucagguggcgg

SEQ ID NO: 501683 - RNA, 32 nt, Human
uccgggcaggccugaggcugggaucccgugcu

SEQ ID NO: 501684 - RNA, 32 nt, Human
uccgggcagugagagggagggagcgccggccg

SEQ ID NO: 501685 - RNA, 20 nt, Human
uccgggccagcccugcuggg

SEQ ID NO: 501686 - RNA, 32 nt, Human
uccgggcccaccugcgggugcaccuuaaaucg

SEQ ID NO: 501687 - RNA, 32 nt, Human
uccgggcccagcucuuccucccggcugcgucu

SEQ ID NO: 501688 - RNA, 32 nt, Human
uccgggccccugcccuccucugcaccugacca

SEQ ID NO: 501689 - RNA, 21 nt, Human
uccgggccucugccgaccuca

SEQ ID NO: 501690 - RNA, 32 nt, Human
uccgggccucugcggagcccugggcagcucug

SEQ ID NO: 501691 - RNA, 26 nt, Human
uccgggccugccugagguugcaguga

SEQ ID NO: 501692 - RNA, 23 nt, Human
uccgggccuguggauuuugcagu

SEQ ID NO: 501693 - RNA, 32 nt, Human
uccgggccuuucucuggcuuccuuggcuugcc

SEQ ID NO: 501694 - RNA, 32 nt, Human
uccgggcgcgagaagaggggagccaggccgag

SEQ ID NO: 501695 - RNA, 22 nt, Human
uccgggcggggacggggcgggg

SEQ ID NO: 501696 - RNA, 32 nt, Human
uccgggcuaagagggccagcucccagccucuu

SEQ ID NO: 501697 - RNA, 26 nt, Human
uccgggcuaguguaagcuugcaguga

SEQ ID NO: 501698 - RNA, 20 nt, Human
uccgggcucuccugcugcuc

SEQ ID NO: 501699 - RNA, 32 nt, Human
uccgggcugcaucaucuuccuggacuguuucu

SEQ ID NO: 501700 - RNA, 32 nt, Human
uccgggcuggaaggcuggcguaggacuugggg

SEQ ID NO: 501701 - RNA, 32 nt, Human
uccgggcugggcgacagagcgagacccugucu

SEQ ID NO: 501702 - RNA, 32 nt, Human
uccgggcuggggagaaguugaaggguccuugu

SEQ ID NO: 501703 - RNA, 32 nt, Human
uccgggcuguguccuaaaugcaaagcacaccu

SEQ ID NO: 501704 - RNA, 25 nt, Human
uccgggcuugcuggagguuguggga

SEQ ID NO: 501705 - RNA, 32 nt, Human
uccggggaagggcagaggucaccaggcugguc

SEQ ID NO: 501706 - RNA, 22 nt, Human
uccggggagaacaucccuccca

SEQ ID NO: 501707 - RNA, 32 nt, Human
uccggggaggcccuagagcagagcagagcagc

SEQ ID NO: 501708 - RNA, 32 nt, Human
uccggggagggcccugggccagcggcuguccg

SEQ ID NO: 501709 - RNA, 32 nt, Human
uccggggaggggcacagggcuccagauaguaa

SEQ ID NO: 501710 - RNA, 32 nt, Human
uccggggagguggaaguugcagugggccaaga

SEQ ID NO: 501711 - RNA, 32 nt, Human
uccggggcccucucugcaccggacagucggaa

SEQ ID NO: 501712 - RNA, 32 nt, Human
uccggggccuggggccuccuugccuggcuucu

SEQ ID NO: 501713 - RNA, 32 nt, Human
uccggggcuacaccgagugcuugcagcggguu

SEQ ID NO: 501714 - RNA, 32 nt, Human
uccggggcucaagcgauccucccgcuucagcc

SEQ ID NO: 501715 - RNA, 32 nt, Human
uccggggcucaagcgcuucuccugccucagcc

SEQ ID NO: 501716 - RNA, 32 nt, Human
uccgggggaacccgguccggaggcagcagugu

SEQ ID NO: 501717 - RNA, 32 nt, Human
uccgggggcagggagaggcuagaggggcagga

SEQ ID NO: 501718 - RNA, 32 nt, Human
uccgggggcccaggcggggaaguggggugcgg

SEQ ID NO: 501719 - RNA, 21 nt, Human
uccggggggcggggggaggga

SEQ ID NO: 501720 - RNA, 32 nt, Human
uccgggguucaagccauucuccugccuaagcc

SEQ ID NO: 501721 - RNA, 32 nt, Human
uccgggguucaagcgauucuccugccucagcc

SEQ ID NO: 501722 - RNA, 32 nt, Human
uccggguaauccagcacccugaggcuucacug

SEQ ID NO: 501723 - RNA, 21 nt, Human
uccggguagcagcuccagggc

SEQ ID NO: 501724 - RNA, 26 nt, Human
uccgggucagggugaccucuggggug

SEQ ID NO: 501725 - RNA, 32 nt, Human
uccgggucugggcucggagauuacaggcggcc

SEQ ID NO: 501726 - RNA, 32 nt, Human
uccgggugcaucgcugcguccugggugcacgu

SEQ ID NO: 501727 - RNA, 32 nt, Human
uccgggugccgguugagguugcuggugggccu

SEQ ID NO: 501728 - RNA, 32 nt, Human
uccggguggcugcuccggcccuuccgccucca

SEQ ID NO: 501729 - RNA, 32 nt, Human
uccggguggcugguucucagugguugucucau

SEQ ID NO: 501730 - RNA, 23 nt, Human
uccgggugggcguccauggugcu

SEQ ID NO: 501731 - RNA, 32 nt, Human
uccgggugucaccuccagagggcgccggcugc

SEQ ID NO: 501732 - RNA, 32 nt, Human
uccggguugggagcuugcugugucuaaccucc

SEQ ID NO: 501733 - RNA, 32 nt, Human
uccggguugggauggagauaggaggaucucag

SEQ ID NO: 501734 - RNA, 24 nt, Human
uccggguuugcaggagguugcagu

SEQ ID NO: 501735 - RNA, 32 nt, Human
uccgguagggaaauggucgugcuuucgguccc

SEQ ID NO: 501736 - RNA, 32 nt, Human
uccggucauuugugcccuucucuugucaucuc

SEQ ID NO: 501737 - RNA, 32 nt, Human
uccggucauuugugccuuucucuugucaucuc

SEQ ID NO: 501738 - RNA, 32 nt, Human
uccgguccuggagcuugcaucgguuucuucag

SEQ ID NO: 501739 - RNA, 32 nt, Human
uccgguccuggccugggcugggcccagccuga

SEQ ID NO: 501740 - RNA, 32 nt, Human
uccgguccuuucuccuccccuagcuggggaga

SEQ ID NO: 501741 - RNA, 24 nt, Human
uccggucugagcgacagagcaaga

SEQ ID NO: 501742 - RNA, 32 nt, Human
uccggucuggcgcucccuuuucuccacaccca

SEQ ID NO: 501743 - RNA, 20 nt, Human
uccggucuggguccccgaga

SEQ ID NO: 501744 - RNA, 24 nt, Human
uccggugaagcggagguguggugg

SEQ ID NO: 501745 - RNA, 31 nt, Human
uccggugccaauaaauccuuguggaaucuga

SEQ ID NO: 501746 - RNA, 32 nt, Human
uccggugccugcaccaaaucaggaagcuccua

SEQ ID NO: 501747 - RNA, 32 nt, Human
uccggugcgcagccaguggagcucuuuucacc

SEQ ID NO: 501748 - RNA, 32 nt, Human
uccgguggagccaauucaccagcaggucccgg

SEQ ID NO: 501749 - RNA, 32 nt, Human
uccgguggaggcagaggcaguccuggggcucu

SEQ ID NO: 501750 - RNA, 32 nt, Human
uccgguggcggggagagcgggcucccagcgcu

SEQ ID NO: 501751 - RNA, 32 nt, Human
uccgguggcucacgccuguaaucccagcaauu

SEQ ID NO: 501752 - RNA, 32 nt, Human
uccgguggcugcagggcgcaggguagccgugu

SEQ ID NO: 501753 - RNA, 32 nt, Human
uccggugggcggagcuuggaggcggcgggaac

SEQ ID NO: 501754 - RNA, 32 nt, Human
uccgguggugcuggaggcuccacucuccuuag

SEQ ID NO: 501755 - RNA, 32 nt, Human
uccggugguuguucgagacuugcccaaugagu

SEQ ID NO: 501756 - RNA, 32 nt, Human
uccggugugguggcucacaccuguaaucccaa

SEQ ID NO: 501757 - RNA, 32 nt, Human
uccgguguuugccuuuucagauuauagaagua

SEQ ID NO: 501758 - RNA, 32 nt, Human
uccgguuauucacuugaguuguugcuuauacu

SEQ ID NO: 501759 - RNA, 32 nt, Human
uccgguuauuuaagucauuucugugauucuau

SEQ ID NO: 501760 - RNA, 32 nt, Human
uccgguucauucuuaccuguguuaggccaugu

SEQ ID NO: 501761 - RNA, 32 nt, Human
uccgguuccuaaauauccuggcccagguucuc

SEQ ID NO: 501762 - RNA, 24 nt, Human
uccgguucuguggcgggugcgaga

SEQ ID NO: 501763 - RNA, 32 nt, Human
uccgguugagacgcacucccacccugggugcu

SEQ ID NO: 501764 - RNA, 32 nt, Human
uccgguugagaguuucccaguuuccugauagu

SEQ ID NO: 501765 - RNA, 19 nt, Human
uccgguuggagccauugca

SEQ ID NO: 501766 - RNA, 32 nt, Human
uccgguuucuauggccuugcuguguacuuucc

SEQ ID NO: 501767 - RNA, 32 nt, Human
uccgguuugcaguacuugcacacauuuuggag

SEQ ID NO: 501768 - RNA, 32 nt, Human
uccgguuugcaucacccggaccgggggauuag

SEQ ID NO: 501769 - RNA, 25 nt, Human
uccgguuugccuacgccaagaggac

SEQ ID NO: 501770 - RNA, 32 nt, Human
uccgguuuuaauauugcuggauuugcuaccuu

SEQ ID NO: 501771 - RNA, 32 nt, Human
uccguaacucggcuguguucuguucauguuug

SEQ ID NO: 501772 - RNA, 32 nt, Human
uccguaagaugaaggucacaaagaaagucaac

SEQ ID NO: 501773 - RNA, 32 nt, Human
uccguaagcuuagugggccugaaucugcggac

SEQ ID NO: 501774 - RNA, 32 nt, Human
uccguacccacugcugaugguuucccagagcc

SEQ ID NO: 501775 - RNA, 32 nt, Human
uccguaccccuucaaauccuuacucuccuaaa

SEQ ID NO: 501776 - RNA, 32 nt, Human
uccguaccuugccuagccucucccucuccccc

SEQ ID NO: 501777 - RNA, 32 nt, Human
uccguacugugaagaaagaacucuccacccca

SEQ ID NO: 501778 - RNA, 32 nt, Human
uccguagcccaggcuggagugcaguggcacag

SEQ ID NO: 501779 - RNA, 32 nt, Human
uccguagccugggugaagucccagaagcuggu

SEQ ID NO: 501780 - RNA, 32 nt, Human
uccguagggcuggacccuacaggcuccagagc

SEQ ID NO: 501781 - RNA, 32 nt, Human
uccguaguccccgccccaccucccaggaagua

SEQ ID NO: 501782 - RNA, 32 nt, Human
uccguaucggggacugugccguguuccucucu

SEQ ID NO: 501783 - RNA, 32 nt, Human
uccguauucuucuuucaguuucuccauuagau

SEQ ID NO: 501784 - RNA, 32 nt, Human
uccgucaacucauauuuucaugcuguucauga

SEQ ID NO: 501785 - RNA, 32 nt, Human
uccgucacccaggcuggagugcaguggcaaga

SEQ ID NO: 501786 - RNA, 32 nt, Human
uccgucacccaggcuggagugcaguggcgcca

SEQ ID NO: 501787 - RNA, 32 nt, Human
uccgucaccccagcucugccugugccuuuauc

SEQ ID NO: 501788 - RNA, 32 nt, Human
uccgucacuccgauagccucacggccacccug

SEQ ID NO: 501789 - RNA, 32 nt, Human
uccgucagagugcuccuggugccaugaacgga

SEQ ID NO: 501790 - RNA, 32 nt, Human
uccgucaguuauuaguggauggagauucccac

SEQ ID NO: 501791 - RNA, 32 nt, Human
uccgucauccaugcccucccaggacccuccac

SEQ ID NO: 501792 - RNA, 32 nt, Human
uccguccaggaggacaaagugggauuugaaga

SEQ ID NO: 501793 - RNA, 32 nt, Human
uccguccaucugucccgcugccccgcggccca

SEQ ID NO: 501794 - RNA, 32 nt, Human
uccgucccaggcccauuuuugacagauggcgg

SEQ ID NO: 501795 - RNA, 32 nt, Human
uccgucccccuuccgccuucucccuuuucuca

SEQ ID NO: 501796 - RNA, 32 nt, Human
uccguccccgccgccucacugcagccagcgug

SEQ ID NO: 501797 - RNA, 32 nt, Human
uccgucccugggauguccucauccccuuuucg

SEQ ID NO: 501798 - RNA, 19 nt, Human
uccgucccugucccgggcu

SEQ ID NO: 501799 - RNA, 32 nt, Human
uccgucccuuggggaccacaggcaucagcagu

SEQ ID NO: 501800 - RNA, 32 nt, Human
uccguccgccgccaccacccacuccggacaca

SEQ ID NO: 501801 - RNA, 32 nt, Human
uccguccgcgucgcgucaccccaaacccuaag

SEQ ID NO: 501802 - RNA, 32 nt, Human
uccguccgguucuugcuauauugccccaggcu

SEQ ID NO: 501803 - RNA, 32 nt, Human
uccguccguccccuccugccugccccucuucu

SEQ ID NO: 501804 - RNA, 32 nt, Human
uccguccuccugucucagggcuggcaggggga

SEQ ID NO: 501805 - RNA, 32 nt, Human
uccguccugcuccccagcucacucucugaagc

SEQ ID NO: 501806 - RNA, 24 nt, Human
uccguccugggugacaaagugaga

SEQ ID NO: 501807 - RNA, 32 nt, Human
uccguccugggugacaaagugagacucccucu

SEQ ID NO: 501808 - RNA, 32 nt, Human
uccguccuuucuuugcugucaugcuggcuugc

SEQ ID NO: 501809 - RNA, 32 nt, Human
uccgucgaucuauuuucgucccuguccucuug

SEQ ID NO: 501810 - RNA, 32 nt, Human
uccgucggaggaaaaugacuccccagucgcug

SEQ ID NO: 501811 - RNA, 32 nt, Human
uccgucggcccagacugaagugcaguggcaca

SEQ ID NO: 501812 - RNA, 32 nt, Human
uccgucguagaagaauuagaguagaaguuguc

SEQ ID NO: 501813 - RNA, 24 nt, Human
uccgucucagacacaccuccauga

SEQ ID NO: 501814 - RNA, 32 nt, Human
uccgucuccacuaaaauacaaaauuagcuggg

SEQ ID NO: 501815 - RNA, 32 nt, Human
uccgucuccggcccugaaccagcuccagcccu

SEQ ID NO: 501816 - RNA, 32 nt, Human
uccgucucgcucaucaucaccgacauguccuu

SEQ ID NO: 501817 - RNA, 32 nt, Human
uccgucucucaaagugcugggauuagaggugu

SEQ ID NO: 501818 - RNA, 32 nt, Human
uccgucucuggagagcucugggcacuuaacau

SEQ ID NO: 501819 - RNA, 32 nt, Human
uccgucucuggagcccaccagggaaggcccuc

SEQ ID NO: 501820 - RNA, 32 nt, Human
uccgucucuuucucccucagauccuccccaca

SEQ ID NO: 501821 - RNA, 32 nt, Human
uccgucugccuaaaucacuuuucucgcagaag

SEQ ID NO: 501822 - RNA, 31 nt, Human
uccgucugccucuuuggucaguuucaggucc

SEQ ID NO: 501823 - RNA, 32 nt, Human
uccgucuguggcuuguuucuccauucucuuau

SEQ ID NO: 501824 - RNA, 32 nt, Human
uccgucuuacaacuaagacauucuuuuuauua

SEQ ID NO: 501825 - RNA, 32 nt, Human
uccgucuucacauugugcacagaucugaggau

SEQ ID NO: 501826 - RNA, 32 nt, Human
uccgucuucugguccacucugcucugagcagc

SEQ ID NO: 501827 - RNA, 32 nt, Human
uccgucuuguaaauguuuggcacuuugcuacu

SEQ ID NO: 501828 - RNA, 32 nt, Human
uccgugaaaccagccucagaucagggcccugc

SEQ ID NO: 501829 - RNA, 32 nt, Human
uccgugaagggagugccucucugggacccccu

SEQ ID NO: 501830 - RNA, 32 nt, Human
uccgugacccuccggcugcucggagugaacag

SEQ ID NO: 501831 - RNA, 27 nt, Human
uccgugagagugagugacggagugaga

SEQ ID NO: 501832 - RNA, 32 nt, Human
uccgugagcucuugggaaaggggugaauucac

SEQ ID NO: 501833 - RNA, 23 nt, Human
uccgugaggugguagaauacucu

SEQ ID NO: 501834 - RNA, 32 nt, Human
uccgugcacacagcguucucugauugccaagc

SEQ ID NO: 501835 - RNA, 32 nt, Human
uccgugcacgucaaaugcuccuuucccuugug

SEQ ID NO: 501836 - RNA, 32 nt, Human
uccgugcagauacucucuucacuauuccuagg

SEQ ID NO: 501837 - RNA, 32 nt, Human
uccgugcauuugacggcauccauguccaaggc

SEQ ID NO: 501838 - RNA, 32 nt, Human
uccgugcccaggcuggagcuggccaauucucc

SEQ ID NO: 501839 - RNA, 32 nt, Human
uccgugcucagaggauccagaacggcagcugg

SEQ ID NO: 501840 - RNA, 32 nt, Human
uccgugcugaugaagaggaaacccacuuacag

SEQ ID NO: 501841 - RNA, 32 nt, Human
uccgugcuggacagcuccuuccucacguucuc

SEQ ID NO: 501842 - RNA, 32 nt, Human
uccgugcuuuucugguugagaucaugucauug

SEQ ID NO: 501843 - RNA, 32 nt, Human
uccguggagacagcagauccgagaagcggcga

SEQ ID NO: 501844 - RNA, 32 nt, Human
uccguggagagcugugcuuggaagagaaggac

SEQ ID NO: 501845 - RNA, 32 nt, Human
uccguggagaggcagagcuuucauacugaauu

SEQ ID NO: 501846 - RNA, 32 nt, Human
uccguggagagggacuggcagagcugaggcca

SEQ ID NO: 501847 - RNA, 24 nt, Human
uccguggaggccucugagcacaga

SEQ ID NO: 501848 - RNA, 32 nt, Human
uccguggaucuuucaugucucuguacauccug

SEQ ID NO: 501849 - RNA, 32 nt, Human
uccguggcgccucgccagcugcaggacgacgc

SEQ ID NO: 501850 - RNA, 32 nt, Human
uccguggcgcuaguccagcacgcccaggguua

SEQ ID NO: 501851 - RNA, 32 nt, Human
uccguggcguagggagcacuguuucuuuccag

SEQ ID NO: 501852 - RNA, 32 nt, Human
uccgugggacccucagcagcucuggcucugcc

SEQ ID NO: 501853 - RNA, 32 nt, Human
uccgugggcuuccguggugcagcccuggggca

SEQ ID NO: 501854 - RNA, 32 nt, Human
uccguggggagcaggagagggaggcggcggac

SEQ ID NO: 501855 - RNA, 17 nt, Human
uccguggugccuggaga

SEQ ID NO: 501856 - RNA, 32 nt, Human
uccguggugccuucuagcuuagaaccauuuuc

SEQ ID NO: 501857 - RNA, 22 nt, Human
uccguggugucccccgcaccca

SEQ ID NO: 501858 - RNA, 32 nt, Human
uccgugguuucauuucacuguggucaaucaca

SEQ ID NO: 501859 - RNA, 32 nt, Human
uccguguagggagcgggcggcggcgggggagg

SEQ ID NO: 501860 - RNA, 32 nt, Human
uccgugucucugagccccggguggcaggaccc

SEQ ID NO: 501861 - RNA, 32 nt, Human
uccgugucuggcuucaucuaaguggccugguc

SEQ ID NO: 501862 - RNA, 32 nt, Human
uccgugugagccacugagugguuaucaccuca

SEQ ID NO: 501863 - RNA, 32 nt, Human
uccgugugcugucugccaccuccucgggccac

SEQ ID NO: 501864 - RNA, 32 nt, Human
uccgugugcuguucuuuuggguucugagaggg

SEQ ID NO: 501865 - RNA, 32 nt, Human
uccgugugucaucugcaggagugaguaggccu

SEQ ID NO: 501866 - RNA, 32 nt, Human
uccguguuuuuaucacaccugcuccccagauu

SEQ ID NO: 501867 - RNA, 32 nt, Human
uccguuaaguguccuuaggaugcagugauuaa

SEQ ID NO: 501868 - RNA, 21 nt, Human
uccguuacugugagguugcug

SEQ ID NO: 501869 - RNA, 30 nt, Human
uccguuagccucucugggccucuguccauc

SEQ ID NO: 501870 - RNA, 31 nt, Human
uccguuagccucucugggccucuguccaucu

SEQ ID NO: 501871 - RNA, 32 nt, Human
uccguuaucuaaacccgucacuccaggaaaca

SEQ ID NO: 501872 - RNA, 32 nt, Human
uccguuaucucaucugaucuuuugcucuucca

SEQ ID NO: 501873 - RNA, 32 nt, Human
uccguuauguuuagaguagaaaauguuuaggu

SEQ ID NO: 501874 - RNA, 32 nt, Human
uccguucaccugugcaaaggcuuccucagaca

SEQ ID NO: 501875 - RNA, 32 nt, Human
uccguucacugcagccuccaccuccccgguuc

SEQ ID NO: 501876 - RNA, 32 nt, Human
uccguucagcauuccacgccccucucugcccu

SEQ ID NO: 501877 - RNA, 32 nt, Human
uccguucagggcccgcucagaaccugaggacc

SEQ ID NO: 501878 - RNA, 32 nt, Human
uccguucauagaaauuguguuugcuaacaagg

SEQ ID NO: 501879 - RNA, 32 nt, Human
uccguuccaguugcugccuaagccccauccuu

SEQ ID NO: 501880 - RNA, 32 nt, Human
uccguuccccuucaucuccgucccccucuuug

SEQ ID NO: 501881 - RNA, 21 nt, Human
uccguuccccuuuccccuccc

SEQ ID NO: 501882 - RNA, 32 nt, Human
uccguuccccuuuccccucccuucccuauccc

SEQ ID NO: 501883 - RNA, 32 nt, Human
uccguucccucaggaccccacugggugccgcu

SEQ ID NO: 501884 - RNA, 32 nt, Human
uccguuccucaagcuccgggcuggggcuuugg

SEQ ID NO: 501885 - RNA, 32 nt, Human
uccguucuccagaucuguuugcucuuaacagg

SEQ ID NO: 501886 - RNA, 32 nt, Human
uccguucuguucugcugggaguucuagaacca

SEQ ID NO: 501887 - RNA, 32 nt, Human
uccguugacucagugcugcugcuccagggugg

SEQ ID NO: 501888 - RNA, 32 nt, Human
uccguugacuucuguacaucuacaaugaauac

SEQ ID NO: 501889 - RNA, 32 nt, Human
uccguugagcaucuagacguuuccuuggcucu

SEQ ID NO: 501890 - RNA, 32 nt, Human
uccguugccaggcuggagugcuguggcgcuau

SEQ ID NO: 501891 - RNA, 32 nt, Human
uccguugcccagguuggagugcaguggcccau

SEQ ID NO: 501892 - RNA, 32 nt, Human
uccguugccucccagcccucuguauccaccug

SEQ ID NO: 501893 - RNA, 32 nt, Human
uccguuggaaacuugggcugaguaccgcggcg

SEQ ID NO: 501894 - RNA, 32 nt, Human
uccguugucggccucccacugcaguaucaccu

SEQ ID NO: 501895 - RNA, 32 nt, Human
uccguugucucucugcugugucgcccaacacu

SEQ ID NO: 501896 - RNA, 32 nt, Human
uccguuucgucucuuggaaacagcuccccacc

SEQ ID NO: 501897 - RNA, 32 nt, Human
uccguuucugcucccuccaccccacgaggacg

SEQ ID NO: 501898 - RNA, 32 nt, Human
uccguuugcacugguggagaccccacaauggg

SEQ ID NO: 501899 - RNA, 32 nt, Human
uccguuuguggacccucagacucuuagucccc

SEQ ID NO: 501900 - RNA, 32 nt, Human
uccguuuuagcugucagacuucaguggguccc

SEQ ID NO: 501901 - RNA, 32 nt, Human
uccguuuuauccaucagagucagugcuauaaa

SEQ ID NO: 501902 - RNA, 32 nt, Human
uccguuuuccagcucaguguagacccucgggc

SEQ ID NO: 501903 - RNA, 32 nt, Human
uccuaaaaauacagaaaauuagccuggcaugg

SEQ ID NO: 501904 - RNA, 32 nt, Human
uccuaaaacuccucaaguucaucuggcucaga

SEQ ID NO: 501905 - RNA, 32 nt, Human
uccuaaaacuucucuccuuucucuccauaaaa

SEQ ID NO: 501906 - RNA, 32 nt, Human
uccuaaaaggccacucucccugccuuuggauu

SEQ ID NO: 501907 - RNA, 32 nt, Human
uccuaaaaguccaggagggggccaggcgcagu

SEQ ID NO: 501908 - RNA, 32 nt, Human
uccuaaaauauacaaaaauuagccgggcaugg

SEQ ID NO: 501909 - RNA, 32 nt, Human
uccuaaacagagagagaaaaaggguaucugcc

SEQ ID NO: 501910 - RNA, 32 nt, Human
uccuaaaccagccugggcaacauagugauacc

SEQ ID NO: 501911 - RNA, 32 nt, Human
uccuaaacccugcugccuucccaaaaauacca

SEQ ID NO: 501912 - RNA, 32 nt, Human
uccuaaacucuacagaaaauuagacagguaug

SEQ ID NO: 501913 - RNA, 32 nt, Human
uccuaaacuggucuuugugcucucuuuguuuu

SEQ ID NO: 501914 - RNA, 32 nt, Human
uccuaaagagcagugaaggaaaugucagguua

SEQ ID NO: 501915 - RNA, 32 nt, Human
uccuaaagcauuccuaggaauauuuuccccgc

SEQ ID NO: 501916 - RNA, 32 nt, Human
uccuaaagcuuuagacucagagcccagggucc

SEQ ID NO: 501917 - RNA, 32 nt, Human
uccuaaagugcuggagauuacaggcaugagcc

SEQ ID NO: 501918 - RNA, 31 nt, Human
uccuaaauauguuucugacugcagaccaaag

SEQ ID NO: 501919 - RNA, 32 nt, Human
uccuaaaugucagaagauauucugaacuggau

SEQ ID NO: 501920 - RNA, 32 nt, Human
uccuaacaaugucuuggaagugggaugauggu

SEQ ID NO: 501921 - RNA, 32 nt, Human
uccuaacacagcacaacaggaggucucuguca

SEQ ID NO: 501922 - RNA, 32 nt, Human
uccuaacacugccaucucgcggauggggucug

SEQ ID NO: 501923 - RNA, 32 nt, Human
uccuaaccagccuggucaacauggugaaaccc

SEQ ID NO: 501924 - RNA, 32 nt, Human
uccuaacccugccuuuuuagucccgguggagc

SEQ ID NO: 501925 - RNA, 32 nt, Human
uccuaacccugggcucccuggaggacucuaga

SEQ ID NO: 501926 - RNA, 32 nt, Human
uccuaaccucaagugauccacccgccucagcc

SEQ ID NO: 501927 - RNA, 32 nt, Human
uccuaaccucaagugauccacccgccuuugcc

SEQ ID NO: 501928 - RNA, 26 nt, Human
uccuaaccucaagugauccucccacc

SEQ ID NO: 501929 - RNA, 21 nt, Human
uccuaaccucaggugauccac

SEQ ID NO: 501930 - RNA, 24 nt, Human
uccuaaccucaggugauccaccca

SEQ ID NO: 501931 - RNA, 24 nt, Human
uccuaaccucaggugauccacccg

SEQ ID NO: 501932 - RNA, 24 nt, Human
uccuaaccucgggugauccaccca

SEQ ID NO: 501933 - RNA, 32 nt, Human
uccuaaccuuucuucuggguccuuccucagau

SEQ ID NO: 501934 - RNA, 31 nt, Human
uccuaacuacacacagggaggagggaauuau

SEQ ID NO: 501935 - RNA, 21 nt, Human
uccuaacuacuguauuuguua

SEQ ID NO: 501936 - RNA, 32 nt, Human
uccuaacucuccucgcugacccuaucugggag

SEQ ID NO: 501937 - RNA, 32 nt, Human
uccuaacuugagugccccaagguccaacucuc

SEQ ID NO: 501938 - RNA, 32 nt, Human
uccuaacuugggaggcugaguugggaggaugg

SEQ ID NO: 501939 - RNA, 31 nt, Human
uccuaagaacaaugccaacaaagcuuacaac

SEQ ID NO: 501940 - RNA, 32 nt, Human
uccuaagaacaaugccaacaaagcuuacaaca

SEQ ID NO: 501941 - RNA, 32 nt, Human
uccuaagacgccaggaggaguuucaguguaag

SEQ ID NO: 501942 - RNA, 32 nt, Human
uccuaagacuggccugcagcuuugccaacauu

SEQ ID NO: 501943 - RNA, 32 nt, Human
uccuaagagccaggcaugguggcucaugccug

SEQ ID NO: 501944 - RNA, 32 nt, Human
uccuaagagugcaguucccaugagucacuucc

SEQ ID NO: 501945 - RNA, 32 nt, Human
uccuaagcauugaaauggcaagugcaaccaaa

SEQ ID NO: 501946 - RNA, 32 nt, Human
uccuaagcuaucucucaugguuccuauguuuu

SEQ ID NO: 501947 - RNA, 32 nt, Human
uccuaagcucaagugauccucccaccucagcc

SEQ ID NO: 501948 - RNA, 21 nt, Human
uccuaagcucugacagucuaa

SEQ ID NO: 501949 - RNA, 32 nt, Human
uccuaagcugacacaggcugcagagaaaagug

SEQ ID NO: 501950 - RNA, 32 nt, Human
uccuaagcuggcugucuugugugcagccugag

SEQ ID NO: 501951 - RNA, 32 nt, Human
uccuaaggaggaagaggaaggcagcccuggag

SEQ ID NO: 501952 - RNA, 32 nt, Human
uccuaaggcacccuuugcaucuucccauccac

SEQ ID NO: 501953 - RNA, 32 nt, Human
uccuaaggcuuugaccagcuucccaggcugga

SEQ ID NO: 501954 - RNA, 32 nt, Human
uccuaagggaacacugcucagaaaguacugca

SEQ ID NO: 501955 - RNA, 32 nt, Human
uccuaagggaccacacccuuccuccuuccccu

SEQ ID NO: 501956 - RNA, 32 nt, Human
uccuaaggggagugccugcgagccucggguga

SEQ ID NO: 501957 - RNA, 32 nt, Human
uccuaaggucaccaagaauaucagggcugugg

SEQ ID NO: 501958 - RNA, 32 nt, Human
uccuaaggucuccagccagggcuucugagaug

SEQ ID NO: 501959 - RNA, 32 nt, Human
uccuaagguuuccagugugucaccaacaaaaa

SEQ ID NO: 501960 - RNA, 23 nt, Human
uccuaaguagcugggauuacagg

SEQ ID NO: 501961 - RNA, 23 nt, Human
uccuaaguaucugggauuacagg

SEQ ID NO: 501962 - RNA, 22 nt, Human
uccuaagugagagagagccugg

SEQ ID NO: 501963 - RNA, 32 nt, Human
uccuaagugucaccccgcuguaagcuccuuug

SEQ ID NO: 501964 - RNA, 32 nt, Human
uccuaaguuaaauaaaugcaagccucugaacu

SEQ ID NO: 501965 - RNA, 32 nt, Human
uccuaaguucaggcgauucuccugccucagcu

SEQ ID NO: 501966 - RNA, 32 nt, Human
uccuaauaugaucuaaaacccuaaaugguuau

SEQ ID NO: 501967 - RNA, 32 nt, Human
uccuaaucgcccucaccucuggcuucaggucc

SEQ ID NO: 501968 - RNA, 32 nt, Human
uccuaaucuuuuaaaaucaagaagaaccaugg

SEQ ID NO: 501969 - RNA, 32 nt, Human
uccuaauguagaacauuuaggagugacaggag

SEQ ID NO: 501970 - RNA, 32 nt, Human
uccuaauguguuuugccuuaaccucuuuucuc

SEQ ID NO: 501971 - RNA, 22 nt, Human
uccuaauuguuucuguaugugu

SEQ ID NO: 501972 - RNA, 32 nt, Human
uccuaauuucaaaacaucaccuugccacccug

SEQ ID NO: 501973 - RNA, 32 nt, Human
uccuacaaaagugccuacagccccagcccagu

SEQ ID NO: 501974 - RNA, 32 nt, Human
uccuacaaacuaauguauuugugcacaagaca

SEQ ID NO: 501975 - RNA, 32 nt, Human
uccuacaagauguaagacuguuuauaauuaaa

SEQ ID NO: 501976 - RNA, 32 nt, Human
uccuacaauggaaugcacacuccagucuuggu

SEQ ID NO: 501977 - RNA, 32 nt, Human
uccuacacaaugcguugccuggcuccacgccc

SEQ ID NO: 501978 - RNA, 23 nt, Human
uccuacacaauucauuuacucca

SEQ ID NO: 501979 - RNA, 32 nt, Human
uccuacacagccaaccuugcugccuuccucac

SEQ ID NO: 501980 - RNA, 32 nt, Human
uccuacacaguucucaggccccggcuaaaugg

SEQ ID NO: 501981 - RNA, 32 nt, Human
uccuacacaucuauaauccccaccccauggcu

SEQ ID NO: 501982 - RNA, 32 nt, Human
uccuacaccugcuuuggaaagacaugcacuuu

SEQ ID NO: 501983 - RNA, 32 nt, Human
uccuacacucacucuccucuggcaccaauaua

SEQ ID NO: 501984 - RNA, 32 nt, Human
uccuacacugauuuugaaauacuaagaucaga

SEQ ID NO: 501985 - RNA, 32 nt, Human
uccuacagagaagguuccaaagcugagcaccc

SEQ ID NO: 501986 - RNA, 32 nt, Human
uccuacagcuguucagcugugccucaucaggg

SEQ ID NO: 501987 - RNA, 32 nt, Human
uccuacaggacugucugucuccugccccauga

SEQ ID NO: 501988 - RNA, 32 nt, Human
uccuacagugcucucccucccugggcagauug

SEQ ID NO: 501989 - RNA, 24 nt, Human
uccuacaucccuuucucccuuccc

SEQ ID NO: 501990 - RNA, 32 nt, Human
uccuacaugcagcugugaacaguugugcccga

SEQ ID NO: 501991 - RNA, 32 nt, Human
uccuaccaacaauccccuccucccauggccug

SEQ ID NO: 501992 - RNA, 32 nt, Human
uccuaccaagcagauuggaaacaaauacuacu

SEQ ID NO: 501993 - RNA, 32 nt, Human
uccuaccaagcccuaccaagcaggaguuaaua

SEQ ID NO: 501994 - RNA, 32 nt, Human
uccuaccacugcacuucagccuaggugacaua

SEQ ID NO: 501995 - RNA, 32 nt, Human
uccuaccagaucggagcccugcccuuuaccac

SEQ ID NO: 501996 - RNA, 32 nt, Human
uccuaccaggcccugaggucaggauggggagc

SEQ ID NO: 501997 - RNA, 32 nt, Human
uccuaccaucccaggaggcaggcacagccagg

SEQ ID NO: 501998 - RNA, 32 nt, Human
uccuaccauuugaggauacagugagaagccuu

SEQ ID NO: 501999 - RNA, 32 nt, Human
uccuacccaaguggccuccagcuguccguuag

SEQ ID NO: 502000 - RNA, 32 nt, Human
uccuacccaaugcuggguagguccuuuaagag

SEQ ID NO: 502001 - RNA, 32 nt, Human
uccuacccauggcuacagaggaauggcccaag

SEQ ID NO: 502002 - RNA, 32 nt, Human
uccuacccaugggaaaccccagauucugaagc

SEQ ID NO: 502003 - RNA, 32 nt, Human
uccuacccccgcccgccauccccaguugcagg

SEQ ID NO: 502004 - RNA, 23 nt, Human
uccuacccccuucucccucuccc

SEQ ID NO: 502005 - RNA, 23 nt, Human
uccuaccccuguccuggggcugg

SEQ ID NO: 502006 - RNA, 32 nt, Human
uccuacccugcucuaccgcuuuucugggucac

SEQ ID NO: 502007 - RNA, 22 nt, Human
uccuacccuucccuuccuuccc

SEQ ID NO: 502008 - RNA, 32 nt, Human
uccuaccuaguggaaagagcaaggcagcucuc

SEQ ID NO: 502009 - RNA, 32 nt, Human
uccuaccugcagcuucacuuugcucuagucuc

SEQ ID NO: 502010 - RNA, 32 nt, Human
uccuaccugcccccaacccacccuccaccccg

SEQ ID NO: 502011 - RNA, 32 nt, Human
uccuaccugccugaccugcccagcauugccaa

SEQ ID NO: 502012 - RNA, 32 nt, Human
uccuaccugccugaccugcccggcauugccaa

SEQ ID NO: 502013 - RNA, 32 nt, Human
uccuaccugccuggugucggugagcuccuuga

SEQ ID NO: 502014 - RNA, 32 nt, Human
uccuaccugucugauauaaacuuucucugggu

SEQ ID NO: 502015 - RNA, 32 nt, Human
uccuaccuuuuauucauggguaguuuugcaaa

SEQ ID NO: 502016 - RNA, 32 nt, Human
uccuacgcaggaggcaacagaggcucagacau

SEQ ID NO: 502017 - RNA, 21 nt, Human
uccuacggacaggucaccucu

SEQ ID NO: 502018 - RNA, 32 nt, Human
uccuacgggcuguagauggagcuguccggccc

SEQ ID NO: 502019 - RNA, 31 nt, Human
uccuacguccuggcugggccuggucccaggc

SEQ ID NO: 502020 - RNA, 25 nt, Human
uccuacuacuggccucucccuuucc

SEQ ID NO: 502021 - RNA, 32 nt, Human
uccuacuaggggcgggcccugcauuugcugga

SEQ ID NO: 502022 - RNA, 32 nt, Human
uccuacucaccaggggcucuucagagcagcag

SEQ ID NO: 502023 - RNA, 32 nt, Human
uccuacuccacccuccccuggugauaagcaug

SEQ ID NO: 502024 - RNA, 32 nt, Human
uccuacucccuucugucucccugcccucugcc

SEQ ID NO: 502025 - RNA, 22 nt, Human
uccuacuccugccaugcauuga

SEQ ID NO: 502026 - RNA, 32 nt, Human
uccuacuccuuuuccucuaccccuugcucugg

SEQ ID NO: 502027 - RNA, 32 nt, Human
uccuacucggcucugcaguccuacucaagcgg

SEQ ID NO: 502028 - RNA, 32 nt, Human
uccuacucuccccucccugcuccuucgcuuuu

SEQ ID NO: 502029 - RNA, 23 nt, Human
uccuacucuccccuucccuuccc

SEQ ID NO: 502030 - RNA, 32 nt, Human
uccuacucugcugccagcaucggucccgaucc

SEQ ID NO: 502031 - RNA, 24 nt, Human
uccuacucuucuuucucccugccc

SEQ ID NO: 502032 - RNA, 21 nt, Human
uccuacugccccuccaucuca

SEQ ID NO: 502033 - RNA, 32 nt, Human
uccuacuggacccucuugcccagccggcugca

SEQ ID NO: 502034 - RNA, 32 nt, Human
uccuacugucauggguuugggauuuguaacgg

SEQ ID NO: 502035 - RNA, 32 nt, Human
uccuacuuaccuccagaccacuggagucaugg

SEQ ID NO: 502036 - RNA, 32 nt, Human
uccuacuucugggauugcagaucagggguggg

SEQ ID NO: 502037 - RNA, 32 nt, Human
uccuacuugaagccaaggugggaggaucacca

SEQ ID NO: 502038 - RNA, 32 nt, Human
uccuacuugcccacccuuccuugcugguucag

SEQ ID NO: 502039 - RNA, 32 nt, Human
uccuacuuuccucauugccuaggcaaccauuu

SEQ ID NO: 502040 - RNA, 32 nt, Human
uccuacuuuuagguuuucccaggacaggacag

SEQ ID NO: 502041 - RNA, 20 nt, Human
uccuagaagcccuugguccc

SEQ ID NO: 502042 - RNA, 32 nt, Human
uccuagaagugcugugucccugaggcacaccu

SEQ ID NO: 502043 - RNA, 32 nt, Human
uccuagaauaagaggugagaaucucaugauuu

SEQ ID NO: 502044 - RNA, 32 nt, Human
uccuagacauuagguggguccucugcccucug

SEQ ID NO: 502045 - RNA, 21 nt, Human
uccuagacauugaggggccca

SEQ ID NO: 502046 - RNA, 20 nt, Human
uccuagaccagccagcucca

SEQ ID NO: 502047 - RNA, 18 nt, Human
uccuagacccgugaccug

SEQ ID NO: 502048 - RNA, 32 nt, Human
uccuagacccuuggacucucagaugcagggcc

SEQ ID NO: 502049 - RNA, 17 nt, Human
uccuagacccuuucucc

SEQ ID NO: 502050 - RNA, 21 nt, Human
uccuagacgugguucccucca

SEQ ID NO: 502051 - RNA, 32 nt, Human
uccuagacucaagugauccuccugucuuggcc

SEQ ID NO: 502052 - RNA, 32 nt, Human
uccuagagaagguagucccugaaggaaaagua

SEQ ID NO: 502053 - RNA, 32 nt, Human
uccuagagacaggauuucgccauguugccugg

SEQ ID NO: 502054 - RNA, 32 nt, Human
uccuagagagggcccugagcaccagcuugauc

SEQ ID NO: 502055 - RNA, 32 nt, Human
uccuagagcacacucuucaucucuccaccccc

SEQ ID NO: 502056 - RNA, 32 nt, Human
uccuagagcucaccuccaggacccagagucug

SEQ ID NO: 502057 - RNA, 24 nt, Human
uccuagaggaagguguuauuuuca

SEQ ID NO: 502058 - RNA, 25 nt, Human
uccuagaggaccaccuccugagaga

SEQ ID NO: 502059 - RNA, 32 nt, Human
uccuagaggagccacagcccaggggcagauga

SEQ ID NO: 502060 - RNA, 32 nt, Human
uccuagaggcagagguugaagauggaagaggg

SEQ ID NO: 502061 - RNA, 32 nt, Human
uccuagaggcagcugcagcugcccagccaugg

SEQ ID NO: 502062 - RNA, 32 nt, Human
uccuagaggcugcuuggcccagaagagccagg

SEQ ID NO: 502063 - RNA, 32 nt, Human
uccuagagucccccuaggucucuggcugccca

SEQ ID NO: 502064 - RNA, 22 nt, Human
uccuagauagucgcccacucca

SEQ ID NO: 502065 - RNA, 32 nt, Human
uccuagaugacagucuuugcacuguguccuca

SEQ ID NO: 502066 - RNA, 31 nt, Human
uccuagauggccuugcagauaccaccuuccg

SEQ ID NO: 502067 - RNA, 32 nt, Human
uccuagcaaggagcuuucugaagaccucccug

SEQ ID NO: 502068 - RNA, 32 nt, Human
uccuagcagccuggugagcucacuccuucccc

SEQ ID NO: 502069 - RNA, 32 nt, Human
uccuagcaggagagaggcucuggggcagcccc

SEQ ID NO: 502070 - RNA, 32 nt, Human
uccuagcagguccugaauccagagacaaaaau

SEQ ID NO: 502071 - RNA, 32 nt, Human
uccuagcagguguaucaccuaaggucaggagu

SEQ ID NO: 502072 - RNA, 32 nt, Human
uccuagccacaaaaucacugcuuagguugcaa

SEQ ID NO: 502073 - RNA, 32 nt, Human
uccuagccacuagaggcugaggugggaggauc

SEQ ID NO: 502074 - RNA, 32 nt, Human
uccuagccagcugcugaaacaugugaacucca

SEQ ID NO: 502075 - RNA, 32 nt, Human
uccuagccaggccaaguauaugagaaagguaa

SEQ ID NO: 502076 - RNA, 32 nt, Human
uccuagccauggucagacuguacaaaacgguu

SEQ ID NO: 502077 - RNA, 32 nt, Human
uccuagcccgagaagccgaaucucccuaaucc

SEQ ID NO: 502078 - RNA, 32 nt, Human
uccuagcccuucaguaagaccuugccaggaga

SEQ ID NO: 502079 - RNA, 32 nt, Human
uccuagccucaagcagucuucuugccucagcc

SEQ ID NO: 502080 - RNA, 32 nt, Human
uccuagccucaagugauccuccugucucaacc

SEQ ID NO: 502081 - RNA, 32 nt, Human
uccuagccugaagugauccuccugccucggcc

SEQ ID NO: 502082 - RNA, 32 nt, Human
uccuagccugugaauuucugucuuccauuguu

SEQ ID NO: 502083 - RNA, 32 nt, Human
uccuagccuuccauugcuaugcacugaaugag

SEQ ID NO: 502084 - RNA, 32 nt, Human
uccuagccuuugcuuuucuuuguauuuuuccu

SEQ ID NO: 502085 - RNA, 32 nt, Human
uccuagcuccacccuccccgugcugcuguguu

SEQ ID NO: 502086 - RNA, 21 nt, Human
uccuagcuccuaacuaugaga

SEQ ID NO: 502087 - RNA, 32 nt, Human
uccuagcucugcucucagagcuaggcacaugg

SEQ ID NO: 502088 - RNA, 32 nt, Human
uccuagcugcuccagucucagccugggcagcu

SEQ ID NO: 502089 - RNA, 32 nt, Human
uccuagcugugucugggaacauugguuuaugu

SEQ ID NO: 502090 - RNA, 32 nt, Human
uccuagcuuaucucccugcuucauaucucucc

SEQ ID NO: 502091 - RNA, 32 nt, Human
uccuagcuuccuagggaagacaguguacaguu

SEQ ID NO: 502092 - RNA, 22 nt, Human
uccuagcuucucucuccuuccc

SEQ ID NO: 502093 - RNA, 32 nt, Human
uccuaggaaccagcuucuacuuugacauaaaa

SEQ ID NO: 502094 - RNA, 32 nt, Human
uccuaggaagcauaugaagugcaucaggaacc

SEQ ID NO: 502095 - RNA, 32 nt, Human
uccuaggacagagagccauaaguagcccuuug

SEQ ID NO: 502096 - RNA, 32 nt, Human
uccuaggagacagacuuugauagugauuuaga

SEQ ID NO: 502097 - RNA, 32 nt, Human
uccuaggagaggguagaugugagccagccuga

SEQ ID NO: 502098 - RNA, 32 nt, Human
uccuaggauggccacggagagccacucgcucc

SEQ ID NO: 502099 - RNA, 24 nt, Human
uccuaggauuacaggugugcacca

SEQ ID NO: 502100 - RNA, 24 nt, Human
uccuaggauuauaggcaugagcca

SEQ ID NO: 502101 - RNA, 32 nt, Human
uccuaggcagagugccugugcgugagggcgcc

SEQ ID NO: 502102 - RNA, 32 nt, Human
uccuaggcagucucacgagcaagugugcuguu

SEQ ID NO: 502103 - RNA, 32 nt, Human
uccuaggcauucacucggagccuggaugaugg

SEQ ID NO: 502104 - RNA, 32 nt, Human
uccuaggcgugggggcagauggguggacagcu

SEQ ID NO: 502105 - RNA, 32 nt, Human
uccuaggcucaagagauccuccugccucagcc

SEQ ID NO: 502106 - RNA, 32 nt, Human
uccuaggcucaagagauucuccugccucagcc

SEQ ID NO: 502107 - RNA, 32 nt, Human
uccuaggcucaagcaauccucccaucuuagcc

SEQ ID NO: 502108 - RNA, 32 nt, Human
uccuaggcucaagcaguccucuugccucagcc

SEQ ID NO: 502109 - RNA, 32 nt, Human
uccuaggcucaagccauccucccaccucagcc

SEQ ID NO: 502110 - RNA, 32 nt, Human
uccuaggcucaagccauuuucccaccucagcc

SEQ ID NO: 502111 - RNA, 32 nt, Human
uccuaggcucaagcgauccuaucaccucaguc

SEQ ID NO: 502112 - RNA, 32 nt, Human
uccuaggcucaagcgauccucccaccucaacc

SEQ ID NO: 502113 - RNA, 32 nt, Human
uccuaggcucaagugauccucccaccucagcc

SEQ ID NO: 502114 - RNA, 32 nt, Human
uccuaggcucaagugauccuccugcuucagca

SEQ ID NO: 502115 - RNA, 32 nt, Human
uccuaggcucaagugauccuccugcuucagcc

SEQ ID NO: 502116 - RNA, 32 nt, Human
uccuaggcucagauaggagaguuuaaaagaau

SEQ ID NO: 502117 - RNA, 32 nt, Human
uccuaggcucaggugauccuccugccucaggc

SEQ ID NO: 502118 - RNA, 32 nt, Human
uccuaggcuccagugauccucucaccucagcu

SEQ ID NO: 502119 - RNA, 32 nt, Human
uccuaggcuggucucgaacuccugggcuuaaa

SEQ ID NO: 502120 - RNA, 32 nt, Human
uccuaggcuuaagugauccucccgccuuagcc

SEQ ID NO: 502121 - RNA, 32 nt, Human
uccuagggcacuucuaguuucacguaaauauu

SEQ ID NO: 502122 - RNA, 32 nt, Human
uccuagggccuggguacagggcaugaguugga

SEQ ID NO: 502123 - RNA, 32 nt, Human
uccuagggcucggacuccccagccuuuccgca

SEQ ID NO: 502124 - RNA, 32 nt, Human
uccuagggcuguaguuauuugggaguuucaua

SEQ ID NO: 502125 - RNA, 32 nt, Human
uccuaggggaacccaauauucagguuuuccug

SEQ ID NO: 502126 - RNA, 32 nt, Human
uccuagggggauguuacuuucagugucaccgg

SEQ ID NO: 502127 - RNA, 22 nt, Human
uccuagggggucuguauuguca

SEQ ID NO: 502128 - RNA, 32 nt, Human
uccuagggguagcagagggaagggaggauuuu

SEQ ID NO: 502129 - RNA, 32 nt, Human
uccuaggggugcugcauuuugcuuccggggaa

SEQ ID NO: 502130 - RNA, 32 nt, Human
uccuagggguuauuucugugccagacacauuc

SEQ ID NO: 502131 - RNA, 32 nt, Human
uccuaggucacacuuuucagaaaaagaaucug

SEQ ID NO: 502132 - RNA, 32 nt, Human
uccuaggugaagcuguuuggagggguaagaga

SEQ ID NO: 502133 - RNA, 32 nt, Human
uccuaggugcugcagugaacagaagagacaaa

SEQ ID NO: 502134 - RNA, 32 nt, Human
uccuagguucaagugauucuacucucucagcc

SEQ ID NO: 502135 - RNA, 32 nt, Human
uccuagguucaagugauucuccuaccuccuga

SEQ ID NO: 502136 - RNA, 32 nt, Human
uccuagguucaagugauucuccugccucagcc

SEQ ID NO: 502137 - RNA, 32 nt, Human
uccuaguagaggcugaaggccacaggggaggc

SEQ ID NO: 502138 - RNA, 32 nt, Human
uccuaguagauaagugaagagcagggaaagag

SEQ ID NO: 502139 - RNA, 32 nt, Human
uccuagucacacacaaacacaggagcucacac

SEQ ID NO: 502140 - RNA, 32 nt, Human
uccuaguccaaacagcugcagcuuugggcauu

SEQ ID NO: 502141 - RNA, 32 nt, Human
uccuagucccucccuucccucuccuugagugc

SEQ ID NO: 502142 - RNA, 32 nt, Human
uccuaguccggccagaggaggccguuuacgag

SEQ ID NO: 502143 - RNA, 20 nt, Human
uccuaguccugggacugcaa

SEQ ID NO: 502144 - RNA, 32 nt, Human
uccuaguccuuuuaaugcuguguguucuguua

SEQ ID NO: 502145 - RNA, 27 nt, Human
uccuagugagauucucugcucuugaua

SEQ ID NO: 502146 - RNA, 32 nt, Human
uccuagugcaaccguccccuacccagggacug

SEQ ID NO: 502147 - RNA, 32 nt, Human
uccuagugguggaauuugaacacuucucacuu

SEQ ID NO: 502148 - RNA, 32 nt, Human
uccuaguguuauguuccagucugcccaccugu

SEQ ID NO: 502149 - RNA, 20 nt, Human
uccuaguguuggcacuuccu

SEQ ID NO: 502150 - RNA, 23 nt, Human
uccuaguguuugccuucuuggua

SEQ ID NO: 502151 - RNA, 32 nt, Human
uccuaguuaucagugucuuacugugaagaaaa

SEQ ID NO: 502152 - RNA, 32 nt, Human
uccuaguucaccuccucagcugugcugauguc

SEQ ID NO: 502153 - RNA, 32 nt, Human
uccuaguucaucccuucucuuccaggcagccg

SEQ ID NO: 502154 - RNA, 32 nt, Human
uccuaguucugccccaggcucuucuuuccgcu

SEQ ID NO: 502155 - RNA, 32 nt, Human
uccuaguugccuggggaaacccuggaaugggc

SEQ ID NO: 502156 - RNA, 32 nt, Human
uccuauaauugaggcauaccacccucaaaaac

SEQ ID NO: 502157 - RNA, 32 nt, Human
uccuauacagccugcagaaccgugagccagcu

SEQ ID NO: 502158 - RNA, 32 nt, Human
uccuauagaaugcauaccuuccucccucuaga

SEQ ID NO: 502159 - RNA, 32 nt, Human
uccuauagaugucucagauguucaguuuuccu

SEQ ID NO: 502160 - RNA, 24 nt, Human
uccuauaucauuccauuuauugga

SEQ ID NO: 502161 - RNA, 32 nt, Human
uccuauaugaucuuccaaacagucccaugugg

SEQ ID NO: 502162 - RNA, 32 nt, Human
uccuauauuuuugucuucuuccuuuccccucu

SEQ ID NO: 502163 - RNA, 32 nt, Human
uccuaucaacacuaaauggugugacuuggccu

SEQ ID NO: 502164 - RNA, 21 nt, Human
uccuaucaguucaaaacaaca

SEQ ID NO: 502165 - RNA, 32 nt, Human
uccuaucaucaucuagcaccuguccgguuccc

SEQ ID NO: 502166 - RNA, 32 nt, Human
uccuaucauccucugcucagcagugaccuccc

SEQ ID NO: 502167 - RNA, 32 nt, Human
uccuaucaugcuucaugugucauuccaagguu

SEQ ID NO: 502168 - RNA, 32 nt, Human
uccuauccaccugcauccacacauggccugca

SEQ ID NO: 502169 - RNA, 32 nt, Human
uccuauccauuucaaagcagaagcuguggaau

SEQ ID NO: 502170 - RNA, 32 nt, Human
uccuaucccccacuccaaaccaggacgaccug

SEQ ID NO: 502171 - RNA, 32 nt, Human
uccuaucccccagcugcaguaggggaguggcc

SEQ ID NO: 502172 - RNA, 32 nt, Human
uccuauccugggcugcucaauguucccaggcc

SEQ ID NO: 502173 - RNA, 32 nt, Human
uccuaucuauggacuucauuuuagucaccaug

SEQ ID NO: 502174 - RNA, 32 nt, Human
uccuaucucauagcucaugcuacuacauaagc

SEQ ID NO: 502175 - RNA, 23 nt, Human
uccuaucucucauucucaccuca

SEQ ID NO: 502176 - RNA, 32 nt, Human
uccuaucugauucgggccccacccuuaugacu

SEQ ID NO: 502177 - RNA, 32 nt, Human
uccuaucuggauggguauugaucauguccaac

SEQ ID NO: 502178 - RNA, 32 nt, Human
uccuaucuguggugacaugugcaccaaaaccu

SEQ ID NO: 502179 - RNA, 32 nt, Human
uccuaucuucauccacaaucucuacccuuuau

SEQ ID NO: 502180 - RNA, 32 nt, Human
uccuaugaacaacguaccaacacuuucugauu

SEQ ID NO: 502181 - RNA, 32 nt, Human
uccuaugacaucuuuguuucugcugcaucuuu

SEQ ID NO: 502182 - RNA, 32 nt, Human
uccuaugacuccuguuuucucucucacagaua

SEQ ID NO: 502183 - RNA, 32 nt, Human
uccuaugaucauccucuagauaccagauagag

SEQ ID NO: 502184 - RNA, 32 nt, Human
uccuaugauguauacugccacuaaccuuccaa

SEQ ID NO: 502185 - RNA, 32 nt, Human
uccuaugccaguuccacaugcuggauuauggu

SEQ ID NO: 502186 - RNA, 29 nt, Human
uccuaugcucaugagccuuuuguguuuuc

SEQ ID NO: 502187 - RNA, 32 nt, Human
uccuaugcucugggugaauagagccugauggu

SEQ ID NO: 502188 - RNA, 32 nt, Human
uccuaugcugguggcagagcaauugacucuga

SEQ ID NO: 502189 - RNA, 32 nt, Human
uccuauggagccagcggcaaggcuccagagga

SEQ ID NO: 502190 - RNA, 32 nt, Human
uccuaugguccaugcagaauuuucuguuuagu

SEQ ID NO: 502191 - RNA, 32 nt, Human
uccuauggugaccucucagaugccagcgaccu

SEQ ID NO: 502192 - RNA, 32 nt, Human
uccuaugugucacauucaucacagguuucaua

SEQ ID NO: 502193 - RNA, 31 nt, Human
uccuauguguuucuuuggccuguguaucagu

SEQ ID NO: 502194 - RNA, 22 nt, Human
uccuauuaccagcuucuaaaug

SEQ ID NO: 502195 - RNA, 32 nt, Human
uccuauuacuuucugcccuggggacguccugu

SEQ ID NO: 502196 - RNA, 32 nt, Human
uccuauuagccccuccuuccaggagcuagaac

SEQ ID NO: 502197 - RNA, 26 nt, Human
uccuauucagaacuaugugcuuguca

SEQ ID NO: 502198 - RNA, 32 nt, Human
uccuauucagcauccuggaacuuaugugggau

SEQ ID NO: 502199 - RNA, 32 nt, Human
uccuauuccaauaugucaucuuuacucagaau

SEQ ID NO: 502200 - RNA, 32 nt, Human
uccuauuccauggcuucaggugccauccucuc

SEQ ID NO: 502201 - RNA, 23 nt, Human
uccuauucucccuuucuccccuc

SEQ ID NO: 502202 - RNA, 32 nt, Human
uccuauucucuagcccuucuauucucccaagg

SEQ ID NO: 502203 - RNA, 32 nt, Human
uccuauuuauucagcaccgcacuacccaggaa

SEQ ID NO: 502204 - RNA, 32 nt, Human
uccuauuuucgcugagcuuuuccucuuauuuc

SEQ ID NO: 502205 - RNA, 32 nt, Human
uccuauuuucuuuuuaacuuuuuaaagacugc

SEQ ID NO: 502206 - RNA, 32 nt, Human
uccucaaaaacgaccaccuccaggacucagug

SEQ ID NO: 502207 - RNA, 23 nt, Human
uccucaaaaacuuguguuuguua

SEQ ID NO: 502208 - RNA, 32 nt, Human
uccucaaaacggccuauccacgcccagcuuuu

SEQ ID NO: 502209 - RNA, 32 nt, Human
uccucaaaacucagaacguggccgggcguggu

SEQ ID NO: 502210 - RNA, 32 nt, Human
uccucaaaagaaugucagaguaaauguauuag

SEQ ID NO: 502211 - RNA, 21 nt, Human
uccucaaaagcagcagcaagu

SEQ ID NO: 502212 - RNA, 32 nt, Human
uccucaaaaggagacucuuuugcucaacauua

SEQ ID NO: 502213 - RNA, 32 nt, Human
uccucaaacaggcugaggagguuccgaggcuc

SEQ ID NO: 502214 - RNA, 20 nt, Human
uccucaaaccuuguguagca

SEQ ID NO: 502215 - RNA, 20 nt, Human
uccucaaagccaaggaagcc

SEQ ID NO: 502216 - RNA, 32 nt, Human
uccucaaagcuaaucugaauucuguaggcuaa

SEQ ID NO: 502217 - RNA, 32 nt, Human
uccucaaauagagcccugggggcagagcuccu

SEQ ID NO: 502218 - RNA, 32 nt, Human
uccucaaaugucccccauugaggacaacagcc

SEQ ID NO: 502219 - RNA, 32 nt, Human
uccucaacagguuggaugaugagggagaucuu

SEQ ID NO: 502220 - RNA, 21 nt, Human
uccucaacauccuggccuuug

SEQ ID NO: 502221 - RNA, 32 nt, Human
uccucaacaugguccuugucccaagcccaggg

SEQ ID NO: 502222 - RNA, 32 nt, Human
uccucaaccacaacuucugaccucccagggug

SEQ ID NO: 502223 - RNA, 32 nt, Human
uccucaaccuccaucccugcccucucugggcu

SEQ ID NO: 502224 - RNA, 21 nt, Human
uccucaaccuccuccuuuccc

SEQ ID NO: 502225 - RNA, 32 nt, Human
uccucaacucacugcaaccuccgcucccgguu

SEQ ID NO: 502226 - RNA, 22 nt, Human
uccucaacucccagccaucugu

SEQ ID NO: 502227 - RNA, 26 nt, Human
uccucaacugggugacaagggugagg

SEQ ID NO: 502228 - RNA, 32 nt, Human
uccucaacuguacaaugaacuauucucaugaa

SEQ ID NO: 502229 - RNA, 32 nt, Human
uccucaacuuccagacaacguguccucaggca

SEQ ID NO: 502230 - RNA, 32 nt, Human
uccucaacuuccugggcucaagugauccuucc

SEQ ID NO: 502231 - RNA, 24 nt, Human
uccucaagaaauaaaaggaagcca

SEQ ID NO: 502232 - RNA, 22 nt, Human
uccucaagaaaucuuagaacca

SEQ ID NO: 502233 - RNA, 21 nt, Human
uccucaagaggacacaacaag

SEQ ID NO: 502234 - RNA, 32 nt, Human
uccucaagaggcugaagaaggaagaggaggaa

SEQ ID NO: 502235 - RNA, 24 nt, Human
uccucaagcagaccuacagcaagu

SEQ ID NO: 502236 - RNA, 23 nt, Human
uccucaagcagagugcggcacgu

SEQ ID NO: 502237 - RNA, 32 nt, Human
uccucaagccuggucugcuccuucuuucacgu

SEQ ID NO: 502238 - RNA, 32 nt, Human
uccucaaggaggugaaggucaugcgaugccug

SEQ ID NO: 502239 - RNA, 24 nt, Human
uccucaaggauccagaacuagaaa

SEQ ID NO: 502240 - RNA, 24 nt, Human
uccucaaggaucuagaaccagaaa

SEQ ID NO: 502241 - RNA, 32 nt, Human
uccucaagggagcuggugggaaggagggaggg

SEQ ID NO: 502242 - RNA, 32 nt, Human
uccucaaguaauccuccugccuuagcauucca

SEQ ID NO: 502243 - RNA, 32 nt, Human
uccucaaguaccaccugcugcuccaggaaauu

SEQ ID NO: 502244 - RNA, 32 nt, Human
uccucaagugaggggaggaggaagcagauaga

SEQ ID NO: 502245 - RNA, 31 nt, Human
uccucaaguuaguuauguuguaggaguguac

SEQ ID NO: 502246 - RNA, 32 nt, Human
uccucacaacacccucuucacccuccacgcca

SEQ ID NO: 502247 - RNA, 23 nt, Human
uccucacaacagcccccugaaag

SEQ ID NO: 502248 - RNA, 32 nt, Human
uccucacaagucucccacaggccauguaaagg

SEQ ID NO: 502249 - RNA, 32 nt, Human
uccucacacacuucuagauucuucccagcuca

SEQ ID NO: 502250 - RNA, 32 nt, Human
uccucacagacugccaagucccagagcccacc

SEQ ID NO: 502251 - RNA, 32 nt, Human
uccucacagcgccaucaccaauggccaaaacu

SEQ ID NO: 502252 - RNA, 32 nt, Human
uccucacaggcuuccagguuaggcacugugaa

SEQ ID NO: 502253 - RNA, 32 nt, Human
uccucacagugaacacucaguggcccauggca

SEQ ID NO: 502254 - RNA, 32 nt, Human
uccucacauggcagagagaaagagagagaaag

SEQ ID NO: 502255 - RNA, 32 nt, Human
uccucacaugugacaaagggccagcagucuac

SEQ ID NO: 502256 - RNA, 32 nt, Human
uccucacauuccagcacuuucccaccugacuc

SEQ ID NO: 502257 - RNA, 32 nt, Human
uccucaccaagcucauuacaucugccagggcc

SEQ ID NO: 502258 - RNA, 32 nt, Human
uccucaccacaguccacagaagccacaaacag

SEQ ID NO: 502259 - RNA, 21 nt, Human
uccucaccaccuucagacccu

SEQ ID NO: 502260 - RNA, 32 nt, Human
uccucaccacuuucuaugccagucucccauuu

SEQ ID NO: 502261 - RNA, 32 nt, Human
uccucaccagcaguugcugauuuugaaaacag

SEQ ID NO: 502262 - RNA, 32 nt, Human
uccucaccagcucuccagccaggacgaucaca

SEQ ID NO: 502263 - RNA, 32 nt, Human
uccucaccagugugcugaugaucccccaugcc

SEQ ID NO: 502264 - RNA, 32 nt, Human
uccucaccaugcccugcuaucuccagcugcug

SEQ ID NO: 502265 - RNA, 32 nt, Human
uccucaccauggccugggccaggugugacaga

SEQ ID NO: 502266 - RNA, 32 nt, Human
uccucacccaaaucucaucuugaauucuacuc

SEQ ID NO: 502267 - RNA, 32 nt, Human
uccucacccaggcuggaaugcaguggugugaa

SEQ ID NO: 502268 - RNA, 32 nt, Human
uccucacccaugggacuguagugcaauuaaac

SEQ ID NO: 502269 - RNA, 32 nt, Human
uccucaccccagcccuccaccucucggggacu

SEQ ID NO: 502270 - RNA, 32 nt, Human
uccucacccggcaccacaucuguguuuuccca

SEQ ID NO: 502271 - RNA, 32 nt, Human
uccucacccucggggagcaacauggcagauaa

SEQ ID NO: 502272 - RNA, 32 nt, Human
uccucacccuggcuccauccagucucuugccu

SEQ ID NO: 502273 - RNA, 32 nt, Human
uccucacccuugcugcuccugaugcaaaacca

SEQ ID NO: 502274 - RNA, 32 nt, Human
uccucacccuugcuuaggaguaaaacaauaua

SEQ ID NO: 502275 - RNA, 32 nt, Human
uccucaccgcagauguuucugccucuuaagga

SEQ ID NO: 502276 - RNA, 32 nt, Human
uccucaccgcccgccgugcaagagucgagccg

SEQ ID NO: 502277 - RNA, 31 nt, Human
uccucaccggcgcaggcuaggagggggcggc

SEQ ID NO: 502278 - RNA, 32 nt, Human
uccucaccgugaugcauucugccuuccugucu

SEQ ID NO: 502279 - RNA, 32 nt, Human
uccucaccuaauuccuccaucacaaccauuaa

SEQ ID NO: 502280 - RNA, 32 nt, Human
uccucaccucaagugauccacccgccucggcc

SEQ ID NO: 502281 - RNA, 21 nt, Human
uccucaccucaggugauccac

SEQ ID NO: 502282 - RNA, 32 nt, Human
uccucaccucgagugauccgccugccucggcc

SEQ ID NO: 502283 - RNA, 32 nt, Human
uccucaccuucucuccccuuuccaugccgucc

SEQ ID NO: 502284 - RNA, 32 nt, Human
uccucaccuuuccuucucaccuguccugcuuu

SEQ ID NO: 502285 - RNA, 32 nt, Human
uccucacgaauggcuccaaccuccugggugcg

SEQ ID NO: 502286 - RNA, 32 nt, Human
uccucacggggguggagggagccggagccugc

SEQ ID NO: 502287 - RNA, 32 nt, Human
uccucacgugggccaggccuucacacacccaa

SEQ ID NO: 502288 - RNA, 18 nt, Human
uccucacuagaggggcag

SEQ ID NO: 502289 - RNA, 32 nt, Human
uccucacucacccuccagccaugcuggcuucc

SEQ ID NO: 502290 - RNA, 32 nt, Human
uccucacucacugcaacuggaucuucagccuc

SEQ ID NO: 502291 - RNA, 32 nt, Human
uccucacucagcccugccgcugcccagggccc

SEQ ID NO: 502292 - RNA, 32 nt, Human
uccucacucaggacacacaugaauguucccca

SEQ ID NO: 502293 - RNA, 32 nt, Human
uccucacuccugcccaccccucaggcuguucc

SEQ ID NO: 502294 - RNA, 32 nt, Human
uccucacuccugccucuccacgcugccccguc

SEQ ID NO: 502295 - RNA, 22 nt, Human
uccucacucgcucacccagaca

SEQ ID NO: 502296 - RNA, 32 nt, Human
uccucacugcauccccaauccccuucccagaa

SEQ ID NO: 502297 - RNA, 32 nt, Human
uccucacuggauggugguggcuccuugcaggg

SEQ ID NO: 502298 - RNA, 32 nt, Human
uccucacuguacaggagaauguggggaucuuu

SEQ ID NO: 502299 - RNA, 32 nt, Human
uccucacuuccucuccaggagggagcgagagu

SEQ ID NO: 502300 - RNA, 32 nt, Human
uccucagaacagauggcucaggguaggguaga

SEQ ID NO: 502301 - RNA, 23 nt, Human
uccucagaaccuccucucuuccc

SEQ ID NO: 502302 - RNA, 21 nt, Human
uccucagaaggggaaaaggga

SEQ ID NO: 502303 - RNA, 32 nt, Human
uccucagacaaucauggcacauggacaucaga

SEQ ID NO: 502304 - RNA, 17 nt, Human
uccucagagaagcuguu

SEQ ID NO: 502305 - RNA, 32 nt, Human
uccucagagagacccuaccagaugcggaugga

SEQ ID NO: 502306 - RNA, 32 nt, Human
uccucagagaggcugaguguccccuccaggca

SEQ ID NO: 502307 - RNA, 32 nt, Human
uccucagagcaggggccagaugauuuuccucc

SEQ ID NO: 502308 - RNA, 32 nt, Human
uccucagagccagcuucuccucucaaugucug

SEQ ID NO: 502309 - RNA, 32 nt, Human
uccucagaggaggaggaggaggaggcagcucc

SEQ ID NO: 502310 - RNA, 32 nt, Human
uccucagaggaugaagccaccaggaauuucag

SEQ ID NO: 502311 - RNA, 32 nt, Human
uccucagaggcagagaaugacuaaguacgggg

SEQ ID NO: 502312 - RNA, 32 nt, Human
uccucagaggccugugcccaucgcaggccugg

SEQ ID NO: 502313 - RNA, 32 nt, Human
uccucagaucccccuucucuccugcuuccucc

SEQ ID NO: 502314 - RNA, 23 nt, Human
uccucagaucgccuugcggccug

SEQ ID NO: 502315 - RNA, 32 nt, Human
uccucagaucuauuuucccaguguccauuucu

SEQ ID NO: 502316 - RNA, 32 nt, Human
uccucagaugaagaggaugacagugacuuaga

SEQ ID NO: 502317 - RNA, 32 nt, Human
uccucagauuuucucacagacccuucccaauu

SEQ ID NO: 502318 - RNA, 32 nt, Human
uccucagcaacaaaaugcaucuccaacugcau

SEQ ID NO: 502319 - RNA, 22 nt, Human
uccucagcacccgugucagugg

SEQ ID NO: 502320 - RNA, 23 nt, Human
uccucagcaccuggcaucggagg

SEQ ID NO: 502321 - RNA, 19 nt, Human
uccucagcagcccaaggac

SEQ ID NO: 502322 - RNA, 32 nt, Human
uccucagcagccgccacagcagcauagaguac

SEQ ID NO: 502323 - RNA, 23 nt, Human
uccucagcaggaaaucaaugugg

SEQ ID NO: 502324 - RNA, 32 nt, Human
uccucagcaggcgccucaccagccuccacacc

SEQ ID NO: 502325 - RNA, 32 nt, Human
uccucagcaucgcaaggccucuccuggcucug

SEQ ID NO: 502326 - RNA, 21 nt, Human
uccucagcauggccucagugg

SEQ ID NO: 502327 - RNA, 23 nt, Human
uccucagcauuccaggucggcgg

SEQ ID NO: 502328 - RNA, 32 nt, Human
uccucagccacuuugguguuuucucaaggauu

SEQ ID NO: 502329 - RNA, 22 nt, Human
uccucagccccauggcuggggc

SEQ ID NO: 502330 - RNA, 32 nt, Human
uccucagcccuggaugaaguggagaagaccua

SEQ ID NO: 502331 - RNA, 32 nt, Human
uccucagccucccagcauucaaucguagccuu

SEQ ID NO: 502332 - RNA, 32 nt, Human
uccucagccucgaaaacugggcucuggaaugc

SEQ ID NO: 502333 - RNA, 32 nt, Human
uccucagccucuggcccucuuggcucagauuc

SEQ ID NO: 502334 - RNA, 32 nt, Human
uccucagccugauccuggaagagacucggggc

SEQ ID NO: 502335 - RNA, 22 nt, Human
uccucagccugggcucccagga

SEQ ID NO: 502336 - RNA, 32 nt, Human
uccucagccugggguuugaccacccaccugac

SEQ ID NO: 502337 - RNA, 20 nt, Human
uccucagcgacccacuggug

SEQ ID NO: 502338 - RNA, 24 nt, Human
uccucagcggcgggaagcuggcgg

SEQ ID NO: 502339 - RNA, 32 nt, Human
uccucagcgggugggaaccucggggcccaggg

SEQ ID NO: 502340 - RNA, 32 nt, Human
uccucagcuaccaaacugggacucacagcuuu

SEQ ID NO: 502341 - RNA, 32 nt, Human
uccucagcuccccuccuugcuuccucgagugu

SEQ ID NO: 502342 - RNA, 32 nt, Human
uccucagcugaggaccuguccauggcucccug

SEQ ID NO: 502343 - RNA, 32 nt, Human
uccucagcuguggaguccagcagucacucugu

SEQ ID NO: 502344 - RNA, 32 nt, Human
uccucagcuuauugaucucugugguaaccacu

SEQ ID NO: 502345 - RNA, 32 nt, Human
uccucagcuucccugagggcugccuagaaucu

SEQ ID NO: 502346 - RNA, 32 nt, Human
uccucagcuucgagccgaggugcagugagcug

SEQ ID NO: 502347 - RNA, 32 nt, Human
uccucagcuugguucccagccugcugauugac

SEQ ID NO: 502348 - RNA, 32 nt, Human
uccucaggaaacugcugccuccccuaagaauc

SEQ ID NO: 502349 - RNA, 32 nt, Human
uccucaggaaguggagaucuagccaggucaga

SEQ ID NO: 502350 - RNA, 32 nt, Human
uccucaggaguccacagacuggaguggaccug

SEQ ID NO: 502351 - RNA, 18 nt, Human
uccucaggcacccugggc

SEQ ID NO: 502352 - RNA, 32 nt, Human
uccucaggccggccuuucuuccggcgacaccc

SEQ ID NO: 502353 - RNA, 21 nt, Human
uccucaggcgguggcuggagg

SEQ ID NO: 502354 - RNA, 32 nt, Human
uccucagggcuggguaccugcucuccgagucu

SEQ ID NO: 502355 - RNA, 32 nt, Human
uccucagggggauuuguuccuguccuggggau

SEQ ID NO: 502356 - RNA, 32 nt, Human
uccucagggucugagcacaucuggaagugagg

SEQ ID NO: 502357 - RNA, 32 nt, Human
uccucagggucugucucacucucaggacuauu

SEQ ID NO: 502358 - RNA, 32 nt, Human
uccucagggugaggacgggaucuguggaggug

SEQ ID NO: 502359 - RNA, 32 nt, Human
uccucagggugagggcccugaggaagaacuga

SEQ ID NO: 502360 - RNA, 32 nt, Human
uccucaggguucccacugaggggucccuucag

SEQ ID NO: 502361 - RNA, 32 nt, Human
uccucaggguucuccucuucucucacaggcgg

SEQ ID NO: 502362 - RNA, 32 nt, Human
uccucagguagauuucuuccacugauaacuug

SEQ ID NO: 502363 - RNA, 32 nt, Human
uccucagguggaggcaguagcccaggaccagu

SEQ ID NO: 502364 - RNA, 18 nt, Human
uccucagucaaguucaga

SEQ ID NO: 502365 - RNA, 32 nt, Human
uccucaguccacugcugaggacacucaguguc

SEQ ID NO: 502366 - RNA, 32 nt, Human
uccucagucucuugucucaccuugcgcaucuc

SEQ ID NO: 502367 - RNA, 22 nt, Human
uccucagugaaaauaaaagcca

SEQ ID NO: 502368 - RNA, 32 nt, Human
uccucagugaaugacguugcagggucuucaug

SEQ ID NO: 502369 - RNA, 32 nt, Human
uccucagugagcucaugagguuuucauuuuua

SEQ ID NO: 502370 - RNA, 32 nt, Human
uccucagugagcugguguauaauccaagacag

SEQ ID NO: 502371 - RNA, 32 nt, Human
uccucagugagcuuugauaugguccaaaaaca

SEQ ID NO: 502372 - RNA, 32 nt, Human
uccucagugcagcucugccagcaucaaggcuu

SEQ ID NO: 502373 - RNA, 32 nt, Human
uccucagugcaggaguuggggacaggcugggg

SEQ ID NO: 502374 - RNA, 32 nt, Human
uccucaguggugccugcaaccccugguucacc

SEQ ID NO: 502375 - RNA, 32 nt, Human
uccucagugugugguuccugcguccuucccca

SEQ ID NO: 502376 - RNA, 32 nt, Human
uccucaguguuguagguugagcgaaugcuacc

SEQ ID NO: 502377 - RNA, 32 nt, Human
uccucaguucaucaggacuuuucucaggacaa

SEQ ID NO: 502378 - RNA, 32 nt, Human
uccucaguucccagcugggauugcuaugcacu

SEQ ID NO: 502379 - RNA, 19 nt, Human
uccucaguuucucaugggu

SEQ ID NO: 502380 - RNA, 32 nt, Human
uccucauaagauaaggagaggccaggccuggu

SEQ ID NO: 502381 - RNA, 32 nt, Human
uccuuagccuccauucagccucaggucuuuug

SEQ ID NO: 502382 - RNA, 32 nt, Human
uccuuagccugcacuccaaccuggcaauuuug

SEQ ID NO: 502383 - RNA, 32 nt, Human
uccuuagcgaggacgaguucuaugaugcgcug

SEQ ID NO: 502384 - RNA, 32 nt, Human
uccuuagcgccugucugcucuccucuaacuag

SEQ ID NO: 502385 - RNA, 32 nt, Human
uccuuagcuugguaugagacagaucggaucca

SEQ ID NO: 502386 - RNA, 32 nt, Human
uccuuaggaagacauuugguuuucaucaugau

SEQ ID NO: 502387 - RNA, 32 nt, Human
uccuuaggaagagauagaaggcacagaagauc

SEQ ID NO: 502388 - RNA, 21 nt, Human
uccuuaggcaaggaaaauggc

SEQ ID NO: 502389 - RNA, 32 nt, Human
uccuuaggcccugccucugggcucagacccca

SEQ ID NO: 502390 - RNA, 25 nt, Human
uccuuaggccucccucucccuuccc

SEQ ID NO: 502391 - RNA, 32 nt, Human
uccuuaggcugcagcuugccacuccugggcug

SEQ ID NO: 502392 - RNA, 32 nt, Human
uccuuagggccuggcccugcaguugucucugc

SEQ ID NO: 502393 - RNA, 32 nt, Human
uccuuagggugggagacauauuccagagcugg

SEQ ID NO: 502394 - RNA, 32 nt, Human
uccuuagguucuccccuucccccuggugcccc

SEQ ID NO: 502395 - RNA, 32 nt, Human
uccuuagucauuguuccuuaucagauccucug

SEQ ID NO: 502396 - RNA, 32 nt, Human
uccuuagugagccuggacagagcaaggagagg

SEQ ID NO: 502397 - RNA, 32 nt, Human
uccuuaguggugcuugcagucacaggaagcag

SEQ ID NO: 502398 - RNA, 32 nt, Human
uccuuaguucagagccugcaaaugaucacugu

SEQ ID NO: 502399 - RNA, 31 nt, Human
uccuuaguucaguucuuuacuguuccucgaa

SEQ ID NO: 502400 - RNA, 32 nt, Human
uccuuaguucccgugugaaagcagaggaaccc

SEQ ID NO: 502401 - RNA, 32 nt, Human
uccuuauaaaucugugcagcugccuuauagua

SEQ ID NO: 502402 - RNA, 32 nt, Human
uccuuauaaaugguguuuagucuuccuguugc

SEQ ID NO: 502403 - RNA, 32 nt, Human
uccuuauaagagaagauagggcgggcauggug

SEQ ID NO: 502404 - RNA, 21 nt, Human
uccuuauaccuucucccuucc

SEQ ID NO: 502405 - RNA, 32 nt, Human
uccuuaucagugccaugagggcagaggugcua

SEQ ID NO: 502406 - RNA, 32 nt, Human
uccuuauccccuggcccuggccuugcagcgug

SEQ ID NO: 502407 - RNA, 32 nt, Human
uccuuauccucuuccuccucuuccuccuccug

SEQ ID NO: 502408 - RNA, 32 nt, Human
uccuuaucuccugcccugucuuggcacaacuc

SEQ ID NO: 502409 - RNA, 32 nt, Human
uccuuaucuugccacuucuacagugccuuuug

SEQ ID NO: 502410 - RNA, 32 nt, Human
uccuuaugcucuuuuaaagccaaugauuccca

SEQ ID NO: 502411 - RNA, 21 nt, Human
uccuuaugugaaaguugcugg

SEQ ID NO: 502412 - RNA, 32 nt, Human
uccuuauuaaagcuucccagcguaugaaauuc

SEQ ID NO: 502413 - RNA, 32 nt, Human
uccuuauuaauacaaacacaaaaaucauuaac

SEQ ID NO: 502414 - RNA, 32 nt, Human
uccuuauuagcuuuauuuuacuuuauguuuuu

SEQ ID NO: 502415 - RNA, 32 nt, Human
uccuuauucacacccugcuucuaaccccaacc

SEQ ID NO: 502416 - RNA, 32 nt, Human
uccuuauucuaauccuccuccccuggaauuac

SEQ ID NO: 502417 - RNA, 21 nt, Human
uccuucaaaaacauucacuuu

SEQ ID NO: 502418 - RNA, 32 nt, Human
uccuucaaaaucagaguucacacuggaucaag

SEQ ID NO: 502419 - RNA, 32 nt, Human
uccuucaaagugguucaucuuggucuauuacu

SEQ ID NO: 502420 - RNA, 19 nt, Human
uccuucaacaccugcugca

SEQ ID NO: 502421 - RNA, 32 nt, Human
uccuucaagaaguuccucugauaggaagcuag

SEQ ID NO: 502422 - RNA, 24 nt, Human
uccuucaagccaagucauccccuu

SEQ ID NO: 502423 - RNA, 23 nt, Human
uccuucaagccuucagccccucc

SEQ ID NO: 502424 - RNA, 32 nt, Human
uccuucaaggccagagaguucacaccagauca

SEQ ID NO: 502425 - RNA, 32 nt, Human
uccuucaauauccauucuuuacuuuucacaua

SEQ ID NO: 502426 - RNA, 21 nt, Human
uccuucaauguuucugccuuu

SEQ ID NO: 502427 - RNA, 32 nt, Human
uccuucacagagacucuugccauucccuuugg

SEQ ID NO: 502428 - RNA, 32 nt, Human
uccuucacagccgcugagcccagaggucccgc

SEQ ID NO: 502429 - RNA, 32 nt, Human
uccuucacagcuuugcuuuucugccucuucuc

SEQ ID NO: 502430 - RNA, 32 nt, Human
uccuucacauaguuugauaaaaagaucaauaa

SEQ ID NO: 502431 - RNA, 21 nt, Human
uccuucaccaauagagugcac

SEQ ID NO: 502432 - RNA, 32 nt, Human
uccuucaccagcaaaguggaaaaagaagcguu

SEQ ID NO: 502433 - RNA, 32 nt, Human
uccuucacccaccacccccaucaucaccgauu

SEQ ID NO: 502434 - RNA, 32 nt, Human
uccuucaccccaaaugaggugaccgcuacauu

SEQ ID NO: 502435 - RNA, 21 nt, Human
uccuucaccccaguggccugc

SEQ ID NO: 502436 - RNA, 32 nt, Human
uccuucaccgucucuccagucucggauccgga

SEQ ID NO: 502437 - RNA, 32 nt, Human
uccuucaccuccccacuccagccccggcucag

SEQ ID NO: 502438 - RNA, 32 nt, Human
uccuucaccuccccacuuuggagcucagauuu

SEQ ID NO: 502439 - RNA, 32 nt, Human
uccuucacucaucaguaaaauguaauaauugc

SEQ ID NO: 502440 - RNA, 32 nt, Human
uccuucacucuccucugagucucccucuuucc

SEQ ID NO: 502441 - RNA, 32 nt, Human
uccuucacuucucgccggaguguguggaggag

SEQ ID NO: 502442 - RNA, 22 nt, Human
uccuucagaaaaggaugccucu

SEQ ID NO: 502443 - RNA, 32 nt, Human
uccuucagaacacuucucugugcucaguggga

SEQ ID NO: 502444 - RNA, 25 nt, Human
uccuucagaagaagcuucauucccu

SEQ ID NO: 502445 - RNA, 32 nt, Human
uccuucagagcugugaugagaggaagggaaac

SEQ ID NO: 502446 - RNA, 32 nt, Human
uccuucagaguuucagcugcauccuggugucc

SEQ ID NO: 502447 - RNA, 32 nt, Human
uccuucagccuccgaagggugauggaaaugga

SEQ ID NO: 502448 - RNA, 32 nt, Human
uccuucagccuccuccucccucaucuguuccc

SEQ ID NO: 502449 - RNA, 32 nt, Human
uccuucagcucagggccacagcuuaaacagcu

SEQ ID NO: 502450 - RNA, 23 nt, Human
uccuucaggaagauguccacuca

SEQ ID NO: 502451 - RNA, 23 nt, Human
uccuucaggcuggagugcagugg

SEQ ID NO: 502452 - RNA, 32 nt, Human
uccuucagguugaacaguagcuucagcgguuu

SEQ ID NO: 502453 - RNA, 32 nt, Human
uccuucagucauuagagguggaagggaggggu

SEQ ID NO: 502454 - RNA, 32 nt, Human
uccuucaguugaguuuucuugucuugaacaua

SEQ ID NO: 502455 - RNA, 21 nt, Human
uccuucaguuucauccccuuu

SEQ ID NO: 502456 - RNA, 32 nt, Human
uccuucauaaggauuugggcucuuagcuccuu

SEQ ID NO: 502457 - RNA, 23 nt, Human
uccuucauaccaccugguucuug

SEQ ID NO: 502458 - RNA, 32 nt, Human
uccuucaucagcaaauggagaagauggccaug

SEQ ID NO: 502459 - RNA, 32 nt, Human
uccuucauccccaacgcuccucaccuagcccc

SEQ ID NO: 502460 - RNA, 32 nt, Human
uccuucauccuuuuauccucccuuuuuggaac

SEQ ID NO: 502461 - RNA, 32 nt, Human
uccuucaucuaaccaauucauuucucagcuuc

SEQ ID NO: 502462 - RNA, 32 nt, Human
uccuucaucugccaggcccuggcauuguuuac

SEQ ID NO: 502463 - RNA, 32 nt, Human
uccuucaucuuccaccaugauuaugaggcguc

SEQ ID NO: 502464 - RNA, 32 nt, Human
uccuucaugagacaggauucaguacugagcua

SEQ ID NO: 502465 - RNA, 32 nt, Human
uccuucaugagcuguuuugcacugugagguaa

SEQ ID NO: 502466 - RNA, 25 nt, Human
uccuucaugcccucccucccuuucc

SEQ ID NO: 502467 - RNA, 32 nt, Human
uccuucaugccuguaaucccagcacuuuggga

SEQ ID NO: 502468 - RNA, 32 nt, Human
uccuucauguccagcagacagcaucuacuccu

SEQ ID NO: 502469 - RNA, 32 nt, Human
uccuucauuaggagcaugaaugguugaaugug

SEQ ID NO: 502470 - RNA, 32 nt, Human
uccuucauuccuccucugucucuuugcacuuu

SEQ ID NO: 502471 - RNA, 32 nt, Human
uccuucauugcagccccucuucuuuuaguucu

SEQ ID NO: 502472 - RNA, 32 nt, Human
uccuuccaaaccacaguuauuugcccaaacua

SEQ ID NO: 502473 - RNA, 32 nt, Human
uccuuccaaaggcagcucagaagauuagaacc

SEQ ID NO: 502474 - RNA, 32 nt, Human
uccuuccaaauacccacccugccagcagcccu

SEQ ID NO: 502475 - RNA, 22 nt, Human
uccuuccaaaugagccacaaca

SEQ ID NO: 502476 - RNA, 32 nt, Human
uccuuccaagccccuccucagaugggccugca

SEQ ID NO: 502477 - RNA, 32 nt, Human
uccuuccaagggcaggaccccauauuccuccu

SEQ ID NO: 502478 - RNA, 23 nt, Human
uccuuccaaguggggccccgaca

SEQ ID NO: 502479 - RNA, 32 nt, Human
uccuuccaauauaacuaggcaaaaagaaguga

SEQ ID NO: 502480 - RNA, 21 nt, Human
uccuuccacacagccccugca

SEQ ID NO: 502481 - RNA, 32 nt, Human
uccuuccacaccaucccucugcccuagaccuu

SEQ ID NO: 502482 - RNA, 21 nt, Human
uccuuccacacuuuccugaca

SEQ ID NO: 502483 - RNA, 23 nt, Human
uccuuccacagcgagaacugcac

SEQ ID NO: 502484 - RNA, 32 nt, Human
uccuuccacagcuguucaguuugucggucucu

SEQ ID NO: 502485 - RNA, 32 nt, Human
uccuuccaccccgacccgcacacacacccaca

SEQ ID NO: 502486 - RNA, 25 nt, Human
uccuuccaccucagacuccaaagca

SEQ ID NO: 502487 - RNA, 32 nt, Human
uccuuccaccugaggggagcacucugacuccu

SEQ ID NO: 502488 - RNA, 22 nt, Human
uccuuccacggaaggccccaca

SEQ ID NO: 502489 - RNA, 32 nt, Human
uccuuccacuacuccccagccuagaagaucca

SEQ ID NO: 502490 - RNA, 19 nt, Human
uccuuccacuaucauuccc

SEQ ID NO: 502491 - RNA, 32 nt, Human
uccuuccacucuuuacccagcagauuucauuc

SEQ ID NO: 502492 - RNA, 32 nt, Human
uccuuccacucuuuucuucuucacauaauuug

SEQ ID NO: 502493 - RNA, 32 nt, Human
uccuuccacuggccagcauucuccucuauuag

SEQ ID NO: 502494 - RNA, 32 nt, Human
uccuuccacuuccuugcuggguggccugugau

SEQ ID NO: 502495 - RNA, 32 nt, Human
uccuuccagaggagggcuggagggacaggagg

SEQ ID NO: 502496 - RNA, 32 nt, Human
uccuuccagcuacucaggaggcugaggcagga

SEQ ID NO: 502497 - RNA, 32 nt, Human
uccuuccagcuggucugcucugaguggcuuau

SEQ ID NO: 502498 - RNA, 32 nt, Human
uccuuccaggguuuagggagugcagugauguc

SEQ ID NO: 502499 - RNA, 32 nt, Human
uccuuccaguguccuuagaacauuuuaauuca

SEQ ID NO: 502500 - RNA, 32 nt, Human
uccuuccaucucuucucucucuugcccuaucu

SEQ ID NO: 502501 - RNA, 32 nt, Human
uccuuccaucuguggccaccucccgggcuguc

SEQ ID NO: 502502 - RNA, 32 nt, Human
uccuuccaugaagaaaacugcugcuuucagca

SEQ ID NO: 502503 - RNA, 32 nt, Human
uccuuccaugaagacugaggcaggcggagcug

SEQ ID NO: 502504 - RNA, 32 nt, Human
uccuuccaugguguguugcugacauugucacu

SEQ ID NO: 502505 - RNA, 32 nt, Human
uccuuccauguggucugaauguuggcaccagc

SEQ ID NO: 502506 - RNA, 32 nt, Human
uccuucccaacaccuccuucccaaaccccucc

SEQ ID NO: 502507 - RNA, 32 nt, Human
uccuucccaacaccuccuucccaaaccccucu

SEQ ID NO: 502508 - RNA, 32 nt, Human
uccuucccaagugagucucucugggccuuagg

SEQ ID NO: 502509 - RNA, 32 nt, Human
uccuucccaaucucccugccagggcccacagc

SEQ ID NO: 502510 - RNA, 32 nt, Human
uccuucccaaugaacaccucucugccacccca

SEQ ID NO: 502511 - RNA, 32 nt, Human
uccuucccacccagaggacccugcacugccuu

SEQ ID NO: 502512 - RNA, 32 nt, Human
uccuucccacggucaacucgggaccucccagc

SEQ ID NO: 502513 - RNA, 32 nt, Human
uccuucccacugcacuccccaguggcuggcgu

SEQ ID NO: 502514 - RNA, 32 nt, Human
uccuucccagaacacauaacccaagaaaaagc

SEQ ID NO: 502515 - RNA, 32 nt, Human
uccuucccagcacucccagccugggauaagcc

SEQ ID NO: 502516 - RNA, 32 nt, Human
uccuucccagccgccucugcuccucgggcuca

SEQ ID NO: 502517 - RNA, 32 nt, Human
uccuucccaggcugaugcuggguccucucucu

SEQ ID NO: 502518 - RNA, 32 nt, Human
uccuucccaucuucugugcuuccagagaacaa

SEQ ID NO: 502519 - RNA, 32 nt, Human
uccuuccccaaagagaucucuggccuuuuacc

SEQ ID NO: 502520 - RNA, 32 nt, Human
uccuuccccagccaggacccugugcuggggcu

SEQ ID NO: 502521 - RNA, 32 nt, Human
uccuuccccaggaauuagaccaagaagccugg

SEQ ID NO: 502522 - RNA, 32 nt, Human
uccuucccccuucucaccauaacccccucuca

SEQ ID NO: 502523 - RNA, 32 nt, Human
uccuucccccuugccuucuucucccccuuccc

SEQ ID NO: 502524 - RNA, 32 nt, Human
uccuuccccgagccccugccccggcuccccgc

SEQ ID NO: 502525 - RNA, 32 nt, Human
uccuuccccuacugcugccuaaguggucuucc

SEQ ID NO: 502526 - RNA, 22 nt, Human
uccuuccccucccugaacccca

SEQ ID NO: 502527 - RNA, 32 nt, Human
uccuuccccugaccuagguguagagaccucca

SEQ ID NO: 502528 - RNA, 32 nt, Human
uccuuccccugccuucagcucaaguuugcuga

SEQ ID NO: 502529 - RNA, 32 nt, Human
uccuuccccuggcugauggacuaauugccugu

SEQ ID NO: 502530 - RNA, 21 nt, Human
uccuuccccuucucccugccc

SEQ ID NO: 502531 - RNA, 32 nt, Human
uccuucccgcuuuuccccuucucccuccugcu

SEQ ID NO: 502532 - RNA, 32 nt, Human
uccuucccggagcccgggacaggcugggcgcg

SEQ ID NO: 502533 - RNA, 32 nt, Human
uccuucccguuuccuuucaauuuacuuucuac

SEQ ID NO: 502534 - RNA, 32 nt, Human
uccuucccuccccgcuuucugaaccucucaac

SEQ ID NO: 502535 - RNA, 32 nt, Human
uccuucccuccccucccccucugccuuuugua

SEQ ID NO: 502536 - RNA, 32 nt, Human
uccuucccuccccuccccucccuuccccuccg

SEQ ID NO: 502537 - RNA, 32 nt, Human
uccuucccuccccuucccuuuuucccuucccc

SEQ ID NO: 502538 - RNA, 32 nt, Human
uccuucccucuuuccaacucccuggguccugg

SEQ ID NO: 502539 - RNA, 32 nt, Human
uccuucccugcaggcacgcaccaucuggggca

SEQ ID NO: 502540 - RNA, 32 nt, Human
uccuucccugcucuccacaucccagaucccca

SEQ ID NO: 502541 - RNA, 32 nt, Human
uccuucccuggaucccucccucccaggucugg

SEQ ID NO: 502542 - RNA, 32 nt, Human
uccuucccuguaaauuugacagugccacauac

SEQ ID NO: 502543 - RNA, 32 nt, Human
uccuucccuucccagucucccuuuucucucuc

SEQ ID NO: 502544 - RNA, 32 nt, Human
uccuucccuuccccucagccuuugguacuguu

SEQ ID NO: 502545 - RNA, 32 nt, Human
uccuucccuuccccuuccuuccuuccuuccuu

SEQ ID NO: 502546 - RNA, 32 nt, Human
uccuucccuuucuccuguccucguccuggccu

SEQ ID NO: 502547 - RNA, 32 nt, Human
uccuucccuuugucuuucuuccaucuuccaac

SEQ ID NO: 502548 - RNA, 24 nt, Human
uccuucccuuuucucaccaaagca

SEQ ID NO: 502549 - RNA, 32 nt, Human
uccuuccgaaucucauccucccuccuccucuc

SEQ ID NO: 502550 - RNA, 32 nt, Human
uccuuccgccucugggccucaggcugccuguc

SEQ ID NO: 502551 - RNA, 32 nt, Human
uccuuccguccucagcgggcagggaacaccuc

SEQ ID NO: 502552 - RNA, 32 nt, Human
uccuuccuacccccuucucccucucccuuccc

SEQ ID NO: 502553 - RNA, 32 nt, Human
uccuuccuacuucuuuucuuccuuccucuucc

SEQ ID NO: 502554 - RNA, 32 nt, Human
uccuuccuauacauuguuuacacuucaacuac

SEQ ID NO: 502555 - RNA, 32 nt, Human
uccuuccucacugguacugccugcuguuuucu

SEQ ID NO: 502556 - RNA, 32 nt, Human
uccuuccuccacugcgcuuacuccucugaccc

SEQ ID NO: 502557 - RNA, 32 nt, Human
uccuuccuccucuauagcuucugggugucccc

SEQ ID NO: 502558 - RNA, 32 nt, Human
uccuuccucuccccuccucccaucccucauag

SEQ ID NO: 502559 - RNA, 32 nt, Human
uccuuccucucuccuccccuccuuccucucuc

SEQ ID NO: 502560 - RNA, 32 nt, Human
uccuuccucucuccucuccuccuuccugucuc

SEQ ID NO: 502561 - RNA, 32 nt, Human
uccuuccucugccuuuuuguuucauauggggc

SEQ ID NO: 502562 - RNA, 32 nt, Human
uccuuccucugcuccuccuuuggagaagcaau

SEQ ID NO: 502563 - RNA, 32 nt, Human
uccuuccucuguaaucccagcuacucaggagg

SEQ ID NO: 502564 - RNA, 32 nt, Human
uccuuccucuuacccuuccucccucagccugc

SEQ ID NO: 502565 - RNA, 22 nt, Human
uccuuccucuuccccaagugca

SEQ ID NO: 502566 - RNA, 32 nt, Human
uccuuccucuuccucucuuaaaacuaucuuag

SEQ ID NO: 502567 - RNA, 32 nt, Human
uccuuccugaaacuauauuuugucauaucaaa

SEQ ID NO: 502568 - RNA, 32 nt, Human
uccuuccugaccaagucugccaaccaauggcc

SEQ ID NO: 502569 - RNA, 32 nt, Human
uccuuccugcccuucugccugccugugucugc

SEQ ID NO: 502570 - RNA, 32 nt, Human
uccuuccugccucuuccagcucccaggggcuc

SEQ ID NO: 502571 - RNA, 32 nt, Human
uccuuccugccugaaauugcugcugcccaucg

SEQ ID NO: 502572 - RNA, 32 nt, Human
uccuuccugccugagcccugcacugucccaga

SEQ ID NO: 502573 - RNA, 32 nt, Human
uccuuccugccuggccgcgggccggccgggcc

SEQ ID NO: 502574 - RNA, 32 nt, Human
uccuuccugcucaagaaaauuagugcucagcc

SEQ ID NO: 502575 - RNA, 32 nt, Human
uccuuccugggggccgaggaaguggggccacu

SEQ ID NO: 502576 - RNA, 32 nt, Human
uccuuccugguugaggaguuucugggagaaug

SEQ ID NO: 502577 - RNA, 32 nt, Human
uccuuccugugaugccaucaccagagaaggug

SEQ ID NO: 502578 - RNA, 32 nt, Human
uccuuccuuaggaccugggggccaggcugacu

SEQ ID NO: 502579 - RNA, 32 nt, Human
uccuuccuuaguuucaaagugucucauucuca

SEQ ID NO: 502580 - RNA, 32 nt, Human
uccuuccuucccucccuuccuccuucucuccu

SEQ ID NO: 502581 - RNA, 32 nt, Human
uccuuccuuccuacccccuucucccucucccu

SEQ ID NO: 502582 - RNA, 32 nt, Human
uccuuccuuccuccuccuccuucucuuuccuc

SEQ ID NO: 502583 - RNA, 32 nt, Human
uccuuccuuccuuccuuccucucucuuucuuu

SEQ ID NO: 502584 - RNA, 32 nt, Human
uccuuccuuccuuccuucuuccuuccuccccu

SEQ ID NO: 502585 - RNA, 32 nt, Human
uccuuccuucuauccauuuucugcccauaauu

SEQ ID NO: 502586 - RNA, 32 nt, Human
uccuuccuucucagggucuccccagcccaguc

SEQ ID NO: 502587 - RNA, 32 nt, Human
uccuuccuucuucccuugaucucccucuuccu

SEQ ID NO: 502588 - RNA, 32 nt, Human
uccuuccuucuuccucugcucaggagaaaacu

SEQ ID NO: 502589 - RNA, 32 nt, Human
uccuuccuucuuuccuccuacagugcugagca

SEQ ID NO: 502590 - RNA, 32 nt, Human
uccuuccuucuuucuuucccuuucccuuucuu

SEQ ID NO: 502591 - RNA, 32 nt, Human
uccuuccuugccccaucuuccucccaacugga

SEQ ID NO: 502592 - RNA, 32 nt, Human
uccuuccuugguucacccuccacccccucccc

SEQ ID NO: 502593 - RNA, 32 nt, Human
uccuuccuuucccagcagcagugcccugcaga

SEQ ID NO: 502594 - RNA, 32 nt, Human
uccuuccuuuuccauuuuccucuggccccucu

SEQ ID NO: 502595 - RNA, 20 nt, Human
uccuucgcugcuggcuugua

SEQ ID NO: 502596 - RNA, 32 nt, Human
uccuucggcagauugcagccccauuccccaca

SEQ ID NO: 502597 - RNA, 32 nt, Human
uccuucgucugcaucuucuucucagcugccuu

SEQ ID NO: 502598 - RNA, 32 nt, Human
uccuucguguggcuauaccauguauguuugua

SEQ ID NO: 502599 - RNA, 32 nt, Human
uccuucuaaaaaggggaaauuuggacacagag

SEQ ID NO: 502600 - RNA, 32 nt, Human
uccuucuaaaaauuugggaggggaauauagua

SEQ ID NO: 502601 - RNA, 32 nt, Human
uccuucuaacaaccacaccaguucuccaacaa

SEQ ID NO: 502602 - RNA, 32 nt, Human
uccuucuaccaggaccucagaagcccagaccu

SEQ ID NO: 502603 - RNA, 32 nt, Human
uccuucuacccacuuuagguuccuuggcuggg

SEQ ID NO: 502604 - RNA, 32 nt, Human
uccuucuagaugguccuugagcaaaacuuaau

SEQ ID NO: 502605 - RNA, 32 nt, Human
uccuucuagcauccuucauccuucagguacca

SEQ ID NO: 502606 - RNA, 32 nt, Human
uccuucuaggagagaggugaaagaaaccuggc

SEQ ID NO: 502607 - RNA, 32 nt, Human
uccuucucaagacuggugccucaggccuuucu

SEQ ID NO: 502608 - RNA, 32 nt, Human
uccuucucacugccuggucacauggugccuag

SEQ ID NO: 502609 - RNA, 32 nt, Human
uccuucucacugcgugucgucuccugaccaga

SEQ ID NO: 502610 - RNA, 32 nt, Human
uccuucucagaaggaggcucccgggggugagc

SEQ ID NO: 502611 - RNA, 32 nt, Human
uccuucucagucuccagaacugugagaaauaa

SEQ ID NO: 502612 - RNA, 32 nt, Human
uccuucucauuuccacuacucacucuagcuuc

SEQ ID NO: 502613 - RNA, 32 nt, Human
uccuucuccacacccagcaccccgcaggagaa

SEQ ID NO: 502614 - RNA, 32 nt, Human
uccuucuccaccagacgagcaccaagaagcug

SEQ ID NO: 502615 - RNA, 32 nt, Human
uccuucuccagccucuucucccgggaacucag

SEQ ID NO: 502616 - RNA, 32 nt, Human
uccuucuccaucaucucaucucuggaugcugu

SEQ ID NO: 502617 - RNA, 32 nt, Human
uccuucucccagaggaaggcagaaacaccuca

SEQ ID NO: 502618 - RNA, 32 nt, Human
uccuucucccuaauacauggcaucacaguucc

SEQ ID NO: 502619 - RNA, 32 nt, Human
uccuucucccucgacauuuucucccucuuucu

SEQ ID NO: 502620 - RNA, 32 nt, Human
uccuucuccggggucagccaggaagauguccc

SEQ ID NO: 502621 - RNA, 32 nt, Human
uccuucuccguggagcucagaggcagcuuacg

SEQ ID NO: 502622 - RNA, 23 nt, Human
uccuucuccuaccauuucccuuu

SEQ ID NO: 502623 - RNA, 32 nt, Human
uccuucuccuacucccugucuuucuggcauuu

SEQ ID NO: 502624 - RNA, 32 nt, Human
uccuucuccuacucuauauucccuuugccuuc

SEQ ID NO: 502625 - RNA, 32 nt, Human
uccuucuccucaccaucuucccagacggaguu

SEQ ID NO: 502626 - RNA, 32 nt, Human
uccuucuccucuuguagccagaauucuggaca

SEQ ID NO: 502627 - RNA, 32 nt, Human
uccuucuccuucugccaugauugugaggccuc

SEQ ID NO: 502628 - RNA, 21 nt, Human
uccuucucgcaggaccagaug

SEQ ID NO: 502629 - RNA, 32 nt, Human
uccuucucucacucccuuucuucaugcuucca

SEQ ID NO: 502630 - RNA, 32 nt, Human
uccuucucucacucccuuucuucaugcuuccc

SEQ ID NO: 502631 - RNA, 32 nt, Human
uccuucucuccucauucuucaacuaucuuuga

SEQ ID NO: 502632 - RNA, 32 nt, Human
uccuucucuccuccuucuucauucuacaccac

SEQ ID NO: 502633 - RNA, 32 nt, Human
uccuucucuccucugcugcagcuacugauauc

SEQ ID NO: 502634 - RNA, 32 nt, Human
uccuucucucuuucucuuuacucaugcucuaa

SEQ ID NO: 502635 - RNA, 32 nt, Human
uccuucucugaggcucagguccuugcuugaac

SEQ ID NO: 502636 - RNA, 32 nt, Human
uccuucucuggccaucuccuucccuccuucca

SEQ ID NO: 502637 - RNA, 32 nt, Human
uccuucucuguugccaauucuggaaccaaaau

SEQ ID NO: 502638 - RNA, 32 nt, Human
uccuucucuucuucuccucuccggcuucgcgc

SEQ ID NO: 502639 - RNA, 32 nt, Human
uccuucucuuucuccuucuuggaugucugaua

SEQ ID NO: 502640 - RNA, 32 nt, Human
uccuucugaagccccuuggcucugccuuggcc

SEQ ID NO: 502641 - RNA, 32 nt, Human
uccuucugcagcaggacucaccuacugacuca

SEQ ID NO: 502642 - RNA, 32 nt, Human
uccuucugcauccuuuggccaauaaaaguugc

SEQ ID NO: 502643 - RNA, 32 nt, Human
uccuucugccagcagcucacacugcuugaagu

SEQ ID NO: 502644 - RNA, 32 nt, Human
uccuucugccauggcccuguggaugcgccucc

SEQ ID NO: 502645 - RNA, 32 nt, Human
uccuucugcccuuguaagcccaucccagcuac

SEQ ID NO: 502646 - RNA, 32 nt, Human
uccuucugccucuguccacauuuccccaugug

SEQ ID NO: 502647 - RNA, 32 nt, Human
uccuucugccuggaauacucucuccccagauu

SEQ ID NO: 502648 - RNA, 32 nt, Human
uccuucugccuucuggucuccucgugccuccu

SEQ ID NO: 502649 - RNA, 32 nt, Human
uccuucugcuaacccagggaggguccuaagag

SEQ ID NO: 502650 - RNA, 32 nt, Human
uccuucuggaaggugauugccauguacacaac

SEQ ID NO: 502651 - RNA, 29 nt, Human
uccuucuggcugcaguaagcucccuggau

SEQ ID NO: 502652 - RNA, 32 nt, Human
uccuucugggacagcuucccugccucagaaaa

SEQ ID NO: 502653 - RNA, 32 nt, Human
uccuucugggaccucaggcaagugacuucgcc

SEQ ID NO: 502654 - RNA, 32 nt, Human
uccuucugggcuccaggauugucuccccacuc

SEQ ID NO: 502655 - RNA, 32 nt, Human
uccuucuggggagaccccacacccaagcacau

SEQ ID NO: 502656 - RNA, 32 nt, Human
uccuucugucucuuggaaagauacagcuccag

SEQ ID NO: 502657 - RNA, 20 nt, Human
uccuucugugagugcugcgu

SEQ ID NO: 502658 - RNA, 21 nt, Human
uccuucugugcuugcuugcau

SEQ ID NO: 502659 - RNA, 32 nt, Human
uccuucuguggcuuggagaugauaggaugauu

SEQ ID NO: 502660 - RNA, 32 nt, Human
uccuucuguuucucugaauaucuucauuucua

SEQ ID NO: 502661 - RNA, 32 nt, Human
uccuucuuacauucuuucccucucacaccauc

SEQ ID NO: 502662 - RNA, 28 nt, Human
uccuucuuaucgccugccucaucgcuca

SEQ ID NO: 502663 - RNA, 32 nt, Human
uccuucuuccaauguuccuccccucucuguau

SEQ ID NO: 502664 - RNA, 32 nt, Human
uccuucuuccaucccuucuuccaucuuuccag

SEQ ID NO: 502665 - RNA, 32 nt, Human
uccuucuuccccacuucucucuucccucauuc

SEQ ID NO: 502666 - RNA, 32 nt, Human
uccuucuucccuucaucaccaaaggagccucu

SEQ ID NO: 502667 - RNA, 32 nt, Human
uccuucuuccucccucuccuccuccccuuccc

SEQ ID NO: 502668 - RNA, 32 nt, Human
uccuucuuccuugacugcucuucaccagggau

SEQ ID NO: 502669 - RNA, 32 nt, Human
uccuucuucuccagcuccuccugcucccucug

SEQ ID NO: 502670 - RNA, 32 nt, Human
uccuucuucuccgccaccgagcucuuugaguc

SEQ ID NO: 502671 - RNA, 32 nt, Human
uccuucuucuuaacccucucccauccauuuuu

SEQ ID NO: 502672 - RNA, 19 nt, Human
uccuucuugaccucaucac

SEQ ID NO: 502673 - RNA, 32 nt, Human
uccuucuugccugcccugucuccugggaucag

SEQ ID NO: 502674 - RNA, 32 nt, Human
uccuucuuggucucacacuugggacucaaaaa

SEQ ID NO: 502675 - RNA, 32 nt, Human
uccuucuuucuuucccuuucccuuucuuuucu

SEQ ID NO: 502676 - RNA, 32 nt, Human
uccuugaaaauucauaucauaaagucaguugu

SEQ ID NO: 502677 - RNA, 32 nt, Human
uccuugaaaccagcucaggcuacugccacuca

SEQ ID NO: 502678 - RNA, 32 nt, Human
uccuugaaaguacauuuaacucacuacaguua

SEQ ID NO: 502679 - RNA, 32 nt, Human
uccuugaagcaccccagcauccuuucaauaaa

SEQ ID NO: 502680 - RNA, 32 nt, Human
uccuugaagggcccagauucuaccacacagca

SEQ ID NO: 502681 - RNA, 32 nt, Human
uccuugaaggggcgggcaccaggcuagguccg

SEQ ID NO: 502682 - RNA, 32 nt, Human
uccuugaagucagcuuuggaccacaauaauuu

SEQ ID NO: 502683 - RNA, 24 nt, Human
uccuugaaucaccugugggacuug

SEQ ID NO: 502684 - RNA, 32 nt, Human
uccuugacaaagcucucagcuccaaugaggua

SEQ ID NO: 502685 - RNA, 20 nt, Human
uccuugacauuugggaucug

SEQ ID NO: 502686 - RNA, 32 nt, Human
uccuugaccaggcugaaaggugaccucggggu

SEQ ID NO: 502687 - RNA, 32 nt, Human
uccuugaccagggucucacacccuggaggaau

SEQ ID NO: 502688 - RNA, 21 nt, Human
uccuugacccuuccccuuucc

SEQ ID NO: 502689 - RNA, 32 nt, Human
uccuugaccucacgugcugcugccuucucugc

SEQ ID NO: 502690 - RNA, 32 nt, Human
uccuugaccucauuuacaaagcaaaaagagau

SEQ ID NO: 502691 - RNA, 32 nt, Human
uccuugacgccugggcagaggcugcagcugca

SEQ ID NO: 502692 - RNA, 32 nt, Human
uccuugacucaauugauccucccaucucagcc

SEQ ID NO: 502693 - RNA, 22 nt, Human
uccuugacuccaucgggcgcuu

SEQ ID NO: 502694 - RNA, 32 nt, Human
uccuugacucgcaguccucccaccgcaccuuc

SEQ ID NO: 502695 - RNA, 32 nt, Human
uccuugagaagaugcaggacaaguagacugga

SEQ ID NO: 502696 - RNA, 32 nt, Human
uccuugagacacaccuggcacccgucaucggc

SEQ ID NO: 502697 - RNA, 32 nt, Human
uccuugagacuggagagcagccagcaggugcc

SEQ ID NO: 502698 - RNA, 32 nt, Human
uccuugagacuucauuccccagcaagcucagc

SEQ ID NO: 502699 - RNA, 32 nt, Human
uccuugagccaucagagagaguguauguucac

SEQ ID NO: 502700 - RNA, 32 nt, Human
uccuugagcccaggagguugaggcugcaguga

SEQ ID NO: 502701 - RNA, 22 nt, Human
uccuugagcugaaccgcacuga

SEQ ID NO: 502702 - RNA, 32 nt, Human
uccuugagcuuugccugucucuugccuuauca

SEQ ID NO: 502703 - RNA, 32 nt, Human
uccuugaggccaggagguugaggcugcaguga

SEQ ID NO: 502704 - RNA, 32 nt, Human
uccuugagggggugaggcagaggaucacuuga

SEQ ID NO: 502705 - RNA, 32 nt, Human
uccuugaggugcaucauuagguuguuuauuug

SEQ ID NO: 502706 - RNA, 32 nt, Human
uccuugagugugggggauuugggugaaugagg

SEQ ID NO: 502707 - RNA, 32 nt, Human
uccuugauagccacuucacucugcuacuacuc

SEQ ID NO: 502708 - RNA, 32 nt, Human
uccuugaucaucguucuuaauucuccauuagu

SEQ ID NO: 502709 - RNA, 32 nt, Human
uccuugaucucagggaucuucuccguuugcau

SEQ ID NO: 502710 - RNA, 23 nt, Human
uccuugauggaggggagaaggga

SEQ ID NO: 502711 - RNA, 32 nt, Human
uccuugaugggcaugugugauggggaaggagc

SEQ ID NO: 502712 - RNA, 23 nt, Human
uccuugauuccacuaugggaccu

SEQ ID NO: 502713 - RNA, 32 nt, Human
uccuugauuuagcacuauuuacauacaggcca

SEQ ID NO: 502714 - RNA, 20 nt, Human
uccuugauuugugaccuuga

SEQ ID NO: 502715 - RNA, 22 nt, Human
uccuugcaaagagaauccugua

SEQ ID NO: 502716 - RNA, 32 nt, Human
uccuugcaaccaggcagcugagaccagggucu

SEQ ID NO: 502717 - RNA, 32 nt, Human
uccuugcaagaccugcuugcucagcuuuuucu

SEQ ID NO: 502718 - RNA, 23 nt, Human
uccuugcacuagcuacauccuca

SEQ ID NO: 502719 - RNA, 32 nt, Human
uccuugcagaacuucugugcacaugacaucuu

SEQ ID NO: 502720 - RNA, 32 nt, Human
uccuugcagagccuguggcuugcauuuccuac

SEQ ID NO: 502721 - RNA, 32 nt, Human
uccuugcagagcuuuacugaggcccuccauau

SEQ ID NO: 502722 - RNA, 32 nt, Human
uccuugcagcagagcagggcugaggggaaggg

SEQ ID NO: 502723 - RNA, 22 nt, Human
uccuugcaggaaaccagucuca

SEQ ID NO: 502724 - RNA, 32 nt, Human
uccuugcaggagaaagcuaagccucaagauag

SEQ ID NO: 502725 - RNA, 32 nt, Human
uccuugcaggcagaaggcaguagggccccugc

SEQ ID NO: 502726 - RNA, 31 nt, Human
uccuugcaggcuuguugccuguugaaagaag

SEQ ID NO: 502727 - RNA, 32 nt, Human
uccuugcagugaagccaccaugggugaccguc

SEQ ID NO: 502728 - RNA, 32 nt, Human
uccuugcaugcacaccuuccuccacccuccac

SEQ ID NO: 502729 - RNA, 32 nt, Human
uccuugccaggccuccccaaccccuggccuca

SEQ ID NO: 502730 - RNA, 32 nt, Human
uccuugcccaggcuggagugcaguggcgcgau

SEQ ID NO: 502731 - RNA, 22 nt, Human
uccuugccccaaccuggcccca

SEQ ID NO: 502732 - RNA, 32 nt, Human
uccuugccccuucaguauucucucuuugcgau

SEQ ID NO: 502733 - RNA, 32 nt, Human
uccuugcccuccacuaccaauuucuauuuccu

SEQ ID NO: 502734 - RNA, 32 nt, Human
uccuugcccugccucaguuuaccugcacaugc

SEQ ID NO: 502735 - RNA, 32 nt, Human
uccuugcccuguuccccaccucccggcuccag

SEQ ID NO: 502736 - RNA, 32 nt, Human
uccuugcccuguuccccaccuccuggcuccag

SEQ ID NO: 502737 - RNA, 21 nt, Human
uccuugcccuuuucccuuccc

SEQ ID NO: 502738 - RNA, 21 nt, Human
uccuugccgcaccgagugcac

SEQ ID NO: 502739 - RNA, 32 nt, Human
uccuugccgccucaccgccggccuccucgacu

SEQ ID NO: 502740 - RNA, 32 nt, Human
uccuugccucaccaaccuucccauacacaguc

SEQ ID NO: 502741 - RNA, 32 nt, Human
uccuugccucucccuauggccugcuggcccac

SEQ ID NO: 502742 - RNA, 32 nt, Human
uccuugccugggugggaggagcgaaagugggg

SEQ ID NO: 502743 - RNA, 32 nt, Human
uccuugccuuaaagagcucucuagucuaacgg

SEQ ID NO: 502744 - RNA, 32 nt, Human
uccuugccuucccauuuauccauguuucacuu

SEQ ID NO: 502745 - RNA, 32 nt, Human
uccuugccuugcuucucccauuuccugaucua

SEQ ID NO: 502746 - RNA, 32 nt, Human
uccuugccuuucuccugucuuucuguguuuau

SEQ ID NO: 502747 - RNA, 32 nt, Human
uccuugcguggccgagauccagcuucaacgaa

SEQ ID NO: 502748 - RNA, 32 nt, Human
uccuugcguggcgaaggucgugccucaggucu

SEQ ID NO: 502749 - RNA, 32 nt, Human
uccuugcguuccugucuggcguauucugaaga

SEQ ID NO: 502750 - RNA, 32 nt, Human
uccuugcuacuucucuuccuccucaaugaaau

SEQ ID NO: 502751 - RNA, 32 nt, Human
uccuugcucacaugcugccaucaugucaggua

SEQ ID NO: 502752 - RNA, 17 nt, Human
uccuugcucccacccca

SEQ ID NO: 502753 - RNA, 32 nt, Human
uccuugcugaugaacugagauggucccaacug

SEQ ID NO: 502754 - RNA, 32 nt, Human
uccuugcugcucccuacugacucuagcuuacu

SEQ ID NO: 502755 - RNA, 32 nt, Human
uccuugcuucucuguggccugugccauggggc

SEQ ID NO: 502756 - RNA, 32 nt, Human
uccuugcuucuuugaugugauaguuuugagau

SEQ ID NO: 502757 - RNA, 32 nt, Human
uccuugcuugcaaucucaucugauuuugcuag

SEQ ID NO: 502758 - RNA, 32 nt, Human
uccuugcuuuccccaucuguuggaccaaauaa

SEQ ID NO: 502759 - RNA, 32 nt, Human
uccuugcuuugucagcuugcaaaggaggagag

SEQ ID NO: 502760 - RNA, 32 nt, Human
uccuugcuuuucaaagauuuuggcuuaaaccc

SEQ ID NO: 502761 - RNA, 22 nt, Human
uccuuggaaacaacauaccucu

SEQ ID NO: 502762 - RNA, 32 nt, Human
uccuuggaaagagacgucgcuuucauccccaa

SEQ ID NO: 502763 - RNA, 27 nt, Human
uccuuggaaauaguaaagaacuacucu

SEQ ID NO: 502764 - RNA, 32 nt, Human
uccuuggaccaaucagagaugcuguagcuccu

SEQ ID NO: 502765 - RNA, 23 nt, Human
uccuuggaccucuuaccaaacca

SEQ ID NO: 502766 - RNA, 32 nt, Human
uccuuggacuccucaaacuucuccagcgccug

SEQ ID NO: 502767 - RNA, 32 nt, Human
uccuuggacuugucugggggcugcaguggagu

SEQ ID NO: 502768 - RNA, 32 nt, Human
uccuuggagcuuccugggcccuucccugggcc

SEQ ID NO: 502769 - RNA, 24 nt, Human
uccuuggaucucuguauguacagg

SEQ ID NO: 502770 - RNA, 32 nt, Human
uccuuggauggcaccauccacccugcaggcuu

SEQ ID NO: 502771 - RNA, 32 nt, Human
uccuuggauguuugugggaaaugcagauugcu

SEQ ID NO: 502772 - RNA, 20 nt, Human
uccuuggcaacaaccuguca

SEQ ID NO: 502773 - RNA, 32 nt, Human
uccuuggcaaucaaccaacguugcuaugaaau

SEQ ID NO: 502774 - RNA, 32 nt, Human
uccuuggcagaacucaguuaaaucuuugaaga

SEQ ID NO: 502775 - RNA, 32 nt, Human
uccuuggcaggggcacugugaugaggaguaag

SEQ ID NO: 502776 - RNA, 32 nt, Human
uccuuggccagccuuuugccucccucgauacu

SEQ ID NO: 502777 - RNA, 32 nt, Human
uccuuggccauucccucuccccucucuaucca

SEQ ID NO: 502778 - RNA, 32 nt, Human
uccuuggcccagucugugccauuuucucugcg

SEQ ID NO: 502779 - RNA, 32 nt, Human
uccuuggcccuugccagacauuagcaccauga

SEQ ID NO: 502780 - RNA, 32 nt, Human
uccuuggccuccaggguccauuaaggugagaa

SEQ ID NO: 502781 - RNA, 32 nt, Human
uccuuggcgacgcagggggccuagagagcccc

SEQ ID NO: 502782 - RNA, 24 nt, Human
uccuuggcgcugccugggguccuu

SEQ ID NO: 502783 - RNA, 32 nt, Human
uccuuggcgucaccccuccacauuguccagau

SEQ ID NO: 502784 - RNA, 32 nt, Human
uccuuggcucaagcaauccugcugccuuggcc

SEQ ID NO: 502785 - RNA, 32 nt, Human
uccuuggcucaagcuguccucuggccucagcc

SEQ ID NO: 502786 - RNA, 32 nt, Human
uccuuggcucaaggcauccucccaccucagcu

SEQ ID NO: 502787 - RNA, 32 nt, Human
uccuuggcucaagugauucucccaccuuagcc

SEQ ID NO: 502788 - RNA, 24 nt, Human
uccuuggcuccacccgcaggccua

SEQ ID NO: 502789 - RNA, 32 nt, Human
uccuuggcuccaggagcccacaggcuggggag

SEQ ID NO: 502790 - RNA, 32 nt, Human
uccuuggcugaagugauccugucgucucggcu

SEQ ID NO: 502791 - RNA, 32 nt, Human
uccuuggcuuaccugaccucuugcugucucug

SEQ ID NO: 502792 - RNA, 32 nt, Human
uccuuggcuuguagacucuguguucucccuuu

SEQ ID NO: 502793 - RNA, 32 nt, Human
uccuugggaggcuaaggcaggagaauagcaug

SEQ ID NO: 502794 - RNA, 32 nt, Human
uccuugggaggcugaggcaggagaauugcuug

SEQ ID NO: 502795 - RNA, 32 nt, Human
uccuugggaugaagaggguagagugggcugcu

SEQ ID NO: 502796 - RNA, 32 nt, Human
uccuugggcccaaacuucuccagucucucaug

SEQ ID NO: 502797 - RNA, 24 nt, Human
uccuugggcccuuuuucccuuccc

SEQ ID NO: 502798 - RNA, 32 nt, Human
uccuugggcuauauuuucucuccucgaguugc

SEQ ID NO: 502799 - RNA, 32 nt, Human
uccuugggcuuauccugggugcuuauaggaga

SEQ ID NO: 502800 - RNA, 32 nt, Human
uccuuggggaaugaccacgcaacugggcccag

SEQ ID NO: 502801 - RNA, 24 nt, Human
uccuuggggagcuugcagcacagg

SEQ ID NO: 502802 - RNA, 32 nt, Human
uccuuggggcuugccacccacuccuuugcugu

SEQ ID NO: 502803 - RNA, 32 nt, Human
uccuugggugagcucugaacaccagcuuuggc

SEQ ID NO: 502804 - RNA, 32 nt, Human
uccuugguaagccugcacaccuggcuuccuaa

SEQ ID NO: 502805 - RNA, 32 nt, Human
uccuuggucaccaggcaaugggagcuguagac

SEQ ID NO: 502806 - RNA, 32 nt, Human
uccuuggucacugaggccauuggaucuuccuc

SEQ ID NO: 502807 - RNA, 32 nt, Human
uccuuggucaguguccaugcuuucugggcagg

SEQ ID NO: 502808 - RNA, 32 nt, Human
uccuugguccuucugagagucaagaucuuuuc

SEQ ID NO: 502809 - RNA, 32 nt, Human
uccuuggucucugccacugcccugccucuccu

SEQ ID NO: 502810 - RNA, 32 nt, Human
uccuuggucuggagaagagaucugagguccca

SEQ ID NO: 502811 - RNA, 20 nt, Human
uccuuggugggcagcauccu

SEQ ID NO: 502812 - RNA, 32 nt, Human
uccuugguguccuaggagaaacagacaagcaa

SEQ ID NO: 502813 - RNA, 32 nt, Human
uccuugguucaaacgauucuccugccucagcc

SEQ ID NO: 502814 - RNA, 32 nt, Human
uccuugguucaagcgauucuccugccucagcc

SEQ ID NO: 502815 - RNA, 32 nt, Human
uccuugguucagagggaagugggucugcuuca

SEQ ID NO: 502816 - RNA, 32 nt, Human
uccuugguucgcccgguuuucuguuuucagua

SEQ ID NO: 502817 - RNA, 21 nt, Human
uccuuguaacuggaaugcccu

SEQ ID NO: 502818 - RNA, 23 nt, Human
uccuuguaacuucaacugacucu

SEQ ID NO: 502819 - RNA, 32 nt, Human
uccuuguaagaguggcuggaaggcuccgcgga

SEQ ID NO: 502820 - RNA, 32 nt, Human
uccuuguagacagaugaugagacgccaaagua

SEQ ID NO: 502821 - RNA, 23 nt, Human
uccuuguaggcagaacauacucu

SEQ ID NO: 502822 - RNA, 32 nt, Human
uccuuguaggcugaagucagucugacuugaag

SEQ ID NO: 502823 - RNA, 32 nt, Human
uccuuguaguaagcuguuuucugcucagccac

SEQ ID NO: 502824 - RNA, 32 nt, Human
uccuuguaguuucuucccuccuguucucuggu

SEQ ID NO: 502825 - RNA, 32 nt, Human
uccuuguaucucugcaguguggauugaacaga

SEQ ID NO: 502826 - RNA, 32 nt, Human
uccuuguaucuucuccccuucugagccugucc

SEQ ID NO: 502827 - RNA, 32 nt, Human
uccuuguauuuuaaauauuuguauuuauuuca

SEQ ID NO: 502828 - RNA, 32 nt, Human
uccuugucaaugcuucccagugaagagaguac

SEQ ID NO: 502829 - RNA, 32 nt, Human
uccuuguccuacucucacaucugcauuccucu

SEQ ID NO: 502830 - RNA, 16 nt, Human
uccuuguccucaccca

SEQ ID NO: 502831 - RNA, 32 nt, Human
uccuugucuccccucuccccacuuauucuccu

SEQ ID NO: 502832 - RNA, 32 nt, Human
uccuugucucgguucagguccagaccuccccg

SEQ ID NO: 502833 - RNA, 25 nt, Human
uccuugucugcacugcugguauggg

SEQ ID NO: 502834 - RNA, 32 nt, Human
uccuugucugcucuccuuugaaccuuggcagc

SEQ ID NO: 502835 - RNA, 32 nt, Human
uccuugucuucgugguuccuggcucagcagga

SEQ ID NO: 502836 - RNA, 32 nt, Human
uccuugugaacaagccccuaggcccacagucu

SEQ ID NO: 502837 - RNA, 32 nt, Human
uccuugugacuggaugacugaggucuccauuu

SEQ ID NO: 502838 - RNA, 32 nt, Human
uccuugugacuuacuaauggcugcaaugccaa

SEQ ID NO: 502839 - RNA, 32 nt, Human
uccuugugagaaauaaaguggagcagccucau

SEQ ID NO: 502840 - RNA, 32 nt, Human
uccuugugcacacccuugugccuuugcucgca

SEQ ID NO: 502841 - RNA, 32 nt, Human
uccuugugcccucaccagacacccuguuggcc

SEQ ID NO: 502842 - RNA, 32 nt, Human
uccuuguggcccacccuguccuuguuucugug

SEQ ID NO: 502843 - RNA, 32 nt, Human
uccuugugggccgcgugggcccccagggccag

SEQ ID NO: 502844 - RNA, 32 nt, Human
uccuugugggccuaccaggcuugguggagcca

SEQ ID NO: 502845 - RNA, 32 nt, Human
uccuuguggggagguggauccucugccagcag

SEQ ID NO: 502846 - RNA, 32 nt, Human
uccuuguguacuccagcauugguuauagucau

SEQ ID NO: 502847 - RNA, 32 nt, Human
uccuugugucccucgucccacaggaggacaca

SEQ ID NO: 502848 - RNA, 32 nt, Human
uccuugugugugucuuggagugcauuugacuc

SEQ ID NO: 502849 - RNA, 32 nt, Human
uccuuguguuuugaggucacugagguaggaag

SEQ ID NO: 502850 - RNA, 32 nt, Human
uccuuguguuuuguccugccucuuguuucugu

SEQ ID NO: 502851 - RNA, 32 nt, Human
uccuuguuauccuuguuuccuuagcuugguau

SEQ ID NO: 502852 - RNA, 32 nt, Human
uccuuguucaaaacauuuaaucaucuuaagca

SEQ ID NO: 502853 - RNA, 32 nt, Human
uccuuguucaguucuuguccaggccuuugggu

SEQ ID NO: 502854 - RNA, 25 nt, Human
uccuuguuccagggaacagcugcuu

SEQ ID NO: 502855 - RNA, 18 nt, Human
uccuuguucugcugccca

SEQ ID NO: 502856 - RNA, 21 nt, Human
uccuuguucuguucugggcca

SEQ ID NO: 502857 - RNA, 32 nt, Human
uccuuguuucuuucuucccugcacccgcuucu

SEQ ID NO: 502858 - RNA, 32 nt, Human
uccuuguuugacuucagaccuggaucuaauag

SEQ ID NO: 502859 - RNA, 32 nt, Human
uccuuuaaaauuauugguuaauacuuugagac

SEQ ID NO: 502860 - RNA, 32 nt, Human
uccuuuaaaggauggaggcaacuuggccaacu

SEQ ID NO: 502861 - RNA, 23 nt, Human
uccuuuaacagaaaguuugccaa

SEQ ID NO: 502862 - RNA, 32 nt, Human
uccuuuaacucccuuuuuacacuuuaugguaa

SEQ ID NO: 502863 - RNA, 32 nt, Human
uccuuuaaucuuuugccccagccauccaguau

SEQ ID NO: 502864 - RNA, 32 nt, Human
uccuuuacagaaaaguuuucugaccucaauuc

SEQ ID NO: 502865 - RNA, 21 nt, Human
uccuuuaccaccguggugaca

SEQ ID NO: 502866 - RNA, 32 nt, Human
uccuuuacccaguuuuuccuuuguaggauggg

SEQ ID NO: 502867 - RNA, 32 nt, Human
uccuuuacucuccucugagucucccucuuucc

SEQ ID NO: 502868 - RNA, 32 nt, Human
uccuuuacucuuuaacagugcagguggucagu

SEQ ID NO: 502869 - RNA, 32 nt, Human
uccuuuagacuggccuagccugggcaucacug

SEQ ID NO: 502870 - RNA, 30 nt, Human
uccuuuagccucuccccaccuguccaaacu

SEQ ID NO: 502871 - RNA, 32 nt, Human
uccuuuagccuggaggucaaggcugcagugag

SEQ ID NO: 502872 - RNA, 24 nt, Human
uccuuuagggccaggcucaccccu

SEQ ID NO: 502873 - RNA, 32 nt, Human
uccuuuauagguuuuauuucuggucauagaga

SEQ ID NO: 502874 - RNA, 32 nt, Human
uccuuuauauuguguuagaggcugaggauaua

SEQ ID NO: 502875 - RNA, 32 nt, Human
uccuuuauccccuccuuuaccccacauaugca

SEQ ID NO: 502876 - RNA, 32 nt, Human
uccuuuaucugugacuucaugcucugauaacu

SEQ ID NO: 502877 - RNA, 32 nt, Human
uccuuuaucuuucugagucucagauucuucau

SEQ ID NO: 502878 - RNA, 21 nt, Human
uccuuuauggagacaaccccu

SEQ ID NO: 502879 - RNA, 32 nt, Human
uccuuuauuucucucccaaccuggcugcaaag

SEQ ID NO: 502880 - RNA, 32 nt, Human
uccuuuauuucucucccuuucucuucaccucu

SEQ ID NO: 502881 - RNA, 32 nt, Human
uccuuuauuuucuuauccucccuucucuuguu

SEQ ID NO: 502882 - RNA, 32 nt, Human
uccuuucaaccagauaacuuccuaaguggaga

SEQ ID NO: 502883 - RNA, 32 nt, Human
uccuuucaagacagaaagagacaggagacaug

SEQ ID NO: 502884 - RNA, 32 nt, Human
uccuuucaauaugacaguuuugugcuucucuc

SEQ ID NO: 502885 - RNA, 32 nt, Human
uccuuucacucccaaaugcaaacagucucuuc

SEQ ID NO: 502886 - RNA, 32 nt, Human
uccuuucacuccugccugacugccaagccacc

SEQ ID NO: 502887 - RNA, 32 nt, Human
uccuuucacugccuuaaucuuugcaacagggu

SEQ ID NO: 502888 - RNA, 32 nt, Human
uccuuucagacacauccucggacacacaugcg

SEQ ID NO: 502889 - RNA, 32 nt, Human
uccuuucagcauggcagggggcuugagauauu

SEQ ID NO: 502890 - RNA, 32 nt, Human
uccuuucagccuugcugacuucucccuauaag

SEQ ID NO: 502891 - RNA, 32 nt, Human
uccuuucaggccagggcaucccagaggucaau

SEQ ID NO: 502892 - RNA, 32 nt, Human
uccuuucauccugauucagcucugccuugcau

SEQ ID NO: 502893 - RNA, 32 nt, Human
uccuuuccacucugccccagcucccuggaucc

SEQ ID NO: 502894 - RNA, 32 nt, Human
uccuuuccagagccgugaccucaggcucaccu

SEQ ID NO: 502895 - RNA, 32 nt, Human
uccuuuccaggugaagggugacuuggcugaag

SEQ ID NO: 502896 - RNA, 32 nt, Human
uccuuuccaguccagcaccuccuggggcaggc

SEQ ID NO: 502897 - RNA, 32 nt, Human
uccuuucccagagguaucaugguaucccaaga

SEQ ID NO: 502898 - RNA, 32 nt, Human
uccuuucccccucccucacuccuuccuuugcg

SEQ ID NO: 502899 - RNA, 32 nt, Human
uccuuuccccuccaaagggcaagaauucacac

SEQ ID NO: 502900 - RNA, 32 nt, Human
uccuuuccccuccccucucuuccuccccucug

SEQ ID NO: 502901 - RNA, 32 nt, Human
uccuuuccccuucauucucacccugucugcuu

SEQ ID NO: 502902 - RNA, 32 nt, Human
uccuuucccucccauucuccugagggacucaa

SEQ ID NO: 502903 - RNA, 32 nt, Human
uccuuucccugccucuuguccaauggaguggg

SEQ ID NO: 502904 - RNA, 32 nt, Human
uccuuucccugccuucucccauacauuccaaa

SEQ ID NO: 502905 - RNA, 32 nt, Human
uccuuucccuucccuuacuucuccccuucccc

SEQ ID NO: 502906 - RNA, 32 nt, Human
uccuuucccuuucuuuccuuuuucccuguccu

SEQ ID NO: 502907 - RNA, 32 nt, Human
uccuuucccuuucuuuucuuuugcuuuccuuu

SEQ ID NO: 502908 - RNA, 32 nt, Human
uccuuuccuaucuuccuuccucucucucuucc

SEQ ID NO: 502909 - RNA, 32 nt, Human
uccuuuccuccccuucugccuuccccuuccuu

SEQ ID NO: 502910 - RNA, 32 nt, Human
uccuuuccuccuccugugcuuccuuucucguu

SEQ ID NO: 502911 - RNA, 32 nt, Human
uccuuuccucucugcugacuccacauuuccaa

SEQ ID NO: 502912 - RNA, 32 nt, Human
uccuuuccugaaagccucaucuaccuuaauuu

SEQ ID NO: 502913 - RNA, 32 nt, Human
uccuuuccugccucugugccccugccucuccc

SEQ ID NO: 502914 - RNA, 32 nt, Human
uccuuuccugccuugugaccucagauggucac

SEQ ID NO: 502915 - RNA, 32 nt, Human
uccuuuccugcucuugguuuucccaggugagc

SEQ ID NO: 502916 - RNA, 32 nt, Human
uccuuuccuguccugguacuuggcaccuugua

SEQ ID NO: 502917 - RNA, 32 nt, Human
uccuuuccuuccccuaagauguuuccagggcc

SEQ ID NO: 502918 - RNA, 32 nt, Human
uccuuuccuuucucccuucccccaccaaccuc

SEQ ID NO: 502919 - RNA, 32 nt, Human
uccuuucgaggcuggggcuagauggauacccc

SEQ ID NO: 502920 - RNA, 32 nt, Human
uccuuucgcccacacauuggcggaggagaaac

SEQ ID NO: 502921 - RNA, 32 nt, Human
uccuuucuagccccugcaucuccaacaagucc

SEQ ID NO: 502922 - RNA, 32 nt, Human
uccuuucuauagacucaacaugcgguugcccg

SEQ ID NO: 502923 - RNA, 32 nt, Human
uccuuucuccagaauggguucugggugggucc

SEQ ID NO: 502924 - RNA, 32 nt, Human
uccuuucuccauccuugaucagagauaaacua

SEQ ID NO: 502925 - RNA, 32 nt, Human
uccuuucucccauucuucccugccucuucccu

SEQ ID NO: 502926 - RNA, 32 nt, Human
uccuuucuccccucagguaggggucccacggc

SEQ ID NO: 502927 - RNA, 32 nt, Human
uccuuucuccccucuuuguguggccccagcca

SEQ ID NO: 502928 - RNA, 32 nt, Human
uccuuucuccucccucuccuuuuccugccaca

SEQ ID NO: 502929 - RNA, 32 nt, Human
uccuuucuccuggcuccagccugaaguguggg

SEQ ID NO: 502930 - RNA, 32 nt, Human
uccuuucuccuuccuuccaaaauaacaugucc

SEQ ID NO: 502931 - RNA, 32 nt, Human
uccuuucuccuugggugaugugcaauccaucg

SEQ ID NO: 502932 - RNA, 32 nt, Human
uccuuucucgcaaucuuccugcauuguacaca

SEQ ID NO: 502933 - RNA, 32 nt, Human
uccuuucucugacccaggcaccucgagggcua

SEQ ID NO: 502934 - RNA, 32 nt, Human
uccuuucucuguccucuccugagguucugccu

SEQ ID NO: 502935 - RNA, 22 nt, Human
uccuuucucuuucucucuuccc

SEQ ID NO: 502936 - RNA, 32 nt, Human
uccuuucugaucccugagccugugccacgccc

SEQ ID NO: 502937 - RNA, 32 nt, Human
uccuuucugcagcugagaugcacgcagaccca

SEQ ID NO: 502938 - RNA, 32 nt, Human
uccuuucugcagcugccuuucagcacaggugg

SEQ ID NO: 502939 - RNA, 32 nt, Human
uccuuucugcuuucuaguugguguuuuguuga

SEQ ID NO: 502940 - RNA, 32 nt, Human
uccuuucuggaaggagcugccgcccaggaacc

SEQ ID NO: 502941 - RNA, 18 nt, Human
uccuuucuggagcuccuu

SEQ ID NO: 502942 - RNA, 32 nt, Human
uccuuucuggccccagccuagguggaggcaag

SEQ ID NO: 502943 - RNA, 32 nt, Human
uccuuucuuaccacucucuccuggggccgaca

SEQ ID NO: 502944 - RNA, 32 nt, Human
uccuuucuuccucucguuccccaaauccgagg

SEQ ID NO: 502945 - RNA, 32 nt, Human
uccuuucuucuccauucccugaugcaucaaca

SEQ ID NO: 502946 - RNA, 32 nt, Human
uccuuucuucugaguugagcagacucacuggc

SEQ ID NO: 502947 - RNA, 32 nt, Human
uccuuucuucuuucuguuuucuuucccguguu

SEQ ID NO: 502948 - RNA, 32 nt, Human
uccuuucuuuccuaccauguaacccugcuuug

SEQ ID NO: 502949 - RNA, 32 nt, Human
uccuuugaaagacugugcuguccuuuaacaua

SEQ ID NO: 502950 - RNA, 32 nt, Human
uccuuugaaagccagaacaauggaucggcuuc

SEQ ID NO: 502951 - RNA, 32 nt, Human
uccuuugaagcacagccuauuucugagccaag

SEQ ID NO: 502952 - RNA, 32 nt, Human
uccuuugaggcagagguuuaaguguaggccug

SEQ ID NO: 502953 - RNA, 32 nt, Human
uccuuugaggcaggcgaggggcugggaguggg

SEQ ID NO: 502954 - RNA, 32 nt, Human
uccuuugauauuuaugacaguacuucugaagc

SEQ ID NO: 502955 - RNA, 32 nt, Human
uccuuugcagaacuucagggacugggagcaga

SEQ ID NO: 502956 - RNA, 32 nt, Human
uccuuugcagcaaaccguaaguuauaaggaug

SEQ ID NO: 502957 - RNA, 32 nt, Human
uccuuugcagugcagcugcccuguagauuuug

SEQ ID NO: 502958 - RNA, 32 nt, Human
uccuuugcaguggaugcuuaaguuuccuuauc

SEQ ID NO: 502959 - RNA, 32 nt, Human
uccuuugcauucgauuguccaucgggaccaca

SEQ ID NO: 502960 - RNA, 32 nt, Human
uccuuugccugucugcccuccuggaugcuauu

SEQ ID NO: 502961 - RNA, 32 nt, Human
uccuuugcggugagcuauguuuacauugacac

SEQ ID NO: 502962 - RNA, 32 nt, Human
uccuuugcucacauguuucccugcugaccuuc

SEQ ID NO: 502963 - RNA, 32 nt, Human
uccuuugcucucuuugcuucuaccucaaauag

SEQ ID NO: 502964 - RNA, 32 nt, Human
uccuuuggagccaccuugucccuggcuagaca

SEQ ID NO: 502965 - RNA, 32 nt, Human
uccuuuggauuuuggggagaaccaagcccugg

SEQ ID NO: 502966 - RNA, 32 nt, Human
uccuuuggcaacacccucacagacacacucag

SEQ ID NO: 502967 - RNA, 32 nt, Human
uccuuuggccguuuccaagaucugcagugcac

SEQ ID NO: 502968 - RNA, 32 nt, Human
uccuuuggcuggcaaaugucuacaucuugaaa

SEQ ID NO: 502969 - RNA, 32 nt, Human
uccuuugggaaaggagaaguuaagcaacaucu

SEQ ID NO: 502970 - RNA, 32 nt, Human
uccuuugggccucugcuucucucaccuaaaaa

SEQ ID NO: 502971 - RNA, 32 nt, Human
uccuuugggccuggggcugugcuuggcuugaa

SEQ ID NO: 502972 - RNA, 32 nt, Human
uccuuugggguucaucuuugacauuugccacc

SEQ ID NO: 502973 - RNA, 32 nt, Human
uccuuugggugagaacaugugaaccaggcacc

SEQ ID NO: 502974 - RNA, 32 nt, Human
uccuuuggucaaugaaaacuuggcuuuaagac

SEQ ID NO: 502975 - RNA, 32 nt, Human
uccuuugguccaguaggaggugcccuucacuc

SEQ ID NO: 502976 - RNA, 32 nt, Human
uccuuugguggaccccaggacuucggcccacu

SEQ ID NO: 502977 - RNA, 32 nt, Human
uccuuuguagauccgcaacuuaaggauuuugu

SEQ ID NO: 502978 - RNA, 22 nt, Human
uccuuuguauaggacccugaca

SEQ ID NO: 502979 - RNA, 32 nt, Human
uccuuuguauaugaugcagcagcauaaaugua

SEQ ID NO: 502980 - RNA, 32 nt, Human
uccuuuguauucucucagugccuuacagcagg

SEQ ID NO: 502981 - RNA, 32 nt, Human
uccuuugucaucuguugccacauccauggaac

SEQ ID NO: 502982 - RNA, 32 nt, Human
uccuuugugaagagcauccauuuaaaagacuu

SEQ ID NO: 502983 - RNA, 32 nt, Human
uccuuugugccaggccccaucuggauguccau

SEQ ID NO: 502984 - RNA, 32 nt, Human
uccuuuguucuuucaguacuuugaggcgacaa

SEQ ID NO: 502985 - RNA, 32 nt, Human
uccuuuguugcaaaaguguggacacuuuugac

SEQ ID NO: 502986 - RNA, 32 nt, Human
uccuuuguuguucucaggaacauaguugcagg

SEQ ID NO: 502987 - RNA, 32 nt, Human
uccuuuuaaacaauguaugaaagauguauuuu

SEQ ID NO: 502988 - RNA, 32 nt, Human
uccuuuuaacuccagagccucugggucucccc

SEQ ID NO: 502989 - RNA, 32 nt, Human
uccuuuuaagccugcagaacuguaaguaaauu

SEQ ID NO: 502990 - RNA, 32 nt, Human
uccuuuuacagugaggugucucucacuggggg

SEQ ID NO: 502991 - RNA, 32 nt, Human
uccuuuuaccccuaugucccccggcuauacuu

SEQ ID NO: 502992 - RNA, 32 nt, Human
uccuuuuagcugguugugcuuugacuaacuga

SEQ ID NO: 502993 - RNA, 32 nt, Human
uccuuuucaaaaacuggagacacagaagaggg

SEQ ID NO: 502994 - RNA, 32 nt, Human
uccuuuucaacacaucuauugaaaguguugga

SEQ ID NO: 502995 - RNA, 32 nt, Human
uccuuuucaccucauagaggaaucaagcaaga

SEQ ID NO: 502996 - RNA, 32 nt, Human
uccuuuucacuggaugauguaugagggaauuu

SEQ ID NO: 502997 - RNA, 32 nt, Human
uccuuuucaugccuagcaucugcuugaguuau

SEQ ID NO: 502998 - RNA, 32 nt, Human
uccuuuucauuguuccauaguauuccaucgug

SEQ ID NO: 502999 - RNA, 32 nt, Human
uccuuuuccacaauaggccagaaagugcucca

SEQ ID NO: 503000 - RNA, 24 nt, Human
uccuuuuccacaucccuaacagca

SEQ ID NO: 503001 - RNA, 32 nt, Human
uccuuuuccaggcugcugaguaaagucuggcu

SEQ ID NO: 503002 - RNA, 24 nt, Human
uccuuuucccacaguucugggaca

SEQ ID NO: 503003 - RNA, 22 nt, Human
uccuuuucccguuuagucccag

SEQ ID NO: 503004 - RNA, 24 nt, Human
uccuuuucccuaaucauucccuuu

SEQ ID NO: 503005 - RNA, 32 nt, Human
uccuuuucccuccaccaugaagauggguuaag

SEQ ID NO: 503006 - RNA, 21 nt, Human
uccuuuucccucccucuuccc

SEQ ID NO: 503007 - RNA, 21 nt, Human
uccuuuucccucucccuuucc

SEQ ID NO: 503008 - RNA, 32 nt, Human
uccuuuucccucucucccuuggaguaucaaug

SEQ ID NO: 503009 - RNA, 22 nt, Human
uccuuuuccucccucccuuccu

SEQ ID NO: 503010 - RNA, 32 nt, Human
uccuuuuccucuucuagaacuuaccuacagug

SEQ ID NO: 503011 - RNA, 32 nt, Human
uccuuuuccucuucucucuuugccuggcuucc

SEQ ID NO: 503012 - RNA, 32 nt, Human
uccuuuuccucuugugaccaccacaugucuag

SEQ ID NO: 503013 - RNA, 32 nt, Human
uccuuuuccuucaagccuagcccuucucucau

SEQ ID NO: 503014 - RNA, 22 nt, Human
uccuuuuccuuucucugguaac

SEQ ID NO: 503015 - RNA, 32 nt, Human
uccuuuuccuuuuccuccucucuuccuuaccu

SEQ ID NO: 503016 - RNA, 32 nt, Human
uccuuuucuaacucucccuugcucgcuguaaa

SEQ ID NO: 503017 - RNA, 32 nt, Human
uccuuuucuauuggcacagcugccgucauucc

SEQ ID NO: 503018 - RNA, 32 nt, Human
uccuuuucucacucuuucucucaucacucacc

SEQ ID NO: 503019 - RNA, 32 nt, Human
uccuuuucuccccucauuuccucuucuccuua

SEQ ID NO: 503020 - RNA, 32 nt, Human
uccuuuucuccucucucugcaucugcgcuuuc

SEQ ID NO: 503021 - RNA, 32 nt, Human
uccuuuucucugagaaagguaauagauaacca

SEQ ID NO: 503022 - RNA, 32 nt, Human
uccuuuucugagugagucuaggauaguuucuu

SEQ ID NO: 503023 - RNA, 24 nt, Human
uccuuuucugaugguggcuggggc

SEQ ID NO: 503024 - RNA, 32 nt, Human
uccuuuucugcuguaacgaaaguuugcaauag

SEQ ID NO: 503025 - RNA, 22 nt, Human
uccuuuucugggcccuagcaca

SEQ ID NO: 503026 - RNA, 32 nt, Human
uccuuuucuguccaccuucccucucucuucua

SEQ ID NO: 503027 - RNA, 32 nt, Human
uccuuuucuguggcuuuuaauuuggaauuuuc

SEQ ID NO: 503028 - RNA, 23 nt, Human
uccuuuucuuguuccugaucuca

SEQ ID NO: 503029 - RNA, 32 nt, Human
uccuuuucuuucuuccuuccuuucuuucuucc

SEQ ID NO: 503030 - RNA, 32 nt, Human
uccuuuucuuuucuccccuugggucuuauuau

SEQ ID NO: 503031 - RNA, 32 nt, Human
uccuuuugaaguauuccuucagauccugcaug

SEQ ID NO: 503032 - RNA, 32 nt, Human
uccuuuugccacccccuccuucccugccucuu

SEQ ID NO: 503033 - RNA, 32 nt, Human
uccuuuugccagucaccaccagccugaccuca

SEQ ID NO: 503034 - RNA, 32 nt, Human
uccuuuugccuucugguauacuuccuuacuuu

SEQ ID NO: 503035 - RNA, 32 nt, Human
uccuuuugccuuggcuuagaggcugcagcacu

SEQ ID NO: 503036 - RNA, 32 nt, Human
uccuuuuggagggagagcagagaccaugucug

SEQ ID NO: 503037 - RNA, 32 nt, Human
uccuuuuggccagcucuaaagcagcaguggac

SEQ ID NO: 503038 - RNA, 32 nt, Human
uccuuuuggcugccaccugcacugcugccauc

SEQ ID NO: 503039 - RNA, 32 nt, Human
uccuuuuggggugaugaaauguuagggaacua

SEQ ID NO: 503040 - RNA, 25 nt, Human
uccuuuugguugcaaauaacaggaa

SEQ ID NO: 503041 - RNA, 32 nt, Human
uccuuuuguaucauucagccuuuuguuuuagu

SEQ ID NO: 503042 - RNA, 32 nt, Human
uccuuuuguuaacugaugaaguugaucagauc

SEQ ID NO: 503043 - RNA, 32 nt, Human
uccuuuuguuacugaaguguguuuuauggacu

SEQ ID NO: 503044 - RNA, 32 nt, Human
uccuuuuguuauauacacaguauuauaugcac

SEQ ID NO: 503045 - RNA, 32 nt, Human
uccuuuuuaaacuucuccccugcuuuauuugg

SEQ ID NO: 503046 - RNA, 32 nt, Human
uccuuuuuaagcugcaaagaagcauuugcaga

SEQ ID NO: 503047 - RNA, 32 nt, Human
uccuuuuuacagucuuugucuuugcagcaagc

SEQ ID NO: 503048 - RNA, 32 nt, Human
uccuuuuuaccucauuuauuugguacuuuccc

SEQ ID NO: 503049 - RNA, 32 nt, Human
uccuuuuuacucuccuguaucuuuuucacucc

SEQ ID NO: 503050 - RNA, 32 nt, Human
uccuuuuuauagcagcccucucaccagaagau

SEQ ID NO: 503051 - RNA, 32 nt, Human
uccuuuuuauguuuggaggcagugacaaaagg

SEQ ID NO: 503052 - RNA, 23 nt, Human
uccuuuuuauuucuuugguaaca

SEQ ID NO: 503053 - RNA, 32 nt, Human
uccuuuuucacucacaaacagcagggagguca

SEQ ID NO: 503054 - RNA, 32 nt, Human
uccuuuuucacuugaccacccuugcucauugg

SEQ ID NO: 503055 - RNA, 32 nt, Human
uccuuuuucauaauuaauuuuauccaagauug

SEQ ID NO: 503056 - RNA, 32 nt, Human
uccuuuuuccuccucuuccuccuuccuccuuc

SEQ ID NO: 503057 - RNA, 32 nt, Human
uccuuuuucugggucccuucccacuuccuucc

SEQ ID NO: 503058 - RNA, 32 nt, Human
uccuuuuugccucuuugccauuuccuuggaaa

SEQ ID NO: 503059 - RNA, 32 nt, Human
uccuuuuuggugagcuucauggguggaguuau

SEQ ID NO: 503060 - RNA, 32 nt, Human
uccuuuuuggugggcugggcugacggcacaac

SEQ ID NO: 503061 - RNA, 21 nt, Human
uccuuuuuuaauccagcagca

SEQ ID NO: 503062 - RNA, 32 nt, Human
ucgaaaaagcccaagacagcagaagcagacac

SEQ ID NO: 503063 - RNA, 32 nt, Human
ucgaaaaauacuggguaagcuguaaagaacuc

SEQ ID NO: 503064 - RNA, 32 nt, Human
ucgaaaacacagaagaaugaaggacaugccag

SEQ ID NO: 503065 - RNA, 32 nt, Human
ucgaaaaccagccugaccaacguggagaaacc

SEQ ID NO: 503066 - RNA, 32 nt, Human
ucgaaaaccuaaacgugaucaucucuuggaug

SEQ ID NO: 503067 - RNA, 32 nt, Human
ucgaaaagaaaaggagaaauaaaucaaacagc

SEQ ID NO: 503068 - RNA, 32 nt, Human
ucgaaaagagcacuucacacagacaaguggcu

SEQ ID NO: 503069 - RNA, 32 nt, Human
ucgaaacaaaggauccaggauuuaacugggag

SEQ ID NO: 503070 - RNA, 32 nt, Human
ucgaaacaauccuggccaacauggugaaacca

SEQ ID NO: 503071 - RNA, 32 nt, Human
ucgaaacaggcaguguuguaagcacggggaca

SEQ ID NO: 503072 - RNA, 32 nt, Human
ucgaaaccagcauauuuuuggaaagcuaaaug

SEQ ID NO: 503073 - RNA, 32 nt, Human
ucgaaaccagccuggccaaaacagugaaaccc

SEQ ID NO: 503074 - RNA, 32 nt, Human
ucgaaaccagccuggccaacaaggugagaccc

SEQ ID NO: 503075 - RNA, 32 nt, Human
ucgaaaccagccuggccaacauagugaaaccc

SEQ ID NO: 503076 - RNA, 32 nt, Human
ucgaaaccagccuggccaacauggagaaaccc

SEQ ID NO: 503077 - RNA, 32 nt, Human
ucgaaaccagccuggccaacauggugaaaccc

SEQ ID NO: 503078 - RNA, 32 nt, Human
ucgaaaccagccuggccaacuugaugaaaccc

SEQ ID NO: 503079 - RNA, 32 nt, Human
ucgaaaccagccugggcaacauagugagaccc

SEQ ID NO: 503080 - RNA, 32 nt, Human
ucgaaaccagccuucccaacauggugaaaccc

SEQ ID NO: 503081 - RNA, 32 nt, Human
ucgaaaccauccuggcuaacacggugaaaccu

SEQ ID NO: 503082 - RNA, 32 nt, Human
ucgaaacgcacgggcagggacacacacgacac

SEQ ID NO: 503083 - RNA, 32 nt, Human
ucgaaacguuuucauccaugcuuagcaucuac

SEQ ID NO: 503084 - RNA, 32 nt, Human
ucgaaacuagccuggccaacaucaugaaaccc

SEQ ID NO: 503085 - RNA, 32 nt, Human
ucgaaagcacuggccccgaacuguguuucugc

SEQ ID NO: 503086 - RNA, 32 nt, Human
ucgaaagcauuaauucacuuuccuuuuuccua

SEQ ID NO: 503087 - RNA, 32 nt, Human
ucgaaaggucuccagccucaucgaauucuuga

SEQ ID NO: 503088 - RNA, 32 nt, Human
ucgaaaguuggcaaauggggccaaggcugcac

SEQ ID NO: 503089 - RNA, 32 nt, Human
ucgaaaucagccuggccaagaugaugaagccc

SEQ ID NO: 503090 - RNA, 32 nt, Human
ucgaaaugcugugccaguugcucugguauuca

SEQ ID NO: 503091 - RNA, 32 nt, Human
ucgaaauucuggagucaagcagucugccugcc

SEQ ID NO: 503092 - RNA, 32 nt, Human
ucgaacauacucaaacacuuuugggccaggau

SEQ ID NO: 503093 - RNA, 32 nt, Human
ucgaaccauuguacuccagccugggugacaga

SEQ ID NO: 503094 - RNA, 32 nt, Human
ucgaacccaggaggcagagguugcagugagcc

SEQ ID NO: 503095 - RNA, 32 nt, Human
ucgaacccaggagguggagguugcagugagcc

SEQ ID NO: 503096 - RNA, 23 nt, Human
ucgaaccccugaccucaagugau

SEQ ID NO: 503097 - RNA, 22 nt, Human
ucgaaccccugagcucagguga

SEQ ID NO: 503098 - RNA, 32 nt, Human
ucgaacccucgcuuuccagcagucgccggauu

SEQ ID NO: 503099 - RNA, 32 nt, Human
ucgaacucaggggguggagguugcagugaguu

SEQ ID NO: 503100 - RNA, 22 nt, Human
ucgaacuccagaccucagguga

SEQ ID NO: 503101 - RNA, 22 nt, Human
ucgaacucccaaccucagguga

SEQ ID NO: 503102 - RNA, 22 nt, Human
ucgaacucccagccucagguga

SEQ ID NO: 503103 - RNA, 23 nt, Human
ucgaacucccgaccucaagugau

SEQ ID NO: 503104 - RNA, 22 nt, Human
ucgaacucccgaccucagguga

SEQ ID NO: 503105 - RNA, 22 nt, Human
ucgaacucccgaucucagguga

SEQ ID NO: 503106 - RNA, 22 nt, Human
ucgaacuccgcaucucagguga

SEQ ID NO: 503107 - RNA, 23 nt, Human
ucgaacuccuaaccucaagugau

SEQ ID NO: 503108 - RNA, 23 nt, Human
ucgaacuccuagccucaagcgau

SEQ ID NO: 503109 - RNA, 23 nt, Human
ucgaacuccugaacgcaagugau

SEQ ID NO: 503110 - RNA, 24 nt, Human
ucgaacuccugaacucaagugauu

SEQ ID NO: 503111 - RNA, 23 nt, Human
ucgaacuccugaccucaagcgau

SEQ ID NO: 503112 - RNA, 22 nt, Human
ucgaacuccugaccucaaguga

SEQ ID NO: 503113 - RNA, 23 nt, Human
ucgaacuccugaccucaagugau

SEQ ID NO: 503114 - RNA, 22 nt, Human
ucgaacuccugaccucagguga

SEQ ID NO: 503115 - RNA, 32 nt, Human
ucgaacuccugacugaccuugugguccaccug

SEQ ID NO: 503116 - RNA, 22 nt, Human
ucgaacuccugacuuuagguga

SEQ ID NO: 503117 - RNA, 22 nt, Human
ucgaacuccugagcucagguga

SEQ ID NO: 503118 - RNA, 22 nt, Human
ucgaacuccugaucucagguga

SEQ ID NO: 503119 - RNA, 32 nt, Human
ucgaacuccugcauuccaaccagccuggguga

SEQ ID NO: 503120 - RNA, 22 nt, Human
ucgaacuccugcccucagguga

SEQ ID NO: 503121 - RNA, 23 nt, Human
ucgaacuccuggccucaagcgau

SEQ ID NO: 503122 - RNA, 23 nt, Human
ucgaacuccuggccucaagugau

SEQ ID NO: 503123 - RNA, 24 nt, Human
ucgaacuccuggccucaagugauu

SEQ ID NO: 503124 - RNA, 22 nt, Human
ucgaacuccuggccucagguga

SEQ ID NO: 503125 - RNA, 22 nt, Human
ucgaacuccuggcucaagugau

SEQ ID NO: 503126 - RNA, 23 nt, Human
ucgaacuccugggcucaacugau

SEQ ID NO: 503127 - RNA, 19 nt, Human
ucgaacuccugggcucaag

SEQ ID NO: 503128 - RNA, 23 nt, Human
ucgaacuccugggcucaagcgau

SEQ ID NO: 503129 - RNA, 23 nt, Human
ucgaacuccugggcucaagugau

SEQ ID NO: 503130 - RNA, 22 nt, Human
ucgaacuccugggcucggguga

SEQ ID NO: 503131 - RNA, 22 nt, Human
ucgaacuccuuaccucagguga

SEQ ID NO: 503132 - RNA, 23 nt, Human
ucgaacucuaggcucaagugauu

SEQ ID NO: 503133 - RNA, 32 nt, Human
ucgaacucuguaaucccagcacuuugggaggc

SEQ ID NO: 503134 - RNA, 21 nt, Human
ucgaacucuuucuuucuucca

SEQ ID NO: 503135 - RNA, 32 nt, Human
ucgaacugcuguagcuggcacaucauugggcu

SEQ ID NO: 503136 - RNA, 32 nt, Human
ucgaacuucucaacccucagagacuuagaucu

SEQ ID NO: 503137 - RNA, 23 nt, Human
ucgaacuucugagcucaagcgau

SEQ ID NO: 503138 - RNA, 24 nt, Human
ucgaacuucugggcucaagcaauu

SEQ ID NO: 503139 - RNA, 32 nt, Human
ucgaagacaaaacacauuucuacccaaguuua

SEQ ID NO: 503140 - RNA, 32 nt, Human
ucgaagacaaggcuuuugaauuaacugaaucc

SEQ ID NO: 503141 - RNA, 32 nt, Human
ucgaagacucgagagggggaggggguaaggag

SEQ ID NO: 503142 - RNA, 32 nt, Human
ucgaagagauggggucuggcuguguugcccag

SEQ ID NO: 503143 - RNA, 21 nt, Human
ucgaagauguagggagcacuu

SEQ ID NO: 503144 - RNA, 20 nt, Human
ucgaagcagccacugagcca

SEQ ID NO: 503145 - RNA, 22 nt, Human
ucgaagccacuucugaagccac

SEQ ID NO: 503146 - RNA, 32 nt, Human
ucgaagccagccugggcaacaaagugagaccg

SEQ ID NO: 503147 - RNA, 32 nt, Human
ucgaagccaggaguucgaaaccagccugugca

SEQ ID NO: 503148 - RNA, 32 nt, Human
ucgaagccucuuugcugaccuggaggugaucu

SEQ ID NO: 503149 - RNA, 32 nt, Human
ucgaagcucacugugccucuuguuuccgaggg

SEQ ID NO: 503150 - RNA, 32 nt, Human
ucgaaggacacacacuuccacacuguuuguga

SEQ ID NO: 503151 - RNA, 19 nt, Human
ucgaaggagcagccugggc

SEQ ID NO: 503152 - RNA, 32 nt, Human
ucgaaggcgccuucuccuccugggagaucgug

SEQ ID NO: 503153 - RNA, 32 nt, Human
ucgaaggcucaggugauucucucaccucagcc

SEQ ID NO: 503154 - RNA, 22 nt, Human
ucgaaguaguugggacuacagg

SEQ ID NO: 503155 - RNA, 32 nt, Human
ucgaagucacaugauaacacacacaggagaug

SEQ ID NO: 503156 - RNA, 32 nt, Human
ucgaagucagaaggcuggggcagaucacuuca

SEQ ID NO: 503157 - RNA, 32 nt, Human
ucgaagucagccuggccaacguggugaaaccc

SEQ ID NO: 503158 - RNA, 32 nt, Human
ucgaaguccaauaacuguagacuucagaagaa

SEQ ID NO: 503159 - RNA, 32 nt, Human
ucgaagucccucucuuuugccaacccucauuu

SEQ ID NO: 503160 - RNA, 32 nt, Human
ucgaagucucacugcaccagugucuuugaugg

SEQ ID NO: 503161 - RNA, 32 nt, Human
ucgaagucuugaauccuagcuaguuugggguu

SEQ ID NO: 503162 - RNA, 32 nt, Human
ucgaagugguuccuuggcagacugccuuuccu

SEQ ID NO: 503163 - RNA, 32 nt, Human
ucgaaguugagggugcaaaaaugcagaguaau

SEQ ID NO: 503164 - RNA, 32 nt, Human
ucgaauacuaccuuugugugccucagggccuc

SEQ ID NO: 503165 - RNA, 32 nt, Human
ucgaauacuguucgcucgcugugugaccuugg

SEQ ID NO: 503166 - RNA, 32 nt, Human
ucgaauaucugguuuuaaaugauagagguuuu

SEQ ID NO: 503167 - RNA, 32 nt, Human
ucgaauccuggaggaggaaauaaagggaaagg

SEQ ID NO: 503168 - RNA, 32 nt, Human
ucgaaucuggaacuuccacaccugaggcaccu

SEQ ID NO: 503169 - RNA, 29 nt, Human
ucgaaugacuucagcaagauccugcuuuc

SEQ ID NO: 503170 - RNA, 32 nt, Human
ucgaauuaauuaagcugacaaaaugaaaauga

SEQ ID NO: 503171 - RNA, 32 nt, Human
ucgaauuugggagccagcgagggaccugacag

SEQ ID NO: 503172 - RNA, 32 nt, Human
ucgacaacuacaugcaacaagaugcccaugaa

SEQ ID NO: 503173 - RNA, 21 nt, Human
ucgacaaggucucacucuguc

SEQ ID NO: 503174 - RNA, 20 nt, Human
ucgacacaaauucuacagcu

SEQ ID NO: 503175 - RNA, 32 nt, Human
ucgacaccaaccugagcaacauggcgaaaccc

SEQ ID NO: 503176 - RNA, 32 nt, Human
ucgacaccagccuggccaacacagugaaaugu

SEQ ID NO: 503177 - RNA, 32 nt, Human
ucgacaccagccuggccaacauggugaaaccu

SEQ ID NO: 503178 - RNA, 32 nt, Human
ucgacaccauccuggcuaacacggugaaaccc

SEQ ID NO: 503179 - RNA, 32 nt, Human
ucgacaccaucuugggcaacauggugaaaccc

SEQ ID NO: 503180 - RNA, 32 nt, Human
ucgacacccaaccccugaaccccacacacucu

SEQ ID NO: 503181 - RNA, 32 nt, Human
ucgacaccgccaggaccuggagggggugccug

SEQ ID NO: 503182 - RNA, 32 nt, Human
ucgacacugugggugaggccugguuuuuguuu

SEQ ID NO: 503183 - RNA, 32 nt, Human
ucgacagcacagaagggcuguccugugucccc

SEQ ID NO: 503184 - RNA, 32 nt, Human
ucgacagcaguguuuucucuccuuuucugggc

SEQ ID NO: 503185 - RNA, 32 nt, Human
ucgacagcaugcuggccaacguggugaaaccc

SEQ ID NO: 503186 - RNA, 32 nt, Human
ucgacagcauuuuccucugcuuugaaagcccc

SEQ ID NO: 503187 - RNA, 25 nt, Human
ucgacagccuucaggagccggucug

SEQ ID NO: 503188 - RNA, 32 nt, Human
ucgacagugagcugaguacuucagaauuggag

SEQ ID NO: 503189 - RNA, 32 nt, Human
ucgacaguucucuuguauuugcuuccuagguu

SEQ ID NO: 503190 - RNA, 32 nt, Human
ucgacauccugcacacccucagccuggcgcug

SEQ ID NO: 503191 - RNA, 32 nt, Human
ucgacaugagauaccuggcauuuugggaagug

SEQ ID NO: 503192 - RNA, 24 nt, Human
ucgacauugagaccaagaugcacg

SEQ ID NO: 503193 - RNA, 31 nt, Human
ucgaccaacaacaacgaggaggagaaguccc

SEQ ID NO: 503194 - RNA, 32 nt, Human
ucgaccacauaggaauuuccaggcaccaaaau

SEQ ID NO: 503195 - RNA, 28 nt, Human
ucgaccagcuucuuugugccucuuuucu

SEQ ID NO: 503196 - RNA, 32 nt, Human
ucgaccagcuucuuugugccucuuuucucucc

SEQ ID NO: 503197 - RNA, 32 nt, Human
ucgaccaggcuggagugcaggggcacaaucuu

SEQ ID NO: 503198 - RNA, 32 nt, Human
ucgaccaguccucccuucuguucucucuuucc

SEQ ID NO: 503199 - RNA, 32 nt, Human
ucgacccaucaggacgccagagcugcuucagc

SEQ ID NO: 503200 - RNA, 32 nt, Human
ucgaccccaaguugaaaaggaauuugguuucu

SEQ ID NO: 503201 - RNA, 32 nt, Human
ucgacccccuggggccccagucuggcucaguc

SEQ ID NO: 503202 - RNA, 32 nt, Human
ucgacccgccuuccucugcugaaaaggcugcu

SEQ ID NO: 503203 - RNA, 32 nt, Human
ucgacccugcccccuugggcucaggccccgcc

SEQ ID NO: 503204 - RNA, 19 nt, Human
ucgacccuucgccucggcc

SEQ ID NO: 503205 - RNA, 31 nt, Human
ucgaccggcagccuccgcacagcagaccuug

SEQ ID NO: 503206 - RNA, 32 nt, Human
ucgaccucacaaagugcugggauuacaggcau

SEQ ID NO: 503207 - RNA, 32 nt, Human
ucgaccucccaaagugcuaggauuacagguuu

SEQ ID NO: 503208 - RNA, 32 nt, Human
ucgaccucccaaagugcugagauuacaggcau

SEQ ID NO: 503209 - RNA, 32 nt, Human
ucgaccucccaaagugcugagauuacaggcuu

SEQ ID NO: 503210 - RNA, 32 nt, Human
ucgaccucccaaagugcugggauuacagaaug

SEQ ID NO: 503211 - RNA, 32 nt, Human
ucgaccucccaaagugcugggauuacaggcau

SEQ ID NO: 503212 - RNA, 32 nt, Human
ucgaccucccaaagugcugggauuacaggcgu

SEQ ID NO: 503213 - RNA, 32 nt, Human
ucgaccucccaaagugcugggauuacaggugu

SEQ ID NO: 503214 - RNA, 32 nt, Human
ucgaccucccaaagugcugugauuacaggugu

SEQ ID NO: 503215 - RNA, 32 nt, Human
ucgaccucccaggugauccucccaccucagcu

SEQ ID NO: 503216 - RNA, 32 nt, Human
ucgaccuccgcaccaaucaggugguggucauu

SEQ ID NO: 503217 - RNA, 32 nt, Human
ucgaccucucaaguagcugggauuacaagcac

SEQ ID NO: 503218 - RNA, 32 nt, Human
ucgacgaggcggagccgcgagagcgcggccca

SEQ ID NO: 503219 - RNA, 32 nt, Human
ucgacgccugugacagggagaaaggauacuuc

SEQ ID NO: 503220 - RNA, 32 nt, Human
ucgacggcugggccaccgucucggugaucgcg

SEQ ID NO: 503221 - RNA, 23 nt, Human
ucgacgggcuaggaacuguccug

SEQ ID NO: 503222 - RNA, 32 nt, Human
ucgacgugagcagccucagggcagagacggau

SEQ ID NO: 503223 - RNA, 32 nt, Human
ucgacucacaugggagaaucgaggucugcuac

SEQ ID NO: 503224 - RNA, 32 nt, Human
ucgacucacugcaaaaucugccucccggguuc

SEQ ID NO: 503225 - RNA, 32 nt, Human
ucgacucacugcaaccuccaccucccagguuc

SEQ ID NO: 503226 - RNA, 32 nt, Human
ucgacucacugcaaccuccgccucccgaguuc

SEQ ID NO: 503227 - RNA, 32 nt, Human
ucgacucacugcaaccucugccucccagguuc

SEQ ID NO: 503228 - RNA, 32 nt, Human
ucgacucacugcaaccuucgccucccaggaga

SEQ ID NO: 503229 - RNA, 32 nt, Human
ucgacucacugcaaccuucgccucccagguuc

SEQ ID NO: 503230 - RNA, 32 nt, Human
ucgacucacugcaacuuccaccuccuggaguc

SEQ ID NO: 503231 - RNA, 32 nt, Human
ucgacucacugcaagcuccgccucccggguuc

SEQ ID NO: 503232 - RNA, 32 nt, Human
ucgacucacugcagccuccgccuccuggguuc

SEQ ID NO: 503233 - RNA, 32 nt, Human
ucgacucacugcagccuugaccucccgggccc

SEQ ID NO: 503234 - RNA, 32 nt, Human
ucgacuccaguucuggcugcccgcgggccucu

SEQ ID NO: 503235 - RNA, 32 nt, Human
ucgacucggcuuucuugccaaaggaggguucc

SEQ ID NO: 503236 - RNA, 32 nt, Human
ucgacucucccaaaagaggucgguauuuuaga

SEQ ID NO: 503237 - RNA, 32 nt, Human
ucgacugaccucaacaggugucuccaagcagc

SEQ ID NO: 503238 - RNA, 32 nt, Human
ucgacugccguguuccuuuuccucuuggaggu

SEQ ID NO: 503239 - RNA, 32 nt, Human
ucgacuggaggcugccaggaauucaggaugca

SEQ ID NO: 503240 - RNA, 32 nt, Human
ucgacuucccaaagugcugggauuacagcgug

SEQ ID NO: 503241 - RNA, 32 nt, Human
ucgacuucccaaagugcugggauuacaggugu

SEQ ID NO: 503242 - RNA, 32 nt, Human
ucgacuucccagagugcugggauuacaggcgu

SEQ ID NO: 503243 - RNA, 32 nt, Human
ucgacuucugggcccgccuccauggccagguc

SEQ ID NO: 503244 - RNA, 32 nt, Human
ucgacuuuccugauaauucugaugucucaagc

SEQ ID NO: 503245 - RNA, 18 nt, Human
ucgacuuugccccagcca

SEQ ID NO: 503246 - RNA, 32 nt, Human
ucgagaaaagccugggcaacauggugaaaccc

SEQ ID NO: 503247 - RNA, 32 nt, Human
ucgagaacagccuggcuaacacggugaaaccc

SEQ ID NO: 503248 - RNA, 32 nt, Human
ucgagaacagucuggccaacauggcgaaaccu

SEQ ID NO: 503249 - RNA, 32 nt, Human
ucgagaagcagcacaaaacagaguaagacagu

SEQ ID NO: 503250 - RNA, 32 nt, Human
ucgagaagccaagggugaggaggcaggaagca

SEQ ID NO: 503251 - RNA, 32 nt, Human
ucgagaagugagagagggucgggggcgguggc

SEQ ID NO: 503252 - RNA, 32 nt, Human
ucgagaauacccuggccaacauggugaaaccc

SEQ ID NO: 503253 - RNA, 32 nt, Human
ucgagacaauccuggccaacauggugaaaccc

SEQ ID NO: 503254 - RNA, 32 nt, Human
ucgagaccaaccuagccaacauggugaaaccc

SEQ ID NO: 503255 - RNA, 32 nt, Human
ucgagaccaaccuggccaaaguggugaaaccc

SEQ ID NO: 503256 - RNA, 32 nt, Human
ucgagaccaaccuggcuaacacagugaaaccc

SEQ ID NO: 503257 - RNA, 32 nt, Human
ucgagaccaaccuggcuaacacggugaaaccc

SEQ ID NO: 503258 - RNA, 32 nt, Human
ucgagaccaaccuugggcaacauagcaagacc

SEQ ID NO: 503259 - RNA, 32 nt, Human
ucgagaccaacuugggcaacauggugaaacac

SEQ ID NO: 503260 - RNA, 32 nt, Human
ucgagaccacccuggccaacauggugaaaccc

SEQ ID NO: 503261 - RNA, 32 nt, Human
ucgagaccacccuggccaacguggugaaaccc

SEQ ID NO: 503262 - RNA, 32 nt, Human
ucgagaccacccuggccaauauggugaaaccc

SEQ ID NO: 503263 - RNA, 32 nt, Human
ucgagaccacccuggcuaacacggugaaaccc

SEQ ID NO: 503264 - RNA, 32 nt, Human
ucgagaccacccuggcuaacauggugaaagcc

SEQ ID NO: 503265 - RNA, 32 nt, Human
ucgagaccacccugggcaacauggugaaaccc

SEQ ID NO: 503266 - RNA, 32 nt, Human
ucgagaccagcaccagccuggccaacacggug

SEQ ID NO: 503267 - RNA, 32 nt, Human
ucgagaccagcaugaccaacauggugaaaccc

SEQ ID NO: 503268 - RNA, 32 nt, Human
ucgagaccagccagaccaacaugaugaaaccc

SEQ ID NO: 503269 - RNA, 32 nt, Human
ucgagaccagccaggccaacauggugaaaacu

SEQ ID NO: 503270 - RNA, 32 nt, Human
ucgagaccagccaggccaacauggugaaaccc

SEQ ID NO: 503271 - RNA, 32 nt, Human
ucgagaccagccagggcaacauggugaaaccc

SEQ ID NO: 503272 - RNA, 32 nt, Human
ucgagaccagcccagccaacauggcgaaacca

SEQ ID NO: 503273 - RNA, 32 nt, Human
ucgagaccagcccggccaacauggugaaaccc

SEQ ID NO: 503274 - RNA, 32 nt, Human
ucgagaccagccgggccaacauggugaaaccc

SEQ ID NO: 503275 - RNA, 32 nt, Human
ucgagaccagccuaaacaacauagugaaaccc

SEQ ID NO: 503276 - RNA, 32 nt, Human
ucgagaccagccuaaccaacauggugaaaccc

SEQ ID NO: 503277 - RNA, 32 nt, Human
ucgagaccagccuagccaacauggugaaaccu

SEQ ID NO: 503278 - RNA, 32 nt, Human
ucgagaccagccuagccaacauggugaacuac

SEQ ID NO: 503279 - RNA, 32 nt, Human
ucgagaccagccuagcuaacaugguaaaacuc

SEQ ID NO: 503280 - RNA, 32 nt, Human
ucgagaccagccuaggcaacauggagaaaccc

SEQ ID NO: 503281 - RNA, 32 nt, Human
ucgagaccagccuaggugacauagugagaccc

SEQ ID NO: 503282 - RNA, 32 nt, Human
ucgagaccagccucagcaacacagugaaaccc

SEQ ID NO: 503283 - RNA, 32 nt, Human
ucgagaccagccucgccaacauggcgaaaccc

SEQ ID NO: 503284 - RNA, 32 nt, Human
ucgagaccagccugaacaacacggugaaaccc

SEQ ID NO: 503285 - RNA, 32 nt, Human
ucgagaccagccugaccaacacggugaaaccc

SEQ ID NO: 503286 - RNA, 32 nt, Human
ucgagaccagccugaccaacauagugaaaccc

SEQ ID NO: 503287 - RNA, 32 nt, Human
ucgagaccagccugaccaacaugaugaaaugc

SEQ ID NO: 503288 - RNA, 32 nt, Human
ucgagaccagccugaccaacauggagaaaccc

SEQ ID NO: 503289 - RNA, 32 nt, Human
ucgagaccagccugaccaacauggagaaacuc

SEQ ID NO: 503290 - RNA, 32 nt, Human
ucgagaccagccugaccaacauggagaaaugc

SEQ ID NO: 503291 - RNA, 32 nt, Human
ucgagaccagccugaccaacauggagaagccc

SEQ ID NO: 503292 - RNA, 32 nt, Human
ucgagaccagccugaccaacauggagauaucc

SEQ ID NO: 503293 - RNA, 32 nt, Human
ucgagaccagccugaccaacauggcaaaaccc

SEQ ID NO: 503294 - RNA, 32 nt, Human
ucgagaccagccugaccaacauggcgaaaccc

SEQ ID NO: 503295 - RNA, 32 nt, Human
ucgagaccagccugaccaacaugguaaaacca

SEQ ID NO: 503296 - RNA, 32 nt, Human
ucgagaccagccugaccaacauggugaaaacc

SEQ ID NO: 503297 - RNA, 32 nt, Human
ucgagaccagccugaccaacauggugaaacac

SEQ ID NO: 503298 - RNA, 32 nt, Human
ucgagaccagccugaccaacauggugaaaccc

SEQ ID NO: 503299 - RNA, 32 nt, Human
ucgagaccagccugaccaacauggugaaaccu

SEQ ID NO: 503300 - RNA, 32 nt, Human
ucgagaccagccugaccaacauggugaaacgc

SEQ ID NO: 503301 - RNA, 32 nt, Human
ucgagaccagccugaccaacauggugaaagcc

SEQ ID NO: 503302 - RNA, 32 nt, Human
ucgagaccagccugaccaacauggugaaaucc

SEQ ID NO: 503303 - RNA, 32 nt, Human
ucgagaccagccugaccaacauggugagaccc

SEQ ID NO: 503304 - RNA, 32 nt, Human
ucgagaccagccugaccaacauggugaggccc

SEQ ID NO: 503305 - RNA, 32 nt, Human
ucgagaccagccugaccaacguggugaaaccc

SEQ ID NO: 503306 - RNA, 32 nt, Human
ucgagaccagccugaccaagaugaugaaacgc

SEQ ID NO: 503307 - RNA, 32 nt, Human
ucgagaccagccugaccaauauggugaaaccc

SEQ ID NO: 503308 - RNA, 32 nt, Human
ucgagaccagccugaccagcaugguggaaccc

SEQ ID NO: 503309 - RNA, 32 nt, Human
ucgagaccagccugagaaacauagugagcccu

SEQ ID NO: 503310 - RNA, 32 nt, Human
ucgagaccagccugagcaacacugugagaccc

SEQ ID NO: 503311 - RNA, 32 nt, Human
ucgagaccagccugagcaacauggcgaaaccc

SEQ ID NO: 503312 - RNA, 32 nt, Human
ucgagaccagccugagcaacauggugaaaccc

SEQ ID NO: 503313 - RNA, 32 nt, Human
ucgagaccagccugaucggcauggugaaaccc

SEQ ID NO: 503314 - RNA, 32 nt, Human
ucgagaccagccugccaacauggugaaacccu

SEQ ID NO: 503315 - RNA, 32 nt, Human
ucgagaccagccugcccaaaaaggugaaaccc

SEQ ID NO: 503316 - RNA, 32 nt, Human
ucgagaccagccugcccaaauggugaaacccc

SEQ ID NO: 503317 - RNA, 32 nt, Human
ucgagaccagccugcccaacauggugaaaccu

SEQ ID NO: 503318 - RNA, 32 nt, Human
ucgagaccagccugcccaauauggugaaaccc

SEQ ID NO: 503319 - RNA, 32 nt, Human
ucgagaccagccugccuaacauggugaaaccc

SEQ ID NO: 503320 - RNA, 32 nt, Human
ucgagaccagccuggaaaauguggugaaaucc

SEQ ID NO: 503321 - RNA, 32 nt, Human
ucgagaccagccuggacaacauagugagaccc

SEQ ID NO: 503322 - RNA, 32 nt, Human
ucgagaccagccuggacaacauagugagaccu

SEQ ID NO: 503323 - RNA, 32 nt, Human
ucgagaccagccuggacaacaucgugaaaccu

SEQ ID NO: 503324 - RNA, 32 nt, Human
ucgagaccagccuggacaacauugugaaaccu

SEQ ID NO: 503325 - RNA, 32 nt, Human
ucgagaccagccuggcaaacauggcgaaaccc

SEQ ID NO: 503326 - RNA, 32 nt, Human
ucgagaccagccuggcaacauggcaagacccu

SEQ ID NO: 503327 - RNA, 32 nt, Human
ucgagaccagccuggccaaaauagugaaacuc

SEQ ID NO: 503328 - RNA, 32 nt, Human
ucgagaccagccuggccaacaaggugaaaccc

SEQ ID NO: 503329 - RNA, 32 nt, Human
ucgagaccagccuggccaacacggugaaaacc

SEQ ID NO: 503330 - RNA, 32 nt, Human
ucgagaccagccuggccaacacggugaaaccc

SEQ ID NO: 503331 - RNA, 32 nt, Human
ucgagaccagccuggccaacacggugagaccc

SEQ ID NO: 503332 - RNA, 32 nt, Human
ucgagaccagccuggccaacacuggucucugu

SEQ ID NO: 503333 - RNA, 23 nt, Human
ucgagaccagccuggccaacaua

SEQ ID NO: 503334 - RNA, 32 nt, Human
ucgagaccagccuggccaacauaguaaaaccu

SEQ ID NO: 503335 - RNA, 32 nt, Human
ucgagaccagccuggccaacauagugaaaccc

SEQ ID NO: 503336 - RNA, 23 nt, Human
ucgagaccagccuggccaacaug

SEQ ID NO: 503337 - RNA, 32 nt, Human
ucgagaccagccuggccaacaugaugaaaccc

SEQ ID NO: 503338 - RNA, 32 nt, Human
ucgagaccagccuggccaacaugaugaaaccu

SEQ ID NO: 503339 - RNA, 32 nt, Human
ucgagaccagccuggccaacauggcaaaacca

SEQ ID NO: 503340 - RNA, 32 nt, Human
ucgagaccagccuggccaacauggcaaaaccc

SEQ ID NO: 503341 - RNA, 32 nt, Human
ucgagaccagccuggccaacauggcaaaaccu

SEQ ID NO: 503342 - RNA, 32 nt, Human
ucgagaccagccuggccaacauggcaaaaucc

SEQ ID NO: 503343 - RNA, 32 nt, Human
ucgagaccagccuggccaacauggcaagaccc

SEQ ID NO: 503344 - RNA, 32 nt, Human
ucgagaccagccuggccaacauggcgaaaacc

SEQ ID NO: 503345 - RNA, 32 nt, Human
ucgagaccagccuggccaacauggcgaaacac

SEQ ID NO: 503346 - RNA, 32 nt, Human
ucgagaccagccuggccaacauggcgaaaccc

SEQ ID NO: 503347 - RNA, 32 nt, Human
ucgagaccagccuggccaacauggcgaaaccu

SEQ ID NO: 503348 - RNA, 32 nt, Human
ucgagaccagccuggccaacauggcgaaacuc

SEQ ID NO: 503349 - RNA, 32 nt, Human
ucgagaccagccuggccaacauggcgaaaucc

SEQ ID NO: 503350 - RNA, 32 nt, Human
ucgagaccagccuggccaacauggcggaaccc

SEQ ID NO: 503351 - RNA, 32 nt, Human
ucgagaccagccuggccaacaugguaaaaccc

SEQ ID NO: 503352 - RNA, 32 nt, Human
ucgagaccagccuggccaacaugguaaaacuc

SEQ ID NO: 503353 - RNA, 32 nt, Human
ucgagaccagccuggccaacaugguaaacgcu

SEQ ID NO: 503354 - RNA, 32 nt, Human
ucgagaccagccuggccaacauggucaaaacc

SEQ ID NO: 503355 - RNA, 32 nt, Human
ucgagaccagccuggccaacauggugaaaacc

SEQ ID NO: 503356 - RNA, 30 nt, Human
ucgagaccagccuggccaacauggugaaac

SEQ ID NO: 503357 - RNA, 32 nt, Human
ucgagaccagccuggccaacauggugaaaccc

SEQ ID NO: 503358 - RNA, 32 nt, Human
ucgagaccagccuggccaacauggugaaaccu

SEQ ID NO: 503359 - RNA, 32 nt, Human
ucgagaccagccuggccaacauggugaaacgc

SEQ ID NO: 503360 - RNA, 32 nt, Human
ucgagaccagccuggccaacauggugaaacuc

SEQ ID NO: 503361 - RNA, 32 nt, Human
ucgagaccagccuggccaacauggugaacccu

SEQ ID NO: 503362 - RNA, 32 nt, Human
ucgagaccagccuggccaacauggugaagccc

SEQ ID NO: 503363 - RNA, 32 nt, Human
ucgagaccagccuggccaacauggugauaccc

SEQ ID NO: 503364 - RNA, 32 nt, Human
ucgagaccagccuggccaacauggugugagac

SEQ ID NO: 503365 - RNA, 32 nt, Human
ucgagaccagccuggccaacaugguuaaaccc

SEQ ID NO: 503366 - RNA, 32 nt, Human
ucgagaccagccuggccaaccaacauggugaa

SEQ ID NO: 503367 - RNA, 23 nt, Human
ucgagaccagccuggccaacgug

SEQ ID NO: 503368 - RNA, 32 nt, Human
ucgagaccagccuggccaacguggugaaaccc

SEQ ID NO: 503369 - RNA, 32 nt, Human
ucgagaccagccuggccaacguggugaaacgc

SEQ ID NO: 503370 - RNA, 32 nt, Human
ucgagaccagccuggccaacuuggugaaaccc

SEQ ID NO: 503371 - RNA, 32 nt, Human
ucgagaccagccuggccaagauggcgaaacgc

SEQ ID NO: 503372 - RNA, 32 nt, Human
ucgagaccagccuggccaauaaggugaaaccc

SEQ ID NO: 503373 - RNA, 32 nt, Human
ucgagaccagccuggccaauaaggugaaacuc

SEQ ID NO: 503374 - RNA, 32 nt, Human
ucgagaccagccuggccaauacggcaaaaccu

SEQ ID NO: 503375 - RNA, 23 nt, Human
ucgagaccagccuggccaauaug

SEQ ID NO: 503376 - RNA, 32 nt, Human
ucgagaccagccuggccaauauggugaaaccc

SEQ ID NO: 503377 - RNA, 32 nt, Human
ucgagaccagccuggccaauauggugaaaccu

SEQ ID NO: 503378 - RNA, 32 nt, Human
ucgagaccagccuggccaauguggugaaaccc

SEQ ID NO: 503379 - RNA, 32 nt, Human
ucgagaccagccuggccacauggcaaaacccc

SEQ ID NO: 503380 - RNA, 32 nt, Human
ucgagaccagccuggccacauggugaaacccu

SEQ ID NO: 503381 - RNA, 32 nt, Human
ucgagaccagccuggccagcaaggugaaaccc

SEQ ID NO: 503382 - RNA, 32 nt, Human
ucgagaccagccuggccagcauggcaaaaccc

SEQ ID NO: 503383 - RNA, 32 nt, Human
ucgagaccagccuggccagcauggcgaaaccc

SEQ ID NO: 503384 - RNA, 32 nt, Human
ucgagaccagccuggccagcauggugaaaccc

SEQ ID NO: 503385 - RNA, 32 nt, Human
ucgagaccagccuggccagcauggugaaacuc

SEQ ID NO: 503386 - RNA, 32 nt, Human
ucgagaccagccuggccagcauggugagaccc

SEQ ID NO: 503387 - RNA, 32 nt, Human
ucgagaccagccuggccauuauggugaaaccc

SEQ ID NO: 503388 - RNA, 32 nt, Human
ucgagaccagccuggcccacauggugaaaccc

SEQ ID NO: 503389 - RNA, 32 nt, Human
ucgagaccagccuggccgacauggcgaaaccc

SEQ ID NO: 503390 - RNA, 32 nt, Human
ucgagaccagccuggcuaacacagugaaaccc

SEQ ID NO: 503391 - RNA, 32 nt, Human
ucgagaccagccuggcuaacacggugaaaccc

SEQ ID NO: 503392 - RNA, 32 nt, Human
ucgagaccagccuggcuaacauggcaaaaccc

SEQ ID NO: 503393 - RNA, 32 nt, Human
ucgagaccagccuggcuaacauggcaaaaccu

SEQ ID NO: 503394 - RNA, 32 nt, Human
ucgagaccagccuggcuaacauggugaaaccc

SEQ ID NO: 503395 - RNA, 32 nt, Human
ucgagaccagccuggcuggcuagcauggugag

SEQ ID NO: 503396 - RNA, 32 nt, Human
ucgagaccagccugggcaacaaagugagacuc

SEQ ID NO: 503397 - RNA, 32 nt, Human
ucgagaccagccugggcaacauagugagaccc

SEQ ID NO: 503398 - RNA, 32 nt, Human
ucgagaccagccugggcaacauagugagaccu

SEQ ID NO: 503399 - RNA, 32 nt, Human
ucgagaccagccugggcaacauagugagacuc

SEQ ID NO: 503400 - RNA, 32 nt, Human
ucgagaccagccugggcaacauggagagaccc

SEQ ID NO: 503401 - RNA, 32 nt, Human
ucgagaccagccugggcaacauggcgagaccc

SEQ ID NO: 503402 - RNA, 32 nt, Human
ucgagaccagccugggcaacauggugaaaccc

SEQ ID NO: 503403 - RNA, 32 nt, Human
ucgagaccagccugggcaacauggugaaaucc

SEQ ID NO: 503404 - RNA, 32 nt, Human
ucgagaccagccugggcaacauggugagaccc

SEQ ID NO: 503405 - RNA, 32 nt, Human
ucgagaccagccugggcaacgcagugagagac

SEQ ID NO: 503406 - RNA, 32 nt, Human
ucgagaccagccugggcaacguggcgaaaucc

SEQ ID NO: 503407 - RNA, 32 nt, Human
ucgagaccagccugggcaacguggugaaaccc

SEQ ID NO: 503408 - RNA, 32 nt, Human
ucgagaccagccugggcaagauggugaaaccc

SEQ ID NO: 503409 - RNA, 32 nt, Human
ucgagaccagccugggcaucguagugagacuc

SEQ ID NO: 503410 - RNA, 32 nt, Human
ucgagaccagccugggcgacacggugaaaccc

SEQ ID NO: 503411 - RNA, 32 nt, Human
ucgagaccagccugggcuacauagugagacca

SEQ ID NO: 503412 - RNA, 32 nt, Human
ucgagaccagccuggucaacauggcaaaacau

SEQ ID NO: 503413 - RNA, 32 nt, Human
ucgagaccagccuggucaacauggcgaaaucc

SEQ ID NO: 503414 - RNA, 32 nt, Human
ucgagaccagccuggucaacauggugaaaccc

SEQ ID NO: 503415 - RNA, 32 nt, Human
ucgagaccagccuggucaacuuggugaaaaca

SEQ ID NO: 503416 - RNA, 32 nt, Human
ucgagaccagccuggucaagauggugaaaccc

SEQ ID NO: 503417 - RNA, 32 nt, Human
ucgagaccagccuggucaauauggugaaaccc

SEQ ID NO: 503418 - RNA, 32 nt, Human
ucgagaccagccuguccaacauggcgaaccuc

SEQ ID NO: 503419 - RNA, 32 nt, Human
ucgagaccagccuguucagcauagcaggaccc

SEQ ID NO: 503420 - RNA, 32 nt, Human
ucgagaccagccuugccaacauagugaaaccc

SEQ ID NO: 503421 - RNA, 32 nt, Human
ucgagaccagccuuggccaacauggcgaaacc

SEQ ID NO: 503422 - RNA, 32 nt, Human
ucgagaccagcguggucaacaugguguaaccc

SEQ ID NO: 503423 - RNA, 32 nt, Human
ucgagaccagcuuaggcaacacggugaaaccc

SEQ ID NO: 503424 - RNA, 23 nt, Human
ucgagaccagcuuggccaacaug

SEQ ID NO: 503425 - RNA, 32 nt, Human
ucgagaccagcuuggccaacauggugaagcuc

SEQ ID NO: 503426 - RNA, 32 nt, Human
ucgagaccagcuuggccaacauggugagcccc

SEQ ID NO: 503427 - RNA, 32 nt, Human
ucgagaccagcuugggcaacauggagaaaccc

SEQ ID NO: 503428 - RNA, 32 nt, Human
ucgagaccagcuugggcaacauggcgaaaccc

SEQ ID NO: 503429 - RNA, 32 nt, Human
ucgagaccagcuugggcaacauggugaaaccu

SEQ ID NO: 503430 - RNA, 32 nt, Human
ucgagaccaggcuggccaacacggugaaacgc

SEQ ID NO: 503431 - RNA, 32 nt, Human
ucgagaccagguuggccaacauggugagaccc

SEQ ID NO: 503432 - RNA, 32 nt, Human
ucgagaccagucuggccaacauagugaaagcc

SEQ ID NO: 503433 - RNA, 32 nt, Human
ucgagaccagucuggccaacauagugaaaucc

SEQ ID NO: 503434 - RNA, 32 nt, Human
ucgagaccagucuggccaacaucgugaaaccc

SEQ ID NO: 503435 - RNA, 32 nt, Human
ucgagaccagucuggccaacauggcgaaaccu

SEQ ID NO: 503436 - RNA, 32 nt, Human
ucgagaccagucuggccaaccuggugaaaccc

SEQ ID NO: 503437 - RNA, 32 nt, Human
ucgagaccagucugggcaacauguugagaccu

SEQ ID NO: 503438 - RNA, 32 nt, Human
ucgagaccagucuggucaacauggugaaaccc

SEQ ID NO: 503439 - RNA, 32 nt, Human
ucgagaccaucccggcuaacauggugaaaccc

SEQ ID NO: 503440 - RNA, 32 nt, Human
ucgagaccauccuagccaacaucgugaaaccc

SEQ ID NO: 503441 - RNA, 32 nt, Human
ucgagaccauccugcccaacauggugaaaccc

SEQ ID NO: 503442 - RNA, 32 nt, Human
ucgagaccauccuggauaacacggagaaaccc

SEQ ID NO: 503443 - RNA, 32 nt, Human
ucgagaccauccuggcaaacacggugaaaccc

SEQ ID NO: 503444 - RNA, 32 nt, Human
ucgagaccauccuggccaaaauggugaaaccu

SEQ ID NO: 503445 - RNA, 32 nt, Human
ucgagaccauccuggccaacacggugaaaccc

SEQ ID NO: 503446 - RNA, 32 nt, Human
ucgagaccauccuggccaacaucgugaaaccc

SEQ ID NO: 503447 - RNA, 32 nt, Human
ucgagaccauccuggccaacaugaugaaaccc

SEQ ID NO: 503448 - RNA, 32 nt, Human
ucgagaccauccuggccaacauggcgaaaccc

SEQ ID NO: 503449 - RNA, 32 nt, Human
ucgagaccauccuggccaacauggugaaacac

SEQ ID NO: 503450 - RNA, 32 nt, Human
ucgagaccauccuggccaacauggugaaaccc

SEQ ID NO: 503451 - RNA, 32 nt, Human
ucgagaccauccuggccaacauggugaaaccu

SEQ ID NO: 503452 - RNA, 32 nt, Human
ucgagaccauccuggccaacauuguaaaaccc

SEQ ID NO: 503453 - RNA, 32 nt, Human
ucgagaccauccuggccaaccaugaugaaacu

SEQ ID NO: 503454 - RNA, 32 nt, Human
ucgagaccauccuggccaacguggugaaaccc

SEQ ID NO: 503455 - RNA, 32 nt, Human
ucgagaccauccuggccaacguggugaagccc

SEQ ID NO: 503456 - RNA, 32 nt, Human
ucgagaccauccuggccaauauggugaaaccc

SEQ ID NO: 503457 - RNA, 32 nt, Human
ucgagaccauccuggcgaacauggugaaaccc

SEQ ID NO: 503458 - RNA, 32 nt, Human
ucgagaccauccuggcgaacauggugagaccc

SEQ ID NO: 503459 - RNA, 32 nt, Human
ucgagaccauccuggcuaacaaggugaaaccc

SEQ ID NO: 503460 - RNA, 32 nt, Human
ucgagaccauccuggcuaacacagugaaaccc

SEQ ID NO: 503461 - RNA, 32 nt, Human
ucgagaccauccuggcuaacacagugaaaccu

SEQ ID NO: 503462 - RNA, 32 nt, Human
ucgagaccauccuggcuaacacgaugaaaccc

SEQ ID NO: 503463 - RNA, 32 nt, Human
ucgagaccauccuggcuaacacggcaugggua

SEQ ID NO: 503464 - RNA, 32 nt, Human
ucgagaccauccuggcuaacacggcgaaaccc

SEQ ID NO: 503465 - RNA, 32 nt, Human
ucgagaccauccuggcuaacacgggugaaacc

SEQ ID NO: 503466 - RNA, 32 nt, Human
ucgagaccauccuggcuaacacggugaaaacc

SEQ ID NO: 503467 - RNA, 32 nt, Human
ucgagaccauccuggcuaacacggugaaaccc

SEQ ID NO: 503468 - RNA, 32 nt, Human
ucgagaccauccuggcuaacacggugaaaccg

SEQ ID NO: 503469 - RNA, 32 nt, Human
ucgagaccauccuggcuaacacggugaaaccu

SEQ ID NO: 503470 - RNA, 32 nt, Human
ucgagaccauccuggcuaacacggugaaacuc

SEQ ID NO: 503471 - RNA, 32 nt, Human
ucgagaccauccuggcuaacagggugaaacca

SEQ ID NO: 503472 - RNA, 32 nt, Human
ucgagaccauccuggcuaacagggugaaaccc

SEQ ID NO: 503473 - RNA, 32 nt, Human
ucgagaccauccuggcuaacagugaaacccug

SEQ ID NO: 503474 - RNA, 32 nt, Human
ucgagaccauccuggcuaacaugguaaaaccc

SEQ ID NO: 503475 - RNA, 32 nt, Human
ucgagaccauccuggcuaacauggugaaaccc

SEQ ID NO: 503476 - RNA, 32 nt, Human
ucgagaccauccugguuaacacggugaaaccc

SEQ ID NO: 503477 - RNA, 32 nt, Human
ucgagaccauccugucuaacacggugaaaccc

SEQ ID NO: 503478 - RNA, 32 nt, Human
ucgagaccaucguggcuaacauggugaaaccc

SEQ ID NO: 503479 - RNA, 32 nt, Human
ucgagaccaucuuggccaacauggugaaaccc

SEQ ID NO: 503480 - RNA, 32 nt, Human
ucgagaccaucuuggcuaacaaggugaaaccc

SEQ ID NO: 503481 - RNA, 32 nt, Human
ucgagaccaucuuggcuaacauggugaaaccc

SEQ ID NO: 503482 - RNA, 32 nt, Human
ucgagaccaugcuggcuaacauggugaaaccc

SEQ ID NO: 503483 - RNA, 32 nt, Human
ucgagaccauggugaaaccccgucucuacuaa

SEQ ID NO: 503484 - RNA, 32 nt, Human
ucgagaccauucuggccaacauagugaaaccc

SEQ ID NO: 503485 - RNA, 32 nt, Human
ucgagaccauucuggcuaacacugaaaccccg

SEQ ID NO: 503486 - RNA, 32 nt, Human
ucgagaccgcccuggcuaacauggugaaacau

SEQ ID NO: 503487 - RNA, 32 nt, Human
ucgagaccggccuggccaacauggugaaaccc

SEQ ID NO: 503488 - RNA, 32 nt, Human
ucgagaccggccuggccaacguggugaaacac

SEQ ID NO: 503489 - RNA, 32 nt, Human
ucgagaccggccuggccaauauggugaaaccc

SEQ ID NO: 503490 - RNA, 32 nt, Human
ucgagaccggccuggucaacauggugaaaccc

SEQ ID NO: 503491 - RNA, 32 nt, Human
ucgagaccggguggagaaugaggcagaaaaag

SEQ ID NO: 503492 - RNA, 32 nt, Human
ucgagaccggucuggccaacauggugaaaccc

SEQ ID NO: 503493 - RNA, 32 nt, Human
ucgagaccguccuggcuaacaccgugaaaccc

SEQ ID NO: 503494 - RNA, 32 nt, Human
ucgagaccugccugaccaacaugcugaaaccc

SEQ ID NO: 503495 - RNA, 32 nt, Human
ucgagacgacccuggccaacauggugaaaucc

SEQ ID NO: 503496 - RNA, 32 nt, Human
ucgagacgauccuggccaacacggugaaaccc

SEQ ID NO: 503497 - RNA, 32 nt, Human
ucgagacggguuucaccacguuggccaggaug

SEQ ID NO: 503498 - RNA, 32 nt, Human
ucgagacuagccugaccaacauggugaaacua

SEQ ID NO: 503499 - RNA, 32 nt, Human
ucgagacuagccuggccaacaugguaaaaccc

SEQ ID NO: 503500 - RNA, 32 nt, Human
ucgagacuagccuggccaacauggugauaccc

SEQ ID NO: 503501 - RNA, 32 nt, Human
ucgagacuagccuggccaauaugguaaaaccc

SEQ ID NO: 503502 - RNA, 32 nt, Human
ucgagacuagccuggccaccguggcgaaacac

SEQ ID NO: 503503 - RNA, 32 nt, Human
ucgagacuagccuggcuaauacagugaaaccc

SEQ ID NO: 503504 - RNA, 32 nt, Human
ucgagacuagcuuggccaacauggugaaaccu

SEQ ID NO: 503505 - RNA, 32 nt, Human
ucgagacuauccuggcuaacacgguaaaaccc

SEQ ID NO: 503506 - RNA, 32 nt, Human
ucgagacuauccuggcuaacacggugaaaccc

SEQ ID NO: 503507 - RNA, 32 nt, Human
ucgagacugaggcugcucagcagccacugggu

SEQ ID NO: 503508 - RNA, 32 nt, Human
ucgagacuugacuuuccagagcaacuuuggau

SEQ ID NO: 503509 - RNA, 32 nt, Human
ucgagacuuuccuggcuaacagggugaauccc

SEQ ID NO: 503510 - RNA, 32 nt, Human
ucgagagacagagagacggagcgcgcuuuccu

SEQ ID NO: 503511 - RNA, 32 nt, Human
ucgagagagcgccggccuagaggcucauuauc

SEQ ID NO: 503512 - RNA, 32 nt, Human
ucgagagcagccuggccaacaccgugaaccuc

SEQ ID NO: 503513 - RNA, 32 nt, Human
ucgagagcagccuggccaacaugaugaaaccc

SEQ ID NO: 503514 - RNA, 32 nt, Human
ucgagagcagccuggccaauaugaugaaaccc

SEQ ID NO: 503515 - RNA, 32 nt, Human
ucgagagcagccugggcaacauggugaaagcc

SEQ ID NO: 503516 - RNA, 32 nt, Human
ucgagagcagccuggucaacauagugaaaccc

SEQ ID NO: 503517 - RNA, 32 nt, Human
ucgagagcauccuggccaacguggugaaaccc

SEQ ID NO: 503518 - RNA, 32 nt, Human
ucgagaggccgaggcagguggaucacgagguc

SEQ ID NO: 503519 - RNA, 32 nt, Human
ucgagaggcugaggcaggagaaucucuugaac

SEQ ID NO: 503520 - RNA, 32 nt, Human
ucgagaggcugaggcaggagaauggcgugaac

SEQ ID NO: 503521 - RNA, 32 nt, Human
ucgagaggcugaggcaggagaauugcuugaac

SEQ ID NO: 503522 - RNA, 32 nt, Human
ucgagaggcugaggcuggagaaucgcuugaac

SEQ ID NO: 503523 - RNA, 32 nt, Human
ucgagaggcugagucaggagaauugcuugaac

SEQ ID NO: 503524 - RNA, 32 nt, Human
ucgagagggagcgaaccaggacuggggugacg

SEQ ID NO: 503525 - RNA, 32 nt, Human
ucgagaguuggguucaguccuggcccguugug

SEQ ID NO: 503526 - RNA, 32 nt, Human
ucgagauacaaguuuccugaaacugcugcucu

SEQ ID NO: 503527 - RNA, 32 nt, Human
ucgagauacagcuuuuugcaguaugguggguu

SEQ ID NO: 503528 - RNA, 32 nt, Human
ucgagauaucaucuguaccucagcacuguugu

SEQ ID NO: 503529 - RNA, 32 nt, Human
ucgagaucagcauggccaacauggugaagccc

SEQ ID NO: 503530 - RNA, 32 nt, Human
ucgagaucagccuaggcaacauggugaaaucc

SEQ ID NO: 503531 - RNA, 32 nt, Human
ucgagaucagccugaccaacaugaugaaaugc

SEQ ID NO: 503532 - RNA, 32 nt, Human
ucgagaucagccugaccaacauggugaaaccc

SEQ ID NO: 503533 - RNA, 32 nt, Human
ucgagaucagccuggacaauacggugagaccc

SEQ ID NO: 503534 - RNA, 23 nt, Human
ucgagaucagccuggccaacaug

SEQ ID NO: 503535 - RNA, 32 nt, Human
ucgagaucagccuggccaacauggcaaaaccc

SEQ ID NO: 503536 - RNA, 32 nt, Human
ucgagaucagccuggccaacauggugaaaccc

SEQ ID NO: 503537 - RNA, 32 nt, Human
ucgagaucagccuggccaacauggugaaaucc

SEQ ID NO: 503538 - RNA, 32 nt, Human
ucgagaucagccuggccaauagggugaaacuc

SEQ ID NO: 503539 - RNA, 32 nt, Human
ucgagaucagcgggaccaacauggugaaaccc

SEQ ID NO: 503540 - RNA, 32 nt, Human
ucgagaucauccuggcuaacacagugaaaccc

SEQ ID NO: 503541 - RNA, 32 nt, Human
ucgagaucauccuggcuaacacggugaaaccc

SEQ ID NO: 503542 - RNA, 32 nt, Human
ucgagaucauugcacuccagccugggcaauaa

SEQ ID NO: 503543 - RNA, 32 nt, Human
ucgagaucuuguuaaaauguagauccugggug

SEQ ID NO: 503544 - RNA, 32 nt, Human
ucgagaugagccuggccaacauggugaaaccc

SEQ ID NO: 503545 - RNA, 32 nt, Human
ucgagaugccucuucucugucuccuuaucaga

SEQ ID NO: 503546 - RNA, 32 nt, Human
ucgagauggaguuucacucuugucgcucaggc

SEQ ID NO: 503547 - RNA, 32 nt, Human
ucgagauggaguuuugcucuuguugcccaggc

SEQ ID NO: 503548 - RNA, 32 nt, Human
ucgagauggcucuguaagccugacuggcaaua

SEQ ID NO: 503549 - RNA, 32 nt, Human
ucgagauuagucuggccaacauggugaaaccc

SEQ ID NO: 503550 - RNA, 32 nt, Human
ucgagcaccagcuggcuccaccagccgccugc

SEQ ID NO: 503551 - RNA, 32 nt, Human
ucgagcacccgcugaacaucagccugggagac

SEQ ID NO: 503552 - RNA, 32 nt, Human
ucgagcacuucacgugucacacaugcugcgga

SEQ ID NO: 503553 - RNA, 32 nt, Human
ucgagcagaaguugaucaacucagggaaacac

SEQ ID NO: 503554 - RNA, 32 nt, Human
ucgagcagagccgguaaccaccacgugccaga

SEQ ID NO: 503555 - RNA, 32 nt, Human
ucgagcauggaggggcacuggggaaggucccc

SEQ ID NO: 503556 - RNA, 25 nt, Human
ucgagccaaaauugcaccacugcac

SEQ ID NO: 503557 - RNA, 32 nt, Human
ucgagccacugcacuccagccugggcaacaga

SEQ ID NO: 503558 - RNA, 32 nt, Human
ucgagccacugcacuccagccugggcagcuga

SEQ ID NO: 503559 - RNA, 32 nt, Human
ucgagccacugcacuccagccugggcgacaga

SEQ ID NO: 503560 - RNA, 32 nt, Human
ucgagccacugcacuccagccugggugacaga

SEQ ID NO: 503561 - RNA, 32 nt, Human
ucgagccacugcacuccagccugggugaugaa

SEQ ID NO: 503562 - RNA, 32 nt, Human
ucgagccacugcacuccugggcaacagagcaa

SEQ ID NO: 503563 - RNA, 32 nt, Human
ucgagccacugcauuccagccugggcgaaaga

SEQ ID NO: 503564 - RNA, 32 nt, Human
ucgagccacuugcuuugcucaguucuguguuu

SEQ ID NO: 503565 - RNA, 32 nt, Human
ucgagccauugcacucaaaccugggggauaag

SEQ ID NO: 503566 - RNA, 32 nt, Human
ucgagccauugcacuccagccuggacagcagg

SEQ ID NO: 503567 - RNA, 32 nt, Human
ucgagccauugcacuccagccugggcaacaag

SEQ ID NO: 503568 - RNA, 32 nt, Human
ucgagcccagaaguucaagaccagccugagca

SEQ ID NO: 503569 - RNA, 32 nt, Human
ucgagcccagacugucgauacugacauagcca

SEQ ID NO: 503570 - RNA, 31 nt, Human
ucgagcccagccucucccugccaaagcccaa

SEQ ID NO: 503571 - RNA, 32 nt, Human
ucgagcccagccugaccaauaugaugaaaccc

SEQ ID NO: 503572 - RNA, 32 nt, Human
ucgagcccagccugaccaauauggugaaaccc

SEQ ID NO: 503573 - RNA, 32 nt, Human
ucgagcccagccuggccaacauggcgaaaccc

SEQ ID NO: 503574 - RNA, 32 nt, Human
ucgagcccagccuggccaacauggugaaaccc

SEQ ID NO: 503575 - RNA, 32 nt, Human
ucgagcccaggaguuugagaccagccugggca

SEQ ID NO: 503576 - RNA, 22 nt, Human
ucgagcccagggacccccgggc

SEQ ID NO: 503577 - RNA, 32 nt, Human
ucgagcccaucaaccuggacagcugucuccgu

SEQ ID NO: 503578 - RNA, 32 nt, Human
ucgagcccucccccaaacagacucgcuagcac

SEQ ID NO: 503579 - RNA, 32 nt, Human
ucgagccgcagccaugucuggggacgagauga

SEQ ID NO: 503580 - RNA, 32 nt, Human
ucgagccgggagcuauuugccucccaggagga

SEQ ID NO: 503581 - RNA, 32 nt, Human
ucgagccucacagaagccagcgcgggucucug

SEQ ID NO: 503582 - RNA, 32 nt, Human
ucgagccugggugacagagugagacuccgucu

SEQ ID NO: 503583 - RNA, 24 nt, Human
ucgagccugggugacagggcaaga

SEQ ID NO: 503584 - RNA, 32 nt, Human
ucgagccugggugacagggcaagacccugucu

SEQ ID NO: 503585 - RNA, 32 nt, Human
ucgagcgagcgccgggcauagcgcggcuggcg

SEQ ID NO: 503586 - RNA, 32 nt, Human
ucgagcgauccucccgccucagccucucgaga

SEQ ID NO: 503587 - RNA, 32 nt, Human
ucgagcgcccgcagcccaccucucgggggcgg

SEQ ID NO: 503588 - RNA, 32 nt, Human
ucgagcucugagccaccacggucccagggccc

SEQ ID NO: 503589 - RNA, 17 nt, Human
ucgagcugccucgggcc

SEQ ID NO: 503590 - RNA, 32 nt, Human
ucgagcugugagauuuuacccucccagcccag

SEQ ID NO: 503591 - RNA, 32 nt, Human
ucgagcuuccuucuggaccagcuccuggggau

SEQ ID NO: 503592 - RNA, 32 nt, Human
ucgaggaagagggagaagccgacaagugcucg

SEQ ID NO: 503593 - RNA, 32 nt, Human
ucgaggaccuggugcugagaagagucuguuca

SEQ ID NO: 503594 - RNA, 32 nt, Human
ucgaggaggaaguggcugauuacugagcgguu

SEQ ID NO: 503595 - RNA, 32 nt, Human
ucgaggaggaggaggaggccgggguggagggg

SEQ ID NO: 503596 - RNA, 32 nt, Human
ucgaggaggagguggauguggcagcugagauc

SEQ ID NO: 503597 - RNA, 32 nt, Human
ucgaggaucugcaggccgccgugaaguggggc

SEQ ID NO: 503598 - RNA, 32 nt, Human
ucgaggauucccaugugggcccuucagcuugg

SEQ ID NO: 503599 - RNA, 32 nt, Human
ucgaggcaggcagaucaccugaggucaggagu

SEQ ID NO: 503600 - RNA, 32 nt, Human
ucgaggcaggcggaucaccugaggucgggagu

SEQ ID NO: 503601 - RNA, 32 nt, Human
ucgaggcaggcggaucacuugaggucaggagu

SEQ ID NO: 503602 - RNA, 32 nt, Human
ucgaggcagguggaucaccugaggucaggagu

SEQ ID NO: 503603 - RNA, 32 nt, Human
ucgaggccagccugaccaacauggugaaacac

SEQ ID NO: 503604 - RNA, 32 nt, Human
ucgaggccagccugaccaacauggugaaaccc

SEQ ID NO: 503605 - RNA, 23 nt, Human
ucgaggccagccugagcaacaug

SEQ ID NO: 503606 - RNA, 32 nt, Human
ucgaggccagccuggccaacaugaugaaaccc

SEQ ID NO: 503607 - RNA, 32 nt, Human
ucgaggccagccuggccaacauggugaaaccc

SEQ ID NO: 503608 - RNA, 32 nt, Human
ucgaggccagguguucgagaccagccugggca

SEQ ID NO: 503609 - RNA, 32 nt, Human
ucgaggcccaccuucuucccacccccggcaaa

SEQ ID NO: 503610 - RNA, 32 nt, Human
ucgaggccucuucuccccagcaccgcuguggu

SEQ ID NO: 503611 - RNA, 32 nt, Human
ucgaggcgagccuggccaacauggugaaaccc

SEQ ID NO: 503612 - RNA, 32 nt, Human
ucgaggcgguuagcaggcuccagcagcucccu

SEQ ID NO: 503613 - RNA, 32 nt, Human
ucgaggcgugagccacagugguuaucuccaag

SEQ ID NO: 503614 - RNA, 32 nt, Human
ucgaggcugcagugagcuaugaucucaccacu

SEQ ID NO: 503615 - RNA, 20 nt, Human
ucgaggcuggaguguagugg

SEQ ID NO: 503616 - RNA, 32 nt, Human
ucgagggacuccgcccucccagccucaacacc

SEQ ID NO: 503617 - RNA, 32 nt, Human
ucgagggacuuaguggaguucucaucccuuca

SEQ ID NO: 503618 - RNA, 32 nt, Human
ucgagggcagaacucugggaaggaaagaaagg

SEQ ID NO: 503619 - RNA, 32 nt, Human
ucgaggggacaguguguuugagcuggagugcu

SEQ ID NO: 503620 - RNA, 32 nt, Human
ucgaggggacuuucagucacaggauuucauaa

SEQ ID NO: 503621 - RNA, 32 nt, Human
ucgaggggccccuucugccagggccuugguug

SEQ ID NO: 503622 - RNA, 32 nt, Human
ucgaggggcgcuggguuaggggagcaccuguu

SEQ ID NO: 503623 - RNA, 32 nt, Human
ucgagggggcucuguuaaaaauaagaacaaaa

SEQ ID NO: 503624 - RNA, 32 nt, Human
ucgagggucagggaggagagugacccggcccu

SEQ ID NO: 503625 - RNA, 32 nt, Human
ucgaggguucucuccccuugccaccaugagcg

SEQ ID NO: 503626 - RNA, 32 nt, Human
ucgagguagguggaucaccugaggucaggagu

SEQ ID NO: 503627 - RNA, 32 nt, Human
ucgagguagguggaucaccugaggucgggagu

SEQ ID NO: 503628 - RNA, 32 nt, Human
ucgaggucaggaguuccagaccagccugacca

SEQ ID NO: 503629 - RNA, 32 nt, Human
ucgaggucgacauuuauaccgucugaggguag

SEQ ID NO: 503630 - RNA, 22 nt, Human
ucgaggucuagggguauccaga

SEQ ID NO: 503631 - RNA, 32 nt, Human
ucgaggugacugugcugugcucggugagggga

SEQ ID NO: 503632 - RNA, 32 nt, Human
ucgaggugcaucuggccuugggggacgaugau

SEQ ID NO: 503633 - RNA, 32 nt, Human
ucgagguggcggcucuggugggaccaagcugc

SEQ ID NO: 503634 - RNA, 32 nt, Human
ucgaggugggcagaucaccugaggucaggagu

SEQ ID NO: 503635 - RNA, 32 nt, Human
ucgaggugggcagaucaccugagguuaggagu

SEQ ID NO: 503636 - RNA, 32 nt, Human
ucgaggugggcggaucaccugaggucaggagu

SEQ ID NO: 503637 - RNA, 32 nt, Human
ucgagguggggagggggaggcgggcuucccuc

SEQ ID NO: 503638 - RNA, 32 nt, Human
ucgagguggguggaucaccugaggucuggagu

SEQ ID NO: 503639 - RNA, 32 nt, Human
ucgagguggguggaugaccugaggucaggagu

SEQ ID NO: 503640 - RNA, 32 nt, Human
ucgagguuucucucagcuuuuugaccuggcuc

SEQ ID NO: 503641 - RNA, 32 nt, Human
ucgaguaaucugccaagcaagaguuuauucaa

SEQ ID NO: 503642 - RNA, 32 nt, Human
ucgagucaucuacaccuagcuucaccuuauuc

SEQ ID NO: 503643 - RNA, 32 nt, Human
ucgaguccagccuggccaacauggugaaaccc

SEQ ID NO: 503644 - RNA, 32 nt, Human
ucgaguccagccuggccaauaugcugaaaccc

SEQ ID NO: 503645 - RNA, 16 nt, Human
ucgagucccaauucuu

SEQ ID NO: 503646 - RNA, 32 nt, Human
ucgagucccgcagccuuaacaggaugggaucg

SEQ ID NO: 503647 - RNA, 32 nt, Human
ucgagucccugcugguuccccuuguccuggga

SEQ ID NO: 503648 - RNA, 32 nt, Human
ucgagucguuccuuccccuccuggauuccggg

SEQ ID NO: 503649 - RNA, 32 nt, Human
ucgagucuguaugaggccagagacguggaagu

SEQ ID NO: 503650 - RNA, 32 nt, Human
ucgagucuuauugcuccaaccuguucgcacuu

SEQ ID NO: 503651 - RNA, 32 nt, Human
ucgagugcaguggcaugaucucagcucacugc

SEQ ID NO: 503652 - RNA, 32 nt, Human
ucgagugcaguggcucgcgccuguaaucccag

SEQ ID NO: 503653 - RNA, 32 nt, Human
ucgaguggaaccuggaagccccggguggcagu

SEQ ID NO: 503654 - RNA, 32 nt, Human
ucgaguggaggaagacagcaggguggggguga

SEQ ID NO: 503655 - RNA, 32 nt, Human
ucgaguggcuuccuggccauggagaggagauc

SEQ ID NO: 503656 - RNA, 32 nt, Human
ucgagugggcugggccacgcugaccacccugg

SEQ ID NO: 503657 - RNA, 32 nt, Human
ucgagugugccuuuuuauucaucuacuuuauu

SEQ ID NO: 503658 - RNA, 32 nt, Human
ucgaguguggucaaaggagagagucuuuguca

SEQ ID NO: 503659 - RNA, 32 nt, Human
ucgaguuacugcacuccagccugggugacaag

SEQ ID NO: 503660 - RNA, 32 nt, Human
ucgaguuaggaggacgagagaccuccagcccc

SEQ ID NO: 503661 - RNA, 32 nt, Human
ucgaguucccgcucuucaccccuucccucacc

SEQ ID NO: 503662 - RNA, 32 nt, Human
ucgaguucgccggcgacguccaugaccgcuac

SEQ ID NO: 503663 - RNA, 32 nt, Human
ucgauaaacgagcucccuucuuugcacacaua

SEQ ID NO: 503664 - RNA, 32 nt, Human
ucgauaaguccccaaggcugcauguauuagca

SEQ ID NO: 503665 - RNA, 32 nt, Human
ucgauaccagccugaccaacauggcgaaaccc

SEQ ID NO: 503666 - RNA, 32 nt, Human
ucgauaccagccuggccaacauggugaaaccc

SEQ ID NO: 503667 - RNA, 32 nt, Human
ucgauaccagccugggcaacauagugggaucc

SEQ ID NO: 503668 - RNA, 32 nt, Human
ucgauaguguuacugauaacaaaccuacuuaa

SEQ ID NO: 503669 - RNA, 32 nt, Human
ucgauaguuacccaaaguucagucuagauggc

SEQ ID NO: 503670 - RNA, 32 nt, Human
ucgauauuugguggccccaagcgaaugaagca

SEQ ID NO: 503671 - RNA, 32 nt, Human
ucgauccacccuccucccuucucaugggacuu

SEQ ID NO: 503672 - RNA, 26 nt, Human
ucgauccguucccccagggaccaucc

SEQ ID NO: 503673 - RNA, 32 nt, Human
ucgauccuggggcccucagcuccuggggaccc

SEQ ID NO: 503674 - RNA, 32 nt, Human
ucgaucgcaggcucggcguccuuggcagccau

SEQ ID NO: 503675 - RNA, 32 nt, Human
ucgaucgcuugagccugggagguggaggcuac

SEQ ID NO: 503676 - RNA, 32 nt, Human
ucgaucuccucugagccucuucugcccccugu

SEQ ID NO: 503677 - RNA, 32 nt, Human
ucgaucugaaucugccggggccccagcccacu

SEQ ID NO: 503678 - RNA, 32 nt, Human
ucgaucugcaagccuuucaccaaccaaauagu

SEQ ID NO: 503679 - RNA, 32 nt, Human
ucgaugaacugaucuucaugcugagcgacagc

SEQ ID NO: 503680 - RNA, 32 nt, Human
ucgaugaagcaguuccagaaggaccauucuca

SEQ ID NO: 503681 - RNA, 32 nt, Human
ucgaugaaggaagggcccaugguucugccacu

SEQ ID NO: 503682 - RNA, 32 nt, Human
ucgaugagaggcaggcucccaccugcagggug

SEQ ID NO: 503683 - RNA, 32 nt, Human
ucgaugagguauuaaaggaaaccacuggucuu

SEQ ID NO: 503684 - RNA, 24 nt, Human
ucgaugccaagccagacccucuca

SEQ ID NO: 503685 - RNA, 32 nt, Human
ucgaugccccacugucgugucucccucccucc

SEQ ID NO: 503686 - RNA, 31 nt, Human
ucgaugcucaauaaauguguguugacugcaa

SEQ ID NO: 503687 - RNA, 32 nt, Human
ucgaugcugcuggccucccuccgucccucugu

SEQ ID NO: 503688 - RNA, 32 nt, Human
ucgaugcuuccuuguccuacucucacaucugc

SEQ ID NO: 503689 - RNA, 31 nt, Human
ucgaugcuuggguuccguaugccaagauucu

SEQ ID NO: 503690 - RNA, 32 nt, Human
ucgauggagaugcuucuagccucccaguagga

SEQ ID NO: 503691 - RNA, 32 nt, Human
ucgauggccugagacacaccccuugagaagaa

SEQ ID NO: 503692 - RNA, 32 nt, Human
ucgauguagagacucuauuuucucccaaagac

SEQ ID NO: 503693 - RNA, 32 nt, Human
ucgaugucaggaguuugagaccagccuggcca

SEQ ID NO: 503694 - RNA, 32 nt, Human
ucgauguccacauccuagugggagccugugac

SEQ ID NO: 503695 - RNA, 32 nt, Human
ucgaugucugcuucuucccagccugggauccu

SEQ ID NO: 503696 - RNA, 19 nt, Human
ucgauguuaccuugcuggu

SEQ ID NO: 503697 - RNA, 23 nt, Human
ucgauguuccaggcacuguccua

SEQ ID NO: 503698 - RNA, 32 nt, Human
ucgauuagcuguucuucuacaucacauuguua

SEQ ID NO: 503699 - RNA, 32 nt, Human
ucgauuguaccacugcacuccagccugggcga

SEQ ID NO: 503700 - RNA, 32 nt, Human
ucgauuguaucgcugcuacaucagacucuaga

SEQ ID NO: 503701 - RNA, 32 nt, Human
ucgauuguucccagauccucccugccuggccu

SEQ ID NO: 503702 - RNA, 32 nt, Human
ucgauuucauuucccuuccccgcaccccuuga

SEQ ID NO: 503703 - RNA, 32 nt, Human
ucgauuuccuccgcuucucucuuugccgagcu

SEQ ID NO: 503704 - RNA, 32 nt, Human
ucgcaaaaccccacagauacagugccaaugac

SEQ ID NO: 503705 - RNA, 32 nt, Human
ucgcaacacuacacuccagccugggcgacaga

SEQ ID NO: 503706 - RNA, 32 nt, Human
ucgcaacacugcacuccagccugggcgacaga

SEQ ID NO: 503707 - RNA, 32 nt, Human
ucgcaacacugcacuccagccugggugacaga

SEQ ID NO: 503708 - RNA, 32 nt, Human
ucgcaacacugcccuccagccugggcaacaga

SEQ ID NO: 503709 - RNA, 32 nt, Human
ucgcaacauugcacuccaggcugggcagcaag

SEQ ID NO: 503710 - RNA, 32 nt, Human
ucgcaaccagccuggccaauauggugagaccc

SEQ ID NO: 503711 - RNA, 32 nt, Human
ucgcaaccauccuggcuaacacggugaaaccc

SEQ ID NO: 503712 - RNA, 32 nt, Human
ucgcaacccugcaaagucggagcugcugagaa

SEQ ID NO: 503713 - RNA, 32 nt, Human
ucgcaagcacacacccugcgggccuucaaguc

SEQ ID NO: 503714 - RNA, 32 nt, Human
ucgcaagcacagaaccaguuguacugagcuuu

SEQ ID NO: 503715 - RNA, 32 nt, Human
ucgcaaggcugagccacugggcugugggggaa

SEQ ID NO: 503716 - RNA, 32 nt, Human
ucgcaaggcugaggcaggagaaucgcuugaac

SEQ ID NO: 503717 - RNA, 22 nt, Human
ucgcaaguagcugggacuacag

SEQ ID NO: 503718 - RNA, 23 nt, Human
ucgcaaguagcugggauuacagg

SEQ ID NO: 503719 - RNA, 32 nt, Human
ucgcaaguaugaccagaagccaggacaaagcu

SEQ ID NO: 503720 - RNA, 24 nt, Human
ucgcacaaccaugacgcacugcuc

SEQ ID NO: 503721 - RNA, 24 nt, Human
ucgcacaacgaugacgcacugcuc

SEQ ID NO: 503722 - RNA, 32 nt, Human
ucgcacacaugagccugugcucagccugcaca

SEQ ID NO: 503723 - RNA, 32 nt, Human
ucgcacaccauccugcgggugcagcccaaaac

SEQ ID NO: 503724 - RNA, 32 nt, Human
ucgcacagccuccccauccuuccuucccagcc

SEQ ID NO: 503725 - RNA, 22 nt, Human
ucgcacaggcuuggagugcagu

SEQ ID NO: 503726 - RNA, 32 nt, Human
ucgcaccacagcacuccagcccaggcggcagu

SEQ ID NO: 503727 - RNA, 32 nt, Human
ucgcaccacagcgcuccagccuggucgacaga

SEQ ID NO: 503728 - RNA, 32 nt, Human
ucgcaccaccacacuccagccugggugacaga

SEQ ID NO: 503729 - RNA, 32 nt, Human
ucgcaccacggcacuccagccuggcgacagag

SEQ ID NO: 503730 - RNA, 32 nt, Human
ucgcaccacugaacuccagccugggcgacaag

SEQ ID NO: 503731 - RNA, 32 nt, Human
ucgcaccacugcacccaaaccuggggagagag

SEQ ID NO: 503732 - RNA, 32 nt, Human
ucgcaccacugcaccccagccugggcaacaag

SEQ ID NO: 503733 - RNA, 32 nt, Human
ucgcaccacugcaccccagcgugggcaacaga

SEQ ID NO: 503734 - RNA, 32 nt, Human
ucgcaccacugcacgcacuccagccuggguga

SEQ ID NO: 503735 - RNA, 32 nt, Human
ucgcaccacugcacuacagccugggcgacaga

SEQ ID NO: 503736 - RNA, 32 nt, Human
ucgcaccacugcacucaagccugggcgacaga

SEQ ID NO: 503737 - RNA, 32 nt, Human
ucgcaccacugcacuccaaccugggcaacaga

SEQ ID NO: 503738 - RNA, 32 nt, Human
ucgcaccacugcacuccaaccugggugacgag

SEQ ID NO: 503739 - RNA, 32 nt, Human
ucgcaccacugcacuccaaucugggcaagaga

SEQ ID NO: 503740 - RNA, 32 nt, Human
ucgcaccacugcacuccagcacuccagccugg

SEQ ID NO: 503741 - RNA, 32 nt, Human
ucgcaccacugcacuccagcaugagugacaga

SEQ ID NO: 503742 - RNA, 32 nt, Human
ucgcaccacugcacuccagccuaggcgacggg

SEQ ID NO: 503743 - RNA, 32 nt, Human
ucgcaccacugcacuccagccuggaagaccaa

SEQ ID NO: 503744 - RNA, 32 nt, Human
ucgcaccacugcacuccagccuggacaacaga

SEQ ID NO: 503745 - RNA, 32 nt, Human
ucgcaccacugcacuccagccugggagacaga

SEQ ID NO: 503746 - RNA, 32 nt, Human
ucgcaccacugcacuccagccugggagauaca

SEQ ID NO: 503747 - RNA, 32 nt, Human
ucgcaccacugcacuccagccugggcaacaag

SEQ ID NO: 503748 - RNA, 32 nt, Human
ucgcaccacugcacuccagccugggcaacaca

SEQ ID NO: 503749 - RNA, 32 nt, Human
ucgcaccacugcacuccagccugggcaacaga

SEQ ID NO: 503750 - RNA, 32 nt, Human
ucgcaccacugcacuccagccugggcaacaua

SEQ ID NO: 503751 - RNA, 32 nt, Human
ucgcaccacugcacuccagccugggcgaaagg

SEQ ID NO: 503752 - RNA, 32 nt, Human
ucgcaccacugcacuccagccugggcgacaaa

SEQ ID NO: 503753 - RNA, 32 nt, Human
ucgcaccacugcacuccagccugggcgacaga

SEQ ID NO: 503754 - RNA, 32 nt, Human
ucgcaccacugcacuccagccugggcggcaga

SEQ ID NO: 503755 - RNA, 32 nt, Human
ucgcaccacugcacuccagccugggcuacaga

SEQ ID NO: 503756 - RNA, 32 nt, Human
ucgcaccacugcacuccagccugggugacaag

SEQ ID NO: 503757 - RNA, 32 nt, Human
ucgcaccacugcacuccagccugggugacaga

SEQ ID NO: 503758 - RNA, 32 nt, Human
ucgcaccacugcacuccagccugggugauaga

SEQ ID NO: 503759 - RNA, 32 nt, Human
ucgcaccacugcacuccagccugggugaugga

SEQ ID NO: 503760 - RNA, 32 nt, Human
ucgcaccacugcacuccagccuggguuacaga

SEQ ID NO: 503761 - RNA, 32 nt, Human
ucgcaccacugcacuccagccuggucgacagc

SEQ ID NO: 503762 - RNA, 32 nt, Human
ucgcaccacugcacuccagccuggugacagag

SEQ ID NO: 503763 - RNA, 32 nt, Human
ucgcaccacugcacuccagccugguuacagag

SEQ ID NO: 503764 - RNA, 32 nt, Human
ucgcaccacugcacuccagcucgggugacaag

SEQ ID NO: 503765 - RNA, 32 nt, Human
ucgcaccacugcacuccagcuuggaggaaaga

SEQ ID NO: 503766 - RNA, 32 nt, Human
ucgcaccacugcacuccagcuugguucaugga

SEQ ID NO: 503767 - RNA, 32 nt, Human
ucgcaccacugcacuccagucuggcaacagag

SEQ ID NO: 503768 - RNA, 32 nt, Human
ucgcaccacugcacuccagucuggguaacaga

SEQ ID NO: 503769 - RNA, 32 nt, Human
ucgcaccacugcacucccgcuuggcaauagag

SEQ ID NO: 503770 - RNA, 32 nt, Human
ucgcaccacugcacucuagccugggugaaaga

SEQ ID NO: 503771 - RNA, 32 nt, Human
ucgcaccacugcacucuagccugggugaccga

SEQ ID NO: 503772 - RNA, 32 nt, Human
ucgcaccacugcacucuagccuuggcaacagu

SEQ ID NO: 503773 - RNA, 32 nt, Human
ucgcaccacugcacucuagcuugggcaacaga

SEQ ID NO: 503774 - RNA, 32 nt, Human
ucgcaccacugcacugcagccuggcaacaaga

SEQ ID NO: 503775 - RNA, 32 nt, Human
ucgcaccacugcacugcagccugggugacaga

SEQ ID NO: 503776 - RNA, 32 nt, Human
ucgcaccacugcacuucagccugggugacaga

SEQ ID NO: 503777 - RNA, 32 nt, Human
ucgcaccacugcauucagccugagcaacagau

SEQ ID NO: 503778 - RNA, 32 nt, Human
ucgcaccacugcauuccagccuaagcaauaga

SEQ ID NO: 503779 - RNA, 32 nt, Human
ucgcaccacugcauuccagccugggcaacaga

SEQ ID NO: 503780 - RNA, 32 nt, Human
ucgcaccacugcauuccagccugggugacaga

SEQ ID NO: 503781 - RNA, 32 nt, Human
ucgcaccacugcauucuagccuuagugauaca

SEQ ID NO: 503782 - RNA, 32 nt, Human
ucgcaccacugcauugcagccuggugacagag

SEQ ID NO: 503783 - RNA, 32 nt, Human
ucgcaccacugcccuccagccuaggugacaga

SEQ ID NO: 503784 - RNA, 32 nt, Human
ucgcaccacugcucuccagccuggcgacagag

SEQ ID NO: 503785 - RNA, 32 nt, Human
ucgcaccacuguacuccagccugggcaacaga

SEQ ID NO: 503786 - RNA, 32 nt, Human
ucgcaccacuguacuccagccugggcgacgga

SEQ ID NO: 503787 - RNA, 32 nt, Human
ucgcaccacuguacuccagccugggugacaga

SEQ ID NO: 503788 - RNA, 32 nt, Human
ucgcaccacuguacuccagccugggugacuga

SEQ ID NO: 503789 - RNA, 32 nt, Human
ucgcaccacuguauuccagccuggaugacaaa

SEQ ID NO: 503790 - RNA, 32 nt, Human
ucgcaccaggguggagccuccuagaagggcag

SEQ ID NO: 503791 - RNA, 32 nt, Human
ucgcaccagugcacuccagccuuggugacaau

SEQ ID NO: 503792 - RNA, 32 nt, Human
ucgcaccauuacacuccagccugggcaacaga

SEQ ID NO: 503793 - RNA, 32 nt, Human
ucgcaccauugcaaccccaccugggcaacaag

SEQ ID NO: 503794 - RNA, 32 nt, Human
ucgcaccauugcacaccaaccugggugacaga

SEQ ID NO: 503795 - RNA, 32 nt, Human
ucgcaccauugcacccgagccuaggcaacaag

SEQ ID NO: 503796 - RNA, 32 nt, Human
ucgcaccauugcacuccagcccgggcaacaac

SEQ ID NO: 503797 - RNA, 32 nt, Human
ucgcaccauugcacuccagccuaggcaaaaag

SEQ ID NO: 503798 - RNA, 32 nt, Human
ucgcaccauugcacuccagccugagugacaga

SEQ ID NO: 503799 - RNA, 32 nt, Human
ucgcaccauugcacuccagccuggaugauaga

SEQ ID NO: 503800 - RNA, 32 nt, Human
ucgcaccauugcacuccagccuggcgaccgag

SEQ ID NO: 503801 - RNA, 32 nt, Human
ucgcaccauugcacuccagccugggcaacaag

SEQ ID NO: 503802 - RNA, 32 nt, Human
ucgcaccauugcacuccagccugggcaacaga

SEQ ID NO: 503803 - RNA, 32 nt, Human
ucgcaccauugcacuccagccugggcaacagc

SEQ ID NO: 503804 - RNA, 32 nt, Human
ucgcaccauugcacuccagccugggcaacgag

SEQ ID NO: 503805 - RNA, 32 nt, Human
ucgcaccauugcacuccagccugugcaacaag

SEQ ID NO: 503806 - RNA, 32 nt, Human
ucgcaccauugcacuccagcugggagacacag

SEQ ID NO: 503807 - RNA, 32 nt, Human
ucgcaccauugcacuccugccugggcaacaag

SEQ ID NO: 503808 - RNA, 32 nt, Human
ucgcaccauugcacucuagccugggcaacgag

SEQ ID NO: 503809 - RNA, 32 nt, Human
ucgcaccauugcacuucagccugggcaacaag

SEQ ID NO: 503810 - RNA, 32 nt, Human
ucgcaccauugcauuccagccugggcaacaag

SEQ ID NO: 503811 - RNA, 32 nt, Human
ucgcaccauugcccuccagccugggcaacaag

SEQ ID NO: 503812 - RNA, 32 nt, Human
ucgcaccauuguacuccagccugggcaacaag

SEQ ID NO: 503813 - RNA, 32 nt, Human
ucgcaccauuguacuccagccugugugacaga

SEQ ID NO: 503814 - RNA, 32 nt, Human
ucgcaccccugcacuccagccugggcaacaga

SEQ ID NO: 503815 - RNA, 32 nt, Human
ucgcacccuuacacuucagccugggcgaccga

SEQ ID NO: 503816 - RNA, 32 nt, Human
ucgcacccuuacacuuuagccugggcgaccga

SEQ ID NO: 503817 - RNA, 32 nt, Human
ucgcaccgccccgcucuccagccaagguuccg

SEQ ID NO: 503818 - RNA, 32 nt, Human
ucgcaccgcuacacuccagccugggugacaga

SEQ ID NO: 503819 - RNA, 32 nt, Human
ucgcaccgcugcacuccagccuggcaacagag

SEQ ID NO: 503820 - RNA, 32 nt, Human
ucgcaccgcugcacuccagccugggcaacaga

SEQ ID NO: 503821 - RNA, 32 nt, Human
ucgcaccgcugcacuccagccugggcaagaga

SEQ ID NO: 503822 - RNA, 32 nt, Human
ucgcaccgcugcacuccagccugggugacaga

SEQ ID NO: 503823 - RNA, 32 nt, Human
ucgcaccgcugcccuccagccugggcaacaag

SEQ ID NO: 503824 - RNA, 32 nt, Human
ucgcaccggaggaggagaggaggcagcgcccg

SEQ ID NO: 503825 - RNA, 32 nt, Human
ucgcaccguuguacuccagccuggugauagaa

SEQ ID NO: 503826 - RNA, 32 nt, Human
ucgcaccuaccaucagggacaggaugaccugg

SEQ ID NO: 503827 - RNA, 32 nt, Human
ucgcaccuccugggugcuguagucuguguugg

SEQ ID NO: 503828 - RNA, 32 nt, Human
ucgcaccugagguggucaugugggggcgcauu

SEQ ID NO: 503829 - RNA, 32 nt, Human
ucgcaccuguaaucccagcacucuaggaggcc

SEQ ID NO: 503830 - RNA, 24 nt, Human
ucgcaccuguaaucccagcacuuu

SEQ ID NO: 503831 - RNA, 32 nt, Human
ucgcaccuguaaucccagcacuuugggaggcu

SEQ ID NO: 503832 - RNA, 32 nt, Human
ucgcaccuguaaucccagcacuuugggauuac

SEQ ID NO: 503833 - RNA, 24 nt, Human
ucgcaccuguaaucccagcauuuu

SEQ ID NO: 503834 - RNA, 32 nt, Human
ucgcaccuguaaucccagcauuuugggaggcu

SEQ ID NO: 503835 - RNA, 32 nt, Human
ucgcaccuguaaucccagggacucaggaugcu

SEQ ID NO: 503836 - RNA, 32 nt, Human
ucgcaccuguaaucccagucacugggaagccg

SEQ ID NO: 503837 - RNA, 32 nt, Human
ucgcaccuucgcucccccuccccugccagcca

SEQ ID NO: 503838 - RNA, 20 nt, Human
ucgcacgcugcuccggacua

SEQ ID NO: 503839 - RNA, 32 nt, Human
ucgcacgucuaggaagaagggaagagguggaa

SEQ ID NO: 503840 - RNA, 32 nt, Human
ucgcacuacugcacuccagccugggugacaga

SEQ ID NO: 503841 - RNA, 32 nt, Human
ucgcacuauugcacucaagccugggcgacaaa

SEQ ID NO: 503842 - RNA, 32 nt, Human
ucgcacucagucagagagcccugcacuggaac

SEQ ID NO: 503843 - RNA, 32 nt, Human
ucgcacuccagacuacagccugggugacagag

SEQ ID NO: 503844 - RNA, 32 nt, Human
ucgcacuccagccuggacaacagagcgagacu

SEQ ID NO: 503845 - RNA, 32 nt, Human
ucgcacuccagccugggugacagagugagauu

SEQ ID NO: 503846 - RNA, 32 nt, Human
ucgcacugcuguacccagccugggccacagug

SEQ ID NO: 503847 - RNA, 32 nt, Human
ucgcacuugucacccaggcuggagugcaaugg

SEQ ID NO: 503848 - RNA, 32 nt, Human
ucgcacuuguugcccaggcuggagugcaaugg

SEQ ID NO: 503849 - RNA, 32 nt, Human
ucgcacuuucaguuccuccauuuggaauucaa

SEQ ID NO: 503850 - RNA, 32 nt, Human
ucgcagacagucaggcuucaggcugucugaca

SEQ ID NO: 503851 - RNA, 32 nt, Human
ucgcagaccagagcugucugaacucacguguc

SEQ ID NO: 503852 - RNA, 32 nt, Human
ucgcagacggcagcgcagucacacucaggaag

SEQ ID NO: 503853 - RNA, 32 nt, Human
ucgcagacgugccuucugccaugauugugaag

SEQ ID NO: 503854 - RNA, 32 nt, Human
ucgcagagagauucggaggagcccgggcgggg

SEQ ID NO: 503855 - RNA, 32 nt, Human
ucgcagagagugacggugucuccuugcauccc

SEQ ID NO: 503856 - RNA, 32 nt, Human
ucgcagaggacggacgucagguacggagggac

SEQ ID NO: 503857 - RNA, 32 nt, Human
ucgcagaguucgcagagagaauguuaucuuug

SEQ ID NO: 503858 - RNA, 32 nt, Human
ucgcagauggggaggaccacgccugcaaccac

SEQ ID NO: 503859 - RNA, 32 nt, Human
ucgcagcaaauggcuucagccugggacgccag

SEQ ID NO: 503860 - RNA, 32 nt, Human
ucgcagcaccagaccagccucugcagcugcac

SEQ ID NO: 503861 - RNA, 32 nt, Human
ucgcagcacuguacuccagccugggcgaugga

SEQ ID NO: 503862 - RNA, 32 nt, Human
ucgcagcagccugaguguucucacuagggguc

SEQ ID NO: 503863 - RNA, 32 nt, Human
ucgcagcagcugcucccggcuccgcggccgca

SEQ ID NO: 503864 - RNA, 32 nt, Human
ucgcagcaggcgugauuacacaugcacaccaa

SEQ ID NO: 503865 - RNA, 32 nt, Human
ucgcagcagggagcucagcgaggcagagggug

SEQ ID NO: 503866 - RNA, 32 nt, Human
ucgcagccaccacaugucucagggcuaccuuc

SEQ ID NO: 503867 - RNA, 18 nt, Human
ucgcagcccgccucggcc

SEQ ID NO: 503868 - RNA, 32 nt, Human
ucgcagccgccgcugacuugugaaugggaccg

SEQ ID NO: 503869 - RNA, 19 nt, Human
ucgcagccgcgcucgggcc

SEQ ID NO: 503870 - RNA, 18 nt, Human
ucgcagccggccugagcc

SEQ ID NO: 503871 - RNA, 32 nt, Human
ucgcagccgggagccggccggggaagaggaga

SEQ ID NO: 503872 - RNA, 32 nt, Human
ucgcagccugaagccuggauuccagcagugaa

SEQ ID NO: 503873 - RNA, 32 nt, Human
ucgcagcggggagggggcggccggaggaugcg

SEQ ID NO: 503874 - RNA, 32 nt, Human
ucgcagcucacucgaggccuggggaaggggac

SEQ ID NO: 503875 - RNA, 32 nt, Human
ucgcagcucacugcaaucucugccuccugggu

SEQ ID NO: 503876 - RNA, 32 nt, Human
ucgcagcucacuguagccucuaucuccugggc

SEQ ID NO: 503877 - RNA, 32 nt, Human
ucgcagcucacuguagcuuugaccucucaggc

SEQ ID NO: 503878 - RNA, 21 nt, Human
ucgcagcugcguucccgggcu

SEQ ID NO: 503879 - RNA, 32 nt, Human
ucgcagcugcugguggucaucaugaucugcgu

SEQ ID NO: 503880 - RNA, 32 nt, Human
ucgcaggacugaaugaaggcaaacuucccaac

SEQ ID NO: 503881 - RNA, 32 nt, Human
ucgcaggaggugccgucugccucccaggugcg

SEQ ID NO: 503882 - RNA, 32 nt, Human
ucgcaggaucugacaagaguccagguucucag

SEQ ID NO: 503883 - RNA, 32 nt, Human
ucgcaggcgcgcaucccuccugacugggacgu

SEQ ID NO: 503884 - RNA, 32 nt, Human
ucgcaggcuuacaccuguaccagggagcuuac

SEQ ID NO: 503885 - RNA, 32 nt, Human
ucgcaggcuucucugcuggugcuucugugccu

SEQ ID NO: 503886 - RNA, 32 nt, Human
ucgcagggaacaggugggcacuauccucugug

SEQ ID NO: 503887 - RNA, 32 nt, Human
ucgcagggaacaguuggguggcuuccagcuua

SEQ ID NO: 503888 - RNA, 32 nt, Human
ucgcagggccuggagugaccuaagccgagagg

SEQ ID NO: 503889 - RNA, 32 nt, Human
ucgcagggggcuguggggaggcauaagcugau

SEQ ID NO: 503890 - RNA, 32 nt, Human
ucgcaggggugaggggaaggauagagaaucua

SEQ ID NO: 503891 - RNA, 32 nt, Human
ucgcagguucaagugauccucaugucucagcc

SEQ ID NO: 503892 - RNA, 32 nt, Human
ucgcagugcaagcucccgccucccuugggucg

SEQ ID NO: 503893 - RNA, 32 nt, Human
ucgcaguguagcugaaauacugucuaucucua

SEQ ID NO: 503894 - RNA, 32 nt, Human
ucgcaguguaggagaugaagagacuguggagu

SEQ ID NO: 503895 - RNA, 32 nt, Human
ucgcaguguaggagauggagagacuguggagu

SEQ ID NO: 503896 - RNA, 32 nt, Human
ucgcaguuagagacugccucccuuauucacgc

SEQ ID NO: 503897 - RNA, 32 nt, Human
ucgcaguuugccuggugcaguggcucacaccu

SEQ ID NO: 503898 - RNA, 32 nt, Human
ucgcauacacaaauggucuuuuuggggacuuu

SEQ ID NO: 503899 - RNA, 32 nt, Human
ucgcauagucacguagcucccaccccacccuc

SEQ ID NO: 503900 - RNA, 32 nt, Human
ucgcaucacugcaguccagccuggaugacaga

SEQ ID NO: 503901 - RNA, 20 nt, Human
ucgcauccgccucugagcca

SEQ ID NO: 503902 - RNA, 32 nt, Human
ucgcaucuguagucccagcuacucaggaggcu

SEQ ID NO: 503903 - RNA, 32 nt, Human
ucgcaucuuggacucggaaagccagacuccac

SEQ ID NO: 503904 - RNA, 32 nt, Human
ucgcaugagaggggagggacagcagugaccuc

SEQ ID NO: 503905 - RNA, 32 nt, Human
ucgcaugcaaacauuuggugauuaagcgaggc

SEQ ID NO: 503906 - RNA, 32 nt, Human
ucgcaugcagcucucagcacugggugggaggg

SEQ ID NO: 503907 - RNA, 32 nt, Human
ucgcaugccacugcacuccagccugggcgaca

SEQ ID NO: 503908 - RNA, 32 nt, Human
ucgcaugcccagagaugauguggaagcucuau

SEQ ID NO: 503909 - RNA, 32 nt, Human
ucgcaugccugcccgcccgccagccugccggg

SEQ ID NO: 503910 - RNA, 32 nt, Human
ucgcaugcgcagugaguaaacaugagccucug

SEQ ID NO: 503911 - RNA, 32 nt, Human
ucgcaugcuacugcacuccagccugggagaca

SEQ ID NO: 503912 - RNA, 32 nt, Human
ucgcaugcugggaucaucgggggaggguagug

SEQ ID NO: 503913 - RNA, 32 nt, Human
ucgcauggaggccuggggcggcccagaggagc

SEQ ID NO: 503914 - RNA, 32 nt, Human
ucgcauguaaagacauccaaaugccgacuucu

SEQ ID NO: 503915 - RNA, 32 nt, Human
ucgcauuacugcacuccagccuggguaacaga

SEQ ID NO: 503916 - RNA, 32 nt, Human
ucgcauucauuuucugcugaacgacuuuuaac

SEQ ID NO: 503917 - RNA, 32 nt, Human
ucgcauugaagccacagguggggcaaggucau

SEQ ID NO: 503918 - RNA, 32 nt, Human
ucgcauuuucccugccuaccucacagagcugu

SEQ ID NO: 503919 - RNA, 32 nt, Human
ucgccaaaguuggagugcaguggcgcggucuc

SEQ ID NO: 503920 - RNA, 21 nt, Human
ucgccaacacugaggacccca

SEQ ID NO: 503921 - RNA, 32 nt, Human
ucgccaacauggcgaaaccccaucucuacuaa

SEQ ID NO: 503922 - RNA, 32 nt, Human
ucgccaacauggugaaaccccaucucuacuaa

SEQ ID NO: 503923 - RNA, 32 nt, Human
ucgccaaccgcaucugcucaucugauauucaa

SEQ ID NO: 503924 - RNA, 21 nt, Human
ucgccaaggcuggagugcagu

SEQ ID NO: 503925 - RNA, 22 nt, Human
ucgccaaggcuggagugcagug

SEQ ID NO: 503926 - RNA, 32 nt, Human
ucgccaaggcuggagugcaguggugcgaucuc

SEQ ID NO: 503927 - RNA, 32 nt, Human
ucgccaaggcuggagugcaguggugugaucuc

SEQ ID NO: 503928 - RNA, 32 nt, Human
ucgccaaguguggcagccugugcaguguuggg

SEQ ID NO: 503929 - RNA, 32 nt, Human
ucgccaaguuggagcuugcagugagccgagau

SEQ ID NO: 503930 - RNA, 21 nt, Human
ucgccaaguuggagugcaaug

SEQ ID NO: 503931 - RNA, 32 nt, Human
ucgccacagugggcagucacacaaagcuaccc

SEQ ID NO: 503932 - RNA, 32 nt, Human
ucgccaccaagacucgcucccaaccuggcucc

SEQ ID NO: 503933 - RNA, 32 nt, Human
ucgccaccauuuuggaagaggaacauccaguc

SEQ ID NO: 503934 - RNA, 32 nt, Human
ucgccacccuccacccuucuccccagcgugcu

SEQ ID NO: 503935 - RNA, 32 nt, Human
ucgccacugcacuccagccugggaaauagagu

SEQ ID NO: 503936 - RNA, 32 nt, Human
ucgccacugcacuccagccugggugacagagc

SEQ ID NO: 503937 - RNA, 32 nt, Human
ucgccacugcacuccaggcugggcgacagagu

SEQ ID NO: 503938 - RNA, 19 nt, Human
ucgccacugcccuggggca

SEQ ID NO: 503939 - RNA, 32 nt, Human
ucgccacugcgcuccagccugggcaacagagu

SEQ ID NO: 503940 - RNA, 32 nt, Human
ucgccacuggccacuccucuguucucauugcu

SEQ ID NO: 503941 - RNA, 32 nt, Human
ucgccacugugcuccagccugggcaacagagu

SEQ ID NO: 503942 - RNA, 32 nt, Human
ucgccacuuaccaggaugggaaagcacagugu

SEQ ID NO: 503943 - RNA, 32 nt, Human
ucgccagcagcugggcuggggugcaggucauc

SEQ ID NO: 503944 - RNA, 32 nt, Human
ucgccagcccuccacguccucccaggcuggcu

SEQ ID NO: 503945 - RNA, 32 nt, Human
ucgccagcccugcuggaguuugcugugggcac

SEQ ID NO: 503946 - RNA, 32 nt, Human
ucgccagccgcaccccuccacccccacccugc

SEQ ID NO: 503947 - RNA, 30 nt, Human
ucgccagccgcauccaugcuucuggcgcgg

SEQ ID NO: 503948 - RNA, 32 nt, Human
ucgccagccguugcuuuguuacugaacgugcc

SEQ ID NO: 503949 - RNA, 32 nt, Human
ucgccaggcugcagccucaggcacuggcaggg

SEQ ID NO: 503950 - RNA, 32 nt, Human
ucgccaggcuggaaugcagugcagugagccaa

SEQ ID NO: 503951 - RNA, 20 nt, Human
ucgccaggcuggaguguagu

SEQ ID NO: 503952 - RNA, 21 nt, Human
ucgccaggcuggaguguagug

SEQ ID NO: 503953 - RNA, 22 nt, Human
ucgccaggcuggaguguagugg

SEQ ID NO: 503954 - RNA, 32 nt, Human
ucgccaggcuggucucuaacuccugggcucag

SEQ ID NO: 503955 - RNA, 21 nt, Human
ucgccagguuggagugcagug

SEQ ID NO: 503956 - RNA, 23 nt, Human
ucgccagugcccgcuucgagcca

SEQ ID NO: 503957 - RNA, 32 nt, Human
ucgccagugggcggacgccaggagcucacgga

SEQ ID NO: 503958 - RNA, 24 nt, Human
ucgccaucaucaucaccaccauca

SEQ ID NO: 503959 - RNA, 32 nt, Human
ucgccaucaucugucugaggucuuauuacuua

SEQ ID NO: 503960 - RNA, 30 nt, Human
ucgccaugcugcuccugggccugcugcugc

SEQ ID NO: 503961 - RNA, 32 nt, Human
ucgccauggacugggaauuaacauguauuuaa

SEQ ID NO: 503962 - RNA, 32 nt, Human
ucgccaugguuggagugcaguggugcgaucua

SEQ ID NO: 503963 - RNA, 32 nt, Human
ucgccaugugggccucuccauagggccgcuug

SEQ ID NO: 503964 - RNA, 32 nt, Human
ucgccauucuguagucuucagggucagcuguu

SEQ ID NO: 503965 - RNA, 32 nt, Human
ucgccauugcacuccauucugggcaacaagag

SEQ ID NO: 503966 - RNA, 32 nt, Human
ucgccauuuuguccagacuagucucgaacucu

SEQ ID NO: 503967 - RNA, 20 nt, Human
ucgcccaagcuagagugcag

SEQ ID NO: 503968 - RNA, 32 nt, Human
ucgcccaagcugaagugcaguggugcgaucuc

SEQ ID NO: 503969 - RNA, 22 nt, Human
ucgcccaagcugccaccgagcc

SEQ ID NO: 503970 - RNA, 32 nt, Human
ucgcccaagcuggagcgcaauggugugaucuu

SEQ ID NO: 503971 - RNA, 32 nt, Human
ucgcccaagcuggaguacaguggugcaaucuc

SEQ ID NO: 503972 - RNA, 22 nt, Human
ucgcccaagcuggagugcagug

SEQ ID NO: 503973 - RNA, 32 nt, Human
ucgcccaagcuggagugcaguggcacaaucau

SEQ ID NO: 503974 - RNA, 32 nt, Human
ucgcccaccagcccugggagagcucagaugcc

SEQ ID NO: 503975 - RNA, 32 nt, Human
ucgcccaccaggcuucuuucugaccccucaug

SEQ ID NO: 503976 - RNA, 32 nt, Human
ucgcccaccaucucccuaccauggacccccgc

SEQ ID NO: 503977 - RNA, 32 nt, Human
ucgcccacccaccucccuccaccccgugccac

SEQ ID NO: 503978 - RNA, 25 nt, Human
ucgcccacccaggcuggaguacagu

SEQ ID NO: 503979 - RNA, 32 nt, Human
ucgcccacccauuccuccuguaccagcaccuc

SEQ ID NO: 503980 - RNA, 22 nt, Human
ucgcccacgcgugcuccgagcu

SEQ ID NO: 503981 - RNA, 32 nt, Human
ucgcccacuccucccuccucuggcuauccuac

SEQ ID NO: 503982 - RNA, 32 nt, Human
ucgcccacucuuccagcccuugcuuggucaca

SEQ ID NO: 503983 - RNA, 32 nt, Human
ucgcccacugcacuccagguugggcuacagag

SEQ ID NO: 503984 - RNA, 32 nt, Human
ucgcccagacuagaaugcaguggugcaaucuc

SEQ ID NO: 503985 - RNA, 32 nt, Human
ucgcccagacuggagugcaauggugcggucac

SEQ ID NO: 503986 - RNA, 22 nt, Human
ucgcccagacuggagugcagug

SEQ ID NO: 503987 - RNA, 32 nt, Human
ucgcccagacuggagugcaguggugggaucgc

SEQ ID NO: 503988 - RNA, 32 nt, Human
ucgcccagagauaccuggccuucauccaaagg

SEQ ID NO: 503989 - RNA, 32 nt, Human
ucgcccagauaaaggaggaaaagggaaaggca

SEQ ID NO: 503990 - RNA, 22 nt, Human
ucgcccagccuggagugcagug

SEQ ID NO: 503991 - RNA, 21 nt, Human
ucgcccaggauggagugcagu

SEQ ID NO: 503992 - RNA, 23 nt, Human
ucgcccaggauggagugcagugg

SEQ ID NO: 503993 - RNA, 32 nt, Human
ucgcccaggauggagugcaguggcgcgaucuu

SEQ ID NO: 503994 - RNA, 32 nt, Human
ucgcccaggauggagugcaguggcucaaucuc

SEQ ID NO: 503995 - RNA, 32 nt, Human
ucgcccaggauggagugcaguggugcgaucuc

SEQ ID NO: 503996 - RNA, 32 nt, Human
ucgcccaggccaggcuguggcagaugagccgu

SEQ ID NO: 503997 - RNA, 32 nt, Human
ucgcccaggccggacugcaguggcgcaaucuu

SEQ ID NO: 503998 - RNA, 32 nt, Human
ucgcccaggccggagugcaguggugcgaucuc

SEQ ID NO: 503999 - RNA, 23 nt, Human
ucgcccaggccugggaugcagug

SEQ ID NO: 504000 - RNA, 32 nt, Human
ucgcccaggcgggaaugcaguggcgcaaucuu

SEQ ID NO: 504001 - RNA, 32 nt, Human
ucgcccaggcuagagugcaauggcgugaucuc

SEQ ID NO: 504002 - RNA, 22 nt, Human
ucgcccaggcuagagugcagug

SEQ ID NO: 504003 - RNA, 32 nt, Human
ucgcccaggcuagagugcaguggcacaaucuc

SEQ ID NO: 504004 - RNA, 32 nt, Human
ucgcccaggcuagagugcaguggcgcgauuuu

SEQ ID NO: 504005 - RNA, 22 nt, Human
ucgcccaggcugaguacagugg

SEQ ID NO: 504006 - RNA, 21 nt, Human
ucgcccaggcugcagugcagu

SEQ ID NO: 504007 - RNA, 22 nt, Human
ucgcccaggcugcagugcagug

SEQ ID NO: 504008 - RNA, 32 nt, Human
ucgcccaggcugcagugcgguggugcgaucuu

SEQ ID NO: 504009 - RNA, 22 nt, Human
ucgcccaggcuggaaugcagug

SEQ ID NO: 504010 - RNA, 32 nt, Human
ucgcccaggcuggaaugcaguggcgcgaucuc

SEQ ID NO: 504011 - RNA, 32 nt, Human
ucgcccaggcuggaaugcaguggcgugaucuc

SEQ ID NO: 504012 - RNA, 32 nt, Human
ucgcccaggcuggaaugcaguggugcaaacau

SEQ ID NO: 504013 - RNA, 32 nt, Human
ucgcccaggcuggaaugcaguggugcgaucuc

SEQ ID NO: 504014 - RNA, 32 nt, Human
ucgcccaggcuggaaugcaguggugcgaucuu

SEQ ID NO: 504015 - RNA, 32 nt, Human
ucgcccaggcuggaaugcuguagcaagauuuc

SEQ ID NO: 504016 - RNA, 32 nt, Human
ucgcccaggcuggacugcaguggugcgaucuc

SEQ ID NO: 504017 - RNA, 32 nt, Human
ucgcccaggcuggagagcgguggcgcgaucuc

SEQ ID NO: 504018 - RNA, 22 nt, Human
ucgcccaggcuggagcgcaaug

SEQ ID NO: 504019 - RNA, 32 nt, Human
ucgcccaggcuggagcgcaauggcgcgaaauc

SEQ ID NO: 504020 - RNA, 32 nt, Human
ucgcccaggcuggagcgcagucccgcaauguc

SEQ ID NO: 504021 - RNA, 22 nt, Human
ucgcccaggcuggagcgcagug

SEQ ID NO: 504022 - RNA, 32 nt, Human
ucgcccaggcuggagggcaguggcgugaucuc

SEQ ID NO: 504023 - RNA, 22 nt, Human
ucgcccaggcuggaguacaaug

SEQ ID NO: 504024 - RNA, 32 nt, Human
ucgcccaggcuggaguacaauggugcgaacuc

SEQ ID NO: 504025 - RNA, 21 nt, Human
ucgcccaggcuggaguacagu

SEQ ID NO: 504026 - RNA, 22 nt, Human
ucgcccaggcuggaguacagug

SEQ ID NO: 504027 - RNA, 23 nt, Human
ucgcccaggcuggaguacaguga

SEQ ID NO: 504028 - RNA, 32 nt, Human
ucgcccaggcuggaguacagugaugcaaucuc

SEQ ID NO: 504029 - RNA, 23 nt, Human
ucgcccaggcuggaguacagugg

SEQ ID NO: 504030 - RNA, 32 nt, Human
ucgcccaggcuggaguacaguggugcgaucuu

SEQ ID NO: 504031 - RNA, 32 nt, Human
ucgcccaggcuggaguacaguggugugauccc

SEQ ID NO: 504032 - RNA, 32 nt, Human
ucgcccaggcuggagugagugcaguggcgcaa

SEQ ID NO: 504033 - RNA, 32 nt, Human
ucgcccaggcuggagugaugaggcgcgaucau

SEQ ID NO: 504034 - RNA, 19 nt, Human
ucgcccaggcuggagugca

SEQ ID NO: 504035 - RNA, 20 nt, Human
ucgcccaggcuggagugcaa

SEQ ID NO: 504036 - RNA, 23 nt, Human
ucgcccaggcuggagugcaacgg

SEQ ID NO: 504037 - RNA, 32 nt, Human
ucgcccaggcuggagugcaacgguacgaucuu

SEQ ID NO: 504038 - RNA, 32 nt, Human
ucgcccaggcuggagugcaaguggcaugaucu

SEQ ID NO: 504039 - RNA, 21 nt, Human
ucgcccaggcuggagugcaau

SEQ ID NO: 504040 - RNA, 32 nt, Human
ucgcccaggcuggagugcaauacugcaaucac

SEQ ID NO: 504041 - RNA, 22 nt, Human
ucgcccaggcuggagugcaaug

SEQ ID NO: 504042 - RNA, 32 nt, Human
ucgcccaggcuggagugcaaugcacgaucuca

SEQ ID NO: 504043 - RNA, 32 nt, Human
ucgcccaggcuggagugcaaugccgugaucuc

SEQ ID NO: 504044 - RNA, 23 nt, Human
ucgcccaggcuggagugcaaugg

SEQ ID NO: 504045 - RNA, 32 nt, Human
ucgcccaggcuggagugcaauggcacaaucuc

SEQ ID NO: 504046 - RNA, 32 nt, Human
ucgcccaggcuggagugcaauggcacaauuuu

SEQ ID NO: 504047 - RNA, 32 nt, Human
ucgcccaggcuggagugcaauggcacgaucuc

SEQ ID NO: 504048 - RNA, 32 nt, Human
ucgcccaggcuggagugcaauggcgcaaucuc

SEQ ID NO: 504049 - RNA, 32 nt, Human
ucgcccaggcuggagugcaauggcgcgaucuc

SEQ ID NO: 504050 - RNA, 32 nt, Human
ucgcccaggcuggagugcaauggcgugaucuc

SEQ ID NO: 504051 - RNA, 32 nt, Human
ucgcccaggcuggagugcaauggugugaucuc

SEQ ID NO: 504052 - RNA, 22 nt, Human
ucgcccaggcuggagugcacug

SEQ ID NO: 504053 - RNA, 32 nt, Human
ucgcccaggcuggagugcacuggcgcaaucuc

SEQ ID NO: 504054 - RNA, 32 nt, Human
ucgcccaggcuggagugcacuggcgcgaucuc

SEQ ID NO: 504055 - RNA, 20 nt, Human
ucgcccaggcuggagugcag

SEQ ID NO: 504056 - RNA, 32 nt, Human
ucgcccaggcuggagugcagaggugcgaucuc

SEQ ID NO: 504057 - RNA, 32 nt, Human
ucgcccaggcuggagugcagcagcacagucuc

SEQ ID NO: 504058 - RNA, 32 nt, Human
ucgcccaggcuggagugcaggggcauuagcuc

SEQ ID NO: 504059 - RNA, 32 nt, Human
ucgcccaggcuggagugcaggggcgcaaucuc

SEQ ID NO: 504060 - RNA, 21 nt, Human
ucgcccaggcuggagugcagu

SEQ ID NO: 504061 - RNA, 32 nt, Human
ucgcccaggcuggagugcaguagcacgaucuu

SEQ ID NO: 504062 - RNA, 32 nt, Human
ucgcccaggcuggagugcaguagcgcgaucuc

SEQ ID NO: 504063 - RNA, 32 nt, Human
ucgcccaggcuggagugcaguagcgugaucuc

SEQ ID NO: 504064 - RNA, 32 nt, Human
ucgcccaggcuggagugcagucgugccaucuc

SEQ ID NO: 504065 - RNA, 22 nt, Human
ucgcccaggcuggagugcagug

SEQ ID NO: 504066 - RNA, 32 nt, Human
ucgcccaggcuggagugcagugagcugagauc

SEQ ID NO: 504067 - RNA, 32 nt, Human
ucgcccaggcuggagugcagugaugcaaucac

SEQ ID NO: 504068 - RNA, 32 nt, Human
ucgcccaggcuggagugcagugaugcaaucuc

SEQ ID NO: 504069 - RNA, 32 nt, Human
ucgcccaggcuggagugcagugccgcgaucuc

SEQ ID NO: 504070 - RNA, 23 nt, Human
ucgcccaggcuggagugcagugg

SEQ ID NO: 504071 - RNA, 32 nt, Human
ucgcccaggcuggagugcaguggagcgaucuc

SEQ ID NO: 504072 - RNA, 32 nt, Human
ucgcccaggcuggagugcaguggcacaaucuc

SEQ ID NO: 504073 - RNA, 32 nt, Human
ucgcccaggcuggagugcaguggcgcaaucuc

SEQ ID NO: 504074 - RNA, 32 nt, Human
ucgcccaggcuggagugcaguggcgcaauuuu

SEQ ID NO: 504075 - RNA, 32 nt, Human
ucgcccaggcuggagugcaguggcgcauucua

SEQ ID NO: 504076 - RNA, 32 nt, Human
ucgcccaggcuggagugcaguggcgccaucuc

SEQ ID NO: 504077 - RNA, 32 nt, Human
ucgcccaggcuggagugcaguggcgcgaucuc

SEQ ID NO: 504078 - RNA, 32 nt, Human
ucgcccaggcuggagugcaguggcgcggucuu

SEQ ID NO: 504079 - RNA, 32 nt, Human
ucgcccaggcuggagugcaguggcgugaucuc

SEQ ID NO: 504080 - RNA, 32 nt, Human
ucgcccaggcuggagugcaguggcgugaucuu

SEQ ID NO: 504081 - RNA, 32 nt, Human
ucgcccaggcuggagugcagugggugggguga

SEQ ID NO: 504082 - RNA, 32 nt, Human
ucgcccaggcuggagugcagugguacgaucuu

SEQ ID NO: 504083 - RNA, 32 nt, Human
ucgcccaggcuggagugcagugguagaucagg

SEQ ID NO: 504084 - RNA, 32 nt, Human
ucgcccaggcuggagugcagugguaugaucuc

SEQ ID NO: 504085 - RNA, 32 nt, Human
ucgcccaggcuggagugcaguggugagaucuc

SEQ ID NO: 504086 - RNA, 32 nt, Human
ucgcccaggcuggagugcaguggugcaaucac

SEQ ID NO: 504087 - RNA, 32 nt, Human
ucgcccaggcuggagugcaguggugcagucuc

SEQ ID NO: 504088 - RNA, 32 nt, Human
ucgcccaggcuggagugcaguggugcaguggc

SEQ ID NO: 504089 - RNA, 32 nt, Human
ucgcccaggcuggagugcaguggugccaucuc

SEQ ID NO: 504090 - RNA, 32 nt, Human
ucgcccaggcuggagugcaguggugccgucuc

SEQ ID NO: 504091 - RNA, 32 nt, Human
ucgcccaggcuggagugcaguggugcgaccuc

SEQ ID NO: 504092 - RNA, 32 nt, Human
ucgcccaggcuggagugcaguggugcgaccuu

SEQ ID NO: 504093 - RNA, 32 nt, Human
ucgcccaggcuggagugcaguggugcgaucuc

SEQ ID NO: 504094 - RNA, 32 nt, Human
ucgcccaggcuggagugcagugguggcgaucu

SEQ ID NO: 504095 - RNA, 32 nt, Human
ucgcccaggcuggagugcaguggugucaucau

SEQ ID NO: 504096 - RNA, 32 nt, Human
ucgcccaggcuggagugcaguggugugaucuc

SEQ ID NO: 504097 - RNA, 22 nt, Human
ucgcccaggcuggagugcauug

SEQ ID NO: 504098 - RNA, 32 nt, Human
ucgcccaggcuggagugccauggcgcgaucuc

SEQ ID NO: 504099 - RNA, 22 nt, Human
ucgcccaggcuggagugcgaug

SEQ ID NO: 504100 - RNA, 32 nt, Human
ucgcccaggcuggagugcgguggcgcaaccuc

SEQ ID NO: 504101 - RNA, 32 nt, Human
ucgcccaggcuggagugcgguggcgcgaucuc

SEQ ID NO: 504102 - RNA, 32 nt, Human
ucgcccaggcuggagugcgguggugcaaucuc

SEQ ID NO: 504103 - RNA, 32 nt, Human
ucgcccaggcuggaguguagugacgcgaucuc

SEQ ID NO: 504104 - RNA, 32 nt, Human
ucgcccaggcuggaguucaguggcgcgaucuu

SEQ ID NO: 504105 - RNA, 32 nt, Human
ucgcccaggcuggcgugaaguggcgcaaccag

SEQ ID NO: 504106 - RNA, 23 nt, Human
ucgcccaggcuggcgugcagugg

SEQ ID NO: 504107 - RNA, 32 nt, Human
ucgcccaggcuggcgugcaguggcacagucuc

SEQ ID NO: 504108 - RNA, 32 nt, Human
ucgcccaggcuggcgugcaguggcgcgaucuc

SEQ ID NO: 504109 - RNA, 32 nt, Human
ucgcccaggcuggggugcaauggcgcaaccuu

SEQ ID NO: 504110 - RNA, 20 nt, Human
ucgcccaggcuggggugcag

SEQ ID NO: 504111 - RNA, 32 nt, Human
ucgcccaggcuggggugcaguggcgccaucuc

SEQ ID NO: 504112 - RNA, 32 nt, Human
ucgcccaggcuggggugcaguggcgcgauccc

SEQ ID NO: 504113 - RNA, 32 nt, Human
ucgcccaggcuggucucaaauuuguggccuca

SEQ ID NO: 504114 - RNA, 32 nt, Human
ucgcccaggcuggucucgaacuccugagcuca

SEQ ID NO: 504115 - RNA, 22 nt, Human
ucgcccaggcuguagugcaaug

SEQ ID NO: 504116 - RNA, 32 nt, Human
ucgcccaggcuguagugcaauggcgcaaucuc

SEQ ID NO: 504117 - RNA, 32 nt, Human
ucgcccaggcuguagugcagugguacagucuc

SEQ ID NO: 504118 - RNA, 23 nt, Human
ucgcccagggcuggagugcagug

SEQ ID NO: 504119 - RNA, 32 nt, Human
ucgcccagggcugggugcaguggcucacgccu

SEQ ID NO: 504120 - RNA, 32 nt, Human
ucgcccaggguggagugcaguggcgugaucuc

SEQ ID NO: 504121 - RNA, 32 nt, Human
ucgcccaggguggagugcaguggugugaucuc

SEQ ID NO: 504122 - RNA, 32 nt, Human
ucgcccagguuggagugcaguggcgcaaucuc

SEQ ID NO: 504123 - RNA, 32 nt, Human
ucgcccagguuggagugcaguggcgcgaucuc

SEQ ID NO: 504124 - RNA, 32 nt, Human
ucgcccagguuggagugcaguggcgugaucuc

SEQ ID NO: 504125 - RNA, 32 nt, Human
ucgcccagguuggagugcaguggugcaaucuc

SEQ ID NO: 504126 - RNA, 32 nt, Human
ucgcccagguuguaaugcaguggcgcaaucuc

SEQ ID NO: 504127 - RNA, 32 nt, Human
ucgcccagguuugagugcaauggcacaaucuc

SEQ ID NO: 504128 - RNA, 32 nt, Human
ucgcccauccugcagggauugcccaccgucuu

SEQ ID NO: 504129 - RNA, 22 nt, Human
ucgcccaugcuggagugcagug

SEQ ID NO: 504130 - RNA, 32 nt, Human
ucgcccaugcuggagugcaguggcgcgaucuc

SEQ ID NO: 504131 - RNA, 32 nt, Human
ucgccccaacacuguccuucccugccacuuca

SEQ ID NO: 504132 - RNA, 32 nt, Human
ucgccccaacuaagcccuuuacaggccaggac

SEQ ID NO: 504133 - RNA, 32 nt, Human
ucgccccaccguucuucucugcugcauuugga

SEQ ID NO: 504134 - RNA, 32 nt, Human
ucgccccacuacacuccagccuggucaacaga

SEQ ID NO: 504135 - RNA, 32 nt, Human
ucgccccacugcacuccagccuggcaauagac

SEQ ID NO: 504136 - RNA, 32 nt, Human
ucgccccacugcacuccagccugggcgacaga

SEQ ID NO: 504137 - RNA, 32 nt, Human
ucgccccacugcacuccagccuggugacuccg

SEQ ID NO: 504138 - RNA, 32 nt, Human
ucgccccacugcuuuucaaccugggugacaga

SEQ ID NO: 504139 - RNA, 32 nt, Human
ucgccccagacccuugaggaaggugcucccuu

SEQ ID NO: 504140 - RNA, 32 nt, Human
ucgccccagaugggcaggaggacacccgccca

SEQ ID NO: 504141 - RNA, 32 nt, Human
ucgccccagccaggcuuggcacugccuccuuu

SEQ ID NO: 504142 - RNA, 20 nt, Human
ucgccccagcugccccgguc

SEQ ID NO: 504143 - RNA, 32 nt, Human
ucgccccagggagggaggacgagggagggcca

SEQ ID NO: 504144 - RNA, 32 nt, Human
ucgccccaguuagcaggguggcugcauuccag

SEQ ID NO: 504145 - RNA, 32 nt, Human
ucgccccaucccugcgcgcccagccugccaag

SEQ ID NO: 504146 - RNA, 32 nt, Human
ucgccccaucuucuccguggaugggccaugcg

SEQ ID NO: 504147 - RNA, 32 nt, Human
ucgccccauuguacuccagccuggggaacaag

SEQ ID NO: 504148 - RNA, 32 nt, Human
ucgcccccgccccgaccuccccggcugacgcg

SEQ ID NO: 504149 - RNA, 32 nt, Human
ucgcccccgccucccccugccucagcggcugc

SEQ ID NO: 504150 - RNA, 32 nt, Human
ucgcccccuaguaguuagucucugccugguuu

SEQ ID NO: 504151 - RNA, 20 nt, Human
ucgcccccuccccucgggcc

SEQ ID NO: 504152 - RNA, 32 nt, Human
ucgcccccugcacagcacuggccuuucggaag

SEQ ID NO: 504153 - RNA, 32 nt, Human
ucgcccccugcacgacccacacaaagcccuga

SEQ ID NO: 504154 - RNA, 32 nt, Human
ucgccccgcgcuuggacauggaaggggccgcc

SEQ ID NO: 504155 - RNA, 32 nt, Human
ucgccccggcgccgggggcuguagcccugguc

SEQ ID NO: 504156 - RNA, 32 nt, Human
ucgccccuagccucagcuuuucagcccugaga

SEQ ID NO: 504157 - RNA, 23 nt, Human
ucgccccucagugcccuggggca

SEQ ID NO: 504158 - RNA, 32 nt, Human
ucgccccucuacuccuccacgccccggcccuu

SEQ ID NO: 504159 - RNA, 32 nt, Human
ucgccccucugccuucgccccugucccgggag

SEQ ID NO: 504160 - RNA, 32 nt, Human
ucgccccugccucccuugccccuaccccggcg

SEQ ID NO: 504161 - RNA, 32 nt, Human
ucgccccugccuggcacugcucaccgcccaag

SEQ ID NO: 504162 - RNA, 32 nt, Human
ucgccccuucccucucucccugccucacuccu

SEQ ID NO: 504163 - RNA, 32 nt, Human
ucgccccuucggcuuggcuccuacaaggccca

SEQ ID NO: 504164 - RNA, 19 nt, Human
ucgccccuugucucgggcc

SEQ ID NO: 504165 - RNA, 32 nt, Human
ucgcccgacagcuuuuucuccguaguaugcga

SEQ ID NO: 504166 - RNA, 32 nt, Human
ucgcccgaucaguguuuugagggggaaggugg

SEQ ID NO: 504167 - RNA, 21 nt, Human
ucgcccgcagccucugcaccu

SEQ ID NO: 504168 - RNA, 21 nt, Human
ucgcccgcgccgucucgagcc

SEQ ID NO: 504169 - RNA, 32 nt, Human
ucgcccgcuacaccacuccucuagaacucggu

SEQ ID NO: 504170 - RNA, 32 nt, Human
ucgcccgggcaggagugcaguggcucaaucuu

SEQ ID NO: 504171 - RNA, 32 nt, Human
ucgcccgggcuggaaugcaauggcacaaucuc

SEQ ID NO: 504172 - RNA, 32 nt, Human
ucgcccucauggcucaucagugcugaguuuca

SEQ ID NO: 504173 - RNA, 32 nt, Human
ucgcccuccagccccaacccccggcccggcgc

SEQ ID NO: 504174 - RNA, 32 nt, Human
ucgcccucccagagugcugggacuacaggcau

SEQ ID NO: 504175 - RNA, 32 nt, Human
ucgcccucccagagugcugggauuacaggcgu

SEQ ID NO: 504176 - RNA, 32 nt, Human
ucgcccuccuccuccccagagcgagagugggg

SEQ ID NO: 504177 - RNA, 32 nt, Human
ucgcccucucaaagugcugggauuaggcauga

SEQ ID NO: 504178 - RNA, 21 nt, Human
ucgcccugcccccuacccacc

SEQ ID NO: 504179 - RNA, 18 nt, Human
ucgcccugcgccccggcc

SEQ ID NO: 504180 - RNA, 32 nt, Human
ucgcccugcugcacuccagccugggcaacaga

SEQ ID NO: 504181 - RNA, 32 nt, Human
ucgcccugcugcacuccagccugggugacaga

SEQ ID NO: 504182 - RNA, 32 nt, Human
ucgcccugcuggcugccggcaccgcccuccug

SEQ ID NO: 504183 - RNA, 20 nt, Human
ucgcccuggcugcccugacc

SEQ ID NO: 504184 - RNA, 22 nt, Human
ucgcccuggcuggagugcaaug

SEQ ID NO: 504185 - RNA, 32 nt, Human
ucgcccuggcuggagugcaauggugugaucuc

SEQ ID NO: 504186 - RNA, 22 nt, Human
ucgcccuggcuggaguggaaug

SEQ ID NO: 504187 - RNA, 21 nt, Human
ucgcccugggcugccccgacu

SEQ ID NO: 504188 - RNA, 32 nt, Human
ucgcccuggucguugcacuccagccugucgcu

SEQ ID NO: 504189 - RNA, 32 nt, Human
ucgcccugucgccaggcuggaguguaguggca

SEQ ID NO: 504190 - RNA, 32 nt, Human
ucgcccuguggccugcuagccuggucgagaga

SEQ ID NO: 504191 - RNA, 32 nt, Human
ucgcccuucccccaccuccuugucuuuccccg

SEQ ID NO: 504192 - RNA, 32 nt, Human
ucgcccuuccuggguucauccugcugcaggug

SEQ ID NO: 504193 - RNA, 32 nt, Human
ucgcccuucuccuggaccucagggaggaauga

SEQ ID NO: 504194 - RNA, 32 nt, Human
ucgcccuugacagcugccuuguggaucuucug

SEQ ID NO: 504195 - RNA, 21 nt, Human
ucgcccuuggcccugcugccu

SEQ ID NO: 504196 - RNA, 32 nt, Human
ucgcccuugucacccaggcuguagugcggugg

SEQ ID NO: 504197 - RNA, 32 nt, Human
ucgcccuuuacaagggacuuuugaaggaggaa

SEQ ID NO: 504198 - RNA, 17 nt, Human
ucgccgagccccgggcc

SEQ ID NO: 504199 - RNA, 22 nt, Human
ucgccgaguccuucugcugccu

SEQ ID NO: 504200 - RNA, 21 nt, Human
ucgccgcagcccuuccgagcc

SEQ ID NO: 504201 - RNA, 20 nt, Human
ucgccgccaccgccucggcc

SEQ ID NO: 504202 - RNA, 32 nt, Human
ucgccgccagcgucugugccgcgucccuugcu

SEQ ID NO: 504203 - RNA, 32 nt, Human
ucgccgccaucugucaccuccacuccggcauc

SEQ ID NO: 504204 - RNA, 19 nt, Human
ucgccgcccgcccgggguc

SEQ ID NO: 504205 - RNA, 18 nt, Human
ucgccgcccgcccggguc

SEQ ID NO: 504206 - RNA, 19 nt, Human
ucgccgcccgcuccgagcc

SEQ ID NO: 504207 - RNA, 32 nt, Human
ucgccgcccuguuucugcaggcauuuugucuc

SEQ ID NO: 504208 - RNA, 32 nt, Human
ucgccgccgcagucuucgccaccaugccgccc

SEQ ID NO: 504209 - RNA, 18 nt, Human
ucgccgccgccgccgccg

SEQ ID NO: 504210 - RNA, 32 nt, Human
ucgccgccgggugggagccgggccgggcagcc

SEQ ID NO: 504211 - RNA, 32 nt, Human
ucgccgccuauacacacgcacacacgcacaca

SEQ ID NO: 504212 - RNA, 17 nt, Human
ucgccgccucccgggcu

SEQ ID NO: 504213 - RNA, 20 nt, Human
ucgccgccucgcucagagcc

SEQ ID NO: 504214 - RNA, 18 nt, Human
ucgccgcggaccugagcc

SEQ ID NO: 504215 - RNA, 19 nt, Human
ucgccgcggagcucgagcc

SEQ ID NO: 504216 - RNA, 32 nt, Human
ucgccgcggaggcuccagcgguaggugcgccc

SEQ ID NO: 504217 - RNA, 18 nt, Human
ucgccgcuccaugcagcc

SEQ ID NO: 504218 - RNA, 17 nt, Human
ucgccgcucgcaagcua

SEQ ID NO: 504219 - RNA, 20 nt, Human
ucgccgcucgccccgcgggc

SEQ ID NO: 504220 - RNA, 21 nt, Human
ucgccgcucgccgcugcaguu

SEQ ID NO: 504221 - RNA, 17 nt, Human
ucgccgcucgcugcagc

SEQ ID NO: 504222 - RNA, 32 nt, Human
ucgccgcucggggccgcagccuggugagcuca

SEQ ID NO: 504223 - RNA, 18 nt, Human
ucgccgcucugcgaggcc

SEQ ID NO: 504224 - RNA, 20 nt, Human
ucgccgcucuucuugaauca

SEQ ID NO: 504225 - RNA, 32 nt, Human
ucgccgcugcacgacgucuggccggcgcugga

SEQ ID NO: 504226 - RNA, 19 nt, Human
ucgccgcugcaguugagcu

SEQ ID NO: 504227 - RNA, 32 nt, Human
ucgccgcugccaccuccgcagcccgggccucc

SEQ ID NO: 504228 - RNA, 32 nt, Human
ucgccgcugccgccuccgcccgcggccgggac

SEQ ID NO: 504229 - RNA, 19 nt, Human
ucgccgcugccucgggcua

SEQ ID NO: 504230 - RNA, 19 nt, Human
ucgccgcugcgccucagcc

SEQ ID NO: 504231 - RNA, 19 nt, Human
ucgccgcugcguugggacc

SEQ ID NO: 504232 - RNA, 20 nt, Human
ucgccgcuggagcccggguc

SEQ ID NO: 504233 - RNA, 19 nt, Human
ucgccgcuggcuuccaguc

SEQ ID NO: 504234 - RNA, 19 nt, Human
ucgccgcugucccuuagcu

SEQ ID NO: 504235 - RNA, 32 nt, Human
ucgccgcugucgggcucguccugcugcugcug

SEQ ID NO: 504236 - RNA, 21 nt, Human
ucgccgcuuccgccuugacca

SEQ ID NO: 504237 - RNA, 32 nt, Human
ucgccggaguagcuugggaggucggggagguc

SEQ ID NO: 504238 - RNA, 32 nt, Human
ucgccggcaggacacugccuggaacgccugga

SEQ ID NO: 504239 - RNA, 20 nt, Human
ucgccggccgcgcccgggcu

SEQ ID NO: 504240 - RNA, 18 nt, Human
ucgccggcgcccgagcca

SEQ ID NO: 504241 - RNA, 32 nt, Human
ucgccggcgggaccaugaagaaguucucucgg

SEQ ID NO: 504242 - RNA, 32 nt, Human
ucgccggggauguuggcaggaugugauucaga

SEQ ID NO: 504243 - RNA, 32 nt, Human
ucgccgggggcugagcgcgcggcugggcccug

SEQ ID NO: 504244 - RNA, 32 nt, Human
ucgccgggggcugcucccugcuuaccucccuc

SEQ ID NO: 504245 - RNA, 32 nt, Human
ucgccggguccucgucccgcagccucuucucg

SEQ ID NO: 504246 - RNA, 32 nt, Human
ucgccgggugucccagugucaccaacacucgg

SEQ ID NO: 504247 - RNA, 19 nt, Human
ucgccggucccccggguca

SEQ ID NO: 504248 - RNA, 32 nt, Human
ucgccguaaagaugcagcauuggccgagugca

SEQ ID NO: 504249 - RNA, 32 nt, Human
ucgccguccagccugcagcaugagcgccccca

SEQ ID NO: 504250 - RNA, 19 nt, Human
ucgccgucuccuuugggcu

SEQ ID NO: 504251 - RNA, 20 nt, Human
ucgccgucugugaauuggac

SEQ ID NO: 504252 - RNA, 32 nt, Human
ucgccgugcuguccuccgugagcaccauccgg

SEQ ID NO: 504253 - RNA, 17 nt, Human
ucgccguggccccgguc

SEQ ID NO: 504254 - RNA, 22 nt, Human
ucgccguucgcggagcgcagcc

SEQ ID NO: 504255 - RNA, 17 nt, Human
ucgccguugcccaggcu

SEQ ID NO: 504256 - RNA, 32 nt, Human
ucgccguugcccaggcuggagugcgguggcau

SEQ ID NO: 504257 - RNA, 18 nt, Human
ucgccguuggcccggguu

SEQ ID NO: 504258 - RNA, 32 nt, Human
ucgccguuuucagucccagaucuugcucugcc

SEQ ID NO: 504259 - RNA, 32 nt, Human
  misc_feature (6)..(6): n is a, c, g or u
ucgccnggcugaggcaggagaaucacuugaac

SEQ ID NO: 504260 - RNA, 32 nt, Human
ucgccuacauccgccucacccaguacaucgac

SEQ ID NO: 504261 - RNA, 22 nt, Human
ucgccuacgcuggagugcagug

SEQ ID NO: 504262 - RNA, 31 nt, Human
ucgccuagcacucugccuugccagagauugg

SEQ ID NO: 504263 - RNA, 23 nt, Human
ucgccuaggcugaagcacagugg

SEQ ID NO: 504264 - RNA, 32 nt, Human
ucgccuaggcugaagcacaguggugcgaucac

SEQ ID NO: 504265 - RNA, 20 nt, Human
ucgccuaggcuggagugcaa

SEQ ID NO: 504266 - RNA, 32 nt, Human
ucgccuaggcuggagugcaacagugugaucuu

SEQ ID NO: 504267 - RNA, 32 nt, Human
ucgccuaggcuggagugcaaugaugcgauccu

SEQ ID NO: 504268 - RNA, 21 nt, Human
ucgccuaggcuggagugcagu

SEQ ID NO: 504269 - RNA, 22 nt, Human
ucgccuaggcuggagugcagug

SEQ ID NO: 504270 - RNA, 32 nt, Human
ucgccuaggcuggagugcaguggcgugaucuu

SEQ ID NO: 504271 - RNA, 32 nt, Human
ucgccuaggcuggagugcaguggugcagucac

SEQ ID NO: 504272 - RNA, 32 nt, Human
ucgccuagggaaauagaucuauucugcuggga

SEQ ID NO: 504273 - RNA, 32 nt, Human
ucgccuagggucagcggugacaucccaaaggg

SEQ ID NO: 504274 - RNA, 32 nt, Human
ucgccuauucucacaccucuucucggucccau

SEQ ID NO: 504275 - RNA, 32 nt, Human
ucgccucacugaggccuccccaguccaaagcu

SEQ ID NO: 504276 - RNA, 32 nt, Human
ucgccucacugcaaccuccgccucccagguuc

SEQ ID NO: 504277 - RNA, 32 nt, Human
ucgccucacugcaaccuucaccuaccgaguuc

SEQ ID NO: 504278 - RNA, 32 nt, Human
ucgccucacugcaacuugcgccucccggguuc

SEQ ID NO: 504279 - RNA, 32 nt, Human
ucgccucacugcagccuccccaguccaaagcu

SEQ ID NO: 504280 - RNA, 32 nt, Human
ucgccucacugcagccucccgaguccaaagcu

SEQ ID NO: 504281 - RNA, 32 nt, Human
ucgccucagaauagagcagggccaggcuuugg

SEQ ID NO: 504282 - RNA, 32 nt, Human
ucgccucaucugaggcccagauaauggugaga

SEQ ID NO: 504283 - RNA, 32 nt, Human
ucgccuccaguggaggcugagcugacccuggg

SEQ ID NO: 504284 - RNA, 32 nt, Human
ucgccuccccuccuguagcccacacccuucuu

SEQ ID NO: 504285 - RNA, 32 nt, Human
ucgccuccccuucauccaccucucucucaccg

SEQ ID NO: 504286 - RNA, 21 nt, Human
ucgccucccggccgccgccgu

SEQ ID NO: 504287 - RNA, 21 nt, Human
ucgccucccuccaggacucca

SEQ ID NO: 504288 - RNA, 32 nt, Human
ucgccuccgagaggaggaagggacagaccaaa

SEQ ID NO: 504289 - RNA, 32 nt, Human
ucgccuccucucacuuucaucucuucccucca

SEQ ID NO: 504290 - RNA, 32 nt, Human
ucgccuccuuucucucccaggugcuggaccag

SEQ ID NO: 504291 - RNA, 32 nt, Human
ucgccucgacuccaaaugguugaaaacagaua

SEQ ID NO: 504292 - RNA, 32 nt, Human
ucgccucgccuccccucaccuugccucaccuc

SEQ ID NO: 504293 - RNA, 32 nt, Human
ucgccucgccucgagucucuggcuccgaccuc

SEQ ID NO: 504294 - RNA, 22 nt, Human
ucgccucgccucgccucgaguc

SEQ ID NO: 504295 - RNA, 32 nt, Human
ucgccucgcgccgguaguuuugggccuacacc

SEQ ID NO: 504296 - RNA, 32 nt, Human
ucgccucgcucauuaccagaaggagguuuuac

SEQ ID NO: 504297 - RNA, 32 nt, Human
ucgccucucaaggagagcuuugauccucagug

SEQ ID NO: 504298 - RNA, 32 nt, Human
ucgccucucuagaccagaucuagccccacccu

SEQ ID NO: 504299 - RNA, 18 nt, Human
ucgccucugcccuggguc

SEQ ID NO: 504300 - RNA, 32 nt, Human
ucgccugaacccaggaggcggagcuugcagug

SEQ ID NO: 504301 - RNA, 32 nt, Human
ucgccugaacccaggaggcggagguugcaggg

SEQ ID NO: 504302 - RNA, 32 nt, Human
ucgccugaagccagccucucugccaagucacu

SEQ ID NO: 504303 - RNA, 32 nt, Human
ucgccugacaguuaaagcagaggacuacacuu

SEQ ID NO: 504304 - RNA, 32 nt, Human
ucgccugaccaggaguucgaggcugcagugag

SEQ ID NO: 504305 - RNA, 32 nt, Human
ucgccugagcccaggagguggagguugcagug

SEQ ID NO: 504306 - RNA, 32 nt, Human
ucgccugcagccgccgccgccgcggggcgggc

SEQ ID NO: 504307 - RNA, 32 nt, Human
ucgccugccucggggccaguacauaccggccu

SEQ ID NO: 504308 - RNA, 32 nt, Human
ucgccugccugugucucuccccaaaccccuuu

SEQ ID NO: 504309 - RNA, 24 nt, Human
ucgccugcucgcuuccccuuccca

SEQ ID NO: 504310 - RNA, 32 nt, Human
ucgccugcucgcuuccccuucccaggcccgug

SEQ ID NO: 504311 - RNA, 32 nt, Human
ucgccuggaagucugggggccauuccaugugg

SEQ ID NO: 504312 - RNA, 32 nt, Human
ucgccuggagugaaccagguugaaacugagaa

SEQ ID NO: 504313 - RNA, 18 nt, Human
ucgccuggcccccgaguc

SEQ ID NO: 504314 - RNA, 21 nt, Human
ucgccuggcuggagugcagug

SEQ ID NO: 504315 - RNA, 32 nt, Human
ucgccugggaagagaaaguguccaguagggcg

SEQ ID NO: 504316 - RNA, 32 nt, Human
ucgccugggagcugccgccagggccaggaggg

SEQ ID NO: 504317 - RNA, 32 nt, Human
ucgccugggaggugaggugugugugacccacu

SEQ ID NO: 504318 - RNA, 32 nt, Human
ucgccugggcuggaguacaguggugcgaucuc

SEQ ID NO: 504319 - RNA, 32 nt, Human
ucgccugucaacggcuagagugcaguagcgug

SEQ ID NO: 504320 - RNA, 32 nt, Human
ucgccugucuggcuggcagggaaggaaaauag

SEQ ID NO: 504321 - RNA, 32 nt, Human
ucgccuguuggggcuuaagaccagguugauaa

SEQ ID NO: 504322 - RNA, 32 nt, Human
ucgccuguuggugcuggcccuuggggagcugg

SEQ ID NO: 504323 - RNA, 32 nt, Human
ucgccuguuugcgguuuagaccccaaagauuc

SEQ ID NO: 504324 - RNA, 32 nt, Human
ucgccuucccucucuucugucccggccaggau

SEQ ID NO: 504325 - RNA, 32 nt, Human
ucgccuuccucuuuuuaagcuguuuuaugaaa

SEQ ID NO: 504326 - RNA, 32 nt, Human
ucgccuucuccccuccauccagccuggcgucc

SEQ ID NO: 504327 - RNA, 22 nt, Human
ucgccuucuccgcccccgggcc

SEQ ID NO: 504328 - RNA, 32 nt, Human
ucgccuucugcucccagcuuggagccccgcgc

SEQ ID NO: 504329 - RNA, 32 nt, Human
ucgccuucugggcucccagccugccgggucgc

SEQ ID NO: 504330 - RNA, 32 nt, Human
ucgccuugacuccaaaugguugaaaacagaua

SEQ ID NO: 504331 - RNA, 32 nt, Human
ucgccuugcaaccgacaggccauucccacccc

SEQ ID NO: 504332 - RNA, 32 nt, Human
ucgccuuggaaccugcaggaaauggaacagca

SEQ ID NO: 504333 - RNA, 32 nt, Human
ucgccuuuagaacgugcagccucuccaugucu

SEQ ID NO: 504334 - RNA, 32 nt, Human
ucgccuuucacaguccccuccugccugcuccu

SEQ ID NO: 504335 - RNA, 32 nt, Human
ucgccuuugcugaaaauacaaaauuagccagg

SEQ ID NO: 504336 - RNA, 32 nt, Human
ucgccuuuggcagcuccuggagagcuguggac

SEQ ID NO: 504337 - RNA, 32 nt, Human
ucgccuuugucuuucagugagcucuuucaccu

SEQ ID NO: 504338 - RNA, 32 nt, Human
ucgcgacacugcacuccagccugggcaacaga

SEQ ID NO: 504339 - RNA, 32 nt, Human
ucgcgacacugcacuccagccugggugacggu

SEQ ID NO: 504340 - RNA, 32 nt, Human
ucgcgacacugcgcuccagccugggcaacaag

SEQ ID NO: 504341 - RNA, 32 nt, Human
ucgcgaccagccuacccaacauggugaaaccc

SEQ ID NO: 504342 - RNA, 32 nt, Human
ucgcgaccagccugaccaacauggaaaaaccc

SEQ ID NO: 504343 - RNA, 32 nt, Human
ucgcgaccauccuggcuaacagugaaacccug

SEQ ID NO: 504344 - RNA, 25 nt, Human
ucgcgagcagcugggacuacaggug

SEQ ID NO: 504345 - RNA, 32 nt, Human
ucgcgaggguauacgcaugcacuaacggcugu

SEQ ID NO: 504346 - RNA, 32 nt, Human
ucgcgagguugaggcaggagaauugcuugaac

SEQ ID NO: 504347 - RNA, 23 nt, Human
ucgcgaguagcuaggacuacagg

SEQ ID NO: 504348 - RNA, 32 nt, Human
ucgcgaguucacgccagucuccugccucagcc

SEQ ID NO: 504349 - RNA, 30 nt, Human
ucgcgaugguccaucagcucucugccaucc

SEQ ID NO: 504350 - RNA, 32 nt, Human
ucgcgcaauugcgcuccagccugggcgacaag

SEQ ID NO: 504351 - RNA, 32 nt, Human
ucgcgcacacacugguucuccucuuuugggug

SEQ ID NO: 504352 - RNA, 32 nt, Human
ucgcgcacuggagcuguggccucggcagcugu

SEQ ID NO: 504353 - RNA, 32 nt, Human
ucgcgcagcugcacuccagccugggcaacaga

SEQ ID NO: 504354 - RNA, 18 nt, Human
ucgcgcaucccucgagcc

SEQ ID NO: 504355 - RNA, 32 nt, Human
ucgcgccaaugcacuccagccugggcgacaga

SEQ ID NO: 504356 - RNA, 32 nt, Human
ucgcgccaccacacuccagccugagcgacaga

SEQ ID NO: 504357 - RNA, 32 nt, Human
ucgcgccacccacuccagcccgggugacagag

SEQ ID NO: 504358 - RNA, 32 nt, Human
ucgcgccaccgcacuccagccucgccgacaaa

SEQ ID NO: 504359 - RNA, 32 nt, Human
ucgcgccaccgcauuccagccugggcgacaga

SEQ ID NO: 504360 - RNA, 32 nt, Human
ucgcgccaccgcccuccagccugggcgacaga

SEQ ID NO: 504361 - RNA, 32 nt, Human
ucgcgccacggcacuccagccugggagacaga

SEQ ID NO: 504362 - RNA, 32 nt, Human
ucgcgccacuacacuccagccugagcaacaga

SEQ ID NO: 504363 - RNA, 32 nt, Human
ucgcgccacuauacuccagccugggcaacaga

SEQ ID NO: 504364 - RNA, 32 nt, Human
ucgcgccacugcaacccagccugggugacaga

SEQ ID NO: 504365 - RNA, 32 nt, Human
ucgcgccacugcacagccagggcgacggugca

SEQ ID NO: 504366 - RNA, 32 nt, Human
ucgcgccacugcacucaagccugggcaacacc

SEQ ID NO: 504367 - RNA, 32 nt, Human
ucgcgccacugcacuccaaccugggugacaga

SEQ ID NO: 504368 - RNA, 32 nt, Human
ucgcgccacugcacuccacccuggguaacgga

SEQ ID NO: 504369 - RNA, 32 nt, Human
ucgcgccacugcacuccagcagucugggcgac

SEQ ID NO: 504370 - RNA, 32 nt, Human
ucgcgccacugcacuccagcccgggugacaga

SEQ ID NO: 504371 - RNA, 32 nt, Human
ucgcgccacugcacuccagccuagacgacaga

SEQ ID NO: 504372 - RNA, 32 nt, Human
ucgcgccacugcacuccagccuaggggacagu

SEQ ID NO: 504373 - RNA, 32 nt, Human
ucgcgccacugcacuccagccuaggugacaga

SEQ ID NO: 504374 - RNA, 32 nt, Human
ucgcgccacugcacuccagccucagcaauaga

SEQ ID NO: 504375 - RNA, 32 nt, Human
ucgcgccacugcacuccagccucggcaacaga

SEQ ID NO: 504376 - RNA, 32 nt, Human
ucgcgccacugcacuccagccucggugacaga

SEQ ID NO: 504377 - RNA, 32 nt, Human
ucgcgccacugcacuccagccuggacgacaga

SEQ ID NO: 504378 - RNA, 32 nt, Human
ucgcgccacugcacuccagccuggcaacagag

SEQ ID NO: 504379 - RNA, 32 nt, Human
ucgcgccacugcacuccagccuggcgacaaag

SEQ ID NO: 504380 - RNA, 32 nt, Human
ucgcgccacugcacuccagccuggcgacagag

SEQ ID NO: 504381 - RNA, 32 nt, Human
ucgcgccacugcacuccagccugggagaaaga

SEQ ID NO: 504382 - RNA, 32 nt, Human
ucgcgccacugcacuccagccugggcaacaag

SEQ ID NO: 504383 - RNA, 32 nt, Human
ucgcgccacugcacuccagccugggcaacaga

SEQ ID NO: 504384 - RNA, 32 nt, Human
ucgcgccacugcacuccagccugggcaacagg

SEQ ID NO: 504385 - RNA, 32 nt, Human
ucgcgccacugcacuccagccugggcagcaag

SEQ ID NO: 504386 - RNA, 32 nt, Human
ucgcgccacugcacuccagccugggcgacaca

SEQ ID NO: 504387 - RNA, 32 nt, Human
ucgcgccacugcacuccagccugggcgacaga

SEQ ID NO: 504388 - RNA, 32 nt, Human
ucgcgccacugcacuccagccugggcgacagc

SEQ ID NO: 504389 - RNA, 32 nt, Human
ucgcgccacugcacuccagccugggcgacagg

SEQ ID NO: 504390 - RNA, 32 nt, Human
ucgcgccacugcacuccagccugggcgacgga

SEQ ID NO: 504391 - RNA, 32 nt, Human
ucgcgccacugcacuccagccugggcgagaga

SEQ ID NO: 504392 - RNA, 32 nt, Human
ucgcgccacugcacuccagccugggcgauaga

SEQ ID NO: 504393 - RNA, 32 nt, Human
ucgcgccacugcacuccagccuggguaacaga

SEQ ID NO: 504394 - RNA, 32 nt, Human
ucgcgccacugcacuccagccugggugacaca

SEQ ID NO: 504395 - RNA, 32 nt, Human
ucgcgccacugcacuccagccugggugacaga

SEQ ID NO: 504396 - RNA, 32 nt, Human
ucgcgccacugcacuccagccugggugauaga

SEQ ID NO: 504397 - RNA, 32 nt, Human
ucgcgccacugcacuccagccuggugacagag

SEQ ID NO: 504398 - RNA, 32 nt, Human
ucgcgccacugcacuccagcuugggcaacaga

SEQ ID NO: 504399 - RNA, 32 nt, Human
ucgcgccacugcacuccaggccugggugacag

SEQ ID NO: 504400 - RNA, 32 nt, Human
ucgcgccacugcacuccaggcugggcaacgga

SEQ ID NO: 504401 - RNA, 32 nt, Human
ucgcgccacugcacuccaggcugggcgacaga

SEQ ID NO: 504402 - RNA, 32 nt, Human
ucgcgccacugcacuccagucugggcaacaga

SEQ ID NO: 504403 - RNA, 32 nt, Human
ucgcgccacugcacuccaguuugggcaacaga

SEQ ID NO: 504404 - RNA, 32 nt, Human
ucgcgccacugcacuccggccugaugacagag

SEQ ID NO: 504405 - RNA, 32 nt, Human
ucgcgccacugcacuccugccugggacacaau

SEQ ID NO: 504406 - RNA, 32 nt, Human
ucgcgccacugcacuccugccugggcaacuga

SEQ ID NO: 504407 - RNA, 32 nt, Human
ucgcgccacugcacucuagccggagugacaga

SEQ ID NO: 504408 - RNA, 32 nt, Human
ucgcgccacugcacucuagccugagugacaga

SEQ ID NO: 504409 - RNA, 32 nt, Human
ucgcgccacugcacucuagccugggccauaga

SEQ ID NO: 504410 - RNA, 32 nt, Human
ucgcgccacugcacucuagccugggugacaga

SEQ ID NO: 504411 - RNA, 32 nt, Human
ucgcgccacugcacuucagccuggacaacaga

SEQ ID NO: 504412 - RNA, 32 nt, Human
ucgcgccacugcacuucagccugggugacaga

SEQ ID NO: 504413 - RNA, 32 nt, Human
ucgcgccacugcaguccagccugggcaacaag

SEQ ID NO: 504414 - RNA, 32 nt, Human
ucgcgccacugcauuccagccuggacgacaga

SEQ ID NO: 504415 - RNA, 32 nt, Human
ucgcgccacugcccuccagccugggcgacaga

SEQ ID NO: 504416 - RNA, 32 nt, Human
ucgcgccacugcgcuccagccuggacaacaca

SEQ ID NO: 504417 - RNA, 32 nt, Human
ucgcgccacugcgcuucagccugggagacaga

SEQ ID NO: 504418 - RNA, 32 nt, Human
ucgcgccacugcucuccagccuggguggcaga

SEQ ID NO: 504419 - RNA, 32 nt, Human
ucgcgccacuggacuccagccuggacaacaga

SEQ ID NO: 504420 - RNA, 32 nt, Human
ucgcgccacugggcuccagccugggcgacaga

SEQ ID NO: 504421 - RNA, 32 nt, Human
ucgcgccacuguacuccagccuggacaacagc

SEQ ID NO: 504422 - RNA, 32 nt, Human
ucgcgccacuguacuccagccugggcaacaga

SEQ ID NO: 504423 - RNA, 32 nt, Human
ucgcgccacuguacuccagccugggugacaga

SEQ ID NO: 504424 - RNA, 32 nt, Human
ucgcgccacuguacuccauccugggugaugga

SEQ ID NO: 504425 - RNA, 32 nt, Human
ucgcgccacugugcuccagccugggcaacaga

SEQ ID NO: 504426 - RNA, 32 nt, Human
ucgcgccagcaaccccagcucuccccagagag

SEQ ID NO: 504427 - RNA, 32 nt, Human
ucgcgccaguacacuccagccuggguaacaga

SEQ ID NO: 504428 - RNA, 32 nt, Human
ucgcgccagugcacuccagccugggcaagaag

SEQ ID NO: 504429 - RNA, 32 nt, Human
ucgcgccauagcacuccagccuuagccugggc

SEQ ID NO: 504430 - RNA, 32 nt, Human
ucgcgccaucacacuccagccuaggcgacaga

SEQ ID NO: 504431 - RNA, 32 nt, Human
ucgcgccaucgcacuccagccugggcaacaag

SEQ ID NO: 504432 - RNA, 32 nt, Human
ucgcgccaucgcacuccagccugggugacaag

SEQ ID NO: 504433 - RNA, 32 nt, Human
ucgcgccauggcacucacuccagccugggcaa

SEQ ID NO: 504434 - RNA, 32 nt, Human
ucgcgccauuacacuucagccugggcaacaag

SEQ ID NO: 504435 - RNA, 32 nt, Human
ucgcgccauucuacuccagccugggccacaag

SEQ ID NO: 504436 - RNA, 32 nt, Human
ucgcgccauugcacuccaaccuaggugacaaa

SEQ ID NO: 504437 - RNA, 32 nt, Human
ucgcgccauugcacuccaaccuggacgacaga

SEQ ID NO: 504438 - RNA, 32 nt, Human
ucgcgccauugcacuccagccuggacaacaag

SEQ ID NO: 504439 - RNA, 32 nt, Human
ucgcgccauugcacuccagccuggccuauaag

SEQ ID NO: 504440 - RNA, 32 nt, Human
ucgcgccauugcacuccagccuggcugacaga

SEQ ID NO: 504441 - RNA, 32 nt, Human
ucgcgccauugcacuccagccugggcaacaac

SEQ ID NO: 504442 - RNA, 32 nt, Human
ucgcgccauugcacuccagccugggcaacaag

SEQ ID NO: 504443 - RNA, 32 nt, Human
ucgcgccauugcacuccagccugggcaacgaa

SEQ ID NO: 504444 - RNA, 32 nt, Human
ucgcgccauugcacuccagccugggcaacucc

SEQ ID NO: 504445 - RNA, 32 nt, Human
ucgcgccauugcacuccagccugggcgacaag

SEQ ID NO: 504446 - RNA, 32 nt, Human
ucgcgccauugcacuccagccugggcgacaga

SEQ ID NO: 504447 - RNA, 32 nt, Human
ucgcgccauugcacuccagccugggcggcaga

SEQ ID NO: 504448 - RNA, 32 nt, Human
ucgcgccauugcacuccagccugggggacaag

SEQ ID NO: 504449 - RNA, 32 nt, Human
ucgcgccauugcacuccagccuggguaacaag

SEQ ID NO: 504450 - RNA, 32 nt, Human
ucgcgccauugcacuccagccugggugacaga

SEQ ID NO: 504451 - RNA, 32 nt, Human
ucgcgccauugcacuccagccugggugacgag

SEQ ID NO: 504452 - RNA, 32 nt, Human
ucgcgccauugcacuccagccuuggaacaaga

SEQ ID NO: 504453 - RNA, 32 nt, Human
ucgcgccauugcacuccauccuggacaacagg

SEQ ID NO: 504454 - RNA, 32 nt, Human
ucgcgccauugcacucccgccugggcgacucc

SEQ ID NO: 504455 - RNA, 32 nt, Human
ucgcgccauugcacuccggccuggggacaaga

SEQ ID NO: 504456 - RNA, 32 nt, Human
ucgcgccauugcacucuagccuaggugacaga

SEQ ID NO: 504457 - RNA, 32 nt, Human
ucgcgccauugcacucuagccugggcaacaag

SEQ ID NO: 504458 - RNA, 32 nt, Human
ucgcgccauugcauuccaaccugggggacaac

SEQ ID NO: 504459 - RNA, 32 nt, Human
ucgcgccauuguacuccagccugggcgaugag

SEQ ID NO: 504460 - RNA, 32 nt, Human
ucgcgccccagaggccucauggagucccgccu

SEQ ID NO: 504461 - RNA, 21 nt, Human
ucgcgcccccuauccuggcca

SEQ ID NO: 504462 - RNA, 32 nt, Human
ucgcgccccugcacuccagccugggugacaga

SEQ ID NO: 504463 - RNA, 23 nt, Human
ucgcgcccgcgcggaucccguca

SEQ ID NO: 504464 - RNA, 18 nt, Human
ucgcgcccgcucugggcc

SEQ ID NO: 504465 - RNA, 32 nt, Human
ucgcgccgcugcacuccagccugggccacaca

SEQ ID NO: 504466 - RNA, 32 nt, Human
ucgcgccgcugcacuccagccugggcgacaga

SEQ ID NO: 504467 - RNA, 32 nt, Human
ucgcgccgcugcacuccagccugggcggcaga

SEQ ID NO: 504468 - RNA, 32 nt, Human
ucgcgccgcugcacuccagccugggugacaga

SEQ ID NO: 504469 - RNA, 32 nt, Human
ucgcgccgcugcauuccagccugggugacaga

SEQ ID NO: 504470 - RNA, 32 nt, Human
ucgcgccggcccucccccuccccggucuccgg

SEQ ID NO: 504471 - RNA, 32 nt, Human
ucgcgccguugcacuccagccugggcaacaag

SEQ ID NO: 504472 - RNA, 20 nt, Human
ucgcgccucccgucccgucg

SEQ ID NO: 504473 - RNA, 32 nt, Human
ucgcgccucugccuucucaaaccccuccacca

SEQ ID NO: 504474 - RNA, 32 nt, Human
ucgcgccucugccuucucaucccugcgcacca

SEQ ID NO: 504475 - RNA, 32 nt, Human
ucgcgccugcagcucauauggaagucuuugcc

SEQ ID NO: 504476 - RNA, 24 nt, Human
ucgcgccuguaaucccagcacuuu

SEQ ID NO: 504477 - RNA, 32 nt, Human
ucgcgccuguaaucccagcacuuugggaggcc

SEQ ID NO: 504478 - RNA, 32 nt, Human
ucgcgccuuugcacuccagccuggaagacaaa

SEQ ID NO: 504479 - RNA, 32 nt, Human
ucgcgcggaggcggaggcuugggugcguucaa

SEQ ID NO: 504480 - RNA, 32 nt, Human
ucgcgcggcacagaagaggaccagccuggacg

SEQ ID NO: 504481 - RNA, 32 nt, Human
ucgcgcggcgccgccuccugggcucaguuacc

SEQ ID NO: 504482 - RNA, 18 nt, Human
ucgcgcgggcaucgagga

SEQ ID NO: 504483 - RNA, 32 nt, Human
ucgcgcuacugcacuccagccugggcgacaga

SEQ ID NO: 504484 - RNA, 32 nt, Human
ucgcgcuacugcacuccagccugggugacagu

SEQ ID NO: 504485 - RNA, 32 nt, Human
ucgcgcuacugcauuccagccugggcgccgag

SEQ ID NO: 504486 - RNA, 32 nt, Human
ucgcgcuauugcacuccagccugggugacaga

SEQ ID NO: 504487 - RNA, 32 nt, Human
ucgcgcuccuccaggcugggccuguggccgcg

SEQ ID NO: 504488 - RNA, 32 nt, Human
ucgcgcucucggcuucugcuccggggcuucuu

SEQ ID NO: 504489 - RNA, 32 nt, Human
ucgcgcucugaccagcccgcagagccagcccc

SEQ ID NO: 504490 - RNA, 32 nt, Human
ucgcgcugcgcgccccggccuccagggacucc

SEQ ID NO: 504491 - RNA, 32 nt, Human
ucgcgcugcugcacuccagccugggugacaga

SEQ ID NO: 504492 - RNA, 32 nt, Human
ucgcgcugcugcaggccaugguggaggaggug

SEQ ID NO: 504493 - RNA, 32 nt, Human
ucgcgcugcugcugcccguguacgcgcugggc

SEQ ID NO: 504494 - RNA, 32 nt, Human
ucgcgcuggguuuuauacaagacacugacugc

SEQ ID NO: 504495 - RNA, 32 nt, Human
ucgcgcuucucagcggagugacccagggacgg

SEQ ID NO: 504496 - RNA, 32 nt, Human
ucgcgcuugugaucccagcacuuugggagacu

SEQ ID NO: 504497 - RNA, 32 nt, Human
ucgcgcuuguugcccaggcuggaaugcaaugg

SEQ ID NO: 504498 - RNA, 32 nt, Human
ucgcggacucuccccgcgaugaugccgaugau

SEQ ID NO: 504499 - RNA, 32 nt, Human
ucgcggcagggugagaggucggguggccaucu

SEQ ID NO: 504500 - RNA, 32 nt, Human
ucgcggcauugcacuucagccugggcgauaga

SEQ ID NO: 504501 - RNA, 17 nt, Human
ucgcggccgcccgagcc

SEQ ID NO: 504502 - RNA, 32 nt, Human
ucgcggccgggccggccugggcugcaaucaau

SEQ ID NO: 504503 - RNA, 32 nt, Human
ucgcggccugccucugccaagagaccagcauc

SEQ ID NO: 504504 - RNA, 32 nt, Human
ucgcggcgcugcacucuagccugggugacaga

SEQ ID NO: 504505 - RNA, 32 nt, Human
ucgcggcggaggcagaggaagagggagcggga

SEQ ID NO: 504506 - RNA, 18 nt, Human
ucgcggcggccccgggcu

SEQ ID NO: 504507 - RNA, 32 nt, Human
ucgcggcucaccgcaaccuccgccuccugggu

SEQ ID NO: 504508 - RNA, 32 nt, Human
ucgcggcucacugcaaccuccaccucccaggu

SEQ ID NO: 504509 - RNA, 32 nt, Human
ucgcggcucacugcaaccuccaccucccgggc

SEQ ID NO: 504510 - RNA, 32 nt, Human
ucgcggcucacugcaaccuggaacuccugggc

SEQ ID NO: 504511 - RNA, 32 nt, Human
ucgcggcucacugcagccuccauccucugggu

SEQ ID NO: 504512 - RNA, 32 nt, Human
ucgcgggaggcugccgccucgggacaccccac

SEQ ID NO: 504513 - RNA, 32 nt, Human
ucgcgggccuggagacccagagcgagacggcc

SEQ ID NO: 504514 - RNA, 32 nt, Human
ucgcgggcgggaggggaggaggcccgagagag

SEQ ID NO: 504515 - RNA, 32 nt, Human
ucgcggggaccaacgcccugagcucuugugcc

SEQ ID NO: 504516 - RNA, 32 nt, Human
ucgcggggcagagggucccccuuugccccucc

SEQ ID NO: 504517 - RNA, 32 nt, Human
ucgcggggcuaggaugggaugucguggcugcc

SEQ ID NO: 504518 - RNA, 32 nt, Human
ucgcgggugugagacaaggaagagugaucauu

SEQ ID NO: 504519 - RNA, 32 nt, Human
ucgcggugcccgcuauuucuaccucuugucca

SEQ ID NO: 504520 - RNA, 32 nt, Human
ucgcgguggaugucugucauguagaagugagg

SEQ ID NO: 504521 - RNA, 32 nt, Human
ucgcguaccacacuccagccugggugacagag

SEQ ID NO: 504522 - RNA, 32 nt, Human
ucgcgucacugcacuccagccugagugacaga

SEQ ID NO: 504523 - RNA, 32 nt, Human
ucgcgucacugcacuccagccuggacaacaga

SEQ ID NO: 504524 - RNA, 32 nt, Human
ucgcgucacugcacuccagccugggagacaga

SEQ ID NO: 504525 - RNA, 32 nt, Human
ucgcgucacugcacuccagccugggcgacaga

SEQ ID NO: 504526 - RNA, 32 nt, Human
ucgcgucacugcacuccagcgugggcgacaga

SEQ ID NO: 504527 - RNA, 32 nt, Human
ucgcgucacugcacuccagucuagcaacagag

SEQ ID NO: 504528 - RNA, 32 nt, Human
ucgcgucaguacacuccagccugggcaacaau

SEQ ID NO: 504529 - RNA, 32 nt, Human
ucgcgucauugcacuccagccugggcaacaag

SEQ ID NO: 504530 - RNA, 32 nt, Human
ucgcguccccugcuugaguuuugcacuuggaa

SEQ ID NO: 504531 - RNA, 32 nt, Human
ucgcgucgcuggacuccagcccgggcgacaga

SEQ ID NO: 504532 - RNA, 32 nt, Human
ucgcgugaacccaggaggcggaggcugcagug

SEQ ID NO: 504533 - RNA, 32 nt, Human
ucgcgugaacccaggaggcggcgguugcagug

SEQ ID NO: 504534 - RNA, 32 nt, Human
ucgcgugacucugcaggcuguuucuguauuau

SEQ ID NO: 504535 - RNA, 32 nt, Human
ucgcgugagaacuucaugguuccaaugucaga

SEQ ID NO: 504536 - RNA, 32 nt, Human
ucgcgugagcccaggaguuccagaccaggcug

SEQ ID NO: 504537 - RNA, 32 nt, Human
ucgcgugcuggugaggguggucgcauguccau

SEQ ID NO: 504538 - RNA, 32 nt, Human
ucgcgugucccuagggugugggagacuccgcc

SEQ ID NO: 504539 - RNA, 29 nt, Human
ucgcguuggcugcugcgaucggccggcgg

SEQ ID NO: 504540 - RNA, 32 nt, Human
ucgcguuucuucuccccuucgcuuaaauaugu

SEQ ID NO: 504541 - RNA, 32 nt, Human
ucgcguuuucaagcgugucuguucugcaggua

SEQ ID NO: 504542 - RNA, 32 nt, Human
ucgcuaaccagauccaggcagccuucugggac

SEQ ID NO: 504543 - RNA, 32 nt, Human
ucgcuaagaggcccugaucccagcucauucag

SEQ ID NO: 504544 - RNA, 32 nt, Human
ucgcuaaguuccacucuccauccucugccgcg

SEQ ID NO: 504545 - RNA, 32 nt, Human
ucgcuaccccuuggcccuucgcucuugcugcc

SEQ ID NO: 504546 - RNA, 25 nt, Human
ucgcuacucuguguccucugcuccu

SEQ ID NO: 504547 - RNA, 32 nt, Human
ucgcuagaccucaguagcaccucccagucaua

SEQ ID NO: 504548 - RNA, 32 nt, Human
ucgcuagaggaaugugcaaggacagaagggaa

SEQ ID NO: 504549 - RNA, 20 nt, Human
ucgcuaggcuuguuggguca

SEQ ID NO: 504550 - RNA, 22 nt, Human
ucgcuaugugccucugccaucu

SEQ ID NO: 504551 - RNA, 32 nt, Human
ucgcuauugcggcauucucccucggcuccgga

SEQ ID NO: 504552 - RNA, 32 nt, Human
ucgcucacccaccccucccucucuuccaagga

SEQ ID NO: 504553 - RNA, 32 nt, Human
ucgcucacccgcucccgaggaagggcaguggg

SEQ ID NO: 504554 - RNA, 32 nt, Human
ucgcucacgccuguaaucccagcacuuuggga

SEQ ID NO: 504555 - RNA, 32 nt, Human
ucgcucacugcaaccuccaccucccagguuca

SEQ ID NO: 504556 - RNA, 32 nt, Human
ucgcucacugcaaccuccgccucccggguuca

SEQ ID NO: 504557 - RNA, 32 nt, Human
ucgcucacuucaaccucugccuucuggguucg

SEQ ID NO: 504558 - RNA, 32 nt, Human
ucgcucagccuggagugcagugagcugagauu

SEQ ID NO: 504559 - RNA, 24 nt, Human
ucgcucagcucuugcucccugcca

SEQ ID NO: 504560 - RNA, 32 nt, Human
ucgcucaggagcagccauuaaaaugucgcccg

SEQ ID NO: 504561 - RNA, 32 nt, Human
ucgcucaggcuggagagcgguggugcagucag

SEQ ID NO: 504562 - RNA, 21 nt, Human
ucgcucaggcuggagugcaau

SEQ ID NO: 504563 - RNA, 22 nt, Human
ucgcucaggcuggagugcaaug

SEQ ID NO: 504564 - RNA, 32 nt, Human
ucgcucaggcuggagugcaaugguggggucuc

SEQ ID NO: 504565 - RNA, 22 nt, Human
ucgcucaggcuggagugcagug

SEQ ID NO: 504566 - RNA, 32 nt, Human
ucgcucaggcuggagugcagugaugcaaucuu

SEQ ID NO: 504567 - RNA, 32 nt, Human
ucgcucaggcuggagugcaguggcgcgaucau

SEQ ID NO: 504568 - RNA, 32 nt, Human
ucgcucaggcuggagugcaguggcgcgauuuc

SEQ ID NO: 504569 - RNA, 32 nt, Human
ucgcucaggcuggagugcaguggcgugaucuc

SEQ ID NO: 504570 - RNA, 32 nt, Human
ucgcucaggcuggagugccauggcgcgaucuu

SEQ ID NO: 504571 - RNA, 32 nt, Human
ucgcucaggcuugaucccacugccuuucccuc

SEQ ID NO: 504572 - RNA, 32 nt, Human
ucgcucaugccuguggucccagcacuuuggga

SEQ ID NO: 504573 - RNA, 19 nt, Human
ucgcuccacaggcgagcag

SEQ ID NO: 504574 - RNA, 32 nt, Human
ucgcuccacugcacuccagcccaggugacagu

SEQ ID NO: 504575 - RNA, 32 nt, Human
ucgcuccacugcacuccagccugggugacaga

SEQ ID NO: 504576 - RNA, 32 nt, Human
ucgcuccagccgcggcucuacagcagcgggcg

SEQ ID NO: 504577 - RNA, 32 nt, Human
ucgcuccagcuugguggugaaugcugaggaga

SEQ ID NO: 504578 - RNA, 32 nt, Human
ucgcuccauugcacuccagccugggcaacaag

SEQ ID NO: 504579 - RNA, 32 nt, Human
ucgcuccauugcacuccagccugggugacagu

SEQ ID NO: 504580 - RNA, 32 nt, Human
ucgcucccacugcacuccagccugggcgacag

SEQ ID NO: 504581 - RNA, 32 nt, Human
ucgcuccccgucccuccuccccucucuccgcc

SEQ ID NO: 504582 - RNA, 32 nt, Human
ucgcucccucaagcccucaaguagguguugga

SEQ ID NO: 504583 - RNA, 32 nt, Human
ucgcucccuccccgcucgcuuccucccccacc

SEQ ID NO: 504584 - RNA, 32 nt, Human
ucgcucccuccuggcccucugguccagccccu

SEQ ID NO: 504585 - RNA, 18 nt, Human
ucgcucccugaccugggg

SEQ ID NO: 504586 - RNA, 32 nt, Human
ucgcuccuaccuccccacaccucucucucagu

SEQ ID NO: 504587 - RNA, 32 nt, Human
ucgcuccugcagcagagccaacaugcccauca

SEQ ID NO: 504588 - RNA, 32 nt, Human
ucgcuccuguaaucccagcacuuugggaggcu

SEQ ID NO: 504589 - RNA, 32 nt, Human
ucgcuccuguucuguuaguaccaaaguuacau

SEQ ID NO: 504590 - RNA, 32 nt, Human
ucgcuccuguuguuaagaagcgucccugucag

SEQ ID NO: 504591 - RNA, 32 nt, Human
ucgcuccuugcucucccaggaucaauuguauc

SEQ ID NO: 504592 - RNA, 32 nt, Human
ucgcucgaaaaagaaacgauggagucucgcuc

SEQ ID NO: 504593 - RNA, 32 nt, Human
ucgcucgaacccaggagguggagguugcagug

SEQ ID NO: 504594 - RNA, 32 nt, Human
ucgcucgagcccagaaguucaagaccagccug

SEQ ID NO: 504595 - RNA, 32 nt, Human
ucgcucgcaacccuaccuaccucucucccgaa

SEQ ID NO: 504596 - RNA, 32 nt, Human
ucgcucgcccucuuugagaaccacggcuuccg

SEQ ID NO: 504597 - RNA, 32 nt, Human
ucgcucgcgcuuucucuuucuccuuuccucug

SEQ ID NO: 504598 - RNA, 32 nt, Human
ucgcucgcuccuccuucgcuucgccucgccgc

SEQ ID NO: 504599 - RNA, 32 nt, Human
ucgcucgcucucggcgccuccucugccugggc

SEQ ID NO: 504600 - RNA, 32 nt, Human
ucgcucgcucuuggcgccuccucugccugggc

SEQ ID NO: 504601 - RNA, 20 nt, Human
ucgcucggugcuuugagcua

SEQ ID NO: 504602 - RNA, 32 nt, Human
ucgcucgucucagcccagcccuggaagacuga

SEQ ID NO: 504603 - RNA, 32 nt, Human
ucgcucguuacccaggguggagugcaguggua

SEQ ID NO: 504604 - RNA, 32 nt, Human
ucgcucuacccaggcgguggugucgaucuacg

SEQ ID NO: 504605 - RNA, 32 nt, Human
ucgcucucaccucccuccuccugagucggugu

SEQ ID NO: 504606 - RNA, 32 nt, Human
ucgcucucacugcuacugcuuccugggaggug

SEQ ID NO: 504607 - RNA, 32 nt, Human
ucgcucuccaggccgcccuccgcgggccugcc

SEQ ID NO: 504608 - RNA, 32 nt, Human
ucgcucuccuucuggacugggagaagggaggc

SEQ ID NO: 504609 - RNA, 32 nt, Human
ucgcucucuggccugggcuggguuucaucagc

SEQ ID NO: 504610 - RNA, 32 nt, Human
ucgcucucuuccuccugcuccaaccaugugga

SEQ ID NO: 504611 - RNA, 32 nt, Human
ucgcucugaaggaggagcaggugaaacaggug

SEQ ID NO: 504612 - RNA, 32 nt, Human
ucgcucugacaccccaaggaagccgacgaucc

SEQ ID NO: 504613 - RNA, 32 nt, Human
ucgcucugaggcucgggguccccagcuccgcg

SEQ ID NO: 504614 - RNA, 32 nt, Human
ucgcucugcaacaaaucuccagccuggguugc

SEQ ID NO: 504615 - RNA, 32 nt, Human
ucgcucugcacuccagccuaggugacagagug

SEQ ID NO: 504616 - RNA, 32 nt, Human
ucgcucugcacuccagccuggcgacugaguga

SEQ ID NO: 504617 - RNA, 32 nt, Human
ucgcucugcaugcucucugucauacagacagg

SEQ ID NO: 504618 - RNA, 18 nt, Human
ucgcucugcucgcaguca

SEQ ID NO: 504619 - RNA, 21 nt, Human
ucgcucuggccgccugagcca

SEQ ID NO: 504620 - RNA, 19 nt, Human
ucgcucuggccuucgagcc

SEQ ID NO: 504621 - RNA, 32 nt, Human
ucgcucugucaccaggcuggagggcaguggug

SEQ ID NO: 504622 - RNA, 32 nt, Human
ucgcucugucaccaggcuggaguacagugaug

SEQ ID NO: 504623 - RNA, 32 nt, Human
ucgcucugucaccaggcuggagugcagugaca

SEQ ID NO: 504624 - RNA, 32 nt, Human
ucgcucugucaccaggcuggagugcaguggcg

SEQ ID NO: 504625 - RNA, 32 nt, Human
ucgcucugucaccaggcuggagugcaguggug

SEQ ID NO: 504626 - RNA, 32 nt, Human
ucgcucuguccucagggugggcagagccacua

SEQ ID NO: 504627 - RNA, 32 nt, Human
ucgcucugucgccaggcugaagugcaguggcg

SEQ ID NO: 504628 - RNA, 32 nt, Human
ucgcucugucgccaggcuggaguacaguggug

SEQ ID NO: 504629 - RNA, 32 nt, Human
ucgcucugucgccaggcuggagugcaauggcg

SEQ ID NO: 504630 - RNA, 32 nt, Human
ucgcucugucgccaggcuggagugcaguggcg

SEQ ID NO: 504631 - RNA, 32 nt, Human
ucgcucugucgccaggcuggagugcaguggug

SEQ ID NO: 504632 - RNA, 32 nt, Human
ucgcucugucgccagguuggagugcaguggcg

SEQ ID NO: 504633 - RNA, 32 nt, Human
ucgcucugucgcccagccuggagugcaguggc

SEQ ID NO: 504634 - RNA, 32 nt, Human
ucgcucugucgccuggcuggagugcaguggug

SEQ ID NO: 504635 - RNA, 32 nt, Human
ucgcucuguugccaggcuggagggcaguggca

SEQ ID NO: 504636 - RNA, 32 nt, Human
ucgcucuguugccaggcuggagugcacugggg

SEQ ID NO: 504637 - RNA, 32 nt, Human
ucgcucuguugccaggcuggagugcaguggug

SEQ ID NO: 504638 - RNA, 32 nt, Human
ucgcucuuauugcccaggcuggagugcaaugg

SEQ ID NO: 504639 - RNA, 32 nt, Human
ucgcucuuauugcccaggcuggagugcaguga

SEQ ID NO: 504640 - RNA, 32 nt, Human
ucgcucuugacagaugucugggaaagcagagu

SEQ ID NO: 504641 - RNA, 32 nt, Human
ucgcucuuggugcccaggcuagagugcaaugg

SEQ ID NO: 504642 - RNA, 32 nt, Human
ucgcucuugucacccaggcaggagugcagugg

SEQ ID NO: 504643 - RNA, 32 nt, Human
ucgcucuugucacccaggcuggaguacaauga

SEQ ID NO: 504644 - RNA, 32 nt, Human
ucgcucuugucacccaggcuggagugcagugg

SEQ ID NO: 504645 - RNA, 32 nt, Human
ucgcucuuguccaggcuggaguauaauggugc

SEQ ID NO: 504646 - RNA, 32 nt, Human
ucgcucuugucgcccaggcuggagugcaacgg

SEQ ID NO: 504647 - RNA, 32 nt, Human
ucgcucuugucgcccaggcuggagugcagugg

SEQ ID NO: 504648 - RNA, 32 nt, Human
ucgcucuugucgcccaggcuguagugcagugg

SEQ ID NO: 504649 - RNA, 32 nt, Human
ucgcucuuguugcccaggcuagagugcaaugg

SEQ ID NO: 504650 - RNA, 32 nt, Human
ucgcucuuguugcccaggcuggaguacagugg

SEQ ID NO: 504651 - RNA, 32 nt, Human
ucgcucuuguugcccaggcuggagugcaacgg

SEQ ID NO: 504652 - RNA, 32 nt, Human
ucgcucuuguugcccaggcuggagugcaaugg

SEQ ID NO: 504653 - RNA, 32 nt, Human
ucgcucuuguugcccaggcugggagggcaaug

SEQ ID NO: 504654 - RNA, 32 nt, Human
ucgcucuuguugcccaggcuugagugcaguga

SEQ ID NO: 504655 - RNA, 32 nt, Human
ucgcugacccccaggcuguggugagggucuga

SEQ ID NO: 504656 - RNA, 17 nt, Human
ucgcugacucgcgggcu

SEQ ID NO: 504657 - RNA, 32 nt, Human
ucgcugacuuggaggcuagggcuggucugcac

SEQ ID NO: 504658 - RNA, 32 nt, Human
ucgcugagacucugccugcuucucacccagcu

SEQ ID NO: 504659 - RNA, 32 nt, Human
ucgcugaucauccucuuccucaucuguaaaug

SEQ ID NO: 504660 - RNA, 32 nt, Human
ucgcugaugaacuaguaggagacucugugccg

SEQ ID NO: 504661 - RNA, 23 nt, Human
ucgcugauguccuccagccgccu

SEQ ID NO: 504662 - RNA, 32 nt, Human
ucgcugcagcaaggagaccaggucaggcuuca

SEQ ID NO: 504663 - RNA, 32 nt, Human
ucgcugcagccugcugugcgcugcacggccug

SEQ ID NO: 504664 - RNA, 22 nt, Human
ucgcugcaguguuccccgagcc

SEQ ID NO: 504665 - RNA, 32 nt, Human
ucgcugcauaaacuguuguaugccuggugcuu

SEQ ID NO: 504666 - RNA, 32 nt, Human
ucgcugccaagguggagagcagugagcaaggg

SEQ ID NO: 504667 - RNA, 17 nt, Human
ucgcugccacccgggcc

SEQ ID NO: 504668 - RNA, 32 nt, Human
ucgcugccaccugagcuccagccgcccacaaa

SEQ ID NO: 504669 - RNA, 31 nt, Human
ucgcugccauucucugggcuggaaugugaag

SEQ ID NO: 504670 - RNA, 32 nt, Human
ucgcugcccagcuccggucccagaucucugac

SEQ ID NO: 504671 - RNA, 31 nt, Human
ucgcugccccucucugggccuguugcuccau

SEQ ID NO: 504672 - RNA, 32 nt, Human
ucgcugcccucgcuccccuucggggcccccgc

SEQ ID NO: 504673 - RNA, 32 nt, Human
ucgcugcccucggggccuccagcgccggcucu

SEQ ID NO: 504674 - RNA, 32 nt, Human
ucgcugccggugggaggaagcgagagggaagc

SEQ ID NO: 504675 - RNA, 32 nt, Human
ucgcugcgcgucugcuccuccuucucgcgcuu

SEQ ID NO: 504676 - RNA, 20 nt, Human
ucgcugcgcucccuguugcc

SEQ ID NO: 504677 - RNA, 18 nt, Human
ucgcugcgggcccgggcc

SEQ ID NO: 504678 - RNA, 32 nt, Human
ucgcugcuaaauuauucuucacuugagugaag

SEQ ID NO: 504679 - RNA, 31 nt, Human
ucgcugcuacuuuucugcagggauaaaacuu

SEQ ID NO: 504680 - RNA, 32 nt, Human
ucgcugcucaccgcaaccuccgccuuccaggu

SEQ ID NO: 504681 - RNA, 21 nt, Human
ucgcugcucaugcccacagcc

SEQ ID NO: 504682 - RNA, 32 nt, Human
ucgcugcucauggagaagaccugggcuuagca

SEQ ID NO: 504683 - RNA, 17 nt, Human
ucgcugcucccgcggcc

SEQ ID NO: 504684 - RNA, 20 nt, Human
ucgcugcuccgcuugccgcc

SEQ ID NO: 504685 - RNA, 22 nt, Human
ucgcugcuccucacgcaauccu

SEQ ID NO: 504686 - RNA, 23 nt, Human
ucgcugcuccugcuucucgggcu

SEQ ID NO: 504687 - RNA, 19 nt, Human
ucgcugcugagaagagcca

SEQ ID NO: 504688 - RNA, 20 nt, Human
ucgcugcugagccgauguca

SEQ ID NO: 504689 - RNA, 32 nt, Human
ucgcugcugcacagcaaggcccugccacccac

SEQ ID NO: 504690 - RNA, 32 nt, Human
ucgcugcugcagcucucgggaaagcugcccag

SEQ ID NO: 504691 - RNA, 23 nt, Human
ucgcugcugcaucccgcacgccu

SEQ ID NO: 504692 - RNA, 32 nt, Human
ucgcugcugccgccgcuaagggagaggagcau

SEQ ID NO: 504693 - RNA, 20 nt, Human
ucgcugcugcgcccugggcu

SEQ ID NO: 504694 - RNA, 32 nt, Human
ucgcugcuggcacuucaggcucugccucuccc

SEQ ID NO: 504695 - RNA, 18 nt, Human
ucgcugcugucaccugca

SEQ ID NO: 504696 - RNA, 32 nt, Human
ucgcugcuuccacacauuaauggcaugauuuu

SEQ ID NO: 504697 - RNA, 19 nt, Human
ucgcugcuuguugggguua

SEQ ID NO: 504698 - RNA, 32 nt, Human
ucgcuggaacccagaagguggagguugcagug

SEQ ID NO: 504699 - RNA, 32 nt, Human
ucgcuggaacccaggaggcaaagguugcagug

SEQ ID NO: 504700 - RNA, 32 nt, Human
ucgcuggacuaggaugggggaugggccuguga

SEQ ID NO: 504701 - RNA, 32 nt, Human
ucgcuggagagggagacgcaggaagcgaugaa

SEQ ID NO: 504702 - RNA, 32 nt, Human
ucgcuggagcccaguaggucaagaccagccag

SEQ ID NO: 504703 - RNA, 32 nt, Human
ucgcuggcacugcaggaaggaggccccucuga

SEQ ID NO: 504704 - RNA, 32 nt, Human
ucgcuggccagagguggaaggaaggaggaaag

SEQ ID NO: 504705 - RNA, 32 nt, Human
ucgcuggccccaggacccccuccugauuuugg

SEQ ID NO: 504706 - RNA, 32 nt, Human
ucgcuggcccgaguuagaggccagcugagaag

SEQ ID NO: 504707 - RNA, 32 nt, Human
ucgcuggcucaggagaaaagcuguggaccuuc

SEQ ID NO: 504708 - RNA, 32 nt, Human
ucgcuggcuuccccaccucucucaggaugaaa

SEQ ID NO: 504709 - RNA, 32 nt, Human
ucgcuggcuuggagaggacuguggcaggugag

SEQ ID NO: 504710 - RNA, 32 nt, Human
ucgcugggaacgcacuuccugggacgcugaga

SEQ ID NO: 504711 - RNA, 32 nt, Human
ucgcugggacucccugggagaugaggccgcga

SEQ ID NO: 504712 - RNA, 23 nt, Human
ucgcugggagcugccucgggaca

SEQ ID NO: 504713 - RNA, 18 nt, Human
ucgcugggcgcccuggcc

SEQ ID NO: 504714 - RNA, 32 nt, Human
ucgcugggcgcugugcagaggaaaggcgggag

SEQ ID NO: 504715 - RNA, 24 nt, Human
ucgcugggcucauggcccugguca

SEQ ID NO: 504716 - RNA, 32 nt, Human
ucgcugggcugcacucagcaggcugcuugagu

SEQ ID NO: 504717 - RNA, 32 nt, Human
ucgcuggggagcaggcgucucuccucagucgg

SEQ ID NO: 504718 - RNA, 32 nt, Human
ucgcuggggaggcagaguccucgcguggucuc

SEQ ID NO: 504719 - RNA, 32 nt, Human
ucgcuggggcaggggcacccagcaucagcccu

SEQ ID NO: 504720 - RNA, 32 nt, Human
ucgcugggguuacugccuuuguuuggcaaacu

SEQ ID NO: 504721 - RNA, 32 nt, Human
ucgcugguacucugaauaaauaagcaugguca

SEQ ID NO: 504722 - RNA, 32 nt, Human
ucgcuggugaagccccaccuucaacccagggg

SEQ ID NO: 504723 - RNA, 32 nt, Human
ucgcuguacagaaacugucaagggaauaaagu

SEQ ID NO: 504724 - RNA, 32 nt, Human
ucgcugucuccuccgcaaagcauuuuaacucg

SEQ ID NO: 504725 - RNA, 19 nt, Human
ucgcugucucucuccgagc

SEQ ID NO: 504726 - RNA, 18 nt, Human
ucgcugugcaccgaguua

SEQ ID NO: 504727 - RNA, 19 nt, Human
ucgcugugcccccggguua

SEQ ID NO: 504728 - RNA, 32 nt, Human
ucgcugugcccgcugugccugcugugcccgcg

SEQ ID NO: 504729 - RNA, 32 nt, Human
ucgcuguggcucaucgucggcaccaauuaacg

SEQ ID NO: 504730 - RNA, 32 nt, Human
ucgcuguuacccaggcuggagugcaauggcgc

SEQ ID NO: 504731 - RNA, 20 nt, Human
ucgcuguucgcucugcgagu

SEQ ID NO: 504732 - RNA, 18 nt, Human
ucgcuguugcccaggcua

SEQ ID NO: 504733 - RNA, 32 nt, Human
ucgcuguugcccaggcuagagcgcaggggcac

SEQ ID NO: 504734 - RNA, 32 nt, Human
ucgcuguugcccaggcuguagugcaguggugc

SEQ ID NO: 504735 - RNA, 21 nt, Human
ucgcuguugccgccgccgccu

SEQ ID NO: 504736 - RNA, 32 nt, Human
ucgcuguugggaaggcagagcaguugcaaccc

SEQ ID NO: 504737 - RNA, 32 nt, Human
ucgcuguugucacccaggcuggagugcagugg

SEQ ID NO: 504738 - RNA, 32 nt, Human
ucgcuguuguugcccaggcuggagugcaauag

SEQ ID NO: 504739 - RNA, 32 nt, Human
ucgcuguuguugcccaggcuggagugcaaugg

SEQ ID NO: 504740 - RNA, 32 nt, Human
ucgcuguuuccaauaaauauugcugaagacag

SEQ ID NO: 504741 - RNA, 32 nt, Human
ucgcuguuuuaccgaugaggguuggauuagag

SEQ ID NO: 504742 - RNA, 32 nt, Human
ucgcuuaaacccaggaggcggagguugcagug

SEQ ID NO: 504743 - RNA, 32 nt, Human
ucgcuuaaacccaggagguggagguugaaaug

SEQ ID NO: 504744 - RNA, 32 nt, Human
ucgcuuaaacccaggagguggagguugcagug

SEQ ID NO: 504745 - RNA, 32 nt, Human
ucgcuuaauugcucugagcuuguuuccucauc

SEQ ID NO: 504746 - RNA, 32 nt, Human
ucgcuuagccugcaccuccuguccugaagccc

SEQ ID NO: 504747 - RNA, 22 nt, Human
ucgcuuaguucugccuugaguc

SEQ ID NO: 504748 - RNA, 32 nt, Human
ucgcuuaguucugccuugaguccugccagugu

SEQ ID NO: 504749 - RNA, 32 nt, Human
ucgcuuccacguccaaaccccuuuaagaagga

SEQ ID NO: 504750 - RNA, 32 nt, Human
ucgcuuccacugcacaggcccaggaaggagaa

SEQ ID NO: 504751 - RNA, 32 nt, Human
ucgcuucccaggaagacuuguugcagguaggu

SEQ ID NO: 504752 - RNA, 32 nt, Human
ucgcuucccuucacugaauucccuucaaagcc

SEQ ID NO: 504753 - RNA, 18 nt, Human
ucgcuucgccuccggcca

SEQ ID NO: 504754 - RNA, 32 nt, Human
ucgcuucugccuccaaaccaaucccuugcuuc

SEQ ID NO: 504755 - RNA, 32 nt, Human
ucgcuucugcuccucuuuuugugcacucucuu

SEQ ID NO: 504756 - RNA, 32 nt, Human
ucgcuugaaaacaggagguggagguugcagug

SEQ ID NO: 504757 - RNA, 32 nt, Human
ucgcuugaacagcuucuccugaguccuccuua

SEQ ID NO: 504758 - RNA, 32 nt, Human
ucgcuugaacccaagaggcggagguugcagug

SEQ ID NO: 504759 - RNA, 32 nt, Human
ucgcuugaacccaagagguggagguugcggug

SEQ ID NO: 504760 - RNA, 32 nt, Human
ucgcuugaacccagaaggcggaaguugcagug

SEQ ID NO: 504761 - RNA, 32 nt, Human
ucgcuugaacccaggaaguagagguugcagug

SEQ ID NO: 504762 - RNA, 32 nt, Human
ucgcuugaacccaggaaguggagacugcagug

SEQ ID NO: 504763 - RNA, 32 nt, Human
ucgcuugaacccaggaaguggagguugcagug

SEQ ID NO: 504764 - RNA, 32 nt, Human
ucgcuugaacccaggagacagggguugcagug

SEQ ID NO: 504765 - RNA, 32 nt, Human
ucgcuugaacccaggagacgagguugcaguga

SEQ ID NO: 504766 - RNA, 32 nt, Human
ucgcuugaacccaggagacggugguugcagug

SEQ ID NO: 504767 - RNA, 32 nt, Human
ucgcuugaacccaggagauggagauugcagua

SEQ ID NO: 504768 - RNA, 32 nt, Human
ucgcuugaacccaggagauugagguuguagug

SEQ ID NO: 504769 - RNA, 32 nt, Human
ucgcuugaacccaggaggcagaaguugcagug

SEQ ID NO: 504770 - RNA, 32 nt, Human
ucgcuugaacccaggaggcagagguugcagua

SEQ ID NO: 504771 - RNA, 32 nt, Human
ucgcuugaacccaggaggcagagguugcagug

SEQ ID NO: 504772 - RNA, 32 nt, Human
ucgcuugaacccaggaggcagagguugcguug

SEQ ID NO: 504773 - RNA, 32 nt, Human
ucgcuugaacccaggaggcagugauugcagug

SEQ ID NO: 504774 - RNA, 32 nt, Human
ucgcuugaacccaggaggcgaagauugccgug

SEQ ID NO: 504775 - RNA, 32 nt, Human
ucgcuugaacccaggaggcggagauugcagug

SEQ ID NO: 504776 - RNA, 32 nt, Human
ucgcuugaacccaggaggcggagcuugcagug

SEQ ID NO: 504777 - RNA, 32 nt, Human
ucgcuugaacccaggaggcggaggcugcagug

SEQ ID NO: 504778 - RNA, 32 nt, Human
ucgcuugaacccaggaggcggagguuacagug

SEQ ID NO: 504779 - RNA, 32 nt, Human
ucgcuugaacccaggaggcggagguugcagua

SEQ ID NO: 504780 - RNA, 32 nt, Human
ucgcuugaacccaggaggcggagguugcagug

SEQ ID NO: 504781 - RNA, 32 nt, Human
ucgcuugaacccaggaggcggagguugcggug

SEQ ID NO: 504782 - RNA, 32 nt, Human
ucgcuugaacccaggagguagaagcugcagug

SEQ ID NO: 504783 - RNA, 32 nt, Human
ucgcuugaacccaggagguagaggcugcagug

SEQ ID NO: 504784 - RNA, 32 nt, Human
ucgcuugaacccaggagguagagguugcagug

SEQ ID NO: 504785 - RNA, 32 nt, Human
ucgcuugaacccaggaggugaagguugcagug

SEQ ID NO: 504786 - RNA, 32 nt, Human
ucgcuugaacccaggaggugcagguugcagug

SEQ ID NO: 504787 - RNA, 32 nt, Human
ucgcuugaacccaggagguggaaguugcuuug

SEQ ID NO: 504788 - RNA, 32 nt, Human
ucgcuugaacccaggagguggagguagcagug

SEQ ID NO: 504789 - RNA, 32 nt, Human
ucgcuugaacccaggagguggagguuacagug

SEQ ID NO: 504790 - RNA, 32 nt, Human
ucgcuugaacccaggagguggagguuccagug

SEQ ID NO: 504791 - RNA, 32 nt, Human
ucgcuugaacccaggagguggagguugcaagu

SEQ ID NO: 504792 - RNA, 32 nt, Human
ucgcuugaacccaggagguggagguugcagua

SEQ ID NO: 504793 - RNA, 32 nt, Human
ucgcuugaacccaggagguggagguugcagug

SEQ ID NO: 504794 - RNA, 32 nt, Human
ucgcuugaacccaggagguggagguugcaguu

SEQ ID NO: 504795 - RNA, 32 nt, Human
ucgcuugaacccaggagguggagguuguggug

SEQ ID NO: 504796 - RNA, 32 nt, Human
ucgcuugaacccaggagguggggguugcaccg

SEQ ID NO: 504797 - RNA, 32 nt, Human
ucgcuugaacccaggagucggagguugcagug

SEQ ID NO: 504798 - RNA, 32 nt, Human
ucgcuugaacccaggaguucaagucugcagug

SEQ ID NO: 504799 - RNA, 32 nt, Human
ucgcuugaacccagggggcggagcuuggagua

SEQ ID NO: 504800 - RNA, 32 nt, Human
ucgcuugaacccagguuguggagguuguagug

SEQ ID NO: 504801 - RNA, 32 nt, Human
ucgcuugaaccccagaggcagagguugcggug

SEQ ID NO: 504802 - RNA, 32 nt, Human
ucgcuugaacccgggagguguagguugcagug

SEQ ID NO: 504803 - RNA, 32 nt, Human
ucgcuugaaccuaggagguggagguugcauuc

SEQ ID NO: 504804 - RNA, 32 nt, Human
ucgcuugaacucaggagguggagguugcggug

SEQ ID NO: 504805 - RNA, 32 nt, Human
ucgcuugaacugaggcagaggcuacagugagu

SEQ ID NO: 504806 - RNA, 32 nt, Human
ucgcuugaauccaggaggaggagguugcagug

SEQ ID NO: 504807 - RNA, 32 nt, Human
ucgcuugaauccaggaggcggagguugcagug

SEQ ID NO: 504808 - RNA, 32 nt, Human
ucgcuugacgggaagcggagguugcagugagc

SEQ ID NO: 504809 - RNA, 32 nt, Human
ucgcuugagcaggaguuccaggcugcagcgcg

SEQ ID NO: 504810 - RNA, 32 nt, Human
ucgcuugagcccagaaguuugagaccagccua

SEQ ID NO: 504811 - RNA, 32 nt, Human
ucgcuugagcccagagguucgagaucaaccug

SEQ ID NO: 504812 - RNA, 32 nt, Human
ucgcuugagcccagcgguuuaagaucagucug

SEQ ID NO: 504813 - RNA, 32 nt, Human
ucgcuugagcccaggaggcggagauugcagug

SEQ ID NO: 504814 - RNA, 32 nt, Human
ucgcuugagcccaggaggcggagguugcagug

SEQ ID NO: 504815 - RNA, 32 nt, Human
ucgcuugagcccaggaggcugaggcugcagug

SEQ ID NO: 504816 - RNA, 32 nt, Human
ucgcuugagcccaggaggucaaggguacagug

SEQ ID NO: 504817 - RNA, 32 nt, Human
ucgcuugagcccaggaggucagggcugcagug

SEQ ID NO: 504818 - RNA, 32 nt, Human
ucgcuugagcccaggaggucgaagcugcagug

SEQ ID NO: 504819 - RNA, 32 nt, Human
ucgcuugagcccaggagguggagguugcagug

SEQ ID NO: 504820 - RNA, 32 nt, Human
ucgcuugagcccaggaguucaagaacagccug

SEQ ID NO: 504821 - RNA, 32 nt, Human
ucgcuugagcccaggaguucaagaccaaccug

SEQ ID NO: 504822 - RNA, 32 nt, Human
ucgcuugagcccaggaguucaagaccagccug

SEQ ID NO: 504823 - RNA, 32 nt, Human
ucgcuugagcccaggaguucaagaccagucug

SEQ ID NO: 504824 - RNA, 32 nt, Human
ucgcuugagcccaggaguuuaagaccagccug

SEQ ID NO: 504825 - RNA, 32 nt, Human
ucgcuugagcccaggcaguuggagaccagucu

SEQ ID NO: 504826 - RNA, 32 nt, Human
ucgcuugagcccagggguucaagaccaaucug

SEQ ID NO: 504827 - RNA, 32 nt, Human
ucgcuugagcucaggaguuccauaccagccug

SEQ ID NO: 504828 - RNA, 32 nt, Human
ucgcuugagcuggagugcaguggugcaaucau

SEQ ID NO: 504829 - RNA, 32 nt, Human
ucgcuugaucucaggagguugaggcugcagug

SEQ ID NO: 504830 - RNA, 32 nt, Human
ucgcuugcacccaggagguggagguugcagug

SEQ ID NO: 504831 - RNA, 18 nt, Human
ucgcuugcgccccgggcc

SEQ ID NO: 504832 - RNA, 32 nt, Human
ucgcuuggaggagcaaggugccucccagcccg

SEQ ID NO: 504833 - RNA, 32 nt, Human
ucgcuugggcccaggagguggagguugcagug

SEQ ID NO: 504834 - RNA, 32 nt, Human
ucgcuuguacccaggaggcggagguuguagug

SEQ ID NO: 504835 - RNA, 18 nt, Human
ucgcuugugaaacuggaa

SEQ ID NO: 504836 - RNA, 32 nt, Human
ucgcuuguugcccaggcuggagugcaauggcg

SEQ ID NO: 504837 - RNA, 32 nt, Human
ucgcuuuacuccaggaaaugcacguuacacau

SEQ ID NO: 504838 - RNA, 32 nt, Human
ucgcuuuaguaaauaaagggucuccaagaaua

SEQ ID NO: 504839 - RNA, 32 nt, Human
ucgcuuucaacuucgucacaggaaaaaggagc

SEQ ID NO: 504840 - RNA, 32 nt, Human
ucgcuuucuccggcuuccucuggcccaggcgc

SEQ ID NO: 504841 - RNA, 32 nt, Human
ucgcuuucuggaggaggaggggacccgcugcg

SEQ ID NO: 504842 - RNA, 32 nt, Human
ucgcuuugucaccaggcuggagugcaguggug

SEQ ID NO: 504843 - RNA, 32 nt, Human
ucgcuuuucucaggaaccaaaggcuuaugaug

SEQ ID NO: 504844 - RNA, 32 nt, Human
ucgcuuuuguugcccaggcuggagugcaaugg

SEQ ID NO: 504845 - RNA, 32 nt, Human
ucgcuuuuuccuccuccuccucucccggcccc

SEQ ID NO: 504846 - RNA, 32 nt, Human
ucgcuuuuuccuccuucuuccuccuggaggaa

SEQ ID NO: 504847 - RNA, 32 nt, Human
ucgcuuuuucuuucccugucuucuuucagauu

SEQ ID NO: 504848 - RNA, 32 nt, Human
ucggaaagggagggaaagcaagccuggcagag

SEQ ID NO: 504849 - RNA, 32 nt, Human
ucggaaauacugcuucucccaccccaucccua

SEQ ID NO: 504850 - RNA, 32 nt, Human
ucggaacagcagagacacagagggcagucaug

SEQ ID NO: 504851 - RNA, 32 nt, Human
ucggaaccaggguuucccuucaucucagugac

SEQ ID NO: 504852 - RNA, 32 nt, Human
ucggaaccuccucccuaauucucccuuccuuc

SEQ ID NO: 504853 - RNA, 20 nt, Human
ucggaagaccccugggccca

SEQ ID NO: 504854 - RNA, 32 nt, Human
ucggaagcgucaguguuuccauguuauggauc

SEQ ID NO: 504855 - RNA, 32 nt, Human
ucggaaggcugaagcaggagaaugguaugaau

SEQ ID NO: 504856 - RNA, 32 nt, Human
ucggaaggcugaagcaggggaauggcgugaac

SEQ ID NO: 504857 - RNA, 32 nt, Human
ucggaaggcugaggcaggagaaucacuugaac

SEQ ID NO: 504858 - RNA, 32 nt, Human
ucggaaggcugaggcaggagaauggcgugaac

SEQ ID NO: 504859 - RNA, 32 nt, Human
ucggaaggcugaggcaggagaauugcuugaac

SEQ ID NO: 504860 - RNA, 32 nt, Human
ucggaaggcugaggcaggaggaucacuugagc

SEQ ID NO: 504861 - RNA, 32 nt, Human
ucggaaggcugaggcaggaggaucauuugagc

SEQ ID NO: 504862 - RNA, 32 nt, Human
ucggaagggaaaacagucgaucaagggaugua

SEQ ID NO: 504863 - RNA, 25 nt, Human
ucggaagggaggcgggguauccaga

SEQ ID NO: 504864 - RNA, 32 nt, Human
ucggaaucacugagagaggagggggcagcgcc

SEQ ID NO: 504865 - RNA, 32 nt, Human
ucggaauuucuuguuaucaccauuccacguug

SEQ ID NO: 504866 - RNA, 32 nt, Human
ucggaauuuugaaaaacaauauauuuucagga

SEQ ID NO: 504867 - RNA, 32 nt, Human
ucggacagagucucacugugcaguggcaugau

SEQ ID NO: 504868 - RNA, 32 nt, Human
ucggacaugguggugcaugccuguaaucccag

SEQ ID NO: 504869 - RNA, 32 nt, Human
ucggaccaaacagugcucaugcuucaggaccu

SEQ ID NO: 504870 - RNA, 32 nt, Human
ucggaccacugcaagggccgaggcagggccag

SEQ ID NO: 504871 - RNA, 21 nt, Human
ucggaccauguggaaguuucu

SEQ ID NO: 504872 - RNA, 19 nt, Human
ucggacccacauccuggca

SEQ ID NO: 504873 - RNA, 32 nt, Human
ucggacccaggagcccagccccggcugugcca

SEQ ID NO: 504874 - RNA, 32 nt, Human
ucggacccugccuuccucccacuccagacccc

SEQ ID NO: 504875 - RNA, 32 nt, Human
ucggacccuuuuagcugggguugggggacggg

SEQ ID NO: 504876 - RNA, 24 nt, Human
ucuagccugggugaccgagggagg

SEQ ID NO: 504877 - RNA, 32 nt, Human
ucuagccugggugaccgagggaggcucugucu

SEQ ID NO: 504878 - RNA, 24 nt, Human
ucuagccugggugaguacggaggg

SEQ ID NO: 504879 - RNA, 32 nt, Human
ucuagccuguaccaguuaguucaucaaaggaa

SEQ ID NO: 504880 - RNA, 24 nt, Human
ucuagccugugugacagagcaaga

SEQ ID NO: 504881 - RNA, 32 nt, Human
ucuagccugugugacagagcaagacccugucu

SEQ ID NO: 504882 - RNA, 24 nt, Human
ucuagccuuagugauacagugaga

SEQ ID NO: 504883 - RNA, 24 nt, Human
ucuagccuuccaccagcagcgagg

SEQ ID NO: 504884 - RNA, 32 nt, Human
ucuagccuuccaggaaggggcuggccucugcu

SEQ ID NO: 504885 - RNA, 32 nt, Human
ucuagccuucuccugcccuccugugucucagg

SEQ ID NO: 504886 - RNA, 32 nt, Human
ucuagccuuuacaaacauccucaggcuucucu

SEQ ID NO: 504887 - RNA, 32 nt, Human
ucuagccuuuccgguccuuccugggcaaaucu

SEQ ID NO: 504888 - RNA, 32 nt, Human
ucuagcuaagaacuuugaaacaaagucaaagc

SEQ ID NO: 504889 - RNA, 32 nt, Human
ucuagcuagaccugcacuguccaguacaguag

SEQ ID NO: 504890 - RNA, 32 nt, Human
ucuagcuagagcccucagucacaggcaaaggc

SEQ ID NO: 504891 - RNA, 22 nt, Human
ucuagcuagcauuucagcauga

SEQ ID NO: 504892 - RNA, 32 nt, Human
ucuagcucacaaguaaguggcuucagguggga

SEQ ID NO: 504893 - RNA, 32 nt, Human
ucuagcuccagccucucgccugcgccccacuc

SEQ ID NO: 504894 - RNA, 32 nt, Human
ucuagcuccaggacagugucuggcacauagua

SEQ ID NO: 504895 - RNA, 32 nt, Human
ucuagcucuaguucaaauuauuuggaaguguu

SEQ ID NO: 504896 - RNA, 32 nt, Human
ucuagcucugcagcuguggcuguuguuagacg

SEQ ID NO: 504897 - RNA, 32 nt, Human
ucuagcugaacucaggaaaaagaagggggaaa

SEQ ID NO: 504898 - RNA, 32 nt, Human
ucuagcugaaucugaaauauuaccccuugucu

SEQ ID NO: 504899 - RNA, 32 nt, Human
ucuagcugagccuuuuagggcaugaggauguu

SEQ ID NO: 504900 - RNA, 32 nt, Human
ucuagcugccaccagagaguucauugagaugu

SEQ ID NO: 504901 - RNA, 21 nt, Human
ucuagcugccaguucuguguu

SEQ ID NO: 504902 - RNA, 32 nt, Human
ucuagcuggcuuucccugucuauugccuuuuc

SEQ ID NO: 504903 - RNA, 21 nt, Human
ucuagcuuagaaccucccuca

SEQ ID NO: 504904 - RNA, 32 nt, Human
ucuagcuucaggcugggcacgguggcucacag

SEQ ID NO: 504905 - RNA, 32 nt, Human
ucuagcuuccucccucuccucugcuuccagca

SEQ ID NO: 504906 - RNA, 24 nt, Human
ucuagcuugggagacagagcgaga

SEQ ID NO: 504907 - RNA, 32 nt, Human
ucuagcuugggagacagagcgagacuccgucu

SEQ ID NO: 504908 - RNA, 32 nt, Human
ucuagcuugggcaacagagcaagacucugucu

SEQ ID NO: 504909 - RNA, 24 nt, Human
ucuagcuugggcaauagagcaagg

SEQ ID NO: 504910 - RNA, 24 nt, Human
ucuagcuugggugacagagcaaga

SEQ ID NO: 504911 - RNA, 32 nt, Human
ucuagcuuuccuuuccuucuggcuccaaggug

SEQ ID NO: 504912 - RNA, 32 nt, Human
ucuagcuuucugcuuuuaccuuuacccuaauc

SEQ ID NO: 504913 - RNA, 32 nt, Human
ucuagcuuugauacacuugcccuuucauaugu

SEQ ID NO: 504914 - RNA, 32 nt, Human
ucuagcuuugucugaaguuucuuuggaaacuc

SEQ ID NO: 504915 - RNA, 32 nt, Human
ucuaggaaaagcugcacugggguggggagacc

SEQ ID NO: 504916 - RNA, 32 nt, Human
ucuaggaaaugaugccagugaaugcguagucc

SEQ ID NO: 504917 - RNA, 32 nt, Human
ucuaggaaccagaguacagaugagaacagcuu

SEQ ID NO: 504918 - RNA, 32 nt, Human
ucuaggaacugacccugcuccaucacacacac

SEQ ID NO: 504919 - RNA, 32 nt, Human
ucuaggaagauggaaaguacuuaaauaaugug

SEQ ID NO: 504920 - RNA, 32 nt, Human
ucuaggacaaggcgcagccagauggaagggag

SEQ ID NO: 504921 - RNA, 32 nt, Human
ucuaggacagcuuugccaugugcagugaaccc

SEQ ID NO: 504922 - RNA, 32 nt, Human
ucuaggacaugcagacucacugugagcgagag

SEQ ID NO: 504923 - RNA, 32 nt, Human
ucuaggaccagccuggacaacauggugagacc

SEQ ID NO: 504924 - RNA, 32 nt, Human
ucuaggacccgaaguucucuccccagcagaga

SEQ ID NO: 504925 - RNA, 32 nt, Human
ucuaggacgagcucugugucccccacaccaca

SEQ ID NO: 504926 - RNA, 32 nt, Human
ucuaggacgcagcagccucuccccagcacuga

SEQ ID NO: 504927 - RNA, 32 nt, Human
ucuaggacgugagacccacacgccgcccucag

SEQ ID NO: 504928 - RNA, 32 nt, Human
ucuaggagaccacccacugccacuucagaaaa

SEQ ID NO: 504929 - RNA, 32 nt, Human
ucuaggagaccguguucaugcaacacagcauu

SEQ ID NO: 504930 - RNA, 23 nt, Human
ucuaggagagggacagaguggga

SEQ ID NO: 504931 - RNA, 32 nt, Human
ucuaggagaugcuuuggcaaugugcugcugau

SEQ ID NO: 504932 - RNA, 32 nt, Human
ucuaggagcucgaagguggugcugggccucuc

SEQ ID NO: 504933 - RNA, 32 nt, Human
ucuaggagcucuggagccuuaggaccauggac

SEQ ID NO: 504934 - RNA, 32 nt, Human
ucuaggaggaggaggagguagggugugaaaca

SEQ ID NO: 504935 - RNA, 32 nt, Human
ucuaggaggcugagaagcaggagauccaagcu

SEQ ID NO: 504936 - RNA, 32 nt, Human
ucuaggagggaugaccccacucagcuccaggc

SEQ ID NO: 504937 - RNA, 32 nt, Human
ucuaggaggucgaggcuucagugagcggugau

SEQ ID NO: 504938 - RNA, 32 nt, Human
ucuaggaguucucggugagaucaaugguuuuu

SEQ ID NO: 504939 - RNA, 32 nt, Human
ucuaggaugaucaguaguucagcacuuaaaaa

SEQ ID NO: 504940 - RNA, 32 nt, Human
ucuaggcacacgcgcacuuccaccucugcccc

SEQ ID NO: 504941 - RNA, 32 nt, Human
ucuaggcaccuuggucccagugucuuccuuuu

SEQ ID NO: 504942 - RNA, 32 nt, Human
ucuaggcacuuccuccagccucaggcagccac

SEQ ID NO: 504943 - RNA, 32 nt, Human
ucuaggcagaacacaggaaggaagagaggugc

SEQ ID NO: 504944 - RNA, 32 nt, Human
ucuaggcagaggcuggaaugcaaugaugcgau

SEQ ID NO: 504945 - RNA, 32 nt, Human
ucuaggcagcagagucaaaacaaggacagcuu

SEQ ID NO: 504946 - RNA, 32 nt, Human
ucuaggcaggcagggugcuccuggugucugcc

SEQ ID NO: 504947 - RNA, 32 nt, Human
ucuaggcagggugcugccgugggaagagagca

SEQ ID NO: 504948 - RNA, 32 nt, Human
ucuaggcccucaccucaaaccuugccauuggu

SEQ ID NO: 504949 - RNA, 32 nt, Human
ucuaggccgcgaggggcgggugcaauggcgga

SEQ ID NO: 504950 - RNA, 32 nt, Human
ucuaggccugcucugcccuugccguggggaag

SEQ ID NO: 504951 - RNA, 32 nt, Human
ucuaggcggacacacccugggcccugagcauc

SEQ ID NO: 504952 - RNA, 26 nt, Human
ucuaggcucacacuguccuugucaag

SEQ ID NO: 504953 - RNA, 32 nt, Human
ucuaggcucacugcaaccuccaccucccaggu

SEQ ID NO: 504954 - RNA, 32 nt, Human
ucuaggcucacugcaaccuccuucucccaggu

SEQ ID NO: 504955 - RNA, 32 nt, Human
ucuaggcucacugcaaccucugucuccagggu

SEQ ID NO: 504956 - RNA, 32 nt, Human
ucuaggcucacugcaaccuucaccgcccaggu

SEQ ID NO: 504957 - RNA, 32 nt, Human
ucuaggcucacugcaacuuccgccucccgggu

SEQ ID NO: 504958 - RNA, 32 nt, Human
ucuaggcucacugcaacuucugccucccaugc

SEQ ID NO: 504959 - RNA, 32 nt, Human
ucuaggcuccuugggcuucaagcaggaccuga

SEQ ID NO: 504960 - RNA, 32 nt, Human
ucuaggcucugaaauagccacuuuaagaauca

SEQ ID NO: 504961 - RNA, 32 nt, Human
ucuaggcucuggaguauggaagugacagcucc

SEQ ID NO: 504962 - RNA, 32 nt, Human
ucuaggcugaauccuaggguaagguggaucaa

SEQ ID NO: 504963 - RNA, 32 nt, Human
ucuaggcugacagagcagggcuguuucucaua

SEQ ID NO: 504964 - RNA, 32 nt, Human
ucuaggcugaggguccuugaacagacgucauc

SEQ ID NO: 504965 - RNA, 32 nt, Human
ucuaggcugagugcauggaaacuguuacgcuu

SEQ ID NO: 504966 - RNA, 19 nt, Human
ucuaggcuggagugcaaug

SEQ ID NO: 504967 - RNA, 20 nt, Human
ucuaggcuggagugcaaugg

SEQ ID NO: 504968 - RNA, 19 nt, Human
ucuaggcuggagugcagug

SEQ ID NO: 504969 - RNA, 20 nt, Human
ucuaggcuggagugcagugg

SEQ ID NO: 504970 - RNA, 20 nt, Human
ucuaggcuggagugccgugg

SEQ ID NO: 504971 - RNA, 32 nt, Human
ucuaggcugggaggggagaaccagccccuccc

SEQ ID NO: 504972 - RNA, 22 nt, Human
ucuaggcuuuguuucucugugu

SEQ ID NO: 504973 - RNA, 32 nt, Human
ucuagggaacaacacaauucgauucaccguau

SEQ ID NO: 504974 - RNA, 32 nt, Human
ucuagggaacacaagaggcggagccagguggc

SEQ ID NO: 504975 - RNA, 32 nt, Human
ucuagggaaggccacagaccucagcuguacga

SEQ ID NO: 504976 - RNA, 32 nt, Human
ucuagggacaccacugcccugucuuuaggaaa

SEQ ID NO: 504977 - RNA, 32 nt, Human
ucuagggacagguaaugucggcuuccaaguga

SEQ ID NO: 504978 - RNA, 21 nt, Human
ucuagggaccuuuauguccua

SEQ ID NO: 504979 - RNA, 32 nt, Human
ucuagggagggcagcucccaucaccuuccacg

SEQ ID NO: 504980 - RNA, 32 nt, Human
ucuagggagggcccuaagaacacgagcuccuc

SEQ ID NO: 504981 - RNA, 32 nt, Human
ucuagggcaagggcaaaaugccuccaaucuuu

SEQ ID NO: 504982 - RNA, 32 nt, Human
ucuagggcagggacaugucgcauuuccucugc

SEQ ID NO: 504983 - RNA, 32 nt, Human
ucuagggccccucaugccccaggcuggagcag

SEQ ID NO: 504984 - RNA, 32 nt, Human
ucuagggccucagucuggagugggauaggagc

SEQ ID NO: 504985 - RNA, 32 nt, Human
ucuagggcuaguagaacuggaucccaacacca

SEQ ID NO: 504986 - RNA, 32 nt, Human
ucuagggcugaugcugaccaugugguuuccac

SEQ ID NO: 504987 - RNA, 32 nt, Human
ucuagggcugggaccugucagucaaggaagag

SEQ ID NO: 504988 - RNA, 32 nt, Human
ucuaggggacaguaaugagcuuugaauauuua

SEQ ID NO: 504989 - RNA, 32 nt, Human
ucuaggggaggcgggugggggagggagggauc

SEQ ID NO: 504990 - RNA, 32 nt, Human
ucuaggggcccaggccggcggcggcgauggcc

SEQ ID NO: 504991 - RNA, 32 nt, Human
ucuaggggccuuuggucugcccuaccuuaacc

SEQ ID NO: 504992 - RNA, 24 nt, Human
ucuaggguacaggugcacaacgug

SEQ ID NO: 504993 - RNA, 32 nt, Human
ucuaggguaugugggaaggucagggcuguggu

SEQ ID NO: 504994 - RNA, 32 nt, Human
ucuaggguccugggucucuugcauuuauaugu

SEQ ID NO: 504995 - RNA, 32 nt, Human
ucuagggucuagacauguucagcuuuguggac

SEQ ID NO: 504996 - RNA, 32 nt, Human
ucuagggucugcaaaauagaggccaaauccag

SEQ ID NO: 504997 - RNA, 32 nt, Human
ucuagggugaagccugggugaugaggcugcug

SEQ ID NO: 504998 - RNA, 32 nt, Human
ucuagggugagcucugcccggcugcagggaug

SEQ ID NO: 504999 - RNA, 20 nt, Human
ucuaggguuaagccaaaaga

SEQ ID NO: 505000 - RNA, 32 nt, Human
ucuaggguuggcgaggcuggagggcaggguga

SEQ ID NO: 505001 - RNA, 32 nt, Human
ucuagguagucacacuucacuaaagcgucauc

SEQ ID NO: 505002 - RNA, 32 nt, Human
ucuaggucaccacauuuuccaucuccaaauag

SEQ ID NO: 505003 - RNA, 32 nt, Human
ucuaggucaccacucccaauccuggggauugg

SEQ ID NO: 505004 - RNA, 32 nt, Human
ucuaggucacuucucacaaugucccuucagca

SEQ ID NO: 505005 - RNA, 32 nt, Human
ucuaggucaggaaaagaaacaguguguucguu

SEQ ID NO: 505006 - RNA, 18 nt, Human
ucuaggucggcugugcug

SEQ ID NO: 505007 - RNA, 32 nt, Human
ucuaggucugggcagccaugaccugcagggcc

SEQ ID NO: 505008 - RNA, 32 nt, Human
ucuaggugccaucacuggauaauguggaguga

SEQ ID NO: 505009 - RNA, 32 nt, Human
ucuaggugcuagauaugggccaggaagagccc

SEQ ID NO: 505010 - RNA, 32 nt, Human
ucuagguggugaggacaagagugauggcuguu

SEQ ID NO: 505011 - RNA, 32 nt, Human
ucuagguguuucuuguguuugagaaccaugac

SEQ ID NO: 505012 - RNA, 32 nt, Human
ucuagguuaaggagggaggaggguugaucuuu

SEQ ID NO: 505013 - RNA, 32 nt, Human
ucuaguaaaaauacaaaaauuagccaggcaug

SEQ ID NO: 505014 - RNA, 32 nt, Human
ucuaguaaaaauacaaaaauuagcucagcaug

SEQ ID NO: 505015 - RNA, 32 nt, Human
ucuaguaaagggaaugaggaaagggaacccuu

SEQ ID NO: 505016 - RNA, 32 nt, Human
ucuaguaacacaaagcugucccagggaaaagc

SEQ ID NO: 505017 - RNA, 32 nt, Human
ucuaguacagaaauuauagaaauaucagccac

SEQ ID NO: 505018 - RNA, 32 nt, Human
ucuaguacagauuccaggugcugcuacuucaa

SEQ ID NO: 505019 - RNA, 22 nt, Human
ucuaguaccucuucucuucucu

SEQ ID NO: 505020 - RNA, 32 nt, Human
ucuaguacuagucccagaauuuagaauaugcu

SEQ ID NO: 505021 - RNA, 32 nt, Human
ucuaguacucagcucaguuugaucuagauauu

SEQ ID NO: 505022 - RNA, 32 nt, Human
ucuaguacugccucuguggacuuagguuccag

SEQ ID NO: 505023 - RNA, 32 nt, Human
ucuaguagccucaguucuuccucuccuuuguu

SEQ ID NO: 505024 - RNA, 21 nt, Human
ucuaguagcuggaacugcagg

SEQ ID NO: 505025 - RNA, 32 nt, Human
ucuaguaggcaggccagguuagugaggaagga

SEQ ID NO: 505026 - RNA, 32 nt, Human
ucuaguagugccugugccccugggcagauugg

SEQ ID NO: 505027 - RNA, 32 nt, Human
ucuaguauaauccagucucucuucucacuucu

SEQ ID NO: 505028 - RNA, 32 nt, Human
ucuaguauuuauccuuuguauuacaagcaacc

SEQ ID NO: 505029 - RNA, 32 nt, Human
ucuagucacuguggugaugcagagauaauacg

SEQ ID NO: 505030 - RNA, 32 nt, Human
ucuagucagcaaauggccuggccacuuggcuc

SEQ ID NO: 505031 - RNA, 32 nt, Human
ucuagucaguuauauugcuauuguaaauucuu

SEQ ID NO: 505032 - RNA, 32 nt, Human
ucuagucauccaccgccauccugggccccacg

SEQ ID NO: 505033 - RNA, 32 nt, Human
ucuaguccgcucgcggugccaugccauuccuc

SEQ ID NO: 505034 - RNA, 31 nt, Human
ucuaguccuuccaaggaggggagagaagugu

SEQ ID NO: 505035 - RNA, 32 nt, Human
ucuaguccuuucugugguucucagccaagaca

SEQ ID NO: 505036 - RNA, 32 nt, Human
ucuagucgccuccugccaucugaucucccucc

SEQ ID NO: 505037 - RNA, 32 nt, Human
ucuagucucuucuuuaugucuaccuccuccau

SEQ ID NO: 505038 - RNA, 32 nt, Human
ucuagucugccuggcuaccaugcuucucacuc

SEQ ID NO: 505039 - RNA, 32 nt, Human
ucuagucugggugacaagagcaaaacccuguc

SEQ ID NO: 505040 - RNA, 24 nt, Human
ucuagucugggugacagagcaaga

SEQ ID NO: 505041 - RNA, 32 nt, Human
ucuagucugggugacagagcaagacccuguuu

SEQ ID NO: 505042 - RNA, 32 nt, Human
ucuagucuguccuuuaauagcucucuuaaaua

SEQ ID NO: 505043 - RNA, 32 nt, Human
ucuagugaaaauacaaaaauuagccaggugug

SEQ ID NO: 505044 - RNA, 23 nt, Human
ucuagugaaaauaucuguuuuca

SEQ ID NO: 505045 - RNA, 32 nt, Human
ucuagugaacuagacaguuuguaccaugaggg

SEQ ID NO: 505046 - RNA, 32 nt, Human
ucuagugauuucccuguauuggguuugaaaua

SEQ ID NO: 505047 - RNA, 32 nt, Human
ucuagugcaauggcacgaucucugcucacugu

SEQ ID NO: 505048 - RNA, 32 nt, Human
ucuagugcacucccuccagccuacccacaaac

SEQ ID NO: 505049 - RNA, 32 nt, Human
ucuagugcagaugguggcggaggcagaaucga

SEQ ID NO: 505050 - RNA, 32 nt, Human
ucuagugcauggaccuccuuguugacugcugu

SEQ ID NO: 505051 - RNA, 32 nt, Human
ucuagugcccucaagcucccaggauuuaggua

SEQ ID NO: 505052 - RNA, 24 nt, Human
ucuagugcuggguguggagugagg

SEQ ID NO: 505053 - RNA, 32 nt, Human
ucuagugggaacaggccccagcucagccuccg

SEQ ID NO: 505054 - RNA, 32 nt, Human
ucuagugggugaggcugaacaccaagagccuu

SEQ ID NO: 505055 - RNA, 32 nt, Human
ucuagugggugagugcagagagagaagaacuc

SEQ ID NO: 505056 - RNA, 32 nt, Human
ucuagugguuaaugcacuugacauguacagua

SEQ ID NO: 505057 - RNA, 32 nt, Human
ucuagugguucaauaaaggugcugaauggguu

SEQ ID NO: 505058 - RNA, 29 nt, Human
ucuaguguucaguguccucaucuuuaaaa

SEQ ID NO: 505059 - RNA, 32 nt, Human
ucuaguguuuuuauguuucucaaauccccuuu

SEQ ID NO: 505060 - RNA, 31 nt, Human
ucuaguuaggagagagaaaauaauugcaaau

SEQ ID NO: 505061 - RNA, 32 nt, Human
ucuaguuaggagagagaaaauaauugcaaaua

SEQ ID NO: 505062 - RNA, 32 nt, Human
ucuaguuagguagaacagggacuuaccagcuu

SEQ ID NO: 505063 - RNA, 32 nt, Human
ucuaguuaguacaguaggcuccugauuuacag

SEQ ID NO: 505064 - RNA, 32 nt, Human
ucuaguuauucagaggaguaagauggugaugu

SEQ ID NO: 505065 - RNA, 32 nt, Human
ucuaguucaguccugugaaccauguccugagg

SEQ ID NO: 505066 - RNA, 32 nt, Human
ucuaguuccucuccauccgccaccuccccucc

SEQ ID NO: 505067 - RNA, 32 nt, Human
ucuaguuccuuuauguccuguacaucauucuc

SEQ ID NO: 505068 - RNA, 32 nt, Human
ucuaguucuagucuguugaucugccuuuuguu

SEQ ID NO: 505069 - RNA, 32 nt, Human
ucuaguucucaaccucuccaaguucaugagcc

SEQ ID NO: 505070 - RNA, 32 nt, Human
ucuaguucuccaaggaccuagaagacagaugg

SEQ ID NO: 505071 - RNA, 32 nt, Human
ucuaguucuuccagucguuauccucugcuguc

SEQ ID NO: 505072 - RNA, 32 nt, Human
ucuaguugcccacacuagagugcaauggcgca

SEQ ID NO: 505073 - RNA, 32 nt, Human
ucuaguugcuuucauccuccuuuuguucugca

SEQ ID NO: 505074 - RNA, 32 nt, Human
ucuaguuggaaagagguauauacagguggauu

SEQ ID NO: 505075 - RNA, 32 nt, Human
ucuaguuguuggauuuaucguacucugcggcu

SEQ ID NO: 505076 - RNA, 32 nt, Human
ucuaguuuaagauuuuuguuuaaucaucaugg

SEQ ID NO: 505077 - RNA, 32 nt, Human
ucuaguuuagagacauccuucauuugacauuu

SEQ ID NO: 505078 - RNA, 32 nt, Human
ucuaguuuagaguuagcagacuacccaaaucu

SEQ ID NO: 505079 - RNA, 32 nt, Human
ucuaguuuagauagcauugugaugcaauuucc

SEQ ID NO: 505080 - RNA, 32 nt, Human
ucuaguuuauagcaccuuaacuuuaacuguuc

SEQ ID NO: 505081 - RNA, 26 nt, Human
ucuaguuucucagggauggagcgaga

SEQ ID NO: 505082 - RNA, 32 nt, Human
ucuaguuuugcaugcccuuuacugcagaacca

SEQ ID NO: 505083 - RNA, 32 nt, Human
ucuauaaaaauuuuuaaaauuagccagguaug

SEQ ID NO: 505084 - RNA, 32 nt, Human
ucuauaaacuuugauccaaagcagaaucaaug

SEQ ID NO: 505085 - RNA, 32 nt, Human
ucuauaaagugggaucuaucaugaccagccua

SEQ ID NO: 505086 - RNA, 32 nt, Human
ucuauaacaggcaaucaacaaacguuucuuga

SEQ ID NO: 505087 - RNA, 32 nt, Human
ucuauaacaugcugcgacggcaggaggagcug

SEQ ID NO: 505088 - RNA, 32 nt, Human
ucuauaaccagccuuuguuaacaaagggaacu

SEQ ID NO: 505089 - RNA, 32 nt, Human
ucuauaagaauucagaccucauuagaaaucaa

SEQ ID NO: 505090 - RNA, 32 nt, Human
ucuauaaggguauagaacugcuuuucucauag

SEQ ID NO: 505091 - RNA, 32 nt, Human
ucuauaaucaguguguuucucucaccuaaaac

SEQ ID NO: 505092 - RNA, 32 nt, Human
ucuauaauccacccuucugcaggcccugaaau

SEQ ID NO: 505093 - RNA, 32 nt, Human
ucuauaaugugggaaauggcuuggggaggaug

SEQ ID NO: 505094 - RNA, 32 nt, Human
ucuauaauuccagcuacucaggaggcugagac

SEQ ID NO: 505095 - RNA, 32 nt, Human
ucuauaauuccagcuacucaggaggcugaggc

SEQ ID NO: 505096 - RNA, 32 nt, Human
ucuauaauugaauaucaaauaagacaaauuac

SEQ ID NO: 505097 - RNA, 32 nt, Human
ucuauacacacauguguguuguguauaugcau

SEQ ID NO: 505098 - RNA, 32 nt, Human
ucuauacacugggugcccaacaacagccccuu

SEQ ID NO: 505099 - RNA, 24 nt, Human
ucuauacauuccuacguucucuca

SEQ ID NO: 505100 - RNA, 32 nt, Human
ucuauaccaaccaaaccaauucaccaacacag

SEQ ID NO: 505101 - RNA, 32 nt, Human
ucuauacccugguaggcuuccucuucagcaug

SEQ ID NO: 505102 - RNA, 32 nt, Human
ucuauaccucagcugaggacauggacacuucc

SEQ ID NO: 505103 - RNA, 32 nt, Human
ucuauacgcaaaccacacaccugccaaggagc

SEQ ID NO: 505104 - RNA, 32 nt, Human
ucuauacuuccucugcagcagaaaagaguauc

SEQ ID NO: 505105 - RNA, 32 nt, Human
ucuauagaaaugaaaaugcagcaugaaguuga

SEQ ID NO: 505106 - RNA, 32 nt, Human
ucuauagacaaggaggucagacuggagugaau

SEQ ID NO: 505107 - RNA, 32 nt, Human
ucuauagcagaguccuuauucuucucauaaau

SEQ ID NO: 505108 - RNA, 32 nt, Human
ucuauagcauccuccugugcucuuaccuaagg

SEQ ID NO: 505109 - RNA, 32 nt, Human
ucuauagcauuuccugacacuuccgcuacuuu

SEQ ID NO: 505110 - RNA, 32 nt, Human
ucuauagccaugagacuccuuguggccucaag

SEQ ID NO: 505111 - RNA, 32 nt, Human
ucuauagccuccagaacugugagaaauaaaca

SEQ ID NO: 505112 - RNA, 32 nt, Human
ucuauagccugaggugggagaaucacuuaagc

SEQ ID NO: 505113 - RNA, 21 nt, Human
ucuauagcucuaaagguuucu

SEQ ID NO: 505114 - RNA, 24 nt, Human
ucuauagcuucugcucacugggca

SEQ ID NO: 505115 - RNA, 30 nt, Human
ucuauaggaagccagguuuacaauagguaa

SEQ ID NO: 505116 - RNA, 32 nt, Human
ucuauaggcccaggugcugaaucgcaaugguc

SEQ ID NO: 505117 - RNA, 32 nt, Human
ucuauagggugaggaugcccagcucugcaaga

SEQ ID NO: 505118 - RNA, 32 nt, Human
ucuauauaauuuuauaaacacaaauucaugau

SEQ ID NO: 505119 - RNA, 19 nt, Human
ucuauauauggcauccacg

SEQ ID NO: 505120 - RNA, 21 nt, Human
ucuauauccccaagcccucaa

SEQ ID NO: 505121 - RNA, 22 nt, Human
ucuauaucuauaaagguuucuu

SEQ ID NO: 505122 - RNA, 32 nt, Human
ucuauaugacagcaaccauugugagaaacuag

SEQ ID NO: 505123 - RNA, 32 nt, Human
ucuauauguagcaaggaaaaggugcuuuuuaa

SEQ ID NO: 505124 - RNA, 32 nt, Human
ucuauauucauuggaucauugccuccuuccua

SEQ ID NO: 505125 - RNA, 32 nt, Human
ucuauauuggcucauaaaacuaaccugaaaaa

SEQ ID NO: 505126 - RNA, 32 nt, Human
ucuauauuugagaaggagucucgcgcugucgc

SEQ ID NO: 505127 - RNA, 32 nt, Human
ucuauauuuuugaacugauacuuguuuuauac

SEQ ID NO: 505128 - RNA, 32 nt, Human
ucuaucaaaauguaaaaugccacucacuucua

SEQ ID NO: 505129 - RNA, 32 nt, Human
ucuaucaaggucaacuggcaguuuuauuaccu

SEQ ID NO: 505130 - RNA, 32 nt, Human
ucuaucacaccacugugcucuagccuggguga

SEQ ID NO: 505131 - RNA, 32 nt, Human
ucuaucacauccagcauugucccagugcuuug

SEQ ID NO: 505132 - RNA, 32 nt, Human
ucuaucaccaggugggagugcaguggcacaau

SEQ ID NO: 505133 - RNA, 32 nt, Human
ucuaucacccaggcuggagugcaguggugcaa

SEQ ID NO: 505134 - RNA, 24 nt, Human
ucuaucacccaggcuggaguggag

SEQ ID NO: 505135 - RNA, 24 nt, Human
ucuaucaccuaggcuggagugcag

SEQ ID NO: 505136 - RNA, 32 nt, Human
ucuaucaccuuuccucacauagguaccuuuuu

SEQ ID NO: 505137 - RNA, 32 nt, Human
ucuaucacuggcaaaguagauguaggaggaca

SEQ ID NO: 505138 - RNA, 32 nt, Human
ucuaucacuuccucuaguacaagccagcugcc

SEQ ID NO: 505139 - RNA, 32 nt, Human
ucuaucagccuucuaugguaccuuuuugucag

SEQ ID NO: 505140 - RNA, 32 nt, Human
ucuaucaggagcaguggagcagugagcugccu

SEQ ID NO: 505141 - RNA, 32 nt, Human
ucuaucaggccugguggcuguuggguggggcu

SEQ ID NO: 505142 - RNA, 32 nt, Human
ucuaucagggcuggaguggugcagccccuggc

SEQ ID NO: 505143 - RNA, 32 nt, Human
ucuaucaggugagagaaaaaugucagacucaa

SEQ ID NO: 505144 - RNA, 32 nt, Human
ucuaucaguucugacauucuaggcuucauaua

SEQ ID NO: 505145 - RNA, 32 nt, Human
ucuaucauacauguacauacucacacacacca

SEQ ID NO: 505146 - RNA, 32 nt, Human
ucuaucauuuuugagcaacucccucucagcua

SEQ ID NO: 505147 - RNA, 32 nt, Human
ucuauccaaacagacguucacugccacuugua

SEQ ID NO: 505148 - RNA, 32 nt, Human
ucuauccagccaaugccuguuuacacagacac

SEQ ID NO: 505149 - RNA, 32 nt, Human
ucuauccaugcuguguccaggaggugaccuug

SEQ ID NO: 505150 - RNA, 32 nt, Human
ucuaucccagaacgugcuggagauuugacacu

SEQ ID NO: 505151 - RNA, 32 nt, Human
ucuaucccauacuacuaaaccccaccagcuau

SEQ ID NO: 505152 - RNA, 32 nt, Human
ucuauccccaaagugucugcuuucaagcacca

SEQ ID NO: 505153 - RNA, 32 nt, Human
ucuauccccaggaauagaacuuaagggguggg

SEQ ID NO: 505154 - RNA, 22 nt, Human
ucuauccccaggcuggagugca

SEQ ID NO: 505155 - RNA, 32 nt, Human
ucuaucccuccucccauccacacacacaggca

SEQ ID NO: 505156 - RNA, 32 nt, Human
ucuauccggcacuaggaacagccccgggggcg

SEQ ID NO: 505157 - RNA, 32 nt, Human
ucuauccuccacuuuuaccauauucuguaaag

SEQ ID NO: 505158 - RNA, 31 nt, Human
ucuauccuccccuccugcccuguguccaucc

SEQ ID NO: 505159 - RNA, 21 nt, Human
ucuauccucuuccuugccaga

SEQ ID NO: 505160 - RNA, 32 nt, Human
ucuauccugaacucuagguuccuugaagccag

SEQ ID NO: 505161 - RNA, 32 nt, Human
ucuauccuugauacaacagcugaccucauuuc

SEQ ID NO: 505162 - RNA, 32 nt, Human
ucuauccuuuucuccccuucaaucuugccaaa

SEQ ID NO: 505163 - RNA, 32 nt, Human
ucuaucgccagaaaaguauuuccuuuguucca

SEQ ID NO: 505164 - RNA, 32 nt, Human
ucuaucgccaggcuggaguguaguggcaugau

SEQ ID NO: 505165 - RNA, 24 nt, Human
ucuaucgcccaggauggagugcag

SEQ ID NO: 505166 - RNA, 32 nt, Human
ucuaucgcccaggauggagugcaguggcucaa

SEQ ID NO: 505167 - RNA, 23 nt, Human
ucuaucgcccaggcuggagugca

SEQ ID NO: 505168 - RNA, 24 nt, Human
ucuaucgcccaggcuggagugcag

SEQ ID NO: 505169 - RNA, 32 nt, Human
ucuaucgcccaggcuggagugcaguggcgcau

SEQ ID NO: 505170 - RNA, 21 nt, Human
ucuaucgccuaggcugaagca

SEQ ID NO: 505171 - RNA, 32 nt, Human
ucuaucgcugcucucuucuugucauccuuaaa

SEQ ID NO: 505172 - RNA, 24 nt, Human
ucuaucggccaggcuggagugcag

SEQ ID NO: 505173 - RNA, 32 nt, Human
ucuaucggccaggcuggagugcaguggugcaa

SEQ ID NO: 505174 - RNA, 32 nt, Human
ucuaucuauaugcacauacauacauauauaca

SEQ ID NO: 505175 - RNA, 32 nt, Human
ucuaucuaucuauaucuucaucccaucaacuc

SEQ ID NO: 505176 - RNA, 32 nt, Human
ucuaucucaagaaacaagaugauuguaacaug

SEQ ID NO: 505177 - RNA, 32 nt, Human
ucuaucucagugaacacacuguauuuacuuga

SEQ ID NO: 505178 - RNA, 28 nt, Human
ucuaucucauuugcugccuuuucacuaa

SEQ ID NO: 505179 - RNA, 32 nt, Human
ucuaucucccucucacacaucaaugcuuaugc

SEQ ID NO: 505180 - RNA, 32 nt, Human
ucuaucucugcaguucugucugacuuagcuga

SEQ ID NO: 505181 - RNA, 32 nt, Human
ucuaucugcagguccccagccuggguaaagau

SEQ ID NO: 505182 - RNA, 32 nt, Human
ucuaucuggucugccuugcccguuugccuguu

SEQ ID NO: 505183 - RNA, 32 nt, Human
ucuaucugucugucugucggucugugucuugg

SEQ ID NO: 505184 - RNA, 32 nt, Human
ucuaucugucugucugucugucugucugucug

SEQ ID NO: 505185 - RNA, 32 nt, Human
ucuaucuucccuuccaacgaauuccugcucag

SEQ ID NO: 505186 - RNA, 32 nt, Human
ucuaucuuccgacuuuguuggaggguccacug

SEQ ID NO: 505187 - RNA, 32 nt, Human
ucuaucuuguucauuuuagggauaaugaagaa

SEQ ID NO: 505188 - RNA, 32 nt, Human
ucuaugaaaauguguuuugaccaaacuuagua

SEQ ID NO: 505189 - RNA, 32 nt, Human
ucuaugaacucaucauuccagccugggcaaca

SEQ ID NO: 505190 - RNA, 32 nt, Human
ucuaugaaggaucuucugcaagaggcugccuc

SEQ ID NO: 505191 - RNA, 32 nt, Human
ucuaugaauagagguggacacaacagcagucu

SEQ ID NO: 505192 - RNA, 32 nt, Human
ucuaugaauggaugauuuccaggcucagggug

SEQ ID NO: 505193 - RNA, 32 nt, Human
ucuaugaauuccggguagguuucuugaaaaua

SEQ ID NO: 505194 - RNA, 32 nt, Human
ucuaugacucuugucuccuccuccaggaggac

SEQ ID NO: 505195 - RNA, 32 nt, Human
ucuaugagagauuuccucugauagcucugcuu

SEQ ID NO: 505196 - RNA, 32 nt, Human
ucuaugagugagggaugcagagccagggaagg

SEQ ID NO: 505197 - RNA, 32 nt, Human
ucuaugaguuggacuucagucuugccuaggcg

SEQ ID NO: 505198 - RNA, 32 nt, Human
ucuaugaucccagcuacuggagaggcugaggc

SEQ ID NO: 505199 - RNA, 32 nt, Human
ucuaugaugucccccuucucugaggccuggac

SEQ ID NO: 505200 - RNA, 32 nt, Human
ucuaugcagcaagcccugcccagucagugacc

SEQ ID NO: 505201 - RNA, 32 nt, Human
ucuaugccacucuggccauccacuauccaggg

SEQ ID NO: 505202 - RNA, 32 nt, Human
ucuaugcccugagaccccacugcugucauugu

SEQ ID NO: 505203 - RNA, 32 nt, Human
ucuaugccggcugagcgagaaaaagaggaaua

SEQ ID NO: 505204 - RNA, 32 nt, Human
ucuaugccuuucuugccauugugugcccuuuc

SEQ ID NO: 505205 - RNA, 32 nt, Human
ucuaugcucacuguagccuugaccuucugggu

SEQ ID NO: 505206 - RNA, 32 nt, Human
ucuaugcugcuuuaggaauucugcaaggguuc

SEQ ID NO: 505207 - RNA, 32 nt, Human
ucuaugcugggaaccagggaccaagaguaaau

SEQ ID NO: 505208 - RNA, 32 nt, Human
ucuaugcuuucaggacuggcuuucugcaccug

SEQ ID NO: 505209 - RNA, 32 nt, Human
ucuauggacucagaggaaugauguuuuaguuu

SEQ ID NO: 505210 - RNA, 32 nt, Human
ucuauggagcuuaaaguucacagccauucugu

SEQ ID NO: 505211 - RNA, 32 nt, Human
ucuauggauacuuggguugugggggcucucuu

SEQ ID NO: 505212 - RNA, 32 nt, Human
ucuauggcagcaccuuugccuuccaugggucc

SEQ ID NO: 505213 - RNA, 32 nt, Human
ucuauggcagccaagagagaggcccuucagag

SEQ ID NO: 505214 - RNA, 23 nt, Human
ucuauggcccugcaaaaauauaa

SEQ ID NO: 505215 - RNA, 32 nt, Human
ucuauggccuugugucaaggugccucuuaaag

SEQ ID NO: 505216 - RNA, 32 nt, Human
ucuauggcuauugugucaggucacuguggaua

SEQ ID NO: 505217 - RNA, 32 nt, Human
ucuaugggguacugcauugcuuuuuauaaagu

SEQ ID NO: 505218 - RNA, 32 nt, Human
ucuaugguguguggaugugugugcaugaaucu

SEQ ID NO: 505219 - RNA, 24 nt, Human
ucuaugucccaggcuagagugcag

SEQ ID NO: 505220 - RNA, 32 nt, Human
ucuaugucuccucucguuggauugugacaccg

SEQ ID NO: 505221 - RNA, 22 nt, Human
ucuaugucuggaccuguguuag

SEQ ID NO: 505222 - RNA, 32 nt, Human
ucuaugugcaaggugauauauaaucauaucca

SEQ ID NO: 505223 - RNA, 32 nt, Human
ucuaugugcacacacccccaucacauggaaug

SEQ ID NO: 505224 - RNA, 32 nt, Human
ucuaugugguggggauggcagguuguauuaac

SEQ ID NO: 505225 - RNA, 28 nt, Human
ucuauguguguaugugccauacauaugu

SEQ ID NO: 505226 - RNA, 32 nt, Human
ucuaugugugugcguguguauguaugugagca

SEQ ID NO: 505227 - RNA, 32 nt, Human
ucuauguucauggagcuuauuugaggcuagaa

SEQ ID NO: 505228 - RNA, 24 nt, Human
ucuauguuccucuucucuuauccu

SEQ ID NO: 505229 - RNA, 32 nt, Human
ucuauguuccuguuccuuccucugcuccuccu

SEQ ID NO: 505230 - RNA, 32 nt, Human
ucuauguugcccaggcuggucucaggcuccug

SEQ ID NO: 505231 - RNA, 32 nt, Human
ucuauguuuuggaaguuggggguuuaauaaua

SEQ ID NO: 505232 - RNA, 32 nt, Human
ucuauuaaaaacacaaaaauuagccagaugug

SEQ ID NO: 505233 - RNA, 32 nt, Human
ucuauuaaaaauacaaaaauuagccaggcaua

SEQ ID NO: 505234 - RNA, 32 nt, Human
ucuauuaaaaauacaaaaauuagccaggcaug

SEQ ID NO: 505235 - RNA, 32 nt, Human
ucuauuaaaaauacaaaaauuagccggaugug

SEQ ID NO: 505236 - RNA, 32 nt, Human
ucuauuaaaaauacaaaaauuagccgggagug

SEQ ID NO: 505237 - RNA, 32 nt, Human
ucuauuaaaaauacaaaaauuagccgggugug

SEQ ID NO: 505238 - RNA, 32 nt, Human
ucuauuaaaaauacaaaauuagccgggcaugg

SEQ ID NO: 505239 - RNA, 32 nt, Human
ucuauuaaaagacaaaaauuagcugggcgugg

SEQ ID NO: 505240 - RNA, 32 nt, Human
ucuauuaaagauacaaaauuagccaggcaugg

SEQ ID NO: 505241 - RNA, 32 nt, Human
ucuauuaagagcacauuuauuuacauuuguau

SEQ ID NO: 505242 - RNA, 32 nt, Human
ucuauuacuaaucaagccgagaggaggcccac

SEQ ID NO: 505243 - RNA, 32 nt, Human
ucuauuacuuuugucugcucagcucuucuccu

SEQ ID NO: 505244 - RNA, 32 nt, Human
ucuauuagcaugccaccaugccccuccuccga

SEQ ID NO: 505245 - RNA, 32 nt, Human
ucuauuauacuagauaaaauguuguuacaaag

SEQ ID NO: 505246 - RNA, 32 nt, Human
ucuauucagcaaacacucagugagacaaccau

SEQ ID NO: 505247 - RNA, 32 nt, Human
ucuauucauucaccuucucucugacugcacuu

SEQ ID NO: 505248 - RNA, 32 nt, Human
ucuauucauucugugaccucaggggucacaua

SEQ ID NO: 505249 - RNA, 32 nt, Human
ucuauucccagcccugggaggaagggggaguc

SEQ ID NO: 505250 - RNA, 32 nt, Human
ucuauuccuucuggccuuuccucucuccuguu

SEQ ID NO: 505251 - RNA, 32 nt, Human
ucuauucggagcggcugaggaggcucauguca

SEQ ID NO: 505252 - RNA, 32 nt, Human
ucuauucugcauucccaagaguuuauguuuau

SEQ ID NO: 505253 - RNA, 32 nt, Human
ucuauucugcguuauuuuuguugcauaaccag

SEQ ID NO: 505254 - RNA, 32 nt, Human
ucuauugacaugcccacaaaacagguuuauuu

SEQ ID NO: 505255 - RNA, 32 nt, Human
ucuauugagaaguuauacaacauacaggcuuc

SEQ ID NO: 505256 - RNA, 32 nt, Human
ucuauugcauaguacaugaaucuauugucacu

SEQ ID NO: 505257 - RNA, 24 nt, Human
ucuauugcccaggcuggagugcag

SEQ ID NO: 505258 - RNA, 32 nt, Human
ucuauugcccaggcuggagugcaguggcucag

SEQ ID NO: 505259 - RNA, 32 nt, Human
ucuauugcccaggcuggagugcagugguacag

SEQ ID NO: 505260 - RNA, 32 nt, Human
ucuauugcccaggcuggagugcaguggugcga

SEQ ID NO: 505261 - RNA, 32 nt, Human
ucuauugcccaggcuggagugcagugguguaa

SEQ ID NO: 505262 - RNA, 32 nt, Human
ucuauugcccagucuggagugcaguggcauga

SEQ ID NO: 505263 - RNA, 32 nt, Human
ucuauugcgucaguagcaacacugcccagagg

SEQ ID NO: 505264 - RNA, 24 nt, Human
ucuauugcucaggcuggagugcag

SEQ ID NO: 505265 - RNA, 32 nt, Human
ucuauugcugagaagcaaaccgcccugcagca

SEQ ID NO: 505266 - RNA, 32 nt, Human
ucuauugcuggcaaagacagaagccucacugc

SEQ ID NO: 505267 - RNA, 32 nt, Human
ucuauugcuguggcugaugauuuccagagugu

SEQ ID NO: 505268 - RNA, 32 nt, Human
ucuauuggaaggagguguaacggcagaauagc

SEQ ID NO: 505269 - RNA, 32 nt, Human
ucuauuggauuuuuccaagagaaaguuuguaa

SEQ ID NO: 505270 - RNA, 32 nt, Human
ucuauuggccaggcuggaguguaguggcacca

SEQ ID NO: 505271 - RNA, 32 nt, Human
ucuauugggaggccgaggcgggaggaucacaa

SEQ ID NO: 505272 - RNA, 32 nt, Human
ucuauugucccagggagauauuagaccucucu

SEQ ID NO: 505273 - RNA, 20 nt, Human
ucuauuguguuuuucuucug

SEQ ID NO: 505274 - RNA, 24 nt, Human
ucuauuguucagacuggagugcag

SEQ ID NO: 505275 - RNA, 32 nt, Human
ucuauuguugcuuuucuggucuuuggaaagag

SEQ ID NO: 505276 - RNA, 32 nt, Human
ucuauuuagagcuucugucccuuccuucccau

SEQ ID NO: 505277 - RNA, 32 nt, Human
ucuauuuagccucacagaugacuuuagaaucu

SEQ ID NO: 505278 - RNA, 32 nt, Human
ucuauuuauauguauauuuauuuuuauguaug

SEQ ID NO: 505279 - RNA, 32 nt, Human
ucuauuuccagaaaguucagagccagauuuga

SEQ ID NO: 505280 - RNA, 32 nt, Human
ucuauuuccuucccuaauaccccacacccaac

SEQ ID NO: 505281 - RNA, 32 nt, Human
ucuauuucucauacauacauaacuucguuuuu

SEQ ID NO: 505282 - RNA, 32 nt, Human
ucuauuucucauuccuaagccuuaccaugagu

SEQ ID NO: 505283 - RNA, 32 nt, Human
ucuauuucucucuagagcacucaagacuuuac

SEQ ID NO: 505284 - RNA, 32 nt, Human
ucuauuucuuggaauacguucuccucugaccu

SEQ ID NO: 505285 - RNA, 32 nt, Human
ucuauuucuuugcaggagccugggugaguucu

SEQ ID NO: 505286 - RNA, 32 nt, Human
ucuauuugaagugaaguuauaaaagggcaaau

SEQ ID NO: 505287 - RNA, 26 nt, Human
ucuauuugacaaagucuuucuguguu

SEQ ID NO: 505288 - RNA, 32 nt, Human
ucuauuuggccacccuuccgcacuggggagaa

SEQ ID NO: 505289 - RNA, 32 nt, Human
ucuauuugggcucccaacacuauuucuccauc

SEQ ID NO: 505290 - RNA, 32 nt, Human
ucuauuuggucuucaguguuuuagccucauua

SEQ ID NO: 505291 - RNA, 32 nt, Human
ucuauuuguuacuccuuuuuacuggacaugau

SEQ ID NO: 505292 - RNA, 32 nt, Human
ucuauuuucagccugugccaccugucuaggca

SEQ ID NO: 505293 - RNA, 32 nt, Human
ucuauuuucagccugugcuucucacucaccau

SEQ ID NO: 505294 - RNA, 32 nt, Human
ucuauuuuccugggcagguuuauguugauguu

SEQ ID NO: 505295 - RNA, 32 nt, Human
ucuauuuucucuaaauauuuugcuuucaguaa

SEQ ID NO: 505296 - RNA, 32 nt, Human
ucuauuuugccaggcuggugcaaaguaauuaa

SEQ ID NO: 505297 - RNA, 32 nt, Human
ucuauuuuguuuccuuugguuuccuuccuccc

SEQ ID NO: 505298 - RNA, 32 nt, Human
ucuauuuuugacuguagccacagcugcuguuc

SEQ ID NO: 505299 - RNA, 32 nt, Human
ucucaaaaaguggccaaggauguggagugggc

SEQ ID NO: 505300 - RNA, 32 nt, Human
ucucaaaaccagaacaucaacagugcuguuuc

SEQ ID NO: 505301 - RNA, 32 nt, Human
ucucaaaacccauggagggaggcugcuggugu

SEQ ID NO: 505302 - RNA, 32 nt, Human
ucucaaaacguugagauucuguuguuuuguuu

SEQ ID NO: 505303 - RNA, 23 nt, Human
ucucaaaacucugauauuuguca

SEQ ID NO: 505304 - RNA, 32 nt, Human
ucucaaaagagugucccuucuucacaccuacu

SEQ ID NO: 505305 - RNA, 32 nt, Human
ucucaaaagccccacaccacccuccugccaac

SEQ ID NO: 505306 - RNA, 32 nt, Human
ucucaaaaggccaugguaucgugccccugagg

SEQ ID NO: 505307 - RNA, 32 nt, Human
ucucaaaaguugugaccguguuaaauuguacu

SEQ ID NO: 505308 - RNA, 32 nt, Human
ucucaaacacacacaaaugcccaaccagcucu

SEQ ID NO: 505309 - RNA, 32 nt, Human
ucucaaacagggacuugugaguacuuggcaag

SEQ ID NO: 505310 - RNA, 32 nt, Human
ucucaaaccaucuucugccucuucccuugaga

SEQ ID NO: 505311 - RNA, 32 nt, Human
ucucaaaccuccauuagaccucaggacuccaa

SEQ ID NO: 505312 - RNA, 32 nt, Human
ucucaaaccugccggcuccucuucccacggcc

SEQ ID NO: 505313 - RNA, 22 nt, Human
ucucaaacuccugaccucguga

SEQ ID NO: 505314 - RNA, 32 nt, Human
ucucaaacuuuaaaaugccucagcaucacuug

SEQ ID NO: 505315 - RNA, 32 nt, Human
ucucaaagaaaacugcugcagauggaaaaagg

SEQ ID NO: 505316 - RNA, 32 nt, Human
ucucaaagaaagaaagaaagaaaagaaagaaa

SEQ ID NO: 505317 - RNA, 32 nt, Human
ucucaaagaccaccauguccaaggucugacag

SEQ ID NO: 505318 - RNA, 32 nt, Human
ucucaaagaccuggggcugcugugaagcugga

SEQ ID NO: 505319 - RNA, 21 nt, Human
ucucaaagauucacacaugcc

SEQ ID NO: 505320 - RNA, 23 nt, Human
ucucaaagccauguacuuuguua

SEQ ID NO: 505321 - RNA, 32 nt, Human
ucucaaaggaugacacuucugugguguguagu

SEQ ID NO: 505322 - RNA, 22 nt, Human
ucucaaagggcugauacuguca

SEQ ID NO: 505323 - RNA, 32 nt, Human
ucucaaaguguggccaacucccauuuacuuag

SEQ ID NO: 505324 - RNA, 32 nt, Human
ucucaaauuaucaucccugguauuccagagua

SEQ ID NO: 505325 - RNA, 32 nt, Human
ucucaacacacaaagugccaccaccuucccug

SEQ ID NO: 505326 - RNA, 22 nt, Human
ucucaacaccauccaucccucu

SEQ ID NO: 505327 - RNA, 32 nt, Human
ucucaacaccauugaugccugccagugccauu

SEQ ID NO: 505328 - RNA, 32 nt, Human
ucucaacauuuugcacuguccaguauuuaaua

SEQ ID NO: 505329 - RNA, 32 nt, Human
ucucaaccaaaagguguuccucuuuaagggcu

SEQ ID NO: 505330 - RNA, 32 nt, Human
ucucaaccaagggagaaaaagacugagaugug

SEQ ID NO: 505331 - RNA, 32 nt, Human
ucucaacccaucucccuaaccccacaugcuug

SEQ ID NO: 505332 - RNA, 32 nt, Human
ucucaaccucauucccaccucuggggccccuu

SEQ ID NO: 505333 - RNA, 32 nt, Human
ucucaaccucgugauccacccaccucggucuc

SEQ ID NO: 505334 - RNA, 28 nt, Human
ucucaacgacuguuggccucaucaagag

SEQ ID NO: 505335 - RNA, 32 nt, Human
ucucaacguuuuacuuucuuuuuaucaggagg

SEQ ID NO: 505336 - RNA, 31 nt, Human
ucucaacuaauacuuugcuguugaaauguug

SEQ ID NO: 505337 - RNA, 20 nt, Human
ucucaacuacauuugaaaua

SEQ ID NO: 505338 - RNA, 32 nt, Human
ucucaacucaccgcaaccuccgccucccgggu

SEQ ID NO: 505339 - RNA, 32 nt, Human
ucucaacucaccgcaaccuccuccucuugggu

SEQ ID NO: 505340 - RNA, 25 nt, Human
ucucaacucacguuuuaauaauaca

SEQ ID NO: 505341 - RNA, 32 nt, Human
ucucaacucacucuagccugggugacagagcg

SEQ ID NO: 505342 - RNA, 32 nt, Human
ucucaacucacugcaaccuccacccgccgggu

SEQ ID NO: 505343 - RNA, 32 nt, Human
ucucaacucacugcaaccucugcccuucaggu

SEQ ID NO: 505344 - RNA, 32 nt, Human
ucucaacucacugcaagcuccgccuccugggu

SEQ ID NO: 505345 - RNA, 32 nt, Human
ucucaacucauugcaaccuccaccugccgggu

SEQ ID NO: 505346 - RNA, 32 nt, Human
ucucaacucugucacccagacuggagugcagu

SEQ ID NO: 505347 - RNA, 32 nt, Human
ucucaacucuguccccaggaaguugugugacc

SEQ ID NO: 505348 - RNA, 32 nt, Human
ucucaacugcaaccgagcacucuacagacuua

SEQ ID NO: 505349 - RNA, 32 nt, Human
ucucaacugguagcuugcuugcucugcgucuu

SEQ ID NO: 505350 - RNA, 31 nt, Human
ucucaacuuacuucuuuaaucaacauuuaau

SEQ ID NO: 505351 - RNA, 32 nt, Human
ucucaacuugaauucucccagaauuccaaugu

SEQ ID NO: 505352 - RNA, 32 nt, Human
ucucaacuuuaagauagaggcggccauaagag

SEQ ID NO: 505353 - RNA, 17 nt, Human
ucucaacuuuucuuccu

SEQ ID NO: 505354 - RNA, 19 nt, Human
ucucaagaaacaaaugcua

SEQ ID NO: 505355 - RNA, 16 nt, Human
ucucaagaauuugcca

SEQ ID NO: 505356 - RNA, 32 nt, Human
ucucaagaccuccagccagaagucccuuccaa

SEQ ID NO: 505357 - RNA, 32 nt, Human
ucucaagacugaauggugaggccagguacagu

SEQ ID NO: 505358 - RNA, 32 nt, Human
ucucaagagcaucugugcugaagaacuuggaa

SEQ ID NO: 505359 - RNA, 32 nt, Human
ucucaagaggccaaaaguuaugaccaaacuuc

SEQ ID NO: 505360 - RNA, 32 nt, Human
ucucaagauauuauggggucccagggagaugc

SEQ ID NO: 505361 - RNA, 32 nt, Human
ucucaagccaaacuugaaaccauucugaacca

SEQ ID NO: 505362 - RNA, 32 nt, Human
ucucaagccuauaaucccagcacuuugggagg

SEQ ID NO: 505363 - RNA, 32 nt, Human
ucucaagccuguaauccuagcacuuugggagg

SEQ ID NO: 505364 - RNA, 32 nt, Human
ucucaagcgugccgauuaaaacuguuacaccc

SEQ ID NO: 505365 - RNA, 32 nt, Human
ucucaagcucacugcaaccucugugcagguuc

SEQ ID NO: 505366 - RNA, 32 nt, Human
ucucaagcuccaggagcaacuuaaggcucccg

SEQ ID NO: 505367 - RNA, 20 nt, Human
ucucaagcuccuuucuguca

SEQ ID NO: 505368 - RNA, 32 nt, Human
ucucaagcugccccaacuucuucaaguccacc

SEQ ID NO: 505369 - RNA, 32 nt, Human
ucucaagcuuugaagaccuaccuguucuucca

SEQ ID NO: 505370 - RNA, 22 nt, Human
ucucaaggaaaaggacucagug

SEQ ID NO: 505371 - RNA, 20 nt, Human
ucucaaggaaauggguguca

SEQ ID NO: 505372 - RNA, 32 nt, Human
ucucaaggaaugaguugugaccuguuuacugu

SEQ ID NO: 505373 - RNA, 16 nt, Human
ucucaaggacuacugc

SEQ ID NO: 505374 - RNA, 22 nt, Human
ucucaaggacucauguauacca

SEQ ID NO: 505375 - RNA, 19 nt, Human
ucucaaggagaugcugcca

SEQ ID NO: 505376 - RNA, 32 nt, Human
ucucaaggagguuucugagauagguagaaguc

SEQ ID NO: 505377 - RNA, 16 nt, Human
ucucaaggaucuucca

SEQ ID NO: 505378 - RNA, 32 nt, Human
ucucaaggcagacauaugaaguauuuacugcu

SEQ ID NO: 505379 - RNA, 32 nt, Human
ucucaaggccaucaauuauugggggagggagg

SEQ ID NO: 505380 - RNA, 32 nt, Human
ucucaaggccguaaucucaucagguugggaca

SEQ ID NO: 505381 - RNA, 32 nt, Human
ucucaagggagaagagcugccaggagaagcaa

SEQ ID NO: 505382 - RNA, 20 nt, Human
ucucaagggcuuccauguca

SEQ ID NO: 505383 - RNA, 32 nt, Human
ucucaagggugaggcuaggaguuggcuagugu

SEQ ID NO: 505384 - RNA, 32 nt, Human
ucucaaguaagcuuaaacuacaacuugucaca

SEQ ID NO: 505385 - RNA, 32 nt, Human
ucucaaguccugcugcccaggcccaggugaga

SEQ ID NO: 505386 - RNA, 32 nt, Human
ucucaagucugaagaccgcgcauccuaacuag

SEQ ID NO: 505387 - RNA, 32 nt, Human
ucucaagugacagcaaccagacagagacuacu

SEQ ID NO: 505388 - RNA, 32 nt, Human
ucucaaguguuaggaauaaucccugcggcaug

SEQ ID NO: 505389 - RNA, 32 nt, Human
ucucaaguugcauacauuccuaccucauuuuc

SEQ ID NO: 505390 - RNA, 32 nt, Human
ucucaauaaaccugcauuaguuggcauugcaa

SEQ ID NO: 505391 - RNA, 22 nt, Human
ucucaauaaccaggucaucagg

SEQ ID NO: 505392 - RNA, 32 nt, Human
ucucaauaaucuuaauuuugauauuugaauaa

SEQ ID NO: 505393 - RNA, 32 nt, Human
ucucaauacagccugcccuugcagucccuauu

SEQ ID NO: 505394 - RNA, 31 nt, Human
ucucaauacauaaauaccuuaguagagagua

SEQ ID NO: 505395 - RNA, 32 nt, Human
ucucaauaccagucuccucacucuccacacaa

SEQ ID NO: 505396 - RNA, 18 nt, Human
ucucaauacccacugcca

SEQ ID NO: 505397 - RNA, 32 nt, Human
ucucaauagcgagucccuggcgaccacagucu

SEQ ID NO: 505398 - RNA, 32 nt, Human
ucucaauagguggcaguuuuagggaagauuuc

SEQ ID NO: 505399 - RNA, 32 nt, Human
ucucaaucauugucagagauguuuucaaguug

SEQ ID NO: 505400 - RNA, 22 nt, Human
ucucaaucuccugaccucguga

SEQ ID NO: 505401 - RNA, 32 nt, Human
ucucaaugaggagcagcucuccccaugagcaa

SEQ ID NO: 505402 - RNA, 32 nt, Human
ucucaaugccucccccucccccauucucucca

SEQ ID NO: 505403 - RNA, 32 nt, Human
ucucaaugguaaaaguuggaaccacaauauua

SEQ ID NO: 505404 - RNA, 32 nt, Human
ucucaauuaaagaaauacauugugaacuauca

SEQ ID NO: 505405 - RNA, 32 nt, Human
ucucaauuccaaggcauuggaaaaagagagga

SEQ ID NO: 505406 - RNA, 32 nt, Human
ucucaauucuugacuucugugcaccugcaggc

SEQ ID NO: 505407 - RNA, 32 nt, Human
ucucaauugacugcaaccucugcuucccaggc

SEQ ID NO: 505408 - RNA, 32 nt, Human
ucucaauuucuuccucuguauaaaggggacaa

SEQ ID NO: 505409 - RNA, 21 nt, Human
ucucaauuugucccucccucu

SEQ ID NO: 505410 - RNA, 32 nt, Human
ucucacaaaguucagaaaacagcuggacuuac

SEQ ID NO: 505411 - RNA, 32 nt, Human
ucucacaaauacaagcauaaguagaagauuug

SEQ ID NO: 505412 - RNA, 32 nt, Human
ucucacaacagugucaagagccuggacgccag

SEQ ID NO: 505413 - RNA, 21 nt, Human
ucucacaagcuccaucccuuu

SEQ ID NO: 505414 - RNA, 31 nt, Human
ucucacacacguguaugcacagcagagagac

SEQ ID NO: 505415 - RNA, 32 nt, Human
ucucacacagaaguguuugagggccugcuggg

SEQ ID NO: 505416 - RNA, 32 nt, Human
ucucacacagcaguacccugaccugcugugca

SEQ ID NO: 505417 - RNA, 32 nt, Human
ucucacacagggcagggugcagaggaaaacau

SEQ ID NO: 505418 - RNA, 32 nt, Human
ucucacaccaacagcacacaccccuuuuuccc

SEQ ID NO: 505419 - RNA, 32 nt, Human
ucucacaccagcugcacucccguggcugccag

SEQ ID NO: 505420 - RNA, 32 nt, Human
ucucacacccaccaacgcucaaucccuccagu

SEQ ID NO: 505421 - RNA, 32 nt, Human
ucucacacccucagugcugaugccaugccaac

SEQ ID NO: 505422 - RNA, 32 nt, Human
ucucacaccuccuucccacccuucuccagauu

SEQ ID NO: 505423 - RNA, 32 nt, Human
ucucacaccuguaaucccagcacuuugagagg

SEQ ID NO: 505424 - RNA, 32 nt, Human
ucucacaccuguaaucccagcacuuugggagg

SEQ ID NO: 505425 - RNA, 32 nt, Human
ucucacaccuguaaucccagcacuuugggugg

SEQ ID NO: 505426 - RNA, 32 nt, Human
ucucacacucaggccagacuccccugggcaga

SEQ ID NO: 505427 - RNA, 32 nt, Human
ucucacacugcaagcucccuggcaugggcaaa

SEQ ID NO: 505428 - RNA, 32 nt, Human
ucucacagagguggcucacagagaaggauggc

SEQ ID NO: 505429 - RNA, 32 nt, Human
ucucacagcacagcuauccacagggagacugg

SEQ ID NO: 505430 - RNA, 32 nt, Human
ucucacagcacaugcuggccagccuggggccu

SEQ ID NO: 505431 - RNA, 32 nt, Human
ucucacagcagcuggggaucacagaaccugca

SEQ ID NO: 505432 - RNA, 32 nt, Human
ucucacagcauuuagugcuuccugccuggugu

SEQ ID NO: 505433 - RNA, 32 nt, Human
ucucacagcucugggcccugggccagauuacu

SEQ ID NO: 505434 - RNA, 21 nt, Human
ucucacagggcucuccagaca

SEQ ID NO: 505435 - RNA, 32 nt, Human
ucucacaguuuuuccccaggaagucuggagaa

SEQ ID NO: 505436 - RNA, 32 nt, Human
ucucacaucccaccccuccugcccuccaaccc

SEQ ID NO: 505437 - RNA, 32 nt, Human
ucucacaucugucuuugggcacccaugcuggc

SEQ ID NO: 505438 - RNA, 32 nt, Human
ucucacauuuacaaagugcuugaucucuucau

SEQ ID NO: 505439 - RNA, 32 nt, Human
ucucaccaaacaggugaagccugcaguccaag

SEQ ID NO: 505440 - RNA, 32 nt, Human
ucucaccaaacaguuugaguaucuuuauuaag

SEQ ID NO: 505441 - RNA, 32 nt, Human
ucucaccaacaagccaacugcucacagaugac

SEQ ID NO: 505442 - RNA, 32 nt, Human
ucucaccaacuugccccacugucccaacuccu

SEQ ID NO: 505443 - RNA, 32 nt, Human
ucucaccaacuuucuuauguguguucuuuuua

SEQ ID NO: 505444 - RNA, 32 nt, Human
ucucaccaagaucuaugggcucaccuuuggcc

SEQ ID NO: 505445 - RNA, 26 nt, Human
ucucaccaauagacaccuucccgaca

SEQ ID NO: 505446 - RNA, 32 nt, Human
ucucaccacaaaaugauaagugugugagguga

SEQ ID NO: 505447 - RNA, 32 nt, Human
ucucaccacaccacagcacaccucaccacaca

SEQ ID NO: 505448 - RNA, 32 nt, Human
ucucaccacuacacuccagccugggugacagc

SEQ ID NO: 505449 - RNA, 32 nt, Human
ucucaccacuccgauucaacauaguacuggaa

SEQ ID NO: 505450 - RNA, 32 nt, Human
ucucaccacugaacuccagccugggcgacaga

SEQ ID NO: 505451 - RNA, 32 nt, Human
ucucaccacugcacuccagccugggcagcaga

SEQ ID NO: 505452 - RNA, 32 nt, Human
ucucaccacuguacuccagccugggugacaga

SEQ ID NO: 505453 - RNA, 32 nt, Human
ucucaccagccuggcccugcagaaggucgugc

SEQ ID NO: 505454 - RNA, 32 nt, Human
ucucaccaggcagacagucugccuaggaccca

SEQ ID NO: 505455 - RNA, 32 nt, Human
ucucaccaggugggacgguuuguccugcucga

SEQ ID NO: 505456 - RNA, 32 nt, Human
ucucaccaugcacuccagccuagacaacaggg

SEQ ID NO: 505457 - RNA, 32 nt, Human
ucucaccauguuagccaggauggucuugaucu

SEQ ID NO: 505458 - RNA, 32 nt, Human
ucucaccauuacacuccagccugggcgacaag

SEQ ID NO: 505459 - RNA, 27 nt, Human
ucucaccauuaugacauccaucccccu

SEQ ID NO: 505460 - RNA, 32 nt, Human
ucucaccauugcacuccagccugggcgacuga

SEQ ID NO: 505461 - RNA, 32 nt, Human
ucucacccacagaugucuguagucggucggug

SEQ ID NO: 505462 - RNA, 32 nt, Human
ucucacccagcaccuggggagaucggugcuac

SEQ ID NO: 505463 - RNA, 32 nt, Human
ucucacccaguuccucucuccuucccugaccc

SEQ ID NO: 505464 - RNA, 20 nt, Human
ucucacccaucccaccccuc

SEQ ID NO: 505465 - RNA, 21 nt, Human
ucucacccaucccuacugcca

SEQ ID NO: 505466 - RNA, 24 nt, Human
ucucaccccacagauaacccaaga

SEQ ID NO: 505467 - RNA, 32 nt, Human
ucucaccccacauucauaucccuaaauuugac

SEQ ID NO: 505468 - RNA, 32 nt, Human
ucucaccccagaggcaacuggauggugccuuu

SEQ ID NO: 505469 - RNA, 19 nt, Human
ucucaccccaggcucugca

SEQ ID NO: 505470 - RNA, 32 nt, Human
ucucacccccacccucuccccugccaggcugg

SEQ ID NO: 505471 - RNA, 20 nt, Human
ucucacccccauuaucccuc

SEQ ID NO: 505472 - RNA, 21 nt, Human
ucucaccccccaaugccucga

SEQ ID NO: 505473 - RNA, 21 nt, Human
ucucaccccccugucacccuc

SEQ ID NO: 505474 - RNA, 32 nt, Human
ucucaccccugcacuccagccugggcaacaga

SEQ ID NO: 505475 - RNA, 32 nt, Human
ucucaccccugcccugguuccugucugccguu

SEQ ID NO: 505476 - RNA, 32 nt, Human
ucucacccgaacaccagugaucaggacuggag

SEQ ID NO: 505477 - RNA, 21 nt, Human
ucucacccggaucccuccuca

SEQ ID NO: 505478 - RNA, 21 nt, Human
ucucacccgguucccacccuc

SEQ ID NO: 505479 - RNA, 32 nt, Human
ucucacccucaaggggcucacauggaggacaa

SEQ ID NO: 505480 - RNA, 22 nt, Human
ucucacccucccuucucucccu

SEQ ID NO: 505481 - RNA, 21 nt, Human
ucucacccuccucccuccccu

SEQ ID NO: 505482 - RNA, 20 nt, Human
ucucacccucuguccuuccc

SEQ ID NO: 505483 - RNA, 21 nt, Human
ucucacccugcacaucccgcu

SEQ ID NO: 505484 - RNA, 32 nt, Human
ucucacccugucuuaccagcauccacucuccc

SEQ ID NO: 505485 - RNA, 20 nt, Human
ucucacccuugcccucuguc

SEQ ID NO: 505486 - RNA, 32 nt, Human
ucucaccgcaaccuccgucuccuggguucaag

SEQ ID NO: 505487 - RNA, 32 nt, Human
ucucaccguucccgcuccugucuccuggaacc

SEQ ID NO: 505488 - RNA, 32 nt, Human
ucucaccucacaggcacaucaggcugcagaau

SEQ ID NO: 505489 - RNA, 32 nt, Human
ucucaccucacugcaaccuccaccuccuaggu

SEQ ID NO: 505490 - RNA, 32 nt, Human
ucucaccucacugcaaccuccgccuccugggu

SEQ ID NO: 505491 - RNA, 32 nt, Human
ucucaccucacugcaaccucugccucccgggu

SEQ ID NO: 505492 - RNA, 32 nt, Human
ucucaccucacugcaagcucugccucccgggc

SEQ ID NO: 505493 - RNA, 32 nt, Human
ucucaccucacugcggccuccccaguccaaag

SEQ ID NO: 505494 - RNA, 22 nt, Human
ucucaccucagccugcugagua

SEQ ID NO: 505495 - RNA, 32 nt, Human
ucucaccucauugcaaccuccgccucccgggu

SEQ ID NO: 505496 - RNA, 20 nt, Human
ucucaccuccaccaccccuc

SEQ ID NO: 505497 - RNA, 32 nt, Human
ucucaccuccaccccauccauauccucuuuau

SEQ ID NO: 505498 - RNA, 32 nt, Human
ucucaccuccgacccauaccuucuccccacag

SEQ ID NO: 505499 - RNA, 32 nt, Human
ucucaccuccgaggccuccucugccuggaaga

SEQ ID NO: 505500 - RNA, 32 nt, Human
ucucaccucuaggauaugauggaagaagugcu

SEQ ID NO: 505501 - RNA, 32 nt, Human
ucucaccucuaggccucaguguccucaucuau

SEQ ID NO: 505502 - RNA, 32 nt, Human
ucucaccucucugaccucagcuuccucaacug

SEQ ID NO: 505503 - RNA, 32 nt, Human
ucucaccugcacucccagcuacucgggaggcu

SEQ ID NO: 505504 - RNA, 32 nt, Human
ucucaccugccuggggccucaccugcuggagu

SEQ ID NO: 505505 - RNA, 23 nt, Human
ucucaccugcuuccuuccagaca

SEQ ID NO: 505506 - RNA, 32 nt, Human
ucucaccuggaggcaagagggaggggacagag

SEQ ID NO: 505507 - RNA, 32 nt, Human
ucucaccuggucuugcggcuguggccaccgcc

SEQ ID NO: 505508 - RNA, 32 nt, Human
ucucaccuguacucuuccgaaaaauccucuuc

SEQ ID NO: 505509 - RNA, 32 nt, Human
ucucaccugucgcuggagugcaguggugugau

SEQ ID NO: 505510 - RNA, 32 nt, Human
ucucaccuuacugcaaccaccacuuccugggu

SEQ ID NO: 505511 - RNA, 32 nt, Human
ucucaccuugcaccuucuucaggauuuuauau

SEQ ID NO: 505512 - RNA, 19 nt, Human
ucucaccuuguucauuuca

SEQ ID NO: 505513 - RNA, 32 nt, Human
ucucaccuuguucauuucacauagugguuuau

SEQ ID NO: 505514 - RNA, 32 nt, Human
ucucaccuuguucucugccuccagaggaucau

SEQ ID NO: 505515 - RNA, 21 nt, Human
ucucaccuuucccaccucucu

SEQ ID NO: 505516 - RNA, 32 nt, Human
ucucacgacucuaccauguccaguggaguuca

SEQ ID NO: 505517 - RNA, 32 nt, Human
ucucacgccuguaaucccagcacuuugggagg

SEQ ID NO: 505518 - RNA, 32 nt, Human
ucucacgccuguagucccagcacuuugggagc

SEQ ID NO: 505519 - RNA, 32 nt, Human
ucucacgccugugaucccagcacuuugggagg

SEQ ID NO: 505520 - RNA, 32 nt, Human
ucucacggaaccacuggcaucagauggugaag

SEQ ID NO: 505521 - RNA, 32 nt, Human
ucucacggcaggcaaaucagugagaaaaaugu

SEQ ID NO: 505522 - RNA, 22 nt, Human
ucucacggccaugcuucagggu

SEQ ID NO: 505523 - RNA, 32 nt, Human
ucucacgggacagacuuuacugagauguacca

SEQ ID NO: 505524 - RNA, 32 nt, Human
ucucacuaauugagucugcuuccacguccucu

SEQ ID NO: 505525 - RNA, 32 nt, Human
ucucacuacuaaaaauacaaaauuagccacgc

SEQ ID NO: 505526 - RNA, 32 nt, Human
ucucacuacugcacuugacuagucuuaaaaca

SEQ ID NO: 505527 - RNA, 32 nt, Human
ucucacuauguugcccaggcaggucuugaacu

SEQ ID NO: 505528 - RNA, 32 nt, Human
ucucacuauguugcccaggccggucuuaaacu

SEQ ID NO: 505529 - RNA, 32 nt, Human
ucucacuauguugcccaggcugaucuugaacu

SEQ ID NO: 505530 - RNA, 24 nt, Human
ucucacuauguugcccaggcugcu

SEQ ID NO: 505531 - RNA, 32 nt, Human
ucucacuauguugucuggagugcuguggugga

SEQ ID NO: 505532 - RNA, 32 nt, Human
ucucacuauuaaauuuauuuaaauuagcaagc

SEQ ID NO: 505533 - RNA, 32 nt, Human
ucucacucaccuucugauuuugcaauguaaga

SEQ ID NO: 505534 - RNA, 32 nt, Human
ucucacucacugcaauugcuucuacucugggc

SEQ ID NO: 505535 - RNA, 32 nt, Human
ucucacucagccugaauuugcauuaaguguuc

SEQ ID NO: 505536 - RNA, 32 nt, Human
ucucacucauaagugagagcuaagcuaugagg

SEQ ID NO: 505537 - RNA, 32 nt, Human
ucucacucaugcauacaaagcagcuaaaaaug

SEQ ID NO: 505538 - RNA, 32 nt, Human
ucucacucauuucccuucccugaauccaaacu

SEQ ID NO: 505539 - RNA, 32 nt, Human
ucucacuccaagcccaguuacagcagaaaguu

SEQ ID NO: 505540 - RNA, 32 nt, Human
ucucacuccaccaucacuucuuugccaaaugc

SEQ ID NO: 505541 - RNA, 32 nt, Human
ucucacuccagccugggcaacagaaugagacc

SEQ ID NO: 505542 - RNA, 32 nt, Human
ucucacucccaaaugacuccuccccuucguug

SEQ ID NO: 505543 - RNA, 21 nt, Human
ucucacuccccacaccccucu

SEQ ID NO: 505544 - RNA, 32 nt, Human
ucucacuccuagaaaacaggaaaaagaagguc

SEQ ID NO: 505545 - RNA, 32 nt, Human
ucucacuccuguaauaccagcacuuugggagg

SEQ ID NO: 505546 - RNA, 32 nt, Human
ucucacuccugugaacuuucaggcuggacuua

SEQ ID NO: 505547 - RNA, 20 nt, Human
ucucacuccuuuuccugucc

SEQ ID NO: 505548 - RNA, 19 nt, Human
ucucacucggugccgcugc

SEQ ID NO: 505549 - RNA, 21 nt, Human
ucucacucuccccaguccuca

SEQ ID NO: 505550 - RNA, 32 nt, Human
ucucacucuccuccgcucaaacucagcucacu

SEQ ID NO: 505551 - RNA, 32 nt, Human
ucucacucucucucccccaaccccuccuuuuc

SEQ ID NO: 505552 - RNA, 32 nt, Human
ucucacucucucugucccuugugccucuguag

SEQ ID NO: 505553 - RNA, 32 nt, Human
ucucacucugcagggauccuccugccucuccu

SEQ ID NO: 505554 - RNA, 32 nt, Human
ucucacucuggcgcucuggagugcaguggugu

SEQ ID NO: 505555 - RNA, 32 nt, Human
ucucacucugggacauagaccaauugugcuuc

SEQ ID NO: 505556 - RNA, 32 nt, Human
ucucacucugucauuguuaaucuaagaauaaa

SEQ ID NO: 505557 - RNA, 32 nt, Human
ucucacucugugugcuccucuggaaggccaag

SEQ ID NO: 505558 - RNA, 19 nt, Human
ucucacugacagcaugcca

SEQ ID NO: 505559 - RNA, 32 nt, Human
ucucacugagucugauaguguguuggaagguu

SEQ ID NO: 505560 - RNA, 32 nt, Human
ucucacugcaaccuccaccucccagguucaag

SEQ ID NO: 505561 - RNA, 32 nt, Human
ucucacugcaaccucugccuccuggguucagg

SEQ ID NO: 505562 - RNA, 32 nt, Human
ucucacugcaagcuccacuuccuggguucaug

SEQ ID NO: 505563 - RNA, 32 nt, Human
ucucacugcaccuggauggcaacgugcuggac

SEQ ID NO: 505564 - RNA, 32 nt, Human
ucucacugcacucaggcuggagugcaguggua

SEQ ID NO: 505565 - RNA, 32 nt, Human
ucucacugcagccucaaccuccuggguucaag

SEQ ID NO: 505566 - RNA, 24 nt, Human
ucucacugccaaacugccuguccu

SEQ ID NO: 505567 - RNA, 23 nt, Human
ucucacugccacgccuuccuuuc

SEQ ID NO: 505568 - RNA, 31 nt, Human
ucucacugccucucggugaccuccguccucu

SEQ ID NO: 505569 - RNA, 32 nt, Human
ucucacugcucugcacaugugcacugacguga

SEQ ID NO: 505570 - RNA, 32 nt, Human
ucucacugggcccucugguggccaggugcaug

SEQ ID NO: 505571 - RNA, 32 nt, Human
ucucacugucaccaggcuggagugcaguggug

SEQ ID NO: 505572 - RNA, 32 nt, Human
ucucacuguccaccccuucgcuguccagaauu

SEQ ID NO: 505573 - RNA, 20 nt, Human
ucucacugucccucucuguc

SEQ ID NO: 505574 - RNA, 32 nt, Human
ucucacuguggaagaguucugcuaacagaagc

SEQ ID NO: 505575 - RNA, 32 nt, Human
ucucacuguggcuuguggcuccgggaaaugga

SEQ ID NO: 505576 - RNA, 32 nt, Human
ucucacuguguugcccagccugggugucaaua

SEQ ID NO: 505577 - RNA, 32 nt, Human
ucucacuguugccaggcuggagugcaguggca

SEQ ID NO: 505578 - RNA, 32 nt, Human
ucucacuguugccuggcuggagcacuuugguu

SEQ ID NO: 505579 - RNA, 32 nt, Human
ucucacuguugccuugaacuccugggcucaag

SEQ ID NO: 505580 - RNA, 32 nt, Human
ucucacuguuguucaaacuggucucaaacucc

SEQ ID NO: 505581 - RNA, 32 nt, Human
ucucacuuacuugcuuuuucucucugcaggag

SEQ ID NO: 505582 - RNA, 32 nt, Human
ucucacuuauaaggagaguuauaggcuauuca

SEQ ID NO: 505583 - RNA, 32 nt, Human
ucucacuucccuucccuucacagacaggcuuu

SEQ ID NO: 505584 - RNA, 21 nt, Human
ucucacuucugccuccuauca

SEQ ID NO: 505585 - RNA, 32 nt, Human
ucucacuugcugagaggauuuggggaauuauc

SEQ ID NO: 505586 - RNA, 32 nt, Human
ucucacuugcuuauacuauucucuccauugau

SEQ ID NO: 505587 - RNA, 32 nt, Human
ucucacuuucccacccuauccuuccuccccac

SEQ ID NO: 505588 - RNA, 23 nt, Human
ucucacuuuccuguggguugcug

SEQ ID NO: 505589 - RNA, 32 nt, Human
ucucacuuuguugcccaggcuggucuugaacu

SEQ ID NO: 505590 - RNA, 32 nt, Human
ucucacuuuuaaaacuaauacagacuuaucuc

SEQ ID NO: 505591 - RNA, 32 nt, Human
ucucagaaacugaugagguacaauucugaacc

SEQ ID NO: 505592 - RNA, 21 nt, Human
ucucagaaacuucucucauua

SEQ ID NO: 505593 - RNA, 32 nt, Human
ucucagaaagccuuucugacugaucucagcau

SEQ ID NO: 505594 - RNA, 32 nt, Human
ucucagaacaaagacagcaaccaaugagccag

SEQ ID NO: 505595 - RNA, 32 nt, Human
ucucagaacacaaaggaggcuugaggacugag

SEQ ID NO: 505596 - RNA, 32 nt, Human
ucucagaacuuaaacucuuaccaaaaucugua

SEQ ID NO: 505597 - RNA, 32 nt, Human
ucucagaaggagccaauggacacugguguaga

SEQ ID NO: 505598 - RNA, 21 nt, Human
ucucagaauauguccaucaca

SEQ ID NO: 505599 - RNA, 32 nt, Human
ucucagaaugaauauuuaauacauuuguuaca

SEQ ID NO: 505600 - RNA, 32 nt, Human
ucucagaauuuuacucuguuacugcaaaaucu

SEQ ID NO: 505601 - RNA, 21 nt, Human
ucucagacaagcguggcacag

SEQ ID NO: 505602 - RNA, 22 nt, Human
ucucagacagcaagaaaggcug

SEQ ID NO: 505603 - RNA, 32 nt, Human
ucucagacaggcugggacucagaguuauuucc

SEQ ID NO: 505604 - RNA, 32 nt, Human
ucucagacaguccugugggucuuuggauucgu

SEQ ID NO: 505605 - RNA, 32 nt, Human
ucucagaccaauguaggcucucacugcagggg

SEQ ID NO: 505606 - RNA, 32 nt, Human
ucucagaccacuggaaugcaaguccuucuucc

SEQ ID NO: 505607 - RNA, 32 nt, Human
ucucagaccugccaccccacagccagagguuu

SEQ ID NO: 505608 - RNA, 32 nt, Human
ucucagaccuucccaucucccuggcuuuccau

SEQ ID NO: 505609 - RNA, 32 nt, Human
ucucagacuccaccaccucuuaauggcucagu

SEQ ID NO: 505610 - RNA, 32 nt, Human
ucucagacuccccugaggguggaggagcugug

SEQ ID NO: 505611 - RNA, 20 nt, Human
ucucagagaagagccaugaa

SEQ ID NO: 505612 - RNA, 32 nt, Human
ucucagagaaggaggugaguucuuccugccug

SEQ ID NO: 505613 - RNA, 32 nt, Human
ucucagagaucauuuucugguaaagaaaaagg

SEQ ID NO: 505614 - RNA, 32 nt, Human
ucucagagaugugaagccagauccucauggca

SEQ ID NO: 505615 - RNA, 32 nt, Human
ucucagagcaggagccucucucccuugcccag

SEQ ID NO: 505616 - RNA, 32 nt, Human
ucucagagcuaggcacaugggcacaggucccc

SEQ ID NO: 505617 - RNA, 23 nt, Human
ucucagaggagcauugcccguca

SEQ ID NO: 505618 - RNA, 21 nt, Human
ucucagaggagcugaggaaca

SEQ ID NO: 505619 - RNA, 32 nt, Human
ucucagaggaggaggagcuggagacaggaggg

SEQ ID NO: 505620 - RNA, 22 nt, Human
ucucagaggauuauaauuguca

SEQ ID NO: 505621 - RNA, 32 nt, Human
ucucagaggcuggagagcagagcaccaagauc

SEQ ID NO: 505622 - RNA, 23 nt, Human
ucucagaguaguaguguuuguca

SEQ ID NO: 505623 - RNA, 32 nt, Human
ucucagaguggaaugacuccuuuuccuuccug

SEQ ID NO: 505624 - RNA, 32 nt, Human
ucucagaguuuccaagcagggaaacauuacug

SEQ ID NO: 505625 - RNA, 32 nt, Human
ucucagauacccuuuagauuuucccccauuga

SEQ ID NO: 505626 - RNA, 32 nt, Human
ucucagaucacugcaaccuccaccucccaggu

SEQ ID NO: 505627 - RNA, 32 nt, Human
ucucagaucacugcaaccuccgccuccugggu

SEQ ID NO: 505628 - RNA, 32 nt, Human
ucucagaucacugcaaccucugccucccgggu

SEQ ID NO: 505629 - RNA, 32 nt, Human
ucucagaucacugcaaccucugccuccugggu

SEQ ID NO: 505630 - RNA, 32 nt, Human
ucucagaucugccaggucucagaagagugcgg

SEQ ID NO: 505631 - RNA, 32 nt, Human
ucucagaugcugcugcuugacaauccacacaa

SEQ ID NO: 505632 - RNA, 32 nt, Human
ucucagaugggacauugugggaaaggcuuugg

SEQ ID NO: 505633 - RNA, 32 nt, Human
ucucagauguggccauguuacaguagagggua

SEQ ID NO: 505634 - RNA, 32 nt, Human
ucucagcaaaacaauaaaaauuaacugagugu

SEQ ID NO: 505635 - RNA, 32 nt, Human
ucucagcaccacccucucccucugugccaugg

SEQ ID NO: 505636 - RNA, 32 nt, Human
ucucagcaccaccuaacgcaccaccuugcccu

SEQ ID NO: 505637 - RNA, 32 nt, Human
ucucagcacuucaggaguacggagcaggugga

SEQ ID NO: 505638 - RNA, 32 nt, Human
ucucagcagauauuucuuugguacuaccaugu

SEQ ID NO: 505639 - RNA, 32 nt, Human
ucucagcagaugggggagcugguaggcagaug

SEQ ID NO: 505640 - RNA, 32 nt, Human
ucucagcagccagcuccugguagcugaugagg

SEQ ID NO: 505641 - RNA, 32 nt, Human
ucucagcagccccugagucaccugcacaaggu

SEQ ID NO: 505642 - RNA, 25 nt, Human
ucucagcagccgcccacacgcuccu

SEQ ID NO: 505643 - RNA, 32 nt, Human
ucucagcaggccaaggccagacaugugaggaa

SEQ ID NO: 505644 - RNA, 32 nt, Human
ucucagcaggguggggaaugccagccagggag

SEQ ID NO: 505645 - RNA, 32 nt, Human
ucucagcagucaggcuucugguugugaaauca

SEQ ID NO: 505646 - RNA, 32 nt, Human
ucucagcaucagaaugagaaagccugagaaga

SEQ ID NO: 505647 - RNA, 32 nt, Human
ucucagcaugauacuauuauuugcuuccuaau

SEQ ID NO: 505648 - RNA, 32 nt, Human
ucucagcauuguacauggcaauaagcuuguuc

SEQ ID NO: 505649 - RNA, 32 nt, Human
ucucagcauuuauuuuccugucucuuccacca

SEQ ID NO: 505650 - RNA, 32 nt, Human
ucucagccacugcucccuggagagaaaugaaa

SEQ ID NO: 505651 - RNA, 32 nt, Human
ucucagccagcccugcucucucccucuucccu

SEQ ID NO: 505652 - RNA, 31 nt, Human
ucucagccauuucagcagccccgucaaccgc

SEQ ID NO: 505653 - RNA, 32 nt, Human
ucucagccccaccucagcaggucuccaggaug

SEQ ID NO: 505654 - RNA, 32 nt, Human
ucucagccccagaacacagcuguguccuagag

SEQ ID NO: 505655 - RNA, 32 nt, Human
ucucagccccugccuuccccagucucuggguc

SEQ ID NO: 505656 - RNA, 32 nt, Human
ucucagcccugagacacaggccucaguuagga

SEQ ID NO: 505657 - RNA, 32 nt, Human
ucucagcccugccuugccccuaccucagcguc

SEQ ID NO: 505658 - RNA, 32 nt, Human
ucucagcccugccuuucucuggagcauucuga

SEQ ID NO: 505659 - RNA, 32 nt, Human
ucucagcccuggcccucugccugcuccucacu

SEQ ID NO: 505660 - RNA, 32 nt, Human
ucucagccguggcagccgaggcugcagcccgg

SEQ ID NO: 505661 - RNA, 32 nt, Human
ucucagccucaagccauuuuccugccuuugcc

SEQ ID NO: 505662 - RNA, 32 nt, Human
ucucagccucacaccccuuccucccagucugg

SEQ ID NO: 505663 - RNA, 32 nt, Human
ucucagccuccgccuggucucuggguuggcug

SEQ ID NO: 505664 - RNA, 32 nt, Human
ucucagccucuccccucuccuuucucucccug

SEQ ID NO: 505665 - RNA, 32 nt, Human
ucucagccucuccuggugucuugggcacccuu

SEQ ID NO: 505666 - RNA, 32 nt, Human
ucucagccucuggccaacacagucccacccau

SEQ ID NO: 505667 - RNA, 32 nt, Human
ucucagccucuucucugccuccagagaggugg

SEQ ID NO: 505668 - RNA, 32 nt, Human
ucucagccuuucucccucccccgucucauucc

SEQ ID NO: 505669 - RNA, 32 nt, Human
ucucagccuuucugugucuccuuuccuccgcc

SEQ ID NO: 505670 - RNA, 32 nt, Human
ucucagccuuugccaucuccucaucccugagc

SEQ ID NO: 505671 - RNA, 32 nt, Human
ucucagcgcucccaugaucgcccggugccuuu

SEQ ID NO: 505672 - RNA, 32 nt, Human
ucucagcgucagagccccuagcucuucucuag

SEQ ID NO: 505673 - RNA, 32 nt, Human
ucucagcguguaggcaagaaauucgaaagaga

SEQ ID NO: 505674 - RNA, 32 nt, Human
ucucagcuagccucauuaucccuucucaguau

SEQ ID NO: 505675 - RNA, 32 nt, Human
ucucagcuauaauucuguuauaugaggggcag

SEQ ID NO: 505676 - RNA, 32 nt, Human
ucucagcucacagcaaccuccgccucccaggu

SEQ ID NO: 505677 - RNA, 32 nt, Human
ucucagcucacagcaaccuccgccucccgggu

SEQ ID NO: 505678 - RNA, 32 nt, Human
ucucagcucacagcaaccucugccuccugggu

SEQ ID NO: 505679 - RNA, 32 nt, Human
ucucagcucaccaaaucucugccucccaggcu

SEQ ID NO: 505680 - RNA, 32 nt, Human
ucucagcucaccacaaccuccaccuccugggu

SEQ ID NO: 505681 - RNA, 32 nt, Human
ucucagcucaccacaaccuccgccucccaggu

SEQ ID NO: 505682 - RNA, 32 nt, Human
ucucagcucaccgaaaccuccaccuacuaggc

SEQ ID NO: 505683 - RNA, 32 nt, Human
ucucagcucaccgcaaccuccaccuccagggu

SEQ ID NO: 505684 - RNA, 32 nt, Human
ucucagcucaccgcaaccuccaccuccugggu

SEQ ID NO: 505685 - RNA, 32 nt, Human
ucucagcucaccgcaaccuccacucgcagguu

SEQ ID NO: 505686 - RNA, 32 nt, Human
ucucagcucaccgcaaccuccgccucccgggu

SEQ ID NO: 505687 - RNA, 32 nt, Human
ucucagcucaccgcaaccucugccucccagau

SEQ ID NO: 505688 - RNA, 32 nt, Human
ucucagcucaccgcauccuccaccucccaggu

SEQ ID NO: 505689 - RNA, 32 nt, Human
ucucagcucaccucaaccuccgccucccgggu

SEQ ID NO: 505690 - RNA, 32 nt, Human
ucucagcucacggcaaccuccgccucccgggu

SEQ ID NO: 505691 - RNA, 32 nt, Human
ucucagcucacuacaaccuccgccucccaugu

SEQ ID NO: 505692 - RNA, 32 nt, Human
ucucagcucacuacaaccucugccuucugguu

SEQ ID NO: 505693 - RNA, 32 nt, Human
ucucagcucacugaagccucgaccuccagaac

SEQ ID NO: 505694 - RNA, 32 nt, Human
ucucagcucacugcaaacuccaccucccaggu

SEQ ID NO: 505695 - RNA, 32 nt, Human
ucucagcucacugcaaacucugccucccgaau

SEQ ID NO: 505696 - RNA, 32 nt, Human
ucucagcucacugcaacaccgccucccggguu

SEQ ID NO: 505697 - RNA, 32 nt, Human
ucucagcucacugcaacauccaccuccugggu

SEQ ID NO: 505698 - RNA, 32 nt, Human
ucucagcucacugcaacauccgccucuggggu

SEQ ID NO: 505699 - RNA, 32 nt, Human
ucucagcucacugcaaccacugccucccaggc

SEQ ID NO: 505700 - RNA, 32 nt, Human
ucucagcucacugcaacccccgccuccugggu

SEQ ID NO: 505701 - RNA, 32 nt, Human
ucucagcucacugcaaccuacgccuucugggu

SEQ ID NO: 505702 - RNA, 21 nt, Human
ucucagcucacugcaaccucc

SEQ ID NO: 505703 - RNA, 32 nt, Human
ucucagcucacugcaaccuccaccucccagac

SEQ ID NO: 505704 - RNA, 32 nt, Human
ucucagcucacugcaaccuccaccucccagga

SEQ ID NO: 505705 - RNA, 32 nt, Human
ucucagcucacugcaaccuccaccucccaggc

SEQ ID NO: 505706 - RNA, 32 nt, Human
ucucagcucacugcaaccuccaccucccaggu

SEQ ID NO: 505707 - RNA, 32 nt, Human
ucucagcucacugcaaccuccaccucccgggu

SEQ ID NO: 505708 - RNA, 32 nt, Human
ucucagcucacugcaaccuccaccucccuggu

SEQ ID NO: 505709 - RNA, 32 nt, Human
ucucagcucacugcaaccuccaccuccggguu

SEQ ID NO: 505710 - RNA, 32 nt, Human
ucucagcucacugcaaccuccaccuccugggu

SEQ ID NO: 505711 - RNA, 32 nt, Human
ucucagcucacugcaaccuccaccucgcaggu

SEQ ID NO: 505712 - RNA, 32 nt, Human
ucucagcucacugcaaccuccaccucucaggu

SEQ ID NO: 505713 - RNA, 32 nt, Human
ucucagcucacugcaaccuccaccucuuaugu

SEQ ID NO: 505714 - RNA, 32 nt, Human
ucucagcucacugcaaccuccaccuugcgugu

SEQ ID NO: 505715 - RNA, 32 nt, Human
ucucagcucacugcaaccuccaucuccagguu

SEQ ID NO: 505716 - RNA, 32 nt, Human
ucucagcucacugcaaccuccaucucccggau

SEQ ID NO: 505717 - RNA, 32 nt, Human
ucucagcucacugcaaccuccaucuccuggau

SEQ ID NO: 505718 - RNA, 32 nt, Human
ucucagcucacugcaaccucccccuccugggu

SEQ ID NO: 505719 - RNA, 23 nt, Human
ucucagcucacugcaaccuccgc

SEQ ID NO: 505720 - RNA, 32 nt, Human
ucucagcucacugcaaccuccgcaucccgggu

SEQ ID NO: 505721 - RNA, 32 nt, Human
ucucagcucacugcaaccuccgcccccugggu

SEQ ID NO: 505722 - RNA, 32 nt, Human
ucucagcucacugcaaccuccgccucccaagu

SEQ ID NO: 505723 - RNA, 32 nt, Human
ucucagcucacugcaaccuccgccucccaggu

SEQ ID NO: 505724 - RNA, 32 nt, Human
ucucagcucacugcaaccuccgccucccgggu

SEQ ID NO: 505725 - RNA, 32 nt, Human
ucucagcucacugcaaccuccgccuccugagg

SEQ ID NO: 505726 - RNA, 32 nt, Human
ucucagcucacugcaaccuccgccuccuggga

SEQ ID NO: 505727 - RNA, 32 nt, Human
ucucagcucacugcaaccuccgccuccugggu

SEQ ID NO: 505728 - RNA, 32 nt, Human
ucucagcucacugcaaccuccgccucuugggu

SEQ ID NO: 505729 - RNA, 32 nt, Human
ucucagcucacugcaaccuccgccugcugggu

SEQ ID NO: 505730 - RNA, 32 nt, Human
ucucagcucacugcaaccuccgccuucugggu

SEQ ID NO: 505731 - RNA, 32 nt, Human
ucucagcucacugcaaccuccgguucccgggc

SEQ ID NO: 505732 - RNA, 32 nt, Human
ucucagcucacugcaaccuccgucuccagggu

SEQ ID NO: 505733 - RNA, 32 nt, Human
ucucagcucacugcaaccuccguuuccugggu

SEQ ID NO: 505734 - RNA, 32 nt, Human
ucucagcucacugcaaccuccuccucccgggu

SEQ ID NO: 505735 - RNA, 32 nt, Human
ucucagcucacugcaaccuccuccuucugggu

SEQ ID NO: 505736 - RNA, 32 nt, Human
ucucagcucacugcaaccucgaccucuugggu

SEQ ID NO: 505737 - RNA, 32 nt, Human
ucucagcucacugcaaccucuaccuccugggu

SEQ ID NO: 505738 - RNA, 32 nt, Human
ucucagcucacugcaaccucucucucccgggu

SEQ ID NO: 505739 - RNA, 32 nt, Human
ucucagcucacugcaaccucugccuccagagu

SEQ ID NO: 505740 - RNA, 32 nt, Human
ucucagcucacugcaaccucugccucccaggu

SEQ ID NO: 505741 - RNA, 32 nt, Human
ucucagcucacugcaaccucugccucccaguu

SEQ ID NO: 505742 - RNA, 32 nt, Human
ucucagcucacugcaaccucugccucccggau

SEQ ID NO: 505743 - RNA, 32 nt, Human
ucucagcucacugcaaccucugccucccgggu

SEQ ID NO: 505744 - RNA, 32 nt, Human
ucucagcucacugcaaccucugccucccuggu

SEQ ID NO: 505745 - RNA, 32 nt, Human
ucucagcucacugcaaccucugccuccugagu

SEQ ID NO: 505746 - RNA, 32 nt, Human
ucucagcucacugcaaccucugccuccuggau

SEQ ID NO: 505747 - RNA, 32 nt, Human
ucucagcucacugcaaccucugccuccugggc

SEQ ID NO: 505748 - RNA, 32 nt, Human
ucucagcucacugcaaccucugccuccugggu

SEQ ID NO: 505749 - RNA, 32 nt, Human
ucucagcucacugcaaccucugccuccugguu

SEQ ID NO: 505750 - RNA, 32 nt, Human
ucucagcucacugcaaccucugccuucuggau

SEQ ID NO: 505751 - RNA, 32 nt, Human
ucucagcucacugcaaccucugcuucccgggu

SEQ ID NO: 505752 - RNA, 32 nt, Human
ucucagcucacugcaaccucugucucccgggu

SEQ ID NO: 505753 - RNA, 32 nt, Human
ucucagcucacugcaaccucugucuccugggu

SEQ ID NO: 505754 - RNA, 32 nt, Human
ucucagcucacugcaaccugugccucccggcu

SEQ ID NO: 505755 - RNA, 32 nt, Human
ucucagcucacugcaaccuucaccucccaggu

SEQ ID NO: 505756 - RNA, 32 nt, Human
ucucagcucacugcaaccuuggccucccgugu

SEQ ID NO: 505757 - RNA, 32 nt, Human
ucucagcucacugcaaccuuugucucccgggc

SEQ ID NO: 505758 - RNA, 32 nt, Human
ucucagcucacugcaacguccaccuccugggu

SEQ ID NO: 505759 - RNA, 32 nt, Human
ucucagcucacugcaacguccaccucuugagu

SEQ ID NO: 505760 - RNA, 32 nt, Human
ucucagcucacugcaacgucugccucccgggu

SEQ ID NO: 505761 - RNA, 32 nt, Human
ucucagcucacugcaacuuccaccucccaggu

SEQ ID NO: 505762 - RNA, 32 nt, Human
ucucagcucacugcaacuuccgcaucccaggu

SEQ ID NO: 505763 - RNA, 32 nt, Human
ucucagcucacugcaacuucugccucccaggu

SEQ ID NO: 505764 - RNA, 32 nt, Human
ucucagcucacugcaacuucugccuccugggu

SEQ ID NO: 505765 - RNA, 32 nt, Human
ucucagcucacugcaacuucugccuccuggua

SEQ ID NO: 505766 - RNA, 32 nt, Human
ucucagcucacugcaagcuccaacucccgggu

SEQ ID NO: 505767 - RNA, 32 nt, Human
ucucagcucacugcaagcuccaccucccgggu

SEQ ID NO: 505768 - RNA, 32 nt, Human
ucucagcucacugcaagcuccaccuuccgggu

SEQ ID NO: 505769 - RNA, 32 nt, Human
ucucagcucacugcaagcuccgccucccaggu

SEQ ID NO: 505770 - RNA, 32 nt, Human
ucucagcucacugcaagcuccgccucccgggu

SEQ ID NO: 505771 - RNA, 32 nt, Human
ucucagcucacugcaagcuccgccuccucccg

SEQ ID NO: 505772 - RNA, 32 nt, Human
ucucagcucacugcaagcuccgccuccugggu

SEQ ID NO: 505773 - RNA, 32 nt, Human
ucucagcucacugcaagcucuaccucuugguu

SEQ ID NO: 505774 - RNA, 32 nt, Human
ucucagcucacugcaagcucugccucccgggu

SEQ ID NO: 505775 - RNA, 32 nt, Human
ucucagcucacugcaagcucugccucccgugu

SEQ ID NO: 505776 - RNA, 32 nt, Human
ucucagcucacugcaagcucugccucucaggu

SEQ ID NO: 505777 - RNA, 32 nt, Human
ucucagcucacugcaaucuccaccuccugggu

SEQ ID NO: 505778 - RNA, 32 nt, Human
ucucagcucacugcaaucuucaccuccuaggc

SEQ ID NO: 505779 - RNA, 32 nt, Human
ucucagcucacugcacccuccgccucucgggu

SEQ ID NO: 505780 - RNA, 32 nt, Human
ucucagcucacugcacccuugaccucccauac

SEQ ID NO: 505781 - RNA, 32 nt, Human
ucucagcucacugcagccacugccucccaggu

SEQ ID NO: 505782 - RNA, 32 nt, Human
ucucagcucacugcagcccccgccucccaggu

SEQ ID NO: 505783 - RNA, 32 nt, Human
ucucagcucacugcagccucaacugccccagg

SEQ ID NO: 505784 - RNA, 32 nt, Human
ucucagcucacugcagccuccaacucucuggu

SEQ ID NO: 505785 - RNA, 32 nt, Human
ucucagcucacugcagccuccaccucccaggu

SEQ ID NO: 505786 - RNA, 32 nt, Human
ucucagcucacugcagccuccacuuccugggu

SEQ ID NO: 505787 - RNA, 32 nt, Human
ucucagcucacugcagccuccgucucccaggu

SEQ ID NO: 505788 - RNA, 32 nt, Human
ucucagcucacugcagccucugccacccagau

SEQ ID NO: 505789 - RNA, 32 nt, Human
ucucagcucacugcagccucugccucccgggu

SEQ ID NO: 505790 - RNA, 32 nt, Human
ucucagcucacugcagccucugccuccugagu

SEQ ID NO: 505791 - RNA, 32 nt, Human
ucucagcucacugcagccucugucucccgggc

SEQ ID NO: 505792 - RNA, 32 nt, Human
ucucagcucacugcagccuugaccuccugggu

SEQ ID NO: 505793 - RNA, 32 nt, Human
ucucagcucacugcaggcucugccuccugggu

SEQ ID NO: 505794 - RNA, 32 nt, Human
ucucagcucacugcagucucugccucccgggu

SEQ ID NO: 505795 - RNA, 32 nt, Human
ucucagcucacugcauccucugccucccgggu

SEQ ID NO: 505796 - RNA, 32 nt, Human
ucucagcucacugccaccucugccucccaggu

SEQ ID NO: 505797 - RNA, 32 nt, Human
ucucagcucacugccaccuuugccuccugggu

SEQ ID NO: 505798 - RNA, 32 nt, Human
ucucagcucacugcgaccuccaccucccaugu

SEQ ID NO: 505799 - RNA, 32 nt, Human
ucucagcucacugcgaccugcaccuccugggu

SEQ ID NO: 505800 - RNA, 32 nt, Human
ucucagcucacugcggccuugaacuccugggc

SEQ ID NO: 505801 - RNA, 32 nt, Human
ucucagcucacuggagccucugccuuccaggu

SEQ ID NO: 505802 - RNA, 32 nt, Human
ucucagcucacuggcaacaucugccucccggg

SEQ ID NO: 505803 - RNA, 32 nt, Human
ucucagcucacuguaaccuccaccucccggau

SEQ ID NO: 505804 - RNA, 32 nt, Human
ucucagcucacuguaaccucugccucccugcu

SEQ ID NO: 505805 - RNA, 32 nt, Human
ucucagcucacuguacuccagcccggguucaa

SEQ ID NO: 505806 - RNA, 32 nt, Human
ucucagcucacuguaggcucuaccucaugggu

SEQ ID NO: 505807 - RNA, 32 nt, Human
ucucagcucacugugaccuccgccuccugggu

SEQ ID NO: 505808 - RNA, 32 nt, Human
ucucagcucagugcaaccuccgccacccgggu

SEQ ID NO: 505809 - RNA, 32 nt, Human
ucucagcucagugcaaccuccgcccccuggga

SEQ ID NO: 505810 - RNA, 32 nt, Human
ucucagcucagugcaaccuccgccucccgagu

SEQ ID NO: 505811 - RNA, 32 nt, Human
ucucagcucauugcaaccucggcucacuguaa

SEQ ID NO: 505812 - RNA, 32 nt, Human
ucucagcucauugcaaccucugucucccaggu

SEQ ID NO: 505813 - RNA, 32 nt, Human
ucucagcucauugcaacuuccaccuccugggu

SEQ ID NO: 505814 - RNA, 32 nt, Human
ucucagcuccaauuuuauugucauuuucauca

SEQ ID NO: 505815 - RNA, 32 nt, Human
ucucagcuccaugcaaccucugccuccugggu

SEQ ID NO: 505816 - RNA, 32 nt, Human
ucucagcucccauuucuacucucccauggcuu

SEQ ID NO: 505817 - RNA, 32 nt, Human
ucucagcuccccugccacccagccucugaggc

SEQ ID NO: 505818 - RNA, 19 nt, Human
ucucagcucccuccuuccc

SEQ ID NO: 505819 - RNA, 32 nt, Human
ucucagcucccugcaaccuccaccuccugggu

SEQ ID NO: 505820 - RNA, 32 nt, Human
ucucagcucccugcaaccuccgccucccgggu

SEQ ID NO: 505821 - RNA, 32 nt, Human
ucucagcucccuuuaaccuccagcuccugggu

SEQ ID NO: 505822 - RNA, 32 nt, Human
ucucagcucgccgcaaccuccgccucccaggu

SEQ ID NO: 505823 - RNA, 32 nt, Human
ucucagcucgcugcaacccccaccucccaggu

SEQ ID NO: 505824 - RNA, 32 nt, Human
ucucagcucgcugcaaccuccaccuccugggc

SEQ ID NO: 505825 - RNA, 32 nt, Human
ucucagcucgcugcaaccuccaccuccugggu

SEQ ID NO: 505826 - RNA, 32 nt, Human
ucucagcucgcugcaaccuccaccuuccgggu

SEQ ID NO: 505827 - RNA, 32 nt, Human
ucucagcucucugcaaccuccaccuccugggu

SEQ ID NO: 505828 - RNA, 32 nt, Human
ucucagcucugccuccccuggccagguugucc

SEQ ID NO: 505829 - RNA, 32 nt, Human
ucucagcugaacacccuccuuucacucccaaa

SEQ ID NO: 505830 - RNA, 32 nt, Human
ucucagcugaacacugucaucugccagagcuu

SEQ ID NO: 505831 - RNA, 23 nt, Human
ucucagcugccaagugagcuuca

SEQ ID NO: 505832 - RNA, 16 nt, Human
ucucagcugccugcca

SEQ ID NO: 505833 - RNA, 32 nt, Human
ucucagcugggaagagaggaugcaagaccaga

SEQ ID NO: 505834 - RNA, 32 nt, Human
ucucagcugguuuugcccacuucccuuugacu

SEQ ID NO: 505835 - RNA, 20 nt, Human
ucucagcuguccaaaguuca

SEQ ID NO: 505836 - RNA, 19 nt, Human
ucucagcuguccagauuca

SEQ ID NO: 505837 - RNA, 23 nt, Human
ucucagcuguucugaugccuuca

SEQ ID NO: 505838 - RNA, 32 nt, Human
ucucagcuuaaugcaaccucuaccucccaggu

SEQ ID NO: 505839 - RNA, 32 nt, Human
ucucagcuuacucaaccucugccucuuggguu

SEQ ID NO: 505840 - RNA, 32 nt, Human
ucucagcuuacugcaaccucugccucccgggu

SEQ ID NO: 505841 - RNA, 32 nt, Human
ucucagcuuacugcaaccucugucucccgggu

SEQ ID NO: 505842 - RNA, 32 nt, Human
ucucagcuuauugcagucuccaccuccugagu

SEQ ID NO: 505843 - RNA, 32 nt, Human
ucucagcuucugguaccaccuccaugggcccc

SEQ ID NO: 505844 - RNA, 32 nt, Human
ucucagcuuucuuagagaauucccuagaacua

SEQ ID NO: 505845 - RNA, 15 nt, Human
ucucaggaaagcugu

SEQ ID NO: 505846 - RNA, 32 nt, Human
ucucaggaaaguuguccaggguuuagggauau

SEQ ID NO: 505847 - RNA, 27 nt, Human
ucucaggaaggacugagccucugucuu

SEQ ID NO: 505848 - RNA, 32 nt, Human
ucucaggaauauuuggagcugugcaaauguua

SEQ ID NO: 505849 - RNA, 32 nt, Human
ucucaggacaagagaaugcaggcaggcaaaug

SEQ ID NO: 505850 - RNA, 20 nt, Human
ucucaggaccaaagcuuuca

SEQ ID NO: 505851 - RNA, 32 nt, Human
ucucaggaccuccugagggcuaugucaugagc

SEQ ID NO: 505852 - RNA, 32 nt, Human
ucucaggacucccuucccucugggcagaggcc

SEQ ID NO: 505853 - RNA, 32 nt, Human
ucucaggagacaauaacuccagugauguuuuu

SEQ ID NO: 505854 - RNA, 32 nt, Human
ucucaggagacagugaggcugccccuccuacc

SEQ ID NO: 505855 - RNA, 32 nt, Human
ucucaggagaccaaaucucacagaaaaauagg

SEQ ID NO: 505856 - RNA, 22 nt, Human
ucucaggagcaggaagacucag

SEQ ID NO: 505857 - RNA, 32 nt, Human
ucucaggaggcuggggugggaagaucacuuga

SEQ ID NO: 505858 - RNA, 32 nt, Human
ucucaggaguccaggacccaggagagggaaga

SEQ ID NO: 505859 - RNA, 32 nt, Human
ucucaggaguuucucuugaugaucuaccuuuu

SEQ ID NO: 505860 - RNA, 32 nt, Human
ucucaggauagaaaauauguuuuggcauuuga

SEQ ID NO: 505861 - RNA, 32 nt, Human
ucucaggauaggggcugcccuuuuugucugau

SEQ ID NO: 505862 - RNA, 32 nt, Human
ucucaggauggagugaagaccuggagaggagg

SEQ ID NO: 505863 - RNA, 32 nt, Human
ucucaggcaagacucaggacugcucuggacau

SEQ ID NO: 505864 - RNA, 32 nt, Human
ucucaggcagagcagggugguccgggcacacu

SEQ ID NO: 505865 - RNA, 32 nt, Human
ucucaggcaggcaguucugcuucagcuuagag

SEQ ID NO: 505866 - RNA, 31 nt, Human
ucucaggcagguugucccacagcagagacaa

SEQ ID NO: 505867 - RNA, 32 nt, Human
ucucaggccacugcauuuagccugggcgacag

SEQ ID NO: 505868 - RNA, 32 nt, Human
ucucaggcccagccucagagcagaucuuggca

SEQ ID NO: 505869 - RNA, 32 nt, Human
ucucaggccuauaaucucagcacuaugggagg

SEQ ID NO: 505870 - RNA, 32 nt, Human
ucucaggccugcuucacggcagccugcccagu

SEQ ID NO: 505871 - RNA, 32 nt, Human
ucucaggcucaagcaaaccucucaccucagcc

SEQ ID NO: 505872 - RNA, 32 nt, Human
ucucaggcucaagcaauccucccgccucagcc

SEQ ID NO: 505873 - RNA, 32 nt, Human
ucucaggcucaagcgauccucccaucucagcc

SEQ ID NO: 505874 - RNA, 32 nt, Human
ucucaggcucaagcgauucucccaccucagcc

SEQ ID NO: 505875 - RNA, 32 nt, Human
ucucaggcucaagugauccucuuaccuuagcc

SEQ ID NO: 505876 - RNA, 32 nt, Human
ucucaggcucacugagugcaaugucugccugc

SEQ ID NO: 505877 - RNA, 32 nt, Human
ucucaggcucaggugauccucccaucucagcc

SEQ ID NO: 505878 - RNA, 32 nt, Human
ucucaggcuccagccauccucucaccucagcc

SEQ ID NO: 505879 - RNA, 32 nt, Human
ucucaggcucugauguuugaaaaagaagggaa

SEQ ID NO: 505880 - RNA, 32 nt, Human
ucucaggcugagccacaucucacuuuuucgcu

SEQ ID NO: 505881 - RNA, 21 nt, Human
ucucaggcuggaguacagugg

SEQ ID NO: 505882 - RNA, 21 nt, Human
ucucaggcuggagugcagugg

SEQ ID NO: 505883 - RNA, 32 nt, Human
ucucaggcuggcugacuuucccugcauguacg

SEQ ID NO: 505884 - RNA, 32 nt, Human
ucucaggcugggcagaggucacacagugagua

SEQ ID NO: 505885 - RNA, 32 nt, Human
ucucaggcuguggcuggaacaggacaggauga

SEQ ID NO: 505886 - RNA, 19 nt, Human
ucucagggacaagaccagu

SEQ ID NO: 505887 - RNA, 19 nt, Human
ucucagggacagaggccag

SEQ ID NO: 505888 - RNA, 32 nt, Human
ucucagggacagaggccagcagaggagccagc

SEQ ID NO: 505889 - RNA, 32 nt, Human
ucucagggacucucagggcagcuccugccacu

SEQ ID NO: 505890 - RNA, 20 nt, Human
ucucagggagaaccucugcu

SEQ ID NO: 505891 - RNA, 32 nt, Human
ucucagggaggaaaccggcuugccagcaagua

SEQ ID NO: 505892 - RNA, 31 nt, Human
ucucagggcaaaggaaccuggcucauuugaa

SEQ ID NO: 505893 - RNA, 32 nt, Human
ucucagggcacggaggcagaacugaaugcccg

SEQ ID NO: 505894 - RNA, 32 nt, Human
ucucagggccaggcaugggaccugccaucgag

SEQ ID NO: 505895 - RNA, 32 nt, Human
ucucagggcccugcuguucccucugccuggaa

SEQ ID NO: 505896 - RNA, 32 nt, Human
ucucagggcuccugccuucuguccugguguca

SEQ ID NO: 505897 - RNA, 32 nt, Human
ucucaggggcuggggcucuaccuccccuggcc

SEQ ID NO: 505898 - RNA, 32 nt, Human
ucucagggguuggggacagggccagguagccu

SEQ ID NO: 505899 - RNA, 20 nt, Human
ucucaggguacuuucuggga

SEQ ID NO: 505900 - RNA, 32 nt, Human
ucucagggucuccccagcccaguccccuugcu

SEQ ID NO: 505901 - RNA, 32 nt, Human
ucucaggucacugcaaccucugccucccaggu

SEQ ID NO: 505902 - RNA, 32 nt, Human
ucucaggucacugcaaccucugccuccugggu

SEQ ID NO: 505903 - RNA, 32 nt, Human
ucucaggucucauuccagaccuggugagccag

SEQ ID NO: 505904 - RNA, 32 nt, Human
ucucaggugaacgcaucacuugccaaacuguu

SEQ ID NO: 505905 - RNA, 31 nt, Human
ucucaggugaugucuccauguggcuaagucu

SEQ ID NO: 505906 - RNA, 32 nt, Human
ucucaggugggacuccagaauucccgcaucug

SEQ ID NO: 505907 - RNA, 32 nt, Human
ucucagguggguggagcaguggugggagaaga

SEQ ID NO: 505908 - RNA, 32 nt, Human
ucucagguucaagcgauuuuucugccucagcc

SEQ ID NO: 505909 - RNA, 32 nt, Human
ucucagguucaagugauucuccugccucagcc

SEQ ID NO: 505910 - RNA, 32 nt, Human
ucucagguucaagugauucuccugccucugcc

SEQ ID NO: 505911 - RNA, 32 nt, Human
ucucagguugucuaaguguuuuuauguaaaac

SEQ ID NO: 505912 - RNA, 32 nt, Human
ucucagguuucugcucaaaagucaccuuucgg

SEQ ID NO: 505913 - RNA, 32 nt, Human
ucucaguacaagggcccugggauggagccaac

SEQ ID NO: 505914 - RNA, 32 nt, Human
ucucagucaagcaaagugugguauccacagac

SEQ ID NO: 505915 - RNA, 32 nt, Human
ucucagucacacaugucuagccuccaggcgcu

SEQ ID NO: 505916 - RNA, 32 nt, Human
ucucagucacuucaguaucuuugcuacacaga

SEQ ID NO: 505917 - RNA, 32 nt, Human
ucucaguccaacaacaucacucaaacaacccu

SEQ ID NO: 505918 - RNA, 18 nt, Human
ucucaguccaccagcuca

SEQ ID NO: 505919 - RNA, 32 nt, Human
ucucaguccacugcaaccucugcccucccggg

SEQ ID NO: 505920 - RNA, 32 nt, Human
ucucagucccuggccuugccccuggcucuggc

SEQ ID NO: 505921 - RNA, 32 nt, Human
ucucaguccugggucugugggagcccucaugc

SEQ ID NO: 505922 - RNA, 32 nt, Human
ucucagucgcccaggcuggagugcagcagcac

SEQ ID NO: 505923 - RNA, 32 nt, Human
ucucagucuaccuccucuuuucugccucugaa

SEQ ID NO: 505924 - RNA, 32 nt, Human
ucucagucucuuccucuuccggcugggauugg

SEQ ID NO: 505925 - RNA, 32 nt, Human
ucucagucugaacaagaaaacuccuucuggag

SEQ ID NO: 505926 - RNA, 32 nt, Human
ucucagucugccuuaaaggaacugugaaggcu

SEQ ID NO: 505927 - RNA, 32 nt, Human
ucucagucuuuccugaggacuugggaacugcc

SEQ ID NO: 505928 - RNA, 32 nt, Human
ucucagugaccccagggcagagcccagagaag

SEQ ID NO: 505929 - RNA, 26 nt, Human
ucucagugagcaccagcugccuccca

SEQ ID NO: 505930 - RNA, 32 nt, Human
ucucagugaggagcugcugcugugcuguuuaa

SEQ ID NO: 505931 - RNA, 32 nt, Human
ucucagugccccggaucggaggccguccaucg

SEQ ID NO: 505932 - RNA, 32 nt, Human
ucucagugccuucucucagcucccaggccaac

SEQ ID NO: 505933 - RNA, 32 nt, Human
ucucagugggaaauccacccagcaaccuaaua

SEQ ID NO: 505934 - RNA, 32 nt, Human
ucucaguggggagggggcaacagauggggcgg

SEQ ID NO: 505935 - RNA, 31 nt, Human
ucucaguggguggagugccagggaggaggag

SEQ ID NO: 505936 - RNA, 32 nt, Human
ucucaguguagaaaucaugucuucuuaauugc

SEQ ID NO: 505937 - RNA, 32 nt, Human
ucucaguuaggccuguauguguguacaugucc

SEQ ID NO: 505938 - RNA, 32 nt, Human
ucucaguucacugcaaccuccacccugcaggu

SEQ ID NO: 505939 - RNA, 32 nt, Human
ucucaguucacugcaaccuccacuuccuaggu

SEQ ID NO: 505940 - RNA, 32 nt, Human
ucucaguucacugcaaccucugccucccacgu

SEQ ID NO: 505941 - RNA, 32 nt, Human
ucucaguucacugcaaccucugccucccgggu

SEQ ID NO: 505942 - RNA, 32 nt, Human
ucucaguucacugcaaccucugccuccuaagu

SEQ ID NO: 505943 - RNA, 32 nt, Human
ucucaguucacugcaaccucugccuccugggu

SEQ ID NO: 505944 - RNA, 32 nt, Human
ucucaguucacugcaacuucugccucccgagu

SEQ ID NO: 505945 - RNA, 32 nt, Human
ucucaguucacugcaagcuccgccuccucguu

SEQ ID NO: 505946 - RNA, 32 nt, Human
ucucaguucacugcagccuccgcccuccaggu

SEQ ID NO: 505947 - RNA, 32 nt, Human
ucucaguucacugcagucucugccuccuuggu

SEQ ID NO: 505948 - RNA, 32 nt, Human
ucucaguucagcugguucuggcugaggccucc

SEQ ID NO: 505949 - RNA, 32 nt, Human
ucucaguucauuuccugagguggauuuacuga

SEQ ID NO: 505950 - RNA, 22 nt, Human
ucucaguucccccuucagcuga

SEQ ID NO: 505951 - RNA, 32 nt, Human
ucucaguucucucccuuccucucuccuuauag

SEQ ID NO: 505952 - RNA, 32 nt, Human
ucucaguucugcugcugauguaccaugaucuu

SEQ ID NO: 505953 - RNA, 32 nt, Human
ucucaguugcagcccugcugcugccugccugg

SEQ ID NO: 505954 - RNA, 32 nt, Human
ucucaguuguguauuuguucaucuucauaugc

SEQ ID NO: 505955 - RNA, 32 nt, Human
ucucaguuuccagaaauggagggacucaugcu

SEQ ID NO: 505956 - RNA, 32 nt, Human
ucucaguuuccgcaauggcaagauggggugga

SEQ ID NO: 505957 - RNA, 32 nt, Human
ucucauaacauauaugagguauacaaaauuuu

SEQ ID NO: 505958 - RNA, 32 nt, Human
ucucauacagaagagcuaagauuggcagaaau

SEQ ID NO: 505959 - RNA, 32 nt, Human
ucucauaccucuggggacaggaaagguagagg

SEQ ID NO: 505960 - RNA, 31 nt, Human
ucucauacucucaaggagggagagugcauuu

SEQ ID NO: 505961 - RNA, 32 nt, Human
ucucauagcaaugccccacuacccucaguacc

SEQ ID NO: 505962 - RNA, 31 nt, Human
ucucauaggaaacauccucauugauccucuu

SEQ ID NO: 505963 - RNA, 32 nt, Human
ucucauagguugagcaauuucccccuaaacca

SEQ ID NO: 505964 - RNA, 32 nt, Human
ucucauaguguuuuauacucaguaccuguuuu

SEQ ID NO: 505965 - RNA, 23 nt, Human
ucucauauaucucgucuuuccuc

SEQ ID NO: 505966 - RNA, 32 nt, Human
ucucauaugccaccccaugugccuuuagucca

SEQ ID NO: 505967 - RNA, 32 nt, Human
ucucauauuucccuaauaaacuccucaacuuu

SEQ ID NO: 505968 - RNA, 32 nt, Human
ucucaucaagacagagaaaggacuaucaaaag

SEQ ID NO: 505969 - RNA, 32 nt, Human
ucucaucaauccaucaagccugcuagaacucu

SEQ ID NO: 505970 - RNA, 32 nt, Human
ucucaucacagacauagccagcucuucaguuc

SEQ ID NO: 505971 - RNA, 32 nt, Human
ucucaucacccaggcuagagugcaguggcaca

SEQ ID NO: 505972 - RNA, 32 nt, Human
ucucaucaccuauccuggaacugaugcaauua

SEQ ID NO: 505973 - RNA, 32 nt, Human
ucucaucaggcggcaacuucacccucacaugc

SEQ ID NO: 505974 - RNA, 32 nt, Human
ucucaucaguaguucacauacaaaucauccau

SEQ ID NO: 505975 - RNA, 32 nt, Human
ucucaucaucccucuagggacagcagggcagg

SEQ ID NO: 505976 - RNA, 32 nt, Human
ucucauccacugguggcucagagccauaaggu

SEQ ID NO: 505977 - RNA, 32 nt, Human
ucucauccagaagcaagaaaagggcaugucuu

SEQ ID NO: 505978 - RNA, 32 nt, Human
ucucauccauccccuucucugucuuugccucu

SEQ ID NO: 505979 - RNA, 32 nt, Human
ucucaucccauucugcgucaugcuuguguuau

SEQ ID NO: 505980 - RNA, 32 nt, Human
ucucaucccucggcaccucuuguuuuccuuuu

SEQ ID NO: 505981 - RNA, 32 nt, Human
ucucauccuccccauuccucguccacacucca

SEQ ID NO: 505982 - RNA, 32 nt, Human
ucucauccugcaggugggacucucagcugaca

SEQ ID NO: 505983 - RNA, 32 nt, Human
ucucauccugggcagagguugccuaguuggua

SEQ ID NO: 505984 - RNA, 32 nt, Human
ucucauccuuucuccucccucuccuuuuccug

SEQ ID NO: 505985 - RNA, 32 nt, Human
ucucaucguggacaccacugcccacaccucca

SEQ ID NO: 505986 - RNA, 21 nt, Human
ucucaucguucagggauggac

SEQ ID NO: 505987 - RNA, 32 nt, Human
ucucaucucacugcaaccuccaccucccaggu

SEQ ID NO: 505988 - RNA, 22 nt, Human
ucucaucucagcccuaucuuca

SEQ ID NO: 505989 - RNA, 32 nt, Human
ucucaucucagugcaaccuccaccucucacgu

SEQ ID NO: 505990 - RNA, 32 nt, Human
ucucaucucccacaaucucuggccuccaggau

SEQ ID NO: 505991 - RNA, 32 nt, Human
ucucaucucccugcaaccuccgccuccugggu

SEQ ID NO: 505992 - RNA, 32 nt, Human
ucucaucugacacgucuuuuucccaggguucg

SEQ ID NO: 505993 - RNA, 32 nt, Human
ucucaucugaggcauccagcagucucugccuu

SEQ ID NO: 505994 - RNA, 21 nt, Human
ucucaucugcuccagcccccu

SEQ ID NO: 505995 - RNA, 32 nt, Human
ucucaucuggggaacugucauugccagcagag

SEQ ID NO: 505996 - RNA, 32 nt, Human
ucucaucugucacccaggcuggagugcaaugg

SEQ ID NO: 505997 - RNA, 32 nt, Human
ucucaugaacccaggaggcagagguugcagug

SEQ ID NO: 505998 - RNA, 18 nt, Human
ucucaugacaacucagug

SEQ ID NO: 505999 - RNA, 32 nt, Human
ucucaugccagccuguccuucuggcuuccucu

SEQ ID NO: 506000 - RNA, 32 nt, Human
ucucaugccuauaaucccagcacuuugggagg

SEQ ID NO: 506001 - RNA, 32 nt, Human
ucucaugccucuaaucccagcacuuuggaaga

SEQ ID NO: 506002 - RNA, 32 nt, Human
ucucaugccuguaaucccagcacuuugggagg

SEQ ID NO: 506003 - RNA, 32 nt, Human
ucucaugccuugcguaugcagcaggaacugug

SEQ ID NO: 506004 - RNA, 24 nt, Human
ucucaugccuuuuuguccuguccu

SEQ ID NO: 506005 - RNA, 32 nt, Human
ucucaugcucguuucuuuccuccuuuugacua

SEQ ID NO: 506006 - RNA, 32 nt, Human
ucucaugcuguggccccuccccagaccgccag

SEQ ID NO: 506007 - RNA, 32 nt, Human
ucucaugcuguugcugcuacugucuuacuauu

SEQ ID NO: 506008 - RNA, 32 nt, Human
ucucauggacaucucuuccucucccaggaagc

SEQ ID NO: 506009 - RNA, 32 nt, Human
ucucauggacccugauguugugcuccacauug

SEQ ID NO: 506010 - RNA, 32 nt, Human
ucucauggcaggcaccuguaaucccaucuacu

SEQ ID NO: 506011 - RNA, 32 nt, Human
ucucauggcuccuugcugggccaagcccucca

SEQ ID NO: 506012 - RNA, 32 nt, Human
ucucaugggaaggaguucuuacacaggugagg

SEQ ID NO: 506013 - RNA, 32 nt, Human
ucucaugggucuucauuuucucuuauuuuguu

SEQ ID NO: 506014 - RNA, 24 nt, Human
ucucauguaccccauaaauauaua

SEQ ID NO: 506015 - RNA, 32 nt, Human
ucucaugucacggcaaccuccgccucccaggu

SEQ ID NO: 506016 - RNA, 32 nt, Human
ucucaugucucauuagagugcaagggggagga

SEQ ID NO: 506017 - RNA, 32 nt, Human
ucucaugugaacccagcaggcuuggaaccagc

SEQ ID NO: 506018 - RNA, 32 nt, Human
ucucauguucauuccgggucaccaagagguuc

SEQ ID NO: 506019 - RNA, 32 nt, Human
ucucauguuccccucacccaucaugccagcca

SEQ ID NO: 506020 - RNA, 32 nt, Human
ucucauguucucugcucccacaccuaagccaa

SEQ ID NO: 506021 - RNA, 32 nt, Human
ucucauguuuggaacaauaaaguugaaauuuu

SEQ ID NO: 506022 - RNA, 32 nt, Human
ucucauuacaucuuuaauuucauauccaagua

SEQ ID NO: 506023 - RNA, 32 nt, Human
ucucauuaccagugacuaauuuugccacaggg

SEQ ID NO: 506024 - RNA, 32 nt, Human
ucucauuacuauuuuuagcauucuccaggcuu

SEQ ID NO: 506025 - RNA, 32 nt, Human
ucucauuaguaggaacaugugagaugaagcac

SEQ ID NO: 506026 - RNA, 32 nt, Human
ucucauuaguaggaacaugugagaugaagcau

SEQ ID NO: 506027 - RNA, 32 nt, Human
ucucauuagugucucccgggccuguccccaac

SEQ ID NO: 506028 - RNA, 32 nt, Human
ucucauucaaauacuguauuuuauauaggcau

SEQ ID NO: 506029 - RNA, 32 nt, Human
ucucauucacugggaaguauucuauugcaguc

SEQ ID NO: 506030 - RNA, 28 nt, Human
ucucauuccuaaguugccucauuaauuu

SEQ ID NO: 506031 - RNA, 32 nt, Human
ucucauuccucuuucccuucuuuuagcaauaa

SEQ ID NO: 506032 - RNA, 31 nt, Human
ucucauuccugcucugggccauuuguguuuu

SEQ ID NO: 506033 - RNA, 32 nt, Human
ucucauuccuuugacucugccggacuuuguca

SEQ ID NO: 506034 - RNA, 32 nt, Human
ucucauucuaccugcaguuuaauuggaaagau

SEQ ID NO: 506035 - RNA, 32 nt, Human
ucucauucucagacuguucaauauggugcccg

SEQ ID NO: 506036 - RNA, 32 nt, Human
ucucauucuguuauccaguucauuccagcaau

SEQ ID NO: 506037 - RNA, 32 nt, Human
ucucauucuuccaagcugagagucuagcacuc

SEQ ID NO: 506038 - RNA, 32 nt, Human
ucucauucuugucacccagacuggagugcgau

SEQ ID NO: 506039 - RNA, 32 nt, Human
ucucauucuuucaaaauaaaacuuuuugaaau

SEQ ID NO: 506040 - RNA, 18 nt, Human
ucucauugagcuggcaga

SEQ ID NO: 506041 - RNA, 32 nt, Human
ucucauugcaaauacaaaauaaaaauuaguug

SEQ ID NO: 506042 - RNA, 32 nt, Human
ucucauugccaagugccagcuguuacacaugg

SEQ ID NO: 506043 - RNA, 18 nt, Human
ucucauugccacauguca

SEQ ID NO: 506044 - RNA, 32 nt, Human
ucucauugcccaggcuggagugcagugagcua

SEQ ID NO: 506045 - RNA, 32 nt, Human
ucucauuggcugcagcacaucacaguggaccu

SEQ ID NO: 506046 - RNA, 32 nt, Human
ucucauugggccacugcagucgagccugggcg

SEQ ID NO: 506047 - RNA, 32 nt, Human
ucucauuggggugagaggaggcccaggaggag

SEQ ID NO: 506048 - RNA, 31 nt, Human
ucucauuggguggauggaugggugaggaggg

SEQ ID NO: 506049 - RNA, 32 nt, Human
ucucauuguucaauucccaccuaggagugaga

SEQ ID NO: 506050 - RNA, 32 nt, Human
ucucauuuaagcaauuuacuuccucauucugg

SEQ ID NO: 506051 - RNA, 32 nt, Human
ucucauuuauucaacaugauucuuaagcacua

SEQ ID NO: 506052 - RNA, 32 nt, Human
ucucauuuauucucacaccaccaccacagcgu

SEQ ID NO: 506053 - RNA, 32 nt, Human
ucucauuuccaaaccaucagcugcuuuuaaaa

SEQ ID NO: 506054 - RNA, 32 nt, Human
ucucauuucccaaaggguuuguauucugcuaa

SEQ ID NO: 506055 - RNA, 32 nt, Human
ucucauuucccucccucccucugacaccuuuc

SEQ ID NO: 506056 - RNA, 32 nt, Human
ucucauuucucccacaccuccuccccauaccu

SEQ ID NO: 506057 - RNA, 32 nt, Human
ucucauuucuuucaugcaguuacucugggaua

SEQ ID NO: 506058 - RNA, 32 nt, Human
ucucauuugaccccuuugcuuccagagaugaa

SEQ ID NO: 506059 - RNA, 32 nt, Human
ucucauuugaucucaaaacagcuugacagagc

SEQ ID NO: 506060 - RNA, 32 nt, Human
ucucauuugcagaagucuaagaauguaccuuu

SEQ ID NO: 506061 - RNA, 32 nt, Human
ucucauuuucacuuguuuucucuaauaaaaau

SEQ ID NO: 506062 - RNA, 32 nt, Human
ucucauuuuccuguuuacacuggggauuugga

SEQ ID NO: 506063 - RNA, 32 nt, Human
ucucauuuugaacccagaucugaacagaauua

SEQ ID NO: 506064 - RNA, 19 nt, Human
ucucauuuugacagcauga

SEQ ID NO: 506065 - RNA, 32 nt, Human
ucucauuuuggguuuucucuucuccugcuuuc

SEQ ID NO: 506066 - RNA, 32 nt, Human
ucuccaaaacguucuucccagacugcgaggac

SEQ ID NO: 506067 - RNA, 32 nt, Human
ucuccaaaagugcugggauuacaggcaugagu

SEQ ID NO: 506068 - RNA, 32 nt, Human
ucuccaaaaguggucaguuuggcugggcaaua

SEQ ID NO: 506069 - RNA, 32 nt, Human
ucuccaaaaugagagcauguuccugggagcca

SEQ ID NO: 506070 - RNA, 32 nt, Human
ucuccaaacagccuugugccucaccuaccccc

SEQ ID NO: 506071 - RNA, 32 nt, Human
ucuccaaacauguaggaggaaaugaggaaauc

SEQ ID NO: 506072 - RNA, 32 nt, Human
ucuccaaacgugcugggauuacaggcaugagc

SEQ ID NO: 506073 - RNA, 32 nt, Human
ucuccaaacuauauuguuucuuugcuaagucc

SEQ ID NO: 506074 - RNA, 32 nt, Human
ucuccaaacugaagcagccucuccccaggucc

SEQ ID NO: 506075 - RNA, 32 nt, Human
ucuccaaacugauuucaccaaggaaccccuuu

SEQ ID NO: 506076 - RNA, 20 nt, Human
ucuccaaagaaccuucccuc

SEQ ID NO: 506077 - RNA, 32 nt, Human
ucuccaaagaagcuguacaggugagguggcuc

SEQ ID NO: 506078 - RNA, 32 nt, Human
ucuccaaauguucacugguacucugccacuuu

SEQ ID NO: 506079 - RNA, 32 nt, Human
ucuccaaauguugggguagggaagggagggga

SEQ ID NO: 506080 - RNA, 32 nt, Human
ucuccaaauugauuuccacaguggcugaacua

SEQ ID NO: 506081 - RNA, 32 nt, Human
ucuccaacaucucuccccaccucaugauuguc

SEQ ID NO: 506082 - RNA, 25 nt, Human
ucuccaacauuuuucccggucugug

SEQ ID NO: 506083 - RNA, 21 nt, Human
ucuccaaccacucaucccucu

SEQ ID NO: 506084 - RNA, 32 nt, Human
ucuccaaccagcucccagugcugcuguccucu

SEQ ID NO: 506085 - RNA, 31 nt, Human
ucuccaaccagggcagaaaggagggaggauu

SEQ ID NO: 506086 - RNA, 23 nt, Human
ucuccaacccugugggcuguaag

SEQ ID NO: 506087 - RNA, 32 nt, Human
ucuccaaccuccgccagcagcaaccgaacuug

SEQ ID NO: 506088 - RNA, 32 nt, Human
ucuccaaccugguuuucaccuacugagggcgc

SEQ ID NO: 506089 - RNA, 18 nt, Human
ucuccaacucagcugggc

SEQ ID NO: 506090 - RNA, 32 nt, Human
ucuccaacucugcagcaguggcagcagcaguc

SEQ ID NO: 506091 - RNA, 32 nt, Human
ucuccaagaagcucuggcuccuuuccuagaac

SEQ ID NO: 506092 - RNA, 32 nt, Human
ucuccaagcucagggcaaucccuucccuccug

SEQ ID NO: 506093 - RNA, 32 nt, Human
ucuccaagcugcacaccagaggcugcacagag

SEQ ID NO: 506094 - RNA, 31 nt, Human
ucuccaaggcacuuucggccuuccuucuucu

SEQ ID NO: 506095 - RNA, 32 nt, Human
ucuccaaggcccaugaggauaugacugcccug

SEQ ID NO: 506096 - RNA, 24 nt, Human
ucuccaaggcccucuccuggucuc

SEQ ID NO: 506097 - RNA, 32 nt, Human
ucuccaagggccaucagugucuugccuagcuu

SEQ ID NO: 506098 - RNA, 31 nt, Human
ucuccaagguagcauccaaugccaagguggc

SEQ ID NO: 506099 - RNA, 32 nt, Human
ucuccaaucaggccuccuucuucugagaaaau

SEQ ID NO: 506100 - RNA, 32 nt, Human
ucuccaaucccugagucucagauguuucauuu

SEQ ID NO: 506101 - RNA, 21 nt, Human
ucuccaaugaaaguuuucuca

SEQ ID NO: 506102 - RNA, 32 nt, Human
ucuccaaugagacucaauggcugggccguggu

SEQ ID NO: 506103 - RNA, 21 nt, Human
ucuccaauggaaagcuuuuca

SEQ ID NO: 506104 - RNA, 31 nt, Human
ucuccaauggccacgagaaccuuaaaccuuu

SEQ ID NO: 506105 - RNA, 32 nt, Human
ucuccaaugucagcacaaaggaggcuuuuucu

SEQ ID NO: 506106 - RNA, 32 nt, Human
ucuccaauuguaagagaaagggggcagggaag

SEQ ID NO: 506107 - RNA, 22 nt, Human
ucuccacaaaauuuaaaaauua

SEQ ID NO: 506108 - RNA, 32 nt, Human
ucuccacaaaauuuaaaaauuagcggccgggc

SEQ ID NO: 506109 - RNA, 20 nt, Human
ucuccacaaaguguuaccag

SEQ ID NO: 506110 - RNA, 32 nt, Human
ucuccacaaugccaagacggagaccacagccu

SEQ ID NO: 506111 - RNA, 19 nt, Human
ucuccacacacagcuccag

SEQ ID NO: 506112 - RNA, 32 nt, Human
ucuccacacagaaaaucuucuugauucuauag

SEQ ID NO: 506113 - RNA, 32 nt, Human
ucuccacacagugcucaaggccagcuuauagu

SEQ ID NO: 506114 - RNA, 32 nt, Human
ucuccacaccauugacuugcagaugcuucugu

SEQ ID NO: 506115 - RNA, 23 nt, Human
ucuccacaccccuccuguuccag

SEQ ID NO: 506116 - RNA, 32 nt, Human
ucuccacaccgccucugccugccccuguggac

SEQ ID NO: 506117 - RNA, 32 nt, Human
ucuccacacucuucgcuccugggaagucaacu

SEQ ID NO: 506118 - RNA, 20 nt, Human
ucuccacagaagaagcccag

SEQ ID NO: 506119 - RNA, 32 nt, Human
ucuccacagcaaccccaggcugaagcagguuc

SEQ ID NO: 506120 - RNA, 32 nt, Human
ucuccacagcaacucuggagggaagcugaaga

SEQ ID NO: 506121 - RNA, 20 nt, Human
ucuccacagcaagcguccag

SEQ ID NO: 506122 - RNA, 21 nt, Human
ucuccacagcccucagucccc

SEQ ID NO: 506123 - RNA, 32 nt, Human
ucuccacagccuucuccagccugugugauaca

SEQ ID NO: 506124 - RNA, 32 nt, Human
ucuccacaggacagcacugcuuccaugcuuca

SEQ ID NO: 506125 - RNA, 32 nt, Human
ucuccacaggaggcuguggcagcuguggcauc

SEQ ID NO: 506126 - RNA, 20 nt, Human
ucuccacaggggcagcccca

SEQ ID NO: 506127 - RNA, 32 nt, Human
ucuccacaucccagauccccaguggguuucuc

SEQ ID NO: 506128 - RNA, 20 nt, Human
ucuccacaucgcggcuccgg

SEQ ID NO: 506129 - RNA, 32 nt, Human
ucuccacaucuuccuucucugaaguccaggua

SEQ ID NO: 506130 - RNA, 32 nt, Human
ucuccacaugagaccacaggcccagccagagc

SEQ ID NO: 506131 - RNA, 23 nt, Human
ucuccacauguuccagcucccag

SEQ ID NO: 506132 - RNA, 32 nt, Human
ucuccacauguuggguguccauccuggggcag

SEQ ID NO: 506133 - RNA, 19 nt, Human
ucuccacauugcaguucca

SEQ ID NO: 506134 - RNA, 32 nt, Human
ucuccaccaaaaagaggaagugccuccagcuu

SEQ ID NO: 506135 - RNA, 23 nt, Human
ucuccaccacaacaccaacaucu

SEQ ID NO: 506136 - RNA, 32 nt, Human
ucuccaccagcacaucacuaugcaucuguucc

SEQ ID NO: 506137 - RNA, 32 nt, Human
ucuccaccagggucgcuccaucacccaaacaa

SEQ ID NO: 506138 - RNA, 18 nt, Human
ucuccaccaugggcugca

SEQ ID NO: 506139 - RNA, 32 nt, Human
ucuccacccuaccccuuacucugggugucagg

SEQ ID NO: 506140 - RNA, 32 nt, Human
ucuccacccuaucccagccucccccacaagcc

SEQ ID NO: 506141 - RNA, 32 nt, Human
ucuccacccuccuugcaccagacuaaaucugu

SEQ ID NO: 506142 - RNA, 32 nt, Human
ucuccacccugaguuuccaucuucuaucagau

SEQ ID NO: 506143 - RNA, 32 nt, Human
ucuccacccuuuccccuucuuucguccucacc

SEQ ID NO: 506144 - RNA, 32 nt, Human
ucuccaccgcuuuggagaccucaggacuugga

SEQ ID NO: 506145 - RNA, 32 nt, Human
ucuccaccuccccuccccaccucuucucuccc

SEQ ID NO: 506146 - RNA, 32 nt, Human
ucuccaccuccuuuucccagccuucagaaggc

SEQ ID NO: 506147 - RNA, 21 nt, Human
ucuccaccucuacccggaaca

SEQ ID NO: 506148 - RNA, 32 nt, Human
ucuccaccucuuaccaaccauauggccuggac

SEQ ID NO: 506149 - RNA, 32 nt, Human
ucuccaccugcacuugcuuaccgcuggagggc

SEQ ID NO: 506150 - RNA, 32 nt, Human
ucuccaccugcaggaugagccggagcucuugu

SEQ ID NO: 506151 - RNA, 22 nt, Human
ucuccaccugcccaccgggaca

SEQ ID NO: 506152 - RNA, 32 nt, Human
ucuccaccuucuccccgccaggcacaggagcc

SEQ ID NO: 506153 - RNA, 32 nt, Human
ucuccacggucacagcagccucgugaugaaga

SEQ ID NO: 506154 - RNA, 32 nt, Human
ucuccacuaaaaauacaaaauuagcugggcgu

SEQ ID NO: 506155 - RNA, 32 nt, Human
ucuccacuaaaaauacaaaauuagcugggugu

SEQ ID NO: 506156 - RNA, 32 nt, Human
ucuccacuaaaauacaaaauuagcugggugug

SEQ ID NO: 506157 - RNA, 21 nt, Human
ucuccacucacagcaaccucu

SEQ ID NO: 506158 - RNA, 32 nt, Human
ucuccacucaccacaaccuccgccuccugggu

SEQ ID NO: 506159 - RNA, 32 nt, Human
ucuccacucacugcaacuuccgccuccugggg

SEQ ID NO: 506160 - RNA, 32 nt, Human
ucuccacucacugcagccuccgccucuggggu

SEQ ID NO: 506161 - RNA, 32 nt, Human
ucuccacucacugcaggcuccgccucccgggu

SEQ ID NO: 506162 - RNA, 32 nt, Human
ucuccacucagcccuggugggugcgggaacca

SEQ ID NO: 506163 - RNA, 32 nt, Human
ucuccacuccacuuuauuucucugggaaaaau

SEQ ID NO: 506164 - RNA, 32 nt, Human
ucuccacuccucuccaggagcuagccugugcc

SEQ ID NO: 506165 - RNA, 32 nt, Human
ucuccacuccuucauggcugggacaguuacug

SEQ ID NO: 506166 - RNA, 32 nt, Human
ucuccacucuuguggucaucauggccagcacg

SEQ ID NO: 506167 - RNA, 32 nt, Human
ucuccacugacccagcagcacacccaugugca

SEQ ID NO: 506168 - RNA, 32 nt, Human
ucuccacugauggcugggaagggaguugggga

SEQ ID NO: 506169 - RNA, 32 nt, Human
ucuccacugccaucugggacggggacugagcc

SEQ ID NO: 506170 - RNA, 32 nt, Human
ucuccacugccuccuccaccccuguauuucac

SEQ ID NO: 506171 - RNA, 32 nt, Human
ucuccacugcucagcacgccuccuauuaggug

SEQ ID NO: 506172 - RNA, 21 nt, Human
ucuccacuggccgccagccuc

SEQ ID NO: 506173 - RNA, 32 nt, Human
ucuccacugggacucaagagaggaaccugggg

SEQ ID NO: 506174 - RNA, 32 nt, Human
ucuccacugugguugugccugugccccucguu

SEQ ID NO: 506175 - RNA, 32 nt, Human
ucuccacuucacuccagcaucaacaagugggg

SEQ ID NO: 506176 - RNA, 32 nt, Human
ucuccacuugccuccccucuggauguaucugg

SEQ ID NO: 506177 - RNA, 22 nt, Human
ucuccacuuugcacgccggaac

SEQ ID NO: 506178 - RNA, 21 nt, Human
ucuccacuuuuuagagcggcg

SEQ ID NO: 506179 - RNA, 32 nt, Human
ucuccagaaagacauccugagaggacuuggca

SEQ ID NO: 506180 - RNA, 32 nt, Human
ucuccagaaccugaaaccaugcuaucucagau

SEQ ID NO: 506181 - RNA, 18 nt, Human
ucuccagaagcucacccu

SEQ ID NO: 506182 - RNA, 32 nt, Human
ucuccagaaguccauuggaauauuaagcccag

SEQ ID NO: 506183 - RNA, 32 nt, Human
ucuccagacaugucugaggugaagagccggaa

SEQ ID NO: 506184 - RNA, 32 nt, Human
ucuccagacccucccucacacgcccagagccu

SEQ ID NO: 506185 - RNA, 32 nt, Human
ucuccagaccuccaaucugggcucugacccca

SEQ ID NO: 506186 - RNA, 32 nt, Human
ucuccagagacagccccuccugugucuacaga

SEQ ID NO: 506187 - RNA, 20 nt, Human
ucuccagagacugcaugugc

SEQ ID NO: 506188 - RNA, 32 nt, Human
ucuccagagcaucauuccuuucuaucugcugc

SEQ ID NO: 506189 - RNA, 32 nt, Human
ucuccagauagugccuuugauugaaaauaagg

SEQ ID NO: 506190 - RNA, 32 nt, Human
ucuccagcaacccugcacuggggaaggcugug

SEQ ID NO: 506191 - RNA, 32 nt, Human
ucuccagcagccagagucucccagaaaacaac

SEQ ID NO: 506192 - RNA, 32 nt, Human
ucuccagcagccgccaucucacacgccucccu

SEQ ID NO: 506193 - RNA, 32 nt, Human
ucuccagcaggggaggcaacagagguagcaac

SEQ ID NO: 506194 - RNA, 32 nt, Human
ucuccagcaguuucgccuccugacucucacca

SEQ ID NO: 506195 - RNA, 20 nt, Human
ucuccagcauccaaugagug

SEQ ID NO: 506196 - RNA, 18 nt, Human
ucuccagcauucuugcca

SEQ ID NO: 506197 - RNA, 32 nt, Human
ucuccagcauuuccucucaccuccgagcucuc

SEQ ID NO: 506198 - RNA, 32 nt, Human
ucuccagcauuuccucucaccuccguguucuc

SEQ ID NO: 506199 - RNA, 32 nt, Human
ucuccagcauuuccucucaccucuguguucuc

SEQ ID NO: 506200 - RNA, 20 nt, Human
ucuccagccacugccgcgag

SEQ ID NO: 506201 - RNA, 32 nt, Human
ucuccagcccacaaguggcucuagugagacga

SEQ ID NO: 506202 - RNA, 18 nt, Human
ucuccagccccucucaag

SEQ ID NO: 506203 - RNA, 22 nt, Human
ucuccagccccugggcuggaag

SEQ ID NO: 506204 - RNA, 32 nt, Human
ucuccagcccgucuuggcuuauccacuuugac

SEQ ID NO: 506205 - RNA, 21 nt, Human
ucuccagcccuguccagcaag

SEQ ID NO: 506206 - RNA, 20 nt, Human
ucuccagccgaagcugcagg

SEQ ID NO: 506207 - RNA, 17 nt, Human
ucuccagccuccuugua

SEQ ID NO: 506208 - RNA, 21 nt, Human
ucuccagccugagcaacagag

SEQ ID NO: 506209 - RNA, 32 nt, Human
ucuccagccugggaaaaguucuccuuauuugu

SEQ ID NO: 506210 - RNA, 32 nt, Human
ucuccagccugggaacuauaacuccucugcga

SEQ ID NO: 506211 - RNA, 22 nt, Human
ucuccagccugggcaacagagu

SEQ ID NO: 506212 - RNA, 20 nt, Human
ucuccagccugggcgacaag

SEQ ID NO: 506213 - RNA, 22 nt, Human
ucuccagccugggcgacagagu

SEQ ID NO: 506214 - RNA, 32 nt, Human
ucuccagcuacacacuccaucucccgggagca

SEQ ID NO: 506215 - RNA, 32 nt, Human
ucuccagcuacauacucugccucagggccuuc

SEQ ID NO: 506216 - RNA, 18 nt, Human
ucuccagcuauucagaca

SEQ ID NO: 506217 - RNA, 32 nt, Human
ucuccagcucacugaaaacagccuccccugau

SEQ ID NO: 506218 - RNA, 18 nt, Human
ucuccagcucagcuucaa

SEQ ID NO: 506219 - RNA, 32 nt, Human
ucuccagcugugaacccaggaggucaaguggg

SEQ ID NO: 506220 - RNA, 32 nt, Human
ucuccagcuguggaaggguugcagccauuacc

SEQ ID NO: 506221 - RNA, 32 nt, Human
ucuccagcuguggugagcaaguuuccugaagu

SEQ ID NO: 506222 - RNA, 32 nt, Human
ucuccagcuuugacaaaucggugcucaccuua

SEQ ID NO: 506223 - RNA, 19 nt, Human
ucuccaggaagccuggcug

SEQ ID NO: 506224 - RNA, 32 nt, Human
ucuccaggaaggcagugaggggcugugacauu

SEQ ID NO: 506225 - RNA, 32 nt, Human
ucuccaggaagguggcgcugggcuacccaccc

SEQ ID NO: 506226 - RNA, 32 nt, Human
ucuccaggaagucugagccaccucuggcuaca

SEQ ID NO: 506227 - RNA, 21 nt, Human
ucuccaggaccuccacaccau

SEQ ID NO: 506228 - RNA, 32 nt, Human
ucuccaggacucagugguuucggagaaacucg

SEQ ID NO: 506229 - RNA, 32 nt, Human
ucuccaggacuccaccuaaggucaguuucucg

SEQ ID NO: 506230 - RNA, 32 nt, Human
ucuccaggacugucuucucacccuuccccacu

SEQ ID NO: 506231 - RNA, 32 nt, Human
ucuccaggagaaacuugaacggcuccagggau

SEQ ID NO: 506232 - RNA, 22 nt, Human
ucuccaggaggagcccagggcc

SEQ ID NO: 506233 - RNA, 16 nt, Human
ucuccaggaggccagg

SEQ ID NO: 506234 - RNA, 32 nt, Human
ucuccaggcaaguccccguccaaaaagaagaa

SEQ ID NO: 506235 - RNA, 19 nt, Human
ucuccaggcccagccucug

SEQ ID NO: 506236 - RNA, 32 nt, Human
ucuccaggcccagcuccggccucccagcggcc

SEQ ID NO: 506237 - RNA, 17 nt, Human
ucuccaggcccaucucu

SEQ ID NO: 506238 - RNA, 18 nt, Human
ucuccaggcccggaucuc

SEQ ID NO: 506239 - RNA, 32 nt, Human
ucuccaggccuaugguccugcccagcacgcca

SEQ ID NO: 506240 - RNA, 32 nt, Human
ucuccaggccuugcccacugagccuucagagg

SEQ ID NO: 506241 - RNA, 32 nt, Human
ucuccaggcgcugaguccgugccuccuuuuuc

SEQ ID NO: 506242 - RNA, 32 nt, Human
ucuccaggcugcugggcagcugggcagagcuc

SEQ ID NO: 506243 - RNA, 21 nt, Human
ucuccaggcuggagugcagug

SEQ ID NO: 506244 - RNA, 22 nt, Human
ucuccaggcuggagugcagugg

SEQ ID NO: 506245 - RNA, 32 nt, Human
ucuccaggcuugagugacagagcaagacugua

SEQ ID NO: 506246 - RNA, 22 nt, Human
ucuccaggcuuuucuccugccu

SEQ ID NO: 506247 - RNA, 32 nt, Human
ucuccagggaaaccacauuggggacuccgggg

SEQ ID NO: 506248 - RNA, 32 nt, Human
ucuccagggaaagugucagugaaaccucagcu

SEQ ID NO: 506249 - RNA, 32 nt, Human
ucuccagggaagaacccagagggagagcggga

SEQ ID NO: 506250 - RNA, 18 nt, Human
ucuccagggagcaggacc

SEQ ID NO: 506251 - RNA, 21 nt, Human
ucuccagggaguccaggaccu

SEQ ID NO: 506252 - RNA, 22 nt, Human
ucuccagggcagcacagggacc

SEQ ID NO: 506253 - RNA, 32 nt, Human
ucuccagggcucaguuugucuaucuccaaaau

SEQ ID NO: 506254 - RNA, 32 nt, Human
ucuccaggguaggccagcuugaggaaucuuau

SEQ ID NO: 506255 - RNA, 20 nt, Human
ucuccaggucaccaauggcu

SEQ ID NO: 506256 - RNA, 32 nt, Human
ucuccaggugccucucccucaccagcucugca

SEQ ID NO: 506257 - RNA, 32 nt, Human
ucuccagguucugucucucccauucugauucu

SEQ ID NO: 506258 - RNA, 32 nt, Human
ucuccaguagaaagcauaacaaaaagaugacc

SEQ ID NO: 506259 - RNA, 32 nt, Human
ucuccagucauuaaaucagugcugcugcauga

SEQ ID NO: 506260 - RNA, 32 nt, Human
ucuccaguccucuuuccugucacugcaucagg

SEQ ID NO: 506261 - RNA, 32 nt, Human
ucuccagucuccccagucuguuggugucuuua

SEQ ID NO: 506262 - RNA, 32 nt, Human
ucuccagugaugacucugcuucuaugagguca

SEQ ID NO: 506263 - RNA, 32 nt, Human
ucuccagugcagcccgccgccacuggagugcc

SEQ ID NO: 506264 - RNA, 24 nt, Human
ucuccagugcccuauagcugcaag

SEQ ID NO: 506265 - RNA, 32 nt, Human
ucuccagugccuaugaggucagcuggccaaac

SEQ ID NO: 506266 - RNA, 32 nt, Human
ucuccagugccuggauccccucugucuacaaa

SEQ ID NO: 506267 - RNA, 32 nt, Human
ucuccagugcuuccuugggcagccaguaauuc

SEQ ID NO: 506268 - RNA, 32 nt, Human
ucuccagugucuccuauuacaaagaagcuggc

SEQ ID NO: 506269 - RNA, 32 nt, Human
ucuccaguguguacccugccccucucugucau

SEQ ID NO: 506270 - RNA, 32 nt, Human
ucuccaguuuuggucccaucuuccugcuaccc

SEQ ID NO: 506271 - RNA, 32 nt, Human
ucuccaucaagcaauauuuccacuucaacuuc

SEQ ID NO: 506272 - RNA, 32 nt, Human
ucuccaucaaguuucaccaaaucauuuuaaca

SEQ ID NO: 506273 - RNA, 32 nt, Human
ucuccaucauugggggaguggaagggagcucc

SEQ ID NO: 506274 - RNA, 25 nt, Human
ucuccauccauacagguggcuccag

SEQ ID NO: 506275 - RNA, 32 nt, Human
ucuccauccccucccugccugcuccuuggcac

SEQ ID NO: 506276 - RNA, 32 nt, Human
ucuccauccccucuccccgcguggacuccuga

SEQ ID NO: 506277 - RNA, 32 nt, Human
ucuccauccucugcugaugccugcugucuuua

SEQ ID NO: 506278 - RNA, 32 nt, Human
ucuccauccuguuuucucccagacacaccaca

SEQ ID NO: 506279 - RNA, 32 nt, Human
ucuccauccuuccacccuccaguuaagcagca

SEQ ID NO: 506280 - RNA, 32 nt, Human
ucuccauccuucccucucccaaaagacauuuc

SEQ ID NO: 506281 - RNA, 32 nt, Human
ucuccaucuaccuuccagucaggaugacggua

SEQ ID NO: 506282 - RNA, 32 nt, Human
ucuccaucucaaagucagccuccagggagccc

SEQ ID NO: 506283 - RNA, 32 nt, Human
ucuccaucucccaaagugcugggaugacaggc

SEQ ID NO: 506284 - RNA, 32 nt, Human
ucuccaugaaaaugcauacguuaaugaacuaa

SEQ ID NO: 506285 - RNA, 32 nt, Human
ucuccaugagauacuuacuaauuucaaagggg

SEQ ID NO: 506286 - RNA, 32 nt, Human
ucuccauggagccagagguaguaugaagaguu

SEQ ID NO: 506287 - RNA, 32 nt, Human
ucuccauggcaggcaucccugccuugggcugc

SEQ ID NO: 506288 - RNA, 32 nt, Human
ucuccauggccaggcugccugugugcauguuc

SEQ ID NO: 506289 - RNA, 32 nt, Human
ucuccauguaacuugcucacaugccuaucuug

SEQ ID NO: 506290 - RNA, 32 nt, Human
ucuccaugugacacaugggcucagggcugcca

SEQ ID NO: 506291 - RNA, 20 nt, Human
ucuccaugugcugguugcag

SEQ ID NO: 506292 - RNA, 32 nt, Human
ucuccauguguaaacuucacccccaggaccca

SEQ ID NO: 506293 - RNA, 32 nt, Human
ucuccauguuaguaauggcagagcagucuaaa

SEQ ID NO: 506294 - RNA, 31 nt, Human
ucuccauucagcuagaaggaccaaagcaugu

SEQ ID NO: 506295 - RNA, 32 nt, Human
ucuccauucucccaaccucuugggccuggaag

SEQ ID NO: 506296 - RNA, 32 nt, Human
ucuccauuucacuugaccccugcccaccucuc

SEQ ID NO: 506297 - RNA, 32 nt, Human
ucuccauuucuacuucugucacaaaccacauu

SEQ ID NO: 506298 - RNA, 32 nt, Human
ucuccauuuucacuccuuccagccucuguccc

SEQ ID NO: 506299 - RNA, 32 nt, Human
ucuccauuuuuaacaaacucucuuaaguaauu

SEQ ID NO: 506300 - RNA, 32 nt, Human
ucuccauuuuucucuuucuccuccuggccugg

SEQ ID NO: 506301 - RNA, 32 nt, Human
ucucccaaaauguacaguaauuccauuuguuu

SEQ ID NO: 506302 - RNA, 32 nt, Human
ucucccaaagagcugggauuacaggcgugaga

SEQ ID NO: 506303 - RNA, 24 nt, Human
ucucccaaagaugcuaaaaacaca

SEQ ID NO: 506304 - RNA, 32 nt, Human
ucucccaaaguacugggauuacaggcgugagc

SEQ ID NO: 506305 - RNA, 32 nt, Human
ucucccaaagugcugagauuacaggcaugagu

SEQ ID NO: 506306 - RNA, 32 nt, Human
ucucccaaagugcugggaauacaggcaugagc

SEQ ID NO: 506307 - RNA, 32 nt, Human
ucucccaaagugcugggauuacagacaugagc

SEQ ID NO: 506308 - RNA, 32 nt, Human
ucucccaaagugcugggauuacaggcaugagc

SEQ ID NO: 506309 - RNA, 32 nt, Human
ucucccaaagugcugggauuacaggcgugagc

SEQ ID NO: 506310 - RNA, 32 nt, Human
ucucccaaagugcugggauuacaggcuugagc

SEQ ID NO: 506311 - RNA, 32 nt, Human
ucucccaaagugcugggauuacaggugugagc

SEQ ID NO: 506312 - RNA, 32 nt, Human
ucucccaaagugcugggauuauaggcaugagc

SEQ ID NO: 506313 - RNA, 32 nt, Human
ucucccaaagugcugggauuauaggcguaagc

SEQ ID NO: 506314 - RNA, 32 nt, Human
ucucccaaaguguugggauuacaggcaugagc

SEQ ID NO: 506315 - RNA, 32 nt, Human
ucucccaaaugagaagucauuaacuggaaauc

SEQ ID NO: 506316 - RNA, 32 nt, Human
ucucccaacauuuacuaacauccacuggucaa

SEQ ID NO: 506317 - RNA, 32 nt, Human
ucucccaaccagccaaggaauaaaagcugauc

SEQ ID NO: 506318 - RNA, 32 nt, Human
ucucccaaccucuugggccuggaagucagaca

SEQ ID NO: 506319 - RNA, 32 nt, Human
ucucccaacgugcugggauuacaggcaugagc

SEQ ID NO: 506320 - RNA, 32 nt, Human
ucucccaagaggagaaggaaugcgaaagagga

SEQ ID NO: 506321 - RNA, 32 nt, Human
ucucccaagaggagaggggcaggcaggaaaga

SEQ ID NO: 506322 - RNA, 32 nt, Human
ucucccaagaggagcagagaaaacuggaagaa

SEQ ID NO: 506323 - RNA, 32 nt, Human
ucucccaagcagcugggauuguagguacacac

SEQ ID NO: 506324 - RNA, 18 nt, Human
ucucccaaggagggcacc

SEQ ID NO: 506325 - RNA, 32 nt, Human
ucucccaaggggaucacuuagcuucucacuga

SEQ ID NO: 506326 - RNA, 19 nt, Human
ucucccaaggggugagugg

SEQ ID NO: 506327 - RNA, 32 nt, Human
ucucccaaguagcagggauuacaggcaugcac

SEQ ID NO: 506328 - RNA, 32 nt, Human
ucucccaaguagcuggaacuacaggcaugcac

SEQ ID NO: 506329 - RNA, 32 nt, Human
ucucccaaguagcugggacuacaagcaugcac

SEQ ID NO: 506330 - RNA, 32 nt, Human
ucucccaaguagcugggacuacaggcaggugc

SEQ ID NO: 506331 - RNA, 32 nt, Human
ucucccaaguagcugggacuacagguacgugc

SEQ ID NO: 506332 - RNA, 32 nt, Human
ucucccaaguagcugggacuauaggcacgugc

SEQ ID NO: 506333 - RNA, 32 nt, Human
ucucccaaguagcugggauuacaggugugcac

SEQ ID NO: 506334 - RNA, 32 nt, Human
ucucccaaguagcugggauuacaggugugugc

SEQ ID NO: 506335 - RNA, 32 nt, Human
ucucccaaguagcugggauuauaggcauccac

SEQ ID NO: 506336 - RNA, 32 nt, Human
ucucccaaguagcugggguuacaggugcacgc

SEQ ID NO: 506337 - RNA, 32 nt, Human
ucucccaaguggccacauacagcaacccacuc

SEQ ID NO: 506338 - RNA, 32 nt, Human
ucucccaauggaggggagguugcaggggagag

SEQ ID NO: 506339 - RNA, 32 nt, Human
ucucccaaugggguggcuuugcucugggcucc

SEQ ID NO: 506340 - RNA, 32 nt, Human
ucucccacacccccuccuacccucucuccugu

SEQ ID NO: 506341 - RNA, 32 nt, Human
ucucccacacucguuucccuuugcucaugacu

SEQ ID NO: 506342 - RNA, 32 nt, Human
ucucccacagcccagccagagacaagggaccu

SEQ ID NO: 506343 - RNA, 23 nt, Human
ucucccacagcuguggcugcagg

SEQ ID NO: 506344 - RNA, 32 nt, Human
ucucccaccacguccccagaucucaagaacgc

SEQ ID NO: 506345 - RNA, 32 nt, Human
ucucccaccaugcaugcaggucacugugugug

SEQ ID NO: 506346 - RNA, 22 nt, Human
ucucccaccaugugcagucuca

SEQ ID NO: 506347 - RNA, 32 nt, Human
ucucccacccacaacguguauuuuaaaccauu

SEQ ID NO: 506348 - RNA, 22 nt, Human
ucucccacccagccccaacccc

SEQ ID NO: 506349 - RNA, 21 nt, Human
ucucccacgacggcucacccu

SEQ ID NO: 506350 - RNA, 23 nt, Human
ucucccacuacagaccugccagg

SEQ ID NO: 506351 - RNA, 32 nt, Human
ucucccacuaugaaccucugauggccuuuucu

SEQ ID NO: 506352 - RNA, 32 nt, Human
ucucccacuccagccccaggacaggaaacaga

SEQ ID NO: 506353 - RNA, 32 nt, Human
ucucccacugcacacagggugguggcacauua

SEQ ID NO: 506354 - RNA, 32 nt, Human
ucucccacuguccuuggcucagcucuugucac

SEQ ID NO: 506355 - RNA, 32 nt, Human
ucucccacuuaccugcucuugugcaauguuuc

SEQ ID NO: 506356 - RNA, 32 nt, Human
ucucccagacacaccacaccuaccuuggggga

SEQ ID NO: 506357 - RNA, 32 nt, Human
ucucccagacuggacugcaguggcacaaucau

SEQ ID NO: 506358 - RNA, 32 nt, Human
ucucccagacuggagugaguggugugaucucg

SEQ ID NO: 506359 - RNA, 16 nt, Human
ucucccagaggccagg

SEQ ID NO: 506360 - RNA, 32 nt, Human
ucucccagaguguuaggauuacaggcgugagc

SEQ ID NO: 506361 - RNA, 32 nt, Human
ucucccagcacugacucacuccugccugggag

SEQ ID NO: 506362 - RNA, 21 nt, Human
ucucccagccaccuccuccca

SEQ ID NO: 506363 - RNA, 32 nt, Human
ucucccagccacuuucccuccuggcacugcca

SEQ ID NO: 506364 - RNA, 32 nt, Human
ucucccagccaucucugggguuacuaggaggc

SEQ ID NO: 506365 - RNA, 32 nt, Human
ucucccagccaucuuguucucucuccugaauu

SEQ ID NO: 506366 - RNA, 32 nt, Human
ucucccagcccaccucaagcagucuccccacc

SEQ ID NO: 506367 - RNA, 32 nt, Human
ucucccagccuccgcccugcccucacccagcc

SEQ ID NO: 506368 - RNA, 32 nt, Human
ucucccagcuccagccuuucuaguuucgaggc

SEQ ID NO: 506369 - RNA, 32 nt, Human
ucucccagcugguuucugcugcuucagaaaag

SEQ ID NO: 506370 - RNA, 30 nt, Human
ucucccagcuugcagguggacauccuagcc

SEQ ID NO: 506371 - RNA, 20 nt, Human
ucucccaggaagccagcucc

SEQ ID NO: 506372 - RNA, 32 nt, Human
ucucccaggacuuggggguggggugaaaagcg

SEQ ID NO: 506373 - RNA, 32 nt, Human
ucucccaggcaaggaccagcugcccauucuga

SEQ ID NO: 506374 - RNA, 18 nt, Human
ucucccaggcacgcaugg

SEQ ID NO: 506375 - RNA, 19 nt, Human
ucucccaggcaggccaugg

SEQ ID NO: 506376 - RNA, 32 nt, Human
ucucccaggccagagugcaguggcgcaauuac

SEQ ID NO: 506377 - RNA, 22 nt, Human
ucucccaggccggagugcagug

SEQ ID NO: 506378 - RNA, 32 nt, Human
ucucccaggccuggguggccucuguagcuggu

SEQ ID NO: 506379 - RNA, 22 nt, Human
ucucccaggcuagagugcaaug

SEQ ID NO: 506380 - RNA, 32 nt, Human
ucucccaggcuagagugcaauggcacaaccuc

SEQ ID NO: 506381 - RNA, 32 nt, Human
ucucccaggcuagagugcaguggugcaaucuc

SEQ ID NO: 506382 - RNA, 22 nt, Human
ucucccaggcugaagugcagug

SEQ ID NO: 506383 - RNA, 32 nt, Human
ucucccaggcugaagugcagugagucaagauu

SEQ ID NO: 506384 - RNA, 32 nt, Human
ucucccaggcugcuggagugcaguggcacaau

SEQ ID NO: 506385 - RNA, 32 nt, Human
ucucccaggcuggaauguagggugugcucaua

SEQ ID NO: 506386 - RNA, 32 nt, Human
ucucccaggcuggacugcagcagcgcagucuc

SEQ ID NO: 506387 - RNA, 32 nt, Human
ucucccaggcuggacugcaguggugcgauucu

SEQ ID NO: 506388 - RNA, 32 nt, Human
ucucccaggcuggagcguaguaaugcaaucau

SEQ ID NO: 506389 - RNA, 32 nt, Human
ucucccaggcuggaggucaguggcacaaaucu

SEQ ID NO: 506390 - RNA, 22 nt, Human
ucucccaggcuggaguacagug

SEQ ID NO: 506391 - RNA, 21 nt, Human
ucucccaggcuggagugcaau

SEQ ID NO: 506392 - RNA, 32 nt, Human
ucucccaggcuggagugcaaucgcgcaaucuc

SEQ ID NO: 506393 - RNA, 22 nt, Human
ucucccaggcuggagugcaaug

SEQ ID NO: 506394 - RNA, 32 nt, Human
ucucccaggcuggagugcaauggugcaaucuu

SEQ ID NO: 506395 - RNA, 22 nt, Human
ucucccaggcuggagugcacug

SEQ ID NO: 506396 - RNA, 32 nt, Human
ucucccaggcuggagugcaggcuuggaguuuu

SEQ ID NO: 506397 - RNA, 22 nt, Human
ucucccaggcuggagugcagug

SEQ ID NO: 506398 - RNA, 23 nt, Human
ucucccaggcuggagugcagugg

SEQ ID NO: 506399 - RNA, 32 nt, Human
ucucccaggcuggagugcaguggagugaucuc

SEQ ID NO: 506400 - RNA, 32 nt, Human
ucucccaggcuggagugcaguggcacaaucaa

SEQ ID NO: 506401 - RNA, 32 nt, Human
ucucccaggcuggagugcaguggcacaaucau

SEQ ID NO: 506402 - RNA, 32 nt, Human
ucucccaggcuggagugcaguggcacagucuu

SEQ ID NO: 506403 - RNA, 32 nt, Human
ucucccaggcuggagugcaguggcacaucucg

SEQ ID NO: 506404 - RNA, 32 nt, Human
ucucccaggcuggagugcaguggcguaaucuc

SEQ ID NO: 506405 - RNA, 32 nt, Human
ucucccaggcuggagugcaguggcgugaucuu

SEQ ID NO: 506406 - RNA, 32 nt, Human
ucucccaggcuggagugcaguggugcaaucuc

SEQ ID NO: 506407 - RNA, 32 nt, Human
ucucccaggcuggagugcagugguguaaucac

SEQ ID NO: 506408 - RNA, 32 nt, Human
ucucccaggcuggagugcgguggcacaaucuc

SEQ ID NO: 506409 - RNA, 32 nt, Human
ucucccaggcuggagugcuauggugcaauuuu

SEQ ID NO: 506410 - RNA, 32 nt, Human
ucucccaggcuggagugugauggcgugaucuc

SEQ ID NO: 506411 - RNA, 32 nt, Human
ucucccaggcuggaguugcaguggugcaauga

SEQ ID NO: 506412 - RNA, 22 nt, Human
ucucccaggcuggcagcauugg

SEQ ID NO: 506413 - RNA, 32 nt, Human
ucucccagggccugggugugcuucguguggcc

SEQ ID NO: 506414 - RNA, 32 nt, Human
ucucccagggucaugcagggaucugcucccuc

SEQ ID NO: 506415 - RNA, 32 nt, Human
ucucccagguagcugggauuacaggcaugugc

SEQ ID NO: 506416 - RNA, 32 nt, Human
ucucccaggucaucugccugcccacacgcucc

SEQ ID NO: 506417 - RNA, 32 nt, Human
ucucccaggugaggauucacaucccaaaauaa

SEQ ID NO: 506418 - RNA, 32 nt, Human
ucucccaguccucaucuuccacccuaaaacua

SEQ ID NO: 506419 - RNA, 22 nt, Human
ucucccaguggagcucugcagg

SEQ ID NO: 506420 - RNA, 32 nt, Human
ucucccaguggaggaaggugugcaguguacuu

SEQ ID NO: 506421 - RNA, 21 nt, Human
ucucccauaacugccccagca

SEQ ID NO: 506422 - RNA, 32 nt, Human
ucucccauacauaggaguggccucaaggccac

SEQ ID NO: 506423 - RNA, 32 nt, Human
ucucccaucaaaggaccugcacagccuuauga

SEQ ID NO: 506424 - RNA, 32 nt, Human
ucucccaucaaaggacgugcacagccuuauga

SEQ ID NO: 506425 - RNA, 19 nt, Human
ucucccaucagugcugugg

SEQ ID NO: 506426 - RNA, 32 nt, Human
ucucccaucccccugcccucguggccagcccg

SEQ ID NO: 506427 - RNA, 32 nt, Human
ucucccauccuuuuuccuucccaaaccucuau

SEQ ID NO: 506428 - RNA, 32 nt, Human
ucuccccaaaacccuucuugcaugcaggaugu

SEQ ID NO: 506429 - RNA, 23 nt, Human
ucuccccaaaacucuguguggug

SEQ ID NO: 506430 - RNA, 21 nt, Human
ucuccccaaagcagccccaca

SEQ ID NO: 506431 - RNA, 24 nt, Human
ucuccccaaaucagugagcaccuu

SEQ ID NO: 506432 - RNA, 32 nt, Human
ucuccccaacccccaagaaccccacuacugcu

SEQ ID NO: 506433 - RNA, 32 nt, Human
ucuccccaacugcccugcucuccucauacuca

SEQ ID NO: 506434 - RNA, 32 nt, Human
ucuccccaaggcaggccauagaaacuaaaagu

SEQ ID NO: 506435 - RNA, 32 nt, Human
ucuccccaagggccaagaacugcucagggaca

SEQ ID NO: 506436 - RNA, 21 nt, Human
ucuccccaaggggagcagccc

SEQ ID NO: 506437 - RNA, 23 nt, Human
ucuccccaaggucuguggcuccu

SEQ ID NO: 506438 - RNA, 20 nt, Human
ucuccccaagugcaacaccu

SEQ ID NO: 506439 - RNA, 32 nt, Human
ucuccccacacccuggaguggcaugguccugu

SEQ ID NO: 506440 - RNA, 32 nt, Human
ucuccccacagccucugcugaugcacagagcu

SEQ ID NO: 506441 - RNA, 32 nt, Human
ucuccccacaucucccuuuccacuugccagug

SEQ ID NO: 506442 - RNA, 21 nt, Human
ucuccccaccaccagcagccu

SEQ ID NO: 506443 - RNA, 32 nt, Human
ucuccccaccacgucugugcccugcacugucc

SEQ ID NO: 506444 - RNA, 32 nt, Human
ucuccccacccccaccuuguucaucaggggcc

SEQ ID NO: 506445 - RNA, 20 nt, Human
ucuccccacccucagcuccu

SEQ ID NO: 506446 - RNA, 21 nt, Human
ucuccccacuccagccaccuu

SEQ ID NO: 506447 - RNA, 32 nt, Human
ucuccccacuccccacucucagccugggagac

SEQ ID NO: 506448 - RNA, 19 nt, Human
ucuccccacucugaucccc

SEQ ID NO: 506449 - RNA, 32 nt, Human
ucuccccacuggagguggagggugggaagaga

SEQ ID NO: 506450 - RNA, 32 nt, Human
ucuccccagagcugucuggacagccuuuccug

SEQ ID NO: 506451 - RNA, 32 nt, Human
ucuccccagcccugcuugccugccucggagag

SEQ ID NO: 506452 - RNA, 32 nt, Human
ucuccccagccuccccgugccaaaaaucuuuu

SEQ ID NO: 506453 - RNA, 21 nt, Human
ucuccccagccucgccuucag

SEQ ID NO: 506454 - RNA, 32 nt, Human
ucuccccagccuguuuucucuuuucuaaaaga

SEQ ID NO: 506455 - RNA, 32 nt, Human
ucuccccaggagccccagccccagagugguuu

SEQ ID NO: 506456 - RNA, 32 nt, Human
ucuccccaggagggaggucguggugcaggcga

SEQ ID NO: 506457 - RNA, 32 nt, Human
ucuccccagggguuuucccugcagugaggcuu

SEQ ID NO: 506458 - RNA, 20 nt, Human
ucuccccaggguucagcccu

SEQ ID NO: 506459 - RNA, 32 nt, Human
ucuccccaguaccugggauuacagguagacac

SEQ ID NO: 506460 - RNA, 32 nt, Human
ucuccccaguagcugggauuacaggugcccgc

SEQ ID NO: 506461 - RNA, 24 nt, Human
ucuccccaguccccaguucacccu

SEQ ID NO: 506462 - RNA, 31 nt, Human
ucuccccaguuucauuccuugguccuuacuc

SEQ ID NO: 506463 - RNA, 19 nt, Human
ucuccccaucccaggagga

SEQ ID NO: 506464 - RNA, 21 nt, Human
ucuccccaucccuauagcuca

SEQ ID NO: 506465 - RNA, 24 nt, Human
ucuccccaucuauuuuaggggcug

SEQ ID NO: 506466 - RNA, 32 nt, Human
ucuccccaucuccagccccucccucuggguuc

SEQ ID NO: 506467 - RNA, 32 nt, Human
ucuccccauuuccaaaccaugauaugaauggg

SEQ ID NO: 506468 - RNA, 22 nt, Human
ucucccccaaaagaccugggug

SEQ ID NO: 506469 - RNA, 32 nt, Human
ucucccccaacaaaacccauaccuaucaagcu

SEQ ID NO: 506470 - RNA, 32 nt, Human
ucucccccaagugagcugcaagaggccccugu

SEQ ID NO: 506471 - RNA, 32 nt, Human
ucucccccaaucuccucagccaccucaaauca

SEQ ID NO: 506472 - RNA, 32 nt, Human
ucucccccaccaggacuuagugcaaggaggua

SEQ ID NO: 506473 - RNA, 22 nt, Human
ucucccccaccucagggugcug

SEQ ID NO: 506474 - RNA, 24 nt, Human
ucucccccagccucccaggcugga

SEQ ID NO: 506475 - RNA, 32 nt, Human
ucucccccagcuugcucaacaggugaccuuac

SEQ ID NO: 506476 - RNA, 32 nt, Human
ucucccccagggagcaucaggaagggacaugg

SEQ ID NO: 506477 - RNA, 32 nt, Human
ucucccccaucaaugcuccaucuugucggucu

SEQ ID NO: 506478 - RNA, 26 nt, Human
ucuccccccgcaccauccguguccug

SEQ ID NO: 506479 - RNA, 32 nt, Human
ucucccccgcccacgaguuccccucugguggc

SEQ ID NO: 506480 - RNA, 32 nt, Human
ucucccccuaguuugugagaaacaucucaaua

SEQ ID NO: 506481 - RNA, 32 nt, Human
ucucccccucaccaaucucuuucuucccuccu

SEQ ID NO: 506482 - RNA, 32 nt, Human
ucucccccucaccuucuaaggucagcucuagc

SEQ ID NO: 506483 - RNA, 32 nt, Human
ucucccccucaggacagggagucuguccaucc

SEQ ID NO: 506484 - RNA, 32 nt, Human
ucucccccucauuucucuuccuccucaccucc

SEQ ID NO: 506485 - RNA, 32 nt, Human
ucucccccuccacccccucccccaccccggag

SEQ ID NO: 506486 - RNA, 32 nt, Human
ucucccccuccagcuuccucggacaaccuggc

SEQ ID NO: 506487 - RNA, 32 nt, Human
ucucccccuccaguaguagcugggugagaccu

SEQ ID NO: 506488 - RNA, 32 nt, Human
ucucccccuccccaguguccucuccucucagg

SEQ ID NO: 506489 - RNA, 32 nt, Human
ucucccccucccccaucuccagucuccuaggu

SEQ ID NO: 506490 - RNA, 32 nt, Human
ucucccccucccccucccccacucccccuccc

SEQ ID NO: 506491 - RNA, 32 nt, Human
ucucccccuccccuccccucccucgcgcuguc

SEQ ID NO: 506492 - RNA, 32 nt, Human
ucucccccuccccuuucucuuucuuuccaaca

SEQ ID NO: 506493 - RNA, 20 nt, Human
ucucccccucccucaggaug

SEQ ID NO: 506494 - RNA, 32 nt, Human
ucucccccuucagcuccugaguagcugggccu

SEQ ID NO: 506495 - RNA, 32 nt, Human
ucucccccuuccccuagacuuuucuuacgaaa

SEQ ID NO: 506496 - RNA, 32 nt, Human
ucucccccuucucuccccuucuuccucgguuu

SEQ ID NO: 506497 - RNA, 32 nt, Human
ucucccccuuucucucuucucuuggcucacuc

SEQ ID NO: 506498 - RNA, 32 nt, Human
ucuccccgagugccuggauuacaggcaugagc

SEQ ID NO: 506499 - RNA, 24 nt, Human
ucuccccgccacccgcucgucccc

SEQ ID NO: 506500 - RNA, 24 nt, Human
ucuccccgcccagccagcagccuu

SEQ ID NO: 506501 - RNA, 23 nt, Human
ucuccccgccucauucccacccc

SEQ ID NO: 506502 - RNA, 32 nt, Human
ucuccccgcugagcugcugccuggugaagagg

SEQ ID NO: 506503 - RNA, 32 nt, Human
ucuccccgcugcaaccauuccaccagucuguu

SEQ ID NO: 506504 - RNA, 21 nt, Human
ucuccccggaggcucagcccc

SEQ ID NO: 506505 - RNA, 24 nt, Human
ucuccccggagugcacagcuccac

SEQ ID NO: 506506 - RNA, 21 nt, Human
ucuccccggccaugugugcug

SEQ ID NO: 506507 - RNA, 32 nt, Human
ucuccccggccccagcucuggacgcucacccc

SEQ ID NO: 506508 - RNA, 32 nt, Human
ucuccccguccugguccagggcuggggucuuu

SEQ ID NO: 506509 - RNA, 32 nt, Human
ucuccccucacacuuugccauuugcuuguacu

SEQ ID NO: 506510 - RNA, 32 nt, Human
ucuccccuccaggccaccugucucuguaaagg

SEQ ID NO: 506511 - RNA, 32 nt, Human
ucuccccucccucccaccuuuuucuuuccuuc

SEQ ID NO: 506512 - RNA, 32 nt, Human
ucuccccuccuccaaacuucaacuccuccaug

SEQ ID NO: 506513 - RNA, 32 nt, Human
ucuccccuccugcccuucgcuccuggguuggu

SEQ ID NO: 506514 - RNA, 18 nt, Human
ucuccccuccugcugcug

SEQ ID NO: 506515 - RNA, 32 nt, Human
ucuccccucgaauucccugauggugguggggu

SEQ ID NO: 506516 - RNA, 32 nt, Human
ucuccccucuacuucucauucccuacucucug

SEQ ID NO: 506517 - RNA, 32 nt, Human
ucuccccucugccuccugcuuugcuguugccg

SEQ ID NO: 506518 - RNA, 32 nt, Human
ucuccccucuuuccuucugccgguccuuuugg

SEQ ID NO: 506519 - RNA, 32 nt, Human
ucuccccugcagcuuccucugcuucuggaaug

SEQ ID NO: 506520 - RNA, 32 nt, Human
ucuccccugcgcaggcccuccgcgggggacag

SEQ ID NO: 506521 - RNA, 32 nt, Human
ucuccccugcucaugggugcuccuccucaggg

SEQ ID NO: 506522 - RNA, 32 nt, Human
ucuccccugcucucccaccucuaccuccaccc

SEQ ID NO: 506523 - RNA, 32 nt, Human
ucuccccugcugcuugagaugccagagcugug

SEQ ID NO: 506524 - RNA, 32 nt, Human
ucuccccuguuccccucucccuucccuccucc

SEQ ID NO: 506525 - RNA, 32 nt, Human
ucuccccuuccaaccccauuuccccagcccau

SEQ ID NO: 506526 - RNA, 32 nt, Human
ucuccccuuccaggagugcacagucugcgggu

SEQ ID NO: 506527 - RNA, 32 nt, Human
ucuccccuuccggugcucacacgcccacgccg

SEQ ID NO: 506528 - RNA, 32 nt, Human
ucuccccuuccuuucucucucuuccagaaguc

SEQ ID NO: 506529 - RNA, 32 nt, Human
ucuccccuucuggcuuuccacccggccugcug

SEQ ID NO: 506530 - RNA, 32 nt, Human
ucuccccuugggacaguaguguuugggugaau

SEQ ID NO: 506531 - RNA, 32 nt, Human
ucuccccuuuccacagccuccaccccugaccc

SEQ ID NO: 506532 - RNA, 32 nt, Human
ucuccccuuuccccauccucuaucuaucccug

SEQ ID NO: 506533 - RNA, 32 nt, Human
ucuccccuuucccuccccagcccggccccugg

SEQ ID NO: 506534 - RNA, 32 nt, Human
ucuccccuuuugcuugagcaggguucccagga

SEQ ID NO: 506535 - RNA, 32 nt, Human
ucucccgaaaauacaaaauuagccaggcgugg

SEQ ID NO: 506536 - RNA, 32 nt, Human
ucucccgaagugcugggauuacaggugugagc

SEQ ID NO: 506537 - RNA, 32 nt, Human
ucucccgacuagcugggacuacaggcgcccgc

SEQ ID NO: 506538 - RNA, 32 nt, Human
ucucccgaguagcuaggauuacagaugugcau

SEQ ID NO: 506539 - RNA, 32 nt, Human
ucucccgaguagcugggacuacaggcaccugc

SEQ ID NO: 506540 - RNA, 32 nt, Human
ucucccgaguagcugggauuacaggcacuugc

SEQ ID NO: 506541 - RNA, 32 nt, Human
ucucccgaguagcugggauuacaggcgugcgc

SEQ ID NO: 506542 - RNA, 32 nt, Human
ucucccgaguagcugggauuauaggcgcccgc

SEQ ID NO: 506543 - RNA, 32 nt, Human
ucucccgaguaguggaaauuacaggugugugc

SEQ ID NO: 506544 - RNA, 32 nt, Human
ucucccgaguaguuggaauuacaggugcaugc

SEQ ID NO: 506545 - RNA, 32 nt, Human
ucucccgaguggcugggauuauaggcgugcac

SEQ ID NO: 506546 - RNA, 32 nt, Human
ucucccgcaggacccccuaaucuucagggcag

SEQ ID NO: 506547 - RNA, 32 nt, Human
ucucccgccccaggcccugcucuuccugcuug

SEQ ID NO: 506548 - RNA, 32 nt, Human
ucucccgccgccuccccggccuggugacacca

SEQ ID NO: 506549 - RNA, 32 nt, Human
ucucccgccucaguagcugggauuacaggugc

SEQ ID NO: 506550 - RNA, 32 nt, Human
ucucccgcugggacacacacaggggccgggga

SEQ ID NO: 506551 - RNA, 32 nt, Human
ucucccggaagccuggggucccuccacaccuu

SEQ ID NO: 506552 - RNA, 32 nt, Human
ucucccggacagacgccuugcccagggugugu

SEQ ID NO: 506553 - RNA, 32 nt, Human
ucucccggaggcaggggucccugggacuggcg

SEQ ID NO: 506554 - RNA, 32 nt, Human
ucucccggccaucuuguugcucucuccugaau

SEQ ID NO: 506555 - RNA, 32 nt, Human
ucucccggccgagccuagcugcggcuggacac

SEQ ID NO: 506556 - RNA, 32 nt, Human
ucucccggcgugccuggcagugugguggccuc

SEQ ID NO: 506557 - RNA, 23 nt, Human
ucucccggcuggguugucaguca

SEQ ID NO: 506558 - RNA, 32 nt, Human
ucucccgggcuggagugcaguggcgcgaucuc

SEQ ID NO: 506559 - RNA, 32 nt, Human
ucucccgggcuguacccugccugcuucuccca

SEQ ID NO: 506560 - RNA, 32 nt, Human
ucucccggggacugcagcggaggcagagccag

SEQ ID NO: 506561 - RNA, 32 nt, Human
ucucccgguggggcagaggacccggugccugc

SEQ ID NO: 506562 - RNA, 32 nt, Human
ucucccgucaccacaucuccccucacccucac

SEQ ID NO: 506563 - RNA, 20 nt, Human
ucucccguccagagcccugc

SEQ ID NO: 506564 - RNA, 32 nt, Human
ucucccguccagcccuggcugcagccucccag

SEQ ID NO: 506565 - RNA, 28 nt, Human
ucucccgugacugcugccucaucgauac

SEQ ID NO: 506566 - RNA, 23 nt, Human
ucucccguuccuuuaggcugccg

SEQ ID NO: 506567 - RNA, 32 nt, Human
ucucccguuggcuccacuguaccgggggcuga

SEQ ID NO: 506568 - RNA, 32 nt, Human
ucucccuaaaauuucuauguugaagucuuaac

SEQ ID NO: 506569 - RNA, 32 nt, Human
ucucccuaauaaaaauuggagcucuuuuccac

SEQ ID NO: 506570 - RNA, 32 nt, Human
ucucccuaauagccucagucucugccuucagu

SEQ ID NO: 506571 - RNA, 32 nt, Human
ucucccuaguagguggaacuacaggcauguac

SEQ ID NO: 506572 - RNA, 32 nt, Human
ucucccuauguugcccaggcagaucucagacu

SEQ ID NO: 506573 - RNA, 32 nt, Human
ucucccucacaccucccuucaucccaggguau

SEQ ID NO: 506574 - RNA, 31 nt, Human
ucucccucagauccuccccacagcucagcgu

SEQ ID NO: 506575 - RNA, 32 nt, Human
ucucccucagccaaguccuuccuuacaaugaa

SEQ ID NO: 506576 - RNA, 32 nt, Human
ucucccuccaaagaagagcaugggagaggugg

SEQ ID NO: 506577 - RNA, 32 nt, Human
ucucccuccacacugcagccgggagccucugc

SEQ ID NO: 506578 - RNA, 32 nt, Human
ucucccuccagccugggcuacucuccuccugg

SEQ ID NO: 506579 - RNA, 32 nt, Human
ucucccuccauggcaggaaggcgggggauuuc

SEQ ID NO: 506580 - RNA, 32 nt, Human
ucucccuccauuguucagcucuguacuuggau

SEQ ID NO: 506581 - RNA, 32 nt, Human
ucucccuccauuucgucccuugccugccuucc

SEQ ID NO: 506582 - RNA, 32 nt, Human
ucucccuccccucaucccacaucucaaagcag

SEQ ID NO: 506583 - RNA, 21 nt, Human
ucucccuccccuuuccuuucc

SEQ ID NO: 506584 - RNA, 32 nt, Human
ucucccucccguuucaggggaaaggucugagu

SEQ ID NO: 506585 - RNA, 32 nt, Human
ucucccucccuccuucacucccucucucuccc

SEQ ID NO: 506586 - RNA, 32 nt, Human
ucucccucccucucucaugaggcacagccaag

SEQ ID NO: 506587 - RNA, 32 nt, Human
ucucccuccggaccuaccucagggagcugagc

SEQ ID NO: 506588 - RNA, 32 nt, Human
ucucccuccuccagaucccugccuccuagugc

SEQ ID NO: 506589 - RNA, 32 nt, Human
ucucccuccucccucgcucucucccccuucuc

SEQ ID NO: 506590 - RNA, 32 nt, Human
ucucccuccuccuccuccuccgagcugcuagc

SEQ ID NO: 506591 - RNA, 32 nt, Human
ucucccuccucuccuuuccucuuccaguaucu

SEQ ID NO: 506592 - RNA, 32 nt, Human
ucucccuccugccucaacuggggcugcuggaa

SEQ ID NO: 506593 - RNA, 32 nt, Human
ucucccuccuucccagcccacccgggcagcag

SEQ ID NO: 506594 - RNA, 32 nt, Human
ucucccuccuuccuugggccugccucaguucc

SEQ ID NO: 506595 - RNA, 32 nt, Human
ucucccuccuuuccuuucucccuucccccacc

SEQ ID NO: 506596 - RNA, 21 nt, Human
ucucccuccuuucuccuuccc

SEQ ID NO: 506597 - RNA, 32 nt, Human
ucucccucgcagcugcuucuugcuuuucuuuc

SEQ ID NO: 506598 - RNA, 32 nt, Human
ucucccucgcuccacgcccuccagggggccgc

SEQ ID NO: 506599 - RNA, 32 nt, Human
ucucccucgggacccaaggccacaaaggagag

SEQ ID NO: 506600 - RNA, 32 nt, Human
ucucccucucaggcagagagguugccgaguga

SEQ ID NO: 506601 - RNA, 32 nt, Human
ucucccucucagggguagcagagacaggguug

SEQ ID NO: 506602 - RNA, 32 nt, Human
ucucccucuccaagcaucuguaaguugcacuc

SEQ ID NO: 506603 - RNA, 32 nt, Human
ucucccucuccccaagcucagaggugcucaga

SEQ ID NO: 506604 - RNA, 32 nt, Human
ucucccucuccucucucccucucccucucccu

SEQ ID NO: 506605 - RNA, 32 nt, Human
ucucccucucucucaucuuacauuucucaccc

SEQ ID NO: 506606 - RNA, 32 nt, Human
ucucccucucugagaggagcagcagaugcuca

SEQ ID NO: 506607 - RNA, 32 nt, Human
ucucccucugaacuucucuucauaaagucauu

SEQ ID NO: 506608 - RNA, 24 nt, Human
ucucccucugccacgcuuaggcug

SEQ ID NO: 506609 - RNA, 23 nt, Human
ucucccucugccuuuccgcggcc

SEQ ID NO: 506610 - RNA, 32 nt, Human
ucucccucugcucuccaguucccuggaccccc

SEQ ID NO: 506611 - RNA, 32 nt, Human
ucucccucuggacacugcgggccagguguaca

SEQ ID NO: 506612 - RNA, 22 nt, Human
ucucccucugucccccaggcug

SEQ ID NO: 506613 - RNA, 32 nt, Human
ucucccucuguggcuucuuggagccgcauaga

SEQ ID NO: 506614 - RNA, 22 nt, Human
ucucccucuguuuuuugcugcc

SEQ ID NO: 506615 - RNA, 32 nt, Human
ucucccucuucuuccucuaauugugaccguuu

SEQ ID NO: 506616 - RNA, 32 nt, Human
ucucccucuuucucaguuccucuuucuuuucu

SEQ ID NO: 506617 - RNA, 22 nt, Human
ucucccugaauccagagcgcug

SEQ ID NO: 506618 - RNA, 32 nt, Human
ucucccugacugccgcucacacugccgugaga

SEQ ID NO: 506619 - RNA, 32 nt, Human
ucucccugagugagacuugccugcuucucugg

SEQ ID NO: 506620 - RNA, 32 nt, Human
ucucccugcaaccuccgccuccuggguugaag

SEQ ID NO: 506621 - RNA, 32 nt, Human
ucucccugcacauaaagcagguuguagaacgu

SEQ ID NO: 506622 - RNA, 32 nt, Human
ucucccugcagccccuggcuucccagccuucc

SEQ ID NO: 506623 - RNA, 32 nt, Human
ucucccugcauccugaaugaugcuuagucaga

SEQ ID NO: 506624 - RNA, 32 nt, Human
ucucccugcauccuuguccuugcaggugcuuu

SEQ ID NO: 506625 - RNA, 32 nt, Human
ucucccugcaucuuccucuccuuucccaaggc

SEQ ID NO: 506626 - RNA, 32 nt, Human
ucucccugcaugacagucccccagaaacuuag

SEQ ID NO: 506627 - RNA, 32 nt, Human
ucucccugccaaagcccaacucccagggcucu

SEQ ID NO: 506628 - RNA, 32 nt, Human
ucucccugccacagggacccagaagacccgcu

SEQ ID NO: 506629 - RNA, 32 nt, Human
ucucccugccacccuuccccaguucaccaaac

SEQ ID NO: 506630 - RNA, 22 nt, Human
ucucccugccagcggagugcug

SEQ ID NO: 506631 - RNA, 32 nt, Human
ucucccugcccuaaggagggugugaugccagc

SEQ ID NO: 506632 - RNA, 32 nt, Human
ucucccugccgccucugccugggcucccacuu

SEQ ID NO: 506633 - RNA, 32 nt, Human
ucucccugccucacuccucuaggcaggggagu

SEQ ID NO: 506634 - RNA, 32 nt, Human
ucucccugcuaccuccugcugggcugcuccug

SEQ ID NO: 506635 - RNA, 32 nt, Human
ucucccugcucacccucugcugggccaggcac

SEQ ID NO: 506636 - RNA, 22 nt, Human
ucucccugcuccccucaacccc

SEQ ID NO: 506637 - RNA, 20 nt, Human
ucucccugcuccuggugccu

SEQ ID NO: 506638 - RNA, 32 nt, Human
ucucccugcucuggauagcagauccgcuggcu

SEQ ID NO: 506639 - RNA, 27 nt, Human
ucucccugcugccucucugggguucug

SEQ ID NO: 506640 - RNA, 32 nt, Human
ucucccugcuucuccccuuugucaucucugau

SEQ ID NO: 506641 - RNA, 32 nt, Human
ucucccuggaacgggagggacagggaauuuuu

SEQ ID NO: 506642 - RNA, 21 nt, Human
ucucccuggacccugccuuca

SEQ ID NO: 506643 - RNA, 32 nt, Human
ucucccuggauggcaggaaggaagcagguggg

SEQ ID NO: 506644 - RNA, 32 nt, Human
ucucccuggcuagggugugguggugugaucuu

SEQ ID NO: 506645 - RNA, 19 nt, Human
ucucccuggcuggagcagg

SEQ ID NO: 506646 - RNA, 32 nt, Human
ucucccugggaggcgggcgcacugccucucac

SEQ ID NO: 506647 - RNA, 19 nt, Human
ucucccugggaggcucagg

SEQ ID NO: 506648 - RNA, 21 nt, Human
ucucccugggcacccugcagg

SEQ ID NO: 506649 - RNA, 32 nt, Human
ucucccuggggagcccgggugggcaggaacaa

SEQ ID NO: 506650 - RNA, 16 nt, Human
ucucccuggggccagg

SEQ ID NO: 506651 - RNA, 32 nt, Human
ucucccuguaggaaggcaaucugggccguaau

SEQ ID NO: 506652 - RNA, 32 nt, Human
ucucccugucagguugcacagaugcauguaga

SEQ ID NO: 506653 - RNA, 32 nt, Human
ucucccuguccacccuucccuucguggacaga

SEQ ID NO: 506654 - RNA, 32 nt, Human
ucucccugucucucccccgcugccauuuugau

SEQ ID NO: 506655 - RNA, 32 nt, Human
ucucccuguguccccuuccugcuuugagcuag

SEQ ID NO: 506656 - RNA, 32 nt, Human
ucucccuguguucugggcuggggccaccuuug

SEQ ID NO: 506657 - RNA, 18 nt, Human
ucucccuuaagcaguguu

SEQ ID NO: 506658 - RNA, 32 nt, Human
ucucccuucaggcggagguugcagugagccga

SEQ ID NO: 506659 - RNA, 32 nt, Human
ucucccuucauaucuuuucaccuauuuccagu

SEQ ID NO: 506660 - RNA, 24 nt, Human
ucucccuuccaagcuagagggcug

SEQ ID NO: 506661 - RNA, 21 nt, Human
ucucccuuccagcaauaagug

SEQ ID NO: 506662 - RNA, 23 nt, Human
ucucccuucccccaccaaccucu

SEQ ID NO: 506663 - RNA, 32 nt, Human
ucucccuucuaucuuucuuuuugagguggugg

SEQ ID NO: 506664 - RNA, 25 nt, Human
ucucccuucucaacuuagggcggcg

SEQ ID NO: 506665 - RNA, 18 nt, Human
ucucccuucuccaaugag

SEQ ID NO: 506666 - RNA, 32 nt, Human
ucucccuucucccacuagaaugaggacucgau

SEQ ID NO: 506667 - RNA, 32 nt, Human
ucucccuucucccacuugccuacccucaaugc

SEQ ID NO: 506668 - RNA, 32 nt, Human
ucucccuucucccuugucaucagacacauugu

SEQ ID NO: 506669 - RNA, 32 nt, Human
ucucccuucuccuucccggccccaccaacacu

SEQ ID NO: 506670 - RNA, 19 nt, Human
ucucccuucucuggggcgc

SEQ ID NO: 506671 - RNA, 32 nt, Human
ucucccuucucuuucucgcauaacuccccacc

SEQ ID NO: 506672 - RNA, 20 nt, Human
ucucccuucugaaaugagug

SEQ ID NO: 506673 - RNA, 32 nt, Human
ucucccuugccagccagcacucugccuucugu

SEQ ID NO: 506674 - RNA, 32 nt, Human
ucucccuugcccaauccugcuucuuuccuuuc

SEQ ID NO: 506675 - RNA, 25 nt, Human
ucucccuuggguuuuaugggcgcug

SEQ ID NO: 506676 - RNA, 22 nt, Human
ucucccuuucccccgaugaaug

SEQ ID NO: 506677 - RNA, 23 nt, Human
ucucccuuucguuccccuucacu

SEQ ID NO: 506678 - RNA, 32 nt, Human
ucucccuuucucccccucucucucugccuuag

SEQ ID NO: 506679 - RNA, 32 nt, Human
ucucccuuucucccucgcuccccaccaacucu

SEQ ID NO: 506680 - RNA, 22 nt, Human
ucucccuuucugaucugucucc

SEQ ID NO: 506681 - RNA, 32 nt, Human
ucucccuuucugcuugcucuucuguuugcggu

SEQ ID NO: 506682 - RNA, 32 nt, Human
ucucccuuugugaaaaggagagcaggugucag

SEQ ID NO: 506683 - RNA, 21 nt, Human
ucucccuuuguuccagcgccg

SEQ ID NO: 506684 - RNA, 22 nt, Human
ucucccuuuuaucccaauaagu

SEQ ID NO: 506685 - RNA, 32 nt, Human
ucucccuuuuucucccucauucccucucucuu

SEQ ID NO: 506686 - RNA, 20 nt, Human
ucuccgacuccagagaccug

SEQ ID NO: 506687 - RNA, 32 nt, Human
ucuccgacugcccagauaucuacuggggccug

SEQ ID NO: 506688 - RNA, 32 nt, Human
ucuccgagagccucuggcagccgucuaccaag

SEQ ID NO: 506689 - RNA, 32 nt, Human
ucuccgagagcugagaaggaaaagaggagcuu

SEQ ID NO: 506690 - RNA, 22 nt, Human
ucuccgaggaaccugcccccuc

SEQ ID NO: 506691 - RNA, 32 nt, Human
ucuccgaggccugcuugcuagguggggcgacu

SEQ ID NO: 506692 - RNA, 32 nt, Human
ucuccgaggcuggaauacgguggugcgaucaa

SEQ ID NO: 506693 - RNA, 32 nt, Human
ucuccgaggcuggagugcaauguugcaaucag

SEQ ID NO: 506694 - RNA, 26 nt, Human
ucuccgaguacaacaucuuccaguuc

SEQ ID NO: 506695 - RNA, 32 nt, Human
ucuccgaguaccccagugaccagagugagaga

SEQ ID NO: 506696 - RNA, 32 nt, Human
ucuccgaguucugcgagaagucggacggcgcg

SEQ ID NO: 506697 - RNA, 32 nt, Human
ucuccgaugcccuucagugagguggggacgcc

SEQ ID NO: 506698 - RNA, 21 nt, Human
ucuccgauuccaccuccuccu

SEQ ID NO: 506699 - RNA, 32 nt, Human
ucuccgauugagcuuugaagauuaggaggaga

SEQ ID NO: 506700 - RNA, 32 nt, Human
ucuccgcaacagaaccaucucaagugggucua

SEQ ID NO: 506701 - RNA, 32 nt, Human
ucuccgcacaccucuggcugucuuuuuguacu

SEQ ID NO: 506702 - RNA, 32 nt, Human
ucuccgcacaucugcaugccugucaaacccag

SEQ ID NO: 506703 - RNA, 32 nt, Human
ucuccgcaggaggcuguggcagcuguggcauc

SEQ ID NO: 506704 - RNA, 32 nt, Human
ucuccgcaggcccacuguccuuggguuuaaug

SEQ ID NO: 506705 - RNA, 32 nt, Human
ucuccgccacugcccucaaggcugcuugaggc

SEQ ID NO: 506706 - RNA, 32 nt, Human
ucuccgccccgugguuccuauggaugcuguuu

SEQ ID NO: 506707 - RNA, 32 nt, Human
ucuccgccccuuucucuuucccacucaguuuu

SEQ ID NO: 506708 - RNA, 32 nt, Human
ucuccgccuccaccuaucuuccuacagaccuc

SEQ ID NO: 506709 - RNA, 32 nt, Human
ucuccgccucucucccugccucccucucucuc

SEQ ID NO: 506710 - RNA, 32 nt, Human
ucuccgccugggaccccuccgccccgacccgg

SEQ ID NO: 506711 - RNA, 32 nt, Human
ucuccgcgcuguuccucgucauggcggcccuc

SEQ ID NO: 506712 - RNA, 32 nt, Human
ucuccgcggaggagguggaggaggcggcggcg

SEQ ID NO: 506713 - RNA, 32 nt, Human
ucuccgcggccuuccuccucccugcuccagaa

SEQ ID NO: 506714 - RNA, 32 nt, Human
ucuccgcgucugccagccuggcuggcaguccg

SEQ ID NO: 506715 - RNA, 32 nt, Human
ucuccgcguggguacuuggggguggggccaca

SEQ ID NO: 506716 - RNA, 32 nt, Human
ucuccgcucacugcaacauccgccucccggac

SEQ ID NO: 506717 - RNA, 32 nt, Human
ucuccgcucacugcaaccuccaccuccuggcu

SEQ ID NO: 506718 - RNA, 32 nt, Human
ucuccgcucacugcaaccucugccucccgguu

SEQ ID NO: 506719 - RNA, 32 nt, Human
ucuccgcucacugcaagcuccgccucccgggu

SEQ ID NO: 506720 - RNA, 32 nt, Human
ucuccgcucacugcaagcuccgccucgcgagu

SEQ ID NO: 506721 - RNA, 32 nt, Human
ucuccgcucacugcaagcucugccuccugggc

SEQ ID NO: 506722 - RNA, 32 nt, Human
ucuccgcucacugcagccuccgccuccugggu

SEQ ID NO: 506723 - RNA, 32 nt, Human
ucuccgcucacugccaccuccgccucucuagu

SEQ ID NO: 506724 - RNA, 32 nt, Human
ucuccgcucgcagcaaccucugccucccaggu

SEQ ID NO: 506725 - RNA, 32 nt, Human
ucuccgcucgcuacaaccuccaccucccagcu

SEQ ID NO: 506726 - RNA, 32 nt, Human
ucuccgcucgcugcaaccaccaucuccugggu

SEQ ID NO: 506727 - RNA, 32 nt, Human
ucuccgcucuuagguaaaugaacaagcuaccc

SEQ ID NO: 506728 - RNA, 32 nt, Human
ucuccgcugcaggagguggggugaggacauug

SEQ ID NO: 506729 - RNA, 32 nt, Human
ucuccgcugccccggucaaccagcggagagug

SEQ ID NO: 506730 - RNA, 32 nt, Human
ucuccgcugcuaguucuuggcucugggaggcc

SEQ ID NO: 506731 - RNA, 32 nt, Human
ucuccgcuucccccagcacacacacauacaac

SEQ ID NO: 506732 - RNA, 32 nt, Human
ucuccggacucugcgucggguuuccucacccu

SEQ ID NO: 506733 - RNA, 32 nt, Human
ucuccggaggcagaaguuguggaucggccggc

SEQ ID NO: 506734 - RNA, 32 nt, Human
ucuccggaucucccucggucccucucuccucc

SEQ ID NO: 506735 - RNA, 32 nt, Human
ucuccggcaagccagggccggggcuucacugc

SEQ ID NO: 506736 - RNA, 18 nt, Human
ucuccggcagucagcacc

SEQ ID NO: 506737 - RNA, 32 nt, Human
ucuccggccguccaugcacagagcgccuuccc

SEQ ID NO: 506738 - RNA, 32 nt, Human
ucuccggccuccugguucccacaacauauaag

SEQ ID NO: 506739 - RNA, 32 nt, Human
ucuccggcgggcgggagccaggcgcugacggg

SEQ ID NO: 506740 - RNA, 25 nt, Human
ucuccggcucugcugcccgggauuu

SEQ ID NO: 506741 - RNA, 23 nt, Human
ucuccggcugaucgcgggaccug

SEQ ID NO: 506742 - RNA, 32 nt, Human
ucuccggcuuugggccuggcaggcuggcacau

SEQ ID NO: 506743 - RNA, 32 nt, Human
ucuccgggacugcccucucgacugucaguggg

SEQ ID NO: 506744 - RNA, 32 nt, Human
ucuccgggcagccaccaccuccucggucugcc

SEQ ID NO: 506745 - RNA, 32 nt, Human
ucuccgggcccagcucuuccucccggcugcgu

SEQ ID NO: 506746 - RNA, 32 nt, Human
ucuccgggccuuucucuggcuuccuuggcuug

SEQ ID NO: 506747 - RNA, 32 nt, Human
ucuccggggaggcagggguccugcagguccug

SEQ ID NO: 506748 - RNA, 19 nt, Human
ucuccggggcccucgcccc

SEQ ID NO: 506749 - RNA, 32 nt, Human
ucuccggucccuuuauggaccccacacaagau

SEQ ID NO: 506750 - RNA, 32 nt, Human
ucuccgucaucccuaucuccccugggcuuaca

SEQ ID NO: 506751 - RNA, 32 nt, Human
ucuccgucucccaggccagagugcaguggcgc

SEQ ID NO: 506752 - RNA, 32 nt, Human
ucuccgucuuugugucugucucugugucuguc

SEQ ID NO: 506753 - RNA, 32 nt, Human
ucuccguucacugcaaucucugccuccugggu

SEQ ID NO: 506754 - RNA, 32 nt, Human
ucuccguucacugcagccuccaccuccccggu

SEQ ID NO: 506755 - RNA, 32 nt, Human
ucuccguucuuccaccuccuccucuuccucag

SEQ ID NO: 506756 - RNA, 32 nt, Human
ucuccguugucuucuugggucuuugggguuga

SEQ ID NO: 506757 - RNA, 32 nt, Human
ucuccuaaaaauacaaaaauuagccagaugug

SEQ ID NO: 506758 - RNA, 32 nt, Human
ucuccuaaaaauacaaaaauuagccgggcaug

SEQ ID NO: 506759 - RNA, 32 nt, Human
ucuccuaaaaauacaaaauuagccgggcgugg

SEQ ID NO: 506760 - RNA, 32 nt, Human
ucuccuaaaaauacagaaaauuagccuggcau

SEQ ID NO: 506761 - RNA, 32 nt, Human
ucuccuaaaauauacaaaaauuagccgggcau

SEQ ID NO: 506762 - RNA, 32 nt, Human
ucuccuaaaguacugggauuacaggcgugagc

SEQ ID NO: 506763 - RNA, 32 nt, Human
ucuccuaagauggaaucugugguuugggaaug

SEQ ID NO: 506764 - RNA, 18 nt, Human
ucuccuaaucccaucacu

SEQ ID NO: 506765 - RNA, 32 nt, Human
ucuccuaaugcuaucccuccccuugcccccaa

SEQ ID NO: 506766 - RNA, 32 nt, Human
ucuccuacaaaacagacagcugccucucagau

SEQ ID NO: 506767 - RNA, 21 nt, Human
ucuccuacagcacgccccagg

SEQ ID NO: 506768 - RNA, 32 nt, Human
ucuccuacagccgccaggccugggguccugaa

SEQ ID NO: 506769 - RNA, 19 nt, Human
ucuccuacagcucccugca

SEQ ID NO: 506770 - RNA, 32 nt, Human
ucuccuacaugccagggaucccaccaggaggc

SEQ ID NO: 506771 - RNA, 20 nt, Human
ucuccuaccggcacccgcag

SEQ ID NO: 506772 - RNA, 32 nt, Human
ucuccuaccugccugacauccuggugacuggc

SEQ ID NO: 506773 - RNA, 32 nt, Human
ucuccuacuccauccaguccugaggagccuua

SEQ ID NO: 506774 - RNA, 32 nt, Human
ucuccuacuccugcccacuccaccuucuuagc

SEQ ID NO: 506775 - RNA, 32 nt, Human
ucuccuagaagcagccggcacaggagggaagg

SEQ ID NO: 506776 - RNA, 22 nt, Human
ucuccuagcucuggaggugcug

SEQ ID NO: 506777 - RNA, 32 nt, Human
ucuccuagcugacugacuccuuccuuaguuca

SEQ ID NO: 506778 - RNA, 25 nt, Human
ucuccuagcugcuacccaggaccuc

SEQ ID NO: 506779 - RNA, 21 nt, Human
ucuccuaggagguggcuccag

SEQ ID NO: 506780 - RNA, 32 nt, Human
ucuccuaggcuggagcgcaguggugcaaucac

SEQ ID NO: 506781 - RNA, 32 nt, Human
ucuccuaggcuggagugcaguggugugaucau

SEQ ID NO: 506782 - RNA, 32 nt, Human
ucuccuaggucaguccccuccuggacccaccc

SEQ ID NO: 506783 - RNA, 32 nt, Human
ucuccuagguuagagagggguggccuggggug

SEQ ID NO: 506784 - RNA, 32 nt, Human
ucuccuaguuccagauuuuaauuuggggaaca

SEQ ID NO: 506785 - RNA, 32 nt, Human
ucuccuaucuguguauuacacauuccccucuc

SEQ ID NO: 506786 - RNA, 32 nt, Human
ucuccuaucuguguccucauacauacugccgc

SEQ ID NO: 506787 - RNA, 32 nt, Human
ucuccuaugccuauuccuacauacuugcugag

SEQ ID NO: 506788 - RNA, 32 nt, Human
ucuccuauuaugcaaacccacaccauggaucc

SEQ ID NO: 506789 - RNA, 32 nt, Human
ucuccuauucuuucucuuucuucucuccacau

SEQ ID NO: 506790 - RNA, 32 nt, Human
ucuccuauugccugcaggggagcaguuggcau

SEQ ID NO: 506791 - RNA, 32 nt, Human
ucuccucaaaccaaaguguugcagugaaggac

SEQ ID NO: 506792 - RNA, 22 nt, Human
ucuccucaaaugcugugugcug

SEQ ID NO: 506793 - RNA, 32 nt, Human
ucuccucaaggccucuggagcaaccagcaccu

SEQ ID NO: 506794 - RNA, 32 nt, Human
ucuccucaccacagugcuguguggucuauacc

SEQ ID NO: 506795 - RNA, 32 nt, Human
ucuccucaccugucucuccauauuuaggucac

SEQ ID NO: 506796 - RNA, 26 nt, Human
ucuccucacucaaagucccuucgcca

SEQ ID NO: 506797 - RNA, 32 nt, Human
ucuccucacuggccuuucuuuccgucuagccu

SEQ ID NO: 506798 - RNA, 32 nt, Human
ucuccucacuguccugacaggcugaggcggcu

SEQ ID NO: 506799 - RNA, 32 nt, Human
ucuccucagccccuggcaaccaccauccuacu

SEQ ID NO: 506800 - RNA, 32 nt, Human
ucuccucagcuauguggaacugugaaucaauu

SEQ ID NO: 506801 - RNA, 32 nt, Human
ucuccucagcucccccuucaccccuccuugcc

SEQ ID NO: 506802 - RNA, 32 nt, Human
ucuccucagggaccaggacaaggugcugcugc

SEQ ID NO: 506803 - RNA, 32 nt, Human
ucuccucaggguggccacuggaggaugggugg

SEQ ID NO: 506804 - RNA, 32 nt, Human
ucuccucagguggagucugcagaguggaccca

SEQ ID NO: 506805 - RNA, 32 nt, Human
ucuccucauacacuccuucccugcugagccag

SEQ ID NO: 506806 - RNA, 32 nt, Human
ucuccucauaguuguuauuaagcucuuuuuaa

SEQ ID NO: 506807 - RNA, 19 nt, Human
ucuccucaucccugagcca

SEQ ID NO: 506808 - RNA, 32 nt, Human
ucuccucauccugcuucacaggcuccgcggcc

SEQ ID NO: 506809 - RNA, 20 nt, Human
ucuccucaucucuugcuugu

SEQ ID NO: 506810 - RNA, 21 nt, Human
ucuccucaucuguaacuuuca

SEQ ID NO: 506811 - RNA, 18 nt, Human
ucuccucauggggccagg

SEQ ID NO: 506812 - RNA, 32 nt, Human
ucuccucauuccuacaccuauuuucugcugca

SEQ ID NO: 506813 - RNA, 32 nt, Human
ucuccucauucucugaacccacuguggugaga

SEQ ID NO: 506814 - RNA, 32 nt, Human
ucuccuccaccacucucuaaccugagagccug

SEQ ID NO: 506815 - RNA, 32 nt, Human
ucuccuccacugcccccgccucccaccaccau

SEQ ID NO: 506816 - RNA, 32 nt, Human
ucuccuccacuuccucccuucccucauccugc

SEQ ID NO: 506817 - RNA, 24 nt, Human
ucuccuccagcauuccugugucug

SEQ ID NO: 506818 - RNA, 32 nt, Human
ucuccuccaugguggucacugccccuggcagg

SEQ ID NO: 506819 - RNA, 21 nt, Human
ucuccuccauucuccaucacu

SEQ ID NO: 506820 - RNA, 32 nt, Human
ucuccuccauuuuuccuccccaagaauagcug

SEQ ID NO: 506821 - RNA, 24 nt, Human
ucuccucccaaucuccauaggcug

SEQ ID NO: 506822 - RNA, 22 nt, Human
ucuccucccacaccuuccugcu

SEQ ID NO: 506823 - RNA, 32 nt, Human
ucuccucccacagggucccccuugccccagcc

SEQ ID NO: 506824 - RNA, 32 nt, Human
ucuccucccagccucugccugucccacagaua

SEQ ID NO: 506825 - RNA, 18 nt, Human
ucuccucccagcgugugu

SEQ ID NO: 506826 - RNA, 32 nt, Human
ucuccuccccagcagccauucuccccuuuccc

SEQ ID NO: 506827 - RNA, 32 nt, Human
ucuccucccccaacccccaccccacaauuuua

SEQ ID NO: 506828 - RNA, 32 nt, Human
ucuccuccccguggauucccccaaacccauaa

SEQ ID NO: 506829 - RNA, 32 nt, Human
ucuccuccccuccccucccucaguccucccuc

SEQ ID NO: 506830 - RNA, 32 nt, Human
ucuccuccccuccccucccuucucauuccuuu

SEQ ID NO: 506831 - RNA, 32 nt, Human
ucuccuccccucccucagagacaccaaacugc

SEQ ID NO: 506832 - RNA, 32 nt, Human
ucuccuccccucucccuucuuuaaacgagcuu

SEQ ID NO: 506833 - RNA, 32 nt, Human
ucuccuccccucuuuuccuuccuuccuacccc

SEQ ID NO: 506834 - RNA, 32 nt, Human
ucuccuccccuuggacucuagauuucuggcca

SEQ ID NO: 506835 - RNA, 24 nt, Human
ucuccucccgaugcucugccgcug

SEQ ID NO: 506836 - RNA, 32 nt, Human
ucuccucccgucccucuccaggggccccgcau

SEQ ID NO: 506837 - RNA, 32 nt, Human
ucuccucccucccucccuccuccugggguggg

SEQ ID NO: 506838 - RNA, 22 nt, Human
ucuccucccugagcaccugcug

SEQ ID NO: 506839 - RNA, 32 nt, Human
ucuccucccugccuccugccuccugcggcugu

SEQ ID NO: 506840 - RNA, 32 nt, Human
ucuccucccuuacccuccucugcugggaaccu

SEQ ID NO: 506841 - RNA, 32 nt, Human
ucuccuccuacugaaaaugcugcccaggggaa

SEQ ID NO: 506842 - RNA, 32 nt, Human
ucuccuccuaugccuucccaugagucagucau

SEQ ID NO: 506843 - RNA, 32 nt, Human
ucuccuccucacccucucgcuccuuccugugu

SEQ ID NO: 506844 - RNA, 32 nt, Human
ucuccuccucaccuuuuguugcuaucggcagc

SEQ ID NO: 506845 - RNA, 32 nt, Human
ucuccuccucagggccuccuguucucagggcc

SEQ ID NO: 506846 - RNA, 23 nt, Human
ucuccuccucaguucugugccug

SEQ ID NO: 506847 - RNA, 32 nt, Human
ucuccuccuccaccaccucaucccgcccaccu

SEQ ID NO: 506848 - RNA, 32 nt, Human
ucuccuccuccaccuccuccuccgccuccucc

SEQ ID NO: 506849 - RNA, 32 nt, Human
ucuccuccuccccuccucuucccuuagccucu

SEQ ID NO: 506850 - RNA, 32 nt, Human
ucuccuccuccccuucccaguuaccaaagagu

SEQ ID NO: 506851 - RNA, 32 nt, Human
ucuccuccucccuucccgcuccuuccucuccc

SEQ ID NO: 506852 - RNA, 32 nt, Human
ucuccuccuccuccuccccuacaauuccuuuu

SEQ ID NO: 506853 - RNA, 32 nt, Human
ucuccuccuccuccuccgccgccggacacgca

SEQ ID NO: 506854 - RNA, 32 nt, Human
ucuccuccuccuccugcuuccccugcucagag

SEQ ID NO: 506855 - RNA, 32 nt, Human
ucuccuccucuaaauuaaacaggauuuaaaua

SEQ ID NO: 506856 - RNA, 32 nt, Human
ucuccuccucuuccucucucuggacgcccggc

SEQ ID NO: 506857 - RNA, 32 nt, Human
ucuccuccugcagggcccacccuaagaaugua

SEQ ID NO: 506858 - RNA, 32 nt, Human
ucuccuccugcagguucaagcuccucaguccc

SEQ ID NO: 506859 - RNA, 32 nt, Human
ucuccuccuuccugaugucugccauuagcauu

SEQ ID NO: 506860 - RNA, 32 nt, Human
ucuccuccuucugcuuaauuuaccuuccuacc

SEQ ID NO: 506861 - RNA, 32 nt, Human
ucuccuccuuucucccacguccuaucugccuc

SEQ ID NO: 506862 - RNA, 32 nt, Human
ucuccuccuuucucucccucuuucccuccauc

SEQ ID NO: 506863 - RNA, 32 nt, Human
ucuccucgccacuccaagguugcagacgaagc

SEQ ID NO: 506864 - RNA, 32 nt, Human
ucuccucggaugaccugccuccuaauuuccug

SEQ ID NO: 506865 - RNA, 32 nt, Human
ucuccucggcguccucacaacucuuaauuggg

SEQ ID NO: 506866 - RNA, 32 nt, Human
ucuccucuagacuguuccaggcugccugcgga

SEQ ID NO: 506867 - RNA, 19 nt, Human
ucuccucucagagaaaggc

SEQ ID NO: 506868 - RNA, 32 nt, Human
ucuccucuccacccuaucccagccucccccac

SEQ ID NO: 506869 - RNA, 22 nt, Human
ucuccucuccaucucugccuuu

SEQ ID NO: 506870 - RNA, 23 nt, Human
ucuccucuccccucaaccucuua

SEQ ID NO: 506871 - RNA, 32 nt, Human
ucuccucuccccucacccuccugccccuggcc

SEQ ID NO: 506872 - RNA, 32 nt, Human
ucuccucuccccucuaaggccgaagaaggguc

SEQ ID NO: 506873 - RNA, 32 nt, Human
ucuccucuccgcccacucuuugcucacugccc

SEQ ID NO: 506874 - RNA, 32 nt, Human
ucuccucuccucaaaucucugaucaucuucuc

SEQ ID NO: 506875 - RNA, 32 nt, Human
ucuccucuccuccuccagcccccagccuacuc

SEQ ID NO: 506876 - RNA, 32 nt, Human
ucuccucuccucucuucuuguuugaacauggu

SEQ ID NO: 506877 - RNA, 32 nt, Human
ucuccucuccugcccuggccccggccccuccu

SEQ ID NO: 506878 - RNA, 23 nt, Human
ucuccucuccugugggacucucu

SEQ ID NO: 506879 - RNA, 32 nt, Human
ucuccucuccuucccuuccucucccccgccca

SEQ ID NO: 506880 - RNA, 32 nt, Human
ucuccucucgcccaggcuggagugcaguggug

SEQ ID NO: 506881 - RNA, 32 nt, Human
ucuccucucucccucucccucucccucucugu

SEQ ID NO: 506882 - RNA, 21 nt, Human
ucuccucucucucugugucug

SEQ ID NO: 506883 - RNA, 32 nt, Human
ucuccucucucuucccuuccugucucucuucc

SEQ ID NO: 506884 - RNA, 32 nt, Human
ucuccucucugccugccuccucccucaccgaa

SEQ ID NO: 506885 - RNA, 21 nt, Human
ucuccucucugggacaggcug

SEQ ID NO: 506886 - RNA, 20 nt, Human
ucuccucucuuccaaaccuc

SEQ ID NO: 506887 - RNA, 23 nt, Human
ucuccucucuugaguuaaccccu

SEQ ID NO: 506888 - RNA, 32 nt, Human
ucuccucucuugcucccaccucccucucuucc

SEQ ID NO: 506889 - RNA, 22 nt, Human
ucuccucugccaaaucuacuua

SEQ ID NO: 506890 - RNA, 32 nt, Human
ucuccucugccauccagaaccguccagaacug

SEQ ID NO: 506891 - RNA, 17 nt, Human
ucuccucugcccaucac

SEQ ID NO: 506892 - RNA, 32 nt, Human
ucuccucugcuccccaucccacuuucucaucu

SEQ ID NO: 506893 - RNA, 32 nt, Human
ucuccucugcuuggagaguuugcccuugucug

SEQ ID NO: 506894 - RNA, 24 nt, Human
ucuccucugggaccugccaugcug

SEQ ID NO: 506895 - RNA, 32 nt, Human
ucuccucugucucuccucggucucagcucugg

SEQ ID NO: 506896 - RNA, 32 nt, Human
ucuccucuguggugugcauaugugguuucuaa

SEQ ID NO: 506897 - RNA, 32 nt, Human
ucuccucuucaccucuuccugcuggccacgag

SEQ ID NO: 506898 - RNA, 26 nt, Human
ucuccucuucacuacucuguguccug

SEQ ID NO: 506899 - RNA, 32 nt, Human
ucuccucuucccaccuccuccuggcuauguuc

SEQ ID NO: 506900 - RNA, 32 nt, Human
ucuccucuucccuccagcucuugagccuaccc

SEQ ID NO: 506901 - RNA, 32 nt, Human
ucuccucuuccuucuccuuucucccauucuuc

SEQ ID NO: 506902 - RNA, 32 nt, Human
ucuccucuucucgagcaggagugauaguuacc

SEQ ID NO: 506903 - RNA, 32 nt, Human
ucuccugaaagcugggaugacaggcacaugcc

SEQ ID NO: 506904 - RNA, 32 nt, Human
ucuccugaaauguuugugcauggaagaacugc

SEQ ID NO: 506905 - RNA, 32 nt, Human
ucuccugaagaggaacugggccuguugcccuu

SEQ ID NO: 506906 - RNA, 32 nt, Human
ucuccugacauuaagacacaccucuggauccc

SEQ ID NO: 506907 - RNA, 32 nt, Human
ucuccugaccucaaguccaacaacagugucca

SEQ ID NO: 506908 - RNA, 32 nt, Human
ucuccugaccucaugauccucccgccucagcc

SEQ ID NO: 506909 - RNA, 32 nt, Human
ucuccugaccucaugauccucccgccucggcc

SEQ ID NO: 506910 - RNA, 32 nt, Human
ucuccugacuagcugggacuacaggugcaugc

SEQ ID NO: 506911 - RNA, 32 nt, Human
ucuccugacuccaaauccgagaauccuuucac

SEQ ID NO: 506912 - RNA, 32 nt, Human
ucuccugagaugucaggaaggagggggccacc

SEQ ID NO: 506913 - RNA, 32 nt, Human
ucuccugagcagcugggauuacaggcaaacgc

SEQ ID NO: 506914 - RNA, 32 nt, Human
ucuccugagccaccaucaccuccuggggugcc

SEQ ID NO: 506915 - RNA, 32 nt, Human
ucuccugagccugucucucccuacccucuucu

SEQ ID NO: 506916 - RNA, 32 nt, Human
ucuccugaggguguuuaguugcauggcuguuc

SEQ ID NO: 506917 - RNA, 32 nt, Human
ucuccugaggguguuuauuuguaugucuguuc

SEQ ID NO: 506918 - RNA, 32 nt, Human
ucuccugaggucccugccaucugugggucaua

SEQ ID NO: 506919 - RNA, 32 nt, Human
ucuccugaguagccgggacuacaggcaugcac

SEQ ID NO: 506920 - RNA, 32 nt, Human
ucuccugaguagcuaggacuacaggcacacac

SEQ ID NO: 506921 - RNA, 32 nt, Human
ucuccugaguagcugagacuacagcugugcgc

SEQ ID NO: 506922 - RNA, 32 nt, Human
ucuccugaguagcugagacuacaggcacgcac

SEQ ID NO: 506923 - RNA, 32 nt, Human
ucuccugaguagcuggaacuacaggugugcgc

SEQ ID NO: 506924 - RNA, 32 nt, Human
ucuccugaguagcugggacuacaggugcaugc

SEQ ID NO: 506925 - RNA, 32 nt, Human
ucuccugaguagcugggacuacaggugcgugc

SEQ ID NO: 506926 - RNA, 32 nt, Human
ucuccugaguagcugggacugcaggcaugcgc

SEQ ID NO: 506927 - RNA, 32 nt, Human
ucuccugaguagcugggaucacaggcaugcac

SEQ ID NO: 506928 - RNA, 32 nt, Human
ucuccugaguagcugggaucacagggaccauu

SEQ ID NO: 506929 - RNA, 32 nt, Human
ucuccugaguagcugggaugacaggcacgccc

SEQ ID NO: 506930 - RNA, 32 nt, Human
ucuccugaguagcugggauuacaggcacccac

SEQ ID NO: 506931 - RNA, 32 nt, Human
ucuccugaguagcugggauuacaggugcccgc

SEQ ID NO: 506932 - RNA, 32 nt, Human
ucuccugaguagcugggauuacgggugcgugc

SEQ ID NO: 506933 - RNA, 32 nt, Human
ucuccugaguagcugggauugcuggugcacag

SEQ ID NO: 506934 - RNA, 32 nt, Human
ucuccugaucaacgucugucucuugggaguag

SEQ ID NO: 506935 - RNA, 32 nt, Human
ucuccugauuucucugaacagaaaacaaaaga

SEQ ID NO: 506936 - RNA, 32 nt, Human
ucuccugcaccucccuggcccugccggccacu

SEQ ID NO: 506937 - RNA, 32 nt, Human
ucuccugcagcucagcagcugccuucaccaug

SEQ ID NO: 506938 - RNA, 32 nt, Human
ucuccugcauauccagccuccugcgacucccc

SEQ ID NO: 506939 - RNA, 23 nt, Human
ucuccugcccucuccccuguccu

SEQ ID NO: 506940 - RNA, 31 nt, Human
ucuccugcccucucugagccuugucacuuga

SEQ ID NO: 506941 - RNA, 32 nt, Human
ucuccugcccugcuugccggcaugaucuuggc

SEQ ID NO: 506942 - RNA, 32 nt, Human
ucuccugcccuucugcaagcucucccuagcuu

SEQ ID NO: 506943 - RNA, 32 nt, Human
ucuccugcccuuggacaucagagcugcaggcu

SEQ ID NO: 506944 - RNA, 32 nt, Human
ucuccugccuacaguggaaauggcuacaauau

SEQ ID NO: 506945 - RNA, 32 nt, Human
ucuccugccuacuugccccuccuuccaggccg

SEQ ID NO: 506946 - RNA, 32 nt, Human
ucuccugccucacccuccugaguagaugggac

SEQ ID NO: 506947 - RNA, 32 nt, Human
ucuccugccucagccuccugaguagaugggac

SEQ ID NO: 506948 - RNA, 20 nt, Human
ucuccugccucagccuucca

SEQ ID NO: 506949 - RNA, 32 nt, Human
ucuccugccucagcuacucaagaggcugaggc

SEQ ID NO: 506950 - RNA, 32 nt, Human
ucuccugccucagcuacucaggaggcugaggu

SEQ ID NO: 506951 - RNA, 32 nt, Human
ucuccugccucagcuacucgggaggcugaggc

SEQ ID NO: 506952 - RNA, 32 nt, Human
ucuccugccucagcuccugaguagcugggauu

SEQ ID NO: 506953 - RNA, 21 nt, Human
ucuccugccuccaucacauca

SEQ ID NO: 506954 - RNA, 32 nt, Human
ucuccugccucccugccucagccugggaccug

SEQ ID NO: 506955 - RNA, 32 nt, Human
ucuccugccuccgccuuccacccugggcccag

SEQ ID NO: 506956 - RNA, 32 nt, Human
ucuccugccucucuguuucuccaucuccucgu

SEQ ID NO: 506957 - RNA, 32 nt, Human
ucuccugccucugccaggagagagcuuguucc

SEQ ID NO: 506958 - RNA, 32 nt, Human
ucuccugccugcugggaccuauggaaggggcu

SEQ ID NO: 506959 - RNA, 32 nt, Human
ucuccugccuggguucaaacucugcauccuuc

SEQ ID NO: 506960 - RNA, 32 nt, Human
ucuccugccuggguucgguuucagcucccagc

SEQ ID NO: 506961 - RNA, 32 nt, Human
ucuccugccuguaaucccaucacuuugggagg

SEQ ID NO: 506962 - RNA, 32 nt, Human
ucuccugcguuucuucacccuauguucuacag

SEQ ID NO: 506963 - RNA, 32 nt, Human
ucuccugcuagcaauaugugccacaacaugac

SEQ ID NO: 506964 - RNA, 32 nt, Human
ucuccugcucauucuucuugacagaacaacca

SEQ ID NO: 506965 - RNA, 32 nt, Human
ucuccugcucguggacuuagaguaagaguguc

SEQ ID NO: 506966 - RNA, 32 nt, Human
ucuccugcucuccuugggaugauggcuggcua

SEQ ID NO: 506967 - RNA, 22 nt, Human
ucuccugcucuucuggagccug

SEQ ID NO: 506968 - RNA, 32 nt, Human
ucuccugcugaggcggagacugcagugagcug

SEQ ID NO: 506969 - RNA, 32 nt, Human
ucuccugcugagguggagacugcagugagcug

SEQ ID NO: 506970 - RNA, 32 nt, Human
ucuccugcugagguggagauugcagugaacua

SEQ ID NO: 506971 - RNA, 32 nt, Human
ucuccugcugcucuccugcugcuggccucgcu

SEQ ID NO: 506972 - RNA, 20 nt, Human
ucuccugcuucagccuccca

SEQ ID NO: 506973 - RNA, 32 nt, Human
ucuccuggacgcagaggugacagugggagcug

SEQ ID NO: 506974 - RNA, 32 nt, Human
ucuccuggaggcugccaagggcauuuucucau

SEQ ID NO: 506975 - RNA, 32 nt, Human
ucuccuggagugagggggcugaagucagacca

SEQ ID NO: 506976 - RNA, 32 nt, Human
ucuccuggaucuucgcacccagcuucggguag

SEQ ID NO: 506977 - RNA, 32 nt, Human
ucuccuggauugcaaaugccucuucaguuugg

SEQ ID NO: 506978 - RNA, 32 nt, Human
ucuccuggcaaaaauucacugccacagacaaa

SEQ ID NO: 506979 - RNA, 32 nt, Human
ucuccuggcaaaagcugcuaugaaaagccuca

SEQ ID NO: 506980 - RNA, 32 nt, Human
ucuccuggcccaggccuggcgggcacugcuuc

SEQ ID NO: 506981 - RNA, 21 nt, Human
ucuccuggccccugccugcug

SEQ ID NO: 506982 - RNA, 32 nt, Human
ucuccuggcccuacagcuucucaccccugcug

SEQ ID NO: 506983 - RNA, 32 nt, Human
ucuccuggcccucucucugaucaugccagguu

SEQ ID NO: 506984 - RNA, 32 nt, Human
ucuccuggcccugcucuggcccuucccgggcc

SEQ ID NO: 506985 - RNA, 32 nt, Human
ucuccuggcccuggcccaucugccuccuggcc

SEQ ID NO: 506986 - RNA, 32 nt, Human
ucuccuggccgggcacgguggaucaugccugu

SEQ ID NO: 506987 - RNA, 32 nt, Human
ucuccuggcuacaccugcuuaacuucaguucc

SEQ ID NO: 506988 - RNA, 32 nt, Human
ucuccuggcuucccgucuggucauggcgagau

SEQ ID NO: 506989 - RNA, 32 nt, Human
ucuccuggcuuuaaccccuccuuggccaaggc

SEQ ID NO: 506990 - RNA, 32 nt, Human
ucuccugggaagcccagucucagucccucccc

SEQ ID NO: 506991 - RNA, 32 nt, Human
ucuccugggacagugggcucugcauguucucc

SEQ ID NO: 506992 - RNA, 32 nt, Human
ucuccugggaggaucgcagucagcagagcagg

SEQ ID NO: 506993 - RNA, 32 nt, Human
ucuccugggggcugggcuggggguuagggcug

SEQ ID NO: 506994 - RNA, 32 nt, Human
ucuccugggucucuggaggagcccaggaagga

SEQ ID NO: 506995 - RNA, 32 nt, Human
ucuccugggucuuggagggaugugggaaugaa

SEQ ID NO: 506996 - RNA, 32 nt, Human
ucuccuggguguaguggaugccagucuuguug

SEQ ID NO: 506997 - RNA, 32 nt, Human
ucuccugguagcugggauuacaggcaugcacc

SEQ ID NO: 506998 - RNA, 32 nt, Human
ucuccugguccccaggagagaugcuuugagga

SEQ ID NO: 506999 - RNA, 32 nt, Human
ucuccugguguaguguggaugcgaggccacgg

SEQ ID NO: 507000 - RNA, 32 nt, Human
ucuccugguucgaucuaggaaaaaggaaagga

SEQ ID NO: 507001 - RNA, 32 nt, Human
ucuccuguacagaaccugccuggggugggugg

SEQ ID NO: 507002 - RNA, 32 nt, Human
ucuccuguaccugggcauccagaaaaauggug

SEQ ID NO: 507003 - RNA, 32 nt, Human
ucuccugucaccugggaaguccaagggauuua

SEQ ID NO: 507004 - RNA, 17 nt, Human
ucuccuguccacagcca

SEQ ID NO: 507005 - RNA, 32 nt, Human
ucuccugucccccagccaugucauucuagcug

SEQ ID NO: 507006 - RNA, 32 nt, Human
ucuccugucucagccuccugaguagaugggac

SEQ ID NO: 507007 - RNA, 32 nt, Human
ucuccugucuuugucugcucuuccugcaaggc

SEQ ID NO: 507008 - RNA, 32 nt, Human
ucuccugugaagccaaaagggaccaggaaccg

SEQ ID NO: 507009 - RNA, 32 nt, Human
ucuccugugcagaaggagaggaaggggcauua

SEQ ID NO: 507010 - RNA, 32 nt, Human
ucuccugugccaagcugcucccugaaauggac

SEQ ID NO: 507011 - RNA, 32 nt, Human
ucuccugugcccacccgucuucaaucucuguu

SEQ ID NO: 507012 - RNA, 32 nt, Human
ucuccugugcggccagcaucagagccauggcg

SEQ ID NO: 507013 - RNA, 32 nt, Human
ucuccugugcggccagcgucagagccauggcg

SEQ ID NO: 507014 - RNA, 32 nt, Human
ucuccugugcucugaugcuacuucugccuagc

SEQ ID NO: 507015 - RNA, 32 nt, Human
ucuccuguggccacagaacacaggcgugcuug

SEQ ID NO: 507016 - RNA, 21 nt, Human
ucuccuguggccuaacuuuca

SEQ ID NO: 507017 - RNA, 32 nt, Human
ucuccuguggcucugccaucagcuccaauauc

SEQ ID NO: 507018 - RNA, 32 nt, Human
ucuccuguuccauucgccuuuccucuucuuuc

SEQ ID NO: 507019 - RNA, 32 nt, Human
ucuccuguuccccuucccaguuaaacagguua

SEQ ID NO: 507020 - RNA, 32 nt, Human
ucuccuguugggggaugguguugggaaggaaa

SEQ ID NO: 507021 - RNA, 32 nt, Human
ucuccuuaaguagcaaccucagggacuggggg

SEQ ID NO: 507022 - RNA, 18 nt, Human
ucuccuuagcccgucacu

SEQ ID NO: 507023 - RNA, 32 nt, Human
ucuccuuaggaguggaggagauguguguucug

SEQ ID NO: 507024 - RNA, 32 nt, Human
ucuccuuaggauugcaagacaguaguucccug

SEQ ID NO: 507025 - RNA, 32 nt, Human
ucuccuuauucuaugugugaacagcuagucug

SEQ ID NO: 507026 - RNA, 32 nt, Human
ucuccuucaacaguucggccaagcagaacugc

SEQ ID NO: 507027 - RNA, 32 nt, Human
ucuccuucagcaacuacaggagauaugaugcc

SEQ ID NO: 507028 - RNA, 32 nt, Human
ucuccuucaguggcauguaguuaucuaaucaa

SEQ ID NO: 507029 - RNA, 32 nt, Human
ucuccuucauuuccuaggucacugccccuuug

SEQ ID NO: 507030 - RNA, 32 nt, Human
ucuccuucauuucucagucaccuuugucucuu

SEQ ID NO: 507031 - RNA, 32 nt, Human
ucuccuucccagagcaauuuauacuuuacccu

SEQ ID NO: 507032 - RNA, 32 nt, Human
ucuccuucccaggaauccuugaucucaugacu

SEQ ID NO: 507033 - RNA, 32 nt, Human
ucuccuucccuccccuccccucccuuccccuc

SEQ ID NO: 507034 - RNA, 32 nt, Human
ucuccuucccucccucuuccucccucucucuc

SEQ ID NO: 507035 - RNA, 32 nt, Human
ucuccuuccuccugcuacugauaccaggcgag

SEQ ID NO: 507036 - RNA, 32 nt, Human
ucuccuuccucggggguaaggaggggacagug

SEQ ID NO: 507037 - RNA, 32 nt, Human
ucuccuuccuuacccaaacuguucaagaaaua

SEQ ID NO: 507038 - RNA, 32 nt, Human
ucuccuuccuucagaaucuaccaccccucccc

SEQ ID NO: 507039 - RNA, 32 nt, Human
ucuccuuccuucuuccucugcucaggagaaaa

SEQ ID NO: 507040 - RNA, 32 nt, Human
ucuccuuccuuuccuuccuuuuucucuaccag

SEQ ID NO: 507041 - RNA, 32 nt, Human
ucuccuucuacucccaauucccucuuggcucc

SEQ ID NO: 507042 - RNA, 32 nt, Human
ucuccuucucccaagcugcaguacuggggaag

SEQ ID NO: 507043 - RNA, 32 nt, Human
ucuccuucuccccuccuucuuuuucagacuga

SEQ ID NO: 507044 - RNA, 32 nt, Human
ucuccuucuccucucugccugccuccucccuc

SEQ ID NO: 507045 - RNA, 32 nt, Human
ucuccuucuccuuccuccuucugcuggcugaa

SEQ ID NO: 507046 - RNA, 32 nt, Human
ucuccuucucuccuccucucuccucuccucuc

SEQ ID NO: 507047 - RNA, 23 nt, Human
ucuccuucugccauaguaugucg

SEQ ID NO: 507048 - RNA, 25 nt, Human
ucuccuucuggacugggagaaggga

SEQ ID NO: 507049 - RNA, 32 nt, Human
ucuccuucuggcccaucugccugcugcccuga

SEQ ID NO: 507050 - RNA, 32 nt, Human
ucuccuucugucccacugcccucuccccgucu

SEQ ID NO: 507051 - RNA, 19 nt, Human
ucuccuucuuccccauuac

SEQ ID NO: 507052 - RNA, 32 nt, Human
ucuccuucuuucucccucuugaguccuucuga

SEQ ID NO: 507053 - RNA, 32 nt, Human
ucuccuugacaauggaaaggcagcagucuuca

SEQ ID NO: 507054 - RNA, 32 nt, Human
ucuccuugacacagacagaagaggggucccuu

SEQ ID NO: 507055 - RNA, 22 nt, Human
ucuccuugagcagugcuacuua

SEQ ID NO: 507056 - RNA, 32 nt, Human
ucuccuugcacacaugggcacacacaaucucc

SEQ ID NO: 507057 - RNA, 32 nt, Human
ucuccuugccacccaaaccaaagaaggccagc

SEQ ID NO: 507058 - RNA, 32 nt, Human
ucuccuugcccgccgccgccucccggagcagc

SEQ ID NO: 507059 - RNA, 32 nt, Human
ucuccuugcccuuuaagguauuuuaacccucg

SEQ ID NO: 507060 - RNA, 31 nt, Human
ucuccuugccucuccuggaaggugucuucuc

SEQ ID NO: 507061 - RNA, 24 nt, Human
ucuccuugccugcuccugaugcuu

SEQ ID NO: 507062 - RNA, 22 nt, Human
ucuccuugccuugcgggugcug

SEQ ID NO: 507063 - RNA, 32 nt, Human
ucuccuugcgagucccaguuugcccauucucc

SEQ ID NO: 507064 - RNA, 32 nt, Human
ucuccuugcuacccagaaaucaucuaaauacc

SEQ ID NO: 507065 - RNA, 32 nt, Human
ucuccuugcugcuuuuucuucuguauuucuag

SEQ ID NO: 507066 - RNA, 32 nt, Human
ucuccuuggaggcaguggugugaaucuucuuc

SEQ ID NO: 507067 - RNA, 32 nt, Human
ucuccuugggcccuuuuucccuucccuccuuu

SEQ ID NO: 507068 - RNA, 32 nt, Human
ucuccuugucuggagugugguggcacagucuc

SEQ ID NO: 507069 - RNA, 32 nt, Human
ucuccuugugugacuuuggagccaugagaccc

SEQ ID NO: 507070 - RNA, 22 nt, Human
ucuccuuuacccuagagcggcg

SEQ ID NO: 507071 - RNA, 31 nt, Human
ucuccuuucaauaaauuaaaugguugagaac

SEQ ID NO: 507072 - RNA, 32 nt, Human
ucuccuuucaccacccccuccuucccuguguc

SEQ ID NO: 507073 - RNA, 32 nt, Human
ucuccuuucaccgcccccuccuucccuguguc

SEQ ID NO: 507074 - RNA, 32 nt, Human
ucuccuuuccaaaggcagagcuuacugucaug

SEQ ID NO: 507075 - RNA, 32 nt, Human
ucuccuuucccaaagagucaucuuuucugcug

SEQ ID NO: 507076 - RNA, 32 nt, Human
ucuccuuucccaaguucucccgccugcgucgg

SEQ ID NO: 507077 - RNA, 32 nt, Human
ucuccuuuccuguucuugccccaggguuaggc

SEQ ID NO: 507078 - RNA, 32 nt, Human
ucuccuuucuauucggagcggcugaggaggcu

SEQ ID NO: 507079 - RNA, 32 nt, Human
ucuccuuucucccauucuucccugccucuucc

SEQ ID NO: 507080 - RNA, 19 nt, Human
ucuccuuucuccccauccu

SEQ ID NO: 507081 - RNA, 32 nt, Human
ucuccuuucuccccauccuguguucugggaga

SEQ ID NO: 507082 - RNA, 32 nt, Human
ucuccuuucucucuucucuuccuuccucuccu

SEQ ID NO: 507083 - RNA, 32 nt, Human
ucuccuuucucuucuugcuucaauugcuuacc

SEQ ID NO: 507084 - RNA, 32 nt, Human
ucuccuuucuuuccucaccccaaccuuuacuc

SEQ ID NO: 507085 - RNA, 32 nt, Human
ucuccuuugaagcacagccuauuucugagcca

SEQ ID NO: 507086 - RNA, 32 nt, Human
ucuccuuugaagcccagacaucuuucuccagc

SEQ ID NO: 507087 - RNA, 32 nt, Human
ucuccuuugcagaaugaugcagguucaggucc

SEQ ID NO: 507088 - RNA, 32 nt, Human
ucuccuuugcugaggccuccagcuucaggcag

SEQ ID NO: 507089 - RNA, 32 nt, Human
ucuccuuugcuugaagccagaggucaguggcc

SEQ ID NO: 507090 - RNA, 32 nt, Human
ucuccuuuguguucaacuuuugugugcuuuua

SEQ ID NO: 507091 - RNA, 32 nt, Human
ucuccuuuuauaucacagcagcuccugugcug

SEQ ID NO: 507092 - RNA, 32 nt, Human
ucuccuuuucccucucccuuucccuaagaguu

SEQ ID NO: 507093 - RNA, 32 nt, Human
ucuccuuuuccuuccuuccuggcagugguuaa

SEQ ID NO: 507094 - RNA, 32 nt, Human
ucuccuuuucuucuccuuucugcugaccagaa

SEQ ID NO: 507095 - RNA, 32 nt, Human
ucuccuuuugccacccccuccuucccugccuc

SEQ ID NO: 507096 - RNA, 32 nt, Human
ucuccuuuugccagucaccaccagccugaccu

SEQ ID NO: 507097 - RNA, 32 nt, Human
ucuccuuuugccgcccccuccuucccuguguc

SEQ ID NO: 507098 - RNA, 32 nt, Human
ucuccuuuuuccuccucuuccuccuuccuccu

SEQ ID NO: 507099 - RNA, 32 nt, Human
ucuccuuuuucucuucacaucucccccauagc

SEQ ID NO: 507100 - RNA, 32 nt, Human
ucucgaaccaucuaccugcuuuuccucucucu

SEQ ID NO: 507101 - RNA, 32 nt, Human
ucucgaaccaugucgcugaccaacacaaagac

SEQ ID NO: 507102 - RNA, 32 nt, Human
ucucgaacccgcauggcuuucccaggccuggu

SEQ ID NO: 507103 - RNA, 22 nt, Human
ucucgaacuccugaccucauga

SEQ ID NO: 507104 - RNA, 22 nt, Human
ucucgaacuccugaccucguga

SEQ ID NO: 507105 - RNA, 22 nt, Human
ucucgaacuccugaccuuguga

SEQ ID NO: 507106 - RNA, 32 nt, Human
ucucgaagaccugccuguagcagaacucaccc

SEQ ID NO: 507107 - RNA, 32 nt, Human
ucucgaaggugcuuggcggucuugccuucccc

SEQ ID NO: 507108 - RNA, 30 nt, Human
ucucgaagugccuucuugcuccugucuguu

SEQ ID NO: 507109 - RNA, 32 nt, Human
ucucgaauacuuugaauguuguguaacaguua

SEQ ID NO: 507110 - RNA, 32 nt, Human
ucucgacaaaaaggaauugaaagcccuaaaua

SEQ ID NO: 507111 - RNA, 32 nt, Human
ucucgacauaggguccuuacagagguaguuaa

SEQ ID NO: 507112 - RNA, 32 nt, Human
ucucgaccagaggaggccauucccaguccuaa

SEQ ID NO: 507113 - RNA, 32 nt, Human
ucucgaccucgugauccgcccaccucggccuc

SEQ ID NO: 507114 - RNA, 32 nt, Human
ucucgacucacugcaaaaucugccucccgggu

SEQ ID NO: 507115 - RNA, 32 nt, Human
ucucgacucacugcaaccuccaccucccaggu

SEQ ID NO: 507116 - RNA, 32 nt, Human
ucucgacucacugcaaccuccgccucccgagu

SEQ ID NO: 507117 - RNA, 32 nt, Human
ucucgacucacugcaaccuucgccucccagga

SEQ ID NO: 507118 - RNA, 32 nt, Human
ucucgacucacugcaaccuucgccucccaggu

SEQ ID NO: 507119 - RNA, 32 nt, Human
ucucgacucacugcaacuuccaccuccuggag

SEQ ID NO: 507120 - RNA, 32 nt, Human
ucucgacucacugcaagcuccgccucccgggu

SEQ ID NO: 507121 - RNA, 32 nt, Human
ucucgacucacugcagccuccgccuccugggu

SEQ ID NO: 507122 - RNA, 32 nt, Human
ucucgacucacugcagccuugaccucccgggc

SEQ ID NO: 507123 - RNA, 32 nt, Human
ucucgacucacugcagcuaucucucgccucag

SEQ ID NO: 507124 - RNA, 32 nt, Human
ucucgacuuccacccggauucucccucggccc

SEQ ID NO: 507125 - RNA, 32 nt, Human
ucucgagacuggcggccagggagccuggaacc

SEQ ID NO: 507126 - RNA, 32 nt, Human
ucucgaggccucuucugaccucaagggucaca

SEQ ID NO: 507127 - RNA, 32 nt, Human
ucucgaggcgaguuggcggagcugugcgcgcg

SEQ ID NO: 507128 - RNA, 32 nt, Human
ucucgaggcgguggugggaagggagacauacu

SEQ ID NO: 507129 - RNA, 32 nt, Human
ucucgagucacugcagccugugucuccugggu

SEQ ID NO: 507130 - RNA, 32 nt, Human
ucucgaguggcuaccuguugggcuugugggca

SEQ ID NO: 507131 - RNA, 24 nt, Human
ucucgaguggugcuguacuuguua

SEQ ID NO: 507132 - RNA, 32 nt, Human
ucucgaguucccacucacuggaaucuccagcc

SEQ ID NO: 507133 - RNA, 22 nt, Human
ucucgaucuccugaccccauga

SEQ ID NO: 507134 - RNA, 22 nt, Human
ucucgaucuccugaccucauga

SEQ ID NO: 507135 - RNA, 22 nt, Human
ucucgaucuccugaccucguga

SEQ ID NO: 507136 - RNA, 22 nt, Human
ucucgaucucuugaucucguga

SEQ ID NO: 507137 - RNA, 32 nt, Human
ucucgaugguucucuccugggcucaggcgcuu

SEQ ID NO: 507138 - RNA, 22 nt, Human
ucucgauuuucugaccucguga

SEQ ID NO: 507139 - RNA, 32 nt, Human
ucucgcacaggcuuggagugcaguggugcgau

SEQ ID NO: 507140 - RNA, 32 nt, Human
ucucgcacccacccacccccucacccccuucu

SEQ ID NO: 507141 - RNA, 32 nt, Human
ucucgcagcaccagaccagccucugcagcugc

SEQ ID NO: 507142 - RNA, 32 nt, Human
ucucgcaggccagagugcaguggugugaucau

SEQ ID NO: 507143 - RNA, 32 nt, Human
ucucgcaugcuuuuccccugcaccacggaucg

SEQ ID NO: 507144 - RNA, 32 nt, Human
ucucgcauggaagaagucgauuagaguucaua

SEQ ID NO: 507145 - RNA, 32 nt, Human
ucucgcauggaagaagucgauuaguuaggagu

SEQ ID NO: 507146 - RNA, 32 nt, Human
ucucgcaugguguggagggcgccaucuauggu

SEQ ID NO: 507147 - RNA, 19 nt, Human
ucucgccaccccugcccaa

SEQ ID NO: 507148 - RNA, 32 nt, Human
ucucgccacugcacuccaggcugggcgacaga

SEQ ID NO: 507149 - RNA, 32 nt, Human
ucucgccacugcagcucggguccagaaaggca

SEQ ID NO: 507150 - RNA, 32 nt, Human
ucucgccacugcgcuccagccugggcaacaga

SEQ ID NO: 507151 - RNA, 32 nt, Human
ucucgccacugugcuccagccugggcaacaga

SEQ ID NO: 507152 - RNA, 32 nt, Human
ucucgccauccgggggcaaccaugccgaguac

SEQ ID NO: 507153 - RNA, 32 nt, Human
ucucgccaugaucagacauacagcugccuacc

SEQ ID NO: 507154 - RNA, 31 nt, Human
ucucgccaugcuucuuuacuuuaacauauuu

SEQ ID NO: 507155 - RNA, 32 nt, Human
ucucgccaugucuucucacaagacuuucacca

SEQ ID NO: 507156 - RNA, 32 nt, Human
ucucgccauugcacuccauucugggcaacaag

SEQ ID NO: 507157 - RNA, 32 nt, Human
ucucgcccagcccaguucuggaagggauaaaa

SEQ ID NO: 507158 - RNA, 32 nt, Human
ucucgccccggggccacggaaguggcucgccg

SEQ ID NO: 507159 - RNA, 32 nt, Human
ucucgccccuccuacccgcagcuccuggcgcu

SEQ ID NO: 507160 - RNA, 32 nt, Human
ucucgccccugccgccugccccagcuuccccg

SEQ ID NO: 507161 - RNA, 22 nt, Human
ucucgcccgcugccccgcgagc

SEQ ID NO: 507162 - RNA, 32 nt, Human
ucucgcccguggcugcuuccuccauccuggua

SEQ ID NO: 507163 - RNA, 32 nt, Human
ucucgcccuucccaccaugccagaaugggaag

SEQ ID NO: 507164 - RNA, 32 nt, Human
ucucgccuacuuccuggugucgaucgccggcc

SEQ ID NO: 507165 - RNA, 32 nt, Human
ucucgccucacugcaaccuccgccucccaggu

SEQ ID NO: 507166 - RNA, 32 nt, Human
ucucgccucacugcaaccuucaccuaccgagu

SEQ ID NO: 507167 - RNA, 32 nt, Human
ucucgccucacugcaacuugcgccucccgggu

SEQ ID NO: 507168 - RNA, 32 nt, Human
ucucgccucacugcagccuccccaguccaaag

SEQ ID NO: 507169 - RNA, 32 nt, Human
ucucgccucacugcagccucccgaguccaaag

SEQ ID NO: 507170 - RNA, 32 nt, Human
ucucgccucacugcggccuccccaguccaaag

SEQ ID NO: 507171 - RNA, 32 nt, Human
ucucgccucacugcggccuccccaguccacag

SEQ ID NO: 507172 - RNA, 32 nt, Human
ucucgccucacugcggccucccccguccaaag

SEQ ID NO: 507173 - RNA, 32 nt, Human
ucucgccucacugcggccucccgaguccaaag

SEQ ID NO: 507174 - RNA, 32 nt, Human
ucucgccucacugcggccuccggaguccaaaa

SEQ ID NO: 507175 - RNA, 32 nt, Human
ucucgccucacugcggcuucccgaguccaaag

SEQ ID NO: 507176 - RNA, 32 nt, Human
ucucgccucacugcggucuccccaguccaaag

SEQ ID NO: 507177 - RNA, 17 nt, Human
ucucgccugaggccagg

SEQ ID NO: 507178 - RNA, 32 nt, Human
ucucgccugcagcuccgccauggcuccuaaag

SEQ ID NO: 507179 - RNA, 32 nt, Human
ucucgccugccugugucugcugccgagaagcc

SEQ ID NO: 507180 - RNA, 32 nt, Human
ucucgccuguaaucccagcacuuugggaggcc

SEQ ID NO: 507181 - RNA, 32 nt, Human
ucucgccuguaaucccagcacuuugggaggcu

SEQ ID NO: 507182 - RNA, 32 nt, Human
ucucgccuguaaucucagcacuuugggaggcc

SEQ ID NO: 507183 - RNA, 32 nt, Human
ucucgccuuccgcccucgcucucccuccgcgc

SEQ ID NO: 507184 - RNA, 32 nt, Human
ucucgccuuuguucuuguugaagggucucuuc

SEQ ID NO: 507185 - RNA, 25 nt, Human
ucucgcgcacccgcacgcucaccga

SEQ ID NO: 507186 - RNA, 22 nt, Human
ucucgcgcgcacugcgcacaga

SEQ ID NO: 507187 - RNA, 32 nt, Human
ucucgcgucugggaacggccgggcccccagcg

SEQ ID NO: 507188 - RNA, 32 nt, Human
ucucgcuagugauguuuuuaugauaucccuga

SEQ ID NO: 507189 - RNA, 32 nt, Human
ucucgcucacugcaaccuccaccucccagguu

SEQ ID NO: 507190 - RNA, 32 nt, Human
ucucgcucacugcaaccuccgccucccggguu

SEQ ID NO: 507191 - RNA, 32 nt, Human
ucucgcucacugcgcucgaggccggcaccuac

SEQ ID NO: 507192 - RNA, 32 nt, Human
ucucgcucagauggggcaaccgagacacaggc

SEQ ID NO: 507193 - RNA, 32 nt, Human
ucucgcuccauuccucccuuucucucuguuuc

SEQ ID NO: 507194 - RNA, 22 nt, Human
ucucgcucgcccucagcgcggc

SEQ ID NO: 507195 - RNA, 32 nt, Human
ucucgcucuccucuugcuugaacagcugccaa

SEQ ID NO: 507196 - RNA, 32 nt, Human
ucucgcucucucucgcugcguccucauuuccc

SEQ ID NO: 507197 - RNA, 32 nt, Human
ucucgcucucuggagugcaauggcgcaaucuu

SEQ ID NO: 507198 - RNA, 32 nt, Human
ucucgcucugcacuccagccuaggugacagag

SEQ ID NO: 507199 - RNA, 32 nt, Human
ucucgcucugcacuccagccuggcgacugagu

SEQ ID NO: 507200 - RNA, 32 nt, Human
ucucgcucugucaccaggcuugagugcagugg

SEQ ID NO: 507201 - RNA, 32 nt, Human
ucucgcugagccagacccacucuguuccuugg

SEQ ID NO: 507202 - RNA, 32 nt, Human
ucucgcugggccuuagcugccuucccucaggg

SEQ ID NO: 507203 - RNA, 32 nt, Human
ucucgcugucccugugcugcugguauuucauu

SEQ ID NO: 507204 - RNA, 21 nt, Human
ucucgcuucuagcccgcgugc

SEQ ID NO: 507205 - RNA, 32 nt, Human
ucucgcuucugccuccaaaccaaucccuugcu

SEQ ID NO: 507206 - RNA, 32 nt, Human
ucucgcuugcaggucgggagguuuccgggcgg

SEQ ID NO: 507207 - RNA, 21 nt, Human
ucucgcuuugcccgccgccgc

SEQ ID NO: 507208 - RNA, 32 nt, Human
ucucgcuuuguugcccaggcuggucuugaacu

SEQ ID NO: 507209 - RNA, 32 nt, Human
ucucgcuuuguugcccaggcuggucuugaauu

SEQ ID NO: 507210 - RNA, 32 nt, Human
ucucggaagaggaggaggacgaggaggaagag

SEQ ID NO: 507211 - RNA, 32 nt, Human
ucucggaaggcugaggcaggaggaucauuuga

SEQ ID NO: 507212 - RNA, 18 nt, Human
ucucggacaagacugguu

SEQ ID NO: 507213 - RNA, 31 nt, Human
ucucggaccaugucucccgccccaagacccc

SEQ ID NO: 507214 - RNA, 32 nt, Human
ucucggacucguuccuccuggaccagcccaac

SEQ ID NO: 507215 - RNA, 32 nt, Human
ucucggauacuguguucuguccuugaaacggu

SEQ ID NO: 507216 - RNA, 32 nt, Human
ucucggaucacugcaaccuccaccuccuaggu

SEQ ID NO: 507217 - RNA, 32 nt, Human
ucucggaugcagggccagagugacacagccga

SEQ ID NO: 507218 - RNA, 32 nt, Human
ucucggcacacugcaaccuucgccucccagau

SEQ ID NO: 507219 - RNA, 32 nt, Human
ucucggcacccacuugcagucacugccgccug

SEQ ID NO: 507220 - RNA, 32 nt, Human
ucucggcagcaucucagccaggagggcucccu

SEQ ID NO: 507221 - RNA, 32 nt, Human
ucucggcagggaacaggaaguaggaaucccag

SEQ ID NO: 507222 - RNA, 32 nt, Human
ucucggccaccgucgaguuccgucgaguuccg

SEQ ID NO: 507223 - RNA, 32 nt, Human
ucucggccaggcaugcacagcacacagacuga

SEQ ID NO: 507224 - RNA, 21 nt, Human
ucucggcccacugaaaccucc

SEQ ID NO: 507225 - RNA, 32 nt, Human
ucucggcccacugaaaccuccaccucccgggu

SEQ ID NO: 507226 - RNA, 32 nt, Human
ucucggcccacugcaaccucugccuccugggu

SEQ ID NO: 507227 - RNA, 32 nt, Human
ucucggcccugaggacucagaacucacaaguc

SEQ ID NO: 507228 - RNA, 32 nt, Human
ucucggcccugggcccagucucucaggccucc

SEQ ID NO: 507229 - RNA, 32 nt, Human
ucucggccucuggccaacacagucccacccau

SEQ ID NO: 507230 - RNA, 32 nt, Human
ucucggccuucccacuugcugugccucccacc

SEQ ID NO: 507231 - RNA, 32 nt, Human
ucucggccuuucucuccugccuuccacagccu

SEQ ID NO: 507232 - RNA, 32 nt, Human
ucucggcggccguguccuccuccuggcguggc

SEQ ID NO: 507233 - RNA, 32 nt, Human
ucucggcggcggcgagggcugagcgcgggagc

SEQ ID NO: 507234 - RNA, 32 nt, Human
ucucggcggcggcgggcaguugcaguggugca

SEQ ID NO: 507235 - RNA, 32 nt, Human
ucucggcuacuuccuggagcuucugccgccuc

SEQ ID NO: 507236 - RNA, 32 nt, Human
ucucggcucacagcaaccucucugccuccaga

SEQ ID NO: 507237 - RNA, 32 nt, Human
ucucggcucacagcaaccucugccucccggau

SEQ ID NO: 507238 - RNA, 32 nt, Human
ucucggcucaccacaaccuccaccucccaggu

SEQ ID NO: 507239 - RNA, 32 nt, Human
ucucggcucaccacaaccuccgccgcccaagu

SEQ ID NO: 507240 - RNA, 32 nt, Human
ucucggcucaccacaaccuccgccuccugggu

SEQ ID NO: 507241 - RNA, 32 nt, Human
ucucggcucaccacaaccuccuccucuugggu

SEQ ID NO: 507242 - RNA, 32 nt, Human
ucucggcucaccccaaccuccgccuccugggu

SEQ ID NO: 507243 - RNA, 21 nt, Human
ucucggcucaccgcaaccucc

SEQ ID NO: 507244 - RNA, 32 nt, Human
ucucggcucaccgcaaccuccaccuuccuggu

SEQ ID NO: 507245 - RNA, 32 nt, Human
ucucggcucaccgcaaccuccgcccccugggu

SEQ ID NO: 507246 - RNA, 32 nt, Human
ucucggcucaccgcaaccuccgccucccaggu

SEQ ID NO: 507247 - RNA, 32 nt, Human
ucucggcucaccgcaaccuccgccucccggau

SEQ ID NO: 507248 - RNA, 32 nt, Human
ucucggcucaccgcaaccuccgccucccgggu

SEQ ID NO: 507249 - RNA, 32 nt, Human
ucucggcucaccgcaaccuccucuucuggguu

SEQ ID NO: 507250 - RNA, 32 nt, Human
ucucggcucaccgcaaccucugccucccaggu

SEQ ID NO: 507251 - RNA, 32 nt, Human
ucucggcucaccgcaaccucugccucccgggu

SEQ ID NO: 507252 - RNA, 32 nt, Human
ucucggcucaccgcaaccucugccuccugggu

SEQ ID NO: 507253 - RNA, 32 nt, Human
ucucggcucaccgcaaccucugcuuccuggcu

SEQ ID NO: 507254 - RNA, 32 nt, Human
ucucggcucacggcaaccuccaccucccgggu

SEQ ID NO: 507255 - RNA, 32 nt, Human
ucucggcucacuacaaccuccaccuccugggu

SEQ ID NO: 507256 - RNA, 32 nt, Human
ucucggcucacuacaaccuccgccucccaggu

SEQ ID NO: 507257 - RNA, 32 nt, Human
ucucggcucacuauaaccuccaccucccaggu

SEQ ID NO: 507258 - RNA, 32 nt, Human
ucucggcucacuccaaccuccaccuacuaggu

SEQ ID NO: 507259 - RNA, 32 nt, Human
ucucggcucacuccaaucuccaccucccggau

SEQ ID NO: 507260 - RNA, 32 nt, Human
ucucggcucacugaaaccucugccucccgggu

SEQ ID NO: 507261 - RNA, 32 nt, Human
ucucggcucacugaaaccucugccuuccaggu

SEQ ID NO: 507262 - RNA, 32 nt, Human
ucucggcucacugaaaccugugccuccccggu

SEQ ID NO: 507263 - RNA, 32 nt, Human
ucucggcucacugaaacuucugccucccgggu

SEQ ID NO: 507264 - RNA, 32 nt, Human
ucucggcucacugaaccuccgccucccagguu

SEQ ID NO: 507265 - RNA, 22 nt, Human
ucucggcucacugcaaaccgcc

SEQ ID NO: 507266 - RNA, 32 nt, Human
ucucggcucacugcaaaccgccucccggguuc

SEQ ID NO: 507267 - RNA, 21 nt, Human
ucucggcucacugcaaacucc

SEQ ID NO: 507268 - RNA, 32 nt, Human
ucucggcucacugcaaacuccgccucccaggu

SEQ ID NO: 507269 - RNA, 32 nt, Human
ucucggcucacugcaaacuccgccucccgggu

SEQ ID NO: 507270 - RNA, 32 nt, Human
ucucggcucacugcaaacuccgccuuccaggu

SEQ ID NO: 507271 - RNA, 32 nt, Human
ucucggcucacugcaaacucugccucccaggu

SEQ ID NO: 507272 - RNA, 32 nt, Human
ucucggcucacugcaaacucugccucccgggu

SEQ ID NO: 507273 - RNA, 32 nt, Human
ucucggcucacugcaaacucugccuccuggau

SEQ ID NO: 507274 - RNA, 22 nt, Human
ucucggcucacugcaaaucucc

SEQ ID NO: 507275 - RNA, 32 nt, Human
ucucggcucacugcaaaucuccgccucccagg

SEQ ID NO: 507276 - RNA, 32 nt, Human
ucucggcucacugcaacauccaccuccugggu

SEQ ID NO: 507277 - RNA, 32 nt, Human
ucucggcucacugcaacauccagcuccugggu

SEQ ID NO: 507278 - RNA, 32 nt, Human
ucucggcucacugcaaccaccaucucccagga

SEQ ID NO: 507279 - RNA, 32 nt, Human
ucucggcucacugcaaccacugccucccaggu

SEQ ID NO: 507280 - RNA, 32 nt, Human
ucucggcucacugcaacccccacaucccgggu

SEQ ID NO: 507281 - RNA, 32 nt, Human
ucucggcucacugcaacccccaucucccaggu

SEQ ID NO: 507282 - RNA, 32 nt, Human
ucucggcucacugcaaccucaccucccggguu

SEQ ID NO: 507283 - RNA, 21 nt, Human
ucucggcucacugcaaccucc

SEQ ID NO: 507284 - RNA, 32 nt, Human
ucucggcucacugcaaccuccaacucccaggu

SEQ ID NO: 507285 - RNA, 32 nt, Human
ucucggcucacugcaaccuccaacucccuggu

SEQ ID NO: 507286 - RNA, 32 nt, Human
ucucggcucacugcaaccuccacaucccaugu

SEQ ID NO: 507287 - RNA, 32 nt, Human
ucucggcucacugcaaccuccacccccgggga

SEQ ID NO: 507288 - RNA, 32 nt, Human
ucucggcucacugcaaccuccaccucacaggu

SEQ ID NO: 507289 - RNA, 32 nt, Human
ucucggcucacugcaaccuccaccucccagaa

SEQ ID NO: 507290 - RNA, 32 nt, Human
ucucggcucacugcaaccuccaccucccagau

SEQ ID NO: 507291 - RNA, 32 nt, Human
ucucggcucacugcaaccuccaccucccaggu

SEQ ID NO: 507292 - RNA, 32 nt, Human
ucucggcucacugcaaccuccaccuccccagu

SEQ ID NO: 507293 - RNA, 32 nt, Human
ucucggcucacugcaaccuccaccuccccggg

SEQ ID NO: 507294 - RNA, 32 nt, Human
ucucggcucacugcaaccuccaccucccgagu

SEQ ID NO: 507295 - RNA, 32 nt, Human
ucucggcucacugcaaccuccaccucccggau

SEQ ID NO: 507296 - RNA, 32 nt, Human
ucucggcucacugcaaccuccaccucccgggu

SEQ ID NO: 507297 - RNA, 32 nt, Human
ucucggcucacugcaaccuccaccuccuaggu

SEQ ID NO: 507298 - RNA, 32 nt, Human
ucucggcucacugcaaccuccaccuccuggau

SEQ ID NO: 507299 - RNA, 32 nt, Human
ucucggcucacugcaaccuccaccuccuggcu

SEQ ID NO: 507300 - RNA, 32 nt, Human
ucucggcucacugcaaccuccaccuccugggc

SEQ ID NO: 507301 - RNA, 32 nt, Human
ucucggcucacugcaaccuccaccuccugggu

SEQ ID NO: 507302 - RNA, 32 nt, Human
ucucggcucacugcaaccuccaccuccugguu

SEQ ID NO: 507303 - RNA, 32 nt, Human
ucucggcucacugcaaccuccaccucucggcu

SEQ ID NO: 507304 - RNA, 32 nt, Human
ucucggcucacugcaaccuccaccuucagggu

SEQ ID NO: 507305 - RNA, 32 nt, Human
ucucggcucacugcaaccuccacuucuugggu

SEQ ID NO: 507306 - RNA, 32 nt, Human
ucucggcucacugcaaccuccagcucccaggu

SEQ ID NO: 507307 - RNA, 32 nt, Human
ucucggcucacugcaaccucccugccugauuc

SEQ ID NO: 507308 - RNA, 32 nt, Human
ucucggcucacugcaaccuccgacuccugggu

SEQ ID NO: 507309 - RNA, 23 nt, Human
ucucggcucacugcaaccuccgc

SEQ ID NO: 507310 - RNA, 32 nt, Human
ucucggcucacugcaaccuccgcaucccgggu

SEQ ID NO: 507311 - RNA, 32 nt, Human
ucucggcucacugcaaccuccgcccccugggu

SEQ ID NO: 507312 - RNA, 32 nt, Human
ucucggcucacugcaaccuccgccuaccgggu

SEQ ID NO: 507313 - RNA, 32 nt, Human
ucucggcucacugcaaccuccgccucccaagu

SEQ ID NO: 507314 - RNA, 32 nt, Human
ucucggcucacugcaaccuccgccucccaggu

SEQ ID NO: 507315 - RNA, 32 nt, Human
ucucggcucacugcaaccuccgccucccaguu

SEQ ID NO: 507316 - RNA, 32 nt, Human
ucucggcucacugcaaccuccgccucccggcu

SEQ ID NO: 507317 - RNA, 32 nt, Human
ucucggcucacugcaaccuccgccucccgggc

SEQ ID NO: 507318 - RNA, 32 nt, Human
ucucggcucacugcaaccuccgccucccgggu

SEQ ID NO: 507319 - RNA, 32 nt, Human
ucucggcucacugcaaccuccgccucccgguu

SEQ ID NO: 507320 - RNA, 32 nt, Human
ucucggcucacugcaaccuccgccuccugagu

SEQ ID NO: 507321 - RNA, 32 nt, Human
ucucggcucacugcaaccuccgccuccugggc

SEQ ID NO: 507322 - RNA, 32 nt, Human
ucucggcucacugcaaccuccgccuccugggu

SEQ ID NO: 507323 - RNA, 32 nt, Human
ucucggcucacugcaaccuccgccuccuuggu

SEQ ID NO: 507324 - RNA, 32 nt, Human
ucucggcucacugcaaccuccgccuuccugag

SEQ ID NO: 507325 - RNA, 32 nt, Human
ucucggcucacugcaaccuccgccuugcuggu

SEQ ID NO: 507326 - RNA, 32 nt, Human
ucucggcucacugcaaccuccgccuuuccacc

SEQ ID NO: 507327 - RNA, 32 nt, Human
ucucggcucacugcaaccuccgcucccugggu

SEQ ID NO: 507328 - RNA, 32 nt, Human
ucucggcucacugcaaccuccgucucccaggu

SEQ ID NO: 507329 - RNA, 32 nt, Human
ucucggcucacugcaaccuccuccucccgggu

SEQ ID NO: 507330 - RNA, 32 nt, Human
ucucggcucacugcaaccucgccucccugguu

SEQ ID NO: 507331 - RNA, 32 nt, Human
ucucggcucacugcaaccucuaccucccaggu

SEQ ID NO: 507332 - RNA, 32 nt, Human
ucucggcucacugcaaccucuaccuccuggau

SEQ ID NO: 507333 - RNA, 32 nt, Human
ucucggcucacugcaaccucuaccuccugggu

SEQ ID NO: 507334 - RNA, 32 nt, Human
ucucggcucacugcaaccucugccaucaggau

SEQ ID NO: 507335 - RNA, 32 nt, Human
ucucggcucacugcaaccucugccucacgggu

SEQ ID NO: 507336 - RNA, 32 nt, Human
ucucggcucacugcaaccucugccucccaggu

SEQ ID NO: 507337 - RNA, 32 nt, Human
ucucggcucacugcaaccucugccucccgagu

SEQ ID NO: 507338 - RNA, 32 nt, Human
ucucggcucacugcaaccucugccucccgcau

SEQ ID NO: 507339 - RNA, 32 nt, Human
ucucggcucacugcaaccucugccucccggau

SEQ ID NO: 507340 - RNA, 32 nt, Human
ucucggcucacugcaaccucugccucccgggu

SEQ ID NO: 507341 - RNA, 32 nt, Human
ucucggcucacugcaaccucugccucccgugu

SEQ ID NO: 507342 - RNA, 32 nt, Human
ucucggcucacugcaaccucugccuccuaggu

SEQ ID NO: 507343 - RNA, 32 nt, Human
ucucggcucacugcaaccucugccuccugagc

SEQ ID NO: 507344 - RNA, 32 nt, Human
ucucggcucacugcaaccucugccuccugagu

SEQ ID NO: 507345 - RNA, 32 nt, Human
ucucggcucacugcaaccucugccuccuggau

SEQ ID NO: 507346 - RNA, 32 nt, Human
ucucggcucacugcaaccucugccuccugggc

SEQ ID NO: 507347 - RNA, 32 nt, Human
ucucggcucacugcaaccucugccuccugggg

SEQ ID NO: 507348 - RNA, 32 nt, Human
ucucggcucacugcaaccucugccuccugggu

SEQ ID NO: 507349 - RNA, 32 nt, Human
ucucggcucacugcaaccucugccucuugggu

SEQ ID NO: 507350 - RNA, 32 nt, Human
ucucggcucacugcaaccucugcuucccgggu

SEQ ID NO: 507351 - RNA, 32 nt, Human
ucucggcucacugcaaccucugucuccugagu

SEQ ID NO: 507352 - RNA, 32 nt, Human
ucucggcucacugcaaccucuugccucccagg

SEQ ID NO: 507353 - RNA, 32 nt, Human
ucucggcucacugcaaccuucgccucuggguu

SEQ ID NO: 507354 - RNA, 32 nt, Human
ucucggcucacugcaacguccgccucccgggu

SEQ ID NO: 507355 - RNA, 32 nt, Human
ucucggcucacugcaacuaccaccuccugggu

SEQ ID NO: 507356 - RNA, 32 nt, Human
ucucggcucacugcaacuccaccucccggguu

SEQ ID NO: 507357 - RNA, 32 nt, Human
ucucggcucacugcaacucugccucccggguu

SEQ ID NO: 507358 - RNA, 32 nt, Human
ucucggcucacugcaacuuccaccucccgggu

SEQ ID NO: 507359 - RNA, 32 nt, Human
ucucggcucacugcaacuuccgccucccgguu

SEQ ID NO: 507360 - RNA, 32 nt, Human
ucucggcucacugcaacuuccgccuccuggga

SEQ ID NO: 507361 - RNA, 32 nt, Human
ucucggcucacugcaacuucuaccaccuaggu

SEQ ID NO: 507362 - RNA, 32 nt, Human
ucucggcucacugcaacuucugccucccgggu

SEQ ID NO: 507363 - RNA, 32 nt, Human
ucucggcucacugcaacuucugccuccuaggu

SEQ ID NO: 507364 - RNA, 32 nt, Human
ucucggcucacugcaagauccgccucccgggu

SEQ ID NO: 507365 - RNA, 32 nt, Human
ucucggcucacugcaagccccaccucccaagu

SEQ ID NO: 507366 - RNA, 32 nt, Human
ucucggcucacugcaagccccaccuucugagu

SEQ ID NO: 507367 - RNA, 32 nt, Human
ucucggcucacugcaagcccugccuccugggu

SEQ ID NO: 507368 - RNA, 32 nt, Human
ucucggcucacugcaagcucagccuccccgau

SEQ ID NO: 507369 - RNA, 32 nt, Human
ucucggcucacugcaagcuccaccucccaggu

SEQ ID NO: 507370 - RNA, 32 nt, Human
ucucggcucacugcaagcuccaccucccgggu

SEQ ID NO: 507371 - RNA, 32 nt, Human
ucucggcucacugcaagcuccaccuccugggu

SEQ ID NO: 507372 - RNA, 32 nt, Human
ucucggcucacugcaagcuccaucucccaggu

SEQ ID NO: 507373 - RNA, 23 nt, Human
ucucggcucacugcaagcuccgc

SEQ ID NO: 507374 - RNA, 32 nt, Human
ucucggcucacugcaagcuccgccucccagau

SEQ ID NO: 507375 - RNA, 32 nt, Human
ucucggcucacugcaagcuccgccucccagga

SEQ ID NO: 507376 - RNA, 32 nt, Human
ucucggcucacugcaagcuccgccucccaggu

SEQ ID NO: 507377 - RNA, 32 nt, Human
ucucggcucacugcaagcuccgccucccggau

SEQ ID NO: 507378 - RNA, 32 nt, Human
ucucggcucacugcaagcuccgccucccgggu

SEQ ID NO: 507379 - RNA, 32 nt, Human
ucugcugggaauuggggcagccccaggcgucc

SEQ ID NO: 507380 - RNA, 32 nt, Human
ucugcugggaggaauggccaaguagauuauaa

SEQ ID NO: 507381 - RNA, 20 nt, Human
ucugcugggagggcgcgcag

SEQ ID NO: 507382 - RNA, 32 nt, Human
ucugcugggcaggcaaccugggguccagcuca

SEQ ID NO: 507383 - RNA, 32 nt, Human
ucugcugggcaggccucggggaggaccccuca

SEQ ID NO: 507384 - RNA, 32 nt, Human
ucugcugggcugcagaagcggcggcggcggca

SEQ ID NO: 507385 - RNA, 32 nt, Human
ucugcugggcugugaaggagaauaaagaguua

SEQ ID NO: 507386 - RNA, 32 nt, Human
ucugcuggggcugaaguuucuggggucacaug

SEQ ID NO: 507387 - RNA, 32 nt, Human
ucugcugggggcccugguaaccccaccucucu

SEQ ID NO: 507388 - RNA, 32 nt, Human
ucugcuggguauguuuuggaagugagugucac

SEQ ID NO: 507389 - RNA, 32 nt, Human
ucugcugggugaggggcacccagcuccagagg

SEQ ID NO: 507390 - RNA, 32 nt, Human
ucugcugguaagugaggcauggaguugguggg

SEQ ID NO: 507391 - RNA, 32 nt, Human
ucugcugguauguguuaaacagcagaccggcc

SEQ ID NO: 507392 - RNA, 32 nt, Human
ucugcuggugcuggugcaaggacuucuguucc

SEQ ID NO: 507393 - RNA, 32 nt, Human
ucugcuggugcuucugugccugugggucugga

SEQ ID NO: 507394 - RNA, 32 nt, Human
ucugcugguguuuuguucaaucuggaagaaug

SEQ ID NO: 507395 - RNA, 18 nt, Human
ucugcugguugcagcuga

SEQ ID NO: 507396 - RNA, 32 nt, Human
ucugcuguacaucuuauuuauuuucuccagag

SEQ ID NO: 507397 - RNA, 32 nt, Human
ucugcuguccuuuauuuaugggagaaacauag

SEQ ID NO: 507398 - RNA, 32 nt, Human
ucugcugucucucauggagauggugggcauca

SEQ ID NO: 507399 - RNA, 32 nt, Human
ucugcugucugugucuucuauuuggcaaacag

SEQ ID NO: 507400 - RNA, 32 nt, Human
ucugcugugccagggcugcacugaguucaaau

SEQ ID NO: 507401 - RNA, 32 nt, Human
ucugcugugcucuccagcacugcgagcuucug

SEQ ID NO: 507402 - RNA, 32 nt, Human
ucugcugugugaauaaauaauuccugaagaau

SEQ ID NO: 507403 - RNA, 32 nt, Human
ucugcuguuaacugcaaccuuguuuauuaaau

SEQ ID NO: 507404 - RNA, 32 nt, Human
ucugcuguuauccugccccaagggccugggcc

SEQ ID NO: 507405 - RNA, 32 nt, Human
ucugcuguuccuucgaggguuccaggcugugu

SEQ ID NO: 507406 - RNA, 32 nt, Human
ucugcuguuuguuccaggcucaccuuuagaac

SEQ ID NO: 507407 - RNA, 32 nt, Human
ucugcuguuuuagccuagaaggaaaagaagca

SEQ ID NO: 507408 - RNA, 32 nt, Human
ucugcuguuuuagccuagcaggaaaagaagca

SEQ ID NO: 507409 - RNA, 32 nt, Human
ucugcuuagccgcggucaugagccggcacagc

SEQ ID NO: 507410 - RNA, 32 nt, Human
ucugcuuagcuggugggcaggggagagaggga

SEQ ID NO: 507411 - RNA, 32 nt, Human
ucugcuuaggucgcagcucacgcauugaaugc

SEQ ID NO: 507412 - RNA, 32 nt, Human
ucugcuuauaaauaaacuuaacaaauacacua

SEQ ID NO: 507413 - RNA, 32 nt, Human
ucugcuuauuagacaaauauauacucauuuua

SEQ ID NO: 507414 - RNA, 32 nt, Human
ucugcuucacuguccagccuuggaacuaccac

SEQ ID NO: 507415 - RNA, 32 nt, Human
ucugcuucagccccaaguaggugggacuccag

SEQ ID NO: 507416 - RNA, 32 nt, Human
ucugcuucagcuaccuaagagggaagggcccc

SEQ ID NO: 507417 - RNA, 32 nt, Human
ucugcuucauccguggaacuugaggcucagau

SEQ ID NO: 507418 - RNA, 32 nt, Human
ucugcuucauucucucuuugacuccagcuguc

SEQ ID NO: 507419 - RNA, 32 nt, Human
ucugcuucauucugagcguucuugccuccccu

SEQ ID NO: 507420 - RNA, 32 nt, Human
ucugcuuccaaggcuccgcuucagaggcggcu

SEQ ID NO: 507421 - RNA, 32 nt, Human
ucugcuuccagcugcagccuccuuccugccug

SEQ ID NO: 507422 - RNA, 32 nt, Human
ucugcuucccaccugcccuccccacccccugc

SEQ ID NO: 507423 - RNA, 32 nt, Human
ucugcuucccagagagggucuggccuugccca

SEQ ID NO: 507424 - RNA, 19 nt, Human
ucugcuucccgucagccuc

SEQ ID NO: 507425 - RNA, 21 nt, Human
ucugcuucccucccaggccuc

SEQ ID NO: 507426 - RNA, 21 nt, Human
ucugcuucccucuauuuucuc

SEQ ID NO: 507427 - RNA, 21 nt, Human
ucugcuucccuguuucauauc

SEQ ID NO: 507428 - RNA, 32 nt, Human
ucugcuuccuauagcugggaugauauggggga

SEQ ID NO: 507429 - RNA, 32 nt, Human
ucugcuuccugcagccucuccccgaccucaga

SEQ ID NO: 507430 - RNA, 32 nt, Human
ucugcuucuacugaacuaugcguacugcauag

SEQ ID NO: 507431 - RNA, 32 nt, Human
ucugcuucuaguucuccaccuccagguuggga

SEQ ID NO: 507432 - RNA, 32 nt, Human
ucugcuucucagacccaaucacuguggccagg

SEQ ID NO: 507433 - RNA, 32 nt, Human
ucugcuucuccucuguggguacgagggccgcu

SEQ ID NO: 507434 - RNA, 32 nt, Human
ucugcuucuccuguggcucugccaucagcucc

SEQ ID NO: 507435 - RNA, 32 nt, Human
ucugcuucucucuuccucaucucccaauaccu

SEQ ID NO: 507436 - RNA, 32 nt, Human
ucugcuucucucuugcauagauacaaucaaga

SEQ ID NO: 507437 - RNA, 32 nt, Human
ucugcuucugcugcugaucaaggcagcucagc

SEQ ID NO: 507438 - RNA, 32 nt, Human
ucugcuucuguagcccacggcaccccaaacuu

SEQ ID NO: 507439 - RNA, 32 nt, Human
ucugcuucuguuucccugucuugggauccuua

SEQ ID NO: 507440 - RNA, 32 nt, Human
ucugcuugcagcugcccaagucugccugggcc

SEQ ID NO: 507441 - RNA, 23 nt, Human
ucugcuugcccuuagugugauga

SEQ ID NO: 507442 - RNA, 32 nt, Human
ucugcuugccuuuccugaaaguuucuggggcu

SEQ ID NO: 507443 - RNA, 32 nt, Human
ucugcuugcucucugcuuagacaggcuuuaag

SEQ ID NO: 507444 - RNA, 32 nt, Human
ucugcuugcugccgccgcgcuccugggugauc

SEQ ID NO: 507445 - RNA, 32 nt, Human
ucugcuugcuugcugcuuuuccuugcuuucuc

SEQ ID NO: 507446 - RNA, 32 nt, Human
ucugcuuggaguuuacauaucaaaguucuggg

SEQ ID NO: 507447 - RNA, 32 nt, Human
ucugcuuggauggugucuuccucuccucagcc

SEQ ID NO: 507448 - RNA, 32 nt, Human
ucugcuugggccgcgagggaaggugaggucgg

SEQ ID NO: 507449 - RNA, 23 nt, Human
ucugcuugguccccgagaugggg

SEQ ID NO: 507450 - RNA, 32 nt, Human
ucugcuugucuuuauguugcuggaacauuucu

SEQ ID NO: 507451 - RNA, 32 nt, Human
ucugcuuuaagaauuaacgaaagcagugucaa

SEQ ID NO: 507452 - RNA, 21 nt, Human
ucugcuuucccggcaaggcag

SEQ ID NO: 507453 - RNA, 32 nt, Human
ucugcuuuccgacauuuugccucucucacugg

SEQ ID NO: 507454 - RNA, 32 nt, Human
ucugcuuuccugucuguagugccugcuguuug

SEQ ID NO: 507455 - RNA, 32 nt, Human
ucugcuuucuuccauuuuuccuucccauuauu

SEQ ID NO: 507456 - RNA, 32 nt, Human
ucugcuuugagacuggaguuucugcuauucuc

SEQ ID NO: 507457 - RNA, 32 nt, Human
ucugcuuugcucucacaggaccucagcccguc

SEQ ID NO: 507458 - RNA, 32 nt, Human
ucugcuuuggguuguucucugccccuuccuuc

SEQ ID NO: 507459 - RNA, 32 nt, Human
ucugcuuuuaauuguucuucaagucugggaaa

SEQ ID NO: 507460 - RNA, 32 nt, Human
ucugcuuuucacucuugccuugucucccaauu

SEQ ID NO: 507461 - RNA, 32 nt, Human
ucugcuuuuccacuucuaccugcguguggguu

SEQ ID NO: 507462 - RNA, 32 nt, Human
ucugcuuuuccauucuggguguuuucagaaag

SEQ ID NO: 507463 - RNA, 32 nt, Human
ucugcuuuucuccaaucucaguuuuuccauca

SEQ ID NO: 507464 - RNA, 32 nt, Human
ucugcuuuucugucagagauggcaagggcuuu

SEQ ID NO: 507465 - RNA, 32 nt, Human
ucugcuuuuucagcuucuccaucgccugccuu

SEQ ID NO: 507466 - RNA, 32 nt, Human
ucugcuuuuugacuugcaucugagaguuucuu

SEQ ID NO: 507467 - RNA, 22 nt, Human
ucuggaaaaccaacaacuugaa

SEQ ID NO: 507468 - RNA, 21 nt, Human
ucuggaaaacccuucccugaa

SEQ ID NO: 507469 - RNA, 32 nt, Human
ucuggaaaacccuucccugaagagagagaacg

SEQ ID NO: 507470 - RNA, 22 nt, Human
ucuggaaaaccuccggcucucu

SEQ ID NO: 507471 - RNA, 20 nt, Human
ucuggaaacacccuuccgga

SEQ ID NO: 507472 - RNA, 32 nt, Human
ucuggaaacaucaaagcuggauuuaaacaucu

SEQ ID NO: 507473 - RNA, 20 nt, Human
ucuggaaacccauuucuguu

SEQ ID NO: 507474 - RNA, 32 nt, Human
ucuggaaaggaaauaaaugggagaaaaauaaa

SEQ ID NO: 507475 - RNA, 32 nt, Human
ucuggaaagggcccucaacagaacccgaccau

SEQ ID NO: 507476 - RNA, 32 nt, Human
ucuggaaaguaucugucacaugauauuuuaaa

SEQ ID NO: 507477 - RNA, 32 nt, Human
ucuggaaauaaauuguuauggaggggcuguuu

SEQ ID NO: 507478 - RNA, 32 nt, Human
ucuggaaauaggaagacagagaagguagagua

SEQ ID NO: 507479 - RNA, 32 nt, Human
ucuggaaaugcacccagaagucuggagaaggu

SEQ ID NO: 507480 - RNA, 32 nt, Human
ucuggaaaugccucugggcugcugugcaaaag

SEQ ID NO: 507481 - RNA, 32 nt, Human
ucuggaaauggaaaccgcuccuguauauucug

SEQ ID NO: 507482 - RNA, 32 nt, Human
ucuggaaauggcuguaggugguguugagaaag

SEQ ID NO: 507483 - RNA, 32 nt, Human
ucuggaacaaaccucucaccucaggccagaag

SEQ ID NO: 507484 - RNA, 32 nt, Human
ucuggaacacgcugcuccccugggcagcuguu

SEQ ID NO: 507485 - RNA, 32 nt, Human
ucuggaaccagccugugugccagcgcuguguc

SEQ ID NO: 507486 - RNA, 22 nt, Human
ucuggaaccucccaucccugcc

SEQ ID NO: 507487 - RNA, 32 nt, Human
ucuggaacucacuguucucuugcuuccuucca

SEQ ID NO: 507488 - RNA, 32 nt, Human
ucuggaagaaaaugacuaaaacuguuugcauc

SEQ ID NO: 507489 - RNA, 32 nt, Human
ucuggaagaagaggaagaggaaagaaaaggag

SEQ ID NO: 507490 - RNA, 22 nt, Human
ucuggaagaauuacuaugcuga

SEQ ID NO: 507491 - RNA, 32 nt, Human
ucuggaagacaaguucauuucaucuugagauc

SEQ ID NO: 507492 - RNA, 32 nt, Human
ucuggaagacuccgugccacuccuuucuagug

SEQ ID NO: 507493 - RNA, 32 nt, Human
ucuggaagccugucccaagugaaugaaugcuc

SEQ ID NO: 507494 - RNA, 32 nt, Human
ucuggaagccuucugccauguuccuccacagc

SEQ ID NO: 507495 - RNA, 32 nt, Human
ucuggaagcuaaauugccuccugccagagaug

SEQ ID NO: 507496 - RNA, 32 nt, Human
ucuggaagcugaagcagcaagaucacuugagc

SEQ ID NO: 507497 - RNA, 32 nt, Human
ucuggaagcugaggcaggagaaucgcuugaac

SEQ ID NO: 507498 - RNA, 32 nt, Human
ucuggaaggaaauuaaaagugcuacuuuaaug

SEQ ID NO: 507499 - RNA, 32 nt, Human
ucuggaaggagaaaauacaacaugucauuuau

SEQ ID NO: 507500 - RNA, 32 nt, Human
ucuggaaggagcuggccccucagucccuuccu

SEQ ID NO: 507501 - RNA, 23 nt, Human
ucuggaaggauagggcugugugg

SEQ ID NO: 507502 - RNA, 32 nt, Human
ucuggaaggauuuugucgucugccucccaguu

SEQ ID NO: 507503 - RNA, 24 nt, Human
ucuggaaggcagagguugcaguga

SEQ ID NO: 507504 - RNA, 20 nt, Human
ucuggaaggccuucgccagg

SEQ ID NO: 507505 - RNA, 32 nt, Human
ucuggaagggcugucuguggcuguccugagac

SEQ ID NO: 507506 - RNA, 32 nt, Human
ucuggaaggugcugaaugcccugcugacuggg

SEQ ID NO: 507507 - RNA, 32 nt, Human
ucuggaaguaccaccuggacucacagaggagc

SEQ ID NO: 507508 - RNA, 32 nt, Human
ucuggaaguagugagagaagcugguaauucug

SEQ ID NO: 507509 - RNA, 32 nt, Human
ucuggaaguauuaggcucauuuuauauuugug

SEQ ID NO: 507510 - RNA, 32 nt, Human
ucuggaagucgugcuggucucccaggugaggc

SEQ ID NO: 507511 - RNA, 32 nt, Human
ucuggaaguggacaucgcggcucuguguuuuu

SEQ ID NO: 507512 - RNA, 32 nt, Human
ucuggaaguggagcuaggaugggaggcguagc

SEQ ID NO: 507513 - RNA, 32 nt, Human
ucuggaaguggugggaggcagcuguggugcag

SEQ ID NO: 507514 - RNA, 32 nt, Human
ucuggaaguuucuagucucacaaaaaggaaga

SEQ ID NO: 507515 - RNA, 32 nt, Human
ucuggaauaaugaagcaggcgaggacggagcc

SEQ ID NO: 507516 - RNA, 32 nt, Human
ucuggaauccuagcuacucaggaggcuguggc

SEQ ID NO: 507517 - RNA, 25 nt, Human
ucuggaaucucuguuuuaugcuaaa

SEQ ID NO: 507518 - RNA, 32 nt, Human
ucuggaaucugccugggcuuggaagaaagagg

SEQ ID NO: 507519 - RNA, 23 nt, Human
ucuggaaucuuccaguucugcca

SEQ ID NO: 507520 - RNA, 32 nt, Human
ucuggaaugccacaucuccucccaccagccac

SEQ ID NO: 507521 - RNA, 32 nt, Human
ucuggaaugccuuuguaaacagguguguugaa

SEQ ID NO: 507522 - RNA, 30 nt, Human
ucuggaauggucucugggcuccuguuucug

SEQ ID NO: 507523 - RNA, 32 nt, Human
ucuggaauggucuggaguggucuggaaagcag

SEQ ID NO: 507524 - RNA, 32 nt, Human
ucuggaaugucacucaagaccaagcggucaga

SEQ ID NO: 507525 - RNA, 32 nt, Human
ucuggaauuuguuguauuuucucccaguaaag

SEQ ID NO: 507526 - RNA, 21 nt, Human
ucuggacaaaucuuguccaag

SEQ ID NO: 507527 - RNA, 32 nt, Human
ucuggacaaauuccuuucucuuuaguucagcg

SEQ ID NO: 507528 - RNA, 32 nt, Human
ucuggacaacagagcaagacucugucucaaaa

SEQ ID NO: 507529 - RNA, 21 nt, Human
ucuggacaccuccuaucugcu

SEQ ID NO: 507530 - RNA, 24 nt, Human
ucuggacacguaaccuaugucaga

SEQ ID NO: 507531 - RNA, 24 nt, Human
ucuggacacuccauccuugccaaa

SEQ ID NO: 507532 - RNA, 24 nt, Human
ucuggacacucuucuccuguuaga

SEQ ID NO: 507533 - RNA, 32 nt, Human
ucuggacacuggcugaauccuuccucuccccu

SEQ ID NO: 507534 - RNA, 32 nt, Human
ucuggacagagaggaaggaaggauuggaaaag

SEQ ID NO: 507535 - RNA, 32 nt, Human
ucuggacagagccacagacaagucuggggaua

SEQ ID NO: 507536 - RNA, 32 nt, Human
ucuggacaggaaaauugcaaaguacaauuaac

SEQ ID NO: 507537 - RNA, 32 nt, Human
ucuggacaguuuacagaagcuaugcacuugau

SEQ ID NO: 507538 - RNA, 32 nt, Human
ucuggacaugaggagcaaaggaagggggcaau

SEQ ID NO: 507539 - RNA, 23 nt, Human
ucuggacauuucauuaugugaga

SEQ ID NO: 507540 - RNA, 32 nt, Human
ucuggaccaaaccacuggacaccuuacaugua

SEQ ID NO: 507541 - RNA, 32 nt, Human
ucuggaccagcacugcagcccagccagugguu

SEQ ID NO: 507542 - RNA, 32 nt, Human
ucuggacccacucugucagcauggacauccuu

SEQ ID NO: 507543 - RNA, 32 nt, Human
ucuggacccagccuggucugcacugcaaccuc

SEQ ID NO: 507544 - RNA, 20 nt, Human
ucuggaccccuuguccugcu

SEQ ID NO: 507545 - RNA, 32 nt, Human
ucuggacccuucuaggacgacauggccgugac

SEQ ID NO: 507546 - RNA, 32 nt, Human
ucuggaccucaaaauuaugggaacauuuacuu

SEQ ID NO: 507547 - RNA, 32 nt, Human
ucuggaccucaaagucccucuggaggaccaca

SEQ ID NO: 507548 - RNA, 32 nt, Human
ucuggaccucagcuuugcuaucuauaaaauga

SEQ ID NO: 507549 - RNA, 32 nt, Human
ucuggaccucagguuuccaucuguaaaaugag

SEQ ID NO: 507550 - RNA, 32 nt, Human
ucuggaccuuaguuuacuagucuccaauacac

SEQ ID NO: 507551 - RNA, 32 nt, Human
ucuggaccuuucuaccaguuguggaccaugag

SEQ ID NO: 507552 - RNA, 24 nt, Human
ucuggacgagcaguggagagggaa

SEQ ID NO: 507553 - RNA, 23 nt, Human
ucuggacgcugccuuuucccaaa

SEQ ID NO: 507554 - RNA, 32 nt, Human
ucuggacggaagugguggcuguggaaggcgua

SEQ ID NO: 507555 - RNA, 21 nt, Human
ucuggacgucccuuccugcua

SEQ ID NO: 507556 - RNA, 32 nt, Human
ucuggacgugaagacguggcuggagcaggaga

SEQ ID NO: 507557 - RNA, 32 nt, Human
ucuggacuagagagaagagggagaggacugga

SEQ ID NO: 507558 - RNA, 32 nt, Human
ucuggacucugauguguguggagggaugggga

SEQ ID NO: 507559 - RNA, 18 nt, Human
ucuggacucugugcccau

SEQ ID NO: 507560 - RNA, 32 nt, Human
ucuggacucuuccuugcccuguucuguaaaga

SEQ ID NO: 507561 - RNA, 32 nt, Human
ucuggacugaggccuuugcugugaacugcagu

SEQ ID NO: 507562 - RNA, 21 nt, Human
ucuggacugaguuuugccaaa

SEQ ID NO: 507563 - RNA, 32 nt, Human
ucuggacugcaaaucugcacacacaacgaaca

SEQ ID NO: 507564 - RNA, 32 nt, Human
ucuggacugcacacagcacccacaaccagccc

SEQ ID NO: 507565 - RNA, 32 nt, Human
ucuggacugcuggaaugggaauccaagagcga

SEQ ID NO: 507566 - RNA, 32 nt, Human
ucuggacugggagcucagugaggauucugacc

SEQ ID NO: 507567 - RNA, 32 nt, Human
ucuggacugggcuguaaaaaucugugaacacu

SEQ ID NO: 507568 - RNA, 32 nt, Human
ucuggacuguuuaguaugcagaaggaccagcc

SEQ ID NO: 507569 - RNA, 28 nt, Human
ucuggacuguuucuuccuguugcuguca

SEQ ID NO: 507570 - RNA, 32 nt, Human
ucuggacuucccaucggcccucagggacguaa

SEQ ID NO: 507571 - RNA, 32 nt, Human
ucuggacuucuuuuauggggcuccuggcggug

SEQ ID NO: 507572 - RNA, 32 nt, Human
ucuggacuugcagaguacaugauagcaaaaua

SEQ ID NO: 507573 - RNA, 32 nt, Human
ucuggagaaaugcugaggcgagauuagugcag

SEQ ID NO: 507574 - RNA, 32 nt, Human
ucuggagaacacagcaacaaggugccaucuug

SEQ ID NO: 507575 - RNA, 24 nt, Human
ucuggagaaccucauccagcuccc

SEQ ID NO: 507576 - RNA, 24 nt, Human
ucuggagaacgccaucagcucgcu

SEQ ID NO: 507577 - RNA, 22 nt, Human
ucuggagaacucugggaccccu

SEQ ID NO: 507578 - RNA, 32 nt, Human
ucuggagaaggcccugaaaucacauugauaua

SEQ ID NO: 507579 - RNA, 32 nt, Human
ucuggagaauccacccccaccagauuccuccg

SEQ ID NO: 507580 - RNA, 32 nt, Human
ucuggagaauggggcagcuuccacacugccca

SEQ ID NO: 507581 - RNA, 21 nt, Human
ucuggagaauuaucacaaccu

SEQ ID NO: 507582 - RNA, 32 nt, Human
ucuggagaccaucuuguuccagccucugaaga

SEQ ID NO: 507583 - RNA, 32 nt, Human
ucuggagacugaggugggagaaucgcuugaga

SEQ ID NO: 507584 - RNA, 21 nt, Human
ucuggagacugcaggcucccu

SEQ ID NO: 507585 - RNA, 32 nt, Human
ucuggagacugcuguguguugagggaagauac

SEQ ID NO: 507586 - RNA, 32 nt, Human
ucuggagagcaucuaccuucaggacagccuuc

SEQ ID NO: 507587 - RNA, 32 nt, Human
ucuggagaggagagagucggcaaagagggcag

SEQ ID NO: 507588 - RNA, 18 nt, Human
ucuggagagggaagggaa

SEQ ID NO: 507589 - RNA, 32 nt, Human
ucuggagagguuauaggucacuccuggggccu

SEQ ID NO: 507590 - RNA, 21 nt, Human
ucuggagagugacgucucccu

SEQ ID NO: 507591 - RNA, 22 nt, Human
ucuggagauagaugggcucccu

SEQ ID NO: 507592 - RNA, 32 nt, Human
ucuggagauuccugcaaccucaagagacuucc

SEQ ID NO: 507593 - RNA, 32 nt, Human
ucuggagcacuuguuuuaaaaugcagauucau

SEQ ID NO: 507594 - RNA, 32 nt, Human
ucuggagcagccuggugaacccugccacaggc

SEQ ID NO: 507595 - RNA, 32 nt, Human
ucuggagcaugaggcuggaugcagugguggug

SEQ ID NO: 507596 - RNA, 32 nt, Human
ucuggagcaugcagcaacaacauaccaucuug

SEQ ID NO: 507597 - RNA, 32 nt, Human
ucuggagcauuguguauagaacuggauuuuca

SEQ ID NO: 507598 - RNA, 32 nt, Human
ucuggagccagccgagcaggaggccuaggagg

SEQ ID NO: 507599 - RNA, 20 nt, Human
ucuggagcccagcccaaaag

SEQ ID NO: 507600 - RNA, 32 nt, Human
ucuggagcccaggaguucgaggcugcaaugag

SEQ ID NO: 507601 - RNA, 32 nt, Human
ucuggagcccaggggcuugugggugggcagcu

SEQ ID NO: 507602 - RNA, 32 nt, Human
ucuggagcccccagaggagauaagacagagac

SEQ ID NO: 507603 - RNA, 21 nt, Human
ucuggagcccgguggagaaga

SEQ ID NO: 507604 - RNA, 32 nt, Human
ucuggagccgagaaggagaacaccucuguccu

SEQ ID NO: 507605 - RNA, 32 nt, Human
ucuggagccuccagggaucuaggggagccugg

SEQ ID NO: 507606 - RNA, 32 nt, Human
ucuggagccugcaggcaggugggggcugcguc

SEQ ID NO: 507607 - RNA, 32 nt, Human
ucuggagcgggcagagcgggggcaguugauag

SEQ ID NO: 507608 - RNA, 32 nt, Human
ucuggagcucaggccuuccugaggagcaauca

SEQ ID NO: 507609 - RNA, 32 nt, Human
ucuggagcugagcuaccuggggugggggccaa

SEQ ID NO: 507610 - RNA, 32 nt, Human
ucuggagcugcagcuuccucccuggcuguggg

SEQ ID NO: 507611 - RNA, 31 nt, Human
ucuggagcugccaaggagggaggagacucgg

SEQ ID NO: 507612 - RNA, 32 nt, Human
ucuggagcuguggagcuuguaaagucacacuc

SEQ ID NO: 507613 - RNA, 32 nt, Human
ucuggagcuugucaccauuggacagucucccu

SEQ ID NO: 507614 - RNA, 32 nt, Human
ucuggagcuuugagaucuaaaacuucuguugc

SEQ ID NO: 507615 - RNA, 32 nt, Human
ucuggaggaagaagacacauuccuaguucccc

SEQ ID NO: 507616 - RNA, 32 nt, Human
ucuggaggaagucgaaaaagauaagaauggca

SEQ ID NO: 507617 - RNA, 32 nt, Human
ucuggaggaauccugcagccagccuugcccag

SEQ ID NO: 507618 - RNA, 32 nt, Human
ucuggaggagcagcuggcucugcucugagaaa

SEQ ID NO: 507619 - RNA, 32 nt, Human
ucuggaggagccauggcccagagcagcugugg

SEQ ID NO: 507620 - RNA, 32 nt, Human
ucuggaggagcccgcccaggagaaggccccaa

SEQ ID NO: 507621 - RNA, 32 nt, Human
ucuggaggaggaggaaaaagauacacgcccuu

SEQ ID NO: 507622 - RNA, 32 nt, Human
ucuggaggauucaagaguggaagaggaauuua

SEQ ID NO: 507623 - RNA, 32 nt, Human
ucuggaggcaggucagaacaagaggcaugugu

SEQ ID NO: 507624 - RNA, 32 nt, Human
ucuggaggccagaaagaaaagccuucuuuuuc

SEQ ID NO: 507625 - RNA, 32 nt, Human
ucuggaggcccaggaguguggcugcaagagaa

SEQ ID NO: 507626 - RNA, 32 nt, Human
ucuggaggccucauuaugucucuggcuugcuc

SEQ ID NO: 507627 - RNA, 32 nt, Human
ucuggaggcuaaggcaggagaauugcuugaac

SEQ ID NO: 507628 - RNA, 32 nt, Human
ucuggaggcugaaaugggaggaucacuugagc

SEQ ID NO: 507629 - RNA, 32 nt, Human
ucuggaggcugaagcaggagaauggcaugaac

SEQ ID NO: 507630 - RNA, 32 nt, Human
ucuggaggcugaaguuggaggauggcuugagc

SEQ ID NO: 507631 - RNA, 32 nt, Human
ucuggaggcugagacaggagaaucgcuugaac

SEQ ID NO: 507632 - RNA, 32 nt, Human
ucuggaggcugaggcagaagaaucacuugaac

SEQ ID NO: 507633 - RNA, 32 nt, Human
ucuggaggcugaggcaggaagaucacuggagc

SEQ ID NO: 507634 - RNA, 32 nt, Human
ucuggaggcugaggcaggagaaacaccugagc

SEQ ID NO: 507635 - RNA, 32 nt, Human
ucuggaggcugaggcaggagaaucaauugaac

SEQ ID NO: 507636 - RNA, 32 nt, Human
ucuggaggcugaggcaggagaaucacuugaac

SEQ ID NO: 507637 - RNA, 32 nt, Human
ucuggaggcugaggcaggagaaucgcuugaac

SEQ ID NO: 507638 - RNA, 32 nt, Human
ucuggaggcugaggcaggagaaucucuugaac

SEQ ID NO: 507639 - RNA, 32 nt, Human
ucuggaggcugaggcaggagaauggcaugagc

SEQ ID NO: 507640 - RNA, 32 nt, Human
ucuggaggcugaggcaggagaauggcgugaac

SEQ ID NO: 507641 - RNA, 32 nt, Human
ucuggaggcugaggcaggagaauggcgugagc

SEQ ID NO: 507642 - RNA, 32 nt, Human
ucuggaggcugaggcaggagaauggcuugaac

SEQ ID NO: 507643 - RNA, 32 nt, Human
ucuggaggcugaggcaggagaauugcuugaac

SEQ ID NO: 507644 - RNA, 32 nt, Human
ucuggaggcugaggcaggagaguagcgugaac

SEQ ID NO: 507645 - RNA, 32 nt, Human
ucuggaggcugaggcaggaggaucacuugagc

SEQ ID NO: 507646 - RNA, 32 nt, Human
ucuggaggcugaggcaggaggauggugugaac

SEQ ID NO: 507647 - RNA, 32 nt, Human
ucuggaggcugaggcgggagaaucgcuugaac

SEQ ID NO: 507648 - RNA, 32 nt, Human
ucuggaggcugagguaggagaauugcuugaac

SEQ ID NO: 507649 - RNA, 32 nt, Human
ucuggaggcugcaggccugagcaggugggcgu

SEQ ID NO: 507650 - RNA, 32 nt, Human
ucuggaggcuggggcaggagaauugcuugaac

SEQ ID NO: 507651 - RNA, 32 nt, Human
ucuggaggcuggucagucuacgcacaacugaa

SEQ ID NO: 507652 - RNA, 32 nt, Human
ucuggaggcuuaggcgggagaaucacuugaac

SEQ ID NO: 507653 - RNA, 32 nt, Human
ucuggagggccauggagaagaggcugggaguc

SEQ ID NO: 507654 - RNA, 21 nt, Human
ucuggagggcucuguccuucc

SEQ ID NO: 507655 - RNA, 24 nt, Human
ucuggaggggaacccacugccgga

SEQ ID NO: 507656 - RNA, 32 nt, Human
ucuggagggugaggcaggagaaucacuugaac

SEQ ID NO: 507657 - RNA, 32 nt, Human
ucuggagguacaggauuuccacaggccucuuu

SEQ ID NO: 507658 - RNA, 21 nt, Human
ucuggagguccuauuucucua

SEQ ID NO: 507659 - RNA, 26 nt, Human
ucuggagguguccugcuguuccuguu

SEQ ID NO: 507660 - RNA, 32 nt, Human
ucuggagguucugcaaagucuucccagaggug

SEQ ID NO: 507661 - RNA, 32 nt, Human
ucuggaguaccgucugccccagacaaguggga

SEQ ID NO: 507662 - RNA, 32 nt, Human
ucuggaguauaagugggaaagcuugauuuaaa

SEQ ID NO: 507663 - RNA, 26 nt, Human
ucuggaguccucuucccguuccucca

SEQ ID NO: 507664 - RNA, 32 nt, Human
ucuggagucuacuccccaggagccaggacagg

SEQ ID NO: 507665 - RNA, 32 nt, Human
ucuggagucuaguugaaggccuccaguuccca

SEQ ID NO: 507666 - RNA, 32 nt, Human
ucuggagugcugugguggaguggaguggcuau

SEQ ID NO: 507667 - RNA, 20 nt, Human
ucuggaguggggggcggcgg

SEQ ID NO: 507668 - RNA, 32 nt, Human
ucuggaguuugagaccagccugggcaacagag

SEQ ID NO: 507669 - RNA, 32 nt, Human
ucuggaguuuguuccuucugauguucggacgu

SEQ ID NO: 507670 - RNA, 32 nt, Human
ucuggaguuuuuggucuccucagagagcucca

SEQ ID NO: 507671 - RNA, 32 nt, Human
ucuggauaaucaggauaacgacccucaacagc

SEQ ID NO: 507672 - RNA, 32 nt, Human
ucuggauacacauacacauacaaaacagaaaa

SEQ ID NO: 507673 - RNA, 32 nt, Human
ucuggauacagaaccccuucuuuuccaaauua

SEQ ID NO: 507674 - RNA, 32 nt, Human
ucuggauaggggaugagguugcugugaaagca

SEQ ID NO: 507675 - RNA, 32 nt, Human
ucuggauauaacauacacagcugcauaaaaac

SEQ ID NO: 507676 - RNA, 24 nt, Human
ucuggauauuaacuccuuaccaaa

SEQ ID NO: 507677 - RNA, 24 nt, Human
ucuggauauuagcccuuugucaga

SEQ ID NO: 507678 - RNA, 32 nt, Human
ucuggaucaguaaaauuauacugugugugagu

SEQ ID NO: 507679 - RNA, 17 nt, Human
ucuggauccacugcuua

SEQ ID NO: 507680 - RNA, 23 nt, Human
ucuggauccagccauuucuggca

SEQ ID NO: 507681 - RNA, 32 nt, Human
ucuggaucccagcaucuucuccacuucagcgc

SEQ ID NO: 507682 - RNA, 32 nt, Human
ucuggauccugauucuccuuuuaagcuaaaau

SEQ ID NO: 507683 - RNA, 32 nt, Human
ucuggauccuucuggccugccucaugaagaua

SEQ ID NO: 507684 - RNA, 32 nt, Human
ucuggaucugucucuguauuccucacucccuu

SEQ ID NO: 507685 - RNA, 32 nt, Human
ucuggaucuuaaggagcuuccauuucuccagc

SEQ ID NO: 507686 - RNA, 32 nt, Human
ucuggaucuuuccuuuguauguuugugucucu

SEQ ID NO: 507687 - RNA, 23 nt, Human
ucuggaugaauacucugugcuga

SEQ ID NO: 507688 - RNA, 32 nt, Human
ucuggaugcaauuagaggaaaccagccaaaaa

SEQ ID NO: 507689 - RNA, 32 nt, Human
ucuggaugcaccguaacaucugagaagcacuc

SEQ ID NO: 507690 - RNA, 21 nt, Human
ucuggaugcaucauuuuugcc

SEQ ID NO: 507691 - RNA, 21 nt, Human
ucuggaugccucauuauguca

SEQ ID NO: 507692 - RNA, 19 nt, Human
ucuggaugccucucggccc

SEQ ID NO: 507693 - RNA, 24 nt, Human
ucuggaugccucucggcccaccca

SEQ ID NO: 507694 - RNA, 21 nt, Human
ucuggaugccuuccugcugcc

SEQ ID NO: 507695 - RNA, 27 nt, Human
ucuggaugcuccacugugcuugccaag

SEQ ID NO: 507696 - RNA, 32 nt, Human
ucuggauggaaccugagcugggucucugacuc

SEQ ID NO: 507697 - RNA, 32 nt, Human
ucuggauggaaccugggcuguggcucucuguc

SEQ ID NO: 507698 - RNA, 32 nt, Human
ucuggauggcuuuuagaaguggacacaguuua

SEQ ID NO: 507699 - RNA, 23 nt, Human
ucuggauguacuaccagagaguu

SEQ ID NO: 507700 - RNA, 24 nt, Human
ucuggaugucagucuuugcuguca

SEQ ID NO: 507701 - RNA, 21 nt, Human
ucuggaugucucccuuuuugu

SEQ ID NO: 507702 - RNA, 26 nt, Human
ucuggaugucuuggauuuucuuccca

SEQ ID NO: 507703 - RNA, 26 nt, Human
ucuggaugucuuuggggguuuugcua

SEQ ID NO: 507704 - RNA, 24 nt, Human
ucuggaugucuuuuauucaaagcu

SEQ ID NO: 507705 - RNA, 21 nt, Human
ucuggauguuguuugcugcca

SEQ ID NO: 507706 - RNA, 32 nt, Human
ucuggauuacccuggggcuggcccaggucuuc

SEQ ID NO: 507707 - RNA, 32 nt, Human
ucuggauucauugucucucacagaugugacug

SEQ ID NO: 507708 - RNA, 32 nt, Human
ucuggauuccaaggugggauggugaucccuuu

SEQ ID NO: 507709 - RNA, 32 nt, Human
ucuggauucugcauggcuggcaugucagacug

SEQ ID NO: 507710 - RNA, 32 nt, Human
ucuggauucugccucuugccaaagcagagggg

SEQ ID NO: 507711 - RNA, 32 nt, Human
ucuggauuuaacucugaugaaagacuggaggc

SEQ ID NO: 507712 - RNA, 32 nt, Human
ucuggauuuauuucucuaguuuacuuauuuuc

SEQ ID NO: 507713 - RNA, 32 nt, Human
ucuggauuugugggaauggcuuugcgugagaa

SEQ ID NO: 507714 - RNA, 32 nt, Human
ucuggauuuugaaagacaucuuuucaucaugg

SEQ ID NO: 507715 - RNA, 18 nt, Human
ucuggcaaaagggcgcgg

SEQ ID NO: 507716 - RNA, 18 nt, Human
ucuggcaaauggggugca

SEQ ID NO: 507717 - RNA, 32 nt, Human
ucuggcaacaaaagccagaguguugugggcca

SEQ ID NO: 507718 - RNA, 32 nt, Human
ucuggcaagacuuggccaagcuugccuggagu

SEQ ID NO: 507719 - RNA, 22 nt, Human
ucuggcaauucuuuuugccaag

SEQ ID NO: 507720 - RNA, 32 nt, Human
ucuggcacaaaaccuccuccucccaggcacuc

SEQ ID NO: 507721 - RNA, 22 nt, Human
ucuggcacaaccagcuuccugg

SEQ ID NO: 507722 - RNA, 32 nt, Human
ucuggcacagaaccugcccugcaggcuguagg

SEQ ID NO: 507723 - RNA, 32 nt, Human
ucuggcacagaaguccucccaccuugaagaga

SEQ ID NO: 507724 - RNA, 20 nt, Human
ucuggcacagggugugucug

SEQ ID NO: 507725 - RNA, 32 nt, Human
ucuggcacaguguggcuggauucucugcucag

SEQ ID NO: 507726 - RNA, 32 nt, Human
ucuggcacccuccugaauggaaccccagagua

SEQ ID NO: 507727 - RNA, 20 nt, Human
ucuggcaccuggcugcucug

SEQ ID NO: 507728 - RNA, 20 nt, Human
ucuggcaccugugggcuguc

SEQ ID NO: 507729 - RNA, 32 nt, Human
ucuggcacggccccgucuucugccuccuccuc

SEQ ID NO: 507730 - RNA, 32 nt, Human
ucuggcacucacugcagacuuccucuuucaag

SEQ ID NO: 507731 - RNA, 32 nt, Human
ucuggcacugugcaagucucagguccuagagu

SEQ ID NO: 507732 - RNA, 32 nt, Human
ucuggcacuucaaaaaugaauguuaaauagaa

SEQ ID NO: 507733 - RNA, 19 nt, Human
ucuggcagaggcgggucgg

SEQ ID NO: 507734 - RNA, 22 nt, Human
ucuggcagaguggggggcgugg

SEQ ID NO: 507735 - RNA, 32 nt, Human
ucuggcagcacuaguguuagaacaccaaggag

SEQ ID NO: 507736 - RNA, 32 nt, Human
ucuggcagcagcuucacuaaggugggauggau

SEQ ID NO: 507737 - RNA, 19 nt, Human
ucuggcagcaggcgggcgc

SEQ ID NO: 507738 - RNA, 32 nt, Human
ucuggcagcauguggagcaggcuguaggcaau

SEQ ID NO: 507739 - RNA, 20 nt, Human
ucuggcagccaggggcgggg

SEQ ID NO: 507740 - RNA, 32 nt, Human
ucuggcagccgucugcccucauggccuuugca

SEQ ID NO: 507741 - RNA, 32 nt, Human
ucuggcagccuggagcccagggagggacaggg

SEQ ID NO: 507742 - RNA, 32 nt, Human
ucuggcagccuguggggucaggagaagcaccc

SEQ ID NO: 507743 - RNA, 32 nt, Human
ucuggcagccuuaaccuguccucugcuaggac

SEQ ID NO: 507744 - RNA, 32 nt, Human
ucuggcagcggcagcuacauccagcuucuggg

SEQ ID NO: 507745 - RNA, 20 nt, Human
ucuggcagcgggggguguag

SEQ ID NO: 507746 - RNA, 18 nt, Human
ucuggcaggaaaagccag

SEQ ID NO: 507747 - RNA, 21 nt, Human
ucuggcaggaaggaggggcag

SEQ ID NO: 507748 - RNA, 19 nt, Human
ucuggcaggaccugccuag

SEQ ID NO: 507749 - RNA, 18 nt, Human
ucuggcaggagagugugg

SEQ ID NO: 507750 - RNA, 18 nt, Human
ucuggcaggagccggcgc

SEQ ID NO: 507751 - RNA, 19 nt, Human
ucuggcaggagcugcgugg

SEQ ID NO: 507752 - RNA, 32 nt, Human
ucuggcaggagugggagcaggagccagggcag

SEQ ID NO: 507753 - RNA, 19 nt, Human
ucuggcaggaucugcucgg

SEQ ID NO: 507754 - RNA, 20 nt, Human
ucuggcaggaugaaucgcag

SEQ ID NO: 507755 - RNA, 18 nt, Human
ucuggcaggauuugucag

SEQ ID NO: 507756 - RNA, 20 nt, Human
ucuggcaggcaggggggcag

SEQ ID NO: 507757 - RNA, 32 nt, Human
ucuggcagggaucucagaugaccguggccucc

SEQ ID NO: 507758 - RNA, 20 nt, Human
ucuggcaggggagaugugca

SEQ ID NO: 507759 - RNA, 19 nt, Human
ucuggcaggggcugcucag

SEQ ID NO: 507760 - RNA, 18 nt, Human
ucuggcagggggacgugg

SEQ ID NO: 507761 - RNA, 20 nt, Human
ucuggcagggggucuggugc

SEQ ID NO: 507762 - RNA, 19 nt, Human
ucuggcagggucugcgcag

SEQ ID NO: 507763 - RNA, 18 nt, Human
ucuggcagguaugugcag

SEQ ID NO: 507764 - RNA, 18 nt, Human
ucuggcaggugugugcag

SEQ ID NO: 507765 - RNA, 32 nt, Human
ucuggcagucucaaagcaaucauuucagcuuc

SEQ ID NO: 507766 - RNA, 32 nt, Human
ucuggcaguggcaccuccgcugagcuuuuaaa

SEQ ID NO: 507767 - RNA, 32 nt, Human
ucuggcaguucuggaauggaaggguucuggcu

SEQ ID NO: 507768 - RNA, 32 nt, Human
ucuggcauaaaccugcagguuugcauggcugu

SEQ ID NO: 507769 - RNA, 32 nt, Human
ucuggcaucaaguuucuugcagcugcucugag

SEQ ID NO: 507770 - RNA, 32 nt, Human
ucuggcaucagaggccagaguucaaaugugac

SEQ ID NO: 507771 - RNA, 32 nt, Human
ucuggcaucugacauuccaccgauucacaaac

SEQ ID NO: 507772 - RNA, 32 nt, Human
ucuggcaucugccucccuagaccuccuucccu

SEQ ID NO: 507773 - RNA, 32 nt, Human
ucuggcauggguuggguaggggauggagguga

SEQ ID NO: 507774 - RNA, 32 nt, Human
ucuggcauugucugcccagcugcuccaagcca

SEQ ID NO: 507775 - RNA, 23 nt, Human
ucuggcauuuaucacccccaccu

SEQ ID NO: 507776 - RNA, 32 nt, Human
ucuggccaaaccaccuucccagccuuuaugca

SEQ ID NO: 507777 - RNA, 26 nt, Human
ucuggccaaaucuuccuguucugcca

SEQ ID NO: 507778 - RNA, 32 nt, Human
ucuggccaacaaacaugagccacuuuucccag

SEQ ID NO: 507779 - RNA, 19 nt, Human
ucuggccaacauggugaaa

SEQ ID NO: 507780 - RNA, 32 nt, Human
ucuggccacccuggcccgccccucgcugcugc

SEQ ID NO: 507781 - RNA, 21 nt, Human
ucuggccacugggaggcgcug

SEQ ID NO: 507782 - RNA, 32 nt, Human
ucuggccacugggcguccuguggugaggccag

SEQ ID NO: 507783 - RNA, 32 nt, Human
ucuggccagaggacucuggaaaacuugcguuu

SEQ ID NO: 507784 - RNA, 32 nt, Human
ucuggccagaguuguagccaggccuugcacua

SEQ ID NO: 507785 - RNA, 32 nt, Human
ucuggccagauggcagagggcagcguucccuu

SEQ ID NO: 507786 - RNA, 23 nt, Human
ucuggccagcacgccuguccucc

SEQ ID NO: 507787 - RNA, 32 nt, Human
ucuggccagcacuggcagcuuccgggccuugu

SEQ ID NO: 507788 - RNA, 32 nt, Human
ucuggccagccucucccugccuccacuugcuc

SEQ ID NO: 507789 - RNA, 32 nt, Human
ucuggccaggagcuggaggagcaggcaguggg

SEQ ID NO: 507790 - RNA, 32 nt, Human
ucuggccauaagggaugggagaggagggauuu

SEQ ID NO: 507791 - RNA, 32 nt, Human
ucuggccaucgacccucaccucccgggacuuc

SEQ ID NO: 507792 - RNA, 32 nt, Human
ucuggccauugcacuccagcgugggcaacaga

SEQ ID NO: 507793 - RNA, 32 nt, Human
ucuggcccaaguggggaagcugggcagagagc

SEQ ID NO: 507794 - RNA, 32 nt, Human
ucuggcccagaaaaagagaugcagugauuuua

SEQ ID NO: 507795 - RNA, 32 nt, Human
ucuggcccaggaggagggucccccaggacccc

SEQ ID NO: 507796 - RNA, 32 nt, Human
ucuggcccagggaauccagccaugacccccac

SEQ ID NO: 507797 - RNA, 32 nt, Human
ucuggcccauugacagaugagaggucugaagc

SEQ ID NO: 507798 - RNA, 32 nt, Human
ucuggcccauuguuuccagucuguuccugucc

SEQ ID NO: 507799 - RNA, 32 nt, Human
ucuggccccagccucugcacuugggcuccccu

SEQ ID NO: 507800 - RNA, 32 nt, Human
ucuggccccagccucugugggcuuaaccacua

SEQ ID NO: 507801 - RNA, 18 nt, Human
ucuggccccagcugugaa

SEQ ID NO: 507802 - RNA, 19 nt, Human
ucuggcccccaccccauua

SEQ ID NO: 507803 - RNA, 32 nt, Human
ucuggcccccugucugucuuccucuccgcggu

SEQ ID NO: 507804 - RNA, 32 nt, Human
ucuggcccccuuccucaccucuuccaccccuc

SEQ ID NO: 507805 - RNA, 28 nt, Human
ucuggccccggugcugccugcaugccaa

SEQ ID NO: 507806 - RNA, 32 nt, Human
ucuggccccucugcucccucaggaagcagucc

SEQ ID NO: 507807 - RNA, 32 nt, Human
ucuggcccucagcugcuugacaggacggacug

SEQ ID NO: 507808 - RNA, 32 nt, Human
ucuggcccucuccacaugcacacccugagaac

SEQ ID NO: 507809 - RNA, 32 nt, Human
ucuggcccugcucuccugcagggagguggcug

SEQ ID NO: 507810 - RNA, 32 nt, Human
ucuggcccugcugcccccacacccaacuccga

SEQ ID NO: 507811 - RNA, 32 nt, Human
ucuggccgaaauuuuuaugagauaucucucac

SEQ ID NO: 507812 - RNA, 32 nt, Human
ucuggccgaggcugggcucuucccuggaugag

SEQ ID NO: 507813 - RNA, 32 nt, Human
ucuggccgcgcuugaggagcccuucagcccgc

SEQ ID NO: 507814 - RNA, 24 nt, Human
ucuggccgcugggcaggacauugg

SEQ ID NO: 507815 - RNA, 32 nt, Human
ucuggccggagcugccuggucccagaguggcu

SEQ ID NO: 507816 - RNA, 22 nt, Human
ucuggccucagguggggcgcag

SEQ ID NO: 507817 - RNA, 32 nt, Human
ucuggccuccaccccaccaccaggcccaauga

SEQ ID NO: 507818 - RNA, 32 nt, Human
ucuggccuccgugcucugcuucaccucuucug

SEQ ID NO: 507819 - RNA, 32 nt, Human
ucuggccuccuuggccucauucucugcauagc

SEQ ID NO: 507820 - RNA, 32 nt, Human
ucuggccucuacucucuccucccucuggcucu

SEQ ID NO: 507821 - RNA, 26 nt, Human
ucuggccucuccccagagcugucugg

SEQ ID NO: 507822 - RNA, 32 nt, Human
ucuggccucuucacacccuucuccccuccuuc

SEQ ID NO: 507823 - RNA, 32 nt, Human
ucuggccucuucucccuucacucccguccagu

SEQ ID NO: 507824 - RNA, 19 nt, Human
ucuggccugagcacaagga

SEQ ID NO: 507825 - RNA, 32 nt, Human
ucuggccugcagcugaccuggcaaccauucag

SEQ ID NO: 507826 - RNA, 32 nt, Human
ucuggccugcaggcccagccuggacaaacaau

SEQ ID NO: 507827 - RNA, 32 nt, Human
ucuggccugccugcaccagcugccugggcccc

SEQ ID NO: 507828 - RNA, 32 nt, Human
ucuggccugccugguccucugcguuguagugc

SEQ ID NO: 507829 - RNA, 32 nt, Human
ucuggccugcucccuuccuccuuggcucccug

SEQ ID NO: 507830 - RNA, 19 nt, Human
ucuggccuggcacacaggg

SEQ ID NO: 507831 - RNA, 32 nt, Human
ucuggccugggagcucucacacccugcacgau

SEQ ID NO: 507832 - RNA, 32 nt, Human
ucuggccugggcaacagagcaagacucggucu

SEQ ID NO: 507833 - RNA, 24 nt, Human
ucuggccugggcgacagagcgaga

SEQ ID NO: 507834 - RNA, 32 nt, Human
ucuggccugggcgacagagcgagacuccgucu

SEQ ID NO: 507835 - RNA, 32 nt, Human
ucuggccugggcgacagagcgagacucugucu

SEQ ID NO: 507836 - RNA, 24 nt, Human
ucuggccugggggccagggcagga

SEQ ID NO: 507837 - RNA, 32 nt, Human
ucuggccugggugacagaguuagacugugucu

SEQ ID NO: 507838 - RNA, 20 nt, Human
ucuggccugggugagcuaga

SEQ ID NO: 507839 - RNA, 32 nt, Human
ucuggccugguggugauucuccagaaacucca

SEQ ID NO: 507840 - RNA, 23 nt, Human
ucuggccuguggcagggccggga

SEQ ID NO: 507841 - RNA, 32 nt, Human
ucuggccuucagcaauccucccaccucaaccu

SEQ ID NO: 507842 - RNA, 32 nt, Human
ucuggccuucccuggggucagugagagaaaug

SEQ ID NO: 507843 - RNA, 32 nt, Human
ucuggccuuuaacuggcuucugaggcuacaga

SEQ ID NO: 507844 - RNA, 32 nt, Human
ucuggccuuuggcuauuuuagcauuucaaagu

SEQ ID NO: 507845 - RNA, 32 nt, Human
ucuggcgagggagggggcaaggugcauccacu

SEQ ID NO: 507846 - RNA, 32 nt, Human
ucuggcgaguuaaguccagcagguucugcgug

SEQ ID NO: 507847 - RNA, 24 nt, Human
ucuggcgcccaggcuggaguacag

SEQ ID NO: 507848 - RNA, 24 nt, Human
ucuggcgcccaggcuggagugcag

SEQ ID NO: 507849 - RNA, 32 nt, Human
ucuggcggccucaucaucucaggaugagcucu

SEQ ID NO: 507850 - RNA, 32 nt, Human
ucuggcggcggcugccgugagcugacugacgu

SEQ ID NO: 507851 - RNA, 21 nt, Human
ucuggcggcugcggggcgcag

SEQ ID NO: 507852 - RNA, 18 nt, Human
ucuggcgggaaggagcag

SEQ ID NO: 507853 - RNA, 18 nt, Human
ucuggcgggauaaugcag

SEQ ID NO: 507854 - RNA, 20 nt, Human
ucuggcggggcuggcagcgg

SEQ ID NO: 507855 - RNA, 19 nt, Human
ucuggcgggggugagcgca

SEQ ID NO: 507856 - RNA, 32 nt, Human
ucuggcggggugcagaacugagcccaggccac

SEQ ID NO: 507857 - RNA, 32 nt, Human
ucuggcgggugagggcggagcugaagugacag

SEQ ID NO: 507858 - RNA, 32 nt, Human
ucuggcguccacauucagacugguuuagagga

SEQ ID NO: 507859 - RNA, 32 nt, Human
ucuggcgucucucaccuccuucauccccuacc

SEQ ID NO: 507860 - RNA, 32 nt, Human
ucuggcgugccuggcgggcacagccauacacg

SEQ ID NO: 507861 - RNA, 32 nt, Human
ucuggcguggagaaggaugagcccacaaaacc

SEQ ID NO: 507862 - RNA, 21 nt, Human
ucuggcuacagcaagaccagc

SEQ ID NO: 507863 - RNA, 32 nt, Human
ucuggcuacugaggcuagagcccacagcagaa

SEQ ID NO: 507864 - RNA, 32 nt, Human
ucuggcuacugcacucuccacugggaccugac

SEQ ID NO: 507865 - RNA, 32 nt, Human
ucuggcuagagccaccauuagacucagacaga

SEQ ID NO: 507866 - RNA, 32 nt, Human
ucuggcuagcuuggcagugauagugaucauga

SEQ ID NO: 507867 - RNA, 32 nt, Human
ucuggcuaggacucccuucuuccuuccuuccc

SEQ ID NO: 507868 - RNA, 32 nt, Human
ucuggcuagugggaaggagggggugaacuaau

SEQ ID NO: 507869 - RNA, 23 nt, Human
ucuggcuauaugguggggcgcgg

SEQ ID NO: 507870 - RNA, 32 nt, Human
ucuggcuaucucuguccugugagaagcuucug

SEQ ID NO: 507871 - RNA, 32 nt, Human
ucuggcucaagaguugaaggugccaucgcagg

SEQ ID NO: 507872 - RNA, 32 nt, Human
ucuggcucaagcaauccucucacuucagccuc

SEQ ID NO: 507873 - RNA, 32 nt, Human
ucuggcucacugcagccucaaacuccugaguc

SEQ ID NO: 507874 - RNA, 32 nt, Human
ucuggcucacugcagccuccgccucccggguu

SEQ ID NO: 507875 - RNA, 32 nt, Human
ucuggcucacugcauccucaacuuccugggcu

SEQ ID NO: 507876 - RNA, 32 nt, Human
ucuggcucagccagaguuguuucucuccacuc

SEQ ID NO: 507877 - RNA, 32 nt, Human
ucuggcucagcugcagcaacaucugugagccc

SEQ ID NO: 507878 - RNA, 32 nt, Human
ucuggcuccagccccgcauccggcgccggccc

SEQ ID NO: 507879 - RNA, 32 nt, Human
ucuggcuccccuaggcuggguguaguggcgcg

SEQ ID NO: 507880 - RNA, 22 nt, Human
ucuggcuccccuuccccuuccc

SEQ ID NO: 507881 - RNA, 32 nt, Human
ucuggcucccuaacaccugaaucccagaugau

SEQ ID NO: 507882 - RNA, 32 nt, Human
ucuggcucgcuucccucccucguuuccagcuc

SEQ ID NO: 507883 - RNA, 32 nt, Human
ucuggcucggcccaaagggacucccccucugc

SEQ ID NO: 507884 - RNA, 32 nt, Human
ucuggcucuaggccauggcgaggcucugccgg

SEQ ID NO: 507885 - RNA, 19 nt, Human
ucuggcucuaggggugcag

SEQ ID NO: 507886 - RNA, 32 nt, Human
ucuggcucucuaauaggacaaaagccagucca

SEQ ID NO: 507887 - RNA, 31 nt, Human
ucuggcucucucaaggagcuggagggugaca

SEQ ID NO: 507888 - RNA, 32 nt, Human
ucuggcucuugccuucccagcaugcccuuuac

SEQ ID NO: 507889 - RNA, 32 nt, Human
ucuggcucuuucacuuccuccccaccugccaa

SEQ ID NO: 507890 - RNA, 21 nt, Human
ucuggcucuuucuccccuccc

SEQ ID NO: 507891 - RNA, 32 nt, Human
ucuggcucuuucuccccucccuccccacccaa

SEQ ID NO: 507892 - RNA, 32 nt, Human
ucuggcugagaggaugggggcagauggggaaa

SEQ ID NO: 507893 - RNA, 32 nt, Human
ucuggcugagguucugagggcaccgagacaga

SEQ ID NO: 507894 - RNA, 32 nt, Human
ucuggcugcaccuggcaugacuguuuguuucu

SEQ ID NO: 507895 - RNA, 32 nt, Human
ucuggcugcacuucucaaugccuggaaggauu

SEQ ID NO: 507896 - RNA, 32 nt, Human
ucuggcugcagagccgucuucucagguugccu

SEQ ID NO: 507897 - RNA, 31 nt, Human
ucuggcugcagcuagaggacaggcaagccag

SEQ ID NO: 507898 - RNA, 32 nt, Human
ucuggcugccauaaggucauguagcuccuggg

SEQ ID NO: 507899 - RNA, 32 nt, Human
ucuggcugccuucugcauuuauuugccuuuuu

SEQ ID NO: 507900 - RNA, 32 nt, Human
ucuggcugcugccuccgcagcucccuccuccu

SEQ ID NO: 507901 - RNA, 32 nt, Human
ucuggcugcugcuccaacucuggcagacacgc

SEQ ID NO: 507902 - RNA, 20 nt, Human
ucuggcugcugguguauaaa

SEQ ID NO: 507903 - RNA, 32 nt, Human
ucuggcuggaaagcagagccuccugggaacac

SEQ ID NO: 507904 - RNA, 22 nt, Human
ucuggcuggcauucugcauguu

SEQ ID NO: 507905 - RNA, 32 nt, Human
ucuggcugggaaaucauuuguuccuaagaaag

SEQ ID NO: 507906 - RNA, 32 nt, Human
ucuggcugggcgggguggcucacaccuguaau

SEQ ID NO: 507907 - RNA, 29 nt, Human
ucuggcuggguguguguggguggggacua

SEQ ID NO: 507908 - RNA, 32 nt, Human
ucuggcuggucaacuauaugaaaccuuguuca

SEQ ID NO: 507909 - RNA, 32 nt, Human
ucuggcugucaccaagcaugacccaggucaac

SEQ ID NO: 507910 - RNA, 32 nt, Human
ucuggcugugcugccaaaccucuccucugcug

SEQ ID NO: 507911 - RNA, 32 nt, Human
ucuggcuguuugagauucucaaaggagcgagc

SEQ ID NO: 507912 - RNA, 32 nt, Human
ucuggcuucccucccagccuuccuugguuugg

SEQ ID NO: 507913 - RNA, 32 nt, Human
ucuggcuuccucugugcauccugugagucugu

SEQ ID NO: 507914 - RNA, 32 nt, Human
ucuggcuugcccaggcuggagugcgguggcua

SEQ ID NO: 507915 - RNA, 32 nt, Human
ucuggcuugccuuccccagcugccucaacucu

SEQ ID NO: 507916 - RNA, 17 nt, Human
ucuggcuuggcugcaaa

SEQ ID NO: 507917 - RNA, 21 nt, Human
ucuggcuuggggagaguggga

SEQ ID NO: 507918 - RNA, 32 nt, Human
ucuggcuuggugguagcauuuaaucuauugca

SEQ ID NO: 507919 - RNA, 32 nt, Human
ucuggcuugguuuuaauuauguucuuaaauuu

SEQ ID NO: 507920 - RNA, 32 nt, Human
ucuggcuuguguuccugggagcuucgcagcgu

SEQ ID NO: 507921 - RNA, 32 nt, Human
ucugggaaaaacaacgaaacuuucccuugugg

SEQ ID NO: 507922 - RNA, 20 nt, Human
ucugggaaaagucucuacuu

SEQ ID NO: 507923 - RNA, 23 nt, Human
ucugggaaaaucuauuccugcca

SEQ ID NO: 507924 - RNA, 25 nt, Human
ucugggaaagcagagguugcaguga

SEQ ID NO: 507925 - RNA, 32 nt, Human
ucugggaacaauauuugggcucagaggguggg

SEQ ID NO: 507926 - RNA, 32 nt, Human
ucugggaacaugccgccuucucuccagccucu

SEQ ID NO: 507927 - RNA, 32 nt, Human
ucugggaacccccguauucuucccccucaccc

SEQ ID NO: 507928 - RNA, 32 nt, Human
ucugggaacugcccgaaaggaggggaaggcgc

SEQ ID NO: 507929 - RNA, 32 nt, Human
ucugggaagagaacuguccacauugcuaaaua

SEQ ID NO: 507930 - RNA, 32 nt, Human
ucugggaagauggaggugcagggcuuggguaa

SEQ ID NO: 507931 - RNA, 20 nt, Human
ucugggaagcaccagggugu

SEQ ID NO: 507932 - RNA, 32 nt, Human
ucugggaagcaggguugguuaguaaagacagg

SEQ ID NO: 507933 - RNA, 24 nt, Human
ucugggaagcggagguugcaguga

SEQ ID NO: 507934 - RNA, 32 nt, Human
ucugggaagcggagguugcagugagcugagau

SEQ ID NO: 507935 - RNA, 32 nt, Human
ucugggaaggaugagaggcagggccugcuugu

SEQ ID NO: 507936 - RNA, 21 nt, Human
ucugggaagggaagggcuacu

SEQ ID NO: 507937 - RNA, 32 nt, Human
ucugggaagggccugacacagccccagcacag

SEQ ID NO: 507938 - RNA, 24 nt, Human
ucugggacacacuucuguccuucc

SEQ ID NO: 507939 - RNA, 21 nt, Human
ucugggaccagguccaggugg

SEQ ID NO: 507940 - RNA, 32 nt, Human
ucugggaccccaggccucacaccagaacuguc

SEQ ID NO: 507941 - RNA, 25 nt, Human
ucugggacccugugccccuccuucc

SEQ ID NO: 507942 - RNA, 20 nt, Human
ucugggacccuuuccuuccu

SEQ ID NO: 507943 - RNA, 32 nt, Human
ucugggaccuugcucccagcugugcugucgcc

SEQ ID NO: 507944 - RNA, 32 nt, Human
ucugggacgaggauggggaaagaggcagcaug

SEQ ID NO: 507945 - RNA, 17 nt, Human
ucugggacucugcugcu

SEQ ID NO: 507946 - RNA, 32 nt, Human
ucugggacugcuuucuuggcagaguugaauag

SEQ ID NO: 507947 - RNA, 32 nt, Human
ucugggacuggguguugaugggggagggcaaa

SEQ ID NO: 507948 - RNA, 32 nt, Human
ucugggacugugagacaaggaagcagggccag

SEQ ID NO: 507949 - RNA, 32 nt, Human
ucugggagacagauaaggaggccaggugcaag

SEQ ID NO: 507950 - RNA, 32 nt, Human
ucugggagacgggagucaagauggcuugguuu

SEQ ID NO: 507951 - RNA, 32 nt, Human
ucugggagagcacagaaaacagucuucuauca

SEQ ID NO: 507952 - RNA, 32 nt, Human
ucugggagaguaauucuaucuccucuucugau

SEQ ID NO: 507953 - RNA, 32 nt, Human
ucugggagauccuguuaaaaugcagguucuga

SEQ ID NO: 507954 - RNA, 32 nt, Human
ucugggagaugagacgggauccuucaugagaa

SEQ ID NO: 507955 - RNA, 32 nt, Human
ucugggagauucugcagggucagcuuuccagg

SEQ ID NO: 507956 - RNA, 32 nt, Human
ucugggagcaagaagaaaaccuaugcauguac

SEQ ID NO: 507957 - RNA, 31 nt, Human
ucugggagccagucugccaugccaggaguca

SEQ ID NO: 507958 - RNA, 32 nt, Human
ucugggagccaugaacugggcucuacauuguu

SEQ ID NO: 507959 - RNA, 32 nt, Human
ucugggagccucuucccuuucucacucaccug

SEQ ID NO: 507960 - RNA, 32 nt, Human
ucugggaggaagcacagcucaccagggccccu

SEQ ID NO: 507961 - RNA, 32 nt, Human
ucugggaggagaggguggagaaagcacuugcu

SEQ ID NO: 507962 - RNA, 32 nt, Human
ucugggaggagcaggaguuuugucuagggaac

SEQ ID NO: 507963 - RNA, 24 nt, Human
ucugggaggaggaccccugggaug

SEQ ID NO: 507964 - RNA, 32 nt, Human
ucugggaggaggcagcucacuggagagccuac

SEQ ID NO: 507965 - RNA, 24 nt, Human
ucugggaggcagagguugcaguga

SEQ ID NO: 507966 - RNA, 32 nt, Human
ucugggaggcagagguugcagugagccgagau

SEQ ID NO: 507967 - RNA, 32 nt, Human
ucugggaggcagagguugcagugagcugagau

SEQ ID NO: 507968 - RNA, 24 nt, Human
ucugggaggcagagguugcuguga

SEQ ID NO: 507969 - RNA, 22 nt, Human
ucugggaggccaaugcaugugg

SEQ ID NO: 507970 - RNA, 32 nt, Human
ucugggaggcccagguggcucugcagcagccu

SEQ ID NO: 507971 - RNA, 32 nt, Human
ucugggaggcccugagacagggauugugcuuc

SEQ ID NO: 507972 - RNA, 24 nt, Human
ucugggaggcggagauugcaguga

SEQ ID NO: 507973 - RNA, 32 nt, Human
ucugggaggcggagauugcagugagccgagau

SEQ ID NO: 507974 - RNA, 32 nt, Human
ucugggaggcggaggcgguggaucacuugagc

SEQ ID NO: 507975 - RNA, 32 nt, Human
ucugggaggcggagguugcagugagccaggau

SEQ ID NO: 507976 - RNA, 32 nt, Human
ucugggaggcggagguugcagugagcugagau

SEQ ID NO: 507977 - RNA, 32 nt, Human
ucugggaggcucggcggcuggagcagcaggca

SEQ ID NO: 507978 - RNA, 32 nt, Human
ucugggagggaaguggagguugcuguacagga

SEQ ID NO: 507979 - RNA, 32 nt, Human
ucugggaggggcucgagagggcugguccuuau

SEQ ID NO: 507980 - RNA, 32 nt, Human
ucugggaggugcugggcugggccacagccagg

SEQ ID NO: 507981 - RNA, 25 nt, Human
ucugggagguggaagcauggggugg

SEQ ID NO: 507982 - RNA, 32 nt, Human
ucugggagguggaaguugcagugagccgagau

SEQ ID NO: 507983 - RNA, 24 nt, Human
ucugggagguggaggcugcaguga

SEQ ID NO: 507984 - RNA, 32 nt, Human
ucugggagguggaggcugcagugagccgugau

SEQ ID NO: 507985 - RNA, 32 nt, Human
ucugggagguggagguugcagugagccaagau

SEQ ID NO: 507986 - RNA, 32 nt, Human
ucugggagguguggcggaccagcugggcccag

SEQ ID NO: 507987 - RNA, 32 nt, Human
ucugggagguugaggcugcagugagcugugau

SEQ ID NO: 507988 - RNA, 25 nt, Human
ucugggagucggaagagcugucugg

SEQ ID NO: 507989 - RNA, 32 nt, Human
ucugggagugacaggacauuuucugcacugcc

SEQ ID NO: 507990 - RNA, 32 nt, Human
ucugggaguguaccuucccuggggaucuuuga

SEQ ID NO: 507991 - RNA, 32 nt, Human
ucugggaguucugauuuccucaguccuuuagg

SEQ ID NO: 507992 - RNA, 22 nt, Human
ucugggauagucuaucuguguu

SEQ ID NO: 507993 - RNA, 32 nt, Human
ucugggaucucagcccugcuccugggagcugg

SEQ ID NO: 507994 - RNA, 32 nt, Human
ucugggaugaaggcuugucagcacuuccaguu

SEQ ID NO: 507995 - RNA, 32 nt, Human
ucugggaugcagcggccagcuucucauguucu

SEQ ID NO: 507996 - RNA, 32 nt, Human
ucugggaugcaucuuaaggagggcuccuaaca

SEQ ID NO: 507997 - RNA, 20 nt, Human
ucugggauggggcuucugcu

SEQ ID NO: 507998 - RNA, 23 nt, Human
ucugggauuacaggcauaagcca

SEQ ID NO: 507999 - RNA, 23 nt, Human
ucugggauuacaggcaugagcca

SEQ ID NO: 508000 - RNA, 23 nt, Human
ucugggauuacaggcgugagcca

SEQ ID NO: 508001 - RNA, 23 nt, Human
ucugggauuacaggcuugagcca

SEQ ID NO: 508002 - RNA, 32 nt, Human
ucugggauuguugggaauucucucccuaauuc

SEQ ID NO: 508003 - RNA, 20 nt, Human
ucugggcaaagccccucaca

SEQ ID NO: 508004 - RNA, 32 nt, Human
ucugggcaaauaguuucucugcucugagcccc

SEQ ID NO: 508005 - RNA, 32 nt, Human
ucugggcaacacagcaagacccugucucuuua

SEQ ID NO: 508006 - RNA, 32 nt, Human
ucugggcaacagagcaagacccugccucaaaa

SEQ ID NO: 508007 - RNA, 31 nt, Human
ucugggcaacagagcaagacccugucuauuu

SEQ ID NO: 508008 - RNA, 32 nt, Human
ucugggcaacagagcaagacucugucucgggg

SEQ ID NO: 508009 - RNA, 28 nt, Human
ucugggcaacagagcaagacucuguguc

SEQ ID NO: 508010 - RNA, 32 nt, Human
ucugggcaacagagugagacccugucucaaaa

SEQ ID NO: 508011 - RNA, 32 nt, Human
ucugggcaacagagugagacccugucucaaua

SEQ ID NO: 508012 - RNA, 30 nt, Human
ucugggcaacagugcaagacccugucacuu

SEQ ID NO: 508013 - RNA, 31 nt, Human
ucugggcaacauagcaaaacccugccucuac

SEQ ID NO: 508014 - RNA, 32 nt, Human
ucugggcaacauagcaagacucugccucuaca

SEQ ID NO: 508015 - RNA, 25 nt, Human
ucugggcaagcggagguugcaguga

SEQ ID NO: 508016 - RNA, 25 nt, Human
ucugggcacaggcauuucugccaag

SEQ ID NO: 508017 - RNA, 32 nt, Human
ucugggcacauggggcccccugggcagugcag

SEQ ID NO: 508018 - RNA, 32 nt, Human
ucugggcaccacugcauucccugauacccaca

SEQ ID NO: 508019 - RNA, 32 nt, Human
ucugggcaccuacagccccagcacagcuucaa

SEQ ID NO: 508020 - RNA, 32 nt, Human
ucugggcacugcacuucagcguggcccaccug

SEQ ID NO: 508021 - RNA, 32 nt, Human
ucugggcacuggcuccgaguuccccuccuggg

SEQ ID NO: 508022 - RNA, 32 nt, Human
ucugggcacuguacauaccugcccccucaucc

SEQ ID NO: 508023 - RNA, 32 nt, Human
ucugggcacuguacuuuagccugggcgacaga

SEQ ID NO: 508024 - RNA, 32 nt, Human
ucugggcagacucccuccccucuuccauaaag

SEQ ID NO: 508025 - RNA, 32 nt, Human
ucugggcagaguuuccccaguuggugguguag

SEQ ID NO: 508026 - RNA, 32 nt, Human
ucugggcagaugggguggagggaguaccccuu

SEQ ID NO: 508027 - RNA, 32 nt, Human
ucugggcagcagcauugcaggaagaggaaagg

SEQ ID NO: 508028 - RNA, 32 nt, Human
ucugggcagcagugggaggcaggccccgugug

SEQ ID NO: 508029 - RNA, 32 nt, Human
ucugggcagccagggaccugcccauucacucc

SEQ ID NO: 508030 - RNA, 32 nt, Human
ucugggcagccugcuuuggccuuuccuuguau

SEQ ID NO: 508031 - RNA, 32 nt, Human
ucugggcaggagagagagugagagacaagaga

SEQ ID NO: 508032 - RNA, 32 nt, Human
ucugggcaggcaggccauggggcauggaggag

SEQ ID NO: 508033 - RNA, 32 nt, Human
ucugggcaggccaguccucaaagcagcuccug

SEQ ID NO: 508034 - RNA, 32 nt, Human
ucugggcagggcccucgggacaucuccacccg

SEQ ID NO: 508035 - RNA, 32 nt, Human
ucugggcagggugagaggucgguggaggaucu

SEQ ID NO: 508036 - RNA, 32 nt, Human
ucugggcagggugugcgggccgggcccggcug

SEQ ID NO: 508037 - RNA, 32 nt, Human
ucugggcaguguuaacagaaucccggaggccg

SEQ ID NO: 508038 - RNA, 32 nt, Human
ucugggcaguuagauagugcucugugccuaag

SEQ ID NO: 508039 - RNA, 31 nt, Human
ucugggcaguuucaccuuugugccuuaaaug

SEQ ID NO: 508040 - RNA, 32 nt, Human
ucugggcauggugcacacgccuguaaucccag

SEQ ID NO: 508041 - RNA, 22 nt, Human
ucugggcauuccagccaccgaa

SEQ ID NO: 508042 - RNA, 32 nt, Human
ucugggcauuggcagugccugccaccacagcc

SEQ ID NO: 508043 - RNA, 32 nt, Human
ucugggcauuuuccuccucugccuacagccag

SEQ ID NO: 508044 - RNA, 32 nt, Human
ucugggccaaccacaccacucaaggccacauc

SEQ ID NO: 508045 - RNA, 32 nt, Human
ucugggccaccaggaucagccaggagggcguu

SEQ ID NO: 508046 - RNA, 32 nt, Human
ucugggccacuucccuccuuccagucaugagu

SEQ ID NO: 508047 - RNA, 22 nt, Human
ucugggccagccuagggcuacu

SEQ ID NO: 508048 - RNA, 32 nt, Human
ucugggccagcuuugaggauaagcugcugaug

SEQ ID NO: 508049 - RNA, 32 nt, Human
ucugggccauauccugccccagcuggggaaag

SEQ ID NO: 508050 - RNA, 32 nt, Human
ucugggcccaacccccauuucccuucaggaga

SEQ ID NO: 508051 - RNA, 32 nt, Human
ucugggcccaggaagaggcuguggcucccacc

SEQ ID NO: 508052 - RNA, 32 nt, Human
ucugggcccaggcugugaguuccaggucugug

SEQ ID NO: 508053 - RNA, 32 nt, Human
ucugggcccaguuucccuaucuguaaauuggg

SEQ ID NO: 508054 - RNA, 32 nt, Human
ucugggccccaucugggauuccugggcccuuu

SEQ ID NO: 508055 - RNA, 25 nt, Human
ucugggccccgucuucuuugccaag

SEQ ID NO: 508056 - RNA, 32 nt, Human
ucugggccccuggcugagaaggggaggauccu

SEQ ID NO: 508057 - RNA, 32 nt, Human
ucugggcccuggacgccgggaaaggccuccgu

SEQ ID NO: 508058 - RNA, 32 nt, Human
ucugggcccuggagcucaagcagugggaggag

SEQ ID NO: 508059 - RNA, 32 nt, Human
ucugggcccugggguagggagggagacucagg

SEQ ID NO: 508060 - RNA, 32 nt, Human
ucugggcccugucgccccuccuuuuggccugg

SEQ ID NO: 508061 - RNA, 19 nt, Human
ucugggccgcagcgggcac

SEQ ID NO: 508062 - RNA, 32 nt, Human
ucugggccggaccccuccuccuuggggagcgu

SEQ ID NO: 508063 - RNA, 32 nt, Human
ucugggccggaggaacuggggccuccaccgac

SEQ ID NO: 508064 - RNA, 32 nt, Human
ucugggccuaugcuuccuucuggaccaccaug

SEQ ID NO: 508065 - RNA, 32 nt, Human
ucugggccuccggggccaggggcaggggaaug

SEQ ID NO: 508066 - RNA, 32 nt, Human
ucugggccucuccugugaugggccagcugcag

SEQ ID NO: 508067 - RNA, 32 nt, Human
ucugggccugcccccucuaucuccugaugggu

SEQ ID NO: 508068 - RNA, 32 nt, Human
ucugggccuggaacuucugccuccuuccuccg

SEQ ID NO: 508069 - RNA, 32 nt, Human
ucugggccugggacccucuccacagaggggau

SEQ ID NO: 508070 - RNA, 32 nt, Human
ucugggccugggaggcgagagcagugcccagg

SEQ ID NO: 508071 - RNA, 23 nt, Human
ucugggccuggugugggggcuac

SEQ ID NO: 508072 - RNA, 32 nt, Human
ucugggccuguaaucccaguuuggauggcacg

SEQ ID NO: 508073 - RNA, 32 nt, Human
ucugggccuuucucccuccgauguuggacugc

SEQ ID NO: 508074 - RNA, 32 nt, Human
ucugggccuuucucuuccucuugguccagggg

SEQ ID NO: 508075 - RNA, 32 nt, Human
ucugggccuuucugaccuacuccugagcuagg

SEQ ID NO: 508076 - RNA, 28 nt, Human
ucugggcgacagagcaagacccucucuc

SEQ ID NO: 508077 - RNA, 32 nt, Human
ucugggcgacagagcaagacucugacucaaaa

SEQ ID NO: 508078 - RNA, 32 nt, Human
ucugggcgccacugcauucccugauacacaca

SEQ ID NO: 508079 - RNA, 18 nt, Human
ucugggcgcggggugcag

SEQ ID NO: 508080 - RNA, 32 nt, Human
ucugggcgcuguucuugcaaggauccucuguu

SEQ ID NO: 508081 - RNA, 32 nt, Human
ucugggcggcgggcaggagcuggcgggggcgc

SEQ ID NO: 508082 - RNA, 32 nt, Human
ucugggcgucagggcgcggggagcugccccgg

SEQ ID NO: 508083 - RNA, 32 nt, Human
ucugggcgucugcaccuggggccuagggaacu

SEQ ID NO: 508084 - RNA, 23 nt, Human
ucugggcuaaccuguuccagcca

SEQ ID NO: 508085 - RNA, 32 nt, Human
ucugggcucacaccagcccugguggccaagcc

SEQ ID NO: 508086 - RNA, 32 nt, Human
ucugggcucacagacagagagggugagggguu

SEQ ID NO: 508087 - RNA, 32 nt, Human
ucugggcucacugcaaccuccgccucccuggu

SEQ ID NO: 508088 - RNA, 32 nt, Human
ucugggcucacugcaaccuccuccuccuggau

SEQ ID NO: 508089 - RNA, 32 nt, Human
ucugggcucacugcaaccucugccucccgggu

SEQ ID NO: 508090 - RNA, 32 nt, Human
ucugggcucacugcaaccuucaccuccagguu

SEQ ID NO: 508091 - RNA, 32 nt, Human
ucugggcucauugcaaccuccgccucccggcu

SEQ ID NO: 508092 - RNA, 32 nt, Human
ucugggcucauugcaaccucugccucccgggu

SEQ ID NO: 508093 - RNA, 26 nt, Human
ucugggcuccagccaucuuuguggaa

SEQ ID NO: 508094 - RNA, 32 nt, Human
ucugggcucccaggaccuguggugaccucaag

SEQ ID NO: 508095 - RNA, 32 nt, Human
ucugggcucuggaaggagccagaugcccccag

SEQ ID NO: 508096 - RNA, 32 nt, Human
ucugggcugccgcaggcacacaggccagagcu

SEQ ID NO: 508097 - RNA, 32 nt, Human
ucugggcugcugucucucuuuccuucaggugg

SEQ ID NO: 508098 - RNA, 32 nt, Human
ucugggcugcuucucacauccugggcuggaug

SEQ ID NO: 508099 - RNA, 20 nt, Human
ucugggcugcuucucugugu

SEQ ID NO: 508100 - RNA, 32 nt, Human
ucugggcuggacugugggaucuguuacagacg

SEQ ID NO: 508101 - RNA, 32 nt, Human
ucugggcugggcagacaccugugggagccgga

SEQ ID NO: 508102 - RNA, 32 nt, Human
ucugggcuguugguggagguuguacuguggua

SEQ ID NO: 508103 - RNA, 32 nt, Human
ucugggcuucuuucugucucuuucugucuuuc

SEQ ID NO: 508104 - RNA, 32 nt, Human
ucugggcuuggucauuuccucccaagcaaacc

SEQ ID NO: 508105 - RNA, 22 nt, Human
ucugggcuuuccccuucuugcc

SEQ ID NO: 508106 - RNA, 32 nt, Human
ucugggcuuugcacuuacuaguugugucaccg

SEQ ID NO: 508107 - RNA, 32 nt, Human
ucuggggaaaaaggagaaaggagaggagaguu

SEQ ID NO: 508108 - RNA, 32 nt, Human
ucuggggaacauaugagaccccugccaucuca

SEQ ID NO: 508109 - RNA, 32 nt, Human
ucuggggaacugcucaccuuuccggagcaggg

SEQ ID NO: 508110 - RNA, 32 nt, Human
ucuggggaauggcaaauauauuaagaagagua

SEQ ID NO: 508111 - RNA, 32 nt, Human
ucuggggacagacaguuauggguucugguccc

SEQ ID NO: 508112 - RNA, 32 nt, Human
ucuggggacaugcggagugggggucuuauccc

SEQ ID NO: 508113 - RNA, 32 nt, Human
ucuggggaccugaagcccuggggcuuacguuc

SEQ ID NO: 508114 - RNA, 32 nt, Human
ucuggggaccuggcacugggaggcagggcucu

SEQ ID NO: 508115 - RNA, 32 nt, Human
ucuggggacuuagcuugaggcucucugaucug

SEQ ID NO: 508116 - RNA, 32 nt, Human
ucuggggagaaauguagacuguccuuagacuc

SEQ ID NO: 508117 - RNA, 32 nt, Human
ucuggggagaggccuggggaggcgugguaugg

SEQ ID NO: 508118 - RNA, 21 nt, Human
ucuggggagccccauccugcu

SEQ ID NO: 508119 - RNA, 32 nt, Human
ucuggggaggaagggccaggagagagaucuag

SEQ ID NO: 508120 - RNA, 25 nt, Human
ucuggggaggaaucuauuccuguca

SEQ ID NO: 508121 - RNA, 32 nt, Human
ucuggggaggcagagaggcagggacuuugggg

SEQ ID NO: 508122 - RNA, 32 nt, Human
ucuggggaggcagaggugacagugagcugaga

SEQ ID NO: 508123 - RNA, 32 nt, Human
ucuggggaggcagcgcuggcggcggggcuggg

SEQ ID NO: 508124 - RNA, 32 nt, Human
ucuggggaggcugaggugugaggugacagcag

SEQ ID NO: 508125 - RNA, 32 nt, Human
ucuggggaggcuggugaaggagggcaggguuc

SEQ ID NO: 508126 - RNA, 32 nt, Human
ucuggggaggcugugggccuggagagggaaaa

SEQ ID NO: 508127 - RNA, 32 nt, Human
ucuggggaggcugugggcuccaccucugcaga

SEQ ID NO: 508128 - RNA, 32 nt, Human
ucuggggaggggaacauccuugccagggaguu

SEQ ID NO: 508129 - RNA, 17 nt, Human
ucuggggagggggugca

SEQ ID NO: 508130 - RNA, 32 nt, Human
ucuggggauacauagauaagccuggcaugacu

SEQ ID NO: 508131 - RNA, 32 nt, Human
ucuggggaugaggaaauuaauaaagguacagu

SEQ ID NO: 508132 - RNA, 32 nt, Human
ucuggggauucuggcaaggugaagagcugguc

SEQ ID NO: 508133 - RNA, 20 nt, Human
ucuggggcaccuauuccucu

SEQ ID NO: 508134 - RNA, 32 nt, Human
ucuggggcagaaggaucaggugaccuucgcaa

SEQ ID NO: 508135 - RNA, 32 nt, Human
ucuggggcagccacaguuuucaugaucacauc

SEQ ID NO: 508136 - RNA, 32 nt, Human
ucuggggcagcucccagccucuucccaugcug

SEQ ID NO: 508137 - RNA, 31 nt, Human
ucuggggcaggaagcuugucacuggaagauc

SEQ ID NO: 508138 - RNA, 24 nt, Human
ucuggggcauuuauucuugacaaa

SEQ ID NO: 508139 - RNA, 22 nt, Human
ucuggggccacucaccagaaga

SEQ ID NO: 508140 - RNA, 32 nt, Human
ucuggggcccaagaggccggugguggaaagag

SEQ ID NO: 508141 - RNA, 32 nt, Human
ucuggggcccaaggcagguugcaggagaucca

SEQ ID NO: 508142 - RNA, 23 nt, Human
ucuggggcccggcgccccccggg

SEQ ID NO: 508143 - RNA, 32 nt, Human
ucuggggccgaggggccagggugugagguuuc

SEQ ID NO: 508144 - RNA, 32 nt, Human
ucuggggccucaauccagucuugauaacagcg

SEQ ID NO: 508145 - RNA, 32 nt, Human
ucuggggcggcugugggcucuggcgcuccucu

SEQ ID NO: 508146 - RNA, 32 nt, Human
ucuggggcuacagcuucugccuccucaccugg

SEQ ID NO: 508147 - RNA, 32 nt, Human
ucuggggcuccuggaccuugggccauaauuuc

SEQ ID NO: 508148 - RNA, 32 nt, Human
ucuggggcugagguugggggaggggugggcgg

SEQ ID NO: 508149 - RNA, 20 nt, Human
ucuggggcuggggggcgggg

SEQ ID NO: 508150 - RNA, 32 nt, Human
ucugggggaacuuugugucucaguccuagaau

SEQ ID NO: 508151 - RNA, 24 nt, Human
ucugggggaucccccagcugaagg

SEQ ID NO: 508152 - RNA, 32 nt, Human
ucugggggcagggagaggcuagaggggcagga

SEQ ID NO: 508153 - RNA, 20 nt, Human
ucugggggcagggggcucag

SEQ ID NO: 508154 - RNA, 22 nt, Human
ucugggggcaucgcggcguccc

SEQ ID NO: 508155 - RNA, 32 nt, Human
ucugggggccaaggcaggagaauugcuugagc

SEQ ID NO: 508156 - RNA, 32 nt, Human
ucugggggccuccucagagccagggcucuuuc

SEQ ID NO: 508157 - RNA, 31 nt, Human
ucugggggccucucugggccuuugugugccg

SEQ ID NO: 508158 - RNA, 32 nt, Human
ucugggggcucugccaguugugagcucugccc

SEQ ID NO: 508159 - RNA, 32 nt, Human
ucugggggcuuccucugcaggaggaaauuagu

SEQ ID NO: 508160 - RNA, 23 nt, Human
ucugggggguggggggugaggga

SEQ ID NO: 508161 - RNA, 32 nt, Human
ucuggggguaccccagggguguuaaggcucag

SEQ ID NO: 508162 - RNA, 32 nt, Human
ucuggggguccccaccacacaaguguuuguaa

SEQ ID NO: 508163 - RNA, 32 nt, Human
ucugggggucugcaggucacugcagaggagcg

SEQ ID NO: 508164 - RNA, 32 nt, Human
ucugggggugcuggaggccaugcucccuccag

SEQ ID NO: 508165 - RNA, 24 nt, Human
ucuggggguugccacacaacaccu

SEQ ID NO: 508166 - RNA, 32 nt, Human
ucugggguaaggguggggguugaaaguuguua

SEQ ID NO: 508167 - RNA, 32 nt, Human
ucugggguauuuuuguuuguucucucuguuuu

SEQ ID NO: 508168 - RNA, 22 nt, Human
ucuggggucacccucuccagca

SEQ ID NO: 508169 - RNA, 32 nt, Human
ucuggggucagagucuguccccgcuccugcag

SEQ ID NO: 508170 - RNA, 32 nt, Human
ucugggguccacccucuuuggcacugucccuc

SEQ ID NO: 508171 - RNA, 32 nt, Human
ucuggggucccaggucauccaggcuggaugug

SEQ ID NO: 508172 - RNA, 32 nt, Human
ucuggggucgugcuuugaggcccguccgguuc

SEQ ID NO: 508173 - RNA, 32 nt, Human
ucuggggucuuacuccuccucaaggagucugu

SEQ ID NO: 508174 - RNA, 32 nt, Human
ucuggggugcagcccugccagcaucaagagga

SEQ ID NO: 508175 - RNA, 32 nt, Human
ucuggggugccuguagucccagcuacucggga

SEQ ID NO: 508176 - RNA, 32 nt, Human
ucugggguggagaagagcagcaagaagaagac

SEQ ID NO: 508177 - RNA, 20 nt, Human
ucugggguggggaggggggu

SEQ ID NO: 508178 - RNA, 18 nt, Human
ucuggggugggggugggg

SEQ ID NO: 508179 - RNA, 32 nt, Human
ucugggguggggugggguggggugggggaggg

SEQ ID NO: 508180 - RNA, 32 nt, Human
ucugggguucaagugauucuccugucucagcc

SEQ ID NO: 508181 - RNA, 32 nt, Human
ucugggguugcuggacuuggugcguggguggu

SEQ ID NO: 508182 - RNA, 32 nt, Human
ucuggguaccagacuacugagcacuuucugac

SEQ ID NO: 508183 - RNA, 32 nt, Human
ucuggguaucucuguguugguguaucugugcc

SEQ ID NO: 508184 - RNA, 32 nt, Human
ucuggguaugggugaguggcagagggguaagg

SEQ ID NO: 508185 - RNA, 32 nt, Human
ucuggguauguuucguuucccauugcuguagc

SEQ ID NO: 508186 - RNA, 32 nt, Human
ucuggguauucauuuuucaucacugagcauug

SEQ ID NO: 508187 - RNA, 31 nt, Human
ucugggucacgcuagaaucagaucugcucuc

SEQ ID NO: 508188 - RNA, 32 nt, Human
ucugggucagaccugagguuggggaaggcgac

SEQ ID NO: 508189 - RNA, 32 nt, Human
ucuggguccagccaccaccaggcugagcagug

SEQ ID NO: 508190 - RNA, 32 nt, Human
ucuggguccagccugcagcccuaggguccagu

SEQ ID NO: 508191 - RNA, 32 nt, Human
ucuggguccauucaagacucugaugacacccc

SEQ ID NO: 508192 - RNA, 32 nt, Human
ucuggguccccagaacucuggagcuacaggcc

SEQ ID NO: 508193 - RNA, 18 nt, Human
ucugggucccccugagca

SEQ ID NO: 508194 - RNA, 32 nt, Human
ucugggucccugcuccccuuugggggugugug

SEQ ID NO: 508195 - RNA, 32 nt, Human
ucugggucccugguugaagcagcagcuuaccu

SEQ ID NO: 508196 - RNA, 32 nt, Human
ucuggguccuuggucccaucuaccuccucuuc

SEQ ID NO: 508197 - RNA, 32 nt, Human
ucugggucuccucuggagcacucugcccuccu

SEQ ID NO: 508198 - RNA, 32 nt, Human
ucugggucucugaaagaagaugaauuuggcug

SEQ ID NO: 508199 - RNA, 32 nt, Human
ucugggucuggccccacuccccaaaacugacc

SEQ ID NO: 508200 - RNA, 26 nt, Human
ucugggucuugcuuuucuuucuguua

SEQ ID NO: 508201 - RNA, 32 nt, Human
ucugggugaagccagagguggcucugggacuu

SEQ ID NO: 508202 - RNA, 19 nt, Human
ucugggugacagagcaaga

SEQ ID NO: 508203 - RNA, 20 nt, Human
ucugggugacccugcagaug

SEQ ID NO: 508204 - RNA, 23 nt, Human
ucugggugaccucaaacaucuga

SEQ ID NO: 508205 - RNA, 32 nt, Human
ucugggugaccucaaacaucugaaaagaaaga

SEQ ID NO: 508206 - RNA, 32 nt, Human
ucugggugcauguccacaguacgguggcuaaa

SEQ ID NO: 508207 - RNA, 22 nt, Human
ucugggugccucuuugcugcca

SEQ ID NO: 508208 - RNA, 19 nt, Human
ucugggugccugcugaaca

SEQ ID NO: 508209 - RNA, 19 nt, Human
ucugggugcgaguuccucc

SEQ ID NO: 508210 - RNA, 32 nt, Human
ucugggugggagaaccagguggugccugccga

SEQ ID NO: 508211 - RNA, 32 nt, Human
ucugggugggggccugggcgcccagccagcac

SEQ ID NO: 508212 - RNA, 32 nt, Human
ucugggugguaacugccagccuuggaggaucg

SEQ ID NO: 508213 - RNA, 21 nt, Human
ucugggugucucccacauguc

SEQ ID NO: 508214 - RNA, 18 nt, Human
ucugggugucuccugcuu

SEQ ID NO: 508215 - RNA, 22 nt, Human
ucugggugucucuugagcccca

SEQ ID NO: 508216 - RNA, 32 nt, Human
ucugggugucuggaaugggggagcuguuaagu

SEQ ID NO: 508217 - RNA, 32 nt, Human
ucugggugugagccacugucaugccuggccuc

SEQ ID NO: 508218 - RNA, 32 nt, Human
ucugggugugagucugucuaggaacaggaggg

SEQ ID NO: 508219 - RNA, 22 nt, Human
ucuggguguuccaauucuucca

SEQ ID NO: 508220 - RNA, 24 nt, Human
ucuggguguuccaauucuuccaag

SEQ ID NO: 508221 - RNA, 22 nt, Human
ucuggguguuuguucccugcca

SEQ ID NO: 508222 - RNA, 32 nt, Human
ucuggguuaacgcuuuucagggccaagcacua

SEQ ID NO: 508223 - RNA, 32 nt, Human
ucuggguuaugucacuuuccuuagcuccccau

SEQ ID NO: 508224 - RNA, 32 nt, Human
ucuggguucaagcaauucucugccucagccuc

SEQ ID NO: 508225 - RNA, 32 nt, Human
ucuggguucacugcaaccuccgccucuugggu

SEQ ID NO: 508226 - RNA, 32 nt, Human
ucuggguucacugcaaccucugccuccagguu

SEQ ID NO: 508227 - RNA, 32 nt, Human
ucuggguucacugcaaccucugccuccugggc

SEQ ID NO: 508228 - RNA, 32 nt, Human
ucuggguuccagggcugcugucuccuggcuaa

SEQ ID NO: 508229 - RNA, 32 nt, Human
ucuggguuccagggcugcuuucuccuggcuaa

SEQ ID NO: 508230 - RNA, 32 nt, Human
ucuggguuccuaggaauguccagccucggaga

SEQ ID NO: 508231 - RNA, 32 nt, Human
ucuggguucucccagccccuuguccuuccuuc

SEQ ID NO: 508232 - RNA, 22 nt, Human
ucuggguucucugugcugggca

SEQ ID NO: 508233 - RNA, 32 nt, Human
ucuggguucugaagucugguauucugguauuc

SEQ ID NO: 508234 - RNA, 32 nt, Human
ucuggguugaagggcaguguucccuggggcuu

SEQ ID NO: 508235 - RNA, 23 nt, Human
ucuggguugcauugagggcuucu

SEQ ID NO: 508236 - RNA, 21 nt, Human
ucuggguuggagcagucucuc

SEQ ID NO: 508237 - RNA, 20 nt, Human
ucuggguuggcgggcuggca

SEQ ID NO: 508238 - RNA, 21 nt, Human
ucuggguuguuuuuucugcca

SEQ ID NO: 508239 - RNA, 26 nt, Human
ucuggguuuaaaucccaguucuguca

SEQ ID NO: 508240 - RNA, 32 nt, Human
ucuggguuuggaaggugugcuugcugugguac

SEQ ID NO: 508241 - RNA, 32 nt, Human
ucuggguuuggguuuauguucuugccuuuucu

SEQ ID NO: 508242 - RNA, 22 nt, Human
ucugguaaaucucuuugucaaa

SEQ ID NO: 508243 - RNA, 32 nt, Human
ucugguaacauuuguuaguaggauuugaguua

SEQ ID NO: 508244 - RNA, 32 nt, Human
ucugguaaccauccuucgucuaucuccacgag

SEQ ID NO: 508245 - RNA, 32 nt, Human
ucugguaacugaacucccucuggaggcaggcu

SEQ ID NO: 508246 - RNA, 32 nt, Human
ucugguaagguuuuuaugcucuguaaaacaaa

SEQ ID NO: 508247 - RNA, 32 nt, Human
ucugguacccaccauucucuucucuacuucuc

SEQ ID NO: 508248 - RNA, 19 nt, Human
ucugguaccucucuuuccc

SEQ ID NO: 508249 - RNA, 32 nt, Human
ucugguaccugcagagacuguccagccauaaa

SEQ ID NO: 508250 - RNA, 32 nt, Human
ucugguacucaggcuggagugcggugguguga

SEQ ID NO: 508251 - RNA, 21 nt, Human
ucugguacugugcaaagggaa

SEQ ID NO: 508252 - RNA, 20 nt, Human
ucugguagccaggguucccu

SEQ ID NO: 508253 - RNA, 30 nt, Human
ucugguagccucucugcuuccuguaauucu

SEQ ID NO: 508254 - RNA, 20 nt, Human
ucugguaggacagggcucag

SEQ ID NO: 508255 - RNA, 19 nt, Human
ucugguaggaugggcacag

SEQ ID NO: 508256 - RNA, 32 nt, Human
ucugguaggucgcccagacaauggagacaucc

SEQ ID NO: 508257 - RNA, 18 nt, Human
ucugguagguugcagcag

SEQ ID NO: 508258 - RNA, 32 nt, Human
ucugguagucauaggcaggauugagugacggu

SEQ ID NO: 508259 - RNA, 32 nt, Human
ucugguagugccugaucacagcccaugauguc

SEQ ID NO: 508260 - RNA, 21 nt, Human
ucugguaugcuuguuccugcu

SEQ ID NO: 508261 - RNA, 22 nt, Human
ucuggucacacacagguguuga

SEQ ID NO: 508262 - RNA, 23 nt, Human
ucuggucaccucugggcgccugg

SEQ ID NO: 508263 - RNA, 22 nt, Human
ucuggucacucccuggcccuga

SEQ ID NO: 508264 - RNA, 32 nt, Human
ucuggucacuccucacuguccccucagcuccc

SEQ ID NO: 508265 - RNA, 22 nt, Human
ucuggucacuucuagcaucuga

SEQ ID NO: 508266 - RNA, 32 nt, Human
ucuggucagcuguguaugaucaguuaucuacc

SEQ ID NO: 508267 - RNA, 22 nt, Human
ucuggucaggaugggggugcag

SEQ ID NO: 508268 - RNA, 32 nt, Human
ucuggucaggcagaaggagaaggaaauguaaa

SEQ ID NO: 508269 - RNA, 32 nt, Human
ucuggucaggcgagguucacugugcauauggc

SEQ ID NO: 508270 - RNA, 32 nt, Human
ucuggucauagagagagaaggaccuuugacuu

SEQ ID NO: 508271 - RNA, 32 nt, Human
ucuggucauaggagucauguccagaggccuag

SEQ ID NO: 508272 - RNA, 32 nt, Human
ucuggucaucccuccccacccucucuccaagg

SEQ ID NO: 508273 - RNA, 32 nt, Human
ucuggucauguggaggugggguuuauugggau

SEQ ID NO: 508274 - RNA, 32 nt, Human
ucuggucauugcugggggugaccccagaugag

SEQ ID NO: 508275 - RNA, 26 nt, Human
ucugguccaccaaccagacccuugga

SEQ ID NO: 508276 - RNA, 32 nt, Human
ucugguccauagagagcaaaacgcugugcugc

SEQ ID NO: 508277 - RNA, 22 nt, Human
ucugguccauagugcccuugga

SEQ ID NO: 508278 - RNA, 21 nt, Human
ucuggucccaaaacccuugag

SEQ ID NO: 508279 - RNA, 32 nt, Human
ucuggucccaauuaucugccccggcuagcccc

SEQ ID NO: 508280 - RNA, 32 nt, Human
ucugguccccauccgcggcugguccggcccug

SEQ ID NO: 508281 - RNA, 23 nt, Human
ucuggucccuacuguucuugcca

SEQ ID NO: 508282 - RNA, 32 nt, Human
ucuggucccuggcaggacagagcgggaugcca

SEQ ID NO: 508283 - RNA, 18 nt, Human
ucuggucccuuuccuucc

SEQ ID NO: 508284 - RNA, 32 nt, Human
ucuggucccuuuccuuugcucagcccccucug

SEQ ID NO: 508285 - RNA, 23 nt, Human
ucugguccucccauccacugcca

SEQ ID NO: 508286 - RNA, 32 nt, Human
ucugguccugcagauguguagcacuuuguagu

SEQ ID NO: 508287 - RNA, 22 nt, Human
ucugguccuggguggagcagga

SEQ ID NO: 508288 - RNA, 32 nt, Human
ucugguccuguccuccccauccuguacugcuu

SEQ ID NO: 508289 - RNA, 32 nt, Human
ucugguccuguucaucucucaggcucugagac

SEQ ID NO: 508290 - RNA, 23 nt, Human
ucuggucgccucauuuccugcua

SEQ ID NO: 508291 - RNA, 32 nt, Human
ucuggucuaaagugccugggcuugguggccau

SEQ ID NO: 508292 - RNA, 32 nt, Human
ucuggucucacugcaaccucuaccucccaggu

SEQ ID NO: 508293 - RNA, 32 nt, Human
ucuggucucagaaauggaccagcuggaugcag

SEQ ID NO: 508294 - RNA, 32 nt, Human
ucuggucuccucagccuccucaucugggggag

SEQ ID NO: 508295 - RNA, 32 nt, Human
ucuggucuccuccagcuccuucuuucugcaac

SEQ ID NO: 508296 - RNA, 32 nt, Human
ucuggucuccuugccuagugcuuuucaaaacu

SEQ ID NO: 508297 - RNA, 32 nt, Human
ucuggucucucuauuaccacugaagauagaag

SEQ ID NO: 508298 - RNA, 32 nt, Human
ucuggucucuucuucuuucugguuguuuuugu

SEQ ID NO: 508299 - RNA, 32 nt, Human
ucuggucuguccucccuguugauuggucuggc

SEQ ID NO: 508300 - RNA, 32 nt, Human
ucuggucugucuggggguucccauucccacac

SEQ ID NO: 508301 - RNA, 32 nt, Human
ucuggucugugucugugugugccuguaagugu

SEQ ID NO: 508302 - RNA, 32 nt, Human
ucuggucuguucugaaacugugccaacugaaa

SEQ ID NO: 508303 - RNA, 31 nt, Human
ucuggucuugagaccuuuucacuguggucug

SEQ ID NO: 508304 - RNA, 32 nt, Human
ucuggucuuuaaggaacacaacuuuaaaacug

SEQ ID NO: 508305 - RNA, 21 nt, Human
ucuggucuuuaaugcaugcua

SEQ ID NO: 508306 - RNA, 32 nt, Human
ucuggucuuuccagucacaucuggaaauaaag

SEQ ID NO: 508307 - RNA, 32 nt, Human
ucuggucuuugcccugcugugugugccucugu

SEQ ID NO: 508308 - RNA, 32 nt, Human
ucuggugacaccagccuuucucccaggccagg

SEQ ID NO: 508309 - RNA, 21 nt, Human
ucuggugaccaggcugcuuca

SEQ ID NO: 508310 - RNA, 32 nt, Human
ucuggugacuccaggccugaaugaccuagugu

SEQ ID NO: 508311 - RNA, 21 nt, Human
ucuggugacucgugccugcuu

SEQ ID NO: 508312 - RNA, 32 nt, Human
ucuggugagggcgacugggugggugaagcacc

SEQ ID NO: 508313 - RNA, 32 nt, Human
ucuggugaggguggcugggauauaccugaccc

SEQ ID NO: 508314 - RNA, 32 nt, Human
ucuggugaucacugaaaucuugccuugggucc

SEQ ID NO: 508315 - RNA, 32 nt, Human
ucuggugcaacugcugcaggaugccuguagua

SEQ ID NO: 508316 - RNA, 32 nt, Human
ucuggugcaccagcugcuggaagcgcugcuuu

SEQ ID NO: 508317 - RNA, 31 nt, Human
ucuggugcacuucuccgugucugaguugccu

SEQ ID NO: 508318 - RNA, 32 nt, Human
ucuggugccaguggauuugcacuugcucgugu

SEQ ID NO: 508319 - RNA, 32 nt, Human
ucuggugccuccucaaacccagucucagacac

SEQ ID NO: 508320 - RNA, 23 nt, Human
ucuggugcgagaagggggugcag

SEQ ID NO: 508321 - RNA, 32 nt, Human
ucuggugcguucucccuguggccccaagaggu

SEQ ID NO: 508322 - RNA, 32 nt, Human
ucuggugcugauguucuugugggaagagggag

SEQ ID NO: 508323 - RNA, 32 nt, Human
ucuggugcuucuucugugcugugguuuacccc

SEQ ID NO: 508324 - RNA, 32 nt, Human
ucugguggaagaugaggcucagugugauugga

SEQ ID NO: 508325 - RNA, 32 nt, Human
ucugguggagagaagugagaauaggcagcccc

SEQ ID NO: 508326 - RNA, 32 nt, Human
ucugguggagcggacccacuccccucacauuc

SEQ ID NO: 508327 - RNA, 32 nt, Human
ucugguggagggaagagagaagagguaggaag

SEQ ID NO: 508328 - RNA, 19 nt, Human
ucugguggaggggcggcgg

SEQ ID NO: 508329 - RNA, 32 nt, Human
ucugguggccagcuugccaguaccugagccgg

SEQ ID NO: 508330 - RNA, 21 nt, Human
ucugguggcccccagucccca

SEQ ID NO: 508331 - RNA, 21 nt, Human
ucugguggccgagcccugagg

SEQ ID NO: 508332 - RNA, 18 nt, Human
ucugguggccuccugcuu

SEQ ID NO: 508333 - RNA, 18 nt, Human
ucugguggcgggcagcag

SEQ ID NO: 508334 - RNA, 32 nt, Human
ucugguggcucaugccuguaaucccagcacuu

SEQ ID NO: 508335 - RNA, 32 nt, Human
ucuggugggagagggagacagauggaggcagu

SEQ ID NO: 508336 - RNA, 20 nt, Human
ucuggugggaggacggugca

SEQ ID NO: 508337 - RNA, 20 nt, Human
ucuggugggaggaggccgca

SEQ ID NO: 508338 - RNA, 32 nt, Human
ucuggugggccucagaaauugucucuuuucug

SEQ ID NO: 508339 - RNA, 18 nt, Human
ucuggugggcggggccag

SEQ ID NO: 508340 - RNA, 32 nt, Human
ucugguggggcugagcgcucugccgcgggggc

SEQ ID NO: 508341 - RNA, 32 nt, Human
ucugguggucagcucagggcuuccucugccca

SEQ ID NO: 508342 - RNA, 32 nt, Human
ucugguggugggaacccagaagucagaacaca

SEQ ID NO: 508343 - RNA, 32 nt, Human
ucugguggugggcaccuguaaucccagcuacu

SEQ ID NO: 508344 - RNA, 32 nt, Human
ucugguguagggggugcuccugccuuaggucu

SEQ ID NO: 508345 - RNA, 32 nt, Human
ucugguguccagcauggaugaaaccuuugagu

SEQ ID NO: 508346 - RNA, 24 nt, Human
ucugguguccaggcuggagugcag

SEQ ID NO: 508347 - RNA, 32 nt, Human
ucugguguccccucaccuucuaguguccccuc

SEQ ID NO: 508348 - RNA, 32 nt, Human
ucugguguccccucaucaccuucugauguccc

SEQ ID NO: 508349 - RNA, 32 nt, Human
ucuggugucugaccacgacugcagccucaugg

SEQ ID NO: 508350 - RNA, 32 nt, Human
ucuggugucugcuuucuccauuguaaaccaca

SEQ ID NO: 508351 - RNA, 19 nt, Human
ucuggugugauuucucugu

SEQ ID NO: 508352 - RNA, 31 nt, Human
ucuggugugggaagaagauggggaguuacuu

SEQ ID NO: 508353 - RNA, 32 nt, Human
ucuggugugguggcucacaccuguaauccuaa

SEQ ID NO: 508354 - RNA, 32 nt, Human
ucuggugugugcucccgccuccuggguauaca

SEQ ID NO: 508355 - RNA, 32 nt, Human
ucugguguucuugcuaacuuugcccuucacug

SEQ ID NO: 508356 - RNA, 31 nt, Human
ucugguuaagugucccauggaaggggaaagc

SEQ ID NO: 508357 - RNA, 32 nt, Human
ucugguuaccauuuucuuuuugucauuggcuu

SEQ ID NO: 508358 - RNA, 32 nt, Human
ucugguuacuguucuaaggcugugccaucagc

SEQ ID NO: 508359 - RNA, 32 nt, Human
ucugguuaugcuguuuuaaaggugacuuguca

SEQ ID NO: 508360 - RNA, 32 nt, Human
ucugguuauugggcacuaagggccagacugga

SEQ ID NO: 508361 - RNA, 32 nt, Human
ucugguucaccauucagcaccagcugaagaua

SEQ ID NO: 508362 - RNA, 32 nt, Human
ucugguucagcccuggauaugccuccacugug

SEQ ID NO: 508363 - RNA, 32 nt, Human
ucugguuccauggaugauggcgguugagcaga

SEQ ID NO: 508364 - RNA, 22 nt, Human
ucugguuccugcuggauccuga

SEQ ID NO: 508365 - RNA, 32 nt, Human
ucugguuccuuucaucucucuaccuccacccu

SEQ ID NO: 508366 - RNA, 32 nt, Human
ucugguuccuuuggagagggcuggguuaccug

SEQ ID NO: 508367 - RNA, 32 nt, Human
ucugguucgcagcuccagaggauugcguuccu

SEQ ID NO: 508368 - RNA, 32 nt, Human
ucugguucggagaagcagcggcuggcgugggc

SEQ ID NO: 508369 - RNA, 32 nt, Human
ucugguucuccgucagcaacaggcuggcauaa

SEQ ID NO: 508370 - RNA, 32 nt, Human
ucugguucugguugaagaguccugucaaggcc

SEQ ID NO: 508371 - RNA, 32 nt, Human
ucugguucuuggaucguguccucucccccucg

SEQ ID NO: 508372 - RNA, 32 nt, Human
ucugguugccaucuuuuucuguggaacuccuc

SEQ ID NO: 508373 - RNA, 32 nt, Human
ucugguugcccaggcuggagugcaguggugcc

SEQ ID NO: 508374 - RNA, 32 nt, Human
ucugguugcccaggcugggguacaguggugga

SEQ ID NO: 508375 - RNA, 32 nt, Human
ucugguugccucccccgccuccagucauggua

SEQ ID NO: 508376 - RNA, 31 nt, Human
ucugguugccucucuaugcuauuguguucag

SEQ ID NO: 508377 - RNA, 32 nt, Human
ucugguuggaaaccaagagaauggcugauguc

SEQ ID NO: 508378 - RNA, 32 nt, Human
ucugguuguuaauauuuguauuguaaguguaa

SEQ ID NO: 508379 - RNA, 32 nt, Human
ucugguuuagaauuauaaauuguuaaaaccuu

SEQ ID NO: 508380 - RNA, 32 nt, Human
ucugguuuauguuugaccccucccucugagcu

SEQ ID NO: 508381 - RNA, 25 nt, Human
ucugguuucagaaacaucagagagg

SEQ ID NO: 508382 - RNA, 32 nt, Human
ucugguuucgucugcuugguucaucugugugc

SEQ ID NO: 508383 - RNA, 32 nt, Human
ucugguuucuaggagcuugaaauuccuggaaa

SEQ ID NO: 508384 - RNA, 32 nt, Human
ucugguuugagaucgugcuggggaggaacaug

SEQ ID NO: 508385 - RNA, 32 nt, Human
ucugguuugcccacuucaucucauucucucuc

SEQ ID NO: 508386 - RNA, 32 nt, Human
ucugguuugggaaauaccaaagaggcuuugau

SEQ ID NO: 508387 - RNA, 32 nt, Human
ucugguuuuccuaggcagaguguuuguguccc

SEQ ID NO: 508388 - RNA, 32 nt, Human
ucugguuuuccucugcuccucugccuguccuc

SEQ ID NO: 508389 - RNA, 22 nt, Human
ucugguuuucucauucaugcca

SEQ ID NO: 508390 - RNA, 32 nt, Human
ucugguuuucugacaguucccagugagagaaa

SEQ ID NO: 508391 - RNA, 32 nt, Human
ucugguuuuggcccucuugcagaaagaagcau

SEQ ID NO: 508392 - RNA, 32 nt, Human
ucugguuuuuaucugguacccacacacacaua

SEQ ID NO: 508393 - RNA, 32 nt, Human
ucugguuuuuauuggauuuuuguauuuuaaau

SEQ ID NO: 508394 - RNA, 32 nt, Human
ucuguaaaaaggcagaccagggauguaauguu

SEQ ID NO: 508395 - RNA, 32 nt, Human
ucuguaaaaauggcaagccacaugcuuuucuc

SEQ ID NO: 508396 - RNA, 32 nt, Human
ucuguaaaacaagggggugggccaggcgaugu

SEQ ID NO: 508397 - RNA, 32 nt, Human
ucuguaaaaugagagcauuggauuagaggcuc

SEQ ID NO: 508398 - RNA, 32 nt, Human
ucuguaaacauacaaccuaucaagauuauaug

SEQ ID NO: 508399 - RNA, 32 nt, Human
ucuguaaacauguugcacaagcuuagccuuuu

SEQ ID NO: 508400 - RNA, 32 nt, Human
ucuguaaagauugccuacagcgcuccuuuaag

SEQ ID NO: 508401 - RNA, 32 nt, Human
ucuguaaagcuaggcagaugagcccagaagaa

SEQ ID NO: 508402 - RNA, 32 nt, Human
ucuguaaaggaggcaggagugucagagugacg

SEQ ID NO: 508403 - RNA, 32 nt, Human
ucuguaaaguggggagaauuuccaucaagauu

SEQ ID NO: 508404 - RNA, 32 nt, Human
ucuguaaauuuggacuguuuuccuucaaccac

SEQ ID NO: 508405 - RNA, 22 nt, Human
ucuguaacaauuguauaucuua

SEQ ID NO: 508406 - RNA, 23 nt, Human
ucuguaacagaggacuauccuca

SEQ ID NO: 508407 - RNA, 32 nt, Human
ucuguaaccccagcacuuugggaggcugagau

SEQ ID NO: 508408 - RNA, 32 nt, Human
ucuguaacucuccaucugugauuugcaacagg

SEQ ID NO: 508409 - RNA, 32 nt, Human
ucuguaacuguaucuuaaucuacaaugagcuu

SEQ ID NO: 508410 - RNA, 23 nt, Human
ucuguaagaaaaacaguuucuca

SEQ ID NO: 508411 - RNA, 32 nt, Human
ucuguaagaacucugucuaagccggucagaag

SEQ ID NO: 508412 - RNA, 21 nt, Human
ucuguaagaaggcccuggugg

SEQ ID NO: 508413 - RNA, 32 nt, Human
ucuguaagaggagccagcuggauaagaugauu

SEQ ID NO: 508414 - RNA, 32 nt, Human
ucuguaagcugcagugucugugauucugugug

SEQ ID NO: 508415 - RNA, 32 nt, Human
ucuguaaguaaguuugguuucaucaugaggga

SEQ ID NO: 508416 - RNA, 32 nt, Human
ucuguaagucacucugccccaggaggccagag

SEQ ID NO: 508417 - RNA, 32 nt, Human
ucuguaagugaagauugucguauuccaagucu

SEQ ID NO: 508418 - RNA, 22 nt, Human
ucuguaauaaaauucuacuuca

SEQ ID NO: 508419 - RNA, 19 nt, Human
ucuguaaucccagcacuuu

SEQ ID NO: 508420 - RNA, 32 nt, Human
ucuguaaucccagcuacccgggaggcugaggc

SEQ ID NO: 508421 - RNA, 22 nt, Human
ucuguaaucccagcuacucagg

SEQ ID NO: 508422 - RNA, 32 nt, Human
ucuguaaucccagcuacucaggaggcugaagc

SEQ ID NO: 508423 - RNA, 32 nt, Human
ucuguaaucccagcuacucaggaggcugaggc

SEQ ID NO: 508424 - RNA, 32 nt, Human
ucuguaaucccagcuacuccagaggcugaggc

SEQ ID NO: 508425 - RNA, 32 nt, Human
ucuguaaucccagcuacucgggaggcugaagc

SEQ ID NO: 508426 - RNA, 32 nt, Human
ucuguaaucccagcuacucgggaggcugagga

SEQ ID NO: 508427 - RNA, 32 nt, Human
ucuguaaucccagcuacucgggaggcugaggc

SEQ ID NO: 508428 - RNA, 32 nt, Human
ucuguaaucccagcuacucuggagacugaggu

SEQ ID NO: 508429 - RNA, 32 nt, Human
ucuguaaucccagcuacuggggaagcugaggc

SEQ ID NO: 508430 - RNA, 32 nt, Human
ucuguaaucccagcuacuggggaggcugaggc

SEQ ID NO: 508431 - RNA, 22 nt, Human
ucuguaaucccagcuacuuggg

SEQ ID NO: 508432 - RNA, 32 nt, Human
ucuguaaucccagcuacuugggagacugaggc

SEQ ID NO: 508433 - RNA, 32 nt, Human
ucuguaaucccagcuacuugggaggcugaggc

SEQ ID NO: 508434 - RNA, 32 nt, Human
ucuguaaucccagcuauucaggaggcugaggc

SEQ ID NO: 508435 - RNA, 19 nt, Human
ucuguaauccuagcacuuu

SEQ ID NO: 508436 - RNA, 32 nt, Human
ucuguaaucucagcuucucaggaggcugagac

SEQ ID NO: 508437 - RNA, 32 nt, Human
ucuguaaugaaggagguucaagaggcugugcu

SEQ ID NO: 508438 - RNA, 32 nt, Human
ucuguaauggcagauaggaggagaugaaaagu

SEQ ID NO: 508439 - RNA, 32 nt, Human
ucuguaauguccccuucuuucuaggcucuguu

SEQ ID NO: 508440 - RNA, 32 nt, Human
ucuguaauuacauauuugacucuuucaaagaa

SEQ ID NO: 508441 - RNA, 32 nt, Human
ucuguaauuauccauuuuccauucaugcauuc

SEQ ID NO: 508442 - RNA, 32 nt, Human
ucuguaauuccagcuacuugggaggcugaggc

SEQ ID NO: 508443 - RNA, 27 nt, Human
ucuguaauuguuagaauuuauuuuuua

SEQ ID NO: 508444 - RNA, 32 nt, Human
ucuguaauuuaaaauauuuugcugcuaguuaa

SEQ ID NO: 508445 - RNA, 32 nt, Human
ucuguacaaucuccuguuucuuugccauagug

SEQ ID NO: 508446 - RNA, 32 nt, Human
ucuguacacuucccugacaccuucccaggugu

SEQ ID NO: 508447 - RNA, 32 nt, Human
ucuguacagacagcugagucacccagucuacu

SEQ ID NO: 508448 - RNA, 31 nt, Human
ucuguacaggcccagccucuaccucacagcg

SEQ ID NO: 508449 - RNA, 32 nt, Human
ucuguacaguuccauacaacaaggaggugaaa

SEQ ID NO: 508450 - RNA, 24 nt, Human
ucuguacauucauuucuccuuccu

SEQ ID NO: 508451 - RNA, 32 nt, Human
ucuguaccaggucacccagcuaugcugcaaag

SEQ ID NO: 508452 - RNA, 32 nt, Human
ucuguacccacacccacccacucacuuguaag

SEQ ID NO: 508453 - RNA, 22 nt, Human
ucuguaccccgccugucccucc

SEQ ID NO: 508454 - RNA, 32 nt, Human
ucuguaccucaaggcacugaagcuggaggacu

SEQ ID NO: 508455 - RNA, 22 nt, Human
ucuguaccucugccuccuuucc

SEQ ID NO: 508456 - RNA, 32 nt, Human
ucuguaccugcagcucugcucucgggauggug

SEQ ID NO: 508457 - RNA, 32 nt, Human
ucuguaccuugcagccaugaccaguucuggcc

SEQ ID NO: 508458 - RNA, 32 nt, Human
ucuguaccuuggaacagucuucccugacaagc

SEQ ID NO: 508459 - RNA, 32 nt, Human
ucuguacuaaaaacacaaaauuagcugggugu

SEQ ID NO: 508460 - RNA, 21 nt, Human
ucuguacuaaaaauacaaaau

SEQ ID NO: 508461 - RNA, 32 nt, Human
ucuguacuaaaaauacaaaauuagcuggguuu

SEQ ID NO: 508462 - RNA, 32 nt, Human
ucuguacuacaccagaggguuggggcugugga

SEQ ID NO: 508463 - RNA, 22 nt, Human
ucuguacuccccucauccuccu

SEQ ID NO: 508464 - RNA, 32 nt, Human
ucuguacuccuuggauuugcauuuuuguauuu

SEQ ID NO: 508465 - RNA, 32 nt, Human
ucuguacucgccguccuccuguccucgcggug

SEQ ID NO: 508466 - RNA, 32 nt, Human
ucuguacucuagucuccugccuccucaguucu

SEQ ID NO: 508467 - RNA, 32 nt, Human
ucuguacugcucauauuacacuccauccucuc

SEQ ID NO: 508468 - RNA, 32 nt, Human
ucuguacuggaaaggcuguggccaugucugcu

SEQ ID NO: 508469 - RNA, 32 nt, Human
ucuguacugugccugccucaacuuccccuaac

SEQ ID NO: 508470 - RNA, 32 nt, Human
ucuguacuguguguagugcuguuuacauagau

SEQ ID NO: 508471 - RNA, 32 nt, Human
ucuguacuucuauuuaaccaguuuucaaaaua

SEQ ID NO: 508472 - RNA, 32 nt, Human
ucuguagaaaugugcaguuugcagauagaaca

SEQ ID NO: 508473 - RNA, 32 nt, Human
ucuguagaaccagcugcacggcagcuguccac

SEQ ID NO: 508474 - RNA, 32 nt, Human
ucuguagaaguaugaguucuuccuuuaauuau

SEQ ID NO: 508475 - RNA, 21 nt, Human
ucuguagaagucugucuuucu

SEQ ID NO: 508476 - RNA, 32 nt, Human
ucuguagaagugaauacugcaacacugucuca

SEQ ID NO: 508477 - RNA, 32 nt, Human
ucuguagacucugccuggguuuuacuggguca

SEQ ID NO: 508478 - RNA, 32 nt, Human
ucuguagagacaggguuucaccauguuggcca

SEQ ID NO: 508479 - RNA, 32 nt, Human
ucuguagagagggagucaggaugcugucuucc

SEQ ID NO: 508480 - RNA, 32 nt, Human
ucuguagaugaugcaguguucuaucauaagua

SEQ ID NO: 508481 - RNA, 32 nt, Human
ucuguagauuuucaaagauaacugacagcugc

SEQ ID NO: 508482 - RNA, 21 nt, Human
ucuguagcaauguuagccuca

SEQ ID NO: 508483 - RNA, 32 nt, Human
ucuguagcagagguucccaaccuacaggccau

SEQ ID NO: 508484 - RNA, 32 nt, Human
ucuguagccacccauccuuugccuuaucuaac

SEQ ID NO: 508485 - RNA, 32 nt, Human
ucuguagccaggcuggagggcaauuguacaau

SEQ ID NO: 508486 - RNA, 24 nt, Human
ucuguagcccaggccagagugcag

SEQ ID NO: 508487 - RNA, 32 nt, Human
ucuguagcccaggcuggagugcaguguggcac

SEQ ID NO: 508488 - RNA, 32 nt, Human
ucuguagcccagucuggagugcagugguacaa

SEQ ID NO: 508489 - RNA, 32 nt, Human
ucuguagcccagucuggagugcagugguguga

SEQ ID NO: 508490 - RNA, 32 nt, Human
ucuguagccucagcuacucaggggguugaggu

SEQ ID NO: 508491 - RNA, 32 nt, Human
ucuguagcuccaaaggcuaucucuucauauug

SEQ ID NO: 508492 - RNA, 32 nt, Human
ucuguagcucuuggggugaucacucaucccag

SEQ ID NO: 508493 - RNA, 31 nt, Human
ucuguagcugagagagacagagcuggacauc

SEQ ID NO: 508494 - RNA, 32 nt, Human
ucuguagcugagagagacagagcuggacaucc

SEQ ID NO: 508495 - RNA, 32 nt, Human
ucuguagcuuguucccugucuuguccaugugg

SEQ ID NO: 508496 - RNA, 23 nt, Human
ucuguaggaagccucggccuucc

SEQ ID NO: 508497 - RNA, 32 nt, Human
ucuguaggauuuauaagucagccaugacaauu

SEQ ID NO: 508498 - RNA, 32 nt, Human
ucuguaggcucacaccuuaaucucaggccccu

SEQ ID NO: 508499 - RNA, 32 nt, Human
ucuguagggcuggaccuauguccuaaggacac

SEQ ID NO: 508500 - RNA, 32 nt, Human
ucuguaggggaaggagccaauuaagaaaaagu

SEQ ID NO: 508501 - RNA, 32 nt, Human
ucuguaggguuauacagaugucagagagcuaa

SEQ ID NO: 508502 - RNA, 32 nt, Human
ucuguagucccaccuauucaggagauuaaggc

SEQ ID NO: 508503 - RNA, 32 nt, Human
ucuguagucccagcuacucagcaggcugagau

SEQ ID NO: 508504 - RNA, 22 nt, Human
ucuguagucccagcuacucagg

SEQ ID NO: 508505 - RNA, 32 nt, Human
ucuguagucccagcuacucaggaggcugaggc

SEQ ID NO: 508506 - RNA, 32 nt, Human
ucuguagucccagcuacucgggaggcugaggc

SEQ ID NO: 508507 - RNA, 32 nt, Human
ucuguagucccagcuacucuggaggcugagac

SEQ ID NO: 508508 - RNA, 22 nt, Human
ucuguagucccagcuacuuggg

SEQ ID NO: 508509 - RNA, 23 nt, Human
ucuguagucccagcuacuuggga

SEQ ID NO: 508510 - RNA, 32 nt, Human
ucuguagucccagcuacuugggaagcugaagu

SEQ ID NO: 508511 - RNA, 32 nt, Human
ucuguagucccagcuacuugggaggcugaggc

SEQ ID NO: 508512 - RNA, 32 nt, Human
ucuguagucccagcuacuugggaggcugaggu

SEQ ID NO: 508513 - RNA, 32 nt, Human
ucuguagucccagcuaugugggaggcuaaggu

SEQ ID NO: 508514 - RNA, 32 nt, Human
ucuguaguccuaacugcucaggaggcugaggu

SEQ ID NO: 508515 - RNA, 32 nt, Human
ucuguaguccuagcuacucaggaggcugaggc

SEQ ID NO: 508516 - RNA, 32 nt, Human
ucuguagucucugcacuugucucccauuaagg

SEQ ID NO: 508517 - RNA, 32 nt, Human
ucuguagugaugacuuccuguccucugcucug

SEQ ID NO: 508518 - RNA, 32 nt, Human
ucuguaguuccagcaacucaggaggcugagau

SEQ ID NO: 508519 - RNA, 32 nt, Human
ucuguaguuccuuuuuguuucauuuucuucug

SEQ ID NO: 508520 - RNA, 32 nt, Human
ucuguaguucuucuuaccuugccuguaaaaca

SEQ ID NO: 508521 - RNA, 32 nt, Human
ucuguaguuucaucaucugucauaaccaugcc

SEQ ID NO: 508522 - RNA, 32 nt, Human
ucuguaguuucucaagugaacacucucaggau

SEQ ID NO: 508523 - RNA, 22 nt, Human
ucuguauaauccccacucucaa

SEQ ID NO: 508524 - RNA, 32 nt, Human
ucuguauauaaauaugugaaauauuauuaucu

SEQ ID NO: 508525 - RNA, 32 nt, Human
ucuguauauguuuuuaaucauauugauguaua

SEQ ID NO: 508526 - RNA, 31 nt, Human
ucuguaucaucucaggagguuucaggggccu

SEQ ID NO: 508527 - RNA, 32 nt, Human
ucuguaucauuuguuucccagaauggcucucc

SEQ ID NO: 508528 - RNA, 32 nt, Human
ucuguauccauugccggcaccuggugagauuc

SEQ ID NO: 508529 - RNA, 32 nt, Human
ucuguaucucucuccuccuuugaaccuaucuu

SEQ ID NO: 508530 - RNA, 32 nt, Human
ucuguaugaacugcucucaaaccaacaaauag

SEQ ID NO: 508531 - RNA, 32 nt, Human
ucuguaugcagggagccagggugagggcagag

SEQ ID NO: 508532 - RNA, 32 nt, Human
ucuguaugcccagggugagaagccgaguggcu

SEQ ID NO: 508533 - RNA, 32 nt, Human
ucuguaugggguccccaagccaggcuaaaccc

SEQ ID NO: 508534 - RNA, 32 nt, Human
ucuguaugguggcugucuucuauggcagaagg

SEQ ID NO: 508535 - RNA, 29 nt, Human
ucuguaugucugugucucccuagaauuca

SEQ ID NO: 508536 - RNA, 32 nt, Human
ucuguaugucuuagggggagagcguacaaaua

SEQ ID NO: 508537 - RNA, 32 nt, Human
ucuguauguggguggaaugaaggaaauugcuc

SEQ ID NO: 508538 - RNA, 32 nt, Human
ucuguaugugugugcuguuaccucaccugcag

SEQ ID NO: 508539 - RNA, 32 nt, Human
ucuguauuccucacucccuuccccaucccaac

SEQ ID NO: 508540 - RNA, 32 nt, Human
ucuguauugcucuaauuggccugcugcccaag

SEQ ID NO: 508541 - RNA, 32 nt, Human
ucuguauugguaagcacagaagauccucagau

SEQ ID NO: 508542 - RNA, 32 nt, Human
ucuguauuugucucccaugucuugcucuucuc

SEQ ID NO: 508543 - RNA, 32 nt, Human
ucuguauuuugauucaugugguguuuucacag

SEQ ID NO: 508544 - RNA, 32 nt, Human
ucugucaaccaggcuggagugcagugacucuu

SEQ ID NO: 508545 - RNA, 32 nt, Human
ucugucaacgcagacuggagugcaguggcacg

SEQ ID NO: 508546 - RNA, 32 nt, Human
ucugucaacggcaggggcaggccuaguuugac

SEQ ID NO: 508547 - RNA, 32 nt, Human
ucugucaaggggcgcugagcaggugugucugu

SEQ ID NO: 508548 - RNA, 32 nt, Human
ucugucaccaaggcuggagugcaggggcacaa

SEQ ID NO: 508549 - RNA, 32 nt, Human
ucugucaccagacuggagugcaguggcgccau

SEQ ID NO: 508550 - RNA, 32 nt, Human
ucugucaccaggccggagugcaguggugucau

SEQ ID NO: 508551 - RNA, 23 nt, Human
ucugucaccaggcuagagugcag

SEQ ID NO: 508552 - RNA, 23 nt, Human
ucugucaccaggcuggaaugcag

SEQ ID NO: 508553 - RNA, 32 nt, Human
ucugucaccaggcuggagggcaguggcgccau

SEQ ID NO: 508554 - RNA, 32 nt, Human
ucugucaccaggcuggagggcaguggugcgau

SEQ ID NO: 508555 - RNA, 23 nt, Human
ucugucaccaggcuggaguacag

SEQ ID NO: 508556 - RNA, 23 nt, Human
ucugucaccaggcuggagugcag

SEQ ID NO: 508557 - RNA, 32 nt, Human
ucugucaccaggcuggagugcagcggcgcaau

SEQ ID NO: 508558 - RNA, 32 nt, Human
ucugucaccaggcuggagugcagugccgcaau

SEQ ID NO: 508559 - RNA, 32 nt, Human
ucugucaccaggcuggagugcaguggaggcau

SEQ ID NO: 508560 - RNA, 32 nt, Human
ucugucaccaggcuggagugcaguggcaugau

SEQ ID NO: 508561 - RNA, 32 nt, Human
ucugucaccaggcuggagugcaguggcgcaau

SEQ ID NO: 508562 - RNA, 32 nt, Human
ucugucaccaggcuggagugcaguggcgcgau

SEQ ID NO: 508563 - RNA, 32 nt, Human
ucugucaccaggcuggagugcaguggugcaau

SEQ ID NO: 508564 - RNA, 32 nt, Human
ucugucaccaggcuggagugcaguggugcgau

SEQ ID NO: 508565 - RNA, 32 nt, Human
ucugucaccaggcuggagugcaguggugugau

SEQ ID NO: 508566 - RNA, 32 nt, Human
ucugucaccaggcuggagugcgguggcauaau

SEQ ID NO: 508567 - RNA, 32 nt, Human
ucugucaccaggcuguacagugccguggccug

SEQ ID NO: 508568 - RNA, 32 nt, Human
ucugucacccaagauggagugcaauggcacga

SEQ ID NO: 508569 - RNA, 32 nt, Human
ucugucacccaagcaggauugcagugagccaa

SEQ ID NO: 508570 - RNA, 32 nt, Human
ucugucacccaaggcggagugcagugacgaca

SEQ ID NO: 508571 - RNA, 32 nt, Human
ucugucacccaggauggagugcaguguuguga

SEQ ID NO: 508572 - RNA, 24 nt, Human
ucugucacccaggcuagaaugcag

SEQ ID NO: 508573 - RNA, 24 nt, Human
ucugucacccaggcuagaguacag

SEQ ID NO: 508574 - RNA, 23 nt, Human
ucugucacccaggcuagagugca

SEQ ID NO: 508575 - RNA, 24 nt, Human
ucugucacccaggcuagagugcag

SEQ ID NO: 508576 - RNA, 32 nt, Human
ucugucacccaggcuggagugcagugacauga

SEQ ID NO: 508577 - RNA, 32 nt, Human
ucugucacccaggcuggagugcagugacucag

SEQ ID NO: 508578 - RNA, 32 nt, Human
ucugucacccagguggcuggaguacaguggcc

SEQ ID NO: 508579 - RNA, 32 nt, Human
ucugucacccagucuggagugcaguggcaaaa

SEQ ID NO: 508580 - RNA, 32 nt, Human
ucugucacccagucuggagugcagugguguga

SEQ ID NO: 508581 - RNA, 32 nt, Human
ucugucacccaguuuggagugcaguggugcag

SEQ ID NO: 508582 - RNA, 32 nt, Human
ucugucacccccaggccagagugcaguggugc

SEQ ID NO: 508583 - RNA, 24 nt, Human
ucugucaccccgccgccacugccu

SEQ ID NO: 508584 - RNA, 32 nt, Human
ucugucacccgggcuggagugcaguggcgcca

SEQ ID NO: 508585 - RNA, 32 nt, Human
ucugucacccgggcuggagugcaguggcgcga

SEQ ID NO: 508586 - RNA, 32 nt, Human
ucugucacccgggcuggagugcaguggcguga

SEQ ID NO: 508587 - RNA, 32 nt, Human
ucugucacccgggcuggagugcaguggugcga

SEQ ID NO: 508588 - RNA, 32 nt, Human
ucugucacccugcagcuccuuuacaguucaau

SEQ ID NO: 508589 - RNA, 32 nt, Human
ucugucaccgaggcuggagugcaguggcgcga

SEQ ID NO: 508590 - RNA, 32 nt, Human
ucugucaccgagguuggagugcagugguauga

SEQ ID NO: 508591 - RNA, 32 nt, Human
ucugucaccuaggcuggagugcaguggcacaa

SEQ ID NO: 508592 - RNA, 32 nt, Human
ucugucaccuaggcuggagugcaguggcacag

SEQ ID NO: 508593 - RNA, 32 nt, Human
ucugucaccuaggcuggagugcaguggcacga

SEQ ID NO: 508594 - RNA, 32 nt, Human
ucugucaccuaggcuggagugcaguggcauga

SEQ ID NO: 508595 - RNA, 32 nt, Human
ucugucaccuaggcuggagugcaguggcgcaa

SEQ ID NO: 508596 - RNA, 32 nt, Human
ucugucaccuaggcuggagugcaguggggcaa

SEQ ID NO: 508597 - RNA, 32 nt, Human
ucugucaccuaggcuggagugcaguggugcaa

SEQ ID NO: 508598 - RNA, 32 nt, Human
ucugucaccuaggcuggaguugcagugguuug

SEQ ID NO: 508599 - RNA, 32 nt, Human
ucugucaccuaggguggagugcaguggcacaa

SEQ ID NO: 508600 - RNA, 32 nt, Human
ucugucaccuuuucuccuccucccucuucuuu

SEQ ID NO: 508601 - RNA, 32 nt, Human
ucugucacgaggcuggagugcaguggccccau

SEQ ID NO: 508602 - RNA, 32 nt, Human
ucugucacucuuccuucuccagccucucuuuc

SEQ ID NO: 508603 - RNA, 32 nt, Human
ucugucacucuuguuacauuguguacauucaa

SEQ ID NO: 508604 - RNA, 32 nt, Human
ucugucacugaggcuggagugcaguggcgcaa

SEQ ID NO: 508605 - RNA, 32 nt, Human
ucugucacugcaacucugugaagcaggguauc

SEQ ID NO: 508606 - RNA, 32 nt, Human
ucugucacugucagaauguuacagaaguggaa

SEQ ID NO: 508607 - RNA, 32 nt, Human
ucugucacuguggacuccagucauucaaggag

SEQ ID NO: 508608 - RNA, 32 nt, Human
ucugucacuuaggcuggagugcaguggcgugg

SEQ ID NO: 508609 - RNA, 32 nt, Human
ucugucacuuggguuggagugcaguugcagga

SEQ ID NO: 508610 - RNA, 22 nt, Human
ucugucagacaccuguccuucc

SEQ ID NO: 508611 - RNA, 32 nt, Human
ucugucagacauuggaaggccauguuccuaaa

SEQ ID NO: 508612 - RNA, 32 nt, Human
ucugucagaccugaaacugaagcuucauuagc

SEQ ID NO: 508613 - RNA, 32 nt, Human
ucugucagacggaugacucugccccucagagc

SEQ ID NO: 508614 - RNA, 32 nt, Human
ucugucagaggccugcaggcugugaguuauau

SEQ ID NO: 508615 - RNA, 31 nt, Human
ucugucagccucucugggcacuugcagccgc

SEQ ID NO: 508616 - RNA, 32 nt, Human
ucugucagcugguccacauuugaaguucaaaa

SEQ ID NO: 508617 - RNA, 32 nt, Human
ucugucaggagcuucagccuagcugaugaaua

SEQ ID NO: 508618 - RNA, 32 nt, Human
ucugucaggcugucccuggccgggguucugua

SEQ ID NO: 508619 - RNA, 32 nt, Human
ucugucagggguccagaggagcggaguccugg

SEQ ID NO: 508620 - RNA, 32 nt, Human
ucugucagguuugaucuggcacuggacccagg

SEQ ID NO: 508621 - RNA, 32 nt, Human
ucugucagucaguucacccucugugauucucc

SEQ ID NO: 508622 - RNA, 32 nt, Human
ucugucagugccuugucacgccuggcauagag

SEQ ID NO: 508623 - RNA, 32 nt, Human
ucugucaguucugccagcucugggccaugauc

SEQ ID NO: 508624 - RNA, 32 nt, Human
ucugucaguucugcuguuuuagccuagaagga

SEQ ID NO: 508625 - RNA, 32 nt, Human
ucugucaguucugcuguuuuagccuagcagga

SEQ ID NO: 508626 - RNA, 23 nt, Human
ucugucaucaggcuggagugcag

SEQ ID NO: 508627 - RNA, 32 nt, Human
ucugucaucaggcuggagugcaguggcgcaau

SEQ ID NO: 508628 - RNA, 32 nt, Human
ucugucaucaggcuggagugcaguggcucacu

SEQ ID NO: 508629 - RNA, 32 nt, Human
ucugucauccaggcuggagugcagugaugcga

SEQ ID NO: 508630 - RNA, 32 nt, Human
ucugucauccucagaucccacaggcauugcga

SEQ ID NO: 508631 - RNA, 32 nt, Human
ucugucaucuaggcuggagugcagugguguga

SEQ ID NO: 508632 - RNA, 32 nt, Human
ucugucaucugggcugcagugcagugguguaa

SEQ ID NO: 508633 - RNA, 32 nt, Human
ucugucaucuuccuuuuucuccagugaggguu

SEQ ID NO: 508634 - RNA, 32 nt, Human
ucugucauuaucucccuuucuccacuugauua

SEQ ID NO: 508635 - RNA, 32 nt, Human
ucugucauucuuacuguuaccauuuuccuggc

SEQ ID NO: 508636 - RNA, 32 nt, Human
ucugucauugcugcuacucuaacacugagcaa

SEQ ID NO: 508637 - RNA, 32 nt, Human
ucugucauuuaucucugugacuucgggcuaga

SEQ ID NO: 508638 - RNA, 32 nt, Human
ucugucauuugcaaaagcuuucagagggcauu

SEQ ID NO: 508639 - RNA, 32 nt, Human
ucugucauuuucucucuuucuucgucuuucuc

SEQ ID NO: 508640 - RNA, 32 nt, Human
ucuguccaacaaacacacacggguagauugcu

SEQ ID NO: 508641 - RNA, 32 nt, Human
ucuguccaagcagauucguggucuuuuccucg

SEQ ID NO: 508642 - RNA, 22 nt, Human
ucuguccacugcaaccuccaca

SEQ ID NO: 508643 - RNA, 32 nt, Human
ucuguccacugcaaccuccacauccuggguuc

SEQ ID NO: 508644 - RNA, 32 nt, Human
ucuguccacugcaugcuugcauaggcagcaag

SEQ ID NO: 508645 - RNA, 32 nt, Human
ucuguccacugccucccagccucagagcagcu

SEQ ID NO: 508646 - RNA, 32 nt, Human
ucuguccagaaccugcucccaccucaggccca

SEQ ID NO: 508647 - RNA, 21 nt, Human
ucuguccagagccccuccaca

SEQ ID NO: 508648 - RNA, 32 nt, Human
ucuguccagccccucaguauuaccaugucucc

SEQ ID NO: 508649 - RNA, 32 nt, Human
ucuguccagcuuuccccagggugacauacaga

SEQ ID NO: 508650 - RNA, 32 nt, Human
ucuguccaggaggcugggcggaggugggcagg

SEQ ID NO: 508651 - RNA, 32 nt, Human
ucuguccaggcaccucuucauuguacacaagu

SEQ ID NO: 508652 - RNA, 32 nt, Human
ucuguccagguugaggaaugggcugaacgugu

SEQ ID NO: 508653 - RNA, 21 nt, Human
ucuguccagucucacccagca

SEQ ID NO: 508654 - RNA, 24 nt, Human
ucuguccauccuccucuccaugca

SEQ ID NO: 508655 - RNA, 32 nt, Human
ucuguccaucuaugguccugucccgccaucaa

SEQ ID NO: 508656 - RNA, 22 nt, Human
ucugucccacaggccugucugg

SEQ ID NO: 508657 - RNA, 32 nt, Human
ucugucccagcuuuugcuaucauugcugacuu

SEQ ID NO: 508658 - RNA, 32 nt, Human
ucugucccaggcucccccuccugcgucucaac

SEQ ID NO: 508659 - RNA, 32 nt, Human
ucuguccccaagacaaugacagcaucuagggc

SEQ ID NO: 508660 - RNA, 32 nt, Human
ucuguccccaaggcuggagugcaguggugcaa

SEQ ID NO: 508661 - RNA, 32 nt, Human
ucuguccccaaguuggacauucacaaaggccg

SEQ ID NO: 508662 - RNA, 32 nt, Human
ucuguccccacuguccucaacccuguccugaa

SEQ ID NO: 508663 - RNA, 32 nt, Human
ucuguccccaucucugaaauccuuccuucucu

SEQ ID NO: 508664 - RNA, 20 nt, Human
ucugucccccaggugugagg

SEQ ID NO: 508665 - RNA, 32 nt, Human
ucugucccccugcucccacuccagaagaacug

SEQ ID NO: 508666 - RNA, 32 nt, Human
ucuguccccucaggucauggucccaagugaaa

SEQ ID NO: 508667 - RNA, 32 nt, Human
ucuguccccucccuccgguauaccuuuauccc

SEQ ID NO: 508668 - RNA, 32 nt, Human
ucuguccccugggcuggagugcaauggugcga

SEQ ID NO: 508669 - RNA, 32 nt, Human
ucuguccccuucacuuucaggccuuggggagu

SEQ ID NO: 508670 - RNA, 32 nt, Human
ucugucccgcugcguguuuuccucuugaucgg

SEQ ID NO: 508671 - RNA, 32 nt, Human
ucugucccuagagguuuauuacuagaggcugg

SEQ ID NO: 508672 - RNA, 32 nt, Human
ucugucccuauuauuugcccuaggcuuucucc

SEQ ID NO: 508673 - RNA, 32 nt, Human
ucugucccucacagcacuaguauuucauguug

SEQ ID NO: 508674 - RNA, 32 nt, Human
ucugucccuccuguucuuguccggcgcugcuu

SEQ ID NO: 508675 - RNA, 32 nt, Human
ucugucccugcagguuguccuauucuggauac

SEQ ID NO: 508676 - RNA, 32 nt, Human
ucugucccugggaggugggugcuggagcaggg

SEQ ID NO: 508677 - RNA, 32 nt, Human
ucugucccuucccaagcaagacauuugugagg

SEQ ID NO: 508678 - RNA, 32 nt, Human
ucugucccuucccaaucaguguccuuuucugu

SEQ ID NO: 508679 - RNA, 32 nt, Human
ucugucccuuggcaaauggacaccaggggcuu

SEQ ID NO: 508680 - RNA, 32 nt, Human
ucugucccuuucuccccacuucuucuggcucc

SEQ ID NO: 508681 - RNA, 32 nt, Human
ucuguccgaucugugcauguuauuuuucuuuu

SEQ ID NO: 508682 - RNA, 32 nt, Human
ucuguccgcccaggcugggugcagucacggcu

SEQ ID NO: 508683 - RNA, 32 nt, Human
ucuguccgccuccagccgcucuccucugacgg

SEQ ID NO: 508684 - RNA, 32 nt, Human
ucuguccgcugcccacagccuagcagucggga

SEQ ID NO: 508685 - RNA, 32 nt, Human
ucuguccguggucagaaguggggucagugugu

SEQ ID NO: 508686 - RNA, 32 nt, Human
ucuguccguuucucuaguaagggagacuuguu

SEQ ID NO: 508687 - RNA, 32 nt, Human
ucuguccuaccaguuuucuuuuacagauucuc

SEQ ID NO: 508688 - RNA, 32 nt, Human
ucuguccuauggagccucugcagacucguucu

SEQ ID NO: 508689 - RNA, 32 nt, Human
ucuguccucaaguacucaaauauuucugauac

SEQ ID NO: 508690 - RNA, 32 nt, Human
ucuguccucacugccaucgccacuaccauccu

SEQ ID NO: 508691 - RNA, 21 nt, Human
ucuguccucagccuugccaga

SEQ ID NO: 508692 - RNA, 32 nt, Human
ucuguccucauuuuguuuccuaugaucauccu

SEQ ID NO: 508693 - RNA, 32 nt, Human
ucuguccuccuuggcuuggcuuugcugcugcu

SEQ ID NO: 508694 - RNA, 32 nt, Human
ucuguccuccuugugaucaguuauuugcacag

SEQ ID NO: 508695 - RNA, 22 nt, Human
ucuguccucguucucuccugca

SEQ ID NO: 508696 - RNA, 32 nt, Human
ucuguccucuacuccacucaugcccaucucug

SEQ ID NO: 508697 - RNA, 32 nt, Human
ucuguccucugaaccacuuuugcucagagugc

SEQ ID NO: 508698 - RNA, 21 nt, Human
ucuguccucuuccuugccaga

SEQ ID NO: 508699 - RNA, 32 nt, Human
ucuguccucuucuccccucucucagauuggcc

SEQ ID NO: 508700 - RNA, 32 nt, Human
ucuguccugaggcuucugcucucauucauuua

SEQ ID NO: 508701 - RNA, 32 nt, Human
ucuguccugggaggcugagauuuaugggucuu

SEQ ID NO: 508702 - RNA, 32 nt, Human
ucuguccugguggcagcgauucagugguaaca

SEQ ID NO: 508703 - RNA, 32 nt, Human
ucuguccuuagaguacugaaggcaguucaaua

SEQ ID NO: 508704 - RNA, 32 nt, Human
ucuguccuuagguuguagcagaaaggaaaaga

SEQ ID NO: 508705 - RNA, 22 nt, Human
ucuguccuuccuccuccuuccc

SEQ ID NO: 508706 - RNA, 32 nt, Human
ucuguccuucuuccugucacuuguagagugga

SEQ ID NO: 508707 - RNA, 32 nt, Human
ucuguccuugguucuguccuccuuagcauuau

SEQ ID NO: 508708 - RNA, 32 nt, Human
ucuguccuuguccuggaccucagguucccagc

SEQ ID NO: 508709 - RNA, 23 nt, Human
ucugucgccaagccagagugcag

SEQ ID NO: 508710 - RNA, 32 nt, Human
ucugucgccaaggcuggagugcagugguguga

SEQ ID NO: 508711 - RNA, 32 nt, Human
ucugucgccaaguuggagcuugcagugagccg

SEQ ID NO: 508712 - RNA, 32 nt, Human
ucugucgccaaguuggagugcaauggugcgau

SEQ ID NO: 508713 - RNA, 23 nt, Human
ucugucgccagacuggagugcag

SEQ ID NO: 508714 - RNA, 32 nt, Human
ucugucgccagacuggagugcaguggcgcaau

SEQ ID NO: 508715 - RNA, 32 nt, Human
ucugucgccaggacuggagugcagugacacga

SEQ ID NO: 508716 - RNA, 23 nt, Human
ucugucgccaggcuagagugcgg

SEQ ID NO: 508717 - RNA, 23 nt, Human
ucugucgccaggcugaagugcag

SEQ ID NO: 508718 - RNA, 32 nt, Human
ucugucgccaggcugaagugcaguggcgcaau

SEQ ID NO: 508719 - RNA, 23 nt, Human
ucugucgccaggcuggaaugcag

SEQ ID NO: 508720 - RNA, 32 nt, Human
ucugucgccaggcuggaaugcaguagggcaau

SEQ ID NO: 508721 - RNA, 32 nt, Human
ucugucgccaggcuggaaugcagugcagugag

SEQ ID NO: 508722 - RNA, 32 nt, Human
ucugucgccaggcuggaguacaguggugugca

SEQ ID NO: 508723 - RNA, 22 nt, Human
ucugucgccaggcuggagugca

SEQ ID NO: 508724 - RNA, 32 nt, Human
ucugucgccaggcuggagugcaauggcgcgau

SEQ ID NO: 508725 - RNA, 32 nt, Human
ucugucgccaggcuggagugcaauggcgugau

SEQ ID NO: 508726 - RNA, 23 nt, Human
ucugucgccaggcuggagugcag

SEQ ID NO: 508727 - RNA, 32 nt, Human
ucugucgccaggcuggagugcaguggcgcagu

SEQ ID NO: 508728 - RNA, 32 nt, Human
ucugucgccaggcuggagugcaguggcgcgau

SEQ ID NO: 508729 - RNA, 32 nt, Human
ucugucgccaggcuggagugcaguggcgugau

SEQ ID NO: 508730 - RNA, 32 nt, Human
ucugucgccaggcuggagugcaguggugcgac

SEQ ID NO: 508731 - RNA, 32 nt, Human
ucugucgccaggcuggagugcaguggugcgau

SEQ ID NO: 508732 - RNA, 32 nt, Human
ucugucgccaggcuggagugcaguggugugau

SEQ ID NO: 508733 - RNA, 32 nt, Human
ucugucgccagguuggagugcaguggcgugau

SEQ ID NO: 508734 - RNA, 23 nt, Human
ucugucgcccaagcuggagcgca

SEQ ID NO: 508735 - RNA, 24 nt, Human
ucugucgcccaagcuggaguacag

SEQ ID NO: 508736 - RNA, 24 nt, Human
ucugucgcccaagcuggagugcag

SEQ ID NO: 508737 - RNA, 24 nt, Human
ucugucgcccagacuagaaugcag

SEQ ID NO: 508738 - RNA, 23 nt, Human
ucugucgcccagacuagagugca

SEQ ID NO: 508739 - RNA, 32 nt, Human
ucugucgcccaggauggagugcaguggcgcga

SEQ ID NO: 508740 - RNA, 24 nt, Human
ucugucgcccaggcuagagugcag

SEQ ID NO: 508741 - RNA, 32 nt, Human
ucugucgcccaggcuggagugcagugacauga

SEQ ID NO: 508742 - RNA, 32 nt, Human
ucugucgcccaggcuggagugcagugaugcaa

SEQ ID NO: 508743 - RNA, 32 nt, Human
ucugucgcccagggcuggagugcaguggcgcg

SEQ ID NO: 508744 - RNA, 32 nt, Human
ucugucgcccaggguggagugcaguggcguga

SEQ ID NO: 508745 - RNA, 32 nt, Human
ucugucgcccgggcuggaaugcagugacauca

SEQ ID NO: 508746 - RNA, 32 nt, Human
ucugucgccuaggcuggagugcaguggugcag

SEQ ID NO: 508747 - RNA, 32 nt, Human
ucugucgccuggcuggagugcaguggugugau

SEQ ID NO: 508748 - RNA, 32 nt, Human
ucugucgccugggcuggaguacaguggugcga

SEQ ID NO: 508749 - RNA, 22 nt, Human
ucugucgcgaggaggggcgcag

SEQ ID NO: 508750 - RNA, 32 nt, Human
ucugucgcucaggcuggagugcagugaugcaa

SEQ ID NO: 508751 - RNA, 32 nt, Human
ucugucgcucuuuucagccccuccugguauuc

SEQ ID NO: 508752 - RNA, 32 nt, Human
ucugucgcugcugccgccuccacccagccucc

SEQ ID NO: 508753 - RNA, 32 nt, Human
ucugucgcuuagcuggagugcgguggcgugau

SEQ ID NO: 508754 - RNA, 32 nt, Human
ucugucggaccagccaggggugaugcggaccc

SEQ ID NO: 508755 - RNA, 32 nt, Human
ucugucggccaggcuggagugcaguggcauga

SEQ ID NO: 508756 - RNA, 32 nt, Human
ucugucggccagguuggagugcaguggugcaa

SEQ ID NO: 508757 - RNA, 32 nt, Human
ucugucggcggcguggggcagcuguagcagcg

SEQ ID NO: 508758 - RNA, 32 nt, Human
ucugucgggaggcgcagcgguuagguggaccg

SEQ ID NO: 508759 - RNA, 32 nt, Human
ucugucgguuuccccucuuuacccuuccccgu

SEQ ID NO: 508760 - RNA, 32 nt, Human
ucugucguccaggcuggagugcagugacucau

SEQ ID NO: 508761 - RNA, 32 nt, Human
ucugucgucgaggcuggaguguaguggugcga

SEQ ID NO: 508762 - RNA, 32 nt, Human
ucugucuaaaagucuggagaaaucccaaagac

SEQ ID NO: 508763 - RNA, 32 nt, Human
ucugucuaacagaacaaaaagaugcucugugu

SEQ ID NO: 508764 - RNA, 32 nt, Human
ucugucuacccacacucugcgaacuuugccuu

SEQ ID NO: 508765 - RNA, 32 nt, Human
ucugucuacccuaguguccaucaugcccugga

SEQ ID NO: 508766 - RNA, 21 nt, Human
ucugucuagccagguccaggu

SEQ ID NO: 508767 - RNA, 32 nt, Human
ucugucuagcuuaaaccuacuaccucaagcug

SEQ ID NO: 508768 - RNA, 32 nt, Human
ucugucuaggcccauuuggggcucccugugag

SEQ ID NO: 508769 - RNA, 32 nt, Human
ucugucuagguuaaagcuaaacugaaucuaug

SEQ ID NO: 508770 - RNA, 32 nt, Human
ucugucuaguuguccuuaagucugacugacuu

SEQ ID NO: 508771 - RNA, 32 nt, Human
ucugucucaaaaacaaaacaaaacagaacaga

SEQ ID NO: 508772 - RNA, 32 nt, Human
ucugucucaaauaauuauuucacagaggauag

SEQ ID NO: 508773 - RNA, 32 nt, Human
ucugucucaucaguucuucacagugagaaaag

SEQ ID NO: 508774 - RNA, 32 nt, Human
ucugucucauugcauaugucauggcucugcaa

SEQ ID NO: 508775 - RNA, 32 nt, Human
ucugucuccaaaacaaaacaaacaaacaaaaa

SEQ ID NO: 508776 - RNA, 21 nt, Human
ucugucuccaaccuggggucc

SEQ ID NO: 508777 - RNA, 23 nt, Human
ucugucuccaaccuggggucccu

SEQ ID NO: 508778 - RNA, 32 nt, Human
ucugucuccacucaagaggcugaugggcaggu

SEQ ID NO: 508779 - RNA, 32 nt, Human
ucugucuccagccacccucugcuugggcuucu

SEQ ID NO: 508780 - RNA, 23 nt, Human
ucugucuccagcccugucuuucu

SEQ ID NO: 508781 - RNA, 32 nt, Human
ucugucuccaggcuggagaggcaggagcccug

SEQ ID NO: 508782 - RNA, 32 nt, Human
ucugucuccaggcuggaguacaguggugcgau

SEQ ID NO: 508783 - RNA, 32 nt, Human
ucugucuccaggcuggagugcaguggcgucau

SEQ ID NO: 508784 - RNA, 32 nt, Human
ucugucuccauagcucugguuucccugggccu

SEQ ID NO: 508785 - RNA, 18 nt, Human
ucugucuccauccuuccc

SEQ ID NO: 508786 - RNA, 32 nt, Human
ucugucucccaaagagcugggauuacaggcgu

SEQ ID NO: 508787 - RNA, 32 nt, Human
ucugucucccacccucacugaucacgccugcc

SEQ ID NO: 508788 - RNA, 32 nt, Human
ucugucucccaggcugaagugcagugagucaa

SEQ ID NO: 508789 - RNA, 32 nt, Human
ucugucucccaggcugcuggagugcaguggca

SEQ ID NO: 508790 - RNA, 32 nt, Human
ucugucucccaggcuggagugcagugacacaa

SEQ ID NO: 508791 - RNA, 32 nt, Human
ucugucucccaggcuggaguugcaguggugca

SEQ ID NO: 508792 - RNA, 32 nt, Human
ucugucuccccauguccucuggaacagcuggg

SEQ ID NO: 508793 - RNA, 32 nt, Human
ucugucucccgggcuggagugcaguggcgcga

SEQ ID NO: 508794 - RNA, 21 nt, Human
ucugucuccucccguccuucc

SEQ ID NO: 508795 - RNA, 32 nt, Human
ucugucuccucuucuuccuccucuguguccuu

SEQ ID NO: 508796 - RNA, 32 nt, Human
ucugucuccugcuccuucaggcugcuggcaga

SEQ ID NO: 508797 - RNA, 32 nt, Human
ucugucuccuggaaugcucccaccucaagugg

SEQ ID NO: 508798 - RNA, 32 nt, Human
ucugucucuccaccaugugcuccaccucgugc

SEQ ID NO: 508799 - RNA, 32 nt, Human
ucugucucucccuuccccuccugggaccauuc

SEQ ID NO: 508800 - RNA, 32 nt, Human
ucugucucucuaggaauagggucuguuucaca

SEQ ID NO: 508801 - RNA, 32 nt, Human
ucugucucucuccucuccucaggcucaauaau

SEQ ID NO: 508802 - RNA, 32 nt, Human
ucugucucuggacccaggcugccugcugaagu

SEQ ID NO: 508803 - RNA, 32 nt, Human
ucugucucuugcauaagccucaggccuggccc

SEQ ID NO: 508804 - RNA, 32 nt, Human
ucugucucuuggaaagauacagcuccaggguu

SEQ ID NO: 508805 - RNA, 27 nt, Human
ucugucucuuuauuucaccuugccaag

SEQ ID NO: 508806 - RNA, 32 nt, Human
ucugucucuuucuuuagagccuaaaacuguag

SEQ ID NO: 508807 - RNA, 32 nt, Human
ucugucugaugcccucuccauagcccagcugg

SEQ ID NO: 508808 - RNA, 32 nt, Human
ucugucugcacugggagccucaggagggcucu

SEQ ID NO: 508809 - RNA, 32 nt, Human
ucugucugccuggcugagaugcaugugggcag

SEQ ID NO: 508810 - RNA, 32 nt, Human
ucugucugcuccugccuccuccaggcaaugag

SEQ ID NO: 508811 - RNA, 32 nt, Human
ucugucugcuucagaccaccucaggcucugcg

SEQ ID NO: 508812 - RNA, 32 nt, Human
ucugucuggaagauggggaccagcagccccac

SEQ ID NO: 508813 - RNA, 32 nt, Human
ucugucuggagugacagaccacaucuuuaucu

SEQ ID NO: 508814 - RNA, 32 nt, Human
ucugucuggccaccccucuguccuggccccgg

SEQ ID NO: 508815 - RNA, 32 nt, Human
ucugucugggcugugaugacgaauauuaugaa

SEQ ID NO: 508816 - RNA, 32 nt, Human
ucugucuggguauuugaauggugugagacaaa

SEQ ID NO: 508817 - RNA, 32 nt, Human
ucugucugggugcaacuucuucagcugucugg

SEQ ID NO: 508818 - RNA, 32 nt, Human
ucugucugguauaggcuaauuuugaagaacuc

SEQ ID NO: 508819 - RNA, 32 nt, Human
ucugucuguagucccaccuauucgggaggcug

SEQ ID NO: 508820 - RNA, 19 nt, Human
ucugucuguccuccuuucc

SEQ ID NO: 508821 - RNA, 32 nt, Human
ucugucuguccuccuuuccucucccuccccga

SEQ ID NO: 508822 - RNA, 32 nt, Human
ucugucugucucucagccuuuaucucuggguu

SEQ ID NO: 508823 - RNA, 32 nt, Human
ucugucugucucucccccucugucuucucuau

SEQ ID NO: 508824 - RNA, 32 nt, Human
ucugucugucugucugucugucuaucuaucua

SEQ ID NO: 508825 - RNA, 32 nt, Human
ucugucugucugucugucugucugucuaucua

SEQ ID NO: 508826 - RNA, 32 nt, Human
ucugucugucugucugucugucugucugucua

SEQ ID NO: 508827 - RNA, 32 nt, Human
ucugucugucugucugucugucugucugucug

SEQ ID NO: 508828 - RNA, 32 nt, Human
ucugucugucugucuguggugguuucuguuuc

SEQ ID NO: 508829 - RNA, 32 nt, Human
ucugucugucugugggcuucagcacuuuaaag

SEQ ID NO: 508830 - RNA, 32 nt, Human
ucugucuguggguggucacaggagggugugag

SEQ ID NO: 508831 - RNA, 32 nt, Human
ucugucugugugucugugacagucagggaagg

SEQ ID NO: 508832 - RNA, 32 nt, Human
ucugucuuaugcugguuauuucacugcuucac

SEQ ID NO: 508833 - RNA, 32 nt, Human
ucugucuucagcagccaacuccuggagcugcc

SEQ ID NO: 508834 - RNA, 32 nt, Human
ucugucuucaucucugaaauucacaggucugg

SEQ ID NO: 508835 - RNA, 32 nt, Human
ucugucuucccaaacccagucuccucuccauu

SEQ ID NO: 508836 - RNA, 32 nt, Human
ucugucuucccuccucuacucuuggugcuuuc

SEQ ID NO: 508837 - RNA, 32 nt, Human
ucugucuucuacgaaaagcucuccccaccuuc

SEQ ID NO: 508838 - RNA, 32 nt, Human
ucugucuugaaaggagguugggccggcgaagu

SEQ ID NO: 508839 - RNA, 32 nt, Human
ucugucuugcucuccccuccccuggcuuuccu

SEQ ID NO: 508840 - RNA, 20 nt, Human
ucugucuugggaguggugua

SEQ ID NO: 508841 - RNA, 32 nt, Human
ucugucuuucucaguugacuucccaaguaagc

SEQ ID NO: 508842 - RNA, 32 nt, Human
ucugucuuuggcugugaacaaauaacaaauaa

SEQ ID NO: 508843 - RNA, 32 nt, Human
ucugucuuugguggaugggaugguggcaaagc

SEQ ID NO: 508844 - RNA, 32 nt, Human
ucugucuuuucaccccuccuuggcugaugacc

SEQ ID NO: 508845 - RNA, 31 nt, Human
ucugucuuuucuccuccgccuguguccaucu

SEQ ID NO: 508846 - RNA, 21 nt, Human
ucugugaaaugaaaggaucag

SEQ ID NO: 508847 - RNA, 32 nt, Human
ucugugaaaugagaucuccugauauuugauug

SEQ ID NO: 508848 - RNA, 32 nt, Human
ucugugaaaugcuggcauuugcaccuaccuca

SEQ ID NO: 508849 - RNA, 32 nt, Human
ucugugaacugaaugcagccuggacacuggcc

SEQ ID NO: 508850 - RNA, 31 nt, Human
ucugugaagagacccaguuucgugggaccac

SEQ ID NO: 508851 - RNA, 32 nt, Human
ucugugaagcaacuuagcugauguggaggaau

SEQ ID NO: 508852 - RNA, 32 nt, Human
ucugugaauccaccccuggcuacccccacccu

SEQ ID NO: 508853 - RNA, 32 nt, Human
ucugugaauuucacuggcaguuuugaacuucc

SEQ ID NO: 508854 - RNA, 32 nt, Human
ucugugacacccaagggaggggccgugcugac

SEQ ID NO: 508855 - RNA, 32 nt, Human
ucugugacaggaaacaucucuguccaugccag

SEQ ID NO: 508856 - RNA, 32 nt, Human
ucugugacaguggauauagcugcuggaccauu

SEQ ID NO: 508857 - RNA, 32 nt, Human
ucugugacccacucaccauguaaagaauuaac

SEQ ID NO: 508858 - RNA, 32 nt, Human
ucugugaccggcagccccagaccugccugccu

SEQ ID NO: 508859 - RNA, 22 nt, Human
ucugugacuacuaaggaaaccu

SEQ ID NO: 508860 - RNA, 24 nt, Human
ucugugacuacuuccaccacaccu

SEQ ID NO: 508861 - RNA, 19 nt, Human
ucugugacuacuuuaucca

SEQ ID NO: 508862 - RNA, 32 nt, Human
ucugugacucaggagcagggaucucaggcagc

SEQ ID NO: 508863 - RNA, 32 nt, Human
ucugugacucaucagaguguggggguugugaa

SEQ ID NO: 508864 - RNA, 32 nt, Human
ucugugacucccaguguucaccaccuuccuga

SEQ ID NO: 508865 - RNA, 32 nt, Human
ucugugacucccuagauucuguccugacccca

SEQ ID NO: 508866 - RNA, 32 nt, Human
ucugugacucuugccaaauaauuuugacuuca

SEQ ID NO: 508867 - RNA, 32 nt, Human
ucugugacucuugggccucugcucugguggga

SEQ ID NO: 508868 - RNA, 22 nt, Human
ucugugacugaaggcccggugg

SEQ ID NO: 508869 - RNA, 32 nt, Human
ucugugacugcauuguaagugcagugggggua

SEQ ID NO: 508870 - RNA, 32 nt, Human
ucugugacuucugcucccucccuagcuuuucc

SEQ ID NO: 508871 - RNA, 32 nt, Human
ucugugacuugaaugagcagcacuuugcaacu

SEQ ID NO: 508872 - RNA, 32 nt, Human
ucugugagaacauucugguucauuuuaaacuc

SEQ ID NO: 508873 - RNA, 32 nt, Human
ucugugagacauggcucgcuguggggaaggca

SEQ ID NO: 508874 - RNA, 32 nt, Human
ucugugagcuuagaccugcuuccacuuucaau

SEQ ID NO: 508875 - RNA, 32 nt, Human
ucugugagcuugaauguucaaaccugagacuu

SEQ ID NO: 508876 - RNA, 32 nt, Human
ucugugaggaaggagcccuucuuaacuccauu

SEQ ID NO: 508877 - RNA, 32 nt, Human
ucugugaggaaggggcccugccacucucccca

SEQ ID NO: 508878 - RNA, 32 nt, Human
ucugugaggaggcaagguucucaggggacagg

SEQ ID NO: 508879 - RNA, 32 nt, Human
ucugugaggauucagggagcaggaggagagag

SEQ ID NO: 508880 - RNA, 32 nt, Human
ucugugagggaacuguucagucucacagcaag

SEQ ID NO: 508881 - RNA, 19 nt, Human
ucugugagggaggcugcuu

SEQ ID NO: 508882 - RNA, 32 nt, Human
ucugugaggggucccaccagcccagggcugau

SEQ ID NO: 508883 - RNA, 32 nt, Human
ucugugaggucuucuugucaugugaguguggu

SEQ ID NO: 508884 - RNA, 20 nt, Human
ucugugagugcuggggccag

SEQ ID NO: 508885 - RNA, 32 nt, Human
ucugugagugggggacagggaguggggcaggc

SEQ ID NO: 508886 - RNA, 21 nt, Human
ucugugauaauuuucuguguu

SEQ ID NO: 508887 - RNA, 32 nt, Human
ucugugauacuggccuugcugaaacgcaucuc

SEQ ID NO: 508888 - RNA, 32 nt, Human
ucugugaucccaagccgccuccuccaccgacu

SEQ ID NO: 508889 - RNA, 23 nt, Human
ucugugaugacagaaauguucua

SEQ ID NO: 508890 - RNA, 18 nt, Human
ucugugaugggggcgcgg

SEQ ID NO: 508891 - RNA, 32 nt, Human
ucugugauugcucucccuuugugucuacugcc

SEQ ID NO: 508892 - RNA, 32 nt, Human
ucugugcagacaccuccucacccaccacccca

SEQ ID NO: 508893 - RNA, 32 nt, Human
ucugugcagagaggcuuugagggaugguggag

SEQ ID NO: 508894 - RNA, 32 nt, Human
ucugugcagagauaaagucccccaaauauagu

SEQ ID NO: 508895 - RNA, 32 nt, Human
ucugugcagagcuguugugcggaccgggagac

SEQ ID NO: 508896 - RNA, 32 nt, Human
ucugugcagcuuucgagcgguagacucacccu

SEQ ID NO: 508897 - RNA, 32 nt, Human
ucugugcaggaccuuggccacucugagggaca

SEQ ID NO: 508898 - RNA, 32 nt, Human
ucugugcaggagcagagccaggugggcccugg

SEQ ID NO: 508899 - RNA, 32 nt, Human
ucugugcaggccagcagggccccaucucuagu

SEQ ID NO: 508900 - RNA, 32 nt, Human
ucugugcagugucucauuucaccucagagaaa

SEQ ID NO: 508901 - RNA, 32 nt, Human
ucugugcauauguuaccauacauguccaaaga

SEQ ID NO: 508902 - RNA, 32 nt, Human
ucugugcaucuucuuguccauucaucugccca

SEQ ID NO: 508903 - RNA, 32 nt, Human
ucugugcaugccacuccugggucagacgguga

SEQ ID NO: 508904 - RNA, 32 nt, Human
ucugugcauuauucacucagacauauuuuuag

SEQ ID NO: 508905 - RNA, 32 nt, Human
ucugugccaagcauugucucuaccucaguuug

SEQ ID NO: 508906 - RNA, 32 nt, Human
ucugugccacauccucuucauuuuagaaucca

SEQ ID NO: 508907 - RNA, 32 nt, Human
ucugugccaccucucacacuggcuccagacac

SEQ ID NO: 508908 - RNA, 32 nt, Human
ucugugccauuucucagggaaguaagauguaa

SEQ ID NO: 508909 - RNA, 32 nt, Human
ucugugcccaugcagagugagcagggagaggc

SEQ ID NO: 508910 - RNA, 32 nt, Human
ucugugccccaugccuguccagccugggcagc

SEQ ID NO: 508911 - RNA, 31 nt, Human
ucugugccccugccucucccugugucccuuc

SEQ ID NO: 508912 - RNA, 32 nt, Human
ucugugcccgggcuauuuugaacccaggaauc

SEQ ID NO: 508913 - RNA, 32 nt, Human
ucugugcccugagcauggcucugcccccaggu

SEQ ID NO: 508914 - RNA, 32 nt, Human
ucugugccucaguuuacucuguaguuuaccau

SEQ ID NO: 508915 - RNA, 32 nt, Human
ucugugccucguugucugccuccuggggcugu

SEQ ID NO: 508916 - RNA, 32 nt, Human
ucugugccucuuuuaugugggaaagggcaggc

SEQ ID NO: 508917 - RNA, 32 nt, Human
ucugugccugggaucaguggggccccaaagcc

SEQ ID NO: 508918 - RNA, 32 nt, Human
ucugugccuucggaggucuuucugccugccug

SEQ ID NO: 508919 - RNA, 32 nt, Human
ucugugccuugagcuuugugcacuuugcaacu

SEQ ID NO: 508920 - RNA, 32 nt, Human
ucugugccuuggaacccaguggcuguacuuca

SEQ ID NO: 508921 - RNA, 23 nt, Human
ucugugccuuugccuguccuuuc

SEQ ID NO: 508922 - RNA, 32 nt, Human
ucugugcgcaccucucugggcuugcugggaga

SEQ ID NO: 508923 - RNA, 32 nt, Human
ucugugcuaugcacauuuucuacuuucucuaa

SEQ ID NO: 508924 - RNA, 32 nt, Human
ucugugcucagcugcaaccacagccucgucgu

SEQ ID NO: 508925 - RNA, 32 nt, Human
ucugugcucagugggagccaggaagccucagg

SEQ ID NO: 508926 - RNA, 32 nt, Human
ucugugcucccacaugcuuccggaacagugac

SEQ ID NO: 508927 - RNA, 32 nt, Human
ucugugcucccuucccucuccuggggcggggg

SEQ ID NO: 508928 - RNA, 32 nt, Human
ucugugcuccuccaaaacauccuuuagaugca

SEQ ID NO: 508929 - RNA, 32 nt, Human
ucugugcucgugcgcuuuuuccuugccaaccu

SEQ ID NO: 508930 - RNA, 32 nt, Human
ucugugcucugacucugcaggguaggaccacg

SEQ ID NO: 508931 - RNA, 32 nt, Human
ucugugcugacauggcucuggacucuaaagac

SEQ ID NO: 508932 - RNA, 20 nt, Human
ucugugcugaccaggccugg

SEQ ID NO: 508933 - RNA, 32 nt, Human
ucugugcugagaugcaaugauguguaaacuga

SEQ ID NO: 508934 - RNA, 32 nt, Human
ucugugcugaggaggauuaguaaaagaggaag

SEQ ID NO: 508935 - RNA, 32 nt, Human
ucugugcugaggaggauuagugaaagaggaag

SEQ ID NO: 508936 - RNA, 22 nt, Human
ucugugcugccagguccuggug

SEQ ID NO: 508937 - RNA, 32 nt, Human
ucugugcugccuucugccugggucugguaucc

SEQ ID NO: 508938 - RNA, 32 nt, Human
ucugugcugcugcuucuccuccaucuugcuag

SEQ ID NO: 508939 - RNA, 32 nt, Human
ucugugcuggcauccugagcacugccaggcac

SEQ ID NO: 508940 - RNA, 32 nt, Human
ucugugcugggaaccugcucugugccaggcac

SEQ ID NO: 508941 - RNA, 32 nt, Human
ucugugcugguugccacccaagagagaacagu

SEQ ID NO: 508942 - RNA, 21 nt, Human
ucugugcugugggccccgggg

SEQ ID NO: 508943 - RNA, 32 nt, Human
ucugugcuucaaggagcuucagagagauugcc

SEQ ID NO: 508944 - RNA, 32 nt, Human
ucugugcuucagggaucuaugagggucaacac

SEQ ID NO: 508945 - RNA, 32 nt, Human
ucugugcuugcaggaaaguccauuuguuuuuc

SEQ ID NO: 508946 - RNA, 32 nt, Human
ucugugcuuggcuaugacucuaccuccagguu

SEQ ID NO: 508947 - RNA, 32 nt, Human
ucugugcuuguacggccuacugggcuuccucc

SEQ ID NO: 508948 - RNA, 32 nt, Human
ucuguggaacuuggaacgugccaggaccaccu

SEQ ID NO: 508949 - RNA, 32 nt, Human
ucuguggaagugagguuuuggagcagccucca

SEQ ID NO: 508950 - RNA, 32 nt, Human
ucuguggagagggacagagagcaugagcaggc

SEQ ID NO: 508951 - RNA, 32 nt, Human
ucuguggagauggacucaggauccagugacau

SEQ ID NO: 508952 - RNA, 32 nt, Human
ucuguggagcacaggcauaucagcaacugcca

SEQ ID NO: 508953 - RNA, 32 nt, Human
ucuguggagcgcccgccgucugcuccggggug

SEQ ID NO: 508954 - RNA, 32 nt, Human
ucuguggaggccaaaccaacucuuugccagca

SEQ ID NO: 508955 - RNA, 32 nt, Human
ucuguggaguuuucccuuugcugagcaagcau

SEQ ID NO: 508956 - RNA, 32 nt, Human
ucuguggcaaaaagagucagacauuucuuugg

SEQ ID NO: 508957 - RNA, 32 nt, Human
ucuguggcaaagcucuuagaauucuuugcagu

SEQ ID NO: 508958 - RNA, 32 nt, Human
ucuguggcaacuguaaucacagagccagaagc

SEQ ID NO: 508959 - RNA, 32 nt, Human
ucuguggcaauaaaugagaucucagugguggu

SEQ ID NO: 508960 - RNA, 32 nt, Human
ucuguggcacagcugcuugccauugccugccu

SEQ ID NO: 508961 - RNA, 32 nt, Human
ucuguggcagacaagacaucugaaaagcucuc

SEQ ID NO: 508962 - RNA, 32 nt, Human
ucuguggcagagggugaaugccugcagaugag

SEQ ID NO: 508963 - RNA, 32 nt, Human
ucuguggcaggagucccugaggacgggagcug

SEQ ID NO: 508964 - RNA, 32 nt, Human
ucuguggcauguuggacuugaucuggcaaaaa

SEQ ID NO: 508965 - RNA, 32 nt, Human
ucuguggcauugaaaugagcaccuccauuaaa

SEQ ID NO: 508966 - RNA, 32 nt, Human
ucuguggcauugucccucccacucuuauuuuu

SEQ ID NO: 508967 - RNA, 32 nt, Human
ucuguggcauuuuaaaugggagaaucuugguu

SEQ ID NO: 508968 - RNA, 32 nt, Human
ucuguggccagccuggcaucaguuuaggccuu

SEQ ID NO: 508969 - RNA, 32 nt, Human
ucuguggccagcugcaucugucugaauggugc

SEQ ID NO: 508970 - RNA, 24 nt, Human
ucuguggcccaggcugaagugcag

SEQ ID NO: 508971 - RNA, 24 nt, Human
ucuguggcccaggcuggagugcag

SEQ ID NO: 508972 - RNA, 32 nt, Human
ucuguggcccaggcuggagugcaguggcacaa

SEQ ID NO: 508973 - RNA, 32 nt, Human
ucuguggcccaggcuggagugcaguggcacga

SEQ ID NO: 508974 - RNA, 32 nt, Human
ucuguggcccaggcuggagugcaguggcauga

SEQ ID NO: 508975 - RNA, 32 nt, Human
ucuguggcccaggcuggagugcaguggcgcaa

SEQ ID NO: 508976 - RNA, 32 nt, Human
ucuguggcccaggcuggagugcaguggcgcgg

SEQ ID NO: 508977 - RNA, 32 nt, Human
ucuguggcccaggcuggagugcaguggcuguu

SEQ ID NO: 508978 - RNA, 32 nt, Human
ucuguggcccaggcuggagugcaguggugcga

SEQ ID NO: 508979 - RNA, 32 nt, Human
ucuguggcccaggcuggaguguaguggcgugg

SEQ ID NO: 508980 - RNA, 32 nt, Human
ucuguggcccucucuuaaugccacggcagcca

SEQ ID NO: 508981 - RNA, 32 nt, Human
ucuguggcccuggcuggaguucagugguguga

SEQ ID NO: 508982 - RNA, 32 nt, Human
ucuguggccucgggggcucaaggcacagagcu

SEQ ID NO: 508983 - RNA, 32 nt, Human
ucuguggcuaucugacaaccagucccagcccc

SEQ ID NO: 508984 - RNA, 32 nt, Human
ucuguggcucuagaaagaguucugagagguga

SEQ ID NO: 508985 - RNA, 32 nt, Human
ucuguggcucugcaccuaagcuggggaccaac

SEQ ID NO: 508986 - RNA, 32 nt, Human
ucuguggcugggaacaccuuccaccaugacca

SEQ ID NO: 508987 - RNA, 32 nt, Human
ucuguggcugguagacaccaagcugcugugac

SEQ ID NO: 508988 - RNA, 32 nt, Human
ucuguggcugugcaguacuuugaaguuuuaau

SEQ ID NO: 508989 - RNA, 32 nt, Human
ucuguggcuuaggaagugugaagauaugaucc

SEQ ID NO: 508990 - RNA, 32 nt, Human
ucuguggcuucaguauacaguaacugaauaaa

SEQ ID NO: 508991 - RNA, 32 nt, Human
ucuguggcuugcuggagaaugccuccgggaac

SEQ ID NO: 508992 - RNA, 32 nt, Human
ucugugggaagagagagccaccuagcaugucc

SEQ ID NO: 508993 - RNA, 31 nt, Human
ucugugggacugucugggccuguuacucauc

SEQ ID NO: 508994 - RNA, 32 nt, Human
ucugugggagcccggccgcgcccagcccccgc

SEQ ID NO: 508995 - RNA, 32 nt, Human
ucugugggcaggaagugaagagaucguucugu

SEQ ID NO: 508996 - RNA, 21 nt, Human
ucugugggcgcccaaggccag

SEQ ID NO: 508997 - RNA, 19 nt, Human
ucugugggcucacaagaca

SEQ ID NO: 508998 - RNA, 32 nt, Human
ucugugggcugcugugggcugcauuuggauag

SEQ ID NO: 508999 - RNA, 32 nt, Human
ucuguggggagauguggaaagcuguucaagug

SEQ ID NO: 509000 - RNA, 32 nt, Human
ucuguggggagguuuuauggcuuuugucagau

SEQ ID NO: 509001 - RNA, 32 nt, Human
ucuguggggcccuguguccccugcucgggagu

SEQ ID NO: 509002 - RNA, 32 nt, Human
ucuguggggccugcuggggccugggagccccc

SEQ ID NO: 509003 - RNA, 32 nt, Human
ucuguggggcugggcaccguguccuccucuga

SEQ ID NO: 509004 - RNA, 32 nt, Human
ucuguggggcuggguuccucucuuuucuuucc

SEQ ID NO: 509005 - RNA, 32 nt, Human
ucugugggggaaaaggaagaggagggucuugu

SEQ ID NO: 509006 - RNA, 32 nt, Human
ucugugggggcacagcccugcccaccccugga

SEQ ID NO: 509007 - RNA, 32 nt, Human
ucuguggggugaggcagugcauggccaaggaa

SEQ ID NO: 509008 - RNA, 32 nt, Human
ucuguggguccucugguguugaguggucggcu

SEQ ID NO: 509009 - RNA, 32 nt, Human
ucugugggugugggggcccugggugaaugcug

SEQ ID NO: 509010 - RNA, 32 nt, Human
ucugugguacuuccucucuggcugauuuagca

SEQ ID NO: 509011 - RNA, 20 nt, Human
ucugugguagaaauguucua

SEQ ID NO: 509012 - RNA, 32 nt, Human
ucugugguagagaacucucuuccuucuuucca

SEQ ID NO: 509013 - RNA, 32 nt, Human
ucugugguaucagaauaaaaggacuugauaua

SEQ ID NO: 509014 - RNA, 32 nt, Human
ucuguggucauugucccucugcagaauaaaga

SEQ ID NO: 509015 - RNA, 32 nt, Human
ucugugguccacguccugccucucccuggggu

SEQ ID NO: 509016 - RNA, 32 nt, Human
ucuguggucccagcuacucgggagacucaugc

SEQ ID NO: 509017 - RNA, 32 nt, Human
ucuguggucccagcuacuggggaggcugaggu

SEQ ID NO: 509018 - RNA, 32 nt, Human
ucuguggucccagcuacuugagaggcugagcc

SEQ ID NO: 509019 - RNA, 32 nt, Human
ucugugguccguggcccuguuucugugcgccu

SEQ ID NO: 509020 - RNA, 32 nt, Human
ucugugguccuccccuccugacccaggccucu

SEQ ID NO: 509021 - RNA, 32 nt, Human
ucugugguccuccuccccagaacucagaaccc

SEQ ID NO: 509022 - RNA, 32 nt, Human
ucuguggugaaauagugggaaggauucaugua

SEQ ID NO: 509023 - RNA, 32 nt, Human
ucuguggugcugcucggggauggacuccaugc

SEQ ID NO: 509024 - RNA, 32 nt, Human
ucugugguggggaaagcggagaggggaguggg

SEQ ID NO: 509025 - RNA, 32 nt, Human
ucugugguuggaggaaagaugagugaagggau

SEQ ID NO: 509026 - RNA, 32 nt, Human
ucuguguacaaaccauggagguuauucauuca

SEQ ID NO: 509027 - RNA, 32 nt, Human
ucuguguacaauauuuuauuuuccuaaauuau

SEQ ID NO: 509028 - RNA, 32 nt, Human
ucuguguagggaggggaggcuuauucaauucu

SEQ ID NO: 509029 - RNA, 32 nt, Human
ucuguguaguaacugccgacaaaucucuccug

SEQ ID NO: 509030 - RNA, 32 nt, Human
ucuguguaguucuucacuaucuguuccagggc

SEQ ID NO: 509031 - RNA, 32 nt, Human
ucuguguauaccaaaugauucuguuaucuaaa

SEQ ID NO: 509032 - RNA, 32 nt, Human
ucuguguauauuuuauaagauguccuucuuag

SEQ ID NO: 509033 - RNA, 32 nt, Human
ucuguguauguauguauauaguguaauacgua

SEQ ID NO: 509034 - RNA, 32 nt, Human
ucuguguaugugucugugugucugcguccgug

SEQ ID NO: 509035 - RNA, 32 nt, Human
ucugugucacccacuccugggugcgugcagac

SEQ ID NO: 509036 - RNA, 32 nt, Human
ucugugucagaagaaagcagcaguaacagcaa

SEQ ID NO: 509037 - RNA, 32 nt, Human
ucugugucagggcagggccaggaggaaaccac

SEQ ID NO: 509038 - RNA, 32 nt, Human
ucugugucccaaauaaauguagacuuucgugc

SEQ ID NO: 509039 - RNA, 32 nt, Human
ucuguguccuccagguuuauaugggaaucgaa

SEQ ID NO: 509040 - RNA, 32 nt, Human
ucuguguccugccucggcgcucucgcaaauga

SEQ ID NO: 509041 - RNA, 32 nt, Human
ucugugucucugguuccuuuucugucacuugg

SEQ ID NO: 509042 - RNA, 32 nt, Human
ucugugucuggacuucagagcaccugcuucuc

SEQ ID NO: 509043 - RNA, 32 nt, Human
ucugugucugggaacuaccugcccagcuguuu

SEQ ID NO: 509044 - RNA, 32 nt, Human
ucugugucugucucccccucagaggagcucuc

SEQ ID NO: 509045 - RNA, 32 nt, Human
ucugugucugugcuccuccuucccucucagac

SEQ ID NO: 509046 - RNA, 32 nt, Human
ucugugucuugcgucuguggccuuccuauugu

SEQ ID NO: 509047 - RNA, 32 nt, Human
ucugugugauaccaaggagaccauuuggauuu

SEQ ID NO: 509048 - RNA, 32 nt, Human
ucugugugaugauacggcaacauuguuuguaa

SEQ ID NO: 509049 - RNA, 32 nt, Human
ucugugugcacacccaugcacacucaugcaca

SEQ ID NO: 509050 - RNA, 32 nt, Human
ucugugugccacaugcugcucucuaccagauu

SEQ ID NO: 509051 - RNA, 32 nt, Human
ucugugugcguuguggggugggggaggggguc

SEQ ID NO: 509052 - RNA, 32 nt, Human
ucugugugcugaagcuaacucaagauggaaag

SEQ ID NO: 509053 - RNA, 29 nt, Human
ucuguguggcuguguguuugggacagggg

SEQ ID NO: 509054 - RNA, 32 nt, Human
ucuguguggggaaaauaaugcauugacugcca

SEQ ID NO: 509055 - RNA, 32 nt, Human
ucugugugggugugugcaugugcacaguuagu

SEQ ID NO: 509056 - RNA, 32 nt, Human
ucuguguguaucaucaauaaaguugugugcuu

SEQ ID NO: 509057 - RNA, 32 nt, Human
ucuguguguauguacaguuuacaugauguucc

SEQ ID NO: 509058 - RNA, 32 nt, Human
ucuguguguauguacauaguagacaugugugu

SEQ ID NO: 509059 - RNA, 29 nt, Human
ucuguguguaugugugugggggugggcag

SEQ ID NO: 509060 - RNA, 29 nt, Human
ucugugugucugugacagucagggaagga

SEQ ID NO: 509061 - RNA, 32 nt, Human
ucugugugugacaccaccacugugucccagug

SEQ ID NO: 509062 - RNA, 32 nt, Human
ucugugugugcccuguaaccugacugguuaac

SEQ ID NO: 509063 - RNA, 32 nt, Human
ucuguguguguauguguguguuuauaugugua

SEQ ID NO: 509064 - RNA, 32 nt, Human
ucuguguuaaagcucaaaugaaccagcccacg

SEQ ID NO: 509065 - RNA, 32 nt, Human
ucuguguuacccaguaacucaucugucaccaa

SEQ ID NO: 509066 - RNA, 32 nt, Human
ucuguguuagggacagaggaaaacuuggugug

SEQ ID NO: 509067 - RNA, 32 nt, Human
ucuguguucauggagcuuauuugaggcuagaa

SEQ ID NO: 509068 - RNA, 32 nt, Human
ucuguguuccauccuccguccacuugagcucu

SEQ ID NO: 509069 - RNA, 32 nt, Human
ucuguguuccguccuggccaugggcuuguugc

SEQ ID NO: 509070 - RNA, 32 nt, Human
ucuguguucuacggcaguuacacacacgcagu

SEQ ID NO: 509071 - RNA, 32 nt, Human
ucuguguucucuuccuuucauuuuaucccuua

SEQ ID NO: 509072 - RNA, 32 nt, Human
ucuguguugcagccccagcucuugaaagugac

SEQ ID NO: 509073 - RNA, 32 nt, Human
ucuguguuguguggcuguaggggagggcugca

SEQ ID NO: 509074 - RNA, 32 nt, Human
ucuguguuucccacccucucccugacccaagu

SEQ ID NO: 509075 - RNA, 32 nt, Human
ucuguguuuggaggcuggaugggauaugauca

SEQ ID NO: 509076 - RNA, 32 nt, Human
ucuguguuuguaguguggaaguuggugacugu

SEQ ID NO: 509077 - RNA, 32 nt, Human
ucuguguuugugugugcauaguucugugguuu

SEQ ID NO: 509078 - RNA, 32 nt, Human
ucuguguuuucagccacccagucugugguauc

SEQ ID NO: 509079 - RNA, 32 nt, Human
ucuguuaaaaauaagaacaaaaauccagagug

SEQ ID NO: 509080 - RNA, 32 nt, Human
ucuguuaaaaauacaaaauuagccaggcgugg

SEQ ID NO: 509081 - RNA, 32 nt, Human
ucuguuaaacaguucuucaccuaacagcauau

SEQ ID NO: 509082 - RNA, 32 nt, Human
ucuguuaaaggcacaugagcugugcuggcuuc

SEQ ID NO: 509083 - RNA, 32 nt, Human
ucuguuaacaucacucuugucuggcaaaagaa

SEQ ID NO: 509084 - RNA, 32 nt, Human
ucuguuaacccugacagucucucuucauugag

SEQ ID NO: 509085 - RNA, 32 nt, Human
ucuguuaccagccuuuuggugugucuuuaugu

SEQ ID NO: 509086 - RNA, 24 nt, Human
ucuguuacccaggcuagaguguag

SEQ ID NO: 509087 - RNA, 24 nt, Human
ucuguuacccaggcuggaaugcag

SEQ ID NO: 509088 - RNA, 23 nt, Human
ucuguuacccaggcuggagugca

SEQ ID NO: 509089 - RNA, 24 nt, Human
ucuguuacccaggcuggagugcag

SEQ ID NO: 509090 - RNA, 32 nt, Human
ucuguuacccaggcuggagugcagugacacaa

SEQ ID NO: 509091 - RNA, 32 nt, Human
ucuguuaccgagcacugcucccagggggcgcu

SEQ ID NO: 509092 - RNA, 32 nt, Human
ucuguuacgugccugugguucuuggaaagagc

SEQ ID NO: 509093 - RNA, 32 nt, Human
ucuguuacuccucaccccauagggcagcccgg

SEQ ID NO: 509094 - RNA, 23 nt, Human
ucuguuacucuaucuuggccaga

SEQ ID NO: 509095 - RNA, 32 nt, Human
ucuguuaggaggcucuacaggagaaucauuuc

SEQ ID NO: 509096 - RNA, 32 nt, Human
ucuguuaggcagcauugcuuugaugcaauuuc

SEQ ID NO: 509097 - RNA, 32 nt, Human
ucuguuagggcugccuuucaguaacucauuua

SEQ ID NO: 509098 - RNA, 32 nt, Human
ucuguuagggggccaauaaaauguaucugcau

SEQ ID NO: 509099 - RNA, 32 nt, Human
ucuguuaucccaguuaggaggcugaggcaaga

SEQ ID NO: 509100 - RNA, 32 nt, Human
ucuguuaucgggggcagaaagacugaagcaca

SEQ ID NO: 509101 - RNA, 32 nt, Human
ucuguuaucuacagugcacacgcacacacaca

SEQ ID NO: 509102 - RNA, 32 nt, Human
ucuguuaugaacacguugguuggcuggauuca

SEQ ID NO: 509103 - RNA, 22 nt, Human
ucuguuaugagauaauguucua

SEQ ID NO: 509104 - RNA, 32 nt, Human
ucuguucacucugcaguucucuugccuacugc

SEQ ID NO: 509105 - RNA, 32 nt, Human
ucuguucacugcaaccgccucccgugcucaag

SEQ ID NO: 509106 - RNA, 32 nt, Human
ucuguucacuggcucucuacauuugccaggau

SEQ ID NO: 509107 - RNA, 32 nt, Human
ucuguucagggugggacuccaggugaauuacu

SEQ ID NO: 509108 - RNA, 32 nt, Human
ucuguucaugcgggagauggcaggggcuggca

SEQ ID NO: 509109 - RNA, 32 nt, Human
ucuguuccaagcagugugagaacauggcuggu

SEQ ID NO: 509110 - RNA, 32 nt, Human
ucuguuccagggcuagucggaggaucauaagc

SEQ ID NO: 509111 - RNA, 32 nt, Human
ucuguuccauggugugcaggucugcuucuuaa

SEQ ID NO: 509112 - RNA, 32 nt, Human
ucuguuccauuuucuuuggauucccuauucac

SEQ ID NO: 509113 - RNA, 32 nt, Human
ucuguucccaagcaguucaugauacagccuca

SEQ ID NO: 509114 - RNA, 32 nt, Human
ucuguucccacacuugggccucugccucugua

SEQ ID NO: 509115 - RNA, 32 nt, Human
ucuguuccccuugaaccuguguggaccugauc

SEQ ID NO: 509116 - RNA, 32 nt, Human
ucuguuccuccuccucucucucuuuccucugc

SEQ ID NO: 509117 - RNA, 32 nt, Human
ucuguuccucuccccuccccuuccuaccgcac

SEQ ID NO: 509118 - RNA, 32 nt, Human
ucuguuccugcaguuuugggguucauuaaaag

SEQ ID NO: 509119 - RNA, 32 nt, Human
ucuguuccugcuccuuccucuggcuagauugc

SEQ ID NO: 509120 - RNA, 32 nt, Human
ucuguuccuucacauccuguguuucuagggaa

SEQ ID NO: 509121 - RNA, 32 nt, Human
ucuguuccuuggcuuguccuuccuucccggga

SEQ ID NO: 509122 - RNA, 31 nt, Human
ucuguuccuuucucugggcuuaggguccugu

SEQ ID NO: 509123 - RNA, 32 nt, Human
ucuguucuaaaauggaggcaguagggagcaaa

SEQ ID NO: 509124 - RNA, 32 nt, Human
ucuguucucacaaagucuccccaaugcucuac

SEQ ID NO: 509125 - RNA, 32 nt, Human
ucuguucucagauuccuaaucauuccagaagu

SEQ ID NO: 509126 - RNA, 32 nt, Human
ucuguucuccuggaaguccagggaagaaggag

SEQ ID NO: 509127 - RNA, 22 nt, Human
ucuguucucucaguaaacagaa

SEQ ID NO: 509128 - RNA, 32 nt, Human
ucuguucucucuuuccccguccuuccucucuc

SEQ ID NO: 509129 - RNA, 32 nt, Human
ucuguucucugccuugucucucuuugucuuaa

SEQ ID NO: 509130 - RNA, 32 nt, Human
ucuguucugcaacuccauccuccugugucacu

SEQ ID NO: 509131 - RNA, 32 nt, Human
ucuguucugggccaggucccagcuugagcugc

SEQ ID NO: 509132 - RNA, 32 nt, Human
ucuguucuuaagaugaggagaguaucuguguu

SEQ ID NO: 509133 - RNA, 32 nt, Human
ucuguugaacugucuuccaaccugccauggca

SEQ ID NO: 509134 - RNA, 32 nt, Human
ucuguugaaguuggccuguggagaugaugugc

SEQ ID NO: 509135 - RNA, 27 nt, Human
ucuguugacaggguuuguuuuauuuua

SEQ ID NO: 509136 - RNA, 24 nt, Human
ucuguugaccaggcuggagugcag

SEQ ID NO: 509137 - RNA, 32 nt, Human
ucuguugaguacuucauacaugccuagucuga

SEQ ID NO: 509138 - RNA, 31 nt, Human
ucuguugaguagagagaaauaggaauugucu

SEQ ID NO: 509139 - RNA, 32 nt, Human
ucuguugaguuucuuuguugaagaagccagca

SEQ ID NO: 509140 - RNA, 32 nt, Human
ucuguugcaaccucaauaaacagcacaaucuc

SEQ ID NO: 509141 - RNA, 32 nt, Human
ucuguugcacacagcucacucguauguccugc

SEQ ID NO: 509142 - RNA, 32 nt, Human
ucuguugcaguagagaaaagcagggcugggga

SEQ ID NO: 509143 - RNA, 21 nt, Human
ucuguugcauacuuaguuuuu

SEQ ID NO: 509144 - RNA, 32 nt, Human
ucuguugccaacagaucuccccuaacaguguc

SEQ ID NO: 509145 - RNA, 21 nt, Human
ucuguugccaaggcuagagca

SEQ ID NO: 509146 - RNA, 32 nt, Human
ucuguugccaaggcuggagugcaguggaacga

SEQ ID NO: 509147 - RNA, 32 nt, Human
ucuguugccacaucuccugccuaguggagaag

SEQ ID NO: 509148 - RNA, 32 nt, Human
ucuguugccacugcacucuggccugggcaaca

SEQ ID NO: 509149 - RNA, 32 nt, Human
ucuguugccagaagcuggaugacuucgggccu

SEQ ID NO: 509150 - RNA, 23 nt, Human
ucuguugccaggccagagugcag

SEQ ID NO: 509151 - RNA, 23 nt, Human
ucuguugccaggcuagagugcag

SEQ ID NO: 509152 - RNA, 23 nt, Human
ucuguugccaggcuggaaugcag

SEQ ID NO: 509153 - RNA, 32 nt, Human
ucuguugccaggcuggaaugcaguggcgucau

SEQ ID NO: 509154 - RNA, 32 nt, Human
ucuguugccaggcuggaaugccguggcgcaau

SEQ ID NO: 509155 - RNA, 32 nt, Human
ucuguugccaggcuggagggcaguggcacgau

SEQ ID NO: 509156 - RNA, 32 nt, Human
ucuguugccaggcuggagugcacuggggcuug

SEQ ID NO: 509157 - RNA, 23 nt, Human
ucuguugccaggcuggagugcag

SEQ ID NO: 509158 - RNA, 32 nt, Human
ucuguugccaggcuggagugcaguggcgcaau

SEQ ID NO: 509159 - RNA, 32 nt, Human
ucuguugccaggcuggagugcaguggcgcgau

SEQ ID NO: 509160 - RNA, 32 nt, Human
ucuguugccaggcuggagugcaguggugcgau

SEQ ID NO: 509161 - RNA, 23 nt, Human
ucuguugccaggcuggggugcag

SEQ ID NO: 509162 - RNA, 32 nt, Human
ucuguugccaguuaaagguuccuuggagauga

SEQ ID NO: 509163 - RNA, 24 nt, Human
ucuguugcccaagcuggaguacag

SEQ ID NO: 509164 - RNA, 24 nt, Human
ucuguugcccaagcuggagugcag

SEQ ID NO: 509165 - RNA, 32 nt, Human
ucuguugcccacaaccuguuuucacccguuuc

SEQ ID NO: 509166 - RNA, 32 nt, Human
ucuguugcccacuuuccuugggccauaccuuc

SEQ ID NO: 509167 - RNA, 23 nt, Human
ucuguugcccagacuagaguaca

SEQ ID NO: 509168 - RNA, 24 nt, Human
ucuguugcccagacuagagugcag

SEQ ID NO: 509169 - RNA, 17 nt, Human
ucuguugcccagacugg

SEQ ID NO: 509170 - RNA, 24 nt, Human
ucuguugcccagacuggagugcag

SEQ ID NO: 509171 - RNA, 32 nt, Human
ucuguugcccagcuggagugcaguggcgugau

SEQ ID NO: 509172 - RNA, 32 nt, Human
ucuguugcccagcuggagugcaguggugugau

SEQ ID NO: 509173 - RNA, 24 nt, Human
ucuguugcccaggagggagugcag

SEQ ID NO: 509174 - RNA, 32 nt, Human
ucuguugcccaggagggagugcaguggugcaa

SEQ ID NO: 509175 - RNA, 32 nt, Human
ucuguugcccaggauggagugcaguggugaga

SEQ ID NO: 509176 - RNA, 24 nt, Human
ucuguugcccaggcaagagugcag

SEQ ID NO: 509177 - RNA, 23 nt, Human
ucuguugcccaggcuagagugca

SEQ ID NO: 509178 - RNA, 24 nt, Human
ucuguugcccaggcuagagugcag

SEQ ID NO: 509179 - RNA, 24 nt, Human
ucuguugcccaggcugaagugcag

SEQ ID NO: 509180 - RNA, 20 nt, Human
ucuguugcccaggcugcugg

SEQ ID NO: 509181 - RNA, 24 nt, Human
ucuguugcccaggcuggaaugcag

SEQ ID NO: 509182 - RNA, 23 nt, Human
ucuguugcccaggcuggaguaca

SEQ ID NO: 509183 - RNA, 24 nt, Human
ucuguugcccaggcuggaguacag

SEQ ID NO: 509184 - RNA, 23 nt, Human
ucuguugcccaggcuggagugca

SEQ ID NO: 509185 - RNA, 24 nt, Human
ucuguugcccaggcuggagugcag

SEQ ID NO: 509186 - RNA, 32 nt, Human
ucuguugcccaggcuggagugcagugacguga

SEQ ID NO: 509187 - RNA, 32 nt, Human
ucuguugcccaggcuggagugcagugauguga

SEQ ID NO: 509188 - RNA, 32 nt, Human
ucuguugcccaggguggagugcaguggcauga

SEQ ID NO: 509189 - RNA, 32 nt, Human
ucuguugcccagucuggagugcaguggcgcag

SEQ ID NO: 509190 - RNA, 32 nt, Human
ucuguugcccaugccccugccugaaaguguag

SEQ ID NO: 509191 - RNA, 32 nt, Human
ucuguugccccaggcuggagugcaguggcgug

SEQ ID NO: 509192 - RNA, 32 nt, Human
ucuguugccccaggcuggagugcaguggugug

SEQ ID NO: 509193 - RNA, 32 nt, Human
ucuguugcccgggcuggagugcagugguguga

SEQ ID NO: 509194 - RNA, 23 nt, Human
ucuguugccgcucguuuuuguca

SEQ ID NO: 509195 - RNA, 24 nt, Human
ucuguugccuaggccagagugcag

SEQ ID NO: 509196 - RNA, 32 nt, Human
ucuguugccuaggcuggagugcagugaggcaa

SEQ ID NO: 509197 - RNA, 32 nt, Human
ucuguugccuaggcuggagugcaguggcgcaa

SEQ ID NO: 509198 - RNA, 32 nt, Human
ucuguugccuaggcuggagugcaguggcgcga

SEQ ID NO: 509199 - RNA, 32 nt, Human
ucuguugccuccucucucccugccucacaucu

SEQ ID NO: 509200 - RNA, 32 nt, Human
ucuguugccugggcuggagugcagugccacga

SEQ ID NO: 509201 - RNA, 32 nt, Human
ucuguugccugggcuggagugcaguggcauga

SEQ ID NO: 509202 - RNA, 32 nt, Human
ucuguugccugggcuggagugcaguggcccaa

SEQ ID NO: 509203 - RNA, 32 nt, Human
ucuguugccugggcuggagugcaguggcguga

SEQ ID NO: 509204 - RNA, 22 nt, Human
ucuguugccuuucuuuccugcu

SEQ ID NO: 509205 - RNA, 32 nt, Human
ucuguugcuaggcuggagugcaguggcacaau

SEQ ID NO: 509206 - RNA, 32 nt, Human
ucuguugcuaggcuggagugcaguggugcgau

SEQ ID NO: 509207 - RNA, 32 nt, Human
ucuguugcuaucuaagaacugcauacccuccu

SEQ ID NO: 509208 - RNA, 32 nt, Human
ucuguugcucaccucugucccuccagaacucg

SEQ ID NO: 509209 - RNA, 32 nt, Human
ucuguugcucaggcuggauugcaguggcguga

SEQ ID NO: 509210 - RNA, 32 nt, Human
ucuguugcucagucuagggugcagugacguga

SEQ ID NO: 509211 - RNA, 32 nt, Human
ucuguugcucugggauccugccagucuuccgc

SEQ ID NO: 509212 - RNA, 32 nt, Human
ucuguugcugaggcuggagugcagugauguga

SEQ ID NO: 509213 - RNA, 32 nt, Human
ucuguugcuugggcugcaaugcagugaugcaa

SEQ ID NO: 509214 - RNA, 32 nt, Human
ucuguugcuuucucccuguggcucgcgccguc

SEQ ID NO: 509215 - RNA, 32 nt, Human
ucuguuggaggacaucccagauuugcuuauac

SEQ ID NO: 509216 - RNA, 32 nt, Human
ucuguuggaggcacaguuuuagaauaaggagg

SEQ ID NO: 509217 - RNA, 32 nt, Human
ucuguuggcaaggacagguuacagaauaggaa

SEQ ID NO: 509218 - RNA, 32 nt, Human
ucuguuggcagacuggagugcaaucauggcuc

SEQ ID NO: 509219 - RNA, 24 nt, Human
ucuguuggccaggcuggaaugcag

SEQ ID NO: 509220 - RNA, 32 nt, Human
ucuguuggccaggcuggaaugcaguggcacaa

SEQ ID NO: 509221 - RNA, 24 nt, Human
ucuguuggccaggcuggagugcag

SEQ ID NO: 509222 - RNA, 32 nt, Human
ucuguuggcugcagaaagaagucagaauagag

SEQ ID NO: 509223 - RNA, 32 nt, Human
ucuguugggacccuuaucuuaacucaccacuu

SEQ ID NO: 509224 - RNA, 32 nt, Human
ucuguugggcugggaaaugucucuuucauauu

SEQ ID NO: 509225 - RNA, 32 nt, Human
ucuguugggucaguggagaugggugaggagca

SEQ ID NO: 509226 - RNA, 32 nt, Human
ucuguugggucuuaggccuccuucccuccuca

SEQ ID NO: 509227 - RNA, 32 nt, Human
ucuguugggugggaugggaggggguagaggga

SEQ ID NO: 509228 - RNA, 22 nt, Human
ucuguuguauucugauuuuuua

SEQ ID NO: 509229 - RNA, 32 nt, Human
ucuguugucaacugcuguacccagaaaucuag

SEQ ID NO: 509230 - RNA, 32 nt, Human
ucuguuguccaagcuagagugcagugauacca

SEQ ID NO: 509231 - RNA, 32 nt, Human
ucuguuguccaaggcuggaguguaguagugcu

SEQ ID NO: 509232 - RNA, 32 nt, Human
ucuguuguccaggauggagugcagugguugau

SEQ ID NO: 509233 - RNA, 24 nt, Human
ucuguuguccaggcuagagugcag

SEQ ID NO: 509234 - RNA, 23 nt, Human
ucuguuguccaggcuggagugca

SEQ ID NO: 509235 - RNA, 24 nt, Human
ucuguuguccaggcuggagugcag

SEQ ID NO: 509236 - RNA, 32 nt, Human
ucuguuguccccacuaccaucucccucucuca

SEQ ID NO: 509237 - RNA, 32 nt, Human
ucuguuguccgagggagauuuggggaaaaaga

SEQ ID NO: 509238 - RNA, 32 nt, Human
ucuguugugugaagacaggagcugaaugcuca

SEQ ID NO: 509239 - RNA, 32 nt, Human
ucuguuguuguuguuuuagaugggcucauuac

SEQ ID NO: 509240 - RNA, 32 nt, Human
ucuguuuaaaugguaauguagcauuuauuuug

SEQ ID NO: 509241 - RNA, 32 nt, Human
ucuguuuaauugauuggugcugugaggaguuc

SEQ ID NO: 509242 - RNA, 32 nt, Human
ucuguuuaauuuuucaguccaaagagaggaaa

SEQ ID NO: 509243 - RNA, 32 nt, Human
ucuguuuacauccugauuuguauacuauuuua

SEQ ID NO: 509244 - RNA, 32 nt, Human
ucuguuuacuuccucuggggaaggcagacuga

SEQ ID NO: 509245 - RNA, 32 nt, Human
ucuguuuaggucccaauaaggaaggucugucc

SEQ ID NO: 509246 - RNA, 23 nt, Human
ucuguuuauguucuguauauguu

SEQ ID NO: 509247 - RNA, 32 nt, Human
ucuguuuauuugggaagucacacucuguauuc

SEQ ID NO: 509248 - RNA, 32 nt, Human
ucuguuucaauuacacaugccugucagcaaaa

SEQ ID NO: 509249 - RNA, 32 nt, Human
ucuguuucacuggguagucuaaaacuagcuua

SEQ ID NO: 509250 - RNA, 32 nt, Human
ucuguuucaggugcccuuggugcaguauaaau

SEQ ID NO: 509251 - RNA, 32 nt, Human
ucuguuucaugcaguggaugaggagggugagu

SEQ ID NO: 509252 - RNA, 32 nt, Human
ucuguuucauuaaggccucuacucuggcucag

SEQ ID NO: 509253 - RNA, 32 nt, Human
ucuguuucccccagacuccuggaguucuaguc

SEQ ID NO: 509254 - RNA, 32 nt, Human
ucuguuuccucuacuccuggcucagaaacagc

SEQ ID NO: 509255 - RNA, 32 nt, Human
ucuguuuccucuuccccuuucuccucguaugu

SEQ ID NO: 509256 - RNA, 32 nt, Human
ucuguuuccucuuccccuuucuccugguaugu

SEQ ID NO: 509257 - RNA, 32 nt, Human
ucuguuuccuggcaaguguuuccugcuacuuu

SEQ ID NO: 509258 - RNA, 32 nt, Human
ucuguuuccuucucuucucuuuccucccucuc

SEQ ID NO: 509259 - RNA, 32 nt, Human
ucuguuucuccucucuucucuccugccagucu

SEQ ID NO: 509260 - RNA, 32 nt, Human
ucuguuucugagucuccuauggaccaucuguc

SEQ ID NO: 509261 - RNA, 31 nt, Human
ucuguuucuuucucuggguaguguccccacu

SEQ ID NO: 509262 - RNA, 32 nt, Human
ucuguuucuuugccugagauccuuccugagga

SEQ ID NO: 509263 - RNA, 32 nt, Human
ucuguuugauaugccacugccuccaugccccu

SEQ ID NO: 509264 - RNA, 16 nt, Human
ucuguuugccuggaga

SEQ ID NO: 509265 - RNA, 20 nt, Human
ucuguuugccuucaguuuuu

SEQ ID NO: 509266 - RNA, 32 nt, Human
ucuguuugcgcccccguguccccagcugcaag

SEQ ID NO: 509267 - RNA, 32 nt, Human
ucuguuugcggcuaguuuuucuuucuguuucc

SEQ ID NO: 509268 - RNA, 32 nt, Human
ucuguuugcuuuugccccgcucuggcuuacca

SEQ ID NO: 509269 - RNA, 32 nt, Human
ucuguuuggaaauguuugccuucagggguacg

SEQ ID NO: 509270 - RNA, 32 nt, Human
ucuguuuggaagaucaguuagaaggcuaguuu

SEQ ID NO: 509271 - RNA, 25 nt, Human
ucuguuuggacuauguuuucuuuuc

SEQ ID NO: 509272 - RNA, 32 nt, Human
ucuguuuggccaccugguguggaugucacugu

SEQ ID NO: 509273 - RNA, 32 nt, Human
ucuguuuggccuagagguguggagugagagaa

SEQ ID NO: 509274 - RNA, 32 nt, Human
ucuguuugggaagacguggaggaaaaggugac

SEQ ID NO: 509275 - RNA, 32 nt, Human
ucuguuugggggucuaucucuccaucccucug

SEQ ID NO: 509276 - RNA, 32 nt, Human
ucuguuuggguguuggaagcugggcgauuccc

SEQ ID NO: 509277 - RNA, 32 nt, Human
ucuguuuguaaucauuaucucacuuuguaaau

SEQ ID NO: 509278 - RNA, 19 nt, Human
ucuguuugugccuuucaaa

SEQ ID NO: 509279 - RNA, 32 nt, Human
ucuguuugugguccuagcugagcccagccuug

SEQ ID NO: 509280 - RNA, 32 nt, Human
ucuguuuguguacgcacauacacacaugcacg

SEQ ID NO: 509281 - RNA, 31 nt, Human
ucuguuuuccucucuggaccucagucuucuc

SEQ ID NO: 509282 - RNA, 32 nt, Human
ucuguuuuccucucuggaccucagucuucucc

SEQ ID NO: 509283 - RNA, 32 nt, Human
ucuguuuugaaacuugaucuacaaucaguaaa

SEQ ID NO: 509284 - RNA, 32 nt, Human
ucuguuuugagucuuuacaaaauagccaguua

SEQ ID NO: 509285 - RNA, 19 nt, Human
ucuguuuugccuccugccu

SEQ ID NO: 509286 - RNA, 32 nt, Human
ucuguuuuguguccugguagcagcuguugagu

SEQ ID NO: 509287 - RNA, 32 nt, Human
ucuguuuuuaucuccccucucaggaccaguca

SEQ ID NO: 509288 - RNA, 32 nt, Human
ucuguuuuugagagggagucucgcucuguccc

SEQ ID NO: 509289 - RNA, 32 nt, Human
ucuguuuuugcuuuugugcuuaggcaagugca

SEQ ID NO: 509290 - RNA, 32 nt, Human
ucuguuuuugggcugagucaccaccuuugccu

SEQ ID NO: 509291 - RNA, 32 nt, Human
ucuuaaaaaggacaaugcugauggaagaccag

SEQ ID NO: 509292 - RNA, 32 nt, Human
ucuuaaaaaugagaaccaguggggaaauuguu

SEQ ID NO: 509293 - RNA, 22 nt, Human
ucuuaaaacucuuguauguguu

SEQ ID NO: 509294 - RNA, 32 nt, Human
ucuuaaaacugauguucugcauuuguuucuca

SEQ ID NO: 509295 - RNA, 32 nt, Human
ucuuaaaacugcauuguacagcucccucccug

SEQ ID NO: 509296 - RNA, 32 nt, Human
ucuuaaaagaggcauuaguucagaauacuuuu

SEQ ID NO: 509297 - RNA, 32 nt, Human
ucuuaaaagcaucagucuguaacuagaacaaa

SEQ ID NO: 509298 - RNA, 32 nt, Human
ucuuaaaaggagagaggaaaaacacaggcacc

SEQ ID NO: 509299 - RNA, 32 nt, Human
ucuuaaaaguaaaauauacuucaugcuguuua

SEQ ID NO: 509300 - RNA, 32 nt, Human
ucuuaaaauaguaauuucuccuacuuuucuuu

SEQ ID NO: 509301 - RNA, 32 nt, Human
ucuuaaaaugcaagauucucacuuugaagguu

SEQ ID NO: 509302 - RNA, 32 nt, Human
ucuuaaaaugugcuacauuugagaauagcuca

SEQ ID NO: 509303 - RNA, 32 nt, Human
ucuuaaaccaggaaggcagagauugcagugag

SEQ ID NO: 509304 - RNA, 32 nt, Human
ucuuaaacuacucuugguugucuuccuaaggg

SEQ ID NO: 509305 - RNA, 32 nt, Human
ucuuaaagaguuuaguuuuccucuccagaggg

SEQ ID NO: 509306 - RNA, 32 nt, Human
ucuuaaagcuaaauuagcuuuucauugcacac

SEQ ID NO: 509307 - RNA, 32 nt, Human
ucuuaaagcuccaaaaugaucuccuuugacuc

SEQ ID NO: 509308 - RNA, 32 nt, Human
ucuuaaaggccugagcuagcuggagaagaggg

SEQ ID NO: 509309 - RNA, 32 nt, Human
ucuuaaagggagcugaugcuggcaaugggauc

SEQ ID NO: 509310 - RNA, 32 nt, Human
ucuuaaagucuguuuuuagacuucauggucau

SEQ ID NO: 509311 - RNA, 32 nt, Human
ucuuaaaugaaugaaucaaagacauucaacag

SEQ ID NO: 509312 - RNA, 22 nt, Human
ucuuaaaugcaaucucuucucu

SEQ ID NO: 509313 - RNA, 32 nt, Human
ucuuaaauggcagcaggcaagaaagugugugc

SEQ ID NO: 509314 - RNA, 32 nt, Human
ucuuaaauggcaguaagagcuauagagaaaaa

SEQ ID NO: 509315 - RNA, 32 nt, Human
ucuuaaauguucuugguaggggaguuggcauu

SEQ ID NO: 509316 - RNA, 31 nt, Human
ucuuaacaagugucuaaagacaguaggcugu

SEQ ID NO: 509317 - RNA, 32 nt, Human
ucuuaacacacauacacauacacgcgcauaca

SEQ ID NO: 509318 - RNA, 32 nt, Human
ucuuaacacaguuucuugacagcagcucugga

SEQ ID NO: 509319 - RNA, 32 nt, Human
ucuuaacaccuguguuuccuuuucagaucuua

SEQ ID NO: 509320 - RNA, 32 nt, Human
ucuuaacacugguagcuccugucccauuccaa

SEQ ID NO: 509321 - RNA, 22 nt, Human
ucuuaacagaagccaaacaaga

SEQ ID NO: 509322 - RNA, 32 nt, Human
ucuuaacagauggggaagugagugcuacagag

SEQ ID NO: 509323 - RNA, 32 nt, Human
ucuuaacaggcaggcaaggggugcggggacca

SEQ ID NO: 509324 - RNA, 26 nt, Human
ucuuaacaugaagaucauuggacaag

SEQ ID NO: 509325 - RNA, 32 nt, Human
ucuuaacauggcagccauucugccuuugccgu

SEQ ID NO: 509326 - RNA, 32 nt, Human
ucuuaacauuugcaguccuugugucacugucu

SEQ ID NO: 509327 - RNA, 32 nt, Human
ucuuaaccaaccagccuuaccaaacaacacaa

SEQ ID NO: 509328 - RNA, 32 nt, Human
ucuuaaccacuauagaugucucuaaugcuucg

SEQ ID NO: 509329 - RNA, 32 nt, Human
ucuuaaccagcaguucuugucuggggagcuca

SEQ ID NO: 509330 - RNA, 24 nt, Human
ucuuaacgugaagaucaaacaaga

SEQ ID NO: 509331 - RNA, 32 nt, Human
ucuuaacucacugcaaccuccgcuucccaggu

SEQ ID NO: 509332 - RNA, 32 nt, Human
ucuuaacucgaugacuuggggcucccugcucu

SEQ ID NO: 509333 - RNA, 32 nt, Human
ucuuaacugcaaucuguuaacacugcugucuc

SEQ ID NO: 509334 - RNA, 32 nt, Human
ucuuaacuguguauacuaauucguuuugucuu

SEQ ID NO: 509335 - RNA, 32 nt, Human
ucuuaagaaaugcaagcuuguucagggggcug

SEQ ID NO: 509336 - RNA, 32 nt, Human
ucuuaagaaauguaucugcaugaacuccgugg

SEQ ID NO: 509337 - RNA, 32 nt, Human
ucuuaagaacacccuugucucagucccacuca

SEQ ID NO: 509338 - RNA, 32 nt, Human
ucuuaagagaugccucauuuuagaaccaccaa

SEQ ID NO: 509339 - RNA, 32 nt, Human
ucuuaagaggagauguagaaaaauguguacaa

SEQ ID NO: 509340 - RNA, 32 nt, Human
ucuuaagaggagcugugaaguuguguggaagc

SEQ ID NO: 509341 - RNA, 32 nt, Human
ucuuaagaggcugcgaugucuagguugggcuu

SEQ ID NO: 509342 - RNA, 32 nt, Human
ucuuaagauaauauuuaaaauaguuccagaua

SEQ ID NO: 509343 - RNA, 32 nt, Human
ucuuaagcaucagcgugacgugaccucucugu

SEQ ID NO: 509344 - RNA, 32 nt, Human
ucuuaagccccagaaagccaaaaagaacaugu

SEQ ID NO: 509345 - RNA, 32 nt, Human
ucuuaagccuucacuguugccuugccagaaug

SEQ ID NO: 509346 - RNA, 32 nt, Human
ucuuaaggguaguggcaugagaucuuuggaag

SEQ ID NO: 509347 - RNA, 32 nt, Human
ucuuaaggugcuuucgagauuaaauuauuaau

SEQ ID NO: 509348 - RNA, 32 nt, Human
ucuuaaguauguauguugaggccaucugagcu

SEQ ID NO: 509349 - RNA, 32 nt, Human
ucuuaagugcaauuauuuuaauaaaaggggca

SEQ ID NO: 509350 - RNA, 32 nt, Human
ucuuaaguugguagcugaggguaucaggcauc

SEQ ID NO: 509351 - RNA, 32 nt, Human
ucuuaauaacagauucuucugaagacagaauu

SEQ ID NO: 509352 - RNA, 32 nt, Human
ucuuaauauucuaugugcuauguaccagauaa

SEQ ID NO: 509353 - RNA, 32 nt, Human
ucuuaauccacuuucuaaauggagguuuagga

SEQ ID NO: 509354 - RNA, 32 nt, Human
ucuuaaugaaccuaugagaguguugugaaguu

SEQ ID NO: 509355 - RNA, 32 nt, Human
ucuuaaugaaguuugaauguuaaauaaauugu

SEQ ID NO: 509356 - RNA, 32 nt, Human
ucuuaaugagagacaagugagguggagggccu

SEQ ID NO: 509357 - RNA, 32 nt, Human
ucuuaaugcauauggggaaacugaggcccaga

SEQ ID NO: 509358 - RNA, 32 nt, Human
ucuuaaugguauagccuccugagauuaaaugu

SEQ ID NO: 509359 - RNA, 32 nt, Human
ucuuaauguagaaagaaaaauggagacuugua

SEQ ID NO: 509360 - RNA, 32 nt, Human
ucuuaauguaucuggcauuugggugaacugug

SEQ ID NO: 509361 - RNA, 32 nt, Human
ucuuaauguguguguuuuuacuugcauaucug

SEQ ID NO: 509362 - RNA, 24 nt, Human
ucuuaauucaguucuguauguguu

SEQ ID NO: 509363 - RNA, 23 nt, Human
ucuuaauucauuuucauauuguu

SEQ ID NO: 509364 - RNA, 26 nt, Human
ucuuaauuccuauuucaauauguguu

SEQ ID NO: 509365 - RNA, 32 nt, Human
ucuuaauucugaguugcucuuggaucucuaca

SEQ ID NO: 509366 - RNA, 20 nt, Human
ucuuaauugaguuguauugu

SEQ ID NO: 509367 - RNA, 32 nt, Human
ucuuaauuguuggcugggcacaguggcucacg

SEQ ID NO: 509368 - RNA, 32 nt, Human
ucuuacaacucauguacccauugcuaguuuuu

SEQ ID NO: 509369 - RNA, 22 nt, Human
ucuuacaacucccccaccgccc

SEQ ID NO: 509370 - RNA, 32 nt, Human
ucuuacaacuggcucuuccuccccucacuaag

SEQ ID NO: 509371 - RNA, 32 nt, Human
ucuuacaagagguugcaucucaguacacagug

SEQ ID NO: 509372 - RNA, 32 nt, Human
ucuuacaaugcauuccuuuaacuugucccugg

SEQ ID NO: 509373 - RNA, 32 nt, Human
ucuuacacaugugacccccacccagacagagg

SEQ ID NO: 509374 - RNA, 32 nt, Human
ucuuacaccauugcuuuccauucuccagaacu

SEQ ID NO: 509375 - RNA, 23 nt, Human
ucuuacacucuauccuuccuaga

SEQ ID NO: 509376 - RNA, 32 nt, Human
ucuuacagaaucucccagacauaugguguuaa

SEQ ID NO: 509377 - RNA, 32 nt, Human
ucuuacaggaaggaggaggggaagcaguggau

SEQ ID NO: 509378 - RNA, 32 nt, Human
ucuuacaggacuaauuucagugguguaaauaa

SEQ ID NO: 509379 - RNA, 32 nt, Human
ucuuacagggagagagauugggugcaauuugc

SEQ ID NO: 509380 - RNA, 32 nt, Human
ucuuacagguauaguuccgugauuaugauagc

SEQ ID NO: 509381 - RNA, 24 nt, Human
ucuuacagugauggaaaugcucua

SEQ ID NO: 509382 - RNA, 32 nt, Human
ucuuacauacaugaaagccaucaaagacaaag

SEQ ID NO: 509383 - RNA, 32 nt, Human
ucuuacaucuaauuuguagaaacaguauaagu

SEQ ID NO: 509384 - RNA, 32 nt, Human
ucuuacauggaugucaggagagcugcugcccu

SEQ ID NO: 509385 - RNA, 32 nt, Human
ucuuacauguagagauuugagugcaguuggua

SEQ ID NO: 509386 - RNA, 32 nt, Human
ucuuacauuccaguagaaaacucucucugcaa

SEQ ID NO: 509387 - RNA, 32 nt, Human
ucuuacauuccuuuucaucauuuccuuuguaa

SEQ ID NO: 509388 - RNA, 32 nt, Human
ucuuacauuuccauuugcaaagugacuagaga

SEQ ID NO: 509389 - RNA, 32 nt, Human
ucuuaccaaaguuuagagucugaguuuuucgu

SEQ ID NO: 509390 - RNA, 32 nt, Human
ucuuaccaagagugggcuuuguggaaacagcu

SEQ ID NO: 509391 - RNA, 32 nt, Human
ucuuaccagcauuucuucugggcuugugaugu

SEQ ID NO: 509392 - RNA, 32 nt, Human
ucuuaccaggagacaggguuugagagcagaca

SEQ ID NO: 509393 - RNA, 32 nt, Human
ucuuacccagcccuggucaagaaucugugagg

SEQ ID NO: 509394 - RNA, 32 nt, Human
ucuuaccccaagcugggccuugcaguaccugu

SEQ ID NO: 509395 - RNA, 32 nt, Human
ucuuaccccuuuccuauacuuucuuguuaucc

SEQ ID NO: 509396 - RNA, 21 nt, Human
ucuuacccucccucccuuccu

SEQ ID NO: 509397 - RNA, 32 nt, Human
ucuuacccugcacaaucucccccuccagcuuc

SEQ ID NO: 509398 - RNA, 32 nt, Human
ucuuaccgaucugugucugugacuugacuccu

SEQ ID NO: 509399 - RNA, 32 nt, Human
ucuuaccgcauaccacuucacacuuguuuuau

SEQ ID NO: 509400 - RNA, 32 nt, Human
ucuuaccucauuaagaguaguaaugaaaaaca

SEQ ID NO: 509401 - RNA, 32 nt, Human
ucuuaccuccacccuccuccugccacccuugu

SEQ ID NO: 509402 - RNA, 32 nt, Human
ucuuaccuccccuggcccuccuuucuggcuca

SEQ ID NO: 509403 - RNA, 32 nt, Human
ucuuaccucuugugguucucaauaaaacagaa

SEQ ID NO: 509404 - RNA, 32 nt, Human
ucuuaccuguaauccuagcacuuugagaccac

SEQ ID NO: 509405 - RNA, 32 nt, Human
ucuuaccugugcgggagcgaaaaagcugggcu

SEQ ID NO: 509406 - RNA, 32 nt, Human
ucuuacgccaugguuaugagcagguugaugag

SEQ ID NO: 509407 - RNA, 32 nt, Human
ucuuacgccucagccuccugaguagauggaac

SEQ ID NO: 509408 - RNA, 32 nt, Human
ucuuacggcuuccauaauggcuaguugauauu

SEQ ID NO: 509409 - RNA, 32 nt, Human
ucuuacguucuuucagcaugcuccuuaaaacc

SEQ ID NO: 509410 - RNA, 24 nt, Human
ucuuacuagacagauauccacuua

SEQ ID NO: 509411 - RNA, 32 nt, Human
ucuuacuaugucccuugcuucaggcccuggcc

SEQ ID NO: 509412 - RNA, 32 nt, Human
ucuuacuccugccuccccauuccuugccuguc

SEQ ID NO: 509413 - RNA, 32 nt, Human
ucuuacucuccccucaugguguuccccucuua

SEQ ID NO: 509414 - RNA, 32 nt, Human
ucuuacucuugucaccugggcugcaguuggag

SEQ ID NO: 509415 - RNA, 32 nt, Human
ucuuacugaagugccugaaacccaaagcuaga

SEQ ID NO: 509416 - RNA, 32 nt, Human
ucuuacugagauacccucucaccccaaaugug

SEQ ID NO: 509417 - RNA, 32 nt, Human
ucuuacugaggacuuuugauccugguuuuuga

SEQ ID NO: 509418 - RNA, 22 nt, Human
ucuuacugcucucacaauucua

SEQ ID NO: 509419 - RNA, 32 nt, Human
ucuuacuggcuucucaauuuucuuccuucucu

SEQ ID NO: 509420 - RNA, 32 nt, Human
ucuuacuguuccaggguggccccaggcagcag

SEQ ID NO: 509421 - RNA, 31 nt, Human
ucuuacuguuucucuggguuguuugucagau

SEQ ID NO: 509422 - RNA, 32 nt, Human
ucuuacuucuaauauccaucccuggacuuuuu

SEQ ID NO: 509423 - RNA, 32 nt, Human
ucuuacuuuauccuuuuuccuuaaguauuggu

SEQ ID NO: 509424 - RNA, 32 nt, Human
ucuuacuuuccucugccugccucaguuuaauu

SEQ ID NO: 509425 - RNA, 32 nt, Human
ucuuacuuugucccugcuguguccucuagcau

SEQ ID NO: 509426 - RNA, 32 nt, Human
ucuuagaaaaaccaccaccaucaccagacagg

SEQ ID NO: 509427 - RNA, 32 nt, Human
ucuuagaaccaccacuaacugcuugacugcca

SEQ ID NO: 509428 - RNA, 21 nt, Human
ucuuagaagaaaccccaugaa

SEQ ID NO: 509429 - RNA, 32 nt, Human
ucuuagaagccuccccugacuucacugugcuu

SEQ ID NO: 509430 - RNA, 32 nt, Human
ucuuagaaugucccucucuugggacuugcuua

SEQ ID NO: 509431 - RNA, 32 nt, Human
ucuuagaccagaacauguagguccccuugugu

SEQ ID NO: 509432 - RNA, 32 nt, Human
ucuuagaccauggcgacccaggcgaagcgucc

SEQ ID NO: 509433 - RNA, 32 nt, Human
ucuuagacugaguaaaguguuaauaccauacc

SEQ ID NO: 509434 - RNA, 32 nt, Human
ucuuagagacauggucuaaccauguugucuag

SEQ ID NO: 509435 - RNA, 32 nt, Human
ucuuagagacugcuucucccaaacauaacgcg

SEQ ID NO: 509436 - RNA, 32 nt, Human
ucuuagagauagauugcaugagggccaugagg

SEQ ID NO: 509437 - RNA, 32 nt, Human
ucuuagagccagagcccacagagcugggggug

SEQ ID NO: 509438 - RNA, 21 nt, Human
ucuuagagccccccucccccu

SEQ ID NO: 509439 - RNA, 22 nt, Human
ucuuagaggaagagaagaaaca

SEQ ID NO: 509440 - RNA, 32 nt, Human
ucuuagaggaagagaagaaacauggcaagcag

SEQ ID NO: 509441 - RNA, 32 nt, Human
ucuuagaucaaauuuaugccaauuauaugaaa

SEQ ID NO: 509442 - RNA, 32 nt, Human
ucuuagaugcaguucugaagaagaugguacca

SEQ ID NO: 509443 - RNA, 32 nt, Human
ucuuagauguugguggugcagccccaggacca

SEQ ID NO: 509444 - RNA, 32 nt, Human
ucuuagcaaaguaaaaaggacagugauaacag

SEQ ID NO: 509445 - RNA, 32 nt, Human
ucuuagcacauccucuguucucuaccugucau

SEQ ID NO: 509446 - RNA, 32 nt, Human
ucuuagcacuuagcacugccuaccucaucaug

SEQ ID NO: 509447 - RNA, 31 nt, Human
ucuuagcaggagagagagcgaggaguuguca

SEQ ID NO: 509448 - RNA, 31 nt, Human
ucuuagcaggagagagagugaggaguuguca

SEQ ID NO: 509449 - RNA, 32 nt, Human
ucuuagccaaaaaccuaggguucauuuucagg

SEQ ID NO: 509450 - RNA, 32 nt, Human
ucuuagccaagaaaagcuaaccaaacaagcug

SEQ ID NO: 509451 - RNA, 32 nt, Human
ucuuagccaagcucuguaaaaccauuuaccug

SEQ ID NO: 509452 - RNA, 32 nt, Human
ucuuagccaaguuugaaaccagccuaauuuac

SEQ ID NO: 509453 - RNA, 32 nt, Human
ucuuagccacaugcuaaccaguugcuucucag

SEQ ID NO: 509454 - RNA, 32 nt, Human
ucuuagccagugacugcagagcagggauacca

SEQ ID NO: 509455 - RNA, 32 nt, Human
ucuuagccaguggacaggcuguccugaaugaa

SEQ ID NO: 509456 - RNA, 32 nt, Human
ucuuagccauggggaggaaggagcuggacugu

SEQ ID NO: 509457 - RNA, 32 nt, Human
ucuuagccccuucacugcccuucuccaucucu

SEQ ID NO: 509458 - RNA, 32 nt, Human
ucuuagccccuucaucaugucaucucccuuau

SEQ ID NO: 509459 - RNA, 32 nt, Human
ucuuagcccgggcuaaucucuuuuccuugaug

SEQ ID NO: 509460 - RNA, 32 nt, Human
ucuuagcccuaguggggugcucagaucucuca

SEQ ID NO: 509461 - RNA, 32 nt, Human
ucuuagcccugagguuuccuccuucccaucuu

SEQ ID NO: 509462 - RNA, 32 nt, Human
ucuuagcccuuguaauccuagcacuuugggag

SEQ ID NO: 509463 - RNA, 32 nt, Human
ucuuagccuacguuaccaggagcccugacaug

SEQ ID NO: 509464 - RNA, 32 nt, Human
ucuuagccuucucucugacuuuacaggacaaa

SEQ ID NO: 509465 - RNA, 32 nt, Human
ucuuagcucacugcaacccccgccucccgggu

SEQ ID NO: 509466 - RNA, 32 nt, Human
ucuuagcucacugcaaccuccaccucccaggu

SEQ ID NO: 509467 - RNA, 32 nt, Human
ucuuagcucacugcaaccuccaccucccgggu

SEQ ID NO: 509468 - RNA, 32 nt, Human
ucuuagcucacugcaaccuccgccuccugggu

SEQ ID NO: 509469 - RNA, 32 nt, Human
ucuuagcucacugcaaccucugcuuccugggu

SEQ ID NO: 509470 - RNA, 32 nt, Human
ucuuagcucacugcaagcuccgccucccaggu

SEQ ID NO: 509471 - RNA, 32 nt, Human
ucuuagcucacugcagccuccaccucccaggc

SEQ ID NO: 509472 - RNA, 32 nt, Human
ucuuagcucucugcaaccucugccucccaggu

SEQ ID NO: 509473 - RNA, 32 nt, Human
ucuuagcugagaacuaagagaugagggaggca

SEQ ID NO: 509474 - RNA, 21 nt, Human
ucuuagcugauagguggcagg

SEQ ID NO: 509475 - RNA, 32 nt, Human
ucuuagcugucuguuccugcucacacugccag

SEQ ID NO: 509476 - RNA, 32 nt, Human
ucuuagcuuuaguuuaucucucugccugaaga

SEQ ID NO: 509477 - RNA, 32 nt, Human
ucuuaggaagcugaauguuguguuaucacuaa

SEQ ID NO: 509478 - RNA, 32 nt, Human
ucuuaggacaugcaucuuuaagcuuuaucauu

SEQ ID NO: 509479 - RNA, 32 nt, Human
ucuuaggagccuagggugucuccucugcuucu

SEQ ID NO: 509480 - RNA, 32 nt, Human
ucuuaggagugacugggggagggaagauuauu

SEQ ID NO: 509481 - RNA, 32 nt, Human
ucuuaggauguguaugcucucaaagaguuugc

SEQ ID NO: 509482 - RNA, 32 nt, Human
ucuuaggauuaaggguccaaaaaugcugaucu

SEQ ID NO: 509483 - RNA, 32 nt, Human
ucuuaggauuagugaaaauuuaugcuuuauua

SEQ ID NO: 509484 - RNA, 32 nt, Human
ucuuaggcacagcauuacucaccaucucacag

SEQ ID NO: 509485 - RNA, 26 nt, Human
ucuuaggcauucuaucuuugcucaaa

SEQ ID NO: 509486 - RNA, 32 nt, Human
ucuuaggcgauuuguggggugcagugaaugaa

SEQ ID NO: 509487 - RNA, 21 nt, Human
ucuuaggcuggagugcagugg

SEQ ID NO: 509488 - RNA, 32 nt, Human
ucuuaggcugugagacaggagcaggggaacca

SEQ ID NO: 509489 - RNA, 20 nt, Human
ucuuaggcuuccagccucua

SEQ ID NO: 509490 - RNA, 32 nt, Human
ucuuagggaggcagaggcaggaggauagcuug

SEQ ID NO: 509491 - RNA, 32 nt, Human
ucuuagggcaccaagccagggaagggagaagu

SEQ ID NO: 509492 - RNA, 32 nt, Human
ucuuagggcuuuuguguaugucugacuuguuu

SEQ ID NO: 509493 - RNA, 32 nt, Human
ucuuaggguaaugagauggaugguggcccagg

SEQ ID NO: 509494 - RNA, 32 nt, Human
ucuuaggucccuuuggaggauauugauggggg

SEQ ID NO: 509495 - RNA, 32 nt, Human
ucuuagguuuaacuuaauucuggucauugucu

SEQ ID NO: 509496 - RNA, 32 nt, Human
ucuuaguaaaaauacaaaauuggccuggcgug

SEQ ID NO: 509497 - RNA, 32 nt, Human
ucuuaguaagauuucugucuucucccaggucu

SEQ ID NO: 509498 - RNA, 32 nt, Human
ucuuaguaugagaaacagaagacugaagaaua

SEQ ID NO: 509499 - RNA, 32 nt, Human
ucuuagucacccagacuagaggucaguggcag

SEQ ID NO: 509500 - RNA, 32 nt, Human
ucuuaguccaucuguucccucuccucuccuca

SEQ ID NO: 509501 - RNA, 32 nt, Human
ucuuagucccacccucaccauaaacauccaag

SEQ ID NO: 509502 - RNA, 21 nt, Human
ucuuagucccuuuccuauccc

SEQ ID NO: 509503 - RNA, 32 nt, Human
ucuuaguccuugcccugccucaguuuaccugc

SEQ ID NO: 509504 - RNA, 31 nt, Human
ucuuaguggguggaugggcauggauagaaau

SEQ ID NO: 509505 - RNA, 22 nt, Human
ucuuagugguggaucaucaggu

SEQ ID NO: 509506 - RNA, 32 nt, Human
ucuuagugugcccaggagucugaucugcuggg

SEQ ID NO: 509507 - RNA, 32 nt, Human
ucuuaguguucaccaguuguacugcaauauag

SEQ ID NO: 509508 - RNA, 32 nt, Human
ucuuaguguuuagugggccacuucucugaugu

SEQ ID NO: 509509 - RNA, 32 nt, Human
ucuuaguuauucacagcucagcccgauaggca

SEQ ID NO: 509510 - RNA, 32 nt, Human
ucuuaguucugacuucucaguuuaauguggga

SEQ ID NO: 509511 - RNA, 32 nt, Human
ucuuauaaagggacagucaguugugucaacac

SEQ ID NO: 509512 - RNA, 32 nt, Human
ucuuauaaaugagaggauuguggaaacuugua

SEQ ID NO: 509513 - RNA, 32 nt, Human
ucuuauaagaaaacaaaaauucccucaggcua

SEQ ID NO: 509514 - RNA, 32 nt, Human
ucuuauaagaaagcucugagaaugggcauuuu

SEQ ID NO: 509515 - RNA, 32 nt, Human
ucuuauaagagggaggcaggaggguuagagug

SEQ ID NO: 509516 - RNA, 32 nt, Human
ucuuauacaaaugaagaaguugcaaagaauac

SEQ ID NO: 509517 - RNA, 21 nt, Human
ucuuauacaucuccuccaucu

SEQ ID NO: 509518 - RNA, 32 nt, Human
ucuuauacauguauccuaaaaagagaagcuca

SEQ ID NO: 509519 - RNA, 32 nt, Human
ucuuauaccucaaacccaccucacaggaacua

SEQ ID NO: 509520 - RNA, 32 nt, Human
ucuuauacugcaacugugucuccuaggggaca

SEQ ID NO: 509521 - RNA, 32 nt, Human
ucuuauacuuucaguagcaucuuuccacagca

SEQ ID NO: 509522 - RNA, 32 nt, Human
ucuuauacuuuuucaguugcugucuuauucuc

SEQ ID NO: 509523 - RNA, 32 nt, Human
ucuuauagagucuccuagaauauuucauuggc

SEQ ID NO: 509524 - RNA, 32 nt, Human
ucuuauagcacuggaggaggaaaacaaauucu

SEQ ID NO: 509525 - RNA, 32 nt, Human
ucuuauauccauuggcagugugcaguguuggc

SEQ ID NO: 509526 - RNA, 32 nt, Human
ucuuaucacaggcuacaacauagaugaaccuu

SEQ ID NO: 509527 - RNA, 32 nt, Human
ucuuaucacccagcucccuggggaauggguag

SEQ ID NO: 509528 - RNA, 32 nt, Human
ucuuaucagcuggugcugcuuccugagccaua

SEQ ID NO: 509529 - RNA, 32 nt, Human
ucuuaucagucugacaaucucugccuuuugau

SEQ ID NO: 509530 - RNA, 32 nt, Human
ucuuaucaguguccuugacaagcauucauauu

SEQ ID NO: 509531 - RNA, 32 nt, Human
ucuuauccaacuuuuucauaguaagugcgaag

SEQ ID NO: 509532 - RNA, 32 nt, Human
ucuuauccuaguuugcuauccuuauuauuugu

SEQ ID NO: 509533 - RNA, 32 nt, Human
ucuuauccucauugcauuucuaugcauauaca

SEQ ID NO: 509534 - RNA, 32 nt, Human
ucuuauccucauugcauuucuaugcauaugcg

SEQ ID NO: 509535 - RNA, 32 nt, Human
ucuuauccuccaccgucuuucuuuuauacuga

SEQ ID NO: 509536 - RNA, 32 nt, Human
ucuuauccuccagaauagagaccuaaggacac

SEQ ID NO: 509537 - RNA, 32 nt, Human
ucuuauccuuaacaagacagcacuccagauag

SEQ ID NO: 509538 - RNA, 32 nt, Human
ucuuaucgccauggacugggaauuaacaugua

SEQ ID NO: 509539 - RNA, 32 nt, Human
ucuuaucgcccaggcuggggugcaauggcgca

SEQ ID NO: 509540 - RNA, 22 nt, Human
ucuuaucggagcuuguaugugu

SEQ ID NO: 509541 - RNA, 32 nt, Human
ucuuaucuaauuuaucucuucuggacccaugu

SEQ ID NO: 509542 - RNA, 32 nt, Human
ucuuaucuacuugcacuguucacccuucacau

SEQ ID NO: 509543 - RNA, 32 nt, Human
ucuuaucuauauuuuaaccugggagacuguug

SEQ ID NO: 509544 - RNA, 32 nt, Human
ucuuaucuccguccucccuguccuucaaggcc

SEQ ID NO: 509545 - RNA, 32 nt, Human
ucuuaucugaguaguugggaggaggggaauac

SEQ ID NO: 509546 - RNA, 32 nt, Human
ucuuaucuucauuuuccuuuguuuauaaugaa

SEQ ID NO: 509547 - RNA, 32 nt, Human
ucuuaucuucugucuguucucuuuucucuccc

SEQ ID NO: 509548 - RNA, 32 nt, Human
ucuuaucuuggcugggaucucacacaugucua

SEQ ID NO: 509549 - RNA, 32 nt, Human
ucuuaugaacgaaaaagagguagcacuacaaa

SEQ ID NO: 509550 - RNA, 32 nt, Human
ucuuaugagcuggcuggauuuggcuuguggac

SEQ ID NO: 509551 - RNA, 32 nt, Human
ucuuaugagcuugugggcuccaucuaccaacc

SEQ ID NO: 509552 - RNA, 32 nt, Human
ucuuaugcaaaaaggaaaacacacacaaccaa

SEQ ID NO: 509553 - RNA, 32 nt, Human
ucuuaugcaaaggcugacuugccugaacgcua

SEQ ID NO: 509554 - RNA, 29 nt, Human
ucuuaugcacacucaugaacaagcugcag

SEQ ID NO: 509555 - RNA, 24 nt, Human
ucuuaugcccaauuucugcuucca

SEQ ID NO: 509556 - RNA, 21 nt, Human
ucuuaugccccauuccuguca

SEQ ID NO: 509557 - RNA, 32 nt, Human
ucuuauggauguccccagcagagagguuugca

SEQ ID NO: 509558 - RNA, 32 nt, Human
ucuuauggcaaugaccccugacggcagaaugc

SEQ ID NO: 509559 - RNA, 21 nt, Human
ucuuauggcuucucuuguccu

SEQ ID NO: 509560 - RNA, 32 nt, Human
ucuuaugggaaagagugagaggaaagaagguu

SEQ ID NO: 509561 - RNA, 32 nt, Human
ucuuaugggguucuccaccugccccagagcuu

SEQ ID NO: 509562 - RNA, 32 nt, Human
ucuuaugguggagcagcugaggagggcaggaa

SEQ ID NO: 509563 - RNA, 32 nt, Human
ucuuauguucccccacaugcaggugguuuuuc

SEQ ID NO: 509564 - RNA, 31 nt, Human
ucuuauguuuugaaauaccugugaauuguug

SEQ ID NO: 509565 - RNA, 32 nt, Human
ucuuauuagcaaggagauugggguuuugagug

SEQ ID NO: 509566 - RNA, 32 nt, Human
ucuuauuaucuagauucacguuuucugugcac

SEQ ID NO: 509567 - RNA, 32 nt, Human
ucuuauucccccaagagaaugggaugauguuc

SEQ ID NO: 509568 - RNA, 32 nt, Human
ucuuauuccucuucuguccuuucuccucuccu

SEQ ID NO: 509569 - RNA, 32 nt, Human
ucuuauucuagcccaaacuuuccuuuucacca

SEQ ID NO: 509570 - RNA, 32 nt, Human
ucuuauugcaccauacuccuugcuuccugaug

SEQ ID NO: 509571 - RNA, 32 nt, Human
ucuuauugcccagacuagagugcgauggugcg

SEQ ID NO: 509572 - RNA, 32 nt, Human
ucuuauugcccaggcuagagugcaauggugcg

SEQ ID NO: 509573 - RNA, 32 nt, Human
ucuuauugcccaggcuggagugcaauggcacg

SEQ ID NO: 509574 - RNA, 32 nt, Human
ucuuauugcccaggcuggagugcaauggugca

SEQ ID NO: 509575 - RNA, 32 nt, Human
ucuuauugcccaggcuggagugcagugacgag

SEQ ID NO: 509576 - RNA, 32 nt, Human
ucuuauugcccaggcuggagugcaguggcaca

SEQ ID NO: 509577 - RNA, 32 nt, Human
ucuuauugcccaggcuggagugcaguggcgug

SEQ ID NO: 509578 - RNA, 32 nt, Human
ucuuauugcccaggcuugagugcaaugaccug

SEQ ID NO: 509579 - RNA, 32 nt, Human
ucuuauugcccuuauuccuccaccccacuucu

SEQ ID NO: 509580 - RNA, 32 nt, Human
ucuuauuggcucugccuccugugcuuauauca

SEQ ID NO: 509581 - RNA, 32 nt, Human
ucuuauuguaaauuugagugcuuguuguuuuu

SEQ ID NO: 509582 - RNA, 32 nt, Human
ucuuauuguaguucaaguacagaugaguaagu

SEQ ID NO: 509583 - RNA, 32 nt, Human
ucuuauuguauuggagggugccacccugggga

SEQ ID NO: 509584 - RNA, 32 nt, Human
ucuuauuguccuccuccuccuggcucggccuc

SEQ ID NO: 509585 - RNA, 32 nt, Human
ucuuauuguuuucauguaaaauaguauagagu

SEQ ID NO: 509586 - RNA, 32 nt, Human
ucuuauuuaugcauuacuugcuuccuugcaug

SEQ ID NO: 509587 - RNA, 32 nt, Human
ucuuauuucauuuucaaugauuuccuagauca

SEQ ID NO: 509588 - RNA, 32 nt, Human
ucuuauuuccagauuacucuggaccuaauuuu

SEQ ID NO: 509589 - RNA, 32 nt, Human
ucuuauuucccauuccuuacgguuauaaucag

SEQ ID NO: 509590 - RNA, 32 nt, Human
ucuuauuucucaguaggaacuuggaagggaag

SEQ ID NO: 509591 - RNA, 32 nt, Human
ucuuauuucucaguugagugagcaaggauacg

SEQ ID NO: 509592 - RNA, 32 nt, Human
ucuuauuucucaucuuuaaacaugucgaccag

SEQ ID NO: 509593 - RNA, 32 nt, Human
ucuuauuucucuauuuuauguugugacuuaac

SEQ ID NO: 509594 - RNA, 32 nt, Human
ucuuauuucugaggcccuucagucuccuuuau

SEQ ID NO: 509595 - RNA, 32 nt, Human
ucuuauuuguauccuaaaaauacguacuauaa

SEQ ID NO: 509596 - RNA, 32 nt, Human
ucuuauuuucaaauuugacauuaucauccuug

SEQ ID NO: 509597 - RNA, 21 nt, Human
ucuuauuuuucccccaccccc

SEQ ID NO: 509598 - RNA, 32 nt, Human
ucuucaaaaguggcugcaaaggcuggcaaacc

SEQ ID NO: 509599 - RNA, 32 nt, Human
ucuucaaaccagguucuugaauacuuaaguua

SEQ ID NO: 509600 - RNA, 32 nt, Human
ucuucaaacccccaccuuccaguucccucacc

SEQ ID NO: 509601 - RNA, 32 nt, Human
ucuucaaagacaacaugcuuuggaaacauaug

SEQ ID NO: 509602 - RNA, 32 nt, Human
ucuucaaagccccagcccuuuuggagguuaca

SEQ ID NO: 509603 - RNA, 32 nt, Human
ucuucaaaggugaugagaaugccuugacaaga

SEQ ID NO: 509604 - RNA, 32 nt, Human
ucuucaaauaagagcaguuggaauaacaaagc

SEQ ID NO: 509605 - RNA, 32 nt, Human
ucuucaacagacucugcaggaaguggcugacu

SEQ ID NO: 509606 - RNA, 32 nt, Human
ucuucaaccagcugcugauucacgcggccuua

SEQ ID NO: 509607 - RNA, 32 nt, Human
ucuucaaccauuguuuuagacucugaacacca

SEQ ID NO: 509608 - RNA, 22 nt, Human
ucuucaacccaaccuccucuca

SEQ ID NO: 509609 - RNA, 32 nt, Human
ucuucaacccuugccuuccucccuucuuccuc

SEQ ID NO: 509610 - RNA, 32 nt, Human
ucuucaaccugucuguguucuugagaacguuc

SEQ ID NO: 509611 - RNA, 32 nt, Human
ucuucaacugauuuuuaaauguuguugcuugg

SEQ ID NO: 509612 - RNA, 32 nt, Human
ucuucaagcccaaaccaauucuguuccuucaa

SEQ ID NO: 509613 - RNA, 21 nt, Human
ucuucaagcugggugcagugg

SEQ ID NO: 509614 - RNA, 32 nt, Human
ucuucaaggagaagauucucccgggaaaucug

SEQ ID NO: 509615 - RNA, 32 nt, Human
ucuucaaggauaaaaacugccaccccaacacc

SEQ ID NO: 509616 - RNA, 32 nt, Human
ucuucaaggauaagcagaguugauccaucuga

SEQ ID NO: 509617 - RNA, 32 nt, Human
ucuucaagugcccuguguuggccaagguuccc

SEQ ID NO: 509618 - RNA, 23 nt, Human
ucuucaauaaaaugcuuuuguca

SEQ ID NO: 509619 - RNA, 32 nt, Human
ucuucaauacugcugcugcuuacgcgccggga

SEQ ID NO: 509620 - RNA, 32 nt, Human
ucuucaaucuuaaaacaaauucauuauucuuu

SEQ ID NO: 509621 - RNA, 32 nt, Human
ucuucaauuccaagccugcucaccaaauuuca

SEQ ID NO: 509622 - RNA, 32 nt, Human
ucuucaauuuccagcuucuccuuggagccuuu

SEQ ID NO: 509623 - RNA, 32 nt, Human
ucuucaauuugguuauagagaaauggccauuc

SEQ ID NO: 509624 - RNA, 31 nt, Human
ucuucacaaguguguaaagcacagauuucaa

SEQ ID NO: 509625 - RNA, 21 nt, Human
ucuucacaccccugaugcucu

SEQ ID NO: 509626 - RNA, 32 nt, Human
ucuucacaccugccaccucauguucacaccua

SEQ ID NO: 509627 - RNA, 32 nt, Human
ucuucacaggaaccuauccucccugcuggugc

SEQ ID NO: 509628 - RNA, 32 nt, Human
ucuucacaggcaggaaccucaugcucugagga

SEQ ID NO: 509629 - RNA, 32 nt, Human
ucuucacaugcugucuucacgugaucuucccu

SEQ ID NO: 509630 - RNA, 32 nt, Human
ucuucacaugugcacacauguaaaacaaaaau

SEQ ID NO: 509631 - RNA, 32 nt, Human
ucuucaccauuguccggcauccugcggaggcu

SEQ ID NO: 509632 - RNA, 17 nt, Human
ucuucacccccaccuca

SEQ ID NO: 509633 - RNA, 18 nt, Human
ucuucaccccugcuccuc

SEQ ID NO: 509634 - RNA, 32 nt, Human
ucuucacccuccccuuuguucuucuauuaauc

SEQ ID NO: 509635 - RNA, 32 nt, Human
ucuucaccuccugccagcaaccccaaacccaa

SEQ ID NO: 509636 - RNA, 32 nt, Human
ucuucaccuuagaucccucuugcccagcacaa

SEQ ID NO: 509637 - RNA, 32 nt, Human
ucuucaccuugccucuggccuuguauuucaca

SEQ ID NO: 509638 - RNA, 32 nt, Human
ucuucaccuuggacuuuccagcaaagacuaga

SEQ ID NO: 509639 - RNA, 32 nt, Human
ucuucacgacgcucugcaugucaguggagcua

SEQ ID NO: 509640 - RNA, 32 nt, Human
ucuucacgcccagccucugccucacaguggac

SEQ ID NO: 509641 - RNA, 32 nt, Human
ucuucacgcccaucuucugccucauagugguc

SEQ ID NO: 509642 - RNA, 32 nt, Human
ucuucacggauuagcugugcuguuauguuguc

SEQ ID NO: 509643 - RNA, 32 nt, Human
ucuucacuccaaaaagaaaaguguuuuguuuu

SEQ ID NO: 509644 - RNA, 32 nt, Human
ucuucacucuaacuuggggaagaaggaagauc

SEQ ID NO: 509645 - RNA, 32 nt, Human
ucuucacucugcucacagcagagcuguauuuu

SEQ ID NO: 509646 - RNA, 32 nt, Human
ucuucagaaagaaaaacuugaagaauacuaau

SEQ ID NO: 509647 - RNA, 31 nt, Human
ucuucagaacaauccugcagucuugacagaa

SEQ ID NO: 509648 - RNA, 32 nt, Human
ucuucagaaggugaguggguugagggaggcag

SEQ ID NO: 509649 - RNA, 32 nt, Human
ucuucagaaugagaggccuguggcuggggcau

SEQ ID NO: 509650 - RNA, 32 nt, Human
ucuucagacuucucacauuuaguauagugcau

SEQ ID NO: 509651 - RNA, 32 nt, Human
ucuucagagaaagagugugagcugaugacaca

SEQ ID NO: 509652 - RNA, 32 nt, Human
ucuucagagccacagaccucaggguggaguga

SEQ ID NO: 509653 - RNA, 32 nt, Human
ucuucagagcugacacaggaugaaggcaaugc

SEQ ID NO: 509654 - RNA, 32 nt, Human
ucuucagagcuuguaagagugccugagaggcc

SEQ ID NO: 509655 - RNA, 32 nt, Human
ucuucagaguauaagauguuuaccucaucuuu

SEQ ID NO: 509656 - RNA, 32 nt, Human
ucuucagagugcuggaaacacacuccugcaga

SEQ ID NO: 509657 - RNA, 32 nt, Human
ucuucagauccaguggcccauucuuuuaucuu

SEQ ID NO: 509658 - RNA, 32 nt, Human
ucuucagcacaucuuauaguaugagaaggaag

SEQ ID NO: 509659 - RNA, 32 nt, Human
ucuucagcagcaucuacucuaggcauauugau

SEQ ID NO: 509660 - RNA, 23 nt, Human
ucuucagcagugauugucagcca

SEQ ID NO: 509661 - RNA, 32 nt, Human
ucuucagcaucaguccagucugugguguccug

SEQ ID NO: 509662 - RNA, 32 nt, Human
ucuucagcauuuuguaccaucugcuccccaau

SEQ ID NO: 509663 - RNA, 32 nt, Human
ucuucagccaugagaagcagugaugacuaucc

SEQ ID NO: 509664 - RNA, 32 nt, Human
ucuucagcccacacccugccagccccacagau

SEQ ID NO: 509665 - RNA, 21 nt, Human
ucuucagccccgagucaugug

SEQ ID NO: 509666 - RNA, 32 nt, Human
ucuucagcccugaugcacaggcugccagcccc

SEQ ID NO: 509667 - RNA, 32 nt, Human
ucuucagccuccaucccuggccuccuccccuc

SEQ ID NO: 509668 - RNA, 32 nt, Human
ucuucagcgauguggaccugguccccauggau

SEQ ID NO: 509669 - RNA, 32 nt, Human
ucuucagcguagcucuccaccucuacccggaa

SEQ ID NO: 509670 - RNA, 32 nt, Human
ucuucagcucacugcuguucucugggcuuguu

SEQ ID NO: 509671 - RNA, 32 nt, Human
ucuucagcucauuuugucucucucacauuaag

SEQ ID NO: 509672 - RNA, 21 nt, Human
ucuucagcucccugcaaguga

SEQ ID NO: 509673 - RNA, 32 nt, Human
ucuucagcuccgccuuucuugcucugaaaauu

SEQ ID NO: 509674 - RNA, 32 nt, Human
ucuucagcuccgucucccuugcucuccgcucu

SEQ ID NO: 509675 - RNA, 32 nt, Human
ucuucagcucuaucugggacaccaucuugacc

SEQ ID NO: 509676 - RNA, 32 nt, Human
ucuucagcucuggcgccuucaucccccugccu

SEQ ID NO: 509677 - RNA, 32 nt, Human
ucuucagcuucucugcugccauguucuuugcu

SEQ ID NO: 509678 - RNA, 32 nt, Human
ucuucagcuugauccuggaggucuuuucuagu

SEQ ID NO: 509679 - RNA, 32 nt, Human
ucuucagcuugucuuguccucuccacaggugg

SEQ ID NO: 509680 - RNA, 32 nt, Human
ucuucagcuuuaacuauacuugagugcaauaa

SEQ ID NO: 509681 - RNA, 32 nt, Human
ucuucagcuuuaggcagaugcaaaagaauaca

SEQ ID NO: 509682 - RNA, 32 nt, Human
ucuucagcuuugaaaaggguuacccugggcac

SEQ ID NO: 509683 - RNA, 32 nt, Human
ucuucaggaauugguccacaggguaaauuuca

SEQ ID NO: 509684 - RNA, 32 nt, Human
ucuucaggacagcacugccagagaugccuggg

SEQ ID NO: 509685 - RNA, 32 nt, Human
ucuucaggaucucuugggguggccguauucug

SEQ ID NO: 509686 - RNA, 31 nt, Human
ucuucaggaugccugcagcacuuguggagaa

SEQ ID NO: 509687 - RNA, 21 nt, Human
ucuucaggcagaagccucugc

SEQ ID NO: 509688 - RNA, 32 nt, Human
ucuucaggcccaggguccuagggcggaacaag

SEQ ID NO: 509689 - RNA, 32 nt, Human
ucuucaggcccaguggagcaggcagcaaguaa

SEQ ID NO: 509690 - RNA, 32 nt, Human
ucuucaggcuagugggauugguugcauuacag

SEQ ID NO: 509691 - RNA, 32 nt, Human
ucuucagggacccggcccugcccugccgcccg

SEQ ID NO: 509692 - RNA, 32 nt, Human
ucuucaggucggcagacccagagcacuugaua

SEQ ID NO: 509693 - RNA, 32 nt, Human
ucuucagguuauuuucuuacuguugcuucaga

SEQ ID NO: 509694 - RNA, 32 nt, Human
ucuucagucauccuuacagaaagauacccucu

SEQ ID NO: 509695 - RNA, 32 nt, Human
ucuucaguccacccugccccacccuuacauga

SEQ ID NO: 509696 - RNA, 32 nt, Human
ucuucaguccucugaguacaucugguggugug

SEQ ID NO: 509697 - RNA, 32 nt, Human
ucuucagucuucaugcuuugucacuguaaaaa

SEQ ID NO: 509698 - RNA, 32 nt, Human
ucuucagugauaauauuucaucuacugauaua

SEQ ID NO: 509699 - RNA, 32 nt, Human
ucuucaguggaugccagcuucccugccccaau

SEQ ID NO: 509700 - RNA, 32 nt, Human
ucuucagugguccugcucugugccucagacuu

SEQ ID NO: 509701 - RNA, 32 nt, Human
ucuucaguguccaaaucucuucugucuccuuu

SEQ ID NO: 509702 - RNA, 32 nt, Human
ucuucaguguguauccaccacauuuaacuuau

SEQ ID NO: 509703 - RNA, 32 nt, Human
ucuucaguuacuagaggcggauuucccugacu

SEQ ID NO: 509704 - RNA, 32 nt, Human
ucuucaguuuuggcugggcaugauggugagcg

SEQ ID NO: 509705 - RNA, 32 nt, Human
ucuucauaaagaugaguaaagucucaguuuuc

SEQ ID NO: 509706 - RNA, 25 nt, Human
ucuucauagauccccugggugcucu

SEQ ID NO: 509707 - RNA, 32 nt, Human
ucuucauagguagaaacaaauacuugacucag

SEQ ID NO: 509708 - RNA, 32 nt, Human
ucuucauauaaaugcuacagaaaaaccuuugu

SEQ ID NO: 509709 - RNA, 32 nt, Human
ucuucauauccccuuccuuuccaucuguagcu

SEQ ID NO: 509710 - RNA, 32 nt, Human
ucuucauaucuauuagggggaaaggaaaaaug

SEQ ID NO: 509711 - RNA, 32 nt, Human
ucuucauauuucuagaguuucucuccaguaua

SEQ ID NO: 509712 - RNA, 32 nt, Human
ucuucaucaagcucugauucuuccagcaauuc

SEQ ID NO: 509713 - RNA, 32 nt, Human
ucuucaucaagcucugauucuuccagcaguuc

SEQ ID NO: 509714 - RNA, 24 nt, Human
ucuucaucaccaccaucaucauca

SEQ ID NO: 509715 - RNA, 32 nt, Human
ucuucaucaccagcaaacgccaggacuuggcu

SEQ ID NO: 509716 - RNA, 32 nt, Human
ucuucaucauuggcauuugaacaaaagacuua

SEQ ID NO: 509717 - RNA, 32 nt, Human
ucuucauccacaucaucuaaagccugaacccg

SEQ ID NO: 509718 - RNA, 32 nt, Human
ucuucauccaugacgacauucccaccaugggg

SEQ ID NO: 509719 - RNA, 32 nt, Human
ucuucauccucauccuccuccuccuccacuug

SEQ ID NO: 509720 - RNA, 32 nt, Human
ucuucauccuggaagugggaacuggaguccca

SEQ ID NO: 509721 - RNA, 32 nt, Human
ucuucauccuguaagcccccaggggcaguccc

SEQ ID NO: 509722 - RNA, 32 nt, Human
ucuucaucggcacaggggccacugagacguuu

SEQ ID NO: 509723 - RNA, 32 nt, Human
ucuucaucuccaccuuccucggcuaccaaaac

SEQ ID NO: 509724 - RNA, 32 nt, Human
ucuucaucugaggccaccucagccuggacuuu

SEQ ID NO: 509725 - RNA, 32 nt, Human
ucuucaucugcagcacguuucuuccuccugca

SEQ ID NO: 509726 - RNA, 32 nt, Human
ucuucaucugggugaagaccucagggucucag

SEQ ID NO: 509727 - RNA, 32 nt, Human
ucuucaucugugaaauggggauaaaaauacuu

SEQ ID NO: 509728 - RNA, 32 nt, Human
ucuucaugaacccagaggauguccgggaagca

SEQ ID NO: 509729 - RNA, 32 nt, Human
ucuucaugaagaggcaacaucucuagugcccu

SEQ ID NO: 509730 - RNA, 32 nt, Human
ucuucaugaauggaggcuucagauuuuucuga

SEQ ID NO: 509731 - RNA, 32 nt, Human
ucuucaugacauacauuaucaguuuuucuguu

SEQ ID NO: 509732 - RNA, 32 nt, Human
ucuucaugccgagagcaucggaaauguuuuug

SEQ ID NO: 509733 - RNA, 32 nt, Human
ucuucauggcauccuucuuuuucuuuuuccau

SEQ ID NO: 509734 - RNA, 30 nt, Human
ucuucaugggcuuugcuuccuaccuccuuc

SEQ ID NO: 509735 - RNA, 32 nt, Human
ucuucaugggcuuugcuuccuaccuccuucac

SEQ ID NO: 509736 - RNA, 24 nt, Human
ucuucauggggguaagaaaagcug

SEQ ID NO: 509737 - RNA, 24 nt, Human
ucuucauggugauggggagcccuu

SEQ ID NO: 509738 - RNA, 32 nt, Human
ucuucaugguuuaaccuccauuucuuauugca

SEQ ID NO: 509739 - RNA, 32 nt, Human
ucuucauguguuaaccacugccuuccuggacc

SEQ ID NO: 509740 - RNA, 32 nt, Human
ucuucauuccuccugguuauugguuuguuugu

SEQ ID NO: 509741 - RNA, 32 nt, Human
ucuucauucuuucucacuuugccaucaugugg

SEQ ID NO: 509742 - RNA, 32 nt, Human
ucuucauugacgguugcuuucaagauguaccu

SEQ ID NO: 509743 - RNA, 32 nt, Human
ucuucauugcagcugcuuucugcucccucuau

SEQ ID NO: 509744 - RNA, 32 nt, Human
ucuucauugcucaugguaugucaaaccuuugg

SEQ ID NO: 509745 - RNA, 32 nt, Human
ucuucauuggcucucuaaaauguggccaagaa

SEQ ID NO: 509746 - RNA, 32 nt, Human
ucuucauuguuuccucaccacuuuucccuuaa

SEQ ID NO: 509747 - RNA, 32 nt, Human
ucuucauuucuggagauggggcagcagguggc

SEQ ID NO: 509748 - RNA, 32 nt, Human
ucuucauuugcuacccucagaagcccaguccg

SEQ ID NO: 509749 - RNA, 32 nt, Human
ucuucauuuugcagaggugagguaagacuuca

SEQ ID NO: 509750 - RNA, 32 nt, Human
ucuucauuuuggaggcagggcugggaagggag

SEQ ID NO: 509751 - RNA, 32 nt, Human
ucuuccaaaguacugggacuacaggcaugaga

SEQ ID NO: 509752 - RNA, 32 nt, Human
ucuuccaaagugcugggauuacaggugugagu

SEQ ID NO: 509753 - RNA, 32 nt, Human
ucuuccaaccaccaccaccugacaacccugca

SEQ ID NO: 509754 - RNA, 31 nt, Human
ucuuccaagacuuugccacucacuuaucuca

SEQ ID NO: 509755 - RNA, 32 nt, Human
ucuuccaagcagcugggacuacagguacccca

SEQ ID NO: 509756 - RNA, 32 nt, Human
ucuuccaauccaagcccacugcagccuugugg

SEQ ID NO: 509757 - RNA, 32 nt, Human
ucuuccaaugcugggcccagacuucuugccug

SEQ ID NO: 509758 - RNA, 23 nt, Human
ucuuccacagcccugaggucuua

SEQ ID NO: 509759 - RNA, 32 nt, Human
ucuuccacagccuucucuuggacagcgacaua

SEQ ID NO: 509760 - RNA, 32 nt, Human
ucuuccacaggcugagaucauccuuggcgucu

SEQ ID NO: 509761 - RNA, 32 nt, Human
ucuuccacagucucucuggggcuguguccuac

SEQ ID NO: 509762 - RNA, 24 nt, Human
ucuuccacaucagauugcaucuca

SEQ ID NO: 509763 - RNA, 32 nt, Human
ucuuccacauuccuccuucuuauaagagcaca

SEQ ID NO: 509764 - RNA, 32 nt, Human
ucuuccacauuucucucuacaucucucaagag

SEQ ID NO: 509765 - RNA, 32 nt, Human
ucuuccacccacccauuccuucaccuggcuga

SEQ ID NO: 509766 - RNA, 32 nt, Human
ucuuccacccucccucucccccucugccccac

SEQ ID NO: 509767 - RNA, 32 nt, Human
ucuuccaccucagcaaccaugaccugaaaccu

SEQ ID NO: 509768 - RNA, 32 nt, Human
ucuuccacugacuugcugugugaccuuaggaa

SEQ ID NO: 509769 - RNA, 32 nt, Human
ucuuccagaaccuccugcucuuccugugggcc

SEQ ID NO: 509770 - RNA, 30 nt, Human
ucuuccagaagccacauccgcacaauuuuc

SEQ ID NO: 509771 - RNA, 32 nt, Human
ucuuccagacuggcugugccugccugugccca

SEQ ID NO: 509772 - RNA, 32 nt, Human
ucuuccagaggaagaggaggaggcggcgaagc

SEQ ID NO: 509773 - RNA, 32 nt, Human
ucuuccagaucuucagcagcaggaugacgaug

SEQ ID NO: 509774 - RNA, 32 nt, Human
ucuuccagcaucucacaguuuauuaugccaga

SEQ ID NO: 509775 - RNA, 32 nt, Human
ucuuccagccaagaagagcucacaggagucca

SEQ ID NO: 509776 - RNA, 20 nt, Human
ucuuccagcccagcauccag

SEQ ID NO: 509777 - RNA, 20 nt, Human
ucuuccagcuucaaucagua

SEQ ID NO: 509778 - RNA, 31 nt, Human
ucuuccaggaaacugacacagggagcucagc

SEQ ID NO: 509779 - RNA, 32 nt, Human
ucuuccaggagguaggaguugguaugggcccu

SEQ ID NO: 509780 - RNA, 32 nt, Human
ucuuccagggccugggaggauagggcuaaucc

SEQ ID NO: 509781 - RNA, 32 nt, Human
ucuuccaggguggcuggagagcacagacgcgc

SEQ ID NO: 509782 - RNA, 32 nt, Human
ucuuccaguucugaggagaggaggucuucagu

SEQ ID NO: 509783 - RNA, 32 nt, Human
ucuuccaguucugccagaauuggccuuuccca

SEQ ID NO: 509784 - RNA, 32 nt, Human
ucuuccaguuuauuuuccuuccccaugcuguu

SEQ ID NO: 509785 - RNA, 32 nt, Human
ucuuccauaaaggcugcaggagaccuguagcu

SEQ ID NO: 509786 - RNA, 32 nt, Human
ucuuccauccacugcccaugacccuguucccu

SEQ ID NO: 509787 - RNA, 32 nt, Human
ucuuccauccuccccucuccccaaaaccacaa

SEQ ID NO: 509788 - RNA, 32 nt, Human
ucuuccaugcuagguauaccuacagcagcuac

SEQ ID NO: 509789 - RNA, 32 nt, Human
ucuuccaugguggacacgucuguucuguaugu

SEQ ID NO: 509790 - RNA, 32 nt, Human
ucuuccauguuguaaaggaacagccccagugc

SEQ ID NO: 509791 - RNA, 32 nt, Human
ucuuccauuucucccaccuuuuuaaugccagu

SEQ ID NO: 509792 - RNA, 32 nt, Human
ucuuccauuuugcacagggagugcaggaggug

SEQ ID NO: 509793 - RNA, 32 nt, Human
ucuucccaaugucauauccaccaggaccuggc

SEQ ID NO: 509794 - RNA, 32 nt, Human
ucuucccacagcaaacagacucuccccagggc

SEQ ID NO: 509795 - RNA, 32 nt, Human
ucuucccacagcuucagaacuuggaguuucag

SEQ ID NO: 509796 - RNA, 32 nt, Human
ucuucccacaguugagcucgggcagcucuuuc

SEQ ID NO: 509797 - RNA, 32 nt, Human
ucuucccacauuuuagcaacauguucauggag

SEQ ID NO: 509798 - RNA, 32 nt, Human
ucuucccaccaacucucucugcccccaaaagu

SEQ ID NO: 509799 - RNA, 32 nt, Human
ucuucccacccccuugcccucucccucucccu

SEQ ID NO: 509800 - RNA, 32 nt, Human
ucuucccacuccacuuguugucccaugaagga

SEQ ID NO: 509801 - RNA, 32 nt, Human
ucuucccacugcacuccagccuggccaauaag

SEQ ID NO: 509802 - RNA, 32 nt, Human
ucuucccacugcacuguggugcuucaguggcc

SEQ ID NO: 509803 - RNA, 32 nt, Human
ucuucccacuugcugacccuuugcuaccuaug

SEQ ID NO: 509804 - RNA, 32 nt, Human
ucuucccagcacaaaccuaaucaaucagugua

SEQ ID NO: 509805 - RNA, 32 nt, Human
ucuucccagccagccucacacacaggagcuga

SEQ ID NO: 509806 - RNA, 32 nt, Human
ucuucccagccaguaugccacaggugaacuuu

SEQ ID NO: 509807 - RNA, 32 nt, Human
ucuucccagccuggcccuggcaaggggcgggu

SEQ ID NO: 509808 - RNA, 32 nt, Human
ucuucccagcuggcugggacugucuuggguuu

SEQ ID NO: 509809 - RNA, 32 nt, Human
ucuucccaggacauuaaauaaggaaacuguau

SEQ ID NO: 509810 - RNA, 32 nt, Human
ucuucccaggcucccagcugguggugacucaa

SEQ ID NO: 509811 - RNA, 32 nt, Human
ucuucccagucugguuccuguacagucugcuc

SEQ ID NO: 509812 - RNA, 32 nt, Human
ucuucccauagcuuccagccugguggggaaua

SEQ ID NO: 509813 - RNA, 32 nt, Human
ucuucccaucuccaaaaauccagagacauuac

SEQ ID NO: 509814 - RNA, 32 nt, Human
ucuucccauggcccagucuguggcuguugggu

SEQ ID NO: 509815 - RNA, 32 nt, Human
ucuucccauuaaacuugaacuguggcuauauu

SEQ ID NO: 509816 - RNA, 32 nt, Human
ucuuccccaacaacagauagcucaccuuggac

SEQ ID NO: 509817 - RNA, 32 nt, Human
ucuuccccaacacuaaccccacucccaugaag

SEQ ID NO: 509818 - RNA, 32 nt, Human
ucuuccccaaggcugagugucccaguuuuauc

SEQ ID NO: 509819 - RNA, 28 nt, Human
ucuuccccaagugcugacaauuaauacc

SEQ ID NO: 509820 - RNA, 32 nt, Human
ucuuccccaaguggaaccucagugcaugcaaa

SEQ ID NO: 509821 - RNA, 32 nt, Human
ucuuccccaaugcuccaucccaaccaggcacc

SEQ ID NO: 509822 - RNA, 32 nt, Human
ucuuccccacagacuuccuuugcuucucuuuu

SEQ ID NO: 509823 - RNA, 32 nt, Human
ucuuccccaccguccucuccccacgcccucuu

SEQ ID NO: 509824 - RNA, 18 nt, Human
ucuuccccagaagcuuca

SEQ ID NO: 509825 - RNA, 32 nt, Human
ucuuccccagcagaaucuggaugaauggcaca

SEQ ID NO: 509826 - RNA, 32 nt, Human
ucuuccccaggcugcuguuccugcugccccgu

SEQ ID NO: 509827 - RNA, 32 nt, Human
ucuuccccauauucacuccucacuuuuacaau

SEQ ID NO: 509828 - RNA, 32 nt, Human
ucuuccccaucucucccccgggccugcugguu

SEQ ID NO: 509829 - RNA, 32 nt, Human
ucuuccccaucuucuucucucggucccgggag

SEQ ID NO: 509830 - RNA, 32 nt, Human
ucuucccccaacagaacuauuucuugcugcuc

SEQ ID NO: 509831 - RNA, 32 nt, Human
ucuucccccuucucaaaaaccuaagauggcuu

SEQ ID NO: 509832 - RNA, 32 nt, Human
ucuuccccuccuuccuugccccuggcugcucu

SEQ ID NO: 509833 - RNA, 32 nt, Human
ucuuccccugcagggaucacacugccagucug

SEQ ID NO: 509834 - RNA, 32 nt, Human
ucuuccccugcccaacaccacgcccucuggca

SEQ ID NO: 509835 - RNA, 32 nt, Human
ucuuccccuguaaaaaccacugccucaaucuc

SEQ ID NO: 509836 - RNA, 32 nt, Human
ucuuccccuguugccaaggucuaacucaugga

SEQ ID NO: 509837 - RNA, 32 nt, Human
ucuuccccuuaccgauccuuuuuaacacucuc

SEQ ID NO: 509838 - RNA, 32 nt, Human
ucuuccccuucccugccuaguuuccuuuuguu

SEQ ID NO: 509839 - RNA, 32 nt, Human
ucuuccccuucuggccaagauuugccagaggc

SEQ ID NO: 509840 - RNA, 32 nt, Human
ucuuccccuuucucugcccgccuuucccaucc

SEQ ID NO: 509841 - RNA, 32 nt, Human
ucuucccgaggcccuggagugccgugcgugug

SEQ ID NO: 509842 - RNA, 19 nt, Human
ucuucccgcuuccuggugc

SEQ ID NO: 509843 - RNA, 32 nt, Human
ucuucccuaauuugaaaguagcuuguuauuuu

SEQ ID NO: 509844 - RNA, 32 nt, Human
ucuucccuacacccuucucugccuuuauuuuu

SEQ ID NO: 509845 - RNA, 32 nt, Human
ucuucccuagcccuuccagucuggaccagcac

SEQ ID NO: 509846 - RNA, 32 nt, Human
ucuucccuauuccauccuuugauggguggccu

SEQ ID NO: 509847 - RNA, 32 nt, Human
ucuucccucaagcugcucguggcaugcccuuc

SEQ ID NO: 509848 - RNA, 32 nt, Human
ucuucccucauuccuuucucucuccuucuggc

SEQ ID NO: 509849 - RNA, 32 nt, Human
ucuucccuccacccucacuccaaccaccccaa

SEQ ID NO: 509850 - RNA, 32 nt, Human
ucuucccucccccagucucucuucucaauccc

SEQ ID NO: 509851 - RNA, 32 nt, Human
ucuucccuccugggaaugguuugguguuugau

SEQ ID NO: 509852 - RNA, 32 nt, Human
ucuucccucucguuuaguuugccuggagcuug

SEQ ID NO: 509853 - RNA, 32 nt, Human
ucuucccucugaguuugauugugaacaacuga

SEQ ID NO: 509854 - RNA, 32 nt, Human
ucuucccucuguguuugaugagagaagucagu

SEQ ID NO: 509855 - RNA, 32 nt, Human
ucuucccucuucccucucccugcccagcccuc

SEQ ID NO: 509856 - RNA, 32 nt, Human
ucuucccucuuugaacaguccuuuguauucug

SEQ ID NO: 509857 - RNA, 32 nt, Human
ucuucccugaaccacuccuccuccugauuucc

SEQ ID NO: 509858 - RNA, 32 nt, Human
ucuucccugaagccccaucucagucaccauug

SEQ ID NO: 509859 - RNA, 32 nt, Human
ucuucccugacccccauacccucacccuuaaa

SEQ ID NO: 509860 - RNA, 32 nt, Human
ucuucccugaucaguccucccagacugcacug

SEQ ID NO: 509861 - RNA, 32 nt, Human
ucuucccugcagccauguaagaccugccuuuc

SEQ ID NO: 509862 - RNA, 32 nt, Human
ucuucccugcagcuuccaagggcugcaucaag

SEQ ID NO: 509863 - RNA, 32 nt, Human
ucuucccuggacaucacugccucuccagggca

SEQ ID NO: 509864 - RNA, 32 nt, Human
ucuucccuggcagcugugauguguugugcggu

SEQ ID NO: 509865 - RNA, 32 nt, Human
ucuucccugggccacauuggaagaagaaaaau

SEQ ID NO: 509866 - RNA, 32 nt, Human
ucuucccuguaaaaugcagauuacagguauua

SEQ ID NO: 509867 - RNA, 32 nt, Human
ucuucccuguauuuucuuucucuacuuugagg

SEQ ID NO: 509868 - RNA, 28 nt, Human
ucuucccugucugcugccucuccagucc

SEQ ID NO: 509869 - RNA, 32 nt, Human
ucuucccuguguucccagcuggagggacauga

SEQ ID NO: 509870 - RNA, 32 nt, Human
ucuucccuucuuucugguuggugcugcugggc

SEQ ID NO: 509871 - RNA, 32 nt, Human
ucuucccuuguccuauaccgggaacuccccuc

SEQ ID NO: 509872 - RNA, 32 nt, Human
ucuuccgaguagcugggauuacaggcgugugc

SEQ ID NO: 509873 - RNA, 32 nt, Human
ucuuccgcacacaccagagcagcugcucugac

SEQ ID NO: 509874 - RNA, 32 nt, Human
ucuuccgccucccggguucaagcgauucuccu

SEQ ID NO: 509875 - RNA, 32 nt, Human
ucuuccgccugccucugcuuccccgucaugca

SEQ ID NO: 509876 - RNA, 32 nt, Human
ucuuccgcucacugcaaccucugcuucccggg

SEQ ID NO: 509877 - RNA, 32 nt, Human
ucuuccggagccaaggugggggcgcagagggc

SEQ ID NO: 509878 - RNA, 32 nt, Human
ucuuccggagucaggcaggaaggagaagcaca

SEQ ID NO: 509879 - RNA, 32 nt, Human
ucuuccggaguguggcuggcggagcugggaug

SEQ ID NO: 509880 - RNA, 32 nt, Human
ucuuccgggaggacgacgguggagccgaucug

SEQ ID NO: 509881 - RNA, 32 nt, Human
ucuuccggguagcugggacuacaggugugcac

SEQ ID NO: 509882 - RNA, 18 nt, Human
ucuuccggugcuuuccca

SEQ ID NO: 509883 - RNA, 32 nt, Human
ucuuccggugcuuucccauccugggccacugu

SEQ ID NO: 509884 - RNA, 32 nt, Human
ucuuccgugacgucacuggaccacugggcaau

SEQ ID NO: 509885 - RNA, 32 nt, Human
ucuuccgugcaggcaggcucuccuggggaccu

SEQ ID NO: 509886 - RNA, 32 nt, Human
ucuuccguggagggcuuagagaggggaagcca

SEQ ID NO: 509887 - RNA, 32 nt, Human
ucuuccgugguggugcagcaccccaggaacuu

SEQ ID NO: 509888 - RNA, 32 nt, Human
ugaaauuaacugccauacuaccucucaguaug

SEQ ID NO: 509889 - RNA, 32 nt, Human
ugaaauuaagagaagagagggagugaagggug

SEQ ID NO: 509890 - RNA, 32 nt, Human
ugaaauuaagguauggggcaugguggccucag

SEQ ID NO: 509891 - RNA, 32 nt, Human
ugaaauuaagugacauuuggauuuuuauuugg

SEQ ID NO: 509892 - RNA, 32 nt, Human
ugaaauuaauacuagcauauuaaguguacaaa

SEQ ID NO: 509893 - RNA, 20 nt, Human
ugaaauuacaggcaugagcc

SEQ ID NO: 509894 - RNA, 23 nt, Human
ugaaauuagugccuguuuucuug

SEQ ID NO: 509895 - RNA, 32 nt, Human
ugaaauuaugcuuccuaaaaucucaagccaaa

SEQ ID NO: 509896 - RNA, 32 nt, Human
ugaaauuauggucacacuauauacuauagcau

SEQ ID NO: 509897 - RNA, 32 nt, Human
ugaaauuauuuauuuuccuuucuauggauuau

SEQ ID NO: 509898 - RNA, 32 nt, Human
ugaaauucaaaucacauuucuccuucacucua

SEQ ID NO: 509899 - RNA, 32 nt, Human
ugaaauucacacucucaaccaccuacugggcg

SEQ ID NO: 509900 - RNA, 32 nt, Human
ugaaauucagccuguggauuccagaaauuugg

SEQ ID NO: 509901 - RNA, 32 nt, Human
ugaaauucaggaugcugugauacacugaaagg

SEQ ID NO: 509902 - RNA, 20 nt, Human
ugaaauucggggccagggaa

SEQ ID NO: 509903 - RNA, 32 nt, Human
ugaaauucuacccuccucaguuuucuguuuuu

SEQ ID NO: 509904 - RNA, 32 nt, Human
ugaaauucucagaacagcuaaccucuaauggg

SEQ ID NO: 509905 - RNA, 32 nt, Human
ugaaauucuccaucuuuucauuuccuuuauau

SEQ ID NO: 509906 - RNA, 32 nt, Human
ugaaauucuccuccuucuucccuuuccagcaa

SEQ ID NO: 509907 - RNA, 32 nt, Human
ugaaauucugacaucugccacuccucaucccc

SEQ ID NO: 509908 - RNA, 32 nt, Human
ugaaauucugaccuuugaaauaaugucaacag

SEQ ID NO: 509909 - RNA, 32 nt, Human
ugaaauugaagaugaggaaaguagcuguacac

SEQ ID NO: 509910 - RNA, 32 nt, Human
ugaaauugacccagcuccaccauacuccuuga

SEQ ID NO: 509911 - RNA, 32 nt, Human
ugaaauugccagaguuuugccugcugcuuucc

SEQ ID NO: 509912 - RNA, 32 nt, Human
ugaaauuggaaagcagagguugcagugagcug

SEQ ID NO: 509913 - RNA, 32 nt, Human
ugaaauuggaaccugggccuccugacuuuggc

SEQ ID NO: 509914 - RNA, 19 nt, Human
ugaaauugggaacucggaa

SEQ ID NO: 509915 - RNA, 32 nt, Human
ugaaauuguacuuccaggcuuggauguaauuu

SEQ ID NO: 509916 - RNA, 32 nt, Human
ugaaauugugccacugcacuccagacugggug

SEQ ID NO: 509917 - RNA, 32 nt, Human
ugaaauugugccacugcacuuuucagccuggg

SEQ ID NO: 509918 - RNA, 32 nt, Human
ugaaauugugcuauugcacuccagccugggug

SEQ ID NO: 509919 - RNA, 32 nt, Human
ugaaauuucauagcuuauuucaguuuaauuuu

SEQ ID NO: 509920 - RNA, 32 nt, Human
ugaaauuuccauauugagagaagccaaacauu

SEQ ID NO: 509921 - RNA, 32 nt, Human
ugaaauuuccauccauaggaaaauggauagac

SEQ ID NO: 509922 - RNA, 32 nt, Human
ugaaauuugagaacugcuggaccagagccuuu

SEQ ID NO: 509923 - RNA, 32 nt, Human
ugaaauuugaggcgcccaggccccagaaguca

SEQ ID NO: 509924 - RNA, 32 nt, Human
ugaaauuugcuuguagagaugggaucucacuc

SEQ ID NO: 509925 - RNA, 32 nt, Human
ugaaauuugggaacaggcagggugugguggcu

SEQ ID NO: 509926 - RNA, 32 nt, Human
ugaaauuuucacaagaauguuugcugacccuc

SEQ ID NO: 509927 - RNA, 32 nt, Human
ugaaauuuugugagacuuuuccugcacuggac

SEQ ID NO: 509928 - RNA, 32 nt, Human
ugaaauuuuuggaacuugcuggacagggugau

SEQ ID NO: 509929 - RNA, 32 nt, Human
ugaacaaaaauuaaggaaggaaaacacgguuu

SEQ ID NO: 509930 - RNA, 32 nt, Human
ugaacaaaagaugcucuucuguggaccacugc

SEQ ID NO: 509931 - RNA, 32 nt, Human
ugaacaaaaugagaugaaagccgagcuggacc

SEQ ID NO: 509932 - RNA, 23 nt, Human
ugaacaaagacaucuaaauaucu

SEQ ID NO: 509933 - RNA, 32 nt, Human
ugaacaaagccucuggggaggccaggcacggu

SEQ ID NO: 509934 - RNA, 32 nt, Human
ugaacaaaggaugcugauggauucaagccagc

SEQ ID NO: 509935 - RNA, 32 nt, Human
ugaacaaaggcuucacuuguccucauccuuua

SEQ ID NO: 509936 - RNA, 32 nt, Human
ugaacaaaggucucuggucuucccaggcagag

SEQ ID NO: 509937 - RNA, 32 nt, Human
ugaacaaaguagaagaaagaaugaaagaauug

SEQ ID NO: 509938 - RNA, 32 nt, Human
ugaacaaaguuggagguuggggugggugugug

SEQ ID NO: 509939 - RNA, 32 nt, Human
ugaacaaauccucugaccucaggccggcugug

SEQ ID NO: 509940 - RNA, 32 nt, Human
ugaacaacaggagggagggaaagagcccaggu

SEQ ID NO: 509941 - RNA, 32 nt, Human
ugaacaacauggcaaaacccugucucugcaaa

SEQ ID NO: 509942 - RNA, 32 nt, Human
ugaacaaccagaccucuucauuccacaucuaa

SEQ ID NO: 509943 - RNA, 32 nt, Human
ugaacaaccugagcuccugggccgggguggaa

SEQ ID NO: 509944 - RNA, 22 nt, Human
ugaacaaccugcuccugaauga

SEQ ID NO: 509945 - RNA, 32 nt, Human
ugaacaacgcagguucaaacugugcaggucca

SEQ ID NO: 509946 - RNA, 25 nt, Human
ugaacaacguccugguggagagacu

SEQ ID NO: 509947 - RNA, 19 nt, Human
ugaacaacuccucugugaa

SEQ ID NO: 509948 - RNA, 32 nt, Human
ugaacaacuguaaucacaacacuuugggaggc

SEQ ID NO: 509949 - RNA, 32 nt, Human
ugaacaagaccacuuggcucccuggcuucagu

SEQ ID NO: 509950 - RNA, 32 nt, Human
ugaacaagagccaggagacccaggagggagcu

SEQ ID NO: 509951 - RNA, 31 nt, Human
ugaacaaggaaacuugucacaaguguuugua

SEQ ID NO: 509952 - RNA, 32 nt, Human
ugaacaaggaagcagcgcggcaccaagaaaag

SEQ ID NO: 509953 - RNA, 32 nt, Human
ugaacaaggggaagcucacaacaggaacucac

SEQ ID NO: 509954 - RNA, 32 nt, Human
ugaacaagguaggcagagguugcagugagcca

SEQ ID NO: 509955 - RNA, 32 nt, Human
ugaacaagguucagaaaacauuguuuacuaag

SEQ ID NO: 509956 - RNA, 32 nt, Human
ugaacaagucacaaccucccaggcuccucauu

SEQ ID NO: 509957 - RNA, 32 nt, Human
ugaacaauacagaugccuucccuuguagcagu

SEQ ID NO: 509958 - RNA, 21 nt, Human
ugaacaauagcuaagugucuu

SEQ ID NO: 509959 - RNA, 32 nt, Human
ugaacaaucugaaacaucccuauucuaaggcu

SEQ ID NO: 509960 - RNA, 32 nt, Human
ugaacaauuguggucucucuuaacuugagguu

SEQ ID NO: 509961 - RNA, 32 nt, Human
ugaacacaccucagagggaggauccuuguugu

SEQ ID NO: 509962 - RNA, 32 nt, Human
ugaacacagaagguggagguugcagugagcca

SEQ ID NO: 509963 - RNA, 32 nt, Human
ugaacacagaauaguaccuuacauuugcuaaa

SEQ ID NO: 509964 - RNA, 32 nt, Human
ugaacacagaugucucagcuggaaucuaaaca

SEQ ID NO: 509965 - RNA, 32 nt, Human
ugaacacagaugugaggggauuugaaccaucu

SEQ ID NO: 509966 - RNA, 32 nt, Human
ugaacacagcaguucugcagaggacgggaggc

SEQ ID NO: 509967 - RNA, 32 nt, Human
ugaacacaggaggcagagguugcagcgagcug

SEQ ID NO: 509968 - RNA, 32 nt, Human
ugaacacaggaggcagagguugcagugagccg

SEQ ID NO: 509969 - RNA, 32 nt, Human
ugaacacaggggaggcaggggaagaggcagga

SEQ ID NO: 509970 - RNA, 32 nt, Human
ugaacacagugcauggugccuccuggggcugc

SEQ ID NO: 509971 - RNA, 32 nt, Human
ugaacacauaugccauauacauauauaccaac

SEQ ID NO: 509972 - RNA, 32 nt, Human
ugaacacauauguaccuacauacauacauaaa

SEQ ID NO: 509973 - RNA, 32 nt, Human
ugaacaccaccaggagcggagggagccuggug

SEQ ID NO: 509974 - RNA, 32 nt, Human
ugaacaccacugcacuccaccuguccacuugu

SEQ ID NO: 509975 - RNA, 32 nt, Human
ugaacacccaaaacgccauugccuuccgcaga

SEQ ID NO: 509976 - RNA, 32 nt, Human
ugaacacccauacauacacauauccacacaug

SEQ ID NO: 509977 - RNA, 32 nt, Human
ugaacaccccaggccugcugaggucccuccuu

SEQ ID NO: 509978 - RNA, 32 nt, Human
ugaacacccuccuuucacucccaaaugcaaac

SEQ ID NO: 509979 - RNA, 32 nt, Human
ugaacaccugaggccuuccuguggcccaccag

SEQ ID NO: 509980 - RNA, 32 nt, Human
ugaacaccuguaaucccagcuacuuggaaggc

SEQ ID NO: 509981 - RNA, 32 nt, Human
ugaacacgcugacugugaaccugcccuguauc

SEQ ID NO: 509982 - RNA, 32 nt, Human
ugaacacgggaggcagagguugcagugagcag

SEQ ID NO: 509983 - RNA, 32 nt, Human
ugaacacgggcuuugaacucuccuacuccugu

SEQ ID NO: 509984 - RNA, 32 nt, Human
ugaacacguaaacaacacagacuucaagcaau

SEQ ID NO: 509985 - RNA, 32 nt, Human
ugaacacuaaacauugcuagaaacccacccac

SEQ ID NO: 509986 - RNA, 32 nt, Human
ugaacacuacugggguauauucaggcucaucc

SEQ ID NO: 509987 - RNA, 32 nt, Human
ugaacacuagaacuguuaaucaccuuuaaaaa

SEQ ID NO: 509988 - RNA, 32 nt, Human
ugaacacuaucaaauccagucucagggacagu

SEQ ID NO: 509989 - RNA, 32 nt, Human
ugaacacugacugcacuuaccagucugauuuu

SEQ ID NO: 509990 - RNA, 32 nt, Human
ugaacacuggcugugugccuggcacuguuagg

SEQ ID NO: 509991 - RNA, 32 nt, Human
ugaacacuuucugcuuuccuuccuccaaagaa

SEQ ID NO: 509992 - RNA, 32 nt, Human
ugaacagaacaaaacccccgcacuccaggaag

SEQ ID NO: 509993 - RNA, 32 nt, Human
ugaacagaacaggaaucugaugaacaagcugg

SEQ ID NO: 509994 - RNA, 32 nt, Human
ugaacagaccacugcaucucacugggccagca

SEQ ID NO: 509995 - RNA, 32 nt, Human
ugaacagagaauuucuggagaaagagugccac

SEQ ID NO: 509996 - RNA, 32 nt, Human
ugaacagagccugggcggaugcagcccgcgac

SEQ ID NO: 509997 - RNA, 32 nt, Human
ugaacagagcuagaggccaugucuccugcaua

SEQ ID NO: 509998 - RNA, 32 nt, Human
ugaacagauaagagguggaggaggugacaggg

SEQ ID NO: 509999 - RNA, 32 nt, Human
ugaacagccauaaaagcacacuaccuuguagu

SEQ ID NO: 510000 - RNA, 32 nt, Human
ugaacagcuccauuucugugcacauguuggug

SEQ ID NO: 510001 - RNA, 23 nt, Human
ugaacagcugaggcagccccucc

SEQ ID NO: 510002 - RNA, 32 nt, Human
ugaacagcuguggaagucggagucucgggagc

SEQ ID NO: 510003 - RNA, 23 nt, Human
ugaacagcuguggcagccccucc

SEQ ID NO: 510004 - RNA, 32 nt, Human
ugaacagcuuuucaaguauuuggggaguuuau

SEQ ID NO: 510005 - RNA, 32 nt, Human
ugaacaggagaaaaggaacuaauggaccugug

SEQ ID NO: 510006 - RNA, 22 nt, Human
ugaacaggagaaucgcuugaac

SEQ ID NO: 510007 - RNA, 32 nt, Human
ugaacaggcacagcccucccaucuucccaaug

SEQ ID NO: 510008 - RNA, 32 nt, Human
ugaacagggaagcagagguugcggugaaccgg

SEQ ID NO: 510009 - RNA, 32 nt, Human
ugaacagggaggcagagguugcagugagccga

SEQ ID NO: 510010 - RNA, 32 nt, Human
ugaacaggggagauggagguugcagugagcug

SEQ ID NO: 510011 - RNA, 32 nt, Human
ugaacagguuucuucucuacugugccuucauc

SEQ ID NO: 510012 - RNA, 32 nt, Human
ugaacaguggccuggcuggcguggcagggcca

SEQ ID NO: 510013 - RNA, 32 nt, Human
ugaacagugguggcugggcucacagcuccauc

SEQ ID NO: 510014 - RNA, 32 nt, Human
ugaacaguguaugacucaaacagcugccuuac

SEQ ID NO: 510015 - RNA, 32 nt, Human
ugaacaguguguggggauuugcuuguauguau

SEQ ID NO: 510016 - RNA, 32 nt, Human
ugaacaguuaaauuaugcaaaacaacugaaag

SEQ ID NO: 510017 - RNA, 32 nt, Human
ugaacaguucuuuuguuuucucuccuuuuacu

SEQ ID NO: 510018 - RNA, 32 nt, Human
ugaacauagaagcgugaaggaaagggaggggc

SEQ ID NO: 510019 - RNA, 32 nt, Human
ugaacauaguaaaacuauugaauuucucuuaa

SEQ ID NO: 510020 - RNA, 25 nt, Human
ugaacauaugguaugguuauugcuu

SEQ ID NO: 510021 - RNA, 32 nt, Human
ugaacaucaagccuguuaauucuucaaagaau

SEQ ID NO: 510022 - RNA, 32 nt, Human
ugaacaucaccuaggagggccaugcaugugaa

SEQ ID NO: 510023 - RNA, 32 nt, Human
ugaacaucccuucucugcuccacaggaguguc

SEQ ID NO: 510024 - RNA, 32 nt, Human
ugaacaucguucuuucagaagugcugaaaaug

SEQ ID NO: 510025 - RNA, 32 nt, Human
ugaacaucuccuccccuucaugcccuagccug

SEQ ID NO: 510026 - RNA, 32 nt, Human
ugaacaucugcacuaggcccaagccuuggagu

SEQ ID NO: 510027 - RNA, 20 nt, Human
ugaacaugccugcgauccca

SEQ ID NO: 510028 - RNA, 32 nt, Human
ugaacaugcugagcaguugagcacuuuuccau

SEQ ID NO: 510029 - RNA, 30 nt, Human
ugaacauggcggcggugguagcugcuacgg

SEQ ID NO: 510030 - RNA, 32 nt, Human
ugaacaugggcaguuccccuggcuuguuugac

SEQ ID NO: 510031 - RNA, 32 nt, Human
ugaacaugggggccagagagcagauggacuga

SEQ ID NO: 510032 - RNA, 32 nt, Human
ugaacaugguagacagagguugcagugagcca

SEQ ID NO: 510033 - RNA, 32 nt, Human
ugaacauguuacagugcugcagagauuuuauu

SEQ ID NO: 510034 - RNA, 32 nt, Human
ugaacauguuacagugcugcagagauuuuguu

SEQ ID NO: 510035 - RNA, 32 nt, Human
ugaacauucaacuaccauaugacccagcaauu

SEQ ID NO: 510036 - RNA, 32 nt, Human
ugaacauuccuggagaaaacagugauguggau

SEQ ID NO: 510037 - RNA, 32 nt, Human
ugaacauuuauugaucuucuacauacaagacu

SEQ ID NO: 510038 - RNA, 32 nt, Human
ugaacauuuccuuccaggaaugaaagagaacc

SEQ ID NO: 510039 - RNA, 32 nt, Human
ugaaccaaacaaaaacaauaacuacaacaacu

SEQ ID NO: 510040 - RNA, 32 nt, Human
ugaaccaaagagaccuccuuguuucagcuggg

SEQ ID NO: 510041 - RNA, 32 nt, Human
ugaaccaacagaccucugcuggcaucugcgau

SEQ ID NO: 510042 - RNA, 32 nt, Human
ugaaccaacccccaucucccuagcccaccccc

SEQ ID NO: 510043 - RNA, 32 nt, Human
ugaaccaaggaggcagagguuguaguaagcug

SEQ ID NO: 510044 - RNA, 32 nt, Human
ugaaccaaggagguggagguugcagugagccg

SEQ ID NO: 510045 - RNA, 32 nt, Human
ugaaccaaggaguucaaguuuagccugggcag

SEQ ID NO: 510046 - RNA, 32 nt, Human
ugaaccaagggaggagucaggaagagacaccc

SEQ ID NO: 510047 - RNA, 32 nt, Human
ugaaccaagggaggggucaggaagagacaccc

SEQ ID NO: 510048 - RNA, 32 nt, Human
ugaaccaagguggcagagguugcaguaagcca

SEQ ID NO: 510049 - RNA, 32 nt, Human
ugaaccaaguaguauucauguuguuauuauau

SEQ ID NO: 510050 - RNA, 32 nt, Human
ugaaccacaacaaacacgcuuucuccuugaau

SEQ ID NO: 510051 - RNA, 32 nt, Human
ugaaccacaggagaggauggcccagggugagg

SEQ ID NO: 510052 - RNA, 32 nt, Human
ugaaccacauccuguccuaucucccccaaacc

SEQ ID NO: 510053 - RNA, 32 nt, Human
ugaaccacucacugcugcgccuggaccucgac

SEQ ID NO: 510054 - RNA, 32 nt, Human
ugaaccacugaauucaggggaugggggugggg

SEQ ID NO: 510055 - RNA, 32 nt, Human
ugaaccacugcacccagccaauggguguaauu

SEQ ID NO: 510056 - RNA, 32 nt, Human
ugaaccacugcacccagccuaucuuuugcauu

SEQ ID NO: 510057 - RNA, 32 nt, Human
ugaaccacugcacccagccugcugauccuuuc

SEQ ID NO: 510058 - RNA, 32 nt, Human
ugaaccacugcaccuggcccuggauugcauuu

SEQ ID NO: 510059 - RNA, 32 nt, Human
ugaaccagaaguagcugggcauuggagucaug

SEQ ID NO: 510060 - RNA, 32 nt, Human
ugaaccagagagguggagguugcagugaaccg

SEQ ID NO: 510061 - RNA, 32 nt, Human
ugaaccagagugugcccugccccucaugcuca

SEQ ID NO: 510062 - RNA, 32 nt, Human
ugaaccagcggugaggcaggagcccagacccu

SEQ ID NO: 510063 - RNA, 32 nt, Human
ugaaccaggaaaaucaguaaagugauuguaaa

SEQ ID NO: 510064 - RNA, 32 nt, Human
ugaaccaggaaggcagagguugcacugagcug

SEQ ID NO: 510065 - RNA, 32 nt, Human
ugaaccaggagacggagguugcagugagcuga

SEQ ID NO: 510066 - RNA, 32 nt, Human
ugaaccaggagacggagguuucagugaaugaa

SEQ ID NO: 510067 - RNA, 32 nt, Human
ugaaccaggagguggacguugcagugauccca

SEQ ID NO: 510068 - RNA, 32 nt, Human
ugaaccaggauggggagguugcagugagccga

SEQ ID NO: 510069 - RNA, 32 nt, Human
ugaaccaggcugucgaagcauuggugcccuca

SEQ ID NO: 510070 - RNA, 32 nt, Human
ugaaccagggaagcggagguugcagugagccg

SEQ ID NO: 510071 - RNA, 32 nt, Human
ugaaccagggaaugggggcagccucuagaggc

SEQ ID NO: 510072 - RNA, 32 nt, Human
ugaaccagggaggaggagcuugcagugagccg

SEQ ID NO: 510073 - RNA, 32 nt, Human
ugaaccagggaggcagagauugcagugagccg

SEQ ID NO: 510074 - RNA, 32 nt, Human
ugaaccagggaggcagaggcugcggugagccg

SEQ ID NO: 510075 - RNA, 32 nt, Human
ugaaccagggaggcagagguugcagugagccc

SEQ ID NO: 510076 - RNA, 32 nt, Human
ugaaccagggaggcagagguuguggugagccg

SEQ ID NO: 510077 - RNA, 32 nt, Human
ugaaccagggaggcagaguuugcagugaaugg

SEQ ID NO: 510078 - RNA, 32 nt, Human
ugaaccagggaggcggagguugcagcaagcca

SEQ ID NO: 510079 - RNA, 32 nt, Human
ugaaccagggaggcggagguugcagugagccg

SEQ ID NO: 510080 - RNA, 32 nt, Human
ugaaccagggaggcggcgguuguggugagcug

SEQ ID NO: 510081 - RNA, 32 nt, Human
ugaaccagggagguggagggugccuguaaucc

SEQ ID NO: 510082 - RNA, 32 nt, Human
ugaaccagggagguggagguugcagugagcca

SEQ ID NO: 510083 - RNA, 32 nt, Human
ugaaccagggagguggagguugcagugagccg

SEQ ID NO: 510084 - RNA, 32 nt, Human
ugaaccagggagguggagguugcagugagcug

SEQ ID NO: 510085 - RNA, 32 nt, Human
ugaaccagggagucagagguuucagugagcca

SEQ ID NO: 510086 - RNA, 32 nt, Human
ugaaccagggagucggagauugcagugagcug

SEQ ID NO: 510087 - RNA, 32 nt, Human
ugaaccaguggcucagccaucugugccaagga

SEQ ID NO: 510088 - RNA, 32 nt, Human
ugaaccaguguggccgagguugcagugagugu

SEQ ID NO: 510089 - RNA, 32 nt, Human
ugaaccaguucugcaagugacuguguuuugua

SEQ ID NO: 510090 - RNA, 32 nt, Human
ugaaccauaagaaauugccaguguacaauuuc

SEQ ID NO: 510091 - RNA, 18 nt, Human
ugaaccaucuaucuccag

SEQ ID NO: 510092 - RNA, 32 nt, Human
ugaaccaucugagaagcuuggaagaggacccc

SEQ ID NO: 510093 - RNA, 32 nt, Human
ugaaccaugauugcacuccaaccugggcgaca

SEQ ID NO: 510094 - RNA, 32 nt, Human
ugaaccaugccagaugccaggaaaggugggag

SEQ ID NO: 510095 - RNA, 32 nt, Human
ugaacccaaaaggcagacauugcagugagcca

SEQ ID NO: 510096 - RNA, 32 nt, Human
ugaacccaagaggcagaggaugcaaugagcca

SEQ ID NO: 510097 - RNA, 32 nt, Human
ugaacccaagaggcagagguugcagugaacug

SEQ ID NO: 510098 - RNA, 32 nt, Human
ugaacccaagaggcagaguuugcagugagcug

SEQ ID NO: 510099 - RNA, 32 nt, Human
ugaacccaagaggcggagguugcagugagcca

SEQ ID NO: 510100 - RNA, 32 nt, Human
ugaacccaagaggcggagguuguggugagccg

SEQ ID NO: 510101 - RNA, 32 nt, Human
ugaacccaagagguccaaggcugcagugagcc

SEQ ID NO: 510102 - RNA, 32 nt, Human
ugaacccaagagguggaggcugaagugagcca

SEQ ID NO: 510103 - RNA, 32 nt, Human
ugaacccaagagguggagguugcggugagcca

SEQ ID NO: 510104 - RNA, 32 nt, Human
ugaacccaaucuuaaaggagguucucaugccc

SEQ ID NO: 510105 - RNA, 32 nt, Human
ugaacccacagggcagaggucacagugagcca

SEQ ID NO: 510106 - RNA, 32 nt, Human
ugaacccacaugcucccuacagccagcggccg

SEQ ID NO: 510107 - RNA, 32 nt, Human
ugaacccagaaagcggagguugcagugaccug

SEQ ID NO: 510108 - RNA, 32 nt, Human
ugaacccagaagacagguugcagugagccaag

SEQ ID NO: 510109 - RNA, 32 nt, Human
ugaacccagaagcggagguugcagugagcuga

SEQ ID NO: 510110 - RNA, 32 nt, Human
ugaacccagaaggcagagguugcagugagcug

SEQ ID NO: 510111 - RNA, 32 nt, Human
ugaacccagaaggcagagguugcaugaugcaa

SEQ ID NO: 510112 - RNA, 32 nt, Human
ugaacccagaaggcggaaguugcagugagccg

SEQ ID NO: 510113 - RNA, 32 nt, Human
ugaacccagaaggcggaaguugcagugagcug

SEQ ID NO: 510114 - RNA, 32 nt, Human
ugaacccagaagguagagguugcagccaagau

SEQ ID NO: 510115 - RNA, 32 nt, Human
ugaacccagaaggugcagguugcagugagcug

SEQ ID NO: 510116 - RNA, 32 nt, Human
ugaacccagaagguggagguagcagugagccg

SEQ ID NO: 510117 - RNA, 32 nt, Human
ugaacccagaggcggagguuguagugagccga

SEQ ID NO: 510118 - RNA, 32 nt, Human
ugaacccagauagcagagguugcagugagcug

SEQ ID NO: 510119 - RNA, 32 nt, Human
ugaacccagauugcccacugcacuccagccug

SEQ ID NO: 510120 - RNA, 32 nt, Human
ugaacccagcagauggagguugcagugagcca

SEQ ID NO: 510121 - RNA, 32 nt, Human
ugaacccagcaggcagagguugcagugagcca

SEQ ID NO: 510122 - RNA, 32 nt, Human
ugaacccagcaggcggagguugcggugagucg

SEQ ID NO: 510123 - RNA, 32 nt, Human
ugaacccagccggcuccaucucagcuucuggu

SEQ ID NO: 510124 - RNA, 32 nt, Human
ugaacccagcgggaagagguugcagugagcca

SEQ ID NO: 510125 - RNA, 32 nt, Human
ugaacccaggaagaggagguugcagugagccg

SEQ ID NO: 510126 - RNA, 32 nt, Human
ugaacccaggaagcagagguugcaguaagcug

SEQ ID NO: 510127 - RNA, 32 nt, Human
ugaacccaggaagcagagguugcagugagcag

SEQ ID NO: 510128 - RNA, 32 nt, Human
ugaacccaggaagcagagguugcagugagcug

SEQ ID NO: 510129 - RNA, 32 nt, Human
ugaacccaggaagcggagguugcagugagccg

SEQ ID NO: 510130 - RNA, 32 nt, Human
ugaacccaggaagcggagguuguggugagcca

SEQ ID NO: 510131 - RNA, 32 nt, Human
ugaacccaggaagcgggguugcagugagccaa

SEQ ID NO: 510132 - RNA, 32 nt, Human
ugaacccaggaaguagagguugcagugagccg

SEQ ID NO: 510133 - RNA, 32 nt, Human
ugaacccaggaaguggagguugcagugagccg

SEQ ID NO: 510134 - RNA, 32 nt, Human
ugaacccaggaaguggagguugcagugagcua

SEQ ID NO: 510135 - RNA, 32 nt, Human
ugaacccaggaaguggagguugcagugagcug

SEQ ID NO: 510136 - RNA, 32 nt, Human
ugaacccaggaaguggcaguugcagugagccg

SEQ ID NO: 510137 - RNA, 32 nt, Human
ugaacccaggacacggagauugcagugagcca

SEQ ID NO: 510138 - RNA, 32 nt, Human
ugaacccaggacgcagagguugcggugagcca

SEQ ID NO: 510139 - RNA, 32 nt, Human
ugaacccaggagacagagguugcagugagcca

SEQ ID NO: 510140 - RNA, 32 nt, Human
ugaacccaggagacagagguuguagugagcug

SEQ ID NO: 510141 - RNA, 32 nt, Human
ugaacccaggagacagagguugugguggggca

SEQ ID NO: 510142 - RNA, 32 nt, Human
ugaacccaggagacagggguugcagugagcca

SEQ ID NO: 510143 - RNA, 32 nt, Human
ugaacccaggagacagguugcagugagccgag

SEQ ID NO: 510144 - RNA, 32 nt, Human
ugaacccaggagacauggguugcagugagccg

SEQ ID NO: 510145 - RNA, 32 nt, Human
ugaacccaggagacgagguugcagugagccga

SEQ ID NO: 510146 - RNA, 32 nt, Human
ugaacccaggagacggaaguugcagugagcug

SEQ ID NO: 510147 - RNA, 32 nt, Human
ugaacccaggagacggagcuugcagugagccg

SEQ ID NO: 510148 - RNA, 32 nt, Human
ugaacccaggagacggagguugcagugagccg

SEQ ID NO: 510149 - RNA, 32 nt, Human
ugaacccaggagacggagguugcggugaguug

SEQ ID NO: 510150 - RNA, 32 nt, Human
ugaacccaggagacggugguugcagugagcca

SEQ ID NO: 510151 - RNA, 32 nt, Human
ugaacccaggagacggugguugcagugagcga

SEQ ID NO: 510152 - RNA, 32 nt, Human
ugaacccaggagaggaagguugcaguaagcug

SEQ ID NO: 510153 - RNA, 32 nt, Human
ugaacccaggagauagagguugcaaugagcca

SEQ ID NO: 510154 - RNA, 32 nt, Human
ugaacccaggagauggaaguugcagugagcug

SEQ ID NO: 510155 - RNA, 32 nt, Human
ugaacccaggagauggagauugcaguaggcca

SEQ ID NO: 510156 - RNA, 32 nt, Human
ugaacccaggagauggagguugcagugagcca

SEQ ID NO: 510157 - RNA, 32 nt, Human
ugaacccaggagauggagguugcagugagcug

SEQ ID NO: 510158 - RNA, 32 nt, Human
ugaacccaggagauggagguugcggugagcug

SEQ ID NO: 510159 - RNA, 32 nt, Human
ugaacccaggagauugagguuguagugagcug

SEQ ID NO: 510160 - RNA, 32 nt, Human
ugaacccaggaggaagagguugcagugagcca

SEQ ID NO: 510161 - RNA, 32 nt, Human
ugaacccaggaggaggagcuugcagugagccg

SEQ ID NO: 510162 - RNA, 32 nt, Human
ugaacccaggaggagguggagaucgcagugag

SEQ ID NO: 510163 - RNA, 32 nt, Human
ugaacccaggaggcacagauugcagugagcca

SEQ ID NO: 510164 - RNA, 32 nt, Human
ugaacccaggaggcacagcuugcagugagcga

SEQ ID NO: 510165 - RNA, 32 nt, Human
ugaacccaggaggcacagguugcagugagcca

SEQ ID NO: 510166 - RNA, 32 nt, Human
ugaacccaggaggcagaaguugcagugagcag

SEQ ID NO: 510167 - RNA, 32 nt, Human
ugaacccaggaggcagaaguugcagugagccg

SEQ ID NO: 510168 - RNA, 32 nt, Human
ugaacccaggaggcagaaguugcagugagcug

SEQ ID NO: 510169 - RNA, 32 nt, Human
ugaacccaggaggcagagaucgcagugaguug

SEQ ID NO: 510170 - RNA, 32 nt, Human
ugaacccaggaggcagagauugcagugagcca

SEQ ID NO: 510171 - RNA, 32 nt, Human
ugaacccaggaggcagagauugcagugagcug

SEQ ID NO: 510172 - RNA, 32 nt, Human
ugaacccaggaggcagagauugcggugagcca

SEQ ID NO: 510173 - RNA, 32 nt, Human
ugaacccaggaggcagagauugcggugagccg

SEQ ID NO: 510174 - RNA, 32 nt, Human
ugaacccaggaggcagagcuugcagugagcca

SEQ ID NO: 510175 - RNA, 32 nt, Human
ugaacccaggaggcagagcuugcagugagccg

SEQ ID NO: 510176 - RNA, 32 nt, Human
ugaacccaggaggcagagcuugcagugagccu

SEQ ID NO: 510177 - RNA, 32 nt, Human
ugaacccaggaggcagagcuugcagugagcug

SEQ ID NO: 510178 - RNA, 32 nt, Human
ugaacccaggaggcagagcuuguagugagccu

SEQ ID NO: 510179 - RNA, 32 nt, Human
ugaacccaggaggcagaggguugcagugagcc

SEQ ID NO: 510180 - RNA, 32 nt, Human
ugaacccaggaggcagagguuacaguaaaccg

SEQ ID NO: 510181 - RNA, 32 nt, Human
ugaacccaggaggcagagguuacagugagcag

SEQ ID NO: 510182 - RNA, 32 nt, Human
ugaacccaggaggcagagguugcaaugagcca

SEQ ID NO: 510183 - RNA, 32 nt, Human
ugaacccaggaggcagagguugcagcgagcug

SEQ ID NO: 510184 - RNA, 32 nt, Human
ugaacccaggaggcagagguugcaguaagcca

SEQ ID NO: 510185 - RNA, 32 nt, Human
ugaacccaggaggcagagguugcaguaagccu

SEQ ID NO: 510186 - RNA, 32 nt, Human
ugaacccaggaggcagagguugcagucagcca

SEQ ID NO: 510187 - RNA, 32 nt, Human
ugaacccaggaggcagagguugcagugagcca

SEQ ID NO: 510188 - RNA, 32 nt, Human
ugaacccaggaggcagagguugcagugagccg

SEQ ID NO: 510189 - RNA, 32 nt, Human
ugaacccaggaggcagagguugcagugagcua

SEQ ID NO: 510190 - RNA, 32 nt, Human
ugaacccaggaggcagagguugcagugagcug

SEQ ID NO: 510191 - RNA, 32 nt, Human
ugaacccaggaggcagagguugcagugaguca

SEQ ID NO: 510192 - RNA, 32 nt, Human
ugaacccaggaggcagagguugcagugcacca

SEQ ID NO: 510193 - RNA, 32 nt, Human
ugaacccaggaggcagagguugcagugcgcug

SEQ ID NO: 510194 - RNA, 32 nt, Human
ugaacccaggaggcagagguugcagugggcca

SEQ ID NO: 510195 - RNA, 32 nt, Human
ugaacccaggaggcagagguugcggugagccg

SEQ ID NO: 510196 - RNA, 32 nt, Human
ugaacccaggaggcagagguugcggugagucg

SEQ ID NO: 510197 - RNA, 32 nt, Human
ugaacccaggaggcagagguugcguugagcca

SEQ ID NO: 510198 - RNA, 32 nt, Human
ugaacccaggaggcagagguuggggugagcug

SEQ ID NO: 510199 - RNA, 32 nt, Human
ugaacccaggaggcagagguuguagugagcca

SEQ ID NO: 510200 - RNA, 32 nt, Human
ugaacccaggaggcagaguuugcagucagcca

SEQ ID NO: 510201 - RNA, 32 nt, Human
ugaacccaggaggcagaguuugcagugagcca

SEQ ID NO: 510202 - RNA, 32 nt, Human
ugaacccaggaggcagaguuugcagugagcug

SEQ ID NO: 510203 - RNA, 32 nt, Human
ugaacccaggaggcagcuguugcagugagcca

SEQ ID NO: 510204 - RNA, 32 nt, Human
ugaacccaggaggcagugauugcagugagcug

SEQ ID NO: 510205 - RNA, 32 nt, Human
ugaacccaggaggcagugguugcaaugagccg

SEQ ID NO: 510206 - RNA, 32 nt, Human
ugaacccaggaggccgagguugcagugagcca

SEQ ID NO: 510207 - RNA, 32 nt, Human
ugaacccaggaggcgaagauugccgugagccg

SEQ ID NO: 510208 - RNA, 32 nt, Human
ugaacccaggaggcgaagguugcaguaaacca

SEQ ID NO: 510209 - RNA, 32 nt, Human
ugaacccaggaggcggaaguugcagugagcug

SEQ ID NO: 510210 - RNA, 32 nt, Human
ugaacccaggaggcggaccuuguagugagccg

SEQ ID NO: 510211 - RNA, 32 nt, Human
ugaacccaggaggcggagauugcagugagccg

SEQ ID NO: 510212 - RNA, 32 nt, Human
ugaacccaggaggcggagauugcagugagcug

SEQ ID NO: 510213 - RNA, 32 nt, Human
ugaacccaggaggcggagcuggcagugagcug

SEQ ID NO: 510214 - RNA, 32 nt, Human
ugaacccaggaggcggagcuugcagugagcag

SEQ ID NO: 510215 - RNA, 32 nt, Human
ugaacccaggaggcggagcuugcagugagcca

SEQ ID NO: 510216 - RNA, 32 nt, Human
ugaacccaggaggcggagcuugcagugagccg

SEQ ID NO: 510217 - RNA, 32 nt, Human
ugaacccaggaggcggagcuugcagugagcug

SEQ ID NO: 510218 - RNA, 32 nt, Human
ugaacccaggaggcggaggcagaggcugcagu

SEQ ID NO: 510219 - RNA, 32 nt, Human
ugaacccaggaggcggaggcugcagugagccc

SEQ ID NO: 510220 - RNA, 32 nt, Human
ugaacccaggaggcggaggcugcagugagcug

SEQ ID NO: 510221 - RNA, 32 nt, Human
ugaacccaggaggcggagguagcagugagcca

SEQ ID NO: 510222 - RNA, 32 nt, Human
ugaacccaggaggcggagguaguggugagcaa

SEQ ID NO: 510223 - RNA, 32 nt, Human
ugaacccaggaggcggagguuacagugagcca

SEQ ID NO: 510224 - RNA, 32 nt, Human
ugaacccaggaggcggagguugcacugagccg

SEQ ID NO: 510225 - RNA, 32 nt, Human
ugaacccaggaggcggagguugcagggaggga

SEQ ID NO: 510226 - RNA, 32 nt, Human
ugaacccaggaggcggagguugcaguaagcca

SEQ ID NO: 510227 - RNA, 32 nt, Human
ugaacccaggaggcggagguugcagugaaccg

SEQ ID NO: 510228 - RNA, 32 nt, Human
ugaacccaggaggcggagguugcagugacccg

SEQ ID NO: 510229 - RNA, 32 nt, Human
ugaacccaggaggcggagguugcagugagacg

SEQ ID NO: 510230 - RNA, 32 nt, Human
ugaacccaggaggcggagguugcagugagcag

SEQ ID NO: 510231 - RNA, 32 nt, Human
ugaacccaggaggcggagguugcagugagcca

SEQ ID NO: 510232 - RNA, 32 nt, Human
ugaacccaggaggcggagguugcagugagccg

SEQ ID NO: 510233 - RNA, 32 nt, Human
ugaacccaggaggcggagguugcagugagcuc

SEQ ID NO: 510234 - RNA, 32 nt, Human
ugaacccaggaggcggagguugcagugagcug

SEQ ID NO: 510235 - RNA, 32 nt, Human
ugaacccaggaggcggagguugcagugaucca

SEQ ID NO: 510236 - RNA, 32 nt, Human
ugaacccaggaggcggagguugccgugagcca

SEQ ID NO: 510237 - RNA, 32 nt, Human
ugaacccaggaggcggagguugcggugagcca

SEQ ID NO: 510238 - RNA, 32 nt, Human
ugaacccaggaggcggagguugcggugagccg

SEQ ID NO: 510239 - RNA, 32 nt, Human
ugaacccaggaggcggagguugcggugagcug

SEQ ID NO: 510240 - RNA, 32 nt, Human
ugaacccaggaggcggagguugcggugaguug

SEQ ID NO: 510241 - RNA, 32 nt, Human
ugaacccaggaggcggagguuguagugagcca

SEQ ID NO: 510242 - RNA, 32 nt, Human
ugaacccaggaggcggagguuguauaggcuga

SEQ ID NO: 510243 - RNA, 32 nt, Human
ugaacccaggaggcggagguuguggugagcca

SEQ ID NO: 510244 - RNA, 32 nt, Human
ugaacccaggaggcggaguuugcagugagcug

SEQ ID NO: 510245 - RNA, 32 nt, Human
ugaacccaggaggcggcgguugcagugagcca

SEQ ID NO: 510246 - RNA, 32 nt, Human
ugaacccaggaggcggggguugcagugagucg

SEQ ID NO: 510247 - RNA, 32 nt, Human
ugaacccaggaggcguagcuagcagugagcca

SEQ ID NO: 510248 - RNA, 32 nt, Human
ugaacccaggaggcugagguugcagugagcca

SEQ ID NO: 510249 - RNA, 32 nt, Human
ugaacccaggaggcugagguugcagugagccc

SEQ ID NO: 510250 - RNA, 32 nt, Human
ugaacccaggagguagaagcugcagugagcag

SEQ ID NO: 510251 - RNA, 32 nt, Human
ugaacccaggagguagaaguugcagugagccg

SEQ ID NO: 510252 - RNA, 32 nt, Human
ugaacccaggagguagaggcugcagugagcag

SEQ ID NO: 510253 - RNA, 32 nt, Human
ugaacccaggagguagaggcugcagugagccg

SEQ ID NO: 510254 - RNA, 32 nt, Human
ugaacccaggagguagaggcugcagugagcug

SEQ ID NO: 510255 - RNA, 32 nt, Human
ugaacccaggagguagagguugcagugagcca

SEQ ID NO: 510256 - RNA, 32 nt, Human
ugaacccaggagguagagguugcagugagccg

SEQ ID NO: 510257 - RNA, 32 nt, Human
ugaacccaggaggugaagguugcagugaccgg

SEQ ID NO: 510258 - RNA, 32 nt, Human
ugaacccaggaggugcagguugcagugagccg

SEQ ID NO: 510259 - RNA, 32 nt, Human
ugaacccaggagguggaaguugcuuugagccg

SEQ ID NO: 510260 - RNA, 32 nt, Human
ugaacccaggagguggacauuacagugagccc

SEQ ID NO: 510261 - RNA, 32 nt, Human
ugaacccaggagguggagauugcagugagcug

SEQ ID NO: 510262 - RNA, 32 nt, Human
ugaacccaggagguggagcuugcaaugagccg

SEQ ID NO: 510263 - RNA, 32 nt, Human
ugaacccaggagguggagcuugcagugagccg

SEQ ID NO: 510264 - RNA, 32 nt, Human
ugaacccaggagguggaggaugcagugaacug

SEQ ID NO: 510265 - RNA, 32 nt, Human
ugaacccaggagguggaggcugcagugagcug

SEQ ID NO: 510266 - RNA, 32 nt, Human
ugaacccaggagguggaggcugcggugagccg

SEQ ID NO: 510267 - RNA, 32 nt, Human
ugaacccaggagguggagguagcagugagccg

SEQ ID NO: 510268 - RNA, 32 nt, Human
ugaacccaggagguggagguuacagugagcca

SEQ ID NO: 510269 - RNA, 32 nt, Human
ugaacccaggagguggagguuacagugagcug

SEQ ID NO: 510270 - RNA, 32 nt, Human
ugaacccaggagguggagguuccagugagcca

SEQ ID NO: 510271 - RNA, 32 nt, Human
ugaacccaggagguggagguugcaagugagcu

SEQ ID NO: 510272 - RNA, 32 nt, Human
ugaacccaggagguggagguugcagcaagcag

SEQ ID NO: 510273 - RNA, 32 nt, Human
ugaacccaggagguggagguugcaguaagcca

SEQ ID NO: 510274 - RNA, 32 nt, Human
ugaacccaggagguggagguugcaguaagcug

SEQ ID NO: 510275 - RNA, 32 nt, Human
ugaacccaggagguggagguugcagugaacug

SEQ ID NO: 510276 - RNA, 32 nt, Human
ugaacccaggagguggagguugcagugagcag

SEQ ID NO: 510277 - RNA, 32 nt, Human
ugaacccaggagguggagguugcagugagcca

SEQ ID NO: 510278 - RNA, 32 nt, Human
ugaacccaggagguggagguugcagugagccg

SEQ ID NO: 510279 - RNA, 32 nt, Human
ugaacccaggagguggagguugcagugagcug

SEQ ID NO: 510280 - RNA, 32 nt, Human
ugaacccaggagguggagguugcagugaggca

SEQ ID NO: 510281 - RNA, 32 nt, Human
ugaacccaggagguggagguugcagugaguca

SEQ ID NO: 510282 - RNA, 32 nt, Human
ugaacccaggagguggagguugcagugagucg

SEQ ID NO: 510283 - RNA, 32 nt, Human
ugaacccaggagguggagguugcagugggccg

SEQ ID NO: 510284 - RNA, 32 nt, Human
ugaacccaggagguggagguugcaguuagcug

SEQ ID NO: 510285 - RNA, 32 nt, Human
ugaacccaggagguggagguugcggugagcug

SEQ ID NO: 510286 - RNA, 32 nt, Human
ugaacccaggagguggagguugcugugagcca

SEQ ID NO: 510287 - RNA, 32 nt, Human
ugaacccaggagguggagguuguagugagaca

SEQ ID NO: 510288 - RNA, 32 nt, Human
ugaacccaggagguggagguuguggugagcca

SEQ ID NO: 510289 - RNA, 32 nt, Human
ugaacccaggagguggagguuguggugagccg

SEQ ID NO: 510290 - RNA, 32 nt, Human
ugaacccaggagguggagguuguggugagcug

SEQ ID NO: 510291 - RNA, 32 nt, Human
ugaacccaggagguggaguuugcagugagcug

SEQ ID NO: 510292 - RNA, 32 nt, Human
ugaacccaggaggugggcauugcagugagccg

SEQ ID NO: 510293 - RNA, 32 nt, Human
ugaacccaggagguggggguugcaccgagcag

SEQ ID NO: 510294 - RNA, 32 nt, Human
ugaacccaggagguggugguugcagugagccu

SEQ ID NO: 510295 - RNA, 32 nt, Human
ugaacccaggagguguugcagugaaccaagau

SEQ ID NO: 510296 - RNA, 32 nt, Human
ugaacccaggagguugaagcugcggugggcca

SEQ ID NO: 510297 - RNA, 32 nt, Human
ugaacccaggagguugaggcugcagugaguca

SEQ ID NO: 510298 - RNA, 32 nt, Human
ugaacccaggagucagagguuucagugagccg

SEQ ID NO: 510299 - RNA, 32 nt, Human
ugaacccaggagucggagguugcagugaguug

SEQ ID NO: 510300 - RNA, 32 nt, Human
ugaacccaggaguucaagaauagccugggcaa

SEQ ID NO: 510301 - RNA, 32 nt, Human
ugaacccaggaguucaagaccagccuggacaa

SEQ ID NO: 510302 - RNA, 32 nt, Human
ugaacccaggaguucaagaccagccugggcag

SEQ ID NO: 510303 - RNA, 32 nt, Human
ugaacccaggaguucaagaucagccugggcaa

SEQ ID NO: 510304 - RNA, 32 nt, Human
ugaacccaggaguuggagcuugcagugagccg

SEQ ID NO: 510305 - RNA, 32 nt, Human
ugaacccaggaugcggagguugcagugagccg

SEQ ID NO: 510306 - RNA, 32 nt, Human
ugaacccaggcaguggagguugcagugagcca

SEQ ID NO: 510307 - RNA, 32 nt, Human
ugaacccaggcggcagagguugcagugagucg

SEQ ID NO: 510308 - RNA, 32 nt, Human
ugaacccagggggcagagguugcagugagccg

SEQ ID NO: 510309 - RNA, 32 nt, Human
ugaacccaggggguggagguugcacugagccg

SEQ ID NO: 510310 - RNA, 32 nt, Human
ugaacccaggugucccggaaaggggcugcagg

SEQ ID NO: 510311 - RNA, 32 nt, Human
ugaacccagguuguggagguuguagugagccg

SEQ ID NO: 510312 - RNA, 32 nt, Human
ugaacccaguagaggaagguugcaguaagcug

SEQ ID NO: 510313 - RNA, 32 nt, Human
ugaacccaguaggcggaaguugcagugagcug

SEQ ID NO: 510314 - RNA, 32 nt, Human
ugaacccagugagccgagaucgugccacugca

SEQ ID NO: 510315 - RNA, 32 nt, Human
ugaacccaguggcggaggcugcagugagccga

SEQ ID NO: 510316 - RNA, 32 nt, Human
ugaacccaguguaggagaguucagcugaaauc

SEQ ID NO: 510317 - RNA, 32 nt, Human
ugaacccauaaggcagagguugcagugagcug

SEQ ID NO: 510318 - RNA, 32 nt, Human
ugaacccaucaucucuuggaauuaaguguccu

SEQ ID NO: 510319 - RNA, 32 nt, Human
ugaacccaugaggcggagguugcagugagccg

SEQ ID NO: 510320 - RNA, 32 nt, Human
ugaacccaugagguggagguugcggugagcca

SEQ ID NO: 510321 - RNA, 28 nt, Human
ugaaccccaaguguguaccucauucuuc

SEQ ID NO: 510322 - RNA, 32 nt, Human
ugaaccccacaguccgccuggccagaccuccu

SEQ ID NO: 510323 - RNA, 32 nt, Human
ugaaccccagaggcagaggcugaagugagcca

SEQ ID NO: 510324 - RNA, 32 nt, Human
ugaaccccagaggcagagguugcagugagcug

SEQ ID NO: 510325 - RNA, 32 nt, Human
ugaaccccagaggcagagguugcggugagccg

SEQ ID NO: 510326 - RNA, 32 nt, Human
ugaaccccagaggcggagguugcagugagccg

SEQ ID NO: 510327 - RNA, 32 nt, Human
ugaaccccagaggcuuccccagcccuggggau

SEQ ID NO: 510328 - RNA, 32 nt, Human
ugaaccccagaggucaagacugcagugagcug

SEQ ID NO: 510329 - RNA, 32 nt, Human
ugaaccccagagguggagguugcagugagccg

SEQ ID NO: 510330 - RNA, 32 nt, Human
ugaaccccagggugggaccccagcacagaggc

SEQ ID NO: 510331 - RNA, 32 nt, Human
ugaacccccaaagcaucuuucucuccacaaag

SEQ ID NO: 510332 - RNA, 32 nt, Human
ugaacccccaaggcggagcuugcagugagccg

SEQ ID NO: 510333 - RNA, 22 nt, Human
ugaacccccacccuacccccua

SEQ ID NO: 510334 - RNA, 32 nt, Human
ugaacccccaggcuggaguacaguggcaggau

SEQ ID NO: 510335 - RNA, 32 nt, Human
ugaacccccuccuggggagccaggcucacagg

SEQ ID NO: 510336 - RNA, 32 nt, Human
ugaacccccugccuuucuugcagccuacaacg

SEQ ID NO: 510337 - RNA, 32 nt, Human
ugaaccccggagauggagguugcagugagcca

SEQ ID NO: 510338 - RNA, 32 nt, Human
ugaaccccggaggcagagguuucagugagccg

SEQ ID NO: 510339 - RNA, 32 nt, Human
ugaaccccggaggcggagcuugcagugagccg

SEQ ID NO: 510340 - RNA, 32 nt, Human
ugaaccccggaggcggagguugcagugagcug

SEQ ID NO: 510341 - RNA, 32 nt, Human
ugaaccccggagguagagguugcagugagccg

SEQ ID NO: 510342 - RNA, 32 nt, Human
ugaaccccuccccaugaacacaaggguuuuau

SEQ ID NO: 510343 - RNA, 32 nt, Human
ugaaccccugcagugacugucaccagccaucg

SEQ ID NO: 510344 - RNA, 32 nt, Human
ugaaccccugcucugucccaggcucccccucc

SEQ ID NO: 510345 - RNA, 32 nt, Human
ugaaccccuuuugguugcacacaugcucccca

SEQ ID NO: 510346 - RNA, 32 nt, Human
ugaacccgaccugggcaauuccaccucugagg

SEQ ID NO: 510347 - RNA, 32 nt, Human
ugaacccgagagacggagguugcagugagcug

SEQ ID NO: 510348 - RNA, 32 nt, Human
ugaacccgagaggcggaaguugcagugagccg

SEQ ID NO: 510349 - RNA, 32 nt, Human
ugaacccgagaggcggagcuugcagugagcca

SEQ ID NO: 510350 - RNA, 32 nt, Human
ugaacccgagaggcggagcuugcagugagcug

SEQ ID NO: 510351 - RNA, 32 nt, Human
ugaacccgagaggcggagguugcagugagccc

SEQ ID NO: 510352 - RNA, 32 nt, Human
ugaacccgagaggcggagguugcagugagccg

SEQ ID NO: 510353 - RNA, 32 nt, Human
ugaacccgagagguagagcuugcaguaagcag

SEQ ID NO: 510354 - RNA, 32 nt, Human
ugaacccgagagguggagguugaagugagcca

SEQ ID NO: 510355 - RNA, 32 nt, Human
ugaacccgagagguggagguugcagugaacca

SEQ ID NO: 510356 - RNA, 32 nt, Human
ugaacccgagagguggagguugcagugagcca

SEQ ID NO: 510357 - RNA, 32 nt, Human
ugaacccgcgaggcggagacugcagugagccg

SEQ ID NO: 510358 - RNA, 32 nt, Human
ugaacccggaagcgaagguugcagugagccaa

SEQ ID NO: 510359 - RNA, 32 nt, Human
ugaacccggaaggcagagcuugcagugagccg

SEQ ID NO: 510360 - RNA, 32 nt, Human
ugaacccggaaggcagagguugcagugagccg

SEQ ID NO: 510361 - RNA, 32 nt, Human
ugaacccggaaggcggagcuugcagugagccg

SEQ ID NO: 510362 - RNA, 32 nt, Human
ugaacccggaaggcggagguugcagugagcca

SEQ ID NO: 510363 - RNA, 32 nt, Human
ugaacccggaagguggagguuguugcggugag

SEQ ID NO: 510364 - RNA, 32 nt, Human
ugaacccggaggcagagguugcagugagccga

SEQ ID NO: 510365 - RNA, 32 nt, Human
ugaacccggaggcggagguugcgguaagccga

SEQ ID NO: 510366 - RNA, 32 nt, Human
ugaacccggcaggaagagguugcauugagcug

SEQ ID NO: 510367 - RNA, 32 nt, Human
ugaacccggcaggcagagcuugcagugagccg

SEQ ID NO: 510368 - RNA, 32 nt, Human
ugaacccggcaggcagagguugcagugagccg

SEQ ID NO: 510369 - RNA, 32 nt, Human
ugaacccggcaggcggagguugcagugagcgg

SEQ ID NO: 510370 - RNA, 32 nt, Human
ugaacccggcgggaagagguugcagugagcca

SEQ ID NO: 510371 - RNA, 32 nt, Human
ugaacccggcgggcagagguugcaguaagcag

SEQ ID NO: 510372 - RNA, 32 nt, Human
ugaacccgggaagcagagguugcagugacaga

SEQ ID NO: 510373 - RNA, 32 nt, Human
ugaacccgggaagcagagguugcagugagcug

SEQ ID NO: 510374 - RNA, 32 nt, Human
ugaacccgggaagcagagguugcggugagccg

SEQ ID NO: 510375 - RNA, 32 nt, Human
ugaacccgggaagcagagguugcggugagcug

SEQ ID NO: 510376 - RNA, 32 nt, Human
ugaacccgggaagcggagcuugcagugagccg

SEQ ID NO: 510377 - RNA, 32 nt, Human
ugaacccgggaagcggagguugcagugagcca

SEQ ID NO: 510378 - RNA, 32 nt, Human
ugaacccgggaagcggagguugcagugagccg

SEQ ID NO: 510379 - RNA, 32 nt, Human
ugaacccgggaaguggagguugccgugagucg

SEQ ID NO: 510380 - RNA, 32 nt, Human
ugaacccgggacgcagagguuacagugaaccg

SEQ ID NO: 510381 - RNA, 32 nt, Human
ugaacccgggacgcagggguugcagugagcgg

SEQ ID NO: 510382 - RNA, 32 nt, Human
ugaacccgggagacggagcuugcaguaagccg

SEQ ID NO: 510383 - RNA, 32 nt, Human
ugaacccgggagacggagguugcagugagcug

SEQ ID NO: 510384 - RNA, 32 nt, Human
ugaacccgggagacggcgcuugcagugagccg

SEQ ID NO: 510385 - RNA, 32 nt, Human
ugaacccgggagaugaagguugcagugagcug

SEQ ID NO: 510386 - RNA, 32 nt, Human
ugaacccgggagauggcgcuugcagugagcug

SEQ ID NO: 510387 - RNA, 32 nt, Human
ugaacccgggagcggagguugcagugagcuga

SEQ ID NO: 510388 - RNA, 32 nt, Human
ugaacccgggaggaagagcuugcagugagccg

SEQ ID NO: 510389 - RNA, 32 nt, Human
ugaacccgggaggaggagcuugcagugagccg

SEQ ID NO: 510390 - RNA, 32 nt, Human
ugaacccgggaggaggagguugcacugagccg

SEQ ID NO: 510391 - RNA, 32 nt, Human
ugaacccgggaggcaaagguugcagugagcug

SEQ ID NO: 510392 - RNA, 32 nt, Human
ugaacccgggaggcaaagguugcgguaagcug

SEQ ID NO: 510393 - RNA, 32 nt, Human
ugaacccgggaggcagaaguugcagugaacug

SEQ ID NO: 510394 - RNA, 32 nt, Human
ugaacccgggaggcagaccuugcagugagcca

SEQ ID NO: 510395 - RNA, 32 nt, Human
ugaacccgggaggcagacuuugcagugagcug

SEQ ID NO: 510396 - RNA, 32 nt, Human
ugaacccgggaggcagagauagcagugaacug

SEQ ID NO: 510397 - RNA, 32 nt, Human
ugaacccgggaggcagagauugcaguaagcug

SEQ ID NO: 510398 - RNA, 32 nt, Human
ugaacccgggaggcagagcuugcaguaagccg

SEQ ID NO: 510399 - RNA, 32 nt, Human
ugaacccgggaggcagagcuugcagugagcag

SEQ ID NO: 510400 - RNA, 32 nt, Human
ugaacccgggaggcagagcuugcagugagcca

SEQ ID NO: 510401 - RNA, 32 nt, Human
ugaacccgggaggcagagcuugcagugagccg

SEQ ID NO: 510402 - RNA, 32 nt, Human
ugaacccgggaggcagagcuugcagugagcug

SEQ ID NO: 510403 - RNA, 32 nt, Human
ugaacccgggaggcagagcuugcagugagucg

SEQ ID NO: 510404 - RNA, 32 nt, Human
ugaacccgggaggcagagcuugcggugagccg

SEQ ID NO: 510405 - RNA, 32 nt, Human
ugaacccgggaggcagagcuuguggugagccg

SEQ ID NO: 510406 - RNA, 32 nt, Human
ugaacccgggaggcagaggcugcagugagccg

SEQ ID NO: 510407 - RNA, 32 nt, Human
ugaacccgggaggcagaggcugcagugagcug

SEQ ID NO: 510408 - RNA, 32 nt, Human
ugaacccgggaggcagaggcuguagugagcca

SEQ ID NO: 510409 - RNA, 32 nt, Human
ugaacccgggaggcagagggugcaguaagccg

SEQ ID NO: 510410 - RNA, 32 nt, Human
ugaacccgggaggcagagguaguagugagcug

SEQ ID NO: 510411 - RNA, 32 nt, Human
ugaacccgggaggcagagguggcugugagccg

SEQ ID NO: 510412 - RNA, 32 nt, Human
ugaacccgggaggcagagguuacagugagcca

SEQ ID NO: 510413 - RNA, 32 nt, Human
ugaacccgggaggcagagguuaucgugagcug

SEQ ID NO: 510414 - RNA, 32 nt, Human
ugaacccgggaggcagagguugaagugagcug

SEQ ID NO: 510415 - RNA, 32 nt, Human
ugaacccgggaggcagagguugcacugagcug

SEQ ID NO: 510416 - RNA, 32 nt, Human
ugaacccgggaggcagagguugcagccggcug

SEQ ID NO: 510417 - RNA, 32 nt, Human
ugaacccgggaggcagagguugcaguaagcag

SEQ ID NO: 510418 - RNA, 32 nt, Human
ugaacccgggaggcagagguugcagugaaccc

SEQ ID NO: 510419 - RNA, 32 nt, Human
ugaacccgggaggcagagguugcagugagcca

SEQ ID NO: 510420 - RNA, 32 nt, Human
ugaacccgggaggcagagguugcagugagccg

SEQ ID NO: 510421 - RNA, 32 nt, Human
ugaacccgggaggcagagguugcagugagcug

SEQ ID NO: 510422 - RNA, 32 nt, Human
ugaacccgggaggcagagguugcagugaggug

SEQ ID NO: 510423 - RNA, 32 nt, Human
ugaacccgggaggcagagguugcagugagucg

SEQ ID NO: 510424 - RNA, 32 nt, Human
ugaacccgggaggcagagguugcagugagugg

SEQ ID NO: 510425 - RNA, 32 nt, Human
ugaacccgggaggcagagguugcaguguggug

SEQ ID NO: 510426 - RNA, 32 nt, Human
ugaacccgggaggcagagguugcauugagccg

SEQ ID NO: 510427 - RNA, 32 nt, Human
ugaacccgggaggcagagguugcggugagcca

SEQ ID NO: 510428 - RNA, 32 nt, Human
ugaacccgggaggcagagguugcggugagccg

SEQ ID NO: 510429 - RNA, 32 nt, Human
ugaacccgggaggcagagguugcuguaagcug

SEQ ID NO: 510430 - RNA, 32 nt, Human
ugaacccgggaggcagagguuguagugagccc

SEQ ID NO: 510431 - RNA, 32 nt, Human
ugaacccgggaggcagagguugugagcugaga

SEQ ID NO: 510432 - RNA, 32 nt, Human
ugaacccgggaggcagagguuguguugagcca

SEQ ID NO: 510433 - RNA, 32 nt, Human
ugaacccgggaggcagcaguugcagugagcug

SEQ ID NO: 510434 - RNA, 32 nt, Human
ugaacccgggaggcauagcuugcagugagccg

SEQ ID NO: 510435 - RNA, 32 nt, Human
ugaacccgggaggcgagcuugcagugagccga

SEQ ID NO: 510436 - RNA, 32 nt, Human
ugaacccgggaggcggaacuugcagugagcca

SEQ ID NO: 510437 - RNA, 32 nt, Human
ugaacccgggaggcggaacuugcggugagccg

SEQ ID NO: 510438 - RNA, 32 nt, Human
ugaacccgggaggcggaaguuucagcgagccg

SEQ ID NO: 510439 - RNA, 32 nt, Human
ugaacccgggaggcggagauugcagugagcug

SEQ ID NO: 510440 - RNA, 32 nt, Human
ugaacccgggaggcggagauugcggugagccg

SEQ ID NO: 510441 - RNA, 32 nt, Human
ugaacccgggaggcggagcuuacagugagcug

SEQ ID NO: 510442 - RNA, 32 nt, Human
ugaacccgggaggcggagcuugcagugaaccg

SEQ ID NO: 510443 - RNA, 32 nt, Human
ugaacccgggaggcggagcuugcagugagcca

SEQ ID NO: 510444 - RNA, 32 nt, Human
ugaacccgggaggcggagcuugcagugagccg

SEQ ID NO: 510445 - RNA, 32 nt, Human
ugaacccgggaggcggagcuugcagugagccu

SEQ ID NO: 510446 - RNA, 32 nt, Human
ugaacccgggaggcggagcuugcagugagcgg

SEQ ID NO: 510447 - RNA, 32 nt, Human
ugaacccgggaggcggagcuugcagugagcug

SEQ ID NO: 510448 - RNA, 32 nt, Human
ugaacccgggaggcggagcuuguagugagccg

SEQ ID NO: 510449 - RNA, 32 nt, Human
ugaacccgggaggcggaggcugcagugagccg

SEQ ID NO: 510450 - RNA, 32 nt, Human
ugaacccgggaggcggaggcugcagugagucg

SEQ ID NO: 510451 - RNA, 32 nt, Human
ugaacccgggaggcggaggcugcagugggccg

SEQ ID NO: 510452 - RNA, 32 nt, Human
ugaacccgggaggcggagguuacagugagccg

SEQ ID NO: 510453 - RNA, 32 nt, Human
ugaacccgggaggcggagguuacagugagccu

SEQ ID NO: 510454 - RNA, 32 nt, Human
ugaacccgggaggcggagguuacagugagcug

SEQ ID NO: 510455 - RNA, 32 nt, Human
ugaacccgggaggcggagguuccagugagccg

SEQ ID NO: 510456 - RNA, 32 nt, Human
ugaacccgggaggcggagguugagcaacuaca

SEQ ID NO: 510457 - RNA, 32 nt, Human
ugaacccgggaggcggagguugcaguaagccg

SEQ ID NO: 510458 - RNA, 32 nt, Human
ugaacccgggaggcggagguugcagucagccg

SEQ ID NO: 510459 - RNA, 32 nt, Human
ugaacccgggaggcggagguugcagugagcca

SEQ ID NO: 510460 - RNA, 32 nt, Human
ugaacccgggaggcggagguugcagugagccg

SEQ ID NO: 510461 - RNA, 32 nt, Human
ugaacccgggaggcggagguugcagugagccu

SEQ ID NO: 510462 - RNA, 32 nt, Human
ugaacccgggaggcggagguugcagugagcua

SEQ ID NO: 510463 - RNA, 32 nt, Human
ugaacccgggaggcggagguugcagugagcug

SEQ ID NO: 510464 - RNA, 32 nt, Human
ugaacccgggaggcggagguugcagugaggua

SEQ ID NO: 510465 - RNA, 32 nt, Human
ugaacccgggaggcggagguugcagugaguca

SEQ ID NO: 510466 - RNA, 32 nt, Human
ugaacccgggaggcggagguugcaguuagcca

SEQ ID NO: 510467 - RNA, 32 nt, Human
ugaacccgggaggcggagguugcaugagcuga

SEQ ID NO: 510468 - RNA, 32 nt, Human
ugaacccgggaggcggagguugcggugagcca

SEQ ID NO: 510469 - RNA, 32 nt, Human
ugaacccgggaggcggagguugcggugagccg

SEQ ID NO: 510470 - RNA, 32 nt, Human
ugaacccgggaggcggagguuguagugagccg

SEQ ID NO: 510471 - RNA, 32 nt, Human
ugaacccgggaggcggagguuguggugagcca

SEQ ID NO: 510472 - RNA, 32 nt, Human
ugaacccgggaggcggagguuguggugagccg

SEQ ID NO: 510473 - RNA, 32 nt, Human
ugaacccgggaggcggagguuguggugagcug

SEQ ID NO: 510474 - RNA, 32 nt, Human
ugaacccgggaggcggagguuucagugagccg

SEQ ID NO: 510475 - RNA, 32 nt, Human
ugaacccgggaggcggaguugcggugagccga

SEQ ID NO: 510476 - RNA, 32 nt, Human
ugaacccgggaggcggaguuugcagugagcca

SEQ ID NO: 510477 - RNA, 32 nt, Human
ugaacccgggaggcggaucuugcagugagcgg

SEQ ID NO: 510478 - RNA, 32 nt, Human
ugaacccgggaggcggaucuugcauugagcca

SEQ ID NO: 510479 - RNA, 32 nt, Human
ugaacccgggaggcuaagguugcagugagccg

SEQ ID NO: 510480 - RNA, 32 nt, Human
ugaacccgggagggagagguugcagugagcca

SEQ ID NO: 510481 - RNA, 32 nt, Human
ugaacccgggagguagagcuugcagugaaccg

SEQ ID NO: 510482 - RNA, 32 nt, Human
ugaacccgggagguagagguugcagugagccg

SEQ ID NO: 510483 - RNA, 32 nt, Human
ugaacccgggaggugcagguugcagugagcca

SEQ ID NO: 510484 - RNA, 32 nt, Human
ugaacccgggagguggaacuugcagugagccg

SEQ ID NO: 510485 - RNA, 32 nt, Human
ugaacccgggagguggagauugcagugagccc

SEQ ID NO: 510486 - RNA, 32 nt, Human
ugaacccgggagguggagauugcagugagcug

SEQ ID NO: 510487 - RNA, 32 nt, Human
ugaacccgggagguggagccuacagugaguca

SEQ ID NO: 510488 - RNA, 32 nt, Human
ugaacccgggagguggagcuuccagugagccg

SEQ ID NO: 510489 - RNA, 32 nt, Human
ugaacccgggagguggagcuugcagugagcca

SEQ ID NO: 510490 - RNA, 32 nt, Human
ugaacccgggagguggagcuugcagugagccg

SEQ ID NO: 510491 - RNA, 32 nt, Human
ugaacccgggagguggagcuugcagugagcgg

SEQ ID NO: 510492 - RNA, 32 nt, Human
ugaacccgggagguggagcuugcagugagcug

SEQ ID NO: 510493 - RNA, 32 nt, Human
ugaacccgggagguggagcuugcagugggugg

SEQ ID NO: 510494 - RNA, 32 nt, Human
ugaacccgggagguggagcuuguagugaggcg

SEQ ID NO: 510495 - RNA, 32 nt, Human
ugaacccgggagguggaggcugcaaugagcug

SEQ ID NO: 510496 - RNA, 32 nt, Human
ugaacccgggagguggaggcugcagcgagcca

SEQ ID NO: 510497 - RNA, 32 nt, Human
ugaacccgggagguggaggcugcagugagccg

SEQ ID NO: 510498 - RNA, 32 nt, Human
ugaacccgggagguggaggcugcagugaguua

SEQ ID NO: 510499 - RNA, 32 nt, Human
ugaacccgggagguggaggcugcggugagcca

SEQ ID NO: 510500 - RNA, 32 nt, Human
ugaacccgggagguggaggucgcggugagccg

SEQ ID NO: 510501 - RNA, 32 nt, Human
ugaacccgggagguggagguggcagugagccg

SEQ ID NO: 510502 - RNA, 32 nt, Human
ugaacccgggagguggagguuacagugagccg

SEQ ID NO: 510503 - RNA, 32 nt, Human
ugaacccgggagguggagguuacagugagcug

SEQ ID NO: 510504 - RNA, 32 nt, Human
ugaacccgggagguggagguucuagugagccg

SEQ ID NO: 510505 - RNA, 32 nt, Human
ugaacccgggagguggagguugcaaugagcca

SEQ ID NO: 510506 - RNA, 32 nt, Human
ugaacccgggagguggagguugcagcaagccg

SEQ ID NO: 510507 - RNA, 32 nt, Human
ugaacccgggagguggagguugcagggagccg

SEQ ID NO: 510508 - RNA, 32 nt, Human
ugaacccgggagguggagguugcaguaagccg

SEQ ID NO: 510509 - RNA, 32 nt, Human
ugaacccgggagguggagguugcagugaacca

SEQ ID NO: 510510 - RNA, 32 nt, Human
ugaacccgggagguggagguugcagugagcca

SEQ ID NO: 510511 - RNA, 32 nt, Human
ugaacccgggagguggagguugcagugagccg

SEQ ID NO: 510512 - RNA, 32 nt, Human
ugaacccgggagguggagguugcagugagcua

SEQ ID NO: 510513 - RNA, 32 nt, Human
ugaacccgggagguggagguugcagugagcug

SEQ ID NO: 510514 - RNA, 32 nt, Human
ugaacccgggagguggagguugcagugaggug

SEQ ID NO: 510515 - RNA, 32 nt, Human
ugaacccgggagguggagguugccgugagcca

SEQ ID NO: 510516 - RNA, 32 nt, Human
ugaacccgggagguggagguugccgugagcug

SEQ ID NO: 510517 - RNA, 32 nt, Human
ugaacccgggagguggagguugccgugaguug

SEQ ID NO: 510518 - RNA, 32 nt, Human
ugaacccgggagguggagguugcgaugagcug

SEQ ID NO: 510519 - RNA, 32 nt, Human
ugaacccgggagguggagguugcggugagcca

SEQ ID NO: 510520 - RNA, 32 nt, Human
ugaacccgggagguggagguugcggugagcug

SEQ ID NO: 510521 - RNA, 32 nt, Human
ugaacccgggagguggagguuguagcgagcug

SEQ ID NO: 510522 - RNA, 32 nt, Human
ugaacccgggagguggagguuguagugagcug

SEQ ID NO: 510523 - RNA, 32 nt, Human
ugaacccgggagguggcaguugcagggagcua

SEQ ID NO: 510524 - RNA, 32 nt, Human
ugaacccgggaggugggaguuguagugagccg

SEQ ID NO: 510525 - RNA, 32 nt, Human
ugaacccgggagguguagguugcagugagccg

SEQ ID NO: 510526 - RNA, 32 nt, Human
ugaacccgggaguggagcuugcaaugagccaa

SEQ ID NO: 510527 - RNA, 32 nt, Human
ugaacccgggaguuaaagguugcagugagccg

SEQ ID NO: 510528 - RNA, 32 nt, Human
ugaacccgggaguuggagguugcagugagcca

SEQ ID NO: 510529 - RNA, 32 nt, Human
ugaacccgggaugcagagguugcagugagcug

SEQ ID NO: 510530 - RNA, 32 nt, Human
ugaacccgggcagcggagguugcagugagccg

SEQ ID NO: 510531 - RNA, 32 nt, Human
ugaacccgggcccgguggaggcugcagugaga

SEQ ID NO: 510532 - RNA, 32 nt, Human
ugaacccgggcggcggaaguugcagugagccg

SEQ ID NO: 510533 - RNA, 32 nt, Human
ugaacccgggcggcggagauugcagugagccg

SEQ ID NO: 510534 - RNA, 32 nt, Human
ugaacccgggcgguggagcuugcagugagccg

SEQ ID NO: 510535 - RNA, 32 nt, Human
ugaacccgggcgguggagguuguagugagcca

SEQ ID NO: 510536 - RNA, 32 nt, Human
ugaacccggggacggagguugcagugaaccga

SEQ ID NO: 510537 - RNA, 32 nt, Human
ugaacccgggggcagaggcugcagugagccga

SEQ ID NO: 510538 - RNA, 32 nt, Human
ugaacccggguggcagagguugcagugagccg

SEQ ID NO: 510539 - RNA, 32 nt, Human
ugaacccggguggcagagguugcagugagcug

SEQ ID NO: 510540 - RNA, 32 nt, Human
ugaacccggguggcggcgcuugcagugagcug

SEQ ID NO: 510541 - RNA, 32 nt, Human
ugaacccgguagaggcggagguugcagugagc

SEQ ID NO: 510542 - RNA, 32 nt, Human
ugaacccgguaggcagagguugcagugagccg

SEQ ID NO: 510543 - RNA, 32 nt, Human
ugaacccgguaggcggagcuugcagugagcug

SEQ ID NO: 510544 - RNA, 32 nt, Human
ugaacccgguaggggagcuugcagugagccca

SEQ ID NO: 510545 - RNA, 32 nt, Human
ugaacccgguagguggagguugcagugagccg

SEQ ID NO: 510546 - RNA, 32 nt, Human
ugaacccguccaggugccccaagaggcucgug

SEQ ID NO: 510547 - RNA, 32 nt, Human
ugaacccgugaggcagagguugcagugaaccg

SEQ ID NO: 510548 - RNA, 32 nt, Human
ugaacccgugaggcagagguugcagugagccg

SEQ ID NO: 510549 - RNA, 32 nt, Human
ugaacccgugaggcggagguuguagugagcca

SEQ ID NO: 510550 - RNA, 32 nt, Human
ugaacccguguggcagagguugcggugagugu

SEQ ID NO: 510551 - RNA, 32 nt, Human
ugaacccuaaaggcagagguugcagugagccg

SEQ ID NO: 510552 - RNA, 32 nt, Human
ugaacccuagaggcggaguuugcagugagccg

SEQ ID NO: 510553 - RNA, 32 nt, Human
ugaacccuagccccagcuuugggaggauguuc

SEQ ID NO: 510554 - RNA, 32 nt, Human
ugaacccucaacuauugacugcugcagacagc

SEQ ID NO: 510555 - RNA, 32 nt, Human
ugaacccucacacaaaggcuacuacugugguc

SEQ ID NO: 510556 - RNA, 17 nt, Human
ugaacccuccagggccu

SEQ ID NO: 510557 - RNA, 32 nt, Human
ugaacccugcacugcguggcugcccagccagc

SEQ ID NO: 510558 - RNA, 32 nt, Human
ugaacccugcagcucacccauucauucaccca

SEQ ID NO: 510559 - RNA, 32 nt, Human
ugaacccuggaaguggagguugcagugagccu

SEQ ID NO: 510560 - RNA, 32 nt, Human
ugaacccuggaggcagaggugguagugagccg

SEQ ID NO: 510561 - RNA, 32 nt, Human
ugaacccuggaggcagagguugcaaugagccg

SEQ ID NO: 510562 - RNA, 32 nt, Human
ugaacccuggaggcagagguuguagugagucg

SEQ ID NO: 510563 - RNA, 32 nt, Human
ugaacccuggaggcagagguuguggugagcug

SEQ ID NO: 510564 - RNA, 32 nt, Human
ugaacccuggaggcagagguuguggugagucg

SEQ ID NO: 510565 - RNA, 32 nt, Human
ugaacccuggaggcggaaguugcagugagccg

SEQ ID NO: 510566 - RNA, 32 nt, Human
ugaacccuggaggcggagauugaagugagcug

SEQ ID NO: 510567 - RNA, 32 nt, Human
ugaacccuggaggcggagguuacaguuauccg

SEQ ID NO: 510568 - RNA, 32 nt, Human
ugaacccuggaggcggagguuccagugagcug

SEQ ID NO: 510569 - RNA, 32 nt, Human
ugaacccuggaggcggagguugcagugagccg

SEQ ID NO: 510570 - RNA, 32 nt, Human
ugaacccuggaggcggagguugcagugagugg

SEQ ID NO: 510571 - RNA, 32 nt, Human
ugaacccuggaggcggagguugccgugagcca

SEQ ID NO: 510572 - RNA, 32 nt, Human
ugaacccuggagguagaaguugcagugagcca

SEQ ID NO: 510573 - RNA, 32 nt, Human
ugaacccuggagguggagguugcagugagccg

SEQ ID NO: 510574 - RNA, 32 nt, Human
ugaacccuggagguggagguugcagugagcug

SEQ ID NO: 510575 - RNA, 32 nt, Human
ugaacccuggagguggcgguugcagugagcac

SEQ ID NO: 510576 - RNA, 32 nt, Human
ugaacccugggagccccuuguggagucugcug

SEQ ID NO: 510577 - RNA, 32 nt, Human
ugaacccugggagcggagauugcagugagcug

SEQ ID NO: 510578 - RNA, 32 nt, Human
ugaaccgaaaaaugaacaguaguuuggcaucu

SEQ ID NO: 510579 - RNA, 32 nt, Human
ugaaccgaggaggcagagcuugcagugagcca

SEQ ID NO: 510580 - RNA, 32 nt, Human
ugaaccgaggaggcgaagguugcagugagccg

SEQ ID NO: 510581 - RNA, 32 nt, Human
ugaaccgcuggcugcuguugugccucaucucu

SEQ ID NO: 510582 - RNA, 32 nt, Human
ugaaccgggaggcagaaguugcagugagccga

SEQ ID NO: 510583 - RNA, 32 nt, Human
ugaaccgggaggcggagguugcagugagccga

SEQ ID NO: 510584 - RNA, 32 nt, Human
ugaaccggggagacggagguugcagugagccg

SEQ ID NO: 510585 - RNA, 32 nt, Human
ugaaccggggaggcagagguugcagugagcug

SEQ ID NO: 510586 - RNA, 32 nt, Human
ugaaccggggaggcagagguugcaguuaagcc

SEQ ID NO: 510587 - RNA, 32 nt, Human
ugaaccggggaggcggagcuugcagugagcca

SEQ ID NO: 510588 - RNA, 32 nt, Human
ugaaccggggaggcggaggguguggugagccg

SEQ ID NO: 510589 - RNA, 32 nt, Human
ugaaccggggaggcggagguuacagugagccg

SEQ ID NO: 510590 - RNA, 32 nt, Human
ugaaccggggagguggaggcugcagugagccg

SEQ ID NO: 510591 - RNA, 32 nt, Human
ugaaccggggagguggagguugcagugagcug

SEQ ID NO: 510592 - RNA, 32 nt, Human
ugaaccggggaguuggagguugcagugagccg

SEQ ID NO: 510593 - RNA, 32 nt, Human
ugaaccguccugaggauggaguggggucccau

SEQ ID NO: 510594 - RNA, 32 nt, Human
ugaaccgugaaagagaaaaagaagaggcuccg

SEQ ID NO: 510595 - RNA, 32 nt, Human
ugaaccuaaguggcagagguugcagugagcug

SEQ ID NO: 510596 - RNA, 32 nt, Human
ugaaccuagaagcagagacucugugagauaau

SEQ ID NO: 510597 - RNA, 32 nt, Human
ugaaccuagaagguggagguugcagugagcgg

SEQ ID NO: 510598 - RNA, 32 nt, Human
ugaaccuaggaggcagaaguugcagugagcag

SEQ ID NO: 510599 - RNA, 32 nt, Human
ugaaccuaggaggcagagguugcagugaaccg

SEQ ID NO: 510600 - RNA, 32 nt, Human
ugaaccuaggaggcagagguugcagugagcca

SEQ ID NO: 510601 - RNA, 32 nt, Human
ugaaccuaggaggcggagguugcagugagcca

SEQ ID NO: 510602 - RNA, 32 nt, Human
ugaaccuaggaggcggagguugcagugaguca

SEQ ID NO: 510603 - RNA, 32 nt, Human
ugaaccuaggaggcugagauugcagugagccg

SEQ ID NO: 510604 - RNA, 32 nt, Human
ugaaccuaggaggggaagguugcagugagccg

SEQ ID NO: 510605 - RNA, 32 nt, Human
ugaaccuaggagguggaggcugcagcgagcug

SEQ ID NO: 510606 - RNA, 32 nt, Human
ugaaccuaggagguggagguugcagugagccg

SEQ ID NO: 510607 - RNA, 32 nt, Human
ugaaccuaggagguggagguugcagugagcug

SEQ ID NO: 510608 - RNA, 32 nt, Human
ugaaccuaggagguggagguugcauucaacug

SEQ ID NO: 510609 - RNA, 32 nt, Human
ugaaccuaggagguggcgguugcugugagcca

SEQ ID NO: 510610 - RNA, 32 nt, Human
ugaaccuaggaguuggagaccaaccugggcaa

SEQ ID NO: 510611 - RNA, 32 nt, Human
ugaaccuaguaacaggcuuuauuuucaccuug

SEQ ID NO: 510612 - RNA, 32 nt, Human
ugaaccuauguuauaugauacaugcauaacuu

SEQ ID NO: 510613 - RNA, 32 nt, Human
ugaaccucagaggcagagguugcaaugaagcg

SEQ ID NO: 510614 - RNA, 32 nt, Human
ugaaccucagauccacugaguguguauccaga

SEQ ID NO: 510615 - RNA, 32 nt, Human
ugaaccucagcggcggagguugcagugagucg

SEQ ID NO: 510616 - RNA, 32 nt, Human
ugaaccucauucuuccuuguuucucugguaga

SEQ ID NO: 510617 - RNA, 32 nt, Human
ugaaccuccaggacuucagcccuucuaggaga

SEQ ID NO: 510618 - RNA, 32 nt, Human
ugaaccucccaaguagcugggauuacagaaag

SEQ ID NO: 510619 - RNA, 32 nt, Human
ugaaccucggaggcggagguugcagugagcca

SEQ ID NO: 510620 - RNA, 32 nt, Human
ugaaccucggaggcugaaguugcagugagcca

SEQ ID NO: 510621 - RNA, 32 nt, Human
ugaaccucucccgcugcugggauugacgccug

SEQ ID NO: 510622 - RNA, 32 nt, Human
ugaaccugagaaguggagguuguggugagcug

SEQ ID NO: 510623 - RNA, 32 nt, Human
ugaaccugagagauggagguugaugugagcug

SEQ ID NO: 510624 - RNA, 32 nt, Human
ugaaccugagaggcagagguuacagugagcug

SEQ ID NO: 510625 - RNA, 32 nt, Human
ugaaccugagaggcagagguugcagugagcca

SEQ ID NO: 510626 - RNA, 32 nt, Human
ugaaccugagaggcagagguugcagugagccg

SEQ ID NO: 510627 - RNA, 32 nt, Human
ugaaccugagaggcggagguugcagugagcca

SEQ ID NO: 510628 - RNA, 32 nt, Human
ugaaccugagaggcggagguugcagugagccg

SEQ ID NO: 510629 - RNA, 32 nt, Human
ugaaccugagaggugaagguuguagugagcca

SEQ ID NO: 510630 - RNA, 32 nt, Human
ugaaccugagaggugagguugcagugagccga

SEQ ID NO: 510631 - RNA, 32 nt, Human
ugaaccugagagguggagguugcagugagccg

SEQ ID NO: 510632 - RNA, 32 nt, Human
ugaaccugagagguggagguuucagugagccg

SEQ ID NO: 510633 - RNA, 32 nt, Human
ugaaccugaugcugcauuuucacugugccaca

SEQ ID NO: 510634 - RNA, 32 nt, Human
ugaaccugauucuauaggcaguuacucugugu

SEQ ID NO: 510635 - RNA, 32 nt, Human
ugaaccugcaggaauaccagagcaagaaacug

SEQ ID NO: 510636 - RNA, 31 nt, Human
ugaaccugccucuugcugggccuuuguuccu

SEQ ID NO: 510637 - RNA, 32 nt, Human
ugaaccugccucuugcugggccuuuguuccuu

SEQ ID NO: 510638 - RNA, 32 nt, Human
ugaaccugcgaggcagagauugcagugagcca

SEQ ID NO: 510639 - RNA, 32 nt, Human
ugaaccuggaacgcggagguugcaaugagccg

SEQ ID NO: 510640 - RNA, 32 nt, Human
ugaaccuggaaggaagagguugcagugagcca

SEQ ID NO: 510641 - RNA, 32 nt, Human
ugaaccuggaaggcagaaguugcagugagcug

SEQ ID NO: 510642 - RNA, 32 nt, Human
ugaaccuggaaggcagagauugcagugagcug

SEQ ID NO: 510643 - RNA, 32 nt, Human
ugaaccuggaaggcagggguugcagugaccug

SEQ ID NO: 510644 - RNA, 32 nt, Human
ugaaccuggaaggcggagcuugcagugagcug

SEQ ID NO: 510645 - RNA, 32 nt, Human
ugaaccuggaaggcggagguugcagugagcag

SEQ ID NO: 510646 - RNA, 32 nt, Human
ugaaccuggaaggcggagguugcagugagcca

SEQ ID NO: 510647 - RNA, 32 nt, Human
ugaaccuggaaggcggagguugcagugagccg

SEQ ID NO: 510648 - RNA, 32 nt, Human
ugaaccuggaagguggagcuugcagugagcug

SEQ ID NO: 510649 - RNA, 32 nt, Human
ugaaccuggaauacagagguuucagugagcug

SEQ ID NO: 510650 - RNA, 32 nt, Human
ugaaccuggacucuugcccucuugccuugcac

SEQ ID NO: 510651 - RNA, 32 nt, Human
ugaaccuggagacagagguugcagugagcuga

SEQ ID NO: 510652 - RNA, 32 nt, Human
ugaaccuggaggcagagauugcagugagccga

SEQ ID NO: 510653 - RNA, 32 nt, Human
ugaaccuggaggcagagguugcagugagucga

SEQ ID NO: 510654 - RNA, 32 nt, Human
ugaaccuggaggguggaaguuguagugagccg

SEQ ID NO: 510655 - RNA, 32 nt, Human
ugaaccuggagguggagguugcagugagccga

SEQ ID NO: 510656 - RNA, 32 nt, Human
ugaaccuggcaaguguagguugcagugagcug

SEQ ID NO: 510657 - RNA, 32 nt, Human
ugaaccuggcaggcagagguugcagugagcca

SEQ ID NO: 510658 - RNA, 32 nt, Human
ugaaccuggcaggcagaguuugcagugaacca

SEQ ID NO: 510659 - RNA, 32 nt, Human
ugaaccuggcaggcggagguugcagugagccg

SEQ ID NO: 510660 - RNA, 32 nt, Human
ugaaccuggcagguggagguuacagugagcca

SEQ ID NO: 510661 - RNA, 32 nt, Human
ugaaccuggcagguggagguugcagugagugg

SEQ ID NO: 510662 - RNA, 32 nt, Human
ugaaccugggaagcagagguugcagugagccg

SEQ ID NO: 510663 - RNA, 32 nt, Human
ugaaccugggaagcagaguuugcagugagcca

SEQ ID NO: 510664 - RNA, 32 nt, Human
ugaaccugggaagugcagguugcagugagcca

SEQ ID NO: 510665 - RNA, 32 nt, Human
ugaaccugggagacagaaguuugcagugaucc

SEQ ID NO: 510666 - RNA, 32 nt, Human
ugaaccugggagacagagguugcaaugaaccg

SEQ ID NO: 510667 - RNA, 32 nt, Human
ugaaccugggagacagagguugcagugagcca

SEQ ID NO: 510668 - RNA, 32 nt, Human
ugaaccugggagacagaugaggagacuggcuc

SEQ ID NO: 510669 - RNA, 32 nt, Human
ugaaccugggagacggagcuugcagugagcug

SEQ ID NO: 510670 - RNA, 32 nt, Human
ugaaccugggagacggagguugcagugagcca

SEQ ID NO: 510671 - RNA, 32 nt, Human
ugaaccugggagauggaaguugcagugaacca

SEQ ID NO: 510672 - RNA, 32 nt, Human
ugaaccugggagauggagauugcagugagcag

SEQ ID NO: 510673 - RNA, 32 nt, Human
ugaaccugggagauggaggcugcaguaagcca

SEQ ID NO: 510674 - RNA, 32 nt, Human
ugaaccugggagauggagguugcagagagcca

SEQ ID NO: 510675 - RNA, 32 nt, Human
ugaaccugggagauggggguuguagugagcca

SEQ ID NO: 510676 - RNA, 32 nt, Human
ugaaccugggagcaggagguugcagugagccg

SEQ ID NO: 510677 - RNA, 32 nt, Human
ugaaccugggagccugagguugcagugagcca

SEQ ID NO: 510678 - RNA, 32 nt, Human
ugaaccugggaggagaagguugcagugagcug

SEQ ID NO: 510679 - RNA, 32 nt, Human
ugaaccugggaggaggagguugcagugagcug

SEQ ID NO: 510680 - RNA, 32 nt, Human
ugaaccugggaggcaaagguugcagugagcug

SEQ ID NO: 510681 - RNA, 32 nt, Human
ugaaccugggaggcaaagguugcggugaacug

SEQ ID NO: 510682 - RNA, 32 nt, Human
ugaaccugggaggcagaaguugcagugaaaca

SEQ ID NO: 510683 - RNA, 32 nt, Human
ugaaccugggaggcagaaguugcagugagccg

SEQ ID NO: 510684 - RNA, 32 nt, Human
ugaaccugggaggcagaaguugcagugagcug

SEQ ID NO: 510685 - RNA, 32 nt, Human
ugaaccugggaggcagaaguuguggugagccg

SEQ ID NO: 510686 - RNA, 32 nt, Human
ugaaccugggaggcagagauuacacugaccug

SEQ ID NO: 510687 - RNA, 32 nt, Human
ugaaccugggaggcagagauugcagugagcca

SEQ ID NO: 510688 - RNA, 32 nt, Human
ugaaccugggaggcagagauugcagugagccg

SEQ ID NO: 510689 - RNA, 32 nt, Human
ugaaccugggaggcagagauugcagugagcug

SEQ ID NO: 510690 - RNA, 32 nt, Human
ugaaccugggaggcagagcuugcaguaagccg

SEQ ID NO: 510691 - RNA, 32 nt, Human
ugaaccugggaggcagagcuugcagugagcca

SEQ ID NO: 510692 - RNA, 32 nt, Human
ugaaccugggaggcagagcuugcagugagccg

SEQ ID NO: 510693 - RNA, 32 nt, Human
ugaaccugggaggcagagcuugcagugagccu

SEQ ID NO: 510694 - RNA, 32 nt, Human
ugaaccugggaggcagagcuugcagugagcug

SEQ ID NO: 510695 - RNA, 32 nt, Human
ugaaccugggaggcagagcuugcagugagugg

SEQ ID NO: 510696 - RNA, 32 nt, Human
ugaaccugggaggcagagcuugcagugauugg

SEQ ID NO: 510697 - RNA, 32 nt, Human
ugaaccugggaggcagagggugcaguaagcug

SEQ ID NO: 510698 - RNA, 32 nt, Human
ugaaccugggaggcagagguuacaaugagccg

SEQ ID NO: 510699 - RNA, 32 nt, Human
ugaaccugggaggcagagguuacagugagccg

SEQ ID NO: 510700 - RNA, 32 nt, Human
ugaaccugggaggcagagguugcaaugagcca

SEQ ID NO: 510701 - RNA, 32 nt, Human
ugaaccugggaggcagagguugcaaugagcug

SEQ ID NO: 510702 - RNA, 32 nt, Human
ugaaccugggaggcagagguugcagggaaccu

SEQ ID NO: 510703 - RNA, 32 nt, Human
ugaaccugggaggcagagguugcaguaagcca

SEQ ID NO: 510704 - RNA, 32 nt, Human
ugaaccugggaggcagagguugcaguaagcua

SEQ ID NO: 510705 - RNA, 32 nt, Human
ugaaccugggaggcagagguugcagugaacag

SEQ ID NO: 510706 - RNA, 32 nt, Human
ugaaccugggaggcagagguugcagugaacca

SEQ ID NO: 510707 - RNA, 32 nt, Human
ugaaccugggaggcagagguugcagugaaccu

SEQ ID NO: 510708 - RNA, 32 nt, Human
ugaaccugggaggcagagguugcagugaacug

SEQ ID NO: 510709 - RNA, 32 nt, Human
ugaaccugggaggcagagguugcagugagcca

SEQ ID NO: 510710 - RNA, 32 nt, Human
ugaaccugggaggcagagguugcagugagccg

SEQ ID NO: 510711 - RNA, 32 nt, Human
ugaaccugggaggcagagguugcagugagcua

SEQ ID NO: 510712 - RNA, 32 nt, Human
ugaaccugggaggcagagguugcagugagcuc

SEQ ID NO: 510713 - RNA, 32 nt, Human
ugaaccugggaggcagagguugcagugagcug

SEQ ID NO: 510714 - RNA, 32 nt, Human
ugaaccugggaggcagagguugcagugaggug

SEQ ID NO: 510715 - RNA, 32 nt, Human
ugaaccugggaggcagagguugcagugaucca

SEQ ID NO: 510716 - RNA, 32 nt, Human
ugaaccugggaggcagagguugcagugauccg

SEQ ID NO: 510717 - RNA, 32 nt, Human
ugaaccugggaggcagagguugccgugagcug

SEQ ID NO: 510718 - RNA, 32 nt, Human
ugaaccugggaggcagagguugcgguaagccg

SEQ ID NO: 510719 - RNA, 32 nt, Human
ugaaccugggaggcagagguuguagcgagcca

SEQ ID NO: 510720 - RNA, 32 nt, Human
ugaaccugggaggcagagguuguagugagcug

SEQ ID NO: 510721 - RNA, 32 nt, Human
ugaaccugggaggcagagguuguggugagcca

SEQ ID NO: 510722 - RNA, 32 nt, Human
ugaaccugggaggcagagguuguggugagcua

SEQ ID NO: 510723 - RNA, 32 nt, Human
ugaaccugggaggcagagguuguggugagcug

SEQ ID NO: 510724 - RNA, 32 nt, Human
ugaaccugggaggcagagguuucagugagcca

SEQ ID NO: 510725 - RNA, 32 nt, Human
ugaaccugggaggcagagucugcagugagccg

SEQ ID NO: 510726 - RNA, 32 nt, Human
ugaaccugggaggcagaguuuacagugagccg

SEQ ID NO: 510727 - RNA, 32 nt, Human
ugaaccugggaggcagaguuugcagugagccg

SEQ ID NO: 510728 - RNA, 32 nt, Human
ugaaccugggaggcagaguuugcagugagcgg

SEQ ID NO: 510729 - RNA, 32 nt, Human
ugaaccugggaggcagauguugcagugagccg

SEQ ID NO: 510730 - RNA, 32 nt, Human
ugaaccugggaggcagauguuguggugagccg

SEQ ID NO: 510731 - RNA, 32 nt, Human
ugaaccugggaggcagcgguugcaguaagcca

SEQ ID NO: 510732 - RNA, 32 nt, Human
ugaaccugggaggcagggguugcagugagcug

SEQ ID NO: 510733 - RNA, 32 nt, Human
ugaaccugggaggcaguuugcagugagcugag

SEQ ID NO: 510734 - RNA, 32 nt, Human
ugaaccugggaggccaagguugcagugagccg

SEQ ID NO: 510735 - RNA, 32 nt, Human
ugaaccugggaggcgaagguugcagugagcca

SEQ ID NO: 510736 - RNA, 32 nt, Human
ugaaccugggaggcgaagguugcagugagcug

SEQ ID NO: 510737 - RNA, 32 nt, Human
ugaaccugggaggcgcagguugcagggaggcg

SEQ ID NO: 510738 - RNA, 32 nt, Human
ugaaccugggaggcggaaguugcagugagcca

SEQ ID NO: 510739 - RNA, 32 nt, Human
ugaaccugggaggcggaaguugcagugagccg

SEQ ID NO: 510740 - RNA, 32 nt, Human
ugaaccugggaggcggaaguugcagugagcug

SEQ ID NO: 510741 - RNA, 32 nt, Human
ugaaccugggaggcggagauugcagugaacca

SEQ ID NO: 510742 - RNA, 32 nt, Human
ugaaccugggaggcggagcuugcaaugaacug

SEQ ID NO: 510743 - RNA, 32 nt, Human
ugaaccugggaggcggagcuugcaguaagccg

SEQ ID NO: 510744 - RNA, 32 nt, Human
ugaaccugggaggcggagcuugcagugagccc

SEQ ID NO: 510745 - RNA, 32 nt, Human
ugaaccugggaggcggagcuugcagugagccg

SEQ ID NO: 510746 - RNA, 32 nt, Human
ugaaccugggaggcggagcuugcagugagcug

SEQ ID NO: 510747 - RNA, 32 nt, Human
ugaaccugggaggcggaggagguugcagugaa

SEQ ID NO: 510748 - RNA, 32 nt, Human
ugaaccugggaggcggaggcugcagugagccg

SEQ ID NO: 510749 - RNA, 32 nt, Human
ugaaccugggaggcggaggcugcagugagcug

SEQ ID NO: 510750 - RNA, 32 nt, Human
ugaaccugggaggcggagguugcaaugagccg

SEQ ID NO: 510751 - RNA, 32 nt, Human
ugaaccugggaggcggagguugcagggagcug

SEQ ID NO: 510752 - RNA, 32 nt, Human
ugaaccugggaggcggagguugcaguaagccc

SEQ ID NO: 510753 - RNA, 32 nt, Human
ugaaccugggaggcggagguugcagugagcca

SEQ ID NO: 510754 - RNA, 32 nt, Human
ugaaccugggaggcggagguugcagugagccg

SEQ ID NO: 510755 - RNA, 32 nt, Human
ugaaccugggaggcggagguugcagugagcga

SEQ ID NO: 510756 - RNA, 32 nt, Human
ugaaccugggaggcggagguugcagugagcgg

SEQ ID NO: 510757 - RNA, 32 nt, Human
ugaaccugggaggcggagguugcagugagcua

SEQ ID NO: 510758 - RNA, 32 nt, Human
ugaaccugggaggcggagguugcagugagcug

SEQ ID NO: 510759 - RNA, 32 nt, Human
ugaaccugggaggcggagguugcagugagucg

SEQ ID NO: 510760 - RNA, 32 nt, Human
ugaaccugggaggcggagguugcagugaguug

SEQ ID NO: 510761 - RNA, 32 nt, Human
ugaaccugggaggcggagguugccgugagccg

SEQ ID NO: 510762 - RNA, 32 nt, Human
ugaaccugggaggcggagguugcggucagcug

SEQ ID NO: 510763 - RNA, 32 nt, Human
ugaaccugggaggcggagguugcggugagcug

SEQ ID NO: 510764 - RNA, 32 nt, Human
ugaaccugggaggcggagguugcugugagcug

SEQ ID NO: 510765 - RNA, 32 nt, Human
ugaaccugggaggcggagguuguagugagcca

SEQ ID NO: 510766 - RNA, 32 nt, Human
ugaaccugggaggcggagguuguagugagccg

SEQ ID NO: 510767 - RNA, 32 nt, Human
ugaaccugggaggcggagguugugaugagcca

SEQ ID NO: 510768 - RNA, 32 nt, Human
ugaaccugggaggcggagguuguggugagcca

SEQ ID NO: 510769 - RNA, 32 nt, Human
ugaaccugggaggcggagguuguggugagccg

SEQ ID NO: 510770 - RNA, 32 nt, Human
ugaaccugggaggcggauguugaagugagcug

SEQ ID NO: 510771 - RNA, 32 nt, Human
ugaaccugggaggcggggguuguggugagccg

SEQ ID NO: 510772 - RNA, 32 nt, Human
ugaaccugggaggcugaaguugcagugagccg

SEQ ID NO: 510773 - RNA, 32 nt, Human
ugaaccugggaggcugagcuugcagugagcug

SEQ ID NO: 510774 - RNA, 32 nt, Human
ugaaccugggagggcggagguugcagugagcc

SEQ ID NO: 510775 - RNA, 32 nt, Human
ugaaccugggagggggagguugccgugagcug

SEQ ID NO: 510776 - RNA, 32 nt, Human
ugaaccugggagguacagguugcagugagccc

SEQ ID NO: 510777 - RNA, 32 nt, Human
ugaaccugggagguagaaguugcagugagcca

SEQ ID NO: 510778 - RNA, 32 nt, Human
ugaaccugggagguagagguugcacugagccg

SEQ ID NO: 510779 - RNA, 32 nt, Human
ugaaccugggagguagagguugcagugagcca

SEQ ID NO: 510780 - RNA, 32 nt, Human
ugaaccugggagguagagguugcagugagccg

SEQ ID NO: 510781 - RNA, 32 nt, Human
ugaaccugggaggucaaagcggcagugagcua

SEQ ID NO: 510782 - RNA, 32 nt, Human
ugaaccugggaggucaagauugcagugagcua

SEQ ID NO: 510783 - RNA, 32 nt, Human
ugaaccugggaggucaaggcuccagugaacca

SEQ ID NO: 510784 - RNA, 32 nt, Human
ugaaccugggaggugaagguugcugugggcca

SEQ ID NO: 510785 - RNA, 32 nt, Human
ugaaccugggagguggaagcugcagugagcca

SEQ ID NO: 510786 - RNA, 32 nt, Human
ugaaccugggagguggaaguugcagugagcca

SEQ ID NO: 510787 - RNA, 32 nt, Human
ugaaccugggagguggaaguugcagugagccg

SEQ ID NO: 510788 - RNA, 32 nt, Human
ugaaccugggagguggaaguugcagugagcug

SEQ ID NO: 510789 - RNA, 32 nt, Human
ugaaccugggagguggagacugcagugagccg

SEQ ID NO: 510790 - RNA, 32 nt, Human
ugaaccugggagguggagauugcagugagccc

SEQ ID NO: 510791 - RNA, 32 nt, Human
ugaaccugggagguggagauugcagugaguca

SEQ ID NO: 510792 - RNA, 32 nt, Human
ugaaccugggagguggagcuugcagugaaccg

SEQ ID NO: 510793 - RNA, 32 nt, Human
ugaaccugggagguggagcuugcagugagccg

SEQ ID NO: 510794 - RNA, 32 nt, Human
ugaaccugggagguggagcuugcagugagcgg

SEQ ID NO: 510795 - RNA, 32 nt, Human
ugaaccugggagguggagcuugcagugagcug

SEQ ID NO: 510796 - RNA, 32 nt, Human
  misc_feature (25)..(25): n is a, c, g or u
ugaaccugggagguggagcuugcanugagcca

SEQ ID NO: 510797 - RNA, 32 nt, Human
ugaaccugggagguggaggcagugagcugaga

SEQ ID NO: 510798 - RNA, 32 nt, Human
ugaaccugggagguggaggcuacagugagcug

SEQ ID NO: 510799 - RNA, 32 nt, Human
ugaaccugggagguggaggggaggcugcagug

SEQ ID NO: 510800 - RNA, 32 nt, Human
ugaaccugggagguggagguuacagugagccg

SEQ ID NO: 510801 - RNA, 32 nt, Human
ugaaccugggagguggagguuauagugagccu

SEQ ID NO: 510802 - RNA, 32 nt, Human
ugaaccugggagguggagguugaggugagcuc

SEQ ID NO: 510803 - RNA, 32 nt, Human
ugaaccugggagguggagguugcagcgagcca

SEQ ID NO: 510804 - RNA, 32 nt, Human
ugaaccugggagguggagguugcaguaagcca

SEQ ID NO: 510805 - RNA, 32 nt, Human
ugaaccugggagguggagguugcaguaagcug

SEQ ID NO: 510806 - RNA, 32 nt, Human
ugaaccugggagguggagguugcagugagcag

SEQ ID NO: 510807 - RNA, 32 nt, Human
ugaaccugggagguggagguugcagugagcca

SEQ ID NO: 510808 - RNA, 32 nt, Human
ugaaccugggagguggagguugcagugagccg

SEQ ID NO: 510809 - RNA, 32 nt, Human
ugaaccugggagguggagguugcagugagcug

SEQ ID NO: 510810 - RNA, 32 nt, Human
ugaaccugggagguggagguugcagugagucg

SEQ ID NO: 510811 - RNA, 32 nt, Human
ugaaccugggagguggagguugcagugaguug

SEQ ID NO: 510812 - RNA, 32 nt, Human
ugaaccugggagguggagguugcagugggcca

SEQ ID NO: 510813 - RNA, 32 nt, Human
ugaaccugggagguggagguugcagugggcua

SEQ ID NO: 510814 - RNA, 32 nt, Human
ugaaccugggagguggagguugcagugggcug

SEQ ID NO: 510815 - RNA, 32 nt, Human
ugaaccugggagguggagguugcauugagcca

SEQ ID NO: 510816 - RNA, 32 nt, Human
ugaaccugggagguggagguugcauugagcug

SEQ ID NO: 510817 - RNA, 32 nt, Human
ugaaccugggagguggagguugcggugagcca

SEQ ID NO: 510818 - RNA, 32 nt, Human
ugaaccugggagguggagguugcggugagccg

SEQ ID NO: 510819 - RNA, 32 nt, Human
ugaaccugggagguggagguugcggugagcug

SEQ ID NO: 510820 - RNA, 32 nt, Human
ugaaccugggagguggagguugcugugagcug

SEQ ID NO: 510821 - RNA, 32 nt, Human
ugaaccugggagguggagguuguggugagcca

SEQ ID NO: 510822 - RNA, 32 nt, Human
ugaaccugggagguggagguuguggugaggcg

SEQ ID NO: 510823 - RNA, 32 nt, Human
ugaaccugggagguggagguuucagugagcca

SEQ ID NO: 510824 - RNA, 32 nt, Human
ugaaccugggagguggaguugcagugagccga

SEQ ID NO: 510825 - RNA, 32 nt, Human
ugaaccugggagguggauguugcagugagcug

SEQ ID NO: 510826 - RNA, 32 nt, Human
ugaaccugggagguggggguuucagugagcug

SEQ ID NO: 510827 - RNA, 32 nt, Human
ugaaccugggagguggugguugcagugagcug

SEQ ID NO: 510828 - RNA, 32 nt, Human
ugaaccugggaguuagagguugcagugagcug

SEQ ID NO: 510829 - RNA, 32 nt, Human
ugaaccugggaguuggagguugcagugaaacg

SEQ ID NO: 510830 - RNA, 32 nt, Human
ugaaccugggcggcagagguugcagugaguca

SEQ ID NO: 510831 - RNA, 32 nt, Human
ugaaccugguaggcagagguugcagugagccg

SEQ ID NO: 510832 - RNA, 32 nt, Human
ugaaccugguaggcagagguuguagugagccg

SEQ ID NO: 510833 - RNA, 32 nt, Human
ugaaccugguagguggagguuucauugagcca

SEQ ID NO: 510834 - RNA, 32 nt, Human
ugaaccugguucugcauuccccaccaccuccc

SEQ ID NO: 510835 - RNA, 32 nt, Human
ugaaccuguaaggcggagguugcagugagccg

SEQ ID NO: 510836 - RNA, 32 nt, Human
ugaaccugucaggaggaguccuggaggcuggu

SEQ ID NO: 510837 - RNA, 32 nt, Human
ugaaccugugaggaagagguugcagugagcug

SEQ ID NO: 510838 - RNA, 32 nt, Human
ugaaccugugaggcagagguugcagugagcca

SEQ ID NO: 510839 - RNA, 32 nt, Human
ugaaccugugagguggagcuugcagugagcca

SEQ ID NO: 510840 - RNA, 32 nt, Human
ugaaccugugggucagagguugcagugaacca

SEQ ID NO: 510841 - RNA, 32 nt, Human
ugaaccuucagauaugcacagcaagagccaag

SEQ ID NO: 510842 - RNA, 32 nt, Human
ugaaccuuggaggcagagguugcagugagcug

SEQ ID NO: 510843 - RNA, 32 nt, Human
ugaaccuuggugcccuaauuguggacccacug

SEQ ID NO: 510844 - RNA, 32 nt, Human
ugaaccuugguguccauguccuggagacgggg

SEQ ID NO: 510845 - RNA, 32 nt, Human
ugaaccuuguguuagcauucucucucuaucuc

SEQ ID NO: 510846 - RNA, 32 nt, Human
ugaacgaaaaagagguagcacuacaaacacaa

SEQ ID NO: 510847 - RNA, 32 nt, Human
ugaacgacacuaugacauguucccucuuacuu

SEQ ID NO: 510848 - RNA, 32 nt, Human
ugaacgacccugcuguccuuuuuaaccugugu

SEQ ID NO: 510849 - RNA, 32 nt, Human
ugaacgacgugagaggcaucucccagccccuc

SEQ ID NO: 510850 - RNA, 32 nt, Human
ugaacgagcucccuccugauuuucacacagac

SEQ ID NO: 510851 - RNA, 32 nt, Human
ugaacgaggagagcacugcugaucagacuagg

SEQ ID NO: 510852 - RNA, 32 nt, Human
ugaacgaguacuggaggagagaauguacguuu

SEQ ID NO: 510853 - RNA, 32 nt, Human
ugaacgauucccuuugcuaaugccuagugcau

SEQ ID NO: 510854 - RNA, 32 nt, Human
ugaacgcaagaggcagcaucuauggugggaaa

SEQ ID NO: 510855 - RNA, 32 nt, Human
ugaacgcaggaggcugaggcugcagugaguug

SEQ ID NO: 510856 - RNA, 32 nt, Human
ugaacgcccggcccccgcgccugcugcggggc

SEQ ID NO: 510857 - RNA, 32 nt, Human
ugaacgcgggaggcagagacugcagugagccg

SEQ ID NO: 510858 - RNA, 32 nt, Human
ugaacgcgggagguggaggauacaaugaaccc

SEQ ID NO: 510859 - RNA, 32 nt, Human
ugaacgcucaccacccugacccuccuuccaga

SEQ ID NO: 510860 - RNA, 32 nt, Human
ugaacggcagccucccaaccacacaacacauc

SEQ ID NO: 510861 - RNA, 32 nt, Human
ugaacggccagagacuuccuggucaauacucc

SEQ ID NO: 510862 - RNA, 32 nt, Human
ugaacggcgagugcucggagaacaagcacgcc

SEQ ID NO: 510863 - RNA, 32 nt, Human
ugaacggcuggccugugguggaugggugcucu

SEQ ID NO: 510864 - RNA, 19 nt, Human
ugaacgggaaggagcccca

SEQ ID NO: 510865 - RNA, 32 nt, Human
ugaacgggagcacgggugcgccagggccccca

SEQ ID NO: 510866 - RNA, 32 nt, Human
ugaacggggcggcaggcuucucgagcuccggg

SEQ ID NO: 510867 - RNA, 32 nt, Human
ugaacgucacccagagacuguaauuuguguag

SEQ ID NO: 510868 - RNA, 32 nt, Human
ugaacgucuuggugugugcacacauuugguca

SEQ ID NO: 510869 - RNA, 32 nt, Human
ugaacguggaccuaucgaaagccagcuucagg

SEQ ID NO: 510870 - RNA, 32 nt, Human
ugaacguggaccuggugugcaaagggaaguuu

SEQ ID NO: 510871 - RNA, 32 nt, Human
ugaacgugggaggcagaaguugcagugagcca

SEQ ID NO: 510872 - RNA, 32 nt, Human
ugaacgugggaggcagagguugcagugagccg

SEQ ID NO: 510873 - RNA, 32 nt, Human
ugaacgugggaggcagagguugcagugagugg

SEQ ID NO: 510874 - RNA, 32 nt, Human
ugaacgugggaggcggagguugcagcgagcug

SEQ ID NO: 510875 - RNA, 32 nt, Human
ugaacgugggaggcggagguugcagugagcug

SEQ ID NO: 510876 - RNA, 32 nt, Human
ugaacgugggaggcggagguuguagugagcca

SEQ ID NO: 510877 - RNA, 32 nt, Human
ugaacguguguauguaaauguauguguguaua

SEQ ID NO: 510878 - RNA, 32 nt, Human
ugaacguucuuuucccuccuggguuguucauc

SEQ ID NO: 510879 - RNA, 32 nt, Human
ugaacguuuacagggcugcacuggcccaagcc

SEQ ID NO: 510880 - RNA, 32 nt, Human
ugaacuaaaggcagacuuucaguaccaagagu

SEQ ID NO: 510881 - RNA, 32 nt, Human
ugaacuaaauguugaagacaaguuugagaucu

SEQ ID NO: 510882 - RNA, 32 nt, Human
ugaacuacuugaauauauguaauguuuauuuc

SEQ ID NO: 510883 - RNA, 32 nt, Human
ugaacuaggaggcagagguugcagugagccga

SEQ ID NO: 510884 - RNA, 21 nt, Human
ugaacuaggaguccugggaga

SEQ ID NO: 510885 - RNA, 21 nt, Human
ugaacuauaaauggugcuucu

SEQ ID NO: 510886 - RNA, 32 nt, Human
ugaacuaucaaauuauaggcaaccacugacua

SEQ ID NO: 510887 - RNA, 32 nt, Human
ugaacuaugcuuggagagagcccugaauccuu

SEQ ID NO: 510888 - RNA, 32 nt, Human
ugaacuauggcuuacaaguauuggacagugcc

SEQ ID NO: 510889 - RNA, 32 nt, Human
ugaacuauucuaccacccuuaaaguuggagcu

SEQ ID NO: 510890 - RNA, 32 nt, Human
ugaacucacugcgcagaagcccccagggaggg

SEQ ID NO: 510891 - RNA, 32 nt, Human
ugaacucagaaggcagagguugcaguggaaaa

SEQ ID NO: 510892 - RNA, 32 nt, Human
ugaacucagaaggcggaggcugcagugagccg

SEQ ID NO: 510893 - RNA, 32 nt, Human
ugaacucagaaggcggagguuccagugagcca

SEQ ID NO: 510894 - RNA, 32 nt, Human
ugaacucagaagguggagguugcagugaggcg

SEQ ID NO: 510895 - RNA, 32 nt, Human
ugaacucagaaguucaagaccagucugggcaa

SEQ ID NO: 510896 - RNA, 32 nt, Human
ugaacucagcugucaucugcagccucugccuc

SEQ ID NO: 510897 - RNA, 32 nt, Human
ugaacucagcuucaagaccccacgcugcugca

SEQ ID NO: 510898 - RNA, 32 nt, Human
ugaacucagcuuggggcugugaagggacagcc

SEQ ID NO: 510899 - RNA, 32 nt, Human
ugaacucaggagacggagguuacagugagucg

SEQ ID NO: 510900 - RNA, 32 nt, Human
ugaacucaggagauggagguuucagugagcca

SEQ ID NO: 510901 - RNA, 32 nt, Human
ugaacucaggaggcagaaguugcgguuagccg

SEQ ID NO: 510902 - RNA, 32 nt, Human
ugaacucaggaggcagagguugcaaugagcca

SEQ ID NO: 510903 - RNA, 32 nt, Human
ugaacucaggaggcggaaguugcggugagcca

SEQ ID NO: 510904 - RNA, 32 nt, Human
ugaacucaggaggcggagcuugcagugagccg

SEQ ID NO: 510905 - RNA, 32 nt, Human
ugaacucaggaggcggagguugcggugagccg

SEQ ID NO: 510906 - RNA, 32 nt, Human
ugaacucaggaggcggagguugcggugagcug

SEQ ID NO: 510907 - RNA, 32 nt, Human
ugaacucaggagguggagguugcagugagcug

SEQ ID NO: 510908 - RNA, 32 nt, Human
ugaacucaggagguggagguugcggugagcca

SEQ ID NO: 510909 - RNA, 32 nt, Human
ugaacucaggaguucaagaccagccugggaaa

SEQ ID NO: 510910 - RNA, 32 nt, Human
ugaacucaggaguucaagaccagccugggcaa

SEQ ID NO: 510911 - RNA, 32 nt, Human
ugaacucaggcagcccuucaguggcuucuuca

SEQ ID NO: 510912 - RNA, 20 nt, Human
ugaacucaggcagccuagua

SEQ ID NO: 510913 - RNA, 32 nt, Human
ugaacucaggcagccuaguagaggcaguggug

SEQ ID NO: 510914 - RNA, 32 nt, Human
ugaacucagguggcagagguugcagugagccg

SEQ ID NO: 510915 - RNA, 32 nt, Human
ugaacucaucauuccagccugggcaacaagag

SEQ ID NO: 510916 - RNA, 32 nt, Human
ugaacucauugaacuccuccugacacccuggc

SEQ ID NO: 510917 - RNA, 32 nt, Human
ugaacuccaaccugcacuccagccugggcaac

SEQ ID NO: 510918 - RNA, 32 nt, Human
ugaacuccagccugggcaacagagugagauuc

SEQ ID NO: 510919 - RNA, 32 nt, Human
ugaacuccagccugggcaacaggugagauucu

SEQ ID NO: 510920 - RNA, 32 nt, Human
ugaacuccagccugggccacauagcaagaccc

SEQ ID NO: 510921 - RNA, 32 nt, Human
ugaacuccagccugggugacagagugagacuc

SEQ ID NO: 510922 - RNA, 32 nt, Human
ugaacuccauugaagggaucauccuaaguuuu

SEQ ID NO: 510923 - RNA, 32 nt, Human
ugaacucccaaaggaagccucaaaacuaugca

SEQ ID NO: 510924 - RNA, 23 nt, Human
ugaacuccgaggcuugguugccu

SEQ ID NO: 510925 - RNA, 22 nt, Human
ugaacuccuagacucaagugau

SEQ ID NO: 510926 - RNA, 22 nt, Human
ugaacuccuaggcucaagugau

SEQ ID NO: 510927 - RNA, 22 nt, Human
ugaacuccugaacucaagugau

SEQ ID NO: 510928 - RNA, 22 nt, Human
ugaacuccugaccucaagugau

SEQ ID NO: 510929 - RNA, 23 nt, Human
ugaacuccugaccucaagugauu

SEQ ID NO: 510930 - RNA, 32 nt, Human
ugaacuccugaccucacacaauccuccugccu

SEQ ID NO: 510931 - RNA, 22 nt, Human
ugaacuccugagcucaagugau

SEQ ID NO: 510932 - RNA, 32 nt, Human
ugaacuccugaguucaagcgauccaccugccu

SEQ ID NO: 510933 - RNA, 22 nt, Human
ugaacuccugaucucaagugau

SEQ ID NO: 510934 - RNA, 32 nt, Human
ugaacuccugcacucuccagaagugacugguc

SEQ ID NO: 510935 - RNA, 22 nt, Human
ugaacuccuggacucuagugau

SEQ ID NO: 510936 - RNA, 32 nt, Human
ugaacuccuggacuuuuccugcuacugauucu

SEQ ID NO: 510937 - RNA, 22 nt, Human
ugaacuccuggccucaaaugau

SEQ ID NO: 510938 - RNA, 22 nt, Human
ugaacuccuggccucaagcgau

SEQ ID NO: 510939 - RNA, 21 nt, Human
ugaacuccuggccucaaguga

SEQ ID NO: 510940 - RNA, 22 nt, Human
ugaacuccuggccucaagugau

SEQ ID NO: 510941 - RNA, 23 nt, Human
ugaacuccuggccucaagugauu

SEQ ID NO: 510942 - RNA, 22 nt, Human
ugaacuccugggcacaagugau

SEQ ID NO: 510943 - RNA, 22 nt, Human
ugaacuccugggcucaagcgau

SEQ ID NO: 510944 - RNA, 19 nt, Human
ugaacuccugggcucaagu

SEQ ID NO: 510945 - RNA, 22 nt, Human
ugaacuccugggcucaagugau

SEQ ID NO: 510946 - RNA, 23 nt, Human
ugaacuccugggcucaagugauu

SEQ ID NO: 510947 - RNA, 22 nt, Human
ugaacuccugggcucgaaugau

SEQ ID NO: 510948 - RNA, 22 nt, Human
ugaacuccuggucucaagugau

SEQ ID NO: 510949 - RNA, 32 nt, Human
ugaacuccuuuuuguaaaacagccuccauaau

SEQ ID NO: 510950 - RNA, 32 nt, Human
ugaacucgaagcccacaauccucgucugaauc

SEQ ID NO: 510951 - RNA, 32 nt, Human
ugaacucgccucccccgugacucugccucggg

SEQ ID NO: 510952 - RNA, 32 nt, Human
ugaacucgggaggaagagguugcagugagcug

SEQ ID NO: 510953 - RNA, 32 nt, Human
ugaacucgggaggcagagguugcagugagcug

SEQ ID NO: 510954 - RNA, 32 nt, Human
ugaacucgggaggcagagguugucaugagcug

SEQ ID NO: 510955 - RNA, 32 nt, Human
ugaacucgggaggcgaagguugcagugagccg

SEQ ID NO: 510956 - RNA, 32 nt, Human
ugaacucgggaggcggagguugcagugagccg

SEQ ID NO: 510957 - RNA, 32 nt, Human
ugaacucgggaggcggauguugcagugagcca

SEQ ID NO: 510958 - RNA, 32 nt, Human
ugaacucgggaggugaaaguugcagugagccg

SEQ ID NO: 510959 - RNA, 32 nt, Human
ugaacucgggagguggagauugcaguaagccg

SEQ ID NO: 510960 - RNA, 32 nt, Human
ugaacucgggagguggagguggcagugagccg

SEQ ID NO: 510961 - RNA, 32 nt, Human
ugaacucgggagguggagguugcagucagcca

SEQ ID NO: 510962 - RNA, 32 nt, Human
ugaacucgggagguggagguugcagugagcug

SEQ ID NO: 510963 - RNA, 32 nt, Human
ugaacucgggagguggagguugugaugugcug

SEQ ID NO: 510964 - RNA, 32 nt, Human
ugaacucgggugggggagguugcaaugagccg

SEQ ID NO: 510965 - RNA, 21 nt, Human
ugaacucuacuguaacuguuu

SEQ ID NO: 510966 - RNA, 32 nt, Human
ugaacucucagguugugagugcugcuauugga

SEQ ID NO: 510967 - RNA, 32 nt, Human
ugaacucucuaccaugaacaugguucucggcu

SEQ ID NO: 510968 - RNA, 32 nt, Human
ugaacucucucuuccuucuccuuuucuuuccu

SEQ ID NO: 510969 - RNA, 32 nt, Human
ugaacucugagcugcaaggacaagaacgccac

SEQ ID NO: 510970 - RNA, 32 nt, Human
ugaacucuggccccucagguuucaaggggacg

SEQ ID NO: 510971 - RNA, 32 nt, Human
ugaacucugggaguugugugcgcagucuuggg

SEQ ID NO: 510972 - RNA, 21 nt, Human
ugaacucugucugaccaaaac

SEQ ID NO: 510973 - RNA, 32 nt, Human
ugaacucuuaaagcuucaugagcagcugcuug

SEQ ID NO: 510974 - RNA, 32 nt, Human
ugaacucuucuccaucuccaagcagacaaccu

SEQ ID NO: 510975 - RNA, 32 nt, Human
ugaacucuucugccauuuuccuccuucacucg

SEQ ID NO: 510976 - RNA, 32 nt, Human
ugaacucuucuuucuuaccugcuuugcggugc

SEQ ID NO: 510977 - RNA, 32 nt, Human
ugaacucuuggccucuaucucagcuccagccc

SEQ ID NO: 510978 - RNA, 22 nt, Human
ugaacucuugggcucaagcgau

SEQ ID NO: 510979 - RNA, 22 nt, Human
ugaacucuugggcucaagugau

SEQ ID NO: 510980 - RNA, 32 nt, Human
ugaacucuuuagccacaacccucaccuucccu

SEQ ID NO: 510981 - RNA, 32 nt, Human
ugaacucuuucugagagacugcagcacaccua

SEQ ID NO: 510982 - RNA, 32 nt, Human
ugaacugacaugcuccuaccaugaccaggcuc

SEQ ID NO: 510983 - RNA, 32 nt, Human
ugaacugaccaacacuggaugaauuugaccau

SEQ ID NO: 510984 - RNA, 32 nt, Human
ugaacugacucuacagcuucuggcaggccgug

SEQ ID NO: 510985 - RNA, 32 nt, Human
ugaacugagccaaaccuucagugccuuccaga

SEQ ID NO: 510986 - RNA, 32 nt, Human
ugaacugaggaaggugcuuagauggugagggc

SEQ ID NO: 510987 - RNA, 32 nt, Human
ugaacugaggagaugaagguuacagugagcca

SEQ ID NO: 510988 - RNA, 32 nt, Human
ugaacugaggagguggagguugcagugagccg

SEQ ID NO: 510989 - RNA, 32 nt, Human
ugaacugaggcagaggcuacagugaguggaga

SEQ ID NO: 510990 - RNA, 32 nt, Human
ugaacugaggcccgaaggcuugagucaaacug

SEQ ID NO: 510991 - RNA, 32 nt, Human
ugaacugaggggaguagagggagagggcaggu

SEQ ID NO: 510992 - RNA, 32 nt, Human
ugaacugaguucuucaacuacagguugaagga

SEQ ID NO: 510993 - RNA, 32 nt, Human
ugaacugcaagcuccccucagcccaucuugcu

SEQ ID NO: 510994 - RNA, 32 nt, Human
ugaacugccucaggaccccacuggagagcaca

SEQ ID NO: 510995 - RNA, 32 nt, Human
ugaacugccuugucuuugucauggaagccaca

SEQ ID NO: 510996 - RNA, 32 nt, Human
ugaacugcuacgggcagcgcugggcggcgggc

SEQ ID NO: 510997 - RNA, 32 nt, Human
ugaacugcuugccugcacuuuuaucuuagacu

SEQ ID NO: 510998 - RNA, 32 nt, Human
ugaacuggagcaucaagacaucucauggaagu

SEQ ID NO: 510999 - RNA, 32 nt, Human
ugaacuggagccaugggcacaaagggcccaga

SEQ ID NO: 511000 - RNA, 32 nt, Human
ugaacuggagcuggcggagaccaaaugcgccu

SEQ ID NO: 511001 - RNA, 32 nt, Human
ugaacuggauauuucuuaacuuuuggaguaca

SEQ ID NO: 511002 - RNA, 32 nt, Human
ugaacuggaugaagacacagacuaaaaggaac

SEQ ID NO: 511003 - RNA, 32 nt, Human
ugaacuggaugccacagaaagaggaguggucu

SEQ ID NO: 511004 - RNA, 32 nt, Human
ugaacuggcuacggauaaaagacugaagauac

SEQ ID NO: 511005 - RNA, 32 nt, Human
ugaacuggcugauuccugcuguggcaggugca

SEQ ID NO: 511006 - RNA, 32 nt, Human
ugaacuggggaagcagagguuguagugagccg

SEQ ID NO: 511007 - RNA, 32 nt, Human
ugaacuggggaggagaagguugcagugagccg

SEQ ID NO: 511008 - RNA, 32 nt, Human
ugaacuggggaggcagagguugcagugagaca

SEQ ID NO: 511009 - RNA, 32 nt, Human
ugaacuggggaggcagagguugcaguggcccg

SEQ ID NO: 511010 - RNA, 32 nt, Human
ugaacuggggaggcagagguugcggugagccc

SEQ ID NO: 511011 - RNA, 32 nt, Human
ugaacuggggcccuggcuuuggccauuaugua

SEQ ID NO: 511012 - RNA, 31 nt, Human
ugaacuggguuuuucugacaugccuagacuc

SEQ ID NO: 511013 - RNA, 32 nt, Human
ugaacugguuuaucacaaaucugauggaucag

SEQ ID NO: 511014 - RNA, 32 nt, Human
ugaacuguaguaccuuucucuaugucaaguuu

SEQ ID NO: 511015 - RNA, 32 nt, Human
ugaacuguauuuuuacaaugaucgccgcauga

SEQ ID NO: 511016 - RNA, 24 nt, Human
ugaacugucaaguguguguugucu

SEQ ID NO: 511017 - RNA, 32 nt, Human
ugaacugucaucauuccuacuguguuugauag

SEQ ID NO: 511018 - RNA, 32 nt, Human
ugaacugugacagaagcaacuaccacaggggc

SEQ ID NO: 511019 - RNA, 32 nt, Human
ugaacuguggguggauggguggauugccuggg

SEQ ID NO: 511020 - RNA, 32 nt, Human
ugaacuguguagugcucuucuuugccauuugc

SEQ ID NO: 511021 - RNA, 32 nt, Human
ugaacuguguauuuaacuuaagcuauugcucu

SEQ ID NO: 511022 - RNA, 32 nt, Human
ugaacugugugugguuccuucuacuuggggau

SEQ ID NO: 511023 - RNA, 32 nt, Human
ugaacugugugugguuuauuguuguacauuca

SEQ ID NO: 511024 - RNA, 32 nt, Human
ugaacuguguuuuucccaucaugacggaagaa

SEQ ID NO: 511025 - RNA, 32 nt, Human
ugaacuguuaacuauuugaucuuuggauguaa

SEQ ID NO: 511026 - RNA, 32 nt, Human
ugaacuguuacgacccaggacaauuagaaaaa

SEQ ID NO: 511027 - RNA, 32 nt, Human
ugaacuguuugguagagccacccggcccuucc

SEQ ID NO: 511028 - RNA, 32 nt, Human
ugaacuuaaucaagagagacugugauaugugc

SEQ ID NO: 511029 - RNA, 32 nt, Human
ugaacuuacauacuaggugccuuuuguuuuug

SEQ ID NO: 511030 - RNA, 22 nt, Human
ugaacuuaccaccagcccuggc

SEQ ID NO: 511031 - RNA, 32 nt, Human
ugaacuuagagauuuucuucucauuucuaauu

SEQ ID NO: 511032 - RNA, 32 nt, Human
ugaacuuaguuaauggaagacugagagcagaa

SEQ ID NO: 511033 - RNA, 32 nt, Human
ugaacuucagacggaccucaggguagguucuc

SEQ ID NO: 511034 - RNA, 21 nt, Human
ugaacuucagagggugcuccu

SEQ ID NO: 511035 - RNA, 32 nt, Human
ugaacuucagcacccgagucagucccagcuca

SEQ ID NO: 511036 - RNA, 22 nt, Human
ugaacuucagcaugagcugccu

SEQ ID NO: 511037 - RNA, 32 nt, Human
ugaacuucagggaggguggucauugccuagag

SEQ ID NO: 511038 - RNA, 32 nt, Human
ugaacuucauuucuguaucaccugaccucugg

SEQ ID NO: 511039 - RNA, 32 nt, Human
ugaacuuccagccucagagaccgccgcccuug

SEQ ID NO: 511040 - RNA, 32 nt, Human
ugaacuuccucucuuuuuagaagaauggauuu

SEQ ID NO: 511041 - RNA, 32 nt, Human
ugaacuuccugagccaccagacaggaaagggu

SEQ ID NO: 511042 - RNA, 23 nt, Human
ugaacuuccuguuggugcugguu

SEQ ID NO: 511043 - RNA, 22 nt, Human
ugaacuucugggcucaagugau

SEQ ID NO: 511044 - RNA, 32 nt, Human
ugaacuugagucuaaagaugcagugccuggcc

SEQ ID NO: 511045 - RNA, 32 nt, Human
ugaacuugcaaucauggacagcaacaauuucu

SEQ ID NO: 511046 - RNA, 32 nt, Human
ugaacuugcagccuuggauggggaagggccag

SEQ ID NO: 511047 - RNA, 32 nt, Human
ugaacuuggauucaagacugucuuuucuauag

SEQ ID NO: 511048 - RNA, 32 nt, Human
ugaacuuggccccagcccugcugggcccagaa

SEQ ID NO: 511049 - RNA, 32 nt, Human
ugaacuugggagcagaggugagcugagugcag

SEQ ID NO: 511050 - RNA, 32 nt, Human
ugaacuugggaggcagagguuguggugagccg

SEQ ID NO: 511051 - RNA, 32 nt, Human
ugaacuugggaggcagagguuucagugagccg

SEQ ID NO: 511052 - RNA, 32 nt, Human
ugaacuugggaggcggagcuugcggugagcca

SEQ ID NO: 511053 - RNA, 32 nt, Human
ugaacuugggaggcggagguugcagugagcua

SEQ ID NO: 511054 - RNA, 32 nt, Human
ugaacuugggagggagagguugcagugagccc

SEQ ID NO: 511055 - RNA, 32 nt, Human
ugaacuugggagggguagguugcagugagcug

SEQ ID NO: 511056 - RNA, 32 nt, Human
ugaacuugggagguggagcuuacagugagccg

SEQ ID NO: 511057 - RNA, 32 nt, Human
ugaacuugggagguggagguugcagugagcca

SEQ ID NO: 511058 - RNA, 32 nt, Human
ugaacuugggagguggagguugcagugggccg

SEQ ID NO: 511059 - RNA, 32 nt, Human
ugaacuuguaucucuaaucugauguccauuuu

SEQ ID NO: 511060 - RNA, 32 nt, Human
ugaacuugugggguggagguugcagugagcug

SEQ ID NO: 511061 - RNA, 32 nt, Human
ugaacuuguuuucaaaauaucaucucaucaac

SEQ ID NO: 511062 - RNA, 24 nt, Human
ugaacuuuaaauaagguaaugccu

SEQ ID NO: 511063 - RNA, 32 nt, Human
ugaacuuuaaaucaaucagugcugcuggcaca

SEQ ID NO: 511064 - RNA, 32 nt, Human
ugaacuuuagagaguucuugcauuggaacugg

SEQ ID NO: 511065 - RNA, 32 nt, Human
ugaacuuucuacuuggacaacuaacacccaca

SEQ ID NO: 511066 - RNA, 32 nt, Human
ugaacuuucuguacucuuuaaggauuauuuua

SEQ ID NO: 511067 - RNA, 22 nt, Human
ugaacuuugaguucugcugucu

SEQ ID NO: 511068 - RNA, 32 nt, Human
ugaacuuuggugccaucaucugcaaaagggag

SEQ ID NO: 511069 - RNA, 21 nt, Human
ugaacuuugucaguguugccu

SEQ ID NO: 511070 - RNA, 21 nt, Human
ugaacuuuuaagauacugucu

SEQ ID NO: 511071 - RNA, 32 nt, Human
ugaacuuuugagagagaugaaaggauggucuc

SEQ ID NO: 511072 - RNA, 22 nt, Human
ugaacuuuuuuguuuuguuuug

SEQ ID NO: 511073 - RNA, 32 nt, Human
ugaagaaaagaaugacagaugcaaggaagaaa

SEQ ID NO: 511074 - RNA, 32 nt, Human
ugaagaaacuaaaauugauuugcucagacagc

SEQ ID NO: 511075 - RNA, 18 nt, Human
ugaagaaacuaucaugag

SEQ ID NO: 511076 - RNA, 32 nt, Human
ugaagaaacucaugcaccaaacucgaacuggu

SEQ ID NO: 511077 - RNA, 32 nt, Human
ugaagaaacugaggccacagagcuaaagugac

SEQ ID NO: 511078 - RNA, 32 nt, Human
ugaagaaagaagaaaagugaagagugguuacc

SEQ ID NO: 511079 - RNA, 21 nt, Human
ugaagaaagagaagcagaacu

SEQ ID NO: 511080 - RNA, 32 nt, Human
ugaagaaagaggacuuggcagagcaggaaugc

SEQ ID NO: 511081 - RNA, 32 nt, Human
ugaagaaaggcaaaggagacaccuguuccuuc

SEQ ID NO: 511082 - RNA, 19 nt, Human
ugaagaaauuaauagcaga

SEQ ID NO: 511083 - RNA, 32 nt, Human
ugaagaacaaauucuuguuaagcaaauagucc

SEQ ID NO: 511084 - RNA, 32 nt, Human
ugaagaacacccuggccuccuccaucaugucg

SEQ ID NO: 511085 - RNA, 32 nt, Human
ugaagaacagagaccugucuggaaaaucgauc

SEQ ID NO: 511086 - RNA, 32 nt, Human
ugaagaacagagccucucaaucagacgggugu

SEQ ID NO: 511087 - RNA, 20 nt, Human
ugaagaacauacacuauuaa

SEQ ID NO: 511088 - RNA, 32 nt, Human
ugaagaacauagugcaacuguacagguaguca

SEQ ID NO: 511089 - RNA, 32 nt, Human
ugaagaacauagugucuuuccucuauugugga

SEQ ID NO: 511090 - RNA, 32 nt, Human
ugaagaacccaagcuccugucaaaguugugaa

SEQ ID NO: 511091 - RNA, 32 nt, Human
ugaagaacugcaggagggcccucagcugugag

SEQ ID NO: 511092 - RNA, 32 nt, Human
ugaagaacugucucccaacaaaggauacaugc

SEQ ID NO: 511093 - RNA, 32 nt, Human
ugaagaagaccagccuuuacugagucgguuca

SEQ ID NO: 511094 - RNA, 32 nt, Human
ugaagaagagaaagaggagauuggcugaggcu

SEQ ID NO: 511095 - RNA, 32 nt, Human
ugaagaagccacuaccuccaccaccaccagca

SEQ ID NO: 511096 - RNA, 32 nt, Human
ugaagaagcccaucaguauuucuugaauacca

SEQ ID NO: 511097 - RNA, 32 nt, Human
ugaagaagccgcacuacuucaccuggccaccc

SEQ ID NO: 511098 - RNA, 21 nt, Human
ugaagaagccugcaaagccuu

SEQ ID NO: 511099 - RNA, 23 nt, Human
ugaagaagcgauuugggggccag

SEQ ID NO: 511100 - RNA, 32 nt, Human
ugaagaagcugacagaagaguuugggccucac

SEQ ID NO: 511101 - RNA, 32 nt, Human
ugaagaagcugcaauucugccugggugccuug

SEQ ID NO: 511102 - RNA, 32 nt, Human
ugaagaaggaagaggauuccaggcugagagca

SEQ ID NO: 511103 - RNA, 32 nt, Human
ugaagaaggggugcgggggugugcggugcccu

SEQ ID NO: 511104 - RNA, 32 nt, Human
ugaagaaguggcugccccuugcuggaccugaa

SEQ ID NO: 511105 - RNA, 32 nt, Human
ugaagaaguucagaaauuuaaaagcagagcau

SEQ ID NO: 511106 - RNA, 32 nt, Human
ugaagaauaaagccucauauccaggaaaaagu

SEQ ID NO: 511107 - RNA, 32 nt, Human
ugaagaauacccacuugguugcagaggccaac

SEQ ID NO: 511108 - RNA, 32 nt, Human
ugaagaauacugggggagggugugguggguuc

SEQ ID NO: 511109 - RNA, 32 nt, Human
ugaagaaucagaggaggaagaggaagaggagg

SEQ ID NO: 511110 - RNA, 32 nt, Human
ugaagaaucaguuuaaaagauccaaggaguac

SEQ ID NO: 511111 - RNA, 32 nt, Human
ugaagaaucccagugaguucugcauuuguauc

SEQ ID NO: 511112 - RNA, 32 nt, Human
ugaagaaucucuucaggaaaccagagcuuccc

SEQ ID NO: 511113 - RNA, 32 nt, Human
ugaagaaugcucugcauuuccuugauuucuau

SEQ ID NO: 511114 - RNA, 32 nt, Human
ugaagaauggagggaggagcaggcuaggaaga

SEQ ID NO: 511115 - RNA, 31 nt, Human
ugaagaauggcagaugaacggaaagacgaag

SEQ ID NO: 511116 - RNA, 32 nt, Human
ugaagaaugggaacacugaaaaguaggggcau

SEQ ID NO: 511117 - RNA, 27 nt, Human
ugaagaaugucucuagaagagaaugaa

SEQ ID NO: 511118 - RNA, 32 nt, Human
ugaagaaugucuuccagaagaaaguagauacc

SEQ ID NO: 511119 - RNA, 32 nt, Human
ugaagaauuaagacaggggcucagggaaucuc

SEQ ID NO: 511120 - RNA, 32 nt, Human
ugaagaauucuagcaucaggaacaagagaaga

SEQ ID NO: 511121 - RNA, 32 nt, Human
ugaagacaacaucacucugaaguguuaucagc

SEQ ID NO: 511122 - RNA, 32 nt, Human
ugaagacaacuugcuuugauucaaccuaaaaa

SEQ ID NO: 511123 - RNA, 32 nt, Human
ugaagacaagaaugcacccuucaagcagugua

SEQ ID NO: 511124 - RNA, 32 nt, Human
ugaagacaauaugcaacaugguauguccauua

SEQ ID NO: 511125 - RNA, 32 nt, Human
ugaagacaaucagaaugauuaccuuucuaccu

SEQ ID NO: 511126 - RNA, 32 nt, Human
ugaagacaaucagggaaaagacccuucuaaaa

SEQ ID NO: 511127 - RNA, 32 nt, Human
ugaagacacacguucacacccaguccaucaug

SEQ ID NO: 511128 - RNA, 32 nt, Human
ugaagacacagagagaagagggccgaggagag

SEQ ID NO: 511129 - RNA, 32 nt, Human
ugaagacacgcagagaugcccacccacguggg

SEQ ID NO: 511130 - RNA, 32 nt, Human
ugaagacacgcccgacucucuccaucagaagg

SEQ ID NO: 511131 - RNA, 32 nt, Human
ugaagacagaaaggaaaggggagaaaccugca

SEQ ID NO: 511132 - RNA, 21 nt, Human
ugaagacagacagucaggcug

SEQ ID NO: 511133 - RNA, 32 nt, Human
ugaagacagaggcagagauuggagugacgcau

SEQ ID NO: 511134 - RNA, 32 nt, Human
ugaagacagcacagcagccauaccccucacca

SEQ ID NO: 511135 - RNA, 32 nt, Human
ugaagacagcccgauccuccccuggacucccg

SEQ ID NO: 511136 - RNA, 32 nt, Human
ugaagacauaaagaaguggaaggagagauacg

SEQ ID NO: 511137 - RNA, 32 nt, Human
ugaagacauaauagcucaaccucuaggauuuu

SEQ ID NO: 511138 - RNA, 32 nt, Human
ugaagacauccggaagaaggugagucugggag

SEQ ID NO: 511139 - RNA, 32 nt, Human
ugaagacauggggaacacagaggcagaaacag

SEQ ID NO: 511140 - RNA, 32 nt, Human
ugaagaccaagaagaagugggaggugacuggc

SEQ ID NO: 511141 - RNA, 32 nt, Human
ugaagaccacuaaaacacuucauugagagagu

SEQ ID NO: 511142 - RNA, 32 nt, Human
ugaagaccacuaacggcuuuuguuuccucugg

SEQ ID NO: 511143 - RNA, 32 nt, Human
ugaagaccagccugagaaauaaggugaaaccc

SEQ ID NO: 511144 - RNA, 32 nt, Human
ugaagaccagccuggccaacauggcaaaaacc

SEQ ID NO: 511145 - RNA, 32 nt, Human
ugaagaccagccuggccaacauggugaaaccc

SEQ ID NO: 511146 - RNA, 32 nt, Human
ugaagaccagccugggcaacacagugagacuu

SEQ ID NO: 511147 - RNA, 32 nt, Human
ugaagaccagccugggcaacauagugagaaaa

SEQ ID NO: 511148 - RNA, 32 nt, Human
ugaagaccaggagaagguugagcugcuaaagc

SEQ ID NO: 511149 - RNA, 32 nt, Human
ugaagaccauuuucaagagggacgguauuuau

SEQ ID NO: 511150 - RNA, 32 nt, Human
ugaagaccauuuucugguucuguguccucugc

SEQ ID NO: 511151 - RNA, 32 nt, Human
ugaagacccagccugcugagacuccuccugca

SEQ ID NO: 511152 - RNA, 32 nt, Human
ugaagaccugaugcccuggagcccacugcagu

SEQ ID NO: 511153 - RNA, 32 nt, Human
ugaagaccuugauuccugccugggcaguucua

SEQ ID NO: 511154 - RNA, 32 nt, Human
ugaagacgcauuccuuuccugccaaccucuuu

SEQ ID NO: 511155 - RNA, 32 nt, Human
ugaagacucacucuuuggaauguccucuugcu

SEQ ID NO: 511156 - RNA, 32 nt, Human
ugaagacucuuuuuaccagagguuuccucuua

SEQ ID NO: 511157 - RNA, 32 nt, Human
ugaagacugccaaggagcagauuuucucccug

SEQ ID NO: 511158 - RNA, 32 nt, Human
ugaagacugccucuggccugcagcugaccugg

SEQ ID NO: 511159 - RNA, 32 nt, Human
ugaagacuggggcucccugaggacagggcugu

SEQ ID NO: 511160 - RNA, 20 nt, Human
ugaagacugucucccgggga

SEQ ID NO: 511161 - RNA, 32 nt, Human
ugaagacuguuuccagccuggcugugagccaa

SEQ ID NO: 511162 - RNA, 32 nt, Human
ugaagacuucuuuaacaaucuuguuuggguuu

SEQ ID NO: 511163 - RNA, 32 nt, Human
ugaagacuuucucuuucccugccuguauuaca

SEQ ID NO: 511164 - RNA, 24 nt, Human
ugaagagaagacuuccuuuccucu

SEQ ID NO: 511165 - RNA, 32 nt, Human
ugaagagaagcagcagucuuuacuuuuccagc

SEQ ID NO: 511166 - RNA, 32 nt, Human
ugaagagaaguuagaaguuuccagauauggag

SEQ ID NO: 511167 - RNA, 32 nt, Human
ugaagagacagagacaaguaauuucaguguaa

SEQ ID NO: 511168 - RNA, 32 nt, Human
ugaagagacaguguccagaagaagcaucuucc

SEQ ID NO: 511169 - RNA, 32 nt, Human
ugaagagacauagccaugcggggccugaaucu

SEQ ID NO: 511170 - RNA, 32 nt, Human
ugaagagagaccucuggauccccaacuuacca

SEQ ID NO: 511171 - RNA, 32 nt, Human
ugaagagagagagggucuccuauguuuccuag

SEQ ID NO: 511172 - RNA, 32 nt, Human
ugaagagagagggaaacacagcagcaucucuc

SEQ ID NO: 511173 - RNA, 19 nt, Human
ugaagagagaucuuacaaa

SEQ ID NO: 511174 - RNA, 32 nt, Human
ugaagagagguaucauccaucccuaucagagu

SEQ ID NO: 511175 - RNA, 32 nt, Human
ugaagagagguaucauugcuguggaaaaaucu

SEQ ID NO: 511176 - RNA, 32 nt, Human
ugaagagaugguuuugcugcucuccuugagga

SEQ ID NO: 511177 - RNA, 32 nt, Human
ugaagagcaaacagccaaauaucaggagacag

SEQ ID NO: 511178 - RNA, 32 nt, Human
ugaagagcaagguuucguggcagcacggcccg

SEQ ID NO: 511179 - RNA, 32 nt, Human
ugaagagcaggaaggccagggcacaggcggua

SEQ ID NO: 511180 - RNA, 32 nt, Human
ugaagagcaugaacuccaggaggagagagcca

SEQ ID NO: 511181 - RNA, 32 nt, Human
ugaagagcauggcaaagcccuuucucucccaa

SEQ ID NO: 511182 - RNA, 32 nt, Human
ugaagagccccaagcucuccauggcccacagc

SEQ ID NO: 511183 - RNA, 32 nt, Human
ugaagagcccuuucagcacuuucucaucugug

SEQ ID NO: 511184 - RNA, 32 nt, Human
ugaagagccgccaggaccuggagcugcacggu

SEQ ID NO: 511185 - RNA, 32 nt, Human
ugaagagcgggucaggaagaugagcacagcac

SEQ ID NO: 511186 - RNA, 32 nt, Human
ugaagagcucaggcccucaggaagugucugcu

SEQ ID NO: 511187 - RNA, 32 nt, Human
ugaagagcugaaaaagaaaacauagucucuua

SEQ ID NO: 511188 - RNA, 32 nt, Human
ugaagaggaaauguuuaauuaaugcuuuuuag

SEQ ID NO: 511189 - RNA, 32 nt, Human
ugaagaggaaccucacgccacugccuggagcu

SEQ ID NO: 511190 - RNA, 32 nt, Human
ugaagaggaagagaugaggaguggggguccuu

SEQ ID NO: 511191 - RNA, 32 nt, Human
ugaagaggaagaggaggacagugaugaagauu

SEQ ID NO: 511192 - RNA, 32 nt, Human
ugaagaggaggaagaagagguguggacacugc

SEQ ID NO: 511193 - RNA, 32 nt, Human
ugaagaggaggaagagggagaagggagagugg

SEQ ID NO: 511194 - RNA, 32 nt, Human
ugaagaggaggaagagugggagaauggugcug

SEQ ID NO: 511195 - RNA, 32 nt, Human
ugaagaggagggagguuucuuuggucuucuau

SEQ ID NO: 511196 - RNA, 32 nt, Human
ugaagaggcaccucuggggagcaaagaggugg

SEQ ID NO: 511197 - RNA, 32 nt, Human
ugaagaggcagccgggaccauuggcaaugcca

SEQ ID NO: 511198 - RNA, 22 nt, Human
ugaagaggcaggucugggccag

SEQ ID NO: 511199 - RNA, 32 nt, Human
ugaagaggcuucauccaggaacuaggugaggg

SEQ ID NO: 511200 - RNA, 32 nt, Human
ugaagaggggaggcaggaagauucaggcgcgc

SEQ ID NO: 511201 - RNA, 32 nt, Human
ugaagagguacccgggggacacacugccucua

SEQ ID NO: 511202 - RNA, 28 nt, Human
ugaagaggucaacagcaggcauggggag

SEQ ID NO: 511203 - RNA, 22 nt, Human
ugaagagguggcuggacaugug

SEQ ID NO: 511204 - RNA, 31 nt, Human
ugaagaggugggagagaaaggaggggaguuc

SEQ ID NO: 511205 - RNA, 32 nt, Human
ugaagagguuugagcuuuagagugcaguugca

SEQ ID NO: 511206 - RNA, 32 nt, Human
ugaagaguauuuuuaaggagaugguaucuccc

SEQ ID NO: 511207 - RNA, 32 nt, Human
ugaagagucaaaggaaucugugucuaauaucc

SEQ ID NO: 511208 - RNA, 32 nt, Human
ugaagagucacaaugucaguucugugucccaa

SEQ ID NO: 511209 - RNA, 32 nt, Human
ugaagaguccaagaagccagcaccaccccauc

SEQ ID NO: 511210 - RNA, 32 nt, Human
ugaagaguggaaauggggaacucccccagagg

SEQ ID NO: 511211 - RNA, 21 nt, Human
ugaagaguuuuguuuuguuuu

SEQ ID NO: 511212 - RNA, 32 nt, Human
ugaagauaaucauagguugugugagccuauga

SEQ ID NO: 511213 - RNA, 32 nt, Human
ugaagauacuggaggggaaaugcugagugauc

SEQ ID NO: 511214 - RNA, 21 nt, Human
ugaagauagaggggccaugug

SEQ ID NO: 511215 - RNA, 20 nt, Human
ugaagauagucacgaaugua

SEQ ID NO: 511216 - RNA, 32 nt, Human
ugaagauaugacaaaguugaugaaaagguuga

SEQ ID NO: 511217 - RNA, 32 nt, Human
ugaagauauuccauggaucagaauauaaagca

SEQ ID NO: 511218 - RNA, 32 nt, Human
ugaagaucagaacauucagcucuggagaacag

SEQ ID NO: 511219 - RNA, 32 nt, Human
ugaagaucaucccgcaaggcaggcuggaggug

SEQ ID NO: 511220 - RNA, 32 nt, Human
ugaagauccccaacugcuccagccucugccgc

SEQ ID NO: 511221 - RNA, 32 nt, Human
ugaagaucccccagccaggauguggccccaga

SEQ ID NO: 511222 - RNA, 32 nt, Human
ugaagaucgaagccuguguaaaaugcuaccaa

SEQ ID NO: 511223 - RNA, 32 nt, Human
ugaagaucuauguaaagcccuuagaacagugu

SEQ ID NO: 511224 - RNA, 32 nt, Human
ugaagaucugcagcuauucuuuuacuuaacau

SEQ ID NO: 511225 - RNA, 32 nt, Human
ugaagaucuggcacaagauagaaugguaaaaa

SEQ ID NO: 511226 - RNA, 20 nt, Human
ugaagaucugggggcacagu

SEQ ID NO: 511227 - RNA, 32 nt, Human
ugaagaucuucugccaacuauucuccauucau

SEQ ID NO: 511228 - RNA, 32 nt, Human
ugaagaugaagcucaacucaggaagagauuua

SEQ ID NO: 511229 - RNA, 32 nt, Human
ugaagaugagacagaccggccaucauuggaau

SEQ ID NO: 511230 - RNA, 32 nt, Human
ugaagaugaguacaaaaaucccaggagaaacc

SEQ ID NO: 511231 - RNA, 32 nt, Human
ugaagaugcugccgccagcacaaugaccccga

SEQ ID NO: 511232 - RNA, 31 nt, Human
ugaagauggaaaagaucucagaugcugugac

SEQ ID NO: 511233 - RNA, 32 nt, Human
ugaagauggacucuaaacuuugguuuaccucc

SEQ ID NO: 511234 - RNA, 30 nt, Human
ugaagauggcggcagugguggagguggagg

SEQ ID NO: 511235 - RNA, 32 nt, Human
ugaagauggcugaagaaagaugacagaaagca

SEQ ID NO: 511236 - RNA, 32 nt, Human
ugaagaugggaagcacagauugcagugaaccg

SEQ ID NO: 511237 - RNA, 32 nt, Human
ugaagauguagagaaacaaggaagaaauugac

SEQ ID NO: 511238 - RNA, 32 nt, Human
ugaagauguagagagaacaagagacagaggca

SEQ ID NO: 511239 - RNA, 30 nt, Human
ugaagaugucugcaguggggaucagagagc

SEQ ID NO: 511240 - RNA, 32 nt, Human
ugaagaugugcaaagucacagaauguaaugga

SEQ ID NO: 511241 - RNA, 32 nt, Human
ugaagaugugggagaggagcagcccccaguau

SEQ ID NO: 511242 - RNA, 32 nt, Human
ugaagauguuguuccuuuaauagaugguuaaa

SEQ ID NO: 511243 - RNA, 32 nt, Human
ugaagauuaggaggagaaaaagaggagcuuug

SEQ ID NO: 511244 - RNA, 32 nt, Human
ugaagauucucuagggucucuacuucugcuca

SEQ ID NO: 511245 - RNA, 32 nt, Human
ugaagauuuagggcaucuuccuggguuuuggg

SEQ ID NO: 511246 - RNA, 23 nt, Human
ugaagauuucuucugaacgugug

SEQ ID NO: 511247 - RNA, 32 nt, Human
ugaagauuuucagcauuuaucucccaugacag

SEQ ID NO: 511248 - RNA, 32 nt, Human
ugaagcaaaaccaggagcccuggcugaagcaa

SEQ ID NO: 511249 - RNA, 32 nt, Human
ugaagcaaaagacaggaguucucuuugaaaca

SEQ ID NO: 511250 - RNA, 32 nt, Human
ugaagcaaagaauuccaggaaacccaagaggc

SEQ ID NO: 511251 - RNA, 32 nt, Human
ugaagcaaagacaucuuccuggccacguguug

SEQ ID NO: 511252 - RNA, 32 nt, Human
ugaagcaacauuucaaaugucucuccacaaac

SEQ ID NO: 511253 - RNA, 32 nt, Human
ugaagcaacuccaaggacacaguucacagaaa

SEQ ID NO: 511254 - RNA, 32 nt, Human
ugaagcaagggacagguaccagcugggauguu

SEQ ID NO: 511255 - RNA, 32 nt, Human
ugaagcaaguggagugguugggauggaagccu

SEQ ID NO: 511256 - RNA, 32 nt, Human
ugaagcaaguuggugaccuuccucuuugcucu

SEQ ID NO: 511257 - RNA, 32 nt, Human
ugaagcaaucuuucugccuccaccucccgagu

SEQ ID NO: 511258 - RNA, 32 nt, Human
ugaagcacaaagugcugggauuacaggcauga

SEQ ID NO: 511259 - RNA, 32 nt, Human
ugaagcacaacucccuuaaggucuccaaacca

SEQ ID NO: 511260 - RNA, 32 nt, Human
ugaagcacagaauuacucagucuuccauauug

SEQ ID NO: 511261 - RNA, 32 nt, Human
ugaagcacaggcaagcuccugagcugugguuu

SEQ ID NO: 511262 - RNA, 32 nt, Human
ugaagcaccacugcccuguagaccugggauaa

SEQ ID NO: 511263 - RNA, 32 nt, Human
ugaagcaccaggaaaaucaacagaucaugcuc

SEQ ID NO: 511264 - RNA, 32 nt, Human
ugaagcacuggaucuaccucuccuacagcauu

SEQ ID NO: 511265 - RNA, 32 nt, Human
ugaagcacuggcuccagccuuagggaagguuu

SEQ ID NO: 511266 - RNA, 32 nt, Human
ugaagcacuguggcugggaaacuucgaagcgg

SEQ ID NO: 511267 - RNA, 32 nt, Human
ugaagcagaaaguacagagaggugugggaugu

SEQ ID NO: 511268 - RNA, 32 nt, Human
ugaagcagaagguugacagcuucaguaagauc

SEQ ID NO: 511269 - RNA, 21 nt, Human
ugaagcagacagagaugcuga

SEQ ID NO: 511270 - RNA, 32 nt, Human
ugaagcagagaaacauucacacacaaaaagca

SEQ ID NO: 511271 - RNA, 32 nt, Human
ugaagcagagaggcacgugccugucucauucg

SEQ ID NO: 511272 - RNA, 22 nt, Human
ugaagcagagucacagagccga

SEQ ID NO: 511273 - RNA, 32 nt, Human
ugaagcagcacacacauuuacuacacacacag

SEQ ID NO: 511274 - RNA, 20 nt, Human
ugaagcagcauuaugcaagg

SEQ ID NO: 511275 - RNA, 32 nt, Human
ugaagcagccacugcccagggggugcaaagaa

SEQ ID NO: 511276 - RNA, 32 nt, Human
ugaagcagccaucucuuucuuggaucucaaga

SEQ ID NO: 511277 - RNA, 32 nt, Human
ugaagcagcugcauacuucagaguaaacuauu

SEQ ID NO: 511278 - RNA, 32 nt, Human
ugaagcaggagaagggaggccccuccuaucua

SEQ ID NO: 511279 - RNA, 32 nt, Human
ugaagcaggagaaucacuugaacucaggaggc

SEQ ID NO: 511280 - RNA, 32 nt, Human
ugaagcaggaggacugcuugagcugaguccaa

SEQ ID NO: 511281 - RNA, 32 nt, Human
ugaagcaggaggaucacuugagcccaggaguu

SEQ ID NO: 511282 - RNA, 32 nt, Human
ugaagcaggaggaucacuugagccugaguuca

SEQ ID NO: 511283 - RNA, 32 nt, Human
ugaagcaggaggaucacuugagcuugggaguu

SEQ ID NO: 511284 - RNA, 32 nt, Human
ugaagcaggaggaucacuugaggccaggaguu

SEQ ID NO: 511285 - RNA, 32 nt, Human
ugaagcaggagguggcauuugaaaugaaauac

SEQ ID NO: 511286 - RNA, 21 nt, Human
ugaagcaggcagaucaccuga

SEQ ID NO: 511287 - RNA, 24 nt, Human
ugaagcaggcagaucaccugaggu

SEQ ID NO: 511288 - RNA, 32 nt, Human
ugaagcaggcggaucacuugagcccaggaguu

SEQ ID NO: 511289 - RNA, 32 nt, Human
ugaagcagggggaaaaaugacaucacaccauu

SEQ ID NO: 511290 - RNA, 32 nt, Human
ugaagcaggguguccugggugccuguguguca

SEQ ID NO: 511291 - RNA, 32 nt, Human
ugaagcagguaucagagucacuccucuguacc

SEQ ID NO: 511292 - RNA, 32 nt, Human
ugaagcaggugugaaugccaggagagguggga

SEQ ID NO: 511293 - RNA, 32 nt, Human
ugaagcagucuaggagcuugcagccacccugu

SEQ ID NO: 511294 - RNA, 32 nt, Human
ugaagcagucucggagcuugcagccaccccgu

SEQ ID NO: 511295 - RNA, 19 nt, Human
ugaagcagucuugcucugu

SEQ ID NO: 511296 - RNA, 32 nt, Human
ugaagcaguugcucaaacuuuguucaacauca

SEQ ID NO: 511297 - RNA, 32 nt, Human
ugaagcaguugcucaaacuuuguucaauauca

SEQ ID NO: 511298 - RNA, 32 nt, Human
ugaagcaguuucacaucagucucuccagauag

SEQ ID NO: 511299 - RNA, 32 nt, Human
ugaagcaucuauuacuucaaggccaauaucuu

SEQ ID NO: 511300 - RNA, 32 nt, Human
ugaagcaugaguugucggaggucugggagaaa

SEQ ID NO: 511301 - RNA, 32 nt, Human
ugaagcauggcagaggcuguuguggacaauca

SEQ ID NO: 511302 - RNA, 32 nt, Human
ugaagcaugucccaccucccacuuuccaucau

SEQ ID NO: 511303 - RNA, 32 nt, Human
ugaagcauuuugcgaggagucuggacucaggu

SEQ ID NO: 511304 - RNA, 32 nt, Human
ugaagcauuuugugccuucugugagaaaacau

SEQ ID NO: 511305 - RNA, 32 nt, Human
ugaagcauuuuugucugugcucccugaucuuc

SEQ ID NO: 511306 - RNA, 32 nt, Human
ugaagccaaaaaugugauagcuguccuugaag

SEQ ID NO: 511307 - RNA, 32 nt, Human
ugaagccaaagccccgugguugcccaugagaa

SEQ ID NO: 511308 - RNA, 32 nt, Human
ugaagccaaaucugaacccauguccucacuuc

SEQ ID NO: 511309 - RNA, 32 nt, Human
ugaagccaaggugggaggaucaccagagccug

SEQ ID NO: 511310 - RNA, 32 nt, Human
ugaagccaaggugggaggcagcugacaacacc

SEQ ID NO: 511311 - RNA, 32 nt, Human
ugaagccaauaaucccagcacuuugagaggcc

SEQ ID NO: 511312 - RNA, 32 nt, Human
ugaagccacccuuccucuucuggacccagccu

SEQ ID NO: 511313 - RNA, 32 nt, Human
ugaagccacgauguucauccaggccaaagcag

SEQ ID NO: 511314 - RNA, 32 nt, Human
ugaagccagaaguucaagaccagccugcacau

SEQ ID NO: 511315 - RNA, 32 nt, Human
ugaagccagaggcagagguugcaaugagccgg

SEQ ID NO: 511316 - RNA, 32 nt, Human
ugaagccagagggugugcagggccaggagcua

SEQ ID NO: 511317 - RNA, 32 nt, Human
ugaagccagcacugguuaacauggugauuagu

SEQ ID NO: 511318 - RNA, 32 nt, Human
ugaagccagcuggucuucugggucgggugggg

SEQ ID NO: 511319 - RNA, 32 nt, Human
ugaagccaggaauucaagacgaaccugggcaa

SEQ ID NO: 511320 - RNA, 32 nt, Human
ugaagccaggacuucaagaccagcuuggccaa

SEQ ID NO: 511321 - RNA, 32 nt, Human
ugaagccaggaggagagaugcagucuuaggag

SEQ ID NO: 511322 - RNA, 32 nt, Human
ugaagccaggaggcagagguugcaguuagccc

SEQ ID NO: 511323 - RNA, 32 nt, Human
ugaagccaggaggcggagguugcagugagccg

SEQ ID NO: 511324 - RNA, 32 nt, Human
ugaagccaggaguucaagaccagccuggccaa

SEQ ID NO: 511325 - RNA, 19 nt, Human
ugaagccaggaguucgaga

SEQ ID NO: 511326 - RNA, 32 nt, Human
ugaagccagggagggagacaggagggcaggag

SEQ ID NO: 511327 - RNA, 32 nt, Human
ugaagccaggggacauccgccaugcuccaaac

SEQ ID NO: 511328 - RNA, 32 nt, Human
ugaagccaggggucaucagccaugcuccagac

SEQ ID NO: 511329 - RNA, 32 nt, Human
ugaagccagggugccgggaggaagggacaucu

SEQ ID NO: 511330 - RNA, 32 nt, Human
ugaagccaguaguucaagaccagccugggcaa

SEQ ID NO: 511331 - RNA, 32 nt, Human
ugaagccagugcacgccagccugggcgacaga

SEQ ID NO: 511332 - RNA, 32 nt, Human
ugaagccaguucaguaaucacacacauuccaa

SEQ ID NO: 511333 - RNA, 32 nt, Human
ugaagccaguuugcuuauuuucaauugccuag

SEQ ID NO: 511334 - RNA, 32 nt, Human
ugaagccauccauccauuugauagguuuugca

SEQ ID NO: 511335 - RNA, 32 nt, Human
ugaagccaucccccaucuucccuagacacagc

SEQ ID NO: 511336 - RNA, 32 nt, Human
ugaagccaugggagagggugagagccaccauc

SEQ ID NO: 511337 - RNA, 32 nt, Human
ugaagccaugguucaucaggugcucuaccggg

SEQ ID NO: 511338 - RNA, 32 nt, Human
ugaagccauuggagagcugucuuccuguguac

SEQ ID NO: 511339 - RNA, 32 nt, Human
ugaagccauuugggggucaaaguuuccuuacu

SEQ ID NO: 511340 - RNA, 32 nt, Human
ugaagcccaaagacuuauuuuugagcucgcug

SEQ ID NO: 511341 - RNA, 32 nt, Human
ugaagcccaagccaggccugguugagggugau

SEQ ID NO: 511342 - RNA, 21 nt, Human
ugaagcccaccagagcccccu

SEQ ID NO: 511343 - RNA, 32 nt, Human
ugaagcccaggaggaggaagaggaggcugguu

SEQ ID NO: 511344 - RNA, 32 nt, Human
ugaagcccccaggauacauggagcagagaagc

SEQ ID NO: 511345 - RNA, 32 nt, Human
ugaagccccgggaggagaggaaggcagcggcg

SEQ ID NO: 511346 - RNA, 32 nt, Human
ugaagccccugagaauauuuuguugagaacac

SEQ ID NO: 511347 - RNA, 32 nt, Human
ugaagccccugaggggaaaagacugggcuucc

SEQ ID NO: 511348 - RNA, 32 nt, Human
ugaagcccgaagagcaggaggccaggcacucg

SEQ ID NO: 511349 - RNA, 32 nt, Human
ugaagcccguuggucucagccuggcuugagcc

SEQ ID NO: 511350 - RNA, 32 nt, Human
ugaagcccuuaccugcuugcugucugcaaggg

SEQ ID NO: 511351 - RNA, 32 nt, Human
ugaagccgagcaacucuguccaaaaagguuua

SEQ ID NO: 511352 - RNA, 32 nt, Human
ugaagccgcagcccugcccuguccuguccugu

SEQ ID NO: 511353 - RNA, 32 nt, Human
ugaagccggccccugcccucuuccugcccguc

SEQ ID NO: 511354 - RNA, 32 nt, Human
ugaagccgggaggcggaaguuguggugagccg

SEQ ID NO: 511355 - RNA, 32 nt, Human
ugaagccgggagguggggguugcagugagccg

SEQ ID NO: 511356 - RNA, 32 nt, Human
ugaagccuauuuuucuguuccagcaacuguuu

SEQ ID NO: 511357 - RNA, 32 nt, Human
ugaagccucaaaggaguaaagucuacaggaua

SEQ ID NO: 511358 - RNA, 32 nt, Human
ugaagccucucuccuucucugccuacaaagac

SEQ ID NO: 511359 - RNA, 18 nt, Human
ugaagccucuuccucgca

SEQ ID NO: 511360 - RNA, 32 nt, Human
ugaagccugccuggccuguggugcuuuccagu

SEQ ID NO: 511361 - RNA, 32 nt, Human
ugaagccuggaggcggaggcugcacugagcug

SEQ ID NO: 511362 - RNA, 32 nt, Human
ugaagccuggcuuggguugaaaaguguucccg

SEQ ID NO: 511363 - RNA, 32 nt, Human
ugaagccugugaucccagcauguugggaggcc

SEQ ID NO: 511364 - RNA, 32 nt, Human
ugaagccuucaggucacaaacugucuuuugua

SEQ ID NO: 511365 - RNA, 32 nt, Human
ugaagcgaggcugaaaucuuagaaucaacccc

SEQ ID NO: 511366 - RNA, 32 nt, Human
ugaagcgagggaggaaguuuccuccgaucagu

SEQ ID NO: 511367 - RNA, 32 nt, Human
ugaagcgauggagagucgggggccaguagcca

SEQ ID NO: 511368 - RNA, 22 nt, Human
ugaagcgcaugcgcagcgggug

SEQ ID NO: 511369 - RNA, 32 nt, Human
ugaagcgcgugucugcugucugugccagugcu

SEQ ID NO: 511370 - RNA, 32 nt, Human
ugaagcgcuaccugcucuaccaguggcccugu

SEQ ID NO: 511371 - RNA, 32 nt, Human
ugaagcgcucugagagaggcggcagcggcaac

SEQ ID NO: 511372 - RNA, 32 nt, Human
ugaagcgggaggaucgcuugagaccaggaguu

SEQ ID NO: 511373 - RNA, 32 nt, Human
ugaagcgggcagaucacuugaggucaggaguu

SEQ ID NO: 511374 - RNA, 32 nt, Human
ugaagcgggguaauuccucuccugcaauuacu

SEQ ID NO: 511375 - RNA, 24 nt, Human
ugaagcggguggaucacccgaggu

SEQ ID NO: 511376 - RNA, 24 nt, Human
ugaagcggguggaucaccugaggu

SEQ ID NO: 511377 - RNA, 32 nt, Human
ugaagcgguuauagccauugacauuguggcca

SEQ ID NO: 511378 - RNA, 32 nt, Human
ugaagcuaggacuuauuuggaaaaggagauag

SEQ ID NO: 511379 - RNA, 32 nt, Human
ugaagcuaggggaggaaggaaggaaggaaggg

SEQ ID NO: 511380 - RNA, 32 nt, Human
ugaagcuaggucucaggggucuccaguccucc

SEQ ID NO: 511381 - RNA, 32 nt, Human
ugaagcuaguucaguaaucacacacauuccaa

SEQ ID NO: 511382 - RNA, 32 nt, Human
ugaagcucaagugaggagggggaggcuggguu

SEQ ID NO: 511383 - RNA, 32 nt, Human
ugaagcucaccacuguccuuuguuuuggagau

SEQ ID NO: 511384 - RNA, 32 nt, Human
ugaagcucacuccgccuccucacucucacugc

SEQ ID NO: 511385 - RNA, 32 nt, Human
ugaagcucaguuauagugcacugaugaacuga

SEQ ID NO: 511386 - RNA, 32 nt, Human
ugaagcucauuuuaaggaaauggaguccauug

SEQ ID NO: 511387 - RNA, 32 nt, Human
ugaagcuccguguauacccugaggucaccacc

SEQ ID NO: 511388 - RNA, 32 nt, Human
ugaagcuccugccuuucugcagccucuacagg

SEQ ID NO: 511389 - RNA, 32 nt, Human
ugaagcucgagaacaaccugaccaacauggag

SEQ ID NO: 511390 - RNA, 32 nt, Human
ugaagcucuaacugccuggacuucuugggaaa

SEQ ID NO: 511391 - RNA, 32 nt, Human
ugaagcucuccucuuugagguccuggcaggcu

SEQ ID NO: 511392 - RNA, 32 nt, Human
ugaagcucucuuugcucuuccugcuuucauuu

SEQ ID NO: 511393 - RNA, 32 nt, Human
ugaagcucugaaaugcgaugugaucuguacca

SEQ ID NO: 511394 - RNA, 32 nt, Human
ugaagcucuggagcucugcauccuguggccug

SEQ ID NO: 511395 - RNA, 32 nt, Human
ugaagcugaaaccuuuggccuaagaagaaaau

SEQ ID NO: 511396 - RNA, 32 nt, Human
ugaagcugaacccagggccuggcuguggucuu

SEQ ID NO: 511397 - RNA, 32 nt, Human
ugaagcugaagcucugucccuauucccccagc

SEQ ID NO: 511398 - RNA, 32 nt, Human
ugaagcugaaggaucacuugagcucaggaguu

SEQ ID NO: 511399 - RNA, 32 nt, Human
ugaagcugagaguucaagaccaaccugggcaa

SEQ ID NO: 511400 - RNA, 32 nt, Human
ugaagcugaggcugcugccaggcccggcauga

SEQ ID NO: 511401 - RNA, 32 nt, Human
ugaagcugcagcccugacugagacauagggcu

SEQ ID NO: 511402 - RNA, 32 nt, Human
ugaagcugcagcuguaagaagcugagugaaag

SEQ ID NO: 511403 - RNA, 32 nt, Human
ugaagcugccaggcccugagguucagacccug

SEQ ID NO: 511404 - RNA, 32 nt, Human
ugaagcugcccucguugguggaggggagggag

SEQ ID NO: 511405 - RNA, 32 nt, Human
ugaagcugcucacugcucacacgcugccuccu

SEQ ID NO: 511406 - RNA, 32 nt, Human
ugaagcugcugacuauuuaggcauuuuacacu

SEQ ID NO: 511407 - RNA, 20 nt, Human
ugaagcugcugcagcucccu

SEQ ID NO: 511408 - RNA, 32 nt, Human
ugaagcuggaggacucuguccaugcccguguc

SEQ ID NO: 511409 - RNA, 32 nt, Human
ugaagcuggaggagucucucuucugcucucca

SEQ ID NO: 511410 - RNA, 32 nt, Human
ugaagcuggaggcagagauuggagugauacau

SEQ ID NO: 511411 - RNA, 32 nt, Human
ugaagcuggccuggccucugcuccugcucuca

SEQ ID NO: 511412 - RNA, 32 nt, Human
ugaagcugggagaaccaaaaagaggcuaugug

SEQ ID NO: 511413 - RNA, 32 nt, Human
ugaagcugggaggcagaguuuucagugagcca

SEQ ID NO: 511414 - RNA, 32 nt, Human
ugaagcugggaggcggagguugcagugagcca

SEQ ID NO: 511415 - RNA, 32 nt, Human
ugaagcugggagugaaacugggucagcuguaa

SEQ ID NO: 511416 - RNA, 32 nt, Human
ugaagcugguccugggcuccgggggugacagu

SEQ ID NO: 511417 - RNA, 32 nt, Human
ugaagcuguggggccaguugauaccugcuggc

SEQ ID NO: 511418 - RNA, 32 nt, Human
ugaagcuuaaugaugugaggcuucuaguggga

SEQ ID NO: 511419 - RNA, 32 nt, Human
ugaagcuuaguaaccagcgccaaaaaguagau

SEQ ID NO: 511420 - RNA, 32 nt, Human
ugaagcuucccaagcaucagucuacaccaaca

SEQ ID NO: 511421 - RNA, 17 nt, Human
ugaagcuucuuggcaua

SEQ ID NO: 511422 - RNA, 22 nt, Human
ugaagcuuggagaaaacucugc

SEQ ID NO: 511423 - RNA, 32 nt, Human
ugaagcuuguauaucagcaccggauuguagaa

SEQ ID NO: 511424 - RNA, 32 nt, Human
ugaagcuuguguccuguugggaggacagacag

SEQ ID NO: 511425 - RNA, 32 nt, Human
ugaaggaaaagcugggaucacagguuccuucu

SEQ ID NO: 511426 - RNA, 19 nt, Human
ugaaggaaagcugcuuccu

SEQ ID NO: 511427 - RNA, 32 nt, Human
ugaaggaaaggagugaaagggaaguaggacca

SEQ ID NO: 511428 - RNA, 32 nt, Human
ugaaggaaauauggucagcauuuuauaacacc

SEQ ID NO: 511429 - RNA, 32 nt, Human
ugaaggaagaauucuauggaaauuacaaaucc

SEQ ID NO: 511430 - RNA, 32 nt, Human
ugaaggaagacccaggaaagguguggcuggaa

SEQ ID NO: 511431 - RNA, 32 nt, Human
ugaaggaagccccucccugggcauuuucugcc

SEQ ID NO: 511432 - RNA, 32 nt, Human
ugaaggaaugcucacacuagauguagcacagc

SEQ ID NO: 511433 - RNA, 32 nt, Human
ugaaggacaacauauggugauggggaaaucag

SEQ ID NO: 511434 - RNA, 32 nt, Human
ugaaggacaacggccgagaacgcccaggaugg

SEQ ID NO: 511435 - RNA, 32 nt, Human
ugaaggacaccaagcuggaacuacccaucuag

SEQ ID NO: 511436 - RNA, 32 nt, Human
ugaaggacagaagaggaaggaagcaggcuuug

SEQ ID NO: 511437 - RNA, 32 nt, Human
ugaaggacagaauuuuuggcagaggaaagauc

SEQ ID NO: 511438 - RNA, 32 nt, Human
ugaaggacagucaggugaaggacuguaagccc

SEQ ID NO: 511439 - RNA, 18 nt, Human
ugaaggacuaaaaccgca

SEQ ID NO: 511440 - RNA, 32 nt, Human
ugaaggacuggguguuacuggagggaacacac

SEQ ID NO: 511441 - RNA, 23 nt, Human
ugaaggagaccgcgcgggcgcug

SEQ ID NO: 511442 - RNA, 32 nt, Human
ugaaggagagcagcaaaaauguaucagggguu

SEQ ID NO: 511443 - RNA, 32 nt, Human
ugaaggagaguuucuugcauuggacaggccca

SEQ ID NO: 511444 - RNA, 32 nt, Human
ugaaggagcaccuuauccucccccuuuguuua

SEQ ID NO: 511445 - RNA, 32 nt, Human
ugaaggagcaggaaggggaaggaggccuggga

SEQ ID NO: 511446 - RNA, 32 nt, Human
ugaaggagccagcagaaccuucccacaugcug

SEQ ID NO: 511447 - RNA, 22 nt, Human
ugaaggagcuguccagcgacua

SEQ ID NO: 511448 - RNA, 21 nt, Human
ugaaggagcuucuuuuccucu

SEQ ID NO: 511449 - RNA, 32 nt, Human
ugaaggaggacugaaccaaggacucugugagg

SEQ ID NO: 511450 - RNA, 32 nt, Human
ugaaggaggagagagguggagggcugguauuu

SEQ ID NO: 511451 - RNA, 32 nt, Human
ugaaggaggaggacuggcugccuccauuuugc

SEQ ID NO: 511452 - RNA, 32 nt, Human
ugaaggaggcagagaagggguuggugauacgg

SEQ ID NO: 511453 - RNA, 32 nt, Human
ugaaggaggcagggguugggacaagugcuaag

SEQ ID NO: 511454 - RNA, 32 nt, Human
ugaaggaggcaugggagcuaaaaauccuguga

SEQ ID NO: 511455 - RNA, 32 nt, Human
ugaaggaggccaccgugugagcacagggccug

SEQ ID NO: 511456 - RNA, 32 nt, Human
ugaaggagggaaggagcaggagagcaggaagg

SEQ ID NO: 511457 - RNA, 32 nt, Human
ugaaggaggggugggaaggugcagagagggca

SEQ ID NO: 511458 - RNA, 18 nt, Human
ugaaggaguggggaggug

SEQ ID NO: 511459 - RNA, 32 nt, Human
ugaaggauagacuaugggugggcagagagaac

SEQ ID NO: 511460 - RNA, 32 nt, Human
ugaaggaugacauggcccugccugagcccggg

SEQ ID NO: 511461 - RNA, 32 nt, Human
ugaaggaugcgguaauggcaggaauagcagaa

SEQ ID NO: 511462 - RNA, 32 nt, Human
ugaaggaugggugagaggugagaagggagaaa

SEQ ID NO: 511463 - RNA, 32 nt, Human
ugaaggaugguauguagacuccuguacagaca

SEQ ID NO: 511464 - RNA, 32 nt, Human
ugaaggauuacucgcccccaccuguggacucu

SEQ ID NO: 511465 - RNA, 32 nt, Human
ugaaggauucacgaaucaggcagcccccagaa

SEQ ID NO: 511466 - RNA, 32 nt, Human
ugaaggcaaacuucauaaugaggggaagaguc

SEQ ID NO: 511467 - RNA, 22 nt, Human
ugaaggcaagauucccaaggga

SEQ ID NO: 511468 - RNA, 32 nt, Human
ugaaggcaaucaguaccucugcuuuucaaagg

SEQ ID NO: 511469 - RNA, 32 nt, Human
ugaaggcaaugccauccucaaacacugcaggc

SEQ ID NO: 511470 - RNA, 32 nt, Human
ugaaggcagcacucacggucaucaagccagcc

SEQ ID NO: 511471 - RNA, 32 nt, Human
ugaaggcagcccaaggucucccagaggcucgg

SEQ ID NO: 511472 - RNA, 32 nt, Human
ugaaggcagcgaaggggguugcaguaggggcg

SEQ ID NO: 511473 - RNA, 32 nt, Human
ugaaggcaggagacccagaaagcagugcagug

SEQ ID NO: 511474 - RNA, 32 nt, Human
ugaaggcaggagcugaagaugcuguacaggaa

SEQ ID NO: 511475 - RNA, 32 nt, Human
ugaaggcaggaguucaagaccagcuugggcau

SEQ ID NO: 511476 - RNA, 32 nt, Human
ugaaggcaggguggcagccuccccacggacuc

SEQ ID NO: 511477 - RNA, 32 nt, Human
ugaaggcagguaaaggagcaaagggaaugggg

SEQ ID NO: 511478 - RNA, 18 nt, Human
ugaaggcaguggcagggg

SEQ ID NO: 511479 - RNA, 31 nt, Human
ugaaggcaguuucagaucgccaccuuuugag

SEQ ID NO: 511480 - RNA, 32 nt, Human
ugaaggcaucugagugugagacccuguucuaa

SEQ ID NO: 511481 - RNA, 32 nt, Human
ugaaggcauuguuugagguugaucucagcacu

SEQ ID NO: 511482 - RNA, 32 nt, Human
ugaaggcauuucugcugaucuguuccaagaca

SEQ ID NO: 511483 - RNA, 32 nt, Human
ugaaggcauuugcaggaugagccugaacuggu

SEQ ID NO: 511484 - RNA, 32 nt, Human
ugaaggccacaucaacuuuauguagcaaaggg

SEQ ID NO: 511485 - RNA, 32 nt, Human
ugaaggccacgguccugaugcggcagccuggg

SEQ ID NO: 511486 - RNA, 32 nt, Human
ugaaggccagugcugugcuggcaggaaaauag

SEQ ID NO: 511487 - RNA, 32 nt, Human
ugaaggccauugacucagagguguaggaaugg

SEQ ID NO: 511488 - RNA, 32 nt, Human
ugaaggccccaccacccagccuguggaugucu

SEQ ID NO: 511489 - RNA, 32 nt, Human
ugaaggccgagaaccucuggccucaggaagcg

SEQ ID NO: 511490 - RNA, 32 nt, Human
ugaaggccgcuagaaaguacagaaggaacuuu

SEQ ID NO: 511491 - RNA, 32 nt, Human
ugaaggccucaguuccucgcuggcuguuggcu

SEQ ID NO: 511492 - RNA, 32 nt, Human
ugaaggccugauggggaggaggacccggcaug

SEQ ID NO: 511493 - RNA, 32 nt, Human
ugaaggcgauugagaggggcugagggaauugu

SEQ ID NO: 511494 - RNA, 32 nt, Human
ugaaggcgccguggcccugccugacgccccgg

SEQ ID NO: 511495 - RNA, 20 nt, Human
ugaaggcgggugcuaggcug

SEQ ID NO: 511496 - RNA, 32 nt, Human
ugaaggcuauggcuuggcacagcugcucugga

SEQ ID NO: 511497 - RNA, 32 nt, Human
ugaaggcugccuuaggucucuccagugccaug

SEQ ID NO: 511498 - RNA, 32 nt, Human
ugaaggcuggaaggcagcaggcauuugcuaag

SEQ ID NO: 511499 - RNA, 32 nt, Human
ugaaggcugggagcucuuggggcugggcuggu

SEQ ID NO: 511500 - RNA, 32 nt, Human
ugaaggcuguaagaguccagaugguggagcca

SEQ ID NO: 511501 - RNA, 32 nt, Human
ugaaggcuguggaagagguuggagugggcgca

SEQ ID NO: 511502 - RNA, 32 nt, Human
ugaaggcuuaggccccugucauucccacccuc

SEQ ID NO: 511503 - RNA, 32 nt, Human
ugaaggcuuccacacccucuacuccaggacag

SEQ ID NO: 511504 - RNA, 32 nt, Human
ugaaggcuuccaggcagaacagcugcagagag

SEQ ID NO: 511505 - RNA, 32 nt, Human
ugaaggcuuuaguucugcuuucugccucuccu

SEQ ID NO: 511506 - RNA, 32 nt, Human
ugaaggcuuucccacauucuuuacauuuguag

SEQ ID NO: 511507 - RNA, 32 nt, Human
ugaagggaacaucuuaccaucuggccauucac

SEQ ID NO: 511508 - RNA, 32 nt, Human
ugaagggaagcccuucagaacauggcucccaa

SEQ ID NO: 511509 - RNA, 32 nt, Human
ugaagggaagucagaguuuucucccugccuau

SEQ ID NO: 511510 - RNA, 32 nt, Human
ugaagggaauacugugcauaagccauuaugau

SEQ ID NO: 511511 - RNA, 22 nt, Human
ugaagggacccgcucccagcuc

SEQ ID NO: 511512 - RNA, 32 nt, Human
ugaagggacccuggggaaggcagggagggcag

SEQ ID NO: 511513 - RNA, 17 nt, Human
ugaagggacgaguacca

SEQ ID NO: 511514 - RNA, 32 nt, Human
ugaagggagaaagccugugcucuggcuggcug

SEQ ID NO: 511515 - RNA, 32 nt, Human
ugaagggagcaguucaguuacagcauucucuc

SEQ ID NO: 511516 - RNA, 32 nt, Human
ugaagggagcuuuguuaguuuaaucacuggaa

SEQ ID NO: 511517 - RNA, 32 nt, Human
ugaagggaggcaguggcggcggcggcgaacau

SEQ ID NO: 511518 - RNA, 32 nt, Human
ugaagggaguggaucagagcacugccugagag

SEQ ID NO: 511519 - RNA, 32 nt, Human
ugaagggauuaaaaauguacguaaaauuagua

SEQ ID NO: 511520 - RNA, 31 nt, Human
ugaagggcacuuuucagauugugggcuggaa

SEQ ID NO: 511521 - RNA, 32 nt, Human
ugaagggcagagccuaugccagccugggccug

SEQ ID NO: 511522 - RNA, 32 nt, Human
ugaagggcaugcaggcccucagcccgggcugu

SEQ ID NO: 511523 - RNA, 32 nt, Human
ugaagggcuaucucuguuuaauucaccaucuu

SEQ ID NO: 511524 - RNA, 32 nt, Human
ugaagggcucugacccuggaagugguucuaag

SEQ ID NO: 511525 - RNA, 32 nt, Human
ugaagggcuucaggcugggggcaguggacagg

SEQ ID NO: 511526 - RNA, 32 nt, Human
ugaaggggacggagacacugacugggcgaugg

SEQ ID NO: 511527 - RNA, 31 nt, Human
ugaaggggcucagggguccuguugaacugcu

SEQ ID NO: 511528 - RNA, 32 nt, Human
ugaaggggcugguggagauguaggaaccgauc

SEQ ID NO: 511529 - RNA, 32 nt, Human
ugaaggggugauagggugaggggccagaggga

SEQ ID NO: 511530 - RNA, 32 nt, Human
ugaaggggugccugggcuagggcugcaggcug

SEQ ID NO: 511531 - RNA, 32 nt, Human
ugaagggguggaggggcuggaggagcaggaau

SEQ ID NO: 511532 - RNA, 32 nt, Human
ugaagggguuuaccuggcaucuucucaggcag

SEQ ID NO: 511533 - RNA, 32 nt, Human
ugaaggguacuuuuugcuuuugcucaccucau

SEQ ID NO: 511534 - RNA, 32 nt, Human
ugaagggucaccaagggucagcucagggcuag

SEQ ID NO: 511535 - RNA, 32 nt, Human
ugaaggguguguaacuucagcucugcaggauu

SEQ ID NO: 511536 - RNA, 32 nt, Human
ugaaggguucggcuuguccuccucuggcgcuc

SEQ ID NO: 511537 - RNA, 32 nt, Human
ugaaggucaauaaauuauuagagauuuucucu

SEQ ID NO: 511538 - RNA, 32 nt, Human
ugaaggucauacaauucuggggacucucuuua

SEQ ID NO: 511539 - RNA, 32 nt, Human
ugaaggucaucuuuacucagucuacccauuca

SEQ ID NO: 511540 - RNA, 32 nt, Human
ugaagguccuggggaagcaggucucaauucug

SEQ ID NO: 511541 - RNA, 32 nt, Human
ugaaggucucagaaggcuucagugacagucau

SEQ ID NO: 511542 - RNA, 32 nt, Human
ugaaggucucuuugcauuucuccaugcaaaga

SEQ ID NO: 511543 - RNA, 32 nt, Human
ugaaggucugcagcuucacuccugaagccagc

SEQ ID NO: 511544 - RNA, 32 nt, Human
ugaaggucugcagcuucacuccuggagucagc

SEQ ID NO: 511545 - RNA, 32 nt, Human
ugaaggucugcagcuucguucuuaaagccagc

SEQ ID NO: 511546 - RNA, 32 nt, Human
ugaaggucuugccugaauccaucaggacuugg

SEQ ID NO: 511547 - RNA, 24 nt, Human
ugaaggugcagcaagucacugaga

SEQ ID NO: 511548 - RNA, 32 nt, Human
ugaaggugccaaggaggaaggcugagaggggg

SEQ ID NO: 511549 - RNA, 32 nt, Human
ugaaggugcccaccugggccaccagaagguga

SEQ ID NO: 511550 - RNA, 32 nt, Human
ugaaggugcccaggagcggcgaugcacucgca

SEQ ID NO: 511551 - RNA, 32 nt, Human
ugaaggugcugacggccagggagaagcuccuc

SEQ ID NO: 511552 - RNA, 21 nt, Human
ugaagguggacucggacugug

SEQ ID NO: 511553 - RNA, 32 nt, Human
ugaagguggggaggggaauauacacauugcuu

SEQ ID NO: 511554 - RNA, 32 nt, Human
ugaaggugucgcaugaagagcuugcuucacac

SEQ ID NO: 511555 - RNA, 32 nt, Human
ugaaggugucugcagcacacacagugagaauu

SEQ ID NO: 511556 - RNA, 32 nt, Human
ugaaggugugagugccugucuugaacuugcac

SEQ ID NO: 511557 - RNA, 32 nt, Human
ugaagguucagggugugaauucccagugccac

SEQ ID NO: 511558 - RNA, 32 nt, Human
ugaagguuccccaccauucagugagagcagaa

SEQ ID NO: 511559 - RNA, 32 nt, Human
ugaagguuuucauuugccauucauguccugua

SEQ ID NO: 511560 - RNA, 32 nt, Human
ugaaguaaacauaccuguaacuaccauucaag

SEQ ID NO: 511561 - RNA, 32 nt, Human
ugaaguaaaguauauuuuuguaccaaaccaca

SEQ ID NO: 511562 - RNA, 32 nt, Human
ugaaguaaauagaagaucaagccuucaaaucu

SEQ ID NO: 511563 - RNA, 32 nt, Human
ugaaguaacauuguauucguguuugcauuauu

SEQ ID NO: 511564 - RNA, 32 nt, Human
ugaaguacagagggagguuggggugggucaga

SEQ ID NO: 511565 - RNA, 32 nt, Human
ugaaguaccaguuuccauuccugggcugagau

SEQ ID NO: 511566 - RNA, 32 nt, Human
ugaaguaccuugagguuccugaugugcgggcg

SEQ ID NO: 511567 - RNA, 32 nt, Human
ugaaguacuggcagauuugcaggcugggaagg

SEQ ID NO: 511568 - RNA, 32 nt, Human
ugaaguacuggcucuuuccugcucuggacaag

SEQ ID NO: 511569 - RNA, 22 nt, Human
ugaaguacuggggccuccucca

SEQ ID NO: 511570 - RNA, 32 nt, Human
ugaaguacuguacaggguuguacaaugagaac

SEQ ID NO: 511571 - RNA, 32 nt, Human
ugaaguagagcagagggccugggugucuguca

SEQ ID NO: 511572 - RNA, 32 nt, Human
ugaaguagagcagugggcuuugccuucugaca

SEQ ID NO: 511573 - RNA, 32 nt, Human
ugaaguagaucaggaaggggcugccucaggaa

SEQ ID NO: 511574 - RNA, 32 nt, Human
ugaaguagauggugacagaacaugagagccag

SEQ ID NO: 511575 - RNA, 32 nt, Human
ugaaguaggaagaaaguauuucaaggagagug

SEQ ID NO: 511576 - RNA, 32 nt, Human
ugaaguaggaggaucgucuugagcccaggagu

SEQ ID NO: 511577 - RNA, 32 nt, Human
ugaaguagggaggaggagguugcagugagcug

SEQ ID NO: 511578 - RNA, 32 nt, Human
ugaaguagucucauuacggaaaaagagagugu

SEQ ID NO: 511579 - RNA, 32 nt, Human
ugaaguauacauuuaguuaacacacauauauc

SEQ ID NO: 511580 - RNA, 32 nt, Human
ugaaguauaucugagggaaaaauaaaugaaaa

SEQ ID NO: 511581 - RNA, 32 nt, Human
ugaaguaucaucucucaaguauauagacacua

SEQ ID NO: 511582 - RNA, 32 nt, Human
ugaaguaucuauccuugacuugcccuucacug

SEQ ID NO: 511583 - RNA, 32 nt, Human
ugaagucaaaggggacuuuacacagaucucga

SEQ ID NO: 511584 - RNA, 32 nt, Human
ugaagucaacaguucaggagaagagaaggaau

SEQ ID NO: 511585 - RNA, 32 nt, Human
ugaagucaagaguuugagaucagccuggagaa

SEQ ID NO: 511586 - RNA, 32 nt, Human
ugaagucacagaaauacgcagagcaaguaucu

SEQ ID NO: 511587 - RNA, 32 nt, Human
ugaagucacauccugaaugugcaugccagaca

SEQ ID NO: 511588 - RNA, 32 nt, Human
ugaagucaccuggccuggaguguguugggcag

SEQ ID NO: 511589 - RNA, 32 nt, Human
ugaagucacugaaaauccaacuccaggagcua

SEQ ID NO: 511590 - RNA, 32 nt, Human
ugaagucacugcacccuccacuaccucuacug

SEQ ID NO: 511591 - RNA, 32 nt, Human
ugaagucacugcaguccaagcucugaguguca

SEQ ID NO: 511592 - RNA, 32 nt, Human
ugaagucaggagaucaagaccauccuggccaa

SEQ ID NO: 511593 - RNA, 32 nt, Human
ugaagucaggaguucaagaccaaccugggcaa

SEQ ID NO: 511594 - RNA, 32 nt, Human
ugaagucaggaguucaagaccagccuggccaa

SEQ ID NO: 511595 - RNA, 32 nt, Human
ugaagucaggaguucaagaccauccuggccaa

SEQ ID NO: 511596 - RNA, 32 nt, Human
ugaagucaggaguucaagccuagccuggccaa

SEQ ID NO: 511597 - RNA, 32 nt, Human
ugaagucaggaguuccagaccaaccuggccaa

SEQ ID NO: 511598 - RNA, 31 nt, Human
ugaagucagugcaaggaggaaugagaggugg

SEQ ID NO: 511599 - RNA, 32 nt, Human
ugaagucauauguacacagaagugagucacca

SEQ ID NO: 511600 - RNA, 32 nt, Human
ugaagucaugccacugcacucaaaccuggcgg

SEQ ID NO: 511601 - RNA, 32 nt, Human
ugaaguccaagaguucgagaccggccugcgag

SEQ ID NO: 511602 - RNA, 32 nt, Human
ugaaguccagcugaguucagugaggacgaugg

SEQ ID NO: 511603 - RNA, 32 nt, Human
ugaaguccaggcuccccaggaagccuggggug

SEQ ID NO: 511604 - RNA, 32 nt, Human
ugaaguccaucuggucucucaguggccugaga

SEQ ID NO: 511605 - RNA, 32 nt, Human
ugaagucccaggcugggggugucaauggacgu

SEQ ID NO: 511606 - RNA, 32 nt, Human
ugaagucccgccacugcacuccagccugggca

SEQ ID NO: 511607 - RNA, 32 nt, Human
ugaagucccgggcugcucucagcacuucuccu

SEQ ID NO: 511608 - RNA, 32 nt, Human
ugaagucccucucacucccucuaccucccucu

SEQ ID NO: 511609 - RNA, 32 nt, Human
ugaaguccgcccuccccuccagccauaucugc

SEQ ID NO: 511610 - RNA, 32 nt, Human
ugaaguccuaucuguaccaacaagcaaggcca

SEQ ID NO: 511611 - RNA, 32 nt, Human
ugaaguccugcaaaggugauggugguccagac

SEQ ID NO: 511612 - RNA, 32 nt, Human
ugaaguccuguggcuaguggcagagaaguugg

SEQ ID NO: 511613 - RNA, 32 nt, Human
ugaaguccuuugucacuucucuugccuuagug

SEQ ID NO: 511614 - RNA, 32 nt, Human
ugaagucuaccauuaccagcugggucaccuug

SEQ ID NO: 511615 - RNA, 32 nt, Human
ugaagucuagcaugugggaggcugaggaugga

SEQ ID NO: 511616 - RNA, 32 nt, Human
ugaagucucacaccccuuccauuuguugccua

SEQ ID NO: 511617 - RNA, 32 nt, Human
ugaagucucacugcugagccuucagcuuuuau

SEQ ID NO: 511618 - RNA, 32 nt, Human
ugaagucucacuguguugcccagccugggugu

SEQ ID NO: 511619 - RNA, 32 nt, Human
ugaagucucaggagucucugguagccugcaga

SEQ ID NO: 511620 - RNA, 32 nt, Human
ugaagucuccgcaggaggcuucagagauauac

SEQ ID NO: 511621 - RNA, 32 nt, Human
ugaagucuccuucccuccuuuagaacucauuu

SEQ ID NO: 511622 - RNA, 32 nt, Human
ugaagucugaagaugucgccauugaacggaca

SEQ ID NO: 511623 - RNA, 32 nt, Human
ugaagucuguaauccuagcacuuugggaggcc

SEQ ID NO: 511624 - RNA, 32 nt, Human
ugaagucuguucugcaguaucuguugcugaau

SEQ ID NO: 511625 - RNA, 32 nt, Human
ugaagucuuaacccuugguaccacagaauauc

SEQ ID NO: 511626 - RNA, 32 nt, Human
ugaagucuucaaguccccagcaaccaaguugg

SEQ ID NO: 511627 - RNA, 22 nt, Human
ugaagugaagauugucagcaaa

SEQ ID NO: 511628 - RNA, 32 nt, Human
ugaagugaaggcugcucaucuggguucauuuu

SEQ ID NO: 511629 - RNA, 32 nt, Human
ugaagugaaugagacacuccaguuuuccuucu

SEQ ID NO: 511630 - RNA, 32 nt, Human
ugaagugaccaagcccuugaucagcuuuaaaa

SEQ ID NO: 511631 - RNA, 32 nt, Human
ugaagugacccccauuccccaaagcaaucaaa

SEQ ID NO: 511632 - RNA, 32 nt, Human
ugaagugacgggccgccuucugcuccagcugc

SEQ ID NO: 511633 - RNA, 19 nt, Human
ugaagugacugagaaucua

SEQ ID NO: 511634 - RNA, 32 nt, Human
ugaagugauaggggucacaauggggaaaugga

SEQ ID NO: 511635 - RNA, 32 nt, Human
ugaagugauaggggucacaauggggaaauuga

SEQ ID NO: 511636 - RNA, 32 nt, Human
ugaagugcaauguugugaucucggcucacugc

SEQ ID NO: 511637 - RNA, 32 nt, Human
ugaagugcagcggcaugaucucagcucacugc

SEQ ID NO: 511638 - RNA, 32 nt, Human
ugaagugcagugagucaagauugagccacugc

SEQ ID NO: 511639 - RNA, 32 nt, Human
ugaagugcaguggcacaaucauagcucgcugc

SEQ ID NO: 511640 - RNA, 32 nt, Human
ugaagugcaguggcacgaucauagguggucac

SEQ ID NO: 511641 - RNA, 32 nt, Human
ugaagugcaguggcaugaacucagcucacugc

SEQ ID NO: 511642 - RNA, 32 nt, Human
ugaagugcaguggcaugaucucagcuuacugc

SEQ ID NO: 511643 - RNA, 32 nt, Human
ugaagugcaguggcaugauucuggcucacugc

SEQ ID NO: 511644 - RNA, 32 nt, Human
ugaagugcagugguacgaucauagcucacugc

SEQ ID NO: 511645 - RNA, 32 nt, Human
ugaagugcaguggugugaucuuggcucacugc

SEQ ID NO: 511646 - RNA, 32 nt, Human
ugaagugcaguggugugauuacagcucaugua

SEQ ID NO: 511647 - RNA, 32 nt, Human
ugaagugccacugggucaccgcagggcagcug

SEQ ID NO: 511648 - RNA, 32 nt, Human
ugaagugcccagcgcuggagugcagcgugcca

SEQ ID NO: 511649 - RNA, 32 nt, Human
ugaaguggagagaagggaaaguaguuaagaaa

SEQ ID NO: 511650 - RNA, 32 nt, Human
ugaaguggagagaucgccugagcccaggaggu

SEQ ID NO: 511651 - RNA, 32 nt, Human
ugaaguggcaaagucccugaggacucacugga

SEQ ID NO: 511652 - RNA, 32 nt, Human
ugaaguggcucacaccuguaaucccagcacug

SEQ ID NO: 511653 - RNA, 32 nt, Human
ugaaguggcucacgccuguaauccccgcacuu

SEQ ID NO: 511654 - RNA, 32 nt, Human
ugaaguggcuguguucacccuggguggacacg

SEQ ID NO: 511655 - RNA, 32 nt, Human
ugaagugggaagaucacuugagcccaggaguu

SEQ ID NO: 511656 - RNA, 32 nt, Human
ugaagugggagccacagcuaggaguggcucau

SEQ ID NO: 511657 - RNA, 32 nt, Human
ugaagugggaggacugcuugagccugggaagu

SEQ ID NO: 511658 - RNA, 32 nt, Human
ugaagugggaggacugcuugggcccaggaauu

SEQ ID NO: 511659 - RNA, 32 nt, Human
ugaagugggaggaguguuugagcccaggaguu

SEQ ID NO: 511660 - RNA, 32 nt, Human
ugaagugggaggaucaccugagcucuggaggu

SEQ ID NO: 511661 - RNA, 32 nt, Human
ugaagugggaggaucauuugugcccagguuga

SEQ ID NO: 511662 - RNA, 32 nt, Human
ugaagugggaggaucccuugagcccagaacuu

SEQ ID NO: 511663 - RNA, 32 nt, Human
ugaagugggaggaucccuugagcucaggaguu

SEQ ID NO: 511664 - RNA, 32 nt, Human
ugaagugggaggaucgcuugagcccaggaguu

SEQ ID NO: 511665 - RNA, 32 nt, Human
ugaagugggaggaucgcuugagccugggaguu

SEQ ID NO: 511666 - RNA, 32 nt, Human
ugaagugggaggaucucucgggccagggaggu

SEQ ID NO: 511667 - RNA, 32 nt, Human
ugaagugggaggauggccugagcucaaggaga

SEQ ID NO: 511668 - RNA, 32 nt, Human
ugaagugggaggauugcuugagccggggaggu

SEQ ID NO: 511669 - RNA, 31 nt, Human
ugaagugggucaaaagaauuagauguacagu

SEQ ID NO: 511670 - RNA, 32 nt, Human
ugaagugggugaaucacuugaggucaggaguu

SEQ ID NO: 511671 - RNA, 32 nt, Human
ugaagugggugagggagacgcuucaguuuuag

SEQ ID NO: 511672 - RNA, 24 nt, Human
ugaaguggguggaucaccugaggu

SEQ ID NO: 511673 - RNA, 32 nt, Human
ugaagugguggaagguugaucucaggauauga

SEQ ID NO: 511674 - RNA, 32 nt, Human
ugaagugguggagaaggaaggcaggcuuaaag

SEQ ID NO: 511675 - RNA, 32 nt, Human
ugaagugguucacccuugaggaccaggagccu

SEQ ID NO: 511676 - RNA, 32 nt, Human
ugaaguguaaacuugugucugaauguuuuauu

SEQ ID NO: 511677 - RNA, 32 nt, Human
ugaaguguaguggcauccauuucuaauguaug

SEQ ID NO: 511678 - RNA, 32 nt, Human
ugaaguguauagcacuugccuuuacuagauau

SEQ ID NO: 511679 - RNA, 19 nt, Human
ugaaguguccugggccuuc

SEQ ID NO: 511680 - RNA, 32 nt, Human
ugaagugucucuucugugaaaggguucagagc

SEQ ID NO: 511681 - RNA, 32 nt, Human
ugaagugucugugagaccucacagaagagcac

SEQ ID NO: 511682 - RNA, 32 nt, Human
ugaaguguggagcgggaaaggagcaguuucug

SEQ ID NO: 511683 - RNA, 32 nt, Human
ugaagugugggacacaguugagcucaguaauc

SEQ ID NO: 511684 - RNA, 32 nt, Human
ugaagugugguguugggcagccccugggcgua

SEQ ID NO: 511685 - RNA, 32 nt, Human
ugaagugugugaagcucugugcuugcaugagg

SEQ ID NO: 511686 - RNA, 32 nt, Human
ugaaguguguguuuugccuccuuucccagugu

SEQ ID NO: 511687 - RNA, 32 nt, Human
ugaaguguguuuuauggacuaggaagcauuuu

SEQ ID NO: 511688 - RNA, 32 nt, Human
ugaaguguuuaggugaaggacaaguagguaag

SEQ ID NO: 511689 - RNA, 32 nt, Human
ugaaguuagccaagguugcuuuuguguuauaa

SEQ ID NO: 511690 - RNA, 32 nt, Human
ugaaguuagggaugacugugauuuucagaaca

SEQ ID NO: 511691 - RNA, 32 nt, Human
ugaaguucaaaccaaggaaacacugccaucuu

SEQ ID NO: 511692 - RNA, 32 nt, Human
ugaaguucaccaaaucagcgcagcuuauuaag

SEQ ID NO: 511693 - RNA, 32 nt, Human
ugaaguucagcacgugcugucguguagucagc

SEQ ID NO: 511694 - RNA, 32 nt, Human
ugaaguucauuuguuuacagggucgggaaugu

SEQ ID NO: 511695 - RNA, 32 nt, Human
ugaaguucgagaccagccuggccaacauggug

SEQ ID NO: 511696 - RNA, 32 nt, Human
ugaaguugaagauacaaccugacagcacagcc

SEQ ID NO: 511697 - RNA, 32 nt, Human
ugaaguugaugaagcaaauaaauauucuggcu

SEQ ID NO: 511698 - RNA, 32 nt, Human
ugaaguugcuaaaaauuuaauuaguugauaga

SEQ ID NO: 511699 - RNA, 32 nt, Human
ugaaguuggagggaggggcagggccuugcagg

SEQ ID NO: 511700 - RNA, 32 nt, Human
ugaaguuggcugacacagcuuagcuugguuuu

SEQ ID NO: 511701 - RNA, 32 nt, Human
ugaaguuggucucuggaccucuccuuacuuau

SEQ ID NO: 511702 - RNA, 32 nt, Human
ugaaguugucaguggcucuuucuguccuucag

SEQ ID NO: 511703 - RNA, 21 nt, Human
ugaaguugugaggcugcucca

SEQ ID NO: 511704 - RNA, 32 nt, Human
ugaaguugugggugcauuggccuaggcugagc

SEQ ID NO: 511705 - RNA, 32 nt, Human
ugaaguuuagagaauccugguauuucagugga

SEQ ID NO: 511706 - RNA, 32 nt, Human
ugaaguuuaguuauaucuucaucuucagauga

SEQ ID NO: 511707 - RNA, 32 nt, Human
ugaaguuucacagcuuggcuucagccuaucag

SEQ ID NO: 511708 - RNA, 32 nt, Human
ugaaguuucuggcauagaguccuggcuucccg

SEQ ID NO: 511709 - RNA, 32 nt, Human
ugaaguuuguacuugagggcagcugggaaauu

SEQ ID NO: 511710 - RNA, 32 nt, Human
ugaaguuuugcagaaauugacugugaaauguc

SEQ ID NO: 511711 - RNA, 32 nt, Human
ugaaguuuuuaaaagcugcuaaagacucggag

SEQ ID NO: 511712 - RNA, 32 nt, Human
ugaauaaaacaacauccaacccaggucauuga

SEQ ID NO: 511713 - RNA, 32 nt, Human
ugaauaaaacauuaaaacaucauauggagaag

SEQ ID NO: 511714 - RNA, 32 nt, Human
ugaauaaaagguggaagugaaaaagaacaaca

SEQ ID NO: 511715 - RNA, 32 nt, Human
ugaauaaaccaguucuacagacugcuucuucc

SEQ ID NO: 511716 - RNA, 32 nt, Human
ugaauaaagauaagaagcaucacugagauaau

SEQ ID NO: 511717 - RNA, 32 nt, Human
ugaauaaauagggaauaauagaauauguuuau

SEQ ID NO: 511718 - RNA, 32 nt, Human
ugaauaaauauugucagccagaaaagguuggu

SEQ ID NO: 511719 - RNA, 27 nt, Human
ugaauaaauuccauauuuuaccuauga

SEQ ID NO: 511720 - RNA, 32 nt, Human
ugaauaacacaaaaucucauucuaccugcagu

SEQ ID NO: 511721 - RNA, 32 nt, Human
ugaauaaccaugggaagugaccaagcaaagac

SEQ ID NO: 511722 - RNA, 32 nt, Human
ugaauaacuaccuguggcauuguugguucuga

SEQ ID NO: 511723 - RNA, 32 nt, Human
ugaauaacugauuugcacagcugaaucaggag

SEQ ID NO: 511724 - RNA, 32 nt, Human
ugaauaacugcacuccagccugggcaacauag

SEQ ID NO: 511725 - RNA, 32 nt, Human
ugaauaagaaucaucagagagcuguauccaug

SEQ ID NO: 511726 - RNA, 32 nt, Human
ugaauaagagauacaaggucucaccuucaucu

SEQ ID NO: 511727 - RNA, 32 nt, Human
ugaauaagaguuccuguagcuccucacccuca

SEQ ID NO: 511728 - RNA, 32 nt, Human
ugaauaagauggcaguguucuccucuggggcc

SEQ ID NO: 511729 - RNA, 32 nt, Human
ugaauaaggugaagaauuucacacaacauaca

SEQ ID NO: 511730 - RNA, 32 nt, Human
ugaauaauauugcagugugucuugucagcugu

SEQ ID NO: 511731 - RNA, 32 nt, Human
ugaauaauccacccuuuguuuagcauauaaac

SEQ ID NO: 511732 - RNA, 32 nt, Human
ugaauaauguggcaauacuuuaaaccaauccu

SEQ ID NO: 511733 - RNA, 32 nt, Human
ugaauacaggcauggaacaaaugaguaugugc

SEQ ID NO: 511734 - RNA, 32 nt, Human
ugaauacaggcuguauggacacuugcuuccau

SEQ ID NO: 511735 - RNA, 31 nt, Human
ugaauacauacuugccauuugaauuaauaac

SEQ ID NO: 511736 - RNA, 32 nt, Human
ugaauacauucugcuuucaucuuggucacaua

SEQ ID NO: 511737 - RNA, 32 nt, Human
ugaauaccaaguguguugggaauugcaugcca

SEQ ID NO: 511738 - RNA, 32 nt, Human
ugaauaccacaguagcauggagugugaccuca

SEQ ID NO: 511739 - RNA, 32 nt, Human
ugaauaccagcaccuauuagguuucauuuugc

SEQ ID NO: 511740 - RNA, 32 nt, Human
ugaauaccauacuaugcccaauacuguuuaaa

SEQ ID NO: 511741 - RNA, 32 nt, Human
ugaauaccugaggcugaguaauuuguaaagaa

SEQ ID NO: 511742 - RNA, 32 nt, Human
ugaauaccuuucaugccacugcagccacugga

SEQ ID NO: 511743 - RNA, 32 nt, Human
ugaauacuccuccccucuucucuuuugccccc

SEQ ID NO: 511744 - RNA, 32 nt, Human
ugaauacugcaacacugucucaaagguuucuu

SEQ ID NO: 511745 - RNA, 32 nt, Human
ugaauacugcugcucacccacagacacaaucu

SEQ ID NO: 511746 - RNA, 32 nt, Human
ugaauagaaugaauaccuuucaugccacugca

SEQ ID NO: 511747 - RNA, 32 nt, Human
ugaauagaguaucaccuuuuucaacaagauuu

SEQ ID NO: 511748 - RNA, 32 nt, Human
ugaauagaugauguuggaagucauggguccuc

SEQ ID NO: 511749 - RNA, 32 nt, Human
ugaauagauuucccuuucuuccugaccccaag

SEQ ID NO: 511750 - RNA, 32 nt, Human
ugaauagcaaacugaggcugaguagggaacag

SEQ ID NO: 511751 - RNA, 32 nt, Human
ugaauagcaauagcaaccauugagcuaaaauu

SEQ ID NO: 511752 - RNA, 32 nt, Human
ugaauagcagaggcaaaggcccucaccccucc

SEQ ID NO: 511753 - RNA, 32 nt, Human
ugaauagcagugagaaauggaugcugucagug

SEQ ID NO: 511754 - RNA, 32 nt, Human
ugaauagcauuuuucuccugccucaucaguca

SEQ ID NO: 511755 - RNA, 32 nt, Human
ugaauagccacugcacuccagccugggcaaca

SEQ ID NO: 511756 - RNA, 32 nt, Human
ugaauagccacugcacuccaucuugggcaaca

SEQ ID NO: 511757 - RNA, 32 nt, Human
ugaauagccacugcacucuagucuggggaaca

SEQ ID NO: 511758 - RNA, 32 nt, Human
ugaauagccacugcacuucagccugggcaaca

SEQ ID NO: 511759 - RNA, 32 nt, Human
ugaauagccacugcacuugagccucuugggaa

SEQ ID NO: 511760 - RNA, 32 nt, Human
ugaauagcucugcuuggacaaugggguugggg

SEQ ID NO: 511761 - RNA, 32 nt, Human
ugaauagcuuccaccuccuuuuuggcccucuu

SEQ ID NO: 511762 - RNA, 32 nt, Human
ugaauagcuuuuccccuuuuugcugacaaaaa

SEQ ID NO: 511763 - RNA, 32 nt, Human
ugaauaggcuucagccucccacugucaguacu

SEQ ID NO: 511764 - RNA, 32 nt, Human
ugaauagggagggagagcacaauucaguccau

SEQ ID NO: 511765 - RNA, 32 nt, Human
ugaauagggggaaacauuggccuuugguucuu

SEQ ID NO: 511766 - RNA, 32 nt, Human
ugaauaguccuaggcuggacagcaaugggcug

SEQ ID NO: 511767 - RNA, 32 nt, Human
ugaauagugcugcagugaacauacacaugcuu

SEQ ID NO: 511768 - RNA, 32 nt, Human
ugaauagugguuuuucucuagcuuuuugccag

SEQ ID NO: 511769 - RNA, 32 nt, Human
ugaauaguugggaauuggaaccccuccagggg

SEQ ID NO: 511770 - RNA, 32 nt, Human
ugaauauaaagucacuuauaaucagaaagcaa

SEQ ID NO: 511771 - RNA, 32 nt, Human
ugaauauacuuccugaaggggagggagaaggg

SEQ ID NO: 511772 - RNA, 32 nt, Human
ugaauauagagccgccagccagaagcucacag

SEQ ID NO: 511773 - RNA, 32 nt, Human
ugaauauaggaggcagagguugcagugagccg

SEQ ID NO: 511774 - RNA, 32 nt, Human
ugaauauaguccagcacagagcuguucaaauu

SEQ ID NO: 511775 - RNA, 32 nt, Human
ugaauauauaaauauuaaguauccucuagcgg

SEQ ID NO: 511776 - RNA, 32 nt, Human
ugaauauauacacacacauacagacacucaua

SEQ ID NO: 511777 - RNA, 32 nt, Human
ugaauaucuaaaaggccagcuaccugccuagg

SEQ ID NO: 511778 - RNA, 32 nt, Human
ugaauaucucuuuugugucuccuuccuaagcc

SEQ ID NO: 511779 - RNA, 32 nt, Human
ugaauaucuguucacuuuucaaucccaauucu

SEQ ID NO: 511780 - RNA, 32 nt, Human
ugaauaugauacaaaugagguuauaguuuaac

SEQ ID NO: 511781 - RNA, 32 nt, Human
ugaauaugccaaaucguacuuauuucagauga

SEQ ID NO: 511782 - RNA, 32 nt, Human
ugaauauggaaaggccagaggcagagugaaau

SEQ ID NO: 511783 - RNA, 32 nt, Human
ugaauauggaacuuaguuacaggacucaauaa

SEQ ID NO: 511784 - RNA, 22 nt, Human
ugaauauggcucguuuuguuuu

SEQ ID NO: 511785 - RNA, 32 nt, Human
ugaauaugggucauuuuagcuuccucaaguaa

SEQ ID NO: 511786 - RNA, 32 nt, Human
ugaauauguuacugaaccuauaguccaguuuu

SEQ ID NO: 511787 - RNA, 32 nt, Human
ugaauauuacuauggaaugauguaauagauuu

SEQ ID NO: 511788 - RNA, 32 nt, Human
ugaauauucaagaucuuucacauugcuuuuga

SEQ ID NO: 511789 - RNA, 32 nt, Human
ugaauauuuuaagagcuucuuucgaaaguuuc

SEQ ID NO: 511790 - RNA, 32 nt, Human
ugaauauuuucccuucaucuaacauugauuga

SEQ ID NO: 511791 - RNA, 32 nt, Human
ugaaucaaaacaaauucaagaaugcaguaucc

SEQ ID NO: 511792 - RNA, 32 nt, Human
ugaaucaaacuaaggguauuggacuuuugaaa

SEQ ID NO: 511793 - RNA, 32 nt, Human
ugaaucaaagaaugagugggcaaguguugauc

SEQ ID NO: 511794 - RNA, 32 nt, Human
ugaaucaacauuucuuccuuaaagcuacacac

SEQ ID NO: 511795 - RNA, 32 nt, Human
ugaaucaagcagcagaauuguacuugauucaa

SEQ ID NO: 511796 - RNA, 32 nt, Human
ugaaucacaacagugcucguuguggacuguaa

SEQ ID NO: 511797 - RNA, 32 nt, Human
ugaaucacacaccaagccccacaaagccccua

SEQ ID NO: 511798 - RNA, 21 nt, Human
ugaaucacaccuguaauccca

SEQ ID NO: 511799 - RNA, 32 nt, Human
ugaaucacaccuguaaucccagcacuuuggga

SEQ ID NO: 511800 - RNA, 32 nt, Human
ugaaucacaguuuuuaaccuguguuugucugc

SEQ ID NO: 511801 - RNA, 32 nt, Human
ugaaucacauaaaagagugccuggcacauagu

SEQ ID NO: 511802 - RNA, 32 nt, Human
ugaaucacauggucuuccgggcagcaggaaca

SEQ ID NO: 511803 - RNA, 32 nt, Human
ugaaucacgguuuuuaaccuguguuugucugc

SEQ ID NO: 511804 - RNA, 32 nt, Human
ugaaucacuuagugugaaagacuugccuugug

SEQ ID NO: 511805 - RNA, 32 nt, Human
ugaaucagaaaccaagaaacacuacuauuaaa

SEQ ID NO: 511806 - RNA, 32 nt, Human
ugaaucagaaaugcuguuuccauaaaggggca

SEQ ID NO: 511807 - RNA, 32 nt, Human
ugaaucagacugccuuuccuuuugucuucauu

SEQ ID NO: 511808 - RNA, 32 nt, Human
ugaaucagccuccccacucuccuuggucauuc

SEQ ID NO: 511809 - RNA, 30 nt, Human
ugaaucagcuucuccauggccugggcacca

SEQ ID NO: 511810 - RNA, 32 nt, Human
ugaaucaggacugaaugugaaagggaaguauu

SEQ ID NO: 511811 - RNA, 32 nt, Human
ugaaucagggaggcggagguuguggugagccg

SEQ ID NO: 511812 - RNA, 32 nt, Human
ugaaucagggcccugcccugcccaccaacucu

SEQ ID NO: 511813 - RNA, 32 nt, Human
ugaaucagggcugcccuuagugacuugcugau

SEQ ID NO: 511814 - RNA, 32 nt, Human
ugaaucaucuccucuguggucuugcccaguac

SEQ ID NO: 511815 - RNA, 24 nt, Human
ugaaucaugguuuuguuuuguuuu

SEQ ID NO: 511816 - RNA, 32 nt, Human
ugaaucaugugacgguggcuugaggaggaacc

SEQ ID NO: 511817 - RNA, 32 nt, Human
ugaaucauuguuaacacagcuguggcucguuu

SEQ ID NO: 511818 - RNA, 32 nt, Human
ugaauccaaacaguauagcuuuuaaauuuuaa

SEQ ID NO: 511819 - RNA, 32 nt, Human
ugaauccaaaccugugucaugccugugugcau

SEQ ID NO: 511820 - RNA, 32 nt, Human
ugaauccacauccugaagggaggcuacaacug

SEQ ID NO: 511821 - RNA, 32 nt, Human
ugaauccacugaguggugaguuccccacagcc

SEQ ID NO: 511822 - RNA, 32 nt, Human
ugaauccagaacuugguguuaagaauggcauc

SEQ ID NO: 511823 - RNA, 32 nt, Human
ugaauccagaaggcggagguugcagugagcug

SEQ ID NO: 511824 - RNA, 32 nt, Human
ugaauccaggaagcagagguugcggugagccg

SEQ ID NO: 511825 - RNA, 32 nt, Human
ugaauccaggagaccccaaccgcugugaugga

SEQ ID NO: 511826 - RNA, 32 nt, Human
ugaauccaggaggaggagguugcagugagccg

SEQ ID NO: 511827 - RNA, 32 nt, Human
ugaauccaggaggcagagcuugcagugagcug

SEQ ID NO: 511828 - RNA, 32 nt, Human
ugaauccaggaggcagaggcuguggugagcca

SEQ ID NO: 511829 - RNA, 32 nt, Human
ugaauccaggaggcagagguugcaaugagcca

SEQ ID NO: 511830 - RNA, 32 nt, Human
ugaauccaggaggcagagguugcagugagugg

SEQ ID NO: 511831 - RNA, 32 nt, Human
ugaauccaggaggcgaagguugcagugagcug

SEQ ID NO: 511832 - RNA, 32 nt, Human
ugaauccaggaggcggagguugcagugaacca

SEQ ID NO: 511833 - RNA, 32 nt, Human
ugaauccaggaggcggagguugcagugagccg

SEQ ID NO: 511834 - RNA, 32 nt, Human
ugaauccaggaggcggaguuuguggugaguug

SEQ ID NO: 511835 - RNA, 32 nt, Human
ugaauccaggagguaaagaugcugugagccga

SEQ ID NO: 511836 - RNA, 32 nt, Human
ugaauccaggagguggagccugcagugagcca

SEQ ID NO: 511837 - RNA, 32 nt, Human
ugaauccaggagguggagcuugcagugagccg

SEQ ID NO: 511838 - RNA, 32 nt, Human
ugaauccaggagguggagguugcagcgagcca

SEQ ID NO: 511839 - RNA, 32 nt, Human
ugaauccaggagguggagguugcagugagcug

SEQ ID NO: 511840 - RNA, 32 nt, Human
ugaauccaggaguucaagaccagcauggggaa

SEQ ID NO: 511841 - RNA, 32 nt, Human
ugaauccagguggcggagguugcagugagccg

SEQ ID NO: 511842 - RNA, 32 nt, Human
ugaauccagugguggagguugcagugagccaa

SEQ ID NO: 511843 - RNA, 32 nt, Human
ugaauccauacaguuucuuaaaagacaauaaa

SEQ ID NO: 511844 - RNA, 32 nt, Human
ugaauccauggauguggaacccauggauguga

SEQ ID NO: 511845 - RNA, 32 nt, Human
ugaauccauucccaucaguccauuccaguugg

SEQ ID NO: 511846 - RNA, 32 nt, Human
ugaauccauugaaacuaggggucuccagugcu

SEQ ID NO: 511847 - RNA, 32 nt, Human
ugaaucccagaacugguaagauugggaaucug

SEQ ID NO: 511848 - RNA, 32 nt, Human
ugaaucccaggagacagagguugcagugagcc

SEQ ID NO: 511849 - RNA, 32 nt, Human
ugaauccccgaggcggagguugcacugagccg

SEQ ID NO: 511850 - RNA, 32 nt, Human
ugaaucccugaacagagaauaucucuuguaaa

SEQ ID NO: 511851 - RNA, 32 nt, Human
ugaaucccugagaagagagagcauggggcgug

SEQ ID NO: 511852 - RNA, 32 nt, Human
ugaaucccugaggcagagguugcagugagcug

SEQ ID NO: 511853 - RNA, 32 nt, Human
ugaaucccugggagcgccugacccuggugggc

SEQ ID NO: 511854 - RNA, 32 nt, Human
ugaauccgggaagcagagguuguagugagcca

SEQ ID NO: 511855 - RNA, 32 nt, Human
ugaauccgggaggcagagauugcagugggccu

SEQ ID NO: 511856 - RNA, 32 nt, Human
ugaauccgggaggcagagguugcaggagcuga

SEQ ID NO: 511857 - RNA, 32 nt, Human
ugaauccgggaggcggagcuugcagcgagccg

SEQ ID NO: 511858 - RNA, 32 nt, Human
ugaauccgggaggcggagguugcagugaaccg

SEQ ID NO: 511859 - RNA, 32 nt, Human
ugaauccgggaggcggagguugcggugagcca

SEQ ID NO: 511860 - RNA, 32 nt, Human
ugaauccgggaggcgggucuugcagugagcag

SEQ ID NO: 511861 - RNA, 32 nt, Human
ugaauccgggagguggagguugcagugagcca

SEQ ID NO: 511862 - RNA, 32 nt, Human
ugaauccgugagguggagguuguagugaguca

SEQ ID NO: 511863 - RNA, 32 nt, Human
ugaauccucauuuuacuccuuguuaucccaga

SEQ ID NO: 511864 - RNA, 32 nt, Human
ugaauccugccccucugguguggugcggccuc

SEQ ID NO: 511865 - RNA, 32 nt, Human
ugaauccuggaggcagagguugcagugagcug

SEQ ID NO: 511866 - RNA, 32 nt, Human
ugaauccugguaaacuuaaccaggacuccaau

SEQ ID NO: 511867 - RNA, 32 nt, Human
ugaauccuuagcagcgaucuccaagggcacca

SEQ ID NO: 511868 - RNA, 32 nt, Human
ugaauccuuccucuccccuccucccaucccuc

SEQ ID NO: 511869 - RNA, 32 nt, Human
ugaauccuuccucuccccuccucccauccuuc

SEQ ID NO: 511870 - RNA, 32 nt, Human
ugaaucgggcucucugcucucuccuuagggag

SEQ ID NO: 511871 - RNA, 32 nt, Human
ugaaucgucaaagguacgggccagcuugugcc

SEQ ID NO: 511872 - RNA, 32 nt, Human
ugaaucguguuugguuucucguucuacuccag

SEQ ID NO: 511873 - RNA, 32 nt, Human
ugaaucuaagaagcagagguugcagugagcug

SEQ ID NO: 511874 - RNA, 32 nt, Human
ugaaucuaggaggcagagguugcagugaacug

SEQ ID NO: 511875 - RNA, 32 nt, Human
ugaaucucagcaguuccgccaucuugaagaau

SEQ ID NO: 511876 - RNA, 32 nt, Human
ugaaucucauucucuuagcugggcgugcaaca

SEQ ID NO: 511877 - RNA, 32 nt, Human
ugaaucuccaaccuuaaauccugaaacagugg

SEQ ID NO: 511878 - RNA, 32 nt, Human
ugaaucucccuccaacccuucuugccuacucc

SEQ ID NO: 511879 - RNA, 21 nt, Human
ugaaucuccucuuggagcauu

SEQ ID NO: 511880 - RNA, 32 nt, Human
ugaaucuccugggaauaauucugcucucugga

SEQ ID NO: 511881 - RNA, 32 nt, Human
ugaaucucuaccagcugcucccagaaucacag

SEQ ID NO: 511882 - RNA, 32 nt, Human
ugaaucucucagacuugaccuguccaaacugc

SEQ ID NO: 511883 - RNA, 32 nt, Human
ugaaucucuccucuccuccuugucuggcucug

SEQ ID NO: 511884 - RNA, 32 nt, Human
ugaaucucuguuuuagggguuggggcuagugu

SEQ ID NO: 511885 - RNA, 32 nt, Human
ugaaucucuuucuggauugcucuuggguacaa

SEQ ID NO: 511886 - RNA, 32 nt, Human
ugaaucugaacaucucuccaucuagagcccaa

SEQ ID NO: 511887 - RNA, 32 nt, Human
ugaaucugagaucuaugaggcaggagcuaagg

SEQ ID NO: 511888 - RNA, 32 nt, Human
ugaaucugagaucuaugaggcaggagcugagg

SEQ ID NO: 511889 - RNA, 32 nt, Human
ugaaucugcccuuuaauaaagcauuauugaga

SEQ ID NO: 511890 - RNA, 32 nt, Human
ugaaucugccucucucugccucuuuucuccug

SEQ ID NO: 511891 - RNA, 32 nt, Human
ugaaucuggaaagaggagaaggacaugaauug

SEQ ID NO: 511892 - RNA, 32 nt, Human
ugaaucuggaagcaagaggaccugagccagau

SEQ ID NO: 511893 - RNA, 32 nt, Human
ugaaucuggagaagaaaagggagauuugaaac

SEQ ID NO: 511894 - RNA, 32 nt, Human
ugaaucugggaagcggagguugcagugagcug

SEQ ID NO: 511895 - RNA, 32 nt, Human
ugaaucugggaggcagagguugcagugagccg

SEQ ID NO: 511896 - RNA, 32 nt, Human
ugaaucugggaggcagagguugcagugagcug

SEQ ID NO: 511897 - RNA, 32 nt, Human
ugaaucugggaggcagagguugcugugagccg

SEQ ID NO: 511898 - RNA, 32 nt, Human
ugaaucugggaggcggagauugcagugagccg

SEQ ID NO: 511899 - RNA, 32 nt, Human
ugaaucugggaggcggagguugcagugagcca

SEQ ID NO: 511900 - RNA, 32 nt, Human
ugaaucugggagggaaguggagguugcuguac

SEQ ID NO: 511901 - RNA, 32 nt, Human
ugaaucugggagguggagguugcagugagcca

SEQ ID NO: 511902 - RNA, 32 nt, Human
ugaaucugucaagcuucaagaauaccagagaa

SEQ ID NO: 511903 - RNA, 32 nt, Human
ugaaucugucccucgugacaauuauaggagga

SEQ ID NO: 511904 - RNA, 32 nt, Human
ugaaucuuaaaagaaaaggauauuuauuagau

SEQ ID NO: 511905 - RNA, 32 nt, Human
ugaaucuuauagaacuagagaacuagagcaaa

SEQ ID NO: 511906 - RNA, 32 nt, Human
ugaaucuuauucccucacccuucccugauucu

SEQ ID NO: 511907 - RNA, 32 nt, Human
ugaaucuuccaaauugaagccauuauucucaa

SEQ ID NO: 511908 - RNA, 32 nt, Human
ugaaucuuccugccccuccucacugcuuaacc

SEQ ID NO: 511909 - RNA, 32 nt, Human
ugaaucuucucccuuguccugcuugggguuca

SEQ ID NO: 511910 - RNA, 32 nt, Human
ugaaucuugagagagaggagauccuccaaguu

SEQ ID NO: 511911 - RNA, 32 nt, Human
ugaaucuugcugcugcucacucuuugggucca

SEQ ID NO: 511912 - RNA, 32 nt, Human
ugaaucuugugagcacuuacgcuaggagaaau

SEQ ID NO: 511913 - RNA, 32 nt, Human
ugaaucuuuccaagcaccacuucggacacacc

SEQ ID NO: 511914 - RNA, 32 nt, Human
ugaaugaaaccaggccauagcugucauaaauc

SEQ ID NO: 511915 - RNA, 32 nt, Human
ugaaugaaacuauaguuccauuuggaagccca

SEQ ID NO: 511916 - RNA, 32 nt, Human
ugaaugaaagaaugguuuacuuuagaaguccc

SEQ ID NO: 511917 - RNA, 32 nt, Human
ugaaugaaccuugcugaauuaaucugaauagc

SEQ ID NO: 511918 - RNA, 32 nt, Human
ugaaugaagaauuuuuagcugugcagauaggu

SEQ ID NO: 511919 - RNA, 32 nt, Human
ugaaugaagaggaguaggaaggaaaauggaau

SEQ ID NO: 511920 - RNA, 32 nt, Human
ugaaugaagggccacagaaaaugaagcuggcg

SEQ ID NO: 511921 - RNA, 32 nt, Human
ugaaugaaggggcagcuggaggauguggugga

SEQ ID NO: 511922 - RNA, 32 nt, Human
ugaaugaaguggagagaagggaaaguaguuaa

SEQ ID NO: 511923 - RNA, 32 nt, Human
ugaaugaauaagaggauguggcacugagcgcc

SEQ ID NO: 511924 - RNA, 32 nt, Human
ugaaugaauagaaguggugagagcagccaccc

SEQ ID NO: 511925 - RNA, 32 nt, Human
ugaaugacacagauuugccagaugacauguag

SEQ ID NO: 511926 - RNA, 32 nt, Human
ugaaugacaugcaacaggugaagguuuauacg

SEQ ID NO: 511927 - RNA, 32 nt, Human
ugaaugacccacccuuccugauuuuaaguaua

SEQ ID NO: 511928 - RNA, 32 nt, Human
ugaaugacccuccaacagccccacauggguug

SEQ ID NO: 511929 - RNA, 32 nt, Human
ugaaugagaacugcaggaguuucuccucuggg

SEQ ID NO: 511930 - RNA, 32 nt, Human
ugaaugagaugguuccugcugaagacauuuac

SEQ ID NO: 511931 - RNA, 32 nt, Human
ugaaugagcagaagaaaauuauuacuggagau

SEQ ID NO: 511932 - RNA, 32 nt, Human
ugaaugagcccuggagcccccuccaguccagu

SEQ ID NO: 511933 - RNA, 32 nt, Human
ugaaugaggaauguguuugugaaugccucaug

SEQ ID NO: 511934 - RNA, 32 nt, Human
ugaaugaggcacagccguagagcuguggcuaa

SEQ ID NO: 511935 - RNA, 32 nt, Human
ugaaugaguuuagugccacagcauuaaaugua

SEQ ID NO: 511936 - RNA, 32 nt, Human
ugaaugauacagugugcauucucuccagcugc

SEQ ID NO: 511937 - RNA, 32 nt, Human
ugaaugaucaguggaggacuugcccacgugag

SEQ ID NO: 511938 - RNA, 32 nt, Human
ugaaugaugucggacauguuacugaacuucca

SEQ ID NO: 511939 - RNA, 32 nt, Human
ugaaugauucacgaaucaggcagcccccagaa

SEQ ID NO: 511940 - RNA, 32 nt, Human
ugaaugcaagaaguggggcagcagcaguggag

SEQ ID NO: 511941 - RNA, 32 nt, Human
ugaaugcacacaugcagaaaugcagagucaau

SEQ ID NO: 511942 - RNA, 32 nt, Human
ugaaugcaccaccaccauuuaaccacccugcc

SEQ ID NO: 511943 - RNA, 32 nt, Human
ugaaugcacuuuuuaugacaaugauucaguaa

SEQ ID NO: 511944 - RNA, 32 nt, Human
ugaaugcagaaaacagggucugggacauuagu

SEQ ID NO: 511945 - RNA, 32 nt, Human
ugaaugcagaagcagagccacugugaaguaag

SEQ ID NO: 511946 - RNA, 32 nt, Human
ugaaugcagccaucugagcaagggcugaggga

SEQ ID NO: 511947 - RNA, 32 nt, Human
ugaaugcagcuuugccaguggcauaucuguca

SEQ ID NO: 511948 - RNA, 32 nt, Human
ugaaugcagguugcugcagcucugccuucucc

SEQ ID NO: 511949 - RNA, 32 nt, Human
ugaaugcauaaauauguauaaugugagaauau

SEQ ID NO: 511950 - RNA, 32 nt, Human
ugaaugccaggcacuggcaugcugggucaugg

SEQ ID NO: 511951 - RNA, 32 nt, Human
ugaaugccaggcuaggaaggaggcggcucucg

SEQ ID NO: 511952 - RNA, 32 nt, Human
ugaaugccccacugcacuccagccugggcgac

SEQ ID NO: 511953 - RNA, 32 nt, Human
ugaaugccggcguggggagcugcacugcacca

SEQ ID NO: 511954 - RNA, 32 nt, Human
ugaaugccuaucuuccuuuugugccucggaac

SEQ ID NO: 511955 - RNA, 32 nt, Human
ugaaugccuuaaaugucccagguauugagaau

SEQ ID NO: 511956 - RNA, 32 nt, Human
ugaaugccuuggagggaucccaggaagcccca

SEQ ID NO: 511957 - RNA, 32 nt, Human
ugaaugcguucugcagcauguagcaugcccac

SEQ ID NO: 511958 - RNA, 21 nt, Human
ugaaugcugaaaagcuacuag

SEQ ID NO: 511959 - RNA, 32 nt, Human
ugaaugcugagcagaggcucucagcagagggg

SEQ ID NO: 511960 - RNA, 32 nt, Human
ugaaugcugagugagcgaguaagggaggaggg

SEQ ID NO: 511961 - RNA, 32 nt, Human
ugaaugcuggaaauggcuucauagugaagugc

SEQ ID NO: 511962 - RNA, 32 nt, Human
ugaaugcugucuugacaucucuugccuugucc

SEQ ID NO: 511963 - RNA, 32 nt, Human
ugaaugcuuaaaguaagaucuauucaugaaac

SEQ ID NO: 511964 - RNA, 32 nt, Human
ugaauggaaaccccggucccuggcagaaguau

SEQ ID NO: 511965 - RNA, 32 nt, Human
ugaauggaaaguugauuuugucuguauuugaa

SEQ ID NO: 511966 - RNA, 32 nt, Human
ugaauggagacaggguuucaacauguuggcca

SEQ ID NO: 511967 - RNA, 32 nt, Human
ugaauggagagauugagagggaugucgggcag

SEQ ID NO: 511968 - RNA, 32 nt, Human
ugaauggagaggacaaaggcagcuucugacac

SEQ ID NO: 511969 - RNA, 32 nt, Human
ugaauggagaggaggaagaaaaugaagaagga

SEQ ID NO: 511970 - RNA, 32 nt, Human
ugaauggagccucuacccucuggaugccuuuc

SEQ ID NO: 511971 - RNA, 32 nt, Human
ugaauggagcuuauuacuggggugagggacag

SEQ ID NO: 511972 - RNA, 32 nt, Human
ugaauggagugagaagacagcccaguggaaug

SEQ ID NO: 511973 - RNA, 32 nt, Human
ugaauggaugaaaccauugcauucuuguacac

SEQ ID NO: 511974 - RNA, 31 nt, Human
ugaauggcagaaaggcgccuaccucaaggac

SEQ ID NO: 511975 - RNA, 32 nt, Human
ugaauggcauugaaugguucaucuuaaauggg

SEQ ID NO: 511976 - RNA, 32 nt, Human
ugaauggccaaaacauuugacuccagugaggg

SEQ ID NO: 511977 - RNA, 32 nt, Human
ugaauggccaauccuuccaucuggaggccugg

SEQ ID NO: 511978 - RNA, 32 nt, Human
ugaauggccccagacugguugcagcugggcuu

SEQ ID NO: 511979 - RNA, 32 nt, Human
ugaauggcuccaccccucccccagcccugcuu

SEQ ID NO: 511980 - RNA, 32 nt, Human
ugaauggcugcucuaucuugggcuguaucaag

SEQ ID NO: 511981 - RNA, 32 nt, Human
ugaauggcuggcaguccuccagcauguggucu

SEQ ID NO: 511982 - RNA, 32 nt, Human
ugaauggcuggccugugguggaugggugcucu

SEQ ID NO: 511983 - RNA, 32 nt, Human
ugaauggcuuuguauagaaccucuuugucuac

SEQ ID NO: 511984 - RNA, 32 nt, Human
ugaaugggaagagcccauaacagaaugaccua

SEQ ID NO: 511985 - RNA, 32 nt, Human
ugaaugggaaggggaaggaauuaauguggaau

SEQ ID NO: 511986 - RNA, 19 nt, Human
ugaaugggacugaguccca

SEQ ID NO: 511987 - RNA, 32 nt, Human
ugaaugggagguggaggaggguugcagcuccc

SEQ ID NO: 511988 - RNA, 32 nt, Human
ugaaugggccuuuuuaucuucccacuguauca

SEQ ID NO: 511989 - RNA, 32 nt, Human
ugaauggggagguauaaaaagcaaagauuauu

SEQ ID NO: 511990 - RNA, 32 nt, Human
ugaauggggagguggaacuugauuggaccugu

SEQ ID NO: 511991 - RNA, 32 nt, Human
ugaauggggcagcguggagaaauccuaagaga

SEQ ID NO: 511992 - RNA, 32 nt, Human
ugaauggguagaaaaugaauuugcuagaacac

SEQ ID NO: 511993 - RNA, 32 nt, Human
ugaaugggucucaaagacuuggugaccccagc

SEQ ID NO: 511994 - RNA, 32 nt, Human
ugaauggguggccuguggugaauggcuggccu

SEQ ID NO: 511995 - RNA, 23 nt, Human
ugaauggguuguuaaaggcaaug

SEQ ID NO: 511996 - RNA, 32 nt, Human
ugaaugguacuguaccgguucaucuggacugc

SEQ ID NO: 511997 - RNA, 32 nt, Human
ugaaugguccagggaugagcagugaugccuca

SEQ ID NO: 511998 - RNA, 32 nt, Human
ugaauggucucuuugccuucaggcuggaugag

SEQ ID NO: 511999 - RNA, 32 nt, Human
ugaaugguggauugcacaucugaaaaggcuag

SEQ ID NO: 512000 - RNA, 32 nt, Human
ugaaugguggucuuugcaaagagcauuuauau

SEQ ID NO: 512001 - RNA, 32 nt, Human
ugaauggugugcuccccucugugucuccaugg

SEQ ID NO: 512002 - RNA, 32 nt, Human
ugaaugguuagccuggugugguggugcacacc

SEQ ID NO: 512003 - RNA, 32 nt, Human
ugaaugguugacugaauuaagcugacacaaag

SEQ ID NO: 512004 - RNA, 32 nt, Human
ugaauguaaaguuacacuguucacaaagguuu

SEQ ID NO: 512005 - RNA, 32 nt, Human
ugaauguaaugcuggggacaggcaugcugccg

SEQ ID NO: 512006 - RNA, 32 nt, Human
ugaauguaccuacuagggcaccauaauacugc

SEQ ID NO: 512007 - RNA, 32 nt, Human
ugaauguagagaaauucaccagagcucacugc

SEQ ID NO: 512008 - RNA, 32 nt, Human
ugaauguagagacccgugggcacuuuuccuuu

SEQ ID NO: 512009 - RNA, 32 nt, Human
ugaauguagccccugacacauacaggccagag

SEQ ID NO: 512010 - RNA, 32 nt, Human
ugaauguauccgccucgguucccaccacugcc

SEQ ID NO: 512011 - RNA, 32 nt, Human
ugaaugucaccaggagaggugggggagggaaa

SEQ ID NO: 512012 - RNA, 31 nt, Human
ugaaugucagaaaauaccuuuuggaggguua

SEQ ID NO: 512013 - RNA, 32 nt, Human
ugaaugucaggaggaagucacagggaguuuug

SEQ ID NO: 512014 - RNA, 32 nt, Human
ugaaugucagugugacugaucucucgugauug

SEQ ID NO: 512015 - RNA, 32 nt, Human
ugaaugucauaauugcagugacaggacauugc

SEQ ID NO: 512016 - RNA, 32 nt, Human
ugaaugucauggagcccagcugaaauggacug

SEQ ID NO: 512017 - RNA, 32 nt, Human
ugaaugucccuggauauggaagagaggaaaug

SEQ ID NO: 512018 - RNA, 32 nt, Human
ugaaugucuaaggucacacaguauuaagugac

SEQ ID NO: 512019 - RNA, 32 nt, Human
ugaaugucucaaaaccuuacacccugggaaua

SEQ ID NO: 512020 - RNA, 32 nt, Human
ugaaugucucacuacaaaaugacuugagucca

SEQ ID NO: 512021 - RNA, 32 nt, Human
ugaaugucuguagccaaaacuuguuuccacau

SEQ ID NO: 512022 - RNA, 32 nt, Human
ugaaugucuuuccaauggcuggaaaggucccu

SEQ ID NO: 512023 - RNA, 32 nt, Human
ugaaugugagccacuuuccuauauaccacacc

SEQ ID NO: 512024 - RNA, 32 nt, Human
ugaaugugaggugcccaaagagguuauaguga

SEQ ID NO: 512025 - RNA, 32 nt, Human
ugaaugugaugguucucccacagcucgcucug

SEQ ID NO: 512026 - RNA, 32 nt, Human
ugaaugugaugguucuuggaauugggaccuuu

SEQ ID NO: 512027 - RNA, 32 nt, Human
ugaaugugccaugcccucucccucucuggaug

SEQ ID NO: 512028 - RNA, 31 nt, Human
ugaaugugccucucuuucagucucugucucu

SEQ ID NO: 512029 - RNA, 32 nt, Human
ugaaugugcugguuccucccaccaucaagcag

SEQ ID NO: 512030 - RNA, 32 nt, Human
ugaaugugcuuaagcagaucucuugcggcgug

SEQ ID NO: 512031 - RNA, 32 nt, Human
ugaaugugggaaagcuuucccugagaauucac

SEQ ID NO: 512032 - RNA, 32 nt, Human
ugaaugugggaaguccuucagcagcaauucaa

SEQ ID NO: 512033 - RNA, 32 nt, Human
ugaaugugggaggcggagguugcagugaguca

SEQ ID NO: 512034 - RNA, 32 nt, Human
ugaauguguccccuuccccacccucuagugua

SEQ ID NO: 512035 - RNA, 32 nt, Human
ugaauguguggaggggacucugaagcaggugu

SEQ ID NO: 512036 - RNA, 32 nt, Human
ugaauguucuauuauuuuauacauacacauua

SEQ ID NO: 512037 - RNA, 32 nt, Human
ugaauguuuaccaucagcauuauuuuaucauu

SEQ ID NO: 512038 - RNA, 32 nt, Human
ugaauguuuacugugcgucaagcacaguuaau

SEQ ID NO: 512039 - RNA, 32 nt, Human
ugaauguuugaugcuaugaaaagcuuuccaua

SEQ ID NO: 512040 - RNA, 23 nt, Human
ugaauguuuugaugaaaugaaug

SEQ ID NO: 512041 - RNA, 32 nt, Human
ugaauguuuugcaaauguauuggucccugugu

SEQ ID NO: 512042 - RNA, 32 nt, Human
ugaauguuuuucuguaccaucuaugugcaauu

SEQ ID NO: 512043 - RNA, 32 nt, Human
ugaauuaaaaugccugugaacugcaaacuugc

SEQ ID NO: 512044 - RNA, 32 nt, Human
ugaauuaagacaugaaguguguucuguccaua

SEQ ID NO: 512045 - RNA, 32 nt, Human
ugaauuaaugagcagaaagagaggauugguaa

SEQ ID NO: 512046 - RNA, 32 nt, Human
ugaauuacaaggggcuacugaauggcuauuac

SEQ ID NO: 512047 - RNA, 32 nt, Human
ugaauuacacccuuggaaucagcccugaugau

SEQ ID NO: 512048 - RNA, 32 nt, Human
ugaauuacaggcagcuguucaaacucuucagg

SEQ ID NO: 512049 - RNA, 32 nt, Human
ugaauuaccucuuguuucuuucaccuuugaaa

SEQ ID NO: 512050 - RNA, 32 nt, Human
ugaauuacucaaggcugccucucugcaaaguu

SEQ ID NO: 512051 - RNA, 32 nt, Human
ugaauuacugugugaaguucucaccgacaaug

SEQ ID NO: 512052 - RNA, 32 nt, Human
ugaauuacuuucucuucucucuucucaauuuu

SEQ ID NO: 512053 - RNA, 32 nt, Human
ugaauuagaaggcuuuugccuuccauauccau

SEQ ID NO: 512054 - RNA, 32 nt, Human
ugaauuagagcugcuccuacuagauaacugag

SEQ ID NO: 512055 - RNA, 32 nt, Human
ugaauuagcaaacugaauaaacuacagaaauu

SEQ ID NO: 512056 - RNA, 32 nt, Human
ugaauuagcagucccgcaguaacagcagcaga

SEQ ID NO: 512057 - RNA, 31 nt, Human
ugaauuaggcuuucugcuugccaaggccugu

SEQ ID NO: 512058 - RNA, 32 nt, Human
ugaauuagucauucugacauucuuuggaccau

SEQ ID NO: 512059 - RNA, 32 nt, Human
ugaauuaguucagaaauaugggccaaaaagau

SEQ ID NO: 512060 - RNA, 32 nt, Human
ugaauuaguugcugcacuccagccuaggcaac

SEQ ID NO: 512061 - RNA, 32 nt, Human
ugaauuauaccacuggcuuuccugguucucca

SEQ ID NO: 512062 - RNA, 32 nt, Human
ugaauuaucaggagugaacccagaggcacgua

SEQ ID NO: 512063 - RNA, 32 nt, Human
ugaauuaucaggugugaacccacaggcaagua

SEQ ID NO: 512064 - RNA, 32 nt, Human
ugaauuaucugugaauguugggaagaggaaug

SEQ ID NO: 512065 - RNA, 32 nt, Human
ugaauuaugauggucugcauuagucucaugug

SEQ ID NO: 512066 - RNA, 32 nt, Human
ugaauuauggcagaaaggaaaaauaaaacaua

SEQ ID NO: 512067 - RNA, 32 nt, Human
ugaauuaugugcugugucacuguggcuugaag

SEQ ID NO: 512068 - RNA, 32 nt, Human
ugaauucacaccauggcagcuuuuaacuugag

SEQ ID NO: 512069 - RNA, 32 nt, Human
ugaauucacggggcccucugggcacauucauc

SEQ ID NO: 512070 - RNA, 32 nt, Human
ugaauucacuccucagcccuguucagaccagc

SEQ ID NO: 512071 - RNA, 32 nt, Human
ugaauucagaaacuaucccagaucucagcuag

SEQ ID NO: 512072 - RNA, 32 nt, Human
ugaauucagacuccugggcuuaagggauccuu

SEQ ID NO: 512073 - RNA, 32 nt, Human
ugaauucaggaggcggagguugcagugagcca

SEQ ID NO: 512074 - RNA, 32 nt, Human
ugaauucaggagguggagguugcagugagccg

SEQ ID NO: 512075 - RNA, 32 nt, Human
ugaauucagugaacacugguugaggagugccu

SEQ ID NO: 512076 - RNA, 32 nt, Human
ugaauucauucuacucauacuacacacccagu

SEQ ID NO: 512077 - RNA, 32 nt, Human
ugaauuccaagugcuccauuggaucagcuucc

SEQ ID NO: 512078 - RNA, 32 nt, Human
ugaauuccacauuaaauuuucuggcaaaguau

SEQ ID NO: 512079 - RNA, 28 nt, Human
ugaauuccagaguccuuuuggaaaacug

SEQ ID NO: 512080 - RNA, 32 nt, Human
ugaauuccaggugucaagaagccuaggaucug

SEQ ID NO: 512081 - RNA, 32 nt, Human
ugaauuccaggugucaagaagccuagggucug

SEQ ID NO: 512082 - RNA, 32 nt, Human
ugaauuccguacgaugacucugguuuugguca

SEQ ID NO: 512083 - RNA, 32 nt, Human
ugaauuccuucauugacuagcuauuucucuuc

SEQ ID NO: 512084 - RNA, 22 nt, Human
ugaauuccuugcugguacuguc

SEQ ID NO: 512085 - RNA, 32 nt, Human
ugaauucgcgaggcagagguugcagcgaaccc

SEQ ID NO: 512086 - RNA, 32 nt, Human
ugaauucgggagguggagguugcagugagccg

SEQ ID NO: 512087 - RNA, 32 nt, Human
ugaauucuaagacuugaaacaaccugaucauu

SEQ ID NO: 512088 - RNA, 32 nt, Human
ugaauucucacaguggcuuagacaauggagac

SEQ ID NO: 512089 - RNA, 20 nt, Human
ugaauucuccaggugcugcu

SEQ ID NO: 512090 - RNA, 32 nt, Human
ugaauucucuagaccaccaguucuaaccuuca

SEQ ID NO: 512091 - RNA, 32 nt, Human
ugaauucucuagaccagaggugcucugaggau

SEQ ID NO: 512092 - RNA, 32 nt, Human
ugaauucugaagauacagaugacagugacgaa

SEQ ID NO: 512093 - RNA, 32 nt, Human
ugaauucugcagccugcggccauguccagguc

SEQ ID NO: 512094 - RNA, 32 nt, Human
ugaauucugcuccucucucaucaauccaggac

SEQ ID NO: 512095 - RNA, 32 nt, Human
ugaauucuggaaggagggugccugggaggugg

SEQ ID NO: 512096 - RNA, 32 nt, Human
ugaauucuucccaauuuagccuaucuccuuaa

SEQ ID NO: 512097 - RNA, 32 nt, Human
ugaauucuucuagcuccuccaaucccauuuua

SEQ ID NO: 512098 - RNA, 32 nt, Human
ugaauucuuggcccaauuucucucacuucugc

SEQ ID NO: 512099 - RNA, 32 nt, Human
ugaauucuuuugcagaacuacugugugucugu

SEQ ID NO: 512100 - RNA, 32 nt, Human
ugaauugaaaggauuucuucugaaagcuaauu

SEQ ID NO: 512101 - RNA, 32 nt, Human
ugaauugagugacaugagcaggauguggggcc

SEQ ID NO: 512102 - RNA, 32 nt, Human
ugaauugauccaggccacacagcugguaagcg

SEQ ID NO: 512103 - RNA, 32 nt, Human
ugaauugcagcaggaggcagauuuauuccugg

SEQ ID NO: 512104 - RNA, 20 nt, Human
ugaauugccuguucauaaaa

SEQ ID NO: 512105 - RNA, 32 nt, Human
ugaauugcucuucauccauauauagcaauugu

SEQ ID NO: 512106 - RNA, 32 nt, Human
ugaauuggaacuccauaaggaggggccaaauu

SEQ ID NO: 512107 - RNA, 32 nt, Human
ugaauuggaagagggcccagggccgcacaagc

SEQ ID NO: 512108 - RNA, 32 nt, Human
ugaauuggaugcuauggaauaccauacaauga

SEQ ID NO: 512109 - RNA, 32 nt, Human
ugaauuggccacugauuucaauucugcaguau

SEQ ID NO: 512110 - RNA, 32 nt, Human
ugaauuggccagaguuuauccuagauuauuuu

SEQ ID NO: 512111 - RNA, 32 nt, Human
ugaauuggcugccaagaguccaagccaucugg

SEQ ID NO: 512112 - RNA, 32 nt, Human
ugaauuggcuuagucaaugccucacaagcuag

SEQ ID NO: 512113 - RNA, 32 nt, Human
ugaauuggcuuccuugacgcgagaggcucuga

SEQ ID NO: 512114 - RNA, 32 nt, Human
ugaauugggagagagaggccugaaccuguuga

SEQ ID NO: 512115 - RNA, 32 nt, Human
ugaauuggggaggcggagguugcagugagcug

SEQ ID NO: 512116 - RNA, 32 nt, Human
ugaauugggguuccaccaugucacccucaugg

SEQ ID NO: 512117 - RNA, 32 nt, Human
ugaauuggguccuugucauuucuguccaauug

SEQ ID NO: 512118 - RNA, 29 nt, Human
ugaauuggguugugugugcacuggaguca

SEQ ID NO: 512119 - RNA, 32 nt, Human
ugaauuggucacugcaucuuguaucgauuaug

SEQ ID NO: 512120 - RNA, 32 nt, Human
ugaauuggucccagcugcucccagaagaacgg

SEQ ID NO: 512121 - RNA, 32 nt, Human
ugaauuguaauccccaaugcuggagguagggc

SEQ ID NO: 512122 - RNA, 23 nt, Human
ugaauugugauucacugauuuua

SEQ ID NO: 512123 - RNA, 32 nt, Human
ugaauuguguguaugaccucagaacugaaauu

SEQ ID NO: 512124 - RNA, 32 nt, Human
ugaauuguuccacucaauguuccucuuacuua

SEQ ID NO: 512125 - RNA, 32 nt, Human
ugaauuguucucugugcuaggccuuaucuaaa

SEQ ID NO: 512126 - RNA, 32 nt, Human
ugaauuguugcuuggauggaaaaagggcugcc

SEQ ID NO: 512127 - RNA, 32 nt, Human
ugaauuguuggagaauguaaaccgccuccacg

SEQ ID NO: 512128 - RNA, 21 nt, Human
ugaauuguuuuguuuuguuuu

SEQ ID NO: 512129 - RNA, 31 nt, Human
ugaauuuaauucaaggaggaggagaauguuu

SEQ ID NO: 512130 - RNA, 32 nt, Human
ugaauuuacuaucaguuuugccacaaucagug

SEQ ID NO: 512131 - RNA, 32 nt, Human
ugaauuuagagaaacaacaugguuccaagaag

SEQ ID NO: 512132 - RNA, 32 nt, Human
ugaauuuaggcugggugcaguggcucacgccu

SEQ ID NO: 512133 - RNA, 32 nt, Human
ugaauuuauaaaugucauuugcaaccaaauga

SEQ ID NO: 512134 - RNA, 32 nt, Human
ugaauuucacaguuuuugcaccaaaauaaacu

SEQ ID NO: 512135 - RNA, 32 nt, Human
ugaauuucaccucuuacauguaaaggguauaa

SEQ ID NO: 512136 - RNA, 32 nt, Human
ugaauuucagcaggaauaaguuuauuuuaccu

SEQ ID NO: 512137 - RNA, 24 nt, Human
ugaauuucaggauggggacugucu

SEQ ID NO: 512138 - RNA, 32 nt, Human
ugaauuucaggcugggagggagcaauauaacu

SEQ ID NO: 512139 - RNA, 32 nt, Human
ugaauuucaggggcauacaacauucaaaucac

SEQ ID NO: 512140 - RNA, 20 nt, Human
ugaauuucagucugcugcuu

SEQ ID NO: 512141 - RNA, 24 nt, Human
ugaauuuccaguguggucuuguuu

SEQ ID NO: 512142 - RNA, 32 nt, Human
ugaauuuccaugaguuacacuggaugaaaaug

SEQ ID NO: 512143 - RNA, 22 nt, Human
ugaauuucguuuucaaauaucu

SEQ ID NO: 512144 - RNA, 32 nt, Human
ugaauuucuaacaaugcccagugacugucgca

SEQ ID NO: 512145 - RNA, 32 nt, Human
ugaauuucuucccucugcuuccuggacacaga

SEQ ID NO: 512146 - RNA, 32 nt, Human
ugaauuugaacagcucaccacugugccuacau

SEQ ID NO: 512147 - RNA, 32 nt, Human
ugaauuugaacucuggaguuacuguucuacag

SEQ ID NO: 512148 - RNA, 32 nt, Human
ugaauuugagauacaaacauguuccugggauc

SEQ ID NO: 512149 - RNA, 32 nt, Human
ugaauuugauccucugugauugugaugaguuc

SEQ ID NO: 512150 - RNA, 32 nt, Human
ugaauuugcaguugcuccagacuggacugaua

SEQ ID NO: 512151 - RNA, 32 nt, Human
ugaauuugcccagguaggcgugagaguguggg

SEQ ID NO: 512152 - RNA, 32 nt, Human
ugaauuugcuccccuuggaguggggugaggcu

SEQ ID NO: 512153 - RNA, 32 nt, Human
ugaauuuggaaacccauguuggcugucccaaa

SEQ ID NO: 512154 - RNA, 32 nt, Human
ugaauuuggaaagagaacuauccagaaagaua

SEQ ID NO: 512155 - RNA, 32 nt, Human
ugaauuuggaaauuggaggggacgcuggugga

SEQ ID NO: 512156 - RNA, 32 nt, Human
ugaauuuggcaaguguguugcccagugugugc

SEQ ID NO: 512157 - RNA, 32 nt, Human
ugaauuuggguaugaacagauugccugcuuuc

SEQ ID NO: 512158 - RNA, 32 nt, Human
ugaauuuguacaagccacaggaagcuagauug

SEQ ID NO: 512159 - RNA, 32 nt, Human
ugaauuuuaaccccuucuuucacugcauggcc

SEQ ID NO: 512160 - RNA, 21 nt, Human
ugaauuuuacaugguacucuu

SEQ ID NO: 512161 - RNA, 32 nt, Human
ugaauuuucacucauuaccuagaguaaacuua

SEQ ID NO: 512162 - RNA, 32 nt, Human
ugaauuuucuucuuccucuggccuccuucugu

SEQ ID NO: 512163 - RNA, 32 nt, Human
ugaauuuucuucuuggacaccuaauacccaca

SEQ ID NO: 512164 - RNA, 32 nt, Human
ugaauuuugaauucuuaaaauucucacugaca

SEQ ID NO: 512165 - RNA, 32 nt, Human
ugaauuuugagaauuuuauaugaauuuugaga

SEQ ID NO: 512166 - RNA, 32 nt, Human
ugaauuuugaugaguaugccuuaaacaaagaa

SEQ ID NO: 512167 - RNA, 32 nt, Human
ugaauuuuguuuaggcugcaauguuuagcuuu

SEQ ID NO: 512168 - RNA, 32 nt, Human
ugaauuuuuauucuagcaacagccgauaauuu

SEQ ID NO: 512169 - RNA, 32 nt, Human
ugaauuuuuccuuuuuguauuuucuuagcaga

SEQ ID NO: 512170 - RNA, 32 nt, Human
ugaauuuuucuuccucuccacuucuuagaggc

SEQ ID NO: 512171 - RNA, 32 nt, Human
ugacaaaaacucaaugaacuagacauaugaga

SEQ ID NO: 512172 - RNA, 32 nt, Human
ugacaaaaauaacacuguuggcacuuauaggu

SEQ ID NO: 512173 - RNA, 32 nt, Human
ugacaaaacagcacuccacugcuggugaaucc

SEQ ID NO: 512174 - RNA, 32 nt, Human
ugacaaaaggagaccugaauuuuuggaagagc

SEQ ID NO: 512175 - RNA, 32 nt, Human
ugacaaaaggucccaguuuggccaggggugag

SEQ ID NO: 512176 - RNA, 32 nt, Human
ugacaaacaccuggcaugacagaauggaauuc

SEQ ID NO: 512177 - RNA, 32 nt, Human
ugacaaacauggagaaaccccaucucuacuaa

SEQ ID NO: 512178 - RNA, 32 nt, Human
ugacaaacucguugaaaugucauuucauuuug

SEQ ID NO: 512179 - RNA, 32 nt, Human
ugacaaacugugaaccugcagauuucaccuau

SEQ ID NO: 512180 - RNA, 32 nt, Human
ugacaaagaagcccagggaggggaagagggug

SEQ ID NO: 512181 - RNA, 32 nt, Human
ugacaaagauucauauaauccaagagagaagu

SEQ ID NO: 512182 - RNA, 32 nt, Human
ugacaaagcagaguaaaaauaugcuguuuaca

SEQ ID NO: 512183 - RNA, 32 nt, Human
ugacaaagcccuaggguuccagccugguccug

SEQ ID NO: 512184 - RNA, 32 nt, Human
ugacaaaggcacugaggcccagggaggugacc

SEQ ID NO: 512185 - RNA, 32 nt, Human
ugacaaagucuaaaugagcacauguaucccag

SEQ ID NO: 512186 - RNA, 32 nt, Human
ugacaaauccugcaguguuuccaggcauccuu

SEQ ID NO: 512187 - RNA, 32 nt, Human
ugacaaaugacaguccaucagacagaucuggc

SEQ ID NO: 512188 - RNA, 32 nt, Human
ugacaaauguauuuaagccuuuggauuuaaag

SEQ ID NO: 512189 - RNA, 20 nt, Human
ugacaaauguuucuaaggua

SEQ ID NO: 512190 - RNA, 24 nt, Human
ugacaacaaauuagguuuuguaca

SEQ ID NO: 512191 - RNA, 21 nt, Human
ugacaacaaauuuauugcaca

SEQ ID NO: 512192 - RNA, 32 nt, Human
ugacaacagcagaggguacaccagggacaaca

SEQ ID NO: 512193 - RNA, 32 nt, Human
ugacaacaggcaggaugguggggacagcaggg

SEQ ID NO: 512194 - RNA, 32 nt, Human
ugacaacauauguggcacucaaaaugcuggua

SEQ ID NO: 512195 - RNA, 22 nt, Human
ugacaacauccuccagauucca

SEQ ID NO: 512196 - RNA, 32 nt, Human
ugacaacaucugaguggacagcuaauugaccu

SEQ ID NO: 512197 - RNA, 32 nt, Human
ugacaacauggugaaaccccaucucugguaga

SEQ ID NO: 512198 - RNA, 32 nt, Human
ugacaacauugagcccacacugcaguuuugaa

SEQ ID NO: 512199 - RNA, 32 nt, Human
ugacaaccaaaccaaucucgguggaaacuccu

SEQ ID NO: 512200 - RNA, 32 nt, Human
ugacaaccagaagacaugagcuaaggguaagg

SEQ ID NO: 512201 - RNA, 17 nt, Human
ugacaacccuggccuca

SEQ ID NO: 512202 - RNA, 32 nt, Human
ugacaaccucucugcugauccuguugugucac

SEQ ID NO: 512203 - RNA, 32 nt, Human
ugacaacgcagcugccaugaugccuugggaug

SEQ ID NO: 512204 - RNA, 32 nt, Human
ugacaacgcugaggccacgagcuccuggguag

SEQ ID NO: 512205 - RNA, 32 nt, Human
ugacaacuaaauagcugagaagaaggacaucu

SEQ ID NO: 512206 - RNA, 23 nt, Human
ugacaacuauucacccuaccuca

SEQ ID NO: 512207 - RNA, 32 nt, Human
ugacaacucuagaccugccugcuuuaucuaau

SEQ ID NO: 512208 - RNA, 32 nt, Human
ugacaacuggaaggccaaggcuauggguuacc

SEQ ID NO: 512209 - RNA, 32 nt, Human
ugacaacuguccuaccuucuugcugaauugau

SEQ ID NO: 512210 - RNA, 32 nt, Human
ugacaagaaagccuggagcgaggaaggaaagc

SEQ ID NO: 512211 - RNA, 16 nt, Human
ugacaagacuuguguu

SEQ ID NO: 512212 - RNA, 32 nt, Human
ugacaagaggagagauaugcacugugauauua

SEQ ID NO: 512213 - RNA, 32 nt, Human
ugacaagauucacuuucuugagagccaucagc

SEQ ID NO: 512214 - RNA, 32 nt, Human
ugacaagauuuggaagaaagaaaauaacagac

SEQ ID NO: 512215 - RNA, 32 nt, Human
ugacaagcagagguugaaagacuugaagccaa

SEQ ID NO: 512216 - RNA, 32 nt, Human
ugacaagcauguccucacccuccccaccacau

SEQ ID NO: 512217 - RNA, 23 nt, Human
ugacaagccauuugaaauucuga

SEQ ID NO: 512218 - RNA, 18 nt, Human
ugacaagcgucccggaga

SEQ ID NO: 512219 - RNA, 32 nt, Human
ugacaagcuaaaggaagcagagucuuuaauga

SEQ ID NO: 512220 - RNA, 32 nt, Human
ugacaagcuccuggucuugagaugucuucucg

SEQ ID NO: 512221 - RNA, 32 nt, Human
ugacaagcucuuuguuucaguuggaguguuug

SEQ ID NO: 512222 - RNA, 24 nt, Human
ugacaagcuuauccucccauggua

SEQ ID NO: 512223 - RNA, 32 nt, Human
ugacaaggaagagcggaagggaagggagaagu

SEQ ID NO: 512224 - RNA, 32 nt, Human
ugacaaggaggcagaggccugagcgaggcgga

SEQ ID NO: 512225 - RNA, 32 nt, Human
ugacaaggaggccgauuugagguggacucucc

SEQ ID NO: 512226 - RNA, 32 nt, Human
ugacaaggaggcggggccugcagcaggcuugg

SEQ ID NO: 512227 - RNA, 32 nt, Human
ugacaaggccuugggcuaccagcugcuccgcc

SEQ ID NO: 512228 - RNA, 32 nt, Human
ugacaaggcugaaaggagggggacuggaggcu

SEQ ID NO: 512229 - RNA, 32 nt, Human
ugacaaggggaagggucuaaaggguggagggc

SEQ ID NO: 512230 - RNA, 20 nt, Human
ugacaaggucccccugggga

SEQ ID NO: 512231 - RNA, 32 nt, Human
ugacaaguagcucauugauucuugccucauuc

SEQ ID NO: 512232 - RNA, 32 nt, Human
ugacaaguauuaacaucagugccagacuugaa

SEQ ID NO: 512233 - RNA, 32 nt, Human
ugacaaguguucacaggagguggggacgccuc

SEQ ID NO: 512234 - RNA, 32 nt, Human
ugacaaguuugacaccugucuacccagagcca

SEQ ID NO: 512235 - RNA, 32 nt, Human
ugacaaguuuuuaaaacuucagugcuuccuaa

SEQ ID NO: 512236 - RNA, 22 nt, Human
ugacaauaaauugugcuguaca

SEQ ID NO: 512237 - RNA, 23 nt, Human
ugacaauaauuucagguuuugua

SEQ ID NO: 512238 - RNA, 24 nt, Human
ugacaauagccccaaguuuacuca

SEQ ID NO: 512239 - RNA, 32 nt, Human
ugacaauaggagagagaaaggggcauugacug

SEQ ID NO: 512240 - RNA, 23 nt, Human
ugacaauaugcccuuucugggga

SEQ ID NO: 512241 - RNA, 23 nt, Human
ugacaauauuuauaaauguaugg

SEQ ID NO: 512242 - RNA, 32 nt, Human
ugacaaucaaauucaugcuauggugugaaaga

SEQ ID NO: 512243 - RNA, 32 nt, Human
ugacaaucaggauaucucaggagguccaaggu

SEQ ID NO: 512244 - RNA, 32 nt, Human
ugacaaucuccaggagaaccuacagauuggaa

SEQ ID NO: 512245 - RNA, 32 nt, Human
ugacaaucugcaaggcugaacaacagccccug

SEQ ID NO: 512246 - RNA, 21 nt, Human
ugacaaugaauugguuauaca

SEQ ID NO: 512247 - RNA, 31 nt, Human
ugacaaugacuucugcccuuuugccaaggga

SEQ ID NO: 512248 - RNA, 32 nt, Human
ugacaaugcaggaaagagaagaagacucaaga

SEQ ID NO: 512249 - RNA, 23 nt, Human
ugacaaugcauggucuuugugca

SEQ ID NO: 512250 - RNA, 32 nt, Human
ugacaauggcagcuagacuggagugaggcuuc

SEQ ID NO: 512251 - RNA, 32 nt, Human
ugacaauggugccuccuucacaugcuuggugu

SEQ ID NO: 512252 - RNA, 31 nt, Human
ugacaaugugaaaccaucacagcugggaaga

SEQ ID NO: 512253 - RNA, 32 nt, Human
ugacaauguguauauguaaauaauauguguuu

SEQ ID NO: 512254 - RNA, 32 nt, Human
ugacaauguugcugggaccucugccuccccac

SEQ ID NO: 512255 - RNA, 32 nt, Human
ugacaauucugaagacauuucuaguuuuauuu

SEQ ID NO: 512256 - RNA, 32 nt, Human
ugacaauugcagcaugacuuucccagggcccu

SEQ ID NO: 512257 - RNA, 32 nt, Human
ugacaauugucagguuggaguguaagugcuuc

SEQ ID NO: 512258 - RNA, 32 nt, Human
ugacacaaaggaugagauuacaccuacaguga

SEQ ID NO: 512259 - RNA, 32 nt, Human
ugacacaaaguagaacugggaccacacucagg

SEQ ID NO: 512260 - RNA, 32 nt, Human
ugacacaacuagucaacuaacaagguuccuga

SEQ ID NO: 512261 - RNA, 32 nt, Human
ugacacaacugcacuccagcuugggcaacagg

SEQ ID NO: 512262 - RNA, 32 nt, Human
ugacacaagcaaugccugugaagugccugcag

SEQ ID NO: 512263 - RNA, 24 nt, Human
ugacacaaucauagcucacugcag

SEQ ID NO: 512264 - RNA, 32 nt, Human
ugacacaaucauagcucacugcagccuuuaac

SEQ ID NO: 512265 - RNA, 24 nt, Human
ugacacaaucauggcucacugcag

SEQ ID NO: 512266 - RNA, 23 nt, Human
ugacacaaucucagcucacugca

SEQ ID NO: 512267 - RNA, 23 nt, Human
ugacacaaucucggcucacugca

SEQ ID NO: 512268 - RNA, 32 nt, Human
ugacacacacaucacacacacaucacaaugac

SEQ ID NO: 512269 - RNA, 19 nt, Human
ugacacacaccaauuucca

SEQ ID NO: 512270 - RNA, 21 nt, Human
ugacacacaccuguaaucuca

SEQ ID NO: 512271 - RNA, 32 nt, Human
ugacacaccacugugcugagugcuugaggacg

SEQ ID NO: 512272 - RNA, 32 nt, Human
ugacacaccuggggugacaggcgaugagacaa

SEQ ID NO: 512273 - RNA, 21 nt, Human
ugacacacgcccguaauccca

SEQ ID NO: 512274 - RNA, 21 nt, Human
ugacacacgccuauaauccca

SEQ ID NO: 512275 - RNA, 21 nt, Human
ugacacacgccuguaauccca

SEQ ID NO: 512276 - RNA, 21 nt, Human
ugacacacuccuauaauccua

SEQ ID NO: 512277 - RNA, 32 nt, Human
ugacacacugauuuuaaucuucgaaucaugac

SEQ ID NO: 512278 - RNA, 32 nt, Human
ugacacacugggugaagaauggaaggguuaug

SEQ ID NO: 512279 - RNA, 32 nt, Human
ugacacagaaaugcacaguguuguuaugaagg

SEQ ID NO: 512280 - RNA, 32 nt, Human
ugacacagaccacccacuccacugugaaacag

SEQ ID NO: 512281 - RNA, 32 nt, Human
ugacacagacccacuucaguguguacagcaaa

SEQ ID NO: 512282 - RNA, 21 nt, Human
ugacacagagucucgcucugu

SEQ ID NO: 512283 - RNA, 32 nt, Human
ugacacagagucucgcucugucgcccaggcug

SEQ ID NO: 512284 - RNA, 32 nt, Human
ugacacagagucuugcucuguugcccaggcug

SEQ ID NO: 512285 - RNA, 32 nt, Human
ugacacagaguuaaaaccugucacucaaaggc

SEQ ID NO: 512286 - RNA, 32 nt, Human
ugacacagcaagaagaaggaugcuaagucaua

SEQ ID NO: 512287 - RNA, 21 nt, Human
ugacacagccugggcaacaca

SEQ ID NO: 512288 - RNA, 32 nt, Human
ugacacagcugagaccaagcugagggacuggg

SEQ ID NO: 512289 - RNA, 32 nt, Human
ugacacagcugcuagagaaagagaaguagaag

SEQ ID NO: 512290 - RNA, 32 nt, Human
ugacacaggggcccuggccaggguuccacccu

SEQ ID NO: 512291 - RNA, 32 nt, Human
ugacacagggucagguccagcaggaaagaaug

SEQ ID NO: 512292 - RNA, 32 nt, Human
ugacacaguagcacugauucugucuuuuccuc

SEQ ID NO: 512293 - RNA, 24 nt, Human
ugacacagucucagcucacugcag

SEQ ID NO: 512294 - RNA, 23 nt, Human
ugacacagucuuggcucacugca

SEQ ID NO: 512295 - RNA, 32 nt, Human
ugacacagugaugaugaucucuucuguccucc

SEQ ID NO: 512296 - RNA, 24 nt, Human
ugacacaguugcagcucacugcag

SEQ ID NO: 512297 - RNA, 32 nt, Human
ugacacaucacaaucccuuucucaguuccuag

SEQ ID NO: 512298 - RNA, 32 nt, Human
ugacacaucugugucaucacgcacugaagaca

SEQ ID NO: 512299 - RNA, 31 nt, Human
ugacacaugcaacccccuggcccgagagauc

SEQ ID NO: 512300 - RNA, 32 nt, Human
ugacacaugccuguaaucccagcaacucagga

SEQ ID NO: 512301 - RNA, 21 nt, Human
ugacacaugccuguaguccca

SEQ ID NO: 512302 - RNA, 32 nt, Human
ugacacaugccuguagucccagcuacucagga

SEQ ID NO: 512303 - RNA, 32 nt, Human
ugacacaugccuguaguccuagcuacuuggga

SEQ ID NO: 512304 - RNA, 20 nt, Human
ugacacaugcugaacaucac

SEQ ID NO: 512305 - RNA, 32 nt, Human
ugacacauggggcagaggagcuccaggcacag

SEQ ID NO: 512306 - RNA, 32 nt, Human
ugacaccaccacugugucccagugucuggccc

SEQ ID NO: 512307 - RNA, 32 nt, Human
ugacaccacgccacugcacuccagccugggug

SEQ ID NO: 512308 - RNA, 32 nt, Human
ugacaccacugcacuccaaccuagguaacaga

SEQ ID NO: 512309 - RNA, 32 nt, Human
ugacaccagcaggcagaugaccagagagccug

SEQ ID NO: 512310 - RNA, 32 nt, Human
ugacaccaugaagccugugcugccucuccagu

SEQ ID NO: 512311 - RNA, 20 nt, Human
ugacaccauuuguuguguua

SEQ ID NO: 512312 - RNA, 32 nt, Human
ugacacccaaaauacagaaacuucuuaaucga

SEQ ID NO: 512313 - RNA, 32 nt, Human
ugacacccaagagaagagauggaagggcaugg

SEQ ID NO: 512314 - RNA, 19 nt, Human
ugacacccacuccugggga

SEQ ID NO: 512315 - RNA, 24 nt, Human
ugacacccaggcuggagugcagug

SEQ ID NO: 512316 - RNA, 24 nt, Human
ugacacccaggcuggcgugcagug

SEQ ID NO: 512317 - RNA, 32 nt, Human
ugacacccagggccauggaagaguugguccag

SEQ ID NO: 512318 - RNA, 32 nt, Human
ugacacccauauuaggaaaaggccugccacca

SEQ ID NO: 512319 - RNA, 32 nt, Human
ugacacccauuucagacuucugaccuccacaa

SEQ ID NO: 512320 - RNA, 22 nt, Human
ugacaccccucccccuaauucu

SEQ ID NO: 512321 - RNA, 22 nt, Human
ugacaccccucccuuggacucu

SEQ ID NO: 512322 - RNA, 32 nt, Human
ugacaccccugccccugccccugcccagaacc

SEQ ID NO: 512323 - RNA, 32 nt, Human
ugacacccgcuaccaguauuguacccaugaug

SEQ ID NO: 512324 - RNA, 32 nt, Human
ugacacccucuccuggagagaggcucacagcg

SEQ ID NO: 512325 - RNA, 32 nt, Human
ugacacccugauccagacucugucuuuauccc

SEQ ID NO: 512326 - RNA, 31 nt, Human
ugacacccugugacugagccuguguccuguc

SEQ ID NO: 512327 - RNA, 32 nt, Human
ugacacccuuaaauuuuaagucuuccagucuu

SEQ ID NO: 512328 - RNA, 32 nt, Human
ugacacccuugggcucccuccugccuccucuc

SEQ ID NO: 512329 - RNA, 32 nt, Human
ugacaccgcaggcagagguugcucggggccuu

SEQ ID NO: 512330 - RNA, 32 nt, Human
ugacaccgcuucuccucacaccccaguccgca

SEQ ID NO: 512331 - RNA, 32 nt, Human
ugacaccgucgaccaggaaagccacacggaga

SEQ ID NO: 512332 - RNA, 32 nt, Human
ugacaccguucccuccaaaagcagaccucgga

SEQ ID NO: 512333 - RNA, 32 nt, Human
ugacaccucugcacucccuugggcagagaugg

SEQ ID NO: 512334 - RNA, 32 nt, Human
ugacaccugacugcaaaaauguuuauaagcaa

SEQ ID NO: 512335 - RNA, 32 nt, Human
ugacaccugcaaucccaacauuuugggaggcc

SEQ ID NO: 512336 - RNA, 32 nt, Human
ugacaccugcagcccucacuccugucauccca

SEQ ID NO: 512337 - RNA, 32 nt, Human
ugacaccuggccugcccuuucucagcugccuc

SEQ ID NO: 512338 - RNA, 32 nt, Human
ugacaccuguaaucccagcacauugggaggcc

SEQ ID NO: 512339 - RNA, 32 nt, Human
ugacaccuguaaucccagcacuuugggaggcc

SEQ ID NO: 512340 - RNA, 32 nt, Human
ugacaccuguaaucccagcauuuugggagacc

SEQ ID NO: 512341 - RNA, 32 nt, Human
ugacaccuguguccugagugagccgcaggagu

SEQ ID NO: 512342 - RNA, 32 nt, Human
ugacaccuucuuuggggcucugcaguuccugc

SEQ ID NO: 512343 - RNA, 31 nt, Human
ugacaccuugugcucaggccuguguugguuc

SEQ ID NO: 512344 - RNA, 24 nt, Human
ugacacgaccucggcucacugcag

SEQ ID NO: 512345 - RNA, 23 nt, Human
ugacacgaucucagcucacugca

SEQ ID NO: 512346 - RNA, 32 nt, Human
ugagagggcagcggccgcguggagaggaggug

SEQ ID NO: 512347 - RNA, 32 nt, Human
ugagagggcgguggagguggugaggaggaucu

SEQ ID NO: 512348 - RNA, 32 nt, Human
ugagaggggaaaagcugaaaugugagugggaa

SEQ ID NO: 512349 - RNA, 32 nt, Human
ugagaggggagagagacuggagcuggcaagga

SEQ ID NO: 512350 - RNA, 32 nt, Human
ugagaggggagggagacucugcggccacacac

SEQ ID NO: 512351 - RNA, 32 nt, Human
ugagaggggagggagaguuugcggccacacac

SEQ ID NO: 512352 - RNA, 32 nt, Human
ugagaggggagggauggguaggugcuuuccaa

SEQ ID NO: 512353 - RNA, 32 nt, Human
ugagaggggagguggaguuggaaaugugggug

SEQ ID NO: 512354 - RNA, 32 nt, Human
ugagaggggaguggaaagaggaaggggugaag

SEQ ID NO: 512355 - RNA, 32 nt, Human
ugagaggggcggcccuggaggagacggaggcc

SEQ ID NO: 512356 - RNA, 32 nt, Human
ugagaggggcugagggaauuguccucugugga

SEQ ID NO: 512357 - RNA, 32 nt, Human
ugagaggggcuguuagcauugcgcagcaucuu

SEQ ID NO: 512358 - RNA, 26 nt, Human
ugagaggggugauccauucugccuca

SEQ ID NO: 512359 - RNA, 32 nt, Human
ugagagggguggcggaggguagagagagaaag

SEQ ID NO: 512360 - RNA, 32 nt, Human
ugagaggguccugcaggcagagcuggaaucaa

SEQ ID NO: 512361 - RNA, 32 nt, Human
ugagagguaggguugaggaacacaggguugaa

SEQ ID NO: 512362 - RNA, 32 nt, Human
ugagagguagucuugcucugucacccaggcug

SEQ ID NO: 512363 - RNA, 32 nt, Human
ugagaggucccagaacucugcaaagugagucc

SEQ ID NO: 512364 - RNA, 32 nt, Human
ugagaggucccagaacucugcgaagugagucc

SEQ ID NO: 512365 - RNA, 32 nt, Human
ugagaggugagguugcagugagccgagaucga

SEQ ID NO: 512366 - RNA, 32 nt, Human
ugagaggugcuugggaaacugcauuuauccgu

SEQ ID NO: 512367 - RNA, 32 nt, Human
ugagagguggagguucucucucuuuuaggcuu

SEQ ID NO: 512368 - RNA, 32 nt, Human
ugagagguuuucuuuuucuuaucaguguccuu

SEQ ID NO: 512369 - RNA, 32 nt, Human
ugagaguaccucauagggcuccugccugaucu

SEQ ID NO: 512370 - RNA, 32 nt, Human
ugagaguagccaugggcucuggaggagacagc

SEQ ID NO: 512371 - RNA, 32 nt, Human
ugagaguagcucagagggacuugcuguggggg

SEQ ID NO: 512372 - RNA, 32 nt, Human
ugagaguagcugguaaagaggggcgaacuaaa

SEQ ID NO: 512373 - RNA, 32 nt, Human
ugagaguaguucaggacagcugugauugaaau

SEQ ID NO: 512374 - RNA, 32 nt, Human
ugagaguccacucaugaagcaagaagucaagc

SEQ ID NO: 512375 - RNA, 32 nt, Human
ugagaguccccaggguccucccccacugggca

SEQ ID NO: 512376 - RNA, 32 nt, Human
ugagagucccugcggccucccaccucccugcc

SEQ ID NO: 512377 - RNA, 32 nt, Human
ugagagucgaaugcuacaguaucugcagucgc

SEQ ID NO: 512378 - RNA, 21 nt, Human
ugagagucuagcacucauuuu

SEQ ID NO: 512379 - RNA, 32 nt, Human
ugagagucugggggagagggcagagaauggau

SEQ ID NO: 512380 - RNA, 32 nt, Human
ugagagugcacuccaguuuucacagcagcaau

SEQ ID NO: 512381 - RNA, 32 nt, Human
ugagagugcaugccauggagacugguuuagac

SEQ ID NO: 512382 - RNA, 32 nt, Human
ugagagugccccacugcacuccagccugggug

SEQ ID NO: 512383 - RNA, 32 nt, Human
ugagagugcccuagacaguaacuucuaagguc

SEQ ID NO: 512384 - RNA, 32 nt, Human
ugagagugcuacccuucucuuguaaccuugca

SEQ ID NO: 512385 - RNA, 32 nt, Human
ugagaguggacugucuucucucccuucacaaa

SEQ ID NO: 512386 - RNA, 32 nt, Human
ugagaguggagcugaguggggucugggcucug

SEQ ID NO: 512387 - RNA, 32 nt, Human
ugagaguggaggaggaagaggaggaggaagag

SEQ ID NO: 512388 - RNA, 32 nt, Human
ugagaguggggagggggcauuggccuuugcag

SEQ ID NO: 512389 - RNA, 32 nt, Human
ugagagugugggagguggaugcgggagggugc

SEQ ID NO: 512390 - RNA, 32 nt, Human
ugagaguguguguccuacaaagggccucacua

SEQ ID NO: 512391 - RNA, 32 nt, Human
ugagaguucagaguuccaggaauauuguuauu

SEQ ID NO: 512392 - RNA, 32 nt, Human
ugagaguucuuucacaccuuugguggucauag

SEQ ID NO: 512393 - RNA, 32 nt, Human
ugagaguugcugaauaucaucacaaagcaaua

SEQ ID NO: 512394 - RNA, 32 nt, Human
ugagauaaaacagaucaaaugguuuagguuaa

SEQ ID NO: 512395 - RNA, 32 nt, Human
ugagauaaaagcuuccaugggagccuuccuuc

SEQ ID NO: 512396 - RNA, 32 nt, Human
ugagauaagaaagaguuccuggaaccaggaau

SEQ ID NO: 512397 - RNA, 32 nt, Human
ugagauaagagccuggcaaccagcaagagcug

SEQ ID NO: 512398 - RNA, 32 nt, Human
ugagauaaggucuugcuguguggcccaggcug

SEQ ID NO: 512399 - RNA, 32 nt, Human
ugagauaaucucugucacccccaggccagagu

SEQ ID NO: 512400 - RNA, 32 nt, Human
ugagauacaaguccuuugucaguuuugugauu

SEQ ID NO: 512401 - RNA, 32 nt, Human
ugagauacccagaaugucagacuuguaaggga

SEQ ID NO: 512402 - RNA, 32 nt, Human
ugagauacccaggaagggaggcugucuggcca

SEQ ID NO: 512403 - RNA, 32 nt, Human
ugagauacuaccuacacggagcaggauggcug

SEQ ID NO: 512404 - RNA, 21 nt, Human
ugagauagaaucucacuaugu

SEQ ID NO: 512405 - RNA, 21 nt, Human
ugagauagagccuugcucugu

SEQ ID NO: 512406 - RNA, 32 nt, Human
ugagauagagccuugcucugucaccaggccgg

SEQ ID NO: 512407 - RNA, 32 nt, Human
ugagauagagucuugcuaguguugcccaggcu

SEQ ID NO: 512408 - RNA, 21 nt, Human
ugagauagagucuugcucugu

SEQ ID NO: 512409 - RNA, 32 nt, Human
ugagauagagucuugcucugucgcucaggcug

SEQ ID NO: 512410 - RNA, 32 nt, Human
ugagauagcaccacugcaugcaagccugggca

SEQ ID NO: 512411 - RNA, 32 nt, Human
ugagauagcgccauugcacuccagccugagcg

SEQ ID NO: 512412 - RNA, 32 nt, Human
ugagauagcgccauugcacuccagccugggca

SEQ ID NO: 512413 - RNA, 32 nt, Human
ugagauagcgucuugcuguguugcccaggcug

SEQ ID NO: 512414 - RNA, 32 nt, Human
ugagauaggaggucggcacaagauacagauca

SEQ ID NO: 512415 - RNA, 32 nt, Human
ugagauaggaggucggcacaagauacagguca

SEQ ID NO: 512416 - RNA, 32 nt, Human
ugagauaggaguucucuaggaaccuggaauga

SEQ ID NO: 512417 - RNA, 32 nt, Human
ugagauaggggcccugggccuccgcccuggcc

SEQ ID NO: 512418 - RNA, 32 nt, Human
ugagauaggguauugcucugucgcccaggcug

SEQ ID NO: 512419 - RNA, 21 nt, Human
ugagauagggucucacuuugu

SEQ ID NO: 512420 - RNA, 21 nt, Human
ugagauagggucuuacucugu

SEQ ID NO: 512421 - RNA, 32 nt, Human
ugagauagggucuuacucugucacccaggcug

SEQ ID NO: 512422 - RNA, 19 nt, Human
ugagauagggucuugcucu

SEQ ID NO: 512423 - RNA, 32 nt, Human
ugagauagggucuugcucuaucaccuaggcug

SEQ ID NO: 512424 - RNA, 32 nt, Human
ugagauagucucaauguggccaaccaaaagga

SEQ ID NO: 512425 - RNA, 21 nt, Human
ugagauagugucuugcucugu

SEQ ID NO: 512426 - RNA, 32 nt, Human
ugagauagugucuugcucugucacccaggcug

SEQ ID NO: 512427 - RNA, 32 nt, Human
ugagauauccucagguuuucucagccagagag

SEQ ID NO: 512428 - RNA, 32 nt, Human
ugagauaugagaaacugaguuggcucugacaa

SEQ ID NO: 512429 - RNA, 32 nt, Human
ugagauauggcuauuuggaagacacugcauuu

SEQ ID NO: 512430 - RNA, 32 nt, Human
ugagauauuuuaaaauuccgcccuccaggcag

SEQ ID NO: 512431 - RNA, 32 nt, Human
ugagaucaaagcacucuuccacuuuacgugau

SEQ ID NO: 512432 - RNA, 32 nt, Human
ugagaucaagaguucaagaccagccuggccaa

SEQ ID NO: 512433 - RNA, 32 nt, Human
ugagaucacacagcauugagucaucaggaaaa

SEQ ID NO: 512434 - RNA, 32 nt, Human
ugagaucacaccacuacacuccagccugggcg

SEQ ID NO: 512435 - RNA, 32 nt, Human
ugagaucacaccacugcaauccagccugggcg

SEQ ID NO: 512436 - RNA, 32 nt, Human
ugagaucacaccacugcacuccagccuggcga

SEQ ID NO: 512437 - RNA, 32 nt, Human
ugagaucacaccacugcacuccagccugggag

SEQ ID NO: 512438 - RNA, 32 nt, Human
ugagaucacaccacugcacuccagccugggca

SEQ ID NO: 512439 - RNA, 32 nt, Human
ugagaucacaccacugcacuccagccugggcg

SEQ ID NO: 512440 - RNA, 32 nt, Human
ugagaucacaccacugcacuccagccuggggu

SEQ ID NO: 512441 - RNA, 32 nt, Human
ugagaucacaccacugcacuccagccugggug

SEQ ID NO: 512442 - RNA, 32 nt, Human
ugagaucacaccacugcacuccagccugguca

SEQ ID NO: 512443 - RNA, 32 nt, Human
ugagaucacaccacugcacuccagccugguga

SEQ ID NO: 512444 - RNA, 32 nt, Human
ugagaucacaccacugcacuccagccugugcg

SEQ ID NO: 512445 - RNA, 32 nt, Human
ugagaucacaccacugcacuccagccuuggug

SEQ ID NO: 512446 - RNA, 32 nt, Human
ugagaucacaccacugcacuccggccugggcg

SEQ ID NO: 512447 - RNA, 32 nt, Human
ugagaucacaccacugcacuucauccuaggca

SEQ ID NO: 512448 - RNA, 32 nt, Human
ugagaucacaccacuguacuccagccugagug

SEQ ID NO: 512449 - RNA, 32 nt, Human
ugagaucacaccacuguacuccagccuggaug

SEQ ID NO: 512450 - RNA, 32 nt, Human
ugagaucacaccacuguacuccagccugggug

SEQ ID NO: 512451 - RNA, 32 nt, Human
ugagaucacaccacuguauuccagccugggug

SEQ ID NO: 512452 - RNA, 32 nt, Human
ugagaucacaccaucgcacuccagccuaggca

SEQ ID NO: 512453 - RNA, 32 nt, Human
ugagaucacaccauugcacuccagccugggca

SEQ ID NO: 512454 - RNA, 32 nt, Human
ugagaucacaccauugcccuccagccugggug

SEQ ID NO: 512455 - RNA, 32 nt, Human
ugagaucacaccauugcgcuucagccugggca

SEQ ID NO: 512456 - RNA, 32 nt, Human
ugagaucacacuacugcacuccugcaugggcg

SEQ ID NO: 512457 - RNA, 32 nt, Human
ugagaucacaucacugcacuccauccugggug

SEQ ID NO: 512458 - RNA, 32 nt, Human
ugagaucaccccauugcacuccagccuggaca

SEQ ID NO: 512459 - RNA, 32 nt, Human
ugagaucacgccacuacacuccaaccugggug

SEQ ID NO: 512460 - RNA, 32 nt, Human
ugagaucacgccacugcacuccaaccugggug

SEQ ID NO: 512461 - RNA, 32 nt, Human
ugagaucacgccacugcacuccaccugggcaa

SEQ ID NO: 512462 - RNA, 32 nt, Human
ugagaucacgccacugcacuccagcccgggcg

SEQ ID NO: 512463 - RNA, 32 nt, Human
ugagaucacgccacugcacuccagccuaggcg

SEQ ID NO: 512464 - RNA, 32 nt, Human
ugagaucacgccacugcacuccagccugggcg

SEQ ID NO: 512465 - RNA, 32 nt, Human
ugagaucacgccacugcacuccagccugggug

SEQ ID NO: 512466 - RNA, 32 nt, Human
ugagaucacgccacugcacuccagucugggug

SEQ ID NO: 512467 - RNA, 32 nt, Human
ugagaucacgccacugcacucuagccuaggcg

SEQ ID NO: 512468 - RNA, 32 nt, Human
ugagaucacgccacugcacucuagccugggau

SEQ ID NO: 512469 - RNA, 32 nt, Human
ugagaucacgccacugcauuccagccugggcg

SEQ ID NO: 512470 - RNA, 32 nt, Human
ugagaucacgccacugcauuccagccugugcg

SEQ ID NO: 512471 - RNA, 32 nt, Human
ugagaucacgccauugcacuacagccugggug

SEQ ID NO: 512472 - RNA, 32 nt, Human
ugagaucacgccauugcacucaagccuggcga

SEQ ID NO: 512473 - RNA, 32 nt, Human
ugagaucacgccauugcacuccaaccugggug

SEQ ID NO: 512474 - RNA, 32 nt, Human
ugagaucacgccauugcacuccagccuaggcg

SEQ ID NO: 512475 - RNA, 32 nt, Human
ugagaucacgccauugcacuccagccugggca

SEQ ID NO: 512476 - RNA, 32 nt, Human
ugagaucacgccauugcacuccagccugggcg

SEQ ID NO: 512477 - RNA, 32 nt, Human
ugagaucacgccauugcacuccagucugagca

SEQ ID NO: 512478 - RNA, 32 nt, Human
ugagaucacgccauugcacuccagucugguug

SEQ ID NO: 512479 - RNA, 32 nt, Human
ugagaucacgccguugcacuccagccugggca

SEQ ID NO: 512480 - RNA, 32 nt, Human
ugagaucacgucauugcacuccauccugagcc

SEQ ID NO: 512481 - RNA, 32 nt, Human
ugagaucagagugccagcauggucaaccucua

SEQ ID NO: 512482 - RNA, 32 nt, Human
ugagaucagcuagaccugcuuucuuuucuccu

SEQ ID NO: 512483 - RNA, 32 nt, Human
ugagaucaggaguucaagacaaggcugaccaa

SEQ ID NO: 512484 - RNA, 32 nt, Human
ugagaucaggaguucaagaccagccuggccaa

SEQ ID NO: 512485 - RNA, 32 nt, Human
ugagaucaggaguucaagacuagccugaccaa

SEQ ID NO: 512486 - RNA, 32 nt, Human
ugagaucaggaguucaagacuagccuggccaa

SEQ ID NO: 512487 - RNA, 32 nt, Human
ugagaucaggaguucaagaucagucuggacaa

SEQ ID NO: 512488 - RNA, 19 nt, Human
ugagaucaggaguucgaga

SEQ ID NO: 512489 - RNA, 32 nt, Human
ugagaucaggaguuugagaccaaccuggccaa

SEQ ID NO: 512490 - RNA, 32 nt, Human
ugagaucaggauuuugagaccaaccuggccaa

SEQ ID NO: 512491 - RNA, 32 nt, Human
ugagaucaggcacuucagccugggcgacagag

SEQ ID NO: 512492 - RNA, 32 nt, Human
ugagaucaggccacugcacuccagccugggca

SEQ ID NO: 512493 - RNA, 32 nt, Human
ugagaucaugcaguguuugucuuucugugccu

SEQ ID NO: 512494 - RNA, 32 nt, Human
ugagaucaugccaccgcacuccagccugggca

SEQ ID NO: 512495 - RNA, 32 nt, Human
ugagaucaugccacuacacuccagccuggcga

SEQ ID NO: 512496 - RNA, 32 nt, Human
ugagaucaugccacugaacuccagccugggca

SEQ ID NO: 512497 - RNA, 32 nt, Human
ugagaucaugccacugcaaucuagccugggug

SEQ ID NO: 512498 - RNA, 32 nt, Human
ugagaucaugccacugcacccuagcuugggug

SEQ ID NO: 512499 - RNA, 32 nt, Human
ugagaucaugccacugcacuccagcccaggug

SEQ ID NO: 512500 - RNA, 32 nt, Human
ugagaucaugccacugcacuccagccugagug

SEQ ID NO: 512501 - RNA, 32 nt, Human
ugagaucaugccacugcacuccagccugggca

SEQ ID NO: 512502 - RNA, 32 nt, Human
ugagaucaugccacugcacuccggccuaggug

SEQ ID NO: 512503 - RNA, 32 nt, Human
ugagaucaugccacugcacuccugccugggug

SEQ ID NO: 512504 - RNA, 32 nt, Human
ugagaucaugccacugcacuuuagccugggug

SEQ ID NO: 512505 - RNA, 32 nt, Human
ugagaucaugccacugcaugccagccugggca

SEQ ID NO: 512506 - RNA, 32 nt, Human
ugagaucaugccauuacacuccagccugggcg

SEQ ID NO: 512507 - RNA, 32 nt, Human
ugagaucaugccauugcacuccaaccugggug

SEQ ID NO: 512508 - RNA, 32 nt, Human
ugagaucaugccauugcacuccagcccaggua

SEQ ID NO: 512509 - RNA, 32 nt, Human
ugagaucaugccauugcacuccagccuaggca

SEQ ID NO: 512510 - RNA, 32 nt, Human
ugagaucaugccauugcacuccagccuggaca

SEQ ID NO: 512511 - RNA, 32 nt, Human
ugagaucaugccauugcacuccagccugggca

SEQ ID NO: 512512 - RNA, 32 nt, Human
ugagaucaugccauugcacuccagcuugggug

SEQ ID NO: 512513 - RNA, 32 nt, Human
ugagaucaugccauugcacuccagucugggcg

SEQ ID NO: 512514 - RNA, 32 nt, Human
ugagaucauucccaggggcccagcagacagug

SEQ ID NO: 512515 - RNA, 32 nt, Human
ugagauccacggucccucaucguccagcccug

SEQ ID NO: 512516 - RNA, 32 nt, Human
ugagauccagccacagcacuccagccugggug

SEQ ID NO: 512517 - RNA, 32 nt, Human
ugagaucccaccacugcacuccagccugggcg

SEQ ID NO: 512518 - RNA, 32 nt, Human
ugagaucccaccauugcacuccagccugggca

SEQ ID NO: 512519 - RNA, 32 nt, Human
ugagaucccccagccguguccuccagcccagc

SEQ ID NO: 512520 - RNA, 32 nt, Human
ugagaucccuguauucaaaaacaaaugacagg

SEQ ID NO: 512521 - RNA, 32 nt, Human
ugagauccugccacugcacuccagccugggca

SEQ ID NO: 512522 - RNA, 32 nt, Human
ugagaucgagaguucaagaccagccuggccaa

SEQ ID NO: 512523 - RNA, 32 nt, Human
ugagaucgagauuacagugagcuauggaucgg

SEQ ID NO: 512524 - RNA, 32 nt, Human
ugagaucgagccacugcacuccagccugggcg

SEQ ID NO: 512525 - RNA, 32 nt, Human
ugagaucgagccacugcacuccagccugggug

SEQ ID NO: 512526 - RNA, 21 nt, Human
ugagaucgagucucgcucugu

SEQ ID NO: 512527 - RNA, 32 nt, Human
ugagaucgagucucgcucugucaccaggcugg

SEQ ID NO: 512528 - RNA, 32 nt, Human
ugagaucgcaacacugcacuccagccugggcg

SEQ ID NO: 512529 - RNA, 32 nt, Human
ugagaucgcaacacugcacuccagccugggug

SEQ ID NO: 512530 - RNA, 32 nt, Human
ugagaucgcaccaccacacuccagccugggug

SEQ ID NO: 512531 - RNA, 32 nt, Human
ugagaucgcaccacugcacucaagccugggcg

SEQ ID NO: 512532 - RNA, 32 nt, Human
ugagaucgcaccacugcacuccaaccugggug

SEQ ID NO: 512533 - RNA, 32 nt, Human
ugagaucgcaccacugcacuccagcacuccag

SEQ ID NO: 512534 - RNA, 32 nt, Human
ugagaucgcaccacugcacuccagccugggag

SEQ ID NO: 512535 - RNA, 32 nt, Human
ugagaucgcaccacugcacuccagccugggca

SEQ ID NO: 512536 - RNA, 32 nt, Human
ugagaucgcaccacugcacuccagccugggcg

SEQ ID NO: 512537 - RNA, 32 nt, Human
ugagaucgcaccacugcacuccagccugggug

SEQ ID NO: 512538 - RNA, 32 nt, Human
ugagaucgcaccacugcacuccagccugguua

SEQ ID NO: 512539 - RNA, 32 nt, Human
ugagaucgcaccacugcacuccagcuuggagg

SEQ ID NO: 512540 - RNA, 32 nt, Human
ugagaucgcaccacugcacucuagccuuggca

SEQ ID NO: 512541 - RNA, 32 nt, Human
ugagaucgcaccacugcacucuagcuugggca

SEQ ID NO: 512542 - RNA, 32 nt, Human
ugagaucgcaccacugcauugcagccugguga

SEQ ID NO: 512543 - RNA, 32 nt, Human
ugagaucgcaccacuguacuccagccugggug

SEQ ID NO: 512544 - RNA, 32 nt, Human
ugagaucgcaccauugcacuccagccuggcga

SEQ ID NO: 512545 - RNA, 32 nt, Human
ugagaucgcaccauugcacuccagccugggca

SEQ ID NO: 512546 - RNA, 32 nt, Human
ugagaucgcaccauugcacuucagccugggca

SEQ ID NO: 512547 - RNA, 32 nt, Human
ugagaucgcaccauugcccuccagccugggca

SEQ ID NO: 512548 - RNA, 32 nt, Human
ugagaucgcaccgcugcacuccagccugggca

SEQ ID NO: 512549 - RNA, 32 nt, Human
ugagaucgcacuauugcacucaagccugggcg

SEQ ID NO: 512550 - RNA, 32 nt, Human
ugagaucgcacuccagccugggugacagagug

SEQ ID NO: 512551 - RNA, 32 nt, Human
ugagaucgcaucauugcacugcagucugagug

SEQ ID NO: 512552 - RNA, 32 nt, Human
ugagaucgccacugcacuccagccugggaaau

SEQ ID NO: 512553 - RNA, 32 nt, Human
ugagaucgccucccucccagcaugcuugguga

SEQ ID NO: 512554 - RNA, 32 nt, Human
ugagaucgcgccacugcacucaagccugggca

SEQ ID NO: 512555 - RNA, 32 nt, Human
ugagaucgcgccacugcacuccagccuggacg

SEQ ID NO: 512556 - RNA, 32 nt, Human
ugagaucgcgccacugcacuccagccugggca

SEQ ID NO: 512557 - RNA, 32 nt, Human
ugagaucgcgccacugcacuccagccugggcg

SEQ ID NO: 512558 - RNA, 32 nt, Human
ugagaucgcgccacugcacuccagccugggua

SEQ ID NO: 512559 - RNA, 32 nt, Human
ugagaucgcgccacugcacuccagccugggug

SEQ ID NO: 512560 - RNA, 32 nt, Human
ugagaucgcgccacugcacuccagccugguga

SEQ ID NO: 512561 - RNA, 32 nt, Human
ugagaucgcgccauugcacuccagccuggccu

SEQ ID NO: 512562 - RNA, 32 nt, Human
ugagaucgcgccauugcacuccagccugggca

SEQ ID NO: 512563 - RNA, 32 nt, Human
ugagaucgcgccauugcacuccagccugggcg

SEQ ID NO: 512564 - RNA, 32 nt, Human
ugagaucgcgccauugcacuccagccugggug

SEQ ID NO: 512565 - RNA, 32 nt, Human
ugagaucgcgccauugcacucccgccugggcg

SEQ ID NO: 512566 - RNA, 32 nt, Human
ugagaucgcgccauugcacugcagcccccggc

SEQ ID NO: 512567 - RNA, 32 nt, Human
ugagaucgcgccauugcauuccaaccuggggg

SEQ ID NO: 512568 - RNA, 32 nt, Human
ugagaucgcgccgcugcacuccagccugggug

SEQ ID NO: 512569 - RNA, 32 nt, Human
ugagaucgcgcugcugcacuccagccugggug

SEQ ID NO: 512570 - RNA, 32 nt, Human
ugagaucgcgucauugcacuccagccugggca

SEQ ID NO: 512571 - RNA, 32 nt, Human
ugagaucgcugcacuccagccugggcgacaag

SEQ ID NO: 512572 - RNA, 32 nt, Human
ugagaucggcugaagagagcgggcccaggcuc

SEQ ID NO: 512573 - RNA, 32 nt, Human
ugagaucgggccacacuugagcugagucacca

SEQ ID NO: 512574 - RNA, 32 nt, Human
ugagaucgugccacugcaccacuccagccugg

SEQ ID NO: 512575 - RNA, 32 nt, Human
ugagaucgugccacugcacucaagccugggug

SEQ ID NO: 512576 - RNA, 32 nt, Human
ugagaucgugccacugcacucaagccugguga

SEQ ID NO: 512577 - RNA, 32 nt, Human
ugagaucgugccacugcacuccagagccuggg

SEQ ID NO: 512578 - RNA, 32 nt, Human
ugagaucgugccacugcacuccagccugcggg

SEQ ID NO: 512579 - RNA, 32 nt, Human
ugagaucgugccacugcacuccagccugggag

SEQ ID NO: 512580 - RNA, 32 nt, Human
ugagaucgugccacugcacuccagccugggca

SEQ ID NO: 512581 - RNA, 32 nt, Human
ugagaucgugccacugcacuccagccugggcg

SEQ ID NO: 512582 - RNA, 32 nt, Human
ugagaucgugccacugcacuccagccugggug

SEQ ID NO: 512583 - RNA, 32 nt, Human
ugagaucgugccacugcacuccagccugguga

SEQ ID NO: 512584 - RNA, 32 nt, Human
ugagaucgugccacugcacuccaggcugggug

SEQ ID NO: 512585 - RNA, 32 nt, Human
ugagaucgugccacugcacuccauccuggacg

SEQ ID NO: 512586 - RNA, 32 nt, Human
ugagaucgugccacugcacucccagccugggc

SEQ ID NO: 512587 - RNA, 32 nt, Human
ugagaucgugccauugcacuccagccuggcca

SEQ ID NO: 512588 - RNA, 32 nt, Human
ugagaucgugccauugcacuccagccuggcga

SEQ ID NO: 512589 - RNA, 32 nt, Human
ugagaucgugccauugcacuccagucugggua

SEQ ID NO: 512590 - RNA, 32 nt, Human
ugagaucgugccauugcacuccggccugggca

SEQ ID NO: 512591 - RNA, 32 nt, Human
ugagaucgugccauugcacucuagccugggca

SEQ ID NO: 512592 - RNA, 32 nt, Human
ugagaucgugccguugcacuccagccugggcg

SEQ ID NO: 512593 - RNA, 32 nt, Human
ugagaucgugcuacugcacuccagccuggggg

SEQ ID NO: 512594 - RNA, 32 nt, Human
ugagaucgugcuauugcacuccagccugggcg

SEQ ID NO: 512595 - RNA, 22 nt, Human
ugagaucgugggucacaggccc

SEQ ID NO: 512596 - RNA, 32 nt, Human
ugagaucgugucacuacacuccaggcugggug

SEQ ID NO: 512597 - RNA, 32 nt, Human
ugagaucguucccaggcuggcgucucuggggu

SEQ ID NO: 512598 - RNA, 32 nt, Human
ugagaucucaagagugacauuugugagaccag

SEQ ID NO: 512599 - RNA, 32 nt, Human
ugagaucucaccacugcacuccagccugggca

SEQ ID NO: 512600 - RNA, 32 nt, Human
ugagaucucgccacugcgcuccagccugggca

SEQ ID NO: 512601 - RNA, 32 nt, Human
ugagaucucuccucagcuggaaugaggaaugu

SEQ ID NO: 512602 - RNA, 32 nt, Human
ugagaucugaggacagacacucacauagacgc

SEQ ID NO: 512603 - RNA, 32 nt, Human
ugagaucugcuguccuguuucugucaagcugg

SEQ ID NO: 512604 - RNA, 32 nt, Human
ugagaucuggaggauccaaggauucuguagcu

SEQ ID NO: 512605 - RNA, 32 nt, Human
ugagaucuuguggagcugggaucauguuugaa

SEQ ID NO: 512606 - RNA, 29 nt, Human
ugagaugaacacagugcugggcuccugcu

SEQ ID NO: 512607 - RNA, 32 nt, Human
ugagaugaagcagggaaugcaggccuggguua

SEQ ID NO: 512608 - RNA, 32 nt, Human
ugagaugaaguucuuagcuccagguuuugggg

SEQ ID NO: 512609 - RNA, 21 nt, Human
ugagaugacaggcaugagcca

SEQ ID NO: 512610 - RNA, 23 nt, Human
ugagaugagaaaguggacauuua

SEQ ID NO: 512611 - RNA, 32 nt, Human
ugagaugagaagaucacuugaggccaggaguu

SEQ ID NO: 512612 - RNA, 32 nt, Human
ugagaugagaggaucacuugagccugaggagg

SEQ ID NO: 512613 - RNA, 32 nt, Human
ugagaugagaggaucacuugagccuggggagg

SEQ ID NO: 512614 - RNA, 32 nt, Human
ugagaugagccccacguggagcucgggacgga

SEQ ID NO: 512615 - RNA, 32 nt, Human
ugagaugagccucaucccuggagggcagcaau

SEQ ID NO: 512616 - RNA, 32 nt, Human
ugagaugagcugccgagccucugccuccacuc

SEQ ID NO: 512617 - RNA, 32 nt, Human
ugagaugagugcugggagugguggacauuccu

SEQ ID NO: 512618 - RNA, 32 nt, Human
ugagaugauggaaauguucuaccucugcacuc

SEQ ID NO: 512619 - RNA, 32 nt, Human
ugagaugauggagagcagguucuuuuaacuca

SEQ ID NO: 512620 - RNA, 32 nt, Human
ugagaugauucugcuacuuuccagacuuuucu

SEQ ID NO: 512621 - RNA, 32 nt, Human
ugagaugcacacuggaaaaccggaacgcucaa

SEQ ID NO: 512622 - RNA, 32 nt, Human
ugagaugcagaaccuccaggagcacccaggcu

SEQ ID NO: 512623 - RNA, 32 nt, Human
ugagaugcagagucuagagugcaguggugcaa

SEQ ID NO: 512624 - RNA, 22 nt, Human
ugagaugcaggcccaggcugcu

SEQ ID NO: 512625 - RNA, 32 nt, Human
ugagaugcaugugggcagcaggaagcccaagu

SEQ ID NO: 512626 - RNA, 32 nt, Human
ugagaugcccaggaggaggagcccuagggaag

SEQ ID NO: 512627 - RNA, 32 nt, Human
ugagaugccucacccaggucucccucugucac

SEQ ID NO: 512628 - RNA, 32 nt, Human
ugagaugccugaugccauuguauuuucccuuc

SEQ ID NO: 512629 - RNA, 32 nt, Human
ugagaugccuggugagcauuacaggcaagggg

SEQ ID NO: 512630 - RNA, 32 nt, Human
ugagaugccuuacauggauucccaccacugca

SEQ ID NO: 512631 - RNA, 21 nt, Human
ugagaugcggucuugcucugu

SEQ ID NO: 512632 - RNA, 32 nt, Human
ugagaugcggucuugcucuguugcugaggcug

SEQ ID NO: 512633 - RNA, 29 nt, Human
ugagaugcuguugccgcugcugcugcugc

SEQ ID NO: 512634 - RNA, 32 nt, Human
ugagauggaaacagcaacuuguacaguggcug

SEQ ID NO: 512635 - RNA, 32 nt, Human
ugagauggaaccuggccucaguuuaggaacag

SEQ ID NO: 512636 - RNA, 32 nt, Human
ugagauggaagacaucguccaagaagauggag

SEQ ID NO: 512637 - RNA, 32 nt, Human
ugagauggaagaggaggaggaggaggagcugg

SEQ ID NO: 512638 - RNA, 21 nt, Human
ugagauggaaucccacucugu

SEQ ID NO: 512639 - RNA, 21 nt, Human
ugagauggaaucuagcucugu

SEQ ID NO: 512640 - RNA, 21 nt, Human
ugagauggaaucucacucugu

SEQ ID NO: 512641 - RNA, 32 nt, Human
ugagauggaaucucacucuguugcccaggcug

SEQ ID NO: 512642 - RNA, 21 nt, Human
ugagauggaaucucgcucugu

SEQ ID NO: 512643 - RNA, 21 nt, Human
ugagauggaaucucucucugu

SEQ ID NO: 512644 - RNA, 21 nt, Human
ugagauggacucuagcucugu

SEQ ID NO: 512645 - RNA, 21 nt, Human
ugagauggacucucacucugu

SEQ ID NO: 512646 - RNA, 21 nt, Human
ugagauggagacucacucugu

SEQ ID NO: 512647 - RNA, 32 nt, Human
ugagauggagacucacucuguugcccaggcug

SEQ ID NO: 512648 - RNA, 32 nt, Human
ugagauggagagaagaaugaagaggugguggu

SEQ ID NO: 512649 - RNA, 32 nt, Human
ugagauggagagaagaaugaaggggugguggu

SEQ ID NO: 512650 - RNA, 32 nt, Human
ugagauggagagacacgugaaccaccauugcu

SEQ ID NO: 512651 - RNA, 32 nt, Human
ugagauggagccuugcucugucacucaugcug

SEQ ID NO: 512652 - RNA, 32 nt, Human
ugagauggaggcuugcucugucacccaggcug

SEQ ID NO: 512653 - RNA, 32 nt, Human
ugagauggagucaugcucugucgcccaggcug

SEQ ID NO: 512654 - RNA, 21 nt, Human
ugagauggagucuagcucugu

SEQ ID NO: 512655 - RNA, 21 nt, Human
ugagauggagucucacgcugu

SEQ ID NO: 512656 - RNA, 21 nt, Human
ugagauggagucucacuccgu

SEQ ID NO: 512657 - RNA, 19 nt, Human
ugagauggagucucacucu

SEQ ID NO: 512658 - RNA, 21 nt, Human
ugagauggagucucacucugu

SEQ ID NO: 512659 - RNA, 32 nt, Human
ugagauggagucucacucuguugcccaggcug

SEQ ID NO: 512660 - RNA, 32 nt, Human
ugagauggagucucacucuguugcccagucug

SEQ ID NO: 512661 - RNA, 21 nt, Human
ugagauggagucucacuuugu

SEQ ID NO: 512662 - RNA, 21 nt, Human
ugagauggagucucccucugu

SEQ ID NO: 512663 - RNA, 21 nt, Human
ugagauggagucucgcacugu

SEQ ID NO: 512664 - RNA, 21 nt, Human
ugagauggagucucgcccugu

SEQ ID NO: 512665 - RNA, 19 nt, Human
ugagauggagucucgcucu

SEQ ID NO: 512666 - RNA, 20 nt, Human
ugagauggagucucgcucug

SEQ ID NO: 512667 - RNA, 21 nt, Human
ugagauggagucucgcucugu

SEQ ID NO: 512668 - RNA, 32 nt, Human
ugagauggagucucgcucugucaccaggcugg

SEQ ID NO: 512669 - RNA, 32 nt, Human
ugagauggagucucgcucugucacccagacug

SEQ ID NO: 512670 - RNA, 32 nt, Human
ugagauggagucucgcucugucacccaggcug

SEQ ID NO: 512671 - RNA, 32 nt, Human
ugagauggagucucgcucugucacccagucug

SEQ ID NO: 512672 - RNA, 32 nt, Human
ugagauggagucucgcucugucgccaaggcug

SEQ ID NO: 512673 - RNA, 32 nt, Human
ugagauggagucucgcucugucgccaggacug

SEQ ID NO: 512674 - RNA, 32 nt, Human
ugagauggagucucgcucugucgccaggcugg

SEQ ID NO: 512675 - RNA, 32 nt, Human
ugagauggagucucgcucugucgcccaggcug

SEQ ID NO: 512676 - RNA, 32 nt, Human
ugagauggagucucgcucugucgcccagguug

SEQ ID NO: 512677 - RNA, 32 nt, Human
ugagauggagucucgcucuguugcccaggcug

SEQ ID NO: 512678 - RNA, 32 nt, Human
ugagauggagucucgcucuguugcccagggug

SEQ ID NO: 512679 - RNA, 32 nt, Human
ugagauggagucucgcucuguugcccagguug

SEQ ID NO: 512680 - RNA, 21 nt, Human
ugagauggagucucgcuuugu

SEQ ID NO: 512681 - RNA, 32 nt, Human
ugagauggagucucgcuuuguugcccagacug

SEQ ID NO: 512682 - RNA, 32 nt, Human
ugagauggagucucgcuuuguugcccaggcug

SEQ ID NO: 512683 - RNA, 21 nt, Human
ugagauggagucucucucugu

SEQ ID NO: 512684 - RNA, 21 nt, Human
ugagauggagucuggcucugu

SEQ ID NO: 512685 - RNA, 21 nt, Human
ugagauggagucuuacucugu

SEQ ID NO: 512686 - RNA, 32 nt, Human
ugagauggagucuuacucugucacccaggcug

SEQ ID NO: 512687 - RNA, 21 nt, Human
ugagauggagucuugcccugu

SEQ ID NO: 512688 - RNA, 32 nt, Human
ugagauggagucuugcccuguugcccaggcug

SEQ ID NO: 512689 - RNA, 32 nt, Human
ugagauggagucuugcuccugucgcccaggcu

SEQ ID NO: 512690 - RNA, 32 nt, Human
ugagauggagucuugcuccuguugugcaggcu

SEQ ID NO: 512691 - RNA, 19 nt, Human
ugagauggagucuugcucu

SEQ ID NO: 512692 - RNA, 32 nt, Human
ugagauggagucuugcucuauugcccaggcug

SEQ ID NO: 512693 - RNA, 21 nt, Human
ugagauggagucuugcucugu

SEQ ID NO: 512694 - RNA, 32 nt, Human
ugagauggagucuugcucugucacccaaauug

SEQ ID NO: 512695 - RNA, 32 nt, Human
ugagauggagucuugcucugucacccaggcug

SEQ ID NO: 512696 - RNA, 32 nt, Human
ugagauggagucuugcucugucacccagguug

SEQ ID NO: 512697 - RNA, 32 nt, Human
ugagauggagucuugcucugucccccaugcug

SEQ ID NO: 512698 - RNA, 32 nt, Human
ugagauggagucuugcucugucgccagacugg

SEQ ID NO: 512699 - RNA, 32 nt, Human
ugagauggagucuugcucugucgcccaggcua

SEQ ID NO: 512700 - RNA, 32 nt, Human
ugagauggagucuugcucugucgcccaggcuc

SEQ ID NO: 512701 - RNA, 32 nt, Human
ugagauggagucuugcucugucgcccaggcug

SEQ ID NO: 512702 - RNA, 32 nt, Human
ugagauggagucuugcucugucgcccagguug

SEQ ID NO: 512703 - RNA, 32 nt, Human
ugagauggagucuugcucugucgcccaugcug

SEQ ID NO: 512704 - RNA, 32 nt, Human
ugagauggagucuugcucugucucccaggcua

SEQ ID NO: 512705 - RNA, 32 nt, Human
ugagauggagucuugcucugucucucaggcua

SEQ ID NO: 512706 - RNA, 32 nt, Human
ugagauggagucuugcucuguugcccagacug

SEQ ID NO: 512707 - RNA, 32 nt, Human
ugagauggagucuugcucuguugcccagcugg

SEQ ID NO: 512708 - RNA, 32 nt, Human
ugagauggagucuugcucuguugcccaggcug

SEQ ID NO: 512709 - RNA, 32 nt, Human
ugagauggagucuugcucuguugcccagguug

SEQ ID NO: 512710 - RNA, 32 nt, Human
ugagauggagucuugcucuguugcccaugcug

SEQ ID NO: 512711 - RNA, 32 nt, Human
ugagauggagucuugcucuguugccccagcuu

SEQ ID NO: 512712 - RNA, 32 nt, Human
ugagauggagucuugcucuguugccccaggcu

SEQ ID NO: 512713 - RNA, 32 nt, Human
ugagauggagucuugcucuguuguccaggcug

SEQ ID NO: 512714 - RNA, 32 nt, Human
ugagauggagucuugcucuugucgcccaggcu

SEQ ID NO: 512715 - RNA, 32 nt, Human
ugagauggagucuugcugugucaccaggaugg

SEQ ID NO: 512716 - RNA, 32 nt, Human
ugagauggagucuugcugugucgccuaggcug

SEQ ID NO: 512717 - RNA, 32 nt, Human
ugagauggagucuugcuguugucgccuaggcu

SEQ ID NO: 512718 - RNA, 32 nt, Human
ugagauggagucuugcuuugucgcccaggcug

SEQ ID NO: 512719 - RNA, 32 nt, Human
ugagauggagucuuguucugucacccaggcug

SEQ ID NO: 512720 - RNA, 32 nt, Human
ugagauggagucuuucucugucacccaggcug

SEQ ID NO: 512721 - RNA, 32 nt, Human
ugagauggagugagcugagacagauaagagaa

SEQ ID NO: 512722 - RNA, 32 nt, Human
ugagauggaguguugcccuguugccaggcugg

SEQ ID NO: 512723 - RNA, 32 nt, Human
ugagauggaguuucacccuuguugcccaggcu

SEQ ID NO: 512724 - RNA, 21 nt, Human
ugagauggaguuucacucugu

SEQ ID NO: 512725 - RNA, 21 nt, Human
ugagauggaguuucgcucugu

SEQ ID NO: 512726 - RNA, 32 nt, Human
ugagauggaguuucgcucuguugcccaggcug

SEQ ID NO: 512727 - RNA, 29 nt, Human
ugagauggaguuuucgcucuuguugccca

SEQ ID NO: 512728 - RNA, 32 nt, Human
ugagauggaguuuugcucugucacccaggcug

SEQ ID NO: 512729 - RNA, 29 nt, Human
ugagauggauggagaggccacagugaagc

SEQ ID NO: 512730 - RNA, 32 nt, Human
ugagauggauggcaaaccccauuuuuaaguua

SEQ ID NO: 512731 - RNA, 21 nt, Human
ugagauggauucucgcucugu

SEQ ID NO: 512732 - RNA, 21 nt, Human
ugagauggauucuugcucugu

SEQ ID NO: 512733 - RNA, 32 nt, Human
ugagauggauucuugcucugucaccaggcugg

SEQ ID NO: 512734 - RNA, 32 nt, Human
ugagauggcaacauuacacucuagccugagca

SEQ ID NO: 512735 - RNA, 32 nt, Human
ugagauggcaccacugcacuccagccugggag

SEQ ID NO: 512736 - RNA, 32 nt, Human
ugagauggcaccacugcacuccagccugggug

SEQ ID NO: 512737 - RNA, 32 nt, Human
ugagauggcaccacugcacuccagcuugggug

SEQ ID NO: 512738 - RNA, 32 nt, Human
ugagauggcaccacugcacuccggccuaggca

SEQ ID NO: 512739 - RNA, 32 nt, Human
ugagauggcagacaggagagaugggccccagg

SEQ ID NO: 512740 - RNA, 21 nt, Human
ugagauggcaucuugcucugu

SEQ ID NO: 512741 - RNA, 32 nt, Human
ugagauggcaucuugcucugucgcccaggaug

SEQ ID NO: 512742 - RNA, 31 nt, Human
ugagauggccguuucugacuuguagagaaau

SEQ ID NO: 512743 - RNA, 32 nt, Human
ugagauggcgccacugcacuccagccuaggca

SEQ ID NO: 512744 - RNA, 32 nt, Human
ugagauggcgccacugcacuccagccugggcg

SEQ ID NO: 512745 - RNA, 32 nt, Human
ugagauggcgccaucacacuccagccugcucu

SEQ ID NO: 512746 - RNA, 32 nt, Human
ugagauggcucacgccugcaaucccagcgcuu

SEQ ID NO: 512747 - RNA, 32 nt, Human
ugagaugggaacacuuuuuaguauaaacgcaa

SEQ ID NO: 512748 - RNA, 32 nt, Human
ugagaugggaagaucacuugagccccggaggu

SEQ ID NO: 512749 - RNA, 32 nt, Human
ugagaugggaaggucacuugagcccaggaccc

SEQ ID NO: 512750 - RNA, 32 nt, Human
ugagaugggagacaggagagaugagccccagg

SEQ ID NO: 512751 - RNA, 32 nt, Human
ugagaugggaggaccauuugagccugggagau

SEQ ID NO: 512752 - RNA, 32 nt, Human
ugagaugggaggagcacuugagccuaggaggu

SEQ ID NO: 512753 - RNA, 32 nt, Human
ugagaugggaggaucacuugaacccaggaggu

SEQ ID NO: 512754 - RNA, 32 nt, Human
ugagaugggaggaucacuugaagccaggaguu

SEQ ID NO: 512755 - RNA, 32 nt, Human
ugagaugggaggaucacuugaggccaagaguu

SEQ ID NO: 512756 - RNA, 32 nt, Human
ugagaugggaggaucaucugagccugggaggg

SEQ ID NO: 512757 - RNA, 32 nt, Human
ugagaugggaggaucgcuugagaccagccugg

SEQ ID NO: 512758 - RNA, 32 nt, Human
ugagaugggaggaucgcuugagcccaggaauu

SEQ ID NO: 512759 - RNA, 32 nt, Human
ugagaugggaggaucucuugagaccagguguu

SEQ ID NO: 512760 - RNA, 32 nt, Human
ugagaugggaggaugagggaggucggggcugc

SEQ ID NO: 512761 - RNA, 32 nt, Human
ugagaugggaggauggcuugagcccaggaguu

SEQ ID NO: 512762 - RNA, 32 nt, Human
ugagaugggaggauggcuugaggccagagguu

SEQ ID NO: 512763 - RNA, 32 nt, Human
ugagaugggaggauugccugagcccagggaug

SEQ ID NO: 512764 - RNA, 32 nt, Human
ugagaugggaggauugcuugagcccaggaggu

SEQ ID NO: 512765 - RNA, 32 nt, Human
ugagaugggaggguuaaggcucagggauuuua

SEQ ID NO: 512766 - RNA, 22 nt, Human
ugagaugggagucuugcucugu

SEQ ID NO: 512767 - RNA, 32 nt, Human
ugagaugggauccuauguguuuggaaaacgug

SEQ ID NO: 512768 - RNA, 32 nt, Human
ugagaugggcagaucacuugaggucaggaguu

SEQ ID NO: 512769 - RNA, 32 nt, Human
ugagaugggccccacaccaggacuggacuggg

SEQ ID NO: 512770 - RNA, 20 nt, Human
ugagaugggccuuacucugu

SEQ ID NO: 512771 - RNA, 29 nt, Human
ugagauggggacucacucuguugcccagg

SEQ ID NO: 512772 - RNA, 32 nt, Human
ugagauggggccacugcacugcagccugugug

SEQ ID NO: 512773 - RNA, 22 nt, Human
ugagaugggggucuugcucugu

SEQ ID NO: 512774 - RNA, 21 nt, Human
ugagauggggucucgcacugu

SEQ ID NO: 512775 - RNA, 32 nt, Human
ugagauggggucucgcacugucccccaggcug

SEQ ID NO: 512776 - RNA, 21 nt, Human
ugagauggggucucgcuaugu

SEQ ID NO: 512777 - RNA, 32 nt, Human
ugagauggggucucgcuauguugaccaggcug

SEQ ID NO: 512778 - RNA, 21 nt, Human
ugagauggggucucgcucugu

SEQ ID NO: 512779 - RNA, 32 nt, Human
ugagauggggucucgcucugucaccaggcugg

SEQ ID NO: 512780 - RNA, 32 nt, Human
ugagauggggucucgcucugucgcccaggcug

SEQ ID NO: 512781 - RNA, 32 nt, Human
ugagauggggucuuccucuguugcccaggcug

SEQ ID NO: 512782 - RNA, 32 nt, Human
ugagauggggucuugcuauguugcccaggcug

SEQ ID NO: 512783 - RNA, 21 nt, Human
ugagauggggucuugcucugu

SEQ ID NO: 512784 - RNA, 32 nt, Human
ugagauggggucuugcucugucgcccaggcug

SEQ ID NO: 512785 - RNA, 32 nt, Human
ugagaugggguuucaccacguuggccaggcug

SEQ ID NO: 512786 - RNA, 32 nt, Human
ugagaugggguuucaccaugguagccaggcug

SEQ ID NO: 512787 - RNA, 32 nt, Human
ugagaugggguuuuaccauguuacccaggcug

SEQ ID NO: 512788 - RNA, 32 nt, Human
ugagaugggguuuugccguguuacccaggcua

SEQ ID NO: 512789 - RNA, 32 nt, Human
ugagaugggguuuuuccacguuggucaggcug

SEQ ID NO: 512790 - RNA, 32 nt, Human
ugagauggguggaucaccugagcucaggaguu

SEQ ID NO: 512791 - RNA, 32 nt, Human
ugagauggguggauugcuugagcccaggaguu

SEQ ID NO: 512792 - RNA, 32 nt, Human
ugagauggguucucacuauauuguccaggcua

SEQ ID NO: 512793 - RNA, 32 nt, Human
ugagaugguacagugugcacagacagguacug

SEQ ID NO: 512794 - RNA, 32 nt, Human
ugagaugguaccacugcacuccagccugggug

SEQ ID NO: 512795 - RNA, 18 nt, Human
ugagaugguccacucugu

SEQ ID NO: 512796 - RNA, 32 nt, Human
ugagauggugacaggcuggccugcagucagca

SEQ ID NO: 512797 - RNA, 32 nt, Human
ugagauggugccacugcacuccagccuggcga

SEQ ID NO: 512798 - RNA, 32 nt, Human
ugagauggugccacugcacuccagccugggca

SEQ ID NO: 512799 - RNA, 32 nt, Human
ugagauggugccacugcacuccagccugggcg

SEQ ID NO: 512800 - RNA, 32 nt, Human
ugagauggugccacugcacuccagccuggggg

SEQ ID NO: 512801 - RNA, 32 nt, Human
ugagauggugccacugcacuccagcuuaggug

SEQ ID NO: 512802 - RNA, 32 nt, Human
ugagauggugccacugcacucuaaccugggcg

SEQ ID NO: 512803 - RNA, 32 nt, Human
ugagauggugucuugcucugucacccaggcug

SEQ ID NO: 512804 - RNA, 32 nt, Human
ugagauggugucuugcucuuuugcccagacug

SEQ ID NO: 512805 - RNA, 32 nt, Human
ugagaugguuaaguguuugagcagacugugac

SEQ ID NO: 512806 - RNA, 32 nt, Human
ugagauguaccaugaacuaacaauucuuugaa

SEQ ID NO: 512807 - RNA, 32 nt, Human
ugagauguaguuuucccaucuccugggaaggg

SEQ ID NO: 512808 - RNA, 32 nt, Human
ugagaugucuuccauaucuauaccuuugugca

SEQ ID NO: 512809 - RNA, 32 nt, Human
ugagaugugaagacuacuugagcucagaaguu

SEQ ID NO: 512810 - RNA, 32 nt, Human
ugagaugugagaauugcuugagcccaggaguu

SEQ ID NO: 512811 - RNA, 32 nt, Human
ugagaugugagccuugugcaugugggggagga

SEQ ID NO: 512812 - RNA, 32 nt, Human
ugagaugugaggaggaggaggaagaaaaugag

SEQ ID NO: 512813 - RNA, 32 nt, Human
ugagaugugagugaggaaggcuuugagauggu

SEQ ID NO: 512814 - RNA, 32 nt, Human
ugagaugugccuggauguucccuaaagagcuu

SEQ ID NO: 512815 - RNA, 32 nt, Human
ugagauguugaaugaugccuuuacagacuuca

SEQ ID NO: 512816 - RNA, 32 nt, Human
ugagauuaaagagguaaagcccaugacgugcu

SEQ ID NO: 512817 - RNA, 32 nt, Human
ugagauuaaaggaggcagggaggugagaggaa

SEQ ID NO: 512818 - RNA, 32 nt, Human
ugagauuaacaccccauccccgggagaacucu

SEQ ID NO: 512819 - RNA, 21 nt, Human
ugagauuacaggcaugagcca

SEQ ID NO: 512820 - RNA, 21 nt, Human
ugagauuacaggcaugaguca

SEQ ID NO: 512821 - RNA, 21 nt, Human
ugagauuacaggcaugcgcca

SEQ ID NO: 512822 - RNA, 21 nt, Human
ugagauuacaggcaugggcca

SEQ ID NO: 512823 - RNA, 22 nt, Human
ugagauuacagucucgcucugu

SEQ ID NO: 512824 - RNA, 32 nt, Human
ugagauuaccugggucuagagugcggagcugc

SEQ ID NO: 512825 - RNA, 32 nt, Human
ugagauuaccuuucuguuccuugcaguucacc

SEQ ID NO: 512826 - RNA, 32 nt, Human
ugagauuacgccacugcacuccagccugggca

SEQ ID NO: 512827 - RNA, 32 nt, Human
ugagauuacgcugccuuaauguaacacagucu

SEQ ID NO: 512828 - RNA, 32 nt, Human
ugagauuacugaugcuucacuugcacucuaag

SEQ ID NO: 512829 - RNA, 32 nt, Human
ugagauuaguguugacagggaggggaggauug

SEQ ID NO: 512830 - RNA, 21 nt, Human
ugagauuauaggcacgagcca

SEQ ID NO: 512831 - RNA, 21 nt, Human
ugagauuauaggcaugagcca

SEQ ID NO: 512832 - RNA, 32 nt, Human
ugagauuauaggccuaccaccaugcccagcca

SEQ ID NO: 512833 - RNA, 32 nt, Human
ugagauuauccauuuuguugcauauguaagua

SEQ ID NO: 512834 - RNA, 32 nt, Human
ugagauuaugccacuguacuccagccugggug

SEQ ID NO: 512835 - RNA, 32 nt, Human
ugagauucaaaggaaucucacuguuccuaaau

SEQ ID NO: 512836 - RNA, 23 nt, Human
ugagauucagcauccccuggagg

SEQ ID NO: 512837 - RNA, 32 nt, Human
ugagauucagcccuguggagguggccaaggcu

SEQ ID NO: 512838 - RNA, 32 nt, Human
ugagauucccaggugcacgcaugcauggacac

SEQ ID NO: 512839 - RNA, 32 nt, Human
ugagauucuccucuauuggaagcuaauuagcc

SEQ ID NO: 512840 - RNA, 32 nt, Human
ugagauucugucucaaaauaaauacauacaua

SEQ ID NO: 512841 - RNA, 32 nt, Human
ugagauucuuuauacucucugccuucagcaau

SEQ ID NO: 512842 - RNA, 32 nt, Human
ugagauugaaacgugaaguauuuggaaaacaa

SEQ ID NO: 512843 - RNA, 32 nt, Human
ugagauugagcagaagaucaaggaguacaaug

SEQ ID NO: 512844 - RNA, 32 nt, Human
ugagauugcaccacggcacuccagccugggug

SEQ ID NO: 512845 - RNA, 32 nt, Human
ugagauugcaccacuacacuccagccuggaug

SEQ ID NO: 512846 - RNA, 32 nt, Human
ugagauugcaccacuacacuccagccugggug

SEQ ID NO: 512847 - RNA, 32 nt, Human
ugagauugcaccacugcacuccagcccaggca

SEQ ID NO: 512848 - RNA, 32 nt, Human
ugagauugcaccacugcacuccagccugggca

SEQ ID NO: 512849 - RNA, 32 nt, Human
ugagauugcaccacugcacuccagccugggcg

SEQ ID NO: 512850 - RNA, 32 nt, Human
ugagauugcaccacugcacuccagccugggga

SEQ ID NO: 512851 - RNA, 32 nt, Human
ugagauugcaccacugcacuccagccugggug

SEQ ID NO: 512852 - RNA, 32 nt, Human
ugagauugcaccacugcacuccagccugguga

SEQ ID NO: 512853 - RNA, 32 nt, Human
ugagauugcaccacugcacuccagucugggug

SEQ ID NO: 512854 - RNA, 32 nt, Human
ugagauugcaccacugcauuccagccuggaug

SEQ ID NO: 512855 - RNA, 32 nt, Human
ugagauugcaccacuguacuccaaccugggcg

SEQ ID NO: 512856 - RNA, 32 nt, Human
ugagauugcaccacuguacuccagcacucuag

SEQ ID NO: 512857 - RNA, 32 nt, Human
ugagauugcaccauugcacuccagccugggca

SEQ ID NO: 512858 - RNA, 32 nt, Human
ugagauugcaccauugcacuccagccugggcg

SEQ ID NO: 512859 - RNA, 32 nt, Human
ugagauugcaccauugcacuccagccugugca

SEQ ID NO: 512860 - RNA, 32 nt, Human
ugagauugcaccauugcauuccagccugggca

SEQ ID NO: 512861 - RNA, 32 nt, Human
ugagauugcaccauuucauuccagccugggca

SEQ ID NO: 512862 - RNA, 32 nt, Human
ugagauugcacuauugcacuccagccugggca

SEQ ID NO: 512863 - RNA, 32 nt, Human
ugagauugcacuccagccugggcgacaggcuc

SEQ ID NO: 512864 - RNA, 32 nt, Human
ugagauugcaucauugcacuccagccugggca

SEQ ID NO: 512865 - RNA, 32 nt, Human
ugagauugcgaaggguggcagauggagguuac

SEQ ID NO: 512866 - RNA, 32 nt, Human
ugagauugcgccaccgcacuccagccugggca

SEQ ID NO: 512867 - RNA, 32 nt, Human
ugagauugcgccaccgcacuccagccugggcg

SEQ ID NO: 512868 - RNA, 32 nt, Human
ugagauugcgccacugcaccccagcaugagcg

SEQ ID NO: 512869 - RNA, 32 nt, Human
ugagauugcgccacugcaccccagccugggug

SEQ ID NO: 512870 - RNA, 32 nt, Human
ugagauugcgccacugcacuccagcccuggcg

SEQ ID NO: 512871 - RNA, 32 nt, Human
ugagauugcgccacugcacuccagccuggcga

SEQ ID NO: 512872 - RNA, 32 nt, Human
ugagauugcgccacugcacuccagccugggca

SEQ ID NO: 512873 - RNA, 32 nt, Human
ugagauugcgccacugcacuccagccugggcg

SEQ ID NO: 512874 - RNA, 32 nt, Human
ugagauugcgccacugcacuccagccugggcu

SEQ ID NO: 512875 - RNA, 32 nt, Human
ugagauugcgccacugcacuccagccugggug

SEQ ID NO: 512876 - RNA, 32 nt, Human
ugagauugcgccacugcacuccagucuggucg

SEQ ID NO: 512877 - RNA, 32 nt, Human
ugagauugcgccauugcacuccagccugggca

SEQ ID NO: 512878 - RNA, 32 nt, Human
ugagauugcgccauugcacuccagccugggga

SEQ ID NO: 512879 - RNA, 32 nt, Human
ugagauugcgccauugcauuccagccugggug

SEQ ID NO: 512880 - RNA, 32 nt, Human
ugagauugcgcugcugcacuccaaccugggcg

SEQ ID NO: 512881 - RNA, 32 nt, Human
ugagauuggaccacugcucuccagccugggca

SEQ ID NO: 512882 - RNA, 32 nt, Human
ugagauuggcccccucccucgacggggcgggu

SEQ ID NO: 512883 - RNA, 32 nt, Human
ugagauuggcuuucacugcacugagccacaau

SEQ ID NO: 512884 - RNA, 32 nt, Human
ugagauugggccacugcacuccacccugggcg

SEQ ID NO: 512885 - RNA, 32 nt, Human
ugagauuguacauuucuuacuacucuucuacu

SEQ ID NO: 512886 - RNA, 32 nt, Human
ugagauuguaccacugcacuccagucugggca

SEQ ID NO: 512887 - RNA, 32 nt, Human
ugagauuguaccacugcgcuccaaacugggug

SEQ ID NO: 512888 - RNA, 32 nt, Human
ugagauuguaccaugcacuccagccuggguaa

SEQ ID NO: 512889 - RNA, 32 nt, Human
ugagauuguaccauugcacuccagccugggca

SEQ ID NO: 512890 - RNA, 32 nt, Human
ugagauugugccacuacacuccagccugggca

SEQ ID NO: 512891 - RNA, 32 nt, Human
ugagauugugccacugcacaccagccuggaca

SEQ ID NO: 512892 - RNA, 32 nt, Human
ugagauugugccacugcacgcacuccagccug

SEQ ID NO: 512893 - RNA, 32 nt, Human
ugagauugugccacugcacuccagccugggag

SEQ ID NO: 512894 - RNA, 32 nt, Human
ugagauugugccacugcacuccagccugggca

SEQ ID NO: 512895 - RNA, 32 nt, Human
ugagauugugccacugcacuccagccugggcc

SEQ ID NO: 512896 - RNA, 32 nt, Human
ugagauugugccacugcacuccagccugggcg

SEQ ID NO: 512897 - RNA, 32 nt, Human
ugagauugugccacugcacuccagccugggug

SEQ ID NO: 512898 - RNA, 32 nt, Human
ugagauugugccacugcacucuagccugggug

SEQ ID NO: 512899 - RNA, 32 nt, Human
ugagauugugccacugcacuucagccugggcg

SEQ ID NO: 512900 - RNA, 32 nt, Human
ugagauugugccacugcacuucagcuugggug

SEQ ID NO: 512901 - RNA, 32 nt, Human
ugagauugugccacuguacugcagccugggug

SEQ ID NO: 512902 - RNA, 32 nt, Human
ugagauugugccacuucacuccagccugggug

SEQ ID NO: 512903 - RNA, 32 nt, Human
ugagauugugccauugcacuccagccugggca

SEQ ID NO: 512904 - RNA, 32 nt, Human
ugagauugugccauugcacuccagccugggcg

SEQ ID NO: 512905 - RNA, 32 nt, Human
ugagauugugccauugcacuccagccugggcu

SEQ ID NO: 512906 - RNA, 32 nt, Human
ugagauugugccauugcacuccagccugggug

SEQ ID NO: 512907 - RNA, 32 nt, Human
ugagauugugccgcugcacuccagccuggcga

SEQ ID NO: 512908 - RNA, 32 nt, Human
ugagauugugcugcugcacuccagccugggag

SEQ ID NO: 512909 - RNA, 32 nt, Human
ugagauuguggcacugcacuccagucugggug

SEQ ID NO: 512910 - RNA, 32 nt, Human
ugagauuguggcucccccucuggaggaggugg

SEQ ID NO: 512911 - RNA, 32 nt, Human
ugagauugugucauugcacuccagccugggca

SEQ ID NO: 512912 - RNA, 23 nt, Human
ugagauuuacaagugacugugau

SEQ ID NO: 512913 - RNA, 21 nt, Human
ugagauuuauucacuaucaca

SEQ ID NO: 512914 - RNA, 32 nt, Human
ugagauuucacugcauuuccccacucugccca

SEQ ID NO: 512915 - RNA, 32 nt, Human
ugagauuuccaucauucagaacagaggcuuuu

SEQ ID NO: 512916 - RNA, 32 nt, Human
ugagauuucuuccuuuuccuuucggauucccc

SEQ ID NO: 512917 - RNA, 32 nt, Human
ugagauuuggguggggacagagccaaaccaua

SEQ ID NO: 512918 - RNA, 32 nt, Human
ugagauuuguucauguuguucucccccuccuu

SEQ ID NO: 512919 - RNA, 32 nt, Human
ugagauuuugcaacugcacuccagccugggcu

SEQ ID NO: 512920 - RNA, 32 nt, Human
ugagauuuugcagguaaaccugggcggugugg

SEQ ID NO: 512921 - RNA, 32 nt, Human
ugagauuuugguauuacacuguauuuguaucu

SEQ ID NO: 512922 - RNA, 32 nt, Human
ugagauuuuugaaaagaguauuuucaguaaua

SEQ ID NO: 512923 - RNA, 32 nt, Human
ugagcaaaaagaccagccuucccaacaugccu

SEQ ID NO: 512924 - RNA, 32 nt, Human
ugagcaaacagccccuucucucgcuuuggguc

SEQ ID NO: 512925 - RNA, 32 nt, Human
ugagcaaacuauuugcgacucacccacaauuc

SEQ ID NO: 512926 - RNA, 32 nt, Human
ugagcaaagauggaucaggaaggugggggaga

SEQ ID NO: 512927 - RNA, 32 nt, Human
ugagcaaaugaauuuaaaaauagacagcaguu

SEQ ID NO: 512928 - RNA, 32 nt, Human
ugagcaaaugggcaguuguggagcucaagccu

SEQ ID NO: 512929 - RNA, 32 nt, Human
ugagcaaauuaaaagcucaucaauuucauaag

SEQ ID NO: 512930 - RNA, 32 nt, Human
ugagcaacaaagcaagaccccaucucuauaaa

SEQ ID NO: 512931 - RNA, 32 nt, Human
ugagcaacaaagcgagaucccaucucuacaaa

SEQ ID NO: 512932 - RNA, 32 nt, Human
ugagcaacacccgucgaacacagccauccacc

SEQ ID NO: 512933 - RNA, 32 nt, Human
ugagcaacagagcaaaaccccgucucuaaaau

SEQ ID NO: 512934 - RNA, 32 nt, Human
ugagcaacaguuacacuagguagaaaaguauu

SEQ ID NO: 512935 - RNA, 32 nt, Human
ugagcaacauaucaaaaccccaucucuacaaa

SEQ ID NO: 512936 - RNA, 32 nt, Human
ugagcaacauaucaaaaccccgucucuacaaa

SEQ ID NO: 512937 - RNA, 32 nt, Human
ugagcaacaugaugagaccccaucucuacaaa

SEQ ID NO: 512938 - RNA, 32 nt, Human
ugagcaacauggcgaaaccccgucucuacuaa

SEQ ID NO: 512939 - RNA, 32 nt, Human
ugagcaacauggcgaaaccccgucuguaauaa

SEQ ID NO: 512940 - RNA, 32 nt, Human
ugagcaacaugguaaaaccccaucucuaccaa

SEQ ID NO: 512941 - RNA, 32 nt, Human
ugagcaacauuaggcuagaggggucuuguuca

SEQ ID NO: 512942 - RNA, 32 nt, Human
ugagcaaccuggacuucugcuuacuggccaga

SEQ ID NO: 512943 - RNA, 32 nt, Human
ugagcaacugcacccagccuaguugaguauac

SEQ ID NO: 512944 - RNA, 32 nt, Human
ugagcaacuguacuccagcuuggcgacagagc

SEQ ID NO: 512945 - RNA, 32 nt, Human
ugagcaacugugcaaggccugguguuucuuga

SEQ ID NO: 512946 - RNA, 32 nt, Human
ugagcaagaccacuuggcucccuggcuucagu

SEQ ID NO: 512947 - RNA, 32 nt, Human
ugagcaagauuugggucucuccagaccucugg

SEQ ID NO: 512948 - RNA, 21 nt, Human
ugagcaagcagcucagggucu

SEQ ID NO: 512949 - RNA, 32 nt, Human
ugagcaagcguaucacaucugcccucccugca

SEQ ID NO: 512950 - RNA, 32 nt, Human
ugagcaaggccuucacugcagccccaucuccu

SEQ ID NO: 512951 - RNA, 32 nt, Human
ugagcaagggcugucugcagaaacccccauca

SEQ ID NO: 512952 - RNA, 32 nt, Human
ugagcaaucuguccuuccuagugaccauccag

SEQ ID NO: 512953 - RNA, 32 nt, Human
ugagcaaugaggaggaguggaaaacaaaaccc

SEQ ID NO: 512954 - RNA, 32 nt, Human
ugagcaaugcaaccuaaugacacccggagcuc

SEQ ID NO: 512955 - RNA, 23 nt, Human
ugagcaaugcuugauugauucua

SEQ ID NO: 512956 - RNA, 32 nt, Human
ugagcaauguggugaaaccccaucucuacuaa

SEQ ID NO: 512957 - RNA, 32 nt, Human
ugagcaauguuaacuguuaacacugcccaagg

SEQ ID NO: 512958 - RNA, 32 nt, Human
ugagcaauuugaaugacuuaacacagugucau

SEQ ID NO: 512959 - RNA, 21 nt, Human
ugagcacaaagcccgcucugu

SEQ ID NO: 512960 - RNA, 32 nt, Human
ugagcacaacuuuauggcuuacacaggguagu

SEQ ID NO: 512961 - RNA, 32 nt, Human
ugagcacaaugccaaccuuaguguuucuccag

SEQ ID NO: 512962 - RNA, 32 nt, Human
ugagcacaaugccaucacuuaacuauaacucu

SEQ ID NO: 512963 - RNA, 32 nt, Human
ugagcacacaauuaugcaaauauuuuaauguu

SEQ ID NO: 512964 - RNA, 32 nt, Human
ugagcacacagcaaugguaucaccuagagaag

SEQ ID NO: 512965 - RNA, 32 nt, Human
ugagcacacccagcaaaguccacccaggaaaa

SEQ ID NO: 512966 - RNA, 32 nt, Human
ugagcacagaugaucaacagaaaauccaagca

SEQ ID NO: 512967 - RNA, 32 nt, Human
ugagcacagcacagugccuggcacacagcaaa

SEQ ID NO: 512968 - RNA, 32 nt, Human
ugagcacaggagacggagguugcugugagcug

SEQ ID NO: 512969 - RNA, 32 nt, Human
ugagcacaggaguucaagaccagcgugggcaa

SEQ ID NO: 512970 - RNA, 32 nt, Human
ugagcacauaagcagaggcugcaggaacuugu

SEQ ID NO: 512971 - RNA, 32 nt, Human
ugagcacaugagauuuggaggggccaggggcg

SEQ ID NO: 512972 - RNA, 32 nt, Human
ugagcaccacugcacuaagccagugcggagcu

SEQ ID NO: 512973 - RNA, 32 nt, Human
ugagcaccagcacuuccagcgcuucacuuaac

SEQ ID NO: 512974 - RNA, 32 nt, Human
ugagcaccagggcauccucuaggcgccaggac

SEQ ID NO: 512975 - RNA, 32 nt, Human
ugagcacccaggagucugggcccaggggccag

SEQ ID NO: 512976 - RNA, 32 nt, Human
ugagcacccugcagcccccacccaagauggcc

SEQ ID NO: 512977 - RNA, 32 nt, Human
ugagcaccgugcagucggccucccaggccaug

SEQ ID NO: 512978 - RNA, 32 nt, Human
ugagcaccuccaggagccucaguuucgccuuu

SEQ ID NO: 512979 - RNA, 32 nt, Human
ugagcaccucccagguuccaagcccugggcca

SEQ ID NO: 512980 - RNA, 32 nt, Human
ugagcaccuccccucugagcacuucccuugug

SEQ ID NO: 512981 - RNA, 32 nt, Human
ugagcaccuggggaucccaggaacccugguca

SEQ ID NO: 512982 - RNA, 18 nt, Human
ugagcaccuguaauccca

SEQ ID NO: 512983 - RNA, 32 nt, Human
ugagcaccuguaaucccagcuacucuggaggc

SEQ ID NO: 512984 - RNA, 18 nt, Human
ugagcaccuguaauccua

SEQ ID NO: 512985 - RNA, 32 nt, Human
ugagcaccuguaauccuagcuacuugggaggc

SEQ ID NO: 512986 - RNA, 32 nt, Human
ugagcaccuuucuccccuccccucuuuccuca

SEQ ID NO: 512987 - RNA, 32 nt, Human
ugagcacgucuucuccaaccuggagccugcca

SEQ ID NO: 512988 - RNA, 32 nt, Human
ugagcacuauuaaaauacaugcauuggcucaa

SEQ ID NO: 512989 - RNA, 32 nt, Human
ugagcacucccagguccucagcacucccaggu

SEQ ID NO: 512990 - RNA, 32 nt, Human
ugagcacucuacuggcugucccugagccucua

SEQ ID NO: 512991 - RNA, 32 nt, Human
ugagcacugaguagcagguucuggagacuacc

SEQ ID NO: 512992 - RNA, 32 nt, Human
ugagcacugcucauguguggaugccccugcaa

SEQ ID NO: 512993 - RNA, 22 nt, Human
ugagcacugcucccagcucugu

SEQ ID NO: 512994 - RNA, 32 nt, Human
ugagcacugcucccagcucuguuuuuguuuuu

SEQ ID NO: 512995 - RNA, 32 nt, Human
ugagcacuguaaccaguccaguugcuucugga

SEQ ID NO: 512996 - RNA, 32 nt, Human
ugagcacuguaggcaagagggaagaaagagaa

SEQ ID NO: 512997 - RNA, 32 nt, Human
ugagcacuuagggcaucaggaacagugcuacu

SEQ ID NO: 512998 - RNA, 32 nt, Human
ugagcacuuccguggacugaaggaaccguagg

SEQ ID NO: 512999 - RNA, 32 nt, Human
ugagcacuugaaauugaguuauugagcacuga

SEQ ID NO: 513000 - RNA, 32 nt, Human
ugagcacuuuaaaaucugaacuuucaaagcuu

SEQ ID NO: 513001 - RNA, 32 nt, Human
ugagcagaaaagagcacugagagcacuuggga

SEQ ID NO: 513002 - RNA, 32 nt, Human
ugagcagaaaggcccuguucaaagcacacagc

SEQ ID NO: 513003 - RNA, 32 nt, Human
ugagcagaacuccuaugcagccugagagaagu

SEQ ID NO: 513004 - RNA, 32 nt, Human
ugagcagaagacggcugugccacccacguaug

SEQ ID NO: 513005 - RNA, 32 nt, Human
ugagcagaagcauaacaaaugcaaaugaagag

SEQ ID NO: 513006 - RNA, 31 nt, Human
ugagcagaaguagagaagaaagacuguaugu

SEQ ID NO: 513007 - RNA, 32 nt, Human
ugagcagacccaccuccuccagcuuggguggc

SEQ ID NO: 513008 - RNA, 32 nt, Human
ugagcagaccuggcucaccacaggguccuacu

SEQ ID NO: 513009 - RNA, 32 nt, Human
ugagcagacucuccagcagacucuccagcccu

SEQ ID NO: 513010 - RNA, 32 nt, Human
ugagcagagaacacagcaaauuuguccagacu

SEQ ID NO: 513011 - RNA, 32 nt, Human
ugagcagagacuccacagacacccuaaaaagg

SEQ ID NO: 513012 - RNA, 32 nt, Human
ugagcagagcccauccaggacacuccacacug

SEQ ID NO: 513013 - RNA, 32 nt, Human
ugagcagaggagaaaaucagaaagauggcuua

SEQ ID NO: 513014 - RNA, 23 nt, Human
ugagcagauacaggaguggggag

SEQ ID NO: 513015 - RNA, 32 nt, Human
ugagcagauagaaaucugcaguguuggcagau

SEQ ID NO: 513016 - RNA, 32 nt, Human
ugagcagaucucuguggguguggagcuuguug

SEQ ID NO: 513017 - RNA, 32 nt, Human
ugagcagaugcuggagaacuagccagggagau

SEQ ID NO: 513018 - RNA, 32 nt, Human
ugagcagcaccaucccagcccuggggccugcu

SEQ ID NO: 513019 - RNA, 32 nt, Human
ugagcagcagagggccggccacaagcgagugu

SEQ ID NO: 513020 - RNA, 32 nt, Human
ugagcagcagauagagacacaggccugugguc

SEQ ID NO: 513021 - RNA, 32 nt, Human
ugagcagcagcagcaagcaucacuuugggcuu

SEQ ID NO: 513022 - RNA, 32 nt, Human
ugagcagcagggagagacagagacuggacaug

SEQ ID NO: 513023 - RNA, 32 nt, Human
ugagcagcauuuucauagggaccgacuucagu

SEQ ID NO: 513024 - RNA, 32 nt, Human
ugagcagccacacucgcaccuccugggugcug

SEQ ID NO: 513025 - RNA, 32 nt, Human
ugagcagccucgugccugucuccuuugcuaca

SEQ ID NO: 513026 - RNA, 32 nt, Human
ugagcagccugacuguagcccagaaucaccau

SEQ ID NO: 513027 - RNA, 32 nt, Human
ugagcagccuggugguacuggccacgccccuc

SEQ ID NO: 513028 - RNA, 32 nt, Human
ugagcagcugugguaauguacuuccaaagccc

SEQ ID NO: 513029 - RNA, 32 nt, Human
ugagcagcuucucaacaugaacuacagccucc

SEQ ID NO: 513030 - RNA, 32 nt, Human
ugagcagcuucuuuuaaauagcaacaccgagg

SEQ ID NO: 513031 - RNA, 32 nt, Human
ugagcagcuugaugguuucuccuugccccauu

SEQ ID NO: 513032 - RNA, 32 nt, Human
ugagcaggaagcucauguauguuugcauuuca

SEQ ID NO: 513033 - RNA, 32 nt, Human
ugagcaggacagccagcagcaggaugggcuga

SEQ ID NO: 513034 - RNA, 22 nt, Human
ugagcaggagaaccgcuggaac

SEQ ID NO: 513035 - RNA, 32 nt, Human
ugagcaggagauuuugcucuuguguugagacc

SEQ ID NO: 513036 - RNA, 32 nt, Human
ugagcaggaggaagaggaggaggcccguuggc

SEQ ID NO: 513037 - RNA, 32 nt, Human
ugagcaggagggagaggaaggggguccuguag

SEQ ID NO: 513038 - RNA, 31 nt, Human
ugagcaggcagcucugggcaugugucugguc

SEQ ID NO: 513039 - RNA, 32 nt, Human
ugagcaggcaugcucacagauccucaagguuu

SEQ ID NO: 513040 - RNA, 32 nt, Human
ugagcaggccacacuucaaacuacuuugcugc

SEQ ID NO: 513041 - RNA, 32 nt, Human
ugagcaggcccucacugucacuuuaagaaggg

SEQ ID NO: 513042 - RNA, 32 nt, Human
ugagcaggcggcagaggaaaagaaagaaaucu

SEQ ID NO: 513043 - RNA, 32 nt, Human
ugagcaggcucauuuuaaagggacuugcaaau

SEQ ID NO: 513044 - RNA, 32 nt, Human
ugagcagggaaaggacuuggaaaggaauaauu

SEQ ID NO: 513045 - RNA, 32 nt, Human
ugagcagggcccugcagccuggcuggcuggcg

SEQ ID NO: 513046 - RNA, 32 nt, Human
ugagcagggccuccucuuccuccugguguuug

SEQ ID NO: 513047 - RNA, 32 nt, Human
ugagcaggggacgguggcaggagcgccccagc

SEQ ID NO: 513048 - RNA, 32 nt, Human
ugagcaggggagcaacugagcaggaagaggau

SEQ ID NO: 513049 - RNA, 32 nt, Human
ugagcaggggcuuccaggcugcaugaggcuca

SEQ ID NO: 513050 - RNA, 32 nt, Human
ugagcagggugaggagcagcugccagccccgg

SEQ ID NO: 513051 - RNA, 32 nt, Human
ugagcaggguucccaggagggagaaagagaag

SEQ ID NO: 513052 - RNA, 32 nt, Human
ugagcaggguuccugugguuucccuggucccu

SEQ ID NO: 513053 - RNA, 32 nt, Human
ugagcaggugagcccccgcuuccuccgagccu

SEQ ID NO: 513054 - RNA, 32 nt, Human
ugagcaggugggcguggauguggauacugccu

SEQ ID NO: 513055 - RNA, 32 nt, Human
ugagcagucacuuuggagagaagcccugugaa

SEQ ID NO: 513056 - RNA, 32 nt, Human
ugagcagucuagccuggaugacauauuuuucg

SEQ ID NO: 513057 - RNA, 32 nt, Human
ugagcagugaaugauucaguguuaaaugugau

SEQ ID NO: 513058 - RNA, 32 nt, Human
ugagcagugacagcuccaccacugcacccagg

SEQ ID NO: 513059 - RNA, 31 nt, Human
ugagcagugaggagagaaaguuucugccugg

SEQ ID NO: 513060 - RNA, 32 nt, Human
ugagcagugcaggagcagggcgagaggaacag

SEQ ID NO: 513061 - RNA, 32 nt, Human
ugagcaguggcugaagcgaugcagccuugaga

SEQ ID NO: 513062 - RNA, 32 nt, Human
ugagcaguuauauuuuaaugcauuucaguguu

SEQ ID NO: 513063 - RNA, 32 nt, Human
ugagcauaagaacugggauugcaggcgugagc

SEQ ID NO: 513064 - RNA, 32 nt, Human
ugagcauaccugucucagcuguuuggccaaug

SEQ ID NO: 513065 - RNA, 32 nt, Human
ugagcauagggaagcaacucucaguauuuugg

SEQ ID NO: 513066 - RNA, 32 nt, Human
ugagcaucaacaacaaaaacauuuguaugaua

SEQ ID NO: 513067 - RNA, 32 nt, Human
ugagcaucaaguccucacccagacccccugcu

SEQ ID NO: 513068 - RNA, 23 nt, Human
ugagcaucacuagugacaagucu

SEQ ID NO: 513069 - RNA, 32 nt, Human
ugagcaucagagaguguacaucauguuauuuu

SEQ ID NO: 513070 - RNA, 32 nt, Human
ugagcauccuggcugggccccacccaggaaga

SEQ ID NO: 513071 - RNA, 32 nt, Human
ugagcauccuguuugcugacaucgagggcuga

SEQ ID NO: 513072 - RNA, 32 nt, Human
ugagcaucgcaucaccaaacacugccuuuauu

SEQ ID NO: 513073 - RNA, 32 nt, Human
ugagcaucuccucuucuugaaggccaaccugg

SEQ ID NO: 513074 - RNA, 19 nt, Human
ugagcaucugaacaugcac

SEQ ID NO: 513075 - RNA, 32 nt, Human
ugagcaucuuagcuuagcaccaaccaacacag

SEQ ID NO: 513076 - RNA, 32 nt, Human
ugagcaugccuaaauccauguucucuagaaug

SEQ ID NO: 513077 - RNA, 32 nt, Human
ugagcauggaaccugagcaaagggaauaggug

SEQ ID NO: 513078 - RNA, 30 nt, Human
ugagcauggcccucccagcccugggccugg

SEQ ID NO: 513079 - RNA, 32 nt, Human
ugagcauggcuggcaggggcagcugcuguggc

SEQ ID NO: 513080 - RNA, 32 nt, Human
ugagcaugggaccauugggagcagagcugaua

SEQ ID NO: 513081 - RNA, 32 nt, Human
ugagcaugggaggcagagguugcagugagcca

SEQ ID NO: 513082 - RNA, 32 nt, Human
ugagcauggggugcaggagccuuucuggauuu

SEQ ID NO: 513083 - RNA, 32 nt, Human
ugagcauguagugcuuugcacgccacagaagc

SEQ ID NO: 513084 - RNA, 32 nt, Human
ugagcauguggagcgagagggaggcaggugga

SEQ ID NO: 513085 - RNA, 32 nt, Human
ugagcaugugugugucaaccugugagcaugca

SEQ ID NO: 513086 - RNA, 32 nt, Human
ugagcaugugugugugcauguaccggggaaug

SEQ ID NO: 513087 - RNA, 16 nt, Human
ugagcauuacuuucau

SEQ ID NO: 513088 - RNA, 23 nt, Human
ugagcauugugguaguuguucuu

SEQ ID NO: 513089 - RNA, 32 nt, Human
ugagcauuuaaaacaugaaaacacucuuguuu

SEQ ID NO: 513090 - RNA, 32 nt, Human
ugagcauuuucucaacucgacucucauuucuu

SEQ ID NO: 513091 - RNA, 32 nt, Human
ugagccaaaaucauaacacugcacuccaggcu

SEQ ID NO: 513092 - RNA, 32 nt, Human
ugagccaaagcccaggcucccuuugggaauca

SEQ ID NO: 513093 - RNA, 32 nt, Human
ugagccaaauagaaaugaggccaagagugcuu

SEQ ID NO: 513094 - RNA, 32 nt, Human
ugagccaacagcuguaaggguccaggucugca

SEQ ID NO: 513095 - RNA, 32 nt, Human
ugagccaacuccugaguuuugcuauacuuaag

SEQ ID NO: 513096 - RNA, 32 nt, Human
ugagccaagaucacgacacugcacuccagccu

SEQ ID NO: 513097 - RNA, 32 nt, Human
ugagccaagaucgcgccacugcaguccagccu

SEQ ID NO: 513098 - RNA, 32 nt, Human
ugagccaagaucgugacacugcacuccagccu

SEQ ID NO: 513099 - RNA, 32 nt, Human
ugagccaagauugugacacugcacuccagccu

SEQ ID NO: 513100 - RNA, 32 nt, Human
ugagccaagccugaggggacagugagucucca

SEQ ID NO: 513101 - RNA, 32 nt, Human
ugagccaagccuugcuuuugcaccggccgggc

SEQ ID NO: 513102 - RNA, 21 nt, Human
ugagccaaggagcuggcccau

SEQ ID NO: 513103 - RNA, 32 nt, Human
ugagccaaggaguucaagaccaacuugggcaa

SEQ ID NO: 513104 - RNA, 32 nt, Human
ugagccaaggaguucaagaccagccugggcaa

SEQ ID NO: 513105 - RNA, 32 nt, Human
ugagccaagggaagagagacaggcuaggaguu

SEQ ID NO: 513106 - RNA, 32 nt, Human
ugagccaaucccaccauaaugugaauaugcca

SEQ ID NO: 513107 - RNA, 32 nt, Human
ugagccacagaagcgggacuguggcagcaccg

SEQ ID NO: 513108 - RNA, 32 nt, Human
ugagccacaggucccugaagaguccgcagagg

SEQ ID NO: 513109 - RNA, 21 nt, Human
ugagccaccaacacccugccu

SEQ ID NO: 513110 - RNA, 19 nt, Human
ugagccaccacacccugcc

SEQ ID NO: 513111 - RNA, 32 nt, Human
ugagccaccacacuccaaccuaggugacagag

SEQ ID NO: 513112 - RNA, 24 nt, Human
ugagccaccaugccuggccaaaac

SEQ ID NO: 513113 - RNA, 24 nt, Human
ugagccaccaugccuggccccaug

SEQ ID NO: 513114 - RNA, 32 nt, Human
ugagccaccgcaccuggccagaagccacuaac

SEQ ID NO: 513115 - RNA, 32 nt, Human
ugagccaccgcaccuggccauuaugccacuaa

SEQ ID NO: 513116 - RNA, 24 nt, Human
ugagccaccgcgccuggccaaaac

SEQ ID NO: 513117 - RNA, 32 nt, Human
ugagccaccgggccuggccugcauuuucuuaa

SEQ ID NO: 513118 - RNA, 32 nt, Human
ugagccaccgugcccagccaaauguuuauuuu

SEQ ID NO: 513119 - RNA, 32 nt, Human
ugagccaccgugccugccccagaaugguuuuu

SEQ ID NO: 513120 - RNA, 32 nt, Human
ugagccaccucuccgccaggcccgugcgagcg

SEQ ID NO: 513121 - RNA, 32 nt, Human
ugagccaccucuuccuccacgggaaccgccug

SEQ ID NO: 513122 - RNA, 32 nt, Human
ugagccacgcagccccgccucuggggccgccu

SEQ ID NO: 513123 - RNA, 32 nt, Human
ugagccacggcaccuggccagaacucaguagu

SEQ ID NO: 513124 - RNA, 32 nt, Human
ugagccacggcaccuggccugaauuuuccuca

SEQ ID NO: 513125 - RNA, 32 nt, Human
ugagccacggcacuccacccugggcaacagag

SEQ ID NO: 513126 - RNA, 32 nt, Human
ugagccacucacccuucugcuggccuuggaga

SEQ ID NO: 513127 - RNA, 32 nt, Human
ugagccacugcacccacccaagacaagugauu

SEQ ID NO: 513128 - RNA, 32 nt, Human
ugagccacugcacccacccacgccuggcugau

SEQ ID NO: 513129 - RNA, 32 nt, Human
ugagccacugcacccagcaaugaguagucuua

SEQ ID NO: 513130 - RNA, 32 nt, Human
ugagccacugcacccagccaagugaucauuuu

SEQ ID NO: 513131 - RNA, 32 nt, Human
ugagccacugcacccagcccucuuagccauuu

SEQ ID NO: 513132 - RNA, 32 nt, Human
ugagccacugcacccagccgagugagaauuuu

SEQ ID NO: 513133 - RNA, 32 nt, Human
ugagccacugcacccagccgauaggaaguuua

SEQ ID NO: 513134 - RNA, 32 nt, Human
ugagccacugcacccagccuauucuaugcauu

SEQ ID NO: 513135 - RNA, 32 nt, Human
ugagccacugcacccagccucauguugacccu

SEQ ID NO: 513136 - RNA, 32 nt, Human
ugagccacugcacccagccugggagagggguu

SEQ ID NO: 513137 - RNA, 32 nt, Human
ugagccacugcacccagccuguaaaauauuuu

SEQ ID NO: 513138 - RNA, 32 nt, Human
ugagccacugcacccagccugugauguuucug

SEQ ID NO: 513139 - RNA, 32 nt, Human
ugagccacugcacccagccuuggcgggcaucu

SEQ ID NO: 513140 - RNA, 32 nt, Human
ugagccacugcacccagcugagagugcuucuu

SEQ ID NO: 513141 - RNA, 32 nt, Human
ugagccacugcacccggccgguggaaagcauu

SEQ ID NO: 513142 - RNA, 32 nt, Human
ugagccacugcacccggccgugaccaacauuc

SEQ ID NO: 513143 - RNA, 32 nt, Human
ugagccacugcacccggccuccaagccagcau

SEQ ID NO: 513144 - RNA, 32 nt, Human
ugagccacugcaccugaccuaagaggaagcag

SEQ ID NO: 513145 - RNA, 32 nt, Human
ugagccacugcaccugaccugcugaauuguuu

SEQ ID NO: 513146 - RNA, 32 nt, Human
ugagccacugcaccugcccagcuccccaacuc

SEQ ID NO: 513147 - RNA, 32 nt, Human
ugagccacugcaccuggcagugaugucauucc

SEQ ID NO: 513148 - RNA, 32 nt, Human
ugagccacugcaccuggccaugguuaguuguu

SEQ ID NO: 513149 - RNA, 32 nt, Human
ugagccacugcaccuggccuaggacugguguc

SEQ ID NO: 513150 - RNA, 32 nt, Human
ugagccacugcaccuggccucuguugcagucu

SEQ ID NO: 513151 - RNA, 32 nt, Human
ugagccacugcaccuggccuggagcucaguuc

SEQ ID NO: 513152 - RNA, 32 nt, Human
ugagccacugcaccuggccuguguauuguuug

SEQ ID NO: 513153 - RNA, 32 nt, Human
ugagccacugcacuccaaucugggugacagaa

SEQ ID NO: 513154 - RNA, 32 nt, Human
ugagccacugcacuccagccucggccacagug

SEQ ID NO: 513155 - RNA, 32 nt, Human
ugagccacugcacuccagccugaugacagagc

SEQ ID NO: 513156 - RNA, 32 nt, Human
ugagccacugcacuccagccugggcaauagag

SEQ ID NO: 513157 - RNA, 32 nt, Human
ugagccacugcacuccagccugggugacagcg

SEQ ID NO: 513158 - RNA, 32 nt, Human
ugagccacugcacuccagccugggugacugag

SEQ ID NO: 513159 - RNA, 32 nt, Human
ugagccacugcgcccagucuacacacuaauuc

SEQ ID NO: 513160 - RNA, 32 nt, Human
ugagccacugcgccuggccaaaugcucuacuu

SEQ ID NO: 513161 - RNA, 32 nt, Human
ugagccacugguuuguggguaugucauuucca

SEQ ID NO: 513162 - RNA, 32 nt, Human
ugagccacugugcccagccucacagcugcauc

SEQ ID NO: 513163 - RNA, 32 nt, Human
ugagccacugugcccaggcugugggcaccagg

SEQ ID NO: 513164 - RNA, 32 nt, Human
ugagccacugugcuuggccacacacauauaca

SEQ ID NO: 513165 - RNA, 32 nt, Human
ugagccacuguguccagccuguaacuauuauu

SEQ ID NO: 513166 - RNA, 32 nt, Human
ugagccagaaccaggcaccaugguggagaagg

SEQ ID NO: 513167 - RNA, 32 nt, Human
ugagccagaauacuuggaggaacuuccuacaa

SEQ ID NO: 513168 - RNA, 32 nt, Human
ugagccagacuggauuaggaugccucgcgacu

SEQ ID NO: 513169 - RNA, 32 nt, Human
ugagccagacuggggcuaagucagccaggcag

SEQ ID NO: 513170 - RNA, 32 nt, Human
ugagccagagcacugucucagcauuugaaccg

SEQ ID NO: 513171 - RNA, 32 nt, Human
ugagccagauuauggaggauucugugacucuu

SEQ ID NO: 513172 - RNA, 19 nt, Human
ugagccagccuccucccag

SEQ ID NO: 513173 - RNA, 32 nt, Human
ugagccaggaagguugagguugcagugagcua

SEQ ID NO: 513174 - RNA, 32 nt, Human
ugagccaggacugugacacugcacuccagccu

SEQ ID NO: 513175 - RNA, 32 nt, Human
ugagccaggaggaggagguugcagugagccga

SEQ ID NO: 513176 - RNA, 32 nt, Human
ugagccaggaggaucgcuugagcccaggaggc

SEQ ID NO: 513177 - RNA, 32 nt, Human
ugagccaggagguugagguugcagugagcuga

SEQ ID NO: 513178 - RNA, 32 nt, Human
ugagccaggaucccucuuugcacagcaugagg

SEQ ID NO: 513179 - RNA, 32 nt, Human
ugagccaggcagcagagcacucgcugcugugu

SEQ ID NO: 513180 - RNA, 32 nt, Human
ugagccaggcagggucugggauccucagggcu

SEQ ID NO: 513181 - RNA, 32 nt, Human
ugagccaggcccugggcugggccuccacuuca

SEQ ID NO: 513182 - RNA, 32 nt, Human
ugagccaggcccugggcugggugcagggacac

SEQ ID NO: 513183 - RNA, 32 nt, Human
ugagccaggcggauagcuugagcucagggggc

SEQ ID NO: 513184 - RNA, 32 nt, Human
ugagccaggcuggggacaguggggcugagggu

SEQ ID NO: 513185 - RNA, 32 nt, Human
ugagccaggcuggugccggggagcagaugcgu

SEQ ID NO: 513186 - RNA, 32 nt, Human
ugagccaggcuggugccggggagcagaugugg

SEQ ID NO: 513187 - RNA, 32 nt, Human
ugagccagggagguggaggcuacagugagcca

SEQ ID NO: 513188 - RNA, 32 nt, Human
ugagccagggccagcggagaaacacuaaagaa

SEQ ID NO: 513189 - RNA, 32 nt, Human
ugagccaggggaggggagggagcgaggggcuc

SEQ ID NO: 513190 - RNA, 32 nt, Human
ugagccagggucuugcuauguggcucaggcuc

SEQ ID NO: 513191 - RNA, 32 nt, Human
ugagccaggugauuugggagacccccuccuuc

SEQ ID NO: 513192 - RNA, 32 nt, Human
ugagccagguggagccacuugaggucaggugu

SEQ ID NO: 513193 - RNA, 32 nt, Human
ugagccagucagggaaaguggaguucugcagc

SEQ ID NO: 513194 - RNA, 32 nt, Human
ugagccauaaucgugccacugcaguccagccu

SEQ ID NO: 513195 - RNA, 32 nt, Human
ugagccaucccccaggaugacgccaccucuga

SEQ ID NO: 513196 - RNA, 32 nt, Human
ugagccaucucagcuucucaaccuugccuguu

SEQ ID NO: 513197 - RNA, 32 nt, Human
ugagccaugauauugccagccugggugacaga

SEQ ID NO: 513198 - RNA, 32 nt, Human
ugagccaugccaaugcacuccagucugggcaa

SEQ ID NO: 513199 - RNA, 32 nt, Human
ugagccaugccuugcccuuuucugaggcucag

SEQ ID NO: 513200 - RNA, 32 nt, Human
ugagccaugucccccagccuggcauggcugca

SEQ ID NO: 513201 - RNA, 32 nt, Human
ugagccauguucaugacacugcacuccagccu

SEQ ID NO: 513202 - RNA, 32 nt, Human
ugagccauuaauaccagcaaguagaagcuggg

SEQ ID NO: 513203 - RNA, 32 nt, Human
ugagccauucaaggcaagcaccaccuuugcua

SEQ ID NO: 513204 - RNA, 32 nt, Human
ugagccauucacacaucuucacccucaguuuc

SEQ ID NO: 513205 - RNA, 32 nt, Human
ugagccauugcucuccagccugggugacacag

SEQ ID NO: 513206 - RNA, 32 nt, Human
ugagcccaagaggcagagguugcagggucaag

SEQ ID NO: 513207 - RNA, 32 nt, Human
ugagcccaagagguagagguugcagugagcca

SEQ ID NO: 513208 - RNA, 32 nt, Human
ugagcccaagagguggagguuacagugagcag

SEQ ID NO: 513209 - RNA, 32 nt, Human
ugagcccaagagucggagaccagccugggcaa

SEQ ID NO: 513210 - RNA, 32 nt, Human
ugagcccaagaguucaagaccagccugggaaa

SEQ ID NO: 513211 - RNA, 32 nt, Human
ugagcccaagaguucaagaucagccugggcag

SEQ ID NO: 513212 - RNA, 32 nt, Human
ugagcccaagaguucagagcagccuggccacc

SEQ ID NO: 513213 - RNA, 32 nt, Human
ugagcccaagaguucauaucuagccuggucaa

SEQ ID NO: 513214 - RNA, 32 nt, Human
ugagcccaagaguuccagaccagccuggccac

SEQ ID NO: 513215 - RNA, 32 nt, Human
ugagcccaagaguucgagaccagccugggcaa

SEQ ID NO: 513216 - RNA, 32 nt, Human
ugagcccaagaguuggagaccagccugggcaa

SEQ ID NO: 513217 - RNA, 32 nt, Human
ugagcccaagaguuugagaccagccuagguga

SEQ ID NO: 513218 - RNA, 32 nt, Human
ugagcccaagaguuuuagaccagccugggcaa

SEQ ID NO: 513219 - RNA, 32 nt, Human
ugagcccacaaggacauuccugccuggggagc

SEQ ID NO: 513220 - RNA, 32 nt, Human
ugagcccaccagccccagcacugaccuccaag

SEQ ID NO: 513221 - RNA, 32 nt, Human
ugagcccacgagauggaaguugcagugaacug

SEQ ID NO: 513222 - RNA, 32 nt, Human
ugagcccacuuguugaaaccuccuucugcugg

SEQ ID NO: 513223 - RNA, 32 nt, Human
ugagcccagaagcucaaggcugcagugagcca

SEQ ID NO: 513224 - RNA, 32 nt, Human
ugagcccagaagcuggaaguugcaaugaacua

SEQ ID NO: 513225 - RNA, 32 nt, Human
ugagcccagaagcuugaagcugcagugagcua

SEQ ID NO: 513226 - RNA, 32 nt, Human
ugagcccagaaguucaagacuagccugggcaa

SEQ ID NO: 513227 - RNA, 32 nt, Human
ugagcccagaaguucaagggugcagugagcua

SEQ ID NO: 513228 - RNA, 32 nt, Human
ugagcccagaaguucgagguugcagugagcca

SEQ ID NO: 513229 - RNA, 32 nt, Human
ugagcccagaggcggagguugcagugagccga

SEQ ID NO: 513230 - RNA, 32 nt, Human
ugagcccagagguagaggcugcagugagccau

SEQ ID NO: 513231 - RNA, 32 nt, Human
ugagcccagagguucaagacuagccugggcaa

SEQ ID NO: 513232 - RNA, 32 nt, Human
ugagcccagcacugcggccaagucgaagacuu

SEQ ID NO: 513233 - RNA, 32 nt, Human
ugagcccagcaggcagagguugcagugagcug

SEQ ID NO: 513234 - RNA, 32 nt, Human
ugagcccagcaguucaagaccagccugggcaa

SEQ ID NO: 513235 - RNA, 32 nt, Human
ugagcccagcaguucaagacuagccuggacaa

SEQ ID NO: 513236 - RNA, 32 nt, Human
ugagcccagcaguucaaggcuacugugagcua

SEQ ID NO: 513237 - RNA, 32 nt, Human
ugagcccagccccagcccgggguccauugccc

SEQ ID NO: 513238 - RNA, 32 nt, Human
ugagcccaggaagcagagguugcagugagccu

SEQ ID NO: 513239 - RNA, 32 nt, Human
ugagcccaggaagcggagguuacagugagcug

SEQ ID NO: 513240 - RNA, 32 nt, Human
ugagcccaggaagcggagguugcaaugagccg

SEQ ID NO: 513241 - RNA, 32 nt, Human
ugagcccaggaaguggagguugcagugagcag

SEQ ID NO: 513242 - RNA, 32 nt, Human
ugagcccaggaauucaagaccagccugggcaa

SEQ ID NO: 513243 - RNA, 32 nt, Human
ugagcccaggaauucaagacuagccugcacaa

SEQ ID NO: 513244 - RNA, 32 nt, Human
ugagcccaggacuucaagaccagccuaggcaa

SEQ ID NO: 513245 - RNA, 32 nt, Human
ugagcccaggagaugcaggcuugcagugagcc

SEQ ID NO: 513246 - RNA, 32 nt, Human
ugagcccaggagauugaggcugcagugagcau

SEQ ID NO: 513247 - RNA, 32 nt, Human
ugagcccaggagauugaggcugcagugagcca

SEQ ID NO: 513248 - RNA, 32 nt, Human
ugagcccaggagcucaagaccagccuggacaa

SEQ ID NO: 513249 - RNA, 32 nt, Human
ugagcccaggagcucaagauugcagugagcua

SEQ ID NO: 513250 - RNA, 32 nt, Human
ugagcccaggagcuggaggcugcagugaacua

SEQ ID NO: 513251 - RNA, 32 nt, Human
ugagcccaggaggaagagaaagcauuguccag

SEQ ID NO: 513252 - RNA, 32 nt, Human
ugagcccaggaggaggaggcugcagugagcua

SEQ ID NO: 513253 - RNA, 32 nt, Human
ugagcccaggaggcagaauuugcagugagcug

SEQ ID NO: 513254 - RNA, 32 nt, Human
ugagcccaggaggcagaggcugcagugagcca

SEQ ID NO: 513255 - RNA, 32 nt, Human
ugagcccaggaggcagaggcugcagugagccg

SEQ ID NO: 513256 - RNA, 32 nt, Human
ugagcccaggaggcagagguugcaguaagccg

SEQ ID NO: 513257 - RNA, 32 nt, Human
ugagcccaggaggcagagguugcagugagcca

SEQ ID NO: 513258 - RNA, 32 nt, Human
ugagcccaggaggccaagguugcagugggccc

SEQ ID NO: 513259 - RNA, 32 nt, Human
ugagcccaggaggcggagauugcagugagccg

SEQ ID NO: 513260 - RNA, 32 nt, Human
ugagcccaggaggcggagcuugcagugagucg

SEQ ID NO: 513261 - RNA, 32 nt, Human
ugagcccaggaggcggaggcugcagugagcug

SEQ ID NO: 513262 - RNA, 32 nt, Human
ugagcccaggaggcggagguugcagugagcug

SEQ ID NO: 513263 - RNA, 32 nt, Human
ugagcccaggaggcugaggcugcaaugacuga

SEQ ID NO: 513264 - RNA, 32 nt, Human
ugagcccaggaggcugaggcugcagugcaucg

SEQ ID NO: 513265 - RNA, 32 nt, Human
ugagcccaggaggucaagacugcagugagcua

SEQ ID NO: 513266 - RNA, 32 nt, Human
ugagcccaggaggucaaggcuacagugagccg

SEQ ID NO: 513267 - RNA, 32 nt, Human
ugagcccaggaggucaaggcuauggugagccg

SEQ ID NO: 513268 - RNA, 32 nt, Human
ugagcccaggaggucaaggcugaagugagcug

SEQ ID NO: 513269 - RNA, 32 nt, Human
ugagcccaggaggucaaggcugcagugagccg

SEQ ID NO: 513270 - RNA, 32 nt, Human
ugagcccaggaggucaaggcugcagugagcug

SEQ ID NO: 513271 - RNA, 32 nt, Human
ugagcccaggaggucaaggcugcagugagcuu

SEQ ID NO: 513272 - RNA, 32 nt, Human
ugagcccaggaggucaaggguacagugagccg

SEQ ID NO: 513273 - RNA, 32 nt, Human
ugagcccaggaggucagggcugcagugagccg

SEQ ID NO: 513274 - RNA, 32 nt, Human
ugagcccaggaggucgaagcugcagugaggua

SEQ ID NO: 513275 - RNA, 32 nt, Human
ugagcccaggaggucgaggcugcagugagcca

SEQ ID NO: 513276 - RNA, 32 nt, Human
ugagcccaggaggucgaggcugcagugagccc

SEQ ID NO: 513277 - RNA, 32 nt, Human
ugagcccaggaggucgaggcugcagugagcua

SEQ ID NO: 513278 - RNA, 32 nt, Human
ugagcccaggaggucgaggcugcagugagcug

SEQ ID NO: 513279 - RNA, 32 nt, Human
ugagcccaggaggucgaggcugcagugggcca

SEQ ID NO: 513280 - RNA, 32 nt, Human
ugagcccaggaggucgaggcugcagugugcug

SEQ ID NO: 513281 - RNA, 32 nt, Human
ugagcccaggaggucgagguugcagugagcag

SEQ ID NO: 513282 - RNA, 32 nt, Human
ugagcccaggaggucuaggcugcagugagcuu

SEQ ID NO: 513283 - RNA, 32 nt, Human
ugagcccaggagguggaaacugcagagaguca

SEQ ID NO: 513284 - RNA, 32 nt, Human
ugagcccaggagguggaggcugcaaugagcug

SEQ ID NO: 513285 - RNA, 32 nt, Human
ugagcccaggagguggaggcugcagugagcca

SEQ ID NO: 513286 - RNA, 32 nt, Human
ugagcccaggagguggagguugcaaugagccg

SEQ ID NO: 513287 - RNA, 32 nt, Human
ugagcccaggagguggagguugcacugagcgg

SEQ ID NO: 513288 - RNA, 32 nt, Human
ugagcccaggagguggagguugcagugagcag

SEQ ID NO: 513289 - RNA, 32 nt, Human
ugagcccaggagguggagguugcagugagcca

SEQ ID NO: 513290 - RNA, 32 nt, Human
ugagcccaggagguggagguugcagugagccg

SEQ ID NO: 513291 - RNA, 32 nt, Human
ugagcccaggagguggagguugcagugagcgg

SEQ ID NO: 513292 - RNA, 32 nt, Human
ugagcccaggagguggagguugcagugagcug

SEQ ID NO: 513293 - RNA, 32 nt, Human
ugagcccaggagguggagguuucagcgagcug

SEQ ID NO: 513294 - RNA, 32 nt, Human
ugagcccaggagguugaggcugcagugaacua

SEQ ID NO: 513295 - RNA, 32 nt, Human
ugagcccaggagguugaggcugcagugagcag

SEQ ID NO: 513296 - RNA, 32 nt, Human
ugagcccaggagguugaggcugcagugagcca

SEQ ID NO: 513297 - RNA, 32 nt, Human
ugagcccaggagguugaggcugcagugagcua

SEQ ID NO: 513298 - RNA, 32 nt, Human
ugagcccaggagguugaggcugcagugaggua

SEQ ID NO: 513299 - RNA, 32 nt, Human
ugagcccaggagguugaggcugcagugaggug

SEQ ID NO: 513300 - RNA, 32 nt, Human
ugagcccaggagguugaggcugcagugaguuc

SEQ ID NO: 513301 - RNA, 32 nt, Human
ugagcccaggagguugaggucacagugagcug

SEQ ID NO: 513302 - RNA, 32 nt, Human
ugagcccaggagguuguggcugcagugagcug

SEQ ID NO: 513303 - RNA, 32 nt, Human
ugagcccaggagucuugagaccagccugggca

SEQ ID NO: 513304 - RNA, 32 nt, Human
ugagcccaggaguuaagaggcugcagugaccg

SEQ ID NO: 513305 - RNA, 32 nt, Human
ugagcccaggaguucaaaaccagccugggcaa

SEQ ID NO: 513306 - RNA, 32 nt, Human
ugagcccaggaguucaacaccagccugagcaa

SEQ ID NO: 513307 - RNA, 32 nt, Human
ugagcccaggaguucaacaccagcuugggcaa

SEQ ID NO: 513308 - RNA, 32 nt, Human
ugagcccaggaguucaagaacagccuggguaa

SEQ ID NO: 513309 - RNA, 32 nt, Human
ugagcccaggaguucaagaccaacaugggcaa

SEQ ID NO: 513310 - RNA, 32 nt, Human
ugagcccaggaguucaagaccaaccuggugaa

SEQ ID NO: 513311 - RNA, 32 nt, Human
ugagcccaggaguucaagaccacccugggcaa

SEQ ID NO: 513312 - RNA, 32 nt, Human
ugagcccaggaguucaagaccagccugagcaa

SEQ ID NO: 513313 - RNA, 32 nt, Human
ugagcccaggaguucaagaccagccuggacaa

SEQ ID NO: 513314 - RNA, 32 nt, Human
ugagcccaggaguucaagaccagccuggacag

SEQ ID NO: 513315 - RNA, 32 nt, Human
ugagcccaggaguucaagaccagccugggaac

SEQ ID NO: 513316 - RNA, 32 nt, Human
ugagcccaggaguucaagaccagccugggcaa

SEQ ID NO: 513317 - RNA, 32 nt, Human
ugagcccaggaguucaagaccagccugggcua

SEQ ID NO: 513318 - RNA, 32 nt, Human
ugagcccaggaguucaagaccagcuugggcaa

SEQ ID NO: 513319 - RNA, 32 nt, Human
ugagcccaggaguucaagaccagcuugugcaa

SEQ ID NO: 513320 - RNA, 32 nt, Human
ugagcccaggaguucaagaccagucugggcaa

SEQ ID NO: 513321 - RNA, 32 nt, Human
ugagcccaggaguucaagaccggccugagcaa

SEQ ID NO: 513322 - RNA, 32 nt, Human
ugagcccaggaguucaagacuagccuaggcaa

SEQ ID NO: 513323 - RNA, 32 nt, Human
ugagcccaggaguucaagagcagccugggcaa

SEQ ID NO: 513324 - RNA, 32 nt, Human
ugagcccaggaguucaaggccagccugggcaa

SEQ ID NO: 513325 - RNA, 32 nt, Human
ugagcccaggaguucaaggcugcaaugagcug

SEQ ID NO: 513326 - RNA, 32 nt, Human
ugagcccaggaguucaauaccugucugggaaa

SEQ ID NO: 513327 - RNA, 32 nt, Human
ugagcccaggaguucgacaccaaccugagcaa

SEQ ID NO: 513328 - RNA, 19 nt, Human
ugagcccaggaguucgaga

SEQ ID NO: 513329 - RNA, 32 nt, Human
ugagcccaggaguucgagaccaaccugggcaa

SEQ ID NO: 513330 - RNA, 32 nt, Human
ugagcccaggaguucgagaccaacuugggcaa

SEQ ID NO: 513331 - RNA, 32 nt, Human
ugagcccaggaguuugagguugcagugagcug

SEQ ID NO: 513332 - RNA, 32 nt, Human
ugagcccaggaguuugagguugcagugcacua

SEQ ID NO: 513333 - RNA, 32 nt, Human
ugagcccaggaguuuggaccagccugggcaac

SEQ ID NO: 513334 - RNA, 32 nt, Human
ugagcccaggaugcagagguugaagugagcca

SEQ ID NO: 513335 - RNA, 32 nt, Human
ugagcccaggcguucaagaccagccugggcaa

SEQ ID NO: 513336 - RNA, 32 nt, Human
ugagcccagggaggucaaggcugcagugagca

SEQ ID NO: 513337 - RNA, 32 nt, Human
ugagcccagggguucaagaccaaucugggcaa

SEQ ID NO: 513338 - RNA, 32 nt, Human
ugagcccagguauucaagaccagccugggaaa

SEQ ID NO: 513339 - RNA, 32 nt, Human
ugagcccaucuuggcagggcucagggggcagc

SEQ ID NO: 513340 - RNA, 32 nt, Human
ugagcccaugaagucaggcugcagugagcugu

SEQ ID NO: 513341 - RNA, 32 nt, Human
ugagccccagaaguuaucuccaaaaagggaua

SEQ ID NO: 513342 - RNA, 32 nt, Human
ugagccccagaggcagagguuguggugagccg

SEQ ID NO: 513343 - RNA, 32 nt, Human
ugagccccagaggucaaggcugcagugagcug

SEQ ID NO: 513344 - RNA, 32 nt, Human
ugagccccagaguucaagaccagccugggcaa

SEQ ID NO: 513345 - RNA, 32 nt, Human
ugagccccagcacccgugagcucaccagugua

SEQ ID NO: 513346 - RNA, 32 nt, Human
ugagccccagcagacgccuggguggugucucc

SEQ ID NO: 513347 - RNA, 32 nt, Human
ugagccccagccccaauccagagaagcgcugu

SEQ ID NO: 513348 - RNA, 32 nt, Human
ugagccccaggccaggaggcuguuccaggagu

SEQ ID NO: 513349 - RNA, 32 nt, Human
ugagccccagggguggaggcugcaaugaacug

SEQ ID NO: 513350 - RNA, 32 nt, Human
ugagccccaggucaguccccagcccucugggu

SEQ ID NO: 513351 - RNA, 32 nt, Human
ugagcccccaacagagcucuucaucuuaccgg

SEQ ID NO: 513352 - RNA, 32 nt, Human
ugagcccccaaccaccuccaccuuucucucug

SEQ ID NO: 513353 - RNA, 21 nt, Human
ugagcccccacacccacccua

SEQ ID NO: 513354 - RNA, 32 nt, Human
ugagcccccagccccuggaauaugcagcccgg

SEQ ID NO: 513355 - RNA, 32 nt, Human
ugagcccccucccccugaccucagcuuccugc

SEQ ID NO: 513356 - RNA, 32 nt, Human
ugagcccccugccuuggcuccagguugguaga

SEQ ID NO: 513357 - RNA, 32 nt, Human
ugagccccgcuguuaccagccgagucugcaca

SEQ ID NO: 513358 - RNA, 32 nt, Human
ugagccccgggggcugagguugcugugagccg

SEQ ID NO: 513359 - RNA, 32 nt, Human
ugagccccuaacccugauccagggaucguuga

SEQ ID NO: 513360 - RNA, 32 nt, Human
ugagccccucaauccuaucacagucuacugac

SEQ ID NO: 513361 - RNA, 32 nt, Human
ugagccccugcacuucugugucgcaggagcug

SEQ ID NO: 513362 - RNA, 32 nt, Human
ugagccccugcagaggcugagcagggagaggg

SEQ ID NO: 513363 - RNA, 32 nt, Human
ugagccccugcagccuccucagccugugcagu

SEQ ID NO: 513364 - RNA, 18 nt, Human
ugagccccuguaauccca

SEQ ID NO: 513365 - RNA, 21 nt, Human
ugagccccuguaaucccagcu

SEQ ID NO: 513366 - RNA, 32 nt, Human
ugagccccuguaaucccagcuacuugggaggc

SEQ ID NO: 513367 - RNA, 32 nt, Human
ugagccccuugcuggaggguucuggggagugg

SEQ ID NO: 513368 - RNA, 32 nt, Human
ugagcccgagagacagagguugcagugagccg

SEQ ID NO: 513369 - RNA, 32 nt, Human
ugagcccgagagguggagacugcaguaagcca

SEQ ID NO: 513370 - RNA, 32 nt, Human
ugagcccgagagguggaggcuggagugaacag

SEQ ID NO: 513371 - RNA, 32 nt, Human
ugagcccggaaggcagagguugcagugagcug

SEQ ID NO: 513372 - RNA, 32 nt, Human
ugagcccggaaggcggagguugcagugagcug

SEQ ID NO: 513373 - RNA, 32 nt, Human
ugagcccggaaggugguccugacagcgagggg

SEQ ID NO: 513374 - RNA, 32 nt, Human
ugagcccggagucuggagcagagcaggccacc

SEQ ID NO: 513375 - RNA, 32 nt, Human
ugagcccggcagaggcagagacacacgcggag

SEQ ID NO: 513376 - RNA, 32 nt, Human
ugagcccggcgccgggaggaguggucuaaacu

SEQ ID NO: 513377 - RNA, 32 nt, Human
ugagcccgggaagcagagguugcagugaacug

SEQ ID NO: 513378 - RNA, 32 nt, Human
ugagcccgggaaguggagguugcacugagcug

SEQ ID NO: 513379 - RNA, 32 nt, Human
ugagcccgggaggcagaggcugcagugaacca

SEQ ID NO: 513380 - RNA, 32 nt, Human
ugagcccgggaggcagagguugcagugagcca

SEQ ID NO: 513381 - RNA, 32 nt, Human
ugagcccgggaggcagagguugcagugagccg

SEQ ID NO: 513382 - RNA, 32 nt, Human
ugagcccgggaggcggagauugcggugagcca

SEQ ID NO: 513383 - RNA, 32 nt, Human
ugagcccgggaggcggagcuuacagugagcug

SEQ ID NO: 513384 - RNA, 32 nt, Human
ugagcccgggaggcggagcuugcagugagcug

SEQ ID NO: 513385 - RNA, 32 nt, Human
ugagcccgggaggcggagcuugcggugggccg

SEQ ID NO: 513386 - RNA, 32 nt, Human
ugagcccgggaggcggagguugcagugagcug

SEQ ID NO: 513387 - RNA, 32 nt, Human
ugagcccgggaggucaagguugcagugaguca

SEQ ID NO: 513388 - RNA, 31 nt, Human
ugagcccgucucucugggcuguaucuccuca

SEQ ID NO: 513389 - RNA, 23 nt, Human
ugagcccucaccagaaucacccu

SEQ ID NO: 513390 - RNA, 32 nt, Human
ugagcccuccccuccacccccugaagccacuc

SEQ ID NO: 513391 - RNA, 32 nt, Human
ugagcccucccucuucccagcacaggcagggg

SEQ ID NO: 513392 - RNA, 32 nt, Human
ugagcccucggggccuccuccugggccucagc

SEQ ID NO: 513393 - RNA, 32 nt, Human
ugagcccugaaagucgagguugcagugagccu

SEQ ID NO: 513394 - RNA, 32 nt, Human
ugagcccugaguggaagccuuucugugccuug

SEQ ID NO: 513395 - RNA, 32 nt, Human
ugagcccugaugcuguaaggauucacaucaga

SEQ ID NO: 513396 - RNA, 32 nt, Human
ugagcccugcagcugccauccugccuggcagg

SEQ ID NO: 513397 - RNA, 32 nt, Human
ugagcccugcaggaguucgagaccaggcuggg

SEQ ID NO: 513398 - RNA, 32 nt, Human
ugagcccugccaccaucccgugaaccaccgaa

SEQ ID NO: 513399 - RNA, 32 nt, Human
ugagcccugccugggcuccacacccagagagu

SEQ ID NO: 513400 - RNA, 32 nt, Human
ugagcccugcucccucugccacuguggacaca

SEQ ID NO: 513401 - RNA, 32 nt, Human
ugagcccugcuguauuugucuguguugacaac

SEQ ID NO: 513402 - RNA, 32 nt, Human
ugagcccuggaaaauuacuuaguggaaaggca

SEQ ID NO: 513403 - RNA, 32 nt, Human
ugagcccuggaaccuccgcucagagaagauga

SEQ ID NO: 513404 - RNA, 32 nt, Human
ugagcccuggaguuggagguugcagugagcag

SEQ ID NO: 513405 - RNA, 32 nt, Human
ugagcccuggcggcagagguugcagugagcca

SEQ ID NO: 513406 - RNA, 32 nt, Human
ugagcccugggagggcccaggagccagaccuc

SEQ ID NO: 513407 - RNA, 32 nt, Human
ugagcccugggcaggggugguggguaccagag

SEQ ID NO: 513408 - RNA, 32 nt, Human
ugagcccuggggaacaggaaagcguggcuggc

SEQ ID NO: 513409 - RNA, 32 nt, Human
ugagcccuggggacccuuggagaaauuaggug

SEQ ID NO: 513410 - RNA, 32 nt, Human
ugagcccuguaaccuggcucuagggcacaggc

SEQ ID NO: 513411 - RNA, 32 nt, Human
ugagccgaaguguauggaagaguugccugagu

SEQ ID NO: 513412 - RNA, 32 nt, Human
ugagccgaaguuaauuucucggggaguucucg

SEQ ID NO: 513413 - RNA, 32 nt, Human
ugagccgacagccucagcucccugccaggcca

SEQ ID NO: 513414 - RNA, 32 nt, Human
ugagccgagacugugcuccagccugggcgaca

SEQ ID NO: 513415 - RNA, 32 nt, Human
ugagccgagaucaugacacugcacuccagccu

SEQ ID NO: 513416 - RNA, 32 nt, Human
ugagccgagaucaugccauuacuccagccugg

SEQ ID NO: 513417 - RNA, 32 nt, Human
ugagccgagauggugccacugcaccaucugga

SEQ ID NO: 513418 - RNA, 32 nt, Human
ugagccgagauggugccacugcacuccagccu

SEQ ID NO: 513419 - RNA, 32 nt, Human
ugagccgagauggugccacugcauuccagccu

SEQ ID NO: 513420 - RNA, 32 nt, Human
ugagccgagauggugccguugcacuccagccg

SEQ ID NO: 513421 - RNA, 32 nt, Human
ugagccgagauuacuccagccuaggcaacaga

SEQ ID NO: 513422 - RNA, 32 nt, Human
ugagccgagauuggccauugcacuccagccug

SEQ ID NO: 513423 - RNA, 32 nt, Human
ugagccgaggaguucaagaccagccuggguau

SEQ ID NO: 513424 - RNA, 32 nt, Human
ugagccgaggcauuccagccugggcaacagag

SEQ ID NO: 513425 - RNA, 32 nt, Human
ugagccgaggggguggggguugcagugagcca

SEQ ID NO: 513426 - RNA, 32 nt, Human
ugagccgcacuuccggugugagccgcacuucc

SEQ ID NO: 513427 - RNA, 32 nt, Human
ugagccgcaucuucuccaucuggcaggguggg

SEQ ID NO: 513428 - RNA, 32 nt, Human
ugagccgcccccuuccuccaccaacucacgcc

SEQ ID NO: 513429 - RNA, 32 nt, Human
ugagccgcccgccugcaccgccacccggcgac

SEQ ID NO: 513430 - RNA, 32 nt, Human
ugagccgcccgcuccgugccccucucugcagc

SEQ ID NO: 513431 - RNA, 32 nt, Human
ugagccgccggccuccggccuccugggccccu

SEQ ID NO: 513432 - RNA, 32 nt, Human
ugagccgcgaggaagagaggcgagcgagagug

SEQ ID NO: 513433 - RNA, 32 nt, Human
ugagccgcuagugauggagagcagagggagag

SEQ ID NO: 513434 - RNA, 32 nt, Human
ugagccggagccagggcaguaugagguggggc

SEQ ID NO: 513435 - RNA, 32 nt, Human
ugagccggccgcagagccauggcgggcgggga

SEQ ID NO: 513436 - RNA, 32 nt, Human
ugagccggcuucuguuccuggccgcagagucg

SEQ ID NO: 513437 - RNA, 32 nt, Human
ugagccggggacacuccucugcccagcaagga

SEQ ID NO: 513438 - RNA, 32 nt, Human
ugagccggggaggaggggguugcagugagccg

SEQ ID NO: 513439 - RNA, 32 nt, Human
ugagccggggaggcagagguugcagugagccg

SEQ ID NO: 513440 - RNA, 32 nt, Human
ugagccggggagguggaggcugcagugaacug

SEQ ID NO: 513441 - RNA, 18 nt, Human
ugagccgggucagggaga

SEQ ID NO: 513442 - RNA, 32 nt, Human
ugagccgugauugagccacugcacuccagccu

SEQ ID NO: 513443 - RNA, 32 nt, Human
ugagccguugugcuccagccugggcgacagaa

SEQ ID NO: 513444 - RNA, 32 nt, Human
ugagccuacaucuucuugucuguaaaauggag

SEQ ID NO: 513445 - RNA, 32 nt, Human
ugagccuaccucugauccuacaguuccaagag

SEQ ID NO: 513446 - RNA, 32 nt, Human
ugagccuagaaguucaagaccagccugggcaa

SEQ ID NO: 513447 - RNA, 32 nt, Human
ugagccuagagcaccaugucccuucccuguag

SEQ ID NO: 513448 - RNA, 23 nt, Human
ugagccuagagggcccucugaug

SEQ ID NO: 513449 - RNA, 32 nt, Human
ugagccuaggaauucaagaccagccuagguaa

SEQ ID NO: 513450 - RNA, 32 nt, Human
ugagccuaggagaaaaugccacugugugcauc

SEQ ID NO: 513451 - RNA, 32 nt, Human
ugagccuaggaguucaagaucagccugggcaa

SEQ ID NO: 513452 - RNA, 32 nt, Human
ugagccuaggaguuuaaaccagccugggcacc

SEQ ID NO: 513453 - RNA, 32 nt, Human
ugagccuagguggccaaggcuuccugcauugc

SEQ ID NO: 513454 - RNA, 32 nt, Human
ugagccuaugaguucaagaccagccuaggcaa

SEQ ID NO: 513455 - RNA, 23 nt, Human
ugagccucacgaccgcugaccca

SEQ ID NO: 513456 - RNA, 32 nt, Human
ugagccucaggagguugaggcugcagugagcu

SEQ ID NO: 513457 - RNA, 24 nt, Human
ugagccucaggauucucaucugua

SEQ ID NO: 513458 - RNA, 32 nt, Human
ugagccucagggugccaaggaggcagggcuga

SEQ ID NO: 513459 - RNA, 32 nt, Human
ugagccuccagacccugcuaaccacaaaaggg

SEQ ID NO: 513460 - RNA, 32 nt, Human
ugagccuccagcgcgugccagccugggccgcu

SEQ ID NO: 513461 - RNA, 32 nt, Human
ugagccuccauuccuuccccagccccuggccc

SEQ ID NO: 513462 - RNA, 32 nt, Human
ugagccucccaaagugcuaggauuacaggcau

SEQ ID NO: 513463 - RNA, 32 nt, Human
ugagccucccaaagugcugggauuacaggcau

SEQ ID NO: 513464 - RNA, 32 nt, Human
ugagccucccaaagugcugggauugcaggugu

SEQ ID NO: 513465 - RNA, 32 nt, Human
ugagccucccaaguaccugggauuacaggagc

SEQ ID NO: 513466 - RNA, 32 nt, Human
ugagccucccaccccgcugccugggcccugug

SEQ ID NO: 513467 - RNA, 32 nt, Human
ugagccucccgaguagcugggauuacaggugc

SEQ ID NO: 513468 - RNA, 21 nt, Human
ugagccuccucucugcucugu

SEQ ID NO: 513469 - RNA, 32 nt, Human
ugagccuccucugccccugucuugcucuuccc

SEQ ID NO: 513470 - RNA, 32 nt, Human
ugagccuccugcaaccaccauuuuugaaauaa

SEQ ID NO: 513471 - RNA, 32 nt, Human
ugagccucggaggcggagguugcagugagcug

SEQ ID NO: 513472 - RNA, 32 nt, Human
ugagccucuccccaucuagaauguuggaacug

SEQ ID NO: 513473 - RNA, 32 nt, Human
ugagccucuggcccggccuuuccuuuuuccuc

SEQ ID NO: 513474 - RNA, 19 nt, Human
ugagccugacccaggggga

SEQ ID NO: 513475 - RNA, 32 nt, Human
ugagccugacucugaagcuguucccagcucuu

SEQ ID NO: 513476 - RNA, 32 nt, Human
ugagccugagagaugaagguugcagugagccg

SEQ ID NO: 513477 - RNA, 32 nt, Human
ugagccugagcaacauaaugagacccugucuc

SEQ ID NO: 513478 - RNA, 32 nt, Human
ugagccugaggaccaaaaugaaaccuuuuucu

SEQ ID NO: 513479 - RNA, 32 nt, Human
ugagccugcaagauggagguugcagugagcuc

SEQ ID NO: 513480 - RNA, 32 nt, Human
ugagccugcacagagccaggugcaaugggcag

SEQ ID NO: 513481 - RNA, 32 nt, Human
ugagccugcaccuggacagguguacgucugca

SEQ ID NO: 513482 - RNA, 32 nt, Human
ugagccuggaagacauagguugcaguguaaug

SEQ ID NO: 513483 - RNA, 32 nt, Human
ugagccuggagauguagaggcugcaaugagcu

SEQ ID NO: 513484 - RNA, 32 nt, Human
ugagccuggagauguagaggcugcagugagcu

SEQ ID NO: 513485 - RNA, 32 nt, Human
ugagccuggcacauagcacccagccugcaucu

SEQ ID NO: 513486 - RNA, 29 nt, Human
ugagccuggcugcucagcgucuccuggcc

SEQ ID NO: 513487 - RNA, 32 nt, Human
ugagccuggcuuggaccuuggcauuccguuug

SEQ ID NO: 513488 - RNA, 32 nt, Human
ugagccugggaaguggaaguugcagugagcca

SEQ ID NO: 513489 - RNA, 32 nt, Human
ugagccugggaaguggagguugcaguaggcug

SEQ ID NO: 513490 - RNA, 32 nt, Human
ugagccugggagaucgaggcugcagugagcca

SEQ ID NO: 513491 - RNA, 32 nt, Human
ugagccugggagauggagguugcagugagcug

SEQ ID NO: 513492 - RNA, 32 nt, Human
ugagccugggagcaaggguugcagugagcuga

SEQ ID NO: 513493 - RNA, 32 nt, Human
ugagccugggagcgcagguugcaaugagccaa

SEQ ID NO: 513494 - RNA, 32 nt, Human
ugagccugggaggaagagguugcagugagccg

SEQ ID NO: 513495 - RNA, 32 nt, Human
ugagccugggaggcagagauugcacugagccg

SEQ ID NO: 513496 - RNA, 32 nt, Human
ugagccugggaggcagaggcugcagugagccg

SEQ ID NO: 513497 - RNA, 32 nt, Human
ugagccugggaggcagagguugcagugagcca

SEQ ID NO: 513498 - RNA, 32 nt, Human
ugagccugggaggcagagguugcagugagccg

SEQ ID NO: 513499 - RNA, 32 nt, Human
ugagccugggaggcagagguugcagugagcug

SEQ ID NO: 513500 - RNA, 32 nt, Human
ugagccugggaggcagagguugcugugagccg

SEQ ID NO: 513501 - RNA, 32 nt, Human
ugagccugggaggcggagguugcagugagccg

SEQ ID NO: 513502 - RNA, 32 nt, Human
ugagccugggaggcggggguuguggugagccg

SEQ ID NO: 513503 - RNA, 32 nt, Human
ugagccugggagggugaggaugcaugagccau

SEQ ID NO: 513504 - RNA, 32 nt, Human
ugagccugggaggucaaggcaucagugagcga

SEQ ID NO: 513505 - RNA, 32 nt, Human
ugagccugggaggucaaggcugcagugaacca

SEQ ID NO: 513506 - RNA, 32 nt, Human
ugagccugggaggucaaggcugcagugagcca

SEQ ID NO: 513507 - RNA, 32 nt, Human
ugagccugggaggucaaggcugcagugagccg

SEQ ID NO: 513508 - RNA, 32 nt, Human
ugagccugggaggucaaggcugcagugagcug

SEQ ID NO: 513509 - RNA, 32 nt, Human
ugagccugggaggucgaggcugcagcgagccg

SEQ ID NO: 513510 - RNA, 32 nt, Human
ugagccugggaggucgaggcugcagugagcug

SEQ ID NO: 513511 - RNA, 32 nt, Human
ugagccugggaggucgaggcuguagugagccc

SEQ ID NO: 513512 - RNA, 32 nt, Human
ugagccugggaggucgaggcuguagugagcua

SEQ ID NO: 513513 - RNA, 32 nt, Human
ugagccugggagguggaggcuacugugagcca

SEQ ID NO: 513514 - RNA, 32 nt, Human
ugagccugggagguggagguugcacugaguag

SEQ ID NO: 513515 - RNA, 32 nt, Human
ugagccugggagguggagguugcagugagcua

SEQ ID NO: 513516 - RNA, 32 nt, Human
ugagccugggagguggagguugcagugagugg

SEQ ID NO: 513517 - RNA, 32 nt, Human
ugagccugggagguggagguugccagugaguc

SEQ ID NO: 513518 - RNA, 32 nt, Human
ugagccugggagguggagguuucagugagcug

SEQ ID NO: 513519 - RNA, 32 nt, Human
ugagccugggagguggaguuugcagugagcua

SEQ ID NO: 513520 - RNA, 32 nt, Human
ugagccugggagguugaggcugcagugagcca

SEQ ID NO: 513521 - RNA, 32 nt, Human
ugagccugggagguugugguugcagugagcua

SEQ ID NO: 513522 - RNA, 32 nt, Human
ugagccugggaguucaagaccagccugggcaa

SEQ ID NO: 513523 - RNA, 32 nt, Human
ugagccugggccggguggagguguccugcaug

SEQ ID NO: 513524 - RNA, 32 nt, Human
ugagccugggcugugccacacaagcacuucau

SEQ ID NO: 513525 - RNA, 32 nt, Human
ugagccuggggucacagggggugucgggcgga

SEQ ID NO: 513526 - RNA, 32 nt, Human
ugagccugguggagaugcuacaagagaacuac

SEQ ID NO: 513527 - RNA, 32 nt, Human
ugagccuguaccacuguuguaacaugggaaga

SEQ ID NO: 513528 - RNA, 32 nt, Human
ugagccuguagucccagcuacucgagaggcug

SEQ ID NO: 513529 - RNA, 32 nt, Human
ugagccuguccucagaggauggcgaggcagcc

SEQ ID NO: 513530 - RNA, 32 nt, Human
ugagccugugcaagugacaugaccucucuaaa

SEQ ID NO: 513531 - RNA, 32 nt, Human
ugagccuguguccugucugccugcccagccau

SEQ ID NO: 513532 - RNA, 32 nt, Human
ugagccuuaaaccuucaucucucagguguuga

SEQ ID NO: 513533 - RNA, 32 nt, Human
ugagccuucucuccaccaccauagacaggugu

SEQ ID NO: 513534 - RNA, 32 nt, Human
ugagccuucugaugagacugcagccccagcug

SEQ ID NO: 513535 - RNA, 32 nt, Human
ugagccuucugaugagacugcagccccggcug

SEQ ID NO: 513536 - RNA, 32 nt, Human
ugagccuucuuucugcccuccagauccacggu

SEQ ID NO: 513537 - RNA, 32 nt, Human
ugagccuugcagagaaaaggagggacaaccug

SEQ ID NO: 513538 - RNA, 32 nt, Human
ugagccuuggaggcggagguugcagugagcug

SEQ ID NO: 513539 - RNA, 32 nt, Human
ugagccuuggcuguuggcagugagugagccug

SEQ ID NO: 513540 - RNA, 32 nt, Human
ugagccuugugagguuuccaggcaggcugauu

SEQ ID NO: 513541 - RNA, 32 nt, Human
ugagccuugugucuuuccaguuacaggcgaug

SEQ ID NO: 513542 - RNA, 32 nt, Human
ugagccuuugacucagacauuuuugccaagga

SEQ ID NO: 513543 - RNA, 32 nt, Human
ugagccuuugccuagucuggggccagaccccu

SEQ ID NO: 513544 - RNA, 32 nt, Human
ugagcgaauagagagagaaucagcuauugaaa

SEQ ID NO: 513545 - RNA, 32 nt, Human
ugagcgaccaggacuacauuucccaagaggcu

SEQ ID NO: 513546 - RNA, 32 nt, Human
ugagcgagguauucccagucuuccugcuaagc

SEQ ID NO: 513547 - RNA, 32 nt, Human
ugagcgaguccagcagaaagcugcagugaccc

SEQ ID NO: 513548 - RNA, 32 nt, Human
ugagcgcacagaaguugagaacugaguuuugg

SEQ ID NO: 513549 - RNA, 32 nt, Human
ugagcgcagagcugcgaaggggaacuguuugc

SEQ ID NO: 513550 - RNA, 32 nt, Human
ugagcgcagguccucucucucccuucacccuu

SEQ ID NO: 513551 - RNA, 32 nt, Human
ugagcgcagugcuguguggcagcagagcuccu

SEQ ID NO: 513552 - RNA, 32 nt, Human
ugagcgcagugcuguguggcagcagagguccu

SEQ ID NO: 513553 - RNA, 32 nt, Human
ugagcgcaugugugugcaccagugcacaagug

SEQ ID NO: 513554 - RNA, 32 nt, Human
ugagcgcauuggcuugucugccgcaggcacag

SEQ ID NO: 513555 - RNA, 32 nt, Human
ugagcgccaguucagcuuucaaaaagagugcu

SEQ ID NO: 513556 - RNA, 32 nt, Human
ugagcgcggcgugggagccuugggagccgccg

SEQ ID NO: 513557 - RNA, 32 nt, Human
ugagcgcucacagcuucauuuggcccagguug

SEQ ID NO: 513558 - RNA, 32 nt, Human
ugagcgcuggcaagaccucaaugugaucaaca

SEQ ID NO: 513559 - RNA, 32 nt, Human
ugagcgcugugagauggauguauuuguagcca

SEQ ID NO: 513560 - RNA, 32 nt, Human
ugagcgcuuccaacagcuucucgaggcugcac

SEQ ID NO: 513561 - RNA, 32 nt, Human
ugagcgcuuccaggcuucaggcucagaaggcg

SEQ ID NO: 513562 - RNA, 32 nt, Human
ugagcggaagaaugugcuacaguugaaacucc

SEQ ID NO: 513563 - RNA, 32 nt, Human
ugagcggagcgguggagagggagaggcuggag

SEQ ID NO: 513564 - RNA, 32 nt, Human
ugagcggagucugaggucgcuguggacugccc

SEQ ID NO: 513565 - RNA, 30 nt, Human
ugagcggaguguuccagggcacaguggucu

SEQ ID NO: 513566 - RNA, 32 nt, Human
ugagcggcgcagagcccuccaggccugcaggg

SEQ ID NO: 513567 - RNA, 24 nt, Human
ugagcggcggccaggccgcucugc

SEQ ID NO: 513568 - RNA, 31 nt, Human
ugagcggcucccaugggcccugugucugcag

SEQ ID NO: 513569 - RNA, 32 nt, Human
ugagcggcuucauggcagacagcagcgagcca

SEQ ID NO: 513570 - RNA, 32 nt, Human
ugagcgggaaggacuccucucugccugcaguu

SEQ ID NO: 513571 - RNA, 32 nt, Human
ugagcgggagcugaggcugaggagaggggagc

SEQ ID NO: 513572 - RNA, 32 nt, Human
ugagcgggaggaacagcgggcccuggcagccc

SEQ ID NO: 513573 - RNA, 31 nt, Human
ugagcgggauccuaggacugaucuguagccc

SEQ ID NO: 513574 - RNA, 32 nt, Human
ugagcgggggcuuggcccagaggagccaagcc

SEQ ID NO: 513575 - RNA, 32 nt, Human
ugagcggguggcagcgacagagccaaaaucag

SEQ ID NO: 513576 - RNA, 32 nt, Human
ugagcguacagcggcuucccucgguggggacc

SEQ ID NO: 513577 - RNA, 21 nt, Human
ugagcguacuguaacuggaga

SEQ ID NO: 513578 - RNA, 22 nt, Human
ugagcguagccugggcaacaca

SEQ ID NO: 513579 - RNA, 32 nt, Human
ugagcguccaggcugcgcgauggcacacacua

SEQ ID NO: 513580 - RNA, 23 nt, Human
ugagcgugaagauggugcugccu

SEQ ID NO: 513581 - RNA, 32 nt, Human
ugagcgugacugugcuaaccuggguggggcag

SEQ ID NO: 513582 - RNA, 32 nt, Human
ugagcgugagccagaagcagcuguguauuuaa

SEQ ID NO: 513583 - RNA, 32 nt, Human
ugagcgugcgucugugugugccugugugcgag

SEQ ID NO: 513584 - RNA, 32 nt, Human
ugagcgugcguucugggcagggccuguaaugg

SEQ ID NO: 513585 - RNA, 32 nt, Human
ugagcguggaagggggaggagucaggggcucu

SEQ ID NO: 513586 - RNA, 32 nt, Human
ugagcguggcaugcaggugucuuugcuguguu

SEQ ID NO: 513587 - RNA, 32 nt, Human
ugagcguggcugcuuccugccgcucgacgccg

SEQ ID NO: 513588 - RNA, 32 nt, Human
ugagcgugucagcauccucugguuccaucucc

SEQ ID NO: 513589 - RNA, 29 nt, Human
ugagcgugucugugugcgaguggacgguc

SEQ ID NO: 513590 - RNA, 32 nt, Human
ugagcguugcccacaccccaucucccgucacc

SEQ ID NO: 513591 - RNA, 32 nt, Human
ugagcguugguguuuggcacgcgccacccucu

SEQ ID NO: 513592 - RNA, 32 nt, Human
ugagcuaaaagcuuccaugaaggggcugggaa

SEQ ID NO: 513593 - RNA, 32 nt, Human
ugagcuaaccuugcccagccucugggaacacu

SEQ ID NO: 513594 - RNA, 32 nt, Human
ugagcuaaucaaaagaaaacacugccuaugug

SEQ ID NO: 513595 - RNA, 21 nt, Human
ugagcuaauccagaagaucca

SEQ ID NO: 513596 - RNA, 32 nt, Human
ugagcuaauucugcaauuuucuaccaaacaga

SEQ ID NO: 513597 - RNA, 32 nt, Human
ugagcuacacacugaguaguauguauuucaug

SEQ ID NO: 513598 - RNA, 22 nt, Human
ugagcuaccauaugugcugucu

SEQ ID NO: 513599 - RNA, 32 nt, Human
ugagcuacgagccuggcagcaggugugcgccg

SEQ ID NO: 513600 - RNA, 31 nt, Human
ugagcuacgggaaugucuaugccaagcacgu

SEQ ID NO: 513601 - RNA, 32 nt, Human
ugagcuacuaacugcaggagcugaggagcugc

SEQ ID NO: 513602 - RNA, 32 nt, Human
ugagcuagcuggagaagaggggaggguccaua

SEQ ID NO: 513603 - RNA, 32 nt, Human
ugagcuaggccguuuccgggaggcggagcuca

SEQ ID NO: 513604 - RNA, 32 nt, Human
ugagcuaggggcaggaggcaugggcgggacag

SEQ ID NO: 513605 - RNA, 32 nt, Human
ugagcuauagcuacagcucuagcuauccagca

SEQ ID NO: 513606 - RNA, 32 nt, Human
ugagcuaugaaugccguacagagcagaggcug

SEQ ID NO: 513607 - RNA, 32 nt, Human
ugagcuauguucaugacacugcacuccagccu

SEQ ID NO: 513608 - RNA, 32 nt, Human
ugagcuauuaaaacucagccugggacaguuua

SEQ ID NO: 513609 - RNA, 32 nt, Human
ugagcucaaccagcagagacauuccaucccaa

SEQ ID NO: 513610 - RNA, 32 nt, Human
ugagcucaagaggccgagguugcagugagccg

SEQ ID NO: 513611 - RNA, 32 nt, Human
ugagcucaagaguucaagaccagccugggaaa

SEQ ID NO: 513612 - RNA, 32 nt, Human
ugagcucaagcaacccucccuccucagccuuc

SEQ ID NO: 513613 - RNA, 32 nt, Human
ugagcucaagcaauccucccaccucagccucc

SEQ ID NO: 513614 - RNA, 32 nt, Human
ugagcucaagcaauccucccaccucagccuuu

SEQ ID NO: 513615 - RNA, 32 nt, Human
ugagcucaaggagaugcaggcugcagugggcu

SEQ ID NO: 513616 - RNA, 32 nt, Human
ugagcucacauugucaaaaacagacuugccug

SEQ ID NO: 513617 - RNA, 32 nt, Human
ugagcucaccuccaugcaaagacuucaguuuu

SEQ ID NO: 513618 - RNA, 32 nt, Human
ugagcucaccugucucucugacugccuuggag

SEQ ID NO: 513619 - RNA, 32 nt, Human
ugagcucacugcaaccucugacucccagacuc

SEQ ID NO: 513620 - RNA, 32 nt, Human
ugagcucacugcaaccucugccucccaaguuc

SEQ ID NO: 513621 - RNA, 32 nt, Human
ugagcucagaaguuccacugcacuccagccug

SEQ ID NO: 513622 - RNA, 32 nt, Human
ugagcucagauggugccacugcacuccagccu

SEQ ID NO: 513623 - RNA, 32 nt, Human
ugagcucagccaaggaaacucuugcacaaaug

SEQ ID NO: 513624 - RNA, 32 nt, Human
ugagcucagccaccgauggagggucguggggc

SEQ ID NO: 513625 - RNA, 32 nt, Human
ugagcucagcuggcagaguuugcaaguggcgg

SEQ ID NO: 513626 - RNA, 32 nt, Human
ugagcucagcuguccccucucagagcgccaca

SEQ ID NO: 513627 - RNA, 32 nt, Human
ugagcucaggagcugcacggaaugguggcagu

SEQ ID NO: 513628 - RNA, 32 nt, Human
ugagcucaggaggcagagguugcagugagcca

SEQ ID NO: 513629 - RNA, 32 nt, Human
ugagcucaggaggcagagguugcagugagcug

SEQ ID NO: 513630 - RNA, 32 nt, Human
ugagcucaggagguugggucugcagugagcua

SEQ ID NO: 513631 - RNA, 32 nt, Human
ugagcucaggaguccaagaccagccugggcaa

SEQ ID NO: 513632 - RNA, 32 nt, Human
ugagcucaggaguucaaaaccagcuugggcag

SEQ ID NO: 513633 - RNA, 19 nt, Human
ugagcucaggaguucaaga

SEQ ID NO: 513634 - RNA, 32 nt, Human
ugagcucaggaguucaagaccagccuaggcaa

SEQ ID NO: 513635 - RNA, 32 nt, Human
ugagcucaggaguucaagaccagccuaggcca

SEQ ID NO: 513636 - RNA, 32 nt, Human
ugagcucaggaguucaagaccagccuggacaa

SEQ ID NO: 513637 - RNA, 32 nt, Human
ugagcucaggaguucaagaccagccugggcaa

SEQ ID NO: 513638 - RNA, 32 nt, Human
ugagcucaggaguucaagaccagccugggcag

SEQ ID NO: 513639 - RNA, 32 nt, Human
ugagcucaggaguucaagaccagcuugggaaa

SEQ ID NO: 513640 - RNA, 32 nt, Human
ugagcucaggaguucaagacgagccugggcaa

SEQ ID NO: 513641 - RNA, 32 nt, Human
ugagcucaggaguucaagagcaaccugaccaa

SEQ ID NO: 513642 - RNA, 32 nt, Human
ugagcucaggaguucaagaucagucugggcaa

SEQ ID NO: 513643 - RNA, 19 nt, Human
ugagcucaggaguuccaga

SEQ ID NO: 513644 - RNA, 19 nt, Human
ugagcucaggaguucgaga

SEQ ID NO: 513645 - RNA, 32 nt, Human
ugagcucaggaguuggagaccaacccuggcaa

SEQ ID NO: 513646 - RNA, 19 nt, Human
ugagcucaggaguuugaga

SEQ ID NO: 513647 - RNA, 32 nt, Human
ugagcucaggaguuugagaccaaccuggccaa

SEQ ID NO: 513648 - RNA, 29 nt, Human
ugagcucaggaguuugagaccaaccuggg

SEQ ID NO: 513649 - RNA, 32 nt, Human
ugagcucaggaguuugagaccaacuuggccaa

SEQ ID NO: 513650 - RNA, 32 nt, Human
ugagcucaggaguuuggaccagccugggcaac

SEQ ID NO: 513651 - RNA, 32 nt, Human
ugagcucaggaucugugugaggugugggaggu

SEQ ID NO: 513652 - RNA, 32 nt, Human
ugagcucaggcagaucacuugaggucaggagu

SEQ ID NO: 513653 - RNA, 26 nt, Human
ugagcucaggugauccacccgccuca

SEQ ID NO: 513654 - RNA, 25 nt, Human
ugagcucaggugauccaccugccuc

SEQ ID NO: 513655 - RNA, 25 nt, Human
ugagcucaggugaucugcccaccuc

SEQ ID NO: 513656 - RNA, 32 nt, Human
ugagcucaguaguucaagaccagccuaggcaa

SEQ ID NO: 513657 - RNA, 32 nt, Human
ugagcucaugagggcccaggaggucaaggcuu

SEQ ID NO: 513658 - RNA, 32 nt, Human
ugagcucaugaguucaagaccagucugggcaa

SEQ ID NO: 513659 - RNA, 32 nt, Human
ugagcucaugcgacugcacuccagccugggug

SEQ ID NO: 513660 - RNA, 19 nt, Human
ugagcuccaagaguagcuu

SEQ ID NO: 513661 - RNA, 32 nt, Human
ugagcuccaagugcuaaauaacagcaucucau

SEQ ID NO: 513662 - RNA, 32 nt, Human
ugagcuccaauucuucucaaacuggagaacug

SEQ ID NO: 513663 - RNA, 32 nt, Human
ugagcuccagaaggagcuuucugggccagcuu

SEQ ID NO: 513664 - RNA, 32 nt, Human
ugagcuccagagccgcaccaucugccacaaac

SEQ ID NO: 513665 - RNA, 32 nt, Human
ugagcuccagccuggcuaucucuuucaagaaa

SEQ ID NO: 513666 - RNA, 23 nt, Human
ugagcuccaggggucagcagcuu

SEQ ID NO: 513667 - RNA, 32 nt, Human
ugagcuccaugugccuuuuggaucuuugcaac

SEQ ID NO: 513668 - RNA, 32 nt, Human
ugagcucccaccacugcacuccagccugggcg

SEQ ID NO: 513669 - RNA, 22 nt, Human
ugagcuccccauggcacuguuu

SEQ ID NO: 513670 - RNA, 32 nt, Human
ugagcucccucgggagccuuucacgaggucag

SEQ ID NO: 513671 - RNA, 32 nt, Human
ugagcucccugucacuggccuggaccuggaga

SEQ ID NO: 513672 - RNA, 24 nt, Human
ugagcuccgccccugcugcugccu

SEQ ID NO: 513673 - RNA, 32 nt, Human
ugagcuccgccccugcugcugccuguagccag

SEQ ID NO: 513674 - RNA, 32 nt, Human
ugagcuccgugcagaagcuggugacggaugag

SEQ ID NO: 513675 - RNA, 32 nt, Human
ugagcuccuggccuagacuccaaaggguuggg

SEQ ID NO: 513676 - RNA, 32 nt, Human
ugagcuccuuucuccucuccuucagccaauca

SEQ ID NO: 513677 - RNA, 32 nt, Human
ugagcucgcugagacuuccuggaccccgcacc

SEQ ID NO: 513678 - RNA, 32 nt, Human
ugagcucgcugaguccagccucguggucuucu

SEQ ID NO: 513679 - RNA, 32 nt, Human
ugagcucggaagauggaggcugcagugagcca

SEQ ID NO: 513680 - RNA, 32 nt, Human
ugagcucgggcacgcagggccugagaucuggc

SEQ ID NO: 513681 - RNA, 23 nt, Human
ugagcucgugaucugcccgccuc

SEQ ID NO: 513682 - RNA, 22 nt, Human
ugagcucuaagaguuucugccu

SEQ ID NO: 513683 - RNA, 32 nt, Human
ugagcucuacaaaaacacacugcuucacuuug

SEQ ID NO: 513684 - RNA, 32 nt, Human
ugagcucuaggcugccuggagggaaggaacag

SEQ ID NO: 513685 - RNA, 32 nt, Human
ugagcucuauagaccaucccucucugcaauca

SEQ ID NO: 513686 - RNA, 32 nt, Human
ugagcucuauuucuacccaggcugcugucguc

SEQ ID NO: 513687 - RNA, 32 nt, Human
ugagcucuccacugccgaaauacaacucugug

SEQ ID NO: 513688 - RNA, 32 nt, Human
ugagcucuccauccucucugggaauuuaccga

SEQ ID NO: 513689 - RNA, 32 nt, Human
ugagcucucggcuccuccuccgucuucagggc

SEQ ID NO: 513690 - RNA, 32 nt, Human
ugagcucucgguggaugaggcugcaguccaug

SEQ ID NO: 513691 - RNA, 32 nt, Human
ugagcucugauggcgcacaccuguaaucagga

SEQ ID NO: 513692 - RNA, 32 nt, Human
ugagcucugauuccucuucugucuggcugauu

SEQ ID NO: 513693 - RNA, 32 nt, Human
ugagcucugcaagcugugaucugucuggguuc

SEQ ID NO: 513694 - RNA, 32 nt, Human
ugagcucuggaaacauugggauggacuguuca

SEQ ID NO: 513695 - RNA, 32 nt, Human
ugagcucuggaaaucuugaggugugaccagau

SEQ ID NO: 513696 - RNA, 32 nt, Human
ugagcucuggagguggaggcugccaugagcca

SEQ ID NO: 513697 - RNA, 32 nt, Human
ugagcucuguguccuccguucauuccauggcu

SEQ ID NO: 513698 - RNA, 32 nt, Human
ugagcucuucaccaucucugugaauggcgucc

SEQ ID NO: 513699 - RNA, 32 nt, Human
ugagcugaacaagacccuacugcugucuuauu

SEQ ID NO: 513700 - RNA, 32 nt, Human
ugagcugaacuauccuggaguguuuuguugca

SEQ ID NO: 513701 - RNA, 32 nt, Human
ugagcugaauccuucaaaggcacagcaggcag

SEQ ID NO: 513702 - RNA, 32 nt, Human
ugagcugacucccuuagagcaaaggagagaca

SEQ ID NO: 513703 - RNA, 32 nt, Human
ugagcugacugccuuggccucccagagugcug

SEQ ID NO: 513704 - RNA, 32 nt, Human
ugagcugagacugugccacugcaguccagccu

SEQ ID NO: 513705 - RNA, 32 nt, Human
ugagcugagacuucggggcuguggagaccagc

SEQ ID NO: 513706 - RNA, 32 nt, Human
ugagcugagaucgugacacugcacuucagccu

SEQ ID NO: 513707 - RNA, 32 nt, Human
ugagcugagaucgugcuacugcaguccagccu

SEQ ID NO: 513708 - RNA, 32 nt, Human
ugagcugagauggcaccacugcacuccagccu

SEQ ID NO: 513709 - RNA, 32 nt, Human
ugagcugagauggcaccacugcacuccagcuu

SEQ ID NO: 513710 - RNA, 32 nt, Human
ugagcugagauggcaccacugcacuccggccu

SEQ ID NO: 513711 - RNA, 32 nt, Human
ugagcugagauggcgccacugcacuccagccu

SEQ ID NO: 513712 - RNA, 32 nt, Human
ugagcugagaugguaccacugcacuccagccu

SEQ ID NO: 513713 - RNA, 32 nt, Human
ugagcugagauggugccacugcacuccagaug

SEQ ID NO: 513714 - RNA, 32 nt, Human
ugagcugagauggugccacugcacuccagccu

SEQ ID NO: 513715 - RNA, 32 nt, Human
ugagcugagauggugccacugcacuccagcuu

SEQ ID NO: 513716 - RNA, 32 nt, Human
ugagcugagauggugccacugcacucuaaccu

SEQ ID NO: 513717 - RNA, 32 nt, Human
ugagcugagauggugccacugcacuucagccu

SEQ ID NO: 513718 - RNA, 32 nt, Human
ugagcugagauggugccacugcauuucugccu

SEQ ID NO: 513719 - RNA, 32 nt, Human
ugagcugagauggugccacuguacuccagccu

SEQ ID NO: 513720 - RNA, 32 nt, Human
ugagcugagauggugccauugcacuucagccc

SEQ ID NO: 513721 - RNA, 32 nt, Human
ugagcugagauggugccauugcccuccagccu

SEQ ID NO: 513722 - RNA, 32 nt, Human
ugagcugagauugcacuccagccugggcgaca

SEQ ID NO: 513723 - RNA, 32 nt, Human
ugagcugagauuguaccaugcacuccagccug

SEQ ID NO: 513724 - RNA, 32 nt, Human
ugagcugaggaguucaagaccagccugggcaa

SEQ ID NO: 513725 - RNA, 32 nt, Human
ugagcugaggccgcugaagcuguaggaagcgc

SEQ ID NO: 513726 - RNA, 32 nt, Human
ugagcugaguccaagguuacagugagccguga

SEQ ID NO: 513727 - RNA, 32 nt, Human
ugagcugaucaaggaagucucucuaggcugca

SEQ ID NO: 513728 - RNA, 32 nt, Human
ugagcugaugagccguccccugggcuugaaau

SEQ ID NO: 513729 - RNA, 32 nt, Human
ugagcugauggugcagggagaauuguugagaa

SEQ ID NO: 513730 - RNA, 32 nt, Human
ugagcugcaaacuucuucuauaccuuucuuac

SEQ ID NO: 513731 - RNA, 32 nt, Human
ugagcugcacacaucccacaaugccugcccca

SEQ ID NO: 513732 - RNA, 32 nt, Human
ugagcugcacacucaagggugugauaaccagc

SEQ ID NO: 513733 - RNA, 32 nt, Human
ugagcugcacuagccccagucuggcccggcac

SEQ ID NO: 513734 - RNA, 32 nt, Human
ugagcugcacugcauuccagccugggugacag

SEQ ID NO: 513735 - RNA, 31 nt, Human
ugagcugcacuuuuuggggugggaaagguga

SEQ ID NO: 513736 - RNA, 32 nt, Human
ugagcugcagaaagugcaagacaugccaauuu

SEQ ID NO: 513737 - RNA, 32 nt, Human
ugagcugcagagcugacgucugggugacagug

SEQ ID NO: 513738 - RNA, 32 nt, Human
ugagcugcagcaguuguacccuuucuugauga

SEQ ID NO: 513739 - RNA, 32 nt, Human
ugagcugcagccacuacacaggccuggaauuc

SEQ ID NO: 513740 - RNA, 32 nt, Human
ugagcugcaugugaauccacacaugccauucc

SEQ ID NO: 513741 - RNA, 32 nt, Human
ugagcugccccuggcuuccuuuaaggaggcug

SEQ ID NO: 513742 - RNA, 22 nt, Human
ugagcugcguggagaaagccau

SEQ ID NO: 513743 - RNA, 32 nt, Human
ugagcugcucagcugcccucugcuccauaccc

SEQ ID NO: 513744 - RNA, 32 nt, Human
ugagcugcucucagaaccucagucuggggacc

SEQ ID NO: 513745 - RNA, 32 nt, Human
ugagcugcugccacuccagcaagggaaauaau

SEQ ID NO: 513746 - RNA, 32 nt, Human
ugagcugcugcugcugugcuggggcagcuucc

SEQ ID NO: 513747 - RNA, 32 nt, Human
ugagcugcuguugcagucuaacccacuaauca

SEQ ID NO: 513748 - RNA, 32 nt, Human
ugagcugcuugccuuuccaccuccagggcaug

SEQ ID NO: 513749 - RNA, 32 nt, Human
ugagcugcuuuggagacucggcugccagaggg

SEQ ID NO: 513750 - RNA, 23 nt, Human
ugagcuggaaagguauggaggug

SEQ ID NO: 513751 - RNA, 32 nt, Human
ugagcuggaccuuaaacacaucugcaggagcu

SEQ ID NO: 513752 - RNA, 32 nt, Human
ugagcuggacuucucagagaggcugggcauua

SEQ ID NO: 513753 - RNA, 21 nt, Human
ugagcuggagucuuacucugu

SEQ ID NO: 513754 - RNA, 32 nt, Human
ugagcuggccacuccagagcugcagugccacu

SEQ ID NO: 513755 - RNA, 32 nt, Human
ugagcuggccccucugccccagcugagaugga

SEQ ID NO: 513756 - RNA, 32 nt, Human
ugagcuggcuacucggggauaaagacugaagu

SEQ ID NO: 513757 - RNA, 32 nt, Human
ugagcuggcugacagcuggggacggguggcgg

SEQ ID NO: 513758 - RNA, 32 nt, Human
ugagcugggaggaucacucaagcccugggagg

SEQ ID NO: 513759 - RNA, 32 nt, Human
ugagcugggaggaucacuugagcccaggaggu

SEQ ID NO: 513760 - RNA, 32 nt, Human
ugagcugggaggauugcuugagaccagaaguu

SEQ ID NO: 513761 - RNA, 32 nt, Human
ugagcugggaguguccggcacuguggucucag

SEQ ID NO: 513762 - RNA, 32 nt, Human
ugagcugggauguucuggaggaugagguuguc

SEQ ID NO: 513763 - RNA, 32 nt, Human
ugagcugggccaucugacuucuaccucccaug

SEQ ID NO: 513764 - RNA, 32 nt, Human
ugagcugggcccacggcucccuucccaugugu

SEQ ID NO: 513765 - RNA, 32 nt, Human
ugagcugggccccagcccagugacuggcucau

SEQ ID NO: 513766 - RNA, 32 nt, Human
ugagcugggcucucgcuuuguugcccaggcug

SEQ ID NO: 513767 - RNA, 32 nt, Human
ugagcugggcugggaggcuuccuacaggggaa

SEQ ID NO: 513768 - RNA, 32 nt, Human
ugagcugggcuggggcucagggguccuaaccc

SEQ ID NO: 513769 - RNA, 32 nt, Human
ugagcugguggagccagacagagcaggugcgg

SEQ ID NO: 513770 - RNA, 32 nt, Human
ugagcugguuaggaaccacagacugugacaga

SEQ ID NO: 513771 - RNA, 32 nt, Human
ugagcuguaggcagggacggggagggacuguc

SEQ ID NO: 513772 - RNA, 32 nt, Human
ugagcugucugcaggaggugaagcaguguuuu

SEQ ID NO: 513773 - RNA, 32 nt, Human
ugagcugugacccagaggggacgcugaggaag

SEQ ID NO: 513774 - RNA, 32 nt, Human
ugagcugugauugagccacugcacuccaaucu

SEQ ID NO: 513775 - RNA, 32 nt, Human
ugagcugugcagguggggagacugggcugagg

SEQ ID NO: 513776 - RNA, 32 nt, Human
ugagcugugcuucuucaaguagcucaguucuu

SEQ ID NO: 513777 - RNA, 32 nt, Human
ugagcugugggacuuuaggcaaguuaucuaaa

SEQ ID NO: 513778 - RNA, 32 nt, Human
ugagcuguguagaguuucuguguguacagaug

SEQ ID NO: 513779 - RNA, 32 nt, Human
ugagcugugucaccugacugguuuuggagguu

SEQ ID NO: 513780 - RNA, 32 nt, Human
ugagcugugugagcucuucugcccaggcgggc

SEQ ID NO: 513781 - RNA, 32 nt, Human
ugagcuguucccagggcuggagcagguguacc

SEQ ID NO: 513782 - RNA, 32 nt, Human
ugagcuguugccgcagaaugggcugcuggcuc

SEQ ID NO: 513783 - RNA, 32 nt, Human
ugagcuguuguggacuaguggugcaggcaagg

SEQ ID NO: 513784 - RNA, 21 nt, Human
ugagcuuaaguacucauuuug

SEQ ID NO: 513785 - RNA, 32 nt, Human
ugagcuuacugcagucagucacagaggcuguu

SEQ ID NO: 513786 - RNA, 32 nt, Human
ugagcuuaggaaaauguacaagagaacaaauu

SEQ ID NO: 513787 - RNA, 32 nt, Human
ugagcuuaucuguuugaugcuguggcaggguc

SEQ ID NO: 513788 - RNA, 32 nt, Human
ugagcuucacaucucagguaacuggagaaguc

SEQ ID NO: 513789 - RNA, 32 nt, Human
ugagcuucagcccauuucucuccauuuccucc

SEQ ID NO: 513790 - RNA, 32 nt, Human
ugagcuucagugagcacccaugggccugcucu

SEQ ID NO: 513791 - RNA, 32 nt, Human
ugagcuucauuucuucaagaugcucugggugg

SEQ ID NO: 513792 - RNA, 32 nt, Human
ugagcuucauuucuugccaccucuauucuuuc

SEQ ID NO: 513793 - RNA, 21 nt, Human
ugagcuuccacuggugcugcu

SEQ ID NO: 513794 - RNA, 32 nt, Human
ugagcuuccuguacccugacccucuccagccu

SEQ ID NO: 513795 - RNA, 32 nt, Human
ugagcuucuccuccgucggcgcccgggcggac

SEQ ID NO: 513796 - RNA, 32 nt, Human
ugagcuucuccuccucauccucccagccccac

SEQ ID NO: 513797 - RNA, 32 nt, Human
ugagcuucugucauaugcccaguauuaugcuu

SEQ ID NO: 513798 - RNA, 32 nt, Human
ugagcuugcaccauugcacuccagccugggcg

SEQ ID NO: 513799 - RNA, 32 nt, Human
ugagcuugcuuuccacauucucccaggguaug

SEQ ID NO: 513800 - RNA, 32 nt, Human
ugagcuuggaagaagagaggcugagagggucu

SEQ ID NO: 513801 - RNA, 32 nt, Human
ugagcuugggaaaucaagguugcagugagcua

SEQ ID NO: 513802 - RNA, 32 nt, Human
ugagcuugggaguucaagaccagccugagagg

SEQ ID NO: 513803 - RNA, 32 nt, Human
ugagcuuggggugggagauggggaacaggcag

SEQ ID NO: 513804 - RNA, 32 nt, Human
ugagcuuggggugggguggauggggaagacuu

SEQ ID NO: 513805 - RNA, 32 nt, Human
ugagcuugguguggcuugguguggcagaaggc

SEQ ID NO: 513806 - RNA, 32 nt, Human
ugagcuuguuauccaucuccccaaacuuucuc

SEQ ID NO: 513807 - RNA, 32 nt, Human
ugagcuuuauacccagcucugccacaaaugug

SEQ ID NO: 513808 - RNA, 32 nt, Human
ugagcuuuaucucauuuaaucuuggcaguggu

SEQ ID NO: 513809 - RNA, 32 nt, Human
ugagcuuucacucaaccccggcaagcagaggu

SEQ ID NO: 513810 - RNA, 32 nt, Human
ugagcuuucuaggucacauuggguuaaguuug

SEQ ID NO: 513811 - RNA, 32 nt, Human
ugagcuuucuucuuggacaccuaauacccaca

SEQ ID NO: 513812 - RNA, 32 nt, Human
ugagcuuugccugucucuugccuuaucaguuc

SEQ ID NO: 513813 - RNA, 32 nt, Human
ugagcuuuuccgugccucuccuccaccucucc

SEQ ID NO: 513814 - RNA, 22 nt, Human
ugagcuuuuggcuuacuauaua

SEQ ID NO: 513815 - RNA, 32 nt, Human
ugaggaaaaagaacuguaacaguaucugugac

SEQ ID NO: 513816 - RNA, 32 nt, Human
ugaggaaaaguccacaagaacaauucaagaaa

SEQ ID NO: 513817 - RNA, 32 nt, Human
ugaggaaacagccacauguucgucaugauuga

SEQ ID NO: 513818 - RNA, 32 nt, Human
ugaggaaacugcacuguuuuauuuuaauucag

SEQ ID NO: 513819 - RNA, 32 nt, Human
ugaggaaacuggagaguaauuugauggagauc

SEQ ID NO: 513820 - RNA, 32 nt, Human
ugaggaaagagaccuccagcaaguccagccag

SEQ ID NO: 513821 - RNA, 32 nt, Human
ugaggaaagaggagacagugggagaggacaau

SEQ ID NO: 513822 - RNA, 32 nt, Human
ugaggaaagcaaaacaccauuuagggcuacca

SEQ ID NO: 513823 - RNA, 32 nt, Human
ugaggaaaggagagggaggaguaaaggggauu

SEQ ID NO: 513824 - RNA, 32 nt, Human
ugaggaaagugaggacaaggagcaagauaucc

SEQ ID NO: 513825 - RNA, 32 nt, Human
ugaggaaaugacaggaggaagacguggguuug

SEQ ID NO: 513826 - RNA, 32 nt, Human
ugaggaaaugagaucacaucuuugucacugga

SEQ ID NO: 513827 - RNA, 32 nt, Human
ugaggaaauuauuucauccccuugugacaucu

SEQ ID NO: 513828 - RNA, 31 nt, Human
ugaggaacacuuuucugaaauaugucaagaa

SEQ ID NO: 513829 - RNA, 32 nt, Human
ugaggaacagccgcagcgugucacagguguug

SEQ ID NO: 513830 - RNA, 32 nt, Human
ugaggaaccacugucucaauaaggucucagug

SEQ ID NO: 513831 - RNA, 32 nt, Human
ugaggaacccuuacaguaggagcccagcucug

SEQ ID NO: 513832 - RNA, 32 nt, Human
ugaggaacucacauacugacuucagugggacu

SEQ ID NO: 513833 - RNA, 32 nt, Human
ugaggaacucagaaguggagauuucaguucag

SEQ ID NO: 513834 - RNA, 32 nt, Human
ugaggaacuggucuucuggagacucugugugg

SEQ ID NO: 513835 - RNA, 32 nt, Human
ugaggaacuguggcacagcaccucguggccug

SEQ ID NO: 513836 - RNA, 32 nt, Human
ugaggaagaaagaggaggagguuugggagcua

SEQ ID NO: 513837 - RNA, 32 nt, Human
ugaggaagaagaggagcugaagguaagaaacu

SEQ ID NO: 513838 - RNA, 32 nt, Human
ugaggaagaagaggaggaggaggaagaggagg

SEQ ID NO: 513839 - RNA, 32 nt, Human
ugaggaagaccagccaccaguggaagcggggu

SEQ ID NO: 513840 - RNA, 32 nt, Human
ugaggaagacgaggacagggaggaggaaaagg

SEQ ID NO: 513841 - RNA, 32 nt, Human
ugaggaagagggcucagagccugacucugagg

SEQ ID NO: 513842 - RNA, 32 nt, Human
ugaggaagauggaccuggacagacagucagcu

SEQ ID NO: 513843 - RNA, 32 nt, Human
ugaggaagcacagcagcaucuucaaacaugua

SEQ ID NO: 513844 - RNA, 32 nt, Human
ugaggaagcugaagcagagaaguuaacuacuu

SEQ ID NO: 513845 - RNA, 32 nt, Human
ugaggaaggaacuagagagaguggcaggagcg

SEQ ID NO: 513846 - RNA, 32 nt, Human
ugaggaaggaauaguuugaggcuggagagaug

SEQ ID NO: 513847 - RNA, 32 nt, Human
ugaggaaggagaggagaggguggcaaugaugc

SEQ ID NO: 513848 - RNA, 32 nt, Human
ugaggaaggagaguggauaaaguagugaaugc

SEQ ID NO: 513849 - RNA, 32 nt, Human
ugaggaaggaggaucgcuugaggccaggaguu

SEQ ID NO: 513850 - RNA, 32 nt, Human
ugaggaaggggcaucacuugaaccaggaguuc

SEQ ID NO: 513851 - RNA, 32 nt, Human
ugaggaaggguaaggggcagggcugguuucag

SEQ ID NO: 513852 - RNA, 32 nt, Human
ugaggaagugagcucagggaggcugagugucc

SEQ ID NO: 513853 - RNA, 32 nt, Human
ugaggaaucuguguguucuccacacucuucgc

SEQ ID NO: 513854 - RNA, 32 nt, Human
ugaggaaugcagaaaaaccagggcaggacagu

SEQ ID NO: 513855 - RNA, 32 nt, Human
ugaggaaugcgguucagggcuggggugagagu

SEQ ID NO: 513856 - RNA, 32 nt, Human
ugaggaauggcugacuccaaagcauguggugg

SEQ ID NO: 513857 - RNA, 31 nt, Human
ugaggaauuaccaaggaggcaggagguggag

SEQ ID NO: 513858 - RNA, 32 nt, Human
ugaggaauucucuccacaccuaggcaauaauu

SEQ ID NO: 513859 - RNA, 32 nt, Human
ugaggaauugcgagauauugcugaggggaaaa

SEQ ID NO: 513860 - RNA, 32 nt, Human
ugaggaauuuggugagcgagauaaaaguccac

SEQ ID NO: 513861 - RNA, 19 nt, Human
ugaggacaaaaauauggac

SEQ ID NO: 513862 - RNA, 32 nt, Human
ugaggacaaagcagggcaccucucugaacuga

SEQ ID NO: 513863 - RNA, 32 nt, Human
ugaggacacacagagggugggggugagcaggc

SEQ ID NO: 513864 - RNA, 32 nt, Human
ugaggacagaggaucacuugaggucaggaguu

SEQ ID NO: 513865 - RNA, 22 nt, Human
ugaggacagccucgggucacca

SEQ ID NO: 513866 - RNA, 32 nt, Human
ugaggacagcugcagagguggcagugugugga

SEQ ID NO: 513867 - RNA, 32 nt, Human
ugaggacaggaguucaagaccagccugggcaa

SEQ ID NO: 513868 - RNA, 32 nt, Human
ugaggacaggcuggcgccuccacccacccucc

SEQ ID NO: 513869 - RNA, 32 nt, Human
ugaggacagucuccaaaugacagcugcaugcc

SEQ ID NO: 513870 - RNA, 32 nt, Human
ugaggacaguuuguuaauacgcuauauacugu

SEQ ID NO: 513871 - RNA, 32 nt, Human
ugaggacauauguacauauacaaguauagaca

SEQ ID NO: 513872 - RNA, 32 nt, Human
ugaggacaucagggccaccucuggaccccuug

SEQ ID NO: 513873 - RNA, 32 nt, Human
ugaggacauccugugcaugaugccuagagagu

SEQ ID NO: 513874 - RNA, 32 nt, Human
ugaggacaugagauuugggagggaccaggggc

SEQ ID NO: 513875 - RNA, 32 nt, Human
ugaggacaugagcaaccagugccagggagggu

SEQ ID NO: 513876 - RNA, 32 nt, Human
ugaggaccagccuguacauguauagaagaaaa

SEQ ID NO: 513877 - RNA, 32 nt, Human
ugaggacccuucagagccacccuuucuaguuu

SEQ ID NO: 513878 - RNA, 32 nt, Human
ugaggaccgcugcucucugccucuccaggaau

SEQ ID NO: 513879 - RNA, 32 nt, Human
ugaggaccucaaggaccccaucaaguguacac

SEQ ID NO: 513880 - RNA, 32 nt, Human
ugaggaccucgauguccagcugcugucagguc

SEQ ID NO: 513881 - RNA, 32 nt, Human
ugaggaccugccaaauggaagaaggacagaga

SEQ ID NO: 513882 - RNA, 32 nt, Human
ugaggaccuggugcaggaagcuucaucugaag

SEQ ID NO: 513883 - RNA, 32 nt, Human
ugaggaccuucccagucuccccagaguccgug

SEQ ID NO: 513884 - RNA, 32 nt, Human
ugaggacgagacccccauccagccuccagggc

SEQ ID NO: 513885 - RNA, 32 nt, Human
ugaggacgaggaggcagcaggagcagugacgg

SEQ ID NO: 513886 - RNA, 32 nt, Human
ugaggacgggucgcauuauguugcccaggcug

SEQ ID NO: 513887 - RNA, 32 nt, Human
ugaggacggucugccuucccucgucccuuuac

SEQ ID NO: 513888 - RNA, 32 nt, Human
ugaggacgguuccagcccugggccaggcagag

SEQ ID NO: 513889 - RNA, 32 nt, Human
ugaggacgugacuucccauugguucauguauc

SEQ ID NO: 513890 - RNA, 32 nt, Human
ugaggacguggugacuuccugaacaucagcuu

SEQ ID NO: 513891 - RNA, 32 nt, Human
ugaggacguguccauggacuucucccaggagg

SEQ ID NO: 513892 - RNA, 32 nt, Human
ugaggacuaagcucugauuuuucaucuugccc

SEQ ID NO: 513893 - RNA, 32 nt, Human
ugaggacucacugagugcaccuccaucuccaa

SEQ ID NO: 513894 - RNA, 31 nt, Human
ugaggacucagaggaacuggcagcucagcug

SEQ ID NO: 513895 - RNA, 32 nt, Human
ugaggacuccauccuccuguuccauucaucug

SEQ ID NO: 513896 - RNA, 32 nt, Human
ugaggacucccuagaagcagauguugccacgc

SEQ ID NO: 513897 - RNA, 32 nt, Human
ugaggacugcagcuagcauccaugcucugaug

SEQ ID NO: 513898 - RNA, 32 nt, Human
ugaggacuuagagugggaagcuguccuuuaac

SEQ ID NO: 513899 - RNA, 32 nt, Human
ugaggagaaaaaggagaaaagggaaaagcaga

SEQ ID NO: 513900 - RNA, 32 nt, Human
ugaggagaaagaaagagagggagggagagaaa

SEQ ID NO: 513901 - RNA, 32 nt, Human
ugaggagaaagaagaaaauggcugcccauuuc

SEQ ID NO: 513902 - RNA, 32 nt, Human
ugaggagaagaauuuucggagugaagacauca

SEQ ID NO: 513903 - RNA, 22 nt, Human
ugaggagaagaucaucggcaaa

SEQ ID NO: 513904 - RNA, 32 nt, Human
ugaggagaaggggccucagcagaggaagcacg

SEQ ID NO: 513905 - RNA, 32 nt, Human
ugaggagaaugguagagaggagaggagagaga

SEQ ID NO: 513906 - RNA, 32 nt, Human
ugaggagaccugaagaccagaggaaacacagc

SEQ ID NO: 513907 - RNA, 23 nt, Human
ugaggagacguggagaggaggag

SEQ ID NO: 513908 - RNA, 32 nt, Human
ugaggagagagaagaaacggaagaggaaguuu

SEQ ID NO: 513909 - RNA, 32 nt, Human
ugaggagaggagaacagagggauggugagaaa

SEQ ID NO: 513910 - RNA, 21 nt, Human
ugaggagaggcuccagacccg

SEQ ID NO: 513911 - RNA, 32 nt, Human
ugaggagagggugaggcccacucuguuccuac

SEQ ID NO: 513912 - RNA, 32 nt, Human
ugaggagcacacuguagacagcugcaucagug

SEQ ID NO: 513913 - RNA, 22 nt, Human
ugaggagcagaaugugguacua

SEQ ID NO: 513914 - RNA, 21 nt, Human
ugaggagcagcacagagcagc

SEQ ID NO: 513915 - RNA, 32 nt, Human
ugaggagcagcagagucugauacuaggucuag

SEQ ID NO: 513916 - RNA, 32 nt, Human
ugaggagcagucaugucuuacaugguggcagg

SEQ ID NO: 513917 - RNA, 32 nt, Human
ugaggagccagccagggguccagcacagcccu

SEQ ID NO: 513918 - RNA, 32 nt, Human
ugaggagccaugaggagccucaguuuugaaag

SEQ ID NO: 513919 - RNA, 32 nt, Human
ugaggagccgggaggcuggaccagucccgucg

SEQ ID NO: 513920 - RNA, 32 nt, Human
ugaggagccugcggugcuccccagaaaagggg

SEQ ID NO: 513921 - RNA, 32 nt, Human
ugaggagccuugcugcucaucagcauccaggu

SEQ ID NO: 513922 - RNA, 32 nt, Human
ugaggagcgggccaccccacacgccaagucgg

SEQ ID NO: 513923 - RNA, 32 nt, Human
ugaggagcguccauuccucuggagucucuccu

SEQ ID NO: 513924 - RNA, 32 nt, Human
ugaggagcuaugaacugguuuuggucccucua

SEQ ID NO: 513925 - RNA, 32 nt, Human
ugaggagcucaugcccuuccuuccucuuuauu

SEQ ID NO: 513926 - RNA, 32 nt, Human
ugaggagcugaccgcucugagcuguucuguuu

SEQ ID NO: 513927 - RNA, 32 nt, Human
ugaggagcugcagucucugucaagaugauaga

SEQ ID NO: 513928 - RNA, 32 nt, Human
ugaggagcugccugccuucuuccaucugagaa

SEQ ID NO: 513929 - RNA, 32 nt, Human
ugaggagcugccuggagcucaccccgcucuuc

SEQ ID NO: 513930 - RNA, 32 nt, Human
ugaggagcugggacaugcugggcaguugucag

SEQ ID NO: 513931 - RNA, 21 nt, Human
ugaggaggaagaggaggagga

SEQ ID NO: 513932 - RNA, 32 nt, Human
ugaggaggaagaggaggaggaagaggaggaag

SEQ ID NO: 513933 - RNA, 32 nt, Human
ugaggaggaagaggaggcgagggaaucagaaa

SEQ ID NO: 513934 - RNA, 32 nt, Human
ugaggaggaagugggcucugaggcugcagggc

SEQ ID NO: 513935 - RNA, 32 nt, Human
ugaggaggaauguaccacugaggcagagaaga

SEQ ID NO: 513936 - RNA, 32 nt, Human
ugaggaggagccgaggccccagcuucauccag

SEQ ID NO: 513937 - RNA, 32 nt, Human
ugaggaggaggaggagaagcggaugagaucgu

SEQ ID NO: 513938 - RNA, 22 nt, Human
ugaggaggaggaggaggaggag

SEQ ID NO: 513939 - RNA, 32 nt, Human
ugaggaggaggaggaggaggaugugaagaugg

SEQ ID NO: 513940 - RNA, 32 nt, Human
ugaggaggaucucaugguuaaugggguacaug

SEQ ID NO: 513941 - RNA, 24 nt, Human
ugaggaggaugacgaggaugagga

SEQ ID NO: 513942 - RNA, 22 nt, Human
ugaggaggcaggagcuggggag

SEQ ID NO: 513943 - RNA, 21 nt, Human
ugaggaggcauuuuugggggg

SEQ ID NO: 513944 - RNA, 32 nt, Human
ugaggaggccugauugaggcaagucagccucc

SEQ ID NO: 513945 - RNA, 32 nt, Human
ugaggaggcugaggcaggagaaucacuugaac

SEQ ID NO: 513946 - RNA, 32 nt, Human
ugaggaggcugaggcaggagaauugcuugaac

SEQ ID NO: 513947 - RNA, 23 nt, Human
ugaggaggcugcacuguggggag

SEQ ID NO: 513948 - RNA, 32 nt, Human
ugaggaggcuggcacuucugaagauccugaag

SEQ ID NO: 513949 - RNA, 32 nt, Human
ugaggaggcuugagacaggguuauggauuucc

SEQ ID NO: 513950 - RNA, 32 nt, Human
ugaggaggcuuuggaagagaaggugaggagca

SEQ ID NO: 513951 - RNA, 32 nt, Human
ugaggaggcuuugguugcacuucuuuggcugg

SEQ ID NO: 513952 - RNA, 32 nt, Human
ugaggagggaaacaaaggaggcuucugcagga

SEQ ID NO: 513953 - RNA, 32 nt, Human
ugaggagggagaaucacuugaggccaggaauu

SEQ ID NO: 513954 - RNA, 32 nt, Human
ugaggagggaggaucucuugugccuaggaguu

SEQ ID NO: 513955 - RNA, 32 nt, Human
ugaggagggaggauggcuugaacacagguguu

SEQ ID NO: 513956 - RNA, 32 nt, Human
ugaggagggaggauggcuugagcccaggagau

SEQ ID NO: 513957 - RNA, 32 nt, Human
ugaggagggcaaaucacuugagcucaggaguu

SEQ ID NO: 513958 - RNA, 32 nt, Human
ugaggagggcagaucacuugagcccaggaguu

SEQ ID NO: 513959 - RNA, 32 nt, Human
ugaggagggcuggacaagaauccauuccuugg

SEQ ID NO: 513960 - RNA, 32 nt, Human
ugaggagggcugggagcaguggcucacgccug

SEQ ID NO: 513961 - RNA, 32 nt, Human
ugaggaggggagcaaggcugcuaaguggaaga

SEQ ID NO: 513962 - RNA, 32 nt, Human
ugaggaggggcacacuccuaaauugcuggaug

SEQ ID NO: 513963 - RNA, 32 nt, Human
ugaggagggggcacuccucuccagccccuggu

SEQ ID NO: 513964 - RNA, 32 nt, Human
ugaggagggguuucccuuugggccucaguguu

SEQ ID NO: 513965 - RNA, 32 nt, Human
ugaggagggugaggcucaaagagcagaguucc

SEQ ID NO: 513966 - RNA, 32 nt, Human
ugaggagggugaggcucagagagcuaaggaca

SEQ ID NO: 513967 - RNA, 32 nt, Human
ugaggaggguggaucacuuaaggucaggaguu

SEQ ID NO: 513968 - RNA, 32 nt, Human
ugaggaggguggaucacuugaggccaggaauu

SEQ ID NO: 513969 - RNA, 32 nt, Human
ugaggaggguggauuucuugagcccagggguu

SEQ ID NO: 513970 - RNA, 28 nt, Human
ugaggagggugggaguguggauggggag

SEQ ID NO: 513971 - RNA, 22 nt, Human
ugaggagguggauggaagggag

SEQ ID NO: 513972 - RNA, 32 nt, Human
ugaggagguggcauccccugcccaugccuacc

SEQ ID NO: 513973 - RNA, 32 nt, Human
ugaggagguggguggaggcaugcaggggagac

SEQ ID NO: 513974 - RNA, 22 nt, Human
ugaggaggugugugagcaggga

SEQ ID NO: 513975 - RNA, 32 nt, Human
ugaggagugacagggcuggagacugugucugc

SEQ ID NO: 513976 - RNA, 32 nt, Human
ugaggagugagacacaggcaucaacacucuca

SEQ ID NO: 513977 - RNA, 32 nt, Human
ugaggagugggcuccugcuccaugagggacac

SEQ ID NO: 513978 - RNA, 32 nt, Human
ugaggaguggugccuauaaugaagacagcgug

SEQ ID NO: 513979 - RNA, 20 nt, Human
ugaggagugguuccagcaaa

SEQ ID NO: 513980 - RNA, 31 nt, Human
ugaggaguugagagagugcaggcugggguca

SEQ ID NO: 513981 - RNA, 32 nt, Human
ugaggaguugcaggguguuccaccaagacgca

SEQ ID NO: 513982 - RNA, 32 nt, Human
ugaggaguuugagaccagccugggcaacauag

SEQ ID NO: 513983 - RNA, 32 nt, Human
ugaggauaauaauacuucauucaugccuuuuu

SEQ ID NO: 513984 - RNA, 32 nt, Human
ugaggauacauacucuggguuuccauuucacc

SEQ ID NO: 513985 - RNA, 32 nt, Human
ugaggauagaaggacggguggaagagaggcag

SEQ ID NO: 513986 - RNA, 32 nt, Human
ugaggauagaccacaaguggguggugagacca

SEQ ID NO: 513987 - RNA, 32 nt, Human
ugaggauaggaguuugagguugcagucagcua

SEQ ID NO: 513988 - RNA, 32 nt, Human
ugaggauauuggaacucagagagguggcuauu

SEQ ID NO: 513989 - RNA, 32 nt, Human
ugaggaucagaaaguaauuucuucucaaaggg

SEQ ID NO: 513990 - RNA, 32 nt, Human
ugaggaucagccggaagagaaaaugagacccc

SEQ ID NO: 513991 - RNA, 32 nt, Human
ugaggauccagccagugaccacggccacuccc

SEQ ID NO: 513992 - RNA, 32 nt, Human
ugaggaucugaagaaaaugugccauaaagcag

SEQ ID NO: 513993 - RNA, 32 nt, Human
ugaggaucugccgggugcugaggucucucaaa

SEQ ID NO: 513994 - RNA, 32 nt, Human
ugaggaugaauaggacaggacaaggagauggu

SEQ ID NO: 513995 - RNA, 30 nt, Human
ugaggaugagacaagccacauuggagaaug

SEQ ID NO: 513996 - RNA, 32 nt, Human
ugaggaugaggcagggcagacacaggccagug

SEQ ID NO: 513997 - RNA, 21 nt, Human
ugaggaugaugagacaaaaga

SEQ ID NO: 513998 - RNA, 32 nt, Human
ugaggaugcauggcaagcucaaacuuuguggu

SEQ ID NO: 513999 - RNA, 32 nt, Human
ugaggaugccaaggacuucuucaagaggaaga

SEQ ID NO: 514000 - RNA, 21 nt, Human
ugaggaugccaagugcuuuaa

SEQ ID NO: 514001 - RNA, 32 nt, Human
ugaggaugcugcuggcagccuggggaaggagc

SEQ ID NO: 514002 - RNA, 32 nt, Human
ugaggauggaaaaucacuugaggccaggaguu

SEQ ID NO: 514003 - RNA, 32 nt, Human
ugaggauggagacagccagcagaggccuauca

SEQ ID NO: 514004 - RNA, 32 nt, Human
ugaggauggcugcuucaggcugcggaaacuga

SEQ ID NO: 514005 - RNA, 32 nt, Human
ugaggauggggaggggccagugagcucugggc

SEQ ID NO: 514006 - RNA, 32 nt, Human
ugaggauggguccugcuugcagaagcugcccu

SEQ ID NO: 514007 - RNA, 32 nt, Human
ugaggauguaucaguacuucauucuuuuguau

SEQ ID NO: 514008 - RNA, 32 nt, Human
ugaggaugucggcggucggggacuuuaccugc

SEQ ID NO: 514009 - RNA, 32 nt, Human
ugaggaugugcggugcauaaaggggcuggaag

SEQ ID NO: 514010 - RNA, 32 nt, Human
ugaggaugugggguuugaaaggaagcagugca

SEQ ID NO: 514011 - RNA, 30 nt, Human
ugaggauguucaggcuggggcugcugguuu

SEQ ID NO: 514012 - RNA, 32 nt, Human
ugaggauuaguagaagagaguggguccagauu

SEQ ID NO: 514013 - RNA, 32 nt, Human
ugaggauucccugccaagaugccugagggcuu

SEQ ID NO: 514014 - RNA, 23 nt, Human
ugaggauucugcacaaaagaggu

SEQ ID NO: 514015 - RNA, 19 nt, Human
ugaggauucuucccgggga

SEQ ID NO: 514016 - RNA, 32 nt, Human
ugaggauugcaaccgcugccuccaggguccag

SEQ ID NO: 514017 - RNA, 32 nt, Human
ugaggauuuucugacagagugauacccaucaa

SEQ ID NO: 514018 - RNA, 22 nt, Human
ugaggcaaaagaauuugccaua

SEQ ID NO: 514019 - RNA, 32 nt, Human
ugaggcaaaagauaccagucgacagccucccu

SEQ ID NO: 514020 - RNA, 32 nt, Human
ugaggcaaaggccaucuccuauggaccaagga

SEQ ID NO: 514021 - RNA, 32 nt, Human
ugaggcaacuacagucagauuuauagccagcc

SEQ ID NO: 514022 - RNA, 32 nt, Human
ugaggcaagaagaucacuugagccuaggaauu

SEQ ID NO: 514023 - RNA, 32 nt, Human
ugaggcaagagaaucacuugaaccucggaggc

SEQ ID NO: 514024 - RNA, 32 nt, Human
ugaggcaagagaaucucuugagcucaggaggc

SEQ ID NO: 514025 - RNA, 32 nt, Human
ugaggcaagagaauuacuugagcccaggaguu

SEQ ID NO: 514026 - RNA, 32 nt, Human
ugaggcaagaggaucacuugagcccagaaggu

SEQ ID NO: 514027 - RNA, 32 nt, Human
ugaggcaagaggaucacuugaggccaggaguu

SEQ ID NO: 514028 - RNA, 32 nt, Human
ugaggcaagaggauuacuugagcucaggaguu

SEQ ID NO: 514029 - RNA, 32 nt, Human
ugaggcaaggagauugguucacuauggagaag

SEQ ID NO: 514030 - RNA, 32 nt, Human
ugaggcaaggucucgcucuguugcccauucug

SEQ ID NO: 514031 - RNA, 32 nt, Human
ugaggcaaggucuugcucugucaccuaggcua

SEQ ID NO: 514032 - RNA, 32 nt, Human
ugaggcaaguggaucacuugaggucaggaguu

SEQ ID NO: 514033 - RNA, 32 nt, Human
ugaggcaauugcucaaacuuuguucaacauca

SEQ ID NO: 514034 - RNA, 32 nt, Human
ugaggcacaagaaucauuugagcucaggaggc

SEQ ID NO: 514035 - RNA, 32 nt, Human
ugaggcacagaagggcuggaugucagaaccgc

SEQ ID NO: 514036 - RNA, 32 nt, Human
ugaggcacagagccuggcugagcacuaugaca

SEQ ID NO: 514037 - RNA, 32 nt, Human
ugaggcacauggaccacuugaggucaggaguu

SEQ ID NO: 514038 - RNA, 32 nt, Human
ugaggcaccacugcacucuagccugggcaaga

SEQ ID NO: 514039 - RNA, 32 nt, Human
ugaggcacgagaaucacuugaacucaggagau

SEQ ID NO: 514040 - RNA, 32 nt, Human
ugaggcacgagaaucacuugagcccaggaggu

SEQ ID NO: 514041 - RNA, 17 nt, Human
ugaggcacggagcgggc

SEQ ID NO: 514042 - RNA, 32 nt, Human
ugaggcacuggcaagguagggggcagaugggg

SEQ ID NO: 514043 - RNA, 32 nt, Human
ugaggcacuucaugagcucagugagaagggcc

SEQ ID NO: 514044 - RNA, 32 nt, Human
ugaggcagaagaauugaacccaggagguggag

SEQ ID NO: 514045 - RNA, 32 nt, Human
ugaggcagaagcauugcuugagcuugggagau

SEQ ID NO: 514046 - RNA, 19 nt, Human
ugaggcagaagccuugaac

SEQ ID NO: 514047 - RNA, 32 nt, Human
ugaggcagaaggaucaccugaguccaggaauu

SEQ ID NO: 514048 - RNA, 32 nt, Human
ugaggcagaaggaucacuugagcccagaaguu

SEQ ID NO: 514049 - RNA, 32 nt, Human
ugaggcagaaggauugcuggggcccacaaagu

SEQ ID NO: 514050 - RNA, 32 nt, Human
ugaggcagacuggaagagucaucacagcaucc

SEQ ID NO: 514051 - RNA, 32 nt, Human
ugaggcagagcugagagagaagaaaaauuacc

SEQ ID NO: 514052 - RNA, 32 nt, Human
ugaggcagagcugcggcuaaucgaaaagcaag

SEQ ID NO: 514053 - RNA, 21 nt, Human
ugaggcagagucucacucugu

SEQ ID NO: 514054 - RNA, 21 nt, Human
ugaggcagagucucucucugu

SEQ ID NO: 514055 - RNA, 32 nt, Human
ugaggcagagucuucuuugugccugaguggcc

SEQ ID NO: 514056 - RNA, 20 nt, Human
ugaggcagagucuugcucug

SEQ ID NO: 514057 - RNA, 21 nt, Human
ugaggcagagucuugcucugu

SEQ ID NO: 514058 - RNA, 32 nt, Human
ugaggcagagucuugcucugucacccaggcug

SEQ ID NO: 514059 - RNA, 32 nt, Human
ugaggcagagucuugcucuguugcccaggcug

SEQ ID NO: 514060 - RNA, 32 nt, Human
ugaggcagcaaagccccugaaaacgcugguac

SEQ ID NO: 514061 - RNA, 32 nt, Human
ugaggcagcacugagcacgguagggcagccug

SEQ ID NO: 514062 - RNA, 32 nt, Human
ugaggcagcagguaggacagugaccucgguga

SEQ ID NO: 514063 - RNA, 20 nt, Human
ugaggcagccagcgcccccu

SEQ ID NO: 514064 - RNA, 32 nt, Human
ugaggcagccuucgcugcuuuccucugcuguc

SEQ ID NO: 514065 - RNA, 32 nt, Human
ugaggcagcugccagccggccugggcagucuu

SEQ ID NO: 514066 - RNA, 32 nt, Human
ugaggcagcugccuccugauccuggccagccc

SEQ ID NO: 514067 - RNA, 32 nt, Human
ugaggcaggaaaaucacuugaacucgggaggc

SEQ ID NO: 514068 - RNA, 32 nt, Human
ugaggcaggaacaggguucugcccucccagag

SEQ ID NO: 514069 - RNA, 32 nt, Human
ugaggcaggaagagcccuugagcccaggagcu

SEQ ID NO: 514070 - RNA, 32 nt, Human
ugaggcaggaagauagcuugagcucagagagu

SEQ ID NO: 514071 - RNA, 32 nt, Human
ugaggcaggaagcucgcuugagcucaggaguu

SEQ ID NO: 514072 - RNA, 32 nt, Human
ugaggcaggacgauuacuugagcuugggaaau

SEQ ID NO: 514073 - RNA, 32 nt, Human
ugaggcaggacuagcaggagcgccucagaccc

SEQ ID NO: 514074 - RNA, 32 nt, Human
ugaggcaggagaaucacuugaacucaggaggc

SEQ ID NO: 514075 - RNA, 32 nt, Human
ugaggcaggagaaucacuugaacucaggaggu

SEQ ID NO: 514076 - RNA, 32 nt, Human
ugaggcaggagaaucacuugaacucagguggc

SEQ ID NO: 514077 - RNA, 32 nt, Human
ugaggcaggagaaucacuugaacucgggaggc

SEQ ID NO: 514078 - RNA, 32 nt, Human
ugaggcaggagaaucacuugaacucgggaggu

SEQ ID NO: 514079 - RNA, 32 nt, Human
ugaggcaggagaaucacuugaagccaggaggc

SEQ ID NO: 514080 - RNA, 32 nt, Human
ugaggcaggagaaucacuugaagcugggaggc

SEQ ID NO: 514081 - RNA, 32 nt, Human
ugaggcaggagaaucacuugaaucagggaggc

SEQ ID NO: 514082 - RNA, 32 nt, Human
ugaggcaggagaaucacuugaauucaggaggc

SEQ ID NO: 514083 - RNA, 32 nt, Human
ugaggcaggagaaucacuugaauucaggaggu

SEQ ID NO: 514084 - RNA, 32 nt, Human
ugaggcaggagaaucacuugaccucaggaggc

SEQ ID NO: 514085 - RNA, 32 nt, Human
ugaggcaggagaaucacuugagaccaggaagu

SEQ ID NO: 514086 - RNA, 32 nt, Human
ugaggcaggagaaucacuugagcccaggaagu

SEQ ID NO: 514087 - RNA, 32 nt, Human
ugaggcaggagaaucacuugagcccaggaggu

SEQ ID NO: 514088 - RNA, 32 nt, Human
ugaggcaggagaaucacuugagcccgggaagu

SEQ ID NO: 514089 - RNA, 32 nt, Human
ugaggcaggagaaucacuugaggucgggaguu

SEQ ID NO: 514090 - RNA, 32 nt, Human
ugaggcaggagaaucgcgugaacccgggcccg

SEQ ID NO: 514091 - RNA, 23 nt, Human
ugaggcaggagaaucgcuugaac

SEQ ID NO: 514092 - RNA, 32 nt, Human
ugaggcaggagaaucucgggaggcagagguug

SEQ ID NO: 514093 - RNA, 32 nt, Human
ugaggcaggagaauggcguaaaccccuccagc

SEQ ID NO: 514094 - RNA, 23 nt, Human
ugaggcaggagaauugcuugaac

SEQ ID NO: 514095 - RNA, 23 nt, Human
ugaggcaggagaccugcuugaac

SEQ ID NO: 514096 - RNA, 31 nt, Human
ugaggcaggagaccugcuugaaccuggaggu

SEQ ID NO: 514097 - RNA, 32 nt, Human
ugaggcaggagagagagcagcuccccugccca

SEQ ID NO: 514098 - RNA, 32 nt, Human
ugaggcaggagaguggacugagcccaggaguu

SEQ ID NO: 514099 - RNA, 21 nt, Human
ugaggcaggagagugguguga

SEQ ID NO: 514100 - RNA, 32 nt, Human
ugaggcaggaggaccgcuugagcccaggaguu

SEQ ID NO: 514101 - RNA, 32 nt, Human
ugaggcaggaggaucaccugaggucaggaguu

SEQ ID NO: 514102 - RNA, 32 nt, Human
ugaggcaggaggaucacgugagcccaggaauu

SEQ ID NO: 514103 - RNA, 32 nt, Human
ugaggcaggaggaucacucgagcucaagaauu

SEQ ID NO: 514104 - RNA, 32 nt, Human
ugaggcaggaggaucacuuaagcccagaaggc

SEQ ID NO: 514105 - RNA, 32 nt, Human
ugaggcaggaggaucacuuaagccugggaggc

SEQ ID NO: 514106 - RNA, 32 nt, Human
ugaggcaggaggaucacuuaaggccaggaguu

SEQ ID NO: 514107 - RNA, 32 nt, Human
ugaggcaggaggaucacuucagccgaggaagg

SEQ ID NO: 514108 - RNA, 32 nt, Human
ugaggcaggaggaucacuucagccuaggacgu

SEQ ID NO: 514109 - RNA, 32 nt, Human
ugaggcaggaggaucacuugaaccugggaggc

SEQ ID NO: 514110 - RNA, 32 nt, Human
ugaggcaggaggaucacuugaaccugggaggu

SEQ ID NO: 514111 - RNA, 32 nt, Human
ugaggcaggaggaucacuugaacuggggaggu

SEQ ID NO: 514112 - RNA, 32 nt, Human
ugaggcaggaggaucacuugagaccaggaguu

SEQ ID NO: 514113 - RNA, 32 nt, Human
ugaggcaggaggaucacuugagccaaggaguu

SEQ ID NO: 514114 - RNA, 32 nt, Human
ugaggcaggaggaucacuugagcccaggagau

SEQ ID NO: 514115 - RNA, 32 nt, Human
ugaggcaggaggaucacuugagcccaggaggu

SEQ ID NO: 514116 - RNA, 32 nt, Human
ugaggcaggaggaucacuugagcccaggaguu

SEQ ID NO: 514117 - RNA, 32 nt, Human
ugaggcaggaggaucacuugagccuauuaguu

SEQ ID NO: 514118 - RNA, 32 nt, Human
ugaggcaggaggaucacuugagccugggaauu

SEQ ID NO: 514119 - RNA, 32 nt, Human
ugaggcaggaggaucacuugaggccaggaguu

SEQ ID NO: 514120 - RNA, 32 nt, Human
ugaggcaggaggaucacuugaggucaggaguu

SEQ ID NO: 514121 - RNA, 32 nt, Human
ugaggcaggaggaucauuugagcccaggaaac

SEQ ID NO: 514122 - RNA, 32 nt, Human
ugaggcaggaggaucauuugagccugggaauu

SEQ ID NO: 514123 - RNA, 32 nt, Human
ugaggcaggaggaucauuugagcucaugaggg

SEQ ID NO: 514124 - RNA, 32 nt, Human
ugaggcaggaggaucauuugaggucaggaguu

SEQ ID NO: 514125 - RNA, 32 nt, Human
ugaggcaggaggaucccuugagcccagaaggu

SEQ ID NO: 514126 - RNA, 32 nt, Human
ugaggcaggaggaucccuugagcccaggaggu

SEQ ID NO: 514127 - RNA, 32 nt, Human
ugaggcaggaggaucccuugaguccaggaggu

SEQ ID NO: 514128 - RNA, 32 nt, Human
ugaggcaggaggaucccuugaguucaggaguu

SEQ ID NO: 514129 - RNA, 32 nt, Human
ugaggcaggaggaucccuuggguucaggaguu

SEQ ID NO: 514130 - RNA, 32 nt, Human
ugaggcaggaggaucgccugagcccaggaggu

SEQ ID NO: 514131 - RNA, 32 nt, Human
ugaggcaggaggaucgcuuaagcacaggaguu

SEQ ID NO: 514132 - RNA, 32 nt, Human
ugaggcaggaggaucgcuugaacccaggaagc

SEQ ID NO: 514133 - RNA, 32 nt, Human
ugaggcaggaggaucgcuugaacccaggaagu

SEQ ID NO: 514134 - RNA, 32 nt, Human
ugaggcaggaggaucgcuugaacccaggaggu

SEQ ID NO: 514135 - RNA, 32 nt, Human
ugaggcaggaggaucgcuugaaccugagaggc

SEQ ID NO: 514136 - RNA, 32 nt, Human
ugaggcaggaggaucgcuugagcccagaaguu

SEQ ID NO: 514137 - RNA, 32 nt, Human
ugaggcaggaggaucgcuugagcccaggaggc

SEQ ID NO: 514138 - RNA, 32 nt, Human
ugaggcaggaggaucgcuugagcccaggaguc

SEQ ID NO: 514139 - RNA, 32 nt, Human
ugaggcaggaggaucgcuugagcccaggaguu

SEQ ID NO: 514140 - RNA, 32 nt, Human
ugaggcaggaggaucgcuugaggccaggaguu

SEQ ID NO: 514141 - RNA, 32 nt, Human
ugaggcaggaggaucgcuugggccugggaggc

SEQ ID NO: 514142 - RNA, 32 nt, Human
ugaggcaggaggaucguuugagcucaggaggu

SEQ ID NO: 514143 - RNA, 23 nt, Human
ugaggcaggaggaucucuugagc

SEQ ID NO: 514144 - RNA, 32 nt, Human
ugaggcaggaggaucucuugagcccaggaggu

SEQ ID NO: 514145 - RNA, 32 nt, Human
ugaggcaggaggaucucuugagcccaggauuu

SEQ ID NO: 514146 - RNA, 32 nt, Human
ugaggcaggaggauugcuugagcucaggaguu

SEQ ID NO: 514147 - RNA, 32 nt, Human
ugaggcaggagggucacuugacccagggaggu

SEQ ID NO: 514148 - RNA, 32 nt, Human
ugaggcaggagggucucuugagcccaggaguu

SEQ ID NO: 514149 - RNA, 32 nt, Human
ugaggcaggaggugcagcguguggagugagaa

SEQ ID NO: 514150 - RNA, 32 nt, Human
ugaggcaggauaaucacuugagccaggaggag

SEQ ID NO: 514151 - RNA, 32 nt, Human
ugaggcaggcacaccugucggucuuggcuugc

SEQ ID NO: 514152 - RNA, 32 nt, Human
ugaggcaggcagaucacuugaggucaggaguu

SEQ ID NO: 514153 - RNA, 32 nt, Human
ugaggcaggcagaucgcuugagcucaggaguu

SEQ ID NO: 514154 - RNA, 32 nt, Human
ugaggcaggcagauugcuugagcucaggaguu

SEQ ID NO: 514155 - RNA, 32 nt, Human
ugaggcaggcaguucacuugagcccaggagcu

SEQ ID NO: 514156 - RNA, 32 nt, Human
ugaggcaggcggaucacuugaagccaggacuu

SEQ ID NO: 514157 - RNA, 32 nt, Human
ugaggcaggcggaucacuugaggucaggaguu

SEQ ID NO: 514158 - RNA, 32 nt, Human
ugaggcaggcggaucgcuugagcucaggaguu

SEQ ID NO: 514159 - RNA, 32 nt, Human
ugaggcaggcgugucacuugaggccaggaguu

SEQ ID NO: 514160 - RNA, 32 nt, Human
ugaggcaggcugaucacuugaggucaggaguu

SEQ ID NO: 514161 - RNA, 32 nt, Human
ugaggcagggccugagacuggaccugggugag

SEQ ID NO: 514162 - RNA, 32 nt, Human
ugaggcagggcuaggagaagagcccagguucc

SEQ ID NO: 514163 - RNA, 32 nt, Human
ugaggcagggcucugguuuagcuguuuccaua

SEQ ID NO: 514164 - RNA, 32 nt, Human
ugaggcaggggaaucacuugaaccugggaggc

SEQ ID NO: 514165 - RNA, 32 nt, Human
ugaggcaggggagggagccacagaaagcagag

SEQ ID NO: 514166 - RNA, 32 nt, Human
ugaggcagggggaucgcuugagcccaggaauu

SEQ ID NO: 514167 - RNA, 21 nt, Human
ugaggcagggucucacucugu

SEQ ID NO: 514168 - RNA, 21 nt, Human
ugaggcagggucucgcucugu

SEQ ID NO: 514169 - RNA, 32 nt, Human
ugaggcagggucucgcucugucaccgaggcug

SEQ ID NO: 514170 - RNA, 21 nt, Human
ugaggcagggucuugcucugu

SEQ ID NO: 514171 - RNA, 32 nt, Human
ugaggcagggucuugcucugucauccaggcug

SEQ ID NO: 514172 - RNA, 32 nt, Human
ugaggcagggucuugcuuugucacccaugcug

SEQ ID NO: 514173 - RNA, 32 nt, Human
ugaggcagguaagucacuugagcucaggaguu

SEQ ID NO: 514174 - RNA, 32 nt, Human
ugaggcagguagcucaccugagucaggagcuc

SEQ ID NO: 514175 - RNA, 18 nt, Human
ugaggcagguaugagguc

SEQ ID NO: 514176 - RNA, 23 nt, Human
ugaggcagguggaucacaagguc

SEQ ID NO: 514177 - RNA, 32 nt, Human
ugaggcagguggaucacuggaggucaggucuu

SEQ ID NO: 514178 - RNA, 32 nt, Human
ugaggcagguggaucacuugaagucaggaguu

SEQ ID NO: 514179 - RNA, 32 nt, Human
ugaggcagguggaucacuugagcucaggagcu

SEQ ID NO: 514180 - RNA, 32 nt, Human
ugaggcagguggaucacuugagcucaggaguu

SEQ ID NO: 514181 - RNA, 32 nt, Human
ugaggcagguggaucacuugaggucaggagcu

SEQ ID NO: 514182 - RNA, 32 nt, Human
ugaggcagguggaucacuugaggucaggaguu

SEQ ID NO: 514183 - RNA, 32 nt, Human
ugaggcagguggaucacuugagguuaggaguu

SEQ ID NO: 514184 - RNA, 32 nt, Human
ugaggcagguggauugcuugagcucgggaguu

SEQ ID NO: 514185 - RNA, 32 nt, Human
ugaggcagguggcucacuugaggucaggaauu

SEQ ID NO: 514186 - RNA, 32 nt, Human
ugaggcaggugggguuucuguugggagaggga

SEQ ID NO: 514187 - RNA, 32 nt, Human
ugaggcagucaggugaagaugcaggcuaggaa

SEQ ID NO: 514188 - RNA, 32 nt, Human
ugaggcaguggggaagacagagcagaaugagc

SEQ ID NO: 514189 - RNA, 32 nt, Human
ugaggcaguggguggagagagaauggggagac

SEQ ID NO: 514190 - RNA, 21 nt, Human
ugaggcagugucucacucugu

SEQ ID NO: 514191 - RNA, 32 nt, Human
ugaggcauccagcagucucugccuugccuuua

SEQ ID NO: 514192 - RNA, 32 nt, Human
ugaggcaugagaaucacuugaacucgggaggu

SEQ ID NO: 514193 - RNA, 32 nt, Human
ugaggcaugaggauugcuugagcuuggaaggu

SEQ ID NO: 514194 - RNA, 32 nt, Human
ugaggcaugcaagccucugccuuuccuucugc

SEQ ID NO: 514195 - RNA, 32 nt, Human
ugaggcaugcugggccuggugcagugauggcg

SEQ ID NO: 514196 - RNA, 30 nt, Human
ugaggcauggguuuucugcuccugugcagg

SEQ ID NO: 514197 - RNA, 32 nt, Human
ugaggcaugguggcacaugccuguaaucucaa

SEQ ID NO: 514198 - RNA, 32 nt, Human
ugaggcauucccaagcuggagucugguggaag

SEQ ID NO: 514199 - RNA, 32 nt, Human
ugaggccaaaggggcuggggaggcaggccugc

SEQ ID NO: 514200 - RNA, 32 nt, Human
ugaggccaagagaucaagaccagucugggcaa

SEQ ID NO: 514201 - RNA, 32 nt, Human
ugaggccaagaguuaaagaccagccuggucaa

SEQ ID NO: 514202 - RNA, 32 nt, Human
ugaggccaagaguucaagaccaacuuggacaa

SEQ ID NO: 514203 - RNA, 32 nt, Human
ugaggccaagaguucaagaccagccugggcaa

SEQ ID NO: 514204 - RNA, 32 nt, Human
ugaggccaagaguuucagaccagccugggcaa

SEQ ID NO: 514205 - RNA, 32 nt, Human
ugaggccaagaguuugagaccaaccuggguaa

SEQ ID NO: 514206 - RNA, 32 nt, Human
ugaggccaaggcaggagaauugcuugagccug

SEQ ID NO: 514207 - RNA, 32 nt, Human
ugaggccaagguaggaggauugcuugaguccg

SEQ ID NO: 514208 - RNA, 32 nt, Human
ugaggccaccagccccuagucucuauguucuc

SEQ ID NO: 514209 - RNA, 32 nt, Human
ugaggccaccucuuugcucaauccaugccucu

SEQ ID NO: 514210 - RNA, 32 nt, Human
ugaggccacugcacccuuucucggggaagaug

SEQ ID NO: 514211 - RNA, 32 nt, Human
ugaggccagaacucucacacacagcuaucaag

SEQ ID NO: 514212 - RNA, 32 nt, Human
ugaggccagaagugcaagaccagccugcgcaa

SEQ ID NO: 514213 - RNA, 32 nt, Human
ugaggccagaaguucaagaucagccuggccaa

SEQ ID NO: 514214 - RNA, 32 nt, Human
ugaggccagacucauguccagcaaggaacgug

SEQ ID NO: 514215 - RNA, 32 nt, Human
ugaggccagagguucaagaccagccugggcaa

SEQ ID NO: 514216 - RNA, 32 nt, Human
ugaggccagaguuugaaaccagccuagguaac

SEQ ID NO: 514217 - RNA, 32 nt, Human
ugaggccagcagaauaggugcagagaugaagu

SEQ ID NO: 514218 - RNA, 32 nt, Human
ugaggccagcaguucaagaccaaccuaggcaa

SEQ ID NO: 514219 - RNA, 32 nt, Human
ugaggccagcccuagccaacaugguguaaaca

SEQ ID NO: 514220 - RNA, 32 nt, Human
ugaggccaggaauucaagaccaaccuggccaa

SEQ ID NO: 514221 - RNA, 32 nt, Human
ugaggccaggaauucaagaccagccugaguaa

SEQ ID NO: 514222 - RNA, 32 nt, Human
ugaggccaggaauucaagaccagccuggccaa

SEQ ID NO: 514223 - RNA, 32 nt, Human
ugaggccaggaauucgagaccaaccuggucag

SEQ ID NO: 514224 - RNA, 32 nt, Human
ugaggccaggaggcggagcuugcagugagccg

SEQ ID NO: 514225 - RNA, 32 nt, Human
ugaggccaggagguccaggccgcaaugagaug

SEQ ID NO: 514226 - RNA, 32 nt, Human
ugaggccaggagguugaggcugcagugagcug

SEQ ID NO: 514227 - RNA, 32 nt, Human
ugaggccaggaguucaagaaaucacuugaacu

SEQ ID NO: 514228 - RNA, 32 nt, Human
ugaggccaggaguucaagaccagccagggcaa

SEQ ID NO: 514229 - RNA, 32 nt, Human
ugaggccaggaguucaagaccagcccaggcaa

SEQ ID NO: 514230 - RNA, 32 nt, Human
ugaggccaggaguucaagaccagccugaccaa

SEQ ID NO: 514231 - RNA, 32 nt, Human
ugaggccaggaguucaagaccagccuggccaa

SEQ ID NO: 514232 - RNA, 32 nt, Human
ugaggccaggaguucaagaccagccuggcuaa

SEQ ID NO: 514233 - RNA, 32 nt, Human
ugaggccaggaguucaagaccagccugggcaa

SEQ ID NO: 514234 - RNA, 32 nt, Human
ugaggccaggaguucaagaccagcuuggccaa

SEQ ID NO: 514235 - RNA, 32 nt, Human
ugaggccaggaguucaagaccaggcagggcaa

SEQ ID NO: 514236 - RNA, 32 nt, Human
ugaggccaggaguucaagaccagucuggccaa

SEQ ID NO: 514237 - RNA, 32 nt, Human
ugaggccaggaguucaagaccagucugggcaa

SEQ ID NO: 514238 - RNA, 32 nt, Human
ugaggccaggaguucaagaccggccuggccaa

SEQ ID NO: 514239 - RNA, 32 nt, Human
ugaggccaggaguucaagacuagccuggcuga

SEQ ID NO: 514240 - RNA, 32 nt, Human
ugaggccaggaguucaagaucagccuggccaa

SEQ ID NO: 514241 - RNA, 32 nt, Human
ugaggccaggaguucaagaucagccugggcaa

SEQ ID NO: 514242 - RNA, 32 nt, Human
ugaggccaggaguucaaggccagccuggacaa

SEQ ID NO: 514243 - RNA, 32 nt, Human
ugaggccaggaguucaauaucaguuugggcaa

SEQ ID NO: 514244 - RNA, 32 nt, Human
ugaggccaggaguucugagaccagccuggcuu

SEQ ID NO: 514245 - RNA, 32 nt, Human
ugaggccaggaguuugagaccaaccugggcaa

SEQ ID NO: 514246 - RNA, 32 nt, Human
ugaggccaggaguuugagaccaaccugguuaa

SEQ ID NO: 514247 - RNA, 32 nt, Human
ugaggccaggcaggccuggguaggggcagcuu

SEQ ID NO: 514248 - RNA, 32 nt, Human
ugaggccagguguucaagagcagccuggucaa

SEQ ID NO: 514249 - RNA, 32 nt, Human
ugaggccagugccaccagaggguggugccaag

SEQ ID NO: 514250 - RNA, 32 nt, Human
ugaggccauagaugcagggaguagaagcuuug

SEQ ID NO: 514251 - RNA, 32 nt, Human
ugaggccauagcaauuccccuacaucaaaugc

SEQ ID NO: 514252 - RNA, 18 nt, Human
ugaggccaucagggcccu

SEQ ID NO: 514253 - RNA, 32 nt, Human
ugaggccauccaggaaaaccaggagcagggca

SEQ ID NO: 514254 - RNA, 32 nt, Human
ugaggccauggauuguuauggugcuguuguuu

SEQ ID NO: 514255 - RNA, 32 nt, Human
ugaggccauggcauucuuccccuagcccccuc

SEQ ID NO: 514256 - RNA, 32 nt, Human
ugaggccauuaggggaaaaggaaggggugugg

SEQ ID NO: 514257 - RNA, 32 nt, Human
ugaggccauucccaacuuguuuuccgagggga

SEQ ID NO: 514258 - RNA, 32 nt, Human
ugaggccauuccucgucaucuaggaggggucu

SEQ ID NO: 514259 - RNA, 18 nt, Human
ugaggccauugggaaguc

SEQ ID NO: 514260 - RNA, 32 nt, Human
ugaggcccaaggagguggaguggagagugggc

SEQ ID NO: 514261 - RNA, 32 nt, Human
ugaggcccacagacucaaaguuacucuccuuc

SEQ ID NO: 514262 - RNA, 32 nt, Human
ugaggcccaccccucacauuacugucucuuug

SEQ ID NO: 514263 - RNA, 32 nt, Human
ugaggcccagaggcggagggcagucugcucaa

SEQ ID NO: 514264 - RNA, 32 nt, Human
ugaggcccagaguucaugggcugcccuggccc

SEQ ID NO: 514265 - RNA, 32 nt, Human
ugaggcccagccuguccugguacagcaggguc

SEQ ID NO: 514266 - RNA, 32 nt, Human
ugaggcccagggguggagguuagggguggagc

SEQ ID NO: 514267 - RNA, 32 nt, Human
ugaggcccagggugggcaccagccagccaugg

SEQ ID NO: 514268 - RNA, 32 nt, Human
ugaggccccaagcucaucacaccagggggcca

SEQ ID NO: 514269 - RNA, 32 nt, Human
ugaggccccagccuggagccaggcacugggug

SEQ ID NO: 514270 - RNA, 32 nt, Human
ugaggccccaggaggaaaccuuggcuucagac

SEQ ID NO: 514271 - RNA, 32 nt, Human
ugaggccccuccugcugccuggccaagcccca

SEQ ID NO: 514272 - RNA, 32 nt, Human
ugaggccccuucuagaaucuaggauaacaaga

SEQ ID NO: 514273 - RNA, 32 nt, Human
ugaggccccuugacagggcugcucuggguggu

SEQ ID NO: 514274 - RNA, 32 nt, Human
ugaggcccugcaccuuccccaaaggaaccgcc

SEQ ID NO: 514275 - RNA, 32 nt, Human
ugaggcccugcaguuaguuugcgggaacucag

SEQ ID NO: 514276 - RNA, 32 nt, Human
ugaggcccuggaccggcggcagacuggcccug

SEQ ID NO: 514277 - RNA, 32 nt, Human
ugaggcccuggcagaggugaaggacauggagc

SEQ ID NO: 514278 - RNA, 32 nt, Human
ugaggcccuugccuucagcugcuucacggagc

SEQ ID NO: 514279 - RNA, 32 nt, Human
ugaggccgaccaugcccagccugcugcugcug

SEQ ID NO: 514280 - RNA, 32 nt, Human
ugaggccgaggguucaagacuagccugggcaa

SEQ ID NO: 514281 - RNA, 32 nt, Human
ugaggccggaggaucacuugaagccaggagcu

SEQ ID NO: 514282 - RNA, 32 nt, Human
ugaggccggcagaucacuugaggucaggaguu

SEQ ID NO: 514283 - RNA, 32 nt, Human
ugaggccguaggaucccuugagcccaggaguu

SEQ ID NO: 514284 - RNA, 32 nt, Human
ugaggccguguggaaaauuaguggagagcuga

SEQ ID NO: 514285 - RNA, 32 nt, Human
ugaggccuacucuaaagaauucuugaaaaacu

SEQ ID NO: 514286 - RNA, 21 nt, Human
ugaggccuaugcaucugaaca

SEQ ID NO: 514287 - RNA, 32 nt, Human
ugaggccucaguugaggcucagucuggggcug

SEQ ID NO: 514288 - RNA, 32 nt, Human
ugaggccucccaggagggccuugggggugaug

SEQ ID NO: 514289 - RNA, 32 nt, Human
ugaggccuccccagccaugcagagccaugagu

SEQ ID NO: 514290 - RNA, 32 nt, Human
ugaggccuccccagccaugccugcuguauagc

SEQ ID NO: 514291 - RNA, 32 nt, Human
ugaggccucccgcuucccaccugcaucacagg

SEQ ID NO: 514292 - RNA, 32 nt, Human
ugaggccucccuggaggaaggaggguuagggg

SEQ ID NO: 514293 - RNA, 32 nt, Human
ugaggccucgccagccaugcagaacugaauag

SEQ ID NO: 514294 - RNA, 32 nt, Human
ugaggccugaggccucuuccucagcuuuaucu

SEQ ID NO: 514295 - RNA, 32 nt, Human
ugaggccugcggaacucagcuuggauggcagc

SEQ ID NO: 514296 - RNA, 32 nt, Human
ugaggccugcuuccuccacuugcuccagcuga

SEQ ID NO: 514297 - RNA, 32 nt, Human
ugaggccuggaaggcaggccaaccagcaaaau

SEQ ID NO: 514298 - RNA, 32 nt, Human
ugaggccuggacuguccacgcugaggcacagc

SEQ ID NO: 514299 - RNA, 32 nt, Human
ugaggccuggaguucaagaccagccugugcaa

SEQ ID NO: 514300 - RNA, 32 nt, Human
ugaggccugggagucucuugagcuccacgacu

SEQ ID NO: 514301 - RNA, 32 nt, Human
ugaggccugggguggcuccugccccuucugcc

SEQ ID NO: 514302 - RNA, 32 nt, Human
ugaggccuuaucauucauucuuagcucuuaau

SEQ ID NO: 514303 - RNA, 32 nt, Human
ugaggccuuccagaaagcaggagcagcugugc

SEQ ID NO: 514304 - RNA, 31 nt, Human
ugaggccuucucuugaggccugugcucuggg

SEQ ID NO: 514305 - RNA, 32 nt, Human
ugaggcgagagaaucacuugaacuggggaggc

SEQ ID NO: 514306 - RNA, 32 nt, Human
ugaggcgagaggaggaggaggaggaggagaag

SEQ ID NO: 514307 - RNA, 32 nt, Human
ugaggcgagaggaucacuugagcacaggaguu

SEQ ID NO: 514308 - RNA, 32 nt, Human
ugaggcgagaggaucacuugagcgcaggaauu

SEQ ID NO: 514309 - RNA, 32 nt, Human
ugaggcgaggaguucaagaccagccuaggcaa

SEQ ID NO: 514310 - RNA, 18 nt, Human
ugaggcgaggggagggac

SEQ ID NO: 514311 - RNA, 32 nt, Human
ugaggcgaggggcaaggugcuuaguccaucau

SEQ ID NO: 514312 - RNA, 32 nt, Human
ugaggcgaguggaucacuugaggccaggaguu

SEQ ID NO: 514313 - RNA, 32 nt, Human
ugaggcgaguggaucacuugaggucaggaguu

SEQ ID NO: 514314 - RNA, 32 nt, Human
ugaggcgcacugagcaucccacugcaggaaac

SEQ ID NO: 514315 - RNA, 32 nt, Human
ugaggcgccagccuggucaggggaggugacug

SEQ ID NO: 514316 - RNA, 32 nt, Human
ugaggcgccauccccaugugcccuucgggcug

SEQ ID NO: 514317 - RNA, 32 nt, Human
ugaggcggagaaacaguggaggggaugguggc

SEQ ID NO: 514318 - RNA, 32 nt, Human
ugaggcggagucucgcucugucacccaggcug

SEQ ID NO: 514319 - RNA, 32 nt, Human
ugaggcggagucuugcucuauuggccaggcug

SEQ ID NO: 514320 - RNA, 32 nt, Human
ugaggcggauggaucacuugaggucaggggau

SEQ ID NO: 514321 - RNA, 32 nt, Human
ugaggcggcaggaucacuaggaggcagagguu

SEQ ID NO: 514322 - RNA, 32 nt, Human
ugaggcggcaggaucacuugaaccaaggaguu

SEQ ID NO: 514323 - RNA, 32 nt, Human
ugaggcggccacuggcucuguguccuugggga

SEQ ID NO: 514324 - RNA, 32 nt, Human
ugaggcggcucacaccuguaaucccagcacuu

SEQ ID NO: 514325 - RNA, 32 nt, Human
ugaggcgggagaaucacuugaacccaggaggu

SEQ ID NO: 514326 - RNA, 32 nt, Human
ugaggcgggagaaucacuugaaccugggaggc

SEQ ID NO: 514327 - RNA, 32 nt, Human
ugaggcgggaggaucaauugagcccaggagcu

SEQ ID NO: 514328 - RNA, 32 nt, Human
ugaggcgggaggaucacaaggucaggagaucg

SEQ ID NO: 514329 - RNA, 32 nt, Human
ugaggcgggaggaucacaugagcccaggaggu

SEQ ID NO: 514330 - RNA, 32 nt, Human
ugaggcgggaggaucacuugagccaggccuaa

SEQ ID NO: 514331 - RNA, 32 nt, Human
ugaggcgggaggaucacuugagcccagggagg

SEQ ID NO: 514332 - RNA, 32 nt, Human
ugaggcgggaggaucacuugagccuaggaauu

SEQ ID NO: 514333 - RNA, 32 nt, Human
ugaggcgggaggaucaguugagcccaggaguu

SEQ ID NO: 514334 - RNA, 32 nt, Human
ugaggcgggaggaucgcuugaaccugggaggc

SEQ ID NO: 514335 - RNA, 32 nt, Human
ugaggcgggaggaucgcuugagccaaggaguu

SEQ ID NO: 514336 - RNA, 32 nt, Human
ugaggcgggaggaucgcuugagcccaggaguu

SEQ ID NO: 514337 - RNA, 32 nt, Human
ugaggcgggaggaucgcuugagcccagggguu

SEQ ID NO: 514338 - RNA, 32 nt, Human
ugaggcgggaggauuacuugagcccaggagga

SEQ ID NO: 514339 - RNA, 32 nt, Human
ugaggcgggaggauuacuugagcccaggaguu

SEQ ID NO: 514340 - RNA, 32 nt, Human
ugaggcgggaggauugcuugagcccaggaguu

SEQ ID NO: 514341 - RNA, 32 nt, Human
ugaggcgggaggauugcuugagccugggaagu

SEQ ID NO: 514342 - RNA, 32 nt, Human
ugaggcgggaggauugcuugaggccaggaauu

SEQ ID NO: 514343 - RNA, 32 nt, Human
ugaggcgggcagaucacuugagaucaggaguu

SEQ ID NO: 514344 - RNA, 32 nt, Human
ugaggcgggcggaucacuaggucaggagaucg

SEQ ID NO: 514345 - RNA, 32 nt, Human
ugaggcgggcggaucacuugaggccaggaguu

SEQ ID NO: 514346 - RNA, 32 nt, Human
ugaggcgggcggaucgguugagcucaggcguu

SEQ ID NO: 514347 - RNA, 32 nt, Human
ugaggcggggagaagcggcggggagacgccgg

SEQ ID NO: 514348 - RNA, 32 nt, Human
ugaggcggguggaucacuaggucaggaguuca

SEQ ID NO: 514349 - RNA, 32 nt, Human
ugaggcggguggaucacuugaagucgggaguu

SEQ ID NO: 514350 - RNA, 32 nt, Human
ugaggcggguggaucacuugaggccagguguu

SEQ ID NO: 514351 - RNA, 32 nt, Human
ugaggcggguggaucacuugaggucagaaguu

SEQ ID NO: 514352 - RNA, 32 nt, Human
ugaggcggguggaucacuugaggucaggaguu

SEQ ID NO: 514353 - RNA, 32 nt, Human
ugaggcggguggauugcuugagcccagaaguu

SEQ ID NO: 514354 - RNA, 32 nt, Human
ugaggcggguggauugcuugagcccaggaguu

SEQ ID NO: 514355 - RNA, 30 nt, Human
ugaggcgguuuauagucagaaagauuuacg

SEQ ID NO: 514356 - RNA, 32 nt, Human
ugaggcguauguggcaaaauguuacagaaucu

SEQ ID NO: 514357 - RNA, 32 nt, Human
ugaggcgugcgaacugguggcagugagagacu

SEQ ID NO: 514358 - RNA, 32 nt, Human
ugaggcgugggugugagccaggcugcaggagg

SEQ ID NO: 514359 - RNA, 32 nt, Human
ugaggcguuggcuuuuucuccaagaagguaca

SEQ ID NO: 514360 - RNA, 32 nt, Human
ugaggcuaaauuugaacccagcaaucugacuc

SEQ ID NO: 514361 - RNA, 32 nt, Human
ugaggcuaagaguucaagaucaguuugggcaa

SEQ ID NO: 514362 - RNA, 32 nt, Human
ugaggcuaaggcacuguaucccaggccuccca

SEQ ID NO: 514363 - RNA, 32 nt, Human
ugaggcuaggaguucaagaccagccuggccaa

SEQ ID NO: 514364 - RNA, 32 nt, Human
ugaggcuaggaguucaagacuagcguggccaa

SEQ ID NO: 514365 - RNA, 32 nt, Human
ugaggcuagugaagcaccuacaagaaacuuau

SEQ ID NO: 514366 - RNA, 32 nt, Human
ugaggcuaguugagaaauuauaccucaccagu

SEQ ID NO: 514367 - RNA, 20 nt, Human
ugaggcuauggaggguccuc

SEQ ID NO: 514368 - RNA, 32 nt, Human
ugaggcucacacacaggucugucugucacaaa

SEQ ID NO: 514369 - RNA, 23 nt, Human
ugaggcucaccagccacaggccu

SEQ ID NO: 514370 - RNA, 21 nt, Human
ugaggcucagcaacagccccu

SEQ ID NO: 514371 - RNA, 21 nt, Human
ugaggcucagcccuagcccuc

SEQ ID NO: 514372 - RNA, 32 nt, Human
ugaggcucaggaguucaagaccagccuggcca

SEQ ID NO: 514373 - RNA, 18 nt, Human
ugaggcucagggaaguua

SEQ ID NO: 514374 - RNA, 32 nt, Human
ugaggcucagucagaaccuccacccuccccca

SEQ ID NO: 514375 - RNA, 32 nt, Human
ugaggcucagugugguuaaaagaucugaccaa

SEQ ID NO: 514376 - RNA, 32 nt, Human
ugaggcucaguuaccccugggcuuaggcugag

SEQ ID NO: 514377 - RNA, 21 nt, Human
ugaggcucaguugugcccucu

SEQ ID NO: 514378 - RNA, 32 nt, Human
ugaggcuccacaggcugcacagucucugauaa

SEQ ID NO: 514379 - RNA, 32 nt, Human
ugaggcuccagccgagggcuccaggccucuga

SEQ ID NO: 514380 - RNA, 32 nt, Human
ugaggcuccaggcgguggaggugcggcagcug

SEQ ID NO: 514381 - RNA, 32 nt, Human
ugaggcuccagggccuuggccuagggaaacua

SEQ ID NO: 514382 - RNA, 32 nt, Human
ugaggcuccaucucaagaaacagaaaaaggga

SEQ ID NO: 514383 - RNA, 32 nt, Human
ugaggcucccauugucuccaucagagccugca

SEQ ID NO: 514384 - RNA, 32 nt, Human
ugaggcucccugggggaugacacucaguucug

SEQ ID NO: 514385 - RNA, 20 nt, Human
ugaggcuccgucagcccccu

SEQ ID NO: 514386 - RNA, 32 nt, Human
ugaggcuccugugccugauggaauucuuguaa

SEQ ID NO: 514387 - RNA, 32 nt, Human
ugaggcucgcugcuguguagcagagcucaguc

SEQ ID NO: 514388 - RNA, 32 nt, Human
ugaggcucgggagccuuuggcagaagguggcu

SEQ ID NO: 514389 - RNA, 32 nt, Human
ugaggcucuaauucccugggucccauugccau

SEQ ID NO: 514390 - RNA, 32 nt, Human
ugaggcucuaauucccugggucccauugucau

SEQ ID NO: 514391 - RNA, 32 nt, Human
ugaggcucuacaaggagagggucuccagggcc

SEQ ID NO: 514392 - RNA, 32 nt, Human
ugaggcucuccccuccuccccucccccaucau

SEQ ID NO: 514393 - RNA, 18 nt, Human
ugaggcucugaaccuucc

SEQ ID NO: 514394 - RNA, 32 nt, Human
ugaggcucuggccugcagcucgcgccgccaug

SEQ ID NO: 514395 - RNA, 20 nt, Human
ugaggcugaagcaccaggga

SEQ ID NO: 514396 - RNA, 32 nt, Human
ugaggcugaaggaauacuugagcccaggaauu

SEQ ID NO: 514397 - RNA, 19 nt, Human
ugaggcugaccagggcccu

SEQ ID NO: 514398 - RNA, 32 nt, Human
ugaggcugaccuugcuagucugcccacucccu

SEQ ID NO: 514399 - RNA, 32 nt, Human
ugaggcugacuugccgacggucggcagguaau

SEQ ID NO: 514400 - RNA, 32 nt, Human
ugaggcugagaggucaagguugcagugagcca

SEQ ID NO: 514401 - RNA, 32 nt, Human
ugaggcugagaugggaggaugagggaggucgg

SEQ ID NO: 514402 - RNA, 32 nt, Human
ugaggcugaggaguucaagaccagccuggcca

SEQ ID NO: 514403 - RNA, 32 nt, Human
ugaggcugaggcagaagaaucgcuugaaccug

SEQ ID NO: 514404 - RNA, 32 nt, Human
ugaggcugaggcaggagaauugcuugaaccgg

SEQ ID NO: 514405 - RNA, 32 nt, Human
ugaggcugaggcaguagaaucgcuugaacccg

SEQ ID NO: 514406 - RNA, 32 nt, Human
ugaggcugagggaggagaaucgcuugaaccca

SEQ ID NO: 514407 - RNA, 32 nt, Human
ugaggcugaggugggaggaucgcuugagccug

SEQ ID NO: 514408 - RNA, 32 nt, Human
ugaggcugaguuuccagaagaccuguucaacc

SEQ ID NO: 514409 - RNA, 20 nt, Human
ugaggcugcaaucacacuga

SEQ ID NO: 514410 - RNA, 32 nt, Human
ugaggcugcaccugaguaccacauccugaccc

SEQ ID NO: 514411 - RNA, 32 nt, Human
ugaggcugcagcgucggcaucuugagcugccg

SEQ ID NO: 514412 - RNA, 32 nt, Human
ugaggcugcaguggcuaugaucaugccacugc

SEQ ID NO: 514413 - RNA, 32 nt, Human
ugaggcugcccagagaaagcacugcuucugua

SEQ ID NO: 514414 - RNA, 32 nt, Human
ugaggcugcccugcgauggccugggugggaga

SEQ ID NO: 514415 - RNA, 31 nt, Human
ugaggcugccucugggccuguggauccagau

SEQ ID NO: 514416 - RNA, 32 nt, Human
ugaggcugcgcugcacuccucugcccuggggc

SEQ ID NO: 514417 - RNA, 32 nt, Human
ugaggcugcucugguuugugauccagacaggc

SEQ ID NO: 514418 - RNA, 32 nt, Human
ugaggcugcugccccaguuucauggaugcugg

SEQ ID NO: 514419 - RNA, 32 nt, Human
ugaggcugcugcugagagaagcucugggaagu

SEQ ID NO: 514420 - RNA, 32 nt, Human
ugaggcuggaaaccccggaguaaggcucgacc

SEQ ID NO: 514421 - RNA, 32 nt, Human
ugaggcuggagaagacaccagggcugacuuug

SEQ ID NO: 514422 - RNA, 32 nt, Human
ugaggcuggagauggcaggaacaggcaugcag

SEQ ID NO: 514423 - RNA, 32 nt, Human
ugaggcuggaggaucacuugagcccaggaagu

SEQ ID NO: 514424 - RNA, 32 nt, Human
ugaggcuggaggaucgcuugaaccugggaggu

SEQ ID NO: 514425 - RNA, 32 nt, Human
ugaggcuggaggaucgcuugagcccaggaguu

SEQ ID NO: 514426 - RNA, 32 nt, Human
ugaggcuggagugcaguggcaccaucucgucu

SEQ ID NO: 514427 - RNA, 32 nt, Human
ugaggcuggagugcaguggcgcgaucuugacu

SEQ ID NO: 514428 - RNA, 32 nt, Human
ugaggcuggcagaucacuugaggucaggaguu

SEQ ID NO: 514429 - RNA, 32 nt, Human
ugaggcuggcagcugccaauggagcccuccug

SEQ ID NO: 514430 - RNA, 32 nt, Human
ugaggcuggcugcuucuggaggcuacuuugca

SEQ ID NO: 514431 - RNA, 32 nt, Human
ugaggcugggaggcagagguugcagugagcug

SEQ ID NO: 514432 - RNA, 32 nt, Human
ugaggcugggaggcggagguugcagugagcug

SEQ ID NO: 514433 - RNA, 32 nt, Human
ugaggcugggaguucaaaaccagccugggcaa

SEQ ID NO: 514434 - RNA, 32 nt, Human
ugaggcugggauacaguggcccuggagugggg

SEQ ID NO: 514435 - RNA, 32 nt, Human
ugaggcugggcugggagggggagggagauaga

SEQ ID NO: 514436 - RNA, 32 nt, Human
ugaggcugggggccagagaagcuuuuacgcau

SEQ ID NO: 514437 - RNA, 32 nt, Human
ugaggcuggggucucugcaggggaggucacug

SEQ ID NO: 514438 - RNA, 32 nt, Human
ugaggcugguggaucacuugaagccaggaauu

SEQ ID NO: 514439 - RNA, 32 nt, Human
ugaggcuguacggcuacagccugggcaacauc

SEQ ID NO: 514440 - RNA, 32 nt, Human
ugaggcuguauccuuauccuccauccaucuau

SEQ ID NO: 514441 - RNA, 32 nt, Human
ugaggcugugacacccagaggaauuccuguga

SEQ ID NO: 514442 - RNA, 32 nt, Human
ugaggcugugcuucagguaugguacaaucaag

SEQ ID NO: 514443 - RNA, 32 nt, Human
ugaggcuguggagccagauggcugcguucaga

SEQ ID NO: 514444 - RNA, 32 nt, Human
ugaggcuucacugcagcggccuccacccaccu

SEQ ID NO: 514445 - RNA, 32 nt, Human
ugaggcuucacugcucuccugagaguuuucua

SEQ ID NO: 514446 - RNA, 32 nt, Human
ugaggcuucuaaaauuuucacauaacugccaa

SEQ ID NO: 514447 - RNA, 32 nt, Human
ugaggcuugggaacaaggggaagaugcuggac

SEQ ID NO: 514448 - RNA, 32 nt, Human
ugaggcuuuggcagaaauuaagaaggaaauau

SEQ ID NO: 514449 - RNA, 32 nt, Human
ugaggcuuuugaggaauccuugguggccagag

SEQ ID NO: 514450 - RNA, 32 nt, Human
ugagggaaaccaggucaccauccacccucgua

SEQ ID NO: 514451 - RNA, 32 nt, Human
ugagggaaacugcugguucugcuggugccucu

SEQ ID NO: 514452 - RNA, 32 nt, Human
ugagggaaaugugggcaacauacauauuugac

SEQ ID NO: 514453 - RNA, 32 nt, Human
ugagggaaauuauccauauacauaucacuaau

SEQ ID NO: 514454 - RNA, 32 nt, Human
ugagggaacacaguguggaccaucucucaguu

SEQ ID NO: 514455 - RNA, 32 nt, Human
ugagggaacugaaagugaugcagagagccaaa

SEQ ID NO: 514456 - RNA, 32 nt, Human
ugagggaagaagaggaagcgggaggagcuugg

SEQ ID NO: 514457 - RNA, 32 nt, Human
ugagggaagugaaaaucaagaccugggggcug

SEQ ID NO: 514458 - RNA, 32 nt, Human
ugagggacaugcuggaaccagggggcauccga

SEQ ID NO: 514459 - RNA, 20 nt, Human
ugagggaccagccaagaggg

SEQ ID NO: 514460 - RNA, 32 nt, Human
ugagggacccuggacugucacagagauuaaug

SEQ ID NO: 514461 - RNA, 32 nt, Human
ugagggagaaacauuugccugccuuguaauaa

SEQ ID NO: 514462 - RNA, 32 nt, Human
ugagggagaaaucgguaacaguugccgaacca

SEQ ID NO: 514463 - RNA, 32 nt, Human
ugagggagaaggaagcagcuagcuaugucccu

SEQ ID NO: 514464 - RNA, 32 nt, Human
ugagggagagaauugcuucaaccagggaggca

SEQ ID NO: 514465 - RNA, 32 nt, Human
ugagggagagagagugagagacccuaaccuau

SEQ ID NO: 514466 - RNA, 22 nt, Human
ugagggagagggagcccuccaa

SEQ ID NO: 514467 - RNA, 32 nt, Human
ugagggagagguugauucugucacccauccca

SEQ ID NO: 514468 - RNA, 32 nt, Human
ugagggagcagacaaacacacaggcuuccuac

SEQ ID NO: 514469 - RNA, 32 nt, Human
ugagggagcagggagagaaagacuggaguaga

SEQ ID NO: 514470 - RNA, 32 nt, Human
ugagggagccacucgggacgcggaggcccuaa

SEQ ID NO: 514471 - RNA, 32 nt, Human
ugagggagcucaguggaauuguaccgccugua

SEQ ID NO: 514472 - RNA, 32 nt, Human
ugagggagcugccuggcuucucugccuccagc

SEQ ID NO: 514473 - RNA, 32 nt, Human
ugagggaggacaguggaaggagggagagguuc

SEQ ID NO: 514474 - RNA, 32 nt, Human
ugagggaggaccugcuggcugcagugaggagc

SEQ ID NO: 514475 - RNA, 32 nt, Human
ugagggaggacuccaguuggaauggccacuuu

SEQ ID NO: 514476 - RNA, 32 nt, Human
ugagggaggacuucuuggacugcuccaucaug

SEQ ID NO: 514477 - RNA, 32 nt, Human
ugagggaggagaaggaguuagguggaagaaaa

SEQ ID NO: 514478 - RNA, 32 nt, Human
ugagggaggagaaucacuugaccccaggaggc

SEQ ID NO: 514479 - RNA, 32 nt, Human
ugagggaggagacaggcccaaggcggaggccc

SEQ ID NO: 514480 - RNA, 32 nt, Human
ugagggaggagagaugaguggcuauuccagaa

SEQ ID NO: 514481 - RNA, 17 nt, Human
ugagggaggagagggga

SEQ ID NO: 514482 - RNA, 32 nt, Human
ugagggaggaggaggaggaagagguauggcau

SEQ ID NO: 514483 - RNA, 32 nt, Human
ugagggaggaugagcuggcuucugagcagaca

SEQ ID NO: 514484 - RNA, 32 nt, Human
ugagggaggcaggcaauaugcagugaaaaccu

SEQ ID NO: 514485 - RNA, 32 nt, Human
ugagggaggcggaucacuugaggucaggaguu

SEQ ID NO: 514486 - RNA, 32 nt, Human
ugagggaggggcaggagagcagugaggagcug

SEQ ID NO: 514487 - RNA, 32 nt, Human
ugagggaggggcuggcaggaaggguggggucc

SEQ ID NO: 514488 - RNA, 32 nt, Human
ugagggagggggcuuguuucccuucccucccg

SEQ ID NO: 514489 - RNA, 32 nt, Human
ugagggaggucggggcugcagugagccaagau

SEQ ID NO: 514490 - RNA, 32 nt, Human
ugagggaguagggaaaggaaagggggaggcgg

SEQ ID NO: 514491 - RNA, 32 nt, Human
ugagggaguggguggagagcaugggagguaaa

SEQ ID NO: 514492 - RNA, 32 nt, Human
ugagggaucaggcucgccagggccacaggaca

SEQ ID NO: 514493 - RNA, 32 nt, Human
ugagggaugaggacaggcauccuauccccagc

SEQ ID NO: 514494 - RNA, 24 nt, Human
ugagggaugccagcccccaagaga

SEQ ID NO: 514495 - RNA, 32 nt, Human
ugagggcaaagcgugguccacugugugugaug

SEQ ID NO: 514496 - RNA, 32 nt, Human
ugagggcaauucuguccuacuguuuuuacagg

SEQ ID NO: 514497 - RNA, 32 nt, Human
ugagggcacagcuguggguugcaggggagaca

SEQ ID NO: 514498 - RNA, 32 nt, Human
ugagggcacccuccuucucugcacccuuggca

SEQ ID NO: 514499 - RNA, 31 nt, Human
ugagggcagaugucuccagccaggacugccc

SEQ ID NO: 514500 - RNA, 32 nt, Human
ugagggcagcaggccugguugcagcuggcgug

SEQ ID NO: 514501 - RNA, 32 nt, Human
ugagggcaggcagagguagcugaggguagcau

SEQ ID NO: 514502 - RNA, 32 nt, Human
ugagggcaggcaggagguggaguugcagcugu

SEQ ID NO: 514503 - RNA, 32 nt, Human
ugagggcagggcccugccgcuccaccgcagcc

SEQ ID NO: 514504 - RNA, 32 nt, Human
ugagggcauagaaguaaaaacaccuggucccu

SEQ ID NO: 514505 - RNA, 22 nt, Human
ugagggcauccagcaagccccu

SEQ ID NO: 514506 - RNA, 32 nt, Human
ugagggcaugagaggcagagugcacagugguc

SEQ ID NO: 514507 - RNA, 32 nt, Human
ugagggcauggagucauuagucucacaaacac

SEQ ID NO: 514508 - RNA, 32 nt, Human
ugagggccaccacugcaguucugcuaggucug

SEQ ID NO: 514509 - RNA, 32 nt, Human
ugagggcccaggaggccuggcgggccuggggg

SEQ ID NO: 514510 - RNA, 32 nt, Human
ugagggcccaggaggucaaggcuucagugagc

SEQ ID NO: 514511 - RNA, 32 nt, Human
ugagggcccaggugguggaggugggguuggag

SEQ ID NO: 514512 - RNA, 32 nt, Human
ugagggccccaaagccacuugucuccuaggau

SEQ ID NO: 514513 - RNA, 32 nt, Human
ugagggcccgcggggagcucuuaaguugggca

SEQ ID NO: 514514 - RNA, 32 nt, Human
ugagggcccugccucccagucccuccuuguuc

SEQ ID NO: 514515 - RNA, 32 nt, Human
ugagggcccuggaggguccuugggaguaguua

SEQ ID NO: 514516 - RNA, 32 nt, Human
ugagggccgacugcugcucugccuuccuucua

SEQ ID NO: 514517 - RNA, 32 nt, Human
ugagggccucuccugccugauuggucuuucaa

SEQ ID NO: 514518 - RNA, 32 nt, Human
ugagggcgaugauucuagaaggguuauaagcu

SEQ ID NO: 514519 - RNA, 32 nt, Human
ugagggcgccugagggccaggagcagcaggca

SEQ ID NO: 514520 - RNA, 32 nt, Human
ugagggcgggucaugaggaggcuguagccaag

SEQ ID NO: 514521 - RNA, 32 nt, Human
ugagggcuaccuagacucaggugcaauuccuu

SEQ ID NO: 514522 - RNA, 32 nt, Human
ugagggcuagugcagcgcugagcccagacccc

SEQ ID NO: 514523 - RNA, 32 nt, Human
ugagggcuaucguuccagcagagaucaacaca

SEQ ID NO: 514524 - RNA, 32 nt, Human
ugagggcuccacagcucuuccucuuuucucua

SEQ ID NO: 514525 - RNA, 32 nt, Human
ugagggcuccuauaccuuguccuuccugcuug

SEQ ID NO: 514526 - RNA, 32 nt, Human
ugagggcucugaagccuaguucugucuucucu

SEQ ID NO: 514527 - RNA, 32 nt, Human
ugagggcugaaggggaaaaccuuucacacacg

SEQ ID NO: 514528 - RNA, 32 nt, Human
ugagggcugagggagagacugaggugcagcag

SEQ ID NO: 514529 - RNA, 32 nt, Human
ugagggcugauagcucugccuuacccugguaa

SEQ ID NO: 514530 - RNA, 20 nt, Human
ugagggcugccagcagcccc

SEQ ID NO: 514531 - RNA, 32 nt, Human
ugagggcugcugcggcgcagggagaggccugg

SEQ ID NO: 514532 - RNA, 32 nt, Human
ugagggcuggagugcacuggagcaauccuggc

SEQ ID NO: 514533 - RNA, 32 nt, Human
ugagggcuggggguugggggagucagcaugau

SEQ ID NO: 514534 - RNA, 32 nt, Human
ugagggcugguaccacccacuccuggguccug

SEQ ID NO: 514535 - RNA, 32 nt, Human
ugagggcuguggaacccagcaggcaugagaug

SEQ ID NO: 514536 - RNA, 21 nt, Human
ugagggcugugucacgggcca

SEQ ID NO: 514537 - RNA, 32 nt, Human
ugagggcuucauucucacccuguauuucuuua

SEQ ID NO: 514538 - RNA, 20 nt, Human
ugagggcuuccugugccaga

SEQ ID NO: 514539 - RNA, 21 nt, Human
ugagggcuuguaguucuuuaa

SEQ ID NO: 514540 - RNA, 21 nt, Human
ugagggcuuuaagagcuuuga

SEQ ID NO: 514541 - RNA, 32 nt, Human
ugagggcuuuaagagcuuugaaguggggaguc

SEQ ID NO: 514542 - RNA, 20 nt, Human
ugagggcuuuaauccuuuaa

SEQ ID NO: 514543 - RNA, 32 nt, Human
ugagggcuuugcuaugaccucaguccccucac

SEQ ID NO: 514544 - RNA, 32 nt, Human
ugaggggaaacguggagaagaaggaagcuucc

SEQ ID NO: 514545 - RNA, 32 nt, Human
ugaggggaaagccauuaaguggggugcagccc

SEQ ID NO: 514546 - RNA, 32 nt, Human
ugaggggaacagggugcaggagagggaucucu

SEQ ID NO: 514547 - RNA, 32 nt, Human
ugaggggaagagaagagaaagagggggaaagg

SEQ ID NO: 514548 - RNA, 32 nt, Human
ugaggggaagagaggaaggaggggcgggcucc

SEQ ID NO: 514549 - RNA, 32 nt, Human
ugaggggaagaggccuguuucgcugucggguc

SEQ ID NO: 514550 - RNA, 32 nt, Human
ugaggggaagggagggggcgggcaggugcagc

SEQ ID NO: 514551 - RNA, 32 nt, Human
ugaggggaagguucugaugacagcugcagagg

SEQ ID NO: 514552 - RNA, 32 nt, Human
ugaggggaauguuauggguaacagacaugcag

SEQ ID NO: 514553 - RNA, 32 nt, Human
ugaggggacacauucucuuuaggaagcauugg

SEQ ID NO: 514554 - RNA, 32 nt, Human
ugaggggaggcaccuccaggcaggccaggcug

SEQ ID NO: 514555 - RNA, 32 nt, Human
ugaggggagggcacgcuugucuucucagguau

SEQ ID NO: 514556 - RNA, 32 nt, Human
ugaggggagggcagaggaggagagagccuggc

SEQ ID NO: 514557 - RNA, 32 nt, Human
ugaggggagggcuguggggaacuccauucagu

SEQ ID NO: 514558 - RNA, 32 nt, Human
ugaggggaggggaagacucggcuuccaagucc

SEQ ID NO: 514559 - RNA, 32 nt, Human
ugaggggaggggcaagugggacccugccaccu

SEQ ID NO: 514560 - RNA, 18 nt, Human
ugaggggagggggccaga

SEQ ID NO: 514561 - RNA, 32 nt, Human
ugaggggagggugaggagcuggagggaggggc

SEQ ID NO: 514562 - RNA, 32 nt, Human
ugaggggaucaggcuuuucuacuccaggcaaa

SEQ ID NO: 514563 - RNA, 32 nt, Human
ugaggggaugagagguuguacacacauuggua

SEQ ID NO: 514564 - RNA, 21 nt, Human
ugaggggauucucuacugcca

SEQ ID NO: 514565 - RNA, 32 nt, Human
ugaggggcaaguguccagcaggagggagaaac

SEQ ID NO: 514566 - RNA, 20 nt, Human
ugaggggcacacuacagcga

SEQ ID NO: 514567 - RNA, 32 nt, Human
ugaggggcaccacuacuccagcccagaaggaa

SEQ ID NO: 514568 - RNA, 32 nt, Human
ugaggggcagaggagaggauggggaggccaag

SEQ ID NO: 514569 - RNA, 32 nt, Human
ugaggggcagcucuggccagugcucaccaggg

SEQ ID NO: 514570 - RNA, 32 nt, Human
ugaggggcaggcacaggaguccuggcugagcu

SEQ ID NO: 514571 - RNA, 32 nt, Human
ugaggggcaggccaggaggagcuugggcgcag

SEQ ID NO: 514572 - RNA, 20 nt, Human
ugaggggcagggagggccag

SEQ ID NO: 514573 - RNA, 32 nt, Human
ugaggggccaaggucaagaccaaccuccaucu

SEQ ID NO: 514574 - RNA, 32 nt, Human
ugaggggccaggccauggccaaggggccagcu

SEQ ID NO: 514575 - RNA, 32 nt, Human
ugaggggccagggaggaaggaggccacggagc

SEQ ID NO: 514576 - RNA, 32 nt, Human
ugaggggccuggcugggggcccccaggcucca

SEQ ID NO: 514577 - RNA, 32 nt, Human
ugaggggccuugggcuguaggaugacaacacu

SEQ ID NO: 514578 - RNA, 32 nt, Human
ugaggggcgggcagccgcgccgccgcggcacu

SEQ ID NO: 514579 - RNA, 32 nt, Human
ugaggggcuagugcagugguccugaccucucu

SEQ ID NO: 514580 - RNA, 32 nt, Human
ugaggggcucaaccucuucuguccucaaagag

SEQ ID NO: 514581 - RNA, 32 nt, Human
ugaggggcucagagcugaggcagaaucccuuu

SEQ ID NO: 514582 - RNA, 32 nt, Human
ugaggggcugaggaggcugaggggcugagggg

SEQ ID NO: 514583 - RNA, 23 nt, Human
ugaggggcuuccuuucugcagcu

SEQ ID NO: 514584 - RNA, 32 nt, Human
ugaggggcuucggagcugaggagcagcuguuc

SEQ ID NO: 514585 - RNA, 32 nt, Human
ugaggggcuuugacauggguauuucugugacg

SEQ ID NO: 514586 - RNA, 32 nt, Human
ugagggggacacaguggugcucugcugaguug

SEQ ID NO: 514587 - RNA, 32 nt, Human
ugagggggacaguguagguugggggugaggaa

SEQ ID NO: 514588 - RNA, 32 nt, Human
ugagggggacaguuugacuucacuuugagggu

SEQ ID NO: 514589 - RNA, 32 nt, Human
ugagggggagccaagggugacuuggcaggggu

SEQ ID NO: 514590 - RNA, 32 nt, Human
ugagggggaggcgcagggucaggaggggaggg

SEQ ID NO: 514591 - RNA, 32 nt, Human
ugagggggcacaugaagauaagccacaaauga

SEQ ID NO: 514592 - RNA, 32 nt, Human
ugagggggcgucugcgugcacagccaugccug

SEQ ID NO: 514593 - RNA, 32 nt, Human
ugagggggcuccugccguccugacgccacccc

SEQ ID NO: 514594 - RNA, 32 nt, Human
ugagggggcugaggcaugagaaucacuugaac

SEQ ID NO: 514595 - RNA, 20 nt, Human
ugaggggggucucacuaugu

SEQ ID NO: 514596 - RNA, 22 nt, Human
ugagggggucagacacaggccc

SEQ ID NO: 514597 - RNA, 32 nt, Human
ugagggggugcccggcggccucggacaggggc

SEQ ID NO: 514598 - RNA, 32 nt, Human
ugaggggguggagucuggucugcuccacuaac

SEQ ID NO: 514599 - RNA, 32 nt, Human
ugaggggguguguuugggagccuggccuccaa

SEQ ID NO: 514600 - RNA, 32 nt, Human
ugagggguccuugaggccaguggaucuggagu

SEQ ID NO: 514601 - RNA, 32 nt, Human
ugaggggucgcuacguggaggaagggcuaccg

SEQ ID NO: 514602 - RNA, 32 nt, Human
ugaggggugcagcagccaggaggcgggcggaa

SEQ ID NO: 514603 - RNA, 32 nt, Human
ugagggguggagggcagaggagaaacugcguc

SEQ ID NO: 514604 - RNA, 32 nt, Human
ugagggguggcgcgcggccaggagcacgcaug

SEQ ID NO: 514605 - RNA, 32 nt, Human
ugagggguguggaggacagagagauggugaaa

SEQ ID NO: 514606 - RNA, 32 nt, Human
ugagggguuagauuagaggaaaguaauuuagg

SEQ ID NO: 514607 - RNA, 32 nt, Human
ugaggguaacaaggaacucacuuggcagucag

SEQ ID NO: 514608 - RNA, 32 nt, Human
ugaggguaccugcacaguuugauucuuuucca

SEQ ID NO: 514609 - RNA, 32 nt, Human
ugaggguauuagacaucccugaaacucaguua

SEQ ID NO: 514610 - RNA, 32 nt, Human
ugagggucaccacugccagccucaggcaacau

SEQ ID NO: 514611 - RNA, 32 nt, Human
ugagggucagaccuucuaauaaaagagacuuu

SEQ ID NO: 514612 - RNA, 32 nt, Human
ugagggucaggaugaagcagaucugcuguaga

SEQ ID NO: 514613 - RNA, 32 nt, Human
ugagggucccagaagcccccagaggugacagc

SEQ ID NO: 514614 - RNA, 32 nt, Human
ugaggguccucuuccaucuugcugaacuguuc

SEQ ID NO: 514615 - RNA, 32 nt, Human
ugagggucuaacuuuauucuuuuucaugugga

SEQ ID NO: 514616 - RNA, 32 nt, Human
ugagggucucuuagggaggacaguauggacug

SEQ ID NO: 514617 - RNA, 32 nt, Human
ugagggucugcggggccgccaaaggagcccac

SEQ ID NO: 514618 - RNA, 32 nt, Human
ugagggucugggcauugcucccagcaucugac

SEQ ID NO: 514619 - RNA, 32 nt, Human
ugagggucuguagguuacacacuuugguacca

SEQ ID NO: 514620 - RNA, 32 nt, Human
ugagggucuguagguugcacacuuugguacca

SEQ ID NO: 514621 - RNA, 32 nt, Human
ugagggucuguggaacuccagcagcucugcac

SEQ ID NO: 514622 - RNA, 32 nt, Human
ugagggucuuuagcaaagauggaaguuuuggu

SEQ ID NO: 514623 - RNA, 32 nt, Human
ugagggugaaagaagacacagauggagccacc

SEQ ID NO: 514624 - RNA, 32 nt, Human
ugagggugagcggcucauucugcuauuuaacu

SEQ ID NO: 514625 - RNA, 32 nt, Human
ugagggugaggcucucugcacacuccagagug

SEQ ID NO: 514626 - RNA, 32 nt, Human
ugagggugccccuaacccuggagccagcuuua

SEQ ID NO: 514627 - RNA, 32 nt, Human
ugaggguggagaaggaggcgggugaugugcuc

SEQ ID NO: 514628 - RNA, 32 nt, Human
ugaggguggagggagacagugggcggcagcac

SEQ ID NO: 514629 - RNA, 32 nt, Human
ugaggguggcagugagcuggcacuuuggucuc

SEQ ID NO: 514630 - RNA, 32 nt, Human
ugagggugggcgacccaggauucccccucccc

SEQ ID NO: 514631 - RNA, 32 nt, Human
ugaggguggguggagggguuugcaguguggga

SEQ ID NO: 514632 - RNA, 31 nt, Human
ugagggugggugggaagagugagaagauaua

SEQ ID NO: 514633 - RNA, 31 nt, Human
ugaggguggguggguggacccaggcucccuu

SEQ ID NO: 514634 - RNA, 32 nt, Human
ugaggguggucacaccugagccuucagcacug

SEQ ID NO: 514635 - RNA, 32 nt, Human
ugagggugguuggggagaggggaccgaugugc

SEQ ID NO: 514636 - RNA, 18 nt, Human
ugagggugugucuuugua

SEQ ID NO: 514637 - RNA, 32 nt, Human
ugaggguucacaagccucccagaaccagcccu

SEQ ID NO: 514638 - RNA, 32 nt, Human
ugaggguuccaagugugcugaagaggacaguc

SEQ ID NO: 514639 - RNA, 32 nt, Human
ugaggguuccucagggccuuggcauugcuagu

SEQ ID NO: 514640 - RNA, 32 nt, Human
ugaggguugaguggguagguugggaagaacau

SEQ ID NO: 514641 - RNA, 32 nt, Human
ugaggguugcagagcccgcuguggagguaaga

SEQ ID NO: 514642 - RNA, 32 nt, Human
ugagguaaaauaaggcauaaaugcagguaauu

SEQ ID NO: 514643 - RNA, 32 nt, Human
ugagguacagaggaagugauguccuugacaag

SEQ ID NO: 514644 - RNA, 32 nt, Human
ugagguacagccacagaagaugucauguacug

SEQ ID NO: 514645 - RNA, 32 nt, Human
ugagguacaggggaauggacucuccccuacug

SEQ ID NO: 514646 - RNA, 32 nt, Human
ugagguaccacagcuccacuccuggcuggaac

SEQ ID NO: 514647 - RNA, 32 nt, Human
ugagguaccugagagccccucaggggaggagg

SEQ ID NO: 514648 - RNA, 32 nt, Human
ugagguagacuccuagagguuaauuaucaucu

SEQ ID NO: 514649 - RNA, 23 nt, Human
ugagguagcagacucacuugaac

SEQ ID NO: 514650 - RNA, 32 nt, Human
ugagguagcucacaccuguaaucccagcacuu

SEQ ID NO: 514651 - RNA, 32 nt, Human
ugagguaggagaaucacuugaaccucagcggc

SEQ ID NO: 514652 - RNA, 32 nt, Human
ugagguaggaggacugcuugagcucaggaggu

SEQ ID NO: 514653 - RNA, 32 nt, Human
ugagguaggaggaucaccugagccuggagaug

SEQ ID NO: 514654 - RNA, 32 nt, Human
ugagguaggaggaucacgugaggucgggaguu

SEQ ID NO: 514655 - RNA, 32 nt, Human
ugagguaggaggaucacuuaagccugggaagu

SEQ ID NO: 514656 - RNA, 32 nt, Human
ugagguaggaggaucacuugggccaagagguu

SEQ ID NO: 514657 - RNA, 32 nt, Human
ugagguaggaggaucgccugagcaugggaggc

SEQ ID NO: 514658 - RNA, 32 nt, Human
ugagguaggaggaucgcuugaacccaggaagu

SEQ ID NO: 514659 - RNA, 32 nt, Human
ugagguaggaggaucgcuugaacccaggaguu

SEQ ID NO: 514660 - RNA, 32 nt, Human
ugagguaggaggaucgcuugagccuggguaga

SEQ ID NO: 514661 - RNA, 32 nt, Human
ugagguaggaggaucgcuugaggccagaaguu

SEQ ID NO: 514662 - RNA, 32 nt, Human
ugagguaggaggcggaggugggggugggggua

SEQ ID NO: 514663 - RNA, 32 nt, Human
ugagguaggcagaucacuugaggucaggaguu

SEQ ID NO: 514664 - RNA, 32 nt, Human
ugagguaggcggaucacuggggucaggauuuc

SEQ ID NO: 514665 - RNA, 32 nt, Human
ugagguagggggaucacuugaaccuggguggu

SEQ ID NO: 514666 - RNA, 32 nt, Human
ugagguauauaccuuugugauuuucuaaugag

SEQ ID NO: 514667 - RNA, 32 nt, Human
ugaggucaagaguucaagaccagccugaccaa

SEQ ID NO: 514668 - RNA, 32 nt, Human
ugaggucaagaguucaagaccagccugacgaa

SEQ ID NO: 514669 - RNA, 32 nt, Human
ugaggucaagaguucaagaccagccuggccaa

SEQ ID NO: 514670 - RNA, 32 nt, Human
ugaggucaagaguucaagaccggccuggccaa

SEQ ID NO: 514671 - RNA, 32 nt, Human
ugaggucaagaguucaagacuagccuggccaa

SEQ ID NO: 514672 - RNA, 32 nt, Human
ugaggucaagaguuccagaccaggcuggccag

SEQ ID NO: 514673 - RNA, 32 nt, Human
ugaggucaagaguucgagaccagccaggccaa

SEQ ID NO: 514674 - RNA, 32 nt, Human
ugaggucaagaguucgagaccagccuagcuaa

SEQ ID NO: 514675 - RNA, 32 nt, Human
ugaggucaagaguucgagaccagccugaccaa

SEQ ID NO: 514676 - RNA, 32 nt, Human
ugaggucaagaguucgaggccagccuggccaa

SEQ ID NO: 514677 - RNA, 32 nt, Human
ugaggucaagaguuugagaccagccugaccaa

SEQ ID NO: 514678 - RNA, 32 nt, Human
ugaggucaagaguuugagaccagccuggccaa

SEQ ID NO: 514679 - RNA, 32 nt, Human
ugaggucaagcaacccucccaccucggccuga

SEQ ID NO: 514680 - RNA, 32 nt, Human
ugaggucaagccaguccucccauggucaugcc

SEQ ID NO: 514681 - RNA, 32 nt, Human
ugaggucaaggcaggaggauugccugagccug

SEQ ID NO: 514682 - RNA, 32 nt, Human
ugaggucacaaguucaagaccagccuggcaaa

SEQ ID NO: 514683 - RNA, 32 nt, Human
ugaggucacaccgcugcacuccagccugggca

SEQ ID NO: 514684 - RNA, 32 nt, Human
ugaggucacacuagccuccugaggccuggcug

SEQ ID NO: 514685 - RNA, 32 nt, Human
ugaggucacgaauuugagaccaaccuggccaa

SEQ ID NO: 514686 - RNA, 32 nt, Human
ugaggucacgaguucaagaccagccuggccaa

SEQ ID NO: 514687 - RNA, 32 nt, Human
ugaggucacugacuccagcucaaaaggcaucu

SEQ ID NO: 514688 - RNA, 32 nt, Human
ugaggucacugcaaccuccaccucccggguuc

SEQ ID NO: 514689 - RNA, 32 nt, Human
ugaggucagaaguucaagaccagccuagccaa

SEQ ID NO: 514690 - RNA, 32 nt, Human
ugaggucagaaguucaagaccagccugaccaa

SEQ ID NO: 514691 - RNA, 32 nt, Human
ugaggucagaaguucaagaccagccuggccaa

SEQ ID NO: 514692 - RNA, 32 nt, Human
ugaggucagaaguucaagaccagccuggcucu

SEQ ID NO: 514693 - RNA, 32 nt, Human
ugaggucagaaguucaagaccauccuggcuaa

SEQ ID NO: 514694 - RNA, 32 nt, Human
ugaggucagaaguucaagacuagccuggucaa

SEQ ID NO: 514695 - RNA, 32 nt, Human
ugaggucagaaguucaaggccagccuggacga

SEQ ID NO: 514696 - RNA, 32 nt, Human
ugaggucagaaguucgagaccaaccuggccaa

SEQ ID NO: 514697 - RNA, 32 nt, Human
ugaggucagcaacagggaaagagggugggcac

SEQ ID NO: 514698 - RNA, 32 nt, Human
ugaggucagcaguccaagaccacccuggccaa

SEQ ID NO: 514699 - RNA, 32 nt, Human
ugaggucagcaguucaagaccagccugaccaa

SEQ ID NO: 514700 - RNA, 32 nt, Human
ugaggucagcaguucaagacuagccuggccaa

SEQ ID NO: 514701 - RNA, 31 nt, Human
ugaggucagccacugggucacuuguagucaa

SEQ ID NO: 514702 - RNA, 32 nt, Human
ugaggucaggaauucaagaccacccuggccaa

SEQ ID NO: 514703 - RNA, 32 nt, Human
ugaggucaggaauucaagaccagccuggccaa

SEQ ID NO: 514704 - RNA, 32 nt, Human
ugaggucaggaauuugagaccaaccuggccaa

SEQ ID NO: 514705 - RNA, 32 nt, Human
ugaggucaggacuucaagaccagccuggccaa

SEQ ID NO: 514706 - RNA, 32 nt, Human
ugaggucaggagaucaagaccacccuggcuaa

SEQ ID NO: 514707 - RNA, 32 nt, Human
ugaggucaggagaucaagaccagccuggccaa

SEQ ID NO: 514708 - RNA, 32 nt, Human
ugaggucaggagaucaagaccauccuggccaa

SEQ ID NO: 514709 - RNA, 32 nt, Human
ugaggucaggagaucaagaccauccuggcuaa

SEQ ID NO: 514710 - RNA, 32 nt, Human
ugaggucaggagaucaagaccaucuuggcuaa

SEQ ID NO: 514711 - RNA, 32 nt, Human
ugaggucaggagcucaagaccagccugaccaa

SEQ ID NO: 514712 - RNA, 32 nt, Human
ugaggucaggagcucaagaccagccuggcuaa

SEQ ID NO: 514713 - RNA, 32 nt, Human
ugaggucaggagcucaagaccagccuggguaa

SEQ ID NO: 514714 - RNA, 32 nt, Human
ugaggucaggagcucaagaccagccuggucaa

SEQ ID NO: 514715 - RNA, 32 nt, Human
ugaggucaggagcuugaaaccagccuggccaa

SEQ ID NO: 514716 - RNA, 18 nt, Human
ugaggucaggaguacgag

SEQ ID NO: 514717 - RNA, 32 nt, Human
ugaggucaggaguccaagaccagccuggccaa

SEQ ID NO: 514718 - RNA, 32 nt, Human
ugaggucaggaguucaaaaccaaccuggucua

SEQ ID NO: 514719 - RNA, 32 nt, Human
ugaggucaggaguucaaaaccagccuggccaa

SEQ ID NO: 514720 - RNA, 32 nt, Human
ugaggucaggaguucaacaccagcaugaccaa

SEQ ID NO: 514721 - RNA, 32 nt, Human
ugaggucaggaguucaacaccagccuggccaa

SEQ ID NO: 514722 - RNA, 32 nt, Human
ugaggucaggaguucaacaucagccuggccaa

SEQ ID NO: 514723 - RNA, 32 nt, Human
ugaggucaggaguucaagaacagccuagccaa

SEQ ID NO: 514724 - RNA, 32 nt, Human
ugaggucaggaguucaagaacagccugaccaa

SEQ ID NO: 514725 - RNA, 32 nt, Human
ugaggucaggaguucaagaacagccuuaccaa

SEQ ID NO: 514726 - RNA, 32 nt, Human
ugaggucaggaguucaagacaagccuggccaa

SEQ ID NO: 514727 - RNA, 32 nt, Human
ugaggucaggaguucaagacaagccuggccua

SEQ ID NO: 514728 - RNA, 32 nt, Human
ugaggucaggaguucaagaccaaccugacuaa

SEQ ID NO: 514729 - RNA, 32 nt, Human
ugaggucaggaguucaagaccaaucugacuaa

SEQ ID NO: 514730 - RNA, 32 nt, Human
ugaggucaggaguucaagaccaaucuggccaa

SEQ ID NO: 514731 - RNA, 32 nt, Human
ugaggucaggaguucaagaccacccugaccaa

SEQ ID NO: 514732 - RNA, 32 nt, Human
ugaggucaggaguucaagaccagcauggcuua

SEQ ID NO: 514733 - RNA, 32 nt, Human
ugaggucaggaguucaagaccagcaugggaaa

SEQ ID NO: 514734 - RNA, 32 nt, Human
ugaggucaggaguucaagaccagccuagccaa

SEQ ID NO: 514735 - RNA, 32 nt, Human
ugaggucaggaguucaagaccagccucaacau

SEQ ID NO: 514736 - RNA, 32 nt, Human
ugaggucaggaguucaagaccagccugaccaa

SEQ ID NO: 514737 - RNA, 32 nt, Human
ugaggucaggaguucaagaccagccugaccca

SEQ ID NO: 514738 - RNA, 32 nt, Human
ugaggucaggaguucaagaccagccugcccaa

SEQ ID NO: 514739 - RNA, 32 nt, Human
ugaggucaggaguucaagaccagccuggccaa

SEQ ID NO: 514740 - RNA, 32 nt, Human
ugaggucaggaguucaagaccagccuggccga

SEQ ID NO: 514741 - RNA, 32 nt, Human
ugaggucaggaguucaagaccagccuggccgg

SEQ ID NO: 514742 - RNA, 32 nt, Human
ugaggucaggaguucaagaccagccuggcuaa

SEQ ID NO: 514743 - RNA, 32 nt, Human
ugaggucaggaguucaagaccagccuggcuga

SEQ ID NO: 514744 - RNA, 32 nt, Human
ugaggucaggaguucaagaccagccugggcaa

SEQ ID NO: 514745 - RNA, 32 nt, Human
ugaggucaggaguucaagaccagccuggucaa

SEQ ID NO: 514746 - RNA, 32 nt, Human
ugaggucaggaguucaagaccagccuguccaa

SEQ ID NO: 514747 - RNA, 32 nt, Human
ugaggucaggaguucaagaccagccuugccaa

SEQ ID NO: 514748 - RNA, 32 nt, Human
ugaggucaggaguucaagaccagccuuggcaa

SEQ ID NO: 514749 - RNA, 32 nt, Human
ugaggucaggaguucaagaccagcuuggccaa

SEQ ID NO: 514750 - RNA, 32 nt, Human
ugaggucaggaguucaagaccaggcuggccaa

SEQ ID NO: 514751 - RNA, 32 nt, Human
ugaggucaggaguucaagaccaguauggccaa

SEQ ID NO: 514752 - RNA, 32 nt, Human
ugaggucaggaguucaagaccagucuggccaa

SEQ ID NO: 514753 - RNA, 32 nt, Human
ugaggucaggaguucaagaccauccuggccaa

SEQ ID NO: 514754 - RNA, 32 nt, Human
ugaggucaggaguucaagaccugccuggccaa

SEQ ID NO: 514755 - RNA, 32 nt, Human
ugaggucaggaguucaagacuagccuggccaa

SEQ ID NO: 514756 - RNA, 32 nt, Human
ugaggucaggaguucaagacuggccugaucaa

SEQ ID NO: 514757 - RNA, 32 nt, Human
ugaggucaggaguucaagagcagccuggccaa

SEQ ID NO: 514758 - RNA, 32 nt, Human
ugaggucaggaguucaagaucaaccuggccaa

SEQ ID NO: 514759 - RNA, 32 nt, Human
ugaggucaggaguucaagaucagccugaccaa

SEQ ID NO: 514760 - RNA, 32 nt, Human
ugaggucaggaguucaagaucagccugcgcaa

SEQ ID NO: 514761 - RNA, 32 nt, Human
ugaggucaggaguucaagaucagccuggccaa

SEQ ID NO: 514762 - RNA, 32 nt, Human
ugaggucaggaguucaagaucaggaccaacau

SEQ ID NO: 514763 - RNA, 32 nt, Human
ugaggucaggaguucaagauuagccuggccaa

SEQ ID NO: 514764 - RNA, 32 nt, Human
ugaggucaggaguucaaggccagccuggccaa

SEQ ID NO: 514765 - RNA, 32 nt, Human
ugaggucaggaguucaauaccagccuggccaa

SEQ ID NO: 514766 - RNA, 19 nt, Human
ugaggucaggaguucgaga

SEQ ID NO: 514767 - RNA, 32 nt, Human
ugaggucaggaguucgagaccaaccgaccaac

SEQ ID NO: 514768 - RNA, 32 nt, Human
ugaggucaggaguucgagaccaaccuagccaa

SEQ ID NO: 514769 - RNA, 32 nt, Human
ugaggucaggaguucgagaccaaccuccaaca

SEQ ID NO: 514770 - RNA, 32 nt, Human
ugaggucaggaguuugaaacuagccuggccaa

SEQ ID NO: 514771 - RNA, 32 nt, Human
ugaggucaggaguuugagaccaaccuagucaa

SEQ ID NO: 514772 - RNA, 32 nt, Human
ugaggucaggaguuugagaccaaccuggccaa

SEQ ID NO: 514773 - RNA, 32 nt, Human
ugaggucaggaguuugagccagccuggccaac

SEQ ID NO: 514774 - RNA, 32 nt, Human
ugaggucaggaguuuugagaccagccuggcca

SEQ ID NO: 514775 - RNA, 32 nt, Human
ugaggucaggauucaaaaccagccuggccaac

SEQ ID NO: 514776 - RNA, 32 nt, Human
ugaggucaggcguucaagaccagccuggccaa

SEQ ID NO: 514777 - RNA, 32 nt, Human
ugaggucaggggcucaagaccagccuggccaa

SEQ ID NO: 514778 - RNA, 32 nt, Human
ugaggucagggguucaagaccagccuggccaa

SEQ ID NO: 514779 - RNA, 32 nt, Human
ugaggucagggguucaagacuagccuggccaa

SEQ ID NO: 514780 - RNA, 32 nt, Human
ugaggucaguaguucaagaccacccuggccaa

SEQ ID NO: 514781 - RNA, 32 nt, Human
ugaggucaguuguucaagagcagccuggccaa

SEQ ID NO: 514782 - RNA, 32 nt, Human
ugaggucauagcagugcuugauugcguggaau

SEQ ID NO: 514783 - RNA, 32 nt, Human
ugaggucaugaccacagcacaaccuagccuau

SEQ ID NO: 514784 - RNA, 32 nt, Human
ugaggucaugaguucaagaccagccugaccaa

SEQ ID NO: 514785 - RNA, 32 nt, Human
ugaggucaugccauuguacuccagccugggca

SEQ ID NO: 514786 - RNA, 32 nt, Human
ugaggucaugcuguaauagggugggcccccaa

SEQ ID NO: 514787 - RNA, 32 nt, Human
ugaggucauugaaacaugagcccaggagcccu

SEQ ID NO: 514788 - RNA, 32 nt, Human
ugagguccacagcucgcagaagaaggagccgu

SEQ ID NO: 514789 - RNA, 32 nt, Human
ugagguccagcccagaucugagaggaacccug

SEQ ID NO: 514790 - RNA, 32 nt, Human
ugagguccagccuccugcccugccucagguga

SEQ ID NO: 514791 - RNA, 32 nt, Human
ugaggucccaccccucaucucuccuugccaaa

SEQ ID NO: 514792 - RNA, 32 nt, Human
ugaggucccuggggcuaccaccugguugaucu

SEQ ID NO: 514793 - RNA, 32 nt, Human
ugagguccgacugucucugccugcagcaugcc

SEQ ID NO: 514794 - RNA, 32 nt, Human
ugagguccgcgcagcugcuggggaagagccca

SEQ ID NO: 514795 - RNA, 32 nt, Human
ugagguccggauuucaagaccagcaugaccaa

SEQ ID NO: 514796 - RNA, 32 nt, Human
ugagguccucgagggcggucccguuugcugau

SEQ ID NO: 514797 - RNA, 32 nt, Human
ugagguccugggcagagagugaaaaggccucu

SEQ ID NO: 514798 - RNA, 32 nt, Human
ugagguccuucccaccugugaccucaccucaa

SEQ ID NO: 514799 - RNA, 21 nt, Human
ugagguccuuguuuuguuuug

SEQ ID NO: 514800 - RNA, 32 nt, Human
ugaggucgcgccauugcacuccagccugggca

SEQ ID NO: 514801 - RNA, 32 nt, Human
ugaggucggaguuggagaucagccuggcuaac

SEQ ID NO: 514802 - RNA, 32 nt, Human
ugaggucgggaguucaagacaaaccuggccaa

SEQ ID NO: 514803 - RNA, 32 nt, Human
ugaggucgggaguucaagaccagccugaccaa

SEQ ID NO: 514804 - RNA, 32 nt, Human
ugaggucgggaguucaagaccagccugaugaa

SEQ ID NO: 514805 - RNA, 32 nt, Human
ugaggucgggaguucaagaccagccuggccaa

SEQ ID NO: 514806 - RNA, 32 nt, Human
ugaggucgggaguucaagaccagccuggccau

SEQ ID NO: 514807 - RNA, 32 nt, Human
ugaggucgggaguucaagaccagcuuggccaa

SEQ ID NO: 514808 - RNA, 32 nt, Human
ugaggucgggaguucaagacuagccuggccaa

SEQ ID NO: 514809 - RNA, 32 nt, Human
ugaggucgggaguucgagaccaaccugaccaa

SEQ ID NO: 514810 - RNA, 24 nt, Human
ugcaaccuccaccucccaggcuca

SEQ ID NO: 514811 - RNA, 23 nt, Human
ugcaaccuccaccucccagguca

SEQ ID NO: 514812 - RNA, 24 nt, Human
ugcaaccuccaccucccaggucca

SEQ ID NO: 514813 - RNA, 24 nt, Human
ugcaaccuccaccucccagguuca

SEQ ID NO: 514814 - RNA, 23 nt, Human
ugcaaccuccaccucccaguuca

SEQ ID NO: 514815 - RNA, 24 nt, Human
ugcaaccuccaccucccgaguuca

SEQ ID NO: 514816 - RNA, 24 nt, Human
ugcaaccuccaccucccggauuca

SEQ ID NO: 514817 - RNA, 24 nt, Human
ugcaaccuccaccucccgggcuca

SEQ ID NO: 514818 - RNA, 23 nt, Human
ugcaaccuccaccucccggguca

SEQ ID NO: 514819 - RNA, 24 nt, Human
ugcaaccuccaccucccgggugca

SEQ ID NO: 514820 - RNA, 24 nt, Human
ugcaaccuccaccucccggguuca

SEQ ID NO: 514821 - RNA, 24 nt, Human
ugcaaccuccaccucccugguuca

SEQ ID NO: 514822 - RNA, 23 nt, Human
ugcaaccuccaccuccggguuca

SEQ ID NO: 514823 - RNA, 24 nt, Human
ugcaaccuccaccuccuagguuca

SEQ ID NO: 514824 - RNA, 24 nt, Human
ugcaaccuccaccuccugaguuca

SEQ ID NO: 514825 - RNA, 24 nt, Human
ugcaaccuccaccuccuggauuca

SEQ ID NO: 514826 - RNA, 24 nt, Human
ugcaaccuccaccuccuggcuuca

SEQ ID NO: 514827 - RNA, 24 nt, Human
ugcaaccuccaccuccugggcuca

SEQ ID NO: 514828 - RNA, 22 nt, Human
ugcaaccuccaccuccuggguu

SEQ ID NO: 514829 - RNA, 24 nt, Human
ugcaaccuccaccuccuggguuca

SEQ ID NO: 514830 - RNA, 24 nt, Human
ugcaaccuccaccuccuggguuua

SEQ ID NO: 514831 - RNA, 23 nt, Human
ugcaaccuccaccuccugguuca

SEQ ID NO: 514832 - RNA, 24 nt, Human
ugcaaccuccaccucgcagguuca

SEQ ID NO: 514833 - RNA, 24 nt, Human
ugcaaccuccaccucucagauuca

SEQ ID NO: 514834 - RNA, 24 nt, Human
ugcaaccuccaccucucagguuca

SEQ ID NO: 514835 - RNA, 24 nt, Human
ugcaaccuccaccucugggauuca

SEQ ID NO: 514836 - RNA, 24 nt, Human
ugcaaccuccaccuuccugguuca

SEQ ID NO: 514837 - RNA, 24 nt, Human
ugcaaccuccaccuucuggguuca

SEQ ID NO: 514838 - RNA, 25 nt, Human
ugcaaccuccaccuugcgugucuca

SEQ ID NO: 514839 - RNA, 32 nt, Human
ugcaaccuccacuacugcuugacccugccggg

SEQ ID NO: 514840 - RNA, 24 nt, Human
ugcaaccuccacuucccagguuca

SEQ ID NO: 514841 - RNA, 24 nt, Human
ugcaaccuccacuuccuagguuca

SEQ ID NO: 514842 - RNA, 24 nt, Human
ugcaaccuccacuuccuggguuca

SEQ ID NO: 514843 - RNA, 24 nt, Human
ugcaaccuccacuucucagguuca

SEQ ID NO: 514844 - RNA, 24 nt, Human
ugcaaccuccacuucuuggguuca

SEQ ID NO: 514845 - RNA, 24 nt, Human
ugcaaccuccacuuuccggguuca

SEQ ID NO: 514846 - RNA, 24 nt, Human
ugcaaccuccaucucccagguuca

SEQ ID NO: 514847 - RNA, 24 nt, Human
ugcaaccuccaucucccuggcuca

SEQ ID NO: 514848 - RNA, 24 nt, Human
ugcaaccuccaucuccggggcuca

SEQ ID NO: 514849 - RNA, 24 nt, Human
ugcaaccuccaucuccuggauuca

SEQ ID NO: 514850 - RNA, 24 nt, Human
ugcaaccucccccuccuggguuca

SEQ ID NO: 514851 - RNA, 24 nt, Human
ugcaaccuccgacuccuggguuca

SEQ ID NO: 514852 - RNA, 24 nt, Human
ugcaaccuccgcccccuggguuca

SEQ ID NO: 514853 - RNA, 24 nt, Human
ugcaaccuccgccucccaaguuca

SEQ ID NO: 514854 - RNA, 24 nt, Human
ugcaaccuccgccucccagauuca

SEQ ID NO: 514855 - RNA, 24 nt, Human
ugcaaccuccgccucccagguuca

SEQ ID NO: 514856 - RNA, 24 nt, Human
ugcaaccuccgccucccgaguuca

SEQ ID NO: 514857 - RNA, 24 nt, Human
ugcaaccuccgccucccgggccca

SEQ ID NO: 514858 - RNA, 24 nt, Human
ugcaaccuccgccucccggguuca

SEQ ID NO: 514859 - RNA, 24 nt, Human
ugcaaccuccgccuccugaguuca

SEQ ID NO: 514860 - RNA, 24 nt, Human
ugcaaccuccgccuccuggauuca

SEQ ID NO: 514861 - RNA, 24 nt, Human
ugcaaccuccgccuccugggauca

SEQ ID NO: 514862 - RNA, 22 nt, Human
ugcaaccuccgccuccugggcu

SEQ ID NO: 514863 - RNA, 24 nt, Human
ugcaaccuccgccuccugggcuca

SEQ ID NO: 514864 - RNA, 24 nt, Human
ugcaaccuccgccuccuggguuca

SEQ ID NO: 514865 - RNA, 32 nt, Human
ugcaaccuccgccuucccagauucaagcgauu

SEQ ID NO: 514866 - RNA, 32 nt, Human
ugcaaccuccgcuccaccacugaggcccaggc

SEQ ID NO: 514867 - RNA, 24 nt, Human
ugcaaccuccgcuuccuggauuca

SEQ ID NO: 514868 - RNA, 24 nt, Human
ugcaaccuccgcuuccuggguuca

SEQ ID NO: 514869 - RNA, 24 nt, Human
ugcaaccuccgucucccagguuca

SEQ ID NO: 514870 - RNA, 24 nt, Human
ugcaaccuccgucuccuggguuca

SEQ ID NO: 514871 - RNA, 24 nt, Human
ugcaaccuccgucuuccggguuca

SEQ ID NO: 514872 - RNA, 24 nt, Human
ugcaaccuccuccuccuggauuca

SEQ ID NO: 514873 - RNA, 24 nt, Human
ugcaaccuccuccuccuggguuca

SEQ ID NO: 514874 - RNA, 32 nt, Human
ugcaaccuccuuucugugccccuuuccucauu

SEQ ID NO: 514875 - RNA, 24 nt, Human
ugcaaccucgaccuccugggcuca

SEQ ID NO: 514876 - RNA, 32 nt, Human
ugcaaccucgaggacauccacaugagccugga

SEQ ID NO: 514877 - RNA, 32 nt, Human
ugcaaccucgcuggacucucagucucugagca

SEQ ID NO: 514878 - RNA, 24 nt, Human
ugcaaccucggccucccggguuca

SEQ ID NO: 514879 - RNA, 23 nt, Human
ugcaaccucgucucccggguuca

SEQ ID NO: 514880 - RNA, 24 nt, Human
ugcaaccucuaccucccagguuca

SEQ ID NO: 514881 - RNA, 24 nt, Human
ugcaaccucuaccuccuggauuca

SEQ ID NO: 514882 - RNA, 24 nt, Human
ugcaaccucuaccuccuggguuca

SEQ ID NO: 514883 - RNA, 32 nt, Human
ugcaaccucuacucccaggcucaagcaauccu

SEQ ID NO: 514884 - RNA, 24 nt, Human
ugcaaccucugacuccuggguuca

SEQ ID NO: 514885 - RNA, 24 nt, Human
ugcaaccucugccccccggguuca

SEQ ID NO: 514886 - RNA, 24 nt, Human
ugcaaccucugcccccuggguuca

SEQ ID NO: 514887 - RNA, 24 nt, Human
ugcaaccucugccucacaggcuca

SEQ ID NO: 514888 - RNA, 24 nt, Human
ugcaaccucugccucccaaguuca

SEQ ID NO: 514889 - RNA, 24 nt, Human
ugcaaccucugccucccaggauca

SEQ ID NO: 514890 - RNA, 23 nt, Human
ugcaaccucugccucccagguca

SEQ ID NO: 514891 - RNA, 24 nt, Human
ugcaaccucugccucccagguuca

SEQ ID NO: 514892 - RNA, 32 nt, Human
ugcaaccucugccucccagguucaagccuccu

SEQ ID NO: 514893 - RNA, 24 nt, Human
ugcaaccucugccucccgaguuca

SEQ ID NO: 514894 - RNA, 32 nt, Human
ugcaaccucugccucccgcauucaagugauuc

SEQ ID NO: 514895 - RNA, 24 nt, Human
ugcaaccucugccucccggauuca

SEQ ID NO: 514896 - RNA, 32 nt, Human
ugcaaccucugccucccggauucaagugauuc

SEQ ID NO: 514897 - RNA, 32 nt, Human
ugcaaccucugccucccgggcucaagugauuc

SEQ ID NO: 514898 - RNA, 24 nt, Human
ugcaaccucugccucccgggucca

SEQ ID NO: 514899 - RNA, 32 nt, Human
ugcaaccucugccucccggguccaagugauuc

SEQ ID NO: 514900 - RNA, 24 nt, Human
ugcaaccucugccucccggguuca

SEQ ID NO: 514901 - RNA, 24 nt, Human
ugcaaccucugccuccuaaguuca

SEQ ID NO: 514902 - RNA, 24 nt, Human
ugcaaccucugccuccugagcuca

SEQ ID NO: 514903 - RNA, 32 nt, Human
ugcaaccucugccuccugagcucaagugaucc

SEQ ID NO: 514904 - RNA, 24 nt, Human
ugcaaccucugccuccugaguuca

SEQ ID NO: 514905 - RNA, 24 nt, Human
ugcaaccucugccuccuggauuca

SEQ ID NO: 514906 - RNA, 24 nt, Human
ugcaaccucugccuccugggcuca

SEQ ID NO: 514907 - RNA, 24 nt, Human
ugcaaccucugccuccuggguuca

SEQ ID NO: 514908 - RNA, 32 nt, Human
ugcaaccucugccucucagguucaagccauuc

SEQ ID NO: 514909 - RNA, 32 nt, Human
ugcaaccucugccucucggguuccagcaauuc

SEQ ID NO: 514910 - RNA, 24 nt, Human
ugcaaccucugcuucccagguuca

SEQ ID NO: 514911 - RNA, 24 nt, Human
ugcaaccucugcuucccggguuca

SEQ ID NO: 514912 - RNA, 24 nt, Human
ugcaaccucugcuuccuagguuca

SEQ ID NO: 514913 - RNA, 24 nt, Human
ugcaaccucugcuuccugggcuca

SEQ ID NO: 514914 - RNA, 24 nt, Human
ugcaaccucugcuuccuggguuca

SEQ ID NO: 514915 - RNA, 24 nt, Human
ugcaaccucugucucccagguuca

SEQ ID NO: 514916 - RNA, 24 nt, Human
ugcaaccucugucucccggguuca

SEQ ID NO: 514917 - RNA, 24 nt, Human
ugcaaccucugucuccugggcuca

SEQ ID NO: 514918 - RNA, 24 nt, Human
ugcaaccucugucuccuggguuca

SEQ ID NO: 514919 - RNA, 24 nt, Human
ugcaaccucuguguccugggcuca

SEQ ID NO: 514920 - RNA, 25 nt, Human
ugcaaccucuugccucccagguuca

SEQ ID NO: 514921 - RNA, 32 nt, Human
ugcaaccugccugagccccguggccucucagc

SEQ ID NO: 514922 - RNA, 24 nt, Human
ugcaaccugcgccuccuggguuca

SEQ ID NO: 514923 - RNA, 32 nt, Human
ugcaaccugcuugucaaaaugauucaaaaaua

SEQ ID NO: 514924 - RNA, 24 nt, Human
ugcaaccuggaacuccugggcuca

SEQ ID NO: 514925 - RNA, 24 nt, Human
ugcaaccuggaccuccugggcuca

SEQ ID NO: 514926 - RNA, 32 nt, Human
ugcaaccugggugacagagcgagacuccaucu

SEQ ID NO: 514927 - RNA, 32 nt, Human
ugcaaccugguuuugaaaaagacugagcaugu

SEQ ID NO: 514928 - RNA, 32 nt, Human
ugcaaccuucacccuucaccucccaggucgaa

SEQ ID NO: 514929 - RNA, 32 nt, Human
ugcaaccuucccagccacuccugcugcacuaa

SEQ ID NO: 514930 - RNA, 24 nt, Human
ugcaaccuucgccucccagguuca

SEQ ID NO: 514931 - RNA, 24 nt, Human
ugcaaccuucgccucccgaguuca

SEQ ID NO: 514932 - RNA, 24 nt, Human
ugcaaccuucgccucccggguuca

SEQ ID NO: 514933 - RNA, 24 nt, Human
ugcaaccuucgccuccuggguuca

SEQ ID NO: 514934 - RNA, 24 nt, Human
ugcaaccuuggccuccuagguuca

SEQ ID NO: 514935 - RNA, 32 nt, Human
ugcaaccuuuagacuaaugacuguccgaaaca

SEQ ID NO: 514936 - RNA, 32 nt, Human
ugcaaccuuugcacuccacugugcaaugcugg

SEQ ID NO: 514937 - RNA, 24 nt, Human
ugcaaccuuugccuccuagguuca

SEQ ID NO: 514938 - RNA, 24 nt, Human
ugcaaccuuugucucccgggcuca

SEQ ID NO: 514939 - RNA, 32 nt, Human
ugcaacgaaauccuauauccaguuuccuguaa

SEQ ID NO: 514940 - RNA, 22 nt, Human
ugcaacggugugaacucagccu

SEQ ID NO: 514941 - RNA, 32 nt, Human
ugcaacguccucugcggggagcgugggaggag

SEQ ID NO: 514942 - RNA, 24 nt, Human
ugcaacgucugccucccggguuca

SEQ ID NO: 514943 - RNA, 24 nt, Human
ugcaacgucugccuccuggguuca

SEQ ID NO: 514944 - RNA, 24 nt, Human
ugcaacuaccaccuccuggguuca

SEQ ID NO: 514945 - RNA, 32 nt, Human
ugcaacucaaauaggcuauauuucacaauagc

SEQ ID NO: 514946 - RNA, 28 nt, Human
ugcaacucagggguggccucauccuccc

SEQ ID NO: 514947 - RNA, 23 nt, Human
ugcaacuccaccucccggguuca

SEQ ID NO: 514948 - RNA, 32 nt, Human
ugcaacuccugccuccaucccccuugcugggg

SEQ ID NO: 514949 - RNA, 32 nt, Human
ugcaacuccuggacccuuuuguccucagugug

SEQ ID NO: 514950 - RNA, 32 nt, Human
ugcaacucuaauucucuuccuuauuuuaauac

SEQ ID NO: 514951 - RNA, 32 nt, Human
ugcaacucugauuccugguucaauuuuaaguu

SEQ ID NO: 514952 - RNA, 32 nt, Human
ugcaacugcacuccaaccugggcaacagagua

SEQ ID NO: 514953 - RNA, 32 nt, Human
ugcaacugcaguagcaggaacaugucaggugc

SEQ ID NO: 514954 - RNA, 32 nt, Human
ugcaacugcccaagcuccaggucuccaggaca

SEQ ID NO: 514955 - RNA, 32 nt, Human
ugcaacugcuucauugcuauuaauaguuaaau

SEQ ID NO: 514956 - RNA, 32 nt, Human
ugcaacuggagcugcaacaauagcucuacaga

SEQ ID NO: 514957 - RNA, 32 nt, Human
ugcaacuggaucuucagccuccugugggagcu

SEQ ID NO: 514958 - RNA, 32 nt, Human
ugcaacugggaaacuuuuguccuuugaggcua

SEQ ID NO: 514959 - RNA, 32 nt, Human
ugcaacuguacuguaacaccaucucuuuugga

SEQ ID NO: 514960 - RNA, 32 nt, Human
ugcaacugugcacuccucccuugguggcaccc

SEQ ID NO: 514961 - RNA, 32 nt, Human
ugcaacuucaggauuaaccacugggaccugaa

SEQ ID NO: 514962 - RNA, 24 nt, Human
ugcaacuuccaccucccagguuca

SEQ ID NO: 514963 - RNA, 24 nt, Human
ugcaacuuccaccucccggguuca

SEQ ID NO: 514964 - RNA, 24 nt, Human
ugcaacuuccaccuccuggaguca

SEQ ID NO: 514965 - RNA, 24 nt, Human
ugcaacuuccaccuccuggguuca

SEQ ID NO: 514966 - RNA, 24 nt, Human
ugcaacuucugccucccggguuca

SEQ ID NO: 514967 - RNA, 24 nt, Human
ugcaacuucugccuccuagguuca

SEQ ID NO: 514968 - RNA, 24 nt, Human
ugcaacuucugccuccuggguuca

SEQ ID NO: 514969 - RNA, 32 nt, Human
ugcaacuuuaguguaauuccuaccucauuugg

SEQ ID NO: 514970 - RNA, 32 nt, Human
ugcaagaagcucaaggaagcucagggaaaaug

SEQ ID NO: 514971 - RNA, 32 nt, Human
ugcaagaaggagagaugaggcaaacguuuaga

SEQ ID NO: 514972 - RNA, 32 nt, Human
ugcaagaauagcacaaugaacaugcauauacc

SEQ ID NO: 514973 - RNA, 32 nt, Human
ugcaagaauauuuugugcuuucuuuagaaaca

SEQ ID NO: 514974 - RNA, 32 nt, Human
ugcaagacagaagucacugucuauccuguggc

SEQ ID NO: 514975 - RNA, 32 nt, Human
ugcaagacaucucacucuucugacauccugca

SEQ ID NO: 514976 - RNA, 32 nt, Human
ugcaagaccagccugcgcaaacagcaagaccc

SEQ ID NO: 514977 - RNA, 32 nt, Human
ugcaagaccgagacugagggaaagcaugucug

SEQ ID NO: 514978 - RNA, 32 nt, Human
ugcaagaccgagauugagggaaagcaugucug

SEQ ID NO: 514979 - RNA, 32 nt, Human
ugcaagacuggguggacuagaaagggagauua

SEQ ID NO: 514980 - RNA, 32 nt, Human
ugcaagacuguaccucugccccagugugucca

SEQ ID NO: 514981 - RNA, 32 nt, Human
ugcaagagaacaauguuucuucaguggcaaau

SEQ ID NO: 514982 - RNA, 32 nt, Human
ugcaagagaaggagauguaaugacagagaguu

SEQ ID NO: 514983 - RNA, 32 nt, Human
ugcaagagaggcagccagaggccagguaucug

SEQ ID NO: 514984 - RNA, 32 nt, Human
ugcaagagauggagacagguuagguggauagu

SEQ ID NO: 514985 - RNA, 20 nt, Human
ugcaagagccuggcugggaa

SEQ ID NO: 514986 - RNA, 32 nt, Human
ugcaagagcuaaaccaucuucaaaacauaaau

SEQ ID NO: 514987 - RNA, 32 nt, Human
ugcaagaggcaagucugcugaagaaccccuuc

SEQ ID NO: 514988 - RNA, 32 nt, Human
ugcaagauacaaaaucagucaacaugcaaaag

SEQ ID NO: 514989 - RNA, 32 nt, Human
ugcaagaugaagguguuaggacaacuuaaaga

SEQ ID NO: 514990 - RNA, 21 nt, Human
ugcaagcaaagggcggugggg

SEQ ID NO: 514991 - RNA, 32 nt, Human
ugcaagcaagaggcucccugacugccugaucc

SEQ ID NO: 514992 - RNA, 32 nt, Human
ugcaagcaauaugcccaucauccuuccugaga

SEQ ID NO: 514993 - RNA, 32 nt, Human
ugcaagcaaucucuagggcuggagggagagaa

SEQ ID NO: 514994 - RNA, 32 nt, Human
ugcaagcacaucugcauuuucaccccacccuu

SEQ ID NO: 514995 - RNA, 32 nt, Human
ugcaagcagcacaagcuuuauauuaccccagc

SEQ ID NO: 514996 - RNA, 32 nt, Human
ugcaagcagccgcggcgcgcccggcccucccu

SEQ ID NO: 514997 - RNA, 32 nt, Human
ugcaagcaucuaagagagguuaaucacacuau

SEQ ID NO: 514998 - RNA, 32 nt, Human
ugcaagccaaguuuggaaggcauucgggaaua

SEQ ID NO: 514999 - RNA, 32 nt, Human
ugcaagccaccaaauaccagggagugaaggau

SEQ ID NO: 515000 - RNA, 32 nt, Human
ugcaagccagagggaggaagggggagaauacg

SEQ ID NO: 515001 - RNA, 32 nt, Human
ugcaagccagcccagcugaggcgaaguggacu

SEQ ID NO: 515002 - RNA, 32 nt, Human
ugcaagccaguugucaaacacagccauuauaa

SEQ ID NO: 515003 - RNA, 32 nt, Human
ugcaagccccugcccauggcccaauggggagc

SEQ ID NO: 515004 - RNA, 32 nt, Human
ugcaagcccugccucagcuucucccaacacuc

SEQ ID NO: 515005 - RNA, 32 nt, Human
ugcaagccgcugaccuuggauggugaauggag

SEQ ID NO: 515006 - RNA, 32 nt, Human
ugcaagcggggagggggccgagcagccaagga

SEQ ID NO: 515007 - RNA, 23 nt, Human
ugcaagcuagaaucaaagaauua

SEQ ID NO: 515008 - RNA, 32 nt, Human
ugcaagcuccacagccucgggcugccagccug

SEQ ID NO: 515009 - RNA, 24 nt, Human
ugcaagcuccaccucccagguuca

SEQ ID NO: 515010 - RNA, 24 nt, Human
ugcaagcuccaccucccggguuca

SEQ ID NO: 515011 - RNA, 24 nt, Human
ugcaagcuccaccuccuggguuca

SEQ ID NO: 515012 - RNA, 32 nt, Human
ugcaagcuccccucagcccaucuugcucccuc

SEQ ID NO: 515013 - RNA, 32 nt, Human
ugcaagcucccgccucccuugggucgcacgcu

SEQ ID NO: 515014 - RNA, 32 nt, Human
ugcaagcuccugcacacaugcaugcacacaaa

SEQ ID NO: 515015 - RNA, 32 nt, Human
ugcaagcucugccucccgguugcugaaccugu

SEQ ID NO: 515016 - RNA, 32 nt, Human
ugcaagcucugccuuggguucagcccaucugg

SEQ ID NO: 515017 - RNA, 32 nt, Human
ugcaagcucuuguuucucaggcugccugcaga

SEQ ID NO: 515018 - RNA, 32 nt, Human
ugcaagcugacuccagccuuggggucagcagc

SEQ ID NO: 515019 - RNA, 32 nt, Human
ugcaagcugagccugcacuaccuuuugucacg

SEQ ID NO: 515020 - RNA, 32 nt, Human
ugcaagcugcucauuuuugacagcuuuuugca

SEQ ID NO: 515021 - RNA, 32 nt, Human
ugcaagcugggagcacaggcacugcaggagag

SEQ ID NO: 515022 - RNA, 32 nt, Human
ugcaagcugggagcuugcaugggugaaugccg

SEQ ID NO: 515023 - RNA, 32 nt, Human
ugcaagcuucaaggggcuuuuguuugaaagac

SEQ ID NO: 515024 - RNA, 32 nt, Human
ugcaagcuugauucaccuucagggggcugaua

SEQ ID NO: 515025 - RNA, 32 nt, Human
ugcaagcuugggaaacucuggagagaggcugc

SEQ ID NO: 515026 - RNA, 20 nt, Human
ugcaaggaaauggcuguggu

SEQ ID NO: 515027 - RNA, 23 nt, Human
ugcaaggaagaaagacaauggaa

SEQ ID NO: 515028 - RNA, 32 nt, Human
ugcaaggaagcgggcuccaggagcaagcucac

SEQ ID NO: 515029 - RNA, 23 nt, Human
ugcaaggaauauguacacuggaa

SEQ ID NO: 515030 - RNA, 32 nt, Human
ugcaaggagaggcagaggccagugcuugcgcg

SEQ ID NO: 515031 - RNA, 32 nt, Human
ugcaaggagcaaggacggggccaaggucgcuc

SEQ ID NO: 515032 - RNA, 24 nt, Human
ugcaaggagcccuccugccuggga

SEQ ID NO: 515033 - RNA, 32 nt, Human
ugcaaggagcugagggcccaccuggagcuccu

SEQ ID NO: 515034 - RNA, 32 nt, Human
ugcaaggaggcugggcacgggggcucacgccu

SEQ ID NO: 515035 - RNA, 32 nt, Human
ugcaaggcagccuaugcucugugggagggacu

SEQ ID NO: 515036 - RNA, 32 nt, Human
ugcaaggcagggcagagcaggggcuguuaagg

SEQ ID NO: 515037 - RNA, 32 nt, Human
ugcaaggcaguagcucugccaacuggggcucc

SEQ ID NO: 515038 - RNA, 32 nt, Human
ugcaaggcauuccuccugaaugcauccaugaa

SEQ ID NO: 515039 - RNA, 32 nt, Human
ugcaaggccacuugugcuagcagcaugcguca

SEQ ID NO: 515040 - RNA, 32 nt, Human
ugcaaggccagaaacugucacuaaugacgaug

SEQ ID NO: 515041 - RNA, 20 nt, Human
ugcaaggcccgcuucaucca

SEQ ID NO: 515042 - RNA, 20 nt, Human
ugcaaggccgcuguucacca

SEQ ID NO: 515043 - RNA, 32 nt, Human
ugcaaggccugggaagaguuucgaugucucua

SEQ ID NO: 515044 - RNA, 32 nt, Human
ugcaaggccuugcaaaugcauuuauaccugua

SEQ ID NO: 515045 - RNA, 32 nt, Human
ugcaaggcgccgcggcucagcgcgcaccggcg

SEQ ID NO: 515046 - RNA, 32 nt, Human
ugcaaggcgccgcggcucagcgcguaccggcg

SEQ ID NO: 515047 - RNA, 22 nt, Human
ugcaaggcuaaacugucauuca

SEQ ID NO: 515048 - RNA, 32 nt, Human
ugcaaggcuaauuaggacagaucaauguacac

SEQ ID NO: 515049 - RNA, 22 nt, Human
ugcaaggcugaagcugccacca

SEQ ID NO: 515050 - RNA, 32 nt, Human
ugcaaggcugcaaugagccaggaucccaugau

SEQ ID NO: 515051 - RNA, 20 nt, Human
ugcaaggcuggcagccccca

SEQ ID NO: 515052 - RNA, 19 nt, Human
ugcaaggcugggugcagug

SEQ ID NO: 515053 - RNA, 20 nt, Human
ugcaaggcugggugcagugg

SEQ ID NO: 515054 - RNA, 32 nt, Human
ugcaagggagaaggaaaaggccaguaaggccu

SEQ ID NO: 515055 - RNA, 32 nt, Human
ugcaaggggaggugcgcgaggcggcgcgggag

SEQ ID NO: 515056 - RNA, 32 nt, Human
ugcaaggggaugguuguuuucuuucugccuuu

SEQ ID NO: 515057 - RNA, 32 nt, Human
ugcaaggggccugcagaugaaagggaagcccu

SEQ ID NO: 515058 - RNA, 32 nt, Human
ugcaagggucaauuaugcauuccugugaguca

SEQ ID NO: 515059 - RNA, 19 nt, Human
ugcaaggucccaggacugg

SEQ ID NO: 515060 - RNA, 32 nt, Human
ugcaaggucuccuugaccccuugccacaacug

SEQ ID NO: 515061 - RNA, 32 nt, Human
ugcaaggugucugaggcccauucucaggcugg

SEQ ID NO: 515062 - RNA, 32 nt, Human
ugcaaguaacaucuuucuucucuggaaggugu

SEQ ID NO: 515063 - RNA, 32 nt, Human
ugcaaguaccacuccauccagccuugggcaag

SEQ ID NO: 515064 - RNA, 32 nt, Human
ugcaaguagcuggcuuguaaagggugaacaga

SEQ ID NO: 515065 - RNA, 32 nt, Human
ugcaaguauaccacccuuccauuuaguauguu

SEQ ID NO: 515066 - RNA, 32 nt, Human
ugcaaguaugggaagcagaaacuauucugucu

SEQ ID NO: 515067 - RNA, 32 nt, Human
ugcaagucaguagguguuaguaugguugcaaa

SEQ ID NO: 515068 - RNA, 32 nt, Human
ugcaaguccuagggacacugugcucaguuuau

SEQ ID NO: 515069 - RNA, 32 nt, Human
ugcaagucuaacuucaucuucccaacaaauuu

SEQ ID NO: 515070 - RNA, 20 nt, Human
ugcaagugcaaggccagugg

SEQ ID NO: 515071 - RNA, 32 nt, Human
ugcaagugcuaccucgcgcuuguacacugcug

SEQ ID NO: 515072 - RNA, 32 nt, Human
ugcaagugcucacagcucuuguucuccagaaa

SEQ ID NO: 515073 - RNA, 31 nt, Human
ugcaaguggaagagagaauaguugaaaaugu

SEQ ID NO: 515074 - RNA, 32 nt, Human
ugcaaguggccaaccuagagauucacuccuua

SEQ ID NO: 515075 - RNA, 32 nt, Human
ugcaagugguagggacaagcagugagguggug

SEQ ID NO: 515076 - RNA, 29 nt, Human
ugcaagugucuguguuucucugggaggga

SEQ ID NO: 515077 - RNA, 32 nt, Human
ugcaaguguguaugugcgugugugcgagugug

SEQ ID NO: 515078 - RNA, 32 nt, Human
ugcaaguguucuccaagggaaggaggaggaaa

SEQ ID NO: 515079 - RNA, 32 nt, Human
ugcaaguucauuuaagccucagggcugguccc

SEQ ID NO: 515080 - RNA, 32 nt, Human
ugcaaguucuaaaaauagacuaaggaugccuu

SEQ ID NO: 515081 - RNA, 32 nt, Human
ugcaaguuguccagguucuuggcauuuugaac

SEQ ID NO: 515082 - RNA, 32 nt, Human
ugcaaguugugaucccagccucccugaguagc

SEQ ID NO: 515083 - RNA, 32 nt, Human
ugcaaguuucccuccccucugugaccgagacu

SEQ ID NO: 515084 - RNA, 28 nt, Human
ugcaaguuuucaguacaaaucugugcua

SEQ ID NO: 515085 - RNA, 32 nt, Human
ugcaauaaauucaagacucuucuuauugguaa

SEQ ID NO: 515086 - RNA, 32 nt, Human
ugcaauaacaaccuuugauuacugaaucccua

SEQ ID NO: 515087 - RNA, 32 nt, Human
ugcaauaacuucugaccuuuuggugaaagcug

SEQ ID NO: 515088 - RNA, 32 nt, Human
ugcaauaaucucuuuucccuugucaugcaagc

SEQ ID NO: 515089 - RNA, 32 nt, Human
ugcaauaaugcccucaccccuccugagaggag

SEQ ID NO: 515090 - RNA, 32 nt, Human
ugcaauacaagaagcaagaccaaacagauauc

SEQ ID NO: 515091 - RNA, 32 nt, Human
ugcaauacagcuuucuugaaauguguauugaa

SEQ ID NO: 515092 - RNA, 32 nt, Human
ugcaauacaguggauacaauuugucauggcua

SEQ ID NO: 515093 - RNA, 32 nt, Human
ugcaauaccacuguuuauaagugacaaaauua

SEQ ID NO: 515094 - RNA, 32 nt, Human
ugcaauaccacuuucggaccugggcggaccac

SEQ ID NO: 515095 - RNA, 32 nt, Human
ugcaauaccugucaccaugcagccgcugauag

SEQ ID NO: 515096 - RNA, 28 nt, Human
ugcaauacugagugugccucauuaucuu

SEQ ID NO: 515097 - RNA, 22 nt, Human
ugcaauacuggauuuauuuuga

SEQ ID NO: 515098 - RNA, 32 nt, Human
ugcaauagauuuguacuaaccagaccuguucu

SEQ ID NO: 515099 - RNA, 32 nt, Human
ugcaauaguagcaaacuacuaacccagcaaau

SEQ ID NO: 515100 - RNA, 24 nt, Human
ugcaauaguguugggaguuggggc

SEQ ID NO: 515101 - RNA, 32 nt, Human
ugcaauaucacugagccugcgaucuauacacc

SEQ ID NO: 515102 - RNA, 32 nt, Human
ugcaauaucggaagacuuucaaaacucaucuc

SEQ ID NO: 515103 - RNA, 32 nt, Human
ugcaauaucuuuccuuccuuccuugcuaagag

SEQ ID NO: 515104 - RNA, 17 nt, Human
ugcaauaucuuuuccua

SEQ ID NO: 515105 - RNA, 32 nt, Human
ugcaauauuuccagaaaaucacugugggagaa

SEQ ID NO: 515106 - RNA, 32 nt, Human
ugcaaucaaaccugcaauguucugucaugaau

SEQ ID NO: 515107 - RNA, 32 nt, Human
ugcaaucaacccacggaagcuccgggaauggc

SEQ ID NO: 515108 - RNA, 32 nt, Human
ugcaaucacaccaugccauguuuuccuuccug

SEQ ID NO: 515109 - RNA, 32 nt, Human
ugcaaucagcugugggagagcggugacugaga

SEQ ID NO: 515110 - RNA, 32 nt, Human
ugcaauccagccugggcgauagagugagacua

SEQ ID NO: 515111 - RNA, 32 nt, Human
ugcaaucccaggagguagcaaccuaggcuuug

SEQ ID NO: 515112 - RNA, 32 nt, Human
ugcaaucgcagcucacuguagcuuugaccucu

SEQ ID NO: 515113 - RNA, 23 nt, Human
ugcaaucuaugggggaagacuga

SEQ ID NO: 515114 - RNA, 32 nt, Human
ugcaaucucacugcaaccuccgccuuccaguu

SEQ ID NO: 515115 - RNA, 32 nt, Human
ugcaaucucacugcaagcucugccucccaggu

SEQ ID NO: 515116 - RNA, 24 nt, Human
ugcaaucuccaccuccuggguuca

SEQ ID NO: 515117 - RNA, 32 nt, Human
ugcaaucuccaucucccggguucaagcgauuc

SEQ ID NO: 515118 - RNA, 32 nt, Human
ugcaaucucggcuuacugaaaccucugccucc

SEQ ID NO: 515119 - RNA, 32 nt, Human
ugcaaucucugccucccggauucaagugauuc

SEQ ID NO: 515120 - RNA, 32 nt, Human
ugcaaucucugccucucugaccccagggccau

SEQ ID NO: 515121 - RNA, 32 nt, Human
ugcaaucucuugucucacaugcuagcaacaua

SEQ ID NO: 515122 - RNA, 21 nt, Human
ugcaaucucuuuaccaccucc

SEQ ID NO: 515123 - RNA, 32 nt, Human
ugcaaucugaagaggauguaagucaguuugau

SEQ ID NO: 515124 - RNA, 32 nt, Human
ugcaaucugaggagaaaggagagccaguccga

SEQ ID NO: 515125 - RNA, 32 nt, Human
ugcaaucugcacuguccagccuagcaggccgc

SEQ ID NO: 515126 - RNA, 32 nt, Human
ugcaaucuguccguggcucuggcuccaaagcc

SEQ ID NO: 515127 - RNA, 32 nt, Human
ugcaaucuucuuucucuuaauuccagaacugg

SEQ ID NO: 515128 - RNA, 32 nt, Human
ugcaaucuuuaaaucagccuccaguuuuugaa

SEQ ID NO: 515129 - RNA, 32 nt, Human
ugcaaugaacugcucccacguccugcacugca

SEQ ID NO: 515130 - RNA, 32 nt, Human
ugcaaugaagaaaaggccuucuggagauuucu

SEQ ID NO: 515131 - RNA, 32 nt, Human
ugcaaugaagcccugcucccagccuuucagag

SEQ ID NO: 515132 - RNA, 32 nt, Human
ugcaaugaagcggagguugcagugagccgaga

SEQ ID NO: 515133 - RNA, 32 nt, Human
ugcaaugaauacagcaaggccuuuacccacug

SEQ ID NO: 515134 - RNA, 32 nt, Human
ugcaaugacucaugccuguaaucccagcacgu

SEQ ID NO: 515135 - RNA, 32 nt, Human
ugcaaugauacaacaaaaagauuuaauuacag

SEQ ID NO: 515136 - RNA, 32 nt, Human
ugcaaugcagagccuggguagaaagagacucu

SEQ ID NO: 515137 - RNA, 22 nt, Human
ugcaaugccucuccucucccca

SEQ ID NO: 515138 - RNA, 18 nt, Human
ugcaaugcucuuucccca

SEQ ID NO: 515139 - RNA, 29 nt, Human
ugcaauggaaaggacacuugagagaagac

SEQ ID NO: 515140 - RNA, 32 nt, Human
ugcaauggagcacgacuccucggcgugcagga

SEQ ID NO: 515141 - RNA, 32 nt, Human
ugcaauggagccaacacaguggaaagcagagc

SEQ ID NO: 515142 - RNA, 32 nt, Human
ugcaauggcacaaccuccaccuccuggguuca

SEQ ID NO: 515143 - RNA, 31 nt, Human
ugcaauggcacaaucucaacucaccgcaacc

SEQ ID NO: 515144 - RNA, 31 nt, Human
ugcaauggcacaaucucagcucacagcaacc

SEQ ID NO: 515145 - RNA, 31 nt, Human
ugcaauggcacaaucucagcucaccgcaacc

SEQ ID NO: 515146 - RNA, 31 nt, Human
ugcaauggcacaaucucagcucacugcaacc

SEQ ID NO: 515147 - RNA, 31 nt, Human
ugcaauggcacaaucucagcucagugcaacc

SEQ ID NO: 515148 - RNA, 31 nt, Human
ugcaauggcacaaucucggcucacugcaacc

SEQ ID NO: 515149 - RNA, 31 nt, Human
ugcaauggcacaaucucggcucacugcaagc

SEQ ID NO: 515150 - RNA, 31 nt, Human
ugcaauggcacaaucucggcucacugcagcc

SEQ ID NO: 515151 - RNA, 31 nt, Human
ugcaauggcacaaucucggcucacugcaucc

SEQ ID NO: 515152 - RNA, 31 nt, Human
ugcaauggcacaaucucgguucacugcaacc

SEQ ID NO: 515153 - RNA, 31 nt, Human
ugcaauggcaccaucucagcucacugcgacc

SEQ ID NO: 515154 - RNA, 31 nt, Human
ugcaauggcacgaucucagcucaccacaacc

SEQ ID NO: 515155 - RNA, 31 nt, Human
ugcaauggcacgaucucagcucacugcaacc

SEQ ID NO: 515156 - RNA, 31 nt, Human
ugcaauggcacgaucucagcucacugcaacu

SEQ ID NO: 515157 - RNA, 31 nt, Human
ugcaauggcaugaucucagcucacugcaacc

SEQ ID NO: 515158 - RNA, 31 nt, Human
ugcaauggcaugaucucagcucacugcaagc

SEQ ID NO: 515159 - RNA, 31 nt, Human
ugcaauggcaugaucucagcucacugcaauc

SEQ ID NO: 515160 - RNA, 32 nt, Human
ugcaauggcaugaucucgccuccuggguucaa

SEQ ID NO: 515161 - RNA, 31 nt, Human
ugcaauggcgcaaucucagcucacugcaagc

SEQ ID NO: 515162 - RNA, 31 nt, Human
ugcaauggcgcgaucucagcucaccgcaucc

SEQ ID NO: 515163 - RNA, 31 nt, Human
ugcaauggcgcgaucucagcucaccucaacc

SEQ ID NO: 515164 - RNA, 31 nt, Human
ugcaauggcgcgaucucagcucacugcaacc

SEQ ID NO: 515165 - RNA, 31 nt, Human
ugcaauggcgcgaucucagcucacugcagcc

SEQ ID NO: 515166 - RNA, 31 nt, Human
ugcaauggcgugaucucagcucaccgcaacc

SEQ ID NO: 515167 - RNA, 31 nt, Human
ugcaauggcgugaucucagcucacuggcaac

SEQ ID NO: 515168 - RNA, 32 nt, Human
ugcaauggcucacaccuauaaucccagcacuu

SEQ ID NO: 515169 - RNA, 32 nt, Human
ugcaauggcucacaccuguaauuccaacacuu

SEQ ID NO: 515170 - RNA, 32 nt, Human
ugcaauggcucacaccuguuaaucccagcacu

SEQ ID NO: 515171 - RNA, 32 nt, Human
ugcaauggcucacacuuguaaucccaacacuu

SEQ ID NO: 515172 - RNA, 32 nt, Human
ugcaauggcucacgccuguaauccuggcacuu

SEQ ID NO: 515173 - RNA, 32 nt, Human
ugcaauggcucacgucuguaaucccagcacuu

SEQ ID NO: 515174 - RNA, 32 nt, Human
ugcaauggcucagcuucucuuccaaccugucc

SEQ ID NO: 515175 - RNA, 32 nt, Human
ugcaauggcucagguucucuuccagccugucc

SEQ ID NO: 515176 - RNA, 32 nt, Human
ugcaauggcucaugccuauaaucccagcacuu

SEQ ID NO: 515177 - RNA, 32 nt, Human
ugcaauggcucaugccuguaaucccaaaacuu

SEQ ID NO: 515178 - RNA, 32 nt, Human
ugcaauggcucaugccuguaaucccaacacuu

SEQ ID NO: 515179 - RNA, 32 nt, Human
ugcaauggcucaugccuguaaucccagcacuu

SEQ ID NO: 515180 - RNA, 32 nt, Human
ugcaauggcucaugucucuaaucccagcacuu

SEQ ID NO: 515181 - RNA, 32 nt, Human
ugcaauggcucgcaccuguaaucccagcacuu

SEQ ID NO: 515182 - RNA, 21 nt, Human
ugcaauggcuggggcuggggc

SEQ ID NO: 515183 - RNA, 32 nt, Human
ugcaauggcuuacgccuguaaucccagcacuu

SEQ ID NO: 515184 - RNA, 32 nt, Human
ugcaaugggaucgccuggaaagccuggagucc

SEQ ID NO: 515185 - RNA, 32 nt, Human
ugcaaugggugaucucagcucacugcaggcuc

SEQ ID NO: 515186 - RNA, 31 nt, Human
ugcaaugguacaaucucggcucacugcaacc

SEQ ID NO: 515187 - RNA, 31 nt, Human
ugcaauggugcaaucucagcucacugcaacc

SEQ ID NO: 515188 - RNA, 31 nt, Human
ugcaauggugcaaucucagcucacugcaacg

SEQ ID NO: 515189 - RNA, 31 nt, Human
ugcaauggugcaaucucagcucacugcaacu

SEQ ID NO: 515190 - RNA, 31 nt, Human
ugcaauggugcaaucucaguucacugcaguc

SEQ ID NO: 515191 - RNA, 31 nt, Human
ugcaauggugcgaucucagcucacugcaagc

SEQ ID NO: 515192 - RNA, 31 nt, Human
ugcaauggugugaucucagcucacugcaccc

SEQ ID NO: 515193 - RNA, 32 nt, Human
ugcaauguccagcagucugauaaacugacgau

SEQ ID NO: 515194 - RNA, 32 nt, Human
ugcaauguccagcagucugauaaacugaugau

SEQ ID NO: 515195 - RNA, 32 nt, Human
ugcaauguccucaaguccuuucccguccuccu

SEQ ID NO: 515196 - RNA, 18 nt, Human
ugcaaugugcaauccccc

SEQ ID NO: 515197 - RNA, 32 nt, Human
ugcaaugugucuggaggguggggagaggaauu

SEQ ID NO: 515198 - RNA, 19 nt, Human
ugcaauguucaauaccuca

SEQ ID NO: 515199 - RNA, 32 nt, Human
ugcaauguucaaugccacgugcugcugacacc

SEQ ID NO: 515200 - RNA, 32 nt, Human
ugcaauguucucagagugacuuucgaaauaaa

SEQ ID NO: 515201 - RNA, 17 nt, Human
ugcaauguugcucucca

SEQ ID NO: 515202 - RNA, 32 nt, Human
ugcaauuaagggcagaucugggccaguggaau

SEQ ID NO: 515203 - RNA, 32 nt, Human
ugcaauuacugcuguucuagcccccaaagagu

SEQ ID NO: 515204 - RNA, 32 nt, Human
ugcaauuauguguaucauaacaugcucauuua

SEQ ID NO: 515205 - RNA, 32 nt, Human
ugcaauucaaaacuaccgugagacaucacuuc

SEQ ID NO: 515206 - RNA, 32 nt, Human
ugcaauucagaauaugcucagggaaugccagc

SEQ ID NO: 515207 - RNA, 32 nt, Human
ugcaauucagcuuuguuuaaagugauuugaaa

SEQ ID NO: 515208 - RNA, 32 nt, Human
ugcaauuccugcaggccaggggagagaccagg

SEQ ID NO: 515209 - RNA, 32 nt, Human
ugcaauuccuuugggggaugcagauuguaggg

SEQ ID NO: 515210 - RNA, 32 nt, Human
ugcaauugaggagauaugccagaugcuuaaac

SEQ ID NO: 515211 - RNA, 32 nt, Human
ugcaauugauuucuuuucuuccuggcuuuuua

SEQ ID NO: 515212 - RNA, 31 nt, Human
ugcaauugcacaaucucggcucauugcaagc

SEQ ID NO: 515213 - RNA, 32 nt, Human
ugcaauugcacuccagccugggcaacaagaac

SEQ ID NO: 515214 - RNA, 32 nt, Human
ugcaauuggugaaucaugcagcuuuggggaca

SEQ ID NO: 515215 - RNA, 31 nt, Human
ugcaauugugcaaucucagcucacugcaacc

SEQ ID NO: 515216 - RNA, 32 nt, Human
ugcaauuuuuguucagucauugcacaagugcu

SEQ ID NO: 515217 - RNA, 32 nt, Human
ugcacaaaacaugcuuccuuuucaaagaauag

SEQ ID NO: 515218 - RNA, 32 nt, Human
ugcacaaaauuucauuuuuaauaaaaguggua

SEQ ID NO: 515219 - RNA, 32 nt, Human
ugcacaaacaccccaccuuccacucggcucac

SEQ ID NO: 515220 - RNA, 32 nt, Human
ugcacaaacuaaaugcagugguagguggguuu

SEQ ID NO: 515221 - RNA, 32 nt, Human
ugcacaaaggguggggagucaggagaccaucc

SEQ ID NO: 515222 - RNA, 32 nt, Human
ugcacaacacagugagaccucguuucuacaaa

SEQ ID NO: 515223 - RNA, 20 nt, Human
ugcacaacagcucggccgcc

SEQ ID NO: 515224 - RNA, 20 nt, Human
ugcacaacagcuguguggcc

SEQ ID NO: 515225 - RNA, 21 nt, Human
ugcacaacggugaggccgacc

SEQ ID NO: 515226 - RNA, 32 nt, Human
ugcacaacucaagcucuguggccuguggaggu

SEQ ID NO: 515227 - RNA, 22 nt, Human
ugcacaacuugcacaaacggua

SEQ ID NO: 515228 - RNA, 22 nt, Human
ugcacaacuugcacaaauggua

SEQ ID NO: 515229 - RNA, 32 nt, Human
ugcacaagcccucauuuugccugcugccaucu

SEQ ID NO: 515230 - RNA, 32 nt, Human
ugcacaagcggcuccugaccuggucauuuugg

SEQ ID NO: 515231 - RNA, 32 nt, Human
ugcacaaggauagagagaaacuaugugacuca

SEQ ID NO: 515232 - RNA, 32 nt, Human
ugcacaagguauagacaaggcugagcaggguu

SEQ ID NO: 515233 - RNA, 32 nt, Human
ugcacaaggucaagacugaacuguggggcucu

SEQ ID NO: 515234 - RNA, 32 nt, Human
ugcacaaggucuuguauacaaauguucauagc

SEQ ID NO: 515235 - RNA, 25 nt, Human
ugcacaaguaacacauuuggccaca

SEQ ID NO: 515236 - RNA, 32 nt, Human
ugcacaaguuagcucuguagaaguaagaacuu

SEQ ID NO: 515237 - RNA, 32 nt, Human
ugcacaaguugacugagcuaaucuugagaaua

SEQ ID NO: 515238 - RNA, 32 nt, Human
ugcacaaugccacccauccacuccuugccaag

SEQ ID NO: 515239 - RNA, 32 nt, Human
ugcacaauugcacuccagccuggcgacagagc

SEQ ID NO: 515240 - RNA, 32 nt, Human
ugcacaauuuucuaaguuugggaagcagcaua

SEQ ID NO: 515241 - RNA, 32 nt, Human
ugcacacacaaaccuccaggcuaucacuucag

SEQ ID NO: 515242 - RNA, 32 nt, Human
ugcacacacacagaaccccaaaccacuaaaaa

SEQ ID NO: 515243 - RNA, 32 nt, Human
ugcacacacacaugcacacauauaugcacagg

SEQ ID NO: 515244 - RNA, 32 nt, Human
ugcacacacacccucucuggggcacagccugc

SEQ ID NO: 515245 - RNA, 32 nt, Human
ugcacacacacgaauacaaagagccauacgac

SEQ ID NO: 515246 - RNA, 32 nt, Human
ugcacacacauauacacacaugugccacaaac

SEQ ID NO: 515247 - RNA, 32 nt, Human
ugcacacacaugcacacacacauuucagggac

SEQ ID NO: 515248 - RNA, 32 nt, Human
ugcacacacaugcacacauacacgcacaugca

SEQ ID NO: 515249 - RNA, 32 nt, Human
ugcacacacaugcaugcacacacaugcacaca

SEQ ID NO: 515250 - RNA, 32 nt, Human
ugcacacacaugcccacauacucaugcacuca

SEQ ID NO: 515251 - RNA, 32 nt, Human
ugcacacaccugcacacaccugcacacucgcu

SEQ ID NO: 515252 - RNA, 23 nt, Human
ugcacacaccugucuuccccuca

SEQ ID NO: 515253 - RNA, 20 nt, Human
ugcacacacgccaacaggca

SEQ ID NO: 515254 - RNA, 32 nt, Human
ugcacacacgccaacaggcaucugccaugcug

SEQ ID NO: 515255 - RNA, 32 nt, Human
ugcacacacuccucacacugcucaggcuccaa

SEQ ID NO: 515256 - RNA, 32 nt, Human
ugcacacagcacaauucagaaauacccaggag

SEQ ID NO: 515257 - RNA, 22 nt, Human
ugcacacagcacccacaaccag

SEQ ID NO: 515258 - RNA, 22 nt, Human
ugcacacagcaggugcucagca

SEQ ID NO: 515259 - RNA, 23 nt, Human
ugcacacaggacaccagucuuca

SEQ ID NO: 515260 - RNA, 32 nt, Human
ugcacacaggaucacucacauauguacaugua

SEQ ID NO: 515261 - RNA, 20 nt, Human
ugcacacaggcaaacaggca

SEQ ID NO: 515262 - RNA, 32 nt, Human
ugcacacaggguagaucucugaacacagguga

SEQ ID NO: 515263 - RNA, 32 nt, Human
ugcacacauacacaggcauacaugcaugcaca

SEQ ID NO: 515264 - RNA, 32 nt, Human
ugcacacaucacccgugacauggucuugccaa

SEQ ID NO: 515265 - RNA, 32 nt, Human
ugcacacaugggcacacacaaucuccaccauc

SEQ ID NO: 515266 - RNA, 32 nt, Human
ugcacaccaacuccaggaaacucauucugggc

SEQ ID NO: 515267 - RNA, 32 nt, Human
ugcacaccagccagggcguucgggaggagcag

SEQ ID NO: 515268 - RNA, 32 nt, Human
ugcacaccagccugggugacagugugagaccc

SEQ ID NO: 515269 - RNA, 32 nt, Human
ugcacacccaccagaagagcacaaagcaaggc

SEQ ID NO: 515270 - RNA, 32 nt, Human
ugcacacccaugcacacucaugcacacagaua

SEQ ID NO: 515271 - RNA, 32 nt, Human
ugcacaccccugcacacaccugcacaccgucc

SEQ ID NO: 515272 - RNA, 32 nt, Human
ugcacacccguggaauuccucccuuccccagu

SEQ ID NO: 515273 - RNA, 32 nt, Human
ugcacacccucucacguccuccagaggcugaa

SEQ ID NO: 515274 - RNA, 32 nt, Human
ugcacaccggucuccagguuguuuucacccuc

SEQ ID NO: 515275 - RNA, 32 nt, Human
ugcacaccugagccugucuguggugaccauuc

SEQ ID NO: 515276 - RNA, 32 nt, Human
ugcacaccugcucucuccucucucccaggcag

SEQ ID NO: 515277 - RNA, 32 nt, Human
ugcacaccuguaaucccagcuacucuggaggc

SEQ ID NO: 515278 - RNA, 32 nt, Human
ugcacaccuguaaucccagcuacuugggagac

SEQ ID NO: 515279 - RNA, 32 nt, Human
ugcacaccuguaaucccagcuacuugggaggc

SEQ ID NO: 515280 - RNA, 32 nt, Human
ugcacaccuguaaucccagcuauucggcugag

SEQ ID NO: 515281 - RNA, 32 nt, Human
ugcacaccuguuuucucauuugcccuuugagc

SEQ ID NO: 515282 - RNA, 32 nt, Human
ugcacaccuugccaaaugcauaugucuguuga

SEQ ID NO: 515283 - RNA, 32 nt, Human
ugcacacgcaugcacacacacauucaguauuu

SEQ ID NO: 515284 - RNA, 32 nt, Human
ugcacacgcaugcacacacgcacacaugcaca

SEQ ID NO: 515285 - RNA, 32 nt, Human
ugcacacgcaugcacacaugugauguguacau

SEQ ID NO: 515286 - RNA, 32 nt, Human
ugcacacgccuguaaucccagcuacucaggag

SEQ ID NO: 515287 - RNA, 32 nt, Human
ugcacacgccuguaaucccagcugcuugggag

SEQ ID NO: 515288 - RNA, 32 nt, Human
ugcacacgugacucauaacacacacauagacc

SEQ ID NO: 515289 - RNA, 32 nt, Human
ugcacacucaucagaagaaucugaagaaacaa

SEQ ID NO: 515290 - RNA, 32 nt, Human
ugcacacuccucgcacuuccagccuuggagcc

SEQ ID NO: 515291 - RNA, 32 nt, Human
ugcacacucgggaccucagcuccaaggcguga

SEQ ID NO: 515292 - RNA, 21 nt, Human
ugcacacucgugaacaaacug

SEQ ID NO: 515293 - RNA, 32 nt, Human
ugcacacugcacuccagccugggugacuagca

SEQ ID NO: 515294 - RNA, 32 nt, Human
ugcacacugcacuccauccugggcgacagucu

SEQ ID NO: 515295 - RNA, 32 nt, Human
ugcacacuuguaaucacagcacuuugggaggc

SEQ ID NO: 515296 - RNA, 19 nt, Human
ugcacagaagucagccgca

SEQ ID NO: 515297 - RNA, 32 nt, Human
ugcacagaagugcacacaccucauugccagca

SEQ ID NO: 515298 - RNA, 32 nt, Human
ugcacagacacacggguggacaggaggcagag

SEQ ID NO: 515299 - RNA, 32 nt, Human
ugcacagacaccuugugagugauugguauugg

SEQ ID NO: 515300 - RNA, 32 nt, Human
ugcacagacgugaucuaugauccucacgagcc

SEQ ID NO: 515301 - RNA, 32 nt, Human
ugcacagacugucagcaugaugucagaggcca

SEQ ID NO: 515302 - RNA, 32 nt, Human
ugcacagagacacacccacacuagcccagugg

SEQ ID NO: 515303 - RNA, 32 nt, Human
ugcacagagcacacugcacacaugcacacaca

SEQ ID NO: 515304 - RNA, 32 nt, Human
ugcacagagccggaugugccacugugacuacc

SEQ ID NO: 515305 - RNA, 32 nt, Human
ugcacagagcggguagggcuguagggaaagcg

SEQ ID NO: 515306 - RNA, 32 nt, Human
ugcacagagcucuccagcuccaagaccuguug

SEQ ID NO: 515307 - RNA, 32 nt, Human
ugcacagaggagagaagcucugugaauguaag

SEQ ID NO: 515308 - RNA, 32 nt, Human
ugcacagaggggcauugaaaggagccaggauu

SEQ ID NO: 515309 - RNA, 32 nt, Human
ugcacagaguagauuuacaaugcuccaauucc

SEQ ID NO: 515310 - RNA, 32 nt, Human
ugcacagaguaggccugcuucuucccaugaaa

SEQ ID NO: 515311 - RNA, 32 nt, Human
ugcacagauauuuccauuucuuccucacuaug

SEQ ID NO: 515312 - RNA, 20 nt, Human
ugcacagauccugggccaag

SEQ ID NO: 515313 - RNA, 32 nt, Human
ugcacagaucgauaccuuuccccaaauagccu

SEQ ID NO: 515314 - RNA, 32 nt, Human
ugcacagaugaagaaugagccuaguagaauau

SEQ ID NO: 515315 - RNA, 32 nt, Human
ugcacagaugccuauacauacauauacaaaua

SEQ ID NO: 515316 - RNA, 32 nt, Human
ugcacagcaaaagaaacuaucaacugaguaaa

SEQ ID NO: 515317 - RNA, 19 nt, Human
ugcacagcaacccagccuu

SEQ ID NO: 515318 - RNA, 32 nt, Human
ugcacagcacacugacugagcaagaacaaaga

SEQ ID NO: 515319 - RNA, 28 nt, Human
ugcacagcacuguuccucuuguguucuu

SEQ ID NO: 515320 - RNA, 32 nt, Human
ugcacagcagaggcgaugagcgcuuacucuuu

SEQ ID NO: 515321 - RNA, 32 nt, Human
ugcacagcauccuccucuggucccagggaggc

SEQ ID NO: 515322 - RNA, 23 nt, Human
ugcacagccaugccugccucuga

SEQ ID NO: 515323 - RNA, 22 nt, Human
ugcacagccggauggccugugg

SEQ ID NO: 515324 - RNA, 20 nt, Human
ugcacagccuuaugauccca

SEQ ID NO: 515325 - RNA, 32 nt, Human
ugcacagcucuuccgccucuucucgaagcaga

SEQ ID NO: 515326 - RNA, 32 nt, Human
ugcacagcugcacuccagccugugcugagacc

SEQ ID NO: 515327 - RNA, 32 nt, Human
ugcacagcugccaggagugcucugccuggagu

SEQ ID NO: 515328 - RNA, 32 nt, Human
ugcacagcuggaugguggaagcaguucacuua

SEQ ID NO: 515329 - RNA, 22 nt, Human
ugcacagcuuccuucccuccuu

SEQ ID NO: 515330 - RNA, 32 nt, Human
ugcacagcuuggagaugggcuggugagaagaa

SEQ ID NO: 515331 - RNA, 24 nt, Human
ugcacagcuuucugagaaguucuu

SEQ ID NO: 515332 - RNA, 32 nt, Human
ugcacaggagcagcauuauccccaaagauauu

SEQ ID NO: 515333 - RNA, 32 nt, Human
ugcacaggagccaaaugaccgagcccuggaga

SEQ ID NO: 515334 - RNA, 32 nt, Human
ugcacaggagcuugguagacugcgggggaaag

SEQ ID NO: 515335 - RNA, 32 nt, Human
ugcacaggcacacacauguaugcacacacaca

SEQ ID NO: 515336 - RNA, 32 nt, Human
ugcacaggcacacgaugcucugggacauaacu

SEQ ID NO: 515337 - RNA, 32 nt, Human
ugcacaggccaucgagccaguaaaaugaacuu

SEQ ID NO: 515338 - RNA, 32 nt, Human
ugcacaggcccagccucugccucacagcagac

SEQ ID NO: 515339 - RNA, 32 nt, Human
ugcacaggcccagccucugccucacagcggac

SEQ ID NO: 515340 - RNA, 32 nt, Human
ugcacaggccccaggugcaggccaccaccucc

SEQ ID NO: 515341 - RNA, 32 nt, Human
ugcacaggcguccuguccacacccagcucagc

SEQ ID NO: 515342 - RNA, 32 nt, Human
ugcacagggaagggaaagacugggcuuuggac

SEQ ID NO: 515343 - RNA, 32 nt, Human
ugcacagggacccccaagcauccccagcaccc

SEQ ID NO: 515344 - RNA, 32 nt, Human
ugcacagggaggagaggugagaucagauucca

SEQ ID NO: 515345 - RNA, 32 nt, Human
ugcacaggggagaagagggguggcgcagaagg

SEQ ID NO: 515346 - RNA, 32 nt, Human
ugcacaggggcagcagauacacacaacaauga

SEQ ID NO: 515347 - RNA, 32 nt, Human
ugcacagggguccucugagaccaccuggcgug

SEQ ID NO: 515348 - RNA, 24 nt, Human
ugcacagggugccacggggccaag

SEQ ID NO: 515349 - RNA, 19 nt, Human
ugcacaggugcuggacaag

SEQ ID NO: 515350 - RNA, 32 nt, Human
ugcacaguacccagagggugaaggacagaagg

SEQ ID NO: 515351 - RNA, 32 nt, Human
ugcacagucccacuaaccuugugaaagaagaa

SEQ ID NO: 515352 - RNA, 32 nt, Human
ugcacagucuagcugcuucuagucagcaaucu

SEQ ID NO: 515353 - RNA, 32 nt, Human
ugcacagugacugggccuugacucccagccuc

SEQ ID NO: 515354 - RNA, 32 nt, Human
ugcacaguggcucugaccuggcagcccaccuc

SEQ ID NO: 515355 - RNA, 32 nt, Human
ugcacaguggucauucuuuggccucuccuugg

SEQ ID NO: 515356 - RNA, 32 nt, Human
ugcacaguucucucuucuccuuguccuaguca

SEQ ID NO: 515357 - RNA, 32 nt, Human
ugcacaguuuggaagccuccugucuuuauuua

SEQ ID NO: 515358 - RNA, 32 nt, Human
ugcacauacccagaaaccuauuuucucagacc

SEQ ID NO: 515359 - RNA, 20 nt, Human
ugcacauaccuucauggugu

SEQ ID NO: 515360 - RNA, 24 nt, Human
ugcacauaccuucuccaucguguc

SEQ ID NO: 515361 - RNA, 32 nt, Human
ugcacauaggcggccagcuccccagcccggcu

SEQ ID NO: 515362 - RNA, 32 nt, Human
ugcacauauagacacacauaugccaauaucuu

SEQ ID NO: 515363 - RNA, 32 nt, Human
ugcacauauauguguguauauguauguauaua

SEQ ID NO: 515364 - RNA, 32 nt, Human
ugcacaucaagcagaaaaucaaggacuaucua

SEQ ID NO: 515365 - RNA, 32 nt, Human
ugcacaucauggcagucauccugggcaucuuu

SEQ ID NO: 515366 - RNA, 32 nt, Human
ugcacauccucccaaggagacacccagacccu

SEQ ID NO: 515367 - RNA, 32 nt, Human
ugcacaucgcgcccucgggcccugccaugucc

SEQ ID NO: 515368 - RNA, 32 nt, Human
ugcacaucucauggcagcuaagccacauggcu

SEQ ID NO: 515369 - RNA, 32 nt, Human
ugcacaucuguaaucccaguuacuugggaggc

SEQ ID NO: 515370 - RNA, 32 nt, Human
ugcacaucuguuguuucccuugcagggcagug

SEQ ID NO: 515371 - RNA, 32 nt, Human
ugcacaucuuucuuggacuugggauauacagu

SEQ ID NO: 515372 - RNA, 21 nt, Human
ugcacaugacagggcugagcc

SEQ ID NO: 515373 - RNA, 32 nt, Human
ugcacaugaccuuccauccuuaccuguauucc

SEQ ID NO: 515374 - RNA, 32 nt, Human
ugcacaugacucucccccauuucccaggucuc

SEQ ID NO: 515375 - RNA, 32 nt, Human
ugcacaugcccuuuccaaggcucaccaggcug

SEQ ID NO: 515376 - RNA, 32 nt, Human
ugcacaugccuccagccccaccuuccaacccc

SEQ ID NO: 515377 - RNA, 18 nt, Human
ugcacaugcggcugcucc

SEQ ID NO: 515378 - RNA, 32 nt, Human
ugcacauggaugcacacacgugcacaccuaca

SEQ ID NO: 515379 - RNA, 32 nt, Human
ugcacauggcccuccuccccacccucaugacu

SEQ ID NO: 515380 - RNA, 32 nt, Human
ugcacaugggugagcuccgugaguccagacau

SEQ ID NO: 515381 - RNA, 32 nt, Human
ugcacauggugacuuccuuccagagagcacag

SEQ ID NO: 515382 - RNA, 32 nt, Human
ugcacaugguugugcugucgaggaccuggugc

SEQ ID NO: 515383 - RNA, 32 nt, Human
ugcacaugucccaucacaccugagaugucaga

SEQ ID NO: 515384 - RNA, 32 nt, Human
ugcacaugucucucccugcucuuccaggguga

SEQ ID NO: 515385 - RNA, 32 nt, Human
ugcacaugugagccaccgcgccuguccuugau

SEQ ID NO: 515386 - RNA, 32 nt, Human
ugcacauguguauggaugcauaugugagcugu

SEQ ID NO: 515387 - RNA, 32 nt, Human
ugcacauguguguacacaacuguauaugcagc

SEQ ID NO: 515388 - RNA, 32 nt, Human
ugcacauuacguuggugcaaaaguaauugcag

SEQ ID NO: 515389 - RNA, 22 nt, Human
ugcacauuccacccuugccaga

SEQ ID NO: 515390 - RNA, 32 nt, Human
ugcacauuccacccuugccagagccacugcag

SEQ ID NO: 515391 - RNA, 32 nt, Human
ugcacauucccuggccguuucuccccagagcu

SEQ ID NO: 515392 - RNA, 21 nt, Human
ugcacauucuccuaguccuca

SEQ ID NO: 515393 - RNA, 32 nt, Human
ugcacauugaauaccaacaagguugcaacguu

SEQ ID NO: 515394 - RNA, 32 nt, Human
ugcacauugagaacaaaggagggaccugaggu

SEQ ID NO: 515395 - RNA, 32 nt, Human
ugcacauuuaaaacacagauaugaugguccuu

SEQ ID NO: 515396 - RNA, 18 nt, Human
ugcacauuuuucugcucu

SEQ ID NO: 515397 - RNA, 32 nt, Human
ugcaccaaaucaggaagcuccuagucugugcc

SEQ ID NO: 515398 - RNA, 32 nt, Human
ugcaccacagcacucaagccugggugacagag

SEQ ID NO: 515399 - RNA, 32 nt, Human
ugcaccacagcacuccaaccugggugacagag

SEQ ID NO: 515400 - RNA, 32 nt, Human
ugcaccacagcacugcagccuagacaacagag

SEQ ID NO: 515401 - RNA, 32 nt, Human
ugcaccacagcggacacaacaaaaagauggua

SEQ ID NO: 515402 - RNA, 24 nt, Human
ugcaccaccacaccuggcucgagg

SEQ ID NO: 515403 - RNA, 32 nt, Human
ugcaccaccacacuccagccugcgcgacagau

SEQ ID NO: 515404 - RNA, 32 nt, Human
ugcaccaccacacuccagccugggugacaaga

SEQ ID NO: 515405 - RNA, 32 nt, Human
ugcaccaccacacuccagccugggugacagag

SEQ ID NO: 515406 - RNA, 32 nt, Human
ugcaccaccauggcuggcuaauuuuuguauuu

SEQ ID NO: 515407 - RNA, 32 nt, Human
ugcaccacccaccuccagagugcagugcuggg

SEQ ID NO: 515408 - RNA, 32 nt, Human
ugcaccaccgcacuccagccugggugacagag

SEQ ID NO: 515409 - RNA, 32 nt, Human
ugcaccacggcacgcuagccugggugacacag

SEQ ID NO: 515410 - RNA, 32 nt, Human
ugcaccacggcacucaagccugggcaauguag

SEQ ID NO: 515411 - RNA, 32 nt, Human
ugcaccacggcacuccagccugggugacagag

SEQ ID NO: 515412 - RNA, 32 nt, Human
ugcaccacuacacuccagccuggaugacagag

SEQ ID NO: 515413 - RNA, 32 nt, Human
ugcaccacuacacuccagccugggcaacagag

SEQ ID NO: 515414 - RNA, 32 nt, Human
ugcaccacuacacuccagccugggugacaaag

SEQ ID NO: 515415 - RNA, 32 nt, Human
ugcaccacuacacuguagccugggugacaaag

SEQ ID NO: 515416 - RNA, 32 nt, Human
ugcaccacuacucccaagccuagggaugaaga

SEQ ID NO: 515417 - RNA, 32 nt, Human
ugcaccacugaacuccagccugggccacauag

SEQ ID NO: 515418 - RNA, 32 nt, Human
ugcaccacugaguccagccuauauucuuguuu

SEQ ID NO: 515419 - RNA, 32 nt, Human
ugcaccacugcacagucugggcgacagagcaa

SEQ ID NO: 515420 - RNA, 32 nt, Human
ugcaccacugcaccccagccugggcgacggag

SEQ ID NO: 515421 - RNA, 32 nt, Human
ugcaccacugcacgccagccugggugaaagag

SEQ ID NO: 515422 - RNA, 32 nt, Human
ugcaccacugcacuacagcuugggugacagcg

SEQ ID NO: 515423 - RNA, 32 nt, Human
ugcaccacugcacucaagccugggcaacagag

SEQ ID NO: 515424 - RNA, 32 nt, Human
ugcaccacugcacuccaaccugggcaacagag

SEQ ID NO: 515425 - RNA, 32 nt, Human
ugcaccacugcacuccaaccugggugacaaga

SEQ ID NO: 515426 - RNA, 32 nt, Human
ugcaccacugcacuccaaccugggugacagag

SEQ ID NO: 515427 - RNA, 32 nt, Human
ugcaccacugcacuccacagagugagacucca

SEQ ID NO: 515428 - RNA, 32 nt, Human
ugcaccacugcacuccacccugggcagaggug

SEQ ID NO: 515429 - RNA, 32 nt, Human
ugcaccacugcacuccagcaugggcaacacag

SEQ ID NO: 515430 - RNA, 32 nt, Human
ugcaccacugcacuccagcccaggcaacagag

SEQ ID NO: 515431 - RNA, 32 nt, Human
ugcaccacugcacuccagccggggugacagag

SEQ ID NO: 515432 - RNA, 32 nt, Human
ugcaccacugcacuccagccuaggcgacagag

SEQ ID NO: 515433 - RNA, 32 nt, Human
ugcaccacugcacuccagccugagugacagag

SEQ ID NO: 515434 - RNA, 32 nt, Human
ugcaccacugcacuccagccugagugaggaag

SEQ ID NO: 515435 - RNA, 32 nt, Human
ugcaccacugcacuccagccuggaaaacggag

SEQ ID NO: 515436 - RNA, 32 nt, Human
ugcaccacugcacuccagccuggcgacaaagu

SEQ ID NO: 515437 - RNA, 32 nt, Human
ugcaccacugcacuccagccugggaaacagag

SEQ ID NO: 515438 - RNA, 32 nt, Human
ugcaccacugcacuccagccugggagacagag

SEQ ID NO: 515439 - RNA, 32 nt, Human
ugcaccacugcacuccagccugggcaacaaag

SEQ ID NO: 515440 - RNA, 32 nt, Human
ugcaccacugcacuccagccugggcaacaaga

SEQ ID NO: 515441 - RNA, 32 nt, Human
ugcaccacugcacuccagccugggcaacagag

SEQ ID NO: 515442 - RNA, 32 nt, Human
ugcaccacugcacuccagccugggcaauagag

SEQ ID NO: 515443 - RNA, 32 nt, Human
ugcaccacugcacuccagccugggcgacagag

SEQ ID NO: 515444 - RNA, 32 nt, Human
ugcaccacugcacuccagccugggcgacugug

SEQ ID NO: 515445 - RNA, 32 nt, Human
ugcaccacugcacuccagccugggcggcagag

SEQ ID NO: 515446 - RNA, 32 nt, Human
ugcaccacugcacuccagccugggcuacagau

SEQ ID NO: 515447 - RNA, 32 nt, Human
ugcaccacugcacuccagccuggggacagagc

SEQ ID NO: 515448 - RNA, 32 nt, Human
ugcaccacugcacuccagccuggguaacaaga

SEQ ID NO: 515449 - RNA, 32 nt, Human
ugcaccacugcacuccagccugggugacagag

SEQ ID NO: 515450 - RNA, 32 nt, Human
ugcaccacugcacuccagccugggugauagag

SEQ ID NO: 515451 - RNA, 32 nt, Human
ugcaccacugcacuccagccuggguggcagag

SEQ ID NO: 515452 - RNA, 32 nt, Human
ugcaccacugcacuccagccugggugucagag

SEQ ID NO: 515453 - RNA, 32 nt, Human
ugcaccacugcacuccagccuggugacagagc

SEQ ID NO: 515454 - RNA, 32 nt, Human
ugcaccacugcacuccagccuggugacagggc

SEQ ID NO: 515455 - RNA, 31 nt, Human
ugcaccacugcacuccagcgagacucugucu

SEQ ID NO: 515456 - RNA, 32 nt, Human
ugcaccacugcacuccaggcuggguaacagaa

SEQ ID NO: 515457 - RNA, 32 nt, Human
ugcaccacugcacuccagucugggcaacagag

SEQ ID NO: 515458 - RNA, 32 nt, Human
ugcaccacugcacuccagucugggugagagug

SEQ ID NO: 515459 - RNA, 32 nt, Human
ugcaccacugcacuccagucugguugagagag

SEQ ID NO: 515460 - RNA, 32 nt, Human
ugcaccacugcacuccauccugggcaacagag

SEQ ID NO: 515461 - RNA, 32 nt, Human
ugcaccacugcacucccuuccaggugaaagaa

SEQ ID NO: 515462 - RNA, 32 nt, Human
ugcaccacugcacucuaacuugggcaacaaag

SEQ ID NO: 515463 - RNA, 32 nt, Human
ugcaccacugcacucuacucugggugacagaa

SEQ ID NO: 515464 - RNA, 32 nt, Human
ugcaccacugcacucuagccugcgugacacaa

SEQ ID NO: 515465 - RNA, 32 nt, Human
ugcaccacugcacucuagccuggggaacagag

SEQ ID NO: 515466 - RNA, 32 nt, Human
ugcaccacugcacucuagccuggguaacaagc

SEQ ID NO: 515467 - RNA, 32 nt, Human
ugcaccacugcacugcagccugggaaacagag

SEQ ID NO: 515468 - RNA, 32 nt, Human
ugcaccacugcacuucagccugggugacagag

SEQ ID NO: 515469 - RNA, 32 nt, Human
ugcaccacugcacuucagccuggugacagagc

SEQ ID NO: 515470 - RNA, 32 nt, Human
ugcaccacugcacuucagcuugggcaacagag

SEQ ID NO: 515471 - RNA, 32 nt, Human
ugcaccacugcacuuuagucugggugacagag

SEQ ID NO: 515472 - RNA, 32 nt, Human
ugcaccacugcaguccagccuaggcaacagug

SEQ ID NO: 515473 - RNA, 32 nt, Human
ugcaccacugcaguucagccuggaugaugaga

SEQ ID NO: 515474 - RNA, 32 nt, Human
ugcaccacugcauuccaaccugggcggcagag

SEQ ID NO: 515475 - RNA, 32 nt, Human
ugcaccacugcauuccagccuggaugacagag

SEQ ID NO: 515476 - RNA, 32 nt, Human
ugcaccacugcauuccagccuggcgacagagu

SEQ ID NO: 515477 - RNA, 32 nt, Human
ugcaccacugcucuccaagcugggcaauggag

SEQ ID NO: 515478 - RNA, 32 nt, Human
ugcaccacugcucuccagccuggggaacagag

SEQ ID NO: 515479 - RNA, 32 nt, Human
ugcaccacuggacgccagccuaggcaacacua

SEQ ID NO: 515480 - RNA, 32 nt, Human
ugcaccacuguacuccaaccugggcgacagag

SEQ ID NO: 515481 - RNA, 32 nt, Human
ugcaccacuguacuccagcacucuagccuggg

SEQ ID NO: 515482 - RNA, 32 nt, Human
ugcaccacuguacuccagccugggcaacagag

SEQ ID NO: 515483 - RNA, 32 nt, Human
ugcaccacuguacuccagccugggcgauacaa

SEQ ID NO: 515484 - RNA, 32 nt, Human
ugcaccacuguacuccagccugggugacaaag

SEQ ID NO: 515485 - RNA, 32 nt, Human
ugcaccacuguacuccagccugggugacaggg

SEQ ID NO: 515486 - RNA, 32 nt, Human
ugcaccacuuacuccagccugggcaacagagc

SEQ ID NO: 515487 - RNA, 32 nt, Human
ugcaccacuucaagugaccaccaggaagugcc

SEQ ID NO: 515488 - RNA, 32 nt, Human
ugcaccacuucaagugaccaccaggaggugcu

SEQ ID NO: 515489 - RNA, 32 nt, Human
ugcaccacuucacuccagccugggugacggag

SEQ ID NO: 515490 - RNA, 32 nt, Human
ugcaccacuucaucccagccugggagacagag

SEQ ID NO: 515491 - RNA, 32 nt, Human
ugcaccacuuguaacuccagccugggcaacag

SEQ ID NO: 515492 - RNA, 32 nt, Human
ugcaccagaagagggaaaauuaaacaauuaaa

SEQ ID NO: 515493 - RNA, 32 nt, Human
ugcaccagacucagcacuagcacuccaucagc

SEQ ID NO: 515494 - RNA, 32 nt, Human
ugcaccagcacccugagauggagcugagacuu

SEQ ID NO: 515495 - RNA, 32 nt, Human
ugcaccagcccagugggacuucagagaugugg

SEQ ID NO: 515496 - RNA, 32 nt, Human
ugcaccagccucucccuccacacccgaagcag

SEQ ID NO: 515497 - RNA, 32 nt, Human
ugcaccagcgaaucugccugggcugcuccugu

SEQ ID NO: 515498 - RNA, 32 nt, Human
ugcaccaggccacugcccuguuggugaggagg

SEQ ID NO: 515499 - RNA, 32 nt, Human
ugcaccaggcccuaggaggccucugccuacuc

SEQ ID NO: 515500 - RNA, 32 nt, Human
ugcaccaggugaaaacagggccagcagacucc

SEQ ID NO: 515501 - RNA, 32 nt, Human
ugcaccagguguuuuugucaccauacagauga

SEQ ID NO: 515502 - RNA, 32 nt, Human
ugcaccagugcacuccagcugggcgacagagc

SEQ ID NO: 515503 - RNA, 32 nt, Human
ugcaccaguguauccacaguccugucucggaa

SEQ ID NO: 515504 - RNA, 32 nt, Human
ugcaccaguuuuuaccuauuaucaugguagua

SEQ ID NO: 515505 - RNA, 22 nt, Human
ugcaccauccccagggcugacc

SEQ ID NO: 515506 - RNA, 32 nt, Human
ugcaccaugagcucaguuggcugcaggagcag

SEQ ID NO: 515507 - RNA, 32 nt, Human
ugcaccaugccccauugggcucaggcgaguuc

SEQ ID NO: 515508 - RNA, 32 nt, Human
ugcaccauguuaguaauaaacagaucugccuu

SEQ ID NO: 515509 - RNA, 32 nt, Human
ugcaccauguuuugagguugagugcauguucg

SEQ ID NO: 515510 - RNA, 32 nt, Human
ugcaccauugaacuccagccugggcaacaaga

SEQ ID NO: 515511 - RNA, 32 nt, Human
ugcaccauugcacacuaaccugggugacagaa

SEQ ID NO: 515512 - RNA, 32 nt, Human
ugcaccauugcaccuccagccugggcaacaga

SEQ ID NO: 515513 - RNA, 32 nt, Human
ugcaccauugcacuccacccugggcgacagag

SEQ ID NO: 515514 - RNA, 32 nt, Human
ugcaccauugcacuccagccugcgcaacaaga

SEQ ID NO: 515515 - RNA, 32 nt, Human
ugcaccauugcacuccagccuggcgacagagc

SEQ ID NO: 515516 - RNA, 32 nt, Human
ugcaccauugcacuccagccugggcaaaaaga

SEQ ID NO: 515517 - RNA, 32 nt, Human
ugcaccauugcacuccagccugggcaacaaga

SEQ ID NO: 515518 - RNA, 32 nt, Human
ugcaccauugcacuccagccugggcaacagag

SEQ ID NO: 515519 - RNA, 32 nt, Human
ugcaccauugcacuccagccugggcaauaaga

SEQ ID NO: 515520 - RNA, 32 nt, Human
ugcaccauugcacuccagccugggcgacaaga

SEQ ID NO: 515521 - RNA, 32 nt, Human
ugcaccauugcacuccagccugggcgacagag

SEQ ID NO: 515522 - RNA, 32 nt, Human
ugcaccauugcacuccagccugggugacagag

SEQ ID NO: 515523 - RNA, 32 nt, Human
ugcaccauugcacuccagccugugcaacaaga

SEQ ID NO: 515524 - RNA, 32 nt, Human
ugcaccauugcacuccagcuugggugacagag

SEQ ID NO: 515525 - RNA, 32 nt, Human
ugcaccauugcacuccugccugggcaacaaga

SEQ ID NO: 515526 - RNA, 32 nt, Human
ugcaccauugcacucuagccuggcaacagagc

SEQ ID NO: 515527 - RNA, 32 nt, Human
ugcaccauugcauuccagccugggcaacaaga

SEQ ID NO: 515528 - RNA, 32 nt, Human
ugcaccauugcauuccagccugggugacagag

SEQ ID NO: 515529 - RNA, 32 nt, Human
ugcaccauugcccuccagccugagcaacagaa

SEQ ID NO: 515530 - RNA, 32 nt, Human
ugcaccauugcgcucuagccugggcaacaaca

SEQ ID NO: 515531 - RNA, 32 nt, Human
ugcaccauuguacuccagccugggcaacaaga

SEQ ID NO: 515532 - RNA, 32 nt, Human
ugcaccauuguacuccagccugggcaauaaga

SEQ ID NO: 515533 - RNA, 22 nt, Human
ugcaccauuuaaaaacaggcag

SEQ ID NO: 515534 - RNA, 32 nt, Human
ugcaccauuucauuccagccugggcaacauga

SEQ ID NO: 515535 - RNA, 32 nt, Human
ugcacccaaacagacacaucaacgcaccccac

SEQ ID NO: 515536 - RNA, 32 nt, Human
ugcacccaagaagaaaagcuuggaguagagca

SEQ ID NO: 515537 - RNA, 24 nt, Human
ugcacccaccgcucauucuugcuc

SEQ ID NO: 515538 - RNA, 32 nt, Human
ugcacccacugcauuugcagccuugaggucau

SEQ ID NO: 515539 - RNA, 32 nt, Human
ugcacccacugccucuucccuucucgcuuggg

SEQ ID NO: 515540 - RNA, 32 nt, Human
ugcacccacuggcugggaagaucucuuccugc

SEQ ID NO: 515541 - RNA, 22 nt, Human
ugcacccagaagcagagaaaag

SEQ ID NO: 515542 - RNA, 32 nt, Human
ugcacccagaccuggaagagcuuuaucccuuu

SEQ ID NO: 515543 - RNA, 32 nt, Human
ugcacccagagccguggccaggagaaccccuu

SEQ ID NO: 515544 - RNA, 23 nt, Human
ugcacccagaguggauauuccca

SEQ ID NO: 515545 - RNA, 32 nt, Human
ugcacccagccaagugaucauuuuuauagguu

SEQ ID NO: 515546 - RNA, 32 nt, Human
ugcacccaggagguggagguugcagugagccg

SEQ ID NO: 515547 - RNA, 32 nt, Human
ugcacccaggcaggcccaggggaggguggggc

SEQ ID NO: 515548 - RNA, 22 nt, Human
ugcacccagggcuccugacucc

SEQ ID NO: 515549 - RNA, 20 nt, Human
ugcacccaggggacaacucc

SEQ ID NO: 515550 - RNA, 20 nt, Human
ugcacccagggucccagccu

SEQ ID NO: 515551 - RNA, 32 nt, Human
ugcacccauguaggagcaugagggccacacuc

SEQ ID NO: 515552 - RNA, 32 nt, Human
ugcaccccaacauugagauguguuuuuaaugu

SEQ ID NO: 515553 - RNA, 32 nt, Human
ugcaccccaacugucuaccacccucagcuauc

SEQ ID NO: 515554 - RNA, 32 nt, Human
ugcaccccaagaagugguggggagauugcugc

SEQ ID NO: 515555 - RNA, 32 nt, Human
ugcaccccaccccacccucuggcuccccaugg

SEQ ID NO: 515556 - RNA, 32 nt, Human
ugcaccccagccccuguccugccuguaagggg

SEQ ID NO: 515557 - RNA, 32 nt, Human
ugcaccccagccuggacaacagagugagacuc

SEQ ID NO: 515558 - RNA, 32 nt, Human
ugcaccccagccugggcaacaagaguaaaacu

SEQ ID NO: 515559 - RNA, 32 nt, Human
ugcaccccagccugggcaacagaguaagauua

SEQ ID NO: 515560 - RNA, 32 nt, Human
ugcaccccagccugucacgcuaucagcaguuc

SEQ ID NO: 515561 - RNA, 31 nt, Human
ugcaccccagcgucaggccuaccucaaguuc

SEQ ID NO: 515562 - RNA, 32 nt, Human
ugcaccccaguagcacccacccucucugugcu

SEQ ID NO: 515563 - RNA, 25 nt, Human
ugcacccccaacugcaccccagcca

SEQ ID NO: 515564 - RNA, 18 nt, Human
ugcacccccaaucugccc

SEQ ID NO: 515565 - RNA, 32 nt, Human
ugcacccccucgggggccagcccccggccggu

SEQ ID NO: 515566 - RNA, 32 nt, Human
ugcacccccugccuucccauugcuggcucacu

SEQ ID NO: 515567 - RNA, 32 nt, Human
ugcacccccuuuccuccagcucuuccugagac

SEQ ID NO: 515568 - RNA, 32 nt, Human
ugcaccccuccaugggccuggccaagccccca

SEQ ID NO: 515569 - RNA, 32 nt, Human
ugcaccccucccccucucccgugcacagggaa

SEQ ID NO: 515570 - RNA, 32 nt, Human
ugcaccccugcacuccagccugggugacagag

SEQ ID NO: 515571 - RNA, 32 nt, Human
ugcaccccugcacuccaggcugggcaacagua

SEQ ID NO: 515572 - RNA, 23 nt, Human
ugcaccccuggcccucccagcca

SEQ ID NO: 515573 - RNA, 32 nt, Human
ugcacccgcaugggagggucggagggugcugc

SEQ ID NO: 515574 - RNA, 32 nt, Human
ugcacccgggcaggccucagaacggugagggg

SEQ ID NO: 515575 - RNA, 32 nt, Human
ugcacccuccacccugucccccagcucuggug

SEQ ID NO: 515576 - RNA, 32 nt, Human
ugcacccucccagggacacuggaugcgcuggg

SEQ ID NO: 515577 - RNA, 32 nt, Human
ugcacccuccgggaagccauggagucugcugg

SEQ ID NO: 515578 - RNA, 32 nt, Human
ugcacccucugugcccugugggacccgcuuca

SEQ ID NO: 515579 - RNA, 32 nt, Human
ugcacccugcacucuagccugggcaacaagag

SEQ ID NO: 515580 - RNA, 32 nt, Human
ugcacccugcagccaccagcacugccuggcuc

SEQ ID NO: 515581 - RNA, 32 nt, Human
ugcacccugccuaguggcuuucccaagagaaa

SEQ ID NO: 515582 - RNA, 32 nt, Human
ugcacccugccugggacuuggcccucuggcug

SEQ ID NO: 515583 - RNA, 32 nt, Human
ugcacccugccuggucacugcucucccagccc

SEQ ID NO: 515584 - RNA, 23 nt, Human
ugcacccugccuuuuguguuuuu

SEQ ID NO: 515585 - RNA, 32 nt, Human
ugcacccugcuuccuggcccagucccagguug

SEQ ID NO: 515586 - RNA, 32 nt, Human
ugcacccuggaagggcaggucuggcggcucca

SEQ ID NO: 515587 - RNA, 32 nt, Human
ugcacccugggaccaagaggcagcagucaucc

SEQ ID NO: 515588 - RNA, 32 nt, Human
ugcacccugggagcccuuaggucuguuuggag

SEQ ID NO: 515589 - RNA, 32 nt, Human
ugcacccugggaggggaagcugggagaaagga

SEQ ID NO: 515590 - RNA, 21 nt, Human
ugcacccuguagcuccugcuc

SEQ ID NO: 515591 - RNA, 32 nt, Human
ugcacccuucccucuucccucucccucucucu

SEQ ID NO: 515592 - RNA, 32 nt, Human
ugcaccgagggucccuugccuacccuaggcca

SEQ ID NO: 515593 - RNA, 32 nt, Human
ugcaccgccagcugccgccgacugcagcccua

SEQ ID NO: 515594 - RNA, 32 nt, Human
ugcaccgccauccccaugcugguuggugcugc

SEQ ID NO: 515595 - RNA, 32 nt, Human
ugcaccgccugccucucagcaggauggacgug

SEQ ID NO: 515596 - RNA, 32 nt, Human
ugcaccgcugcacuccagccuggcgacagagc

SEQ ID NO: 515597 - RNA, 32 nt, Human
ugcaccgcuguacuccagccugggcaacagag

SEQ ID NO: 515598 - RNA, 32 nt, Human
ugcaccggccacucuuagcccccgaggcguug

SEQ ID NO: 515599 - RNA, 32 nt, Human
ugcaccguaugauguucagcagcauccguggc

SEQ ID NO: 515600 - RNA, 32 nt, Human
ugcaccgugacacuccagccugggcaacagaa

SEQ ID NO: 515601 - RNA, 32 nt, Human
ugcaccuaaggaauacuacacagcauguaaaa

SEQ ID NO: 515602 - RNA, 19 nt, Human
ugcaccuacagauauggug

SEQ ID NO: 515603 - RNA, 18 nt, Human
ugcaccuacuuguuccca

SEQ ID NO: 515604 - RNA, 23 nt, Human
ugcaccuaggagcccaggacccc

SEQ ID NO: 515605 - RNA, 32 nt, Human
ugcaccuauagucccagcuacuugggaggcug

SEQ ID NO: 515606 - RNA, 32 nt, Human
ugcaccuauagucccagcuauucaggaggcug

SEQ ID NO: 515607 - RNA, 32 nt, Human
ugcaccuaucucagccauaggugcaguuugcu

SEQ ID NO: 515608 - RNA, 32 nt, Human
ugcaccuaucucuugcugaauugcuuuaauag

SEQ ID NO: 515609 - RNA, 32 nt, Human
ugcaccucagcagccagggaagcagggcccag

SEQ ID NO: 515610 - RNA, 32 nt, Human
ugcaccuccaccuccagccuccagucaccuca

SEQ ID NO: 515611 - RNA, 32 nt, Human
ugcaccuccaccugccccagccccugccucug

SEQ ID NO: 515612 - RNA, 23 nt, Human
ugcaccuccaccuuccgggcuca

SEQ ID NO: 515613 - RNA, 32 nt, Human
ugcaccuccagccugggcaacagagugagacu

SEQ ID NO: 515614 - RNA, 21 nt, Human
ugcaccucccagcccucggcc

SEQ ID NO: 515615 - RNA, 32 nt, Human
ugcaccucccaguuugcuggguuuauuuuaga

SEQ ID NO: 515616 - RNA, 32 nt, Human
ugcaccuccuuaggcccugccucugggcucag

SEQ ID NO: 515617 - RNA, 32 nt, Human
ugcaccuccuuucccucucuccaucuuccaau

SEQ ID NO: 515618 - RNA, 21 nt, Human
ugcaccucgcccccgcaagcc

SEQ ID NO: 515619 - RNA, 32 nt, Human
ugcaccucuaacaaugcacaccucacugcuug

SEQ ID NO: 515620 - RNA, 32 nt, Human
ugcaccucuagcugcaaacaaagcuaagacag

SEQ ID NO: 515621 - RNA, 32 nt, Human
ugcaccucucagccucugccgccgggcacccc

SEQ ID NO: 515622 - RNA, 32 nt, Human
ugcaccucuccuccccucagccaccuuuuagg

SEQ ID NO: 515623 - RNA, 24 nt, Human
ugcaccucuccuguucgguuuaga

SEQ ID NO: 515624 - RNA, 32 nt, Human
ugcaccucuuaguccagcaccaggaagagugg

SEQ ID NO: 515625 - RNA, 32 nt, Human
ugcaccugauaugaaugagaccaguuuuauuu

SEQ ID NO: 515626 - RNA, 20 nt, Human
ugcaccugcaaucccagcua

SEQ ID NO: 515627 - RNA, 32 nt, Human
ugcaccugcaaucccagcuacucgggaggcug

SEQ ID NO: 515628 - RNA, 18 nt, Human
ugcaccugcaccuguucc

SEQ ID NO: 515629 - RNA, 32 nt, Human
ugcaccugcacucuagugacccugggugccgc

SEQ ID NO: 515630 - RNA, 32 nt, Human
ugcaccugcagucucuuuccacuggcacuucc

SEQ ID NO: 515631 - RNA, 20 nt, Human
ugcaccugcauucccagcua

SEQ ID NO: 515632 - RNA, 32 nt, Human
ugcaccugcauucccagcuacuugggaggcug

SEQ ID NO: 515633 - RNA, 16 nt, Human
ugcaccugcugucuua

SEQ ID NO: 515634 - RNA, 32 nt, Human
ugcaccuggacguaauggacggacaugcacau

SEQ ID NO: 515635 - RNA, 32 nt, Human
ugcaccuggcuacuccugcuguggaccagcua

SEQ ID NO: 515636 - RNA, 32 nt, Human
ugcaccugggaggcaggcaggcaugcaugugg

SEQ ID NO: 515637 - RNA, 32 nt, Human
ugcaccugggcaacaagagugaaacuccgucu

SEQ ID NO: 515638 - RNA, 32 nt, Human
ugcaccugggccccagcaggcccagccaggcg

SEQ ID NO: 515639 - RNA, 32 nt, Human
ugcaccugggcgagaaccugacuggggcaggg

SEQ ID NO: 515640 - RNA, 32 nt, Human
ugcaccuguaaacccagcuacuugggaggcug

SEQ ID NO: 515641 - RNA, 20 nt, Human
ugcaccuguaaucccaccua

SEQ ID NO: 515642 - RNA, 20 nt, Human
ugcaccuguaaucccagcua

SEQ ID NO: 515643 - RNA, 32 nt, Human
ugcaccuguaaucccagcuacuagggaggaug

SEQ ID NO: 515644 - RNA, 32 nt, Human
ugcaccuguaaucccagcuacucgagaggcca

SEQ ID NO: 515645 - RNA, 32 nt, Human
ugcaccuguaaucccagcuacucgggaggcug

SEQ ID NO: 515646 - RNA, 32 nt, Human
ugcaccuguaaucccagcuacucuggaggcua

SEQ ID NO: 515647 - RNA, 32 nt, Human
ugcaccuguaaucccagcuacucuggaggcug

SEQ ID NO: 515648 - RNA, 32 nt, Human
ugcaccuguaaucccagcuacucuggagggug

SEQ ID NO: 515649 - RNA, 32 nt, Human
ugcaccuguaaucccagcuacuugggaggcug

SEQ ID NO: 515650 - RNA, 20 nt, Human
ugcaccuguagucccagcua

SEQ ID NO: 515651 - RNA, 32 nt, Human
ugcaccuguagucccagcuacuagggaggcug

SEQ ID NO: 515652 - RNA, 32 nt, Human
ugcaccuguagucccagcuacucaggaggcca

SEQ ID NO: 515653 - RNA, 32 nt, Human
ugcaccuguagucccagcuacucaggaggcug

SEQ ID NO: 515654 - RNA, 32 nt, Human
ugcaccuguagucccagcuacuccggaggcug

SEQ ID NO: 515655 - RNA, 32 nt, Human
ugcaccuguagucccagcuacucgggaagcug

SEQ ID NO: 515656 - RNA, 32 nt, Human
ugcaccuguagucccagcuacucgggggcuga

SEQ ID NO: 515657 - RNA, 32 nt, Human
ugcaccuguagucccagcuacucuggaggcug

SEQ ID NO: 515658 - RNA, 32 nt, Human
ugcaccuguagucccagcuacuugggaagcug

SEQ ID NO: 515659 - RNA, 32 nt, Human
ugcaccuguagucccagcuacuugggaggcug

SEQ ID NO: 515660 - RNA, 32 nt, Human
ugcaccuguagucccagcuacuuggggugcug

SEQ ID NO: 515661 - RNA, 32 nt, Human
ugcaccuguagucccagcuauaugggaugcug

SEQ ID NO: 515662 - RNA, 32 nt, Human
ugcaccuguagucccagcuauucaggaagcug

SEQ ID NO: 515663 - RNA, 32 nt, Human
ugcaccuguagucccagcuauuugggaggcug

SEQ ID NO: 515664 - RNA, 32 nt, Human
ugcaccuguagucccagcucuucaggaggcug

SEQ ID NO: 515665 - RNA, 32 nt, Human
ugcaccuguagucccagcugcuugggaggcug

SEQ ID NO: 515666 - RNA, 32 nt, Human
ugcaccuguagucccagcuguuugggaagcug

SEQ ID NO: 515667 - RNA, 32 nt, Human
ugcaccuguagucccagcuucuugggaggcug

SEQ ID NO: 515668 - RNA, 32 nt, Human
ugcaccuguagucccaguuaggaggcugaggu

SEQ ID NO: 515669 - RNA, 32 nt, Human
ugcaccuguaguuucagcuauucgggaggcug

SEQ ID NO: 515670 - RNA, 20 nt, Human
ugcaccugucaucccagcua

SEQ ID NO: 515671 - RNA, 32 nt, Human
ugcaccuguggccucucagucaaacaaguugu

SEQ ID NO: 515672 - RNA, 32 nt, Human
ugcaccuguggucccagcuacucuggaggcug

SEQ ID NO: 515673 - RNA, 32 nt, Human
ugcaccuguggucccagcuacuggggaggcug

SEQ ID NO: 515674 - RNA, 32 nt, Human
ugcaccuguguaugaaucuggaagugugugug

SEQ ID NO: 515675 - RNA, 32 nt, Human
ugcaccuuagagaacaguaggagcagcaggug

SEQ ID NO: 515676 - RNA, 32 nt, Human
ugcaccuuccuccgaccuguguagggugugga

SEQ ID NO: 515677 - RNA, 32 nt, Human
ugcaccuucucagugcuguaugcggcugcagc

SEQ ID NO: 515678 - RNA, 32 nt, Human
ugcaccuugcaggugcaguuuccuuggggacc

SEQ ID NO: 515679 - RNA, 32 nt, Human
ugcaccuugugaaggaaaaacaugcuuaaggg

SEQ ID NO: 515680 - RNA, 32 nt, Human
ugcaccuuuaagcucacuccaucccaaaccgg

SEQ ID NO: 515681 - RNA, 32 nt, Human
ugcaccuuuguacuccagccugggcaacgagc

SEQ ID NO: 515682 - RNA, 32 nt, Human
ugcacgaacacuuccuccuuccuugccaccag

SEQ ID NO: 515683 - RNA, 32 nt, Human
ugcacgacugcacuccagccugggcaauggag

SEQ ID NO: 515684 - RNA, 32 nt, Human
ugcacgaugaacacacaccgggcugguugggc

SEQ ID NO: 515685 - RNA, 32 nt, Human
ugcacgauucccucagcucuggguuuaaugua

SEQ ID NO: 515686 - RNA, 32 nt, Human
ugcacgcaagcagggacauuuccuagccagcu

SEQ ID NO: 515687 - RNA, 32 nt, Human
ugcacgcacacacacaugcacacauacacgug

SEQ ID NO: 515688 - RNA, 32 nt, Human
ugcacgcacacgugugcagacacguaguggaa

SEQ ID NO: 515689 - RNA, 32 nt, Human
ugcacgcacugaggccauuguuaaaggagcuc

SEQ ID NO: 515690 - RNA, 23 nt, Human
ugcacgcacuuuucuuguugaca

SEQ ID NO: 515691 - RNA, 32 nt, Human
ugcacgcauaugucuucaagaugaccacaauu

SEQ ID NO: 515692 - RNA, 32 nt, Human
ugcacgccaucaucgagcgcacggccagcuuc

SEQ ID NO: 515693 - RNA, 32 nt, Human
ugcacgcccaacucccuccugucuuccacagu

SEQ ID NO: 515694 - RNA, 32 nt, Human
ugcacgcccaggcugcggagcaccuggaggca

SEQ ID NO: 515695 - RNA, 32 nt, Human
  misc_feature (29)..(29): n is a, c, g or u
ugcacgccgguccacagacacacucacgnccg

SEQ ID NO: 515696 - RNA, 32 nt, Human
ugcacgccguggagcaucaggccacacacucu

SEQ ID NO: 515697 - RNA, 32 nt, Human
ugcacgccucgggacgaucugccuuccucccc

SEQ ID NO: 515698 - RNA, 32 nt, Human
ugcacgccuguaacccagcuacucaggaggcu

SEQ ID NO: 515699 - RNA, 32 nt, Human
ugcacgccuguaaucucagcuacuugggaggc

SEQ ID NO: 515700 - RNA, 32 nt, Human
ugcacgcgcagggagagauccaucucugcugu

SEQ ID NO: 515701 - RNA, 32 nt, Human
ugcacgcuguugucugugcacucgcucacacu

SEQ ID NO: 515702 - RNA, 32 nt, Human
ugcacgcuuguaaucccagcuacucaggaguc

SEQ ID NO: 515703 - RNA, 32 nt, Human
ugcacgcuuguaaucccagcuacucuggaggc

SEQ ID NO: 515704 - RNA, 32 nt, Human
ugcacggaacucuguuucuaagugccaagcac

SEQ ID NO: 515705 - RNA, 32 nt, Human
ugcacggagagcagugccaagccuguggauca

SEQ ID NO: 515706 - RNA, 32 nt, Human
ugcacggaugcugaauguuugggaaugagagg

SEQ ID NO: 515707 - RNA, 32 nt, Human
ugcacggcaagaacaccuugaaugaugugcug

SEQ ID NO: 515708 - RNA, 32 nt, Human
ugcacgggcagcucuaugcaucaggagcaaug

SEQ ID NO: 515709 - RNA, 17 nt, Human
ugcacggggcugggcca

SEQ ID NO: 515710 - RNA, 31 nt, Human
ugcacgguggagcugccucagggcugucggu

SEQ ID NO: 515711 - RNA, 32 nt, Human
ugcacgucaagggccucaggugacuuucaugc

SEQ ID NO: 515712 - RNA, 32 nt, Human
ugcacgucaggguuggcauccacccagaucca

SEQ ID NO: 515713 - RNA, 32 nt, Human
ugcacgucugccgaaaaauccgaaccuguuga

SEQ ID NO: 515714 - RNA, 32 nt, Human
ugcacgucuguaaucccagcugcucgggaggc

SEQ ID NO: 515715 - RNA, 32 nt, Human
ugcacgucuuccauacuaauguucauuucuaa

SEQ ID NO: 515716 - RNA, 32 nt, Human
ugcacguguguauccaaucugccugugacaug

SEQ ID NO: 515717 - RNA, 32 nt, Human
ugcacguuuuugucccuucaguugccuuaugu

SEQ ID NO: 515718 - RNA, 32 nt, Human
ugcacuaaaauuauaucaaggucucagaugag

SEQ ID NO: 515719 - RNA, 32 nt, Human
ugcacuaauaauacuuaccaacccacuuugug

SEQ ID NO: 515720 - RNA, 21 nt, Human
ugcacuaauacucagccuuua

SEQ ID NO: 515721 - RNA, 32 nt, Human
ugcacuacuacacuccagccuggugacagagu

SEQ ID NO: 515722 - RNA, 32 nt, Human
ugcacuacuccucugcagugccuuggggaauu

SEQ ID NO: 515723 - RNA, 32 nt, Human
ugcacuacugcacuccagacuggugacggagc

SEQ ID NO: 515724 - RNA, 32 nt, Human
ugcacuacugcacuccagccugggugacagag

SEQ ID NO: 515725 - RNA, 32 nt, Human
ugcacuacugcauuccagccugggugacauau

SEQ ID NO: 515726 - RNA, 32 nt, Human
ugcacuacugcgcuucacccugggcaacagag

SEQ ID NO: 515727 - RNA, 32 nt, Human
ugcacuacuguacuccagccagggcaagagag

SEQ ID NO: 515728 - RNA, 32 nt, Human
ugcacuagagaagguaaagagagaaucaguau

SEQ ID NO: 515729 - RNA, 32 nt, Human
ugcacuaggaagaaucaguaaucacuuuucag

SEQ ID NO: 515730 - RNA, 32 nt, Human
ugcacuagucugagguggccacugccuuugau

SEQ ID NO: 515731 - RNA, 32 nt, Human
ugcacuaucacccaggcuggagugcaguggca

SEQ ID NO: 515732 - RNA, 32 nt, Human
ugcacuaugagaagguuucccaacaagagugu

SEQ ID NO: 515733 - RNA, 32 nt, Human
ugcacuauugcacaucauauucuauuguuuac

SEQ ID NO: 515734 - RNA, 32 nt, Human
ugcacuauugcacuccagccugggcaacagga

SEQ ID NO: 515735 - RNA, 32 nt, Human
ugcacucaaugccaacuuuuuguuacagauua

SEQ ID NO: 515736 - RNA, 32 nt, Human
ugcacucacaugcacacaugcaugcacacuca

SEQ ID NO: 515737 - RNA, 32 nt, Human
ugcacucagcaaacacauuggguaucuugugc

SEQ ID NO: 515738 - RNA, 32 nt, Human
ugcacucaggcaagaacuaggcucgggguaga

SEQ ID NO: 515739 - RNA, 32 nt, Human
ugcacucaguuucccuacauagcagggauucu

SEQ ID NO: 515740 - RNA, 23 nt, Human
ugcacucaugcaagcuucugcuc

SEQ ID NO: 515741 - RNA, 32 nt, Human
ugcacuccaaccugggcaacagagccagaccc

SEQ ID NO: 515742 - RNA, 19 nt, Human
ugcacuccaaggcugcgca

SEQ ID NO: 515743 - RNA, 32 nt, Human
ugcacuccacacuccagccugagcaacaagag

SEQ ID NO: 515744 - RNA, 32 nt, Human
ugcacuccagcacuccagccugggugacagag

SEQ ID NO: 515745 - RNA, 32 nt, Human
ugcacuccagcagaggcuagaggaaugccagu

SEQ ID NO: 515746 - RNA, 32 nt, Human
ugcacuccagccagggcaacagugagacucag

SEQ ID NO: 515747 - RNA, 32 nt, Human
ugcacuccagccugaagacagagcaaggcucc

SEQ ID NO: 515748 - RNA, 32 nt, Human
ugcacuccagccugagcaacagagugagacuc

SEQ ID NO: 515749 - RNA, 32 nt, Human
ugcacuccagccugagcaacagagugaguguc

SEQ ID NO: 515750 - RNA, 32 nt, Human
ugcacuccagccugagcacagagcaagacucu

SEQ ID NO: 515751 - RNA, 32 nt, Human
ugcacuccagccugagcgacagagugagacac

SEQ ID NO: 515752 - RNA, 32 nt, Human
ugcacuccagccugagcgacagugagacucug

SEQ ID NO: 515753 - RNA, 32 nt, Human
ugcacuccagccugagugacagagugagaccc

SEQ ID NO: 515754 - RNA, 32 nt, Human
ugcacuccagccugaugacagagcaagacuca

SEQ ID NO: 515755 - RNA, 32 nt, Human
ugcacuccagccugcacaacaagagugaaacu

SEQ ID NO: 515756 - RNA, 32 nt, Human
ugcacuccagccugcgugacaaagugagaccc

SEQ ID NO: 515757 - RNA, 32 nt, Human
ugcacuccagccuggaaaacggagugagagug

SEQ ID NO: 515758 - RNA, 32 nt, Human
ugcacuccagccuggacaacaagagugaaacg

SEQ ID NO: 515759 - RNA, 32 nt, Human
ugcacuccagccuggacaacagaguaaaaccc

SEQ ID NO: 515760 - RNA, 32 nt, Human
ugcacuccagccuggacaacagagugagaacc

SEQ ID NO: 515761 - RNA, 32 nt, Human
ugcacuccagccuggacaacagagugagacuc

SEQ ID NO: 515762 - RNA, 32 nt, Human
ugcacuccagccuggacaacagagugggacuc

SEQ ID NO: 515763 - RNA, 32 nt, Human
ugcacuccagccuggacaacggagugagacuc

SEQ ID NO: 515764 - RNA, 32 nt, Human
ugcacuccagccuggacgacagagugagacgu

SEQ ID NO: 515765 - RNA, 32 nt, Human
ugcacuccagccuggacgacagagugagauuc

SEQ ID NO: 515766 - RNA, 32 nt, Human
ugcacuccagccuggaugacaagagugaaacu

SEQ ID NO: 515767 - RNA, 32 nt, Human
ugcacuccagccuggaugacagagugaaaccc

SEQ ID NO: 515768 - RNA, 32 nt, Human
ugcacuccagccuggaugacagagugagaccu

SEQ ID NO: 515769 - RNA, 32 nt, Human
ugcacuccagccuggaugacagagugagacuc

SEQ ID NO: 515770 - RNA, 32 nt, Human
ugcacuccagccuggaugauagagugagacug

SEQ ID NO: 515771 - RNA, 32 nt, Human
ugcacuccagccuggauuacagaguaaaacug

SEQ ID NO: 515772 - RNA, 32 nt, Human
ugcacuccagccuggcaacagagugagacucu

SEQ ID NO: 515773 - RNA, 32 nt, Human
ugcacuccagccuggccuauaagaguaaaaua

SEQ ID NO: 515774 - RNA, 20 nt, Human
ugcacuccagccuggccugg

SEQ ID NO: 515775 - RNA, 32 nt, Human
ugcacuccagccuggccugggcaacagagcaa

SEQ ID NO: 515776 - RNA, 32 nt, Human
ugcacuccagccuggcgacaaagugagacucc

SEQ ID NO: 515777 - RNA, 32 nt, Human
ugcacuccagccuggcgacacagugagacucu

SEQ ID NO: 515778 - RNA, 32 nt, Human
ugcacuccagccuggcgacagagugagacucc

SEQ ID NO: 515779 - RNA, 32 nt, Human
ugcacuccagccuggcgacagagugagacucu

SEQ ID NO: 515780 - RNA, 32 nt, Human
ugcacuccagccuggcuacagagugagauucc

SEQ ID NO: 515781 - RNA, 32 nt, Human
ugcacuccagccuggcugacagagugagaauc

SEQ ID NO: 515782 - RNA, 32 nt, Human
ugcacuccagccuggcugacagugagacacuc

SEQ ID NO: 515783 - RNA, 32 nt, Human
ugcacuccagccugggaaacaagagugaaauu

SEQ ID NO: 515784 - RNA, 32 nt, Human
ugcacuccagccugggaaacagagugaggcuc

SEQ ID NO: 515785 - RNA, 32 nt, Human
ugcacuccagccugggaaauagagugagcaag

SEQ ID NO: 515786 - RNA, 32 nt, Human
ugcacuccagccugggaagcagagugagaccc

SEQ ID NO: 515787 - RNA, 32 nt, Human
ugcacuccagccugggagacagagugagacuc

SEQ ID NO: 515788 - RNA, 32 nt, Human
ugcacuccagccugggagacagagugagauac

SEQ ID NO: 515789 - RNA, 18 nt, Human
ugcacuccagccugggca

SEQ ID NO: 515790 - RNA, 32 nt, Human
ugcacuccagccugggcaaaaagagugagacu

SEQ ID NO: 515791 - RNA, 32 nt, Human
ugcacuccagccugggcaacaaagugagacuc

SEQ ID NO: 515792 - RNA, 32 nt, Human
ugcacuccagccugggcaacaacagugaaacu

SEQ ID NO: 515793 - RNA, 32 nt, Human
ugcacuccagccugggcaacaagaguaaaacu

SEQ ID NO: 515794 - RNA, 32 nt, Human
ugcacuccagccugggcaacaagaguaagacu

SEQ ID NO: 515795 - RNA, 32 nt, Human
ugcacuccagccugggcaacaagagugaaacu

SEQ ID NO: 515796 - RNA, 32 nt, Human
ugcacuccagccugggcaacaagagugaaccu

SEQ ID NO: 515797 - RNA, 32 nt, Human
ugcacuccagccugggcaacaagagugagacu

SEQ ID NO: 515798 - RNA, 32 nt, Human
ugcacuccagccugggcaacacagcaagaccc

SEQ ID NO: 515799 - RNA, 32 nt, Human
ugcacuccagccugggcaacacagcaagacuc

SEQ ID NO: 515800 - RNA, 32 nt, Human
ugcacuccagccugggcaacacagcaagaucc

SEQ ID NO: 515801 - RNA, 32 nt, Human
ugcacuccagccugggcaacacagugagacuc

SEQ ID NO: 515802 - RNA, 32 nt, Human
ugcacuccagccugggcaacagacagagugag

SEQ ID NO: 515803 - RNA, 32 nt, Human
ugcacuccagccugggcaacagagcgugacuc

SEQ ID NO: 515804 - RNA, 32 nt, Human
ugcacuccagccugggcaacagaguaagaacu

SEQ ID NO: 515805 - RNA, 32 nt, Human
ugcacuccagccugggcaacagaguaagacuc

SEQ ID NO: 515806 - RNA, 32 nt, Human
ugcacuccagccugggcaacagaguaagauuc

SEQ ID NO: 515807 - RNA, 32 nt, Human
ugcacuccagccugggcaacagagugaaacuc

SEQ ID NO: 515808 - RNA, 32 nt, Human
ugcacuccagccugggcaacagagugacacuc

SEQ ID NO: 515809 - RNA, 32 nt, Human
ugcacuccagccugggcaacagagugagaccc

SEQ ID NO: 515810 - RNA, 32 nt, Human
ugcacuccagccugggcaacagagugagacgc

SEQ ID NO: 515811 - RNA, 32 nt, Human
ugcacuccagccugggcaacagagugagacua

SEQ ID NO: 515812 - RNA, 32 nt, Human
ugcacuccagccugggcaacagagugagacuc

SEQ ID NO: 515813 - RNA, 32 nt, Human
ugcacuccagccugggcaacagagugagacug

SEQ ID NO: 515814 - RNA, 32 nt, Human
ugcacuccagccugggcaacagagugagacuu

SEQ ID NO: 515815 - RNA, 32 nt, Human
ugcacuccagccugggcaacagagugagaucc

SEQ ID NO: 515816 - RNA, 32 nt, Human
ugcacuccagccugggcaacagagugaggccc

SEQ ID NO: 515817 - RNA, 32 nt, Human
ugcacuccagccugggcaacagaguggacucc

SEQ ID NO: 515818 - RNA, 32 nt, Human
ugcacuccagccugggcaacagagugggacuc

SEQ ID NO: 515819 - RNA, 32 nt, Human
ugcacuccagccugggcaacagcaagacccug

SEQ ID NO: 515820 - RNA, 32 nt, Human
ugcacuccagccugggcaacagcagcgaaacu

SEQ ID NO: 515821 - RNA, 26 nt, Human
ugcacuccagccugggcaacaggcuc

SEQ ID NO: 515822 - RNA, 32 nt, Human
ugcacuccagccugggcaacagguaagacucu

SEQ ID NO: 515823 - RNA, 32 nt, Human
ugcacuccagccugggcaacagugagacucug

SEQ ID NO: 515824 - RNA, 32 nt, Human
ugcacuccagccugggcaacaguguuaagacu

SEQ ID NO: 515825 - RNA, 32 nt, Human
ugcacuccagccugggcaaccaggugagaccc

SEQ ID NO: 515826 - RNA, 32 nt, Human
ugcacuccagccugggcaacgagagugaaacu

SEQ ID NO: 515827 - RNA, 32 nt, Human
ugcacuccagccugggcaacgagugaaacucc

SEQ ID NO: 515828 - RNA, 32 nt, Human
ugcacuccagccugggcaacguggugagaccc

SEQ ID NO: 515829 - RNA, 32 nt, Human
ugcacuccagccugggcaauaagagugaaacu

SEQ ID NO: 515830 - RNA, 32 nt, Human
ugcacuccagccugggcaauagagcaagacuc

SEQ ID NO: 515831 - RNA, 32 nt, Human
ugcacuccagccugggcaauagagcaagacug

SEQ ID NO: 515832 - RNA, 32 nt, Human
ugcacuccagccugggcaauagaguaagaccc

SEQ ID NO: 515833 - RNA, 32 nt, Human
ugcacuccagccugggcaauagagugagacuc

SEQ ID NO: 515834 - RNA, 32 nt, Human
ugcacuccagccugggcaauagagugagauuc

SEQ ID NO: 515835 - RNA, 32 nt, Human
ugcacuccagccugggcaauagagugagcccu

SEQ ID NO: 515836 - RNA, 32 nt, Human
ugcacuccagccugggcaauauagcaagaccc

SEQ ID NO: 515837 - RNA, 32 nt, Human
ugcacuccagccugggcaauggagugagacuc

SEQ ID NO: 515838 - RNA, 32 nt, Human
ugcacuccagccugggcaccacagcaagacuc

SEQ ID NO: 515839 - RNA, 32 nt, Human
ugcacuccagccugggcagcaagagcaaaaca

SEQ ID NO: 515840 - RNA, 32 nt, Human
ugcacuccagccugggcagcagagugagacuu

SEQ ID NO: 515841 - RNA, 32 nt, Human
ugcacuccagccugggccacacagugagacuc

SEQ ID NO: 515842 - RNA, 32 nt, Human
ugcacuccagccugggccacagagcaagacuc

SEQ ID NO: 515843 - RNA, 32 nt, Human
ugcacuccagccugggccacagagugagauuc

SEQ ID NO: 515844 - RNA, 32 nt, Human
ugcacuccagccugggcgacaaagugagacuc

SEQ ID NO: 515845 - RNA, 32 nt, Human
ugcacuccagccugggcgacaagagugaaacu

SEQ ID NO: 515846 - RNA, 32 nt, Human
ugcacuccagccugggcgacaagagugaaauu

SEQ ID NO: 515847 - RNA, 32 nt, Human
ugcacuccagccugggcgacacagcaagacuc

SEQ ID NO: 515848 - RNA, 32 nt, Human
ugcacuccagccugggcgacagaguaagacug

SEQ ID NO: 515849 - RNA, 32 nt, Human
ugcacuccagccugggcgacagagugacacuu

SEQ ID NO: 515850 - RNA, 32 nt, Human
ugcacuccagccugggcgacagagugacucug

SEQ ID NO: 515851 - RNA, 32 nt, Human
ugcacuccagccugggcgacagagugagaccc

SEQ ID NO: 515852 - RNA, 32 nt, Human
ugcacuccagccugggcgacagagugagacuc

SEQ ID NO: 515853 - RNA, 32 nt, Human
ugcacuccagccugggcgacagagugagacug

SEQ ID NO: 515854 - RNA, 32 nt, Human
ugcacuccagccugggcgacagagugagacuu

SEQ ID NO: 515855 - RNA, 32 nt, Human
ugcacuccagccugggcgacagagugaggcuc

SEQ ID NO: 515856 - RNA, 32 nt, Human
ugcacuccagccugggcgacagagugggacuc

SEQ ID NO: 515857 - RNA, 32 nt, Human
ugcacuccagccugggcgacagcaagacuccg

SEQ ID NO: 515858 - RNA, 32 nt, Human
ugcacuccagccugggcgacagcgugagaucc

SEQ ID NO: 515859 - RNA, 32 nt, Human
ugcacuccagccugggcgacagggugagacug

SEQ ID NO: 515860 - RNA, 32 nt, Human
ugcacuccagccugggcgacagugagacccug

SEQ ID NO: 515861 - RNA, 32 nt, Human
ugcacuccagccugggcgacagugagacugcu

SEQ ID NO: 515862 - RNA, 32 nt, Human
ugcacuccagccugggcgacagugagacuuug

SEQ ID NO: 515863 - RNA, 32 nt, Human
ugcacuccagccugggcgacgagugaaacucc

SEQ ID NO: 515864 - RNA, 32 nt, Human
ugcacuccagccugggcgacggagugagacuc

SEQ ID NO: 515865 - RNA, 32 nt, Human
ugcacuccagccugggcgauagagcaagacuc

SEQ ID NO: 515866 - RNA, 32 nt, Human
ugcacuccagccugggcgauagagugagacuc

SEQ ID NO: 515867 - RNA, 32 nt, Human
ugcacuccagccugggcgauggagugagacuc

SEQ ID NO: 515868 - RNA, 32 nt, Human
ugcacuccagccugggcggcagagugagacuc

SEQ ID NO: 515869 - RNA, 32 nt, Human
ugcacuccagccugggcgucagagugagaacu

SEQ ID NO: 515870 - RNA, 32 nt, Human
ugcacuccagccugggcugcagggugaggucc

SEQ ID NO: 515871 - RNA, 32 nt, Human
ugcacuccagccugggcuucagagcaagacuc

SEQ ID NO: 515872 - RNA, 32 nt, Human
ugcacuccagccugggggacaagagugagacu

SEQ ID NO: 515873 - RNA, 32 nt, Human
ugcacuccagccugggggacagagugagaccc

SEQ ID NO: 515874 - RNA, 32 nt, Human
ugcacuccagccuggguaacagagugagacuc

SEQ ID NO: 515875 - RNA, 32 nt, Human
ugcacuccagccuggguaacagagugagacug

SEQ ID NO: 515876 - RNA, 32 nt, Human
ugcacuccagccuggguaacagugagaggccu

SEQ ID NO: 515877 - RNA, 32 nt, Human
ugcacuccagccugggugacaaagugagacuc

SEQ ID NO: 515878 - RNA, 32 nt, Human
ugcacuccagccugggugacaagagugaaacu

SEQ ID NO: 515879 - RNA, 32 nt, Human
ugcacuccagccugggugacaagagugagacu

SEQ ID NO: 515880 - RNA, 32 nt, Human
ugcacuccagccugggugacacagugagacuc

SEQ ID NO: 515881 - RNA, 32 nt, Human
ugcacuccagccugggugacagagcaagugag

SEQ ID NO: 515882 - RNA, 32 nt, Human
ugcacuccagccugggugacagaguaacacuc

SEQ ID NO: 515883 - RNA, 32 nt, Human
ugcacuccagccugggugacagaguaagaccc

SEQ ID NO: 515884 - RNA, 32 nt, Human
ugcacuccagccugggugacagaguaagacuc

SEQ ID NO: 515885 - RNA, 32 nt, Human
ugcacuccagccugggugacagaguaauacuc

SEQ ID NO: 515886 - RNA, 32 nt, Human
ugcacuccagccugggugacagaguaggaccc

SEQ ID NO: 515887 - RNA, 32 nt, Human
ugcacuccagccugggugacagagugaaaccc

SEQ ID NO: 515888 - RNA, 32 nt, Human
ugcacuccagccugggugacagagugagacac

SEQ ID NO: 515889 - RNA, 32 nt, Human
ugcacuccagccugggugacagagugagaccc

SEQ ID NO: 515890 - RNA, 32 nt, Human
ugcacuccagccugggugacagagugagaccu

SEQ ID NO: 515891 - RNA, 32 nt, Human
ugcacuccagccugggugacagagugagacuc

SEQ ID NO: 515892 - RNA, 32 nt, Human
ugcacuccagccugggugacagagugagacuu

SEQ ID NO: 515893 - RNA, 32 nt, Human
ugcacuccagccugggugacagagugagagac

SEQ ID NO: 515894 - RNA, 32 nt, Human
ugcacuccagccugggugacagagugagaguc

SEQ ID NO: 515895 - RNA, 32 nt, Human
ugcacuccagccugggugacagagugagaucc

SEQ ID NO: 515896 - RNA, 32 nt, Human
ugcacuccagccugggugacagagugagauuc

SEQ ID NO: 515897 - RNA, 32 nt, Human
ugcacuccagccugggugacagagugaggccc

SEQ ID NO: 515898 - RNA, 32 nt, Human
ugcacuccagccugggugacagagugagugag

SEQ ID NO: 515899 - RNA, 32 nt, Human
ugcacuccagccugggugacagugaaacucca

SEQ ID NO: 515900 - RNA, 32 nt, Human
ugcacuccagccugggugacagugagacucug

SEQ ID NO: 515901 - RNA, 32 nt, Human
ugcacuccagccugggugacagugagacuuug

SEQ ID NO: 515902 - RNA, 32 nt, Human
ugcacuccagccugggugacagugagucuuug

SEQ ID NO: 515903 - RNA, 32 nt, Human
ugcacuccagccugggugacagugugaaacuu

SEQ ID NO: 515904 - RNA, 32 nt, Human
ugcacuccagccugggugacgagugaaacucc

SEQ ID NO: 515905 - RNA, 32 nt, Human
ugcacuccagccugggugacggugagacuuug

SEQ ID NO: 515906 - RNA, 32 nt, Human
ugcacuccagccugggugacugagugagaccc

SEQ ID NO: 515907 - RNA, 32 nt, Human
ugcacuccagccugggugauagagugagaacu

SEQ ID NO: 515908 - RNA, 32 nt, Human
ugcacuccagccugggugauagagugagacac

SEQ ID NO: 515909 - RNA, 32 nt, Human
ugcacuccagccugggugauagagugagaccc

SEQ ID NO: 515910 - RNA, 32 nt, Human
ugcacuccagccugggugauagagugagauuc

SEQ ID NO: 515911 - RNA, 32 nt, Human
ugcacuccagccuggguggcagagugagaccc

SEQ ID NO: 515912 - RNA, 32 nt, Human
ugcacuccagccuggguggcagagugagacuc

SEQ ID NO: 515913 - RNA, 32 nt, Human
ugcacuccagccuggguuacagagugagaccc

SEQ ID NO: 515914 - RNA, 32 nt, Human
ugcacuccagccuggucaacaagaguaaaacu

SEQ ID NO: 515915 - RNA, 32 nt, Human
ugcacuccagccuggucaacagagugggacuc

SEQ ID NO: 515916 - RNA, 32 nt, Human
ugcacuccagccuggugacagagugagacucc

SEQ ID NO: 515917 - RNA, 32 nt, Human
ugcacuccagccuggugacagagugagacucu

SEQ ID NO: 515918 - RNA, 32 nt, Human
ugcacuccagccuggugacagggcgagacucc

SEQ ID NO: 515919 - RNA, 32 nt, Human
ugcacuccagccugucgcugugcagaccuggc

SEQ ID NO: 515920 - RNA, 32 nt, Human
ugcacuccagccugugcaacaagagugaaacu

SEQ ID NO: 515921 - RNA, 32 nt, Human
ugcacuccagccugugcgacaagagcgaaacu

SEQ ID NO: 515922 - RNA, 32 nt, Human
ugcacuccaggcgggugacagagcaagacugc

SEQ ID NO: 515923 - RNA, 32 nt, Human
ugcacuccaggcugggcagcaagagcaagacu

SEQ ID NO: 515924 - RNA, 32 nt, Human
ugcacuccaguccgggcuggcggacagagggc

SEQ ID NO: 515925 - RNA, 32 nt, Human
ugcacuccagucugggagacaagagcaagacg

SEQ ID NO: 515926 - RNA, 32 nt, Human
ugcacucccagccugggcaacggagugagacu

SEQ ID NO: 515927 - RNA, 32 nt, Human
ugcacucccauguucacugcaguauuauuugc

SEQ ID NO: 515928 - RNA, 20 nt, Human
ugcacuccccacccugcucc

SEQ ID NO: 515929 - RNA, 32 nt, Human
ugcacuccccugcucuucugagcugcccaguc

SEQ ID NO: 515930 - RNA, 32 nt, Human
ugcacucccuaguccagaccuggggaccacug

SEQ ID NO: 515931 - RNA, 32 nt, Human
ugcacuccggagguagagguuguggugagccg

SEQ ID NO: 515932 - RNA, 32 nt, Human
ugcacuccuaccaaauaaacaggauuuuagua

SEQ ID NO: 515933 - RNA, 21 nt, Human
ugcacuccucaacucugcucc

SEQ ID NO: 515934 - RNA, 32 nt, Human
ugcacuccucaacucugcuccaaagcagccgc

SEQ ID NO: 515935 - RNA, 32 nt, Human
ugcacuccuccaccaucacaaucucacccaaa

SEQ ID NO: 515936 - RNA, 22 nt, Human
ugcacuccucuuuguaauuuca

SEQ ID NO: 515937 - RNA, 32 nt, Human
ugcacuccugucuucuggcuucagucuggaag

SEQ ID NO: 515938 - RNA, 32 nt, Human
ugcacuccuuucucuccaaccagggcagaaag

SEQ ID NO: 515939 - RNA, 32 nt, Human
ugcacucuagccuggcaacagagcaagacucc

SEQ ID NO: 515940 - RNA, 32 nt, Human
ugcacucuagccuggcaacagagcgagauucc

SEQ ID NO: 515941 - RNA, 32 nt, Human
ugcacucucagaaaucagacuugaguggccgg

SEQ ID NO: 515942 - RNA, 32 nt, Human
ugcacucucagguauucccugcucuuacucca

SEQ ID NO: 515943 - RNA, 32 nt, Human
ugcacucuccaaacucagguuccgggaagcuu

SEQ ID NO: 515944 - RNA, 32 nt, Human
ugcacucuccacccuggcugggaucagagcag

SEQ ID NO: 515945 - RNA, 32 nt, Human
ugcacucuccugggcugucuuuuucuccagca

SEQ ID NO: 515946 - RNA, 32 nt, Human
ugcacucucucccacccccuuccagggccucu

SEQ ID NO: 515947 - RNA, 32 nt, Human
ugcacucugaaauaaaauaugcuuuaaaaaug

SEQ ID NO: 515948 - RNA, 32 nt, Human
ugcacucugauuuucuguagguacaguucaaa

SEQ ID NO: 515949 - RNA, 32 nt, Human
ugcacucuggaaccucuggccucaggggaccu

SEQ ID NO: 515950 - RNA, 32 nt, Human
ugcacucuguugcccaggcuggaguacagugg

SEQ ID NO: 515951 - RNA, 32 nt, Human
ugcacugaagagagcauuuggcagagucugaa

SEQ ID NO: 515952 - RNA, 32 nt, Human
ugcacugacccacagccucugccugugcacgg

SEQ ID NO: 515953 - RNA, 32 nt, Human
ugcacugacugggccacaucuugaaaacucgu

SEQ ID NO: 515954 - RNA, 22 nt, Human
ugcacugacugugaaaccuuua

SEQ ID NO: 515955 - RNA, 32 nt, Human
ugcacugacuucuguuucggaaccacaguaag

SEQ ID NO: 515956 - RNA, 32 nt, Human
ugcacugagcagagucuugcuaccucagucag

SEQ ID NO: 515957 - RNA, 32 nt, Human
ugcacugagccuucaucgcccauugcuuuagg

SEQ ID NO: 515958 - RNA, 32 nt, Human
ugcacugagcuguaaucacaccacugcacucc

SEQ ID NO: 515959 - RNA, 32 nt, Human
ugcacugaggguaaccagaugaucucauggga

SEQ ID NO: 515960 - RNA, 32 nt, Human
ugcacugcaacuucuguauccuuccuuccccu

SEQ ID NO: 515961 - RNA, 32 nt, Human
ugcacugcaaguguccccaggaggagcacaug

SEQ ID NO: 515962 - RNA, 32 nt, Human
ugcacugcagauguccuugaugaagagaauga

SEQ ID NO: 515963 - RNA, 32 nt, Human
ugcacugcagccugugugacaaagggagacug

SEQ ID NO: 515964 - RNA, 32 nt, Human
ugcacugcaucaggagucaggagaccuggcuu

SEQ ID NO: 515965 - RNA, 32 nt, Human
ugcacugcauuccagccugggugacagaguga

SEQ ID NO: 515966 - RNA, 32 nt, Human
ugcacugccauccuggacagaaaggcaggagc

SEQ ID NO: 515967 - RNA, 32 nt, Human
ugcacugccccuucucccuccugagagcucug

SEQ ID NO: 515968 - RNA, 32 nt, Human
ugcacugcccucacccucagccgucccaagga

SEQ ID NO: 515969 - RNA, 32 nt, Human
ugcacugcccuuacuuugaagcagaagcuggu

SEQ ID NO: 515970 - RNA, 19 nt, Human
ugcacugcgaggauggaga

SEQ ID NO: 515971 - RNA, 32 nt, Human
ugcacugcuguucacccugggcuacgcccucu

SEQ ID NO: 515972 - RNA, 32 nt, Human
ugcacugcuguugagguuugacucgaagccca

SEQ ID NO: 515973 - RNA, 32 nt, Human
ugcacuggacacugaggaucacaaagccaaaa

SEQ ID NO: 515974 - RNA, 32 nt, Human
ugcacuggagccacaggcaggggugagagcac

SEQ ID NO: 515975 - RNA, 32 nt, Human
ugcacuggaggaacuccugccauuaccagcuc

SEQ ID NO: 515976 - RNA, 32 nt, Human
ugcacuggccagggguuccggcuguauaucca

SEQ ID NO: 515977 - RNA, 32 nt, Human
ugcacuggcccugcggcgggccccagagccca

SEQ ID NO: 515978 - RNA, 30 nt, Human
ugcacuggccucuccugcauucuguuugca

SEQ ID NO: 515979 - RNA, 32 nt, Human
ugcacuggcuacugaugauacagccaugcuga

SEQ ID NO: 515980 - RNA, 32 nt, Human
ugcacuggcuauuuguguuuaaucagaaugaa

SEQ ID NO: 515981 - RNA, 32 nt, Human
ugcacuggcucaagccuguaaucccagcacuu

SEQ ID NO: 515982 - RNA, 32 nt, Human
ugcacugggccccagcccuccugcuccuuagg

SEQ ID NO: 515983 - RNA, 32 nt, Human
ugcacuggggcuguucaugggagcauccacac

SEQ ID NO: 515984 - RNA, 32 nt, Human
ugcacugggggaggggagggagugaggggcag

SEQ ID NO: 515985 - RNA, 32 nt, Human
ugcacuggguuguuuugacaagcuaccacacg

SEQ ID NO: 515986 - RNA, 32 nt, Human
ugcacuguaauacgugcuuaacuuugcuuaaa

SEQ ID NO: 515987 - RNA, 32 nt, Human
ugcacuguagggcugggcgcagcaucccuagg

SEQ ID NO: 515988 - RNA, 32 nt, Human
ugcacugucacccaggcugcuggaguacagug

SEQ ID NO: 515989 - RNA, 32 nt, Human
ugcacugucacccaggcuggagugcaguggcg

SEQ ID NO: 515990 - RNA, 32 nt, Human
ugcacugucauuguaugcaagcauuuugucuu

SEQ ID NO: 515991 - RNA, 32 nt, Human
ugcacugucgcacuccagccuggaugauagag

SEQ ID NO: 515992 - RNA, 32 nt, Human
ugcacugugagcgcugugugaggaugccuggc

SEQ ID NO: 515993 - RNA, 32 nt, Human
ugcacugugagcugugugcugcuguagccacu

SEQ ID NO: 515994 - RNA, 32 nt, Human
ugcacugugaggcggggcgauggggaagggcc

SEQ ID NO: 515995 - RNA, 32 nt, Human
ugcacugugaggcuggaccuguugacucugca

SEQ ID NO: 515996 - RNA, 32 nt, Human
ugcacugugccccuguccacaggucaugugac

SEQ ID NO: 515997 - RNA, 32 nt, Human
ugcacugugcugcucucacagaucggugucug

SEQ ID NO: 515998 - RNA, 32 nt, Human
ugcacuguggaucugccauccauucugcaguc

SEQ ID NO: 515999 - RNA, 32 nt, Human
ugcacuguucacugcagcccauuugcuguaug

SEQ ID NO: 516000 - RNA, 31 nt, Human
ugcacuuaggagagagacucaaagcccuggg

SEQ ID NO: 516001 - RNA, 32 nt, Human
ugcacuucacagauucaccagacuguagcauc

SEQ ID NO: 516002 - RNA, 32 nt, Human
ugcacuucagccuggacaacagagugagaccc

SEQ ID NO: 516003 - RNA, 32 nt, Human
ugcacuucagccuggacaacagagugagacuc

SEQ ID NO: 516004 - RNA, 32 nt, Human
ugcacuucagccuggaugacagagugagaccc

SEQ ID NO: 516005 - RNA, 32 nt, Human
ugcacuucagccugggcaacagagugagacuc

SEQ ID NO: 516006 - RNA, 32 nt, Human
ugcacuucagccugggcaacagagugagacug

SEQ ID NO: 516007 - RNA, 32 nt, Human
ugcacuucagccugggcgacagagugacucug

SEQ ID NO: 516008 - RNA, 32 nt, Human
ugcacuucagccugggugacagagugagacag

SEQ ID NO: 516009 - RNA, 32 nt, Human
ugcacuucagccugggugacagagugagaccc

SEQ ID NO: 516010 - RNA, 32 nt, Human
ugcacuucagccugggugacagagugagacuc

SEQ ID NO: 516011 - RNA, 32 nt, Human
ugcacuucagcugucugucccuugaaugcuuc

SEQ ID NO: 516012 - RNA, 32 nt, Human
ugcacuucaguggauugaagacuugacuuuga

SEQ ID NO: 516013 - RNA, 32 nt, Human
ugcacuucauucuugcccaucuuaacaugcua

SEQ ID NO: 516014 - RNA, 32 nt, Human
ugcacuuccaacaacgggcagcagagggcgcg

SEQ ID NO: 516015 - RNA, 32 nt, Human
ugcacuuccagccucuucuccuuguggcucuc

SEQ ID NO: 516016 - RNA, 32 nt, Human
ugcacuuccagccugggugacacagugagacc

SEQ ID NO: 516017 - RNA, 32 nt, Human
ugcacuuccagccugggugacagagugagacc

SEQ ID NO: 516018 - RNA, 32 nt, Human
ugcacuucccacagacuggaguuuuuggugcu

SEQ ID NO: 516019 - RNA, 32 nt, Human
ugcacuuccuccucauguagucuggaguacuu

SEQ ID NO: 516020 - RNA, 30 nt, Human
ugcacuugccucuccaugugaucugugacg

SEQ ID NO: 516021 - RNA, 32 nt, Human
ugcacuugccuuguugcugaaguuccaauaau

SEQ ID NO: 516022 - RNA, 32 nt, Human
ugcacuuggcaaaaagaaucccaauguuugac

SEQ ID NO: 516023 - RNA, 32 nt, Human
ugcacuuguaaucccagcuacaugggaagcgg

SEQ ID NO: 516024 - RNA, 32 nt, Human
ugcacuuguacucccagcuacuugggaggcug

SEQ ID NO: 516025 - RNA, 32 nt, Human
ugcacuuguccaccccuguuacccccaggauc

SEQ ID NO: 516026 - RNA, 32 nt, Human
ugcacuuguuacuguaccauagugcggacgag

SEQ ID NO: 516027 - RNA, 32 nt, Human
ugcacuuuuccuuaccuccuggccucagauau

SEQ ID NO: 516028 - RNA, 32 nt, Human
ugcacuuuugggccuuugggcucuggaaccug

SEQ ID NO: 516029 - RNA, 32 nt, Human
ugcagaaaaaucaggcaggcagcuacgaguuu

SEQ ID NO: 516030 - RNA, 32 nt, Human
ugcagaaaaccagugaagggaccuacuaccau

SEQ ID NO: 516031 - RNA, 19 nt, Human
ugcagaaaaggccccagaa

SEQ ID NO: 516032 - RNA, 21 nt, Human
ugcagaaacccacccugcucc

SEQ ID NO: 516033 - RNA, 18 nt, Human
ugcagaaacccuucaaag

SEQ ID NO: 516034 - RNA, 32 nt, Human
ugcagaaaccgccucuguggcugcauuugaaa

SEQ ID NO: 516035 - RNA, 32 nt, Human
ugcagaaacguugcaccggugccugagguggg

SEQ ID NO: 516036 - RNA, 32 nt, Human
ugcagaaaggagagagagggaucugauggcaa

SEQ ID NO: 516037 - RNA, 32 nt, Human
ugcagaaauacaauuuccuacacuucauaccu

SEQ ID NO: 516038 - RNA, 20 nt, Human
ugcagaaaugcagacauggu

SEQ ID NO: 516039 - RNA, 32 nt, Human
ugcagaaauuuccucagccacuggagggauuu

SEQ ID NO: 516040 - RNA, 32 nt, Human
ugcagaacccccagugugggccuggggguggg

SEQ ID NO: 516041 - RNA, 32 nt, Human
ugcagaaccucaccucuaguugagaccaagaa

SEQ ID NO: 516042 - RNA, 32 nt, Human
ugcagaacuaucauagucacauacauauaaga

SEQ ID NO: 516043 - RNA, 23 nt, Human
ugcagaacuguagaagacccuga

SEQ ID NO: 516044 - RNA, 32 nt, Human
ugcagaacuguucagugguauuacaugaaaug

SEQ ID NO: 516045 - RNA, 32 nt, Human
ugcagaacuugcagaaugcgugguguuaaucu

SEQ ID NO: 516046 - RNA, 32 nt, Human
ugcagaagaaaauuuugcucuuauaaaaccuc

SEQ ID NO: 516047 - RNA, 32 nt, Human
ugcagaagacaguguuaauguguuugguuugg

SEQ ID NO: 516048 - RNA, 32 nt, Human
ugcagaagaggaagagaugagggaaggccugg

SEQ ID NO: 516049 - RNA, 32 nt, Human
ugcagaagaggaagaggaggaguauggugucu

SEQ ID NO: 516050 - RNA, 32 nt, Human
ugcagaagaguccuggugguggcagccucacc

SEQ ID NO: 516051 - RNA, 32 nt, Human
ugcagaagcagcaggaggcacuugaggagcag

SEQ ID NO: 516052 - RNA, 18 nt, Human
ugcagaagcagcccugug

SEQ ID NO: 516053 - RNA, 24 nt, Human
ugcagaagcuaaaaagcuaaagua

SEQ ID NO: 516054 - RNA, 32 nt, Human
ugcagaagcucccuuagugauuucacguuuaa

SEQ ID NO: 516055 - RNA, 32 nt, Human
ugcagaagcugaagcacaagaauugcuugaac

SEQ ID NO: 516056 - RNA, 32 nt, Human
ugcagaagcugcauuucagcugaaucuguguu

SEQ ID NO: 516057 - RNA, 32 nt, Human
ugcagaaggagagaauguguggaggauuaugu

SEQ ID NO: 516058 - RNA, 18 nt, Human
ugcagaaggccccgugca

SEQ ID NO: 516059 - RNA, 16 nt, Human
ugcagaagggccucuu

SEQ ID NO: 516060 - RNA, 32 nt, Human
ugcagaagucaauccuuuguucuuuuguuuug

SEQ ID NO: 516061 - RNA, 32 nt, Human
ugcagaaguccuucuuguccuggucguuguuc

SEQ ID NO: 516062 - RNA, 32 nt, Human
ugcagaagucugucuuccuccugcugcuauca

SEQ ID NO: 516063 - RNA, 32 nt, Human
ugcagaagugaguuuuuauugaagaagcucca

SEQ ID NO: 516064 - RNA, 32 nt, Human
ugcagaagugcacuaccaugcccagcuaauuu

SEQ ID NO: 516065 - RNA, 32 nt, Human
ugcagaauaaagauugcucaggccugccuggc

SEQ ID NO: 516066 - RNA, 32 nt, Human
ugcagaaugaaaccucuuuuccauccagaagc

SEQ ID NO: 516067 - RNA, 23 nt, Human
ugcagaaugaaauagaagcaaag

SEQ ID NO: 516068 - RNA, 32 nt, Human
ugcagaaugagaggagagagggaaggcagguc

SEQ ID NO: 516069 - RNA, 32 nt, Human
ugcagaaugccacaucugaaccacccuucccu

SEQ ID NO: 516070 - RNA, 33 nt, Human
ugcagaauguguguugaauauucuuuacauuua

SEQ ID NO: 516071 - RNA, 32 nt, Human
ugcagaauuaugcacugacaugacccugggug

SEQ ID NO: 516072 - RNA, 22 nt, Human
ugcagacaaagcaccccugcac

SEQ ID NO: 516073 - RNA, 32 nt, Human
ugcagacaagaaugcagguggggaaggaagag

SEQ ID NO: 516074 - RNA, 32 nt, Human
ugcagacaagcuaagcucaucaucugguuccc

SEQ ID NO: 516075 - RNA, 19 nt, Human
ugcagacaagggucuccac

SEQ ID NO: 516076 - RNA, 32 nt, Human
ugcagacacagcaucuacucagcgugggucac

SEQ ID NO: 516077 - RNA, 32 nt, Human
ugcagacacaggcuggugcugcaagggcuccu

SEQ ID NO: 516078 - RNA, 32 nt, Human
ugcagacacgcccgcauuucuccagggcgggg

SEQ ID NO: 516079 - RNA, 32 nt, Human
ugcagacagggugaccaggagcugcuaagccc

SEQ ID NO: 516080 - RNA, 32 nt, Human
ugcagacaguucuaaagcaaggagcugcagca

SEQ ID NO: 516081 - RNA, 32 nt, Human
ugcagacaucacaaaguaguuuuucagaaugc

SEQ ID NO: 516082 - RNA, 32 nt, Human
ugcagacaucucuggagccagagagaacaaca

SEQ ID NO: 516083 - RNA, 32 nt, Human
ugcagacauggaccaucaugcccagcugcaac

SEQ ID NO: 516084 - RNA, 32 nt, Human
ugcagaccaauuaaauccaggucucuaggggu

SEQ ID NO: 516085 - RNA, 32 nt, Human
ugcagaccagccuggccaacauggcaaaaccc

SEQ ID NO: 516086 - RNA, 32 nt, Human
ugcagaccagccuggguaacauagugagaccu

SEQ ID NO: 516087 - RNA, 32 nt, Human
ugcagaccaucucacaaucaucauguuccaca

SEQ ID NO: 516088 - RNA, 32 nt, Human
ugcagacccagagguaaggcugccuggcugcc

SEQ ID NO: 516089 - RNA, 21 nt, Human
ugcagacccaucucccuccac

SEQ ID NO: 516090 - RNA, 32 nt, Human
ugcagaccccagggugggcagaugucuccagu

SEQ ID NO: 516091 - RNA, 21 nt, Human
ugcagacccccacccccggcc

SEQ ID NO: 516092 - RNA, 18 nt, Human
ugcagaccccgccuccca

SEQ ID NO: 516093 - RNA, 32 nt, Human
ugcagacccggcccagagacugugcgugccac

SEQ ID NO: 516094 - RNA, 32 nt, Human
ugcagacccuacucucuauuuugcagugggug

SEQ ID NO: 516095 - RNA, 32 nt, Human
ugcagacccugaacccacaccugggcaucagg

SEQ ID NO: 516096 - RNA, 32 nt, Human
ugcagacccuggggucccuguuguacgcugca

SEQ ID NO: 516097 - RNA, 32 nt, Human
ugcagacccuucugccccaugacaggccuggg

SEQ ID NO: 516098 - RNA, 32 nt, Human
ugcagaccucaaggaggcucccuagcaacagc

SEQ ID NO: 516099 - RNA, 32 nt, Human
ugcagaccugaagaccuccucggauucccugu

SEQ ID NO: 516100 - RNA, 32 nt, Human
ugcagaccugcaagaucauauucuuccuccug

SEQ ID NO: 516101 - RNA, 32 nt, Human
ugcagaccugcaggacaucgagucucugcuau

SEQ ID NO: 516102 - RNA, 20 nt, Human
ugcagacggcccgggagcug

SEQ ID NO: 516103 - RNA, 29 nt, Human
ugcagacggcugcuaugacaucccuguuc

SEQ ID NO: 516104 - RNA, 32 nt, Human
ugcagacggggaguagcuuuguggaaacugau

SEQ ID NO: 516105 - RNA, 32 nt, Human
ugcagacggugacuggcccuggcuuccugggu

SEQ ID NO: 516106 - RNA, 32 nt, Human
ugcagacgucccugagagguucuugaagaugu

SEQ ID NO: 516107 - RNA, 32 nt, Human
ugcagacgugagccaccacagcuggcugaaga

SEQ ID NO: 516108 - RNA, 32 nt, Human
ugcagacgugagccaccaugcccagccaaguu

SEQ ID NO: 516109 - RNA, 32 nt, Human
ugcagacucacagauaauaaagcucagagcag

SEQ ID NO: 516110 - RNA, 32 nt, Human
ugcagacucacugcccaccggcucccuccccc

SEQ ID NO: 516111 - RNA, 23 nt, Human
ugcagacucaugaaagacccuga

SEQ ID NO: 516112 - RNA, 32 nt, Human
ugcagacucgagggucuccgcagccacuuccu

SEQ ID NO: 516113 - RNA, 32 nt, Human
ugcagacucugccucucaggcucaggugaucc

SEQ ID NO: 516114 - RNA, 20 nt, Human
ugcagacucuuguccagcgg

SEQ ID NO: 516115 - RNA, 32 nt, Human
ugcagacuggacuggauucuucuagcuccuuc

SEQ ID NO: 516116 - RNA, 32 nt, Human
ugcagacuggugaaacugaacaagcaccauuu

SEQ ID NO: 516117 - RNA, 32 nt, Human
ugcagacuuaccccacccuccaccccuagcuc

SEQ ID NO: 516118 - RNA, 24 nt, Human
ugcagacuucaccuccugaguuca

SEQ ID NO: 516119 - RNA, 32 nt, Human
ugcagacuuccgggggaauuguugccuccugc

SEQ ID NO: 516120 - RNA, 32 nt, Human
ugcagacuucugggggaauugucgccuccugc

SEQ ID NO: 516121 - RNA, 32 nt, Human
ugcagacuugagccacagugcccagccucacu

SEQ ID NO: 516122 - RNA, 32 nt, Human
ugcagacuugcgcuucucugcaccuuaucccu

SEQ ID NO: 516123 - RNA, 32 nt, Human
ugcagagaaacuuaagcaaaggggacagcugu

SEQ ID NO: 516124 - RNA, 32 nt, Human
ugcagagaaagagcaaagcccaaaagggagaa

SEQ ID NO: 516125 - RNA, 32 nt, Human
ugcagagaaggagccggggaccagcuugaaga

SEQ ID NO: 516126 - RNA, 32 nt, Human
ugcagagaaggcaccugcagagagcagggcag

SEQ ID NO: 516127 - RNA, 21 nt, Human
ugcagagaagguccugggaaa

SEQ ID NO: 516128 - RNA, 32 nt, Human
ugcagagaaggugggaccagggccaggguucc

SEQ ID NO: 516129 - RNA, 32 nt, Human
ugcagagaaguuuucucagugccguaauauag

SEQ ID NO: 516130 - RNA, 32 nt, Human
ugcagagaccacugcacuccagccugggcaac

SEQ ID NO: 516131 - RNA, 18 nt, Human
ugcagagaccccggcaag

SEQ ID NO: 516132 - RNA, 22 nt, Human
ugcagagaccugugcccagaga

SEQ ID NO: 516133 - RNA, 32 nt, Human
ugcagagacgcgagcaaccucuucucaucggc

SEQ ID NO: 516134 - RNA, 15 nt, Human
ugcagagagaagucu

SEQ ID NO: 516135 - RNA, 32 nt, Human
ugcagagagacaccuggucagccagcguugca

SEQ ID NO: 516136 - RNA, 32 nt, Human
ugcagagagagcaugggcuuucuggugucaga

SEQ ID NO: 516137 - RNA, 32 nt, Human
ugcagagagccuuuggaagaggucuucggaga

SEQ ID NO: 516138 - RNA, 32 nt, Human
ugcagagaggaagagggcagcaguugaggaug

SEQ ID NO: 516139 - RNA, 32 nt, Human
ugcagagaggagaaaguucuguagguaauaag

SEQ ID NO: 516140 - RNA, 32 nt, Human
ugcagagaggagcuacccucucugcuuagagc

SEQ ID NO: 516141 - RNA, 20 nt, Human
ugcagagaggauccuggcaa

SEQ ID NO: 516142 - RNA, 32 nt, Human
ugcagagaggccugccuuccggauuccaggcg

SEQ ID NO: 516143 - RNA, 16 nt, Human
ugcagagaggcugcug

SEQ ID NO: 516144 - RNA, 32 nt, Human
ugcagagaugccucuggagucccuguggccac

SEQ ID NO: 516145 - RNA, 32 nt, Human
ugcagagauggacaugggcagcuggaggguag

SEQ ID NO: 516146 - RNA, 21 nt, Human
ugcagagauuugcugccagga

SEQ ID NO: 516147 - RNA, 32 nt, Human
ugcagagcaacagggcuucaguauauucacau

SEQ ID NO: 516148 - RNA, 32 nt, Human
ugcagagcaagggagagugaaggaagccaaag

SEQ ID NO: 516149 - RNA, 32 nt, Human
ugcagagcacuuccauacucagccacacauuc

SEQ ID NO: 516150 - RNA, 25 nt, Human
ugcagagcacuuccuuuugguuuuu

SEQ ID NO: 516151 - RNA, 32 nt, Human
ugcagagcagcaagaggcucucuccagaaaac

SEQ ID NO: 516152 - RNA, 21 nt, Human
ugcagagcagcacuaacagug

SEQ ID NO: 516153 - RNA, 18 nt, Human
ugcagagcagcccuguga

SEQ ID NO: 516154 - RNA, 32 nt, Human
ugcagagcagccugggcaacauggugaaaccc

SEQ ID NO: 516155 - RNA, 32 nt, Human
ugcagagccagaagagcacggagcagcaacuc

SEQ ID NO: 516156 - RNA, 32 nt, Human
ugcagagccagccugacccaccagaaccuccc

SEQ ID NO: 516157 - RNA, 32 nt, Human
ugcagagccagccugugcugcccacuuucaga

SEQ ID NO: 516158 - RNA, 20 nt, Human
ugcagagcccaccagaugug

SEQ ID NO: 516159 - RNA, 22 nt, Human
ugcagagcccacugggcacggu

SEQ ID NO: 516160 - RNA, 32 nt, Human
ugcagagcccaggaggcaaauguuuguacacu

SEQ ID NO: 516161 - RNA, 20 nt, Human
ugcagagcccagggcacugg

SEQ ID NO: 516162 - RNA, 22 nt, Human
ugcagagcccccagguggaaga

SEQ ID NO: 516163 - RNA, 19 nt, Human
ugcagagccggacccagug

SEQ ID NO: 516164 - RNA, 24 nt, Human
ugcagagccguccaaccccagucc

SEQ ID NO: 516165 - RNA, 32 nt, Human
ugcagagccgugggcuguagaaggucagaugg

SEQ ID NO: 516166 - RNA, 27 nt, Human
ugcagagccucgcacuggggccagggc

SEQ ID NO: 516167 - RNA, 30 nt, Human
ugcagagccuguccacagcuccuguggggg

SEQ ID NO: 516168 - RNA, 32 nt, Human
ugcagagccuuccuuagcaccauuaggccuuc

SEQ ID NO: 516169 - RNA, 32 nt, Human
ugcagagccuuucuccccuucccggaucauua

SEQ ID NO: 516170 - RNA, 22 nt, Human
ugcagagcgccgugaguucuca

SEQ ID NO: 516171 - RNA, 32 nt, Human
ugcagagcggcggcuggagacuggagccaccg

SEQ ID NO: 516172 - RNA, 19 nt, Human
ugcagagcucacagccagg

SEQ ID NO: 516173 - RNA, 22 nt, Human
ugcagagcucacagggcccagg

SEQ ID NO: 516174 - RNA, 32 nt, Human
ugcagagcucaggagccaguccuggcccccug

SEQ ID NO: 516175 - RNA, 19 nt, Human
ugcagagcuccgggacgug

SEQ ID NO: 516176 - RNA, 32 nt, Human
ugcagagcucggagcggcggaggcagagaccg

SEQ ID NO: 516177 - RNA, 32 nt, Human
ugcagagcucugcuuccugcagccucuccccg

SEQ ID NO: 516178 - RNA, 20 nt, Human
ugcagagcugacccagagug

SEQ ID NO: 516179 - RNA, 21 nt, Human
ugcagagcugauuaaacagug

SEQ ID NO: 516180 - RNA, 32 nt, Human
ugcagagcugggcaguugaggaaaggacagcc

SEQ ID NO: 516181 - RNA, 32 nt, Human
ugcagagcugggcucuaccccaaaaggcuuca

SEQ ID NO: 516182 - RNA, 32 nt, Human
ugcagagcuguggcuuaccagagacucugcuc

SEQ ID NO: 516183 - RNA, 32 nt, Human
ugcagagcuugcugcccuugaauuuccuccaa

SEQ ID NO: 516184 - RNA, 32 nt, Human
ugcagaggaagaucgaugaguucuggugucgg

SEQ ID NO: 516185 - RNA, 32 nt, Human
ugcagaggaaggcugaggcgggaggauugcuu

SEQ ID NO: 516186 - RNA, 32 nt, Human
ugcagaggacagaggccugggucuccaggaga

SEQ ID NO: 516187 - RNA, 32 nt, Human
ugcagaggacaggccaagaaacuccacaucau

SEQ ID NO: 516188 - RNA, 32 nt, Human
ugcagaggacaguggacguggagcugcggggu

SEQ ID NO: 516189 - RNA, 32 nt, Human
ugcagaggagagagacagcgagaagaagccgc

SEQ ID NO: 516190 - RNA, 32 nt, Human
ugcagaggagcauaaaguucaaaaagaucaaa

SEQ ID NO: 516191 - RNA, 32 nt, Human
ugcagaggaggcaccugaggcccagagacgag

SEQ ID NO: 516192 - RNA, 32 nt, Human
ugcagaggagggcagagggaagauugauuugc

SEQ ID NO: 516193 - RNA, 32 nt, Human
ugcagaggaggugagagugggagggagguaac

SEQ ID NO: 516194 - RNA, 32 nt, Human
ugcagaggaguuuucaagaggcuaucuggugu

SEQ ID NO: 516195 - RNA, 32 nt, Human
ugcagaggauggaggucaaaaaccacucccag

SEQ ID NO: 516196 - RNA, 32 nt, Human
ugcagaggcacuccacccugggcacggagauu

SEQ ID NO: 516197 - RNA, 32 nt, Human
ugcagaggccuggguuacacagccugagucac

SEQ ID NO: 516198 - RNA, 32 nt, Human
ugcagaggcucauuccuguaaucccagcucuu

SEQ ID NO: 516199 - RNA, 32 nt, Human
ugcagagggagaggacaacagcuccaguaaac

SEQ ID NO: 516200 - RNA, 32 nt, Human
ugcagagggagggagagccagguccguagcgu

SEQ ID NO: 516201 - RNA, 32 nt, Human
ugcagagggcccaggagggucuugcagucauc

SEQ ID NO: 516202 - RNA, 21 nt, Human
ugcagagggcugggcacggug

SEQ ID NO: 516203 - RNA, 32 nt, Human
ugcagaggggucagcagcaggagaagcguguu

SEQ ID NO: 516204 - RNA, 31 nt, Human
ugcagagggguggaaaauggcagagcugcag

SEQ ID NO: 516205 - RNA, 32 nt, Human
ugcagagguauucaguuccuggcacaggggac

SEQ ID NO: 516206 - RNA, 32 nt, Human
ugcagaggucacuucccuagccucagaugggu

SEQ ID NO: 516207 - RNA, 32 nt, Human
ugcagaggugcagaaccagggacuccugggcc

SEQ ID NO: 516208 - RNA, 32 nt, Human
ugcagaggugcagagucaggugggacccgucg

SEQ ID NO: 516209 - RNA, 32 nt, Human
ugcagaggugccugugucucagccugaccccu

SEQ ID NO: 516210 - RNA, 25 nt, Human
ugcagaguagacugagagcuggggc

SEQ ID NO: 516211 - RNA, 32 nt, Human
ugcagagucaauuuuacaugcccauaaagaca

SEQ ID NO: 516212 - RNA, 23 nt, Human
ugcagagucagcagaacuggggu

SEQ ID NO: 516213 - RNA, 32 nt, Human
ugcagaguccugcaccaggccugggugagugg

SEQ ID NO: 516214 - RNA, 32 nt, Human
ugcagaguccuuccagccuaggccugcagcgc

SEQ ID NO: 516215 - RNA, 32 nt, Human
ugcagagugauggacagcagguggcaucuuac

SEQ ID NO: 516216 - RNA, 32 nt, Human
ugcagagugcaagagaugccucagucaaguca

SEQ ID NO: 516217 - RNA, 32 nt, Human
ugcagagugccuucccugaugcugcagccgga

SEQ ID NO: 516218 - RNA, 18 nt, Human
ugcagagugcugggccaa

SEQ ID NO: 516219 - RNA, 32 nt, Human
ugcagagugggcucccugccccucucugccug

SEQ ID NO: 516220 - RNA, 18 nt, Human
ugcagaguguagaauggu

SEQ ID NO: 516221 - RNA, 32 nt, Human
ugcagaguuauguaacgaacccaacaaugaag

SEQ ID NO: 516222 - RNA, 32 nt, Human
ugcagaguuccuggagcucacagcugagcccg

SEQ ID NO: 516223 - RNA, 32 nt, Human
ugcagauaacacuuaguuaagacaaggucaca

SEQ ID NO: 516224 - RNA, 19 nt, Human
ugcagauacaaccugcucu

SEQ ID NO: 516225 - RNA, 32 nt, Human
ugcagauaccuuacucccagccacuuugccuu

SEQ ID NO: 516226 - RNA, 32 nt, Human
ugcagauaggugaagaaaagcaaaaugaucaa

SEQ ID NO: 516227 - RNA, 32 nt, Human
ugcagauaguaauauauaaacacacacaauga

SEQ ID NO: 516228 - RNA, 32 nt, Human
ugcagauaguacaagccauuucuucaggguuc

SEQ ID NO: 516229 - RNA, 32 nt, Human
ugcagauaucccccagcauugagacccucccc

SEQ ID NO: 516230 - RNA, 32 nt, Human
ugcagauaucucuacaagauccugauuuuaau

SEQ ID NO: 516231 - RNA, 32 nt, Human
ugcagauauuggaauguauggaaguaucucag

SEQ ID NO: 516232 - RNA, 28 nt, Human
ugcagaucaugaggaaggaaaguugaug

SEQ ID NO: 516233 - RNA, 23 nt, Human
ugcagaucccacacucacccuga

SEQ ID NO: 516234 - RNA, 21 nt, Human
ugcagaucccucaggccccga

SEQ ID NO: 516235 - RNA, 32 nt, Human
ugcagaucuacaacaccugccagugccccugc

SEQ ID NO: 516236 - RNA, 32 nt, Human
ugcagaugaagccacagagcaggcgcucgacc

SEQ ID NO: 516237 - RNA, 30 nt, Human
ugcagaugaagccaguuccucccaccacga

SEQ ID NO: 516238 - RNA, 32 nt, Human
ugcagaugccgcccacucccaccccacuccua

SEQ ID NO: 516239 - RNA, 19 nt, Human
ugcagaugcgcagacaugg

SEQ ID NO: 516240 - RNA, 32 nt, Human
ugcagaugcucauguaagcagcuuuucgagag

SEQ ID NO: 516241 - RNA, 32 nt, Human
ugcagauggaaagaggugaaaaugaagaagga

SEQ ID NO: 516242 - RNA, 32 nt, Human
ugcagauggaauaaaaggcagggaccuguucc

SEQ ID NO: 516243 - RNA, 32 nt, Human
ugcagauggaauagggcccugccuugccuugc

SEQ ID NO: 516244 - RNA, 32 nt, Human
ugcagauggagacugaaucugagggcagcaga

SEQ ID NO: 516245 - RNA, 32 nt, Human
ugcagauggaggcaguggcuggagugaaugaa

SEQ ID NO: 516246 - RNA, 32 nt, Human
ugcagaugggcagagggaugcauggggaugca

SEQ ID NO: 516247 - RNA, 32 nt, Human
ugcagauggggcuaggacugugggcuuuuagc

SEQ ID NO: 516248 - RNA, 32 nt, Human
ugcagaugggggaaacugaggaagcaccaggu

SEQ ID NO: 516249 - RNA, 32 nt, Human
ugcagauggggucuuuggaaauguuagucacc

SEQ ID NO: 516250 - RNA, 32 nt, Human
ugcagauguacgugacaaugagacugaccuuu

SEQ ID NO: 516251 - RNA, 32 nt, Human
ugcagauguccucagacgggaagguuugagaa

SEQ ID NO: 516252 - RNA, 32 nt, Human
ugcagaugugagccaccgugccuggccagauu

SEQ ID NO: 516253 - RNA, 32 nt, Human
ugcagaugugagccacugugccaggcuccuuc

SEQ ID NO: 516254 - RNA, 32 nt, Human
ugcagaugugcgccaccaugcccggcuaauuu

SEQ ID NO: 516255 - RNA, 25 nt, Human
ugcagauguuguuuucagguuaaug

SEQ ID NO: 516256 - RNA, 21 nt, Human
ugcagauuaaaguaacuguga

SEQ ID NO: 516257 - RNA, 32 nt, Human
ugcagauucauuuuucuuucugaugucaaaaa

SEQ ID NO: 516258 - RNA, 23 nt, Human
ugcagauucccaggaaugugcua

SEQ ID NO: 516259 - RNA, 32 nt, Human
ugcagauucccaggcugggugcaguggcucac

SEQ ID NO: 516260 - RNA, 21 nt, Human
ugcagauuccuccccuggcca

SEQ ID NO: 516261 - RNA, 32 nt, Human
ugcagauucucauuagcuucagcugggucaug

SEQ ID NO: 516262 - RNA, 32 nt, Human
ugcagauuggggcucccugaggauggggcugu

SEQ ID NO: 516263 - RNA, 32 nt, Human
ugcagauugggugacugaccagacuuguuggg

SEQ ID NO: 516264 - RNA, 29 nt, Human
ugcagauuuggcuggagcuccagaccucc

SEQ ID NO: 516265 - RNA, 32 nt, Human
ugcagauuuuugcaaccuccuccugagccggg

SEQ ID NO: 516266 - RNA, 32 nt, Human
ugcagcaaaaccaacuccaccaaaaagccagg

SEQ ID NO: 516267 - RNA, 32 nt, Human
ugcagcaaaccaccauggcacauguauaccua

SEQ ID NO: 516268 - RNA, 32 nt, Human
ugcagcaaaccaccauggcacguguauaccua

SEQ ID NO: 516269 - RNA, 32 nt, Human
ugcagcaaaguaccauggcacauguauaccug

SEQ ID NO: 516270 - RNA, 32 nt, Human
ugcagcaacagcuucuacuaccagcccuuggg

SEQ ID NO: 516271 - RNA, 32 nt, Human
ugcagcaacaucacuaaccacaucccagacau

SEQ ID NO: 516272 - RNA, 32 nt, Human
ugcagcaacccuauuucuccauccccagugaa

SEQ ID NO: 516273 - RNA, 32 nt, Human
ugcagcaagauggauuugggaaaggaccaauc

SEQ ID NO: 516274 - RNA, 32 nt, Human
ugcagcaagcagauugggaagaccucucacag

SEQ ID NO: 516275 - RNA, 32 nt, Human
ugcagcaagccuugaggcccucaagaaugcag

SEQ ID NO: 516276 - RNA, 23 nt, Human
ugcagcaagcucacagugccccu

SEQ ID NO: 516277 - RNA, 32 nt, Human
ugcagcaauccaaaaggcaguuuguuuggggu

SEQ ID NO: 516278 - RNA, 22 nt, Human
ugcagcaaugaacaguacaucu

SEQ ID NO: 516279 - RNA, 32 nt, Human
ugcagcaauggccuggugauucccacacaucc

SEQ ID NO: 516280 - RNA, 32 nt, Human
ugcagcacaccaacauggcacauguauacaua

SEQ ID NO: 516281 - RNA, 32 nt, Human
ugcagcacaccaacauggcauauguauacaua

SEQ ID NO: 516282 - RNA, 32 nt, Human
ugcagcacaccagcauggcacagguauacaua

SEQ ID NO: 516283 - RNA, 32 nt, Human
ugcagcacaccagcauggcacaugaauacaca

SEQ ID NO: 516284 - RNA, 32 nt, Human
ugcagcacaccagcauggcacauguauacaua

SEQ ID NO: 516285 - RNA, 32 nt, Human
ugcagcacaccaucauggcaccuguauacaua

SEQ ID NO: 516286 - RNA, 32 nt, Human
ugcagcacagagcgggcaaagccaggcaggcc

SEQ ID NO: 516287 - RNA, 22 nt, Human
ugcagcacagcccgcauucaca

SEQ ID NO: 516288 - RNA, 32 nt, Human
ugcagcacaggaguucaaggcuucagugagcu

SEQ ID NO: 516289 - RNA, 32 nt, Human
ugcagcacagggcuucugugaggaccacaaaa

SEQ ID NO: 516290 - RNA, 32 nt, Human
ugcagcacccacccuaaagcccccuccaaaua

SEQ ID NO: 516291 - RNA, 32 nt, Human
ugcagcacccaggacacagccagcaugaacug

SEQ ID NO: 516292 - RNA, 32 nt, Human
ugcagcacccaugacagaaaucaaagaguuga

SEQ ID NO: 516293 - RNA, 20 nt, Human
ugcagcaccuuccucacaca

SEQ ID NO: 516294 - RNA, 32 nt, Human
ugcagcacuaggggagggggcagauggugguu

SEQ ID NO: 516295 - RNA, 32 nt, Human
ugcagcacucuuaucuacauaaggaugaaggu

SEQ ID NO: 516296 - RNA, 32 nt, Human
ugcagcacugcaccacccugcaacaccucagg

SEQ ID NO: 516297 - RNA, 32 nt, Human
ugcagcacuggggaagugacagaaugugaaaa

SEQ ID NO: 516298 - RNA, 23 nt, Human
ugcagcacuucugggucguugca

SEQ ID NO: 516299 - RNA, 32 nt, Human
ugcagcacuuguaaaccacacacacagccucu

SEQ ID NO: 516300 - RNA, 24 nt, Human
ugcagcacuuucugaggcuuucac

SEQ ID NO: 516301 - RNA, 32 nt, Human
ugcagcagaagcugcccacauucugaccaaug

SEQ ID NO: 516302 - RNA, 24 nt, Human
ugcagcagacuacacaguacuucu

SEQ ID NO: 516303 - RNA, 27 nt, Human
ugcagcagagccuugaaggagugugua

SEQ ID NO: 516304 - RNA, 32 nt, Human
ugcagcagaggaacuccuauaaccaccaccag

SEQ ID NO: 516305 - RNA, 32 nt, Human
ugcagcagagggcagaaggcuugcacuugggc

SEQ ID NO: 516306 - RNA, 32 nt, Human
ugcagcagagugacagcaguggagauugagag

SEQ ID NO: 516307 - RNA, 32 nt, Human
ugcagcagagugaggagugagggcagcugaca

SEQ ID NO: 516308 - RNA, 22 nt, Human
ugcagcagagugaggcuggggc

SEQ ID NO: 516309 - RNA, 32 nt, Human
ugcagcagaguuuggcaggcacugcugugcac

SEQ ID NO: 516310 - RNA, 22 nt, Human
ugcagcagaucauugagcuggg

SEQ ID NO: 516311 - RNA, 32 nt, Human
ugcagcagauccagagacagaggcagccuguc

SEQ ID NO: 516312 - RNA, 32 nt, Human
ugcagcagauuccacagacaaagagcccauuc

SEQ ID NO: 516313 - RNA, 32 nt, Human
ugcagcagcaaccggauuucagccugggccuc

SEQ ID NO: 516314 - RNA, 32 nt, Human
ugcagcagcaggcagaugaugcagaggagcga

SEQ ID NO: 516315 - RNA, 32 nt, Human
ugcagcagcaggggcaagacccuggguccagu

SEQ ID NO: 516316 - RNA, 32 nt, Human
ugcagcagcauggugacugccucuguguggcc

SEQ ID NO: 516317 - RNA, 25 nt, Human
ugcagcagcauuggaaggcuggggc

SEQ ID NO: 516318 - RNA, 32 nt, Human
ugcagcagccacauccauacacacacgcucgc

SEQ ID NO: 516319 - RNA, 32 nt, Human
ugcagcagcccguuccccuccucggugccgcc

SEQ ID NO: 516320 - RNA, 32 nt, Human
ugcagcagccugaaacuugagagcgaaaguga

SEQ ID NO: 516321 - RNA, 32 nt, Human
ugcagcagcggagacagucgccagcagcuggg

SEQ ID NO: 516322 - RNA, 32 nt, Human
ugcagcagcucacaccucucugcgguucccuc

SEQ ID NO: 516323 - RNA, 32 nt, Human
ugcagcagcuccuccagcugcaccaccuucag

SEQ ID NO: 516324 - RNA, 32 nt, Human
ugcagcagcugcaguaagccaagaucaugcug

SEQ ID NO: 516325 - RNA, 32 nt, Human
ugcagcaggaaggaggacucuuuugccgcgga

SEQ ID NO: 516326 - RNA, 32 nt, Human
ugcagcaggacuagcugucaccucccgcccgc

SEQ ID NO: 516327 - RNA, 32 nt, Human
ugcagcaggaggcagagcugugggaugaauga

SEQ ID NO: 516328 - RNA, 32 nt, Human
ugcagcaggaggccagaggacagagcagagga

SEQ ID NO: 516329 - RNA, 32 nt, Human
ugcagcaggaggggcaggcucagaguuaagca

SEQ ID NO: 516330 - RNA, 32 nt, Human
ugcagcaggccugcugggagcucggagauggu

SEQ ID NO: 516331 - RNA, 32 nt, Human
ugcagcagggccuggggcugagccugggcugc

SEQ ID NO: 516332 - RNA, 32 nt, Human
ugcagcagggugucugggcauugguggcucca

SEQ ID NO: 516333 - RNA, 32 nt, Human
ugcagcaggugccaccaccaccacaaaagaca

SEQ ID NO: 516334 - RNA, 32 nt, Human
ugcagcaguccaggugcacacuaagaacagcc

SEQ ID NO: 516335 - RNA, 32 nt, Human
ugcagcaguccaggugcacacuagaacagccu

SEQ ID NO: 516336 - RNA, 32 nt, Human
ugcagcagucccaugccccacacucugagucu

SEQ ID NO: 516337 - RNA, 32 nt, Human
ugcagcagucccgugccccacacucugagucu

SEQ ID NO: 516338 - RNA, 32 nt, Human
ugcagcagugccuucuucauccuuccuuacga

SEQ ID NO: 516339 - RNA, 32 nt, Human
ugcagcaguggcgccuccuagcucaggacagu

SEQ ID NO: 516340 - RNA, 32 nt, Human
ugcagcauacgcaggagccuauccugaauuuu

SEQ ID NO: 516341 - RNA, 32 nt, Human
ugcagcaucagcccuguuggaaaaggacaagg

SEQ ID NO: 516342 - RNA, 19 nt, Human
ugcagcaucuaccugcucc

SEQ ID NO: 516343 - RNA, 32 nt, Human
ugcagcaugaacacaauuucucuccaccuggc

SEQ ID NO: 516344 - RNA, 22 nt, Human
ugcagcaugaaggcccuugcca

SEQ ID NO: 516345 - RNA, 32 nt, Human
ugcagcaugccaauauggcacauguauacaua

SEQ ID NO: 516346 - RNA, 32 nt, Human
ugcagcaugccauuuggcuuucccaccuaaac

SEQ ID NO: 516347 - RNA, 32 nt, Human
ugcagcauggcagaggcggcauggcagaggcg

SEQ ID NO: 516348 - RNA, 32 nt, Human
ugcagcauuaugcuuugggcaguauuacaaaa

SEQ ID NO: 516349 - RNA, 32 nt, Human
ugcagcauugcacuccagccugggugacagaa

SEQ ID NO: 516350 - RNA, 32 nt, Human
ugcagcauuuaaaucacuguguuuuccuuguu

SEQ ID NO: 516351 - RNA, 32 nt, Human
ugcagcauuuggagucucucucuugcugagga

SEQ ID NO: 516352 - RNA, 32 nt, Human
ugcagccaaacuuggccucugaagggggaagg

SEQ ID NO: 516353 - RNA, 32 nt, Human
ugcagccaaccaaccuggcacauguauucaua

SEQ ID NO: 516354 - RNA, 32 nt, Human
ugcagccaaccacacgagcaauacugugcugg

SEQ ID NO: 516355 - RNA, 32 nt, Human
ugcagccaagcccagccccguggggaagggga

SEQ ID NO: 516356 - RNA, 23 nt, Human
ugcagccaagcucggcacuuugu

SEQ ID NO: 516357 - RNA, 21 nt, Human
ugcagccaaggcuguccccgc

SEQ ID NO: 516358 - RNA, 32 nt, Human
ugcagccaaguucacugucacgggggaaggag

SEQ ID NO: 516359 - RNA, 20 nt, Human
ugcagccaaugaccagaagc

SEQ ID NO: 516360 - RNA, 32 nt, Human
ugcagccaauugccuguugcagcuguggccac

SEQ ID NO: 516361 - RNA, 32 nt, Human
ugcagccacagaacaccuggugucaucagggc

SEQ ID NO: 516362 - RNA, 19 nt, Human
ugcagccacagcuccucca

SEQ ID NO: 516363 - RNA, 32 nt, Human
ugcagccacagcugcagccgcaggcccugcac

SEQ ID NO: 516364 - RNA, 32 nt, Human
ugcagccaccauguucagcuggcugaagcggg

SEQ ID NO: 516365 - RNA, 32 nt, Human
ugcagccaccguccugacguucaucggagcag

SEQ ID NO: 516366 - RNA, 23 nt, Human
ugcagccacgcaccucccgaucc

SEQ ID NO: 516367 - RNA, 24 nt, Human
ugcagccacugccucccagguuca

SEQ ID NO: 516368 - RNA, 24 nt, Human
ugcagccacugccuccuggguuca

SEQ ID NO: 516369 - RNA, 21 nt, Human
ugcagccagaacagguggcug

SEQ ID NO: 516370 - RNA, 32 nt, Human
ugcagccagaagccagaggauacccagggaca

SEQ ID NO: 516371 - RNA, 18 nt, Human
ugcagccagaauugugcu

SEQ ID NO: 516372 - RNA, 32 nt, Human
ugcagccagaccuauuccuccugggccccuca

SEQ ID NO: 516373 - RNA, 19 nt, Human
ugcagccagacuggaugcu

SEQ ID NO: 516374 - RNA, 32 nt, Human
ugcagccagagaaugcccacugccuguaacag

SEQ ID NO: 516375 - RNA, 21 nt, Human
ugcagccagcacccugggcuc

SEQ ID NO: 516376 - RNA, 21 nt, Human
ugcagccagccaccaacggcc

SEQ ID NO: 516377 - RNA, 32 nt, Human
ugcagccagccaucaaauagugaauggucucu

SEQ ID NO: 516378 - RNA, 23 nt, Human
ugcagccagcucuccugggauca

SEQ ID NO: 516379 - RNA, 32 nt, Human
ugcagccagcuggccugcacuggguguggaga

SEQ ID NO: 516380 - RNA, 20 nt, Human
ugcagccaggagaccgaugc

SEQ ID NO: 516381 - RNA, 18 nt, Human
ugcagccaggagacuugc

SEQ ID NO: 516382 - RNA, 32 nt, Human
ugcagccaggagacuugcaagggauuggugau

SEQ ID NO: 516383 - RNA, 32 nt, Human
ugcagccaggagagcagcaguuugcagcugac

SEQ ID NO: 516384 - RNA, 32 nt, Human
ugcagccaggcagaggcgaggaaggcuucucc

SEQ ID NO: 516385 - RNA, 32 nt, Human
ugcagccaggguagcugaaguuugggucuggg

SEQ ID NO: 516386 - RNA, 32 nt, Human
ugcagccagguaucucagguugcaauggucag

SEQ ID NO: 516387 - RNA, 32 nt, Human
ugcagccaguccagagagaauagagccugccc

SEQ ID NO: 516388 - RNA, 20 nt, Human
ugcagccaguuccaaugcug

SEQ ID NO: 516389 - RNA, 21 nt, Human
ugcagccaugaagggaugcua

SEQ ID NO: 516390 - RNA, 32 nt, Human
ugcagccaugucacuccucuugcugguggucu

SEQ ID NO: 516391 - RNA, 32 nt, Human
ugcagccauuuugccaccaugggaaaccuggg

SEQ ID NO: 516392 - RNA, 32 nt, Human
ugcagcccaacaaacaagggaacuaggaccga

SEQ ID NO: 516393 - RNA, 32 nt, Human
ugcagcccaaggcauccucugugucuccuacu

SEQ ID NO: 516394 - RNA, 32 nt, Human
ugcagcccacaggaguccagggaaggcgggga

SEQ ID NO: 516395 - RNA, 32 nt, Human
ugcagcccaccuggcuggaggugugcuggcuc

SEQ ID NO: 516396 - RNA, 32 nt, Human
ugcagcccagagcugcugggcccacuggccgu

SEQ ID NO: 516397 - RNA, 32 nt, Human
ugcagcccaggcccagugggggccagaggauc

SEQ ID NO: 516398 - RNA, 24 nt, Human
ugcagcccaggcuggagugcagug

SEQ ID NO: 516399 - RNA, 32 nt, Human
ugcagcccaguguggaggggcgagacuugggg

SEQ ID NO: 516400 - RNA, 32 nt, Human
ugcagcccauccgcgaccucaccaagaacugg

SEQ ID NO: 516401 - RNA, 32 nt, Human
ugcagcccauggagagcaacuacacggugcug

SEQ ID NO: 516402 - RNA, 32 nt, Human
ugcagccccagccugagcagcagccguucuca

SEQ ID NO: 516403 - RNA, 32 nt, Human
ugcagccccagcuggacuccagccugucccuc

SEQ ID NO: 516404 - RNA, 32 nt, Human
ugcagccccaggaagucccagaccuaaaacaa

SEQ ID NO: 516405 - RNA, 32 nt, Human
ugcagccccaggacuggacgaccugagacugc

SEQ ID NO: 516406 - RNA, 20 nt, Human
ugcagccccaggccccggcc

SEQ ID NO: 516407 - RNA, 32 nt, Human
ugcagccccauacccauacccaacccauugac

SEQ ID NO: 516408 - RNA, 18 nt, Human
ugcagccccaucuccuca

SEQ ID NO: 516409 - RNA, 22 nt, Human
ugcagccccauuucccaagcuc

SEQ ID NO: 516410 - RNA, 32 nt, Human
ugcagcccccgaccucccgggcucaggugauu

SEQ ID NO: 516411 - RNA, 32 nt, Human
ugcagcccccgccacccuuccuucccuucccu

SEQ ID NO: 516412 - RNA, 32 nt, Human
ugcagcccccggcauugaccuccugggugucc

SEQ ID NO: 516413 - RNA, 32 nt, Human
ugcagccccucccagccucucccgcuaggaga

SEQ ID NO: 516414 - RNA, 32 nt, Human
ugcagccccugccuucccugggugggcugaug

SEQ ID NO: 516415 - RNA, 32 nt, Human
ugcagccccuguccgggccucuugccugccgc

SEQ ID NO: 516416 - RNA, 32 nt, Human
ugcagcccgaaaccuccagucacugcgcccgg

SEQ ID NO: 516417 - RNA, 32 nt, Human
ugcagcccgccuggcccagcggccaggccugc

SEQ ID NO: 516418 - RNA, 32 nt, Human
ugcagcccggcuucccgcugcagcacgacggu

SEQ ID NO: 516419 - RNA, 32 nt, Human
ugcagcccgugaauucaagaccagccuggcca

SEQ ID NO: 516420 - RNA, 32 nt, Human
ugcagcccuagugccuuagcuccaugcccggc

SEQ ID NO: 516421 - RNA, 32 nt, Human
ugcagcccuccagcucuggcccucagcugcuu

SEQ ID NO: 516422 - RNA, 25 nt, Human
ugcagcccucgaccuccugggcuca

SEQ ID NO: 516423 - RNA, 32 nt, Human
ugcagcccucgaccuccugggcucaagugauc

SEQ ID NO: 516424 - RNA, 32 nt, Human
ugcagcccucuuggggcuccaggauuugcuga

SEQ ID NO: 516425 - RNA, 32 nt, Human
ugcagcccugcaggugccugggcacugaugga

SEQ ID NO: 516426 - RNA, 32 nt, Human
ugcagcccugcuccagccuuggccucuccuga

SEQ ID NO: 516427 - RNA, 32 nt, Human
ugcagcccuugccucuuucccacagguuccac

SEQ ID NO: 516428 - RNA, 21 nt, Human
ugcagccgcugccuccugggc

SEQ ID NO: 516429 - RNA, 32 nt, Human
ugcagccggacccugcucgaugggcacgacug

SEQ ID NO: 516430 - RNA, 32 nt, Human
ugcagccggcggaucccucuucccaggcuccg

SEQ ID NO: 516431 - RNA, 19 nt, Human
ugcagccgugaagaaugcu

SEQ ID NO: 516432 - RNA, 32 nt, Human
ugcagccguggucccguccacgcccaccucag

SEQ ID NO: 516433 - RNA, 32 nt, Human
ugcagccguucugaacaccacccuccauuuca

SEQ ID NO: 516434 - RNA, 24 nt, Human
ugcagccuagaccugcugggcuca

SEQ ID NO: 516435 - RNA, 32 nt, Human
ugcagccuaggugacagagcgagacccugucu

SEQ ID NO: 516436 - RNA, 32 nt, Human
ugcagccuaguggaaggugcugagggggcccu

SEQ ID NO: 516437 - RNA, 32 nt, Human
ugcagccuauggaucaaggagugauuucaacu

SEQ ID NO: 516438 - RNA, 24 nt, Human
ugcagccucaaacuacugggcuca

SEQ ID NO: 516439 - RNA, 24 nt, Human
ugcagccucaaacuccuaggcuca

SEQ ID NO: 516440 - RNA, 24 nt, Human
ugcagccucaaacuccugagccca

SEQ ID NO: 516441 - RNA, 23 nt, Human
ugcagccucaaacuccugggcuc

SEQ ID NO: 516442 - RNA, 24 nt, Human
ugcagccucaaacuccugggcuca

SEQ ID NO: 516443 - RNA, 24 nt, Human
ugcagccucaaauuccugggcuca

SEQ ID NO: 516444 - RNA, 24 nt, Human
ugcagccucaaccucccaggcuca

SEQ ID NO: 516445 - RNA, 24 nt, Human
ugcagccucaaccuccugagcuca

SEQ ID NO: 516446 - RNA, 24 nt, Human
ugcagccucaaccuccuggacuca

SEQ ID NO: 516447 - RNA, 22 nt, Human
ugcagccucaaccuccugggcu

SEQ ID NO: 516448 - RNA, 24 nt, Human
ugcagccucaaccuccugggcuca

SEQ ID NO: 516449 - RNA, 24 nt, Human
ugcagccucaaccugcugggcuca

SEQ ID NO: 516450 - RNA, 21 nt, Human
ugcagccucaaccuggguuca

SEQ ID NO: 516451 - RNA, 24 nt, Human
ugcagccucaacuucccaggcuca

SEQ ID NO: 516452 - RNA, 24 nt, Human
ugcagccucaacuuccuggacuca

SEQ ID NO: 516453 - RNA, 24 nt, Human
ugcagccucaaucuccuggucuca

SEQ ID NO: 516454 - RNA, 24 nt, Human
ugcagccucaaucuuccaggcuca

SEQ ID NO: 516455 - RNA, 24 nt, Human
ugcagccucagacuccuggguuca

SEQ ID NO: 516456 - RNA, 24 nt, Human
ugcagccucagcguccugggcuca

SEQ ID NO: 516457 - RNA, 24 nt, Human
ugcagccucauacuccugggcuca

SEQ ID NO: 516458 - RNA, 24 nt, Human
ugcagccuccaacuccuagccuca

SEQ ID NO: 516459 - RNA, 24 nt, Human
ugcagccuccaacuccugggcuca

SEQ ID NO: 516460 - RNA, 32 nt, Human
ugcagccuccaccccuacagugcugccaucug

SEQ ID NO: 516461 - RNA, 19 nt, Human
ugcagccuccacccggcuc

SEQ ID NO: 516462 - RNA, 24 nt, Human
ugcagccuccaccuccagaguuca

SEQ ID NO: 516463 - RNA, 24 nt, Human
ugcagccuccaccuccaggguuca

SEQ ID NO: 516464 - RNA, 24 nt, Human
ugcagccuccaccucccaggcuca

SEQ ID NO: 516465 - RNA, 24 nt, Human
ugcagccuccaccucccagguuca

SEQ ID NO: 516466 - RNA, 23 nt, Human
ugcagccuccaccuccccgguuc

SEQ ID NO: 516467 - RNA, 24 nt, Human
ugcagccuccaccuccccgguuca

SEQ ID NO: 516468 - RNA, 23 nt, Human
ugcagccuccaccucccgggcuc

SEQ ID NO: 516469 - RNA, 24 nt, Human
ugcagccuccaccucccggguuca

SEQ ID NO: 516470 - RNA, 24 nt, Human
ugcagccuccaccuccuaggcuca

SEQ ID NO: 516471 - RNA, 23 nt, Human
ugcagccuccaccuccugggcuc

SEQ ID NO: 516472 - RNA, 24 nt, Human
ugcagccuccaccuccugggcuca

SEQ ID NO: 516473 - RNA, 24 nt, Human
ugcagccuccaccuccuggguuca

SEQ ID NO: 516474 - RNA, 23 nt, Human
ugcagccuccaccuccuugacuc

SEQ ID NO: 516475 - RNA, 24 nt, Human
ugcagccuccaccugccaggcuca

SEQ ID NO: 516476 - RNA, 24 nt, Human
ugcagccuccacuuccuggguuca

SEQ ID NO: 516477 - RNA, 32 nt, Human
ugcagccuccauccucuggguucaagcaauuc

SEQ ID NO: 516478 - RNA, 32 nt, Human
ugcagccuccaucucccggggcucaggugauu

SEQ ID NO: 516479 - RNA, 24 nt, Human
ugcagccuccaucucccggguuca

SEQ ID NO: 516480 - RNA, 24 nt, Human
ugcagccuccaucuccuaggcuca

SEQ ID NO: 516481 - RNA, 24 nt, Human
ugcagccuccaucuccugggcuca

SEQ ID NO: 516482 - RNA, 24 nt, Human
ugcagccuccccaaucccagccca

SEQ ID NO: 516483 - RNA, 32 nt, Human
ugcagccucccugccucacauugcuaagacuc

SEQ ID NO: 516484 - RNA, 32 nt, Human
ugcagccuccgacuccugcuggcuccaggaac

SEQ ID NO: 516485 - RNA, 24 nt, Human
ugcagccuccgccaccuggguuca

SEQ ID NO: 516486 - RNA, 24 nt, Human
ugcagccuccgccucccgaguuca

SEQ ID NO: 516487 - RNA, 24 nt, Human
ugcagccuccgccucccggguuca

SEQ ID NO: 516488 - RNA, 24 nt, Human
ugcagccuccgcuuccuggguuca

SEQ ID NO: 516489 - RNA, 22 nt, Human
ugcagccuccguccuggccuca

SEQ ID NO: 516490 - RNA, 32 nt, Human
ugcagccuccucccccugagcauucauucucu

SEQ ID NO: 516491 - RNA, 23 nt, Human
ugcagccuccucccuaaagcuca

SEQ ID NO: 516492 - RNA, 32 nt, Human
ugcagccuccucucccccagcuccuggaagca

SEQ ID NO: 516493 - RNA, 24 nt, Human
ugcagccuccuucuccugggucca

SEQ ID NO: 516494 - RNA, 22 nt, Human
ugcagccucgaacaccugggcu

SEQ ID NO: 516495 - RNA, 24 nt, Human
ugcagccucgaacuccugggcuca

SEQ ID NO: 516496 - RNA, 24 nt, Human
ugcagccucgaacuccugggcuua

SEQ ID NO: 516497 - RNA, 24 nt, Human
ugcagccucgaaucccugggcuca

SEQ ID NO: 516498 - RNA, 23 nt, Human
ugcagccucgacaccuggguuca

SEQ ID NO: 516499 - RNA, 23 nt, Human
ugcagccucgaccucccaggcuc

SEQ ID NO: 516500 - RNA, 24 nt, Human
ugcagccucgaccucccaggcuca

SEQ ID NO: 516501 - RNA, 24 nt, Human
ugcagccucgaccuccccagcuca

SEQ ID NO: 516502 - RNA, 24 nt, Human
ugcagccucgaccucccgggcuca

SEQ ID NO: 516503 - RNA, 25 nt, Human
ugcagccucgaccucccugggcuca

SEQ ID NO: 516504 - RNA, 24 nt, Human
ugcagccucgaccuccugggcuca

SEQ ID NO: 516505 - RNA, 24 nt, Human
ugcagccucgacuuccugggcuca

SEQ ID NO: 516506 - RNA, 32 nt, Human
ugcagccucggcagggcagguacaggggccac

SEQ ID NO: 516507 - RNA, 24 nt, Human
ugcagccucuaacuccugggcuca

SEQ ID NO: 516508 - RNA, 24 nt, Human
ugcagccucuaccuccccaggcuc

SEQ ID NO: 516509 - RNA, 24 nt, Human
ugcagccucuauuucccaggcuca

SEQ ID NO: 516510 - RNA, 32 nt, Human
ugcagccucucaucucacacugugaguccagc

SEQ ID NO: 516511 - RNA, 21 nt, Human
ugcagccucuccccgaccuca

SEQ ID NO: 516512 - RNA, 32 nt, Human
ugcagccucugccuccagcccggcagcucugg

SEQ ID NO: 516513 - RNA, 24 nt, Human
ugcagccucugccucccagguuca

SEQ ID NO: 516514 - RNA, 24 nt, Human
ugcagccucugccuccuggguuca

SEQ ID NO: 516515 - RNA, 32 nt, Human
ugcagccucugccucucucagccgcaucaccc

SEQ ID NO: 516516 - RNA, 32 nt, Human
ugcagccucugccuucugggcucacgugaucc

SEQ ID NO: 516517 - RNA, 32 nt, Human
ugcagccucugcucagaacgcccuuccuccag

SEQ ID NO: 516518 - RNA, 23 nt, Human
ugcagccucugucccuggguuca

SEQ ID NO: 516519 - RNA, 24 nt, Human
ugcagccucugucucccgggcuca

SEQ ID NO: 516520 - RNA, 32 nt, Human
ugcagccugcaaucccagcuacuugagaggcu

SEQ ID NO: 516521 - RNA, 21 nt, Human
ugcagccugcagaacuggggc

SEQ ID NO: 516522 - RNA, 32 nt, Human
ugcagccugcagccuccggccggccggcgagc

SEQ ID NO: 516523 - RNA, 32 nt, Human
ugcagccugccuggcuccgccccuagugcccc

SEQ ID NO: 516524 - RNA, 19 nt, Human
ugcagccugcggggccaag

SEQ ID NO: 516525 - RNA, 32 nt, Human
ugcagccugcucccuccuacccuggccucaag

SEQ ID NO: 516526 - RNA, 32 nt, Human
ugcagccuggaaccuccagucacugugccagc

SEQ ID NO: 516527 - RNA, 24 nt, Human
ugcagccuggaacuccugggauca

SEQ ID NO: 516528 - RNA, 24 nt, Human
ugcagccuggaacuccugggcuca

SEQ ID NO: 516529 - RNA, 24 nt, Human
ugcagccuggaacuccuuggcuca

SEQ ID NO: 516530 - RNA, 24 nt, Human
ugcagccuggaauuccugggcuca

SEQ ID NO: 516531 - RNA, 32 nt, Human
ugcagccuggacaacaugaugagauccccauc

SEQ ID NO: 516532 - RNA, 32 nt, Human
ugcagccuggacaguagagcgagaccccaucu

SEQ ID NO: 516533 - RNA, 24 nt, Human
ugcagccuggaccuccuagccuca

SEQ ID NO: 516534 - RNA, 21 nt, Human
ugcagccuggagcuccugggc

SEQ ID NO: 516535 - RNA, 32 nt, Human
ugcagccuggaugacagagcgagacucuaucu

SEQ ID NO: 516536 - RNA, 22 nt, Human
ugcagccuggcugggcuggagc

SEQ ID NO: 516537 - RNA, 32 nt, Human
ugcagccugggaggagcuuuugcugcggaugc

SEQ ID NO: 516538 - RNA, 31 nt, Human
ugcagccugggcaacacagugagacccuguc

SEQ ID NO: 516539 - RNA, 32 nt, Human
ugcagccugggcaacagaaugagacugugucu

SEQ ID NO: 516540 - RNA, 32 nt, Human
ugcagccugggcaacauagcaagacucugucu

SEQ ID NO: 516541 - RNA, 32 nt, Human
ugcagccugggcgacagagcgagauucugccu

SEQ ID NO: 516542 - RNA, 32 nt, Human
ugcagccugggugacaaagcaagacccugugu

SEQ ID NO: 516543 - RNA, 32 nt, Human
ugcagccugggugacacuccagccugggugac

SEQ ID NO: 516544 - RNA, 32 nt, Human
ugcagccugggugacagaaugagacugcaucu

SEQ ID NO: 516545 - RNA, 32 nt, Human
ugcagccugggugacagaaugugacucugucu

SEQ ID NO: 516546 - RNA, 32 nt, Human
ugcagccugggugacagagcaagacccugucu

SEQ ID NO: 516547 - RNA, 32 nt, Human
ugcagccugggugacagagugagacucugucu

SEQ ID NO: 516548 - RNA, 32 nt, Human
ugcagccuggguggcagagugagacccagucu

SEQ ID NO: 516549 - RNA, 32 nt, Human
ugcagccugguguuuuaccuccuucacucucu

SEQ ID NO: 516550 - RNA, 32 nt, Human
ugcagccugguuggcagcaucugcuccaucgg

SEQ ID NO: 516551 - RNA, 32 nt, Human
ugcagccugucaucccugucugugaccauugg

SEQ ID NO: 516552 - RNA, 24 nt, Human
ugcagccugugucuccuggguuca

SEQ ID NO: 516553 - RNA, 24 nt, Human
ugcagccuucaauuccugggcuca

SEQ ID NO: 516554 - RNA, 24 nt, Human
ugcagccuucaccucccggguuca

SEQ ID NO: 516555 - RNA, 32 nt, Human
ugcagccuuccagauuuagaggcacugggagg

SEQ ID NO: 516556 - RNA, 32 nt, Human
ugcagccuucgagggccagcccucuccgaguc

SEQ ID NO: 516557 - RNA, 24 nt, Human
ugcagccuucgccucccggguuca

SEQ ID NO: 516558 - RNA, 24 nt, Human
ugcagccuugaacaccugagcuca

SEQ ID NO: 516559 - RNA, 24 nt, Human
ugcagccuugaacaccuggacuca

SEQ ID NO: 516560 - RNA, 24 nt, Human
ugcagccuugaacuccuaggcuca

SEQ ID NO: 516561 - RNA, 24 nt, Human
ugcagccuugaacuccugagcuca

SEQ ID NO: 516562 - RNA, 24 nt, Human
ugcagccuugaacuccuggccuca

SEQ ID NO: 516563 - RNA, 24 nt, Human
ugcagccuugaacuccugggauca

SEQ ID NO: 516564 - RNA, 22 nt, Human
ugcagccuugaacuccugggcu

SEQ ID NO: 516565 - RNA, 24 nt, Human
ugcagccuugaacuccugggcuca

SEQ ID NO: 516566 - RNA, 24 nt, Human
ugcagccuugaacuccugggcuua

SEQ ID NO: 516567 - RNA, 23 nt, Human
ugcagccuugaacucugggcuca

SEQ ID NO: 516568 - RNA, 23 nt, Human
ugcagccuugaauuccugggcuc

SEQ ID NO: 516569 - RNA, 24 nt, Human
ugcagccuugaccucaugggcuca

SEQ ID NO: 516570 - RNA, 24 nt, Human
ugcagccuugaccuccagggcuca

SEQ ID NO: 516571 - RNA, 24 nt, Human
ugcagccuugaccucccaggcuca

SEQ ID NO: 516572 - RNA, 24 nt, Human
ugcagccuugaccucccgggcuca

SEQ ID NO: 516573 - RNA, 24 nt, Human
ugcagccuugaccuccuaggauca

SEQ ID NO: 516574 - RNA, 24 nt, Human
ugcagccuugaccuccugagcuca

SEQ ID NO: 516575 - RNA, 22 nt, Human
ugcagccuugaccuccugggcu

SEQ ID NO: 516576 - RNA, 24 nt, Human
ugcagccuugaccuccugggcuca

SEQ ID NO: 516577 - RNA, 24 nt, Human
ugcagccuugacuuccugggcuca

SEQ ID NO: 516578 - RNA, 24 nt, Human
ugcagccuugaucucccaggcuca

SEQ ID NO: 516579 - RNA, 24 nt, Human
ugcagccuugauuucccgggcuca

SEQ ID NO: 516580 - RNA, 25 nt, Human
ugcagccuuggcuucccugggcuca

SEQ ID NO: 516581 - RNA, 24 nt, Human
ugcagccuuguccucccaggcuca

SEQ ID NO: 516582 - RNA, 32 nt, Human
ugcagccuugugacuuuuauaaaacaagugau

SEQ ID NO: 516583 - RNA, 32 nt, Human
ugcagccuuguggauuuuccacacagcagcuu

SEQ ID NO: 516584 - RNA, 23 nt, Human
ugcagccuuguguccaccaccaa

SEQ ID NO: 516585 - RNA, 24 nt, Human
ugcagccuuuaacuacugggcuca

SEQ ID NO: 516586 - RNA, 32 nt, Human
ugcagccuuugcagaccacacagcucgguccc

SEQ ID NO: 516587 - RNA, 22 nt, Human
ugcagccuuuggcucaagcuca

SEQ ID NO: 516588 - RNA, 32 nt, Human
ugcagcgacauggagggagcugcuuugcugag

SEQ ID NO: 516589 - RNA, 21 nt, Human
ugcagcgagcagccggcgcgg

SEQ ID NO: 516590 - RNA, 32 nt, Human
ugcagcgaggucugggaacacccugggugagg

SEQ ID NO: 516591 - RNA, 32 nt, Human
ugcagcgagguugaugcccagguccagcacug

SEQ ID NO: 516592 - RNA, 32 nt, Human
ugcagcgaucauggcucagugcagccucaaac

SEQ ID NO: 516593 - RNA, 32 nt, Human
ugcagcgcaccagcacggcacauguauacaua

SEQ ID NO: 516594 - RNA, 32 nt, Human
ugcagcgcaccagcauggcacauguauacaua

SEQ ID NO: 516595 - RNA, 32 nt, Human
ugcagcgcaccagcauggcacauguauacgua

SEQ ID NO: 516596 - RNA, 32 nt, Human
ugcagcgcaccagcguggcacauguauacaua

SEQ ID NO: 516597 - RNA, 22 nt, Human
ugcagcgccacaguccccggcc

SEQ ID NO: 516598 - RNA, 32 nt, Human
ugcagcgccagccucacuaucaguguggacac

SEQ ID NO: 516599 - RNA, 32 nt, Human
ugcagcgccucgggggaucccuggccgcgcau

SEQ ID NO: 516600 - RNA, 22 nt, Human
ugcagcgccuucaaauguuuau

SEQ ID NO: 516601 - RNA, 32 nt, Human
ugcagcgccuugcugggcuccuggguuggacu

SEQ ID NO: 516602 - RNA, 32 nt, Human
ugcagcgcgaacacaaacaggcccagcagagc

SEQ ID NO: 516603 - RNA, 32 nt, Human
ugcagcgcgcuccugaccccucccugcagggg

SEQ ID NO: 516604 - RNA, 32 nt, Human
ugcagcgcgggugggagccccgggcggaaccg

SEQ ID NO: 516605 - RNA, 23 nt, Human
ugcagcgcugagauuccuuuaca

SEQ ID NO: 516606 - RNA, 32 nt, Human
ugcagcggacuugcuccagccugggugaggag

SEQ ID NO: 516607 - RNA, 32 nt, Human
ugcagcggagagucugcccaccccggagacac

SEQ ID NO: 516608 - RNA, 32 nt, Human
ugcagcggaggcacuuuggaagaaugacucug

SEQ ID NO: 516609 - RNA, 22 nt, Human
ugcagcggcacaaaugcaccuc

SEQ ID NO: 516610 - RNA, 22 nt, Human
ugcagcggccacacuguacucu

SEQ ID NO: 516611 - RNA, 23 nt, Human
ugcagcggccggcucucaccucu

SEQ ID NO: 516612 - RNA, 32 nt, Human
ugcagcgggggagcucuggggagcagcuugug

SEQ ID NO: 516613 - RNA, 32 nt, Human
ugcagcggguggaucacuugagguaaggaguu

SEQ ID NO: 516614 - RNA, 32 nt, Human
ugcagcguccgagggccaccgggcuggcauuu

SEQ ID NO: 516615 - RNA, 32 nt, Human
ugcagcguugggaggagcagagccagggagcc

SEQ ID NO: 516616 - RNA, 32 nt, Human
ugcagcuaaaggccaccaaggcagaacaggca

SEQ ID NO: 516617 - RNA, 21 nt, Human
ugcagcuaacccacccaccaa

SEQ ID NO: 516618 - RNA, 32 nt, Human
ugcagcuaagcaugauugacccugccagagga

SEQ ID NO: 516619 - RNA, 32 nt, Human
ugcagcuaagugguccuggggcauggagucuu

SEQ ID NO: 516620 - RNA, 32 nt, Human
ugcagcuacagaaauccaaggccuggcauggc

SEQ ID NO: 516621 - RNA, 20 nt, Human
ugcagcuaccagacauggug

SEQ ID NO: 516622 - RNA, 32 nt, Human
ugcagcuaccucagugcgcagggcccgucugu

SEQ ID NO: 516623 - RNA, 32 nt, Human
ugcagcuaccugcacuucuagaugcuccccag

SEQ ID NO: 516624 - RNA, 32 nt, Human
ugcagcuagaggcaucuucuacgggauggcca

SEQ ID NO: 516625 - RNA, 32 nt, Human
ugcagcuauacgcaagauuaaggcugggacuu

SEQ ID NO: 516626 - RNA, 16 nt, Human
ugcagcuaucucucca

SEQ ID NO: 516627 - RNA, 32 nt, Human
ugcagcuauggugggagccacauaggaacuuc

SEQ ID NO: 516628 - RNA, 32 nt, Human
ugcagcucaagaaacugaaggaugaguacguc

SEQ ID NO: 516629 - RNA, 32 nt, Human
ugcagcucacaccacuccagaaccugacaagg

SEQ ID NO: 516630 - RNA, 26 nt, Human
ugcagcucaccucccuccuguucaca

SEQ ID NO: 516631 - RNA, 32 nt, Human
ugcagcucacggggcagaaccagcacaucugg

SEQ ID NO: 516632 - RNA, 32 nt, Human
ugcagcucacuccaugccacacgggugggcca

SEQ ID NO: 516633 - RNA, 32 nt, Human
ugcagcucagccaccuccuccucucaggucug

SEQ ID NO: 516634 - RNA, 32 nt, Human
ugcagcucagcccagagccacuuguaauugau

SEQ ID NO: 516635 - RNA, 32 nt, Human
ugcagcucagggacuggcacacuggccuccag

SEQ ID NO: 516636 - RNA, 19 nt, Human
ugcagcucagucccugcca

SEQ ID NO: 516637 - RNA, 32 nt, Human
ugcagcuccagugcccugagcucccagccaca

SEQ ID NO: 516638 - RNA, 32 nt, Human
ugcagcucccuccgugccucagaucugcugua

SEQ ID NO: 516639 - RNA, 31 nt, Human
ugcagcucccucucugguccugggucccaca

SEQ ID NO: 516640 - RNA, 32 nt, Human
ugcagcuccguuuggcagugcaaugguauaaa

SEQ ID NO: 516641 - RNA, 32 nt, Human
ugcagcuccuggaggcagacgcuggagggcug

SEQ ID NO: 516642 - RNA, 32 nt, Human
ugcagcucgcguaucccaaccccagguaccaa

SEQ ID NO: 516643 - RNA, 32 nt, Human
ugcagcucgggugucuguggcuucuaaccuug

SEQ ID NO: 516644 - RNA, 22 nt, Human
ugcagcucugucccagccuuca

SEQ ID NO: 516645 - RNA, 32 nt, Human
ugcagcucuucuuccugcucccugcacauuga

SEQ ID NO: 516646 - RNA, 32 nt, Human
ugcagcucuuguugaagacacaaucagacuua

SEQ ID NO: 516647 - RNA, 32 nt, Human
ugcagcugaccaggguuugugcagugaucuuc

SEQ ID NO: 516648 - RNA, 32 nt, Human
ugcagcugagagcaggagcaggaaaaggaggc

SEQ ID NO: 516649 - RNA, 32 nt, Human
ugcagcugagagccggagcuuccuucagcucg

SEQ ID NO: 516650 - RNA, 32 nt, Human
ugcagcugagccacuagcacauggagucaccu

SEQ ID NO: 516651 - RNA, 32 nt, Human
ugcagcugaugccaaaguugugguguccagug

SEQ ID NO: 516652 - RNA, 32 nt, Human
ugcagcugcaaaaugacuacagccugaagggc

SEQ ID NO: 516653 - RNA, 32 nt, Human
ugcagcugcacuccagucuuuaagcccagcug

SEQ ID NO: 516654 - RNA, 21 nt, Human
ugcagcugcagcccgaccgcg

SEQ ID NO: 516655 - RNA, 19 nt, Human
ugcagcugcagccggggcg

SEQ ID NO: 516656 - RNA, 18 nt, Human
ugcagcugcagccugcca

SEQ ID NO: 516657 - RNA, 32 nt, Human
ugcagcugcagcuggagaaugaagaagacaua

SEQ ID NO: 516658 - RNA, 19 nt, Human
ugcagcugcaggacugagc

SEQ ID NO: 516659 - RNA, 32 nt, Human
ugcagcugcccaggcgcuauggcgagugcggu

SEQ ID NO: 516660 - RNA, 18 nt, Human
ugcagcugccccacccca

SEQ ID NO: 516661 - RNA, 21 nt, Human
ugcagcugccgccgccgccac

SEQ ID NO: 516662 - RNA, 32 nt, Human
ugcagcugcuccauccuccccugaauuuguac

SEQ ID NO: 516663 - RNA, 32 nt, Human
ugcagcugcugcaggggauggggaagggaugg

SEQ ID NO: 516664 - RNA, 32 nt, Human
ugcagcuggaauucuccucuuggucccagggc

SEQ ID NO: 516665 - RNA, 32 nt, Human
ugcagcuggacgacauccagcaugccaucgcc

SEQ ID NO: 516666 - RNA, 32 nt, Human
ugcagcuggagcagaggagcucacgccugcgg

SEQ ID NO: 516667 - RNA, 32 nt, Human
ugcagcugggauuugaaccaggccuucugauu

SEQ ID NO: 516668 - RNA, 32 nt, Human
ugcagcugggcugagcggggagucagcucaga

SEQ ID NO: 516669 - RNA, 32 nt, Human
ugcagcuggggcuugagcuggagcucgguuag

SEQ ID NO: 516670 - RNA, 32 nt, Human
ugcagcugggguccccggugcagccucgucag

SEQ ID NO: 516671 - RNA, 32 nt, Human
ugcagcuggugaacuuugccuaucgggacuug

SEQ ID NO: 516672 - RNA, 32 nt, Human
ugcagcuguacaacaagguggacccuggagag

SEQ ID NO: 516673 - RNA, 32 nt, Human
ugcagcugucgcuuugcagugccuguaggacu

SEQ ID NO: 516674 - RNA, 32 nt, Human
ugcagcugucuucuccucagugcuggcgcucu

SEQ ID NO: 516675 - RNA, 32 nt, Human
ugcagcugugcucaccccaggucaucagacuc

SEQ ID NO: 516676 - RNA, 32 nt, Human
ugcagcuguggacccaggaaucucuguacucu

SEQ ID NO: 516677 - RNA, 32 nt, Human
ugcagcuguggcuguggcugaagcuggcggau

SEQ ID NO: 516678 - RNA, 32 nt, Human
ugcagcuguggucccagcuacucaggaggcug

SEQ ID NO: 516679 - RNA, 32 nt, Human
ugcagcuguguagugcuggacagugacaaccc

SEQ ID NO: 516680 - RNA, 32 nt, Human
ugcagcuguguuuguugcugggagcggcggca

SEQ ID NO: 516681 - RNA, 32 nt, Human
ugcagcuguuuaacuugaaagacacugucgga

SEQ ID NO: 516682 - RNA, 32 nt, Human
ugcagcuuacgguccguucccuggaggggugg

SEQ ID NO: 516683 - RNA, 24 nt, Human
ugcagcuucaacuuccugggcuca

SEQ ID NO: 516684 - RNA, 22 nt, Human
ugcagcuucacuccugaagcca

SEQ ID NO: 516685 - RNA, 21 nt, Human
ugcagcuucacuccugagcca

SEQ ID NO: 516686 - RNA, 32 nt, Human
ugcagcuucacuugcuggagugccaaguagau

SEQ ID NO: 516687 - RNA, 32 nt, Human
ugcagcuucauuuugggcugccuuagccauga

SEQ ID NO: 516688 - RNA, 21 nt, Human
ugcagcuuccaaaucucauac

SEQ ID NO: 516689 - RNA, 21 nt, Human
ugcagcuuccacauuauacug

SEQ ID NO: 516690 - RNA, 24 nt, Human
ugcagcuuccacuuccugggcuca

SEQ ID NO: 516691 - RNA, 31 nt, Human
ugcagcuucuaguuuaagaccaaagcccuuc

SEQ ID NO: 516692 - RNA, 32 nt, Human
ugcagcuucuguggccaagccccagccugcac

SEQ ID NO: 516693 - RNA, 31 nt, Human
ugcagcuucuucuguaaccuaccucagaggg

SEQ ID NO: 516694 - RNA, 21 nt, Human
ugcagcuugacucugggccca

SEQ ID NO: 516695 - RNA, 32 nt, Human
ugcagcuugcccauggcccuaggcagcgaggg

SEQ ID NO: 516696 - RNA, 32 nt, Human
ugcagcuugcuacugugguggagguuccauug

SEQ ID NO: 516697 - RNA, 21 nt, Human
ugcagcuuucaagcucaucug

SEQ ID NO: 516698 - RNA, 24 nt, Human
ugcagcuuugaccuccugggcuua

SEQ ID NO: 516699 - RNA, 32 nt, Human
ugcagcuuugaccuugccgggcucaggugacc

SEQ ID NO: 516700 - RNA, 24 nt, Human
ugcagcuuugacuuccugggcuca

SEQ ID NO: 516701 - RNA, 32 nt, Human
ugcagcuuugggacagaugaguggcucugucc

SEQ ID NO: 516702 - RNA, 32 nt, Human
ugcagcuuuguuguccuuugagcuuucuguua

SEQ ID NO: 516703 - RNA, 32 nt, Human
ugcagcuuuugccuugguucuuccuagugccu

SEQ ID NO: 516704 - RNA, 24 nt, Human
ugcagcuuuuugugcccucuacug

SEQ ID NO: 516705 - RNA, 32 nt, Human
ugcaggaaacaccuagagcagccccagaguca

SEQ ID NO: 516706 - RNA, 23 nt, Human
ugcaggaacagcacuuccugcca

SEQ ID NO: 516707 - RNA, 32 nt, Human
ugcaggaacagcucuagucuacuaagcugaac

SEQ ID NO: 516708 - RNA, 23 nt, Human
ugcaggaacccuggccaugggag

SEQ ID NO: 516709 - RNA, 22 nt, Human
ugcaggaacguggagacccuga

SEQ ID NO: 516710 - RNA, 32 nt, Human
ugcaggaacuauucaacuuaguucccaacaug

SEQ ID NO: 516711 - RNA, 32 nt, Human
ugcaggaagaaaggaagagaauggaaauugcu

SEQ ID NO: 516712 - RNA, 32 nt, Human
ugcaggaaggagagaggaagaggagcagaagg

SEQ ID NO: 516713 - RNA, 32 nt, Human
ugcaggaagggaggguggcgagggggaagcga

SEQ ID NO: 516714 - RNA, 32 nt, Human
ugcaggaagucaaacacgaacucaaagaggac

SEQ ID NO: 516715 - RNA, 23 nt, Human
ugcaggaaugucccuucccacca

SEQ ID NO: 516716 - RNA, 32 nt, Human
ugcaggacaaacgccccugcccugccagaauc

SEQ ID NO: 516717 - RNA, 32 nt, Human
ugcaggacacauuuugccauguaaacuaacau

SEQ ID NO: 516718 - RNA, 32 nt, Human
ugcaggacagaucaggucagagcccaggaauu

SEQ ID NO: 516719 - RNA, 20 nt, Human
ugcaggacaguaagcccuca

SEQ ID NO: 516720 - RNA, 32 nt, Human
ugcaggaccagaaccccugccuccaucuuucc

SEQ ID NO: 516721 - RNA, 32 nt, Human
ugcaggaccaugguggcuuuaguuucuacccc

SEQ ID NO: 516722 - RNA, 32 nt, Human
ugcaggaccccuggccagucugaauagcagga

SEQ ID NO: 516723 - RNA, 19 nt, Human
ugcaggaccccuuccccca

SEQ ID NO: 516724 - RNA, 32 nt, Human
ugcaggacccuccccugcuccaugugacccuc

SEQ ID NO: 516725 - RNA, 32 nt, Human
ugcaggaccugcccuccacugcccagcugcug

SEQ ID NO: 516726 - RNA, 32 nt, Human
ugcaggaccuucugccccagcugggccuggug

SEQ ID NO: 516727 - RNA, 32 nt, Human
ugcaggacgagaaacgcccgcggcaccaaagc

SEQ ID NO: 516728 - RNA, 32 nt, Human
ugcaggacucaccucugugccuugcugcuccu

SEQ ID NO: 516729 - RNA, 32 nt, Human
ugcaggacuccaguggaagugaaagaacuggg

SEQ ID NO: 516730 - RNA, 32 nt, Human
ugcaggacuccuuuccucaucccaggcucgga

SEQ ID NO: 516731 - RNA, 32 nt, Human
ugcaggacuggaaguugcucugggugagucaa

SEQ ID NO: 516732 - RNA, 32 nt, Human
ugcaggagaaaagauaauuggcucaggucucg

SEQ ID NO: 516733 - RNA, 32 nt, Human
ugcaggagaacgccaguggccgggggaacaug

SEQ ID NO: 516734 - RNA, 32 nt, Human
ugcaggagaaggacuugcccgcauggagcuau

SEQ ID NO: 516735 - RNA, 32 nt, Human
ugcaggagacaaggucucgccauguugccuag

SEQ ID NO: 516736 - RNA, 32 nt, Human
ugcaggagacgagagaauaugagucuccaucu

SEQ ID NO: 516737 - RNA, 32 nt, Human
ugcaggagagugaccaggagcccggggcagcu

SEQ ID NO: 516738 - RNA, 32 nt, Human
ugcaggagcacuuggcccugccuuaccugcca

SEQ ID NO: 516739 - RNA, 32 nt, Human
ugcaggagcagucugcaauuuaugccuacagg

SEQ ID NO: 516740 - RNA, 32 nt, Human
ugcaggagcauccugaagaccaggagaagguu

SEQ ID NO: 516741 - RNA, 32 nt, Human
ugcaggagccagaaagagauccuggccugaga

SEQ ID NO: 516742 - RNA, 19 nt, Human
ugcaggagccuagcaggaa

SEQ ID NO: 516743 - RNA, 32 nt, Human
ugcaggagccugggcugacugguugggacuca

SEQ ID NO: 516744 - RNA, 32 nt, Human
ugcaggagcucaaggaccugggcgucaccgug

SEQ ID NO: 516745 - RNA, 32 nt, Human
ugcaggagcuucugugggaguacggucaugag

SEQ ID NO: 516746 - RNA, 23 nt, Human
ugcaggaggaaaagaacaggcag

SEQ ID NO: 516747 - RNA, 32 nt, Human
ugcaggaggagaaggaggaggagcaggaggug

SEQ ID NO: 516748 - RNA, 32 nt, Human
ugcaggaggauguagcgccucaguuuauuuua

SEQ ID NO: 516749 - RNA, 32 nt, Human
ugcaggaggccaaacugucccucccuugcuga

SEQ ID NO: 516750 - RNA, 23 nt, Human
ugcaggaggcccgcagccgggaa

SEQ ID NO: 516751 - RNA, 23 nt, Human
ugcaggagggcacuggagcuggg

SEQ ID NO: 516752 - RNA, 32 nt, Human
ugcaggaggucgggaaaggcaguccugguaga

SEQ ID NO: 516753 - RNA, 24 nt, Human
ugcaggagguggagcggcagagaa

SEQ ID NO: 516754 - RNA, 32 nt, Human
ugcaggagucugcaggucacccggagcaggau

SEQ ID NO: 516755 - RNA, 22 nt, Human
ugcaggagugaccaggacacua

SEQ ID NO: 516756 - RNA, 32 nt, Human
ugcaggaguuugugguaacuugagauucaaga

SEQ ID NO: 516757 - RNA, 32 nt, Human
ugcaggaucaggaggggagaagaaggagccuc

SEQ ID NO: 516758 - RNA, 32 nt, Human
ugcaggaucucucuucauagcccaguacgacu

SEQ ID NO: 516759 - RNA, 32 nt, Human
ugcaggaucugcuucccuucucuccaggaccu

SEQ ID NO: 516760 - RNA, 32 nt, Human
ugcaggaugcccagggcucggaagcaguaagg

SEQ ID NO: 516761 - RNA, 32 nt, Human
ugcaggaugguuuugaaacagaaacaauacuu

SEQ ID NO: 516762 - RNA, 31 nt, Human
ugcaggaugucagaagagugagaugucuugc

SEQ ID NO: 516763 - RNA, 32 nt, Human
ugcaggaugugugagaggaagcaguuaauugu

SEQ ID NO: 516764 - RNA, 32 nt, Human
ugcaggcaacacagggccucucccaaaagaga

SEQ ID NO: 516765 - RNA, 32 nt, Human
ugcaggcaagcggucggguggggagggagggc

SEQ ID NO: 516766 - RNA, 23 nt, Human
ugcaggcaaggaggagauggggu

SEQ ID NO: 516767 - RNA, 32 nt, Human
ugcaggcacacugcagugguuuuccugcagcu

SEQ ID NO: 516768 - RNA, 32 nt, Human
ugcaggcacugaaauugguucaucccagugac

SEQ ID NO: 516769 - RNA, 32 nt, Human
ugcaggcacugaggcuggagggacauggagcc

SEQ ID NO: 516770 - RNA, 21 nt, Human
ugcaggcagaaggcaguaggg

SEQ ID NO: 516771 - RNA, 23 nt, Human
ugcaggcagacgcaccauugagg

SEQ ID NO: 516772 - RNA, 17 nt, Human
ugcaggcagccugcucc

SEQ ID NO: 516773 - RNA, 23 nt, Human
ugcaggcaggacagccaugaggu

SEQ ID NO: 516774 - RNA, 19 nt, Human
ugcaggcaggcuugauggg

SEQ ID NO: 516775 - RNA, 20 nt, Human
ugcaggcagggcgcugcggg

SEQ ID NO: 516776 - RNA, 19 nt, Human
ugcaggcagggcguguggg

SEQ ID NO: 516777 - RNA, 23 nt, Human
ugcaggcagggcugacucuaggu

SEQ ID NO: 516778 - RNA, 21 nt, Human
ugcaggcagggcuggguuggg

SEQ ID NO: 516779 - RNA, 32 nt, Human
ugcaggcagggcuguggcccagcugggucuga

SEQ ID NO: 516780 - RNA, 23 nt, Human
ugcaggcagguccugauugaagg

SEQ ID NO: 516781 - RNA, 32 nt, Human
ugcaggcaugagccaccacucccggccugcuu

SEQ ID NO: 516782 - RNA, 32 nt, Human
ugcaggcaugagccaccaugccuggccccaca

SEQ ID NO: 516783 - RNA, 32 nt, Human
ugcaggcaugagccaccgcgcccagccagaaa

SEQ ID NO: 516784 - RNA, 32 nt, Human
ugcaggcaugagccaccgugcccagccucaaa

SEQ ID NO: 516785 - RNA, 32 nt, Human
ugcaggcaugagccacugcacccaaccccugg

SEQ ID NO: 516786 - RNA, 32 nt, Human
ugcaggcaugagccacugcacccagcccugua

SEQ ID NO: 516787 - RNA, 32 nt, Human
ugcaggcaugagccacugcgccuggccuaauc

SEQ ID NO: 516788 - RNA, 32 nt, Human
ugcaggcaugagccacugcgccuggccucaaa

SEQ ID NO: 516789 - RNA, 32 nt, Human
ugcaggcaugagccacugcucccggcccuauu

SEQ ID NO: 516790 - RNA, 32 nt, Human
ugcaggcaugagccacugugccuguccaagaa

SEQ ID NO: 516791 - RNA, 32 nt, Human
ugcaggcaugagccacuucgccuagccaagcc

SEQ ID NO: 516792 - RNA, 32 nt, Human
ugcaggcaugagccaucacacccggcugguuu

SEQ ID NO: 516793 - RNA, 32 nt, Human
ugcaggcaugcgccaccaugccaggcugauuu

SEQ ID NO: 516794 - RNA, 32 nt, Human
ugcaggcauggacuggaagucguaguacuuuu

SEQ ID NO: 516795 - RNA, 24 nt, Human
ugcaggccacagaaagauuugaug

SEQ ID NO: 516796 - RNA, 32 nt, Human
ugcaggccacaggcagcgacucaccaguugcc

SEQ ID NO: 516797 - RNA, 32 nt, Human
ugcaggccacauggccaccugggaaggcccgg

SEQ ID NO: 516798 - RNA, 26 nt, Human
ugcaggccaccuggcugggguuggug

SEQ ID NO: 516799 - RNA, 32 nt, Human
ugcaggccagaagauagugucugaguagggcu

SEQ ID NO: 516800 - RNA, 32 nt, Human
ugcaggccagcccuucaaguucaguaucgcgg

SEQ ID NO: 516801 - RNA, 32 nt, Human
ugcaggccagccuggaccucugacacacucgu

SEQ ID NO: 516802 - RNA, 32 nt, Human
ugcaggccaggucauuggccccuuccccaauc

SEQ ID NO: 516803 - RNA, 32 nt, Human
ugcaggccaguaacaggaagggccuggggaga

SEQ ID NO: 516804 - RNA, 32 nt, Human
ugcaggccauguccugaaggguuccucaggag

SEQ ID NO: 516805 - RNA, 19 nt, Human
ugcaggcccagcuccugcc

SEQ ID NO: 516806 - RNA, 32 nt, Human
ugcaggccccagcacccgcagagcagacacug

SEQ ID NO: 516807 - RNA, 32 nt, Human
ugcaggccccaugccucuccucccucucuggc

SEQ ID NO: 516808 - RNA, 32 nt, Human
ugcaggcccccuggguccccuuguucagagac

SEQ ID NO: 516809 - RNA, 32 nt, Human
ugcaggcccuaaaacagaaaggacggacggag

SEQ ID NO: 516810 - RNA, 32 nt, Human
ugcaggccucaucccugacugcagcuugacuc

SEQ ID NO: 516811 - RNA, 32 nt, Human
ugcaggccuccaggugaccucacucggacgga

SEQ ID NO: 516812 - RNA, 32 nt, Human
ugcaggccuccccuccauccuggaccagcugu

SEQ ID NO: 516813 - RNA, 32 nt, Human
ugcaggccucgcggaucccccacuugucucga

SEQ ID NO: 516814 - RNA, 32 nt, Human
ugcaggccucugguguuugcaaaggaugcgug

SEQ ID NO: 516815 - RNA, 32 nt, Human
ugcaggccugagccaccgcgcccggccccuua

SEQ ID NO: 516816 - RNA, 32 nt, Human
ugcaggccuguaaucccagcuacucgggaggc

SEQ ID NO: 516817 - RNA, 32 nt, Human
ugcaggccuucugcaaaucagugcuggccugg

SEQ ID NO: 516818 - RNA, 21 nt, Human
ugcaggcgaagagauuggagg

SEQ ID NO: 516819 - RNA, 32 nt, Human
ugcaggcgaaggacaggacagcagagugagcu

SEQ ID NO: 516820 - RNA, 24 nt, Human
ugcaggcgaaugagaaaggacaga

SEQ ID NO: 516821 - RNA, 32 nt, Human
ugcaggcgccggcagcccuggagggcagccgc

SEQ ID NO: 516822 - RNA, 32 nt, Human
ugcaggcgccuauaaucccagcuacucaggag

SEQ ID NO: 516823 - RNA, 32 nt, Human
ugcaggcgcucaggggcgcuaggguuugaggc

SEQ ID NO: 516824 - RNA, 21 nt, Human
ugcaggcggcgugugcugcug

SEQ ID NO: 516825 - RNA, 32 nt, Human
ugcaggcgugagccaccacacccggcccaccu

SEQ ID NO: 516826 - RNA, 32 nt, Human
ugcaggcgugagccaccacgcccggccuccag

SEQ ID NO: 516827 - RNA, 32 nt, Human
ugcaggcgugagccaccaggcccugccugguu

SEQ ID NO: 516828 - RNA, 32 nt, Human
ugcaggcgugagccaccaugcccggcucucac

SEQ ID NO: 516829 - RNA, 32 nt, Human
ugcaggcgugagccaccaugccuggccagaag

SEQ ID NO: 516830 - RNA, 32 nt, Human
ugcaggcgugagccaccgcgcccggccaacgu

SEQ ID NO: 516831 - RNA, 32 nt, Human
ugcaggcgugagccaccgcgcccggccugccc

SEQ ID NO: 516832 - RNA, 32 nt, Human
ugcaggcgugagccacugcacccagccucuuu

SEQ ID NO: 516833 - RNA, 32 nt, Human
ugcaggcgugagccacugcauccgaccucauu

SEQ ID NO: 516834 - RNA, 32 nt, Human
ugcaggcgugagccacugcuccuggcuugaau

SEQ ID NO: 516835 - RNA, 32 nt, Human
ugcaggcgugagccacuuucccagccucucuu

SEQ ID NO: 516836 - RNA, 32 nt, Human
ugcaggcguggucaugagggcagauggacacu

SEQ ID NO: 516837 - RNA, 23 nt, Human
ugcaggcuagcggccucccgcca

SEQ ID NO: 516838 - RNA, 32 nt, Human
ugcaggcucagcgaugaacaucuggcuggggc

SEQ ID NO: 516839 - RNA, 32 nt, Human
ugcaggcucauagggaagaccugcugagggac

SEQ ID NO: 516840 - RNA, 17 nt, Human
ugcaggcucauucccca

SEQ ID NO: 516841 - RNA, 32 nt, Human
ugcaggcuccaugcaccucccuucccucccug

SEQ ID NO: 516842 - RNA, 32 nt, Human
ugcaggcucccuacacaguccugcugcugccg

SEQ ID NO: 516843 - RNA, 18 nt, Human
ugcaggcuccgcgagcgg

SEQ ID NO: 516844 - RNA, 32 nt, Human
ugcaggcucgaggagcuuuccggagcuuccca

SEQ ID NO: 516845 - RNA, 31 nt, Human
ugcaggcucgccucugggcuuugucuccuug

SEQ ID NO: 516846 - RNA, 32 nt, Human
ugcaggcucucaucugguccaugcccagaugc

SEQ ID NO: 516847 - RNA, 17 nt, Human
ugcaggcugagagcugg

SEQ ID NO: 516848 - RNA, 32 nt, Human
ugcaggcugauccuucuuuucacuuucuguca

SEQ ID NO: 516849 - RNA, 32 nt, Human
ugcaggcugaugacacacagggagaguggccc

SEQ ID NO: 516850 - RNA, 15 nt, Human
ugcaggcugcagggg

SEQ ID NO: 516851 - RNA, 19 nt, Human
ugcaggcugccacuggagg

SEQ ID NO: 516852 - RNA, 23 nt, Human
ugcaggcugcccccugccggcca

SEQ ID NO: 516853 - RNA, 29 nt, Human
ugcaggcugcugcuauucccugucugcug

SEQ ID NO: 516854 - RNA, 22 nt, Human
ugcaggcuggaagcaccaggga

SEQ ID NO: 516855 - RNA, 17 nt, Human
ugcaggcuggagugcgg

SEQ ID NO: 516856 - RNA, 23 nt, Human
ugcaggcuggcuggcccuugcca

SEQ ID NO: 516857 - RNA, 32 nt, Human
ugcaggcugggagggggcagccaagaagccgg

SEQ ID NO: 516858 - RNA, 32 nt, Human
ugcaggcuggguagcugguagaaauguugugg

SEQ ID NO: 516859 - RNA, 32 nt, Human
ugcaggcugggugacagagugagacuccaucu

SEQ ID NO: 516860 - RNA, 32 nt, Human
ugcaggcugguucaugccacuuuuucagagua

SEQ ID NO: 516861 - RNA, 20 nt, Human
ugcaggcuguccuccccgcc

SEQ ID NO: 516862 - RNA, 19 nt, Human
ugcaggcuguguccuggca

SEQ ID NO: 516863 - RNA, 16 nt, Human
ugcaggcuucaggagg

SEQ ID NO: 516864 - RNA, 32 nt, Human
ugcaggcuugcagugagccaugaucaugccac

SEQ ID NO: 516865 - RNA, 32 nt, Human
ugcaggcuuguugggagccuuuaggacgucuc

SEQ ID NO: 516866 - RNA, 32 nt, Human
ugcaggcuuuguaugugaauaauucuagcggg

SEQ ID NO: 516867 - RNA, 32 nt, Human
ugcagggaaggaugaugccagccccggauccg

SEQ ID NO: 516868 - RNA, 18 nt, Human
ugcagggacacgucggau

SEQ ID NO: 516869 - RNA, 32 nt, Human
ugcagggacaguuggcuuccagagguuucagc

SEQ ID NO: 516870 - RNA, 32 nt, Human
ugcagggacaucuuauugacugccuccuucuc

SEQ ID NO: 516871 - RNA, 32 nt, Human
ugcagggaccgagggccuacacugccuccucc

SEQ ID NO: 516872 - RNA, 32 nt, Human
ugcagggaccugccuuugccuccugcucgaag

SEQ ID NO: 516873 - RNA, 32 nt, Human
ugcagggacucaugacuguaauccuaguacuu

SEQ ID NO: 516874 - RNA, 32 nt, Human
ugcagggagagggcaggcggcugcugcuguug

SEQ ID NO: 516875 - RNA, 32 nt, Human
ugcagggagagggcugugaggaagagcacagg

SEQ ID NO: 516876 - RNA, 32 nt, Human
ugcagggagaggggaggcggggacggugugcc

SEQ ID NO: 516877 - RNA, 32 nt, Human
ugcagggagcacuguucacaucauagauaaag

SEQ ID NO: 516878 - RNA, 18 nt, Human
ugcagggagcaggcgcug

SEQ ID NO: 516879 - RNA, 19 nt, Human
ugcagggagccuucugcca

SEQ ID NO: 516880 - RNA, 32 nt, Human
ugcagggagcuggggagcaggaacgccucgga

SEQ ID NO: 516881 - RNA, 32 nt, Human
ugcagggaggagaggggaagggccagucuggg

SEQ ID NO: 516882 - RNA, 22 nt, Human
ugcagggaggaggaaauggggg

SEQ ID NO: 516883 - RNA, 32 nt, Human
ugcagggaggcggagguugcagugagccgaga

SEQ ID NO: 516884 - RNA, 32 nt, Human
ugcagggagggcagaggcauugcugagacugc

SEQ ID NO: 516885 - RNA, 23 nt, Human
ugcagggagggcccaggagccgg

SEQ ID NO: 516886 - RNA, 32 nt, Human
ugcagggaguggcuccccagacccccucgcca

SEQ ID NO: 516887 - RNA, 22 nt, Human
ugcagggauauuugaggacagg

SEQ ID NO: 516888 - RNA, 18 nt, Human
ugcagggaucccaggccc

SEQ ID NO: 516889 - RNA, 32 nt, Human
ugcagggaugaguugagggugcgugggcacag

SEQ ID NO: 516890 - RNA, 32 nt, Human
ugcagggauuacaggcaugagccaccaugccu

SEQ ID NO: 516891 - RNA, 32 nt, Human
ugcagggauucuagagcagagagcagaccaua

SEQ ID NO: 516892 - RNA, 32 nt, Human
ugcagggauuucaccaccucaggguggagaga

SEQ ID NO: 516893 - RNA, 32 nt, Human
ugcagggcagacagugccuggcacugaggggu

SEQ ID NO: 516894 - RNA, 32 nt, Human
ugcagggcagagaccuaggaauuuggauaaug

SEQ ID NO: 516895 - RNA, 32 nt, Human
ugcagggcaggaaagcuccacacacacagccc

SEQ ID NO: 516896 - RNA, 32 nt, Human
ugcagggcaguguggcagguggagagguccua

SEQ ID NO: 516897 - RNA, 32 nt, Human
ugcagggcaucuugugaauauguauguaaaua

SEQ ID NO: 516898 - RNA, 32 nt, Human
ugcagggccagaggugacccugccuggccucc

SEQ ID NO: 516899 - RNA, 32 nt, Human
ugcagggccagccugccaugaucuuucucacu

SEQ ID NO: 516900 - RNA, 21 nt, Human
ugcagggcccacaaacacggu

SEQ ID NO: 516901 - RNA, 32 nt, Human
ugcagggcccuguguggucuccggacagcugc

SEQ ID NO: 516902 - RNA, 22 nt, Human
ugcagggccgggcacccaccca

SEQ ID NO: 516903 - RNA, 32 nt, Human
ugcagggccguugcccccagacuuccuccuuu

SEQ ID NO: 516904 - RNA, 32 nt, Human
ugcagggccuggagguggggaggccagaggca

SEQ ID NO: 516905 - RNA, 32 nt, Human
ugcagggccuggugaugcuguccucuguaccg

SEQ ID NO: 516906 - RNA, 32 nt, Human
ugcagggccuguaaucccagcauuuugggagg

SEQ ID NO: 516907 - RNA, 32 nt, Human
ugcagggcgcagccccgaggaggcagguggag

SEQ ID NO: 516908 - RNA, 32 nt, Human
ugcagggcgggccugggacaauggggcgguug

SEQ ID NO: 516909 - RNA, 32 nt, Human
ugcagggcuggcccuggcucgggcaggguggg

SEQ ID NO: 516910 - RNA, 32 nt, Human
ugcagggcugguggcccugcuucugcccaggc

SEQ ID NO: 516911 - RNA, 32 nt, Human
ugcagggcugguuuguucugacuuuuuguuuc

SEQ ID NO: 516912 - RNA, 32 nt, Human
ugcagggcugugacacaauagggacucuaugg

SEQ ID NO: 516913 - RNA, 31 nt, Human
ugcagggcugugaucacagccaacaccaccu

SEQ ID NO: 516914 - RNA, 32 nt, Human
ugcagggcuguuguguagacugcagacaucca

SEQ ID NO: 516915 - RNA, 22 nt, Human
ugcagggcuucucuuguuuaca

SEQ ID NO: 516916 - RNA, 32 nt, Human
ugcagggcuuuccccucuccuuccuuuacgua

SEQ ID NO: 516917 - RNA, 32 nt, Human
ugcaggggaaggcagcggcggcggcggcggga

SEQ ID NO: 516918 - RNA, 19 nt, Human
ugcaggggacacucuggau

SEQ ID NO: 516919 - RNA, 32 nt, Human
ugcaggggacaggagugggagcagggagauag

SEQ ID NO: 516920 - RNA, 32 nt, Human
ugcaggggacauccugaaguucuugaaaaaga

SEQ ID NO: 516921 - RNA, 32 nt, Human
ugcaggggacucuggccagcuugagugacgcg

SEQ ID NO: 516922 - RNA, 17 nt, Human
ugcaggggacugggcca

SEQ ID NO: 516923 - RNA, 32 nt, Human
ugcaggggaggggcccaggcagcugugcuggu

SEQ ID NO: 516924 - RNA, 32 nt, Human
ugcaggggagguggaggccagaggacagggag

SEQ ID NO: 516925 - RNA, 31 nt, Human
ugcaggggcacaaucucagcucacugcaacc

SEQ ID NO: 516926 - RNA, 32 nt, Human
ugcaggggcagagagagcagcaggugaaggcu

SEQ ID NO: 516927 - RNA, 32 nt, Human
ugcaggggcagaggaggagaccagccugacaa

SEQ ID NO: 516928 - RNA, 32 nt, Human
ugcaggggcaggagaggaagggaccggcaaag

SEQ ID NO: 516929 - RNA, 32 nt, Human
ugcaggggcauuagcucacugcagucuccacc

SEQ ID NO: 516930 - RNA, 22 nt, Human
ugcaggggccgcgccuggcuca

SEQ ID NO: 516931 - RNA, 32 nt, Human
ugcaggggccugggcuaguaggguuugggaaa

SEQ ID NO: 516932 - RNA, 32 nt, Human
ugcaggggcugcaggccguuaaguggacagga

SEQ ID NO: 516933 - RNA, 32 nt, Human
ugcagggggaggaggacuuggagggucugggg

SEQ ID NO: 516934 - RNA, 21 nt, Human
ugcagggggagggagagggga

SEQ ID NO: 516935 - RNA, 32 nt, Human
ugcagggggcacuuguuccugagguccucgcc

SEQ ID NO: 516936 - RNA, 32 nt, Human
ugcagggggccagcaccccuggguuaucuggg

SEQ ID NO: 516937 - RNA, 32 nt, Human
ugcagggggcgcggggcggaggcugcgagggc

SEQ ID NO: 516938 - RNA, 32 nt, Human
ugcagggggugagggggaacagcgagagcuug

SEQ ID NO: 516939 - RNA, 32 nt, Human
ugcagggggugugucugcucaguaauuugagg

SEQ ID NO: 516940 - RNA, 32 nt, Human
ugcagggucacugcaccucggcccagggccuc

SEQ ID NO: 516941 - RNA, 18 nt, Human
ugcagggucauuucccca

SEQ ID NO: 516942 - RNA, 32 nt, Human
ugcaggguccccaaggauggaaagggaauguu

SEQ ID NO: 516943 - RNA, 21 nt, Human
ugcaggguccuggagcuaggc

SEQ ID NO: 516944 - RNA, 32 nt, Human
ugcagggucuaugucuuugucuugacuuccag

SEQ ID NO: 516945 - RNA, 32 nt, Human
ugcagggucugaugucaucguugacagccuuu

SEQ ID NO: 516946 - RNA, 32 nt, Human
ugcagggugaugagaaguuuggucugaguaac

SEQ ID NO: 516947 - RNA, 32 nt, Human
ugcagggugcccagugcacacacuagagagaa

SEQ ID NO: 516948 - RNA, 32 nt, Human
ugcagggugggaggagaagaccaaacgaagua

SEQ ID NO: 516949 - RNA, 32 nt, Human
ugcaggguguggaauugcccuuugggguccuu

SEQ ID NO: 516950 - RNA, 32 nt, Human
ugcaggguuggcagggacagagcccagaccau

SEQ ID NO: 516951 - RNA, 32 nt, Human
ugcagguacaggaauuguuccaccagcauuag

SEQ ID NO: 516952 - RNA, 32 nt, Human
ugcagguacccaccucuuucucuugggugagg

SEQ ID NO: 516953 - RNA, 32 nt, Human
ugcagguacgagcccgcccaggaacaggaggg

SEQ ID NO: 516954 - RNA, 32 nt, Human
ugcagguagagaagagauggugccaugauaua

SEQ ID NO: 516955 - RNA, 32 nt, Human
ugcagguagagcagccucauuccuucacaaga

SEQ ID NO: 516956 - RNA, 21 nt, Human
ugcagguagccggccggccgg

SEQ ID NO: 516957 - RNA, 32 nt, Human
ugcagguagggaaaaaguuggucuaauugaag

SEQ ID NO: 516958 - RNA, 32 nt, Human
ugcagguauuaaaaauaauuaaaaauaguccu

SEQ ID NO: 516959 - RNA, 32 nt, Human
ugcaggucagcaacugugucgugagcagcugc

SEQ ID NO: 516960 - RNA, 32 nt, Human
ugcaggucagcccaggaauuggcagaggaagu

SEQ ID NO: 516961 - RNA, 32 nt, Human
ugcaggucaggcguucaacaccagccuggcca

SEQ ID NO: 516962 - RNA, 32 nt, Human
ugcaggucaguauccugggacuuggaagcugg

SEQ ID NO: 516963 - RNA, 32 nt, Human
ugcagguccagcccuggcgagggcaggucaga

SEQ ID NO: 516964 - RNA, 32 nt, Human
ugcagguccauucugcaccucuuggcucgggu

SEQ ID NO: 516965 - RNA, 32 nt, Human
ugcaggucucccaugaaggccaccccaugguc

SEQ ID NO: 516966 - RNA, 32 nt, Human
ugcaggucucggggcuccuggguugcuucugg

SEQ ID NO: 516967 - RNA, 32 nt, Human
ugcaggucucugagcaaggcggagguguggag

SEQ ID NO: 516968 - RNA, 32 nt, Human
ugcaggucucugcugguuucucuuagucgcca

SEQ ID NO: 516969 - RNA, 32 nt, Human
ugcaggucuuggcacaugcacagcaggcuccc

SEQ ID NO: 516970 - RNA, 32 nt, Human
ugcaggugaacgccuccaaccuggugagcuuu

SEQ ID NO: 516971 - RNA, 32 nt, Human
ugcaggugaaggacaggaaggggcaugugagc

SEQ ID NO: 516972 - RNA, 32 nt, Human
ugcaggugaauuuauuacugagccaaaugagg

SEQ ID NO: 516973 - RNA, 32 nt, Human
ugcaggugacaagggcccugccuccaccccuc

SEQ ID NO: 516974 - RNA, 32 nt, Human
ugcaggugagcagaagggagagagggagggcg

SEQ ID NO: 516975 - RNA, 32 nt, Human
ugcaggugagcucugggccauguugccuugac

SEQ ID NO: 516976 - RNA, 32 nt, Human
ugcaggugaggugggcugaggcuuccuuguga

SEQ ID NO: 516977 - RNA, 32 nt, Human
ugcaggugaugccauguuauauccaauaacua

SEQ ID NO: 516978 - RNA, 32 nt, Human
ugcaggugcaugccaccaugccuggcuaauuu

SEQ ID NO: 516979 - RNA, 32 nt, Human
ugcaggugccaaggcacaucaugcugcuggac

SEQ ID NO: 516980 - RNA, 32 nt, Human
ugcaggugccauccggggucucagagcccauc

SEQ ID NO: 516981 - RNA, 32 nt, Human
ugcaggugcccaccaucaugcccagcuaauuu

SEQ ID NO: 516982 - RNA, 32 nt, Human
ugcaggugccugccaccaugccuggcuaauuu

SEQ ID NO: 516983 - RNA, 32 nt, Human
ugcaggugcgagccaccggguccagccucuca

SEQ ID NO: 516984 - RNA, 32 nt, Human
ugcagguggagagaaaacaggagaguagcaau

SEQ ID NO: 516985 - RNA, 32 nt, Human
ugcagguggaggacgcgcaggagcgcgcggcc

SEQ ID NO: 516986 - RNA, 32 nt, Human
ugcagguggcagguggccccaggccuguuugg

SEQ ID NO: 516987 - RNA, 32 nt, Human
ugcagguggcccuuccccuuggaggcgagaag

SEQ ID NO: 516988 - RNA, 32 nt, Human
ugcaggugggcauaggugcagugagugcaggu

SEQ ID NO: 516989 - RNA, 32 nt, Human
ugcagguggggagacugggcugagggagccug

SEQ ID NO: 516990 - RNA, 32 nt, Human
ugcagguggguaaacugaggcucaggaaguuu

SEQ ID NO: 516991 - RNA, 32 nt, Human
ugcagguguccugagcaccacacccaguggga

SEQ ID NO: 516992 - RNA, 20 nt, Human
ugcagguguccugggccaag

SEQ ID NO: 516993 - RNA, 32 nt, Human
ugcaggugucugcagugucagaggagccgcug

SEQ ID NO: 516994 - RNA, 32 nt, Human
ugcaggugugagccaccacacccagccaugaa

SEQ ID NO: 516995 - RNA, 32 nt, Human
ugcaggugugagccaccacgcccagccuagaa

SEQ ID NO: 516996 - RNA, 32 nt, Human
ugcaggugugagccaccgcacccagccucaau

SEQ ID NO: 516997 - RNA, 32 nt, Human
ugcaggugugagccacugcacccggcccuugc

SEQ ID NO: 516998 - RNA, 32 nt, Human
ugcaggugugagccacugcgccuggccuaaac

SEQ ID NO: 516999 - RNA, 32 nt, Human
ugcaggugugagccacugugccuggcuggcag

SEQ ID NO: 517000 - RNA, 32 nt, Human
ugcaggugugagccagugcacccggccguaug

SEQ ID NO: 517001 - RNA, 32 nt, Human
ugcaggugugcaccaccaugcccagcuaauuu

SEQ ID NO: 517002 - RNA, 32 nt, Human
ugcagguguggaccccaggaaccuacaggggu

SEQ ID NO: 517003 - RNA, 22 nt, Human
ugcagguguggcagagaugggg

SEQ ID NO: 517004 - RNA, 32 nt, Human
ugcaggugugggcucuccacauugggccgggg

SEQ ID NO: 517005 - RNA, 32 nt, Human
ugcagguguuaacauguaucaccacuucugug

SEQ ID NO: 517006 - RNA, 26 nt, Human
ugcagguuaagaauccacacaaccaa

SEQ ID NO: 517007 - RNA, 32 nt, Human
ugcagguuagaagacgacuguggugugcagug

SEQ ID NO: 517008 - RNA, 16 nt, Human
ugcagguuccaggugg

SEQ ID NO: 517009 - RNA, 32 nt, Human
ugcagguugcccaggaggagcugcagcgccag

SEQ ID NO: 517010 - RNA, 32 nt, Human
ugcagguugggcuauagggaggcuccaguuug

SEQ ID NO: 517011 - RNA, 24 nt, Human
ugcagguuugcagccagcggagga

SEQ ID NO: 517012 - RNA, 32 nt, Human
ugcagguuugcagccagcggaggagugaaagu

SEQ ID NO: 517013 - RNA, 32 nt, Human
ugcagguuuuauaauaguaaaaagcuagaaaa

SEQ ID NO: 517014 - RNA, 32 nt, Human
ugcagguuuuucaaggaucaacuaaugugcaa

SEQ ID NO: 517015 - RNA, 31 nt, Human
ugcaguaaaaguuucagacaugcaagagaga

SEQ ID NO: 517016 - RNA, 32 nt, Human
ugcaguaaaauguccacuaggaccccauugcc

SEQ ID NO: 517017 - RNA, 20 nt, Human
ugcaguaaagcccaggacug

SEQ ID NO: 517018 - RNA, 25 nt, Human
ugcaguaaauggauuacacuggggc

SEQ ID NO: 517019 - RNA, 21 nt, Human
ugcaguaauuugccugugauc

SEQ ID NO: 517020 - RNA, 32 nt, Human
ugcaguaccagcuccucugucucccucugccu

SEQ ID NO: 517021 - RNA, 32 nt, Human
ugcaguaccccagcucaugggggacucagcaa

SEQ ID NO: 517022 - RNA, 32 nt, Human
ugcaguacgauuggaacacuugagauuucugc

SEQ ID NO: 517023 - RNA, 32 nt, Human
ugcaguacucaguaagacagugcagugcucag

SEQ ID NO: 517024 - RNA, 32 nt, Human
ugcaguacuugcucuaacuuugccgcagcugc

SEQ ID NO: 517025 - RNA, 32 nt, Human
ugcaguacuuugcccaaagucacacacauauu

SEQ ID NO: 517026 - RNA, 23 nt, Human
ugcaguagaacggaacuuggggc

SEQ ID NO: 517027 - RNA, 22 nt, Human
ugcaguagcaacuggugcuggg

SEQ ID NO: 517028 - RNA, 32 nt, Human
ugcaguagccaauauaggcuucaugcccuccu

SEQ ID NO: 517029 - RNA, 21 nt, Human
ugcaguagcuaaagcuggggu

SEQ ID NO: 517030 - RNA, 22 nt, Human
ugcaguagcucacacuguaauc

SEQ ID NO: 517031 - RNA, 32 nt, Human
ugcaguagcucacgccuguaaucccagcacuu

SEQ ID NO: 517032 - RNA, 32 nt, Human
ugcaguagcucaugccuguaaucccagcacuu

SEQ ID NO: 517033 - RNA, 31 nt, Human
ugcaguaggaaacuguccuagcaaggcucca

SEQ ID NO: 517034 - RNA, 32 nt, Human
ugcaguaggagagauuacuagaggagagaguu

SEQ ID NO: 517035 - RNA, 32 nt, Human
ugcaguaggagggagaggaaggggugccaccg

SEQ ID NO: 517036 - RNA, 22 nt, Human
ugcaguaggcaccagagguggg

SEQ ID NO: 517037 - RNA, 32 nt, Human
ugcaguaggggagagagcagagaaguacaggu

SEQ ID NO: 517038 - RNA, 32 nt, Human
ugcaguaguuuacgccuguaaucccagcacug

SEQ ID NO: 517039 - RNA, 32 nt, Human
ugcaguaucugacagagaacucacaggaaguu

SEQ ID NO: 517040 - RNA, 20 nt, Human
ugcaguaugcuuauccuuga

SEQ ID NO: 517041 - RNA, 22 nt, Human
ugcaguauuuggauuugcuuga

SEQ ID NO: 517042 - RNA, 25 nt, Human
ugcaguauuugguuuucuguuccca

SEQ ID NO: 517043 - RNA, 25 nt, Human
ugcaguauuuuuacuccauuuuuga

SEQ ID NO: 517044 - RNA, 31 nt, Human
ugcagucaagugucugucauguguugauauc

SEQ ID NO: 517045 - RNA, 32 nt, Human
ugcagucacaccccugcacuccagccugggug

SEQ ID NO: 517046 - RNA, 32 nt, Human
ugcagucacccaggaggguuuuccuggggccc

SEQ ID NO: 517047 - RNA, 18 nt, Human
ugcagucacugggccagg

SEQ ID NO: 517048 - RNA, 32 nt, Human
ugcagucagcacucuccagugauuagaauggg

SEQ ID NO: 517049 - RNA, 32 nt, Human
ugcagucagcagcguggaggugucugggccac

SEQ ID NO: 517050 - RNA, 31 nt, Human
ugcagucaggaaccccaacucacuuggaaug

SEQ ID NO: 517051 - RNA, 32 nt, Human
ugcagucaggacaagagagcagguuugaacgu

SEQ ID NO: 517052 - RNA, 32 nt, Human
ugcagucagggugguggccugcagggaccuga

SEQ ID NO: 517053 - RNA, 32 nt, Human
ugcagucauuggagagagagcuccucauuucu

SEQ ID NO: 517054 - RNA, 32 nt, Human
ugcaguccaaggugccuggagccagaggucgg

SEQ ID NO: 517055 - RNA, 32 nt, Human
ugcaguccacguaacuggcugcagagaaaucu

SEQ ID NO: 517056 - RNA, 32 nt, Human
ugcaguccagccuggaugacagagugagacuc

SEQ ID NO: 517057 - RNA, 32 nt, Human
ugcaguccagccugggcagcaagagugaaacu

SEQ ID NO: 517058 - RNA, 32 nt, Human
ugcaguccagccugggcgacagagugagaccc

SEQ ID NO: 517059 - RNA, 32 nt, Human
ugcaguccagccugggcgacagagugagacuc

SEQ ID NO: 517060 - RNA, 32 nt, Human
ugcaguccagccugggcuacagagugagacug

SEQ ID NO: 517061 - RNA, 32 nt, Human
ugcaguccccuccauguuccccagcgccacua

SEQ ID NO: 517062 - RNA, 32 nt, Human
ugcaguccccuccauguuccccggcgccacua

SEQ ID NO: 517063 - RNA, 23 nt, Human
ugcagucccuggauucugugcca

SEQ ID NO: 517064 - RNA, 32 nt, Human
ugcagucccuguccucagacagugccaccaug

SEQ ID NO: 517065 - RNA, 32 nt, Human
ugcaguccgcaguccagccugggcgacagagc

SEQ ID NO: 517066 - RNA, 32 nt, Human
ugcaguccgcugacccuacuguccucacugaa

SEQ ID NO: 517067 - RNA, 32 nt, Human
ugcaguccuccaccaugccggaauccacuugc

SEQ ID NO: 517068 - RNA, 32 nt, Human
ugcaguccuccccuacccacucccugcccuuc

SEQ ID NO: 517069 - RNA, 32 nt, Human
ugcaguccucggccagccuggcugucaguugg

SEQ ID NO: 517070 - RNA, 32 nt, Human
ugcaguccugugagggugugcauaaccguucc

SEQ ID NO: 517071 - RNA, 21 nt, Human
ugcagucgccgccgccgccgc

SEQ ID NO: 517072 - RNA, 32 nt, Human
ugcagucgcguuccugcuguccggacacuuuu

SEQ ID NO: 517073 - RNA, 32 nt, Human
ugcagucgcugcaaccuacccucucucugccu

SEQ ID NO: 517074 - RNA, 32 nt, Human
ugcagucgcuguguguuuuagggucucauacc

SEQ ID NO: 517075 - RNA, 19 nt, Human
ugcagucggcccaggacgg

SEQ ID NO: 517076 - RNA, 32 nt, Human
ugcagucgggagguggaggcaccggcugcauu

SEQ ID NO: 517077 - RNA, 22 nt, Human
ugcagucguucccucuacccua

SEQ ID NO: 517078 - RNA, 24 nt, Human
ugcagucuccaccuccuggguuca

SEQ ID NO: 517079 - RNA, 32 nt, Human
ugcagucuccucucagucauucaucaaugugg

SEQ ID NO: 517080 - RNA, 24 nt, Human
ugcagucucgaccucccaggcuca

SEQ ID NO: 517081 - RNA, 32 nt, Human
ugcagucucugccucccaggcucaagugaucc

SEQ ID NO: 517082 - RNA, 32 nt, Human
ugcagucugcgucagccucugggaaaccacag

SEQ ID NO: 517083 - RNA, 32 nt, Human
ugcagucuggaagggcaggugggagcugugac

SEQ ID NO: 517084 - RNA, 32 nt, Human
ugcagucugggugggaugccugaaagagccca

SEQ ID NO: 517085 - RNA, 32 nt, Human
ugcagucugugcugugugucugggccugucuc

SEQ ID NO: 517086 - RNA, 32 nt, Human
ugcagucuguuuggugcauguaugaaugugau

SEQ ID NO: 517087 - RNA, 24 nt, Human
ugcagucuucaccucccagauuca

SEQ ID NO: 517088 - RNA, 32 nt, Human
ugcagucuuccaucugcuuucucuucauacug

SEQ ID NO: 517089 - RNA, 32 nt, Human
ugcagucuucccucagccuccugaguagcuag

SEQ ID NO: 517090 - RNA, 32 nt, Human
ugcagucuucucuucgcucuucagccugaagg

SEQ ID NO: 517091 - RNA, 32 nt, Human
ugcagugaacagcccuggcugggggugcagcc

SEQ ID NO: 517092 - RNA, 21 nt, Human
ugcagugaagaaaaaccuuua

SEQ ID NO: 517093 - RNA, 32 nt, Human
ugcagugacugugguuucuucccauuuuacuc

SEQ ID NO: 517094 - RNA, 32 nt, Human
ugcagugagacaccuuccuguauccagcuuuc

SEQ ID NO: 517095 - RNA, 32 nt, Human
ugcagugagccaagaucacaccacuccacucc

SEQ ID NO: 517096 - RNA, 32 nt, Human
ugcagugagccaagaucaugccacuuuacucc

SEQ ID NO: 517097 - RNA, 32 nt, Human
ugcagugagccaagaucgcaccgcugcacucc

SEQ ID NO: 517098 - RNA, 32 nt, Human
ugcagugagccaagauugcgccgcuacauucc

SEQ ID NO: 517099 - RNA, 32 nt, Human
ugcagugagccaagcgcgugccauuucacucc

SEQ ID NO: 517100 - RNA, 32 nt, Human
ugcagugagccaagcucacuucacugcacucc

SEQ ID NO: 517101 - RNA, 32 nt, Human
ugcagugagccacggcacuccacccugggcaa

SEQ ID NO: 517102 - RNA, 32 nt, Human
ugcagugagccacugcacuccagccugaugac

SEQ ID NO: 517103 - RNA, 32 nt, Human
ugcagugagccgagauugcgccacugcacucc

SEQ ID NO: 517104 - RNA, 32 nt, Human
ugcagugagccgggauugcagugagccacggc

SEQ ID NO: 517105 - RNA, 21 nt, Human
ugcagugagcuacugugauca

SEQ ID NO: 517106 - RNA, 32 nt, Human
ugcagugagcugucuggccuuuuguccuugau

SEQ ID NO: 517107 - RNA, 32 nt, Human
ugcagugaggcgccguccgccuucccuguguc

SEQ ID NO: 517108 - RNA, 32 nt, Human
ugcagugaguggagagccuacauaaaagagag

SEQ ID NO: 517109 - RNA, 32 nt, Human
ugcagugagugugaguuccuuccaggugugug

SEQ ID NO: 517110 - RNA, 32 nt, Human
ugcagugauggaaacacuuuucuuauguacca

SEQ ID NO: 517111 - RNA, 24 nt, Human
ugcagugcaauccugcaauucuca

SEQ ID NO: 517112 - RNA, 31 nt, Human
ugcagugcacuuuggggagcagauauuaacu

SEQ ID NO: 517113 - RNA, 18 nt, Human
ugcagugcagccugcucc

SEQ ID NO: 517114 - RNA, 32 nt, Human
ugcagugcagcucuaauaaaggccuuauuuuu

SEQ ID NO: 517115 - RNA, 32 nt, Human
ugcagugcagugacacgaucuugucucacugc

SEQ ID NO: 517116 - RNA, 32 nt, Human
ugcagugcagugagccaagaucgugccagugc

SEQ ID NO: 517117 - RNA, 32 nt, Human
ugcagugcaguggcaugaucauggcucgcugc

SEQ ID NO: 517118 - RNA, 32 nt, Human
ugcagugcaguggcaugaucuuggcuuacugc

SEQ ID NO: 517119 - RNA, 32 nt, Human
ugcagugcaguggugugaucuuggcucacuac

SEQ ID NO: 517120 - RNA, 32 nt, Human
ugcagugcaguugcugaggaacugagcagacu

SEQ ID NO: 517121 - RNA, 17 nt, Human
ugcagugcauccauuca

SEQ ID NO: 517122 - RNA, 32 nt, Human
ugcagugccaggacucagcccacugugcggcu

SEQ ID NO: 517123 - RNA, 32 nt, Human
ugcagugccccgagguggccaaggcugaccgg

SEQ ID NO: 517124 - RNA, 32 nt, Human
ugcagugccggcccagcuaacccuccagcccu

SEQ ID NO: 517125 - RNA, 32 nt, Human
ugcagugcggcagccucggccugggcaggccc

SEQ ID NO: 517126 - RNA, 32 nt, Human
ugcagugcuagacucaagcccugaccuuugca

SEQ ID NO: 517127 - RNA, 32 nt, Human
ugcagugcuaugagccuuauaucuguuaauau

SEQ ID NO: 517128 - RNA, 32 nt, Human
ugcagugcucaaaaucucagauuuuggagcau

SEQ ID NO: 517129 - RNA, 32 nt, Human
ugcagugcucaaggaauccucucccaucagcc

SEQ ID NO: 517130 - RNA, 32 nt, Human
ugcagugcucaauaaggcagugcagugcucag

SEQ ID NO: 517131 - RNA, 32 nt, Human
ugcagugcucaguaaggcagugcaauacucag

SEQ ID NO: 517132 - RNA, 32 nt, Human
ugcagugcugcccucauccuccagcagugcaa

SEQ ID NO: 517133 - RNA, 32 nt, Human
ugcagugcuuuugacuaucuuaugcaugguuu

SEQ ID NO: 517134 - RNA, 32 nt, Human
ugcaguggaacaaccuuggcucacggcaacuu

SEQ ID NO: 517135 - RNA, 32 nt, Human
ugcaguggaagucaugagguugcuugauaccc

SEQ ID NO: 517136 - RNA, 32 nt, Human
ugcaguggacccugcugcugccaagcugugga

SEQ ID NO: 517137 - RNA, 32 nt, Human
ugcaguggaucacgccuguaaucccagcacau

SEQ ID NO: 517138 - RNA, 32 nt, Human
ugcaguggaucaugucuguaauccuagcacug

SEQ ID NO: 517139 - RNA, 31 nt, Human
ugcaguggcacaaucucaacucacuacagcc

SEQ ID NO: 517140 - RNA, 31 nt, Human
ugcaguggcacaaucucagcucacugcaacc

SEQ ID NO: 517141 - RNA, 31 nt, Human
ugcaguggcacaaucucagcucacugcaagc

SEQ ID NO: 517142 - RNA, 31 nt, Human
ugcaguggcacaaucucaguucacugcaacc

SEQ ID NO: 517143 - RNA, 31 nt, Human
ugcaguggcacaaucucggcccgcugcagcc

SEQ ID NO: 517144 - RNA, 31 nt, Human
ugcaguggcacaaucucggcucacugcaacc

SEQ ID NO: 517145 - RNA, 31 nt, Human
ugcaguggcacaaucucggcucacugcaagc

SEQ ID NO: 517146 - RNA, 31 nt, Human
ugcaguggcacaaucucggcucacugcaauu

SEQ ID NO: 517147 - RNA, 31 nt, Human
ugcaguggcacaaucucggcucacugcagcc

SEQ ID NO: 517148 - RNA, 31 nt, Human
ugcaguggcacaaucucggcucacuguaacc

SEQ ID NO: 517149 - RNA, 31 nt, Human
ugcaguggcacaaucucugcucacugcaagc

SEQ ID NO: 517150 - RNA, 32 nt, Human
ugcaguggcacacaccuguagucccagcuaca

SEQ ID NO: 517151 - RNA, 32 nt, Human
ugcaguggcacacggcuguaaucccagcacuu

SEQ ID NO: 517152 - RNA, 31 nt, Human
ugcaguggcaccaucucagcucacugcaacc

SEQ ID NO: 517153 - RNA, 31 nt, Human
ugcaguggcacgaucucagcucacugcaacc

SEQ ID NO: 517154 - RNA, 31 nt, Human
ugcaguggcacgaucucagcucacugcaagc

SEQ ID NO: 517155 - RNA, 31 nt, Human
ugcaguggcacgaucucagcucauugcaacc

SEQ ID NO: 517156 - RNA, 31 nt, Human
ugcaguggcacgaucucagcucauugcagcc

SEQ ID NO: 517157 - RNA, 31 nt, Human
ugcaguggcauaaucucagcucacugcaguc

SEQ ID NO: 517158 - RNA, 31 nt, Human
ugcaguggcaugaucucagcucacugaagcc

SEQ ID NO: 517159 - RNA, 31 nt, Human
ugcaguggcaugaucucagcucacuguaacc

SEQ ID NO: 517160 - RNA, 31 nt, Human
ugcaguggcaugaucucagcucacuguaggc

SEQ ID NO: 517161 - RNA, 32 nt, Human
ugcaguggcaugugcuuguaaucccagcuacu

SEQ ID NO: 517162 - RNA, 19 nt, Human
ugcaguggccaggcauggu

SEQ ID NO: 517163 - RNA, 32 nt, Human
ugcaguggccaggugacauuccuguggagaaa

SEQ ID NO: 517164 - RNA, 32 nt, Human
ugcaguggcccaugccuguaaucccagcacuu

SEQ ID NO: 517165 - RNA, 32 nt, Human
ugcaguggcccuucuacccugcaccugaccuc

SEQ ID NO: 517166 - RNA, 31 nt, Human
ugcaguggcgcaaucucagcucaccgcaacc

SEQ ID NO: 517167 - RNA, 31 nt, Human
ugcaguggcgcaaucucagcucacugcaacc

SEQ ID NO: 517168 - RNA, 31 nt, Human
ugcaguggcgcaaucucagcucacugcaacg

SEQ ID NO: 517169 - RNA, 31 nt, Human
ugcaguggcgcaaucucagcucacugcaagc

SEQ ID NO: 517170 - RNA, 31 nt, Human
ugcaguggcgcaaucucagcucacugccacc

SEQ ID NO: 517171 - RNA, 31 nt, Human
ugcaguggcgcgaucucagcucacuacaacc

SEQ ID NO: 517172 - RNA, 31 nt, Human
ugcaguggcgcgaucucagcucacugcaacc

SEQ ID NO: 517173 - RNA, 31 nt, Human
ugcaguggcgcgaucucagcucacugcaagc

SEQ ID NO: 517174 - RNA, 31 nt, Human
ugcaguggcgcgaucucagcucacugcagcc

SEQ ID NO: 517175 - RNA, 31 nt, Human
ugcaguggcgcgaucucagcucacugccacc

SEQ ID NO: 517176 - RNA, 31 nt, Human
ugcaguggcgcgaucucagcuuacugcaagc

SEQ ID NO: 517177 - RNA, 32 nt, Human
ugcaguggcuaaagccuguaaucccagcacuu

SEQ ID NO: 517178 - RNA, 32 nt, Human
ugcaguggcucaagccuguaaugucagcacuu

SEQ ID NO: 517179 - RNA, 32 nt, Human
ugcaguggcucacacauguaaucccaccuacu

SEQ ID NO: 517180 - RNA, 32 nt, Human
ugcaguggcucacaccgguaaucccagcacuu

SEQ ID NO: 517181 - RNA, 32 nt, Human
ugcaguggcucacaccuauaaucccaacacuu

SEQ ID NO: 517182 - RNA, 32 nt, Human
ugcaguggcucacaccuauaaucccagcacuu

SEQ ID NO: 517183 - RNA, 32 nt, Human
ugcaguggcucacaccuguaauaccagcacuu

SEQ ID NO: 517184 - RNA, 32 nt, Human
ugcaguggcucacaccuguaauaccagcaguu

SEQ ID NO: 517185 - RNA, 23 nt, Human
ugcaguggcucacaccuguaauc

SEQ ID NO: 517186 - RNA, 32 nt, Human
ugcaguggcucacaccuguaaucccaacauuu

SEQ ID NO: 517187 - RNA, 32 nt, Human
ugcaguggcucacaccuguaaucccagcacuu

SEQ ID NO: 517188 - RNA, 32 nt, Human
ugcaguggcucacaccuguaaucccagugcuu

SEQ ID NO: 517189 - RNA, 32 nt, Human
ugcaguggcucacaccuguaauccuagcacuu

SEQ ID NO: 517190 - RNA, 32 nt, Human
ugcaguggcucacaccuguaauccuagcaucu

SEQ ID NO: 517191 - RNA, 32 nt, Human
ugcaguggcucacaccuguaaucucaacacuu

SEQ ID NO: 517192 - RNA, 32 nt, Human
ugcaguggcucacaccuguaaucucagcacuu

SEQ ID NO: 517193 - RNA, 32 nt, Human
ugcaguggcucacaccuguaauuccagcacuu

SEQ ID NO: 517194 - RNA, 32 nt, Human
ugcaguggcucacaccuguauucccaacacuu

SEQ ID NO: 517195 - RNA, 32 nt, Human
ugcaguggcucacaccuguauucccagcacuu

SEQ ID NO: 517196 - RNA, 32 nt, Human
ugcaguggcucacaccugucauuccagcacuu

SEQ ID NO: 517197 - RNA, 32 nt, Human
ugcaguggcucacaccugugaucccagcacuu

SEQ ID NO: 517198 - RNA, 32 nt, Human
ugcaguggcucacaccuguggaaucccagcac

SEQ ID NO: 517199 - RNA, 32 nt, Human
ugcaguggcucacaccuuuaaucccagcacuu

SEQ ID NO: 517200 - RNA, 32 nt, Human
ugcaguggcucacacuuguaaucccagcacuu

SEQ ID NO: 517201 - RNA, 32 nt, Human
ugcaguggcucacaucuguaaucucaacacuu

SEQ ID NO: 517202 - RNA, 32 nt, Human
ugcaguggcucacgccuauaaucccaacacuu

SEQ ID NO: 517203 - RNA, 32 nt, Human
ugcaguggcucacgccuauaaucccagcacuu

SEQ ID NO: 517204 - RNA, 32 nt, Human
ugcaguggcucacgccuguaaucccaacacuu

SEQ ID NO: 517205 - RNA, 32 nt, Human
ugcaguggcucacgccuguaaucccagcaauu

SEQ ID NO: 517206 - RNA, 32 nt, Human
ugcaguggcucacgccuguaaucccagcacug

SEQ ID NO: 517207 - RNA, 32 nt, Human
ugcaguggcucacgccuguaaucccagcacuu

SEQ ID NO: 517208 - RNA, 32 nt, Human
ugcaguggcucacgcuuauaaucccagcacuu

SEQ ID NO: 517209 - RNA, 32 nt, Human
ugcaguggcucacgcuuguaaucccagcacuu

SEQ ID NO: 517210 - RNA, 32 nt, Human
ugcaguggcucacguauguaaucccagcacuu

SEQ ID NO: 517211 - RNA, 32 nt, Human
ugcaguggcucacgucuguaaucccagcacuu

SEQ ID NO: 517212 - RNA, 32 nt, Human
ugcaguggcucacuccuguaauccgagcaauu

SEQ ID NO: 517213 - RNA, 32 nt, Human
ugcaguggcucacuccuguaauccuagcaguu

SEQ ID NO: 517214 - RNA, 32 nt, Human
ugcaguggcucacugcaaccugggugacagaa

SEQ ID NO: 517215 - RNA, 23 nt, Human
ugcaguggcucaggccuguaauc

SEQ ID NO: 517216 - RNA, 32 nt, Human
ugcaguggcucaggccuguaaucccaacccuu

SEQ ID NO: 517217 - RNA, 32 nt, Human
ugcaguggcucaggccuguaaucccagcacuu

SEQ ID NO: 517218 - RNA, 32 nt, Human
ugcaguggcucaggccuguaaucccagcauuu

SEQ ID NO: 517219 - RNA, 32 nt, Human
ugcaguggcucauaccuguaaucccagcacuu

SEQ ID NO: 517220 - RNA, 32 nt, Human
ugcaguggcucaugccuauaaucccagcacuu

SEQ ID NO: 517221 - RNA, 32 nt, Human
ugcaguggcucaugccuauaaucccagcucuu

SEQ ID NO: 517222 - RNA, 23 nt, Human
ugcaguggcucaugccuguaauc

SEQ ID NO: 517223 - RNA, 32 nt, Human
ugcaguggcucaugccuguaaucccaacacuu

SEQ ID NO: 517224 - RNA, 32 nt, Human
ugcaguggcucaugccuguaaucccagcaccu

SEQ ID NO: 517225 - RNA, 32 nt, Human
ugcaguggcucaugccuguaaucccagcacua

SEQ ID NO: 517226 - RNA, 32 nt, Human
ugcaguggcucaugccuguaaucccagcacuu

SEQ ID NO: 517227 - RNA, 32 nt, Human
ugcaguggcucaugccuguaaucccagcauuu

SEQ ID NO: 517228 - RNA, 32 nt, Human
ugcaguggcucaugccuguaaucucagcaauu

SEQ ID NO: 517229 - RNA, 32 nt, Human
ugcaguggcucaugccuguaauuccaauguga

SEQ ID NO: 517230 - RNA, 23 nt, Human
ugcaguggcucaugcuuguaauc

SEQ ID NO: 517231 - RNA, 32 nt, Human
ugcaguggcucaugcuuguaaucccagcacuu

SEQ ID NO: 517232 - RNA, 32 nt, Human
ugcaguggcucgcaccuguaaucccagcacuu

SEQ ID NO: 517233 - RNA, 32 nt, Human
ugcaguggcucgcgccuguaaucccagcacuu

SEQ ID NO: 517234 - RNA, 32 nt, Human
ugcaguggcucgugccuguaaucccagcacuu

SEQ ID NO: 517235 - RNA, 32 nt, Human
ugcaguggcucuugccuguaaucccagcacuu

SEQ ID NO: 517236 - RNA, 32 nt, Human
ugcaguggcugcaggcgcagaacagagcguua

SEQ ID NO: 517237 - RNA, 32 nt, Human
ugcaguggcuuacaccaguaaucccagcacuu

SEQ ID NO: 517238 - RNA, 32 nt, Human
ugcaguggcuuacaccuguaaucccagcacuu

SEQ ID NO: 517239 - RNA, 21 nt, Human
ugcaguggcuuacaucuguaa

SEQ ID NO: 517240 - RNA, 32 nt, Human
ugcaguggcuuaugcuuguaaucccagcacuu

SEQ ID NO: 517241 - RNA, 32 nt, Human
ugcaguggcuuuggggacucagcaguggcaag

SEQ ID NO: 517242 - RNA, 32 nt, Human
ugcagugggagaggggacacgcagggccuggc

SEQ ID NO: 517243 - RNA, 32 nt, Human
ugcagugggcucaggagucugcauuugugggu

SEQ ID NO: 517244 - RNA, 21 nt, Human
ugcaguggggauuccaguaag

SEQ ID NO: 517245 - RNA, 32 nt, Human
ugcaguggggcaucgucugucuugccuuguca

SEQ ID NO: 517246 - RNA, 32 nt, Human
ugcaguggggccaccaggaagugccggccaag

SEQ ID NO: 517247 - RNA, 31 nt, Human
ugcagugguacaaucucggcucacugcaacc

SEQ ID NO: 517248 - RNA, 31 nt, Human
ugcagugguacgaucucagcucaccaaaucu

SEQ ID NO: 517249 - RNA, 31 nt, Human
ugcagugguauaaucucagcucacugcaacc

SEQ ID NO: 517250 - RNA, 32 nt, Human
ugcaguggucucagcugcuucccuggggguaa

SEQ ID NO: 517251 - RNA, 31 nt, Human
ugcaguggugcaaucucagcucacuacaacc

SEQ ID NO: 517252 - RNA, 31 nt, Human
ugcaguggugcaaucucagcucacugcaaac

SEQ ID NO: 517253 - RNA, 31 nt, Human
ugcaguggugcaaucucagcucacugcaacc

SEQ ID NO: 517254 - RNA, 31 nt, Human
ugcaguggugcaaucucagcucacugcagcc

SEQ ID NO: 517255 - RNA, 31 nt, Human
ugcaguggugcaaucucagcuugcugcaaac

SEQ ID NO: 517256 - RNA, 31 nt, Human
ugcaguggugcaaucucaguucacugcaacc

SEQ ID NO: 517257 - RNA, 31 nt, Human
ugcaguggugcgaucucagcucacugcaacc

SEQ ID NO: 517258 - RNA, 31 nt, Human
ugcaguggugcgaucucagcucacugcaagc

SEQ ID NO: 517259 - RNA, 31 nt, Human
ugcaguggugcgaucucagcucacugcagcc

SEQ ID NO: 517260 - RNA, 31 nt, Human
ugcaguggugcgaucucagcucacugcaucc

SEQ ID NO: 517261 - RNA, 31 nt, Human
ugcaguggugcgaucucagcucacuguacuc

SEQ ID NO: 517262 - RNA, 31 nt, Human
ugcaguggugcgaucucagcuuacugcagcc

SEQ ID NO: 517263 - RNA, 31 nt, Human
ugcaguggugcgaucucagcuuauuacaacc

SEQ ID NO: 517264 - RNA, 32 nt, Human
ugcaguggugggcaccuguaaucccagcuacu

SEQ ID NO: 517265 - RNA, 32 nt, Human
ugcagugguucacaccuguaauugcagcacuu

SEQ ID NO: 517266 - RNA, 32 nt, Human
ugcagugguucacgccuguauucccagcauuu

SEQ ID NO: 517267 - RNA, 32 nt, Human
ugcagugguucaucugaaggcuggauuccauu

SEQ ID NO: 517268 - RNA, 32 nt, Human
ugcagugguucaugccuguaauccagcacuuu

SEQ ID NO: 517269 - RNA, 32 nt, Human
ugcagugguucaugccuguaaucccagcacuu

SEQ ID NO: 517270 - RNA, 32 nt, Human
ugcagugucaugccuauaagcauuucuccuau

SEQ ID NO: 517271 - RNA, 19 nt, Human
ugcaguguccuucguucac

SEQ ID NO: 517272 - RNA, 32 nt, Human
ugcagugucucaagccuauaaucccagcacuu

SEQ ID NO: 517273 - RNA, 32 nt, Human
ugcagugucuuucaccuguaaucccagcacuu

SEQ ID NO: 517274 - RNA, 32 nt, Human
ugcagugugauuuggacuuagguguguguauc

SEQ ID NO: 517275 - RNA, 32 nt, Human
ugcagugugcugccuacaccuccaccuccuuc

SEQ ID NO: 517276 - RNA, 32 nt, Human
ugcaguguggaggauaaccagugccuuacaaa

SEQ ID NO: 517277 - RNA, 25 nt, Human
ugcaguguggcucaugccuauaauc

SEQ ID NO: 517278 - RNA, 32 nt, Human
ugcaguguggugagaucaugccacuacacucc

SEQ ID NO: 517279 - RNA, 32 nt, Human
ugcaguguucaguuuccuugggggccugcucc

SEQ ID NO: 517280 - RNA, 32 nt, Human
ugcaguguucaucaaagagagagacagugaac

SEQ ID NO: 517281 - RNA, 32 nt, Human
ugcaguguugguccacacuaccauccuaagug

SEQ ID NO: 517282 - RNA, 32 nt, Human
ugcaguuaagaggcagcucauuuguccaaauu

SEQ ID NO: 517283 - RNA, 32 nt, Human
ugcaguuaagccuguugucuguuguagucugu

SEQ ID NO: 517284 - RNA, 32 nt, Human
ugcaguuaauaucaguguuggaagaugucuuu

SEQ ID NO: 517285 - RNA, 32 nt, Human
ugcaguuacauggccacaucuuuggucauugu

SEQ ID NO: 517286 - RNA, 32 nt, Human
ugcaguuagauaccagaugcaccagaacaggc

SEQ ID NO: 517287 - RNA, 32 nt, Human
ugcaguucagaauggcaguccuggaggcaggg

SEQ ID NO: 517288 - RNA, 32 nt, Human
ugcaguucagcccggcugaagcugaccgaaug

SEQ ID NO: 517289 - RNA, 32 nt, Human
ugcaguucaggagauagcuguucuccagccuu

SEQ ID NO: 517290 - RNA, 32 nt, Human
ugcaguuccagaggauccuggacgaccccucc

SEQ ID NO: 517291 - RNA, 32 nt, Human
ugcaguucccguuuccgccauggaugccucau

SEQ ID NO: 517292 - RNA, 32 nt, Human
ugcaguuccugcccccauucucuuggggucag

SEQ ID NO: 517293 - RNA, 32 nt, Human
ugcaguucucaugacuccuacuuuucauccua

SEQ ID NO: 517294 - RNA, 32 nt, Human
ugcaguucugagaagguggaggcaccaggcuc

SEQ ID NO: 517295 - RNA, 32 nt, Human
ugcaguugagauagaggaaggccgcugucuca

SEQ ID NO: 517296 - RNA, 32 nt, Human
ugcaguugcaagcacagaugcugccaccagug

SEQ ID NO: 517297 - RNA, 32 nt, Human
ugcaguugcccagccccaauucuuuauuugga

SEQ ID NO: 517298 - RNA, 32 nt, Human
ugcaguugucuggaagccuggguggcgucaug

SEQ ID NO: 517299 - RNA, 32 nt, Human
ugcaguuguguccaggggcagccguagaccac

SEQ ID NO: 517300 - RNA, 32 nt, Human
ugcaguuguuuauuuguuuacaguuauuuccc

SEQ ID NO: 517301 - RNA, 32 nt, Human
ugcaguuuaucccacacacugcacuuagggag

SEQ ID NO: 517302 - RNA, 32 nt, Human
ugcaguuucccagcugcagccuaggcagggga

SEQ ID NO: 517303 - RNA, 32 nt, Human
ugcaguuucuaaaaucacacaggugagugggc

SEQ ID NO: 517304 - RNA, 32 nt, Human
ugcaguuucucauuugcuguggacaugaccau

SEQ ID NO: 517305 - RNA, 32 nt, Human
ugcaguuucuuucucuuuccauaaguacuuuc

SEQ ID NO: 517306 - RNA, 32 nt, Human
ugcaguuuggcaaccuguguccuggcugagga

SEQ ID NO: 517307 - RNA, 32 nt, Human
ugcaguuugggcuccguagcugcucagcaaau

SEQ ID NO: 517308 - RNA, 32 nt, Human
ugcaguuuuauuauugcuugugccucaacugu

SEQ ID NO: 517309 - RNA, 24 nt, Human
ugcaguuuugaccucccaggcuca

SEQ ID NO: 517310 - RNA, 32 nt, Human
ugcauaaaaguuaaagagaggggaaagauuac

SEQ ID NO: 517311 - RNA, 32 nt, Human
ugcauaaaauccuaaaacagacuucuguauag

SEQ ID NO: 517312 - RNA, 32 nt, Human
ugcauaaagcucuccccuccugugaccagcug

SEQ ID NO: 517313 - RNA, 32 nt, Human
ugcauaacaauaacaggaaugacuuugccugc

SEQ ID NO: 517314 - RNA, 32 nt, Human
ugcauaaccagcugccacccucaggccugggc

SEQ ID NO: 517315 - RNA, 32 nt, Human
ugcauaagcacagcucaagaacugagcuuugu

SEQ ID NO: 517316 - RNA, 32 nt, Human
ugcauaagcccugggcugcuguggacccaacc

SEQ ID NO: 517317 - RNA, 32 nt, Human
ugcauaaggaagaacucuacagcagcccaauc

SEQ ID NO: 517318 - RNA, 23 nt, Human
ugcauaaguccuagugggucaag

SEQ ID NO: 517319 - RNA, 32 nt, Human
ugcauaagugugaccuggaugugagacacgga

SEQ ID NO: 517320 - RNA, 32 nt, Human
ugcauaaucauuucucagauucagaugcaaaa

SEQ ID NO: 517321 - RNA, 32 nt, Human
ugcauaaucucagccacucuuucacaacuaua

SEQ ID NO: 517322 - RNA, 32 nt, Human
ugcauaauucugaaguuauauuuccuauacca

SEQ ID NO: 517323 - RNA, 32 nt, Human
ugcauacaaaggacacacagggauuuugaaaa

SEQ ID NO: 517324 - RNA, 32 nt, Human
ugcauacaagcagauucagcacugccuaccag

SEQ ID NO: 517325 - RNA, 32 nt, Human
ugcauacaagucugaguggcagaagcuucaag

SEQ ID NO: 517326 - RNA, 32 nt, Human
ugcauacacacagacauacacaugcacucaca

SEQ ID NO: 517327 - RNA, 32 nt, Human
ugcauacacaccaacacacauaugcacacuca

SEQ ID NO: 517328 - RNA, 32 nt, Human
ugcauacacagugcuaaugaggugccuucggg

SEQ ID NO: 517329 - RNA, 32 nt, Human
ugcauacacaugcacacucagacacaugguca

SEQ ID NO: 517330 - RNA, 32 nt, Human
ugcauacacaugccuccaugcauauaugugug

SEQ ID NO: 517331 - RNA, 32 nt, Human
ugcauacacaugccugcauacaggcauacaca

SEQ ID NO: 517332 - RNA, 32 nt, Human
ugcauacaggggaggggcgcaccccacagcug

SEQ ID NO: 517333 - RNA, 32 nt, Human
ugcauacauacacauauauacacacacaaaga

SEQ ID NO: 517334 - RNA, 32 nt, Human
ugcauacauauauacacacauauguauauaaa

SEQ ID NO: 517335 - RNA, 32 nt, Human
ugcauacaugugggccagccugccucacuuua

SEQ ID NO: 517336 - RNA, 32 nt, Human
ugcauaccaauaagaaaacuuaccuuauuuug

SEQ ID NO: 517337 - RNA, 32 nt, Human
ugcauaccacacugcccggcacgccacaucca

SEQ ID NO: 517338 - RNA, 32 nt, Human
ugcauaccauagggcagggcaccccacuaugg

SEQ ID NO: 517339 - RNA, 21 nt, Human
ugccgggauuacaggcaugag

SEQ ID NO: 517340 - RNA, 32 nt, Human
ugccgggauuacaggcaugagccaccgcuccc

SEQ ID NO: 517341 - RNA, 32 nt, Human
ugccgggauuacaggcaugagccacugcaccc

SEQ ID NO: 517342 - RNA, 32 nt, Human
ugccgggauuacaggcaugagccacugugucu

SEQ ID NO: 517343 - RNA, 32 nt, Human
ugccgggauuacaggcaugagccuccacaccu

SEQ ID NO: 517344 - RNA, 32 nt, Human
ugccgggauuacaggcgugagccaccuugccu

SEQ ID NO: 517345 - RNA, 32 nt, Human
ugccgggauugcaggcaugagccuccacaccu

SEQ ID NO: 517346 - RNA, 23 nt, Human
ugccgggcccacucaccugcaca

SEQ ID NO: 517347 - RNA, 22 nt, Human
ugccgggccuugauucugcgga

SEQ ID NO: 517348 - RNA, 32 nt, Human
ugccgggcucuuggggcugagcuacgggcugc

SEQ ID NO: 517349 - RNA, 32 nt, Human
ugccggggacugccucgacucugguuuuggca

SEQ ID NO: 517350 - RNA, 32 nt, Human
ugccggggaggaggaggaggaggaagaggagg

SEQ ID NO: 517351 - RNA, 22 nt, Human
ugccggggccccgaccccggcc

SEQ ID NO: 517352 - RNA, 32 nt, Human
ugccgggggacgcugggcugagcggccggcgg

SEQ ID NO: 517353 - RNA, 32 nt, Human
ugccgggggccgcuggacccaccagcugcacg

SEQ ID NO: 517354 - RNA, 32 nt, Human
ugccgggguaggcagggggaggagaacgcuca

SEQ ID NO: 517355 - RNA, 22 nt, Human
ugccggguaaagcuguaugcca

SEQ ID NO: 517356 - RNA, 15 nt, Human
ugccgggugcagugg

SEQ ID NO: 517357 - RNA, 32 nt, Human
ugccggguguugcuucagcccagagccagagg

SEQ ID NO: 517358 - RNA, 32 nt, Human
ugccggguucacgccauucuccugccucagcc

SEQ ID NO: 517359 - RNA, 32 nt, Human
ugccggguugacuuggcugggguggugggaau

SEQ ID NO: 517360 - RNA, 32 nt, Human
ugccgguagcccaggagauggagcagcccagc

SEQ ID NO: 517361 - RNA, 32 nt, Human
ugccggucaccaggccacugugcagugggcgc

SEQ ID NO: 517362 - RNA, 32 nt, Human
ugccggucuccuacucuucauggccuuuguac

SEQ ID NO: 517363 - RNA, 32 nt, Human
ugccggucugcaggauguaguuuaacaauuug

SEQ ID NO: 517364 - RNA, 32 nt, Human
ugccggugaaaacagucuaguacacaggugcu

SEQ ID NO: 517365 - RNA, 32 nt, Human
ugccgguggaucaggcagguccacacuugcua

SEQ ID NO: 517366 - RNA, 32 nt, Human
ugccgguggcuccugcucacaugucuucgggu

SEQ ID NO: 517367 - RNA, 22 nt, Human
ugccggugggccuguguugcug

SEQ ID NO: 517368 - RNA, 32 nt, Human
ugccgguguccccagagcagggacucugucac

SEQ ID NO: 517369 - RNA, 32 nt, Human
ugccgguuauucacuaggaauauuuccccaag

SEQ ID NO: 517370 - RNA, 32 nt, Human
ugccgguuauuuuucuguccugggaacagccu

SEQ ID NO: 517371 - RNA, 32 nt, Human
ugccgguugacaugaagaagcagcagcggcua

SEQ ID NO: 517372 - RNA, 22 nt, Human
ugccgguuucaacaaaugucca

SEQ ID NO: 517373 - RNA, 32 nt, Human
ugccguaacucacgccuguaaucccagcacuu

SEQ ID NO: 517374 - RNA, 32 nt, Human
ugccguacucgcacuccagagcccugggaugu

SEQ ID NO: 517375 - RNA, 23 nt, Human
ugccguagucccagcuacuugga

SEQ ID NO: 517376 - RNA, 32 nt, Human
ugccguaucugugcguuccuucauccuggucc

SEQ ID NO: 517377 - RNA, 32 nt, Human
ugccguauuuauuguuuuaaaaaugaaaggaa

SEQ ID NO: 517378 - RNA, 32 nt, Human
ugccgucaauaugcacuguacauuccacaagc

SEQ ID NO: 517379 - RNA, 32 nt, Human
ugccgucacaccacuguguauuuaacugccau

SEQ ID NO: 517380 - RNA, 31 nt, Human
ugccgucacagcugggccaguaaaguaccuu

SEQ ID NO: 517381 - RNA, 32 nt, Human
ugccgucagacucuggcagggcucccagagga

SEQ ID NO: 517382 - RNA, 32 nt, Human
ugccgucagacucuggcagggcucccagaggu

SEQ ID NO: 517383 - RNA, 32 nt, Human
ugccgucagggcagugccaugcugaccugcug

SEQ ID NO: 517384 - RNA, 32 nt, Human
ugccgucaguucuuccuuucuccguggcuggc

SEQ ID NO: 517385 - RNA, 32 nt, Human
ugccgucaucacaaugaugauauagggauauu

SEQ ID NO: 517386 - RNA, 32 nt, Human
ugccgucauccaggcuggacaguucagugauu

SEQ ID NO: 517387 - RNA, 32 nt, Human
ugccgucaugcugcuggccugagacaguaucc

SEQ ID NO: 517388 - RNA, 32 nt, Human
ugccguccccagccugccacgggugcgaggac

SEQ ID NO: 517389 - RNA, 28 nt, Human
ugccgucccccgacugccucauucuuug

SEQ ID NO: 517390 - RNA, 32 nt, Human
ugccgucccugggccacuggccuggcgccugu

SEQ ID NO: 517391 - RNA, 32 nt, Human
ugccgucgccgcugcaaccuccacuacugcuu

SEQ ID NO: 517392 - RNA, 23 nt, Human
ugccgucuccaucucagugccaa

SEQ ID NO: 517393 - RNA, 32 nt, Human
ugccgucucggaaggguuagcacacagccagg

SEQ ID NO: 517394 - RNA, 21 nt, Human
ugccgucugccaccccgccac

SEQ ID NO: 517395 - RNA, 32 nt, Human
ugccgucugcgcuccagccuucgccuggcaga

SEQ ID NO: 517396 - RNA, 32 nt, Human
ugccgugaagauccaggcaucuugccgggcuc

SEQ ID NO: 517397 - RNA, 32 nt, Human
ugccgugacuccagaggccugaggcuccaggg

SEQ ID NO: 517398 - RNA, 32 nt, Human
ugccgugcagccaggcagaggcgaggaaggcu

SEQ ID NO: 517399 - RNA, 32 nt, Human
ugccgugcauuugcugagagauaaaaacauuc

SEQ ID NO: 517400 - RNA, 24 nt, Human
ugccgugcccggccggugcugcug

SEQ ID NO: 517401 - RNA, 32 nt, Human
ugccgugcuuuuaguguucccugaagaauacu

SEQ ID NO: 517402 - RNA, 32 nt, Human
ugccguggcaaagagcucagaaauccaauuug

SEQ ID NO: 517403 - RNA, 31 nt, Human
ugccguggcacaaucuccgcucacugcaacc

SEQ ID NO: 517404 - RNA, 31 nt, Human
ugccguggcacgaucucagcucacugcaacc

SEQ ID NO: 517405 - RNA, 31 nt, Human
ugccguggcgcaaucucagcucacugcaacc

SEQ ID NO: 517406 - RNA, 32 nt, Human
ugccguggcucacaccuguaaucccagcauuu

SEQ ID NO: 517407 - RNA, 32 nt, Human
ugccguggcucacaccuguaaucccaguaccu

SEQ ID NO: 517408 - RNA, 32 nt, Human
ugccguggcucacaccuguaaucugagcacau

SEQ ID NO: 517409 - RNA, 32 nt, Human
ugccguggcucacgccuguaaucccagcacuu

SEQ ID NO: 517410 - RNA, 32 nt, Human
ugccguggcucacgccuguaaucccagcauuu

SEQ ID NO: 517411 - RNA, 32 nt, Human
ugccguggcucaugccuguaaucccagcacuu

SEQ ID NO: 517412 - RNA, 32 nt, Human
ugccgugggucacgccuguaaucccagcacuu

SEQ ID NO: 517413 - RNA, 32 nt, Human
ugccguggguggacacagcaagaaggcccuca

SEQ ID NO: 517414 - RNA, 32 nt, Human
ugccguggguggggacacaggagaagcacgga

SEQ ID NO: 517415 - RNA, 32 nt, Human
ugccgugugcugcuucucaucacugcacacaa

SEQ ID NO: 517416 - RNA, 32 nt, Human
ugccguguuacccaggcuagucacgaacuccu

SEQ ID NO: 517417 - RNA, 32 nt, Human
ugccguuacucuaccccgagacugccuucugc

SEQ ID NO: 517418 - RNA, 32 nt, Human
ugccguuccauccugguucagagaaggccgag

SEQ ID NO: 517419 - RNA, 32 nt, Human
ugccguucguuucucguugccuaagauguuuu

SEQ ID NO: 517420 - RNA, 32 nt, Human
ugccguugagccagaagaugucucgugugaag

SEQ ID NO: 517421 - RNA, 32 nt, Human
ugccguugcacuccagccgggcaacaagggcu

SEQ ID NO: 517422 - RNA, 32 nt, Human
ugccguugcacuccagccugggcaacaagagu

SEQ ID NO: 517423 - RNA, 32 nt, Human
ugccguugcacuccagccugggcgacaagagc

SEQ ID NO: 517424 - RNA, 24 nt, Human
ugccguuggugccgccgccgccgc

SEQ ID NO: 517425 - RNA, 32 nt, Human
ugccguuguacuccagcuugggcaacagagug

SEQ ID NO: 517426 - RNA, 32 nt, Human
ugccguuucuccaagcacugcagguuccaccg

SEQ ID NO: 517427 - RNA, 32 nt, Human
ugccuaaaaaggauuuugugcuucguggcuug

SEQ ID NO: 517428 - RNA, 32 nt, Human
ugccuaaaaguggagagccaggggaguguggg

SEQ ID NO: 517429 - RNA, 32 nt, Human
ugccuaaaugaccacgggccagugacuuuacc

SEQ ID NO: 517430 - RNA, 32 nt, Human
ugccuaacauggugaaaccccgucuccacuaa

SEQ ID NO: 517431 - RNA, 32 nt, Human
ugccuaacuucagagcagggcuucugaucccu

SEQ ID NO: 517432 - RNA, 32 nt, Human
ugccuaagagccuuuugaggagaccguccugg

SEQ ID NO: 517433 - RNA, 32 nt, Human
ugccuaagccuccugaguagcuaggacuacag

SEQ ID NO: 517434 - RNA, 32 nt, Human
ugccuaaggcugucugguauuucuuuucaagg

SEQ ID NO: 517435 - RNA, 32 nt, Human
ugccuaagggcuaggccacccagagacugugc

SEQ ID NO: 517436 - RNA, 32 nt, Human
ugccuaaggggauaaggaaaaauaaugugaaa

SEQ ID NO: 517437 - RNA, 23 nt, Human
ugccuaauacccgacguagcucu

SEQ ID NO: 517438 - RNA, 32 nt, Human
ugccuaaucugaaaucugaauccuaaugagaa

SEQ ID NO: 517439 - RNA, 32 nt, Human
ugccuaauuuuugccauucucauaauguggca

SEQ ID NO: 517440 - RNA, 32 nt, Human
ugccuacaaagcucugaauucaggucccaguu

SEQ ID NO: 517441 - RNA, 32 nt, Human
ugccuacaaauggagcuccacccuucagucug

SEQ ID NO: 517442 - RNA, 32 nt, Human
ugccuacacuucaaagcacgucuagcacuaau

SEQ ID NO: 517443 - RNA, 32 nt, Human
ugccuacagcagccagagcagcagggaguccg

SEQ ID NO: 517444 - RNA, 18 nt, Human
ugccuacagccccagccc

SEQ ID NO: 517445 - RNA, 32 nt, Human
ugccuacagcuuugccuguaacaugggcacag

SEQ ID NO: 517446 - RNA, 32 nt, Human
ugccuacagugcuacaggaggcugaggcaaga

SEQ ID NO: 517447 - RNA, 32 nt, Human
ugccuacauauuuuaucuucugaucucacuga

SEQ ID NO: 517448 - RNA, 32 nt, Human
ugccuacaucuucucucuuccccaucuugcau

SEQ ID NO: 517449 - RNA, 32 nt, Human
ugccuacccuccuucuugcccgccgggcugug

SEQ ID NO: 517450 - RNA, 32 nt, Human
ugccuaccuggccgcaaguccccagccccuca

SEQ ID NO: 517451 - RNA, 32 nt, Human
ugccuacgaggaaggccagcgcaugcaggacu

SEQ ID NO: 517452 - RNA, 32 nt, Human
ugccuacgauagagucuuccuuugggugaggu

SEQ ID NO: 517453 - RNA, 32 nt, Human
ugccuacgauaugcaggcugcacagaacacaa

SEQ ID NO: 517454 - RNA, 32 nt, Human
ugccuacuccaaaaggucuguccuuuuuaaug

SEQ ID NO: 517455 - RNA, 32 nt, Human
ugccuacucccagcucccaaggagacugagau

SEQ ID NO: 517456 - RNA, 21 nt, Human
ugccuacuccccgccaggggg

SEQ ID NO: 517457 - RNA, 32 nt, Human
ugccuacugcacuccagccugggcaacaaagu

SEQ ID NO: 517458 - RNA, 32 nt, Human
ugccuacuggaagccuguucuucagcuuuggg

SEQ ID NO: 517459 - RNA, 32 nt, Human
ugccuacugugugccacacaccauaucaggug

SEQ ID NO: 517460 - RNA, 32 nt, Human
ugccuacuucgccugcacugccauccuggaca

SEQ ID NO: 517461 - RNA, 32 nt, Human
ugccuagaaaccaggugguacauggcuccagc

SEQ ID NO: 517462 - RNA, 32 nt, Human
ugccuagaaccagcugcaccugcuguucucuu

SEQ ID NO: 517463 - RNA, 32 nt, Human
ugccuagaacucccguggugguccugagcaga

SEQ ID NO: 517464 - RNA, 32 nt, Human
ugccuagaagugaaauugcugggucaaagacu

SEQ ID NO: 517465 - RNA, 27 nt, Human
ugccuagaggcacggagccaccaggga

SEQ ID NO: 517466 - RNA, 32 nt, Human
ugccuagaguuugccuauccagaaguucuuuc

SEQ ID NO: 517467 - RNA, 32 nt, Human
ugccuagcaagaaucacauucguuucccagug

SEQ ID NO: 517468 - RNA, 32 nt, Human
ugccuagcaggccuuccuuuucaccaccucgg

SEQ ID NO: 517469 - RNA, 32 nt, Human
ugccuagccacacugucauagacacagacaug

SEQ ID NO: 517470 - RNA, 28 nt, Human
ugccuagccaugucugccucauccucag

SEQ ID NO: 517471 - RNA, 19 nt, Human
ugccuagccuacagagauc

SEQ ID NO: 517472 - RNA, 22 nt, Human
ugccuagcgacucuucuggcac

SEQ ID NO: 517473 - RNA, 32 nt, Human
ugccuagcucacugcuguuccucugcuugcac

SEQ ID NO: 517474 - RNA, 22 nt, Human
ugccuagcuggacacagcuccc

SEQ ID NO: 517475 - RNA, 32 nt, Human
ugccuagcuguuguaaguuuucaucaguagcu

SEQ ID NO: 517476 - RNA, 32 nt, Human
ugccuaggagaaaggccacgaauggcagcgga

SEQ ID NO: 517477 - RNA, 32 nt, Human
ugccuaggaggaagggacccagcugggucugg

SEQ ID NO: 517478 - RNA, 32 nt, Human
ugccuaggagguugaggcugcagugagcugug

SEQ ID NO: 517479 - RNA, 21 nt, Human
ugccuaggccagagugcagug

SEQ ID NO: 517480 - RNA, 32 nt, Human
ugccuaggcccagggucagucucagauggaag

SEQ ID NO: 517481 - RNA, 32 nt, Human
ugccuaggccuggaaauggaguaaaucuuuca

SEQ ID NO: 517482 - RNA, 19 nt, Human
ugccuaggcugagugcagu

SEQ ID NO: 517483 - RNA, 20 nt, Human
ugccuaggcugagugcagug

SEQ ID NO: 517484 - RNA, 21 nt, Human
ugccuaggcugagugcagugg

SEQ ID NO: 517485 - RNA, 21 nt, Human
ugccuaggcuggaaugcagug

SEQ ID NO: 517486 - RNA, 21 nt, Human
ugccuaggcuggaguacagug

SEQ ID NO: 517487 - RNA, 21 nt, Human
ugccuaggcuggagugaagug

SEQ ID NO: 517488 - RNA, 21 nt, Human
ugccuaggcuggagugcaaug

SEQ ID NO: 517489 - RNA, 21 nt, Human
ugccuaggcuggagugcagug

SEQ ID NO: 517490 - RNA, 32 nt, Human
ugccuaggcuggucucuaaccccugagcuccg

SEQ ID NO: 517491 - RNA, 32 nt, Human
ugccuagggggcagagggugcaguggcagugu

SEQ ID NO: 517492 - RNA, 32 nt, Human
ugccuaggguuuguaacccagggccugugcug

SEQ ID NO: 517493 - RNA, 32 nt, Human
ugccuagguugcugaaaacagggaggcaccug

SEQ ID NO: 517494 - RNA, 19 nt, Human
ugccuagguuggaguacag

SEQ ID NO: 517495 - RNA, 32 nt, Human
ugccuagugcauccuggcugugggcagccccu

SEQ ID NO: 517496 - RNA, 32 nt, Human
ugccuagugcuacaaaccuuccugugggacuc

SEQ ID NO: 517497 - RNA, 32 nt, Human
ugccuaguuuccucccccuccucuucucccuc

SEQ ID NO: 517498 - RNA, 23 nt, Human
ugccuaguuuccuuuuguuccuu

SEQ ID NO: 517499 - RNA, 20 nt, Human
ugccuauaagguugggauua

SEQ ID NO: 517500 - RNA, 24 nt, Human
ugccuauaaucccagcuacucaga

SEQ ID NO: 517501 - RNA, 24 nt, Human
ugccuauaaucccagcuacucagg

SEQ ID NO: 517502 - RNA, 24 nt, Human
ugccuauaaucccagcuacucggg

SEQ ID NO: 517503 - RNA, 22 nt, Human
ugccuauaaucccagcuacuug

SEQ ID NO: 517504 - RNA, 24 nt, Human
ugccuauaaucccagcuacuuggg

SEQ ID NO: 517505 - RNA, 24 nt, Human
ugccuauaaucccagcuauuuggg

SEQ ID NO: 517506 - RNA, 32 nt, Human
ugccuauaaucccagcucuuagggaggcagag

SEQ ID NO: 517507 - RNA, 24 nt, Human
ugccuauaaucccagcuucuuggg

SEQ ID NO: 517508 - RNA, 24 nt, Human
ugccuauaaucccagguacuuggg

SEQ ID NO: 517509 - RNA, 32 nt, Human
ugccuauaaucccagugcuuuacaaggcugag

SEQ ID NO: 517510 - RNA, 32 nt, Human
ugccuauaaucccagugcuuugggaagccgaa

SEQ ID NO: 517511 - RNA, 24 nt, Human
ugccuauaaucccggcuacucggg

SEQ ID NO: 517512 - RNA, 32 nt, Human
ugccuauaaucccggcuacucgggaggcugag

SEQ ID NO: 517513 - RNA, 24 nt, Human
ugccuauagccccagcuacuuggg

SEQ ID NO: 517514 - RNA, 32 nt, Human
ugccuauaggggacucacagacugcagaugca

SEQ ID NO: 517515 - RNA, 24 nt, Human
ugccuauagucccaacuacuaggg

SEQ ID NO: 517516 - RNA, 24 nt, Human
ugccuauagucccaacuacuuaga

SEQ ID NO: 517517 - RNA, 24 nt, Human
ugccuauagucccagcaacuuggg

SEQ ID NO: 517518 - RNA, 24 nt, Human
ugccuauagucccagcacuuuggg

SEQ ID NO: 517519 - RNA, 24 nt, Human
ugccuauagucccagccacuagga

SEQ ID NO: 517520 - RNA, 20 nt, Human
ugccuauagucccagcuacu

SEQ ID NO: 517521 - RNA, 24 nt, Human
ugccuauagucccagcuacucggg

SEQ ID NO: 517522 - RNA, 24 nt, Human
ugccuauagucccagcuacuuggg

SEQ ID NO: 517523 - RNA, 24 nt, Human
ugccuauagucccagcuccuuggg

SEQ ID NO: 517524 - RNA, 23 nt, Human
ugccuauagucccagcugcuggg

SEQ ID NO: 517525 - RNA, 23 nt, Human
ugccuauaguccuggcacuuuga

SEQ ID NO: 517526 - RNA, 24 nt, Human
ugccuauaguuuuagcuacuuggg

SEQ ID NO: 517527 - RNA, 32 nt, Human
ugccuauccugggaccuccacacuccugguuc

SEQ ID NO: 517528 - RNA, 32 nt, Human
ugccuaucugcacuuccaggugccccaccuau

SEQ ID NO: 517529 - RNA, 32 nt, Human
ugccuaucuggaccccugccuagguggauggc

SEQ ID NO: 517530 - RNA, 32 nt, Human
ugccuaucugugcucuuuccucccucugcggg

SEQ ID NO: 517531 - RNA, 32 nt, Human
ugccuaucuuuguccucucucuuccggcuucg

SEQ ID NO: 517532 - RNA, 32 nt, Human
ugccuaugagcuacugcacauaccucaaggcc

SEQ ID NO: 517533 - RNA, 32 nt, Human
ugccuaugcauucaugucugucuccaugcaug

SEQ ID NO: 517534 - RNA, 32 nt, Human
ugccuaugcccagggaauaagauguauucuuu

SEQ ID NO: 517535 - RNA, 32 nt, Human
ugccuaugcuggaaaggaccagaggaauuaau

SEQ ID NO: 517536 - RNA, 32 nt, Human
ugccuaugcuguguguuugcuauauucaaucu

SEQ ID NO: 517537 - RNA, 32 nt, Human
ugccuaugcuguugcccuccccagggccugag

SEQ ID NO: 517538 - RNA, 32 nt, Human
ugccuauggcccgugaguguucuugaagcuau

SEQ ID NO: 517539 - RNA, 32 nt, Human
ugccuaugggaaccaaaagaaucaagcugaac

SEQ ID NO: 517540 - RNA, 32 nt, Human
ugccuauguacauguguaaacaugccauagca

SEQ ID NO: 517541 - RNA, 32 nt, Human
ugccuaugugcaccacacauuccagugugcug

SEQ ID NO: 517542 - RNA, 32 nt, Human
ugccuauguggguggcaagccacccaggugcc

SEQ ID NO: 517543 - RNA, 32 nt, Human
ugccuauucgcucuuccuccagccucuggcaa

SEQ ID NO: 517544 - RNA, 32 nt, Human
ugccuauucuauuuucugcaguuuacaauaca

SEQ ID NO: 517545 - RNA, 20 nt, Human
ugccuauuuaaagucuccua

SEQ ID NO: 517546 - RNA, 22 nt, Human
ugccuauuucauucugauucua

SEQ ID NO: 517547 - RNA, 32 nt, Human
ugccucaaaaacugggaccaaccaaagugugu

SEQ ID NO: 517548 - RNA, 19 nt, Human
ugccucaaagagcugugau

SEQ ID NO: 517549 - RNA, 32 nt, Human
ugccucaaauggaacaccagcacuggaaccau

SEQ ID NO: 517550 - RNA, 32 nt, Human
ugccucaacugcugccccaggcaccagcccca

SEQ ID NO: 517551 - RNA, 18 nt, Human
ugccucaacuucuuccag

SEQ ID NO: 517552 - RNA, 19 nt, Human
ugccucaacuuuccuagga

SEQ ID NO: 517553 - RNA, 32 nt, Human
ugccucaagggagcgaggcgggagggugugug

SEQ ID NO: 517554 - RNA, 32 nt, Human
ugccucaaguuccucaucuaaguggcccuggc

SEQ ID NO: 517555 - RNA, 32 nt, Human
ugccucacaagugccuuucagagagccccaau

SEQ ID NO: 517556 - RNA, 32 nt, Human
ugccucacaccaugccuggcccuuagaagugc

SEQ ID NO: 517557 - RNA, 21 nt, Human
ugccucacaccuguaauccca

SEQ ID NO: 517558 - RNA, 32 nt, Human
ugccucacaccuguaaucccagcacuuugggg

SEQ ID NO: 517559 - RNA, 32 nt, Human
ugccucacaccuguaauuccagcacuuuggga

SEQ ID NO: 517560 - RNA, 32 nt, Human
ugccucacacuggccucuauaggcccaggugc

SEQ ID NO: 517561 - RNA, 32 nt, Human
ugccucacacuggccucucuacauccagcuca

SEQ ID NO: 517562 - RNA, 32 nt, Human
ugccucacacuggccucucuacauccagcuua

SEQ ID NO: 517563 - RNA, 32 nt, Human
ugccucacacuggccucucuaggcccagcucc

SEQ ID NO: 517564 - RNA, 32 nt, Human
ugccucacacuggccucucuaggccgaggucc

SEQ ID NO: 517565 - RNA, 32 nt, Human
ugccucacacuggccucuugaggcucagcuca

SEQ ID NO: 517566 - RNA, 32 nt, Human
ugccucacacuggccuguugaggcccagcuca

SEQ ID NO: 517567 - RNA, 32 nt, Human
ugccucacacuggccuguugaggcccagcuua

SEQ ID NO: 517568 - RNA, 32 nt, Human
ugccucacagaagagguggggaccgcagucag

SEQ ID NO: 517569 - RNA, 32 nt, Human
ugccucacagcauccuccgaaaacugagcauu

SEQ ID NO: 517570 - RNA, 32 nt, Human
ugccucacaggguuccugcugccuggugucuu

SEQ ID NO: 517571 - RNA, 32 nt, Human
ugccucaccagcucucugcucacuuuucucuc

SEQ ID NO: 517572 - RNA, 32 nt, Human
ugccucaccauggccuccucugaccagguucc

SEQ ID NO: 517573 - RNA, 32 nt, Human
ugccucacccugagcugggcaccaagguuaga

SEQ ID NO: 517574 - RNA, 32 nt, Human
ugccucaccuguaauccaaguacuuugggagg

SEQ ID NO: 517575 - RNA, 21 nt, Human
ugccucacgccuguaauccca

SEQ ID NO: 517576 - RNA, 32 nt, Human
ugccucacgccuguaaucccagcacuuuggga

SEQ ID NO: 517577 - RNA, 32 nt, Human
ugccucacgccugucaucccagcacuuuggga

SEQ ID NO: 517578 - RNA, 32 nt, Human
ugccucacuacaaccccugccuccuggguuuu

SEQ ID NO: 517579 - RNA, 32 nt, Human
ugccucacucagcuccugcugcucuuagggaa

SEQ ID NO: 517580 - RNA, 32 nt, Human
ugccucacucucucagcuuucuucccacaguu

SEQ ID NO: 517581 - RNA, 32 nt, Human
ugccucacugcaacgccugccucucaggcuca

SEQ ID NO: 517582 - RNA, 32 nt, Human
ugccucacugcuguucugggccauccccauag

SEQ ID NO: 517583 - RNA, 32 nt, Human
ugccucacuuccuuggaacuccugccuccaca

SEQ ID NO: 517584 - RNA, 31 nt, Human
ugccucagaagcuagaaucgaaggcuuaccc

SEQ ID NO: 517585 - RNA, 32 nt, Human
ugccucagaaggcagaggaagccuugaggugg

SEQ ID NO: 517586 - RNA, 32 nt, Human
ugccucagacaagaacucugggaauccuaaca

SEQ ID NO: 517587 - RNA, 32 nt, Human
ugccucagaccacagcagagcucacagaaccu

SEQ ID NO: 517588 - RNA, 32 nt, Human
ugccucagacuacuuugccaacccacuuccac

SEQ ID NO: 517589 - RNA, 32 nt, Human
ugccucagacuccugaguaucugggaccacag

SEQ ID NO: 517590 - RNA, 32 nt, Human
ugccucagagccgguccucagagaccacgaag

SEQ ID NO: 517591 - RNA, 32 nt, Human
ugccucagaugcaaaaggaaaccaucgccauc

SEQ ID NO: 517592 - RNA, 32 nt, Human
ugccucagccagaugggaauacugucuugugu

SEQ ID NO: 517593 - RNA, 32 nt, Human
ugccucagcccagccaggcugugccuuugacu

SEQ ID NO: 517594 - RNA, 32 nt, Human
ugccucagccccacuagcuggcaccaacuuaa

SEQ ID NO: 517595 - RNA, 32 nt, Human
ugccucagcccccagagguugggguggggugg

SEQ ID NO: 517596 - RNA, 18 nt, Human
ugccucagccccgugccc

SEQ ID NO: 517597 - RNA, 32 nt, Human
ugccucagccccucaaguagcugggacuacaa

SEQ ID NO: 517598 - RNA, 32 nt, Human
ugccucagccuccagaguagcuggaacuacag

SEQ ID NO: 517599 - RNA, 32 nt, Human
ugccucagccuccagaguaucugggacuacag

SEQ ID NO: 517600 - RNA, 32 nt, Human
ugccucagccuccagaguaucugggauuacau

SEQ ID NO: 517601 - RNA, 22 nt, Human
ugccucagccucccaaaaugcu

SEQ ID NO: 517602 - RNA, 32 nt, Human
ugccucagccucccaaagugcuuggauuacag

SEQ ID NO: 517603 - RNA, 32 nt, Human
ugccucagccucccaaaguucugggauuacag

SEQ ID NO: 517604 - RNA, 32 nt, Human
ugccucagccucccaaguagcuuggacuacag

SEQ ID NO: 517605 - RNA, 32 nt, Human
ugccucagccucccaaguagcuuggauuacag

SEQ ID NO: 517606 - RNA, 32 nt, Human
ugccucagccucccaaguaggugggacuacag

SEQ ID NO: 517607 - RNA, 32 nt, Human
ugccucagccucccaaguaggugggauuacag

SEQ ID NO: 517608 - RNA, 32 nt, Human
ugccucagccucccgaguagcugagaccacag

SEQ ID NO: 517609 - RNA, 32 nt, Human
ugccucagccucccgaguagcugagacuacag

SEQ ID NO: 517610 - RNA, 32 nt, Human
ugccucagccucccgaguagcugagacuucag

SEQ ID NO: 517611 - RNA, 32 nt, Human
ugccucagccucccgaguagcugagauuacag

SEQ ID NO: 517612 - RNA, 32 nt, Human
ugccucagccucccgaguagcugagauuauag

SEQ ID NO: 517613 - RNA, 32 nt, Human
ugccucagccucccgaguagcuggaacuacag

SEQ ID NO: 517614 - RNA, 32 nt, Human
ugccucagccucccgaguagcuggaauuacag

SEQ ID NO: 517615 - RNA, 32 nt, Human
ugccucagccucccgaguagcuggaauuauag

SEQ ID NO: 517616 - RNA, 32 nt, Human
ugccucagccucccgaguagcuuggacuacag

SEQ ID NO: 517617 - RNA, 32 nt, Human
ugccucagccucccgaguaggugggaccacag

SEQ ID NO: 517618 - RNA, 32 nt, Human
ugccucagccucccgaguaggugggacuacag

SEQ ID NO: 517619 - RNA, 32 nt, Human
ugccucagccucccgaguaggugggauuauag

SEQ ID NO: 517620 - RNA, 32 nt, Human
ugccucagccucccgaguggcugggauuagcg

SEQ ID NO: 517621 - RNA, 19 nt, Human
ugccucagccucccuagca

SEQ ID NO: 517622 - RNA, 19 nt, Human
ugccucagccucccuagua

SEQ ID NO: 517623 - RNA, 32 nt, Human
ugccucagccuccgagguagcugggaccauag

SEQ ID NO: 517624 - RNA, 32 nt, Human
ugccucagccuccuaaguaucugggauuacag

SEQ ID NO: 517625 - RNA, 32 nt, Human
ugccucagccuccucuuccugaguagcugcaa

SEQ ID NO: 517626 - RNA, 32 nt, Human
ugccucagccuccugaauagccgggauuacag

SEQ ID NO: 517627 - RNA, 32 nt, Human
ugccucagccuccugagaagcuaggacuacag

SEQ ID NO: 517628 - RNA, 32 nt, Human
ugccucagccuccugagaagcugagauuacag

SEQ ID NO: 517629 - RNA, 32 nt, Human
ugccucagccuccugagcagcugggauuacag

SEQ ID NO: 517630 - RNA, 32 nt, Human
ugccucagccuccugaguaacuggaauugcag

SEQ ID NO: 517631 - RNA, 32 nt, Human
ugccucagccuccugaguagcuaggacuacag

SEQ ID NO: 517632 - RNA, 32 nt, Human
ugccucagccuccugaguagcuaggacuauag

SEQ ID NO: 517633 - RNA, 32 nt, Human
ugccucagccuccugaguagcuaggauuacag

SEQ ID NO: 517634 - RNA, 32 nt, Human
ugccucagccuccugaguagcugagauuacag

SEQ ID NO: 517635 - RNA, 32 nt, Human
ugccucagccuccugaguagcugagauuauag

SEQ ID NO: 517636 - RNA, 32 nt, Human
ugccucagccuccugaguagcuggaauuacag

SEQ ID NO: 517637 - RNA, 32 nt, Human
ugccucagccuccugaguagcugggaauacag

SEQ ID NO: 517638 - RNA, 32 nt, Human
ugccucagccuccugaguagcugggacuagag

SEQ ID NO: 517639 - RNA, 32 nt, Human
ugccucagccuccugaguagcugggaguacag

SEQ ID NO: 517640 - RNA, 32 nt, Human
ugccucagccuccugaguagcugggauaacag

SEQ ID NO: 517641 - RNA, 32 nt, Human
ugccucagccuccugaguagcugggaugacag

SEQ ID NO: 517642 - RNA, 32 nt, Human
ugccucagccuccugaguagcugggauuacaa

SEQ ID NO: 517643 - RNA, 32 nt, Human
ugccucagccuccugaguagcugggauuacag

SEQ ID NO: 517644 - RNA, 32 nt, Human
ugccucagccuccugaguagcugggauuacgg

SEQ ID NO: 517645 - RNA, 32 nt, Human
ugccucagccuccugaguagcugggauuauag

SEQ ID NO: 517646 - RNA, 32 nt, Human
ugccucagccuccugaguagcugggauuaugg

SEQ ID NO: 517647 - RNA, 32 nt, Human
ugccucagccuccugaguagcugggauugcag

SEQ ID NO: 517648 - RNA, 32 nt, Human
ugccucagccuccugaguaucuaggaucacag

SEQ ID NO: 517649 - RNA, 32 nt, Human
ugccucagccuccugaguaucugggauuacag

SEQ ID NO: 517650 - RNA, 32 nt, Human
ugccucagccuccugagucgcugggauuacug

SEQ ID NO: 517651 - RNA, 32 nt, Human
ugccucagccuccuggguagcugggauuacaa

SEQ ID NO: 517652 - RNA, 32 nt, Human
ugccucagccuccuggguagcugggauuacag

SEQ ID NO: 517653 - RNA, 32 nt, Human
ugccucagccucucaaguaacugggauuacag

SEQ ID NO: 517654 - RNA, 32 nt, Human
ugccucagccucucaaguagcugggacuacag

SEQ ID NO: 517655 - RNA, 32 nt, Human
ugccucagccucucaaguagcugggauuacag

SEQ ID NO: 517656 - RNA, 32 nt, Human
ugccucagccucugccucccagccucuuucug

SEQ ID NO: 517657 - RNA, 19 nt, Human
ugccucagccugccuagua

SEQ ID NO: 517658 - RNA, 32 nt, Human
ugccucagccugucaaguagcugggauuacag

SEQ ID NO: 517659 - RNA, 32 nt, Human
ugccucagcuacucaagaggcugaggcaggag

SEQ ID NO: 517660 - RNA, 32 nt, Human
ugccucagcuacucaggagaauugcuugaacc

SEQ ID NO: 517661 - RNA, 32 nt, Human
ugccucagcuacucaggaggcugagguaguag

SEQ ID NO: 517662 - RNA, 32 nt, Human
ugccucagcuacucgggaggcugaggcaagag

SEQ ID NO: 517663 - RNA, 32 nt, Human
ugccucagcugguuccugcucccaggccuagc

SEQ ID NO: 517664 - RNA, 32 nt, Human
ugccucagcuuccugaguaggugggauuacaa

SEQ ID NO: 517665 - RNA, 32 nt, Human
ugccucaggaggagaacccuccccaguguacu

SEQ ID NO: 517666 - RNA, 32 nt, Human
ugccucagggcagacuuuccaggccuagcguu

SEQ ID NO: 517667 - RNA, 32 nt, Human
ugccucaggucaggccagggcagugcugcugc

SEQ ID NO: 517668 - RNA, 32 nt, Human
ugccucaguccuguccccuugggcacugagga

SEQ ID NO: 517669 - RNA, 32 nt, Human
ugccucagucuccugagcagcugggauuacag

SEQ ID NO: 517670 - RNA, 32 nt, Human
ugccucagucuccugaguagcugagacuacag

SEQ ID NO: 517671 - RNA, 32 nt, Human
ugccucagucuccugaguagcuggaacuacaa

SEQ ID NO: 517672 - RNA, 32 nt, Human
ugccucagucuccugaguagcuggaacuacag

SEQ ID NO: 517673 - RNA, 32 nt, Human
ugccucagucuccugaguagcugggauuacag

SEQ ID NO: 517674 - RNA, 32 nt, Human
ugccucagucuccugaguagcugggauuacgg

SEQ ID NO: 517675 - RNA, 32 nt, Human
ugccucagucuccugaguaucuaggacuacag

SEQ ID NO: 517676 - RNA, 32 nt, Human
ugccucagugccaggcuggcuccuggggaugg

SEQ ID NO: 517677 - RNA, 32 nt, Human
ugccucaguuuagucaucuggaaaggaagggg

SEQ ID NO: 517678 - RNA, 32 nt, Human
ugccucauaggacucauguucucuccaaccag

SEQ ID NO: 517679 - RNA, 32 nt, Human
ugccucauccuccuccucauucagaccaaucu

SEQ ID NO: 517680 - RNA, 21 nt, Human
ugccucaugccuauaauccca

SEQ ID NO: 517681 - RNA, 32 nt, Human
ugccucaugccuauaaucccagcacuuuggga

SEQ ID NO: 517682 - RNA, 32 nt, Human
ugccucaugccugcaauccuagcacuuuggga

SEQ ID NO: 517683 - RNA, 21 nt, Human
ugccucaugccuguaauccca

SEQ ID NO: 517684 - RNA, 32 nt, Human
ugccucaugccuguaaucccagcacuuucgga

SEQ ID NO: 517685 - RNA, 32 nt, Human
ugccucaugccuguaaucccagcacuuuggga

SEQ ID NO: 517686 - RNA, 32 nt, Human
ugccucaugccuguaauccuagcaccuuggga

SEQ ID NO: 517687 - RNA, 32 nt, Human
ugccucaugccuguaauuccagcacuuuggga

SEQ ID NO: 517688 - RNA, 32 nt, Human
ugccucaugccuguagucccagcacuuugggg

SEQ ID NO: 517689 - RNA, 32 nt, Human
ugccucauguaggauccggcaggcuggugggu

SEQ ID NO: 517690 - RNA, 32 nt, Human
ugccucauugccaccuccaccugcaggaaggc

SEQ ID NO: 517691 - RNA, 32 nt, Human
ugccuccaaagaaagaaaaaguaaaacugaaa

SEQ ID NO: 517692 - RNA, 23 nt, Human
ugccuccaaagugcugggauuac

SEQ ID NO: 517693 - RNA, 32 nt, Human
ugccuccaacagcaucuaucaauccuguuagc

SEQ ID NO: 517694 - RNA, 17 nt, Human
ugccuccaaccugcuuc

SEQ ID NO: 517695 - RNA, 32 nt, Human
ugccuccaacgucaccaccauccacaccccgg

SEQ ID NO: 517696 - RNA, 32 nt, Human
ugccuccaagaccuggugucucccacugugag

SEQ ID NO: 517697 - RNA, 32 nt, Human
ugccuccacaaacugccacugcuuaacgguca

SEQ ID NO: 517698 - RNA, 32 nt, Human
ugccuccacacuggccuucccugcugcgugga

SEQ ID NO: 517699 - RNA, 32 nt, Human
ugccuccacccugcucuccaucucccgcucua

SEQ ID NO: 517700 - RNA, 32 nt, Human
ugccuccaccucacuguccccagccugccugc

SEQ ID NO: 517701 - RNA, 32 nt, Human
ugccuccacuccaaggcugccugccugcugua

SEQ ID NO: 517702 - RNA, 32 nt, Human
ugccuccacuccugccuccaccauguccauca

SEQ ID NO: 517703 - RNA, 20 nt, Human
ugccuccacucucauucaga

SEQ ID NO: 517704 - RNA, 32 nt, Human
ugccuccagaccacaggacugcagccuggggc

SEQ ID NO: 517705 - RNA, 32 nt, Human
ugccuccagauuucaagaggagaaauuuaguu

SEQ ID NO: 517706 - RNA, 32 nt, Human
ugccuccagcacugcccauccuugccccuuuc

SEQ ID NO: 517707 - RNA, 32 nt, Human
ugccuccagcaucaccuggccgagacgggccu

SEQ ID NO: 517708 - RNA, 32 nt, Human
ugccuccagccaaaugccuagcacagagcuca

SEQ ID NO: 517709 - RNA, 32 nt, Human
ugccuccagccacacccccugccuuccccagc

SEQ ID NO: 517710 - RNA, 32 nt, Human
ugccuccagccaccaucaccacugaccaaggc

SEQ ID NO: 517711 - RNA, 20 nt, Human
ugccuccagccuuugcugcu

SEQ ID NO: 517712 - RNA, 32 nt, Human
ugccuccagcucugccccaggcuccuccuaga

SEQ ID NO: 517713 - RNA, 32 nt, Human
ugccuccaggagauggaggcacgugauaagac

SEQ ID NO: 517714 - RNA, 32 nt, Human
ugccuccagggaggggaggggaugggaagcac

SEQ ID NO: 517715 - RNA, 19 nt, Human
ugccuccaggguccagaug

SEQ ID NO: 517716 - RNA, 32 nt, Human
ugccuccagucugggaaagucaccaacccgca

SEQ ID NO: 517717 - RNA, 32 nt, Human
ugccuccaguucagguacuuggcauugcuaag

SEQ ID NO: 517718 - RNA, 32 nt, Human
ugccuccauaaccugaacugugccgacuccac

SEQ ID NO: 517719 - RNA, 32 nt, Human
ugccuccauaccaauccucuuucucacagaga

SEQ ID NO: 517720 - RNA, 32 nt, Human
ugccuccaugccacuccagacugcaccggcau

SEQ ID NO: 517721 - RNA, 32 nt, Human
ugccuccauuuugccuuguuuguuaguuugcc

SEQ ID NO: 517722 - RNA, 32 nt, Human
ugccucccaaaacacugcucucaccagaacug

SEQ ID NO: 517723 - RNA, 32 nt, Human
ugccucccaaaaugcugggauuacaggcguga

SEQ ID NO: 517724 - RNA, 32 nt, Human
ugccucccaaagugcuaggauuacaggcguga

SEQ ID NO: 517725 - RNA, 32 nt, Human
ugccucccaaagugcugccauuacaggcguga

SEQ ID NO: 517726 - RNA, 32 nt, Human
ugccucccaaagugcugggaucacaggcauga

SEQ ID NO: 517727 - RNA, 24 nt, Human
ugccucccaaagugcugggauuac

SEQ ID NO: 517728 - RNA, 32 nt, Human
ugccucccaaagugcugggauuacaagcauga

SEQ ID NO: 517729 - RNA, 32 nt, Human
ugccucccaaagugcugggauuacaggcauga

SEQ ID NO: 517730 - RNA, 32 nt, Human
ugccucccaaagugcugggauuacaggcguaa

SEQ ID NO: 517731 - RNA, 32 nt, Human
ugccucccaaagugcugggauuacaggcguga

SEQ ID NO: 517732 - RNA, 32 nt, Human
ugccucccaaagugcugggauuacagguguga

SEQ ID NO: 517733 - RNA, 32 nt, Human
ugccucccaaagugcugggauugcaggcaugg

SEQ ID NO: 517734 - RNA, 32 nt, Human
ugccucccaaagugcugugauuacaggccuca

SEQ ID NO: 517735 - RNA, 24 nt, Human
ugccucccaaaguguugggauuac

SEQ ID NO: 517736 - RNA, 32 nt, Human
ugccucccaagcaauccucccaccucagccuc

SEQ ID NO: 517737 - RNA, 32 nt, Human
ugccucccaaguagcugggaccacaggugggc

SEQ ID NO: 517738 - RNA, 32 nt, Human
ugccucccaaguagcugggacuacagaacaga

SEQ ID NO: 517739 - RNA, 32 nt, Human
ugccucccaaguagcugggacuacaggcaugc

SEQ ID NO: 517740 - RNA, 32 nt, Human
ugccucccaaguagcugggauuaaggcgccug

SEQ ID NO: 517741 - RNA, 32 nt, Human
ugccucccaaguagcugggauuacaggcaccc

SEQ ID NO: 517742 - RNA, 32 nt, Human
ugccucccacaggauuccagcugcagggagcc

SEQ ID NO: 517743 - RNA, 32 nt, Human
ugccucccacugcagccucugccugcucugcc

SEQ ID NO: 517744 - RNA, 32 nt, Human
ugccucccacuuggcugucccugcugcugggc

SEQ ID NO: 517745 - RNA, 32 nt, Human
ugccucccagaacaaagugggaaagggaagcu

SEQ ID NO: 517746 - RNA, 32 nt, Human
ugccucccagaaccccagcccagaacucuuca

SEQ ID NO: 517747 - RNA, 32 nt, Human
ugccucccagagugcugggauuacaggcguga

SEQ ID NO: 517748 - RNA, 32 nt, Human
ugccucccaggaacccccuccgucucagacac

SEQ ID NO: 517749 - RNA, 32 nt, Human
ugccucccaggcucaagcacuuuuccugucuc

SEQ ID NO: 517750 - RNA, 32 nt, Human
ugccucccauccuggcagcccagccugagacc

SEQ ID NO: 517751 - RNA, 32 nt, Human
ugccucccauucugaccacccuucucauucca

SEQ ID NO: 517752 - RNA, 32 nt, Human
ugccucccauuuccuuccccuuucucugucau

SEQ ID NO: 517753 - RNA, 32 nt, Human
ugccuccccacugccccuaaagccacagcaga

SEQ ID NO: 517754 - RNA, 32 nt, Human
ugccuccccaggcuggccccagaggagcgagc

SEQ ID NO: 517755 - RNA, 32 nt, Human
ugccucccccaccuccacaugccugcagucga

SEQ ID NO: 517756 - RNA, 32 nt, Human
ugccucccccuccagccuucuccacugaugcc

SEQ ID NO: 517757 - RNA, 32 nt, Human
ugccucccccucccccauucucuccauuuucu

SEQ ID NO: 517758 - RNA, 32 nt, Human
ugccucccccuguauucccccucccagggcag

SEQ ID NO: 517759 - RNA, 32 nt, Human
ugccuccccuccaccccugccucuccuccacc

SEQ ID NO: 517760 - RNA, 32 nt, Human
ugccuccccuccuacccucuggccucaagagc

SEQ ID NO: 517761 - RNA, 32 nt, Human
ugccuccccugcccuuucucagcugccucccc

SEQ ID NO: 517762 - RNA, 32 nt, Human
ugccuccccugccucaccagcccuggcaacug

SEQ ID NO: 517763 - RNA, 32 nt, Human
ugccuccccugccuccccugccugccuccugc

SEQ ID NO: 517764 - RNA, 32 nt, Human
ugccuccccugccugccuccugccuccccugc

SEQ ID NO: 517765 - RNA, 32 nt, Human
ugccucccgaagugcuuggauuacagguguga

SEQ ID NO: 517766 - RNA, 32 nt, Human
ugccucccgaguagcugggauuacaggcacac

SEQ ID NO: 517767 - RNA, 32 nt, Human
ugccucccgaguagcugggauuacaggcaucu

SEQ ID NO: 517768 - RNA, 20 nt, Human
ugccucccgcaguccaggug

SEQ ID NO: 517769 - RNA, 32 nt, Human
ugccucccgcuggcccaggucuccucuccagu

SEQ ID NO: 517770 - RNA, 32 nt, Human
ugccucccgggagacugggauuucuggccucc

SEQ ID NO: 517771 - RNA, 32 nt, Human
ugccucccguugcucugugaccugaggguauu

SEQ ID NO: 517772 - RNA, 32 nt, Human
ugccucccuaaccuuuucuagggcucaguuug

SEQ ID NO: 517773 - RNA, 32 nt, Human
ugccucccuaaguguugggauuacaggcauga

SEQ ID NO: 517774 - RNA, 32 nt, Human
ugccucccucagauagaaaacagcccccacuc

SEQ ID NO: 517775 - RNA, 32 nt, Human
ugccucccuccagacucgggagggucgagggg

SEQ ID NO: 517776 - RNA, 32 nt, Human
ugccucccucccucccccuggcaccggcucca

SEQ ID NO: 517777 - RNA, 32 nt, Human
ugccucccuccugucuggcuccuggggcccau

SEQ ID NO: 517778 - RNA, 32 nt, Human
ugccucccucucacaggccugccuguguuacu

SEQ ID NO: 517779 - RNA, 32 nt, Human
ugccucccugcagggcccucggugcagccugg

SEQ ID NO: 517780 - RNA, 32 nt, Human
ugccucccuggggcugaggggcugcaaggaga

SEQ ID NO: 517781 - RNA, 32 nt, Human
ugccucccuuucucccuucuccacuucacugg

SEQ ID NO: 517782 - RNA, 32 nt, Human
ugccuccgagauguggcaccauagugcggugc

SEQ ID NO: 517783 - RNA, 32 nt, Human
ugccuccgagcucuggcuucaaggggagcucu

SEQ ID NO: 517784 - RNA, 21 nt, Human
ugccuccgccgccgccgccgc

SEQ ID NO: 517785 - RNA, 32 nt, Human
ugccuccggccuugaaaucuccaccucugcuc

SEQ ID NO: 517786 - RNA, 32 nt, Human
ugccuccgggaggguuaagaucaaagaugaag

SEQ ID NO: 517787 - RNA, 32 nt, Human
ugccuccguccagaaaugccucucacaccagg

SEQ ID NO: 517788 - RNA, 32 nt, Human
ugccuccuaaagugcugggauucugggccuua

SEQ ID NO: 517789 - RNA, 32 nt, Human
ugccuccuaagccaggagcuggguuaugcacc

SEQ ID NO: 517790 - RNA, 32 nt, Human
ugccuccuagagugcagggauuacaggcguga

SEQ ID NO: 517791 - RNA, 32 nt, Human
ugccuccuagcccaggauuugucuccuuuaga

SEQ ID NO: 517792 - RNA, 31 nt, Human
ugccuccucacuuagaauaccaacagucaaa

SEQ ID NO: 517793 - RNA, 32 nt, Human
ugccuccucagcacucccuccugggaggccuu

SEQ ID NO: 517794 - RNA, 32 nt, Human
ugccuccuccagucucuccaucccugagcucu

SEQ ID NO: 517795 - RNA, 19 nt, Human
ugccuccuccauucuuccu

SEQ ID NO: 517796 - RNA, 17 nt, Human
ugccuccucccauccag

SEQ ID NO: 517797 - RNA, 32 nt, Human
ugccuccuccccagguggaggugccaggaagc

SEQ ID NO: 517798 - RNA, 23 nt, Human
ugccuccucccuggcugcagccu

SEQ ID NO: 517799 - RNA, 18 nt, Human
ugccuccuccuguccaga

SEQ ID NO: 517800 - RNA, 32 nt, Human
ugccuccucuagcccaggaaugcagcuggggg

SEQ ID NO: 517801 - RNA, 17 nt, Human
ugccuccucuccacgga

SEQ ID NO: 517802 - RNA, 18 nt, Human
ugccuccucuccauucag

SEQ ID NO: 517803 - RNA, 32 nt, Human
ugccuccucugccaguuccuuuauugaaagag

SEQ ID NO: 517804 - RNA, 32 nt, Human
ugccuccucugcccauggguccugggcaccca

SEQ ID NO: 517805 - RNA, 32 nt, Human
ugccuccucuggcugcugccuccgcagcuccc

SEQ ID NO: 517806 - RNA, 32 nt, Human
ugccuccucuugcugcuaugucuccuugugau

SEQ ID NO: 517807 - RNA, 32 nt, Human
ugccuccugaagcccaacgauggaccauucuc

SEQ ID NO: 517808 - RNA, 32 nt, Human
ugccuccugacccucagacgccuccgccccac

SEQ ID NO: 517809 - RNA, 32 nt, Human
ugccuccugagagccuccugggugucaaguac

SEQ ID NO: 517810 - RNA, 32 nt, Human
ugccuccugaguagcuggaauuacaggcaugu

SEQ ID NO: 517811 - RNA, 32 nt, Human
ugccuccugaguagcugggacuacaggcgcac

SEQ ID NO: 517812 - RNA, 32 nt, Human
ugccuccugaguagcugggauuacaggcgugu

SEQ ID NO: 517813 - RNA, 32 nt, Human
ugccuccugaguagcugggauuacaggugcau

SEQ ID NO: 517814 - RNA, 32 nt, Human
ugccuccugaguagcugggauuacuggcacac

SEQ ID NO: 517815 - RNA, 32 nt, Human
ugccuccugccaccccuuccuccccauacucc

SEQ ID NO: 517816 - RNA, 32 nt, Human
ugccuccugccugccccucucccgccagacug

SEQ ID NO: 517817 - RNA, 32 nt, Human
ugccuccugcuuccuuucucucuccugccucu

SEQ ID NO: 517818 - RNA, 32 nt, Human
ugccuccugcuuugggaagacugaggcauccg

SEQ ID NO: 517819 - RNA, 32 nt, Human
ugccuccugggugagaagggucagauuuuccu

SEQ ID NO: 517820 - RNA, 19 nt, Human
ugccuccuggguucagaug

SEQ ID NO: 517821 - RNA, 32 nt, Human
ugccuccuggguuuuaucccagauagcucugg

SEQ ID NO: 517822 - RNA, 20 nt, Human
ugccuccuguguuccaggug

SEQ ID NO: 517823 - RNA, 32 nt, Human
ugccuccuucacauuuccuccccagcuuuugc

SEQ ID NO: 517824 - RNA, 22 nt, Human
ugccuccuuccuccgcgcaccc

SEQ ID NO: 517825 - RNA, 21 nt, Human
ugccuccuuccuccuccuucc

SEQ ID NO: 517826 - RNA, 32 nt, Human
ugccuccuuccucuccccuggggcugggaggc

SEQ ID NO: 517827 - RNA, 32 nt, Human
ugccuccuuccucuucccagcuuugcagcagg

SEQ ID NO: 517828 - RNA, 23 nt, Human
ugccuccuuccucuuuuccuucc

SEQ ID NO: 517829 - RNA, 32 nt, Human
ugccuccuuccucuuuuccuucccaaagcaag

SEQ ID NO: 517830 - RNA, 26 nt, Human
ugccuccuuccugcugauugcuucca

SEQ ID NO: 517831 - RNA, 32 nt, Human
ugccuccuugccucccugccucccucccuccc

SEQ ID NO: 517832 - RNA, 32 nt, Human
ugccuccuuuccagcaaguaguuuacucucag

SEQ ID NO: 517833 - RNA, 32 nt, Human
ugccuccuuucucacuuuagaacauauauugg

SEQ ID NO: 517834 - RNA, 19 nt, Human
ugccuccuuuuauccagau

SEQ ID NO: 517835 - RNA, 32 nt, Human
ugccucgaccucucaaguagcugggauuacaa

SEQ ID NO: 517836 - RNA, 32 nt, Human
ugccucgauucccugcccuugugaccucccag

SEQ ID NO: 517837 - RNA, 32 nt, Human
ugccucgcaagaaccugccugagcggcugcuc

SEQ ID NO: 517838 - RNA, 32 nt, Human
ugccucgcagaggcagcccgcucacuucccgc

SEQ ID NO: 517839 - RNA, 32 nt, Human
ugccucggagcugagguggggugagacagagu

SEQ ID NO: 517840 - RNA, 22 nt, Human
ugccucggccucccaaaaugcu

SEQ ID NO: 517841 - RNA, 23 nt, Human
ugccucggccucccaaagugcuu

SEQ ID NO: 517842 - RNA, 32 nt, Human
ugccucggccuccugaguagcugggauuacag

SEQ ID NO: 517843 - RNA, 32 nt, Human
ugccucggccuccugaguagcugggauuucag

SEQ ID NO: 517844 - RNA, 32 nt, Human
ugccucggcugcaggcgcagcgcgcagaccug

SEQ ID NO: 517845 - RNA, 32 nt, Human
ugccucgggacagauggauguccaguuuacug

SEQ ID NO: 517846 - RNA, 32 nt, Human
ugccucgggacggcucugccccagggagcgug

SEQ ID NO: 517847 - RNA, 32 nt, Human
ugccucguacccuuuccuuguuuuucuccaga

SEQ ID NO: 517848 - RNA, 23 nt, Human
ugccucgucgagccccucuaggg

SEQ ID NO: 517849 - RNA, 32 nt, Human
ugccucgugaacacaucugcuggugggaaggc

SEQ ID NO: 517850 - RNA, 32 nt, Human
ugccucgugagccucccagagcccaggccucc

SEQ ID NO: 517851 - RNA, 32 nt, Human
ugccucgugccugugaucccagcacuuuggga

SEQ ID NO: 517852 - RNA, 32 nt, Human
ugccucguugggggacagagagagggacucca

SEQ ID NO: 517853 - RNA, 32 nt, Human
ugccucuaacacagcuuugccuucuaaagcgg

SEQ ID NO: 517854 - RNA, 25 nt, Human
ugccucuaauagcccugccugguac

SEQ ID NO: 517855 - RNA, 32 nt, Human
ugccucuacaaaacaugcaaaaauuagcuggg

SEQ ID NO: 517856 - RNA, 32 nt, Human
ugccucuaccaccaccucucacuucucaaggc

SEQ ID NO: 517857 - RNA, 21 nt, Human
ugccucuaccagcuucccaug

SEQ ID NO: 517858 - RNA, 32 nt, Human
ugccucuaccugccugguccagcugggacccu

SEQ ID NO: 517859 - RNA, 22 nt, Human
ugccucuacuaaaaauacaaaa

SEQ ID NO: 517860 - RNA, 32 nt, Human
ugccucuaggccccacucucaggcuaggaugg

SEQ ID NO: 517861 - RNA, 32 nt, Human
ugccucuagugcacucccuccagccuacccac

SEQ ID NO: 517862 - RNA, 32 nt, Human
ugccucuaucagggcuggaguggugcagcccc

SEQ ID NO: 517863 - RNA, 23 nt, Human
ugccucuaugugcuguuuuuccu

SEQ ID NO: 517864 - RNA, 32 nt, Human
ugccucucacucauccuccaccacuuugccga

SEQ ID NO: 517865 - RNA, 32 nt, Human
ugccucucagucuuaggggacauggcagagau

SEQ ID NO: 517866 - RNA, 32 nt, Human
ugccucucauaucaccaguggccaucugaggu

SEQ ID NO: 517867 - RNA, 32 nt, Human
ugccucucccacccuuaccuccaucucacaca

SEQ ID NO: 517868 - RNA, 32 nt, Human
ugccucucccauaggaauggaauacauuuauu

SEQ ID NO: 517869 - RNA, 32 nt, Human
ugccucuccccuuccuccucugcucuugaucu

SEQ ID NO: 517870 - RNA, 24 nt, Human
ugccucuccgccggaggucuagcu

SEQ ID NO: 517871 - RNA, 32 nt, Human
ugccucuccuacagcauggagaggcugacccc

SEQ ID NO: 517872 - RNA, 19 nt, Human
ugccucuccucuccccaga

SEQ ID NO: 517873 - RNA, 32 nt, Human
ugccucuccugccucucgccgcugcuccuccc

SEQ ID NO: 517874 - RNA, 32 nt, Human
ugccucuccuucugaaccuugggagagggcug

SEQ ID NO: 517875 - RNA, 32 nt, Human
ugccucuccuuuuccuccuuuuuaccuucugg

SEQ ID NO: 517876 - RNA, 32 nt, Human
ugccucucgcaggccccagcuggcugucacug

SEQ ID NO: 517877 - RNA, 32 nt, Human
ugccucucgggcagcuggaauuacaggcaugc

SEQ ID NO: 517878 - RNA, 32 nt, Human
ugccucucuacggcucugcuucccagcgggca

SEQ ID NO: 517879 - RNA, 32 nt, Human
ugccucucuacuccagccugggcaauagggua

SEQ ID NO: 517880 - RNA, 32 nt, Human
ugccucucucacucuucauacuccuccauauu

SEQ ID NO: 517881 - RNA, 22 nt, Human
ugccucucugcguuuccaggug

SEQ ID NO: 517882 - RNA, 32 nt, Human
ugccucucuuccucuuggauccaggagcaauu

SEQ ID NO: 517883 - RNA, 32 nt, Human
ugccucucuugaggagaggaagugguucuauu

SEQ ID NO: 517884 - RNA, 32 nt, Human
ugccucucuuugucucugcauuuccuuuccug

SEQ ID NO: 517885 - RNA, 21 nt, Human
ugccucugaagcaccugcuca

SEQ ID NO: 517886 - RNA, 32 nt, Human
ugccucugaagcaccugcucacagaaggguga

SEQ ID NO: 517887 - RNA, 32 nt, Human
ugccucugaccagcaucgucuguaaagguuaa

SEQ ID NO: 517888 - RNA, 32 nt, Human
ugccucugaccccuccugugguggugacccau

SEQ ID NO: 517889 - RNA, 32 nt, Human
ugccucugaccugccguguccuuugcaggaag

SEQ ID NO: 517890 - RNA, 32 nt, Human
ugccucugagagcaucaggccuagaggccuga

SEQ ID NO: 517891 - RNA, 32 nt, Human
ugccucugagcagagagcagcagcagcaggua

SEQ ID NO: 517892 - RNA, 32 nt, Human
ugccucugaggcccuucugcaggcuggaugaa

SEQ ID NO: 517893 - RNA, 32 nt, Human
ugccucugagucugaaucucccaaagagagaa

SEQ ID NO: 517894 - RNA, 19 nt, Human
ugccucugaguuucagaug

SEQ ID NO: 517895 - RNA, 32 nt, Human
ugccucugcacuccaaccugggugauggagca

SEQ ID NO: 517896 - RNA, 32 nt, Human
ugccucugcacuccagccugcgugacaaagug

SEQ ID NO: 517897 - RNA, 32 nt, Human
ugccucugcaguuggacaagacuuggcccccg

SEQ ID NO: 517898 - RNA, 32 nt, Human
ugccucugcauuccagccuuggugacagagca

SEQ ID NO: 517899 - RNA, 32 nt, Human
ugccucugcccaccucuucucuucugcuucca

SEQ ID NO: 517900 - RNA, 31 nt, Human
ugccucugccucagugggccugugggagccu

SEQ ID NO: 517901 - RNA, 22 nt, Human
ugccucugcgaagaaccuugug

SEQ ID NO: 517902 - RNA, 32 nt, Human
ugccucugcucccaucucucucuuugccucau

SEQ ID NO: 517903 - RNA, 32 nt, Human
ugccucuggaaagaacaacuggcaggacuguu

SEQ ID NO: 517904 - RNA, 32 nt, Human
ugccucuggagaccccagccccagagggcuuu

SEQ ID NO: 517905 - RNA, 29 nt, Human
ugccucuggcugccugcguccucucggug

SEQ ID NO: 517906 - RNA, 32 nt, Human
ugccucuggcugucugcacuuuuguucaugcu

SEQ ID NO: 517907 - RNA, 32 nt, Human
ugccucugggagagaggaagaagaaaggggcc

SEQ ID NO: 517908 - RNA, 32 nt, Human
ugccucugggaggggugcugccuuguagaugg

SEQ ID NO: 517909 - RNA, 32 nt, Human
ugccucugggcaaugaaguaauguuucucuac

SEQ ID NO: 517910 - RNA, 32 nt, Human
ugccucugguauccuuccuuuugaaacgaagc

SEQ ID NO: 517911 - RNA, 32 nt, Human
ugccucuguaccauuuuuccuugagugugcuu

SEQ ID NO: 517912 - RNA, 32 nt, Human
ugccucuguagcuggccuucuuccugccacag

SEQ ID NO: 517913 - RNA, 22 nt, Human
ugccucuguaggcaaucuucug

SEQ ID NO: 517914 - RNA, 32 nt, Human
ugccucuguaguguggccuggugcugggguga

SEQ ID NO: 517915 - RNA, 32 nt, Human
ugccucuguccacacccaccucccugguguac

SEQ ID NO: 517916 - RNA, 20 nt, Human
ugccucugugccucucccca

SEQ ID NO: 517917 - RNA, 32 nt, Human
ugccucugugcgagugcaccgacagaaaacug

SEQ ID NO: 517918 - RNA, 32 nt, Human
ugccucuguggaagacgccugcugcuaagaga

SEQ ID NO: 517919 - RNA, 32 nt, Human
ugccucuguggggagucugccucccagacugg

SEQ ID NO: 517920 - RNA, 32 nt, Human
ugccucuguuggcugagcucuccugggcuacu

SEQ ID NO: 517921 - RNA, 17 nt, Human
ugccucuuacucuccag

SEQ ID NO: 517922 - RNA, 20 nt, Human
ugccucuucagcacaucuca

SEQ ID NO: 517923 - RNA, 32 nt, Human
ugccucuucauacccaugcaugcugcucaccc

SEQ ID NO: 517924 - RNA, 22 nt, Human
ugccucuuccaaaacagugcaa

SEQ ID NO: 517925 - RNA, 17 nt, Human
ugccucuucccagaaga

SEQ ID NO: 517926 - RNA, 18 nt, Human
ugccucuuccccacccag

SEQ ID NO: 517927 - RNA, 19 nt, Human
ugccucuucccuaacuaga

SEQ ID NO: 517928 - RNA, 26 nt, Human
ugccucuuccuccccaccccacugcc

SEQ ID NO: 517929 - RNA, 18 nt, Human
ugccucuuccugcaguug

SEQ ID NO: 517930 - RNA, 18 nt, Human
ugccucuuccugcuccag

SEQ ID NO: 517931 - RNA, 32 nt, Human
ugccucuuccuguuucuccugaggaugcuccu

SEQ ID NO: 517932 - RNA, 19 nt, Human
ugccucuucuaggcaguug

SEQ ID NO: 517933 - RNA, 19 nt, Human
ugccucuucuccaaucaga

SEQ ID NO: 517934 - RNA, 32 nt, Human
ugccucuucuccaaucagagcguggaggcgag

SEQ ID NO: 517935 - RNA, 19 nt, Human
ugccucuucucccgcgggu

SEQ ID NO: 517936 - RNA, 32 nt, Human
ugccucuucugcauuuggcuuuauuuugauuc

SEQ ID NO: 517937 - RNA, 20 nt, Human
ugccucuucuguggccagau

SEQ ID NO: 517938 - RNA, 19 nt, Human
ugccucuucuugcaaggug

SEQ ID NO: 517939 - RNA, 32 nt, Human
ugccucuugaagcuuuuucugccuccugauuc

SEQ ID NO: 517940 - RNA, 32 nt, Human
ugccucuugaaugcagggacaaaugccacacg

SEQ ID NO: 517941 - RNA, 32 nt, Human
ugccucuugcaagcugugugaccccgggcaca

SEQ ID NO: 517942 - RNA, 32 nt, Human
ugccucuugcaagcugugugacccugggcaca

SEQ ID NO: 517943 - RNA, 32 nt, Human
ugccucuugcguuccugaccucaugggaccag

SEQ ID NO: 517944 - RNA, 19 nt, Human
ugccucuuuaggccaguug

SEQ ID NO: 517945 - RNA, 25 nt, Human
ugccucuuucccccagccaccgccu

SEQ ID NO: 517946 - RNA, 32 nt, Human
ugccucuuucugcucuaucuccaccuccuuuu

SEQ ID NO: 517947 - RNA, 19 nt, Human
ugccucuuucuuccccaga

SEQ ID NO: 517948 - RNA, 32 nt, Human
ugccucuuugaaaaauacaaaaauuagcugga

SEQ ID NO: 517949 - RNA, 20 nt, Human
ugccucuuuguccccaggug

SEQ ID NO: 517950 - RNA, 32 nt, Human
ugccugaaaaauuggccauggaggcacaccaa

SEQ ID NO: 517951 - RNA, 32 nt, Human
ugccugaaaccucagauaguacugaacccuuu

SEQ ID NO: 517952 - RNA, 32 nt, Human
ugccugaaacuuccuccaccugcuugaggagc

SEQ ID NO: 517953 - RNA, 32 nt, Human
ugccugaaacuuccuccaccuucuugaggagc

SEQ ID NO: 517954 - RNA, 32 nt, Human
ugccugaacagccccuucucucccuccacccc

SEQ ID NO: 517955 - RNA, 32 nt, Human
ugccugaacagcccucucucucacuccccucu

SEQ ID NO: 517956 - RNA, 32 nt, Human
ugccugaacauacacacgcacacccaugcgca

SEQ ID NO: 517957 - RNA, 32 nt, Human
ugccugaacccccagccugggcuuagcccugu

SEQ ID NO: 517958 - RNA, 32 nt, Human
ugccugaacgcuaagaacaugacuucugucug

SEQ ID NO: 517959 - RNA, 32 nt, Human
ugccugaagcuccccucuuccucucuuccucc

SEQ ID NO: 517960 - RNA, 32 nt, Human
ugccugaagcuuggugcacccuccagugagac

SEQ ID NO: 517961 - RNA, 32 nt, Human
ugccugaaggauccugaacauauuuaguuacc

SEQ ID NO: 517962 - RNA, 32 nt, Human
ugccugaaguuuuaguauuuguuuucuaggug

SEQ ID NO: 517963 - RNA, 32 nt, Human
ugccugaauaguacaccccacccuccaucugu

SEQ ID NO: 517964 - RNA, 32 nt, Human
ugccugaaugaacaugcccacugugaaagauu

SEQ ID NO: 517965 - RNA, 27 nt, Human
ugccugaauguaaccugcuagcucucc

SEQ ID NO: 517966 - RNA, 32 nt, Human
ugccugacaagugccugacacgcagccuaguu

SEQ ID NO: 517967 - RNA, 32 nt, Human
ugccugacacccagggaugagcaguguccagu

SEQ ID NO: 517968 - RNA, 32 nt, Human
ugccugacagaauugcuuagaaaggagcagag

SEQ ID NO: 517969 - RNA, 32 nt, Human
ugccugacccaggucaggauuuucaagaaaga

SEQ ID NO: 517970 - RNA, 31 nt, Human
ugccugacccuacuggagcaauuugugaucu

SEQ ID NO: 517971 - RNA, 32 nt, Human
ugccugaccugacagguggcuucaggccucgg

SEQ ID NO: 517972 - RNA, 32 nt, Human
ugccugacggacccuguugccugcuccugggc

SEQ ID NO: 517973 - RNA, 32 nt, Human
ugccugacucauuccugaccucuugucauuuu

SEQ ID NO: 517974 - RNA, 32 nt, Human
ugccugacuccaccuagcuauuuggaauaacc

SEQ ID NO: 517975 - RNA, 32 nt, Human
ugccugacuccccuccccagacuggcuuggga

SEQ ID NO: 517976 - RNA, 32 nt, Human
ugccugacucuugguccuucuggcagggaccu

SEQ ID NO: 517977 - RNA, 32 nt, Human
ugccugacuuaucuugcaucccuuugaaugag

SEQ ID NO: 517978 - RNA, 32 nt, Human
ugccugacuucaucacgcucccugcacuuagg

SEQ ID NO: 517979 - RNA, 19 nt, Human
ugccugacuucucugaaua

SEQ ID NO: 517980 - RNA, 20 nt, Human
ugccugagaaacugagccua

SEQ ID NO: 517981 - RNA, 32 nt, Human
ugccugagaagaacccacagaguggaugcugu

SEQ ID NO: 517982 - RNA, 32 nt, Human
ugccugagaccaggagguugaggcugcaguga

SEQ ID NO: 517983 - RNA, 32 nt, Human
ugccugagagaaccuguuucuucaccuaaaaa

SEQ ID NO: 517984 - RNA, 32 nt, Human
ugccugagagcagaaugaauaauugagguuag

SEQ ID NO: 517985 - RNA, 32 nt, Human
ugccugagagccccauaacggaaagggcuaag

SEQ ID NO: 517986 - RNA, 32 nt, Human
ugccugagaggaaacaguggaggcagcggggc

SEQ ID NO: 517987 - RNA, 32 nt, Human
ugccugagagugaagacacagaggacagcgca

SEQ ID NO: 517988 - RNA, 32 nt, Human
ugccugagcccaggacccacuggagccagccc

SEQ ID NO: 517989 - RNA, 23 nt, Human
ugccugagcccaggaguucaaga

SEQ ID NO: 517990 - RNA, 32 nt, Human
ugccugagcgccgccucugugcccagguccca

SEQ ID NO: 517991 - RNA, 23 nt, Human
ugccugagcucaggaguucaaga

SEQ ID NO: 517992 - RNA, 23 nt, Human
ugccugagcucaggaguucgaga

SEQ ID NO: 517993 - RNA, 23 nt, Human
ugccugagcucaggaguuugaga

SEQ ID NO: 517994 - RNA, 32 nt, Human
ugccugagcuccaagacagggccuccugagga

SEQ ID NO: 517995 - RNA, 32 nt, Human
ugccugagcuggugcugaccucuuagccaugg

SEQ ID NO: 517996 - RNA, 32 nt, Human
ugccugaggacagcagugcaguugacauggau

SEQ ID NO: 517997 - RNA, 32 nt, Human
ugccugaggccccacagcagaguucaacugga

SEQ ID NO: 517998 - RNA, 32 nt, Human
ugccugagggcugugcugagagggagaggagc

SEQ ID NO: 517999 - RNA, 32 nt, Human
ugccugagguaggccuuagaaggggaugaguc

SEQ ID NO: 518000 - RNA, 23 nt, Human
ugccugaggucaggaguucaaga

SEQ ID NO: 518001 - RNA, 32 nt, Human
ugccugaguaccauugggguccuugcccaguc

SEQ ID NO: 518002 - RNA, 32 nt, Human
ugccugaguagcugggacuacaggcaugcacc

SEQ ID NO: 518003 - RNA, 24 nt, Human
ugccugagucaccgccgccgccgc

SEQ ID NO: 518004 - RNA, 32 nt, Human
ugccugaguccaguccugccuuacccguuccu

SEQ ID NO: 518005 - RNA, 23 nt, Human
ugccugaguucaggaguucgaga

SEQ ID NO: 518006 - RNA, 32 nt, Human
ugccugaguucucuccuaggcaaguggccagu

SEQ ID NO: 518007 - RNA, 32 nt, Human
ugccugauggccagggccagaugcuguucuuc

SEQ ID NO: 518008 - RNA, 32 nt, Human
ugccugaugugggaacagcucuucucccagau

SEQ ID NO: 518009 - RNA, 23 nt, Human
ugccugauucaacuguagccugu

SEQ ID NO: 518010 - RNA, 22 nt, Human
ugccugauuccugauucccaug

SEQ ID NO: 518011 - RNA, 32 nt, Human
ugccugcaaaccuaggagagaggucuacaaca

SEQ ID NO: 518012 - RNA, 31 nt, Human
ugccugcaacaacugcucaugccaagcuggg

SEQ ID NO: 518013 - RNA, 32 nt, Human
ugccugcaacccaaguggccuuauccgugcag

SEQ ID NO: 518014 - RNA, 24 nt, Human
ugccugcaaucccagcuacucagg

SEQ ID NO: 518015 - RNA, 24 nt, Human
ugccugcaaucccagcuacucggg

SEQ ID NO: 518016 - RNA, 22 nt, Human
ugccugcaaucccagcuacuug

SEQ ID NO: 518017 - RNA, 24 nt, Human
ugccugcaaucccagcuacuugga

SEQ ID NO: 518018 - RNA, 32 nt, Human
ugccugcaccccgguccucagccugggcuccc

SEQ ID NO: 518019 - RNA, 32 nt, Human
ugccugcaccuugucuuggacuugccagccuu

SEQ ID NO: 518020 - RNA, 21 nt, Human
ugccugcagacccuccagggg

SEQ ID NO: 518021 - RNA, 32 nt, Human
ugccugcagagcagagagaaauuuguagcaau

SEQ ID NO: 518022 - RNA, 32 nt, Human
ugccugcagccugcccugccucucucacaggc

SEQ ID NO: 518023 - RNA, 32 nt, Human
ugccugcagccugccuggcuccgccccuagug

SEQ ID NO: 518024 - RNA, 32 nt, Human
ugccugcagcuuccagcuccuucgucccugau

SEQ ID NO: 518025 - RNA, 24 nt, Human
ugccugcagggccgccgccaccac

SEQ ID NO: 518026 - RNA, 31 nt, Human
ugccugcagguguccaucaccuucaaggacu

SEQ ID NO: 518027 - RNA, 24 nt, Human
ugccugcagucccagcuauucagg

SEQ ID NO: 518028 - RNA, 24 nt, Human
ugccugcagucccaguuacuuggg

SEQ ID NO: 518029 - RNA, 24 nt, Human
ugccugcaguccuagcuacuuggg

SEQ ID NO: 518030 - RNA, 27 nt, Human
ugccugcagugaccagugcucuguggg

SEQ ID NO: 518031 - RNA, 32 nt, Human
ugccugcauacaggcauacacaugcacgcuua

SEQ ID NO: 518032 - RNA, 32 nt, Human
ugccugcauagcacaccuuagaugugguauuu

SEQ ID NO: 518033 - RNA, 32 nt, Human
ugccugcaucucgugugccuguugugcauucu

SEQ ID NO: 518034 - RNA, 32 nt, Human
ugccugcauucaggccaggggccguguuugcu

SEQ ID NO: 518035 - RNA, 32 nt, Human
ugccugccacagagcaaaaggagugguggaac

SEQ ID NO: 518036 - RNA, 32 nt, Human
ugccugccaccaccauccaacagaccuggugc

SEQ ID NO: 518037 - RNA, 32 nt, Human
ugccugccaccugggcccucacagcccagacc

SEQ ID NO: 518038 - RNA, 22 nt, Human
ugccugccacuucuuccagggg

SEQ ID NO: 518039 - RNA, 32 nt, Human
ugccugccagcccuuucuggauuacugauaga

SEQ ID NO: 518040 - RNA, 32 nt, Human
ugccugccauuuucuuuuugcuuagguuuuuc

SEQ ID NO: 518041 - RNA, 32 nt, Human
ugccugcccacaucccugccuccuggaauccu

SEQ ID NO: 518042 - RNA, 32 nt, Human
ugccugcccacccuccacccacugccuucccg

SEQ ID NO: 518043 - RNA, 32 nt, Human
ugccugcccagaacgccugcacccucaccucu

SEQ ID NO: 518044 - RNA, 32 nt, Human
ugccugcccagccugggcccugcaguguggag

SEQ ID NO: 518045 - RNA, 32 nt, Human
ugccugccccacugcacccucucccccuuauc

SEQ ID NO: 518046 - RNA, 20 nt, Human
ugccugccccccaccccagg

SEQ ID NO: 518047 - RNA, 32 nt, Human
ugccugcccccgcugacucaggagcuccggug

SEQ ID NO: 518048 - RNA, 22 nt, Human
ugccugccccgagucccccggg

SEQ ID NO: 518049 - RNA, 19 nt, Human
ugccugccccgccuugggg

SEQ ID NO: 518050 - RNA, 16 nt, Human
ugccugccccucccca

SEQ ID NO: 518051 - RNA, 20 nt, Human
ugccugccccucucccgcca

SEQ ID NO: 518052 - RNA, 31 nt, Human
ugccugccccucucuggcccacugggcgucg

SEQ ID NO: 518053 - RNA, 32 nt, Human
ugccugccccugggcgagugcgggcagggauc

SEQ ID NO: 518054 - RNA, 19 nt, Human
ugccugccccuuccagcug

SEQ ID NO: 518055 - RNA, 17 nt, Human
ugccugcccgccugcuu

SEQ ID NO: 518056 - RNA, 19 nt, Human
ugccugcccgggcccgggg

SEQ ID NO: 518057 - RNA, 32 nt, Human
ugccugcccuauuccuccucccaagucuguuc

SEQ ID NO: 518058 - RNA, 32 nt, Human
ugccugcccucagcucucacacaugacuggag

SEQ ID NO: 518059 - RNA, 19 nt, Human
ugccugcccuccagugcug

SEQ ID NO: 518060 - RNA, 32 nt, Human
ugccugcccucugucugucuucuccuaauucu

SEQ ID NO: 518061 - RNA, 32 nt, Human
ugccugcccugagcugugucucugucuaggua

SEQ ID NO: 518062 - RNA, 32 nt, Human
ugccugcccugccaaggaucuugcuguggacg

SEQ ID NO: 518063 - RNA, 22 nt, Human
ugccugcccugccagagggagg

SEQ ID NO: 518064 - RNA, 24 nt, Human
ugccugcccugccccuccaggggg

SEQ ID NO: 518065 - RNA, 20 nt, Human
ugccugcccugcccuugggg

SEQ ID NO: 518066 - RNA, 32 nt, Human
ugccugcccugccuccgucccaaccaugggcu

SEQ ID NO: 518067 - RNA, 32 nt, Human
ugccugcccugccucuccacgcacaguguuaa

SEQ ID NO: 518068 - RNA, 32 nt, Human
ugccugcccugccucugccugaggcagccgcu

SEQ ID NO: 518069 - RNA, 21 nt, Human
ugccugcccugccuuucaugg

SEQ ID NO: 518070 - RNA, 23 nt, Human
ugccugcccugcuucccccaggg

SEQ ID NO: 518071 - RNA, 19 nt, Human
ugccugcccugggccaggg

SEQ ID NO: 518072 - RNA, 32 nt, Human
ugccugcccugucaggaggcagaaggaagcag

SEQ ID NO: 518073 - RNA, 32 nt, Human
ugccugcccuguucacacaaccccuguggacu

SEQ ID NO: 518074 - RNA, 32 nt, Human
ugccugccgccuucauugauccuguauuaagc

SEQ ID NO: 518075 - RNA, 32 nt, Human
ugccugccggcuuagggaggguugauggggga

SEQ ID NO: 518076 - RNA, 32 nt, Human
ugccugccuacuggccugucucucacaaucca

SEQ ID NO: 518077 - RNA, 24 nt, Human
ugccugccucagccucccaagggg

SEQ ID NO: 518078 - RNA, 32 nt, Human
ugccugccuccaccucuuuaacgagccucuuu

SEQ ID NO: 518079 - RNA, 32 nt, Human
ugccugccuccaggagcaggacgguggcuggg

SEQ ID NO: 518080 - RNA, 32 nt, Human
ugccugccucccucccugucugccuccugccc

SEQ ID NO: 518081 - RNA, 32 nt, Human
ugccugccuccuuccuggugugaauggucagc

SEQ ID NO: 518082 - RNA, 32 nt, Human
ugccugccucucuccuuuccuuccucaucccc

SEQ ID NO: 518083 - RNA, 32 nt, Human
ugccugccugauuccauggcuguugugcugau

SEQ ID NO: 518084 - RNA, 32 nt, Human
ugccugccugcacuauugccccagaggagggc

SEQ ID NO: 518085 - RNA, 32 nt, Human
ugccugccugcagggaguuaccccaguuucca

SEQ ID NO: 518086 - RNA, 32 nt, Human
ugccugccugccugccugccucaguuuauuuc

SEQ ID NO: 518087 - RNA, 32 nt, Human
ugccugccugcucgcucccugcagaggggcug

SEQ ID NO: 518088 - RNA, 32 nt, Human
ugccugccugcucuugagaaaccuggaccagg

SEQ ID NO: 518089 - RNA, 23 nt, Human
ugccugccuggcccacgcugcug

SEQ ID NO: 518090 - RNA, 32 nt, Human
ugccugccuggcuggggagccccagggauagc

SEQ ID NO: 518091 - RNA, 32 nt, Human
ugccugccuguaauccagcuacucaggaggcu

SEQ ID NO: 518092 - RNA, 32 nt, Human
ugccugccuguaaucccagcacugugggaggc

SEQ ID NO: 518093 - RNA, 32 nt, Human
ugccugccugucucuaguuucucucacauccc

SEQ ID NO: 518094 - RNA, 32 nt, Human
ugccugccuguuacagaucacuucuccgucgg

SEQ ID NO: 518095 - RNA, 32 nt, Human
ugccugccuucccauauuggucccuugacauu

SEQ ID NO: 518096 - RNA, 32 nt, Human
ugccugccuuccucccagaggguguuuccuag

SEQ ID NO: 518097 - RNA, 32 nt, Human
ugccugccuucucuagcggcacagaagcagcc

SEQ ID NO: 518098 - RNA, 32 nt, Human
ugccugcggccugucuguguuugucuuacuca

SEQ ID NO: 518099 - RNA, 32 nt, Human
ugccugcuaagguacugaguugacaauuuuau

SEQ ID NO: 518100 - RNA, 32 nt, Human
ugccugcuaguaagcagucacauaagugggua

SEQ ID NO: 518101 - RNA, 32 nt, Human
ugccugcucacugaccaacugccccucgccca

SEQ ID NO: 518102 - RNA, 32 nt, Human
ugccugcucagcugccucgggcccucaccuga

SEQ ID NO: 518103 - RNA, 32 nt, Human
ugccugcuccagacauuuuguucuugaaucug

SEQ ID NO: 518104 - RNA, 32 nt, Human
ugccugcucccagagaagcuugucuaaccuag

SEQ ID NO: 518105 - RNA, 19 nt, Human
ugccugcuccuccaugcug

SEQ ID NO: 518106 - RNA, 32 nt, Human
ugccugcuccugggcagugguuuuguugccug

SEQ ID NO: 518107 - RNA, 24 nt, Human
ugccugcucgcucccugcagaggg

SEQ ID NO: 518108 - RNA, 32 nt, Human
ugccugcugaagggaagccaggcagcucucua

SEQ ID NO: 518109 - RNA, 32 nt, Human
ugccugcugagccaguccuggagcccauaccu

SEQ ID NO: 518110 - RNA, 22 nt, Human
ugccugcugaugcccacagggg

SEQ ID NO: 518111 - RNA, 32 nt, Human
ugccugcugccaccagcauccucuggaguccu

SEQ ID NO: 518112 - RNA, 32 nt, Human
ugccugcugcccucucuggugccuguggagau

SEQ ID NO: 518113 - RNA, 32 nt, Human
ugccugcugcucccuuuuucugucucugucca

SEQ ID NO: 518114 - RNA, 32 nt, Human
ugccugcugcucggcuuugcuuuugcuuuucc

SEQ ID NO: 518115 - RNA, 32 nt, Human
ugccugcugcuuccuuccccuguuuacagcaa

SEQ ID NO: 518116 - RNA, 22 nt, Human
ugccugcuggaagcucuguggg

SEQ ID NO: 518117 - RNA, 21 nt, Human
ugccugcuggaguuuucugcc

SEQ ID NO: 518118 - RNA, 32 nt, Human
ugccugcuggcugcacggcagcuguucuugga

SEQ ID NO: 518119 - RNA, 21 nt, Human
ugccugcugggacccuggcca

SEQ ID NO: 518120 - RNA, 32 nt, Human
ugccugcuguagguaucugugugugcaccuug

SEQ ID NO: 518121 - RNA, 32 nt, Human
ugccugcugugcugggagguauagggguccug

SEQ ID NO: 518122 - RNA, 32 nt, Human
ugccugcuuccccagcccugccaguuuccaga

SEQ ID NO: 518123 - RNA, 32 nt, Human
ugccugcuugccaaaagcuaggaugcuucagg

SEQ ID NO: 518124 - RNA, 32 nt, Human
ugccugcuugcucuccuuugcugauggauugc

SEQ ID NO: 518125 - RNA, 32 nt, Human
ugccugcuuucuggucacauguggaccuugau

SEQ ID NO: 518126 - RNA, 32 nt, Human
ugccuggaaaggagggacuggagcagccagga

SEQ ID NO: 518127 - RNA, 31 nt, Human
ugccuggaaaugucucccgaaaaggaugaaa

SEQ ID NO: 518128 - RNA, 32 nt, Human
ugccuggaacaccgcugccacuguggcuccag

SEQ ID NO: 518129 - RNA, 32 nt, Human
ugccuggaacauucuucccauagugucugcau

SEQ ID NO: 518130 - RNA, 20 nt, Human
ugccuggaaccauccagaug

SEQ ID NO: 518131 - RNA, 32 nt, Human
ugccuggaagcugaaugcccaucucuguggac

SEQ ID NO: 518132 - RNA, 22 nt, Human
ugccuggaaggggccuccuagg

SEQ ID NO: 518133 - RNA, 32 nt, Human
ugccuggaccuagccaggcucacuguugaagu

SEQ ID NO: 518134 - RNA, 21 nt, Human
ugccuggacgccccccuggug

SEQ ID NO: 518135 - RNA, 24 nt, Human
ugccuggacuucccuucccaggga

SEQ ID NO: 518136 - RNA, 32 nt, Human
ugccuggagaggauucaagaugaccaacgaag

SEQ ID NO: 518137 - RNA, 32 nt, Human
ugccuggagaugggaauguggccucagugccu

SEQ ID NO: 518138 - RNA, 32 nt, Human
ugccuggagcaucuggcagccccacaccugcc

SEQ ID NO: 518139 - RNA, 32 nt, Human
ugccuggagccugggccaggcccagcccaucu

SEQ ID NO: 518140 - RNA, 32 nt, Human
ugccuggagcgccaugguauggggaaggacag

SEQ ID NO: 518141 - RNA, 32 nt, Human
ugccuggaggaugggugcgcagcucugcccuc

SEQ ID NO: 518142 - RNA, 32 nt, Human
ugccuggaggggacaucagggaagaggcuucc

SEQ ID NO: 518143 - RNA, 32 nt, Human
ugccuggaggggcggaguuuccaagauaacag

SEQ ID NO: 518144 - RNA, 32 nt, Human
ugccuggaggugugggagggaagaugaguuau

SEQ ID NO: 518145 - RNA, 32 nt, Human
ugccuggagucccgccccugcccagaacccuu

SEQ ID NO: 518146 - RNA, 23 nt, Human
ugccuggagucgucuguccaagg

SEQ ID NO: 518147 - RNA, 32 nt, Human
ugccuggaguggagcugagagcucaggucugg

SEQ ID NO: 518148 - RNA, 32 nt, Human
ugccuggaguuacauaacccauugugcuucca

SEQ ID NO: 518149 - RNA, 25 nt, Human
ugccuggauacaggagcucuguggg

SEQ ID NO: 518150 - RNA, 32 nt, Human
ugccuggaucccggcagaagcuaugaaaggga

SEQ ID NO: 518151 - RNA, 32 nt, Human
ugccuggaugucugcggccaccccagacaugc

SEQ ID NO: 518152 - RNA, 32 nt, Human
ugccuggauuacaggcaugagccacugcaccc

SEQ ID NO: 518153 - RNA, 22 nt, Human
ugccuggcaaccuaggcccucc

SEQ ID NO: 518154 - RNA, 23 nt, Human
ugccuggcacagggaacagcaug

SEQ ID NO: 518155 - RNA, 22 nt, Human
ugccuggcacagugucugguac

SEQ ID NO: 518156 - RNA, 32 nt, Human
ugccuggcacagugucugguacauuuguguuu

SEQ ID NO: 518157 - RNA, 32 nt, Human
ugccuggcagaagguguuaugcuuuucuggcu

SEQ ID NO: 518158 - RNA, 32 nt, Human
ugccuggcagaauccacagagcagcccaggug

SEQ ID NO: 518159 - RNA, 32 nt, Human
ugccuggcagaaugcccugccugccugccugc

SEQ ID NO: 518160 - RNA, 32 nt, Human
ugccuggcagccaaggguguuggucgcgaagc

SEQ ID NO: 518161 - RNA, 32 nt, Human
ugccuggcagcccucagaugugauuuggccuu

SEQ ID NO: 518162 - RNA, 32 nt, Human
ugccuggcaucgagaagaacuggagcaccgac

SEQ ID NO: 518163 - RNA, 21 nt, Human
ugccuggcaugacaucucucc

SEQ ID NO: 518164 - RNA, 32 nt, Human
ugccuggccacugcucccuaagccagccuggu

SEQ ID NO: 518165 - RNA, 32 nt, Human
ugccuggccagccugcuguaagcuagaaccca

SEQ ID NO: 518166 - RNA, 24 nt, Human
ugccuggccaggggcucugcuggg

SEQ ID NO: 518167 - RNA, 32 nt, Human
ugccuggccagucagcagcacagccaucaucu

SEQ ID NO: 518168 - RNA, 32 nt, Human
ugccuggccaugucaccuugaagcugugaccu

SEQ ID NO: 518169 - RNA, 19 nt, Human
ugccuggcccaggcucacc

SEQ ID NO: 518170 - RNA, 20 nt, Human
ugccuggcccauagacaucc

SEQ ID NO: 518171 - RNA, 21 nt, Human
ugccuggcccccaggcccucc

SEQ ID NO: 518172 - RNA, 20 nt, Human
ugccuggccccccagcuucc

SEQ ID NO: 518173 - RNA, 21 nt, Human
ugccuggccccccuggcuccc

SEQ ID NO: 518174 - RNA, 22 nt, Human
ugccuggcccccuguccucucu

SEQ ID NO: 518175 - RNA, 32 nt, Human
ugccuggcccccuguccucucuggcuggggag

SEQ ID NO: 518176 - RNA, 32 nt, Human
ugccuggccccucgccuguggagcucagcccc

SEQ ID NO: 518177 - RNA, 19 nt, Human
ugccuggccccugcugcug

SEQ ID NO: 518178 - RNA, 22 nt, Human
ugccuggccccugcugcugucc

SEQ ID NO: 518179 - RNA, 20 nt, Human
ugccuggccccuggccaucc

SEQ ID NO: 518180 - RNA, 20 nt, Human
ugccuggcccggcggccucc

SEQ ID NO: 518181 - RNA, 17 nt, Human
ugccuggcccugagcca

SEQ ID NO: 518182 - RNA, 32 nt, Human
ugccuggcccugcuugaaugucaugaacaggu

SEQ ID NO: 518183 - RNA, 19 nt, Human
ugccuggccuccccucuca

SEQ ID NO: 518184 - RNA, 21 nt, Human
ugccuggccuccccugccccc

SEQ ID NO: 518185 - RNA, 18 nt, Human
ugccuggccugguagcuc

SEQ ID NO: 518186 - RNA, 20 nt, Human
ugccuggccugucagcuccc

SEQ ID NO: 518187 - RNA, 22 nt, Human
ugccuggccuguggguucugcc

SEQ ID NO: 518188 - RNA, 18 nt, Human
ugccuggccuuccagaug

SEQ ID NO: 518189 - RNA, 23 nt, Human
ugccuggcgcuauuuuugcaggg

SEQ ID NO: 518190 - RNA, 20 nt, Human
ugccuggcggccaggccucc

SEQ ID NO: 518191 - RNA, 32 nt, Human
ugccuggcgucucugugccccugugagaaucu

SEQ ID NO: 518192 - RNA, 20 nt, Human
ugccuggcuaccugcucaug

SEQ ID NO: 518193 - RNA, 24 nt, Human
ugccuggcuacuuggcaccaggga

SEQ ID NO: 518194 - RNA, 23 nt, Human
ugccuggcuauuccaugcucaug

SEQ ID NO: 518195 - RNA, 21 nt, Human
ugccuggcucauuaccugcca

SEQ ID NO: 518196 - RNA, 21 nt, Human
ugccuggcuccacgugccucc

SEQ ID NO: 518197 - RNA, 18 nt, Human
ugccuggcuccauucucc

SEQ ID NO: 518198 - RNA, 32 nt, Human
ugccuggcucccgguugcuuguguaaacucaa

SEQ ID NO: 518199 - RNA, 32 nt, Human
ugccuggcucccugucuucauucuccacgcag

SEQ ID NO: 518200 - RNA, 32 nt, Human
ugccuggcuccggcauccggaaacccacgugg

SEQ ID NO: 518201 - RNA, 22 nt, Human
ugccuggcuccuagauggcucu

SEQ ID NO: 518202 - RNA, 32 nt, Human
ugccuggcuccucugggcuaggcucuucucua

SEQ ID NO: 518203 - RNA, 32 nt, Human
ugccuggcucuucuccacuggaccagggagcu

SEQ ID NO: 518204 - RNA, 23 nt, Human
ugccuggcugucucccagcuccc

SEQ ID NO: 518205 - RNA, 19 nt, Human
ugccuggcuuccuucuggu

SEQ ID NO: 518206 - RNA, 32 nt, Human
ugccuggcuucucugccuccagccuuuggggu

SEQ ID NO: 518207 - RNA, 32 nt, Human
ugccuggcuuggcugcagugcacuuugaaaug

SEQ ID NO: 518208 - RNA, 32 nt, Human
ugccuggcuuggugccuggcaccuagaaagca

SEQ ID NO: 518209 - RNA, 32 nt, Human
ugccuggcuuuauuuaaaggaacugcaguagg

SEQ ID NO: 518210 - RNA, 22 nt, Human
ugccuggcuuugccccacugac

SEQ ID NO: 518211 - RNA, 32 nt, Human
ugccugggaaaaugguuugucuuccaggacaa

SEQ ID NO: 518212 - RNA, 32 nt, Human
ugccugggaaacaggcuucauucagcacagcu

SEQ ID NO: 518213 - RNA, 32 nt, Human
ugccugggaccuggaaaguguuuagauucuug

SEQ ID NO: 518214 - RNA, 21 nt, Human
ugccugggacgcugcuugcca

SEQ ID NO: 518215 - RNA, 32 nt, Human
ugccugggagaacagagcaggagcgucgugcg

SEQ ID NO: 518216 - RNA, 32 nt, Human
ugccugggaggcacguagaggcccagagaguc

SEQ ID NO: 518217 - RNA, 32 nt, Human
ugccugggaggcugaggcaggagaauugcuug

SEQ ID NO: 518218 - RNA, 32 nt, Human
ugccugggaggcugccaggggguggggcuucu

SEQ ID NO: 518219 - RNA, 32 nt, Human
ugccugggagugugugguguuagggugcagcc

SEQ ID NO: 518220 - RNA, 32 nt, Human
ugccugggauggagugggcgggcagguguagc

SEQ ID NO: 518221 - RNA, 32 nt, Human
ugccugggccauggccagcucuagguggauuc

SEQ ID NO: 518222 - RNA, 32 nt, Human
ugccugggcccaggcuggggguuuucaguauu

SEQ ID NO: 518223 - RNA, 20 nt, Human
ugccugggccccccuccagg

SEQ ID NO: 518224 - RNA, 32 nt, Human
ugccugggccucggucccuccugcaccugcug

SEQ ID NO: 518225 - RNA, 21 nt, Human
ugccugggcuggagugcagug

SEQ ID NO: 518226 - RNA, 32 nt, Human
ugccugggcuggcugugaggccaccuuugucc

SEQ ID NO: 518227 - RNA, 32 nt, Human
ugccugggcuguuggcacucacagaccuggag

SEQ ID NO: 518228 - RNA, 26 nt, Human
ugccugggcuucaggccuucuggcac

SEQ ID NO: 518229 - RNA, 32 nt, Human
ugccugggcuuuggugagaggggcagacucug

SEQ ID NO: 518230 - RNA, 32 nt, Human
ugccuggggaaguuuuuccuccccaaggcggc

SEQ ID NO: 518231 - RNA, 32 nt, Human
ugccuggggaauggggaucaugggugcuggca

SEQ ID NO: 518232 - RNA, 31 nt, Human
ugccuggggcacuggaacacauuccuggggg

SEQ ID NO: 518233 - RNA, 32 nt, Human
ugccuggggcccuggcuccuucucggcugccc

SEQ ID NO: 518234 - RNA, 32 nt, Human
ugccuggggccugcucucucccaggaauucuc

SEQ ID NO: 518235 - RNA, 32 nt, Human
ugccuggggccugggucaagggccagucagca

SEQ ID NO: 518236 - RNA, 32 nt, Human
ugccuggggcguccucccuggagcugggggag

SEQ ID NO: 518237 - RNA, 32 nt, Human
ugccugggggagagaggcagcaagucuuaaca

SEQ ID NO: 518238 - RNA, 32 nt, Human
ugccugggggcucccccgacccucucucuauu

SEQ ID NO: 518239 - RNA, 24 nt, Human
ugccuggggucgaaggagcugcuu

SEQ ID NO: 518240 - RNA, 32 nt, Human
ugccuggggucuacuccauaaggguuuacaaa

SEQ ID NO: 518241 - RNA, 32 nt, Human
ugccugggguggaggcuaagccuggacacagu

SEQ ID NO: 518242 - RNA, 32 nt, Human
ugccuggguaacagccacugagauccuccagc

SEQ ID NO: 518243 - RNA, 32 nt, Human
ugccuggguccuggcccuccucccccaucugc

SEQ ID NO: 518244 - RNA, 32 nt, Human
ugccugggucucccugucucuccagccaguau

SEQ ID NO: 518245 - RNA, 32 nt, Human
ugccugggugcagcuucucuagcuggccuugc

SEQ ID NO: 518246 - RNA, 32 nt, Human
ugccugguaggugacuggaggcauugagcagu

SEQ ID NO: 518247 - RNA, 32 nt, Human
ugccugguaggugacuggaggccuugaucggu

SEQ ID NO: 518248 - RNA, 26 nt, Human
ugccuggucccaagccucuuuugcca

SEQ ID NO: 518249 - RNA, 32 nt, Human
ugccuggucccaagccucuuuugccaugguca

SEQ ID NO: 518250 - RNA, 20 nt, Human
ugccuggucccggcuccacc

SEQ ID NO: 518251 - RNA, 21 nt, Human
ugccuggucugcuuucuucca

SEQ ID NO: 518252 - RNA, 21 nt, Human
ugccuggucuuugucuccgcc

SEQ ID NO: 518253 - RNA, 32 nt, Human
ugccuggugcauuuccugucuccugagcaucu

SEQ ID NO: 518254 - RNA, 24 nt, Human
ugccuggugccaacaggggcaucc

SEQ ID NO: 518255 - RNA, 24 nt, Human
ugccuggugcccagugaccugggg

SEQ ID NO: 518256 - RNA, 18 nt, Human
ugccuggugcccuccugg

SEQ ID NO: 518257 - RNA, 20 nt, Human
ugccugguggauguuucugg

SEQ ID NO: 518258 - RNA, 23 nt, Human
ugccugguggugcuagcuccucc

SEQ ID NO: 518259 - RNA, 32 nt, Human
ugccuggugucggccaccuccguguggacggc

SEQ ID NO: 518260 - RNA, 32 nt, Human
ugccuggugucucccugacugcagaggagccc

SEQ ID NO: 518261 - RNA, 32 nt, Human
ugccugguucucuugcuccaccaggaacaagc

SEQ ID NO: 518262 - RNA, 32 nt, Human
ugccugguuuucgagcagguccuggcugagcg

SEQ ID NO: 518263 - RNA, 32 nt, Human
ugccuguaaaacaccugggaaguuccacuggu

SEQ ID NO: 518264 - RNA, 21 nt, Human
ugccuguaacagccaccugga

SEQ ID NO: 518265 - RNA, 24 nt, Human
ugccuguaaccccagcacuuuggg

SEQ ID NO: 518266 - RNA, 24 nt, Human
ugccuguaaccccagcuacucagg

SEQ ID NO: 518267 - RNA, 24 nt, Human
ugccuguaaccccagcuacucggg

SEQ ID NO: 518268 - RNA, 21 nt, Human
ugccuguaagaacuacucucc

SEQ ID NO: 518269 - RNA, 26 nt, Human
ugccuguaauaccaugucuucccaug

SEQ ID NO: 518270 - RNA, 24 nt, Human
ugccuguaauagcagcuacucggg

SEQ ID NO: 518271 - RNA, 32 nt, Human
ugccuguaaucaaucccagcacuuugggaggc

SEQ ID NO: 518272 - RNA, 24 nt, Human
ugccuguaaucacagcuacucggg

SEQ ID NO: 518273 - RNA, 22 nt, Human
ugccuguaaucagcuacucggg

SEQ ID NO: 518274 - RNA, 32 nt, Human
ugccuguaaucagcuacucgggaggcugaggc

SEQ ID NO: 518275 - RNA, 24 nt, Human
ugccuguaauccaacuacccagga

SEQ ID NO: 518276 - RNA, 24 nt, Human
ugccuguaauccaagcuacucgga

SEQ ID NO: 518277 - RNA, 24 nt, Human
ugccuguaauccagcuacucagga

SEQ ID NO: 518278 - RNA, 32 nt, Human
ugccuguaauccagcuacucaggaggcugagg

SEQ ID NO: 518279 - RNA, 24 nt, Human
ugccuguaaucccaaaacuuuggg

SEQ ID NO: 518280 - RNA, 24 nt, Human
ugccuguaaucccaacacucuggg

SEQ ID NO: 518281 - RNA, 24 nt, Human
ugccuguaaucccaacacuuaggg

SEQ ID NO: 518282 - RNA, 24 nt, Human
ugccuguaaucccaacacuucagg

SEQ ID NO: 518283 - RNA, 21 nt, Human
ugccuguaaucccaacacuuu

SEQ ID NO: 518284 - RNA, 23 nt, Human
ugccuguaaucccaacacuuuga

SEQ ID NO: 518285 - RNA, 24 nt, Human
ugccuguaaucccaacacuuuggg

SEQ ID NO: 518286 - RNA, 24 nt, Human
ugccuguaaucccaacacuuuugg

SEQ ID NO: 518287 - RNA, 24 nt, Human
ugccuguaaucccaacauucuggg

SEQ ID NO: 518288 - RNA, 24 nt, Human
ugccuguaaucccaacauuuuggg

SEQ ID NO: 518289 - RNA, 24 nt, Human
ugccuguaaucccaacuaccugga

SEQ ID NO: 518290 - RNA, 24 nt, Human
ugccuguaaucccaacuacucagg

SEQ ID NO: 518291 - RNA, 24 nt, Human
ugccuguaaucccaacuacucggg

SEQ ID NO: 518292 - RNA, 24 nt, Human
ugccuguaaucccaacuacuuggg

SEQ ID NO: 518293 - RNA, 23 nt, Human
ugccuguaaucccaacucuuggg

SEQ ID NO: 518294 - RNA, 24 nt, Human
ugccuguaaucccaauacuuuggg

SEQ ID NO: 518295 - RNA, 24 nt, Human
ugccuguaaucccaccacuuuggg

SEQ ID NO: 518296 - RNA, 24 nt, Human
ugccuguaaucccagaacuuugga

SEQ ID NO: 518297 - RNA, 24 nt, Human
ugccuguaaucccagaacuuuggg

SEQ ID NO: 518298 - RNA, 24 nt, Human
ugccuguaaucccagaauuuuggg

SEQ ID NO: 518299 - RNA, 24 nt, Human
ugccuguaaucccagauacucagg

SEQ ID NO: 518300 - RNA, 24 nt, Human
ugccuguaaucccagauacuuggg

SEQ ID NO: 518301 - RNA, 24 nt, Human
ugccuguaaucccagcaauuuagg

SEQ ID NO: 518302 - RNA, 24 nt, Human
ugccuguaaucccagcaauuuggg

SEQ ID NO: 518303 - RNA, 24 nt, Human
ugccuguaaucccagcacauuggg

SEQ ID NO: 518304 - RNA, 24 nt, Human
ugccuguaaucccagcacccuggg

SEQ ID NO: 518305 - RNA, 22 nt, Human
ugccuguaaucccagcaccuug

SEQ ID NO: 518306 - RNA, 24 nt, Human
ugccuguaaucccagcacucugga

SEQ ID NO: 518307 - RNA, 24 nt, Human
ugccuguaaucccagcacucuggg

SEQ ID NO: 518308 - RNA, 20 nt, Human
ugccuguaaucccagcacuu

SEQ ID NO: 518309 - RNA, 23 nt, Human
ugccuguaaucccagcacuuagg

SEQ ID NO: 518310 - RNA, 24 nt, Human
ugccuguaaucccagcacuucagg

SEQ ID NO: 518311 - RNA, 24 nt, Human
ugccuguaaucccagcacuucggg

SEQ ID NO: 518312 - RNA, 23 nt, Human
ugccuguaaucccagcacuugga

SEQ ID NO: 518313 - RNA, 23 nt, Human
ugccuguaaucccagcacuuggg

SEQ ID NO: 518314 - RNA, 21 nt, Human
ugccuguaaucccagcacuuu

SEQ ID NO: 518315 - RNA, 24 nt, Human
ugccuguaaucccagcacuuuagg

SEQ ID NO: 518316 - RNA, 23 nt, Human
ugccuguaaucccagcacuuuga

SEQ ID NO: 518317 - RNA, 23 nt, Human
ugccuguaaucccagcacuuugg

SEQ ID NO: 518318 - RNA, 24 nt, Human
ugccuguaaucccagcacuuugga

SEQ ID NO: 518319 - RNA, 24 nt, Human
ugccuguaaucccagcacuuuggg

SEQ ID NO: 518320 - RNA, 32 nt, Human
ugccuguaaucccagcacuuuugaggcugagg

SEQ ID NO: 518321 - RNA, 32 nt, Human
ugccuguaaucccagcaugcugggaggccaag

SEQ ID NO: 518322 - RNA, 24 nt, Human
ugccuguaaucccagcauguuggg

SEQ ID NO: 518323 - RNA, 24 nt, Human
ugccuguaaucccagcauucuggg

SEQ ID NO: 518324 - RNA, 23 nt, Human
ugccuguaaucccagcauuuugg

SEQ ID NO: 518325 - RNA, 24 nt, Human
ugccuguaaucccagcauuuuggg

SEQ ID NO: 518326 - RNA, 24 nt, Human
ugccuguaaucccagccacucagg

SEQ ID NO: 518327 - RNA, 24 nt, Human
ugccuguaaucccagccacuuggg

SEQ ID NO: 518328 - RNA, 24 nt, Human
ugccuguaaucccagcgcuuuggg

SEQ ID NO: 518329 - RNA, 24 nt, Human
ugccuguaaucccagcuaaucagg

SEQ ID NO: 518330 - RNA, 24 nt, Human
ugccuguaaucccagcuacacugg

SEQ ID NO: 518331 - RNA, 24 nt, Human
ugccuguaaucccagcuacccagg

SEQ ID NO: 518332 - RNA, 24 nt, Human
ugccuguaaucccagcuacccggg

SEQ ID NO: 518333 - RNA, 20 nt, Human
ugccuguaaucccagcuacu

SEQ ID NO: 518334 - RNA, 23 nt, Human
ugccuguaaucccagcuacuagg

SEQ ID NO: 518335 - RNA, 24 nt, Human
ugccuguaaucccagcuacucagg

SEQ ID NO: 518336 - RNA, 24 nt, Human
ugccuguaaucccagcuacuccgg

SEQ ID NO: 518337 - RNA, 24 nt, Human
ugccuguaaucccagcuacucgga

SEQ ID NO: 518338 - RNA, 24 nt, Human
ugccuguaaucccagcuacucggg

SEQ ID NO: 518339 - RNA, 24 nt, Human
ugccuguaaucccagcuacucugg

SEQ ID NO: 518340 - RNA, 23 nt, Human
ugccuguaaucccagcuacuggg

SEQ ID NO: 518341 - RNA, 24 nt, Human
ugccuguaaucccagcuacuggga

SEQ ID NO: 518342 - RNA, 24 nt, Human
ugccuguaaucccagcuacuuagg

SEQ ID NO: 518343 - RNA, 22 nt, Human
ugccuguaaucccagcuacuug

SEQ ID NO: 518344 - RNA, 24 nt, Human
ugccuguaaucccagcuacuuggg

SEQ ID NO: 518345 - RNA, 24 nt, Human
ugccuguaaucccagcuacuuugg

SEQ ID NO: 518346 - RNA, 24 nt, Human
ugccuguaaucccagcuauucagg

SEQ ID NO: 518347 - RNA, 24 nt, Human
ugccuguaaucccagcuauucgga

SEQ ID NO: 518348 - RNA, 24 nt, Human
ugccuguaaucccagcuauucggg

SEQ ID NO: 518349 - RNA, 24 nt, Human
ugccuguaaucccagcuauuuggg

SEQ ID NO: 518350 - RNA, 24 nt, Human
ugccuguaaucccagcuccuuggg

SEQ ID NO: 518351 - RNA, 24 nt, Human
ugccuguaaucccagcucuuuggg

SEQ ID NO: 518352 - RNA, 24 nt, Human
ugccuguaaucccagcugcucagg

SEQ ID NO: 518353 - RNA, 24 nt, Human
ugccuguaaucccagcugcuuggg

SEQ ID NO: 518354 - RNA, 24 nt, Human
ugccuguaaucccagcuguuuggg

SEQ ID NO: 518355 - RNA, 23 nt, Human
ugccuguaaucccagcuucugga

SEQ ID NO: 518356 - RNA, 24 nt, Human
ugccuguaaucccagcuucuuggg

SEQ ID NO: 518357 - RNA, 23 nt, Human
ugccuguaaucccaggacuuugg

SEQ ID NO: 518358 - RNA, 24 nt, Human
ugccuguaaucccaggacuuuggg

SEQ ID NO: 518359 - RNA, 22 nt, Human
ugccuguaaucccagguacuug

SEQ ID NO: 518360 - RNA, 24 nt, Human
ugccuguaaucccagguacuugga

SEQ ID NO: 518361 - RNA, 24 nt, Human
ugccuguaaucccaguacucuggg

SEQ ID NO: 518362 - RNA, 24 nt, Human
ugccuguaaucccaguacuuuggg

SEQ ID NO: 518363 - RNA, 24 nt, Human
ugccuguaaucccagugcuuugga

SEQ ID NO: 518364 - RNA, 24 nt, Human
ugccuguaaucccagugcuuuggg

SEQ ID NO: 518365 - RNA, 32 nt, Human
ugccuguaaucccagugcuuugggaggcugag

SEQ ID NO: 518366 - RNA, 24 nt, Human
ugccuguaaucccaguuacucagg

SEQ ID NO: 518367 - RNA, 23 nt, Human
ugccuguaaucccaguuacuggg

SEQ ID NO: 518368 - RNA, 24 nt, Human
ugccuguaaucccaguuacuuggg

SEQ ID NO: 518369 - RNA, 24 nt, Human
ugccuguaaucccaucuacucagg

SEQ ID NO: 518370 - RNA, 24 nt, Human
ugccuguaaucccggcuacucagg

SEQ ID NO: 518371 - RNA, 32 nt, Human
ugccuguaaucccggcuacuugggaggcugag

SEQ ID NO: 518372 - RNA, 24 nt, Human
ugccuguaaucccggcuauucaga

SEQ ID NO: 518373 - RNA, 24 nt, Human
ugccuguaaucccgguacuuuggg

SEQ ID NO: 518374 - RNA, 23 nt, Human
ugccuguaaucccugcacuuagg

SEQ ID NO: 518375 - RNA, 24 nt, Human
ugccuguaaucccugcuacucagg

SEQ ID NO: 518376 - RNA, 24 nt, Human
ugccuguaaucccugcuacuuggg

SEQ ID NO: 518377 - RNA, 24 nt, Human
ugccuguaauccuagcacuuugga

SEQ ID NO: 518378 - RNA, 24 nt, Human
ugccuguaauccuagcuacucagg

SEQ ID NO: 518379 - RNA, 23 nt, Human
ugccuguaauccuagcuacuugg

SEQ ID NO: 518380 - RNA, 24 nt, Human
ugccuguaauccuagcuacuuggg

SEQ ID NO: 518381 - RNA, 24 nt, Human
ugccuguaauccuggcuacuuggg

SEQ ID NO: 518382 - RNA, 21 nt, Human
ugccuguaaucgcagcacuuu

SEQ ID NO: 518383 - RNA, 24 nt, Human
ugccuguaaucgcagcuacucagg

SEQ ID NO: 518384 - RNA, 23 nt, Human
ugccuguaaucguagcacuuuga

SEQ ID NO: 518385 - RNA, 24 nt, Human
ugccuguaaucuaagcuacuuggg

SEQ ID NO: 518386 - RNA, 24 nt, Human
ugccuguaaucucaacuacuuggg

SEQ ID NO: 518387 - RNA, 24 nt, Human
ugccuguaaucucaccuacuuggg

SEQ ID NO: 518388 - RNA, 23 nt, Human
ugccuguaaucucagcacuuuga

SEQ ID NO: 518389 - RNA, 20 nt, Human
ugccuguaaucucagcuacu

SEQ ID NO: 518390 - RNA, 24 nt, Human
ugccuguaaucucagcuacucagg

SEQ ID NO: 518391 - RNA, 24 nt, Human
ugccuguaaucucagcuacucggg

SEQ ID NO: 518392 - RNA, 23 nt, Human
ugccuguaaucucagcuacuugg

SEQ ID NO: 518393 - RNA, 24 nt, Human
ugccuguaaucucagcuacuuggg

SEQ ID NO: 518394 - RNA, 24 nt, Human
ugccuguaaucuccgcuacuuagg

SEQ ID NO: 518395 - RNA, 24 nt, Human
ugccuguaauuucagcuacuuggg

SEQ ID NO: 518396 - RNA, 32 nt, Human
ugccuguacauacacaugcacacccucucuga

SEQ ID NO: 518397 - RNA, 32 nt, Human
ugccuguacuguacuccagccugggaaacaau

SEQ ID NO: 518398 - RNA, 24 nt, Human
ugccuguagcccaagcuacucaga

SEQ ID NO: 518399 - RNA, 24 nt, Human
ugccuguagccccagcuacucagg

SEQ ID NO: 518400 - RNA, 24 nt, Human
ugccuguagccccagcuacuuggg

SEQ ID NO: 518401 - RNA, 32 nt, Human
ugccuguaggggugaaaggagcagggaccggc

SEQ ID NO: 518402 - RNA, 32 nt, Human
ugccuguaguaaucccagcacuuuuggaggcc

SEQ ID NO: 518403 - RNA, 20 nt, Human
ugccuguaguccaagcuacu

SEQ ID NO: 518404 - RNA, 22 nt, Human
ugccuguaguccaagcuacuug

SEQ ID NO: 518405 - RNA, 24 nt, Human
ugccuguagucccaacuacuaggg

SEQ ID NO: 518406 - RNA, 24 nt, Human
ugccuguagucccaccuacuuggg

SEQ ID NO: 518407 - RNA, 24 nt, Human
ugccuguagucccacuuacuuggg

SEQ ID NO: 518408 - RNA, 24 nt, Human
ugccuguagucccagauacuuggg

SEQ ID NO: 518409 - RNA, 24 nt, Human
ugccuguagucccagcaacucagg

SEQ ID NO: 518410 - RNA, 23 nt, Human
ugccuguagucccagcacucggg

SEQ ID NO: 518411 - RNA, 26 nt, Human
ugccuguagucccagcacucuguggg

SEQ ID NO: 518412 - RNA, 24 nt, Human
ugccuguagucccagcacuuuggg

SEQ ID NO: 518413 - RNA, 20 nt, Human
ugccuguagucccagccacu

SEQ ID NO: 518414 - RNA, 23 nt, Human
ugccuguagucccagccacuagg

SEQ ID NO: 518415 - RNA, 24 nt, Human
ugccuguagucccagccacucaga

SEQ ID NO: 518416 - RNA, 24 nt, Human
ugccuguagucccagccacuuggg

SEQ ID NO: 518417 - RNA, 24 nt, Human
ugccuguagucccagcuaacuggg

SEQ ID NO: 518418 - RNA, 24 nt, Human
ugccuguagucccagcuaaucagg

SEQ ID NO: 518419 - RNA, 24 nt, Human
ugccuguagucccagcuaccuggg

SEQ ID NO: 518420 - RNA, 20 nt, Human
ugccuguagucccagcuacu

SEQ ID NO: 518421 - RNA, 24 nt, Human
ugccuguagucccagcuacucaga

SEQ ID NO: 518422 - RNA, 24 nt, Human
ugccuguagucccagcuacucagg

SEQ ID NO: 518423 - RNA, 24 nt, Human
ugccuguagucccagcuacuccgg

SEQ ID NO: 518424 - RNA, 23 nt, Human
ugccuguagucccagcuacucgg

SEQ ID NO: 518425 - RNA, 24 nt, Human
ugccuguagucccagcuacucggg

SEQ ID NO: 518426 - RNA, 24 nt, Human
ugccuguagucccagcuacucugg

SEQ ID NO: 518427 - RNA, 22 nt, Human
ugccuguagucccagcuacugg

SEQ ID NO: 518428 - RNA, 23 nt, Human
ugccuguagucccagcuacuggg

SEQ ID NO: 518429 - RNA, 24 nt, Human
ugccuguagucccagcuacuuagg

SEQ ID NO: 518430 - RNA, 24 nt, Human
ugccuguagucccagcuacuucgg

SEQ ID NO: 518431 - RNA, 22 nt, Human
ugccuguagucccagcuacuug

SEQ ID NO: 518432 - RNA, 32 nt, Human
ugccuguagucccagcuacuugaguggccgag

SEQ ID NO: 518433 - RNA, 23 nt, Human
ugccuguagucccagcuacuugg

SEQ ID NO: 518434 - RNA, 24 nt, Human
ugccuguagucccagcuacuuggg

SEQ ID NO: 518435 - RNA, 24 nt, Human
ugccuguagucccagcuagucugg

SEQ ID NO: 518436 - RNA, 24 nt, Human
ugccuguagucccagcuaucuggg

SEQ ID NO: 518437 - RNA, 24 nt, Human
ugccuguagucccagcuauucagg

SEQ ID NO: 518438 - RNA, 24 nt, Human
ugccuguagucccagcuauucggg

SEQ ID NO: 518439 - RNA, 24 nt, Human
ugccuguagucccagcuauucugg

SEQ ID NO: 518440 - RNA, 24 nt, Human
ugccuguagucccagcuccucagg

SEQ ID NO: 518441 - RNA, 24 nt, Human
ugccuguagucccagcuccuuggg

SEQ ID NO: 518442 - RNA, 24 nt, Human
ugccuguagucccagcugcuuggg

SEQ ID NO: 518443 - RNA, 24 nt, Human
ugccuguagucccagguacucagg

SEQ ID NO: 518444 - RNA, 24 nt, Human
ugccuguagucccaguacucagga

SEQ ID NO: 518445 - RNA, 24 nt, Human
ugccuguagucccaguuacucagg

SEQ ID NO: 518446 - RNA, 24 nt, Human
ugccuguagucccaguuacuuggg

SEQ ID NO: 518447 - RNA, 24 nt, Human
ugccuguagucccauguacuuggg

SEQ ID NO: 518448 - RNA, 24 nt, Human
ugccuguagucccgguuacucggg

SEQ ID NO: 518449 - RNA, 24 nt, Human
ugccuguagucccugcuacuuggg

SEQ ID NO: 518450 - RNA, 20 nt, Human
ugccuguaguccuagcuacu

SEQ ID NO: 518451 - RNA, 24 nt, Human
ugccuguaguccuagcuacuuggg

SEQ ID NO: 518452 - RNA, 24 nt, Human
ugccuguaguccuaguuacuuggg

SEQ ID NO: 518453 - RNA, 24 nt, Human
ugccuguagucgcagcuacucaga

SEQ ID NO: 518454 - RNA, 24 nt, Human
ugccuguagucucagcuacucagg

SEQ ID NO: 518455 - RNA, 24 nt, Human
ugccuguagucucagcuacucggg

SEQ ID NO: 518456 - RNA, 24 nt, Human
ugccuguagucucagcuacuuagg

SEQ ID NO: 518457 - RNA, 24 nt, Human
ugccuguagucucagcuacuuggg

SEQ ID NO: 518458 - RNA, 24 nt, Human
ugccuguagugcuagcuacucaga

SEQ ID NO: 518459 - RNA, 23 nt, Human
ugccuguaguucagcuacucagg

SEQ ID NO: 518460 - RNA, 24 nt, Human
ugccuguaguugcagcuacucagg

SEQ ID NO: 518461 - RNA, 24 nt, Human
ugccuguauugccagcuacucgga

SEQ ID NO: 518462 - RNA, 32 nt, Human
ugccugucacaacacaaauaccccucuugaaa

SEQ ID NO: 518463 - RNA, 32 nt, Human
ugccugucacaguccuucagccagggcuggac

SEQ ID NO: 518464 - RNA, 23 nt, Human
ugccugucacccaguucugugga

SEQ ID NO: 518465 - RNA, 32 nt, Human
ugccugucacccaguucuguggaugugcuggu

SEQ ID NO: 518466 - RNA, 32 nt, Human
ugccugucacccuucaucugggacuugcuguc

SEQ ID NO: 518467 - RNA, 32 nt, Human
ugccugucacguggcccugccuauccgccccu

SEQ ID NO: 518468 - RNA, 24 nt, Human
ugccugucacucagcauucccaug

SEQ ID NO: 518469 - RNA, 32 nt, Human
ugccugucacucgagcaagccuggguguuccu

SEQ ID NO: 518470 - RNA, 32 nt, Human
ugccugucagcuccagauucaucaggaccugc

SEQ ID NO: 518471 - RNA, 32 nt, Human
ugccugucagguggucugcaaagaugauaacc

SEQ ID NO: 518472 - RNA, 18 nt, Human
ugccugucauggugcugg

SEQ ID NO: 518473 - RNA, 32 nt, Human
ugccugucauuugaauaaacaguguuucuauu

SEQ ID NO: 518474 - RNA, 32 nt, Human
ugccuguccagccugggcagccaggcugccaa

SEQ ID NO: 518475 - RNA, 32 nt, Human
ugccugucccuccugcugaaguugccuuuccu

SEQ ID NO: 518476 - RNA, 32 nt, Human
ugccugucccugagcuuggccugcuggagcau

SEQ ID NO: 518477 - RNA, 24 nt, Human
ugccuguccugcagaguccccaug

SEQ ID NO: 518478 - RNA, 31 nt, Human
ugccuguccugccucuggccuguguccuggg

SEQ ID NO: 518479 - RNA, 32 nt, Human
ugccuguccugggaaaguaucuuugccccacu

SEQ ID NO: 518480 - RNA, 32 nt, Human
ugccugucucacaggccugcugugaaggcuga

SEQ ID NO: 518481 - RNA, 21 nt, Human
ugccugucucagacucuuggg

SEQ ID NO: 518482 - RNA, 32 nt, Human
ugccugucucaucuaacgccccaaaccuucau

SEQ ID NO: 518483 - RNA, 32 nt, Human
ugccugucucccuccagcacugccgagguucu

SEQ ID NO: 518484 - RNA, 32 nt, Human
ugccugucuccucccuccuacacauuuccagc

SEQ ID NO: 518485 - RNA, 19 nt, Human
ugccugucucggccuccca

SEQ ID NO: 518486 - RNA, 32 nt, Human
ugccugucucugcuuccgacuuugucuucuuu

SEQ ID NO: 518487 - RNA, 32 nt, Human
ugccugucugcgccucucacacacagauaagu

SEQ ID NO: 518488 - RNA, 32 nt, Human
ugccugucugggaaaaggucacuggaccugga

SEQ ID NO: 518489 - RNA, 20 nt, Human
ugccugucugugccugggag

SEQ ID NO: 518490 - RNA, 32 nt, Human
ugccugucuuugggugcugcaguucaguagga

SEQ ID NO: 518491 - RNA, 32 nt, Human
ugccugucuuugggugcuguaguucgguagga

SEQ ID NO: 518492 - RNA, 20 nt, Human
ugccugugaacugaacucug

SEQ ID NO: 518493 - RNA, 32 nt, Human
ugccugugaagugccugcagcccacgccucug

SEQ ID NO: 518494 - RNA, 32 nt, Human
ugccugugacaugcagguucugggcccacucu

SEQ ID NO: 518495 - RNA, 32 nt, Human
ugccugugagaauuggagguuagugccugaag

SEQ ID NO: 518496 - RNA, 32 nt, Human
ugccugugagucgucuucacacaugcuguuuu

SEQ ID NO: 518497 - RNA, 32 nt, Human
ugccugugcagaagguggagguggcaggcgga

SEQ ID NO: 518498 - RNA, 32 nt, Human
ugccugugcagcgggugcugcugguaacagug

SEQ ID NO: 518499 - RNA, 32 nt, Human
ugccugugcagcuguauuuagggcugcguucc

SEQ ID NO: 518500 - RNA, 32 nt, Human
ugccugugccauucuuccucugggccuucaug

SEQ ID NO: 518501 - RNA, 22 nt, Human
ugccugugcccacucugugccu

SEQ ID NO: 518502 - RNA, 32 nt, Human
ugccugugcccacucugugccugcugggagga

SEQ ID NO: 518503 - RNA, 32 nt, Human
ugccugugcccucuggaaaaauuuccuccuag

SEQ ID NO: 518504 - RNA, 32 nt, Human
ugccugugcuugcugugagucuuuguggacag

SEQ ID NO: 518505 - RNA, 32 nt, Human
ugccuguggagacagcccugccuauccucugu

SEQ ID NO: 518506 - RNA, 32 nt, Human
ugccuguggagaugcacaguucuaccauucaa

SEQ ID NO: 518507 - RNA, 32 nt, Human
ugccuguggaggucgccucuccccaggggagc

SEQ ID NO: 518508 - RNA, 32 nt, Human
ugccuguggccagacacacgguggagggaagu

SEQ ID NO: 518509 - RNA, 32 nt, Human
ugccuguggccugucuguccuccucccuaauu

SEQ ID NO: 518510 - RNA, 22 nt, Human
ugccugugggaagcagcucucc

SEQ ID NO: 518511 - RNA, 24 nt, Human
ugccuguggucccagcuacucaga

SEQ ID NO: 518512 - RNA, 24 nt, Human
ugccuguggucccagcuacuugga

SEQ ID NO: 518513 - RNA, 32 nt, Human
ugccuguggucccggcugcucgggaggcugag

SEQ ID NO: 518514 - RNA, 32 nt, Human
ugccugugucagacauggauugcagugcuccc

SEQ ID NO: 518515 - RNA, 32 nt, Human
ugccuguguccucaggguggggcagguuggca

SEQ ID NO: 518516 - RNA, 18 nt, Human
ugccugugucucucccca

SEQ ID NO: 518517 - RNA, 32 nt, Human
ugccugugugcagccuccugugccucacccag

SEQ ID NO: 518518 - RNA, 32 nt, Human
ugccugugugccuccauuggcaucucugccug

SEQ ID NO: 518519 - RNA, 32 nt, Human
ugccuguguggaauauguguguguggguuugc

SEQ ID NO: 518520 - RNA, 32 nt, Human
ugccugugugggaacagcucuucucccagaug

SEQ ID NO: 518521 - RNA, 22 nt, Human
ugccuguguguaaacuugggga

SEQ ID NO: 518522 - RNA, 32 nt, Human
ugccuguguguccagcccuggagccagccagu

SEQ ID NO: 518523 - RNA, 32 nt, Human
ugccugugugugugcaagugugcagguuccuu

SEQ ID NO: 518524 - RNA, 32 nt, Human
ugccugugugugugcacucgugucgcgccuuc

SEQ ID NO: 518525 - RNA, 32 nt, Human
ugccugugugugugggugcacauuugugugug

SEQ ID NO: 518526 - RNA, 32 nt, Human
ugccuguguugcccaccuguucacaaaaagua

SEQ ID NO: 518527 - RNA, 32 nt, Human
ugccuguuaauuuauaauguauuugaaaauua

SEQ ID NO: 518528 - RNA, 32 nt, Human
ugccuguuaccaggugcugcuucuucagauga

SEQ ID NO: 518529 - RNA, 32 nt, Human
ugccuguucaucugcugacuucugucuaggcu

SEQ ID NO: 518530 - RNA, 32 nt, Human
ugccuguuccagcccaggcagagaucaggugg

SEQ ID NO: 518531 - RNA, 32 nt, Human
ugccuguucuggacuguguucugggccugcug

SEQ ID NO: 518532 - RNA, 32 nt, Human
ugccuguugacagaugugugucuguccucagg

SEQ ID NO: 518533 - RNA, 32 nt, Human
ugccuguugcagcuguggccacugccucccgg

SEQ ID NO: 518534 - RNA, 32 nt, Human
ugccuguugccagacuggagugcaguggcacg

SEQ ID NO: 518535 - RNA, 32 nt, Human
ugccuguuggcagcccacuccccagccccagc

SEQ ID NO: 518536 - RNA, 32 nt, Human
ugccuguuggguggccuggccuggaggcgggg

SEQ ID NO: 518537 - RNA, 32 nt, Human
ugccuguuguagccccagcuacucaagaggcu

SEQ ID NO: 518538 - RNA, 22 nt, Human
ugccuguuuaaaacugauccua

SEQ ID NO: 518539 - RNA, 20 nt, Human
ugccuguuuaaaucucccug

SEQ ID NO: 518540 - RNA, 19 nt, Human
ugccuguuuaacauuucua

SEQ ID NO: 518541 - RNA, 18 nt, Human
ugccuguuuauggauccu

SEQ ID NO: 518542 - RNA, 21 nt, Human
ugccuguuuauuuaugaccua

SEQ ID NO: 518543 - RNA, 23 nt, Human
ugccuguuuccuggcuuccaaug

SEQ ID NO: 518544 - RNA, 32 nt, Human
ugccuguuucuuuccagugccugcuucugggg

SEQ ID NO: 518545 - RNA, 32 nt, Human
ugccuguuuuaccuuaaaugacaggaaaggaa

SEQ ID NO: 518546 - RNA, 19 nt, Human
ugccuguuuucuuauccua

SEQ ID NO: 518547 - RNA, 32 nt, Human
ugccuguuuuggccauuagcugccuuaaacgu

SEQ ID NO: 518548 - RNA, 32 nt, Human
ugccuuaaaaaugucacuucaagucuacuuuu

SEQ ID NO: 518549 - RNA, 32 nt, Human
ugccuuaaauagccucucuccccauuuaggag

SEQ ID NO: 518550 - RNA, 32 nt, Human
ugccuuaacaguacuauuuucucgccaccaaa

SEQ ID NO: 518551 - RNA, 32 nt, Human
ugccuuaacucauagacaucaaucagagagug

SEQ ID NO: 518552 - RNA, 32 nt, Human
ugccuuaacugacguagcuccuaagugauguu

SEQ ID NO: 518553 - RNA, 32 nt, Human
ugccuuaacuuagcagugaaugacaacuguca

SEQ ID NO: 518554 - RNA, 19 nt, Human
ugccuuaaggaaaagguua

SEQ ID NO: 518555 - RNA, 32 nt, Human
ugccuuaaguaggaagagagggaaggacacca

SEQ ID NO: 518556 - RNA, 32 nt, Human
ugccuuaauuguuuaaaaucucuggcuucaaa

SEQ ID NO: 518557 - RNA, 32 nt, Human
ugccuuacagaccuaccucaaacacacuguuu

SEQ ID NO: 518558 - RNA, 32 nt, Human
ugccuuacagggaaauagccuggggugucugg

SEQ ID NO: 518559 - RNA, 32 nt, Human
ugccuuacccaccaucaugguauuccacacag

SEQ ID NO: 518560 - RNA, 32 nt, Human
ugccuuaccugacugggggcucugaguccagu

SEQ ID NO: 518561 - RNA, 32 nt, Human
ugccuuaccuuucuuugguuucccaagagcua

SEQ ID NO: 518562 - RNA, 32 nt, Human
ugccuuacgcuacaucuuguuuucuaggaaga

SEQ ID NO: 518563 - RNA, 32 nt, Human
ugccuuagaaaugcacauucuguauuuugugg

SEQ ID NO: 518564 - RNA, 31 nt, Human
ugccuuagacuucucccgacccccagagcgc

SEQ ID NO: 518565 - RNA, 32 nt, Human
ugccuuagagagagcgcgcucugcucccugcc

SEQ ID NO: 518566 - RNA, 32 nt, Human
ugccuuagagccaccagcccugucccaggcca

SEQ ID NO: 518567 - RNA, 19 nt, Human
ugccuuagauuccucaaua

SEQ ID NO: 518568 - RNA, 32 nt, Human
ugccuuagccuccugaguagcuggaauuauag

SEQ ID NO: 518569 - RNA, 32 nt, Human
ugccuuagccuccugaguagcugggauuacag

SEQ ID NO: 518570 - RNA, 32 nt, Human
ugccuuaggaacagccuucccccaccagcagc

SEQ ID NO: 518571 - RNA, 32 nt, Human
ugccuuaggauggggccaggaggccaggcacu

SEQ ID NO: 518572 - RNA, 31 nt, Human
ugccuuaggcacuauuccuuauauaacaaaa

SEQ ID NO: 518573 - RNA, 32 nt, Human
ugccuuaggugccuucugcucucuggaaccag

SEQ ID NO: 518574 - RNA, 32 nt, Human
ugccuuauacugggaaugccucaggcuugcuc

SEQ ID NO: 518575 - RNA, 32 nt, Human
ugccuuauccuucuguuuguucauacacuuag

SEQ ID NO: 518576 - RNA, 32 nt, Human
ugccuuaucgccaagcuccuucaggagaacaa

SEQ ID NO: 518577 - RNA, 32 nt, Human
ugccuuaucugugucacugucacuuuagcaaa

SEQ ID NO: 518578 - RNA, 32 nt, Human
ugccuuauggccagcauauucucuuacaaggg

SEQ ID NO: 518579 - RNA, 32 nt, Human
ugccuucaaaguguaaguucucaugucauuau

SEQ ID NO: 518580 - RNA, 32 nt, Human
ugccuucaacacagcuugucucuugccugcca

SEQ ID NO: 518581 - RNA, 32 nt, Human
ugccuucaauaugaguuucauuuccucugugu

SEQ ID NO: 518582 - RNA, 32 nt, Human
ugccuucacagcaacaccuagauuagcauuca

SEQ ID NO: 518583 - RNA, 32 nt, Human
ugccuucaccguguccaugccugcuccggcag

SEQ ID NO: 518584 - RNA, 32 nt, Human
ugccuucacugaaauauaccucaggcugaaau

SEQ ID NO: 518585 - RNA, 32 nt, Human
ugccuucacugaaauauaccucaggcugagau

SEQ ID NO: 518586 - RNA, 32 nt, Human
ugccuucacugaaggcugcagugcuguucuga

SEQ ID NO: 518587 - RNA, 32 nt, Human
ugccuucacugccuggugauccuccaucaacc

SEQ ID NO: 518588 - RNA, 32 nt, Human
ugccuucacugugcuccaaccugaaggucccc

SEQ ID NO: 518589 - RNA, 32 nt, Human
ugccuucagaaaccugagcuucagcggccaac

SEQ ID NO: 518590 - RNA, 32 nt, Human
ugccuucagagcagguccugccagccucgcug

SEQ ID NO: 518591 - RNA, 22 nt, Human
ugccuucaggaccuucugguac

SEQ ID NO: 518592 - RNA, 32 nt, Human
ugccuucaggccacagucgugcugcuagaaca

SEQ ID NO: 518593 - RNA, 32 nt, Human
ugccuucaucccucauuuccucccucucauuc

SEQ ID NO: 518594 - RNA, 29 nt, Human
ugccuucaucugugugugcuugggccagc

SEQ ID NO: 518595 - RNA, 32 nt, Human
ugccuucaugaagaaaagacagaggcagaaag

SEQ ID NO: 518596 - RNA, 32 nt, Human
ugccuuccaccaugcuugugagaucuucccag

SEQ ID NO: 518597 - RNA, 32 nt, Human
ugccuucccacacaccccuuuccuccuguucc

SEQ ID NO: 518598 - RNA, 32 nt, Human
ugccuucccacacacucacuauccagaaaaga

SEQ ID NO: 518599 - RNA, 32 nt, Human
ugccuucccagccccuccuucucccucccucc

SEQ ID NO: 518600 - RNA, 23 nt, Human
ugccuucccaggccagcugcuca

SEQ ID NO: 518601 - RNA, 23 nt, Human
ugccuuccccacuccuguguccu

SEQ ID NO: 518602 - RNA, 18 nt, Human
ugccuuccccacuucuca

SEQ ID NO: 518603 - RNA, 32 nt, Human
ugccuuccccaugucucuccucuccuuggccg

SEQ ID NO: 518604 - RNA, 32 nt, Human
ugccuucccccggaugcugggcccugcugcuc

SEQ ID NO: 518605 - RNA, 32 nt, Human
ugccuucccccuucucccuugaagacccucau

SEQ ID NO: 518606 - RNA, 32 nt, Human
ugccuuccccuauguguauacacacauacaug

SEQ ID NO: 518607 - RNA, 32 nt, Human
ugccuuccccucagccucuccccacaccaccc

SEQ ID NO: 518608 - RNA, 32 nt, Human
ugccuucccgcugccauuucuacucgucagga

SEQ ID NO: 518609 - RNA, 32 nt, Human
ugccuucccuaccucuuccucccagaguccuc

SEQ ID NO: 518610 - RNA, 32 nt, Human
ugccuucccucccagggaggccccuucagaga

SEQ ID NO: 518611 - RNA, 32 nt, Human
ugccuucccugagacugucucuucuccuguga

SEQ ID NO: 518612 - RNA, 23 nt, Human
ugccuuccgaguagcugugauca

SEQ ID NO: 518613 - RNA, 32 nt, Human
ugccuuccgggaacuguggugcugcuuucugu

SEQ ID NO: 518614 - RNA, 32 nt, Human
ugccuuccuaagauugcugguauucuagcucu

SEQ ID NO: 518615 - RNA, 32 nt, Human
ugccuuccuagaguuggguugucacuguccug

SEQ ID NO: 518616 - RNA, 32 nt, Human
ugccuuccucaccaccuagccauagucucaaa

SEQ ID NO: 518617 - RNA, 32 nt, Human
ugccuuccucccuucuuccucuuggagucccc

SEQ ID NO: 518618 - RNA, 32 nt, Human
ugccuuccuuucucaucccauggggcccugug

SEQ ID NO: 518619 - RNA, 32 nt, Human
ugccuuccuuucucccaaucuccauucccaaa

SEQ ID NO: 518620 - RNA, 32 nt, Human
ugccuuccuuucucuacccccucgcuguugug

SEQ ID NO: 518621 - RNA, 32 nt, Human
ugccuuccuuuuccucuucucucuuugccugg

SEQ ID NO: 518622 - RNA, 32 nt, Human
ugccuucgaaacugagccgugaggaacuauac

SEQ ID NO: 518623 - RNA, 32 nt, Human
ugccuucggcgcgcuucucagcagggccgccg

SEQ ID NO: 518624 - RNA, 32 nt, Human
ugccuucguccgggccccuccugggccucccc

SEQ ID NO: 518625 - RNA, 32 nt, Human
ugccuucuaagccgggcugggaauggggacac

SEQ ID NO: 518626 - RNA, 32 nt, Human
ugccuucuagccguccuccaccuugcagaaag

SEQ ID NO: 518627 - RNA, 32 nt, Human
ugccuucucaaggaguccacagucuggaggac

SEQ ID NO: 518628 - RNA, 32 nt, Human
ugccuucucauguugccccuccaucuucaagc

SEQ ID NO: 518629 - RNA, 32 nt, Human
ugccuucuccaccagggucgcuccaucaccca

SEQ ID NO: 518630 - RNA, 32 nt, Human
ugccuucuccaccugcccucccacucuuccag

SEQ ID NO: 518631 - RNA, 32 nt, Human
ugccuucuccaccuuccccuccuuuggcucug

SEQ ID NO: 518632 - RNA, 31 nt, Human
ugccuucuccucucugggccuuuguuuccuu

SEQ ID NO: 518633 - RNA, 32 nt, Human
ugccuucucuccacuuuucacagucuucucau

SEQ ID NO: 518634 - RNA, 32 nt, Human
ugccuucucuccccugucauuuccagauuuca

SEQ ID NO: 518635 - RNA, 32 nt, Human
ugccuucucugcugggagcucuuuggagagga

SEQ ID NO: 518636 - RNA, 32 nt, Human
ugccuucucuggggccucccacaugcccucuu

SEQ ID NO: 518637 - RNA, 32 nt, Human
ugccuucugaccaaccucuccccaucguugcc

SEQ ID NO: 518638 - RNA, 32 nt, Human
ugccuucugagcggagucuccuuagcuuuggg

SEQ ID NO: 518639 - RNA, 32 nt, Human
ugccuucugccaccucugccucaggagcagau

SEQ ID NO: 518640 - RNA, 31 nt, Human
ugccuucugggcuggggaugggugagcaaag

SEQ ID NO: 518641 - RNA, 21 nt, Human
ugccuucuguccuccauggug

SEQ ID NO: 518642 - RNA, 32 nt, Human
ugccuucugucugccucgccuguucucuccag

SEQ ID NO: 518643 - RNA, 32 nt, Human
ugccuucuguucgggcccuccuuuggugggaa

SEQ ID NO: 518644 - RNA, 32 nt, Human
ugccuucuucucuggcuuccucuccuucuggu

SEQ ID NO: 518645 - RNA, 32 nt, Human
ugccuucuucuucauuuaucccaguacgagca

SEQ ID NO: 518646 - RNA, 32 nt, Human
ugccuucuuuucucccuuuuaauccuggcugu

SEQ ID NO: 518647 - RNA, 32 nt, Human
ugccuucuuuucuuccagaggauuucucucuc

SEQ ID NO: 518648 - RNA, 32 nt, Human
ugccuugaacaucaugguuccuuuggugaucu

SEQ ID NO: 518649 - RNA, 32 nt, Human
ugccuugacuguggcgaugauuacaugaaaac

SEQ ID NO: 518650 - RNA, 32 nt, Human
ugccuugagaucugugguggucuucaaaaugg

SEQ ID NO: 518651 - RNA, 32 nt, Human
ugccuugagcuugagagguugaagcugcagug

SEQ ID NO: 518652 - RNA, 32 nt, Human
ugccuugaggggcagcuguggccuaggcuacc

SEQ ID NO: 518653 - RNA, 32 nt, Human
ugccuugaguagcugggacuucaggugcacgc

SEQ ID NO: 518654 - RNA, 32 nt, Human
ugccuugagucugaggcauccucugccugcuu

SEQ ID NO: 518655 - RNA, 32 nt, Human
ugccuugauucugacauuuggcccagccugua

SEQ ID NO: 518656 - RNA, 32 nt, Human
ugccuugcaaauugcugccugggugaaugcug

SEQ ID NO: 518657 - RNA, 32 nt, Human
ugccuugcacuccaugcauucugauaacggca

SEQ ID NO: 518658 - RNA, 32 nt, Human
ugccuugcagagccugaagccuggggagaagg

SEQ ID NO: 518659 - RNA, 32 nt, Human
ugccuugcagagccuggagccggaaagagcac

SEQ ID NO: 518660 - RNA, 32 nt, Human
ugccuugccagccugcucuccauugccuuggc

SEQ ID NO: 518661 - RNA, 32 nt, Human
ugccuugccuggugcuuccucccucauugugu

SEQ ID NO: 518662 - RNA, 32 nt, Human
ugccuugccuuggugugaaaccucggggcucc

SEQ ID NO: 518663 - RNA, 18 nt, Human
ugccuugcuuccuccagg

SEQ ID NO: 518664 - RNA, 32 nt, Human
ugccuugcuuucucuucuuacugucccacagc

SEQ ID NO: 518665 - RNA, 32 nt, Human
ugccuuggaagggaagucaggcucacuuggac

SEQ ID NO: 518666 - RNA, 32 nt, Human
ugccuuggacucucccccaccgggcuccuuuu

SEQ ID NO: 518667 - RNA, 32 nt, Human
ugccuuggagagagcagacacugugggggcca

SEQ ID NO: 518668 - RNA, 32 nt, Human
ugccuuggagcagaaagccaggguccugagug

SEQ ID NO: 518669 - RNA, 32 nt, Human
ugccuuggagcagagcaccaaaugucugcccu

SEQ ID NO: 518670 - RNA, 32 nt, Human
ugccuuggagcccugcauccacgucuuguaac

SEQ ID NO: 518671 - RNA, 32 nt, Human
ugccuuggaggucaaaacugcagugagccaug

SEQ ID NO: 518672 - RNA, 22 nt, Human
ugccuuggccucccaaaaugcu

SEQ ID NO: 518673 - RNA, 32 nt, Human
ugccuuggcuguuuaucccacugccuuggaag

SEQ ID NO: 518674 - RNA, 20 nt, Human
ugccuugggaaaugauccua

SEQ ID NO: 518675 - RNA, 32 nt, Human
ugccuugggaauguuauagugugaacuaccuu

SEQ ID NO: 518676 - RNA, 32 nt, Human
ugccuugggacccguccucucacccccagcag

SEQ ID NO: 518677 - RNA, 32 nt, Human
ugccuugggcagucccagcuccacacugcccu

SEQ ID NO: 518678 - RNA, 32 nt, Human
ugccuugggccuuucaugccccggcugcacac

SEQ ID NO: 518679 - RNA, 32 nt, Human
ugccuugguaacuuucagauuccuguggaauu

SEQ ID NO: 518680 - RNA, 32 nt, Human
ugccuugguaaucccuuagauaauguggaaac

SEQ ID NO: 518681 - RNA, 32 nt, Human
ugccuuggugcugugccucaggcuccuuccug

SEQ ID NO: 518682 - RNA, 32 nt, Human
ugccuugguuaggaaauguuuugggggauauc

SEQ ID NO: 518683 - RNA, 32 nt, Human
ugccuuguaacugcucagacccuggccagaag

SEQ ID NO: 518684 - RNA, 32 nt, Human
ugccuuguaagugucaggccuccugggcgcuc

SEQ ID NO: 518685 - RNA, 32 nt, Human
ugccuuguccccagcaggcugaggaauuacca

SEQ ID NO: 518686 - RNA, 32 nt, Human
ugccuugugagagauugagacacucuaaauaa

SEQ ID NO: 518687 - RNA, 32 nt, Human
ugccuugugccuggcacucugccggugccuug

SEQ ID NO: 518688 - RNA, 32 nt, Human
ugccuuguggaaacaggaaguccaagugauuc

SEQ ID NO: 518689 - RNA, 32 nt, Human
ugccuuguggagccacggccucccgggacgga

SEQ ID NO: 518690 - RNA, 32 nt, Human
ugccuuguggugagauauaaauuauggccaug

SEQ ID NO: 518691 - RNA, 32 nt, Human
ugccuugugguuuuggccagccuugugcuaug

SEQ ID NO: 518692 - RNA, 32 nt, Human
ugccuuguuucaaaucaugugcuggcuguuuu

SEQ ID NO: 518693 - RNA, 32 nt, Human
ugccuuuacaauaccuuuaauuuauuaggauc

SEQ ID NO: 518694 - RNA, 23 nt, Human
ugccuuuacugauccguuugcug

SEQ ID NO: 518695 - RNA, 32 nt, Human
ugccuuuaguuacagguccugccuuauuuuca

SEQ ID NO: 518696 - RNA, 16 nt, Human
ugccuuuaucucccca

SEQ ID NO: 518697 - RNA, 19 nt, Human
ugccuuuaugaaaccuuug

SEQ ID NO: 518698 - RNA, 32 nt, Human
ugccuuucaccauuuucuccccacuuccagug

SEQ ID NO: 518699 - RNA, 32 nt, Human
ugccuuucaccuucugccaugacugugaggcc

SEQ ID NO: 518700 - RNA, 32 nt, Human
ugccuuucaguaggaggaggcugugaaauagu

SEQ ID NO: 518701 - RNA, 32 nt, Human
ugccuuuccaccauaggcuuguucacaugcac

SEQ ID NO: 518702 - RNA, 32 nt, Human
ugccuuuccaccugcuuucuccugggcccgcu

SEQ ID NO: 518703 - RNA, 32 nt, Human
ugccuuuccagacucuuaccacugccuguuga

SEQ ID NO: 518704 - RNA, 28 nt, Human
ugccuuuccagugcugcucccuuuauca

SEQ ID NO: 518705 - RNA, 32 nt, Human
ugccuuucccacuccaccuucuacaguugcuu

SEQ ID NO: 518706 - RNA, 32 nt, Human
ugccuuuccuccuucuggaaucguguccaucc

SEQ ID NO: 518707 - RNA, 32 nt, Human
ugccuuuccucuggcccugcugcccccacacc

SEQ ID NO: 518708 - RNA, 32 nt, Human
ugccuuuccucuuccuccuccuccuccuuggc

SEQ ID NO: 518709 - RNA, 32 nt, Human
ugccuuuccuugucugccuccugcugcuucug

SEQ ID NO: 518710 - RNA, 32 nt, Human
ugccuuucgcaauaauguauccauuccccuga

SEQ ID NO: 518711 - RNA, 32 nt, Human
ugccuuucuacguucucuuucuuccaagccua

SEQ ID NO: 518712 - RNA, 32 nt, Human
ugccuuucuccccucagcaccuucaucucugc

SEQ ID NO: 518713 - RNA, 32 nt, Human
ugccuuucugucuugcuuccagggggcugguu

SEQ ID NO: 518714 - RNA, 32 nt, Human
ugccuuugacaccucugcauauguuuuaauga

SEQ ID NO: 518715 - RNA, 32 nt, Human
ugccuuugcacuccagcguggaagacagugag

SEQ ID NO: 518716 - RNA, 32 nt, Human
ugccuuugcagugcuuucggcccaguucuggc

SEQ ID NO: 518717 - RNA, 32 nt, Human
ugccuuugccguggcccuguccuguuuaguuc

SEQ ID NO: 518718 - RNA, 29 nt, Human
ugccuuugccuguguguguucugggggag

SEQ ID NO: 518719 - RNA, 32 nt, Human
ugccuuugcuccaugccuuuuccaugagcaug

SEQ ID NO: 518720 - RNA, 32 nt, Human
ugccuuugcuucugcauuuccuccuugagugc

SEQ ID NO: 518721 - RNA, 32 nt, Human
ugccuuuggaagggucucucuccaggucagcc

SEQ ID NO: 518722 - RNA, 32 nt, Human
ugccuuuggacugcucugacuuuagcaucagc

SEQ ID NO: 518723 - RNA, 32 nt, Human
ugccuuuggcuuccuguugacuucuucccgac

SEQ ID NO: 518724 - RNA, 23 nt, Human
ugccuuuggggcuccugggcuca

SEQ ID NO: 518725 - RNA, 32 nt, Human
ugccuuuguagugcuuucggcccaguucuggc

SEQ ID NO: 518726 - RNA, 32 nt, Human
ugccuuuguccucauccaaagcauuuugugcc

SEQ ID NO: 518727 - RNA, 32 nt, Human
ugccuuugucggcagaauugguacuuaaccuu

SEQ ID NO: 518728 - RNA, 32 nt, Human
ugccuuuguugaguaaaaauguuaauauagcu

SEQ ID NO: 518729 - RNA, 20 nt, Human
ugccuuuguuggaguccgca

SEQ ID NO: 518730 - RNA, 32 nt, Human
ugccuuuuaagccauaaagauaccucaagccu

SEQ ID NO: 518731 - RNA, 32 nt, Human
ugccuuuuccaucaauuuuagcauggaaaaau

SEQ ID NO: 518732 - RNA, 32 nt, Human
ugccuuuuccuccuccucacagaggagaugug

SEQ ID NO: 518733 - RNA, 32 nt, Human
ugccuuuucugccauuuuaauuuuccauuuaa

SEQ ID NO: 518734 - RNA, 32 nt, Human
ugccuuuucuuucuguggauccaguaucuucc

SEQ ID NO: 518735 - RNA, 32 nt, Human
ugccuuuugcugcaauagaagaugagcaaagg

SEQ ID NO: 518736 - RNA, 32 nt, Human
ugccuuuugcugguguuucuggaauuugcuuu

SEQ ID NO: 518737 - RNA, 32 nt, Human
ugccuuuuucugugcuuugaaaacuugauaug

SEQ ID NO: 518738 - RNA, 32 nt, Human
ugccuuuuugggacucagauggcaggaggucc

SEQ ID NO: 518739 - RNA, 32 nt, Human
ugccuuuuugggaggcagcccugcagacaugg

SEQ ID NO: 518740 - RNA, 32 nt, Human
ugcgaacagcagagcaggcaagggaaacuggg

SEQ ID NO: 518741 - RNA, 32 nt, Human
ugcgaacagccauugcacuccagccugggcaa

SEQ ID NO: 518742 - RNA, 32 nt, Human
ugcgaacccgggaggcggagcuugcagugagc

SEQ ID NO: 518743 - RNA, 32 nt, Human
ugcgaaccggcuggaaagaaacaccgagucac

SEQ ID NO: 518744 - RNA, 32 nt, Human
ugcgaaccucauucugacugugaacuaagcaa

SEQ ID NO: 518745 - RNA, 24 nt, Human
ugcgaacggaggaggaacugugau

SEQ ID NO: 518746 - RNA, 32 nt, Human
ugcgaagaugggcgaggacagagcagggcccg

SEQ ID NO: 518747 - RNA, 32 nt, Human
ugcgaaggagaagccgccgcagaggaaaagca

SEQ ID NO: 518748 - RNA, 32 nt, Human
ugcgaauagccacugcacuccagccugggcaa

SEQ ID NO: 518749 - RNA, 32 nt, Human
ugcgaaucccuccugagggagaugcuugaagg

SEQ ID NO: 518750 - RNA, 32 nt, Human
ugcgaaucuguguuaagaaucuagucuuugua

SEQ ID NO: 518751 - RNA, 32 nt, Human
ugcgaauuucgaagaggagguggcaaaguggg

SEQ ID NO: 518752 - RNA, 32 nt, Human
ugcgacagagucucaaucugucacccaggcug

SEQ ID NO: 518753 - RNA, 32 nt, Human
ugcgacagagucuugcucugucgccaagccag

SEQ ID NO: 518754 - RNA, 32 nt, Human
ugcgacagccuggguaagagguguaggucggc

SEQ ID NO: 518755 - RNA, 32 nt, Human
ugcgacagugugacccugggcucuggcgggca

SEQ ID NO: 518756 - RNA, 32 nt, Human
ugcgaccaccuugccgcuuuucaucacaagcu

SEQ ID NO: 518757 - RNA, 32 nt, Human
ugcgaccagagcaugaugccuccaucaagugg

SEQ ID NO: 518758 - RNA, 32 nt, Human
ugcgaccccugccccgacccgggcugccaucu

SEQ ID NO: 518759 - RNA, 32 nt, Human
ugcgacccuccagggaugcaggggauccagga

SEQ ID NO: 518760 - RNA, 32 nt, Human
ugcgacccuccccgcuugugucccuucuccug

SEQ ID NO: 518761 - RNA, 32 nt, Human
ugcgacccugggggcacaggaggcaggcaugg

SEQ ID NO: 518762 - RNA, 24 nt, Human
ugcgaccuccaccuccuggguuca

SEQ ID NO: 518763 - RNA, 32 nt, Human
ugcgaccuggcugagcuccugccuccugucgg

SEQ ID NO: 518764 - RNA, 32 nt, Human
ugcgaccuugcaaccucaccuuccugugggug

SEQ ID NO: 518765 - RNA, 32 nt, Human
ugcgacgcacuccuggccaucuugccguguca

SEQ ID NO: 518766 - RNA, 32 nt, Human
ugcgacgccccuccuucucuuaagccuuucca

SEQ ID NO: 518767 - RNA, 18 nt, Human
ugcgacggugucuggugu

SEQ ID NO: 518768 - RNA, 32 nt, Human
ugcgacgugagucugagucugaucccuccgaa

SEQ ID NO: 518769 - RNA, 32 nt, Human
ugcgacugcacuccagccugggugacugagca

SEQ ID NO: 518770 - RNA, 32 nt, Human
ugcgacuucucccaaggcccugcucagcauag

SEQ ID NO: 518771 - RNA, 32 nt, Human
ugcgacuucuucccucgcuccuccuggucaug

SEQ ID NO: 518772 - RNA, 32 nt, Human
ugcgagaaauggaugguggaaggguggcgaau

SEQ ID NO: 518773 - RNA, 32 nt, Human
ugcgagaaggcagaggaggagggagggaggga

SEQ ID NO: 518774 - RNA, 32 nt, Human
ugcgagaaggugagacacacucagagucagag

SEQ ID NO: 518775 - RNA, 32 nt, Human
ugcgagaaucgagcgcagccugugcugguugu

SEQ ID NO: 518776 - RNA, 32 nt, Human
ugcgagacagagagcuacuuauucucugcuuu

SEQ ID NO: 518777 - RNA, 32 nt, Human
ugcgagacucacugcagugucaagaucaccuu

SEQ ID NO: 518778 - RNA, 32 nt, Human
ugcgagcaccagcucccuucuccucgccacuc

SEQ ID NO: 518779 - RNA, 32 nt, Human
ugcgagcagagcuggguuuaaugagcauuuaa

SEQ ID NO: 518780 - RNA, 32 nt, Human
ugcgagcaugccacuguacuccagccugagcu

SEQ ID NO: 518781 - RNA, 32 nt, Human
ugcgagccagcagaggccuccacccagugcug

SEQ ID NO: 518782 - RNA, 32 nt, Human
ugcgagcccagcccuggugccucaugggaugg

SEQ ID NO: 518783 - RNA, 20 nt, Human
ugcgagcccagcuccuacca

SEQ ID NO: 518784 - RNA, 32 nt, Human
ugcgagcccuccugggcucuggggacuggccg

SEQ ID NO: 518785 - RNA, 32 nt, Human
ugcgagccugcacucacuucauccucagcaga

SEQ ID NO: 518786 - RNA, 32 nt, Human
ugcgagcgcacacacaugcacaagugcgaagg

SEQ ID NO: 518787 - RNA, 22 nt, Human
ugcgagcgcccccgccccggcc

SEQ ID NO: 518788 - RNA, 32 nt, Human
ugcgagcgggcucucugugcuuccugccuucu

SEQ ID NO: 518789 - RNA, 32 nt, Human
ugcgagcucagccuuccucccauccucaaccc

SEQ ID NO: 518790 - RNA, 23 nt, Human
ugcgagcuggcggggcgcgcgga

SEQ ID NO: 518791 - RNA, 21 nt, Human
ugcgagcugggccagggaaga

SEQ ID NO: 518792 - RNA, 32 nt, Human
ugcgagcugggccguguguaugugagugccga

SEQ ID NO: 518793 - RNA, 32 nt, Human
ugcgaggaaagccguuuccuggaacaucggaa

SEQ ID NO: 518794 - RNA, 32 nt, Human
ugcgaggaauagguggggcaucaggaagaagc

SEQ ID NO: 518795 - RNA, 32 nt, Human
ugcgaggagaagaagagagagcccagggcuca

SEQ ID NO: 518796 - RNA, 23 nt, Human
ugcgaggagccuuucauccgaag

SEQ ID NO: 518797 - RNA, 32 nt, Human
ugcgaggcacccaccagcaucauuccccgugc

SEQ ID NO: 518798 - RNA, 32 nt, Human
ugcgaggccacagcccugggaggggguccuga

SEQ ID NO: 518799 - RNA, 32 nt, Human
ugcgaggccuacccuuucucccgucucagggc

SEQ ID NO: 518800 - RNA, 32 nt, Human
ugcgaggccucuggacaguucauccaucaggc

SEQ ID NO: 518801 - RNA, 32 nt, Human
ugcgaggccugggagcaccguggccccuccug

SEQ ID NO: 518802 - RNA, 32 nt, Human
ugcgaggcgcgcccuggagcugcuagagaucc

SEQ ID NO: 518803 - RNA, 32 nt, Human
ugcgaggcggcggucagcaggugccgaaccca

SEQ ID NO: 518804 - RNA, 32 nt, Human
ugcgaggcuagaugguaacacacagaaagcuc

SEQ ID NO: 518805 - RNA, 32 nt, Human
ugcgaggcucaagcgauccucccgccuuagcc

SEQ ID NO: 518806 - RNA, 21 nt, Human
ugcgagggaaaggccaguggc

SEQ ID NO: 518807 - RNA, 32 nt, Human
ugcgagggagagagaggacaccgaagccggga

SEQ ID NO: 518808 - RNA, 32 nt, Human
ugcgagggaggaacgggccgcuccccgccagc

SEQ ID NO: 518809 - RNA, 32 nt, Human
ugcgagggugcacggccggcccugggcaggcg

SEQ ID NO: 518810 - RNA, 32 nt, Human
ugcgagguaggaggggagcacuggcagggaga

SEQ ID NO: 518811 - RNA, 32 nt, Human
ugcgaggucagggcauuucucuacaaaguggc

SEQ ID NO: 518812 - RNA, 32 nt, Human
ugcgaggucccccaggccucagccuggagcuc

SEQ ID NO: 518813 - RNA, 32 nt, Human
ugcgaggucugucgccuggugcagccuggccu

SEQ ID NO: 518814 - RNA, 32 nt, Human
ugcgaguagggagggcaggagggugaugggag

SEQ ID NO: 518815 - RNA, 32 nt, Human
ugcgaguccggaaagccugaucuuuaagucca

SEQ ID NO: 518816 - RNA, 32 nt, Human
ugcgagucuccuuggaaaaguguaagguucua

SEQ ID NO: 518817 - RNA, 32 nt, Human
ugcgagucugggaacagaucuguuuuucacuu

SEQ ID NO: 518818 - RNA, 31 nt, Human
ugcgagugggugguggaguaggggugggagu

SEQ ID NO: 518819 - RNA, 20 nt, Human
ugcgagugugucugauuuca

SEQ ID NO: 518820 - RNA, 32 nt, Human
ugcgagugugugugcacauguuacaaaggcaa

SEQ ID NO: 518821 - RNA, 32 nt, Human
ugcgauccuugucuuccuccagugcugguccc

SEQ ID NO: 518822 - RNA, 32 nt, Human
ugcgaucucacugcaaccucugccucccgggc

SEQ ID NO: 518823 - RNA, 32 nt, Human
ugcgaucucagcucacugcauccucugccucc

SEQ ID NO: 518824 - RNA, 32 nt, Human
ugcgaugaagaaaagcgggccagugugggaau

SEQ ID NO: 518825 - RNA, 29 nt, Human
ugcgaugcuguacuucucuuuguuuuggg

SEQ ID NO: 518826 - RNA, 29 nt, Human
ugcgauggagucuugcucucuugcccagg

SEQ ID NO: 518827 - RNA, 32 nt, Human
ugcgauggcucacgccuguaaucccagcacua

SEQ ID NO: 518828 - RNA, 32 nt, Human
ugcgauggcucacgccuguaaucccggcacuu

SEQ ID NO: 518829 - RNA, 32 nt, Human
ugcgauggggcgagaaaggucccacugcagcc

SEQ ID NO: 518830 - RNA, 29 nt, Human
ugcgaugggggaagcagagaaguuucacu

SEQ ID NO: 518831 - RNA, 32 nt, Human
ugcgaugguaacaugcucaucagccaucuacu

SEQ ID NO: 518832 - RNA, 32 nt, Human
ugcgauggugggugccuguaaucccagauacu

SEQ ID NO: 518833 - RNA, 32 nt, Human
ugcgaugugaucuguaccaggucacccagcua

SEQ ID NO: 518834 - RNA, 32 nt, Human
ugcgauguugcccaggcuggucucaaacuccu

SEQ ID NO: 518835 - RNA, 32 nt, Human
ugcgauguugucauucuuacuaaucuagucca

SEQ ID NO: 518836 - RNA, 32 nt, Human
ugcgauuuguuuugugccugaacggucuguuu

SEQ ID NO: 518837 - RNA, 32 nt, Human
ugcgcaaaccccuagccagccuucccacacug

SEQ ID NO: 518838 - RNA, 32 nt, Human
ugcgcaaacuccuucaggguugggggacucug

SEQ ID NO: 518839 - RNA, 32 nt, Human
ugcgcaaagaugguggaggaggagaacauccg

SEQ ID NO: 518840 - RNA, 32 nt, Human
ugcgcaacauggcgaaaccccgucucuacaau

SEQ ID NO: 518841 - RNA, 32 nt, Human
ugcgcaaccauccugaccacagauccagaaag

SEQ ID NO: 518842 - RNA, 32 nt, Human
ugcgcaacccuuucuacaccaggaugacacug

SEQ ID NO: 518843 - RNA, 32 nt, Human
ugcgcaaguuuccguccccaucggccggacag

SEQ ID NO: 518844 - RNA, 32 nt, Human
ugcgcaaugccgcggcgguggagcuguggcag

SEQ ID NO: 518845 - RNA, 32 nt, Human
ugcgcacacacagcagucugucacgaggcugg

SEQ ID NO: 518846 - RNA, 32 nt, Human
ugcgcacagccacgggggacugacgccagguu

SEQ ID NO: 518847 - RNA, 32 nt, Human
ugcgcacagggagcugucaccaugccucacuc

SEQ ID NO: 518848 - RNA, 32 nt, Human
ugcgcacauauguguauguguggaguaugugu

SEQ ID NO: 518849 - RNA, 32 nt, Human
ugcgcaccagcugccugcuguuuacacccagg

SEQ ID NO: 518850 - RNA, 32 nt, Human
ugcgcacccaggaggagcagaucaagacccuc

SEQ ID NO: 518851 - RNA, 32 nt, Human
ugcgcacccauaauccagcuacuugggaggcu

SEQ ID NO: 518852 - RNA, 32 nt, Human
ugcgcaccccuggaugucucggggaggggaug

SEQ ID NO: 518853 - RNA, 32 nt, Human
ugcgcacccgcacuggggccugggcggugcag

SEQ ID NO: 518854 - RNA, 32 nt, Human
ugcgcaccugggagggagcugccauccgggcu

SEQ ID NO: 518855 - RNA, 32 nt, Human
ugcgcaccuguaaucccagcuacuuggaaggc

SEQ ID NO: 518856 - RNA, 32 nt, Human
ugcgcaccuguaaucccagcuacuugggaggc

SEQ ID NO: 518857 - RNA, 32 nt, Human
ugcgcacggcggccuaccuccacaccacaacc

SEQ ID NO: 518858 - RNA, 32 nt, Human
ugcgcacuccaucucccucccuuuucuucucu

SEQ ID NO: 518859 - RNA, 32 nt, Human
ugcgcacugcagcuccccaggccacccaccac

SEQ ID NO: 518860 - RNA, 32 nt, Human
ugcgcagaccacccauagcccugcugcugcca

SEQ ID NO: 518861 - RNA, 32 nt, Human
ugcgcagagccaagccucucaaccucuucugg

SEQ ID NO: 518862 - RNA, 32 nt, Human
ugcgcagcaggcaccuccagaaagguaauggu

SEQ ID NO: 518863 - RNA, 32 nt, Human
ugcgcagccaggacugggguaugggcgcuguc

SEQ ID NO: 518864 - RNA, 32 nt, Human
ugcgcagccauuuucucccgggagagguugga

SEQ ID NO: 518865 - RNA, 32 nt, Human
ugcgcagccugaagggacaggacggacaagcg

SEQ ID NO: 518866 - RNA, 32 nt, Human
ugcgcaggacagccccucacaaaaagaaaccc

SEQ ID NO: 518867 - RNA, 32 nt, Human
ugcgcaggccagagugagugagcccagcacgg

SEQ ID NO: 518868 - RNA, 32 nt, Human
ugcgcaggcugcaacccuggugugcugggcga

SEQ ID NO: 518869 - RNA, 32 nt, Human
ugcgcagugaacaggcuggcugaggugcacgg

SEQ ID NO: 518870 - RNA, 32 nt, Human
ugcgcaguggagcggccagugggcaggaugac

SEQ ID NO: 518871 - RNA, 32 nt, Human
ugcgcaucagcaccuggggaucuggacccugc

SEQ ID NO: 518872 - RNA, 32 nt, Human
ugcgcaugccuguagucccagcuacuugggag

SEQ ID NO: 518873 - RNA, 22 nt, Human
ugcgcaugggcaaggccagcgc

SEQ ID NO: 518874 - RNA, 32 nt, Human
ugcgcauggugcagugccgcucuguggagggc

SEQ ID NO: 518875 - RNA, 32 nt, Human
ugcgcaugugugugcgugcaugcacauaugug

SEQ ID NO: 518876 - RNA, 32 nt, Human
ugcgcauuccuucucccuggacuuuaccuuac

SEQ ID NO: 518877 - RNA, 32 nt, Human
ugcgccaagccuugccugaacggaggcgucug

SEQ ID NO: 518878 - RNA, 32 nt, Human
ugcgccacagcauuccagccugggcgauggag

SEQ ID NO: 518879 - RNA, 32 nt, Human
ugcgccaccacacuccagccugggcaacagag

SEQ ID NO: 518880 - RNA, 32 nt, Human
ugcgccaccacugcacuccagccugggcaaca

SEQ ID NO: 518881 - RNA, 32 nt, Human
ugcgccacccaccuacucccuacacgcccacu

SEQ ID NO: 518882 - RNA, 32 nt, Human
ugcgccaccgcacuccagccugggcaacagag

SEQ ID NO: 518883 - RNA, 32 nt, Human
ugcgccaccgcacuccagccugggcgacagag

SEQ ID NO: 518884 - RNA, 32 nt, Human
ugcgccaccgcgcuccagccugggugacagag

SEQ ID NO: 518885 - RNA, 32 nt, Human
ugcgccacgccguggcucccaccagcagugcc

SEQ ID NO: 518886 - RNA, 32 nt, Human
ugcgccacggcacuccagccugggcgacagag

SEQ ID NO: 518887 - RNA, 21 nt, Human
ugcgccacgucugcugaagcc

SEQ ID NO: 518888 - RNA, 32 nt, Human
ugcgccacuacacuccagccugggugacagag

SEQ ID NO: 518889 - RNA, 32 nt, Human
ugcgccacuacacucuagccugggcaacgaga

SEQ ID NO: 518890 - RNA, 32 nt, Human
ugcgccacugcaaaccagccugggcaauagag

SEQ ID NO: 518891 - RNA, 32 nt, Human
ugcgccacugcacaccagucuggagacagagu

SEQ ID NO: 518892 - RNA, 32 nt, Human
ugcgccacugcacacuagcuugggugacagag

SEQ ID NO: 518893 - RNA, 32 nt, Human
ugcgccacugcaccccagcaugagcgacagaa

SEQ ID NO: 518894 - RNA, 32 nt, Human
ugcgccacugcaccccagcccagugacagggc

SEQ ID NO: 518895 - RNA, 32 nt, Human
ugcgccacugcaccccagcccgggugacagag

SEQ ID NO: 518896 - RNA, 32 nt, Human
ugcgccacugcaccccagccuggacaacagag

SEQ ID NO: 518897 - RNA, 32 nt, Human
ugcgccacugcaccccagccugggcgacagag

SEQ ID NO: 518898 - RNA, 32 nt, Human
ugcgccacugcaccccagccugggugacagag

SEQ ID NO: 518899 - RNA, 32 nt, Human
ugcgccacugcacccggcccgugaaggucuuu

SEQ ID NO: 518900 - RNA, 32 nt, Human
ugcgccacugcacucaagucugggcgacaggg

SEQ ID NO: 518901 - RNA, 32 nt, Human
ugcgccacugcacuccaaccugggcaauagag

SEQ ID NO: 518902 - RNA, 32 nt, Human
ugcgccacugcacuccacccugggugacagag

SEQ ID NO: 518903 - RNA, 32 nt, Human
ugcgccacugcacuccagccagggcgaaggag

SEQ ID NO: 518904 - RNA, 32 nt, Human
ugcgccacugcacuccagcccuggcgacagag

SEQ ID NO: 518905 - RNA, 32 nt, Human
ugcgccacugcacuccagccuaggugauagag

SEQ ID NO: 518906 - RNA, 32 nt, Human
ugcgccacugcacuccagccugacgacaaagc

SEQ ID NO: 518907 - RNA, 32 nt, Human
ugcgccacugcacuccagccugagcgacagag

SEQ ID NO: 518908 - RNA, 32 nt, Human
ugcgccacugcacuccagccuggcgacagagc

SEQ ID NO: 518909 - RNA, 32 nt, Human
ugcgccacugcacuccagccugggagacagag

SEQ ID NO: 518910 - RNA, 32 nt, Human
ugcgccacugcacuccagccugggcaacaaga

SEQ ID NO: 518911 - RNA, 32 nt, Human
ugcgccacugcacuccagccugggcaacagag

SEQ ID NO: 518912 - RNA, 32 nt, Human
ugcgccacugcacuccagccugggcaauagag

SEQ ID NO: 518913 - RNA, 32 nt, Human
ugcgccacugcacuccagccugggcagcagag

SEQ ID NO: 518914 - RNA, 32 nt, Human
ugcgccacugcacuccagccugggcgacagag

SEQ ID NO: 518915 - RNA, 32 nt, Human
ugcgccacugcacuccagccugggcgacggag

SEQ ID NO: 518916 - RNA, 32 nt, Human
ugcgccacugcacuccagccugggcuacagag

SEQ ID NO: 518917 - RNA, 32 nt, Human
ugcgccacugcacuccagccugggggacagag

SEQ ID NO: 518918 - RNA, 32 nt, Human
ugcgccacugcacuccagccuggguaacagag

SEQ ID NO: 518919 - RNA, 32 nt, Human
ugcgccacugcacuccagccugggugacagaa

SEQ ID NO: 518920 - RNA, 32 nt, Human
ugcgccacugcacuccagccugggugacagag

SEQ ID NO: 518921 - RNA, 32 nt, Human
ugcgccacugcacuccagccugggugacugag

SEQ ID NO: 518922 - RNA, 32 nt, Human
ugcgccacugcacuccagccugguugacagag

SEQ ID NO: 518923 - RNA, 32 nt, Human
ugcgccacugcacuccagcgcggaagacagag

SEQ ID NO: 518924 - RNA, 32 nt, Human
ugcgccacugcacuccagcgugggcuacagag

SEQ ID NO: 518925 - RNA, 32 nt, Human
ugcgccacugcacuccagucugggacaacaga

SEQ ID NO: 518926 - RNA, 32 nt, Human
ugcgccacugcacuccagucugggcgacagag

SEQ ID NO: 518927 - RNA, 32 nt, Human
ugcgccacugcacuccagucuggucggcaaga

SEQ ID NO: 518928 - RNA, 32 nt, Human
ugcgccacugcacucuagccuaagcaauggag

SEQ ID NO: 518929 - RNA, 32 nt, Human
ugcgccacugcacucuagccugggcuacagag

SEQ ID NO: 518930 - RNA, 32 nt, Human
ugcgccacugcacuucagccuggaugacagag

SEQ ID NO: 518931 - RNA, 32 nt, Human
ugcgccacugcacuucagccugggcaacagag

SEQ ID NO: 518932 - RNA, 32 nt, Human
ugcgccacugcauuccagccugggugacugag

SEQ ID NO: 518933 - RNA, 32 nt, Human
ugcgccacugcauucuagccugagugacagag

SEQ ID NO: 518934 - RNA, 32 nt, Human
ugcgccacugcgcuccagccugggcaacagag

SEQ ID NO: 518935 - RNA, 32 nt, Human
ugcgccacuggacuccagccugcgugacagag

SEQ ID NO: 518936 - RNA, 32 nt, Human
ugcgccacuguacuccagccuggcaacagagu

SEQ ID NO: 518937 - RNA, 32 nt, Human
ugcgccacuguacuccagccugggugacgagc

SEQ ID NO: 518938 - RNA, 32 nt, Human
ugcgccacuguacuccagccugggugaggaga

SEQ ID NO: 518939 - RNA, 32 nt, Human
ugcgccacuguacuccagcuugggcaacagag

SEQ ID NO: 518940 - RNA, 32 nt, Human
ugcgccacuucacuccagccugggcaacagag

SEQ ID NO: 518941 - RNA, 32 nt, Human
ugcgccacuucacuccagccugggugacagag

SEQ ID NO: 518942 - RNA, 32 nt, Human
ugcgccagagugaggggugcaggaagacaaag

SEQ ID NO: 518943 - RNA, 32 nt, Human
ugcgccagccuccccgcccgcucucuuuucuc

SEQ ID NO: 518944 - RNA, 32 nt, Human
ugcgccaggcaggaagaaggcaggcuucuggc

SEQ ID NO: 518945 - RNA, 32 nt, Human
ugcgccagugcacuccagcugggcgacagagc

SEQ ID NO: 518946 - RNA, 32 nt, Human
ugcgccauaggcagaggcuuauaaagaaaugg

SEQ ID NO: 518947 - RNA, 32 nt, Human
ugcgccauugcacuccagcccgggcaacaaga

SEQ ID NO: 518948 - RNA, 32 nt, Human
ugcgccauugcacuccagccuagguaacaaga

SEQ ID NO: 518949 - RNA, 32 nt, Human
ugcgccauugcacuccagccugggcaaaaaga

SEQ ID NO: 518950 - RNA, 32 nt, Human
ugcgccauugcacuccagccugggcaacaaga

SEQ ID NO: 518951 - RNA, 32 nt, Human
ugcgccauugcacuccagccugggcaacacag

SEQ ID NO: 518952 - RNA, 32 nt, Human
ugcgccauugcacuccagccugggcaacagag

SEQ ID NO: 518953 - RNA, 32 nt, Human
ugcgccauugcacuccagccugggcaacgagu

SEQ ID NO: 518954 - RNA, 32 nt, Human
ugcgccauugcacuccagccuggggacaaagc

SEQ ID NO: 518955 - RNA, 32 nt, Human
ugcgccauugcacucuagccugugugacagag

SEQ ID NO: 518956 - RNA, 32 nt, Human
ugcgccauugcauuccagccugggcaacaaga

SEQ ID NO: 518957 - RNA, 32 nt, Human
ugcgccauugcauuccagccugggugacagag

SEQ ID NO: 518958 - RNA, 32 nt, Human
ugcgccauuguacuccagccugggcaacaaga

SEQ ID NO: 518959 - RNA, 32 nt, Human
ugcgccauuguacuccagccugggggacagga

SEQ ID NO: 518960 - RNA, 32 nt, Human
ugcgccauugugcuccagccugggugacaaag

SEQ ID NO: 518961 - RNA, 32 nt, Human
ugcgcccagagacccacuggucuuccaccuuc

SEQ ID NO: 518962 - RNA, 32 nt, Human
ugcgcccagccucuccccagcauguaaagucu

SEQ ID NO: 518963 - RNA, 32 nt, Human
ugcgccccaaaccucuucauauugaagaugga

SEQ ID NO: 518964 - RNA, 21 nt, Human
ugcgccccaccgcggcccgca

SEQ ID NO: 518965 - RNA, 32 nt, Human
ugcgcccccagccugccccagcccagucccuc

SEQ ID NO: 518966 - RNA, 32 nt, Human
ugcgcccccagcuucucucucccugucacaca

SEQ ID NO: 518967 - RNA, 32 nt, Human
ugcgcccccaggcugcucacagccggcuugcu

SEQ ID NO: 518968 - RNA, 32 nt, Human
ugcgcccccgagugcccauggcuacaagggug

SEQ ID NO: 518969 - RNA, 32 nt, Human
ugcgcccccggcuggggagggaagcacuguca

SEQ ID NO: 518970 - RNA, 32 nt, Human
ugcgcccccugcacuccagccugggcuucaga

SEQ ID NO: 518971 - RNA, 26 nt, Human
ugcgcccccuucuuugcagcugccca

SEQ ID NO: 518972 - RNA, 32 nt, Human
ugcgccccuccaccaacagcccaucuccuguc

SEQ ID NO: 518973 - RNA, 32 nt, Human
ugcgccccugcacuccaaccuggacaacacag

SEQ ID NO: 518974 - RNA, 32 nt, Human
ugcgcccgaggcagacggugcaggggccuccg

SEQ ID NO: 518975 - RNA, 32 nt, Human
ugcgcccgcagcccugccuccacagcucgcca

SEQ ID NO: 518976 - RNA, 32 nt, Human
ugcgcccgcuugguucggaccucggcaacugg

SEQ ID NO: 518977 - RNA, 32 nt, Human
ugcgcccggcaggagucaggagccagggacug

SEQ ID NO: 518978 - RNA, 32 nt, Human
ugcgcccggcagucuggcgaccaccuugcggg

SEQ ID NO: 518979 - RNA, 32 nt, Human
ugcgcccggcgcccggggugggcgaccugggc

SEQ ID NO: 518980 - RNA, 32 nt, Human
ugcgcccuaaacacuccugggccaugagcuaa

SEQ ID NO: 518981 - RNA, 32 nt, Human
ugcgcccuccacccucacucugccauuguucc

SEQ ID NO: 518982 - RNA, 32 nt, Human
ugcgcccucccucugcuccugagaugcugacc

SEQ ID NO: 518983 - RNA, 23 nt, Human
ugcgcccuccgugagcugcggca

SEQ ID NO: 518984 - RNA, 32 nt, Human
ugcgcccucggcuugccucucucccuccuccc

SEQ ID NO: 518985 - RNA, 32 nt, Human
ugcgcccugccuggaacucuaugaggaaauac

SEQ ID NO: 518986 - RNA, 22 nt, Human
ugcgcccugcggcccgcucccc

SEQ ID NO: 518987 - RNA, 32 nt, Human
ugcgcccuggagggagguguagaaagagguac

SEQ ID NO: 518988 - RNA, 32 nt, Human
ugcgcccugggggccugggcucugcugcccug

SEQ ID NO: 518989 - RNA, 32 nt, Human
ugcgcccugguggcggggguggugcuggcuca

SEQ ID NO: 518990 - RNA, 32 nt, Human
ugcgcccugugggcaccgacaccacagaagcc

SEQ ID NO: 518991 - RNA, 32 nt, Human
ugcgcccuuaacugcauccagccuggggcuga

SEQ ID NO: 518992 - RNA, 32 nt, Human
ugcgccgacggcagcgacgagcgcggcugcgg

SEQ ID NO: 518993 - RNA, 32 nt, Human
ugcgccgacuccgucucccagaaaucaacgug

SEQ ID NO: 518994 - RNA, 32 nt, Human
ugcgccgauugccucucggccugggcaauggu

SEQ ID NO: 518995 - RNA, 32 nt, Human
ugcgccgcuacauuccagccugggcaacacga

SEQ ID NO: 518996 - RNA, 32 nt, Human
ugcgccgcugcacuccagccugggcaacagag

SEQ ID NO: 518997 - RNA, 32 nt, Human
ugcgccgcugcacuccagccugggcgacagag

SEQ ID NO: 518998 - RNA, 32 nt, Human
ugcgccgguagaaaggaugacgccucaacccu

SEQ ID NO: 518999 - RNA, 32 nt, Human
ugcgccggugccuuugccccagcggagccugc

SEQ ID NO: 519000 - RNA, 32 nt, Human
ugcgccguaccucaccuggccugcaggaugaa

SEQ ID NO: 519001 - RNA, 32 nt, Human
ugcgccguggcguuccgcuccaugacugucgc

SEQ ID NO: 519002 - RNA, 32 nt, Human
ugcgccguuguacuccagccugggcaacagag

SEQ ID NO: 519003 - RNA, 32 nt, Human
ugcgccuagaaucccagcuacucggaaggcca

SEQ ID NO: 519004 - RNA, 32 nt, Human
ugcgccucaguugaugcugcuaaauucccugg

SEQ ID NO: 519005 - RNA, 32 nt, Human
ugcgccuccacugcagugccugggcuccccuu

SEQ ID NO: 519006 - RNA, 32 nt, Human
ugcgccuccucuauuggcccaggaagcccacc

SEQ ID NO: 519007 - RNA, 32 nt, Human
ugcgccuccugggccacuggcccagccccagc

SEQ ID NO: 519008 - RNA, 32 nt, Human
ugcgccucgguaucuggcuucccuggaagcuc

SEQ ID NO: 519009 - RNA, 32 nt, Human
ugcgccucucuggaguucacgugcugcacccc

SEQ ID NO: 519010 - RNA, 24 nt, Human
ugcgccucugccccucuccugcca

SEQ ID NO: 519011 - RNA, 32 nt, Human
ugcgccucugcggucgucgcuccugggccucg

SEQ ID NO: 519012 - RNA, 32 nt, Human
ugcgccugcagucccagcuacuugggaggccg

SEQ ID NO: 519013 - RNA, 32 nt, Human
ugcgccugcuccugaaaagcucucugggaagg

SEQ ID NO: 519014 - RNA, 32 nt, Human
ugcgccugggcaacauagaaaccugugucuac

SEQ ID NO: 519015 - RNA, 32 nt, Human
ugcgccuguaaccccagcuauucgggaggcug

SEQ ID NO: 519016 - RNA, 32 nt, Human
ugcgccuguaaucccagcuaccggagaggcug

SEQ ID NO: 519017 - RNA, 32 nt, Human
ugcgccuguaaucccagcuacucgggaggcug

SEQ ID NO: 519018 - RNA, 32 nt, Human
ugcgccuguaaucccagcuacucgggagguug

SEQ ID NO: 519019 - RNA, 32 nt, Human
ugcgccuguaaucccagcuacucgggagucuc

SEQ ID NO: 519020 - RNA, 32 nt, Human
ugcgccuguaaucccagcuacucuggaggcug

SEQ ID NO: 519021 - RNA, 32 nt, Human
ugcgccuguaaucccagcuacuucggagguug

SEQ ID NO: 519022 - RNA, 32 nt, Human
ugcgccuguaaucccagcuacuugggaggcug

SEQ ID NO: 519023 - RNA, 32 nt, Human
ugcgccuguaaucccagcuauauaggaggcug

SEQ ID NO: 519024 - RNA, 32 nt, Human
ugcgccuguagucccagcuacccaggaggcug

SEQ ID NO: 519025 - RNA, 32 nt, Human
ugcgccuguagucccagcuacucaggaggcug

SEQ ID NO: 519026 - RNA, 32 nt, Human
ugcgccuguagucccagcuacucgggagacug

SEQ ID NO: 519027 - RNA, 32 nt, Human
ugcgccuguagucccagcuacucgggaggcug

SEQ ID NO: 519028 - RNA, 32 nt, Human
ugcgccuguagucccagcuacuuggaagcuga

SEQ ID NO: 519029 - RNA, 32 nt, Human
ugcgccuguagucccagcuacuugggagacug

SEQ ID NO: 519030 - RNA, 32 nt, Human
ugcgccuguagucccagcuacuugggaggcug

SEQ ID NO: 519031 - RNA, 32 nt, Human
ugcgccuguagucccagcuacuugugaggcug

SEQ ID NO: 519032 - RNA, 32 nt, Human
ugcgccuguagucccagcugcucaggaggcug

SEQ ID NO: 519033 - RNA, 32 nt, Human
ugcgccuguagucccagcugcucggggaggcu

SEQ ID NO: 519034 - RNA, 32 nt, Human
ugcgccuguagucccaucuacuugggaggcug

SEQ ID NO: 519035 - RNA, 32 nt, Human
ugcgccuguauacccagcuacucgggaggcug

SEQ ID NO: 519036 - RNA, 32 nt, Human
ugcgccugucaucccagcuacuugagaggcug

SEQ ID NO: 519037 - RNA, 32 nt, Human
ugcgccugucuucucccucugaccccagagaa

SEQ ID NO: 519038 - RNA, 32 nt, Human
ugcgccugugaucccagcuacuuggaaggcug

SEQ ID NO: 519039 - RNA, 32 nt, Human
ugcgccugugggggaagagcaaacaggaagga

SEQ ID NO: 519040 - RNA, 32 nt, Human
ugcgccuucaucuugaagcacucugaaauugc

SEQ ID NO: 519041 - RNA, 32 nt, Human
ugcgccuucucauggcugacucaggccugggg

SEQ ID NO: 519042 - RNA, 32 nt, Human
ugcgcgaacagcccuccuccuccucucgccgc

SEQ ID NO: 519043 - RNA, 17 nt, Human
ugcgcgagcggcugcug

SEQ ID NO: 519044 - RNA, 32 nt, Human
ugcgcgcacccucuccccucguccaccgcugc

SEQ ID NO: 519045 - RNA, 32 nt, Human
ugcgcgcacccucuccccuuguccacugcugc

SEQ ID NO: 519046 - RNA, 32 nt, Human
ugcgcgcccagccugccaagcagcgugccccg

SEQ ID NO: 519047 - RNA, 22 nt, Human
ugcgcgcccgccucggcccgca

SEQ ID NO: 519048 - RNA, 32 nt, Human
ugcgcgccugcacuuccccucggugcagaagg

SEQ ID NO: 519049 - RNA, 32 nt, Human
ugcgcgccugcagccagaguugcagggaaagc

SEQ ID NO: 519050 - RNA, 32 nt, Human
ugcgcgcucccagguucuuggagacgccgagu

SEQ ID NO: 519051 - RNA, 32 nt, Human
ugcgcgcucugcucuucgcagcuccccggacc

SEQ ID NO: 519052 - RNA, 32 nt, Human
ugcgcgcuuugucagcagugcugugagaaguu

SEQ ID NO: 519053 - RNA, 32 nt, Human
ugcgcggacauggccucaaacgauuauaccca

SEQ ID NO: 519054 - RNA, 32 nt, Human
ugcgcggccccugauuucugcaugguguagaa

SEQ ID NO: 519055 - RNA, 32 nt, Human
ugcgcggccgccaaguuucagugaugaacgcc

SEQ ID NO: 519056 - RNA, 32 nt, Human
ugcgcggccuaccucaagcugagacacuggca

SEQ ID NO: 519057 - RNA, 32 nt, Human
ugcgcggcuuccugccuccaugccacuccaga

SEQ ID NO: 519058 - RNA, 32 nt, Human
ugcgcgggaggccaaagccauggccauugcca

SEQ ID NO: 519059 - RNA, 32 nt, Human
ugcgcggggugggcgggggaaagacccugagg

SEQ ID NO: 519060 - RNA, 32 nt, Human
ugcgcguccccagcuuccuagccuggguggga

SEQ ID NO: 519061 - RNA, 32 nt, Human
ugcgcgugugugugcgugugcgcacgcucugg

SEQ ID NO: 519062 - RNA, 32 nt, Human
ugcgcuaagagccccgggugaggaccuccaag

SEQ ID NO: 519063 - RNA, 32 nt, Human
ugcgcuacagccugggcgacacaguaagaccc

SEQ ID NO: 519064 - RNA, 32 nt, Human
ugcgcuacuacgcuacagccugggugacagcc

SEQ ID NO: 519065 - RNA, 32 nt, Human
ugcgcuacugaacuccagccuggguuacagag

SEQ ID NO: 519066 - RNA, 32 nt, Human
ugcgcuacugcaaucccaccugggcaacaaga

SEQ ID NO: 519067 - RNA, 32 nt, Human
ugcgcuacugcacuccagccuaggcaacagag

SEQ ID NO: 519068 - RNA, 32 nt, Human
ugcgcuacugcacuccagccuggacaacagag

SEQ ID NO: 519069 - RNA, 32 nt, Human
ugcgcuacugcacuccagccugggcgacagua

SEQ ID NO: 519070 - RNA, 32 nt, Human
ugcgcuacugcacuccagccugggugacagag

SEQ ID NO: 519071 - RNA, 32 nt, Human
ugcgcuacuggcagagcugcugcgaggacccu

SEQ ID NO: 519072 - RNA, 32 nt, Human
ugcgcucaggaggcagagguuacagguuacag

SEQ ID NO: 519073 - RNA, 32 nt, Human
ugcgcucaugcuggcaucaguggugagacagu

SEQ ID NO: 519074 - RNA, 32 nt, Human
ugcgcuccagccuggacaacacagugagacuc

SEQ ID NO: 519075 - RNA, 32 nt, Human
ugcgcuccagccugggcaacagagugagacuc

SEQ ID NO: 519076 - RNA, 32 nt, Human
ugcgcuccagccugggcgaaagagugagacuc

SEQ ID NO: 519077 - RNA, 32 nt, Human
ugcgcuccagccugggcgacagagugguauuc

SEQ ID NO: 519078 - RNA, 32 nt, Human
ugcgcuccagccugggugacagagugagacuc

SEQ ID NO: 519079 - RNA, 32 nt, Human
ugcgcuccccacucugaugcucaggcccgugg

SEQ ID NO: 519080 - RNA, 32 nt, Human
ugcgcuccuggcucccuguaaaaucacagccc

SEQ ID NO: 519081 - RNA, 32 nt, Human
ugcgcucgucccugggaggggagggaggcgcg

SEQ ID NO: 519082 - RNA, 32 nt, Human
ugcgcucugggaaagguggcagagggcaggac

SEQ ID NO: 519083 - RNA, 32 nt, Human
ugcgcucuguugcccaggcuggagugcagugg

SEQ ID NO: 519084 - RNA, 32 nt, Human
ugcgcucuugcagccaagaaggcgggaggcug

SEQ ID NO: 519085 - RNA, 32 nt, Human
ugcgcugacucugcggcccuccaggacggaca

SEQ ID NO: 519086 - RNA, 32 nt, Human
ugcgcugcagaggcacuccacccugggcacgg

SEQ ID NO: 519087 - RNA, 32 nt, Human
ugcgcugcagccugggcaacacagugagaccc

SEQ ID NO: 519088 - RNA, 32 nt, Human
ugcgcugcagcucuguggccugcgccuggaag

SEQ ID NO: 519089 - RNA, 32 nt, Human
ugcgcugcucaaccucucuccuucuggcgcaa

SEQ ID NO: 519090 - RNA, 32 nt, Human
ugcgcugcugcacuccaaccugggcgacagag

SEQ ID NO: 519091 - RNA, 32 nt, Human
ugcgcugcugugagccucacccugggccccug

SEQ ID NO: 519092 - RNA, 32 nt, Human
ugcgcugcuuucccucuccugccucauuccuu

SEQ ID NO: 519093 - RNA, 32 nt, Human
ugcgcuggaaucgcagcaggagaggggagugg

SEQ ID NO: 519094 - RNA, 32 nt, Human
ugcgcuggcugcugcuuuucugcuccuggaag

SEQ ID NO: 519095 - RNA, 32 nt, Human
ugcgcugggaaucccucucggaguuuuuccag

SEQ ID NO: 519096 - RNA, 32 nt, Human
ugcgcuguaauucccugcucccuggagacugg

SEQ ID NO: 519097 - RNA, 32 nt, Human
ugcgcugucacccaggcuggagugcagugcug

SEQ ID NO: 519098 - RNA, 32 nt, Human
ugcgcuguugcccaggcucuagugcaauggca

SEQ ID NO: 519099 - RNA, 32 nt, Human
ugcgcuuagauuuuaccggucuguaaaaugga

SEQ ID NO: 519100 - RNA, 32 nt, Human
ugcgcuucacagaaccuccucuucauuggaaa

SEQ ID NO: 519101 - RNA, 32 nt, Human
ugcgcuucagccugggcaacaagagugaaacu

SEQ ID NO: 519102 - RNA, 31 nt, Human
ugcgcuucauccaaggaggauuugaagagga

SEQ ID NO: 519103 - RNA, 32 nt, Human
ugcgcuucuuggauuuuccaaaggaggugacc

SEQ ID NO: 519104 - RNA, 32 nt, Human
ugcgcuuuugucccguaaauguuaacacucau

SEQ ID NO: 519105 - RNA, 32 nt, Human
ugcggaaacagaaaggaaagaguccucccaga

SEQ ID NO: 519106 - RNA, 32 nt, Human
ugcggaaagggucagagcagggcucggcguca

SEQ ID NO: 519107 - RNA, 32 nt, Human
ugcggaacucuuccuggaaugcauucacucag

SEQ ID NO: 519108 - RNA, 32 nt, Human
ugcggaaggaggggcaggcagugaagagggaa

SEQ ID NO: 519109 - RNA, 32 nt, Human
ugcggaagggagcugcugggaaggcggacgag

SEQ ID NO: 519110 - RNA, 32 nt, Human
ugcggacagugcgggccagggaggaaaaccag

SEQ ID NO: 519111 - RNA, 32 nt, Human
ugcggacagugugggccagggaggaaaaccag

SEQ ID NO: 519112 - RNA, 32 nt, Human
ugcggaccauggggacucagcucugcauggca

SEQ ID NO: 519113 - RNA, 32 nt, Human
ugcggacccacggacacggaggcugcaccuuc

SEQ ID NO: 519114 - RNA, 32 nt, Human
ugcggacgagcgggcggcaggagccggcgcga

SEQ ID NO: 519115 - RNA, 32 nt, Human
ugcggacggggccugguggcgagcccaagugg

SEQ ID NO: 519116 - RNA, 32 nt, Human
ugcggacucaggcuggcgaauagcccuggcga

SEQ ID NO: 519117 - RNA, 32 nt, Human
ugcggagagagugggagugcucagggaaagaa

SEQ ID NO: 519118 - RNA, 32 nt, Human
ugcggagagggggagagcaggcagcgggcggc

SEQ ID NO: 519119 - RNA, 32 nt, Human
ugcggagccauccugaggcuuugacaucuaug

SEQ ID NO: 519120 - RNA, 25 nt, Human
ugcggagcccgcucacccgcucccu

SEQ ID NO: 519121 - RNA, 32 nt, Human
ugcggagcuugcugaggcaaggccgaggauaa

SEQ ID NO: 519122 - RNA, 32 nt, Human
ugcggaggaaggcacgggggcacuggggcgca

SEQ ID NO: 519123 - RNA, 32 nt, Human
ugcggagggaaguguggggagagcagaggcgc

SEQ ID NO: 519124 - RNA, 24 nt, Human
ugcggaggucacccccgccuggcc

SEQ ID NO: 519125 - RNA, 32 nt, Human
ugcggagguggggcagggggagacugaggugg

SEQ ID NO: 519126 - RNA, 32 nt, Human
ugcggagguuccugggggaaucaaagagaaau

SEQ ID NO: 519127 - RNA, 32 nt, Human
ugcggagucugugguucuggaagggcucacug

SEQ ID NO: 519128 - RNA, 32 nt, Human
ugcggagugcggggcuccgggggacugagcag

SEQ ID NO: 519129 - RNA, 32 nt, Human
ugcggaguugugccgagugccugcugcagacc

SEQ ID NO: 519130 - RNA, 32 nt, Human
ugcggaguugugccgagugccugcugcagucu

SEQ ID NO: 519131 - RNA, 32 nt, Human
ugcggaucuucauggccucaggagacuuguuu

SEQ ID NO: 519132 - RNA, 32 nt, Human
ugcggaugagccugcggcaguccuggggaaac

SEQ ID NO: 519133 - RNA, 32 nt, Human
ugcggauggccucagcccuggguggccaggcu

SEQ ID NO: 519134 - RNA, 32 nt, Human
ugcggauggucucagcaguucuccaguuuggc

SEQ ID NO: 519135 - RNA, 32 nt, Human
ugcggcaaacagcacuugcaagaaauauaacc

SEQ ID NO: 519136 - RNA, 20 nt, Human
ugcggcaaccuuuaaccaca

SEQ ID NO: 519137 - RNA, 22 nt, Human
ugcggcaacuccaugcaagcug

SEQ ID NO: 519138 - RNA, 32 nt, Human
ugcggcacaggacugugcccugugcugucccc

SEQ ID NO: 519139 - RNA, 32 nt, Human
ugcggcagagagaggaaggcagggaggugcug

SEQ ID NO: 519140 - RNA, 32 nt, Human
ugcggcagccugggcgggugcaggagaucgug

SEQ ID NO: 519141 - RNA, 32 nt, Human
ugcggcaggagaaggaccaagagaggagagga

SEQ ID NO: 519142 - RNA, 32 nt, Human
ugcggcaggcggaucacuugaggucaggaguc

SEQ ID NO: 519143 - RNA, 32 nt, Human
ugcggcaguagggacagcaggagcaguggugc

SEQ ID NO: 519144 - RNA, 32 nt, Human
ugcggcagucucucccugccaggcucuucauc

SEQ ID NO: 519145 - RNA, 32 nt, Human
ugcggcaucacccucagaccuuggagcccaag

SEQ ID NO: 519146 - RNA, 32 nt, Human
ugcggcauccuucugccuguuucuguaagcaa

SEQ ID NO: 519147 - RNA, 32 nt, Human
ugcggcaucuuuccuccccaccgcugggccug

SEQ ID NO: 519148 - RNA, 20 nt, Human
ugcggccagaacccccugcc

SEQ ID NO: 519149 - RNA, 22 nt, Human
ugcggccagcagagcccaggcc

SEQ ID NO: 519150 - RNA, 32 nt, Human
ugcggccaggcagaggaagagaggucgacugu

SEQ ID NO: 519151 - RNA, 24 nt, Human
ugcggccauuaggggccggugcgg

SEQ ID NO: 519152 - RNA, 32 nt, Human
ugcggcccaaagagucacaugggguuuucugg

SEQ ID NO: 519153 - RNA, 28 nt, Human
ugcggcccaagugauacuuucuuuaccg

SEQ ID NO: 519154 - RNA, 22 nt, Human
ugcggcccaggguucgcgcggg

SEQ ID NO: 519155 - RNA, 32 nt, Human
ugcggccccaggaggggaacugagucacgcug

SEQ ID NO: 519156 - RNA, 32 nt, Human
ugcggcccccuccugagugggacaucaggggu

SEQ ID NO: 519157 - RNA, 21 nt, Human
ugcggccccgggccgcgcggg

SEQ ID NO: 519158 - RNA, 32 nt, Human
ugcggccccuggcaauggcgccaccaucgguc

SEQ ID NO: 519159 - RNA, 19 nt, Human
ugcggcccgcagccggcgc

SEQ ID NO: 519160 - RNA, 25 nt, Human
ugcggcccguggcggcgugcgcggg

SEQ ID NO: 519161 - RNA, 32 nt, Human
ugcggcccugcuccaaacuccuggaccccauc

SEQ ID NO: 519162 - RNA, 24 nt, Human
ugcggccgcaguagccggagccgg

SEQ ID NO: 519163 - RNA, 21 nt, Human
ugcggccgccaccgcggugga

SEQ ID NO: 519164 - RNA, 21 nt, Human
ugcggccgcccugcgcacgga

SEQ ID NO: 519165 - RNA, 23 nt, Human
ugcggccgccugcgcgcggcggg

SEQ ID NO: 519166 - RNA, 22 nt, Human
ugcggccgcgccgggcgccggg

SEQ ID NO: 519167 - RNA, 21 nt, Human
ugcggccgcgggggcggcgga

SEQ ID NO: 519168 - RNA, 21 nt, Human
ugcggccgcugcagcgcaggg

SEQ ID NO: 519169 - RNA, 32 nt, Human
ugcggccgcugcugcugacacucgcucccagg

SEQ ID NO: 519170 - RNA, 21 nt, Human
ugcggccgcuuucggcaugga

SEQ ID NO: 519171 - RNA, 32 nt, Human
ugcggccggcggucucgggaaaagugagggga

SEQ ID NO: 519172 - RNA, 22 nt, Human
ugcggccggggaggcgcgcgga

SEQ ID NO: 519173 - RNA, 21 nt, Human
ugcggccggguccggcgcggg

SEQ ID NO: 519174 - RNA, 22 nt, Human
ugcggccguagccuguggcggg

SEQ ID NO: 519175 - RNA, 32 nt, Human
ugcggccgugccccaucuccccgcagcugcgg

SEQ ID NO: 519176 - RNA, 32 nt, Human
ugcggccguggcugucucaggcuccaggacag

SEQ ID NO: 519177 - RNA, 32 nt, Human
ugcggccuccagggcgccuccugccggccccg

SEQ ID NO: 519178 - RNA, 32 nt, Human
ugcggccuccccugccuuuucuccggugggga

SEQ ID NO: 519179 - RNA, 32 nt, Human
ugcggccugccuauuccaucugaaugucgcau

SEQ ID NO: 519180 - RNA, 32 nt, Human
ugcggccugcuccuggucaucgcccugggcug

SEQ ID NO: 519181 - RNA, 19 nt, Human
ugcggccugugccagagag

SEQ ID NO: 519182 - RNA, 32 nt, Human
ugcggcgacgagaugcgagcagaggagcccug

SEQ ID NO: 519183 - RNA, 32 nt, Human
ugcggcgaggagaaaggaaggagaggagaaaa

SEQ ID NO: 519184 - RNA, 32 nt, Human
ugcggcgcagccucggugucucugggccggcg

SEQ ID NO: 519185 - RNA, 32 nt, Human
ugcggcgccaugcaggucuccagccucaauga

SEQ ID NO: 519186 - RNA, 32 nt, Human
ugcggcgcgcacaggcaggagguugcaguugg

SEQ ID NO: 519187 - RNA, 23 nt, Human
ugcggcgcugcggccgacgccgg

SEQ ID NO: 519188 - RNA, 32 nt, Human
ugcggcggcagaagugaagugccugaggaccg

SEQ ID NO: 519189 - RNA, 24 nt, Human
ugcggcggcggcugcgcgcguggg

SEQ ID NO: 519190 - RNA, 32 nt, Human
ugcggcggcucacgcauguaaucccagcacuu

SEQ ID NO: 519191 - RNA, 32 nt, Human
ugcggcggcuguaugggcucucuuccuccuuc

SEQ ID NO: 519192 - RNA, 32 nt, Human
ugcggcgggaggcccugaagaugcaguccccc

SEQ ID NO: 519193 - RNA, 21 nt, Human
ugcggcgggucucuguucaca

SEQ ID NO: 519194 - RNA, 32 nt, Human
ugcggcgguucaugccuguaaucccaguacuu

SEQ ID NO: 519195 - RNA, 32 nt, Human
ugcggcuccauggucugaguugucagccguug

SEQ ID NO: 519196 - RNA, 28 nt, Human
ugcggcugacagcagccgcgcgcgcggg

SEQ ID NO: 519197 - RNA, 22 nt, Human
ugcggcugcaauggaggcaagg

SEQ ID NO: 519198 - RNA, 25 nt, Human
ugcggcugcacugagagcgcgcggg

SEQ ID NO: 519199 - RNA, 22 nt, Human
ugcggcugcaggcaccggcgcg

SEQ ID NO: 519200 - RNA, 22 nt, Human
ugcggcugcaguagcagcugga

SEQ ID NO: 519201 - RNA, 24 nt, Human
ugcggcugcaguggugguggcggg

SEQ ID NO: 519202 - RNA, 32 nt, Human
ugcggcugccccuucccugccucccagcuguu

SEQ ID NO: 519203 - RNA, 22 nt, Human
ugcggcugccgcugccgggcgg

SEQ ID NO: 519204 - RNA, 20 nt, Human
ugcggcugcggcaggacggg

SEQ ID NO: 519205 - RNA, 22 nt, Human
ugcggcugcggcggccgcgcgg

SEQ ID NO: 519206 - RNA, 26 nt, Human
ugcggcugcggcggccgcgcggcggg

SEQ ID NO: 519207 - RNA, 21 nt, Human
ugcggcugcugcggccggagc

SEQ ID NO: 519208 - RNA, 21 nt, Human
ugcggcugcugcggcugcgga

SEQ ID NO: 519209 - RNA, 20 nt, Human
ugcggcugcuggaugcggag

SEQ ID NO: 519210 - RNA, 32 nt, Human
ugcggcuggaggcggaggcaacggcggcugga

SEQ ID NO: 519211 - RNA, 32 nt, Human
ugcggcugggcccggggagcagugaguggaaa

SEQ ID NO: 519212 - RNA, 32 nt, Human
ugcggcugggcuggaggucaaggaugcauucc

SEQ ID NO: 519213 - RNA, 32 nt, Human
ugcggcugggggcagagagggagagccggucc

SEQ ID NO: 519214 - RNA, 23 nt, Human
ugcggcuguccggggccgcgcgg

SEQ ID NO: 519215 - RNA, 21 nt, Human
ugcggcugucgucaagcgcgg

SEQ ID NO: 519216 - RNA, 32 nt, Human
ugcggcugugugugcacgcgugugcaggagcg

SEQ ID NO: 519217 - RNA, 32 nt, Human
ugcggcuugcccagucccgccccucugacccc

SEQ ID NO: 519218 - RNA, 21 nt, Human
ugcgggaaagagggaggggga

SEQ ID NO: 519219 - RNA, 32 nt, Human
ugcgggaaaggcugcugguaacauucuguuga

SEQ ID NO: 519220 - RNA, 32 nt, Human
ugcgggaaccccacagcagcccagcggauuga

SEQ ID NO: 519221 - RNA, 32 nt, Human
ugcgggaaccuggucccagcuugaguuccugc

SEQ ID NO: 519222 - RNA, 32 nt, Human
ugcgggaaggagagaaggagaagaguugcgac

SEQ ID NO: 519223 - RNA, 32 nt, Human
ugcgggaccugccacugcacaccagcccagcu

SEQ ID NO: 519224 - RNA, 24 nt, Human
ugcgggacugcgcaggcgcgcggg

SEQ ID NO: 519225 - RNA, 32 nt, Human
ugcgggagcaucugaagagagaagggaugauu

SEQ ID NO: 519226 - RNA, 32 nt, Human
ugcgggagcucuguauggucaggauguagggg

SEQ ID NO: 519227 - RNA, 32 nt, Human
ugcgggaggaaggggacagggaagaagaggcu

SEQ ID NO: 519228 - RNA, 18 nt, Human
ugcgggaggaagugggga

SEQ ID NO: 519229 - RNA, 31 nt, Human
ugcgggaggagaccugguccaggaucaagga

SEQ ID NO: 519230 - RNA, 21 nt, Human
ugcgggaggaggcuuagcaga

SEQ ID NO: 519231 - RNA, 32 nt, Human
ugcgggcaagggagccgggcaagcccagggca

SEQ ID NO: 519232 - RNA, 19 nt, Human
ugcgggcaccagaaugcua

SEQ ID NO: 519233 - RNA, 32 nt, Human
ugcgggcaccuguaaucccagcuacuugggug

SEQ ID NO: 519234 - RNA, 32 nt, Human
ugcgggcagacucuuccuccacacagcagaca

SEQ ID NO: 519235 - RNA, 32 nt, Human
ugcgggcaggaggcggcggcagcagcgggacc

SEQ ID NO: 519236 - RNA, 32 nt, Human
ugcgggcaggggcugcagggaggaggagagga

SEQ ID NO: 519237 - RNA, 32 nt, Human
ugcgggccaagaagguccgggagcccacggcg

SEQ ID NO: 519238 - RNA, 32 nt, Human
ugcgggccacacagguagccacccugagcuca

SEQ ID NO: 519239 - RNA, 32 nt, Human
ugcgggccaccuccucuuccuuggcuccugcu

SEQ ID NO: 519240 - RNA, 32 nt, Human
ugcgggccaggcggaggcucaagcggggaucc

SEQ ID NO: 519241 - RNA, 32 nt, Human
ugcgggcccccuucaccccuuuucugucugca

SEQ ID NO: 519242 - RNA, 32 nt, Human
ugcgggccccggcugugaacccugcaccaagc

SEQ ID NO: 519243 - RNA, 27 nt, Human
ugcgggccccuauguuugaguuugaug

SEQ ID NO: 519244 - RNA, 32 nt, Human
ugcgggccggcagaggcuggcggggagcagcc

SEQ ID NO: 519245 - RNA, 32 nt, Human
ugcgggccucugcugucacacgcccggggugg

SEQ ID NO: 519246 - RNA, 32 nt, Human
ugcgggccuggcgggaggugggggagguccau

SEQ ID NO: 519247 - RNA, 32 nt, Human
ugcgggcggguggucuuagcuccaguccccca

SEQ ID NO: 519248 - RNA, 32 nt, Human
ugcgggcgugggcucccgggucgcaagccggg

SEQ ID NO: 519249 - RNA, 32 nt, Human
ugcgggcucaccaggcugcuggcuccgguacc

SEQ ID NO: 519250 - RNA, 32 nt, Human
ugcgggcucacugcaagcuccggcucccgggu

SEQ ID NO: 519251 - RNA, 32 nt, Human
ugcgggcucccuggcaggaugcugagcuuguc

SEQ ID NO: 519252 - RNA, 32 nt, Human
ugcgggcuccggggucaccacccugggcgacc

SEQ ID NO: 519253 - RNA, 32 nt, Human
ugcgggcucugccccacgaaagcccuguccug

SEQ ID NO: 519254 - RNA, 32 nt, Human
ugcgggcucugggggcagagguggcaggaaug

SEQ ID NO: 519255 - RNA, 32 nt, Human
ugcgggcugagggcaucucugagugucucugc

SEQ ID NO: 519256 - RNA, 32 nt, Human
ugcgggcuggcgccagcucaggaggacgcccc

SEQ ID NO: 519257 - RNA, 32 nt, Human
ugcgggcugucaggaaaccuaccugaacggga

SEQ ID NO: 519258 - RNA, 32 nt, Human
ugcggggaaccccuaccgccagccuccccgcc

SEQ ID NO: 519259 - RNA, 32 nt, Human
ugcggggacugaggcauggcagggaaacugcc

SEQ ID NO: 519260 - RNA, 20 nt, Human
ugcggggagaagacggagga

SEQ ID NO: 519261 - RNA, 32 nt, Human
ugcggggagagggagcgagcagaagaggaaga

SEQ ID NO: 519262 - RNA, 32 nt, Human
ugcggggagagggggaggaggggacggagagg

SEQ ID NO: 519263 - RNA, 22 nt, Human
ugcggggagauuugagagggga

SEQ ID NO: 519264 - RNA, 32 nt, Human
ugcggggaggggaaggacgccuccaagcccgc

SEQ ID NO: 519265 - RNA, 32 nt, Human
ugcggggagguguggaggugagggguuagagg

SEQ ID NO: 519266 - RNA, 25 nt, Human
ugcggggauuggagagggaugggga

SEQ ID NO: 519267 - RNA, 32 nt, Human
ugcggggcagaggcccuucucuccgccaaaug

SEQ ID NO: 519268 - RNA, 32 nt, Human
ugcggggcagaggcggcggccgcagcggcgca

SEQ ID NO: 519269 - RNA, 32 nt, Human
ugcggggcagggccuaacaaggaaaccugggc

SEQ ID NO: 519270 - RNA, 32 nt, Human
ugcggggcagugccccacuccuuugugcacaa

SEQ ID NO: 519271 - RNA, 32 nt, Human
ugcggggcaugcugggggcaggaggggcaggg

SEQ ID NO: 519272 - RNA, 32 nt, Human
ugcggggccagucccugcccucccaggagggg

SEQ ID NO: 519273 - RNA, 22 nt, Human
ugcggggccucccgccucgacc

SEQ ID NO: 519274 - RNA, 24 nt, Human
ugcggggcgcgcacccacgucccc

SEQ ID NO: 519275 - RNA, 32 nt, Human
ugcggggcgggcuccgcaggcccagccgccuc

SEQ ID NO: 519276 - RNA, 32 nt, Human
ugcggggcuggcagaggcgagggagguugcgg

SEQ ID NO: 519277 - RNA, 32 nt, Human
ugcgggggcucacgccuguaaucccagcacuu

SEQ ID NO: 519278 - RNA, 32 nt, Human
ugcgggggcuuuccccugggagccgcagcugu

SEQ ID NO: 519279 - RNA, 32 nt, Human
ugcgggggugccuugaaaacuucauuuuaaau

SEQ ID NO: 519280 - RNA, 32 nt, Human
ugcgggggugcuguuguccugccugugucuca

SEQ ID NO: 519281 - RNA, 32 nt, Human
ugcggggucccagcucugaauggaugcccaug

SEQ ID NO: 519282 - RNA, 32 nt, Human
ugcgggguccgcggggaagucuuggcggugga

SEQ ID NO: 519283 - RNA, 32 nt, Human
ugcgggguccgggagagcgggaugcuggccgg

SEQ ID NO: 519284 - RNA, 32 nt, Human
ugcggggugugaggacugagccggcuuccccu

SEQ ID NO: 519285 - RNA, 32 nt, Human
ugcgggucgguguuuggggagcuggaguccca

SEQ ID NO: 519286 - RNA, 32 nt, Human
ugcgggucucagaaccgagugagguguacauu

SEQ ID NO: 519287 - RNA, 32 nt, Human
ugcgggucuccucugagcugucuuaucucuca

SEQ ID NO: 519288 - RNA, 32 nt, Human
ugcgggucuccucugagcugucuuaucucucg

SEQ ID NO: 519289 - RNA, 32 nt, Human
ugcgggucuccucugaucuguuguaaugcuga

SEQ ID NO: 519290 - RNA, 32 nt, Human
ugcgggugaacaaagcagccacgaggugcaac

SEQ ID NO: 519291 - RNA, 20 nt, Human
ugcgggugaagggaugggga

SEQ ID NO: 519292 - RNA, 32 nt, Human
ugcgggugacugcuucagggcuucuccgcgac

SEQ ID NO: 519293 - RNA, 32 nt, Human
ugcgggugaggaacuuguugcgcccgcggcug

SEQ ID NO: 519294 - RNA, 18 nt, Human
ugcgggugcacugccuca

SEQ ID NO: 519295 - RNA, 32 nt, Human
ugcgggugcacugccucagggaagaaguugag

SEQ ID NO: 519296 - RNA, 32 nt, Human
ugcgggugcucucacccucccuucucucccuc

SEQ ID NO: 519297 - RNA, 32 nt, Human
ugcggguggggaaggauggaaggccuuggauu

SEQ ID NO: 519298 - RNA, 23 nt, Human
ugcgggugguaaccaguggaaga

SEQ ID NO: 519299 - RNA, 32 nt, Human
ugcggguggucugccuguguauuuuggucaug

SEQ ID NO: 519300 - RNA, 32 nt, Human
ugcggguguucgccaccaugcccagcuaauuu

SEQ ID NO: 519301 - RNA, 32 nt, Human
ugcggguguugggaaccaugccugccagccag

SEQ ID NO: 519302 - RNA, 32 nt, Human
ugcggguguuugcaggagguugcaguacucgc

SEQ ID NO: 519303 - RNA, 32 nt, Human
ugcggguugcaggaguucaggaaaggaggugg

SEQ ID NO: 519304 - RNA, 32 nt, Human
ugcgguagaagaggaagggaaacacgaacaaa

SEQ ID NO: 519305 - RNA, 24 nt, Human
ugcgguagccgccgccgccgccgc

SEQ ID NO: 519306 - RNA, 32 nt, Human
ugcgguagcucauaccuguaaucccaggacuu

SEQ ID NO: 519307 - RNA, 32 nt, Human
ugcgguaguagccuggcuuugcucugacggcg

SEQ ID NO: 519308 - RNA, 32 nt, Human
ugcgguaugaaggaugugaagauggagggcuu

SEQ ID NO: 519309 - RNA, 32 nt, Human
ugcggucacagcucacugccuccugggcucag

SEQ ID NO: 519310 - RNA, 32 nt, Human
ugcggucacgagacgcccccaagggaguaucc

SEQ ID NO: 519311 - RNA, 32 nt, Human
ugcggucacucgcacaccacagccugaagcuc

SEQ ID NO: 519312 - RNA, 32 nt, Human
ugcggucaugccacugcacuccagccugggug

SEQ ID NO: 519313 - RNA, 22 nt, Human
ugcggucccggagccgcgcggg

SEQ ID NO: 519314 - RNA, 32 nt, Human
ugcgguccgaaugcaugcauucaugaguccau

SEQ ID NO: 519315 - RNA, 22 nt, Human
ugcggucgcagaggccgacgga

SEQ ID NO: 519316 - RNA, 32 nt, Human
ugcggucgcucuguggcaagugugugagaagu

SEQ ID NO: 519317 - RNA, 32 nt, Human
ugcggucucaggcugcagccuagcucgguaac

SEQ ID NO: 519318 - RNA, 32 nt, Human
ugcggucugcaucagccucugggaaaccacag

SEQ ID NO: 519319 - RNA, 32 nt, Human
ugcggugaagaagaugguagaaaacagucugg

SEQ ID NO: 519320 - RNA, 18 nt, Human
ugcggugacaccugcucc

SEQ ID NO: 519321 - RNA, 32 nt, Human
ugcggugacaugcaccuguaaucccaccuacu

SEQ ID NO: 519322 - RNA, 32 nt, Human
ugcggugaccacccugguccugaaaaguccag

SEQ ID NO: 519323 - RNA, 32 nt, Human
ugcggugaccagcagcacacagcaaccagucu

SEQ ID NO: 519324 - RNA, 32 nt, Human
ugcggugaccugccagcaccugccgcagccuu

SEQ ID NO: 519325 - RNA, 32 nt, Human
ugcggugacucacgccuauaaucccagcacuu

SEQ ID NO: 519326 - RNA, 32 nt, Human
ugcggugacucaugccuguaaucccaguacuc

SEQ ID NO: 519327 - RNA, 32 nt, Human
ugcggugacucaugccuguaaucccugcacuu

SEQ ID NO: 519328 - RNA, 32 nt, Human
ugcggugacucgcaccuguaaucccagcauuu

SEQ ID NO: 519329 - RNA, 32 nt, Human
ugcggugacugcacuuucccuggaguggaagc

SEQ ID NO: 519330 - RNA, 32 nt, Human
ugcggugcagagcagagcaggcaggggugggg

SEQ ID NO: 519331 - RNA, 32 nt, Human
ugcggugccucacaucuguaaucccaacacuu

SEQ ID NO: 519332 - RNA, 32 nt, Human
ugcggugccucaugccuguaaucccagcacuu

SEQ ID NO: 519333 - RNA, 32 nt, Human
ugcggugccuggguggggcugcuccuccaggg

SEQ ID NO: 519334 - RNA, 32 nt, Human
ugcggugcuaucucccccagccccauccucug

SEQ ID NO: 519335 - RNA, 32 nt, Human
ugcgguggaaggaucaccugagcccaggaggu

SEQ ID NO: 519336 - RNA, 31 nt, Human
ugcgguggcacaaucucggcucacugcaacc

SEQ ID NO: 519337 - RNA, 32 nt, Human
ugcgguggcacacaccuguaaucccagcuacc

SEQ ID NO: 519338 - RNA, 32 nt, Human
ugcgguggcacaugccuguaaucccagcacuu

SEQ ID NO: 519339 - RNA, 32 nt, Human
ugcgguggcacccgccuguaaucccagcuacu

SEQ ID NO: 519340 - RNA, 32 nt, Human
ugcgguggcaggcgccuguaaucccaguuacu

SEQ ID NO: 519341 - RNA, 32 nt, Human
ugcgguggccaugucggcagggccagggccuc

SEQ ID NO: 519342 - RNA, 32 nt, Human
ugcgguggcccacaucuguaaucccagcacuu

SEQ ID NO: 519343 - RNA, 32 nt, Human
ugcgguggcgggcaccuguagucccagcuacu

SEQ ID NO: 519344 - RNA, 32 nt, Human
ugcgguggcuaacaccuguaaucccagcacuu

SEQ ID NO: 519345 - RNA, 32 nt, Human
ugcgguggcuauaauccuagcacuuugggagg

SEQ ID NO: 519346 - RNA, 32 nt, Human
ugcgguggcucaagccuguaaucccagcacuu

SEQ ID NO: 519347 - RNA, 23 nt, Human
ugcgguggcucacaccuauaauc

SEQ ID NO: 519348 - RNA, 32 nt, Human
ugcgguggcucacaccuauaaucccagcacuu

SEQ ID NO: 519349 - RNA, 32 nt, Human
ugcgguggcucacaccugcaaucccagcacuu

SEQ ID NO: 519350 - RNA, 23 nt, Human
ugcgguggcucacaccuguaauc

SEQ ID NO: 519351 - RNA, 32 nt, Human
ugcgguggcucacaccuguaaucccagcacuc

SEQ ID NO: 519352 - RNA, 32 nt, Human
ugcgguggcucacaccuguaaucccagcacuu

SEQ ID NO: 519353 - RNA, 32 nt, Human
ugcgguggcucacaccuguaaucccagcaguu

SEQ ID NO: 519354 - RNA, 32 nt, Human
ugcgguggcucacaccuguaaucccagcauuu

SEQ ID NO: 519355 - RNA, 32 nt, Human
ugcgguggcucacaccuguaaucccagcgcuu

SEQ ID NO: 519356 - RNA, 32 nt, Human
ugcgguggcucacaccuguaauccuagcacuu

SEQ ID NO: 519357 - RNA, 32 nt, Human
ugcgguggcucacaccuguaaucucagcacuu

SEQ ID NO: 519358 - RNA, 32 nt, Human
ugcgguggcucacaccuguaauuccagcacuu

SEQ ID NO: 519359 - RNA, 32 nt, Human
ugcgguggcucacaccugucaucccagcacuu

SEQ ID NO: 519360 - RNA, 32 nt, Human
ugcgguggcucaccccuuuaaucccagcacuu

SEQ ID NO: 519361 - RNA, 32 nt, Human
ugcgguggcucacgccuauaaucccagcacuu

SEQ ID NO: 519362 - RNA, 23 nt, Human
ugcgguggcucacgccuguaauc

SEQ ID NO: 519363 - RNA, 32 nt, Human
ugcgguggcucacgccuguaaucacacuuucg

SEQ ID NO: 519364 - RNA, 32 nt, Human
ugcgguggcucacgccuguaaucccaacacuu

SEQ ID NO: 519365 - RNA, 32 nt, Human
ugcgguggcucacgccuguaaucccagcaccu

SEQ ID NO: 519366 - RNA, 32 nt, Human
ugcgguggcucacgccuguaaucccagcacug

SEQ ID NO: 519367 - RNA, 32 nt, Human
ugcgguggcucacgccuguaaucccagcacuu

SEQ ID NO: 519368 - RNA, 32 nt, Human
ugcgguggcucacgccuguaaucccagcccuu

SEQ ID NO: 519369 - RNA, 32 nt, Human
ugcgguggcucacgccuguaaucccagcucuu

SEQ ID NO: 519370 - RNA, 32 nt, Human
ugcgguggcucacgccuguaauccuagcacuu

SEQ ID NO: 519371 - RNA, 32 nt, Human
ugcgguggcucacgcuugcaaucccagugcuu

SEQ ID NO: 519372 - RNA, 32 nt, Human
ugcgguggcucacgcuuguaaucccagcacuu

SEQ ID NO: 519373 - RNA, 32 nt, Human
ugcgguggcucacgucuguaaucccagcaccu

SEQ ID NO: 519374 - RNA, 32 nt, Human
ugcgguggcucacgucuguaaucccagcacuu

SEQ ID NO: 519375 - RNA, 32 nt, Human
ugcgguggcucacgucuguaaucucagcacuu

SEQ ID NO: 519376 - RNA, 32 nt, Human
ugcgguggcucacuccuguaauccuagcaguu

SEQ ID NO: 519377 - RNA, 32 nt, Human
ugcgguggcucaggccuguaaucccagcacuu

SEQ ID NO: 519378 - RNA, 32 nt, Human
ugcgguggcucauaccuguaaucccagcauuu

SEQ ID NO: 519379 - RNA, 32 nt, Human
ugcgguggcucaugccuauaaucccagcaccu

SEQ ID NO: 519380 - RNA, 32 nt, Human
ugcgguggcucaugccuauaaucccagcacuu

SEQ ID NO: 519381 - RNA, 32 nt, Human
ugcgguggcucaugccuggaaucccagcacuu

SEQ ID NO: 519382 - RNA, 20 nt, Human
ugcgguggcucaugccugua

SEQ ID NO: 519383 - RNA, 23 nt, Human
ugcgguggcucaugccuguaauc

SEQ ID NO: 519384 - RNA, 32 nt, Human
ugcgguggcucaugccuguaaucccaccacuu

SEQ ID NO: 519385 - RNA, 32 nt, Human
ugcgguggcucaugccuguaaucccagcacua

SEQ ID NO: 519386 - RNA, 32 nt, Human
ugcgguggcucaugccuguaaucccagcacug

SEQ ID NO: 519387 - RNA, 32 nt, Human
ugcgguggcucaugccuguaaucccagcacuu

SEQ ID NO: 519388 - RNA, 32 nt, Human
ugcgguggcucaugccuguaaucccagcauuu

SEQ ID NO: 519389 - RNA, 32 nt, Human
ugcgguggcucaugccuguaaucccagcgcuu

SEQ ID NO: 519390 - RNA, 32 nt, Human
ugcgguggcucaugccuguaaucccagugcuu

SEQ ID NO: 519391 - RNA, 32 nt, Human
ugcgguggcucaugccuguaaucccggcacuu

SEQ ID NO: 519392 - RNA, 32 nt, Human
ugcgguggcucaugccuguaauccuagcacuu

SEQ ID NO: 519393 - RNA, 32 nt, Human
ugcgguggcucaugccuguaauccuagcauuu

SEQ ID NO: 519394 - RNA, 32 nt, Human
ugcgguggcucaugucuguaaucccagcacuc

SEQ ID NO: 519395 - RNA, 32 nt, Human
ugcgguggcucaugucuguaaucccagcacuu

SEQ ID NO: 519396 - RNA, 32 nt, Human
ugcgguggcucccgccuguaauccuagcacuu

SEQ ID NO: 519397 - RNA, 32 nt, Human
ugcgguggcuccugccuauaaucccagcacuu

SEQ ID NO: 519398 - RNA, 32 nt, Human
ugcgguggcuuacaccuguaaucccaacacuu

SEQ ID NO: 519399 - RNA, 32 nt, Human
ugcgguggcuuacaccuguaaucccagcacuu

SEQ ID NO: 519400 - RNA, 32 nt, Human
ugcggugggcugggguggugccacugcgcucc

SEQ ID NO: 519401 - RNA, 32 nt, Human
ugcggugggucugaggcuaggugcucuggguu

SEQ ID NO: 519402 - RNA, 31 nt, Human
ugcggugguacaaucucggcucacugcaacc

SEQ ID NO: 519403 - RNA, 31 nt, Human
ugcgguggugcaaucucagcucacugcaacc

SEQ ID NO: 519404 - RNA, 32 nt, Human
ugcgguggugcuuucugggcagccagggguuc

SEQ ID NO: 519405 - RNA, 32 nt, Human
ugcggugguucacaccuguaauccaagcacuu

SEQ ID NO: 519406 - RNA, 32 nt, Human
ugcggugguucacgcuuguaaucccaucacuu

SEQ ID NO: 519407 - RNA, 32 nt, Human
ugcggugguucaugccuauaaucccagugcuu

SEQ ID NO: 519408 - RNA, 32 nt, Human
ugcggugguucgugccuguaaucccagcucuu

SEQ ID NO: 519409 - RNA, 32 nt, Human
ugcggugucucacaccuguaaucccagcacuu

SEQ ID NO: 519410 - RNA, 32 nt, Human
ugcggugucucaugccuguaaucccagcacuu

SEQ ID NO: 519411 - RNA, 32 nt, Human
ugcgguguuggggguggguuggggaggguggu

SEQ ID NO: 519412 - RNA, 32 nt, Human
ugcgguucauuucugauuuccucaucuuuugc

SEQ ID NO: 519413 - RNA, 32 nt, Human
ugcgguugagcucucugccacuuucuucaaug

SEQ ID NO: 519414 - RNA, 32 nt, Human
ugcgguuucccaagccuuuguccaucucagcc

SEQ ID NO: 519415 - RNA, 32 nt, Human
ugcgguuuugcaagagccgggaagaaacuuaa

SEQ ID NO: 519416 - RNA, 32 nt, Human
ugcguaacaggcccgaugagggugccaggcug

SEQ ID NO: 519417 - RNA, 32 nt, Human
ugcguaaugugcgugugaagagacugggggag

SEQ ID NO: 519418 - RNA, 32 nt, Human
ugcguacaaaccugccuagcuguuguaaguuu

SEQ ID NO: 519419 - RNA, 32 nt, Human
ugcguaccccucuccagugucaaccuggggcu

SEQ ID NO: 519420 - RNA, 32 nt, Human
ugcguacuuacuccuccauauucuuucaaccc

SEQ ID NO: 519421 - RNA, 32 nt, Human
ugcguaggaaucuuauuaaaaugcagauucug

SEQ ID NO: 519422 - RNA, 29 nt, Human
ugcguauaacaucagugaggaagacugca

SEQ ID NO: 519423 - RNA, 32 nt, Human
ugcguauaugguaaagagaucuuuucagcugc

SEQ ID NO: 519424 - RNA, 32 nt, Human
ugcguaucccccagccuugagggaagaugaag

SEQ ID NO: 519425 - RNA, 32 nt, Human
ugcguaugcuccaccacgccugggcgacucgg

SEQ ID NO: 519426 - RNA, 32 nt, Human
ugcguauggucuguguggggccccuuucacag

SEQ ID NO: 519427 - RNA, 22 nt, Human
ugcguauguggcuccuccaggu

SEQ ID NO: 519428 - RNA, 32 nt, Human
ugcguauguguaugacuauggguggguggugg

SEQ ID NO: 519429 - RNA, 29 nt, Human
ugcguauguguguguaugccuggagauug

SEQ ID NO: 519430 - RNA, 32 nt, Human
ugcguauuugccaaagacgacagggugggcug

SEQ ID NO: 519431 - RNA, 32 nt, Human
ugcgucacagcccaggucaaggagaacuggcu

SEQ ID NO: 519432 - RNA, 32 nt, Human
ugcgucacugaacuccggccugggugacagaa

SEQ ID NO: 519433 - RNA, 32 nt, Human
ugcgucacugcacuccaaccugggugacagag

SEQ ID NO: 519434 - RNA, 32 nt, Human
ugcgucacugcacuccagccugagcaacagag

SEQ ID NO: 519435 - RNA, 32 nt, Human
ugcgucacugcacuccagccugggcgacagag

SEQ ID NO: 519436 - RNA, 32 nt, Human
ugcgucacugcacugcagccugggugacagaa

SEQ ID NO: 519437 - RNA, 32 nt, Human
ugcgucacugcagccuccaccucccgggcucc

SEQ ID NO: 519438 - RNA, 32 nt, Human
ugcgucagagcgagacucagaggcuccgaacu

SEQ ID NO: 519439 - RNA, 21 nt, Human
ugcgucagcaauuuccugcuc

SEQ ID NO: 519440 - RNA, 32 nt, Human
ugcgucagccaaggaaagggaagugcugcuua

SEQ ID NO: 519441 - RNA, 32 nt, Human
ugcgucagccucccccaccccucugcagacug

SEQ ID NO: 519442 - RNA, 31 nt, Human
ugcgucaucagcuagagccccgccgcgcugg

SEQ ID NO: 519443 - RNA, 32 nt, Human
ugcgucauuuuuccuuugcuuucucuuuacuu

SEQ ID NO: 519444 - RNA, 32 nt, Human
ugcguccagcucccugaaucucugcugcugcu

SEQ ID NO: 519445 - RNA, 32 nt, Human
ugcgucccauaucuggacccagaagggacuuc

SEQ ID NO: 519446 - RNA, 32 nt, Human
ugcguccccugccccggccucagccagcccug

SEQ ID NO: 519447 - RNA, 32 nt, Human
ugcgucccucugggcgccucaggccccaggau

SEQ ID NO: 519448 - RNA, 32 nt, Human
ugcguccggcugggauuccacucacugggacu

SEQ ID NO: 519449 - RNA, 32 nt, Human
ugcguccgggggaggggaaggaagggccgcug

SEQ ID NO: 519450 - RNA, 32 nt, Human
ugcguccuccccaggcugaaguguccucaggu

SEQ ID NO: 519451 - RNA, 32 nt, Human
ugcguccucuuaucuucugccaggaucaccuc

SEQ ID NO: 519452 - RNA, 32 nt, Human
ugcguccugcccauguggaaagugaccacuuu

SEQ ID NO: 519453 - RNA, 32 nt, Human
ugcguccugguuccuguuuagcuguucugaaa

SEQ ID NO: 519454 - RNA, 32 nt, Human
ugcguccuuucaggccccgcguuguuacagga

SEQ ID NO: 519455 - RNA, 18 nt, Human
ugcgucgccuccaggcgg

SEQ ID NO: 519456 - RNA, 31 nt, Human
ugcgucuaucaugauuccuguugagagggcu

SEQ ID NO: 519457 - RNA, 32 nt, Human
ugcgucucauuggcucagguccugcagccgcu

SEQ ID NO: 519458 - RNA, 18 nt, Human
ugcgucucccucucugca

SEQ ID NO: 519459 - RNA, 31 nt, Human
ugcgucucccucucugcagccuguguaagcu

SEQ ID NO: 519460 - RNA, 18 nt, Human
ugcgucucucugucugca

SEQ ID NO: 519461 - RNA, 32 nt, Human
ugcgucugagucugggcugagaccaguccugg

SEQ ID NO: 519462 - RNA, 32 nt, Human
ugcgucugcucuucugugcccaggguggcugc

SEQ ID NO: 519463 - RNA, 32 nt, Human
ugcgucugggccugagacgugcauggagggcu

SEQ ID NO: 519464 - RNA, 23 nt, Human
ugcgucugucguugugcuuuuuu

SEQ ID NO: 519465 - RNA, 32 nt, Human
ugcgucuuaaagccagcuccucugccagaccc

SEQ ID NO: 519466 - RNA, 32 nt, Human
ugcgucuuaguuccgcccuccuguccaucagg

SEQ ID NO: 519467 - RNA, 32 nt, Human
ugcgucuucuaguuuauuccuccuggggacau

SEQ ID NO: 519468 - RNA, 32 nt, Human
ugcgucuuucccucuuccgcugccucauuccu

SEQ ID NO: 519469 - RNA, 32 nt, Human
ugcgugaaaaggcccugagaucaaugaggaag

SEQ ID NO: 519470 - RNA, 32 nt, Human
ugcgugaacuuggccucuccagcccuugcagg

SEQ ID NO: 519471 - RNA, 32 nt, Human
ugcgugacagcggagggcuaggaaaaggcgca

SEQ ID NO: 519472 - RNA, 32 nt, Human
ugcgugagagugaaaccaagaagcggaugggg

SEQ ID NO: 519473 - RNA, 32 nt, Human
ugcgugaggaagagagcuagagacuggacagg

SEQ ID NO: 519474 - RNA, 32 nt, Human
ugcgugcagcaugggcggcgucggggagccgg

SEQ ID NO: 519475 - RNA, 32 nt, Human
ugcgugcauccagcagccccuucaagacauaa

SEQ ID NO: 519476 - RNA, 32 nt, Human
ugcgugccauccagagucaucucagcccugcc

SEQ ID NO: 519477 - RNA, 32 nt, Human
ugcgugcccaccaggauuuccugugagggccc

SEQ ID NO: 519478 - RNA, 32 nt, Human
ugcgugccuauaauccuagcuacucagguggc

SEQ ID NO: 519479 - RNA, 32 nt, Human
ugcgugccugugugcugggaucuagcguggcc

SEQ ID NO: 519480 - RNA, 32 nt, Human
ugcgugcgcgagugggagguggcaggccugcg

SEQ ID NO: 519481 - RNA, 32 nt, Human
ugcgugcggugaggaggccccgccaagagacu

SEQ ID NO: 519482 - RNA, 32 nt, Human
ugcgugcugcgaggugggggacccugggcagg

SEQ ID NO: 519483 - RNA, 32 nt, Human
ugcgugcuuguuuucuccuuugcccaaguucc

SEQ ID NO: 519484 - RNA, 32 nt, Human
ugcguggaagcccugucugcagccucugcuca

SEQ ID NO: 519485 - RNA, 32 nt, Human
ugcguggacccgugagcucaggagccucagac

SEQ ID NO: 519486 - RNA, 32 nt, Human
ugcguggacuccugggagcuccugcucccuac

SEQ ID NO: 519487 - RNA, 32 nt, Human
ugcguggagagggaguggugucagagggucag

SEQ ID NO: 519488 - RNA, 32 nt, Human
ugcguggagagggugggugcaggaggcagacc

SEQ ID NO: 519489 - RNA, 32 nt, Human
ugcguggagcugcaggcuucagcugccuucaa

SEQ ID NO: 519490 - RNA, 32 nt, Human
ugcguggagguccugcaucaguuugaccaggu

SEQ ID NO: 519491 - RNA, 32 nt, Human
ugcguggagguggagccugcggcuggaguaag

SEQ ID NO: 519492 - RNA, 32 nt, Human
ugcguggauauugcccagcucugccucccuug

SEQ ID NO: 519493 - RNA, 32 nt, Human
ugcguggccaccugaaugcugccuuaucacaa

SEQ ID NO: 519494 - RNA, 32 nt, Human
ugcguggccugcagaguccauuccaucaugau

SEQ ID NO: 519495 - RNA, 32 nt, Human
ugcguggccuggaugguuggaggcagagcuug

SEQ ID NO: 519496 - RNA, 32 nt, Human
ugcguggcgguggaccagccagcugcugucca

SEQ ID NO: 519497 - RNA, 32 nt, Human
ugcgugggcaaguggcacuggccacucugccu

SEQ ID NO: 519498 - RNA, 21 nt, Human
ugcgugggcggggcaggggcg

SEQ ID NO: 519499 - RNA, 32 nt, Human
ugcgugggcugugccaucugaugucuauuccc

SEQ ID NO: 519500 - RNA, 32 nt, Human
ugcguggggacauccugggucaucucagucau

SEQ ID NO: 519501 - RNA, 32 nt, Human
ugcguggggcuccaccucacacccaccccugg

SEQ ID NO: 519502 - RNA, 32 nt, Human
ugcgugguggcugcaggcugagcucuaaccag

SEQ ID NO: 519503 - RNA, 32 nt, Human
ugcguguaaaccacagccucagaccagcuaug

SEQ ID NO: 519504 - RNA, 32 nt, Human
ugcguguaucuccuccaccucucccauuccau

SEQ ID NO: 519505 - RNA, 32 nt, Human
ugcgugucagcccuuggugguggccagggaga

SEQ ID NO: 519506 - RNA, 32 nt, Human
ugcguguccagaaggcaagagagggcggcucc

SEQ ID NO: 519507 - RNA, 32 nt, Human
ugcguguccuccccuccacugccugcaugggg

SEQ ID NO: 519508 - RNA, 32 nt, Human
ugcguguccuucaguucuuuggcucugauucc

SEQ ID NO: 519509 - RNA, 32 nt, Human
ugcgugucgaaacagauccagcagugcaaaga

SEQ ID NO: 519510 - RNA, 32 nt, Human
ugcgugucuuuuccuuugucugucuuuuucuu

SEQ ID NO: 519511 - RNA, 29 nt, Human
ugcgugugccugugugugaaccugggggc

SEQ ID NO: 519512 - RNA, 29 nt, Human
ugcgugugccugugugugccugggaguga

SEQ ID NO: 519513 - RNA, 32 nt, Human
ugcguguggccucagcuugcagaggagugcac

SEQ ID NO: 519514 - RNA, 32 nt, Human
ugcguguggugggcaagcuccucaaaugguau

SEQ ID NO: 519515 - RNA, 32 nt, Human
ugcgugugugagagcgcgcgagggagugugag

SEQ ID NO: 519516 - RNA, 32 nt, Human
ugcguguguguagacacacacgcauacacaca

SEQ ID NO: 519517 - RNA, 20 nt, Human
ugcguguguguccuaccggg

SEQ ID NO: 519518 - RNA, 20 nt, Human
ugcguguguuugccccaagg

SEQ ID NO: 519519 - RNA, 32 nt, Human
ugcguguuaugcugguuuccugggugacaaaa

SEQ ID NO: 519520 - RNA, 32 nt, Human
ugcguguuccacuugaggcccuuuggugucuu

SEQ ID NO: 519521 - RNA, 32 nt, Human
ugcguuacacccgagucugccucucggagcag

SEQ ID NO: 519522 - RNA, 32 nt, Human
ugcguuagcccccugcacuguccuucccauag

SEQ ID NO: 519523 - RNA, 32 nt, Human
ugcguucacaugcacauuugcuagcccagagc

SEQ ID NO: 519524 - RNA, 32 nt, Human
ugcguucacccucacaccacacgccuuaaauc

SEQ ID NO: 519525 - RNA, 32 nt, Human
ugcguucacggcaggauucgguuaggaggaac

SEQ ID NO: 519526 - RNA, 32 nt, Human
ugcguucagacccugcaggcugggcuggccug

SEQ ID NO: 519527 - RNA, 32 nt, Human
ugcguucagcagacugguuugcagugaauuuu

SEQ ID NO: 519528 - RNA, 32 nt, Human
ugcguuccugcaggcuucaucuggcccuaugg

SEQ ID NO: 519529 - RNA, 32 nt, Human
ugcguucggucaccucguaggccagccuaguu

SEQ ID NO: 519530 - RNA, 32 nt, Human
ugcguucucuccaccagcucccggcucaccca

SEQ ID NO: 519531 - RNA, 32 nt, Human
ugcguugaucauucucagaucauugauuggcc

SEQ ID NO: 519532 - RNA, 32 nt, Human
ugcguugccaccagauccugcccagcaauggc

SEQ ID NO: 519533 - RNA, 32 nt, Human
ugcguugccacuugucuuaacucugaauauuu

SEQ ID NO: 519534 - RNA, 32 nt, Human
ugcguuggaggcugugacagagcugagagccu

SEQ ID NO: 519535 - RNA, 32 nt, Human
ugcguuggcugcggccuggcaccaaaggggcg

SEQ ID NO: 519536 - RNA, 32 nt, Human
ugcguugguuucucucauagaggcauuaacua

SEQ ID NO: 519537 - RNA, 32 nt, Human
ugcguugucugacaucgucgcucucuucauaa

SEQ ID NO: 519538 - RNA, 32 nt, Human
ugcguuguggucuccgguggggccagaucccc

SEQ ID NO: 519539 - RNA, 32 nt, Human
ugcguuuccaaccucggagaauuccaggcacu

SEQ ID NO: 519540 - RNA, 32 nt, Human
ugcguuugcaauggcugcuacugugaacuugg

SEQ ID NO: 519541 - RNA, 32 nt, Human
ugcguuugucccaggcucgggggcucaguggg

SEQ ID NO: 519542 - RNA, 32 nt, Human
ugcguuuguccucugcugccaucugccccggc

SEQ ID NO: 519543 - RNA, 32 nt, Human
ugcguuugucucuucacuaagaguaaacuggg

SEQ ID NO: 519544 - RNA, 32 nt, Human
ugcguuugugugugugcguguauguaugugua

SEQ ID NO: 519545 - RNA, 32 nt, Human
ugcuaaaaauaagaaaaauuagccaggagugg

SEQ ID NO: 519546 - RNA, 32 nt, Human
ugcuaaaacacaugcuaugagcacucgaggaa

SEQ ID NO: 519547 - RNA, 32 nt, Human
ugcuaaaagagcuccagguguugucuguuuug

SEQ ID NO: 519548 - RNA, 32 nt, Human
ugcuaaaagggugggaguagcaggagggucuu

SEQ ID NO: 519549 - RNA, 32 nt, Human
ugcuaaaauaaaagucucugaaguauuccaug

SEQ ID NO: 519550 - RNA, 32 nt, Human
ugcuaaagaaagggagaucaauggaguugccu

SEQ ID NO: 519551 - RNA, 32 nt, Human
ugcuaaaucacaaagacaacucuccuugcaaa

SEQ ID NO: 519552 - RNA, 32 nt, Human
ugcuaaaucacaucugccucauagagaaagga

SEQ ID NO: 519553 - RNA, 32 nt, Human
ugcuaaaugaauaucccugcucugcuggucaa

SEQ ID NO: 519554 - RNA, 32 nt, Human
ugcuaaauguggcaagguuucucagucuuugc

SEQ ID NO: 519555 - RNA, 32 nt, Human
ugcuaaauuucauuuuggcuuugcaagucaug

SEQ ID NO: 519556 - RNA, 32 nt, Human
ugcuaacaaaagaagauauggaaguaacagag

SEQ ID NO: 519557 - RNA, 32 nt, Human
ugcuaacacaguggcaguguuagaugaagaug

SEQ ID NO: 519558 - RNA, 32 nt, Human
ugcuaacaccucagagcuguccucuucucuag

SEQ ID NO: 519559 - RNA, 32 nt, Human
ugcuaacacgaggaugggggacuuggaugcug

SEQ ID NO: 519560 - RNA, 32 nt, Human
ugcuaacacuuggcauugucagucucuuaaaa

SEQ ID NO: 519561 - RNA, 32 nt, Human
ugcuaacagcauaaacaugcagggggugggag

SEQ ID NO: 519562 - RNA, 32 nt, Human
ugcuaacaggagacuugcaggagaccguguga

SEQ ID NO: 519563 - RNA, 32 nt, Human
ugcuaacauggugaaaccccgucucuacuaaa

SEQ ID NO: 519564 - RNA, 32 nt, Human
ugcuaacauugaaacuguugguggugauggau

SEQ ID NO: 519565 - RNA, 32 nt, Human
ugcuaaccaaaacccaaaggcucuuuucagag

SEQ ID NO: 519566 - RNA, 32 nt, Human
ugcuaaccaagcucuugacucuguuucccuua

SEQ ID NO: 519567 - RNA, 32 nt, Human
ugcuaaccuguaaucccagcuacuugggaggc

SEQ ID NO: 519568 - RNA, 32 nt, Human
ugcuaaccuuucaggauucagagaaagaugaa

SEQ ID NO: 519569 - RNA, 32 nt, Human
ugcuaacuagcuguuuaaccucgcuuagggca

SEQ ID NO: 519570 - RNA, 32 nt, Human
ugcuaacuauuuaugcauuagcuccccaaggg

SEQ ID NO: 519571 - RNA, 32 nt, Human
ugcuaacuccuaaacugggacccccuacccug

SEQ ID NO: 519572 - RNA, 32 nt, Human
ugcuaacugcccuucucuccucccucucaucc

SEQ ID NO: 519573 - RNA, 32 nt, Human
ugcuaagaagcagcaguggggcuuuugaauuu

SEQ ID NO: 519574 - RNA, 32 nt, Human
ugcuaagaagggaaggagauucccuggaggcc

SEQ ID NO: 519575 - RNA, 23 nt, Human
ugcuaagauggaaagggcugcuu

SEQ ID NO: 519576 - RNA, 32 nt, Human
ugcuaagcacuauuuuuagcauguuauuuaua

SEQ ID NO: 519577 - RNA, 32 nt, Human
ugcuaagcacuggccccacagagccauggucc

SEQ ID NO: 519578 - RNA, 22 nt, Human
ugcuaagcccuuggcaggggug

SEQ ID NO: 519579 - RNA, 32 nt, Human
ugcuaagcucaugcagggaagggaggcuggaa

SEQ ID NO: 519580 - RNA, 32 nt, Human
ugcuaagcuuuccugguaugcgcccuauuuuu

SEQ ID NO: 519581 - RNA, 20 nt, Human
ugcuaaggaagcuguggcca

SEQ ID NO: 519582 - RNA, 32 nt, Human
ugcuaaggaguucucaucccucugucaggguc

SEQ ID NO: 519583 - RNA, 32 nt, Human
ugcuaaggccaucaaaccuauugaucggaagu

SEQ ID NO: 519584 - RNA, 32 nt, Human
ugcuaagggaaaggggaaagaaagggaaaagg

SEQ ID NO: 519585 - RNA, 32 nt, Human
ugcuaagggcuuccaaacauugccugcacccc

SEQ ID NO: 519586 - RNA, 32 nt, Human
ugcuaaggguaagggagagggagggagccggg

SEQ ID NO: 519587 - RNA, 32 nt, Human
ugcuaaguacuaccccuucaucuuccauggau

SEQ ID NO: 519588 - RNA, 32 nt, Human
ugcuaagugagcuuggaguguaccagucaagg

SEQ ID NO: 519589 - RNA, 32 nt, Human
ugcuaagugcaauagggguauguagaaaagag

SEQ ID NO: 519590 - RNA, 32 nt, Human
ugcuaauaccaguccccucccuucccuuuggc

SEQ ID NO: 519591 - RNA, 32 nt, Human
ugcuaauagaaaagccuagucuucucaagcaa

SEQ ID NO: 519592 - RNA, 32 nt, Human
ugcuaaucagugucagugaauccacagucuuu

SEQ ID NO: 519593 - RNA, 32 nt, Human
ugcuaaucccccagugcucuggaguuuggacc

SEQ ID NO: 519594 - RNA, 32 nt, Human
ugcuaaucucaaggagcuuccagugcagaggg

SEQ ID NO: 519595 - RNA, 32 nt, Human
ugcuaaucuucugcuuauuuuucagccuuuaa

SEQ ID NO: 519596 - RNA, 32 nt, Human
ugcuaaugaguauaggauuuccuuuugaguga

SEQ ID NO: 519597 - RNA, 32 nt, Human
ugcuaauggaagcaccacggcagcuuuguuug

SEQ ID NO: 519598 - RNA, 32 nt, Human
ugcuaauguguuaauagcuuuuaaaagaaaag

SEQ ID NO: 519599 - RNA, 32 nt, Human
ugcuaauucuggggagguaccugcucuaguaa

SEQ ID NO: 519600 - RNA, 32 nt, Human
ugcuaauugagucugauaaaagucuucuuuga

SEQ ID NO: 519601 - RNA, 32 nt, Human
ugcuacaacaucacuaauuuggcuuucacauu

SEQ ID NO: 519602 - RNA, 32 nt, Human
ugcuacaauuuccauuacagagacaucuguug

SEQ ID NO: 519603 - RNA, 32 nt, Human
ugcuacacaaaauacaaaaacagaugaaggag

SEQ ID NO: 519604 - RNA, 32 nt, Human
ugcuacacaggcaggaaugcgguugggaggca

SEQ ID NO: 519605 - RNA, 32 nt, Human
ugcuacacucgucccccuccugccucaucuuc

SEQ ID NO: 519606 - RNA, 32 nt, Human
ugcuacacucuguuuugugugccuuccuuggu

SEQ ID NO: 519607 - RNA, 32 nt, Human
ugcuacacuuggaauucugugcucugacucug

SEQ ID NO: 519608 - RNA, 22 nt, Human
ugcuacagaaagcugcuugcca

SEQ ID NO: 519609 - RNA, 32 nt, Human
ugcuacagacaggauggggcccagagcugugc

SEQ ID NO: 519610 - RNA, 32 nt, Human
ugcuacagagcagacaguuaagagaaaugagc

SEQ ID NO: 519611 - RNA, 32 nt, Human
ugcuacagaggagugcuuuucuucucaauugu

SEQ ID NO: 519612 - RNA, 32 nt, Human
ugcuacagccacuccuggaagugcugccugac

SEQ ID NO: 519613 - RNA, 21 nt, Human
ugcuacagccgccgccgccgc

SEQ ID NO: 519614 - RNA, 32 nt, Human
ugcuacagccugggcgacacagugagacuccg

SEQ ID NO: 519615 - RNA, 32 nt, Human
ugcuacagcuccaagggcccuucaccuucaug

SEQ ID NO: 519616 - RNA, 32 nt, Human
ugcuacagcuccagccccuccugggccuccca

SEQ ID NO: 519617 - RNA, 32 nt, Human
ugcuacaggauccaggccaggcugugguuucc

SEQ ID NO: 519618 - RNA, 32 nt, Human
ugcuacauaccccuguuccagcauuaacuacc

SEQ ID NO: 519619 - RNA, 32 nt, Human
ugcuacaugcagcagacagcugugagcuugca

SEQ ID NO: 519620 - RNA, 25 nt, Human
ugcuacauucaggcuuacccauuga

SEQ ID NO: 519621 - RNA, 32 nt, Human
ugcuacauugcccaggcuggucucaaacuccu

SEQ ID NO: 519622 - RNA, 32 nt, Human
ugcuaccaaggaagagagcacacagauaagac

SEQ ID NO: 519623 - RNA, 32 nt, Human
ugcuaccacaggaagacacagcagggagaagc

SEQ ID NO: 519624 - RNA, 27 nt, Human
ugcuaccaccgcugccgucgccgccgc

SEQ ID NO: 519625 - RNA, 32 nt, Human
ugcuaccaggagacaccuggacccuguaaggc

SEQ ID NO: 519626 - RNA, 32 nt, Human
ugcuaccaugaaggaaaggccaagacaaucau

SEQ ID NO: 519627 - RNA, 32 nt, Human
ugcuacccaucggcccuuaauaaauggccuca

SEQ ID NO: 519628 - RNA, 32 nt, Human
ugcuacccauuuucagcuucucugccucucuu

SEQ ID NO: 519629 - RNA, 32 nt, Human
ugcuaccccuugcccaggcaaggaaagacagc

SEQ ID NO: 519630 - RNA, 32 nt, Human
ugcuacccucauuucucaucuuuuuacuaaac

SEQ ID NO: 519631 - RNA, 32 nt, Human
ugcuacccuccaggggccaacagcccagcucc

SEQ ID NO: 519632 - RNA, 32 nt, Human
ugcuacccuccccgccucccuccacagugauc

SEQ ID NO: 519633 - RNA, 32 nt, Human
ugcuaccgugaccguuuagaacagaaacuguu

SEQ ID NO: 519634 - RNA, 18 nt, Human
ugcuaccuaguuccagcu

SEQ ID NO: 519635 - RNA, 32 nt, Human
ugcuaccucagacauccucuuuucuccagagu

SEQ ID NO: 519636 - RNA, 32 nt, Human
ugcuaccucgauuccuccuguguuggacagag

SEQ ID NO: 519637 - RNA, 32 nt, Human
ugcuaccugcagcugcagccacucucccaccc

SEQ ID NO: 519638 - RNA, 32 nt, Human
ugcuaccugccugcugaccgcugcaacuacca

SEQ ID NO: 519639 - RNA, 32 nt, Human
ugcuaccuggucuguguuuugagaagugcccc

SEQ ID NO: 519640 - RNA, 22 nt, Human
ugcuacgacccccacgaugugc

SEQ ID NO: 519641 - RNA, 32 nt, Human
ugcuacgagcgguggcucaugccugaaucuca

SEQ ID NO: 519642 - RNA, 32 nt, Human
ugcuacggagacacuggcugcuguggggagga

SEQ ID NO: 519643 - RNA, 32 nt, Human
ugcuacggcugcugcccuuguacuacuaccuc

SEQ ID NO: 519644 - RNA, 32 nt, Human
ugcuacgggaaaccaucaggaaccuagacugu

SEQ ID NO: 519645 - RNA, 32 nt, Human
ugcuacggggccagagccaaggaagcuuccac

SEQ ID NO: 519646 - RNA, 32 nt, Human
ugcuacgugacccaggcuggaguguaguagcu

SEQ ID NO: 519647 - RNA, 32 nt, Human
ugcuacguggaagugaauggagacugaucuca

SEQ ID NO: 519648 - RNA, 32 nt, Human
ugcuacuaaaaauacaaaaauuacccgggcuu

SEQ ID NO: 519649 - RNA, 32 nt, Human
ugcuacuaaaaauacaaaaauuggcugggugu

SEQ ID NO: 519650 - RNA, 32 nt, Human
ugcuacuaagugguaacuuuuguauuuuaaua

SEQ ID NO: 519651 - RNA, 32 nt, Human
ugcuacuaccaccaccaccaccaccccuucug

SEQ ID NO: 519652 - RNA, 32 nt, Human
ugcuacucacaguguaguccauggacaaucgg

SEQ ID NO: 519653 - RNA, 32 nt, Human
ugcuacuccugugcucuggaggcugcagagcu

SEQ ID NO: 519654 - RNA, 32 nt, Human
ugcuacucuacuccagccugggcaacacagca

SEQ ID NO: 519655 - RNA, 32 nt, Human
ugcuacucucucccucuccaucccaucuuugc

SEQ ID NO: 519656 - RNA, 32 nt, Human
ugcuacugaggugucaggagugcagcugggcc

SEQ ID NO: 519657 - RNA, 32 nt, Human
ugcuacugcacuccaaucuggcaacagagcga

SEQ ID NO: 519658 - RNA, 32 nt, Human
ugcuacugcacuccagccccagcugggugaca

SEQ ID NO: 519659 - RNA, 32 nt, Human
ugcuacugcacuccagccuaggugacagagug

SEQ ID NO: 519660 - RNA, 32 nt, Human
ugcuacugcacuccagccugggagacagagcg

SEQ ID NO: 519661 - RNA, 32 nt, Human
ugcuacugcacuccagccugggcaacacagag

SEQ ID NO: 519662 - RNA, 32 nt, Human
ugcuacugcacuccagccugggcgacagagcg

SEQ ID NO: 519663 - RNA, 32 nt, Human
ugcuacugcacuccagccugggggacagaaag

SEQ ID NO: 519664 - RNA, 32 nt, Human
ugcuacugcacuccagccugggugacagagcg

SEQ ID NO: 519665 - RNA, 32 nt, Human
ugcuacugcacuccagcuuagguggcaaagug

SEQ ID NO: 519666 - RNA, 32 nt, Human
ugcuacugcacuccagucugggugacagagug

SEQ ID NO: 519667 - RNA, 32 nt, Human
ugcuacugcacucccgccugggugacagagug

SEQ ID NO: 519668 - RNA, 32 nt, Human
ugcuacugcacucuagauugggugacagagcc

SEQ ID NO: 519669 - RNA, 32 nt, Human
ugcuacugcaugccagccugggugacaaagcg

SEQ ID NO: 519670 - RNA, 32 nt, Human
ugcuacugccgcagcggaguucagagggcccg

SEQ ID NO: 519671 - RNA, 32 nt, Human
ugcuacugguguccuuucuccucagucacaag

SEQ ID NO: 519672 - RNA, 32 nt, Human
ugcuacugucccuucucacaggcauucacaga

SEQ ID NO: 519673 - RNA, 23 nt, Human
ugcuacugugcaggccaagggua

SEQ ID NO: 519674 - RNA, 32 nt, Human
ugcuacuuacaucucccucccuuggcugaggu

SEQ ID NO: 519675 - RNA, 32 nt, Human
ugcuacuucacagcuucauuuuuguuucauuc

SEQ ID NO: 519676 - RNA, 32 nt, Human
ugcuacuucccuuaucccucuuccaccaucuc

SEQ ID NO: 519677 - RNA, 32 nt, Human
ugcuacuucugaaucuguuuugucuuccuaau

SEQ ID NO: 519678 - RNA, 32 nt, Human
ugcuacuucuuaauagccaaagccuggaaaug

SEQ ID NO: 519679 - RNA, 32 nt, Human
ugcuacuugccaggaacagguugggaagaaaa

SEQ ID NO: 519680 - RNA, 32 nt, Human
ugcuacuugcccagguagugaucagugagagu

SEQ ID NO: 519681 - RNA, 32 nt, Human
ugcuacuuuuauuuuggacaggccaguucucc

SEQ ID NO: 519682 - RNA, 32 nt, Human
ugcuacuuuucugcagggauaaaacuuuugag

SEQ ID NO: 519683 - RNA, 32 nt, Human
ugcuacuuuugaaaauaaaucuuucuuuauau

SEQ ID NO: 519684 - RNA, 20 nt, Human
ugcuagaaaaucauguuccu

SEQ ID NO: 519685 - RNA, 32 nt, Human
ugcuagaaagcguacaucacacauucgcaaug

SEQ ID NO: 519686 - RNA, 32 nt, Human
ugcuagaacccccacccaccagccuccggaac

SEQ ID NO: 519687 - RNA, 32 nt, Human
ugcuagaacccuaaaagaaccaaaaaucugcc

SEQ ID NO: 519688 - RNA, 32 nt, Human
ugcuagaacucagcauucaugacaggggcuaa

SEQ ID NO: 519689 - RNA, 23 nt, Human
ugcuagaagacugaaugcuuucc

SEQ ID NO: 519690 - RNA, 32 nt, Human
ugcuagaagaggaggaaaaggaauauguggug

SEQ ID NO: 519691 - RNA, 24 nt, Human
ugcuagaagcacuuuauguuuccu

SEQ ID NO: 519692 - RNA, 32 nt, Human
ugcuagaaguuggguuguucuggauuuucccc

SEQ ID NO: 519693 - RNA, 32 nt, Human
ugcuagaauggguggagaagaagcagagauac

SEQ ID NO: 519694 - RNA, 32 nt, Human
ugcuagaauuacaggcauuagccaccaugccu

SEQ ID NO: 519695 - RNA, 32 nt, Human
ugcuagacagggauugguguguuugcaccugu

SEQ ID NO: 519696 - RNA, 20 nt, Human
ugcuagaccaagaccuguug

SEQ ID NO: 519697 - RNA, 32 nt, Human
ugcuagacucccuccuccuccaaaucugggcu

SEQ ID NO: 519698 - RNA, 32 nt, Human
ugcuagagaaaagaauguggacaaguguaugg

SEQ ID NO: 519699 - RNA, 32 nt, Human
ugcuagagacagggauucgccauguuggccag

SEQ ID NO: 519700 - RNA, 32 nt, Human
ugcuagagccuuucccuuuaccgcacccaaga

SEQ ID NO: 519701 - RNA, 32 nt, Human
ugcuagagcugcggcauucuccugggucucgg

SEQ ID NO: 519702 - RNA, 32 nt, Human
ugcuagaggguaggagagagccuggaucucug

SEQ ID NO: 519703 - RNA, 32 nt, Human
ugcuagaggguguggaaaagaccaagaugcca

SEQ ID NO: 519704 - RNA, 32 nt, Human
ugcuagagucaggccugcauccaaaucagggg

SEQ ID NO: 519705 - RNA, 32 nt, Human
ugcuagaguccucagggagggagugaccucga

SEQ ID NO: 519706 - RNA, 32 nt, Human
ugcuagagucuuccuuugucagccaggcugga

SEQ ID NO: 519707 - RNA, 32 nt, Human
ugcuagauaucuuaucagagcucagauuccag

SEQ ID NO: 519708 - RNA, 32 nt, Human
ugcuagauggguucuuugcauguggguuccau

SEQ ID NO: 519709 - RNA, 32 nt, Human
ugcuagcaagccugcaaaacagcaaccuaaac

SEQ ID NO: 519710 - RNA, 32 nt, Human
ugcuagcaagggcaguagcuuaaauacuuuug

SEQ ID NO: 519711 - RNA, 32 nt, Human
ugcuagcaagugaaguccagggccaggugggg

SEQ ID NO: 519712 - RNA, 32 nt, Human
ugcuagcacagcuguccacgucugugugagcu

SEQ ID NO: 519713 - RNA, 32 nt, Human
ugcuagcagacuaauacagaggaugauugaaa

SEQ ID NO: 519714 - RNA, 32 nt, Human
ugcuagcaggaagccuucaucuucuugaguac

SEQ ID NO: 519715 - RNA, 32 nt, Human
ugcuagcaguuuccguucacauuggccuagac

SEQ ID NO: 519716 - RNA, 23 nt, Human
ugcuagccaagugaacccgugga

SEQ ID NO: 519717 - RNA, 32 nt, Human
ugcuagccacaugaggaacaaguuuccguguc

SEQ ID NO: 519718 - RNA, 20 nt, Human
ugcuagccccagagaugcca

SEQ ID NO: 519719 - RNA, 32 nt, Human
ugcuagcccuggcaggcacagcccuccccuca

SEQ ID NO: 519720 - RNA, 32 nt, Human
ugcuagccuagauuuuguaauaacacugauuu

SEQ ID NO: 519721 - RNA, 32 nt, Human
ugcuagccuagccagggcuuacuccaggaauc

SEQ ID NO: 519722 - RNA, 32 nt, Human
ugcuagccucaaccuccuggggcaggggacgc

SEQ ID NO: 519723 - RNA, 32 nt, Human
ugcuagccugaguuggcacacugugagaaccc

SEQ ID NO: 519724 - RNA, 32 nt, Human
ugcuagccuguacaaccuacaugucuuuucuu

SEQ ID NO: 519725 - RNA, 20 nt, Human
ugcuagcgccuagcagcccc

SEQ ID NO: 519726 - RNA, 32 nt, Human
ugcuagcgcugcacuccauuuugcaauggccu

SEQ ID NO: 519727 - RNA, 32 nt, Human
ugcuagcucagguaagucagcacacagcaccu

SEQ ID NO: 519728 - RNA, 32 nt, Human
ugcuagcucauagcacucuucguccacuacau

SEQ ID NO: 519729 - RNA, 32 nt, Human
ugcuagcucuucuaacaggggaagucuguaug

SEQ ID NO: 519730 - RNA, 32 nt, Human
ugcuaggaaaccuuaaguauggggaagguaga

SEQ ID NO: 519731 - RNA, 18 nt, Human
ugcuaggaagggccccuu

SEQ ID NO: 519732 - RNA, 32 nt, Human
ugcuaggagaggauggucuccacccaucuuuc

SEQ ID NO: 519733 - RNA, 32 nt, Human
ugcuaggagagggcgggcagcgccgcggcgcg

SEQ ID NO: 519734 - RNA, 32 nt, Human
ugcuaggagcagcagaggauguggugaaugca

SEQ ID NO: 519735 - RNA, 32 nt, Human
ugcuaggaggcagaaggggcagagaguaaaaa

SEQ ID NO: 519736 - RNA, 32 nt, Human
ugcuaggaggcgacagaagaaaaagacacaag

SEQ ID NO: 519737 - RNA, 32 nt, Human
ugcuaggauaacaggugugagccaccgcaccc

SEQ ID NO: 519738 - RNA, 32 nt, Human
ugcuaggaucauuggauucaguucccaaaaua

SEQ ID NO: 519739 - RNA, 32 nt, Human
ugcuaggauuacaggcaucagccaccacgccu

SEQ ID NO: 519740 - RNA, 32 nt, Human
ugcuaggauuacaggcaugaaccaccgugccc

SEQ ID NO: 519741 - RNA, 32 nt, Human
ugcuaggauuacaggcaugagccaccacaucc

SEQ ID NO: 519742 - RNA, 32 nt, Human
ugcuaggauuacaggcaugagccaccacgccc

SEQ ID NO: 519743 - RNA, 32 nt, Human
ugcuaggauuacaggcaugagccaccaugccc

SEQ ID NO: 519744 - RNA, 32 nt, Human
ugcuaggauuacaggcaugagccaccgcaccg

SEQ ID NO: 519745 - RNA, 32 nt, Human
ugcuaggauuacaggcaugagccacugcaccc

SEQ ID NO: 519746 - RNA, 32 nt, Human
ugcuaggauuacaggcaugggccacugcacuc

SEQ ID NO: 519747 - RNA, 20 nt, Human
ugcuaggcaagcccagggca

SEQ ID NO: 519748 - RNA, 32 nt, Human
ugcuaggcaccacugggcucuguuucuguccc

SEQ ID NO: 519749 - RNA, 32 nt, Human
ugcuaggcgggggaggggcguugcuauggcga

SEQ ID NO: 519750 - RNA, 26 nt, Human
ugcuaggcucuagggcuuuccugcuc

SEQ ID NO: 519751 - RNA, 32 nt, Human
ugcuaggcugcagacugccuuguacucccugg

SEQ ID NO: 519752 - RNA, 20 nt, Human
ugcuaggcuggagugcagug

SEQ ID NO: 519753 - RNA, 32 nt, Human
ugcuagggagagaacgccagagggaggcggcu

SEQ ID NO: 519754 - RNA, 32 nt, Human
ugcuagggagagggaagagggagaccaaaugu

SEQ ID NO: 519755 - RNA, 32 nt, Human
ugcuagggccuccagccagggcaugucuagug

SEQ ID NO: 519756 - RNA, 32 nt, Human
ugcuagggcuucaucagaccacugacuugacu

SEQ ID NO: 519757 - RNA, 32 nt, Human
ugcuaggggaagagacugggccuuagcagguc

SEQ ID NO: 519758 - RNA, 32 nt, Human
ugcuaggggacuagcaggaagcggcacgccug

SEQ ID NO: 519759 - RNA, 32 nt, Human
ugcuaggggagcugagcaagaggcucaccaug

SEQ ID NO: 519760 - RNA, 32 nt, Human
ugcuaggggagggagagugaggagggaguguu

SEQ ID NO: 519761 - RNA, 32 nt, Human
ugcuaggggcuggaaugggggaaaguguugac

SEQ ID NO: 519762 - RNA, 32 nt, Human
ugcuagggguuaggcuuuugagcuugaacgcc

SEQ ID NO: 519763 - RNA, 32 nt, Human
ugcuagggguuugggacugaggcguggagagc

SEQ ID NO: 519764 - RNA, 32 nt, Human
ugcuagguaguacgacccucuggauuuggaag

SEQ ID NO: 519765 - RNA, 32 nt, Human
ugcuagguucacacccuccucgccccgaucuu

SEQ ID NO: 519766 - RNA, 32 nt, Human
ugcuaguacagugucaguuauuuaaaguggua

SEQ ID NO: 519767 - RNA, 32 nt, Human
ugcuagucaugaccuggucaucagcuugcuuu

SEQ ID NO: 519768 - RNA, 32 nt, Human
ugcuagugaaguuucgggcacgcauugucauu

SEQ ID NO: 519769 - RNA, 32 nt, Human
ugcuagugagccuucccauuuagauuaaagau

SEQ ID NO: 519770 - RNA, 32 nt, Human
ugcuagugaggccaagagagccugugacaauu

SEQ ID NO: 519771 - RNA, 23 nt, Human
ugcuagugcccaagugguggagg

SEQ ID NO: 519772 - RNA, 32 nt, Human
ugcuaguggccagggcugcaccugccaucccc

SEQ ID NO: 519773 - RNA, 32 nt, Human
ugcuaguguuuagaauaacagauuuguuuaua

SEQ ID NO: 519774 - RNA, 18 nt, Human
ugcuaguuaaccgcgggg

SEQ ID NO: 519775 - RNA, 32 nt, Human
ugcuaguucuuauucgagaacuauggucagag

SEQ ID NO: 519776 - RNA, 32 nt, Human
ugcuaguugcaggagacggguguuacacgcag

SEQ ID NO: 519777 - RNA, 32 nt, Human
ugcuaguuuugcaaaucguuucucugaugacc

SEQ ID NO: 519778 - RNA, 32 nt, Human
ugcuauaaaucagcuauguguauugucaaauu

SEQ ID NO: 519779 - RNA, 20 nt, Human
ugcuauaauccuagcacuuu

SEQ ID NO: 519780 - RNA, 32 nt, Human
ugcuauaauuccaugaaucagaaauaauaaaa

SEQ ID NO: 519781 - RNA, 32 nt, Human
ugcuauagaugucuucuggaaguugaguugug

SEQ ID NO: 519782 - RNA, 32 nt, Human
ugcuauagcaacguccuggacgcccagaccuu

SEQ ID NO: 519783 - RNA, 32 nt, Human
ugcuauagccugggcaagagcgugagacccug

SEQ ID NO: 519784 - RNA, 32 nt, Human
ugcuauaguguuuggcuuauuuuccaucccag

SEQ ID NO: 519785 - RNA, 32 nt, Human
ugcuauauacagucuagguuuucuguuuggaa

SEQ ID NO: 519786 - RNA, 32 nt, Human
ugcuauaucaucuuuauuuauucaggguauuu

SEQ ID NO: 519787 - RNA, 32 nt, Human
ugcuauaugaacacaucgggacugugucugca

SEQ ID NO: 519788 - RNA, 32 nt, Human
ugcuauauggaaggcacauuuuugcacuauau

SEQ ID NO: 519789 - RNA, 31 nt, Human
ugcuauauguagucucguugccaaagucugc

SEQ ID NO: 519790 - RNA, 32 nt, Human
ugcuaucacagaacuccaccagcaacuccacc

SEQ ID NO: 519791 - RNA, 32 nt, Human
ugcuaucagaauaucaggugaagagagaauca

SEQ ID NO: 519792 - RNA, 32 nt, Human
ugcuaucaguguacuccagugcccuugaauaa

SEQ ID NO: 519793 - RNA, 32 nt, Human
ugcuaucccaggaguaucaggaccagacacau

SEQ ID NO: 519794 - RNA, 32 nt, Human
ugcuaucccuccaguauuuagauuuauccugc

SEQ ID NO: 519795 - RNA, 32 nt, Human
ugcuaucccuccccucuccacccaccccacag

SEQ ID NO: 519796 - RNA, 32 nt, Human
ugcuaucccugcacucaaaaguuuugaaagaa

SEQ ID NO: 519797 - RNA, 32 nt, Human
ugcuaucucccaggggccuggaugucgaugga

SEQ ID NO: 519798 - RNA, 32 nt, Human
ugcuaucugcagcuccuaggugcuuuccucag

SEQ ID NO: 519799 - RNA, 32 nt, Human
ugcuaucuuagcgucagcgagggaagguugag

SEQ ID NO: 519800 - RNA, 32 nt, Human
ugcuaucuuagucuguucaggcugucacaaca

SEQ ID NO: 519801 - RNA, 32 nt, Human
ugcuaucuugcagcccaaccaggaggcccugc

SEQ ID NO: 519802 - RNA, 32 nt, Human
ugcuaugaacacagcagucggucccugucauu

SEQ ID NO: 519803 - RNA, 32 nt, Human
ugcuaugaaccagccccacagccccaggcucc

SEQ ID NO: 519804 - RNA, 32 nt, Human
ugcuaugaaggcagagcuucuauucuuuaugg

SEQ ID NO: 519805 - RNA, 19 nt, Human
ugcuaugacaaaaccuuua

SEQ ID NO: 519806 - RNA, 32 nt, Human
ugcuaugagagcagaggaguaaccuggucuga

SEQ ID NO: 519807 - RNA, 32 nt, Human
ugcuaugcaacaaugcauugaguauuaggaag

SEQ ID NO: 519808 - RNA, 32 nt, Human
ugcuaugcaggaaucccucccaugacguguau

SEQ ID NO: 519809 - RNA, 32 nt, Human
ugcuaugccugggaaaaugguuugucuuccag

SEQ ID NO: 519810 - RNA, 32 nt, Human
ugcuaugccuguguguaaacuuggggauggcu

SEQ ID NO: 519811 - RNA, 32 nt, Human
ugcuaugcuaaaccuccugccucccaauacca

SEQ ID NO: 519812 - RNA, 32 nt, Human
ugcuaugcuuaugauucaggcuggacagccug

SEQ ID NO: 519813 - RNA, 29 nt, Human
ugcuauggaagggagagaggaggagauug

SEQ ID NO: 519814 - RNA, 29 nt, Human
ugcuauggaagugaguccuuggaguuguc

SEQ ID NO: 519815 - RNA, 29 nt, Human
ugcuauggaauaugaugagaagcuggccc

SEQ ID NO: 519816 - RNA, 32 nt, Human
ugcuauggagagaaagcuaacauggucccaug

SEQ ID NO: 519817 - RNA, 32 nt, Human
ugcuauggagccacaguugaggacaguaguuu

SEQ ID NO: 519818 - RNA, 29 nt, Human
ugcuauggaggcggcggcggcgguggugg

SEQ ID NO: 519819 - RNA, 32 nt, Human
ugcuaugggcucccuggccucccaggccacca

SEQ ID NO: 519820 - RNA, 32 nt, Human
ugcuauggggagaaaagacaugaauaugauua

SEQ ID NO: 519821 - RNA, 32 nt, Human
ugcuauggucuccccuaggaaugugauagaua

SEQ ID NO: 519822 - RNA, 32 nt, Human
ugcuauggugugaaagacuaccuuugacuugg

SEQ ID NO: 519823 - RNA, 32 nt, Human
ugcuaugucacucaggcuggagugcaguggca

SEQ ID NO: 519824 - RNA, 32 nt, Human
ugcuaugucagcuccccucugccccaccucac

SEQ ID NO: 519825 - RNA, 31 nt, Human
ugcuaugucauuucauguccugugucaguuu

SEQ ID NO: 519826 - RNA, 32 nt, Human
ugcuaugucucaggccuguaaucccagcuuug

SEQ ID NO: 519827 - RNA, 32 nt, Human
ugcuaugucucccaggcuggagugcaguggca

SEQ ID NO: 519828 - RNA, 32 nt, Human
ugcuauguugcccaggcuagagugcaguggcu

SEQ ID NO: 519829 - RNA, 32 nt, Human
ugcuauguugcccaggcuggucccaaacuccu

SEQ ID NO: 519830 - RNA, 32 nt, Human
ugcuauguugcccaggcuggucucaaacuccu

SEQ ID NO: 519831 - RNA, 32 nt, Human
ugcuauguugcccaggcuggucucaaacuucu

SEQ ID NO: 519832 - RNA, 32 nt, Human
ugcuauguugcccaggcuggucuccaacucaa

SEQ ID NO: 519833 - RNA, 32 nt, Human
ugcuauguugcccaggcuggucucgaacuccu

SEQ ID NO: 519834 - RNA, 32 nt, Human
ugcuauguugcccaggcugguugcaaacuucu

SEQ ID NO: 519835 - RNA, 32 nt, Human
ugcuauguuggccaggcuggucucaaacuucu

SEQ ID NO: 519836 - RNA, 32 nt, Human
ugcuauguuuuagcuggucagggaaggcuccu

SEQ ID NO: 519837 - RNA, 32 nt, Human
ugcuauguuuuuacaaaauuguuccuacaccu

SEQ ID NO: 519838 - RNA, 32 nt, Human
ugcuauuauaaauaaugauucauuuuauaacc

SEQ ID NO: 519839 - RNA, 32 nt, Human
ugcuauuaucuauuacucuugagagcuggcug

SEQ ID NO: 519840 - RNA, 32 nt, Human
ugcuauuccaaccuucuuugguauuuguaauu

SEQ ID NO: 519841 - RNA, 32 nt, Human
ugcuauucccccauccuaguucuaucauauua

SEQ ID NO: 519842 - RNA, 32 nt, Human
ugcuauucuggcccaaauguuccauuauucag

SEQ ID NO: 519843 - RNA, 32 nt, Human
ugcuauugaaaugaaguauagaggaggaaaaa

SEQ ID NO: 519844 - RNA, 32 nt, Human
ugcuauugcacuccagccugggcgacagagca

SEQ ID NO: 519845 - RNA, 32 nt, Human
ugcuauugcacuccagccugggugacagacua

SEQ ID NO: 519846 - RNA, 32 nt, Human
ugcuauugugauauuuuagcacuuugguagcu

SEQ ID NO: 519847 - RNA, 32 nt, Human
ugcuauuguucugcacgaggcugggccugccu

SEQ ID NO: 519848 - RNA, 32 nt, Human
ugcuauuucacuuuuugacuugacuuuuauau

SEQ ID NO: 519849 - RNA, 32 nt, Human
ugcuauuucccaagcuggagugcaguggugcg

SEQ ID NO: 519850 - RNA, 32 nt, Human
ugcuauuuccuagaaguuucugguuuuuaaga

SEQ ID NO: 519851 - RNA, 32 nt, Human
ugcuauuuguguaacugaaagguugcacucua

SEQ ID NO: 519852 - RNA, 32 nt, Human
ugcuauuuuccuccucuuguuacaagcuucag

SEQ ID NO: 519853 - RNA, 32 nt, Human
ugcuauuuucucacuuuuccuuuugauggugc

SEQ ID NO: 519854 - RNA, 32 nt, Human
ugcuauuuuugagagugaugcuccugagcccc

SEQ ID NO: 519855 - RNA, 32 nt, Human
ugcucaaaaguucugaauucauacagaaaaca

SEQ ID NO: 519856 - RNA, 32 nt, Human
ugcucaaaauggaauuccucuaagaaucaagg

SEQ ID NO: 519857 - RNA, 25 nt, Human
ugcucaaaccacaaacaacagcaug

SEQ ID NO: 519858 - RNA, 32 nt, Human
ugcucaacaaggccucuaacagucuucugucc

SEQ ID NO: 519859 - RNA, 32 nt, Human
ugcucaacuauacgaggacacugcaggcacag

SEQ ID NO: 519860 - RNA, 32 nt, Human
ugcucaagaaaauuagugcucagccccaacaa

SEQ ID NO: 519861 - RNA, 32 nt, Human
ugcucaagaacagauuugaggccaggugcggu

SEQ ID NO: 519862 - RNA, 32 nt, Human
ugcucaagaccaugggaacccaucucuugugg

SEQ ID NO: 519863 - RNA, 32 nt, Human
ugcucaagagggagguuuccuccugagugaag

SEQ ID NO: 519864 - RNA, 23 nt, Human
ugcucaagcccaggaguuugaga

SEQ ID NO: 519865 - RNA, 32 nt, Human
ugcucaagcuguuccguccccuuaccaccccu

SEQ ID NO: 519866 - RNA, 32 nt, Human
ugcucaaggacagagaaaaggauagaaguuug

SEQ ID NO: 519867 - RNA, 25 nt, Human
ugcucaagguguccaggcuuuuggg

SEQ ID NO: 519868 - RNA, 32 nt, Human
ugcucaagucuacacaccuguacagcacguua

SEQ ID NO: 519869 - RNA, 32 nt, Human
ugcucaaguucugcuaagggacagacugccuc

SEQ ID NO: 519870 - RNA, 31 nt, Human
ugcucaauaaauaguugcugacuuuaauuuu

SEQ ID NO: 519871 - RNA, 28 nt, Human
ugcucaauaaauguugguuccugcugau

SEQ ID NO: 519872 - RNA, 31 nt, Human
ugcucaauacugugagagaaagacuguacuc

SEQ ID NO: 519873 - RNA, 32 nt, Human
ugcuuugggcugggacauaaguuuuucugcuu

SEQ ID NO: 519874 - RNA, 32 nt, Human
ugcuuugggcugggauggugacuccugaaacc

SEQ ID NO: 519875 - RNA, 32 nt, Human
ugcuuugggguuuuauuucuguuguucaaaug

SEQ ID NO: 519876 - RNA, 18 nt, Human
ugcuuuggguacugugau

SEQ ID NO: 519877 - RNA, 32 nt, Human
ugcuuuggugaugcuuugcucaucucagugaa

SEQ ID NO: 519878 - RNA, 32 nt, Human
ugcuuuggugcaagguacagcccacaccucuc

SEQ ID NO: 519879 - RNA, 32 nt, Human
ugcuuuguaaagcauugagauguuuaugugua

SEQ ID NO: 519880 - RNA, 32 nt, Human
ugcuuuguaauauuucacuuuguuuuacuaca

SEQ ID NO: 519881 - RNA, 32 nt, Human
ugcuuugucacccaggcuggaguacaguggcg

SEQ ID NO: 519882 - RNA, 32 nt, Human
ugcuuugucacccaggcuggagugcaguggug

SEQ ID NO: 519883 - RNA, 32 nt, Human
ugcuuugucacccaggcuggagugcagugucg

SEQ ID NO: 519884 - RNA, 32 nt, Human
ugcuuugucacccaggcuggagugcuguggug

SEQ ID NO: 519885 - RNA, 32 nt, Human
ugcuuugucacccaugcuggaguacaauggca

SEQ ID NO: 519886 - RNA, 32 nt, Human
ugcuuugucgcccaggcuggagcgcagucccg

SEQ ID NO: 519887 - RNA, 32 nt, Human
ugcuuugucgcccaggcuggagugcaguggca

SEQ ID NO: 519888 - RNA, 32 nt, Human
ugcuuugucgcccaggcuggagugcaguggcg

SEQ ID NO: 519889 - RNA, 22 nt, Human
ugcuuuguggcugggugcagug

SEQ ID NO: 519890 - RNA, 32 nt, Human
ugcuuuguggcugggugcagugguucacaccu

SEQ ID NO: 519891 - RNA, 32 nt, Human
ugcuuuguguguggaguuuuccaugaagugca

SEQ ID NO: 519892 - RNA, 32 nt, Human
ugcuuuguguguggggaugcuuaccaacacca

SEQ ID NO: 519893 - RNA, 32 nt, Human
ugcuuuguuccaaguuaaguguuuucagaaaa

SEQ ID NO: 519894 - RNA, 22 nt, Human
ugcuuuguugcaaguugauaua

SEQ ID NO: 519895 - RNA, 22 nt, Human
ugcuuuguugcacgccugggca

SEQ ID NO: 519896 - RNA, 32 nt, Human
ugcuuuguugccaggcuggagugcaguggcgc

SEQ ID NO: 519897 - RNA, 32 nt, Human
ugcuuuguugcccagacuggagugcaguggca

SEQ ID NO: 519898 - RNA, 32 nt, Human
ugcuuuguugcccaggcuggagugcaguagca

SEQ ID NO: 519899 - RNA, 32 nt, Human
ugcuuuguugcccaggcuggaguguggugggg

SEQ ID NO: 519900 - RNA, 22 nt, Human
ugcuuuguugggggccuggcca

SEQ ID NO: 519901 - RNA, 32 nt, Human
ugcuuuguuuacuaaggacuuguggggaggaa

SEQ ID NO: 519902 - RNA, 24 nt, Human
ugcuuuguuuuaguuccuuacaua

SEQ ID NO: 519903 - RNA, 31 nt, Human
ugcuuuuaaaugucucaugccaaggcacuga

SEQ ID NO: 519904 - RNA, 32 nt, Human
ugcuuuuaacagagucugaaccuauuucuuaa

SEQ ID NO: 519905 - RNA, 32 nt, Human
ugcuuuuaagagguggauugaagaauauuuga

SEQ ID NO: 519906 - RNA, 32 nt, Human
ugcuuuuaccauugaagaaacugagguccugu

SEQ ID NO: 519907 - RNA, 32 nt, Human
ugcuuuuauaaauaugugaugucacauauuuc

SEQ ID NO: 519908 - RNA, 23 nt, Human
ugcuuuuauuccagcacuguggu

SEQ ID NO: 519909 - RNA, 24 nt, Human
ugcuuuuauucuaugcucucugua

SEQ ID NO: 519910 - RNA, 31 nt, Human
ugcuuuucaggcaaggagggagaaauccugc

SEQ ID NO: 519911 - RNA, 32 nt, Human
ugcuuuucccaagggucugggcucugaguugg

SEQ ID NO: 519912 - RNA, 32 nt, Human
ugcuuuuccucacucacguggaaaugugaacu

SEQ ID NO: 519913 - RNA, 32 nt, Human
ugcuuuucuaacugcuuugaacuuuucggauu

SEQ ID NO: 519914 - RNA, 32 nt, Human
ugcuuuucucacccaugcuuccuugaagcccc

SEQ ID NO: 519915 - RNA, 32 nt, Human
ugcuuuucuccuccuccccuucccaguuacca

SEQ ID NO: 519916 - RNA, 32 nt, Human
ugcuuuucuccucugagucuuagcaauggaca

SEQ ID NO: 519917 - RNA, 32 nt, Human
ugcuuuucucuucucuucuccugcuccguucc

SEQ ID NO: 519918 - RNA, 32 nt, Human
ugcuuuucuucccacccugccaccccaccccu

SEQ ID NO: 519919 - RNA, 32 nt, Human
ugcuuuucuuguaggaacugugucuuugaguu

SEQ ID NO: 519920 - RNA, 32 nt, Human
ugcuuuucuuuccauuugacuugcuguaagcc

SEQ ID NO: 519921 - RNA, 32 nt, Human
ugcuuuucuuucugaaaaaucucccucucucc

SEQ ID NO: 519922 - RNA, 32 nt, Human
ugcuuuucuuuguauuuuuccugcuuuagucc

SEQ ID NO: 519923 - RNA, 32 nt, Human
ugcuuuugaaggagguagggaaugacaucuuc

SEQ ID NO: 519924 - RNA, 32 nt, Human
ugcuuuugacccuuuacaugcgggugagcaag

SEQ ID NO: 519925 - RNA, 32 nt, Human
ugcuuuugcauuaggaugacagaggugaauag

SEQ ID NO: 519926 - RNA, 19 nt, Human
ugcuuuugccaacuuucca

SEQ ID NO: 519927 - RNA, 32 nt, Human
ugcuuuugccuucuguuguuuaucuuaccugc

SEQ ID NO: 519928 - RNA, 32 nt, Human
ugcuuuugcugcagauaaucagccagagccug

SEQ ID NO: 519929 - RNA, 32 nt, Human
ugcuuuuggaagucaccuaccuuuuuaacaca

SEQ ID NO: 519930 - RNA, 32 nt, Human
ugcuuuuggacagugacccaugauaucugccu

SEQ ID NO: 519931 - RNA, 32 nt, Human
ugcuuuugggaaaugugcucagaggaagaacu

SEQ ID NO: 519932 - RNA, 32 nt, Human
ugcuuuugggagacuggaaaagggaaggugac

SEQ ID NO: 519933 - RNA, 32 nt, Human
ugcuuuugggcaacaugagaggaaccuuuuca

SEQ ID NO: 519934 - RNA, 32 nt, Human
ugcuuuugggcaggaaaauggaagaaagagug

SEQ ID NO: 519935 - RNA, 31 nt, Human
ugcuuuuggguggaaguuaggagaauguuug

SEQ ID NO: 519936 - RNA, 32 nt, Human
ugcuuuuguacggguucccaugaaucuucugc

SEQ ID NO: 519937 - RNA, 32 nt, Human
ugcuuuugucuuucuuaccugauugauauuac

SEQ ID NO: 519938 - RNA, 23 nt, Human
ugcuuuuguuccguggagaugca

SEQ ID NO: 519939 - RNA, 32 nt, Human
ugcuuuuguucguuuugccuucuguccuugga

SEQ ID NO: 519940 - RNA, 32 nt, Human
ugcuuuuguuuaccuggguaccacacaaccaa

SEQ ID NO: 519941 - RNA, 32 nt, Human
ugcuuuuuccaccucggaaaugcagcuuuccc

SEQ ID NO: 519942 - RNA, 32 nt, Human
ugcuuuuuccuuucacuuggauuugcauuuua

SEQ ID NO: 519943 - RNA, 32 nt, Human
ugcuuuuucuaggauucauuguuuucuauuug

SEQ ID NO: 519944 - RNA, 32 nt, Human
ugcuuuuucuucagugcuaagaaaguucccuc

SEQ ID NO: 519945 - RNA, 32 nt, Human
ugcuuuuucuuucuuaguugaguaaacaagua

SEQ ID NO: 519946 - RNA, 32 nt, Human
ugcuuuuuguguugguauuauuccucagaauu

SEQ ID NO: 519947 - RNA, 24 nt, Human
ugcuuuuuuccuaugguuacagca

SEQ ID NO: 519948 - RNA, 32 nt, Human
uggaaaaacaaaaucugcaagcuuugaaugau

SEQ ID NO: 519949 - RNA, 32 nt, Human
uggaaaaacaagccaaggaggauuucuuuugu

SEQ ID NO: 519950 - RNA, 26 nt, Human
uggaaaaacauuucucuuuaguuuca

SEQ ID NO: 519951 - RNA, 22 nt, Human
uggaaaaacugccauugcugug

SEQ ID NO: 519952 - RNA, 32 nt, Human
uggaaaaaggaaagagauucgagaagugagag

SEQ ID NO: 519953 - RNA, 32 nt, Human
uggaaaaaggagacggugguguggaaauggcu

SEQ ID NO: 519954 - RNA, 32 nt, Human
uggaaaaaggcagagaacgugggagugaucau

SEQ ID NO: 519955 - RNA, 32 nt, Human
uggaaaaauacugccuagaaaaugcaaaauga

SEQ ID NO: 519956 - RNA, 32 nt, Human
uggaaaaauagaagaaggucggccgggcuugg

SEQ ID NO: 519957 - RNA, 32 nt, Human
uggaaaaaucgagccucucccacccucagucg

SEQ ID NO: 519958 - RNA, 21 nt, Human
uggaaaaaugaacacuucccu

SEQ ID NO: 519959 - RNA, 32 nt, Human
uggaaaacaaagugacugaccuguggcucugg

SEQ ID NO: 519960 - RNA, 21 nt, Human
uggaaaacaauuuuuccacca

SEQ ID NO: 519961 - RNA, 32 nt, Human
uggaaaacacuccccucucccucuuucuucuu

SEQ ID NO: 519962 - RNA, 32 nt, Human
uggaaaacagcaggaacaccucuccuccauuc

SEQ ID NO: 519963 - RNA, 32 nt, Human
uggaaaacaggccuccccucccucucucggca

SEQ ID NO: 519964 - RNA, 21 nt, Human
uggaaaacaguuaauaugcca

SEQ ID NO: 519965 - RNA, 24 nt, Human
uggaaaacaguuaaugaccagcca

SEQ ID NO: 519966 - RNA, 32 nt, Human
uggaaaaccaacaacuugaaaucucagguauu

SEQ ID NO: 519967 - RNA, 32 nt, Human
uggaaaaccaguaucugccaggugcucaguga

SEQ ID NO: 519968 - RNA, 23 nt, Human
uggaaaacccaccccacacgcca

SEQ ID NO: 519969 - RNA, 19 nt, Human
uggaaaaccugcucugcug

SEQ ID NO: 519970 - RNA, 32 nt, Human
uggaaaacuacacacauauacauaaggaagag

SEQ ID NO: 519971 - RNA, 32 nt, Human
uggaaaacucacugagccugacaucugccugu

SEQ ID NO: 519972 - RNA, 32 nt, Human
uggaaaacuguggcuucucaauaaauauucag

SEQ ID NO: 519973 - RNA, 32 nt, Human
uggaaaagaacuggugugggagagggauaccu

SEQ ID NO: 519974 - RNA, 32 nt, Human
uggaaaagacucccuuuagucccuuuuucaau

SEQ ID NO: 519975 - RNA, 32 nt, Human
uggaaaagccaucucagguuggcggcagacac

SEQ ID NO: 519976 - RNA, 23 nt, Human
uggaaaagcggggacccagcgag

SEQ ID NO: 519977 - RNA, 32 nt, Human
uggaaaagcugcagacacucaaugccaacgug

SEQ ID NO: 519978 - RNA, 32 nt, Human
uggaaaagcugcagacacucaaugccagccca

SEQ ID NO: 519979 - RNA, 32 nt, Human
uggaaaaggagaaaauguccuuuuggaagaau

SEQ ID NO: 519980 - RNA, 22 nt, Human
uggaaaaggagauaauacaauu

SEQ ID NO: 519981 - RNA, 32 nt, Human
uggaaaaggagcuucaguauuguggggcucau

SEQ ID NO: 519982 - RNA, 32 nt, Human
uggaaaaggagucaggagccacugugagguga

SEQ ID NO: 519983 - RNA, 32 nt, Human
uggaaaaggccguuugccucacacauuguaac

SEQ ID NO: 519984 - RNA, 32 nt, Human
uggaaaaggugauggugcuggggugugaguug

SEQ ID NO: 519985 - RNA, 32 nt, Human
uggaaaagucggcuuguaaucaagagcaugcu

SEQ ID NO: 519986 - RNA, 32 nt, Human
uggaaaagucucccaaaccuucagagagugga

SEQ ID NO: 519987 - RNA, 32 nt, Human
uggaaaagucuucgguccaguguuacaccuua

SEQ ID NO: 519988 - RNA, 32 nt, Human
uggaaaagugagacuggaucucugauucugug

SEQ ID NO: 519989 - RNA, 32 nt, Human
uggaaaauaagaaauugagaucuagucaggaa

SEQ ID NO: 519990 - RNA, 32 nt, Human
uggaaaauauggucaguguacuacaaaaugag

SEQ ID NO: 519991 - RNA, 32 nt, Human
uggaaaaucaaccugaauucagagaagccuuc

SEQ ID NO: 519992 - RNA, 32 nt, Human
uggaaaaucauaauugccgucuggaccauuga

SEQ ID NO: 519993 - RNA, 32 nt, Human
uggaaaauccagacauuuggaauugcauauua

SEQ ID NO: 519994 - RNA, 32 nt, Human
uggaaaauccuccaaauuuggccacagaaacu

SEQ ID NO: 519995 - RNA, 32 nt, Human
uggaaaaucucccaugcgacccucggggccca

SEQ ID NO: 519996 - RNA, 22 nt, Human
uggaaaaugaucccggggccag

SEQ ID NO: 519997 - RNA, 31 nt, Human
uggaaaaugcuccuggcgccucagggaaggu

SEQ ID NO: 519998 - RNA, 24 nt, Human
uggaaaauggcuacaccacuccca

SEQ ID NO: 519999 - RNA, 32 nt, Human
uggaaaaugucacugugacaaaagccagcaua

SEQ ID NO: 520000 - RNA, 32 nt, Human
uggaaaaugucucucagcauugcuuuauuaca

SEQ ID NO: 520001 - RNA, 32 nt, Human
uggaaaauucacuauguuuccacacaccaaca

SEQ ID NO: 520002 - RNA, 32 nt, Human
uggaaaauuucaggacuuuucuuuugcaagug

SEQ ID NO: 520003 - RNA, 32 nt, Human
uggaaaauuuucuccucgguuugcuaguaucu

SEQ ID NO: 520004 - RNA, 32 nt, Human
uggaaacaaucugagagacaggaaaagugcaa

SEQ ID NO: 520005 - RNA, 32 nt, Human
uggaaacagagccacugucaagaaggaaucug

SEQ ID NO: 520006 - RNA, 32 nt, Human
uggaaacagaguggaaacacauggagcaucag

SEQ ID NO: 520007 - RNA, 32 nt, Human
uggaaacagcacacagcaagcaaccacaaaac

SEQ ID NO: 520008 - RNA, 32 nt, Human
uggaaacagcucugugugugaaggugaggacu

SEQ ID NO: 520009 - RNA, 32 nt, Human
uggaaacaucugaggcaccacuuugauucugu

SEQ ID NO: 520010 - RNA, 32 nt, Human
uggaaacaucuucuuccugagaccucguugaa

SEQ ID NO: 520011 - RNA, 32 nt, Human
uggaaaccaagagaauggcugaugucucuuuc

SEQ ID NO: 520012 - RNA, 32 nt, Human
uggaaaccacaucugcuucucucccaggacug

SEQ ID NO: 520013 - RNA, 21 nt, Human
uggaaaccaccuuaccugguu

SEQ ID NO: 520014 - RNA, 21 nt, Human
uggaaaccacguguucugguu

SEQ ID NO: 520015 - RNA, 32 nt, Human
uggaaaccagcccaggccucccagggaagggc

SEQ ID NO: 520016 - RNA, 32 nt, Human
uggaaaccagugcugccgugcaacgcuguguc

SEQ ID NO: 520017 - RNA, 20 nt, Human
uggaaacccaagccaggcgg

SEQ ID NO: 520018 - RNA, 23 nt, Human
uggaaaccccuucuuuacuuccc

SEQ ID NO: 520019 - RNA, 32 nt, Human
uggaaacccugcacucuccccugagcacccac

SEQ ID NO: 520020 - RNA, 32 nt, Human
uggaaaccgaauucccccuccaugguuucccc

SEQ ID NO: 520021 - RNA, 23 nt, Human
uggaaaccgccaaaugcccaggg

SEQ ID NO: 520022 - RNA, 32 nt, Human
uggaaaccgugaccaccauggacugcccuucc

SEQ ID NO: 520023 - RNA, 32 nt, Human
uggaaaccuguauuuauacauuaguuugucuu

SEQ ID NO: 520024 - RNA, 28 nt, Human
uggaaacgauugccaacacauacuucua

SEQ ID NO: 520025 - RNA, 32 nt, Human
uggaaacuacauuuuaaacuuuggaaucaaau

SEQ ID NO: 520026 - RNA, 32 nt, Human
uggaaacuaccaggugugccuggaagaguugg

SEQ ID NO: 520027 - RNA, 32 nt, Human
uggaaacucaaaagcuugcacucucauuuugg

SEQ ID NO: 520028 - RNA, 22 nt, Human
uggaaacucaauugucagagga

SEQ ID NO: 520029 - RNA, 32 nt, Human
uggaaacucaguaauucucccaccuucacauu

SEQ ID NO: 520030 - RNA, 32 nt, Human
uggaaacuccacucugaagcugccgcuuugga

SEQ ID NO: 520031 - RNA, 32 nt, Human
uggaaacugcagcucuguaaaugccucucuag

SEQ ID NO: 520032 - RNA, 23 nt, Human
uggaaacugcucuucuaacucca

SEQ ID NO: 520033 - RNA, 32 nt, Human
uggaaacugcuucuagaaacucuggcucagcc

SEQ ID NO: 520034 - RNA, 24 nt, Human
uggaaacuggacaggccauugcca

SEQ ID NO: 520035 - RNA, 32 nt, Human
uggaaacugggugagagacuguggcagcugcu

SEQ ID NO: 520036 - RNA, 22 nt, Human
uggaaacuggucaauauugcca

SEQ ID NO: 520037 - RNA, 32 nt, Human
uggaaacugguuuuccucuguuuuggucucuu

SEQ ID NO: 520038 - RNA, 32 nt, Human
uggaaacuguccuuuuuggauuccugcugcuu

SEQ ID NO: 520039 - RNA, 32 nt, Human
uggaaacuucaagggcugaugguucuguguuc

SEQ ID NO: 520040 - RNA, 20 nt, Human
uggaaacuucucccacggga

SEQ ID NO: 520041 - RNA, 32 nt, Human
uggaaacuuguggaugcugugaccucaagaag

SEQ ID NO: 520042 - RNA, 20 nt, Human
uggaaagaaaaucccagcag

SEQ ID NO: 520043 - RNA, 32 nt, Human
uggaaagaaaugcagaacuaucauagucacau

SEQ ID NO: 520044 - RNA, 32 nt, Human
uggaaagaacauaguguggcagaagggacagg

SEQ ID NO: 520045 - RNA, 32 nt, Human
uggaaagaagacagggaugaaauauaaucaag

SEQ ID NO: 520046 - RNA, 32 nt, Human
uggaaagaauacugcaacaacuucucgcaauu

SEQ ID NO: 520047 - RNA, 32 nt, Human
uggaaagagaaaaagauggaauaucuuaaaga

SEQ ID NO: 520048 - RNA, 32 nt, Human
uggaaagagauccaggucuggagcuggagaga

SEQ ID NO: 520049 - RNA, 22 nt, Human
uggaaagagcuagcaaacagca

SEQ ID NO: 520050 - RNA, 32 nt, Human
uggaaagagcuuuuuccuucucuacaaggagg

SEQ ID NO: 520051 - RNA, 32 nt, Human
uggaaagaggagcugggaccgcggcgagcagc

SEQ ID NO: 520052 - RNA, 32 nt, Human
uggaaagauacagcuccaggguuaaaaagaga

SEQ ID NO: 520053 - RNA, 32 nt, Human
uggaaagauggaggagaaaaagaaaaggaaga

SEQ ID NO: 520054 - RNA, 32 nt, Human
uggaaagauguggccucaggaaaagggaugag

SEQ ID NO: 520055 - RNA, 32 nt, Human
uggaaagauguggucugagaugggugcugcaa

SEQ ID NO: 520056 - RNA, 32 nt, Human
uggaaagauuugcacacccuccagaaaggaga

SEQ ID NO: 520057 - RNA, 32 nt, Human
uggaaagcaaaggagagcaggaaguuguaaau

SEQ ID NO: 520058 - RNA, 32 nt, Human
uggaaagcaacucuugccccuaccucuucugg

SEQ ID NO: 520059 - RNA, 32 nt, Human
uggaaagcaaggggguggugcguccccaggcc

SEQ ID NO: 520060 - RNA, 32 nt, Human
uggaaagcagccuggccaacauagugggaccc

SEQ ID NO: 520061 - RNA, 32 nt, Human
uggaaagcaguuuggcaguuucuuaaaacguu

SEQ ID NO: 520062 - RNA, 32 nt, Human
uggaaagcauccucaaaacugugggucaguga

SEQ ID NO: 520063 - RNA, 32 nt, Human
uggaaagccagguuguuuuauagagguucuug

SEQ ID NO: 520064 - RNA, 32 nt, Human
uggaaagcccuagaaacuaggguuccucugcc

SEQ ID NO: 520065 - RNA, 32 nt, Human
uggaaagccgauguauaugcucagccaguuua

SEQ ID NO: 520066 - RNA, 32 nt, Human
uggaaagcgucccagaauauuagccaguuuuc

SEQ ID NO: 520067 - RNA, 32 nt, Human
uggaaagcucagggguaggcccaggugggaug

SEQ ID NO: 520068 - RNA, 18 nt, Human
uggaaagcuccuagcaga

SEQ ID NO: 520069 - RNA, 32 nt, Human
uggaaagcugggacuggagccuggggaaaacu

SEQ ID NO: 520070 - RNA, 32 nt, Human
uggaaagcugggaggacagagggcaaggcaga

SEQ ID NO: 520071 - RNA, 22 nt, Human
uggaaaggaaagaugaugcuca

SEQ ID NO: 520072 - RNA, 32 nt, Human
uggaaaggaauuucauccugcccacacacugc

SEQ ID NO: 520073 - RNA, 21 nt, Human
uggaaaggacagcccuugacc

SEQ ID NO: 520074 - RNA, 32 nt, Human
uggaaaggacgguacaccggagcggcggagga

SEQ ID NO: 520075 - RNA, 26 nt, Human
uggaaaggaucuuggguccuaucccu

SEQ ID NO: 520076 - RNA, 32 nt, Human
uggaaaggcacugacaugaccuaaucaugaau

SEQ ID NO: 520077 - RNA, 32 nt, Human
uggaaaggcaggcagagggagaggcacucuga

SEQ ID NO: 520078 - RNA, 32 nt, Human
uggaaaggccacuggggagaaaccuuauuccu

SEQ ID NO: 520079 - RNA, 32 nt, Human
uggaaaggccaggccuggagcuugccucuuca

SEQ ID NO: 520080 - RNA, 32 nt, Human
uggaaagggaaaggggaggagaugggacuuug

SEQ ID NO: 520081 - RNA, 32 nt, Human
uggaaagggaaaggguggggguuaggggaagg

SEQ ID NO: 520082 - RNA, 32 nt, Human
uggaaagggacacacccagcugucugcucgca

SEQ ID NO: 520083 - RNA, 32 nt, Human
uggaaagggagacagccagguggcaccugcag

SEQ ID NO: 520084 - RNA, 21 nt, Human
uggaaagggagauuccacgga

SEQ ID NO: 520085 - RNA, 32 nt, Human
uggaaagggaugacauuuaccuaugugugcug

SEQ ID NO: 520086 - RNA, 32 nt, Human
uggaaaggggcuuccugagcugcuagggggug

SEQ ID NO: 520087 - RNA, 22 nt, Human
uggaaaggucagcuggggccag

SEQ ID NO: 520088 - RNA, 32 nt, Human
uggaaagguucagaaauguggugaggaaguga

SEQ ID NO: 520089 - RNA, 32 nt, Human
uggaaaguaagaaaguuucauggauuagagug

SEQ ID NO: 520090 - RNA, 21 nt, Human
uggaaagucacaaaccgcugg

SEQ ID NO: 520091 - RNA, 24 nt, Human
uggaaaguccuccuccagcuccac

SEQ ID NO: 520092 - RNA, 32 nt, Human
uggaaaguccuccuccagcuccaccucccucc

SEQ ID NO: 520093 - RNA, 32 nt, Human
uggaaaguccugaacuccuggcuuuccaggag

SEQ ID NO: 520094 - RNA, 32 nt, Human
uggaaagucucuuccaguucaucaggguagua

SEQ ID NO: 520095 - RNA, 32 nt, Human
uggaaagucuucgagaagcuucagaggaggga

SEQ ID NO: 520096 - RNA, 32 nt, Human
uggaaagugagugccuacagaaauuucuugga

SEQ ID NO: 520097 - RNA, 32 nt, Human
uggaaaguggaccugugucugugucuguccug

SEQ ID NO: 520098 - RNA, 32 nt, Human
uggaaagugggacugagagggagucagcaggc

SEQ ID NO: 520099 - RNA, 32 nt, Human
uggaaaguguccaaucagauccccaaaacggu

SEQ ID NO: 520100 - RNA, 22 nt, Human
uggaaaguugaugcccaguaag

SEQ ID NO: 520101 - RNA, 32 nt, Human
uggaaaguuuugaaggaggaggcauggcccgg

SEQ ID NO: 520102 - RNA, 32 nt, Human
uggaaauaaaguuuuaaaaaugagagagcagu

SEQ ID NO: 520103 - RNA, 32 nt, Human
uggaaauaaucauaacuugucuuuccaaaaua

SEQ ID NO: 520104 - RNA, 21 nt, Human
uggaaauacaggcaugagcca

SEQ ID NO: 520105 - RNA, 32 nt, Human
uggaaauacagguucuuguccccaaauuaggu

SEQ ID NO: 520106 - RNA, 32 nt, Human
uggaaauagcuuugugaaaagaggguggagag

SEQ ID NO: 520107 - RNA, 28 nt, Human
uggaaauauaccugauaauuaccaccug

SEQ ID NO: 520108 - RNA, 22 nt, Human
uggaaaucaaccgcccgcgggg

SEQ ID NO: 520109 - RNA, 32 nt, Human
uggaaaucaaguauaauagccaccucaaagaa

SEQ ID NO: 520110 - RNA, 22 nt, Human
uggaaaucagaggcacaggaag

SEQ ID NO: 520111 - RNA, 32 nt, Human
uggaaaucauucuccaacgauauacaaauugg

SEQ ID NO: 520112 - RNA, 32 nt, Human
uggaaaucccauuccuccuugugucucaucug

SEQ ID NO: 520113 - RNA, 24 nt, Human
uggaaauccgaccacuaauugcca

SEQ ID NO: 520114 - RNA, 32 nt, Human
uggaaaugaaaccaugugaaccuggccagggc

SEQ ID NO: 520115 - RNA, 20 nt, Human
uggaaaugaacagggcccuc

SEQ ID NO: 520116 - RNA, 32 nt, Human
uggaaaugagccucuccugguaucaggccuag

SEQ ID NO: 520117 - RNA, 32 nt, Human
uggaaaugaucuguauugacuaauacaccagu

SEQ ID NO: 520118 - RNA, 32 nt, Human
uggaaaugaugccaaauuuuuguauuucuuua

SEQ ID NO: 520119 - RNA, 32 nt, Human
uggaaaugcaaauaagugagccucccaaggga

SEQ ID NO: 520120 - RNA, 32 nt, Human
uggaaaugcucuguacaaagauauaagucaug

SEQ ID NO: 520121 - RNA, 32 nt, Human
uggaaaugcugagcuuccauaagucagcugag

SEQ ID NO: 520122 - RNA, 20 nt, Human
uggaaauggauuauugaaga

SEQ ID NO: 520123 - RNA, 29 nt, Human
uggaaauggcuacaauauuuaaccucaga

SEQ ID NO: 520124 - RNA, 23 nt, Human
uggaaaugguccaacacuucccu

SEQ ID NO: 520125 - RNA, 32 nt, Human
uggaaauggucuccugucuccagccugcuuga

SEQ ID NO: 520126 - RNA, 32 nt, Human
uggaaauggugcagccacuggggacaguucug

SEQ ID NO: 520127 - RNA, 22 nt, Human
uggaaauguggagagaauugaa

SEQ ID NO: 520128 - RNA, 32 nt, Human
uggaaauuaguccucaaaguaaccucagcugu

SEQ ID NO: 520129 - RNA, 32 nt, Human
uggaaauucaacuaauuuuuggugcuauuauu

SEQ ID NO: 520130 - RNA, 32 nt, Human
uggaaauucacugagucagcagccuucacacc

SEQ ID NO: 520131 - RNA, 20 nt, Human
uggaaauugaagcccaggga

SEQ ID NO: 520132 - RNA, 32 nt, Human
uggaaauugagucugaagcacucucgcacaca

SEQ ID NO: 520133 - RNA, 32 nt, Human
uggaaauugcuagcagguuccacgauguuuau

SEQ ID NO: 520134 - RNA, 17 nt, Human
uggaaauuggaauggag

SEQ ID NO: 520135 - RNA, 32 nt, Human
uggaaauuguauuugccuucuccacuuuggga

SEQ ID NO: 520136 - RNA, 32 nt, Human
uggaaauugucggucauauuucuagaacuuua

SEQ ID NO: 520137 - RNA, 32 nt, Human
uggaaauuucugagagauguguaguuaauuag

SEQ ID NO: 520138 - RNA, 32 nt, Human
uggaaauuuucaagaagggaaguauggucuug

SEQ ID NO: 520139 - RNA, 32 nt, Human
uggaacaaaagaaucugaacagcagcccuuga

SEQ ID NO: 520140 - RNA, 32 nt, Human
uggaacaaacccucaggcaccagcacagggcu

SEQ ID NO: 520141 - RNA, 32 nt, Human
uggaacaacaaacuguccugguugcuggucag

SEQ ID NO: 520142 - RNA, 32 nt, Human
uggaacaacuguucucccuugugacuaauucc

SEQ ID NO: 520143 - RNA, 21 nt, Human
uggaacaagccuguaguccca

SEQ ID NO: 520144 - RNA, 32 nt, Human
uggaacaagcugggaauggcuuugaguagcua

SEQ ID NO: 520145 - RNA, 32 nt, Human
uggaacaaggaggugggggcaguguggccccu

SEQ ID NO: 520146 - RNA, 32 nt, Human
uggaacaauacaaugcauagaguaaacaugca

SEQ ID NO: 520147 - RNA, 32 nt, Human
uggaacaaugucccuccucuuagaauguccca

SEQ ID NO: 520148 - RNA, 32 nt, Human
uggaacaauugaugccgagugucuaaaaucau

SEQ ID NO: 520149 - RNA, 18 nt, Human
uggaacacaauaccucua

SEQ ID NO: 520150 - RNA, 32 nt, Human
uggaacacagucagugguagguaaucuguagg

SEQ ID NO: 520151 - RNA, 32 nt, Human
uggaacacccgcuguccucuggccucccacac

SEQ ID NO: 520152 - RNA, 32 nt, Human
uggaacaccuuucuguuuaauucccaaaguga

SEQ ID NO: 520153 - RNA, 32 nt, Human
uggaacacugccucauugucuuguuagaucuc

SEQ ID NO: 520154 - RNA, 21 nt, Human
uggaacacuuccugugccagg

SEQ ID NO: 520155 - RNA, 32 nt, Human
uggaacagaaaguaacaaagaggaaugagcca

SEQ ID NO: 520156 - RNA, 32 nt, Human
uggaacagaccagccacugcagcagacagacc

SEQ ID NO: 520157 - RNA, 32 nt, Human
uggaacagagcugcaagaagucucugggcauc

SEQ ID NO: 520158 - RNA, 21 nt, Human
uggaacagcagagccugcucc

SEQ ID NO: 520159 - RNA, 32 nt, Human
uggaacagcaggaggcggaggugcaggggccg

SEQ ID NO: 520160 - RNA, 32 nt, Human
uggaacagcaucuccccugggcuugcuccugg

SEQ ID NO: 520161 - RNA, 32 nt, Human
uggaacagcccugcacgcccaggaugaagggg

SEQ ID NO: 520162 - RNA, 24 nt, Human
uggaacagcugggcaugggucaug

SEQ ID NO: 520163 - RNA, 32 nt, Human
uggaacaggagaggcuucaggagcaggaugag

SEQ ID NO: 520164 - RNA, 32 nt, Human
uggaacaggagggagagccaagggggcggccc

SEQ ID NO: 520165 - RNA, 32 nt, Human
uggaacagggaaacccagagagccagugcugu

SEQ ID NO: 520166 - RNA, 32 nt, Human
uggaacaggggcccugggcauuucugcugaga

SEQ ID NO: 520167 - RNA, 32 nt, Human
uggaacagugccuggcaccuaggaagccuuca

SEQ ID NO: 520168 - RNA, 32 nt, Human
uggaacaguuuggagggcucagaaggagacag

SEQ ID NO: 520169 - RNA, 32 nt, Human
uggaacauagccaagaccaggagaagagagag

SEQ ID NO: 520170 - RNA, 32 nt, Human
uggaacauccuguaacuuuucacugcacuugg

SEQ ID NO: 520171 - RNA, 32 nt, Human
uggaacaugagacucgaggcugagcguggauc

SEQ ID NO: 520172 - RNA, 32 nt, Human
uggaacaugccuguggucccagcuucuuggga

SEQ ID NO: 520173 - RNA, 32 nt, Human
uggaacauggaaauuuuugaaagugauauaug

SEQ ID NO: 520174 - RNA, 32 nt, Human
uggaacauggaaugccuuuccaggaaaacguu

SEQ ID NO: 520175 - RNA, 21 nt, Human
uggaacaugugauuucagggu

SEQ ID NO: 520176 - RNA, 32 nt, Human
uggaacauguugaauuuuaucaggugguuaca

SEQ ID NO: 520177 - RNA, 21 nt, Human
uggaaccaaaaaucacuguca

SEQ ID NO: 520178 - RNA, 32 nt, Human
uggaaccaaaccugcgcgcguggccgggccgu

SEQ ID NO: 520179 - RNA, 32 nt, Human
uggaaccacaauauuauuguuaccuucaaaga

SEQ ID NO: 520180 - RNA, 21 nt, Human
uggaaccacaugagccugcuc

SEQ ID NO: 520181 - RNA, 32 nt, Human
uggaaccagagagcugggagggaccaagguug

SEQ ID NO: 520182 - RNA, 32 nt, Human
uggaaccagccaggccaggcaaccaguggccc

SEQ ID NO: 520183 - RNA, 22 nt, Human
uggaaccaggaauucauucuca

SEQ ID NO: 520184 - RNA, 32 nt, Human
uggaaccaggacuucguuguuccuucauugug

SEQ ID NO: 520185 - RNA, 32 nt, Human
uggaaccaggagacacguguggcgggcagugg

SEQ ID NO: 520186 - RNA, 32 nt, Human
uggaaccagggcugccuuccagcacuucaugg

SEQ ID NO: 520187 - RNA, 32 nt, Human
uggaaccaguagcaaggagcccgagaucagcc

SEQ ID NO: 520188 - RNA, 32 nt, Human
uggaaccagucaggaaccaggcucuggaaggc

SEQ ID NO: 520189 - RNA, 32 nt, Human
uggaaccauaaggguaaccagauuuucaucua

SEQ ID NO: 520190 - RNA, 22 nt, Human
uggaaccaugccccucccaguc

SEQ ID NO: 520191 - RNA, 32 nt, Human
uggaaccauggaguguguagaagagaagaagg

SEQ ID NO: 520192 - RNA, 32 nt, Human
uggaacccacacagauaggggagggauuaagc

SEQ ID NO: 520193 - RNA, 32 nt, Human
uggaacccacagaauguucaacagggcagcac

SEQ ID NO: 520194 - RNA, 32 nt, Human
uggaacccagaaggucaaggcugcaaugagcc

SEQ ID NO: 520195 - RNA, 32 nt, Human
uggaacccagaagguggagguugcagugagcc

SEQ ID NO: 520196 - RNA, 32 nt, Human
uggaacccaggaggcaaagguugcagugagcc

SEQ ID NO: 520197 - RNA, 32 nt, Human
uggaacccaggaggcagaggucgcagugaguc

SEQ ID NO: 520198 - RNA, 32 nt, Human
uggaacccaggagguggagguugcagugagcu

SEQ ID NO: 520199 - RNA, 32 nt, Human
uggaaccccagcuucccuccagccucuccucc

SEQ ID NO: 520200 - RNA, 32 nt, Human
uggaaccccaggagccugacuuaaggucgcug

SEQ ID NO: 520201 - RNA, 32 nt, Human
uggaacccgggagguagaggcugcagugagcc

SEQ ID NO: 520202 - RNA, 24 nt, Human
uggaacccggugcucccucuguca

SEQ ID NO: 520203 - RNA, 32 nt, Human
uggaacccucccuacccugccugucuucuguu

SEQ ID NO: 520204 - RNA, 32 nt, Human
uggaacccugcucucagccuggaggcuggcag

SEQ ID NO: 520205 - RNA, 32 nt, Human
uggaacccugggaacugcccucccccuuagcu

SEQ ID NO: 520206 - RNA, 32 nt, Human
uggaaccgacucuaaagccauuguagacccuc

SEQ ID NO: 520207 - RNA, 20 nt, Human
uggaaccgggccgcagcccc

SEQ ID NO: 520208 - RNA, 32 nt, Human
uggaaccguuuaugaggaaaacugagcagggu

SEQ ID NO: 520209 - RNA, 32 nt, Human
uggaaccuagagcuggagugaggaguagaggu

SEQ ID NO: 520210 - RNA, 32 nt, Human
uggaaccucaggccuagacuagguugccuuug

SEQ ID NO: 520211 - RNA, 32 nt, Human
uggaaccugccugcucccucucccagaccagc

SEQ ID NO: 520212 - RNA, 32 nt, Human
uggaaccuggcaggcccugcccagccagccau

SEQ ID NO: 520213 - RNA, 32 nt, Human
uggaaccugggagccggaggcugcagugagcc

SEQ ID NO: 520214 - RNA, 32 nt, Human
uggaaccugggagguggaggcugcagugaacc

SEQ ID NO: 520215 - RNA, 32 nt, Human
uggaaccuuaccucuccuccuuagcccaauau

SEQ ID NO: 520216 - RNA, 32 nt, Human
uggaaccuuauccaaccucuuggugcuucagu

SEQ ID NO: 520217 - RNA, 32 nt, Human
uggaaccuuuggaaccugcugucaacaggucu

SEQ ID NO: 520218 - RNA, 23 nt, Human
uggaacgaucuuggcucacugca

SEQ ID NO: 520219 - RNA, 21 nt, Human
uggaacgcagugguguuuuca

SEQ ID NO: 520220 - RNA, 32 nt, Human
uggaacgccguugccaccgaggaggcggcggc

SEQ ID NO: 520221 - RNA, 32 nt, Human
uggaacgcgggcgcuccuccagcuuccgaguc

SEQ ID NO: 520222 - RNA, 32 nt, Human
uggaacgcgguugccaccgaggaggcggcggc

SEQ ID NO: 520223 - RNA, 32 nt, Human
uggaacguggaggcagagguugcagugagccg

SEQ ID NO: 520224 - RNA, 32 nt, Human
uggaacguuccaguuggaagguuccuaugccu

SEQ ID NO: 520225 - RNA, 32 nt, Human
uggaacuaagggcagggacucaugcauaaggg

SEQ ID NO: 520226 - RNA, 32 nt, Human
uggaacuaauccccuguggauaccaagggaug

SEQ ID NO: 520227 - RNA, 32 nt, Human
uggaacuacaccauuggcucuccugggucucc

SEQ ID NO: 520228 - RNA, 32 nt, Human
uggaacucacagccaccacuaccaccacuuua

SEQ ID NO: 520229 - RNA, 32 nt, Human
uggaacucagcugucuguggcuucccaugucu

SEQ ID NO: 520230 - RNA, 32 nt, Human
uggaacucaggaggcggaggcugcagucaacc

SEQ ID NO: 520231 - RNA, 22 nt, Human
uggaacucccauagucaucugc

SEQ ID NO: 520232 - RNA, 32 nt, Human
uggaacucccgagggccucuaggaccaggguu

SEQ ID NO: 520233 - RNA, 32 nt, Human
uggaacucccgauuucaggugggcuaaaagag

SEQ ID NO: 520234 - RNA, 32 nt, Human
uggaacuccugccuccacagccccuccagugg

SEQ ID NO: 520235 - RNA, 32 nt, Human
uggaacuccuugugggaagaaguuugcaccuc

SEQ ID NO: 520236 - RNA, 32 nt, Human
uggaacucucucucgcagugcucgaggcugug

SEQ ID NO: 520237 - RNA, 32 nt, Human
uggaacucugaguccuccuaugaaccucugua

SEQ ID NO: 520238 - RNA, 32 nt, Human
uggaacucuguggaauucugcccaggcagugg

SEQ ID NO: 520239 - RNA, 32 nt, Human
uggaacugaccacccuccagccugccuuagua

SEQ ID NO: 520240 - RNA, 31 nt, Human
uggaacugacuucuucugucaggaggacugg

SEQ ID NO: 520241 - RNA, 22 nt, Human
uggaacugagaagaacuucaca

SEQ ID NO: 520242 - RNA, 23 nt, Human
uggaacugagauuuagcugcaca

SEQ ID NO: 520243 - RNA, 21 nt, Human
uggaacugagccggggcccuc

SEQ ID NO: 520244 - RNA, 32 nt, Human
uggaacugagccugaaguuauggggcguguau

SEQ ID NO: 520245 - RNA, 32 nt, Human
uggaacugcaacuccagcguccucagcacccc

SEQ ID NO: 520246 - RNA, 32 nt, Human
uggaacugcagccucagcccaucuggcagagu

SEQ ID NO: 520247 - RNA, 32 nt, Human
uggaacugcccauuuucuggaucuucccucuc

SEQ ID NO: 520248 - RNA, 31 nt, Human
uggaacugccucugcugcccugggaucauua

SEQ ID NO: 520249 - RNA, 31 nt, Human
uggaacugccucugggagcuuuggcgucugu

SEQ ID NO: 520250 - RNA, 32 nt, Human
uggaacugcugaggauacaguaaugaauuggc

SEQ ID NO: 520251 - RNA, 32 nt, Human
uggaacugggaggaagcuggagaaaagaugcc

SEQ ID NO: 520252 - RNA, 21 nt, Human
uggaacugggggugcucggca

SEQ ID NO: 520253 - RNA, 32 nt, Human
uggaacugggguaagggcaggagccaguuauu

SEQ ID NO: 520254 - RNA, 32 nt, Human
uggaacuguaggagcaggugaauaaaggaucu

SEQ ID NO: 520255 - RNA, 31 nt, Human
uggaacuuaaaacuacuuuguugaaacauca

SEQ ID NO: 520256 - RNA, 32 nt, Human
uggaacuucauacuucauccuguguaagagua

SEQ ID NO: 520257 - RNA, 32 nt, Human
uggaacuucauauggaccaaguggccacacac

SEQ ID NO: 520258 - RNA, 32 nt, Human
uggaacuuccaccugggcucugcgcuaggucu

SEQ ID NO: 520259 - RNA, 32 nt, Human
uggaacuucccccucaccgccagacuuaagcu

SEQ ID NO: 520260 - RNA, 32 nt, Human
uggaacuucucccucccuauucccacaaaaac

SEQ ID NO: 520261 - RNA, 32 nt, Human
uggaacuucugccuccaccucgcuggggagcc

SEQ ID NO: 520262 - RNA, 24 nt, Human
uggaacuucuggaagauuucaggg

SEQ ID NO: 520263 - RNA, 32 nt, Human
uggaacuucuuccuuccuccugccucugcaca

SEQ ID NO: 520264 - RNA, 32 nt, Human
uggaacuugaacucuuugccuaugggccuggu

SEQ ID NO: 520265 - RNA, 32 nt, Human
uggaacuuuaccagcagccucagcuuuacaaa

SEQ ID NO: 520266 - RNA, 32 nt, Human
uggaacuuucugggauguucucugugccuugg

SEQ ID NO: 520267 - RNA, 23 nt, Human
uggaacuuuuuuccuggguagua

SEQ ID NO: 520268 - RNA, 32 nt, Human
uggaagaaaaacaugugccuucugcuaacugu

SEQ ID NO: 520269 - RNA, 32 nt, Human
uggaagaaaagccucuucuuaaagcuauugua

SEQ ID NO: 520270 - RNA, 32 nt, Human
uggaagaaaaggauuuuggaaacucaaggaaa

SEQ ID NO: 520271 - RNA, 32 nt, Human
uggaagaaaaguagaaaagaguaguacuauug

SEQ ID NO: 520272 - RNA, 32 nt, Human
uggaagaaacacccuuucaucucagaguccac

SEQ ID NO: 520273 - RNA, 32 nt, Human
uggaagaaacuggacacagucaccagcauccc

SEQ ID NO: 520274 - RNA, 32 nt, Human
uggaagaaagcggagagcagcaaagggaagca

SEQ ID NO: 520275 - RNA, 32 nt, Human
uggaagaacaggagaaaaagaaaagcaaaaac

SEQ ID NO: 520276 - RNA, 32 nt, Human
uggaagaaccaguucuggagcucaggccuucc

SEQ ID NO: 520277 - RNA, 32 nt, Human
uggaagaacucacuagaacuucuuugagcauc

SEQ ID NO: 520278 - RNA, 32 nt, Human
uggaagaagaaacaccaguuagaaguuuguuu

SEQ ID NO: 520279 - RNA, 32 nt, Human
uggaagaagauacuccaggcagaggaaauagu

SEQ ID NO: 520280 - RNA, 32 nt, Human
uggaagaagaugaagaaggaaaccaggugaac

SEQ ID NO: 520281 - RNA, 32 nt, Human
uggaagaagcacaggcuccuguccucagaucc

SEQ ID NO: 520282 - RNA, 32 nt, Human
uggaagaagcacaucaagacuguucuccugcg

SEQ ID NO: 520283 - RNA, 32 nt, Human
uggaagaagcagccgccgcagccccgguggaa

SEQ ID NO: 520284 - RNA, 21 nt, Human
uggaagaaggggucucacaaa

SEQ ID NO: 520285 - RNA, 21 nt, Human
uggaagaaguguccuagcaag

SEQ ID NO: 520286 - RNA, 32 nt, Human
uggaagaaucuauccaugugucugccuccaua

SEQ ID NO: 520287 - RNA, 32 nt, Human
uggaagaaugggggugggaggguggaggggcu

SEQ ID NO: 520288 - RNA, 32 nt, Human
uggaagaauucauauaugaaucagaugagaau

SEQ ID NO: 520289 - RNA, 32 nt, Human
uggaagaauugucuugggucacacauaaaaua

SEQ ID NO: 520290 - RNA, 32 nt, Human
uggaagacaagagguuugagcauggcagaagg

SEQ ID NO: 520291 - RNA, 32 nt, Human
uggaagacacagauuccuaauuaguccaaauu

SEQ ID NO: 520292 - RNA, 32 nt, Human
uggaagacacagauuuuucuggaagacaugga

SEQ ID NO: 520293 - RNA, 32 nt, Human
uggaagacagcaucugcuacgagcggaggcac

SEQ ID NO: 520294 - RNA, 32 nt, Human
uggaagacaggaagaaaagaagagaaggaagu

SEQ ID NO: 520295 - RNA, 32 nt, Human
uggaagaccuggaggaagaggaggaggaggag

SEQ ID NO: 520296 - RNA, 32 nt, Human
uggaagacgaggaggacgaggaugaggaggag

SEQ ID NO: 520297 - RNA, 32 nt, Human
uggaagacggggccaagggaaaggccagagcc

SEQ ID NO: 520298 - RNA, 22 nt, Human
uggaagacguuuccuuucuucu

SEQ ID NO: 520299 - RNA, 32 nt, Human
uggaagacuaaagaggugcaaugugaucugag

SEQ ID NO: 520300 - RNA, 32 nt, Human
uggaagacuggauuugcuggaagacuugauuu

SEQ ID NO: 520301 - RNA, 32 nt, Human
uggaagagaagcugggguagggagacaggaag

SEQ ID NO: 520302 - RNA, 21 nt, Human
uggaagagaauggaccaguaa

SEQ ID NO: 520303 - RNA, 32 nt, Human
uggaagagcagccuuuuucaucaggcccacaa

SEQ ID NO: 520304 - RNA, 32 nt, Human
uggaagagccagagggcucuggagugagcaga

SEQ ID NO: 520305 - RNA, 32 nt, Human
uggaagagccuccauuucaucucauguccauu

SEQ ID NO: 520306 - RNA, 32 nt, Human
uggaagagcucggggaucuggcucaggcccac

SEQ ID NO: 520307 - RNA, 32 nt, Human
uggaagagcuggggugggggaggagggagcgu

SEQ ID NO: 520308 - RNA, 32 nt, Human
uggaagaggaagaagagaggaaugagaaagaa

SEQ ID NO: 520309 - RNA, 32 nt, Human
uggaagaggaagaugccuagcacagaccuucu

SEQ ID NO: 520310 - RNA, 20 nt, Human
uggaagaggaauccagugaa

SEQ ID NO: 520311 - RNA, 32 nt, Human
uggaagaggaccccaaacuccaaauaagaagc

SEQ ID NO: 520312 - RNA, 32 nt, Human
uggaagaggacuggugaugguggagggugaga

SEQ ID NO: 520313 - RNA, 32 nt, Human
uggaagaggagaaaggagaaccacugauuuua

SEQ ID NO: 520314 - RNA, 32 nt, Human
uggaagaggaggaggaggagaggcggcgggga

SEQ ID NO: 520315 - RNA, 32 nt, Human
uggaagaggaggaggaggaggagaaggaggag

SEQ ID NO: 520316 - RNA, 32 nt, Human
uggaagaggaggcagaagaggagcagcgcauc

SEQ ID NO: 520317 - RNA, 32 nt, Human
uggaagaggcagcaguggcucaaguuugcgug

SEQ ID NO: 520318 - RNA, 20 nt, Human
uggaagaggcucuuggcaaa

SEQ ID NO: 520319 - RNA, 32 nt, Human
uggaagagggugagacagguauuccucacaga

SEQ ID NO: 520320 - RNA, 32 nt, Human
uggaagaggguuuugcccucucuccucaaaaa

SEQ ID NO: 520321 - RNA, 32 nt, Human
uggaagagguggcggggaccagcugggcagau

SEQ ID NO: 520322 - RNA, 20 nt, Human
uggaagagguucucagcaag

SEQ ID NO: 520323 - RNA, 32 nt, Human
uggaagagugggaggaagcagagggagggacu

SEQ ID NO: 520324 - RNA, 20 nt, Human
uggaagagugggcaggggga

SEQ ID NO: 520325 - RNA, 32 nt, Human
uggaagaguguuagauuuuucuuaauuccacu

SEQ ID NO: 520326 - RNA, 32 nt, Human
uggaagauacacuuuugucuuugcuauuauag

SEQ ID NO: 520327 - RNA, 32 nt, Human
uggaagauaucaugagaaugcacacaaaacug

SEQ ID NO: 520328 - RNA, 32 nt, Human
uggaagauauuaagcaaaauguuuaaagacac

SEQ ID NO: 520329 - RNA, 32 nt, Human
uggaagauauuccuuuuuaacuuugugguaac

SEQ ID NO: 520330 - RNA, 32 nt, Human
uggaagauccugcugugaaaggagcaguacaa

SEQ ID NO: 520331 - RNA, 32 nt, Human
uggaagaucugcugcaaccauuaucuuuguuc

SEQ ID NO: 520332 - RNA, 32 nt, Human
uggaagaugaaggcaggaggcagcagcucaga

SEQ ID NO: 520333 - RNA, 32 nt, Human
uggaagaugaaggcgcaccagaagggaaggac

SEQ ID NO: 520334 - RNA, 32 nt, Human
uggaagaugacaacauccuuuuucauuacugu

SEQ ID NO: 520335 - RNA, 32 nt, Human
uggaagaugauugcaugcauccucauaaucau

SEQ ID NO: 520336 - RNA, 32 nt, Human
uggaagaugcagcuguuugagcagcccugucc

SEQ ID NO: 520337 - RNA, 32 nt, Human
uggaagaugcuauauaguccagaguuguaagc

SEQ ID NO: 520338 - RNA, 32 nt, Human
uggaagauggcucacccaggaggucccaggag

SEQ ID NO: 520339 - RNA, 32 nt, Human
uggaagauguggaagaugucaaguuugugauc

SEQ ID NO: 520340 - RNA, 32 nt, Human
uggaagauguuacauuugaucugaaucuugaa

SEQ ID NO: 520341 - RNA, 32 nt, Human
uggaagauuaggcaugaauacacagagauuua

SEQ ID NO: 520342 - RNA, 28 nt, Human
uggaagcaagcccacccuccccagggga

SEQ ID NO: 520343 - RNA, 32 nt, Human
uggaagcacagucgggacagaauucgauggau

SEQ ID NO: 520344 - RNA, 22 nt, Human
uggaagcagcacccccagagga

SEQ ID NO: 520345 - RNA, 18 nt, Human
uggaagcaggaccaguaa

SEQ ID NO: 520346 - RNA, 32 nt, Human
uggaagcaggcagaggaagacaagggcauccc

SEQ ID NO: 520347 - RNA, 32 nt, Human
uggaagcagggacugguugagggaguggggag

SEQ ID NO: 520348 - RNA, 22 nt, Human
uggaagcagucgaaggacuuca

SEQ ID NO: 520349 - RNA, 32 nt, Human
uggaagcaucaccccaauuggcuccaaauacu

SEQ ID NO: 520350 - RNA, 32 nt, Human
uggaagcaucucccuacacuggcagccaguca

SEQ ID NO: 520351 - RNA, 32 nt, Human
uggaagccaaaccaguucuuaaaugcuacaug

SEQ ID NO: 520352 - RNA, 32 nt, Human
uggaagccaagcgcaacaggugcuuggagguc

SEQ ID NO: 520353 - RNA, 32 nt, Human
uggaagccaccaggaacagaaggucuggccac

SEQ ID NO: 520354 - RNA, 23 nt, Human
uggaagccaccaucaucucuggc

SEQ ID NO: 520355 - RNA, 32 nt, Human
uggaagccacccacaaacacacaccugcuggu

SEQ ID NO: 520356 - RNA, 20 nt, Human
uggaagccacccggaccugg

SEQ ID NO: 520357 - RNA, 32 nt, Human
uggaagccagaacaugguggguggagagaugu

SEQ ID NO: 520358 - RNA, 32 nt, Human
uggaagccagggcuugucacagucucuacugu

SEQ ID NO: 520359 - RNA, 18 nt, Human
uggaagccaucugcugcu

SEQ ID NO: 520360 - RNA, 32 nt, Human
uggaagccaugugauuccaucuugcccgcuca

SEQ ID NO: 520361 - RNA, 32 nt, Human
uggaagccauuuggggaggcaggcugggccaa

SEQ ID NO: 520362 - RNA, 32 nt, Human
uggaagcccagagggacuaugaucugauggcc

SEQ ID NO: 520363 - RNA, 23 nt, Human
uggaagcccaguuccuuaggugg

SEQ ID NO: 520364 - RNA, 21 nt, Human
uggaagccccccaccuuucuc

SEQ ID NO: 520365 - RNA, 21 nt, Human
uggaagcccccucugccuccc

SEQ ID NO: 520366 - RNA, 32 nt, Human
uggaagcccucuuguaaagacacaccuaaacc

SEQ ID NO: 520367 - RNA, 22 nt, Human
uggaagccgucugguacugcuu

SEQ ID NO: 520368 - RNA, 32 nt, Human
uggaagccguggggucccucaggccugggcgg

SEQ ID NO: 520369 - RNA, 24 nt, Human
uggaagccuaugguauucuuggcu

SEQ ID NO: 520370 - RNA, 32 nt, Human
uggaagccucagggagcuacaacaucaaguua

SEQ ID NO: 520371 - RNA, 32 nt, Human
uggaagccuccaccugcagccccaggccuccc

SEQ ID NO: 520372 - RNA, 32 nt, Human
uggaagccucuccuguccuuggcucuucccuc

SEQ ID NO: 520373 - RNA, 32 nt, Human
uggaagccugcacuccagcuucgaguggaacg

SEQ ID NO: 520374 - RNA, 18 nt, Human
uggaagccuguaguccca

SEQ ID NO: 520375 - RNA, 21 nt, Human
uggaagccuguagucccagcu

SEQ ID NO: 520376 - RNA, 32 nt, Human
uggaagccuucagguugcugugcaauggaaua

SEQ ID NO: 520377 - RNA, 23 nt, Human
uggaagccuucccacagcuuccc

SEQ ID NO: 520378 - RNA, 32 nt, Human
uggaagccuuucuuuccaaggccguguuucuc

SEQ ID NO: 520379 - RNA, 32 nt, Human
uggaagcuaaaggaacuugggcauucagggag

SEQ ID NO: 520380 - RNA, 32 nt, Human
uggaagcuccuuuucuccaccucucucaacac

SEQ ID NO: 520381 - RNA, 32 nt, Human
uggaagcucuccacuugaaccucuucauguca

SEQ ID NO: 520382 - RNA, 32 nt, Human
uggaagcucugcaucccuucucccauaccuug

SEQ ID NO: 520383 - RNA, 32 nt, Human
uggaagcucuucauuuauaaagcuauuugaag

SEQ ID NO: 520384 - RNA, 20 nt, Human
uggaagcugagccugaccca

SEQ ID NO: 520385 - RNA, 23 nt, Human
uggaagcugcccuuuguucugua

SEQ ID NO: 520386 - RNA, 32 nt, Human
uggaagcugcuugugaugcgccugguccaggg

SEQ ID NO: 520387 - RNA, 32 nt, Human
uggaagcuggagugugacuggaaaaauacuca

SEQ ID NO: 520388 - RNA, 24 nt, Human
uggaagcuguggcucacaccugua

SEQ ID NO: 520389 - RNA, 21 nt, Human
uggaagcuguucaagauacau

SEQ ID NO: 520390 - RNA, 21 nt, Human
uggaagcuuacacaucucccu

SEQ ID NO: 520391 - RNA, 32 nt, Human
uggaagcuuccccuccugccuuaugcucaccu

SEQ ID NO: 520392 - RNA, 32 nt, Human
uggaagcuucccugagcaacagaccagaagag

SEQ ID NO: 520393 - RNA, 32 nt, Human
uggaaggaaaggugacugugugaucugauucu

SEQ ID NO: 520394 - RNA, 32 nt, Human
uggaaggaagggaggaaggaaaggaggagaaa

SEQ ID NO: 520395 - RNA, 32 nt, Human
uggaaggaaucagcuauguucugccuuuugcu

SEQ ID NO: 520396 - RNA, 32 nt, Human
uggaaggacacauacuacugaacuaggaaggu

SEQ ID NO: 520397 - RNA, 26 nt, Human
uggaaggacagauucgagggggccag

SEQ ID NO: 520398 - RNA, 32 nt, Human
uggaaggacagauucgagggggccaguauugu

SEQ ID NO: 520399 - RNA, 32 nt, Human
uggaaggacaggcagcacgggagccaggcgcu

SEQ ID NO: 520400 - RNA, 32 nt, Human
uggaaggagacaugugacauggggagggagag

SEQ ID NO: 520401 - RNA, 32 nt, Human
uggaaggagagggcacagaagcagcuguuuac

SEQ ID NO: 520402 - RNA, 32 nt, Human
uggaaggagagggugagugggggauggcuuuc

SEQ ID NO: 520403 - RNA, 32 nt, Human
uggaaggagcaucuccccucuugucuguggaa

SEQ ID NO: 520404 - RNA, 24 nt, Human
uggaaggagccucagcccaugcca

SEQ ID NO: 520405 - RNA, 32 nt, Human
uggaaggauaguuuccuggugcgcuggauuag

SEQ ID NO: 520406 - RNA, 32 nt, Human
uggaaggauauggagaaggccacugaacccac

SEQ ID NO: 520407 - RNA, 32 nt, Human
uggaaggauuuagcuuaacaacugucacuccu

SEQ ID NO: 520408 - RNA, 32 nt, Human
uggaaggcaaagucuuggcuuuugagacugaa

SEQ ID NO: 520409 - RNA, 32 nt, Human
uggaaggcacuucuccugccuccugggagccu

SEQ ID NO: 520410 - RNA, 32 nt, Human
uggaaggcagaagggaaaagaaucaaucagaa

SEQ ID NO: 520411 - RNA, 18 nt, Human
uggaaggcaggaccucuc

SEQ ID NO: 520412 - RNA, 32 nt, Human
uggaaggccaaaggaauaaaauucuuuuauau

SEQ ID NO: 520413 - RNA, 21 nt, Human
uggaaggcugaggcaggggga

SEQ ID NO: 520414 - RNA, 32 nt, Human
uggaagggaaacacuggaaauugugagacuuc

SEQ ID NO: 520415 - RNA, 32 nt, Human
uggaagggaagugaggaggagggacaaggaag

SEQ ID NO: 520416 - RNA, 32 nt, Human
uggaagggacugcagaggugugcgagaugagu

SEQ ID NO: 520417 - RNA, 32 nt, Human
uggaagggacugucuguccgucccgcuuguuc

SEQ ID NO: 520418 - RNA, 32 nt, Human
uggaagggagagaaagagaaagaagguauccu

SEQ ID NO: 520419 - RNA, 32 nt, Human
uggaagggagagaggugggugggaggguggga

SEQ ID NO: 520420 - RNA, 32 nt, Human
uggaagggaggaaggccuuucuucuguguuaa

SEQ ID NO: 520421 - RNA, 32 nt, Human
uggaagggaggcauuugcugacagaggacggg

SEQ ID NO: 520422 - RNA, 32 nt, Human
uggaagggcgcagcuccucucccagagcucau

SEQ ID NO: 520423 - RNA, 32 nt, Human
uggaaggggcagcaggaggaguggaaggaaac

SEQ ID NO: 520424 - RNA, 32 nt, Human
uggaaggguccagagcaggagcuucuaucucc

SEQ ID NO: 520425 - RNA, 32 nt, Human
uggaagguagucugagccacugccuuucccaa

SEQ ID NO: 520426 - RNA, 22 nt, Human
uggaaggucacuauuucugacu

SEQ ID NO: 520427 - RNA, 32 nt, Human
uggaagguccaguaccaccaagagcugcccau

SEQ ID NO: 520428 - RNA, 21 nt, Human
uggaaggucgcugcccaggga

SEQ ID NO: 520429 - RNA, 32 nt, Human
uggaaggucucugcuggaagagacugggagag

SEQ ID NO: 520430 - RNA, 32 nt, Human
uggaaggucuuacaauacacugccugccucac

SEQ ID NO: 520431 - RNA, 32 nt, Human
uggaaggugaaagcugagcaggcuccaguccc

SEQ ID NO: 520432 - RNA, 32 nt, Human
uggaaggugaaggugaaggugagacccuguag

SEQ ID NO: 520433 - RNA, 24 nt, Human
uggaaggugccacauauacuuuua

SEQ ID NO: 520434 - RNA, 20 nt, Human
uggaagguggcgguggugaa

SEQ ID NO: 520435 - RNA, 32 nt, Human
uggaagguuuacugcugccucaaguccucuuc

SEQ ID NO: 520436 - RNA, 32 nt, Human
uggaagguuugauguccuguuucucauugaag

SEQ ID NO: 520437 - RNA, 24 nt, Human
uggaaguagaaugauuucaguaga

SEQ ID NO: 520438 - RNA, 32 nt, Human
uggaaguagggagggggaagcaggagaaugag

SEQ ID NO: 520439 - RNA, 32 nt, Human
uggaagucaaaacagcuggagucuaguuuaau

SEQ ID NO: 520440 - RNA, 32 nt, Human
uggaagucacaggacaggaaugacagaucagg

SEQ ID NO: 520441 - RNA, 22 nt, Human
uggaagucaggagccuuugaug

SEQ ID NO: 520442 - RNA, 32 nt, Human
uggaagucaguguggcgauuccucagagaugu

SEQ ID NO: 520443 - RNA, 32 nt, Human
uggaagucauagggagacaggaguuguacuua

SEQ ID NO: 520444 - RNA, 32 nt, Human
uggaagucauugccaacucugccagucacacu

SEQ ID NO: 520445 - RNA, 24 nt, Human
uggaaguccagugaugggaaaaug

SEQ ID NO: 520446 - RNA, 24 nt, Human
uggaagucgcccuggcccacagcu

SEQ ID NO: 520447 - RNA, 19 nt, Human
uggaagucugggaaugagg

SEQ ID NO: 520448 - RNA, 32 nt, Human
uggaagugaaggagggaaagugcagaggcuuu

SEQ ID NO: 520449 - RNA, 32 nt, Human
uggaagugaccacuuugcuauauacagauauu

SEQ ID NO: 520450 - RNA, 32 nt, Human
uggaagugaccagcucggcaccugaggagaca

SEQ ID NO: 520451 - RNA, 32 nt, Human
uggaagugagaggugaagccagcuggucuucu

SEQ ID NO: 520452 - RNA, 32 nt, Human
uggaagugagguuuuggagcagccuccagagg

SEQ ID NO: 520453 - RNA, 22 nt, Human
uggaagugcagcaggcagguga

SEQ ID NO: 520454 - RNA, 32 nt, Human
uggaagugccuguagucccagcuacucuggag

SEQ ID NO: 520455 - RNA, 32 nt, Human
uggaagugcuucuguuaagacagacauguagc

SEQ ID NO: 520456 - RNA, 32 nt, Human
uggaaguggacugacaugcucuucugacauca

SEQ ID NO: 520457 - RNA, 32 nt, Human
uggaagugucugcacuggggucaugcacugag

SEQ ID NO: 520458 - RNA, 32 nt, Human
uggaaguuaagaggggugagaaaacaaagaag

SEQ ID NO: 520459 - RNA, 32 nt, Human
uggaaguucauugaagagucugaaauuaggga

SEQ ID NO: 520460 - RNA, 32 nt, Human
uggaaguuccuucacaccaauucuccuccuga

SEQ ID NO: 520461 - RNA, 23 nt, Human
uggaaguugccacuccagugccc

SEQ ID NO: 520462 - RNA, 32 nt, Human
uggaaguugcucugggugagucaaugagugag

SEQ ID NO: 520463 - RNA, 32 nt, Human
uggaauaaaagauaaccguucaucuuaccuaa

SEQ ID NO: 520464 - RNA, 32 nt, Human
uggaauaaaaggagguuuuccugauguggugu

SEQ ID NO: 520465 - RNA, 32 nt, Human
uggaauaaauuaucuuuuucagucuccucuaa

SEQ ID NO: 520466 - RNA, 32 nt, Human
uggaauaagggcccgaugcagcauuuucuugc

SEQ ID NO: 520467 - RNA, 32 nt, Human
uggaauacaagcuugaaucugggaaacaagcu

SEQ ID NO: 520468 - RNA, 32 nt, Human
uggaauacacagagagaggcagcagcuugcuc

SEQ ID NO: 520469 - RNA, 32 nt, Human
uggaauacaguggugugaucauagcucacugc

SEQ ID NO: 520470 - RNA, 20 nt, Human
uggaauacccaugggcccuc

SEQ ID NO: 520471 - RNA, 32 nt, Human
uggaauacucauuuguggaugauucaacacag

SEQ ID NO: 520472 - RNA, 32 nt, Human
uggaauacugaaaagaaaucacuuccuugaaa

SEQ ID NO: 520473 - RNA, 32 nt, Human
uggaauacuugaauucuggcugugguguaaac

SEQ ID NO: 520474 - RNA, 32 nt, Human
uggaauagacagaguccagcugcccaaaccgu

SEQ ID NO: 520475 - RNA, 32 nt, Human
uggaauagcacaagggcaucacguacuucacg

SEQ ID NO: 520476 - RNA, 32 nt, Human
uggaauagcagagcaaaauauggauaaugaaa

SEQ ID NO: 520477 - RNA, 32 nt, Human
uggaauaggagcuugcucuguccacucuacac

SEQ ID NO: 520478 - RNA, 32 nt, Human
uggaauagggcugaagccagggagccaagugg

SEQ ID NO: 520479 - RNA, 20 nt, Human
uggaauaguaaacuaaagua

SEQ ID NO: 520480 - RNA, 22 nt, Human
uggaauauaaacuguacacaua

SEQ ID NO: 520481 - RNA, 32 nt, Human
uggaauauacaaacaauuucaaaaagaaaggu

SEQ ID NO: 520482 - RNA, 32 nt, Human
uggaauauacagguaauaaauaguuugaugua

SEQ ID NO: 520483 - RNA, 21 nt, Human
uggaauaucucuaaaaacaua

SEQ ID NO: 520484 - RNA, 31 nt, Human
uggaauaugaaaugccuacuuaaguacaguu

SEQ ID NO: 520485 - RNA, 32 nt, Human
uggaauaugagaggaugggaggcccuuuagag

SEQ ID NO: 520486 - RNA, 32 nt, Human
uggaauauuuccaauaaacacaaggugccgua

SEQ ID NO: 520487 - RNA, 32 nt, Human
uggaauauuucuggcuuuagaaguacaggagg

SEQ ID NO: 520488 - RNA, 32 nt, Human
uggaaucaaaggcuccuucgggugauuaccuc

SEQ ID NO: 520489 - RNA, 32 nt, Human
uggaaucaacacagacuugcucuccaaagaga

SEQ ID NO: 520490 - RNA, 32 nt, Human
uggaaucacagucaagacggaucaauaauaug

SEQ ID NO: 520491 - RNA, 32 nt, Human
uggaaucacauucuuagcacaccuacaccucu

SEQ ID NO: 520492 - RNA, 32 nt, Human
uggaaucacccagaggggugccuugcccuggc

SEQ ID NO: 520493 - RNA, 32 nt, Human
uggaaucaccuuucccccucccaugugcuuuc

SEQ ID NO: 520494 - RNA, 32 nt, Human
uggaaucacugcaaaucuaucugcucuucaga

SEQ ID NO: 520495 - RNA, 32 nt, Human
uggaaucagaagaccuaccuuugauuccuggc

SEQ ID NO: 520496 - RNA, 32 nt, Human
uggaaucagagagaagagguuugcauuguuaa

SEQ ID NO: 520497 - RNA, 32 nt, Human
uggaaucauccaguguuagagcauugggaccc

SEQ ID NO: 520498 - RNA, 32 nt, Human
uggaaucaucccugucauguaaauaggaaauc

SEQ ID NO: 520499 - RNA, 32 nt, Human
uggaaucaugacucccacaaugccuugggcac

SEQ ID NO: 520500 - RNA, 32 nt, Human
uggaauccagaacuuuccauuugcagugugca

SEQ ID NO: 520501 - RNA, 32 nt, Human
uggaauccccuaggagccuucagucugggaga

SEQ ID NO: 520502 - RNA, 32 nt, Human
uggaauccuaccaucccaggaggcaggcacag

SEQ ID NO: 520503 - RNA, 32 nt, Human
uggaauccuaguuugcuaaccugcauuugugu

SEQ ID NO: 520504 - RNA, 32 nt, Human
uggaauccuccucugcgaguugcugaaugcua

SEQ ID NO: 520505 - RNA, 32 nt, Human
uggaauccucuuugaaguucccccucucuuug

SEQ ID NO: 520506 - RNA, 24 nt, Human
uggaauccugugcucccucugugc

SEQ ID NO: 520507 - RNA, 32 nt, Human
uggaaucgauuuccucccaccuccgugugacg

SEQ ID NO: 520508 - RNA, 32 nt, Human
uggaaucgcuugaacccaggaggcggagguug

SEQ ID NO: 520509 - RNA, 32 nt, Human
uggaaucuaagcuguauauguguacauuugua

SEQ ID NO: 520510 - RNA, 32 nt, Human
uggaaucucacuggugccccaggagagcgaga

SEQ ID NO: 520511 - RNA, 32 nt, Human
uggaaucugaggcauccucugacuccacucaa

SEQ ID NO: 520512 - RNA, 32 nt, Human
uggaaucugcugcaguggcuaccucuaugccu

SEQ ID NO: 520513 - RNA, 32 nt, Human
uggaaucuuguucucuugcccaggcuggagug

SEQ ID NO: 520514 - RNA, 32 nt, Human
uggaaugaaccuaaauggugcauuaaaggaau

SEQ ID NO: 520515 - RNA, 32 nt, Human
uggaaugaaggcugcaggcacugguugcagac

SEQ ID NO: 520516 - RNA, 32 nt, Human
uggaaugaccagugauuucagcucucacuccc

SEQ ID NO: 520517 - RNA, 32 nt, Human
uggaaugacuacaggcaugggccaccacaccc

SEQ ID NO: 520518 - RNA, 32 nt, Human
uggaaugagcagucuuccauuccaacuuuagu

SEQ ID NO: 520519 - RNA, 32 nt, Human
uggaaugaggaaccucggucuuugaguuaugg

SEQ ID NO: 520520 - RNA, 32 nt, Human
uggaaugaggugaagggcaagugcuuucccag

SEQ ID NO: 520521 - RNA, 22 nt, Human
uggaaugaguugaucauuccag

SEQ ID NO: 520522 - RNA, 32 nt, Human
uggaaugauaaauacagccauacuuaaauaga

SEQ ID NO: 520523 - RNA, 32 nt, Human
uggaaugauggaccuuuuccccacuggauuag

SEQ ID NO: 520524 - RNA, 32 nt, Human
uggaaugauucacauccucucaaguuaggagg

SEQ ID NO: 520525 - RNA, 32 nt, Human
uggaaugcacugaauaaagcacgugcaaggac

SEQ ID NO: 520526 - RNA, 32 nt, Human
uggaaugcagagccuggccugccaagcuacaa

SEQ ID NO: 520527 - RNA, 32 nt, Human
uggaaugcaggcaagaggguuccaacucagag

SEQ ID NO: 520528 - RNA, 32 nt, Human
uggaaugcaguggcacaaucauagcucacucc

SEQ ID NO: 520529 - RNA, 32 nt, Human
uggaaugcaguggcacaaucuuagcucacuac

SEQ ID NO: 520530 - RNA, 32 nt, Human
uggaaugcaguggcacgaucuuggcucacugc

SEQ ID NO: 520531 - RNA, 32 nt, Human
uggaaugcaguggcaugaucucagcucacugc

SEQ ID NO: 520532 - RNA, 32 nt, Human
uggaaugcaguggcaugaucuuggcucacuga

SEQ ID NO: 520533 - RNA, 32 nt, Human
uggaaugcaguggcaugaucuuggcucacugc

SEQ ID NO: 520534 - RNA, 32 nt, Human
uggaaugcaguggcgagaucauagcucacugc

SEQ ID NO: 520535 - RNA, 32 nt, Human
uggaaugcaguggcgugaucucggcucacugc

SEQ ID NO: 520536 - RNA, 32 nt, Human
uggaaugcaguggcgugaucucggcuuuacug

SEQ ID NO: 520537 - RNA, 32 nt, Human
uggaaugcaguggcgugaucuuggcuuacugc

SEQ ID NO: 520538 - RNA, 32 nt, Human
uggaaugcaguggugcaaucauagcucacugc

SEQ ID NO: 520539 - RNA, 32 nt, Human
uggaaugcaguggugugaucuuggcucacugc

SEQ ID NO: 520540 - RNA, 32 nt, Human
uggaaugcccagcuuggguuucugagcuuuuc

SEQ ID NO: 520541 - RNA, 22 nt, Human
uggaaugccccauggggcucuc

SEQ ID NO: 520542 - RNA, 32 nt, Human
uggaaugccugaggguggagagagcuguggcu

SEQ ID NO: 520543 - RNA, 29 nt, Human
uggaaugcgaaacuuauuugcaaacuuuu

SEQ ID NO: 520544 - RNA, 32 nt, Human
uggaaugcguggucaacugucagcucucaggg

SEQ ID NO: 520545 - RNA, 32 nt, Human
uggaaugcguuuacagucauuguaauggaagc

SEQ ID NO: 520546 - RNA, 32 nt, Human
uggaaugcuguguccucucuucugucuccugc

SEQ ID NO: 520547 - RNA, 32 nt, Human
uggaauggacauccuguauaagcacugaaaaa

SEQ ID NO: 520548 - RNA, 32 nt, Human
uggaauggauugggccucaggccagguggucu

SEQ ID NO: 520549 - RNA, 32 nt, Human
uggaauggcugagccugguucugcaggggagg

SEQ ID NO: 520550 - RNA, 32 nt, Human
uggaaugggauuacuuuggcccagggaagccc

SEQ ID NO: 520551 - RNA, 32 nt, Human
uggaauggggagcaaugagaggagggagugag

SEQ ID NO: 520552 - RNA, 32 nt, Human
uggaauggggucugggcugcuggaaccuauuc

SEQ ID NO: 520553 - RNA, 32 nt, Human
uggaaugggugucccagcaagagaugcuggag

SEQ ID NO: 520554 - RNA, 32 nt, Human
uggaaugguaaagaauuuacuuaaacacaaag

SEQ ID NO: 520555 - RNA, 32 nt, Human
uggaaugguuacuguuuauacugugguauguu

SEQ ID NO: 520556 - RNA, 20 nt, Human
uggaauguaauuguggugaa

SEQ ID NO: 520557 - RNA, 32 nt, Human
uggaauguaguggagagaucauagcucacugu

SEQ ID NO: 520558 - RNA, 32 nt, Human
uggaaugugcgacaagcccaaauguuccaggg

SEQ ID NO: 520559 - RNA, 32 nt, Human
uggaaugugggaugguaacuuaucaacauauu

SEQ ID NO: 520560 - RNA, 32 nt, Human
uggaaugugguggcaugaacauagcucacugu

SEQ ID NO: 520561 - RNA, 32 nt, Human
uggaauguucagcagaacaccaccacugugac

SEQ ID NO: 520562 - RNA, 32 nt, Human
uggaauguugcuggauggauuacauagaugag

SEQ ID NO: 520563 - RNA, 32 nt, Human
uggaauuaaaagccacugacuguuauaaagua

SEQ ID NO: 520564 - RNA, 32 nt, Human
uggaauuacaauuuucaacugggaaacagaaa

SEQ ID NO: 520565 - RNA, 21 nt, Human
uggaauuacaggcaugcgcca

SEQ ID NO: 520566 - RNA, 32 nt, Human
uggaauuacuuaaauuuuaaagccugaaaauu

SEQ ID NO: 520567 - RNA, 32 nt, Human
uggaauuaugugccugaaguuuggaggcacau

SEQ ID NO: 520568 - RNA, 32 nt, Human
uggaauucagaagaaauuugaagaccagauca

SEQ ID NO: 520569 - RNA, 32 nt, Human
uggaauucagcaguuuuauccuggccuuguac

SEQ ID NO: 520570 - RNA, 32 nt, Human
uggaauucagcuauuuaucauaacucuugcua

SEQ ID NO: 520571 - RNA, 32 nt, Human
uggaauucauucucuucauuggcaguucuagu

SEQ ID NO: 520572 - RNA, 32 nt, Human
uggaauucauuuucuuuucguuucauguuuaa

SEQ ID NO: 520573 - RNA, 32 nt, Human
uggaauuccaggccccuccuguccuccugcuc

SEQ ID NO: 520574 - RNA, 32 nt, Human
uggaauucucacugugggcccauuccauggcu

SEQ ID NO: 520575 - RNA, 32 nt, Human
uggaauucuccucuuggucccagggcggggca

SEQ ID NO: 520576 - RNA, 23 nt, Human
uggaauugagaaucuggaccuua

SEQ ID NO: 520577 - RNA, 32 nt, Human
uggaauugaugucggucauaguuuccugaagc

SEQ ID NO: 520578 - RNA, 32 nt, Human
uggaauugcccagccagucacagcaguagcuc

SEQ ID NO: 520579 - RNA, 32 nt, Human
uggaauugcugcucucugagggagaggcugug

SEQ ID NO: 520580 - RNA, 32 nt, Human
uggaauuggaacuuauuuuaaauuguuggagu

SEQ ID NO: 520581 - RNA, 32 nt, Human
uggaauuggaagccugauaauuucgggaggcu

SEQ ID NO: 520582 - RNA, 32 nt, Human
uggaauuggaauuuccuaggaauaucuucuac

SEQ ID NO: 520583 - RNA, 32 nt, Human
uggaauuggauaaauauugcaaguggaugagu

SEQ ID NO: 520584 - RNA, 32 nt, Human
uggaauugggcaccgagaagaccugagaaaaa

SEQ ID NO: 520585 - RNA, 23 nt, Human
uggaauugucuuccccacccuca

SEQ ID NO: 520586 - RNA, 32 nt, Human
uggaauuuaaggcuugauguaaagaagaaccc

SEQ ID NO: 520587 - RNA, 21 nt, Human
uggaauuuaugaucuggguua

SEQ ID NO: 520588 - RNA, 32 nt, Human
uggaauuucacugcaaucccccguaucaucca

SEQ ID NO: 520589 - RNA, 32 nt, Human
uggaauuuccagauuuccugagagcuugguac

SEQ ID NO: 520590 - RNA, 32 nt, Human
uggaauuucucaucuucugccucccuuccuac

SEQ ID NO: 520591 - RNA, 32 nt, Human
uggaauuuguaaccucagcucugggagaggau

SEQ ID NO: 520592 - RNA, 32 nt, Human
uggaauuuuccacuucuggcaucacgucagug

SEQ ID NO: 520593 - RNA, 32 nt, Human
uggacaaaaagcuuuuucugaaaccaacuuuu

SEQ ID NO: 520594 - RNA, 32 nt, Human
uggacaaaauggcuggcuucaaaauauaguca

SEQ ID NO: 520595 - RNA, 32 nt, Human
uggacaaacaccaaauucagacuugccucugg

SEQ ID NO: 520596 - RNA, 32 nt, Human
uggacaaacccuucccccucucugggcacccu

SEQ ID NO: 520597 - RNA, 32 nt, Human
uggacaaagagagagaaagaaagaaggaagga

SEQ ID NO: 520598 - RNA, 32 nt, Human
uggacaaagcaggcuggggcaccaggugugca

SEQ ID NO: 520599 - RNA, 32 nt, Human
uggacaaaggcugggugcaguggcucaugccu

SEQ ID NO: 520600 - RNA, 18 nt, Human
uggacaaaguuaacagca

SEQ ID NO: 520601 - RNA, 32 nt, Human
uggacaaauccugggaaaaccugagacuagaa

SEQ ID NO: 520602 - RNA, 32 nt, Human
uggacaacaaagcaagaccccaucucuauuaa

SEQ ID NO: 520603 - RNA, 32 nt, Human
uggacaacacagugagaccucaucucuaucaa

SEQ ID NO: 520604 - RNA, 32 nt, Human
uggacaacagcugggagcucaacauggacuug

SEQ ID NO: 520605 - RNA, 32 nt, Human
uggacaacaguaacuucucagagcuguucucc

SEQ ID NO: 520606 - RNA, 32 nt, Human
uggacaacaguuacauagugucuugguagcac

SEQ ID NO: 520607 - RNA, 22 nt, Human
uggacaacauaaugagacccca

SEQ ID NO: 520608 - RNA, 32 nt, Human
uggacaacauagcaagaccccaucucuuaaaa

SEQ ID NO: 520609 - RNA, 32 nt, Human
uggacaacauagcaagauuccaucucuaaaaa

SEQ ID NO: 520610 - RNA, 32 nt, Human
uggacaacauagugagaccccgucucuacaaa

SEQ ID NO: 520611 - RNA, 32 nt, Human
uggacaacauggcaaaacccugucucuacaaa

SEQ ID NO: 520612 - RNA, 32 nt, Human
uggacaacauggcaaaacccugucucucccaa

SEQ ID NO: 520613 - RNA, 32 nt, Human
uggacaacauggcaagacccauuucuacaaaa

SEQ ID NO: 520614 - RNA, 32 nt, Human
uggacaacauggcgaaaaaccgccucuacaaa

SEQ ID NO: 520615 - RNA, 32 nt, Human
uggacaacauggcgagaccccaccucuacgaa

SEQ ID NO: 520616 - RNA, 32 nt, Human
uggacaacauggggagaccccaucucuaccgg

SEQ ID NO: 520617 - RNA, 32 nt, Human
uggacaacauggugaaaccccaucucuacgaa

SEQ ID NO: 520618 - RNA, 32 nt, Human
uggacaacauggugaaaccccaucucuuuaaa

SEQ ID NO: 520619 - RNA, 32 nt, Human
uggacaacauggugaaaccccgucucuacaaa

SEQ ID NO: 520620 - RNA, 32 nt, Human
uggacaacuaagugagacuccaucucuacaaa

SEQ ID NO: 520621 - RNA, 32 nt, Human
uggacaagaccccaagauucuucaaggauagg

SEQ ID NO: 520622 - RNA, 32 nt, Human
uggacaagaggugguugguggguggugaaggc

SEQ ID NO: 520623 - RNA, 32 nt, Human
uggacaaggaggugggggcagcugaguuagag

SEQ ID NO: 520624 - RNA, 32 nt, Human
uggacaaguacaacaguggcaaguacauggaa

SEQ ID NO: 520625 - RNA, 32 nt, Human
uggacaauagcugcuuucuucucuauccaaga

SEQ ID NO: 520626 - RNA, 32 nt, Human
uggacaauauagugaaaccccgucucuacuaa

SEQ ID NO: 520627 - RNA, 32 nt, Human
uggacaaucauaaacccuuuugcucagcgauu

SEQ ID NO: 520628 - RNA, 32 nt, Human
uggacaaucugcaaaauggagagaauacaaua

SEQ ID NO: 520629 - RNA, 32 nt, Human
uggacaaugaacacaugggccgccgcucaucc

SEQ ID NO: 520630 - RNA, 31 nt, Human
uggacaaugccacuccuccuguacaccuguc

SEQ ID NO: 520631 - RNA, 32 nt, Human
uggacaaugcuagugacugcacaauauuguga

SEQ ID NO: 520632 - RNA, 24 nt, Human
uggacacaacuacaaagaacagca

SEQ ID NO: 520633 - RNA, 32 nt, Human
uggacacaagagccacugcacaacagccaagg

SEQ ID NO: 520634 - RNA, 32 nt, Human
uggacacaaugacauaaguacucuccacagua

SEQ ID NO: 520635 - RNA, 32 nt, Human
uggacacaauuucacgaaguauacaaagcaac

SEQ ID NO: 520636 - RNA, 21 nt, Human
uggacacacacagcccuggag

SEQ ID NO: 520637 - RNA, 32 nt, Human
uggacacacagaugcacugcugugcugcuuuc

SEQ ID NO: 520638 - RNA, 24 nt, Human
uggacacacaugcagccccuggag

SEQ ID NO: 520639 - RNA, 32 nt, Human
uggacacacucgguuccucagaaagccaagcc

SEQ ID NO: 520640 - RNA, 32 nt, Human
uggacacacuugguuccucagaaagccaagcc

SEQ ID NO: 520641 - RNA, 19 nt, Human
uggacacagagaaacagca

SEQ ID NO: 520642 - RNA, 32 nt, Human
uggacacagagcugcagaguccugaacauccc

SEQ ID NO: 520643 - RNA, 32 nt, Human
uggacacagccauccuggaagacgccggugcc

SEQ ID NO: 520644 - RNA, 19 nt, Human
uggacacagcccacugcag

SEQ ID NO: 520645 - RNA, 32 nt, Human
uggacacaggaccaguuuggaaaagggucagg

SEQ ID NO: 520646 - RNA, 32 nt, Human
uggacacaguagggcuuggugaaugcugcuga

SEQ ID NO: 520647 - RNA, 32 nt, Human
uggacacauacuccugggccagaggcuaaaac

SEQ ID NO: 520648 - RNA, 32 nt, Human
uggacacauacuccugggccagaggcuauaaa

SEQ ID NO: 520649 - RNA, 32 nt, Human
uggacacauauggacacacauauggacacgug

SEQ ID NO: 520650 - RNA, 32 nt, Human
uggacacaugaggaagaggcugcucugggagc

SEQ ID NO: 520651 - RNA, 24 nt, Human
uggacaccagcugggucggucuca

SEQ ID NO: 520652 - RNA, 20 nt, Human
uggacacccaaauagcccca

SEQ ID NO: 520653 - RNA, 32 nt, Human
uggacacccacugugugccaggccccagcggg

SEQ ID NO: 520654 - RNA, 32 nt, Human
uggacacccagaauccacgaaaagcaacucgc

SEQ ID NO: 520655 - RNA, 22 nt, Human
uggacacccggccccagcucca

SEQ ID NO: 520656 - RNA, 32 nt, Human
uggacacccugacccccgaagcggggagggcc

SEQ ID NO: 520657 - RNA, 32 nt, Human
uggacaccucuccucugcugccauacucuccc

SEQ ID NO: 520658 - RNA, 18 nt, Human
uggacaccuguaauccca

SEQ ID NO: 520659 - RNA, 21 nt, Human
uggacaccuguaaucccagcu

SEQ ID NO: 520660 - RNA, 18 nt, Human
uggacaccuguaguccca

SEQ ID NO: 520661 - RNA, 21 nt, Human
uggacaccuguagucccagcu

SEQ ID NO: 520662 - RNA, 32 nt, Human
uggacaccuucacuccagcuggacaaagacuc

SEQ ID NO: 520663 - RNA, 32 nt, Human
uggacaccuucgucuccaucuggugguccagc

SEQ ID NO: 520664 - RNA, 32 nt, Human
uggacacgcauauggacacauauggacacaca

SEQ ID NO: 520665 - RNA, 32 nt, Human
uggacacggaggaggggguagagguggugugg

SEQ ID NO: 520666 - RNA, 32 nt, Human
uggacacggaucugcugggcucugccuuaaac

SEQ ID NO: 520667 - RNA, 32 nt, Human
uggacacguggacaaggcccaggcgcccucug

SEQ ID NO: 520668 - RNA, 18 nt, Human
uggacacuacaaaugcca

SEQ ID NO: 520669 - RNA, 31 nt, Human
uggacacucaauaaauguucauuggugaaaa

SEQ ID NO: 520670 - RNA, 22 nt, Human
uggacacuccccgguucuggcu

SEQ ID NO: 520671 - RNA, 32 nt, Human
uggacacucuguaucuagcuacucuggugggg

SEQ ID NO: 520672 - RNA, 32 nt, Human
uggacacugccucuggagccagccugacacca

SEQ ID NO: 520673 - RNA, 32 nt, Human
uggacacuggaagugccaggaggaaggaaggc

SEQ ID NO: 520674 - RNA, 32 nt, Human
uggacacuggcagccaauggggaggcggccuc

SEQ ID NO: 520675 - RNA, 32 nt, Human
uggacacuggccauucuggucaucucagucug

SEQ ID NO: 520676 - RNA, 32 nt, Human
uggacacuugcucccaucuacuuucuucucua

SEQ ID NO: 520677 - RNA, 21 nt, Human
uggacacuuuauaaucauuaa

SEQ ID NO: 520678 - RNA, 32 nt, Human
uggacacuuuucagaagucacugcaguauucc

SEQ ID NO: 520679 - RNA, 18 nt, Human
uggacacuuuucccaaua

SEQ ID NO: 520680 - RNA, 32 nt, Human
uggacagaaagcuucagaagacaagcugggcc

SEQ ID NO: 520681 - RNA, 18 nt, Human
uggacagaacagaauaau

SEQ ID NO: 520682 - RNA, 32 nt, Human
uggacagaagaaugcucuggugaggcaggugu

SEQ ID NO: 520683 - RNA, 32 nt, Human
uggacagaagccaugaggcagagccagaacca

SEQ ID NO: 520684 - RNA, 32 nt, Human
uggacagaagcccacuuaguuucuugggagca

SEQ ID NO: 520685 - RNA, 19 nt, Human
uggacagaauauugcugug

SEQ ID NO: 520686 - RNA, 32 nt, Human
uggacagacagcagugccugaugggugucccc

SEQ ID NO: 520687 - RNA, 32 nt, Human
uggacagaccugggcuaggaggcacauucaca

SEQ ID NO: 520688 - RNA, 32 nt, Human
uggacagagacaccugcacuuggaacuggacu

SEQ ID NO: 520689 - RNA, 32 nt, Human
uggacagagagccacagaaucaugagugcaga

SEQ ID NO: 520690 - RNA, 32 nt, Human
uggacagagauaugcccagagaugcauaugug

SEQ ID NO: 520691 - RNA, 20 nt, Human
uggacagagcaagaacagua

SEQ ID NO: 520692 - RNA, 32 nt, Human
uggacagagcacuggcugggcaucaggacuag

SEQ ID NO: 520693 - RNA, 32 nt, Human
uggacagagccccagucacugagcugcccacc

SEQ ID NO: 520694 - RNA, 32 nt, Human
uggacagagcccugggcaggcaguaggggagg

SEQ ID NO: 520695 - RNA, 32 nt, Human
uggacagagcuacagaccuauggggccuggaa

SEQ ID NO: 520696 - RNA, 20 nt, Human
uggacagaggcugcccucca

SEQ ID NO: 520697 - RNA, 32 nt, Human
uggacagaggggauugcuaaagugcugaaucg

SEQ ID NO: 520698 - RNA, 32 nt, Human
uggacagaggggcaggggagugccaagguugu

SEQ ID NO: 520699 - RNA, 18 nt, Human
uggacagagggggcgugg

SEQ ID NO: 520700 - RNA, 20 nt, Human
uggacagagggucucacgga

SEQ ID NO: 520701 - RNA, 32 nt, Human
uggacagaguacugcauugcaccaugagcaag

SEQ ID NO: 520702 - RNA, 32 nt, Human
uggacagaguccgaauccuacuccauccuuca

SEQ ID NO: 520703 - RNA, 19 nt, Human
uggacagagucuugcugug

SEQ ID NO: 520704 - RNA, 32 nt, Human
uggacagaguuccugggcagaggggaaagcag

SEQ ID NO: 520705 - RNA, 32 nt, Human
uggacagaugugagccaucuggagcagagggg

SEQ ID NO: 520706 - RNA, 32 nt, Human
uggacagauugauuuccagcugaauaaauugg

SEQ ID NO: 520707 - RNA, 32 nt, Human
uggacagcaucguccuggaauggccacggagu

SEQ ID NO: 520708 - RNA, 32 nt, Human
uggacagcauggcaaaacccuaucucuacaaa

SEQ ID NO: 520709 - RNA, 32 nt, Human
uggacagcaugguccucacacccagcucccug

SEQ ID NO: 520710 - RNA, 32 nt, Human
uggacagccagcccgcccgcccgucccuggcc

SEQ ID NO: 520711 - RNA, 22 nt, Human
uggacagcccagacacuucccu

SEQ ID NO: 520712 - RNA, 32 nt, Human
uggacagcgaaaggagagaaaccaccacaggc

SEQ ID NO: 520713 - RNA, 19 nt, Human
uggacagcgaagucugcgg

SEQ ID NO: 520714 - RNA, 32 nt, Human
uggacagcgcccgcuccugccugggugcacac

SEQ ID NO: 520715 - RNA, 22 nt, Human
uggacagcuccaccagcuccac

SEQ ID NO: 520716 - RNA, 18 nt, Human
uggacagcuccuagcaaa

SEQ ID NO: 520717 - RNA, 32 nt, Human
uggacagcucuggaaggugcucacaggugcac

SEQ ID NO: 520718 - RNA, 32 nt, Human
uggacagcuuuuccuucuucuccagugucuac

SEQ ID NO: 520719 - RNA, 32 nt, Human
uggacaggagguucugguccugccuuuggggc

SEQ ID NO: 520720 - RNA, 20 nt, Human
uggacaggauccaaauagca

SEQ ID NO: 520721 - RNA, 32 nt, Human
uggacaggcaucagccuacuaacaucauaugg

SEQ ID NO: 520722 - RNA, 32 nt, Human
uggacaggccagcauccccagcagguucuggg

SEQ ID NO: 520723 - RNA, 32 nt, Human
uggacaggcugcagagggcuccagguucuggg

SEQ ID NO: 520724 - RNA, 32 nt, Human
uggacaggcuggcauuccccagccucucugcc

SEQ ID NO: 520725 - RNA, 32 nt, Human
uggacagggacagcuggcuacagggaaucaaa

SEQ ID NO: 520726 - RNA, 22 nt, Human
uggacagggaggugacaagucu

SEQ ID NO: 520727 - RNA, 19 nt, Human
uggacagggcugggccagc

SEQ ID NO: 520728 - RNA, 32 nt, Human
uggacaggggagaaacgaaaaccacaaaaaga

SEQ ID NO: 520729 - RNA, 32 nt, Human
uggacagggguggucagagagaggaaggggca

SEQ ID NO: 520730 - RNA, 32 nt, Human
uggacagggugugggcccggggagacaguugu

SEQ ID NO: 520731 - RNA, 22 nt, Human
uggacagguacacccaagcaca

SEQ ID NO: 520732 - RNA, 32 nt, Human
uggacaggugugccgacagaaggaaccagcgu

SEQ ID NO: 520733 - RNA, 32 nt, Human
uggacaguacaaaaacaaagcugcucuuguua

SEQ ID NO: 520734 - RNA, 18 nt, Human
uggacaguacccagcaag

SEQ ID NO: 520735 - RNA, 21 nt, Human
uggacaguaggauucagcaga

SEQ ID NO: 520736 - RNA, 32 nt, Human
uggacaguaucagucuugaucuaaauuguagg

SEQ ID NO: 520737 - RNA, 32 nt, Human
uggacagucagaagcauuggaagaggaaaaug

SEQ ID NO: 520738 - RNA, 32 nt, Human
uggacagucagcaaggaauugucucccagugc

SEQ ID NO: 520739 - RNA, 32 nt, Human
uggacagucugagccaagucccuccugcugga

SEQ ID NO: 520740 - RNA, 32 nt, Human
uggacagugagauaucgggaaaccccaugaaa

SEQ ID NO: 520741 - RNA, 32 nt, Human
uggacagugaggucacaguccacccacccucu

SEQ ID NO: 520742 - RNA, 19 nt, Human
uggacagugcuguugaaga

SEQ ID NO: 520743 - RNA, 32 nt, Human
uggacagugggaugugguguuccacaugugcc

SEQ ID NO: 520744 - RNA, 32 nt, Human
uggacagugggcuuuucaugccucucuuacug

SEQ ID NO: 520745 - RNA, 32 nt, Human
uggacaguguauccuaacaagucccaugucug

SEQ ID NO: 520746 - RNA, 32 nt, Human
uggacagugugggcgcucucccuaccuugccu

SEQ ID NO: 520747 - RNA, 21 nt, Human
uggacaguuagguugauucca

SEQ ID NO: 520748 - RNA, 32 nt, Human
uggacaguugcagagaaacacaggcuugucgu

SEQ ID NO: 520749 - RNA, 32 nt, Human
uggacauaaaacacagaugaggaaagggcuuc

SEQ ID NO: 520750 - RNA, 21 nt, Human
uggacauaaaggcucuuuuca

SEQ ID NO: 520751 - RNA, 22 nt, Human
uggacauaagcucuuucuuucc

SEQ ID NO: 520752 - RNA, 32 nt, Human
uggacauaagugcuggaaaagacuuaaugaug

SEQ ID NO: 520753 - RNA, 32 nt, Human
uggacauacuucuaguuguauucuccauacua

SEQ ID NO: 520754 - RNA, 32 nt, Human
uggacauagcacagaugaaccaaaaauguauu

SEQ ID NO: 520755 - RNA, 21 nt, Human
uggacauaggaaggucccaag

SEQ ID NO: 520756 - RNA, 32 nt, Human
uggacauaguaaaauuuuucuccauaaauaau

SEQ ID NO: 520757 - RNA, 32 nt, Human
uggacauauaucaggaagcuacauacaucaaa

SEQ ID NO: 520758 - RNA, 32 nt, Human
uggacauaugcuggcugugugggguagaggga

SEQ ID NO: 520759 - RNA, 32 nt, Human
uggacaucaagugccuugcauagagcccccuc

SEQ ID NO: 520760 - RNA, 20 nt, Human
uggacaucaccgccccugga

SEQ ID NO: 520761 - RNA, 32 nt, Human
uggacaucagcucuucauuaugcagcuucccu

SEQ ID NO: 520762 - RNA, 32 nt, Human
uggacauccagacgacacagauuuuauccaaa

SEQ ID NO: 520763 - RNA, 32 nt, Human
uggacaucccggcaggagaguccuccaagggg

SEQ ID NO: 520764 - RNA, 32 nt, Human
uggacauccuggagcagaaacagucccauuuu

SEQ ID NO: 520765 - RNA, 19 nt, Human
uggacaucuaccagcccac

SEQ ID NO: 520766 - RNA, 32 nt, Human
uggacaucuccaggaaaccaggccaucugggc

SEQ ID NO: 520767 - RNA, 32 nt, Human
uggacaucucuaguguagcugccacauugauu

SEQ ID NO: 520768 - RNA, 32 nt, Human
uggacaucucuuccucucccaggaagcuuaca

SEQ ID NO: 520769 - RNA, 32 nt, Human
uggacaugagcugagggcacggucgcgggcgg

SEQ ID NO: 520770 - RNA, 21 nt, Human
uggacaugcgacuggggagug

SEQ ID NO: 520771 - RNA, 22 nt, Human
uggacaugcgcaaagggcccuc

SEQ ID NO: 520772 - RNA, 32 nt, Human
uggacaugcuagaggugugaggcugcagaaca

SEQ ID NO: 520773 - RNA, 32 nt, Human
uggacaugcugcagagggcugaaggaggcggg

SEQ ID NO: 520774 - RNA, 32 nt, Human
uggacauggacucugugguacuaaauggugau

SEQ ID NO: 520775 - RNA, 32 nt, Human
uggacaugggagaaagggaugggagccacagu

SEQ ID NO: 520776 - RNA, 20 nt, Human
uggacaugggugcccuccac

SEQ ID NO: 520777 - RNA, 24 nt, Human
uggacaugguggcacgugccugua

SEQ ID NO: 520778 - RNA, 24 nt, Human
uggacaugguggcucaugccugua

SEQ ID NO: 520779 - RNA, 24 nt, Human
uggacauggugguggguaccugua

SEQ ID NO: 520780 - RNA, 32 nt, Human
uggacauguaaugucacaucuuuguggagugu

SEQ ID NO: 520781 - RNA, 32 nt, Human
uggacaugugccuucaggguuccuccggggcc

SEQ ID NO: 520782 - RNA, 32 nt, Human
uggacauguggguggagaagggaggguggcca

SEQ ID NO: 520783 - RNA, 32 nt, Human
uggacauuauugaguuuguggaacccugccuc

SEQ ID NO: 520784 - RNA, 20 nt, Human
uggacauuggaaccuuggag

SEQ ID NO: 520785 - RNA, 21 nt, Human
uggacauuuaaggucuuucca

SEQ ID NO: 520786 - RNA, 32 nt, Human
uggacauuuaaugccaaaaccaggaauauccg

SEQ ID NO: 520787 - RNA, 32 nt, Human
uggacauuugggggccacugcagccccaccgc

SEQ ID NO: 520788 - RNA, 22 nt, Human
uggaccaaaccuucugcacacu

SEQ ID NO: 520789 - RNA, 23 nt, Human
uggaccaaaggacugcccuccac

SEQ ID NO: 520790 - RNA, 32 nt, Human
uggaccaagauguccagaauuauucuugagca

SEQ ID NO: 520791 - RNA, 32 nt, Human
uggaccaagggagccagucuugggcgcuggag

SEQ ID NO: 520792 - RNA, 32 nt, Human
uggaccacagaguggaccugccacacgcagac

SEQ ID NO: 520793 - RNA, 32 nt, Human
uggaccaccagccugggcgcaguggugcuggg

SEQ ID NO: 520794 - RNA, 32 nt, Human
uggaccacccaucuugagccccuuggaguucu

SEQ ID NO: 520795 - RNA, 32 nt, Human
uggaccaccccacuugcugccagccugucagu

SEQ ID NO: 520796 - RNA, 32 nt, Human
uggaccaccuggggcucccugaggauucacgg

SEQ ID NO: 520797 - RNA, 22 nt, Human
uggaccacggggcaccaaucca

SEQ ID NO: 520798 - RNA, 32 nt, Human
uggaccacuaccugcagcuaagcagugagcag

SEQ ID NO: 520799 - RNA, 32 nt, Human
uggaccacuauacuccagccuggcaacagagc

SEQ ID NO: 520800 - RNA, 32 nt, Human
uggaccacugcucuccagccugggcaacagag

SEQ ID NO: 520801 - RNA, 32 nt, Human
uggaccagaagcagggaggguguggagaaggc

SEQ ID NO: 520802 - RNA, 32 nt, Human
uggaccagagaauuccugcaugugcaaguuug

SEQ ID NO: 520803 - RNA, 32 nt, Human
uggaccagaucugucccaguccuggaugccuc

SEQ ID NO: 520804 - RNA, 32 nt, Human
uggaccagcagcucugacucacacacgcacag

SEQ ID NO: 520805 - RNA, 32 nt, Human
uggaccagcaugccgguggggugcaggcgcca

SEQ ID NO: 520806 - RNA, 30 nt, Human
uggaccagccucuccacucaugugacucuu

SEQ ID NO: 520807 - RNA, 32 nt, Human
uggaccagccugaaaugaucuugaaggaagcc

SEQ ID NO: 520808 - RNA, 32 nt, Human
uggaccagccugcugcggguccuggccagggg

SEQ ID NO: 520809 - RNA, 20 nt, Human
uggaccaggagcagcaccaa

SEQ ID NO: 520810 - RNA, 32 nt, Human
uggaccaggaugaagagggaucaaagagauaa

SEQ ID NO: 520811 - RNA, 32 nt, Human
uggaccagggucagcaaagugcagccuacaag

SEQ ID NO: 520812 - RNA, 32 nt, Human
uggaccaggugggacagauuagcugugcccuu

SEQ ID NO: 520813 - RNA, 32 nt, Human
uggaccaguagucacuguuaaauguaaaagua

SEQ ID NO: 520814 - RNA, 31 nt, Human
uggaccagugagaggagagggcuggggcgcu

SEQ ID NO: 520815 - RNA, 32 nt, Human
uggaccaguucuuguugcuauuguacaaguua

SEQ ID NO: 520816 - RNA, 22 nt, Human
uggaccauagaaaauauccaga

SEQ ID NO: 520817 - RNA, 20 nt, Human
uggaccaucuguacagacca

SEQ ID NO: 520818 - RNA, 32 nt, Human
uggaccauggcaagauuuccucauucaucaaa

SEQ ID NO: 520819 - RNA, 31 nt, Human
uggaccauggugcugcucugggagccugcag

SEQ ID NO: 520820 - RNA, 32 nt, Human
uggaccauuucugaaaccugucccacaaaaag

SEQ ID NO: 520821 - RNA, 32 nt, Human
uggacccaaggcagauguccaggcuuuauccu

SEQ ID NO: 520822 - RNA, 20 nt, Human
uggacccaccucccuugcca

SEQ ID NO: 520823 - RNA, 32 nt, Human
uggacccacuacccuucuccuuuccuucccag

SEQ ID NO: 520824 - RNA, 32 nt, Human
uggacccagaacucaaagucagccccaaggaa

SEQ ID NO: 520825 - RNA, 32 nt, Human
uggacccagccccuggagacaccauucacuuu

SEQ ID NO: 520826 - RNA, 32 nt, Human
uggacccaggaggaguggcaggugguggcggg

SEQ ID NO: 520827 - RNA, 32 nt, Human
uggacccaggaggcagagcuugcagugagccg

SEQ ID NO: 520828 - RNA, 23 nt, Human
uggacccaggaggucucugcaga

SEQ ID NO: 520829 - RNA, 32 nt, Human
uggacccaggcagcagccacagaggggcccau

SEQ ID NO: 520830 - RNA, 32 nt, Human
uggacccagggugggguggggcagggcgggcg

SEQ ID NO: 520831 - RNA, 32 nt, Human
uggacccagugacgaguggcccuuguaagggu

SEQ ID NO: 520832 - RNA, 32 nt, Human
uggacccaguggucaauccugcagagaauucg

SEQ ID NO: 520833 - RNA, 32 nt, Human
uggacccaguucagugagguucuuggguuuug

SEQ ID NO: 520834 - RNA, 32 nt, Human
uggacccauccagcugagugaacccagggugg

SEQ ID NO: 520835 - RNA, 21 nt, Human
uggacccauccucccugcuca

SEQ ID NO: 520836 - RNA, 32 nt, Human
uggaccccagaaccccagacaagggggcaggc

SEQ ID NO: 520837 - RNA, 32 nt, Human
uggaccccagaagcgugcugugguguggacug

SEQ ID NO: 520838 - RNA, 32 nt, Human
uggaccccagccccuugcaccuccaugccagg

SEQ ID NO: 520839 - RNA, 32 nt, Human
uggacccccaggaggcuggugccagggagaca

SEQ ID NO: 520840 - RNA, 24 nt, Human
uggacccccuacuacuauuuguca

SEQ ID NO: 520841 - RNA, 32 nt, Human
uggacccccugccucucagugccccugcccua

SEQ ID NO: 520842 - RNA, 23 nt, Human
uggaccccgagauggugcugucu

SEQ ID NO: 520843 - RNA, 32 nt, Human
uggaccccgcagcugcgugggcagccgacaca

SEQ ID NO: 520844 - RNA, 19 nt, Human
uggaccccgccucccagga

SEQ ID NO: 520845 - RNA, 32 nt, Human
uggaccccgcguuccuccucccugccgguccc

SEQ ID NO: 520846 - RNA, 32 nt, Human
uggaccccgguggaugaccugccccucucccc

SEQ ID NO: 520847 - RNA, 32 nt, Human
uggaccccgugccucgaaacaggcaguguugu

SEQ ID NO: 520848 - RNA, 32 nt, Human
uggaccccucuccucugcugccauacuccccc

SEQ ID NO: 520849 - RNA, 32 nt, Human
uggaccccuucaaguugagaacuggucagggc

SEQ ID NO: 520850 - RNA, 32 nt, Human
uggacccgcggggcccggcgccccagacucug

SEQ ID NO: 520851 - RNA, 32 nt, Human
uggacccgcugcugccccagggggcgggccug

SEQ ID NO: 520852 - RNA, 32 nt, Human
uggacccggcucagggcagguggaggagcugg

SEQ ID NO: 520853 - RNA, 32 nt, Human
uggacccgggaggcagagguugcagugagccg

SEQ ID NO: 520854 - RNA, 32 nt, Human
uggacccgggaggcggagguugcagugagccg

SEQ ID NO: 520855 - RNA, 32 nt, Human
uggacccggggaggggaggcugaggcguuugg

SEQ ID NO: 520856 - RNA, 32 nt, Human
uggacccgugagcucaggagccucagacgccu

SEQ ID NO: 520857 - RNA, 32 nt, Human
uggacccucacugcugucucugccuccuuucu

SEQ ID NO: 520858 - RNA, 32 nt, Human
uggacccucagugcccuggcaacagcucugug

SEQ ID NO: 520859 - RNA, 22 nt, Human
uggacccuccaguucugccaca

SEQ ID NO: 520860 - RNA, 32 nt, Human
uggacccuccauuccuccuuucugagcccaac

SEQ ID NO: 520861 - RNA, 32 nt, Human
uggacccucccugagcaacuuccugagcagga

SEQ ID NO: 520862 - RNA, 32 nt, Human
uggacccucuaggucuugggggaagagcuggg

SEQ ID NO: 520863 - RNA, 22 nt, Human
uggacccucugccaggcuccac

SEQ ID NO: 520864 - RNA, 32 nt, Human
uggacccugcuuccuguguaccacugaggggc

SEQ ID NO: 520865 - RNA, 32 nt, Human
uggacccugcuucugugcaccugcugcaggcu

SEQ ID NO: 520866 - RNA, 32 nt, Human
uggacccuggagaaggaggccaggagccagcc

SEQ ID NO: 520867 - RNA, 32 nt, Human
uggacccuggcuuaggggugacucauuucuac

SEQ ID NO: 520868 - RNA, 32 nt, Human
uggacccuggggaccccgucaggagcagguga

SEQ ID NO: 520869 - RNA, 19 nt, Human
uggacccuucccacuacau

SEQ ID NO: 520870 - RNA, 23 nt, Human
uggacccuucccagggaucauug

SEQ ID NO: 520871 - RNA, 32 nt, Human
uggaccgagcccuuugaagaauacucagaagu

SEQ ID NO: 520872 - RNA, 32 nt, Human
uggaccgggugggugaggcugccccucccucc

SEQ ID NO: 520873 - RNA, 32 nt, Human
uggaccuacucucccuccuccccaccauuccu

SEQ ID NO: 520874 - RNA, 32 nt, Human
uggaccuagaagcacacgggaccaggcugggc

SEQ ID NO: 520875 - RNA, 32 nt, Human
uggaccuaggagguggagguugcagugagcug

SEQ ID NO: 520876 - RNA, 32 nt, Human
uggaccuaugaacaaaagaaggcucccuggag

SEQ ID NO: 520877 - RNA, 32 nt, Human
uggaccucagcccugggugcugggccuugaag

SEQ ID NO: 520878 - RNA, 23 nt, Human
uggaccucagguuuccaucugua

SEQ ID NO: 520879 - RNA, 32 nt, Human
uggaccucauacucuucuguuuuccauuccac

SEQ ID NO: 520880 - RNA, 32 nt, Human
uggaccucaucacucugacucugccuucuugg

SEQ ID NO: 520881 - RNA, 32 nt, Human
uggaccucccaaagcgcugggauuacaggcuc

SEQ ID NO: 520882 - RNA, 32 nt, Human
uggaccucccaaagugcuggaauuacaggcgu

SEQ ID NO: 520883 - RNA, 32 nt, Human
uggaccucugaacaaaaagauuaucuuccgcu

SEQ ID NO: 520884 - RNA, 32 nt, Human
uggaccugaaggagcggguagagaaacuagag

SEQ ID NO: 520885 - RNA, 32 nt, Human
uggaccugagggcugaagccugccccaccucc

SEQ ID NO: 520886 - RNA, 32 nt, Human
uggaccugaugaagaaugacacgaggauacac

SEQ ID NO: 520887 - RNA, 32 nt, Human
uggaccugcaggacgagggucagggcucagcc

SEQ ID NO: 520888 - RNA, 32 nt, Human
uggaccugcuucugucagggggacagccagug

SEQ ID NO: 520889 - RNA, 32 nt, Human
uggaccugcuuuggcggaaguugguugacaag

SEQ ID NO: 520890 - RNA, 21 nt, Human
uggaccuggaaucccagcaga

SEQ ID NO: 520891 - RNA, 32 nt, Human
uggaccuggagagaggaugaaagggaauagga

SEQ ID NO: 520892 - RNA, 22 nt, Human
uggaccuggccagcagccgccu

SEQ ID NO: 520893 - RNA, 32 nt, Human
uggaccugggaggaagcuggagaaaagaugcc

SEQ ID NO: 520894 - RNA, 32 nt, Human
uggaccugggaggaaggaaggaccugggagca

SEQ ID NO: 520895 - RNA, 32 nt, Human
uggaccugggaggcagagguuucagugagccc

SEQ ID NO: 520896 - RNA, 32 nt, Human
uggaccugggaggcggagcuugcagugagcug

SEQ ID NO: 520897 - RNA, 32 nt, Human
uggaccugggagguggagguugcagugagcug

SEQ ID NO: 520898 - RNA, 32 nt, Human
uggaccugggagguggagguugcggugagcug

SEQ ID NO: 520899 - RNA, 32 nt, Human
uggaccugggccuauuaguccaugaagaagcu

SEQ ID NO: 520900 - RNA, 32 nt, Human
uggaccugguacugaggagcaagacuguccag

SEQ ID NO: 520901 - RNA, 32 nt, Human
uggaccuggucccaggcucagugaggagaugg

SEQ ID NO: 520902 - RNA, 32 nt, Human
uggaccuggugcagcugggaagcuugggacuc

SEQ ID NO: 520903 - RNA, 32 nt, Human
uggaccuguggcuucucugaggcccuugagua

SEQ ID NO: 520904 - RNA, 32 nt, Human
uggaccuguguacccacccaaggcuaaaggca

SEQ ID NO: 520905 - RNA, 18 nt, Human
uggaccuuaggccuuccu

SEQ ID NO: 520906 - RNA, 32 nt, Human
uggaccuuuaccucgcugccuagauuccgagg

SEQ ID NO: 520907 - RNA, 32 nt, Human
uggaccuuucccccucucccugcggccuuugu

SEQ ID NO: 520908 - RNA, 32 nt, Human
uggaccuuucuuucucugcuuucuugacuuaa

SEQ ID NO: 520909 - RNA, 32 nt, Human
uggaccuuuucgagaggcuccucuguguucau

SEQ ID NO: 520910 - RNA, 32 nt, Human
uggacgacaugaucaaugguggcaggaagcag

SEQ ID NO: 520911 - RNA, 32 nt, Human
uggacgacccuccgcugccacugaugagccag

SEQ ID NO: 520912 - RNA, 19 nt, Human
uggacgaccugcucucuac

SEQ ID NO: 520913 - RNA, 32 nt, Human
uggacgacgcuggcggcccagccugggcaggu

SEQ ID NO: 520914 - RNA, 32 nt, Human
uggacgacgcuugcggcccagccugggcaggu

SEQ ID NO: 520915 - RNA, 32 nt, Human
uggacgagcucaucaucaccgacuggcuggag

SEQ ID NO: 520916 - RNA, 32 nt, Human
uggacgagcuccuggcgcgccugcugcagggg

SEQ ID NO: 520917 - RNA, 32 nt, Human
uggacgauaauggagaaaaagcagggaugcua

SEQ ID NO: 520918 - RNA, 22 nt, Human
uggacgaucucagcucacugca

SEQ ID NO: 520919 - RNA, 32 nt, Human
uggacgaugggccuguuaccagcugggacuua

SEQ ID NO: 520920 - RNA, 32 nt, Human
uggacgcauuuuuauacauaggguaagcgcag

SEQ ID NO: 520921 - RNA, 20 nt, Human
uggacgccucucccccggag

SEQ ID NO: 520922 - RNA, 18 nt, Human
uggacgccuguaauccca

SEQ ID NO: 520923 - RNA, 21 nt, Human
uggacgccuguaaucccagcu

SEQ ID NO: 520924 - RNA, 32 nt, Human
uggacgccuguaaucccagcuacuugggaggc

SEQ ID NO: 520925 - RNA, 24 nt, Human
uggacgcgguggcucacgccugua

SEQ ID NO: 520926 - RNA, 32 nt, Human
uggacgcucgcgaggagcaggcugcagguuuc

SEQ ID NO: 520927 - RNA, 32 nt, Human
uggacgcugcagcuggaacuagcgugccaagu

SEQ ID NO: 520928 - RNA, 32 nt, Human
uggacgcuuugucccaaggcguuucuugcugc

SEQ ID NO: 520929 - RNA, 32 nt, Human
uggacgggagacagagugaagcaucaaccuac

SEQ ID NO: 520930 - RNA, 32 nt, Human
uggacgggagugucuggggcagguguggcaau

SEQ ID NO: 520931 - RNA, 32 nt, Human
uggacgggaugaccuccagaagucccuucaau

SEQ ID NO: 520932 - RNA, 32 nt, Human
uggacgggccaaggagacuccgggcuugagcc

SEQ ID NO: 520933 - RNA, 32 nt, Human
uggacggggcugggaaaaugaauaagaauuau

SEQ ID NO: 520934 - RNA, 32 nt, Human
uggacggggcuggggccaaggcccuggagauc

SEQ ID NO: 520935 - RNA, 32 nt, Human
uggacgguccgcagaagcagaccucauugauu

SEQ ID NO: 520936 - RNA, 21 nt, Human
uggacggugagaucucacaga

SEQ ID NO: 520937 - RNA, 32 nt, Human
uggacguagcacugucauguggcauuuggaaa

SEQ ID NO: 520938 - RNA, 32 nt, Human
uggacguaguuuagcuuaaacuuuauguuaga

SEQ ID NO: 520939 - RNA, 32 nt, Human
uggacgucagguccagccugccccggcagccc

SEQ ID NO: 520940 - RNA, 21 nt, Human
uggacgugcaaagcccuugga

SEQ ID NO: 520941 - RNA, 32 nt, Human
uggacgugcagagacugucugcgcagccccca

SEQ ID NO: 520942 - RNA, 32 nt, Human
uggacgugcguucugccuuccuuguuaauuuu

SEQ ID NO: 520943 - RNA, 24 nt, Human
uggacguggcggcucuugccugua

SEQ ID NO: 520944 - RNA, 32 nt, Human
uggacgugggagaguggagcacuaccuccuca

SEQ ID NO: 520945 - RNA, 32 nt, Human
uggacgugggcccagaggcccacagggacgcc

SEQ ID NO: 520946 - RNA, 24 nt, Human
uggacgugguggcaugugcuugua

SEQ ID NO: 520947 - RNA, 24 nt, Human
uggacgugguggcucagccuugua

SEQ ID NO: 520948 - RNA, 24 nt, Human
uggacgugguggcuuacgccugua

SEQ ID NO: 520949 - RNA, 21 nt, Human
uggacguggugguucaugccu

SEQ ID NO: 520950 - RNA, 32 nt, Human
uggacguguagucccagcuacuuaggaggcug

SEQ ID NO: 520951 - RNA, 32 nt, Human
uggacguuauuugaugaacagaaauaaauuga

SEQ ID NO: 520952 - RNA, 32 nt, Human
uggacguugauuuggagccagcacuuuauuuc

SEQ ID NO: 520953 - RNA, 32 nt, Human
uggacguugccuggcccugccucgaugccucu

SEQ ID NO: 520954 - RNA, 32 nt, Human
uggacguuuccagauugugaauaacucuguga

SEQ ID NO: 520955 - RNA, 21 nt, Human
uggacuaacccgccgccacca

SEQ ID NO: 520956 - RNA, 22 nt, Human
uggacuaagauuuagaauauag

SEQ ID NO: 520957 - RNA, 32 nt, Human
uggacuaauacaucuggcaauacuugaagugg

SEQ ID NO: 520958 - RNA, 32 nt, Human
uggacuaaugacacaaauacuuuaggucgccg

SEQ ID NO: 520959 - RNA, 31 nt, Human
uggacuaauguugaaagaugggauggauugg

SEQ ID NO: 520960 - RNA, 32 nt, Human
uggacuacagcuuauucagccugggaaaaaua

SEQ ID NO: 520961 - RNA, 32 nt, Human
uggacuacaggcaauccuggccuuggcaggga

SEQ ID NO: 520962 - RNA, 32 nt, Human
uggacuacaguuaucggcaggcugugcggcgc

SEQ ID NO: 520963 - RNA, 32 nt, Human
uggacuacauggugaaacuccaucucuacuaa

SEQ ID NO: 520964 - RNA, 32 nt, Human
uggacuaccuuuccucaccucuaucucucuca

SEQ ID NO: 520965 - RNA, 32 nt, Human
uggacuacuucuacgaccugcucuagugggca

SEQ ID NO: 520966 - RNA, 32 nt, Human
uggacuagauuuaacaaaucagcuaugugguu

SEQ ID NO: 520967 - RNA, 32 nt, Human
uggacuagcuuggguuggugaucaugucuccu

SEQ ID NO: 520968 - RNA, 32 nt, Human
uggacuaggagugggaagggccuggacacuca

SEQ ID NO: 520969 - RNA, 32 nt, Human
uggacuaggcugguauauacauauuugaaaag

SEQ ID NO: 520970 - RNA, 32 nt, Human
uggacuagugagcagaggaugagaggacuacc

SEQ ID NO: 520971 - RNA, 21 nt, Human
uggacuagugcaguccuugcc

SEQ ID NO: 520972 - RNA, 32 nt, Human
uggacuauauaauaauauagcaggugcucaau

SEQ ID NO: 520973 - RNA, 24 nt, Human
uggacuauaucaguuuuuggaaag

SEQ ID NO: 520974 - RNA, 32 nt, Human
uggacuauauuuuaaaggggaaucugggguca

SEQ ID NO: 520975 - RNA, 31 nt, Human
uggacuaucaauaaauacaaauugaauauuc

SEQ ID NO: 520976 - RNA, 21 nt, Human
uggacuauccucuuuggaaag

SEQ ID NO: 520977 - RNA, 32 nt, Human
uggacuauggacauccagcagaaaagaggaug

SEQ ID NO: 520978 - RNA, 32 nt, Human
uggacuauuucagacaaccagguuccgacagu

SEQ ID NO: 520979 - RNA, 32 nt, Human
uggacucaagcaguccucccaccucagccucc

SEQ ID NO: 520980 - RNA, 32 nt, Human
uggacucaagugaccaaaaccuugcuuggauu

SEQ ID NO: 520981 - RNA, 32 nt, Human
uggacucaagugauccucccaccucagccucc

SEQ ID NO: 520982 - RNA, 32 nt, Human
uggacucaauggccugggagguuugucccagc

SEQ ID NO: 520983 - RNA, 32 nt, Human
uggacucacuuccugcccaccuggugagggga

SEQ ID NO: 520984 - RNA, 32 nt, Human
uggacucagaaaaacacacaccaccuuuuggc

SEQ ID NO: 520985 - RNA, 21 nt, Human
uggacucagcagcaacaccaa

SEQ ID NO: 520986 - RNA, 21 nt, Human
uggacucagcaggaacaccaa

SEQ ID NO: 520987 - RNA, 32 nt, Human
uggacucaggaggcggaguuugcagugagcug

SEQ ID NO: 520988 - RNA, 32 nt, Human
uggacuccaaagguggagguugcaguaagcug

SEQ ID NO: 520989 - RNA, 23 nt, Human
uggacuccaagcuguaacuuccu

SEQ ID NO: 520990 - RNA, 32 nt, Human
uggacuccagagguggagguugcaguaagcug

SEQ ID NO: 520991 - RNA, 32 nt, Human
uggacuccagccugggcgacagagugagacuc

SEQ ID NO: 520992 - RNA, 32 nt, Human
uggacuccagccugucccucuuagcacucuag

SEQ ID NO: 520993 - RNA, 26 nt, Human
uggacuccagggugccuccaccugac

SEQ ID NO: 520994 - RNA, 21 nt, Human
uggacuccagguuccuugccu

SEQ ID NO: 520995 - RNA, 23 nt, Human
uggacuccagugugacuuugcuu

SEQ ID NO: 520996 - RNA, 32 nt, Human
uggacuccaguuuuggccccucucacacagag

SEQ ID NO: 520997 - RNA, 32 nt, Human
uggacucccagccugggugacagagcgagacu

SEQ ID NO: 520998 - RNA, 24 nt, Human
uggacucccgugucccuccgcgca

SEQ ID NO: 520999 - RNA, 21 nt, Human
uggacucccuccuugaccaaa

SEQ ID NO: 521000 - RNA, 32 nt, Human
uggacucccucuuccucccauuccaccuccac

SEQ ID NO: 521001 - RNA, 32 nt, Human
uggacuccuaccuaucugugcauuuuaccggc

SEQ ID NO: 521002 - RNA, 32 nt, Human
uggacuccuugaagagugggcuucuggagaga

SEQ ID NO: 521003 - RNA, 32 nt, Human
uggacuccuuucuccuuuucuuuccucucuag

SEQ ID NO: 521004 - RNA, 32 nt, Human
uggacucgaagcacagcacccccaucagaaug

SEQ ID NO: 521005 - RNA, 20 nt, Human
uggacucgccuguaaucuca

SEQ ID NO: 521006 - RNA, 32 nt, Human
uggacucgggcugugcaggggcgaggggagca

SEQ ID NO: 521007 - RNA, 32 nt, Human
uggacucgugguacuaaggcuuggccuggaca

SEQ ID NO: 521008 - RNA, 32 nt, Human
uggacucuacgcuuaggcugggcagaggccuc

SEQ ID NO: 521009 - RNA, 24 nt, Human
uggacucuagaggugaugcugcuu

SEQ ID NO: 521010 - RNA, 32 nt, Human
uggacucucagccuugcuguucugccuggaga

SEQ ID NO: 521011 - RNA, 32 nt, Human
uggacucuccaaugcagcugccucuguuaccu

SEQ ID NO: 521012 - RNA, 32 nt, Human
uggacucuccauuccucugccuguacuacccc

SEQ ID NO: 521013 - RNA, 32 nt, Human
uggacucugagcugccccuggcuuccuuuaag

SEQ ID NO: 521014 - RNA, 23 nt, Human
uggacucugaguggcgacugccu

SEQ ID NO: 521015 - RNA, 32 nt, Human
uggacucugcuccugaucccccuucuccuugc

SEQ ID NO: 521016 - RNA, 22 nt, Human
uggacucugggauguguagccu

SEQ ID NO: 521017 - RNA, 32 nt, Human
uggacucuguaacucauaggugcauucuuuuu

SEQ ID NO: 521018 - RNA, 32 nt, Human
uggacucuuaacaggugcuaugugaccaggaa

SEQ ID NO: 521019 - RNA, 32 nt, Human
uggacugaaaagaggaagaggcugcaauggag

SEQ ID NO: 521020 - RNA, 32 nt, Human
uggacugaacggaaucaagcucugagcagagg

SEQ ID NO: 521021 - RNA, 32 nt, Human
uggacugaaggcaugagaugcccuuugagugu

SEQ ID NO: 521022 - RNA, 32 nt, Human
uggacugaaugaccucccaccuccagcauuag

SEQ ID NO: 521023 - RNA, 32 nt, Human
uggacugaccagcuggcacuuccccuggccua

SEQ ID NO: 521024 - RNA, 32 nt, Human
uggacugagacaugaggcugagcugguuccgg

SEQ ID NO: 521025 - RNA, 32 nt, Human
uggacugaggcaaaggcugggccaggcucagc

SEQ ID NO: 521026 - RNA, 32 nt, Human
uggacugaggcaaagggcuggccacaccaccu

SEQ ID NO: 521027 - RNA, 32 nt, Human
uggacugaguagaacuggaggacaagagucga

SEQ ID NO: 521028 - RNA, 32 nt, Human
uggacugagugucccccaggcccagccaggac

SEQ ID NO: 521029 - RNA, 31 nt, Human
uggacugauuggccacccugccaaagcugca

SEQ ID NO: 521030 - RNA, 32 nt, Human
uggacugcacagucuaagcuaauuccgauugg

SEQ ID NO: 521031 - RNA, 32 nt, Human
uggacugcaguggcacaaucauagcucacugc

SEQ ID NO: 521032 - RNA, 32 nt, Human
uggacugcaguggcaugaucucggcucacugc

SEQ ID NO: 521033 - RNA, 32 nt, Human
uggacugcaguggcgugaucucugcucacugc

SEQ ID NO: 521034 - RNA, 32 nt, Human
uggacugccagauuccuugagugugggggauu

SEQ ID NO: 521035 - RNA, 32 nt, Human
uggacugccaugaguuucacaaccucaggccc

SEQ ID NO: 521036 - RNA, 22 nt, Human
uggacugccccccugcacccag

SEQ ID NO: 521037 - RNA, 32 nt, Human
uggacugcccucuccuucuuggugauucaaag

SEQ ID NO: 521038 - RNA, 32 nt, Human
uggacugcgaccuccuucccuccugggagagc

SEQ ID NO: 521039 - RNA, 21 nt, Human
uggacugcgcggcgccgugag

SEQ ID NO: 521040 - RNA, 32 nt, Human
uggacugcgguguggagggaaagcuugggauu

SEQ ID NO: 521041 - RNA, 32 nt, Human
uggacugcguggacccgugagcucaggagccu

SEQ ID NO: 521042 - RNA, 32 nt, Human
uggacugcucagaaaaaugagggagagagaaa

SEQ ID NO: 521043 - RNA, 32 nt, Human
uggacugcugggagggagggggcagcaggccc

SEQ ID NO: 521044 - RNA, 32 nt, Human
uggacugcuuugugcuauaugaaaaucucuga

SEQ ID NO: 521045 - RNA, 22 nt, Human
uggacuggaaaguaaguaggug

SEQ ID NO: 521046 - RNA, 32 nt, Human
uggacuggaaggcagaaagugggauccuggcc

SEQ ID NO: 521047 - RNA, 20 nt, Human
uggacuggaaucuuagcaaa

SEQ ID NO: 521048 - RNA, 21 nt, Human
uggacuggagauccgagcaga

SEQ ID NO: 521049 - RNA, 20 nt, Human
uggacuggaggccccuggag

SEQ ID NO: 521050 - RNA, 32 nt, Human
uggacuggagugaaugggcacagggguggagc

SEQ ID NO: 521051 - RNA, 32 nt, Human
uggacuggauauuaccaucauccaccauccug

SEQ ID NO: 521052 - RNA, 32 nt, Human
uggacuggcaccugggcugcuggagaagucuc

SEQ ID NO: 521053 - RNA, 32 nt, Human
uggacuggcauggauccagugugcagaagagc

SEQ ID NO: 521054 - RNA, 32 nt, Human
uggacuggccaauccaggucccugcacgccuc

SEQ ID NO: 521055 - RNA, 32 nt, Human
uggacuggccaggagucugggaggcagguuuc

SEQ ID NO: 521056 - RNA, 32 nt, Human
uggacuggccaguucauagcagcacugugagg

SEQ ID NO: 521057 - RNA, 32 nt, Human
uggacuggcccaggaggacgugcaucaucacu

SEQ ID NO: 521058 - RNA, 32 nt, Human
uggacuggccgggaggugaugggcggggaagg

SEQ ID NO: 521059 - RNA, 32 nt, Human
uggacugggaggagggggagggugaugcauua

SEQ ID NO: 521060 - RNA, 32 nt, Human
uggacugggucugaucacagcccuuggcccug

SEQ ID NO: 521061 - RNA, 32 nt, Human
uggacugguccagucacagucacccccacuuu

SEQ ID NO: 521062 - RNA, 32 nt, Human
uggacuggucucucagaccccugggccaccau

SEQ ID NO: 521063 - RNA, 32 nt, Human
uggacuguacccuuuucccauucauucacaaa

SEQ ID NO: 521064 - RNA, 32 nt, Human
uggacuguacugcugccaucucuggcucacug

SEQ ID NO: 521065 - RNA, 32 nt, Human
uggacuguaugauuuccaaggacucuaccagu

SEQ ID NO: 521066 - RNA, 32 nt, Human
uggacuguccugcggagagaaaccccagccca

SEQ ID NO: 521067 - RNA, 32 nt, Human
uggacugucucauacugcucuggacuaugugg

SEQ ID NO: 521068 - RNA, 18 nt, Human
uggacuguguacaucuga

SEQ ID NO: 521069 - RNA, 32 nt, Human
uggacugugucacacugccaggcuuccagggc

SEQ ID NO: 521070 - RNA, 32 nt, Human
uggacuguucuguaaaguggcugguaacaaca

SEQ ID NO: 521071 - RNA, 32 nt, Human
uggacuuaaauggugugaccaggaucuaguuu

SEQ ID NO: 521072 - RNA, 32 nt, Human
uggacuuacauaagcagcuguauuccauuaga

SEQ ID NO: 521073 - RNA, 32 nt, Human
uggacuuacccucaucaccuugcucaccaacu

SEQ ID NO: 521074 - RNA, 32 nt, Human
uggacuuagaccagugugugagguuggacuua

SEQ ID NO: 521075 - RNA, 32 nt, Human
uggacuuaggaaggagaaagaaacaagauuaa

SEQ ID NO: 521076 - RNA, 32 nt, Human
uggacuucacauaggacgcccaaagcuacaag

SEQ ID NO: 521077 - RNA, 32 nt, Human
uggacuucacauggucaugcaggaagugagga

SEQ ID NO: 521078 - RNA, 32 nt, Human
uggacuucacccaggaggaguggggucaacua

SEQ ID NO: 521079 - RNA, 32 nt, Human
uggacuucacuggggcugcuggauuggauggg

SEQ ID NO: 521080 - RNA, 32 nt, Human
uggacuucagagcaccugcuucucccuggccu

SEQ ID NO: 521081 - RNA, 32 nt, Human
uggacuucagagggucuaugaaaccccuaaaa

SEQ ID NO: 521082 - RNA, 32 nt, Human
uggacuucagccccucugcucuguacccuuuu

SEQ ID NO: 521083 - RNA, 32 nt, Human
uggacuucagccccugccaguguggcaggauc

SEQ ID NO: 521084 - RNA, 32 nt, Human
uggacuucagccuccagaacugugagaaauac

SEQ ID NO: 521085 - RNA, 32 nt, Human
uggacuuccauuccucuuucuuuugauucccc

SEQ ID NO: 521086 - RNA, 32 nt, Human
uggacuucccugcuguugccaucagggugcac

SEQ ID NO: 521087 - RNA, 32 nt, Human
uggacuuccugggucuaguggggacuuggaga

SEQ ID NO: 521088 - RNA, 32 nt, Human
uggacuucgcaguccacuucugacagccucag

SEQ ID NO: 521089 - RNA, 32 nt, Human
uggacuucucugagucugugcaaucauuuucu

SEQ ID NO: 521090 - RNA, 19 nt, Human
uggacuucuggcuuccaca

SEQ ID NO: 521091 - RNA, 32 nt, Human
uggacuucugguaguguccacauugcucuucc

SEQ ID NO: 521092 - RNA, 32 nt, Human
uggacuugacaacuauucacccuaccucagau

SEQ ID NO: 521093 - RNA, 32 nt, Human
uggacuugccccugccaccuccugccucaggu

SEQ ID NO: 521094 - RNA, 32 nt, Human
uggacuuggaccugggccugcaguuccuacag

SEQ ID NO: 521095 - RNA, 32 nt, Human
uggacuuggauccgaggcagacgaggaagcug

SEQ ID NO: 521096 - RNA, 32 nt, Human
uggacuugggaggcgguuguugcagugagcug

SEQ ID NO: 521097 - RNA, 32 nt, Human
uggacuuggggguaggggaggggugugugugc

SEQ ID NO: 521098 - RNA, 32 nt, Human
uggacuugucuuuuuaaaugcuuuaucuuuuu

SEQ ID NO: 521099 - RNA, 23 nt, Human
uggacuuguuaaacuuuuggaaa

SEQ ID NO: 521100 - RNA, 32 nt, Human
uggacuuguugacggaagaaaaguaggaaugc

SEQ ID NO: 521101 - RNA, 32 nt, Human
uggacuuucacaaucggagauggcagugguga

SEQ ID NO: 521102 - RNA, 32 nt, Human
uggacuuuccuuucuguuccuugggucuauuu

SEQ ID NO: 521103 - RNA, 32 nt, Human
uggacuuugaguggaagaugugauuuggacca

SEQ ID NO: 521104 - RNA, 18 nt, Human
uggacuuuggaggggaag

SEQ ID NO: 521105 - RNA, 32 nt, Human
uggacuuuuccucuggacaaaaugacagcauc

SEQ ID NO: 521106 - RNA, 32 nt, Human
uggacuuuugaguuaagacuuugggggacagu

SEQ ID NO: 521107 - RNA, 32 nt, Human
uggacuuuugcagcuuccuuccaagucuuccu

SEQ ID NO: 521108 - RNA, 32 nt, Human
uggagaaaacauugccugguagcugcagauuc

SEQ ID NO: 521109 - RNA, 32 nt, Human
uggagaaaaccucaaguaaaguuuuauucugc

SEQ ID NO: 521110 - RNA, 21 nt, Human
uggagaaaauacuccagcaaa

SEQ ID NO: 521111 - RNA, 32 nt, Human
uggagaaaaugagaggcccugccuggacccag

SEQ ID NO: 521112 - RNA, 32 nt, Human
uggagaaaaugcuaauacagacaucuuacuuc

SEQ ID NO: 521113 - RNA, 32 nt, Human
uggagaaaaugggcggggguggugugggugau

SEQ ID NO: 521114 - RNA, 32 nt, Human
uggagaaacccagccgccccaaaacuuccuuc

SEQ ID NO: 521115 - RNA, 32 nt, Human
uggagaaaccccaucucuaccaaaaauacaaa

SEQ ID NO: 521116 - RNA, 32 nt, Human
uggagaaaccccaucuuuaccaaaaauacaaa

SEQ ID NO: 521117 - RNA, 32 nt, Human
uggagaaacucaaaccuucaagcccuaggugu

SEQ ID NO: 521118 - RNA, 18 nt, Human
uggagaaacuccagcaag

SEQ ID NO: 521119 - RNA, 32 nt, Human
uggagaaacuccuaauuuaaaugucacagaca

SEQ ID NO: 521120 - RNA, 32 nt, Human
uggagaaacugaaguuacccugggcggcugua

SEQ ID NO: 521121 - RNA, 32 nt, Human
uggagaaacugaggcacagauaaauuaacuug

SEQ ID NO: 521122 - RNA, 32 nt, Human
uggagaaagaauugugccaugaaaaauggaaa

SEQ ID NO: 521123 - RNA, 32 nt, Human
uggagaaagggcccugggccugccucaccacg

SEQ ID NO: 521124 - RNA, 20 nt, Human
uggagaaaggguuuugcaaa

SEQ ID NO: 521125 - RNA, 32 nt, Human
uggagaaauaagagguaagcaugcacuguaag

SEQ ID NO: 521126 - RNA, 32 nt, Human
uggagaaaugccaucucuacuaaaaauacaaa

SEQ ID NO: 521127 - RNA, 32 nt, Human
uggagaaauguauuauuuccaugaucaaaugu

SEQ ID NO: 521128 - RNA, 32 nt, Human
uggagaaauuaacuuucacauauggcuuuggg

SEQ ID NO: 521129 - RNA, 32 nt, Human
uggagaaauucaggcugggugcaguggcucac

SEQ ID NO: 521130 - RNA, 32 nt, Human
uggagaacaacaaauauguucucugaaugagc

SEQ ID NO: 521131 - RNA, 32 nt, Human
uggagaacacagcaacaaggugccaucuugga

SEQ ID NO: 521132 - RNA, 32 nt, Human
uggagaacagacuguagggggagccagagggc

SEQ ID NO: 521133 - RNA, 32 nt, Human
uggagaacaguaagggagcagagugguuaagg

SEQ ID NO: 521134 - RNA, 32 nt, Human
uggagaacaguggugggcauggagaggauaug

SEQ ID NO: 521135 - RNA, 32 nt, Human
uggagaaccaguacuccuucuacuacccgcgg

SEQ ID NO: 521136 - RNA, 25 nt, Human
uggagaacccugggaaggaccuggu

SEQ ID NO: 521137 - RNA, 32 nt, Human
uggagaaccugaagagagaggcugcagagguc

SEQ ID NO: 521138 - RNA, 32 nt, Human
uggagaacggagaagaaguuguagcagaggga

SEQ ID NO: 521139 - RNA, 32 nt, Human
uggagaacuagguuuaaaacagccuggguagg

SEQ ID NO: 521140 - RNA, 32 nt, Human
uggagaacucgcagagguuuaaauaagaucgu

SEQ ID NO: 521141 - RNA, 32 nt, Human
uggagaacugagccuugcaucucuccaggguc

SEQ ID NO: 521142 - RNA, 32 nt, Human
uggagaacugcaacgccuacgcccccagucgu

SEQ ID NO: 521143 - RNA, 32 nt, Human
uggagaagaaggcuugcaggaggcaggagaug

SEQ ID NO: 521144 - RNA, 32 nt, Human
uggagaagagcaaucugggcacuguuaccacu

SEQ ID NO: 521145 - RNA, 32 nt, Human
uggagaagagguacaaaggaaaacgagagggu

SEQ ID NO: 521146 - RNA, 32 nt, Human
uggagaagaguccucaaugagccuggccgagg

SEQ ID NO: 521147 - RNA, 32 nt, Human
uggagaagcaaggcuguccucccagggcugcc

SEQ ID NO: 521148 - RNA, 24 nt, Human
uggagaagcaggccuuauucaacu

SEQ ID NO: 521149 - RNA, 32 nt, Human
uggagaagccaaugcagaacugaugggaaagg

SEQ ID NO: 521150 - RNA, 32 nt, Human
uggagaagccugggugggaagcugcuggccca

SEQ ID NO: 521151 - RNA, 22 nt, Human
uggagaagcgaggccagcaggc

SEQ ID NO: 521152 - RNA, 32 nt, Human
uggagaagcggaggcccaggaggagggggaau

SEQ ID NO: 521153 - RNA, 32 nt, Human
uggagaagcucugcaagagaccugugcaaggg

SEQ ID NO: 521154 - RNA, 32 nt, Human
uggagaagcuguagaaguuacacagaagaucu

SEQ ID NO: 521155 - RNA, 32 nt, Human
uggagaaggaagcacugacucagacucgggua

SEQ ID NO: 521156 - RNA, 32 nt, Human
uggagaaggaccugggcugugggcuucugggu

SEQ ID NO: 521157 - RNA, 32 nt, Human
uggagaagggagaccuggcaguggagggaggc

SEQ ID NO: 521158 - RNA, 32 nt, Human
uggagaagggcccacgugucuccacacgccag

SEQ ID NO: 521159 - RNA, 32 nt, Human
uggagaagguucugagaugcagugagggaaga

SEQ ID NO: 521160 - RNA, 32 nt, Human
uggagaagugagugcuccuugaugguggaaug

SEQ ID NO: 521161 - RNA, 21 nt, Human
uggagaagugcugauggucuu

SEQ ID NO: 521162 - RNA, 32 nt, Human
uggagaaguggaaucacuggccugaggucaca

SEQ ID NO: 521163 - RNA, 32 nt, Human
uggagaagugguuccugcaguguagagauaug

SEQ ID NO: 521164 - RNA, 32 nt, Human
uggagaaguuaaauaaccaagacuucacaggc

SEQ ID NO: 521165 - RNA, 32 nt, Human
uggagaaguuugcgcugcgguucgugagcgca

SEQ ID NO: 521166 - RNA, 32 nt, Human
uggagaauacucacccuucagaaacagaccaa

SEQ ID NO: 521167 - RNA, 32 nt, Human
uggagaauagcgaagacucauucuuccugcac

SEQ ID NO: 521168 - RNA, 23 nt, Human
uggagaaucacaaaagaagugaa

SEQ ID NO: 521169 - RNA, 32 nt, Human
uggagaaucagaaaaucuuucucuaacaaccu

SEQ ID NO: 521170 - RNA, 32 nt, Human
uggagaauccacacccucacgccucaguccaa

SEQ ID NO: 521171 - RNA, 32 nt, Human
uggagaaucugagggcacucucugccagcucc

SEQ ID NO: 521172 - RNA, 18 nt, Human
uggagaaucuucagcaga

SEQ ID NO: 521173 - RNA, 21 nt, Human
uggagaaugaaaccugcucca

SEQ ID NO: 521174 - RNA, 32 nt, Human
uggagaauggcugucucucagcuggggaggag

SEQ ID NO: 521175 - RNA, 32 nt, Human
uggagaaugggaugugaagcaguagaccgcag

SEQ ID NO: 521176 - RNA, 32 nt, Human
uggagaauggggcagcuuccacacugcccagg

SEQ ID NO: 521177 - RNA, 21 nt, Human
uggagaauuguucuuuccucu

SEQ ID NO: 521178 - RNA, 20 nt, Human
uggagaauuuuccuuucccu

SEQ ID NO: 521179 - RNA, 26 nt, Human
uggagacaaaagccuugcuuuccucu

SEQ ID NO: 521180 - RNA, 32 nt, Human
uggagacaagccugggcaacauggugaaacug

SEQ ID NO: 521181 - RNA, 32 nt, Human
uggagacaaggcaugaacaguuccuagagcag

SEQ ID NO: 521182 - RNA, 21 nt, Human
uggagacaauugccugguucc

SEQ ID NO: 521183 - RNA, 32 nt, Human
uggagacaauugggucagauaaucuugguggu

SEQ ID NO: 521184 - RNA, 32 nt, Human
uggagacacagccuucuggcugggacugacuu

SEQ ID NO: 521185 - RNA, 32 nt, Human
uggagacacccaggaggaaggccgugcuccug

SEQ ID NO: 521186 - RNA, 21 nt, Human
uggagacacccucuuuggccc

SEQ ID NO: 521187 - RNA, 32 nt, Human
uggagacagaaaacucuaguucaagagcugua

SEQ ID NO: 521188 - RNA, 23 nt, Human
uggagacagaagggaucccggca

SEQ ID NO: 521189 - RNA, 21 nt, Human
uggagacagaaucucacucca

SEQ ID NO: 521190 - RNA, 32 nt, Human
uggagacagcacagcagcacucacaucccggc

SEQ ID NO: 521191 - RNA, 22 nt, Human
uggagacagccccagacccuuu

SEQ ID NO: 521192 - RNA, 23 nt, Human
uggagacagcccucuuucucacc

SEQ ID NO: 521193 - RNA, 25 nt, Human
uggagacagcuccgagacggcuuca

SEQ ID NO: 521194 - RNA, 32 nt, Human
uggagacaggcaggaggugggggaagagcuga

SEQ ID NO: 521195 - RNA, 32 nt, Human
uggagacaggcaggcuucucugcccugggaag

SEQ ID NO: 521196 - RNA, 22 nt, Human
uggagacaggcuagccuggcca

SEQ ID NO: 521197 - RNA, 32 nt, Human
uggagacaggguggggaggauaaagggagcgu

SEQ ID NO: 521198 - RNA, 22 nt, Human
uggagacaggugcugggcuggu

SEQ ID NO: 521199 - RNA, 32 nt, Human
uggagacauaugugugcguguggaugucuaca

SEQ ID NO: 521200 - RNA, 32 nt, Human
uggagaccaaaccaaaggucucacuaggaaau

SEQ ID NO: 521201 - RNA, 32 nt, Human
uggagaccaaccagccuggccaauucaaaggc

SEQ ID NO: 521202 - RNA, 20 nt, Human
uggagaccagaaaccuucca

SEQ ID NO: 521203 - RNA, 32 nt, Human
uggagaccagcaccagaggaaucuacaaggca

SEQ ID NO: 521204 - RNA, 32 nt, Human
uggagaccagcaccucauacucagugaaggcc

SEQ ID NO: 521205 - RNA, 32 nt, Human
uggagaccagccuaggcaacauggcgaaaccc

SEQ ID NO: 521206 - RNA, 32 nt, Human
uggagaccagccugaccaacauggacaaaccc

SEQ ID NO: 521207 - RNA, 32 nt, Human
uggagaccagccugaccaacauggagaaaccc

SEQ ID NO: 521208 - RNA, 32 nt, Human
uggagaccagccugagcaacauagugagaccc

SEQ ID NO: 521209 - RNA, 32 nt, Human
uggagaccagccugcccaacaugaugaaaccc

SEQ ID NO: 521210 - RNA, 32 nt, Human
uggagaccagccuggccaacauagugaaaccc

SEQ ID NO: 521211 - RNA, 32 nt, Human
uggagaccagccuggccaacauggcgaaaccc

SEQ ID NO: 521212 - RNA, 32 nt, Human
uggagaccagccuggccaacauggugaaaccc

SEQ ID NO: 521213 - RNA, 32 nt, Human
uggagaccagccuggccaacguggcaaaaccc

SEQ ID NO: 521214 - RNA, 32 nt, Human
uggagaccagccuggccaagauggugaaaccc

SEQ ID NO: 521215 - RNA, 32 nt, Human
uggagaccagccugggcaacacagugagaacc

SEQ ID NO: 521216 - RNA, 32 nt, Human
uggagaccagccugggcaacauagugagaccc

SEQ ID NO: 521217 - RNA, 32 nt, Human
uggagaccagccugggcaacauggcaaaacuc

SEQ ID NO: 521218 - RNA, 32 nt, Human
uggagaccagccugggcaacauggugagacca

SEQ ID NO: 521219 - RNA, 32 nt, Human
uggagaccagccugguggccgaugucauagag

SEQ ID NO: 521220 - RNA, 32 nt, Human
uggagaccaggcuggccaacacggugaaaccc

SEQ ID NO: 521221 - RNA, 32 nt, Human
uggagaccagucuggccaauauggugaaaccc

SEQ ID NO: 521222 - RNA, 32 nt, Human
uggagaccagucugggcaacauggugaaaccc

SEQ ID NO: 521223 - RNA, 22 nt, Human
uggagaccagugggcccagggg

SEQ ID NO: 521224 - RNA, 32 nt, Human
uggagaccauccuggccaacacagugaggccc

SEQ ID NO: 521225 - RNA, 32 nt, Human
uggagaccauccuggccaacauggugaaaccc

SEQ ID NO: 521226 - RNA, 32 nt, Human
uggagaccauccuggccaacauggugaaaccu

SEQ ID NO: 521227 - RNA, 32 nt, Human
uggagaccauccuggcuaacaaggugaaaccc

SEQ ID NO: 521228 - RNA, 32 nt, Human
uggagaccauccuggcuaacacggugaaaccc

SEQ ID NO: 521229 - RNA, 32 nt, Human
uggagaccauccuggcuaacacggugagaccc

SEQ ID NO: 521230 - RNA, 32 nt, Human
uggagaccauccuggcuaacauggugaaaccc

SEQ ID NO: 521231 - RNA, 20 nt, Human
uggagaccaucuuguuccag

SEQ ID NO: 521232 - RNA, 23 nt, Human
uggagacccaggagccucggggg

SEQ ID NO: 521233 - RNA, 22 nt, Human
uggagacccaggcgugccuaga

SEQ ID NO: 521234 - RNA, 22 nt, Human
uggagacccgcagccucaagga

SEQ ID NO: 521235 - RNA, 32 nt, Human
uggagacccgccuggcuaacaaggcgaaaucc

SEQ ID NO: 521236 - RNA, 22 nt, Human
uggagacccgcggacgccggga

SEQ ID NO: 521237 - RNA, 20 nt, Human
uggagacccugcaggccaga

SEQ ID NO: 521238 - RNA, 19 nt, Human
uggagacccuucccaggga

SEQ ID NO: 521239 - RNA, 32 nt, Human
uggagaccgaggcccaucuccgcaucccgggc

SEQ ID NO: 521240 - RNA, 18 nt, Human
uggagaccgucagccaga

SEQ ID NO: 521241 - RNA, 32 nt, Human
uggagaccuacaggaggccagagugagggguc

SEQ ID NO: 521242 - RNA, 32 nt, Human
uggagaccuaguguccagucuggacagaaugc

SEQ ID NO: 521243 - RNA, 32 nt, Human
uggagaccucccaucacugagacagaucacag

SEQ ID NO: 521244 - RNA, 32 nt, Human
uggagaccugggagcuugaggcucauuggaag

SEQ ID NO: 521245 - RNA, 32 nt, Human
uggagaccugggaggagcggcugcuucgguuc

SEQ ID NO: 521246 - RNA, 20 nt, Human
uggagaccuggucccagcag

SEQ ID NO: 521247 - RNA, 21 nt, Human
uggagaccugguuccaguaaa

SEQ ID NO: 521248 - RNA, 32 nt, Human
uggagaccugugguugcgaggcucccuggggc

SEQ ID NO: 521249 - RNA, 24 nt, Human
uggagaccuugggagcuccaggga

SEQ ID NO: 521250 - RNA, 24 nt, Human
uggagacgaggccgcagaccccuu

SEQ ID NO: 521251 - RNA, 18 nt, Human
uggagacgcacagauccc

SEQ ID NO: 521252 - RNA, 32 nt, Human
uggagacgcaguucacguccaggcucuuccac

SEQ ID NO: 521253 - RNA, 21 nt, Human
uggagacgccccccgaccccu

SEQ ID NO: 521254 - RNA, 32 nt, Human
uggagacggcuuucauauguuugggaaacauu

SEQ ID NO: 521255 - RNA, 32 nt, Human
uggagacuagaggcaggagcugagggacugau

SEQ ID NO: 521256 - RNA, 32 nt, Human
uggagacuaucugagaacaaaaggacauuauu

SEQ ID NO: 521257 - RNA, 23 nt, Human
uggagacucaaagagacaagaga

SEQ ID NO: 521258 - RNA, 32 nt, Human
uggagacucccaggugccccaggugugcccag

SEQ ID NO: 521259 - RNA, 32 nt, Human
uggagacugauccccucugaguccucugcccc

SEQ ID NO: 521260 - RNA, 24 nt, Human
uggagacugauuuuagcaggaacu

SEQ ID NO: 521261 - RNA, 32 nt, Human
uggagacugccuggcuguguccucucagccag

SEQ ID NO: 521262 - RNA, 32 nt, Human
uggagacugcgcugcccugcccugcaccuacc

SEQ ID NO: 521263 - RNA, 22 nt, Human
uggagacugggaaagcaaagcu

SEQ ID NO: 521264 - RNA, 32 nt, Human
uggagacugggacaucccugauagguucacau

SEQ ID NO: 521265 - RNA, 23 nt, Human
uggagacugggagagcccagcag

SEQ ID NO: 521266 - RNA, 22 nt, Human
uggagacugggggcccagcaga

SEQ ID NO: 521267 - RNA, 32 nt, Human
uggagacuuaguuucacagacucugucauuuu

SEQ ID NO: 521268 - RNA, 32 nt, Human
uggagacuuauccaaucuguguuguaguacag

SEQ ID NO: 521269 - RNA, 32 nt, Human
uggagacuuauucgaggguauaggaagggccc

SEQ ID NO: 521270 - RNA, 32 nt, Human
uggagacuugagccaccaccagucagaggugc

SEQ ID NO: 521271 - RNA, 32 nt, Human
uggagacuugcuggaugccccauggcaauugu

SEQ ID NO: 521272 - RNA, 21 nt, Human
uggagacuuugcgcccggggg

SEQ ID NO: 521273 - RNA, 17 nt, Human
uggagagaaaaagcaaa

SEQ ID NO: 521274 - RNA, 21 nt, Human
uggagagaaaaccucugcgag

SEQ ID NO: 521275 - RNA, 21 nt, Human
uggagagaaacaucagucaaa

SEQ ID NO: 521276 - RNA, 18 nt, Human
uggagagaaaccaacaag

SEQ ID NO: 521277 - RNA, 19 nt, Human
uggagagaaaccauacaaa

SEQ ID NO: 521278 - RNA, 19 nt, Human
uggagagaaaccccacaaa

SEQ ID NO: 521279 - RNA, 19 nt, Human
uggagagaaacccuacaaa

SEQ ID NO: 521280 - RNA, 19 nt, Human
uggagagaaacccuauaaa

SEQ ID NO: 521281 - RNA, 19 nt, Human
uggagagaaaccgugcaag

SEQ ID NO: 521282 - RNA, 19 nt, Human
uggagagaaaccuuacaaa

SEQ ID NO: 521283 - RNA, 18 nt, Human
uggagagaaacuagugaa

SEQ ID NO: 521284 - RNA, 19 nt, Human
uggagagaaacucuacaaa

SEQ ID NO: 521285 - RNA, 32 nt, Human
uggagagaaagaaugaaguagauggaaagauc

SEQ ID NO: 521286 - RNA, 19 nt, Human
uggagagaaagcuuacaaa

SEQ ID NO: 521287 - RNA, 20 nt, Human
uggagagaaaggguggcaag

SEQ ID NO: 521288 - RNA, 19 nt, Human
uggagagaaauccugugaa

SEQ ID NO: 521289 - RNA, 18 nt, Human
uggagagaaaucgguaag

SEQ ID NO: 521290 - RNA, 19 nt, Human
uggagagaaauguuacaag

SEQ ID NO: 521291 - RNA, 20 nt, Human
uggagagaacaccuagggaa

SEQ ID NO: 521292 - RNA, 20 nt, Human
uggagagaacccccggcagg

SEQ ID NO: 521293 - RNA, 19 nt, Human
uggagagaaccuugguaaa

SEQ ID NO: 521294 - RNA, 21 nt, Human
uggagagaacgccauagugaa

SEQ ID NO: 521295 - RNA, 19 nt, Human
uggagagaacgcuugcaag

SEQ ID NO: 521296 - RNA, 18 nt, Human
uggagagaagaagcugca

SEQ ID NO: 521297 - RNA, 22 nt, Human
uggagagaagacgaucugcacu

SEQ ID NO: 521298 - RNA, 21 nt, Human
uggagagaagacugcagugag

SEQ ID NO: 521299 - RNA, 22 nt, Human
uggagagaagagaaggcagcag

SEQ ID NO: 521300 - RNA, 19 nt, Human
uggagagaagagagguaga

SEQ ID NO: 521301 - RNA, 19 nt, Human
uggagagaagcccugugaa

SEQ ID NO: 521302 - RNA, 23 nt, Human
uggagagaaggaaaacuaguaga

SEQ ID NO: 521303 - RNA, 22 nt, Human
uggagagaaggaaucccagcaa

SEQ ID NO: 521304 - RNA, 18 nt, Human
uggagagaaggccgcagc

SEQ ID NO: 521305 - RNA, 21 nt, Human
uggagagaaggcuaagacaaa

SEQ ID NO: 521306 - RNA, 21 nt, Human
uggagagaaggucuccuuggc

SEQ ID NO: 521307 - RNA, 17 nt, Human
uggagagaaguaaguaa

SEQ ID NO: 521308 - RNA, 32 nt, Human
uggagagaaguuaggcagguccuagggagggc

SEQ ID NO: 521309 - RNA, 18 nt, Human
uggagagaaucaugcaaa

SEQ ID NO: 521310 - RNA, 20 nt, Human
uggagagaauccccuccaga

SEQ ID NO: 521311 - RNA, 17 nt, Human
uggagagaaucuggcaa

SEQ ID NO: 521312 - RNA, 32 nt, Human
uggagagaaugcugguaaugaagaacccaagc

SEQ ID NO: 521313 - RNA, 20 nt, Human
uggagagacaaagggaggug

SEQ ID NO: 521314 - RNA, 21 nt, Human
uggagagacaacuccuguaaa

SEQ ID NO: 521315 - RNA, 21 nt, Human
uggagagacacaccugcucca

SEQ ID NO: 521316 - RNA, 32 nt, Human
uggagagacacagccugacauacacauaucau

SEQ ID NO: 521317 - RNA, 23 nt, Human
uggagagacacugcgcucaggga

SEQ ID NO: 521318 - RNA, 21 nt, Human
uggagagacaggacccacaga

SEQ ID NO: 521319 - RNA, 18 nt, Human
uggagagacaggugcaag

SEQ ID NO: 521320 - RNA, 18 nt, Human
uggagagaccccaggaaa

SEQ ID NO: 521321 - RNA, 32 nt, Human
uggagagacccccagccccaccauucagcgcg

SEQ ID NO: 521322 - RNA, 32 nt, Human
uggagagaccccuucagagcagggauugugcc

SEQ ID NO: 521323 - RNA, 32 nt, Human
uggagagacggaggagaagggcaggguucaga

SEQ ID NO: 521324 - RNA, 19 nt, Human
uggagagacuccaugcaga

SEQ ID NO: 521325 - RNA, 32 nt, Human
uggagagacugaaugcuugugagggaauuagg

SEQ ID NO: 521326 - RNA, 32 nt, Human
uggagagagaaaaggugguaacuggagugcug

SEQ ID NO: 521327 - RNA, 21 nt, Human
uggagagagaaauucagcaaa

SEQ ID NO: 521328 - RNA, 18 nt, Human
uggagagagaagagcaga

SEQ ID NO: 521329 - RNA, 32 nt, Human
uggagagagaagguauugaaacaucuccuuua

SEQ ID NO: 521330 - RNA, 19 nt, Human
uggagagagacccuauaaa

SEQ ID NO: 521331 - RNA, 19 nt, Human
uggagagagacccuguaaa

SEQ ID NO: 521332 - RNA, 32 nt, Human
uggagagagagccauuggcuggaguugagacu

SEQ ID NO: 521333 - RNA, 32 nt, Human
uggagagagcacugaaauggggcuuggcaggu

SEQ ID NO: 521334 - RNA, 32 nt, Human
uggagagagcaggaacagggagagaguaggga

SEQ ID NO: 521335 - RNA, 19 nt, Human
uggagagagcaucaggaaa

SEQ ID NO: 521336 - RNA, 20 nt, Human
uggagagagcugacggcaga

SEQ ID NO: 521337 - RNA, 32 nt, Human
uggagagagcuggaaggaaggagccagcgugc

SEQ ID NO: 521338 - RNA, 19 nt, Human
uggagagaggacccaguga

SEQ ID NO: 521339 - RNA, 18 nt, Human
uggagagaggagacagca

SEQ ID NO: 521340 - RNA, 18 nt, Human
uggagagaggagaggcaa

SEQ ID NO: 521341 - RNA, 21 nt, Human
uggagagaggagcgcugcgga

SEQ ID NO: 521342 - RNA, 21 nt, Human
uggagagaggaugaaagggaa

SEQ ID NO: 521343 - RNA, 18 nt, Human
uggagagaggauuuuagc

SEQ ID NO: 521344 - RNA, 19 nt, Human
uggagagaggcccuacaaa

SEQ ID NO: 521345 - RNA, 32 nt, Human
uggagagaggccggggaggcgagcccaggcga

SEQ ID NO: 521346 - RNA, 32 nt, Human
uggagagaggcugccuuucugguuccaucucc

SEQ ID NO: 521347 - RNA, 23 nt, Human
uggagagagggaagcucaauaaa

SEQ ID NO: 521348 - RNA, 20 nt, Human
uggagagaggggaccucaag

SEQ ID NO: 521349 - RNA, 20 nt, Human
uggagagaggucugggcagg

SEQ ID NO: 521350 - RNA, 17 nt, Human
uggagagaggugagcaa

SEQ ID NO: 521351 - RNA, 21 nt, Human
uggagagaggugggaagcaga

SEQ ID NO: 521352 - RNA, 19 nt, Human
uggagagagugcuaggaaa

SEQ ID NO: 521353 - RNA, 21 nt, Human
uggagagaguugauugaccca

SEQ ID NO: 521354 - RNA, 19 nt, Human
uggagagauagcccacaag

SEQ ID NO: 521355 - RNA, 20 nt, Human
uggagagauccaucagcaga

SEQ ID NO: 521356 - RNA, 32 nt, Human
uggagagauccggagagcuggagcagcagcgg

SEQ ID NO: 521357 - RNA, 32 nt, Human
uggagagauccucuacccuuuugaggauauuu

SEQ ID NO: 521358 - RNA, 32 nt, Human
uggagagaucuggccucagcuugggcuagaga

SEQ ID NO: 521359 - RNA, 32 nt, Human
uggagagaugacaccaggcgggugggacucaa

SEQ ID NO: 521360 - RNA, 22 nt, Human
uggagagaugagaacccagugg

SEQ ID NO: 521361 - RNA, 32 nt, Human
uggagagauggaaaaucagcucucauacuaau

SEQ ID NO: 521362 - RNA, 17 nt, Human
uggagagauucuggcaa

SEQ ID NO: 521363 - RNA, 20 nt, Human
uggagagauuuuccauuaag

SEQ ID NO: 521364 - RNA, 22 nt, Human
uggagagcacuguuuuagcaga

SEQ ID NO: 521365 - RNA, 32 nt, Human
uggagagcagagccaggagcucuggcagcugu

SEQ ID NO: 521366 - RNA, 32 nt, Human
uggagagcagaggaccugaucccccacuagag

SEQ ID NO: 521367 - RNA, 18 nt, Human
uggagagcagccagcagg

SEQ ID NO: 521368 - RNA, 32 nt, Human
uggagagcagcugaaagccaucuggguggaga

SEQ ID NO: 521369 - RNA, 32 nt, Human
uggagagcaggaggccaggacaaggacaaagg

SEQ ID NO: 521370 - RNA, 32 nt, Human
uggagagcagugaggaauuaaucuugcuuuug

SEQ ID NO: 521371 - RNA, 32 nt, Human
uggagagcaguggccaaucauagcuuacugcc

SEQ ID NO: 521372 - RNA, 32 nt, Human
uggagagcaguggugcaaucuuggcucacugc

SEQ ID NO: 521373 - RNA, 32 nt, Human
uggagagccacaggaagagaaggaagaccagc

SEQ ID NO: 521374 - RNA, 32 nt, Human
uggagagccaugccuguucuccuuccuugcua

SEQ ID NO: 521375 - RNA, 24 nt, Human
uggagagcccgggcagccacugcc

SEQ ID NO: 521376 - RNA, 32 nt, Human
uggagagccucaagauaaaacucugucauuca

SEQ ID NO: 521377 - RNA, 32 nt, Human
uggagagccucaugccgucucuaccuucgcac

SEQ ID NO: 521378 - RNA, 32 nt, Human
uggagagccugaggaaucaggagcuccaggaa

SEQ ID NO: 521379 - RNA, 32 nt, Human
uggagagccugcagagggucaaguccaagcua

SEQ ID NO: 521380 - RNA, 18 nt, Human
uggagagccuucagcaag

SEQ ID NO: 521381 - RNA, 32 nt, Human
uggagagcuacaccauuuucuucuccaaccau

SEQ ID NO: 521382 - RNA, 21 nt, Human
uggagagcuagaacccggcag

SEQ ID NO: 521383 - RNA, 19 nt, Human
uggagagcuagguuccagc

SEQ ID NO: 521384 - RNA, 16 nt, Human
uggagagcucccagca

SEQ ID NO: 521385 - RNA, 32 nt, Human
uggagagcuggcugccccuggugcacuggccc

SEQ ID NO: 521386 - RNA, 22 nt, Human
uggagagcugguacuuagcaaa

SEQ ID NO: 521387 - RNA, 22 nt, Human
uggagagcuuucaggggaggug

SEQ ID NO: 521388 - RNA, 32 nt, Human
uggagaggaaacaggcuauuguuggccagccc

SEQ ID NO: 521389 - RNA, 19 nt, Human
uggagaggaaaugggcaaa

SEQ ID NO: 521390 - RNA, 20 nt, Human
uggagaggaagacaugugaa

SEQ ID NO: 521391 - RNA, 32 nt, Human
uggagaggaagagacgcccccucugcccgaga

SEQ ID NO: 521392 - RNA, 18 nt, Human
uggagaggaagaggcaag

SEQ ID NO: 521393 - RNA, 32 nt, Human
uggagaggaaggacuuagggaggcagagugga

SEQ ID NO: 521394 - RNA, 20 nt, Human
uggagaggaauuucagggag

SEQ ID NO: 521395 - RNA, 20 nt, Human
uggagaggaccccccgcgaa

SEQ ID NO: 521396 - RNA, 32 nt, Human
uggagaggagacaaaaccaggagcagcacagu

SEQ ID NO: 521397 - RNA, 32 nt, Human
uggagaggagagaaugagagaguguggaaaaa

SEQ ID NO: 521398 - RNA, 20 nt, Human
uggagaggagagacagcaag

SEQ ID NO: 521399 - RNA, 18 nt, Human
uggagaggagauggggga

SEQ ID NO: 521400 - RNA, 21 nt, Human
uggagaggagaugggggacag

SEQ ID NO: 521401 - RNA, 18 nt, Human
uggagaggagauuaagca

SEQ ID NO: 521402 - RNA, 32 nt, Human
uggagaggagcaggccauggaggcaggugcca

SEQ ID NO: 521403 - RNA, 19 nt, Human
uggagaggagcccggggag

SEQ ID NO: 521404 - RNA, 18 nt, Human
uggagaggagcgugcaga

SEQ ID NO: 521405 - RNA, 18 nt, Human
uggagaggaggaagcgga

SEQ ID NO: 521406 - RNA, 32 nt, Human
uggagaggaggcaggggcugggcugggggcgc

SEQ ID NO: 521407 - RNA, 20 nt, Human
uggagaggagggagccggca

SEQ ID NO: 521408 - RNA, 32 nt, Human
uggagaggaguaagucuaaaagaagggugaaa

SEQ ID NO: 521409 - RNA, 20 nt, Human
uggagaggauaccucacaag

SEQ ID NO: 521410 - RNA, 32 nt, Human
uggagaggaugagguuugaggagcagagggaa

SEQ ID NO: 521411 - RNA, 20 nt, Human
uggagaggcagaucugggcc

SEQ ID NO: 521412 - RNA, 32 nt, Human
uggagaggcagauguguccugaggaacaguug

SEQ ID NO: 521413 - RNA, 32 nt, Human
uggagaggcaggcagagggcagugguucuccc

SEQ ID NO: 521414 - RNA, 32 nt, Human
uggagaggcaggcauaggcagggaaccgagca

SEQ ID NO: 521415 - RNA, 20 nt, Human
uggagaggcagggcagggug

SEQ ID NO: 521416 - RNA, 32 nt, Human
uggagaggccagaagagacucagaggagcggg

SEQ ID NO: 521417 - RNA, 18 nt, Human
uggagaggccccaccaag

SEQ ID NO: 521418 - RNA, 18 nt, Human
uggagaggccccaggaag

SEQ ID NO: 521419 - RNA, 18 nt, Human
uggagaggccccagggag

SEQ ID NO: 521420 - RNA, 21 nt, Human
uggagaggccuccuuuucccu

SEQ ID NO: 521421 - RNA, 32 nt, Human
uggagaggccugacagaagaaggagcggcccu

SEQ ID NO: 521422 - RNA, 20 nt, Human
uggagaggcgggccugcaag

SEQ ID NO: 521423 - RNA, 32 nt, Human
uggagaggcugaggcaggagaauagcuugaac

SEQ ID NO: 521424 - RNA, 32 nt, Human
uggagaggcugaggcaggagaaucacuuagac

SEQ ID NO: 521425 - RNA, 32 nt, Human
uggagaggcugaggcaggagaaucgcuugaac

SEQ ID NO: 521426 - RNA, 19 nt, Human
uggagaggcuucccagcaa

SEQ ID NO: 521427 - RNA, 18 nt, Human
uggagagggaaaagcaga

SEQ ID NO: 521428 - RNA, 32 nt, Human
uggagagggaacaacuguguacaaacauguga

SEQ ID NO: 521429 - RNA, 32 nt, Human
uggagagggacaggaggaaacgcagcgccagc

SEQ ID NO: 521430 - RNA, 19 nt, Human
uggagagggacgcggcgga

SEQ ID NO: 521431 - RNA, 18 nt, Human
uggagagggacuggcaga

SEQ ID NO: 521432 - RNA, 21 nt, Human
uggagagggagacgcaggaag

SEQ ID NO: 521433 - RNA, 32 nt, Human
uggagagggcccuguccaguugggugaucagg

SEQ ID NO: 521434 - RNA, 32 nt, Human
uggagagggcuggguuaccugggcccuguggc

SEQ ID NO: 521435 - RNA, 32 nt, Human
uggagaggggagugcagggcaccaccugggcg

SEQ ID NO: 521436 - RNA, 20 nt, Human
uggagaggggcuacagcaga

SEQ ID NO: 521437 - RNA, 32 nt, Human
uggagagggguuggcucucugagccaucagug

SEQ ID NO: 521438 - RNA, 21 nt, Human
uggagaggguauuaccgcgag

SEQ ID NO: 521439 - RNA, 32 nt, Human
uggagagggucuguggcagcuuucuggacuga

SEQ ID NO: 521440 - RNA, 19 nt, Human
uggagaggucuucagggaa

SEQ ID NO: 521441 - RNA, 32 nt, Human
uggagaggugaggaccccaugguggcucuagu

SEQ ID NO: 521442 - RNA, 32 nt, Human
uggagaggugggcuugguccagcucuugcugg

SEQ ID NO: 521443 - RNA, 32 nt, Human
uggagaggugugaggcugaggcaggguuuuac

SEQ ID NO: 521444 - RNA, 19 nt, Human
uggagaguagacuagcaaa

SEQ ID NO: 521445 - RNA, 18 nt, Human
uggagaguagccugcucc

SEQ ID NO: 521446 - RNA, 32 nt, Human
uggagagucagccuguggacccugugcacagc

SEQ ID NO: 521447 - RNA, 32 nt, Human
uggagagucaggcagugacccauuggccaugu

SEQ ID NO: 521448 - RNA, 18 nt, Human
uggagagucccuagcaga

SEQ ID NO: 521449 - RNA, 17 nt, Human
uggagaguccucagcag

SEQ ID NO: 521450 - RNA, 21 nt, Human
uggagaguuacagccagcaag

SEQ ID NO: 521451 - RNA, 32 nt, Human
uggagaguucucuccugaagcuccauccccuc

SEQ ID NO: 521452 - RNA, 21 nt, Human
uggagaguuggugcuggcaaa

SEQ ID NO: 521453 - RNA, 32 nt, Human
uggagauaaggaaagagagggacuucagagag

SEQ ID NO: 521454 - RNA, 21 nt, Human
uggagauaaggucucugcaga

SEQ ID NO: 521455 - RNA, 32 nt, Human
uggagauaauuuaaauagcacagggaccccug

SEQ ID NO: 521456 - RNA, 32 nt, Human
uggagauacuugagcugagaacucagccaucu

SEQ ID NO: 521457 - RNA, 32 nt, Human
uggagauagcaguagcaccaacuccacugcuu

SEQ ID NO: 521458 - RNA, 32 nt, Human
uggagauagcgcuccuggagagggcagaguag

SEQ ID NO: 521459 - RNA, 22 nt, Human
uggagauaggaggaucucagua

SEQ ID NO: 521460 - RNA, 32 nt, Human
uggagauaggagggggacuggguguguccagc

SEQ ID NO: 521461 - RNA, 32 nt, Human
uggagauaucaaguccccagcccagggccaga

SEQ ID NO: 521462 - RNA, 32 nt, Human
uggagaucacccuguucuaguguguggaggcu

SEQ ID NO: 521463 - RNA, 32 nt, Human
uggagaucagcaccugugagaccgaggccucc

SEQ ID NO: 521464 - RNA, 21 nt, Human
uggagaucagccugggcaaca

SEQ ID NO: 521465 - RNA, 32 nt, Human
uggagaucaggaaacugcaaagacugggaagu

SEQ ID NO: 521466 - RNA, 32 nt, Human
uggagaucauugggcucccuguggacugcagc

SEQ ID NO: 521467 - RNA, 32 nt, Human
uggagauccacaaccuuuaacagggauccaag

SEQ ID NO: 521468 - RNA, 32 nt, Human
uggagauccaggaagcccagguaucggauaaa

SEQ ID NO: 521469 - RNA, 32 nt, Human
uggagauccaucuguccuguguggaauccagu

SEQ ID NO: 521470 - RNA, 32 nt, Human
uggagaucccagaggaaggggcgccucacacc

SEQ ID NO: 521471 - RNA, 32 nt, Human
uggagaucccccagaggaguggagggugucuc

SEQ ID NO: 521472 - RNA, 23 nt, Human
uggagaucccuggacccaguaag

SEQ ID NO: 521473 - RNA, 32 nt, Human
uggagaucccuuaaagagaaccagauucauac

SEQ ID NO: 521474 - RNA, 32 nt, Human
uggagauccugguggagaccuggcaggagccc

SEQ ID NO: 521475 - RNA, 26 nt, Human
uggagaucuacggcauacgcccaggg

SEQ ID NO: 521476 - RNA, 32 nt, Human
uggagaucucaaacuuucuguacucagaaggg

SEQ ID NO: 521477 - RNA, 32 nt, Human
uggagaucuccagguagacuucagagagaugc

SEQ ID NO: 521478 - RNA, 32 nt, Human
uggagaucugcagcaagcucaacuacauucca

SEQ ID NO: 521479 - RNA, 23 nt, Human
uggagaucuggcacgggggccag

SEQ ID NO: 521480 - RNA, 32 nt, Human
uggagaugaacacaucgcguuugcaucccaga

SEQ ID NO: 521481 - RNA, 32 nt, Human
uggagaugacagugaugcugccaccuuuaagc

SEQ ID NO: 521482 - RNA, 32 nt, Human
uggagaugaccaguccacacugauaaggaguu

SEQ ID NO: 521483 - RNA, 32 nt, Human
uggagaugcacuaacccagcuggauguguuga

SEQ ID NO: 521484 - RNA, 32 nt, Human
uggagaugcgccacugcacuccagccugggcg

SEQ ID NO: 521485 - RNA, 26 nt, Human
uggagaugcugggccaccagaccccu

SEQ ID NO: 521486 - RNA, 32 nt, Human
uggagaugcuguccccaguggaaaugaaguuu

SEQ ID NO: 521487 - RNA, 30 nt, Human
uggagaugcuuucagugguggagaauggac

SEQ ID NO: 521488 - RNA, 32 nt, Human
uggagauggagccccuacagaggucagcaggu

SEQ ID NO: 521489 - RNA, 32 nt, Human
uggagauggccaguucuuucuaccucagagug

SEQ ID NO: 521490 - RNA, 18 nt, Human
uggagauggcccggcgga

SEQ ID NO: 521491 - RNA, 29 nt, Human
uggagauggcugcugcucacccuccuagc

SEQ ID NO: 521492 - RNA, 30 nt, Human
uggagauggggaccgcccuggacaucaaga

SEQ ID NO: 521493 - RNA, 32 nt, Human
uggagaugucucuguguguuuguguguaucug

SEQ ID NO: 521494 - RNA, 24 nt, Human
uggagauguuccgccagcgcuuca

SEQ ID NO: 521495 - RNA, 32 nt, Human
uggagauucagcaauucugucuucauugcucc

SEQ ID NO: 521496 - RNA, 32 nt, Human
uggagauucaggcccuggaauggggcugaaug

SEQ ID NO: 521497 - RNA, 32 nt, Human
uggagauuccucagccucucguggacacccac

SEQ ID NO: 521498 - RNA, 19 nt, Human
uggagauugauccugcgag

SEQ ID NO: 521499 - RNA, 32 nt, Human
uggagauugcugucugcuuuauguuccagugg

SEQ ID NO: 521500 - RNA, 32 nt, Human
uggagauuuccagauggaagcuguacuugggu

SEQ ID NO: 521501 - RNA, 32 nt, Human
uggagauuucuagcuuuccugagagcugcugc

SEQ ID NO: 521502 - RNA, 20 nt, Human
uggagcaacuuccugcucca

SEQ ID NO: 521503 - RNA, 32 nt, Human
uggagcaaguggagcccagcaguccuguauga

SEQ ID NO: 521504 - RNA, 32 nt, Human
uggagcaauucuuguaauucaccagagguauc

SEQ ID NO: 521505 - RNA, 19 nt, Human
uggagcaauuuccagcaga

SEQ ID NO: 521506 - RNA, 32 nt, Human
uggagcaauuuccagcagaaguuguggcuugc

SEQ ID NO: 521507 - RNA, 32 nt, Human
uggagcacaagggggagagagacuggcccucc

SEQ ID NO: 521508 - RNA, 18 nt, Human
uggagcacagaggccgca

SEQ ID NO: 521509 - RNA, 32 nt, Human
uggagcacauuuccucugcuucuuuuaucaua

SEQ ID NO: 521510 - RNA, 32 nt, Human
uggagcaccaaacuccgccccaaaaaggagag

SEQ ID NO: 521511 - RNA, 32 nt, Human
uggagcacccgagcgccugccugguggcggcg

SEQ ID NO: 521512 - RNA, 32 nt, Human
uggagcaccugggaaggagcaaccagaguggg

SEQ ID NO: 521513 - RNA, 32 nt, Human
uggagcaccuuagacaaacuacccagcacagg

SEQ ID NO: 521514 - RNA, 32 nt, Human
uggagcaccuugcacacagucacugcagccuc

SEQ ID NO: 521515 - RNA, 25 nt, Human
uggagcacgguggcucacaccugua

SEQ ID NO: 521516 - RNA, 32 nt, Human
uggagcacguccgggcaguggagggagggaca

SEQ ID NO: 521517 - RNA, 32 nt, Human
uggagcacugguuuuacauucugccucugcug

SEQ ID NO: 521518 - RNA, 32 nt, Human
uggagcacugucugaagaugaggaaucaucug

SEQ ID NO: 521519 - RNA, 32 nt, Human
uggagcacuuaaaguccagccuccaggaccgg

SEQ ID NO: 521520 - RNA, 32 nt, Human
uggagcagaaauucaccucucucacugacuau

SEQ ID NO: 521521 - RNA, 32 nt, Human
uggagcagaacuuaagagagugugugggguga

SEQ ID NO: 521522 - RNA, 32 nt, Human
uggagcagaccaccccgccugcccucauggcc

SEQ ID NO: 521523 - RNA, 22 nt, Human
uggagcagagcugcgcccaggu

SEQ ID NO: 521524 - RNA, 32 nt, Human
uggagcagcaccugucccgcugggcagaggau

SEQ ID NO: 521525 - RNA, 32 nt, Human
uggagcagcagugccucgcaccccagcacgcc

SEQ ID NO: 521526 - RNA, 20 nt, Human
uggagcagcaguuuagcaaa

SEQ ID NO: 521527 - RNA, 22 nt, Human
uggagcagcaugaggcccagca

SEQ ID NO: 521528 - RNA, 24 nt, Human
uggagcagcaugaggcccagcaag

SEQ ID NO: 521529 - RNA, 32 nt, Human
uggagcagccaaggccgccacuguggagacag

SEQ ID NO: 521530 - RNA, 23 nt, Human
uggagcagcccaggcccggcgga

SEQ ID NO: 521531 - RNA, 32 nt, Human
uggagcagccccugccgccagcgucaggucca

SEQ ID NO: 521532 - RNA, 32 nt, Human
uggagcagccucguggaguagggacggacuag

SEQ ID NO: 521533 - RNA, 32 nt, Human
uggagcagccugggggcugacccaggcuggag

SEQ ID NO: 521534 - RNA, 19 nt, Human
uggagcagcugaaugcaga

SEQ ID NO: 521535 - RNA, 32 nt, Human
uggagcagcugaggaggaggcaggagagaggg

SEQ ID NO: 521536 - RNA, 32 nt, Human
uggagcagcugcaggagcugcagaccaggguu

SEQ ID NO: 521537 - RNA, 32 nt, Human
uggagcagcugcaggccuggcugcaggccuga

SEQ ID NO: 521538 - RNA, 32 nt, Human
uggagcagcuuuuccuggaggcccaggauauu

SEQ ID NO: 521539 - RNA, 32 nt, Human
uggagcaggagaccauuauccuaagugaccua

SEQ ID NO: 521540 - RNA, 21 nt, Human
uggagcaggagaggugggagg

SEQ ID NO: 521541 - RNA, 32 nt, Human
uggagcaggagccauauaccuggagggaaugu

SEQ ID NO: 521542 - RNA, 32 nt, Human
uggagcaggcuucuugcuuuguucccuccuaa

SEQ ID NO: 521543 - RNA, 32 nt, Human
uggagcagggccuuugaucacuguggucacag

SEQ ID NO: 521544 - RNA, 32 nt, Human
uggagcaggguggggagucagagcagguccca

SEQ ID NO: 521545 - RNA, 31 nt, Human
uggagcagguggcuagaaaaagaggcugugg

SEQ ID NO: 521546 - RNA, 32 nt, Human
uggagcaguacggaaagucacagggaagauca

SEQ ID NO: 521547 - RNA, 21 nt, Human
uggagcagucagagggcccuc

SEQ ID NO: 521548 - RNA, 18 nt, Human
uggagcagucguggugaa

SEQ ID NO: 521549 - RNA, 32 nt, Human
uggagcagugccugucagagcccugggggugu

SEQ ID NO: 521550 - RNA, 23 nt, Human
uggagcauaagguuuccaguaag

SEQ ID NO: 521551 - RNA, 18 nt, Human
uggagcauaggaauugcc

SEQ ID NO: 521552 - RNA, 32 nt, Human
uggagcauauuuguuucucucuaccugauuuc

SEQ ID NO: 521553 - RNA, 24 nt, Human
uggagcaucccaagucuguccuua

SEQ ID NO: 521554 - RNA, 32 nt, Human
uggagcaucgucagauccucuaccuuuuacag

SEQ ID NO: 521555 - RNA, 32 nt, Human
uggagcaugaggcuggaugcagugguggugag

SEQ ID NO: 521556 - RNA, 32 nt, Human
uggagcaugccaagccuacugcagccauggau

SEQ ID NO: 521557 - RNA, 32 nt, Human
uggagcaugccauuggaaaacccacccccacc

SEQ ID NO: 521558 - RNA, 32 nt, Human
uggagcaugccuguagucucagcuacucagga

SEQ ID NO: 521559 - RNA, 32 nt, Human
uggagcaugccugucaucccagcuacuuggga

SEQ ID NO: 521560 - RNA, 32 nt, Human
uggagcaugccugugaucccagcuacucagga

SEQ ID NO: 521561 - RNA, 32 nt, Human
uggagcauugaugggggagaucagagggucug

SEQ ID NO: 521562 - RNA, 32 nt, Human
uggagccacagcugccucagcccacuccucac

SEQ ID NO: 521563 - RNA, 32 nt, Human
uggagccacagucuggcgucugacccuucagu

SEQ ID NO: 521564 - RNA, 32 nt, Human
uggagccacaguugaggacaguaguuuccugc

SEQ ID NO: 521565 - RNA, 32 nt, Human
uggagccaccucugcuucucagccccacccag

SEQ ID NO: 521566 - RNA, 18 nt, Human
uggagccacugcacucca

SEQ ID NO: 521567 - RNA, 32 nt, Human
uggagccacugcacuccagcccaggugacaga

SEQ ID NO: 521568 - RNA, 32 nt, Human
uggagccacugcacuccagccugggcgacaga

SEQ ID NO: 521569 - RNA, 32 nt, Human
uggagccacugcacuccagccugggggaaaga

SEQ ID NO: 521570 - RNA, 32 nt, Human
uggagccacuugaggucagguguucgagauua

SEQ ID NO: 521571 - RNA, 32 nt, Human
uggagccagagagguagaggcugcagugagcu

SEQ ID NO: 521572 - RNA, 32 nt, Human
uggagccagagggagcccagugagugccggga

SEQ ID NO: 521573 - RNA, 32 nt, Human
uggagccagaguggcugggaugugggagcagc

SEQ ID NO: 521574 - RNA, 22 nt, Human
uggagccagauggcaagagggu

SEQ ID NO: 521575 - RNA, 32 nt, Human
uggagccagcccugagccagaggcagaaugga

SEQ ID NO: 521576 - RNA, 32 nt, Human
uggagccagccuucagacucagugguuguuuc

SEQ ID NO: 521577 - RNA, 32 nt, Human
uggagccagcuguccccucucucucaggcucc

SEQ ID NO: 521578 - RNA, 32 nt, Human
uggagccaggaacaggcaggagcccagcccuu

SEQ ID NO: 521579 - RNA, 32 nt, Human
uggagccaggcaggggccacaggcccgugaag

SEQ ID NO: 521580 - RNA, 32 nt, Human
uggagccagguagaggaaaaggguuugggcgu

SEQ ID NO: 521581 - RNA, 32 nt, Human
uggagccagguccuccuccuccuccuucuccu

SEQ ID NO: 521582 - RNA, 32 nt, Human
uggagccaguacgcuccuccagaguggagcca

SEQ ID NO: 521583 - RNA, 32 nt, Human
uggagccaucuucuccauagcauuacggacuu

SEQ ID NO: 521584 - RNA, 32 nt, Human
uggagcccaaucugcuggacagccugggaccg

SEQ ID NO: 521585 - RNA, 32 nt, Human
uggagcccaccaggcuggugucgacggagugu

SEQ ID NO: 521586 - RNA, 24 nt, Human
uggagcccagcaugcuggggagug

SEQ ID NO: 521587 - RNA, 24 nt, Human
uggagcccagccaggcagccuccu

SEQ ID NO: 521588 - RNA, 32 nt, Human
uggagcccaggaaauugaggcugcagugagcc

SEQ ID NO: 521589 - RNA, 32 nt, Human
uggagcccaggaauucaagaccagucugagca

SEQ ID NO: 521590 - RNA, 32 nt, Human
uggagcccaggaggcacaggcugcagugagca

SEQ ID NO: 521591 - RNA, 32 nt, Human
uggagcccaggaggucaaggcugcagugagcu

SEQ ID NO: 521592 - RNA, 32 nt, Human
uggagcccaggaguucgagaccugccuuggca

SEQ ID NO: 521593 - RNA, 32 nt, Human
uggagcccaggaguucgaggcugcaaugagcu

SEQ ID NO: 521594 - RNA, 32 nt, Human
uggagcccaggaguuugagaccagcuugggca

SEQ ID NO: 521595 - RNA, 32 nt, Human
uggagcccaggaguuugaggcugcagcgagcu

SEQ ID NO: 521596 - RNA, 32 nt, Human
uggagcccaggaguuugagguuacaguaaacc

SEQ ID NO: 521597 - RNA, 32 nt, Human
uggagcccaggccacauggaugaugaugauuc

SEQ ID NO: 521598 - RNA, 32 nt, Human
uggagcccaggccagcuggggagggguggggu

SEQ ID NO: 521599 - RNA, 32 nt, Human
uggagcccaguaggucaagaccagccagggca

SEQ ID NO: 521600 - RNA, 32 nt, Human
uggagccccacacagacccuggcuccaggcug

SEQ ID NO: 521601 - RNA, 32 nt, Human
uggagccccagagcggugaccucugccucgac

SEQ ID NO: 521602 - RNA, 32 nt, Human
uggagccccaggacccaggccgcuuguaugug

SEQ ID NO: 521603 - RNA, 32 nt, Human
uggagcccccaucacaaaacagugcccaggag

SEQ ID NO: 521604 - RNA, 32 nt, Human
uggagccccuccgcuccuaucuccagcagaca

SEQ ID NO: 521605 - RNA, 32 nt, Human
uggagcccgaagguauuucuccagauccacag

SEQ ID NO: 521606 - RNA, 32 nt, Human
uggagcccgaguagcugccuggaucgcucgac

SEQ ID NO: 521607 - RNA, 19 nt, Human
uggagcccgggucgagagg

SEQ ID NO: 521608 - RNA, 32 nt, Human
uggagcccuaucuuuacaaaaguuuccuacug

SEQ ID NO: 521609 - RNA, 32 nt, Human
uggagcccuccaggaaaugacccccugggcug

SEQ ID NO: 521610 - RNA, 32 nt, Human
uggagcccugaugaaugggauuagugcuuuau

SEQ ID NO: 521611 - RNA, 32 nt, Human
uggagcccugggaggcuggagccccaggugca

SEQ ID NO: 521612 - RNA, 32 nt, Human
uggagcccugggcucuugccuccuguugaauu

SEQ ID NO: 521613 - RNA, 32 nt, Human
uggagcccuugccuccgagcucuggcuucaag

SEQ ID NO: 521614 - RNA, 32 nt, Human
uggagccgaggccaggauuucucugaagaccc

SEQ ID NO: 521615 - RNA, 32 nt, Human
uggagccgauucugcaacccucacuuccuaag

SEQ ID NO: 521616 - RNA, 32 nt, Human
uggagccgcaaggagccacacagcaggaggug

SEQ ID NO: 521617 - RNA, 32 nt, Human
uggagccgccgcaccccgacuccuggggccgc

SEQ ID NO: 521618 - RNA, 32 nt, Human
uggagccgcggugggagcccgccgggucgagc

SEQ ID NO: 521619 - RNA, 32 nt, Human
uggagccggcgccgggcacggcaucgggggcc

SEQ ID NO: 521620 - RNA, 21 nt, Human
uggagccgguggccaggaagg

SEQ ID NO: 521621 - RNA, 32 nt, Human
uggagccucacugucugauuuucccagacguu

SEQ ID NO: 521622 - RNA, 32 nt, Human
uggagccucacuuccagcccagccugggcccg

SEQ ID NO: 521623 - RNA, 32 nt, Human
uggagccucagcaaccugugcuauccaauagc

SEQ ID NO: 521624 - RNA, 32 nt, Human
uggagccucagcccuguccuggccacgggccg

SEQ ID NO: 521625 - RNA, 32 nt, Human
uggagccucagcucuguuucuuucucugggua

SEQ ID NO: 521626 - RNA, 32 nt, Human
uggagccucagcugccccuccaacacagcccu

SEQ ID NO: 521627 - RNA, 31 nt, Human
uggagccucccugaauaccuguccauggaug

SEQ ID NO: 521628 - RNA, 32 nt, Human
uggagccuccugggagaucuucagacccaggg

SEQ ID NO: 521629 - RNA, 32 nt, Human
uggagccuccugggcauguuugucugugugcu

SEQ ID NO: 521630 - RNA, 32 nt, Human
uggagccucggcaauuauuucugugauucugu

SEQ ID NO: 521631 - RNA, 32 nt, Human
uggagccucugcccuccuccagcccggauggc

SEQ ID NO: 521632 - RNA, 32 nt, Human
uggagccucuucugggacccagccaugagugu

SEQ ID NO: 521633 - RNA, 32 nt, Human
uggagccucuuuuuccuucuucagcaggaagg

SEQ ID NO: 521634 - RNA, 32 nt, Human
uggagccugaacugaaagaccaucacagcuug

SEQ ID NO: 521635 - RNA, 32 nt, Human
uggagccugcagccccugccuucccugggugg

SEQ ID NO: 521636 - RNA, 32 nt, Human
uggagccugcagcugagucugugcccgagaca

SEQ ID NO: 521637 - RNA, 32 nt, Human
uggagccugcaggaggagaggcuggggagggu

SEQ ID NO: 521638 - RNA, 32 nt, Human
uggagccugcagggcaggucaggcugguucag

SEQ ID NO: 521639 - RNA, 32 nt, Human
uggagccugcaguuggucacagaugauacugc

SEQ ID NO: 521640 - RNA, 17 nt, Human
uggagccugcccugcag

SEQ ID NO: 521641 - RNA, 32 nt, Human
uggagccugccugcagcccgaggucccacucu

SEQ ID NO: 521642 - RNA, 32 nt, Human
uggagccugccuggucucuggggguguugagu

SEQ ID NO: 521643 - RNA, 18 nt, Human
uggagccuggaaggggga

SEQ ID NO: 521644 - RNA, 32 nt, Human
uggagccugggaaguugaggcugcagugagcc

SEQ ID NO: 521645 - RNA, 32 nt, Human
uggagccugggacauucuggaagcauggaagg

SEQ ID NO: 521646 - RNA, 32 nt, Human
uggagccugucaggaacuccucacuguuuaaa

SEQ ID NO: 521647 - RNA, 32 nt, Human
uggagccuguccugccaaguggcaagagugug

SEQ ID NO: 521648 - RNA, 32 nt, Human
uggagccuuaaagauggagaugacagaaauga

SEQ ID NO: 521649 - RNA, 17 nt, Human
uggagccuuccagcaga

SEQ ID NO: 521650 - RNA, 32 nt, Human
uggagccuuccagcagacuucaguagcucauu

SEQ ID NO: 521651 - RNA, 32 nt, Human
uggagccuuccuccucuacuuucuaggcaccu

SEQ ID NO: 521652 - RNA, 32 nt, Human
uggagcgacacccaggcaggagagggggaaga

SEQ ID NO: 521653 - RNA, 32 nt, Human
uggagcgacagaaccaggaguaccaggugcuc

SEQ ID NO: 521654 - RNA, 32 nt, Human
uggagcgacgucacugacccugucuuuguccc

SEQ ID NO: 521655 - RNA, 32 nt, Human
uggagcgagagggaggcagguggacgcugcag

SEQ ID NO: 521656 - RNA, 32 nt, Human
uggagcgaggguggcuuuggggugggggcuug

SEQ ID NO: 521657 - RNA, 21 nt, Human
uggagcgaucucggcucacug

SEQ ID NO: 521658 - RNA, 32 nt, Human
uggagcgcagcgguaaagagcaagggguuggu

SEQ ID NO: 521659 - RNA, 32 nt, Human
uggagcgcaguggcaggaucucagcucaacac

SEQ ID NO: 521660 - RNA, 21 nt, Human
uggagcgcaugguggugguga

SEQ ID NO: 521661 - RNA, 18 nt, Human
uggagcggacccagcgag

SEQ ID NO: 521662 - RNA, 23 nt, Human
uggagcggagacgggaggccugg

SEQ ID NO: 521663 - RNA, 32 nt, Human
uggagcggagcuugccugccugccuguggaga

SEQ ID NO: 521664 - RNA, 32 nt, Human
uggagcggaggacccgagcggcugaggagaga

SEQ ID NO: 521665 - RNA, 19 nt, Human
uggagcggccagugggcag

SEQ ID NO: 521666 - RNA, 32 nt, Human
uggagcggcuguuccgcagcaccaugcuguag

SEQ ID NO: 521667 - RNA, 32 nt, Human
uggagcgggaggcguugccguggggccucgag

SEQ ID NO: 521668 - RNA, 32 nt, Human
uggagcgggcagagcgggggcaguugauagaa

SEQ ID NO: 521669 - RNA, 32 nt, Human
uggagcggggaggcgaggagggggcugugagu

SEQ ID NO: 521670 - RNA, 18 nt, Human
uggagcggggaggcgggc

SEQ ID NO: 521671 - RNA, 32 nt, Human
uggagcgguacaggggucucucuucauccacc

SEQ ID NO: 521672 - RNA, 31 nt, Human
uggagcgucggacauggaugggugaacugac

SEQ ID NO: 521673 - RNA, 32 nt, Human
uggagcgugaugcccagaagugugugaacugg

SEQ ID NO: 521674 - RNA, 32 nt, Human
uggagcuacagggagagaaacaggaggagacu

SEQ ID NO: 521675 - RNA, 32 nt, Human
uggagcuacauccugcuuccuuugggccuggg

SEQ ID NO: 521676 - RNA, 32 nt, Human
uggagcuaccuuccuguguaugcugagguaca

SEQ ID NO: 521677 - RNA, 32 nt, Human
uggagcuacugccuugcccuuccuucccuccc

SEQ ID NO: 521678 - RNA, 32 nt, Human
uggagcuacugggaggguaaagccauuugaag

SEQ ID NO: 521679 - RNA, 32 nt, Human
uggagcuagagaggcaggcaagcaguuggguu

SEQ ID NO: 521680 - RNA, 32 nt, Human
uggagcuauccaggguuuucauccaaagguug

SEQ ID NO: 521681 - RNA, 32 nt, Human
uggagcuaucucaucuaaguguuccugaugcc

SEQ ID NO: 521682 - RNA, 32 nt, Human
uggagcuaucuguggucuuagggaaggaucca

SEQ ID NO: 521683 - RNA, 32 nt, Human
uggagcucaagucaccagccacacaaccagau

SEQ ID NO: 521684 - RNA, 32 nt, Human
uggagcucacagugaucagugaccacaucauu

SEQ ID NO: 521685 - RNA, 32 nt, Human
uggagcucacucucuucagcuuccggcccuca

SEQ ID NO: 521686 - RNA, 32 nt, Human
uggagcucacugcacuccagcagucaugggac

SEQ ID NO: 521687 - RNA, 32 nt, Human
uggagcucagaggcagcuuacguugugauuag

SEQ ID NO: 521688 - RNA, 32 nt, Human
uggagcucagcagcagcagcugguuuggaaga

SEQ ID NO: 521689 - RNA, 19 nt, Human
uggagcucagccgagcccc

SEQ ID NO: 521690 - RNA, 32 nt, Human
uggagcucauggagaaauggauagaaagcaau

SEQ ID NO: 521691 - RNA, 32 nt, Human
uggagcucauuuccaggcgcccuucccucuuc

SEQ ID NO: 521692 - RNA, 22 nt, Human
uggagcucccccauuucuggcu

SEQ ID NO: 521693 - RNA, 32 nt, Human
uggagcuccgaaugugcuuaaguggaaagaua

SEQ ID NO: 521694 - RNA, 32 nt, Human
uggagcuccugcugggcuauggggaagggagg

SEQ ID NO: 521695 - RNA, 25 nt, Human
uggagcuccuuccucucugguucca

SEQ ID NO: 521696 - RNA, 32 nt, Human
uggagcucgggaguucaagaccagccugggca

SEQ ID NO: 521697 - RNA, 32 nt, Human
uggagcucuccaggaaagccaagcuggcggcc

SEQ ID NO: 521698 - RNA, 32 nt, Human
uggagcucuccuggcccaggccuggcgggcac

SEQ ID NO: 521699 - RNA, 32 nt, Human
uggagcucugugggucucuggaagaggaacca

SEQ ID NO: 521700 - RNA, 32 nt, Human
uggagcucuucccagccucccaucugacuaca

SEQ ID NO: 521701 - RNA, 32 nt, Human
uggagcugaaggaggaauggcaggaugaagaa

SEQ ID NO: 521702 - RNA, 32 nt, Human
uggagcugaaggaggugguuguggggaaccac

SEQ ID NO: 521703 - RNA, 32 nt, Human
uggagcugaauuugaaugcaagccuuggcacc

SEQ ID NO: 521704 - RNA, 32 nt, Human
uggagcugacgauuuugagggcugaggcuggu

SEQ ID NO: 521705 - RNA, 32 nt, Human
uggagcugagaagaggaggaggugggggcugg

SEQ ID NO: 521706 - RNA, 32 nt, Human
uggagcugagggaaggcagagcugggucucac

SEQ ID NO: 521707 - RNA, 32 nt, Human
uggagcugauuaggcugggauuugaggugaua

SEQ ID NO: 521708 - RNA, 32 nt, Human
uggagcugcagcugggacugugaggaccgaga

SEQ ID NO: 521709 - RNA, 23 nt, Human
uggagcugcaggaucccagggga

SEQ ID NO: 521710 - RNA, 32 nt, Human
uggagcugccaagugagggguuaaagaagagg

SEQ ID NO: 521711 - RNA, 21 nt, Human
uggagcugccagcagcacccc

SEQ ID NO: 521712 - RNA, 32 nt, Human
uggagcugcccacugucuccccagccaacgcu

SEQ ID NO: 521713 - RNA, 32 nt, Human
uggagcugcccugccuuucucaaguauuuauu

SEQ ID NO: 521714 - RNA, 31 nt, Human
uggagcugccucugugggcgguucgggagau

SEQ ID NO: 521715 - RNA, 32 nt, Human
uggagcugcugcguucugugaaugacuuucug

SEQ ID NO: 521716 - RNA, 32 nt, Human
uggagcugcuucaguccaucucccagaggcau

SEQ ID NO: 521717 - RNA, 32 nt, Human
uggagcuggagaagcugggacacauggcacca

SEQ ID NO: 521718 - RNA, 32 nt, Human
uggagcuggaggaggaaaaggcaggcagugga

SEQ ID NO: 521719 - RNA, 32 nt, Human
uggagcuggagugagguggaggggccgcaagc

SEQ ID NO: 521720 - RNA, 17 nt, Human
uggagcuggaugccugg

SEQ ID NO: 521721 - RNA, 24 nt, Human
uggagcuggccuagggaggccugg

SEQ ID NO: 521722 - RNA, 18 nt, Human
uggagcuggcggcagcug

SEQ ID NO: 521723 - RNA, 22 nt, Human
uggagcuggcuuccuuuucccu

SEQ ID NO: 521724 - RNA, 21 nt, Human
uggagcugggaacccagcgag

SEQ ID NO: 521725 - RNA, 32 nt, Human
uggagcugggaaggcaggaaaccggcuagaug

SEQ ID NO: 521726 - RNA, 32 nt, Human
uggagcugggcaagggcaggcagcaaaugggg

SEQ ID NO: 521727 - RNA, 32 nt, Human
uggagcugggcacugcccugccucaacagggu

SEQ ID NO: 521728 - RNA, 32 nt, Human
uggagcugggccuacauuggaaacaagccccu

SEQ ID NO: 521729 - RNA, 32 nt, Human
uggagcugggcuggggcaggggagaaagacag

SEQ ID NO: 521730 - RNA, 32 nt, Human
uggagcugggcuguggucuggggcaggccagc

SEQ ID NO: 521731 - RNA, 32 nt, Human
uggagcuggugcagacaccaaggcugcccagu

SEQ ID NO: 521732 - RNA, 32 nt, Human
uggagcuguacuuggccagggugucaaaggga

SEQ ID NO: 521733 - RNA, 18 nt, Human
uggagcugucccagcgaa

SEQ ID NO: 521734 - RNA, 32 nt, Human
uggagcugucuuugcuggaggccgaggcggcg

SEQ ID NO: 521735 - RNA, 32 nt, Human
uggagcugugugccuccacuccaaggcugccu

SEQ ID NO: 521736 - RNA, 32 nt, Human
uggagcuguucuguagccgggaugacagcucu

SEQ ID NO: 521737 - RNA, 19 nt, Human
uggagcuguuuccccaagu

SEQ ID NO: 521738 - RNA, 32 nt, Human
uggagcuucauaacuuuagcuuuuuccuaaaa

SEQ ID NO: 521739 - RNA, 21 nt, Human
uggagcuuccugcagccuccu

SEQ ID NO: 521740 - RNA, 32 nt, Human
uggagcuucuccucagcuccucugagcagcca

SEQ ID NO: 521741 - RNA, 32 nt, Human
uggagcuugccaaggagcacuggcugcggggc

SEQ ID NO: 521742 - RNA, 21 nt, Human
uggagcuuggaagccugcucc

SEQ ID NO: 521743 - RNA, 32 nt, Human
uggagcuuggugggggaggugggcgcagcagg

SEQ ID NO: 521744 - RNA, 32 nt, Human
uggagcuugucccagaucuggagcuucccagg

SEQ ID NO: 521745 - RNA, 32 nt, Human
uggagcuuuaagaacauacuuaguuucucaug

SEQ ID NO: 521746 - RNA, 32 nt, Human
uggagcuuuauuaguuucuuuuguagguguca

SEQ ID NO: 521747 - RNA, 32 nt, Human
uggagcuuugagagaaaaacagaagggugaug

SEQ ID NO: 521748 - RNA, 32 nt, Human
uggagcuuugggaacagucuguccuuacagag

SEQ ID NO: 521749 - RNA, 23 nt, Human
uggagcuuuuaggggaaaaugaa

SEQ ID NO: 521750 - RNA, 23 nt, Human
uggagcuuuuucuuugggccaua

SEQ ID NO: 521751 - RNA, 32 nt, Human
uggaggaaaagaacaaagaagcacgugucuua

SEQ ID NO: 521752 - RNA, 21 nt, Human
uggaggaaaagcuggggccag

SEQ ID NO: 521753 - RNA, 32 nt, Human
uggaggaaaugagggagauacggagugggagg

SEQ ID NO: 521754 - RNA, 32 nt, Human
uggaggaaccaccacagcagugccuucucguc

SEQ ID NO: 521755 - RNA, 22 nt, Human
uggaggaaccgauuucagggaa

SEQ ID NO: 521756 - RNA, 20 nt, Human
uggaggaaccgcccagugaa

SEQ ID NO: 521757 - RNA, 32 nt, Human
uggaggaacggagacaaaggaggauucauguc

SEQ ID NO: 521758 - RNA, 32 nt, Human
uggaggaacuaccuggccaaaacacuggccag

SEQ ID NO: 521759 - RNA, 32 nt, Human
uggaggaacugcuuccuguagggcaagaacug

SEQ ID NO: 521760 - RNA, 32 nt, Human
uggaggaagaggaggaggaggaggaggaagcu

SEQ ID NO: 521761 - RNA, 32 nt, Human
uggaggaagaggagggacaaaugaggucaagu

SEQ ID NO: 521762 - RNA, 32 nt, Human
uggaggaagaggccucgcgcagaggagggagc

SEQ ID NO: 521763 - RNA, 22 nt, Human
uggaggaagcccacccagcaag

SEQ ID NO: 521764 - RNA, 32 nt, Human
uggaggaagccuccaaguagaggggagaccug

SEQ ID NO: 521765 - RNA, 32 nt, Human
uggaggaaggacggggcugagguggugggcag

SEQ ID NO: 521766 - RNA, 22 nt, Human
uggaggaaguagcuucggcaag

SEQ ID NO: 521767 - RNA, 32 nt, Human
uggaggaauacauuuuauucuguccaugaagc

SEQ ID NO: 521768 - RNA, 32 nt, Human
uggaggaauagucucuucucuucaccucaaua

SEQ ID NO: 521769 - RNA, 32 nt, Human
uggaggacaagccugaagacacugccacauuc

SEQ ID NO: 521770 - RNA, 32 nt, Human
uggaggacacaccgaccccaccccaugcugcc

SEQ ID NO: 521771 - RNA, 20 nt, Human
uggaggacacucccaucaga

SEQ ID NO: 521772 - RNA, 32 nt, Human
uggaggacagacagcaauucuaugagugcuca

SEQ ID NO: 521773 - RNA, 32 nt, Human
uggaggacaguggcacaaucauggcugauugc

SEQ ID NO: 521774 - RNA, 21 nt, Human
uggaggaccaguggagacacu

SEQ ID NO: 521775 - RNA, 32 nt, Human
uggaggacccgccucuuggcagccagcugaga

SEQ ID NO: 521776 - RNA, 32 nt, Human
uggaggaccuggagguggacggucagaaaguu

SEQ ID NO: 521777 - RNA, 32 nt, Human
uggaggaccugggaggagggaguguguccuuu

SEQ ID NO: 521778 - RNA, 32 nt, Human
uggaggaccuguacacccaaagacugaauugg

SEQ ID NO: 521779 - RNA, 32 nt, Human
uggaggacgaaucacuuuacagacaagauuaa

SEQ ID NO: 521780 - RNA, 32 nt, Human
uggaggacucugccacccacucuugggaaaca

SEQ ID NO: 521781 - RNA, 32 nt, Human
uggaggacuggcugaggggagacuacuucccu

SEQ ID NO: 521782 - RNA, 32 nt, Human
uggaggacuggguagagacauuggagggaagg

SEQ ID NO: 521783 - RNA, 32 nt, Human
uggaggacuuccagaaaauuaccacuguugga

SEQ ID NO: 521784 - RNA, 32 nt, Human
uggaggagaacagaugugcggcuccguccugg

SEQ ID NO: 521785 - RNA, 21 nt, Human
uggaggagaagaggagugagg

SEQ ID NO: 521786 - RNA, 25 nt, Human
uggaggagaccccgccaguggggug

SEQ ID NO: 521787 - RNA, 22 nt, Human
uggaggagacugcagcaaauua

SEQ ID NO: 521788 - RNA, 32 nt, Human
uggaggagagagagcucaccaugcucagguaa

SEQ ID NO: 521789 - RNA, 32 nt, Human
uggaggagagaguggcacccucugauugucug

SEQ ID NO: 521790 - RNA, 32 nt, Human
uggaggagaggauaauuuccacuguguggaau

SEQ ID NO: 521791 - RNA, 32 nt, Human
uggaggagaggccggcuugggguggggccucg

SEQ ID NO: 521792 - RNA, 18 nt, Human
uggaggagaggcuaggug

SEQ ID NO: 521793 - RNA, 20 nt, Human
uggaggagauggaggaagug

SEQ ID NO: 521794 - RNA, 22 nt, Human
uggaggagcacaggugauagug

SEQ ID NO: 521795 - RNA, 18 nt, Human
uggaggagcaggaaggug

SEQ ID NO: 521796 - RNA, 21 nt, Human
uggaggagcagucugcgggug

SEQ ID NO: 521797 - RNA, 19 nt, Human
uggaggagccauugcuuug

SEQ ID NO: 521798 - RNA, 32 nt, Human
uggaggagcccugagcugggaggcagcaaagg

SEQ ID NO: 521799 - RNA, 32 nt, Human
uggaggagccggagguggaggguggggucugg

SEQ ID NO: 521800 - RNA, 32 nt, Human
uggaggagcgucgccaacaucaugcccuaaac

SEQ ID NO: 521801 - RNA, 25 nt, Human
uggaggagcgugaguucucagcgga

SEQ ID NO: 521802 - RNA, 32 nt, Human
uggaggagcugcagagauguccggccagagcc

SEQ ID NO: 521803 - RNA, 32 nt, Human
uggaggagcuugggugacagccaggugagcac

SEQ ID NO: 521804 - RNA, 32 nt, Human
uggaggaggaaauaaagggaaagggaagucgu

SEQ ID NO: 521805 - RNA, 32 nt, Human
uggaggaggaagaaggggcacagcacagucca

SEQ ID NO: 521806 - RNA, 32 nt, Human
uggaggaggaagagaagcaggagagagaaagc

SEQ ID NO: 521807 - RNA, 32 nt, Human
uggaggaggaagagggcauggcggccucacug

SEQ ID NO: 521808 - RNA, 32 nt, Human
uggaggaggagagacgggaggggaccauuugg

SEQ ID NO: 521809 - RNA, 32 nt, Human
uggaggaggaggagcauuuccugcaggaggcu

SEQ ID NO: 521810 - RNA, 32 nt, Human
uggaggaggaggaggaagagguggaggaggag

SEQ ID NO: 521811 - RNA, 32 nt, Human
uggaggaggaggaggaagaucaggaggaggag

SEQ ID NO: 521812 - RNA, 32 nt, Human
uggaggaggaggaggagaaggaggagggcagc

SEQ ID NO: 521813 - RNA, 32 nt, Human
uggaggaggaggaggaggaggagaggggccuc

SEQ ID NO: 521814 - RNA, 32 nt, Human
uggaggaggaggaggaggaggaggagguggcg

SEQ ID NO: 521815 - RNA, 32 nt, Human
uggaggaggaggaggaggaggugguggaggag

SEQ ID NO: 521816 - RNA, 32 nt, Human
uggaggaggaggaggaggauacgccagucagc

SEQ ID NO: 521817 - RNA, 32 nt, Human
uggaggaggaggcagagaggaguggagggcgg

SEQ ID NO: 521818 - RNA, 32 nt, Human
uggaggaggaggcggcggcugcgggacggucc

SEQ ID NO: 521819 - RNA, 32 nt, Human
uggaggaggagguggggcuggcgcugaagccg

SEQ ID NO: 521820 - RNA, 19 nt, Human
uggaggaggcagugggggc

SEQ ID NO: 521821 - RNA, 32 nt, Human
uggaggagggcagaggcagugugggcugauga

SEQ ID NO: 521822 - RNA, 20 nt, Human
uggaggagggccccagcgag

SEQ ID NO: 521823 - RNA, 32 nt, Human
uggaggagggcgaugugcugugcccuggcugc

SEQ ID NO: 521824 - RNA, 21 nt, Human
uggaggaggggacaugaggug

SEQ ID NO: 521825 - RNA, 18 nt, Human
uggaggaggggcgagcug

SEQ ID NO: 521826 - RNA, 32 nt, Human
uggaggaggggcgagcuguggagcagccaccc

SEQ ID NO: 521827 - RNA, 18 nt, Human
uggaggaggggguaaggu

SEQ ID NO: 521828 - RNA, 17 nt, Human
uggaggaggggguacag

SEQ ID NO: 521829 - RNA, 32 nt, Human
uggaggagguacaugggcuggggaaggagagg

SEQ ID NO: 521830 - RNA, 32 nt, Human
uggaggaggugugggcugacuaccucccagaa

SEQ ID NO: 521831 - RNA, 18 nt, Human
uggaggagucagagugag

SEQ ID NO: 521832 - RNA, 32 nt, Human
uggaggaguccaggccauggaggcagaauccu

SEQ ID NO: 521833 - RNA, 31 nt, Human
uggaggagugagaggagccaaggaggguggg

SEQ ID NO: 521834 - RNA, 32 nt, Human
uggaggaguggguggagacaaggagggaguaa

SEQ ID NO: 521835 - RNA, 32 nt, Human
uggaggaguugaguuugguugacuugaggacu

SEQ ID NO: 521836 - RNA, 19 nt, Human
uggaggaguuuccuuccca

SEQ ID NO: 521837 - RNA, 32 nt, Human
uggaggaucacuugaguccaggaguccgagac

SEQ ID NO: 521838 - RNA, 22 nt, Human
uggaggauccaccccaucacca

SEQ ID NO: 521839 - RNA, 32 nt, Human
uggaggaucccacccuucugcucugaugucuu

SEQ ID NO: 521840 - RNA, 20 nt, Human
uggaggaucuacuuagcaaa

SEQ ID NO: 521841 - RNA, 32 nt, Human
uggaggaucuuaaagagaccaguuacagaugc

SEQ ID NO: 521842 - RNA, 32 nt, Human
uggaggaugagcuguagggggcuggaguggaa

SEQ ID NO: 521843 - RNA, 20 nt, Human
uggaggauggagagagggga

SEQ ID NO: 521844 - RNA, 32 nt, Human
uggaggauggcuucugcugcuaaaaauacaaa

SEQ ID NO: 521845 - RNA, 32 nt, Human
uggaggauggggaaguggaggcugacauuaag

SEQ ID NO: 521846 - RNA, 32 nt, Human
uggaggaugucaucaggcuggcccagaaggag

SEQ ID NO: 521847 - RNA, 18 nt, Human
uggaggauguccacauca

SEQ ID NO: 521848 - RNA, 20 nt, Human
uggaggauugauucgguaga

SEQ ID NO: 521849 - RNA, 21 nt, Human
uggaggcaaacaccuuccccu

SEQ ID NO: 521850 - RNA, 32 nt, Human
uggaggcaaagcauucuuucugugacuauuuu

SEQ ID NO: 521851 - RNA, 32 nt, Human
uggaggcaacagauguucauauuucuaguauu

SEQ ID NO: 521852 - RNA, 32 nt, Human
uggaggcacaacgcaccagacacucacagcaa

SEQ ID NO: 521853 - RNA, 32 nt, Human
uggaggcacccaaacuggaacuucauuugucu

SEQ ID NO: 521854 - RNA, 32 nt, Human
uggaggcacccagggaccuggccagccgugca

SEQ ID NO: 521855 - RNA, 21 nt, Human
uggaggcagacaagaugcuca

SEQ ID NO: 521856 - RNA, 32 nt, Human
uggaggcagagcaguccucucuggggagccug

SEQ ID NO: 521857 - RNA, 32 nt, Human
uggaggcagagcccaggguaggggacagagcu

SEQ ID NO: 521858 - RNA, 32 nt, Human
uggaggcagagggagcgggcacggggccggca

SEQ ID NO: 521859 - RNA, 32 nt, Human
uggaggcagagguaaacuuggagaggacagga

SEQ ID NO: 521860 - RNA, 32 nt, Human
uggaggcaggcgcgaucagccgaacucuaggg

SEQ ID NO: 521861 - RNA, 32 nt, Human
uggaggcagggagaaugcgacucuccaaaacc

SEQ ID NO: 521862 - RNA, 32 nt, Human
uggaggcaggggcagaggugacgacagugccc

SEQ ID NO: 521863 - RNA, 32 nt, Human
uggaggcagggugagaucagaggaccggggca

SEQ ID NO: 521864 - RNA, 32 nt, Human
uggaggcaguaggacaaggugcaggcaggcug

SEQ ID NO: 521865 - RNA, 32 nt, Human
uggaggcaguugcuuugcaagauggcugagga

SEQ ID NO: 521866 - RNA, 32 nt, Human
uggaggcaucuugacuuaguugcugggagccu

SEQ ID NO: 521867 - RNA, 22 nt, Human
uggaggcauuauccucagcaaa

SEQ ID NO: 521868 - RNA, 32 nt, Human
uggaggcauucuaagucacaggaugagacagg

SEQ ID NO: 521869 - RNA, 32 nt, Human
uggaggccaacgaaaucugccuccuucaauca

SEQ ID NO: 521870 - RNA, 32 nt, Human
uggaggccaagagucugagaccagccuggcua

SEQ ID NO: 521871 - RNA, 32 nt, Human
uggaggccaauggagaagacagggagauggug

SEQ ID NO: 521872 - RNA, 32 nt, Human
uggaggccaccaggagcauccaugagcgggga

SEQ ID NO: 521873 - RNA, 32 nt, Human
uggaggccacguggucacugaccucauuuccu

SEQ ID NO: 521874 - RNA, 22 nt, Human
uggaggccacucagcccaggga

SEQ ID NO: 521875 - RNA, 22 nt, Human
uggaggccagagacacugcuca

SEQ ID NO: 521876 - RNA, 21 nt, Human
uggaggccagagcucggcaga

SEQ ID NO: 521877 - RNA, 19 nt, Human
uggaggccagcagaccccu

SEQ ID NO: 521878 - RNA, 32 nt, Human
uggaggccaggaguucaauaccagccugggca

SEQ ID NO: 521879 - RNA, 32 nt, Human
uggaggccaggccguggccagagcagauacgu

SEQ ID NO: 521880 - RNA, 32 nt, Human
uggaggccagugccagcaccugcccagugggc

SEQ ID NO: 521881 - RNA, 20 nt, Human
uggaggcccaaggucgggga

SEQ ID NO: 521882 - RNA, 32 nt, Human
uggaggcccaggaaugggcgggcaggacaccc

SEQ ID NO: 521883 - RNA, 32 nt, Human
uggaggcccagguggagguagccagugccaag

SEQ ID NO: 521884 - RNA, 21 nt, Human
uggaggccccaccccagaggg

SEQ ID NO: 521885 - RNA, 22 nt, Human
uggaggcccccacugacccuca

SEQ ID NO: 521886 - RNA, 32 nt, Human
uggaggcccccugguguguguggugcacucca

SEQ ID NO: 521887 - RNA, 24 nt, Human
uggaggccccgggggguucaggga

SEQ ID NO: 521888 - RNA, 32 nt, Human
uggaggccccucucucaccucaaggcugccug

SEQ ID NO: 521889 - RNA, 32 nt, Human
uggaggcccgggcuggaggggcaguguugcug

SEQ ID NO: 521890 - RNA, 24 nt, Human
uggaggcccugcagacacugcuca

SEQ ID NO: 521891 - RNA, 32 nt, Human
uggaggcccuggagaaggauauggcccugaag

SEQ ID NO: 521892 - RNA, 32 nt, Human
uggaggccgacagcaggacuccgucagugauu

SEQ ID NO: 521893 - RNA, 32 nt, Human
uggaggccgaugaagacaagaaggaggagggg

SEQ ID NO: 521894 - RNA, 17 nt, Human
uggaggccgcccugcag

SEQ ID NO: 521895 - RNA, 32 nt, Human
uggaggccguggucagaaacagguugaauugg

SEQ ID NO: 521896 - RNA, 32 nt, Human
uggaggccgugguggaaggcuugguggccacu

SEQ ID NO: 521897 - RNA, 32 nt, Human
uggaggccuaggcuggcccuaggaccuucuug

SEQ ID NO: 521898 - RNA, 32 nt, Human
uggaggccuaucucccucagaacggcgcgaga

SEQ ID NO: 521899 - RNA, 24 nt, Human
uggaggccuccaagcugcugcuca

SEQ ID NO: 521900 - RNA, 23 nt, Human
uggaggccuccuguccucgggga

SEQ ID NO: 521901 - RNA, 32 nt, Human
uggaggccucggggaguggcuuuuccagcucu

SEQ ID NO: 521902 - RNA, 32 nt, Human
uggaggccucugagccuccccugugccuuggg

SEQ ID NO: 521903 - RNA, 32 nt, Human
uggaggccugacaucgaagaccuguguguuuu

SEQ ID NO: 521904 - RNA, 22 nt, Human
uggaggccugcuuccagcccca

SEQ ID NO: 521905 - RNA, 22 nt, Human
uggaggccuggagcccaggaga

SEQ ID NO: 521906 - RNA, 21 nt, Human
uggaggccuggcuggugcuca

SEQ ID NO: 521907 - RNA, 32 nt, Human
uggaggccuggcuggugcucacauacaauaau

SEQ ID NO: 521908 - RNA, 32 nt, Human
uggaggccugggaacaggguuuauacuaagua

SEQ ID NO: 521909 - RNA, 26 nt, Human
uggaggccuguguccuuguccagggg

SEQ ID NO: 521910 - RNA, 20 nt, Human
uggaggccuuacagagugcu

SEQ ID NO: 521911 - RNA, 32 nt, Human
uggaggccuuccugccugccuuccagcguggc

SEQ ID NO: 521912 - RNA, 21 nt, Human
uggaggccuugaugaggccca

SEQ ID NO: 521913 - RNA, 32 nt, Human
uggaggccuuucuuucccgcuaggcucccagc

SEQ ID NO: 521914 - RNA, 24 nt, Human
uggaggcgcuucagcaccgcggcc

SEQ ID NO: 521915 - RNA, 32 nt, Human
uggaggcggaagcgugaaauaaggacugagug

SEQ ID NO: 521916 - RNA, 32 nt, Human
uggaggcggaggaggaggcggaggaggguggc

SEQ ID NO: 521917 - RNA, 32 nt, Human
uggaggcgggaaaaucauuugaggucagaagu

SEQ ID NO: 521918 - RNA, 32 nt, Human
uggaggcggggcugcaucuggcuuggugguag

SEQ ID NO: 521919 - RNA, 32 nt, Human
uggaggcgugugccaccaugcccagcuaauuc

SEQ ID NO: 521920 - RNA, 32 nt, Human
uggaggcuauucuuguuucuccaucucaaguc

SEQ ID NO: 521921 - RNA, 32 nt, Human
uggaggcucacaccuauaaucccaacacuuug

SEQ ID NO: 521922 - RNA, 32 nt, Human
uggaggcucaggggaccccauggggacaggca

SEQ ID NO: 521923 - RNA, 32 nt, Human
uggaggcucauugucucagagcccagacaguu

SEQ ID NO: 521924 - RNA, 32 nt, Human
uggaggcuccacccugugggacgucaccaguu

SEQ ID NO: 521925 - RNA, 32 nt, Human
uggaggcuccagggcaggaaggggaggaucca

SEQ ID NO: 521926 - RNA, 22 nt, Human
uggaggcuccauccuuucuccu

SEQ ID NO: 521927 - RNA, 32 nt, Human
uggaggcuccccucgcgguccggggcugcgcg

SEQ ID NO: 521928 - RNA, 32 nt, Human
uggaggcuccggaccaagccccuucagcuucu

SEQ ID NO: 521929 - RNA, 32 nt, Human
uggaggcucgccucucuggccgggugcaguga

SEQ ID NO: 521930 - RNA, 32 nt, Human
uggaggcucugugagcccugcagcccucagaa

SEQ ID NO: 521931 - RNA, 32 nt, Human
uggaggcugaaagucuuugaauccagagauuu

SEQ ID NO: 521932 - RNA, 32 nt, Human
uggaggcugagcaggaagcccuggagaaggac

SEQ ID NO: 521933 - RNA, 32 nt, Human
uggaggcugaugugcuuuuggucagugaacca

SEQ ID NO: 521934 - RNA, 32 nt, Human
uggaggcugcuggccguuuccuacugccuggg

SEQ ID NO: 521935 - RNA, 32 nt, Human
uggaggcugggaaguccaagaugaggguguca

SEQ ID NO: 521936 - RNA, 32 nt, Human
uggaggcugggaaguucaagaucaaggcacua

SEQ ID NO: 521937 - RNA, 32 nt, Human
uggaggcugggacaggggucccugccagggau

SEQ ID NO: 521938 - RNA, 18 nt, Human
uggaggcugggagccugg

SEQ ID NO: 521939 - RNA, 32 nt, Human
uggaggcuggggcagagaugggcgugacccag

SEQ ID NO: 521940 - RNA, 20 nt, Human
uggaggcugggucagagggg

SEQ ID NO: 521941 - RNA, 32 nt, Human
uggaggcugguccaccucccucagcuuccagg

SEQ ID NO: 521942 - RNA, 32 nt, Human
uggaggcuguggacagaaacaggucagugaug

SEQ ID NO: 521943 - RNA, 32 nt, Human
uggaggcuucaaggcccugccugcugcacgcc

SEQ ID NO: 521944 - RNA, 32 nt, Human
uggaggcuuccagacagccacaguuagugccc

SEQ ID NO: 521945 - RNA, 27 nt, Human
uggaggcuuuuccaacgucuucaggga

SEQ ID NO: 521946 - RNA, 18 nt, Human
uggagggaaacgagcaaa

SEQ ID NO: 521947 - RNA, 18 nt, Human
uggagggaaagccacaaa

SEQ ID NO: 521948 - RNA, 32 nt, Human
uggagggaaagccacaaaagggggcuauagua

SEQ ID NO: 521949 - RNA, 19 nt, Human
uggagggaaccccagggag

SEQ ID NO: 521950 - RNA, 21 nt, Human
uggagggaagaaagaaguaaa

SEQ ID NO: 521951 - RNA, 19 nt, Human
uggagggaagagaauagca

SEQ ID NO: 521952 - RNA, 20 nt, Human
uggagggaagaggcaggaaa

SEQ ID NO: 521953 - RNA, 18 nt, Human
uggagggaagaguccagc

SEQ ID NO: 521954 - RNA, 19 nt, Human
uggagggaagaugcagggg

SEQ ID NO: 521955 - RNA, 17 nt, Human
uggagggaagccgugaa

SEQ ID NO: 521956 - RNA, 17 nt, Human
uggagggaagcgggaag

SEQ ID NO: 521957 - RNA, 32 nt, Human
uggagggaagcugggggagaagacugaacuca

SEQ ID NO: 521958 - RNA, 20 nt, Human
uggagggaaggagcuacgag

SEQ ID NO: 521959 - RNA, 19 nt, Human
uggagggaagucccaggga

SEQ ID NO: 521960 - RNA, 21 nt, Human
uggagggaaguccuaaguaaa

SEQ ID NO: 521961 - RNA, 18 nt, Human
uggagggaaucuagggaa

SEQ ID NO: 521962 - RNA, 25 nt, Human
uggagggacagagcagaggggccag

SEQ ID NO: 521963 - RNA, 32 nt, Human
uggagggacuccugggacaguccuccacccug

SEQ ID NO: 521964 - RNA, 32 nt, Human
uggagggacucgugagccggagcccagaaauc

SEQ ID NO: 521965 - RNA, 32 nt, Human
uggagggacuggacuccucuccagcuccccac

SEQ ID NO: 521966 - RNA, 20 nt, Human
uggagggagacaccagcagg

SEQ ID NO: 521967 - RNA, 22 nt, Human
uggagggagaggcuuaggcaga

SEQ ID NO: 521968 - RNA, 20 nt, Human
uggagggagagggaagcaag

SEQ ID NO: 521969 - RNA, 32 nt, Human
uggagggagagggagcgucagaagcccggagg

SEQ ID NO: 521970 - RNA, 20 nt, Human
uggagggagcaugcggcaga

SEQ ID NO: 521971 - RNA, 32 nt, Human
uggagggagccacagagagggguccaggcuuu

SEQ ID NO: 521972 - RNA, 32 nt, Human
uggagggagccacugagcacagcaaggcacca

SEQ ID NO: 521973 - RNA, 18 nt, Human
uggagggagccugucaaa

SEQ ID NO: 521974 - RNA, 32 nt, Human
uggagggagcuuccuuccuuccuuccuggaca

SEQ ID NO: 521975 - RNA, 23 nt, Human
uggagggaggaacaacgagcaga

SEQ ID NO: 521976 - RNA, 22 nt, Human
uggagggaggagagaagacaga

SEQ ID NO: 521977 - RNA, 21 nt, Human
uggagggaggagcccaacaga

SEQ ID NO: 521978 - RNA, 32 nt, Human
uggagggagggagggaggggagcauggugucu

SEQ ID NO: 521979 - RNA, 32 nt, Human
uggagggaggggcagagcgguguggacuuccc

SEQ ID NO: 521980 - RNA, 32 nt, Human
uggagggaggggcagggccuugcaggggauug

SEQ ID NO: 521981 - RNA, 32 nt, Human
uggagggaggggcuuuaauuggaggccccgua

SEQ ID NO: 521982 - RNA, 32 nt, Human
uggagggaggugguguguucacgugagccuac

SEQ ID NO: 521983 - RNA, 19 nt, Human
uggagggaguacaagcaaa

SEQ ID NO: 521984 - RNA, 32 nt, Human
uggagggaguuucauuaaaugcuaacuacuuu

SEQ ID NO: 521985 - RNA, 25 nt, Human
uggagggaucgcagagcccggcaag

SEQ ID NO: 521986 - RNA, 22 nt, Human
uggagggaucugggugccggca

SEQ ID NO: 521987 - RNA, 22 nt, Human
uggagggaugacuuuuaguaaa

SEQ ID NO: 521988 - RNA, 21 nt, Human
uggagggaugccacccagcaa

SEQ ID NO: 521989 - RNA, 32 nt, Human
uggagggauggaaaacuccucugcagcaucag

SEQ ID NO: 521990 - RNA, 19 nt, Human
uggagggauggccagggaa

SEQ ID NO: 521991 - RNA, 19 nt, Human
uggagggauuuccuacaag

SEQ ID NO: 521992 - RNA, 32 nt, Human
uggagggcaaauucugguggaacuuuugggcc

SEQ ID NO: 521993 - RNA, 32 nt, Human
uggagggcaagggguuuccacaguugcugcuc

SEQ ID NO: 521994 - RNA, 20 nt, Human
uggagggcagaucucgcgag

SEQ ID NO: 521995 - RNA, 32 nt, Human
uggagggcaggggcucucccuaggggcauagc

SEQ ID NO: 521996 - RNA, 32 nt, Human
uggagggcagugacauaaucauagcucacugu

SEQ ID NO: 521997 - RNA, 32 nt, Human
uggagggcaguggcacgaucucagcucacugc

SEQ ID NO: 521998 - RNA, 32 nt, Human
uggagggcaguggcacgaucuuggcuuucugc

SEQ ID NO: 521999 - RNA, 32 nt, Human
uggagggcaguggcgugaucucggcucacugc

SEQ ID NO: 522000 - RNA, 32 nt, Human
uggagggcauuugugcuaaauugcccagugcu

SEQ ID NO: 522001 - RNA, 32 nt, Human
uggagggcauuuuccagggcacugcuuucccc

SEQ ID NO: 522002 - RNA, 32 nt, Human
uggagggccaggcagaggcuguucuggaaggc

SEQ ID NO: 522003 - RNA, 21 nt, Human
uggagggcgccuguaauccca

SEQ ID NO: 522004 - RNA, 21 nt, Human
uggagggcgccuguaguccca

SEQ ID NO: 522005 - RNA, 32 nt, Human
uggagggcguagggugggggcagugaggaaug

SEQ ID NO: 522006 - RNA, 32 nt, Human
uggagggcucagaaggagacaggaaaaugugg

SEQ ID NO: 522007 - RNA, 20 nt, Human
uggagggcucccuuucccuc

SEQ ID NO: 522008 - RNA, 27 nt, Human
uggagggcucggggcuuccucuccucu

SEQ ID NO: 522009 - RNA, 32 nt, Human
uggagggcucuggggaugaugacuccuuuccc

SEQ ID NO: 522010 - RNA, 32 nt, Human
uggagggcugccaggaaacauggugcaagugc

SEQ ID NO: 522011 - RNA, 32 nt, Human
uggagggcugcuucugccccgaggggacucug

SEQ ID NO: 522012 - RNA, 32 nt, Human
uggagggcuguggacagcccagcaaccugucg

SEQ ID NO: 522013 - RNA, 32 nt, Human
uggagggcuucguggaggaagggagaauugag

SEQ ID NO: 522014 - RNA, 32 nt, Human
uggaggggaaaaagauccauucuacguauccu

SEQ ID NO: 522015 - RNA, 18 nt, Human
uggaggggaaacagcgga

SEQ ID NO: 522016 - RNA, 21 nt, Human
uggaggggaagaaacaggaaa

SEQ ID NO: 522017 - RNA, 18 nt, Human
uggaggggaagcggcaga

SEQ ID NO: 522018 - RNA, 24 nt, Human
uggaggggacugguggggacucag

SEQ ID NO: 522019 - RNA, 23 nt, Human
uggaggggagaauuucuagggga

SEQ ID NO: 522020 - RNA, 32 nt, Human
uggaggggagagaaggauucuaggggugugga

SEQ ID NO: 522021 - RNA, 18 nt, Human
uggaggggagaucccugc

SEQ ID NO: 522022 - RNA, 32 nt, Human
uggaggggagccaaggccagggagagccguca

SEQ ID NO: 522023 - RNA, 32 nt, Human
uggaggggagccaccaccccugaccauguaga

SEQ ID NO: 522024 - RNA, 20 nt, Human
uggaggggagcccaagugag

SEQ ID NO: 522025 - RNA, 21 nt, Human
uggaggggcacggaggagccg

SEQ ID NO: 522026 - RNA, 21 nt, Human
uggaggggcagagccaggaag

SEQ ID NO: 522027 - RNA, 32 nt, Human
uggaggggcagccugugccugccuuuguguca

SEQ ID NO: 522028 - RNA, 32 nt, Human
uggaggggcaggcacaggagacagcaguggcc

SEQ ID NO: 522029 - RNA, 21 nt, Human
uggaggggcaguggagaucag

SEQ ID NO: 522030 - RNA, 19 nt, Human
uggaggggcaguguacagg

SEQ ID NO: 522031 - RNA, 32 nt, Human
uggaggggcauagcuagugagacagagcucgc

SEQ ID NO: 522032 - RNA, 21 nt, Human
uggaggggcccagcagggcca

SEQ ID NO: 522033 - RNA, 32 nt, Human
uggaggggcccaggcucugagcuccacagguc

SEQ ID NO: 522034 - RNA, 32 nt, Human
uggaggggccccaggauuuguugggggcaaag

SEQ ID NO: 522035 - RNA, 32 nt, Human
uggaggggccccugcuucuccagccuggaccc

SEQ ID NO: 522036 - RNA, 21 nt, Human
uggaggggcccgaggagccag

SEQ ID NO: 522037 - RNA, 32 nt, Human
uggaggggcuggcugaucacacaugcccccuc

SEQ ID NO: 522038 - RNA, 32 nt, Human
uggaggggcuugcaacaaggaggcaggcccug

SEQ ID NO: 522039 - RNA, 32 nt, Human
uggagggggaaaugaggucaagagagauuucc

SEQ ID NO: 522040 - RNA, 32 nt, Human
uggagggggaauggcagcagggguuggggaaa

SEQ ID NO: 522041 - RNA, 32 nt, Human
uggagggggaaugugugcuggccaggguggag

SEQ ID NO: 522042 - RNA, 24 nt, Human
uggagggggagcacccggggccag

SEQ ID NO: 522043 - RNA, 32 nt, Human
uggagggggaggcaggaggauugcugucagcc

SEQ ID NO: 522044 - RNA, 21 nt, Human
uggagggggcagaugcaggug

SEQ ID NO: 522045 - RNA, 32 nt, Human
uggagggggcagugcuggaggagaagaaagca

SEQ ID NO: 522046 - RNA, 23 nt, Human
uggagggggccaaugggggucag

SEQ ID NO: 522047 - RNA, 32 nt, Human
uggagggggccagcaggucacggggcagaauc

SEQ ID NO: 522048 - RNA, 21 nt, Human
uggagggggccggggacccag

SEQ ID NO: 522049 - RNA, 32 nt, Human
uggagggggcggcuccuggagaucaggccaaa

SEQ ID NO: 522050 - RNA, 22 nt, Human
uggagggggcuggggucacaga

SEQ ID NO: 522051 - RNA, 19 nt, Human
uggaggggggaacagcgag

SEQ ID NO: 522052 - RNA, 20 nt, Human
uggaggggggacccacuaaa

SEQ ID NO: 522053 - RNA, 21 nt, Human
uggaggggggccuggggcaga

SEQ ID NO: 522054 - RNA, 22 nt, Human
uggaggggguggguccggggga

SEQ ID NO: 522055 - RNA, 32 nt, Human
uggaggggguugaaggauccugacagaccaug

SEQ ID NO: 522056 - RNA, 21 nt, Human
uggaggggguuugguuuguga

SEQ ID NO: 522057 - RNA, 21 nt, Human
uggagggguauuuucagcaga

SEQ ID NO: 522058 - RNA, 32 nt, Human
uggaggggucaccaagccagagcugggcucca

SEQ ID NO: 522059 - RNA, 20 nt, Human
uggaggggucagggccgcuc

SEQ ID NO: 522060 - RNA, 22 nt, Human
uggagggguccuuuagggccag

SEQ ID NO: 522061 - RNA, 32 nt, Human
uggagggguggaggaaggagguguugggcagc

SEQ ID NO: 522062 - RNA, 18 nt, Human
uggagggguggcagcgga

SEQ ID NO: 522063 - RNA, 32 nt, Human
uggaggguaaaugauguggugccugaggucug

SEQ ID NO: 522064 - RNA, 32 nt, Human
uggaggguagggcugaaaguccuaaccuucua

SEQ ID NO: 522065 - RNA, 21 nt, Human
uggaggguaguccucaguaaa

SEQ ID NO: 522066 - RNA, 32 nt, Human
uggagggucaaguggcuucuucugagcgcuga

SEQ ID NO: 522067 - RNA, 32 nt, Human
uggagggucauugccagaucuaaccaaccucc

SEQ ID NO: 522068 - RNA, 32 nt, Human
uggaggguccagagucucacucuguugcccag

SEQ ID NO: 522069 - RNA, 22 nt, Human
uggaggguccgcacacccgccc

SEQ ID NO: 522070 - RNA, 32 nt, Human
uggagggucgccuggcuuauucccauguguga

SEQ ID NO: 522071 - RNA, 32 nt, Human
uggagggucugcaggcuuaggcugcagcaggc

SEQ ID NO: 522072 - RNA, 32 nt, Human
uggagggucugcuucuagcucagcuguuucuc

SEQ ID NO: 522073 - RNA, 32 nt, Human
uggagggucuucaugaaacacagcugccagga

SEQ ID NO: 522074 - RNA, 32 nt, Human
uggagggugaaaggagggagaggaucagcaaa

SEQ ID NO: 522075 - RNA, 32 nt, Human
uggagggugacuggcccuggcuccugcuauga

SEQ ID NO: 522076 - RNA, 32 nt, Human
uggagggugagguuugagcuguggcugaaagc

SEQ ID NO: 522077 - RNA, 32 nt, Human
uggagggugccagguguguggugaccuucugg

SEQ ID NO: 522078 - RNA, 21 nt, Human
uggagggugccuguaauccca

SEQ ID NO: 522079 - RNA, 24 nt, Human
uggagggugccuguaaucccagcu

SEQ ID NO: 522080 - RNA, 32 nt, Human
uggagggugccuuuagucccagcucuuuggga

SEQ ID NO: 522081 - RNA, 32 nt, Human
uggagggugggcacugcugggccaugccacuu

SEQ ID NO: 522082 - RNA, 32 nt, Human
uggagggugggcauuuaguggugacccuugca

SEQ ID NO: 522083 - RNA, 32 nt, Human
uggaggguggggcuuggccaggagugaccaga

SEQ ID NO: 522084 - RNA, 32 nt, Human
uggagggugugccugcucugugccccaugcug

SEQ ID NO: 522085 - RNA, 32 nt, Human
uggaggguguggcggaaacuugaggcuuggag

SEQ ID NO: 522086 - RNA, 32 nt, Human
uggagguacugagacagggugcugaugggaag

SEQ ID NO: 522087 - RNA, 32 nt, Human
uggagguauguucuucaugcaagggcaguucc

SEQ ID NO: 522088 - RNA, 32 nt, Human
uggaggucaggaguucgaaaccagccuggcca

SEQ ID NO: 522089 - RNA, 32 nt, Human
uggaggucaggaguuugagaccagccuggcca

SEQ ID NO: 522090 - RNA, 32 nt, Human
uggaggucagggaggugggaaggugggugggc

SEQ ID NO: 522091 - RNA, 32 nt, Human
uggaggucaguggaggaugcagccaguggcca

SEQ ID NO: 522092 - RNA, 21 nt, Human
uggaggucccagccacaggga

SEQ ID NO: 522093 - RNA, 21 nt, Human
uggaggucccccugugccaga

SEQ ID NO: 522094 - RNA, 32 nt, Human
uggaggucggggacaaaaugaagaauguguuu

SEQ ID NO: 522095 - RNA, 32 nt, Human
uggaggucucacagcagcaccagaagaacaaa

SEQ ID NO: 522096 - RNA, 32 nt, Human
uggaggucucacuauguugcccaggcugaucu

SEQ ID NO: 522097 - RNA, 32 nt, Human
uggaggugaacaagcaaacccagagggcucca

SEQ ID NO: 522098 - RNA, 32 nt, Human
uggaggugaaugucucugccuccuguaggccu

SEQ ID NO: 522099 - RNA, 32 nt, Human
uggaggugacaaggccuuagggccaaaagucu

SEQ ID NO: 522100 - RNA, 31 nt, Human
uggaggugacagagagaagaggccauugguc

SEQ ID NO: 522101 - RNA, 19 nt, Human
uggaggugaucccaggaaa

SEQ ID NO: 522102 - RNA, 32 nt, Human
uggaggugaugcacagaugucacugggaaacc

SEQ ID NO: 522103 - RNA, 20 nt, Human
uggaggugaugugggcccuc

SEQ ID NO: 522104 - RNA, 19 nt, Human
uggaggugauuccagugaa

SEQ ID NO: 522105 - RNA, 23 nt, Human
uggaggugcagguggcauguaga

SEQ ID NO: 522106 - RNA, 20 nt, Human
uggaggugccaggggcccuc

SEQ ID NO: 522107 - RNA, 32 nt, Human
uggaggugcucaauacugcugaacuguacacu

SEQ ID NO: 522108 - RNA, 32 nt, Human
uggagguggaacuucccaggaggggaagggac

SEQ ID NO: 522109 - RNA, 32 nt, Human
uggagguggacugcauagcccagagcccuuca

SEQ ID NO: 522110 - RNA, 32 nt, Human
uggagguggagcugcaccccuuguagagaaug

SEQ ID NO: 522111 - RNA, 32 nt, Human
uggagguggaggcagagauuacugugggccaa

SEQ ID NO: 522112 - RNA, 32 nt, Human
uggagguggagguggagguugcagugagccga

SEQ ID NO: 522113 - RNA, 32 nt, Human
uggagguggauggggaggaugguugcacaaca

SEQ ID NO: 522114 - RNA, 32 nt, Human
uggaggugggagcuuagggaaugcagagccua

SEQ ID NO: 522115 - RNA, 21 nt, Human
uggaggugggcagggcugcuc

SEQ ID NO: 522116 - RNA, 32 nt, Human
uggaggugggcggaucacgugaggucaggagu

SEQ ID NO: 522117 - RNA, 20 nt, Human
uggaggugggcugggcccuc

SEQ ID NO: 522118 - RNA, 32 nt, Human
uggagguggggugggagaaagagcuaaaauca

SEQ ID NO: 522119 - RNA, 32 nt, Human
uggaggugugcagacuggucucugccugggcu

SEQ ID NO: 522120 - RNA, 32 nt, Human
uggagguguguauguuuauauguauauaacaa

SEQ ID NO: 522121 - RNA, 32 nt, Human
uggagguguuagacaccagcccccugcauccu

SEQ ID NO: 522122 - RNA, 32 nt, Human
uggagguguucuggacaguggggagggcucca

SEQ ID NO: 522123 - RNA, 32 nt, Human
uggagguuacacaggguaaagugcaguaugau

SEQ ID NO: 522124 - RNA, 32 nt, Human
uggagguucacaguggauuucuuucugccgaa

SEQ ID NO: 522125 - RNA, 32 nt, Human
uggagguuccuggaagguggugaaccuggaga

SEQ ID NO: 522126 - RNA, 32 nt, Human
uggagguucuguccucccugcugcucucagga

SEQ ID NO: 522127 - RNA, 32 nt, Human
uggagguugaaaagauuucacuacaguguucu

SEQ ID NO: 522128 - RNA, 32 nt, Human
uggagguugaguucgagaccagccuggccaca

SEQ ID NO: 522129 - RNA, 32 nt, Human
uggagguuguagugagacaagauugcgcuacu

SEQ ID NO: 522130 - RNA, 32 nt, Human
uggagguuguggcggagguuguggugagcuga

SEQ ID NO: 522131 - RNA, 24 nt, Human
uggagguuuaccccaugaugcuca

SEQ ID NO: 522132 - RNA, 32 nt, Human
uggagguuuagcaggaggaucacuugagccca

SEQ ID NO: 522133 - RNA, 31 nt, Human
uggagguuucucaaggagcuggagacuucag

SEQ ID NO: 522134 - RNA, 20 nt, Human
uggagguuugcagugaggug

SEQ ID NO: 522135 - RNA, 32 nt, Human
uggagguuuuuagguagauucauagaauauaa

SEQ ID NO: 522136 - RNA, 24 nt, Human
uggaguaaacuagcuuggaccuug

SEQ ID NO: 522137 - RNA, 32 nt, Human
uggaguaaagcacaauuuuggcaauuuuaaag

SEQ ID NO: 522138 - RNA, 18 nt, Human
uggaguaacugagccugu

SEQ ID NO: 522139 - RNA, 32 nt, Human
uggaguacaauggcacaaacacugcucacugc

SEQ ID NO: 522140 - RNA, 32 nt, Human
uggaguacacagaaggaaagcaaagaagagca

SEQ ID NO: 522141 - RNA, 32 nt, Human
uggaguacaggaguuuggggcuguagugugua

SEQ ID NO: 522142 - RNA, 32 nt, Human
uggaguacaguggcaugaucauagcucacugc

SEQ ID NO: 522143 - RNA, 32 nt, Human
uggaguacaguggcaugaucauggcucacugc

SEQ ID NO: 522144 - RNA, 32 nt, Human
uggaguaccaugggcauuaucccaggcccaca

SEQ ID NO: 522145 - RNA, 32 nt, Human
uggaguacccuggcuguucuccacacucacaa

SEQ ID NO: 522146 - RNA, 32 nt, Human
uggaguaccggcagcugcucauccccugugca

SEQ ID NO: 522147 - RNA, 32 nt, Human
uggaguacgagaugcaacccagcccccaaacc

SEQ ID NO: 522148 - RNA, 32 nt, Human
uggaguagagccagagguauaacugaauaaga

SEQ ID NO: 522149 - RNA, 32 nt, Human
uggaguagcggggagagcgggaagccugaggg

SEQ ID NO: 522150 - RNA, 21 nt, Human
uggaguagcuggaacuacagg

SEQ ID NO: 522151 - RNA, 32 nt, Human
uggaguagcugggaccacaaucacacaccacc

SEQ ID NO: 522152 - RNA, 23 nt, Human
uggaguagcugggacuacaggug

SEQ ID NO: 522153 - RNA, 23 nt, Human
uggaguagcugggauuacaggug

SEQ ID NO: 522154 - RNA, 32 nt, Human
uggaguaggaauagaagugcaagcuggaaagg

SEQ ID NO: 522155 - RNA, 32 nt, Human
uggaguaggagaaaagagagauuagaucuuaa

SEQ ID NO: 522156 - RNA, 23 nt, Human
uggaguagggcgggaaggggcag

SEQ ID NO: 522157 - RNA, 20 nt, Human
uggaguaugagcucagcaga

SEQ ID NO: 522158 - RNA, 32 nt, Human
uggaguaugagcugcccccgcccgcuccugag

SEQ ID NO: 522159 - RNA, 32 nt, Human
uggaguauucuugaggagccuuuugcucauag

SEQ ID NO: 522160 - RNA, 22 nt, Human
uggagucaaccccagccccuca

SEQ ID NO: 522161 - RNA, 32 nt, Human
uggagucaagcagucauggcucagggacacuc

SEQ ID NO: 522162 - RNA, 32 nt, Human
uggagucaauaugcuagucuuggauugccugc

SEQ ID NO: 522163 - RNA, 32 nt, Human
uggagucagaugagcaaggacauugccccaag

SEQ ID NO: 522164 - RNA, 23 nt, Human
uggagucagcccugcuuccccuc

SEQ ID NO: 522165 - RNA, 22 nt, Human
uggagucagccucgcaggccuc

SEQ ID NO: 522166 - RNA, 32 nt, Human
uggagucaggcagagccgguauugaaaguggg

SEQ ID NO: 522167 - RNA, 21 nt, Human
uggagucagggcccccugugc

SEQ ID NO: 522168 - RNA, 32 nt, Human
uggagucaguaucgagccugaccaccgcaagc

SEQ ID NO: 522169 - RNA, 20 nt, Human
uggagucaguccccucugug

SEQ ID NO: 522170 - RNA, 32 nt, Human
uggagucauaaaggaauucaauuccuaggguu

SEQ ID NO: 522171 - RNA, 32 nt, Human
uggagucaucaucucuacccccagucuggcuu

SEQ ID NO: 522172 - RNA, 32 nt, Human
uggagucauccaggugcugccacaugacaggc

SEQ ID NO: 522173 - RNA, 32 nt, Human
uggagucaucuuccugcccuugccccaugccc

SEQ ID NO: 522174 - RNA, 32 nt, Human
uggagucauggagccucccaaacauagggaaa

SEQ ID NO: 522175 - RNA, 32 nt, Human
uggagucaugguccgguguccuuuucacuaca

SEQ ID NO: 522176 - RNA, 32 nt, Human
uggaguccagaacaaaguuagggagcaaacca

SEQ ID NO: 522177 - RNA, 32 nt, Human
uggaguccagaccugggcccugguucccccag

SEQ ID NO: 522178 - RNA, 32 nt, Human
uggaguccagagccuucauucaaucucagauu

SEQ ID NO: 522179 - RNA, 32 nt, Human
uggaguccagauggcaggcuacaguugggaag

SEQ ID NO: 522180 - RNA, 22 nt, Human
uggaguccagcaaggugacuca

SEQ ID NO: 522181 - RNA, 32 nt, Human
uggaguccagcaauccucccaccucaaccucu

SEQ ID NO: 522182 - RNA, 32 nt, Human
uggaguccagccugggugacagagugagaccc

SEQ ID NO: 522183 - RNA, 32 nt, Human
uggaguccaggaguucaagguggcagugagcu

SEQ ID NO: 522184 - RNA, 32 nt, Human
uggaguccagucucuucugcuggcagaaagca

SEQ ID NO: 522185 - RNA, 32 nt, Human
uggaguccaguggugugaucauagcucacugc

SEQ ID NO: 522186 - RNA, 22 nt, Human
uggagucccaucucucugagca

SEQ ID NO: 522187 - RNA, 32 nt, Human
uggaguccgaggaggaggagaaggaggccugc

SEQ ID NO: 522188 - RNA, 32 nt, Human
uggaguccguguccaagguccucugugagguc

SEQ ID NO: 522189 - RNA, 32 nt, Human
uggaguccuagagaggcagacaauguugauga

SEQ ID NO: 522190 - RNA, 32 nt, Human
uggaguccuccguuccccucagccucugagcu

SEQ ID NO: 522191 - RNA, 18 nt, Human
uggaguccuccuagcaga

SEQ ID NO: 522192 - RNA, 32 nt, Human
uggaguccugcucugugugguccagguccuuu

SEQ ID NO: 522193 - RNA, 32 nt, Human
uggagucuaaacuuuuucauugccagugcccc

SEQ ID NO: 522194 - RNA, 32 nt, Human
uggagucuccaccuucuugacacuuggggccc

SEQ ID NO: 522195 - RNA, 32 nt, Human
uggagucuccaccuuuuccuaccaagucccca

SEQ ID NO: 522196 - RNA, 32 nt, Human
uggagucuccaggaaccccagccuguuagggu

SEQ ID NO: 522197 - RNA, 32 nt, Human
uggagucucgcucucuggagugcaauggcgca

SEQ ID NO: 522198 - RNA, 32 nt, Human
uggagucucgcucucuugcccaggcuggagug

SEQ ID NO: 522199 - RNA, 32 nt, Human
uggagucucguucugucacccaggcuggcgug

SEQ ID NO: 522200 - RNA, 32 nt, Human
uggagucucucugcacuccagccugggugaca

SEQ ID NO: 522201 - RNA, 32 nt, Human
uggagucucugucacccaggcuggagugcaau

SEQ ID NO: 522202 - RNA, 32 nt, Human
uggagucucuuuuaugagggcacuaauuccaa

SEQ ID NO: 522203 - RNA, 32 nt, Human
uggagucugaagauggagaccaacgagucuac

SEQ ID NO: 522204 - RNA, 32 nt, Human
uggagucugaagccugcagguccggggaggag

SEQ ID NO: 522205 - RNA, 32 nt, Human
uggagucugagccggugguugcagcggaggcg

SEQ ID NO: 522206 - RNA, 32 nt, Human
uggagucugauggggagaagaaguacccaugc

SEQ ID NO: 522207 - RNA, 32 nt, Human
uggagucugccacccaggcuggaguccagugg

SEQ ID NO: 522208 - RNA, 23 nt, Human
uggagucuggaagcagcagaacu

SEQ ID NO: 522209 - RNA, 30 nt, Human
uggagucuggcucucuggcuccugugcauu

SEQ ID NO: 522210 - RNA, 32 nt, Human
uggagucuggggguacugaucuuuggaaaugu

SEQ ID NO: 522211 - RNA, 32 nt, Human
uggagucuguucuguguugauuugacugccau

SEQ ID NO: 522212 - RNA, 32 nt, Human
uggagucuuaccacucugcugcagggguggaa

SEQ ID NO: 522213 - RNA, 32 nt, Human
uggagucuuaggcaucucugguacaguggggu

SEQ ID NO: 522214 - RNA, 32 nt, Human
uggagucuuccucccuucucccaagucuuucu

SEQ ID NO: 522215 - RNA, 32 nt, Human
uggagucuuguucugucacccaggcuggagug

SEQ ID NO: 522216 - RNA, 32 nt, Human
uggagucuuguucugucacccaggcuggggug

SEQ ID NO: 522217 - RNA, 32 nt, Human
uggagucuuuaaaaauguugaagaauaaaaua

SEQ ID NO: 522218 - RNA, 20 nt, Human
uggagugaaaauccccucca

SEQ ID NO: 522219 - RNA, 32 nt, Human
uggagugaaaggaagggagaaagggaaaaagc

SEQ ID NO: 522220 - RNA, 31 nt, Human
uggagugaaauaaauucagccaacaugugac

SEQ ID NO: 522221 - RNA, 32 nt, Human
uggagugaaauuccacgccaggcacagaauuu

SEQ ID NO: 522222 - RNA, 32 nt, Human
uggagugacagccuuguucucugugauaggaa

SEQ ID NO: 522223 - RNA, 21 nt, Human
uggagugacaguuuccgccca

SEQ ID NO: 522224 - RNA, 18 nt, Human
uggagugaccuggcccca

SEQ ID NO: 522225 - RNA, 32 nt, Human
uggagugacuagaucacaggagcacuggagga

SEQ ID NO: 522226 - RNA, 21 nt, Human
uggagugacugaauuucuaca

SEQ ID NO: 522227 - RNA, 32 nt, Human
uggagugagaaacugggaucccagggggaggg

SEQ ID NO: 522228 - RNA, 32 nt, Human
uggagugagaugggauuuggcgucucguuuuu

SEQ ID NO: 522229 - RNA, 32 nt, Human
uggagugagucaaaccucagcccaggguaauu

SEQ ID NO: 522230 - RNA, 21 nt, Human
uggagugagucaccugcucca

SEQ ID NO: 522231 - RNA, 32 nt, Human
uggagugagucaccugcuccagaagaugccag

SEQ ID NO: 522232 - RNA, 20 nt, Human
uggagugaguuucugcacca

SEQ ID NO: 522233 - RNA, 32 nt, Human
uggagugaucacugccccuuugaacuucuggg

SEQ ID NO: 522234 - RNA, 32 nt, Human
uggagugaugcggccacaagcccagggacacc

SEQ ID NO: 522235 - RNA, 32 nt, Human
uggagugauuuguuggaaaaaguucugaagaa

SEQ ID NO: 522236 - RNA, 32 nt, Human
uggagugcaauggcacguucucagcucacugc

SEQ ID NO: 522237 - RNA, 32 nt, Human
uggagugcaauggcauaauuucugcucaccgc

SEQ ID NO: 522238 - RNA, 32 nt, Human
uggagugcaauggcaugaucucaccgauggcu

SEQ ID NO: 522239 - RNA, 32 nt, Human
uggagugcaauggcgcguucucugcucacuac

SEQ ID NO: 522240 - RNA, 32 nt, Human
uggagugcaauggcgugaucgcugcucaccgc

SEQ ID NO: 522241 - RNA, 32 nt, Human
uggagugcagaggcacagucagaacucacugc

SEQ ID NO: 522242 - RNA, 32 nt, Human
uggagugcagaggcacgaucuccguucacugc

SEQ ID NO: 522243 - RNA, 32 nt, Human
uggagugcagagggcccugaugacaugugugu

SEQ ID NO: 522244 - RNA, 32 nt, Human
uggagugcaggaguucaagaccagccugggca

SEQ ID NO: 522245 - RNA, 32 nt, Human
uggagugcagugacacgaucuuggcucacugc

SEQ ID NO: 522246 - RNA, 32 nt, Human
uggagugcagugacaugaucuuagcucacugc

SEQ ID NO: 522247 - RNA, 32 nt, Human
uggagugcagugacaugaucuuggcugacugc

SEQ ID NO: 522248 - RNA, 32 nt, Human
uggagugcagugacgcgauccugacugacugu

SEQ ID NO: 522249 - RNA, 32 nt, Human
uggagugcagugacucaugucucggcucacug

SEQ ID NO: 522250 - RNA, 32 nt, Human
uggagugcagugagccgagaucacgccacugc

SEQ ID NO: 522251 - RNA, 32 nt, Human
uggagugcagugagcuauuacagugccacugc

SEQ ID NO: 522252 - RNA, 32 nt, Human
uggagugcagugagcugagaucgcaccacugc

SEQ ID NO: 522253 - RNA, 32 nt, Human
uggagugcagugagcugagauugcgccacugc

SEQ ID NO: 522254 - RNA, 32 nt, Human
uggagugcagugaugcgauugaucauggcuca

SEQ ID NO: 522255 - RNA, 32 nt, Human
uggagugcagugaugugaucucggcuuacugu

SEQ ID NO: 522256 - RNA, 32 nt, Human
uggagugcagugaugugaucucgguucacugc

SEQ ID NO: 522257 - RNA, 32 nt, Human
uggagugcagugaugugaucuuggcucacugc

SEQ ID NO: 522258 - RNA, 32 nt, Human
uggagugcagugccaugaucacagcucacugc

SEQ ID NO: 522259 - RNA, 32 nt, Human
uggagugcaguggcaaaaucauggcucacugc

SEQ ID NO: 522260 - RNA, 32 nt, Human
uggagugcaguggcaagaucuuggcucacugc

SEQ ID NO: 522261 - RNA, 32 nt, Human
uggagugcaguggcacaaucaaagcucacugc

SEQ ID NO: 522262 - RNA, 32 nt, Human
uggagugcaguggcacaaucacagcucacugc

SEQ ID NO: 522263 - RNA, 32 nt, Human
uggagugcaguggcacaaucauaccucacugc

SEQ ID NO: 522264 - RNA, 32 nt, Human
uggagugcaguggcacaaucauggcucacugc

SEQ ID NO: 522265 - RNA, 32 nt, Human
uggagugcaguggcacaaucuuagcucacugc

SEQ ID NO: 522266 - RNA, 32 nt, Human
uggagugcaguggcaccaucuuagcucaccgc

SEQ ID NO: 522267 - RNA, 32 nt, Human
uggagugcaguggcacgaucacagcucacugc

SEQ ID NO: 522268 - RNA, 32 nt, Human
uggagugcaguggcacgaucauagcucacuga

SEQ ID NO: 522269 - RNA, 32 nt, Human
uggagugcaguggcacgaucauagcucacugc

SEQ ID NO: 522270 - RNA, 32 nt, Human
uggagugcaguggcacgaucauggcucacugc

SEQ ID NO: 522271 - RNA, 32 nt, Human
uggagugcaguggcacgaucucagcucacugc

SEQ ID NO: 522272 - RNA, 32 nt, Human
uggagugcaguggcacgaucucagcucauugc

SEQ ID NO: 522273 - RNA, 32 nt, Human
uggagugcaguggcacgaucucagcucccugc

SEQ ID NO: 522274 - RNA, 32 nt, Human
uggagugcaguggcacgaucucggcugacugc

SEQ ID NO: 522275 - RNA, 32 nt, Human
uggagugcaguggcacgaucuuagcucacuac

SEQ ID NO: 522276 - RNA, 32 nt, Human
uggagugcaguggcacgaucuuggcucacucc

SEQ ID NO: 522277 - RNA, 32 nt, Human
uggagugcaguggcacgaucuuggcucacugc

SEQ ID NO: 522278 - RNA, 32 nt, Human
uggagugcaguggcacgaucuuggcucgcugc

SEQ ID NO: 522279 - RNA, 32 nt, Human
uggagugcaguggcacgaucuuggcuuacuac

SEQ ID NO: 522280 - RNA, 32 nt, Human
uggagugcaguggcacgauuauggcucauugc

SEQ ID NO: 522281 - RNA, 32 nt, Human
uggagugcaguggcacugaucucggcucacug

SEQ ID NO: 522282 - RNA, 32 nt, Human
uggagugcaguggcagaguugcagcuggcugc

SEQ ID NO: 522283 - RNA, 32 nt, Human
uggagugcaguggcaggaucacagcuuacugc

SEQ ID NO: 522284 - RNA, 32 nt, Human
uggagugcaguggcagugucauggcucacugc

SEQ ID NO: 522285 - RNA, 32 nt, Human
uggagugcaguggcauaaucauaccucauugc

SEQ ID NO: 522286 - RNA, 32 nt, Human
uggagugcaguggcauaaucauagcucaccgc

SEQ ID NO: 522287 - RNA, 32 nt, Human
uggagugcaguggcaucaucucagcucacugc

SEQ ID NO: 522288 - RNA, 32 nt, Human
uggagugcaguggcaugaucacagcucacugc

SEQ ID NO: 522289 - RNA, 32 nt, Human
uggagugcaguggcaugaucauaacucacugc

SEQ ID NO: 522290 - RNA, 32 nt, Human
uggagugcaguggcaugaucauagcucacugc

SEQ ID NO: 522291 - RNA, 32 nt, Human
uggagugcaguggcaugaucauagcucauugc

SEQ ID NO: 522292 - RNA, 32 nt, Human
uggagugcaguggcaugaucaucagugagcgu

SEQ ID NO: 522293 - RNA, 32 nt, Human
uggagugcaguggcaugaucauggcucacugc

SEQ ID NO: 522294 - RNA, 32 nt, Human
uggagugcaguggcaugaucauggcuuacugc

SEQ ID NO: 522295 - RNA, 32 nt, Human
uggagugcaguggcaugaucauugcucacuac

SEQ ID NO: 522296 - RNA, 32 nt, Human
uggagugcaguggcaugaucucagcucacugc

SEQ ID NO: 522297 - RNA, 32 nt, Human
uggagugcaguggcaugaucucagcucacugu

SEQ ID NO: 522298 - RNA, 32 nt, Human
uggagugcaguggcaugaucucagcucgcugc

SEQ ID NO: 522299 - RNA, 32 nt, Human
uggagugcaguggcaugaucucaguuuaugca

SEQ ID NO: 522300 - RNA, 32 nt, Human
uggagugcaguggcaugaucucggcucacuac

SEQ ID NO: 522301 - RNA, 32 nt, Human
uggagugcaguggcaugaucucggcucacugc

SEQ ID NO: 522302 - RNA, 32 nt, Human
uggagugcaguggcaugaucucggcucauugc

SEQ ID NO: 522303 - RNA, 32 nt, Human
uggagugcaguggcaugaucucggcucgcugc

SEQ ID NO: 522304 - RNA, 32 nt, Human
uggagugcaguggcaugaucuggucucacugc

SEQ ID NO: 522305 - RNA, 32 nt, Human
uggagugcaguggcaugaucuuagcucacugc

SEQ ID NO: 522306 - RNA, 32 nt, Human
uggagugcaguggcaugaucuuagcucucugc

SEQ ID NO: 522307 - RNA, 32 nt, Human
uggagugcaguggcaugaucuuggcucacucc

SEQ ID NO: 522308 - RNA, 32 nt, Human
uggagugcaguggcaugaucuuggcucacugc

SEQ ID NO: 522309 - RNA, 32 nt, Human
uggagugcaguggcaugaucuuggcuuacugc

SEQ ID NO: 522310 - RNA, 32 nt, Human
uggagugcaguggcaugaugucggcucacugc

SEQ ID NO: 522311 - RNA, 32 nt, Human
uggagugcaguggcaugauuucggcucacugc

SEQ ID NO: 522312 - RNA, 32 nt, Human
uggagugcaguggcauuaucuagacucacugc

SEQ ID NO: 522313 - RNA, 32 nt, Human
uggagugcaguggccugaucuuggcucacugc

SEQ ID NO: 522314 - RNA, 32 nt, Human
uggagugcaguggccuggucauggcaucaagg

SEQ ID NO: 522315 - RNA, 32 nt, Human
uggagugcaguggcgcaaucauggcucacugc

SEQ ID NO: 522316 - RNA, 32 nt, Human
uggagugcaguggcgccaucucccaggcucaa

SEQ ID NO: 522317 - RNA, 32 nt, Human
uggagugcaguggcgcgaucauggcucacuga

SEQ ID NO: 522318 - RNA, 32 nt, Human
uggagugcaguggcgcgaucaugguucccugc

SEQ ID NO: 522319 - RNA, 32 nt, Human
uggagugcaguggcgcgaucuuagcucacugc

SEQ ID NO: 522320 - RNA, 32 nt, Human
uggagugcaguggcgcgaucuuagcucucugc

SEQ ID NO: 522321 - RNA, 32 nt, Human
uggagugcaguggcgugagcucggcugacugc

SEQ ID NO: 522322 - RNA, 32 nt, Human
uggagugcaguggcgugaucauagcucacugc

SEQ ID NO: 522323 - RNA, 32 nt, Human
uggagugcaguggcgugaucccagcuauauug

SEQ ID NO: 522324 - RNA, 32 nt, Human
uggagugcaguggcgugaucucagcucacugc

SEQ ID NO: 522325 - RNA, 32 nt, Human
uggagugcaguggcgugaucucagcucgcuac

SEQ ID NO: 522326 - RNA, 32 nt, Human
uggagugcaguggcgugaucucagcucgcugc

SEQ ID NO: 522327 - RNA, 32 nt, Human
uggagugcaguggcgugaucucaguucacugc

SEQ ID NO: 522328 - RNA, 32 nt, Human
uggagugcaguggcgugaucuccgcucgcuac

SEQ ID NO: 522329 - RNA, 32 nt, Human
uggagugcaguggcgugaucucggcucaccgc

SEQ ID NO: 522330 - RNA, 32 nt, Human
uggagugcaguggcgugaucucggcucacuac

SEQ ID NO: 522331 - RNA, 32 nt, Human
uggagugcaguggcgugaucucggcucacugc

SEQ ID NO: 522332 - RNA, 32 nt, Human
uggagugcaguggcgugaucucggcucauggc

SEQ ID NO: 522333 - RNA, 32 nt, Human
uggagugcaguggcgugaucucggcucauugc

SEQ ID NO: 522334 - RNA, 32 nt, Human
uggagugcaguggcgugaucucggcucgcuac

SEQ ID NO: 522335 - RNA, 32 nt, Human
uggagugcaguggcgugaucucggcucgcugc

SEQ ID NO: 522336 - RNA, 32 nt, Human
uggagugcaguggcgugaucucggcuuacugc

SEQ ID NO: 522337 - RNA, 32 nt, Human
uggagugcaguggcgugaucucugcucacugc

SEQ ID NO: 522338 - RNA, 32 nt, Human
uggagugcaguggcgugaucugggcucaccuc

SEQ ID NO: 522339 - RNA, 32 nt, Human
uggagugcaguggcgugaucuuggcucacuac

SEQ ID NO: 522340 - RNA, 32 nt, Human
uggagugcaguggcgugaucuuggcucacugc

SEQ ID NO: 522341 - RNA, 32 nt, Human
uggagugcaguggcgugaucuuggcucgcugc

SEQ ID NO: 522342 - RNA, 32 nt, Human
uggagugcaguggcgugaucuuggcugacugc

SEQ ID NO: 522343 - RNA, 32 nt, Human
uggagugcaguggcgugaucuugguucacugc

SEQ ID NO: 522344 - RNA, 32 nt, Human
uggagugcaguggcgugauuucagcucacggc

SEQ ID NO: 522345 - RNA, 32 nt, Human
uggagugcaguggcgugauuuuggcucacugc

SEQ ID NO: 522346 - RNA, 32 nt, Human
uggagugcaguggcgugauuuuggcucacugu

SEQ ID NO: 522347 - RNA, 32 nt, Human
uggagugcaguggcgugucuuggguuacugca

SEQ ID NO: 522348 - RNA, 32 nt, Human
uggagugcaguggcuugaucuuggcucacugc

SEQ ID NO: 522349 - RNA, 32 nt, Human
uggagugcagugggaugaucuuggcucacugc

SEQ ID NO: 522350 - RNA, 32 nt, Human
uggagugcagugguacaaucauggcucacugc

SEQ ID NO: 522351 - RNA, 32 nt, Human
uggagugcagugguaugaccauagcucacugc

SEQ ID NO: 522352 - RNA, 32 nt, Human
uggagugcagugguaugaucauagcugacugc

SEQ ID NO: 522353 - RNA, 32 nt, Human
uggagugcagugguaugaucauggcuugcugc

SEQ ID NO: 522354 - RNA, 32 nt, Human
uggagugcagugguaugaucucaccuuacugc

SEQ ID NO: 522355 - RNA, 32 nt, Human
uggagugcagugguaugaucucagcucacugc

SEQ ID NO: 522356 - RNA, 32 nt, Human
uggagugcagugguaugaucuuggcucacugu

SEQ ID NO: 522357 - RNA, 32 nt, Human
uggagugcaguggugcaaucauagcucacuau

SEQ ID NO: 522358 - RNA, 32 nt, Human
uggagugcaguggugcaaucauagcucacugc

SEQ ID NO: 522359 - RNA, 32 nt, Human
uggagugcaguggugcaaucauagcucauuga

SEQ ID NO: 522360 - RNA, 32 nt, Human
uggagugcaguggugccaucauagcucacugu

SEQ ID NO: 522361 - RNA, 32 nt, Human
uggagugcaguggugcgaucauagcucacugc

SEQ ID NO: 522362 - RNA, 32 nt, Human
uggagugcaguggugcgaucauggcucacugc

SEQ ID NO: 522363 - RNA, 32 nt, Human
uggagugcaguggugcgaucguggcucacuga

SEQ ID NO: 522364 - RNA, 32 nt, Human
uggagugcaguggugcgaucucggcuggcugc

SEQ ID NO: 522365 - RNA, 32 nt, Human
uggagugcaguggugucaucauagcucauugc

SEQ ID NO: 522366 - RNA, 32 nt, Human
uggagugcaguggugugaacagggcuaacugc

SEQ ID NO: 522367 - RNA, 32 nt, Human
uggagugcaguggugugaucacagcucacugc

SEQ ID NO: 522368 - RNA, 32 nt, Human
uggagugcaguggugugaucacggcucacugc

SEQ ID NO: 522369 - RNA, 32 nt, Human
uggagugcaguggugugaucacugcucagugc

SEQ ID NO: 522370 - RNA, 32 nt, Human
uggagugcaguggugugaucauaacucaguau

SEQ ID NO: 522371 - RNA, 32 nt, Human
uggagugcaguggugugaucauagccaauaga

SEQ ID NO: 522372 - RNA, 32 nt, Human
uggagugcaguggugugaucauagcucacuac

SEQ ID NO: 522373 - RNA, 32 nt, Human
uggagugcaguggugugaucauagcucacugc

SEQ ID NO: 522374 - RNA, 32 nt, Human
uggagugcaguggugugaucauagcucacugg

SEQ ID NO: 522375 - RNA, 32 nt, Human
uggagugcaguggugugaucauggcucacugc

SEQ ID NO: 522376 - RNA, 32 nt, Human
uggagugcaguggugugaucaugguucacugc

SEQ ID NO: 522377 - RNA, 32 nt, Human
uggagugcaguggugugauccuggcucacugu

SEQ ID NO: 522378 - RNA, 32 nt, Human
uggagugcaguggugugaucucagcucaccga

SEQ ID NO: 522379 - RNA, 32 nt, Human
uggagugcaguggugugaucucagcucacugc

SEQ ID NO: 522380 - RNA, 32 nt, Human
uggagugcaguggugugaucucagcucagugc

SEQ ID NO: 522381 - RNA, 32 nt, Human
uggagugcaguggugugaucucagcucaucaa

SEQ ID NO: 522382 - RNA, 32 nt, Human
uggagugcaguggugugaucucagcucgcugc

SEQ ID NO: 522383 - RNA, 32 nt, Human
uggagugcaguggugugaucucagcuuacugc

SEQ ID NO: 522384 - RNA, 32 nt, Human
uggagugcaguggugugaucucagcuuauugc

SEQ ID NO: 522385 - RNA, 32 nt, Human
uggagugcaguggugugaucuuggcucaccgu

SEQ ID NO: 522386 - RNA, 32 nt, Human
uggagugcaguggugugaucuuggcucacugc

SEQ ID NO: 522387 - RNA, 32 nt, Human
uggagugcaguggugugaucuuggcucacuug

SEQ ID NO: 522388 - RNA, 32 nt, Human
uggagugcaguggugugaucuuggcucaucgu

SEQ ID NO: 522389 - RNA, 32 nt, Human
uggagugcaguggugugaucuuggcuuucugc

SEQ ID NO: 522390 - RNA, 32 nt, Human
uggagugcagugguugaucauagcucccgggc

SEQ ID NO: 522391 - RNA, 32 nt, Human
uggagugcaguugcaggaucauaguuugcugc

SEQ ID NO: 522392 - RNA, 32 nt, Human
uggagugcauguugacaccagcacuuuuucug

SEQ ID NO: 522393 - RNA, 32 nt, Human
uggagugccacaccccucucucugccaguuca

SEQ ID NO: 522394 - RNA, 32 nt, Human
uggagugcgguggcaugaucucaguucacugc

SEQ ID NO: 522395 - RNA, 32 nt, Human
uggagugcgguggugcgaucauagcucacugc

SEQ ID NO: 522396 - RNA, 32 nt, Human
uggagugcggugguggaaucauagcucacuau

SEQ ID NO: 522397 - RNA, 32 nt, Human
uggagugcucacuaacaagggugagugcucuc

SEQ ID NO: 522398 - RNA, 32 nt, Human
uggagugcugggacuggcagaggaaauuaauu

SEQ ID NO: 522399 - RNA, 32 nt, Human
uggagugcuucacaggggaaacccauccgcau

SEQ ID NO: 522400 - RNA, 32 nt, Human
uggaguggaauuuucuguuacagugaaugcag

SEQ ID NO: 522401 - RNA, 32 nt, Human
uggaguggagaaggggccagggguucugggca

SEQ ID NO: 522402 - RNA, 21 nt, Human
uggaguggagaccuaccucca

SEQ ID NO: 522403 - RNA, 32 nt, Human
uggaguggagagagcacugaaauggggcuugg

SEQ ID NO: 522404 - RNA, 32 nt, Human
uggaguggagagugggcucggguacaugggag

SEQ ID NO: 522405 - RNA, 32 nt, Human
uggaguggagccaaaggaaaagaucguuagag

SEQ ID NO: 522406 - RNA, 32 nt, Human
uggaguggagguggagggaccgaggaaccaug

SEQ ID NO: 522407 - RNA, 32 nt, Human
uggaguggaguggcacgaucauagcucacuaa

SEQ ID NO: 522408 - RNA, 32 nt, Human
uggaguggaguggcaugaucucggcugacugc

SEQ ID NO: 522409 - RNA, 32 nt, Human
uggaguggcagcuggggugauggccagggcag

SEQ ID NO: 522410 - RNA, 32 nt, Human
uggaguggccaugucccuugugcauugagugc

SEQ ID NO: 522411 - RNA, 32 nt, Human
uggaguggccugaaagagagcaagaacaugug

SEQ ID NO: 522412 - RNA, 32 nt, Human
uggaguggcguagaguucaguguucgcagucg

SEQ ID NO: 522413 - RNA, 32 nt, Human
uggaguggcucauaccuguaaucccagcacuu

SEQ ID NO: 522414 - RNA, 32 nt, Human
uggaguggcugcagccaucuggauggaggcag

SEQ ID NO: 522415 - RNA, 32 nt, Human
uggagugggaaaaugcugggaccaaagauugg

SEQ ID NO: 522416 - RNA, 21 nt, Human
uggagugggaagaccuaucca

SEQ ID NO: 522417 - RNA, 24 nt, Human
uggagugggaagaguugagacuga

SEQ ID NO: 522418 - RNA, 20 nt, Human
uggagugggagggaggcgca

SEQ ID NO: 522419 - RNA, 32 nt, Human
uggagugggcacaggcaugguaccaccagccu

SEQ ID NO: 522420 - RNA, 32 nt, Human
uggagugggcaggcaggccagggcugcgcauc

SEQ ID NO: 522421 - RNA, 32 nt, Human
uggagugggccccagaccagagaaaaguggua

SEQ ID NO: 522422 - RNA, 32 nt, Human
uggagugggcccugugcaccucaccuggcgga

SEQ ID NO: 522423 - RNA, 23 nt, Human
uggaguggggccucaaagggcag

SEQ ID NO: 522424 - RNA, 32 nt, Human
uggagugggggaacaaaucaauguggcuguuu

SEQ ID NO: 522425 - RNA, 32 nt, Human
uggagugggggucaaccccuccccagucucug

SEQ ID NO: 522426 - RNA, 32 nt, Human
uggagugggugcuugugucugcugucucagag

SEQ ID NO: 522427 - RNA, 32 nt, Human
uggagugguuuaaaacugaucaagcagcucau

SEQ ID NO: 522428 - RNA, 32 nt, Human
uggccuaccuccugaggaccucagccacagau

SEQ ID NO: 522429 - RNA, 32 nt, Human
uggccuaccugagcccaugcagccuggggcca

SEQ ID NO: 522430 - RNA, 32 nt, Human
uggccuacggagcccacccaggcacagccacc

SEQ ID NO: 522431 - RNA, 32 nt, Human
uggccuagacuccaaaggguuggguagaugag

SEQ ID NO: 522432 - RNA, 32 nt, Human
uggccuagauccagccaccacucugaaacuca

SEQ ID NO: 522433 - RNA, 30 nt, Human
uggccuagccucucuguccuucccugaguc

SEQ ID NO: 522434 - RNA, 32 nt, Human
uggccuaggaguucaagaccagccugggcuac

SEQ ID NO: 522435 - RNA, 21 nt, Human
uggccuaggcuggagugcagu

SEQ ID NO: 522436 - RNA, 22 nt, Human
uggccuaggcuggagugcagug

SEQ ID NO: 522437 - RNA, 32 nt, Human
uggccuaggggaggggaagggaggcccacuuc

SEQ ID NO: 522438 - RNA, 32 nt, Human
uggccuaggggcccugaucgcccaccugccug

SEQ ID NO: 522439 - RNA, 32 nt, Human
uggccuagggucuugcuauguugcccaggcug

SEQ ID NO: 522440 - RNA, 24 nt, Human
uggccuaggugauccacccgccuc

SEQ ID NO: 522441 - RNA, 32 nt, Human
uggccuagguuggagugcaauggcgcaaucuc

SEQ ID NO: 522442 - RNA, 19 nt, Human
uggccuagucccuuccaca

SEQ ID NO: 522443 - RNA, 32 nt, Human
uggccuaugauggaugggggcucuguggcaaa

SEQ ID NO: 522444 - RNA, 32 nt, Human
uggccuaugauggaugggggcucuguggugaa

SEQ ID NO: 522445 - RNA, 32 nt, Human
uggccuaugcugcagaaucucacugcagcugg

SEQ ID NO: 522446 - RNA, 32 nt, Human
uggccuauuggcccucaguuuuccuacagagu

SEQ ID NO: 522447 - RNA, 23 nt, Human
uggccucaaacgaccuuccugcc

SEQ ID NO: 522448 - RNA, 32 nt, Human
uggccucaaacuugaacaaagcugcaggcucc

SEQ ID NO: 522449 - RNA, 25 nt, Human
uggccucaaaugauccacccaccuu

SEQ ID NO: 522450 - RNA, 26 nt, Human
uggccucaaaugaucuucccacuuca

SEQ ID NO: 522451 - RNA, 32 nt, Human
uggccucaaauggaugccagaugccaacccca

SEQ ID NO: 522452 - RNA, 26 nt, Human
uggccucaagcaauccgccuaccuca

SEQ ID NO: 522453 - RNA, 26 nt, Human
uggccucaagcaauccucccaccuca

SEQ ID NO: 522454 - RNA, 32 nt, Human
uggccucaagcaauccucccaccucagcaucc

SEQ ID NO: 522455 - RNA, 32 nt, Human
uggccucaagcaauccucccaccucagccucc

SEQ ID NO: 522456 - RNA, 32 nt, Human
uggccucaagcaauccucccaccucggccucc

SEQ ID NO: 522457 - RNA, 26 nt, Human
uggccucaagcaauccucccaccuua

SEQ ID NO: 522458 - RNA, 26 nt, Human
uggccucaagcaauccuuccaccuca

SEQ ID NO: 522459 - RNA, 20 nt, Human
uggccucaagcaguccuccc

SEQ ID NO: 522460 - RNA, 26 nt, Human
uggccucaagcaguccucccaccuca

SEQ ID NO: 522461 - RNA, 26 nt, Human
uggccucaagcaguccucccaccuua

SEQ ID NO: 522462 - RNA, 32 nt, Human
uggccucaagccuaaggaccccaauggcagua

SEQ ID NO: 522463 - RNA, 25 nt, Human
uggccucaagcgauccacccaucuu

SEQ ID NO: 522464 - RNA, 25 nt, Human
uggccucaagcgauccucccaccuc

SEQ ID NO: 522465 - RNA, 26 nt, Human
uggccucaagcgauccucccaccuca

SEQ ID NO: 522466 - RNA, 32 nt, Human
uggccucaagcgauccucccaccucagccucc

SEQ ID NO: 522467 - RNA, 32 nt, Human
uggccucaagcgauccucccaccucgaccucc

SEQ ID NO: 522468 - RNA, 26 nt, Human
uggccucaagcgauccucucaucuca

SEQ ID NO: 522469 - RNA, 26 nt, Human
uggccucaagcuguccucccaucuca

SEQ ID NO: 522470 - RNA, 25 nt, Human
uggccucaagucauuccccaccuua

SEQ ID NO: 522471 - RNA, 26 nt, Human
uggccucaagugauccacccaccuca

SEQ ID NO: 522472 - RNA, 25 nt, Human
uggccucaagugauccaccggccuc

SEQ ID NO: 522473 - RNA, 24 nt, Human
uggccucaagugauccaccuaccu

SEQ ID NO: 522474 - RNA, 26 nt, Human
uggccucaagugauccuccugccuca

SEQ ID NO: 522475 - RNA, 26 nt, Human
uggccucaagugauccuccugccuua

SEQ ID NO: 522476 - RNA, 26 nt, Human
uggccucaagugauccucuugccuca

SEQ ID NO: 522477 - RNA, 25 nt, Human
uggccucaagugauccuuccaccuu

SEQ ID NO: 522478 - RNA, 25 nt, Human
uggccucaagugaucugccgccuca

SEQ ID NO: 522479 - RNA, 26 nt, Human
uggccucaagugaucugccugccuca

SEQ ID NO: 522480 - RNA, 25 nt, Human
uggccucaagugauucacccgccuc

SEQ ID NO: 522481 - RNA, 26 nt, Human
uggccucaagugauucuccugccuca

SEQ ID NO: 522482 - RNA, 32 nt, Human
uggccucaaguuggggcuuggcugggagaagu

SEQ ID NO: 522483 - RNA, 24 nt, Human
uggccucaaucgaucuuccugcca

SEQ ID NO: 522484 - RNA, 31 nt, Human
uggccucacagcuuccuugcaaggcugucac

SEQ ID NO: 522485 - RNA, 32 nt, Human
uggccucaccagaaacugacccugccagaccu

SEQ ID NO: 522486 - RNA, 32 nt, Human
uggccucacccaagccucuucuaaaaaccaug

SEQ ID NO: 522487 - RNA, 32 nt, Human
uggccucacccaggacuuugaugugagaauga

SEQ ID NO: 522488 - RNA, 22 nt, Human
uggccucacgccuguaauccca

SEQ ID NO: 522489 - RNA, 24 nt, Human
uggccucacgccuguaaucccagc

SEQ ID NO: 522490 - RNA, 26 nt, Human
uggccucacgugaucuguccacuuca

SEQ ID NO: 522491 - RNA, 31 nt, Human
uggccucagaccucugggccugugugagcuc

SEQ ID NO: 522492 - RNA, 32 nt, Human
uggccucagagcuuccuggggaccaagauuua

SEQ ID NO: 522493 - RNA, 32 nt, Human
uggccucagauggauggauguguuuggacgag

SEQ ID NO: 522494 - RNA, 32 nt, Human
uggccucagcccccagcaucuccuggggcccc

SEQ ID NO: 522495 - RNA, 32 nt, Human
uggccucaggagcugggggugcagugggggac

SEQ ID NO: 522496 - RNA, 18 nt, Human
uggccucaggcaauuuca

SEQ ID NO: 522497 - RNA, 32 nt, Human
uggccucaggggaccugccuguccucagcucc

SEQ ID NO: 522498 - RNA, 25 nt, Human
uggccucaggugacccgcccgccuu

SEQ ID NO: 522499 - RNA, 26 nt, Human
uggccucaggugauccacccaccuca

SEQ ID NO: 522500 - RNA, 26 nt, Human
uggccucaggugauccacccgccuca

SEQ ID NO: 522501 - RNA, 25 nt, Human
uggccucaggugaucugcccaccuc

SEQ ID NO: 522502 - RNA, 26 nt, Human
uggccucaggugaucugcccaccuca

SEQ ID NO: 522503 - RNA, 25 nt, Human
uggccucaggugaucugcccaccuu

SEQ ID NO: 522504 - RNA, 32 nt, Human
uggccucagguuuauuggcgauaaucacagaa

SEQ ID NO: 522505 - RNA, 32 nt, Human
uggccucagucccuaaaaaugauguggaaagg

SEQ ID NO: 522506 - RNA, 32 nt, Human
uggccucagugcacaguggcccccagccucgg

SEQ ID NO: 522507 - RNA, 20 nt, Human
uggccucauaagcucacaga

SEQ ID NO: 522508 - RNA, 32 nt, Human
uggccucauacagaaagugacaagggcacaag

SEQ ID NO: 522509 - RNA, 32 nt, Human
uggccucauagcuccuccucgccaagcauguc

SEQ ID NO: 522510 - RNA, 32 nt, Human
uggccucaucuccuccugccuuuccucccuua

SEQ ID NO: 522511 - RNA, 22 nt, Human
uggccucaugccuauaauccca

SEQ ID NO: 522512 - RNA, 24 nt, Human
uggccucaugccuauaaucccagc

SEQ ID NO: 522513 - RNA, 32 nt, Human
uggccucauggaggugcugguggagaagauuu

SEQ ID NO: 522514 - RNA, 26 nt, Human
uggccucaugugaucugcccaccuca

SEQ ID NO: 522515 - RNA, 32 nt, Human
uggccucauucucuuucuaaucuugcugguuu

SEQ ID NO: 522516 - RNA, 32 nt, Human
uggccuccaaagugcugggauuacagguguga

SEQ ID NO: 522517 - RNA, 32 nt, Human
uggccuccaagcucugccuccagugcucacuc

SEQ ID NO: 522518 - RNA, 32 nt, Human
uggccuccaagcucugcguccagugcucacuc

SEQ ID NO: 522519 - RNA, 32 nt, Human
uggccuccaccccaccaccaggcccaaugacc

SEQ ID NO: 522520 - RNA, 18 nt, Human
uggccuccagauuccagu

SEQ ID NO: 522521 - RNA, 32 nt, Human
uggccuccagccugggugaccgagugagacug

SEQ ID NO: 522522 - RNA, 32 nt, Human
uggccuccagcuguucuuagugacacacacug

SEQ ID NO: 522523 - RNA, 32 nt, Human
uggccuccagcuugucccucucucacuuucua

SEQ ID NO: 522524 - RNA, 21 nt, Human
uggccuccaggccucuacaca

SEQ ID NO: 522525 - RNA, 26 nt, Human
uggccuccagggugccuccaccugac

SEQ ID NO: 522526 - RNA, 32 nt, Human
uggccuccagucccaucucccccaacacaugu

SEQ ID NO: 522527 - RNA, 32 nt, Human
uggccuccauccucaucucucuugggccaagc

SEQ ID NO: 522528 - RNA, 32 nt, Human
uggccucccaaagugcuagauuacaggcgugg

SEQ ID NO: 522529 - RNA, 32 nt, Human
uggccucccaaagugcuggauuacaggcauag

SEQ ID NO: 522530 - RNA, 32 nt, Human
uggccucccaaaguguuggauuacagguguga

SEQ ID NO: 522531 - RNA, 32 nt, Human
uggccucccaagugcugggauuacaggcgcga

SEQ ID NO: 522532 - RNA, 18 nt, Human
uggccucccacucccaca

SEQ ID NO: 522533 - RNA, 32 nt, Human
uggccucccacuguuuucagcuguguccccca

SEQ ID NO: 522534 - RNA, 26 nt, Human
uggccucccaguuuccccuccugcca

SEQ ID NO: 522535 - RNA, 32 nt, Human
uggccucccaguuuccccuccugccaguccuu

SEQ ID NO: 522536 - RNA, 18 nt, Human
uggccucccauucacaca

SEQ ID NO: 522537 - RNA, 32 nt, Human
uggccuccccaaagugcugggauuacaggcau

SEQ ID NO: 522538 - RNA, 24 nt, Human
uggccuccccuuccccucccugcc

SEQ ID NO: 522539 - RNA, 32 nt, Human
uggccucccgaaagugcugggauuacagucau

SEQ ID NO: 522540 - RNA, 32 nt, Human
uggccucccgggcuguguccgcacucagcagc

SEQ ID NO: 522541 - RNA, 22 nt, Human
uggccucccucccccuaccuca

SEQ ID NO: 522542 - RNA, 19 nt, Human
uggccucccugccuccagu

SEQ ID NO: 522543 - RNA, 32 nt, Human
uggccucccugccuccaguccuucccuagccc

SEQ ID NO: 522544 - RNA, 26 nt, Human
uggccucccuggccugucuccccacu

SEQ ID NO: 522545 - RNA, 19 nt, Human
uggccucccugguucugca

SEQ ID NO: 522546 - RNA, 32 nt, Human
uggccucccuugccuggugccugagugaagga

SEQ ID NO: 522547 - RNA, 32 nt, Human
uggccuccgccagcuccugccuggcugccaga

SEQ ID NO: 522548 - RNA, 22 nt, Human
uggccuccggagccuuccugcu

SEQ ID NO: 522549 - RNA, 32 nt, Human
uggccuccgggaccagggagggaggacgcugg

SEQ ID NO: 522550 - RNA, 32 nt, Human
uggccuccuaagugcugggauuacaggcguga

SEQ ID NO: 522551 - RNA, 32 nt, Human
uggccuccuagagugcugggauuacaggugug

SEQ ID NO: 522552 - RNA, 32 nt, Human
uggccuccuaguuucuaccuaaucaugucccu

SEQ ID NO: 522553 - RNA, 32 nt, Human
uggccuccucauucucuuuugccauuggaaug

SEQ ID NO: 522554 - RNA, 32 nt, Human
uggccuccuccaccaccugccuugugaccaca

SEQ ID NO: 522555 - RNA, 32 nt, Human
uggccuccuccaggagggcuggcuucucugca

SEQ ID NO: 522556 - RNA, 32 nt, Human
uggccuccuccugugugagucccaccaggagc

SEQ ID NO: 522557 - RNA, 32 nt, Human
uggccuccugaguagcugggguugcaggugug

SEQ ID NO: 522558 - RNA, 32 nt, Human
uggccuccugccucccugucuucccauguucu

SEQ ID NO: 522559 - RNA, 32 nt, Human
uggccuccugggugcugggauuacagacguga

SEQ ID NO: 522560 - RNA, 32 nt, Human
uggccuccuugaacuccuccugccuuggccuc

SEQ ID NO: 522561 - RNA, 32 nt, Human
uggccuccuugccugugagauggcacugugac

SEQ ID NO: 522562 - RNA, 32 nt, Human
uggccuccuuggggcuccuguuggcuccuaau

SEQ ID NO: 522563 - RNA, 32 nt, Human
uggccuccuuuuccuuugacuggaccacugcc

SEQ ID NO: 522564 - RNA, 32 nt, Human
uggccucgcacacuggagacccuggugccaga

SEQ ID NO: 522565 - RNA, 22 nt, Human
uggccucgcguccgcccauuca

SEQ ID NO: 522566 - RNA, 21 nt, Human
uggccucuaacccucugcaca

SEQ ID NO: 522567 - RNA, 32 nt, Human
uggccucuacccacuaggugccaggaaugcgc

SEQ ID NO: 522568 - RNA, 18 nt, Human
uggccucuacuccccaca

SEQ ID NO: 522569 - RNA, 18 nt, Human
uggccucuacucugaaca

SEQ ID NO: 522570 - RNA, 20 nt, Human
uggccucuagauuaaugcca

SEQ ID NO: 522571 - RNA, 32 nt, Human
uggccucucaaccucagacuucucagccugcc

SEQ ID NO: 522572 - RNA, 20 nt, Human
uggccucucacuccuucaca

SEQ ID NO: 522573 - RNA, 19 nt, Human
uggccucucagccugcaua

SEQ ID NO: 522574 - RNA, 32 nt, Human
uggccucucagccugcauaacagacugaaaug

SEQ ID NO: 522575 - RNA, 19 nt, Human
uggccucucagcucugcca

SEQ ID NO: 522576 - RNA, 20 nt, Human
uggccucucaggauuccaca

SEQ ID NO: 522577 - RNA, 32 nt, Human
uggccucucaucccccuucuucccacaacccu

SEQ ID NO: 522578 - RNA, 21 nt, Human
uggccucuccagggcugcuca

SEQ ID NO: 522579 - RNA, 32 nt, Human
uggccucuccauccgccccgacuuccagaagg

SEQ ID NO: 522580 - RNA, 19 nt, Human
uggccucucccccaugcug

SEQ ID NO: 522581 - RNA, 21 nt, Human
uggccucucccugcccugaca

SEQ ID NO: 522582 - RNA, 32 nt, Human
uggccucuccuccccuccccucccucaguccu

SEQ ID NO: 522583 - RNA, 32 nt, Human
uggccucuccugaugucccucucccucccucc

SEQ ID NO: 522584 - RNA, 32 nt, Human
uggccucucuccccucucucuuuuccuccuuc

SEQ ID NO: 522585 - RNA, 20 nt, Human
uggccucucugauccuucca

SEQ ID NO: 522586 - RNA, 32 nt, Human
uggccucucugccuucucuguucuguucuccc

SEQ ID NO: 522587 - RNA, 18 nt, Human
uggccucucuggcugcca

SEQ ID NO: 522588 - RNA, 19 nt, Human
uggccucucuguccccaca

SEQ ID NO: 522589 - RNA, 18 nt, Human
uggccucugacccccaca

SEQ ID NO: 522590 - RNA, 32 nt, Human
uggccucugagaugcacuggcuuggggcgccc

SEQ ID NO: 522591 - RNA, 18 nt, Human
uggccucugagcuccaca

SEQ ID NO: 522592 - RNA, 19 nt, Human
uggccucugcaacugcuca

SEQ ID NO: 522593 - RNA, 24 nt, Human
uggccucugcacccccuucugcca

SEQ ID NO: 522594 - RNA, 32 nt, Human
uggccucugcacccuggagaugcggcugccuc

SEQ ID NO: 522595 - RNA, 20 nt, Human
uggccucugcaccuccacac

SEQ ID NO: 522596 - RNA, 32 nt, Human
uggccucugcacuccagccugggugacagagu

SEQ ID NO: 522597 - RNA, 32 nt, Human
uggccucugcagaggggaccucagccugucac

SEQ ID NO: 522598 - RNA, 20 nt, Human
uggccucugcagccaacaca

SEQ ID NO: 522599 - RNA, 32 nt, Human
uggccucugcagggagcuucguagaggugagg

SEQ ID NO: 522600 - RNA, 18 nt, Human
uggccucugccaucugca

SEQ ID NO: 522601 - RNA, 32 nt, Human
uggccucugcccacccuuugagcuguaccugc

SEQ ID NO: 522602 - RNA, 32 nt, Human
uggccucugccuccuuggccccacauuucugc

SEQ ID NO: 522603 - RNA, 21 nt, Human
uggccucugcgccuccugcca

SEQ ID NO: 522604 - RNA, 32 nt, Human
uggccucugcuccaccucaacagcucccacug

SEQ ID NO: 522605 - RNA, 32 nt, Human
uggccucuggaaccagccugugugccagcgcu

SEQ ID NO: 522606 - RNA, 22 nt, Human
uggccucuggaaccuuauccaa

SEQ ID NO: 522607 - RNA, 32 nt, Human
uggccucugggagggggucaggaagaggcgaa

SEQ ID NO: 522608 - RNA, 32 nt, Human
uggccucuggggaucugcugggcagauguccc

SEQ ID NO: 522609 - RNA, 32 nt, Human
uggccucuuaacccucuccuuagcccuagggc

SEQ ID NO: 522610 - RNA, 32 nt, Human
uggccucuuagcaccacauuccuguuuuucag

SEQ ID NO: 522611 - RNA, 32 nt, Human
uggccucuuccuccuccccugccaggccucug

SEQ ID NO: 522612 - RNA, 32 nt, Human
uggccucuucugggugccugaauucaugcgug

SEQ ID NO: 522613 - RNA, 32 nt, Human
uggccucuucuuucccagcuccugccuccugg

SEQ ID NO: 522614 - RNA, 22 nt, Human
uggccucuugaguuccucugca

SEQ ID NO: 522615 - RNA, 32 nt, Human
uggccucuuuaagaguuaguuucuuugggauu

SEQ ID NO: 522616 - RNA, 21 nt, Human
uggccucuuucacucagcaca

SEQ ID NO: 522617 - RNA, 32 nt, Human
uggccucuuugaagaaauggccagaagugagc

SEQ ID NO: 522618 - RNA, 32 nt, Human
uggccucuuuugauuauaacuggggucaccaa

SEQ ID NO: 522619 - RNA, 19 nt, Human
uggccugaacagauguaaa

SEQ ID NO: 522620 - RNA, 26 nt, Human
uggccugaagcaauccgcccaccuca

SEQ ID NO: 522621 - RNA, 32 nt, Human
uggccugaagccugggcuggaggguucagucc

SEQ ID NO: 522622 - RNA, 25 nt, Human
uggccugaagugauuugcccaucuc

SEQ ID NO: 522623 - RNA, 32 nt, Human
uggccugaauugcaggaugacauuccaaacau

SEQ ID NO: 522624 - RNA, 32 nt, Human
uggccugacccagccagguggccuuauuucuu

SEQ ID NO: 522625 - RNA, 32 nt, Human
uggccugacccuguccugucagcuggguuuac

SEQ ID NO: 522626 - RNA, 32 nt, Human
uggccugagcccagggguucuagaccagcuua

SEQ ID NO: 522627 - RNA, 32 nt, Human
uggccugagccccaggccuuggccuccugugc

SEQ ID NO: 522628 - RNA, 19 nt, Human
uggccugagcgcaggggga

SEQ ID NO: 522629 - RNA, 32 nt, Human
uggccugaggauggcccugccuggcagaggag

SEQ ID NO: 522630 - RNA, 32 nt, Human
uggccugagggcaggccagagcugaggggcug

SEQ ID NO: 522631 - RNA, 32 nt, Human
uggccugaucaauaugaugaaaccccugucuc

SEQ ID NO: 522632 - RNA, 32 nt, Human
uggccugaucauggaaaguaaggaguuaggca

SEQ ID NO: 522633 - RNA, 23 nt, Human
uggccugaucucggcucacugca

SEQ ID NO: 522634 - RNA, 23 nt, Human
uggccugaucuuggcucacugca

SEQ ID NO: 522635 - RNA, 20 nt, Human
uggccugcaauggacccgag

SEQ ID NO: 522636 - RNA, 32 nt, Human
uggccugcacacagcugcucagcaccauuuca

SEQ ID NO: 522637 - RNA, 21 nt, Human
uggccugcaccuguaguccca

SEQ ID NO: 522638 - RNA, 24 nt, Human
uggccugcaccuguagucccagcu

SEQ ID NO: 522639 - RNA, 32 nt, Human
uggccugcagaacugugagacaauaaacucuc

SEQ ID NO: 522640 - RNA, 16 nt, Human
uggccugcaugggguc

SEQ ID NO: 522641 - RNA, 32 nt, Human
uggccugccccuccuccagcccuaagugccug

SEQ ID NO: 522642 - RNA, 32 nt, Human
uggccugccugaggccuuccagccagaacauc

SEQ ID NO: 522643 - RNA, 32 nt, Human
uggccugcgggaggcuguguacacuuggcccc

SEQ ID NO: 522644 - RNA, 22 nt, Human
uggccugcgugcccucccagca

SEQ ID NO: 522645 - RNA, 32 nt, Human
uggccugcuccaggauggugcugcagguaccu

SEQ ID NO: 522646 - RNA, 32 nt, Human
uggccugcugcauuugacuugcucugaaucaa

SEQ ID NO: 522647 - RNA, 32 nt, Human
uggccugcugcucucugcaauggugggacccu

SEQ ID NO: 522648 - RNA, 19 nt, Human
uggccugcugcucugcaca

SEQ ID NO: 522649 - RNA, 32 nt, Human
uggccugcugcuggugaagacgccccuuacua

SEQ ID NO: 522650 - RNA, 32 nt, Human
uggccuggaaaccaagccccacugccucuuug

SEQ ID NO: 522651 - RNA, 32 nt, Human
uggccuggaaccuggaugccuccagccuuugc

SEQ ID NO: 522652 - RNA, 32 nt, Human
uggccuggacaacauggcgagaccccaccucu

SEQ ID NO: 522653 - RNA, 32 nt, Human
uggccuggacaccgccaugagcacagggcagg

SEQ ID NO: 522654 - RNA, 32 nt, Human
uggccuggacagugaagggagagaaguggauu

SEQ ID NO: 522655 - RNA, 18 nt, Human
uggccuggaccagggagg

SEQ ID NO: 522656 - RNA, 20 nt, Human
uggccuggaccucagaagga

SEQ ID NO: 522657 - RNA, 20 nt, Human
uggccuggacugacugcagc

SEQ ID NO: 522658 - RNA, 20 nt, Human
uggccuggacugagggagga

SEQ ID NO: 522659 - RNA, 32 nt, Human
uggccuggagcagcagcccaugcuacucucug

SEQ ID NO: 522660 - RNA, 32 nt, Human
uggccuggagccuggaagggggagacggcccg

SEQ ID NO: 522661 - RNA, 21 nt, Human
uggccuggaggcaccagaggg

SEQ ID NO: 522662 - RNA, 32 nt, Human
uggccuggaggcaccagaggggcaagagaaug

SEQ ID NO: 522663 - RNA, 32 nt, Human
uggccuggauucugcugccacgugccauagug

SEQ ID NO: 522664 - RNA, 32 nt, Human
uggccuggauugcaacauccucccagagaagg

SEQ ID NO: 522665 - RNA, 20 nt, Human
uggccuggcaccgggugggg

SEQ ID NO: 522666 - RNA, 21 nt, Human
uggccuggcagccagggguga

SEQ ID NO: 522667 - RNA, 17 nt, Human
uggccuggcaggcaggg

SEQ ID NO: 522668 - RNA, 32 nt, Human
uggccuggccaucucccuccccagaaacagug

SEQ ID NO: 522669 - RNA, 32 nt, Human
uggccuggccaucuuguugcugcuuggagaga

SEQ ID NO: 522670 - RNA, 32 nt, Human
uggccuggcccaccuuccccagaaccagggga

SEQ ID NO: 522671 - RNA, 32 nt, Human
uggccuggcccuggcccuccugcugcugcugg

SEQ ID NO: 522672 - RNA, 32 nt, Human
uggccuggccgacgugguaaaaccccaucuau

SEQ ID NO: 522673 - RNA, 32 nt, Human
uggccuggccuccagcucccacucccuuucca

SEQ ID NO: 522674 - RNA, 32 nt, Human
uggccuggccugggacaccuccucucugccag

SEQ ID NO: 522675 - RNA, 19 nt, Human
uggccuggcggggagcggg

SEQ ID NO: 522676 - RNA, 18 nt, Human
uggccuggcgggucuggg

SEQ ID NO: 522677 - RNA, 32 nt, Human
uggccuggcuaggaggaaaaagagcaguuuuc

SEQ ID NO: 522678 - RNA, 19 nt, Human
uggccuggcucaaccgagu

SEQ ID NO: 522679 - RNA, 32 nt, Human
uggccuggcucugugccugccugccuccagga

SEQ ID NO: 522680 - RNA, 16 nt, Human
uggccuggcugagggg

SEQ ID NO: 522681 - RNA, 18 nt, Human
uggccuggcuguggaggg

SEQ ID NO: 522682 - RNA, 17 nt, Human
uggccuggcuucagggg

SEQ ID NO: 522683 - RNA, 32 nt, Human
uggccuggcuuccuggcguagccagcaaguuc

SEQ ID NO: 522684 - RNA, 32 nt, Human
uggccugggaaagaaggggaagaaacaauugc

SEQ ID NO: 522685 - RNA, 21 nt, Human
uggccugggaacucaggggga

SEQ ID NO: 522686 - RNA, 32 nt, Human
uggccugggacugcuguggcagaggaagcaug

SEQ ID NO: 522687 - RNA, 32 nt, Human
uggccugggagcugcuuucuccccacuggcug

SEQ ID NO: 522688 - RNA, 32 nt, Human
uggccugggaggcagggccugggcagggcuuc

SEQ ID NO: 522689 - RNA, 32 nt, Human
uggccugggaggccagaaugaaguggguauua

SEQ ID NO: 522690 - RNA, 32 nt, Human
uggccugggaggcgggggccggcgggagccaa

SEQ ID NO: 522691 - RNA, 32 nt, Human
uggccugggagggagaaggggcuggagagggc

SEQ ID NO: 522692 - RNA, 32 nt, Human
uggccugggagguccaggcugcaaugagccaa

SEQ ID NO: 522693 - RNA, 21 nt, Human
uggccugggaucucagaggga

SEQ ID NO: 522694 - RNA, 32 nt, Human
uggccugggauuggcugugaggucccuccgca

SEQ ID NO: 522695 - RNA, 21 nt, Human
uggccugggcaacagagcaag

SEQ ID NO: 522696 - RNA, 22 nt, Human
uggccugggcgacagagcgaga

SEQ ID NO: 522697 - RNA, 32 nt, Human
uggccugggcgagccaggucugaggccccgcu

SEQ ID NO: 522698 - RNA, 32 nt, Human
uggccugggcucccgcagcccacccugaccgg

SEQ ID NO: 522699 - RNA, 32 nt, Human
uggccugggcucucccagccucccagcccucu

SEQ ID NO: 522700 - RNA, 17 nt, Human
uggccuggggaaggagg

SEQ ID NO: 522701 - RNA, 18 nt, Human
uggccuggggaaguggga

SEQ ID NO: 522702 - RNA, 32 nt, Human
uggccuggggagcccugagauugccuggccag

SEQ ID NO: 522703 - RNA, 19 nt, Human
uggccuggggcccaggagg

SEQ ID NO: 522704 - RNA, 32 nt, Human
uggccuggggcuggaggcccugguagagcugc

SEQ ID NO: 522705 - RNA, 19 nt, Human
uggccugggggaaggagga

SEQ ID NO: 522706 - RNA, 19 nt, Human
uggccugggggaaggcaga

SEQ ID NO: 522707 - RNA, 32 nt, Human
uggccugggggagaaugcuggagggagcacgc

SEQ ID NO: 522708 - RNA, 32 nt, Human
uggccugggggcggggacagagacggagaccu

SEQ ID NO: 522709 - RNA, 23 nt, Human
uggccuggggucgggcaggggga

SEQ ID NO: 522710 - RNA, 32 nt, Human
uggccuggggucucuucuuugcuggacacagc

SEQ ID NO: 522711 - RNA, 19 nt, Human
uggccuggguccagggaga

SEQ ID NO: 522712 - RNA, 20 nt, Human
uggccugggugccaggagga

SEQ ID NO: 522713 - RNA, 32 nt, Human
uggccuggguggagcagucauccucccccuuc

SEQ ID NO: 522714 - RNA, 21 nt, Human
uggccugggugugcagggagg

SEQ ID NO: 522715 - RNA, 17 nt, Human
uggccuggucccagggg

SEQ ID NO: 522716 - RNA, 32 nt, Human
uggccuggucccccggccccugccccaucucc

SEQ ID NO: 522717 - RNA, 19 nt, Human
uggccugguccucuggaca

SEQ ID NO: 522718 - RNA, 20 nt, Human
uggccuggugacucucaggg

SEQ ID NO: 522719 - RNA, 32 nt, Human
uggccuggugagccccuccaccuuccaggcuu

SEQ ID NO: 522720 - RNA, 32 nt, Human
uggccuggugaguggagguagaaaaaugauga

SEQ ID NO: 522721 - RNA, 17 nt, Human
uggccuggugcacaggg

SEQ ID NO: 522722 - RNA, 20 nt, Human
uggccuggugccagcuggga

SEQ ID NO: 522723 - RNA, 32 nt, Human
uggccuggugcucugggcucugccuucugguu

SEQ ID NO: 522724 - RNA, 19 nt, Human
uggccuggugcugggguga

SEQ ID NO: 522725 - RNA, 19 nt, Human
uggccuggugggaccaggg

SEQ ID NO: 522726 - RNA, 18 nt, Human
uggccuggugggcggagg

SEQ ID NO: 522727 - RNA, 18 nt, Human
uggccuggugggggugga

SEQ ID NO: 522728 - RNA, 21 nt, Human
uggccugguguuuagguggga

SEQ ID NO: 522729 - RNA, 18 nt, Human
uggccugguuuuggggga

SEQ ID NO: 522730 - RNA, 32 nt, Human
uggccuguacuuccucuggcccuggcugaaga

SEQ ID NO: 522731 - RNA, 32 nt, Human
uggccuguagcagacacugaaccaccagccag

SEQ ID NO: 522732 - RNA, 20 nt, Human
uggccuguaugaccuccaca

SEQ ID NO: 522733 - RNA, 32 nt, Human
uggccuguccccaucuuucugugacaucacaa

SEQ ID NO: 522734 - RNA, 32 nt, Human
uggccugucgcucucacuugucuuccagcggg

SEQ ID NO: 522735 - RNA, 22 nt, Human
uggccugucucggcucacugca

SEQ ID NO: 522736 - RNA, 32 nt, Human
uggccugucugccuguucugggagggcuguga

SEQ ID NO: 522737 - RNA, 32 nt, Human
uggccugucuuuccuucaagcagaccagagag

SEQ ID NO: 522738 - RNA, 32 nt, Human
uggccugugagucuccccuugcagccugguca

SEQ ID NO: 522739 - RNA, 32 nt, Human
uggccugugauggauggauguucuguggugaa

SEQ ID NO: 522740 - RNA, 32 nt, Human
uggccugugcauuuccuuccucuccucuuccc

SEQ ID NO: 522741 - RNA, 21 nt, Human
uggccugugccuauaguccca

SEQ ID NO: 522742 - RNA, 21 nt, Human
uggccugugccuguaaaccca

SEQ ID NO: 522743 - RNA, 24 nt, Human
uggccugugccuguaaacccagcu

SEQ ID NO: 522744 - RNA, 32 nt, Human
uggccugugcugcugucacggugcuaaggggc

SEQ ID NO: 522745 - RNA, 32 nt, Human
uggccuguggcacagcccugagugucccaagc

SEQ ID NO: 522746 - RNA, 17 nt, Human
uggccuguggcccgagg

SEQ ID NO: 522747 - RNA, 19 nt, Human
uggccuguggccuggggga

SEQ ID NO: 522748 - RNA, 32 nt, Human
uggccuguuaggaaccaggcuacagagcagga

SEQ ID NO: 522749 - RNA, 32 nt, Human
uggccuguuccgggacacucugggcagggccc

SEQ ID NO: 522750 - RNA, 32 nt, Human
uggccuguuggaggcaaauagaucagauuuuu

SEQ ID NO: 522751 - RNA, 32 nt, Human
uggccuguuuaucacuggcucugugauacaug

SEQ ID NO: 522752 - RNA, 32 nt, Human
uggccuguuugcagccucuccuagccacagac

SEQ ID NO: 522753 - RNA, 21 nt, Human
uggccuuaagugauccuccca

SEQ ID NO: 522754 - RNA, 26 nt, Human
uggccuuaagugauccucccaccuca

SEQ ID NO: 522755 - RNA, 24 nt, Human
uggccuuaauaauccauccuuuca

SEQ ID NO: 522756 - RNA, 19 nt, Human
uggccuuacagaaagggaa

SEQ ID NO: 522757 - RNA, 32 nt, Human
uggccuuacccccagcccuggcucagcaucua

SEQ ID NO: 522758 - RNA, 32 nt, Human
uggccuuacgauggcaauuggcaucauucucc

SEQ ID NO: 522759 - RNA, 21 nt, Human
uggccuuacucuccucugaca

SEQ ID NO: 522760 - RNA, 32 nt, Human
uggccuuagaaaauaaauugccucuaacuuac

SEQ ID NO: 522761 - RNA, 32 nt, Human
uggccuuagaaccacccgcucucucuuccuuu

SEQ ID NO: 522762 - RNA, 17 nt, Human
uggccuuaucuguucca

SEQ ID NO: 522763 - RNA, 32 nt, Human
uggccuuaugguagaaaauuuuauaccagauu

SEQ ID NO: 522764 - RNA, 32 nt, Human
uggccuuaugucaguugucuacucuggagcuu

SEQ ID NO: 522765 - RNA, 25 nt, Human
uggccuuaugugauccgcccaccuu

SEQ ID NO: 522766 - RNA, 19 nt, Human
uggccuuauuuccauucca

SEQ ID NO: 522767 - RNA, 32 nt, Human
uggccuuauuugggagauucuauacugaccuu

SEQ ID NO: 522768 - RNA, 25 nt, Human
uggccuucaagauccaucgaccuua

SEQ ID NO: 522769 - RNA, 32 nt, Human
uggccuucaccauggcgggagggagaccgcau

SEQ ID NO: 522770 - RNA, 32 nt, Human
uggccuucaccccgggccucuuaacuucaggu

SEQ ID NO: 522771 - RNA, 32 nt, Human
uggccuucagcaauccucccaccucaaccucc

SEQ ID NO: 522772 - RNA, 32 nt, Human
uggccuucagcccucacagaugcccagccuca

SEQ ID NO: 522773 - RNA, 22 nt, Human
uggccuucauggcgcgcuccag

SEQ ID NO: 522774 - RNA, 32 nt, Human
uggccuuccaagugcuaggauuacaggcguga

SEQ ID NO: 522775 - RNA, 23 nt, Human
uggccuuccacgucuuccuccaa

SEQ ID NO: 522776 - RNA, 21 nt, Human
uggccuuccccuccucugcca

SEQ ID NO: 522777 - RNA, 21 nt, Human
uggccuuccgugcccgcucca

SEQ ID NO: 522778 - RNA, 24 nt, Human
uggccuuccuccccauuccugcca

SEQ ID NO: 522779 - RNA, 32 nt, Human
uggccuuccucuucuuucucuuucccucugcc

SEQ ID NO: 522780 - RNA, 32 nt, Human
uggccuuccuguucuucacucccuucagccac

SEQ ID NO: 522781 - RNA, 32 nt, Human
uggccuuccuuucaauaaagcugccucagcuu

SEQ ID NO: 522782 - RNA, 32 nt, Human
uggccuuccuuuccucuuuccuccucacucuc

SEQ ID NO: 522783 - RNA, 19 nt, Human
uggccuucgggguccccac

SEQ ID NO: 522784 - RNA, 24 nt, Human
uggccuucgugaacuuugcuccaa

SEQ ID NO: 522785 - RNA, 24 nt, Human
uggccuucguggucacuugcuuca

SEQ ID NO: 522786 - RNA, 22 nt, Human
uggccuucuaggaucuguccaa

SEQ ID NO: 522787 - RNA, 32 nt, Human
uggccuucucaggacuccuggguggcacagca

SEQ ID NO: 522788 - RNA, 32 nt, Human
uggccuucucuccuggucccuggugcuguuug

SEQ ID NO: 522789 - RNA, 32 nt, Human
uggccuucuggacccuggcuucuccccacugu

SEQ ID NO: 522790 - RNA, 32 nt, Human
uggccuucuuuguguacaugacaugcauucuc

SEQ ID NO: 522791 - RNA, 32 nt, Human
uggccuugaacaaaaccaaguccacuggggac

SEQ ID NO: 522792 - RNA, 32 nt, Human
uggccuugaaccccuugccucaagugagcuuc

SEQ ID NO: 522793 - RNA, 20 nt, Human
uggccuugaauccaccucuu

SEQ ID NO: 522794 - RNA, 19 nt, Human
uggccuugaggccuuugca

SEQ ID NO: 522795 - RNA, 21 nt, Human
uggccuugaggccuuugcaca

SEQ ID NO: 522796 - RNA, 32 nt, Human
uggccuugagggaggggugcagguguggcucc

SEQ ID NO: 522797 - RNA, 22 nt, Human
uggccuugauccuccugccuua

SEQ ID NO: 522798 - RNA, 18 nt, Human
uggccuugaucucuccau

SEQ ID NO: 522799 - RNA, 32 nt, Human
uggccuugcaaugcuuuguggcauuuucaaug

SEQ ID NO: 522800 - RNA, 24 nt, Human
uggccuugcacacacacccaccca

SEQ ID NO: 522801 - RNA, 32 nt, Human
uggccuugcacugugaggugggggagguggga

SEQ ID NO: 522802 - RNA, 21 nt, Human
uggccuugccccaggcccugc

SEQ ID NO: 522803 - RNA, 21 nt, Human
uggccuugcccccgugagcua

SEQ ID NO: 522804 - RNA, 20 nt, Human
uggccuugccccugcccgcc

SEQ ID NO: 522805 - RNA, 24 nt, Human
uggccuugccccugcccgccuaca

SEQ ID NO: 522806 - RNA, 21 nt, Human
uggccuugcccgccagccuca

SEQ ID NO: 522807 - RNA, 24 nt, Human
uggccuugccuccccuuccugcca

SEQ ID NO: 522808 - RNA, 32 nt, Human
uggccuugccuccccuuccugccacgugcccc

SEQ ID NO: 522809 - RNA, 23 nt, Human
uggccuugcugaaacgcaucuca

SEQ ID NO: 522810 - RNA, 32 nt, Human
uggccuugcuggcagguucugccuccucucug

SEQ ID NO: 522811 - RNA, 32 nt, Human
uggccuugcuggggccccuccugccuccacgc

SEQ ID NO: 522812 - RNA, 32 nt, Human
uggccuuggaagggaugagcaaacggaagaga

SEQ ID NO: 522813 - RNA, 20 nt, Human
uggccuuggccacccacuuc

SEQ ID NO: 522814 - RNA, 32 nt, Human
uggccuuggcccugcuacucacccaacauucc

SEQ ID NO: 522815 - RNA, 32 nt, Human
uggccuugggcaacuuccuuaaccucacucaa

SEQ ID NO: 522816 - RNA, 23 nt, Human
uggccuugggcugcucgaucuca

SEQ ID NO: 522817 - RNA, 23 nt, Human
uggccuuggugaucacuuuuuca

SEQ ID NO: 522818 - RNA, 17 nt, Human
uggccuugguuugcaca

SEQ ID NO: 522819 - RNA, 21 nt, Human
uggccuuguaucuugcauuca

SEQ ID NO: 522820 - RNA, 32 nt, Human
uggccuuguccacuccuugaggcagauccugg

SEQ ID NO: 522821 - RNA, 32 nt, Human
uggccuugugccagggcugucugugauccgcc

SEQ ID NO: 522822 - RNA, 24 nt, Human
uggccuuguggagacaacgccuua

SEQ ID NO: 522823 - RNA, 24 nt, Human
uggccuuguggcagcacauccuca

SEQ ID NO: 522824 - RNA, 32 nt, Human
uggccuuguggcuucaugaauggagcugcugu

SEQ ID NO: 522825 - RNA, 32 nt, Human
uggccuuguuugcuuaguuuaucuggaauucu

SEQ ID NO: 522826 - RNA, 32 nt, Human
uggccuuuaaccugcagcguccugggucucuu

SEQ ID NO: 522827 - RNA, 32 nt, Human
uggccuuuagacuuugccauccuuaaggagug

SEQ ID NO: 522828 - RNA, 32 nt, Human
uggccuuuauugccuugugggccuggagauuc

SEQ ID NO: 522829 - RNA, 32 nt, Human
uggccuuucacuccaguucugggugaggcagg

SEQ ID NO: 522830 - RNA, 32 nt, Human
uggccuuuccucaguguuguaaggccuaugcc

SEQ ID NO: 522831 - RNA, 32 nt, Human
uggccuuucuguuccuuggacaugccuggaga

SEQ ID NO: 522832 - RNA, 32 nt, Human
uggccuuucuuccucugggcaaagaagggcuu

SEQ ID NO: 522833 - RNA, 32 nt, Human
uggccuuucuuucugcugagugguucacugug

SEQ ID NO: 522834 - RNA, 32 nt, Human
uggccuuugacucaugaggccuggagaaaagu

SEQ ID NO: 522835 - RNA, 32 nt, Human
uggccuuugagagagucucacucuccagcuag

SEQ ID NO: 522836 - RNA, 32 nt, Human
uggccuuugcacuugcggcagcaacguguacu

SEQ ID NO: 522837 - RNA, 32 nt, Human
uggccuuugcagaagcugaugguuacagagcu

SEQ ID NO: 522838 - RNA, 32 nt, Human
uggccuuuggagauugcgugugguguucagga

SEQ ID NO: 522839 - RNA, 24 nt, Human
uggccuuugggaacuuugcuccaa

SEQ ID NO: 522840 - RNA, 32 nt, Human
uggccuuuggucagcguuuccacauccugcuc

SEQ ID NO: 522841 - RNA, 32 nt, Human
uggccuuuggugaccucaccacucccucccac

SEQ ID NO: 522842 - RNA, 32 nt, Human
uggccuuuguaggcaguggaaaacuugcaagg

SEQ ID NO: 522843 - RNA, 25 nt, Human
uggccuuuuaauuccuccucugcca

SEQ ID NO: 522844 - RNA, 32 nt, Human
uggccuuuuaauuccuccucugccaggguggg

SEQ ID NO: 522845 - RNA, 32 nt, Human
uggccuuuugagacagggccucacucuguucc

SEQ ID NO: 522846 - RNA, 32 nt, Human
uggccuuuugcgaggugcugcagccauagcua

SEQ ID NO: 522847 - RNA, 32 nt, Human
uggccuuuuggaaauccaaauugccugaacau

SEQ ID NO: 522848 - RNA, 19 nt, Human
uggccuuuuuccucacaca

SEQ ID NO: 522849 - RNA, 23 nt, Human
uggcgaaaucucagcucacugca

SEQ ID NO: 522850 - RNA, 17 nt, Human
uggcgaacaaauguaaa

SEQ ID NO: 522851 - RNA, 32 nt, Human
uggcgaacauggugaaaccccaucucuacuaa

SEQ ID NO: 522852 - RNA, 32 nt, Human
uggcgaacauggugagacccaucucuacuaaa

SEQ ID NO: 522853 - RNA, 32 nt, Human
uggcgaagcaccuguccauguguuuggccaaa

SEQ ID NO: 522854 - RNA, 32 nt, Human
uggcgaaggagaggacaccgccagugguccaa

SEQ ID NO: 522855 - RNA, 32 nt, Human
uggcgaagggguggccucggaggcaggcucug

SEQ ID NO: 522856 - RNA, 24 nt, Human
uggcgaaugccuguaaucucagcu

SEQ ID NO: 522857 - RNA, 32 nt, Human
uggcgacacaggcacccagcuuugggguggug

SEQ ID NO: 522858 - RNA, 32 nt, Human
uggcgacacugcacugcaggcugggcuacaaa

SEQ ID NO: 522859 - RNA, 32 nt, Human
uggcgaccucaccuucauucuuaggucaauac

SEQ ID NO: 522860 - RNA, 32 nt, Human
uggcgacugcagcugcaccaucacacaugcau

SEQ ID NO: 522861 - RNA, 32 nt, Human
uggcgagaucacagcucacugcagccuugaac

SEQ ID NO: 522862 - RNA, 23 nt, Human
uggcgagaucacggcucacugca

SEQ ID NO: 522863 - RNA, 24 nt, Human
uggcgagaucauagcucacugcag

SEQ ID NO: 522864 - RNA, 32 nt, Human
uggcgagaucauagcucacugcagccucaaac

SEQ ID NO: 522865 - RNA, 23 nt, Human
uggcgagaucucagcucacugca

SEQ ID NO: 522866 - RNA, 32 nt, Human
uggcgagcauccuggccaacauggugaaaccc

SEQ ID NO: 522867 - RNA, 32 nt, Human
uggcgagccacuguuugccguuugaucgggca

SEQ ID NO: 522868 - RNA, 32 nt, Human
uggcgagccaguacccgugaaugcuacuuccu

SEQ ID NO: 522869 - RNA, 21 nt, Human
uggcgagcgccuguaguccca

SEQ ID NO: 522870 - RNA, 24 nt, Human
uggcgagcgccuguagucccagcu

SEQ ID NO: 522871 - RNA, 32 nt, Human
uggcgagcuguggcucggggucugccacgaau

SEQ ID NO: 522872 - RNA, 32 nt, Human
uggcgagcuguggcucggggucugccaugaau

SEQ ID NO: 522873 - RNA, 32 nt, Human
uggcgaggacaucgggacggaggcagacgugg

SEQ ID NO: 522874 - RNA, 32 nt, Human
uggcgaggagcugcugcgcuuccuucacaugc

SEQ ID NO: 522875 - RNA, 22 nt, Human
uggcgaggccccuuggggccac

SEQ ID NO: 522876 - RNA, 32 nt, Human
uggcgaggccggcccagcacagcaagcagcag

SEQ ID NO: 522877 - RNA, 32 nt, Human
uggcgaggcugcugggguugcagcgggacagu

SEQ ID NO: 522878 - RNA, 32 nt, Human
uggcgagggcugcccuggaggcuccggcucgg

SEQ ID NO: 522879 - RNA, 32 nt, Human
uggcgaggguuaugaacccaguguagagacca

SEQ ID NO: 522880 - RNA, 32 nt, Human
uggcgaguccccgcuaccacacggugggccgc

SEQ ID NO: 522881 - RNA, 32 nt, Human
uggcgagucggaggcaggguggggcccaggua

SEQ ID NO: 522882 - RNA, 32 nt, Human
uggcgagugaguggagagccagcucugcggag

SEQ ID NO: 522883 - RNA, 32 nt, Human
uggcgagugaguugagagccagcucugcgggg

SEQ ID NO: 522884 - RNA, 32 nt, Human
uggcgaguggugcugaagggacagcuccagca

SEQ ID NO: 522885 - RNA, 21 nt, Human
uggcgagugucuguaauccca

SEQ ID NO: 522886 - RNA, 32 nt, Human
uggcgaucauuucccaagauugguuucccuug

SEQ ID NO: 522887 - RNA, 32 nt, Human
uggcgaugacaucagagauuccgaccuuccug

SEQ ID NO: 522888 - RNA, 32 nt, Human
uggcgcaaacauggcucacugcagccucaacc

SEQ ID NO: 522889 - RNA, 22 nt, Human
uggcgcaaccagcucacugcag

SEQ ID NO: 522890 - RNA, 23 nt, Human
uggcgcaaccucggcucacugca

SEQ ID NO: 522891 - RNA, 23 nt, Human
uggcgcaaccuuggcucacugca

SEQ ID NO: 522892 - RNA, 21 nt, Human
uggcgcaagccuguaauccca

SEQ ID NO: 522893 - RNA, 32 nt, Human
uggcgcaagccuguaaucccagcuauuuggga

SEQ ID NO: 522894 - RNA, 21 nt, Human
uggcgcaagccuguaguccca

SEQ ID NO: 522895 - RNA, 23 nt, Human
uggcgcaaucucagcucacugca

SEQ ID NO: 522896 - RNA, 32 nt, Human
uggcgcaaucuccacucacugcagccuccgcc

SEQ ID NO: 522897 - RNA, 23 nt, Human
uggcgcaaucucggcucacugca

SEQ ID NO: 522898 - RNA, 23 nt, Human
uggcgcaaucucggcucacugua

SEQ ID NO: 522899 - RNA, 23 nt, Human
uggcgcaaucugggcucacugca

SEQ ID NO: 522900 - RNA, 23 nt, Human
uggcgcaaucuuggcucacuaca

SEQ ID NO: 522901 - RNA, 23 nt, Human
uggcgcaaucuuggcucacugca

SEQ ID NO: 522902 - RNA, 23 nt, Human
uggcgcaauuucagcucacugca

SEQ ID NO: 522903 - RNA, 23 nt, Human
uggcgcaauuucggcucacugca

SEQ ID NO: 522904 - RNA, 23 nt, Human
uggcgcaauuuuggcucacugca

SEQ ID NO: 522905 - RNA, 21 nt, Human
uggcgcacaccuauaaucuca

SEQ ID NO: 522906 - RNA, 21 nt, Human
uggcgcacaccuguaauccca

SEQ ID NO: 522907 - RNA, 24 nt, Human
uggcgcacaccuguaaucccagcu

SEQ ID NO: 522908 - RNA, 21 nt, Human
uggcgcacaccuguaauccua

SEQ ID NO: 522909 - RNA, 24 nt, Human
uggcgcacaccuguaauccuagcu

SEQ ID NO: 522910 - RNA, 21 nt, Human
uggcgcacaccuguaaucuca

SEQ ID NO: 522911 - RNA, 24 nt, Human
uggcgcacaccuguaaucucagcu

SEQ ID NO: 522912 - RNA, 21 nt, Human
uggcgcacaccuguaguccca

SEQ ID NO: 522913 - RNA, 24 nt, Human
uggcgcacaccuguagucccagcu

SEQ ID NO: 522914 - RNA, 32 nt, Human
uggcgcaccagccucugcaacuagugaggucu

SEQ ID NO: 522915 - RNA, 21 nt, Human
uggcgcaccccuguaaucuca

SEQ ID NO: 522916 - RNA, 24 nt, Human
uggcgcaccccuguaaucucagcu

SEQ ID NO: 522917 - RNA, 21 nt, Human
uggcgcacgccucuaauccca

SEQ ID NO: 522918 - RNA, 21 nt, Human
uggcgcacgccuguaauccca

SEQ ID NO: 522919 - RNA, 24 nt, Human
uggcgcacgccuguaaucccagcu

SEQ ID NO: 522920 - RNA, 21 nt, Human
uggcgcacgccuguaaucuca

SEQ ID NO: 522921 - RNA, 24 nt, Human
uggcgcacgccuguaaucucagcu

SEQ ID NO: 522922 - RNA, 32 nt, Human
uggcgcacgccuguaaugccagcuacuuggga

SEQ ID NO: 522923 - RNA, 21 nt, Human
uggcgcacgccuguaguccca

SEQ ID NO: 522924 - RNA, 24 nt, Human
uggcgcacgccuguagucccagcu

SEQ ID NO: 522925 - RNA, 24 nt, Human
uggcgcacgccuguaguuccagcu

SEQ ID NO: 522926 - RNA, 21 nt, Human
uggcgcacuacuauaauccca

SEQ ID NO: 522927 - RNA, 32 nt, Human
uggcgcaggagucccuggcuugcaguguuucu

SEQ ID NO: 522928 - RNA, 32 nt, Human
uggcgcagggccacuuggcugcagagaacgug

SEQ ID NO: 522929 - RNA, 23 nt, Human
uggcgcaguggcucacgccugua

SEQ ID NO: 522930 - RNA, 32 nt, Human
uggcgcaguguuucagcaucuaggggucaaaa

SEQ ID NO: 522931 - RNA, 21 nt, Human
uggcgcauaccuguaauccca

SEQ ID NO: 522932 - RNA, 24 nt, Human
uggcgcauaccuguaaucccagcu

SEQ ID NO: 522933 - RNA, 32 nt, Human
uggcgcauaccuguaaucccagcuacuuggga

SEQ ID NO: 522934 - RNA, 21 nt, Human
uggcgcauaccuguaauucca

SEQ ID NO: 522935 - RNA, 24 nt, Human
uggcgcauaccuguaauuccagcu

SEQ ID NO: 522936 - RNA, 21 nt, Human
uggcgcauaccuguaguccca

SEQ ID NO: 522937 - RNA, 24 nt, Human
uggcgcauaccuguagucccagcu

SEQ ID NO: 522938 - RNA, 32 nt, Human
uggcgcaucccuguaaucccagcuacuuuacu

SEQ ID NO: 522939 - RNA, 32 nt, Human
uggcgcaucucuagauccuuucccggaguuca

SEQ ID NO: 522940 - RNA, 21 nt, Human
uggcgcaugccuauaauccca

SEQ ID NO: 522941 - RNA, 21 nt, Human
uggcgcaugccuauaguccca

SEQ ID NO: 522942 - RNA, 21 nt, Human
uggcgcaugccuguaacccca

SEQ ID NO: 522943 - RNA, 24 nt, Human
uggcgcaugccuguaaccccagcu

SEQ ID NO: 522944 - RNA, 21 nt, Human
uggcgcaugccuguaauccca

SEQ ID NO: 522945 - RNA, 24 nt, Human
uggcgcaugccuguaaucccaacu

SEQ ID NO: 522946 - RNA, 32 nt, Human
uggcgcaugccuguaaucccagaacuuuggga

SEQ ID NO: 522947 - RNA, 23 nt, Human
uggcgcaugccuguaaucccagc

SEQ ID NO: 522948 - RNA, 32 nt, Human
uggcgcaugccuguaaucccagcacuuuggga

SEQ ID NO: 522949 - RNA, 24 nt, Human
uggcgcaugccuguaaucccagcu

SEQ ID NO: 522950 - RNA, 32 nt, Human
uggcgcaugccuguaaucccagcuacuagaga

SEQ ID NO: 522951 - RNA, 32 nt, Human
uggcgcaugccuguaaucccagcuacucagga

SEQ ID NO: 522952 - RNA, 32 nt, Human
uggcgcaugccuguaaucccagcuacucggga

SEQ ID NO: 522953 - RNA, 32 nt, Human
uggcgcaugccuguaaucccagcuacugggaa

SEQ ID NO: 522954 - RNA, 32 nt, Human
uggcgcaugccuguaaucccagcuacuuagga

SEQ ID NO: 522955 - RNA, 32 nt, Human
uggcgcaugccuguaaucccagcuacuuggga

SEQ ID NO: 522956 - RNA, 32 nt, Human
uggcgcaugccuguaaucccagcugcuuggga

SEQ ID NO: 522957 - RNA, 24 nt, Human
uggcgcaugccuguaaucccaguu

SEQ ID NO: 522958 - RNA, 32 nt, Human
uggcgcaugccuguaaucccaguuacucagga

SEQ ID NO: 522959 - RNA, 21 nt, Human
uggcgcaugccuguaauccua

SEQ ID NO: 522960 - RNA, 24 nt, Human
uggcgcaugccuguaauccuagcu

SEQ ID NO: 522961 - RNA, 32 nt, Human
uggcgcaugccuguaauccuagcuacucagga

SEQ ID NO: 522962 - RNA, 32 nt, Human
uggcgcaugccuguaauccuagcuacucggga

SEQ ID NO: 522963 - RNA, 21 nt, Human
uggcgcaugccuguaaucuca

SEQ ID NO: 522964 - RNA, 24 nt, Human
uggcgcaugccuguaaucucagcu

SEQ ID NO: 522965 - RNA, 32 nt, Human
uggcgcaugccuguaaucucagcuacucagga

SEQ ID NO: 522966 - RNA, 21 nt, Human
uggcgcaugccuguaauucca

SEQ ID NO: 522967 - RNA, 24 nt, Human
uggcgcaugccuguaauuccagcu

SEQ ID NO: 522968 - RNA, 21 nt, Human
uggcgcaugccuguaguccca

SEQ ID NO: 522969 - RNA, 24 nt, Human
uggcgcaugccuguagucccaacu

SEQ ID NO: 522970 - RNA, 24 nt, Human
uggcgcaugccuguagucccagcu

SEQ ID NO: 522971 - RNA, 32 nt, Human
uggcgcaugccuguagucccagcuaacuggga

SEQ ID NO: 522972 - RNA, 32 nt, Human
uggcgcaugccuguagucccagcuacuuggga

SEQ ID NO: 522973 - RNA, 32 nt, Human
uggcgcaugccuguagucccagguacucagga

SEQ ID NO: 522974 - RNA, 32 nt, Human
uggcgcaugccuguagucgcagcuacucgcga

SEQ ID NO: 522975 - RNA, 24 nt, Human
uggcgcaugccuguaguuccagcu

SEQ ID NO: 522976 - RNA, 32 nt, Human
uggcgcaugccuguaguuccagcuacucagga

SEQ ID NO: 522977 - RNA, 32 nt, Human
uggcgcaugccuguaguuccagcuacuuguga

SEQ ID NO: 522978 - RNA, 21 nt, Human
uggcgcaugccugugauccca

SEQ ID NO: 522979 - RNA, 24 nt, Human
uggcgcaugccugugaucccagcu

SEQ ID NO: 522980 - RNA, 32 nt, Human
uggcgcaugccugugaucccagcuacuugaga

SEQ ID NO: 522981 - RNA, 21 nt, Human
uggcgcaugcuuguaauccca

SEQ ID NO: 522982 - RNA, 24 nt, Human
uggcgcaugcuuguaaucccagcu

SEQ ID NO: 522983 - RNA, 32 nt, Human
uggcgcauguccugugcuuuguggacgcugcu

SEQ ID NO: 522984 - RNA, 21 nt, Human
uggcgcaugucuguaauccca

SEQ ID NO: 522985 - RNA, 24 nt, Human
uggcgcaugucuguaaucccagcu

SEQ ID NO: 522986 - RNA, 23 nt, Human
uggcgcauucuaggcucacugca

SEQ ID NO: 522987 - RNA, 22 nt, Human
uggcgcauugccuguaauccca

SEQ ID NO: 522988 - RNA, 32 nt, Human
uggcgccaacaacuucuccauccuuucugccu

SEQ ID NO: 522989 - RNA, 32 nt, Human
uggcgccacuacacuccagccugggcaacaga

SEQ ID NO: 522990 - RNA, 32 nt, Human
uggcgccacuacacuccagccugggcgacaga

SEQ ID NO: 522991 - RNA, 32 nt, Human
uggcgccacugcacuccagcccgggcgacaga

SEQ ID NO: 522992 - RNA, 32 nt, Human
uggcgccacugcacuccagccuaggcaacaga

SEQ ID NO: 522993 - RNA, 32 nt, Human
uggcgccacugcacuccagccugagugacaga

SEQ ID NO: 522994 - RNA, 32 nt, Human
uggcgccacugcacuccagccugggcgacaga

SEQ ID NO: 522995 - RNA, 32 nt, Human
uggcgccacugcacuccagccugggcgucaga

SEQ ID NO: 522996 - RNA, 32 nt, Human
uggcgccacugcacuccagccuggguaacaga

SEQ ID NO: 522997 - RNA, 32 nt, Human
uggcgccacugcacuccagccugggugacaga

SEQ ID NO: 522998 - RNA, 32 nt, Human
uggcgccacugcacuccagccugggugagaga

SEQ ID NO: 522999 - RNA, 32 nt, Human
uggcgccacugcacuccagucugggcaacaga

SEQ ID NO: 523000 - RNA, 32 nt, Human
uggcgccacugcacuccagucugggcgauaga

SEQ ID NO: 523001 - RNA, 32 nt, Human
uggcgccacugcacucccgucugggggagaga

SEQ ID NO: 523002 - RNA, 32 nt, Human
uggcgccacugcacuucagccuuggagacagg

SEQ ID NO: 523003 - RNA, 20 nt, Human
uggcgccacugcauuccagc

SEQ ID NO: 523004 - RNA, 32 nt, Human
uggcgccacugcauuccagccugggcaacaga

SEQ ID NO: 523005 - RNA, 32 nt, Human
uggcgccacugcgcuccagccugggcaacaga

SEQ ID NO: 523006 - RNA, 32 nt, Human
uggcgccacuucacugcagccuggguggcaga

SEQ ID NO: 523007 - RNA, 32 nt, Human
uggcgccagcagguggagcuugacgugacguc

SEQ ID NO: 523008 - RNA, 23 nt, Human
uggcgccaucucggcucacugca

SEQ ID NO: 523009 - RNA, 23 nt, Human
uggcgccaucuuggcucacugca

SEQ ID NO: 523010 - RNA, 23 nt, Human
uggcgccaucuuggcucacugua

SEQ ID NO: 523011 - RNA, 32 nt, Human
uggcgccauugcacuccagccugggcaaaaag

SEQ ID NO: 523012 - RNA, 32 nt, Human
uggcgccauugcacuccagccugggugacaag

SEQ ID NO: 523013 - RNA, 32 nt, Human
uggcgccauuucacuccagccugggcgacaga

SEQ ID NO: 523014 - RNA, 32 nt, Human
uggcgcccaaagccuccagccugagagucgcc

SEQ ID NO: 523015 - RNA, 21 nt, Human
uggcgcccaccuguaauccua

SEQ ID NO: 523016 - RNA, 24 nt, Human
uggcgcccaccuguaauccuagcu

SEQ ID NO: 523017 - RNA, 24 nt, Human
uggcgcccaggcuggaguacagug

SEQ ID NO: 523018 - RNA, 24 nt, Human
uggcgcccaggcuggagugcagug

SEQ ID NO: 523019 - RNA, 32 nt, Human
uggcgccccacccagucucauccgggggacuu

SEQ ID NO: 523020 - RNA, 32 nt, Human
uggcgcccccuggagggaggaaggggaacugc

SEQ ID NO: 523021 - RNA, 32 nt, Human
uggcgcccccuggagggaggaaggggaacugu

SEQ ID NO: 523022 - RNA, 32 nt, Human
uggcgccccgugccaugcgggagcgcuggggc

SEQ ID NO: 523023 - RNA, 32 nt, Human
uggcgccccucacucagauucuccccugggcu

SEQ ID NO: 523024 - RNA, 32 nt, Human
uggcgcccgaggagaacgcugggaccuaacuc

SEQ ID NO: 523025 - RNA, 32 nt, Human
uggcgcccguaaucccagcuacuaaggcugga

SEQ ID NO: 523026 - RNA, 32 nt, Human
uggcgccggcgcugccuuucgguugccaaaau

SEQ ID NO: 523027 - RNA, 29 nt, Human
uggcgccgggcagcuucauccccuccccc

SEQ ID NO: 523028 - RNA, 32 nt, Human
uggcgccgucgggggcaaggguggcucggggg

SEQ ID NO: 523029 - RNA, 24 nt, Human
uggcgccgucucggcucacuacag

SEQ ID NO: 523030 - RNA, 32 nt, Human
uggcgccuauagucccagcuacuugggaggcu

SEQ ID NO: 523031 - RNA, 32 nt, Human
uggcgccuccacccacccuccugccucacccc

SEQ ID NO: 523032 - RNA, 19 nt, Human
uggcgccugaggcaacaca

SEQ ID NO: 523033 - RNA, 32 nt, Human
uggcgccugccagaaaaauuuggggcuaggca

SEQ ID NO: 523034 - RNA, 32 nt, Human
uggcgccugccugcccaucucugcccucgguu

SEQ ID NO: 523035 - RNA, 21 nt, Human
uggcgccugccuguaauccca

SEQ ID NO: 523036 - RNA, 24 nt, Human
uggcgccugccuguaaucccagcu

SEQ ID NO: 523037 - RNA, 32 nt, Human
uggcgccugccuguaaucccagcuacuaagga

SEQ ID NO: 523038 - RNA, 32 nt, Human
uggcgccuguaaucccagcuacucaggagguu

SEQ ID NO: 523039 - RNA, 32 nt, Human
uggcgccuguaaucccagcuacucgggaggcu

SEQ ID NO: 523040 - RNA, 32 nt, Human
uggcgccuguagucccagcuacuccagaugcu

SEQ ID NO: 523041 - RNA, 32 nt, Human
uggcgccuguagucccagcuacucggaaggcu

SEQ ID NO: 523042 - RNA, 32 nt, Human
uggcgccuugaagaaagaggccuaggagagca

SEQ ID NO: 523043 - RNA, 23 nt, Human
uggcgcgacccugaccgauccca

SEQ ID NO: 523044 - RNA, 32 nt, Human
uggcgcgacugcacuccagccugggcgagaga

SEQ ID NO: 523045 - RNA, 32 nt, Human
uggcgcgaucauggcucccugcagccucaaac

SEQ ID NO: 523046 - RNA, 32 nt, Human
uggcgcgaucccagcucgcugcagccuccacc

SEQ ID NO: 523047 - RNA, 23 nt, Human
uggcgcgaucuaggcucacugca

SEQ ID NO: 523048 - RNA, 23 nt, Human
uggcgcgaucucaacucacugca

SEQ ID NO: 523049 - RNA, 23 nt, Human
uggcgcgaucucagcucaccgca

SEQ ID NO: 523050 - RNA, 23 nt, Human
uggcgcgaucucagcucacuaca

SEQ ID NO: 523051 - RNA, 23 nt, Human
uggcgcgaucucagcucacugca

SEQ ID NO: 523052 - RNA, 24 nt, Human
uggcgcgaucucagcucacugcag

SEQ ID NO: 523053 - RNA, 23 nt, Human
uggcgcgaucuccgcucacugca

SEQ ID NO: 523054 - RNA, 23 nt, Human
uggcgcgaucucgacucacugca

SEQ ID NO: 523055 - RNA, 23 nt, Human
uggcgcgaucucggcucaccgca

SEQ ID NO: 523056 - RNA, 23 nt, Human
uggcgcgaucucggcucacuaca

SEQ ID NO: 523057 - RNA, 24 nt, Human
uggcgcgaucucggcucacuacag

SEQ ID NO: 523058 - RNA, 23 nt, Human
uggcgcgaucucggcucacugca

SEQ ID NO: 523059 - RNA, 24 nt, Human
uggcgcgaucucggcucacugcag

SEQ ID NO: 523060 - RNA, 23 nt, Human
uggcgcgaucuuagcucacugca

SEQ ID NO: 523061 - RNA, 23 nt, Human
uggcgcgaucuugacucacugca

SEQ ID NO: 523062 - RNA, 23 nt, Human
uggcgcgaucuuggcucacugca

SEQ ID NO: 523063 - RNA, 23 nt, Human
uggcgcgaucuuugcucacugca

SEQ ID NO: 523064 - RNA, 22 nt, Human
uggcgcgauucagcucacugca

SEQ ID NO: 523065 - RNA, 23 nt, Human
uggcgcgauuucagcucacugca

SEQ ID NO: 523066 - RNA, 23 nt, Human
uggcgcgauuucggcucacugca

SEQ ID NO: 523067 - RNA, 32 nt, Human
uggcgcgcaccugcucaagaccaggguccugc

SEQ ID NO: 523068 - RNA, 21 nt, Human
uggcgcgcaccuguaauccca

SEQ ID NO: 523069 - RNA, 24 nt, Human
uggcgcgcaccuguaaucccagcu

SEQ ID NO: 523070 - RNA, 21 nt, Human
uggcgcgcaccuguaguccca

SEQ ID NO: 523071 - RNA, 24 nt, Human
uggcgcgcaccuguagucccagcu

SEQ ID NO: 523072 - RNA, 21 nt, Human
uggcgcgcgccuauaauccca

SEQ ID NO: 523073 - RNA, 21 nt, Human
uggcgcgcgccuguaauccca

SEQ ID NO: 523074 - RNA, 24 nt, Human
uggcgcgcgccuguaaucccagcu

SEQ ID NO: 523075 - RNA, 24 nt, Human
uggcgcgcgccuguaaucccaguu

SEQ ID NO: 523076 - RNA, 21 nt, Human
uggcgcgcgccuguaguccca

SEQ ID NO: 523077 - RNA, 24 nt, Human
uggcgcgcgccuguagucccagcu

SEQ ID NO: 523078 - RNA, 21 nt, Human
uggcgcgcgucuguaauccca

SEQ ID NO: 523079 - RNA, 24 nt, Human
uggcgcgcgucuguaaucccagcu

SEQ ID NO: 523080 - RNA, 32 nt, Human
uggcgcggcugucggcuggcaccagcucccug

SEQ ID NO: 523081 - RNA, 32 nt, Human
uggcgcgggcgguggaggaggagguggggcug

SEQ ID NO: 523082 - RNA, 32 nt, Human
uggcgcggggaagggguggaaggguggaggua

SEQ ID NO: 523083 - RNA, 32 nt, Human
uggcgcggggcggcgggggcgggcggugcuga

SEQ ID NO: 523084 - RNA, 32 nt, Human
uggcgcggugagggagcggggguggggaucgg

SEQ ID NO: 523085 - RNA, 21 nt, Human
uggcgcgugccuguaauccca

SEQ ID NO: 523086 - RNA, 24 nt, Human
uggcgcgugccuguaaucccagcu

SEQ ID NO: 523087 - RNA, 32 nt, Human
uggcgcgugccuguaaucccagcuacuagggg

SEQ ID NO: 523088 - RNA, 32 nt, Human
uggcgcgugccuguaaucccagcuacucggga

SEQ ID NO: 523089 - RNA, 32 nt, Human
uggcgcgugccuguaaucccagcuacuuggga

SEQ ID NO: 523090 - RNA, 21 nt, Human
uggcgcgugccuguaauccua

SEQ ID NO: 523091 - RNA, 24 nt, Human
uggcgcgugccuguaauccuagcu

SEQ ID NO: 523092 - RNA, 32 nt, Human
uggcgcgugccuguaauccuagcuacucagga

SEQ ID NO: 523093 - RNA, 21 nt, Human
uggcgcgugccuguaauucca

SEQ ID NO: 523094 - RNA, 24 nt, Human
uggcgcgugccuguaauuccagcu

SEQ ID NO: 523095 - RNA, 21 nt, Human
uggcgcgugccuguaguccca

SEQ ID NO: 523096 - RNA, 24 nt, Human
uggcgcgugccuguagucccagcu

SEQ ID NO: 523097 - RNA, 32 nt, Human
uggcgcgugccuguagucccagcuacucgaga

SEQ ID NO: 523098 - RNA, 21 nt, Human
uggcgcgugcuuguaauccca

SEQ ID NO: 523099 - RNA, 24 nt, Human
uggcgcgugcuuguaaucccagcu

SEQ ID NO: 523100 - RNA, 32 nt, Human
uggcgcuagaggccauggaggcaguaggacaa

SEQ ID NO: 523101 - RNA, 32 nt, Human
uggcgcuaguccagcacgcccaggguuaaaag

SEQ ID NO: 523102 - RNA, 23 nt, Human
uggcgcuaucucagcucgcugca

SEQ ID NO: 523103 - RNA, 23 nt, Human
uggcgcuaucucggcucacugca

SEQ ID NO: 523104 - RNA, 23 nt, Human
uggcgcuaucuuggcucacugca

SEQ ID NO: 523105 - RNA, 32 nt, Human
uggcgcuauugcacuccagucuggguaacagg

SEQ ID NO: 523106 - RNA, 21 nt, Human
uggcgcucaaggagcagcagg

SEQ ID NO: 523107 - RNA, 32 nt, Human
uggcgcucagcagcuaggugggcaggucggcc

SEQ ID NO: 523108 - RNA, 32 nt, Human
uggcgcucauauccuccagucaugcccuagag

SEQ ID NO: 523109 - RNA, 32 nt, Human
uggcgcuccaacagaaaggcuugggugaccag

SEQ ID NO: 523110 - RNA, 32 nt, Human
uggcgcuccccuccucucccgcucuggcuucu

SEQ ID NO: 523111 - RNA, 32 nt, Human
uggcgcuccggaguugcugggcucagcgcagc

SEQ ID NO: 523112 - RNA, 32 nt, Human
uggcgcucuuagcuccugauugguuguguguu

SEQ ID NO: 523113 - RNA, 32 nt, Human
uggcgcugcacugggggcugggugcuggggag

SEQ ID NO: 523114 - RNA, 32 nt, Human
uggcgcugcugcacucaagcuuggaugacaga

SEQ ID NO: 523115 - RNA, 32 nt, Human
uggcgcugcugccaucuuuccucccaggugga

SEQ ID NO: 523116 - RNA, 32 nt, Human
uggcgcuggacauuggcaguucugcucugaau

SEQ ID NO: 523117 - RNA, 32 nt, Human
uggcgcuggauguggauuccaccaacagccgg

SEQ ID NO: 523118 - RNA, 32 nt, Human
uggcgcuguagcagcggcaggcugcugggcag

SEQ ID NO: 523119 - RNA, 23 nt, Human
uggcgcugucucagcucacugca

SEQ ID NO: 523120 - RNA, 23 nt, Human
uggcgcugucucggcucacugca

SEQ ID NO: 523121 - RNA, 32 nt, Human
uggcgcugucucucccccucggcucggagagg

SEQ ID NO: 523122 - RNA, 32 nt, Human
uggcgcuuccccuucuccucuggcuccggggu

SEQ ID NO: 523123 - RNA, 32 nt, Human
uggcgcuugccuguagucuagcuacuuggggu

SEQ ID NO: 523124 - RNA, 32 nt, Human
uggcgcuuugugaagcucugcuagccacuguu

SEQ ID NO: 523125 - RNA, 32 nt, Human
uggcggaaccgcgcugccgcagccugggauuc

SEQ ID NO: 523126 - RNA, 32 nt, Human
uggcggaaccuguaaucccagcuacucaggag

SEQ ID NO: 523127 - RNA, 32 nt, Human
uggcggacaccuggcccccgaggucccccggc

SEQ ID NO: 523128 - RNA, 32 nt, Human
uggcggaccacgaccagcuggcaccucagcuc

SEQ ID NO: 523129 - RNA, 32 nt, Human
uggcggaccagaccugcccugcucugugacag

SEQ ID NO: 523130 - RNA, 32 nt, Human
uggcggaccaucagcaagaacggaggggcuga

SEQ ID NO: 523131 - RNA, 32 nt, Human
uggcggacgccuguaaucccagcuacuuggaa

SEQ ID NO: 523132 - RNA, 32 nt, Human
uggcggacggucccuggcuggguucuggaggc

SEQ ID NO: 523133 - RNA, 32 nt, Human
uggcggagaacagcgagagucugggcaccguc

SEQ ID NO: 523134 - RNA, 23 nt, Human
uggcggagacaagcacugagaca

SEQ ID NO: 523135 - RNA, 32 nt, Human
uggcggagacaggguuucaccauguuggccag

SEQ ID NO: 523136 - RNA, 32 nt, Human
uggcggagagugaaggagacggagaaacgcgc

SEQ ID NO: 523137 - RNA, 32 nt, Human
uggcggagcgcugagggcagcggcuggcucug

SEQ ID NO: 523138 - RNA, 32 nt, Human
uggcggaggaagaggaguggcggcagcggcgg

SEQ ID NO: 523139 - RNA, 32 nt, Human
uggcggaggggagggggcgcccaggaggggug

SEQ ID NO: 523140 - RNA, 31 nt, Human
uggcggcaacaugcaagaaggagggacuguc

SEQ ID NO: 523141 - RNA, 32 nt, Human
uggcggcaagagcccuuaaauuacauuaaauc

SEQ ID NO: 523142 - RNA, 21 nt, Human
uggcggcagacgagaagagag

SEQ ID NO: 523143 - RNA, 32 nt, Human
uggcggcagaggcagagaugggagugaugcgg

SEQ ID NO: 523144 - RNA, 32 nt, Human
uggcggcagccgcggcggcgggcggcgguugc

SEQ ID NO: 523145 - RNA, 32 nt, Human
uggcggcagcugucuguguuucuccuguucuc

SEQ ID NO: 523146 - RNA, 32 nt, Human
uggcggcaggacggcgaacuugcaguaucucc

SEQ ID NO: 523147 - RNA, 25 nt, Human
uggcggcagucacggccaagagagu

SEQ ID NO: 523148 - RNA, 32 nt, Human
uggcggcaucugcacacacaaaaacuuguaca

SEQ ID NO: 523149 - RNA, 32 nt, Human
uggcggccaagguggcgaagcagcagccgcgg

SEQ ID NO: 523150 - RNA, 32 nt, Human
uggcggcccugccugggccuucggagccuccu

SEQ ID NO: 523151 - RNA, 32 nt, Human
uggcggccuccagggggcugggaauagccgcu

SEQ ID NO: 523152 - RNA, 32 nt, Human
uggcggccugcagcgugagcugugggagaggg

SEQ ID NO: 523153 - RNA, 20 nt, Human
uggcggccuuggucggccca

SEQ ID NO: 523154 - RNA, 32 nt, Human
uggcggccuuucugcuccucgcggcccaggug

SEQ ID NO: 523155 - RNA, 32 nt, Human
uggcggcgccuggcaggcuccgccagcccccu

SEQ ID NO: 523156 - RNA, 30 nt, Human
uggcggcgccuguaaucccagcuacuuggg

SEQ ID NO: 523157 - RNA, 19 nt, Human
uggcggcgcgguugguccu

SEQ ID NO: 523158 - RNA, 32 nt, Human
uggcggcggcggaggagagggagcagcgucac

SEQ ID NO: 523159 - RNA, 32 nt, Human
uggcggcggcggcagaggcggcgggaggauga

SEQ ID NO: 523160 - RNA, 32 nt, Human
uggcggcggcggcaggcggcagaggggagucc

SEQ ID NO: 523161 - RNA, 32 nt, Human
uggcggcggcggcggaggcgucgguggaggag

SEQ ID NO: 523162 - RNA, 32 nt, Human
uggcggcggcuccucuucugccuguguaugga

SEQ ID NO: 523163 - RNA, 32 nt, Human
uggcggcgguagcggaggugugaguggacgcg

SEQ ID NO: 523164 - RNA, 32 nt, Human
uggcggcguccaagggagguugagggcucuga

SEQ ID NO: 523165 - RNA, 32 nt, Human
uggcggcuagcugcaccucccauuucuuggac

SEQ ID NO: 523166 - RNA, 32 nt, Human
uggcggcuccuggaggaggggcagagggaguu

SEQ ID NO: 523167 - RNA, 32 nt, Human
uggcggcucuggcggccuaaagaaggcggccg

SEQ ID NO: 523168 - RNA, 32 nt, Human
uggcggcuucagcaggaagcccagggacagca

SEQ ID NO: 523169 - RNA, 32 nt, Human
uggcgggaacccaggaggcagagguugcagug

SEQ ID NO: 523170 - RNA, 22 nt, Human
uggcgggaagagcccggaaaga

SEQ ID NO: 523171 - RNA, 32 nt, Human
uggcgggagauggcuguggagcuggggguuua

SEQ ID NO: 523172 - RNA, 32 nt, Human
uggcgggaggcagcgccgcggagccagcgccg

SEQ ID NO: 523173 - RNA, 32 nt, Human
uggcgggagggacagccccagagcagacccuu

SEQ ID NO: 523174 - RNA, 32 nt, Human
uggcgggagggaggaauggaaaguggcugcua

SEQ ID NO: 523175 - RNA, 32 nt, Human
uggcgggaggugcagagcagggggcuuuaggg

SEQ ID NO: 523176 - RNA, 21 nt, Human
uggcgggcaccuauaauccca

SEQ ID NO: 523177 - RNA, 21 nt, Human
uggcgggcaccuauaguccca

SEQ ID NO: 523178 - RNA, 21 nt, Human
uggcgggcaccuguaauacca

SEQ ID NO: 523179 - RNA, 21 nt, Human
uggcgggcaccuguaauccca

SEQ ID NO: 523180 - RNA, 24 nt, Human
uggcgggcaccuguaaucccagcu

SEQ ID NO: 523181 - RNA, 21 nt, Human
uggcgggcaccuguaaucgca

SEQ ID NO: 523182 - RNA, 21 nt, Human
uggcgggcaccuguaguccca

SEQ ID NO: 523183 - RNA, 24 nt, Human
uggcgggcaccuguagucccagcu

SEQ ID NO: 523184 - RNA, 24 nt, Human
uggcgggcaccuguaguuccagcu

SEQ ID NO: 523185 - RNA, 32 nt, Human
uggcgggcaccuguaguuccagcugcuuggga

SEQ ID NO: 523186 - RNA, 21 nt, Human
uggcgggcacuuguaauccca

SEQ ID NO: 523187 - RNA, 24 nt, Human
uggcgggcacuuguaaucccagcu

SEQ ID NO: 523188 - RNA, 32 nt, Human
uggcgggcaggcggguggggcaggcugggggc

SEQ ID NO: 523189 - RNA, 21 nt, Human
uggcgggcccccguaguccca

SEQ ID NO: 523190 - RNA, 21 nt, Human
uggcgggccccuguaauccca

SEQ ID NO: 523191 - RNA, 24 nt, Human
uggcgggccccuguaaucccagcu

SEQ ID NO: 523192 - RNA, 21 nt, Human
uggcgggccccuguaguccca

SEQ ID NO: 523193 - RNA, 24 nt, Human
uggcgggccccuguagucccagcu

SEQ ID NO: 523194 - RNA, 21 nt, Human
uggcgggcgcccguaauccca

SEQ ID NO: 523195 - RNA, 21 nt, Human
uggcgggcgccuauaauccca

SEQ ID NO: 523196 - RNA, 21 nt, Human
uggcgggcgccuauaauccua

SEQ ID NO: 523197 - RNA, 32 nt, Human
uggcgggcgccuguaauaucagcuacuuggga

SEQ ID NO: 523198 - RNA, 24 nt, Human
uggcgggcgccuguaaucacagcu

SEQ ID NO: 523199 - RNA, 32 nt, Human
uggcgggcgccuguaaucacagcuacuuggga

SEQ ID NO: 523200 - RNA, 21 nt, Human
uggcgggcgccuguaauccca

SEQ ID NO: 523201 - RNA, 24 nt, Human
uggcgggcgccuguaaucccagcu

SEQ ID NO: 523202 - RNA, 32 nt, Human
uggcgggcgccuguaaucccagcuacuuggga

SEQ ID NO: 523203 - RNA, 32 nt, Human
uggcgggcgccuguaaucccagcuacuugggu

SEQ ID NO: 523204 - RNA, 21 nt, Human
uggcgggcgccuguaauccua

SEQ ID NO: 523205 - RNA, 24 nt, Human
uggcgggcgccuguaauccuagcu

SEQ ID NO: 523206 - RNA, 32 nt, Human
uggcgggcgccuguaauccuagcugcuuggga

SEQ ID NO: 523207 - RNA, 21 nt, Human
uggcgggcgccuguagcccca

SEQ ID NO: 523208 - RNA, 24 nt, Human
uggcgggcgccuguagccccagcu

SEQ ID NO: 523209 - RNA, 21 nt, Human
uggcgggcgccuguaguccca

SEQ ID NO: 523210 - RNA, 24 nt, Human
uggcgggcgccuguagucccagcu

SEQ ID NO: 523211 - RNA, 24 nt, Human
uggcgggcgccuguaguuccagcu

SEQ ID NO: 523212 - RNA, 32 nt, Human
uggcgggcgccuguaucccagcuacucgggag

SEQ ID NO: 523213 - RNA, 21 nt, Human
uggcgggcgccuguauuccca

SEQ ID NO: 523214 - RNA, 21 nt, Human
uggcgggcgccugugguccca

SEQ ID NO: 523215 - RNA, 21 nt, Human
uggcgggcuccuguaguccca

SEQ ID NO: 523216 - RNA, 24 nt, Human
uggcgggcuccuguagucccagcu

SEQ ID NO: 523217 - RNA, 32 nt, Human
uggcgggcugacccucgaccucccagacacca

SEQ ID NO: 523218 - RNA, 32 nt, Human
uggcgggcuggcaaggggauauucagcucugc

SEQ ID NO: 523219 - RNA, 32 nt, Human
uggcgggcuucuguaauuccagcuacuuggga

SEQ ID NO: 523220 - RNA, 32 nt, Human
uggcggggagcacagcugcccugacacauugg

SEQ ID NO: 523221 - RNA, 32 nt, Human
uggcggggcugcuccuucccaccccucagaac

SEQ ID NO: 523222 - RNA, 32 nt, Human
uggcgggggaggcaggggugagaggauggaau

SEQ ID NO: 523223 - RNA, 32 nt, Human
uggcgggggcagcagaggggcugggugaacuc

SEQ ID NO: 523224 - RNA, 32 nt, Human
uggcgggggccuguaauccuagcuacuugggg

SEQ ID NO: 523225 - RNA, 32 nt, Human
uggcgggggcugggaggacaggcguggggucc

SEQ ID NO: 523226 - RNA, 32 nt, Human
uggcgggggugaguggggccagcggggcugga

SEQ ID NO: 523227 - RNA, 32 nt, Human
uggcgggucaugaaaacaguuacuggaauugu

SEQ ID NO: 523228 - RNA, 32 nt, Human
uggcgggucugcagaagaucagcagcuucuua

SEQ ID NO: 523229 - RNA, 32 nt, Human
uggcgggugcacagagacggucuggaaggaaa

SEQ ID NO: 523230 - RNA, 21 nt, Human
uggcgggugccuguaauccca

SEQ ID NO: 523231 - RNA, 32 nt, Human
uggcgggugccuguaaucccagcuacucagga

SEQ ID NO: 523232 - RNA, 32 nt, Human
uggcgggugccuguaaucccagcuacucggga

SEQ ID NO: 523233 - RNA, 32 nt, Human
uggcgggugccuguaaucccagcuacugggga

SEQ ID NO: 523234 - RNA, 32 nt, Human
uggcgggugccuguaaucccagcuacuuggga

SEQ ID NO: 523235 - RNA, 32 nt, Human
uggcgggugccuguaaucccggcuacucagga

SEQ ID NO: 523236 - RNA, 32 nt, Human
uggcgggugccuguaaucucagcuacucagga

SEQ ID NO: 523237 - RNA, 32 nt, Human
uggcgggugccuguaaucucagcuacuugaga

SEQ ID NO: 523238 - RNA, 32 nt, Human
uggcgggugccuguagucccagccacuuggga

SEQ ID NO: 523239 - RNA, 32 nt, Human
uggcgggugccuguagucccagcuacucagga

SEQ ID NO: 523240 - RNA, 32 nt, Human
uggcgggugccuguagucccagcuacucggga

SEQ ID NO: 523241 - RNA, 32 nt, Human
uggcgggugccuguagucccagcuacugguag

SEQ ID NO: 523242 - RNA, 32 nt, Human
uggcgggugccuguagucccagcuauuuggga

SEQ ID NO: 523243 - RNA, 32 nt, Human
uggcgggugccuguagucccagcugcucggga

SEQ ID NO: 523244 - RNA, 32 nt, Human
uggcgggugccuguagucccaguacucaggag

SEQ ID NO: 523245 - RNA, 32 nt, Human
uggcgggugccuguauugccagcuacucggaa

SEQ ID NO: 523246 - RNA, 32 nt, Human
uggcggguggcugcucugggcccacugcucuu

SEQ ID NO: 523247 - RNA, 22 nt, Human
uggcgguacccacccagcccaa

SEQ ID NO: 523248 - RNA, 21 nt, Human
uggcggucaccuguaguccca

SEQ ID NO: 523249 - RNA, 24 nt, Human
uggcggucaccuguagucccagcu

SEQ ID NO: 523250 - RNA, 32 nt, Human
uggcggucaugaaggcugugugcagugcaagg

SEQ ID NO: 523251 - RNA, 20 nt, Human
uggcggucucuguaauccca

SEQ ID NO: 523252 - RNA, 23 nt, Human
uggcggucucuguaaucccagcu

SEQ ID NO: 523253 - RNA, 32 nt, Human
uggcggucugcacuucucucccggguuccauc

SEQ ID NO: 523254 - RNA, 20 nt, Human
uggcggugacagccggccca

SEQ ID NO: 523255 - RNA, 32 nt, Human
uggcggugacucugcuuccugcacugacccag

SEQ ID NO: 523256 - RNA, 21 nt, Human
uggcggugacugcgugguccu

SEQ ID NO: 523257 - RNA, 24 nt, Human
uggcggugcacgccugugguccca

SEQ ID NO: 523258 - RNA, 17 nt, Human
uggcggugccggcgccc

SEQ ID NO: 523259 - RNA, 32 nt, Human
uggcggugcugccuccacccuccugagccugg

SEQ ID NO: 523260 - RNA, 32 nt, Human
uggcgguggaguccugagcuagucgugucccg

SEQ ID NO: 523261 - RNA, 32 nt, Human
uggcgguggcccuucccggcugcggagagccc

SEQ ID NO: 523262 - RNA, 32 nt, Human
uggcgguggcugggcagggcugggcagggccg

SEQ ID NO: 523263 - RNA, 32 nt, Human
uggcggugggcccugaaccugcggugucgggg

SEQ ID NO: 523264 - RNA, 32 nt, Human
uggcgguggggaucgaaagaaaggagggcaug

SEQ ID NO: 523265 - RNA, 29 nt, Human
uggcggugucugugaugguccggagcgag

SEQ ID NO: 523266 - RNA, 20 nt, Human
uggcggugugggccguccca

SEQ ID NO: 523267 - RNA, 22 nt, Human
uggcgguuccguagcgguccca

SEQ ID NO: 523268 - RNA, 32 nt, Human
uggcgguuccugugcugaguccugaacacgua

SEQ ID NO: 523269 - RNA, 23 nt, Human
uggcguaaucucggcucacugca

SEQ ID NO: 523270 - RNA, 23 nt, Human
uggcguaaucuuggcucacugca

SEQ ID NO: 523271 - RNA, 21 nt, Human
uggcguacgccuauaguccca

SEQ ID NO: 523272 - RNA, 21 nt, Human
uggcguacgccuguaguccca

SEQ ID NO: 523273 - RNA, 24 nt, Human
uggcguacgccuguagucccagcu

SEQ ID NO: 523274 - RNA, 32 nt, Human
uggcguagagccuagcaacagcgcaggcuccc

SEQ ID NO: 523275 - RNA, 21 nt, Human
uggcguaugccuguaauccca

SEQ ID NO: 523276 - RNA, 24 nt, Human
uggcguaugccuguaaucccagcu

SEQ ID NO: 523277 - RNA, 32 nt, Human
uggcguaugccuguaaucccagcuacuuagga

SEQ ID NO: 523278 - RNA, 32 nt, Human
uggcgucaagagcaguugacucacugaugaag

SEQ ID NO: 523279 - RNA, 31 nt, Human
uggcgucacagcugagcaccgugccgggagg

SEQ ID NO: 523280 - RNA, 32 nt, Human
uggcgucacuaccuucuuguaagccaguauac

SEQ ID NO: 523281 - RNA, 32 nt, Human
uggcgucaguguucuccagccugggcaacaga

SEQ ID NO: 523282 - RNA, 23 nt, Human
uggcgucaucucagcucacugca

SEQ ID NO: 523283 - RNA, 23 nt, Human
uggcgucaucucggcucacugca

SEQ ID NO: 523284 - RNA, 32 nt, Human
uggcguccgggguggggucaaugaagugcagc

SEQ ID NO: 523285 - RNA, 32 nt, Human
uggcguccuccaccaccacaccuucaccugcg

SEQ ID NO: 523286 - RNA, 32 nt, Human
uggcgucgaggcuuccauggggugggggaggc

SEQ ID NO: 523287 - RNA, 32 nt, Human
uggcgucggagccggcccuggcccccugcagc

SEQ ID NO: 523288 - RNA, 32 nt, Human
uggcgucugagcaacuuucguccacaagcaug

SEQ ID NO: 523289 - RNA, 32 nt, Human
uggcgucuguccucaccaugccuagccuuugg

SEQ ID NO: 523290 - RNA, 32 nt, Human
uggcgugaacccaggagacggagcuugcagug

SEQ ID NO: 523291 - RNA, 32 nt, Human
uggcgugaacccaggaggaggagcuugcagug

SEQ ID NO: 523292 - RNA, 32 nt, Human
uggcgugaacccaggaggcagagcuugcagug

SEQ ID NO: 523293 - RNA, 32 nt, Human
uggcgugaacccaggaggcagagguugcagug

SEQ ID NO: 523294 - RNA, 32 nt, Human
uggcgugaacccaggaggcggaccuuguagug

SEQ ID NO: 523295 - RNA, 32 nt, Human
uggcgugaacccaggaggcggagcuggcagug

SEQ ID NO: 523296 - RNA, 32 nt, Human
uggcgugaacccaggaggcggagcuugcagug

SEQ ID NO: 523297 - RNA, 32 nt, Human
uggcgugaacccaggaggcggagguugcagug

SEQ ID NO: 523298 - RNA, 32 nt, Human
uggcgugaacccaggaggcguagcuagcagug

SEQ ID NO: 523299 - RNA, 32 nt, Human
uggcgugaacccaggagguggagcuugcagug

SEQ ID NO: 523300 - RNA, 32 nt, Human
uggcgugaauccaggagguggagccugcagug

SEQ ID NO: 523301 - RNA, 32 nt, Human
uggcgugaccagggcucacugcagccuugacc

SEQ ID NO: 523302 - RNA, 23 nt, Human
uggcgugaccuuggcucacugca

SEQ ID NO: 523303 - RNA, 32 nt, Human
uggcgugagcccaggaggcggagcuugcagug

SEQ ID NO: 523304 - RNA, 32 nt, Human
uggcgugauaacccugucaucuucccaaagcu

SEQ ID NO: 523305 - RNA, 24 nt, Human
uggcgugaucacagcucacugcag

SEQ ID NO: 523306 - RNA, 32 nt, Human
uggcgugaucacagcucacugcagccuugacc

SEQ ID NO: 523307 - RNA, 32 nt, Human
uggcgugaucauaccucacugcagcuucaacu

SEQ ID NO: 523308 - RNA, 32 nt, Human
uggcgugaucauagcucacugcagccuugaau

SEQ ID NO: 523309 - RNA, 32 nt, Human
uggcgugaucaugccucacugcagccucgacc

SEQ ID NO: 523310 - RNA, 32 nt, Human
uggcgugaucauggcucauugcagccucgacc

SEQ ID NO: 523311 - RNA, 23 nt, Human
uggcgugaucucagaucacugca

SEQ ID NO: 523312 - RNA, 23 nt, Human
uggcgugaucucagcucacugca

SEQ ID NO: 523313 - RNA, 23 nt, Human
uggcgugaucuccacucacugca

SEQ ID NO: 523314 - RNA, 24 nt, Human
uggcgugaucucgagucacugcag

SEQ ID NO: 523315 - RNA, 32 nt, Human
uggcgugaucucgagucacugcagccuguguc

SEQ ID NO: 523316 - RNA, 23 nt, Human
uggcgugaucucggcucaaugca

SEQ ID NO: 523317 - RNA, 23 nt, Human
uggcgugaucucggcucaccgca

SEQ ID NO: 523318 - RNA, 23 nt, Human
uggcgugaucucggcucacuaca

SEQ ID NO: 523319 - RNA, 22 nt, Human
uggcgugaucucggcucacugc

SEQ ID NO: 523320 - RNA, 23 nt, Human
uggcgugaucucggcucacugca

SEQ ID NO: 523321 - RNA, 32 nt, Human
uggcgugaucucggcucacugcagccuccgcc

SEQ ID NO: 523322 - RNA, 23 nt, Human
uggcgugaucucggcucacugcg

SEQ ID NO: 523323 - RNA, 23 nt, Human
uggcgugaucucggcucauugca

SEQ ID NO: 523324 - RNA, 32 nt, Human
uggcgugaucucggcucgcugcagccucugcc

SEQ ID NO: 523325 - RNA, 23 nt, Human
uggcgugaucucggcuuacugca

SEQ ID NO: 523326 - RNA, 23 nt, Human
uggcgugaucucgguucacugca

SEQ ID NO: 523327 - RNA, 23 nt, Human
uggcgugaucucugcucacugca

SEQ ID NO: 523328 - RNA, 23 nt, Human
uggcgugaucuuggcucacugca

SEQ ID NO: 523329 - RNA, 24 nt, Human
uggcgugaucuuggcucacugcag

SEQ ID NO: 523330 - RNA, 32 nt, Human
uggcgugaucuuggcucacugcagacuucacc

SEQ ID NO: 523331 - RNA, 32 nt, Human
uggcgugaucuuggcucacugcagccuccacc

SEQ ID NO: 523332 - RNA, 32 nt, Human
uggcgugaucuuggcucacugcagccuucgcc

SEQ ID NO: 523333 - RNA, 23 nt, Human
uggcgugaucuuggcuuacugca

SEQ ID NO: 523334 - RNA, 24 nt, Human
uggcgugaucuuggcuuacugcag

SEQ ID NO: 523335 - RNA, 32 nt, Human
uggcgugaucuuggcuuacugcagccuuugcc

SEQ ID NO: 523336 - RNA, 23 nt, Human
uggcgugaucuugguucacugca

SEQ ID NO: 523337 - RNA, 21 nt, Human
uggcgugcaccuguaauccca

SEQ ID NO: 523338 - RNA, 24 nt, Human
uggcgugcaccuguaaucccagcu

SEQ ID NO: 523339 - RNA, 32 nt, Human
uggcgugcaccuguaaucccagcuacuaggga

SEQ ID NO: 523340 - RNA, 32 nt, Human
uggcgugcaccuguaaucccagcuacucagga

SEQ ID NO: 523341 - RNA, 32 nt, Human
uggcgugcaccuguaaucccagcuacuuggga

SEQ ID NO: 523342 - RNA, 21 nt, Human
uggcgugcaccuguaguccca

SEQ ID NO: 523343 - RNA, 22 nt, Human
uggcgugcaguggugugaucuc

SEQ ID NO: 523344 - RNA, 32 nt, Human
uggcgugcaugugccaagaaauguguuuuuau

SEQ ID NO: 523345 - RNA, 18 nt, Human
uggcgugcccucugccca

SEQ ID NO: 523346 - RNA, 32 nt, Human
uggcgugccugccugcacggcccuugccucuc

SEQ ID NO: 523347 - RNA, 21 nt, Human
uggcgugcgccuguaauccca

SEQ ID NO: 523348 - RNA, 24 nt, Human
uggcgugcgccuguaaucccagcu

SEQ ID NO: 523349 - RNA, 32 nt, Human
uggcgugcgccuguaaucccagcuacuuggga

SEQ ID NO: 523350 - RNA, 21 nt, Human
uggcgugcgccuguaaucuca

SEQ ID NO: 523351 - RNA, 24 nt, Human
uggcgugcgccuguaaucucagcu

SEQ ID NO: 523352 - RNA, 32 nt, Human
uggcgugcgccuguaaucucagcuacuuggga

SEQ ID NO: 523353 - RNA, 21 nt, Human
uggcgugcgccuguaguccca

SEQ ID NO: 523354 - RNA, 24 nt, Human
uggcgugcgccuguagucccagcu

SEQ ID NO: 523355 - RNA, 32 nt, Human
uggcguggaaccgccucaucaugcggcccagc

SEQ ID NO: 523356 - RNA, 32 nt, Human
uggcguggaagagauauagagaacucgacugg

SEQ ID NO: 523357 - RNA, 32 nt, Human
uggcguggcucagcugucuguugaaguuguug

SEQ ID NO: 523358 - RNA, 32 nt, Human
uggcgugggaugggggaaagaaaagaaagaga

SEQ ID NO: 523359 - RNA, 19 nt, Human
uggcguggggacgggccau

SEQ ID NO: 523360 - RNA, 21 nt, Human
uggcgugugccuguaauccca

SEQ ID NO: 523361 - RNA, 24 nt, Human
uggcgugugccuguaaucccagcu

SEQ ID NO: 523362 - RNA, 32 nt, Human
uggcgugugccuguaaucccagcuacuuggga

SEQ ID NO: 523363 - RNA, 32 nt, Human
uggcgugugccuguaaucccagcuauuuggga

SEQ ID NO: 523364 - RNA, 21 nt, Human
uggcgugugccuguaaucuca

SEQ ID NO: 523365 - RNA, 24 nt, Human
uggcgugugccuguaaucucagcu

SEQ ID NO: 523366 - RNA, 21 nt, Human
uggcgugugccuguaaugcca

SEQ ID NO: 523367 - RNA, 24 nt, Human
uggcgugugccuguaaugccagcu

SEQ ID NO: 523368 - RNA, 21 nt, Human
uggcgugugccuguaguccca

SEQ ID NO: 523369 - RNA, 24 nt, Human
uggcgugugccuguagucccagcu

SEQ ID NO: 523370 - RNA, 32 nt, Human
uggcgugugccuguagucccagcuacuuggga

SEQ ID NO: 523371 - RNA, 32 nt, Human
uggcgugugccuguagucccagcugcuuggga

SEQ ID NO: 523372 - RNA, 21 nt, Human
uggcgugugccugugauccca

SEQ ID NO: 523373 - RNA, 24 nt, Human
uggcgugugccugugaucccagcu

SEQ ID NO: 523374 - RNA, 32 nt, Human
uggcgugugguggcucaugccuguaaucccag

SEQ ID NO: 523375 - RNA, 32 nt, Human
uggcguguuccuucucccuggguccgacaugu

SEQ ID NO: 523376 - RNA, 32 nt, Human
uggcguucccagugcccggggaaagggguccc

SEQ ID NO: 523377 - RNA, 32 nt, Human
uggcguuugccuccuucgcuuaguucuccaga

SEQ ID NO: 523378 - RNA, 32 nt, Human
uggcuaaaaauacaaaaaguuagccgggcgug

SEQ ID NO: 523379 - RNA, 21 nt, Human
uggcuaaagccuguaauccca

SEQ ID NO: 523380 - RNA, 32 nt, Human
uggcuaaagccuguaaucccagcacuuuggga

SEQ ID NO: 523381 - RNA, 32 nt, Human
uggcuaaauugagcuaaugacaagcuguucga

SEQ ID NO: 523382 - RNA, 32 nt, Human
uggcuaacaaggugaaaccccgucucuacuaa

SEQ ID NO: 523383 - RNA, 32 nt, Human
uggcuaacacagugaaaccccaucucuaauaa

SEQ ID NO: 523384 - RNA, 32 nt, Human
uggcuaacacagugaaaccccaucucuacuaa

SEQ ID NO: 523385 - RNA, 32 nt, Human
uggcuaacacagugaaaccccgucucuaccaa

SEQ ID NO: 523386 - RNA, 30 nt, Human
uggcuaacacagugaaaccccgucucuacu

SEQ ID NO: 523387 - RNA, 32 nt, Human
uggcuaacacagugaaaccccgucucuacuaa

SEQ ID NO: 523388 - RNA, 32 nt, Human
uggcuaacacagugaaaccccgucucuucuaa

SEQ ID NO: 523389 - RNA, 32 nt, Human
uggcuaacaccgugaaaccccaucucuacuaa

SEQ ID NO: 523390 - RNA, 32 nt, Human
uggcuaacaccuguaaucccagcacuuuggga

SEQ ID NO: 523391 - RNA, 32 nt, Human
uggcuaacacggcgaaaccccgucucuacuaa

SEQ ID NO: 523392 - RNA, 32 nt, Human
uggcuaacacggcgaaacgccaucucuacuga

SEQ ID NO: 523393 - RNA, 32 nt, Human
uggcuaacacgggugaaaccccgucucuauua

SEQ ID NO: 523394 - RNA, 32 nt, Human
uggcuaacacgguaaaaccccaucucuacuaa

SEQ ID NO: 523395 - RNA, 32 nt, Human
uggcuaacacggugaaaacccaugucuacuaa

SEQ ID NO: 523396 - RNA, 32 nt, Human
uggcuaacacggugaaaccccaucuccacuaa

SEQ ID NO: 523397 - RNA, 32 nt, Human
uggcuaacacggugaaaccccaucucuacaaa

SEQ ID NO: 523398 - RNA, 32 nt, Human
uggcuaacacggugaaaccccaucucuacuaa

SEQ ID NO: 523399 - RNA, 32 nt, Human
uggcuaacacggugaaaccccaucucuacuga

SEQ ID NO: 523400 - RNA, 32 nt, Human
uggcuaacacggugaaaccccgucucuaauaa

SEQ ID NO: 523401 - RNA, 32 nt, Human
uggcuaacacggugaaaccccgucucuacaua

SEQ ID NO: 523402 - RNA, 32 nt, Human
uggcuaacacggugaaaccccgucucuacuaa

SEQ ID NO: 523403 - RNA, 32 nt, Human
uggcuaacacggugaaaccccgucucuacuac

SEQ ID NO: 523404 - RNA, 32 nt, Human
uggcuaacacggugaaaccccgucucuacuga

SEQ ID NO: 523405 - RNA, 32 nt, Human
uggcuaacacggugaaaccccgucucuaguaa

SEQ ID NO: 523406 - RNA, 32 nt, Human
uggcuaacacggugaaaccccgucuuuacuaa

SEQ ID NO: 523407 - RNA, 32 nt, Human
uggcuaacacggugaaacuccaucucuacuaa

SEQ ID NO: 523408 - RNA, 32 nt, Human
uggcuaacacggugaaacuccgucucuacuaa

SEQ ID NO: 523409 - RNA, 32 nt, Human
uggcuaacacggugagaccccaucucuacuaa

SEQ ID NO: 523410 - RNA, 32 nt, Human
uggcuaacacggugauaccccgucucuacuaa

SEQ ID NO: 523411 - RNA, 32 nt, Human
uggcuaacagggugaaaccccgucucuacuaa

SEQ ID NO: 523412 - RNA, 32 nt, Human
uggcuaacauggcaaaaccccaucucuacuaa

SEQ ID NO: 523413 - RNA, 32 nt, Human
uggcuaacauggcaaaaccucaucucuacuaa

SEQ ID NO: 523414 - RNA, 32 nt, Human
uggcuaacauggcaauacccuaucucuacuaa

SEQ ID NO: 523415 - RNA, 32 nt, Human
uggcuaacauggcgaaaccccgucucuacuaa

SEQ ID NO: 523416 - RNA, 32 nt, Human
uggcuaacaugguaaaaccccgucucuacuaa

SEQ ID NO: 523417 - RNA, 32 nt, Human
uggcuaacauggugaaaccccaucuccacuaa

SEQ ID NO: 523418 - RNA, 30 nt, Human
uggcuaacauggugaaaccccaucucuacu

SEQ ID NO: 523419 - RNA, 32 nt, Human
uggcuaacauggugaaaccccaucucuacuaa

SEQ ID NO: 523420 - RNA, 32 nt, Human
uggcuaacauggugaaaccccaucucuacuga

SEQ ID NO: 523421 - RNA, 32 nt, Human
uggcuaacauggugaaaccccaucucuaguaa

SEQ ID NO: 523422 - RNA, 32 nt, Human
uggcuaacauggugaaaccccgucucuaccaa

SEQ ID NO: 523423 - RNA, 32 nt, Human
uggcuaacauggugaaaccccgucucuacuaa

SEQ ID NO: 523424 - RNA, 32 nt, Human
uggcuaacauggugaaaccccgucucuacuga

SEQ ID NO: 523425 - RNA, 32 nt, Human
uggcuaacauggugaaaccccgucucuacuua

SEQ ID NO: 523426 - RNA, 32 nt, Human
uggcuaacauggugaaaccccgucucugcuaa

SEQ ID NO: 523427 - RNA, 32 nt, Human
uggcuaacauggugaaaucccgucucuacuga

SEQ ID NO: 523428 - RNA, 32 nt, Human
uggcuaacauggugguaccccgucucuacuga

SEQ ID NO: 523429 - RNA, 32 nt, Human
uggcuaacgccuguaaucccagaacuuuggga

SEQ ID NO: 523430 - RNA, 32 nt, Human
uggcuaacgccuguaaucccagcacuugggag

SEQ ID NO: 523431 - RNA, 32 nt, Human
uggcuaacgccuguaaucccagcacuuugaga

SEQ ID NO: 523432 - RNA, 32 nt, Human
uggcuaacguggugaaaccccaucucuacuaa

SEQ ID NO: 523433 - RNA, 32 nt, Human
uggcuaacugcaaccuccagcuccuggguuca

SEQ ID NO: 523434 - RNA, 32 nt, Human
uggcuaacugcaaccuccgccucccagguuca

SEQ ID NO: 523435 - RNA, 32 nt, Human
uggcuaacugcaacuuccaccuccuggguuca

SEQ ID NO: 523436 - RNA, 32 nt, Human
uggcuaacugggacuaaaacagcuccaucacc

SEQ ID NO: 523437 - RNA, 32 nt, Human
uggcuaacuuggugaaaccccgucucuaauaa

SEQ ID NO: 523438 - RNA, 32 nt, Human
uggcuaagaacucauggccacuguggaaaucu

SEQ ID NO: 523439 - RNA, 32 nt, Human
uggcuaaggagagucacguagcugugggcggg

SEQ ID NO: 523440 - RNA, 20 nt, Human
uggcuaaggccccucugcac

SEQ ID NO: 523441 - RNA, 32 nt, Human
uggcuaauacagugaaaccccaucucuacuaa

SEQ ID NO: 523442 - RNA, 32 nt, Human
uggcuaauacggugaaaccccgucucuacuaa

SEQ ID NO: 523443 - RNA, 32 nt, Human
uggcuaauauggugaaaccccaucucuacuaa

SEQ ID NO: 523444 - RNA, 32 nt, Human
uggcuaauauggugaaaccccgucucuacuaa

SEQ ID NO: 523445 - RNA, 32 nt, Human
uggcuaaucauucauucauucauuccacacac

SEQ ID NO: 523446 - RNA, 32 nt, Human
uggcuaauguggugaaaccccgucucuacuaa

SEQ ID NO: 523447 - RNA, 32 nt, Human
uggcuaauuagcucugugccacauuccuaagc

SEQ ID NO: 523448 - RNA, 32 nt, Human
uggcuaauuaugcaauuaauucucaacguauc

SEQ ID NO: 523449 - RNA, 32 nt, Human
uggcuacacagaaccccacuacuuaccaggca

SEQ ID NO: 523450 - RNA, 32 nt, Human
uggcuacacagcaacagcacccgaugggccca

SEQ ID NO: 523451 - RNA, 32 nt, Human
uggcuacaccacucucccagccugugaccacc

SEQ ID NO: 523452 - RNA, 21 nt, Human
uggcuacagcuuaugcaucau

SEQ ID NO: 523453 - RNA, 32 nt, Human
uggcuacauggugaaaccccgucucuauaaaa

SEQ ID NO: 523454 - RNA, 32 nt, Human
uggcuaccaaaugauaagaacaacagcaacaa

SEQ ID NO: 523455 - RNA, 32 nt, Human
uggcuaccagcaacacaccugcuccaccgcca

SEQ ID NO: 523456 - RNA, 32 nt, Human
uggcuacccagcugugugugaggaggaccuga

SEQ ID NO: 523457 - RNA, 32 nt, Human
uggcuacccuggggcgaguccuguuuacagug

SEQ ID NO: 523458 - RNA, 32 nt, Human
uggcuaccuaggcuugccagguacggcagaaa

SEQ ID NO: 523459 - RNA, 26 nt, Human
uggcuaccucccuuacuuucuucagg

SEQ ID NO: 523460 - RNA, 32 nt, Human
uggcuaccugacuuggugggagcuccaggcag

SEQ ID NO: 523461 - RNA, 32 nt, Human
uggcuacgacuugggacggaaguggccugaga

SEQ ID NO: 523462 - RNA, 32 nt, Human
uggcuacgccuguaaucccagcacuuugggag

SEQ ID NO: 523463 - RNA, 32 nt, Human
uggcuacugcuggcuuucuucauggccucucu

SEQ ID NO: 523464 - RNA, 32 nt, Human
uggcuagaauggcuuguuccugcuggggcuga

SEQ ID NO: 523465 - RNA, 32 nt, Human
uggcuagacccaaacauaugcacauucacuua

SEQ ID NO: 523466 - RNA, 32 nt, Human
uggcuagagaugggggugagaccggggaagga

SEQ ID NO: 523467 - RNA, 32 nt, Human
uggcuagcagaggccuggccagcuggccacug

SEQ ID NO: 523468 - RNA, 32 nt, Human
uggcuagcauaguaaaaccccaucucuacuga

SEQ ID NO: 523469 - RNA, 32 nt, Human
uggcuagcaugcugcugggccacaccccaaga

SEQ ID NO: 523470 - RNA, 32 nt, Human
uggcuagcauggugaaaccccgucucuacuaa

SEQ ID NO: 523471 - RNA, 32 nt, Human
uggcuagccacuguccaagccugggucugugu

SEQ ID NO: 523472 - RNA, 32 nt, Human
uggcuagccacugugcuccagccugggcaaca

SEQ ID NO: 523473 - RNA, 32 nt, Human
uggcuagccaucccaguacuuccacguuuuuc

SEQ ID NO: 523474 - RNA, 32 nt, Human
uggcuagccugcagauaacaucaaguaguuuc

SEQ ID NO: 523475 - RNA, 32 nt, Human
uggcuagcuacacagaguccaucuaauuuuug

SEQ ID NO: 523476 - RNA, 32 nt, Human
uggcuagcucagggguccagcucugcagggug

SEQ ID NO: 523477 - RNA, 19 nt, Human
uggcuagcucuugcccuua

SEQ ID NO: 523478 - RNA, 32 nt, Human
uggcuaggacccagagccacacugcagccucc

SEQ ID NO: 523479 - RNA, 32 nt, Human
uggcuaggaccccuccaugugggcuaguuggg

SEQ ID NO: 523480 - RNA, 32 nt, Human
uggcuaggagggucucaaacuccugaccucag

SEQ ID NO: 523481 - RNA, 32 nt, Human
uggcuaggcagacaguggggacugugcauauu

SEQ ID NO: 523482 - RNA, 32 nt, Human
uggcuaggcccugggaaucggguuuagucauc

SEQ ID NO: 523483 - RNA, 32 nt, Human
uggcuagggaaguuuccagaaacccgcuggac

SEQ ID NO: 523484 - RNA, 32 nt, Human
uggcuagggcaagucuccaaaguaauucagau

SEQ ID NO: 523485 - RNA, 32 nt, Human
uggcuagggcugggaggguuuugcucuccuau

SEQ ID NO: 523486 - RNA, 32 nt, Human
uggcuaggggcagagggcacugccaggcugug

SEQ ID NO: 523487 - RNA, 32 nt, Human
uggcuaguaaguacuggcaaagugaauauuua

SEQ ID NO: 523488 - RNA, 32 nt, Human
uggcuagugaacacuugaaauguggcuagugu

SEQ ID NO: 523489 - RNA, 32 nt, Human
uggcuauacaucuucaucccuccccaccaucc

SEQ ID NO: 523490 - RNA, 32 nt, Human
uggcuauaucccccguccccagccccucuucu

SEQ ID NO: 523491 - RNA, 32 nt, Human
uggcuauauguuguugagauauuugaaacuua

SEQ ID NO: 523492 - RNA, 19 nt, Human
uggcuaucccccucugcca

SEQ ID NO: 523493 - RNA, 32 nt, Human
uggcuaucccuucuccccuccguggaauuccu

SEQ ID NO: 523494 - RNA, 32 nt, Human
uggcuauccugauccaguggccacaucucagg

SEQ ID NO: 523495 - RNA, 32 nt, Human
uggcuaucucaguucuguagcagaucccuggu

SEQ ID NO: 523496 - RNA, 32 nt, Human
uggcuaucuccaagacagcaaaggcaggggaa

SEQ ID NO: 523497 - RNA, 17 nt, Human
uggcuaugaacagacca

SEQ ID NO: 523498 - RNA, 32 nt, Human
uggcuaugcucaccccaucucccuugagaggc

SEQ ID NO: 523499 - RNA, 32 nt, Human
uggcuauggggugagagaaguagcuugaggau

SEQ ID NO: 523500 - RNA, 31 nt, Human
uggcuauggguggagggugaguuugaagagg

SEQ ID NO: 523501 - RNA, 32 nt, Human
uggcuauggguggagggugaguuugaagaggu

SEQ ID NO: 523502 - RNA, 19 nt, Human
uggcuauguagacauaaag

SEQ ID NO: 523503 - RNA, 32 nt, Human
uggcuaugugaagccuaauuuaccugcaggaa

SEQ ID NO: 523504 - RNA, 32 nt, Human
uggcuauuaaaguguuuuauuucccaauucau

SEQ ID NO: 523505 - RNA, 32 nt, Human
uggcuauuacaaaggggcagcccauucacuac

SEQ ID NO: 523506 - RNA, 32 nt, Human
uggcuauugcaauauuuacuaguagaggaacu

SEQ ID NO: 523507 - RNA, 32 nt, Human
uggcuauuggcagccuccgcauggaagccugu

SEQ ID NO: 523508 - RNA, 32 nt, Human
uggcuauugggggagcccagagacaggggaag

SEQ ID NO: 523509 - RNA, 32 nt, Human
uggcuauuuaaggaggacuggguuuguuguga

SEQ ID NO: 523510 - RNA, 32 nt, Human
uggcuauuuguauuuaacaagacuuaaucauc

SEQ ID NO: 523511 - RNA, 21 nt, Human
uggcucaaaccuguaauccca

SEQ ID NO: 523512 - RNA, 23 nt, Human
uggcucaaaccuguaaucccagc

SEQ ID NO: 523513 - RNA, 32 nt, Human
uggcucaaaccuguaaucccagcacuuuggga

SEQ ID NO: 523514 - RNA, 23 nt, Human
uggcucaaaugccuguaauccca

SEQ ID NO: 523515 - RNA, 25 nt, Human
uggcucaaaugccuguaaucccagu

SEQ ID NO: 523516 - RNA, 32 nt, Human
uggcucaacacaugagaagaagcacgaagcag

SEQ ID NO: 523517 - RNA, 20 nt, Human
uggcucaagcaguccucccc

SEQ ID NO: 523518 - RNA, 32 nt, Human
uggcucaagcagucuucaucucagccuccaga

SEQ ID NO: 523519 - RNA, 21 nt, Human
uggcucaagcccauaauccca

SEQ ID NO: 523520 - RNA, 21 nt, Human
uggcucaagccuauaauccca

SEQ ID NO: 523521 - RNA, 21 nt, Human
uggcucaagccuguaauccca

SEQ ID NO: 523522 - RNA, 23 nt, Human
uggcucaagccuguaaucccagc

SEQ ID NO: 523523 - RNA, 32 nt, Human
uggcucaagccuguaaucccagcacuuuaggu

SEQ ID NO: 523524 - RNA, 32 nt, Human
uggcucaagccuguaaucccagcacuuuggga

SEQ ID NO: 523525 - RNA, 32 nt, Human
uggcucaagccuguaaucccagcauuuuggga

SEQ ID NO: 523526 - RNA, 23 nt, Human
uggcucaagccuguaaucccagu

SEQ ID NO: 523527 - RNA, 21 nt, Human
uggcucaagccuguaauguca

SEQ ID NO: 523528 - RNA, 32 nt, Human
uggcucaagccuguaaugucagcacuuuaaaa

SEQ ID NO: 523529 - RNA, 32 nt, Human
uggcucaagccuguacucccagcacuuuugga

SEQ ID NO: 523530 - RNA, 21 nt, Human
uggcucaagccuguaguucca

SEQ ID NO: 523531 - RNA, 24 nt, Human
uggcucaagccuguaguuccagcu

SEQ ID NO: 523532 - RNA, 32 nt, Human
uggcucaagccugucaucccagcacuguggga

SEQ ID NO: 523533 - RNA, 25 nt, Human
uggcucaaggcauccucccaccuca

SEQ ID NO: 523534 - RNA, 24 nt, Human
uggcucaagugaucucccacuuca

SEQ ID NO: 523535 - RNA, 32 nt, Human
uggcucaauccuccuccaccaccaggggccuc

SEQ ID NO: 523536 - RNA, 32 nt, Human
uggcucaaucuauccugugcuugaugcuagaa

SEQ ID NO: 523537 - RNA, 23 nt, Human
uggcucaaucucggcucacugca

SEQ ID NO: 523538 - RNA, 32 nt, Human
uggcucaaugcaaccuccaccucccagguuca

SEQ ID NO: 523539 - RNA, 32 nt, Human
uggcucacaacugcaaccuccgucucccgggu

SEQ ID NO: 523540 - RNA, 20 nt, Human
uggcucacaacuguaauccc

SEQ ID NO: 523541 - RNA, 21 nt, Human
uggcucacaacuguaauccua

SEQ ID NO: 523542 - RNA, 32 nt, Human
uggcucacacauccccagccagggagcuugcc

SEQ ID NO: 523543 - RNA, 21 nt, Human
uggcucacacauguaauccca

SEQ ID NO: 523544 - RNA, 21 nt, Human
uggcucacacccauaauccca

SEQ ID NO: 523545 - RNA, 21 nt, Human
uggcucacacccguaauccca

SEQ ID NO: 523546 - RNA, 21 nt, Human
uggcucacaccgguaauccca

SEQ ID NO: 523547 - RNA, 19 nt, Human
uggcucacaccuaauccca

SEQ ID NO: 523548 - RNA, 32 nt, Human
uggcucacaccuaaucccagcacuuugggagg

SEQ ID NO: 523549 - RNA, 21 nt, Human
uggcucacaccuauaauccca

SEQ ID NO: 523550 - RNA, 21 nt, Human
uggcucacaccuauaauccua

SEQ ID NO: 523551 - RNA, 21 nt, Human
uggcucacaccuauaauucca

SEQ ID NO: 523552 - RNA, 23 nt, Human
uggcucacaccuauaauuccagc

SEQ ID NO: 523553 - RNA, 21 nt, Human
uggcucacaccuauaguccca

SEQ ID NO: 523554 - RNA, 21 nt, Human
uggcucacaccucuaauccca

SEQ ID NO: 523555 - RNA, 21 nt, Human
uggcucacaccuguaauacca

SEQ ID NO: 523556 - RNA, 23 nt, Human
uggcucacaccuguaauaccagc

SEQ ID NO: 523557 - RNA, 32 nt, Human
uggcucacaccuguaauaccagcacuuuggga

SEQ ID NO: 523558 - RNA, 18 nt, Human
uggcucacaccuguaauc

SEQ ID NO: 523559 - RNA, 32 nt, Human
uggcucacaccuguaauccaagcacuuuggga

SEQ ID NO: 523560 - RNA, 20 nt, Human
uggcucacaccuguaauccc

SEQ ID NO: 523561 - RNA, 21 nt, Human
uggcucacaccuguaauccca

SEQ ID NO: 523562 - RNA, 22 nt, Human
uggcucacaccuguaaucccag

SEQ ID NO: 523563 - RNA, 32 nt, Human
uggcucacaccuguaaucccagaacuuuggga

SEQ ID NO: 523564 - RNA, 23 nt, Human
uggcucacaccuguaaucccagc

SEQ ID NO: 523565 - RNA, 27 nt, Human
uggcucacaccuguaaucccagcacuu

SEQ ID NO: 523566 - RNA, 32 nt, Human
uggcucacaccuguaaucccagcacuuagaga

SEQ ID NO: 523567 - RNA, 32 nt, Human
uggcucacaccuguaaucccagcacuuaggga
